United States Patent 7,888,497 (BIOINFORMATICALLY DETECTABLE GROUP OF NOVEL REGULATORY OLIGONUCLEOTIDES AND USES THEREOF) - sequence listing, part 51

SEQ ID NO: 2138345 - DNA, 22 bp, Homo sapiens
cacagatatgcacacacatgga

SEQ ID NO: 2138346 - DNA, 18 bp, Homo sapiens
cacagatatttccatttc

SEQ ID NO: 2138347 - DNA, 20 bp, Homo sapiens
cacagatgcacacacagatg

SEQ ID NO: 2138348 - DNA, 18 bp, Homo sapiens
cacagatggtcacacaga

SEQ ID NO: 2138349 - DNA, 16 bp, Homo sapiens
cacagcaccagaatgt

SEQ ID NO: 2138350 - DNA, 15 bp, Homo sapiens
cacagcagaatgaag

SEQ ID NO: 2138351 - DNA, 21 bp, Homo sapiens
cacagcagaatgaagacctaa

SEQ ID NO: 2138352 - DNA, 21 bp, Homo sapiens
cacagcagttgaaaagactcc

SEQ ID NO: 2138353 - DNA, 17 bp, Homo sapiens
cacagccagactggcac

SEQ ID NO: 2138354 - DNA, 13 bp, Homo sapiens
cacagcccaagag

SEQ ID NO: 2138355 - DNA, 16 bp, Homo sapiens
cacagcccacacatga

SEQ ID NO: 2138356 - DNA, 14 bp, Homo sapiens
cacagccccacagc

SEQ ID NO: 2138357 - DNA, 20 bp, Homo sapiens
cacagccccacagcacccag

SEQ ID NO: 2138358 - DNA, 21 bp, Homo sapiens
cacagccccacagcacccagg

SEQ ID NO: 2138359 - DNA, 12 bp, Homo sapiens
cacagccctggg

SEQ ID NO: 2138360 - DNA, 16 bp, Homo sapiens
cacagccctgggaggg

SEQ ID NO: 2138361 - DNA, 21 bp, Homo sapiens
cacagccgcagcctccctctg

SEQ ID NO: 2138362 - DNA, 15 bp, Homo sapiens
cacagcctctccctt

SEQ ID NO: 2138363 - DNA, 14 bp, Homo sapiens
cacagcctctgcct

SEQ ID NO: 2138364 - DNA, 16 bp, Homo sapiens
cacagcggaggagacc

SEQ ID NO: 2138365 - DNA, 19 bp, Homo sapiens
cacagcggaggagaccagc

SEQ ID NO: 2138366 - DNA, 21 bp, Homo sapiens
cacagcggaggagaccagctc

SEQ ID NO: 2138367 - DNA, 16 bp, Homo sapiens
cacagcggcccctgca

SEQ ID NO: 2138368 - DNA, 20 bp, Homo sapiens
cacagcggggccccagggct

SEQ ID NO: 2138369 - DNA, 14 bp, Homo sapiens
cacagctcccaccc

SEQ ID NO: 2138370 - DNA, 12 bp, Homo sapiens
cacagctcctcg

SEQ ID NO: 2138371 - DNA, 20 bp, Homo sapiens
cacagctcctcgctgcgtct

SEQ ID NO: 2138372 - DNA, 15 bp, Homo sapiens
cacagctctgtcctg

SEQ ID NO: 2138373 - DNA, 23 bp, Homo sapiens
cacagctctgtcctgggagtgag

SEQ ID NO: 2138374 - DNA, 15 bp, Homo sapiens
cacagctcttctcca

SEQ ID NO: 2138375 - DNA, 15 bp, Homo sapiens
cacagctgcagctgg

SEQ ID NO: 2138376 - DNA, 17 bp, Homo sapiens
cacagctgcagctgggc

SEQ ID NO: 2138377 - DNA, 19 bp, Homo sapiens
cacagctgcagctgggccc

SEQ ID NO: 2138378 - DNA, 15 bp, Homo sapiens
cacagctgctgaaga

SEQ ID NO: 2138379 - DNA, 20 bp, Homo sapiens
cacagctgctgaagaggcaa

SEQ ID NO: 2138380 - DNA, 13 bp, Homo sapiens
cacagctgcttgt

SEQ ID NO: 2138381 - DNA, 12 bp, Homo sapiens
cacaggaaaagg

SEQ ID NO: 2138382 - DNA, 23 bp, Homo sapiens
cacaggaaaccaacacccaaagc

SEQ ID NO: 2138383 - DNA, 15 bp, Homo sapiens
cacaggagacactgt

SEQ ID NO: 2138384 - DNA, 21 bp, Homo sapiens
cacaggagacactgtgctata

SEQ ID NO: 2138385 - DNA, 15 bp, Homo sapiens
cacaggagcagacag

SEQ ID NO: 2138386 - DNA, 18 bp, Homo sapiens
cacaggagcagacagaga

SEQ ID NO: 2138387 - DNA, 23 bp, Homo sapiens
cacaggagcagacagagaaatgt

SEQ ID NO: 2138388 - DNA, 15 bp, Homo sapiens
cacaggagcatttgg

SEQ ID NO: 2138389 - DNA, 16 bp, Homo sapiens
cacaggagctacctgt

SEQ ID NO: 2138390 - DNA, 20 bp, Homo sapiens
cacaggagggagagaactta

SEQ ID NO: 2138391 - DNA, 23 bp, Homo sapiens
cacaggagggggtcgtggagagc

SEQ ID NO: 2138392 - DNA, 20 bp, Homo sapiens
cacaggatcctattctcacc

SEQ ID NO: 2138393 - DNA, 17 bp, Homo sapiens
cacaggcaactgaggca

SEQ ID NO: 2138394 - DNA, 16 bp, Homo sapiens
cacaggcagctggatg

SEQ ID NO: 2138395 - DNA, 21 bp, Homo sapiens
cacaggcagctggatgagact

SEQ ID NO: 2138396 - DNA, 10 bp, Homo sapiens
cacaggcagg

SEQ ID NO: 2138397 - DNA, 20 bp, Homo sapiens
cacaggcaggaagagagaga

SEQ ID NO: 2138398 - DNA, 15 bp, Homo sapiens
cacaggcaggtccag

SEQ ID NO: 2138399 - DNA, 19 bp, Homo sapiens
cacaggcaggtccagggtt

SEQ ID NO: 2138400 - DNA, 18 bp, Homo sapiens
cacaggcatttcctgggt

SEQ ID NO: 2138401 - DNA, 23 bp, Homo sapiens
cacaggcatttcctgggtggcta

SEQ ID NO: 2138402 - DNA, 12 bp, Homo sapiens
cacaggccagcc

SEQ ID NO: 2138403 - DNA, 15 bp, Homo sapiens
cacaggccagcccca

SEQ ID NO: 2138404 - DNA, 23 bp, Homo sapiens
cacaggccagccccatcttggtc

SEQ ID NO: 2138405 - DNA, 19 bp, Homo sapiens
cacaggccccccgcagcac

SEQ ID NO: 2138406 - DNA, 16 bp, Homo sapiens
cacaggcccggctcca

SEQ ID NO: 2138407 - DNA, 20 bp, Homo sapiens
cacaggcccggctccaggct

SEQ ID NO: 2138408 - DNA, 15 bp, Homo sapiens
cacaggcccttcctc

SEQ ID NO: 2138409 - DNA, 16 bp, Homo sapiens
cacaggcccttcctct

SEQ ID NO: 2138410 - DNA, 19 bp, Homo sapiens
cacaggcccttcctctcca

SEQ ID NO: 2138411 - DNA, 21 bp, Homo sapiens
cacaggcccttcctctccact

SEQ ID NO: 2138412 - DNA, 23 bp, Homo sapiens
cacaggcctgtgtagctgtgacc

SEQ ID NO: 2138413 - DNA, 17 bp, Homo sapiens
cacagggcagagccggg

SEQ ID NO: 2138414 - DNA, 14 bp, Homo sapiens
cacagggccccaga

SEQ ID NO: 2138415 - DNA, 16 bp, Homo sapiens
cacagggctctttgat

SEQ ID NO: 2138416 - DNA, 22 bp, Homo sapiens
cacaggggcaaagaactgcccc

SEQ ID NO: 2138417 - DNA, 23 bp, Homo sapiens
cacaggggcaaagaactgcccca

SEQ ID NO: 2138418 - DNA, 17 bp, Homo sapiens
cacaggggcaggcctgg

SEQ ID NO: 2138419 - DNA, 20 bp, Homo sapiens
cacaggggcaggcctgggac

SEQ ID NO: 2138420 - DNA, 18 bp, Homo sapiens
cacaggggccccagatct

SEQ ID NO: 2138421 - DNA, 23 bp, Homo sapiens
cacaggggccccagatctgcctg

SEQ ID NO: 2138422 - DNA, 15 bp, Homo sapiens
cacaggggcggggca

SEQ ID NO: 2138423 - DNA, 16 bp, Homo sapiens
cacagggttttgtatt

SEQ ID NO: 2138424 - DNA, 19 bp, Homo sapiens
cacaggtacagcaacagga

SEQ ID NO: 2138425 - DNA, 14 bp, Homo sapiens
cacaggtgtaaata

SEQ ID NO: 2138426 - DNA, 19 bp, Homo sapiens
cacaggtgtggtgtaattt

SEQ ID NO: 2138427 - DNA, 15 bp, Homo sapiens
cacaggtgtttatac

SEQ ID NO: 2138428 - DNA, 14 bp, Homo sapiens
cacaggttccatag

SEQ ID NO: 2138429 - DNA, 18 bp, Homo sapiens
cacagtattacttctgct

SEQ ID NO: 2138430 - DNA, 19 bp, Homo sapiens
cacagtattacttctgcta

SEQ ID NO: 2138431 - DNA, 21 bp, Homo sapiens
cacagtattacttctgctaca

SEQ ID NO: 2138432 - DNA, 14 bp, Homo sapiens
cacagtcctcacag

SEQ ID NO: 2138433 - DNA, 16 bp, Homo sapiens
cacagtctagattaga

SEQ ID NO: 2138434 - DNA, 18 bp, Homo sapiens
cacagtctcagtccagat

SEQ ID NO: 2138435 - DNA, 19 bp, Homo sapiens
cacagtctcagtccagatg

SEQ ID NO: 2138436 - DNA, 13 bp, Homo sapiens
cacagtctctggg

SEQ ID NO: 2138437 - DNA, 16 bp, Homo sapiens
cacagtgacccttccc

SEQ ID NO: 2138438 - DNA, 17 bp, Homo sapiens
cacagtgacccttccca

SEQ ID NO: 2138439 - DNA, 21 bp, Homo sapiens
cacagtgactttacaggaggt

SEQ ID NO: 2138440 - DNA, 15 bp, Homo sapiens
cacagtgagctgatg

SEQ ID NO: 2138441 - DNA, 19 bp, Homo sapiens
cacagtgagtcgaggacag

SEQ ID NO: 2138442 - DNA, 18 bp, Homo sapiens
cacagtgcatctcagccc

SEQ ID NO: 2138443 - DNA, 13 bp, Homo sapiens
cacagtgctgctt

SEQ ID NO: 2138444 - DNA, 17 bp, Homo sapiens
cacagtggcgagaggag

SEQ ID NO: 2138445 - DNA, 18 bp, Homo sapiens
cacagtggcgagaggaga

SEQ ID NO: 2138446 - DNA, 14 bp, Homo sapiens
cacagtgggaactc

SEQ ID NO: 2138447 - DNA, 13 bp, Homo sapiens
cacagtgggtggc

SEQ ID NO: 2138448 - DNA, 18 bp, Homo sapiens
cacagtgggtggcacctc

SEQ ID NO: 2138449 - DNA, 16 bp, Homo sapiens
caccggcgctgcaggt

SEQ ID NO: 2138450 - DNA, 19 bp, Homo sapiens
caccgggagcctccccctc

SEQ ID NO: 2138451 - DNA, 15 bp, Homo sapiens
caccgggcactcaga

SEQ ID NO: 2138452 - DNA, 22 bp, Homo sapiens
caccgggcactcagaagacact

SEQ ID NO: 2138453 - DNA, 21 bp, Homo sapiens
caccgggccactccttcctgc

SEQ ID NO: 2138454 - DNA, 23 bp, Homo sapiens
caccgggccactccttcctgccc

SEQ ID NO: 2138455 - DNA, 15 bp, Homo sapiens
caccgggccctcctt

SEQ ID NO: 2138456 - DNA, 13 bp, Homo sapiens
caccgggcctgga

SEQ ID NO: 2138457 - DNA, 15 bp, Homo sapiens
caccgtcatggctta

SEQ ID NO: 2138458 - DNA, 23 bp, Homo sapiens
caccgtggaccttcctgccacca

SEQ ID NO: 2138459 - DNA, 21 bp, Homo sapiens
caccgttggggattggggaag

SEQ ID NO: 2138460 - DNA, 12 bp, Homo sapiens
cacctaaagaaa

SEQ ID NO: 2138461 - DNA, 17 bp, Homo sapiens
cacctaaagaaaaacaa

SEQ ID NO: 2138462 - DNA, 19 bp, Homo sapiens
cacctaatcaggctgaggt

SEQ ID NO: 2138463 - DNA, 16 bp, Homo sapiens
cacctaccatgctgct

SEQ ID NO: 2138464 - DNA, 19 bp, Homo sapiens
cacctaccccccaaaaaaa

SEQ ID NO: 2138465 - DNA, 17 bp, Homo sapiens
cacctactcacacaggc

SEQ ID NO: 2138466 - DNA, 18 bp, Homo sapiens
cacctactcacacaggca

SEQ ID NO: 2138467 - DNA, 12 bp, Homo sapiens
cacctactgagt

SEQ ID NO: 2138468 - DNA, 15 bp, Homo sapiens
cacctagtccagtga

SEQ ID NO: 2138469 - DNA, 17 bp, Homo sapiens
cacctagtgcttccact

SEQ ID NO: 2138470 - DNA, 19 bp, Homo sapiens
cacctatgtcatttcattt

SEQ ID NO: 2138471 - DNA, 20 bp, Homo sapiens
cacctatgtcatttcatttc

SEQ ID NO: 2138472 - DNA, 23 bp, Homo sapiens
cacctcaaaataccatgccattt

SEQ ID NO: 2138473 - DNA, 15 bp, Homo sapiens
cacctcaaatacata

SEQ ID NO: 2138474 - DNA, 19 bp, Homo sapiens
cacctcacgctctggacat

SEQ ID NO: 2138475 - DNA, 14 bp, Homo sapiens
cacctcactcctgt

SEQ ID NO: 2138476 - DNA, 15 bp, Homo sapiens
cacctcactgaggaa

SEQ ID NO: 2138477 - DNA, 12 bp, Homo sapiens
cacctcagcctt

SEQ ID NO: 2138478 - DNA, 15 bp, Homo sapiens
cacctcaggccaggt

SEQ ID NO: 2138479 - DNA, 23 bp, Homo sapiens
cacctccacccccgccacggcca

SEQ ID NO: 2138480 - DNA, 16 bp, Homo sapiens
cacctcccaccccact

SEQ ID NO: 2138481 - DNA, 18 bp, Homo sapiens
cacctcccaccccactcc

SEQ ID NO: 2138482 - DNA, 21 bp, Homo sapiens
cacctcccaccccactccagc

SEQ ID NO: 2138483 - DNA, 12 bp, Homo sapiens
cacctcccaggg

SEQ ID NO: 2138484 - DNA, 15 bp, Homo sapiens
cacctcccaggggct

SEQ ID NO: 2138485 - DNA, 23 bp, Homo sapiens
cacctcccaggggctccacctgt

SEQ ID NO: 2138486 - DNA, 22 bp, Homo sapiens
cacctcctagaggtgggcagct

SEQ ID NO: 2138487 - DNA, 22 bp, Homo sapiens
cacctcctagcaagacctgttg

SEQ ID NO: 2138488 - DNA, 17 bp, Homo sapiens
cacctcctccactcact

SEQ ID NO: 2138489 - DNA, 20 bp, Homo sapiens
cacctcctccactcactcca

SEQ ID NO: 2138490 - DNA, 14 bp, Homo sapiens
cacctcctgagaag

SEQ ID NO: 2138491 - DNA, 12 bp, Homo sapiens
cacctcctgagt

SEQ ID NO: 2138492 - DNA, 20 bp, Homo sapiens
cacctcctgagttcaagcga

SEQ ID NO: 2138493 - DNA, 18 bp, Homo sapiens
cacctccttgctttgctg

SEQ ID NO: 2138494 - DNA, 14 bp, Homo sapiens
cacctctgcctcaa

SEQ ID NO: 2138495 - DNA, 18 bp, Homo sapiens
cacctctggatccctgga

SEQ ID NO: 2138496 - DNA, 18 bp, Homo sapiens
cacctctggctttgtctc

SEQ ID NO: 2138497 - DNA, 14 bp, Homo sapiens
cacctcttcacccc

SEQ ID NO: 2138498 - DNA, 17 bp, Homo sapiens
cacctcttctcttcctg

SEQ ID NO: 2138499 - DNA, 16 bp, Homo sapiens
cacctcttctgccagc

SEQ ID NO: 2138500 - DNA, 13 bp, Homo sapiens
cacctcttgggca

SEQ ID NO: 2138501 - DNA, 22 bp, Homo sapiens
cacctgaaccccatgggcttgg

SEQ ID NO: 2138502 - DNA, 23 bp, Homo sapiens
cacctgaaccccatgggcttgga

SEQ ID NO: 2138503 - DNA, 15 bp, Homo sapiens
cacctgaagactcat

SEQ ID NO: 2138504 - DNA, 17 bp, Homo sapiens
cacctgacaatggcagc

SEQ ID NO: 2138505 - DNA, 17 bp, Homo sapiens
cacctgaggctgaggca

SEQ ID NO: 2138506 - DNA, 13 bp, Homo sapiens
cacctgcaagccc

SEQ ID NO: 2138507 - DNA, 14 bp, Homo sapiens
cacctgcaagcccc

SEQ ID NO: 2138508 - DNA, 20 bp, Homo sapiens
cacctgcaagccccagggcc

SEQ ID NO: 2138509 - DNA, 14 bp, Homo sapiens
cacctgcaagtgcc

SEQ ID NO: 2138510 - DNA, 11 bp, Homo sapiens
cacctgcacct

SEQ ID NO: 2138511 - DNA, 13 bp, Homo sapiens
cacctgcacctcc

SEQ ID NO: 2138512 - DNA, 19 bp, Homo sapiens
cacctgcacctccccccac

SEQ ID NO: 2138513 - DNA, 15 bp, Homo sapiens
cacctgcagattctg

SEQ ID NO: 2138514 - DNA, 19 bp, Homo sapiens
cacctgccaattctacatg

SEQ ID NO: 2138515 - DNA, 16 bp, Homo sapiens
cacctgccagccatca

SEQ ID NO: 2138516 - DNA, 16 bp, Homo sapiens
cacctgccagcctggc

SEQ ID NO: 2138517 - DNA, 20 bp, Homo sapiens
cacctgccagcctggcttct

SEQ ID NO: 2138518 - DNA, 13 bp, Homo sapiens
cacctgcccaacc

SEQ ID NO: 2138519 - DNA, 18 bp, Homo sapiens
cacctgcccaacctgctc

SEQ ID NO: 2138520 - DNA, 19 bp, Homo sapiens
cacctgccccagcgcggct

SEQ ID NO: 2138521 - DNA, 14 bp, Homo sapiens
cacctgccccctgg

SEQ ID NO: 2138522 - DNA, 21 bp, Homo sapiens
cacctgccccctggtggacag

SEQ ID NO: 2138523 - DNA, 18 bp, Homo sapiens
cacctgccctgccctgcc

SEQ ID NO: 2138524 - DNA, 19 bp, Homo sapiens
cacctgccctgccctgcca

SEQ ID NO: 2138525 - DNA, 23 bp, Homo sapiens
cacctgccctgccctgccacctg

SEQ ID NO: 2138526 - DNA, 20 bp, Homo sapiens
cacctgcctatccatcctgc

SEQ ID NO: 2138527 - DNA, 19 bp, Homo sapiens
cacctgcgagaggtccctg

SEQ ID NO: 2138528 - DNA, 22 bp, Homo sapiens
cacctgcgagaggtccctgctt

SEQ ID NO: 2138529 - DNA, 14 bp, Homo sapiens
cacctgctcttcta

SEQ ID NO: 2138530 - DNA, 18 bp, Homo sapiens
cacctgcttctgaactca

SEQ ID NO: 2138531 - DNA, 22 bp, Homo sapiens
cacctggaagcatttgtttcta

SEQ ID NO: 2138532 - DNA, 12 bp, Homo sapiens
cacctggagggc

SEQ ID NO: 2138533 - DNA, 15 bp, Homo sapiens
cacctggccccatgt

SEQ ID NO: 2138534 - DNA, 19 bp, Homo sapiens
cacctggccgcctccagga

SEQ ID NO: 2138535 - DNA, 21 bp, Homo sapiens
cacctggccgcctccaggagc

SEQ ID NO: 2138536 - DNA, 21 bp, Homo sapiens
cacctgggaaaacagaggaat

SEQ ID NO: 2138537 - DNA, 18 bp, Homo sapiens
cacctgggccctggggcc

SEQ ID NO: 2138538 - DNA, 12 bp, Homo sapiens
cacctgggcctt

SEQ ID NO: 2138539 - DNA, 19 bp, Homo sapiens
cacctgggcctttcctgtg

SEQ ID NO: 2138540 - DNA, 22 bp, Homo sapiens
cacctggttgacccaaaaatgt

SEQ ID NO: 2138541 - DNA, 21 bp, Homo sapiens
cacctgtaatcccagctactt

SEQ ID NO: 2138542 - DNA, 15 bp, Homo sapiens
cacctgtactcagga

SEQ ID NO: 2138543 - DNA, 22 bp, Homo sapiens
cacctgtactcaggaggctgag

SEQ ID NO: 2138544 - DNA, 12 bp, Homo sapiens
cacctgtctgtc

SEQ ID NO: 2138545 - DNA, 11 bp, Homo sapiens
cacctgtgcac

SEQ ID NO: 2138546 - DNA, 17 bp, Homo sapiens
cacctgtgcaccccatg

SEQ ID NO: 2138547 - DNA, 21 bp, Homo sapiens
cacctgttgcacctcaggcag

SEQ ID NO: 2138548 - DNA, 13 bp, Homo sapiens
caccttacattcc

SEQ ID NO: 2138549 - DNA, 18 bp, Homo sapiens
caccttaccaactttctg

SEQ ID NO: 2138550 - DNA, 19 bp, Homo sapiens
caccttaccaactttctgt

SEQ ID NO: 2138551 - DNA, 15 bp, Homo sapiens
caccttatatttacg

SEQ ID NO: 2138552 - DNA, 13 bp, Homo sapiens
caccttatgtatt

SEQ ID NO: 2138553 - DNA, 19 bp, Homo sapiens
caccttcaattcctgggcc

SEQ ID NO: 2138554 - DNA, 12 bp, Homo sapiens
caccttcccagc

SEQ ID NO: 2138555 - DNA, 13 bp, Homo sapiens
caccttcccagct

SEQ ID NO: 2138556 - DNA, 19 bp, Homo sapiens
caccttcccagctctccct

SEQ ID NO: 2138557 - DNA, 11 bp, Homo sapiens
caccttcccca

SEQ ID NO: 2138558 - DNA, 14 bp, Homo sapiens
caccttccccagac

SEQ ID NO: 2138559 - DNA, 15 bp, Homo sapiens
caccttcttggcttc

SEQ ID NO: 2138560 - DNA, 13 bp, Homo sapiens
caccttgacaggg

SEQ ID NO: 2138561 - DNA, 18 bp, Homo sapiens
caccttgacagggcacac

SEQ ID NO: 2138562 - DNA, 17 bp, Homo sapiens
caccttgccgagagagg

SEQ ID NO: 2138563 - DNA, 16 bp, Homo sapiens
caccttgctcttcttt

SEQ ID NO: 2138564 - DNA, 19 bp, Homo sapiens
cagaccctgcctgagccca

SEQ ID NO: 2138565 - DNA, 14 bp, Homo sapiens
cagaccgggggcca

SEQ ID NO: 2138566 - DNA, 22 bp, Homo sapiens
cagaccgggggccagacacaga

SEQ ID NO: 2138567 - DNA, 22 bp, Homo sapiens
cagaccggggttcaagccatgg

SEQ ID NO: 2138568 - DNA, 19 bp, Homo sapiens
cagacctagacctgggcca

SEQ ID NO: 2138569 - DNA, 22 bp, Homo sapiens
cagacctaggatttcatgattt

SEQ ID NO: 2138570 - DNA, 13 bp, Homo sapiens
cagaccttttatc

SEQ ID NO: 2138571 - DNA, 15 bp, Homo sapiens
cagactacagccaga

SEQ ID NO: 2138572 - DNA, 14 bp, Homo sapiens
cagactcaaactca

SEQ ID NO: 2138573 - DNA, 17 bp, Homo sapiens
cagactcaaactcaagg

SEQ ID NO: 2138574 - DNA, 16 bp, Homo sapiens
cagactcagctccaga

SEQ ID NO: 2138575 - DNA, 15 bp, Homo sapiens
cagactcagctctga

SEQ ID NO: 2138576 - DNA, 18 bp, Homo sapiens
cagactcagtttgtcaga

SEQ ID NO: 2138577 - DNA, 17 bp, Homo sapiens
cagactccctcccctgc

SEQ ID NO: 2138578 - DNA, 14 bp, Homo sapiens
cagactcctcagat

SEQ ID NO: 2138579 - DNA, 21 bp, Homo sapiens
cagactcctgtgcaactttcc

SEQ ID NO: 2138580 - DNA, 18 bp, Homo sapiens
cagactccttcaacaatt

SEQ ID NO: 2138581 - DNA, 20 bp, Homo sapiens
cagactctacagaggccatg

SEQ ID NO: 2138582 - DNA, 22 bp, Homo sapiens
cagactgatggcgattccctct

SEQ ID NO: 2138583 - DNA, 18 bp, Homo sapiens
cagactgcatgtagttgg

SEQ ID NO: 2138584 - DNA, 20 bp, Homo sapiens
cagactggaagcacagcttc

SEQ ID NO: 2138585 - DNA, 21 bp, Homo sapiens
cagactggaagcacagcttca

SEQ ID NO: 2138586 - DNA, 18 bp, Homo sapiens
cagactggcacagttttc

SEQ ID NO: 2138587 - DNA, 23 bp, Homo sapiens
cagactggcacagttttctgaga

SEQ ID NO: 2138588 - DNA, 22 bp, Homo sapiens
cagactgtggctgcagagacct

SEQ ID NO: 2138589 - DNA, 15 bp, Homo sapiens
cagacttcacactgc

SEQ ID NO: 2138590 - DNA, 21 bp, Homo sapiens
cagacttccctgaatgtattg

SEQ ID NO: 2138591 - DNA, 17 bp, Homo sapiens
cagacttctctttctta

SEQ ID NO: 2138592 - DNA, 15 bp, Homo sapiens
cagagaaagaagaga

SEQ ID NO: 2138593 - DNA, 20 bp, Homo sapiens
cagagaaagaagagacagga

SEQ ID NO: 2138594 - DNA, 21 bp, Homo sapiens
cagagaaagaagagacaggag

SEQ ID NO: 2138595 - DNA, 23 bp, Homo sapiens
cagagaaagaagagacaggaggg

SEQ ID NO: 2138596 - DNA, 19 bp, Homo sapiens
cagagaaagtacttctcca

SEQ ID NO: 2138597 - DNA, 19 bp, Homo sapiens
cagagaagaaagaacggaa

SEQ ID NO: 2138598 - DNA, 23 bp, Homo sapiens
cagagaaggatgtccgttccagg

SEQ ID NO: 2138599 - DNA, 14 bp, Homo sapiens
cagagaaggcctct

SEQ ID NO: 2138600 - DNA, 18 bp, Homo sapiens
cagagaaggcctcttgtg

SEQ ID NO: 2138601 - DNA, 19 bp, Homo sapiens
cagagaaggcctcttgtgc

SEQ ID NO: 2138602 - DNA, 18 bp, Homo sapiens
cagagaatctgaagctat

SEQ ID NO: 2138603 - DNA, 20 bp, Homo sapiens
cagagaatgaaagggcccag

SEQ ID NO: 2138604 - DNA, 21 bp, Homo sapiens
cagagaatgaaagggcccaga

SEQ ID NO: 2138605 - DNA, 15 bp, Homo sapiens
cagagaatttctacc

SEQ ID NO: 2138606 - DNA, 18 bp, Homo sapiens
cagagacaataaaacatt

SEQ ID NO: 2138607 - DNA, 15 bp, Homo sapiens
cagagacacctgcac

SEQ ID NO: 2138608 - DNA, 18 bp, Homo sapiens
cagagacacctgcacctc

SEQ ID NO: 2138609 - DNA, 20 bp, Homo sapiens
cagagacacctgcacctccc

SEQ ID NO: 2138610 - DNA, 13 bp, Homo sapiens
cagagacagaaac

SEQ ID NO: 2138611 - DNA, 16 bp, Homo sapiens
cagagacagagagaga

SEQ ID NO: 2138612 - DNA, 22 bp, Homo sapiens
cagagacaggaaaatcctctgg

SEQ ID NO: 2138613 - DNA, 15 bp, Homo sapiens
cagagaccccaggat

SEQ ID NO: 2138614 - DNA, 16 bp, Homo sapiens
cagagaccccaggatc

SEQ ID NO: 2138615 - DNA, 15 bp, Homo sapiens
cagagaccccttcct

SEQ ID NO: 2138616 - DNA, 17 bp, Homo sapiens
cagagacctgaggcaga

SEQ ID NO: 2138617 - DNA, 14 bp, Homo sapiens
cagagaccttgcga

SEQ ID NO: 2138618 - DNA, 19 bp, Homo sapiens
cagagaccttttctctccc

SEQ ID NO: 2138619 - DNA, 22 bp, Homo sapiens
cagagaccttttctctcccata

SEQ ID NO: 2138620 - DNA, 16 bp, Homo sapiens
cagagacgcaagggag

SEQ ID NO: 2138621 - DNA, 21 bp, Homo sapiens
cagagacgcaagggagaagaa

SEQ ID NO: 2138622 - DNA, 22 bp, Homo sapiens
cagagactcagggccccagcac

SEQ ID NO: 2138623 - DNA, 23 bp, Homo sapiens
cagagactcagggccccagcact

SEQ ID NO: 2138624 - DNA, 16 bp, Homo sapiens
cagagactctggaagc

SEQ ID NO: 2138625 - DNA, 19 bp, Homo sapiens
cagagacttggggaccaga

SEQ ID NO: 2138626 - DNA, 13 bp, Homo sapiens
cagagagagacag

SEQ ID NO: 2138627 - DNA, 17 bp, Homo sapiens
cagagagagacagagac

SEQ ID NO: 2138628 - DNA, 18 bp, Homo sapiens
cagagagaggatgcagag

SEQ ID NO: 2138629 - DNA, 13 bp, Homo sapiens
cagagaggaatca

SEQ ID NO: 2138630 - DNA, 14 bp, Homo sapiens
cagagaggagcacc

SEQ ID NO: 2138631 - DNA, 20 bp, Homo sapiens
cagagaggagcacctgaacc

SEQ ID NO: 2138632 - DNA, 12 bp, Homo sapiens
cagagagggcag

SEQ ID NO: 2138633 - DNA, 15 bp, Homo sapiens
cagagagggcccagc

SEQ ID NO: 2138634 - DNA, 16 bp, Homo sapiens
cagagagggcccagct

SEQ ID NO: 2138635 - DNA, 20 bp, Homo sapiens
cagagagggcccagctgtag

SEQ ID NO: 2138636 - DNA, 17 bp, Homo sapiens
cagagaggtctcaggtt

SEQ ID NO: 2138637 - DNA, 21 bp, Homo sapiens
cagagaggtggagaactggga

SEQ ID NO: 2138638 - DNA, 23 bp, Homo sapiens
cagagaggtggagaactgggatt

SEQ ID NO: 2138639 - DNA, 17 bp, Homo sapiens
cagagagtcctctggat

SEQ ID NO: 2138640 - DNA, 18 bp, Homo sapiens
cagagagtcctctggatg

SEQ ID NO: 2138641 - DNA, 16 bp, Homo sapiens
cagagatctgggaggt

SEQ ID NO: 2138642 - DNA, 19 bp, Homo sapiens
cagagatgcatgcgcaggc

SEQ ID NO: 2138643 - DNA, 14 bp, Homo sapiens
cagagatgcctcca

SEQ ID NO: 2138644 - DNA, 18 bp, Homo sapiens
cagagatgcctccaccgc

SEQ ID NO: 2138645 - DNA, 21 bp, Homo sapiens
cagagatgcctccaccgctgc

SEQ ID NO: 2138646 - DNA, 11 bp, Homo sapiens
cagagatgtac

SEQ ID NO: 2138647 - DNA, 14 bp, Homo sapiens
cagagatgtaccat

SEQ ID NO: 2138648 - DNA, 18 bp, Homo sapiens
cagagatttcctccatgg

SEQ ID NO: 2138649 - DNA, 14 bp, Homo sapiens
cagagcaaaataat

SEQ ID NO: 2138650 - DNA, 21 bp, Homo sapiens
cagagcactaggttcaattcc

SEQ ID NO: 2138651 - DNA, 22 bp, Homo sapiens
cagagcactaggttcaattccc

SEQ ID NO: 2138652 - DNA, 15 bp, Homo sapiens
cagagcactgctcca

SEQ ID NO: 2138653 - DNA, 15 bp, Homo sapiens
cagagcagagagcag

SEQ ID NO: 2138654 - DNA, 21 bp, Homo sapiens
cagagcagagcaaatgaggga

SEQ ID NO: 2138655 - DNA, 21 bp, Homo sapiens
cagagcaggctcagactctgg

SEQ ID NO: 2138656 - DNA, 23 bp, Homo sapiens
cagagcaggggtccttggtgtga

SEQ ID NO: 2138657 - DNA, 19 bp, Homo sapiens
cagagcattacgtgagcca

SEQ ID NO: 2138658 - DNA, 20 bp, Homo sapiens
cagagcattacgtgagccag

SEQ ID NO: 2138659 - DNA, 21 bp, Homo sapiens
cagagcattacgtgagccagg

SEQ ID NO: 2138660 - DNA, 23 bp, Homo sapiens
cagagcattacgtgagccaggta

SEQ ID NO: 2138661 - DNA, 17 bp, Homo sapiens
cagagccaccagggcac

SEQ ID NO: 2138662 - DNA, 23 bp, Homo sapiens
cagagccagcctgggactcccag

SEQ ID NO: 2138663 - DNA, 17 bp, Homo sapiens
cagagccagtgaaggag

SEQ ID NO: 2138664 - DNA, 11 bp, Homo sapiens
cagagccatgg

SEQ ID NO: 2138665 - DNA, 13 bp, Homo sapiens
cagagccatgggc

SEQ ID NO: 2138666 - DNA, 16 bp, Homo sapiens
cagagccatgggcctg

SEQ ID NO: 2138667 - DNA, 17 bp, Homo sapiens
cagagccatgggcctgg

SEQ ID NO: 2138668 - DNA, 19 bp, Homo sapiens
cagagccatgggcctgggc

SEQ ID NO: 2138669 - DNA, 21 bp, Homo sapiens
cagagccatgggcctgggcct

SEQ ID NO: 2138670 - DNA, 23 bp, Homo sapiens
cagagccatgggcctgggcctgc

SEQ ID NO: 2138671 - DNA, 16 bp, Homo sapiens
cagagcccaagtgcca

SEQ ID NO: 2138672 - DNA, 19 bp, Homo sapiens
cagagcccaagtgccatcc

SEQ ID NO: 2138673 - DNA, 21 bp, Homo sapiens
cagagcccaagtgccatccca

SEQ ID NO: 2138674 - DNA, 15 bp, Homo sapiens
cagagcccaccttgg

SEQ ID NO: 2138675 - DNA, 15 bp, Homo sapiens
cagagcccatgctca

SEQ ID NO: 2138676 - DNA, 23 bp, Homo sapiens
cagagccccactcccggccaggc

SEQ ID NO: 2138677 - DNA, 15 bp, Homo sapiens
cagagcccccaagcc

SEQ ID NO: 2138678 - DNA, 12 bp, Homo sapiens
cagccatggtga

SEQ ID NO: 2138679 - DNA, 13 bp, Homo sapiens
cagccatgtttgg

SEQ ID NO: 2138680 - DNA, 14 bp, Homo sapiens
cagccatgtttggt

SEQ ID NO: 2138681 - DNA, 16 bp, Homo sapiens
cagccattaccatgga

SEQ ID NO: 2138682 - DNA, 11 bp, Homo sapiens
cagcccacacc

SEQ ID NO: 2138683 - DNA, 12 bp, Homo sapiens
cagcccacaccc

SEQ ID NO: 2138684 - DNA, 14 bp, Homo sapiens
cagcccacacccct

SEQ ID NO: 2138685 - DNA, 15 bp, Homo sapiens
cagcccacagagcct

SEQ ID NO: 2138686 - DNA, 13 bp, Homo sapiens
cagcccagcccag

SEQ ID NO: 2138687 - DNA, 17 bp, Homo sapiens
cagcccagcccagctgg

SEQ ID NO: 2138688 - DNA, 12 bp, Homo sapiens
cagcccagcctc

SEQ ID NO: 2138689 - DNA, 18 bp, Homo sapiens
cagcccattctctctcct

SEQ ID NO: 2138690 - DNA, 23 bp, Homo sapiens
cagcccattctctctcctgtcca

SEQ ID NO: 2138691 - DNA, 14 bp, Homo sapiens
cagccccaaaccag

SEQ ID NO: 2138692 - DNA, 14 bp, Homo sapiens
cagccccacagcac

SEQ ID NO: 2138693 - DNA, 16 bp, Homo sapiens
cagccccacagcaccc

SEQ ID NO: 2138694 - DNA, 17 bp, Homo sapiens
cagccccacagcaccca

SEQ ID NO: 2138695 - DNA, 22 bp, Homo sapiens
cagccccacagcacccaggctc

SEQ ID NO: 2138696 - DNA, 24 bp, Homo sapiens
cagccccacagcacccaggctcca

SEQ ID NO: 2138697 - DNA, 12 bp, Homo sapiens
cagccccagcaa

SEQ ID NO: 2138698 - DNA, 14 bp, Homo sapiens
cagccccagggccc

SEQ ID NO: 2138699 - DNA, 18 bp, Homo sapiens
cagccccagtgcccacag

SEQ ID NO: 2138700 - DNA, 16 bp, Homo sapiens
cagccccattctgcct

SEQ ID NO: 2138701 - DNA, 18 bp, Homo sapiens
cagccccattctgcctgc

SEQ ID NO: 2138702 - DNA, 20 bp, Homo sapiens
cagccccattctgcctgccc

SEQ ID NO: 2138703 - DNA, 22 bp, Homo sapiens
cagccccattctgcctgcccag

SEQ ID NO: 2138704 - DNA, 22 bp, Homo sapiens
cagcccccacctccgccccaga

SEQ ID NO: 2138705 - DNA, 15 bp, Homo sapiens
cagcccccactttcc

SEQ ID NO: 2138706 - DNA, 16 bp, Homo sapiens
cagccccccagcacta

SEQ ID NO: 2138707 - DNA, 14 bp, Homo sapiens
cagccccctggatg

SEQ ID NO: 2138708 - DNA, 15 bp, Homo sapiens
cagccccgactccag

SEQ ID NO: 2138709 - DNA, 16 bp, Homo sapiens
cagccccgactccagc

SEQ ID NO: 2138710 - DNA, 18 bp, Homo sapiens
cagccccgccctctgcgt

SEQ ID NO: 2138711 - DNA, 18 bp, Homo sapiens
cagccccgcgcctccttc

SEQ ID NO: 2138712 - DNA, 20 bp, Homo sapiens
cagccccgctcctcccctct

SEQ ID NO: 2138713 - DNA, 14 bp, Homo sapiens
cagccccgggcctg

SEQ ID NO: 2138714 - DNA, 17 bp, Homo sapiens
cagccccgggcctgcct

SEQ ID NO: 2138715 - DNA, 19 bp, Homo sapiens
cagccccgggcctgcctct

SEQ ID NO: 2138716 - DNA, 12 bp, Homo sapiens
cagcccctcctc

SEQ ID NO: 2138717 - DNA, 20 bp, Homo sapiens
cagcccctcctccccttcct

SEQ ID NO: 2138718 - DNA, 21 bp, Homo sapiens
cagcccctcctccccttcctg

SEQ ID NO: 2138719 - DNA, 22 bp, Homo sapiens
cagcccctcctccccttcctgc

SEQ ID NO: 2138720 - DNA, 17 bp, Homo sapiens
cagccccttgagaaacc

SEQ ID NO: 2138721 - DNA, 14 bp, Homo sapiens
cagcccgaagccca

SEQ ID NO: 2138722 - DNA, 15 bp, Homo sapiens
cagcccgaatgcctg

SEQ ID NO: 2138723 - DNA, 14 bp, Homo sapiens
cagcccgggacagg

SEQ ID NO: 2138724 - DNA, 18 bp, Homo sapiens
cagcccgtgaagcagtgc

SEQ ID NO: 2138725 - DNA, 22 bp, Homo sapiens
cagcccgtgaagcagtgcctcg

SEQ ID NO: 2138726 - DNA, 14 bp, Homo sapiens
cagccctaaacatc

SEQ ID NO: 2138727 - DNA, 16 bp, Homo sapiens
cagccctacatcttca

SEQ ID NO: 2138728 - DNA, 19 bp, Homo sapiens
cagccctacatcttcagct

SEQ ID NO: 2138729 - DNA, 22 bp, Homo sapiens
cagccctacatcttcagctccc

SEQ ID NO: 2138730 - DNA, 14 bp, Homo sapiens
cagccctcaggcca

SEQ ID NO: 2138731 - DNA, 15 bp, Homo sapiens
cagccctcaggccag

SEQ ID NO: 2138732 - DNA, 15 bp, Homo sapiens
cagccctccctgccc

SEQ ID NO: 2138733 - DNA, 18 bp, Homo sapiens
cagccctccctgcccctc

SEQ ID NO: 2138734 - DNA, 22 bp, Homo sapiens
cagccctccctgcccctccctt

SEQ ID NO: 2138735 - DNA, 13 bp, Homo sapiens
cagccctcctcac

SEQ ID NO: 2138736 - DNA, 21 bp, Homo sapiens
cagccctgccaggaggctgcg

SEQ ID NO: 2138737 - DNA, 17 bp, Homo sapiens
cagccctgcctggagga

SEQ ID NO: 2138738 - DNA, 19 bp, Homo sapiens
cagccctgcctggaggacc

SEQ ID NO: 2138739 - DNA, 22 bp, Homo sapiens
cagccctggcccagagctggaa

SEQ ID NO: 2138740 - DNA, 12 bp, Homo sapiens
cagccctggctc

SEQ ID NO: 2138741 - DNA, 22 bp, Homo sapiens
cagccctgggccccaccaccta

SEQ ID NO: 2138742 - DNA, 13 bp, Homo sapiens
cagccctgggggc

SEQ ID NO: 2138743 - DNA, 16 bp, Homo sapiens
cagccctgggggccag

SEQ ID NO: 2138744 - DNA, 21 bp, Homo sapiens
cagcccttagcagggaaacag

SEQ ID NO: 2138745 - DNA, 16 bp, Homo sapiens
cagcccttcctcctga

SEQ ID NO: 2138746 - DNA, 18 bp, Homo sapiens
cagcccttcctcctgaag

SEQ ID NO: 2138747 - DNA, 21 bp, Homo sapiens
cagcccttgcccccatccctc

SEQ ID NO: 2138748 - DNA, 17 bp, Homo sapiens
cagccctttgcaggccc

SEQ ID NO: 2138749 - DNA, 19 bp, Homo sapiens
cagccctttgggaggctga

SEQ ID NO: 2138750 - DNA, 14 bp, Homo sapiens
cagccgagccgggc

SEQ ID NO: 2138751 - DNA, 16 bp, Homo sapiens
cagccgcagcgcagcc

SEQ ID NO: 2138752 - DNA, 12 bp, Homo sapiens
cagccgctcctg

SEQ ID NO: 2138753 - DNA, 16 bp, Homo sapiens
cagccgctcctgtctg

SEQ ID NO: 2138754 - DNA, 18 bp, Homo sapiens
cagccgctcctgtctgcc

SEQ ID NO: 2138755 - DNA, 20 bp, Homo sapiens
cagccgctcctgtctgccag

SEQ ID NO: 2138756 - DNA, 22 bp, Homo sapiens
cagccgctcctgtctgccagcc

SEQ ID NO: 2138757 - DNA, 15 bp, Homo sapiens
cagccggggcgagtg

SEQ ID NO: 2138758 - DNA, 15 bp, Homo sapiens
cagccggtacctggg

SEQ ID NO: 2138759 - DNA, 13 bp, Homo sapiens
cagccggtgcctg

SEQ ID NO: 2138760 - DNA, 19 bp, Homo sapiens
cagccgtcagccaaatgta

SEQ ID NO: 2138761 - DNA, 9 bp, Homo sapiens
cagccgtgc

SEQ ID NO: 2138762 - DNA, 17 bp, Homo sapiens
cagcctaagaagctctg

SEQ ID NO: 2138763 - DNA, 21 bp, Homo sapiens
cagcctacactattctagcag

SEQ ID NO: 2138764 - DNA, 15 bp, Homo sapiens
cagcctaccatgaga

SEQ ID NO: 2138765 - DNA, 22 bp, Homo sapiens
cagcctagccgacctcagcctt

SEQ ID NO: 2138766 - DNA, 17 bp, Homo sapiens
cagcctcaacctcctgg

SEQ ID NO: 2138767 - DNA, 19 bp, Homo sapiens
cagcctcaacctcctgggc

SEQ ID NO: 2138768 - DNA, 21 bp, Homo sapiens
cagcctcaacctcctgggcta

SEQ ID NO: 2138769 - DNA, 14 bp, Homo sapiens
cagcctcacagaag

SEQ ID NO: 2138770 - DNA, 14 bp, Homo sapiens
cagcctcagctcag

SEQ ID NO: 2138771 - DNA, 17 bp, Homo sapiens
cagcctcagctcagcct

SEQ ID NO: 2138772 - DNA, 12 bp, Homo sapiens
cagcctcagtgc

SEQ ID NO: 2138773 - DNA, 14 bp, Homo sapiens
cagcctcagtgcca

SEQ ID NO: 2138774 - DNA, 17 bp, Homo sapiens
cagcctcagtgccactt

SEQ ID NO: 2138775 - DNA, 19 bp, Homo sapiens
cagcctcagtgccacttga

SEQ ID NO: 2138776 - DNA, 20 bp, Homo sapiens
cagcctccaccttgctcttc

SEQ ID NO: 2138777 - DNA, 12 bp, Homo sapiens
cagcctccagag

SEQ ID NO: 2138778 - DNA, 14 bp, Homo sapiens
cagcctccagagcc

SEQ ID NO: 2138779 - DNA, 18 bp, Homo sapiens
cagcctccatgctgcctc

SEQ ID NO: 2138780 - DNA, 14 bp, Homo sapiens
cagcctcccaaccc

SEQ ID NO: 2138781 - DNA, 19 bp, Homo sapiens
cagcctcccaagtagctgg

SEQ ID NO: 2138782 - DNA, 17 bp, Homo sapiens
cagcctccccccgctgg

SEQ ID NO: 2138783 - DNA, 15 bp, Homo sapiens
cagcctccccctgct

SEQ ID NO: 2138784 - DNA, 20 bp, Homo sapiens
cagcctccccctgctgctca

SEQ ID NO: 2138785 - DNA, 19 bp, Homo sapiens
cagcctcccgagtagctgg

SEQ ID NO: 2138786 - DNA, 19 bp, Homo sapiens
cagcctcctaagcagctgg

SEQ ID NO: 2138787 - DNA, 20 bp, Homo sapiens
cagcctcctaagcagctggg

SEQ ID NO: 2138788 - DNA, 21 bp, Homo sapiens
cagcctcctaagcagctggga

SEQ ID NO: 2138789 - DNA, 20 bp, Homo sapiens
cagcctcctcccaccaccct

SEQ ID NO: 2138790 - DNA, 13 bp, Homo sapiens
cagcctctcccgg

SEQ ID NO: 2138791 - DNA, 14 bp, Homo sapiens
cagcctctcccggc

SEQ ID NO: 2138792 - DNA, 15 bp, Homo sapiens
cagcctctcccggct

SEQ ID NO: 2138793 - DNA, 19 bp, Homo sapiens
cagcctctcccggctgcct

SEQ ID NO: 2138794 - DNA, 17 bp, Homo sapiens
caggaggctagcaaagc

SEQ ID NO: 2138795 - DNA, 20 bp, Homo sapiens
caggaggctgaggcaggagg

SEQ ID NO: 2138796 - DNA, 12 bp, Homo sapiens
caggaggctgcg

SEQ ID NO: 2138797 - DNA, 16 bp, Homo sapiens
caggagggacaaagga

SEQ ID NO: 2138798 - DNA, 20 bp, Homo sapiens
caggagggacaaaggagcct

SEQ ID NO: 2138799 - DNA, 12 bp, Homo sapiens
caggagggagag

SEQ ID NO: 2138800 - DNA, 18 bp, Homo sapiens
caggagggagagaactta

SEQ ID NO: 2138801 - DNA, 21 bp, Homo sapiens
caggagggggtcgtggagagc

SEQ ID NO: 2138802 - DNA, 23 bp, Homo sapiens
caggagggggtcgtggagagcta

SEQ ID NO: 2138803 - DNA, 16 bp, Homo sapiens
caggagggtccccagc

SEQ ID NO: 2138804 - DNA, 19 bp, Homo sapiens
caggagggtccccagctgg

SEQ ID NO: 2138805 - DNA, 23 bp, Homo sapiens
caggagggtccccagctggtcca

SEQ ID NO: 2138806 - DNA, 22 bp, Homo sapiens
caggaggtggctatggccaccc

SEQ ID NO: 2138807 - DNA, 18 bp, Homo sapiens
caggaggttggtgactga

SEQ ID NO: 2138808 - DNA, 21 bp, Homo sapiens
caggaggttggtgactgaaac

SEQ ID NO: 2138809 - DNA, 21 bp, Homo sapiens
caggaggttgtggatgctcca

SEQ ID NO: 2138810 - DNA, 23 bp, Homo sapiens
caggaggttgtggatgctccagg

SEQ ID NO: 2138811 - DNA, 14 bp, Homo sapiens
caggagtagctgag

SEQ ID NO: 2138812 - DNA, 16 bp, Homo sapiens
caggagtcccaaggaa

SEQ ID NO: 2138813 - DNA, 17 bp, Homo sapiens
caggagtctgtgctctt

SEQ ID NO: 2138814 - DNA, 19 bp, Homo sapiens
caggagtggccggggaagc

SEQ ID NO: 2138815 - DNA, 18 bp, Homo sapiens
caggagttcaagaccagc

SEQ ID NO: 2138816 - DNA, 20 bp, Homo sapiens
caggagttcaagaccagcct

SEQ ID NO: 2138817 - DNA, 18 bp, Homo sapiens
caggagttcgaggctgca

SEQ ID NO: 2138818 - DNA, 13 bp, Homo sapiens
caggagttctgaa

SEQ ID NO: 2138819 - DNA, 24 bp, Homo sapiens
caggagtttgagacaagccctggc

SEQ ID NO: 2138820 - DNA, 18 bp, Homo sapiens
caggagtttgaggctgca

SEQ ID NO: 2138821 - DNA, 21 bp, Homo sapiens
caggagtttgaggctgcagcg

SEQ ID NO: 2138822 - DNA, 18 bp, Homo sapiens
caggataataaagtgttt

SEQ ID NO: 2138823 - DNA, 14 bp, Homo sapiens
caggatcagtctga

SEQ ID NO: 2138824 - DNA, 14 bp, Homo sapiens
caggatcccagagc

SEQ ID NO: 2138825 - DNA, 17 bp, Homo sapiens
caggatccgctgccacc

SEQ ID NO: 2138826 - DNA, 19 bp, Homo sapiens
caggatcctattctcacca

SEQ ID NO: 2138827 - DNA, 21 bp, Homo sapiens
caggatgaggaacctcaaact

SEQ ID NO: 2138828 - DNA, 23 bp, Homo sapiens
caggatggcccttcccactggag

SEQ ID NO: 2138829 - DNA, 12 bp, Homo sapiens
caggatggcttt

SEQ ID NO: 2138830 - DNA, 23 bp, Homo sapiens
caggatggggtatggattctaaa

SEQ ID NO: 2138831 - DNA, 14 bp, Homo sapiens
caggatgtggcact

SEQ ID NO: 2138832 - DNA, 23 bp, Homo sapiens
caggattcctctctcaggtcact

SEQ ID NO: 2138833 - DNA, 14 bp, Homo sapiens
caggatttcattga

SEQ ID NO: 2138834 - DNA, 18 bp, Homo sapiens
caggatttcattgactga

SEQ ID NO: 2138835 - DNA, 16 bp, Homo sapiens
caggattttaatcttt

SEQ ID NO: 2138836 - DNA, 17 bp, Homo sapiens
caggattttgtgttttt

SEQ ID NO: 2138837 - DNA, 20 bp, Homo sapiens
caggcaaaacacgcaagggc

SEQ ID NO: 2138838 - DNA, 18 bp, Homo sapiens
caggcaaaatccttgctt

SEQ ID NO: 2138839 - DNA, 22 bp, Homo sapiens
caggcaactgaggcagacagca

SEQ ID NO: 2138840 - DNA, 14 bp, Homo sapiens
caggcaagcacctc

SEQ ID NO: 2138841 - DNA, 15 bp, Homo sapiens
caggcaagcacctcc

SEQ ID NO: 2138842 - DNA, 17 bp, Homo sapiens
caggcaagcccctcagc

SEQ ID NO: 2138843 - DNA, 22 bp, Homo sapiens
caggcaagcccctcagcccttg

SEQ ID NO: 2138844 - DNA, 19 bp, Homo sapiens
caggcaatgctggctgttg

SEQ ID NO: 2138845 - DNA, 17 bp, Homo sapiens
caggcacacagcagccc

SEQ ID NO: 2138846 - DNA, 18 bp, Homo sapiens
caggcacacagcagcccc

SEQ ID NO: 2138847 - DNA, 13 bp, Homo sapiens
caggcacaggcag

SEQ ID NO: 2138848 - DNA, 21 bp, Homo sapiens
caggcacaggcaggaagagag

SEQ ID NO: 2138849 - DNA, 14 bp, Homo sapiens
caggcaccaggcag

SEQ ID NO: 2138850 - DNA, 18 bp, Homo sapiens
caggcacccaccatcatg

SEQ ID NO: 2138851 - DNA, 23 bp, Homo sapiens
caggcacccaccatcatgtctgg

SEQ ID NO: 2138852 - DNA, 18 bp, Homo sapiens
caggcaccccctggagag

SEQ ID NO: 2138853 - DNA, 21 bp, Homo sapiens
caggcaccccctggagagaag

SEQ ID NO: 2138854 - DNA, 23 bp, Homo sapiens
caggcacccttctttcctcttcc

SEQ ID NO: 2138855 - DNA, 19 bp, Homo sapiens
caggcacctagcaattcca

SEQ ID NO: 2138856 - DNA, 16 bp, Homo sapiens
caggcacgaacccacc

SEQ ID NO: 2138857 - DNA, 19 bp, Homo sapiens
caggcacgaacccacctgc

SEQ ID NO: 2138858 - DNA, 15 bp, Homo sapiens
caggcacgtcccgga

SEQ ID NO: 2138859 - DNA, 22 bp, Homo sapiens
caggcacgtcccggacctgtgg

SEQ ID NO: 2138860 - DNA, 17 bp, Homo sapiens
caggcactgctgcccag

SEQ ID NO: 2138861 - DNA, 17 bp, Homo sapiens
caggcagacaagagctg

SEQ ID NO: 2138862 - DNA, 20 bp, Homo sapiens
caggcagacaagagctgctg

SEQ ID NO: 2138863 - DNA, 23 bp, Homo sapiens
caggcagacaagagctgctgtcc

SEQ ID NO: 2138864 - DNA, 17 bp, Homo sapiens
caggcagagacaataaa

SEQ ID NO: 2138865 - DNA, 23 bp, Homo sapiens
caggcagagacaataaaacattc

SEQ ID NO: 2138866 - DNA, 15 bp, Homo sapiens
caggcagagcgggga

SEQ ID NO: 2138867 - DNA, 16 bp, Homo sapiens
caggcagagcggggag

SEQ ID NO: 2138868 - DNA, 19 bp, Homo sapiens
caggcagagcggggaggtg

SEQ ID NO: 2138869 - DNA, 13 bp, Homo sapiens
caggcaggaagag

SEQ ID NO: 2138870 - DNA, 16 bp, Homo sapiens
caggcaggaagagaga

SEQ ID NO: 2138871 - DNA, 14 bp, Homo sapiens
caggcagggctctc

SEQ ID NO: 2138872 - DNA, 15 bp, Homo sapiens
caggcagggctctcc

SEQ ID NO: 2138873 - DNA, 18 bp, Homo sapiens
caggcagggctctcctgg

SEQ ID NO: 2138874 - DNA, 20 bp, Homo sapiens
caggcaggggtgggagagcc

SEQ ID NO: 2138875 - DNA, 13 bp, Homo sapiens
caggcaggtcttg

SEQ ID NO: 2138876 - DNA, 14 bp, Homo sapiens
caggcaggtttgcc

SEQ ID NO: 2138877 - DNA, 12 bp, Homo sapiens
caggcatcctcc

SEQ ID NO: 2138878 - DNA, 17 bp, Homo sapiens
caggcatctacacagcc

SEQ ID NO: 2138879 - DNA, 19 bp, Homo sapiens
caggcatgctggcctccca

SEQ ID NO: 2138880 - DNA, 20 bp, Homo sapiens
caggcatgttctctgaggac

SEQ ID NO: 2138881 - DNA, 16 bp, Homo sapiens
caggcatttcctgggt

SEQ ID NO: 2138882 - DNA, 18 bp, Homo sapiens
caggcatttcctgggtgg

SEQ ID NO: 2138883 - DNA, 19 bp, Homo sapiens
caggccaagagcagaggca

SEQ ID NO: 2138884 - DNA, 16 bp, Homo sapiens
caggccaccaggatgg

SEQ ID NO: 2138885 - DNA, 16 bp, Homo sapiens
caggccacgctcaggc

SEQ ID NO: 2138886 - DNA, 20 bp, Homo sapiens
caggccactgtggccagagc

SEQ ID NO: 2138887 - DNA, 22 bp, Homo sapiens
caggccactgtggccagagctg

SEQ ID NO: 2138888 - DNA, 23 bp, Homo sapiens
caggccactgtggccagagctgg

SEQ ID NO: 2138889 - DNA, 13 bp, Homo sapiens
caggccagaggga

SEQ ID NO: 2138890 - DNA, 16 bp, Homo sapiens
caggccaggtgcagtg

SEQ ID NO: 2138891 - DNA, 13 bp, Homo sapiens
caggccagtgcca

SEQ ID NO: 2138892 - DNA, 16 bp, Homo sapiens
caggccagtgccagga

SEQ ID NO: 2138893 - DNA, 19 bp, Homo sapiens
caggccagtgccaggacag

SEQ ID NO: 2138894 - DNA, 23 bp, Homo sapiens
caggccagtgccaggacagctgg

SEQ ID NO: 2138895 - DNA, 15 bp, Homo sapiens
caggcccagagaagc

SEQ ID NO: 2138896 - DNA, 21 bp, Homo sapiens
caggcccatctcaggtgccac

SEQ ID NO: 2138897 - DNA, 24 bp, Homo sapiens
caggcccatctcaggtgccactcc

SEQ ID NO: 2138898 - DNA, 14 bp, Homo sapiens
caggccccatgacc

SEQ ID NO: 2138899 - DNA, 19 bp, Homo sapiens
caggccccatgacctccag

SEQ ID NO: 2138900 - DNA, 20 bp, Homo sapiens
caggccccatgacctccagc

SEQ ID NO: 2138901 - DNA, 18 bp, Homo sapiens
caggcccccacctggctc

SEQ ID NO: 2138902 - DNA, 16 bp, Homo sapiens
caggccccccgcagca

SEQ ID NO: 2138903 - DNA, 21 bp, Homo sapiens
caggccccccgcagcaccctg

SEQ ID NO: 2138904 - DNA, 19 bp, Homo sapiens
caggccccgcttgtccagc

SEQ ID NO: 2138905 - DNA, 14 bp, Homo sapiens
caggcccctgagga

SEQ ID NO: 2138906 - DNA, 18 bp, Homo sapiens
caggcccctgaggactgg

SEQ ID NO: 2138907 - DNA, 19 bp, Homo sapiens
caggcccctgaggactgga

SEQ ID NO: 2138908 - DNA, 15 bp, Homo sapiens
cagtctggcctgggc

SEQ ID NO: 2138909 - DNA, 23 bp, Homo sapiens
cagtcttgaatttctaaaaaaca

SEQ ID NO: 2138910 - DNA, 13 bp, Homo sapiens
cagtcttgtgctt

SEQ ID NO: 2138911 - DNA, 22 bp, Homo sapiens
cagtgaaaaatatgttgagtgt

SEQ ID NO: 2138912 - DNA, 14 bp, Homo sapiens
cagtgaaagcatca

SEQ ID NO: 2138913 - DNA, 21 bp, Homo sapiens
cagtgaaccaaagagactgga

SEQ ID NO: 2138914 - DNA, 23 bp, Homo sapiens
cagtgaacttacacttggagccc

SEQ ID NO: 2138915 - DNA, 20 bp, Homo sapiens
cagtgaattgacccatgttc

SEQ ID NO: 2138916 - DNA, 14 bp, Homo sapiens
cagtgacaagtgga

SEQ ID NO: 2138917 - DNA, 20 bp, Homo sapiens
cagtgacaagtggagggggt

SEQ ID NO: 2138918 - DNA, 18 bp, Homo sapiens
cagtgacagagttcacta

SEQ ID NO: 2138919 - DNA, 13 bp, Homo sapiens
cagtgacctgacc

SEQ ID NO: 2138920 - DNA, 16 bp, Homo sapiens
cagtgacgtgcacctg

SEQ ID NO: 2138921 - DNA, 18 bp, Homo sapiens
cagtgacgtgcacctgta

SEQ ID NO: 2138922 - DNA, 12 bp, Homo sapiens
cagtgactggca

SEQ ID NO: 2138923 - DNA, 17 bp, Homo sapiens
cagtgactggcaggtgc

SEQ ID NO: 2138924 - DNA, 17 bp, Homo sapiens
cagtgactttacaggag

SEQ ID NO: 2138925 - DNA, 19 bp, Homo sapiens
cagtgagaaaaagctcctg

SEQ ID NO: 2138926 - DNA, 20 bp, Homo sapiens
cagtgagaaaaagctcctgt

SEQ ID NO: 2138927 - DNA, 18 bp, Homo sapiens
cagtgagacacagagtgg

SEQ ID NO: 2138928 - DNA, 17 bp, Homo sapiens
cagtgagccgagatggc

SEQ ID NO: 2138929 - DNA, 12 bp, Homo sapiens
cagtgagcctga

SEQ ID NO: 2138930 - DNA, 13 bp, Homo sapiens
cagtgagctgaga

SEQ ID NO: 2138931 - DNA, 15 bp, Homo sapiens
cagtgagggctgggc

SEQ ID NO: 2138932 - DNA, 18 bp, Homo sapiens
cagtgagtctcttcagaa

SEQ ID NO: 2138933 - DNA, 23 bp, Homo sapiens
cagtgatacatgtactccagagg

SEQ ID NO: 2138934 - DNA, 15 bp, Homo sapiens
cagtgatctccatat

SEQ ID NO: 2138935 - DNA, 21 bp, Homo sapiens
cagtgatggcgcgggaggcac

SEQ ID NO: 2138936 - DNA, 22 bp, Homo sapiens
cagtgatggcgcgggaggcacc

SEQ ID NO: 2138937 - DNA, 15 bp, Homo sapiens
cagtgatgtgctgga

SEQ ID NO: 2138938 - DNA, 20 bp, Homo sapiens
cagtgattgtcttaatattg

SEQ ID NO: 2138939 - DNA, 15 bp, Homo sapiens
cagtgcacacggatg

SEQ ID NO: 2138940 - DNA, 23 bp, Homo sapiens
cagtgcacacggatgcacagaga

SEQ ID NO: 2138941 - DNA, 22 bp, Homo sapiens
cagtgcagtgatacatgtactc

SEQ ID NO: 2138942 - DNA, 16 bp, Homo sapiens
cagtgcatctcagccc

SEQ ID NO: 2138943 - DNA, 12 bp, Homo sapiens
cagtgccacaga

SEQ ID NO: 2138944 - DNA, 13 bp, Homo sapiens
cagtgccacagag

SEQ ID NO: 2138945 - DNA, 16 bp, Homo sapiens
cagtgccaggacagct

SEQ ID NO: 2138946 - DNA, 17 bp, Homo sapiens
cagtgccaggacagctg

SEQ ID NO: 2138947 - DNA, 19 bp, Homo sapiens
cagtgccaggacagctggc

SEQ ID NO: 2138948 - DNA, 17 bp, Homo sapiens
cagtgcccacaggatca

SEQ ID NO: 2138949 - DNA, 22 bp, Homo sapiens
cagtgcccacaggatcagtctg

SEQ ID NO: 2138950 - DNA, 16 bp, Homo sapiens
cagtgcccaccaacat

SEQ ID NO: 2138951 - DNA, 21 bp, Homo sapiens
cagtgcccaccaacatcccat

SEQ ID NO: 2138952 - DNA, 15 bp, Homo sapiens
cagtgcctcctggga

SEQ ID NO: 2138953 - DNA, 14 bp, Homo sapiens
cagtgcctcgaggc

SEQ ID NO: 2138954 - DNA, 18 bp, Homo sapiens
cagtgcctcgaggcaccg

SEQ ID NO: 2138955 - DNA, 15 bp, Homo sapiens
cagtgccttccataa

SEQ ID NO: 2138956 - DNA, 23 bp, Homo sapiens
cagtgccttggagcagaaagcca

SEQ ID NO: 2138957 - DNA, 13 bp, Homo sapiens
cagtgctcggcag

SEQ ID NO: 2138958 - DNA, 14 bp, Homo sapiens
cagtgctcggcagt

SEQ ID NO: 2138959 - DNA, 18 bp, Homo sapiens
cagtgctctaggctgccc

SEQ ID NO: 2138960 - DNA, 14 bp, Homo sapiens
cagtgctgccatgc

SEQ ID NO: 2138961 - DNA, 20 bp, Homo sapiens
cagtgctgccatgccactgc

SEQ ID NO: 2138962 - DNA, 21 bp, Homo sapiens
cagtgctgccatgccactgcc

SEQ ID NO: 2138963 - DNA, 18 bp, Homo sapiens
cagtgctgcttctcttgg

SEQ ID NO: 2138964 - DNA, 19 bp, Homo sapiens
cagtgctgcttctcttggg

SEQ ID NO: 2138965 - DNA, 14 bp, Homo sapiens
cagtgctgttctgg

SEQ ID NO: 2138966 - DNA, 16 bp, Homo sapiens
cagtgcttcagcctga

SEQ ID NO: 2138967 - DNA, 17 bp, Homo sapiens
cagtgcttcagcctgag

SEQ ID NO: 2138968 - DNA, 18 bp, Homo sapiens
cagtggaaattcaggtga

SEQ ID NO: 2138969 - DNA, 12 bp, Homo sapiens
cagtggaaattt

SEQ ID NO: 2138970 - DNA, 11 bp, Homo sapiens
cagtggagtga

SEQ ID NO: 2138971 - DNA, 14 bp, Homo sapiens
cagtggagtgagat

SEQ ID NO: 2138972 - DNA, 20 bp, Homo sapiens
cagtggatcatgaaaagtgc

SEQ ID NO: 2138973 - DNA, 14 bp, Homo sapiens
cagtggattaatta

SEQ ID NO: 2138974 - DNA, 20 bp, Homo sapiens
cagtggccgcaagcgcaggg

SEQ ID NO: 2138975 - DNA, 22 bp, Homo sapiens
cagtggccgcaagcgcagggag

SEQ ID NO: 2138976 - DNA, 17 bp, Homo sapiens
cagtggcgagaggagag

SEQ ID NO: 2138977 - DNA, 19 bp, Homo sapiens
cagtggcgagaggagagga

SEQ ID NO: 2138978 - DNA, 13 bp, Homo sapiens
cagtggctcgctc

SEQ ID NO: 2138979 - DNA, 18 bp, Homo sapiens
cagtggctcgctccctgt

SEQ ID NO: 2138980 - DNA, 17 bp, Homo sapiens
cagtgggaactctgaca

SEQ ID NO: 2138981 - DNA, 15 bp, Homo sapiens
cagtgggaactggag

SEQ ID NO: 2138982 - DNA, 17 bp, Homo sapiens
cagtgggaactggaggg

SEQ ID NO: 2138983 - DNA, 16 bp, Homo sapiens
cagtgggacagggcat

SEQ ID NO: 2138984 - DNA, 13 bp, Homo sapiens
cagtgggagaaaa

SEQ ID NO: 2138985 - DNA, 15 bp, Homo sapiens
cagtgggagctgcct

SEQ ID NO: 2138986 - DNA, 22 bp, Homo sapiens
cagtgggaggtgagaccacctc

SEQ ID NO: 2138987 - DNA, 13 bp, Homo sapiens
cagtgggtgcccc

SEQ ID NO: 2138988 - DNA, 15 bp, Homo sapiens
cagtggtaagctctg

SEQ ID NO: 2138989 - DNA, 20 bp, Homo sapiens
cagtggtaagctctggcttt

SEQ ID NO: 2138990 - DNA, 16 bp, Homo sapiens
cagtggtaccagctca

SEQ ID NO: 2138991 - DNA, 21 bp, Homo sapiens
cagtggtaccagctcactccc

SEQ ID NO: 2138992 - DNA, 21 bp, Homo sapiens
cagtggtatgatcacggctca

SEQ ID NO: 2138993 - DNA, 20 bp, Homo sapiens
cagtggtgcgatctgggttc

SEQ ID NO: 2138994 - DNA, 21 bp, Homo sapiens
cagtggtgcgatctgggttca

SEQ ID NO: 2138995 - DNA, 13 bp, Homo sapiens
cagtggttgctgt

SEQ ID NO: 2138996 - DNA, 18 bp, Homo sapiens
cagtgtaaagaataaatg

SEQ ID NO: 2138997 - DNA, 14 bp, Homo sapiens
cagtgtactgcttt

SEQ ID NO: 2138998 - DNA, 21 bp, Homo sapiens
cagtgtactgctttcaactta

SEQ ID NO: 2138999 - DNA, 20 bp, Homo sapiens
cagtgtcatttatgaaaaga

SEQ ID NO: 2139000 - DNA, 18 bp, Homo sapiens
cagtgtcctcttgctcaa

SEQ ID NO: 2139001 - DNA, 19 bp, Homo sapiens
cagtgtcctcttgctcaaa

SEQ ID NO: 2139002 - DNA, 14 bp, Homo sapiens
cagtgtctcggagg

SEQ ID NO: 2139003 - DNA, 15 bp, Homo sapiens
cagtgtcttccataa

SEQ ID NO: 2139004 - DNA, 18 bp, Homo sapiens
cagtgtcttccataatgt

SEQ ID NO: 2139005 - DNA, 20 bp, Homo sapiens
cagtgtcttccataatgtat

SEQ ID NO: 2139006 - DNA, 19 bp, Homo sapiens
cagtgtgatcccaagtgcc

SEQ ID NO: 2139007 - DNA, 16 bp, Homo sapiens
cagtgtgcacccctcc

SEQ ID NO: 2139008 - DNA, 19 bp, Homo sapiens
cagtgtgcacccctcccca

SEQ ID NO: 2139009 - DNA, 20 bp, Homo sapiens
cagtgtgcacccctccccat

SEQ ID NO: 2139010 - DNA, 15 bp, Homo sapiens
cagtgtggagagggg

SEQ ID NO: 2139011 - DNA, 17 bp, Homo sapiens
cagtgtggagaggggtg

SEQ ID NO: 2139012 - DNA, 16 bp, Homo sapiens
cagtgtgtcacactga

SEQ ID NO: 2139013 - DNA, 19 bp, Homo sapiens
cagtgtgtcacactgagct

SEQ ID NO: 2139014 - DNA, 20 bp, Homo sapiens
cagtgtgtcacactgagctg

SEQ ID NO: 2139015 - DNA, 22 bp, Homo sapiens
cagtgtgtccttggggcacagt

SEQ ID NO: 2139016 - DNA, 17 bp, Homo sapiens
cagtgttaaatgaaatt

SEQ ID NO: 2139017 - DNA, 18 bp, Homo sapiens
cagtgttaaatgaaattg

SEQ ID NO: 2139018 - DNA, 14 bp, Homo sapiens
cagtgttccccatc

SEQ ID NO: 2139019 - DNA, 21 bp, Homo sapiens
cagtgttccccatctgggtcc

SEQ ID NO: 2139020 - DNA, 14 bp, Homo sapiens
cagtgtttcccata

SEQ ID NO: 2139021 - DNA, 17 bp, Homo sapiens
cagtgtttcccataatt

SEQ ID NO: 2139022 - DNA, 17 bp, Homo sapiens
cagtgttttagctgttt

SEQ ID NO: 2139023 - DNA, 13 bp, Homo sapiens
catctatttctga

SEQ ID NO: 2139024 - DNA, 16 bp, Homo sapiens
catctatttctgagaa

SEQ ID NO: 2139025 - DNA, 13 bp, Homo sapiens
catctcactgccc

SEQ ID NO: 2139026 - DNA, 13 bp, Homo sapiens
catctcactttgc

SEQ ID NO: 2139027 - DNA, 21 bp, Homo sapiens
catctcagggtccagaccctg

SEQ ID NO: 2139028 - DNA, 16 bp, Homo sapiens
catctcaggtgccact

SEQ ID NO: 2139029 - DNA, 17 bp, Homo sapiens
catctcaggtgccactc

SEQ ID NO: 2139030 - DNA, 17 bp, Homo sapiens
catctcattccaacttc

SEQ ID NO: 2139031 - DNA, 20 bp, Homo sapiens
catctcatttaagggaaaaa

SEQ ID NO: 2139032 - DNA, 23 bp, Homo sapiens
catctcatttaagggaaaaatat

SEQ ID NO: 2139033 - DNA, 22 bp, Homo sapiens
catctccatgtagaataaatga

SEQ ID NO: 2139034 - DNA, 16 bp, Homo sapiens
catctccccaggcctc

SEQ ID NO: 2139035 - DNA, 17 bp, Homo sapiens
catctccccaggcctcc

SEQ ID NO: 2139036 - DNA, 24 bp, Homo sapiens
catctcccccatcccccactgcca

SEQ ID NO: 2139037 - DNA, 15 bp, Homo sapiens
catctccctcccaca

SEQ ID NO: 2139038 - DNA, 23 bp, Homo sapiens
catctcctcccatggccttccct

SEQ ID NO: 2139039 - DNA, 16 bp, Homo sapiens
catctcctctatcaca

SEQ ID NO: 2139040 - DNA, 18 bp, Homo sapiens
catctcgagccccctgga

SEQ ID NO: 2139041 - DNA, 21 bp, Homo sapiens
catctctctactcctacctca

SEQ ID NO: 2139042 - DNA, 14 bp, Homo sapiens
catctctctggggc

SEQ ID NO: 2139043 - DNA, 14 bp, Homo sapiens
catctctctttaat

SEQ ID NO: 2139044 - DNA, 13 bp, Homo sapiens
catctgaaagcca

SEQ ID NO: 2139045 - DNA, 14 bp, Homo sapiens
catctgaaagccac

SEQ ID NO: 2139046 - DNA, 14 bp, Homo sapiens
catctgagaaaagc

SEQ ID NO: 2139047 - DNA, 23 bp, Homo sapiens
catctgagaaaagctttgaaccc

SEQ ID NO: 2139048 - DNA, 15 bp, Homo sapiens
catctgagcaagagc

SEQ ID NO: 2139049 - DNA, 18 bp, Homo sapiens
catctgagcaagagctgg

SEQ ID NO: 2139050 - DNA, 15 bp, Homo sapiens
catctgcagctcttt

SEQ ID NO: 2139051 - DNA, 18 bp, Homo sapiens
catctgcggggcttctgg

SEQ ID NO: 2139052 - DNA, 20 bp, Homo sapiens
catctgcggggcttctgggt

SEQ ID NO: 2139053 - DNA, 13 bp, Homo sapiens
catctgctgcccc

SEQ ID NO: 2139054 - DNA, 20 bp, Homo sapiens
catctgggaggctggtctcc

SEQ ID NO: 2139055 - DNA, 16 bp, Homo sapiens
catctgggattcccac

SEQ ID NO: 2139056 - DNA, 19 bp, Homo sapiens
catctgtcttgccagccag

SEQ ID NO: 2139057 - DNA, 16 bp, Homo sapiens
catctgtgtctctgga

SEQ ID NO: 2139058 - DNA, 12 bp, Homo sapiens
catcttaaatga

SEQ ID NO: 2139059 - DNA, 17 bp, Homo sapiens
catcttaaatgacagtg

SEQ ID NO: 2139060 - DNA, 20 bp, Homo sapiens
catcttattttcatgtatat

SEQ ID NO: 2139061 - DNA, 15 bp, Homo sapiens
catcttcagctccca

SEQ ID NO: 2139062 - DNA, 16 bp, Homo sapiens
catcttcctgctgctg

SEQ ID NO: 2139063 - DNA, 16 bp, Homo sapiens
catcttctccatctgg

SEQ ID NO: 2139064 - DNA, 13 bp, Homo sapiens
catcttctggctt

SEQ ID NO: 2139065 - DNA, 19 bp, Homo sapiens
catcttgaatatttgctta

SEQ ID NO: 2139066 - DNA, 13 bp, Homo sapiens
catcttgacatgt

SEQ ID NO: 2139067 - DNA, 13 bp, Homo sapiens
catcttgccccct

SEQ ID NO: 2139068 - DNA, 15 bp, Homo sapiens
catcttgctctgctg

SEQ ID NO: 2139069 - DNA, 17 bp, Homo sapiens
catcttggtcctgtcac

SEQ ID NO: 2139070 - DNA, 15 bp, Homo sapiens
catctttgaaaagaa

SEQ ID NO: 2139071 - DNA, 16 bp, Homo sapiens
catctttgaaaagaaa

SEQ ID NO: 2139072 - DNA, 17 bp, Homo sapiens
catctttgaaaagaaaa

SEQ ID NO: 2139073 - DNA, 16 bp, Homo sapiens
catcttttgtgagatg

SEQ ID NO: 2139074 - DNA, 21 bp, Homo sapiens
catcttttgtgagatgtaatt

SEQ ID NO: 2139075 - DNA, 20 bp, Homo sapiens
catgaaaaacacggcagctg

SEQ ID NO: 2139076 - DNA, 21 bp, Homo sapiens
catgaaaaccattacctgact

SEQ ID NO: 2139077 - DNA, 22 bp, Homo sapiens
catgaaaaccattacctgactt

SEQ ID NO: 2139078 - DNA, 22 bp, Homo sapiens
catgaaaatgcaacaacatgta

SEQ ID NO: 2139079 - DNA, 24 bp, Homo sapiens
catgaaattgtctagcagagcagg

SEQ ID NO: 2139080 - DNA, 18 bp, Homo sapiens
catgaacacacatggatg

SEQ ID NO: 2139081 - DNA, 15 bp, Homo sapiens
catgaagacacgctt

SEQ ID NO: 2139082 - DNA, 22 bp, Homo sapiens
catgaagcccaagtgaaatcaa

SEQ ID NO: 2139083 - DNA, 16 bp, Homo sapiens
catgaaggtgtcatac

SEQ ID NO: 2139084 - DNA, 15 bp, Homo sapiens
catgaaggtttctga

SEQ ID NO: 2139085 - DNA, 18 bp, Homo sapiens
catgaaggtttctgaaaa

SEQ ID NO: 2139086 - DNA, 18 bp, Homo sapiens
catgaattcttatgctta

SEQ ID NO: 2139087 - DNA, 12 bp, Homo sapiens
catgacaaagtt

SEQ ID NO: 2139088 - DNA, 13 bp, Homo sapiens
catgacactgacc

SEQ ID NO: 2139089 - DNA, 13 bp, Homo sapiens
catgacagccaga

SEQ ID NO: 2139090 - DNA, 16 bp, Homo sapiens
catgacagccagagcc

SEQ ID NO: 2139091 - DNA, 15 bp, Homo sapiens
catgaccagcaaata

SEQ ID NO: 2139092 - DNA, 17 bp, Homo sapiens
catgaccctcctgtcca

SEQ ID NO: 2139093 - DNA, 23 bp, Homo sapiens
catgaccctcctgtccagcaggt

SEQ ID NO: 2139094 - DNA, 13 bp, Homo sapiens
catgacctccagc

SEQ ID NO: 2139095 - DNA, 14 bp, Homo sapiens
catgacctccagct

SEQ ID NO: 2139096 - DNA, 15 bp, Homo sapiens
catgacctccagctt

SEQ ID NO: 2139097 - DNA, 20 bp, Homo sapiens
catgacctccagctttcctg

SEQ ID NO: 2139098 - DNA, 15 bp, Homo sapiens
catgacgtaaaattt

SEQ ID NO: 2139099 - DNA, 20 bp, Homo sapiens
catgactcgtatatgtctca

SEQ ID NO: 2139100 - DNA, 23 bp, Homo sapiens
catgactcgtatatgtctcaggt

SEQ ID NO: 2139101 - DNA, 21 bp, Homo sapiens
catgacttttccatgtatcta

SEQ ID NO: 2139102 - DNA, 10 bp, Homo sapiens
catgagaaat

SEQ ID NO: 2139103 - DNA, 16 bp, Homo sapiens
catgagaagagggcct

SEQ ID NO: 2139104 - DNA, 17 bp, Homo sapiens
catgagaagagggcctg

SEQ ID NO: 2139105 - DNA, 20 bp, Homo sapiens
catgagaataagagaaagaa

SEQ ID NO: 2139106 - DNA, 19 bp, Homo sapiens
catgagaatctatatttaa

SEQ ID NO: 2139107 - DNA, 12 bp, Homo sapiens
catgagctgagt

SEQ ID NO: 2139108 - DNA, 15 bp, Homo sapiens
catgaggagttgctg

SEQ ID NO: 2139109 - DNA, 19 bp, Homo sapiens
catgaggcctttccccagt

SEQ ID NO: 2139110 - DNA, 17 bp, Homo sapiens
catgagtggatggatgg

SEQ ID NO: 2139111 - DNA, 22 bp, Homo sapiens
catgagtggatggatggacaga

SEQ ID NO: 2139112 - DNA, 18 bp, Homo sapiens
catgataatgaacagaac

SEQ ID NO: 2139113 - DNA, 16 bp, Homo sapiens
catgatctccctgccg

SEQ ID NO: 2139114 - DNA, 19 bp, Homo sapiens
catgatctccctgccgcct

SEQ ID NO: 2139115 - DNA, 23 bp, Homo sapiens
catgatctgactttaattgtgtg

SEQ ID NO: 2139116 - DNA, 12 bp, Homo sapiens
catgatctgtat

SEQ ID NO: 2139117 - DNA, 20 bp, Homo sapiens
catgatgccgctcttctgtc

SEQ ID NO: 2139118 - DNA, 18 bp, Homo sapiens
catgatggagcgcacctg

SEQ ID NO: 2139119 - DNA, 19 bp, Homo sapiens
catgatggagcgcacctgc

SEQ ID NO: 2139120 - DNA, 23 bp, Homo sapiens
catgatggatggaaatatgttct

SEQ ID NO: 2139121 - DNA, 22 bp, Homo sapiens
catgatgttaaccagaataaag

SEQ ID NO: 2139122 - DNA, 16 bp, Homo sapiens
catgattcatgccaat

SEQ ID NO: 2139123 - DNA, 18 bp, Homo sapiens
catgattcattttaacat

SEQ ID NO: 2139124 - DNA, 20 bp, Homo sapiens
catgatttacagagaagtga

SEQ ID NO: 2139125 - DNA, 22 bp, Homo sapiens
catgatttagggaagcagggac

SEQ ID NO: 2139126 - DNA, 14 bp, Homo sapiens
catgatttatatat

SEQ ID NO: 2139127 - DNA, 15 bp, Homo sapiens
catgatttatatatg

SEQ ID NO: 2139128 - DNA, 17 bp, Homo sapiens
catgatttatatatggc

SEQ ID NO: 2139129 - DNA, 18 bp, Homo sapiens
catgatttatatatggca

SEQ ID NO: 2139130 - DNA, 11 bp, Homo sapiens
catgattttac

SEQ ID NO: 2139131 - DNA, 12 bp, Homo sapiens
catgattttaca

SEQ ID NO: 2139132 - DNA, 16 bp, Homo sapiens
catgattttacagaga

SEQ ID NO: 2139133 - DNA, 15 bp, Homo sapiens
catgattttatacat

SEQ ID NO: 2139134 - DNA, 17 bp, Homo sapiens
catgattttatacatag

SEQ ID NO: 2139135 - DNA, 15 bp, Homo sapiens
catgcaaaagtgggg

SEQ ID NO: 2139136 - DNA, 18 bp, Homo sapiens
catgcaagtgctatgcca

SEQ ID NO: 2139137 - DNA, 15 bp, Homo sapiens
catgcacagctgctt

SEQ ID NO: 2139138 - DNA, 14 bp, Homo sapiens
catttaaaatgatt

SEQ ID NO: 2139139 - DNA, 18 bp, Homo sapiens
catttaaaatgattagaa

SEQ ID NO: 2139140 - DNA, 16 bp, Homo sapiens
catttaagggaaaaat

SEQ ID NO: 2139141 - DNA, 17 bp, Homo sapiens
catttaagggaaaaata

SEQ ID NO: 2139142 - DNA, 22 bp, Homo sapiens
catttaagggaaaaatatatat

SEQ ID NO: 2139143 - DNA, 16 bp, Homo sapiens
catttaattcataatt

SEQ ID NO: 2139144 - DNA, 20 bp, Homo sapiens
catttaattcataattagaa

SEQ ID NO: 2139145 - DNA, 23 bp, Homo sapiens
catttacaataaatattctgcat

SEQ ID NO: 2139146 - DNA, 16 bp, Homo sapiens
catttacctcgaggct

SEQ ID NO: 2139147 - DNA, 15 bp, Homo sapiens
catttaggtttctga

SEQ ID NO: 2139148 - DNA, 20 bp, Homo sapiens
catttagtccaatgtctttt

SEQ ID NO: 2139149 - DNA, 14 bp, Homo sapiens
catttagttttatg

SEQ ID NO: 2139150 - DNA, 15 bp, Homo sapiens
catttagttttatgg

SEQ ID NO: 2139151 - DNA, 21 bp, Homo sapiens
catttataatgtttgctattg

SEQ ID NO: 2139152 - DNA, 14 bp, Homo sapiens
catttatatatata

SEQ ID NO: 2139153 - DNA, 19 bp, Homo sapiens
catttatatatatatgtat

SEQ ID NO: 2139154 - DNA, 22 bp, Homo sapiens
catttatatatatatgtatatg

SEQ ID NO: 2139155 - DNA, 16 bp, Homo sapiens
catttatgaagcaagc

SEQ ID NO: 2139156 - DNA, 20 bp, Homo sapiens
catttatgagctcttcatgt

SEQ ID NO: 2139157 - DNA, 15 bp, Homo sapiens
catttattctgctca

SEQ ID NO: 2139158 - DNA, 22 bp, Homo sapiens
catttattgcactcagcttttt

SEQ ID NO: 2139159 - DNA, 14 bp, Homo sapiens
catttattttgaca

SEQ ID NO: 2139160 - DNA, 16 bp, Homo sapiens
catttcaactccagaa

SEQ ID NO: 2139161 - DNA, 23 bp, Homo sapiens
catttcacacaggtcctgaaagt

SEQ ID NO: 2139162 - DNA, 15 bp, Homo sapiens
catttcacattaatg

SEQ ID NO: 2139163 - DNA, 13 bp, Homo sapiens
catttcactttaa

SEQ ID NO: 2139164 - DNA, 22 bp, Homo sapiens
catttcataaggcctgccctcc

SEQ ID NO: 2139165 - DNA, 14 bp, Homo sapiens
catttcatctattt

SEQ ID NO: 2139166 - DNA, 17 bp, Homo sapiens
catttcatctatttctg

SEQ ID NO: 2139167 - DNA, 20 bp, Homo sapiens
catttcatctatttctgaga

SEQ ID NO: 2139168 - DNA, 16 bp, Homo sapiens
catttcatctcattta

SEQ ID NO: 2139169 - DNA, 20 bp, Homo sapiens
catttcattgtatgatgtgt

SEQ ID NO: 2139170 - DNA, 23 bp, Homo sapiens
catttcattgtatgatgtgttgt

SEQ ID NO: 2139171 - DNA, 21 bp, Homo sapiens
catttccaaatgaatgacctt

SEQ ID NO: 2139172 - DNA, 17 bp, Homo sapiens
catttccacactgtcag

SEQ ID NO: 2139173 - DNA, 13 bp, Homo sapiens
catttccgtgaag

SEQ ID NO: 2139174 - DNA, 12 bp, Homo sapiens
catttcctgggt

SEQ ID NO: 2139175 - DNA, 14 bp, Homo sapiens
catttcctgggtgg

SEQ ID NO: 2139176 - DNA, 22 bp, Homo sapiens
catttcctgggtggctactctg

SEQ ID NO: 2139177 - DNA, 17 bp, Homo sapiens
catttccttggaggcca

SEQ ID NO: 2139178 - DNA, 21 bp, Homo sapiens
catttcgcccctcatttatcc

SEQ ID NO: 2139179 - DNA, 18 bp, Homo sapiens
catttctaacatatgtat

SEQ ID NO: 2139180 - DNA, 16 bp, Homo sapiens
catttctaattttaag

SEQ ID NO: 2139181 - DNA, 14 bp, Homo sapiens
catttctatttatt

SEQ ID NO: 2139182 - DNA, 17 bp, Homo sapiens
catttctcaatcagtgc

SEQ ID NO: 2139183 - DNA, 18 bp, Homo sapiens
catttctcaatcagtgca

SEQ ID NO: 2139184 - DNA, 14 bp, Homo sapiens
catttctctgctta

SEQ ID NO: 2139185 - DNA, 13 bp, Homo sapiens
catttcttcctca

SEQ ID NO: 2139186 - DNA, 15 bp, Homo sapiens
catttgagagaagcc

SEQ ID NO: 2139187 - DNA, 14 bp, Homo sapiens
catttgagcagggc

SEQ ID NO: 2139188 - DNA, 13 bp, Homo sapiens
catttgagtgtct

SEQ ID NO: 2139189 - DNA, 14 bp, Homo sapiens
catttgatgctaaa

SEQ ID NO: 2139190 - DNA, 15 bp, Homo sapiens
catttgatgctaaat

SEQ ID NO: 2139191 - DNA, 15 bp, Homo sapiens
catttgatgtacatg

SEQ ID NO: 2139192 - DNA, 16 bp, Homo sapiens
catttgatgtacatgt

SEQ ID NO: 2139193 - DNA, 13 bp, Homo sapiens
catttgcaagctg

SEQ ID NO: 2139194 - DNA, 17 bp, Homo sapiens
catttgccattcctgga

SEQ ID NO: 2139195 - DNA, 16 bp, Homo sapiens
catttgctttttcacc

SEQ ID NO: 2139196 - DNA, 20 bp, Homo sapiens
catttggtgctggtctattt

SEQ ID NO: 2139197 - DNA, 21 bp, Homo sapiens
catttgtaatgtatcttattt

SEQ ID NO: 2139198 - DNA, 23 bp, Homo sapiens
catttgtaatgtatcttatttat

SEQ ID NO: 2139199 - DNA, 12 bp, Homo sapiens
catttgtacatt

SEQ ID NO: 2139200 - DNA, 18 bp, Homo sapiens
catttgtacattcctgat

SEQ ID NO: 2139201 - DNA, 23 bp, Homo sapiens
catttgtataatgggaagcctgt

SEQ ID NO: 2139202 - DNA, 13 bp, Homo sapiens
catttgtatttgt

SEQ ID NO: 2139203 - DNA, 17 bp, Homo sapiens
catttgtcacacacttt

SEQ ID NO: 2139204 - DNA, 14 bp, Homo sapiens
catttgtgaaatga

SEQ ID NO: 2139205 - DNA, 20 bp, Homo sapiens
cattttaaaagcaattatat

SEQ ID NO: 2139206 - DNA, 23 bp, Homo sapiens
cattttaaaagcaattatattgt

SEQ ID NO: 2139207 - DNA, 15 bp, Homo sapiens
cattttaaataaaag

SEQ ID NO: 2139208 - DNA, 18 bp, Homo sapiens
cattttaagaagacatga

SEQ ID NO: 2139209 - DNA, 18 bp, Homo sapiens
cattttaatttatatttg

SEQ ID NO: 2139210 - DNA, 15 bp, Homo sapiens
cattttacattctgt

SEQ ID NO: 2139211 - DNA, 14 bp, Homo sapiens
cattttacgtcttt

SEQ ID NO: 2139212 - DNA, 16 bp, Homo sapiens
cattttactgtctgta

SEQ ID NO: 2139213 - DNA, 17 bp, Homo sapiens
cattttactgtctgtaa

SEQ ID NO: 2139214 - DNA, 15 bp, Homo sapiens
cattttagtgactgt

SEQ ID NO: 2139215 - DNA, 16 bp, Homo sapiens
cattttagtgactgta

SEQ ID NO: 2139216 - DNA, 16 bp, Homo sapiens
cattttcaatgcacat

SEQ ID NO: 2139217 - DNA, 13 bp, Homo sapiens
cattttcagagtg

SEQ ID NO: 2139218 - DNA, 16 bp, Homo sapiens
cattttcagagtgaca

SEQ ID NO: 2139219 - DNA, 16 bp, Homo sapiens
cattttctcctaggag

SEQ ID NO: 2139220 - DNA, 14 bp, Homo sapiens
cattttgcaaaatt

SEQ ID NO: 2139221 - DNA, 22 bp, Homo sapiens
cattttggaagttttcaggact

SEQ ID NO: 2139222 - DNA, 21 bp, Homo sapiens
cattttggggtacccactgct

SEQ ID NO: 2139223 - DNA, 17 bp, Homo sapiens
catttttacaataaata

SEQ ID NO: 2139224 - DNA, 21 bp, Homo sapiens
catttttactaaagcagtgtt

SEQ ID NO: 2139225 - DNA, 20 bp, Homo sapiens
catttttagtagagacaggg

SEQ ID NO: 2139226 - DNA, 19 bp, Homo sapiens
ccaaaaaaaaatacatgct

SEQ ID NO: 2139227 - DNA, 16 bp, Homo sapiens
ccaaaaaagtattttt

SEQ ID NO: 2139228 - DNA, 22 bp, Homo sapiens
ccaaaacctcatgacagccaga

SEQ ID NO: 2139229 - DNA, 16 bp, Homo sapiens
ccaaaacctttcccca

SEQ ID NO: 2139230 - DNA, 22 bp, Homo sapiens
ccaaaagggcagccaggggctg

SEQ ID NO: 2139231 - DNA, 22 bp, Homo sapiens
ccaaaagtcaaaaggtgcctgt

SEQ ID NO: 2139232 - DNA, 18 bp, Homo sapiens
ccaaaagttttcctgaga

SEQ ID NO: 2139233 - DNA, 20 bp, Homo sapiens
ccaaaatactacacatccaa

SEQ ID NO: 2139234 - DNA, 22 bp, Homo sapiens
ccaaaattcagaacatcctcca

SEQ ID NO: 2139235 - DNA, 15 bp, Homo sapiens
ccaaacctgacagat

SEQ ID NO: 2139236 - DNA, 13 bp, Homo sapiens
ccaaactacagaa

SEQ ID NO: 2139237 - DNA, 20 bp, Homo sapiens
ccaaagaaaaagggctgccg

SEQ ID NO: 2139238 - DNA, 14 bp, Homo sapiens
ccaaagaacagcct

SEQ ID NO: 2139239 - DNA, 21 bp, Homo sapiens
ccaaagagactggagcatctg

SEQ ID NO: 2139240 - DNA, 15 bp, Homo sapiens
ccaaagagcctggag

SEQ ID NO: 2139241 - DNA, 18 bp, Homo sapiens
ccaaagagcctggagaag

SEQ ID NO: 2139242 - DNA, 21 bp, Homo sapiens
ccaaagatatatacacaggat

SEQ ID NO: 2139243 - DNA, 15 bp, Homo sapiens
ccaaagcaaaagaag

SEQ ID NO: 2139244 - DNA, 14 bp, Homo sapiens
ccaaagcatggact

SEQ ID NO: 2139245 - DNA, 19 bp, Homo sapiens
ccaaagcattgcctgccag

SEQ ID NO: 2139246 - DNA, 16 bp, Homo sapiens
ccaaagctaggcctgg

SEQ ID NO: 2139247 - DNA, 17 bp, Homo sapiens
ccaaagctaggcctggc

SEQ ID NO: 2139248 - DNA, 17 bp, Homo sapiens
ccaaaggacagccgcct

SEQ ID NO: 2139249 - DNA, 21 bp, Homo sapiens
ccaaagggaaaactcttcatt

SEQ ID NO: 2139250 - DNA, 15 bp, Homo sapiens
ccaaaggggctgctg

SEQ ID NO: 2139251 - DNA, 20 bp, Homo sapiens
ccaaaggggctgctggggca

SEQ ID NO: 2139252 - DNA, 20 bp, Homo sapiens
ccaaagtattaatgtacaga

SEQ ID NO: 2139253 - DNA, 20 bp, Homo sapiens
ccactacactccagcctgag

SEQ ID NO: 2139254 - DNA, 14 bp, Homo sapiens
ccactacctttgtc

SEQ ID NO: 2139255 - DNA, 19 bp, Homo sapiens
ccactagagctgagagtct

SEQ ID NO: 2139256 - DNA, 19 bp, Homo sapiens
ccactaggactctgaggct

SEQ ID NO: 2139257 - DNA, 20 bp, Homo sapiens
ccactaggactctgaggctc

SEQ ID NO: 2139258 - DNA, 20 bp, Homo sapiens
ccactagggtcctggccctc

SEQ ID NO: 2139259 - DNA, 22 bp, Homo sapiens
ccactagggtcctggccctctt

SEQ ID NO: 2139260 - DNA, 21 bp, Homo sapiens
ccactatgtccagctagccaa

SEQ ID NO: 2139261 - DNA, 14 bp, Homo sapiens
ccactcacacttgg

SEQ ID NO: 2139262 - DNA, 16 bp, Homo sapiens
ccactcacacttggag

SEQ ID NO: 2139263 - DNA, 17 bp, Homo sapiens
ccactcaccagggtccg

SEQ ID NO: 2139264 - DNA, 20 bp, Homo sapiens
ccactcaggaggctgaggca

SEQ ID NO: 2139265 - DNA, 18 bp, Homo sapiens
ccactcagggctgccact

SEQ ID NO: 2139266 - DNA, 11 bp, Homo sapiens
ccactccagcc

SEQ ID NO: 2139267 - DNA, 12 bp, Homo sapiens
ccactccagccc

SEQ ID NO: 2139268 - DNA, 13 bp, Homo sapiens
ccactccattccc

SEQ ID NO: 2139269 - DNA, 14 bp, Homo sapiens
ccactccattccca

SEQ ID NO: 2139270 - DNA, 17 bp, Homo sapiens
ccactcccaaagctcag

SEQ ID NO: 2139271 - DNA, 15 bp, Homo sapiens
ccactcccccacctg

SEQ ID NO: 2139272 - DNA, 16 bp, Homo sapiens
ccactcccccacctga

SEQ ID NO: 2139273 - DNA, 17 bp, Homo sapiens
ccactcccccacctgac

SEQ ID NO: 2139274 - DNA, 18 bp, Homo sapiens
ccactccctcctaaccta

SEQ ID NO: 2139275 - DNA, 14 bp, Homo sapiens
ccactccctgagct

SEQ ID NO: 2139276 - DNA, 15 bp, Homo sapiens
ccactccctgagctt

SEQ ID NO: 2139277 - DNA, 18 bp, Homo sapiens
ccactcctcactgcccca

SEQ ID NO: 2139278 - DNA, 16 bp, Homo sapiens
ccactcctccaaagga

SEQ ID NO: 2139279 - DNA, 16 bp, Homo sapiens
ccactcctgcttctct

SEQ ID NO: 2139280 - DNA, 20 bp, Homo sapiens
ccactcctgcttctctgggg

SEQ ID NO: 2139281 - DNA, 13 bp, Homo sapiens
ccactcctgtccc

SEQ ID NO: 2139282 - DNA, 18 bp, Homo sapiens
ccactccttcctgcccca

SEQ ID NO: 2139283 - DNA, 18 bp, Homo sapiens
ccactcgcagtcgcagga

SEQ ID NO: 2139284 - DNA, 23 bp, Homo sapiens
ccactcgggaggctgagacagga

SEQ ID NO: 2139285 - DNA, 13 bp, Homo sapiens
ccactctcaggag

SEQ ID NO: 2139286 - DNA, 14 bp, Homo sapiens
ccactctcaggagg

SEQ ID NO: 2139287 - DNA, 13 bp, Homo sapiens
ccactctgctctg

SEQ ID NO: 2139288 - DNA, 18 bp, Homo sapiens
ccactctgctctgatgca

SEQ ID NO: 2139289 - DNA, 14 bp, Homo sapiens
ccactctggcagcc

SEQ ID NO: 2139290 - DNA, 15 bp, Homo sapiens
ccactctggcagcca

SEQ ID NO: 2139291 - DNA, 16 bp, Homo sapiens
ccactctggcagccac

SEQ ID NO: 2139292 - DNA, 17 bp, Homo sapiens
ccactctggcagccaca

SEQ ID NO: 2139293 - DNA, 16 bp, Homo sapiens
ccactgaagctgggat

SEQ ID NO: 2139294 - DNA, 22 bp, Homo sapiens
ccactgacctcaccggcatgct

SEQ ID NO: 2139295 - DNA, 23 bp, Homo sapiens
ccactgacctcaccggcatgctg

SEQ ID NO: 2139296 - DNA, 16 bp, Homo sapiens
ccactgagacggcaga

SEQ ID NO: 2139297 - DNA, 19 bp, Homo sapiens
ccactgcaccgggccacag

SEQ ID NO: 2139298 - DNA, 20 bp, Homo sapiens
ccactgcactatagcctagg

SEQ ID NO: 2139299 - DNA, 21 bp, Homo sapiens
ccactgcactccagcctgggc

SEQ ID NO: 2139300 - DNA, 13 bp, Homo sapiens
ccactgcaggccc

SEQ ID NO: 2139301 - DNA, 14 bp, Homo sapiens
ccactgcaggcccc

SEQ ID NO: 2139302 - DNA, 14 bp, Homo sapiens
ccactgccaggcac

SEQ ID NO: 2139303 - DNA, 21 bp, Homo sapiens
ccactgccaggcacctggcct

SEQ ID NO: 2139304 - DNA, 22 bp, Homo sapiens
ccactgccaggcacctggcctg

SEQ ID NO: 2139305 - DNA, 23 bp, Homo sapiens
ccactgccaggcacctggcctgc

SEQ ID NO: 2139306 - DNA, 12 bp, Homo sapiens
ccactgccctgc

SEQ ID NO: 2139307 - DNA, 13 bp, Homo sapiens
ccactgccctgcc

SEQ ID NO: 2139308 - DNA, 15 bp, Homo sapiens
ccactgccctgcctg

SEQ ID NO: 2139309 - DNA, 16 bp, Homo sapiens
ccactgccctgcctgc

SEQ ID NO: 2139310 - DNA, 18 bp, Homo sapiens
ccactgccctgcctgccc

SEQ ID NO: 2139311 - DNA, 13 bp, Homo sapiens
ccactgcctcttc

SEQ ID NO: 2139312 - DNA, 20 bp, Homo sapiens
ccactgctctcagcctccca

SEQ ID NO: 2139313 - DNA, 12 bp, Homo sapiens
ccactgctctgg

SEQ ID NO: 2139314 - DNA, 13 bp, Homo sapiens
ccactgctctggt

SEQ ID NO: 2139315 - DNA, 22 bp, Homo sapiens
ccactgcttttggtctgtgtga

SEQ ID NO: 2139316 - DNA, 17 bp, Homo sapiens
ccactggaacagcccat

SEQ ID NO: 2139317 - DNA, 16 bp, Homo sapiens
ccactggacttgagct

SEQ ID NO: 2139318 - DNA, 14 bp, Homo sapiens
ccactggatcttca

SEQ ID NO: 2139319 - DNA, 16 bp, Homo sapiens
ccactgggtctcactc

SEQ ID NO: 2139320 - DNA, 19 bp, Homo sapiens
ccactggttaaaataaagc

SEQ ID NO: 2139321 - DNA, 16 bp, Homo sapiens
ccactggtttctcaga

SEQ ID NO: 2139322 - DNA, 17 bp, Homo sapiens
ccactggtttctcagaa

SEQ ID NO: 2139323 - DNA, 14 bp, Homo sapiens
ccactgtaaaatga

SEQ ID NO: 2139324 - DNA, 18 bp, Homo sapiens
ccactgtcttgcctgcca

SEQ ID NO: 2139325 - DNA, 19 bp, Homo sapiens
ccactgtgccatgtgccag

SEQ ID NO: 2139326 - DNA, 16 bp, Homo sapiens
ccactgtggccagagc

SEQ ID NO: 2139327 - DNA, 20 bp, Homo sapiens
ccactgtggccagagctgga

SEQ ID NO: 2139328 - DNA, 19 bp, Homo sapiens
ccacttaaaaaatgtccat

SEQ ID NO: 2139329 - DNA, 21 bp, Homo sapiens
ccacttaaaaaatgtccatga

SEQ ID NO: 2139330 - DNA, 12 bp, Homo sapiens
ccacttacctag

SEQ ID NO: 2139331 - DNA, 22 bp, Homo sapiens
ccacttaccttcaataaagtat

SEQ ID NO: 2139332 - DNA, 21 bp, Homo sapiens
ccacttagaaattgcatttcc

SEQ ID NO: 2139333 - DNA, 15 bp, Homo sapiens
ccacttagccgtcca

SEQ ID NO: 2139334 - DNA, 19 bp, Homo sapiens
ccacttagccgtccatggc

SEQ ID NO: 2139335 - DNA, 20 bp, Homo sapiens
ccacttagccgtccatggca

SEQ ID NO: 2139336 - DNA, 22 bp, Homo sapiens
ccacttagccgtccatggcacc

SEQ ID NO: 2139337 - DNA, 23 bp, Homo sapiens
ccacttcattcttgaaagctgtg

SEQ ID NO: 2139338 - DNA, 19 bp, Homo sapiens
ccacttctctactctggaa

SEQ ID NO: 2139339 - DNA, 12 bp, Homo sapiens
ccacttctctcc

SEQ ID NO: 2139340 - DNA, 19 bp, Homo sapiens
ccacttcttaaaggcctgg

SEQ ID NO: 2139341 - DNA, 23 bp, Homo sapiens
ccacttcttaaaggcctggaacc

SEQ ID NO: 2139342 - DNA, 21 bp, Homo sapiens
ccacttcttaatgctttcctc

SEQ ID NO: 2139343 - DNA, 16 bp, Homo sapiens
ccacttgacattcctt

SEQ ID NO: 2139344 - DNA, 16 bp, Homo sapiens
ccacttgggtcttccc

SEQ ID NO: 2139345 - DNA, 17 bp, Homo sapiens
ccacttgggtcttccct

SEQ ID NO: 2139346 - DNA, 22 bp, Homo sapiens
ccacttgtcatccataaagcaa

SEQ ID NO: 2139347 - DNA, 20 bp, Homo sapiens
ccactttgcacagctctccg

SEQ ID NO: 2139348 - DNA, 21 bp, Homo sapiens
ccactttggcttctcctgtga

SEQ ID NO: 2139349 - DNA, 18 bp, Homo sapiens
ccactttggtcccgtgca

SEQ ID NO: 2139350 - DNA, 16 bp, Homo sapiens
ccagaaaaccccagca

SEQ ID NO: 2139351 - DNA, 18 bp, Homo sapiens
ccagaaaacctccagtag

SEQ ID NO: 2139352 - DNA, 17 bp, Homo sapiens
ccagaaaatataaatgc

SEQ ID NO: 2139353 - DNA, 15 bp, Homo sapiens
ccagaaacagggaca

SEQ ID NO: 2139354 - DNA, 16 bp, Homo sapiens
ccagaaactccttttg

SEQ ID NO: 2139355 - DNA, 19 bp, Homo sapiens
ccagaaagaaggacacttg

SEQ ID NO: 2139356 - DNA, 21 bp, Homo sapiens
ccagaaagtgaggaagcctaa

SEQ ID NO: 2139357 - DNA, 16 bp, Homo sapiens
ccagaaatcattttac

SEQ ID NO: 2139358 - DNA, 17 bp, Homo sapiens
ccagaaattagaaacct

SEQ ID NO: 2139359 - DNA, 17 bp, Homo sapiens
ccagaacagtttgtaca

SEQ ID NO: 2139360 - DNA, 17 bp, Homo sapiens
ccagaaccacactgttg

SEQ ID NO: 2139361 - DNA, 17 bp, Homo sapiens
ccagaagatgccctcca

SEQ ID NO: 2139362 - DNA, 16 bp, Homo sapiens
ccagaagccaaagact

SEQ ID NO: 2139363 - DNA, 20 bp, Homo sapiens
ccagaagcccatggagcagg

SEQ ID NO: 2139364 - DNA, 23 bp, Homo sapiens
ccagaaggagggcagagccatgg

SEQ ID NO: 2139365 - DNA, 18 bp, Homo sapiens
ccagaagggagttgctca

SEQ ID NO: 2139366 - DNA, 19 bp, Homo sapiens
ccagaaggggcacgcctgc

SEQ ID NO: 2139367 - DNA, 22 bp, Homo sapiens
ccagaaggggcacgcctgccca

SEQ ID NO: 2139368 - DNA, 18 bp, Homo sapiens
ccaggctccatggggaag

SEQ ID NO: 2139369 - DNA, 21 bp, Homo sapiens
ccaggctcctttagcgcccag

SEQ ID NO: 2139370 - DNA, 13 bp, Homo sapiens
ccaggctctgcct

SEQ ID NO: 2139371 - DNA, 19 bp, Homo sapiens
ccaggctctggagccagag

SEQ ID NO: 2139372 - DNA, 15 bp, Homo sapiens
ccaggctctgggaag

SEQ ID NO: 2139373 - DNA, 21 bp, Homo sapiens
ccaggctctgggaaggggtgc

SEQ ID NO: 2139374 - DNA, 22 bp, Homo sapiens
ccaggctctttggggtcagcca

SEQ ID NO: 2139375 - DNA, 12 bp, Homo sapiens
ccaggctgcact

SEQ ID NO: 2139376 - DNA, 16 bp, Homo sapiens
ccaggctggcgtgcag

SEQ ID NO: 2139377 - DNA, 18 bp, Homo sapiens
ccaggctggcgtgcagtg

SEQ ID NO: 2139378 - DNA, 19 bp, Homo sapiens
ccaggctggcgtgcagtgg

SEQ ID NO: 2139379 - DNA, 23 bp, Homo sapiens
ccaggctggtctcgaactcctga

SEQ ID NO: 2139380 - DNA, 22 bp, Homo sapiens
ccaggctgtaagcattctgagc

SEQ ID NO: 2139381 - DNA, 24 bp, Homo sapiens
ccaggctgtatcccatgagcctca

SEQ ID NO: 2139382 - DNA, 13 bp, Homo sapiens
ccaggctgtttct

SEQ ID NO: 2139383 - DNA, 18 bp, Homo sapiens
ccaggcttcaccctgaat

SEQ ID NO: 2139384 - DNA, 23 bp, Homo sapiens
ccagggaagaaggtttgaaagat

SEQ ID NO: 2139385 - DNA, 13 bp, Homo sapiens
ccagggaggagag

SEQ ID NO: 2139386 - DNA, 15 bp, Homo sapiens
ccagggaggagagga

SEQ ID NO: 2139387 - DNA, 17 bp, Homo sapiens
ccagggatgggggatgg

SEQ ID NO: 2139388 - DNA, 21 bp, Homo sapiens
ccagggatgggggatgggcca

SEQ ID NO: 2139389 - DNA, 14 bp, Homo sapiens
ccagggcacaggag

SEQ ID NO: 2139390 - DNA, 22 bp, Homo sapiens
ccagggcacaggagctacctgt

SEQ ID NO: 2139391 - DNA, 13 bp, Homo sapiens
ccagggcagcctc

SEQ ID NO: 2139392 - DNA, 21 bp, Homo sapiens
ccagggccacgtgccaggccc

SEQ ID NO: 2139393 - DNA, 14 bp, Homo sapiens
ccagggccagggcc

SEQ ID NO: 2139394 - DNA, 17 bp, Homo sapiens
ccagggccagggccctg

SEQ ID NO: 2139395 - DNA, 19 bp, Homo sapiens
ccagggcccctccctctgc

SEQ ID NO: 2139396 - DNA, 22 bp, Homo sapiens
ccagggcccctccctctgcccc

SEQ ID NO: 2139397 - DNA, 12 bp, Homo sapiens
ccagggccctaa

SEQ ID NO: 2139398 - DNA, 14 bp, Homo sapiens
ccagggccctaacg

SEQ ID NO: 2139399 - DNA, 15 bp, Homo sapiens
ccagggccctgagct

SEQ ID NO: 2139400 - DNA, 13 bp, Homo sapiens
ccagggcctgggg

SEQ ID NO: 2139401 - DNA, 16 bp, Homo sapiens
ccagggcctgggggca

SEQ ID NO: 2139402 - DNA, 15 bp, Homo sapiens
ccagggcctgtctca

SEQ ID NO: 2139403 - DNA, 20 bp, Homo sapiens
ccagggcgggagtgggggct

SEQ ID NO: 2139404 - DNA, 15 bp, Homo sapiens
ccagggctcagcctg

SEQ ID NO: 2139405 - DNA, 16 bp, Homo sapiens
ccagggctcagcctgg

SEQ ID NO: 2139406 - DNA, 17 bp, Homo sapiens
ccagggctcgggcgctg

SEQ ID NO: 2139407 - DNA, 13 bp, Homo sapiens
ccagggctgcccc

SEQ ID NO: 2139408 - DNA, 13 bp, Homo sapiens
ccaggggaccaca

SEQ ID NO: 2139409 - DNA, 16 bp, Homo sapiens
ccaggggctccacctg

SEQ ID NO: 2139410 - DNA, 14 bp, Homo sapiens
ccaggggctgctca

SEQ ID NO: 2139411 - DNA, 21 bp, Homo sapiens
ccaggggctgctcatcaccca

SEQ ID NO: 2139412 - DNA, 17 bp, Homo sapiens
ccaggggtctccctgga

SEQ ID NO: 2139413 - DNA, 19 bp, Homo sapiens
ccaggggtgatttcagaga

SEQ ID NO: 2139414 - DNA, 20 bp, Homo sapiens
ccaggggtgatttcagagag

SEQ ID NO: 2139415 - DNA, 21 bp, Homo sapiens
ccaggggtgatttcagagagg

SEQ ID NO: 2139416 - DNA, 20 bp, Homo sapiens
ccaggggtgcctgtgggggt

SEQ ID NO: 2139417 - DNA, 14 bp, Homo sapiens
ccagggtccgcacc

SEQ ID NO: 2139418 - DNA, 16 bp, Homo sapiens
ccagggtccgcaccag

SEQ ID NO: 2139419 - DNA, 19 bp, Homo sapiens
ccagggtccgcaccagctg

SEQ ID NO: 2139420 - DNA, 22 bp, Homo sapiens
ccagggtcttgggctactggca

SEQ ID NO: 2139421 - DNA, 18 bp, Homo sapiens
ccagggtgcatggcttgg

SEQ ID NO: 2139422 - DNA, 23 bp, Homo sapiens
ccagggtgcatggcttggggagc

SEQ ID NO: 2139423 - DNA, 22 bp, Homo sapiens
ccagggtgttacaaggcacttg

SEQ ID NO: 2139424 - DNA, 23 bp, Homo sapiens
ccaggtaatgagggactggaacc

SEQ ID NO: 2139425 - DNA, 13 bp, Homo sapiens
ccaggtcctggtg

SEQ ID NO: 2139426 - DNA, 14 bp, Homo sapiens
ccaggtcctggtgg

SEQ ID NO: 2139427 - DNA, 21 bp, Homo sapiens
ccaggtcctggtggggcagct

SEQ ID NO: 2139428 - DNA, 20 bp, Homo sapiens
ccaggtctccctggatcaga

SEQ ID NO: 2139429 - DNA, 18 bp, Homo sapiens
ccaggtctctccactgct

SEQ ID NO: 2139430 - DNA, 23 bp, Homo sapiens
ccaggtctctccactgctctcag

SEQ ID NO: 2139431 - DNA, 12 bp, Homo sapiens
ccaggtgccagt

SEQ ID NO: 2139432 - DNA, 16 bp, Homo sapiens
ccaggtggccactcca

SEQ ID NO: 2139433 - DNA, 20 bp, Homo sapiens
ccaggtggctgacccagtcc

SEQ ID NO: 2139434 - DNA, 22 bp, Homo sapiens
ccaggtggctgacccagtccct

SEQ ID NO: 2139435 - DNA, 23 bp, Homo sapiens
ccaggtggctgacccagtccctg

SEQ ID NO: 2139436 - DNA, 13 bp, Homo sapiens
ccaggtgggagag

SEQ ID NO: 2139437 - DNA, 17 bp, Homo sapiens
ccaggttaggaaggcag

SEQ ID NO: 2139438 - DNA, 15 bp, Homo sapiens
ccaggttatgcctca

SEQ ID NO: 2139439 - DNA, 14 bp, Homo sapiens
ccaggttcagcttg

SEQ ID NO: 2139440 - DNA, 13 bp, Homo sapiens
ccaggttgaaaga

SEQ ID NO: 2139441 - DNA, 17 bp, Homo sapiens
ccaggtttttggtctga

SEQ ID NO: 2139442 - DNA, 15 bp, Homo sapiens
ccagtaactcatctg

SEQ ID NO: 2139443 - DNA, 16 bp, Homo sapiens
ccagtaactcatctgt

SEQ ID NO: 2139444 - DNA, 16 bp, Homo sapiens
ccagtacgtgctaaca

SEQ ID NO: 2139445 - DNA, 17 bp, Homo sapiens
ccagtactgggaaggag

SEQ ID NO: 2139446 - DNA, 13 bp, Homo sapiens
ccagtacttctaa

SEQ ID NO: 2139447 - DNA, 13 bp, Homo sapiens
ccagtagtcagaa

SEQ ID NO: 2139448 - DNA, 15 bp, Homo sapiens
ccagtatgagcccta

SEQ ID NO: 2139449 - DNA, 20 bp, Homo sapiens
ccagtatggaagggaggggt

SEQ ID NO: 2139450 - DNA, 22 bp, Homo sapiens
ccagtcccagaaccacactgtt

SEQ ID NO: 2139451 - DNA, 13 bp, Homo sapiens
ccagtcccagagc

SEQ ID NO: 2139452 - DNA, 15 bp, Homo sapiens
ccagtcccagagcag

SEQ ID NO: 2139453 - DNA, 15 bp, Homo sapiens
ccagtccccgtgccc

SEQ ID NO: 2139454 - DNA, 22 bp, Homo sapiens
ccagtccccgtgccccgcctcc

SEQ ID NO: 2139455 - DNA, 12 bp, Homo sapiens
ccagtccctggg

SEQ ID NO: 2139456 - DNA, 15 bp, Homo sapiens
ccagtccctggggga

SEQ ID NO: 2139457 - DNA, 14 bp, Homo sapiens
ccagtcctagagct

SEQ ID NO: 2139458 - DNA, 15 bp, Homo sapiens
ccagtcctagagctc

SEQ ID NO: 2139459 - DNA, 17 bp, Homo sapiens
ccagtcctagagctcct

SEQ ID NO: 2139460 - DNA, 20 bp, Homo sapiens
ccagtcctagagctcctgtc

SEQ ID NO: 2139461 - DNA, 22 bp, Homo sapiens
ccagtcctagagctcctgtccc

SEQ ID NO: 2139462 - DNA, 23 bp, Homo sapiens
ccagtcctagagctcctgtccct

SEQ ID NO: 2139463 - DNA, 18 bp, Homo sapiens
ccagtcgatatctcactt

SEQ ID NO: 2139464 - DNA, 22 bp, Homo sapiens
ccagtctacgttctccagccca

SEQ ID NO: 2139465 - DNA, 23 bp, Homo sapiens
ccagtctacgttctccagcccac

SEQ ID NO: 2139466 - DNA, 15 bp, Homo sapiens
ccagtctcctgacat

SEQ ID NO: 2139467 - DNA, 19 bp, Homo sapiens
ccagtctgggctgccgggt

SEQ ID NO: 2139468 - DNA, 17 bp, Homo sapiens
ccagtctgggtctgggt

SEQ ID NO: 2139469 - DNA, 13 bp, Homo sapiens
ccagtcttgccta

SEQ ID NO: 2139470 - DNA, 17 bp, Homo sapiens
ccagtcttgcctaggcc

SEQ ID NO: 2139471 - DNA, 23 bp, Homo sapiens
ccagtgaacttacacttggagcc

SEQ ID NO: 2139472 - DNA, 12 bp, Homo sapiens
ccagtgaagact

SEQ ID NO: 2139473 - DNA, 18 bp, Homo sapiens
ccagtgacctgaccggca

SEQ ID NO: 2139474 - DNA, 16 bp, Homo sapiens
ccagtgagggctgggc

SEQ ID NO: 2139475 - DNA, 21 bp, Homo sapiens
ccagtgatgctaaaggttgta

SEQ ID NO: 2139476 - DNA, 15 bp, Homo sapiens
ccagtgatgtgctgg

SEQ ID NO: 2139477 - DNA, 16 bp, Homo sapiens
ccagtgatgtgctgga

SEQ ID NO: 2139478 - DNA, 20 bp, Homo sapiens
ccagtgcacttgctggaaga

SEQ ID NO: 2139479 - DNA, 20 bp, Homo sapiens
ccagtgcatgttgccatgag

SEQ ID NO: 2139480 - DNA, 13 bp, Homo sapiens
ccagtgccacaga

SEQ ID NO: 2139481 - DNA, 14 bp, Homo sapiens
ccagtgccacagag

SEQ ID NO: 2139482 - DNA, 18 bp, Homo sapiens
ccagtgccacagagaaga

SEQ ID NO: 2139483 - DNA, 19 bp, Homo sapiens
cccacctttctcgctggaa

SEQ ID NO: 2139484 - DNA, 17 bp, Homo sapiens
cccacgaacgctcttag

SEQ ID NO: 2139485 - DNA, 13 bp, Homo sapiens
cccacgagtcacc

SEQ ID NO: 2139486 - DNA, 16 bp, Homo sapiens
cccacgagtcacctgc

SEQ ID NO: 2139487 - DNA, 17 bp, Homo sapiens
cccacgagtcacctgca

SEQ ID NO: 2139488 - DNA, 18 bp, Homo sapiens
cccacgagtcacctgcaa

SEQ ID NO: 2139489 - DNA, 19 bp, Homo sapiens
cccacgctggagtgcagtg

SEQ ID NO: 2139490 - DNA, 23 bp, Homo sapiens
cccacgtgagagaatctgcctgt

SEQ ID NO: 2139491 - DNA, 20 bp, Homo sapiens
cccactaagctttctccttt

SEQ ID NO: 2139492 - DNA, 17 bp, Homo sapiens
cccactatcctcactcc

SEQ ID NO: 2139493 - DNA, 15 bp, Homo sapiens
cccactcaccagggt

SEQ ID NO: 2139494 - DNA, 13 bp, Homo sapiens
cccactccagccc

SEQ ID NO: 2139495 - DNA, 15 bp, Homo sapiens
cccactccagccctg

SEQ ID NO: 2139496 - DNA, 17 bp, Homo sapiens
cccactccagccctgtc

SEQ ID NO: 2139497 - DNA, 17 bp, Homo sapiens
cccactccccaccttca

SEQ ID NO: 2139498 - DNA, 14 bp, Homo sapiens
cccactctcattcc

SEQ ID NO: 2139499 - DNA, 14 bp, Homo sapiens
cccactctgctctg

SEQ ID NO: 2139500 - DNA, 15 bp, Homo sapiens
cccactctgctctga

SEQ ID NO: 2139501 - DNA, 17 bp, Homo sapiens
cccactctgctctgatg

SEQ ID NO: 2139502 - DNA, 17 bp, Homo sapiens
cccactgccacaccctc

SEQ ID NO: 2139503 - DNA, 13 bp, Homo sapiens
cccactgctctgg

SEQ ID NO: 2139504 - DNA, 19 bp, Homo sapiens
cccactgcttttggtctgt

SEQ ID NO: 2139505 - DNA, 16 bp, Homo sapiens
cccactggactgggtt

SEQ ID NO: 2139506 - DNA, 17 bp, Homo sapiens
cccactggccagtccta

SEQ ID NO: 2139507 - DNA, 21 bp, Homo sapiens
cccactggccagtcctagagc

SEQ ID NO: 2139508 - DNA, 19 bp, Homo sapiens
cccactgtgcttacagtga

SEQ ID NO: 2139509 - DNA, 22 bp, Homo sapiens
cccactgtgcttacagtgactg

SEQ ID NO: 2139510 - DNA, 21 bp, Homo sapiens
cccacttagccgtccatggca

SEQ ID NO: 2139511 - DNA, 12 bp, Homo sapiens
cccacttctgcc

SEQ ID NO: 2139512 - DNA, 15 bp, Homo sapiens
cccacttgaggctgg

SEQ ID NO: 2139513 - DNA, 13 bp, Homo sapiens
cccacttgtcatc

SEQ ID NO: 2139514 - DNA, 19 bp, Homo sapiens
cccactttcctacaaaatg

SEQ ID NO: 2139515 - DNA, 18 bp, Homo sapiens
cccagaaaacctccagta

SEQ ID NO: 2139516 - DNA, 18 bp, Homo sapiens
cccagaaattccttccca

SEQ ID NO: 2139517 - DNA, 22 bp, Homo sapiens
cccagaacccttcctgagacct

SEQ ID NO: 2139518 - DNA, 13 bp, Homo sapiens
cccagaaggcagg

SEQ ID NO: 2139519 - DNA, 17 bp, Homo sapiens
cccagaattcccagctg

SEQ ID NO: 2139520 - DNA, 19 bp, Homo sapiens
cccagacacaccccccagt

SEQ ID NO: 2139521 - DNA, 16 bp, Homo sapiens
cccagacactggtttg

SEQ ID NO: 2139522 - DNA, 17 bp, Homo sapiens
cccagaccacctccctg

SEQ ID NO: 2139523 - DNA, 21 bp, Homo sapiens
cccagaccttttatccactta

SEQ ID NO: 2139524 - DNA, 16 bp, Homo sapiens
cccagactcagctcca

SEQ ID NO: 2139525 - DNA, 22 bp, Homo sapiens
cccagacttctctttcttattt

SEQ ID NO: 2139526 - DNA, 19 bp, Homo sapiens
cccagactttctacacctg

SEQ ID NO: 2139527 - DNA, 14 bp, Homo sapiens
cccagagacaggaa

SEQ ID NO: 2139528 - DNA, 23 bp, Homo sapiens
cccagagaccccttcctttcctc

SEQ ID NO: 2139529 - DNA, 22 bp, Homo sapiens
cccagagaccttttctctccca

SEQ ID NO: 2139530 - DNA, 21 bp, Homo sapiens
cccagagaggaatcagacttc

SEQ ID NO: 2139531 - DNA, 22 bp, Homo sapiens
cccagagaggggacatttccct

SEQ ID NO: 2139532 - DNA, 17 bp, Homo sapiens
cccagagatgcctccac

SEQ ID NO: 2139533 - DNA, 20 bp, Homo sapiens
cccagagatgcctccaccgc

SEQ ID NO: 2139534 - DNA, 18 bp, Homo sapiens
cccagagcacaagttcca

SEQ ID NO: 2139535 - DNA, 21 bp, Homo sapiens
cccagagcattacgtgagcca

SEQ ID NO: 2139536 - DNA, 20 bp, Homo sapiens
cccagagccttctcctgcct

SEQ ID NO: 2139537 - DNA, 14 bp, Homo sapiens
cccagaggcctctc

SEQ ID NO: 2139538 - DNA, 16 bp, Homo sapiens
cccagagggcccaggc

SEQ ID NO: 2139539 - DNA, 18 bp, Homo sapiens
cccagagggcccaggcag

SEQ ID NO: 2139540 - DNA, 18 bp, Homo sapiens
cccagagggtagggcagc

SEQ ID NO: 2139541 - DNA, 21 bp, Homo sapiens
cccagagggtagggcagcaga

SEQ ID NO: 2139542 - DNA, 20 bp, Homo sapiens
cccagaggttatctgcctgg

SEQ ID NO: 2139543 - DNA, 17 bp, Homo sapiens
cccagagtggagtctga

SEQ ID NO: 2139544 - DNA, 19 bp, Homo sapiens
cccagagtggagtctgagt

SEQ ID NO: 2139545 - DNA, 15 bp, Homo sapiens
cccagagtgtgaaac

SEQ ID NO: 2139546 - DNA, 16 bp, Homo sapiens
cccagagtgtgggaag

SEQ ID NO: 2139547 - DNA, 23 bp, Homo sapiens
cccagagtgtgggaagggagagc

SEQ ID NO: 2139548 - DNA, 13 bp, Homo sapiens
cccagatctgcct

SEQ ID NO: 2139549 - DNA, 23 bp, Homo sapiens
cccagatctgcctgggcctgtgc

SEQ ID NO: 2139550 - DNA, 15 bp, Homo sapiens
cccagatgctgggga

SEQ ID NO: 2139551 - DNA, 20 bp, Homo sapiens
cccagattgcaacaggctgg

SEQ ID NO: 2139552 - DNA, 20 bp, Homo sapiens
cccagcaagtgagagctggg

SEQ ID NO: 2139553 - DNA, 22 bp, Homo sapiens
cccagcaagtgagagctgggtg

SEQ ID NO: 2139554 - DNA, 23 bp, Homo sapiens
cccagcaagtgagagctgggtgt

SEQ ID NO: 2139555 - DNA, 16 bp, Homo sapiens
cccagcactaaagcag

SEQ ID NO: 2139556 - DNA, 20 bp, Homo sapiens
cccagcactaaggccgtgtc

SEQ ID NO: 2139557 - DNA, 21 bp, Homo sapiens
cccagcactaaggccgtgtct

SEQ ID NO: 2139558 - DNA, 15 bp, Homo sapiens
cccagcactcctctg

SEQ ID NO: 2139559 - DNA, 12 bp, Homo sapiens
cccagcactgtg

SEQ ID NO: 2139560 - DNA, 15 bp, Homo sapiens
cccagcactttggga

SEQ ID NO: 2139561 - DNA, 23 bp, Homo sapiens
cccagcactttgggaggctgaag

SEQ ID NO: 2139562 - DNA, 16 bp, Homo sapiens
cccagcacttttggag

SEQ ID NO: 2139563 - DNA, 14 bp, Homo sapiens
cccagcagctgggc

SEQ ID NO: 2139564 - DNA, 21 bp, Homo sapiens
cccagcagctgggccggccag

SEQ ID NO: 2139565 - DNA, 21 bp, Homo sapiens
cccagcaggaagccaggctga

SEQ ID NO: 2139566 - DNA, 16 bp, Homo sapiens
cccagcagtttgggag

SEQ ID NO: 2139567 - DNA, 14 bp, Homo sapiens
cccagccacctccc

SEQ ID NO: 2139568 - DNA, 16 bp, Homo sapiens
cccagcccaaagctgt

SEQ ID NO: 2139569 - DNA, 13 bp, Homo sapiens
cccagcccacaga

SEQ ID NO: 2139570 - DNA, 16 bp, Homo sapiens
cccagcccacagagcc

SEQ ID NO: 2139571 - DNA, 18 bp, Homo sapiens
cccagcccacagagcctg

SEQ ID NO: 2139572 - DNA, 19 bp, Homo sapiens
cccagcccacagagcctga

SEQ ID NO: 2139573 - DNA, 21 bp, Homo sapiens
cccagcccattctctctcctg

SEQ ID NO: 2139574 - DNA, 13 bp, Homo sapiens
cccagccccaggg

SEQ ID NO: 2139575 - DNA, 13 bp, Homo sapiens
cccagcccccacc

SEQ ID NO: 2139576 - DNA, 18 bp, Homo sapiens
cccagccccctaagagag

SEQ ID NO: 2139577 - DNA, 19 bp, Homo sapiens
cccagccccgactccagcc

SEQ ID NO: 2139578 - DNA, 20 bp, Homo sapiens
cccagccccgactccagcca

SEQ ID NO: 2139579 - DNA, 21 bp, Homo sapiens
cccagccccgactccagccag

SEQ ID NO: 2139580 - DNA, 23 bp, Homo sapiens
cccagccccgactccagccagcg

SEQ ID NO: 2139581 - DNA, 23 bp, Homo sapiens
cccagcccctcctccccttcctg

SEQ ID NO: 2139582 - DNA, 14 bp, Homo sapiens
cccagccctgccag

SEQ ID NO: 2139583 - DNA, 15 bp, Homo sapiens
cccagccctgccagg

SEQ ID NO: 2139584 - DNA, 17 bp, Homo sapiens
cccagccctgccaggag

SEQ ID NO: 2139585 - DNA, 18 bp, Homo sapiens
cccagccctgccaggagg

SEQ ID NO: 2139586 - DNA, 18 bp, Homo sapiens
cccagcccttctgccttt

SEQ ID NO: 2139587 - DNA, 13 bp, Homo sapiens
cccagccgcagga

SEQ ID NO: 2139588 - DNA, 18 bp, Homo sapiens
cccagccgcaggaaggca

SEQ ID NO: 2139589 - DNA, 18 bp, Homo sapiens
cccagcctcctcccacca

SEQ ID NO: 2139590 - DNA, 23 bp, Homo sapiens
cccagcctcgcatgccagagcct

SEQ ID NO: 2139591 - DNA, 13 bp, Homo sapiens
cccagcctctgtc

SEQ ID NO: 2139592 - DNA, 11 bp, Homo sapiens
cccagcctggg

SEQ ID NO: 2139593 - DNA, 12 bp, Homo sapiens
cccagcctgggc

SEQ ID NO: 2139594 - DNA, 18 bp, Homo sapiens
cccagcctgggcctatgg

SEQ ID NO: 2139595 - DNA, 19 bp, Homo sapiens
cccagcctgtcctggtaca

SEQ ID NO: 2139596 - DNA, 22 bp, Homo sapiens
cccagcctgtcctggtacagca

SEQ ID NO: 2139597 - DNA, 17 bp, Homo sapiens
ccccaggcctctgtgtc

SEQ ID NO: 2139598 - DNA, 22 bp, Homo sapiens
ccccagggacaaaacactgtgt

SEQ ID NO: 2139599 - DNA, 12 bp, Homo sapiens
ccccagggcaca

SEQ ID NO: 2139600 - DNA, 22 bp, Homo sapiens
ccccagggcacaggagctacct

SEQ ID NO: 2139601 - DNA, 23 bp, Homo sapiens
ccccagggcacaggagctacctg

SEQ ID NO: 2139602 - DNA, 13 bp, Homo sapiens
ccccagggcccct

SEQ ID NO: 2139603 - DNA, 12 bp, Homo sapiens
ccccagggcctg

SEQ ID NO: 2139604 - DNA, 18 bp, Homo sapiens
ccccaggggaaaatgaag

SEQ ID NO: 2139605 - DNA, 17 bp, Homo sapiens
ccccaggtctctccact

SEQ ID NO: 2139606 - DNA, 13 bp, Homo sapiens
ccccaggtggctg

SEQ ID NO: 2139607 - DNA, 23 bp, Homo sapiens
ccccaggtggctgacccagtccc

SEQ ID NO: 2139608 - DNA, 11 bp, Homo sapiens
ccccagtccca

SEQ ID NO: 2139609 - DNA, 15 bp, Homo sapiens
ccccagtgccacaga

SEQ ID NO: 2139610 - DNA, 17 bp, Homo sapiens
ccccagtgtggccccag

SEQ ID NO: 2139611 - DNA, 16 bp, Homo sapiens
ccccagttctgctcct

SEQ ID NO: 2139612 - DNA, 23 bp, Homo sapiens
ccccagtttgcagaaaagcacct

SEQ ID NO: 2139613 - DNA, 22 bp, Homo sapiens
ccccataattttttttttcctt

SEQ ID NO: 2139614 - DNA, 13 bp, Homo sapiens
ccccatcccacat

SEQ ID NO: 2139615 - DNA, 15 bp, Homo sapiens
ccccatcccctttcc

SEQ ID NO: 2139616 - DNA, 14 bp, Homo sapiens
ccccatcccttcct

SEQ ID NO: 2139617 - DNA, 14 bp, Homo sapiens
ccccatctccccag

SEQ ID NO: 2139618 - DNA, 16 bp, Homo sapiens
ccccatctccccaggc

SEQ ID NO: 2139619 - DNA, 19 bp, Homo sapiens
ccccatctccccaggcctc

SEQ ID NO: 2139620 - DNA, 20 bp, Homo sapiens
ccccatctccccaggcctcc

SEQ ID NO: 2139621 - DNA, 21 bp, Homo sapiens
ccccatctcctcccatggcct

SEQ ID NO: 2139622 - DNA, 14 bp, Homo sapiens
ccccatctgggtcc

SEQ ID NO: 2139623 - DNA, 19 bp, Homo sapiens
ccccatctgggtccttgca

SEQ ID NO: 2139624 - DNA, 21 bp, Homo sapiens
ccccatgctctgccccaagcc

SEQ ID NO: 2139625 - DNA, 14 bp, Homo sapiens
ccccatgggcttgg

SEQ ID NO: 2139626 - DNA, 22 bp, Homo sapiens
ccccatgggcttggacttcctg

SEQ ID NO: 2139627 - DNA, 21 bp, Homo sapiens
ccccatgtttaaactttgtgc

SEQ ID NO: 2139628 - DNA, 15 bp, Homo sapiens
ccccattcacagagc

SEQ ID NO: 2139629 - DNA, 13 bp, Homo sapiens
ccccattctgcct

SEQ ID NO: 2139630 - DNA, 14 bp, Homo sapiens
ccccattctgcctg

SEQ ID NO: 2139631 - DNA, 23 bp, Homo sapiens
ccccattcttcctagttttctcc

SEQ ID NO: 2139632 - DNA, 18 bp, Homo sapiens
ccccatttaggtttctga

SEQ ID NO: 2139633 - DNA, 20 bp, Homo sapiens
ccccatttgctttcttttct

SEQ ID NO: 2139634 - DNA, 12 bp, Homo sapiens
cccccaaaaaaa

SEQ ID NO: 2139635 - DNA, 23 bp, Homo sapiens
cccccaaccaagtggctcccaca

SEQ ID NO: 2139636 - DNA, 19 bp, Homo sapiens
cccccaagctgttttcttc

SEQ ID NO: 2139637 - DNA, 12 bp, Homo sapiens
cccccaccccct

SEQ ID NO: 2139638 - DNA, 23 bp, Homo sapiens
cccccacctccgccccagacaca

SEQ ID NO: 2139639 - DNA, 20 bp, Homo sapiens
cccccacctggctcaccttg

SEQ ID NO: 2139640 - DNA, 18 bp, Homo sapiens
cccccacctttctcgctg

SEQ ID NO: 2139641 - DNA, 21 bp, Homo sapiens
cccccactctcattccccagg

SEQ ID NO: 2139642 - DNA, 14 bp, Homo sapiens
cccccagagacctt

SEQ ID NO: 2139643 - DNA, 14 bp, Homo sapiens
cccccagccctcag

SEQ ID NO: 2139644 - DNA, 13 bp, Homo sapiens
cccccagcctggg

SEQ ID NO: 2139645 - DNA, 16 bp, Homo sapiens
cccccagcctgggcct

SEQ ID NO: 2139646 - DNA, 23 bp, Homo sapiens
cccccagctttgctaccaaagca

SEQ ID NO: 2139647 - DNA, 23 bp, Homo sapiens
cccccagtcgagccctgcagcca

SEQ ID NO: 2139648 - DNA, 11 bp, Homo sapiens
cccccatcccc

SEQ ID NO: 2139649 - DNA, 18 bp, Homo sapiens
cccccatctccccaggcc

SEQ ID NO: 2139650 - DNA, 13 bp, Homo sapiens
ccccccagcccct

SEQ ID NO: 2139651 - DNA, 13 bp, Homo sapiens
cccccctccaggc

SEQ ID NO: 2139652 - DNA, 13 bp, Homo sapiens
cccccgacactgc

SEQ ID NO: 2139653 - DNA, 16 bp, Homo sapiens
cccccgacactgctgc

SEQ ID NO: 2139654 - DNA, 16 bp, Homo sapiens
cccccgacagcccagc

SEQ ID NO: 2139655 - DNA, 23 bp, Homo sapiens
cccccgcagtccccagcccttct

SEQ ID NO: 2139656 - DNA, 17 bp, Homo sapiens
cccccgccacggccacc

SEQ ID NO: 2139657 - DNA, 18 bp, Homo sapiens
cccccgctggcagccacc

SEQ ID NO: 2139658 - DNA, 13 bp, Homo sapiens
ccccctccagctc

SEQ ID NO: 2139659 - DNA, 15 bp, Homo sapiens
ccccctccagctcca

SEQ ID NO: 2139660 - DNA, 20 bp, Homo sapiens
ccccctccaggcatgctggc

SEQ ID NO: 2139661 - DNA, 13 bp, Homo sapiens
ccccctcccaggg

SEQ ID NO: 2139662 - DNA, 23 bp, Homo sapiens
ccccctgagtcaactggagcaag

SEQ ID NO: 2139663 - DNA, 14 bp, Homo sapiens
ccccctgcagcttg

SEQ ID NO: 2139664 - DNA, 12 bp, Homo sapiens
ccccctggagag

SEQ ID NO: 2139665 - DNA, 18 bp, Homo sapiens
ccccctggatgtcccctg

SEQ ID NO: 2139666 - DNA, 13 bp, Homo sapiens
ccccctgggctct

SEQ ID NO: 2139667 - DNA, 19 bp, Homo sapiens
ccccctggggcttctcctg

SEQ ID NO: 2139668 - DNA, 23 bp, Homo sapiens
ccccctggggcttctcctgaccc

SEQ ID NO: 2139669 - DNA, 20 bp, Homo sapiens
ccccctggtggacagtcctg

SEQ ID NO: 2139670 - DNA, 15 bp, Homo sapiens
ccccctgtgccagct

SEQ ID NO: 2139671 - DNA, 16 bp, Homo sapiens
ccccctgtgccagctc

SEQ ID NO: 2139672 - DNA, 14 bp, Homo sapiens
cccccttcagtgcc

SEQ ID NO: 2139673 - DNA, 16 bp, Homo sapiens
cccccttccccttctg

SEQ ID NO: 2139674 - DNA, 20 bp, Homo sapiens
cccccttgaatctgcaggga

SEQ ID NO: 2139675 - DNA, 19 bp, Homo sapiens
cccccttggaggagggctg

SEQ ID NO: 2139676 - DNA, 12 bp, Homo sapiens
ccccgacactgc

SEQ ID NO: 2139677 - DNA, 16 bp, Homo sapiens
ccccgacactgctgca

SEQ ID NO: 2139678 - DNA, 18 bp, Homo sapiens
ccccgacactgctgcacc

SEQ ID NO: 2139679 - DNA, 15 bp, Homo sapiens
ccccgacagcccagc

SEQ ID NO: 2139680 - DNA, 13 bp, Homo sapiens
ccccgactccagc

SEQ ID NO: 2139681 - DNA, 14 bp, Homo sapiens
ccccgactccagcc

SEQ ID NO: 2139682 - DNA, 18 bp, Homo sapiens
ccccgactccagccagcg

SEQ ID NO: 2139683 - DNA, 16 bp, Homo sapiens
ccccgacttcatccca

SEQ ID NO: 2139684 - DNA, 15 bp, Homo sapiens
ccccgcagagctccc

SEQ ID NO: 2139685 - DNA, 14 bp, Homo sapiens
ccccgccctctgcg

SEQ ID NO: 2139686 - DNA, 15 bp, Homo sapiens
ccccgcctcccagcc

SEQ ID NO: 2139687 - DNA, 17 bp, Homo sapiens
ccccgcctgtcctgcct

SEQ ID NO: 2139688 - DNA, 22 bp, Homo sapiens
ccccgcctgtcctgcctctctg

SEQ ID NO: 2139689 - DNA, 18 bp, Homo sapiens
ccccgcggtgctctggcg

SEQ ID NO: 2139690 - DNA, 14 bp, Homo sapiens
ccccgctccagatc

SEQ ID NO: 2139691 - DNA, 16 bp, Homo sapiens
ccccgcttccccacag

SEQ ID NO: 2139692 - DNA, 19 bp, Homo sapiens
ccccgcttccccacagaac

SEQ ID NO: 2139693 - DNA, 17 bp, Homo sapiens
ccccgcttgtccagcgc

SEQ ID NO: 2139694 - DNA, 24 bp, Homo sapiens
ccccggctgcttccttctgcaccc

SEQ ID NO: 2139695 - DNA, 17 bp, Homo sapiens
ccccgggctctggccac

SEQ ID NO: 2139696 - DNA, 13 bp, Homo sapiens
ccccggggctggc

SEQ ID NO: 2139697 - DNA, 17 bp, Homo sapiens
ccccgggtccccagctc

SEQ ID NO: 2139698 - DNA, 15 bp, Homo sapiens
ccccggtcccttgag

SEQ ID NO: 2139699 - DNA, 24 bp, Homo sapiens
ccccggtcccttgagacctcagcc

SEQ ID NO: 2139700 - DNA, 14 bp, Homo sapiens
ccccgtctctacta

SEQ ID NO: 2139701 - DNA, 20 bp, Homo sapiens
ccccgtctggggttcagccc

SEQ ID NO: 2139702 - DNA, 22 bp, Homo sapiens
ccccgtctggggttcagcccct

SEQ ID NO: 2139703 - DNA, 17 bp, Homo sapiens
ccccgtggtctttgaat

SEQ ID NO: 2139704 - DNA, 22 bp, Homo sapiens
ccccgtggtctttgaataaagt

SEQ ID NO: 2139705 - DNA, 14 bp, Homo sapiens
ccccgtgtggctta

SEQ ID NO: 2139706 - DNA, 16 bp, Homo sapiens
cccctaacctggctta

SEQ ID NO: 2139707 - DNA, 18 bp, Homo sapiens
cccctactcccctgatcc

SEQ ID NO: 2139708 - DNA, 14 bp, Homo sapiens
cccctatccaccca

SEQ ID NO: 2139709 - DNA, 17 bp, Homo sapiens
cccctatccacccagcc

SEQ ID NO: 2139710 - DNA, 20 bp, Homo sapiens
cccctatccacccagcccat

SEQ ID NO: 2139711 - DNA, 15 bp, Homo sapiens
cccctcacctgggcc

SEQ ID NO: 2139712 - DNA, 14 bp, Homo sapiens
ccctgggtgccatt

SEQ ID NO: 2139713 - DNA, 15 bp, Homo sapiens
ccctggtgcagaggt

SEQ ID NO: 2139714 - DNA, 13 bp, Homo sapiens
ccctggtgctgcc

SEQ ID NO: 2139715 - DNA, 16 bp, Homo sapiens
ccctggtgctgccaca

SEQ ID NO: 2139716 - DNA, 20 bp, Homo sapiens
ccctggtggacagtcctggg

SEQ ID NO: 2139717 - DNA, 21 bp, Homo sapiens
ccctggtggacagtcctggga

SEQ ID NO: 2139718 - DNA, 13 bp, Homo sapiens
ccctggtggcagt

SEQ ID NO: 2139719 - DNA, 14 bp, Homo sapiens
ccctggtggcagtg

SEQ ID NO: 2139720 - DNA, 19 bp, Homo sapiens
ccctggttatattctcacg

SEQ ID NO: 2139721 - DNA, 20 bp, Homo sapiens
ccctgtaaatagttttaaat

SEQ ID NO: 2139722 - DNA, 18 bp, Homo sapiens
ccctgtacaatatttaaa

SEQ ID NO: 2139723 - DNA, 14 bp, Homo sapiens
ccctgtacccagct

SEQ ID NO: 2139724 - DNA, 15 bp, Homo sapiens
ccctgtagagtcact

SEQ ID NO: 2139725 - DNA, 14 bp, Homo sapiens
ccctgtcaccaagc

SEQ ID NO: 2139726 - DNA, 17 bp, Homo sapiens
ccctgtcagaggctaag

SEQ ID NO: 2139727 - DNA, 12 bp, Homo sapiens
ccctgtcccacc

SEQ ID NO: 2139728 - DNA, 21 bp, Homo sapiens
ccctgtcccaccaactctgca

SEQ ID NO: 2139729 - DNA, 22 bp, Homo sapiens
ccctgtcccaccaactctgcac

SEQ ID NO: 2139730 - DNA, 12 bp, Homo sapiens
ccctgtcccagc

SEQ ID NO: 2139731 - DNA, 16 bp, Homo sapiens
ccctgtcgagacactt

SEQ ID NO: 2139732 - DNA, 14 bp, Homo sapiens
ccctgtctaaaaaa

SEQ ID NO: 2139733 - DNA, 18 bp, Homo sapiens
ccctgtcttctctcaaag

SEQ ID NO: 2139734 - DNA, 19 bp, Homo sapiens
ccctgtcttctctcaaagg

SEQ ID NO: 2139735 - DNA, 11 bp, Homo sapiens
ccctgtgccag

SEQ ID NO: 2139736 - DNA, 14 bp, Homo sapiens
ccctgtgccagctc

SEQ ID NO: 2139737 - DNA, 18 bp, Homo sapiens
ccctgtgggggtggccat

SEQ ID NO: 2139738 - DNA, 16 bp, Homo sapiens
ccctgttatctgctag

SEQ ID NO: 2139739 - DNA, 17 bp, Homo sapiens
ccctgttctcagctccg

SEQ ID NO: 2139740 - DNA, 19 bp, Homo sapiens
ccctgttctcagctccgtc

SEQ ID NO: 2139741 - DNA, 20 bp, Homo sapiens
ccctgttctcagctccgtca

SEQ ID NO: 2139742 - DNA, 21 bp, Homo sapiens
ccctgtttaatatttaaacag

SEQ ID NO: 2139743 - DNA, 14 bp, Homo sapiens
ccctgtttcctgag

SEQ ID NO: 2139744 - DNA, 14 bp, Homo sapiens
ccctgttttccaca

SEQ ID NO: 2139745 - DNA, 14 bp, Homo sapiens
cccttaaaatagaa

SEQ ID NO: 2139746 - DNA, 20 bp, Homo sapiens
cccttaaggaggtagctccc

SEQ ID NO: 2139747 - DNA, 20 bp, Homo sapiens
cccttaagggttgaaggcag

SEQ ID NO: 2139748 - DNA, 16 bp, Homo sapiens
cccttacacgtacctc

SEQ ID NO: 2139749 - DNA, 23 bp, Homo sapiens
cccttactacttcttggaaaaaa

SEQ ID NO: 2139750 - DNA, 19 bp, Homo sapiens
cccttactatgatctcagg

SEQ ID NO: 2139751 - DNA, 20 bp, Homo sapiens
cccttactatgatctcagga

SEQ ID NO: 2139752 - DNA, 22 bp, Homo sapiens
cccttagagattgccccagagc

SEQ ID NO: 2139753 - DNA, 14 bp, Homo sapiens
cccttcaaccattc

SEQ ID NO: 2139754 - DNA, 19 bp, Homo sapiens
cccttcagaacagaggcat

SEQ ID NO: 2139755 - DNA, 19 bp, Homo sapiens
cccttcagggccagaagga

SEQ ID NO: 2139756 - DNA, 13 bp, Homo sapiens
cccttcagtgccc

SEQ ID NO: 2139757 - DNA, 18 bp, Homo sapiens
cccttccacctcctagag

SEQ ID NO: 2139758 - DNA, 22 bp, Homo sapiens
cccttccagtggtaccagctca

SEQ ID NO: 2139759 - DNA, 21 bp, Homo sapiens
cccttcccaatcagcactgaa

SEQ ID NO: 2139760 - DNA, 16 bp, Homo sapiens
cccttcccactggagg

SEQ ID NO: 2139761 - DNA, 14 bp, Homo sapiens
cccttccccaagaa

SEQ ID NO: 2139762 - DNA, 13 bp, Homo sapiens
cccttccccttct

SEQ ID NO: 2139763 - DNA, 17 bp, Homo sapiens
cccttcctcctcctttg

SEQ ID NO: 2139764 - DNA, 12 bp, Homo sapiens
cccttcctcctg

SEQ ID NO: 2139765 - DNA, 21 bp, Homo sapiens
cccttcctcctgaagcctctg

SEQ ID NO: 2139766 - DNA, 22 bp, Homo sapiens
cccttcctcctgaagcctctgc

SEQ ID NO: 2139767 - DNA, 17 bp, Homo sapiens
cccttcctctccactgc

SEQ ID NO: 2139768 - DNA, 14 bp, Homo sapiens
cccttcctggcctc

SEQ ID NO: 2139769 - DNA, 13 bp, Homo sapiens
cccttcctttcct

SEQ ID NO: 2139770 - DNA, 14 bp, Homo sapiens
cccttcctttcctc

SEQ ID NO: 2139771 - DNA, 15 bp, Homo sapiens
cccttcctttcctct

SEQ ID NO: 2139772 - DNA, 14 bp, Homo sapiens
cccttcgctgccag

SEQ ID NO: 2139773 - DNA, 18 bp, Homo sapiens
cccttcgctgccaggaca

SEQ ID NO: 2139774 - DNA, 14 bp, Homo sapiens
cccttcgggagggc

SEQ ID NO: 2139775 - DNA, 23 bp, Homo sapiens
cccttctatgcagtattgccaca

SEQ ID NO: 2139776 - DNA, 17 bp, Homo sapiens
cccttctctccttccct

SEQ ID NO: 2139777 - DNA, 12 bp, Homo sapiens
cccttcttccct

SEQ ID NO: 2139778 - DNA, 13 bp, Homo sapiens
cccttctttaaat

SEQ ID NO: 2139779 - DNA, 13 bp, Homo sapiens
cccttctttcctc

SEQ ID NO: 2139780 - DNA, 11 bp, Homo sapiens
cccttcttttt

SEQ ID NO: 2139781 - DNA, 16 bp, Homo sapiens
cccttgaatctgcagg

SEQ ID NO: 2139782 - DNA, 15 bp, Homo sapiens
cccttgagacctcag

SEQ ID NO: 2139783 - DNA, 18 bp, Homo sapiens
cccttgagacctcagcca

SEQ ID NO: 2139784 - DNA, 19 bp, Homo sapiens
cccttgagacctcagccat

SEQ ID NO: 2139785 - DNA, 20 bp, Homo sapiens
cccttgagacctcagccatg

SEQ ID NO: 2139786 - DNA, 18 bp, Homo sapiens
cccttgagctccccaaaa

SEQ ID NO: 2139787 - DNA, 15 bp, Homo sapiens
cccttgccagacatg

SEQ ID NO: 2139788 - DNA, 14 bp, Homo sapiens
cccttgcccagggc

SEQ ID NO: 2139789 - DNA, 13 bp, Homo sapiens
cccttgccctgac

SEQ ID NO: 2139790 - DNA, 19 bp, Homo sapiens
cccttgccctgacctccca

SEQ ID NO: 2139791 - DNA, 18 bp, Homo sapiens
cccttgcccttgccctga

SEQ ID NO: 2139792 - DNA, 16 bp, Homo sapiens
cccttgctcagtgcct

SEQ ID NO: 2139793 - DNA, 20 bp, Homo sapiens
cccttgctgacatggctttg

SEQ ID NO: 2139794 - DNA, 15 bp, Homo sapiens
cccttggaggagggc

SEQ ID NO: 2139795 - DNA, 20 bp, Homo sapiens
cccttggcgggcagcccagc

SEQ ID NO: 2139796 - DNA, 21 bp, Homo sapiens
cccttggcgggcagcccagcc

SEQ ID NO: 2139797 - DNA, 15 bp, Homo sapiens
cccttggctcaatcc

SEQ ID NO: 2139798 - DNA, 14 bp, Homo sapiens
cccttggctgtgag

SEQ ID NO: 2139799 - DNA, 19 bp, Homo sapiens
cccttggcttcctccgtcc

SEQ ID NO: 2139800 - DNA, 19 bp, Homo sapiens
cccttgggcatccacccag

SEQ ID NO: 2139801 - DNA, 22 bp, Homo sapiens
cccttgggcctccccccagccc

SEQ ID NO: 2139802 - DNA, 14 bp, Homo sapiens
cccttggggcctgg

SEQ ID NO: 2139803 - DNA, 15 bp, Homo sapiens
cccttgtcctgccag

SEQ ID NO: 2139804 - DNA, 16 bp, Homo sapiens
cccttgtcctgccagc

SEQ ID NO: 2139805 - DNA, 17 bp, Homo sapiens
cccttgtcctgccagct

SEQ ID NO: 2139806 - DNA, 18 bp, Homo sapiens
cccttgtcctgccagctg

SEQ ID NO: 2139807 - DNA, 20 bp, Homo sapiens
cccttgtttggggcaggagt

SEQ ID NO: 2139808 - DNA, 23 bp, Homo sapiens
ccctttattaattcattaaattt

SEQ ID NO: 2139809 - DNA, 13 bp, Homo sapiens
ccctttccagcca

SEQ ID NO: 2139810 - DNA, 13 bp, Homo sapiens
ccctttccagtta

SEQ ID NO: 2139811 - DNA, 13 bp, Homo sapiens
ccctttcccccac

SEQ ID NO: 2139812 - DNA, 12 bp, Homo sapiens
ccctttcctccc

SEQ ID NO: 2139813 - DNA, 15 bp, Homo sapiens
ccctttcctggggga

SEQ ID NO: 2139814 - DNA, 18 bp, Homo sapiens
ccctttctggaccagatc

SEQ ID NO: 2139815 - DNA, 19 bp, Homo sapiens
cccttttcctccagacaga

SEQ ID NO: 2139816 - DNA, 16 bp, Homo sapiens
cccttttgcctggctg

SEQ ID NO: 2139817 - DNA, 23 bp, Homo sapiens
ccgaacatcaccgacgcgtctcc

SEQ ID NO: 2139818 - DNA, 17 bp, Homo sapiens
ccgaagaccgaatttta

SEQ ID NO: 2139819 - DNA, 13 bp, Homo sapiens
ccgaagagccctg

SEQ ID NO: 2139820 - DNA, 17 bp, Homo sapiens
ccgaagagccctgagct

SEQ ID NO: 2139821 - DNA, 21 bp, Homo sapiens
ccgaagagccctgagctcagg

SEQ ID NO: 2139822 - DNA, 21 bp, Homo sapiens
ccgaaggttatggtcaatccc

SEQ ID NO: 2139823 - DNA, 16 bp, Homo sapiens
ccgaatagctgggact

SEQ ID NO: 2139824 - DNA, 21 bp, Homo sapiens
ccgacaaagggaaggctgctg

SEQ ID NO: 2139825 - DNA, 16 bp, Homo sapiens
ccgacactgctgcacc

SEQ ID NO: 2139826 - DNA, 17 bp, Homo sapiens
ccgacactgctgcacca

SEQ ID NO: 2139827 - DNA, 13 bp, Homo sapiens
ccgacagagagat

SEQ ID NO: 2139828 - DNA, 19 bp, Homo sapiens
cctcactgccccaccagcc

SEQ ID NO: 2139829 - DNA, 15 bp, Homo sapiens
cctcactgccttcca

SEQ ID NO: 2139830 - DNA, 19 bp, Homo sapiens
cctcactgccttccaggag

SEQ ID NO: 2139831 - DNA, 20 bp, Homo sapiens
cctcactggggtcctggggc

SEQ ID NO: 2139832 - DNA, 23 bp, Homo sapiens
cctcactggggtcctggggcctc

SEQ ID NO: 2139833 - DNA, 22 bp, Homo sapiens
cctcactgtcagcgtttctcca

SEQ ID NO: 2139834 - DNA, 15 bp, Homo sapiens
cctcagacaatccac

SEQ ID NO: 2139835 - DNA, 10 bp, Homo sapiens
cctcagactg

SEQ ID NO: 2139836 - DNA, 14 bp, Homo sapiens
cctcagactgctca

SEQ ID NO: 2139837 - DNA, 14 bp, Homo sapiens
cctcagagcaggct

SEQ ID NO: 2139838 - DNA, 19 bp, Homo sapiens
cctcagatgatctctccac

SEQ ID NO: 2139839 - DNA, 16 bp, Homo sapiens
cctcagcatcctggca

SEQ ID NO: 2139840 - DNA, 15 bp, Homo sapiens
cctcagccaaacaca

SEQ ID NO: 2139841 - DNA, 14 bp, Homo sapiens
cctcagccctcaga

SEQ ID NO: 2139842 - DNA, 11 bp, Homo sapiens
cctcagccctt

SEQ ID NO: 2139843 - DNA, 18 bp, Homo sapiens
cctcagcccttgccccca

SEQ ID NO: 2139844 - DNA, 19 bp, Homo sapiens
cctcagcctagaccctcct

SEQ ID NO: 2139845 - DNA, 20 bp, Homo sapiens
cctcagcctagaccctcctc

SEQ ID NO: 2139846 - DNA, 15 bp, Homo sapiens
cctcagcctcccaga

SEQ ID NO: 2139847 - DNA, 16 bp, Homo sapiens
cctcagcctcccagag

SEQ ID NO: 2139848 - DNA, 22 bp, Homo sapiens
cctcagcctcccgaatagctgg

SEQ ID NO: 2139849 - DNA, 13 bp, Homo sapiens
cctcagcctccta

SEQ ID NO: 2139850 - DNA, 16 bp, Homo sapiens
cctcagcctgtgctgc

SEQ ID NO: 2139851 - DNA, 23 bp, Homo sapiens
cctcagccttgaaaaacaagtct

SEQ ID NO: 2139852 - DNA, 13 bp, Homo sapiens
cctcagctcagcc

SEQ ID NO: 2139853 - DNA, 14 bp, Homo sapiens
cctcagctcagcct

SEQ ID NO: 2139854 - DNA, 15 bp, Homo sapiens
cctcagctcagcctc

SEQ ID NO: 2139855 - DNA, 14 bp, Homo sapiens
cctcagctgccaag

SEQ ID NO: 2139856 - DNA, 16 bp, Homo sapiens
cctcagctgccaagca

SEQ ID NO: 2139857 - DNA, 17 bp, Homo sapiens
cctcagctgccaagcac

SEQ ID NO: 2139858 - DNA, 19 bp, Homo sapiens
cctcagctgccaagcactc

SEQ ID NO: 2139859 - DNA, 21 bp, Homo sapiens
cctcaggccaggtgcagtggc

SEQ ID NO: 2139860 - DNA, 13 bp, Homo sapiens
cctcaggccagtg

SEQ ID NO: 2139861 - DNA, 19 bp, Homo sapiens
cctcaggccagtgccagga

SEQ ID NO: 2139862 - DNA, 11 bp, Homo sapiens
cctcagggaca

SEQ ID NO: 2139863 - DNA, 23 bp, Homo sapiens
cctcagggacagagacacctgca

SEQ ID NO: 2139864 - DNA, 21 bp, Homo sapiens
cctcagtcagttcccggagca

SEQ ID NO: 2139865 - DNA, 13 bp, Homo sapiens
cctcagtcctgga

SEQ ID NO: 2139866 - DNA, 15 bp, Homo sapiens
cctcagtcctggaag

SEQ ID NO: 2139867 - DNA, 15 bp, Homo sapiens
cctcagtgccacttg

SEQ ID NO: 2139868 - DNA, 12 bp, Homo sapiens
cctcagtgctcg

SEQ ID NO: 2139869 - DNA, 16 bp, Homo sapiens
cctcagtgctcggcag

SEQ ID NO: 2139870 - DNA, 20 bp, Homo sapiens
cctcagtgctcggcagtcat

SEQ ID NO: 2139871 - DNA, 22 bp, Homo sapiens
cctcagtgctcggcagtcatac

SEQ ID NO: 2139872 - DNA, 23 bp, Homo sapiens
cctcagtgtcatttatgaaaaga

SEQ ID NO: 2139873 - DNA, 22 bp, Homo sapiens
cctcagtttttcggtgggacag

SEQ ID NO: 2139874 - DNA, 23 bp, Homo sapiens
cctcagtttttcggtgggacagc

SEQ ID NO: 2139875 - DNA, 15 bp, Homo sapiens
cctcataccatctgc

SEQ ID NO: 2139876 - DNA, 21 bp, Homo sapiens
cctcatagtatggtggctggg

SEQ ID NO: 2139877 - DNA, 13 bp, Homo sapiens
cctcatatttaaa

SEQ ID NO: 2139878 - DNA, 14 bp, Homo sapiens
cctcatccgaggca

SEQ ID NO: 2139879 - DNA, 13 bp, Homo sapiens
cctcatctccttt

SEQ ID NO: 2139880 - DNA, 17 bp, Homo sapiens
cctcatgacagccagag

SEQ ID NO: 2139881 - DNA, 18 bp, Homo sapiens
cctcatgacagccagagc

SEQ ID NO: 2139882 - DNA, 13 bp, Homo sapiens
cctcattcaggaa

SEQ ID NO: 2139883 - DNA, 15 bp, Homo sapiens
cctcattcaggaaaa

SEQ ID NO: 2139884 - DNA, 17 bp, Homo sapiens
cctcattcaggaaaact

SEQ ID NO: 2139885 - DNA, 14 bp, Homo sapiens
cctcattcccctcg

SEQ ID NO: 2139886 - DNA, 13 bp, Homo sapiens
cctcattcctgaa

SEQ ID NO: 2139887 - DNA, 16 bp, Homo sapiens
cctccaaactcctgcc

SEQ ID NO: 2139888 - DNA, 18 bp, Homo sapiens
cctccaaactcctgcctg

SEQ ID NO: 2139889 - DNA, 22 bp, Homo sapiens
cctccaagctccatctccactc

SEQ ID NO: 2139890 - DNA, 19 bp, Homo sapiens
cctccaatcctttccaccc

SEQ ID NO: 2139891 - DNA, 15 bp, Homo sapiens
cctccaattccacag

SEQ ID NO: 2139892 - DNA, 16 bp, Homo sapiens
cctccaattccacagt

SEQ ID NO: 2139893 - DNA, 20 bp, Homo sapiens
cctccaattccacagtctct

SEQ ID NO: 2139894 - DNA, 23 bp, Homo sapiens
cctccacagttcgacctgcggct

SEQ ID NO: 2139895 - DNA, 13 bp, Homo sapiens
cctccaccgctgc

SEQ ID NO: 2139896 - DNA, 18 bp, Homo sapiens
cctccacctctccttgga

SEQ ID NO: 2139897 - DNA, 17 bp, Homo sapiens
cctccaccttgctcttc

SEQ ID NO: 2139898 - DNA, 19 bp, Homo sapiens
cctccaccttgctcttctt

SEQ ID NO: 2139899 - DNA, 23 bp, Homo sapiens
cctccaccttgctcttctttctg

SEQ ID NO: 2139900 - DNA, 13 bp, Homo sapiens
cctccacgcctcc

SEQ ID NO: 2139901 - DNA, 14 bp, Homo sapiens
cctccactcactcc

SEQ ID NO: 2139902 - DNA, 21 bp, Homo sapiens
cctccactcactccagcccaa

SEQ ID NO: 2139903 - DNA, 14 bp, Homo sapiens
cctccactccacct

SEQ ID NO: 2139904 - DNA, 16 bp, Homo sapiens
cctccactccacctcc

SEQ ID NO: 2139905 - DNA, 12 bp, Homo sapiens
cctccagacaga

SEQ ID NO: 2139906 - DNA, 20 bp, Homo sapiens
cctccagacccctgtggcag

SEQ ID NO: 2139907 - DNA, 17 bp, Homo sapiens
cctccagaccctgcctg

SEQ ID NO: 2139908 - DNA, 18 bp, Homo sapiens
cctccagagccagcctgg

SEQ ID NO: 2139909 - DNA, 21 bp, Homo sapiens
cctccagagccagcctgggac

SEQ ID NO: 2139910 - DNA, 22 bp, Homo sapiens
cctccagagccagcctgggact

SEQ ID NO: 2139911 - DNA, 12 bp, Homo sapiens
cctccagcctct

SEQ ID NO: 2139912 - DNA, 14 bp, Homo sapiens
cctccagctccagt

SEQ ID NO: 2139913 - DNA, 12 bp, Homo sapiens
cctccagctgga

SEQ ID NO: 2139914 - DNA, 15 bp, Homo sapiens
cctccaggagcctac

SEQ ID NO: 2139915 - DNA, 10 bp, Homo sapiens
cctccaggca

SEQ ID NO: 2139916 - DNA, 16 bp, Homo sapiens
cctccaggcatgctgg

SEQ ID NO: 2139917 - DNA, 18 bp, Homo sapiens
cctccagggaatccgcct

SEQ ID NO: 2139918 - DNA, 19 bp, Homo sapiens
cctccagggaatccgcctg

SEQ ID NO: 2139919 - DNA, 21 bp, Homo sapiens
cctccagggaatccgcctgca

SEQ ID NO: 2139920 - DNA, 14 bp, Homo sapiens
cctccagggccacg

SEQ ID NO: 2139921 - DNA, 20 bp, Homo sapiens
cctccagtagtggacaacag

SEQ ID NO: 2139922 - DNA, 20 bp, Homo sapiens
cctccatccggctcctgtca

SEQ ID NO: 2139923 - DNA, 19 bp, Homo sapiens
cctccatgctgcctccaga

SEQ ID NO: 2139924 - DNA, 14 bp, Homo sapiens
cctccatgtggccc

SEQ ID NO: 2139925 - DNA, 22 bp, Homo sapiens
cctccatgtggccccaggtgcc

SEQ ID NO: 2139926 - DNA, 12 bp, Homo sapiens
cctccatgtggg

SEQ ID NO: 2139927 - DNA, 23 bp, Homo sapiens
cctccatgtgggctagttgggct

SEQ ID NO: 2139928 - DNA, 18 bp, Homo sapiens
cctccattgctgttgttg

SEQ ID NO: 2139929 - DNA, 22 bp, Homo sapiens
cctccatttctctccaggaagt

SEQ ID NO: 2139930 - DNA, 17 bp, Homo sapiens
cctcccaaagtgctggg

SEQ ID NO: 2139931 - DNA, 15 bp, Homo sapiens
cctcccaacagagct

SEQ ID NO: 2139932 - DNA, 16 bp, Homo sapiens
cctcccaaccccaggg

SEQ ID NO: 2139933 - DNA, 12 bp, Homo sapiens
cctcccaacctc

SEQ ID NO: 2139934 - DNA, 15 bp, Homo sapiens
cctcccaccaccctc

SEQ ID NO: 2139935 - DNA, 20 bp, Homo sapiens
cctcccaccaccctcccacc

SEQ ID NO: 2139936 - DNA, 16 bp, Homo sapiens
cctcccaccatgcgct

SEQ ID NO: 2139937 - DNA, 18 bp, Homo sapiens
cctcccaccccactccag

SEQ ID NO: 2139938 - DNA, 20 bp, Homo sapiens
cctcccaccccactccagcc

SEQ ID NO: 2139939 - DNA, 23 bp, Homo sapiens
cctcccaccccactccagccctg

SEQ ID NO: 2139940 - DNA, 14 bp, Homo sapiens
cctcccacccccag

SEQ ID NO: 2139941 - DNA, 15 bp, Homo sapiens
cctcccacctcagcc

SEQ ID NO: 2139942 - DNA, 19 bp, Homo sapiens
cctcccagagtgctaggat

SEQ ID NO: 2139943 - DNA, 14 bp, Homo sapiens
cctgcagagcacac

SEQ ID NO: 2139944 - DNA, 16 bp, Homo sapiens
cctgcagagcacacag

SEQ ID NO: 2139945 - DNA, 17 bp, Homo sapiens
cctgcagagcacacagg

SEQ ID NO: 2139946 - DNA, 18 bp, Homo sapiens
cctgcagaggacagagct

SEQ ID NO: 2139947 - DNA, 19 bp, Homo sapiens
cctgcagaggaccacagtg

SEQ ID NO: 2139948 - DNA, 21 bp, Homo sapiens
cctgcagaggaccacagtggg

SEQ ID NO: 2139949 - DNA, 22 bp, Homo sapiens
cctgcagaggaccacagtgggt

SEQ ID NO: 2139950 - DNA, 19 bp, Homo sapiens
cctgcagaggggaaaccag

SEQ ID NO: 2139951 - DNA, 23 bp, Homo sapiens
cctgcagccaaacagagccttca

SEQ ID NO: 2139952 - DNA, 22 bp, Homo sapiens
cctgcagccccgcgcctccttc

SEQ ID NO: 2139953 - DNA, 15 bp, Homo sapiens
cctgcagcctggtag

SEQ ID NO: 2139954 - DNA, 12 bp, Homo sapiens
cctgcagcttgt

SEQ ID NO: 2139955 - DNA, 16 bp, Homo sapiens
cctgcagcttgtagcc

SEQ ID NO: 2139956 - DNA, 17 bp, Homo sapiens
cctgcagcttgtagcca

SEQ ID NO: 2139957 - DNA, 18 bp, Homo sapiens
cctgcagcttgtagccag

SEQ ID NO: 2139958 - DNA, 19 bp, Homo sapiens
cctgcagcttgtagccagc

SEQ ID NO: 2139959 - DNA, 18 bp, Homo sapiens
cctgcaggaacgagcact

SEQ ID NO: 2139960 - DNA, 20 bp, Homo sapiens
cctgcaggaacgagcactgg

SEQ ID NO: 2139961 - DNA, 21 bp, Homo sapiens
cctgcaggaacgagcactggc

SEQ ID NO: 2139962 - DNA, 22 bp, Homo sapiens
cctgcaggaacgagcactggcc

SEQ ID NO: 2139963 - DNA, 22 bp, Homo sapiens
cctgcaggccaagagcagaggc

SEQ ID NO: 2139964 - DNA, 20 bp, Homo sapiens
cctgcagtactttacctcct

SEQ ID NO: 2139965 - DNA, 14 bp, Homo sapiens
cctgcagttcctga

SEQ ID NO: 2139966 - DNA, 23 bp, Homo sapiens
cctgcatccccttggctgtgagg

SEQ ID NO: 2139967 - DNA, 24 bp, Homo sapiens
cctgcatccccttggctgtgaggc

SEQ ID NO: 2139968 - DNA, 19 bp, Homo sapiens
cctgcatccgtagttccct

SEQ ID NO: 2139969 - DNA, 22 bp, Homo sapiens
cctgcatccgtagttccctgaa

SEQ ID NO: 2139970 - DNA, 19 bp, Homo sapiens
cctgcatgtgttgtacaat

SEQ ID NO: 2139971 - DNA, 14 bp, Homo sapiens
cctgcatttctcag

SEQ ID NO: 2139972 - DNA, 16 bp, Homo sapiens
cctgcatttctgagtt

SEQ ID NO: 2139973 - DNA, 11 bp, Homo sapiens
cctgcatttta

SEQ ID NO: 2139974 - DNA, 14 bp, Homo sapiens
cctgccaccagtca

SEQ ID NO: 2139975 - DNA, 19 bp, Homo sapiens
cctgccaccagtcactgtc

SEQ ID NO: 2139976 - DNA, 12 bp, Homo sapiens
cctgccaccctg

SEQ ID NO: 2139977 - DNA, 14 bp, Homo sapiens
cctgccaccgccag

SEQ ID NO: 2139978 - DNA, 15 bp, Homo sapiens
cctgccacctgtctg

SEQ ID NO: 2139979 - DNA, 15 bp, Homo sapiens
cctgccactgacctc

SEQ ID NO: 2139980 - DNA, 17 bp, Homo sapiens
cctgccactgacctcac

SEQ ID NO: 2139981 - DNA, 12 bp, Homo sapiens
cctgccagccat

SEQ ID NO: 2139982 - DNA, 15 bp, Homo sapiens
cctgccagccatcac

SEQ ID NO: 2139983 - DNA, 14 bp, Homo sapiens
cctgccagcctggc

SEQ ID NO: 2139984 - DNA, 16 bp, Homo sapiens
cctgccagctgccttc

SEQ ID NO: 2139985 - DNA, 14 bp, Homo sapiens
cctgccaggaggct

SEQ ID NO: 2139986 - DNA, 20 bp, Homo sapiens
cctgccaggaggctgcggcc

SEQ ID NO: 2139987 - DNA, 13 bp, Homo sapiens
cctgccagggctc

SEQ ID NO: 2139988 - DNA, 18 bp, Homo sapiens
cctgccagtgccttacct

SEQ ID NO: 2139989 - DNA, 20 bp, Homo sapiens
cctgccagtgccttacctcc

SEQ ID NO: 2139990 - DNA, 21 bp, Homo sapiens
cctgccagtgccttacctcct

SEQ ID NO: 2139991 - DNA, 21 bp, Homo sapiens
cctgccataccgctggggaac

SEQ ID NO: 2139992 - DNA, 17 bp, Homo sapiens
cctgccatttgcaccct

SEQ ID NO: 2139993 - DNA, 23 bp, Homo sapiens
cctgccatttgcaccctccgcct

SEQ ID NO: 2139994 - DNA, 22 bp, Homo sapiens
cctgcccaatgctttgggaggc

SEQ ID NO: 2139995 - DNA, 13 bp, Homo sapiens
cctgcccagcctc

SEQ ID NO: 2139996 - DNA, 21 bp, Homo sapiens
cctgcccagcctcgcatgcca

SEQ ID NO: 2139997 - DNA, 13 bp, Homo sapiens
cctgcccaggccc

SEQ ID NO: 2139998 - DNA, 18 bp, Homo sapiens
cctgcccagtgcacttgc

SEQ ID NO: 2139999 - DNA, 19 bp, Homo sapiens
cctgcccatgtgtcccctc

SEQ ID NO: 2140000 - DNA, 22 bp, Homo sapiens
cctgcccatgtgtcccctcact

SEQ ID NO: 2140001 - DNA, 17 bp, Homo sapiens
cctgccccaacccccac

SEQ ID NO: 2140002 - DNA, 18 bp, Homo sapiens
cctgccccaacccccacc

SEQ ID NO: 2140003 - DNA, 15 bp, Homo sapiens
cctgccccaactcct

SEQ ID NO: 2140004 - DNA, 12 bp, Homo sapiens
cctgccccagcg

SEQ ID NO: 2140005 - DNA, 14 bp, Homo sapiens
cctgccccagcgcg

SEQ ID NO: 2140006 - DNA, 12 bp, Homo sapiens
cctgccccatcc

SEQ ID NO: 2140007 - DNA, 18 bp, Homo sapiens
cctgcccccagcactcct

SEQ ID NO: 2140008 - DNA, 20 bp, Homo sapiens
cctgcccccatctccccagg

SEQ ID NO: 2140009 - DNA, 21 bp, Homo sapiens
cctgcccccgacagcccagcc

SEQ ID NO: 2140010 - DNA, 15 bp, Homo sapiens
cctgcccctgcccca

SEQ ID NO: 2140011 - DNA, 18 bp, Homo sapiens
cctgccctagagcacact

SEQ ID NO: 2140012 - DNA, 24 bp, Homo sapiens
cctgccctagagcacactgtagca

SEQ ID NO: 2140013 - DNA, 21 bp, Homo sapiens
cctgccctcctacagcactcc

SEQ ID NO: 2140014 - DNA, 13 bp, Homo sapiens
cctgccctctctc

SEQ ID NO: 2140015 - DNA, 15 bp, Homo sapiens
cctgccctctctcag

SEQ ID NO: 2140016 - DNA, 12 bp, Homo sapiens
cctgccctgcca

SEQ ID NO: 2140017 - DNA, 17 bp, Homo sapiens
cctgccctgccacctgt

SEQ ID NO: 2140018 - DNA, 13 bp, Homo sapiens
cctgccctgctgc

SEQ ID NO: 2140019 - DNA, 22 bp, Homo sapiens
cctgcccttgtttggggcagga

SEQ ID NO: 2140020 - DNA, 21 bp, Homo sapiens
cctgcctaggaattcccagcc

SEQ ID NO: 2140021 - DNA, 16 bp, Homo sapiens
cctgcctatccatcct

SEQ ID NO: 2140022 - DNA, 12 bp, Homo sapiens
cctgcctcagcc

SEQ ID NO: 2140023 - DNA, 16 bp, Homo sapiens
cctgcctcagcctccc

SEQ ID NO: 2140024 - DNA, 16 bp, Homo sapiens
cctgcctcccagccct

SEQ ID NO: 2140025 - DNA, 15 bp, Homo sapiens
cctgcctccctttct

SEQ ID NO: 2140026 - DNA, 18 bp, Homo sapiens
cctgcctccctttctggg

SEQ ID NO: 2140027 - DNA, 19 bp, Homo sapiens
cctgcctccctttctggga

SEQ ID NO: 2140028 - DNA, 21 bp, Homo sapiens
cctgcctccctttctgggagg

SEQ ID NO: 2140029 - DNA, 12 bp, Homo sapiens
cctgcctctact

SEQ ID NO: 2140030 - DNA, 21 bp, Homo sapiens
cctgcctctactgggaaggct

SEQ ID NO: 2140031 - DNA, 13 bp, Homo sapiens
cctgcctctcccc

SEQ ID NO: 2140032 - DNA, 16 bp, Homo sapiens
cctgcctctccccaaa

SEQ ID NO: 2140033 - DNA, 14 bp, Homo sapiens
cctgcctgagccca

SEQ ID NO: 2140034 - DNA, 14 bp, Homo sapiens
cctgcctgcccact

SEQ ID NO: 2140035 - DNA, 11 bp, Homo sapiens
cctgcctggag

SEQ ID NO: 2140036 - DNA, 12 bp, Homo sapiens
cctgcctggagg

SEQ ID NO: 2140037 - DNA, 19 bp, Homo sapiens
cctgcctggaggacctgag

SEQ ID NO: 2140038 - DNA, 23 bp, Homo sapiens
cctgcctggaggacctgagcctg

SEQ ID NO: 2140039 - DNA, 24 bp, Homo sapiens
cctgcctggaggacctgagcctgc

SEQ ID NO: 2140040 - DNA, 13 bp, Homo sapiens
cctgcctgtgcat

SEQ ID NO: 2140041 - DNA, 14 bp, Homo sapiens
cctgcctgtgcatg

SEQ ID NO: 2140042 - DNA, 22 bp, Homo sapiens
cctgcctgttcccattcttgca

SEQ ID NO: 2140043 - DNA, 14 bp, Homo sapiens
cctgccttcatgga

SEQ ID NO: 2140044 - DNA, 22 bp, Homo sapiens
cctgccttgaagccactgaagc

SEQ ID NO: 2140045 - DNA, 18 bp, Homo sapiens
cctgccttgatgaagccc

SEQ ID NO: 2140046 - DNA, 20 bp, Homo sapiens
cctgccttgatgaagcccgt

SEQ ID NO: 2140047 - DNA, 22 bp, Homo sapiens
cctgccttgatgaagcccgtgt

SEQ ID NO: 2140048 - DNA, 19 bp, Homo sapiens
cctgccttgatgaagcctg

SEQ ID NO: 2140049 - DNA, 22 bp, Homo sapiens
cctgccttgatgaagcctgtgc

SEQ ID NO: 2140050 - DNA, 17 bp, Homo sapiens
cctgcgaaggggccctg

SEQ ID NO: 2140051 - DNA, 17 bp, Homo sapiens
cctgcggccgggctgcc

SEQ ID NO: 2140052 - DNA, 19 bp, Homo sapiens
cctgcggccgggctgccct

SEQ ID NO: 2140053 - DNA, 21 bp, Homo sapiens
cctgcggctgctgtgtgcctt

SEQ ID NO: 2140054 - DNA, 15 bp, Homo sapiens
cctgcgggagtagtt

SEQ ID NO: 2140055 - DNA, 19 bp, Homo sapiens
cctgcgggcttttccccgg

SEQ ID NO: 2140056 - DNA, 16 bp, Homo sapiens
cctgcgggttttaatt

SEQ ID NO: 2140057 - DNA, 20 bp, Homo sapiens
cctgcgtcctgacgccctgc

SEQ ID NO: 2140058 - DNA, 18 bp, Homo sapiens
ccttagattagctctgga

SEQ ID NO: 2140059 - DNA, 21 bp, Homo sapiens
ccttagattagctctggacca

SEQ ID NO: 2140060 - DNA, 19 bp, Homo sapiens
ccttagcagggaaacagct

SEQ ID NO: 2140061 - DNA, 16 bp, Homo sapiens
ccttagtggctttttt

SEQ ID NO: 2140062 - DNA, 15 bp, Homo sapiens
ccttataagcccagc

SEQ ID NO: 2140063 - DNA, 15 bp, Homo sapiens
ccttatccaggactc

SEQ ID NO: 2140064 - DNA, 16 bp, Homo sapiens
ccttatcttgaaaaga

SEQ ID NO: 2140065 - DNA, 16 bp, Homo sapiens
ccttatgtaattattt

SEQ ID NO: 2140066 - DNA, 12 bp, Homo sapiens
ccttatgtatta

SEQ ID NO: 2140067 - DNA, 22 bp, Homo sapiens
ccttatgtttgaagagaaacct

SEQ ID NO: 2140068 - DNA, 16 bp, Homo sapiens
ccttattgtacctctc

SEQ ID NO: 2140069 - DNA, 22 bp, Homo sapiens
ccttatttatatatcagttata

SEQ ID NO: 2140070 - DNA, 13 bp, Homo sapiens
ccttatttatcaa

SEQ ID NO: 2140071 - DNA, 14 bp, Homo sapiens
ccttattttgtatt

SEQ ID NO: 2140072 - DNA, 19 bp, Homo sapiens
ccttcaagaactctgggct

SEQ ID NO: 2140073 - DNA, 20 bp, Homo sapiens
ccttcaagcaccctgttccc

SEQ ID NO: 2140074 - DNA, 14 bp, Homo sapiens
ccttcaattcctgg

SEQ ID NO: 2140075 - DNA, 16 bp, Homo sapiens
ccttcaattcctgggc

SEQ ID NO: 2140076 - DNA, 15 bp, Homo sapiens
ccttcaccagagccc

SEQ ID NO: 2140077 - DNA, 17 bp, Homo sapiens
ccttcacctttggtgca

SEQ ID NO: 2140078 - DNA, 23 bp, Homo sapiens
ccttcactccggtgtgcctgcag

SEQ ID NO: 2140079 - DNA, 12 bp, Homo sapiens
ccttcagagctc

SEQ ID NO: 2140080 - DNA, 19 bp, Homo sapiens
ccttcagggccagaaggag

SEQ ID NO: 2140081 - DNA, 12 bp, Homo sapiens
ccttcagtgccc

SEQ ID NO: 2140082 - DNA, 16 bp, Homo sapiens
ccttcagtgcccacca

SEQ ID NO: 2140083 - DNA, 21 bp, Homo sapiens
ccttcataggcggtcatgtgt

SEQ ID NO: 2140084 - DNA, 22 bp, Homo sapiens
ccttcataggcggtcatgtgtg

SEQ ID NO: 2140085 - DNA, 14 bp, Homo sapiens
ccttcatttcctcc

SEQ ID NO: 2140086 - DNA, 21 bp, Homo sapiens
ccttccacggatccatgtagc

SEQ ID NO: 2140087 - DNA, 11 bp, Homo sapiens
ccttccataat

SEQ ID NO: 2140088 - DNA, 18 bp, Homo sapiens
ccttccatgtcgcctctg

SEQ ID NO: 2140089 - DNA, 19 bp, Homo sapiens
ccttccatgtcgcctctgc

SEQ ID NO: 2140090 - DNA, 21 bp, Homo sapiens
ccttccatgtcgcctctgcat

SEQ ID NO: 2140091 - DNA, 12 bp, Homo sapiens
ccttcccagctc

SEQ ID NO: 2140092 - DNA, 14 bp, Homo sapiens
ccttcccagctctc

SEQ ID NO: 2140093 - DNA, 17 bp, Homo sapiens
ccttcccagctctccct

SEQ ID NO: 2140094 - DNA, 19 bp, Homo sapiens
ccttcccatgatgccgctc

SEQ ID NO: 2140095 - DNA, 23 bp, Homo sapiens
ccttcccatgatgccgctcttct

SEQ ID NO: 2140096 - DNA, 13 bp, Homo sapiens
ccttccccagact

SEQ ID NO: 2140097 - DNA, 14 bp, Homo sapiens
ccttccccagactc

SEQ ID NO: 2140098 - DNA, 19 bp, Homo sapiens
ccttccccagactcagctc

SEQ ID NO: 2140099 - DNA, 20 bp, Homo sapiens
ccttcccccatcccctttcc

SEQ ID NO: 2140100 - DNA, 20 bp, Homo sapiens
ccttccccctcccagggcca

SEQ ID NO: 2140101 - DNA, 14 bp, Homo sapiens
ccttcccctgcctg

SEQ ID NO: 2140102 - DNA, 22 bp, Homo sapiens
ccttccccttgcccagggctca

SEQ ID NO: 2140103 - DNA, 12 bp, Homo sapiens
ccttccctccaa

SEQ ID NO: 2140104 - DNA, 18 bp, Homo sapiens
ccttccctccccacagtc

SEQ ID NO: 2140105 - DNA, 14 bp, Homo sapiens
ccttccctgctttg

SEQ ID NO: 2140106 - DNA, 20 bp, Homo sapiens
ccttccctgctttgaggaca

SEQ ID NO: 2140107 - DNA, 18 bp, Homo sapiens
ccttccgatgacagtgct

SEQ ID NO: 2140108 - DNA, 20 bp, Homo sapiens
ccttcctacacccttggact

SEQ ID NO: 2140109 - DNA, 16 bp, Homo sapiens
ccttcctacagatagt

SEQ ID NO: 2140110 - DNA, 18 bp, Homo sapiens
ccttcctcagtcctggaa

SEQ ID NO: 2140111 - DNA, 12 bp, Homo sapiens
ccttcctcccca

SEQ ID NO: 2140112 - DNA, 14 bp, Homo sapiens
ccttcctcctccac

SEQ ID NO: 2140113 - DNA, 20 bp, Homo sapiens
ccttcctcctgaagcctctg

SEQ ID NO: 2140114 - DNA, 16 bp, Homo sapiens
ccttcctgccaccagt

SEQ ID NO: 2140115 - DNA, 11 bp, Homo sapiens
ccttcctggcc

SEQ ID NO: 2140116 - DNA, 13 bp, Homo sapiens
ccttcctggcctc

SEQ ID NO: 2140117 - DNA, 18 bp, Homo sapiens
ccttcctggcctcactgg

SEQ ID NO: 2140118 - DNA, 20 bp, Homo sapiens
ccttcctggcctcactggct

SEQ ID NO: 2140119 - DNA, 15 bp, Homo sapiens
ccttccttccctggc

SEQ ID NO: 2140120 - DNA, 19 bp, Homo sapiens
ccttcctttaggtctggtt

SEQ ID NO: 2140121 - DNA, 20 bp, Homo sapiens
ccttcgatacaccgggcctg

SEQ ID NO: 2140122 - DNA, 23 bp, Homo sapiens
ccttcgatacaccgggcctggag

SEQ ID NO: 2140123 - DNA, 17 bp, Homo sapiens
ccttcgcggtggaaggc

SEQ ID NO: 2140124 - DNA, 14 bp, Homo sapiens
ccttcgctcctgtg

SEQ ID NO: 2140125 - DNA, 13 bp, Homo sapiens
ccttcgctgccag

SEQ ID NO: 2140126 - DNA, 18 bp, Homo sapiens
ccttcgctgccaggacac

SEQ ID NO: 2140127 - DNA, 21 bp, Homo sapiens
ccttcgctgccaggacacctg

SEQ ID NO: 2140128 - DNA, 22 bp, Homo sapiens
ccttcgctgccaggacacctgc

SEQ ID NO: 2140129 - DNA, 14 bp, Homo sapiens
ccttctactgagcc

SEQ ID NO: 2140130 - DNA, 15 bp, Homo sapiens
ccttctcgcattttc

SEQ ID NO: 2140131 - DNA, 16 bp, Homo sapiens
ccttctctatatcatg

SEQ ID NO: 2140132 - DNA, 18 bp, Homo sapiens
ccttctctccttccctct

SEQ ID NO: 2140133 - DNA, 16 bp, Homo sapiens
ccttctctgcccccag

SEQ ID NO: 2140134 - DNA, 11 bp, Homo sapiens
ccttctgctgc

SEQ ID NO: 2140135 - DNA, 20 bp, Homo sapiens
ccttctgggcagaccttgac

SEQ ID NO: 2140136 - DNA, 19 bp, Homo sapiens
ccttctggtacaatccttt

SEQ ID NO: 2140137 - DNA, 21 bp, Homo sapiens
ccttctgtcctactctgtgtc

SEQ ID NO: 2140138 - DNA, 19 bp, Homo sapiens
ccttcttattctcactcca

SEQ ID NO: 2140139 - DNA, 14 bp, Homo sapiens
ccttcttcacccag

SEQ ID NO: 2140140 - DNA, 15 bp, Homo sapiens
ccttcttcacccagc

SEQ ID NO: 2140141 - DNA, 19 bp, Homo sapiens
ccttcttcacccagctaat

SEQ ID NO: 2140142 - DNA, 16 bp, Homo sapiens
ccttcttccctgtttt

SEQ ID NO: 2140143 - DNA, 18 bp, Homo sapiens
ccttcttccctgttttaa

SEQ ID NO: 2140144 - DNA, 21 bp, Homo sapiens
ccttcttcggggaactcctgg

SEQ ID NO: 2140145 - DNA, 22 bp, Homo sapiens
ccttcttcggggaactcctgga

SEQ ID NO: 2140146 - DNA, 16 bp, Homo sapiens
ccttcttggcttctgg

SEQ ID NO: 2140147 - DNA, 18 bp, Homo sapiens
ccttcttggcttctggga

SEQ ID NO: 2140148 - DNA, 14 bp, Homo sapiens
ccttctttaaatca

SEQ ID NO: 2140149 - DNA, 13 bp, Homo sapiens
ccttctttcctct

SEQ ID NO: 2140150 - DNA, 17 bp, Homo sapiens
ccttctttcctcttccc

SEQ ID NO: 2140151 - DNA, 19 bp, Homo sapiens
ccttctttctaccctgctg

SEQ ID NO: 2140152 - DNA, 16 bp, Homo sapiens
ccttctttctcttccc

SEQ ID NO: 2140153 - DNA, 19 bp, Homo sapiens
ccttctttctcttccctcc

SEQ ID NO: 2140154 - DNA, 14 bp, Homo sapiens
ccttctttttcttc

SEQ ID NO: 2140155 - DNA, 16 bp, Homo sapiens
ccttgaactgggtact

SEQ ID NO: 2140156 - DNA, 19 bp, Homo sapiens
ccttgaagaggggaggggc

SEQ ID NO: 2140157 - DNA, 13 bp, Homo sapiens
ccttgacagggca

SEQ ID NO: 2140158 - DNA, 17 bp, Homo sapiens
ccttgacagggcacacc

SEQ ID NO: 2140159 - DNA, 23 bp, Homo sapiens
ccttgacattgtagagcttctgg

SEQ ID NO: 2140160 - DNA, 14 bp, Homo sapiens
ccttgaccattggc

SEQ ID NO: 2140161 - DNA, 20 bp, Homo sapiens
ccttgacgtcaagtctcctt

SEQ ID NO: 2140162 - DNA, 18 bp, Homo sapiens
ccttgatgaagcccgtgt

SEQ ID NO: 2140163 - DNA, 16 bp, Homo sapiens
ccttgatgaagcctgt

SEQ ID NO: 2140164 - DNA, 22 bp, Homo sapiens
ccttgattttagccttctctgt

SEQ ID NO: 2140165 - DNA, 20 bp, Homo sapiens
ccttgcacagcccacacatg

SEQ ID NO: 2140166 - DNA, 13 bp, Homo sapiens
ccttgcacccctc

SEQ ID NO: 2140167 - DNA, 14 bp, Homo sapiens
ccttgcacctgcat

SEQ ID NO: 2140168 - DNA, 21 bp, Homo sapiens
ccttgcaggtcggtttggttt

SEQ ID NO: 2140169 - DNA, 15 bp, Homo sapiens
ccttgcccagggctc

SEQ ID NO: 2140170 - DNA, 21 bp, Homo sapiens
ccttgcccagggctcagcctg

SEQ ID NO: 2140171 - DNA, 20 bp, Homo sapiens
ccttgcccgccagcctcagt

SEQ ID NO: 2140172 - DNA, 18 bp, Homo sapiens
ccttgcccggattctggg

SEQ ID NO: 2140173 - DNA, 18 bp, Homo sapiens
cgcggcttggccgccatc

SEQ ID NO: 2140174 - DNA, 21 bp, Homo sapiens
cgcgggaggcaccagctctgt

SEQ ID NO: 2140175 - DNA, 15 bp, Homo sapiens
cgcgggtagatgccg

SEQ ID NO: 2140176 - DNA, 18 bp, Homo sapiens
cgcggtgctctggcggct

SEQ ID NO: 2140177 - DNA, 13 bp, Homo sapiens
cgcgtctcctgtt

SEQ ID NO: 2140178 - DNA, 21 bp, Homo sapiens
cgcgtctcctgtttttctggg

SEQ ID NO: 2140179 - DNA, 14 bp, Homo sapiens
cgcgtctgccccac

SEQ ID NO: 2140180 - DNA, 19 bp, Homo sapiens
cgcgtctgccccaccctca

SEQ ID NO: 2140181 - DNA, 20 bp, Homo sapiens
cgcgtgcacacaccagagcc

SEQ ID NO: 2140182 - DNA, 13 bp, Homo sapiens
cgctaaaagaaac

SEQ ID NO: 2140183 - DNA, 15 bp, Homo sapiens
cgctaaaagaaactt

SEQ ID NO: 2140184 - DNA, 15 bp, Homo sapiens
cgctaacccccagcc

SEQ ID NO: 2140185 - DNA, 20 bp, Homo sapiens
cgctacaccactctggcagc

SEQ ID NO: 2140186 - DNA, 23 bp, Homo sapiens
cgctacaccactctggcagccac

SEQ ID NO: 2140187 - DNA, 11 bp, Homo sapiens
cgctacccact

SEQ ID NO: 2140188 - DNA, 20 bp, Homo sapiens
cgctcaggacccaggccctc

SEQ ID NO: 2140189 - DNA, 18 bp, Homo sapiens
cgctcattttaggcctcc

SEQ ID NO: 2140190 - DNA, 22 bp, Homo sapiens
cgctcccccgcagtccccagcc

SEQ ID NO: 2140191 - DNA, 20 bp, Homo sapiens
cgctcctgtctgccagccag

SEQ ID NO: 2140192 - DNA, 13 bp, Homo sapiens
cgctcctgtgtct

SEQ ID NO: 2140193 - DNA, 17 bp, Homo sapiens
cgctcctttacctacca

SEQ ID NO: 2140194 - DNA, 14 bp, Homo sapiens
cgctctctgtctgg

SEQ ID NO: 2140195 - DNA, 14 bp, Homo sapiens
cgctctcttccaga

SEQ ID NO: 2140196 - DNA, 19 bp, Homo sapiens
cgctctgccctccctggcc

SEQ ID NO: 2140197 - DNA, 16 bp, Homo sapiens
cgctctgctggcctgg

SEQ ID NO: 2140198 - DNA, 21 bp, Homo sapiens
cgctcttagctttctcagggg

SEQ ID NO: 2140199 - DNA, 22 bp, Homo sapiens
cgctgcaggtacttcctcctga

SEQ ID NO: 2140200 - DNA, 18 bp, Homo sapiens
cgctgccaccacgtctgc

SEQ ID NO: 2140201 - DNA, 21 bp, Homo sapiens
cgctgccaccacgtctgccag

SEQ ID NO: 2140202 - DNA, 22 bp, Homo sapiens
cgctgccaccacgtctgccagg

SEQ ID NO: 2140203 - DNA, 23 bp, Homo sapiens
cgctgccaccacgtctgccaggc

SEQ ID NO: 2140204 - DNA, 12 bp, Homo sapiens
cgctgccaggac

SEQ ID NO: 2140205 - DNA, 18 bp, Homo sapiens
cgctgccgctgcaccacg

SEQ ID NO: 2140206 - DNA, 18 bp, Homo sapiens
cgctgccgctgccgctgc

SEQ ID NO: 2140207 - DNA, 20 bp, Homo sapiens
cgctgcctaagtggctgctg

SEQ ID NO: 2140208 - DNA, 14 bp, Homo sapiens
cgctgctctagctg

SEQ ID NO: 2140209 - DNA, 16 bp, Homo sapiens
cgctgctctagctggc

SEQ ID NO: 2140210 - DNA, 18 bp, Homo sapiens
cgctgctctagctggcag

SEQ ID NO: 2140211 - DNA, 20 bp, Homo sapiens
cgctgctttgcgctggtgga

SEQ ID NO: 2140212 - DNA, 22 bp, Homo sapiens
cgctggaatcaatttcccagaa

SEQ ID NO: 2140213 - DNA, 22 bp, Homo sapiens
cgctggacaacccagaactgga

SEQ ID NO: 2140214 - DNA, 19 bp, Homo sapiens
cgctggaccttgaactggg

SEQ ID NO: 2140215 - DNA, 14 bp, Homo sapiens
cgctggcagccacc

SEQ ID NO: 2140216 - DNA, 19 bp, Homo sapiens
cgctggcccagggtagggg

SEQ ID NO: 2140217 - DNA, 12 bp, Homo sapiens
cgctggctcagg

SEQ ID NO: 2140218 - DNA, 21 bp, Homo sapiens
cgctggctcaggaagaaaccc

SEQ ID NO: 2140219 - DNA, 22 bp, Homo sapiens
cgctgggatttcttcgctgctc

SEQ ID NO: 2140220 - DNA, 13 bp, Homo sapiens
cgctggggaacag

SEQ ID NO: 2140221 - DNA, 21 bp, Homo sapiens
cgctggggaacagagcgggcc

SEQ ID NO: 2140222 - DNA, 16 bp, Homo sapiens
cgctgtcctctcgagc

SEQ ID NO: 2140223 - DNA, 15 bp, Homo sapiens
cgctgtcctgctgtg

SEQ ID NO: 2140224 - DNA, 12 bp, Homo sapiens
cgctgtggctcc

SEQ ID NO: 2140225 - DNA, 15 bp, Homo sapiens
cgctgtggctcctgc

SEQ ID NO: 2140226 - DNA, 16 bp, Homo sapiens
cgctgtggctcctgcc

SEQ ID NO: 2140227 - DNA, 16 bp, Homo sapiens
cgcttcacccctgcac

SEQ ID NO: 2140228 - DNA, 17 bp, Homo sapiens
cgcttcacccctgcact

SEQ ID NO: 2140229 - DNA, 14 bp, Homo sapiens
cgcttccagaccac

SEQ ID NO: 2140230 - DNA, 17 bp, Homo sapiens
cgcttccagaccacctg

SEQ ID NO: 2140231 - DNA, 18 bp, Homo sapiens
cgcttccagaccacctgc

SEQ ID NO: 2140232 - DNA, 22 bp, Homo sapiens
cgcttccagaccacctgccagc

SEQ ID NO: 2140233 - DNA, 23 bp, Homo sapiens
cgcttccagaccacctgccagcc

SEQ ID NO: 2140234 - DNA, 12 bp, Homo sapiens
cgcttcccagag

SEQ ID NO: 2140235 - DNA, 16 bp, Homo sapiens
cgcttccccacagaac

SEQ ID NO: 2140236 - DNA, 21 bp, Homo sapiens
cgcttccttagccttgctcag

SEQ ID NO: 2140237 - DNA, 16 bp, Homo sapiens
cgcttgagcccaggag

SEQ ID NO: 2140238 - DNA, 13 bp, Homo sapiens
cgcttgcttctgc

SEQ ID NO: 2140239 - DNA, 15 bp, Homo sapiens
cgcttgcttctgcag

SEQ ID NO: 2140240 - DNA, 13 bp, Homo sapiens
cgctttcatgaac

SEQ ID NO: 2140241 - DNA, 22 bp, Homo sapiens
cgctttctggaaaagaggagtt

SEQ ID NO: 2140242 - DNA, 13 bp, Homo sapiens
cgctttgcctgct

SEQ ID NO: 2140243 - DNA, 16 bp, Homo sapiens
cggaaaccttgcagca

SEQ ID NO: 2140244 - DNA, 17 bp, Homo sapiens
cggaagaatcacttgaa

SEQ ID NO: 2140245 - DNA, 21 bp, Homo sapiens
cggaagccgtctgactccaga

SEQ ID NO: 2140246 - DNA, 18 bp, Homo sapiens
cggaaggctggctgggca

SEQ ID NO: 2140247 - DNA, 19 bp, Homo sapiens
cggaaggggacgcgggctg

SEQ ID NO: 2140248 - DNA, 22 bp, Homo sapiens
cggaaggggacgcgggctgtgc

SEQ ID NO: 2140249 - DNA, 15 bp, Homo sapiens
cggaaggtcagttgc

SEQ ID NO: 2140250 - DNA, 21 bp, Homo sapiens
cggaatcctgtcgattagact

SEQ ID NO: 2140251 - DNA, 13 bp, Homo sapiens
cggacaagtttta

SEQ ID NO: 2140252 - DNA, 22 bp, Homo sapiens
cggacagccacggccaggccag

SEQ ID NO: 2140253 - DNA, 15 bp, Homo sapiens
cggaccaagatgggc

SEQ ID NO: 2140254 - DNA, 18 bp, Homo sapiens
cggaccgcgtagagagcc

SEQ ID NO: 2140255 - DNA, 15 bp, Homo sapiens
cggacgtttccatca

SEQ ID NO: 2140256 - DNA, 24 bp, Homo sapiens
cggagaagagctgttcacagccag

SEQ ID NO: 2140257 - DNA, 17 bp, Homo sapiens
cggagaaggccgctgcc

SEQ ID NO: 2140258 - DNA, 18 bp, Homo sapiens
cggagaaggccgctgccc

SEQ ID NO: 2140259 - DNA, 15 bp, Homo sapiens
cggagacagtgatct

SEQ ID NO: 2140260 - DNA, 15 bp, Homo sapiens
cggagaccctgagtc

SEQ ID NO: 2140261 - DNA, 21 bp, Homo sapiens
cggagagtacagtgagccaag

SEQ ID NO: 2140262 - DNA, 21 bp, Homo sapiens
cggagcacagccctgggaggg

SEQ ID NO: 2140263 - DNA, 19 bp, Homo sapiens
cggagcaggggtctgagcc

SEQ ID NO: 2140264 - DNA, 21 bp, Homo sapiens
cggaggagaccagctcagagg

SEQ ID NO: 2140265 - DNA, 14 bp, Homo sapiens
cggaggctgggccc

SEQ ID NO: 2140266 - DNA, 20 bp, Homo sapiens
cggaggctgggcccctggga

SEQ ID NO: 2140267 - DNA, 17 bp, Homo sapiens
cggagggattcccctaa

SEQ ID NO: 2140268 - DNA, 15 bp, Homo sapiens
cggaggggttgcggg

SEQ ID NO: 2140269 - DNA, 14 bp, Homo sapiens
cggaggtggtggag

SEQ ID NO: 2140270 - DNA, 17 bp, Homo sapiens
cggaggtggtggaggag

SEQ ID NO: 2140271 - DNA, 13 bp, Homo sapiens
cggaggttgcagg

SEQ ID NO: 2140272 - DNA, 19 bp, Homo sapiens
cggagtaatcaggcagcct

SEQ ID NO: 2140273 - DNA, 18 bp, Homo sapiens
cggagtacagacgtctca

SEQ ID NO: 2140274 - DNA, 21 bp, Homo sapiens
cggagtagaaattgttcctga

SEQ ID NO: 2140275 - DNA, 14 bp, Homo sapiens
cggagtcccacctt

SEQ ID NO: 2140276 - DNA, 16 bp, Homo sapiens
cggagtcccaccttgg

SEQ ID NO: 2140277 - DNA, 18 bp, Homo sapiens
cggagtcccaccttggct

SEQ ID NO: 2140278 - DNA, 22 bp, Homo sapiens
cggagtcccaccttggctgcag

SEQ ID NO: 2140279 - DNA, 23 bp, Homo sapiens
cggagtcccaccttggctgcagg

SEQ ID NO: 2140280 - DNA, 15 bp, Homo sapiens
cggatcgaggacaag

SEQ ID NO: 2140281 - DNA, 15 bp, Homo sapiens
cggatctcactcagc

SEQ ID NO: 2140282 - DNA, 13 bp, Homo sapiens
cggatgcacagag

SEQ ID NO: 2140283 - DNA, 15 bp, Homo sapiens
cggatgcacagagat

SEQ ID NO: 2140284 - DNA, 19 bp, Homo sapiens
cggatgttgtcaggaatca

SEQ ID NO: 2140285 - DNA, 17 bp, Homo sapiens
cggcaaccccagttctg

SEQ ID NO: 2140286 - DNA, 19 bp, Homo sapiens
cggcaactaagcagtccct

SEQ ID NO: 2140287 - DNA, 12 bp, Homo sapiens
ctaactgtaaat

SEQ ID NO: 2140288 - DNA, 14 bp, Homo sapiens
ctaactgtaaatca

SEQ ID NO: 2140289 - DNA, 16 bp, Homo sapiens
ctaactgtaaatcact

SEQ ID NO: 2140290 - DNA, 18 bp, Homo sapiens
ctaactgtaaatcacttg

SEQ ID NO: 2140291 - DNA, 19 bp, Homo sapiens
ctaactgtaaatcacttgt

SEQ ID NO: 2140292 - DNA, 21 bp, Homo sapiens
ctaactgtaaatcacttgtaa

SEQ ID NO: 2140293 - DNA, 21 bp, Homo sapiens
ctaagaagctctggccccagg

SEQ ID NO: 2140294 - DNA, 22 bp, Homo sapiens
ctaagaagctctggccccaggc

SEQ ID NO: 2140295 - DNA, 13 bp, Homo sapiens
ctaagacctcccc

SEQ ID NO: 2140296 - DNA, 15 bp, Homo sapiens
ctaagacctccccac

SEQ ID NO: 2140297 - DNA, 20 bp, Homo sapiens
ctaagacttcagtcctggtc

SEQ ID NO: 2140298 - DNA, 17 bp, Homo sapiens
ctaagagaagtagaaat

SEQ ID NO: 2140299 - DNA, 19 bp, Homo sapiens
ctaagagaagtagaaatca

SEQ ID NO: 2140300 - DNA, 24 bp, Homo sapiens
ctaagaggcgacttcctctccagc

SEQ ID NO: 2140301 - DNA, 13 bp, Homo sapiens
ctaagattgtaca

SEQ ID NO: 2140302 - DNA, 15 bp, Homo sapiens
ctaagattgtacata

SEQ ID NO: 2140303 - DNA, 12 bp, Homo sapiens
ctaagcaacaga

SEQ ID NO: 2140304 - DNA, 22 bp, Homo sapiens
ctaagcatcttgtcaagaaata

SEQ ID NO: 2140305 - DNA, 21 bp, Homo sapiens
ctaagccctgtcgagacactt

SEQ ID NO: 2140306 - DNA, 14 bp, Homo sapiens
ctaagctaggaatg

SEQ ID NO: 2140307 - DNA, 14 bp, Homo sapiens
ctaagctgcagctt

SEQ ID NO: 2140308 - DNA, 21 bp, Homo sapiens
ctaagctggagctcttggaag

SEQ ID NO: 2140309 - DNA, 23 bp, Homo sapiens
ctaagctggagctcttggaagag

SEQ ID NO: 2140310 - DNA, 24 bp, Homo sapiens
ctaagctggagctcttggaagagc

SEQ ID NO: 2140311 - DNA, 22 bp, Homo sapiens
ctaagctggagtgcttatccct

SEQ ID NO: 2140312 - DNA, 14 bp, Homo sapiens
ctaagctttctcct

SEQ ID NO: 2140313 - DNA, 15 bp, Homo sapiens
ctaagctttctcctt

SEQ ID NO: 2140314 - DNA, 16 bp, Homo sapiens
ctaaggaagggaaagg

SEQ ID NO: 2140315 - DNA, 12 bp, Homo sapiens
ctaaggacacac

SEQ ID NO: 2140316 - DNA, 13 bp, Homo sapiens
ctaaggagcatga

SEQ ID NO: 2140317 - DNA, 18 bp, Homo sapiens
ctaaggatctctcaggag

SEQ ID NO: 2140318 - DNA, 23 bp, Homo sapiens
ctaaggatctctcaggagcacag

SEQ ID NO: 2140319 - DNA, 19 bp, Homo sapiens
ctaaggtcccataataaaa

SEQ ID NO: 2140320 - DNA, 15 bp, Homo sapiens
ctaaggtgtgctctg

SEQ ID NO: 2140321 - DNA, 22 bp, Homo sapiens
ctaagtaaaaccacagcagttg

SEQ ID NO: 2140322 - DNA, 16 bp, Homo sapiens
ctaagtaaaagggtgg

SEQ ID NO: 2140323 - DNA, 22 bp, Homo sapiens
ctaagtagaataaagaaaaacg

SEQ ID NO: 2140324 - DNA, 17 bp, Homo sapiens
ctaagtaggggcagtga

SEQ ID NO: 2140325 - DNA, 16 bp, Homo sapiens
ctaagttatagtatat

SEQ ID NO: 2140326 - DNA, 23 bp, Homo sapiens
ctaagtttagaagcgctcatctg

SEQ ID NO: 2140327 - DNA, 16 bp, Homo sapiens
ctaataaagagactga

SEQ ID NO: 2140328 - DNA, 20 bp, Homo sapiens
ctaatagaactcagttttaa

SEQ ID NO: 2140329 - DNA, 17 bp, Homo sapiens
ctaatagactaaatgaa

SEQ ID NO: 2140330 - DNA, 23 bp, Homo sapiens
ctaatagcgggttactttcacat

SEQ ID NO: 2140331 - DNA, 17 bp, Homo sapiens
ctaatatacagggtagc

SEQ ID NO: 2140332 - DNA, 13 bp, Homo sapiens
ctaatattaaaaa

SEQ ID NO: 2140333 - DNA, 18 bp, Homo sapiens
ctaatatttaggcaagag

SEQ ID NO: 2140334 - DNA, 20 bp, Homo sapiens
ctaatcaggctgaggtgtct

SEQ ID NO: 2140335 - DNA, 20 bp, Homo sapiens
ctaatcagggaggtcatttt

SEQ ID NO: 2140336 - DNA, 21 bp, Homo sapiens
ctaatcagggaggtcattttg

SEQ ID NO: 2140337 - DNA, 12 bp, Homo sapiens
ctaatcctccaa

SEQ ID NO: 2140338 - DNA, 15 bp, Homo sapiens
ctaatcgaactatga

SEQ ID NO: 2140339 - DNA, 13 bp, Homo sapiens
ctaatctgtaggg

SEQ ID NO: 2140340 - DNA, 18 bp, Homo sapiens
ctaatctgtagggctgga

SEQ ID NO: 2140341 - DNA, 22 bp, Homo sapiens
ctaatcttgttaaattgcttat

SEQ ID NO: 2140342 - DNA, 17 bp, Homo sapiens
ctaatgaaattgagaag

SEQ ID NO: 2140343 - DNA, 22 bp, Homo sapiens
ctaatgctaagaaatgctgaaa

SEQ ID NO: 2140344 - DNA, 14 bp, Homo sapiens
ctaatggagaagac

SEQ ID NO: 2140345 - DNA, 12 bp, Homo sapiens
ctaatgggacac

SEQ ID NO: 2140346 - DNA, 17 bp, Homo sapiens
ctaatgtctcttcctct

SEQ ID NO: 2140347 - DNA, 23 bp, Homo sapiens
ctaatgtctcttcctctgttcta

SEQ ID NO: 2140348 - DNA, 19 bp, Homo sapiens
ctaatgtcttcatttcatt

SEQ ID NO: 2140349 - DNA, 15 bp, Homo sapiens
ctaattaaaaagtta

SEQ ID NO: 2140350 - DNA, 18 bp, Homo sapiens
ctaattaaaatctggaaa

SEQ ID NO: 2140351 - DNA, 23 bp, Homo sapiens
ctaattaaggtttgccctgcctg

SEQ ID NO: 2140352 - DNA, 19 bp, Homo sapiens
ctaattagggcatcctgcc

SEQ ID NO: 2140353 - DNA, 15 bp, Homo sapiens
ctaattcaatttatg

SEQ ID NO: 2140354 - DNA, 16 bp, Homo sapiens
ctaattcccagagtgt

SEQ ID NO: 2140355 - DNA, 17 bp, Homo sapiens
ctaattcccattttgca

SEQ ID NO: 2140356 - DNA, 20 bp, Homo sapiens
ctaattcccattttgcaaaa

SEQ ID NO: 2140357 - DNA, 21 bp, Homo sapiens
ctaattggaagaaattcctgt

SEQ ID NO: 2140358 - DNA, 22 bp, Homo sapiens
ctaattggcatgaaggtgtcat

SEQ ID NO: 2140359 - DNA, 12 bp, Homo sapiens
ctaatttaaacc

SEQ ID NO: 2140360 - DNA, 16 bp, Homo sapiens
ctaatttaaaccagca

SEQ ID NO: 2140361 - DNA, 18 bp, Homo sapiens
ctaatttatacaaaataa

SEQ ID NO: 2140362 - DNA, 23 bp, Homo sapiens
ctaatttatcctgaaatttcaga

SEQ ID NO: 2140363 - DNA, 20 bp, Homo sapiens
ctaatttttttgtattttag

SEQ ID NO: 2140364 - DNA, 23 bp, Homo sapiens
ctacaaaaaattagaaattggct

SEQ ID NO: 2140365 - DNA, 20 bp, Homo sapiens
ctacaaaacctgatgttaaa

SEQ ID NO: 2140366 - DNA, 21 bp, Homo sapiens
ctacaaaacctgatgttaaaa

SEQ ID NO: 2140367 - DNA, 11 bp, Homo sapiens
ctacaaaatgg

SEQ ID NO: 2140368 - DNA, 14 bp, Homo sapiens
ctacaaattatcat

SEQ ID NO: 2140369 - DNA, 15 bp, Homo sapiens
ctacaagcatatttg

SEQ ID NO: 2140370 - DNA, 16 bp, Homo sapiens
ctacaagcatatttga

SEQ ID NO: 2140371 - DNA, 15 bp, Homo sapiens
ctacaagcatttgcc

SEQ ID NO: 2140372 - DNA, 14 bp, Homo sapiens
ctacaataaatgct

SEQ ID NO: 2140373 - DNA, 12 bp, Homo sapiens
ctacacagcctg

SEQ ID NO: 2140374 - DNA, 19 bp, Homo sapiens
ctacacatatatgtatatg

SEQ ID NO: 2140375 - DNA, 19 bp, Homo sapiens
ctacaccactctggcagcc

SEQ ID NO: 2140376 - DNA, 22 bp, Homo sapiens
ctacaccactctggcagccaca

SEQ ID NO: 2140377 - DNA, 14 bp, Homo sapiens
ctacacctccctcc

SEQ ID NO: 2140378 - DNA, 20 bp, Homo sapiens
ctacactattgcattgttca

SEQ ID NO: 2140379 - DNA, 14 bp, Homo sapiens
ctacactccagcct

SEQ ID NO: 2140380 - DNA, 20 bp, Homo sapiens
ctacagaaatactgctctga

SEQ ID NO: 2140381 - DNA, 14 bp, Homo sapiens
ctacagaacaaaga

SEQ ID NO: 2140382 - DNA, 16 bp, Homo sapiens
ctacagaacaaagaac

SEQ ID NO: 2140383 - DNA, 14 bp, Homo sapiens
ctacagattttaga

SEQ ID NO: 2140384 - DNA, 18 bp, Homo sapiens
ctacaggagagggaagag

SEQ ID NO: 2140385 - DNA, 16 bp, Homo sapiens
ctacaggagtgagcac

SEQ ID NO: 2140386 - DNA, 14 bp, Homo sapiens
ctacaggtgtgagt

SEQ ID NO: 2140387 - DNA, 16 bp, Homo sapiens
ctacagtttcttactg

SEQ ID NO: 2140388 - DNA, 15 bp, Homo sapiens
ctacataatttagtt

SEQ ID NO: 2140389 - DNA, 18 bp, Homo sapiens
ctacatactatggaattt

SEQ ID NO: 2140390 - DNA, 17 bp, Homo sapiens
ctacatccccaggtctc

SEQ ID NO: 2140391 - DNA, 18 bp, Homo sapiens
ctacatcttcagctccca

SEQ ID NO: 2140392 - DNA, 21 bp, Homo sapiens
ctacatcttcagctcccatag

SEQ ID NO: 2140393 - DNA, 22 bp, Homo sapiens
ctacatcttcagctcccatagc

SEQ ID NO: 2140394 - DNA, 22 bp, Homo sapiens
ctacatggtattgtaatgaata

SEQ ID NO: 2140395 - DNA, 22 bp, Homo sapiens
ctacattccctggcctggctct

SEQ ID NO: 2140396 - DNA, 13 bp, Homo sapiens
ctacattcctcag

SEQ ID NO: 2140397 - DNA, 19 bp, Homo sapiens
ctaccaaatataaacttgt

SEQ ID NO: 2140398 - DNA, 17 bp, Homo sapiens
ctaccaaggcccagcta

SEQ ID NO: 2140399 - DNA, 13 bp, Homo sapiens
ctaccaagtgacc

SEQ ID NO: 2140400 - DNA, 15 bp, Homo sapiens
ctaccaatgcatgca

SEQ ID NO: 2140401 - DNA, 15 bp, Homo sapiens
ctatacatttctgtt

SEQ ID NO: 2140402 - DNA, 17 bp, Homo sapiens
ctatacccattcttcag

SEQ ID NO: 2140403 - DNA, 14 bp, Homo sapiens
ctatagagaggggg

SEQ ID NO: 2140404 - DNA, 21 bp, Homo sapiens
ctatagagagggggctctcca

SEQ ID NO: 2140405 - DNA, 14 bp, Homo sapiens
ctatagccaaaaat

SEQ ID NO: 2140406 - DNA, 19 bp, Homo sapiens
ctatagccaaaaatagcta

SEQ ID NO: 2140407 - DNA, 15 bp, Homo sapiens
ctatagcccaggtcc

SEQ ID NO: 2140408 - DNA, 19 bp, Homo sapiens
ctatagcctaggtgacaga

SEQ ID NO: 2140409 - DNA, 21 bp, Homo sapiens
ctatagcctaggtgacagagt

SEQ ID NO: 2140410 - DNA, 12 bp, Homo sapiens
ctatagctcttc

SEQ ID NO: 2140411 - DNA, 17 bp, Homo sapiens
ctatagctcttctattt

SEQ ID NO: 2140412 - DNA, 18 bp, Homo sapiens
ctatagctcttctattta

SEQ ID NO: 2140413 - DNA, 22 bp, Homo sapiens
ctatagtagtcaattagtacag

SEQ ID NO: 2140414 - DNA, 23 bp, Homo sapiens
ctatagtagtcaattagtacagt

SEQ ID NO: 2140415 - DNA, 18 bp, Homo sapiens
ctatataaggaggaaaac

SEQ ID NO: 2140416 - DNA, 14 bp, Homo sapiens
ctatatagagatgt

SEQ ID NO: 2140417 - DNA, 13 bp, Homo sapiens
ctatatatacatg

SEQ ID NO: 2140418 - DNA, 16 bp, Homo sapiens
ctatatatataaatat

SEQ ID NO: 2140419 - DNA, 15 bp, Homo sapiens
ctatatctctaaact

SEQ ID NO: 2140420 - DNA, 19 bp, Homo sapiens
ctatatggcaagaaagctg

SEQ ID NO: 2140421 - DNA, 19 bp, Homo sapiens
ctatattccgggtgccatt

SEQ ID NO: 2140422 - DNA, 13 bp, Homo sapiens
ctatattgtacac

SEQ ID NO: 2140423 - DNA, 13 bp, Homo sapiens
ctatatttagatt

SEQ ID NO: 2140424 - DNA, 23 bp, Homo sapiens
ctatatttagattgttaaaataa

SEQ ID NO: 2140425 - DNA, 17 bp, Homo sapiens
ctatcaaaacatatcaa

SEQ ID NO: 2140426 - DNA, 15 bp, Homo sapiens
ctatcaaaataaatt

SEQ ID NO: 2140427 - DNA, 13 bp, Homo sapiens
ctatcaaactgaa

SEQ ID NO: 2140428 - DNA, 16 bp, Homo sapiens
ctatcaaactgaagcc

SEQ ID NO: 2140429 - DNA, 21 bp, Homo sapiens
ctatcaaactgaagccagaaa

SEQ ID NO: 2140430 - DNA, 21 bp, Homo sapiens
ctatcaaccccagacactggt

SEQ ID NO: 2140431 - DNA, 21 bp, Homo sapiens
ctatcaacctaagcaacagaa

SEQ ID NO: 2140432 - DNA, 14 bp, Homo sapiens
ctatcaatagtcaa

SEQ ID NO: 2140433 - DNA, 15 bp, Homo sapiens
ctatcaatatttaag

SEQ ID NO: 2140434 - DNA, 16 bp, Homo sapiens
ctatcacatacaattt

SEQ ID NO: 2140435 - DNA, 13 bp, Homo sapiens
ctatcagaagacc

SEQ ID NO: 2140436 - DNA, 14 bp, Homo sapiens
ctatccaaaggaat

SEQ ID NO: 2140437 - DNA, 13 bp, Homo sapiens
ctatccacccagc

SEQ ID NO: 2140438 - DNA, 12 bp, Homo sapiens
ctatccatcctg

SEQ ID NO: 2140439 - DNA, 13 bp, Homo sapiens
ctatccatcctgc

SEQ ID NO: 2140440 - DNA, 19 bp, Homo sapiens
ctatccttccagtggctcg

SEQ ID NO: 2140441 - DNA, 19 bp, Homo sapiens
ctatccttggagagcagct

SEQ ID NO: 2140442 - DNA, 20 bp, Homo sapiens
ctatccttggagagcagctg

SEQ ID NO: 2140443 - DNA, 13 bp, Homo sapiens
ctatctatttgag

SEQ ID NO: 2140444 - DNA, 14 bp, Homo sapiens
ctatctatttgagg

SEQ ID NO: 2140445 - DNA, 19 bp, Homo sapiens
ctatctcttgtcatataaa

SEQ ID NO: 2140446 - DNA, 23 bp, Homo sapiens
ctatctgagactataactgtcat

SEQ ID NO: 2140447 - DNA, 17 bp, Homo sapiens
ctatctggaatttaatt

SEQ ID NO: 2140448 - DNA, 12 bp, Homo sapiens
ctatgaaaatca

SEQ ID NO: 2140449 - DNA, 13 bp, Homo sapiens
ctatgaaggctgt

SEQ ID NO: 2140450 - DNA, 17 bp, Homo sapiens
ctatgactgctccccag

SEQ ID NO: 2140451 - DNA, 17 bp, Homo sapiens
ctatgagaacaagtcac

SEQ ID NO: 2140452 - DNA, 22 bp, Homo sapiens
ctatgagaacaagtcacagctg

SEQ ID NO: 2140453 - DNA, 15 bp, Homo sapiens
ctatgatcacagtga

SEQ ID NO: 2140454 - DNA, 16 bp, Homo sapiens
ctatgatcacagtgac

SEQ ID NO: 2140455 - DNA, 21 bp, Homo sapiens
ctatgcaatttttaaactagt

SEQ ID NO: 2140456 - DNA, 17 bp, Homo sapiens
ctatgccccaaatatag

SEQ ID NO: 2140457 - DNA, 19 bp, Homo sapiens
ctatgccttgtctggggac

SEQ ID NO: 2140458 - DNA, 19 bp, Homo sapiens
ctatgctatttctggcctc

SEQ ID NO: 2140459 - DNA, 14 bp, Homo sapiens
ctatggagagccct

SEQ ID NO: 2140460 - DNA, 13 bp, Homo sapiens
ctatggagggcag

SEQ ID NO: 2140461 - DNA, 14 bp, Homo sapiens
ctatggagggcaga

SEQ ID NO: 2140462 - DNA, 16 bp, Homo sapiens
ctatggagggcagagt

SEQ ID NO: 2140463 - DNA, 19 bp, Homo sapiens
ctatggctgcctgcatcta

SEQ ID NO: 2140464 - DNA, 18 bp, Homo sapiens
ctatgggactcaatgcac

SEQ ID NO: 2140465 - DNA, 19 bp, Homo sapiens
ctatgggggcactgaggac

SEQ ID NO: 2140466 - DNA, 17 bp, Homo sapiens
ctatggtatgctggcca

SEQ ID NO: 2140467 - DNA, 21 bp, Homo sapiens
ctatggtatgctggccagcac

SEQ ID NO: 2140468 - DNA, 22 bp, Homo sapiens
ctatggtatgctggccagcacc

SEQ ID NO: 2140469 - DNA, 14 bp, Homo sapiens
ctatggtgaggtgt

SEQ ID NO: 2140470 - DNA, 20 bp, Homo sapiens
ctatggttcccaataaaagt

SEQ ID NO: 2140471 - DNA, 22 bp, Homo sapiens
ctatggttcccaataaaagtga

SEQ ID NO: 2140472 - DNA, 13 bp, Homo sapiens
ctatgtcccttgc

SEQ ID NO: 2140473 - DNA, 22 bp, Homo sapiens
ctatgtcctaaggacacactaa

SEQ ID NO: 2140474 - DNA, 23 bp, Homo sapiens
ctatgtcctaaggacacactaat

SEQ ID NO: 2140475 - DNA, 13 bp, Homo sapiens
ctatgtgacagac

SEQ ID NO: 2140476 - DNA, 11 bp, Homo sapiens
ctatgtgatgt

SEQ ID NO: 2140477 - DNA, 17 bp, Homo sapiens
ctatgtgggacacctca

SEQ ID NO: 2140478 - DNA, 21 bp, Homo sapiens
ctatgtgggacacctcaaata

SEQ ID NO: 2140479 - DNA, 15 bp, Homo sapiens
ctatgttgcccaggc

SEQ ID NO: 2140480 - DNA, 17 bp, Homo sapiens
ctatgttgcccaggcag

SEQ ID NO: 2140481 - DNA, 16 bp, Homo sapiens
ctatgttgcccaggct

SEQ ID NO: 2140482 - DNA, 17 bp, Homo sapiens
ctattaaagtgccattt

SEQ ID NO: 2140483 - DNA, 21 bp, Homo sapiens
ctattaagggaaaggaaaaga

SEQ ID NO: 2140484 - DNA, 14 bp, Homo sapiens
ctattaattccaag

SEQ ID NO: 2140485 - DNA, 18 bp, Homo sapiens
ctattacttgaactttcc

SEQ ID NO: 2140486 - DNA, 21 bp, Homo sapiens
ctattacttgaactttccaaa

SEQ ID NO: 2140487 - DNA, 17 bp, Homo sapiens
ctattagatgttttaca

SEQ ID NO: 2140488 - DNA, 20 bp, Homo sapiens
ctattatctgtgcttttgag

SEQ ID NO: 2140489 - DNA, 22 bp, Homo sapiens
ctattcaaggtggccaaattat

SEQ ID NO: 2140490 - DNA, 13 bp, Homo sapiens
ctattcagacaag

SEQ ID NO: 2140491 - DNA, 14 bp, Homo sapiens
ctattcctgaccct

SEQ ID NO: 2140492 - DNA, 14 bp, Homo sapiens
ctattctattgcag

SEQ ID NO: 2140493 - DNA, 14 bp, Homo sapiens
ctattctgagcctt

SEQ ID NO: 2140494 - DNA, 14 bp, Homo sapiens
ctattgaaattact

SEQ ID NO: 2140495 - DNA, 15 bp, Homo sapiens
ctattgaactgagcc

SEQ ID NO: 2140496 - DNA, 18 bp, Homo sapiens
ctattgaactgagccaaa

SEQ ID NO: 2140497 - DNA, 18 bp, Homo sapiens
ctattgatgtttccagaa

SEQ ID NO: 2140498 - DNA, 13 bp, Homo sapiens
ctattgcactcca

SEQ ID NO: 2140499 - DNA, 17 bp, Homo sapiens
ctattgcatgtaaaatg

SEQ ID NO: 2140500 - DNA, 18 bp, Homo sapiens
ctattgcatgtaaaatgc

SEQ ID NO: 2140501 - DNA, 16 bp, Homo sapiens
ctattgtagcatttct

SEQ ID NO: 2140502 - DNA, 22 bp, Homo sapiens
ctattgtcccctagcaaggcat

SEQ ID NO: 2140503 - DNA, 15 bp, Homo sapiens
ctattgttgtgggct

SEQ ID NO: 2140504 - DNA, 23 bp, Homo sapiens
ctattgtttaaaaacaggaaaaa

SEQ ID NO: 2140505 - DNA, 14 bp, Homo sapiens
ctattgtttattct

SEQ ID NO: 2140506 - DNA, 21 bp, Homo sapiens
ctattgtttctttaagaaagt

SEQ ID NO: 2140507 - DNA, 22 bp, Homo sapiens
ctatttaactggcttcagcctc

SEQ ID NO: 2140508 - DNA, 12 bp, Homo sapiens
ctatttaatatt

SEQ ID NO: 2140509 - DNA, 14 bp, Homo sapiens
ctatttaatattta

SEQ ID NO: 2140510 - DNA, 21 bp, Homo sapiens
ctatttataaactagatctcc

SEQ ID NO: 2140511 - DNA, 16 bp, Homo sapiens
ctatttattcattcag

SEQ ID NO: 2140512 - DNA, 14 bp, Homo sapiens
ctatttatttactg

SEQ ID NO: 2140513 - DNA, 18 bp, Homo sapiens
ctatttatttactgagct

SEQ ID NO: 2140514 - DNA, 12 bp, Homo sapiens
ctatttctacat

SEQ ID NO: 2140515 - DNA, 14 bp, Homo sapiens
ctatttctctcccc

SEQ ID NO: 2140516 - DNA, 21 bp, Homo sapiens
ctcccacaggcccttcctctc

SEQ ID NO: 2140517 - DNA, 12 bp, Homo sapiens
ctcccaccccac

SEQ ID NO: 2140518 - DNA, 13 bp, Homo sapiens
ctcccaccccacc

SEQ ID NO: 2140519 - DNA, 17 bp, Homo sapiens
ctcccaccccactccag

SEQ ID NO: 2140520 - DNA, 15 bp, Homo sapiens
ctcccacccccagcc

SEQ ID NO: 2140521 - DNA, 16 bp, Homo sapiens
ctcccacccccagccc

SEQ ID NO: 2140522 - DNA, 20 bp, Homo sapiens
ctcccaccccggcctccact

SEQ ID NO: 2140523 - DNA, 16 bp, Homo sapiens
ctcccacctcagcctc

SEQ ID NO: 2140524 - DNA, 17 bp, Homo sapiens
ctcccacctcagcctcc

SEQ ID NO: 2140525 - DNA, 23 bp, Homo sapiens
ctcccacgactgttgtacaagct

SEQ ID NO: 2140526 - DNA, 21 bp, Homo sapiens
ctcccacgtgggagacaagaa

SEQ ID NO: 2140527 - DNA, 20 bp, Homo sapiens
ctcccactggaacagcccat

SEQ ID NO: 2140528 - DNA, 17 bp, Homo sapiens
ctcccagatgctgggga

SEQ ID NO: 2140529 - DNA, 22 bp, Homo sapiens
ctcccagcaagtttcaccttgg

SEQ ID NO: 2140530 - DNA, 14 bp, Homo sapiens
ctcccagccccagg

SEQ ID NO: 2140531 - DNA, 16 bp, Homo sapiens
ctcccagccccagggg

SEQ ID NO: 2140532 - DNA, 11 bp, Homo sapiens
ctcccagcctg

SEQ ID NO: 2140533 - DNA, 15 bp, Homo sapiens
ctcccaggccccatg

SEQ ID NO: 2140534 - DNA, 16 bp, Homo sapiens
ctcccaggccccatga

SEQ ID NO: 2140535 - DNA, 19 bp, Homo sapiens
ctcccaggccccatgacct

SEQ ID NO: 2140536 - DNA, 22 bp, Homo sapiens
ctcccaggcgccccttccccct

SEQ ID NO: 2140537 - DNA, 19 bp, Homo sapiens
ctcccagggccagggccct

SEQ ID NO: 2140538 - DNA, 16 bp, Homo sapiens
ctcccatagcgctggc

SEQ ID NO: 2140539 - DNA, 15 bp, Homo sapiens
ctcccatcccctgga

SEQ ID NO: 2140540 - DNA, 16 bp, Homo sapiens
ctcccatcccctggac

SEQ ID NO: 2140541 - DNA, 23 bp, Homo sapiens
ctcccatcccctggactgggagg

SEQ ID NO: 2140542 - DNA, 20 bp, Homo sapiens
ctccccaaaacctttcccca

SEQ ID NO: 2140543 - DNA, 18 bp, Homo sapiens
ctccccaaacccatcaga

SEQ ID NO: 2140544 - DNA, 20 bp, Homo sapiens
ctccccacccccgctggggg

SEQ ID NO: 2140545 - DNA, 16 bp, Homo sapiens
ctccccaccttcccca

SEQ ID NO: 2140546 - DNA, 17 bp, Homo sapiens
ctccccaccttccccag

SEQ ID NO: 2140547 - DNA, 20 bp, Homo sapiens
ctccccacgagtcacctgca

SEQ ID NO: 2140548 - DNA, 21 bp, Homo sapiens
ctccccacgagtcacctgcaa

SEQ ID NO: 2140549 - DNA, 12 bp, Homo sapiens
ctccccactctg

SEQ ID NO: 2140550 - DNA, 14 bp, Homo sapiens
ctccccactctgct

SEQ ID NO: 2140551 - DNA, 16 bp, Homo sapiens
ctccccactctgctct

SEQ ID NO: 2140552 - DNA, 21 bp, Homo sapiens
ctccccactctgctctgatgc

SEQ ID NO: 2140553 - DNA, 22 bp, Homo sapiens
ctccccactctgctctgatgca

SEQ ID NO: 2140554 - DNA, 12 bp, Homo sapiens
ctccccactgaa

SEQ ID NO: 2140555 - DNA, 21 bp, Homo sapiens
ctccccagcaagtgagagctg

SEQ ID NO: 2140556 - DNA, 12 bp, Homo sapiens
ctccccagccct

SEQ ID NO: 2140557 - DNA, 13 bp, Homo sapiens
ctccccagccctg

SEQ ID NO: 2140558 - DNA, 17 bp, Homo sapiens
ctccccaggactcaccc

SEQ ID NO: 2140559 - DNA, 18 bp, Homo sapiens
ctccccaggactcaccct

SEQ ID NO: 2140560 - DNA, 12 bp, Homo sapiens
ctccccaggcca

SEQ ID NO: 2140561 - DNA, 18 bp, Homo sapiens
ctccccaggcctccagcc

SEQ ID NO: 2140562 - DNA, 20 bp, Homo sapiens
ctccccaggcctccagcctc

SEQ ID NO: 2140563 - DNA, 21 bp, Homo sapiens
ctccccaggggagagggtctg

SEQ ID NO: 2140564 - DNA, 15 bp, Homo sapiens
ctccccatcccatgt

SEQ ID NO: 2140565 - DNA, 17 bp, Homo sapiens
ctccccattcacagagc

SEQ ID NO: 2140566 - DNA, 13 bp, Homo sapiens
ctcccccagagcc

SEQ ID NO: 2140567 - DNA, 13 bp, Homo sapiens
ctccccccactgc

SEQ ID NO: 2140568 - DNA, 16 bp, Homo sapiens
ctccccccactgcagg

SEQ ID NO: 2140569 - DNA, 16 bp, Homo sapiens
ctccccccagcccctc

SEQ ID NO: 2140570 - DNA, 21 bp, Homo sapiens
ctccccccagcccctcctccc

SEQ ID NO: 2140571 - DNA, 16 bp, Homo sapiens
ctcccccgacactgct

SEQ ID NO: 2140572 - DNA, 22 bp, Homo sapiens
ctcccccgacactgctgcacca

SEQ ID NO: 2140573 - DNA, 14 bp, Homo sapiens
ctccccctcagatg

SEQ ID NO: 2140574 - DNA, 16 bp, Homo sapiens
ctccccctgccagtgc

SEQ ID NO: 2140575 - DNA, 17 bp, Homo sapiens
ctccccctgccagtgcc

SEQ ID NO: 2140576 - DNA, 23 bp, Homo sapiens
ctcccccttccccttctgtgtca

SEQ ID NO: 2140577 - DNA, 23 bp, Homo sapiens
ctcccctatccacccagcccatt

SEQ ID NO: 2140578 - DNA, 18 bp, Homo sapiens
ctcccctcccccctgtaa

SEQ ID NO: 2140579 - DNA, 14 bp, Homo sapiens
ctcccctcggagaa

SEQ ID NO: 2140580 - DNA, 14 bp, Homo sapiens
ctcccctctgccct

SEQ ID NO: 2140581 - DNA, 15 bp, Homo sapiens
ctcccctctgccctg

SEQ ID NO: 2140582 - DNA, 16 bp, Homo sapiens
ctcccctctgccctgt

SEQ ID NO: 2140583 - DNA, 13 bp, Homo sapiens
ctcccctcttgag

SEQ ID NO: 2140584 - DNA, 12 bp, Homo sapiens
ctcccctgccag

SEQ ID NO: 2140585 - DNA, 14 bp, Homo sapiens
ctcccctgccaggg

SEQ ID NO: 2140586 - DNA, 13 bp, Homo sapiens
ctcccctgccctg

SEQ ID NO: 2140587 - DNA, 15 bp, Homo sapiens
ctcccctgccctgct

SEQ ID NO: 2140588 - DNA, 22 bp, Homo sapiens
ctcccctggaactgtctctcat

SEQ ID NO: 2140589 - DNA, 11 bp, Homo sapiens
ctccccttcct

SEQ ID NO: 2140590 - DNA, 18 bp, Homo sapiens
ctccccttcctgcacccg

SEQ ID NO: 2140591 - DNA, 19 bp, Homo sapiens
ctcccgaatagctgggact

SEQ ID NO: 2140592 - DNA, 20 bp, Homo sapiens
ctcccgaatagctgggacta

SEQ ID NO: 2140593 - DNA, 15 bp, Homo sapiens
ctcccgcaccaggcc

SEQ ID NO: 2140594 - DNA, 18 bp, Homo sapiens
ctcccgcaccaggccggg

SEQ ID NO: 2140595 - DNA, 13 bp, Homo sapiens
ctcccggctgcct

SEQ ID NO: 2140596 - DNA, 14 bp, Homo sapiens
ctcccggctgcctg

SEQ ID NO: 2140597 - DNA, 16 bp, Homo sapiens
ctcccggctgcctgcc

SEQ ID NO: 2140598 - DNA, 17 bp, Homo sapiens
ctcccggctgcctgccg

SEQ ID NO: 2140599 - DNA, 15 bp, Homo sapiens
ctcccggtgcccaag

SEQ ID NO: 2140600 - DNA, 15 bp, Homo sapiens
ctccctaaaataaaa

SEQ ID NO: 2140601 - DNA, 23 bp, Homo sapiens
ctccctaaaataaaaaccagaat

SEQ ID NO: 2140602 - DNA, 19 bp, Homo sapiens
ctccctaagaaaccccagg

SEQ ID NO: 2140603 - DNA, 19 bp, Homo sapiens
ctccctaaggaatctgaaa

SEQ ID NO: 2140604 - DNA, 18 bp, Homo sapiens
ctccctacctgaggccta

SEQ ID NO: 2140605 - DNA, 17 bp, Homo sapiens
ctccctcacccccaggt

SEQ ID NO: 2140606 - DNA, 13 bp, Homo sapiens
ctccctcattcca

SEQ ID NO: 2140607 - DNA, 13 bp, Homo sapiens
ctccctccacccc

SEQ ID NO: 2140608 - DNA, 15 bp, Homo sapiens
ctccctccaccccag

SEQ ID NO: 2140609 - DNA, 18 bp, Homo sapiens
ctccctccaccccaggac

SEQ ID NO: 2140610 - DNA, 19 bp, Homo sapiens
ctccctccaccccaggacg

SEQ ID NO: 2140611 - DNA, 22 bp, Homo sapiens
ctccctccagggaatccgcctg

SEQ ID NO: 2140612 - DNA, 19 bp, Homo sapiens
ctccctcctggagcatccc

SEQ ID NO: 2140613 - DNA, 22 bp, Homo sapiens
ctccctcctggagcatcccagg

SEQ ID NO: 2140614 - DNA, 21 bp, Homo sapiens
ctccctctgacctgcaggcca

SEQ ID NO: 2140615 - DNA, 12 bp, Homo sapiens
ctccctctgccc

SEQ ID NO: 2140616 - DNA, 15 bp, Homo sapiens
ctccctctggccctg

SEQ ID NO: 2140617 - DNA, 17 bp, Homo sapiens
ctccctctggccctgcc

SEQ ID NO: 2140618 - DNA, 15 bp, Homo sapiens
ctccctcttccttcc

SEQ ID NO: 2140619 - DNA, 19 bp, Homo sapiens
ctccctgaaccatccctga

SEQ ID NO: 2140620 - DNA, 21 bp, Homo sapiens
ctccctgaacctcagtttcct

SEQ ID NO: 2140621 - DNA, 18 bp, Homo sapiens
ctccctgactccctgtgg

SEQ ID NO: 2140622 - DNA, 20 bp, Homo sapiens
ctccctgactccctgtgggg

SEQ ID NO: 2140623 - DNA, 17 bp, Homo sapiens
ctccctgagctttgggg

SEQ ID NO: 2140624 - DNA, 13 bp, Homo sapiens
ctccctgcccctc

SEQ ID NO: 2140625 - DNA, 21 bp, Homo sapiens
ctccctgcccctcccttcaac

SEQ ID NO: 2140626 - DNA, 19 bp, Homo sapiens
ctccctgccctgtcctcca

SEQ ID NO: 2140627 - DNA, 20 bp, Homo sapiens
ctccctgccctgtcctccag

SEQ ID NO: 2140628 - DNA, 12 bp, Homo sapiens
ctccctggagtg

SEQ ID NO: 2140629 - DNA, 23 bp, Homo sapiens
ctccctggatcagaacaggagct

SEQ ID NO: 2140630 - DNA, 23 bp, Homo sapiens
ctccctggcatgaccatcctgtc

SEQ ID NO: 2140631 - DNA, 14 bp, Homo sapiens
ctctggctccagaa

SEQ ID NO: 2140632 - DNA, 12 bp, Homo sapiens
ctctggcttcca

SEQ ID NO: 2140633 - DNA, 18 bp, Homo sapiens
ctctggctttgtctctag

SEQ ID NO: 2140634 - DNA, 21 bp, Homo sapiens
ctctgggaaggggtgccctct

SEQ ID NO: 2140635 - DNA, 18 bp, Homo sapiens
ctctgggagactttccct

SEQ ID NO: 2140636 - DNA, 18 bp, Homo sapiens
ctctgggcagctgtcatg

SEQ ID NO: 2140637 - DNA, 22 bp, Homo sapiens
ctctgggctcagggctggagtg

SEQ ID NO: 2140638 - DNA, 14 bp, Homo sapiens
ctctggggccctgg

SEQ ID NO: 2140639 - DNA, 16 bp, Homo sapiens
ctctggggccctgggc

SEQ ID NO: 2140640 - DNA, 22 bp, Homo sapiens
ctctggggccctgggcctcagt

SEQ ID NO: 2140641 - DNA, 17 bp, Homo sapiens
ctctgggtccctcggag

SEQ ID NO: 2140642 - DNA, 17 bp, Homo sapiens
ctctggtggaacctgca

SEQ ID NO: 2140643 - DNA, 13 bp, Homo sapiens
ctctggtggtgct

SEQ ID NO: 2140644 - DNA, 16 bp, Homo sapiens
ctctgtcatcactccc

SEQ ID NO: 2140645 - DNA, 21 bp, Homo sapiens
ctctgtcatcactccctggat

SEQ ID NO: 2140646 - DNA, 16 bp, Homo sapiens
ctctgtccactctgaa

SEQ ID NO: 2140647 - DNA, 15 bp, Homo sapiens
ctctgtccaggccac

SEQ ID NO: 2140648 - DNA, 16 bp, Homo sapiens
ctctgtccaggccact

SEQ ID NO: 2140649 - DNA, 22 bp, Homo sapiens
ctctgtccagggccctgagctc

SEQ ID NO: 2140650 - DNA, 15 bp, Homo sapiens
ctctgtccctcactg

SEQ ID NO: 2140651 - DNA, 18 bp, Homo sapiens
ctctgtccctcactgcct

SEQ ID NO: 2140652 - DNA, 21 bp, Homo sapiens
ctctgtccctcactgccttcc

SEQ ID NO: 2140653 - DNA, 22 bp, Homo sapiens
ctctgtcctgggagtgagctgg

SEQ ID NO: 2140654 - DNA, 18 bp, Homo sapiens
ctctgtcgcccagtctgg

SEQ ID NO: 2140655 - DNA, 23 bp, Homo sapiens
ctctgtctcgagcgccctgcaga

SEQ ID NO: 2140656 - DNA, 13 bp, Homo sapiens
ctctgtctctgct

SEQ ID NO: 2140657 - DNA, 23 bp, Homo sapiens
ctctgtgaacgatttagaaagaa

SEQ ID NO: 2140658 - DNA, 15 bp, Homo sapiens
ctctgtgacctgccc

SEQ ID NO: 2140659 - DNA, 19 bp, Homo sapiens
ctctgtgactcgcttagct

SEQ ID NO: 2140660 - DNA, 17 bp, Homo sapiens
ctctgtgccagagcctg

SEQ ID NO: 2140661 - DNA, 16 bp, Homo sapiens
ctctgtgcccctgtaa

SEQ ID NO: 2140662 - DNA, 15 bp, Homo sapiens
ctctgtggcctgtgt

SEQ ID NO: 2140663 - DNA, 19 bp, Homo sapiens
ctctgtgtcaggtggggca

SEQ ID NO: 2140664 - DNA, 22 bp, Homo sapiens
ctctgtgtcaggtggggcagct

SEQ ID NO: 2140665 - DNA, 19 bp, Homo sapiens
ctcttaaaaaataaaaact

SEQ ID NO: 2140666 - DNA, 19 bp, Homo sapiens
ctcttaggaagagaaacca

SEQ ID NO: 2140667 - DNA, 13 bp, Homo sapiens
ctcttagtgcccg

SEQ ID NO: 2140668 - DNA, 16 bp, Homo sapiens
ctcttagtgcccgcct

SEQ ID NO: 2140669 - DNA, 18 bp, Homo sapiens
ctcttatagaatatttat

SEQ ID NO: 2140670 - DNA, 20 bp, Homo sapiens
ctcttatatagtattcattt

SEQ ID NO: 2140671 - DNA, 13 bp, Homo sapiens
ctcttattgccca

SEQ ID NO: 2140672 - DNA, 15 bp, Homo sapiens
ctcttcactcagcca

SEQ ID NO: 2140673 - DNA, 18 bp, Homo sapiens
ctcttcactcagccacac

SEQ ID NO: 2140674 - DNA, 17 bp, Homo sapiens
ctcttcactcccaataa

SEQ ID NO: 2140675 - DNA, 23 bp, Homo sapiens
ctcttcagcccctagtgctattc

SEQ ID NO: 2140676 - DNA, 13 bp, Homo sapiens
ctcttcaggaggc

SEQ ID NO: 2140677 - DNA, 19 bp, Homo sapiens
ctcttcatactttttttca

SEQ ID NO: 2140678 - DNA, 15 bp, Homo sapiens
ctcttcccctttcct

SEQ ID NO: 2140679 - DNA, 15 bp, Homo sapiens
ctcttccctcagttt

SEQ ID NO: 2140680 - DNA, 12 bp, Homo sapiens
ctcttccctcct

SEQ ID NO: 2140681 - DNA, 19 bp, Homo sapiens
ctcttcctacccaaccact

SEQ ID NO: 2140682 - DNA, 20 bp, Homo sapiens
ctcttcctacccaaccactc

SEQ ID NO: 2140683 - DNA, 12 bp, Homo sapiens
ctcttcctctgt

SEQ ID NO: 2140684 - DNA, 12 bp, Homo sapiens
ctcttccttccc

SEQ ID NO: 2140685 - DNA, 21 bp, Homo sapiens
ctcttctaactcatgggtacc

SEQ ID NO: 2140686 - DNA, 16 bp, Homo sapiens
ctcttctatttaaaaa

SEQ ID NO: 2140687 - DNA, 19 bp, Homo sapiens
ctcttctatttaaaaaata

SEQ ID NO: 2140688 - DNA, 12 bp, Homo sapiens
ctcttctccact

SEQ ID NO: 2140689 - DNA, 14 bp, Homo sapiens
ctcttctccactgg

SEQ ID NO: 2140690 - DNA, 17 bp, Homo sapiens
ctcttctccactggatg

SEQ ID NO: 2140691 - DNA, 15 bp, Homo sapiens
ctcttctccaggctg

SEQ ID NO: 2140692 - DNA, 16 bp, Homo sapiens
ctcttctccaggctgt

SEQ ID NO: 2140693 - DNA, 13 bp, Homo sapiens
ctcttctcccccc

SEQ ID NO: 2140694 - DNA, 20 bp, Homo sapiens
ctcttctctattcctgaccc

SEQ ID NO: 2140695 - DNA, 17 bp, Homo sapiens
ctcttctgccagcctcc

SEQ ID NO: 2140696 - DNA, 16 bp, Homo sapiens
ctcttctgtcatcccg

SEQ ID NO: 2140697 - DNA, 19 bp, Homo sapiens
ctcttctgtcatcccgctc

SEQ ID NO: 2140698 - DNA, 16 bp, Homo sapiens
ctcttctgttctcaaa

SEQ ID NO: 2140699 - DNA, 19 bp, Homo sapiens
ctcttctgttctcaaatgc

SEQ ID NO: 2140700 - DNA, 16 bp, Homo sapiens
ctcttctttctgagag

SEQ ID NO: 2140701 - DNA, 23 bp, Homo sapiens
ctcttcttttaaaccattttctt

SEQ ID NO: 2140702 - DNA, 13 bp, Homo sapiens
ctcttgcaggctg

SEQ ID NO: 2140703 - DNA, 17 bp, Homo sapiens
ctcttgcaggctgagtc

SEQ ID NO: 2140704 - DNA, 21 bp, Homo sapiens
ctcttgcatcctcctcccaac

SEQ ID NO: 2140705 - DNA, 17 bp, Homo sapiens
ctcttgccactgcctct

SEQ ID NO: 2140706 - DNA, 14 bp, Homo sapiens
ctcttgcctctctc

SEQ ID NO: 2140707 - DNA, 15 bp, Homo sapiens
ctcttgcctctctca

SEQ ID NO: 2140708 - DNA, 12 bp, Homo sapiens
ctcttgcctgta

SEQ ID NO: 2140709 - DNA, 18 bp, Homo sapiens
ctcttgcctttccacctg

SEQ ID NO: 2140710 - DNA, 20 bp, Homo sapiens
ctcttgcctttccacctgct

SEQ ID NO: 2140711 - DNA, 16 bp, Homo sapiens
ctcttgctattggaat

SEQ ID NO: 2140712 - DNA, 18 bp, Homo sapiens
ctcttgctattggaatgt

SEQ ID NO: 2140713 - DNA, 19 bp, Homo sapiens
ctcttgctcaaaaatctgt

SEQ ID NO: 2140714 - DNA, 20 bp, Homo sapiens
ctcttgctcaaaaatctgtt

SEQ ID NO: 2140715 - DNA, 19 bp, Homo sapiens
ctcttggacctctgctctg

SEQ ID NO: 2140716 - DNA, 23 bp, Homo sapiens
ctcttgggaactccactctcctt

SEQ ID NO: 2140717 - DNA, 22 bp, Homo sapiens
ctcttgggagtcaggacctccg

SEQ ID NO: 2140718 - DNA, 16 bp, Homo sapiens
ctcttggtccctggtc

SEQ ID NO: 2140719 - DNA, 13 bp, Homo sapiens
ctcttgttgcaga

SEQ ID NO: 2140720 - DNA, 16 bp, Homo sapiens
ctcttgttttcagttt

SEQ ID NO: 2140721 - DNA, 20 bp, Homo sapiens
ctctttaatgtcacaggcag

SEQ ID NO: 2140722 - DNA, 17 bp, Homo sapiens
ctctttatgactgtttt

SEQ ID NO: 2140723 - DNA, 20 bp, Homo sapiens
ctctttatttctagcagagt

SEQ ID NO: 2140724 - DNA, 12 bp, Homo sapiens
ctctttcagaga

SEQ ID NO: 2140725 - DNA, 22 bp, Homo sapiens
ctctttcctgttgttgttaatg

SEQ ID NO: 2140726 - DNA, 12 bp, Homo sapiens
ctctttctccct

SEQ ID NO: 2140727 - DNA, 21 bp, Homo sapiens
ctctttcttattttgtaataa

SEQ ID NO: 2140728 - DNA, 23 bp, Homo sapiens
ctctttcttattttgtaataaac

SEQ ID NO: 2140729 - DNA, 13 bp, Homo sapiens
ctctttcttcttt

SEQ ID NO: 2140730 - DNA, 20 bp, Homo sapiens
ctctttctttcttttgtgtt

SEQ ID NO: 2140731 - DNA, 20 bp, Homo sapiens
ctctttctttttctgtctct

SEQ ID NO: 2140732 - DNA, 14 bp, Homo sapiens
ctctttgctacaat

SEQ ID NO: 2140733 - DNA, 17 bp, Homo sapiens
ctctttggggtcagcca

SEQ ID NO: 2140734 - DNA, 19 bp, Homo sapiens
ctctttggggtcagccagg

SEQ ID NO: 2140735 - DNA, 20 bp, Homo sapiens
ctctttgttcagttgactta

SEQ ID NO: 2140736 - DNA, 21 bp, Homo sapiens
ctcttttacaatcctaatcat

SEQ ID NO: 2140737 - DNA, 20 bp, Homo sapiens
ctcttttgaatccatgcttg

SEQ ID NO: 2140738 - DNA, 22 bp, Homo sapiens
ctctttttagggccaggcaggt

SEQ ID NO: 2140739 - DNA, 19 bp, Homo sapiens
ctcttttttcaactggctg

SEQ ID NO: 2140740 - DNA, 18 bp, Homo sapiens
ctgaaaaaaagtttacaa

SEQ ID NO: 2140741 - DNA, 20 bp, Homo sapiens
ctgaaaaaaagtttacaagt

SEQ ID NO: 2140742 - DNA, 15 bp, Homo sapiens
ctgaaaacccagaga

SEQ ID NO: 2140743 - DNA, 15 bp, Homo sapiens
ctgaaaacgaagggg

SEQ ID NO: 2140744 - DNA, 21 bp, Homo sapiens
ctgaaaactggaataagaagc

SEQ ID NO: 2140745 - DNA, 23 bp, Homo sapiens
ctgaaaactggaataagaagcaa

SEQ ID NO: 2140746 - DNA, 17 bp, Homo sapiens
ctgcatgctctggaagc

SEQ ID NO: 2140747 - DNA, 20 bp, Homo sapiens
ctgcattcaggatcaaaccc

SEQ ID NO: 2140748 - DNA, 22 bp, Homo sapiens
ctgcattccccgctgcccaatc

SEQ ID NO: 2140749 - DNA, 15 bp, Homo sapiens
ctgcattgttattgt

SEQ ID NO: 2140750 - DNA, 20 bp, Homo sapiens
ctgcattgttattgtggaag

SEQ ID NO: 2140751 - DNA, 13 bp, Homo sapiens
ctgcatttctgag

SEQ ID NO: 2140752 - DNA, 14 bp, Homo sapiens
ctgcatttgtgaaa

SEQ ID NO: 2140753 - DNA, 12 bp, Homo sapiens
ctgccaaaacaa

SEQ ID NO: 2140754 - DNA, 14 bp, Homo sapiens
ctgccaaggtgtgg

SEQ ID NO: 2140755 - DNA, 17 bp, Homo sapiens
ctgccaaggtgtggcct

SEQ ID NO: 2140756 - DNA, 15 bp, Homo sapiens
ctgccacacctgagc

SEQ ID NO: 2140757 - DNA, 12 bp, Homo sapiens
ctgccacagaga

SEQ ID NO: 2140758 - DNA, 13 bp, Homo sapiens
ctgccaccacccc

SEQ ID NO: 2140759 - DNA, 21 bp, Homo sapiens
ctgccaccacgtctgccaggc

SEQ ID NO: 2140760 - DNA, 22 bp, Homo sapiens
ctgccaccacgtctgccaggcc

SEQ ID NO: 2140761 - DNA, 23 bp, Homo sapiens
ctgccaccacgtctgccaggccc

SEQ ID NO: 2140762 - DNA, 16 bp, Homo sapiens
ctgccaccctggggag

SEQ ID NO: 2140763 - DNA, 12 bp, Homo sapiens
ctgccacctccc

SEQ ID NO: 2140764 - DNA, 12 bp, Homo sapiens
ctgccacctgtc

SEQ ID NO: 2140765 - DNA, 18 bp, Homo sapiens
ctgccacctgtctgtctg

SEQ ID NO: 2140766 - DNA, 15 bp, Homo sapiens
ctgccactgacctca

SEQ ID NO: 2140767 - DNA, 18 bp, Homo sapiens
ctgccagagcccaagtgc

SEQ ID NO: 2140768 - DNA, 19 bp, Homo sapiens
ctgccagagcccaagtgcc

SEQ ID NO: 2140769 - DNA, 20 bp, Homo sapiens
ctgccagccagcagccagct

SEQ ID NO: 2140770 - DNA, 23 bp, Homo sapiens
ctgccagccagcagccagctctc

SEQ ID NO: 2140771 - DNA, 21 bp, Homo sapiens
ctgccagccatcacaagggga

SEQ ID NO: 2140772 - DNA, 12 bp, Homo sapiens
ctgccagcctgg

SEQ ID NO: 2140773 - DNA, 23 bp, Homo sapiens
ctgccagcctggcttctggagcc

SEQ ID NO: 2140774 - DNA, 14 bp, Homo sapiens
ctgccagctgcctt

SEQ ID NO: 2140775 - DNA, 15 bp, Homo sapiens
ctgccagctgccttc

SEQ ID NO: 2140776 - DNA, 23 bp, Homo sapiens
ctgccagctgccttcctcatccc

SEQ ID NO: 2140777 - DNA, 15 bp, Homo sapiens
ctgccaggacacctg

SEQ ID NO: 2140778 - DNA, 21 bp, Homo sapiens
ctgccaggacacctgccccag

SEQ ID NO: 2140779 - DNA, 11 bp, Homo sapiens
ctgccaggagg

SEQ ID NO: 2140780 - DNA, 18 bp, Homo sapiens
ctgccaggagggacaaag

SEQ ID NO: 2140781 - DNA, 22 bp, Homo sapiens
ctgccaggagggacaaaggagc

SEQ ID NO: 2140782 - DNA, 18 bp, Homo sapiens
ctgccaggcacctggcct

SEQ ID NO: 2140783 - DNA, 19 bp, Homo sapiens
ctgccaggcacctggcctg

SEQ ID NO: 2140784 - DNA, 12 bp, Homo sapiens
ctgccaggccca

SEQ ID NO: 2140785 - DNA, 13 bp, Homo sapiens
ctgccaggcccat

SEQ ID NO: 2140786 - DNA, 23 bp, Homo sapiens
ctgccaggcccatctcaggtgcc

SEQ ID NO: 2140787 - DNA, 19 bp, Homo sapiens
ctgccaggcgttggtgcca

SEQ ID NO: 2140788 - DNA, 13 bp, Homo sapiens
ctgccagggctcg

SEQ ID NO: 2140789 - DNA, 16 bp, Homo sapiens
ctgccagggctcgggc

SEQ ID NO: 2140790 - DNA, 19 bp, Homo sapiens
ctgccagggctcgggcgct

SEQ ID NO: 2140791 - DNA, 17 bp, Homo sapiens
ctgccagtccccctgcc

SEQ ID NO: 2140792 - DNA, 20 bp, Homo sapiens
ctgccagtccccctgcccca

SEQ ID NO: 2140793 - DNA, 14 bp, Homo sapiens
ctgccagtgcctta

SEQ ID NO: 2140794 - DNA, 20 bp, Homo sapiens
ctgccagtgccttacctcct

SEQ ID NO: 2140795 - DNA, 22 bp, Homo sapiens
ctgccagtgccttacctcctgc

SEQ ID NO: 2140796 - DNA, 15 bp, Homo sapiens
ctgccataccgctgg

SEQ ID NO: 2140797 - DNA, 20 bp, Homo sapiens
ctgccatattctgttggcca

SEQ ID NO: 2140798 - DNA, 12 bp, Homo sapiens
ctgccatccagg

SEQ ID NO: 2140799 - DNA, 18 bp, Homo sapiens
ctgccatccaggttcagc

SEQ ID NO: 2140800 - DNA, 18 bp, Homo sapiens
ctgccatgccactgccag

SEQ ID NO: 2140801 - DNA, 20 bp, Homo sapiens
ctgccatgccactgccaggc

SEQ ID NO: 2140802 - DNA, 15 bp, Homo sapiens
ctgccatgcccagag

SEQ ID NO: 2140803 - DNA, 19 bp, Homo sapiens
ctgccatgcctcaagaaca

SEQ ID NO: 2140804 - DNA, 14 bp, Homo sapiens
ctgccatggcgtgt

SEQ ID NO: 2140805 - DNA, 21 bp, Homo sapiens
ctgccatggcgtgtccctctc

SEQ ID NO: 2140806 - DNA, 17 bp, Homo sapiens
ctgcccactcccaggac

SEQ ID NO: 2140807 - DNA, 13 bp, Homo sapiens
ctgcccactgtga

SEQ ID NO: 2140808 - DNA, 19 bp, Homo sapiens
ctgcccacttagccgtcca

SEQ ID NO: 2140809 - DNA, 23 bp, Homo sapiens
ctgcccacttagccgtccatggc

SEQ ID NO: 2140810 - DNA, 24 bp, Homo sapiens
ctgcccacttagccgtccatggca

SEQ ID NO: 2140811 - DNA, 13 bp, Homo sapiens
ctgcccacttcag

SEQ ID NO: 2140812 - DNA, 17 bp, Homo sapiens
ctgcccacttcagccca

SEQ ID NO: 2140813 - DNA, 22 bp, Homo sapiens
ctgcccagaattcccagctgtc

SEQ ID NO: 2140814 - DNA, 12 bp, Homo sapiens
ctgcccagcctc

SEQ ID NO: 2140815 - DNA, 20 bp, Homo sapiens
ctgcccagcctcgcatgcca

SEQ ID NO: 2140816 - DNA, 11 bp, Homo sapiens
ctgcccaggag

SEQ ID NO: 2140817 - DNA, 12 bp, Homo sapiens
ctgcccaggaga

SEQ ID NO: 2140818 - DNA, 18 bp, Homo sapiens
ctgcccaggagagccagc

SEQ ID NO: 2140819 - DNA, 19 bp, Homo sapiens
ctgcccaggagagccagcc

SEQ ID NO: 2140820 - DNA, 21 bp, Homo sapiens
ctgcccaggagagccagccct

SEQ ID NO: 2140821 - DNA, 22 bp, Homo sapiens
ctgcccaggagagccagccctc

SEQ ID NO: 2140822 - DNA, 14 bp, Homo sapiens
ctgcccaggcccct

SEQ ID NO: 2140823 - DNA, 17 bp, Homo sapiens
ctgcccaggcctgcctg

SEQ ID NO: 2140824 - DNA, 19 bp, Homo sapiens
ctgcccaggcctgcctgtt

SEQ ID NO: 2140825 - DNA, 21 bp, Homo sapiens
ctgcccatacccctgcctggg

SEQ ID NO: 2140826 - DNA, 20 bp, Homo sapiens
ctgcccatgtgtcccctcac

SEQ ID NO: 2140827 - DNA, 16 bp, Homo sapiens
ctgccccaactcctgg

SEQ ID NO: 2140828 - DNA, 20 bp, Homo sapiens
ctgccccaactcctggaagc

SEQ ID NO: 2140829 - DNA, 21 bp, Homo sapiens
ctgccccaactcctggaagct

SEQ ID NO: 2140830 - DNA, 18 bp, Homo sapiens
ctgccccaagcagccagc

SEQ ID NO: 2140831 - DNA, 19 bp, Homo sapiens
ctgccccaagcagccagcc

SEQ ID NO: 2140832 - DNA, 21 bp, Homo sapiens
ctgccccaagcagccagccag

SEQ ID NO: 2140833 - DNA, 13 bp, Homo sapiens
ctgccccaagccc

SEQ ID NO: 2140834 - DNA, 20 bp, Homo sapiens
ctgccccaccagccacctct

SEQ ID NO: 2140835 - DNA, 13 bp, Homo sapiens
ctgccccagcgcg

SEQ ID NO: 2140836 - DNA, 14 bp, Homo sapiens
ctgccccagctctg

SEQ ID NO: 2140837 - DNA, 19 bp, Homo sapiens
ctgccccagctctggcttc

SEQ ID NO: 2140838 - DNA, 24 bp, Homo sapiens
ctgccccagctttatctgtcacac

SEQ ID NO: 2140839 - DNA, 19 bp, Homo sapiens
ctgccccatcctgggcctt

SEQ ID NO: 2140840 - DNA, 12 bp, Homo sapiens
ctgcccccacga

SEQ ID NO: 2140841 - DNA, 20 bp, Homo sapiens
ctgcccccatctccccaggc

SEQ ID NO: 2140842 - DNA, 21 bp, Homo sapiens
ctgcccccatctccccaggcc

SEQ ID NO: 2140843 - DNA, 23 bp, Homo sapiens
ctgcccccatctccccaggcctc

SEQ ID NO: 2140844 - DNA, 11 bp, Homo sapiens
ctgccccccgc

SEQ ID NO: 2140845 - DNA, 17 bp, Homo sapiens
ctgcccccgacagccca

SEQ ID NO: 2140846 - DNA, 13 bp, Homo sapiens
ctgccccctggtg

SEQ ID NO: 2140847 - DNA, 14 bp, Homo sapiens
ctgccccctggtgg

SEQ ID NO: 2140848 - DNA, 17 bp, Homo sapiens
ctgccccgcccagctgc

SEQ ID NO: 2140849 - DNA, 13 bp, Homo sapiens
ctgccccgcttcc

SEQ ID NO: 2140850 - DNA, 20 bp, Homo sapiens
ctgccccgcttccccacaga

SEQ ID NO: 2140851 - DNA, 21 bp, Homo sapiens
ctgccccgggtccccagctcc

SEQ ID NO: 2140852 - DNA, 17 bp, Homo sapiens
ctgccccgggtgcctca

SEQ ID NO: 2140853 - DNA, 17 bp, Homo sapiens
ctgcccctcccttcaac

SEQ ID NO: 2140854 - DNA, 16 bp, Homo sapiens
ctgcccctgcagttgg

SEQ ID NO: 2140855 - DNA, 13 bp, Homo sapiens
ctgcccctgtagg

SEQ ID NO: 2140856 - DNA, 17 bp, Homo sapiens
ctgcccctgtaggttgc

SEQ ID NO: 2140857 - DNA, 14 bp, Homo sapiens
ctgcccgcagagcc

SEQ ID NO: 2140858 - DNA, 21 bp, Homo sapiens
ctgccctagcgctctcttcca

SEQ ID NO: 2140859 - DNA, 16 bp, Homo sapiens
ctgccctcagcacaga

SEQ ID NO: 2140860 - DNA, 14 bp, Homo sapiens
ctgccctccctggc

SEQ ID NO: 2140861 - DNA, 20 bp, Homo sapiens
ctggctgcaagggccagagt

SEQ ID NO: 2140862 - DNA, 13 bp, Homo sapiens
ctggctgcagtga

SEQ ID NO: 2140863 - DNA, 13 bp, Homo sapiens
ctggctgccaggc

SEQ ID NO: 2140864 - DNA, 14 bp, Homo sapiens
ctggctgccaggcg

SEQ ID NO: 2140865 - DNA, 15 bp, Homo sapiens
ctggctgccaggcgt

SEQ ID NO: 2140866 - DNA, 23 bp, Homo sapiens
ctggctgccaggcgttggtgcca

SEQ ID NO: 2140867 - DNA, 14 bp, Homo sapiens
ctggctgccttaga

SEQ ID NO: 2140868 - DNA, 19 bp, Homo sapiens
ctggctgccttagaacctt

SEQ ID NO: 2140869 - DNA, 20 bp, Homo sapiens
ctggctgctctcatgcctgc

SEQ ID NO: 2140870 - DNA, 16 bp, Homo sapiens
ctggctgctgacagga

SEQ ID NO: 2140871 - DNA, 15 bp, Homo sapiens
ctggctggctgcagt

SEQ ID NO: 2140872 - DNA, 17 bp, Homo sapiens
ctggctggctgcagtga

SEQ ID NO: 2140873 - DNA, 15 bp, Homo sapiens
ctggctgggcatgga

SEQ ID NO: 2140874 - DNA, 18 bp, Homo sapiens
ctggctggtagagcaggt

SEQ ID NO: 2140875 - DNA, 20 bp, Homo sapiens
ctggctgtcttcccccaccc

SEQ ID NO: 2140876 - DNA, 15 bp, Homo sapiens
ctggctgtggaggcc

SEQ ID NO: 2140877 - DNA, 16 bp, Homo sapiens
ctggctgtggaggcct

SEQ ID NO: 2140878 - DNA, 17 bp, Homo sapiens
ctggctgttggctgggg

SEQ ID NO: 2140879 - DNA, 14 bp, Homo sapiens
ctggcttccaggta

SEQ ID NO: 2140880 - DNA, 16 bp, Homo sapiens
ctggcttcccatcccc

SEQ ID NO: 2140881 - DNA, 18 bp, Homo sapiens
ctggcttcccatccccag

SEQ ID NO: 2140882 - DNA, 22 bp, Homo sapiens
ctggcttcccatccccagcgat

SEQ ID NO: 2140883 - DNA, 16 bp, Homo sapiens
ctggcttctggagccc

SEQ ID NO: 2140884 - DNA, 18 bp, Homo sapiens
ctggcttgctccagggtc

SEQ ID NO: 2140885 - DNA, 22 bp, Homo sapiens
ctggctttctccgactgctagg

SEQ ID NO: 2140886 - DNA, 19 bp, Homo sapiens
ctggcttttcactgctggc

SEQ ID NO: 2140887 - DNA, 23 bp, Homo sapiens
ctggcttttcgcttgcttctgca

SEQ ID NO: 2140888 - DNA, 16 bp, Homo sapiens
ctgggaaaacagagga

SEQ ID NO: 2140889 - DNA, 16 bp, Homo sapiens
ctgggaaacagggagc

SEQ ID NO: 2140890 - DNA, 21 bp, Homo sapiens
ctgggaaaggaaaaccaggga

SEQ ID NO: 2140891 - DNA, 22 bp, Homo sapiens
ctgggaaaggaaaaccagggat

SEQ ID NO: 2140892 - DNA, 16 bp, Homo sapiens
ctgggaaaggacccac

SEQ ID NO: 2140893 - DNA, 13 bp, Homo sapiens
ctgggaaccccgc

SEQ ID NO: 2140894 - DNA, 17 bp, Homo sapiens
ctgggaaccccgcagcc

SEQ ID NO: 2140895 - DNA, 21 bp, Homo sapiens
ctgggaaccccgcagcccgtg

SEQ ID NO: 2140896 - DNA, 16 bp, Homo sapiens
ctgggaactcatcctg

SEQ ID NO: 2140897 - DNA, 21 bp, Homo sapiens
ctgggaagctgtactcagagc

SEQ ID NO: 2140898 - DNA, 14 bp, Homo sapiens
ctgggaaggctaag

SEQ ID NO: 2140899 - DNA, 21 bp, Homo sapiens
ctgggaaggggtgccctctgg

SEQ ID NO: 2140900 - DNA, 11 bp, Homo sapiens
ctgggacacag

SEQ ID NO: 2140901 - DNA, 12 bp, Homo sapiens
ctgggacacagt

SEQ ID NO: 2140902 - DNA, 15 bp, Homo sapiens
ctgggaccagggcat

SEQ ID NO: 2140903 - DNA, 19 bp, Homo sapiens
ctgggaccatggacacatt

SEQ ID NO: 2140904 - DNA, 19 bp, Homo sapiens
ctgggacccagctactctg

SEQ ID NO: 2140905 - DNA, 21 bp, Homo sapiens
ctgggacccagctactctgtc

SEQ ID NO: 2140906 - DNA, 23 bp, Homo sapiens
ctgggaccccagctagggctgga

SEQ ID NO: 2140907 - DNA, 18 bp, Homo sapiens
ctgggacccctcccaacc

SEQ ID NO: 2140908 - DNA, 23 bp, Homo sapiens
ctgggacccctcccaacctcaat

SEQ ID NO: 2140909 - DNA, 22 bp, Homo sapiens
ctgggaccgctacaccactctg

SEQ ID NO: 2140910 - DNA, 23 bp, Homo sapiens
ctgggaccgctacaccactctgg

SEQ ID NO: 2140911 - DNA, 18 bp, Homo sapiens
ctgggactacaggtgcaa

SEQ ID NO: 2140912 - DNA, 13 bp, Homo sapiens
ctgggactggcca

SEQ ID NO: 2140913 - DNA, 15 bp, Homo sapiens
ctgggagaacctcag

SEQ ID NO: 2140914 - DNA, 23 bp, Homo sapiens
ctgggagagaaggagatcagggc

SEQ ID NO: 2140915 - DNA, 14 bp, Homo sapiens
ctgggaggaagcag

SEQ ID NO: 2140916 - DNA, 17 bp, Homo sapiens
ctgggaggcagaacagg

SEQ ID NO: 2140917 - DNA, 13 bp, Homo sapiens
ctgggaggcatgg

SEQ ID NO: 2140918 - DNA, 13 bp, Homo sapiens
ctgggagggggct

SEQ ID NO: 2140919 - DNA, 13 bp, Homo sapiens
ctgggagtgagct

SEQ ID NO: 2140920 - DNA, 14 bp, Homo sapiens
ctgggagtgttctg

SEQ ID NO: 2140921 - DNA, 17 bp, Homo sapiens
ctgggatgagccgctgt

SEQ ID NO: 2140922 - DNA, 22 bp, Homo sapiens
ctgggatgagccgctgtgagcc

SEQ ID NO: 2140923 - DNA, 14 bp, Homo sapiens
ctgggatggaccct

SEQ ID NO: 2140924 - DNA, 16 bp, Homo sapiens
ctgggatggaccctcg

SEQ ID NO: 2140925 - DNA, 15 bp, Homo sapiens
ctgggatgggaccag

SEQ ID NO: 2140926 - DNA, 19 bp, Homo sapiens
ctgggatgggaccagggat

SEQ ID NO: 2140927 - DNA, 17 bp, Homo sapiens
ctgggatgtagaacttc

SEQ ID NO: 2140928 - DNA, 21 bp, Homo sapiens
ctgggattacaagcgtgagcc

SEQ ID NO: 2140929 - DNA, 20 bp, Homo sapiens
ctgggattacaggtgtgaac

SEQ ID NO: 2140930 - DNA, 21 bp, Homo sapiens
ctgggatttcttcgctgctct

SEQ ID NO: 2140931 - DNA, 18 bp, Homo sapiens
ctgggcaaacccttctct

SEQ ID NO: 2140932 - DNA, 20 bp, Homo sapiens
ctgggcaaacccttctcttc

SEQ ID NO: 2140933 - DNA, 15 bp, Homo sapiens
ctgggcaacagagca

SEQ ID NO: 2140934 - DNA, 18 bp, Homo sapiens
ctgggcaacagagcaaga

SEQ ID NO: 2140935 - DNA, 12 bp, Homo sapiens
ctgggcagctga

SEQ ID NO: 2140936 - DNA, 17 bp, Homo sapiens
ctgggcagcttgagagg

SEQ ID NO: 2140937 - DNA, 17 bp, Homo sapiens
ctgggcatcttctggct

SEQ ID NO: 2140938 - DNA, 19 bp, Homo sapiens
ctgggcatcttctggcttg

SEQ ID NO: 2140939 - DNA, 12 bp, Homo sapiens
ctgggcattttc

SEQ ID NO: 2140940 - DNA, 21 bp, Homo sapiens
ctgggccaaaagggcagccag

SEQ ID NO: 2140941 - DNA, 23 bp, Homo sapiens
ctgggccaaaagggcagccaggg

SEQ ID NO: 2140942 - DNA, 18 bp, Homo sapiens
ctgggccaagttcctcta

SEQ ID NO: 2140943 - DNA, 12 bp, Homo sapiens
ctgggccagcct

SEQ ID NO: 2140944 - DNA, 11 bp, Homo sapiens
ctgggcccagg

SEQ ID NO: 2140945 - DNA, 14 bp, Homo sapiens
ctgggccccaccta

SEQ ID NO: 2140946 - DNA, 16 bp, Homo sapiens
ctgggccccacctact

SEQ ID NO: 2140947 - DNA, 16 bp, Homo sapiens
ctgggccccatgctct

SEQ ID NO: 2140948 - DNA, 17 bp, Homo sapiens
ctgggccccatgctctg

SEQ ID NO: 2140949 - DNA, 18 bp, Homo sapiens
ctgggccccatgctctgc

SEQ ID NO: 2140950 - DNA, 21 bp, Homo sapiens
ctgggcccctccacgcctcct

SEQ ID NO: 2140951 - DNA, 14 bp, Homo sapiens
ctgggcccctggga

SEQ ID NO: 2140952 - DNA, 16 bp, Homo sapiens
ctgggcccgctttgcc

SEQ ID NO: 2140953 - DNA, 18 bp, Homo sapiens
ctgggcccgctttgcctg

SEQ ID NO: 2140954 - DNA, 14 bp, Homo sapiens
ctgggccctggggc

SEQ ID NO: 2140955 - DNA, 15 bp, Homo sapiens
ctgggccggccagcc

SEQ ID NO: 2140956 - DNA, 17 bp, Homo sapiens
ctgggccggccagcctt

SEQ ID NO: 2140957 - DNA, 21 bp, Homo sapiens
ctgggcctatggagagccctg

SEQ ID NO: 2140958 - DNA, 22 bp, Homo sapiens
ctgggcctatggagagccctgg

SEQ ID NO: 2140959 - DNA, 18 bp, Homo sapiens
ctgggcctgctgctgaga

SEQ ID NO: 2140960 - DNA, 19 bp, Homo sapiens
ctgggcctgcttttccagg

SEQ ID NO: 2140961 - DNA, 23 bp, Homo sapiens
ctgggcctggaccgcttcccaga

SEQ ID NO: 2140962 - DNA, 16 bp, Homo sapiens
ctgggccttacctccc

SEQ ID NO: 2140963 - DNA, 16 bp, Homo sapiens
ctgggcctttcctgtg

SEQ ID NO: 2140964 - DNA, 23 bp, Homo sapiens
ctgggcctttcctgtgccaacct

SEQ ID NO: 2140965 - DNA, 15 bp, Homo sapiens
ctgggctaccccacc

SEQ ID NO: 2140966 - DNA, 13 bp, Homo sapiens
ctgggctagggag

SEQ ID NO: 2140967 - DNA, 22 bp, Homo sapiens
ctgggctagggagaatgcagag

SEQ ID NO: 2140968 - DNA, 23 bp, Homo sapiens
ctgggctagggagaatgcagaga

SEQ ID NO: 2140969 - DNA, 13 bp, Homo sapiens
ctgggctcagggc

SEQ ID NO: 2140970 - DNA, 20 bp, Homo sapiens
ctgggctcctggaaccaatc

SEQ ID NO: 2140971 - DNA, 16 bp, Homo sapiens
ctgggctctccacctc

SEQ ID NO: 2140972 - DNA, 17 bp, Homo sapiens
ctgggctctccacctca

SEQ ID NO: 2140973 - DNA, 18 bp, Homo sapiens
ctgggctctccacctcag

SEQ ID NO: 2140974 - DNA, 21 bp, Homo sapiens
ctgggctctccacctcagcct

SEQ ID NO: 2140975 - DNA, 17 bp, Homo sapiens
ctgggctgtctgtcacc

SEQ ID NO: 2140976 - DNA, 23 bp, Homo sapiens
ctgtgactgccaaggtgtggcct

SEQ ID NO: 2140977 - DNA, 20 bp, Homo sapiens
ctgtgagataaccacaacca

SEQ ID NO: 2140978 - DNA, 13 bp, Homo sapiens
ctgtgagcccctg

SEQ ID NO: 2140979 - DNA, 14 bp, Homo sapiens
ctgtgaggcagggg

SEQ ID NO: 2140980 - DNA, 17 bp, Homo sapiens
ctgtgaggcccctggac

SEQ ID NO: 2140981 - DNA, 22 bp, Homo sapiens
ctgtgattgggcgtagaagtgg

SEQ ID NO: 2140982 - DNA, 19 bp, Homo sapiens
ctgtgcaccttacattcct

SEQ ID NO: 2140983 - DNA, 21 bp, Homo sapiens
ctgtgcacggccagctgcatc

SEQ ID NO: 2140984 - DNA, 18 bp, Homo sapiens
ctgtgcagatgagcagtc

SEQ ID NO: 2140985 - DNA, 13 bp, Homo sapiens
ctgtgcagcagcc

SEQ ID NO: 2140986 - DNA, 18 bp, Homo sapiens
ctgtgcagcagcccagct

SEQ ID NO: 2140987 - DNA, 23 bp, Homo sapiens
ctgtgcagcagcccagcttcctg

SEQ ID NO: 2140988 - DNA, 12 bp, Homo sapiens
ctgtgccacctg

SEQ ID NO: 2140989 - DNA, 13 bp, Homo sapiens
ctgtgccacctgc

SEQ ID NO: 2140990 - DNA, 14 bp, Homo sapiens
ctgtgccacctgca

SEQ ID NO: 2140991 - DNA, 21 bp, Homo sapiens
ctgtgccacctgcaagtgccc

SEQ ID NO: 2140992 - DNA, 14 bp, Homo sapiens
ctgtgccagagcct

SEQ ID NO: 2140993 - DNA, 17 bp, Homo sapiens
ctgtgccagagcctggg

SEQ ID NO: 2140994 - DNA, 18 bp, Homo sapiens
ctgtgccagagcctgggg

SEQ ID NO: 2140995 - DNA, 22 bp, Homo sapiens
ctgtgccagagcctggggctct

SEQ ID NO: 2140996 - DNA, 13 bp, Homo sapiens
ctgtgccagctca

SEQ ID NO: 2140997 - DNA, 16 bp, Homo sapiens
ctgtgccagctcaggt

SEQ ID NO: 2140998 - DNA, 18 bp, Homo sapiens
ctgtgccatgtgccaggt

SEQ ID NO: 2140999 - DNA, 18 bp, Homo sapiens
ctgtgcccacatcccagg

SEQ ID NO: 2141000 - DNA, 16 bp, Homo sapiens
ctgtgcccctcagaga

SEQ ID NO: 2141001 - DNA, 13 bp, Homo sapiens
ctgtgcctcctca

SEQ ID NO: 2141002 - DNA, 24 bp, Homo sapiens
ctgtgcctcgctccccactctgct

SEQ ID NO: 2141003 - DNA, 12 bp, Homo sapiens
ctgtgcctctgc

SEQ ID NO: 2141004 - DNA, 15 bp, Homo sapiens
ctgtgcctctgcctg

SEQ ID NO: 2141005 - DNA, 16 bp, Homo sapiens
ctgtgcctctgcctgt

SEQ ID NO: 2141006 - DNA, 12 bp, Homo sapiens
ctgtgcctgcta

SEQ ID NO: 2141007 - DNA, 14 bp, Homo sapiens
ctgtgcctgctaga

SEQ ID NO: 2141008 - DNA, 16 bp, Homo sapiens
ctgtgcctgctagagc

SEQ ID NO: 2141009 - DNA, 18 bp, Homo sapiens
ctgtgcctgctagagcaa

SEQ ID NO: 2141010 - DNA, 14 bp, Homo sapiens
ctgtgctctggaca

SEQ ID NO: 2141011 - DNA, 18 bp, Homo sapiens
ctgtgctctttgaagaga

SEQ ID NO: 2141012 - DNA, 22 bp, Homo sapiens
ctgtgctcttttggtggggagc

SEQ ID NO: 2141013 - DNA, 13 bp, Homo sapiens
ctgtgctgccctg

SEQ ID NO: 2141014 - DNA, 21 bp, Homo sapiens
ctgtgctgccctgctctgggg

SEQ ID NO: 2141015 - DNA, 13 bp, Homo sapiens
ctgtgctgtgcct

SEQ ID NO: 2141016 - DNA, 16 bp, Homo sapiens
ctgtgctgtgcctgct

SEQ ID NO: 2141017 - DNA, 13 bp, Homo sapiens
ctgtgcttacagt

SEQ ID NO: 2141018 - DNA, 18 bp, Homo sapiens
ctgtggaaaaatatttaa

SEQ ID NO: 2141019 - DNA, 13 bp, Homo sapiens
ctgtggagaaata

SEQ ID NO: 2141020 - DNA, 16 bp, Homo sapiens
ctgtggagagtgagaa

SEQ ID NO: 2141021 - DNA, 22 bp, Homo sapiens
ctgtggagagtgagaataattg

SEQ ID NO: 2141022 - DNA, 21 bp, Homo sapiens
ctgtggaggcctgatgctgcc

SEQ ID NO: 2141023 - DNA, 22 bp, Homo sapiens
ctgtggaggcctgatgctgccc

SEQ ID NO: 2141024 - DNA, 12 bp, Homo sapiens
ctgtggcacaga

SEQ ID NO: 2141025 - DNA, 15 bp, Homo sapiens
ctgtggcacagactt

SEQ ID NO: 2141026 - DNA, 23 bp, Homo sapiens
ctgtggcacagacttctggaagg

SEQ ID NO: 2141027 - DNA, 19 bp, Homo sapiens
ctgtggcagaaaagaggag

SEQ ID NO: 2141028 - DNA, 21 bp, Homo sapiens
ctgtggcagaaaagaggagac

SEQ ID NO: 2141029 - DNA, 20 bp, Homo sapiens
ctgtggccagagctggaagg

SEQ ID NO: 2141030 - DNA, 19 bp, Homo sapiens
ctgtggcctcacttccctg

SEQ ID NO: 2141031 - DNA, 14 bp, Homo sapiens
ctgtggcctgtgtc

SEQ ID NO: 2141032 - DNA, 16 bp, Homo sapiens
ctgtggcctgtgtcca

SEQ ID NO: 2141033 - DNA, 22 bp, Homo sapiens
ctgtggcctgtgtccagcagct

SEQ ID NO: 2141034 - DNA, 24 bp, Homo sapiens
ctgtggcctgtgtccagcagctgc

SEQ ID NO: 2141035 - DNA, 14 bp, Homo sapiens
ctgtggcggtgcct

SEQ ID NO: 2141036 - DNA, 18 bp, Homo sapiens
ctgtggcggtgcctgggt

SEQ ID NO: 2141037 - DNA, 11 bp, Homo sapiens
ctgtggctcct

SEQ ID NO: 2141038 - DNA, 18 bp, Homo sapiens
ctgtggctcctgccttga

SEQ ID NO: 2141039 - DNA, 18 bp, Homo sapiens
ctgtggctgcagagacct

SEQ ID NO: 2141040 - DNA, 15 bp, Homo sapiens
ctgtgggagcctcgc

SEQ ID NO: 2141041 - DNA, 11 bp, Homo sapiens
ctgtgggcagc

SEQ ID NO: 2141042 - DNA, 14 bp, Homo sapiens
ctgtgggcagcacc

SEQ ID NO: 2141043 - DNA, 16 bp, Homo sapiens
ctgtgggcagcaccct

SEQ ID NO: 2141044 - DNA, 23 bp, Homo sapiens
ctgtgggcagcaccctcccccgc

SEQ ID NO: 2141045 - DNA, 19 bp, Homo sapiens
ctgtgggccaggagctcag

SEQ ID NO: 2141046 - DNA, 20 bp, Homo sapiens
ctgtgggccaggagctcagc

SEQ ID NO: 2141047 - DNA, 19 bp, Homo sapiens
ctgtgggcttggccttgtg

SEQ ID NO: 2141048 - DNA, 21 bp, Homo sapiens
ctgtgggcttggccttgtgtc

SEQ ID NO: 2141049 - DNA, 21 bp, Homo sapiens
ctgtgggggaggtccctgcca

SEQ ID NO: 2141050 - DNA, 23 bp, Homo sapiens
ctgtgggggaggtccctgccagt

SEQ ID NO: 2141051 - DNA, 16 bp, Homo sapiens
ctgtgggggtggccat

SEQ ID NO: 2141052 - DNA, 20 bp, Homo sapiens
ctgtgggggtggccatccct

SEQ ID NO: 2141053 - DNA, 23 bp, Homo sapiens
ctgtgggggtggccatccctggg

SEQ ID NO: 2141054 - DNA, 16 bp, Homo sapiens
ctgtggtgatgttgcc

SEQ ID NO: 2141055 - DNA, 14 bp, Homo sapiens
ctgtggtggctgtc

SEQ ID NO: 2141056 - DNA, 17 bp, Homo sapiens
ctgtggtggctgtctct

SEQ ID NO: 2141057 - DNA, 21 bp, Homo sapiens
ctgtggttgttttagctcctt

SEQ ID NO: 2141058 - DNA, 16 bp, Homo sapiens
ctgtgtacccactcct

SEQ ID NO: 2141059 - DNA, 19 bp, Homo sapiens
ctgtgtagctgtgacctgc

SEQ ID NO: 2141060 - DNA, 15 bp, Homo sapiens
ctgtgtattttgaga

SEQ ID NO: 2141061 - DNA, 19 bp, Homo sapiens
ctgtgtattttttaaagct

SEQ ID NO: 2141062 - DNA, 16 bp, Homo sapiens
ctgtgtcagcctgtcc

SEQ ID NO: 2141063 - DNA, 19 bp, Homo sapiens
ctgtgtcaggtggggcagc

SEQ ID NO: 2141064 - DNA, 16 bp, Homo sapiens
ctgtgtcataccacaa

SEQ ID NO: 2141065 - DNA, 16 bp, Homo sapiens
ctgtgtcccttttgca

SEQ ID NO: 2141066 - DNA, 15 bp, Homo sapiens
ctgtgtcctctcccc

SEQ ID NO: 2141067 - DNA, 15 bp, Homo sapiens
ctgtgtccttccctg

SEQ ID NO: 2141068 - DNA, 14 bp, Homo sapiens
ctgtgtccttgcac

SEQ ID NO: 2141069 - DNA, 16 bp, Homo sapiens
ctgtgtccttgcacct

SEQ ID NO: 2141070 - DNA, 18 bp, Homo sapiens
ctgtgtccttgcacctgc

SEQ ID NO: 2141071 - DNA, 13 bp, Homo sapiens
ctgtgtctgcacc

SEQ ID NO: 2141072 - DNA, 16 bp, Homo sapiens
ctgtgtcttgcaatgg

SEQ ID NO: 2141073 - DNA, 19 bp, Homo sapiens
ctgtgtcttgcaatggcag

SEQ ID NO: 2141074 - DNA, 22 bp, Homo sapiens
ctgtgtcttgcaatggcagcct

SEQ ID NO: 2141075 - DNA, 20 bp, Homo sapiens
ctgtgtcttttttcactaca

SEQ ID NO: 2141076 - DNA, 15 bp, Homo sapiens
ctgtgtgaagaaatg

SEQ ID NO: 2141077 - DNA, 16 bp, Homo sapiens
ctgtgtgaagaaatgg

SEQ ID NO: 2141078 - DNA, 18 bp, Homo sapiens
ctgtgtgaattcccaggt

SEQ ID NO: 2141079 - DNA, 15 bp, Homo sapiens
ctgtgtgatgaactt

SEQ ID NO: 2141080 - DNA, 18 bp, Homo sapiens
ctgtgtgggctgcagatt

SEQ ID NO: 2141081 - DNA, 22 bp, Homo sapiens
ctgtgtgggctgcagatttcct

SEQ ID NO: 2141082 - DNA, 23 bp, Homo sapiens
ctgtgtgggctgcagatttcctg

SEQ ID NO: 2141083 - DNA, 14 bp, Homo sapiens
ctgtgtggggaggc

SEQ ID NO: 2141084 - DNA, 16 bp, Homo sapiens
ctgtgtggggaggcag

SEQ ID NO: 2141085 - DNA, 15 bp, Homo sapiens
ctgtgttcagtgcct

SEQ ID NO: 2141086 - DNA, 16 bp, Homo sapiens
ctgtgttcagtgcctt

SEQ ID NO: 2141087 - DNA, 21 bp, Homo sapiens
ctgtgttcagtgccttggagc

SEQ ID NO: 2141088 - DNA, 15 bp, Homo sapiens
ctgtgttcttgctga

SEQ ID NO: 2141089 - DNA, 14 bp, Homo sapiens
ctgtgttgaacaca

SEQ ID NO: 2141090 - DNA, 23 bp, Homo sapiens
ctgtgtttgaccttcacatttgt

SEQ ID NO: 2141091 - DNA, 14 bp, Homo sapiens
cttccccatctcca

SEQ ID NO: 2141092 - DNA, 21 bp, Homo sapiens
cttcccccatcccctttcctc

SEQ ID NO: 2141093 - DNA, 18 bp, Homo sapiens
cttcccctcgctgtcctg

SEQ ID NO: 2141094 - DNA, 23 bp, Homo sapiens
cttcccctcgctgtcctgctgtg

SEQ ID NO: 2141095 - DNA, 14 bp, Homo sapiens
cttcccctgcctgg

SEQ ID NO: 2141096 - DNA, 16 bp, Homo sapiens
cttccccttgcccagg

SEQ ID NO: 2141097 - DNA, 19 bp, Homo sapiens
cttccccttgcccagggct

SEQ ID NO: 2141098 - DNA, 22 bp, Homo sapiens
cttccccttgcccttgccctga

SEQ ID NO: 2141099 - DNA, 13 bp, Homo sapiens
cttcccctttcct

SEQ ID NO: 2141100 - DNA, 15 bp, Homo sapiens
cttcccgctcagccc

SEQ ID NO: 2141101 - DNA, 22 bp, Homo sapiens
cttcccgggatcacttaatgaa

SEQ ID NO: 2141102 - DNA, 13 bp, Homo sapiens
cttccctccttcc

SEQ ID NO: 2141103 - DNA, 14 bp, Homo sapiens
cttccctctttccc

SEQ ID NO: 2141104 - DNA, 21 bp, Homo sapiens
cttccctctttccccacctct

SEQ ID NO: 2141105 - DNA, 21 bp, Homo sapiens
cttccctgggaactcatcctg

SEQ ID NO: 2141106 - DNA, 13 bp, Homo sapiens
cttccctgggaag

SEQ ID NO: 2141107 - DNA, 15 bp, Homo sapiens
cttccctgggaaggc

SEQ ID NO: 2141108 - DNA, 19 bp, Homo sapiens
cttccctgggaaggctaag

SEQ ID NO: 2141109 - DNA, 14 bp, Homo sapiens
cttcccttctctcc

SEQ ID NO: 2141110 - DNA, 18 bp, Homo sapiens
cttcccttctctccttcc

SEQ ID NO: 2141111 - DNA, 20 bp, Homo sapiens
cttcccttctctccttccct

SEQ ID NO: 2141112 - DNA, 13 bp, Homo sapiens
cttccgatgacag

SEQ ID NO: 2141113 - DNA, 16 bp, Homo sapiens
cttccgctcctttacc

SEQ ID NO: 2141114 - DNA, 17 bp, Homo sapiens
cttcctaccaaatataa

SEQ ID NO: 2141115 - DNA, 22 bp, Homo sapiens
cttcctcatcagtagatggtac

SEQ ID NO: 2141116 - DNA, 13 bp, Homo sapiens
cttcctccctcat

SEQ ID NO: 2141117 - DNA, 13 bp, Homo sapiens
cttcctccgtcca

SEQ ID NO: 2141118 - DNA, 16 bp, Homo sapiens
cttcctccgtccaccc

SEQ ID NO: 2141119 - DNA, 20 bp, Homo sapiens
cttcctccgtccacccaggc

SEQ ID NO: 2141120 - DNA, 18 bp, Homo sapiens
cttcctccgtctgcaatg

SEQ ID NO: 2141121 - DNA, 15 bp, Homo sapiens
cttcctcctccacag

SEQ ID NO: 2141122 - DNA, 19 bp, Homo sapiens
cttcctcctccacagtgct

SEQ ID NO: 2141123 - DNA, 15 bp, Homo sapiens
cttcctcctgaagcc

SEQ ID NO: 2141124 - DNA, 17 bp, Homo sapiens
cttcctcctgaagcctc

SEQ ID NO: 2141125 - DNA, 20 bp, Homo sapiens
cttcctcctgaagcctctgc

SEQ ID NO: 2141126 - DNA, 19 bp, Homo sapiens
cttcctctccactgccttc

SEQ ID NO: 2141127 - DNA, 13 bp, Homo sapiens
cttcctctccagc

SEQ ID NO: 2141128 - DNA, 12 bp, Homo sapiens
cttcctctgctg

SEQ ID NO: 2141129 - DNA, 21 bp, Homo sapiens
cttcctgactgacacaggcca

SEQ ID NO: 2141130 - DNA, 15 bp, Homo sapiens
cttcctgattcccca

SEQ ID NO: 2141131 - DNA, 13 bp, Homo sapiens
cttcctgcaagga

SEQ ID NO: 2141132 - DNA, 14 bp, Homo sapiens
cttcctgcacccgt

SEQ ID NO: 2141133 - DNA, 13 bp, Homo sapiens
cttcctgccacca

SEQ ID NO: 2141134 - DNA, 15 bp, Homo sapiens
cttcctgccaccagt

SEQ ID NO: 2141135 - DNA, 18 bp, Homo sapiens
cttcctgccaccagtcac

SEQ ID NO: 2141136 - DNA, 13 bp, Homo sapiens
cttcctggacagc

SEQ ID NO: 2141137 - DNA, 14 bp, Homo sapiens
cttcctggacagct

SEQ ID NO: 2141138 - DNA, 12 bp, Homo sapiens
cttcctggacct

SEQ ID NO: 2141139 - DNA, 11 bp, Homo sapiens
cttcctggcct

SEQ ID NO: 2141140 - DNA, 13 bp, Homo sapiens
cttcctggcctca

SEQ ID NO: 2141141 - DNA, 22 bp, Homo sapiens
cttcctggggccccgctgggat

SEQ ID NO: 2141142 - DNA, 18 bp, Homo sapiens
cttcctggtgaggcccag

SEQ ID NO: 2141143 - DNA, 23 bp, Homo sapiens
cttcctggtgaggcccagcctgt

SEQ ID NO: 2141144 - DNA, 24 bp, Homo sapiens
cttcctggtgaggcccagcctgtc

SEQ ID NO: 2141145 - DNA, 17 bp, Homo sapiens
cttcctgtcccacctct

SEQ ID NO: 2141146 - DNA, 16 bp, Homo sapiens
cttcctgtgccctgca

SEQ ID NO: 2141147 - DNA, 15 bp, Homo sapiens
cttcctgtgggagca

SEQ ID NO: 2141148 - DNA, 20 bp, Homo sapiens
cttcctgtgggccaggagct

SEQ ID NO: 2141149 - DNA, 16 bp, Homo sapiens
cttccttacccaaact

SEQ ID NO: 2141150 - DNA, 19 bp, Homo sapiens
cttccttactcccaggcac

SEQ ID NO: 2141151 - DNA, 16 bp, Homo sapiens
cttccttcatttcctc

SEQ ID NO: 2141152 - DNA, 18 bp, Homo sapiens
cttccttccgctccttta

SEQ ID NO: 2141153 - DNA, 21 bp, Homo sapiens
cttccttccgctcctttacct

SEQ ID NO: 2141154 - DNA, 13 bp, Homo sapiens
cttccttctgcac

SEQ ID NO: 2141155 - DNA, 15 bp, Homo sapiens
cttccttctgcaccc

SEQ ID NO: 2141156 - DNA, 17 bp, Homo sapiens
cttccttgctgtcctag

SEQ ID NO: 2141157 - DNA, 19 bp, Homo sapiens
cttccttgctgtcctaggc

SEQ ID NO: 2141158 - DNA, 19 bp, Homo sapiens
cttccttggcatcacaggg

SEQ ID NO: 2141159 - DNA, 14 bp, Homo sapiens
cttccttgtgagga

SEQ ID NO: 2141160 - DNA, 14 bp, Homo sapiens
cttcctttcctctg

SEQ ID NO: 2141161 - DNA, 20 bp, Homo sapiens
cttcgaaagcatcattattt

SEQ ID NO: 2141162 - DNA, 14 bp, Homo sapiens
cttcgactcaggat

SEQ ID NO: 2141163 - DNA, 15 bp, Homo sapiens
cttcgactcaggatc

SEQ ID NO: 2141164 - DNA, 16 bp, Homo sapiens
cttcgactcaggatcc

SEQ ID NO: 2141165 - DNA, 13 bp, Homo sapiens
cttcgctcctgtg

SEQ ID NO: 2141166 - DNA, 12 bp, Homo sapiens
cttcgctgccag

SEQ ID NO: 2141167 - DNA, 14 bp, Homo sapiens
cttcgctgccagga

SEQ ID NO: 2141168 - DNA, 15 bp, Homo sapiens
cttcgctgctctagc

SEQ ID NO: 2141169 - DNA, 19 bp, Homo sapiens
cttcgctgctctagctggc

SEQ ID NO: 2141170 - DNA, 20 bp, Homo sapiens
cttcgctgctctagctggca

SEQ ID NO: 2141171 - DNA, 18 bp, Homo sapiens
cttcggggaactcctgga

SEQ ID NO: 2141172 - DNA, 19 bp, Homo sapiens
cttcggtgtttaaagtcaa

SEQ ID NO: 2141173 - DNA, 22 bp, Homo sapiens
cttcgtgtctctcccaccccgg

SEQ ID NO: 2141174 - DNA, 20 bp, Homo sapiens
cttctaaaatgcttttaatt

SEQ ID NO: 2141175 - DNA, 12 bp, Homo sapiens
cttctaaatgcc

SEQ ID NO: 2141176 - DNA, 18 bp, Homo sapiens
cttctaactcatgggtac

SEQ ID NO: 2141177 - DNA, 21 bp, Homo sapiens
cttctaagtaaaaccacagca

SEQ ID NO: 2141178 - DNA, 23 bp, Homo sapiens
cttctaagtaaaaccacagcagt

SEQ ID NO: 2141179 - DNA, 11 bp, Homo sapiens
cttctaatata

SEQ ID NO: 2141180 - DNA, 14 bp, Homo sapiens
cttctaatatattt

SEQ ID NO: 2141181 - DNA, 22 bp, Homo sapiens
cttctaggagtcaactggctgg

SEQ ID NO: 2141182 - DNA, 19 bp, Homo sapiens
cttctagtctggtgttctg

SEQ ID NO: 2141183 - DNA, 15 bp, Homo sapiens
cttctatgcagtatt

SEQ ID NO: 2141184 - DNA, 13 bp, Homo sapiens
cttctattaaatg

SEQ ID NO: 2141185 - DNA, 15 bp, Homo sapiens
cttctatttaaaaaa

SEQ ID NO: 2141186 - DNA, 16 bp, Homo sapiens
cttctatttaaaaaat

SEQ ID NO: 2141187 - DNA, 17 bp, Homo sapiens
cttctatttaaaaaata

SEQ ID NO: 2141188 - DNA, 22 bp, Homo sapiens
cttctatttaaaaaataaaaaa

SEQ ID NO: 2141189 - DNA, 17 bp, Homo sapiens
cttctcaggacacaggc

SEQ ID NO: 2141190 - DNA, 19 bp, Homo sapiens
cttctcaggacacaggcct

SEQ ID NO: 2141191 - DNA, 20 bp, Homo sapiens
cttctcaggacacaggcctg

SEQ ID NO: 2141192 - DNA, 22 bp, Homo sapiens
cttctcaggacacaggcctgtg

SEQ ID NO: 2141193 - DNA, 11 bp, Homo sapiens
cttctcagtgt

SEQ ID NO: 2141194 - DNA, 14 bp, Homo sapiens
cttctccaccctgc

SEQ ID NO: 2141195 - DNA, 17 bp, Homo sapiens
cttctccatctggcagg

SEQ ID NO: 2141196 - DNA, 13 bp, Homo sapiens
cttctccattcta

SEQ ID NO: 2141197 - DNA, 23 bp, Homo sapiens
cttctccattctagatgcttccc

SEQ ID NO: 2141198 - DNA, 14 bp, Homo sapiens
cttctcctgcctac

SEQ ID NO: 2141199 - DNA, 16 bp, Homo sapiens
cttctccttggaggac

SEQ ID NO: 2141200 - DNA, 18 bp, Homo sapiens
cttctccttggaggacag

SEQ ID NO: 2141201 - DNA, 20 bp, Homo sapiens
cttctcctttcacaaccttc

SEQ ID NO: 2141202 - DNA, 18 bp, Homo sapiens
cttctcgcattttctcta

SEQ ID NO: 2141203 - DNA, 16 bp, Homo sapiens
cttctcgtttgctcta

SEQ ID NO: 2141204 - DNA, 20 bp, Homo sapiens
cttctctacccatctccccc

SEQ ID NO: 2141205 - DNA, 21 bp, Homo sapiens
cttctctacccatctccccca

SEQ ID NO: 2141206 - DNA, 19 bp, Homo sapiens
ctttacctaccaccttccc

SEQ ID NO: 2141207 - DNA, 20 bp, Homo sapiens
ctttacctaccaccttccct

SEQ ID NO: 2141208 - DNA, 22 bp, Homo sapiens
ctttacctaccaccttccctct

SEQ ID NO: 2141209 - DNA, 16 bp, Homo sapiens
ctttacctgagaccag

SEQ ID NO: 2141210 - DNA, 15 bp, Homo sapiens
ctttacctttaaaat

SEQ ID NO: 2141211 - DNA, 16 bp, Homo sapiens
ctttactcccttcctg

SEQ ID NO: 2141212 - DNA, 14 bp, Homo sapiens
ctttacttttaaac

SEQ ID NO: 2141213 - DNA, 15 bp, Homo sapiens
ctttaggagcagtgg

SEQ ID NO: 2141214 - DNA, 18 bp, Homo sapiens
ctttaggcagcagctttt

SEQ ID NO: 2141215 - DNA, 16 bp, Homo sapiens
ctttaggcagcctgcc

SEQ ID NO: 2141216 - DNA, 15 bp, Homo sapiens
ctttaggcattaaat

SEQ ID NO: 2141217 - DNA, 20 bp, Homo sapiens
ctttaggtgcctcctgtctt

SEQ ID NO: 2141218 - DNA, 20 bp, Homo sapiens
ctttatcaccaggatgtcac

SEQ ID NO: 2141219 - DNA, 14 bp, Homo sapiens
ctttatcagtgatg

SEQ ID NO: 2141220 - DNA, 22 bp, Homo sapiens
ctttatctaatacctctgtgtg

SEQ ID NO: 2141221 - DNA, 14 bp, Homo sapiens
ctttatctgtcaca

SEQ ID NO: 2141222 - DNA, 16 bp, Homo sapiens
ctttatctgtcacaca

SEQ ID NO: 2141223 - DNA, 13 bp, Homo sapiens
ctttatgctgtgt

SEQ ID NO: 2141224 - DNA, 14 bp, Homo sapiens
ctttattaaaaact

SEQ ID NO: 2141225 - DNA, 17 bp, Homo sapiens
ctttattaaaaactgag

SEQ ID NO: 2141226 - DNA, 16 bp, Homo sapiens
ctttattaattcatta

SEQ ID NO: 2141227 - DNA, 14 bp, Homo sapiens
ctttattgtgatct

SEQ ID NO: 2141228 - DNA, 21 bp, Homo sapiens
ctttatttatggcttataaat

SEQ ID NO: 2141229 - DNA, 22 bp, Homo sapiens
ctttatttatggcttataaatg

SEQ ID NO: 2141230 - DNA, 14 bp, Homo sapiens
ctttatttctagca

SEQ ID NO: 2141231 - DNA, 17 bp, Homo sapiens
ctttatttctagcagag

SEQ ID NO: 2141232 - DNA, 22 bp, Homo sapiens
ctttatttgtttatatttaatt

SEQ ID NO: 2141233 - DNA, 12 bp, Homo sapiens
ctttcaacttaa

SEQ ID NO: 2141234 - DNA, 18 bp, Homo sapiens
ctttcaacttaaatcact

SEQ ID NO: 2141235 - DNA, 22 bp, Homo sapiens
ctttcaacttaaatcactgagg

SEQ ID NO: 2141236 - DNA, 12 bp, Homo sapiens
ctttcaattgta

SEQ ID NO: 2141237 - DNA, 15 bp, Homo sapiens
ctttcacaaaaaaga

SEQ ID NO: 2141238 - DNA, 16 bp, Homo sapiens
ctttcacaaaaaagaa

SEQ ID NO: 2141239 - DNA, 20 bp, Homo sapiens
ctttcacaaaattttattcc

SEQ ID NO: 2141240 - DNA, 14 bp, Homo sapiens
ctttcacaaccttc

SEQ ID NO: 2141241 - DNA, 14 bp, Homo sapiens
ctttcagctgtgaa

SEQ ID NO: 2141242 - DNA, 20 bp, Homo sapiens
ctttcagggaatttcaggaa

SEQ ID NO: 2141243 - DNA, 17 bp, Homo sapiens
ctttcagtgaaagcatc

SEQ ID NO: 2141244 - DNA, 16 bp, Homo sapiens
ctttcatccccacctt

SEQ ID NO: 2141245 - DNA, 17 bp, Homo sapiens
ctttcatccccaccttg

SEQ ID NO: 2141246 - DNA, 14 bp, Homo sapiens
ctttccacaggagg

SEQ ID NO: 2141247 - DNA, 17 bp, Homo sapiens
ctttccaccctattccc

SEQ ID NO: 2141248 - DNA, 20 bp, Homo sapiens
ctttccagtgaggaaatggc

SEQ ID NO: 2141249 - DNA, 16 bp, Homo sapiens
ctttcccaccagcatg

SEQ ID NO: 2141250 - DNA, 23 bp, Homo sapiens
ctttcccaccagcatgtcactcc

SEQ ID NO: 2141251 - DNA, 24 bp, Homo sapiens
ctttcccaccagcatgtcactccc

SEQ ID NO: 2141252 - DNA, 13 bp, Homo sapiens
ctttcccatgctg

SEQ ID NO: 2141253 - DNA, 15 bp, Homo sapiens
ctttcccatgctgaa

SEQ ID NO: 2141254 - DNA, 18 bp, Homo sapiens
ctttcccatgctgaatta

SEQ ID NO: 2141255 - DNA, 14 bp, Homo sapiens
ctttccccacctct

SEQ ID NO: 2141256 - DNA, 14 bp, Homo sapiens
ctttccccagacac

SEQ ID NO: 2141257 - DNA, 23 bp, Homo sapiens
ctttccccagtgtggccccagcc

SEQ ID NO: 2141258 - DNA, 18 bp, Homo sapiens
ctttccccgggggaggaa

SEQ ID NO: 2141259 - DNA, 15 bp, Homo sapiens
ctttccgctgtcgcc

SEQ ID NO: 2141260 - DNA, 21 bp, Homo sapiens
ctttccgtctccctaaaataa

SEQ ID NO: 2141261 - DNA, 23 bp, Homo sapiens
ctttcctagactaattaaaatct

SEQ ID NO: 2141262 - DNA, 23 bp, Homo sapiens
ctttcctccaaactcctgcctgt

SEQ ID NO: 2141263 - DNA, 13 bp, Homo sapiens
ctttcctccccac

SEQ ID NO: 2141264 - DNA, 15 bp, Homo sapiens
ctttcctccccacct

SEQ ID NO: 2141265 - DNA, 17 bp, Homo sapiens
ctttcctccccaccttc

SEQ ID NO: 2141266 - DNA, 21 bp, Homo sapiens
ctttcctccccaccttcccca

SEQ ID NO: 2141267 - DNA, 16 bp, Homo sapiens
ctttcctctgcagcac

SEQ ID NO: 2141268 - DNA, 13 bp, Homo sapiens
ctttcctcttccc

SEQ ID NO: 2141269 - DNA, 14 bp, Homo sapiens
ctttcctcttcccc

SEQ ID NO: 2141270 - DNA, 23 bp, Homo sapiens
ctttcctgtatttgttcccaaga

SEQ ID NO: 2141271 - DNA, 16 bp, Homo sapiens
ctttcctgtgccaacc

SEQ ID NO: 2141272 - DNA, 11 bp, Homo sapiens
ctttccttcct

SEQ ID NO: 2141273 - DNA, 16 bp, Homo sapiens
ctttccttccttccct

SEQ ID NO: 2141274 - DNA, 13 bp, Homo sapiens
ctttccttgtctc

SEQ ID NO: 2141275 - DNA, 20 bp, Homo sapiens
ctttccttgtctctcattct

SEQ ID NO: 2141276 - DNA, 20 bp, Homo sapiens
ctttccttttcttccttctt

SEQ ID NO: 2141277 - DNA, 17 bp, Homo sapiens
ctttctacccagcgagc

SEQ ID NO: 2141278 - DNA, 14 bp, Homo sapiens
ctttctagctgttg

SEQ ID NO: 2141279 - DNA, 16 bp, Homo sapiens
ctttctagttgaaaat

SEQ ID NO: 2141280 - DNA, 22 bp, Homo sapiens
ctttctcactaaatcttttata

SEQ ID NO: 2141281 - DNA, 15 bp, Homo sapiens
ctttctccctcaccc

SEQ ID NO: 2141282 - DNA, 19 bp, Homo sapiens
ctttctctaaatatgatta

SEQ ID NO: 2141283 - DNA, 21 bp, Homo sapiens
ctttctctccttcttccctgt

SEQ ID NO: 2141284 - DNA, 20 bp, Homo sapiens
ctttctctgagagagatgat

SEQ ID NO: 2141285 - DNA, 16 bp, Homo sapiens
ctttctctggctccag

SEQ ID NO: 2141286 - DNA, 13 bp, Homo sapiens
ctttctggctctc

SEQ ID NO: 2141287 - DNA, 20 bp, Homo sapiens
ctttctgtgcttctctttgt

SEQ ID NO: 2141288 - DNA, 12 bp, Homo sapiens
ctttctgtgtgc

SEQ ID NO: 2141289 - DNA, 13 bp, Homo sapiens
ctttcttcctctg

SEQ ID NO: 2141290 - DNA, 16 bp, Homo sapiens
ctttcttctattttat

SEQ ID NO: 2141291 - DNA, 15 bp, Homo sapiens
ctttctttacctgag

SEQ ID NO: 2141292 - DNA, 16 bp, Homo sapiens
ctttctttcacaaaaa

SEQ ID NO: 2141293 - DNA, 16 bp, Homo sapiens
ctttcttttgtgttgg

SEQ ID NO: 2141294 - DNA, 18 bp, Homo sapiens
ctttcttttgtgttggat

SEQ ID NO: 2141295 - DNA, 14 bp, Homo sapiens
ctttctttttctgg

SEQ ID NO: 2141296 - DNA, 17 bp, Homo sapiens
ctttctttttctggaaa

SEQ ID NO: 2141297 - DNA, 18 bp, Homo sapiens
ctttctttttctgtctct

SEQ ID NO: 2141298 - DNA, 19 bp, Homo sapiens
ctttctttttctgtctctc

SEQ ID NO: 2141299 - DNA, 20 bp, Homo sapiens
ctttctttttctgtctctct

SEQ ID NO: 2141300 - DNA, 22 bp, Homo sapiens
ctttgaaacaagataactgaga

SEQ ID NO: 2141301 - DNA, 15 bp, Homo sapiens
ctttgaaattgttta

SEQ ID NO: 2141302 - DNA, 21 bp, Homo sapiens
ctttgaagttagctttaactt

SEQ ID NO: 2141303 - DNA, 11 bp, Homo sapiens
ctttgaataaa

SEQ ID NO: 2141304 - DNA, 16 bp, Homo sapiens
ctttgaataaagtctg

SEQ ID NO: 2141305 - DNA, 18 bp, Homo sapiens
ctttgaataaagtctgag

SEQ ID NO: 2141306 - DNA, 19 bp, Homo sapiens
ctttgaatacccccagaga

SEQ ID NO: 2141307 - DNA, 18 bp, Homo sapiens
ctttgaatcctctctctg

SEQ ID NO: 2141308 - DNA, 19 bp, Homo sapiens
ctttgaatcctctctctgt

SEQ ID NO: 2141309 - DNA, 13 bp, Homo sapiens
ctttgacatgaaa

SEQ ID NO: 2141310 - DNA, 15 bp, Homo sapiens
ctttgagaaagaaat

SEQ ID NO: 2141311 - DNA, 19 bp, Homo sapiens
ctttgagaaaggattaaga

SEQ ID NO: 2141312 - DNA, 17 bp, Homo sapiens
ctttgagaatgtgattc

SEQ ID NO: 2141313 - DNA, 22 bp, Homo sapiens
ctttgagggacgatctttgaat

SEQ ID NO: 2141314 - DNA, 23 bp, Homo sapiens
ctttgagggacgatctttgaata

SEQ ID NO: 2141315 - DNA, 17 bp, Homo sapiens
ctttgaggttgctttgt

SEQ ID NO: 2141316 - DNA, 21 bp, Homo sapiens
ctttgagtaccaaatccacaa

SEQ ID NO: 2141317 - DNA, 15 bp, Homo sapiens
ctttgatctctgctt

SEQ ID NO: 2141318 - DNA, 21 bp, Homo sapiens
ctttgatgcatttccacactg

SEQ ID NO: 2141319 - DNA, 18 bp, Homo sapiens
ctttgcacagctctccgg

SEQ ID NO: 2141320 - DNA, 18 bp, Homo sapiens
ctttgcactgagggccac

SEQ ID NO: 2141321 - DNA, 16 bp, Homo sapiens
gagaccagcctggcca

SEQ ID NO: 2141322 - DNA, 12 bp, Homo sapiens
gagaccagctca

SEQ ID NO: 2141323 - DNA, 22 bp, Homo sapiens
gagaccagctcagaggcccagg

SEQ ID NO: 2141324 - DNA, 20 bp, Homo sapiens
gagaccagttgggagcactg

SEQ ID NO: 2141325 - DNA, 23 bp, Homo sapiens
gagaccagttgggagcactggag

SEQ ID NO: 2141326 - DNA, 17 bp, Homo sapiens
gagaccatcctggcccc

SEQ ID NO: 2141327 - DNA, 18 bp, Homo sapiens
gagacccagatctcatgg

SEQ ID NO: 2141328 - DNA, 13 bp, Homo sapiens
gagaccccaggat

SEQ ID NO: 2141329 - DNA, 14 bp, Homo sapiens
gagaccccttcctt

SEQ ID NO: 2141330 - DNA, 15 bp, Homo sapiens
gagaccccttccttt

SEQ ID NO: 2141331 - DNA, 17 bp, Homo sapiens
gagaccccttcctttcc

SEQ ID NO: 2141332 - DNA, 17 bp, Homo sapiens
gagaccctcgccacggg

SEQ ID NO: 2141333 - DNA, 21 bp, Homo sapiens
gagaccgcttcacccctgcac

SEQ ID NO: 2141334 - DNA, 15 bp, Homo sapiens
gagacctcagccatg

SEQ ID NO: 2141335 - DNA, 23 bp, Homo sapiens
gagaccttttctctcccatacca

SEQ ID NO: 2141336 - DNA, 16 bp, Homo sapiens
gagacggagtcccacc

SEQ ID NO: 2141337 - DNA, 19 bp, Homo sapiens
gagacggagtcccaccttg

SEQ ID NO: 2141338 - DNA, 14 bp, Homo sapiens
gagacggcagagac

SEQ ID NO: 2141339 - DNA, 15 bp, Homo sapiens
gagacggtcgagcag

SEQ ID NO: 2141340 - DNA, 14 bp, Homo sapiens
gagactatggagcc

SEQ ID NO: 2141341 - DNA, 13 bp, Homo sapiens
gagactatgtgtc

SEQ ID NO: 2141342 - DNA, 14 bp, Homo sapiens
gagactatgtgtca

SEQ ID NO: 2141343 - DNA, 18 bp, Homo sapiens
gagactcacctctgcctc

SEQ ID NO: 2141344 - DNA, 19 bp, Homo sapiens
gagactcacctctgcctca

SEQ ID NO: 2141345 - DNA, 20 bp, Homo sapiens
gagactcacctctgcctcaa

SEQ ID NO: 2141346 - DNA, 23 bp, Homo sapiens
gagactcacctctgcctcaatgt

SEQ ID NO: 2141347 - DNA, 17 bp, Homo sapiens
gagactcagggccccag

SEQ ID NO: 2141348 - DNA, 21 bp, Homo sapiens
gagactcagggccccagcact

SEQ ID NO: 2141349 - DNA, 17 bp, Homo sapiens
gagactccagaatctgc

SEQ ID NO: 2141350 - DNA, 17 bp, Homo sapiens
gagactcctgccctgtt

SEQ ID NO: 2141351 - DNA, 23 bp, Homo sapiens
gagactctggaagccccccacct

SEQ ID NO: 2141352 - DNA, 12 bp, Homo sapiens
gagactctggcc

SEQ ID NO: 2141353 - DNA, 13 bp, Homo sapiens
gagactctggcct

SEQ ID NO: 2141354 - DNA, 12 bp, Homo sapiens
gagactctgtgg

SEQ ID NO: 2141355 - DNA, 18 bp, Homo sapiens
gagactgaaagcagcagc

SEQ ID NO: 2141356 - DNA, 21 bp, Homo sapiens
gagactgaaagcagcagctag

SEQ ID NO: 2141357 - DNA, 18 bp, Homo sapiens
gagactgacacctcactg

SEQ ID NO: 2141358 - DNA, 18 bp, Homo sapiens
gagactgagggagagact

SEQ ID NO: 2141359 - DNA, 19 bp, Homo sapiens
gagactgcgggatggtcct

SEQ ID NO: 2141360 - DNA, 16 bp, Homo sapiens
gagactggtcctgtgt

SEQ ID NO: 2141361 - DNA, 23 bp, Homo sapiens
gagactggtcctgtgtgcagtga

SEQ ID NO: 2141362 - DNA, 22 bp, Homo sapiens
gagactgtctcaagagggcact

SEQ ID NO: 2141363 - DNA, 23 bp, Homo sapiens
gagacttcaggttgttctgtata

SEQ ID NO: 2141364 - DNA, 13 bp, Homo sapiens
gagacttgtatga

SEQ ID NO: 2141365 - DNA, 18 bp, Homo sapiens
gagagaaaaagtgcccct

SEQ ID NO: 2141366 - DNA, 13 bp, Homo sapiens
gagagaaaactta

SEQ ID NO: 2141367 - DNA, 13 bp, Homo sapiens
gagagacactccc

SEQ ID NO: 2141368 - DNA, 17 bp, Homo sapiens
gagagacattgcctcca

SEQ ID NO: 2141369 - DNA, 13 bp, Homo sapiens
gagagaccctcac

SEQ ID NO: 2141370 - DNA, 15 bp, Homo sapiens
gagagaccctcactg

SEQ ID NO: 2141371 - DNA, 16 bp, Homo sapiens
gagagactgaaagcag

SEQ ID NO: 2141372 - DNA, 19 bp, Homo sapiens
gagagactgaaagcagcag

SEQ ID NO: 2141373 - DNA, 22 bp, Homo sapiens
gagagagactgagggagagact

SEQ ID NO: 2141374 - DNA, 14 bp, Homo sapiens
gagagatatatctg

SEQ ID NO: 2141375 - DNA, 18 bp, Homo sapiens
gagagatatatctgaaaa

SEQ ID NO: 2141376 - DNA, 10 bp, Homo sapiens
gagagcagct

SEQ ID NO: 2141377 - DNA, 13 bp, Homo sapiens
gagagcagctggc

SEQ ID NO: 2141378 - DNA, 19 bp, Homo sapiens
gagagcagctggctctcca

SEQ ID NO: 2141379 - DNA, 13 bp, Homo sapiens
gagagccagccct

SEQ ID NO: 2141380 - DNA, 14 bp, Homo sapiens
gagagccctgggac

SEQ ID NO: 2141381 - DNA, 15 bp, Homo sapiens
gagagccctgggacc

SEQ ID NO: 2141382 - DNA, 23 bp, Homo sapiens
gagagcctgctcccccaccccct

SEQ ID NO: 2141383 - DNA, 16 bp, Homo sapiens
gagagctagaacctgg

SEQ ID NO: 2141384 - DNA, 19 bp, Homo sapiens
gagagctagaacctggagg

SEQ ID NO: 2141385 - DNA, 13 bp, Homo sapiens
gagagctaggagc

SEQ ID NO: 2141386 - DNA, 19 bp, Homo sapiens
gagagctaggagcaaagcc

SEQ ID NO: 2141387 - DNA, 23 bp, Homo sapiens
gagaggaaaaacgatcgctgtga

SEQ ID NO: 2141388 - DNA, 14 bp, Homo sapiens
gagaggaagatgaa

SEQ ID NO: 2141389 - DNA, 14 bp, Homo sapiens
gagaggaagggtgg

SEQ ID NO: 2141390 - DNA, 19 bp, Homo sapiens
gagaggagcacctgaaccc

SEQ ID NO: 2141391 - DNA, 17 bp, Homo sapiens
gagaggcacctgctgga

SEQ ID NO: 2141392 - DNA, 20 bp, Homo sapiens
gagaggcagaagaaccctgg

SEQ ID NO: 2141393 - DNA, 22 bp, Homo sapiens
gagaggcagacttccctgaatg

SEQ ID NO: 2141394 - DNA, 15 bp, Homo sapiens
gagaggcatggctgg

SEQ ID NO: 2141395 - DNA, 15 bp, Homo sapiens
gagaggccttttgga

SEQ ID NO: 2141396 - DNA, 18 bp, Homo sapiens
gagaggccttttggaatg

SEQ ID NO: 2141397 - DNA, 18 bp, Homo sapiens
gagaggccttttgtttaa

SEQ ID NO: 2141398 - DNA, 13 bp, Homo sapiens
gagaggcggcctc

SEQ ID NO: 2141399 - DNA, 15 bp, Homo sapiens
gagaggcggcctcgt

SEQ ID NO: 2141400 - DNA, 16 bp, Homo sapiens
gagaggcggcctcgtg

SEQ ID NO: 2141401 - DNA, 12 bp, Homo sapiens
gagaggggcctg

SEQ ID NO: 2141402 - DNA, 18 bp, Homo sapiens
gagaggggcctgggaaag

SEQ ID NO: 2141403 - DNA, 13 bp, Homo sapiens
gagagggtctgga

SEQ ID NO: 2141404 - DNA, 18 bp, Homo sapiens
gagagggtctggagaagc

SEQ ID NO: 2141405 - DNA, 18 bp, Homo sapiens
gagaggtagcgagctgct

SEQ ID NO: 2141406 - DNA, 15 bp, Homo sapiens
gagaggtccctgctt

SEQ ID NO: 2141407 - DNA, 23 bp, Homo sapiens
gagaggtccctgcttacctgacg

SEQ ID NO: 2141408 - DNA, 15 bp, Homo sapiens
gagaggtctcaggtt

SEQ ID NO: 2141409 - DNA, 14 bp, Homo sapiens
gagaggtgggcagc

SEQ ID NO: 2141410 - DNA, 19 bp, Homo sapiens
gagaggttctggggaggaa

SEQ ID NO: 2141411 - DNA, 17 bp, Homo sapiens
gagagtaccatgctggc

SEQ ID NO: 2141412 - DNA, 15 bp, Homo sapiens
gagagtatattatgt

SEQ ID NO: 2141413 - DNA, 13 bp, Homo sapiens
gagagtggctcct

SEQ ID NO: 2141414 - DNA, 21 bp, Homo sapiens
gagagtggctcctcccggtgc

SEQ ID NO: 2141415 - DNA, 11 bp, Homo sapiens
gagagtgtgac

SEQ ID NO: 2141416 - DNA, 21 bp, Homo sapiens
gagagttggctcaggcagaca

SEQ ID NO: 2141417 - DNA, 22 bp, Homo sapiens
gagataaccacaaccaggaaga

SEQ ID NO: 2141418 - DNA, 24 bp, Homo sapiens
gagataaccacaaccaggaagaac

SEQ ID NO: 2141419 - DNA, 16 bp, Homo sapiens
gagatatgcagaagga

SEQ ID NO: 2141420 - DNA, 17 bp, Homo sapiens
gagatatggcagcgaaa

SEQ ID NO: 2141421 - DNA, 23 bp, Homo sapiens
gagatcaaccccttcgctcctgt

SEQ ID NO: 2141422 - DNA, 16 bp, Homo sapiens
gagatcacgccactgc

SEQ ID NO: 2141423 - DNA, 12 bp, Homo sapiens
gagatcagagtc

SEQ ID NO: 2141424 - DNA, 19 bp, Homo sapiens
gagatcagggcgacctgca

SEQ ID NO: 2141425 - DNA, 22 bp, Homo sapiens
gagatcagggcgacctgcacgc

SEQ ID NO: 2141426 - DNA, 17 bp, Homo sapiens
gagatcctaactgagaa

SEQ ID NO: 2141427 - DNA, 16 bp, Homo sapiens
gagatcgctggcagag

SEQ ID NO: 2141428 - DNA, 22 bp, Homo sapiens
gagatcgtgccgttactctcca

SEQ ID NO: 2141429 - DNA, 19 bp, Homo sapiens
gagatctagaaagtgggtt

SEQ ID NO: 2141430 - DNA, 17 bp, Homo sapiens
gagatgatgatgatgat

SEQ ID NO: 2141431 - DNA, 14 bp, Homo sapiens
gagatgcctccacc

SEQ ID NO: 2141432 - DNA, 22 bp, Homo sapiens
gagatgcctccaccgctgccta

SEQ ID NO: 2141433 - DNA, 20 bp, Homo sapiens
gagatggaagttgcagtgag

SEQ ID NO: 2141434 - DNA, 18 bp, Homo sapiens
gagatggagttcttgtgc

SEQ ID NO: 2141435 - DNA, 20 bp, Homo sapiens
gagatggtaatctacagctc

SEQ ID NO: 2141436 - DNA, 22 bp, Homo sapiens
gaggctcaagaggcccagggag

SEQ ID NO: 2141437 - DNA, 22 bp, Homo sapiens
gaggctcctgtgctactttgcc

SEQ ID NO: 2141438 - DNA, 18 bp, Homo sapiens
gaggctcttccatcccca

SEQ ID NO: 2141439 - DNA, 14 bp, Homo sapiens
gaggctgagacagg

SEQ ID NO: 2141440 - DNA, 15 bp, Homo sapiens
gaggctgaggcagga

SEQ ID NO: 2141441 - DNA, 16 bp, Homo sapiens
gaggctgcagcgagct

SEQ ID NO: 2141442 - DNA, 14 bp, Homo sapiens
gaggctgcagtcag

SEQ ID NO: 2141443 - DNA, 17 bp, Homo sapiens
gaggctgcatgctctgg

SEQ ID NO: 2141444 - DNA, 22 bp, Homo sapiens
gaggctgctcggggtgcacagg

SEQ ID NO: 2141445 - DNA, 15 bp, Homo sapiens
gaggctggaggcagg

SEQ ID NO: 2141446 - DNA, 16 bp, Homo sapiens
gaggctgggccagcct

SEQ ID NO: 2141447 - DNA, 14 bp, Homo sapiens
gaggctgggcccct

SEQ ID NO: 2141448 - DNA, 17 bp, Homo sapiens
gaggctgggcccctggg

SEQ ID NO: 2141449 - DNA, 12 bp, Homo sapiens
gaggctggggga

SEQ ID NO: 2141450 - DNA, 20 bp, Homo sapiens
gaggctggtgctgtggccag

SEQ ID NO: 2141451 - DNA, 16 bp, Homo sapiens
gaggcttccagagagt

SEQ ID NO: 2141452 - DNA, 21 bp, Homo sapiens
gaggcttccagagagtcctct

SEQ ID NO: 2141453 - DNA, 14 bp, Homo sapiens
gaggcttccaggct

SEQ ID NO: 2141454 - DNA, 16 bp, Homo sapiens
gaggcttcctgactga

SEQ ID NO: 2141455 - DNA, 21 bp, Homo sapiens
gaggcttcctgactgacacag

SEQ ID NO: 2141456 - DNA, 16 bp, Homo sapiens
gaggcttcttcagatc

SEQ ID NO: 2141457 - DNA, 15 bp, Homo sapiens
gaggcttggaaagca

SEQ ID NO: 2141458 - DNA, 14 bp, Homo sapiens
gaggctttggccca

SEQ ID NO: 2141459 - DNA, 20 bp, Homo sapiens
gagggaatgttccctgcacc

SEQ ID NO: 2141460 - DNA, 16 bp, Homo sapiens
gagggacaaaggagcc

SEQ ID NO: 2141461 - DNA, 17 bp, Homo sapiens
gagggacaaaggagcct

SEQ ID NO: 2141462 - DNA, 18 bp, Homo sapiens
gagggacaaaggagcctg

SEQ ID NO: 2141463 - DNA, 22 bp, Homo sapiens
gagggacaaaggagcctgtgaa

SEQ ID NO: 2141464 - DNA, 21 bp, Homo sapiens
gagggacagggcttggggagc

SEQ ID NO: 2141465 - DNA, 20 bp, Homo sapiens
gagggaccaaattgcttcta

SEQ ID NO: 2141466 - DNA, 15 bp, Homo sapiens
gagggacgaagaaag

SEQ ID NO: 2141467 - DNA, 18 bp, Homo sapiens
gagggactgtcgctgctt

SEQ ID NO: 2141468 - DNA, 14 bp, Homo sapiens
gagggagagactct

SEQ ID NO: 2141469 - DNA, 20 bp, Homo sapiens
gagggagcagacaggaggaa

SEQ ID NO: 2141470 - DNA, 18 bp, Homo sapiens
gagggagtgacagaggca

SEQ ID NO: 2141471 - DNA, 20 bp, Homo sapiens
gagggatgctgcctgagtca

SEQ ID NO: 2141472 - DNA, 13 bp, Homo sapiens
gagggatggagag

SEQ ID NO: 2141473 - DNA, 17 bp, Homo sapiens
gagggatgtaactattg

SEQ ID NO: 2141474 - DNA, 20 bp, Homo sapiens
gagggcaaggggtttccaca

SEQ ID NO: 2141475 - DNA, 11 bp, Homo sapiens
gagggcagagc

SEQ ID NO: 2141476 - DNA, 17 bp, Homo sapiens
gagggcagagccatggg

SEQ ID NO: 2141477 - DNA, 21 bp, Homo sapiens
gagggcagagccatgggcctg

SEQ ID NO: 2141478 - DNA, 14 bp, Homo sapiens
gagggcagaggctg

SEQ ID NO: 2141479 - DNA, 15 bp, Homo sapiens
gagggcagagtgggc

SEQ ID NO: 2141480 - DNA, 13 bp, Homo sapiens
gagggcagcagcc

SEQ ID NO: 2141481 - DNA, 17 bp, Homo sapiens
gagggcagcagccagcc

SEQ ID NO: 2141482 - DNA, 21 bp, Homo sapiens
gagggcagcagccagccctgc

SEQ ID NO: 2141483 - DNA, 17 bp, Homo sapiens
gagggcatgggagggag

SEQ ID NO: 2141484 - DNA, 18 bp, Homo sapiens
gagggccaagacttggca

SEQ ID NO: 2141485 - DNA, 17 bp, Homo sapiens
gagggccaagagagaca

SEQ ID NO: 2141486 - DNA, 14 bp, Homo sapiens
gagggcccagctgt

SEQ ID NO: 2141487 - DNA, 13 bp, Homo sapiens
gagggcccaggca

SEQ ID NO: 2141488 - DNA, 16 bp, Homo sapiens
gagggctagaacctgg

SEQ ID NO: 2141489 - DNA, 20 bp, Homo sapiens
gagggctagaacctggaagg

SEQ ID NO: 2141490 - DNA, 18 bp, Homo sapiens
gagggctagaacctggag

SEQ ID NO: 2141491 - DNA, 19 bp, Homo sapiens
gagggctagaactggagag

SEQ ID NO: 2141492 - DNA, 20 bp, Homo sapiens
gagggctagaatctggagag

SEQ ID NO: 2141493 - DNA, 13 bp, Homo sapiens
gagggctgccctg

SEQ ID NO: 2141494 - DNA, 13 bp, Homo sapiens
gagggctggaatc

SEQ ID NO: 2141495 - DNA, 13 bp, Homo sapiens
gagggctgggccc

SEQ ID NO: 2141496 - DNA, 12 bp, Homo sapiens
gaggggaacaga

SEQ ID NO: 2141497 - DNA, 22 bp, Homo sapiens
gaggggacatttccctcctggg

SEQ ID NO: 2141498 - DNA, 22 bp, Homo sapiens
gaggggactatttatgaaggca

SEQ ID NO: 2141499 - DNA, 15 bp, Homo sapiens
gaggggcacctgcca

SEQ ID NO: 2141500 - DNA, 16 bp, Homo sapiens
gaggggcacctgccac

SEQ ID NO: 2141501 - DNA, 18 bp, Homo sapiens
gaggggcacctgccaccg

SEQ ID NO: 2141502 - DNA, 13 bp, Homo sapiens
gaggggcctaggg

SEQ ID NO: 2141503 - DNA, 13 bp, Homo sapiens
gaggggcctggca

SEQ ID NO: 2141504 - DNA, 13 bp, Homo sapiens
gaggggcctggga

SEQ ID NO: 2141505 - DNA, 14 bp, Homo sapiens
gaggggctcctgga

SEQ ID NO: 2141506 - DNA, 20 bp, Homo sapiens
gagggggcgctcaggaccca

SEQ ID NO: 2141507 - DNA, 16 bp, Homo sapiens
gagggggctccatgga

SEQ ID NO: 2141508 - DNA, 12 bp, Homo sapiens
gagggggctctc

SEQ ID NO: 2141509 - DNA, 14 bp, Homo sapiens
gagggggctctcca

SEQ ID NO: 2141510 - DNA, 21 bp, Homo sapiens
gagggggtcgtggagagctag

SEQ ID NO: 2141511 - DNA, 21 bp, Homo sapiens
gagggggtgtctggaagctga

SEQ ID NO: 2141512 - DNA, 16 bp, Homo sapiens
gagggtaataaactta

SEQ ID NO: 2141513 - DNA, 16 bp, Homo sapiens
gagggtagggcagcag

SEQ ID NO: 2141514 - DNA, 13 bp, Homo sapiens
gagggtaggggag

SEQ ID NO: 2141515 - DNA, 13 bp, Homo sapiens
gagggtcagggca

SEQ ID NO: 2141516 - DNA, 16 bp, Homo sapiens
gagggtcagggcagta

SEQ ID NO: 2141517 - DNA, 14 bp, Homo sapiens
gagggtctgaggaa

SEQ ID NO: 2141518 - DNA, 15 bp, Homo sapiens
gagggtctggagaag

SEQ ID NO: 2141519 - DNA, 15 bp, Homo sapiens
gagggtgagaggaag

SEQ ID NO: 2141520 - DNA, 23 bp, Homo sapiens
gagggtggaggaaggtgctgagc

SEQ ID NO: 2141521 - DNA, 18 bp, Homo sapiens
gagggtgtatctagctct

SEQ ID NO: 2141522 - DNA, 22 bp, Homo sapiens
gagggtgtcccaaaaagaaagg

SEQ ID NO: 2141523 - DNA, 15 bp, Homo sapiens
gagggttgggctggt

SEQ ID NO: 2141524 - DNA, 16 bp, Homo sapiens
gaggtcaacagagaag

SEQ ID NO: 2141525 - DNA, 23 bp, Homo sapiens
gaggtcaacagagaaggcaggaa

SEQ ID NO: 2141526 - DNA, 14 bp, Homo sapiens
gaggtcccaggcag

SEQ ID NO: 2141527 - DNA, 16 bp, Homo sapiens
gaggtcctgagcactg

SEQ ID NO: 2141528 - DNA, 18 bp, Homo sapiens
gaggtcctgagcactgcc

SEQ ID NO: 2141529 - DNA, 19 bp, Homo sapiens
gaggtcctgagcactgcca

SEQ ID NO: 2141530 - DNA, 23 bp, Homo sapiens
gaggtcctgagcactgccaggag

SEQ ID NO: 2141531 - DNA, 21 bp, Homo sapiens
gaggtctcaggttctttccat

SEQ ID NO: 2141532 - DNA, 16 bp, Homo sapiens
gaggtctccactgagg

SEQ ID NO: 2141533 - DNA, 16 bp, Homo sapiens
gaggtctgagccctgg

SEQ ID NO: 2141534 - DNA, 16 bp, Homo sapiens
gaggtcttggccgact

SEQ ID NO: 2141535 - DNA, 23 bp, Homo sapiens
gaggtcttggccgactcagggac

SEQ ID NO: 2141536 - DNA, 15 bp, Homo sapiens
gaggtgaagtccctg

SEQ ID NO: 2141537 - DNA, 17 bp, Homo sapiens
gaggtgaagtccctgtt

SEQ ID NO: 2141538 - DNA, 18 bp, Homo sapiens
gaggtgaccccagggcac

SEQ ID NO: 2141539 - DNA, 21 bp, Homo sapiens
gaggtgaccccagggcacagg

SEQ ID NO: 2141540 - DNA, 23 bp, Homo sapiens
gaggtgaccccagggcacaggag

SEQ ID NO: 2141541 - DNA, 15 bp, Homo sapiens
gaggtgcccaggaga

SEQ ID NO: 2141542 - DNA, 13 bp, Homo sapiens
gaggtgctgatga

SEQ ID NO: 2141543 - DNA, 17 bp, Homo sapiens
gaggtgctgatgagtga

SEQ ID NO: 2141544 - DNA, 21 bp, Homo sapiens
gaggtggattcctgggcaaga

SEQ ID NO: 2141545 - DNA, 18 bp, Homo sapiens
gaggtggcagccctgtag

SEQ ID NO: 2141546 - DNA, 23 bp, Homo sapiens
gaggtggccagagctgggaggca

SEQ ID NO: 2141547 - DNA, 19 bp, Homo sapiens
gaggtgggcagctgggccc

SEQ ID NO: 2141548 - DNA, 17 bp, Homo sapiens
gaggtggtggaggagga

SEQ ID NO: 2141549 - DNA, 18 bp, Homo sapiens
gaggtggtggaggaggag

SEQ ID NO: 2141550 - DNA, 20 bp, Homo sapiens
gaggtgtcaccctgcagagc

SEQ ID NO: 2141551 - DNA, 19 bp, Homo sapiens
gatggctgtgcctctgcct

SEQ ID NO: 2141552 - DNA, 19 bp, Homo sapiens
gatggcttatttgtataat

SEQ ID NO: 2141553 - DNA, 16 bp, Homo sapiens
gatgggaaagcattgt

SEQ ID NO: 2141554 - DNA, 20 bp, Homo sapiens
gatgggcaacccccagcctg

SEQ ID NO: 2141555 - DNA, 17 bp, Homo sapiens
gatgggcacatgaggag

SEQ ID NO: 2141556 - DNA, 20 bp, Homo sapiens
gatgggcacatgaggagggt

SEQ ID NO: 2141557 - DNA, 16 bp, Homo sapiens
gatgggcattgggctg

SEQ ID NO: 2141558 - DNA, 22 bp, Homo sapiens
gatgggcattgggctgacacct

SEQ ID NO: 2141559 - DNA, 21 bp, Homo sapiens
gatgggctgtttcgtgtagtg

SEQ ID NO: 2141560 - DNA, 18 bp, Homo sapiens
gatgggcttgttttcttg

SEQ ID NO: 2141561 - DNA, 16 bp, Homo sapiens
gatgggggatgggcca

SEQ ID NO: 2141562 - DNA, 16 bp, Homo sapiens
gatggggtgggcaggg

SEQ ID NO: 2141563 - DNA, 18 bp, Homo sapiens
gatggggtgggcagggct

SEQ ID NO: 2141564 - DNA, 19 bp, Homo sapiens
gatggggtgggcagggctg

SEQ ID NO: 2141565 - DNA, 21 bp, Homo sapiens
gatgggtgattccttcaattc

SEQ ID NO: 2141566 - DNA, 14 bp, Homo sapiens
gatggtagcagata

SEQ ID NO: 2141567 - DNA, 23 bp, Homo sapiens
gatggtagcagataaagacagct

SEQ ID NO: 2141568 - DNA, 18 bp, Homo sapiens
gatggtcacacagagata

SEQ ID NO: 2141569 - DNA, 13 bp, Homo sapiens
gatggtcctgggg

SEQ ID NO: 2141570 - DNA, 24 bp, Homo sapiens
gatggtcctggggctctgtgcagg

SEQ ID NO: 2141571 - DNA, 13 bp, Homo sapiens
gatggtgagctgg

SEQ ID NO: 2141572 - DNA, 14 bp, Homo sapiens
gatggtgagctggg

SEQ ID NO: 2141573 - DNA, 21 bp, Homo sapiens
gatggttcccctgttcactct

SEQ ID NO: 2141574 - DNA, 19 bp, Homo sapiens
gatgtaaacagtgcctgct

SEQ ID NO: 2141575 - DNA, 21 bp, Homo sapiens
gatgtaaggaattgaagatag

SEQ ID NO: 2141576 - DNA, 19 bp, Homo sapiens
gatgtaccatgttaaagag

SEQ ID NO: 2141577 - DNA, 12 bp, Homo sapiens
gatgtagaactt

SEQ ID NO: 2141578 - DNA, 20 bp, Homo sapiens
gatgtagggtaaggtgcctt

SEQ ID NO: 2141579 - DNA, 13 bp, Homo sapiens
gatgtattggaac

SEQ ID NO: 2141580 - DNA, 18 bp, Homo sapiens
gatgtcccaacttgtaaa

SEQ ID NO: 2141581 - DNA, 18 bp, Homo sapiens
gatgtcccatctgctcct

SEQ ID NO: 2141582 - DNA, 13 bp, Homo sapiens
gatgtctcttgta

SEQ ID NO: 2141583 - DNA, 16 bp, Homo sapiens
gatgtctcttgtagaa

SEQ ID NO: 2141584 - DNA, 14 bp, Homo sapiens
gatgtgaacacatc

SEQ ID NO: 2141585 - DNA, 16 bp, Homo sapiens
gatgtgaacacatcag

SEQ ID NO: 2141586 - DNA, 17 bp, Homo sapiens
gatgtgagtgtgtgtga

SEQ ID NO: 2141587 - DNA, 19 bp, Homo sapiens
gatgtgagttgcacagcta

SEQ ID NO: 2141588 - DNA, 18 bp, Homo sapiens
gatgtgctggagctggct

SEQ ID NO: 2141589 - DNA, 21 bp, Homo sapiens
gatgtgctttgcattcctaca

SEQ ID NO: 2141590 - DNA, 17 bp, Homo sapiens
gatgtggcactgcttga

SEQ ID NO: 2141591 - DNA, 14 bp, Homo sapiens
gatgttaaccagaa

SEQ ID NO: 2141592 - DNA, 14 bp, Homo sapiens
gatgttaactatta

SEQ ID NO: 2141593 - DNA, 20 bp, Homo sapiens
gatgttacatcacagtgttt

SEQ ID NO: 2141594 - DNA, 14 bp, Homo sapiens
gatgttctgggaca

SEQ ID NO: 2141595 - DNA, 16 bp, Homo sapiens
gatgttctgggacaca

SEQ ID NO: 2141596 - DNA, 19 bp, Homo sapiens
gatgttgttactgattctc

SEQ ID NO: 2141597 - DNA, 14 bp, Homo sapiens
gatgtttccagaaa

SEQ ID NO: 2141598 - DNA, 16 bp, Homo sapiens
gatgttttagaatgat

SEQ ID NO: 2141599 - DNA, 21 bp, Homo sapiens
gatgttttgtcccatttcctt

SEQ ID NO: 2141600 - DNA, 18 bp, Homo sapiens
gatgttttgttcaaagtt

SEQ ID NO: 2141601 - DNA, 20 bp, Homo sapiens
gatgtttttaaaagtttcaa

SEQ ID NO: 2141602 - DNA, 16 bp, Homo sapiens
gatgtttttcatgaaa

SEQ ID NO: 2141603 - DNA, 19 bp, Homo sapiens
gattaaacacctgacacat

SEQ ID NO: 2141604 - DNA, 12 bp, Homo sapiens
gattaaaggaag

SEQ ID NO: 2141605 - DNA, 20 bp, Homo sapiens
gattaaattatatctgaggc

SEQ ID NO: 2141606 - DNA, 15 bp, Homo sapiens
gattaatgttttgta

SEQ ID NO: 2141607 - DNA, 19 bp, Homo sapiens
gattaatgttttgtacaat

SEQ ID NO: 2141608 - DNA, 20 bp, Homo sapiens
gattaatttgagaattattc

SEQ ID NO: 2141609 - DNA, 23 bp, Homo sapiens
gattaatttgtgtagattgtgta

SEQ ID NO: 2141610 - DNA, 13 bp, Homo sapiens
gattacaagcgtg

SEQ ID NO: 2141611 - DNA, 20 bp, Homo sapiens
gattacaggtgtgaaccacc

SEQ ID NO: 2141612 - DNA, 21 bp, Homo sapiens
gattacctgatcatggtcagc

SEQ ID NO: 2141613 - DNA, 17 bp, Homo sapiens
gattagaatgaaaattg

SEQ ID NO: 2141614 - DNA, 19 bp, Homo sapiens
gattagactggacagcttg

SEQ ID NO: 2141615 - DNA, 20 bp, Homo sapiens
gattagactggacagcttgt

SEQ ID NO: 2141616 - DNA, 12 bp, Homo sapiens
gattagctctgg

SEQ ID NO: 2141617 - DNA, 21 bp, Homo sapiens
gattatagttgtgggtgggag

SEQ ID NO: 2141618 - DNA, 18 bp, Homo sapiens
gattatatatcataaagt

SEQ ID NO: 2141619 - DNA, 23 bp, Homo sapiens
gattattccctgtacaatattta

SEQ ID NO: 2141620 - DNA, 17 bp, Homo sapiens
gattattctgattccac

SEQ ID NO: 2141621 - DNA, 15 bp, Homo sapiens
gattatttatttctg

SEQ ID NO: 2141622 - DNA, 16 bp, Homo sapiens
gattatttatttctgt

SEQ ID NO: 2141623 - DNA, 22 bp, Homo sapiens
gattatttgttatttgtacagt

SEQ ID NO: 2141624 - DNA, 22 bp, Homo sapiens
gattcacaactaggacctcata

SEQ ID NO: 2141625 - DNA, 18 bp, Homo sapiens
gattcacaatgaaatgct

SEQ ID NO: 2141626 - DNA, 16 bp, Homo sapiens
gattcacatctcattt

SEQ ID NO: 2141627 - DNA, 19 bp, Homo sapiens
gattcaggaaaaggcctgg

SEQ ID NO: 2141628 - DNA, 17 bp, Homo sapiens
gattcatctatggaggg

SEQ ID NO: 2141629 - DNA, 21 bp, Homo sapiens
gattcatctatggagggcaga

SEQ ID NO: 2141630 - DNA, 21 bp, Homo sapiens
gattcatgccaattagcaatt

SEQ ID NO: 2141631 - DNA, 11 bp, Homo sapiens
gattcatgtgg

SEQ ID NO: 2141632 - DNA, 15 bp, Homo sapiens
gattccacacaaaat

SEQ ID NO: 2141633 - DNA, 21 bp, Homo sapiens
gattccacacaaaatgtcaca

SEQ ID NO: 2141634 - DNA, 19 bp, Homo sapiens
gattccagagagtggctcc

SEQ ID NO: 2141635 - DNA, 16 bp, Homo sapiens
gattccagcatttgcc

SEQ ID NO: 2141636 - DNA, 15 bp, Homo sapiens
gattcccaagctctg

SEQ ID NO: 2141637 - DNA, 19 bp, Homo sapiens
gattcccaagctctgctcc

SEQ ID NO: 2141638 - DNA, 19 bp, Homo sapiens
gattcccagagacaggaaa

SEQ ID NO: 2141639 - DNA, 21 bp, Homo sapiens
gattcccagagacaggaaaat

SEQ ID NO: 2141640 - DNA, 19 bp, Homo sapiens
gattcccagagcaaaataa

SEQ ID NO: 2141641 - DNA, 18 bp, Homo sapiens
gattccctctcccaggcc

SEQ ID NO: 2141642 - DNA, 20 bp, Homo sapiens
gattccctctcccaggcccc

SEQ ID NO: 2141643 - DNA, 19 bp, Homo sapiens
gattcctcttgcctctctc

SEQ ID NO: 2141644 - DNA, 20 bp, Homo sapiens
gattcctcttgcctctctca

SEQ ID NO: 2141645 - DNA, 22 bp, Homo sapiens
gattcctgcatttttttacctt

SEQ ID NO: 2141646 - DNA, 12 bp, Homo sapiens
gattcctgggcc

SEQ ID NO: 2141647 - DNA, 16 bp, Homo sapiens
gattcgaatgacactg

SEQ ID NO: 2141648 - DNA, 15 bp, Homo sapiens
gattctaatgtcttc

SEQ ID NO: 2141649 - DNA, 23 bp, Homo sapiens
gattctcatgtctcagcctcctc

SEQ ID NO: 2141650 - DNA, 22 bp, Homo sapiens
gattgaggcctgccctcaggga

SEQ ID NO: 2141651 - DNA, 21 bp, Homo sapiens
gattgcaacaggctgggcttc

SEQ ID NO: 2141652 - DNA, 17 bp, Homo sapiens
gattgcttaaaatagca

SEQ ID NO: 2141653 - DNA, 14 bp, Homo sapiens
gattggacattttc

SEQ ID NO: 2141654 - DNA, 22 bp, Homo sapiens
gattggctcacccaagcaaggc

SEQ ID NO: 2141655 - DNA, 16 bp, Homo sapiens
gattgggagggacagg

SEQ ID NO: 2141656 - DNA, 14 bp, Homo sapiens
gattgggtgccatg

SEQ ID NO: 2141657 - DNA, 15 bp, Homo sapiens
gattgtcttaatatt

SEQ ID NO: 2141658 - DNA, 14 bp, Homo sapiens
gattgttaaaataa

SEQ ID NO: 2141659 - DNA, 11 bp, Homo sapiens
gattgtttgca

SEQ ID NO: 2141660 - DNA, 17 bp, Homo sapiens
gatttaacagtcattta

SEQ ID NO: 2141661 - DNA, 12 bp, Homo sapiens
gatttaatgttt

SEQ ID NO: 2141662 - DNA, 22 bp, Homo sapiens
gatttaatgttttctgctgttt

SEQ ID NO: 2141663 - DNA, 16 bp, Homo sapiens
gatttaccttttctgt

SEQ ID NO: 2141664 - DNA, 14 bp, Homo sapiens
gatttacgactgaa

SEQ ID NO: 2141665 - DNA, 22 bp, Homo sapiens
gcactgcttgaggaggggcacc

SEQ ID NO: 2141666 - DNA, 16 bp, Homo sapiens
gcactggagtgcaggg

SEQ ID NO: 2141667 - DNA, 14 bp, Homo sapiens
gcactggccagaga

SEQ ID NO: 2141668 - DNA, 22 bp, Homo sapiens
gcactggccagagagggcccag

SEQ ID NO: 2141669 - DNA, 14 bp, Homo sapiens
gcactggccccacc

SEQ ID NO: 2141670 - DNA, 15 bp, Homo sapiens
gcactggccccaccc

SEQ ID NO: 2141671 - DNA, 18 bp, Homo sapiens
gcactgggttgactttca

SEQ ID NO: 2141672 - DNA, 15 bp, Homo sapiens
gcactgtcaagatga

SEQ ID NO: 2141673 - DNA, 16 bp, Homo sapiens
gcactgtgggggctgg

SEQ ID NO: 2141674 - DNA, 23 bp, Homo sapiens
gcacttattatgaggctattaaa

SEQ ID NO: 2141675 - DNA, 16 bp, Homo sapiens
gcacttgcagactcta

SEQ ID NO: 2141676 - DNA, 15 bp, Homo sapiens
gcacttgcgtcctgc

SEQ ID NO: 2141677 - DNA, 17 bp, Homo sapiens
gcacttgcgtcctgcag

SEQ ID NO: 2141678 - DNA, 13 bp, Homo sapiens
gcacttggagcca

SEQ ID NO: 2141679 - DNA, 22 bp, Homo sapiens
gcacttggagccaagggttcag

SEQ ID NO: 2141680 - DNA, 13 bp, Homo sapiens
gcacttggctcct

SEQ ID NO: 2141681 - DNA, 17 bp, Homo sapiens
gcacttggggcaccttg

SEQ ID NO: 2141682 - DNA, 13 bp, Homo sapiens
gcacttgtcacta

SEQ ID NO: 2141683 - DNA, 17 bp, Homo sapiens
gcacttgttccttctgc

SEQ ID NO: 2141684 - DNA, 23 bp, Homo sapiens
gcactttaaccctctcttcccta

SEQ ID NO: 2141685 - DNA, 17 bp, Homo sapiens
gcactttataaaagcaa

SEQ ID NO: 2141686 - DNA, 20 bp, Homo sapiens
gcagaaaaaaaaaaagaaac

SEQ ID NO: 2141687 - DNA, 22 bp, Homo sapiens
gcagaaaacggagagtgcttgg

SEQ ID NO: 2141688 - DNA, 15 bp, Homo sapiens
gcagaaaagaggaga

SEQ ID NO: 2141689 - DNA, 16 bp, Homo sapiens
gcagaaaagaggagac

SEQ ID NO: 2141690 - DNA, 22 bp, Homo sapiens
gcagaaaagaggagaccctgga

SEQ ID NO: 2141691 - DNA, 19 bp, Homo sapiens
gcagaaaagtgcttagaaa

SEQ ID NO: 2141692 - DNA, 23 bp, Homo sapiens
gcagaaaagtgcttagaaagtta

SEQ ID NO: 2141693 - DNA, 22 bp, Homo sapiens
gcagaaaatcttttactagtgt

SEQ ID NO: 2141694 - DNA, 18 bp, Homo sapiens
gcagaaagccagggtcct

SEQ ID NO: 2141695 - DNA, 18 bp, Homo sapiens
gcagaacagccgctcctg

SEQ ID NO: 2141696 - DNA, 22 bp, Homo sapiens
gcagaaggaagggcatccttct

SEQ ID NO: 2141697 - DNA, 16 bp, Homo sapiens
gcagaagtcagcccga

SEQ ID NO: 2141698 - DNA, 23 bp, Homo sapiens
gcagaatcctaggctccacccca

SEQ ID NO: 2141699 - DNA, 15 bp, Homo sapiens
gcagaatgaagacct

SEQ ID NO: 2141700 - DNA, 15 bp, Homo sapiens
gcagacaagagctgc

SEQ ID NO: 2141701 - DNA, 12 bp, Homo sapiens
gcagacagagaa

SEQ ID NO: 2141702 - DNA, 22 bp, Homo sapiens
gcagacagagaaatgtgaaggg

SEQ ID NO: 2141703 - DNA, 19 bp, Homo sapiens
gcagacagcagctcaggca

SEQ ID NO: 2141704 - DNA, 21 bp, Homo sapiens
gcagacagcagctcaggcaca

SEQ ID NO: 2141705 - DNA, 17 bp, Homo sapiens
gcagacaggaggaatca

SEQ ID NO: 2141706 - DNA, 16 bp, Homo sapiens
gcagaccatctccagc

SEQ ID NO: 2141707 - DNA, 21 bp, Homo sapiens
gcagaccgggggccagacaca

SEQ ID NO: 2141708 - DNA, 22 bp, Homo sapiens
gcagaccgggggccagacacag

SEQ ID NO: 2141709 - DNA, 17 bp, Homo sapiens
gcagaccttttttagga

SEQ ID NO: 2141710 - DNA, 15 bp, Homo sapiens
gcagactcagctctg

SEQ ID NO: 2141711 - DNA, 21 bp, Homo sapiens
gcagactcctcagatctgaac

SEQ ID NO: 2141712 - DNA, 22 bp, Homo sapiens
gcagactcctcagatctgaaca

SEQ ID NO: 2141713 - DNA, 18 bp, Homo sapiens
gcagactctacagaggcc

SEQ ID NO: 2141714 - DNA, 12 bp, Homo sapiens
gcagactgtggc

SEQ ID NO: 2141715 - DNA, 22 bp, Homo sapiens
gcagacttgagtctgaggcccc

SEQ ID NO: 2141716 - DNA, 15 bp, Homo sapiens
gcagagaaagaagag

SEQ ID NO: 2141717 - DNA, 14 bp, Homo sapiens
gcagagaaggcctc

SEQ ID NO: 2141718 - DNA, 13 bp, Homo sapiens
gcagagaaggctt

SEQ ID NO: 2141719 - DNA, 19 bp, Homo sapiens
gcagagacaataaaacatt

SEQ ID NO: 2141720 - DNA, 17 bp, Homo sapiens
gcagagacaggacctga

SEQ ID NO: 2141721 - DNA, 19 bp, Homo sapiens
gcagagacgcaagggagaa

SEQ ID NO: 2141722 - DNA, 14 bp, Homo sapiens
gcagagaggtggag

SEQ ID NO: 2141723 - DNA, 21 bp, Homo sapiens
gcagagaggtggagaactggg

SEQ ID NO: 2141724 - DNA, 14 bp, Homo sapiens
gcagagcacacagg

SEQ ID NO: 2141725 - DNA, 17 bp, Homo sapiens
gcagagccatgggcctg

SEQ ID NO: 2141726 - DNA, 20 bp, Homo sapiens
gcagagccatgggcctgggc

SEQ ID NO: 2141727 - DNA, 13 bp, Homo sapiens
gcagagcctgagt

SEQ ID NO: 2141728 - DNA, 14 bp, Homo sapiens
gcagagcggggagg

SEQ ID NO: 2141729 - DNA, 13 bp, Homo sapiens
gcagaggaccaca

SEQ ID NO: 2141730 - DNA, 16 bp, Homo sapiens
gcagaggaccacagtg

SEQ ID NO: 2141731 - DNA, 21 bp, Homo sapiens
gcagaggaccacagtgggtgg

SEQ ID NO: 2141732 - DNA, 17 bp, Homo sapiens
gcagaggagtccagggc

SEQ ID NO: 2141733 - DNA, 12 bp, Homo sapiens
gcagaggcagcg

SEQ ID NO: 2141734 - DNA, 13 bp, Homo sapiens
gcagaggcggaaa

SEQ ID NO: 2141735 - DNA, 21 bp, Homo sapiens
gcagaggcggaaaccttgcag

SEQ ID NO: 2141736 - DNA, 11 bp, Homo sapiens
gcagaggctgg

SEQ ID NO: 2141737 - DNA, 19 bp, Homo sapiens
gcagaggctggaggcaggg

SEQ ID NO: 2141738 - DNA, 21 bp, Homo sapiens
gcagagggaatgttccctgca

SEQ ID NO: 2141739 - DNA, 18 bp, Homo sapiens
gcagagggcagaggctgg

SEQ ID NO: 2141740 - DNA, 15 bp, Homo sapiens
gcagaggggcagccg

SEQ ID NO: 2141741 - DNA, 22 bp, Homo sapiens
gcagaggggcagccgctaggag

SEQ ID NO: 2141742 - DNA, 16 bp, Homo sapiens
gcagaggggctttctg

SEQ ID NO: 2141743 - DNA, 21 bp, Homo sapiens
gcagaggggctttctggagag

SEQ ID NO: 2141744 - DNA, 15 bp, Homo sapiens
gcagaggtgagcaga

SEQ ID NO: 2141745 - DNA, 19 bp, Homo sapiens
gcagaggtgagcagaggag

SEQ ID NO: 2141746 - DNA, 15 bp, Homo sapiens
gcagaggtggccaga

SEQ ID NO: 2141747 - DNA, 14 bp, Homo sapiens
gcagagtgggctgc

SEQ ID NO: 2141748 - DNA, 16 bp, Homo sapiens
gcagagtgggctgcct

SEQ ID NO: 2141749 - DNA, 15 bp, Homo sapiens
gcagataaagacagc

SEQ ID NO: 2141750 - DNA, 16 bp, Homo sapiens
gcagataatcagcctc

SEQ ID NO: 2141751 - DNA, 17 bp, Homo sapiens
gcagataatcagcctct

SEQ ID NO: 2141752 - DNA, 19 bp, Homo sapiens
gcagatagccagacacatg

SEQ ID NO: 2141753 - DNA, 14 bp, Homo sapiens
gcagatcatctggg

SEQ ID NO: 2141754 - DNA, 15 bp, Homo sapiens
gcagatctttttgtg

SEQ ID NO: 2141755 - DNA, 22 bp, Homo sapiens
gcagatgagcagtcacactgtt

SEQ ID NO: 2141756 - DNA, 15 bp, Homo sapiens
gcagatggaaagaaa

SEQ ID NO: 2141757 - DNA, 14 bp, Homo sapiens
gcagatgtaggagg

SEQ ID NO: 2141758 - DNA, 19 bp, Homo sapiens
gcagatgtaggagggactg

SEQ ID NO: 2141759 - DNA, 23 bp, Homo sapiens
gcagattattttagtctgtcatc

SEQ ID NO: 2141760 - DNA, 19 bp, Homo sapiens
gcagattcatttttctttc

SEQ ID NO: 2141761 - DNA, 13 bp, Homo sapiens
gcagattcctggg

SEQ ID NO: 2141762 - DNA, 15 bp, Homo sapiens
gcagattcctgggcc

SEQ ID NO: 2141763 - DNA, 15 bp, Homo sapiens
gcagatttcctgtgt

SEQ ID NO: 2141764 - DNA, 12 bp, Homo sapiens
gcagcaactccc

SEQ ID NO: 2141765 - DNA, 13 bp, Homo sapiens
gcagcaactccca

SEQ ID NO: 2141766 - DNA, 21 bp, Homo sapiens
gcagcaaggcccgagcagctg

SEQ ID NO: 2141767 - DNA, 22 bp, Homo sapiens
gcagcaaggcccgagcagctga

SEQ ID NO: 2141768 - DNA, 19 bp, Homo sapiens
gcagcacatggtgttgtat

SEQ ID NO: 2141769 - DNA, 12 bp, Homo sapiens
gcagcaccctcc

SEQ ID NO: 2141770 - DNA, 19 bp, Homo sapiens
gcagcaccctcccccgcag

SEQ ID NO: 2141771 - DNA, 21 bp, Homo sapiens
gcagcactttaaccctctctt

SEQ ID NO: 2141772 - DNA, 17 bp, Homo sapiens
gcagcagagagccctgg

SEQ ID NO: 2141773 - DNA, 14 bp, Homo sapiens
gcagcagccagccc

SEQ ID NO: 2141774 - DNA, 16 bp, Homo sapiens
gcagcagccagccctg

SEQ ID NO: 2141775 - DNA, 21 bp, Homo sapiens
gcagcagccagccctgcctgg

SEQ ID NO: 2141776 - DNA, 13 bp, Homo sapiens
gcagcagcccagc

SEQ ID NO: 2141777 - DNA, 12 bp, Homo sapiens
gcagcagctagg

SEQ ID NO: 2141778 - DNA, 17 bp, Homo sapiens
gcagcagctaggactga

SEQ ID NO: 2141779 - DNA, 21 bp, Homo sapiens
gcagcagctcagcctcccccc

SEQ ID NO: 2141780 - DNA, 14 bp, Homo sapiens
gccagacacatggc

SEQ ID NO: 2141781 - DNA, 15 bp, Homo sapiens
gccagactggcacag

SEQ ID NO: 2141782 - DNA, 20 bp, Homo sapiens
gccagagacggaagcctttt

SEQ ID NO: 2141783 - DNA, 15 bp, Homo sapiens
gccagagagggccca

SEQ ID NO: 2141784 - DNA, 16 bp, Homo sapiens
gccagagagggcccag

SEQ ID NO: 2141785 - DNA, 18 bp, Homo sapiens
gccagagagggcccagct

SEQ ID NO: 2141786 - DNA, 20 bp, Homo sapiens
gccagagagggcccagctgt

SEQ ID NO: 2141787 - DNA, 20 bp, Homo sapiens
gccagagcccaagtgccatc

SEQ ID NO: 2141788 - DNA, 13 bp, Homo sapiens
gccagagcctggg

SEQ ID NO: 2141789 - DNA, 15 bp, Homo sapiens
gccagagcctggggc

SEQ ID NO: 2141790 - DNA, 17 bp, Homo sapiens
gccagagcctggggctc

SEQ ID NO: 2141791 - DNA, 14 bp, Homo sapiens
gccagagctggaag

SEQ ID NO: 2141792 - DNA, 15 bp, Homo sapiens
gccagagctggaagg

SEQ ID NO: 2141793 - DNA, 23 bp, Homo sapiens
gccagagctggaaggcagggcag

SEQ ID NO: 2141794 - DNA, 13 bp, Homo sapiens
gccagaggacaag

SEQ ID NO: 2141795 - DNA, 16 bp, Homo sapiens
gccagaggacaaggaa

SEQ ID NO: 2141796 - DNA, 17 bp, Homo sapiens
gccagagggagtgacag

SEQ ID NO: 2141797 - DNA, 19 bp, Homo sapiens
gccagagggagtgacagag

SEQ ID NO: 2141798 - DNA, 21 bp, Homo sapiens
gccagagggagtgacagaggc

SEQ ID NO: 2141799 - DNA, 20 bp, Homo sapiens
gccagaggttttaggaaacc

SEQ ID NO: 2141800 - DNA, 13 bp, Homo sapiens
gccagatccaccc

SEQ ID NO: 2141801 - DNA, 18 bp, Homo sapiens
gccagatgcaccagccct

SEQ ID NO: 2141802 - DNA, 17 bp, Homo sapiens
gccagatgcttggcctg

SEQ ID NO: 2141803 - DNA, 12 bp, Homo sapiens
gccagatttttt

SEQ ID NO: 2141804 - DNA, 13 bp, Homo sapiens
gccagatttttta

SEQ ID NO: 2141805 - DNA, 18 bp, Homo sapiens
gccagcaaaccaggactc

SEQ ID NO: 2141806 - DNA, 16 bp, Homo sapiens
gccagcaacacagagc

SEQ ID NO: 2141807 - DNA, 22 bp, Homo sapiens
gccagcaatgatgtccagaaga

SEQ ID NO: 2141808 - DNA, 13 bp, Homo sapiens
gccagcaccctct

SEQ ID NO: 2141809 - DNA, 17 bp, Homo sapiens
gccagcaccctctcctg

SEQ ID NO: 2141810 - DNA, 20 bp, Homo sapiens
gccagcaccctctcctgggg

SEQ ID NO: 2141811 - DNA, 12 bp, Homo sapiens
gccagcagcaga

SEQ ID NO: 2141812 - DNA, 16 bp, Homo sapiens
gccagcagccagctct

SEQ ID NO: 2141813 - DNA, 17 bp, Homo sapiens
gccagcagccagctctc

SEQ ID NO: 2141814 - DNA, 18 bp, Homo sapiens
gccagcagccagctctca

SEQ ID NO: 2141815 - DNA, 22 bp, Homo sapiens
gccagcagccagctctcagcca

SEQ ID NO: 2141816 - DNA, 19 bp, Homo sapiens
gccagccagtcttgcctag

SEQ ID NO: 2141817 - DNA, 16 bp, Homo sapiens
gccagccatcacaagg

SEQ ID NO: 2141818 - DNA, 21 bp, Homo sapiens
gccagccatcacaaggggaac

SEQ ID NO: 2141819 - DNA, 11 bp, Homo sapiens
gccagccccat

SEQ ID NO: 2141820 - DNA, 14 bp, Homo sapiens
gccagccctacatc

SEQ ID NO: 2141821 - DNA, 20 bp, Homo sapiens
gccagccctacatcttcagc

SEQ ID NO: 2141822 - DNA, 23 bp, Homo sapiens
gccagccctccctgtcctcctcg

SEQ ID NO: 2141823 - DNA, 10 bp, Homo sapiens
gccagccctg

SEQ ID NO: 2141824 - DNA, 19 bp, Homo sapiens
gccagccctgcctggagga

SEQ ID NO: 2141825 - DNA, 19 bp, Homo sapiens
gccagccgccctgggctgt

SEQ ID NO: 2141826 - DNA, 22 bp, Homo sapiens
gccagccgggtacctcagtttc

SEQ ID NO: 2141827 - DNA, 16 bp, Homo sapiens
gccagccggtgcctgg

SEQ ID NO: 2141828 - DNA, 18 bp, Homo sapiens
gccagccgtgatgctcag

SEQ ID NO: 2141829 - DNA, 13 bp, Homo sapiens
gccagcctcagct

SEQ ID NO: 2141830 - DNA, 14 bp, Homo sapiens
gccagcctcagctc

SEQ ID NO: 2141831 - DNA, 15 bp, Homo sapiens
gccagcctcagctca

SEQ ID NO: 2141832 - DNA, 18 bp, Homo sapiens
gccagcctcagctcagcc

SEQ ID NO: 2141833 - DNA, 13 bp, Homo sapiens
gccagcctcagtg

SEQ ID NO: 2141834 - DNA, 17 bp, Homo sapiens
gccagcctcagtgccac

SEQ ID NO: 2141835 - DNA, 18 bp, Homo sapiens
gccagcctcagtgccact

SEQ ID NO: 2141836 - DNA, 16 bp, Homo sapiens
gccagcctccccacat

SEQ ID NO: 2141837 - DNA, 13 bp, Homo sapiens
gccagcctggcct

SEQ ID NO: 2141838 - DNA, 20 bp, Homo sapiens
gccagcctggcctcctgcct

SEQ ID NO: 2141839 - DNA, 18 bp, Homo sapiens
gccagcctggcttctgga

SEQ ID NO: 2141840 - DNA, 15 bp, Homo sapiens
gccagcgcctccctc

SEQ ID NO: 2141841 - DNA, 17 bp, Homo sapiens
gccagcgcctccctcca

SEQ ID NO: 2141842 - DNA, 20 bp, Homo sapiens
gccagcgcctccctccaccc

SEQ ID NO: 2141843 - DNA, 10 bp, Homo sapiens
gccagctctc

SEQ ID NO: 2141844 - DNA, 14 bp, Homo sapiens
gccagctctcagcc

SEQ ID NO: 2141845 - DNA, 15 bp, Homo sapiens
gccagctctcagcca

SEQ ID NO: 2141846 - DNA, 17 bp, Homo sapiens
gccagctctctctaccc

SEQ ID NO: 2141847 - DNA, 19 bp, Homo sapiens
gccagctgcatctactcag

SEQ ID NO: 2141848 - DNA, 12 bp, Homo sapiens
gccagctgcctt

SEQ ID NO: 2141849 - DNA, 13 bp, Homo sapiens
gccagctggtgct

SEQ ID NO: 2141850 - DNA, 14 bp, Homo sapiens
gccagctggtgctg

SEQ ID NO: 2141851 - DNA, 19 bp, Homo sapiens
gccagctggtgctgcaagg

SEQ ID NO: 2141852 - DNA, 20 bp, Homo sapiens
gccagctggtgctgcaagga

SEQ ID NO: 2141853 - DNA, 18 bp, Homo sapiens
gccagcttgttatttata

SEQ ID NO: 2141854 - DNA, 16 bp, Homo sapiens
gccaggaatctgccat

SEQ ID NO: 2141855 - DNA, 20 bp, Homo sapiens
gccaggacagctggctgctg

SEQ ID NO: 2141856 - DNA, 22 bp, Homo sapiens
gccaggacagctggctgctgac

SEQ ID NO: 2141857 - DNA, 23 bp, Homo sapiens
gccaggacagctggctgctgaca

SEQ ID NO: 2141858 - DNA, 10 bp, Homo sapiens
gccaggagag

SEQ ID NO: 2141859 - DNA, 13 bp, Homo sapiens
gccaggagagaga

SEQ ID NO: 2141860 - DNA, 15 bp, Homo sapiens
gccaggagcaaatgt

SEQ ID NO: 2141861 - DNA, 14 bp, Homo sapiens
gccaggagctcagc

SEQ ID NO: 2141862 - DNA, 17 bp, Homo sapiens
gccaggagctggaggag

SEQ ID NO: 2141863 - DNA, 17 bp, Homo sapiens
gccaggaggctgcggcc

SEQ ID NO: 2141864 - DNA, 13 bp, Homo sapiens
gccaggagggaca

SEQ ID NO: 2141865 - DNA, 19 bp, Homo sapiens
gccaggagggacaaaggag

SEQ ID NO: 2141866 - DNA, 15 bp, Homo sapiens
gccaggaggtcctcc

SEQ ID NO: 2141867 - DNA, 17 bp, Homo sapiens
gccaggatcccaagcgt

SEQ ID NO: 2141868 - DNA, 19 bp, Homo sapiens
gccaggcaccccctggaga

SEQ ID NO: 2141869 - DNA, 17 bp, Homo sapiens
gccaggcacctggcctg

SEQ ID NO: 2141870 - DNA, 18 bp, Homo sapiens
gccaggcacctggcctgc

SEQ ID NO: 2141871 - DNA, 19 bp, Homo sapiens
gccaggcacctggcctgct

SEQ ID NO: 2141872 - DNA, 23 bp, Homo sapiens
gccaggcacctggcctgctggga

SEQ ID NO: 2141873 - DNA, 22 bp, Homo sapiens
gccaggcaggggtgggagagcc

SEQ ID NO: 2141874 - DNA, 18 bp, Homo sapiens
gccaggcaggtgcctgga

SEQ ID NO: 2141875 - DNA, 19 bp, Homo sapiens
gccaggccaccaggatggc

SEQ ID NO: 2141876 - DNA, 22 bp, Homo sapiens
gccaggcgcggtggctcacgcc

SEQ ID NO: 2141877 - DNA, 23 bp, Homo sapiens
gccaggcgggagatggacccctc

SEQ ID NO: 2141878 - DNA, 15 bp, Homo sapiens
gccaggcgttggtgc

SEQ ID NO: 2141879 - DNA, 21 bp, Homo sapiens
gccaggcgttggtgccacttc

SEQ ID NO: 2141880 - DNA, 15 bp, Homo sapiens
gccaggctaattttt

SEQ ID NO: 2141881 - DNA, 20 bp, Homo sapiens
gccaggctccctttctcttc

SEQ ID NO: 2141882 - DNA, 16 bp, Homo sapiens
gccaggctctgcctgg

SEQ ID NO: 2141883 - DNA, 21 bp, Homo sapiens
gccaggctgtaagcattctga

SEQ ID NO: 2141884 - DNA, 13 bp, Homo sapiens
gccagggccaggg

SEQ ID NO: 2141885 - DNA, 15 bp, Homo sapiens
gccagggcctggtgt

SEQ ID NO: 2141886 - DNA, 15 bp, Homo sapiens
gccaggggctgctca

SEQ ID NO: 2141887 - DNA, 19 bp, Homo sapiens
gccaggggctgctcatcac

SEQ ID NO: 2141888 - DNA, 18 bp, Homo sapiens
gccaggggtctccctgga

SEQ ID NO: 2141889 - DNA, 19 bp, Homo sapiens
gccagggtttacccagtgg

SEQ ID NO: 2141890 - DNA, 13 bp, Homo sapiens
gccaggtgcagtg

SEQ ID NO: 2141891 - DNA, 18 bp, Homo sapiens
gccaggtggccactccag

SEQ ID NO: 2141892 - DNA, 13 bp, Homo sapiens
gccagtcctagag

SEQ ID NO: 2141893 - DNA, 18 bp, Homo sapiens
gccagtcttgcctaggcc

SEQ ID NO: 2141894 - DNA, 18 bp, Homo sapiens
gccagtgactttttctga

SEQ ID NO: 2141895 - DNA, 16 bp, Homo sapiens
gccgtccatggcacca

SEQ ID NO: 2141896 - DNA, 21 bp, Homo sapiens
gccgtccatggcaccagcccc

SEQ ID NO: 2141897 - DNA, 23 bp, Homo sapiens
gccgtccatggcaccagccccct

SEQ ID NO: 2141898 - DNA, 14 bp, Homo sapiens
gccgtctgactcca

SEQ ID NO: 2141899 - DNA, 16 bp, Homo sapiens
gccgtctgactccaga

SEQ ID NO: 2141900 - DNA, 23 bp, Homo sapiens
gccgtgaggacacgtggcctgca

SEQ ID NO: 2141901 - DNA, 17 bp, Homo sapiens
gccgtgatgctcaggct

SEQ ID NO: 2141902 - DNA, 21 bp, Homo sapiens
gccgtggcttcccgctcagcc

SEQ ID NO: 2141903 - DNA, 15 bp, Homo sapiens
gccgtggtccagctc

SEQ ID NO: 2141904 - DNA, 18 bp, Homo sapiens
gccgtggtccagctcttg

SEQ ID NO: 2141905 - DNA, 15 bp, Homo sapiens
gccgttccccttggc

SEQ ID NO: 2141906 - DNA, 17 bp, Homo sapiens
gcctaaaaatgcaactt

SEQ ID NO: 2141907 - DNA, 16 bp, Homo sapiens
gcctaaaagtaaacat

SEQ ID NO: 2141908 - DNA, 16 bp, Homo sapiens
gcctaagaagctctgg

SEQ ID NO: 2141909 - DNA, 20 bp, Homo sapiens
gcctaatatttaggcaagag

SEQ ID NO: 2141910 - DNA, 17 bp, Homo sapiens
gcctaattcctggcatg

SEQ ID NO: 2141911 - DNA, 16 bp, Homo sapiens
gcctacaggagtgagc

SEQ ID NO: 2141912 - DNA, 19 bp, Homo sapiens
gcctacattccctggcctg

SEQ ID NO: 2141913 - DNA, 20 bp, Homo sapiens
gcctacattccctggcctgg

SEQ ID NO: 2141914 - DNA, 21 bp, Homo sapiens
gcctacattccctggcctggc

SEQ ID NO: 2141915 - DNA, 19 bp, Homo sapiens
gcctacccttgtaccccat

SEQ ID NO: 2141916 - DNA, 22 bp, Homo sapiens
gcctacccttgtaccccatccc

SEQ ID NO: 2141917 - DNA, 12 bp, Homo sapiens
gcctagccacct

SEQ ID NO: 2141918 - DNA, 14 bp, Homo sapiens
gcctagccacctcc

SEQ ID NO: 2141919 - DNA, 19 bp, Homo sapiens
gcctagccacctcccaccc

SEQ ID NO: 2141920 - DNA, 16 bp, Homo sapiens
gcctagccgacctcag

SEQ ID NO: 2141921 - DNA, 17 bp, Homo sapiens
gcctagccgacctcagc

SEQ ID NO: 2141922 - DNA, 20 bp, Homo sapiens
gcctagccgacctcagcctt

SEQ ID NO: 2141923 - DNA, 22 bp, Homo sapiens
gcctagctaccttctctaccca

SEQ ID NO: 2141924 - DNA, 17 bp, Homo sapiens
gcctaggaattcccagc

SEQ ID NO: 2141925 - DNA, 14 bp, Homo sapiens
gcctaggacctcag

SEQ ID NO: 2141926 - DNA, 14 bp, Homo sapiens
gcctaggtgacaga

SEQ ID NO: 2141927 - DNA, 22 bp, Homo sapiens
gcctagttcctgtggccaggag

SEQ ID NO: 2141928 - DNA, 20 bp, Homo sapiens
gcctatcaacctaagcaaca

SEQ ID NO: 2141929 - DNA, 14 bp, Homo sapiens
gcctatccatcctg

SEQ ID NO: 2141930 - DNA, 15 bp, Homo sapiens
gcctatccatcctgc

SEQ ID NO: 2141931 - DNA, 14 bp, Homo sapiens
gcctatctgagact

SEQ ID NO: 2141932 - DNA, 20 bp, Homo sapiens
gcctatgcacatatggactc

SEQ ID NO: 2141933 - DNA, 14 bp, Homo sapiens
gcctatggagagcc

SEQ ID NO: 2141934 - DNA, 22 bp, Homo sapiens
gcctcaaagcaagcattcagaa

SEQ ID NO: 2141935 - DNA, 20 bp, Homo sapiens
gcctcaaataaaaagtgctt

SEQ ID NO: 2141936 - DNA, 12 bp, Homo sapiens
gcctcaagaaca

SEQ ID NO: 2141937 - DNA, 17 bp, Homo sapiens
gcctcaagaacaccttt

SEQ ID NO: 2141938 - DNA, 22 bp, Homo sapiens
gcctcaagtgattctcctgcct

SEQ ID NO: 2141939 - DNA, 22 bp, Homo sapiens
gcctcaatgtgaatcagaccct

SEQ ID NO: 2141940 - DNA, 21 bp, Homo sapiens
gcctcaatgtggttgcaaggc

SEQ ID NO: 2141941 - DNA, 16 bp, Homo sapiens
gcctcacagaagaata

SEQ ID NO: 2141942 - DNA, 18 bp, Homo sapiens
gcctcacgcccagcctcc

SEQ ID NO: 2141943 - DNA, 20 bp, Homo sapiens
gcctcacgcccagcctcctc

SEQ ID NO: 2141944 - DNA, 23 bp, Homo sapiens
gcctcacgcccagcctcctccca

SEQ ID NO: 2141945 - DNA, 19 bp, Homo sapiens
gcctcactattacttgaac

SEQ ID NO: 2141946 - DNA, 16 bp, Homo sapiens
gcctcactgagctaat

SEQ ID NO: 2141947 - DNA, 17 bp, Homo sapiens
gcctcacttccctggga

SEQ ID NO: 2141948 - DNA, 23 bp, Homo sapiens
gcctcacttttaatgaacaaatg

SEQ ID NO: 2141949 - DNA, 12 bp, Homo sapiens
gcctcagaccaa

SEQ ID NO: 2141950 - DNA, 20 bp, Homo sapiens
gcctcagaccaactctctcc

SEQ ID NO: 2141951 - DNA, 15 bp, Homo sapiens
gcctcagcatcctgg

SEQ ID NO: 2141952 - DNA, 17 bp, Homo sapiens
gcctcagcatcctggca

SEQ ID NO: 2141953 - DNA, 12 bp, Homo sapiens
gcctcagccctc

SEQ ID NO: 2141954 - DNA, 15 bp, Homo sapiens
gcctcagccctcaga

SEQ ID NO: 2141955 - DNA, 16 bp, Homo sapiens
gcctcagccctcagaa

SEQ ID NO: 2141956 - DNA, 12 bp, Homo sapiens
gcctcagcctcc

SEQ ID NO: 2141957 - DNA, 23 bp, Homo sapiens
gcctcagcctcccaaagtgctgg

SEQ ID NO: 2141958 - DNA, 18 bp, Homo sapiens
gcctcagctcagcctccc

SEQ ID NO: 2141959 - DNA, 14 bp, Homo sapiens
gcctcagctgctcg

SEQ ID NO: 2141960 - DNA, 15 bp, Homo sapiens
gcctcagtgccactt

SEQ ID NO: 2141961 - DNA, 16 bp, Homo sapiens
gcctcagttcaacctg

SEQ ID NO: 2141962 - DNA, 15 bp, Homo sapiens
gcctcagtttcccca

SEQ ID NO: 2141963 - DNA, 16 bp, Homo sapiens
gcctcagtttccccat

SEQ ID NO: 2141964 - DNA, 21 bp, Homo sapiens
gcctcatgaccctcctgtcca

SEQ ID NO: 2141965 - DNA, 17 bp, Homo sapiens
gcctccaagctccatct

SEQ ID NO: 2141966 - DNA, 20 bp, Homo sapiens
gcctccactcccccacctga

SEQ ID NO: 2141967 - DNA, 23 bp, Homo sapiens
gcctccactcccccacctgacaa

SEQ ID NO: 2141968 - DNA, 15 bp, Homo sapiens
gcctccagagccagc

SEQ ID NO: 2141969 - DNA, 16 bp, Homo sapiens
gcctccagagccagcc

SEQ ID NO: 2141970 - DNA, 20 bp, Homo sapiens
gcctccagagccagcctggg

SEQ ID NO: 2141971 - DNA, 21 bp, Homo sapiens
gcctccagagccagcctggga

SEQ ID NO: 2141972 - DNA, 23 bp, Homo sapiens
gcctccagagccagcctgggact

SEQ ID NO: 2141973 - DNA, 17 bp, Homo sapiens
gcctccatttagttctt

SEQ ID NO: 2141974 - DNA, 16 bp, Homo sapiens
gcctcccaaagtgctg

SEQ ID NO: 2141975 - DNA, 22 bp, Homo sapiens
gcctcccagccctgccaggagg

SEQ ID NO: 2141976 - DNA, 14 bp, Homo sapiens
gcctcccagcctgg

SEQ ID NO: 2141977 - DNA, 12 bp, Homo sapiens
gcctccccacct

SEQ ID NO: 2141978 - DNA, 15 bp, Homo sapiens
gcctccccctcagat

SEQ ID NO: 2141979 - DNA, 18 bp, Homo sapiens
gcctccccctgctgctca

SEQ ID NO: 2141980 - DNA, 19 bp, Homo sapiens
gcctcccgaatagctggga

SEQ ID NO: 2141981 - DNA, 20 bp, Homo sapiens
gcctcccgaatagctgggac

SEQ ID NO: 2141982 - DNA, 20 bp, Homo sapiens
gcctcccgagtagctgggac

SEQ ID NO: 2141983 - DNA, 23 bp, Homo sapiens
gcctcccgagtagctgggactac

SEQ ID NO: 2141984 - DNA, 14 bp, Homo sapiens
gcctccctccaccc

SEQ ID NO: 2141985 - DNA, 15 bp, Homo sapiens
gcctccctccacccc

SEQ ID NO: 2141986 - DNA, 17 bp, Homo sapiens
gcctccctccaccccag

SEQ ID NO: 2141987 - DNA, 14 bp, Homo sapiens
gcctccctcctcgt

SEQ ID NO: 2141988 - DNA, 13 bp, Homo sapiens
gcctccctctcca

SEQ ID NO: 2141989 - DNA, 16 bp, Homo sapiens
gcctccgtcaggagag

SEQ ID NO: 2141990 - DNA, 18 bp, Homo sapiens
gcctccgtttatgggcct

SEQ ID NO: 2141991 - DNA, 20 bp, Homo sapiens
gcctccgtttatgggccttg

SEQ ID NO: 2141992 - DNA, 14 bp, Homo sapiens
gcctcctcaccccc

SEQ ID NO: 2141993 - DNA, 19 bp, Homo sapiens
gcctcctcacccccagctt

SEQ ID NO: 2141994 - DNA, 19 bp, Homo sapiens
gcctcctcccaccaccctc

SEQ ID NO: 2141995 - DNA, 13 bp, Homo sapiens
gcctcctcctgac

SEQ ID NO: 2141996 - DNA, 15 bp, Homo sapiens
gcctcctcctgacca

SEQ ID NO: 2141997 - DNA, 16 bp, Homo sapiens
gcctcctgacctgagg

SEQ ID NO: 2141998 - DNA, 16 bp, Homo sapiens
gcctcctggccagacg

SEQ ID NO: 2141999 - DNA, 14 bp, Homo sapiens
gcctcctgggacca

SEQ ID NO: 2142000 - DNA, 13 bp, Homo sapiens
gcctcctgtctta

SEQ ID NO: 2142001 - DNA, 13 bp, Homo sapiens
gcctcctgtgtgt

SEQ ID NO: 2142002 - DNA, 16 bp, Homo sapiens
gcctccttatttatca

SEQ ID NO: 2142003 - DNA, 20 bp, Homo sapiens
gcctccttccttgctgtcct

SEQ ID NO: 2142004 - DNA, 16 bp, Homo sapiens
gcctcgaactggctgc

SEQ ID NO: 2142005 - DNA, 20 bp, Homo sapiens
gcctcgaactggctgcaaag

SEQ ID NO: 2142006 - DNA, 22 bp, Homo sapiens
gcctcgaactggctgcaaaggg

SEQ ID NO: 2142007 - DNA, 22 bp, Homo sapiens
gcctcgaggcaccggcgctgca

SEQ ID NO: 2142008 - DNA, 14 bp, Homo sapiens
gcctcgcatgccag

SEQ ID NO: 2142009 - DNA, 20 bp, Homo sapiens
gcctcgcatgccagagcctg

SEQ ID NO: 2142010 - DNA, 15 bp, Homo sapiens
gcggcttcctgtcca

SEQ ID NO: 2142011 - DNA, 14 bp, Homo sapiens
gcgggaaggagggt

SEQ ID NO: 2142012 - DNA, 20 bp, Homo sapiens
gcgggaggatgttctgggac

SEQ ID NO: 2142013 - DNA, 21 bp, Homo sapiens
gcgggaggatgttctgggaca

SEQ ID NO: 2142014 - DNA, 12 bp, Homo sapiens
gcgggaggcacc

SEQ ID NO: 2142015 - DNA, 18 bp, Homo sapiens
gcgggaggcaccagctct

SEQ ID NO: 2142016 - DNA, 19 bp, Homo sapiens
gcgggaggcaccagctctg

SEQ ID NO: 2142017 - DNA, 23 bp, Homo sapiens
gcgggaggcaccagctctgtggc

SEQ ID NO: 2142018 - DNA, 16 bp, Homo sapiens
gcgggcaccagaatgc

SEQ ID NO: 2142019 - DNA, 16 bp, Homo sapiens
gcgggccaccaagttc

SEQ ID NO: 2142020 - DNA, 20 bp, Homo sapiens
gcgggcgcctgtagtcccag

SEQ ID NO: 2142021 - DNA, 15 bp, Homo sapiens
gcggggacagctcct

SEQ ID NO: 2142022 - DNA, 14 bp, Homo sapiens
gcggggcagagcca

SEQ ID NO: 2142023 - DNA, 12 bp, Homo sapiens
gcggggcaggag

SEQ ID NO: 2142024 - DNA, 15 bp, Homo sapiens
gcggggcaggaggcc

SEQ ID NO: 2142025 - DNA, 23 bp, Homo sapiens
gcggggcttctgggtggctcctg

SEQ ID NO: 2142026 - DNA, 17 bp, Homo sapiens
gcgggggagccaacagc

SEQ ID NO: 2142027 - DNA, 20 bp, Homo sapiens
gcgggggagccaacagcagc

SEQ ID NO: 2142028 - DNA, 11 bp, Homo sapiens
gcggtacccca

SEQ ID NO: 2142029 - DNA, 19 bp, Homo sapiens
gcggtcatgtgtgcatgtg

SEQ ID NO: 2142030 - DNA, 13 bp, Homo sapiens
gcggtccacccag

SEQ ID NO: 2142031 - DNA, 16 bp, Homo sapiens
gcggtccacccaggag

SEQ ID NO: 2142032 - DNA, 19 bp, Homo sapiens
gcggtccacccaggagccc

SEQ ID NO: 2142033 - DNA, 14 bp, Homo sapiens
gcggtgctctggcg

SEQ ID NO: 2142034 - DNA, 19 bp, Homo sapiens
gcggtggctcttgcctgta

SEQ ID NO: 2142035 - DNA, 15 bp, Homo sapiens
gcggtttccaggaag

SEQ ID NO: 2142036 - DNA, 19 bp, Homo sapiens
gcgtagaaaacgcacctcc

SEQ ID NO: 2142037 - DNA, 14 bp, Homo sapiens
gcgtagagagccgg

SEQ ID NO: 2142038 - DNA, 20 bp, Homo sapiens
gcgtatatgtgcgtctctct

SEQ ID NO: 2142039 - DNA, 15 bp, Homo sapiens
gcgtcccccagccct

SEQ ID NO: 2142040 - DNA, 20 bp, Homo sapiens
gcgtcccccagccctcaggc

SEQ ID NO: 2142041 - DNA, 19 bp, Homo sapiens
gcgtcccctgctactcctg

SEQ ID NO: 2142042 - DNA, 17 bp, Homo sapiens
gcgtcctgacgccctgc

SEQ ID NO: 2142043 - DNA, 13 bp, Homo sapiens
gcgtcctgcagag

SEQ ID NO: 2142044 - DNA, 18 bp, Homo sapiens
gcgtcctgcagaggacca

SEQ ID NO: 2142045 - DNA, 15 bp, Homo sapiens
gcgtctaccctggga

SEQ ID NO: 2142046 - DNA, 16 bp, Homo sapiens
gcgtctaccctgggat

SEQ ID NO: 2142047 - DNA, 11 bp, Homo sapiens
gcgtctcctgt

SEQ ID NO: 2142048 - DNA, 20 bp, Homo sapiens
gcgtctcctgtttttctggg

SEQ ID NO: 2142049 - DNA, 21 bp, Homo sapiens
gcgtctcctgtttttctgggt

SEQ ID NO: 2142050 - DNA, 21 bp, Homo sapiens
gcgtctctctttctccctcac

SEQ ID NO: 2142051 - DNA, 19 bp, Homo sapiens
gcgtgactattttttaata

SEQ ID NO: 2142052 - DNA, 18 bp, Homo sapiens
gcgtgagccactgcaccg

SEQ ID NO: 2142053 - DNA, 18 bp, Homo sapiens
gcgtgcacacaccagagc

SEQ ID NO: 2142054 - DNA, 23 bp, Homo sapiens
gcgtgcacacaccagagcccacc

SEQ ID NO: 2142055 - DNA, 23 bp, Homo sapiens
gcgtgcacagcgcgggcggaggc

SEQ ID NO: 2142056 - DNA, 16 bp, Homo sapiens
gcgtgcaccaccatgc

SEQ ID NO: 2142057 - DNA, 21 bp, Homo sapiens
gcgtgccctgacccctgcacc

SEQ ID NO: 2142058 - DNA, 23 bp, Homo sapiens
gcgtgcgtgttagtgtgtgtgca

SEQ ID NO: 2142059 - DNA, 17 bp, Homo sapiens
gcgtgctttatttatgg

SEQ ID NO: 2142060 - DNA, 16 bp, Homo sapiens
gcgtggaccccgacaa

SEQ ID NO: 2142061 - DNA, 17 bp, Homo sapiens
gcgtggactctgcacat

SEQ ID NO: 2142062 - DNA, 18 bp, Homo sapiens
gcgtggactctgcacatg

SEQ ID NO: 2142063 - DNA, 21 bp, Homo sapiens
gcgtggccttgttctgtcacc

SEQ ID NO: 2142064 - DNA, 12 bp, Homo sapiens
gcgtggctgtgg

SEQ ID NO: 2142065 - DNA, 14 bp, Homo sapiens
gcgtggctgtggca

SEQ ID NO: 2142066 - DNA, 13 bp, Homo sapiens
gcgtgtgtacaca

SEQ ID NO: 2142067 - DNA, 15 bp, Homo sapiens
gcgttggagccactc

SEQ ID NO: 2142068 - DNA, 17 bp, Homo sapiens
gcgttggagccactcct

SEQ ID NO: 2142069 - DNA, 21 bp, Homo sapiens
gcgtttagtttctagaggcct

SEQ ID NO: 2142070 - DNA, 22 bp, Homo sapiens
gcgtttagtttctagaggcctc

SEQ ID NO: 2142071 - DNA, 13 bp, Homo sapiens
gcgtttgtaaatt

SEQ ID NO: 2142072 - DNA, 12 bp, Homo sapiens
gcgttttagagt

SEQ ID NO: 2142073 - DNA, 12 bp, Homo sapiens
gctaaaagaaac

SEQ ID NO: 2142074 - DNA, 16 bp, Homo sapiens
gctaaaagaaactttc

SEQ ID NO: 2142075 - DNA, 16 bp, Homo sapiens
gctaaatactgtacat

SEQ ID NO: 2142076 - DNA, 19 bp, Homo sapiens
gctaaatactgtacataga

SEQ ID NO: 2142077 - DNA, 20 bp, Homo sapiens
gctaaatgcaaacactgtgt

SEQ ID NO: 2142078 - DNA, 19 bp, Homo sapiens
gctaaatggtcgcccagga

SEQ ID NO: 2142079 - DNA, 22 bp, Homo sapiens
gctaaatttttcttaatcaaga

SEQ ID NO: 2142080 - DNA, 17 bp, Homo sapiens
gctaacattttaaataa

SEQ ID NO: 2142081 - DNA, 23 bp, Homo sapiens
gctaacattttaaataaaagaaa

SEQ ID NO: 2142082 - DNA, 21 bp, Homo sapiens
gctaacccccagcccacagag

SEQ ID NO: 2142083 - DNA, 21 bp, Homo sapiens
gctaactagcttggaaactgg

SEQ ID NO: 2142084 - DNA, 13 bp, Homo sapiens
gctaactggaagc

SEQ ID NO: 2142085 - DNA, 22 bp, Homo sapiens
gctaagatgagatttgccagca

SEQ ID NO: 2142086 - DNA, 18 bp, Homo sapiens
gctaagtgatcctcccac

SEQ ID NO: 2142087 - DNA, 22 bp, Homo sapiens
gctaagtgatcctcccacctca

SEQ ID NO: 2142088 - DNA, 16 bp, Homo sapiens
gctaatcagcattctc

SEQ ID NO: 2142089 - DNA, 17 bp, Homo sapiens
gctaatcagcattctca

SEQ ID NO: 2142090 - DNA, 18 bp, Homo sapiens
gctaatctgtagggctgg

SEQ ID NO: 2142091 - DNA, 20 bp, Homo sapiens
gctaatctgtagggctggac

SEQ ID NO: 2142092 - DNA, 22 bp, Homo sapiens
gctaatctgtagggctggacct

SEQ ID NO: 2142093 - DNA, 14 bp, Homo sapiens
gctaattaaaaagt

SEQ ID NO: 2142094 - DNA, 15 bp, Homo sapiens
gctaattaaaaagtt

SEQ ID NO: 2142095 - DNA, 20 bp, Homo sapiens
gctaatttaaggatgacttt

SEQ ID NO: 2142096 - DNA, 20 bp, Homo sapiens
gctaattttttgttgtttct

SEQ ID NO: 2142097 - DNA, 17 bp, Homo sapiens
gctacaaaaacacagca

SEQ ID NO: 2142098 - DNA, 20 bp, Homo sapiens
gctacaaatactcttaggaa

SEQ ID NO: 2142099 - DNA, 14 bp, Homo sapiens
gctacaataaatgc

SEQ ID NO: 2142100 - DNA, 16 bp, Homo sapiens
gctacacaaaagccaa

SEQ ID NO: 2142101 - DNA, 18 bp, Homo sapiens
gctacaccactctggcag

SEQ ID NO: 2142102 - DNA, 20 bp, Homo sapiens
gctacaccactctggcagcc

SEQ ID NO: 2142103 - DNA, 19 bp, Homo sapiens
gctacagtactatgtaaat

SEQ ID NO: 2142104 - DNA, 20 bp, Homo sapiens
gctacagttttgtgaatctt

SEQ ID NO: 2142105 - DNA, 15 bp, Homo sapiens
gctacattcctcagc

SEQ ID NO: 2142106 - DNA, 18 bp, Homo sapiens
gctacattcctcagctgc

SEQ ID NO: 2142107 - DNA, 19 bp, Homo sapiens
gctacattcctcagctgcc

SEQ ID NO: 2142108 - DNA, 18 bp, Homo sapiens
gctaccaaggcccagcta

SEQ ID NO: 2142109 - DNA, 16 bp, Homo sapiens
gctacccaaaagagaa

SEQ ID NO: 2142110 - DNA, 13 bp, Homo sapiens
gctaccccaccca

SEQ ID NO: 2142111 - DNA, 22 bp, Homo sapiens
gctaccccccctcctgctgcct

SEQ ID NO: 2142112 - DNA, 16 bp, Homo sapiens
gctactcagaagcctg

SEQ ID NO: 2142113 - DNA, 18 bp, Homo sapiens
gctactcagaagcctgag

SEQ ID NO: 2142114 - DNA, 19 bp, Homo sapiens
gctactcagaagcctgagg

SEQ ID NO: 2142115 - DNA, 12 bp, Homo sapiens
gctactcagcag

SEQ ID NO: 2142116 - DNA, 21 bp, Homo sapiens
gctactcagcagccctcctca

SEQ ID NO: 2142117 - DNA, 22 bp, Homo sapiens
gctactcagcagccctcctcac

SEQ ID NO: 2142118 - DNA, 24 bp, Homo sapiens
gctactcagcagccctcctcaccc

SEQ ID NO: 2142119 - DNA, 14 bp, Homo sapiens
gctactcaggaggc

SEQ ID NO: 2142120 - DNA, 15 bp, Homo sapiens
gctactcaggaggct

SEQ ID NO: 2142121 - DNA, 14 bp, Homo sapiens
gctactctgtccag

SEQ ID NO: 2142122 - DNA, 16 bp, Homo sapiens
gctactctgtccaggc

SEQ ID NO: 2142123 - DNA, 19 bp, Homo sapiens
gctactctgtccaggccac

SEQ ID NO: 2142124 - DNA, 17 bp, Homo sapiens
gctgcctaagtggctgc

SEQ ID NO: 2142125 - DNA, 14 bp, Homo sapiens
gctgcctgaaaacc

SEQ ID NO: 2142126 - DNA, 13 bp, Homo sapiens
gctgcctgccgcc

SEQ ID NO: 2142127 - DNA, 12 bp, Homo sapiens
gctgcctgtagt

SEQ ID NO: 2142128 - DNA, 19 bp, Homo sapiens
gctgcctgtagttaggaaa

SEQ ID NO: 2142129 - DNA, 12 bp, Homo sapiens
gctgcctgttca

SEQ ID NO: 2142130 - DNA, 20 bp, Homo sapiens
gctgcctgttcagctccagc

SEQ ID NO: 2142131 - DNA, 17 bp, Homo sapiens
gctgcgagcatttccct

SEQ ID NO: 2142132 - DNA, 15 bp, Homo sapiens
gctgcgggtctgaag

SEQ ID NO: 2142133 - DNA, 16 bp, Homo sapiens
gctgcggtccacccag

SEQ ID NO: 2142134 - DNA, 14 bp, Homo sapiens
gctgcgtctccatc

SEQ ID NO: 2142135 - DNA, 14 bp, Homo sapiens
gctgctagagaagg

SEQ ID NO: 2142136 - DNA, 20 bp, Homo sapiens
gctgctagcacttggagcca

SEQ ID NO: 2142137 - DNA, 21 bp, Homo sapiens
gctgctcatcacccagtcctg

SEQ ID NO: 2142138 - DNA, 22 bp, Homo sapiens
gctgctcatcacccagtcctgg

SEQ ID NO: 2142139 - DNA, 22 bp, Homo sapiens
gctgctcatccagggtgttaca

SEQ ID NO: 2142140 - DNA, 12 bp, Homo sapiens
gctgctcctcca

SEQ ID NO: 2142141 - DNA, 18 bp, Homo sapiens
gctgctcctccagggcca

SEQ ID NO: 2142142 - DNA, 21 bp, Homo sapiens
gctgctcggggtgcacaggag

SEQ ID NO: 2142143 - DNA, 22 bp, Homo sapiens
gctgctcggggtgcacaggagg

SEQ ID NO: 2142144 - DNA, 15 bp, Homo sapiens
gctgctctagctggc

SEQ ID NO: 2142145 - DNA, 16 bp, Homo sapiens
gctgctctagctggca

SEQ ID NO: 2142146 - DNA, 12 bp, Homo sapiens
gctgctctgcta

SEQ ID NO: 2142147 - DNA, 14 bp, Homo sapiens
gctgctgacaggat

SEQ ID NO: 2142148 - DNA, 17 bp, Homo sapiens
gctgctgagaacctggc

SEQ ID NO: 2142149 - DNA, 19 bp, Homo sapiens
gctgctgagaacctggcct

SEQ ID NO: 2142150 - DNA, 17 bp, Homo sapiens
gctgctggggcatgtgt

SEQ ID NO: 2142151 - DNA, 22 bp, Homo sapiens
gctgctggggcatgtgtgcctg

SEQ ID NO: 2142152 - DNA, 16 bp, Homo sapiens
gctgctgtaactgctg

SEQ ID NO: 2142153 - DNA, 20 bp, Homo sapiens
gctgctgtaactgctgagcc

SEQ ID NO: 2142154 - DNA, 23 bp, Homo sapiens
gctgctgtaactgctgagccact

SEQ ID NO: 2142155 - DNA, 20 bp, Homo sapiens
gctgctgtgtagctctgtcc

SEQ ID NO: 2142156 - DNA, 18 bp, Homo sapiens
gctgctttttggcacagt

SEQ ID NO: 2142157 - DNA, 18 bp, Homo sapiens
gctggaaaagtcacacag

SEQ ID NO: 2142158 - DNA, 22 bp, Homo sapiens
gctggaaataaacctggagatg

SEQ ID NO: 2142159 - DNA, 18 bp, Homo sapiens
gctggaagcactgctgtg

SEQ ID NO: 2142160 - DNA, 11 bp, Homo sapiens
gctggaatcaa

SEQ ID NO: 2142161 - DNA, 20 bp, Homo sapiens
gctggaatcaatttcccaga

SEQ ID NO: 2142162 - DNA, 22 bp, Homo sapiens
gctggaatcaatttcccagaag

SEQ ID NO: 2142163 - DNA, 23 bp, Homo sapiens
gctggaatcaatttcccagaagg

SEQ ID NO: 2142164 - DNA, 19 bp, Homo sapiens
gctggaatctggagagcta

SEQ ID NO: 2142165 - DNA, 14 bp, Homo sapiens
gctggacaacccag

SEQ ID NO: 2142166 - DNA, 15 bp, Homo sapiens
gctggacaagaagct

SEQ ID NO: 2142167 - DNA, 17 bp, Homo sapiens
gctggacaagaagctgc

SEQ ID NO: 2142168 - DNA, 17 bp, Homo sapiens
gctggacagaggggcag

SEQ ID NO: 2142169 - DNA, 23 bp, Homo sapiens
gctggacctatgtcctaaggaca

SEQ ID NO: 2142170 - DNA, 22 bp, Homo sapiens
gctggacctgcacgccaccgct

SEQ ID NO: 2142171 - DNA, 16 bp, Homo sapiens
gctggaccttgaactg

SEQ ID NO: 2142172 - DNA, 22 bp, Homo sapiens
gctggaccttgaactgggtact

SEQ ID NO: 2142173 - DNA, 15 bp, Homo sapiens
gctggactctggcac

SEQ ID NO: 2142174 - DNA, 19 bp, Homo sapiens
gctggactctggcacccag

SEQ ID NO: 2142175 - DNA, 12 bp, Homo sapiens
gctggagaagct

SEQ ID NO: 2142176 - DNA, 16 bp, Homo sapiens
gctggagaagctcacc

SEQ ID NO: 2142177 - DNA, 12 bp, Homo sapiens
gctggaggcagg

SEQ ID NO: 2142178 - DNA, 16 bp, Homo sapiens
gctggaggcagggcct

SEQ ID NO: 2142179 - DNA, 20 bp, Homo sapiens
gctggagtgcagtggtgcga

SEQ ID NO: 2142180 - DNA, 20 bp, Homo sapiens
gctggatgagacttccaaac

SEQ ID NO: 2142181 - DNA, 15 bp, Homo sapiens
gctggcaagcaggga

SEQ ID NO: 2142182 - DNA, 12 bp, Homo sapiens
gctggcactccc

SEQ ID NO: 2142183 - DNA, 15 bp, Homo sapiens
gctggcagcactcag

SEQ ID NO: 2142184 - DNA, 13 bp, Homo sapiens
gctggcagccacc

SEQ ID NO: 2142185 - DNA, 20 bp, Homo sapiens
gctggccacagtgagctgat

SEQ ID NO: 2142186 - DNA, 13 bp, Homo sapiens
gctggccagcacc

SEQ ID NO: 2142187 - DNA, 17 bp, Homo sapiens
gctggccagcaccctct

SEQ ID NO: 2142188 - DNA, 18 bp, Homo sapiens
gctggccagcaccctctc

SEQ ID NO: 2142189 - DNA, 19 bp, Homo sapiens
gctggccagcaccctctcc

SEQ ID NO: 2142190 - DNA, 23 bp, Homo sapiens
gctggccagcaccctctcctggg

SEQ ID NO: 2142191 - DNA, 12 bp, Homo sapiens
gctggccagtct

SEQ ID NO: 2142192 - DNA, 23 bp, Homo sapiens
gctggcccagccaactgccccgg

SEQ ID NO: 2142193 - DNA, 13 bp, Homo sapiens
gctggcccagggt

SEQ ID NO: 2142194 - DNA, 17 bp, Homo sapiens
gctggcccagggtaggg

SEQ ID NO: 2142195 - DNA, 16 bp, Homo sapiens
gctggcctcaggctgc

SEQ ID NO: 2142196 - DNA, 18 bp, Homo sapiens
gctggcctcccaataaag

SEQ ID NO: 2142197 - DNA, 22 bp, Homo sapiens
gctggcctcccaataaagctgg

SEQ ID NO: 2142198 - DNA, 13 bp, Homo sapiens
gctggcctctaga

SEQ ID NO: 2142199 - DNA, 23 bp, Homo sapiens
gctggcctctagaacacccactg

SEQ ID NO: 2142200 - DNA, 13 bp, Homo sapiens
gctggcctgtggc

SEQ ID NO: 2142201 - DNA, 19 bp, Homo sapiens
gctggcctgtggcaggcct

SEQ ID NO: 2142202 - DNA, 20 bp, Homo sapiens
gctggcggctactcagcagc

SEQ ID NO: 2142203 - DNA, 21 bp, Homo sapiens
gctggcggctactcagcagcc

SEQ ID NO: 2142204 - DNA, 14 bp, Homo sapiens
gctggctcaggaag

SEQ ID NO: 2142205 - DNA, 20 bp, Homo sapiens
gctggctcaggaagaaaccc

SEQ ID NO: 2142206 - DNA, 13 bp, Homo sapiens
gctggctctccac

SEQ ID NO: 2142207 - DNA, 15 bp, Homo sapiens
gctggctgagggcag

SEQ ID NO: 2142208 - DNA, 13 bp, Homo sapiens
gctggctgagtgg

SEQ ID NO: 2142209 - DNA, 20 bp, Homo sapiens
gctggctgccttagaacctt

SEQ ID NO: 2142210 - DNA, 10 bp, Homo sapiens
gctggctgtc

SEQ ID NO: 2142211 - DNA, 15 bp, Homo sapiens
gctggctgttggctg

SEQ ID NO: 2142212 - DNA, 17 bp, Homo sapiens
gctggctgttggctggg

SEQ ID NO: 2142213 - DNA, 17 bp, Homo sapiens
gctgggaaacagggagc

SEQ ID NO: 2142214 - DNA, 18 bp, Homo sapiens
gctgggaaccccgcagcc

SEQ ID NO: 2142215 - DNA, 19 bp, Homo sapiens
gctgggactacaggtgtga

SEQ ID NO: 2142216 - DNA, 23 bp, Homo sapiens
gctgggaggaacctgaacctggg

SEQ ID NO: 2142217 - DNA, 16 bp, Homo sapiens
gctgggattacaggtg

SEQ ID NO: 2142218 - DNA, 23 bp, Homo sapiens
gctgggatttcttcgctgctcta

SEQ ID NO: 2142219 - DNA, 21 bp, Homo sapiens
gctgggcagctgattttgtca

SEQ ID NO: 2142220 - DNA, 15 bp, Homo sapiens
gctgggccccaccta

SEQ ID NO: 2142221 - DNA, 19 bp, Homo sapiens
gctgggccccatgctctgc

SEQ ID NO: 2142222 - DNA, 20 bp, Homo sapiens
gctgggccccatgctctgcc

SEQ ID NO: 2142223 - DNA, 21 bp, Homo sapiens
gctgggccccatgctctgccc

SEQ ID NO: 2142224 - DNA, 22 bp, Homo sapiens
gctgggccccatgctctgcccc

SEQ ID NO: 2142225 - DNA, 12 bp, Homo sapiens
gctgggcccctg

SEQ ID NO: 2142226 - DNA, 15 bp, Homo sapiens
gctgggcccctggga

SEQ ID NO: 2142227 - DNA, 17 bp, Homo sapiens
gctgggccggccagcct

SEQ ID NO: 2142228 - DNA, 12 bp, Homo sapiens
gctggggaacag

SEQ ID NO: 2142229 - DNA, 13 bp, Homo sapiens
gctggggaacaga

SEQ ID NO: 2142230 - DNA, 23 bp, Homo sapiens
gctggggaacagagcgggcctct

SEQ ID NO: 2142231 - DNA, 22 bp, Homo sapiens
gctggggcagaggggcagccgc

SEQ ID NO: 2142232 - DNA, 16 bp, Homo sapiens
gctgggggaagggtgg

SEQ ID NO: 2142233 - DNA, 19 bp, Homo sapiens
gctgggggcctcagtgcca

SEQ ID NO: 2142234 - DNA, 14 bp, Homo sapiens
gctgggggtggggg

SEQ ID NO: 2142235 - DNA, 15 bp, Homo sapiens
gctggggtacaggtt

SEQ ID NO: 2142236 - DNA, 21 bp, Homo sapiens
gctgggtaaactgtggatgat

SEQ ID NO: 2142237 - DNA, 14 bp, Homo sapiens
gctgggttggaggg

SEQ ID NO: 2142238 - DNA, 14 bp, Homo sapiens
gctggtaaactatt

SEQ ID NO: 2142239 - DNA, 18 bp, Homo sapiens
ggactgggttttgtctct

SEQ ID NO: 2142240 - DNA, 20 bp, Homo sapiens
ggactgtcgctgcttcgtgg

SEQ ID NO: 2142241 - DNA, 20 bp, Homo sapiens
ggacttaacggctccaggat

SEQ ID NO: 2142242 - DNA, 14 bp, Homo sapiens
ggacttcctggggc

SEQ ID NO: 2142243 - DNA, 15 bp, Homo sapiens
ggacttcctggggcc

SEQ ID NO: 2142244 - DNA, 14 bp, Homo sapiens
ggacttctgcagct

SEQ ID NO: 2142245 - DNA, 14 bp, Homo sapiens
ggacttggaagctc

SEQ ID NO: 2142246 - DNA, 16 bp, Homo sapiens
ggagaaaatgaagaaa

SEQ ID NO: 2142247 - DNA, 13 bp, Homo sapiens
ggagaaacagaga

SEQ ID NO: 2142248 - DNA, 15 bp, Homo sapiens
ggagaaacagagaca

SEQ ID NO: 2142249 - DNA, 16 bp, Homo sapiens
ggagaaataaattttg

SEQ ID NO: 2142250 - DNA, 13 bp, Homo sapiens
ggagaaataattg

SEQ ID NO: 2142251 - DNA, 18 bp, Homo sapiens
ggagaactagaacctgga

SEQ ID NO: 2142252 - DNA, 22 bp, Homo sapiens
ggagaactagaacctggagggc

SEQ ID NO: 2142253 - DNA, 15 bp, Homo sapiens
ggagaagagctgttc

SEQ ID NO: 2142254 - DNA, 20 bp, Homo sapiens
ggagaaggaaaaagaaagta

SEQ ID NO: 2142255 - DNA, 20 bp, Homo sapiens
ggagaaggatctagaatgtg

SEQ ID NO: 2142256 - DNA, 21 bp, Homo sapiens
ggagaagggatggaggtcaca

SEQ ID NO: 2142257 - DNA, 13 bp, Homo sapiens
ggagaagggccag

SEQ ID NO: 2142258 - DNA, 17 bp, Homo sapiens
ggagaagggccagccct

SEQ ID NO: 2142259 - DNA, 22 bp, Homo sapiens
ggagaagggccagccctacatc

SEQ ID NO: 2142260 - DNA, 15 bp, Homo sapiens
ggagacagagacaga

SEQ ID NO: 2142261 - DNA, 13 bp, Homo sapiens
ggagacagggcaa

SEQ ID NO: 2142262 - DNA, 13 bp, Homo sapiens
ggagacagtgatc

SEQ ID NO: 2142263 - DNA, 15 bp, Homo sapiens
ggagaccagctcaga

SEQ ID NO: 2142264 - DNA, 12 bp, Homo sapiens
ggagaccctgga

SEQ ID NO: 2142265 - DNA, 23 bp, Homo sapiens
ggagaccgcttcacccctgcact

SEQ ID NO: 2142266 - DNA, 16 bp, Homo sapiens
ggagactaagccctgt

SEQ ID NO: 2142267 - DNA, 17 bp, Homo sapiens
ggagactatgtgtcatg

SEQ ID NO: 2142268 - DNA, 9 bp, Homo sapiens
ggagactca

SEQ ID NO: 2142269 - DNA, 17 bp, Homo sapiens
ggagactcacctctgcc

SEQ ID NO: 2142270 - DNA, 12 bp, Homo sapiens
ggagactcctgc

SEQ ID NO: 2142271 - DNA, 17 bp, Homo sapiens
ggagactcctgccctgt

SEQ ID NO: 2142272 - DNA, 21 bp, Homo sapiens
ggagactgggtgaaagtgact

SEQ ID NO: 2142273 - DNA, 16 bp, Homo sapiens
ggagactgtctcaaga

SEQ ID NO: 2142274 - DNA, 14 bp, Homo sapiens
ggagagaagaaagt

SEQ ID NO: 2142275 - DNA, 15 bp, Homo sapiens
ggagagacactccca

SEQ ID NO: 2142276 - DNA, 20 bp, Homo sapiens
ggagagactgaaagcagcag

SEQ ID NO: 2142277 - DNA, 19 bp, Homo sapiens
ggagagagacgtgtacata

SEQ ID NO: 2142278 - DNA, 21 bp, Homo sapiens
ggagagaggggaataatagaa

SEQ ID NO: 2142279 - DNA, 20 bp, Homo sapiens
ggagagcaccttaatattat

SEQ ID NO: 2142280 - DNA, 10 bp, Homo sapiens
ggagagcagc

SEQ ID NO: 2142281 - DNA, 12 bp, Homo sapiens
ggagagcagctg

SEQ ID NO: 2142282 - DNA, 13 bp, Homo sapiens
ggagagcagctgg

SEQ ID NO: 2142283 - DNA, 15 bp, Homo sapiens
ggagagcagctggct

SEQ ID NO: 2142284 - DNA, 19 bp, Homo sapiens
ggagagccagaacctggag

SEQ ID NO: 2142285 - DNA, 20 bp, Homo sapiens
ggagagccagaacctggagg

SEQ ID NO: 2142286 - DNA, 15 bp, Homo sapiens
ggagagccagccctc

SEQ ID NO: 2142287 - DNA, 18 bp, Homo sapiens
ggagagccagccctccct

SEQ ID NO: 2142288 - DNA, 21 bp, Homo sapiens
ggagagccagccctccctgtc

SEQ ID NO: 2142289 - DNA, 23 bp, Homo sapiens
ggagagccagccctccctgtcct

SEQ ID NO: 2142290 - DNA, 14 bp, Homo sapiens
ggagagccagctct

SEQ ID NO: 2142291 - DNA, 17 bp, Homo sapiens
ggagagccagctctctc

SEQ ID NO: 2142292 - DNA, 19 bp, Homo sapiens
ggagagccagctctctcta

SEQ ID NO: 2142293 - DNA, 12 bp, Homo sapiens
ggagagcccagc

SEQ ID NO: 2142294 - DNA, 13 bp, Homo sapiens
ggagagccctggg

SEQ ID NO: 2142295 - DNA, 15 bp, Homo sapiens
ggagagcggctgccc

SEQ ID NO: 2142296 - DNA, 16 bp, Homo sapiens
ggagagctagaacctg

SEQ ID NO: 2142297 - DNA, 22 bp, Homo sapiens
ggagagctagaacctggagagc

SEQ ID NO: 2142298 - DNA, 20 bp, Homo sapiens
ggagagctagaacctggagg

SEQ ID NO: 2142299 - DNA, 20 bp, Homo sapiens
ggagaggagtgactgagctt

SEQ ID NO: 2142300 - DNA, 16 bp, Homo sapiens
ggagaggcgccctccc

SEQ ID NO: 2142301 - DNA, 16 bp, Homo sapiens
ggagaggcggcctcgt

SEQ ID NO: 2142302 - DNA, 12 bp, Homo sapiens
ggagaggctgtg

SEQ ID NO: 2142303 - DNA, 18 bp, Homo sapiens
ggagaggggaagggccag

SEQ ID NO: 2142304 - DNA, 14 bp, Homo sapiens
ggagaggggcagaa

SEQ ID NO: 2142305 - DNA, 12 bp, Homo sapiens
ggagaggggcct

SEQ ID NO: 2142306 - DNA, 13 bp, Homo sapiens
ggagaggggcctg

SEQ ID NO: 2142307 - DNA, 14 bp, Homo sapiens
ggagaggggcctgg

SEQ ID NO: 2142308 - DNA, 22 bp, Homo sapiens
ggagaggggcctgggaaaggaa

SEQ ID NO: 2142309 - DNA, 18 bp, Homo sapiens
ggagagggtctggagaag

SEQ ID NO: 2142310 - DNA, 18 bp, Homo sapiens
ggagagtggttgttgcca

SEQ ID NO: 2142311 - DNA, 14 bp, Homo sapiens
ggagatgatgatga

SEQ ID NO: 2142312 - DNA, 19 bp, Homo sapiens
ggagatggacccctccctt

SEQ ID NO: 2142313 - DNA, 18 bp, Homo sapiens
ggagatgggccttttgga

SEQ ID NO: 2142314 - DNA, 16 bp, Homo sapiens
ggagcaaatgtttctg

SEQ ID NO: 2142315 - DNA, 15 bp, Homo sapiens
ggagcacagaggggc

SEQ ID NO: 2142316 - DNA, 13 bp, Homo sapiens
ggagcacctgaac

SEQ ID NO: 2142317 - DNA, 15 bp, Homo sapiens
ggagcacctgaaccc

SEQ ID NO: 2142318 - DNA, 15 bp, Homo sapiens
ggagcactggagtgc

SEQ ID NO: 2142319 - DNA, 13 bp, Homo sapiens
ggagcagaatcag

SEQ ID NO: 2142320 - DNA, 23 bp, Homo sapiens
ggagcagaatcagtattgggagc

SEQ ID NO: 2142321 - DNA, 14 bp, Homo sapiens
ggagcagacagaga

SEQ ID NO: 2142322 - DNA, 16 bp, Homo sapiens
ggagcagacagagaaa

SEQ ID NO: 2142323 - DNA, 17 bp, Homo sapiens
ggagcagacagagaaat

SEQ ID NO: 2142324 - DNA, 23 bp, Homo sapiens
ggagcagagctgatggagaagga

SEQ ID NO: 2142325 - DNA, 13 bp, Homo sapiens
ggagcaggaacag

SEQ ID NO: 2142326 - DNA, 19 bp, Homo sapiens
ggagcaggaacagagactc

SEQ ID NO: 2142327 - DNA, 19 bp, Homo sapiens
ggagcaggtctctggcaga

SEQ ID NO: 2142328 - DNA, 20 bp, Homo sapiens
ggagcatctcttgaggccag

SEQ ID NO: 2142329 - DNA, 21 bp, Homo sapiens
ggagcatctcttgaggccagg

SEQ ID NO: 2142330 - DNA, 16 bp, Homo sapiens
ggagcatctgactcac

SEQ ID NO: 2142331 - DNA, 20 bp, Homo sapiens
ggagccaacagaagcttcca

SEQ ID NO: 2142332 - DNA, 11 bp, Homo sapiens
ggagccactcc

SEQ ID NO: 2142333 - DNA, 18 bp, Homo sapiens
ggagccactcctgtcccg

SEQ ID NO: 2142334 - DNA, 12 bp, Homo sapiens
ggagccagctct

SEQ ID NO: 2142335 - DNA, 15 bp, Homo sapiens
ggagcccagaaaacc

SEQ ID NO: 2142336 - DNA, 13 bp, Homo sapiens
ggagccccaggcc

SEQ ID NO: 2142337 - DNA, 23 bp, Homo sapiens
ggagccccaggcctctgtgtcct

SEQ ID NO: 2142338 - DNA, 16 bp, Homo sapiens
ggagcccctaggaaag

SEQ ID NO: 2142339 - DNA, 21 bp, Homo sapiens
ggagcccgagggcctgacagg

SEQ ID NO: 2142340 - DNA, 23 bp, Homo sapiens
ggagcctaccccctgaaagtgac

SEQ ID NO: 2142341 - DNA, 19 bp, Homo sapiens
ggagcctcatccgaggcag

SEQ ID NO: 2142342 - DNA, 16 bp, Homo sapiens
ggagcctccccctcag

SEQ ID NO: 2142343 - DNA, 17 bp, Homo sapiens
ggagcctccccctcaga

SEQ ID NO: 2142344 - DNA, 22 bp, Homo sapiens
ggagcctcgcaacccgtgccaa

SEQ ID NO: 2142345 - DNA, 19 bp, Homo sapiens
ggagcctcggtggccatgc

SEQ ID NO: 2142346 - DNA, 22 bp, Homo sapiens
ggagcctgcaaactcactgctc

SEQ ID NO: 2142347 - DNA, 19 bp, Homo sapiens
ggagcctggcacaggactg

SEQ ID NO: 2142348 - DNA, 21 bp, Homo sapiens
ggagcctgtgaacccaggaca

SEQ ID NO: 2142349 - DNA, 19 bp, Homo sapiens
ggagcgaagcagagaggtg

SEQ ID NO: 2142350 - DNA, 22 bp, Homo sapiens
ggagctgatttccaggcccctg

SEQ ID NO: 2142351 - DNA, 20 bp, Homo sapiens
ggagctgccgcaaggccctg

SEQ ID NO: 2142352 - DNA, 23 bp, Homo sapiens
ggagctgccgcaaggccctgtcc

SEQ ID NO: 2142353 - DNA, 22 bp, Homo sapiens
ggagctgcctgttcagctccag

SEQ ID NO: 2142354 - DNA, 17 bp, Homo sapiens
ggcaggggtgggagagc

SEQ ID NO: 2142355 - DNA, 17 bp, Homo sapiens
ggcagggtcaggagagg

SEQ ID NO: 2142356 - DNA, 19 bp, Homo sapiens
ggcagggtctcactctgtc

SEQ ID NO: 2142357 - DNA, 16 bp, Homo sapiens
ggcagggtgggatgga

SEQ ID NO: 2142358 - DNA, 21 bp, Homo sapiens
ggcagggtgggatggaggaga

SEQ ID NO: 2142359 - DNA, 20 bp, Homo sapiens
ggcaggtagatcgcttgagc

SEQ ID NO: 2142360 - DNA, 24 bp, Homo sapiens
ggcaggtagatcgcttgagcccag

SEQ ID NO: 2142361 - DNA, 15 bp, Homo sapiens
ggcaggtcctgccca

SEQ ID NO: 2142362 - DNA, 12 bp, Homo sapiens
ggcaggtgcaga

SEQ ID NO: 2142363 - DNA, 19 bp, Homo sapiens
ggcaggtgcagatgggctg

SEQ ID NO: 2142364 - DNA, 13 bp, Homo sapiens
ggcagtacctggg

SEQ ID NO: 2142365 - DNA, 23 bp, Homo sapiens
ggcagtagctgtggtgaggtggg

SEQ ID NO: 2142366 - DNA, 14 bp, Homo sapiens
ggcagtccagccag

SEQ ID NO: 2142367 - DNA, 18 bp, Homo sapiens
ggcagtccagccagctcc

SEQ ID NO: 2142368 - DNA, 19 bp, Homo sapiens
ggcagtccagccagctcct

SEQ ID NO: 2142369 - DNA, 22 bp, Homo sapiens
ggcagtcgtaagggttgcggcg

SEQ ID NO: 2142370 - DNA, 17 bp, Homo sapiens
ggcagtgacaagtggag

SEQ ID NO: 2142371 - DNA, 18 bp, Homo sapiens
ggcagtgacaagtggagg

SEQ ID NO: 2142372 - DNA, 16 bp, Homo sapiens
ggcagtgactggcagg

SEQ ID NO: 2142373 - DNA, 16 bp, Homo sapiens
ggcagtgccagggcag

SEQ ID NO: 2142374 - DNA, 13 bp, Homo sapiens
ggcagtgcctcct

SEQ ID NO: 2142375 - DNA, 16 bp, Homo sapiens
ggcagtgggagctgcc

SEQ ID NO: 2142376 - DNA, 22 bp, Homo sapiens
ggcagttcgcagccaccctgag

SEQ ID NO: 2142377 - DNA, 23 bp, Homo sapiens
ggcagttcgcagccaccctgagg

SEQ ID NO: 2142378 - DNA, 19 bp, Homo sapiens
ggcatagaaactgaggagt

SEQ ID NO: 2142379 - DNA, 11 bp, Homo sapiens
ggcatatttat

SEQ ID NO: 2142380 - DNA, 13 bp, Homo sapiens
ggcatcacagggc

SEQ ID NO: 2142381 - DNA, 17 bp, Homo sapiens
ggcatcacagggcagag

SEQ ID NO: 2142382 - DNA, 22 bp, Homo sapiens
ggcatcacagggcagagccggg

SEQ ID NO: 2142383 - DNA, 18 bp, Homo sapiens
ggcatcaggcactggtgg

SEQ ID NO: 2142384 - DNA, 19 bp, Homo sapiens
ggcatcaggcactggtggc

SEQ ID NO: 2142385 - DNA, 13 bp, Homo sapiens
ggcatccacccag

SEQ ID NO: 2142386 - DNA, 15 bp, Homo sapiens
ggcatcccatccctt

SEQ ID NO: 2142387 - DNA, 19 bp, Homo sapiens
ggcatccttctgccttttt

SEQ ID NO: 2142388 - DNA, 17 bp, Homo sapiens
ggcatctacacagcctg

SEQ ID NO: 2142389 - DNA, 19 bp, Homo sapiens
ggcatgagggatcacaggg

SEQ ID NO: 2142390 - DNA, 19 bp, Homo sapiens
ggcatgcgcacaaggctga

SEQ ID NO: 2142391 - DNA, 14 bp, Homo sapiens
ggcatgctcagccc

SEQ ID NO: 2142392 - DNA, 16 bp, Homo sapiens
ggcatgctggggcaag

SEQ ID NO: 2142393 - DNA, 13 bp, Homo sapiens
ggcatggccctgg

SEQ ID NO: 2142394 - DNA, 17 bp, Homo sapiens
ggcatggccctggggtc

SEQ ID NO: 2142395 - DNA, 22 bp, Homo sapiens
ggcatggtggcgcaagcctgta

SEQ ID NO: 2142396 - DNA, 19 bp, Homo sapiens
ggcatgtattatcacatca

SEQ ID NO: 2142397 - DNA, 12 bp, Homo sapiens
ggcatgtggaga

SEQ ID NO: 2142398 - DNA, 23 bp, Homo sapiens
ggcatgttctctgaggacactaa

SEQ ID NO: 2142399 - DNA, 14 bp, Homo sapiens
ggcattgggctgac

SEQ ID NO: 2142400 - DNA, 17 bp, Homo sapiens
ggcattgggctgacacc

SEQ ID NO: 2142401 - DNA, 18 bp, Homo sapiens
ggcattgggctgacacct

SEQ ID NO: 2142402 - DNA, 17 bp, Homo sapiens
ggcattttcctcgccta

SEQ ID NO: 2142403 - DNA, 17 bp, Homo sapiens
ggccaaaagggcagcca

SEQ ID NO: 2142404 - DNA, 15 bp, Homo sapiens
ggccaaagccaaagc

SEQ ID NO: 2142405 - DNA, 15 bp, Homo sapiens
ggccaagacttggca

SEQ ID NO: 2142406 - DNA, 15 bp, Homo sapiens
ggccaagagagacat

SEQ ID NO: 2142407 - DNA, 20 bp, Homo sapiens
ggccaagctgaggtgcccag

SEQ ID NO: 2142408 - DNA, 22 bp, Homo sapiens
ggccaagctgaggtgcccagga

SEQ ID NO: 2142409 - DNA, 22 bp, Homo sapiens
ggccaatgcacctaaagaaaaa

SEQ ID NO: 2142410 - DNA, 16 bp, Homo sapiens
ggccaattaaaatata

SEQ ID NO: 2142411 - DNA, 23 bp, Homo sapiens
ggccaattaaaatatatataaat

SEQ ID NO: 2142412 - DNA, 21 bp, Homo sapiens
ggccacactattaccatgaga

SEQ ID NO: 2142413 - DNA, 15 bp, Homo sapiens
ggccaccccgtgcca

SEQ ID NO: 2142414 - DNA, 18 bp, Homo sapiens
ggccaccgggacagacct

SEQ ID NO: 2142415 - DNA, 21 bp, Homo sapiens
ggccaccgggacagacctgga

SEQ ID NO: 2142416 - DNA, 17 bp, Homo sapiens
ggccactccttcctgcc

SEQ ID NO: 2142417 - DNA, 16 bp, Homo sapiens
ggccactctcccctcc

SEQ ID NO: 2142418 - DNA, 19 bp, Homo sapiens
ggccactctcccctccctc

SEQ ID NO: 2142419 - DNA, 22 bp, Homo sapiens
ggccactgggtctcactcctga

SEQ ID NO: 2142420 - DNA, 17 bp, Homo sapiens
ggccactgtggccagag

SEQ ID NO: 2142421 - DNA, 21 bp, Homo sapiens
ggccactttaagagagaaatc

SEQ ID NO: 2142422 - DNA, 13 bp, Homo sapiens
ggccagaaggagg

SEQ ID NO: 2142423 - DNA, 19 bp, Homo sapiens
ggccagaaggagggcagag

SEQ ID NO: 2142424 - DNA, 22 bp, Homo sapiens
ggccagaaggagggcagagcca

SEQ ID NO: 2142425 - DNA, 14 bp, Homo sapiens
ggccagacgctgcc

SEQ ID NO: 2142426 - DNA, 12 bp, Homo sapiens
ggccagagaggg

SEQ ID NO: 2142427 - DNA, 13 bp, Homo sapiens
ggccagagagggc

SEQ ID NO: 2142428 - DNA, 16 bp, Homo sapiens
ggccagagagggccca

SEQ ID NO: 2142429 - DNA, 15 bp, Homo sapiens
ggccagagctggaag

SEQ ID NO: 2142430 - DNA, 18 bp, Homo sapiens
ggccagagctggaaggca

SEQ ID NO: 2142431 - DNA, 16 bp, Homo sapiens
ggccagagctgggagg

SEQ ID NO: 2142432 - DNA, 17 bp, Homo sapiens
ggccagagctgggaggc

SEQ ID NO: 2142433 - DNA, 15 bp, Homo sapiens
ggccagatgcaccag

SEQ ID NO: 2142434 - DNA, 17 bp, Homo sapiens
ggccagatgcaccagcc

SEQ ID NO: 2142435 - DNA, 16 bp, Homo sapiens
ggccagcaccctctcc

SEQ ID NO: 2142436 - DNA, 21 bp, Homo sapiens
ggccagccccatcttggtcct

SEQ ID NO: 2142437 - DNA, 21 bp, Homo sapiens
ggccagccctacatcttcagc

SEQ ID NO: 2142438 - DNA, 19 bp, Homo sapiens
ggccagcctcagctcagcc

SEQ ID NO: 2142439 - DNA, 16 bp, Homo sapiens
ggccagcctggcctcc

SEQ ID NO: 2142440 - DNA, 21 bp, Homo sapiens
ggccagcctggcctcctgcct

SEQ ID NO: 2142441 - DNA, 20 bp, Homo sapiens
ggccagctcacaagcccagg

SEQ ID NO: 2142442 - DNA, 13 bp, Homo sapiens
ggccagctggtgc

SEQ ID NO: 2142443 - DNA, 20 bp, Homo sapiens
ggccagctggtgctgcaagg

SEQ ID NO: 2142444 - DNA, 16 bp, Homo sapiens
ggccaggaatctgcca

SEQ ID NO: 2142445 - DNA, 16 bp, Homo sapiens
ggccaggacaggcccg

SEQ ID NO: 2142446 - DNA, 19 bp, Homo sapiens
ggccaggagtttgagacca

SEQ ID NO: 2142447 - DNA, 16 bp, Homo sapiens
ggccaggattcctctc

SEQ ID NO: 2142448 - DNA, 19 bp, Homo sapiens
ggccaggcaggggtgggag

SEQ ID NO: 2142449 - DNA, 11 bp, Homo sapiens
ggccaggctgg

SEQ ID NO: 2142450 - DNA, 14 bp, Homo sapiens
ggccaggctggtct

SEQ ID NO: 2142451 - DNA, 16 bp, Homo sapiens
ggccaggctggtctca

SEQ ID NO: 2142452 - DNA, 17 bp, Homo sapiens
ggccagggccctgcaga

SEQ ID NO: 2142453 - DNA, 12 bp, Homo sapiens
ggccagggcctg

SEQ ID NO: 2142454 - DNA, 13 bp, Homo sapiens
ggccagggcctgg

SEQ ID NO: 2142455 - DNA, 17 bp, Homo sapiens
ggccaggggtctccctg

SEQ ID NO: 2142456 - DNA, 16 bp, Homo sapiens
ggccagtcctagagct

SEQ ID NO: 2142457 - DNA, 22 bp, Homo sapiens
ggccagtcctagagctcctgtc

SEQ ID NO: 2142458 - DNA, 24 bp, Homo sapiens
ggccagtcctagagctcctgtccc

SEQ ID NO: 2142459 - DNA, 15 bp, Homo sapiens
ggccagtctgggctg

SEQ ID NO: 2142460 - DNA, 15 bp, Homo sapiens
ggccagtgagggctg

SEQ ID NO: 2142461 - DNA, 18 bp, Homo sapiens
ggccagtgtaaggcatag

SEQ ID NO: 2142462 - DNA, 16 bp, Homo sapiens
ggccagtgtgacaagg

SEQ ID NO: 2142463 - DNA, 14 bp, Homo sapiens
ggccatccctgggc

SEQ ID NO: 2142464 - DNA, 21 bp, Homo sapiens
ggccatccctgggcccctcca

SEQ ID NO: 2142465 - DNA, 19 bp, Homo sapiens
ggccatgcaattcatccca

SEQ ID NO: 2142466 - DNA, 16 bp, Homo sapiens
ggccatgctgaaggga

SEQ ID NO: 2142467 - DNA, 17 bp, Homo sapiens
ggccatgctgaagggac

SEQ ID NO: 2142468 - DNA, 17 bp, Homo sapiens
ggccatgcttcttgccc

SEQ ID NO: 2142469 - DNA, 24 bp, Homo sapiens
ggccgctggcccagggtaggggag

SEQ ID NO: 2142470 - DNA, 19 bp, Homo sapiens
ggccgctgttcacccacag

SEQ ID NO: 2142471 - DNA, 13 bp, Homo sapiens
ggccggccagcct

SEQ ID NO: 2142472 - DNA, 13 bp, Homo sapiens
ggccgggctgccc

SEQ ID NO: 2142473 - DNA, 20 bp, Homo sapiens
ggccgggcttgggccctgca

SEQ ID NO: 2142474 - DNA, 15 bp, Homo sapiens
ggccggggcccctca

SEQ ID NO: 2142475 - DNA, 13 bp, Homo sapiens
ggccgtgcccagg

SEQ ID NO: 2142476 - DNA, 18 bp, Homo sapiens
ggccgttccccttggctt

SEQ ID NO: 2142477 - DNA, 23 bp, Homo sapiens
ggcctagatccacacacagagga

SEQ ID NO: 2142478 - DNA, 20 bp, Homo sapiens
ggcctatgcacatatggact

SEQ ID NO: 2142479 - DNA, 17 bp, Homo sapiens
ggcctatggagagccct

SEQ ID NO: 2142480 - DNA, 19 bp, Homo sapiens
ggcctatggagagccctgg

SEQ ID NO: 2142481 - DNA, 23 bp, Homo sapiens
ggcctcaaagcaagcattcagaa

SEQ ID NO: 2142482 - DNA, 22 bp, Homo sapiens
ggcctcaaagttggggcaggct

SEQ ID NO: 2142483 - DNA, 20 bp, Homo sapiens
ggcctcacacccagagggta

SEQ ID NO: 2142484 - DNA, 13 bp, Homo sapiens
ggcctcactggct

SEQ ID NO: 2142485 - DNA, 19 bp, Homo sapiens
ggcctcactggctggggca

SEQ ID NO: 2142486 - DNA, 16 bp, Homo sapiens
ggcctcacttccctgg

SEQ ID NO: 2142487 - DNA, 14 bp, Homo sapiens
ggcctcagtttccc

SEQ ID NO: 2142488 - DNA, 21 bp, Homo sapiens
ggcctcagtttctccatcagc

SEQ ID NO: 2142489 - DNA, 12 bp, Homo sapiens
ggcctccactcc

SEQ ID NO: 2142490 - DNA, 22 bp, Homo sapiens
ggcctccactcccccacctgac

SEQ ID NO: 2142491 - DNA, 18 bp, Homo sapiens
ggcctccagcctctcccg

SEQ ID NO: 2142492 - DNA, 21 bp, Homo sapiens
ggcctccagcctctcccggct

SEQ ID NO: 2142493 - DNA, 17 bp, Homo sapiens
ggcctcccaataaagct

SEQ ID NO: 2142494 - DNA, 20 bp, Homo sapiens
ggcctcccaataaagctgga

SEQ ID NO: 2142495 - DNA, 22 bp, Homo sapiens
ggcctccccccagcccctcctc

SEQ ID NO: 2142496 - DNA, 14 bp, Homo sapiens
ggcctcctgcctct

SEQ ID NO: 2142497 - DNA, 14 bp, Homo sapiens
ggcctcgcctgggc

SEQ ID NO: 2142498 - DNA, 16 bp, Homo sapiens
ggcctcgcctgggccc

SEQ ID NO: 2142499 - DNA, 21 bp, Homo sapiens
ggcctcgcctgggcccaggct

SEQ ID NO: 2142500 - DNA, 15 bp, Homo sapiens
ggcctcggagcctca

SEQ ID NO: 2142501 - DNA, 17 bp, Homo sapiens
ggcctcgtaccagccag

SEQ ID NO: 2142502 - DNA, 19 bp, Homo sapiens
ggcctcgtaccagccagga

SEQ ID NO: 2142503 - DNA, 14 bp, Homo sapiens
ggcctcgtgccatg

SEQ ID NO: 2142504 - DNA, 13 bp, Homo sapiens
ggcctctagaaca

SEQ ID NO: 2142505 - DNA, 18 bp, Homo sapiens
ggcctctagaacacccac

SEQ ID NO: 2142506 - DNA, 20 bp, Homo sapiens
ggcctctagaacacccactg

SEQ ID NO: 2142507 - DNA, 21 bp, Homo sapiens
ggcctctagaacacccactgg

SEQ ID NO: 2142508 - DNA, 19 bp, Homo sapiens
ggcctctcgagttctccta

SEQ ID NO: 2142509 - DNA, 14 bp, Homo sapiens
ggcctctgtgtcct

SEQ ID NO: 2142510 - DNA, 20 bp, Homo sapiens
ggcctctgtgtccttccctg

SEQ ID NO: 2142511 - DNA, 16 bp, Homo sapiens
ggcctcttccacccat

SEQ ID NO: 2142512 - DNA, 19 bp, Homo sapiens
ggcctcttccgtgacgtca

SEQ ID NO: 2142513 - DNA, 17 bp, Homo sapiens
ggcctcttggacctctg

SEQ ID NO: 2142514 - DNA, 19 bp, Homo sapiens
ggcctgacaggttcccagc

SEQ ID NO: 2142515 - DNA, 21 bp, Homo sapiens
ggcctgacaggttcccagcag

SEQ ID NO: 2142516 - DNA, 15 bp, Homo sapiens
ggcctgagctggggc

SEQ ID NO: 2142517 - DNA, 17 bp, Homo sapiens
ggcctgagctggggcca

SEQ ID NO: 2142518 - DNA, 19 bp, Homo sapiens
ggcctgatggggtggaagg

SEQ ID NO: 2142519 - DNA, 20 bp, Homo sapiens
ggcctgcactgggttgtcca

SEQ ID NO: 2142520 - DNA, 15 bp, Homo sapiens
ggcctgcctcccagc

SEQ ID NO: 2142521 - DNA, 23 bp, Homo sapiens
ggcctgcctcccagccctgccag

SEQ ID NO: 2142522 - DNA, 11 bp, Homo sapiens
ggcctgcctgt

SEQ ID NO: 2142523 - DNA, 12 bp, Homo sapiens
ggcctgcggccg

SEQ ID NO: 2142524 - DNA, 19 bp, Homo sapiens
ggcctgcggccgggctgcc

SEQ ID NO: 2142525 - DNA, 20 bp, Homo sapiens
ggcctgcggccgggctgccc

SEQ ID NO: 2142526 - DNA, 20 bp, Homo sapiens
ggcctgctaatagctgctag

SEQ ID NO: 2142527 - DNA, 18 bp, Homo sapiens
ggcctgctcccagcagcc

SEQ ID NO: 2142528 - DNA, 10 bp, Homo sapiens
ggcctgctgc

SEQ ID NO: 2142529 - DNA, 11 bp, Homo sapiens
ggcctgctgct

SEQ ID NO: 2142530 - DNA, 16 bp, Homo sapiens
ggcctgctgctgagaa

SEQ ID NO: 2142531 - DNA, 17 bp, Homo sapiens
ggcctgctgggctctcc

SEQ ID NO: 2142532 - DNA, 21 bp, Homo sapiens
ggcctgcttttccaggatcct

SEQ ID NO: 2142533 - DNA, 24 bp, Homo sapiens
ggcctgcttttccaggatcctgca

SEQ ID NO: 2142534 - DNA, 21 bp, Homo sapiens
ggcctggaccgcttcccagag

SEQ ID NO: 2142535 - DNA, 15 bp, Homo sapiens
ggcctggagaggggc

SEQ ID NO: 2142536 - DNA, 16 bp, Homo sapiens
ggcctggccagatgca

SEQ ID NO: 2142537 - DNA, 21 bp, Homo sapiens
ggcctggccggcaaccccagt

SEQ ID NO: 2142538 - DNA, 11 bp, Homo sapiens
ggcctggcctg

SEQ ID NO: 2142539 - DNA, 15 bp, Homo sapiens
ggcctggcctgagct

SEQ ID NO: 2142540 - DNA, 16 bp, Homo sapiens
ggcctggcctgagctg

SEQ ID NO: 2142541 - DNA, 14 bp, Homo sapiens
ggcctggccttgtc

SEQ ID NO: 2142542 - DNA, 20 bp, Homo sapiens
ggcctggccttgtcaggacc

SEQ ID NO: 2142543 - DNA, 14 bp, Homo sapiens
ggcctggctcccca

SEQ ID NO: 2142544 - DNA, 11 bp, Homo sapiens
ggcctggctgg

SEQ ID NO: 2142545 - DNA, 12 bp, Homo sapiens
ggcctggctggc

SEQ ID NO: 2142546 - DNA, 17 bp, Homo sapiens
ggcctggctggctgagg

SEQ ID NO: 2142547 - DNA, 19 bp, Homo sapiens
ggcctggctggctgagggc

SEQ ID NO: 2142548 - DNA, 16 bp, Homo sapiens
ggcctggcttgctcca

SEQ ID NO: 2142549 - DNA, 18 bp, Homo sapiens
ggcctggcttgctccagg

SEQ ID NO: 2142550 - DNA, 20 bp, Homo sapiens
ggcctggcttgctccagggt

SEQ ID NO: 2142551 - DNA, 15 bp, Homo sapiens
ggcctgggaaaggaa

SEQ ID NO: 2142552 - DNA, 23 bp, Homo sapiens
ggcctgggaaaggaaaaccaggg

SEQ ID NO: 2142553 - DNA, 16 bp, Homo sapiens
ggcctgggacccagct

SEQ ID NO: 2142554 - DNA, 13 bp, Homo sapiens
ggcctgggcctgc

SEQ ID NO: 2142555 - DNA, 14 bp, Homo sapiens
ggcctgggcctgct

SEQ ID NO: 2142556 - DNA, 16 bp, Homo sapiens
ggcctggggctccttt

SEQ ID NO: 2142557 - DNA, 15 bp, Homo sapiens
ggcctggggtgaccc

SEQ ID NO: 2142558 - DNA, 19 bp, Homo sapiens
ggcctggtgtgaggctggg

SEQ ID NO: 2142559 - DNA, 17 bp, Homo sapiens
ggcctgtactgcctgct

SEQ ID NO: 2142560 - DNA, 18 bp, Homo sapiens
ggcctgtactgcctgctt

SEQ ID NO: 2142561 - DNA, 17 bp, Homo sapiens
ggcctgtcccccaaggt

SEQ ID NO: 2142562 - DNA, 13 bp, Homo sapiens
ggcctgtggcagg

SEQ ID NO: 2142563 - DNA, 15 bp, Homo sapiens
ggcctgtgtccagca

SEQ ID NO: 2142564 - DNA, 19 bp, Homo sapiens
ggcctgtgtccagcagctg

SEQ ID NO: 2142565 - DNA, 20 bp, Homo sapiens
ggcctgtgtccagcagctgc

SEQ ID NO: 2142566 - DNA, 22 bp, Homo sapiens
ggcctgtgtccagcagctgcgg

SEQ ID NO: 2142567 - DNA, 22 bp, Homo sapiens
ggcctgtgtgtgaaaggaagct

SEQ ID NO: 2142568 - DNA, 19 bp, Homo sapiens
ggccttacttaaacccagc

SEQ ID NO: 2142569 - DNA, 19 bp, Homo sapiens
ggccttccccttttgcctg

SEQ ID NO: 2142570 - DNA, 22 bp, Homo sapiens
ggccttccccttttgcctggct

SEQ ID NO: 2142571 - DNA, 23 bp, Homo sapiens
ggccttccccttttgcctggctg

SEQ ID NO: 2142572 - DNA, 15 bp, Homo sapiens
ggccttctctgaagg

SEQ ID NO: 2142573 - DNA, 16 bp, Homo sapiens
ggccttctctgaagga

SEQ ID NO: 2142574 - DNA, 13 bp, Homo sapiens
ggccttgcccaga

SEQ ID NO: 2142575 - DNA, 15 bp, Homo sapiens
ggccttgcccagaga

SEQ ID NO: 2142576 - DNA, 16 bp, Homo sapiens
ggccttgcccagagat

SEQ ID NO: 2142577 - DNA, 19 bp, Homo sapiens
ggccttgtcaggacccagg

SEQ ID NO: 2142578 - DNA, 18 bp, Homo sapiens
ggccttgttctgtcacca

SEQ ID NO: 2142579 - DNA, 22 bp, Homo sapiens
ggcctttcctgtgccaacctga

SEQ ID NO: 2142580 - DNA, 12 bp, Homo sapiens
ggcgaataaatg

SEQ ID NO: 2142581 - DNA, 18 bp, Homo sapiens
ggcgaataaatgttcaaa

SEQ ID NO: 2142582 - DNA, 20 bp, Homo sapiens
ggcgacagagcgagactccg

SEQ ID NO: 2142583 - DNA, 13 bp, Homo sapiens
ggcgacccctcag

SEQ ID NO: 2142584 - DNA, 22 bp, Homo sapiens
gggatagatgaatactaaatgg

SEQ ID NO: 2142585 - DNA, 19 bp, Homo sapiens
gggatgactaaaatattta

SEQ ID NO: 2142586 - DNA, 20 bp, Homo sapiens
gggatgactaaaatatttat

SEQ ID NO: 2142587 - DNA, 17 bp, Homo sapiens
gggatgactagaggcag

SEQ ID NO: 2142588 - DNA, 23 bp, Homo sapiens
gggatgactagaggcagggaggg

SEQ ID NO: 2142589 - DNA, 14 bp, Homo sapiens
gggatgagagtggc

SEQ ID NO: 2142590 - DNA, 18 bp, Homo sapiens
gggatggaccctcgcagc

SEQ ID NO: 2142591 - DNA, 14 bp, Homo sapiens
gggatgggccaggg

SEQ ID NO: 2142592 - DNA, 21 bp, Homo sapiens
gggattcaggaaaaggcctgg

SEQ ID NO: 2142593 - DNA, 22 bp, Homo sapiens
gggattcaggaaaaggcctggg

SEQ ID NO: 2142594 - DNA, 22 bp, Homo sapiens
gggatttttttgttttctgatg

SEQ ID NO: 2142595 - DNA, 21 bp, Homo sapiens
gggcaaacccttctcttctcc

SEQ ID NO: 2142596 - DNA, 18 bp, Homo sapiens
gggcaacccccagcctgc

SEQ ID NO: 2142597 - DNA, 24 bp, Homo sapiens
gggcaagtccctgactctctgtga

SEQ ID NO: 2142598 - DNA, 19 bp, Homo sapiens
gggcaagtcgagagggctg

SEQ ID NO: 2142599 - DNA, 14 bp, Homo sapiens
gggcaatggggaga

SEQ ID NO: 2142600 - DNA, 19 bp, Homo sapiens
gggcaatggggagaggcaa

SEQ ID NO: 2142601 - DNA, 15 bp, Homo sapiens
gggcacaccactgcc

SEQ ID NO: 2142602 - DNA, 18 bp, Homo sapiens
gggcacaccactgccctg

SEQ ID NO: 2142603 - DNA, 19 bp, Homo sapiens
gggcacaccactgccctgc

SEQ ID NO: 2142604 - DNA, 21 bp, Homo sapiens
gggcacaccactgccctgcct

SEQ ID NO: 2142605 - DNA, 18 bp, Homo sapiens
gggcacaggagctacctg

SEQ ID NO: 2142606 - DNA, 21 bp, Homo sapiens
gggcacaggagctacctgtgt

SEQ ID NO: 2142607 - DNA, 11 bp, Homo sapiens
gggcacctgcc

SEQ ID NO: 2142608 - DNA, 12 bp, Homo sapiens
gggcacctgcca

SEQ ID NO: 2142609 - DNA, 19 bp, Homo sapiens
gggcacctgccaccgccag

SEQ ID NO: 2142610 - DNA, 19 bp, Homo sapiens
gggcactcagaagacactg

SEQ ID NO: 2142611 - DNA, 13 bp, Homo sapiens
gggcactggtggc

SEQ ID NO: 2142612 - DNA, 16 bp, Homo sapiens
gggcactggtggcccg

SEQ ID NO: 2142613 - DNA, 14 bp, Homo sapiens
gggcagagccatgg

SEQ ID NO: 2142614 - DNA, 17 bp, Homo sapiens
gggcagagccatgggcc

SEQ ID NO: 2142615 - DNA, 20 bp, Homo sapiens
gggcagagccatgggcctgg

SEQ ID NO: 2142616 - DNA, 13 bp, Homo sapiens
gggcagagccggg

SEQ ID NO: 2142617 - DNA, 14 bp, Homo sapiens
gggcagaggctgga

SEQ ID NO: 2142618 - DNA, 15 bp, Homo sapiens
gggcagaggctggag

SEQ ID NO: 2142619 - DNA, 12 bp, Homo sapiens
gggcagagggaa

SEQ ID NO: 2142620 - DNA, 14 bp, Homo sapiens
gggcagagggaatg

SEQ ID NO: 2142621 - DNA, 22 bp, Homo sapiens
gggcagagggaatgttccctgc

SEQ ID NO: 2142622 - DNA, 20 bp, Homo sapiens
gggcagagggcagaggctgg

SEQ ID NO: 2142623 - DNA, 15 bp, Homo sapiens
gggcagaggggcagc

SEQ ID NO: 2142624 - DNA, 15 bp, Homo sapiens
gggcagagtgggctg

SEQ ID NO: 2142625 - DNA, 20 bp, Homo sapiens
gggcagagtgggctgcctgg

SEQ ID NO: 2142626 - DNA, 17 bp, Homo sapiens
gggcagcaccctccccc

SEQ ID NO: 2142627 - DNA, 12 bp, Homo sapiens
gggcagcagcca

SEQ ID NO: 2142628 - DNA, 14 bp, Homo sapiens
gggcagcagccagc

SEQ ID NO: 2142629 - DNA, 19 bp, Homo sapiens
gggcagcagccagccctgc

SEQ ID NO: 2142630 - DNA, 23 bp, Homo sapiens
gggcagcagccagccctgcctgg

SEQ ID NO: 2142631 - DNA, 18 bp, Homo sapiens
gggcagccgctaggagag

SEQ ID NO: 2142632 - DNA, 22 bp, Homo sapiens
gggcagccgctaggagagactg

SEQ ID NO: 2142633 - DNA, 14 bp, Homo sapiens
gggcagctcctctg

SEQ ID NO: 2142634 - DNA, 22 bp, Homo sapiens
gggcagctcctctgtctcgagc

SEQ ID NO: 2142635 - DNA, 12 bp, Homo sapiens
gggcaggaggcc

SEQ ID NO: 2142636 - DNA, 17 bp, Homo sapiens
gggcaggaggcctggcc

SEQ ID NO: 2142637 - DNA, 13 bp, Homo sapiens
gggcaggcctggg

SEQ ID NO: 2142638 - DNA, 21 bp, Homo sapiens
gggcaggcctgggacccagct

SEQ ID NO: 2142639 - DNA, 16 bp, Homo sapiens
gggcaggctacccctt

SEQ ID NO: 2142640 - DNA, 17 bp, Homo sapiens
gggcaggtcctgcccat

SEQ ID NO: 2142641 - DNA, 22 bp, Homo sapiens
gggcagtacctgggaaaggacc

SEQ ID NO: 2142642 - DNA, 12 bp, Homo sapiens
gggcagtgacaa

SEQ ID NO: 2142643 - DNA, 21 bp, Homo sapiens
gggcagtgacaagtggagggg

SEQ ID NO: 2142644 - DNA, 14 bp, Homo sapiens
gggcagtgcctcct

SEQ ID NO: 2142645 - DNA, 17 bp, Homo sapiens
gggcagtgcctcctggg

SEQ ID NO: 2142646 - DNA, 22 bp, Homo sapiens
gggcagtggtaagctctggctt

SEQ ID NO: 2142647 - DNA, 16 bp, Homo sapiens
gggcagttcgcagcca

SEQ ID NO: 2142648 - DNA, 17 bp, Homo sapiens
gggcagttcgcagccac

SEQ ID NO: 2142649 - DNA, 20 bp, Homo sapiens
gggcagttcgcagccaccct

SEQ ID NO: 2142650 - DNA, 23 bp, Homo sapiens
gggcagttcgcagccaccctgag

SEQ ID NO: 2142651 - DNA, 16 bp, Homo sapiens
gggcatagaaactgag

SEQ ID NO: 2142652 - DNA, 22 bp, Homo sapiens
gggcatagaaactgaggagtag

SEQ ID NO: 2142653 - DNA, 14 bp, Homo sapiens
gggcatcaggcact

SEQ ID NO: 2142654 - DNA, 19 bp, Homo sapiens
gggcatccacccagtgctg

SEQ ID NO: 2142655 - DNA, 23 bp, Homo sapiens
gggcatccacccagtgctgccat

SEQ ID NO: 2142656 - DNA, 17 bp, Homo sapiens
gggcatccgcagcccag

SEQ ID NO: 2142657 - DNA, 22 bp, Homo sapiens
gggcatctcgtgccagggcagg

SEQ ID NO: 2142658 - DNA, 14 bp, Homo sapiens
gggcatgctggggc

SEQ ID NO: 2142659 - DNA, 17 bp, Homo sapiens
gggcatgctggggcaag

SEQ ID NO: 2142660 - DNA, 20 bp, Homo sapiens
gggcatggccaggtggccac

SEQ ID NO: 2142661 - DNA, 19 bp, Homo sapiens
gggcatggttccttccctg

SEQ ID NO: 2142662 - DNA, 22 bp, Homo sapiens
gggcatgtgtgcctgtggcaga

SEQ ID NO: 2142663 - DNA, 15 bp, Homo sapiens
gggcattaaaaatag

SEQ ID NO: 2142664 - DNA, 14 bp, Homo sapiens
gggcattgggctga

SEQ ID NO: 2142665 - DNA, 14 bp, Homo sapiens
gggccaaaagggca

SEQ ID NO: 2142666 - DNA, 18 bp, Homo sapiens
gggccaaaagggcagcca

SEQ ID NO: 2142667 - DNA, 16 bp, Homo sapiens
gggccactccttcctg

SEQ ID NO: 2142668 - DNA, 18 bp, Homo sapiens
gggccactctcccctccc

SEQ ID NO: 2142669 - DNA, 18 bp, Homo sapiens
gggccagaaggagggcag

SEQ ID NO: 2142670 - DNA, 20 bp, Homo sapiens
gggccagaaggagggcagag

SEQ ID NO: 2142671 - DNA, 16 bp, Homo sapiens
gggccagacacagata

SEQ ID NO: 2142672 - DNA, 17 bp, Homo sapiens
gggccagcctcagctca

SEQ ID NO: 2142673 - DNA, 11 bp, Homo sapiens
gggccagctgg

SEQ ID NO: 2142674 - DNA, 15 bp, Homo sapiens
gggccagctggtgct

SEQ ID NO: 2142675 - DNA, 22 bp, Homo sapiens
gggccagctggtgctgcaagga

SEQ ID NO: 2142676 - DNA, 17 bp, Homo sapiens
gggccaggacaggcccg

SEQ ID NO: 2142677 - DNA, 12 bp, Homo sapiens
gggccaggcagg

SEQ ID NO: 2142678 - DNA, 13 bp, Homo sapiens
gggccaggcaggt

SEQ ID NO: 2142679 - DNA, 23 bp, Homo sapiens
gggccaggcaggtgcctggacat

SEQ ID NO: 2142680 - DNA, 16 bp, Homo sapiens
gggccagggccctgca

SEQ ID NO: 2142681 - DNA, 18 bp, Homo sapiens
gggccagggccctgcaga

SEQ ID NO: 2142682 - DNA, 20 bp, Homo sapiens
gggccagtctgggctgccgg

SEQ ID NO: 2142683 - DNA, 17 bp, Homo sapiens
gggccagtgagggctgg

SEQ ID NO: 2142684 - DNA, 19 bp, Homo sapiens
gggccagtgtaaggcatag

SEQ ID NO: 2142685 - DNA, 20 bp, Homo sapiens
gggccagtgtaaggcatagg

SEQ ID NO: 2142686 - DNA, 15 bp, Homo sapiens
gggccatgctgaagg

SEQ ID NO: 2142687 - DNA, 18 bp, Homo sapiens
gggcccacaaaggggaga

SEQ ID NO: 2142688 - DNA, 12 bp, Homo sapiens
gggcccagctgt

SEQ ID NO: 2142689 - DNA, 13 bp, Homo sapiens
gggcccaggcagg

SEQ ID NO: 2142690 - DNA, 13 bp, Homo sapiens
gggcccaggctct

SEQ ID NO: 2142691 - DNA, 14 bp, Homo sapiens
gggcccaggctctg

SEQ ID NO: 2142692 - DNA, 22 bp, Homo sapiens
gggcccataatagttagccctc

SEQ ID NO: 2142693 - DNA, 17 bp, Homo sapiens
gggccccagatctgcct

SEQ ID NO: 2142694 - DNA, 24 bp, Homo sapiens
gggccccagatctgcctgggcctg

SEQ ID NO: 2142695 - DNA, 16 bp, Homo sapiens
gggccccatgctctgc

SEQ ID NO: 2142696 - DNA, 13 bp, Homo sapiens
gggcccccacagg

SEQ ID NO: 2142697 - DNA, 21 bp, Homo sapiens
gggcccccctccttgctctgc

SEQ ID NO: 2142698 - DNA, 20 bp, Homo sapiens
ggtatcaggcacaggcagga

SEQ ID NO: 2142699 - DNA, 12 bp, Homo sapiens
ggtatctccagg

SEQ ID NO: 2142700 - DNA, 13 bp, Homo sapiens
ggtatctccagga

SEQ ID NO: 2142701 - DNA, 23 bp, Homo sapiens
ggtatctccaggattgaagagca

SEQ ID NO: 2142702 - DNA, 15 bp, Homo sapiens
ggtatgagctgaggg

SEQ ID NO: 2142703 - DNA, 16 bp, Homo sapiens
ggtatgctggccagca

SEQ ID NO: 2142704 - DNA, 17 bp, Homo sapiens
ggtattaaagatgtgtt

SEQ ID NO: 2142705 - DNA, 14 bp, Homo sapiens
ggtattagaaagtg

SEQ ID NO: 2142706 - DNA, 15 bp, Homo sapiens
ggtattagcacctct

SEQ ID NO: 2142707 - DNA, 14 bp, Homo sapiens
ggtatttcctgcta

SEQ ID NO: 2142708 - DNA, 18 bp, Homo sapiens
ggtattttcgtgcatttg

SEQ ID NO: 2142709 - DNA, 20 bp, Homo sapiens
ggtattttcgtgcatttgtg

SEQ ID NO: 2142710 - DNA, 14 bp, Homo sapiens
ggtcaaaggaagac

SEQ ID NO: 2142711 - DNA, 19 bp, Homo sapiens
ggtcaacggccctgtttat

SEQ ID NO: 2142712 - DNA, 21 bp, Homo sapiens
ggtcaatactgccttaatgag

SEQ ID NO: 2142713 - DNA, 16 bp, Homo sapiens
ggtcacaggactctgc

SEQ ID NO: 2142714 - DNA, 14 bp, Homo sapiens
ggtcaccatgaaac

SEQ ID NO: 2142715 - DNA, 15 bp, Homo sapiens
ggtcaccatgaaact

SEQ ID NO: 2142716 - DNA, 13 bp, Homo sapiens
ggtcactgctaca

SEQ ID NO: 2142717 - DNA, 11 bp, Homo sapiens
ggtcagagcct

SEQ ID NO: 2142718 - DNA, 13 bp, Homo sapiens
ggtcagagcctgc

SEQ ID NO: 2142719 - DNA, 13 bp, Homo sapiens
ggtcagccagggc

SEQ ID NO: 2142720 - DNA, 15 bp, Homo sapiens
ggtcagccagggcca

SEQ ID NO: 2142721 - DNA, 18 bp, Homo sapiens
ggtcagccagggccaggg

SEQ ID NO: 2142722 - DNA, 21 bp, Homo sapiens
ggtcagcccattggctcccat

SEQ ID NO: 2142723 - DNA, 14 bp, Homo sapiens
ggtcagtgtggaga

SEQ ID NO: 2142724 - DNA, 16 bp, Homo sapiens
ggtcatgtgtgcatgt

SEQ ID NO: 2142725 - DNA, 14 bp, Homo sapiens
ggtccaagggccat

SEQ ID NO: 2142726 - DNA, 13 bp, Homo sapiens
ggtccacccagga

SEQ ID NO: 2142727 - DNA, 17 bp, Homo sapiens
ggtccacccaggagccc

SEQ ID NO: 2142728 - DNA, 19 bp, Homo sapiens
ggtccacccaggagccccg

SEQ ID NO: 2142729 - DNA, 20 bp, Homo sapiens
ggtccactcagggctgccac

SEQ ID NO: 2142730 - DNA, 23 bp, Homo sapiens
ggtccagctcttggcccctgtgt

SEQ ID NO: 2142731 - DNA, 18 bp, Homo sapiens
ggtccagcttgctcttca

SEQ ID NO: 2142732 - DNA, 15 bp, Homo sapiens
ggtccaggaaggcag

SEQ ID NO: 2142733 - DNA, 21 bp, Homo sapiens
ggtccaggaaggcagctgctc

SEQ ID NO: 2142734 - DNA, 22 bp, Homo sapiens
ggtccaggaaggcagctgctct

SEQ ID NO: 2142735 - DNA, 17 bp, Homo sapiens
ggtcccacatccctggg

SEQ ID NO: 2142736 - DNA, 19 bp, Homo sapiens
ggtcccacatccctgggcc

SEQ ID NO: 2142737 - DNA, 22 bp, Homo sapiens
ggtcccacatccctgggcctgc

SEQ ID NO: 2142738 - DNA, 17 bp, Homo sapiens
ggtccccagctccccag

SEQ ID NO: 2142739 - DNA, 18 bp, Homo sapiens
ggtccccagctccccagg

SEQ ID NO: 2142740 - DNA, 20 bp, Homo sapiens
ggtccctcctttggaccctg

SEQ ID NO: 2142741 - DNA, 17 bp, Homo sapiens
ggtccctcggagctgcc

SEQ ID NO: 2142742 - DNA, 12 bp, Homo sapiens
ggtccctgccag

SEQ ID NO: 2142743 - DNA, 15 bp, Homo sapiens
ggtccctgccagtgt

SEQ ID NO: 2142744 - DNA, 19 bp, Homo sapiens
ggtcccttgagacctcagc

SEQ ID NO: 2142745 - DNA, 20 bp, Homo sapiens
ggtcccttgagacctcagcc

SEQ ID NO: 2142746 - DNA, 21 bp, Homo sapiens
ggtcccttgagacctcagcca

SEQ ID NO: 2142747 - DNA, 18 bp, Homo sapiens
ggtccgcaccagctgctc

SEQ ID NO: 2142748 - DNA, 17 bp, Homo sapiens
ggtccggtgtccttttc

SEQ ID NO: 2142749 - DNA, 19 bp, Homo sapiens
ggtcctagcccagtgcttc

SEQ ID NO: 2142750 - DNA, 21 bp, Homo sapiens
ggtcctccatttcaactccag

SEQ ID NO: 2142751 - DNA, 22 bp, Homo sapiens
ggtcctccatttcaactccaga

SEQ ID NO: 2142752 - DNA, 23 bp, Homo sapiens
ggtcctgaaagtctgtgtccaat

SEQ ID NO: 2142753 - DNA, 16 bp, Homo sapiens
ggtcctgagcactgcc

SEQ ID NO: 2142754 - DNA, 18 bp, Homo sapiens
ggtcctgagcactgccag

SEQ ID NO: 2142755 - DNA, 20 bp, Homo sapiens
ggtcctgagcactgccagga

SEQ ID NO: 2142756 - DNA, 20 bp, Homo sapiens
ggtcctgagtcttggcctgc

SEQ ID NO: 2142757 - DNA, 13 bp, Homo sapiens
ggtcctgagtggc

SEQ ID NO: 2142758 - DNA, 23 bp, Homo sapiens
ggtcctgcaatctccagggctgc

SEQ ID NO: 2142759 - DNA, 13 bp, Homo sapiens
ggtcctggcttct

SEQ ID NO: 2142760 - DNA, 12 bp, Homo sapiens
ggtcctggggct

SEQ ID NO: 2142761 - DNA, 17 bp, Homo sapiens
ggtcctggtggggcagc

SEQ ID NO: 2142762 - DNA, 18 bp, Homo sapiens
ggtcctggtggggcagct

SEQ ID NO: 2142763 - DNA, 19 bp, Homo sapiens
ggtcctggtggggcagctc

SEQ ID NO: 2142764 - DNA, 17 bp, Homo sapiens
ggtcctgtcaccctggc

SEQ ID NO: 2142765 - DNA, 18 bp, Homo sapiens
ggtcctgtcaccctggcc

SEQ ID NO: 2142766 - DNA, 19 bp, Homo sapiens
ggtcctgtcaccctggccc

SEQ ID NO: 2142767 - DNA, 16 bp, Homo sapiens
ggtccttgcacccctc

SEQ ID NO: 2142768 - DNA, 16 bp, Homo sapiens
ggtcctttaggcagcc

SEQ ID NO: 2142769 - DNA, 19 bp, Homo sapiens
ggtcctttaggcagcctgc

SEQ ID NO: 2142770 - DNA, 17 bp, Homo sapiens
ggtcgccacacccggct

SEQ ID NO: 2142771 - DNA, 22 bp, Homo sapiens
ggtcgcttactttgagtgatcc

SEQ ID NO: 2142772 - DNA, 19 bp, Homo sapiens
ggtcgtggagagctaggag

SEQ ID NO: 2142773 - DNA, 22 bp, Homo sapiens
ggtctcactatgttgcccaggc

SEQ ID NO: 2142774 - DNA, 16 bp, Homo sapiens
ggtctccctccagctg

SEQ ID NO: 2142775 - DNA, 18 bp, Homo sapiens
ggtctccctccagctgga

SEQ ID NO: 2142776 - DNA, 22 bp, Homo sapiens
ggtctccctctcctgcctactc

SEQ ID NO: 2142777 - DNA, 18 bp, Homo sapiens
ggtctccttactctgagc

SEQ ID NO: 2142778 - DNA, 19 bp, Homo sapiens
ggtctccttactctgagcc

SEQ ID NO: 2142779 - DNA, 22 bp, Homo sapiens
ggtctccttactctgagcccag

SEQ ID NO: 2142780 - DNA, 23 bp, Homo sapiens
ggtctccttactctgagcccagg

SEQ ID NO: 2142781 - DNA, 15 bp, Homo sapiens
ggtctctccactgct

SEQ ID NO: 2142782 - DNA, 18 bp, Homo sapiens
ggtctctggcagagaagg

SEQ ID NO: 2142783 - DNA, 13 bp, Homo sapiens
ggtctgaaatgga

SEQ ID NO: 2142784 - DNA, 23 bp, Homo sapiens
ggtctgaaggaatagccagagag

SEQ ID NO: 2142785 - DNA, 13 bp, Homo sapiens
ggtctgagccctg

SEQ ID NO: 2142786 - DNA, 19 bp, Homo sapiens
ggtctgaggaatccagacc

SEQ ID NO: 2142787 - DNA, 11 bp, Homo sapiens
ggtctgccctg

SEQ ID NO: 2142788 - DNA, 18 bp, Homo sapiens
ggtctgcttttgctgggg

SEQ ID NO: 2142789 - DNA, 15 bp, Homo sapiens
ggtctggctgagctg

SEQ ID NO: 2142790 - DNA, 16 bp, Homo sapiens
ggtctgtatatacatt

SEQ ID NO: 2142791 - DNA, 22 bp, Homo sapiens
ggtctgtgccaaagaagaatcc

SEQ ID NO: 2142792 - DNA, 14 bp, Homo sapiens
ggtctgtgctgccc

SEQ ID NO: 2142793 - DNA, 16 bp, Homo sapiens
ggtctgtgctgtgcct

SEQ ID NO: 2142794 - DNA, 17 bp, Homo sapiens
ggtctgtgctgtgcctg

SEQ ID NO: 2142795 - DNA, 19 bp, Homo sapiens
ggtctgtgctgtgcctgct

SEQ ID NO: 2142796 - DNA, 21 bp, Homo sapiens
ggtctgttgtaaatgaccaag

SEQ ID NO: 2142797 - DNA, 21 bp, Homo sapiens
ggtcttgaactcctggcctca

SEQ ID NO: 2142798 - DNA, 22 bp, Homo sapiens
ggtcttggaagtgtgtggaagg

SEQ ID NO: 2142799 - DNA, 19 bp, Homo sapiens
ggtctttcctatcatggag

SEQ ID NO: 2142800 - DNA, 17 bp, Homo sapiens
ggtctttgcacatgtga

SEQ ID NO: 2142801 - DNA, 23 bp, Homo sapiens
ggtgaaatttattagttaatata

SEQ ID NO: 2142802 - DNA, 14 bp, Homo sapiens
ggtgacatcccagg

SEQ ID NO: 2142803 - DNA, 20 bp, Homo sapiens
ggtgacatcccaggaggggc

SEQ ID NO: 2142804 - DNA, 14 bp, Homo sapiens
ggtgaccccagggc

SEQ ID NO: 2142805 - DNA, 21 bp, Homo sapiens
ggtgaccccagggcacaggag

SEQ ID NO: 2142806 - DNA, 22 bp, Homo sapiens
ggtgaccccagggcacaggagc

SEQ ID NO: 2142807 - DNA, 22 bp, Homo sapiens
ggtgacccggcaccccctgcag

SEQ ID NO: 2142808 - DNA, 16 bp, Homo sapiens
ggtgacctctgcctga

SEQ ID NO: 2142809 - DNA, 22 bp, Homo sapiens
ggtgacggtcctttaggcagcc

SEQ ID NO: 2142810 - DNA, 23 bp, Homo sapiens
ggtgacggtcctttaggcagcct

SEQ ID NO: 2142811 - DNA, 20 bp, Homo sapiens
ggtgactgaatttgggcctc

SEQ ID NO: 2142812 - DNA, 14 bp, Homo sapiens
gtagagagccgggc

SEQ ID NO: 2142813 - DNA, 14 bp, Homo sapiens
gtagagatgtgtgt

SEQ ID NO: 2142814 - DNA, 21 bp, Homo sapiens
gtagagtggcccagaattgca

SEQ ID NO: 2142815 - DNA, 23 bp, Homo sapiens
gtagatagttaaaagactgcagc

SEQ ID NO: 2142816 - DNA, 17 bp, Homo sapiens
gtagatcagtggtctcc

SEQ ID NO: 2142817 - DNA, 18 bp, Homo sapiens
gtagatcgcttgagccca

SEQ ID NO: 2142818 - DNA, 20 bp, Homo sapiens
gtagatcgcttgagcccagg

SEQ ID NO: 2142819 - DNA, 15 bp, Homo sapiens
gtagatctgcttctt

SEQ ID NO: 2142820 - DNA, 15 bp, Homo sapiens
gtagatgccggcagg

SEQ ID NO: 2142821 - DNA, 16 bp, Homo sapiens
gtagattacctgccac

SEQ ID NO: 2142822 - DNA, 23 bp, Homo sapiens
gtagcacaagttatttaaatctg

SEQ ID NO: 2142823 - DNA, 16 bp, Homo sapiens
gtagcacatgtatgct

SEQ ID NO: 2142824 - DNA, 13 bp, Homo sapiens
gtagcatacattt

SEQ ID NO: 2142825 - DNA, 15 bp, Homo sapiens
gtagcattacagtgg

SEQ ID NO: 2142826 - DNA, 20 bp, Homo sapiens
gtagcatttcttatttgttt

SEQ ID NO: 2142827 - DNA, 19 bp, Homo sapiens
gtagccaagttatattgaa

SEQ ID NO: 2142828 - DNA, 21 bp, Homo sapiens
gtagccagccggggcgagtgg

SEQ ID NO: 2142829 - DNA, 15 bp, Homo sapiens
gtagccatggctcag

SEQ ID NO: 2142830 - DNA, 17 bp, Homo sapiens
gtagccatggctcaggc

SEQ ID NO: 2142831 - DNA, 23 bp, Homo sapiens
gtagccatggctcaggcaagccc

SEQ ID NO: 2142832 - DNA, 14 bp, Homo sapiens
gtagccctttctgt

SEQ ID NO: 2142833 - DNA, 19 bp, Homo sapiens
gtagccgagagcctgctcc

SEQ ID NO: 2142834 - DNA, 23 bp, Homo sapiens
gtagcctccgtttatgggccttg

SEQ ID NO: 2142835 - DNA, 23 bp, Homo sapiens
gtagccttgccttttaaaagaaa

SEQ ID NO: 2142836 - DNA, 13 bp, Homo sapiens
gtagctcccagca

SEQ ID NO: 2142837 - DNA, 14 bp, Homo sapiens
gtagctctgcctcc

SEQ ID NO: 2142838 - DNA, 18 bp, Homo sapiens
gtagctctgcctccctct

SEQ ID NO: 2142839 - DNA, 12 bp, Homo sapiens
gtagctgagagg

SEQ ID NO: 2142840 - DNA, 14 bp, Homo sapiens
gtagctgagaggaa

SEQ ID NO: 2142841 - DNA, 15 bp, Homo sapiens
gtagctgagaggaag

SEQ ID NO: 2142842 - DNA, 17 bp, Homo sapiens
gtagctgagaggaagat

SEQ ID NO: 2142843 - DNA, 12 bp, Homo sapiens
gtagctgagctc

SEQ ID NO: 2142844 - DNA, 13 bp, Homo sapiens
gtagctgagctca

SEQ ID NO: 2142845 - DNA, 12 bp, Homo sapiens
gtagctgggact

SEQ ID NO: 2142846 - DNA, 18 bp, Homo sapiens
gtagctgggactacaggc

SEQ ID NO: 2142847 - DNA, 19 bp, Homo sapiens
gtagctgggactacaggca

SEQ ID NO: 2142848 - DNA, 13 bp, Homo sapiens
gtagcttaaataa

SEQ ID NO: 2142849 - DNA, 17 bp, Homo sapiens
gtagcttacctgacaca

SEQ ID NO: 2142850 - DNA, 19 bp, Homo sapiens
gtagcttacctgacacaag

SEQ ID NO: 2142851 - DNA, 22 bp, Homo sapiens
gtagcttacctgacacaagagg

SEQ ID NO: 2142852 - DNA, 12 bp, Homo sapiens
gtagctttgctc

SEQ ID NO: 2142853 - DNA, 19 bp, Homo sapiens
gtaggaaaaataaaaacag

SEQ ID NO: 2142854 - DNA, 22 bp, Homo sapiens
gtaggaaagcaccgcagcatgt

SEQ ID NO: 2142855 - DNA, 20 bp, Homo sapiens
gtaggaaggctactggcatt

SEQ ID NO: 2142856 - DNA, 12 bp, Homo sapiens
gtaggaatcctt

SEQ ID NO: 2142857 - DNA, 14 bp, Homo sapiens
gtaggaggtttgga

SEQ ID NO: 2142858 - DNA, 14 bp, Homo sapiens
gtaggcagagcctt

SEQ ID NO: 2142859 - DNA, 13 bp, Homo sapiens
gtaggcagcctct

SEQ ID NO: 2142860 - DNA, 20 bp, Homo sapiens
gtaggcatgagggatcacag

SEQ ID NO: 2142861 - DNA, 23 bp, Homo sapiens
gtaggccaagctgaagtgaagga

SEQ ID NO: 2142862 - DNA, 22 bp, Homo sapiens
gtaggcccggtgtggtggctca

SEQ ID NO: 2142863 - DNA, 17 bp, Homo sapiens
gtaggcccttgtcctgc

SEQ ID NO: 2142864 - DNA, 16 bp, Homo sapiens
gtagggcgggaggatg

SEQ ID NO: 2142865 - DNA, 17 bp, Homo sapiens
gtaggggagtgtgggtg

SEQ ID NO: 2142866 - DNA, 19 bp, Homo sapiens
gtaggggagtgtgggtgat

SEQ ID NO: 2142867 - DNA, 23 bp, Homo sapiens
gtaggggagtgtgggtgatcaga

SEQ ID NO: 2142868 - DNA, 20 bp, Homo sapiens
gtaggtattaaagatgtgtt

SEQ ID NO: 2142869 - DNA, 15 bp, Homo sapiens
gtaggtccaagggcc

SEQ ID NO: 2142870 - DNA, 16 bp, Homo sapiens
gtaggtccaagggcca

SEQ ID NO: 2142871 - DNA, 21 bp, Homo sapiens
gtagtactcctgcaaaatttt

SEQ ID NO: 2142872 - DNA, 19 bp, Homo sapiens
gtagtagttgatgaccaat

SEQ ID NO: 2142873 - DNA, 20 bp, Homo sapiens
gtagtatggcctgtgtcact

SEQ ID NO: 2142874 - DNA, 17 bp, Homo sapiens
gtagtcgtcaagttgca

SEQ ID NO: 2142875 - DNA, 15 bp, Homo sapiens
gtagtggaagagcag

SEQ ID NO: 2142876 - DNA, 16 bp, Homo sapiens
gtagtggaagagcagc

SEQ ID NO: 2142877 - DNA, 19 bp, Homo sapiens
gtagtggaagagcagcctg

SEQ ID NO: 2142878 - DNA, 15 bp, Homo sapiens
gtagtgggtgaatgt

SEQ ID NO: 2142879 - DNA, 21 bp, Homo sapiens
gtagtgtcttcctagtatatt

SEQ ID NO: 2142880 - DNA, 13 bp, Homo sapiens
gtagttaggaaat

SEQ ID NO: 2142881 - DNA, 14 bp, Homo sapiens
gtagttaggaaata

SEQ ID NO: 2142882 - DNA, 16 bp, Homo sapiens
gtagttaggaaataaa

SEQ ID NO: 2142883 - DNA, 17 bp, Homo sapiens
gtagttccctgaaaacc

SEQ ID NO: 2142884 - DNA, 15 bp, Homo sapiens
gtagttcttgtgcat

SEQ ID NO: 2142885 - DNA, 20 bp, Homo sapiens
gtagttgatgaccaatctct

SEQ ID NO: 2142886 - DNA, 13 bp, Homo sapiens
gtagttttaacag

SEQ ID NO: 2142887 - DNA, 15 bp, Homo sapiens
gtagttttaacagaa

SEQ ID NO: 2142888 - DNA, 11 bp, Homo sapiens
gtagtttttca

SEQ ID NO: 2142889 - DNA, 19 bp, Homo sapiens
gtagtttttcagctagttt

SEQ ID NO: 2142890 - DNA, 11 bp, Homo sapiens
gtataaacatt

SEQ ID NO: 2142891 - DNA, 14 bp, Homo sapiens
gtataaacattaaa

SEQ ID NO: 2142892 - DNA, 18 bp, Homo sapiens
gtataaacattaaatgtc

SEQ ID NO: 2142893 - DNA, 13 bp, Homo sapiens
gtataaactatca

SEQ ID NO: 2142894 - DNA, 13 bp, Homo sapiens
gtataaagaaaag

SEQ ID NO: 2142895 - DNA, 14 bp, Homo sapiens
gtataaagaaaagt

SEQ ID NO: 2142896 - DNA, 14 bp, Homo sapiens
gtataaataataaa

SEQ ID NO: 2142897 - DNA, 19 bp, Homo sapiens
gtataaataataaagaact

SEQ ID NO: 2142898 - DNA, 15 bp, Homo sapiens
gtataaatatgaaat

SEQ ID NO: 2142899 - DNA, 17 bp, Homo sapiens
gtataaatggttgtctg

SEQ ID NO: 2142900 - DNA, 11 bp, Homo sapiens
gtataaatgta

SEQ ID NO: 2142901 - DNA, 16 bp, Homo sapiens
gtataaatgtatatac

SEQ ID NO: 2142902 - DNA, 18 bp, Homo sapiens
gtataaatgtatatacac

SEQ ID NO: 2142903 - DNA, 19 bp, Homo sapiens
gtataaatgtatatacaca

SEQ ID NO: 2142904 - DNA, 20 bp, Homo sapiens
gtataacttcttaaaagttg

SEQ ID NO: 2142905 - DNA, 15 bp, Homo sapiens
gtatacacacatata

SEQ ID NO: 2142906 - DNA, 21 bp, Homo sapiens
gtatacattttgttatagaat

SEQ ID NO: 2142907 - DNA, 12 bp, Homo sapiens
gtatacttcatt

SEQ ID NO: 2142908 - DNA, 17 bp, Homo sapiens
gtatacttcattagcaa

SEQ ID NO: 2142909 - DNA, 22 bp, Homo sapiens
gtatagacagcacttggctcct

SEQ ID NO: 2142910 - DNA, 16 bp, Homo sapiens
gtatagatgcaagata

SEQ ID NO: 2142911 - DNA, 22 bp, Homo sapiens
gtatagattataaaattatttt

SEQ ID NO: 2142912 - DNA, 16 bp, Homo sapiens
gtatagtgtaaaataa

SEQ ID NO: 2142913 - DNA, 19 bp, Homo sapiens
gtatataatactaaagtgt

SEQ ID NO: 2142914 - DNA, 12 bp, Homo sapiens
gtatatacacat

SEQ ID NO: 2142915 - DNA, 18 bp, Homo sapiens
gtatatacacatatacct

SEQ ID NO: 2142916 - DNA, 21 bp, Homo sapiens
gtatatacatattataaataa

SEQ ID NO: 2142917 - DNA, 16 bp, Homo sapiens
gtatatagtatattta

SEQ ID NO: 2142918 - DNA, 18 bp, Homo sapiens
gtatatagtatatttata

SEQ ID NO: 2142919 - DNA, 22 bp, Homo sapiens
gtatatagtatatttatactct

SEQ ID NO: 2142920 - DNA, 13 bp, Homo sapiens
gtatatatacata

SEQ ID NO: 2142921 - DNA, 17 bp, Homo sapiens
gtatatatacatacact

SEQ ID NO: 2142922 - DNA, 10 bp, Homo sapiens
gtatatatat

SEQ ID NO: 2142923 - DNA, 18 bp, Homo sapiens
gtatatatatatatatgt

SEQ ID NO: 2142924 - DNA, 14 bp, Homo sapiens
gtatatatatatgt

SEQ ID NO: 2142925 - DNA, 20 bp, Homo sapiens
gtatatatgtgtatatatac

SEQ ID NO: 2142926 - DNA, 13 bp, Homo sapiens
gtatatatgtgtg

SEQ ID NO: 2142927 - DNA, 14 bp, Homo sapiens
gtatatatgtgtgt

SEQ ID NO: 2142928 - DNA, 21 bp, Homo sapiens
gtcctccccctgccagtgcct

SEQ ID NO: 2142929 - DNA, 21 bp, Homo sapiens
gtcctcctcggatcaccgaga

SEQ ID NO: 2142930 - DNA, 12 bp, Homo sapiens
gtcctctcccct

SEQ ID NO: 2142931 - DNA, 11 bp, Homo sapiens
gtcctctggat

SEQ ID NO: 2142932 - DNA, 18 bp, Homo sapiens
gtcctctggatggcacca

SEQ ID NO: 2142933 - DNA, 21 bp, Homo sapiens
gtcctctggatggcaccagag

SEQ ID NO: 2142934 - DNA, 14 bp, Homo sapiens
gtcctcttattcct

SEQ ID NO: 2142935 - DNA, 23 bp, Homo sapiens
gtcctctttactcccttcctggc

SEQ ID NO: 2142936 - DNA, 13 bp, Homo sapiens
gtcctgagcactg

SEQ ID NO: 2142937 - DNA, 16 bp, Homo sapiens
gtcctgagcactgcca

SEQ ID NO: 2142938 - DNA, 19 bp, Homo sapiens
gtcctgagtcttggcctgc

SEQ ID NO: 2142939 - DNA, 18 bp, Homo sapiens
gtcctgcaatctccaggg

SEQ ID NO: 2142940 - DNA, 12 bp, Homo sapiens
gtcctgcagagg

SEQ ID NO: 2142941 - DNA, 14 bp, Homo sapiens
gtcctgcccatgtg

SEQ ID NO: 2142942 - DNA, 18 bp, Homo sapiens
gtcctgcctctctgctcc

SEQ ID NO: 2142943 - DNA, 20 bp, Homo sapiens
gtcctgcctctctgctccag

SEQ ID NO: 2142944 - DNA, 21 bp, Homo sapiens
gtcctgcctctctgctccaga

SEQ ID NO: 2142945 - DNA, 22 bp, Homo sapiens
gtcctgcctctctgctccagag

SEQ ID NO: 2142946 - DNA, 19 bp, Homo sapiens
gtcctggaatgaagcatgt

SEQ ID NO: 2142947 - DNA, 20 bp, Homo sapiens
gtcctggaatgaagcatgta

SEQ ID NO: 2142948 - DNA, 22 bp, Homo sapiens
gtcctggaatgaagcatgtagc

SEQ ID NO: 2142949 - DNA, 20 bp, Homo sapiens
gtcctgggagaacctcaggc

SEQ ID NO: 2142950 - DNA, 15 bp, Homo sapiens
gtcctgggagtgagc

SEQ ID NO: 2142951 - DNA, 17 bp, Homo sapiens
gtcctggggctctgtgc

SEQ ID NO: 2142952 - DNA, 21 bp, Homo sapiens
gtcctggtacagcagggtctt

SEQ ID NO: 2142953 - DNA, 18 bp, Homo sapiens
gtcctggtctgctcagga

SEQ ID NO: 2142954 - DNA, 13 bp, Homo sapiens
gtcctgtcccaga

SEQ ID NO: 2142955 - DNA, 15 bp, Homo sapiens
gtcctgtctctgcct

SEQ ID NO: 2142956 - DNA, 15 bp, Homo sapiens
gtcctgtgaatttct

SEQ ID NO: 2142957 - DNA, 22 bp, Homo sapiens
gtcctgttaacgtcatctcagg

SEQ ID NO: 2142958 - DNA, 15 bp, Homo sapiens
gtcctgttccctacc

SEQ ID NO: 2142959 - DNA, 16 bp, Homo sapiens
gtcctgttccctaccc

SEQ ID NO: 2142960 - DNA, 20 bp, Homo sapiens
gtccttaatgatccgttcca

SEQ ID NO: 2142961 - DNA, 13 bp, Homo sapiens
gtccttactcctg

SEQ ID NO: 2142962 - DNA, 17 bp, Homo sapiens
gtccttactcctgtggg

SEQ ID NO: 2142963 - DNA, 23 bp, Homo sapiens
gtccttactcctgtgggagcctc

SEQ ID NO: 2142964 - DNA, 13 bp, Homo sapiens
gtccttcagagct

SEQ ID NO: 2142965 - DNA, 16 bp, Homo sapiens
gtccttcctctcaagc

SEQ ID NO: 2142966 - DNA, 15 bp, Homo sapiens
gtccttctcattcat

SEQ ID NO: 2142967 - DNA, 18 bp, Homo sapiens
gtccttctcgtttgctct

SEQ ID NO: 2142968 - DNA, 16 bp, Homo sapiens
gtccttgcacctgcat

SEQ ID NO: 2142969 - DNA, 17 bp, Homo sapiens
gtcctttaggcagcctg

SEQ ID NO: 2142970 - DNA, 16 bp, Homo sapiens
gtcctttgagaaagaa

SEQ ID NO: 2142971 - DNA, 18 bp, Homo sapiens
gtcctttgagaaagaaat

SEQ ID NO: 2142972 - DNA, 21 bp, Homo sapiens
gtcctttgagaaagaaataat

SEQ ID NO: 2142973 - DNA, 18 bp, Homo sapiens
gtccttttcactacacca

SEQ ID NO: 2142974 - DNA, 17 bp, Homo sapiens
gtccttttgtaccatgg

SEQ ID NO: 2142975 - DNA, 17 bp, Homo sapiens
gtcgaattaatagcttt

SEQ ID NO: 2142976 - DNA, 14 bp, Homo sapiens
gtcgagagggctgt

SEQ ID NO: 2142977 - DNA, 16 bp, Homo sapiens
gtcgagccctgcagcc

SEQ ID NO: 2142978 - DNA, 14 bp, Homo sapiens
gtcgattagactgg

SEQ ID NO: 2142979 - DNA, 20 bp, Homo sapiens
gtcgcaggatccgctgccac

SEQ ID NO: 2142980 - DNA, 21 bp, Homo sapiens
gtcgcaggatccgctgccacc

SEQ ID NO: 2142981 - DNA, 13 bp, Homo sapiens
gtcgcccagtctg

SEQ ID NO: 2142982 - DNA, 14 bp, Homo sapiens
gtcgccccaggccc

SEQ ID NO: 2142983 - DNA, 16 bp, Homo sapiens
gtcgccccaggccctc

SEQ ID NO: 2142984 - DNA, 22 bp, Homo sapiens
gtcgccccaggccctccctgac

SEQ ID NO: 2142985 - DNA, 12 bp, Homo sapiens
gtcgcctctgca

SEQ ID NO: 2142986 - DNA, 14 bp, Homo sapiens
gtcgcctgccccca

SEQ ID NO: 2142987 - DNA, 23 bp, Homo sapiens
gtcgcgcgcagcgcgtgcacagc

SEQ ID NO: 2142988 - DNA, 20 bp, Homo sapiens
gtcgctctgctggcctggcc

SEQ ID NO: 2142989 - DNA, 16 bp, Homo sapiens
gtcgctggacaaccca

SEQ ID NO: 2142990 - DNA, 15 bp, Homo sapiens
gtcgctgggctgtgg

SEQ ID NO: 2142991 - DNA, 15 bp, Homo sapiens
gtcggagtagaaatt

SEQ ID NO: 2142992 - DNA, 15 bp, Homo sapiens
gtcggctaagtggga

SEQ ID NO: 2142993 - DNA, 13 bp, Homo sapiens
gtcgggggtggca

SEQ ID NO: 2142994 - DNA, 18 bp, Homo sapiens
gtcgtggagagctaggag

SEQ ID NO: 2142995 - DNA, 13 bp, Homo sapiens
gtcgttgtgaggg

SEQ ID NO: 2142996 - DNA, 12 bp, Homo sapiens
gtctaaaaacac

SEQ ID NO: 2142997 - DNA, 16 bp, Homo sapiens
gtctaaagtttacagt

SEQ ID NO: 2142998 - DNA, 14 bp, Homo sapiens
gtctaccctgggat

SEQ ID NO: 2142999 - DNA, 22 bp, Homo sapiens
gtctaccctgggattcaggaaa

SEQ ID NO: 2143000 - DNA, 17 bp, Homo sapiens
gtctacctgagcattca

SEQ ID NO: 2143001 - DNA, 21 bp, Homo sapiens
gtctaggagctgggaggaaaa

SEQ ID NO: 2143002 - DNA, 15 bp, Homo sapiens
gtctaggagctgtct

SEQ ID NO: 2143003 - DNA, 17 bp, Homo sapiens
gtctatatgaaaaacaa

SEQ ID NO: 2143004 - DNA, 21 bp, Homo sapiens
gtctatcaaccccagacactg

SEQ ID NO: 2143005 - DNA, 21 bp, Homo sapiens
gtctatgacttatttccttca

SEQ ID NO: 2143006 - DNA, 19 bp, Homo sapiens
gtctattagttttctttgt

SEQ ID NO: 2143007 - DNA, 15 bp, Homo sapiens
gtctattctgagcct

SEQ ID NO: 2143008 - DNA, 16 bp, Homo sapiens
gtctattctgagcctt

SEQ ID NO: 2143009 - DNA, 18 bp, Homo sapiens
gtctattctgagccttga

SEQ ID NO: 2143010 - DNA, 15 bp, Homo sapiens
gtctcacatttttac

SEQ ID NO: 2143011 - DNA, 14 bp, Homo sapiens
gtctcactcctgag

SEQ ID NO: 2143012 - DNA, 16 bp, Homo sapiens
gtctcactctgtcgcc

SEQ ID NO: 2143013 - DNA, 18 bp, Homo sapiens
gtctcactctgtcgccca

SEQ ID NO: 2143014 - DNA, 18 bp, Homo sapiens
gtctcactgttgcccagg

SEQ ID NO: 2143015 - DNA, 19 bp, Homo sapiens
gtctcactgttgcccaggc

SEQ ID NO: 2143016 - DNA, 20 bp, Homo sapiens
gtctcactgttgcccaggct

SEQ ID NO: 2143017 - DNA, 16 bp, Homo sapiens
gtctcacttataccaa

SEQ ID NO: 2143018 - DNA, 22 bp, Homo sapiens
gtctcagcccgggacagggtct

SEQ ID NO: 2143019 - DNA, 12 bp, Homo sapiens
gtctcagcttca

SEQ ID NO: 2143020 - DNA, 23 bp, Homo sapiens
gtctcagcttcatttccgtgaag

SEQ ID NO: 2143021 - DNA, 13 bp, Homo sapiens
gtctcaggccctg

SEQ ID NO: 2143022 - DNA, 16 bp, Homo sapiens
gtctcagtccagatgc

SEQ ID NO: 2143023 - DNA, 14 bp, Homo sapiens
gtctccaagaatac

SEQ ID NO: 2143024 - DNA, 21 bp, Homo sapiens
gtctccactaaatgagctcct

SEQ ID NO: 2143025 - DNA, 16 bp, Homo sapiens
gtctccataatgccac

SEQ ID NO: 2143026 - DNA, 18 bp, Homo sapiens
gtctccataatgccactg

SEQ ID NO: 2143027 - DNA, 17 bp, Homo sapiens
gtctcccacgtgggaga

SEQ ID NO: 2143028 - DNA, 12 bp, Homo sapiens
gtctcccattct

SEQ ID NO: 2143029 - DNA, 19 bp, Homo sapiens
gtctccctaaaataaaaac

SEQ ID NO: 2143030 - DNA, 17 bp, Homo sapiens
gtctccctccagctgga

SEQ ID NO: 2143031 - DNA, 18 bp, Homo sapiens
gtctcctacctgctgctg

SEQ ID NO: 2143032 - DNA, 14 bp, Homo sapiens
gtctcctctctgag

SEQ ID NO: 2143033 - DNA, 16 bp, Homo sapiens
gtctcctctctgagac

SEQ ID NO: 2143034 - DNA, 22 bp, Homo sapiens
gtctcctcttaaaaaataaaaa

SEQ ID NO: 2143035 - DNA, 18 bp, Homo sapiens
gtctccttactctgagcc

SEQ ID NO: 2143036 - DNA, 22 bp, Homo sapiens
gtctcctttgcactgagggcca

SEQ ID NO: 2143037 - DNA, 23 bp, Homo sapiens
gtctcctttgcactgagggccac

SEQ ID NO: 2143038 - DNA, 17 bp, Homo sapiens
gtctcgagcgccctgca

SEQ ID NO: 2143039 - DNA, 22 bp, Homo sapiens
gtctcgggtccgattaatttat

SEQ ID NO: 2143040 - DNA, 11 bp, Homo sapiens
gtctctacatg

SEQ ID NO: 2143041 - DNA, 14 bp, Homo sapiens
gtctctagccgggc

SEQ ID NO: 2143042 - DNA, 23 bp, Homo sapiens
gtctctatgccagctcagtccca

SEQ ID NO: 2143043 - DNA, 22 bp, Homo sapiens
gtgccttccataattatgacag

SEQ ID NO: 2143044 - DNA, 19 bp, Homo sapiens
gtgcctttctctggctcca

SEQ ID NO: 2143045 - DNA, 14 bp, Homo sapiens
gtgccttttatagc

SEQ ID NO: 2143046 - DNA, 17 bp, Homo sapiens
gtgcgacttcacaaaat

SEQ ID NO: 2143047 - DNA, 22 bp, Homo sapiens
gtgcgacttcacaaaatgcaag

SEQ ID NO: 2143048 - DNA, 21 bp, Homo sapiens
gtgcgatctgggttcactgca

SEQ ID NO: 2143049 - DNA, 14 bp, Homo sapiens
gtgcgcacacacag

SEQ ID NO: 2143050 - DNA, 14 bp, Homo sapiens
gtgcggcaggagca

SEQ ID NO: 2143051 - DNA, 16 bp, Homo sapiens
gtgcgtgcgtgtgtgt

SEQ ID NO: 2143052 - DNA, 14 bp, Homo sapiens
gtgcgtggctgtgg

SEQ ID NO: 2143053 - DNA, 16 bp, Homo sapiens
gtgcgtggctgtggca

SEQ ID NO: 2143054 - DNA, 21 bp, Homo sapiens
gtgcgtgttagtgtgtgtgca

SEQ ID NO: 2143055 - DNA, 15 bp, Homo sapiens
gtgcgttggaatcac

SEQ ID NO: 2143056 - DNA, 14 bp, Homo sapiens
gtgcgttttagagt

SEQ ID NO: 2143057 - DNA, 13 bp, Homo sapiens
gtgctaactgtat

SEQ ID NO: 2143058 - DNA, 15 bp, Homo sapiens
gtgctacaaaaacac

SEQ ID NO: 2143059 - DNA, 20 bp, Homo sapiens
gtgctacaaaaacacagcaa

SEQ ID NO: 2143060 - DNA, 21 bp, Homo sapiens
gtgctacaaaaacacagcaag

SEQ ID NO: 2143061 - DNA, 20 bp, Homo sapiens
gtgctacgtacatgtgaggc

SEQ ID NO: 2143062 - DNA, 16 bp, Homo sapiens
gtgctataggctggag

SEQ ID NO: 2143063 - DNA, 21 bp, Homo sapiens
gtgctataggctggagaagct

SEQ ID NO: 2143064 - DNA, 18 bp, Homo sapiens
gtgctatgccaagccatg

SEQ ID NO: 2143065 - DNA, 13 bp, Homo sapiens
gtgctattctgtg

SEQ ID NO: 2143066 - DNA, 14 bp, Homo sapiens
gtgctattctgtgt

SEQ ID NO: 2143067 - DNA, 17 bp, Homo sapiens
gtgctattgaactgagc

SEQ ID NO: 2143068 - DNA, 20 bp, Homo sapiens
gtgctcacgctcccccgcag

SEQ ID NO: 2143069 - DNA, 13 bp, Homo sapiens
gtgctctggacag

SEQ ID NO: 2143070 - DNA, 14 bp, Homo sapiens
gtgctctggacagg

SEQ ID NO: 2143071 - DNA, 15 bp, Homo sapiens
gtgctctggacaggc

SEQ ID NO: 2143072 - DNA, 17 bp, Homo sapiens
gtgctcttctgttctca

SEQ ID NO: 2143073 - DNA, 13 bp, Homo sapiens
gtgctctttgaag

SEQ ID NO: 2143074 - DNA, 20 bp, Homo sapiens
gtgctgacaatactgctgcc

SEQ ID NO: 2143075 - DNA, 14 bp, Homo sapiens
gtgctgacctctgg

SEQ ID NO: 2143076 - DNA, 21 bp, Homo sapiens
gtgctgactaactataagcat

SEQ ID NO: 2143077 - DNA, 18 bp, Homo sapiens
gtgctgccatccaggttc

SEQ ID NO: 2143078 - DNA, 19 bp, Homo sapiens
gtgctgccatgccactgcc

SEQ ID NO: 2143079 - DNA, 23 bp, Homo sapiens
gtgctgccatgccactgccaggc

SEQ ID NO: 2143080 - DNA, 20 bp, Homo sapiens
gtgctgccctgctctgggga

SEQ ID NO: 2143081 - DNA, 12 bp, Homo sapiens
gtgctggaggat

SEQ ID NO: 2143082 - DNA, 22 bp, Homo sapiens
gtgctgggattacaagcgtgag

SEQ ID NO: 2143083 - DNA, 21 bp, Homo sapiens
gtgctggtctattttgatttt

SEQ ID NO: 2143084 - DNA, 20 bp, Homo sapiens
gtgctgtacccttccacctc

SEQ ID NO: 2143085 - DNA, 17 bp, Homo sapiens
gtgctgtggcctgggca

SEQ ID NO: 2143086 - DNA, 19 bp, Homo sapiens
gtgctgtggcctgggcaag

SEQ ID NO: 2143087 - DNA, 12 bp, Homo sapiens
gtgctgtgggca

SEQ ID NO: 2143088 - DNA, 13 bp, Homo sapiens
gtgctgtttgaga

SEQ ID NO: 2143089 - DNA, 15 bp, Homo sapiens
gtgcttacagtgact

SEQ ID NO: 2143090 - DNA, 18 bp, Homo sapiens
gtgcttcagcctgaggct

SEQ ID NO: 2143091 - DNA, 19 bp, Homo sapiens
gtgcttccctaggctgagc

SEQ ID NO: 2143092 - DNA, 19 bp, Homo sapiens
gtgcttctctttgtcccca

SEQ ID NO: 2143093 - DNA, 23 bp, Homo sapiens
gtgcttggtggggctcgtggcct

SEQ ID NO: 2143094 - DNA, 18 bp, Homo sapiens
gtgctttatttatggctt

SEQ ID NO: 2143095 - DNA, 14 bp, Homo sapiens
gtgctttcaggtct

SEQ ID NO: 2143096 - DNA, 15 bp, Homo sapiens
gtgcttttaaatgca

SEQ ID NO: 2143097 - DNA, 17 bp, Homo sapiens
gtgcttttcctatttgt

SEQ ID NO: 2143098 - DNA, 14 bp, Homo sapiens
gtgcttttgatgtg

SEQ ID NO: 2143099 - DNA, 15 bp, Homo sapiens
gtgcttttgatgtga

SEQ ID NO: 2143100 - DNA, 14 bp, Homo sapiens
gtggaaaaaagaga

SEQ ID NO: 2143101 - DNA, 17 bp, Homo sapiens
gtggaaaaaagagaaaa

SEQ ID NO: 2143102 - DNA, 19 bp, Homo sapiens
gtggaaaaaagagaaaaac

SEQ ID NO: 2143103 - DNA, 14 bp, Homo sapiens
gtggaaaaatattt

SEQ ID NO: 2143104 - DNA, 20 bp, Homo sapiens
gtggaaaagaatccctgcag

SEQ ID NO: 2143105 - DNA, 22 bp, Homo sapiens
gtggaacagtcacccttctggg

SEQ ID NO: 2143106 - DNA, 13 bp, Homo sapiens
gtggaagagcagc

SEQ ID NO: 2143107 - DNA, 15 bp, Homo sapiens
gtggaagagcagcct

SEQ ID NO: 2143108 - DNA, 13 bp, Homo sapiens
gtggaagccctcc

SEQ ID NO: 2143109 - DNA, 16 bp, Homo sapiens
gtggaagccctccttc

SEQ ID NO: 2143110 - DNA, 17 bp, Homo sapiens
gtggaagggggtgtgcg

SEQ ID NO: 2143111 - DNA, 18 bp, Homo sapiens
gtggaagggggtgtgcgt

SEQ ID NO: 2143112 - DNA, 17 bp, Homo sapiens
gtggacacagctcttct

SEQ ID NO: 2143113 - DNA, 17 bp, Homo sapiens
gtggacacctgccctgc

SEQ ID NO: 2143114 - DNA, 22 bp, Homo sapiens
gtggaccacccgccctggcagt

SEQ ID NO: 2143115 - DNA, 20 bp, Homo sapiens
gtggacgcaattgtgggatg

SEQ ID NO: 2143116 - DNA, 23 bp, Homo sapiens
gtggactgaaccgacttttctaa

SEQ ID NO: 2143117 - DNA, 16 bp, Homo sapiens
gtggaggaaggtgctg

SEQ ID NO: 2143118 - DNA, 13 bp, Homo sapiens
gtggaggaggagg

SEQ ID NO: 2143119 - DNA, 15 bp, Homo sapiens
gtggaggaggcctgg

SEQ ID NO: 2143120 - DNA, 20 bp, Homo sapiens
gtggaggcctgatgctgccc

SEQ ID NO: 2143121 - DNA, 13 bp, Homo sapiens
gtggaggctgctc

SEQ ID NO: 2143122 - DNA, 14 bp, Homo sapiens
gtggaggctgctcg

SEQ ID NO: 2143123 - DNA, 22 bp, Homo sapiens
gtggaggggaatcggttcatca

SEQ ID NO: 2143124 - DNA, 18 bp, Homo sapiens
gtggagggtaggggagtg

SEQ ID NO: 2143125 - DNA, 12 bp, Homo sapiens
gtggagtctcat

SEQ ID NO: 2143126 - DNA, 13 bp, Homo sapiens
gtggagtctgagt

SEQ ID NO: 2143127 - DNA, 18 bp, Homo sapiens
gtggagtctgagtctgag

SEQ ID NO: 2143128 - DNA, 15 bp, Homo sapiens
gtggatcacagaggc

SEQ ID NO: 2143129 - DNA, 19 bp, Homo sapiens
gtggatcatgaggtcagga

SEQ ID NO: 2143130 - DNA, 17 bp, Homo sapiens
gtggatccactgtgcag

SEQ ID NO: 2143131 - DNA, 18 bp, Homo sapiens
gtggatctccaaggacca

SEQ ID NO: 2143132 - DNA, 19 bp, Homo sapiens
gtggatctccaaggaccag

SEQ ID NO: 2143133 - DNA, 20 bp, Homo sapiens
gtggatggaggagaaataaa

SEQ ID NO: 2143134 - DNA, 15 bp, Homo sapiens
gtggatggatggaca

SEQ ID NO: 2143135 - DNA, 16 bp, Homo sapiens
gtggatggatggacag

SEQ ID NO: 2143136 - DNA, 21 bp, Homo sapiens
gtggatggatggacagaatga

SEQ ID NO: 2143137 - DNA, 19 bp, Homo sapiens
gtggattcctgggcaagaa

SEQ ID NO: 2143138 - DNA, 15 bp, Homo sapiens
gtggcaagggggcgg

SEQ ID NO: 2143139 - DNA, 16 bp, Homo sapiens
gtggcaagggggcggg

SEQ ID NO: 2143140 - DNA, 22 bp, Homo sapiens
gtggcacacgcctgtaatccca

SEQ ID NO: 2143141 - DNA, 14 bp, Homo sapiens
gtggcaccagatgc

SEQ ID NO: 2143142 - DNA, 17 bp, Homo sapiens
gtggcacctcctgagaa

SEQ ID NO: 2143143 - DNA, 20 bp, Homo sapiens
gtggcacctcctgagaaggc

SEQ ID NO: 2143144 - DNA, 20 bp, Homo sapiens
gtggcactgcttgaggaggg

SEQ ID NO: 2143145 - DNA, 20 bp, Homo sapiens
gtggcagaaaagaggagacc

SEQ ID NO: 2143146 - DNA, 13 bp, Homo sapiens
gtggcagaccggg

SEQ ID NO: 2143147 - DNA, 19 bp, Homo sapiens
gtggcagaccgggggccag

SEQ ID NO: 2143148 - DNA, 20 bp, Homo sapiens
gtggcagaccgggggccaga

SEQ ID NO: 2143149 - DNA, 13 bp, Homo sapiens
gtggcagccatgc

SEQ ID NO: 2143150 - DNA, 14 bp, Homo sapiens
gtggcagccatgcc

SEQ ID NO: 2143151 - DNA, 15 bp, Homo sapiens
gtggcagccatgcct

SEQ ID NO: 2143152 - DNA, 19 bp, Homo sapiens
gtggcagccatgcctcatg

SEQ ID NO: 2143153 - DNA, 19 bp, Homo sapiens
gtggcagctgcggtccacc

SEQ ID NO: 2143154 - DNA, 13 bp, Homo sapiens
gtggcagctgctt

SEQ ID NO: 2143155 - DNA, 19 bp, Homo sapiens
gtggcagctgcttttgtct

SEQ ID NO: 2143156 - DNA, 17 bp, Homo sapiens
gtggcagtgggagctgc

SEQ ID NO: 2143157 - DNA, 19 bp, Homo sapiens
gtggcagtgggagctgcct

SEQ ID NO: 2143158 - DNA, 23 bp, Homo sapiens
gttccccatctgggtccttgcac

SEQ ID NO: 2143159 - DNA, 15 bp, Homo sapiens
gttcccctgttcact

SEQ ID NO: 2143160 - DNA, 20 bp, Homo sapiens
gttcccggagcacagccctg

SEQ ID NO: 2143161 - DNA, 22 bp, Homo sapiens
gttcccggagcacagccctggg

SEQ ID NO: 2143162 - DNA, 19 bp, Homo sapiens
gttccctgaaaacccagag

SEQ ID NO: 2143163 - DNA, 20 bp, Homo sapiens
gttccctgaaaacccagaga

SEQ ID NO: 2143164 - DNA, 19 bp, Homo sapiens
gttccctgaacatctgtgt

SEQ ID NO: 2143165 - DNA, 14 bp, Homo sapiens
gttcccttgaccat

SEQ ID NO: 2143166 - DNA, 19 bp, Homo sapiens
gttcctactttagccactg

SEQ ID NO: 2143167 - DNA, 15 bp, Homo sapiens
gttcctcaccaataa

SEQ ID NO: 2143168 - DNA, 18 bp, Homo sapiens
gttcctcaccaataactt

SEQ ID NO: 2143169 - DNA, 21 bp, Homo sapiens
gttcctcaccaataacttcag

SEQ ID NO: 2143170 - DNA, 16 bp, Homo sapiens
gttcctcgccctgggt

SEQ ID NO: 2143171 - DNA, 12 bp, Homo sapiens
gttcctgcatgc

SEQ ID NO: 2143172 - DNA, 13 bp, Homo sapiens
gttcctggctttg

SEQ ID NO: 2143173 - DNA, 14 bp, Homo sapiens
gttccttactgcag

SEQ ID NO: 2143174 - DNA, 14 bp, Homo sapiens
gttccttccctggg

SEQ ID NO: 2143175 - DNA, 15 bp, Homo sapiens
gttccttctgcttct

SEQ ID NO: 2143176 - DNA, 16 bp, Homo sapiens
gttccttctgcttctc

SEQ ID NO: 2143177 - DNA, 17 bp, Homo sapiens
gttccttctgcttctcc

SEQ ID NO: 2143178 - DNA, 19 bp, Homo sapiens
gttcgagaccagcctggcc

SEQ ID NO: 2143179 - DNA, 17 bp, Homo sapiens
gttcgcagccaccctga

SEQ ID NO: 2143180 - DNA, 16 bp, Homo sapiens
gttcgccgcgtggaat

SEQ ID NO: 2143181 - DNA, 13 bp, Homo sapiens
gttcgtagctttc

SEQ ID NO: 2143182 - DNA, 19 bp, Homo sapiens
gttctaaaaattgtgatca

SEQ ID NO: 2143183 - DNA, 15 bp, Homo sapiens
gttctaacagcatct

SEQ ID NO: 2143184 - DNA, 19 bp, Homo sapiens
gttctaggtcctggcttct

SEQ ID NO: 2143185 - DNA, 21 bp, Homo sapiens
gttctagttagcaggaaatag

SEQ ID NO: 2143186 - DNA, 19 bp, Homo sapiens
gttctatattgtgccaagc

SEQ ID NO: 2143187 - DNA, 18 bp, Homo sapiens
gttctcagatcttgacag

SEQ ID NO: 2143188 - DNA, 20 bp, Homo sapiens
gttctccgggtgtggcctca

SEQ ID NO: 2143189 - DNA, 18 bp, Homo sapiens
gttctcctccattgctgt

SEQ ID NO: 2143190 - DNA, 13 bp, Homo sapiens
gttctctccagga

SEQ ID NO: 2143191 - DNA, 16 bp, Homo sapiens
gttctctccaggaagg

SEQ ID NO: 2143192 - DNA, 15 bp, Homo sapiens
gttctgaaaactgtt

SEQ ID NO: 2143193 - DNA, 18 bp, Homo sapiens
gttctgaataatttctta

SEQ ID NO: 2143194 - DNA, 16 bp, Homo sapiens
gttctgacacacgtat

SEQ ID NO: 2143195 - DNA, 15 bp, Homo sapiens
gttctgacattcatt

SEQ ID NO: 2143196 - DNA, 14 bp, Homo sapiens
gttctgcactgaaa

SEQ ID NO: 2143197 - DNA, 11 bp, Homo sapiens
gttctgctcct

SEQ ID NO: 2143198 - DNA, 13 bp, Homo sapiens
gttctgctcctct

SEQ ID NO: 2143199 - DNA, 14 bp, Homo sapiens
gttctgctcctctc

SEQ ID NO: 2143200 - DNA, 17 bp, Homo sapiens
gttctgctcctctccag

SEQ ID NO: 2143201 - DNA, 18 bp, Homo sapiens
gttctgctcctctccagg

SEQ ID NO: 2143202 - DNA, 16 bp, Homo sapiens
gttctggagctgctgt

SEQ ID NO: 2143203 - DNA, 21 bp, Homo sapiens
gttctggctttacattttatt

SEQ ID NO: 2143204 - DNA, 15 bp, Homo sapiens
gttctgggacacagt

SEQ ID NO: 2143205 - DNA, 23 bp, Homo sapiens
gttctgggacacagttcaattct

SEQ ID NO: 2143206 - DNA, 22 bp, Homo sapiens
gttctggggaggaagggccagg

SEQ ID NO: 2143207 - DNA, 18 bp, Homo sapiens
gttctgggtgttgaccac

SEQ ID NO: 2143208 - DNA, 23 bp, Homo sapiens
gttctggtttagtgttctgtatt

SEQ ID NO: 2143209 - DNA, 21 bp, Homo sapiens
gttctgtaatggaactgaccc

SEQ ID NO: 2143210 - DNA, 12 bp, Homo sapiens
gttctgtatttt

SEQ ID NO: 2143211 - DNA, 15 bp, Homo sapiens
gttctgtattttaag

SEQ ID NO: 2143212 - DNA, 13 bp, Homo sapiens
gttctgtattttc

SEQ ID NO: 2143213 - DNA, 19 bp, Homo sapiens
gttctgtgggcttggcctt

SEQ ID NO: 2143214 - DNA, 13 bp, Homo sapiens
gttctgtgtgggt

SEQ ID NO: 2143215 - DNA, 22 bp, Homo sapiens
gttcttagctgaacaatgaatg

SEQ ID NO: 2143216 - DNA, 14 bp, Homo sapiens
gttcttcgaggtgg

SEQ ID NO: 2143217 - DNA, 22 bp, Homo sapiens
gttcttgagtagatctgcttct

SEQ ID NO: 2143218 - DNA, 13 bp, Homo sapiens
gttcttgatgaca

SEQ ID NO: 2143219 - DNA, 18 bp, Homo sapiens
gttcttggtgactgtccc

SEQ ID NO: 2143220 - DNA, 19 bp, Homo sapiens
gttctttaggtgcctcctg

SEQ ID NO: 2143221 - DNA, 13 bp, Homo sapiens
gttcttttaaagg

SEQ ID NO: 2143222 - DNA, 20 bp, Homo sapiens
gttgaaaaatctagtttttt

SEQ ID NO: 2143223 - DNA, 23 bp, Homo sapiens
gttgaaaagactccaaagaaatg

SEQ ID NO: 2143224 - DNA, 19 bp, Homo sapiens
gttgaaaattattttaaac

SEQ ID NO: 2143225 - DNA, 22 bp, Homo sapiens
gttgaaaattcaaaaagtgttt

SEQ ID NO: 2143226 - DNA, 11 bp, Homo sapiens
gttgaaatctt

SEQ ID NO: 2143227 - DNA, 20 bp, Homo sapiens
gttgaacatctcactttgcc

SEQ ID NO: 2143228 - DNA, 15 bp, Homo sapiens
gttgaagaggaaggg

SEQ ID NO: 2143229 - DNA, 13 bp, Homo sapiens
gttgaaggcagtc

SEQ ID NO: 2143230 - DNA, 19 bp, Homo sapiens
gttgaatgacaacagaagc

SEQ ID NO: 2143231 - DNA, 15 bp, Homo sapiens
gttgacccctttccc

SEQ ID NO: 2143232 - DNA, 16 bp, Homo sapiens
gttgacccctttcccc

SEQ ID NO: 2143233 - DNA, 18 bp, Homo sapiens
gttgactcaagtttttac

SEQ ID NO: 2143234 - DNA, 21 bp, Homo sapiens
gttgaggcagggcaaatgaca

SEQ ID NO: 2143235 - DNA, 23 bp, Homo sapiens
gttgagggaacagacaggagaaa

SEQ ID NO: 2143236 - DNA, 16 bp, Homo sapiens
gttgaggggctcctgg

SEQ ID NO: 2143237 - DNA, 20 bp, Homo sapiens
gttgagtctcctctctgaga

SEQ ID NO: 2143238 - DNA, 22 bp, Homo sapiens
gttgagtctcctctctgagact

SEQ ID NO: 2143239 - DNA, 13 bp, Homo sapiens
gttgatgaccaat

SEQ ID NO: 2143240 - DNA, 15 bp, Homo sapiens
gttgatgaggcctct

SEQ ID NO: 2143241 - DNA, 16 bp, Homo sapiens
gttgatgaggcctctt

SEQ ID NO: 2143242 - DNA, 22 bp, Homo sapiens
gttgatgatctttgcagacagg

SEQ ID NO: 2143243 - DNA, 19 bp, Homo sapiens
gttgattctgaatctgaaa

SEQ ID NO: 2143244 - DNA, 15 bp, Homo sapiens
gttgcaaggccgctg

SEQ ID NO: 2143245 - DNA, 17 bp, Homo sapiens
gttgcaagtactgctgt

SEQ ID NO: 2143246 - DNA, 12 bp, Homo sapiens
gttgcaataaaa

SEQ ID NO: 2143247 - DNA, 14 bp, Homo sapiens
gttgcaggccaggt

SEQ ID NO: 2143248 - DNA, 17 bp, Homo sapiens
gttgcagtctcagaaag

SEQ ID NO: 2143249 - DNA, 13 bp, Homo sapiens
gttgcagtgagct

SEQ ID NO: 2143250 - DNA, 16 bp, Homo sapiens
gttgcatgatgtattt

SEQ ID NO: 2143251 - DNA, 19 bp, Homo sapiens
gttgccaactaagccctcg

SEQ ID NO: 2143252 - DNA, 19 bp, Homo sapiens
gttgccatgaggcctttcc

SEQ ID NO: 2143253 - DNA, 14 bp, Homo sapiens
gttgcccaggcagg

SEQ ID NO: 2143254 - DNA, 17 bp, Homo sapiens
gttgcccaggcaggtct

SEQ ID NO: 2143255 - DNA, 21 bp, Homo sapiens
gttgccccttccccatctcca

SEQ ID NO: 2143256 - DNA, 21 bp, Homo sapiens
gttgcgggggagctggaaata

SEQ ID NO: 2143257 - DNA, 20 bp, Homo sapiens
gttgctcaaatctattcaga

SEQ ID NO: 2143258 - DNA, 17 bp, Homo sapiens
gttgcttctggctcctc

SEQ ID NO: 2143259 - DNA, 22 bp, Homo sapiens
gttgcttctggctcctccttcc

SEQ ID NO: 2143260 - DNA, 20 bp, Homo sapiens
gttgctttaaagtacctgta

SEQ ID NO: 2143261 - DNA, 23 bp, Homo sapiens
gttgctttaaagtacctgtagtg

SEQ ID NO: 2143262 - DNA, 21 bp, Homo sapiens
gttgcttttctaatcttgtta

SEQ ID NO: 2143263 - DNA, 20 bp, Homo sapiens
gttggaaaagaatacagaaa

SEQ ID NO: 2143264 - DNA, 23 bp, Homo sapiens
gttggaaccgtgtccagcacaga

SEQ ID NO: 2143265 - DNA, 14 bp, Homo sapiens
gttggacacactgt

SEQ ID NO: 2143266 - DNA, 16 bp, Homo sapiens
gttggacagctgcttg

SEQ ID NO: 2143267 - DNA, 18 bp, Homo sapiens
gttggacccgctctggac

SEQ ID NO: 2143268 - DNA, 20 bp, Homo sapiens
gttggacccgctctggacca

SEQ ID NO: 2143269 - DNA, 19 bp, Homo sapiens
gttggagaaaatgaagaaa

SEQ ID NO: 2143270 - DNA, 22 bp, Homo sapiens
gttggagagctagaacctggag

SEQ ID NO: 2143271 - DNA, 12 bp, Homo sapiens
gttggagccact

SEQ ID NO: 2143272 - DNA, 19 bp, Homo sapiens
gttggccgtggtccagctc

SEQ ID NO: 2143273 - DNA, 15 bp, Homo sapiens
taaaatatacaaaca

SEQ ID NO: 2143274 - DNA, 16 bp, Homo sapiens
taaaatatatataaat

SEQ ID NO: 2143275 - DNA, 15 bp, Homo sapiens
taaaatatcctcagg

SEQ ID NO: 2143276 - DNA, 14 bp, Homo sapiens
taaaatatggctat

SEQ ID NO: 2143277 - DNA, 22 bp, Homo sapiens
taaaatattcctgcatttgtga

SEQ ID NO: 2143278 - DNA, 13 bp, Homo sapiens
taaaatatttatt

SEQ ID NO: 2143279 - DNA, 15 bp, Homo sapiens
taaaatcatgtacat

SEQ ID NO: 2143280 - DNA, 18 bp, Homo sapiens
taaaatcatttctgcatc

SEQ ID NO: 2143281 - DNA, 22 bp, Homo sapiens
taaaatcatttctgcatcagct

SEQ ID NO: 2143282 - DNA, 23 bp, Homo sapiens
taaaatctgatttaatgttttct

SEQ ID NO: 2143283 - DNA, 19 bp, Homo sapiens
taaaatctggcaaagttat

SEQ ID NO: 2143284 - DNA, 16 bp, Homo sapiens
taaaatgaaatgtttt

SEQ ID NO: 2143285 - DNA, 12 bp, Homo sapiens
taaaatgacagc

SEQ ID NO: 2143286 - DNA, 14 bp, Homo sapiens
taaaatgcagtcca

SEQ ID NO: 2143287 - DNA, 17 bp, Homo sapiens
taaaatgcagtccagaa

SEQ ID NO: 2143288 - DNA, 21 bp, Homo sapiens
taaaatgcagtccagaataag

SEQ ID NO: 2143289 - DNA, 22 bp, Homo sapiens
taaaattagtgagatttgtatt

SEQ ID NO: 2143290 - DNA, 22 bp, Homo sapiens
taaaattgctagtgatttcatt

SEQ ID NO: 2143291 - DNA, 15 bp, Homo sapiens
taaaattgtaaaatt

SEQ ID NO: 2143292 - DNA, 14 bp, Homo sapiens
taaaattgtataga

SEQ ID NO: 2143293 - DNA, 19 bp, Homo sapiens
taaaattgtgatgttttgt

SEQ ID NO: 2143294 - DNA, 23 bp, Homo sapiens
taaacaaaatagaagctgtagta

SEQ ID NO: 2143295 - DNA, 13 bp, Homo sapiens
taaacaaaggttg

SEQ ID NO: 2143296 - DNA, 19 bp, Homo sapiens
taaacaaatgtatgattac

SEQ ID NO: 2143297 - DNA, 23 bp, Homo sapiens
taaacaagtatttgttaatttag

SEQ ID NO: 2143298 - DNA, 11 bp, Homo sapiens
taaacacctga

SEQ ID NO: 2143299 - DNA, 13 bp, Homo sapiens
taaacacctgaca

SEQ ID NO: 2143300 - DNA, 16 bp, Homo sapiens
taaacacctgacacat

SEQ ID NO: 2143301 - DNA, 18 bp, Homo sapiens
taaacacctgacacatct

SEQ ID NO: 2143302 - DNA, 15 bp, Homo sapiens
taaacacgtgtctat

SEQ ID NO: 2143303 - DNA, 16 bp, Homo sapiens
taaacacgtgtctata

SEQ ID NO: 2143304 - DNA, 20 bp, Homo sapiens
taaacactgtaatcttaaaa

SEQ ID NO: 2143305 - DNA, 15 bp, Homo sapiens
taaacagcatttatt

SEQ ID NO: 2143306 - DNA, 18 bp, Homo sapiens
taaacaggagacaggaag

SEQ ID NO: 2143307 - DNA, 20 bp, Homo sapiens
taaacagtgagcctgaattt

SEQ ID NO: 2143308 - DNA, 23 bp, Homo sapiens
taaacagtgagcctgaattttgt

SEQ ID NO: 2143309 - DNA, 13 bp, Homo sapiens
taaacagtgcctg

SEQ ID NO: 2143310 - DNA, 15 bp, Homo sapiens
taaacataattcttg

SEQ ID NO: 2143311 - DNA, 15 bp, Homo sapiens
taaacatagatagtg

SEQ ID NO: 2143312 - DNA, 15 bp, Homo sapiens
taaacatcattcatt

SEQ ID NO: 2143313 - DNA, 17 bp, Homo sapiens
taaacatcattcatttt

SEQ ID NO: 2143314 - DNA, 12 bp, Homo sapiens
taaacatgtgtt

SEQ ID NO: 2143315 - DNA, 13 bp, Homo sapiens
taaacatgtgttt

SEQ ID NO: 2143316 - DNA, 15 bp, Homo sapiens
taaacatgtgtttta

SEQ ID NO: 2143317 - DNA, 14 bp, Homo sapiens
taaacattaaaaga

SEQ ID NO: 2143318 - DNA, 17 bp, Homo sapiens
taaacattaaacactgt

SEQ ID NO: 2143319 - DNA, 19 bp, Homo sapiens
taaacattaaacactgtaa

SEQ ID NO: 2143320 - DNA, 22 bp, Homo sapiens
taaacattaatcaatcatctgt

SEQ ID NO: 2143321 - DNA, 20 bp, Homo sapiens
taaacattggtatatttcca

SEQ ID NO: 2143322 - DNA, 19 bp, Homo sapiens
taaaccaaaggacattatg

SEQ ID NO: 2143323 - DNA, 21 bp, Homo sapiens
taaaccaaaggacattatgtg

SEQ ID NO: 2143324 - DNA, 14 bp, Homo sapiens
taaaccagcagaaa

SEQ ID NO: 2143325 - DNA, 15 bp, Homo sapiens
taaaccagcagaaaa

SEQ ID NO: 2143326 - DNA, 19 bp, Homo sapiens
taaacccaggaggcggagg

SEQ ID NO: 2143327 - DNA, 20 bp, Homo sapiens
taaaccctgccccacttctc

SEQ ID NO: 2143328 - DNA, 13 bp, Homo sapiens
taaaccttttttg

SEQ ID NO: 2143329 - DNA, 15 bp, Homo sapiens
taaactataagcaag

SEQ ID NO: 2143330 - DNA, 20 bp, Homo sapiens
taaactatcttggtgaattt

SEQ ID NO: 2143331 - DNA, 19 bp, Homo sapiens
taaactcaaaacttaacat

SEQ ID NO: 2143332 - DNA, 20 bp, Homo sapiens
taaactcaaaacttaacata

SEQ ID NO: 2143333 - DNA, 19 bp, Homo sapiens
taaactcaaaatatttgta

SEQ ID NO: 2143334 - DNA, 16 bp, Homo sapiens
taaactgaaaaatgtc

SEQ ID NO: 2143335 - DNA, 20 bp, Homo sapiens
taaactgagcctcttttcaa

SEQ ID NO: 2143336 - DNA, 16 bp, Homo sapiens
taaactgcattagaaa

SEQ ID NO: 2143337 - DNA, 22 bp, Homo sapiens
taaactggggagttataaaaat

SEQ ID NO: 2143338 - DNA, 19 bp, Homo sapiens
taaacttagaataaaattg

SEQ ID NO: 2143339 - DNA, 12 bp, Homo sapiens
taaacttcagca

SEQ ID NO: 2143340 - DNA, 13 bp, Homo sapiens
taaacttcagcac

SEQ ID NO: 2143341 - DNA, 12 bp, Homo sapiens
taaacttctgat

SEQ ID NO: 2143342 - DNA, 14 bp, Homo sapiens
taaacttgtcagaa

SEQ ID NO: 2143343 - DNA, 18 bp, Homo sapiens
taaagaagtaaatttgtc

SEQ ID NO: 2143344 - DNA, 15 bp, Homo sapiens
taaagacacctactg

SEQ ID NO: 2143345 - DNA, 14 bp, Homo sapiens
taaagacagaaaaa

SEQ ID NO: 2143346 - DNA, 20 bp, Homo sapiens
taaagacagaaaaaaataaa

SEQ ID NO: 2143347 - DNA, 19 bp, Homo sapiens
taaagacagggtttcacca

SEQ ID NO: 2143348 - DNA, 15 bp, Homo sapiens
taaagacttaagatt

SEQ ID NO: 2143349 - DNA, 10 bp, Homo sapiens
taaagagctc

SEQ ID NO: 2143350 - DNA, 22 bp, Homo sapiens
taaagaggcgtcttgtattttc

SEQ ID NO: 2143351 - DNA, 21 bp, Homo sapiens
taaagagtggagcaaatgctt

SEQ ID NO: 2143352 - DNA, 15 bp, Homo sapiens
taaagagttattcaa

SEQ ID NO: 2143353 - DNA, 21 bp, Homo sapiens
taaagataaaatatcctcagg

SEQ ID NO: 2143354 - DNA, 11 bp, Homo sapiens
taaagatgatc

SEQ ID NO: 2143355 - DNA, 22 bp, Homo sapiens
taaagatgccctaagtgttgaa

SEQ ID NO: 2143356 - DNA, 16 bp, Homo sapiens
taaagatgtaactagg

SEQ ID NO: 2143357 - DNA, 14 bp, Homo sapiens
taaagatgtcaaat

SEQ ID NO: 2143358 - DNA, 17 bp, Homo sapiens
taaagattttttaataa

SEQ ID NO: 2143359 - DNA, 18 bp, Homo sapiens
taaagcaacattttattt

SEQ ID NO: 2143360 - DNA, 20 bp, Homo sapiens
taaagcagagggactttgta

SEQ ID NO: 2143361 - DNA, 22 bp, Homo sapiens
taaagcatgaatggtatggaac

SEQ ID NO: 2143362 - DNA, 15 bp, Homo sapiens
taaagcgtttgcaca

SEQ ID NO: 2143363 - DNA, 15 bp, Homo sapiens
taaagctactgaatt

SEQ ID NO: 2143364 - DNA, 20 bp, Homo sapiens
taaagctggacaagaagctg

SEQ ID NO: 2143365 - DNA, 22 bp, Homo sapiens
taaagctggacaagaagctgct

SEQ ID NO: 2143366 - DNA, 18 bp, Homo sapiens
taaaggaagtcaccaaaa

SEQ ID NO: 2143367 - DNA, 17 bp, Homo sapiens
taaaggagaaggcatga

SEQ ID NO: 2143368 - DNA, 22 bp, Homo sapiens
taaaggattgatcactttgtta

SEQ ID NO: 2143369 - DNA, 16 bp, Homo sapiens
taaaggcaaaggcaat

SEQ ID NO: 2143370 - DNA, 19 bp, Homo sapiens
taaaggcctggaaccaggg

SEQ ID NO: 2143371 - DNA, 21 bp, Homo sapiens
taaagggaaaggattcatgtg

SEQ ID NO: 2143372 - DNA, 21 bp, Homo sapiens
taaagggcagaaggggaagat

SEQ ID NO: 2143373 - DNA, 14 bp, Homo sapiens
taaagtacctgtag

SEQ ID NO: 2143374 - DNA, 16 bp, Homo sapiens
taaagtacctgtagtg

SEQ ID NO: 2143375 - DNA, 14 bp, Homo sapiens
taaagtatatattt

SEQ ID NO: 2143376 - DNA, 17 bp, Homo sapiens
taaagtatatatttatt

SEQ ID NO: 2143377 - DNA, 13 bp, Homo sapiens
taaagtatgtaaa

SEQ ID NO: 2143378 - DNA, 16 bp, Homo sapiens
taaagtatgtaaacag

SEQ ID NO: 2143379 - DNA, 22 bp, Homo sapiens
taaagtatgtaaacaggagaca

SEQ ID NO: 2143380 - DNA, 22 bp, Homo sapiens
taaagtcaacaaccatgccagg

SEQ ID NO: 2143381 - DNA, 16 bp, Homo sapiens
taaagtcacttccagt

SEQ ID NO: 2143382 - DNA, 18 bp, Homo sapiens
taaagtcacttccagtgt

SEQ ID NO: 2143383 - DNA, 13 bp, Homo sapiens
taaagttggaaag

SEQ ID NO: 2143384 - DNA, 18 bp, Homo sapiens
taaagtttaaaaaataca

SEQ ID NO: 2143385 - DNA, 13 bp, Homo sapiens
taaagtttacagt

SEQ ID NO: 2143386 - DNA, 16 bp, Homo sapiens
taaagtttacagtaaa

SEQ ID NO: 2143387 - DNA, 23 bp, Homo sapiens
taaagtttacagtaaataaattg

SEQ ID NO: 2143388 - DNA, 18 bp, Homo sapiens
taatatggcaaaaatggc

SEQ ID NO: 2143389 - DNA, 20 bp, Homo sapiens
taatatgtctgccacagaga

SEQ ID NO: 2143390 - DNA, 18 bp, Homo sapiens
taatattaaaaatatgga

SEQ ID NO: 2143391 - DNA, 14 bp, Homo sapiens
taatattattgggg

SEQ ID NO: 2143392 - DNA, 12 bp, Homo sapiens
taatatttaggc

SEQ ID NO: 2143393 - DNA, 16 bp, Homo sapiens
taatatttaggcaaga

SEQ ID NO: 2143394 - DNA, 23 bp, Homo sapiens
taatatttatgtctatttaagcc

SEQ ID NO: 2143395 - DNA, 15 bp, Homo sapiens
taatattttgtattt

SEQ ID NO: 2143396 - DNA, 17 bp, Homo sapiens
taatcaatcatctgtgt

SEQ ID NO: 2143397 - DNA, 18 bp, Homo sapiens
taatcaatgtttcttcta

SEQ ID NO: 2143398 - DNA, 13 bp, Homo sapiens
taatcaattatta

SEQ ID NO: 2143399 - DNA, 14 bp, Homo sapiens
taatcaccaaagta

SEQ ID NO: 2143400 - DNA, 18 bp, Homo sapiens
taatcagcattattcttc

SEQ ID NO: 2143401 - DNA, 17 bp, Homo sapiens
taatcaggttgttaatg

SEQ ID NO: 2143402 - DNA, 20 bp, Homo sapiens
taatcatataataaatgtac

SEQ ID NO: 2143403 - DNA, 13 bp, Homo sapiens
taatcccagcact

SEQ ID NO: 2143404 - DNA, 20 bp, Homo sapiens
taatcccagctactcaggag

SEQ ID NO: 2143405 - DNA, 22 bp, Homo sapiens
taatcctattaaaacacagctt

SEQ ID NO: 2143406 - DNA, 21 bp, Homo sapiens
taatcgaaatgaatttatctg

SEQ ID NO: 2143407 - DNA, 22 bp, Homo sapiens
taatcggcccacagctcccacc

SEQ ID NO: 2143408 - DNA, 21 bp, Homo sapiens
taatctctaaatcaagtattt

SEQ ID NO: 2143409 - DNA, 15 bp, Homo sapiens
taatctggactcctc

SEQ ID NO: 2143410 - DNA, 13 bp, Homo sapiens
taatcttcagttt

SEQ ID NO: 2143411 - DNA, 16 bp, Homo sapiens
taatcttcagttttat

SEQ ID NO: 2143412 - DNA, 20 bp, Homo sapiens
taatcttcagttttatcttt

SEQ ID NO: 2143413 - DNA, 18 bp, Homo sapiens
taatctttctttacctga

SEQ ID NO: 2143414 - DNA, 21 bp, Homo sapiens
taatctttctttacctgagac

SEQ ID NO: 2143415 - DNA, 12 bp, Homo sapiens
taatctttgggt

SEQ ID NO: 2143416 - DNA, 22 bp, Homo sapiens
taatctttgggtaacttcaaaa

SEQ ID NO: 2143417 - DNA, 16 bp, Homo sapiens
taatctttgtgacagg

SEQ ID NO: 2143418 - DNA, 16 bp, Homo sapiens
taatgaaacaaagagt

SEQ ID NO: 2143419 - DNA, 14 bp, Homo sapiens
taatgaacaaatgg

SEQ ID NO: 2143420 - DNA, 14 bp, Homo sapiens
taatgacacggtag

SEQ ID NO: 2143421 - DNA, 14 bp, Homo sapiens
taatgactttttat

SEQ ID NO: 2143422 - DNA, 14 bp, Homo sapiens
taatgagaacattt

SEQ ID NO: 2143423 - DNA, 20 bp, Homo sapiens
taatgagtctgcataaactt

SEQ ID NO: 2143424 - DNA, 21 bp, Homo sapiens
taatgagtctgcataaacttc

SEQ ID NO: 2143425 - DNA, 12 bp, Homo sapiens
taatgcacaatt

SEQ ID NO: 2143426 - DNA, 16 bp, Homo sapiens
taatgcctctcccgca

SEQ ID NO: 2143427 - DNA, 13 bp, Homo sapiens
taatgccttccac

SEQ ID NO: 2143428 - DNA, 17 bp, Homo sapiens
taatgctcccatctcct

SEQ ID NO: 2143429 - DNA, 14 bp, Homo sapiens
taatgctgttgcct

SEQ ID NO: 2143430 - DNA, 20 bp, Homo sapiens
taatgcttagagaatgttct

SEQ ID NO: 2143431 - DNA, 23 bp, Homo sapiens
taatgcttcaagtgttgctcttg

SEQ ID NO: 2143432 - DNA, 17 bp, Homo sapiens
taatgctttatgtttaa

SEQ ID NO: 2143433 - DNA, 13 bp, Homo sapiens
taatggagaagac

SEQ ID NO: 2143434 - DNA, 15 bp, Homo sapiens
taatggggcggtgag

SEQ ID NO: 2143435 - DNA, 18 bp, Homo sapiens
taatggtgccttcatttg

SEQ ID NO: 2143436 - DNA, 22 bp, Homo sapiens
taatggtttttatttctcgggt

SEQ ID NO: 2143437 - DNA, 14 bp, Homo sapiens
taatgtaagaaaat

SEQ ID NO: 2143438 - DNA, 22 bp, Homo sapiens
taatgtaagggtctgttgtaaa

SEQ ID NO: 2143439 - DNA, 15 bp, Homo sapiens
taatgtacaagtttt

SEQ ID NO: 2143440 - DNA, 20 bp, Homo sapiens
taatgtacagagtggcccct

SEQ ID NO: 2143441 - DNA, 20 bp, Homo sapiens
taatgtaggtttagatatat

SEQ ID NO: 2143442 - DNA, 19 bp, Homo sapiens
taatgtagtatgatgtaat

SEQ ID NO: 2143443 - DNA, 14 bp, Homo sapiens
taatgtatcttatt

SEQ ID NO: 2143444 - DNA, 18 bp, Homo sapiens
taatgtatcttatttata

SEQ ID NO: 2143445 - DNA, 16 bp, Homo sapiens
taatgtcacaggcagg

SEQ ID NO: 2143446 - DNA, 21 bp, Homo sapiens
taatgtcttcatttcattgta

SEQ ID NO: 2143447 - DNA, 16 bp, Homo sapiens
taatgtggatttccta

SEQ ID NO: 2143448 - DNA, 15 bp, Homo sapiens
taatgtgtgtatgtg

SEQ ID NO: 2143449 - DNA, 15 bp, Homo sapiens
taatgttaattcagc

SEQ ID NO: 2143450 - DNA, 22 bp, Homo sapiens
taatgttctctgggtaggtgtt

SEQ ID NO: 2143451 - DNA, 20 bp, Homo sapiens
taatgttgggatttatatct

SEQ ID NO: 2143452 - DNA, 22 bp, Homo sapiens
taatgttgggatttatatctat

SEQ ID NO: 2143453 - DNA, 23 bp, Homo sapiens
taatgttgttccttttgaaagaa

SEQ ID NO: 2143454 - DNA, 15 bp, Homo sapiens
taatgtttgatttag

SEQ ID NO: 2143455 - DNA, 22 bp, Homo sapiens
taattaaaaaccactgaacatt

SEQ ID NO: 2143456 - DNA, 12 bp, Homo sapiens
taattaaaatct

SEQ ID NO: 2143457 - DNA, 22 bp, Homo sapiens
taattaaaatctggaaatctgt

SEQ ID NO: 2143458 - DNA, 17 bp, Homo sapiens
taattaactatgtgatg

SEQ ID NO: 2143459 - DNA, 12 bp, Homo sapiens
taattaagtaaa

SEQ ID NO: 2143460 - DNA, 14 bp, Homo sapiens
taattaatgtgtgt

SEQ ID NO: 2143461 - DNA, 23 bp, Homo sapiens
taattactatattttagatgcaa

SEQ ID NO: 2143462 - DNA, 20 bp, Homo sapiens
taattagaacaatagctatt

SEQ ID NO: 2143463 - DNA, 14 bp, Homo sapiens
taattatccaggaa

SEQ ID NO: 2143464 - DNA, 19 bp, Homo sapiens
taattatcggaagcagtgc

SEQ ID NO: 2143465 - DNA, 13 bp, Homo sapiens
taattatgacagt

SEQ ID NO: 2143466 - DNA, 13 bp, Homo sapiens
taattattattta

SEQ ID NO: 2143467 - DNA, 22 bp, Homo sapiens
taattattatttatatatgtat

SEQ ID NO: 2143468 - DNA, 21 bp, Homo sapiens
taattcagaaaacataatata

SEQ ID NO: 2143469 - DNA, 14 bp, Homo sapiens
taattcataattag

SEQ ID NO: 2143470 - DNA, 17 bp, Homo sapiens
taattcataattagaac

SEQ ID NO: 2143471 - DNA, 19 bp, Homo sapiens
taattcataattagaacaa

SEQ ID NO: 2143472 - DNA, 14 bp, Homo sapiens
taattcattaaatt

SEQ ID NO: 2143473 - DNA, 18 bp, Homo sapiens
taattccaatatgatgac

SEQ ID NO: 2143474 - DNA, 21 bp, Homo sapiens
taattcccattttgcaaaatt

SEQ ID NO: 2143475 - DNA, 15 bp, Homo sapiens
taattcctggcatga

SEQ ID NO: 2143476 - DNA, 16 bp, Homo sapiens
taattctactaaatat

SEQ ID NO: 2143477 - DNA, 19 bp, Homo sapiens
taattcttatttctgtgtt

SEQ ID NO: 2143478 - DNA, 15 bp, Homo sapiens
taattcttgtatatt

SEQ ID NO: 2143479 - DNA, 22 bp, Homo sapiens
taattgaaatttaaaaataaag

SEQ ID NO: 2143480 - DNA, 19 bp, Homo sapiens
taattgatttcaagacctt

SEQ ID NO: 2143481 - DNA, 17 bp, Homo sapiens
taattgcatttctgctc

SEQ ID NO: 2143482 - DNA, 20 bp, Homo sapiens
taattgggattttaaaaaca

SEQ ID NO: 2143483 - DNA, 18 bp, Homo sapiens
taattggtccgatctttg

SEQ ID NO: 2143484 - DNA, 14 bp, Homo sapiens
taattggtgacaat

SEQ ID NO: 2143485 - DNA, 18 bp, Homo sapiens
taattggtgacaatgtca

SEQ ID NO: 2143486 - DNA, 21 bp, Homo sapiens
taattgtaggtcaatgaaata

SEQ ID NO: 2143487 - DNA, 14 bp, Homo sapiens
taatttaaaccagc

SEQ ID NO: 2143488 - DNA, 19 bp, Homo sapiens
taatttaaaccagcagaaa

SEQ ID NO: 2143489 - DNA, 22 bp, Homo sapiens
taatttaaaccagcagaaaagt

SEQ ID NO: 2143490 - DNA, 15 bp, Homo sapiens
taatttaactaattt

SEQ ID NO: 2143491 - DNA, 17 bp, Homo sapiens
taatttagaaaacttta

SEQ ID NO: 2143492 - DNA, 17 bp, Homo sapiens
taatttagtttcatata

SEQ ID NO: 2143493 - DNA, 13 bp, Homo sapiens
taatttataaaat

SEQ ID NO: 2143494 - DNA, 13 bp, Homo sapiens
taatttatacaaa

SEQ ID NO: 2143495 - DNA, 14 bp, Homo sapiens
taatttatacaaaa

SEQ ID NO: 2143496 - DNA, 23 bp, Homo sapiens
taatttatcttgtctctgggctt

SEQ ID NO: 2143497 - DNA, 14 bp, Homo sapiens
taatttatgagttt

SEQ ID NO: 2143498 - DNA, 23 bp, Homo sapiens
taatttattttgtatttttgaat

SEQ ID NO: 2143499 - DNA, 12 bp, Homo sapiens
taatttgagaat

SEQ ID NO: 2143500 - DNA, 18 bp, Homo sapiens
taatttgttgtacttttt

SEQ ID NO: 2143501 - DNA, 18 bp, Homo sapiens
taattttaaaagttggga

SEQ ID NO: 2143502 - DNA, 13 bp, Homo sapiens
taattttcctcct

SEQ ID NO: 2143503 - DNA, 18 bp, Homo sapiens
tactgagccttgtaattc

SEQ ID NO: 2143504 - DNA, 17 bp, Homo sapiens
tactgatgttcctttgg

SEQ ID NO: 2143505 - DNA, 17 bp, Homo sapiens
tactgattctcctgtca

SEQ ID NO: 2143506 - DNA, 15 bp, Homo sapiens
tactgatttttgtga

SEQ ID NO: 2143507 - DNA, 15 bp, Homo sapiens
tactgcagctttaca

SEQ ID NO: 2143508 - DNA, 22 bp, Homo sapiens
tactgcagctttacatgcaatt

SEQ ID NO: 2143509 - DNA, 23 bp, Homo sapiens
tactgcagctttacatgcaattt

SEQ ID NO: 2143510 - DNA, 13 bp, Homo sapiens
tactgcatgcact

SEQ ID NO: 2143511 - DNA, 22 bp, Homo sapiens
tactgcccaggcctgcctgttc

SEQ ID NO: 2143512 - DNA, 20 bp, Homo sapiens
tactgccggtcacccaggct

SEQ ID NO: 2143513 - DNA, 10 bp, Homo sapiens
tactgcctgc

SEQ ID NO: 2143514 - DNA, 11 bp, Homo sapiens
tactgcctgct

SEQ ID NO: 2143515 - DNA, 12 bp, Homo sapiens
tactgcctgctt

SEQ ID NO: 2143516 - DNA, 16 bp, Homo sapiens
tactgcctgcttgggg

SEQ ID NO: 2143517 - DNA, 14 bp, Homo sapiens
tactgctgcaaagt

SEQ ID NO: 2143518 - DNA, 23 bp, Homo sapiens
tactgctgtcattgtccatgcct

SEQ ID NO: 2143519 - DNA, 19 bp, Homo sapiens
tactggaccccgcctccca

SEQ ID NO: 2143520 - DNA, 11 bp, Homo sapiens
tactggcagct

SEQ ID NO: 2143521 - DNA, 18 bp, Homo sapiens
tactggcattaattatta

SEQ ID NO: 2143522 - DNA, 16 bp, Homo sapiens
tactgggttatttttg

SEQ ID NO: 2143523 - DNA, 23 bp, Homo sapiens
tactgggttatttttgtccctgc

SEQ ID NO: 2143524 - DNA, 14 bp, Homo sapiens
tactgtaaatgtat

SEQ ID NO: 2143525 - DNA, 20 bp, Homo sapiens
tactgtaattttgtttgtaa

SEQ ID NO: 2143526 - DNA, 17 bp, Homo sapiens
tactgtctgtaagagaa

SEQ ID NO: 2143527 - DNA, 15 bp, Homo sapiens
tactgtgcatacatg

SEQ ID NO: 2143528 - DNA, 16 bp, Homo sapiens
tactgtggaaaaatat

SEQ ID NO: 2143529 - DNA, 17 bp, Homo sapiens
tacttaaatgaaagcat

SEQ ID NO: 2143530 - DNA, 17 bp, Homo sapiens
tacttaacattgattta

SEQ ID NO: 2143531 - DNA, 19 bp, Homo sapiens
tacttacatgcattactgc

SEQ ID NO: 2143532 - DNA, 18 bp, Homo sapiens
tacttatttacctataaa

SEQ ID NO: 2143533 - DNA, 20 bp, Homo sapiens
tacttattttccaataaaat

SEQ ID NO: 2143534 - DNA, 19 bp, Homo sapiens
tacttatttttgacagtgt

SEQ ID NO: 2143535 - DNA, 23 bp, Homo sapiens
tacttcaagttaaagtgaataac

SEQ ID NO: 2143536 - DNA, 16 bp, Homo sapiens
tacttcactttaattc

SEQ ID NO: 2143537 - DNA, 23 bp, Homo sapiens
tacttcaggtgcttttgatgtga

SEQ ID NO: 2143538 - DNA, 11 bp, Homo sapiens
tacttcatgag

SEQ ID NO: 2143539 - DNA, 23 bp, Homo sapiens
tacttcctgtgacttcagctctg

SEQ ID NO: 2143540 - DNA, 13 bp, Homo sapiens
tacttcctgtgta

SEQ ID NO: 2143541 - DNA, 13 bp, Homo sapiens
tacttctccaccc

SEQ ID NO: 2143542 - DNA, 20 bp, Homo sapiens
tacttctccaccctgctctc

SEQ ID NO: 2143543 - DNA, 21 bp, Homo sapiens
tacttctgagaccttgtttca

SEQ ID NO: 2143544 - DNA, 15 bp, Homo sapiens
tacttctgctacata

SEQ ID NO: 2143545 - DNA, 18 bp, Homo sapiens
tacttcttcattcaatac

SEQ ID NO: 2143546 - DNA, 16 bp, Homo sapiens
tacttcttggaaaaaa

SEQ ID NO: 2143547 - DNA, 20 bp, Homo sapiens
tacttgaaaaaatgttctat

SEQ ID NO: 2143548 - DNA, 22 bp, Homo sapiens
tacttgaactttccaaaaccta

SEQ ID NO: 2143549 - DNA, 17 bp, Homo sapiens
tacttgagctgtatata

SEQ ID NO: 2143550 - DNA, 22 bp, Homo sapiens
tacttgcacaagcttgtatata

SEQ ID NO: 2143551 - DNA, 21 bp, Homo sapiens
tacttgggagacctgtaatca

SEQ ID NO: 2143552 - DNA, 19 bp, Homo sapiens
tacttggtgtaattaataa

SEQ ID NO: 2143553 - DNA, 15 bp, Homo sapiens
tacttgtagaaatct

SEQ ID NO: 2143554 - DNA, 14 bp, Homo sapiens
tacttgtctgaggc

SEQ ID NO: 2143555 - DNA, 15 bp, Homo sapiens
tacttgtctgaggcc

SEQ ID NO: 2143556 - DNA, 16 bp, Homo sapiens
tacttgtctgaggcct

SEQ ID NO: 2143557 - DNA, 15 bp, Homo sapiens
tacttgtggacacag

SEQ ID NO: 2143558 - DNA, 21 bp, Homo sapiens
tactttacactctctgtacaa

SEQ ID NO: 2143559 - DNA, 20 bp, Homo sapiens
tactttatctgtgaccacac

SEQ ID NO: 2143560 - DNA, 20 bp, Homo sapiens
tactttatgttactacatgc

SEQ ID NO: 2143561 - DNA, 19 bp, Homo sapiens
tactttgccttttgcaaac

SEQ ID NO: 2143562 - DNA, 22 bp, Homo sapiens
tactttgccttttgcaaacttt

SEQ ID NO: 2143563 - DNA, 24 bp, Homo sapiens
tactttggaatgactataaacatt

SEQ ID NO: 2143564 - DNA, 16 bp, Homo sapiens
tactttgtatttgtat

SEQ ID NO: 2143565 - DNA, 21 bp, Homo sapiens
tacttttaaacagtgagcctg

SEQ ID NO: 2143566 - DNA, 20 bp, Homo sapiens
tacttttaattcctagaggg

SEQ ID NO: 2143567 - DNA, 17 bp, Homo sapiens
tacttttgtcttcctca

SEQ ID NO: 2143568 - DNA, 13 bp, Homo sapiens
tacttttgtttca

SEQ ID NO: 2143569 - DNA, 14 bp, Homo sapiens
tacttttgtttcag

SEQ ID NO: 2143570 - DNA, 16 bp, Homo sapiens
tactttttatactcca

SEQ ID NO: 2143571 - DNA, 14 bp, Homo sapiens
tacttttttcttat

SEQ ID NO: 2143572 - DNA, 16 bp, Homo sapiens
tagaaaacattcatcc

SEQ ID NO: 2143573 - DNA, 11 bp, Homo sapiens
tagaaaacttt

SEQ ID NO: 2143574 - DNA, 15 bp, Homo sapiens
tagaaaactttaaag

SEQ ID NO: 2143575 - DNA, 18 bp, Homo sapiens
tagaaaagatgagaggca

SEQ ID NO: 2143576 - DNA, 21 bp, Homo sapiens
tagaaaaggctaggtacacag

SEQ ID NO: 2143577 - DNA, 14 bp, Homo sapiens
tagaaacatgacac

SEQ ID NO: 2143578 - DNA, 17 bp, Homo sapiens
tagaaacatgacactga

SEQ ID NO: 2143579 - DNA, 23 bp, Homo sapiens
tagaaacatggttttgaaatgct

SEQ ID NO: 2143580 - DNA, 19 bp, Homo sapiens
tagaaactcaccatgtaaa

SEQ ID NO: 2143581 - DNA, 20 bp, Homo sapiens
tagaaagaaaagaccctgag

SEQ ID NO: 2143582 - DNA, 17 bp, Homo sapiens
tagaaagacagagctgg

SEQ ID NO: 2143583 - DNA, 22 bp, Homo sapiens
tagaaaggggcagtttaaagca

SEQ ID NO: 2143584 - DNA, 23 bp, Homo sapiens
tagaaagttattgtgttgcctta

SEQ ID NO: 2143585 - DNA, 12 bp, Homo sapiens
tagaaataagtg

SEQ ID NO: 2143586 - DNA, 22 bp, Homo sapiens
tagaaatagctccgtggagcag

SEQ ID NO: 2143587 - DNA, 14 bp, Homo sapiens
tagaaatcattgta

SEQ ID NO: 2143588 - DNA, 16 bp, Homo sapiens
tagaaatcattttgca

SEQ ID NO: 2143589 - DNA, 17 bp, Homo sapiens
tagaaatcattttgcaa

SEQ ID NO: 2143590 - DNA, 14 bp, Homo sapiens
tagaaatctgtaat

SEQ ID NO: 2143591 - DNA, 22 bp, Homo sapiens
tagaaattaccagagttgttct

SEQ ID NO: 2143592 - DNA, 18 bp, Homo sapiens
tagaaattagctgtgtga

SEQ ID NO: 2143593 - DNA, 23 bp, Homo sapiens
tagaacaatagctattgcatgta

SEQ ID NO: 2143594 - DNA, 14 bp, Homo sapiens
tagaacacccactg

SEQ ID NO: 2143595 - DNA, 17 bp, Homo sapiens
tagaacacccactggcc

SEQ ID NO: 2143596 - DNA, 19 bp, Homo sapiens
tagaacacccactggccag

SEQ ID NO: 2143597 - DNA, 18 bp, Homo sapiens
tagaacataaagcaaata

SEQ ID NO: 2143598 - DNA, 22 bp, Homo sapiens
tagaacataaagcaaatagaca

SEQ ID NO: 2143599 - DNA, 14 bp, Homo sapiens
tagaacatgcacat

SEQ ID NO: 2143600 - DNA, 22 bp, Homo sapiens
tagaacatggagagctagaacc

SEQ ID NO: 2143601 - DNA, 16 bp, Homo sapiens
tagaaccaagcttcag

SEQ ID NO: 2143602 - DNA, 21 bp, Homo sapiens
tagaaccaagcttcagagcct

SEQ ID NO: 2143603 - DNA, 13 bp, Homo sapiens
tagaacctagaag

SEQ ID NO: 2143604 - DNA, 17 bp, Homo sapiens
tagaacctggaagggct

SEQ ID NO: 2143605 - DNA, 20 bp, Homo sapiens
tagaactgtatgtcagacat

SEQ ID NO: 2143606 - DNA, 23 bp, Homo sapiens
tagaacttcaagaagtaagagct

SEQ ID NO: 2143607 - DNA, 22 bp, Homo sapiens
tagaagaaagggcaagaaggaa

SEQ ID NO: 2143608 - DNA, 23 bp, Homo sapiens
tagaagaaagggcaagaaggaaa

SEQ ID NO: 2143609 - DNA, 18 bp, Homo sapiens
tagaagagcctgactgtg

SEQ ID NO: 2143610 - DNA, 18 bp, Homo sapiens
tagaagcggtttccaggc

SEQ ID NO: 2143611 - DNA, 17 bp, Homo sapiens
tagaagctggaggacta

SEQ ID NO: 2143612 - DNA, 11 bp, Homo sapiens
tagaaggccac

SEQ ID NO: 2143613 - DNA, 19 bp, Homo sapiens
tagaaggccacatgtcacc

SEQ ID NO: 2143614 - DNA, 24 bp, Homo sapiens
tagaagggctagaacctggagagc

SEQ ID NO: 2143615 - DNA, 16 bp, Homo sapiens
tagaagtcacacagta

SEQ ID NO: 2143616 - DNA, 16 bp, Homo sapiens
tagaagtggaccagga

SEQ ID NO: 2143617 - DNA, 16 bp, Homo sapiens
taggagataccaggtt

SEQ ID NO: 2143618 - DNA, 16 bp, Homo sapiens
taggagcaaagcctgt

SEQ ID NO: 2143619 - DNA, 17 bp, Homo sapiens
taggagcaaagcctgtt

SEQ ID NO: 2143620 - DNA, 14 bp, Homo sapiens
taggagcagagctc

SEQ ID NO: 2143621 - DNA, 15 bp, Homo sapiens
taggaggaccccggg

SEQ ID NO: 2143622 - DNA, 21 bp, Homo sapiens
taggaggttccggtgtctgga

SEQ ID NO: 2143623 - DNA, 17 bp, Homo sapiens
taggagttcgagaccag

SEQ ID NO: 2143624 - DNA, 15 bp, Homo sapiens
taggatacaatgtat

SEQ ID NO: 2143625 - DNA, 17 bp, Homo sapiens
taggatataaaacacat

SEQ ID NO: 2143626 - DNA, 20 bp, Homo sapiens
taggatcatttgttggaatg

SEQ ID NO: 2143627 - DNA, 13 bp, Homo sapiens
taggatgtttttc

SEQ ID NO: 2143628 - DNA, 17 bp, Homo sapiens
taggatttatttaaaat

SEQ ID NO: 2143629 - DNA, 12 bp, Homo sapiens
taggcagagcct

SEQ ID NO: 2143630 - DNA, 13 bp, Homo sapiens
taggcagcagctt

SEQ ID NO: 2143631 - DNA, 13 bp, Homo sapiens
taggcagcctgcc

SEQ ID NO: 2143632 - DNA, 21 bp, Homo sapiens
taggcatgagggatcacaggg

SEQ ID NO: 2143633 - DNA, 13 bp, Homo sapiens
taggcattattta

SEQ ID NO: 2143634 - DNA, 17 bp, Homo sapiens
taggcattatttaatgt

SEQ ID NO: 2143635 - DNA, 13 bp, Homo sapiens
taggccactcctc

SEQ ID NO: 2143636 - DNA, 16 bp, Homo sapiens
taggccatttgtattt

SEQ ID NO: 2143637 - DNA, 15 bp, Homo sapiens
taggcccttgtcctg

SEQ ID NO: 2143638 - DNA, 16 bp, Homo sapiens
taggcctcctctctgc

SEQ ID NO: 2143639 - DNA, 18 bp, Homo sapiens
taggcgagtgccaggact

SEQ ID NO: 2143640 - DNA, 19 bp, Homo sapiens
taggcggtcatgtgtgcat

SEQ ID NO: 2143641 - DNA, 20 bp, Homo sapiens
taggcggtcatgtgtgcatg

SEQ ID NO: 2143642 - DNA, 19 bp, Homo sapiens
taggctctgaaatcttggg

SEQ ID NO: 2143643 - DNA, 23 bp, Homo sapiens
taggctgccccgggtccccagct

SEQ ID NO: 2143644 - DNA, 14 bp, Homo sapiens
taggctggagaagc

SEQ ID NO: 2143645 - DNA, 19 bp, Homo sapiens
taggctggagaagctcacc

SEQ ID NO: 2143646 - DNA, 17 bp, Homo sapiens
taggcttatcaaaatct

SEQ ID NO: 2143647 - DNA, 20 bp, Homo sapiens
tagggaagaaaactatcctg

SEQ ID NO: 2143648 - DNA, 21 bp, Homo sapiens
tagggaatggcacagcccaaa

SEQ ID NO: 2143649 - DNA, 22 bp, Homo sapiens
tagggcaggagtgagaggtctc

SEQ ID NO: 2143650 - DNA, 14 bp, Homo sapiens
tagggccaggcagg

SEQ ID NO: 2143651 - DNA, 18 bp, Homo sapiens
tagggcttatggccaggg

SEQ ID NO: 2143652 - DNA, 17 bp, Homo sapiens
taggggaagtatgtgtg

SEQ ID NO: 2143653 - DNA, 18 bp, Homo sapiens
taggggaagtatgtgtgg

SEQ ID NO: 2143654 - DNA, 11 bp, Homo sapiens
taggggagggt

SEQ ID NO: 2143655 - DNA, 19 bp, Homo sapiens
taggggagggtggggcaat

SEQ ID NO: 2143656 - DNA, 22 bp, Homo sapiens
taggggagtgtgggtgatcaga

SEQ ID NO: 2143657 - DNA, 16 bp, Homo sapiens
taggggtaatatattg

SEQ ID NO: 2143658 - DNA, 23 bp, Homo sapiens
tagggtcaggcggggtgctgtgg

SEQ ID NO: 2143659 - DNA, 22 bp, Homo sapiens
tagggtctggaacaccaggctg

SEQ ID NO: 2143660 - DNA, 14 bp, Homo sapiens
taggtaggaaatgt

SEQ ID NO: 2143661 - DNA, 14 bp, Homo sapiens
taggtatacagtgg

SEQ ID NO: 2143662 - DNA, 19 bp, Homo sapiens
taggtattaaagatgtgtt

SEQ ID NO: 2143663 - DNA, 14 bp, Homo sapiens
taggtatttcaaaa

SEQ ID NO: 2143664 - DNA, 12 bp, Homo sapiens
taggtcattttc

SEQ ID NO: 2143665 - DNA, 15 bp, Homo sapiens
taggtccaagggcca

SEQ ID NO: 2143666 - DNA, 14 bp, Homo sapiens
taggtcctggcttc

SEQ ID NO: 2143667 - DNA, 17 bp, Homo sapiens
taggtgaaagtgtaata

SEQ ID NO: 2143668 - DNA, 11 bp, Homo sapiens
taggtgacaga

SEQ ID NO: 2143669 - DNA, 23 bp, Homo sapiens
taggtgacagagtgagactctgt

SEQ ID NO: 2143670 - DNA, 15 bp, Homo sapiens
taggtgccaggctgt

SEQ ID NO: 2143671 - DNA, 13 bp, Homo sapiens
taggtgcctcctg

SEQ ID NO: 2143672 - DNA, 16 bp, Homo sapiens
taggtggatcacctga

SEQ ID NO: 2143673 - DNA, 18 bp, Homo sapiens
taggtttgagttcaaatt

SEQ ID NO: 2143674 - DNA, 15 bp, Homo sapiens
taggtttttgtttgt

SEQ ID NO: 2143675 - DNA, 21 bp, Homo sapiens
tagtaaatcacgctttttgaa

SEQ ID NO: 2143676 - DNA, 16 bp, Homo sapiens
tagtaagaaaacatca

SEQ ID NO: 2143677 - DNA, 19 bp, Homo sapiens
tagtaatgggccaattaaa

SEQ ID NO: 2143678 - DNA, 16 bp, Homo sapiens
tagtacagtagcttaa

SEQ ID NO: 2143679 - DNA, 23 bp, Homo sapiens
tagtacagtagcttaaataaatt

SEQ ID NO: 2143680 - DNA, 23 bp, Homo sapiens
tagtaccaatcattttaattatt

SEQ ID NO: 2143681 - DNA, 19 bp, Homo sapiens
tagtaccctatagagaggg

SEQ ID NO: 2143682 - DNA, 22 bp, Homo sapiens
tagtaccctatagagagggggc

SEQ ID NO: 2143683 - DNA, 17 bp, Homo sapiens
tagtactcctgcaaaat

SEQ ID NO: 2143684 - DNA, 21 bp, Homo sapiens
tagtactcctgcaaaatttta

SEQ ID NO: 2143685 - DNA, 22 bp, Homo sapiens
tagtagagacagggttttgcca

SEQ ID NO: 2143686 - DNA, 16 bp, Homo sapiens
tagtagccctttctgt

SEQ ID NO: 2143687 - DNA, 23 bp, Homo sapiens
tagtagtcaattagtacagtagc

SEQ ID NO: 2143688 - DNA, 13 bp, Homo sapiens
tagtagtgtcttc

SEQ ID NO: 2143689 - DNA, 17 bp, Homo sapiens
tagtagttgatgaccaa

SEQ ID NO: 2143690 - DNA, 22 bp, Homo sapiens
tagtagttgatgaccaatctct

SEQ ID NO: 2143691 - DNA, 14 bp, Homo sapiens
tagtagtttgggtg

SEQ ID NO: 2143692 - DNA, 14 bp, Homo sapiens
tagtataaagaaaa

SEQ ID NO: 2143693 - DNA, 14 bp, Homo sapiens
tagtataccataca

SEQ ID NO: 2143694 - DNA, 19 bp, Homo sapiens
tagtatatctggacaagcc

SEQ ID NO: 2143695 - DNA, 16 bp, Homo sapiens
tagtatatttatactc

SEQ ID NO: 2143696 - DNA, 17 bp, Homo sapiens
tagtatatttatactct

SEQ ID NO: 2143697 - DNA, 13 bp, Homo sapiens
tagtatcctgtta

SEQ ID NO: 2143698 - DNA, 17 bp, Homo sapiens
tagtatgatttttacaa

SEQ ID NO: 2143699 - DNA, 16 bp, Homo sapiens
tagtatggcctgtgtc

SEQ ID NO: 2143700 - DNA, 19 bp, Homo sapiens
tagtatggcctgtgtcact

SEQ ID NO: 2143701 - DNA, 16 bp, Homo sapiens
tagtatggtggctggg

SEQ ID NO: 2143702 - DNA, 15 bp, Homo sapiens
tagtatggttctcag

SEQ ID NO: 2143703 - DNA, 14 bp, Homo sapiens
tagtattgaaagtg

SEQ ID NO: 2143704 - DNA, 17 bp, Homo sapiens
tagtcacaaaaatggtg

SEQ ID NO: 2143705 - DNA, 18 bp, Homo sapiens
tagtcacaaaaatggtgg

SEQ ID NO: 2143706 - DNA, 14 bp, Homo sapiens
tagtcacaccatct

SEQ ID NO: 2143707 - DNA, 13 bp, Homo sapiens
tagtcagcgcagt

SEQ ID NO: 2143708 - DNA, 21 bp, Homo sapiens
tagtccaaatgtgatcaactg

SEQ ID NO: 2143709 - DNA, 15 bp, Homo sapiens
tagtccaatatttgg

SEQ ID NO: 2143710 - DNA, 16 bp, Homo sapiens
tagtccaatatttggc

SEQ ID NO: 2143711 - DNA, 18 bp, Homo sapiens
tagtccaatgtcttttta

SEQ ID NO: 2143712 - DNA, 22 bp, Homo sapiens
tagtccaatgtctttttaagct

SEQ ID NO: 2143713 - DNA, 21 bp, Homo sapiens
tagtcccagctactcagaagc

SEQ ID NO: 2143714 - DNA, 20 bp, Homo sapiens
tagtccccatcagcaccatg

SEQ ID NO: 2143715 - DNA, 18 bp, Homo sapiens
tagtcctagaggacctga

SEQ ID NO: 2143716 - DNA, 17 bp, Homo sapiens
tagtccttggtctgctg

SEQ ID NO: 2143717 - DNA, 18 bp, Homo sapiens
tagtctcctttgcactga

SEQ ID NO: 2143718 - DNA, 17 bp, Homo sapiens
tagtctctgtgctttga

SEQ ID NO: 2143719 - DNA, 12 bp, Homo sapiens
tagtgaagatgt

SEQ ID NO: 2143720 - DNA, 23 bp, Homo sapiens
tagtgagtgtggcttagtaatag

SEQ ID NO: 2143721 - DNA, 20 bp, Homo sapiens
tagtgatgttgtttgggaga

SEQ ID NO: 2143722 - DNA, 22 bp, Homo sapiens
tagtgcccacttgaggctggca

SEQ ID NO: 2143723 - DNA, 22 bp, Homo sapiens
tagtgccccctctaacccccag

SEQ ID NO: 2143724 - DNA, 17 bp, Homo sapiens
tagtgccctccacagcc

SEQ ID NO: 2143725 - DNA, 14 bp, Homo sapiens
tagtgctatatata

SEQ ID NO: 2143726 - DNA, 16 bp, Homo sapiens
tagtgctattctgtgt

SEQ ID NO: 2143727 - DNA, 17 bp, Homo sapiens
tagtgctttattttgtt

SEQ ID NO: 2143728 - DNA, 18 bp, Homo sapiens
tagtggaagagcagcctg

SEQ ID NO: 2143729 - DNA, 23 bp, Homo sapiens
tagtggaagagcagcctgatggc

SEQ ID NO: 2143730 - DNA, 15 bp, Homo sapiens
tagtggcttcctccg

SEQ ID NO: 2143731 - DNA, 16 bp, Homo sapiens
tagtggggtaattctg

SEQ ID NO: 2143732 - DNA, 15 bp, Homo sapiens
tatgagctcttcatg

SEQ ID NO: 2143733 - DNA, 16 bp, Homo sapiens
tatgagctcttcatgt

SEQ ID NO: 2143734 - DNA, 23 bp, Homo sapiens
tatgagtaggtttggccccctca

SEQ ID NO: 2143735 - DNA, 21 bp, Homo sapiens
tatgagtttttgatagcttta

SEQ ID NO: 2143736 - DNA, 21 bp, Homo sapiens
tatgatcacggctcactgcag

SEQ ID NO: 2143737 - DNA, 13 bp, Homo sapiens
tatgatccaagta

SEQ ID NO: 2143738 - DNA, 14 bp, Homo sapiens
tatgatccttgttt

SEQ ID NO: 2143739 - DNA, 13 bp, Homo sapiens
tatgatctcagga

SEQ ID NO: 2143740 - DNA, 21 bp, Homo sapiens
tatgatgggtgtttttagcag

SEQ ID NO: 2143741 - DNA, 17 bp, Homo sapiens
tatgatgtgttgtgata

SEQ ID NO: 2143742 - DNA, 18 bp, Homo sapiens
tatgattttctatttttc

SEQ ID NO: 2143743 - DNA, 21 bp, Homo sapiens
tatgattttttaaaagaaatt

SEQ ID NO: 2143744 - DNA, 15 bp, Homo sapiens
tatgcaaagcactga

SEQ ID NO: 2143745 - DNA, 17 bp, Homo sapiens
tatgcaagaagaatata

SEQ ID NO: 2143746 - DNA, 20 bp, Homo sapiens
tatgcacatatggactctgc

SEQ ID NO: 2143747 - DNA, 22 bp, Homo sapiens
tatgcaccttgtgtctgtacac

SEQ ID NO: 2143748 - DNA, 15 bp, Homo sapiens
tatgcacgaccttgg

SEQ ID NO: 2143749 - DNA, 13 bp, Homo sapiens
tatgcactggcca

SEQ ID NO: 2143750 - DNA, 17 bp, Homo sapiens
tatgcactggccaccca

SEQ ID NO: 2143751 - DNA, 20 bp, Homo sapiens
tatgcatggaaacctgaaaa

SEQ ID NO: 2143752 - DNA, 14 bp, Homo sapiens
tatgccagctcagt

SEQ ID NO: 2143753 - DNA, 22 bp, Homo sapiens
tatgccatagcaagattgctta

SEQ ID NO: 2143754 - DNA, 22 bp, Homo sapiens
tatgccgtataggatgtcagac

SEQ ID NO: 2143755 - DNA, 16 bp, Homo sapiens
tatgcctctgtattta

SEQ ID NO: 2143756 - DNA, 18 bp, Homo sapiens
tatgccttatgtaattat

SEQ ID NO: 2143757 - DNA, 17 bp, Homo sapiens
tatgccttcctgtttaa

SEQ ID NO: 2143758 - DNA, 17 bp, Homo sapiens
tatgctatttctggcct

SEQ ID NO: 2143759 - DNA, 19 bp, Homo sapiens
tatgctatttctggcctca

SEQ ID NO: 2143760 - DNA, 20 bp, Homo sapiens
tatgctatttctggcctcag

SEQ ID NO: 2143761 - DNA, 20 bp, Homo sapiens
tatgctgccaaattttggcc

SEQ ID NO: 2143762 - DNA, 13 bp, Homo sapiens
tatgctggccagc

SEQ ID NO: 2143763 - DNA, 13 bp, Homo sapiens
tatgctgtgttta

SEQ ID NO: 2143764 - DNA, 15 bp, Homo sapiens
tatgctgtgtttatg

SEQ ID NO: 2143765 - DNA, 19 bp, Homo sapiens
tatgcttattttaaaattt

SEQ ID NO: 2143766 - DNA, 22 bp, Homo sapiens
tatggaaaagggtcttcttggc

SEQ ID NO: 2143767 - DNA, 12 bp, Homo sapiens
tatggaaatata

SEQ ID NO: 2143768 - DNA, 15 bp, Homo sapiens
tatggaaatcctgtt

SEQ ID NO: 2143769 - DNA, 17 bp, Homo sapiens
tatggaactctctccac

SEQ ID NO: 2143770 - DNA, 16 bp, Homo sapiens
tatggaagggaggggt

SEQ ID NO: 2143771 - DNA, 17 bp, Homo sapiens
tatggaagggaggggtc

SEQ ID NO: 2143772 - DNA, 23 bp, Homo sapiens
tatggaatacagtgttattttct

SEQ ID NO: 2143773 - DNA, 16 bp, Homo sapiens
tatggactctgcacat

SEQ ID NO: 2143774 - DNA, 14 bp, Homo sapiens
tatggagagccctg

SEQ ID NO: 2143775 - DNA, 13 bp, Homo sapiens
tatggagcctggc

SEQ ID NO: 2143776 - DNA, 15 bp, Homo sapiens
tatggagggcagagt

SEQ ID NO: 2143777 - DNA, 22 bp, Homo sapiens
tatggagggcagagtgggctgc

SEQ ID NO: 2143778 - DNA, 16 bp, Homo sapiens
tatggattctaaaatg

SEQ ID NO: 2143779 - DNA, 23 bp, Homo sapiens
tatggcaagtgatatcacctctc

SEQ ID NO: 2143780 - DNA, 21 bp, Homo sapiens
tatggcagtccagccagctcc

SEQ ID NO: 2143781 - DNA, 16 bp, Homo sapiens
tatggcagtgtctttc

SEQ ID NO: 2143782 - DNA, 14 bp, Homo sapiens
tatggcatatttat

SEQ ID NO: 2143783 - DNA, 17 bp, Homo sapiens
tatggcatatttatatt

SEQ ID NO: 2143784 - DNA, 20 bp, Homo sapiens
tatggccctgcaaaaatata

SEQ ID NO: 2143785 - DNA, 16 bp, Homo sapiens
tatggctcttcacctg

SEQ ID NO: 2143786 - DNA, 17 bp, Homo sapiens
tatggcttataaatgtg

SEQ ID NO: 2143787 - DNA, 14 bp, Homo sapiens
tatgggtcctgcaa

SEQ ID NO: 2143788 - DNA, 15 bp, Homo sapiens
tatgggtcctgcaat

SEQ ID NO: 2143789 - DNA, 14 bp, Homo sapiens
tatgggtgctggca

SEQ ID NO: 2143790 - DNA, 13 bp, Homo sapiens
tatggtataatgg

SEQ ID NO: 2143791 - DNA, 18 bp, Homo sapiens
tatggtatgctggccagc

SEQ ID NO: 2143792 - DNA, 23 bp, Homo sapiens
tatggtatgctggccagcaccct

SEQ ID NO: 2143793 - DNA, 14 bp, Homo sapiens
tatggtatttgagt

SEQ ID NO: 2143794 - DNA, 22 bp, Homo sapiens
tatggtcaacacttaagggttt

SEQ ID NO: 2143795 - DNA, 18 bp, Homo sapiens
tatggtgtaatgcacaat

SEQ ID NO: 2143796 - DNA, 17 bp, Homo sapiens
tatggttcccaataaaa

SEQ ID NO: 2143797 - DNA, 14 bp, Homo sapiens
tatggttgattccc

SEQ ID NO: 2143798 - DNA, 15 bp, Homo sapiens
tatgtaaaacattta

SEQ ID NO: 2143799 - DNA, 15 bp, Homo sapiens
tatgtaaacaggaga

SEQ ID NO: 2143800 - DNA, 14 bp, Homo sapiens
tatgtaaacataat

SEQ ID NO: 2143801 - DNA, 12 bp, Homo sapiens
tatgtacagtta

SEQ ID NO: 2143802 - DNA, 18 bp, Homo sapiens
tatgtacagttatacata

SEQ ID NO: 2143803 - DNA, 14 bp, Homo sapiens
tatgtagaaatatt

SEQ ID NO: 2143804 - DNA, 22 bp, Homo sapiens
tatgtatacacacatatacata

SEQ ID NO: 2143805 - DNA, 23 bp, Homo sapiens
tatgtatatactatacaacaatg

SEQ ID NO: 2143806 - DNA, 18 bp, Homo sapiens
tatgtatatgtatatcta

SEQ ID NO: 2143807 - DNA, 20 bp, Homo sapiens
tatgtatggaatacagtgtt

SEQ ID NO: 2143808 - DNA, 17 bp, Homo sapiens
tatgtatgtgtgtatgg

SEQ ID NO: 2143809 - DNA, 16 bp, Homo sapiens
tatgtattattttcta

SEQ ID NO: 2143810 - DNA, 22 bp, Homo sapiens
tatgtattgtaaacatgtgttt

SEQ ID NO: 2143811 - DNA, 16 bp, Homo sapiens
tatgtcaatttgtata

SEQ ID NO: 2143812 - DNA, 20 bp, Homo sapiens
tatgtcagacatgaaaacta

SEQ ID NO: 2143813 - DNA, 15 bp, Homo sapiens
tatgtcatcatacat

SEQ ID NO: 2143814 - DNA, 19 bp, Homo sapiens
tatgtcatcatacatgact

SEQ ID NO: 2143815 - DNA, 12 bp, Homo sapiens
tatgtgaatgat

SEQ ID NO: 2143816 - DNA, 21 bp, Homo sapiens
tatgtgacaacctttgtgtaa

SEQ ID NO: 2143817 - DNA, 20 bp, Homo sapiens
tatgtgatatctgaacacat

SEQ ID NO: 2143818 - DNA, 16 bp, Homo sapiens
tatgtgcgtctctctt

SEQ ID NO: 2143819 - DNA, 17 bp, Homo sapiens
tatgtgtatatatacat

SEQ ID NO: 2143820 - DNA, 21 bp, Homo sapiens
tatgtgtatatatacatacac

SEQ ID NO: 2143821 - DNA, 17 bp, Homo sapiens
tatgtgtatttgtatgt

SEQ ID NO: 2143822 - DNA, 18 bp, Homo sapiens
tatgtgtcacagctctgt

SEQ ID NO: 2143823 - DNA, 12 bp, Homo sapiens
tatgtgtcatga

SEQ ID NO: 2143824 - DNA, 17 bp, Homo sapiens
tatgtgtgcatgtgtgt

SEQ ID NO: 2143825 - DNA, 18 bp, Homo sapiens
tatgtgtgcatgtgtgta

SEQ ID NO: 2143826 - DNA, 20 bp, Homo sapiens
tatgtgtgcatgtgtgtata

SEQ ID NO: 2143827 - DNA, 19 bp, Homo sapiens
tatgtgtgtatatgtatgt

SEQ ID NO: 2143828 - DNA, 21 bp, Homo sapiens
tatgtgtgtatgggtgtgtgt

SEQ ID NO: 2143829 - DNA, 19 bp, Homo sapiens
tatgtgtgtggtgtgtgtg

SEQ ID NO: 2143830 - DNA, 13 bp, Homo sapiens
tatgtgtgtgtat

SEQ ID NO: 2143831 - DNA, 17 bp, Homo sapiens
tatgtgtgtttaaataa

SEQ ID NO: 2143832 - DNA, 21 bp, Homo sapiens
tatgtgtgtttaaataaagta

SEQ ID NO: 2143833 - DNA, 19 bp, Homo sapiens
tatgttaagctctttatga

SEQ ID NO: 2143834 - DNA, 19 bp, Homo sapiens
tatgttacatctgttttaa

SEQ ID NO: 2143835 - DNA, 12 bp, Homo sapiens
tatgttcaatgc

SEQ ID NO: 2143836 - DNA, 16 bp, Homo sapiens
tatgttcagaagaaat

SEQ ID NO: 2143837 - DNA, 20 bp, Homo sapiens
tatgttcattaaattttcta

SEQ ID NO: 2143838 - DNA, 19 bp, Homo sapiens
tatgttgcccaggcaggtc

SEQ ID NO: 2143839 - DNA, 21 bp, Homo sapiens
tatgttgcccaggcaggtctt

SEQ ID NO: 2143840 - DNA, 19 bp, Homo sapiens
tatgtttgctttaatgtgt

SEQ ID NO: 2143841 - DNA, 13 bp, Homo sapiens
tatgtttttaatg

SEQ ID NO: 2143842 - DNA, 14 bp, Homo sapiens
tatgtttttgtgta

SEQ ID NO: 2143843 - DNA, 18 bp, Homo sapiens
tatgtttttgtgtatttg

SEQ ID NO: 2143844 - DNA, 20 bp, Homo sapiens
tattaaaaatatggaacttc

SEQ ID NO: 2143845 - DNA, 12 bp, Homo sapiens
tattaaaactca

SEQ ID NO: 2143846 - DNA, 17 bp, Homo sapiens
tattaaaatgattgtaa

SEQ ID NO: 2143847 - DNA, 21 bp, Homo sapiens
tcaagtagaaaatttcttata

SEQ ID NO: 2143848 - DNA, 21 bp, Homo sapiens
tcaagtataaagtcaggacct

SEQ ID NO: 2143849 - DNA, 23 bp, Homo sapiens
tcaagtataaagtcaggacctgg

SEQ ID NO: 2143850 - DNA, 14 bp, Homo sapiens
tcaagtccagagcc

SEQ ID NO: 2143851 - DNA, 17 bp, Homo sapiens
tcaagtgatatatgtat

SEQ ID NO: 2143852 - DNA, 21 bp, Homo sapiens
tcaagtgatatatgtatttat

SEQ ID NO: 2143853 - DNA, 16 bp, Homo sapiens
tcaagtgattctcctg

SEQ ID NO: 2143854 - DNA, 17 bp, Homo sapiens
tcaagtgattctcctgc

SEQ ID NO: 2143855 - DNA, 18 bp, Homo sapiens
tcaagtgattctcctgcc

SEQ ID NO: 2143856 - DNA, 20 bp, Homo sapiens
tcaagtgattctcctgcctc

SEQ ID NO: 2143857 - DNA, 22 bp, Homo sapiens
tcaagtgcctcttgttgcagag

SEQ ID NO: 2143858 - DNA, 15 bp, Homo sapiens
tcaagttgaggggct

SEQ ID NO: 2143859 - DNA, 23 bp, Homo sapiens
tcaagttgttccttaagtcagaa

SEQ ID NO: 2143860 - DNA, 13 bp, Homo sapiens
tcaataaagtatc

SEQ ID NO: 2143861 - DNA, 16 bp, Homo sapiens
tcaataggaattgcat

SEQ ID NO: 2143862 - DNA, 17 bp, Homo sapiens
tcaatagtcaagaaaaa

SEQ ID NO: 2143863 - DNA, 13 bp, Homo sapiens
tcaatatgcttac

SEQ ID NO: 2143864 - DNA, 14 bp, Homo sapiens
tcaatattaaatac

SEQ ID NO: 2143865 - DNA, 15 bp, Homo sapiens
tcaatattaaataca

SEQ ID NO: 2143866 - DNA, 21 bp, Homo sapiens
tcaatattaaatacagacact

SEQ ID NO: 2143867 - DNA, 15 bp, Homo sapiens
tcaatattcaataaa

SEQ ID NO: 2143868 - DNA, 20 bp, Homo sapiens
tcaatattgcctttgcctct

SEQ ID NO: 2143869 - DNA, 13 bp, Homo sapiens
tcaatatttaagt

SEQ ID NO: 2143870 - DNA, 17 bp, Homo sapiens
tcaatatttaagtttgt

SEQ ID NO: 2143871 - DNA, 11 bp, Homo sapiens
tcaatatttat

SEQ ID NO: 2143872 - DNA, 15 bp, Homo sapiens
tcaatattttccatg

SEQ ID NO: 2143873 - DNA, 18 bp, Homo sapiens
tcaatattttccatgaaa

SEQ ID NO: 2143874 - DNA, 21 bp, Homo sapiens
tcaatcagtctcagaatgtca

SEQ ID NO: 2143875 - DNA, 14 bp, Homo sapiens
tcaatcagtgcagt

SEQ ID NO: 2143876 - DNA, 15 bp, Homo sapiens
tcaatcccctcattc

SEQ ID NO: 2143877 - DNA, 14 bp, Homo sapiens
tcaatcctctaagc

SEQ ID NO: 2143878 - DNA, 16 bp, Homo sapiens
tcaatctatcaattac

SEQ ID NO: 2143879 - DNA, 20 bp, Homo sapiens
tcaatcttcggggtgtgatg

SEQ ID NO: 2143880 - DNA, 17 bp, Homo sapiens
tcaatgaaatatttgct

SEQ ID NO: 2143881 - DNA, 21 bp, Homo sapiens
tcaatgaaatatttgcttatt

SEQ ID NO: 2143882 - DNA, 16 bp, Homo sapiens
tcaatgcattgtcttg

SEQ ID NO: 2143883 - DNA, 19 bp, Homo sapiens
tcaatgcttttctagcaac

SEQ ID NO: 2143884 - DNA, 15 bp, Homo sapiens
tcaatggaaacaggg

SEQ ID NO: 2143885 - DNA, 15 bp, Homo sapiens
tcaatggacttcaaa

SEQ ID NO: 2143886 - DNA, 17 bp, Homo sapiens
tcaatgggcaatgacag

SEQ ID NO: 2143887 - DNA, 15 bp, Homo sapiens
tcaatgtcaagtacc

SEQ ID NO: 2143888 - DNA, 21 bp, Homo sapiens
tcaatgtgcaagttgtactgt

SEQ ID NO: 2143889 - DNA, 18 bp, Homo sapiens
tcaatgtggtgatgaaat

SEQ ID NO: 2143890 - DNA, 21 bp, Homo sapiens
tcaatgttcacgcaacttgaa

SEQ ID NO: 2143891 - DNA, 21 bp, Homo sapiens
tcaatgtttatgcaaggaagg

SEQ ID NO: 2143892 - DNA, 18 bp, Homo sapiens
tcaatgtttcttctaggt

SEQ ID NO: 2143893 - DNA, 14 bp, Homo sapiens
tcaatgtttttaaa

SEQ ID NO: 2143894 - DNA, 18 bp, Homo sapiens
tcaatgtttttaaaaatc

SEQ ID NO: 2143895 - DNA, 13 bp, Homo sapiens
tcaattaattctt

SEQ ID NO: 2143896 - DNA, 21 bp, Homo sapiens
tcaattattacatttatacat

SEQ ID NO: 2143897 - DNA, 15 bp, Homo sapiens
tcaattatttcaatg

SEQ ID NO: 2143898 - DNA, 14 bp, Homo sapiens
tcaattcaaaagct

SEQ ID NO: 2143899 - DNA, 17 bp, Homo sapiens
tcaattcaaagctgtgt

SEQ ID NO: 2143900 - DNA, 15 bp, Homo sapiens
tcaattcaacacatt

SEQ ID NO: 2143901 - DNA, 16 bp, Homo sapiens
tcaattcaacacatta

SEQ ID NO: 2143902 - DNA, 14 bp, Homo sapiens
tcaattccacctgc

SEQ ID NO: 2143903 - DNA, 21 bp, Homo sapiens
tcaattccatttaaaaaacaa

SEQ ID NO: 2143904 - DNA, 16 bp, Homo sapiens
tcaattcctctgggaa

SEQ ID NO: 2143905 - DNA, 14 bp, Homo sapiens
tcaattgtatttta

SEQ ID NO: 2143906 - DNA, 15 bp, Homo sapiens
tcaatttaaataacc

SEQ ID NO: 2143907 - DNA, 15 bp, Homo sapiens
tcaatttctgaacac

SEQ ID NO: 2143908 - DNA, 20 bp, Homo sapiens
tcaatttgtaattgcttaca

SEQ ID NO: 2143909 - DNA, 13 bp, Homo sapiens
tcaatttgtatat

SEQ ID NO: 2143910 - DNA, 15 bp, Homo sapiens
tcaatttttatacat

SEQ ID NO: 2143911 - DNA, 16 bp, Homo sapiens
tcaatttttatacata

SEQ ID NO: 2143912 - DNA, 21 bp, Homo sapiens
tcaatttttatacatatcaga

SEQ ID NO: 2143913 - DNA, 22 bp, Homo sapiens
tcaatttttatacatatcagaa

SEQ ID NO: 2143914 - DNA, 13 bp, Homo sapiens
tcacaaaatgcaa

SEQ ID NO: 2143915 - DNA, 14 bp, Homo sapiens
tcacaacagcctga

SEQ ID NO: 2143916 - DNA, 22 bp, Homo sapiens
tcacaacagcctgacaacattt

SEQ ID NO: 2143917 - DNA, 13 bp, Homo sapiens
tcacaacaggcat

SEQ ID NO: 2143918 - DNA, 20 bp, Homo sapiens
tcacaacataaggagaatgt

SEQ ID NO: 2143919 - DNA, 16 bp, Homo sapiens
tcacaaccagccacac

SEQ ID NO: 2143920 - DNA, 20 bp, Homo sapiens
tcacaaccagccacacagag

SEQ ID NO: 2143921 - DNA, 20 bp, Homo sapiens
tcacaacctccgtgctgggc

SEQ ID NO: 2143922 - DNA, 19 bp, Homo sapiens
tcacaactgtttttgaaga

SEQ ID NO: 2143923 - DNA, 21 bp, Homo sapiens
tcacaactgtttttgaagaag

SEQ ID NO: 2143924 - DNA, 17 bp, Homo sapiens
tcacaagcaataattag

SEQ ID NO: 2143925 - DNA, 18 bp, Homo sapiens
tcacaagcacaaagctca

SEQ ID NO: 2143926 - DNA, 16 bp, Homo sapiens
tcacaaggtcaggagt

SEQ ID NO: 2143927 - DNA, 15 bp, Homo sapiens
tcacaataattttct

SEQ ID NO: 2143928 - DNA, 14 bp, Homo sapiens
tcacaatagaaact

SEQ ID NO: 2143929 - DNA, 17 bp, Homo sapiens
tcacaattccatttcca

SEQ ID NO: 2143930 - DNA, 21 bp, Homo sapiens
tcacacacaggcaactgaggc

SEQ ID NO: 2143931 - DNA, 12 bp, Homo sapiens
tcacacagagat

SEQ ID NO: 2143932 - DNA, 19 bp, Homo sapiens
tcacacaggcatttcctgg

SEQ ID NO: 2143933 - DNA, 22 bp, Homo sapiens
tcacacagtgagtcgaggacag

SEQ ID NO: 2143934 - DNA, 15 bp, Homo sapiens
tcacaccctaataag

SEQ ID NO: 2143935 - DNA, 19 bp, Homo sapiens
tcacacctcacgctctgga

SEQ ID NO: 2143936 - DNA, 15 bp, Homo sapiens
tcacacctctgggct

SEQ ID NO: 2143937 - DNA, 13 bp, Homo sapiens
tcacactctgggt

SEQ ID NO: 2143938 - DNA, 11 bp, Homo sapiens
tcacactgatg

SEQ ID NO: 2143939 - DNA, 21 bp, Homo sapiens
tcacactgcaagagccttggt

SEQ ID NO: 2143940 - DNA, 21 bp, Homo sapiens
tcacactgtgcgttttagagt

SEQ ID NO: 2143941 - DNA, 21 bp, Homo sapiens
tcacagaacccttggagccaa

SEQ ID NO: 2143942 - DNA, 11 bp, Homo sapiens
tcacagaagaa

SEQ ID NO: 2143943 - DNA, 22 bp, Homo sapiens
tcacagatgggtattaaacttg

SEQ ID NO: 2143944 - DNA, 15 bp, Homo sapiens
tcacagcagaatgaa

SEQ ID NO: 2143945 - DNA, 16 bp, Homo sapiens
tcacagcagaatgaag

SEQ ID NO: 2143946 - DNA, 22 bp, Homo sapiens
tcacagcagaatgaagacctaa

SEQ ID NO: 2143947 - DNA, 17 bp, Homo sapiens
tcacagccagactggca

SEQ ID NO: 2143948 - DNA, 23 bp, Homo sapiens
tcacagcccgggtgtgcctgccc

SEQ ID NO: 2143949 - DNA, 13 bp, Homo sapiens
tcacagcctctcc

SEQ ID NO: 2143950 - DNA, 14 bp, Homo sapiens
tcacagcctctccc

SEQ ID NO: 2143951 - DNA, 16 bp, Homo sapiens
tcacagcctctccctt

SEQ ID NO: 2143952 - DNA, 12 bp, Homo sapiens
tcacagctgcag

SEQ ID NO: 2143953 - DNA, 14 bp, Homo sapiens
tcacagctgcagct

SEQ ID NO: 2143954 - DNA, 16 bp, Homo sapiens
tcacagctgcagctgg

SEQ ID NO: 2143955 - DNA, 18 bp, Homo sapiens
tcacaggactctgcctcc

SEQ ID NO: 2143956 - DNA, 19 bp, Homo sapiens
tcacaggactctgcctcct

SEQ ID NO: 2143957 - DNA, 12 bp, Homo sapiens
tcacaggagcag

SEQ ID NO: 2143958 - DNA, 15 bp, Homo sapiens
tcacaggagcagaca

SEQ ID NO: 2143959 - DNA, 18 bp, Homo sapiens
tcacaggagcagacagag

SEQ ID NO: 2143960 - DNA, 21 bp, Homo sapiens
tcacaggagcagacagagaaa

SEQ ID NO: 2143961 - DNA, 11 bp, Homo sapiens
tcacaggcagg

SEQ ID NO: 2143962 - DNA, 23 bp, Homo sapiens
tcagccaaatgtaattgaataaa

SEQ ID NO: 2143963 - DNA, 16 bp, Homo sapiens
tcagccacacctgtca

SEQ ID NO: 2143964 - DNA, 20 bp, Homo sapiens
tcagccaccctgaggcctct

SEQ ID NO: 2143965 - DNA, 20 bp, Homo sapiens
tcagccagaatcttcgtcct

SEQ ID NO: 2143966 - DNA, 23 bp, Homo sapiens
tcagccagccgccctgggctgtc

SEQ ID NO: 2143967 - DNA, 12 bp, Homo sapiens
tcagccagggcc

SEQ ID NO: 2143968 - DNA, 23 bp, Homo sapiens
tcagccatgaggagttgctgttt

SEQ ID NO: 2143969 - DNA, 18 bp, Homo sapiens
tcagccccgggcctgcct

SEQ ID NO: 2143970 - DNA, 19 bp, Homo sapiens
tcagccccgggcctgcctc

SEQ ID NO: 2143971 - DNA, 16 bp, Homo sapiens
tcagcccctagtgcta

SEQ ID NO: 2143972 - DNA, 13 bp, Homo sapiens
tcagcccgggaca

SEQ ID NO: 2143973 - DNA, 13 bp, Homo sapiens
tcagccctccctg

SEQ ID NO: 2143974 - DNA, 17 bp, Homo sapiens
tcagccctccctgcccc

SEQ ID NO: 2143975 - DNA, 22 bp, Homo sapiens
tcagccctgggccccaccacct

SEQ ID NO: 2143976 - DNA, 23 bp, Homo sapiens
tcagccctgggccccaccaccta

SEQ ID NO: 2143977 - DNA, 21 bp, Homo sapiens
tcagcccttgcccccatccct

SEQ ID NO: 2143978 - DNA, 19 bp, Homo sapiens
tcagccgagccgggcctgg

SEQ ID NO: 2143979 - DNA, 21 bp, Homo sapiens
tcagccggcgtggcaaatata

SEQ ID NO: 2143980 - DNA, 20 bp, Homo sapiens
tcagcctagccgacctcagc

SEQ ID NO: 2143981 - DNA, 22 bp, Homo sapiens
tcagcctcccaaagtgctggga

SEQ ID NO: 2143982 - DNA, 22 bp, Homo sapiens
tcagcctcccagagtgctagga

SEQ ID NO: 2143983 - DNA, 17 bp, Homo sapiens
tcagcctccccctgctg

SEQ ID NO: 2143984 - DNA, 18 bp, Homo sapiens
tcagcctcccgagtagct

SEQ ID NO: 2143985 - DNA, 21 bp, Homo sapiens
tcagcctcccgagtagctggg

SEQ ID NO: 2143986 - DNA, 22 bp, Homo sapiens
tcagcctcccgagtagctggga

SEQ ID NO: 2143987 - DNA, 22 bp, Homo sapiens
tcagcctcctaagcagctggga

SEQ ID NO: 2143988 - DNA, 12 bp, Homo sapiens
tcagcctcttaa

SEQ ID NO: 2143989 - DNA, 21 bp, Homo sapiens
tcagcctcttaaagctgcctg

SEQ ID NO: 2143990 - DNA, 22 bp, Homo sapiens
tcagcctcttaaagctgcctgt

SEQ ID NO: 2143991 - DNA, 13 bp, Homo sapiens
tcagcctgaggct

SEQ ID NO: 2143992 - DNA, 18 bp, Homo sapiens
tcagcctgaggctgagac

SEQ ID NO: 2143993 - DNA, 11 bp, Homo sapiens
tcagcctgagt

SEQ ID NO: 2143994 - DNA, 16 bp, Homo sapiens
tcagcctgagtctcct

SEQ ID NO: 2143995 - DNA, 19 bp, Homo sapiens
tcagcctgagtctcctgtg

SEQ ID NO: 2143996 - DNA, 19 bp, Homo sapiens
tcagcctggtgggcctcct

SEQ ID NO: 2143997 - DNA, 18 bp, Homo sapiens
tcagccttgaaaaacaag

SEQ ID NO: 2143998 - DNA, 21 bp, Homo sapiens
tcagccttgaaaaacaagtct

SEQ ID NO: 2143999 - DNA, 19 bp, Homo sapiens
tcagcggggacagctcctt

SEQ ID NO: 2144000 - DNA, 18 bp, Homo sapiens
tcagcgtgcttagcctcc

SEQ ID NO: 2144001 - DNA, 13 bp, Homo sapiens
tcagcgtggcctt

SEQ ID NO: 2144002 - DNA, 19 bp, Homo sapiens
tcagctacttaagagaaat

SEQ ID NO: 2144003 - DNA, 12 bp, Homo sapiens
tcagctccagct

SEQ ID NO: 2144004 - DNA, 14 bp, Homo sapiens
tcagctccagctca

SEQ ID NO: 2144005 - DNA, 21 bp, Homo sapiens
tcagctccagctcaccagccc

SEQ ID NO: 2144006 - DNA, 22 bp, Homo sapiens
tcagctccagctcaccagcccc

SEQ ID NO: 2144007 - DNA, 22 bp, Homo sapiens
tcagctcccttcccctgcctgg

SEQ ID NO: 2144008 - DNA, 17 bp, Homo sapiens
tcagctctcctgctgca

SEQ ID NO: 2144009 - DNA, 15 bp, Homo sapiens
tcagctctctgtata

SEQ ID NO: 2144010 - DNA, 22 bp, Homo sapiens
tcagctctgacattctgattcg

SEQ ID NO: 2144011 - DNA, 17 bp, Homo sapiens
tcagctgacacataatt

SEQ ID NO: 2144012 - DNA, 16 bp, Homo sapiens
tcagctgcacattcct

SEQ ID NO: 2144013 - DNA, 15 bp, Homo sapiens
tcagctgtttgtcat

SEQ ID NO: 2144014 - DNA, 17 bp, Homo sapiens
tcagcttcagactttta

SEQ ID NO: 2144015 - DNA, 21 bp, Homo sapiens
tcagcttgtaaatagctcagg

SEQ ID NO: 2144016 - DNA, 18 bp, Homo sapiens
tcaggaaaattgaatgca

SEQ ID NO: 2144017 - DNA, 21 bp, Homo sapiens
tcaggaaatcaaatatgcaaa

SEQ ID NO: 2144018 - DNA, 22 bp, Homo sapiens
tcaggaaatcaaatatgcaaag

SEQ ID NO: 2144019 - DNA, 19 bp, Homo sapiens
tcaggaagaaaccccaagc

SEQ ID NO: 2144020 - DNA, 21 bp, Homo sapiens
tcaggaagaaaccccaagcag

SEQ ID NO: 2144021 - DNA, 20 bp, Homo sapiens
tcaggaagggaaagccagaa

SEQ ID NO: 2144022 - DNA, 15 bp, Homo sapiens
tcaggaattgaagat

SEQ ID NO: 2144023 - DNA, 16 bp, Homo sapiens
tcaggacacaggcctg

SEQ ID NO: 2144024 - DNA, 16 bp, Homo sapiens
tcaggacccaggccct

SEQ ID NO: 2144025 - DNA, 17 bp, Homo sapiens
tcaggacccaggccctc

SEQ ID NO: 2144026 - DNA, 15 bp, Homo sapiens
tcaggacccaggccg

SEQ ID NO: 2144027 - DNA, 19 bp, Homo sapiens
tcaggacctccggggagag

SEQ ID NO: 2144028 - DNA, 23 bp, Homo sapiens
tcaggacctccggggagagcaga

SEQ ID NO: 2144029 - DNA, 18 bp, Homo sapiens
tcaggactggctcacccc

SEQ ID NO: 2144030 - DNA, 15 bp, Homo sapiens
tcaggacttgggaaa

SEQ ID NO: 2144031 - DNA, 17 bp, Homo sapiens
tcaggagaggggcagaa

SEQ ID NO: 2144032 - DNA, 18 bp, Homo sapiens
tcaggagcacaggcagct

SEQ ID NO: 2144033 - DNA, 18 bp, Homo sapiens
tcaggaggccctggtgtc

SEQ ID NO: 2144034 - DNA, 22 bp, Homo sapiens
tcaggaggccctggtgtcaggc

SEQ ID NO: 2144035 - DNA, 19 bp, Homo sapiens
tcaggaggcgaataaatgt

SEQ ID NO: 2144036 - DNA, 20 bp, Homo sapiens
tcaggaggcgaataaatgtt

SEQ ID NO: 2144037 - DNA, 21 bp, Homo sapiens
tcaggaggcgaataaatgttc

SEQ ID NO: 2144038 - DNA, 15 bp, Homo sapiens
tcaggaggcgcagcc

SEQ ID NO: 2144039 - DNA, 16 bp, Homo sapiens
tcaggaggcgcagccc

SEQ ID NO: 2144040 - DNA, 18 bp, Homo sapiens
tcaggaggctgaggcaga

SEQ ID NO: 2144041 - DNA, 22 bp, Homo sapiens
tcaggaggctgaggcagaagaa

SEQ ID NO: 2144042 - DNA, 22 bp, Homo sapiens
tcaggagttcaagaccagcctg

SEQ ID NO: 2144043 - DNA, 23 bp, Homo sapiens
tcaggagttcgagaccagcccag

SEQ ID NO: 2144044 - DNA, 18 bp, Homo sapiens
tcaggatactctgtcaga

SEQ ID NO: 2144045 - DNA, 21 bp, Homo sapiens
tcaggcaagcccctcagccct

SEQ ID NO: 2144046 - DNA, 15 bp, Homo sapiens
tcaggcacaggcagg

SEQ ID NO: 2144047 - DNA, 18 bp, Homo sapiens
tcaggcacaggcaggaag

SEQ ID NO: 2144048 - DNA, 17 bp, Homo sapiens
tcaggcactggtggcat

SEQ ID NO: 2144049 - DNA, 14 bp, Homo sapiens
tcaggcaggtttgc

SEQ ID NO: 2144050 - DNA, 13 bp, Homo sapiens
tcaggcattttgt

SEQ ID NO: 2144051 - DNA, 20 bp, Homo sapiens
tcaggccaagaccccagctt

SEQ ID NO: 2144052 - DNA, 13 bp, Homo sapiens
tcaggccacttga

SEQ ID NO: 2144053 - DNA, 18 bp, Homo sapiens
tcaggccaggtgcagtgg

SEQ ID NO: 2144054 - DNA, 14 bp, Homo sapiens
tcaggccagtgcca

SEQ ID NO: 2144055 - DNA, 15 bp, Homo sapiens
tcaggccagtgccag

SEQ ID NO: 2144056 - DNA, 21 bp, Homo sapiens
tcaggccagtgccaggacagc

SEQ ID NO: 2144057 - DNA, 17 bp, Homo sapiens
tcaggcccactgcagag

SEQ ID NO: 2144058 - DNA, 20 bp, Homo sapiens
tcaggcccccacctggctca

SEQ ID NO: 2144059 - DNA, 13 bp, Homo sapiens
tcaggcggggagg

SEQ ID NO: 2144060 - DNA, 14 bp, Homo sapiens
tcaggcggggagga

SEQ ID NO: 2144061 - DNA, 16 bp, Homo sapiens
tcaggcggggaggagg

SEQ ID NO: 2144062 - DNA, 18 bp, Homo sapiens
tcaggcggggtgctgtgg

SEQ ID NO: 2144063 - DNA, 11 bp, Homo sapiens
tcaggctccat

SEQ ID NO: 2144064 - DNA, 16 bp, Homo sapiens
tcaggctccattagga

SEQ ID NO: 2144065 - DNA, 16 bp, Homo sapiens
tcaggctcttctcctt

SEQ ID NO: 2144066 - DNA, 17 bp, Homo sapiens
tcaggctgagcccagcc

SEQ ID NO: 2144067 - DNA, 19 bp, Homo sapiens
tcaggctgagcccagccac

SEQ ID NO: 2144068 - DNA, 18 bp, Homo sapiens
tcaggcttggaatgaatt

SEQ ID NO: 2144069 - DNA, 12 bp, Homo sapiens
tcagggaagcag

SEQ ID NO: 2144070 - DNA, 14 bp, Homo sapiens
tcagggaagcaggc

SEQ ID NO: 2144071 - DNA, 18 bp, Homo sapiens
tcagggaagcaggcagag

SEQ ID NO: 2144072 - DNA, 19 bp, Homo sapiens
tcagggaagcaggcagagc

SEQ ID NO: 2144073 - DNA, 19 bp, Homo sapiens
tcagggccagaaggagggc

SEQ ID NO: 2144074 - DNA, 22 bp, Homo sapiens
tcagggccagaaggagggcaga

SEQ ID NO: 2144075 - DNA, 14 bp, Homo sapiens
tcagggccccagca

SEQ ID NO: 2144076 - DNA, 22 bp, Homo sapiens
tccagggcagcctccaccttgc

SEQ ID NO: 2144077 - DNA, 13 bp, Homo sapiens
tccagggccctga

SEQ ID NO: 2144078 - DNA, 20 bp, Homo sapiens
tccagggccctgagctcggt

SEQ ID NO: 2144079 - DNA, 13 bp, Homo sapiens
tccagggctgccc

SEQ ID NO: 2144080 - DNA, 15 bp, Homo sapiens
tccagggtcttgggc

SEQ ID NO: 2144081 - DNA, 22 bp, Homo sapiens
tccagggtcttgggctactggc

SEQ ID NO: 2144082 - DNA, 19 bp, Homo sapiens
tccaggtccggaggggttg

SEQ ID NO: 2144083 - DNA, 14 bp, Homo sapiens
tccaggtgggagag

SEQ ID NO: 2144084 - DNA, 16 bp, Homo sapiens
tccaggtgggagagac

SEQ ID NO: 2144085 - DNA, 20 bp, Homo sapiens
tccagtctgggtaacaggga

SEQ ID NO: 2144086 - DNA, 14 bp, Homo sapiens
tccagtgagctgga

SEQ ID NO: 2144087 - DNA, 17 bp, Homo sapiens
tccagtgatgtgctgga

SEQ ID NO: 2144088 - DNA, 18 bp, Homo sapiens
tccagtgatgtgctggag

SEQ ID NO: 2144089 - DNA, 19 bp, Homo sapiens
tccagtgatgtgctggagc

SEQ ID NO: 2144090 - DNA, 15 bp, Homo sapiens
tccagtgcaacaaaa

SEQ ID NO: 2144091 - DNA, 15 bp, Homo sapiens
tccagtgcaaccaca

SEQ ID NO: 2144092 - DNA, 18 bp, Homo sapiens
tccagtggacctgaagga

SEQ ID NO: 2144093 - DNA, 23 bp, Homo sapiens
tccagtggctcgctccctgtagc

SEQ ID NO: 2144094 - DNA, 19 bp, Homo sapiens
tccagtggttgctgttgat

SEQ ID NO: 2144095 - DNA, 16 bp, Homo sapiens
tccagtgtctcggagg

SEQ ID NO: 2144096 - DNA, 13 bp, Homo sapiens
tccagtgtgcacc

SEQ ID NO: 2144097 - DNA, 17 bp, Homo sapiens
tccagtgtgcacccctc

SEQ ID NO: 2144098 - DNA, 13 bp, Homo sapiens
tccagtttccaaa

SEQ ID NO: 2144099 - DNA, 14 bp, Homo sapiens
tccagtttccaaag

SEQ ID NO: 2144100 - DNA, 12 bp, Homo sapiens
tccagtttccca

SEQ ID NO: 2144101 - DNA, 15 bp, Homo sapiens
tccagtttccccatg

SEQ ID NO: 2144102 - DNA, 19 bp, Homo sapiens
tccagtttgttctccgggt

SEQ ID NO: 2144103 - DNA, 21 bp, Homo sapiens
tccataaagcaagctcaacct

SEQ ID NO: 2144104 - DNA, 16 bp, Homo sapiens
tccataatgccactgg

SEQ ID NO: 2144105 - DNA, 12 bp, Homo sapiens
tccataattatg

SEQ ID NO: 2144106 - DNA, 17 bp, Homo sapiens
tccatatattagcattt

SEQ ID NO: 2144107 - DNA, 16 bp, Homo sapiens
tccatatcagacctct

SEQ ID NO: 2144108 - DNA, 18 bp, Homo sapiens
tccatattttcacaggtg

SEQ ID NO: 2144109 - DNA, 12 bp, Homo sapiens
tccatgaaaatg

SEQ ID NO: 2144110 - DNA, 17 bp, Homo sapiens
tccatgaagacacgctt

SEQ ID NO: 2144111 - DNA, 20 bp, Homo sapiens
tccatgagggtttcattgtg

SEQ ID NO: 2144112 - DNA, 14 bp, Homo sapiens
tccatgatggaata

SEQ ID NO: 2144113 - DNA, 14 bp, Homo sapiens
tccatgcccaacct

SEQ ID NO: 2144114 - DNA, 15 bp, Homo sapiens
tccatgcctacagat

SEQ ID NO: 2144115 - DNA, 18 bp, Homo sapiens
tccatgcctacagataat

SEQ ID NO: 2144116 - DNA, 12 bp, Homo sapiens
tccatgcctgag

SEQ ID NO: 2144117 - DNA, 23 bp, Homo sapiens
tccatggaggaggtgtcccaagc

SEQ ID NO: 2144118 - DNA, 14 bp, Homo sapiens
tccatggcaccagc

SEQ ID NO: 2144119 - DNA, 17 bp, Homo sapiens
tccatggcaccagcccc

SEQ ID NO: 2144120 - DNA, 13 bp, Homo sapiens
tccatggccaccc

SEQ ID NO: 2144121 - DNA, 20 bp, Homo sapiens
tccatgggctagtgtgagtg

SEQ ID NO: 2144122 - DNA, 18 bp, Homo sapiens
tccatgtcgcctctgcat

SEQ ID NO: 2144123 - DNA, 19 bp, Homo sapiens
tccatgttaaaatagacaa

SEQ ID NO: 2144124 - DNA, 19 bp, Homo sapiens
tccatgtttgtaaaactac

SEQ ID NO: 2144125 - DNA, 20 bp, Homo sapiens
tccattaacttagcatgtgt

SEQ ID NO: 2144126 - DNA, 22 bp, Homo sapiens
tccattaacttagcatgtgttg

SEQ ID NO: 2144127 - DNA, 20 bp, Homo sapiens
tccattcccaactagacatt

SEQ ID NO: 2144128 - DNA, 12 bp, Homo sapiens
tccattcctcag

SEQ ID NO: 2144129 - DNA, 14 bp, Homo sapiens
tccattcctcaggg

SEQ ID NO: 2144130 - DNA, 15 bp, Homo sapiens
tccattcctcaggga

SEQ ID NO: 2144131 - DNA, 19 bp, Homo sapiens
tccattctagatgcttccc

SEQ ID NO: 2144132 - DNA, 15 bp, Homo sapiens
tccattgctgttgtt

SEQ ID NO: 2144133 - DNA, 14 bp, Homo sapiens
tccatttagttctt

SEQ ID NO: 2144134 - DNA, 17 bp, Homo sapiens
tccatttcaactccaga

SEQ ID NO: 2144135 - DNA, 23 bp, Homo sapiens
tccatttcacacaggtcctgaaa

SEQ ID NO: 2144136 - DNA, 22 bp, Homo sapiens
tccatttctcaatcagtgcagt

SEQ ID NO: 2144137 - DNA, 20 bp, Homo sapiens
tccatttctctccaggaagt

SEQ ID NO: 2144138 - DNA, 16 bp, Homo sapiens
tccatttcttcctcac

SEQ ID NO: 2144139 - DNA, 18 bp, Homo sapiens
tccatttggacaaaatgg

SEQ ID NO: 2144140 - DNA, 20 bp, Homo sapiens
tccatttggacaaaatggaa

SEQ ID NO: 2144141 - DNA, 22 bp, Homo sapiens
tccatttttactaaagcagtgt

SEQ ID NO: 2144142 - DNA, 20 bp, Homo sapiens
tcccaaaatgttgaaatatg

SEQ ID NO: 2144143 - DNA, 17 bp, Homo sapiens
tcccaaacttcggaaac

SEQ ID NO: 2144144 - DNA, 13 bp, Homo sapiens
tcccaaagtgctg

SEQ ID NO: 2144145 - DNA, 16 bp, Homo sapiens
tcccaaagtgctggga

SEQ ID NO: 2144146 - DNA, 22 bp, Homo sapiens
tcccaaattggtgtttctgaat

SEQ ID NO: 2144147 - DNA, 19 bp, Homo sapiens
tcccaacaacatccatgtc

SEQ ID NO: 2144148 - DNA, 22 bp, Homo sapiens
tcccaacctcaatgccctgcca

SEQ ID NO: 2144149 - DNA, 17 bp, Homo sapiens
tcccaactgctctgccc

SEQ ID NO: 2144150 - DNA, 14 bp, Homo sapiens
tcccaacttgtaaa

SEQ ID NO: 2144151 - DNA, 14 bp, Homo sapiens
tcccaagctctgct

SEQ ID NO: 2144152 - DNA, 17 bp, Homo sapiens
tcccaagctctgctcct

SEQ ID NO: 2144153 - DNA, 12 bp, Homo sapiens
tcccaagctttg

SEQ ID NO: 2144154 - DNA, 18 bp, Homo sapiens
tcccaaggaaagccccag

SEQ ID NO: 2144155 - DNA, 22 bp, Homo sapiens
tcccaaggagctgatttccagg

SEQ ID NO: 2144156 - DNA, 23 bp, Homo sapiens
tcccaaggagctgatttccaggc

SEQ ID NO: 2144157 - DNA, 18 bp, Homo sapiens
tcccaaggctctgagcaa

SEQ ID NO: 2144158 - DNA, 11 bp, Homo sapiens
tcccaataaaa

SEQ ID NO: 2144159 - DNA, 16 bp, Homo sapiens
tcccaataaaagtgac

SEQ ID NO: 2144160 - DNA, 17 bp, Homo sapiens
tcccaataaaagtgact

SEQ ID NO: 2144161 - DNA, 13 bp, Homo sapiens
tcccaataaagct

SEQ ID NO: 2144162 - DNA, 15 bp, Homo sapiens
tcccaatcagcactg

SEQ ID NO: 2144163 - DNA, 14 bp, Homo sapiens
tcccaatgcacatc

SEQ ID NO: 2144164 - DNA, 22 bp, Homo sapiens
tcccaatgcacatccattccca

SEQ ID NO: 2144165 - DNA, 15 bp, Homo sapiens
tcccaattcatttca

SEQ ID NO: 2144166 - DNA, 18 bp, Homo sapiens
tcccacactcccccagac

SEQ ID NO: 2144167 - DNA, 19 bp, Homo sapiens
tcccacagcattcctccat

SEQ ID NO: 2144168 - DNA, 18 bp, Homo sapiens
tcccacaggttcaggcga

SEQ ID NO: 2144169 - DNA, 16 bp, Homo sapiens
tcccacatccctgggc

SEQ ID NO: 2144170 - DNA, 22 bp, Homo sapiens
tcccacatccctgggcctgctg

SEQ ID NO: 2144171 - DNA, 15 bp, Homo sapiens
tcccaccaactctgc

SEQ ID NO: 2144172 - DNA, 22 bp, Homo sapiens
tcccaccaactctgcactccat

SEQ ID NO: 2144173 - DNA, 18 bp, Homo sapiens
tcccaccaccctcccacc

SEQ ID NO: 2144174 - DNA, 20 bp, Homo sapiens
tcccaccaccttggactcct

SEQ ID NO: 2144175 - DNA, 19 bp, Homo sapiens
tcccaccatgcgctgctca

SEQ ID NO: 2144176 - DNA, 15 bp, Homo sapiens
tcccacccacatgtg

SEQ ID NO: 2144177 - DNA, 16 bp, Homo sapiens
tcccacccacatgtga

SEQ ID NO: 2144178 - DNA, 20 bp, Homo sapiens
tcccaccccacccccttcag

SEQ ID NO: 2144179 - DNA, 22 bp, Homo sapiens
tcccaccccacccccttcagtg

SEQ ID NO: 2144180 - DNA, 18 bp, Homo sapiens
tcccaccccactccagcc

SEQ ID NO: 2144181 - DNA, 19 bp, Homo sapiens
tcccaccccactccagccc

SEQ ID NO: 2144182 - DNA, 14 bp, Homo sapiens
tcccacccccagcc

SEQ ID NO: 2144183 - DNA, 15 bp, Homo sapiens
tcccacccccagccc

SEQ ID NO: 2144184 - DNA, 17 bp, Homo sapiens
tcccaccccggcctcca

SEQ ID NO: 2144185 - DNA, 21 bp, Homo sapiens
tcccaccgggagcctccccct

SEQ ID NO: 2144186 - DNA, 15 bp, Homo sapiens
tcccacctcagcctc

SEQ ID NO: 2144187 - DNA, 18 bp, Homo sapiens
tcccacctcagcctcccg

SEQ ID NO: 2144188 - DNA, 18 bp, Homo sapiens
tcccaccttggctgcagg

SEQ ID NO: 2144189 - DNA, 21 bp, Homo sapiens
tcccaccttggctgcagggag

SEQ ID NO: 2144190 - DNA, 20 bp, Homo sapiens
tcccacgaatttgctgggga

SEQ ID NO: 2144191 - DNA, 15 bp, Homo sapiens
tcctgccactgacct

SEQ ID NO: 2144192 - DNA, 13 bp, Homo sapiens
tcctgccagctgc

SEQ ID NO: 2144193 - DNA, 15 bp, Homo sapiens
tcctgccagctgcct

SEQ ID NO: 2144194 - DNA, 13 bp, Homo sapiens
tcctgcccatgtg

SEQ ID NO: 2144195 - DNA, 16 bp, Homo sapiens
tcctgcccatgtgtcc

SEQ ID NO: 2144196 - DNA, 17 bp, Homo sapiens
tcctgcccatgtgtccc

SEQ ID NO: 2144197 - DNA, 19 bp, Homo sapiens
tcctgcccatgtgtcccct

SEQ ID NO: 2144198 - DNA, 18 bp, Homo sapiens
tcctgccctgttgtgtat

SEQ ID NO: 2144199 - DNA, 15 bp, Homo sapiens
tcctgcctacatccc

SEQ ID NO: 2144200 - DNA, 13 bp, Homo sapiens
tcctgcctcagcc

SEQ ID NO: 2144201 - DNA, 15 bp, Homo sapiens
tcctgcctcagcctc

SEQ ID NO: 2144202 - DNA, 19 bp, Homo sapiens
tcctgcctcagcctcccaa

SEQ ID NO: 2144203 - DNA, 21 bp, Homo sapiens
tcctgcctcgaactggctgca

SEQ ID NO: 2144204 - DNA, 17 bp, Homo sapiens
tcctgcctctctgctcc

SEQ ID NO: 2144205 - DNA, 19 bp, Homo sapiens
tcctgcctctctgctccag

SEQ ID NO: 2144206 - DNA, 12 bp, Homo sapiens
tcctgccttgat

SEQ ID NO: 2144207 - DNA, 22 bp, Homo sapiens
tcctgccttgatgaagcccgtg

SEQ ID NO: 2144208 - DNA, 16 bp, Homo sapiens
tcctgctctcttcagg

SEQ ID NO: 2144209 - DNA, 19 bp, Homo sapiens
tcctgctgctgacctgatc

SEQ ID NO: 2144210 - DNA, 23 bp, Homo sapiens
tcctgctgctgtaactgctgagc

SEQ ID NO: 2144211 - DNA, 14 bp, Homo sapiens
tcctgctgctgtgt

SEQ ID NO: 2144212 - DNA, 17 bp, Homo sapiens
tcctgctggcacctcag

SEQ ID NO: 2144213 - DNA, 20 bp, Homo sapiens
tcctgctggcacctcagaca

SEQ ID NO: 2144214 - DNA, 11 bp, Homo sapiens
tcctgctgtgc

SEQ ID NO: 2144215 - DNA, 23 bp, Homo sapiens
tcctgctgtgtgaattcccaggt

SEQ ID NO: 2144216 - DNA, 16 bp, Homo sapiens
tcctggaaaggctcag

SEQ ID NO: 2144217 - DNA, 14 bp, Homo sapiens
tcctggaaccaatc

SEQ ID NO: 2144218 - DNA, 21 bp, Homo sapiens
tcctggaagctgtgtccttgc

SEQ ID NO: 2144219 - DNA, 19 bp, Homo sapiens
tcctggacagctgtgcctc

SEQ ID NO: 2144220 - DNA, 22 bp, Homo sapiens
tcctggacagctgtgcctcgct

SEQ ID NO: 2144221 - DNA, 16 bp, Homo sapiens
tcctggagcatcccag

SEQ ID NO: 2144222 - DNA, 13 bp, Homo sapiens
tcctggaggcaga

SEQ ID NO: 2144223 - DNA, 17 bp, Homo sapiens
tcctggagggggcaagc

SEQ ID NO: 2144224 - DNA, 23 bp, Homo sapiens
tcctggcacccggcccctgctgg

SEQ ID NO: 2144225 - DNA, 13 bp, Homo sapiens
tcctggccccagc

SEQ ID NO: 2144226 - DNA, 21 bp, Homo sapiens
tcctggccccgggctctggcc

SEQ ID NO: 2144227 - DNA, 18 bp, Homo sapiens
tcctggcccctccagacc

SEQ ID NO: 2144228 - DNA, 18 bp, Homo sapiens
tcctggcctcactggctg

SEQ ID NO: 2144229 - DNA, 23 bp, Homo sapiens
tcctggcctcactggctggggca

SEQ ID NO: 2144230 - DNA, 13 bp, Homo sapiens
tcctggcctcctt

SEQ ID NO: 2144231 - DNA, 14 bp, Homo sapiens
tcctggcttcccat

SEQ ID NO: 2144232 - DNA, 14 bp, Homo sapiens
tcctggcttctaga

SEQ ID NO: 2144233 - DNA, 17 bp, Homo sapiens
tcctggctttgacatga

SEQ ID NO: 2144234 - DNA, 19 bp, Homo sapiens
tcctgggagaacctcaggc

SEQ ID NO: 2144235 - DNA, 21 bp, Homo sapiens
tcctgggcccgctttgcctgc

SEQ ID NO: 2144236 - DNA, 22 bp, Homo sapiens
tcctgggcccgctttgcctgct

SEQ ID NO: 2144237 - DNA, 15 bp, Homo sapiens
tcctgggccttacct

SEQ ID NO: 2144238 - DNA, 17 bp, Homo sapiens
tcctggggccccgctgg

SEQ ID NO: 2144239 - DNA, 19 bp, Homo sapiens
tcctggggccccgctggga

SEQ ID NO: 2144240 - DNA, 22 bp, Homo sapiens
tcctggggcctcggagcctcat

SEQ ID NO: 2144241 - DNA, 18 bp, Homo sapiens
tcctgggggatgtgcacg

SEQ ID NO: 2144242 - DNA, 19 bp, Homo sapiens
tcctgggggatgtgcacgg

SEQ ID NO: 2144243 - DNA, 13 bp, Homo sapiens
tcctgggggtggc

SEQ ID NO: 2144244 - DNA, 15 bp, Homo sapiens
tcctgggtggctact

SEQ ID NO: 2144245 - DNA, 15 bp, Homo sapiens
tcctggtacagcagg

SEQ ID NO: 2144246 - DNA, 18 bp, Homo sapiens
tcctggtacagcagggtc

SEQ ID NO: 2144247 - DNA, 23 bp, Homo sapiens
tcctggtacagcagggtcttgct

SEQ ID NO: 2144248 - DNA, 15 bp, Homo sapiens
tcctggtctgtgctg

SEQ ID NO: 2144249 - DNA, 16 bp, Homo sapiens
tcctggtgaggcccag

SEQ ID NO: 2144250 - DNA, 22 bp, Homo sapiens
tcctggtgaggcccagcctgtc

SEQ ID NO: 2144251 - DNA, 17 bp, Homo sapiens
tcctgtacgaacccctc

SEQ ID NO: 2144252 - DNA, 22 bp, Homo sapiens
tcctgtagctctcctggggttc

SEQ ID NO: 2144253 - DNA, 23 bp, Homo sapiens
tcctgtagttgcgtggactctgc

SEQ ID NO: 2144254 - DNA, 22 bp, Homo sapiens
tcctgtataatctctctcctgt

SEQ ID NO: 2144255 - DNA, 14 bp, Homo sapiens
tcctgtatattatg

SEQ ID NO: 2144256 - DNA, 19 bp, Homo sapiens
tcctgtatttgttcccaag

SEQ ID NO: 2144257 - DNA, 20 bp, Homo sapiens
tcctgtatttgttcccaaga

SEQ ID NO: 2144258 - DNA, 21 bp, Homo sapiens
tcctgtatttgttcccaagag

SEQ ID NO: 2144259 - DNA, 15 bp, Homo sapiens
tcctgtcaccctggc

SEQ ID NO: 2144260 - DNA, 16 bp, Homo sapiens
tcctgtcaccctggcc

SEQ ID NO: 2144261 - DNA, 18 bp, Homo sapiens
tcctgtcaccctggcccc

SEQ ID NO: 2144262 - DNA, 18 bp, Homo sapiens
tcctgtccaacctaaccc

SEQ ID NO: 2144263 - DNA, 22 bp, Homo sapiens
tcctgtcccgccttcctcctcc

SEQ ID NO: 2144264 - DNA, 16 bp, Homo sapiens
tcctgtccctacccac

SEQ ID NO: 2144265 - DNA, 21 bp, Homo sapiens
tcctgtccctacccactcttt

SEQ ID NO: 2144266 - DNA, 11 bp, Homo sapiens
tcctgtcctcc

SEQ ID NO: 2144267 - DNA, 17 bp, Homo sapiens
tcctgtcgattagactg

SEQ ID NO: 2144268 - DNA, 21 bp, Homo sapiens
tcctgtcgattagactggaca

SEQ ID NO: 2144269 - DNA, 13 bp, Homo sapiens
tcctgtctctgcc

SEQ ID NO: 2144270 - DNA, 21 bp, Homo sapiens
tcctgtctgccagccagcagc

SEQ ID NO: 2144271 - DNA, 18 bp, Homo sapiens
tcctgtctgtcctggagg

SEQ ID NO: 2144272 - DNA, 18 bp, Homo sapiens
tcctgtgacttcagctct

SEQ ID NO: 2144273 - DNA, 13 bp, Homo sapiens
tcctgtgcccctc

SEQ ID NO: 2144274 - DNA, 13 bp, Homo sapiens
tcctgtgctctgg

SEQ ID NO: 2144275 - DNA, 14 bp, Homo sapiens
tcctgtgggagcct

SEQ ID NO: 2144276 - DNA, 18 bp, Homo sapiens
tcctgtgggagcctcgca

SEQ ID NO: 2144277 - DNA, 16 bp, Homo sapiens
tcctgtgtggggaggc

SEQ ID NO: 2144278 - DNA, 13 bp, Homo sapiens
tcctgtgtgtgcg

SEQ ID NO: 2144279 - DNA, 19 bp, Homo sapiens
tcctgttcaccttatgtat

SEQ ID NO: 2144280 - DNA, 17 bp, Homo sapiens
tcctgtttttctgggtg

SEQ ID NO: 2144281 - DNA, 14 bp, Homo sapiens
tccttaagccagga

SEQ ID NO: 2144282 - DNA, 16 bp, Homo sapiens
tccttactcccaggca

SEQ ID NO: 2144283 - DNA, 17 bp, Homo sapiens
tccttactctgagccca

SEQ ID NO: 2144284 - DNA, 19 bp, Homo sapiens
tccttagagacatcaaaat

SEQ ID NO: 2144285 - DNA, 19 bp, Homo sapiens
tccttagcttagacctcag

SEQ ID NO: 2144286 - DNA, 21 bp, Homo sapiens
tccttagcttagacctcagcc

SEQ ID NO: 2144287 - DNA, 19 bp, Homo sapiens
tccttaggaaaatgcttct

SEQ ID NO: 2144288 - DNA, 23 bp, Homo sapiens
tccttaggaaaatgcttctgttg

SEQ ID NO: 2144289 - DNA, 19 bp, Homo sapiens
tccttcaagaactctgggc

SEQ ID NO: 2144290 - DNA, 15 bp, Homo sapiens
tccttcaagccagca

SEQ ID NO: 2144291 - DNA, 19 bp, Homo sapiens
tccttcaagttagctcagg

SEQ ID NO: 2144292 - DNA, 23 bp, Homo sapiens
tccttcaagttagctcaggaggc

SEQ ID NO: 2144293 - DNA, 13 bp, Homo sapiens
tccttcagagctc

SEQ ID NO: 2144294 - DNA, 18 bp, Homo sapiens
tccttcagcttccatttc

SEQ ID NO: 2144295 - DNA, 21 bp, Homo sapiens
tccttcatcgaacaaactgat

SEQ ID NO: 2144296 - DNA, 22 bp, Homo sapiens
tccttccagctagtgacccaca

SEQ ID NO: 2144297 - DNA, 21 bp, Homo sapiens
tccttccaggcccccaccact

SEQ ID NO: 2144298 - DNA, 12 bp, Homo sapiens
tccttcccactc

SEQ ID NO: 2144299 - DNA, 22 bp, Homo sapiens
tccttcccccatcccctttcct

SEQ ID NO: 2144300 - DNA, 15 bp, Homo sapiens
tccttcccctgtggt

SEQ ID NO: 2144301 - DNA, 15 bp, Homo sapiens
tccttccctaaagac

SEQ ID NO: 2144302 - DNA, 18 bp, Homo sapiens
tccttccctgggaaggct

SEQ ID NO: 2144303 - DNA, 14 bp, Homo sapiens
tccttcccttctct

SEQ ID NO: 2144304 - DNA, 17 bp, Homo sapiens
tccttcccttctctcct

SEQ ID NO: 2144305 - DNA, 16 bp, Homo sapiens
tctcctatcttctcca

SEQ ID NO: 2144306 - DNA, 12 bp, Homo sapiens
tctcctcccagg

SEQ ID NO: 2144307 - DNA, 18 bp, Homo sapiens
tctcctcccatggccttc

SEQ ID NO: 2144308 - DNA, 21 bp, Homo sapiens
tctcctcccatggccttccct

SEQ ID NO: 2144309 - DNA, 15 bp, Homo sapiens
tctcctctctgagac

SEQ ID NO: 2144310 - DNA, 14 bp, Homo sapiens
tctcctcttaaaaa

SEQ ID NO: 2144311 - DNA, 14 bp, Homo sapiens
tctcctgcctacat

SEQ ID NO: 2144312 - DNA, 18 bp, Homo sapiens
tctcctgcctacatccca

SEQ ID NO: 2144313 - DNA, 18 bp, Homo sapiens
tctcctggcttcccatcc

SEQ ID NO: 2144314 - DNA, 21 bp, Homo sapiens
tctcctgggcccgctttgcct

SEQ ID NO: 2144315 - DNA, 22 bp, Homo sapiens
tctcctgggggtggcaggcaca

SEQ ID NO: 2144316 - DNA, 20 bp, Homo sapiens
tctcctgtataaccccacct

SEQ ID NO: 2144317 - DNA, 22 bp, Homo sapiens
tctcctgtcagagatctgggag

SEQ ID NO: 2144318 - DNA, 16 bp, Homo sapiens
tctcctgtccaaccta

SEQ ID NO: 2144319 - DNA, 16 bp, Homo sapiens
tctcctgtgcccacat

SEQ ID NO: 2144320 - DNA, 17 bp, Homo sapiens
tctcctgtgcccacatc

SEQ ID NO: 2144321 - DNA, 19 bp, Homo sapiens
tctcctgtgcccctcagag

SEQ ID NO: 2144322 - DNA, 19 bp, Homo sapiens
tctcctgtttttctgggtg

SEQ ID NO: 2144323 - DNA, 18 bp, Homo sapiens
tctccttactctgagccc

SEQ ID NO: 2144324 - DNA, 11 bp, Homo sapiens
tctccttccct

SEQ ID NO: 2144325 - DNA, 14 bp, Homo sapiens
tctccttccctctt

SEQ ID NO: 2144326 - DNA, 19 bp, Homo sapiens
tctccttcgtgtctctccc

SEQ ID NO: 2144327 - DNA, 16 bp, Homo sapiens
tctccttgggctcctg

SEQ ID NO: 2144328 - DNA, 17 bp, Homo sapiens
tctccttgggctcctgg

SEQ ID NO: 2144329 - DNA, 20 bp, Homo sapiens
tctccttgggctcctggctg

SEQ ID NO: 2144330 - DNA, 16 bp, Homo sapiens
tctccttgttctgata

SEQ ID NO: 2144331 - DNA, 17 bp, Homo sapiens
tctcctttgcactgagg

SEQ ID NO: 2144332 - DNA, 17 bp, Homo sapiens
tctcggggcgacccctc

SEQ ID NO: 2144333 - DNA, 17 bp, Homo sapiens
tctctaaaaataaaatg

SEQ ID NO: 2144334 - DNA, 19 bp, Homo sapiens
tctctaaaaataaaatgat

SEQ ID NO: 2144335 - DNA, 20 bp, Homo sapiens
tctctaaaaataaaatgatg

SEQ ID NO: 2144336 - DNA, 14 bp, Homo sapiens
tctctaaacccaaa

SEQ ID NO: 2144337 - DNA, 20 bp, Homo sapiens
tctctaaatcttccttgtga

SEQ ID NO: 2144338 - DNA, 20 bp, Homo sapiens
tctctaagccacagcttctt

SEQ ID NO: 2144339 - DNA, 18 bp, Homo sapiens
tctctacccggcccagag

SEQ ID NO: 2144340 - DNA, 19 bp, Homo sapiens
tctctactcctacctcagc

SEQ ID NO: 2144341 - DNA, 20 bp, Homo sapiens
tctctactcctacctcagcc

SEQ ID NO: 2144342 - DNA, 21 bp, Homo sapiens
tctctactcctacctcagcct

SEQ ID NO: 2144343 - DNA, 13 bp, Homo sapiens
tctctagaatttt

SEQ ID NO: 2144344 - DNA, 16 bp, Homo sapiens
tctctattcctgaccc

SEQ ID NO: 2144345 - DNA, 17 bp, Homo sapiens
tctctattcctgaccct

SEQ ID NO: 2144346 - DNA, 16 bp, Homo sapiens
tctctcaatatgctta

SEQ ID NO: 2144347 - DNA, 20 bp, Homo sapiens
tctctcaatatgcttacaaa

SEQ ID NO: 2144348 - DNA, 18 bp, Homo sapiens
tctctcaggagcacaggc

SEQ ID NO: 2144349 - DNA, 22 bp, Homo sapiens
tctctcaggagcacaggcagct

SEQ ID NO: 2144350 - DNA, 14 bp, Homo sapiens
tctctccaggaagg

SEQ ID NO: 2144351 - DNA, 15 bp, Homo sapiens
tctctccaggaaggt

SEQ ID NO: 2144352 - DNA, 19 bp, Homo sapiens
tctctcccaccccggcctc

SEQ ID NO: 2144353 - DNA, 22 bp, Homo sapiens
tctctcccaccccggcctccac

SEQ ID NO: 2144354 - DNA, 21 bp, Homo sapiens
tctctcggggcgacccctcag

SEQ ID NO: 2144355 - DNA, 22 bp, Homo sapiens
tctctcggggcgacccctcagt

SEQ ID NO: 2144356 - DNA, 22 bp, Homo sapiens
tctctctactcctacctcagcc

SEQ ID NO: 2144357 - DNA, 14 bp, Homo sapiens
tctctctatatata

SEQ ID NO: 2144358 - DNA, 21 bp, Homo sapiens
tctctctatatatacatgtat

SEQ ID NO: 2144359 - DNA, 12 bp, Homo sapiens
tctctctcctgt

SEQ ID NO: 2144360 - DNA, 13 bp, Homo sapiens
tctctctcctgtc

SEQ ID NO: 2144361 - DNA, 13 bp, Homo sapiens
tctctctctccct

SEQ ID NO: 2144362 - DNA, 14 bp, Homo sapiens
tctctctctggtca

SEQ ID NO: 2144363 - DNA, 13 bp, Homo sapiens
tctctctgcctat

SEQ ID NO: 2144364 - DNA, 18 bp, Homo sapiens
tctctctggggccctggg

SEQ ID NO: 2144365 - DNA, 10 bp, Homo sapiens
tctctcttcc

SEQ ID NO: 2144366 - DNA, 16 bp, Homo sapiens
tctctgaacagaaaac

SEQ ID NO: 2144367 - DNA, 12 bp, Homo sapiens
tctctgaagcat

SEQ ID NO: 2144368 - DNA, 14 bp, Homo sapiens
tctctgaagcatgt

SEQ ID NO: 2144369 - DNA, 20 bp, Homo sapiens
tctctgactcttgcctttcc

SEQ ID NO: 2144370 - DNA, 21 bp, Homo sapiens
tctctgactcttgcctttcca

SEQ ID NO: 2144371 - DNA, 14 bp, Homo sapiens
tctctgagaacaga

SEQ ID NO: 2144372 - DNA, 13 bp, Homo sapiens
tctctgaggacac

SEQ ID NO: 2144373 - DNA, 14 bp, Homo sapiens
tctctgaggacact

SEQ ID NO: 2144374 - DNA, 17 bp, Homo sapiens
tctctgaggacactaac

SEQ ID NO: 2144375 - DNA, 17 bp, Homo sapiens
tctctgagggagaggct

SEQ ID NO: 2144376 - DNA, 20 bp, Homo sapiens
tctctgatgtgatatccact

SEQ ID NO: 2144377 - DNA, 20 bp, Homo sapiens
tctctgattttcaaagcttt

SEQ ID NO: 2144378 - DNA, 15 bp, Homo sapiens
tctctgcagccagcc

SEQ ID NO: 2144379 - DNA, 17 bp, Homo sapiens
tctctgcagccagccca

SEQ ID NO: 2144380 - DNA, 19 bp, Homo sapiens
tctctgcagccagcccagc

SEQ ID NO: 2144381 - DNA, 16 bp, Homo sapiens
tctctgctccagagag

SEQ ID NO: 2144382 - DNA, 15 bp, Homo sapiens
tctctgcttaccctt

SEQ ID NO: 2144383 - DNA, 14 bp, Homo sapiens
tctctgctttaaag

SEQ ID NO: 2144384 - DNA, 14 bp, Homo sapiens
tctctggctccaga

SEQ ID NO: 2144385 - DNA, 21 bp, Homo sapiens
tctctgggcttggggcttcct

SEQ ID NO: 2144386 - DNA, 22 bp, Homo sapiens
tctctggggccctgggcctcag

SEQ ID NO: 2144387 - DNA, 18 bp, Homo sapiens
tctctgtacaaaaacaaa

SEQ ID NO: 2144388 - DNA, 21 bp, Homo sapiens
tctctgtataaacattaaatg

SEQ ID NO: 2144389 - DNA, 16 bp, Homo sapiens
tctctgtccctcactg

SEQ ID NO: 2144390 - DNA, 16 bp, Homo sapiens
tctctgtgaacgattt

SEQ ID NO: 2144391 - DNA, 23 bp, Homo sapiens
tctctgtgaacgatttagaaaga

SEQ ID NO: 2144392 - DNA, 19 bp, Homo sapiens
tctctgtgcttcaattaat

SEQ ID NO: 2144393 - DNA, 21 bp, Homo sapiens
tctctgtgctttgactcacct

SEQ ID NO: 2144394 - DNA, 17 bp, Homo sapiens
tctctgttcatttcctc

SEQ ID NO: 2144395 - DNA, 20 bp, Homo sapiens
tctcttaccgcgagactgag

SEQ ID NO: 2144396 - DNA, 21 bp, Homo sapiens
tctcttatagaatatttatta

SEQ ID NO: 2144397 - DNA, 13 bp, Homo sapiens
tctcttcactccc

SEQ ID NO: 2144398 - DNA, 23 bp, Homo sapiens
tctcttcagcccctagtgctatt

SEQ ID NO: 2144399 - DNA, 13 bp, Homo sapiens
tctcttcaggttc

SEQ ID NO: 2144400 - DNA, 15 bp, Homo sapiens
tctcttcaggttctt

SEQ ID NO: 2144401 - DNA, 23 bp, Homo sapiens
tctcttccagaagatgccctcca

SEQ ID NO: 2144402 - DNA, 20 bp, Homo sapiens
tctcttccctaatcctccaa

SEQ ID NO: 2144403 - DNA, 13 bp, Homo sapiens
tctcttctttaaa

SEQ ID NO: 2144404 - DNA, 13 bp, Homo sapiens
tctcttgccagca

SEQ ID NO: 2144405 - DNA, 17 bp, Homo sapiens
tctcttgtcatataaac

SEQ ID NO: 2144406 - DNA, 19 bp, Homo sapiens
tctcttgtcatataaacct

SEQ ID NO: 2144407 - DNA, 20 bp, Homo sapiens
tctctttaatgtcacaggca

SEQ ID NO: 2144408 - DNA, 19 bp, Homo sapiens
tctctttatgtctgtggat

SEQ ID NO: 2144409 - DNA, 15 bp, Homo sapiens
tctctttcttatttt

SEQ ID NO: 2144410 - DNA, 20 bp, Homo sapiens
tctctttcttattttgtaat

SEQ ID NO: 2144411 - DNA, 21 bp, Homo sapiens
tctctttcttattttgtaata

SEQ ID NO: 2144412 - DNA, 22 bp, Homo sapiens
tctctttcttattttgtaataa

SEQ ID NO: 2144413 - DNA, 19 bp, Homo sapiens
tctctttggaatgaacaat

SEQ ID NO: 2144414 - DNA, 16 bp, Homo sapiens
tctcttttcaaaacat

SEQ ID NO: 2144415 - DNA, 23 bp, Homo sapiens
tctcttttgaatccatgcttggg

SEQ ID NO: 2144416 - DNA, 22 bp, Homo sapiens
tctgaaaaccccatttgctttc

SEQ ID NO: 2144417 - DNA, 12 bp, Homo sapiens
tctgaaaactgg

SEQ ID NO: 2144418 - DNA, 15 bp, Homo sapiens
tctgaaaactgttta

SEQ ID NO: 2144419 - DNA, 21 bp, Homo sapiens
tctgaaaagcaattgccctgt

SEQ ID NO: 2144420 - DNA, 13 bp, Homo sapiens
tcttaaatgacag

SEQ ID NO: 2144421 - DNA, 17 bp, Homo sapiens
tcttaaatgacagtgaa

SEQ ID NO: 2144422 - DNA, 23 bp, Homo sapiens
tcttaaggattgtgatattttta

SEQ ID NO: 2144423 - DNA, 16 bp, Homo sapiens
tcttaatcaagaatat

SEQ ID NO: 2144424 - DNA, 18 bp, Homo sapiens
tcttaatgctttcctccc

SEQ ID NO: 2144425 - DNA, 18 bp, Homo sapiens
tcttaattaaaagaatat

SEQ ID NO: 2144426 - DNA, 19 bp, Homo sapiens
tcttaattttttttaatgt

SEQ ID NO: 2144427 - DNA, 14 bp, Homo sapiens
tcttacagtggagt

SEQ ID NO: 2144428 - DNA, 12 bp, Homo sapiens
tcttacatctgc

SEQ ID NO: 2144429 - DNA, 17 bp, Homo sapiens
tcttacccatatatctt

SEQ ID NO: 2144430 - DNA, 23 bp, Homo sapiens
tcttacctgtatgtctccagtat

SEQ ID NO: 2144431 - DNA, 14 bp, Homo sapiens
tcttaccttaaaaa

SEQ ID NO: 2144432 - DNA, 14 bp, Homo sapiens
tcttactaaacatt

SEQ ID NO: 2144433 - DNA, 15 bp, Homo sapiens
tcttactatttcaca

SEQ ID NO: 2144434 - DNA, 13 bp, Homo sapiens
tcttacttaaaaa

SEQ ID NO: 2144435 - DNA, 22 bp, Homo sapiens
tcttagcatgcctccaaaaatt

SEQ ID NO: 2144436 - DNA, 13 bp, Homo sapiens
tcttagctttcca

SEQ ID NO: 2144437 - DNA, 17 bp, Homo sapiens
tcttataggtttccact

SEQ ID NO: 2144438 - DNA, 15 bp, Homo sapiens
tcttatcttctgcaa

SEQ ID NO: 2144439 - DNA, 20 bp, Homo sapiens
tcttatgaaatgggctttaa

SEQ ID NO: 2144440 - DNA, 12 bp, Homo sapiens
tcttatgatttt

SEQ ID NO: 2144441 - DNA, 22 bp, Homo sapiens
tcttattagaacaggcaagtga

SEQ ID NO: 2144442 - DNA, 24 bp, Homo sapiens
tcttattcccaaactacagaataa

SEQ ID NO: 2144443 - DNA, 15 bp, Homo sapiens
tcttattctcactcc

SEQ ID NO: 2144444 - DNA, 14 bp, Homo sapiens
tcttatttatatat

SEQ ID NO: 2144445 - DNA, 13 bp, Homo sapiens
tcttattttgtaa

SEQ ID NO: 2144446 - DNA, 15 bp, Homo sapiens
tcttattttgtaata

SEQ ID NO: 2144447 - DNA, 17 bp, Homo sapiens
tcttattttttaaaaag

SEQ ID NO: 2144448 - DNA, 16 bp, Homo sapiens
tcttcaactgaccagc

SEQ ID NO: 2144449 - DNA, 17 bp, Homo sapiens
tcttcaatatgaaggac

SEQ ID NO: 2144450 - DNA, 13 bp, Homo sapiens
tcttcacaacctc

SEQ ID NO: 2144451 - DNA, 20 bp, Homo sapiens
tcttcacccagctaatctgt

SEQ ID NO: 2144452 - DNA, 19 bp, Homo sapiens
tcttcactgccatgcctca

SEQ ID NO: 2144453 - DNA, 11 bp, Homo sapiens
tcttcagccta

SEQ ID NO: 2144454 - DNA, 14 bp, Homo sapiens
tcttcagctcccat

SEQ ID NO: 2144455 - DNA, 21 bp, Homo sapiens
tcttcaggaggccctggtgtc

SEQ ID NO: 2144456 - DNA, 13 bp, Homo sapiens
tcttcagtgccta

SEQ ID NO: 2144457 - DNA, 19 bp, Homo sapiens
tcttcagtgggagaaaaca

SEQ ID NO: 2144458 - DNA, 12 bp, Homo sapiens
tcttcagtttta

SEQ ID NO: 2144459 - DNA, 13 bp, Homo sapiens
tcttcatactttt

SEQ ID NO: 2144460 - DNA, 15 bp, Homo sapiens
tcttcatactttttt

SEQ ID NO: 2144461 - DNA, 22 bp, Homo sapiens
tcttcatactttttttcacagt

SEQ ID NO: 2144462 - DNA, 23 bp, Homo sapiens
tcttcatcagcatttaataaatg

SEQ ID NO: 2144463 - DNA, 16 bp, Homo sapiens
tcttcatgtttcagga

SEQ ID NO: 2144464 - DNA, 17 bp, Homo sapiens
tcttcatttcattgtat

SEQ ID NO: 2144465 - DNA, 22 bp, Homo sapiens
tcttcatttcattgtatgatgt

SEQ ID NO: 2144466 - DNA, 13 bp, Homo sapiens
tcttccaaagctc

SEQ ID NO: 2144467 - DNA, 15 bp, Homo sapiens
tcttccaaaggcata

SEQ ID NO: 2144468 - DNA, 17 bp, Homo sapiens
tcttccaaccccagctg

SEQ ID NO: 2144469 - DNA, 14 bp, Homo sapiens
tcttccactgcaaa

SEQ ID NO: 2144470 - DNA, 19 bp, Homo sapiens
tcttccagagcctaagaaa

SEQ ID NO: 2144471 - DNA, 20 bp, Homo sapiens
tcttccagagcctaagaaaa

SEQ ID NO: 2144472 - DNA, 22 bp, Homo sapiens
tcttccagagcctaagaaaatc

SEQ ID NO: 2144473 - DNA, 16 bp, Homo sapiens
tcttccataatgtata

SEQ ID NO: 2144474 - DNA, 14 bp, Homo sapiens
tcttccccactccc

SEQ ID NO: 2144475 - DNA, 14 bp, Homo sapiens
tcttcccctttcct

SEQ ID NO: 2144476 - DNA, 16 bp, Homo sapiens
tcttccctccttccct

SEQ ID NO: 2144477 - DNA, 17 bp, Homo sapiens
tcttcctaccaaatata

SEQ ID NO: 2144478 - DNA, 21 bp, Homo sapiens
tcttcctagttttctcctccc

SEQ ID NO: 2144479 - DNA, 11 bp, Homo sapiens
tcttcctctgc

SEQ ID NO: 2144480 - DNA, 16 bp, Homo sapiens
tcttcctgccaagcca

SEQ ID NO: 2144481 - DNA, 12 bp, Homo sapiens
tcttcctgctgc

SEQ ID NO: 2144482 - DNA, 13 bp, Homo sapiens
tcttccttccccc

SEQ ID NO: 2144483 - DNA, 13 bp, Homo sapiens
tcttccttctttc

SEQ ID NO: 2144484 - DNA, 19 bp, Homo sapiens
tcttcgctgctagagaagg

SEQ ID NO: 2144485 - DNA, 18 bp, Homo sapiens
tcttcggtgtttaaagtc

SEQ ID NO: 2144486 - DNA, 14 bp, Homo sapiens
tcttcgtcctgccc

SEQ ID NO: 2144487 - DNA, 18 bp, Homo sapiens
tcttctaaaatgctttta

SEQ ID NO: 2144488 - DNA, 21 bp, Homo sapiens
tcttctaaaatgcttttaatt

SEQ ID NO: 2144489 - DNA, 22 bp, Homo sapiens
tcttctaactcatgggtaccca

SEQ ID NO: 2144490 - DNA, 16 bp, Homo sapiens
tcttctacaaccagag

SEQ ID NO: 2144491 - DNA, 20 bp, Homo sapiens
tcttctacaaccagagcccc

SEQ ID NO: 2144492 - DNA, 22 bp, Homo sapiens
tcttctactttcatctattctt

SEQ ID NO: 2144493 - DNA, 15 bp, Homo sapiens
tcttctatttaaaaa

SEQ ID NO: 2144494 - DNA, 16 bp, Homo sapiens
tcttctatttaaaaaa

SEQ ID NO: 2144495 - DNA, 15 bp, Homo sapiens
tcttctattttattc

SEQ ID NO: 2144496 - DNA, 15 bp, Homo sapiens
tcttctccaggctgt

SEQ ID NO: 2144497 - DNA, 21 bp, Homo sapiens
tcttctccattctagatgctt

SEQ ID NO: 2144498 - DNA, 20 bp, Homo sapiens
tcttctctattcctgaccct

SEQ ID NO: 2144499 - DNA, 13 bp, Homo sapiens
tcttctcttcctg

SEQ ID NO: 2144500 - DNA, 13 bp, Homo sapiens
tcttctgccaaga

SEQ ID NO: 2144501 - DNA, 12 bp, Homo sapiens
tcttctgcttca

SEQ ID NO: 2144502 - DNA, 22 bp, Homo sapiens
tcttctgcttcagcctcccgag

SEQ ID NO: 2144503 - DNA, 17 bp, Homo sapiens
tcttctggagtctccag

SEQ ID NO: 2144504 - DNA, 11 bp, Homo sapiens
tcttctggctt

SEQ ID NO: 2144505 - DNA, 12 bp, Homo sapiens
tcttctgtcatc

SEQ ID NO: 2144506 - DNA, 15 bp, Homo sapiens
tcttctgtcatcccg

SEQ ID NO: 2144507 - DNA, 13 bp, Homo sapiens
tcttctttctgag

SEQ ID NO: 2144508 - DNA, 16 bp, Homo sapiens
tcttgaactcctggcc

SEQ ID NO: 2144509 - DNA, 16 bp, Homo sapiens
tcttgaagaatattgt

SEQ ID NO: 2144510 - DNA, 22 bp, Homo sapiens
tcttgaatctagggagggggaa

SEQ ID NO: 2144511 - DNA, 16 bp, Homo sapiens
tcttgacacggtgaaa

SEQ ID NO: 2144512 - DNA, 20 bp, Homo sapiens
tcttgacagtatatttgaaa

SEQ ID NO: 2144513 - DNA, 15 bp, Homo sapiens
tcttgacatgtaatg

SEQ ID NO: 2144514 - DNA, 19 bp, Homo sapiens
tcttgacattcaaggcatt

SEQ ID NO: 2144515 - DNA, 16 bp, Homo sapiens
tcttgaggccaggagt

SEQ ID NO: 2144516 - DNA, 23 bp, Homo sapiens
tcttgcaatggcagccttggcaa

SEQ ID NO: 2144517 - DNA, 17 bp, Homo sapiens
tcttgccactgcctctt

SEQ ID NO: 2144518 - DNA, 19 bp, Homo sapiens
tcttgccagccagaagcct

SEQ ID NO: 2144519 - DNA, 14 bp, Homo sapiens
tcttgccccttggg

SEQ ID NO: 2144520 - DNA, 15 bp, Homo sapiens
tcttgcctgcaccct

SEQ ID NO: 2144521 - DNA, 18 bp, Homo sapiens
tcttgcctgccagggccc

SEQ ID NO: 2144522 - DNA, 23 bp, Homo sapiens
tcttgcctttccacctgctttct

SEQ ID NO: 2144523 - DNA, 18 bp, Homo sapiens
tcttgctatttgagcatg

SEQ ID NO: 2144524 - DNA, 14 bp, Homo sapiens
tcttgctctgctga

SEQ ID NO: 2144525 - DNA, 13 bp, Homo sapiens
tcttggaaaaaaa

SEQ ID NO: 2144526 - DNA, 16 bp, Homo sapiens
tcttggaagtgtgtgg

SEQ ID NO: 2144527 - DNA, 22 bp, Homo sapiens
tcttggaagtgtgtggaaggca

SEQ ID NO: 2144528 - DNA, 13 bp, Homo sapiens
tcttggctcactg

SEQ ID NO: 2144529 - DNA, 13 bp, Homo sapiens
tcttggcttctgg

SEQ ID NO: 2144530 - DNA, 21 bp, Homo sapiens
tcttgggaactccactctcct

SEQ ID NO: 2144531 - DNA, 22 bp, Homo sapiens
tcttgggcaaaatgacaagggg

SEQ ID NO: 2144532 - DNA, 14 bp, Homo sapiens
tcttgggctactgg

SEQ ID NO: 2144533 - DNA, 19 bp, Homo sapiens
tcttgggctactggcagct

SEQ ID NO: 2144534 - DNA, 17 bp, Homo sapiens
tcttggggtcccaggga

SEQ ID NO: 2144535 - DNA, 19 bp, Homo sapiens
tcttggggtcccagggaag

SEQ ID NO: 2144536 - DNA, 15 bp, Homo sapiens
tgaatttattattgt

SEQ ID NO: 2144537 - DNA, 18 bp, Homo sapiens
tgaatttattattgttct

SEQ ID NO: 2144538 - DNA, 19 bp, Homo sapiens
tgaatttcaggcattttgt

SEQ ID NO: 2144539 - DNA, 21 bp, Homo sapiens
tgaatttcttcactgttgaaa

SEQ ID NO: 2144540 - DNA, 14 bp, Homo sapiens
tgaatttggagact

SEQ ID NO: 2144541 - DNA, 15 bp, Homo sapiens
tgaatttggagactc

SEQ ID NO: 2144542 - DNA, 14 bp, Homo sapiens
tgaatttgggcctc

SEQ ID NO: 2144543 - DNA, 22 bp, Homo sapiens
tgaatttgtaagcaacttgctt

SEQ ID NO: 2144544 - DNA, 16 bp, Homo sapiens
tgaattttgttgctgt

SEQ ID NO: 2144545 - DNA, 23 bp, Homo sapiens
tgaatttttaaacaagtatttgt

SEQ ID NO: 2144546 - DNA, 15 bp, Homo sapiens
tgacaaaatatataa

SEQ ID NO: 2144547 - DNA, 17 bp, Homo sapiens
tgacaaaattggccaga

SEQ ID NO: 2144548 - DNA, 18 bp, Homo sapiens
tgacaaaatttgttgaaa

SEQ ID NO: 2144549 - DNA, 22 bp, Homo sapiens
tgacaaacccaggagtttgtgt

SEQ ID NO: 2144550 - DNA, 15 bp, Homo sapiens
tgacaaagaaaccca

SEQ ID NO: 2144551 - DNA, 17 bp, Homo sapiens
tgacaaagaaacccaag

SEQ ID NO: 2144552 - DNA, 14 bp, Homo sapiens
tgacaacagaagct

SEQ ID NO: 2144553 - DNA, 16 bp, Homo sapiens
tgacaacatttctata

SEQ ID NO: 2144554 - DNA, 14 bp, Homo sapiens
tgacaacctttgtg

SEQ ID NO: 2144555 - DNA, 20 bp, Homo sapiens
tgacaagataaaggaagtca

SEQ ID NO: 2144556 - DNA, 15 bp, Homo sapiens
tgacaagcactgcta

SEQ ID NO: 2144557 - DNA, 18 bp, Homo sapiens
tgacaaggattgctactg

SEQ ID NO: 2144558 - DNA, 22 bp, Homo sapiens
tgacaagggctgacctgcctct

SEQ ID NO: 2144559 - DNA, 17 bp, Homo sapiens
tgacaaggtagacatgg

SEQ ID NO: 2144560 - DNA, 20 bp, Homo sapiens
tgacaagtcattttaacttt

SEQ ID NO: 2144561 - DNA, 15 bp, Homo sapiens
tgacaagtggagggg

SEQ ID NO: 2144562 - DNA, 23 bp, Homo sapiens
tgacaatagttatgcctgtacta

SEQ ID NO: 2144563 - DNA, 23 bp, Homo sapiens
tgacaatcctgaagaaaccacag

SEQ ID NO: 2144564 - DNA, 16 bp, Homo sapiens
tgacaatggcagctag

SEQ ID NO: 2144565 - DNA, 20 bp, Homo sapiens
tgacacaagaggaataagaa

SEQ ID NO: 2144566 - DNA, 14 bp, Homo sapiens
tgacacacagcagc

SEQ ID NO: 2144567 - DNA, 21 bp, Homo sapiens
tgacacacagctctgtcctgg

SEQ ID NO: 2144568 - DNA, 20 bp, Homo sapiens
tgacacacgtatttatattt

SEQ ID NO: 2144569 - DNA, 13 bp, Homo sapiens
tgacacaggccag

SEQ ID NO: 2144570 - DNA, 15 bp, Homo sapiens
tgacacaggccagcc

SEQ ID NO: 2144571 - DNA, 20 bp, Homo sapiens
tgacacaggccagccccatc

SEQ ID NO: 2144572 - DNA, 21 bp, Homo sapiens
tgacacaggccagccccatct

SEQ ID NO: 2144573 - DNA, 23 bp, Homo sapiens
tgacacaggccagccccatcttg

SEQ ID NO: 2144574 - DNA, 17 bp, Homo sapiens
tgacacattctcttttt

SEQ ID NO: 2144575 - DNA, 19 bp, Homo sapiens
tgacacccaagagggctgc

SEQ ID NO: 2144576 - DNA, 17 bp, Homo sapiens
tgacaccgtccctcagt

SEQ ID NO: 2144577 - DNA, 19 bp, Homo sapiens
tgacaccgtccctcagtga

SEQ ID NO: 2144578 - DNA, 16 bp, Homo sapiens
tgacacctccatttct

SEQ ID NO: 2144579 - DNA, 22 bp, Homo sapiens
tgacacctccatttctctccag

SEQ ID NO: 2144580 - DNA, 23 bp, Homo sapiens
tgacacggtaggccaagctgaag

SEQ ID NO: 2144581 - DNA, 17 bp, Homo sapiens
tgacacggtgaaatcca

SEQ ID NO: 2144582 - DNA, 20 bp, Homo sapiens
tgacacggtgaaatccaggt

SEQ ID NO: 2144583 - DNA, 19 bp, Homo sapiens
tgacactaccttatcaggc

SEQ ID NO: 2144584 - DNA, 23 bp, Homo sapiens
tgacactgaccttggagagacac

SEQ ID NO: 2144585 - DNA, 17 bp, Homo sapiens
tgacagaacactgtctt

SEQ ID NO: 2144586 - DNA, 14 bp, Homo sapiens
tgacagacacaggc

SEQ ID NO: 2144587 - DNA, 17 bp, Homo sapiens
tgacagacacaggcccg

SEQ ID NO: 2144588 - DNA, 20 bp, Homo sapiens
tgacagacattttcaataat

SEQ ID NO: 2144589 - DNA, 18 bp, Homo sapiens
tgacagagacccagatct

SEQ ID NO: 2144590 - DNA, 18 bp, Homo sapiens
tgacagagcaagactctg

SEQ ID NO: 2144591 - DNA, 16 bp, Homo sapiens
tgacagaggcagcccc

SEQ ID NO: 2144592 - DNA, 18 bp, Homo sapiens
tgacagaggcagccccat

SEQ ID NO: 2144593 - DNA, 19 bp, Homo sapiens
tgacagagtgagactctgt

SEQ ID NO: 2144594 - DNA, 11 bp, Homo sapiens
tgacagccaga

SEQ ID NO: 2144595 - DNA, 15 bp, Homo sapiens
tgacagccagagcct

SEQ ID NO: 2144596 - DNA, 16 bp, Homo sapiens
tgacagctgtccctgt

SEQ ID NO: 2144597 - DNA, 21 bp, Homo sapiens
tgacagctgtccctgtcacca

SEQ ID NO: 2144598 - DNA, 19 bp, Homo sapiens
tgacaggaaagccctcccc

SEQ ID NO: 2144599 - DNA, 21 bp, Homo sapiens
tgacaggaagcccaaggcagt

SEQ ID NO: 2144600 - DNA, 23 bp, Homo sapiens
tgacaggaagcccaaggcagtgt

SEQ ID NO: 2144601 - DNA, 18 bp, Homo sapiens
tgacaggatgtggcactg

SEQ ID NO: 2144602 - DNA, 19 bp, Homo sapiens
tgacaggcaatgctggctg

SEQ ID NO: 2144603 - DNA, 20 bp, Homo sapiens
tgacaggcaatgctggctgt

SEQ ID NO: 2144604 - DNA, 14 bp, Homo sapiens
tgacaggcccagtg

SEQ ID NO: 2144605 - DNA, 11 bp, Homo sapiens
tgacagggcac

SEQ ID NO: 2144606 - DNA, 17 bp, Homo sapiens
tgacaggttcccagcag

SEQ ID NO: 2144607 - DNA, 18 bp, Homo sapiens
tgacaggttcccagcagc

SEQ ID NO: 2144608 - DNA, 15 bp, Homo sapiens
tgacagtcttgtgct

SEQ ID NO: 2144609 - DNA, 23 bp, Homo sapiens
tgacagtcttgtgcttttcctat

SEQ ID NO: 2144610 - DNA, 22 bp, Homo sapiens
tgacagtgctctaggctgcccc

SEQ ID NO: 2144611 - DNA, 24 bp, Homo sapiens
tgacagtgtgggaggcctcgtacc

SEQ ID NO: 2144612 - DNA, 16 bp, Homo sapiens
tgacagtgttgaaaat

SEQ ID NO: 2144613 - DNA, 14 bp, Homo sapiens
tgacataaagttga

SEQ ID NO: 2144614 - DNA, 21 bp, Homo sapiens
tgacataacactataaaggtt

SEQ ID NO: 2144615 - DNA, 19 bp, Homo sapiens
tgacatcacttgtacaaaa

SEQ ID NO: 2144616 - DNA, 21 bp, Homo sapiens
tgacatcacttgtacaaaata

SEQ ID NO: 2144617 - DNA, 22 bp, Homo sapiens
tgacatcacttgtacaaaataa

SEQ ID NO: 2144618 - DNA, 19 bp, Homo sapiens
tgacatcatgttagtcttt

SEQ ID NO: 2144619 - DNA, 14 bp, Homo sapiens
tgacatctctttga

SEQ ID NO: 2144620 - DNA, 12 bp, Homo sapiens
tgacatcttatt

SEQ ID NO: 2144621 - DNA, 11 bp, Homo sapiens
tgacatgcact

SEQ ID NO: 2144622 - DNA, 19 bp, Homo sapiens
tgacatgcactgacccttc

SEQ ID NO: 2144623 - DNA, 16 bp, Homo sapiens
tgacatgggtgtgcca

SEQ ID NO: 2144624 - DNA, 17 bp, Homo sapiens
tgacatgtaatgaatgg

SEQ ID NO: 2144625 - DNA, 10 bp, Homo sapiens
tgacattcct

SEQ ID NO: 2144626 - DNA, 20 bp, Homo sapiens
tgacattgttggccaaagcc

SEQ ID NO: 2144627 - DNA, 15 bp, Homo sapiens
tgacatttctaacat

SEQ ID NO: 2144628 - DNA, 20 bp, Homo sapiens
tgacatttctaacatatgta

SEQ ID NO: 2144629 - DNA, 18 bp, Homo sapiens
tgacatttgacagtgtgg

SEQ ID NO: 2144630 - DNA, 17 bp, Homo sapiens
tgaccaacagttccttc

SEQ ID NO: 2144631 - DNA, 17 bp, Homo sapiens
tgaccaacatggagaaa

SEQ ID NO: 2144632 - DNA, 16 bp, Homo sapiens
tgaccaagagagaaag

SEQ ID NO: 2144633 - DNA, 20 bp, Homo sapiens
tgaccaagttataaatcaat

SEQ ID NO: 2144634 - DNA, 19 bp, Homo sapiens
tgaccaatactactgtaaa

SEQ ID NO: 2144635 - DNA, 13 bp, Homo sapiens
tgaccaatctctg

SEQ ID NO: 2144636 - DNA, 15 bp, Homo sapiens
tgaccaatctctgtg

SEQ ID NO: 2144637 - DNA, 19 bp, Homo sapiens
tgaccaatctctgtgactc

SEQ ID NO: 2144638 - DNA, 14 bp, Homo sapiens
tgaccacacgctgt

SEQ ID NO: 2144639 - DNA, 23 bp, Homo sapiens
tgaccacacgctgtctcttgaga

SEQ ID NO: 2144640 - DNA, 17 bp, Homo sapiens
tgaccacatacgtgtta

SEQ ID NO: 2144641 - DNA, 23 bp, Homo sapiens
tgaccacggacgtttccatcagg

SEQ ID NO: 2144642 - DNA, 17 bp, Homo sapiens
tgaccacgggcctcagt

SEQ ID NO: 2144643 - DNA, 18 bp, Homo sapiens
tgaccagaaacagggaca

SEQ ID NO: 2144644 - DNA, 16 bp, Homo sapiens
tgaccagacctagacc

SEQ ID NO: 2144645 - DNA, 16 bp, Homo sapiens
tgaccaggcatcctcc

SEQ ID NO: 2144646 - DNA, 16 bp, Homo sapiens
tgaccatcctgtcctt

SEQ ID NO: 2144647 - DNA, 22 bp, Homo sapiens
tgaccatctcttaggtctaatg

SEQ ID NO: 2144648 - DNA, 12 bp, Homo sapiens
tgaccatgtact

SEQ ID NO: 2144649 - DNA, 23 bp, Homo sapiens
tgaccattggctgcgctaacccc

SEQ ID NO: 2144650 - DNA, 16 bp, Homo sapiens
tgacccaaagaccaat

SEQ ID NO: 2144651 - DNA, 15 bp, Homo sapiens
tgacccaagaggtgg

SEQ ID NO: 2144652 - DNA, 14 bp, Homo sapiens
tgacccacatgcca

SEQ ID NO: 2144653 - DNA, 15 bp, Homo sapiens
tgacccacatgccat

SEQ ID NO: 2144654 - DNA, 14 bp, Homo sapiens
tgacccacccagtg

SEQ ID NO: 2144655 - DNA, 18 bp, Homo sapiens
tgacccagagtggagtct

SEQ ID NO: 2144656 - DNA, 20 bp, Homo sapiens
tgacccagagtggagtctga

SEQ ID NO: 2144657 - DNA, 12 bp, Homo sapiens
tgacccagtccc

SEQ ID NO: 2144658 - DNA, 14 bp, Homo sapiens
tgacccagtccctg

SEQ ID NO: 2144659 - DNA, 16 bp, Homo sapiens
tgacccagtccctggg

SEQ ID NO: 2144660 - DNA, 13 bp, Homo sapiens
tgacccagtgaga

SEQ ID NO: 2144661 - DNA, 22 bp, Homo sapiens
tgacccccaaccaagtggctcc

SEQ ID NO: 2144662 - DNA, 14 bp, Homo sapiens
tgacccctctaatt

SEQ ID NO: 2144663 - DNA, 14 bp, Homo sapiens
tgacccctttcccc

SEQ ID NO: 2144664 - DNA, 17 bp, Homo sapiens
tgacccctttcccccac

SEQ ID NO: 2144665 - DNA, 18 bp, Homo sapiens
tgacccctttcccccacc

SEQ ID NO: 2144666 - DNA, 22 bp, Homo sapiens
tgacccggcaccccctgcagct

SEQ ID NO: 2144667 - DNA, 14 bp, Homo sapiens
tgaccctccctacc

SEQ ID NO: 2144668 - DNA, 15 bp, Homo sapiens
tgaccctcctgtcca

SEQ ID NO: 2144669 - DNA, 23 bp, Homo sapiens
tgaccctctgaatggtccagggt

SEQ ID NO: 2144670 - DNA, 13 bp, Homo sapiens
tgacccttcaggg

SEQ ID NO: 2144671 - DNA, 14 bp, Homo sapiens
tgacccttcagggc

SEQ ID NO: 2144672 - DNA, 21 bp, Homo sapiens
tgacccttcagggccagaagg

SEQ ID NO: 2144673 - DNA, 19 bp, Homo sapiens
tgacccttcccaatcagca

SEQ ID NO: 2144674 - DNA, 22 bp, Homo sapiens
tgacccttcccaatcagcactg

SEQ ID NO: 2144675 - DNA, 15 bp, Homo sapiens
tgaccggcacctgcg

SEQ ID NO: 2144676 - DNA, 19 bp, Homo sapiens
tgaccgggacttcaaagcc

SEQ ID NO: 2144677 - DNA, 17 bp, Homo sapiens
tgaccgttttcatcctg

SEQ ID NO: 2144678 - DNA, 22 bp, Homo sapiens
tgaccgttttcatcctggcctc

SEQ ID NO: 2144679 - DNA, 23 bp, Homo sapiens
tgaccgttttcatcctggcctcc

SEQ ID NO: 2144680 - DNA, 23 bp, Homo sapiens
tgacctatacctgtgtttcttgc

SEQ ID NO: 2144681 - DNA, 15 bp, Homo sapiens
tgacctcacagtgac

SEQ ID NO: 2144682 - DNA, 12 bp, Homo sapiens
tgacctcagcaa

SEQ ID NO: 2144683 - DNA, 19 bp, Homo sapiens
tgacctcagcaaatcctct

SEQ ID NO: 2144684 - DNA, 22 bp, Homo sapiens
tgacctcagctgcacattcctg

SEQ ID NO: 2144685 - DNA, 14 bp, Homo sapiens
tgacctcccagccc

SEQ ID NO: 2144686 - DNA, 22 bp, Homo sapiens
tgacctcccagccctatggatg

SEQ ID NO: 2144687 - DNA, 23 bp, Homo sapiens
tgacctcccagccctatggatgt

SEQ ID NO: 2144688 - DNA, 14 bp, Homo sapiens
tgacctccctctaa

SEQ ID NO: 2144689 - DNA, 14 bp, Homo sapiens
tgacctctgcctga

SEQ ID NO: 2144690 - DNA, 11 bp, Homo sapiens
tgacctgcagg

SEQ ID NO: 2144691 - DNA, 20 bp, Homo sapiens
tgacctgccccgcccagctg

SEQ ID NO: 2144692 - DNA, 12 bp, Homo sapiens
tgacctgctgag

SEQ ID NO: 2144693 - DNA, 15 bp, Homo sapiens
tgacctgctgagctc

SEQ ID NO: 2144694 - DNA, 17 bp, Homo sapiens
tgacctgctgagctctg

SEQ ID NO: 2144695 - DNA, 18 bp, Homo sapiens
tgacctgctgagctctga

SEQ ID NO: 2144696 - DNA, 21 bp, Homo sapiens
tgacctgctgagctctgagag

SEQ ID NO: 2144697 - DNA, 22 bp, Homo sapiens
tgacctgctgagctctgagagg

SEQ ID NO: 2144698 - DNA, 17 bp, Homo sapiens
tgaccttctaggaagct

SEQ ID NO: 2144699 - DNA, 14 bp, Homo sapiens
tgaccttctctata

SEQ ID NO: 2144700 - DNA, 19 bp, Homo sapiens
tgaccttggagagacacag

SEQ ID NO: 2144701 - DNA, 20 bp, Homo sapiens
tgaccttggagagacacagc

SEQ ID NO: 2144702 - DNA, 19 bp, Homo sapiens
tgacgattatttatttctg

SEQ ID NO: 2144703 - DNA, 20 bp, Homo sapiens
tgacgattatttatttctgt

SEQ ID NO: 2144704 - DNA, 12 bp, Homo sapiens
tgacgccctgcg

SEQ ID NO: 2144705 - DNA, 16 bp, Homo sapiens
tgacggacgtcctgct

SEQ ID NO: 2144706 - DNA, 16 bp, Homo sapiens
tgacgggagcctcctc

SEQ ID NO: 2144707 - DNA, 15 bp, Homo sapiens
tgacgggaggcctca

SEQ ID NO: 2144708 - DNA, 17 bp, Homo sapiens
tgacgggaggcctcagt

SEQ ID NO: 2144709 - DNA, 20 bp, Homo sapiens
tgacggtcctttaggcagcc

SEQ ID NO: 2144710 - DNA, 21 bp, Homo sapiens
tgacggtcctttaggcagcct

SEQ ID NO: 2144711 - DNA, 22 bp, Homo sapiens
tgacggtcctttaggcagcctg

SEQ ID NO: 2144712 - DNA, 18 bp, Homo sapiens
tgacgtgcacctgtactc

SEQ ID NO: 2144713 - DNA, 14 bp, Homo sapiens
tgactaaaaatatt

SEQ ID NO: 2144714 - DNA, 22 bp, Homo sapiens
tgactaaaaatattataactta

SEQ ID NO: 2144715 - DNA, 22 bp, Homo sapiens
tgactataaacattaaaagaag

SEQ ID NO: 2144716 - DNA, 17 bp, Homo sapiens
tgactatatagagatgt

SEQ ID NO: 2144717 - DNA, 22 bp, Homo sapiens
tgactatcacatacaatttgca

SEQ ID NO: 2144718 - DNA, 16 bp, Homo sapiens
tgactattttttaata

SEQ ID NO: 2144719 - DNA, 20 bp, Homo sapiens
tgactattttttaataaaag

SEQ ID NO: 2144720 - DNA, 15 bp, Homo sapiens
tgactcacccaagca

SEQ ID NO: 2144721 - DNA, 18 bp, Homo sapiens
tgactccagagtctgagc

SEQ ID NO: 2144722 - DNA, 20 bp, Homo sapiens
tgactccagagtctgagccc

SEQ ID NO: 2144723 - DNA, 14 bp, Homo sapiens
tgactccagcctgc

SEQ ID NO: 2144724 - DNA, 17 bp, Homo sapiens
tgactccagtgagctgg

SEQ ID NO: 2144725 - DNA, 16 bp, Homo sapiens
tgactccctgtggggg

SEQ ID NO: 2144726 - DNA, 22 bp, Homo sapiens
tgactcccttaaaatagaaata

SEQ ID NO: 2144727 - DNA, 17 bp, Homo sapiens
tgactcctctaagccac

SEQ ID NO: 2144728 - DNA, 22 bp, Homo sapiens
tgactccttagagacatcaaaa

SEQ ID NO: 2144729 - DNA, 19 bp, Homo sapiens
tgactcggtgtaaaaccat

SEQ ID NO: 2144730 - DNA, 15 bp, Homo sapiens
tgactctctgtgacc

SEQ ID NO: 2144731 - DNA, 14 bp, Homo sapiens
tgactcttgccttt

SEQ ID NO: 2144732 - DNA, 20 bp, Homo sapiens
tgactcttgcctttccacct

SEQ ID NO: 2144733 - DNA, 22 bp, Homo sapiens
tgactctttttagggccaggca

SEQ ID NO: 2144734 - DNA, 18 bp, Homo sapiens
tgactgaaggggcacacc

SEQ ID NO: 2144735 - DNA, 18 bp, Homo sapiens
tgactgaatttgggcctc

SEQ ID NO: 2144736 - DNA, 16 bp, Homo sapiens
tgactgacacaggcca

SEQ ID NO: 2144737 - DNA, 22 bp, Homo sapiens
tgactgacacaggccagcccca

SEQ ID NO: 2144738 - DNA, 11 bp, Homo sapiens
tgactgagctt

SEQ ID NO: 2144739 - DNA, 16 bp, Homo sapiens
tgactgccccaactcc

SEQ ID NO: 2144740 - DNA, 21 bp, Homo sapiens
tgactgctccccagccctggc

SEQ ID NO: 2144741 - DNA, 15 bp, Homo sapiens
tgactggagcccgag

SEQ ID NO: 2144742 - DNA, 16 bp, Homo sapiens
tgactggcaggtgcag

SEQ ID NO: 2144743 - DNA, 21 bp, Homo sapiens
tgactggcaggtgcagatggg

SEQ ID NO: 2144744 - DNA, 21 bp, Homo sapiens
tgactgggtttctctgtatag

SEQ ID NO: 2144745 - DNA, 18 bp, Homo sapiens
tgactgtaaacatagata

SEQ ID NO: 2144746 - DNA, 21 bp, Homo sapiens
tgactgtaaacatagatagtg

SEQ ID NO: 2144747 - DNA, 14 bp, Homo sapiens
tgactgtaattaat

SEQ ID NO: 2144748 - DNA, 16 bp, Homo sapiens
tgactgtcactgttcc

SEQ ID NO: 2144749 - DNA, 17 bp, Homo sapiens
tgactgtcactgttcct

SEQ ID NO: 2144750 - DNA, 15 bp, Homo sapiens
tgacttactgtttct

SEQ ID NO: 2144751 - DNA, 15 bp, Homo sapiens
tgacttcacagcagc

SEQ ID NO: 2144752 - DNA, 12 bp, Homo sapiens
tgacttcaggtg

SEQ ID NO: 2144753 - DNA, 24 bp, Homo sapiens
tgacttcaggtggagagcactaga

SEQ ID NO: 2144754 - DNA, 19 bp, Homo sapiens
tgacttcctcgcctctccc

SEQ ID NO: 2144755 - DNA, 21 bp, Homo sapiens
tgacttcctcgcctctcccac

SEQ ID NO: 2144756 - DNA, 14 bp, Homo sapiens
tgacttcctggtga

SEQ ID NO: 2144757 - DNA, 15 bp, Homo sapiens
tgacttctaagtaaa

SEQ ID NO: 2144758 - DNA, 23 bp, Homo sapiens
tgacttctaagtaaaaccacagc

SEQ ID NO: 2144759 - DNA, 24 bp, Homo sapiens
tgacttctaagtaaaaccacagca

SEQ ID NO: 2144760 - DNA, 12 bp, Homo sapiens
tgacttcttggt

SEQ ID NO: 2144761 - DNA, 18 bp, Homo sapiens
tgacttgcacatctctgc

SEQ ID NO: 2144762 - DNA, 19 bp, Homo sapiens
tgacttgggcacccccagc

SEQ ID NO: 2144763 - DNA, 23 bp, Homo sapiens
tgacttgggcacccccagcctgg

SEQ ID NO: 2144764 - DNA, 21 bp, Homo sapiens
tgatgatcagctgtttgtcat

SEQ ID NO: 2144765 - DNA, 20 bp, Homo sapiens
tgatgatctttgcagacagg

SEQ ID NO: 2144766 - DNA, 18 bp, Homo sapiens
tgatgattaaacacctga

SEQ ID NO: 2144767 - DNA, 22 bp, Homo sapiens
tgatgattaaacacctgacaca

SEQ ID NO: 2144768 - DNA, 16 bp, Homo sapiens
tgatgcatttccacac

SEQ ID NO: 2144769 - DNA, 21 bp, Homo sapiens
tgatgccaaaaaaaaatacat

SEQ ID NO: 2144770 - DNA, 17 bp, Homo sapiens
tgatgccgctcttctgt

SEQ ID NO: 2144771 - DNA, 11 bp, Homo sapiens
tgatgctaaat

SEQ ID NO: 2144772 - DNA, 16 bp, Homo sapiens
tgatgctaaataggag

SEQ ID NO: 2144773 - DNA, 13 bp, Homo sapiens
tgatgctgccccg

SEQ ID NO: 2144774 - DNA, 22 bp, Homo sapiens
tgatgctgccccgttccctgtc

SEQ ID NO: 2144775 - DNA, 23 bp, Homo sapiens
tgatggaccgggtgggcctggcc

SEQ ID NO: 2144776 - DNA, 17 bp, Homo sapiens
tgatggagaaggaaggc

SEQ ID NO: 2144777 - DNA, 16 bp, Homo sapiens
tgatggatgagaaaaa

SEQ ID NO: 2144778 - DNA, 22 bp, Homo sapiens
tgatggcaccactgcactccag

SEQ ID NO: 2144779 - DNA, 22 bp, Homo sapiens
tgatggcacttagctatcagaa

SEQ ID NO: 2144780 - DNA, 15 bp, Homo sapiens
tgatggccaagagca

SEQ ID NO: 2144781 - DNA, 16 bp, Homo sapiens
tgatggccaagagcat

SEQ ID NO: 2144782 - DNA, 15 bp, Homo sapiens
tgatggccaaggggg

SEQ ID NO: 2144783 - DNA, 19 bp, Homo sapiens
tgatgggaaagcattgtaa

SEQ ID NO: 2144784 - DNA, 12 bp, Homo sapiens
tgatggggagaa

SEQ ID NO: 2144785 - DNA, 15 bp, Homo sapiens
tgatggggtgggcag

SEQ ID NO: 2144786 - DNA, 17 bp, Homo sapiens
tgatggggtgggcaggg

SEQ ID NO: 2144787 - DNA, 18 bp, Homo sapiens
tgatggggtgggcagggc

SEQ ID NO: 2144788 - DNA, 15 bp, Homo sapiens
tgatggtgctcccct

SEQ ID NO: 2144789 - DNA, 14 bp, Homo sapiens
tgatgtacatgtgt

SEQ ID NO: 2144790 - DNA, 12 bp, Homo sapiens
tgatgtcagcct

SEQ ID NO: 2144791 - DNA, 18 bp, Homo sapiens
tgatgtcagccttgcatc

SEQ ID NO: 2144792 - DNA, 21 bp, Homo sapiens
tgatgtcatgtacttcctgtg

SEQ ID NO: 2144793 - DNA, 12 bp, Homo sapiens
tgatgtccagaa

SEQ ID NO: 2144794 - DNA, 17 bp, Homo sapiens
tgatgtctcttgtagaa

SEQ ID NO: 2144795 - DNA, 13 bp, Homo sapiens
tgatgtgcaagga

SEQ ID NO: 2144796 - DNA, 22 bp, Homo sapiens
tgatgtgctggagctggctttg

SEQ ID NO: 2144797 - DNA, 23 bp, Homo sapiens
tgatgttaaaaaaataagaagaa

SEQ ID NO: 2144798 - DNA, 16 bp, Homo sapiens
tgatgttaaaattcca

SEQ ID NO: 2144799 - DNA, 10 bp, Homo sapiens
tgatgttaac

SEQ ID NO: 2144800 - DNA, 22 bp, Homo sapiens
tgatgttaaccagaataaagtt

SEQ ID NO: 2144801 - DNA, 20 bp, Homo sapiens
tgatgtttccagaaaatata

SEQ ID NO: 2144802 - DNA, 15 bp, Homo sapiens
tgatgtttttatgat

SEQ ID NO: 2144803 - DNA, 21 bp, Homo sapiens
tgattaaacacctgacacatc

SEQ ID NO: 2144804 - DNA, 15 bp, Homo sapiens
tgattaatttgagaa

SEQ ID NO: 2144805 - DNA, 18 bp, Homo sapiens
tgattacataatcaaagc

SEQ ID NO: 2144806 - DNA, 20 bp, Homo sapiens
tgattacataatcaaagcta

SEQ ID NO: 2144807 - DNA, 11 bp, Homo sapiens
tgattagatga

SEQ ID NO: 2144808 - DNA, 21 bp, Homo sapiens
tgattatgtgtcctttcttga

SEQ ID NO: 2144809 - DNA, 18 bp, Homo sapiens
tgattattctgattccac

SEQ ID NO: 2144810 - DNA, 17 bp, Homo sapiens
tgattcataacaatgta

SEQ ID NO: 2144811 - DNA, 19 bp, Homo sapiens
tgattcatgccaattagca

SEQ ID NO: 2144812 - DNA, 20 bp, Homo sapiens
tgattcattttaacatctga

SEQ ID NO: 2144813 - DNA, 15 bp, Homo sapiens
tgattcccaagctct

SEQ ID NO: 2144814 - DNA, 18 bp, Homo sapiens
tgattcggatttgacaaa

SEQ ID NO: 2144815 - DNA, 19 bp, Homo sapiens
tgattctaatgtcttcatt

SEQ ID NO: 2144816 - DNA, 16 bp, Homo sapiens
tgattgacacacagca

SEQ ID NO: 2144817 - DNA, 23 bp, Homo sapiens
tgattggacattttcttcagaga

SEQ ID NO: 2144818 - DNA, 14 bp, Homo sapiens
tgattgtaaaatag

SEQ ID NO: 2144819 - DNA, 20 bp, Homo sapiens
tgattgtagtaatctgcatt

SEQ ID NO: 2144820 - DNA, 18 bp, Homo sapiens
tgattgtcttaatattgt

SEQ ID NO: 2144821 - DNA, 16 bp, Homo sapiens
tgattgtttaattgta

SEQ ID NO: 2144822 - DNA, 12 bp, Homo sapiens
tgatttaatgtt

SEQ ID NO: 2144823 - DNA, 15 bp, Homo sapiens
tgatttaatgttttc

SEQ ID NO: 2144824 - DNA, 21 bp, Homo sapiens
tgatttagaactgtatgtcag

SEQ ID NO: 2144825 - DNA, 19 bp, Homo sapiens
tgatttagggaagcaggga

SEQ ID NO: 2144826 - DNA, 17 bp, Homo sapiens
tgatttatatatggcat

SEQ ID NO: 2144827 - DNA, 20 bp, Homo sapiens
tgatttatgatcacttggaa

SEQ ID NO: 2144828 - DNA, 17 bp, Homo sapiens
tgatttcaatgattgtt

SEQ ID NO: 2144829 - DNA, 23 bp, Homo sapiens
tgatttcaggatactctgtcaga

SEQ ID NO: 2144830 - DNA, 14 bp, Homo sapiens
tgatttcagggaaa

SEQ ID NO: 2144831 - DNA, 15 bp, Homo sapiens
tgatttcattaatac

SEQ ID NO: 2144832 - DNA, 18 bp, Homo sapiens
tgatttccaaagagaaaa

SEQ ID NO: 2144833 - DNA, 13 bp, Homo sapiens
tgatttccaggcc

SEQ ID NO: 2144834 - DNA, 13 bp, Homo sapiens
tgatttctattca

SEQ ID NO: 2144835 - DNA, 20 bp, Homo sapiens
tgatttctattcaaggtggc

SEQ ID NO: 2144836 - DNA, 13 bp, Homo sapiens
tgatttctctgaa

SEQ ID NO: 2144837 - DNA, 21 bp, Homo sapiens
tgatttctctgaacagaaaac

SEQ ID NO: 2144838 - DNA, 21 bp, Homo sapiens
tgatttgacccactcacactt

SEQ ID NO: 2144839 - DNA, 20 bp, Homo sapiens
tgatttggaagagaggcacc

SEQ ID NO: 2144840 - DNA, 18 bp, Homo sapiens
tgatttgtactgaaaaat

SEQ ID NO: 2144841 - DNA, 15 bp, Homo sapiens
tgattttaaaaggtt

SEQ ID NO: 2144842 - DNA, 16 bp, Homo sapiens
tgattttaaaaggttg

SEQ ID NO: 2144843 - DNA, 13 bp, Homo sapiens
tgattttacagag

SEQ ID NO: 2144844 - DNA, 22 bp, Homo sapiens
tgattttacagagaatctgaag

SEQ ID NO: 2144845 - DNA, 15 bp, Homo sapiens
tgattttatacatag

SEQ ID NO: 2144846 - DNA, 22 bp, Homo sapiens
tgattttatacatagtcacaaa

SEQ ID NO: 2144847 - DNA, 20 bp, Homo sapiens
tgattttcaaagctttttcc

SEQ ID NO: 2144848 - DNA, 16 bp, Homo sapiens
tgattttgtacagaat

SEQ ID NO: 2144849 - DNA, 14 bp, Homo sapiens
tgatttttgttgat

SEQ ID NO: 2144850 - DNA, 17 bp, Homo sapiens
tgattttttaaaagaaa

SEQ ID NO: 2144851 - DNA, 16 bp, Homo sapiens
tgatttttttttttca

SEQ ID NO: 2144852 - DNA, 12 bp, Homo sapiens
tgcaaaaaatag

SEQ ID NO: 2144853 - DNA, 13 bp, Homo sapiens
tgcaaaagtgggg

SEQ ID NO: 2144854 - DNA, 16 bp, Homo sapiens
tgcaaaagtggggcta

SEQ ID NO: 2144855 - DNA, 22 bp, Homo sapiens
tgcaaaagtggggctaaatgaa

SEQ ID NO: 2144856 - DNA, 14 bp, Homo sapiens
tgcaaaatttccag

SEQ ID NO: 2144857 - DNA, 23 bp, Homo sapiens
tgcaaacacacaaaggtataatt

SEQ ID NO: 2144858 - DNA, 16 bp, Homo sapiens
tgcaaactcactgctc

SEQ ID NO: 2144859 - DNA, 19 bp, Homo sapiens
tgcaaacttgtatctgaag

SEQ ID NO: 2144860 - DNA, 22 bp, Homo sapiens
tgcaaaggtctttttaaaccag

SEQ ID NO: 2144861 - DNA, 21 bp, Homo sapiens
tgcaaagtgttttctcagaac

SEQ ID NO: 2144862 - DNA, 23 bp, Homo sapiens
tgcaaagttccctacttcctgtg

SEQ ID NO: 2144863 - DNA, 23 bp, Homo sapiens
tgcaaatattagcaaagaagctt

SEQ ID NO: 2144864 - DNA, 14 bp, Homo sapiens
tgcaaatgcctcca

SEQ ID NO: 2144865 - DNA, 14 bp, Homo sapiens
tgcaaattaacagt

SEQ ID NO: 2144866 - DNA, 16 bp, Homo sapiens
tgcaacaagagcaaaa

SEQ ID NO: 2144867 - DNA, 14 bp, Homo sapiens
tgcaaccacacacc

SEQ ID NO: 2144868 - DNA, 19 bp, Homo sapiens
tgcaacctccacctcctga

SEQ ID NO: 2144869 - DNA, 20 bp, Homo sapiens
tgcaacctccacctcctgag

SEQ ID NO: 2144870 - DNA, 18 bp, Homo sapiens
tgcaacctccgcctcttg

SEQ ID NO: 2144871 - DNA, 13 bp, Homo sapiens
tgcaactagccaa

SEQ ID NO: 2144872 - DNA, 17 bp, Homo sapiens
tgcaagagacagagccc

SEQ ID NO: 2144873 - DNA, 18 bp, Homo sapiens
tgcaagagacagagcccc

SEQ ID NO: 2144874 - DNA, 19 bp, Homo sapiens
tgcaagagacagagccccc

SEQ ID NO: 2144875 - DNA, 22 bp, Homo sapiens
tgcaagagacagagcccccaag

SEQ ID NO: 2144876 - DNA, 17 bp, Homo sapiens
tgcaagagactctggcc

SEQ ID NO: 2144877 - DNA, 23 bp, Homo sapiens
tgcaagagccttggtgtccacct

SEQ ID NO: 2144878 - DNA, 20 bp, Homo sapiens
tgccagtgtttagaagagcc

SEQ ID NO: 2144879 - DNA, 21 bp, Homo sapiens
tgccagtgtttagaagagcct

SEQ ID NO: 2144880 - DNA, 23 bp, Homo sapiens
tgccagtgtttagaagagcctga

SEQ ID NO: 2144881 - DNA, 12 bp, Homo sapiens
tgccataccgct

SEQ ID NO: 2144882 - DNA, 18 bp, Homo sapiens
tgccatagagtttaacac

SEQ ID NO: 2144883 - DNA, 17 bp, Homo sapiens
tgccatagtcacatggc

SEQ ID NO: 2144884 - DNA, 19 bp, Homo sapiens
tgccatagtcacatggcct

SEQ ID NO: 2144885 - DNA, 15 bp, Homo sapiens
tgccatattctgttg

SEQ ID NO: 2144886 - DNA, 15 bp, Homo sapiens
tgccatctccaccct

SEQ ID NO: 2144887 - DNA, 18 bp, Homo sapiens
tgccatgaggcctttccc

SEQ ID NO: 2144888 - DNA, 23 bp, Homo sapiens
tgccatgaggcctttccccagtg

SEQ ID NO: 2144889 - DNA, 14 bp, Homo sapiens
tgccatgatctgta

SEQ ID NO: 2144890 - DNA, 15 bp, Homo sapiens
tgccatgatctgtat

SEQ ID NO: 2144891 - DNA, 14 bp, Homo sapiens
tgccatgcccagag

SEQ ID NO: 2144892 - DNA, 23 bp, Homo sapiens
tgccatggacagaagaaggcagc

SEQ ID NO: 2144893 - DNA, 15 bp, Homo sapiens
tgccatgggcctgct

SEQ ID NO: 2144894 - DNA, 16 bp, Homo sapiens
tgccatgtagacccct

SEQ ID NO: 2144895 - DNA, 22 bp, Homo sapiens
tgccatgtcttgttcagaagac

SEQ ID NO: 2144896 - DNA, 16 bp, Homo sapiens
tgccatgttggccagg

SEQ ID NO: 2144897 - DNA, 23 bp, Homo sapiens
tgccatgtttagattccaggatc

SEQ ID NO: 2144898 - DNA, 16 bp, Homo sapiens
tgccattcatagagag

SEQ ID NO: 2144899 - DNA, 14 bp, Homo sapiens
tgccatttctctgc

SEQ ID NO: 2144900 - DNA, 17 bp, Homo sapiens
tgccatttgcaccctcc

SEQ ID NO: 2144901 - DNA, 22 bp, Homo sapiens
tgccatttgcaccctccgcctt

SEQ ID NO: 2144902 - DNA, 22 bp, Homo sapiens
tgcccaacctgctctcctcttg

SEQ ID NO: 2144903 - DNA, 21 bp, Homo sapiens
tgcccaagaatagatgctgac

SEQ ID NO: 2144904 - DNA, 22 bp, Homo sapiens
tgcccaagaatagatgctgact

SEQ ID NO: 2144905 - DNA, 22 bp, Homo sapiens
tgcccaatgctttgggaggcca

SEQ ID NO: 2144906 - DNA, 14 bp, Homo sapiens
tgcccacaggatca

SEQ ID NO: 2144907 - DNA, 19 bp, Homo sapiens
tgcccacaggatcagtctg

SEQ ID NO: 2144908 - DNA, 18 bp, Homo sapiens
tgcccacagggaccaaga

SEQ ID NO: 2144909 - DNA, 23 bp, Homo sapiens
tgcccacttagccgtccatggca

SEQ ID NO: 2144910 - DNA, 16 bp, Homo sapiens
tgcccagagaatcagg

SEQ ID NO: 2144911 - DNA, 20 bp, Homo sapiens
tgcccagagatgcctccacc

SEQ ID NO: 2144912 - DNA, 21 bp, Homo sapiens
tgcccagagatgcctccaccg

SEQ ID NO: 2144913 - DNA, 19 bp, Homo sapiens
tgcccagccctaaacatca

SEQ ID NO: 2144914 - DNA, 17 bp, Homo sapiens
tgcccaggagagccagc

SEQ ID NO: 2144915 - DNA, 19 bp, Homo sapiens
tgcccaggagagccagccc

SEQ ID NO: 2144916 - DNA, 20 bp, Homo sapiens
tgcccaggagagccagccct

SEQ ID NO: 2144917 - DNA, 21 bp, Homo sapiens
tgcccaggagagccagccctc

SEQ ID NO: 2144918 - DNA, 22 bp, Homo sapiens
tgcccaggagagccagccctcc

SEQ ID NO: 2144919 - DNA, 17 bp, Homo sapiens
tgcccaggcccctgcca

SEQ ID NO: 2144920 - DNA, 18 bp, Homo sapiens
tgcccaggcccctgccac

SEQ ID NO: 2144921 - DNA, 19 bp, Homo sapiens
tgcccaggctggcgtgcag

SEQ ID NO: 2144922 - DNA, 15 bp, Homo sapiens
tgcccagggctcagc

SEQ ID NO: 2144923 - DNA, 16 bp, Homo sapiens
tgcccagggctcagcc

SEQ ID NO: 2144924 - DNA, 19 bp, Homo sapiens
tgcccagggctcagcctgg

SEQ ID NO: 2144925 - DNA, 20 bp, Homo sapiens
tgcccagggctcagcctggt

SEQ ID NO: 2144926 - DNA, 13 bp, Homo sapiens
tgcccagttcact

SEQ ID NO: 2144927 - DNA, 15 bp, Homo sapiens
tgcccatacccctgc

SEQ ID NO: 2144928 - DNA, 18 bp, Homo sapiens
tgcccatacccctgcctg

SEQ ID NO: 2144929 - DNA, 22 bp, Homo sapiens
tgcccatgtgtcccctcactct

SEQ ID NO: 2144930 - DNA, 18 bp, Homo sapiens
tgccccaacccccaccga

SEQ ID NO: 2144931 - DNA, 15 bp, Homo sapiens
tgccccaactcctgg

SEQ ID NO: 2144932 - DNA, 16 bp, Homo sapiens
tgccccaactcctgga

SEQ ID NO: 2144933 - DNA, 17 bp, Homo sapiens
tgccccaagcagccagc

SEQ ID NO: 2144934 - DNA, 14 bp, Homo sapiens
tgccccaccagcca

SEQ ID NO: 2144935 - DNA, 16 bp, Homo sapiens
tgccccagagatgggc

SEQ ID NO: 2144936 - DNA, 13 bp, Homo sapiens
tgccccagaggcc

SEQ ID NO: 2144937 - DNA, 15 bp, Homo sapiens
tgccccagcgcggct

SEQ ID NO: 2144938 - DNA, 13 bp, Homo sapiens
tgccccagctctg

SEQ ID NO: 2144939 - DNA, 19 bp, Homo sapiens
tgccccagctctggcttcc

SEQ ID NO: 2144940 - DNA, 13 bp, Homo sapiens
tgccccagcttta

SEQ ID NO: 2144941 - DNA, 23 bp, Homo sapiens
tgccccatcctgggccttacctc

SEQ ID NO: 2144942 - DNA, 23 bp, Homo sapiens
tgcccccagcactcctctgtctc

SEQ ID NO: 2144943 - DNA, 16 bp, Homo sapiens
tgcccccagcctctgt

SEQ ID NO: 2144944 - DNA, 21 bp, Homo sapiens
tgcccccatctccccaggcct

SEQ ID NO: 2144945 - DNA, 21 bp, Homo sapiens
tgcccccgacagcccagccta

SEQ ID NO: 2144946 - DNA, 13 bp, Homo sapiens
tgccccctcatct

SEQ ID NO: 2144947 - DNA, 12 bp, Homo sapiens
tgccccctggtg

SEQ ID NO: 2144948 - DNA, 13 bp, Homo sapiens
tgccccctggtgg

SEQ ID NO: 2144949 - DNA, 21 bp, Homo sapiens
tgccccctggtggacagtcct

SEQ ID NO: 2144950 - DNA, 17 bp, Homo sapiens
tgccccgcttccccaca

SEQ ID NO: 2144951 - DNA, 20 bp, Homo sapiens
tgccccgggtccccagctcc

SEQ ID NO: 2144952 - DNA, 23 bp, Homo sapiens
tgccccgggtccccagctcccca

SEQ ID NO: 2144953 - DNA, 19 bp, Homo sapiens
tgccccgttccctgtcaga

SEQ ID NO: 2144954 - DNA, 15 bp, Homo sapiens
tgcccctgccccaac

SEQ ID NO: 2144955 - DNA, 17 bp, Homo sapiens
tgcccctgccccaaccc

SEQ ID NO: 2144956 - DNA, 21 bp, Homo sapiens
tgcccctgccccaacccccac

SEQ ID NO: 2144957 - DNA, 12 bp, Homo sapiens
tgcccctgtaaa

SEQ ID NO: 2144958 - DNA, 17 bp, Homo sapiens
tgcccctgtaggttgct

SEQ ID NO: 2144959 - DNA, 16 bp, Homo sapiens
tgccccttccccatct

SEQ ID NO: 2144960 - DNA, 15 bp, Homo sapiens
tgccccttgggcctc

SEQ ID NO: 2144961 - DNA, 14 bp, Homo sapiens
tgcccgcagagccc

SEQ ID NO: 2144962 - DNA, 17 bp, Homo sapiens
tgcccgccctgcccctg

SEQ ID NO: 2144963 - DNA, 12 bp, Homo sapiens
tgcccggctgcg

SEQ ID NO: 2144964 - DNA, 17 bp, Homo sapiens
tgcccgtcttcagccta

SEQ ID NO: 2144965 - DNA, 18 bp, Homo sapiens
tgccctcagatggagaca

SEQ ID NO: 2144966 - DNA, 18 bp, Homo sapiens
tgccctcattttatgtca

SEQ ID NO: 2144967 - DNA, 18 bp, Homo sapiens
tgccctccacagccgcag

SEQ ID NO: 2144968 - DNA, 15 bp, Homo sapiens
tgccctccctggcct

SEQ ID NO: 2144969 - DNA, 21 bp, Homo sapiens
tgccctccctggggtccttgc

SEQ ID NO: 2144970 - DNA, 15 bp, Homo sapiens
tgccctctccttcct

SEQ ID NO: 2144971 - DNA, 16 bp, Homo sapiens
tgccctctccttcctt

SEQ ID NO: 2144972 - DNA, 21 bp, Homo sapiens
tgccctctggattctctgggt

SEQ ID NO: 2144973 - DNA, 16 bp, Homo sapiens
tgccctgacccctgca

SEQ ID NO: 2144974 - DNA, 12 bp, Homo sapiens
tgccctgacctc

SEQ ID NO: 2144975 - DNA, 21 bp, Homo sapiens
tgccctgacctcccagcccta

SEQ ID NO: 2144976 - DNA, 16 bp, Homo sapiens
tgccctgccacctgtc

SEQ ID NO: 2144977 - DNA, 17 bp, Homo sapiens
tgccctgccacctgtct

SEQ ID NO: 2144978 - DNA, 21 bp, Homo sapiens
tgccctgccacctgtctgtct

SEQ ID NO: 2144979 - DNA, 22 bp, Homo sapiens
tgccctgccacctgtctgtctg

SEQ ID NO: 2144980 - DNA, 16 bp, Homo sapiens
tgccctgcccccacga

SEQ ID NO: 2144981 - DNA, 14 bp, Homo sapiens
tgccctgccctgcc

SEQ ID NO: 2144982 - DNA, 18 bp, Homo sapiens
tgccctgccctgccacct

SEQ ID NO: 2144983 - DNA, 13 bp, Homo sapiens
tgccctgcctccc

SEQ ID NO: 2144984 - DNA, 11 bp, Homo sapiens
tgccctgcctg

SEQ ID NO: 2144985 - DNA, 13 bp, Homo sapiens
tgccctgcctgca

SEQ ID NO: 2144986 - DNA, 18 bp, Homo sapiens
tgccctgcctgcccactt

SEQ ID NO: 2144987 - DNA, 20 bp, Homo sapiens
tgccctgctctggggatgca

SEQ ID NO: 2144988 - DNA, 21 bp, Homo sapiens
tgccctgctgccgcctcccag

SEQ ID NO: 2144989 - DNA, 15 bp, Homo sapiens
tgccctggagggagg

SEQ ID NO: 2144990 - DNA, 12 bp, Homo sapiens
tgccctggtgct

SEQ ID NO: 2144991 - DNA, 14 bp, Homo sapiens
tgccctggtgctgc

SEQ ID NO: 2144992 - DNA, 20 bp, Homo sapiens
tgccctggtgctgccacact

SEQ ID NO: 2144993 - DNA, 14 bp, Homo sapiens
tgctgctgtgtttt

SEQ ID NO: 2144994 - DNA, 16 bp, Homo sapiens
tgctgcttctcttggg

SEQ ID NO: 2144995 - DNA, 18 bp, Homo sapiens
tgctggaaaccacacttc

SEQ ID NO: 2144996 - DNA, 16 bp, Homo sapiens
tgctggactgaggacc

SEQ ID NO: 2144997 - DNA, 14 bp, Homo sapiens
tgctggactgtcat

SEQ ID NO: 2144998 - DNA, 15 bp, Homo sapiens
tgctggactgtcata

SEQ ID NO: 2144999 - DNA, 22 bp, Homo sapiens
tgctggagacagtagaggcatg

SEQ ID NO: 2145000 - DNA, 12 bp, Homo sapiens
tgctggagctgg

SEQ ID NO: 2145001 - DNA, 13 bp, Homo sapiens
tgctggagctggc

SEQ ID NO: 2145002 - DNA, 15 bp, Homo sapiens
tgctggattaatgtt

SEQ ID NO: 2145003 - DNA, 16 bp, Homo sapiens
tgctggattaatgttt

SEQ ID NO: 2145004 - DNA, 12 bp, Homo sapiens
tgctggcacctc

SEQ ID NO: 2145005 - DNA, 15 bp, Homo sapiens
tgctggcacctcaga

SEQ ID NO: 2145006 - DNA, 15 bp, Homo sapiens
tgctggccagcaccc

SEQ ID NO: 2145007 - DNA, 18 bp, Homo sapiens
tgctggccagcaccctct

SEQ ID NO: 2145008 - DNA, 16 bp, Homo sapiens
tgctggcctcaggctg

SEQ ID NO: 2145009 - DNA, 16 bp, Homo sapiens
tgctggcctggatctc

SEQ ID NO: 2145010 - DNA, 17 bp, Homo sapiens
tgctggcctgtggcagg

SEQ ID NO: 2145011 - DNA, 16 bp, Homo sapiens
tgctggcggcgcagag

SEQ ID NO: 2145012 - DNA, 15 bp, Homo sapiens
tgctggctgccttag

SEQ ID NO: 2145013 - DNA, 18 bp, Homo sapiens
tgctggctgttggctggg

SEQ ID NO: 2145014 - DNA, 23 bp, Homo sapiens
tgctgggaaccccgcagcccgtg

SEQ ID NO: 2145015 - DNA, 17 bp, Homo sapiens
tgctgggattacaggtg

SEQ ID NO: 2145016 - DNA, 19 bp, Homo sapiens
tgctgggcattttcccaga

SEQ ID NO: 2145017 - DNA, 14 bp, Homo sapiens
tgctgggctctcca

SEQ ID NO: 2145018 - DNA, 16 bp, Homo sapiens
tgctgggctctccacc

SEQ ID NO: 2145019 - DNA, 17 bp, Homo sapiens
tgctgggctctccacct

SEQ ID NO: 2145020 - DNA, 18 bp, Homo sapiens
tgctgggctctccacctc

SEQ ID NO: 2145021 - DNA, 15 bp, Homo sapiens
tgctggggagtccct

SEQ ID NO: 2145022 - DNA, 22 bp, Homo sapiens
tgctggttttcctaaatgcagt

SEQ ID NO: 2145023 - DNA, 17 bp, Homo sapiens
tgctgtaactgctgagc

SEQ ID NO: 2145024 - DNA, 18 bp, Homo sapiens
tgctgtaactgctgagcc

SEQ ID NO: 2145025 - DNA, 20 bp, Homo sapiens
tgctgtaactgctgagccac

SEQ ID NO: 2145026 - DNA, 23 bp, Homo sapiens
tgctgtaactgctgagccactcg

SEQ ID NO: 2145027 - DNA, 19 bp, Homo sapiens
tgctgtacccttccacctc

SEQ ID NO: 2145028 - DNA, 17 bp, Homo sapiens
tgctgtcaccttgctca

SEQ ID NO: 2145029 - DNA, 18 bp, Homo sapiens
tgctgtctccataatgcc

SEQ ID NO: 2145030 - DNA, 20 bp, Homo sapiens
tgctgtctccataatgccac

SEQ ID NO: 2145031 - DNA, 15 bp, Homo sapiens
tgctgtctttctcta

SEQ ID NO: 2145032 - DNA, 13 bp, Homo sapiens
tgctgtgcctgct

SEQ ID NO: 2145033 - DNA, 15 bp, Homo sapiens
tgctgtgcctgctag

SEQ ID NO: 2145034 - DNA, 18 bp, Homo sapiens
tgctgtgcctgctagagc

SEQ ID NO: 2145035 - DNA, 17 bp, Homo sapiens
tgctgtggccagggtga

SEQ ID NO: 2145036 - DNA, 23 bp, Homo sapiens
tgctgtggccagggtgagagctg

SEQ ID NO: 2145037 - DNA, 13 bp, Homo sapiens
tgctgtggcctca

SEQ ID NO: 2145038 - DNA, 23 bp, Homo sapiens
tgctgtggcctcacttccctggg

SEQ ID NO: 2145039 - DNA, 10 bp, Homo sapiens
tgctgtgggc

SEQ ID NO: 2145040 - DNA, 11 bp, Homo sapiens
tgctgtgggca

SEQ ID NO: 2145041 - DNA, 18 bp, Homo sapiens
tgctgtgggcagcaccct

SEQ ID NO: 2145042 - DNA, 14 bp, Homo sapiens
tgctgtggtgggga

SEQ ID NO: 2145043 - DNA, 11 bp, Homo sapiens
tgctgtgtagc

SEQ ID NO: 2145044 - DNA, 15 bp, Homo sapiens
tgctgttgccatagc

SEQ ID NO: 2145045 - DNA, 19 bp, Homo sapiens
tgctgtttgtttgacaaag

SEQ ID NO: 2145046 - DNA, 18 bp, Homo sapiens
tgctgttttgatttgtac

SEQ ID NO: 2145047 - DNA, 12 bp, Homo sapiens
tgcttaaaagac

SEQ ID NO: 2145048 - DNA, 15 bp, Homo sapiens
tgcttaaaattttac

SEQ ID NO: 2145049 - DNA, 21 bp, Homo sapiens
tgcttaaattatttttataca

SEQ ID NO: 2145050 - DNA, 17 bp, Homo sapiens
tgcttacagtgactgtc

SEQ ID NO: 2145051 - DNA, 14 bp, Homo sapiens
tgcttacattttta

SEQ ID NO: 2145052 - DNA, 13 bp, Homo sapiens
tgcttacccttca

SEQ ID NO: 2145053 - DNA, 18 bp, Homo sapiens
tgcttacccttcaccttt

SEQ ID NO: 2145054 - DNA, 13 bp, Homo sapiens
tgcttacctgacg

SEQ ID NO: 2145055 - DNA, 12 bp, Homo sapiens
tgcttagaaagt

SEQ ID NO: 2145056 - DNA, 16 bp, Homo sapiens
tgcttagaaagttatt

SEQ ID NO: 2145057 - DNA, 14 bp, Homo sapiens
tgcttaggatgttt

SEQ ID NO: 2145058 - DNA, 21 bp, Homo sapiens
tgcttagtatctcatcaacaa

SEQ ID NO: 2145059 - DNA, 20 bp, Homo sapiens
tgcttagtatggttctcaga

SEQ ID NO: 2145060 - DNA, 20 bp, Homo sapiens
tgcttatttatattcagaga

SEQ ID NO: 2145061 - DNA, 15 bp, Homo sapiens
tgcttatttccctca

SEQ ID NO: 2145062 - DNA, 18 bp, Homo sapiens
tgcttcagacctgacacc

SEQ ID NO: 2145063 - DNA, 14 bp, Homo sapiens
tgcttcagcctccc

SEQ ID NO: 2145064 - DNA, 20 bp, Homo sapiens
tgcttccctaggctgagctg

SEQ ID NO: 2145065 - DNA, 23 bp, Homo sapiens
tgcttctaaatgcccagttcact

SEQ ID NO: 2145066 - DNA, 13 bp, Homo sapiens
tgcttctccaaca

SEQ ID NO: 2145067 - DNA, 12 bp, Homo sapiens
tgcttctcttaa

SEQ ID NO: 2145068 - DNA, 13 bp, Homo sapiens
tgcttctgcagca

SEQ ID NO: 2145069 - DNA, 17 bp, Homo sapiens
tgcttctgcagcaactc

SEQ ID NO: 2145070 - DNA, 21 bp, Homo sapiens
tgcttctgcagcaactcccac

SEQ ID NO: 2145071 - DNA, 14 bp, Homo sapiens
tgcttctgtccagg

SEQ ID NO: 2145072 - DNA, 15 bp, Homo sapiens
tgcttctgtccagga

SEQ ID NO: 2145073 - DNA, 18 bp, Homo sapiens
tgcttctgtccaggacat

SEQ ID NO: 2145074 - DNA, 21 bp, Homo sapiens
tgcttctgtccaggacatgat

SEQ ID NO: 2145075 - DNA, 16 bp, Homo sapiens
tgcttcttcatcttga

SEQ ID NO: 2145076 - DNA, 16 bp, Homo sapiens
tgcttcttgccccttg

SEQ ID NO: 2145077 - DNA, 21 bp, Homo sapiens
tgcttcttgccccttgggcct

SEQ ID NO: 2145078 - DNA, 16 bp, Homo sapiens
tgcttgaaggaacagt

SEQ ID NO: 2145079 - DNA, 19 bp, Homo sapiens
tgcttgaaggaacagtgct

SEQ ID NO: 2145080 - DNA, 22 bp, Homo sapiens
tgcttgaaggaacagtgctgtt

SEQ ID NO: 2145081 - DNA, 15 bp, Homo sapiens
tgcttgactatcaca

SEQ ID NO: 2145082 - DNA, 16 bp, Homo sapiens
tgcttgactatcacat

SEQ ID NO: 2145083 - DNA, 17 bp, Homo sapiens
tgcttgactatcacata

SEQ ID NO: 2145084 - DNA, 20 bp, Homo sapiens
tgcttgactatcacatacaa

SEQ ID NO: 2145085 - DNA, 14 bp, Homo sapiens
tgcttgagcccagg

SEQ ID NO: 2145086 - DNA, 23 bp, Homo sapiens
tgcttgaggaggggcacctgcca

SEQ ID NO: 2145087 - DNA, 15 bp, Homo sapiens
tgcttggtggggctc

SEQ ID NO: 2145088 - DNA, 22 bp, Homo sapiens
tgcttgttgtcaagtataaagt

SEQ ID NO: 2145089 - DNA, 17 bp, Homo sapiens
tgctttaaagtacctgt

SEQ ID NO: 2145090 - DNA, 20 bp, Homo sapiens
tgctttacatgctgtgctct

SEQ ID NO: 2145091 - DNA, 13 bp, Homo sapiens
tgctttaccttta

SEQ ID NO: 2145092 - DNA, 21 bp, Homo sapiens
tgctttacctttaaaatcatt

SEQ ID NO: 2145093 - DNA, 21 bp, Homo sapiens
tgctttacctttattaatgaa

SEQ ID NO: 2145094 - DNA, 18 bp, Homo sapiens
tgctttatttatggctta

SEQ ID NO: 2145095 - DNA, 18 bp, Homo sapiens
tgctttccagcctgggca

SEQ ID NO: 2145096 - DNA, 12 bp, Homo sapiens
tgctttccctcc

SEQ ID NO: 2145097 - DNA, 16 bp, Homo sapiens
tgctttccctccccaa

SEQ ID NO: 2145098 - DNA, 21 bp, Homo sapiens
tgctttcctaaagtctctgct

SEQ ID NO: 2145099 - DNA, 12 bp, Homo sapiens
tgctttcctccc

SEQ ID NO: 2145100 - DNA, 15 bp, Homo sapiens
tgctttcctccctgg

SEQ ID NO: 2145101 - DNA, 20 bp, Homo sapiens
tgctttctgaagctttacca

SEQ ID NO: 2145102 - DNA, 13 bp, Homo sapiens
tgctttgatattt

SEQ ID NO: 2145103 - DNA, 17 bp, Homo sapiens
tgctttgggaggccaag

SEQ ID NO: 2145104 - DNA, 20 bp, Homo sapiens
tgctttgggaggccaaggca

SEQ ID NO: 2145105 - DNA, 15 bp, Homo sapiens
tgctttgtcatccat

SEQ ID NO: 2145106 - DNA, 22 bp, Homo sapiens
tgctttgttattaatattgtgc

SEQ ID NO: 2145107 - DNA, 17 bp, Homo sapiens
tgcttttaaaaaaaaat

SEQ ID NO: 2145108 - DNA, 12 bp, Homo sapiens
tgcttttccagg

SEQ ID NO: 2145109 - DNA, 22 bp, Homo sapiens
tggccatccctgggcccctcca

SEQ ID NO: 2145110 - DNA, 15 bp, Homo sapiens
tggccatgcttcttg

SEQ ID NO: 2145111 - DNA, 18 bp, Homo sapiens
tggccatgcttcttgccc

SEQ ID NO: 2145112 - DNA, 23 bp, Homo sapiens
tggccatgcttcttgccccttgg

SEQ ID NO: 2145113 - DNA, 15 bp, Homo sapiens
tggccatgtcgcctg

SEQ ID NO: 2145114 - DNA, 20 bp, Homo sapiens
tggccattttcttgcctgag

SEQ ID NO: 2145115 - DNA, 13 bp, Homo sapiens
tggcccagaattg

SEQ ID NO: 2145116 - DNA, 23 bp, Homo sapiens
tggccccaactattaaagtgcca

SEQ ID NO: 2145117 - DNA, 22 bp, Homo sapiens
tggccccaccctcgtggacacc

SEQ ID NO: 2145118 - DNA, 13 bp, Homo sapiens
tggccccagggtt

SEQ ID NO: 2145119 - DNA, 18 bp, Homo sapiens
tggccccaggtgccacca

SEQ ID NO: 2145120 - DNA, 23 bp, Homo sapiens
tggccccatgtctctcagaattc

SEQ ID NO: 2145121 - DNA, 15 bp, Homo sapiens
tggcccccctccagg

SEQ ID NO: 2145122 - DNA, 17 bp, Homo sapiens
tggcccccctccaggca

SEQ ID NO: 2145123 - DNA, 21 bp, Homo sapiens
tggcccccctccaggcatgct

SEQ ID NO: 2145124 - DNA, 18 bp, Homo sapiens
tggccccgggctctggcc

SEQ ID NO: 2145125 - DNA, 20 bp, Homo sapiens
tggcccctgaacaagaattg

SEQ ID NO: 2145126 - DNA, 15 bp, Homo sapiens
tggcccctgcccggc

SEQ ID NO: 2145127 - DNA, 16 bp, Homo sapiens
tggcccctgcccggct

SEQ ID NO: 2145128 - DNA, 13 bp, Homo sapiens
tggccctcttctt

SEQ ID NO: 2145129 - DNA, 12 bp, Homo sapiens
tggccctgcctt

SEQ ID NO: 2145130 - DNA, 16 bp, Homo sapiens
tggccctggcctgctg

SEQ ID NO: 2145131 - DNA, 17 bp, Homo sapiens
tggccctggcctgctgg

SEQ ID NO: 2145132 - DNA, 19 bp, Homo sapiens
tggcccttcccactggagg

SEQ ID NO: 2145133 - DNA, 15 bp, Homo sapiens
tggcccttcctggac

SEQ ID NO: 2145134 - DNA, 18 bp, Homo sapiens
tggcccttcctggacagc

SEQ ID NO: 2145135 - DNA, 21 bp, Homo sapiens
tggccgacggcggcggccctc

SEQ ID NO: 2145136 - DNA, 18 bp, Homo sapiens
tggccgactcagggacct

SEQ ID NO: 2145137 - DNA, 20 bp, Homo sapiens
tggccgcaagcgcagggagg

SEQ ID NO: 2145138 - DNA, 14 bp, Homo sapiens
tggccggctccagt

SEQ ID NO: 2145139 - DNA, 16 bp, Homo sapiens
tggccgtggtccagct

SEQ ID NO: 2145140 - DNA, 17 bp, Homo sapiens
tggccgtggtccagctc

SEQ ID NO: 2145141 - DNA, 18 bp, Homo sapiens
tggccgtggtccagctct

SEQ ID NO: 2145142 - DNA, 23 bp, Homo sapiens
tggccgtggtccagctcttggcc

SEQ ID NO: 2145143 - DNA, 17 bp, Homo sapiens
tggcctatgcacatatg

SEQ ID NO: 2145144 - DNA, 20 bp, Homo sapiens
tggcctatgcacatatggac

SEQ ID NO: 2145145 - DNA, 21 bp, Homo sapiens
tggcctcacgcccagcctcct

SEQ ID NO: 2145146 - DNA, 17 bp, Homo sapiens
tggcctcacttccctgg

SEQ ID NO: 2145147 - DNA, 19 bp, Homo sapiens
tggcctcacttccctggga

SEQ ID NO: 2145148 - DNA, 21 bp, Homo sapiens
tggcctcacttccctgggaac

SEQ ID NO: 2145149 - DNA, 12 bp, Homo sapiens
tggcctcagccc

SEQ ID NO: 2145150 - DNA, 18 bp, Homo sapiens
tggcctcccaataaagct

SEQ ID NO: 2145151 - DNA, 15 bp, Homo sapiens
tggcctcctgcctct

SEQ ID NO: 2145152 - DNA, 20 bp, Homo sapiens
tggcctcgcctgggcccagg

SEQ ID NO: 2145153 - DNA, 21 bp, Homo sapiens
tggcctcgcctgggcccaggc

SEQ ID NO: 2145154 - DNA, 20 bp, Homo sapiens
tggcctctagaacacccact

SEQ ID NO: 2145155 - DNA, 24 bp, Homo sapiens
tggcctctagaacacccactggcc

SEQ ID NO: 2145156 - DNA, 11 bp, Homo sapiens
tggcctgagct

SEQ ID NO: 2145157 - DNA, 18 bp, Homo sapiens
tggcctgagctggggcca

SEQ ID NO: 2145158 - DNA, 14 bp, Homo sapiens
tggcctgcctccca

SEQ ID NO: 2145159 - DNA, 19 bp, Homo sapiens
tggcctgcggccgggctgc

SEQ ID NO: 2145160 - DNA, 12 bp, Homo sapiens
tggcctgctggg

SEQ ID NO: 2145161 - DNA, 20 bp, Homo sapiens
tggcctgctgggctctccac

SEQ ID NO: 2145162 - DNA, 12 bp, Homo sapiens
tggcctggatct

SEQ ID NO: 2145163 - DNA, 14 bp, Homo sapiens
tggcctggatctcc

SEQ ID NO: 2145164 - DNA, 21 bp, Homo sapiens
tggcctggatctccccactct

SEQ ID NO: 2145165 - DNA, 12 bp, Homo sapiens
tggcctggcaca

SEQ ID NO: 2145166 - DNA, 16 bp, Homo sapiens
tggcctggcacacatc

SEQ ID NO: 2145167 - DNA, 18 bp, Homo sapiens
tggcctggcacacatcag

SEQ ID NO: 2145168 - DNA, 12 bp, Homo sapiens
tggcctggctct

SEQ ID NO: 2145169 - DNA, 16 bp, Homo sapiens
tggcctggctctcctg

SEQ ID NO: 2145170 - DNA, 18 bp, Homo sapiens
tggcctgggtgggcagga

SEQ ID NO: 2145171 - DNA, 16 bp, Homo sapiens
tggcctgtggcaggcc

SEQ ID NO: 2145172 - DNA, 16 bp, Homo sapiens
tggcctgtgtccagca

SEQ ID NO: 2145173 - DNA, 19 bp, Homo sapiens
tggcctgtgtccagcagct

SEQ ID NO: 2145174 - DNA, 11 bp, Homo sapiens
tggccttccct

SEQ ID NO: 2145175 - DNA, 22 bp, Homo sapiens
tggccttgcccgccagcctcag

SEQ ID NO: 2145176 - DNA, 16 bp, Homo sapiens
tggccttgtcaggacc

SEQ ID NO: 2145177 - DNA, 22 bp, Homo sapiens
tggccttgtcaggacccaggcc

SEQ ID NO: 2145178 - DNA, 18 bp, Homo sapiens
tggccttgtgtcagagct

SEQ ID NO: 2145179 - DNA, 13 bp, Homo sapiens
tggccttttccta

SEQ ID NO: 2145180 - DNA, 16 bp, Homo sapiens
tggccttttcctattt

SEQ ID NO: 2145181 - DNA, 16 bp, Homo sapiens
tggcgactgcagctgc

SEQ ID NO: 2145182 - DNA, 13 bp, Homo sapiens
tggcgagaggaga

SEQ ID NO: 2145183 - DNA, 13 bp, Homo sapiens
tggcgcgggaggc

SEQ ID NO: 2145184 - DNA, 15 bp, Homo sapiens
tggcgcgggaggcac

SEQ ID NO: 2145185 - DNA, 19 bp, Homo sapiens
tggcgcgggaggcaccagc

SEQ ID NO: 2145186 - DNA, 23 bp, Homo sapiens
tggcgcgggaggcaccagctctg

SEQ ID NO: 2145187 - DNA, 18 bp, Homo sapiens
tggcggcttcctgtccac

SEQ ID NO: 2145188 - DNA, 23 bp, Homo sapiens
tggcgggcagcccagcctctgtc

SEQ ID NO: 2145189 - DNA, 16 bp, Homo sapiens
tggcggggcaggaggc

SEQ ID NO: 2145190 - DNA, 16 bp, Homo sapiens
tggcgtaatgggcctg

SEQ ID NO: 2145191 - DNA, 20 bp, Homo sapiens
tggcgtaatgggcctgccca

SEQ ID NO: 2145192 - DNA, 18 bp, Homo sapiens
tggcgtgtccctctcgga

SEQ ID NO: 2145193 - DNA, 14 bp, Homo sapiens
tggctactctgtgc

SEQ ID NO: 2145194 - DNA, 17 bp, Homo sapiens
tggctactctgtgccag

SEQ ID NO: 2145195 - DNA, 18 bp, Homo sapiens
tggctactctgtgccaga

SEQ ID NO: 2145196 - DNA, 21 bp, Homo sapiens
tggctactctgtgccagagcc

SEQ ID NO: 2145197 - DNA, 16 bp, Homo sapiens
tggctagtcagagaga

SEQ ID NO: 2145198 - DNA, 19 bp, Homo sapiens
tggctataaatatataaaa

SEQ ID NO: 2145199 - DNA, 18 bp, Homo sapiens
tggctataacatgtcttt

SEQ ID NO: 2145200 - DNA, 22 bp, Homo sapiens
tggctataacatgtctttcagc

SEQ ID NO: 2145201 - DNA, 21 bp, Homo sapiens
tggctatatggcaagaaagct

SEQ ID NO: 2145202 - DNA, 22 bp, Homo sapiens
tggctattagagatcaacccct

SEQ ID NO: 2145203 - DNA, 16 bp, Homo sapiens
tggctcaatcctctaa

SEQ ID NO: 2145204 - DNA, 13 bp, Homo sapiens
tggctcaggaaga

SEQ ID NO: 2145205 - DNA, 21 bp, Homo sapiens
tggctcaggaagaaaccccaa

SEQ ID NO: 2145206 - DNA, 21 bp, Homo sapiens
tggctcaggcaagcccctcag

SEQ ID NO: 2145207 - DNA, 14 bp, Homo sapiens
tggctcaggcagac

SEQ ID NO: 2145208 - DNA, 14 bp, Homo sapiens
tggctcccacaggc

SEQ ID NO: 2145209 - DNA, 16 bp, Homo sapiens
tggctcctcccggtgc

SEQ ID NO: 2145210 - DNA, 12 bp, Homo sapiens
tggctcctgcca

SEQ ID NO: 2145211 - DNA, 14 bp, Homo sapiens
tggctcctgccact

SEQ ID NO: 2145212 - DNA, 16 bp, Homo sapiens
tggctcctgccactga

SEQ ID NO: 2145213 - DNA, 13 bp, Homo sapiens
tggctcctgcctt

SEQ ID NO: 2145214 - DNA, 14 bp, Homo sapiens
tggctcctgccttg

SEQ ID NO: 2145215 - DNA, 15 bp, Homo sapiens
tggctcgctccctgt

SEQ ID NO: 2145216 - DNA, 14 bp, Homo sapiens
tggctctgcaatgg

SEQ ID NO: 2145217 - DNA, 13 bp, Homo sapiens
tggctctgtgaaa

SEQ ID NO: 2145218 - DNA, 15 bp, Homo sapiens
tggctcttgcctgta

SEQ ID NO: 2145219 - DNA, 15 bp, Homo sapiens
tggctctttcagaga

SEQ ID NO: 2145220 - DNA, 16 bp, Homo sapiens
tggctgaaaatcacta

SEQ ID NO: 2145221 - DNA, 20 bp, Homo sapiens
tggctgaaataaaagcctct

SEQ ID NO: 2145222 - DNA, 15 bp, Homo sapiens
tggctgagcttggcc

SEQ ID NO: 2145223 - DNA, 14 bp, Homo sapiens
tggctgagggcagt

SEQ ID NO: 2145224 - DNA, 11 bp, Homo sapiens
tgggaggctga

SEQ ID NO: 2145225 - DNA, 15 bp, Homo sapiens
tgggaggctgaggcg

SEQ ID NO: 2145226 - DNA, 14 bp, Homo sapiens
tgggagggacaggg

SEQ ID NO: 2145227 - DNA, 17 bp, Homo sapiens
tgggagggacagggctt

SEQ ID NO: 2145228 - DNA, 16 bp, Homo sapiens
tgggagggagggagag

SEQ ID NO: 2145229 - DNA, 17 bp, Homo sapiens
tgggagggggctccatg

SEQ ID NO: 2145230 - DNA, 19 bp, Homo sapiens
tgggagtcaggacctccgg

SEQ ID NO: 2145231 - DNA, 19 bp, Homo sapiens
tgggagtcattaccacgcc

SEQ ID NO: 2145232 - DNA, 16 bp, Homo sapiens
tgggataacagaggca

SEQ ID NO: 2145233 - DNA, 15 bp, Homo sapiens
tgggatctgtaagga

SEQ ID NO: 2145234 - DNA, 21 bp, Homo sapiens
tgggatgagaatgaaagctta

SEQ ID NO: 2145235 - DNA, 13 bp, Homo sapiens
tgggatgcggggc

SEQ ID NO: 2145236 - DNA, 16 bp, Homo sapiens
tgggatggatgctggg

SEQ ID NO: 2145237 - DNA, 13 bp, Homo sapiens
tgggatgtagaac

SEQ ID NO: 2145238 - DNA, 23 bp, Homo sapiens
tgggattagattcatctatggag

SEQ ID NO: 2145239 - DNA, 22 bp, Homo sapiens
tgggattcaggaaaaggcctgg

SEQ ID NO: 2145240 - DNA, 19 bp, Homo sapiens
tgggattgtggtacaatct

SEQ ID NO: 2145241 - DNA, 19 bp, Homo sapiens
tgggatttatatctatagt

SEQ ID NO: 2145242 - DNA, 18 bp, Homo sapiens
tgggatttcttcgctgct

SEQ ID NO: 2145243 - DNA, 18 bp, Homo sapiens
tgggcaaacccttctctt

SEQ ID NO: 2145244 - DNA, 16 bp, Homo sapiens
tgggcaacccccagcc

SEQ ID NO: 2145245 - DNA, 17 bp, Homo sapiens
tgggcaacccccagcct

SEQ ID NO: 2145246 - DNA, 15 bp, Homo sapiens
tgggcaagtgattga

SEQ ID NO: 2145247 - DNA, 19 bp, Homo sapiens
tgggcaatgaaaccaaagc

SEQ ID NO: 2145248 - DNA, 14 bp, Homo sapiens
tgggcacatgagga

SEQ ID NO: 2145249 - DNA, 15 bp, Homo sapiens
tgggcacccacctcc

SEQ ID NO: 2145250 - DNA, 18 bp, Homo sapiens
tgggcacccacctccacc

SEQ ID NO: 2145251 - DNA, 20 bp, Homo sapiens
tgggcacccccagcctgggc

SEQ ID NO: 2145252 - DNA, 17 bp, Homo sapiens
tgggcagcaccctcccc

SEQ ID NO: 2145253 - DNA, 15 bp, Homo sapiens
tgggcagcagctcag

SEQ ID NO: 2145254 - DNA, 17 bp, Homo sapiens
tgggcagcagctcagcc

SEQ ID NO: 2145255 - DNA, 18 bp, Homo sapiens
tgggcagcatagcaagac

SEQ ID NO: 2145256 - DNA, 19 bp, Homo sapiens
tgggcagctgattttgtca

SEQ ID NO: 2145257 - DNA, 15 bp, Homo sapiens
tgggcagggctggga

SEQ ID NO: 2145258 - DNA, 21 bp, Homo sapiens
tgggcagggctgggagaactt

SEQ ID NO: 2145259 - DNA, 20 bp, Homo sapiens
tgggcaggtctcctctggga

SEQ ID NO: 2145260 - DNA, 15 bp, Homo sapiens
tgggcatccacccag

SEQ ID NO: 2145261 - DNA, 17 bp, Homo sapiens
tgggcatcttctggctt

SEQ ID NO: 2145262 - DNA, 20 bp, Homo sapiens
tgggccaaaagggcagccag

SEQ ID NO: 2145263 - DNA, 18 bp, Homo sapiens
tgggccaaggtgtttcca

SEQ ID NO: 2145264 - DNA, 16 bp, Homo sapiens
tgggccaattaaaata

SEQ ID NO: 2145265 - DNA, 23 bp, Homo sapiens
tgggccaattaaaatatatataa

SEQ ID NO: 2145266 - DNA, 14 bp, Homo sapiens
tgggccactctccc

SEQ ID NO: 2145267 - DNA, 15 bp, Homo sapiens
tgggccactctcccc

SEQ ID NO: 2145268 - DNA, 18 bp, Homo sapiens
tgggccactctcccctcc

SEQ ID NO: 2145269 - DNA, 20 bp, Homo sapiens
tgggccactctcccctccct

SEQ ID NO: 2145270 - DNA, 21 bp, Homo sapiens
tgggccactctcccctccctc

SEQ ID NO: 2145271 - DNA, 13 bp, Homo sapiens
tgggccactgcca

SEQ ID NO: 2145272 - DNA, 21 bp, Homo sapiens
tgggccactgccagcagctgt

SEQ ID NO: 2145273 - DNA, 21 bp, Homo sapiens
tgggccagcctcagctcagcc

SEQ ID NO: 2145274 - DNA, 23 bp, Homo sapiens
tgggccagcctcagctcagcctc

SEQ ID NO: 2145275 - DNA, 18 bp, Homo sapiens
tgggccaggacaggcccg

SEQ ID NO: 2145276 - DNA, 21 bp, Homo sapiens
tgggcccataatagttagccc

SEQ ID NO: 2145277 - DNA, 19 bp, Homo sapiens
tgggccccatgctctgccc

SEQ ID NO: 2145278 - DNA, 22 bp, Homo sapiens
tgggcccctccacgcctcctgg

SEQ ID NO: 2145279 - DNA, 19 bp, Homo sapiens
tgggcccgctttgcctgct

SEQ ID NO: 2145280 - DNA, 13 bp, Homo sapiens
tgggccctggggc

SEQ ID NO: 2145281 - DNA, 19 bp, Homo sapiens
tgggccctggggcctgtac

SEQ ID NO: 2145282 - DNA, 22 bp, Homo sapiens
tgggccctggggcctgtactgc

SEQ ID NO: 2145283 - DNA, 14 bp, Homo sapiens
tgggccggccagcc

SEQ ID NO: 2145284 - DNA, 20 bp, Homo sapiens
tgggcctcagttcaacctgg

SEQ ID NO: 2145285 - DNA, 14 bp, Homo sapiens
tgggcctcctgtgt

SEQ ID NO: 2145286 - DNA, 22 bp, Homo sapiens
tgggcctcctgtgtgtgcgcct

SEQ ID NO: 2145287 - DNA, 12 bp, Homo sapiens
tgggcctgccca

SEQ ID NO: 2145288 - DNA, 13 bp, Homo sapiens
tgggcctgctgcg

SEQ ID NO: 2145289 - DNA, 15 bp, Homo sapiens
tgggcctgctgctga

SEQ ID NO: 2145290 - DNA, 16 bp, Homo sapiens
tgggcctgctgctgag

SEQ ID NO: 2145291 - DNA, 18 bp, Homo sapiens
tgggcctgctgctgagaa

SEQ ID NO: 2145292 - DNA, 23 bp, Homo sapiens
tgggcctgctgctgagaacctgg

SEQ ID NO: 2145293 - DNA, 21 bp, Homo sapiens
tgggcctgcttttccaggatc

SEQ ID NO: 2145294 - DNA, 22 bp, Homo sapiens
tgggcctgcttttccaggatcc

SEQ ID NO: 2145295 - DNA, 11 bp, Homo sapiens
tgggcctggcc

SEQ ID NO: 2145296 - DNA, 14 bp, Homo sapiens
tgggcctggcctga

SEQ ID NO: 2145297 - DNA, 12 bp, Homo sapiens
tgggcctgggcc

SEQ ID NO: 2145298 - DNA, 13 bp, Homo sapiens
tgggcctgggcct

SEQ ID NO: 2145299 - DNA, 15 bp, Homo sapiens
tgggcctgggcctgc

SEQ ID NO: 2145300 - DNA, 17 bp, Homo sapiens
tgggcctgtgcagcagc

SEQ ID NO: 2145301 - DNA, 19 bp, Homo sapiens
tgggcctgtgcagcagccc

SEQ ID NO: 2145302 - DNA, 21 bp, Homo sapiens
tgggcctgtgcagcagcccag

SEQ ID NO: 2145303 - DNA, 21 bp, Homo sapiens
tgggccttacctcccctgcca

SEQ ID NO: 2145304 - DNA, 14 bp, Homo sapiens
tgggccttgctttg

SEQ ID NO: 2145305 - DNA, 15 bp, Homo sapiens
tgggcctttcctgtg

SEQ ID NO: 2145306 - DNA, 13 bp, Homo sapiens
tgggcgctctgcc

SEQ ID NO: 2145307 - DNA, 22 bp, Homo sapiens
tgggctaagtgatcctcccacc

SEQ ID NO: 2145308 - DNA, 17 bp, Homo sapiens
tgggctaattaaataaa

SEQ ID NO: 2145309 - DNA, 16 bp, Homo sapiens
tgggctactggcagct

SEQ ID NO: 2145310 - DNA, 16 bp, Homo sapiens
tgggctcctggctgcc

SEQ ID NO: 2145311 - DNA, 20 bp, Homo sapiens
tgggctcctggctgccaggc

SEQ ID NO: 2145312 - DNA, 21 bp, Homo sapiens
tgggctcctggctgccaggcg

SEQ ID NO: 2145313 - DNA, 15 bp, Homo sapiens
tgggctctccacctc

SEQ ID NO: 2145314 - DNA, 17 bp, Homo sapiens
tgggctctgccccagct

SEQ ID NO: 2145315 - DNA, 20 bp, Homo sapiens
tgggctctgccccagctctg

SEQ ID NO: 2145316 - DNA, 21 bp, Homo sapiens
tgggctctgccccagctctgg

SEQ ID NO: 2145317 - DNA, 22 bp, Homo sapiens
tgggctgacacctaccatgctg

SEQ ID NO: 2145318 - DNA, 15 bp, Homo sapiens
tgggctgagccctgg

SEQ ID NO: 2145319 - DNA, 18 bp, Homo sapiens
tgggctgagccctggcag

SEQ ID NO: 2145320 - DNA, 13 bp, Homo sapiens
tgggctgccctgg

SEQ ID NO: 2145321 - DNA, 12 bp, Homo sapiens
tgggctgcctgg

SEQ ID NO: 2145322 - DNA, 15 bp, Homo sapiens
tgggctgcctgggga

SEQ ID NO: 2145323 - DNA, 17 bp, Homo sapiens
tgggctgcctggggatt

SEQ ID NO: 2145324 - DNA, 17 bp, Homo sapiens
tgggctgctacccagaa

SEQ ID NO: 2145325 - DNA, 13 bp, Homo sapiens
tgggctggcccag

SEQ ID NO: 2145326 - DNA, 15 bp, Homo sapiens
tgggctgtcaacatt

SEQ ID NO: 2145327 - DNA, 18 bp, Homo sapiens
tgggctgtctgtcaccag

SEQ ID NO: 2145328 - DNA, 19 bp, Homo sapiens
tgggctgtctgtcaccagc

SEQ ID NO: 2145329 - DNA, 22 bp, Homo sapiens
tgggcttcagtggcagctgctt

SEQ ID NO: 2145330 - DNA, 22 bp, Homo sapiens
tgggcttggacttcctggggcc

SEQ ID NO: 2145331 - DNA, 14 bp, Homo sapiens
tgggcttggccttg

SEQ ID NO: 2145332 - DNA, 16 bp, Homo sapiens
tgggctttaacaaaac

SEQ ID NO: 2145333 - DNA, 23 bp, Homo sapiens
tgggctttaacaaaacaagaaag

SEQ ID NO: 2145334 - DNA, 18 bp, Homo sapiens
tgggctttgcaggctctg

SEQ ID NO: 2145335 - DNA, 17 bp, Homo sapiens
tggggaagactgtggct

SEQ ID NO: 2145336 - DNA, 22 bp, Homo sapiens
tggggaagcaagacgtcctgga

SEQ ID NO: 2145337 - DNA, 20 bp, Homo sapiens
tggggaagtgctccccacac

SEQ ID NO: 2145338 - DNA, 21 bp, Homo sapiens
tgtactacgtgccagctctag

SEQ ID NO: 2145339 - DNA, 19 bp, Homo sapiens
tgtactatggctgtatttt

SEQ ID NO: 2145340 - DNA, 15 bp, Homo sapiens
tgtactattgtttaa

SEQ ID NO: 2145341 - DNA, 16 bp, Homo sapiens
tgtactattgtttaaa

SEQ ID NO: 2145342 - DNA, 22 bp, Homo sapiens
tgtactattgtttaaaaacagg

SEQ ID NO: 2145343 - DNA, 13 bp, Homo sapiens
tgtactcctccca

SEQ ID NO: 2145344 - DNA, 20 bp, Homo sapiens
tgtactctttatttctagca

SEQ ID NO: 2145345 - DNA, 12 bp, Homo sapiens
tgtactgataaa

SEQ ID NO: 2145346 - DNA, 23 bp, Homo sapiens
tgtactgtaattttgtttgtaat

SEQ ID NO: 2145347 - DNA, 16 bp, Homo sapiens
tgtacttaataaattc

SEQ ID NO: 2145348 - DNA, 22 bp, Homo sapiens
tgtacttaataaattcagatat

SEQ ID NO: 2145349 - DNA, 17 bp, Homo sapiens
tgtacttcctgtgtact

SEQ ID NO: 2145350 - DNA, 16 bp, Homo sapiens
tgtacttgatgacaga

SEQ ID NO: 2145351 - DNA, 23 bp, Homo sapiens
tgtagaaacacagttttgaaaga

SEQ ID NO: 2145352 - DNA, 18 bp, Homo sapiens
tgtagaaatattataaat

SEQ ID NO: 2145353 - DNA, 17 bp, Homo sapiens
tgtagaacctaattcaa

SEQ ID NO: 2145354 - DNA, 21 bp, Homo sapiens
tgtagaagatggactctgaaa

SEQ ID NO: 2145355 - DNA, 22 bp, Homo sapiens
tgtagaagtaggaagtgaaaat

SEQ ID NO: 2145356 - DNA, 17 bp, Homo sapiens
tgtagaataaatgaaga

SEQ ID NO: 2145357 - DNA, 16 bp, Homo sapiens
tgtagaatgatttcat

SEQ ID NO: 2145358 - DNA, 15 bp, Homo sapiens
tgtagaccactgtcc

SEQ ID NO: 2145359 - DNA, 18 bp, Homo sapiens
tgtagactatatacatgt

SEQ ID NO: 2145360 - DNA, 15 bp, Homo sapiens
tgtagagccagggtc

SEQ ID NO: 2145361 - DNA, 15 bp, Homo sapiens
tgtagattacctgcc

SEQ ID NO: 2145362 - DNA, 15 bp, Homo sapiens
tgtagattgcgtgga

SEQ ID NO: 2145363 - DNA, 16 bp, Homo sapiens
tgtagattgtgtaaat

SEQ ID NO: 2145364 - DNA, 13 bp, Homo sapiens
tgtagcagaaagg

SEQ ID NO: 2145365 - DNA, 10 bp, Homo sapiens
tgtagccaag

SEQ ID NO: 2145366 - DNA, 14 bp, Homo sapiens
tgtagccatggctc

SEQ ID NO: 2145367 - DNA, 18 bp, Homo sapiens
tgtagccatggctcaggc

SEQ ID NO: 2145368 - DNA, 16 bp, Homo sapiens
tgtagccccagtgaca

SEQ ID NO: 2145369 - DNA, 21 bp, Homo sapiens
tgtagccccagtgacagctag

SEQ ID NO: 2145370 - DNA, 14 bp, Homo sapiens
tgtagcccggccag

SEQ ID NO: 2145371 - DNA, 16 bp, Homo sapiens
tgtagcccggccaggg

SEQ ID NO: 2145372 - DNA, 23 bp, Homo sapiens
tgtagcccggccagggcctggtg

SEQ ID NO: 2145373 - DNA, 16 bp, Homo sapiens
tgtagcctgtgcatgt

SEQ ID NO: 2145374 - DNA, 16 bp, Homo sapiens
tgtagccttgcccgga

SEQ ID NO: 2145375 - DNA, 23 bp, Homo sapiens
tgtagccttgccttttaaaagaa

SEQ ID NO: 2145376 - DNA, 14 bp, Homo sapiens
tgtagctctgcctc

SEQ ID NO: 2145377 - DNA, 13 bp, Homo sapiens
tgtagctgatgaa

SEQ ID NO: 2145378 - DNA, 17 bp, Homo sapiens
tgtagctgtgacctgct

SEQ ID NO: 2145379 - DNA, 15 bp, Homo sapiens
tgtagctttatcctt

SEQ ID NO: 2145380 - DNA, 12 bp, Homo sapiens
tgtagctttgct

SEQ ID NO: 2145381 - DNA, 15 bp, Homo sapiens
tgtagctttgctctt

SEQ ID NO: 2145382 - DNA, 19 bp, Homo sapiens
tgtaggaatcctttgagaa

SEQ ID NO: 2145383 - DNA, 23 bp, Homo sapiens
tgtaggaatgaccacgggcctca

SEQ ID NO: 2145384 - DNA, 14 bp, Homo sapiens
tgtaggcagggaac

SEQ ID NO: 2145385 - DNA, 15 bp, Homo sapiens
tgtagggctggacct

SEQ ID NO: 2145386 - DNA, 14 bp, Homo sapiens
tgtaggtaaatcta

SEQ ID NO: 2145387 - DNA, 16 bp, Homo sapiens
tgtaggtattaaagat

SEQ ID NO: 2145388 - DNA, 18 bp, Homo sapiens
tgtaggtcaatgaaatat

SEQ ID NO: 2145389 - DNA, 13 bp, Homo sapiens
tgtaggttgctta

SEQ ID NO: 2145390 - DNA, 19 bp, Homo sapiens
tgtagtggaagagcagcct

SEQ ID NO: 2145391 - DNA, 12 bp, Homo sapiens
tgtagttaggaa

SEQ ID NO: 2145392 - DNA, 23 bp, Homo sapiens
tgtagttaggaaataaaaccttt

SEQ ID NO: 2145393 - DNA, 19 bp, Homo sapiens
tgtagttcttgtctgattg

SEQ ID NO: 2145394 - DNA, 16 bp, Homo sapiens
tgtagttttaacagaa

SEQ ID NO: 2145395 - DNA, 13 bp, Homo sapiens
tgtataaaaatag

SEQ ID NO: 2145396 - DNA, 20 bp, Homo sapiens
tgtataaataataaagaact

SEQ ID NO: 2145397 - DNA, 21 bp, Homo sapiens
tgtataacttcttaaaagttg

SEQ ID NO: 2145398 - DNA, 16 bp, Homo sapiens
tgtataagtgcacaca

SEQ ID NO: 2145399 - DNA, 23 bp, Homo sapiens
tgtataagtgcacacagaaatat

SEQ ID NO: 2145400 - DNA, 15 bp, Homo sapiens
tgtataatattttta

SEQ ID NO: 2145401 - DNA, 18 bp, Homo sapiens
tgtatacacacatataca

SEQ ID NO: 2145402 - DNA, 17 bp, Homo sapiens
tgtatacattttgttat

SEQ ID NO: 2145403 - DNA, 19 bp, Homo sapiens
tgtatacattttgttatag

SEQ ID NO: 2145404 - DNA, 21 bp, Homo sapiens
tgtatacattttgttatagaa

SEQ ID NO: 2145405 - DNA, 22 bp, Homo sapiens
tgtatacattttgttatagaat

SEQ ID NO: 2145406 - DNA, 15 bp, Homo sapiens
tgtatacttcattag

SEQ ID NO: 2145407 - DNA, 19 bp, Homo sapiens
tgtatagattataaaatta

SEQ ID NO: 2145408 - DNA, 23 bp, Homo sapiens
tgtatagtaaagtgataatttct

SEQ ID NO: 2145409 - DNA, 15 bp, Homo sapiens
tgtatagtaaatcac

SEQ ID NO: 2145410 - DNA, 22 bp, Homo sapiens
tgtatagttttataaaactcag

SEQ ID NO: 2145411 - DNA, 21 bp, Homo sapiens
tgtatataatactaaagtgtc

SEQ ID NO: 2145412 - DNA, 18 bp, Homo sapiens
tgtatatacaataacata

SEQ ID NO: 2145413 - DNA, 13 bp, Homo sapiens
tgtatatacacat

SEQ ID NO: 2145414 - DNA, 18 bp, Homo sapiens
tgtatatacacatatacc

SEQ ID NO: 2145415 - DNA, 17 bp, Homo sapiens
tgtatatacatattata

SEQ ID NO: 2145416 - DNA, 19 bp, Homo sapiens
tgtatatacatattataaa

SEQ ID NO: 2145417 - DNA, 11 bp, Homo sapiens
tgtatatatac

SEQ ID NO: 2145418 - DNA, 13 bp, Homo sapiens
tgtatatatacat

SEQ ID NO: 2145419 - DNA, 17 bp, Homo sapiens
tgtatatatacatacac

SEQ ID NO: 2145420 - DNA, 19 bp, Homo sapiens
tgtatatatacatacactt

SEQ ID NO: 2145421 - DNA, 15 bp, Homo sapiens
tgtatatatgtgtat

SEQ ID NO: 2145422 - DNA, 20 bp, Homo sapiens
tgtatatatgtgtatatata

SEQ ID NO: 2145423 - DNA, 22 bp, Homo sapiens
tgtatatatgtgtatatataca

SEQ ID NO: 2145424 - DNA, 19 bp, Homo sapiens
tgtatatatgtgtgtttaa

SEQ ID NO: 2145425 - DNA, 20 bp, Homo sapiens
tgtatatatgtgtgtttaaa

SEQ ID NO: 2145426 - DNA, 13 bp, Homo sapiens
tgtatatcagaaa

SEQ ID NO: 2145427 - DNA, 14 bp, Homo sapiens
tgtatatcagaaaa

SEQ ID NO: 2145428 - DNA, 19 bp, Homo sapiens
tgtatatctatatctctaa

SEQ ID NO: 2145429 - DNA, 23 bp, Homo sapiens
tgtatatgatctaatacaaagat

SEQ ID NO: 2145430 - DNA, 17 bp, Homo sapiens
tgtatatgtatatctat

SEQ ID NO: 2145431 - DNA, 14 bp, Homo sapiens
tgtatatgtcattt

SEQ ID NO: 2145432 - DNA, 21 bp, Homo sapiens
tgtatattatggaagatttta

SEQ ID NO: 2145433 - DNA, 21 bp, Homo sapiens
tgtatattccaccattcacat

SEQ ID NO: 2145434 - DNA, 14 bp, Homo sapiens
tgtatcaaatctgt

SEQ ID NO: 2145435 - DNA, 15 bp, Homo sapiens
tgtatcacaaatctt

SEQ ID NO: 2145436 - DNA, 15 bp, Homo sapiens
tgtatcatagaaatg

SEQ ID NO: 2145437 - DNA, 14 bp, Homo sapiens
tgtatcattaatgt

SEQ ID NO: 2145438 - DNA, 21 bp, Homo sapiens
tgtatcccccccctgtatagt

SEQ ID NO: 2145439 - DNA, 20 bp, Homo sapiens
tgtatcctgaggctgagaga

SEQ ID NO: 2145440 - DNA, 14 bp, Homo sapiens
tgtatctagctcta

SEQ ID NO: 2145441 - DNA, 13 bp, Homo sapiens
tgtatctcctcct

SEQ ID NO: 2145442 - DNA, 17 bp, Homo sapiens
tgtatcttatttatata

SEQ ID NO: 2145443 - DNA, 19 bp, Homo sapiens
tgtatcttctgcagacact

SEQ ID NO: 2145444 - DNA, 22 bp, Homo sapiens
tgtatgaaagatggctgtgcct

SEQ ID NO: 2145445 - DNA, 21 bp, Homo sapiens
tgtatgaacatggagaggact

SEQ ID NO: 2145446 - DNA, 19 bp, Homo sapiens
tgtatggaatacagtgtta

SEQ ID NO: 2145447 - DNA, 23 bp, Homo sapiens
tgtatgggtgtgtgtttgtgtga

SEQ ID NO: 2145448 - DNA, 19 bp, Homo sapiens
tgtatgtaagtaattgcat

SEQ ID NO: 2145449 - DNA, 17 bp, Homo sapiens
tgtatgtatacacacat

SEQ ID NO: 2145450 - DNA, 17 bp, Homo sapiens
tgtatgtctaattgagt

SEQ ID NO: 2145451 - DNA, 12 bp, Homo sapiens
tgtatgtgaaag

SEQ ID NO: 2145452 - DNA, 19 bp, Homo sapiens
tgtatgtgaaagtgtaaaa

SEQ ID NO: 2145453 - DNA, 14 bp, Homo sapiens
tgtgtgtgtatgct

SEQ ID NO: 2145454 - DNA, 13 bp, Homo sapiens
tgtgtgtgtctgt

SEQ ID NO: 2145455 - DNA, 13 bp, Homo sapiens
tgtgtgtgtgtgc

SEQ ID NO: 2145456 - DNA, 23 bp, Homo sapiens
tgtgtgttctgtaatggaactga

SEQ ID NO: 2145457 - DNA, 19 bp, Homo sapiens
tgtgtgtttaaataaagta

SEQ ID NO: 2145458 - DNA, 13 bp, Homo sapiens
tgtgtgtttggaa

SEQ ID NO: 2145459 - DNA, 15 bp, Homo sapiens
tgtgttcagtgcctt

SEQ ID NO: 2145460 - DNA, 16 bp, Homo sapiens
tgtgttggccaggctg

SEQ ID NO: 2145461 - DNA, 17 bp, Homo sapiens
tgtgttggccaggctgg

SEQ ID NO: 2145462 - DNA, 13 bp, Homo sapiens
tgtgttgtctgtg

SEQ ID NO: 2145463 - DNA, 18 bp, Homo sapiens
tgtgtttaaataaagtat

SEQ ID NO: 2145464 - DNA, 22 bp, Homo sapiens
tgtgtttaaataaagtatcatg

SEQ ID NO: 2145465 - DNA, 21 bp, Homo sapiens
tgtgtttccagatcgatcctg

SEQ ID NO: 2145466 - DNA, 17 bp, Homo sapiens
tgtgtttcttgcctcat

SEQ ID NO: 2145467 - DNA, 14 bp, Homo sapiens
tgtgtttgtgagca

SEQ ID NO: 2145468 - DNA, 23 bp, Homo sapiens
tgtgttttgcacgtcttgctatt

SEQ ID NO: 2145469 - DNA, 21 bp, Homo sapiens
tgtgtttttgctatcacacag

SEQ ID NO: 2145470 - DNA, 22 bp, Homo sapiens
tgttaaaaaaataagaagaatg

SEQ ID NO: 2145471 - DNA, 21 bp, Homo sapiens
tgttaaagaggcgtcttgtat

SEQ ID NO: 2145472 - DNA, 18 bp, Homo sapiens
tgttaaatgaaattgtaa

SEQ ID NO: 2145473 - DNA, 22 bp, Homo sapiens
tgttaagcaaaggaaaccaaag

SEQ ID NO: 2145474 - DNA, 14 bp, Homo sapiens
tgttaatgaaaatg

SEQ ID NO: 2145475 - DNA, 19 bp, Homo sapiens
tgttaatgaaaatgtcaga

SEQ ID NO: 2145476 - DNA, 19 bp, Homo sapiens
tgttaatgcatttttgatg

SEQ ID NO: 2145477 - DNA, 14 bp, Homo sapiens
tgttaattgattaa

SEQ ID NO: 2145478 - DNA, 16 bp, Homo sapiens
tgttaatttttgatac

SEQ ID NO: 2145479 - DNA, 20 bp, Homo sapiens
tgttacacagcccaagagga

SEQ ID NO: 2145480 - DNA, 17 bp, Homo sapiens
tgttactgttgcactga

SEQ ID NO: 2145481 - DNA, 13 bp, Homo sapiens
tgttacttaaata

SEQ ID NO: 2145482 - DNA, 16 bp, Homo sapiens
tgttacttaaatagca

SEQ ID NO: 2145483 - DNA, 12 bp, Homo sapiens
tgttagagaggt

SEQ ID NO: 2145484 - DNA, 14 bp, Homo sapiens
tgttagctgttatt

SEQ ID NO: 2145485 - DNA, 12 bp, Homo sapiens
tgttaggggaaa

SEQ ID NO: 2145486 - DNA, 16 bp, Homo sapiens
tgttaggggaaaatag

SEQ ID NO: 2145487 - DNA, 16 bp, Homo sapiens
tgttagtgtgtgtgca

SEQ ID NO: 2145488 - DNA, 20 bp, Homo sapiens
tgttagtgtgtgtgcatgtg

SEQ ID NO: 2145489 - DNA, 21 bp, Homo sapiens
tgttagttattttaggagaca

SEQ ID NO: 2145490 - DNA, 20 bp, Homo sapiens
tgttatcaaaactttctttt

SEQ ID NO: 2145491 - DNA, 12 bp, Homo sapiens
tgttatgctatt

SEQ ID NO: 2145492 - DNA, 20 bp, Homo sapiens
tgttatgtatatagatgtgc

SEQ ID NO: 2145493 - DNA, 14 bp, Homo sapiens
tgttattgtggaag

SEQ ID NO: 2145494 - DNA, 17 bp, Homo sapiens
tgttatttgtaatagat

SEQ ID NO: 2145495 - DNA, 22 bp, Homo sapiens
tgttatttttatatcagcctga

SEQ ID NO: 2145496 - DNA, 21 bp, Homo sapiens
tgttatttttgtttcttccaa

SEQ ID NO: 2145497 - DNA, 20 bp, Homo sapiens
tgttattttttatttccaca

SEQ ID NO: 2145498 - DNA, 15 bp, Homo sapiens
tgttcaaatgcattt

SEQ ID NO: 2145499 - DNA, 23 bp, Homo sapiens
tgttcaagaccagcctgaccaac

SEQ ID NO: 2145500 - DNA, 16 bp, Homo sapiens
tgttcaatgcaaagta

SEQ ID NO: 2145501 - DNA, 15 bp, Homo sapiens
tgttcagaagaaatt

SEQ ID NO: 2145502 - DNA, 16 bp, Homo sapiens
tgttcagctccagctc

SEQ ID NO: 2145503 - DNA, 14 bp, Homo sapiens
tgttcagcttcaga

SEQ ID NO: 2145504 - DNA, 14 bp, Homo sapiens
tgttcagtgccttg

SEQ ID NO: 2145505 - DNA, 18 bp, Homo sapiens
tgttcagtgccttggagc

SEQ ID NO: 2145506 - DNA, 13 bp, Homo sapiens
tgttcagttgact

SEQ ID NO: 2145507 - DNA, 16 bp, Homo sapiens
tgttcatgagtggatg

SEQ ID NO: 2145508 - DNA, 18 bp, Homo sapiens
tgttcattaaattttcta

SEQ ID NO: 2145509 - DNA, 11 bp, Homo sapiens
tgttcatttcc

SEQ ID NO: 2145510 - DNA, 22 bp, Homo sapiens
tgttccacttctctagagaaca

SEQ ID NO: 2145511 - DNA, 16 bp, Homo sapiens
tgttcccaagagcatc

SEQ ID NO: 2145512 - DNA, 23 bp, Homo sapiens
tgttcccaagagcatcatgcctc

SEQ ID NO: 2145513 - DNA, 21 bp, Homo sapiens
tgttcccccgctggcagccac

SEQ ID NO: 2145514 - DNA, 13 bp, Homo sapiens
tgttccctacccc

SEQ ID NO: 2145515 - DNA, 14 bp, Homo sapiens
tgttccctgcaccc

SEQ ID NO: 2145516 - DNA, 17 bp, Homo sapiens
tgttccctgcaccctgg

SEQ ID NO: 2145517 - DNA, 15 bp, Homo sapiens
tgttcccttgaccat

SEQ ID NO: 2145518 - DNA, 16 bp, Homo sapiens
tgttcctgatgtgcca

SEQ ID NO: 2145519 - DNA, 17 bp, Homo sapiens
tgttccttcacatttaa

SEQ ID NO: 2145520 - DNA, 19 bp, Homo sapiens
tgttccttctgcttctccc

SEQ ID NO: 2145521 - DNA, 16 bp, Homo sapiens
tgttctacatgaggac

SEQ ID NO: 2145522 - DNA, 16 bp, Homo sapiens
tgttctatatgcattt

SEQ ID NO: 2145523 - DNA, 23 bp, Homo sapiens
tgttctatatgcatttaattctg

SEQ ID NO: 2145524 - DNA, 13 bp, Homo sapiens
tgttctcagaatc

SEQ ID NO: 2145525 - DNA, 15 bp, Homo sapiens
tgttctgataatgaa

SEQ ID NO: 2145526 - DNA, 13 bp, Homo sapiens
tgttctgcactga

SEQ ID NO: 2145527 - DNA, 14 bp, Homo sapiens
tgttctgcactgaa

SEQ ID NO: 2145528 - DNA, 12 bp, Homo sapiens
tgttctggacct

SEQ ID NO: 2145529 - DNA, 16 bp, Homo sapiens
tgttctggacctcccc

SEQ ID NO: 2145530 - DNA, 17 bp, Homo sapiens
tgttctggagctgctgt

SEQ ID NO: 2145531 - DNA, 12 bp, Homo sapiens
tgttctgggaca

SEQ ID NO: 2145532 - DNA, 13 bp, Homo sapiens
tgttctgggacac

SEQ ID NO: 2145533 - DNA, 23 bp, Homo sapiens
tgttctggtttagtgttctgtat

SEQ ID NO: 2145534 - DNA, 13 bp, Homo sapiens
tgttctgtcacca

SEQ ID NO: 2145535 - DNA, 18 bp, Homo sapiens
tgttctgtccagtttcca

SEQ ID NO: 2145536 - DNA, 20 bp, Homo sapiens
tgttctgtccagtttccaaa

SEQ ID NO: 2145537 - DNA, 14 bp, Homo sapiens
tgttctgtgtgggt

SEQ ID NO: 2145538 - DNA, 22 bp, Homo sapiens
tgttctgtgtgggtctggggag

SEQ ID NO: 2145539 - DNA, 13 bp, Homo sapiens
tgttctgtttccc

SEQ ID NO: 2145540 - DNA, 17 bp, Homo sapiens
tgttcttacctgtatgt

SEQ ID NO: 2145541 - DNA, 14 bp, Homo sapiens
tgttgaaaatgttc

SEQ ID NO: 2145542 - DNA, 17 bp, Homo sapiens
tgttgaaaatgttcaga

SEQ ID NO: 2145543 - DNA, 22 bp, Homo sapiens
tgttgaaaattattttaaacaa

SEQ ID NO: 2145544 - DNA, 15 bp, Homo sapiens
tgttgaaattatgta

SEQ ID NO: 2145545 - DNA, 21 bp, Homo sapiens
tgttgaagaagagtttgcaaa

SEQ ID NO: 2145546 - DNA, 20 bp, Homo sapiens
tgttgagaaagaatgagcat

SEQ ID NO: 2145547 - DNA, 15 bp, Homo sapiens
tgttgagagtgtgac

SEQ ID NO: 2145548 - DNA, 14 bp, Homo sapiens
tgttgattaaaaca

SEQ ID NO: 2145549 - DNA, 18 bp, Homo sapiens
tgttgcagggaagtctta

SEQ ID NO: 2145550 - DNA, 17 bp, Homo sapiens
tgttgcatgatgtattt

SEQ ID NO: 2145551 - DNA, 17 bp, Homo sapiens
tgttgccacctgttaaa

SEQ ID NO: 2145552 - DNA, 21 bp, Homo sapiens
tgttgccacctgttaaaatgt

SEQ ID NO: 2145553 - DNA, 18 bp, Homo sapiens
tgttgcccaggcaggtct

SEQ ID NO: 2145554 - DNA, 19 bp, Homo sapiens
tgttgcccaggcaggtctt

SEQ ID NO: 2145555 - DNA, 13 bp, Homo sapiens
tgttgccctgagt

SEQ ID NO: 2145556 - DNA, 19 bp, Homo sapiens
tgttgccttagcacttctt

SEQ ID NO: 2145557 - DNA, 21 bp, Homo sapiens
tgttgctcaaatctattcaga

SEQ ID NO: 2145558 - DNA, 13 bp, Homo sapiens
tgttgctcttgga

SEQ ID NO: 2145559 - DNA, 12 bp, Homo sapiens
tgttggaatgaa

SEQ ID NO: 2145560 - DNA, 15 bp, Homo sapiens
tgttggacagctgct

SEQ ID NO: 2145561 - DNA, 15 bp, Homo sapiens
tgttggccaggctgg

SEQ ID NO: 2145562 - DNA, 16 bp, Homo sapiens
tgttggccaggctggt

SEQ ID NO: 2145563 - DNA, 14 bp, Homo sapiens
tgttggcctcgcct

SEQ ID NO: 2145564 - DNA, 15 bp, Homo sapiens
tgttggctaatgaag

SEQ ID NO: 2145565 - DNA, 19 bp, Homo sapiens
tgttggctgggggcctcag

SEQ ID NO: 2145566 - DNA, 14 bp, Homo sapiens
tgttggctgtgtga

SEQ ID NO: 2145567 - DNA, 22 bp, Homo sapiens
tgttgggcttgggggaaaagag

SEQ ID NO: 2145568 - DNA, 15 bp, Homo sapiens
tgttggggcagtggt

SEQ ID NO: 2145569 - DNA, 21 bp, Homo sapiens
ttacccagtgggacagaggag

SEQ ID NO: 2145570 - DNA, 17 bp, Homo sapiens
ttacccctgcacagttt

SEQ ID NO: 2145571 - DNA, 21 bp, Homo sapiens
ttacccggagaaggccgctgc

SEQ ID NO: 2145572 - DNA, 16 bp, Homo sapiens
ttacctaaacagatat

SEQ ID NO: 2145573 - DNA, 16 bp, Homo sapiens
ttacctaccacagtgt

SEQ ID NO: 2145574 - DNA, 20 bp, Homo sapiens
ttacctcccctgccagggct

SEQ ID NO: 2145575 - DNA, 17 bp, Homo sapiens
ttacctcttacattttc

SEQ ID NO: 2145576 - DNA, 14 bp, Homo sapiens
ttaccttaaatctg

SEQ ID NO: 2145577 - DNA, 14 bp, Homo sapiens
ttaccttacagaag

SEQ ID NO: 2145578 - DNA, 21 bp, Homo sapiens
ttaccttagattagctctgga

SEQ ID NO: 2145579 - DNA, 18 bp, Homo sapiens
ttaccttcaataaagtat

SEQ ID NO: 2145580 - DNA, 19 bp, Homo sapiens
ttaccttggccgtgaggac

SEQ ID NO: 2145581 - DNA, 15 bp, Homo sapiens
ttacctttattaatg

SEQ ID NO: 2145582 - DNA, 18 bp, Homo sapiens
ttacctttattaatgaac

SEQ ID NO: 2145583 - DNA, 20 bp, Homo sapiens
ttacctttattaatgaactg

SEQ ID NO: 2145584 - DNA, 13 bp, Homo sapiens
ttacgactgaaga

SEQ ID NO: 2145585 - DNA, 13 bp, Homo sapiens
ttacgctctctgt

SEQ ID NO: 2145586 - DNA, 21 bp, Homo sapiens
ttacggagggaggacatcata

SEQ ID NO: 2145587 - DNA, 16 bp, Homo sapiens
ttactaaacattttgt

SEQ ID NO: 2145588 - DNA, 21 bp, Homo sapiens
ttactaaacattttgttattg

SEQ ID NO: 2145589 - DNA, 21 bp, Homo sapiens
ttactaagccacaagaaattt

SEQ ID NO: 2145590 - DNA, 14 bp, Homo sapiens
ttactacaaaattt

SEQ ID NO: 2145591 - DNA, 20 bp, Homo sapiens
ttactacaaaatttgaaatt

SEQ ID NO: 2145592 - DNA, 13 bp, Homo sapiens
ttactacatgcac

SEQ ID NO: 2145593 - DNA, 14 bp, Homo sapiens
ttactacatgcact

SEQ ID NO: 2145594 - DNA, 16 bp, Homo sapiens
ttactactattctgtt

SEQ ID NO: 2145595 - DNA, 20 bp, Homo sapiens
ttactacttgttacctttcc

SEQ ID NO: 2145596 - DNA, 15 bp, Homo sapiens
ttactagcttttcaa

SEQ ID NO: 2145597 - DNA, 15 bp, Homo sapiens
ttactcagcagcaga

SEQ ID NO: 2145598 - DNA, 21 bp, Homo sapiens
ttactcagcagcagagagccc

SEQ ID NO: 2145599 - DNA, 14 bp, Homo sapiens
ttactcagccctgg

SEQ ID NO: 2145600 - DNA, 18 bp, Homo sapiens
ttactcatgtacattggt

SEQ ID NO: 2145601 - DNA, 19 bp, Homo sapiens
ttactctccaacctggaca

SEQ ID NO: 2145602 - DNA, 18 bp, Homo sapiens
ttactctgagcccaggcc

SEQ ID NO: 2145603 - DNA, 23 bp, Homo sapiens
ttactctgcggtggtgccagagg

SEQ ID NO: 2145604 - DNA, 14 bp, Homo sapiens
ttactcttcagttt

SEQ ID NO: 2145605 - DNA, 12 bp, Homo sapiens
ttactgaccatg

SEQ ID NO: 2145606 - DNA, 17 bp, Homo sapiens
ttactgagcttctctgt

SEQ ID NO: 2145607 - DNA, 19 bp, Homo sapiens
ttactgagcttctctgtga

SEQ ID NO: 2145608 - DNA, 21 bp, Homo sapiens
ttactgcctttggaagaaaca

SEQ ID NO: 2145609 - DNA, 12 bp, Homo sapiens
ttactgctgtca

SEQ ID NO: 2145610 - DNA, 23 bp, Homo sapiens
ttactgggtttgtttttcaaagc

SEQ ID NO: 2145611 - DNA, 14 bp, Homo sapiens
ttactgtctgtaag

SEQ ID NO: 2145612 - DNA, 18 bp, Homo sapiens
ttactgttagtcatttgc

SEQ ID NO: 2145613 - DNA, 16 bp, Homo sapiens
ttacttaaagcttgtt

SEQ ID NO: 2145614 - DNA, 22 bp, Homo sapiens
ttacttaaatagcatctgctct

SEQ ID NO: 2145615 - DNA, 11 bp, Homo sapiens
ttacttacctg

SEQ ID NO: 2145616 - DNA, 22 bp, Homo sapiens
ttacttccacagaatacaagcc

SEQ ID NO: 2145617 - DNA, 19 bp, Homo sapiens
ttacttgaaaaaatgttct

SEQ ID NO: 2145618 - DNA, 13 bp, Homo sapiens
ttacttgaaagat

SEQ ID NO: 2145619 - DNA, 17 bp, Homo sapiens
ttacttgaactttccaa

SEQ ID NO: 2145620 - DNA, 12 bp, Homo sapiens
ttacttgcacaa

SEQ ID NO: 2145621 - DNA, 16 bp, Homo sapiens
ttacttgcacaagctt

SEQ ID NO: 2145622 - DNA, 19 bp, Homo sapiens
ttacttggtgtaattaata

SEQ ID NO: 2145623 - DNA, 18 bp, Homo sapiens
ttacttgtagaaatctgt

SEQ ID NO: 2145624 - DNA, 20 bp, Homo sapiens
ttacttgtagaaatctgtaa

SEQ ID NO: 2145625 - DNA, 22 bp, Homo sapiens
ttacttgtagaaatctgtaatt

SEQ ID NO: 2145626 - DNA, 16 bp, Homo sapiens
ttacttgtctgaggcc

SEQ ID NO: 2145627 - DNA, 18 bp, Homo sapiens
ttactttaaaaggagcca

SEQ ID NO: 2145628 - DNA, 16 bp, Homo sapiens
ttactttatgttacta

SEQ ID NO: 2145629 - DNA, 13 bp, Homo sapiens
ttactttattaga

SEQ ID NO: 2145630 - DNA, 18 bp, Homo sapiens
ttacttttgtcttcctca

SEQ ID NO: 2145631 - DNA, 16 bp, Homo sapiens
ttagaaacaccattca

SEQ ID NO: 2145632 - DNA, 18 bp, Homo sapiens
ttagaaaccttaatatgt

SEQ ID NO: 2145633 - DNA, 13 bp, Homo sapiens
ttagaaagttatt

SEQ ID NO: 2145634 - DNA, 22 bp, Homo sapiens
ttagaacaatagctattgcatg

SEQ ID NO: 2145635 - DNA, 22 bp, Homo sapiens
ttagaacaggcaagtgaagaaa

SEQ ID NO: 2145636 - DNA, 13 bp, Homo sapiens
ttagaacctttct

SEQ ID NO: 2145637 - DNA, 21 bp, Homo sapiens
ttagaagtacgtttttgcatt

SEQ ID NO: 2145638 - DNA, 13 bp, Homo sapiens
ttagaagtgttaa

SEQ ID NO: 2145639 - DNA, 14 bp, Homo sapiens
ttagaataaaattg

SEQ ID NO: 2145640 - DNA, 21 bp, Homo sapiens
ttagaatgattccctcttgct

SEQ ID NO: 2145641 - DNA, 10 bp, Homo sapiens
ttagaatttt

SEQ ID NO: 2145642 - DNA, 14 bp, Homo sapiens
ttagacctcagcct

SEQ ID NO: 2145643 - DNA, 15 bp, Homo sapiens
ttagactggaacttg

SEQ ID NO: 2145644 - DNA, 21 bp, Homo sapiens
ttagactggaacttgaactga

SEQ ID NO: 2145645 - DNA, 17 bp, Homo sapiens
ttagactggacagcttg

SEQ ID NO: 2145646 - DNA, 21 bp, Homo sapiens
ttagagaggtagcgagctgct

SEQ ID NO: 2145647 - DNA, 13 bp, Homo sapiens
ttagagatgaatt

SEQ ID NO: 2145648 - DNA, 17 bp, Homo sapiens
ttagaggaaaaaaatga

SEQ ID NO: 2145649 - DNA, 22 bp, Homo sapiens
ttagagtgcccttaaaataatg

SEQ ID NO: 2145650 - DNA, 23 bp, Homo sapiens
ttagatatataactttagaaata

SEQ ID NO: 2145651 - DNA, 16 bp, Homo sapiens
ttagatcccatgtcac

SEQ ID NO: 2145652 - DNA, 21 bp, Homo sapiens
ttagatcccatgtcacctcag

SEQ ID NO: 2145653 - DNA, 17 bp, Homo sapiens
ttagatgagggtgactg

SEQ ID NO: 2145654 - DNA, 15 bp, Homo sapiens
ttagattccaggatc

SEQ ID NO: 2145655 - DNA, 13 bp, Homo sapiens
ttagcaaagagtt

SEQ ID NO: 2145656 - DNA, 14 bp, Homo sapiens
ttagcacaatttat

SEQ ID NO: 2145657 - DNA, 15 bp, Homo sapiens
ttagcacaatttata

SEQ ID NO: 2145658 - DNA, 22 bp, Homo sapiens
ttagcagctcttcccctttcct

SEQ ID NO: 2145659 - DNA, 20 bp, Homo sapiens
ttagcatgcctccaaaaatt

SEQ ID NO: 2145660 - DNA, 22 bp, Homo sapiens
ttagcatgcctccaaaaattca

SEQ ID NO: 2145661 - DNA, 17 bp, Homo sapiens
ttagcatgtgttgaaaa

SEQ ID NO: 2145662 - DNA, 20 bp, Homo sapiens
ttagccactggtttctcaga

SEQ ID NO: 2145663 - DNA, 12 bp, Homo sapiens
ttagccagtgac

SEQ ID NO: 2145664 - DNA, 14 bp, Homo sapiens
ttagccccataatt

SEQ ID NO: 2145665 - DNA, 20 bp, Homo sapiens
ttagcctcaatttctgaaca

SEQ ID NO: 2145666 - DNA, 23 bp, Homo sapiens
ttagcctggagcacctttccttc

SEQ ID NO: 2145667 - DNA, 12 bp, Homo sapiens
ttagccttctct

SEQ ID NO: 2145668 - DNA, 17 bp, Homo sapiens
ttagccttctctgttca

SEQ ID NO: 2145669 - DNA, 18 bp, Homo sapiens
ttagcctttgccctgtca

SEQ ID NO: 2145670 - DNA, 13 bp, Homo sapiens
ttagctgcagaac

SEQ ID NO: 2145671 - DNA, 16 bp, Homo sapiens
ttagctggcattacag

SEQ ID NO: 2145672 - DNA, 23 bp, Homo sapiens
ttagctggccacagtgagctgat

SEQ ID NO: 2145673 - DNA, 16 bp, Homo sapiens
ttagctgtgtgaaata

SEQ ID NO: 2145674 - DNA, 21 bp, Homo sapiens
ttagctgttatttctattttt

SEQ ID NO: 2145675 - DNA, 21 bp, Homo sapiens
ttagcttagacctcagcctgt

SEQ ID NO: 2145676 - DNA, 19 bp, Homo sapiens
ttaggaaataaaacctttc

SEQ ID NO: 2145677 - DNA, 23 bp, Homo sapiens
ttaggaacagctcttcactcagc

SEQ ID NO: 2145678 - DNA, 15 bp, Homo sapiens
ttaggaagagaaacc

SEQ ID NO: 2145679 - DNA, 20 bp, Homo sapiens
ttaggaaggcagcattccat

SEQ ID NO: 2145680 - DNA, 18 bp, Homo sapiens
ttaggaggctcaacaata

SEQ ID NO: 2145681 - DNA, 20 bp, Homo sapiens
ttaggatctatgcaattttt

SEQ ID NO: 2145682 - DNA, 11 bp, Homo sapiens
ttaggcctcct

SEQ ID NO: 2145683 - DNA, 22 bp, Homo sapiens
ttaggcgcccatggtacaagga

SEQ ID NO: 2145684 - DNA, 18 bp, Homo sapiens
ttcatcaatttttataca

SEQ ID NO: 2145685 - DNA, 15 bp, Homo sapiens
ttcatccagttgcaa

SEQ ID NO: 2145686 - DNA, 16 bp, Homo sapiens
ttcatccagttgcaat

SEQ ID NO: 2145687 - DNA, 18 bp, Homo sapiens
ttcatccagttgcaataa

SEQ ID NO: 2145688 - DNA, 20 bp, Homo sapiens
ttcatccagttgcaataaaa

SEQ ID NO: 2145689 - DNA, 23 bp, Homo sapiens
ttcatccagttgcaataaaatag

SEQ ID NO: 2145690 - DNA, 24 bp, Homo sapiens
ttcatcccaaaggacagccgcctg

SEQ ID NO: 2145691 - DNA, 13 bp, Homo sapiens
ttcatcccagccc

SEQ ID NO: 2145692 - DNA, 18 bp, Homo sapiens
ttcatctctaacatatga

SEQ ID NO: 2145693 - DNA, 22 bp, Homo sapiens
ttcatcttcaaccttaaggact

SEQ ID NO: 2145694 - DNA, 16 bp, Homo sapiens
ttcatgagtggatgga

SEQ ID NO: 2145695 - DNA, 18 bp, Homo sapiens
ttcatgataatgaacaga

SEQ ID NO: 2145696 - DNA, 14 bp, Homo sapiens
ttcatgcaatgaca

SEQ ID NO: 2145697 - DNA, 21 bp, Homo sapiens
ttcatgcaatgacatcttcaa

SEQ ID NO: 2145698 - DNA, 18 bp, Homo sapiens
ttcatgccatctgttttc

SEQ ID NO: 2145699 - DNA, 23 bp, Homo sapiens
ttcatgccgtggtaagtaccaca

SEQ ID NO: 2145700 - DNA, 13 bp, Homo sapiens
ttcatgcctcagt

SEQ ID NO: 2145701 - DNA, 18 bp, Homo sapiens
ttcatgcctcagtttccc

SEQ ID NO: 2145702 - DNA, 17 bp, Homo sapiens
ttcatgctatctctgtg

SEQ ID NO: 2145703 - DNA, 14 bp, Homo sapiens
ttcatgctcagccc

SEQ ID NO: 2145704 - DNA, 16 bp, Homo sapiens
ttcatgctttctcctt

SEQ ID NO: 2145705 - DNA, 19 bp, Homo sapiens
ttcatggtgaaaatgtact

SEQ ID NO: 2145706 - DNA, 23 bp, Homo sapiens
ttcatgtaataaatctgagccta

SEQ ID NO: 2145707 - DNA, 15 bp, Homo sapiens
ttcatgtgaaaataa

SEQ ID NO: 2145708 - DNA, 15 bp, Homo sapiens
ttcatgtttgtaaat

SEQ ID NO: 2145709 - DNA, 17 bp, Homo sapiens
ttcatgtttgtaaatta

SEQ ID NO: 2145710 - DNA, 18 bp, Homo sapiens
ttcatgtttgtaaattaa

SEQ ID NO: 2145711 - DNA, 15 bp, Homo sapiens
ttcattaaaagctac

SEQ ID NO: 2145712 - DNA, 13 bp, Homo sapiens
ttcattaaagcat

SEQ ID NO: 2145713 - DNA, 15 bp, Homo sapiens
ttcattaaattttct

SEQ ID NO: 2145714 - DNA, 13 bp, Homo sapiens
ttcattcttgaaa

SEQ ID NO: 2145715 - DNA, 16 bp, Homo sapiens
ttcattgactatcaaa

SEQ ID NO: 2145716 - DNA, 16 bp, Homo sapiens
ttcatttaaaatgatt

SEQ ID NO: 2145717 - DNA, 16 bp, Homo sapiens
ttcatttaactacaaa

SEQ ID NO: 2145718 - DNA, 12 bp, Homo sapiens
ttcatttcactt

SEQ ID NO: 2145719 - DNA, 15 bp, Homo sapiens
ttcatttcactttaa

SEQ ID NO: 2145720 - DNA, 13 bp, Homo sapiens
ttcatttccgtga

SEQ ID NO: 2145721 - DNA, 16 bp, Homo sapiens
ttcatttcctcaaaaa

SEQ ID NO: 2145722 - DNA, 15 bp, Homo sapiens
ttcatttcctgtgtc

SEQ ID NO: 2145723 - DNA, 16 bp, Homo sapiens
ttcatttcctgtgtct

SEQ ID NO: 2145724 - DNA, 16 bp, Homo sapiens
ttcatttgatgctaaa

SEQ ID NO: 2145725 - DNA, 13 bp, Homo sapiens
ttcatttgtgtca

SEQ ID NO: 2145726 - DNA, 15 bp, Homo sapiens
ttcatttgtgtcaat

SEQ ID NO: 2145727 - DNA, 21 bp, Homo sapiens
ttcattttaacatctgagaaa

SEQ ID NO: 2145728 - DNA, 15 bp, Homo sapiens
ttcattttaatttat

SEQ ID NO: 2145729 - DNA, 20 bp, Homo sapiens
ttcattttaatttatatttg

SEQ ID NO: 2145730 - DNA, 22 bp, Homo sapiens
ttcattttaatttatatttgaa

SEQ ID NO: 2145731 - DNA, 14 bp, Homo sapiens
ttcattttcagagt

SEQ ID NO: 2145732 - DNA, 17 bp, Homo sapiens
ttcattttgaaaaacac

SEQ ID NO: 2145733 - DNA, 17 bp, Homo sapiens
ttccaaaataaaatgaa

SEQ ID NO: 2145734 - DNA, 15 bp, Homo sapiens
ttccaaataaaatga

SEQ ID NO: 2145735 - DNA, 22 bp, Homo sapiens
ttccaaataaggatttgttcac

SEQ ID NO: 2145736 - DNA, 13 bp, Homo sapiens
ttccaacagacag

SEQ ID NO: 2145737 - DNA, 16 bp, Homo sapiens
ttccaaccccagctgg

SEQ ID NO: 2145738 - DNA, 21 bp, Homo sapiens
ttccaaccccagctggcctct

SEQ ID NO: 2145739 - DNA, 21 bp, Homo sapiens
ttccaagaaagatccaccctc

SEQ ID NO: 2145740 - DNA, 13 bp, Homo sapiens
ttccaagcccttt

SEQ ID NO: 2145741 - DNA, 21 bp, Homo sapiens
ttccaagggtatgggaagcca

SEQ ID NO: 2145742 - DNA, 19 bp, Homo sapiens
ttccaagtaatataatgga

SEQ ID NO: 2145743 - DNA, 19 bp, Homo sapiens
ttccaagtcaacactcttc

SEQ ID NO: 2145744 - DNA, 16 bp, Homo sapiens
ttccaatatgatgact

SEQ ID NO: 2145745 - DNA, 20 bp, Homo sapiens
ttccacaagattcccagaga

SEQ ID NO: 2145746 - DNA, 19 bp, Homo sapiens
ttccacacctagcatctca

SEQ ID NO: 2145747 - DNA, 18 bp, Homo sapiens
ttccacagtctctgggag

SEQ ID NO: 2145748 - DNA, 15 bp, Homo sapiens
ttccacctgctttct

SEQ ID NO: 2145749 - DNA, 16 bp, Homo sapiens
ttccactactgtgtag

SEQ ID NO: 2145750 - DNA, 20 bp, Homo sapiens
ttccactcctatggaaaagg

SEQ ID NO: 2145751 - DNA, 21 bp, Homo sapiens
ttccacttagaaattgcattt

SEQ ID NO: 2145752 - DNA, 18 bp, Homo sapiens
ttccagaaaaccccagca

SEQ ID NO: 2145753 - DNA, 13 bp, Homo sapiens
ttccagaccacct

SEQ ID NO: 2145754 - DNA, 16 bp, Homo sapiens
ttccagaccacctgcc

SEQ ID NO: 2145755 - DNA, 17 bp, Homo sapiens
ttccagaccacctgcca

SEQ ID NO: 2145756 - DNA, 22 bp, Homo sapiens
ttccagaccacctgccagccat

SEQ ID NO: 2145757 - DNA, 11 bp, Homo sapiens
ttccaggaaga

SEQ ID NO: 2145758 - DNA, 23 bp, Homo sapiens
ttccaggagcacacggccctgcc

SEQ ID NO: 2145759 - DNA, 17 bp, Homo sapiens
ttccaggagggaaaatg

SEQ ID NO: 2145760 - DNA, 16 bp, Homo sapiens
ttccaggcccctgagg

SEQ ID NO: 2145761 - DNA, 17 bp, Homo sapiens
ttccaggcccctgagga

SEQ ID NO: 2145762 - DNA, 21 bp, Homo sapiens
ttccaggctcttcctggacct

SEQ ID NO: 2145763 - DNA, 19 bp, Homo sapiens
ttccagtggtaccagctca

SEQ ID NO: 2145764 - DNA, 22 bp, Homo sapiens
ttccataaccccaggcatccca

SEQ ID NO: 2145765 - DNA, 19 bp, Homo sapiens
ttccataaggaatgtagct

SEQ ID NO: 2145766 - DNA, 19 bp, Homo sapiens
ttccataatctggactcct

SEQ ID NO: 2145767 - DNA, 12 bp, Homo sapiens
ttccataattat

SEQ ID NO: 2145768 - DNA, 14 bp, Homo sapiens
ttccataattatga

SEQ ID NO: 2145769 - DNA, 18 bp, Homo sapiens
ttccataggaatcatgtt

SEQ ID NO: 2145770 - DNA, 12 bp, Homo sapiens
ttccatctgatt

SEQ ID NO: 2145771 - DNA, 22 bp, Homo sapiens
ttccatctgcttgtattttcca

SEQ ID NO: 2145772 - DNA, 24 bp, Homo sapiens
ttccatgaaaatgcaacaacatgt

SEQ ID NO: 2145773 - DNA, 20 bp, Homo sapiens
ttccatgaagtttgaacttc

SEQ ID NO: 2145774 - DNA, 18 bp, Homo sapiens
ttccatgagaacagcagg

SEQ ID NO: 2145775 - DNA, 14 bp, Homo sapiens
ttccatgtccctgt

SEQ ID NO: 2145776 - DNA, 17 bp, Homo sapiens
ttccatgtcgcctctgc

SEQ ID NO: 2145777 - DNA, 20 bp, Homo sapiens
ttccatgtcgcctctgcatt

SEQ ID NO: 2145778 - DNA, 13 bp, Homo sapiens
ttccattcttgtc

SEQ ID NO: 2145779 - DNA, 16 bp, Homo sapiens
ttccatttccagttca

SEQ ID NO: 2145780 - DNA, 21 bp, Homo sapiens
ttccatttggtgaccatctgt

SEQ ID NO: 2145781 - DNA, 20 bp, Homo sapiens
ttcccaaattccctggacct

SEQ ID NO: 2145782 - DNA, 16 bp, Homo sapiens
ttcccaactgctctgc

SEQ ID NO: 2145783 - DNA, 21 bp, Homo sapiens
ttcccaagagcatcatgcctc

SEQ ID NO: 2145784 - DNA, 12 bp, Homo sapiens
ttcccaataaaa

SEQ ID NO: 2145785 - DNA, 17 bp, Homo sapiens
ttcccaatcagcactga

SEQ ID NO: 2145786 - DNA, 19 bp, Homo sapiens
ttcccaatcagcactgaaa

SEQ ID NO: 2145787 - DNA, 20 bp, Homo sapiens
ttcccaatcagcactgaaaa

SEQ ID NO: 2145788 - DNA, 13 bp, Homo sapiens
ttcccacagcatt

SEQ ID NO: 2145789 - DNA, 15 bp, Homo sapiens
ttcccaccaaggtct

SEQ ID NO: 2145790 - DNA, 22 bp, Homo sapiens
ttcccaccagcatgtcactccc

SEQ ID NO: 2145791 - DNA, 15 bp, Homo sapiens
ttcccagagaagctc

SEQ ID NO: 2145792 - DNA, 19 bp, Homo sapiens
ttcccagagacaggaaaat

SEQ ID NO: 2145793 - DNA, 22 bp, Homo sapiens
ttcccagagacaggaaaatcct

SEQ ID NO: 2145794 - DNA, 14 bp, Homo sapiens
ttcccagaggcaga

SEQ ID NO: 2145795 - DNA, 22 bp, Homo sapiens
ttcccagagtcagaggagaaga

SEQ ID NO: 2145796 - DNA, 21 bp, Homo sapiens
ttcccagagtgtgaaacttcc

SEQ ID NO: 2145797 - DNA, 15 bp, Homo sapiens
ttcccatccccagcg

SEQ ID NO: 2145798 - DNA, 11 bp, Homo sapiens
ttcccatctgc

SEQ ID NO: 2145799 - DNA, 20 bp, Homo sapiens
ttgacggatgattggattat

SEQ ID NO: 2145800 - DNA, 18 bp, Homo sapiens
ttgacgggaggcctcagt

SEQ ID NO: 2145801 - DNA, 21 bp, Homo sapiens
ttgactatcacatacaatttg

SEQ ID NO: 2145802 - DNA, 21 bp, Homo sapiens
ttgactcaagtttttacaaaa

SEQ ID NO: 2145803 - DNA, 15 bp, Homo sapiens
ttgactcttttgcca

SEQ ID NO: 2145804 - DNA, 23 bp, Homo sapiens
ttgactgaactgcacgttctata

SEQ ID NO: 2145805 - DNA, 17 bp, Homo sapiens
ttgactgggtttctctg

SEQ ID NO: 2145806 - DNA, 14 bp, Homo sapiens
ttgacttcttggtt

SEQ ID NO: 2145807 - DNA, 22 bp, Homo sapiens
ttgacttcttggtttggggaga

SEQ ID NO: 2145808 - DNA, 12 bp, Homo sapiens
ttgactttcagg

SEQ ID NO: 2145809 - DNA, 14 bp, Homo sapiens
ttgactttcaggta

SEQ ID NO: 2145810 - DNA, 12 bp, Homo sapiens
ttgagaaagaaa

SEQ ID NO: 2145811 - DNA, 21 bp, Homo sapiens
ttgagaaaggattaagataca

SEQ ID NO: 2145812 - DNA, 22 bp, Homo sapiens
ttgagaatttggatacactctc

SEQ ID NO: 2145813 - DNA, 13 bp, Homo sapiens
ttgagaattttaa

SEQ ID NO: 2145814 - DNA, 14 bp, Homo sapiens
ttgagacaagccct

SEQ ID NO: 2145815 - DNA, 15 bp, Homo sapiens
ttgagacaagccctg

SEQ ID NO: 2145816 - DNA, 16 bp, Homo sapiens
ttgagacaagccctgg

SEQ ID NO: 2145817 - DNA, 20 bp, Homo sapiens
ttgagacaagccctggcaac

SEQ ID NO: 2145818 - DNA, 12 bp, Homo sapiens
ttgagacagagt

SEQ ID NO: 2145819 - DNA, 21 bp, Homo sapiens
ttgagaccagcctggccaaca

SEQ ID NO: 2145820 - DNA, 15 bp, Homo sapiens
ttgagacctcagcca

SEQ ID NO: 2145821 - DNA, 15 bp, Homo sapiens
ttgagagtgtgacca

SEQ ID NO: 2145822 - DNA, 21 bp, Homo sapiens
ttgagataatatctgtgaggt

SEQ ID NO: 2145823 - DNA, 15 bp, Homo sapiens
ttgagatttctttta

SEQ ID NO: 2145824 - DNA, 16 bp, Homo sapiens
ttgagcactcagtcta

SEQ ID NO: 2145825 - DNA, 16 bp, Homo sapiens
ttgagcagggctcagc

SEQ ID NO: 2145826 - DNA, 11 bp, Homo sapiens
ttgagcccagg

SEQ ID NO: 2145827 - DNA, 17 bp, Homo sapiens
ttgagcctccatttctg

SEQ ID NO: 2145828 - DNA, 23 bp, Homo sapiens
ttgagcctccatttctggcttct

SEQ ID NO: 2145829 - DNA, 13 bp, Homo sapiens
ttgaggacacatg

SEQ ID NO: 2145830 - DNA, 14 bp, Homo sapiens
ttgaggacacatgt

SEQ ID NO: 2145831 - DNA, 17 bp, Homo sapiens
ttgaggaggggcacctg

SEQ ID NO: 2145832 - DNA, 13 bp, Homo sapiens
ttgaggccaggag

SEQ ID NO: 2145833 - DNA, 13 bp, Homo sapiens
ttgagggtaggag

SEQ ID NO: 2145834 - DNA, 16 bp, Homo sapiens
ttgagggttgggctgg

SEQ ID NO: 2145835 - DNA, 22 bp, Homo sapiens
ttgaggtggaagccctccttcc

SEQ ID NO: 2145836 - DNA, 18 bp, Homo sapiens
ttgagtacagtgaggagg

SEQ ID NO: 2145837 - DNA, 17 bp, Homo sapiens
ttgagtcaaaagcctgg

SEQ ID NO: 2145838 - DNA, 21 bp, Homo sapiens
ttgagtcaaaagcctgggtga

SEQ ID NO: 2145839 - DNA, 17 bp, Homo sapiens
ttgagtctcttttttat

SEQ ID NO: 2145840 - DNA, 21 bp, Homo sapiens
ttgagtctcttttttattctg

SEQ ID NO: 2145841 - DNA, 13 bp, Homo sapiens
ttgagtgtttaaa

SEQ ID NO: 2145842 - DNA, 17 bp, Homo sapiens
ttgagtgttttaagata

SEQ ID NO: 2145843 - DNA, 18 bp, Homo sapiens
ttgagttttgactgcttg

SEQ ID NO: 2145844 - DNA, 20 bp, Homo sapiens
ttgataaagattttttaata

SEQ ID NO: 2145845 - DNA, 21 bp, Homo sapiens
ttgataaattccactggactt

SEQ ID NO: 2145846 - DNA, 19 bp, Homo sapiens
ttgatagctttatttttta

SEQ ID NO: 2145847 - DNA, 17 bp, Homo sapiens
ttgatatatttcattct

SEQ ID NO: 2145848 - DNA, 13 bp, Homo sapiens
ttgatatgaaaaa

SEQ ID NO: 2145849 - DNA, 22 bp, Homo sapiens
ttgatatgaaaaatatgatatt

SEQ ID NO: 2145850 - DNA, 15 bp, Homo sapiens
ttgatatgactgttt

SEQ ID NO: 2145851 - DNA, 18 bp, Homo sapiens
ttgatatgagtatacaat

SEQ ID NO: 2145852 - DNA, 22 bp, Homo sapiens
ttgatcacagtggcgagaggag

SEQ ID NO: 2145853 - DNA, 14 bp, Homo sapiens
ttgatgaagcctgt

SEQ ID NO: 2145854 - DNA, 21 bp, Homo sapiens
ttgatgaagcctgtgccacct

SEQ ID NO: 2145855 - DNA, 16 bp, Homo sapiens
ttgatgatctttgcag

SEQ ID NO: 2145856 - DNA, 14 bp, Homo sapiens
ttgatgccaaaaaa

SEQ ID NO: 2145857 - DNA, 22 bp, Homo sapiens
ttgatgccaaaaaaaaatacat

SEQ ID NO: 2145858 - DNA, 21 bp, Homo sapiens
ttgatgggaagaaaaggtaca

SEQ ID NO: 2145859 - DNA, 13 bp, Homo sapiens
ttgatggggagaa

SEQ ID NO: 2145860 - DNA, 17 bp, Homo sapiens
ttgatgtacatgtgtag

SEQ ID NO: 2145861 - DNA, 16 bp, Homo sapiens
ttgatgtcagccttgc

SEQ ID NO: 2145862 - DNA, 17 bp, Homo sapiens
ttgatgtcagccttgca

SEQ ID NO: 2145863 - DNA, 17 bp, Homo sapiens
ttgatgtttccagaaaa

SEQ ID NO: 2145864 - DNA, 21 bp, Homo sapiens
ttgatgtttccagaaaatata

SEQ ID NO: 2145865 - DNA, 20 bp, Homo sapiens
ttgattattctgattccact

SEQ ID NO: 2145866 - DNA, 12 bp, Homo sapiens
ttgattcttcct

SEQ ID NO: 2145867 - DNA, 22 bp, Homo sapiens
ttgatttctacgttatgaaaac

SEQ ID NO: 2145868 - DNA, 17 bp, Homo sapiens
ttgcaacaggctgggct

SEQ ID NO: 2145869 - DNA, 13 bp, Homo sapiens
ttgcaagaggagg

SEQ ID NO: 2145870 - DNA, 18 bp, Homo sapiens
ttgcaagatttaacacta

SEQ ID NO: 2145871 - DNA, 19 bp, Homo sapiens
ttgcaagcagcctcctggg

SEQ ID NO: 2145872 - DNA, 13 bp, Homo sapiens
ttgcaaggaagcc

SEQ ID NO: 2145873 - DNA, 13 bp, Homo sapiens
ttgcaataaaata

SEQ ID NO: 2145874 - DNA, 14 bp, Homo sapiens
ttgcaataaaatag

SEQ ID NO: 2145875 - DNA, 17 bp, Homo sapiens
ttgcaatggcagccttg

SEQ ID NO: 2145876 - DNA, 20 bp, Homo sapiens
ttgcaatggtgttgccctga

SEQ ID NO: 2145877 - DNA, 14 bp, Homo sapiens
ttgcaattattcta

SEQ ID NO: 2145878 - DNA, 14 bp, Homo sapiens
ttgcacatctctgc

SEQ ID NO: 2145879 - DNA, 22 bp, Homo sapiens
ttgcacatgtaacatagattta

SEQ ID NO: 2145880 - DNA, 13 bp, Homo sapiens
ttgcacattagga

SEQ ID NO: 2145881 - DNA, 13 bp, Homo sapiens
ttgcacccctcac

SEQ ID NO: 2145882 - DNA, 22 bp, Homo sapiens
ttgcacccctcactctggcctc

SEQ ID NO: 2145883 - DNA, 17 bp, Homo sapiens
ttgcactatgaaaatca

SEQ ID NO: 2145884 - DNA, 16 bp, Homo sapiens
ttgcactgagggccac

SEQ ID NO: 2145885 - DNA, 21 bp, Homo sapiens
ttgcactgagggccacactat

SEQ ID NO: 2145886 - DNA, 18 bp, Homo sapiens
ttgcagaaaagcacctgc

SEQ ID NO: 2145887 - DNA, 19 bp, Homo sapiens
ttgcagaaaagcacctgcc

SEQ ID NO: 2145888 - DNA, 23 bp, Homo sapiens
ttgcagacaggcaagcacctcct

SEQ ID NO: 2145889 - DNA, 19 bp, Homo sapiens
ttgcagactcagtttgtca

SEQ ID NO: 2145890 - DNA, 14 bp, Homo sapiens
ttgcagcagaagcc

SEQ ID NO: 2145891 - DNA, 19 bp, Homo sapiens
ttgcagcagaagccaaatt

SEQ ID NO: 2145892 - DNA, 14 bp, Homo sapiens
ttgcagcagtgagt

SEQ ID NO: 2145893 - DNA, 16 bp, Homo sapiens
ttgcaggacacaagca

SEQ ID NO: 2145894 - DNA, 22 bp, Homo sapiens
ttgcaggccaggttatgcctca

SEQ ID NO: 2145895 - DNA, 14 bp, Homo sapiens
ttgcagtccccagt

SEQ ID NO: 2145896 - DNA, 16 bp, Homo sapiens
ttgcagttcaaatcct

SEQ ID NO: 2145897 - DNA, 17 bp, Homo sapiens
ttgcataagattaaagg

SEQ ID NO: 2145898 - DNA, 22 bp, Homo sapiens
ttgcataagattaaaggaagga

SEQ ID NO: 2145899 - DNA, 23 bp, Homo sapiens
ttgcataagattaaaggaaggaa

SEQ ID NO: 2145900 - DNA, 23 bp, Homo sapiens
ttgcatagtaccaatcattttaa

SEQ ID NO: 2145901 - DNA, 14 bp, Homo sapiens
ttgcatgatgtatt

SEQ ID NO: 2145902 - DNA, 12 bp, Homo sapiens
ttgcatgtaaaa

SEQ ID NO: 2145903 - DNA, 13 bp, Homo sapiens
ttgcatgtaaaat

SEQ ID NO: 2145904 - DNA, 18 bp, Homo sapiens
ttgcatgtaaaatgcagt

SEQ ID NO: 2145905 - DNA, 11 bp, Homo sapiens
ttgcattagaa

SEQ ID NO: 2145906 - DNA, 13 bp, Homo sapiens
ttgcattccatga

SEQ ID NO: 2145907 - DNA, 19 bp, Homo sapiens
ttgccacaatgcctctccc

SEQ ID NO: 2145908 - DNA, 22 bp, Homo sapiens
ttgccacaatgcctctcccacg

SEQ ID NO: 2145909 - DNA, 18 bp, Homo sapiens
ttgccaccactagagctg

SEQ ID NO: 2145910 - DNA, 21 bp, Homo sapiens
ttgccaccactagagctgaga

SEQ ID NO: 2145911 - DNA, 15 bp, Homo sapiens
ttgccacctgttaaa

SEQ ID NO: 2145912 - DNA, 15 bp, Homo sapiens
ttgccactgcctctt

SEQ ID NO: 2145913 - DNA, 18 bp, Homo sapiens
ttgccactgcctcttcct

SEQ ID NO: 2145914 - DNA, 18 bp, Homo sapiens
tttacattttatttatta

SEQ ID NO: 2145915 - DNA, 21 bp, Homo sapiens
tttacctaccaccttccctct

SEQ ID NO: 2145916 - DNA, 13 bp, Homo sapiens
tttacctataaaa

SEQ ID NO: 2145917 - DNA, 16 bp, Homo sapiens
tttaccttcagcagtt

SEQ ID NO: 2145918 - DNA, 13 bp, Homo sapiens
tttactaaagcag

SEQ ID NO: 2145919 - DNA, 15 bp, Homo sapiens
tttactaaagcagtg

SEQ ID NO: 2145920 - DNA, 17 bp, Homo sapiens
tttactaccaatgccaa

SEQ ID NO: 2145921 - DNA, 23 bp, Homo sapiens
tttactactgtggaaaaatattt

SEQ ID NO: 2145922 - DNA, 20 bp, Homo sapiens
tttactcccttcctggcctc

SEQ ID NO: 2145923 - DNA, 18 bp, Homo sapiens
tttactgagcttctctgt

SEQ ID NO: 2145924 - DNA, 12 bp, Homo sapiens
tttactgctgtc

SEQ ID NO: 2145925 - DNA, 19 bp, Homo sapiens
tttactgtctgtaagagaa

SEQ ID NO: 2145926 - DNA, 12 bp, Homo sapiens
tttacttgaaag

SEQ ID NO: 2145927 - DNA, 18 bp, Homo sapiens
tttacttgcattgaatat

SEQ ID NO: 2145928 - DNA, 22 bp, Homo sapiens
tttacttgtagaaatctgtaat

SEQ ID NO: 2145929 - DNA, 23 bp, Homo sapiens
tttagaaagaagcccaatattat

SEQ ID NO: 2145930 - DNA, 13 bp, Homo sapiens
tttagaaatcatt

SEQ ID NO: 2145931 - DNA, 18 bp, Homo sapiens
tttagaaatcattttgca

SEQ ID NO: 2145932 - DNA, 12 bp, Homo sapiens
tttagacagagt

SEQ ID NO: 2145933 - DNA, 22 bp, Homo sapiens
tttagagtatgcaagaagaata

SEQ ID NO: 2145934 - DNA, 16 bp, Homo sapiens
tttagatttcaagaaa

SEQ ID NO: 2145935 - DNA, 13 bp, Homo sapiens
tttagattttatg

SEQ ID NO: 2145936 - DNA, 18 bp, Homo sapiens
tttagcacaatttatatt

SEQ ID NO: 2145937 - DNA, 11 bp, Homo sapiens
tttagccagtg

SEQ ID NO: 2145938 - DNA, 21 bp, Homo sapiens
tttagcctggtacctagcaca

SEQ ID NO: 2145939 - DNA, 16 bp, Homo sapiens
tttagccttctctgtt

SEQ ID NO: 2145940 - DNA, 16 bp, Homo sapiens
tttagctctgttcttt

SEQ ID NO: 2145941 - DNA, 17 bp, Homo sapiens
tttagctctgttcttta

SEQ ID NO: 2145942 - DNA, 16 bp, Homo sapiens
tttagggccaggcagg

SEQ ID NO: 2145943 - DNA, 20 bp, Homo sapiens
tttagtaatagtccaatatt

SEQ ID NO: 2145944 - DNA, 13 bp, Homo sapiens
tttagtctgtcat

SEQ ID NO: 2145945 - DNA, 17 bp, Homo sapiens
tttagtcttttactcct

SEQ ID NO: 2145946 - DNA, 18 bp, Homo sapiens
tttagttgaaaaatctag

SEQ ID NO: 2145947 - DNA, 20 bp, Homo sapiens
tttagttgtatctcttttga

SEQ ID NO: 2145948 - DNA, 14 bp, Homo sapiens
tttataaaattaga

SEQ ID NO: 2145949 - DNA, 22 bp, Homo sapiens
tttataaaattagaaagcaact

SEQ ID NO: 2145950 - DNA, 14 bp, Homo sapiens
tttataaactagat

SEQ ID NO: 2145951 - DNA, 19 bp, Homo sapiens
tttataactagtcctttac

SEQ ID NO: 2145952 - DNA, 21 bp, Homo sapiens
tttataactcatcataaaata

SEQ ID NO: 2145953 - DNA, 12 bp, Homo sapiens
tttatacaaaat

SEQ ID NO: 2145954 - DNA, 22 bp, Homo sapiens
tttatacaaaataatttaacta

SEQ ID NO: 2145955 - DNA, 18 bp, Homo sapiens
tttatacatagtcacaaa

SEQ ID NO: 2145956 - DNA, 12 bp, Homo sapiens
tttatacatatc

SEQ ID NO: 2145957 - DNA, 16 bp, Homo sapiens
tttatacatatcagaa

SEQ ID NO: 2145958 - DNA, 23 bp, Homo sapiens
tttatactctagaacatgcacat

SEQ ID NO: 2145959 - DNA, 16 bp, Homo sapiens
tttatagctcagttta

SEQ ID NO: 2145960 - DNA, 19 bp, Homo sapiens
tttatagtttgtacatgca

SEQ ID NO: 2145961 - DNA, 15 bp, Homo sapiens
tttatataattttgc

SEQ ID NO: 2145962 - DNA, 13 bp, Homo sapiens
tttatatatgtat

SEQ ID NO: 2145963 - DNA, 23 bp, Homo sapiens
tttatatattggtaacatccttt

SEQ ID NO: 2145964 - DNA, 12 bp, Homo sapiens
tttatatattta

SEQ ID NO: 2145965 - DNA, 16 bp, Homo sapiens
tttatatatttataac

SEQ ID NO: 2145966 - DNA, 14 bp, Homo sapiens
tttatatctatagt

SEQ ID NO: 2145967 - DNA, 16 bp, Homo sapiens
tttatatgaaatgttt

SEQ ID NO: 2145968 - DNA, 14 bp, Homo sapiens
tttatatgccaccg

SEQ ID NO: 2145969 - DNA, 23 bp, Homo sapiens
tttatattaatttgtttttctta

SEQ ID NO: 2145970 - DNA, 16 bp, Homo sapiens
tttatattacactaca

SEQ ID NO: 2145971 - DNA, 19 bp, Homo sapiens
tttatattgtaaatattgt

SEQ ID NO: 2145972 - DNA, 15 bp, Homo sapiens
tttatattgtatatt

SEQ ID NO: 2145973 - DNA, 17 bp, Homo sapiens
tttatattgtatattct

SEQ ID NO: 2145974 - DNA, 22 bp, Homo sapiens
tttatattgtatattctggaaa

SEQ ID NO: 2145975 - DNA, 13 bp, Homo sapiens
tttatatttaatt

SEQ ID NO: 2145976 - DNA, 21 bp, Homo sapiens
tttatatttaatttttacatg

SEQ ID NO: 2145977 - DNA, 14 bp, Homo sapiens
tttatatttagtta

SEQ ID NO: 2145978 - DNA, 14 bp, Homo sapiens
tttatatttctcgt

SEQ ID NO: 2145979 - DNA, 13 bp, Homo sapiens
tttatatttggaa

SEQ ID NO: 2145980 - DNA, 14 bp, Homo sapiens
tttatatttggaaa

SEQ ID NO: 2145981 - DNA, 21 bp, Homo sapiens
tttatatttggaaagagacca

SEQ ID NO: 2145982 - DNA, 14 bp, Homo sapiens
tttatattttccct

SEQ ID NO: 2145983 - DNA, 22 bp, Homo sapiens
tttatcaaacagaattttaaag

SEQ ID NO: 2145984 - DNA, 16 bp, Homo sapiens
tttatcagccatgttt

SEQ ID NO: 2145985 - DNA, 23 bp, Homo sapiens
tttatcatgacatgttatatatt

SEQ ID NO: 2145986 - DNA, 21 bp, Homo sapiens
tttatccattcaactgaaaat

SEQ ID NO: 2145987 - DNA, 14 bp, Homo sapiens
tttatccttaggaa

SEQ ID NO: 2145988 - DNA, 16 bp, Homo sapiens
tttatcgcagaccttt

SEQ ID NO: 2145989 - DNA, 14 bp, Homo sapiens
tttatctaaaagaa

SEQ ID NO: 2145990 - DNA, 20 bp, Homo sapiens
tttatctaaaagaatttaaa

SEQ ID NO: 2145991 - DNA, 21 bp, Homo sapiens
tttatctaaaagaatttaaat

SEQ ID NO: 2145992 - DNA, 13 bp, Homo sapiens
tttatctgtcaca

SEQ ID NO: 2145993 - DNA, 11 bp, Homo sapiens
tttatctgtga

SEQ ID NO: 2145994 - DNA, 21 bp, Homo sapiens
tttatgaaaaactcttctact

SEQ ID NO: 2145995 - DNA, 12 bp, Homo sapiens
tttatgaagaaa

SEQ ID NO: 2145996 - DNA, 20 bp, Homo sapiens
tttatgagtcagtctctctc

SEQ ID NO: 2145997 - DNA, 16 bp, Homo sapiens
tttatgatatccctga

SEQ ID NO: 2145998 - DNA, 15 bp, Homo sapiens
tttatgcaaggaagg

SEQ ID NO: 2145999 - DNA, 15 bp, Homo sapiens
tttatggcatgattt

SEQ ID NO: 2146000 - DNA, 23 bp, Homo sapiens
tttatggcatgatttatatatgg

SEQ ID NO: 2146001 - DNA, 19 bp, Homo sapiens
tttatggtgtgttcctaac

SEQ ID NO: 2146002 - DNA, 22 bp, Homo sapiens
tttatggtgtgttcctaacata

SEQ ID NO: 2146003 - DNA, 14 bp, Homo sapiens
tttatgtctaaaga

SEQ ID NO: 2146004 - DNA, 19 bp, Homo sapiens
tttatgtctaaagagcttt

SEQ ID NO: 2146005 - DNA, 19 bp, Homo sapiens
tttatgtctgtggattttt

SEQ ID NO: 2146006 - DNA, 13 bp, Homo sapiens
tttatgttattta

SEQ ID NO: 2146007 - DNA, 17 bp, Homo sapiens
tttatgttctcagaatc

SEQ ID NO: 2146008 - DNA, 22 bp, Homo sapiens
tttattaaaatgattgtaaaat

SEQ ID NO: 2146009 - DNA, 19 bp, Homo sapiens
tttattaaagcaacatttt

SEQ ID NO: 2146010 - DNA, 12 bp, Homo sapiens
tttattaacaaa

SEQ ID NO: 2146011 - DNA, 18 bp, Homo sapiens
tttattaacaaattatgt

SEQ ID NO: 2146012 - DNA, 18 bp, Homo sapiens
tttattaattcattaaat

SEQ ID NO: 2146013 - DNA, 13 bp, Homo sapiens
tttattactgatt

SEQ ID NO: 2146014 - DNA, 20 bp, Homo sapiens
tttattagctgtaaatacat

SEQ ID NO: 2146015 - DNA, 17 bp, Homo sapiens
tttattcagcttcattt

SEQ ID NO: 2146016 - DNA, 19 bp, Homo sapiens
tttattcagcttcatttgt

SEQ ID NO: 2146017 - DNA, 21 bp, Homo sapiens
tttattcagcttcatttgtgt

SEQ ID NO: 2146018 - DNA, 22 bp, Homo sapiens
tttattcattcagtgagacaca

SEQ ID NO: 2146019 - DNA, 15 bp, Homo sapiens
tttattctgttttct

SEQ ID NO: 2146020 - DNA, 14 bp, Homo sapiens
tttatttatcagtg

SEQ ID NO: 2146021 - DNA, 12 bp, Homo sapiens
tttatttatggc

SEQ ID NO: 2146022 - DNA, 14 bp, Homo sapiens
tttatttattcact

SEQ ID NO: 2146023 - DNA, 12 bp, Homo sapiens
tttatttcatgg

SEQ ID NO: 2146024 - DNA, 12 bp, Homo sapiens
tttatttccaaa

SEQ ID NO: 2146025 - DNA, 18 bp, Homo sapiens
tttatttccacataaagg

SEQ ID NO: 2146026 - DNA, 13 bp, Homo sapiens
tttatttcttaaa

SEQ ID NO: 2146027 - DNA, 15 bp, Homo sapiens
tttatttctttgtga

SEQ ID NO: 2146028 - DNA, 15 bp, Homo sapiens
tttatttggaataat

SEQ ID NO: 2146029 - DNA, 16 bp, Homo sapiens
tttattttgaaatttg

SEQ ID NO: 2146030 - DNA, 15 bp, Homo sapiens
ttttaaataaaagca

SEQ ID NO: 2146031 - DNA, 19 bp, Homo sapiens
ttttaaatatgaacaaaga

SEQ ID NO: 2146032 - DNA, 19 bp, Homo sapiens
ttttaaatgcataaatgca

SEQ ID NO: 2146033 - DNA, 21 bp, Homo sapiens
ttttaaattataacttaaaat

SEQ ID NO: 2146034 - DNA, 19 bp, Homo sapiens
ttttaacatttatctaaaa

SEQ ID NO: 2146035 - DNA, 16 bp, Homo sapiens
ttttaactagaattta

SEQ ID NO: 2146036 - DNA, 17 bp, Homo sapiens
ttttaacttaaatttta

SEQ ID NO: 2146037 - DNA, 12 bp, Homo sapiens
ttttaagaaaca

SEQ ID NO: 2146038 - DNA, 16 bp, Homo sapiens
ttttaagaagacatga

SEQ ID NO: 2146039 - DNA, 13 bp, Homo sapiens
ttttaagacgtga

SEQ ID NO: 2146040 - DNA, 22 bp, Homo sapiens
ttttaagacgtgaatgtctcag

SEQ ID NO: 2146041 - DNA, 15 bp, Homo sapiens
ttttaagaggcaggg

SEQ ID NO: 2146042 - DNA, 13 bp, Homo sapiens
ttttaataaaatt

SEQ ID NO: 2146043 - DNA, 15 bp, Homo sapiens
ttttaatcatttaaa

SEQ ID NO: 2146044 - DNA, 16 bp, Homo sapiens
ttttaatgaacaaatg

SEQ ID NO: 2146045 - DNA, 16 bp, Homo sapiens
ttttaatgacttttta

SEQ ID NO: 2146046 - DNA, 14 bp, Homo sapiens
ttttaatgtacaag

SEQ ID NO: 2146047 - DNA, 17 bp, Homo sapiens
ttttaattattattctt

SEQ ID NO: 2146048 - DNA, 18 bp, Homo sapiens
ttttaattccaatatgat

SEQ ID NO: 2146049 - DNA, 15 bp, Homo sapiens
ttttaattgattatt

SEQ ID NO: 2146050 - DNA, 23 bp, Homo sapiens
ttttaatttatgagtttttgata

SEQ ID NO: 2146051 - DNA, 17 bp, Homo sapiens
ttttaatttgatacaaa

SEQ ID NO: 2146052 - DNA, 19 bp, Homo sapiens
ttttacaaaaaagaaaaga

SEQ ID NO: 2146053 - DNA, 13 bp, Homo sapiens
ttttacaaaacat

SEQ ID NO: 2146054 - DNA, 12 bp, Homo sapiens
ttttacaaagcc

SEQ ID NO: 2146055 - DNA, 16 bp, Homo sapiens
ttttacaaatttaatt

SEQ ID NO: 2146056 - DNA, 12 bp, Homo sapiens
ttttacaataaa

SEQ ID NO: 2146057 - DNA, 12 bp, Homo sapiens
ttttacagagaa

SEQ ID NO: 2146058 - DNA, 16 bp, Homo sapiens
ttttacagctgcctgc

SEQ ID NO: 2146059 - DNA, 19 bp, Homo sapiens
ttttacagctttacacaca

SEQ ID NO: 2146060 - DNA, 20 bp, Homo sapiens
ttttacctaccacagtgtct

SEQ ID NO: 2146061 - DNA, 21 bp, Homo sapiens
ttttacctaccacagtgtctg

SEQ ID NO: 2146062 - DNA, 19 bp, Homo sapiens
ttttacctgggatatgaca

SEQ ID NO: 2146063 - DNA, 16 bp, Homo sapiens
ttttaccttaaatctg

SEQ ID NO: 2146064 - DNA, 14 bp, Homo sapiens
ttttactaaagcag

SEQ ID NO: 2146065 - DNA, 15 bp, Homo sapiens
ttttactaaagcagt

SEQ ID NO: 2146066 - DNA, 22 bp, Homo sapiens
ttttactaccaatgccaagata

SEQ ID NO: 2146067 - DNA, 15 bp, Homo sapiens
ttttactactgtgga

SEQ ID NO: 2146068 - DNA, 18 bp, Homo sapiens
ttttactacttgttacct

SEQ ID NO: 2146069 - DNA, 13 bp, Homo sapiens
ttttactcctttg

SEQ ID NO: 2146070 - DNA, 22 bp, Homo sapiens
ttttactcctttgcattccatg

SEQ ID NO: 2146071 - DNA, 22 bp, Homo sapiens
ttttactctatgccccaaatat

SEQ ID NO: 2146072 - DNA, 18 bp, Homo sapiens
ttttactgacagaaatgc

SEQ ID NO: 2146073 - DNA, 15 bp, Homo sapiens
ttttacttttgttct

SEQ ID NO: 2146074 - DNA, 18 bp, Homo sapiens
ttttagatgcaatgtgat

SEQ ID NO: 2146075 - DNA, 20 bp, Homo sapiens
ttttagccttaaatttttgt

SEQ ID NO: 2146076 - DNA, 16 bp, Homo sapiens
ttttagccttctctgt

SEQ ID NO: 2146077 - DNA, 23 bp, Homo sapiens
ttttagccttctctgttcatttc

SEQ ID NO: 2146078 - DNA, 19 bp, Homo sapiens
ttttagctccttgactcct

SEQ ID NO: 2146079 - DNA, 14 bp, Homo sapiens
ttttaggaaacctg

SEQ ID NO: 2146080 - DNA, 15 bp, Homo sapiens
ttttaggagacagtc

SEQ ID NO: 2146081 - DNA, 19 bp, Homo sapiens
ttttaggcagggatttgag

SEQ ID NO: 2146082 - DNA, 17 bp, Homo sapiens
ttttagggagctggtct

SEQ ID NO: 2146083 - DNA, 15 bp, Homo sapiens
ttttagtcttttact

SEQ ID NO: 2146084 - DNA, 17 bp, Homo sapiens
ttttataatgtggattt

SEQ ID NO: 2146085 - DNA, 18 bp, Homo sapiens
ttttatacacaacattta

SEQ ID NO: 2146086 - DNA, 12 bp, Homo sapiens
ttttatacatag

SEQ ID NO: 2146087 - DNA, 16 bp, Homo sapiens
ttttatacatatcaga

SEQ ID NO: 2146088 - DNA, 21 bp, Homo sapiens
ttttatacatatcagaaaagt

SEQ ID NO: 2146089 - DNA, 17 bp, Homo sapiens
ttttatactccatacat

SEQ ID NO: 2146090 - DNA, 20 bp, Homo sapiens
ttttatactccatacataac

SEQ ID NO: 2146091 - DNA, 15 bp, Homo sapiens
ttttatactgtactt

SEQ ID NO: 2146092 - DNA, 17 bp, Homo sapiens
ttttatcatgacatgtt

SEQ ID NO: 2146093 - DNA, 23 bp, Homo sapiens
ttttatctgaatttttaaacaag

SEQ ID NO: 2146094 - DNA, 19 bp, Homo sapiens
ttttatgccttttatttct

SEQ ID NO: 2146095 - DNA, 17 bp, Homo sapiens
ttttatggcatgattta

SEQ ID NO: 2146096 - DNA, 22 bp, Homo sapiens
ttttatggcatgatttatatat

SEQ ID NO: 2146097 - DNA, 14 bp, Homo sapiens
ttttattaaagcaa

SEQ ID NO: 2146098 - DNA, 16 bp, Homo sapiens
ttttattaaagcaaca

SEQ ID NO: 2146099 - DNA, 14 bp, Homo sapiens
ttttattcaagtta

SEQ ID NO: 2146100 - DNA, 14 bp, Homo sapiens
ttttattctgactt

SEQ ID NO: 2146101 - DNA, 19 bp, Homo sapiens
ttttattgagaattttaaa

SEQ ID NO: 2146102 - DNA, 13 bp, Homo sapiens
ttttatttagttc

SEQ ID NO: 2146103 - DNA, 15 bp, Homo sapiens
ttttatttgacaaaa

SEQ ID NO: 2146104 - DNA, 16 bp, Homo sapiens
ttttcaaccagcattt

SEQ ID NO: 2146105 - DNA, 22 bp, Homo sapiens
ttttcaacgcagccctgctttg

SEQ ID NO: 2146106 - DNA, 15 bp, Homo sapiens
ttttcaataatgtga

SEQ ID NO: 2146107 - DNA, 23 bp, Homo sapiens
ttttcacaggtgtggtgtaattt

SEQ ID NO: 2146108 - DNA, 16 bp, Homo sapiens
ttttcactgtagaatg

SEQ ID NO: 2146109 - DNA, 14 bp, Homo sapiens
ttttcagactcaga

SEQ ID NO: 2146110 - DNA, 23 bp, Homo sapiens
ttttcagtagggctacaaaacct

SEQ ID NO: 2146111 - DNA, 18 bp, Homo sapiens
ttttcatggtgaaaatgt

SEQ ID NO: 2146112 - DNA, 21 bp, Homo sapiens
ttttcattcaggtatttgtaa

SEQ ID NO: 2146113 - DNA, 22 bp, Homo sapiens
ttttcattttaatttatatttg

SEQ ID NO: 2146114 - DNA, 19 bp, Homo sapiens
ttttccaggatcctgcagg

SEQ ID NO: 2146115 - DNA, 20 bp, Homo sapiens
ttttccagggcaatcaatgt

SEQ ID NO: 2146116 - DNA, 18 bp, Homo sapiens
ttttccatgaaaatgcaa

SEQ ID NO: 2146117 - DNA, 18 bp, Homo sapiens
ttttcccaaaatgttgaa

SEQ ID NO: 2146118 - DNA, 14 bp, Homo sapiens
ttttccctctggca

SEQ ID NO: 2146119 - DNA, 18 bp, Homo sapiens
ttttcctattttcagccc

SEQ ID NO: 2146120 - DNA, 24 bp, Homo sapiens
ttttcctcccagttctacaagcat

SEQ ID NO: 2146121 - DNA, 13 bp, Homo sapiens
ttttctaactgta

SEQ ID NO: 2146122 - DNA, 12 bp, Homo sapiens
ttttctagaaga

SEQ ID NO: 2146123 - DNA, 13 bp, Homo sapiens
ttttctagacttt

SEQ ID NO: 2146124 - DNA, 15 bp, Homo sapiens
ttttctagtttcagt

SEQ ID NO: 2146125 - DNA, 14 bp, Homo sapiens
ttttctatgcttat

SEQ ID NO: 2146126 - DNA, 12 bp, Homo sapiens
ttttctgctgtt

SEQ ID NO: 2146127 - DNA, 13 bp, Homo sapiens
ttttctgctgttt

SEQ ID NO: 2146128 - DNA, 17 bp, Homo sapiens
ttttctggaatacatga

SEQ ID NO: 2146129 - DNA, 21 bp, Homo sapiens
ttttctgttgtacgtaaagct

SEQ ID NO: 2146130 - DNA, 15 bp, Homo sapiens
ttttcttcccatttg

SEQ ID NO: 2146131 - DNA, 12 bp, Homo sapiens
ttttcttgcagt

SEQ ID NO: 2146132 - DNA, 17 bp, Homo sapiens
ttttctttctttttctg

SEQ ID NO: 2146133 - DNA, 14 bp, Homo sapiens
ttttgaaaagctaa

SEQ ID NO: 2146134 - DNA, 15 bp, Homo sapiens
ttttgaaagaaaaat

SEQ ID NO: 2146135 - DNA, 21 bp, Homo sapiens
ttttgaactaataaaagcata

SEQ ID NO: 2146136 - DNA, 16 bp, Homo sapiens
ttttgaagaagggaaa

SEQ ID NO: 2146137 - DNA, 20 bp, Homo sapiens
ttttgaagaagggaaattca

SEQ ID NO: 2146138 - DNA, 14 bp, Homo sapiens
ttttgaatgttatt

SEQ ID NO: 2146139 - DNA, 24 bp, Homo sapiens
ttttgacagtgttgaaaatgttca

SEQ ID NO: 2146140 - DNA, 20 bp, Homo sapiens
ttttgacggatgattggatt

SEQ ID NO: 2146141 - DNA, 14 bp, Homo sapiens
ttttgagtctcagg

SEQ ID NO: 2146142 - DNA, 12 bp, Homo sapiens
ttttgattgaag

SEQ ID NO: 2146143 - DNA, 12 bp, Homo sapiens
ttttgcatgaaa

SEQ ID NO: 2146144 - DNA, 16 bp, Homo sapiens
ttttgcattattcata

SEQ ID NO: 2146145 - DNA, 12 bp, Homo sapiens
gccttgcccaga

SEQ ID NO: 2146146 - DNA, 15 bp, Homo sapiens
gccttgcccagagat

SEQ ID NO: 2146147 - DNA, 20 bp, Homo sapiens
gccttgcccagagatgcctc

SEQ ID NO: 2146148 - DNA, 22 bp, Homo sapiens
gccttgcccggattctgggagg

SEQ ID NO: 2146149 - DNA, 14 bp, Homo sapiens
gccttgctggacgg

SEQ ID NO: 2146150 - DNA, 17 bp, Homo sapiens
gccttgctttgggcttt

SEQ ID NO: 2146151 - DNA, 22 bp, Homo sapiens
gccttggagcagaaagccaggg

SEQ ID NO: 2146152 - DNA, 17 bp, Homo sapiens
gccttggtgtccacctg

SEQ ID NO: 2146153 - DNA, 19 bp, Homo sapiens
gccttggtgtccacctggc

SEQ ID NO: 2146154 - DNA, 21 bp, Homo sapiens
gccttggtgtccacctggccc

SEQ ID NO: 2146155 - DNA, 18 bp, Homo sapiens
gccttggttcccttgtgt

SEQ ID NO: 2146156 - DNA, 12 bp, Homo sapiens
gccttgttctgt

SEQ ID NO: 2146157 - DNA, 21 bp, Homo sapiens
gcctttccataaggaatgtag

SEQ ID NO: 2146158 - DNA, 14 bp, Homo sapiens
gcctttccccagtg

SEQ ID NO: 2146159 - DNA, 15 bp, Homo sapiens
gcctttccccagtgt

SEQ ID NO: 2146160 - DNA, 15 bp, Homo sapiens
gcctttcctgtgcca

SEQ ID NO: 2146161 - DNA, 17 bp, Homo sapiens
gcctttctctggctcca

SEQ ID NO: 2146162 - DNA, 19 bp, Homo sapiens
gcctttctctggctccaga

SEQ ID NO: 2146163 - DNA, 12 bp, Homo sapiens
gcctttctgtgg

SEQ ID NO: 2146164 - DNA, 19 bp, Homo sapiens
gcctttcttatttgcaata

SEQ ID NO: 2146165 - DNA, 22 bp, Homo sapiens
gcctttcttatttgcaataaaa

SEQ ID NO: 2146166 - DNA, 19 bp, Homo sapiens
gcctttgaaattcccccac

SEQ ID NO: 2146167 - DNA, 20 bp, Homo sapiens
gccttttacccctgcacagt

SEQ ID NO: 2146168 - DNA, 22 bp, Homo sapiens
gcctttttcataaactgagcct

SEQ ID NO: 2146169 - DNA, 23 bp, Homo sapiens
gcctttttcataaactgagcctc

SEQ ID NO: 2146170 - DNA, 22 bp, Homo sapiens
gcgaaaaaatcaggtggctttt

SEQ ID NO: 2146171 - DNA, 14 bp, Homo sapiens
gcgaaggggccctg

SEQ ID NO: 2146172 - DNA, 16 bp, Homo sapiens
gcgaaggggccctggt

SEQ ID NO: 2146173 - DNA, 16 bp, Homo sapiens
gcgaataaatgttcaa

SEQ ID NO: 2146174 - DNA, 17 bp, Homo sapiens
gcgaataaatgttcaaa

SEQ ID NO: 2146175 - DNA, 18 bp, Homo sapiens
gcgacaggagtatttttt

SEQ ID NO: 2146176 - DNA, 11 bp, Homo sapiens
gcgacccctca

SEQ ID NO: 2146177 - DNA, 21 bp, Homo sapiens
gctccacctgttcaggagctg

SEQ ID NO: 2146178 - DNA, 21 bp, Homo sapiens
gctccacggtgcgtggctgtg

SEQ ID NO: 2146179 - DNA, 12 bp, Homo sapiens
gctccactgtca

SEQ ID NO: 2146180 - DNA, 21 bp, Homo sapiens
gctccagagagaggatgcaga

SEQ ID NO: 2146181 - DNA, 17 bp, Homo sapiens
gctccagatctgcactg

SEQ ID NO: 2146182 - DNA, 14 bp, Homo sapiens
gctccagcatccag

SEQ ID NO: 2146183 - DNA, 13 bp, Homo sapiens
gctccagctcacc

SEQ ID NO: 2146184 - DNA, 16 bp, Homo sapiens
gctccaggctccttta

SEQ ID NO: 2146185 - DNA, 24 bp, Homo sapiens
gctccaggctcctttagcgcccag

SEQ ID NO: 2146186 - DNA, 18 bp, Homo sapiens
gctccagggtcttgggct

SEQ ID NO: 2146187 - DNA, 19 bp, Homo sapiens
gctccagggtcttgggcta

SEQ ID NO: 2146188 - DNA, 20 bp, Homo sapiens
gctccagggtcttgggctac

SEQ ID NO: 2146189 - DNA, 14 bp, Homo sapiens
gctccaggtccgga

SEQ ID NO: 2146190 - DNA, 13 bp, Homo sapiens
gctccatggagga

SEQ ID NO: 2146191 - DNA, 15 bp, Homo sapiens
gctcccacaggccct

SEQ ID NO: 2146192 - DNA, 21 bp, Homo sapiens
gctcccacaggcccttcctct

SEQ ID NO: 2146193 - DNA, 16 bp, Homo sapiens
gctcccagatgctggg

SEQ ID NO: 2146194 - DNA, 11 bp, Homo sapiens
gctcccagggc

SEQ ID NO: 2146195 - DNA, 16 bp, Homo sapiens
gctcccatctcctgat

SEQ ID NO: 2146196 - DNA, 22 bp, Homo sapiens
gctccccacacgtgctcgcagc

SEQ ID NO: 2146197 - DNA, 12 bp, Homo sapiens
gctccccacgag

SEQ ID NO: 2146198 - DNA, 23 bp, Homo sapiens
gctccccacgagtcacctgcaag

SEQ ID NO: 2146199 - DNA, 16 bp, Homo sapiens
gctccccactctgctc

SEQ ID NO: 2146200 - DNA, 18 bp, Homo sapiens
gctccccagccctggctc

SEQ ID NO: 2146201 - DNA, 20 bp, Homo sapiens
gctccccagccctggctctg

SEQ ID NO: 2146202 - DNA, 13 bp, Homo sapiens
gctccccaggact

SEQ ID NO: 2146203 - DNA, 14 bp, Homo sapiens
gctccccaggactc

SEQ ID NO: 2146204 - DNA, 14 bp, Homo sapiens
gctcccccaccccc

SEQ ID NO: 2146205 - DNA, 21 bp, Homo sapiens
gctccccccagccccctaaga

SEQ ID NO: 2146206 - DNA, 19 bp, Homo sapiens
gctcccccgcagtccccag

SEQ ID NO: 2146207 - DNA, 19 bp, Homo sapiens
gctccccctgcctttgaaa

SEQ ID NO: 2146208 - DNA, 23 bp, Homo sapiens
gctccccgggggcagacacctgt

SEQ ID NO: 2146209 - DNA, 19 bp, Homo sapiens
gctccctgtagctctgcct

SEQ ID NO: 2146210 - DNA, 18 bp, Homo sapiens
gctcccttccacctgtca

SEQ ID NO: 2146211 - DNA, 13 bp, Homo sapiens
gctcccttcctga

SEQ ID NO: 2146212 - DNA, 21 bp, Homo sapiens
gctcccttctacagcctcaga

SEQ ID NO: 2146213 - DNA, 18 bp, Homo sapiens
gctccgctttctacccag

SEQ ID NO: 2146214 - DNA, 21 bp, Homo sapiens
gctccgctttctacccagcga

SEQ ID NO: 2146215 - DNA, 14 bp, Homo sapiens
gctccgtcatctgc

SEQ ID NO: 2146216 - DNA, 15 bp, Homo sapiens
gctccgtcatctgcg

SEQ ID NO: 2146217 - DNA, 17 bp, Homo sapiens
gctccgtcatctgcggg

SEQ ID NO: 2146218 - DNA, 21 bp, Homo sapiens
ggaatgaccacgggcctcagt

SEQ ID NO: 2146219 - DNA, 19 bp, Homo sapiens
ggaatgactataaacatta

SEQ ID NO: 2146220 - DNA, 18 bp, Homo sapiens
ggaatgcagggaagaggg

SEQ ID NO: 2146221 - DNA, 22 bp, Homo sapiens
ggaatgcggccgcattccctga

SEQ ID NO: 2146222 - DNA, 23 bp, Homo sapiens
ggaatgcggccgcattccctgag

SEQ ID NO: 2146223 - DNA, 21 bp, Homo sapiens
ggaatggaaggctttgccatg

SEQ ID NO: 2146224 - DNA, 19 bp, Homo sapiens
ggaatgttccctgcaccct

SEQ ID NO: 2146225 - DNA, 16 bp, Homo sapiens
ggaattcagcaccctg

SEQ ID NO: 2146226 - DNA, 21 bp, Homo sapiens
ggaattctttacaataaacat

SEQ ID NO: 2146227 - DNA, 11 bp, Homo sapiens
ggacaaaatgg

SEQ ID NO: 2146228 - DNA, 14 bp, Homo sapiens
ggacaaaggagcct

SEQ ID NO: 2146229 - DNA, 18 bp, Homo sapiens
ggacaaaggagcctgtga

SEQ ID NO: 2146230 - DNA, 14 bp, Homo sapiens
ggacaacccagaac

SEQ ID NO: 2146231 - DNA, 13 bp, Homo sapiens
ggacaagaagctg

SEQ ID NO: 2146232 - DNA, 14 bp, Homo sapiens
ggacaagaagctgc

SEQ ID NO: 2146233 - DNA, 16 bp, Homo sapiens
ggacaagaagctgcta

SEQ ID NO: 2146234 - DNA, 13 bp, Homo sapiens
ggacaagcatggt

SEQ ID NO: 2146235 - DNA, 15 bp, Homo sapiens
ggacaaggaagtggg

SEQ ID NO: 2146236 - DNA, 23 bp, Homo sapiens
ggacaatataaactgaaaaatgt

SEQ ID NO: 2146237 - DNA, 23 bp, Homo sapiens
ggacacactgtaaacccctgggt

SEQ ID NO: 2146238 - DNA, 12 bp, Homo sapiens
ggacacaggcct

SEQ ID NO: 2146239 - DNA, 14 bp, Homo sapiens
ggacacaggcctgt

SEQ ID NO: 2146240 - DNA, 16 bp, Homo sapiens
ggacacaggcctgtgt

SEQ ID NO: 2146241 - DNA, 23 bp, Homo sapiens
ggacacaggcctgtgtagctgtg

SEQ ID NO: 2146242 - DNA, 20 bp, Homo sapiens
ggacacagtttctattgtaa

SEQ ID NO: 2146243 - DNA, 19 bp, Homo sapiens
ggacacatcccggcctctt

SEQ ID NO: 2146244 - DNA, 21 bp, Homo sapiens
ggacacatcccggcctcttcc

SEQ ID NO: 2146245 - DNA, 23 bp, Homo sapiens
ggacacatcccggcctcttccac

SEQ ID NO: 2146246 - DNA, 13 bp, Homo sapiens
ggacacatgtcca

SEQ ID NO: 2146247 - DNA, 21 bp, Homo sapiens
ggacacattttctcctaggag

SEQ ID NO: 2146248 - DNA, 23 bp, Homo sapiens
ggacacattttctcctaggagaa

SEQ ID NO: 2146249 - DNA, 13 bp, Homo sapiens
ggacaccaggagt

SEQ ID NO: 2146250 - DNA, 20 bp, Homo sapiens
ggacaccccttatccaggac

SEQ ID NO: 2146251 - DNA, 10 bp, Homo sapiens
ggacacctgc

SEQ ID NO: 2146252 - DNA, 11 bp, Homo sapiens
ggacacctgcc

SEQ ID NO: 2146253 - DNA, 14 bp, Homo sapiens
ggacacctgcccca

SEQ ID NO: 2146254 - DNA, 16 bp, Homo sapiens
ggacacctgccccagc

SEQ ID NO: 2146255 - DNA, 14 bp, Homo sapiens
ggacacctgccctg

SEQ ID NO: 2146256 - DNA, 23 bp, Homo sapiens
ggacacctggccgcctccaggag

SEQ ID NO: 2146257 - DNA, 22 bp, Homo sapiens
ggacactaaccacgctggacct

SEQ ID NO: 2146258 - DNA, 17 bp, Homo sapiens
ggacactagggtcaggc

SEQ ID NO: 2146259 - DNA, 19 bp, Homo sapiens
ggacagagacacctgcacc

SEQ ID NO: 2146260 - DNA, 16 bp, Homo sapiens
ggacagaggggcaggg

SEQ ID NO: 2146261 - DNA, 13 bp, Homo sapiens
ggacagccccagg

SEQ ID NO: 2146262 - DNA, 14 bp, Homo sapiens
ggacagccccaggg

SEQ ID NO: 2146263 - DNA, 22 bp, Homo sapiens
ggacagcctgtggcggtgcctg

SEQ ID NO: 2146264 - DNA, 16 bp, Homo sapiens
ggacagctccttctgt

SEQ ID NO: 2146265 - DNA, 20 bp, Homo sapiens
ggacagctccttctgtccta

SEQ ID NO: 2146266 - DNA, 14 bp, Homo sapiens
ggacagctgcttgt

SEQ ID NO: 2146267 - DNA, 16 bp, Homo sapiens
ggacagctggctgctg

SEQ ID NO: 2146268 - DNA, 22 bp, Homo sapiens
ggacagctggctgctgacagga

SEQ ID NO: 2146269 - DNA, 23 bp, Homo sapiens
ggacagctggctgctgacaggat

SEQ ID NO: 2146270 - DNA, 19 bp, Homo sapiens
ggacaggactaacactcag

SEQ ID NO: 2146271 - DNA, 18 bp, Homo sapiens
ggacaggaggggcccaca

SEQ ID NO: 2146272 - DNA, 22 bp, Homo sapiens
ggacaggcccggcgcggtggct

SEQ ID NO: 2146273 - DNA, 15 bp, Homo sapiens
ggacagggcttgggg

SEQ ID NO: 2146274 - DNA, 20 bp, Homo sapiens
ggacaggtcctcagtgtcct

SEQ ID NO: 2146275 - DNA, 14 bp, Homo sapiens
ggacagtcctggga

SEQ ID NO: 2146276 - DNA, 15 bp, Homo sapiens
ggacagtcctgggag

SEQ ID NO: 2146277 - DNA, 16 bp, Homo sapiens
ggacagtcctgggaga

SEQ ID NO: 2146278 - DNA, 23 bp, Homo sapiens
ggacagttggcagagaaggcctc

SEQ ID NO: 2146279 - DNA, 15 bp, Homo sapiens
ggacatgcagctctg

SEQ ID NO: 2146280 - DNA, 16 bp, Homo sapiens
ggacatgcagctctga

SEQ ID NO: 2146281 - DNA, 13 bp, Homo sapiens
ggcagcagctcag

SEQ ID NO: 2146282 - DNA, 19 bp, Homo sapiens
ggcagcagttccatgaaga

SEQ ID NO: 2146283 - DNA, 18 bp, Homo sapiens
ggcagccaaacccatgag

SEQ ID NO: 2146284 - DNA, 13 bp, Homo sapiens
ggcagccaggggc

SEQ ID NO: 2146285 - DNA, 15 bp, Homo sapiens
ggcagccaggggctg

SEQ ID NO: 2146286 - DNA, 12 bp, Homo sapiens
ggcagccatgcc

SEQ ID NO: 2146287 - DNA, 13 bp, Homo sapiens
ggcagccatgcct

SEQ ID NO: 2146288 - DNA, 21 bp, Homo sapiens
ggcagccatgcctcatgccac

SEQ ID NO: 2146289 - DNA, 13 bp, Homo sapiens
ggcagcccagcct

SEQ ID NO: 2146290 - DNA, 18 bp, Homo sapiens
ggcagcccagcctctgtc

SEQ ID NO: 2146291 - DNA, 19 bp, Homo sapiens
ggcagcccagcctctgtcc

SEQ ID NO: 2146292 - DNA, 15 bp, Homo sapiens
ggcagccctgtaggg

SEQ ID NO: 2146293 - DNA, 21 bp, Homo sapiens
ggcagccgctaggagagactg

SEQ ID NO: 2146294 - DNA, 19 bp, Homo sapiens
ggcagccgtgccttcagct

SEQ ID NO: 2146295 - DNA, 14 bp, Homo sapiens
ggcagcctccagag

SEQ ID NO: 2146296 - DNA, 16 bp, Homo sapiens
ggcagcctccagagcc

SEQ ID NO: 2146297 - DNA, 23 bp, Homo sapiens
ggcagcctccagagccagcctgg

SEQ ID NO: 2146298 - DNA, 15 bp, Homo sapiens
ggcagctccaacagc

SEQ ID NO: 2146299 - DNA, 22 bp, Homo sapiens
ggcagctgagagccctgctgtg

SEQ ID NO: 2146300 - DNA, 12 bp, Homo sapiens
ggcagctgctct

SEQ ID NO: 2146301 - DNA, 16 bp, Homo sapiens
ggcagctggatgagac

SEQ ID NO: 2146302 - DNA, 12 bp, Homo sapiens
ggcagctgggcc

SEQ ID NO: 2146303 - DNA, 19 bp, Homo sapiens
ggcagctgggccccaccta

SEQ ID NO: 2146304 - DNA, 21 bp, Homo sapiens
ggcagcttaacattgacttct

SEQ ID NO: 2146305 - DNA, 22 bp, Homo sapiens
ggcaggaactgcagtatggcca

SEQ ID NO: 2146306 - DNA, 23 bp, Homo sapiens
ggcaggaactgcagtatggccat

SEQ ID NO: 2146307 - DNA, 14 bp, Homo sapiens
ggcaggaagagaga

SEQ ID NO: 2146308 - DNA, 22 bp, Homo sapiens
ggcaggagcaggaacagagact

SEQ ID NO: 2146309 - DNA, 23 bp, Homo sapiens
ggcaggagcaggaacagagactc

SEQ ID NO: 2146310 - DNA, 13 bp, Homo sapiens
ggcaggaggcctg

SEQ ID NO: 2146311 - DNA, 15 bp, Homo sapiens
ggcaggaggcctggc

SEQ ID NO: 2146312 - DNA, 15 bp, Homo sapiens
ggcaggagtggcagc

SEQ ID NO: 2146313 - DNA, 19 bp, Homo sapiens
ggcaggcagggctctcctg

SEQ ID NO: 2146314 - DNA, 16 bp, Homo sapiens
ggcaggcctaggacct

SEQ ID NO: 2146315 - DNA, 12 bp, Homo sapiens
ggcaggcctggg

SEQ ID NO: 2146316 - DNA, 19 bp, Homo sapiens
ggcaggcctgggacccagc

SEQ ID NO: 2146317 - DNA, 16 bp, Homo sapiens
ggcaggctaccccttc

SEQ ID NO: 2146318 - DNA, 13 bp, Homo sapiens
ggcaggctgggtt

SEQ ID NO: 2146319 - DNA, 12 bp, Homo sapiens
ggcagggctctc

SEQ ID NO: 2146320 - DNA, 10 bp, Homo sapiens
ggcagggctg

SEQ ID NO: 2146321 - DNA, 12 bp, Homo sapiens
ggcaggggcgga

SEQ ID NO: 2146322 - DNA, 15 bp, Homo sapiens
ggcaggggtgggaga

SEQ ID NO: 2146323 - DNA, 16 bp, Homo sapiens
ggcaggggtgggagag

SEQ ID NO: 2146324 - DNA, 18 bp, Homo sapiens
ggcagggtctcactctgt

SEQ ID NO: 2146325 - DNA, 20 bp, Homo sapiens
ggcagggtctcactctgtcg

SEQ ID NO: 2146326 - DNA, 13 bp, Homo sapiens
ggcaggtgcagat

SEQ ID NO: 2146327 - DNA, 16 bp, Homo sapiens
ggcaggttagaaccta

SEQ ID NO: 2146328 - DNA, 14 bp, Homo sapiens
ggcagtacctggga

SEQ ID NO: 2146329 - DNA, 15 bp, Homo sapiens
ggcagtccagccagc

SEQ ID NO: 2146330 - DNA, 16 bp, Homo sapiens
ggcagtccagccagct

SEQ ID NO: 2146331 - DNA, 20 bp, Homo sapiens
ggcagtccagccagctcctg

SEQ ID NO: 2146332 - DNA, 15 bp, Homo sapiens
ggcagtctgaaccct

SEQ ID NO: 2146333 - DNA, 21 bp, Homo sapiens
ggcagtctgaacccttgtgct

SEQ ID NO: 2146334 - DNA, 14 bp, Homo sapiens
ggcagtgcctcctg

SEQ ID NO: 2146335 - DNA, 19 bp, Homo sapiens
ggcagtgggagctgcctgt

SEQ ID NO: 2146336 - DNA, 15 bp, Homo sapiens
ggcagttcgcagcca

SEQ ID NO: 2146337 - DNA, 21 bp, Homo sapiens
ggcatacgcctgtagtcctag

SEQ ID NO: 2146338 - DNA, 18 bp, Homo sapiens
ggcatagaaactgaggag

SEQ ID NO: 2146339 - DNA, 21 bp, Homo sapiens
ggcatagaaactgaggagtag

SEQ ID NO: 2146340 - DNA, 12 bp, Homo sapiens
ggcatcaggcac

SEQ ID NO: 2146341 - DNA, 14 bp, Homo sapiens
ggcatcaggcactg

SEQ ID NO: 2146342 - DNA, 16 bp, Homo sapiens
ggcatcaggcactggt

SEQ ID NO: 2146343 - DNA, 15 bp, Homo sapiens
ggcatccacccagtg

SEQ ID NO: 2146344 - DNA, 16 bp, Homo sapiens
ggcatccacccagtgc

SEQ ID NO: 2146345 - DNA, 17 bp, Homo sapiens
ggcatccacccagtgct

SEQ ID NO: 2146346 - DNA, 21 bp, Homo sapiens
ggcatccacccagtgctgcca

SEQ ID NO: 2146347 - DNA, 14 bp, Homo sapiens
ggcatcccatccct

SEQ ID NO: 2146348 - DNA, 16 bp, Homo sapiens
ggcatccgcagcccag

SEQ ID NO: 2146349 - DNA, 16 bp, Homo sapiens
ggcatctacacagcct

SEQ ID NO: 2146350 - DNA, 15 bp, Homo sapiens
ggcatctgcaccctc

SEQ ID NO: 2146351 - DNA, 22 bp, Homo sapiens
ggcatctgcaccctcgatgaag

SEQ ID NO: 2146352 - DNA, 17 bp, Homo sapiens
ggcatgaccatcctgtc

SEQ ID NO: 2146353 - DNA, 14 bp, Homo sapiens
ggcatgagggatca

SEQ ID NO: 2146354 - DNA, 12 bp, Homo sapiens
ggcatgatttat

SEQ ID NO: 2146355 - DNA, 17 bp, Homo sapiens
ggcatgatttatatatg

SEQ ID NO: 2146356 - DNA, 12 bp, Homo sapiens
ggcatgctgggg

SEQ ID NO: 2146357 - DNA, 14 bp, Homo sapiens
ggcatgctggggca

SEQ ID NO: 2146358 - DNA, 14 bp, Homo sapiens
ggcatgcttaaata

SEQ ID NO: 2146359 - DNA, 16 bp, Homo sapiens
ggcatggccctggggt

SEQ ID NO: 2146360 - DNA, 13 bp, Homo sapiens
ggcatggctccct

SEQ ID NO: 2146361 - DNA, 19 bp, Homo sapiens
ggcatggtacggagatgtt

SEQ ID NO: 2146362 - DNA, 20 bp, Homo sapiens
ggcatgtattatcacatcaa

SEQ ID NO: 2146363 - DNA, 14 bp, Homo sapiens
ggcatgtggagaca

SEQ ID NO: 2146364 - DNA, 19 bp, Homo sapiens
ggcatgtgtgcctgtggca

SEQ ID NO: 2146365 - DNA, 23 bp, Homo sapiens
ggccctggatcagcgtggccttg

SEQ ID NO: 2146366 - DNA, 18 bp, Homo sapiens
ggccctggatgtgcccac

SEQ ID NO: 2146367 - DNA, 21 bp, Homo sapiens
ggccctggatgtgcccacagg

SEQ ID NO: 2146368 - DNA, 22 bp, Homo sapiens
ggccctggcctgctgggctctc

SEQ ID NO: 2146369 - DNA, 15 bp, Homo sapiens
ggccctgggcctcag

SEQ ID NO: 2146370 - DNA, 15 bp, Homo sapiens
ggccctggggcctgt

SEQ ID NO: 2146371 - DNA, 17 bp, Homo sapiens
ggccctggggcctgtac

SEQ ID NO: 2146372 - DNA, 23 bp, Homo sapiens
ggccctggggcctgtactgcctg

SEQ ID NO: 2146373 - DNA, 12 bp, Homo sapiens
ggccctggtcct

SEQ ID NO: 2146374 - DNA, 15 bp, Homo sapiens
ggccctggtccttcc

SEQ ID NO: 2146375 - DNA, 13 bp, Homo sapiens
ggccctgtcccag

SEQ ID NO: 2146376 - DNA, 17 bp, Homo sapiens
ggccctgtcccagcaga

SEQ ID NO: 2146377 - DNA, 17 bp, Homo sapiens
ggcccttcctctccact

SEQ ID NO: 2146378 - DNA, 22 bp, Homo sapiens
ggcccttcctctccactgcctt

SEQ ID NO: 2146379 - DNA, 13 bp, Homo sapiens
ggcccttcctgga

SEQ ID NO: 2146380 - DNA, 15 bp, Homo sapiens
ggcccttcctggaca

SEQ ID NO: 2146381 - DNA, 19 bp, Homo sapiens
ggcccttcctggacagctg

SEQ ID NO: 2146382 - DNA, 17 bp, Homo sapiens
ggcccttgtcctgccag

SEQ ID NO: 2146383 - DNA, 20 bp, Homo sapiens
ggcccttgtcctgccagctg

SEQ ID NO: 2146384 - DNA, 22 bp, Homo sapiens
ggcccttgtcctgccagctgcc

SEQ ID NO: 2146385 - DNA, 16 bp, Homo sapiens
ggccgaaggcagtgca

SEQ ID NO: 2146386 - DNA, 20 bp, Homo sapiens
ggccgcaagcgcagggagga

SEQ ID NO: 2146387 - DNA, 17 bp, Homo sapiens
ggccgcattccctgagt

SEQ ID NO: 2146388 - DNA, 13 bp, Homo sapiens
ggccgcctccagg

SEQ ID NO: 2146389 - DNA, 15 bp, Homo sapiens
ggccgcctgccatac

SEQ ID NO: 2146390 - DNA, 13 bp, Homo sapiens
ggccgctggccca

SEQ ID NO: 2146391 - DNA, 15 bp, Homo sapiens
ggccggccagccttg

SEQ ID NO: 2146392 - DNA, 16 bp, Homo sapiens
ggccggccagccttgc

SEQ ID NO: 2146393 - DNA, 16 bp, Homo sapiens
ggccgtgggggttgag

SEQ ID NO: 2146394 - DNA, 17 bp, Homo sapiens
ggccgtggtccagctct

SEQ ID NO: 2146395 - DNA, 13 bp, Homo sapiens
ggccgtgtctctg

SEQ ID NO: 2146396 - DNA, 17 bp, Homo sapiens
ggccgttccccttggct

SEQ ID NO: 2146397 - DNA, 19 bp, Homo sapiens
ggcctagcaggcacaggac

SEQ ID NO: 2146398 - DNA, 15 bp, Homo sapiens
ggcctaggacctcag

SEQ ID NO: 2146399 - DNA, 14 bp, Homo sapiens
ggcctatctgagac

SEQ ID NO: 2146400 - DNA, 18 bp, Homo sapiens
ggcctatgacttgggcac

SEQ ID NO: 2146401 - DNA, 15 bp, Homo sapiens
ggcctatggagagcc

SEQ ID NO: 2146402 - DNA, 21 bp, Homo sapiens
ggcctatggagagccctggga

SEQ ID NO: 2146403 - DNA, 19 bp, Homo sapiens
ggcctcacacccagagggt

SEQ ID NO: 2146404 - DNA, 14 bp, Homo sapiens
ggcctcactggctg

SEQ ID NO: 2146405 - DNA, 12 bp, Homo sapiens
ggcctcacttcc

SEQ ID NO: 2146406 - DNA, 12 bp, Homo sapiens
ggcctcagacca

SEQ ID NO: 2146407 - DNA, 13 bp, Homo sapiens
ggcctcagccctc

SEQ ID NO: 2146408 - DNA, 15 bp, Homo sapiens
ggcctcagccctcag

SEQ ID NO: 2146409 - DNA, 14 bp, Homo sapiens
ggcctcatccctcg

SEQ ID NO: 2146410 - DNA, 21 bp, Homo sapiens
ggcctccactcccccacctga

SEQ ID NO: 2146411 - DNA, 23 bp, Homo sapiens
ggcctccactcccccacctgaca

SEQ ID NO: 2146412 - DNA, 13 bp, Homo sapiens
ggcctccagcctc

SEQ ID NO: 2146413 - DNA, 18 bp, Homo sapiens
ggcctcccaataaagctg

SEQ ID NO: 2146414 - DNA, 18 bp, Homo sapiens
ggcctccccccagcccct

SEQ ID NO: 2146415 - DNA, 21 bp, Homo sapiens
ggcctccgtccaggagcctgg

SEQ ID NO: 2146416 - DNA, 20 bp, Homo sapiens
ggcctcctctctgccaccac

SEQ ID NO: 2146417 - DNA, 20 bp, Homo sapiens
ggcctcgcctgggcccaggc

SEQ ID NO: 2146418 - DNA, 23 bp, Homo sapiens
ggcctcgcctgggcccaggctct

SEQ ID NO: 2146419 - DNA, 19 bp, Homo sapiens
ggcctcggagcctcatccg

SEQ ID NO: 2146420 - DNA, 22 bp, Homo sapiens
ggcctcgggacacctgccctgc

SEQ ID NO: 2146421 - DNA, 23 bp, Homo sapiens
ggcctcgggacacctgccctgcc

SEQ ID NO: 2146422 - DNA, 18 bp, Homo sapiens
ggcctcgtaccagccagg

SEQ ID NO: 2146423 - DNA, 23 bp, Homo sapiens
ggcctctagaacacccactggcc

SEQ ID NO: 2146424 - DNA, 21 bp, Homo sapiens
ggcctctggaaagcaaagggc

SEQ ID NO: 2146425 - DNA, 15 bp, Homo sapiens
ggcctcttccaccca

SEQ ID NO: 2146426 - DNA, 13 bp, Homo sapiens
ggcctcttccctc

SEQ ID NO: 2146427 - DNA, 15 bp, Homo sapiens
ggcctcttccctcag

SEQ ID NO: 2146428 - DNA, 22 bp, Homo sapiens
ggcctgacaggttcccagcagc

SEQ ID NO: 2146429 - DNA, 23 bp, Homo sapiens
ggcctgacaggttcccagcagct

SEQ ID NO: 2146430 - DNA, 19 bp, Homo sapiens
ggcctgagctggggccaca

SEQ ID NO: 2146431 - DNA, 14 bp, Homo sapiens
ggcctgatgacaga

SEQ ID NO: 2146432 - DNA, 18 bp, Homo sapiens
ggcctgatgacagagcga

SEQ ID NO: 2146433 - DNA, 15 bp, Homo sapiens
ggcctgcccaatgct

SEQ ID NO: 2146434 - DNA, 21 bp, Homo sapiens
ggcctgcccaatgctttggga

SEQ ID NO: 2146435 - DNA, 17 bp, Homo sapiens
ggcctgcccagtgcact

SEQ ID NO: 2146436 - DNA, 13 bp, Homo sapiens
ggcctgccctccc

SEQ ID NO: 2146437 - DNA, 17 bp, Homo sapiens
ggcctgcctcccagccc

SEQ ID NO: 2146438 - DNA, 20 bp, Homo sapiens
ggcctgcctcccagccctgc

SEQ ID NO: 2146439 - DNA, 23 bp, Homo sapiens
ggcctgcggccgggctgcccttc

SEQ ID NO: 2146440 - DNA, 13 bp, Homo sapiens
ggcctgctgctga

SEQ ID NO: 2146441 - DNA, 15 bp, Homo sapiens
ggcctgctgctgaga

SEQ ID NO: 2146442 - DNA, 20 bp, Homo sapiens
ggcctgctgctgagaacctg

SEQ ID NO: 2146443 - DNA, 21 bp, Homo sapiens
ggcctgctgggaaccccgcag

SEQ ID NO: 2146444 - DNA, 22 bp, Homo sapiens
ggcctgctgggaaccccgcagc

SEQ ID NO: 2146445 - DNA, 16 bp, Homo sapiens
ggcctggagaggggcc

SEQ ID NO: 2146446 - DNA, 17 bp, Homo sapiens
ggcctggagaggggcct

SEQ ID NO: 2146447 - DNA, 14 bp, Homo sapiens
ggcctggcagccgt

SEQ ID NO: 2146448 - DNA, 21 bp, Homo sapiens
ggcctggccagatgcaccagc

SEQ ID NO: 2146449 - DNA, 14 bp, Homo sapiens
ggcctggccaggca

SEQ ID NO: 2146450 - DNA, 15 bp, Homo sapiens
ggcctggctctcctg

SEQ ID NO: 2146451 - DNA, 15 bp, Homo sapiens
ggcctggctggctga

SEQ ID NO: 2146452 - DNA, 21 bp, Homo sapiens
ggcctggcttgctccagggtc

SEQ ID NO: 2146453 - DNA, 16 bp, Homo sapiens
ggcctgggaaaggaaa

SEQ ID NO: 2146454 - DNA, 12 bp, Homo sapiens
ggcctgggcctg

SEQ ID NO: 2146455 - DNA, 14 bp, Homo sapiens
ggcctggggctcct

SEQ ID NO: 2146456 - DNA, 23 bp, Homo sapiens
ggcctggggctcctttctccagc

SEQ ID NO: 2146457 - DNA, 19 bp, Homo sapiens
ggcctgggggcagtgactg

SEQ ID NO: 2146458 - DNA, 14 bp, Homo sapiens
ggcctgtgcagcag

SEQ ID NO: 2146459 - DNA, 17 bp, Homo sapiens
ggcctgtgcagcagccc

SEQ ID NO: 2146460 - DNA, 19 bp, Homo sapiens
ggcctgtgcagcagcccag

SEQ ID NO: 2146461 - DNA, 14 bp, Homo sapiens
ggcctgtggcaggc

SEQ ID NO: 2146462 - DNA, 15 bp, Homo sapiens
ggcctgtggcaggcc

SEQ ID NO: 2146463 - DNA, 17 bp, Homo sapiens
ggcctgtggcaggccta

SEQ ID NO: 2146464 - DNA, 18 bp, Homo sapiens
ggcctgtggcaggcctag

SEQ ID NO: 2146465 - DNA, 21 bp, Homo sapiens
ggcctgtggcaggcctaggac

SEQ ID NO: 2146466 - DNA, 20 bp, Homo sapiens
ggcctgtgtagctgtgacct

SEQ ID NO: 2146467 - DNA, 18 bp, Homo sapiens
ggccttacctcccctgcc

SEQ ID NO: 2146468 - DNA, 19 bp, Homo sapiens
ggccttacctcccctgcca

SEQ ID NO: 2146469 - DNA, 24 bp, Homo sapiens
ggccttacctcccctgccagggct

SEQ ID NO: 2146470 - DNA, 22 bp, Homo sapiens
ggccttgcccgccagcctcagt

SEQ ID NO: 2146471 - DNA, 21 bp, Homo sapiens
ggccttgtcaggacccaggcc

SEQ ID NO: 2146472 - DNA, 22 bp, Homo sapiens
ggccttgtcaggacccaggccg

SEQ ID NO: 2146473 - DNA, 16 bp, Homo sapiens
ggccttgttctgtcac

SEQ ID NO: 2146474 - DNA, 16 bp, Homo sapiens
ggcctttaaagactta

SEQ ID NO: 2146475 - DNA, 12 bp, Homo sapiens
ggccttttccta

SEQ ID NO: 2146476 - DNA, 11 bp, Homo sapiens
ggcgaataaat

SEQ ID NO: 2146477 - DNA, 16 bp, Homo sapiens
ggcgaataaatgttca

SEQ ID NO: 2146478 - DNA, 17 bp, Homo sapiens
ggcgaataaatgttcaa

SEQ ID NO: 2146479 - DNA, 13 bp, Homo sapiens
gggcacaggagct

SEQ ID NO: 2146480 - DNA, 12 bp, Homo sapiens
gggcacagtcat

SEQ ID NO: 2146481 - DNA, 18 bp, Homo sapiens
gggcacatgaggagggtg

SEQ ID NO: 2146482 - DNA, 16 bp, Homo sapiens
gggcacccacctccac

SEQ ID NO: 2146483 - DNA, 14 bp, Homo sapiens
gggcacccccagcc

SEQ ID NO: 2146484 - DNA, 16 bp, Homo sapiens
gggcacccccagcctg

SEQ ID NO: 2146485 - DNA, 21 bp, Homo sapiens
gggcaccgagaactcgaagcc

SEQ ID NO: 2146486 - DNA, 14 bp, Homo sapiens
gggcacctgccacc

SEQ ID NO: 2146487 - DNA, 17 bp, Homo sapiens
gggcacctgccaccgcc

SEQ ID NO: 2146488 - DNA, 13 bp, Homo sapiens
gggcacctgggaa

SEQ ID NO: 2146489 - DNA, 22 bp, Homo sapiens
gggcacctgggaaaacagagga

SEQ ID NO: 2146490 - DNA, 20 bp, Homo sapiens
gggcactcagaagacactga

SEQ ID NO: 2146491 - DNA, 18 bp, Homo sapiens
gggcagaagggagaagga

SEQ ID NO: 2146492 - DNA, 19 bp, Homo sapiens
gggcagagccatgggcctg

SEQ ID NO: 2146493 - DNA, 16 bp, Homo sapiens
gggcagaggctggagg

SEQ ID NO: 2146494 - DNA, 14 bp, Homo sapiens
gggcagagggcaga

SEQ ID NO: 2146495 - DNA, 14 bp, Homo sapiens
gggcagaggggcag

SEQ ID NO: 2146496 - DNA, 18 bp, Homo sapiens
gggcagaggggcagccgc

SEQ ID NO: 2146497 - DNA, 16 bp, Homo sapiens
gggcagcagatcttct

SEQ ID NO: 2146498 - DNA, 20 bp, Homo sapiens
gggcagcagccagccctgcc

SEQ ID NO: 2146499 - DNA, 22 bp, Homo sapiens
gggcagcagccagccctgcctg

SEQ ID NO: 2146500 - DNA, 20 bp, Homo sapiens
gggcagcatagcaagacaca

SEQ ID NO: 2146501 - DNA, 19 bp, Homo sapiens
gggcagccaggggctgctc

SEQ ID NO: 2146502 - DNA, 13 bp, Homo sapiens
gggcagcccagcc

SEQ ID NO: 2146503 - DNA, 19 bp, Homo sapiens
gggcagccgctaggagaga

SEQ ID NO: 2146504 - DNA, 17 bp, Homo sapiens
gggcagctcctctgtct

SEQ ID NO: 2146505 - DNA, 21 bp, Homo sapiens
gggcagctcctctgtctcgag

SEQ ID NO: 2146506 - DNA, 14 bp, Homo sapiens
gggcagctgggccc

SEQ ID NO: 2146507 - DNA, 13 bp, Homo sapiens
gggcaggaggcct

SEQ ID NO: 2146508 - DNA, 18 bp, Homo sapiens
gggcaggaggcctggcct

SEQ ID NO: 2146509 - DNA, 14 bp, Homo sapiens
gggcaggagtagct

SEQ ID NO: 2146510 - DNA, 15 bp, Homo sapiens
gggcaggagtagctg

SEQ ID NO: 2146511 - DNA, 11 bp, Homo sapiens
gggcaggcctg

SEQ ID NO: 2146512 - DNA, 12 bp, Homo sapiens
gggcaggcctgg

SEQ ID NO: 2146513 - DNA, 23 bp, Homo sapiens
gggcaggcctgggacccagctac

SEQ ID NO: 2146514 - DNA, 16 bp, Homo sapiens
gggcaggtcctgccca

SEQ ID NO: 2146515 - DNA, 14 bp, Homo sapiens
gggcagtacctggg

SEQ ID NO: 2146516 - DNA, 18 bp, Homo sapiens
gggcagtgactggcaggt

SEQ ID NO: 2146517 - DNA, 15 bp, Homo sapiens
gggcagtgcctcctg

SEQ ID NO: 2146518 - DNA, 15 bp, Homo sapiens
gggcagtggggagca

SEQ ID NO: 2146519 - DNA, 21 bp, Homo sapiens
gggcagtggtaagctctggct

SEQ ID NO: 2146520 - DNA, 19 bp, Homo sapiens
gggcagttcgcagccaccc

SEQ ID NO: 2146521 - DNA, 15 bp, Homo sapiens
gggcatagaaactga

SEQ ID NO: 2146522 - DNA, 18 bp, Homo sapiens
gggcatagaaactgagga

SEQ ID NO: 2146523 - DNA, 19 bp, Homo sapiens
gggcatagaaactgaggag

SEQ ID NO: 2146524 - DNA, 18 bp, Homo sapiens
gggcatattaaaggcttt

SEQ ID NO: 2146525 - DNA, 12 bp, Homo sapiens
gggcatcaggca

SEQ ID NO: 2146526 - DNA, 17 bp, Homo sapiens
gggcatcaggcactggt

SEQ ID NO: 2146527 - DNA, 21 bp, Homo sapiens
gggcatccacccagtgctgcc

SEQ ID NO: 2146528 - DNA, 15 bp, Homo sapiens
gggcatcttctggct

SEQ ID NO: 2146529 - DNA, 15 bp, Homo sapiens
gggcatggccaggtg

SEQ ID NO: 2146530 - DNA, 16 bp, Homo sapiens
gggcatgggagggagg

SEQ ID NO: 2146531 - DNA, 22 bp, Homo sapiens
gggcatggttccttccctggga

SEQ ID NO: 2146532 - DNA, 15 bp, Homo sapiens
gggcatgtgtgcctg

SEQ ID NO: 2146533 - DNA, 20 bp, Homo sapiens
gggcatgtgtgcctgtggca

SEQ ID NO: 2146534 - DNA, 23 bp, Homo sapiens
gggcatgtgtgcctgtggcagaa

SEQ ID NO: 2146535 - DNA, 16 bp, Homo sapiens
gggccaaaagggcagc

SEQ ID NO: 2146536 - DNA, 20 bp, Homo sapiens
gggccaaaagggcagccagg

SEQ ID NO: 2146537 - DNA, 13 bp, Homo sapiens
gggccaattaaaa

SEQ ID NO: 2146538 - DNA, 23 bp, Homo sapiens
gggccacagagaaagtacttctc

SEQ ID NO: 2146539 - DNA, 18 bp, Homo sapiens
gggccacgtgccaggccc

SEQ ID NO: 2146540 - DNA, 17 bp, Homo sapiens
gggccactccttcctgc

SEQ ID NO: 2146541 - DNA, 17 bp, Homo sapiens
gggccactctcccctcc

SEQ ID NO: 2146542 - DNA, 19 bp, Homo sapiens
gggccactctcccctccct

SEQ ID NO: 2146543 - DNA, 11 bp, Homo sapiens
gggccactgcc

SEQ ID NO: 2146544 - DNA, 14 bp, Homo sapiens
gggccagacacaga

SEQ ID NO: 2146545 - DNA, 20 bp, Homo sapiens
gggccagctggtgctgcaag

SEQ ID NO: 2146546 - DNA, 16 bp, Homo sapiens
gggccaggacaggccc

SEQ ID NO: 2146547 - DNA, 14 bp, Homo sapiens
gggccaggagagag

SEQ ID NO: 2146548 - DNA, 16 bp, Homo sapiens
gggccaggagagagat

SEQ ID NO: 2146549 - DNA, 16 bp, Homo sapiens
gggccaggagctcagc

SEQ ID NO: 2146550 - DNA, 23 bp, Homo sapiens
gggccaggggtctccctggagtg

SEQ ID NO: 2146551 - DNA, 16 bp, Homo sapiens
gggccagtctgggctg

SEQ ID NO: 2146552 - DNA, 22 bp, Homo sapiens
gggccagtgagggctgggccca

SEQ ID NO: 2146553 - DNA, 12 bp, Homo sapiens
gggcccacaaag

SEQ ID NO: 2146554 - DNA, 16 bp, Homo sapiens
gggcccacaaagggga

SEQ ID NO: 2146555 - DNA, 20 bp, Homo sapiens
gggcccagctgtagccatgg

SEQ ID NO: 2146556 - DNA, 12 bp, Homo sapiens
gggcccaggctc

SEQ ID NO: 2146557 - DNA, 19 bp, Homo sapiens
gggcccaggctctgggaag

SEQ ID NO: 2146558 - DNA, 19 bp, Homo sapiens
gggccccagatctgcctgg

SEQ ID NO: 2146559 - DNA, 21 bp, Homo sapiens
gggccccagatctgcctgggc

SEQ ID NO: 2146560 - DNA, 13 bp, Homo sapiens
gggccccatgctc

SEQ ID NO: 2146561 - DNA, 18 bp, Homo sapiens
gggccccatgctctgccc

SEQ ID NO: 2146562 - DNA, 19 bp, Homo sapiens
gggccccatgctctgcccc

SEQ ID NO: 2146563 - DNA, 12 bp, Homo sapiens
gggcccccacag

SEQ ID NO: 2146564 - DNA, 17 bp, Homo sapiens
gggcccccctccttgct

SEQ ID NO: 2146565 - DNA, 13 bp, Homo sapiens
gggcccctccacg

SEQ ID NO: 2146566 - DNA, 20 bp, Homo sapiens
gggcccctccctctgcccca

SEQ ID NO: 2146567 - DNA, 15 bp, Homo sapiens
gggcccgaaagctga

SEQ ID NO: 2146568 - DNA, 22 bp, Homo sapiens
gggcccggagtaatcaggcagc

SEQ ID NO: 2146569 - DNA, 13 bp, Homo sapiens
gggccctgagctc

SEQ ID NO: 2146570 - DNA, 15 bp, Homo sapiens
gggccctgcagaggg

SEQ ID NO: 2146571 - DNA, 12 bp, Homo sapiens
gggccctgggcc

SEQ ID NO: 2146572 - DNA, 18 bp, Homo sapiens
gggccctggggcctgtac

SEQ ID NO: 2146573 - DNA, 16 bp, Homo sapiens
gggcccttggggcctg

SEQ ID NO: 2146574 - DNA, 15 bp, Homo sapiens
gggccgctggcccag

SEQ ID NO: 2146575 - DNA, 13 bp, Homo sapiens
gggccggccagcc

SEQ ID NO: 2146576 - DNA, 19 bp, Homo sapiens
gggccggggaactggccaa

SEQ ID NO: 2146577 - DNA, 22 bp, Homo sapiens
gggcctagatccacacacagag

SEQ ID NO: 2146578 - DNA, 14 bp, Homo sapiens
gggcctatggagag

SEQ ID NO: 2146579 - DNA, 20 bp, Homo sapiens
gggcctatggagagccctgg

SEQ ID NO: 2146580 - DNA, 21 bp, Homo sapiens
gggcctatggagagccctggg

SEQ ID NO: 2146581 - DNA, 13 bp, Homo sapiens
gggcctcagtgcc

SEQ ID NO: 2146582 - DNA, 14 bp, Homo sapiens
gggcctcagtgcca

SEQ ID NO: 2146583 - DNA, 14 bp, Homo sapiens
gggcctcagtttcc

SEQ ID NO: 2146584 - DNA, 19 bp, Homo sapiens
gggcctccccccagcccct

SEQ ID NO: 2146585 - DNA, 17 bp, Homo sapiens
gggcctcggagcctcat

SEQ ID NO: 2146586 - DNA, 14 bp, Homo sapiens
gggcctctgaaatt

SEQ ID NO: 2146587 - DNA, 13 bp, Homo sapiens
gggcctcttccct

SEQ ID NO: 2146588 - DNA, 14 bp, Homo sapiens
gggcctgcccagtg

SEQ ID NO: 2146589 - DNA, 11 bp, Homo sapiens
gggcctgctgc

SEQ ID NO: 2146590 - DNA, 12 bp, Homo sapiens
gggcctgctgcg

SEQ ID NO: 2146591 - DNA, 17 bp, Homo sapiens
gggcctgctgcgtcaga

SEQ ID NO: 2146592 - DNA, 12 bp, Homo sapiens
gggcctgctgct

SEQ ID NO: 2146593 - DNA, 16 bp, Homo sapiens
gggcctgctgctgaga

SEQ ID NO: 2146594 - DNA, 18 bp, Homo sapiens
gggcctggagaggggcct

SEQ ID NO: 2146595 - DNA, 21 bp, Homo sapiens
gaacaatagctattgcatgta

SEQ ID NO: 2146596 - DNA, 23 bp, Homo sapiens
gaacaatagctattgcatgtaaa

SEQ ID NO: 2146597 - DNA, 13 bp, Homo sapiens
gaacaatgaatgc

SEQ ID NO: 2146598 - DNA, 22 bp, Homo sapiens
gaacaatgtgggcgtttgtaaa

SEQ ID NO: 2146599 - DNA, 23 bp, Homo sapiens
gaacacagcctgggaccagggca

SEQ ID NO: 2146600 - DNA, 20 bp, Homo sapiens
gaacaccataggtagaatgt

SEQ ID NO: 2146601 - DNA, 16 bp, Homo sapiens
gaacacccactggcca

SEQ ID NO: 2146602 - DNA, 18 bp, Homo sapiens
gaacacccactggccagt

SEQ ID NO: 2146603 - DNA, 21 bp, Homo sapiens
gaacacccgactcctcaaaag

SEQ ID NO: 2146604 - DNA, 17 bp, Homo sapiens
gaacacccggaaagact

SEQ ID NO: 2146605 - DNA, 16 bp, Homo sapiens
gaacacggcctactga

SEQ ID NO: 2146606 - DNA, 20 bp, Homo sapiens
gaacactgggggaggggaca

SEQ ID NO: 2146607 - DNA, 12 bp, Homo sapiens
gaacagaaggat

SEQ ID NO: 2146608 - DNA, 17 bp, Homo sapiens
gaacagacaggagaaat

SEQ ID NO: 2146609 - DNA, 16 bp, Homo sapiens
gaacagactggaagca

SEQ ID NO: 2146610 - DNA, 22 bp, Homo sapiens
gaacagactggaagcacagctt

SEQ ID NO: 2146611 - DNA, 12 bp, Homo sapiens
gaacagagactc

SEQ ID NO: 2146612 - DNA, 22 bp, Homo sapiens
gaacagagactctggaagcccc

SEQ ID NO: 2146613 - DNA, 17 bp, Homo sapiens
gaacagagcgggcctct

SEQ ID NO: 2146614 - DNA, 23 bp, Homo sapiens
gaacagagcgggcctcttccctc

SEQ ID NO: 2146615 - DNA, 17 bp, Homo sapiens
gaacagaggcatttaaa

SEQ ID NO: 2146616 - DNA, 13 bp, Homo sapiens
gaacagagtatat

SEQ ID NO: 2146617 - DNA, 14 bp, Homo sapiens
gaacagagtatata

SEQ ID NO: 2146618 - DNA, 17 bp, Homo sapiens
gaacagagtatatatgt

SEQ ID NO: 2146619 - DNA, 21 bp, Homo sapiens
gaacagagtatatatgtacag

SEQ ID NO: 2146620 - DNA, 20 bp, Homo sapiens
gaacagcagactcagctctg

SEQ ID NO: 2146621 - DNA, 21 bp, Homo sapiens
gaacagctcttcactcagcca

SEQ ID NO: 2146622 - DNA, 16 bp, Homo sapiens
gaacaggtggatgtat

SEQ ID NO: 2146623 - DNA, 12 bp, Homo sapiens
gaacagtaaaca

SEQ ID NO: 2146624 - DNA, 14 bp, Homo sapiens
gaacagtaactgcc

SEQ ID NO: 2146625 - DNA, 19 bp, Homo sapiens
gaacagtcacccttctggg

SEQ ID NO: 2146626 - DNA, 21 bp, Homo sapiens
gaacagtcatgaggcagcttt

SEQ ID NO: 2146627 - DNA, 21 bp, Homo sapiens
gaacagtgtttcccataattt

SEQ ID NO: 2146628 - DNA, 15 bp, Homo sapiens
gaacataaaatacaa

SEQ ID NO: 2146629 - DNA, 20 bp, Homo sapiens
gaacatccaaggagaaacag

SEQ ID NO: 2146630 - DNA, 22 bp, Homo sapiens
gaacatctcactttgccccagt

SEQ ID NO: 2146631 - DNA, 19 bp, Homo sapiens
gaacatgcctgattttaaa

SEQ ID NO: 2146632 - DNA, 23 bp, Homo sapiens
gaacatgcctgattttaaaaggt

SEQ ID NO: 2146633 - DNA, 18 bp, Homo sapiens
gaacatgtgggaggaaga

SEQ ID NO: 2146634 - DNA, 19 bp, Homo sapiens
gaacatgtgggaggaagaa

SEQ ID NO: 2146635 - DNA, 13 bp, Homo sapiens
gaaccaagcttca

SEQ ID NO: 2146636 - DNA, 16 bp, Homo sapiens
gaaccaagcttcagag

SEQ ID NO: 2146637 - DNA, 17 bp, Homo sapiens
gaaccaagcttcagagc

SEQ ID NO: 2146638 - DNA, 15 bp, Homo sapiens
gaaccaaggcagcct

SEQ ID NO: 2146639 - DNA, 20 bp, Homo sapiens
gaaccaaggcagcctccaga

SEQ ID NO: 2146640 - DNA, 21 bp, Homo sapiens
gaaccaaggcagcctccagag

SEQ ID NO: 2146641 - DNA, 18 bp, Homo sapiens
gaaccacatcttgctctg

SEQ ID NO: 2146642 - DNA, 18 bp, Homo sapiens
gaaccaccacacccagcc

SEQ ID NO: 2146643 - DNA, 21 bp, Homo sapiens
gaaccaccacacccagcccac

SEQ ID NO: 2146644 - DNA, 19 bp, Homo sapiens
gaaccagtttcaggtgttt

SEQ ID NO: 2146645 - DNA, 20 bp, Homo sapiens
gaaccatcattataaacgtg

SEQ ID NO: 2146646 - DNA, 12 bp, Homo sapiens
gaacccacctgc

SEQ ID NO: 2146647 - DNA, 13 bp, Homo sapiens
gaacccacctgct

SEQ ID NO: 2146648 - DNA, 15 bp, Homo sapiens
gaacccagccctggg

SEQ ID NO: 2146649 - DNA, 11 bp, Homo sapiens
gaacccaggac

SEQ ID NO: 2146650 - DNA, 12 bp, Homo sapiens
gaacccaggaca

SEQ ID NO: 2146651 - DNA, 13 bp, Homo sapiens
gaacccaggacaa

SEQ ID NO: 2146652 - DNA, 19 bp, Homo sapiens
gaacccaggacaagcatgg

SEQ ID NO: 2146653 - DNA, 15 bp, Homo sapiens
gaacccctcccctcc

SEQ ID NO: 2146654 - DNA, 19 bp, Homo sapiens
gaacccctcccctcccccc

SEQ ID NO: 2146655 - DNA, 12 bp, Homo sapiens
gaacccctgtgt

SEQ ID NO: 2146656 - DNA, 17 bp, Homo sapiens
gaaccccttcatcctct

SEQ ID NO: 2146657 - DNA, 18 bp, Homo sapiens
gaacccttgtgcttggtg

SEQ ID NO: 2146658 - DNA, 16 bp, Homo sapiens
gaacccttttcctcca

SEQ ID NO: 2146659 - DNA, 22 bp, Homo sapiens
gaacccttttcctccagacaga

SEQ ID NO: 2146660 - DNA, 20 bp, Homo sapiens
gaacctaactccccacccca

SEQ ID NO: 2146661 - DNA, 19 bp, Homo sapiens
gaacctaattgaaatttaa

SEQ ID NO: 2146662 - DNA, 14 bp, Homo sapiens
gaacctagaagggc

SEQ ID NO: 2146663 - DNA, 17 bp, Homo sapiens
gaacctagaagggctag

SEQ ID NO: 2146664 - DNA, 19 bp, Homo sapiens
gaacctagtactctctgct

SEQ ID NO: 2146665 - DNA, 18 bp, Homo sapiens
gaacctcaggcttccttg

SEQ ID NO: 2146666 - DNA, 12 bp, Homo sapiens
gaacctcagttt

SEQ ID NO: 2146667 - DNA, 18 bp, Homo sapiens
gaacctcagtttcctcat

SEQ ID NO: 2146668 - DNA, 12 bp, Homo sapiens
gaacctggagag

SEQ ID NO: 2146669 - DNA, 13 bp, Homo sapiens
gaacctggagggg

SEQ ID NO: 2146670 - DNA, 17 bp, Homo sapiens
gaacctggaggggctag

SEQ ID NO: 2146671 - DNA, 13 bp, Homo sapiens
gaacctggccttc

SEQ ID NO: 2146672 - DNA, 14 bp, Homo sapiens
gaacctggccttca

SEQ ID NO: 2146673 - DNA, 23 bp, Homo sapiens
gaacctgggaaccatgaagctgg

SEQ ID NO: 2146674 - DNA, 14 bp, Homo sapiens
gaacctgtactggg

SEQ ID NO: 2146675 - DNA, 21 bp, Homo sapiens
gaacctgtactgggttatttt

SEQ ID NO: 2146676 - DNA, 15 bp, Homo sapiens
gaaccttccctccaa

SEQ ID NO: 2146677 - DNA, 14 bp, Homo sapiens
gaacgagcactggc

SEQ ID NO: 2146678 - DNA, 18 bp, Homo sapiens
gaacgagcactggccaga

SEQ ID NO: 2146679 - DNA, 21 bp, Homo sapiens
gaacgctcttagctttctcag

SEQ ID NO: 2146680 - DNA, 16 bp, Homo sapiens
gaacggggtccttcaa

SEQ ID NO: 2146681 - DNA, 22 bp, Homo sapiens
gaacgtgactgccccaactcct

SEQ ID NO: 2146682 - DNA, 15 bp, Homo sapiens
gaactcaactttgac

SEQ ID NO: 2146683 - DNA, 16 bp, Homo sapiens
gaactcaactttgaca

SEQ ID NO: 2146684 - DNA, 17 bp, Homo sapiens
gaactcaagctgcgttt

SEQ ID NO: 2146685 - DNA, 16 bp, Homo sapiens
gaactcagagcccctc

SEQ ID NO: 2146686 - DNA, 21 bp, Homo sapiens
gaactcagctgtctgtggctt

SEQ ID NO: 2146687 - DNA, 17 bp, Homo sapiens
gaactccttattttgta

SEQ ID NO: 2146688 - DNA, 20 bp, Homo sapiens
gaactccttattttgtatta

SEQ ID NO: 2146689 - DNA, 16 bp, Homo sapiens
gaactcgaagcccttc

SEQ ID NO: 2146690 - DNA, 17 bp, Homo sapiens
gaactcgaagcccttcc

SEQ ID NO: 2146691 - DNA, 17 bp, Homo sapiens
gaactctctccacccta

SEQ ID NO: 2146692 - DNA, 11 bp, Homo sapiens
gaactctgaca

SEQ ID NO: 2146693 - DNA, 13 bp, Homo sapiens
gaactctgacaag

SEQ ID NO: 2146694 - DNA, 19 bp, Homo sapiens
gaactctgacaagggctga

SEQ ID NO: 2146695 - DNA, 16 bp, Homo sapiens
gaactctgcacagcaa

SEQ ID NO: 2146696 - DNA, 16 bp, Homo sapiens
gaactctggcttccag

SEQ ID NO: 2146697 - DNA, 17 bp, Homo sapiens
gaactctggcttccagg

SEQ ID NO: 2146698 - DNA, 15 bp, Homo sapiens
gaactgaattaagtt

SEQ ID NO: 2146699 - DNA, 17 bp, Homo sapiens
gaactgaccccctcccc

SEQ ID NO: 2146700 - DNA, 13 bp, Homo sapiens
gaactgagccaaa

SEQ ID NO: 2146701 - DNA, 21 bp, Homo sapiens
gaactgagccaaacacactgt

SEQ ID NO: 2146702 - DNA, 14 bp, Homo sapiens
gaactgagcctagc

SEQ ID NO: 2146703 - DNA, 21 bp, Homo sapiens
gaactgattcacatctcattt

SEQ ID NO: 2146704 - DNA, 23 bp, Homo sapiens
gaactgattcacatctcattttt

SEQ ID NO: 2146705 - DNA, 20 bp, Homo sapiens
gaactgcttactagccctgc

SEQ ID NO: 2146706 - DNA, 11 bp, Homo sapiens
gaactggctgc

SEQ ID NO: 2146707 - DNA, 18 bp, Homo sapiens
gaactgggatttgaaccc

SEQ ID NO: 2146708 - DNA, 20 bp, Homo sapiens
gaactggtcaccatgaaact

SEQ ID NO: 2146709 - DNA, 18 bp, Homo sapiens
gaactggttcaagagaca

SEQ ID NO: 2146710 - DNA, 17 bp, Homo sapiens
gaactgtctctcatgaa

SEQ ID NO: 2146711 - DNA, 16 bp, Homo sapiens
gaactgtgacaggaag

SEQ ID NO: 2146712 - DNA, 18 bp, Homo sapiens
gcagcacatggtgttgta

SEQ ID NO: 2146713 - DNA, 12 bp, Homo sapiens
gcagcagaagcc

SEQ ID NO: 2146714 - DNA, 12 bp, Homo sapiens
gcagcagagagc

SEQ ID NO: 2146715 - DNA, 11 bp, Homo sapiens
gcagcagccag

SEQ ID NO: 2146716 - DNA, 19 bp, Homo sapiens
gcagcagcccagcttcctg

SEQ ID NO: 2146717 - DNA, 16 bp, Homo sapiens
gcagcagctaggactg

SEQ ID NO: 2146718 - DNA, 20 bp, Homo sapiens
gcagcagctaggactgagga

SEQ ID NO: 2146719 - DNA, 23 bp, Homo sapiens
gcagcagctaggactgaggagtg

SEQ ID NO: 2146720 - DNA, 20 bp, Homo sapiens
gcagcagctcagcctccccc

SEQ ID NO: 2146721 - DNA, 18 bp, Homo sapiens
gcagcagctgggacccct

SEQ ID NO: 2146722 - DNA, 22 bp, Homo sapiens
gcagcagctgggacccctccca

SEQ ID NO: 2146723 - DNA, 23 bp, Homo sapiens
gcagcagctgggacccctcccaa

SEQ ID NO: 2146724 - DNA, 16 bp, Homo sapiens
gcagcaggtgcaagag

SEQ ID NO: 2146725 - DNA, 13 bp, Homo sapiens
gcagcagtgagct

SEQ ID NO: 2146726 - DNA, 15 bp, Homo sapiens
gcagcatctgctaat

SEQ ID NO: 2146727 - DNA, 10 bp, Homo sapiens
gcagcatgtg

SEQ ID NO: 2146728 - DNA, 19 bp, Homo sapiens
gcagcatgtggggaagcaa

SEQ ID NO: 2146729 - DNA, 21 bp, Homo sapiens
gcagcatgtggggaagcaaga

SEQ ID NO: 2146730 - DNA, 14 bp, Homo sapiens
gcagcattcagcac

SEQ ID NO: 2146731 - DNA, 17 bp, Homo sapiens
gcagccaccctgaggag

SEQ ID NO: 2146732 - DNA, 20 bp, Homo sapiens
gcagccaccctgaggagtct

SEQ ID NO: 2146733 - DNA, 21 bp, Homo sapiens
gcagccaccctgaggagtctg

SEQ ID NO: 2146734 - DNA, 15 bp, Homo sapiens
gcagccagccagtct

SEQ ID NO: 2146735 - DNA, 11 bp, Homo sapiens
gcagccagccc

SEQ ID NO: 2146736 - DNA, 13 bp, Homo sapiens
gcagccagcccag

SEQ ID NO: 2146737 - DNA, 15 bp, Homo sapiens
gcagccagcccagcc

SEQ ID NO: 2146738 - DNA, 23 bp, Homo sapiens
gcagccagcccagcccagctggt

SEQ ID NO: 2146739 - DNA, 14 bp, Homo sapiens
gcagccagccctgc

SEQ ID NO: 2146740 - DNA, 15 bp, Homo sapiens
gcagccagccctgcc

SEQ ID NO: 2146741 - DNA, 19 bp, Homo sapiens
gcagccagccctgcctgga

SEQ ID NO: 2146742 - DNA, 22 bp, Homo sapiens
gcagccagccctgcctggagga

SEQ ID NO: 2146743 - DNA, 18 bp, Homo sapiens
gcagccagccggtgcctg

SEQ ID NO: 2146744 - DNA, 19 bp, Homo sapiens
gcagccagccggtgcctgg

SEQ ID NO: 2146745 - DNA, 15 bp, Homo sapiens
gcagccagctctcag

SEQ ID NO: 2146746 - DNA, 16 bp, Homo sapiens
gcagccaggaggagag

SEQ ID NO: 2146747 - DNA, 18 bp, Homo sapiens
gcagccaggggctgctca

SEQ ID NO: 2146748 - DNA, 11 bp, Homo sapiens
gcagccatgcc

SEQ ID NO: 2146749 - DNA, 16 bp, Homo sapiens
gcagccatgcctcatg

SEQ ID NO: 2146750 - DNA, 17 bp, Homo sapiens
gcagccatgcctcatgc

SEQ ID NO: 2146751 - DNA, 14 bp, Homo sapiens
gcagcccagcctct

SEQ ID NO: 2146752 - DNA, 13 bp, Homo sapiens
gcagcccagcttc

SEQ ID NO: 2146753 - DNA, 20 bp, Homo sapiens
gcagcccagggcacttcaga

SEQ ID NO: 2146754 - DNA, 18 bp, Homo sapiens
gcagccccattctgcctg

SEQ ID NO: 2146755 - DNA, 21 bp, Homo sapiens
gcagccccattctgcctgccc

SEQ ID NO: 2146756 - DNA, 20 bp, Homo sapiens
gcagcccgtgaagcagtgcc

SEQ ID NO: 2146757 - DNA, 15 bp, Homo sapiens
gcagttccatcaggt

SEQ ID NO: 2146758 - DNA, 13 bp, Homo sapiens
gcagttcctgagt

SEQ ID NO: 2146759 - DNA, 23 bp, Homo sapiens
gcagttcgcagccaccctgagga

SEQ ID NO: 2146760 - DNA, 17 bp, Homo sapiens
gcagttgacagcaggtg

SEQ ID NO: 2146761 - DNA, 16 bp, Homo sapiens
gcagttggcagaaagg

SEQ ID NO: 2146762 - DNA, 13 bp, Homo sapiens
gcagtttaaagca

SEQ ID NO: 2146763 - DNA, 18 bp, Homo sapiens
gcataaaccaatgagctg

SEQ ID NO: 2146764 - DNA, 19 bp, Homo sapiens
gcataaacttcatcttcaa

SEQ ID NO: 2146765 - DNA, 18 bp, Homo sapiens
gcataagattaaaggaag

SEQ ID NO: 2146766 - DNA, 19 bp, Homo sapiens
gcataatcagcgccctgga

SEQ ID NO: 2146767 - DNA, 23 bp, Homo sapiens
gcataattcggaagggaaaacag

SEQ ID NO: 2146768 - DNA, 17 bp, Homo sapiens
gcatagaaactgaggag

SEQ ID NO: 2146769 - DNA, 22 bp, Homo sapiens
gcatagaggtaccagcaatatg

SEQ ID NO: 2146770 - DNA, 23 bp, Homo sapiens
gcatatcggaggtggtggaggag

SEQ ID NO: 2146771 - DNA, 23 bp, Homo sapiens
gcatatttatagcaatccatgtt

SEQ ID NO: 2146772 - DNA, 13 bp, Homo sapiens
gcatatttatatt

SEQ ID NO: 2146773 - DNA, 20 bp, Homo sapiens
gcatatttatattgtatatt

SEQ ID NO: 2146774 - DNA, 23 bp, Homo sapiens
gcatatttatattgtatattctg

SEQ ID NO: 2146775 - DNA, 14 bp, Homo sapiens
gcatcacagggcag

SEQ ID NO: 2146776 - DNA, 15 bp, Homo sapiens
gcatcacagggcaga

SEQ ID NO: 2146777 - DNA, 17 bp, Homo sapiens
gcatcacagggcagagc

SEQ ID NO: 2146778 - DNA, 21 bp, Homo sapiens
gcatcacagggcagagccggg

SEQ ID NO: 2146779 - DNA, 13 bp, Homo sapiens
gcatcagaaagag

SEQ ID NO: 2146780 - DNA, 18 bp, Homo sapiens
gcatcagaaagggagggc

SEQ ID NO: 2146781 - DNA, 21 bp, Homo sapiens
gcatcagaaagggagggctct

SEQ ID NO: 2146782 - DNA, 14 bp, Homo sapiens
gcatcaggcactgg

SEQ ID NO: 2146783 - DNA, 19 bp, Homo sapiens
gcatcaggcactggtggca

SEQ ID NO: 2146784 - DNA, 13 bp, Homo sapiens
gcatcatgcctct

SEQ ID NO: 2146785 - DNA, 15 bp, Homo sapiens
gcatcatgcctctga

SEQ ID NO: 2146786 - DNA, 16 bp, Homo sapiens
gcatcatgcctctgag

SEQ ID NO: 2146787 - DNA, 17 bp, Homo sapiens
gcatcatgcctctgagg

SEQ ID NO: 2146788 - DNA, 15 bp, Homo sapiens
gcatcattgtaaatt

SEQ ID NO: 2146789 - DNA, 21 bp, Homo sapiens
gcatccacccagtgctgccat

SEQ ID NO: 2146790 - DNA, 23 bp, Homo sapiens
gcatccacccagtgctgccatgc

SEQ ID NO: 2146791 - DNA, 14 bp, Homo sapiens
gcatccacgcacac

SEQ ID NO: 2146792 - DNA, 13 bp, Homo sapiens
gcatccagcctgt

SEQ ID NO: 2146793 - DNA, 12 bp, Homo sapiens
gcatccattcct

SEQ ID NO: 2146794 - DNA, 16 bp, Homo sapiens
gcatccattcctcagg

SEQ ID NO: 2146795 - DNA, 18 bp, Homo sapiens
gcatccattcctcaggga

SEQ ID NO: 2146796 - DNA, 21 bp, Homo sapiens
gcatccattcctcagggacag

SEQ ID NO: 2146797 - DNA, 16 bp, Homo sapiens
gcatcccaggggacca

SEQ ID NO: 2146798 - DNA, 14 bp, Homo sapiens
gcatcccatccctt

SEQ ID NO: 2146799 - DNA, 21 bp, Homo sapiens
gcatcccatgggggtgctgca

SEQ ID NO: 2146800 - DNA, 19 bp, Homo sapiens
gcatcccccagcactgatg

SEQ ID NO: 2146801 - DNA, 21 bp, Homo sapiens
gcatccccttggctgtgaggc

SEQ ID NO: 2146802 - DNA, 17 bp, Homo sapiens
gcatccgtagttccctg

SEQ ID NO: 2146803 - DNA, 18 bp, Homo sapiens
gcatcctccacaatagca

SEQ ID NO: 2146804 - DNA, 17 bp, Homo sapiens
gcatcctcctcccaact

SEQ ID NO: 2146805 - DNA, 14 bp, Homo sapiens
gcatcctggcaccc

SEQ ID NO: 2146806 - DNA, 21 bp, Homo sapiens
gcatcgtgacccttcagggcc

SEQ ID NO: 2146807 - DNA, 14 bp, Homo sapiens
gcatctacacagcc

SEQ ID NO: 2146808 - DNA, 15 bp, Homo sapiens
gcatctacacagcct

SEQ ID NO: 2146809 - DNA, 21 bp, Homo sapiens
gcatctagaggcttccttcat

SEQ ID NO: 2146810 - DNA, 23 bp, Homo sapiens
gcatctattctttgtaccatctg

SEQ ID NO: 2146811 - DNA, 12 bp, Homo sapiens
gcatctcagccc

SEQ ID NO: 2146812 - DNA, 15 bp, Homo sapiens
gcatctcagcccaca

SEQ ID NO: 2146813 - DNA, 19 bp, Homo sapiens
gcatctcgtgccagggcag

SEQ ID NO: 2146814 - DNA, 16 bp, Homo sapiens
gcatctcttgaggcca

SEQ ID NO: 2146815 - DNA, 20 bp, Homo sapiens
gcatctcttgaggccaggag

SEQ ID NO: 2146816 - DNA, 19 bp, Homo sapiens
gcatctgcctctattcaat

SEQ ID NO: 2146817 - DNA, 20 bp, Homo sapiens
gcatcttctggagtctccag

SEQ ID NO: 2146818 - DNA, 23 bp, Homo sapiens
gcatcttctggagtctccagtgg

SEQ ID NO: 2146819 - DNA, 15 bp, Homo sapiens
gcatcttctggcttg

SEQ ID NO: 2146820 - DNA, 13 bp, Homo sapiens
gcatgaaggtttc

SEQ ID NO: 2146821 - DNA, 14 bp, Homo sapiens
gcatgacactctag

SEQ ID NO: 2146822 - DNA, 21 bp, Homo sapiens
gcatgatcttgttaatgcatt

SEQ ID NO: 2146823 - DNA, 22 bp, Homo sapiens
gcatgatttatatatggcatat

SEQ ID NO: 2146824 - DNA, 20 bp, Homo sapiens
gcatgattttaagaggcttt

SEQ ID NO: 2146825 - DNA, 13 bp, Homo sapiens
gcatgattttata

SEQ ID NO: 2146826 - DNA, 16 bp, Homo sapiens
gcatgattttatacat

SEQ ID NO: 2146827 - DNA, 17 bp, Homo sapiens
gcatgattttatacata

SEQ ID NO: 2146828 - DNA, 18 bp, Homo sapiens
gcatgcaataatgtgcaa

SEQ ID NO: 2146829 - DNA, 16 bp, Homo sapiens
gcatgcacagctgctt

SEQ ID NO: 2146830 - DNA, 22 bp, Homo sapiens
gcatgcacagctgcttgtcctg

SEQ ID NO: 2146831 - DNA, 21 bp, Homo sapiens
gcatgcaccagtgccgcctgt

SEQ ID NO: 2146832 - DNA, 14 bp, Homo sapiens
gcatgcgcacaagg

SEQ ID NO: 2146833 - DNA, 21 bp, Homo sapiens
gcatgctctctgcagccagcc

SEQ ID NO: 2146834 - DNA, 22 bp, Homo sapiens
gcatgctctctgcagccagccc

SEQ ID NO: 2146835 - DNA, 23 bp, Homo sapiens
gcatgctctctgcagccagccca

SEQ ID NO: 2146836 - DNA, 12 bp, Homo sapiens
gcatgctctgga

SEQ ID NO: 2146837 - DNA, 14 bp, Homo sapiens
gcatgctctggaag

SEQ ID NO: 2146838 - DNA, 18 bp, Homo sapiens
gcatgctctggaagcctg

SEQ ID NO: 2146839 - DNA, 13 bp, Homo sapiens
gcatgctggcctg

SEQ ID NO: 2146840 - DNA, 15 bp, Homo sapiens
gcatgctggcctgtg

SEQ ID NO: 2146841 - DNA, 18 bp, Homo sapiens
gcatgctggcctgtggca

SEQ ID NO: 2146842 - DNA, 20 bp, Homo sapiens
gcatgctggcctgtggcagg

SEQ ID NO: 2146843 - DNA, 23 bp, Homo sapiens
gcatgctggcctgtggcaggcct

SEQ ID NO: 2146844 - DNA, 17 bp, Homo sapiens
gcatggaatttgtaagt

SEQ ID NO: 2146845 - DNA, 19 bp, Homo sapiens
gcatggagagcctcttagt

SEQ ID NO: 2146846 - DNA, 14 bp, Homo sapiens
gcatggatttctgt

SEQ ID NO: 2146847 - DNA, 13 bp, Homo sapiens
gcatggccaggtg

SEQ ID NO: 2146848 - DNA, 16 bp, Homo sapiens
gcatggccctggggtc

SEQ ID NO: 2146849 - DNA, 15 bp, Homo sapiens
gcatggcttggggag

SEQ ID NO: 2146850 - DNA, 18 bp, Homo sapiens
gcatggcttggggagcag

SEQ ID NO: 2146851 - DNA, 21 bp, Homo sapiens
gcatgggagggagggagaggt

SEQ ID NO: 2146852 - DNA, 15 bp, Homo sapiens
gcatgggtgtgccct

SEQ ID NO: 2146853 - DNA, 23 bp, Homo sapiens
gcatggtcctggaggatgaccag

SEQ ID NO: 2146854 - DNA, 22 bp, Homo sapiens
gcatgtacaaaagtaccataga

SEQ ID NO: 2146855 - DNA, 19 bp, Homo sapiens
gcatgtagctctatggggg

SEQ ID NO: 2146856 - DNA, 19 bp, Homo sapiens
gcatgtattatcacatcaa

SEQ ID NO: 2146857 - DNA, 21 bp, Homo sapiens
gcatgtattgtaaacagaagg

SEQ ID NO: 2146858 - DNA, 15 bp, Homo sapiens
gcatgtcactcccag

SEQ ID NO: 2146859 - DNA, 23 bp, Homo sapiens
gcatgtccctaccgagtctcttc

SEQ ID NO: 2146860 - DNA, 14 bp, Homo sapiens
gcatgtgagcacat

SEQ ID NO: 2146861 - DNA, 14 bp, Homo sapiens
gcatgtgtgcctgt

SEQ ID NO: 2146862 - DNA, 13 bp, Homo sapiens
gcatgtgtgtata

SEQ ID NO: 2146863 - DNA, 15 bp, Homo sapiens
gcatgtgtgtgtctg

SEQ ID NO: 2146864 - DNA, 18 bp, Homo sapiens
gcatgttacctcctataa

SEQ ID NO: 2146865 - DNA, 15 bp, Homo sapiens
gcatgttctctgagg

SEQ ID NO: 2146866 - DNA, 19 bp, Homo sapiens
gcatgttgccatgaggcct

SEQ ID NO: 2146867 - DNA, 20 bp, Homo sapiens
gcatgtttcatgttttgtga

SEQ ID NO: 2146868 - DNA, 19 bp, Homo sapiens
gcattaaattttaaggtag

SEQ ID NO: 2146869 - DNA, 13 bp, Homo sapiens
gcattaacttaaa

SEQ ID NO: 2146870 - DNA, 13 bp, Homo sapiens
gcattaattatta

SEQ ID NO: 2146871 - DNA, 22 bp, Homo sapiens
gcattaggcttttaagaaacac

SEQ ID NO: 2146872 - DNA, 16 bp, Homo sapiens
gcattattcctccagg

SEQ ID NO: 2146873 - DNA, 22 bp, Homo sapiens
gcattattggaatataattgtt

SEQ ID NO: 2146874 - DNA, 23 bp, Homo sapiens
gcattattggaatataattgttt

SEQ ID NO: 2146875 - DNA, 17 bp, Homo sapiens
gcattatttaatgtttg

SEQ ID NO: 2146876 - DNA, 17 bp, Homo sapiens
gcattcagcacacccca

SEQ ID NO: 2146877 - DNA, 20 bp, Homo sapiens
gcattcagcacaccccaagg

SEQ ID NO: 2146878 - DNA, 11 bp, Homo sapiens
gcattccatga

SEQ ID NO: 2146879 - DNA, 20 bp, Homo sapiens
gcattccatgattttacaga

SEQ ID NO: 2146880 - DNA, 17 bp, Homo sapiens
gcattccccgctgccca

SEQ ID NO: 2146881 - DNA, 18 bp, Homo sapiens
gcattccccgctgcccaa

SEQ ID NO: 2146882 - DNA, 13 bp, Homo sapiens
gcattccctgagt

SEQ ID NO: 2146883 - DNA, 14 bp, Homo sapiens
gcattccctgagtc

SEQ ID NO: 2146884 - DNA, 21 bp, Homo sapiens
gcattccctgagtcaccagga

SEQ ID NO: 2146885 - DNA, 16 bp, Homo sapiens
gcattcctacaaagat

SEQ ID NO: 2146886 - DNA, 19 bp, Homo sapiens
gcattcctacaaagatgtt

SEQ ID NO: 2146887 - DNA, 15 bp, Homo sapiens
gcattctgagctggg

SEQ ID NO: 2146888 - DNA, 13 bp, Homo sapiens
gcattcttagact

SEQ ID NO: 2146889 - DNA, 20 bp, Homo sapiens
gcattcttttaaagttttat

SEQ ID NO: 2146890 - DNA, 18 bp, Homo sapiens
gcattggggggccgggca

SEQ ID NO: 2146891 - DNA, 14 bp, Homo sapiens
gcatttaataaatg

SEQ ID NO: 2146892 - DNA, 20 bp, Homo sapiens
gcatttccacactgtcagag

SEQ ID NO: 2146893 - DNA, 16 bp, Homo sapiens
gcatttcccccaggga

SEQ ID NO: 2146894 - DNA, 21 bp, Homo sapiens
gcatttcttgatgttgcttag

SEQ ID NO: 2146895 - DNA, 16 bp, Homo sapiens
gcatttgtgttattat

SEQ ID NO: 2146896 - DNA, 18 bp, Homo sapiens
gcattttactacttgtta

SEQ ID NO: 2146897 - DNA, 22 bp, Homo sapiens
gcattttactacttgttacctt

SEQ ID NO: 2146898 - DNA, 14 bp, Homo sapiens
gcattttcccagat

SEQ ID NO: 2146899 - DNA, 23 bp, Homo sapiens
gcattttcctcgcctaggcctgt

SEQ ID NO: 2146900 - DNA, 14 bp, Homo sapiens
gcattttctctagc

SEQ ID NO: 2146901 - DNA, 23 bp, Homo sapiens
gcatttttactactattctgtta

SEQ ID NO: 2146902 - DNA, 16 bp, Homo sapiens
gccaaaaaaaaataca

SEQ ID NO: 2146903 - DNA, 15 bp, Homo sapiens
gccaaaagggcagcc

SEQ ID NO: 2146904 - DNA, 13 bp, Homo sapiens
gcccaacctcctg

SEQ ID NO: 2146905 - DNA, 17 bp, Homo sapiens
gcccaagaggtctgagc

SEQ ID NO: 2146906 - DNA, 21 bp, Homo sapiens
gcccaagaggtctgagccctg

SEQ ID NO: 2146907 - DNA, 15 bp, Homo sapiens
gcccaagcctggtct

SEQ ID NO: 2146908 - DNA, 17 bp, Homo sapiens
gcccaagtgccatccca

SEQ ID NO: 2146909 - DNA, 19 bp, Homo sapiens
gcccaagtgccatcccaca

SEQ ID NO: 2146910 - DNA, 22 bp, Homo sapiens
gcccaagtgccatcccacattc

SEQ ID NO: 2146911 - DNA, 22 bp, Homo sapiens
gcccaatgctttgggaggccaa

SEQ ID NO: 2146912 - DNA, 14 bp, Homo sapiens
gcccacaaactgat

SEQ ID NO: 2146913 - DNA, 16 bp, Homo sapiens
gcccacaaaggggaga

SEQ ID NO: 2146914 - DNA, 23 bp, Homo sapiens
gcccacaagccttactcacctct

SEQ ID NO: 2146915 - DNA, 18 bp, Homo sapiens
gcccacagacagatccca

SEQ ID NO: 2146916 - DNA, 15 bp, Homo sapiens
gcccacagagcctga

SEQ ID NO: 2146917 - DNA, 16 bp, Homo sapiens
gcccacagctcccacc

SEQ ID NO: 2146918 - DNA, 13 bp, Homo sapiens
gcccacaggatca

SEQ ID NO: 2146919 - DNA, 12 bp, Homo sapiens
gcccacagggaa

SEQ ID NO: 2146920 - DNA, 15 bp, Homo sapiens
gcccacatcccaggc

SEQ ID NO: 2146921 - DNA, 17 bp, Homo sapiens
gcccaccaacatcccat

SEQ ID NO: 2146922 - DNA, 13 bp, Homo sapiens
gcccaccttggct

SEQ ID NO: 2146923 - DNA, 15 bp, Homo sapiens
gcccacgctggagtg

SEQ ID NO: 2146924 - DNA, 19 bp, Homo sapiens
gcccacgctggagtgcagt

SEQ ID NO: 2146925 - DNA, 18 bp, Homo sapiens
gcccacgtgtgcagactg

SEQ ID NO: 2146926 - DNA, 22 bp, Homo sapiens
gcccacgtgtgcagactgtggc

SEQ ID NO: 2146927 - DNA, 23 bp, Homo sapiens
gcccacttagccgtccatggcac

SEQ ID NO: 2146928 - DNA, 17 bp, Homo sapiens
gcccacttcagcccagc

SEQ ID NO: 2146929 - DNA, 14 bp, Homo sapiens
gcccacttctgcca

SEQ ID NO: 2146930 - DNA, 17 bp, Homo sapiens
gcccagagaccccttcc

SEQ ID NO: 2146931 - DNA, 23 bp, Homo sapiens
gcccagagaccccttcctttcct

SEQ ID NO: 2146932 - DNA, 15 bp, Homo sapiens
gcccagagagggtgg

SEQ ID NO: 2146933 - DNA, 13 bp, Homo sapiens
gcccagagggccc

SEQ ID NO: 2146934 - DNA, 15 bp, Homo sapiens
gcccagagggcccag

SEQ ID NO: 2146935 - DNA, 21 bp, Homo sapiens
gcccagagggcccaggcaggc

SEQ ID NO: 2146936 - DNA, 14 bp, Homo sapiens
gcccagcactgtga

SEQ ID NO: 2146937 - DNA, 14 bp, Homo sapiens
gcccagccacctcc

SEQ ID NO: 2146938 - DNA, 20 bp, Homo sapiens
gcccagccacctcccaagga

SEQ ID NO: 2146939 - DNA, 20 bp, Homo sapiens
gcccagccattaccatggag

SEQ ID NO: 2146940 - DNA, 21 bp, Homo sapiens
gcccagccattaccatggaga

SEQ ID NO: 2146941 - DNA, 15 bp, Homo sapiens
gcccagcccagctgg

SEQ ID NO: 2146942 - DNA, 15 bp, Homo sapiens
gcccagcctagccca

SEQ ID NO: 2146943 - DNA, 17 bp, Homo sapiens
gcccagcctcctcccac

SEQ ID NO: 2146944 - DNA, 21 bp, Homo sapiens
gcccagcctcctcccaccacc

SEQ ID NO: 2146945 - DNA, 13 bp, Homo sapiens
gcccagcctctgt

SEQ ID NO: 2146946 - DNA, 14 bp, Homo sapiens
gcccagcctctgtc

SEQ ID NO: 2146947 - DNA, 20 bp, Homo sapiens
gcccagcctctgtccctctt

SEQ ID NO: 2146948 - DNA, 15 bp, Homo sapiens
gcccagcctgtcctg

SEQ ID NO: 2146949 - DNA, 16 bp, Homo sapiens
gcccagctgaggctgg

SEQ ID NO: 2146950 - DNA, 15 bp, Homo sapiens
gcccagctgcacctg

SEQ ID NO: 2146951 - DNA, 22 bp, Homo sapiens
gcccagctgtagccatggctca

SEQ ID NO: 2146952 - DNA, 23 bp, Homo sapiens
gcccagctgtagccatggctcag

SEQ ID NO: 2146953 - DNA, 21 bp, Homo sapiens
gcccaggagagccagccctcc

SEQ ID NO: 2146954 - DNA, 22 bp, Homo sapiens
gcccaggagtttgaggctgcag

SEQ ID NO: 2146955 - DNA, 13 bp, Homo sapiens
gcccaggcaggtc

SEQ ID NO: 2146956 - DNA, 14 bp, Homo sapiens
gcccaggcaggtct

SEQ ID NO: 2146957 - DNA, 11 bp, Homo sapiens
gcccaggcccc

SEQ ID NO: 2146958 - DNA, 21 bp, Homo sapiens
gcccaggcccctgccaccctg

SEQ ID NO: 2146959 - DNA, 23 bp, Homo sapiens
gcccaggcccctgccaccctggg

SEQ ID NO: 2146960 - DNA, 21 bp, Homo sapiens
gcccaggccgttccccttggc

SEQ ID NO: 2146961 - DNA, 13 bp, Homo sapiens
gcccaggcctcca

SEQ ID NO: 2146962 - DNA, 17 bp, Homo sapiens
gcccaggcctgcctgtt

SEQ ID NO: 2146963 - DNA, 14 bp, Homo sapiens
gcccaggctctggg

SEQ ID NO: 2146964 - DNA, 15 bp, Homo sapiens
gcccaggctgaagag

SEQ ID NO: 2146965 - DNA, 11 bp, Homo sapiens
gcccaggctgg

SEQ ID NO: 2146966 - DNA, 12 bp, Homo sapiens
gcccaggctggc

SEQ ID NO: 2146967 - DNA, 15 bp, Homo sapiens
gcccaggctggcgtg

SEQ ID NO: 2146968 - DNA, 12 bp, Homo sapiens
gcccagggctca

SEQ ID NO: 2146969 - DNA, 18 bp, Homo sapiens
gcccagggctcagcctgg

SEQ ID NO: 2146970 - DNA, 19 bp, Homo sapiens
gcccaggggcccacaggga

SEQ ID NO: 2146971 - DNA, 17 bp, Homo sapiens
gcccagggtaggggagg

SEQ ID NO: 2146972 - DNA, 21 bp, Homo sapiens
gcccagggtaggggagggtgg

SEQ ID NO: 2146973 - DNA, 16 bp, Homo sapiens
gcccaggtcctctgat

SEQ ID NO: 2146974 - DNA, 22 bp, Homo sapiens
gcccagtcattgggttttatca

SEQ ID NO: 2146975 - DNA, 20 bp, Homo sapiens
gcccagtctggaatgcagtg

SEQ ID NO: 2146976 - DNA, 21 bp, Homo sapiens
gcccagttgggtggatgcctg

SEQ ID NO: 2146977 - DNA, 20 bp, Homo sapiens
gcccataaggccagaaactc

SEQ ID NO: 2146978 - DNA, 22 bp, Homo sapiens
gcccataatagttagccctcag

SEQ ID NO: 2146979 - DNA, 16 bp, Homo sapiens
gcccatacccctgcct

SEQ ID NO: 2146980 - DNA, 19 bp, Homo sapiens
gcccatacccctgcctggg

SEQ ID NO: 2146981 - DNA, 15 bp, Homo sapiens
gcccataccttctgg

SEQ ID NO: 2146982 - DNA, 21 bp, Homo sapiens
gcccatagaaacatgacactg

SEQ ID NO: 2146983 - DNA, 15 bp, Homo sapiens
gcccatgctttccca

SEQ ID NO: 2146984 - DNA, 14 bp, Homo sapiens
gcccatggagcagg

SEQ ID NO: 2146985 - DNA, 18 bp, Homo sapiens
gcccatgtgtcccctcac

SEQ ID NO: 2146986 - DNA, 17 bp, Homo sapiens
gcccatgtgttccctct

SEQ ID NO: 2146987 - DNA, 17 bp, Homo sapiens
gcccattcgtctgtccc

SEQ ID NO: 2146988 - DNA, 20 bp, Homo sapiens
gcccattcgtctgtcccaga

SEQ ID NO: 2146989 - DNA, 17 bp, Homo sapiens
gcccattctctctcctg

SEQ ID NO: 2146990 - DNA, 14 bp, Homo sapiens
gccccaaaccaggg

SEQ ID NO: 2146991 - DNA, 22 bp, Homo sapiens
gccccaactattaaagtgccat

SEQ ID NO: 2146992 - DNA, 22 bp, Homo sapiens
gccccaactcctggaagctgtg

SEQ ID NO: 2146993 - DNA, 14 bp, Homo sapiens
gccccaaggggccc

SEQ ID NO: 2146994 - DNA, 17 bp, Homo sapiens
gccccaaggggcccaca

SEQ ID NO: 2146995 - DNA, 15 bp, Homo sapiens
gccccacagcaccca

SEQ ID NO: 2146996 - DNA, 18 bp, Homo sapiens
gccccacagcacccaggc

SEQ ID NO: 2146997 - DNA, 19 bp, Homo sapiens
gccccacagcacccaggct

SEQ ID NO: 2146998 - DNA, 18 bp, Homo sapiens
gccccaccacctaggcca

SEQ ID NO: 2146999 - DNA, 20 bp, Homo sapiens
gccccaccacctaggccact

SEQ ID NO: 2147000 - DNA, 18 bp, Homo sapiens
gccccaccagccacctct

SEQ ID NO: 2147001 - DNA, 15 bp, Homo sapiens
gccccacccagggct

SEQ ID NO: 2147002 - DNA, 17 bp, Homo sapiens
gccccacccccatgcag

SEQ ID NO: 2147003 - DNA, 23 bp, Homo sapiens
gccccaccctcgtggacacctgc

SEQ ID NO: 2147004 - DNA, 23 bp, Homo sapiens
gccccacctacttgtgactgaag

SEQ ID NO: 2147005 - DNA, 18 bp, Homo sapiens
gccccacctttaagtcct

SEQ ID NO: 2147006 - DNA, 18 bp, Homo sapiens
gccccagaaggcagggaa

SEQ ID NO: 2147007 - DNA, 14 bp, Homo sapiens
gccccagacacacc

SEQ ID NO: 2147008 - DNA, 12 bp, Homo sapiens
gccccagagccc

SEQ ID NO: 2147009 - DNA, 15 bp, Homo sapiens
gccccagaggcctct

SEQ ID NO: 2147010 - DNA, 20 bp, Homo sapiens
gccccagatcaccagcccgg

SEQ ID NO: 2147011 - DNA, 15 bp, Homo sapiens
gccccagatctgcct

SEQ ID NO: 2147012 - DNA, 17 bp, Homo sapiens
gccccagatctgcctgg

SEQ ID NO: 2147013 - DNA, 21 bp, Homo sapiens
gccccagatctgcctgggcct

SEQ ID NO: 2147014 - DNA, 22 bp, Homo sapiens
gccaggagggacaaaggagcct

SEQ ID NO: 2147015 - DNA, 14 bp, Homo sapiens
gccaggagtctgtg

SEQ ID NO: 2147016 - DNA, 15 bp, Homo sapiens
gccaggagtctgtgc

SEQ ID NO: 2147017 - DNA, 16 bp, Homo sapiens
gccaggagtctgtgct

SEQ ID NO: 2147018 - DNA, 20 bp, Homo sapiens
gccaggcaccccctggagag

SEQ ID NO: 2147019 - DNA, 21 bp, Homo sapiens
gccaggcaccccctggagaga

SEQ ID NO: 2147020 - DNA, 15 bp, Homo sapiens
gccaggcacctggcc

SEQ ID NO: 2147021 - DNA, 16 bp, Homo sapiens
gccaggcacctggcct

SEQ ID NO: 2147022 - DNA, 12 bp, Homo sapiens
gccaggccagag

SEQ ID NO: 2147023 - DNA, 22 bp, Homo sapiens
gccaggccagagggagtgacag

SEQ ID NO: 2147024 - DNA, 19 bp, Homo sapiens
gccaggcccatctcaggtg

SEQ ID NO: 2147025 - DNA, 21 bp, Homo sapiens
gccaggcccatctcaggtgcc

SEQ ID NO: 2147026 - DNA, 22 bp, Homo sapiens
gccaggcccatctcaggtgcca

SEQ ID NO: 2147027 - DNA, 23 bp, Homo sapiens
gccaggcccatctcaggtgccac

SEQ ID NO: 2147028 - DNA, 17 bp, Homo sapiens
gccaggcgttggtgcca

SEQ ID NO: 2147029 - DNA, 19 bp, Homo sapiens
gccaggctagactaggagg

SEQ ID NO: 2147030 - DNA, 13 bp, Homo sapiens
gccaggctctgcc

SEQ ID NO: 2147031 - DNA, 15 bp, Homo sapiens
gccaggctctgcctg

SEQ ID NO: 2147032 - DNA, 15 bp, Homo sapiens
gccaggctggtctca

SEQ ID NO: 2147033 - DNA, 15 bp, Homo sapiens
gccaggctgtaagca

SEQ ID NO: 2147034 - DNA, 13 bp, Homo sapiens
gccagggccctgc

SEQ ID NO: 2147035 - DNA, 19 bp, Homo sapiens
gccagggccctgcagaggg

SEQ ID NO: 2147036 - DNA, 13 bp, Homo sapiens
gccagggcctggt

SEQ ID NO: 2147037 - DNA, 10 bp, Homo sapiens
gccagggctc

SEQ ID NO: 2147038 - DNA, 17 bp, Homo sapiens
gccagggctcgggcgct

SEQ ID NO: 2147039 - DNA, 21 bp, Homo sapiens
gccaggggtctccctggagtg

SEQ ID NO: 2147040 - DNA, 17 bp, Homo sapiens
gccagggtcctgagtgg

SEQ ID NO: 2147041 - DNA, 16 bp, Homo sapiens
gccagggtgagagctg

SEQ ID NO: 2147042 - DNA, 17 bp, Homo sapiens
gccaggtttttggtctg

SEQ ID NO: 2147043 - DNA, 23 bp, Homo sapiens
gccagtacagagaaattctgtgg

SEQ ID NO: 2147044 - DNA, 14 bp, Homo sapiens
gccagtcctagagc

SEQ ID NO: 2147045 - DNA, 15 bp, Homo sapiens
gccagtcctagagct

SEQ ID NO: 2147046 - DNA, 24 bp, Homo sapiens
gccagtcctagagctcctgtccct

SEQ ID NO: 2147047 - DNA, 13 bp, Homo sapiens
gccagtctgggct

SEQ ID NO: 2147048 - DNA, 16 bp, Homo sapiens
gccagtctgggctgcc

SEQ ID NO: 2147049 - DNA, 17 bp, Homo sapiens
gccagtctgggctgccg

SEQ ID NO: 2147050 - DNA, 23 bp, Homo sapiens
gccagtcttgcctaggccaaatg

SEQ ID NO: 2147051 - DNA, 13 bp, Homo sapiens
gccagtcttgtgt

SEQ ID NO: 2147052 - DNA, 15 bp, Homo sapiens
gccagtgactttttc

SEQ ID NO: 2147053 - DNA, 19 bp, Homo sapiens
gccagtgactttttctgag

SEQ ID NO: 2147054 - DNA, 14 bp, Homo sapiens
gccagtgagggctg

SEQ ID NO: 2147055 - DNA, 20 bp, Homo sapiens
gccagtgagggctgggccca

SEQ ID NO: 2147056 - DNA, 21 bp, Homo sapiens
gccagtgagggctgggcccac

SEQ ID NO: 2147057 - DNA, 13 bp, Homo sapiens
gccagtgccagga

SEQ ID NO: 2147058 - DNA, 14 bp, Homo sapiens
gccagtgccaggac

SEQ ID NO: 2147059 - DNA, 15 bp, Homo sapiens
gccagtgccaggaca

SEQ ID NO: 2147060 - DNA, 18 bp, Homo sapiens
gccagtgccaggacagct

SEQ ID NO: 2147061 - DNA, 19 bp, Homo sapiens
gccagtgccttacctcctg

SEQ ID NO: 2147062 - DNA, 20 bp, Homo sapiens
gccagtgccttacctcctgc

SEQ ID NO: 2147063 - DNA, 21 bp, Homo sapiens
gccagtgccttacctcctgcc

SEQ ID NO: 2147064 - DNA, 22 bp, Homo sapiens
gccagtgccttacctcctgccc

SEQ ID NO: 2147065 - DNA, 20 bp, Homo sapiens
gccagtgtgatcccaagtgc

SEQ ID NO: 2147066 - DNA, 21 bp, Homo sapiens
gccagtgtttagaagagcctg

SEQ ID NO: 2147067 - DNA, 22 bp, Homo sapiens
gccagtgtttagaagagcctga

SEQ ID NO: 2147068 - DNA, 22 bp, Homo sapiens
gccagttatggctataggtgct

SEQ ID NO: 2147069 - DNA, 20 bp, Homo sapiens
gccagtttgcttagttctca

SEQ ID NO: 2147070 - DNA, 18 bp, Homo sapiens
gccatacattaaggagca

SEQ ID NO: 2147071 - DNA, 15 bp, Homo sapiens
gccatatttatagaa

SEQ ID NO: 2147072 - DNA, 17 bp, Homo sapiens
gccatcaacaagagttg

SEQ ID NO: 2147073 - DNA, 22 bp, Homo sapiens
gccatcagggtgggccactctc

SEQ ID NO: 2147074 - DNA, 24 bp, Homo sapiens
gccatcagggtgggccactctccc

SEQ ID NO: 2147075 - DNA, 16 bp, Homo sapiens
gccatcatgtgcctgg

SEQ ID NO: 2147076 - DNA, 13 bp, Homo sapiens
gccatcccacatt

SEQ ID NO: 2147077 - DNA, 17 bp, Homo sapiens
gccatcccgtcttctcc

SEQ ID NO: 2147078 - DNA, 16 bp, Homo sapiens
gccatccctgggcccc

SEQ ID NO: 2147079 - DNA, 15 bp, Homo sapiens
gccatccgggacgct

SEQ ID NO: 2147080 - DNA, 16 bp, Homo sapiens
gccatccgggacgctt

SEQ ID NO: 2147081 - DNA, 18 bp, Homo sapiens
gccatccgggacgcttcc

SEQ ID NO: 2147082 - DNA, 20 bp, Homo sapiens
gccatccgggacgcttccag

SEQ ID NO: 2147083 - DNA, 21 bp, Homo sapiens
gccatccgggacgcttccaga

SEQ ID NO: 2147084 - DNA, 12 bp, Homo sapiens
gccatccttcac

SEQ ID NO: 2147085 - DNA, 14 bp, Homo sapiens
gccatctgttttca

SEQ ID NO: 2147086 - DNA, 16 bp, Homo sapiens
gccatctgttttcaac

SEQ ID NO: 2147087 - DNA, 22 bp, Homo sapiens
gccatgatctgtatttaatggt

SEQ ID NO: 2147088 - DNA, 21 bp, Homo sapiens
gccatgatggtgctgacctct

SEQ ID NO: 2147089 - DNA, 14 bp, Homo sapiens
gccatgccaccctg

SEQ ID NO: 2147090 - DNA, 15 bp, Homo sapiens
gccatgccactgcca

SEQ ID NO: 2147091 - DNA, 23 bp, Homo sapiens
gccatgccactgccaggcacctg

SEQ ID NO: 2147092 - DNA, 15 bp, Homo sapiens
gccatgcccagagaa

SEQ ID NO: 2147093 - DNA, 15 bp, Homo sapiens
gccatgctgaaggga

SEQ ID NO: 2147094 - DNA, 13 bp, Homo sapiens
gccatgcttcttg

SEQ ID NO: 2147095 - DNA, 15 bp, Homo sapiens
gccatgcttcttgcc

SEQ ID NO: 2147096 - DNA, 16 bp, Homo sapiens
gccatgcttcttgccc

SEQ ID NO: 2147097 - DNA, 18 bp, Homo sapiens
gccatgcttcttgcccct

SEQ ID NO: 2147098 - DNA, 21 bp, Homo sapiens
gccatgcttcttgccccttgg

SEQ ID NO: 2147099 - DNA, 18 bp, Homo sapiens
gccatgctttccttttct

SEQ ID NO: 2147100 - DNA, 13 bp, Homo sapiens
gccatggctcagg

SEQ ID NO: 2147101 - DNA, 18 bp, Homo sapiens
gccatggctcaggcaagc

SEQ ID NO: 2147102 - DNA, 22 bp, Homo sapiens
gccatggctcaggcaagcccct

SEQ ID NO: 2147103 - DNA, 15 bp, Homo sapiens
gccatgggcctgctg

SEQ ID NO: 2147104 - DNA, 15 bp, Homo sapiens
gccatgggcctgggc

SEQ ID NO: 2147105 - DNA, 17 bp, Homo sapiens
gccatgggcctgggcct

SEQ ID NO: 2147106 - DNA, 19 bp, Homo sapiens
gccatgtcgcctgccccca

SEQ ID NO: 2147107 - DNA, 15 bp, Homo sapiens
gccatgtggagtgga

SEQ ID NO: 2147108 - DNA, 18 bp, Homo sapiens
gccatgttaattaaactg

SEQ ID NO: 2147109 - DNA, 16 bp, Homo sapiens
gccatgttggccaggc

SEQ ID NO: 2147110 - DNA, 20 bp, Homo sapiens
gccatgttggccaggctggt

SEQ ID NO: 2147111 - DNA, 24 bp, Homo sapiens
gccatgttggccaggctggtctca

SEQ ID NO: 2147112 - DNA, 22 bp, Homo sapiens
gccattccaagtcaacactctt

SEQ ID NO: 2147113 - DNA, 23 bp, Homo sapiens
gccccagatctgcctgggcctgt

SEQ ID NO: 2147114 - DNA, 12 bp, Homo sapiens
gccccagcacta

SEQ ID NO: 2147115 - DNA, 19 bp, Homo sapiens
gccccagcactaaagcagt

SEQ ID NO: 2147116 - DNA, 23 bp, Homo sapiens
gccccagcactaaagcagtggac

SEQ ID NO: 2147117 - DNA, 16 bp, Homo sapiens
gccccagcccccacct

SEQ ID NO: 2147118 - DNA, 14 bp, Homo sapiens
gccccagcgcggct

SEQ ID NO: 2147119 - DNA, 16 bp, Homo sapiens
gccccagcgcggcttg

SEQ ID NO: 2147120 - DNA, 13 bp, Homo sapiens
gccccagctctgg

SEQ ID NO: 2147121 - DNA, 11 bp, Homo sapiens
gccccaggccc

SEQ ID NO: 2147122 - DNA, 13 bp, Homo sapiens
gccccagggcctg

SEQ ID NO: 2147123 - DNA, 16 bp, Homo sapiens
gccccagggctaccct

SEQ ID NO: 2147124 - DNA, 18 bp, Homo sapiens
gccccagggctaccctcc

SEQ ID NO: 2147125 - DNA, 13 bp, Homo sapiens
gccccaggggtgc

SEQ ID NO: 2147126 - DNA, 13 bp, Homo sapiens
gccccaggtgcca

SEQ ID NO: 2147127 - DNA, 21 bp, Homo sapiens
gccccaggtgccaccaataaa

SEQ ID NO: 2147128 - DNA, 22 bp, Homo sapiens
gccccagtagtcagaagcaggt

SEQ ID NO: 2147129 - DNA, 13 bp, Homo sapiens
gccccatcctggg

SEQ ID NO: 2147130 - DNA, 15 bp, Homo sapiens
gccccatgacctcca

SEQ ID NO: 2147131 - DNA, 16 bp, Homo sapiens
gccccatgacctccag

SEQ ID NO: 2147132 - DNA, 16 bp, Homo sapiens
gccccatgctctgccc

SEQ ID NO: 2147133 - DNA, 18 bp, Homo sapiens
gccccatgctctgcccca

SEQ ID NO: 2147134 - DNA, 20 bp, Homo sapiens
gccccatgctctgccccaag

SEQ ID NO: 2147135 - DNA, 22 bp, Homo sapiens
gccccatgctctgccccaagcc

SEQ ID NO: 2147136 - DNA, 18 bp, Homo sapiens
gccccatgtctctcagaa

SEQ ID NO: 2147137 - DNA, 18 bp, Homo sapiens
gccccattctgcctgccc

SEQ ID NO: 2147138 - DNA, 21 bp, Homo sapiens
gccccattctgcctgcccagg

SEQ ID NO: 2147139 - DNA, 20 bp, Homo sapiens
gcccccaaccccgcggtgct

SEQ ID NO: 2147140 - DNA, 13 bp, Homo sapiens
gcccccacaggcc

SEQ ID NO: 2147141 - DNA, 13 bp, Homo sapiens
gcccccacccagt

SEQ ID NO: 2147142 - DNA, 16 bp, Homo sapiens
gcccccacctggctca

SEQ ID NO: 2147143 - DNA, 16 bp, Homo sapiens
gcccccagcctctgtc

SEQ ID NO: 2147144 - DNA, 21 bp, Homo sapiens
gcccccatccctcggacccac

SEQ ID NO: 2147145 - DNA, 15 bp, Homo sapiens
gcccccatctcccca

SEQ ID NO: 2147146 - DNA, 19 bp, Homo sapiens
gcccccatctccccaggcc

SEQ ID NO: 2147147 - DNA, 21 bp, Homo sapiens
gcccccatctccccaggcctc

SEQ ID NO: 2147148 - DNA, 21 bp, Homo sapiens
gccccccctcttttggccttg

SEQ ID NO: 2147149 - DNA, 22 bp, Homo sapiens
gccccccctcttttggccttgt

SEQ ID NO: 2147150 - DNA, 20 bp, Homo sapiens
gccccccgcagcaccctgca

SEQ ID NO: 2147151 - DNA, 12 bp, Homo sapiens
gcccccctccag

SEQ ID NO: 2147152 - DNA, 16 bp, Homo sapiens
gcccccctccttgctc

SEQ ID NO: 2147153 - DNA, 20 bp, Homo sapiens
gcccccctccttgctctgca

SEQ ID NO: 2147154 - DNA, 20 bp, Homo sapiens
gcccccgacagcccagccta

SEQ ID NO: 2147155 - DNA, 23 bp, Homo sapiens
gccccctcatctcactgcccagt

SEQ ID NO: 2147156 - DNA, 12 bp, Homo sapiens
gccccctggatg

SEQ ID NO: 2147157 - DNA, 22 bp, Homo sapiens
gccccctggtggacagtcctgg

SEQ ID NO: 2147158 - DNA, 13 bp, Homo sapiens
gccccctgtgcca

SEQ ID NO: 2147159 - DNA, 14 bp, Homo sapiens
gccccctgtgccag

SEQ ID NO: 2147160 - DNA, 17 bp, Homo sapiens
gccccgactccagccag

SEQ ID NO: 2147161 - DNA, 21 bp, Homo sapiens
gccccgactccagccagcgcc

SEQ ID NO: 2147162 - DNA, 14 bp, Homo sapiens
gccccgccctctgc

SEQ ID NO: 2147163 - DNA, 17 bp, Homo sapiens
gccccgcgcctccttcc

SEQ ID NO: 2147164 - DNA, 23 bp, Homo sapiens
gccccgctgggatttcttcgctg

SEQ ID NO: 2147165 - DNA, 14 bp, Homo sapiens
gccccgggcctgcc

SEQ ID NO: 2147166 - DNA, 24 bp, Homo sapiens
gccccgggcctgcctctgactcac

SEQ ID NO: 2147167 - DNA, 20 bp, Homo sapiens
gccccgggctctggccaccc

SEQ ID NO: 2147168 - DNA, 21 bp, Homo sapiens
gccccgggctctggccaccct

SEQ ID NO: 2147169 - DNA, 15 bp, Homo sapiens
gccccggggctggca

SEQ ID NO: 2147170 - DNA, 16 bp, Homo sapiens
gccccggggctggcaa

SEQ ID NO: 2147171 - DNA, 15 bp, Homo sapiens
gccccgggtccccag

SEQ ID NO: 2147172 - DNA, 18 bp, Homo sapiens
gccccgggtccccagctc

SEQ ID NO: 2147173 - DNA, 17 bp, Homo sapiens
gccccgggtgcctcaga

SEQ ID NO: 2147174 - DNA, 18 bp, Homo sapiens
gccccgggtgcctcagag

SEQ ID NO: 2147175 - DNA, 23 bp, Homo sapiens
gccccgggtgcctcagagcaggc

SEQ ID NO: 2147176 - DNA, 22 bp, Homo sapiens
gccccggtcctggccccagccc

SEQ ID NO: 2147177 - DNA, 15 bp, Homo sapiens
gccccgttccctgtc

SEQ ID NO: 2147178 - DNA, 17 bp, Homo sapiens
gccccgttccctgtcag

SEQ ID NO: 2147179 - DNA, 15 bp, Homo sapiens
gcccctcaccccaag

SEQ ID NO: 2147180 - DNA, 16 bp, Homo sapiens
gcccctcaccccaagg

SEQ ID NO: 2147181 - DNA, 20 bp, Homo sapiens
gcccctcacctgcctgccct

SEQ ID NO: 2147182 - DNA, 17 bp, Homo sapiens
gcccctcacctgggcct

SEQ ID NO: 2147183 - DNA, 20 bp, Homo sapiens
gcccctcacctgggcctttc

SEQ ID NO: 2147184 - DNA, 16 bp, Homo sapiens
gcccctcagagaggca

SEQ ID NO: 2147185 - DNA, 17 bp, Homo sapiens
gcccctcagagaggcat

SEQ ID NO: 2147186 - DNA, 16 bp, Homo sapiens
gcccctcagcccttgc

SEQ ID NO: 2147187 - DNA, 18 bp, Homo sapiens
gcccctccagaccctgcc

SEQ ID NO: 2147188 - DNA, 17 bp, Homo sapiens
gcccctccccagccctt

SEQ ID NO: 2147189 - DNA, 14 bp, Homo sapiens
gcccctccctctgc

SEQ ID NO: 2147190 - DNA, 12 bp, Homo sapiens
gcccctcccttc

SEQ ID NO: 2147191 - DNA, 15 bp, Homo sapiens
gcccctcctcccctt

SEQ ID NO: 2147192 - DNA, 13 bp, Homo sapiens
gcccctcctctgc

SEQ ID NO: 2147193 - DNA, 16 bp, Homo sapiens
gcccctcctctgccac

SEQ ID NO: 2147194 - DNA, 18 bp, Homo sapiens
gcccctcctctgccacct

SEQ ID NO: 2147195 - DNA, 20 bp, Homo sapiens
gcccctcctctgccacctcc

SEQ ID NO: 2147196 - DNA, 22 bp, Homo sapiens
gcccctctccaaacaccggcag

SEQ ID NO: 2147197 - DNA, 16 bp, Homo sapiens
gcccctgaggactgga

SEQ ID NO: 2147198 - DNA, 20 bp, Homo sapiens
gcccctgcatccccttggct

SEQ ID NO: 2147199 - DNA, 23 bp, Homo sapiens
gcccctgcatccccttggctgtg

SEQ ID NO: 2147200 - DNA, 14 bp, Homo sapiens
gcccctgccaccct

SEQ ID NO: 2147201 - DNA, 14 bp, Homo sapiens
gcccctgccccaac

SEQ ID NO: 2147202 - DNA, 15 bp, Homo sapiens
gcccctgccccaacc

SEQ ID NO: 2147203 - DNA, 13 bp, Homo sapiens
gcccctgcccggc

SEQ ID NO: 2147204 - DNA, 15 bp, Homo sapiens
gcccctgctggttca

SEQ ID NO: 2147205 - DNA, 16 bp, Homo sapiens
gcccctggtcctgagg

SEQ ID NO: 2147206 - DNA, 17 bp, Homo sapiens
gcccctggtctgccctg

SEQ ID NO: 2147207 - DNA, 11 bp, Homo sapiens
gcccctgtaaa

SEQ ID NO: 2147208 - DNA, 18 bp, Homo sapiens
gcccctgtgtgagttgag

SEQ ID NO: 2147209 - DNA, 20 bp, Homo sapiens
gccccttaagggttgaaggc

SEQ ID NO: 2147210 - DNA, 20 bp, Homo sapiens
gccccttactatgatctcag

SEQ ID NO: 2147211 - DNA, 10 bp, Homo sapiens
gccccttcca

SEQ ID NO: 2147212 - DNA, 18 bp, Homo sapiens
gccccttctgtttccata

SEQ ID NO: 2147213 - DNA, 20 bp, Homo sapiens
gccccttgctctcccctgcc

SEQ ID NO: 2147214 - DNA, 13 bp, Homo sapiens
gccccttgggcat

SEQ ID NO: 2147215 - DNA, 13 bp, Homo sapiens
gcccgaaagctga

SEQ ID NO: 2147216 - DNA, 14 bp, Homo sapiens
gcccgaatgcctgt

SEQ ID NO: 2147217 - DNA, 15 bp, Homo sapiens
gcccgacagagagat

SEQ ID NO: 2147218 - DNA, 19 bp, Homo sapiens
gcccgacagagagatgaag

SEQ ID NO: 2147219 - DNA, 14 bp, Homo sapiens
gcccgaccccatct

SEQ ID NO: 2147220 - DNA, 14 bp, Homo sapiens
gcccgactagcagg

SEQ ID NO: 2147221 - DNA, 23 bp, Homo sapiens
gcccgagcagctgagcagggccg

SEQ ID NO: 2147222 - DNA, 18 bp, Homo sapiens
gcccgagggcctgacagg

SEQ ID NO: 2147223 - DNA, 12 bp, Homo sapiens
gcccgcagagcc

SEQ ID NO: 2147224 - DNA, 16 bp, Homo sapiens
gcccgccagcctcagt

SEQ ID NO: 2147225 - DNA, 23 bp, Homo sapiens
gcccggagtaatcaggcagcctt

SEQ ID NO: 2147226 - DNA, 14 bp, Homo sapiens
gcccggcccagcct

SEQ ID NO: 2147227 - DNA, 20 bp, Homo sapiens
gcccggccccatcagaggct

SEQ ID NO: 2147228 - DNA, 22 bp, Homo sapiens
gcccggcctgctcccagcagcc

SEQ ID NO: 2147229 - DNA, 13 bp, Homo sapiens
gcccggctccagg

SEQ ID NO: 2147230 - DNA, 19 bp, Homo sapiens
gcaggaacgagcactggcc

SEQ ID NO: 2147231 - DNA, 22 bp, Homo sapiens
gcaggaacgagcactggccaga

SEQ ID NO: 2147232 - DNA, 13 bp, Homo sapiens
gcaggaagccagg

SEQ ID NO: 2147233 - DNA, 23 bp, Homo sapiens
gcaggaaggactatgaaaagcta

SEQ ID NO: 2147234 - DNA, 17 bp, Homo sapiens
gcaggaaggatggcaag

SEQ ID NO: 2147235 - DNA, 20 bp, Homo sapiens
gcaggacacatcccggcctc

SEQ ID NO: 2147236 - DNA, 12 bp, Homo sapiens
gcaggaccagga

SEQ ID NO: 2147237 - DNA, 15 bp, Homo sapiens
gcaggaggcctggcc

SEQ ID NO: 2147238 - DNA, 15 bp, Homo sapiens
gcaggagtagctgag

SEQ ID NO: 2147239 - DNA, 17 bp, Homo sapiens
gcaggagtagctgagct

SEQ ID NO: 2147240 - DNA, 19 bp, Homo sapiens
gcaggagtagctgagctca

SEQ ID NO: 2147241 - DNA, 19 bp, Homo sapiens
gcaggcacacagcagcccc

SEQ ID NO: 2147242 - DNA, 20 bp, Homo sapiens
gcaggcaccttagtggcttt

SEQ ID NO: 2147243 - DNA, 20 bp, Homo sapiens
gcaggcagagcggggaggtg

SEQ ID NO: 2147244 - DNA, 23 bp, Homo sapiens
gcaggcagagcggggaggtgcct

SEQ ID NO: 2147245 - DNA, 13 bp, Homo sapiens
gcaggcagggctc

SEQ ID NO: 2147246 - DNA, 16 bp, Homo sapiens
gcaggcagggctctcc

SEQ ID NO: 2147247 - DNA, 20 bp, Homo sapiens
gcaggccaagagcagaggca

SEQ ID NO: 2147248 - DNA, 20 bp, Homo sapiens
gcaggccaagtcaggccctt

SEQ ID NO: 2147249 - DNA, 16 bp, Homo sapiens
gcaggcccgacagaga

SEQ ID NO: 2147250 - DNA, 14 bp, Homo sapiens
gcaggccctgcctt

SEQ ID NO: 2147251 - DNA, 21 bp, Homo sapiens
gcaggcctaggacctcaggcg

SEQ ID NO: 2147252 - DNA, 12 bp, Homo sapiens
gcaggcctggga

SEQ ID NO: 2147253 - DNA, 13 bp, Homo sapiens
gcaggcctgggac

SEQ ID NO: 2147254 - DNA, 14 bp, Homo sapiens
gcaggcctgggacc

SEQ ID NO: 2147255 - DNA, 23 bp, Homo sapiens
gcaggctccccctgcctttgaaa

SEQ ID NO: 2147256 - DNA, 12 bp, Homo sapiens
gcaggctctggg

SEQ ID NO: 2147257 - DNA, 13 bp, Homo sapiens
gcaggctctgggc

SEQ ID NO: 2147258 - DNA, 20 bp, Homo sapiens
gcaggctctgggctcagggc

SEQ ID NO: 2147259 - DNA, 21 bp, Homo sapiens
gcaggctctgggctcagggct

SEQ ID NO: 2147260 - DNA, 23 bp, Homo sapiens
gcaggctctgggctcagggctgg

SEQ ID NO: 2147261 - DNA, 12 bp, Homo sapiens
gcaggctgattt

SEQ ID NO: 2147262 - DNA, 17 bp, Homo sapiens
gcaggctgatttctagg

SEQ ID NO: 2147263 - DNA, 22 bp, Homo sapiens
gcagggaaacagctaatgggac

SEQ ID NO: 2147264 - DNA, 14 bp, Homo sapiens
gcagggacaccccc

SEQ ID NO: 2147265 - DNA, 15 bp, Homo sapiens
gcagggacacccccc

SEQ ID NO: 2147266 - DNA, 15 bp, Homo sapiens
gcagggacagagatg

SEQ ID NO: 2147267 - DNA, 23 bp, Homo sapiens
gcagggaggatgccacagcccca

SEQ ID NO: 2147268 - DNA, 15 bp, Homo sapiens
gcagggaggggacta

SEQ ID NO: 2147269 - DNA, 19 bp, Homo sapiens
gcagggatgataggccctg

SEQ ID NO: 2147270 - DNA, 12 bp, Homo sapiens
gcccgggacagg

SEQ ID NO: 2147271 - DNA, 20 bp, Homo sapiens
gcccgggtgtgcctgccctg

SEQ ID NO: 2147272 - DNA, 18 bp, Homo sapiens
gcccgtcatgttcctcaa

SEQ ID NO: 2147273 - DNA, 14 bp, Homo sapiens
gcccgtcttcagcc

SEQ ID NO: 2147274 - DNA, 15 bp, Homo sapiens
gcccgtcttcagcct

SEQ ID NO: 2147275 - DNA, 17 bp, Homo sapiens
gcccgtgcagtacaggc

SEQ ID NO: 2147276 - DNA, 18 bp, Homo sapiens
gcccgtgcagtacaggca

SEQ ID NO: 2147277 - DNA, 16 bp, Homo sapiens
gcccgtgtcctgcctt

SEQ ID NO: 2147278 - DNA, 21 bp, Homo sapiens
gccctaacgggggtgcggcag

SEQ ID NO: 2147279 - DNA, 23 bp, Homo sapiens
gccctaacgggggtgcggcagga

SEQ ID NO: 2147280 - DNA, 13 bp, Homo sapiens
gccctagagcaca

SEQ ID NO: 2147281 - DNA, 23 bp, Homo sapiens
gccctaggattcctcccccagag

SEQ ID NO: 2147282 - DNA, 15 bp, Homo sapiens
gccctatttttgcaa

SEQ ID NO: 2147283 - DNA, 17 bp, Homo sapiens
gccctatttttgcaatg

SEQ ID NO: 2147284 - DNA, 16 bp, Homo sapiens
gccctcaaaagcactt

SEQ ID NO: 2147285 - DNA, 12 bp, Homo sapiens
gccctcagaaca

SEQ ID NO: 2147286 - DNA, 19 bp, Homo sapiens
gccctcaggccagtgccag

SEQ ID NO: 2147287 - DNA, 20 bp, Homo sapiens
gccctcaggccagtgccagg

SEQ ID NO: 2147288 - DNA, 21 bp, Homo sapiens
gccctcagtcagttcccggag

SEQ ID NO: 2147289 - DNA, 22 bp, Homo sapiens
gccctcagtcagttcccggagc

SEQ ID NO: 2147290 - DNA, 23 bp, Homo sapiens
gccctcagtcagttcccggagca

SEQ ID NO: 2147291 - DNA, 14 bp, Homo sapiens
gccctccacagccg

SEQ ID NO: 2147292 - DNA, 20 bp, Homo sapiens
gccctccacagccgcagcct

SEQ ID NO: 2147293 - DNA, 23 bp, Homo sapiens
gccctccacagccgcagcctccc

SEQ ID NO: 2147294 - DNA, 17 bp, Homo sapiens
gccctccctgactccct

SEQ ID NO: 2147295 - DNA, 19 bp, Homo sapiens
gccctccctgactccctgt

SEQ ID NO: 2147296 - DNA, 23 bp, Homo sapiens
gccctccctgactccctgtgggg

SEQ ID NO: 2147297 - DNA, 18 bp, Homo sapiens
gccctccctggcatgtca

SEQ ID NO: 2147298 - DNA, 21 bp, Homo sapiens
gccctccctgtcctcctcgga

SEQ ID NO: 2147299 - DNA, 10 bp, Homo sapiens
gccctccttc

SEQ ID NO: 2147300 - DNA, 19 bp, Homo sapiens
gccctcgaaccaaggcagc

SEQ ID NO: 2147301 - DNA, 23 bp, Homo sapiens
gccctcgaaccaaggcagcctcc

SEQ ID NO: 2147302 - DNA, 16 bp, Homo sapiens
gccctctatttctctc

SEQ ID NO: 2147303 - DNA, 19 bp, Homo sapiens
gccctctcccatgcacaca

SEQ ID NO: 2147304 - DNA, 20 bp, Homo sapiens
gccctctcccatgcacacaa

SEQ ID NO: 2147305 - DNA, 11 bp, Homo sapiens
gccctctctga

SEQ ID NO: 2147306 - DNA, 18 bp, Homo sapiens
gccctctgcgtcccccag

SEQ ID NO: 2147307 - DNA, 20 bp, Homo sapiens
gccctctgcgtcccccagcc

SEQ ID NO: 2147308 - DNA, 13 bp, Homo sapiens
gccctgacctccc

SEQ ID NO: 2147309 - DNA, 17 bp, Homo sapiens
gccctgacctcccagcc

SEQ ID NO: 2147310 - DNA, 14 bp, Homo sapiens
gccctgagctcagg

SEQ ID NO: 2147311 - DNA, 18 bp, Homo sapiens
gccctgagctcaggctga

SEQ ID NO: 2147312 - DNA, 16 bp, Homo sapiens
gccctgagctcggtgg

SEQ ID NO: 2147313 - DNA, 22 bp, Homo sapiens
gccctgagtggatctccaagga

SEQ ID NO: 2147314 - DNA, 13 bp, Homo sapiens
gccctgcagaccc

SEQ ID NO: 2147315 - DNA, 14 bp, Homo sapiens
gccctgcagaccct

SEQ ID NO: 2147316 - DNA, 20 bp, Homo sapiens
gccctgccacctgtctgtct

SEQ ID NO: 2147317 - DNA, 20 bp, Homo sapiens
gccctgccccatcctgggcc

SEQ ID NO: 2147318 - DNA, 20 bp, Homo sapiens
gccctgcccccatctcccca

SEQ ID NO: 2147319 - DNA, 13 bp, Homo sapiens
gccctgcccctgc

SEQ ID NO: 2147320 - DNA, 17 bp, Homo sapiens
gccctgcccctgcccca

SEQ ID NO: 2147321 - DNA, 17 bp, Homo sapiens
gccctgccctgccacct

SEQ ID NO: 2147322 - DNA, 16 bp, Homo sapiens
gccctgcctccctttc

SEQ ID NO: 2147323 - DNA, 13 bp, Homo sapiens
gccctgcctgccc

SEQ ID NO: 2147324 - DNA, 20 bp, Homo sapiens
gccctgcctggaggacctga

SEQ ID NO: 2147325 - DNA, 21 bp, Homo sapiens
gccctgcctggaggacctgag

SEQ ID NO: 2147326 - DNA, 12 bp, Homo sapiens
gccctgccttca

SEQ ID NO: 2147327 - DNA, 14 bp, Homo sapiens
gccctgcggagacc

SEQ ID NO: 2147328 - DNA, 20 bp, Homo sapiens
gccctgcggagccggcacct

SEQ ID NO: 2147329 - DNA, 17 bp, Homo sapiens
gccctgcgttggagcca

SEQ ID NO: 2147330 - DNA, 21 bp, Homo sapiens
gccctgcgttggagccactcc

SEQ ID NO: 2147331 - DNA, 22 bp, Homo sapiens
gccctgcgttggagccactcct

SEQ ID NO: 2147332 - DNA, 23 bp, Homo sapiens
gccctgcgttggagccactcctg

SEQ ID NO: 2147333 - DNA, 14 bp, Homo sapiens
gccctgctctgggg

SEQ ID NO: 2147334 - DNA, 14 bp, Homo sapiens
gccctgctgtggga

SEQ ID NO: 2147335 - DNA, 20 bp, Homo sapiens
gccctggagtcccctgggcc

SEQ ID NO: 2147336 - DNA, 21 bp, Homo sapiens
gccctggatcagcgtggcctt

SEQ ID NO: 2147337 - DNA, 21 bp, Homo sapiens
gccctggatgtgcccacaggg

SEQ ID NO: 2147338 - DNA, 20 bp, Homo sapiens
gccctggcccagagctggaa

SEQ ID NO: 2147339 - DNA, 16 bp, Homo sapiens
gccctggcctgctggg

SEQ ID NO: 2147340 - DNA, 17 bp, Homo sapiens
gccctggcctgctgggc

SEQ ID NO: 2147341 - DNA, 20 bp, Homo sapiens
gccctgggaccgctacacca

SEQ ID NO: 2147342 - DNA, 22 bp, Homo sapiens
gccctgggaccgctacaccact

SEQ ID NO: 2147343 - DNA, 16 bp, Homo sapiens
gccctgggagggggct

SEQ ID NO: 2147344 - DNA, 20 bp, Homo sapiens
gccctgggcacccacctcca

SEQ ID NO: 2147345 - DNA, 18 bp, Homo sapiens
gccctgggccccaccacc

SEQ ID NO: 2147346 - DNA, 21 bp, Homo sapiens
gccctgggctgtctgtcacca

SEQ ID NO: 2147347 - DNA, 23 bp, Homo sapiens
gccctgggctgtctgtcaccagc

SEQ ID NO: 2147348 - DNA, 13 bp, Homo sapiens
gccctggggcctg

SEQ ID NO: 2147349 - DNA, 18 bp, Homo sapiens
gccctggggcctgtactg

SEQ ID NO: 2147350 - DNA, 15 bp, Homo sapiens
gccctgggggccagc

SEQ ID NO: 2147351 - DNA, 15 bp, Homo sapiens
gccctggtgctgcca

SEQ ID NO: 2147352 - DNA, 17 bp, Homo sapiens
gccctggtggcagtggg

SEQ ID NO: 2147353 - DNA, 23 bp, Homo sapiens
gccctggtggcagtgggagctgc

SEQ ID NO: 2147354 - DNA, 13 bp, Homo sapiens
gccctgtcccagc

SEQ ID NO: 2147355 - DNA, 18 bp, Homo sapiens
gccctgtcccagcagaag

SEQ ID NO: 2147356 - DNA, 14 bp, Homo sapiens
gccctgtcctccag

SEQ ID NO: 2147357 - DNA, 15 bp, Homo sapiens
gccctgtcctccagc

SEQ ID NO: 2147358 - DNA, 16 bp, Homo sapiens
gccctgtcgagacact

SEQ ID NO: 2147359 - DNA, 19 bp, Homo sapiens
gccctgtgaggctgggtcc

SEQ ID NO: 2147360 - DNA, 14 bp, Homo sapiens
gccctgttaaaaga

SEQ ID NO: 2147361 - DNA, 19 bp, Homo sapiens
gcccttagcagggaaacag

SEQ ID NO: 2147362 - DNA, 21 bp, Homo sapiens
gcccttccatgtcgcctctgc

SEQ ID NO: 2147363 - DNA, 22 bp, Homo sapiens
gcccttccatgtcgcctctgca

SEQ ID NO: 2147364 - DNA, 12 bp, Homo sapiens
gcccttcccact

SEQ ID NO: 2147365 - DNA, 16 bp, Homo sapiens
gcccttccctgctttg

SEQ ID NO: 2147366 - DNA, 22 bp, Homo sapiens
gcccttcctcctgaagcctctg

SEQ ID NO: 2147367 - DNA, 23 bp, Homo sapiens
gcccttcctcctgaagcctctgc

SEQ ID NO: 2147368 - DNA, 12 bp, Homo sapiens
gcccttcctctc

SEQ ID NO: 2147369 - DNA, 15 bp, Homo sapiens
gcccttcctctccac

SEQ ID NO: 2147370 - DNA, 16 bp, Homo sapiens
gcccttcctctccact

SEQ ID NO: 2147371 - DNA, 17 bp, Homo sapiens
gcccttcctctccactg

SEQ ID NO: 2147372 - DNA, 19 bp, Homo sapiens
gcccttcctctccactgcc

SEQ ID NO: 2147373 - DNA, 20 bp, Homo sapiens
gcccttggggcctggcttgc

SEQ ID NO: 2147374 - DNA, 13 bp, Homo sapiens
gcccttggggttc

SEQ ID NO: 2147375 - DNA, 16 bp, Homo sapiens
gcccttgtcctgccag

SEQ ID NO: 2147376 - DNA, 19 bp, Homo sapiens
gcccttgtcctgccagctg

SEQ ID NO: 2147377 - DNA, 17 bp, Homo sapiens
gcccttgtttggggcag

SEQ ID NO: 2147378 - DNA, 14 bp, Homo sapiens
gccctttctggacc

SEQ ID NO: 2147379 - DNA, 15 bp, Homo sapiens
gccctttgcaggccc

SEQ ID NO: 2147380 - DNA, 14 bp, Homo sapiens
gccgaagctaacag

SEQ ID NO: 2147381 - DNA, 13 bp, Homo sapiens
gccgacctcagcc

SEQ ID NO: 2147382 - DNA, 13 bp, Homo sapiens
gccgactcaggga

SEQ ID NO: 2147383 - DNA, 15 bp, Homo sapiens
gccgactcagggacc

SEQ ID NO: 2147384 - DNA, 12 bp, Homo sapiens
gccgagagcctg

SEQ ID NO: 2147385 - DNA, 22 bp, Homo sapiens
gccgagagcctgctcccccacc

SEQ ID NO: 2147386 - DNA, 22 bp, Homo sapiens
gccgagatcacgccactgcact

SEQ ID NO: 2147387 - DNA, 18 bp, Homo sapiens
gccgagattgcgccactg

SEQ ID NO: 2147388 - DNA, 20 bp, Homo sapiens
gccgagccgggcctggggct

SEQ ID NO: 2147389 - DNA, 23 bp, Homo sapiens
gccgagtttgggccactgcactc

SEQ ID NO: 2147390 - DNA, 14 bp, Homo sapiens
gccgcaaggccctg

SEQ ID NO: 2147391 - DNA, 17 bp, Homo sapiens
gccgcagcctccctctg

SEQ ID NO: 2147392 - DNA, 20 bp, Homo sapiens
gccgcagggacagaactgaa

SEQ ID NO: 2147393 - DNA, 15 bp, Homo sapiens
gccgcattccctgag

SEQ ID NO: 2147394 - DNA, 16 bp, Homo sapiens
gccgccatcagcccaa

SEQ ID NO: 2147395 - DNA, 24 bp, Homo sapiens
gccgccctgggctgtctgtcacca

SEQ ID NO: 2147396 - DNA, 13 bp, Homo sapiens
gccgcctccagga

SEQ ID NO: 2147397 - DNA, 13 bp, Homo sapiens
gccgcctcccagc

SEQ ID NO: 2147398 - DNA, 16 bp, Homo sapiens
gccgcctcccagcctg

SEQ ID NO: 2147399 - DNA, 21 bp, Homo sapiens
gccgcggtaggtaagggccgc

SEQ ID NO: 2147400 - DNA, 22 bp, Homo sapiens
gccgctaggagagactgaaagc

SEQ ID NO: 2147401 - DNA, 23 bp, Homo sapiens
gccgctcctgtctgccagccagc

SEQ ID NO: 2147402 - DNA, 19 bp, Homo sapiens
gccgctcttctgtcatccc

SEQ ID NO: 2147403 - DNA, 14 bp, Homo sapiens
gccgctgcaccacg

SEQ ID NO: 2147404 - DNA, 16 bp, Homo sapiens
gccgctgccgctgcac

SEQ ID NO: 2147405 - DNA, 12 bp, Homo sapiens
gccgctggccca

SEQ ID NO: 2147406 - DNA, 13 bp, Homo sapiens
gccgctggcccag

SEQ ID NO: 2147407 - DNA, 23 bp, Homo sapiens
gccgctgtgagcccctggtcctg

SEQ ID NO: 2147408 - DNA, 23 bp, Homo sapiens
gccggaccgcgtagagagccggg

SEQ ID NO: 2147409 - DNA, 15 bp, Homo sapiens
gccgggagaggactc

SEQ ID NO: 2147410 - DNA, 13 bp, Homo sapiens
gccgggcaggcct

SEQ ID NO: 2147411 - DNA, 17 bp, Homo sapiens
gccgggcaggtcctgcc

SEQ ID NO: 2147412 - DNA, 19 bp, Homo sapiens
gccgggcaggtcctgccca

SEQ ID NO: 2147413 - DNA, 20 bp, Homo sapiens
gccggggaactggccaagct

SEQ ID NO: 2147414 - DNA, 23 bp, Homo sapiens
gccggggaactggccaagctgag

SEQ ID NO: 2147415 - DNA, 16 bp, Homo sapiens
gccgggtacctcagtt

SEQ ID NO: 2147416 - DNA, 13 bp, Homo sapiens
gccgggtgcggtg

SEQ ID NO: 2147417 - DNA, 17 bp, Homo sapiens
gccggtcacccaggctc

SEQ ID NO: 2147418 - DNA, 17 bp, Homo sapiens
gccgtccatggcaccag

SEQ ID NO: 2147419 - DNA, 20 bp, Homo sapiens
gccgtccatggcaccagccc

SEQ ID NO: 2147420 - DNA, 19 bp, Homo sapiens
gccgtcgtggaattaaatc

SEQ ID NO: 2147421 - DNA, 19 bp, Homo sapiens
gccgtctgactccagagtc

SEQ ID NO: 2147422 - DNA, 17 bp, Homo sapiens
gccgtgcactccctaag

SEQ ID NO: 2147423 - DNA, 15 bp, Homo sapiens
gccgtgcccaggggc

SEQ ID NO: 2147424 - DNA, 15 bp, Homo sapiens
gccgtgccttcagct

SEQ ID NO: 2147425 - DNA, 12 bp, Homo sapiens
gccgtggcttcc

SEQ ID NO: 2147426 - DNA, 16 bp, Homo sapiens
gccgtggtccagctct

SEQ ID NO: 2147427 - DNA, 22 bp, Homo sapiens
gccgtgtgtctcgtctcctgac

SEQ ID NO: 2147428 - DNA, 21 bp, Homo sapiens
gccgtgttactgttgcactga

SEQ ID NO: 2147429 - DNA, 20 bp, Homo sapiens
gccgttactctccaacctgg

SEQ ID NO: 2147430 - DNA, 16 bp, Homo sapiens
gccgttccccttggct

SEQ ID NO: 2147431 - DNA, 18 bp, Homo sapiens
gccgttgaagaggaaggg

SEQ ID NO: 2147432 - DNA, 14 bp, Homo sapiens
gcctaaaaatgcaa

SEQ ID NO: 2147433 - DNA, 19 bp, Homo sapiens
gcctaagaaaatcatcttg

SEQ ID NO: 2147434 - DNA, 14 bp, Homo sapiens
gcctaagaagctct

SEQ ID NO: 2147435 - DNA, 23 bp, Homo sapiens
gcctaatatttaggcaagagaaa

SEQ ID NO: 2147436 - DNA, 22 bp, Homo sapiens
gcctaatctcatacctctgacc

SEQ ID NO: 2147437 - DNA, 22 bp, Homo sapiens
gcctaattcctggcatgacact

SEQ ID NO: 2147438 - DNA, 17 bp, Homo sapiens
gcctacaggagtgagca

SEQ ID NO: 2147439 - DNA, 14 bp, Homo sapiens
gcctaccccctgaa

SEQ ID NO: 2147440 - DNA, 23 bp, Homo sapiens
gcctacccttgtaccccatccct

SEQ ID NO: 2147441 - DNA, 17 bp, Homo sapiens
gcctagaaaatgcaaaa

SEQ ID NO: 2147442 - DNA, 18 bp, Homo sapiens
gcctagcaggcacaggac

SEQ ID NO: 2147443 - DNA, 15 bp, Homo sapiens
gcctagccacctccc

SEQ ID NO: 2147444 - DNA, 23 bp, Homo sapiens
gcctagccacctcccaccccact

SEQ ID NO: 2147445 - DNA, 14 bp, Homo sapiens
gcctagcccacttg

SEQ ID NO: 2147446 - DNA, 18 bp, Homo sapiens
gcctagccgacctcagcc

SEQ ID NO: 2147447 - DNA, 13 bp, Homo sapiens
gcctaggacctca

SEQ ID NO: 2147448 - DNA, 15 bp, Homo sapiens
gcctaggacctcagg

SEQ ID NO: 2147449 - DNA, 21 bp, Homo sapiens
gcctaggagttgagtacagtg

SEQ ID NO: 2147450 - DNA, 12 bp, Homo sapiens
gcctagggagcc

SEQ ID NO: 2147451 - DNA, 20 bp, Homo sapiens
gcctagggagccgcaccttg

SEQ ID NO: 2147452 - DNA, 18 bp, Homo sapiens
gcctagtggggtctccct

SEQ ID NO: 2147453 - DNA, 19 bp, Homo sapiens
gcctagtggggtctccctc

SEQ ID NO: 2147454 - DNA, 16 bp, Homo sapiens
gcctatccatcctgcg

SEQ ID NO: 2147455 - DNA, 19 bp, Homo sapiens
gcctatccatcctgcgagc

SEQ ID NO: 2147456 - DNA, 16 bp, Homo sapiens
gcctatgacttgggca

SEQ ID NO: 2147457 - DNA, 17 bp, Homo sapiens
gcctatgacttgggcac

SEQ ID NO: 2147458 - DNA, 15 bp, Homo sapiens
gcctatgatcccagc

SEQ ID NO: 2147459 - DNA, 23 bp, Homo sapiens
gcctatgcacatatggactctgc

SEQ ID NO: 2147460 - DNA, 18 bp, Homo sapiens
gcctatggagagccctgg

SEQ ID NO: 2147461 - DNA, 21 bp, Homo sapiens
gcctatggagagccctgggac

SEQ ID NO: 2147462 - DNA, 20 bp, Homo sapiens
gcctattatattaaaatatg

SEQ ID NO: 2147463 - DNA, 18 bp, Homo sapiens
gcctatttattcattcag

SEQ ID NO: 2147464 - DNA, 13 bp, Homo sapiens
gcctatttattgg

SEQ ID NO: 2147465 - DNA, 19 bp, Homo sapiens
gcctatttattggggatct

SEQ ID NO: 2147466 - DNA, 16 bp, Homo sapiens
gcctatttattggggt

SEQ ID NO: 2147467 - DNA, 14 bp, Homo sapiens
gcctcaacctcctg

SEQ ID NO: 2147468 - DNA, 17 bp, Homo sapiens
gcctcaacctcctgggc

SEQ ID NO: 2147469 - DNA, 24 bp, Homo sapiens
gcctcaagtgattctcctgcctca

SEQ ID NO: 2147470 - DNA, 15 bp, Homo sapiens
gcctcacgcccagcc

SEQ ID NO: 2147471 - DNA, 14 bp, Homo sapiens
gctctcctggcttc

SEQ ID NO: 2147472 - DNA, 15 bp, Homo sapiens
gctctcctggcttcc

SEQ ID NO: 2147473 - DNA, 17 bp, Homo sapiens
gctctcctggcttccca

SEQ ID NO: 2147474 - DNA, 22 bp, Homo sapiens
gctctctgagggagaggctgtg

SEQ ID NO: 2147475 - DNA, 14 bp, Homo sapiens
gctctctgcagcca

SEQ ID NO: 2147476 - DNA, 21 bp, Homo sapiens
gctctctgcagccagcccagc

SEQ ID NO: 2147477 - DNA, 18 bp, Homo sapiens
gctctctggccttttcct

SEQ ID NO: 2147478 - DNA, 11 bp, Homo sapiens
gctctctgtct

SEQ ID NO: 2147479 - DNA, 15 bp, Homo sapiens
gctctgaacaaacac

SEQ ID NO: 2147480 - DNA, 23 bp, Homo sapiens
gctctgaagtcacatcacaggac

SEQ ID NO: 2147481 - DNA, 23 bp, Homo sapiens
gctctgagaggccctggatcagc

SEQ ID NO: 2147482 - DNA, 21 bp, Homo sapiens
gctctgagcaaatgtggctcc

SEQ ID NO: 2147483 - DNA, 16 bp, Homo sapiens
gctctgaggcttccag

SEQ ID NO: 2147484 - DNA, 19 bp, Homo sapiens
gctctgaggcttccagaga

SEQ ID NO: 2147485 - DNA, 20 bp, Homo sapiens
gctctgaggcttccagagag

SEQ ID NO: 2147486 - DNA, 21 bp, Homo sapiens
gctctgatcatccactgtgcc

SEQ ID NO: 2147487 - DNA, 16 bp, Homo sapiens
gctctgatgcatcaga

SEQ ID NO: 2147488 - DNA, 20 bp, Homo sapiens
gctctgatgcatcagaaagg

SEQ ID NO: 2147489 - DNA, 13 bp, Homo sapiens
gctctgccccagc

SEQ ID NO: 2147490 - DNA, 18 bp, Homo sapiens
gctctgccccagctctgg

SEQ ID NO: 2147491 - DNA, 12 bp, Homo sapiens
gctctgccctcc

SEQ ID NO: 2147492 - DNA, 18 bp, Homo sapiens
gctctgccctccctggcc

SEQ ID NO: 2147493 - DNA, 13 bp, Homo sapiens
gctctgctcctct

SEQ ID NO: 2147494 - DNA, 14 bp, Homo sapiens
gctctgctcctctc

SEQ ID NO: 2147495 - DNA, 13 bp, Homo sapiens
gctctgctgacag

SEQ ID NO: 2147496 - DNA, 13 bp, Homo sapiens
gctctgctggcct

SEQ ID NO: 2147497 - DNA, 21 bp, Homo sapiens
gctctggaaaatgtgacccag

SEQ ID NO: 2147498 - DNA, 14 bp, Homo sapiens
gctctggacaggca

SEQ ID NO: 2147499 - DNA, 16 bp, Homo sapiens
gctctggacaggcatg

SEQ ID NO: 2147500 - DNA, 14 bp, Homo sapiens
gctctggagccaga

SEQ ID NO: 2147501 - DNA, 22 bp, Homo sapiens
gctctggagccagagagacaga

SEQ ID NO: 2147502 - DNA, 18 bp, Homo sapiens
gctctggataacaagact

SEQ ID NO: 2147503 - DNA, 14 bp, Homo sapiens
gctctggccaccct

SEQ ID NO: 2147504 - DNA, 14 bp, Homo sapiens
gctctggccccagg

SEQ ID NO: 2147505 - DNA, 18 bp, Homo sapiens
gctctggccccaggcttg

SEQ ID NO: 2147506 - DNA, 19 bp, Homo sapiens
gctctggccccaggcttgt

SEQ ID NO: 2147507 - DNA, 21 bp, Homo sapiens
gctctggcggcttcctgtcca

SEQ ID NO: 2147508 - DNA, 11 bp, Homo sapiens
gctctgggaag

SEQ ID NO: 2147509 - DNA, 18 bp, Homo sapiens
gctctgggaaggggtgcc

SEQ ID NO: 2147510 - DNA, 19 bp, Homo sapiens
gctctgggaaggggtgccc

SEQ ID NO: 2147511 - DNA, 22 bp, Homo sapiens
gctctgggaaggggtgccctct

SEQ ID NO: 2147512 - DNA, 21 bp, Homo sapiens
gctctgggatagctgacccag

SEQ ID NO: 2147513 - DNA, 11 bp, Homo sapiens
gctctgggctc

SEQ ID NO: 2147514 - DNA, 16 bp, Homo sapiens
gctctgggctcagggc

SEQ ID NO: 2147515 - DNA, 21 bp, Homo sapiens
gctctgggctcagggctggag

SEQ ID NO: 2147516 - DNA, 23 bp, Homo sapiens
gctctgggctcagggctggagtg

SEQ ID NO: 2147517 - DNA, 12 bp, Homo sapiens
gctctgtggcct

SEQ ID NO: 2147518 - DNA, 15 bp, Homo sapiens
gctctgtggcctgtg

SEQ ID NO: 2147519 - DNA, 20 bp, Homo sapiens
gctctgtggcctgtgtccag

SEQ ID NO: 2147520 - DNA, 22 bp, Homo sapiens
gctctgtggcctgtgtccagca

SEQ ID NO: 2147521 - DNA, 19 bp, Homo sapiens
gctcttagctttctcaggg

SEQ ID NO: 2147522 - DNA, 23 bp, Homo sapiens
gctcttcaagctgtcccctctgt

SEQ ID NO: 2147523 - DNA, 13 bp, Homo sapiens
gctcttcctggac

SEQ ID NO: 2147524 - DNA, 18 bp, Homo sapiens
gctcttcggtttctgagc

SEQ ID NO: 2147525 - DNA, 19 bp, Homo sapiens
gctcttcggtttctgagca

SEQ ID NO: 2147526 - DNA, 17 bp, Homo sapiens
gctcttctaacctcagc

SEQ ID NO: 2147527 - DNA, 16 bp, Homo sapiens
gctcttctccaggctg

SEQ ID NO: 2147528 - DNA, 17 bp, Homo sapiens
gctcttctccttggagg

SEQ ID NO: 2147529 - DNA, 21 bp, Homo sapiens
gctcttctcctttcacaacct

SEQ ID NO: 2147530 - DNA, 16 bp, Homo sapiens
gctcttctgttctcaa

SEQ ID NO: 2147531 - DNA, 16 bp, Homo sapiens
gctcttctttctgaga

SEQ ID NO: 2147532 - DNA, 19 bp, Homo sapiens
gctcttggcaggtactcag

SEQ ID NO: 2147533 - DNA, 22 bp, Homo sapiens
gctcttggcattttcctcgcct

SEQ ID NO: 2147534 - DNA, 14 bp, Homo sapiens
gctcttggcccctg

SEQ ID NO: 2147535 - DNA, 16 bp, Homo sapiens
gctcttggcccctgtg

SEQ ID NO: 2147536 - DNA, 14 bp, Homo sapiens
gctctttcagagag

SEQ ID NO: 2147537 - DNA, 14 bp, Homo sapiens
gctctttctgggcc

SEQ ID NO: 2147538 - DNA, 18 bp, Homo sapiens
gctctttctgggccaagt

SEQ ID NO: 2147539 - DNA, 20 bp, Homo sapiens
gctcttttggtggggagcac

SEQ ID NO: 2147540 - DNA, 24 bp, Homo sapiens
gctcttttggtggggagcacttgc

SEQ ID NO: 2147541 - DNA, 16 bp, Homo sapiens
gctgaaacaacaaata

SEQ ID NO: 2147542 - DNA, 18 bp, Homo sapiens
gctgaaacacctcccagg

SEQ ID NO: 2147543 - DNA, 17 bp, Homo sapiens
gctgaacggggagaaaa

SEQ ID NO: 2147544 - DNA, 21 bp, Homo sapiens
gctgaagcctatttatttgaa

SEQ ID NO: 2147545 - DNA, 21 bp, Homo sapiens
gctgaagggcttcttcttata

SEQ ID NO: 2147546 - DNA, 23 bp, Homo sapiens
gctgaattattttgttgtgattt

SEQ ID NO: 2147547 - DNA, 18 bp, Homo sapiens
gctgacagacacaggccc

SEQ ID NO: 2147548 - DNA, 21 bp, Homo sapiens
gctgacagacacaggcccggc

SEQ ID NO: 2147549 - DNA, 11 bp, Homo sapiens
gctgacagata

SEQ ID NO: 2147550 - DNA, 13 bp, Homo sapiens
gctgacagataca

SEQ ID NO: 2147551 - DNA, 21 bp, Homo sapiens
gctgacagatacatagatgga

SEQ ID NO: 2147552 - DNA, 12 bp, Homo sapiens
gctgacagctgc

SEQ ID NO: 2147553 - DNA, 23 bp, Homo sapiens
gctgacaggatgtggcactgctt

SEQ ID NO: 2147554 - DNA, 15 bp, Homo sapiens
gctgacatggctttg

SEQ ID NO: 2147555 - DNA, 20 bp, Homo sapiens
gctgaccaagagagaaagaa

SEQ ID NO: 2147556 - DNA, 22 bp, Homo sapiens
gctgacccagccccttgagaaa

SEQ ID NO: 2147557 - DNA, 17 bp, Homo sapiens
gctgacccagtccctgg

SEQ ID NO: 2147558 - DNA, 19 bp, Homo sapiens
gctgacccagtccctgggg

SEQ ID NO: 2147559 - DNA, 16 bp, Homo sapiens
gctgacctgtttttgt

SEQ ID NO: 2147560 - DNA, 18 bp, Homo sapiens
gctgactgtactcctccc

SEQ ID NO: 2147561 - DNA, 14 bp, Homo sapiens
gctgagaacctggc

SEQ ID NO: 2147562 - DNA, 15 bp, Homo sapiens
gctgagaacctggcc

SEQ ID NO: 2147563 - DNA, 13 bp, Homo sapiens
gctgagaagaagc

SEQ ID NO: 2147564 - DNA, 16 bp, Homo sapiens
gctgagaagaagctga

SEQ ID NO: 2147565 - DNA, 19 bp, Homo sapiens
gctgagaagaagctgagga

SEQ ID NO: 2147566 - DNA, 15 bp, Homo sapiens
gctgagacaggagaa

SEQ ID NO: 2147567 - DNA, 20 bp, Homo sapiens
gctgagagacccaaggagga

SEQ ID NO: 2147568 - DNA, 13 bp, Homo sapiens
gctgagagccctg

SEQ ID NO: 2147569 - DNA, 13 bp, Homo sapiens
gctgagaggaaga

SEQ ID NO: 2147570 - DNA, 16 bp, Homo sapiens
gctgagaggaagatga

SEQ ID NO: 2147571 - DNA, 24 bp, Homo sapiens
gctgagaggaagatgaagagaagc

SEQ ID NO: 2147572 - DNA, 15 bp, Homo sapiens
gctgagcaggcccga

SEQ ID NO: 2147573 - DNA, 21 bp, Homo sapiens
gctgagcaggcccgacagaga

SEQ ID NO: 2147574 - DNA, 14 bp, Homo sapiens
gctgagcagggccg

SEQ ID NO: 2147575 - DNA, 12 bp, Homo sapiens
gctgagccactc

SEQ ID NO: 2147576 - DNA, 15 bp, Homo sapiens
gctgagcccagccac

SEQ ID NO: 2147577 - DNA, 19 bp, Homo sapiens
gctgagcccagccacctcc

SEQ ID NO: 2147578 - DNA, 14 bp, Homo sapiens
gctgagccctggca

SEQ ID NO: 2147579 - DNA, 19 bp, Homo sapiens
gctgagctcacaaggcagc

SEQ ID NO: 2147580 - DNA, 21 bp, Homo sapiens
gctgagctcacaaggcagcaa

SEQ ID NO: 2147581 - DNA, 13 bp, Homo sapiens
gctgagctctgag

SEQ ID NO: 2147582 - DNA, 14 bp, Homo sapiens
gctgagctctgaga

SEQ ID NO: 2147583 - DNA, 18 bp, Homo sapiens
gctgagctctgagaggcc

SEQ ID NO: 2147584 - DNA, 23 bp, Homo sapiens
gctgagctctgagaggccctgga

SEQ ID NO: 2147585 - DNA, 16 bp, Homo sapiens
gctgagcttagccttg

SEQ ID NO: 2147586 - DNA, 23 bp, Homo sapiens
gctgggggaggcggcacattggc

SEQ ID NO: 2147587 - DNA, 14 bp, Homo sapiens
gctgggggcctcag

SEQ ID NO: 2147588 - DNA, 18 bp, Homo sapiens
gctgggggcctcagtgcc

SEQ ID NO: 2147589 - DNA, 19 bp, Homo sapiens
gctgggggtgggggcgggt

SEQ ID NO: 2147590 - DNA, 19 bp, Homo sapiens
gctgggtccaattgtggca

SEQ ID NO: 2147591 - DNA, 17 bp, Homo sapiens
gctgggtgccgggctgc

SEQ ID NO: 2147592 - DNA, 15 bp, Homo sapiens
gctggtaaactattt

SEQ ID NO: 2147593 - DNA, 21 bp, Homo sapiens
gctggtcgtgaactcctgagc

SEQ ID NO: 2147594 - DNA, 13 bp, Homo sapiens
gctggtctccctc

SEQ ID NO: 2147595 - DNA, 15 bp, Homo sapiens
gctggtctccctcca

SEQ ID NO: 2147596 - DNA, 17 bp, Homo sapiens
gctggtctccctccagc

SEQ ID NO: 2147597 - DNA, 15 bp, Homo sapiens
gctggtgctgcaagg

SEQ ID NO: 2147598 - DNA, 19 bp, Homo sapiens
gctggtggaccacaggcat

SEQ ID NO: 2147599 - DNA, 21 bp, Homo sapiens
gctggtgggaagcgtctgtcc

SEQ ID NO: 2147600 - DNA, 18 bp, Homo sapiens
gctggtgtcacctgaaga

SEQ ID NO: 2147601 - DNA, 14 bp, Homo sapiens
gctggttagaaatg

SEQ ID NO: 2147602 - DNA, 22 bp, Homo sapiens
gctggttcagggttggcccctg

SEQ ID NO: 2147603 - DNA, 16 bp, Homo sapiens
gctggttggagagcta

SEQ ID NO: 2147604 - DNA, 18 bp, Homo sapiens
gctggttggagagctaga

SEQ ID NO: 2147605 - DNA, 15 bp, Homo sapiens
gctggtttaatgttt

SEQ ID NO: 2147606 - DNA, 14 bp, Homo sapiens
gctggttttcctaa

SEQ ID NO: 2147607 - DNA, 14 bp, Homo sapiens
gctgtaaataaatg

SEQ ID NO: 2147608 - DNA, 15 bp, Homo sapiens
gctgtaaataaatgc

SEQ ID NO: 2147609 - DNA, 17 bp, Homo sapiens
gctgtaaatacatgtgt

SEQ ID NO: 2147610 - DNA, 17 bp, Homo sapiens
gctgtacccttccacct

SEQ ID NO: 2147611 - DNA, 13 bp, Homo sapiens
gctgtactcagag

SEQ ID NO: 2147612 - DNA, 15 bp, Homo sapiens
gctgtactcagagca

SEQ ID NO: 2147613 - DNA, 19 bp, Homo sapiens
gctgtactcagagcagagc

SEQ ID NO: 2147614 - DNA, 20 bp, Homo sapiens
gctgtactcagagcagagca

SEQ ID NO: 2147615 - DNA, 13 bp, Homo sapiens
gctgtagccatgg

SEQ ID NO: 2147616 - DNA, 17 bp, Homo sapiens
gctgtagccatggctca

SEQ ID NO: 2147617 - DNA, 20 bp, Homo sapiens
gctgtatcccatgagcctca

SEQ ID NO: 2147618 - DNA, 16 bp, Homo sapiens
gctgtatctgtaatta

SEQ ID NO: 2147619 - DNA, 22 bp, Homo sapiens
gctgtatgtttgatcacacagc

SEQ ID NO: 2147620 - DNA, 18 bp, Homo sapiens
gctgtattcagatcgtat

SEQ ID NO: 2147621 - DNA, 24 bp, Homo sapiens
gctgtattcagatcgtattaatta

SEQ ID NO: 2147622 - DNA, 16 bp, Homo sapiens
gctgtatttttagaga

SEQ ID NO: 2147623 - DNA, 18 bp, Homo sapiens
gctgtcatggaaaagccc

SEQ ID NO: 2147624 - DNA, 18 bp, Homo sapiens
gctgtcccctctccctgg

SEQ ID NO: 2147625 - DNA, 14 bp, Homo sapiens
gctgtccctgtcac

SEQ ID NO: 2147626 - DNA, 15 bp, Homo sapiens
gctgtccctgtcacc

SEQ ID NO: 2147627 - DNA, 18 bp, Homo sapiens
gctgtccctgtcaccaag

SEQ ID NO: 2147628 - DNA, 13 bp, Homo sapiens
gctgtcctaggcc

SEQ ID NO: 2147629 - DNA, 14 bp, Homo sapiens
gctgtcgccccagg

SEQ ID NO: 2147630 - DNA, 15 bp, Homo sapiens
gctgtcgccccaggc

SEQ ID NO: 2147631 - DNA, 17 bp, Homo sapiens
gctgtcgccccaggccc

SEQ ID NO: 2147632 - DNA, 18 bp, Homo sapiens
gctgtcgccccaggccct

SEQ ID NO: 2147633 - DNA, 19 bp, Homo sapiens
gctgtcgccccaggccctc

SEQ ID NO: 2147634 - DNA, 12 bp, Homo sapiens
gctgtctctgtc

SEQ ID NO: 2147635 - DNA, 21 bp, Homo sapiens
gctgtctgtcaccagctatct

SEQ ID NO: 2147636 - DNA, 13 bp, Homo sapiens
gctgtctttctct

SEQ ID NO: 2147637 - DNA, 18 bp, Homo sapiens
gctgtgacctgctgagct

SEQ ID NO: 2147638 - DNA, 20 bp, Homo sapiens
gctgtgacctgctgagctct

SEQ ID NO: 2147639 - DNA, 18 bp, Homo sapiens
gctgtgaggcccctggac

SEQ ID NO: 2147640 - DNA, 22 bp, Homo sapiens
gctgtgaggcccctggacaagc

SEQ ID NO: 2147641 - DNA, 20 bp, Homo sapiens
gctgtgcaccttacattcct

SEQ ID NO: 2147642 - DNA, 21 bp, Homo sapiens
gctgtgcaccttacattccta

SEQ ID NO: 2147643 - DNA, 15 bp, Homo sapiens
gctgtgcctcgctcc

SEQ ID NO: 2147644 - DNA, 16 bp, Homo sapiens
gctgtgcctctgcctg

SEQ ID NO: 2147645 - DNA, 14 bp, Homo sapiens
gctgtgcctgctag

SEQ ID NO: 2147646 - DNA, 22 bp, Homo sapiens
gctgtgcctgctagagcaaccc

SEQ ID NO: 2147647 - DNA, 14 bp, Homo sapiens
gctgtggaggcctg

SEQ ID NO: 2147648 - DNA, 16 bp, Homo sapiens
gctgtggaggcctgat

SEQ ID NO: 2147649 - DNA, 13 bp, Homo sapiens
gctgtggcacaga

SEQ ID NO: 2147650 - DNA, 13 bp, Homo sapiens
gctgtggccaggg

SEQ ID NO: 2147651 - DNA, 19 bp, Homo sapiens
gctgtggccagggtgagag

SEQ ID NO: 2147652 - DNA, 21 bp, Homo sapiens
gctgtggcctcacttccctgg

SEQ ID NO: 2147653 - DNA, 14 bp, Homo sapiens
gctgtggcctgggc

SEQ ID NO: 2147654 - DNA, 15 bp, Homo sapiens
gctgtggcctgggca

SEQ ID NO: 2147655 - DNA, 14 bp, Homo sapiens
gctgtggctcctgc

SEQ ID NO: 2147656 - DNA, 16 bp, Homo sapiens
gctgtgggcagcaccc

SEQ ID NO: 2147657 - DNA, 18 bp, Homo sapiens
gctgtggtggctgtctct

SEQ ID NO: 2147658 - DNA, 12 bp, Homo sapiens
gctgtgtagctc

SEQ ID NO: 2147659 - DNA, 17 bp, Homo sapiens
gctgtgtagctctgtcc

SEQ ID NO: 2147660 - DNA, 20 bp, Homo sapiens
gctgtgtccttgcacctgca

SEQ ID NO: 2147661 - DNA, 20 bp, Homo sapiens
gctgtgtgacagaatcttgt

SEQ ID NO: 2147662 - DNA, 20 bp, Homo sapiens
gctgtgtttatgcccccaat

SEQ ID NO: 2147663 - DNA, 22 bp, Homo sapiens
gctgttcacccacagggctaag

SEQ ID NO: 2147664 - DNA, 18 bp, Homo sapiens
gctgttccacttctctag

SEQ ID NO: 2147665 - DNA, 18 bp, Homo sapiens
gctgttctggagctgctg

SEQ ID NO: 2147666 - DNA, 13 bp, Homo sapiens
gctgttgcctcat

SEQ ID NO: 2147667 - DNA, 20 bp, Homo sapiens
gctgttggcctcgcctgggc

SEQ ID NO: 2147668 - DNA, 21 bp, Homo sapiens
gctgttggcctcgcctgggcc

SEQ ID NO: 2147669 - DNA, 13 bp, Homo sapiens
gctgttggctggg

SEQ ID NO: 2147670 - DNA, 14 bp, Homo sapiens
gctgttggctgggg

SEQ ID NO: 2147671 - DNA, 16 bp, Homo sapiens
gctgttggctgggggc

SEQ ID NO: 2147672 - DNA, 21 bp, Homo sapiens
gctgttggctgggggcctcag

SEQ ID NO: 2147673 - DNA, 16 bp, Homo sapiens
gctgttgttgcaggga

SEQ ID NO: 2147674 - DNA, 18 bp, Homo sapiens
gctgtttatttattcact

SEQ ID NO: 2147675 - DNA, 14 bp, Homo sapiens
gctgttttcatctc

SEQ ID NO: 2147676 - DNA, 17 bp, Homo sapiens
gctgttttccctgacct

SEQ ID NO: 2147677 - DNA, 13 bp, Homo sapiens
gcttaaaactttg

SEQ ID NO: 2147678 - DNA, 16 bp, Homo sapiens
gcttaaaagagtagaa

SEQ ID NO: 2147679 - DNA, 14 bp, Homo sapiens
gcttaaaatatgta

SEQ ID NO: 2147680 - DNA, 20 bp, Homo sapiens
gcttaaaatatgtatgtcta

SEQ ID NO: 2147681 - DNA, 17 bp, Homo sapiens
gcttaaacttgacccag

SEQ ID NO: 2147682 - DNA, 20 bp, Homo sapiens
gcttaaacttgacccaggtg

SEQ ID NO: 2147683 - DNA, 22 bp, Homo sapiens
gcttaaacttgacccaggtggc

SEQ ID NO: 2147684 - DNA, 17 bp, Homo sapiens
gcttaaattgcttttgt

SEQ ID NO: 2147685 - DNA, 22 bp, Homo sapiens
gcttaacctttccgctgtcgcc

SEQ ID NO: 2147686 - DNA, 21 bp, Homo sapiens
gcttaaggagaggagaaactg

SEQ ID NO: 2147687 - DNA, 17 bp, Homo sapiens
gcttaatcagatagata

SEQ ID NO: 2147688 - DNA, 12 bp, Homo sapiens
gcttaatgttta

SEQ ID NO: 2147689 - DNA, 11 bp, Homo sapiens
gcttacatttt

SEQ ID NO: 2147690 - DNA, 19 bp, Homo sapiens
gcttactaatgtgccccat

SEQ ID NO: 2147691 - DNA, 21 bp, Homo sapiens
gcttactagccctgcggagcc

SEQ ID NO: 2147692 - DNA, 18 bp, Homo sapiens
gcttagaaagttattgtg

SEQ ID NO: 2147693 - DNA, 17 bp, Homo sapiens
gcttagacctcagcctg

SEQ ID NO: 2147694 - DNA, 18 bp, Homo sapiens
gcttagagaatgttctcc

SEQ ID NO: 2147695 - DNA, 21 bp, Homo sapiens
gcttagccttgtgccctgccc

SEQ ID NO: 2147696 - DNA, 22 bp, Homo sapiens
gcttagtaatagatcacggcat

SEQ ID NO: 2147697 - DNA, 15 bp, Homo sapiens
gcttagttctcactg

SEQ ID NO: 2147698 - DNA, 23 bp, Homo sapiens
gcttatcatgctgtctttacatg

SEQ ID NO: 2147699 - DNA, 16 bp, Homo sapiens
gcttgtccagcgccta

SEQ ID NO: 2147700 - DNA, 21 bp, Homo sapiens
gcttgtcctgctctcttcagg

SEQ ID NO: 2147701 - DNA, 15 bp, Homo sapiens
gcttgtgagagctgg

SEQ ID NO: 2147702 - DNA, 16 bp, Homo sapiens
gcttgtgagagctggt

SEQ ID NO: 2147703 - DNA, 21 bp, Homo sapiens
gcttgttaatgctttctgaag

SEQ ID NO: 2147704 - DNA, 23 bp, Homo sapiens
gcttgttaatgctttctgaagct

SEQ ID NO: 2147705 - DNA, 23 bp, Homo sapiens
gcttgttgtcaagtataaagtca

SEQ ID NO: 2147706 - DNA, 23 bp, Homo sapiens
gcttgttttcttgccaatgaggt

SEQ ID NO: 2147707 - DNA, 20 bp, Homo sapiens
gctttaaactaccctccaga

SEQ ID NO: 2147708 - DNA, 19 bp, Homo sapiens
gctttaacaaaacaagaaa

SEQ ID NO: 2147709 - DNA, 18 bp, Homo sapiens
gctttaacttaaatagta

SEQ ID NO: 2147710 - DNA, 12 bp, Homo sapiens
gctttacacaca

SEQ ID NO: 2147711 - DNA, 17 bp, Homo sapiens
gctttattttttaagta

SEQ ID NO: 2147712 - DNA, 19 bp, Homo sapiens
gctttattttttaagtatt

SEQ ID NO: 2147713 - DNA, 16 bp, Homo sapiens
gctttcagagccagtg

SEQ ID NO: 2147714 - DNA, 22 bp, Homo sapiens
gctttccccgggggaggaaggg

SEQ ID NO: 2147715 - DNA, 11 bp, Homo sapiens
gctttcctccc

SEQ ID NO: 2147716 - DNA, 13 bp, Homo sapiens
gctttctacccag

SEQ ID NO: 2147717 - DNA, 21 bp, Homo sapiens
gctttctccggggtctgtgct

SEQ ID NO: 2147718 - DNA, 12 bp, Homo sapiens
gctttctcctgg

SEQ ID NO: 2147719 - DNA, 19 bp, Homo sapiens
gctttctgaagctttacca

SEQ ID NO: 2147720 - DNA, 17 bp, Homo sapiens
gctttgaatacccccag

SEQ ID NO: 2147721 - DNA, 20 bp, Homo sapiens
gctttgactcacctgttact

SEQ ID NO: 2147722 - DNA, 18 bp, Homo sapiens
gctttgaggacaaagaga

SEQ ID NO: 2147723 - DNA, 15 bp, Homo sapiens
gctttgcaggctctg

SEQ ID NO: 2147724 - DNA, 16 bp, Homo sapiens
gctttgcaggctctgg

SEQ ID NO: 2147725 - DNA, 17 bp, Homo sapiens
gctttgcaggctctggg

SEQ ID NO: 2147726 - DNA, 22 bp, Homo sapiens
gctttgcaggctctgggctcag

SEQ ID NO: 2147727 - DNA, 22 bp, Homo sapiens
gctttgcattcctacaaagatg

SEQ ID NO: 2147728 - DNA, 20 bp, Homo sapiens
gctttgccatgggcctgctg

SEQ ID NO: 2147729 - DNA, 14 bp, Homo sapiens
gctttgcctgcttg

SEQ ID NO: 2147730 - DNA, 14 bp, Homo sapiens
gctttgggaggcca

SEQ ID NO: 2147731 - DNA, 20 bp, Homo sapiens
gctttgggctttgcaggctc

SEQ ID NO: 2147732 - DNA, 22 bp, Homo sapiens
gctttgggctttgcaggctctg

SEQ ID NO: 2147733 - DNA, 19 bp, Homo sapiens
gctttggggacagttggca

SEQ ID NO: 2147734 - DNA, 20 bp, Homo sapiens
gctttggggtcctagcccag

SEQ ID NO: 2147735 - DNA, 21 bp, Homo sapiens
gctttggggtcctagcccagt

SEQ ID NO: 2147736 - DNA, 21 bp, Homo sapiens
gcttttaactggggtattaac

SEQ ID NO: 2147737 - DNA, 13 bp, Homo sapiens
gcttttaataaaa

SEQ ID NO: 2147738 - DNA, 23 bp, Homo sapiens
gcttttaataaaattgacaacat

SEQ ID NO: 2147739 - DNA, 14 bp, Homo sapiens
gcttttcactgctg

SEQ ID NO: 2147740 - DNA, 18 bp, Homo sapiens
gcttttcactgctggctg

SEQ ID NO: 2147741 - DNA, 22 bp, Homo sapiens
gcttttcactgctggctgcctt

SEQ ID NO: 2147742 - DNA, 19 bp, Homo sapiens
gcttttccaggatcctgca

SEQ ID NO: 2147743 - DNA, 20 bp, Homo sapiens
gcttttccaggatcctgcag

SEQ ID NO: 2147744 - DNA, 23 bp, Homo sapiens
gcttttccaggatcctgcaggaa

SEQ ID NO: 2147745 - DNA, 19 bp, Homo sapiens
gcttttgaggctatttcta

SEQ ID NO: 2147746 - DNA, 15 bp, Homo sapiens
gcttttgccactttg

SEQ ID NO: 2147747 - DNA, 18 bp, Homo sapiens
gcttttgccactttggct

SEQ ID NO: 2147748 - DNA, 21 bp, Homo sapiens
gcttttgccactttggcttct

SEQ ID NO: 2147749 - DNA, 21 bp, Homo sapiens
gcttttggtggtccccacagc

SEQ ID NO: 2147750 - DNA, 18 bp, Homo sapiens
gcttttgtctatgggact

SEQ ID NO: 2147751 - DNA, 18 bp, Homo sapiens
gcttttgttgtgactttt

SEQ ID NO: 2147752 - DNA, 13 bp, Homo sapiens
gctttttccagag

SEQ ID NO: 2147753 - DNA, 13 bp, Homo sapiens
ggaaaaagaaaga

SEQ ID NO: 2147754 - DNA, 11 bp, Homo sapiens
ggaaaaatatt

SEQ ID NO: 2147755 - DNA, 21 bp, Homo sapiens
ggccagaaggagggcagagcc

SEQ ID NO: 2147756 - DNA, 23 bp, Homo sapiens
ggccagaaggagggcagagccat

SEQ ID NO: 2147757 - DNA, 24 bp, Homo sapiens
ggccagaaggagggcagagccatg

SEQ ID NO: 2147758 - DNA, 23 bp, Homo sapiens
ggccagagaagataatgttcttt

SEQ ID NO: 2147759 - DNA, 15 bp, Homo sapiens
ggccagagagggccc

SEQ ID NO: 2147760 - DNA, 20 bp, Homo sapiens
ggccagagagggcccagctg

SEQ ID NO: 2147761 - DNA, 23 bp, Homo sapiens
ggccagagagggcccagctgtag

SEQ ID NO: 2147762 - DNA, 13 bp, Homo sapiens
ggccagagctgga

SEQ ID NO: 2147763 - DNA, 19 bp, Homo sapiens
ggccagagctggaaggcag

SEQ ID NO: 2147764 - DNA, 20 bp, Homo sapiens
ggccagagctggaaggcagg

SEQ ID NO: 2147765 - DNA, 21 bp, Homo sapiens
ggccagagctgggaggcatgg

SEQ ID NO: 2147766 - DNA, 22 bp, Homo sapiens
ggccagagggagtgacagaggc

SEQ ID NO: 2147767 - DNA, 16 bp, Homo sapiens
ggccagatgcaccagc

SEQ ID NO: 2147768 - DNA, 20 bp, Homo sapiens
ggccagatgcaccagccctt

SEQ ID NO: 2147769 - DNA, 13 bp, Homo sapiens
ggccagcaccctc

SEQ ID NO: 2147770 - DNA, 23 bp, Homo sapiens
ggccagcaccctctcctgggggt

SEQ ID NO: 2147771 - DNA, 13 bp, Homo sapiens
ggccagccccatc

SEQ ID NO: 2147772 - DNA, 14 bp, Homo sapiens
ggccagccccatct

SEQ ID NO: 2147773 - DNA, 19 bp, Homo sapiens
ggccagcctggcctcctgc

SEQ ID NO: 2147774 - DNA, 20 bp, Homo sapiens
ggccagcctggcctcctgcc

SEQ ID NO: 2147775 - DNA, 22 bp, Homo sapiens
ggccagcctggcctcctgcctc

SEQ ID NO: 2147776 - DNA, 23 bp, Homo sapiens
ggccagctgcatctactcaggcc

SEQ ID NO: 2147777 - DNA, 15 bp, Homo sapiens
ggccaggagagagat

SEQ ID NO: 2147778 - DNA, 11 bp, Homo sapiens
ggccaggcagg

SEQ ID NO: 2147779 - DNA, 12 bp, Homo sapiens
ggccaggcaggt

SEQ ID NO: 2147780 - DNA, 17 bp, Homo sapiens
ggccaggccaccaggat

SEQ ID NO: 2147781 - DNA, 20 bp, Homo sapiens
ggccaggcgcggtggctcac

SEQ ID NO: 2147782 - DNA, 18 bp, Homo sapiens
ggccaggctggtctcaaa

SEQ ID NO: 2147783 - DNA, 16 bp, Homo sapiens
ggccagggccctgcag

SEQ ID NO: 2147784 - DNA, 16 bp, Homo sapiens
ggccagggcctggtgt

SEQ ID NO: 2147785 - DNA, 18 bp, Homo sapiens
ggccagggcctggtgtga

SEQ ID NO: 2147786 - DNA, 16 bp, Homo sapiens
ggccagggtgagagct

SEQ ID NO: 2147787 - DNA, 14 bp, Homo sapiens
ggccaggtgcagtg

SEQ ID NO: 2147788 - DNA, 19 bp, Homo sapiens
ggccaggtggccactccag

SEQ ID NO: 2147789 - DNA, 14 bp, Homo sapiens
ggccagtcctagag

SEQ ID NO: 2147790 - DNA, 15 bp, Homo sapiens
ggccagtcctagagc

SEQ ID NO: 2147791 - DNA, 17 bp, Homo sapiens
ggccagtctgggctgcc

SEQ ID NO: 2147792 - DNA, 14 bp, Homo sapiens
ggccagtgccagga

SEQ ID NO: 2147793 - DNA, 15 bp, Homo sapiens
ggccagtgccaggac

SEQ ID NO: 2147794 - DNA, 19 bp, Homo sapiens
ggccagtgtgatcccaagt

SEQ ID NO: 2147795 - DNA, 14 bp, Homo sapiens
ggccatcagggtgg

SEQ ID NO: 2147796 - DNA, 16 bp, Homo sapiens
ggccatccctgggccc

SEQ ID NO: 2147797 - DNA, 13 bp, Homo sapiens
ggccatggcagaa

SEQ ID NO: 2147798 - DNA, 18 bp, Homo sapiens
ggccatttgtatttgtat

SEQ ID NO: 2147799 - DNA, 16 bp, Homo sapiens
ggccattttcttgcct

SEQ ID NO: 2147800 - DNA, 17 bp, Homo sapiens
ggccattttcttgcctg

SEQ ID NO: 2147801 - DNA, 20 bp, Homo sapiens
ggccattttcttgcctgagg

SEQ ID NO: 2147802 - DNA, 22 bp, Homo sapiens
ggccattttcttgcctgaggct

SEQ ID NO: 2147803 - DNA, 16 bp, Homo sapiens
ggcccacaaaggggag

SEQ ID NO: 2147804 - DNA, 18 bp, Homo sapiens
ggcccacagctcccaccc

SEQ ID NO: 2147805 - DNA, 17 bp, Homo sapiens
ggcccagaagtttccct

SEQ ID NO: 2147806 - DNA, 22 bp, Homo sapiens
ggcccagagaccccttcctttc

SEQ ID NO: 2147807 - DNA, 12 bp, Homo sapiens
ggcccagagagg

SEQ ID NO: 2147808 - DNA, 22 bp, Homo sapiens
ggcccagctatggccccagggt

SEQ ID NO: 2147809 - DNA, 14 bp, Homo sapiens
ggcccagctgtagc

SEQ ID NO: 2147810 - DNA, 15 bp, Homo sapiens
ggcccagctgtagcc

SEQ ID NO: 2147811 - DNA, 16 bp, Homo sapiens
ggcccagctgtagcca

SEQ ID NO: 2147812 - DNA, 19 bp, Homo sapiens
ggcccagctgtagccatgg

SEQ ID NO: 2147813 - DNA, 12 bp, Homo sapiens
ggcccaggaatc

SEQ ID NO: 2147814 - DNA, 22 bp, Homo sapiens
ggcccatagaaacatgacactg

SEQ ID NO: 2147815 - DNA, 20 bp, Homo sapiens
ggcccatctcaggtgccact

SEQ ID NO: 2147816 - DNA, 21 bp, Homo sapiens
ggcccatctcaggtgccactc

SEQ ID NO: 2147817 - DNA, 12 bp, Homo sapiens
ggccccagagca

SEQ ID NO: 2147818 - DNA, 18 bp, Homo sapiens
ggccccagatctgcctgg

SEQ ID NO: 2147819 - DNA, 16 bp, Homo sapiens
ggccccagcactaaag

SEQ ID NO: 2147820 - DNA, 14 bp, Homo sapiens
ggccccatgacctc

SEQ ID NO: 2147821 - DNA, 18 bp, Homo sapiens
ggccccatgacctccagc

SEQ ID NO: 2147822 - DNA, 12 bp, Homo sapiens
ggccccatgctc

SEQ ID NO: 2147823 - DNA, 15 bp, Homo sapiens
ggccccatgctctgc

SEQ ID NO: 2147824 - DNA, 16 bp, Homo sapiens
ggccccatgctctgcc

SEQ ID NO: 2147825 - DNA, 17 bp, Homo sapiens
ggcccccacctggctca

SEQ ID NO: 2147826 - DNA, 21 bp, Homo sapiens
ggccccccctcttttggcctt

SEQ ID NO: 2147827 - DNA, 17 bp, Homo sapiens
ggccccccgcagcaccc

SEQ ID NO: 2147828 - DNA, 12 bp, Homo sapiens
ggcccccctcca

SEQ ID NO: 2147829 - DNA, 14 bp, Homo sapiens
ggcccccctccagg

SEQ ID NO: 2147830 - DNA, 17 bp, Homo sapiens
ggcccccctccttgctc

SEQ ID NO: 2147831 - DNA, 20 bp, Homo sapiens
ggcccccctccttgctctgc

SEQ ID NO: 2147832 - DNA, 16 bp, Homo sapiens
ggccccctgtgccagc

SEQ ID NO: 2147833 - DNA, 17 bp, Homo sapiens
ggccccctgtgccagct

SEQ ID NO: 2147834 - DNA, 21 bp, Homo sapiens
ggccccgcttgtccagcgcct

SEQ ID NO: 2147835 - DNA, 19 bp, Homo sapiens
ggccccgggctctggccac

SEQ ID NO: 2147836 - DNA, 14 bp, Homo sapiens
ggccccggggctgg

SEQ ID NO: 2147837 - DNA, 13 bp, Homo sapiens
ggcccctccacgc

SEQ ID NO: 2147838 - DNA, 20 bp, Homo sapiens
ggcccctccagaccctgcct

SEQ ID NO: 2147839 - DNA, 19 bp, Homo sapiens
ggcccctccctctgcccca

SEQ ID NO: 2147840 - DNA, 13 bp, Homo sapiens
ggcccctgaggac

SEQ ID NO: 2147841 - DNA, 17 bp, Homo sapiens
ggcccctgcatcccctt

SEQ ID NO: 2147842 - DNA, 18 bp, Homo sapiens
cctcctcattcagaccaa

SEQ ID NO: 2147843 - DNA, 12 bp, Homo sapiens
cctcctctccat

SEQ ID NO: 2147844 - DNA, 13 bp, Homo sapiens
cctcctgccagct

SEQ ID NO: 2147845 - DNA, 14 bp, Homo sapiens
cctcctgccagctc

SEQ ID NO: 2147846 - DNA, 16 bp, Homo sapiens
cctcctgccagctctg

SEQ ID NO: 2147847 - DNA, 23 bp, Homo sapiens
cctcctgccctgtccctgtcccc

SEQ ID NO: 2147848 - DNA, 18 bp, Homo sapiens
cctcggaggctcctccct

SEQ ID NO: 2147849 - DNA, 15 bp, Homo sapiens
cctcggcccatctgt

SEQ ID NO: 2147850 - DNA, 18 bp, Homo sapiens
cctctaactccctcctca

SEQ ID NO: 2147851 - DNA, 21 bp, Homo sapiens
cctctccaagtctctctgtga

SEQ ID NO: 2147852 - DNA, 23 bp, Homo sapiens
cctctccatgcaagtgctgtttg

SEQ ID NO: 2147853 - DNA, 13 bp, Homo sapiens
cctctgcctcatc

SEQ ID NO: 2147854 - DNA, 16 bp, Homo sapiens
cctctgcctcatcctc

SEQ ID NO: 2147855 - DNA, 21 bp, Homo sapiens
cctctgcctcatcctcctcct

SEQ ID NO: 2147856 - DNA, 16 bp, Homo sapiens
cctctggttgcctccc

SEQ ID NO: 2147857 - DNA, 17 bp, Homo sapiens
cctctggttgcctcccc

SEQ ID NO: 2147858 - DNA, 19 bp, Homo sapiens
cctgacactgagccccacc

SEQ ID NO: 2147859 - DNA, 20 bp, Homo sapiens
cctgacagatgtcagccgag

SEQ ID NO: 2147860 - DNA, 15 bp, Homo sapiens
cctgacccctgcacc

SEQ ID NO: 2147861 - DNA, 21 bp, Homo sapiens
cctgacccggattggccctgc

SEQ ID NO: 2147862 - DNA, 22 bp, Homo sapiens
cctgacccggattggccctgcc

SEQ ID NO: 2147863 - DNA, 14 bp, Homo sapiens
cctgacctccagtc

SEQ ID NO: 2147864 - DNA, 22 bp, Homo sapiens
cctgagaccagttgggagcact

SEQ ID NO: 2147865 - DNA, 15 bp, Homo sapiens
cctgaggatcccctg

SEQ ID NO: 2147866 - DNA, 16 bp, Homo sapiens
cctgaggatcccctgt

SEQ ID NO: 2147867 - DNA, 22 bp, Homo sapiens
cctgaggatcccctgtcccctg

SEQ ID NO: 2147868 - DNA, 16 bp, Homo sapiens
cctgagggtggagact

SEQ ID NO: 2147869 - DNA, 16 bp, Homo sapiens
cctgagtctcctgtgc

SEQ ID NO: 2147870 - DNA, 18 bp, Homo sapiens
cctgagtctcctgtgccc

SEQ ID NO: 2147871 - DNA, 14 bp, Homo sapiens
cctgcaaactcact

SEQ ID NO: 2147872 - DNA, 16 bp, Homo sapiens
cctgcaaactcactgc

SEQ ID NO: 2147873 - DNA, 15 bp, Homo sapiens
cctgccagctctgtc

SEQ ID NO: 2147874 - DNA, 23 bp, Homo sapiens
cctgcccaagggcctcccaccag

SEQ ID NO: 2147875 - DNA, 15 bp, Homo sapiens
cctgcccctccccct

SEQ ID NO: 2147876 - DNA, 19 bp, Homo sapiens
cctgcccctccctagatcc

SEQ ID NO: 2147877 - DNA, 20 bp, Homo sapiens
cctgcccctccctagatcca

SEQ ID NO: 2147878 - DNA, 16 bp, Homo sapiens
cctgcctagctcttgg

SEQ ID NO: 2147879 - DNA, 15 bp, Homo sapiens
cctgcctgctgtgga

SEQ ID NO: 2147880 - DNA, 17 bp, Homo sapiens
cctgctcctcctgccct

SEQ ID NO: 2147881 - DNA, 20 bp, Homo sapiens
cctgctcctcctgccctgtc

SEQ ID NO: 2147882 - DNA, 16 bp, Homo sapiens
cctgctggcctgctct

SEQ ID NO: 2147883 - DNA, 12 bp, Homo sapiens
cctgctgggctc

SEQ ID NO: 2147884 - DNA, 14 bp, Homo sapiens
cctgctgggctctt

SEQ ID NO: 2147885 - DNA, 18 bp, Homo sapiens
cctgctttgaggacaaag

SEQ ID NO: 2147886 - DNA, 13 bp, Homo sapiens
cggccctgcccct

SEQ ID NO: 2147887 - DNA, 14 bp, Homo sapiens
cggcctgctcccag

SEQ ID NO: 2147888 - DNA, 18 bp, Homo sapiens
cggcctgctcccagcagc

SEQ ID NO: 2147889 - DNA, 20 bp, Homo sapiens
cggctgggtcggccctgccc

SEQ ID NO: 2147890 - DNA, 19 bp, Homo sapiens
cgggacatggttgggggaa

SEQ ID NO: 2147891 - DNA, 11 bp, Homo sapiens
cgggctcagag

SEQ ID NO: 2147892 - DNA, 23 bp, Homo sapiens
cggtgggggggagaaggcctccc

SEQ ID NO: 2147893 - DNA, 16 bp, Homo sapiens
cgtaaaaatgatttca

SEQ ID NO: 2147894 - DNA, 23 bp, Homo sapiens
cgtcaagttgcagatctttttgt

SEQ ID NO: 2147895 - DNA, 11 bp, Homo sapiens
cgtctctctgc

SEQ ID NO: 2147896 - DNA, 14 bp, Homo sapiens
cgtctctctgcctg

SEQ ID NO: 2147897 - DNA, 13 bp, Homo sapiens
cgtgactcagagc

SEQ ID NO: 2147898 - DNA, 23 bp, Homo sapiens
cgtggctccagaatgtgctgcct

SEQ ID NO: 2147899 - DNA, 17 bp, Homo sapiens
cgttctgctggcctgga

SEQ ID NO: 2147900 - DNA, 12 bp, Homo sapiens
ctaaacagatat

SEQ ID NO: 2147901 - DNA, 21 bp, Homo sapiens
ctaaagctctgaacaaaagct

SEQ ID NO: 2147902 - DNA, 22 bp, Homo sapiens
ctaaagctctgaacaaaagctt

SEQ ID NO: 2147903 - DNA, 18 bp, Homo sapiens
ctaaccaaagagtctctg

SEQ ID NO: 2147904 - DNA, 21 bp, Homo sapiens
ctaaccaaagagtctctggct

SEQ ID NO: 2147905 - DNA, 13 bp, Homo sapiens
ctaactccctcct

SEQ ID NO: 2147906 - DNA, 14 bp, Homo sapiens
ctaactccctcctc

SEQ ID NO: 2147907 - DNA, 16 bp, Homo sapiens
ctaactccctcctcac

SEQ ID NO: 2147908 - DNA, 21 bp, Homo sapiens
ctaagccctgtcgagacactt

SEQ ID NO: 2147909 - DNA, 14 bp, Homo sapiens
ctaagctttctcct

SEQ ID NO: 2147910 - DNA, 17 bp, Homo sapiens
ctaagctttctcctttg

SEQ ID NO: 2147911 - DNA, 12 bp, Homo sapiens
ctaaggacacac

SEQ ID NO: 2147912 - DNA, 16 bp, Homo sapiens
ctaaggacacactaat

SEQ ID NO: 2147913 - DNA, 12 bp, Homo sapiens
ctaaggatctct

SEQ ID NO: 2147914 - DNA, 20 bp, Homo sapiens
ctaaggatctctcaggagca

SEQ ID NO: 2147915 - DNA, 20 bp, Homo sapiens
ctaagttatagtatatctgg

SEQ ID NO: 2147916 - DNA, 16 bp, Homo sapiens
ctaataaatcaatgtg

SEQ ID NO: 2147917 - DNA, 17 bp, Homo sapiens
ctaataaatcaatgtga

SEQ ID NO: 2147918 - DNA, 18 bp, Homo sapiens
ctaatcaagagtctctcc

SEQ ID NO: 2147919 - DNA, 15 bp, Homo sapiens
ctaatcgaactatga

SEQ ID NO: 2147920 - DNA, 18 bp, Homo sapiens
ctaatctgtagggctgga

SEQ ID NO: 2147921 - DNA, 12 bp, Homo sapiens
ctacacatatat

SEQ ID NO: 2147922 - DNA, 12 bp, Homo sapiens
ctaccgcatggc

SEQ ID NO: 2147923 - DNA, 14 bp, Homo sapiens
ctaccgcatggcag

SEQ ID NO: 2147924 - DNA, 14 bp, Homo sapiens
ctcccactcctaat

SEQ ID NO: 2147925 - DNA, 14 bp, Homo sapiens
ctcccagtcctcca

SEQ ID NO: 2147926 - DNA, 15 bp, Homo sapiens
ctcccagtcctccag

SEQ ID NO: 2147927 - DNA, 13 bp, Homo sapiens
ctccccacagtcc

SEQ ID NO: 2147928 - DNA, 12 bp, Homo sapiens
ctccccactcta

SEQ ID NO: 2147929 - DNA, 14 bp, Homo sapiens
ctccccagcccttt

SEQ ID NO: 2147930 - DNA, 13 bp, Homo sapiens
ctcccccacgtct

SEQ ID NO: 2147931 - DNA, 17 bp, Homo sapiens
ctcccccacgtctctct

SEQ ID NO: 2147932 - DNA, 19 bp, Homo sapiens
ctcccccacgtctctctgc

SEQ ID NO: 2147933 - DNA, 22 bp, Homo sapiens
ctccccctaccgcatggcagct

SEQ ID NO: 2147934 - DNA, 14 bp, Homo sapiens
ctcccctcccagtc

SEQ ID NO: 2147935 - DNA, 16 bp, Homo sapiens
ctcccctcccagtcct

SEQ ID NO: 2147936 - DNA, 18 bp, Homo sapiens
ctccccttgcccttcctg

SEQ ID NO: 2147937 - DNA, 23 bp, Homo sapiens
ctcccggacctggactagggcct

SEQ ID NO: 2147938 - DNA, 18 bp, Homo sapiens
ctcccgggaagcatcctc

SEQ ID NO: 2147939 - DNA, 23 bp, Homo sapiens
ctcccgggaagcatcctccccac

SEQ ID NO: 2147940 - DNA, 14 bp, Homo sapiens
ctccctagatccag

SEQ ID NO: 2147941 - DNA, 22 bp, Homo sapiens
ctccctagatccaggcttctcc

SEQ ID NO: 2147942 - DNA, 23 bp, Homo sapiens
ctccctagatccaggcttctccc

SEQ ID NO: 2147943 - DNA, 12 bp, Homo sapiens
ctccctcctcac

SEQ ID NO: 2147944 - DNA, 13 bp, Homo sapiens
ctccctcctcaca

SEQ ID NO: 2147945 - DNA, 18 bp, Homo sapiens
ctccctcctcacactcca

SEQ ID NO: 2147946 - DNA, 19 bp, Homo sapiens
ctccctcctcacactccag

SEQ ID NO: 2147947 - DNA, 12 bp, Homo sapiens
ctccctctgcct

SEQ ID NO: 2147948 - DNA, 13 bp, Homo sapiens
ctccctctgcctc

SEQ ID NO: 2147949 - DNA, 17 bp, Homo sapiens
ctccctctgcctcatcc

SEQ ID NO: 2147950 - DNA, 23 bp, Homo sapiens
ctccctctgcctcatcctcctcc

SEQ ID NO: 2147951 - DNA, 21 bp, Homo sapiens
ctcccttgagtaggccctgct

SEQ ID NO: 2147952 - DNA, 19 bp, Homo sapiens
ctcctaatcaagagtctct

SEQ ID NO: 2147953 - DNA, 16 bp, Homo sapiens
ctcctcacactccaga

SEQ ID NO: 2147954 - DNA, 17 bp, Homo sapiens
ctcctcccctgccgcct

SEQ ID NO: 2147955 - DNA, 18 bp, Homo sapiens
ctcctcccctgccgcctc

SEQ ID NO: 2147956 - DNA, 11 bp, Homo sapiens
ctcctccctct

SEQ ID NO: 2147957 - DNA, 13 bp, Homo sapiens
ctcctccctctgc

SEQ ID NO: 2147958 - DNA, 17 bp, Homo sapiens
ctcctccctctgcctca

SEQ ID NO: 2147959 - DNA, 12 bp, Homo sapiens
ctcctcctgcca

SEQ ID NO: 2147960 - DNA, 23 bp, Homo sapiens
ctcctctccatgcaagtgctgtt

SEQ ID NO: 2147961 - DNA, 12 bp, Homo sapiens
ctcctgccagct

SEQ ID NO: 2147962 - DNA, 12 bp, Homo sapiens
ctcctgccctgt

SEQ ID NO: 2147963 - DNA, 18 bp, Homo sapiens
ctcctgccctgtccctgt

SEQ ID NO: 2147964 - DNA, 20 bp, Homo sapiens
ctccttccccttgtccctgg

SEQ ID NO: 2147965 - DNA, 23 bp, Homo sapiens
ctccttccccttgtccctggggc

SEQ ID NO: 2147966 - DNA, 22 bp, Homo sapiens
ctcctttgcactgagggccaca

SEQ ID NO: 2147967 - DNA, 13 bp, Homo sapiens
ctcggaggctcct

SEQ ID NO: 2147968 - DNA, 19 bp, Homo sapiens
ctcggaggctcctccctct

SEQ ID NO: 2147969 - DNA, 20 bp, Homo sapiens
ctcggaggctcctccctctg

SEQ ID NO: 2147970 - DNA, 18 bp, Homo sapiens
ctctaaactgctgttaat

SEQ ID NO: 2147971 - DNA, 21 bp, Homo sapiens
ctctaactccctcctcacact

SEQ ID NO: 2147972 - DNA, 18 bp, Homo sapiens
ctctcaggagcacaggca

SEQ ID NO: 2147973 - DNA, 22 bp, Homo sapiens
ctctccaagtctctctgtgaat

SEQ ID NO: 2147974 - DNA, 11 bp, Homo sapiens
ctctccagcct

SEQ ID NO: 2147975 - DNA, 12 bp, Homo sapiens
ctctccagcctc

SEQ ID NO: 2147976 - DNA, 16 bp, Homo sapiens
ctctccagcctcacag

SEQ ID NO: 2147977 - DNA, 17 bp, Homo sapiens
ctctccagcctcacaga

SEQ ID NO: 2147978 - DNA, 14 bp, Homo sapiens
ctctccatgcaagt

SEQ ID NO: 2147979 - DNA, 18 bp, Homo sapiens
ctctccatgcaagtgctg

SEQ ID NO: 2147980 - DNA, 22 bp, Homo sapiens
ctctccatgcaagtgctgtttg

SEQ ID NO: 2147981 - DNA, 13 bp, Homo sapiens
ctctctgcctgct

SEQ ID NO: 2147982 - DNA, 20 bp, Homo sapiens
ctctctgcctgctgggctct

SEQ ID NO: 2147983 - DNA, 15 bp, Homo sapiens
ctctgagtgtctctg

SEQ ID NO: 2147984 - DNA, 18 bp, Homo sapiens
ctctgagtgtctctgcct

SEQ ID NO: 2147985 - DNA, 19 bp, Homo sapiens
ctctgagtgtctctgcctg

SEQ ID NO: 2147986 - DNA, 21 bp, Homo sapiens
ctctgagtgtctctgcctgga

SEQ ID NO: 2147987 - DNA, 15 bp, Homo sapiens
ctctgcctcatcctc

SEQ ID NO: 2147988 - DNA, 17 bp, Homo sapiens
ctctgcctcatcctcct

SEQ ID NO: 2147989 - DNA, 13 bp, Homo sapiens
ctctgcctgctgg

SEQ ID NO: 2147990 - DNA, 14 bp, Homo sapiens
ctctgcctgctggg

SEQ ID NO: 2147991 - DNA, 18 bp, Homo sapiens
ctctgcctgctgggctct

SEQ ID NO: 2147992 - DNA, 18 bp, Homo sapiens
ctctgcctggagcagggg

SEQ ID NO: 2147993 - DNA, 16 bp, Homo sapiens
ctctgctgcctgtaca

SEQ ID NO: 2147994 - DNA, 15 bp, Homo sapiens
ctctggctcagctgt

SEQ ID NO: 2147995 - DNA, 20 bp, Homo sapiens
ctctggctcagctgtggtcc

SEQ ID NO: 2147996 - DNA, 23 bp, Homo sapiens
ctctggctcagctgtggtcccac

SEQ ID NO: 2147997 - DNA, 12 bp, Homo sapiens
ctctggttgcct

SEQ ID NO: 2147998 - DNA, 14 bp, Homo sapiens
ctctggttgcctcc

SEQ ID NO: 2147999 - DNA, 16 bp, Homo sapiens
ctctgtcaccctggcc

SEQ ID NO: 2148000 - DNA, 17 bp, Homo sapiens
ctctgtcaccctggcca

SEQ ID NO: 2148001 - DNA, 19 bp, Homo sapiens
ctctgtcaccctggccacc

SEQ ID NO: 2148002 - DNA, 19 bp, Homo sapiens
ctctgtgaatacaattaaa

SEQ ID NO: 2148003 - DNA, 13 bp, Homo sapiens
ctcttacttcccc

SEQ ID NO: 2148004 - DNA, 20 bp, Homo sapiens
ctcttacttcccccaccctg

SEQ ID NO: 2148005 - DNA, 22 bp, Homo sapiens
ctcttacttcccccaccctggg

SEQ ID NO: 2148006 - DNA, 22 bp, Homo sapiens
ctcttccaccagagcaggggct

SEQ ID NO: 2148007 - DNA, 20 bp, Homo sapiens
ctcttcctacccaaccactc

SEQ ID NO: 2148008 - DNA, 22 bp, Homo sapiens
ctcttcctacccaaccactcaa

SEQ ID NO: 2148009 - DNA, 16 bp, Homo sapiens
ctcttggcacctgcct

SEQ ID NO: 2148010 - DNA, 17 bp, Homo sapiens
ctcttggcacctgccta

SEQ ID NO: 2148011 - DNA, 22 bp, Homo sapiens
ctcttggcacctgcctagctct

SEQ ID NO: 2148012 - DNA, 16 bp, Homo sapiens
ctgaacagtgctctgc

SEQ ID NO: 2148013 - DNA, 18 bp, Homo sapiens
ctgaacagtgctctgcct

SEQ ID NO: 2148014 - DNA, 19 bp, Homo sapiens
ctgaacagtgctctgcctc

SEQ ID NO: 2148015 - DNA, 21 bp, Homo sapiens
ctgaacagtgctctgcctcta

SEQ ID NO: 2148016 - DNA, 22 bp, Homo sapiens
ctgaatggttccatgcctgagg

SEQ ID NO: 2148017 - DNA, 16 bp, Homo sapiens
ctgacactgagcccca

SEQ ID NO: 2148018 - DNA, 17 bp, Homo sapiens
ctgacccaccaaggtct

SEQ ID NO: 2148019 - DNA, 24 bp, Homo sapiens
ctgacccaccaaggtctcacactc

SEQ ID NO: 2148020 - DNA, 14 bp, Homo sapiens
ctgacccctgcacc

SEQ ID NO: 2148021 - DNA, 19 bp, Homo sapiens
ctgacccggattggccctg

SEQ ID NO: 2148022 - DNA, 20 bp, Homo sapiens
ctgacccggattggccctgc

SEQ ID NO: 2148023 - DNA, 22 bp, Homo sapiens
ctgacccggattggccctgccc

SEQ ID NO: 2148024 - DNA, 23 bp, Homo sapiens
ctgacccggattggccctgcccc

SEQ ID NO: 2148025 - DNA, 16 bp, Homo sapiens
ctgacctccagtcctg

SEQ ID NO: 2148026 - DNA, 19 bp, Homo sapiens
ctgacctccagtcctgctg

SEQ ID NO: 2148027 - DNA, 16 bp, Homo sapiens
ctgagaagtgtatata

SEQ ID NO: 2148028 - DNA, 17 bp, Homo sapiens
ctgagaagtgtatatag

SEQ ID NO: 2148029 - DNA, 17 bp, Homo sapiens
ctgaggatcccctgtcc

SEQ ID NO: 2148030 - DNA, 19 bp, Homo sapiens
ctgaggatcccctgtcccc

SEQ ID NO: 2148031 - DNA, 12 bp, Homo sapiens
ctgaggcctccc

SEQ ID NO: 2148032 - DNA, 12 bp, Homo sapiens
ctgagggcatct

SEQ ID NO: 2148033 - DNA, 13 bp, Homo sapiens
ctgagggcatctc

SEQ ID NO: 2148034 - DNA, 15 bp, Homo sapiens
ctgagggtggagact

SEQ ID NO: 2148035 - DNA, 17 bp, Homo sapiens
gcatcctccccaccaga

SEQ ID NO: 2148036 - DNA, 21 bp, Homo sapiens
gcatcctccccaccagagctg

SEQ ID NO: 2148037 - DNA, 23 bp, Homo sapiens
gcatcctccccaccagagctgcc

SEQ ID NO: 2148038 - DNA, 19 bp, Homo sapiens
gcatctctgagtgtctctg

SEQ ID NO: 2148039 - DNA, 13 bp, Homo sapiens
gcatggcagctgg

SEQ ID NO: 2148040 - DNA, 16 bp, Homo sapiens
gcatggcagctgggcc

SEQ ID NO: 2148041 - DNA, 20 bp, Homo sapiens
gcatggcagctgggcccaca

SEQ ID NO: 2148042 - DNA, 13 bp, Homo sapiens
gccaacttgtaaa

SEQ ID NO: 2148043 - DNA, 17 bp, Homo sapiens
gccaacttgtaaataca

SEQ ID NO: 2148044 - DNA, 18 bp, Homo sapiens
gccacactattaccatga

SEQ ID NO: 2148045 - DNA, 21 bp, Homo sapiens
gccacactattaccatgagaa

SEQ ID NO: 2148046 - DNA, 16 bp, Homo sapiens
gccacatggtgtctcc

SEQ ID NO: 2148047 - DNA, 16 bp, Homo sapiens
gccaccacccaacctg

SEQ ID NO: 2148048 - DNA, 23 bp, Homo sapiens
gccacccgttctgctggcctgga

SEQ ID NO: 2148049 - DNA, 15 bp, Homo sapiens
gccaccgcagctgct

SEQ ID NO: 2148050 - DNA, 17 bp, Homo sapiens
gccaccgcagctgctgc

SEQ ID NO: 2148051 - DNA, 19 bp, Homo sapiens
gccaccgcagctgctgcca

SEQ ID NO: 2148052 - DNA, 21 bp, Homo sapiens
gccaccgcagctgctgccact

SEQ ID NO: 2148053 - DNA, 16 bp, Homo sapiens
gccactacctttgtcc

SEQ ID NO: 2148054 - DNA, 13 bp, Homo sapiens
gccactctgctgc

SEQ ID NO: 2148055 - DNA, 16 bp, Homo sapiens
gccactctgctgcctg

SEQ ID NO: 2148056 - DNA, 22 bp, Homo sapiens
gccagcaatgatgtccagaaga

SEQ ID NO: 2148057 - DNA, 13 bp, Homo sapiens
gccagcaggcagc

SEQ ID NO: 2148058 - DNA, 20 bp, Homo sapiens
gccagcaggcagcgcctgtc

SEQ ID NO: 2148059 - DNA, 15 bp, Homo sapiens
gccagctctgtcacc

SEQ ID NO: 2148060 - DNA, 23 bp, Homo sapiens
gccagctctgtcaccctggccac

SEQ ID NO: 2148061 - DNA, 14 bp, Homo sapiens
gccagtctgggctg

SEQ ID NO: 2148062 - DNA, 17 bp, Homo sapiens
gccagtctgggctgccg

SEQ ID NO: 2148063 - DNA, 18 bp, Homo sapiens
gccatggggtccatcccc

SEQ ID NO: 2148064 - DNA, 16 bp, Homo sapiens
gccatgggtcctcggc

SEQ ID NO: 2148065 - DNA, 17 bp, Homo sapiens
gccatgggtcctcggcc

SEQ ID NO: 2148066 - DNA, 19 bp, Homo sapiens
gcccacacacactccttcc

SEQ ID NO: 2148067 - DNA, 16 bp, Homo sapiens
gcccacagcccccacc

SEQ ID NO: 2148068 - DNA, 18 bp, Homo sapiens
gcccacagcccccacccc

SEQ ID NO: 2148069 - DNA, 15 bp, Homo sapiens
gcccacatcccaggc

SEQ ID NO: 2148070 - DNA, 19 bp, Homo sapiens
gcccaccctgctcctcctg

SEQ ID NO: 2148071 - DNA, 23 bp, Homo sapiens
gcccaccctgctcctcctgccct

SEQ ID NO: 2148072 - DNA, 16 bp, Homo sapiens
gcccagagctggaaca

SEQ ID NO: 2148073 - DNA, 22 bp, Homo sapiens
gcccatctgtccatcctcctct

SEQ ID NO: 2148074 - DNA, 21 bp, Homo sapiens
gccccaagaggggcgggctca

SEQ ID NO: 2148075 - DNA, 23 bp, Homo sapiens
gccccaagaggggcgggctcaga

SEQ ID NO: 2148076 - DNA, 16 bp, Homo sapiens
gccccatctcctccca

SEQ ID NO: 2148077 - DNA, 20 bp, Homo sapiens
gcccccaccccagcacagct

SEQ ID NO: 2148078 - DNA, 16 bp, Homo sapiens
gcccctccccctaccg

SEQ ID NO: 2148079 - DNA, 13 bp, Homo sapiens
gcccctggaacct

SEQ ID NO: 2148080 - DNA, 23 bp, Homo sapiens
gcccctggaacctttcccttgtg

SEQ ID NO: 2148081 - DNA, 15 bp, Homo sapiens
gccccttcccatctc

SEQ ID NO: 2148082 - DNA, 19 bp, Homo sapiens
gcccgaccccatctcattc

SEQ ID NO: 2148083 - DNA, 14 bp, Homo sapiens
gcccggcctgctcc

SEQ ID NO: 2148084 - DNA, 15 bp, Homo sapiens
gcccggcctgctccc

SEQ ID NO: 2148085 - DNA, 22 bp, Homo sapiens
gcccggcctgctcccagcagcc

SEQ ID NO: 2148086 - DNA, 14 bp, Homo sapiens
gccctgcccctccc

SEQ ID NO: 2148087 - DNA, 22 bp, Homo sapiens
gccctgcccctccccctaccgc

SEQ ID NO: 2148088 - DNA, 23 bp, Homo sapiens
gccctgcccctccctagatccag

SEQ ID NO: 2148089 - DNA, 16 bp, Homo sapiens
gccgagccgggcctgg

SEQ ID NO: 2148090 - DNA, 13 bp, Homo sapiens
gccggccctgccc

SEQ ID NO: 2148091 - DNA, 15 bp, Homo sapiens
gccggccctgcccct

SEQ ID NO: 2148092 - DNA, 16 bp, Homo sapiens
gccggccctgcccctc

SEQ ID NO: 2148093 - DNA, 17 bp, Homo sapiens
gccgtgatgctcaggct

SEQ ID NO: 2148094 - DNA, 18 bp, Homo sapiens
gcctagctcttgggcctg

SEQ ID NO: 2148095 - DNA, 17 bp, Homo sapiens
gcctccagtcatggtac

SEQ ID NO: 2148096 - DNA, 18 bp, Homo sapiens
gcctccagtcatggtact

SEQ ID NO: 2148097 - DNA, 13 bp, Homo sapiens
gcctcccaccaga

SEQ ID NO: 2148098 - DNA, 21 bp, Homo sapiens
gcctcccgggaagcatcctcc

SEQ ID NO: 2148099 - DNA, 15 bp, Homo sapiens
gcctcggaggctcct

SEQ ID NO: 2148100 - DNA, 17 bp, Homo sapiens
gcctcggaggctcctcc

SEQ ID NO: 2148101 - DNA, 21 bp, Homo sapiens
gcctcggaggctcctccctct

SEQ ID NO: 2148102 - DNA, 22 bp, Homo sapiens
gcctcggaggctcctccctctg

SEQ ID NO: 2148103 - DNA, 23 bp, Homo sapiens
gcctcggaggctcctccctctgc

SEQ ID NO: 2148104 - DNA, 16 bp, Homo sapiens
gcctctaactccctcc

SEQ ID NO: 2148105 - DNA, 18 bp, Homo sapiens
gcctctggttgcctcccc

SEQ ID NO: 2148106 - DNA, 19 bp, Homo sapiens
gcctctggttgcctccccc

SEQ ID NO: 2148107 - DNA, 20 bp, Homo sapiens
gcctgacactgagccccacc

SEQ ID NO: 2148108 - DNA, 14 bp, Homo sapiens
gcctgacctccagt

SEQ ID NO: 2148109 - DNA, 19 bp, Homo sapiens
gcctgacctccagtcctgc

SEQ ID NO: 2148110 - DNA, 17 bp, Homo sapiens
gcctgagggtggagact

SEQ ID NO: 2148111 - DNA, 13 bp, Homo sapiens
gcctgagtctcct

SEQ ID NO: 2148112 - DNA, 13 bp, Homo sapiens
gcctgctcccagc

SEQ ID NO: 2148113 - DNA, 15 bp, Homo sapiens
gcctgctcccagcag

SEQ ID NO: 2148114 - DNA, 20 bp, Homo sapiens
gcctgctcccagcagcccta

SEQ ID NO: 2148115 - DNA, 23 bp, Homo sapiens
gcctgctcttacttcccccaccc

SEQ ID NO: 2148116 - DNA, 23 bp, Homo sapiens
ggcccctcaggggaagctgctag

SEQ ID NO: 2148117 - DNA, 22 bp, Homo sapiens
ggccctaggattcctcccccag

SEQ ID NO: 2148118 - DNA, 12 bp, Homo sapiens
ggccctgcccct

SEQ ID NO: 2148119 - DNA, 14 bp, Homo sapiens
ggccctgcccctcc

SEQ ID NO: 2148120 - DNA, 23 bp, Homo sapiens
ggccctgcccctccccctaccgc

SEQ ID NO: 2148121 - DNA, 17 bp, Homo sapiens
ggccctgcccctcccta

SEQ ID NO: 2148122 - DNA, 13 bp, Homo sapiens
ggccggccctgcc

SEQ ID NO: 2148123 - DNA, 13 bp, Homo sapiens
ggcctcccaccag

SEQ ID NO: 2148124 - DNA, 11 bp, Homo sapiens
ggcctcccctg

SEQ ID NO: 2148125 - DNA, 22 bp, Homo sapiens
ggcctcccctgaggatcccctg

SEQ ID NO: 2148126 - DNA, 22 bp, Homo sapiens
ggcctcccttgagtaggccctg

SEQ ID NO: 2148127 - DNA, 18 bp, Homo sapiens
ggcctcggaggctcctcc

SEQ ID NO: 2148128 - DNA, 14 bp, Homo sapiens
ggcctgacctccag

SEQ ID NO: 2148129 - DNA, 20 bp, Homo sapiens
ggcctgacctccagtcctgc

SEQ ID NO: 2148130 - DNA, 14 bp, Homo sapiens
ggcctggggctcct

SEQ ID NO: 2148131 - DNA, 16 bp, Homo sapiens
ggcctggggctccttt

SEQ ID NO: 2148132 - DNA, 20 bp, Homo sapiens
ggcctgtgggagcctgcaaa

SEQ ID NO: 2148133 - DNA, 16 bp, Homo sapiens
ggcgggctcagagctt

SEQ ID NO: 2148134 - DNA, 15 bp, Homo sapiens
ggctcagagctttgt

SEQ ID NO: 2148135 - DNA, 14 bp, Homo sapiens
ggctcagctgtggt

SEQ ID NO: 2148136 - DNA, 19 bp, Homo sapiens
ggctcagctgtggtcccac

SEQ ID NO: 2148137 - DNA, 17 bp, Homo sapiens
ggctcttaactgttgct

SEQ ID NO: 2148138 - DNA, 14 bp, Homo sapiens
ggctgagggcatct

SEQ ID NO: 2148139 - DNA, 15 bp, Homo sapiens
ggctgggggagggac

SEQ ID NO: 2148140 - DNA, 21 bp, Homo sapiens
ggctgggggagggactgctga

SEQ ID NO: 2148141 - DNA, 19 bp, Homo sapiens
ggctggtggattgggcaga

SEQ ID NO: 2148142 - DNA, 13 bp, Homo sapiens
ggcttctcccgga

SEQ ID NO: 2148143 - DNA, 13 bp, Homo sapiens
gggaagcatcctc

SEQ ID NO: 2148144 - DNA, 15 bp, Homo sapiens
gggaagcatcctccc

SEQ ID NO: 2148145 - DNA, 19 bp, Homo sapiens
gggaagcatcctccccacc

SEQ ID NO: 2148146 - DNA, 15 bp, Homo sapiens
gggaccactgggccc

SEQ ID NO: 2148147 - DNA, 17 bp, Homo sapiens
gggaccactgggcccct

SEQ ID NO: 2148148 - DNA, 18 bp, Homo sapiens
gggaccactgggcccctc

SEQ ID NO: 2148149 - DNA, 24 bp, Homo sapiens
gggactgggccatgggtcctcggc

SEQ ID NO: 2148150 - DNA, 16 bp, Homo sapiens
gggagcactggagtgc

SEQ ID NO: 2148151 - DNA, 12 bp, Homo sapiens
gggagctgaggc

SEQ ID NO: 2148152 - DNA, 17 bp, Homo sapiens
gggagctgaggcctccc

SEQ ID NO: 2148153 - DNA, 18 bp, Homo sapiens
gggagctgaggcctccct

SEQ ID NO: 2148154 - DNA, 17 bp, Homo sapiens
gggagggagctgaggcc

SEQ ID NO: 2148155 - DNA, 22 bp, Homo sapiens
gggatcagccccgcctgtcaca

SEQ ID NO: 2148156 - DNA, 15 bp, Homo sapiens
gggcactcccccagg

SEQ ID NO: 2148157 - DNA, 15 bp, Homo sapiens
gggcagaatcctggg

SEQ ID NO: 2148158 - DNA, 20 bp, Homo sapiens
gggcagaatcctgggccccc

SEQ ID NO: 2148159 - DNA, 12 bp, Homo sapiens
gggcagctgagg

SEQ ID NO: 2148160 - DNA, 14 bp, Homo sapiens
gggcagctgaggac

SEQ ID NO: 2148161 - DNA, 13 bp, Homo sapiens
gggcatctctgag

SEQ ID NO: 2148162 - DNA, 16 bp, Homo sapiens
gggccagcaggcagcg

SEQ ID NO: 2148163 - DNA, 15 bp, Homo sapiens
gggccagtctgggct

SEQ ID NO: 2148164 - DNA, 16 bp, Homo sapiens
gggccagtctgggctg

SEQ ID NO: 2148165 - DNA, 15 bp, Homo sapiens
gggccatgggtcctc

SEQ ID NO: 2148166 - DNA, 22 bp, Homo sapiens
gggccatgggtcctcggcccat

SEQ ID NO: 2148167 - DNA, 18 bp, Homo sapiens
gggcccacagcccccacc

SEQ ID NO: 2148168 - DNA, 12 bp, Homo sapiens
gggcccccagag

SEQ ID NO: 2148169 - DNA, 16 bp, Homo sapiens
gggcccctcaggggaa

SEQ ID NO: 2148170 - DNA, 22 bp, Homo sapiens
gggcccctcaggggaagctgct

SEQ ID NO: 2148171 - DNA, 14 bp, Homo sapiens
gggcctgacctcca

SEQ ID NO: 2148172 - DNA, 12 bp, Homo sapiens
gggcgctcctgt

SEQ ID NO: 2148173 - DNA, 12 bp, Homo sapiens
gggcgggctcag

SEQ ID NO: 2148174 - DNA, 14 bp, Homo sapiens
gggcgggctcagag

SEQ ID NO: 2148175 - DNA, 21 bp, Homo sapiens
gggcgggctcagagctttgtc

SEQ ID NO: 2148176 - DNA, 19 bp, Homo sapiens
gggctccccttgcccttcc

SEQ ID NO: 2148177 - DNA, 21 bp, Homo sapiens
gggctcctttctccagccagc

SEQ ID NO: 2148178 - DNA, 21 bp, Homo sapiens
gggctggtgaggccggccctg

SEQ ID NO: 2148179 - DNA, 13 bp, Homo sapiens
ggggaagggccag

SEQ ID NO: 2148180 - DNA, 19 bp, Homo sapiens
ggggaccactgggcccctc

SEQ ID NO: 2148181 - DNA, 15 bp, Homo sapiens
ggggagaaggcctcc

SEQ ID NO: 2148182 - DNA, 17 bp, Homo sapiens
ggggctccccttgccct

SEQ ID NO: 2148183 - DNA, 20 bp, Homo sapiens
ggggctccccttgcccttcc

SEQ ID NO: 2148184 - DNA, 21 bp, Homo sapiens
ggggctcctttctccagccag

SEQ ID NO: 2148185 - DNA, 13 bp, Homo sapiens
ggggctgctgggg

SEQ ID NO: 2148186 - DNA, 16 bp, Homo sapiens
gggggagaaggcctcc

SEQ ID NO: 2148187 - DNA, 18 bp, Homo sapiens
gggggagaaggcctcccc

SEQ ID NO: 2148188 - DNA, 22 bp, Homo sapiens
gggggagaaggcctcccctgag

SEQ ID NO: 2148189 - DNA, 12 bp, Homo sapiens
gggtcaggctcc

SEQ ID NO: 2148190 - DNA, 14 bp, Homo sapiens
gggtcctcggccca

SEQ ID NO: 2148191 - DNA, 15 bp, Homo sapiens
gggtcggccctgccc

SEQ ID NO: 2148192 - DNA, 14 bp, Homo sapiens
gggtttggcccctg

SEQ ID NO: 2148193 - DNA, 15 bp, Homo sapiens
gggtttggcccctgg

SEQ ID NO: 2148194 - DNA, 16 bp, Homo sapiens
gggtttggcccctgga

SEQ ID NO: 2148195 - DNA, 16 bp, Homo sapiens
ggtactgcacattttg

SEQ ID NO: 2148196 - DNA, 19 bp, Homo sapiens
ggtaggaggtttggatggg

SEQ ID NO: 2148197 - DNA, 23 bp, Homo sapiens
ggtccatccccttcccccatccc

SEQ ID NO: 2148198 - DNA, 20 bp, Homo sapiens
ggtcctcggcccatctgtcc

SEQ ID NO: 2148199 - DNA, 14 bp, Homo sapiens
ggtcctggccctct

SEQ ID NO: 2148200 - DNA, 21 bp, Homo sapiens
ggtctcacactcctcctgcca

SEQ ID NO: 2148201 - DNA, 14 bp, Homo sapiens
ggtggattgggcag

SEQ ID NO: 2148202 - DNA, 19 bp, Homo sapiens
ggtgtctcccaacatggga

SEQ ID NO: 2148203 - DNA, 13 bp, Homo sapiens
ggttccatgcctg

SEQ ID NO: 2148204 - DNA, 15 bp, Homo sapiens
ggttccatgcctgag

SEQ ID NO: 2148205 - DNA, 23 bp, Homo sapiens
ggttctagtctcctttgcactga

SEQ ID NO: 2148206 - DNA, 20 bp, Homo sapiens
ggttgggggaatgcacctcc

SEQ ID NO: 2148207 - DNA, 12 bp, Homo sapiens
gtaaatacacca

SEQ ID NO: 2148208 - DNA, 14 bp, Homo sapiens
gtaacaagccagat

SEQ ID NO: 2148209 - DNA, 16 bp, Homo sapiens
gtaccaagccaccgca

SEQ ID NO: 2148210 - DNA, 22 bp, Homo sapiens
gtaccaagccaccgcagctgct

SEQ ID NO: 2148211 - DNA, 23 bp, Homo sapiens
gtaccaagccaccgcagctgctg

SEQ ID NO: 2148212 - DNA, 20 bp, Homo sapiens
gtaccacaccctgcctgctg

SEQ ID NO: 2148213 - DNA, 12 bp, Homo sapiens
gtactaccccag

SEQ ID NO: 2148214 - DNA, 16 bp, Homo sapiens
gtagccccagtgacag

SEQ ID NO: 2148215 - DNA, 14 bp, Homo sapiens
gtagtagtgtcttc

SEQ ID NO: 2148216 - DNA, 17 bp, Homo sapiens
gtagtcgtcaagttgca

SEQ ID NO: 2148217 - DNA, 11 bp, Homo sapiens
gtagtgtcttc

SEQ ID NO: 2148218 - DNA, 18 bp, Homo sapiens
gtatagatgcaagatatt

SEQ ID NO: 2148219 - DNA, 18 bp, Homo sapiens
gtatatctatatctctaa

SEQ ID NO: 2148220 - DNA, 17 bp, Homo sapiens
gtatatctggacaagcc

SEQ ID NO: 2148221 - DNA, 13 bp, Homo sapiens
gtcaaaacagatt

SEQ ID NO: 2148222 - DNA, 12 bp, Homo sapiens
gtcaaacaaata

SEQ ID NO: 2148223 - DNA, 15 bp, Homo sapiens
gtcaatattaaatac

SEQ ID NO: 2148224 - DNA, 22 bp, Homo sapiens
gtcaatattaaatacagacact

SEQ ID NO: 2148225 - DNA, 15 bp, Homo sapiens
gtcacaataaagttt

SEQ ID NO: 2148226 - DNA, 16 bp, Homo sapiens
gtcaccctggccacca

SEQ ID NO: 2148227 - DNA, 11 bp, Homo sapiens
gtcacttgcca

SEQ ID NO: 2148228 - DNA, 22 bp, Homo sapiens
ctgtgaatacaattaaaggtcc

SEQ ID NO: 2148229 - DNA, 16 bp, Homo sapiens
ctgtgacatcagaagt

SEQ ID NO: 2148230 - DNA, 19 bp, Homo sapiens
ctgtgcccacatcccaggc

SEQ ID NO: 2148231 - DNA, 14 bp, Homo sapiens
ctgtgcctgtctgt

SEQ ID NO: 2148232 - DNA, 12 bp, Homo sapiens
ctgtgctcccac

SEQ ID NO: 2148233 - DNA, 13 bp, Homo sapiens
ctgtgctcccacg

SEQ ID NO: 2148234 - DNA, 16 bp, Homo sapiens
ctgtggtcccacccag

SEQ ID NO: 2148235 - DNA, 21 bp, Homo sapiens
ctgttgctcaaatctattcag

SEQ ID NO: 2148236 - DNA, 21 bp, Homo sapiens
ctgtttgggcaggagtcacca

SEQ ID NO: 2148237 - DNA, 15 bp, Homo sapiens
ctgtttttcggacag

SEQ ID NO: 2148238 - DNA, 14 bp, Homo sapiens
cttaacggctccag

SEQ ID NO: 2148239 - DNA, 15 bp, Homo sapiens
cttaacggctccagg

SEQ ID NO: 2148240 - DNA, 15 bp, Homo sapiens
cttactcagagctgc

SEQ ID NO: 2148241 - DNA, 15 bp, Homo sapiens
cttacttcccccacc

SEQ ID NO: 2148242 - DNA, 14 bp, Homo sapiens
cttataggtttcca

SEQ ID NO: 2148243 - DNA, 18 bp, Homo sapiens
cttccaccagagcagggg

SEQ ID NO: 2148244 - DNA, 12 bp, Homo sapiens
cttccccttgtc

SEQ ID NO: 2148245 - DNA, 14 bp, Homo sapiens
cttccccttgtccc

SEQ ID NO: 2148246 - DNA, 18 bp, Homo sapiens
cttccccttgtccctggg

SEQ ID NO: 2148247 - DNA, 19 bp, Homo sapiens
cttccccttgtccctgggg

SEQ ID NO: 2148248 - DNA, 20 bp, Homo sapiens
cttccctccccacagtcctc

SEQ ID NO: 2148249 - DNA, 17 bp, Homo sapiens
cttccctgctttgagga

SEQ ID NO: 2148250 - DNA, 14 bp, Homo sapiens
cttcctcatctgtg

SEQ ID NO: 2148251 - DNA, 15 bp, Homo sapiens
cttcctcatctgtgc

SEQ ID NO: 2148252 - DNA, 16 bp, Homo sapiens
cttcctcatctgtgcc

SEQ ID NO: 2148253 - DNA, 20 bp, Homo sapiens
cttcctcatctgtgcctgtc

SEQ ID NO: 2148254 - DNA, 22 bp, Homo sapiens
cttcctgacccggattggccct

SEQ ID NO: 2148255 - DNA, 16 bp, Homo sapiens
cttcgactcaggatcc

SEQ ID NO: 2148256 - DNA, 20 bp, Homo sapiens
cttctcccggacctggacta

SEQ ID NO: 2148257 - DNA, 16 bp, Homo sapiens
cttcttcacccagcta

SEQ ID NO: 2148258 - DNA, 14 bp, Homo sapiens
cttgaactgattca

SEQ ID NO: 2148259 - DNA, 16 bp, Homo sapiens
cttgcccttcctgacc

SEQ ID NO: 2148260 - DNA, 15 bp, Homo sapiens
cttggcacctgccta

SEQ ID NO: 2148261 - DNA, 23 bp, Homo sapiens
cttgggcctgacctccagtcctg

SEQ ID NO: 2148262 - DNA, 15 bp, Homo sapiens
ctttaaaataaaata

SEQ ID NO: 2148263 - DNA, 13 bp, Homo sapiens
ctttacctgagac

SEQ ID NO: 2148264 - DNA, 15 bp, Homo sapiens
ctttaggagcagtgg

SEQ ID NO: 2148265 - DNA, 14 bp, Homo sapiens
ctttctagttgaaa

SEQ ID NO: 2148266 - DNA, 16 bp, Homo sapiens
ctttctagttgaaaat

SEQ ID NO: 2148267 - DNA, 18 bp, Homo sapiens
ctttctagttgaaaataa

SEQ ID NO: 2148268 - DNA, 16 bp, Homo sapiens
ctttctccagccagca

SEQ ID NO: 2148269 - DNA, 17 bp, Homo sapiens
ctttgaggacaaagaga

SEQ ID NO: 2148270 - DNA, 20 bp, Homo sapiens
ctttgcaggcccagcagact

SEQ ID NO: 2148271 - DNA, 20 bp, Homo sapiens
ctttgcccacacacactcct

SEQ ID NO: 2148272 - DNA, 12 bp, Homo sapiens
ctttgtcacttg

SEQ ID NO: 2148273 - DNA, 17 bp, Homo sapiens
ctttgtcacttgccaca

SEQ ID NO: 2148274 - DNA, 18 bp, Homo sapiens
ctttgtcacttgccacat

SEQ ID NO: 2148275 - DNA, 16 bp, Homo sapiens
cttttcgaactgtgct

SEQ ID NO: 2148276 - DNA, 16 bp, Homo sapiens
cttttgtcctgttatt

SEQ ID NO: 2148277 - DNA, 17 bp, Homo sapiens
cttttgtcctgttattt

SEQ ID NO: 2148278 - DNA, 22 bp, Homo sapiens
ctttttgtgaaattcaacctgt

SEQ ID NO: 2148279 - DNA, 15 bp, Homo sapiens
gaaaacccctggctg

SEQ ID NO: 2148280 - DNA, 21 bp, Homo sapiens
gaaattcaacctgtgtcttat

SEQ ID NO: 2148281 - DNA, 15 bp, Homo sapiens
gaacaaatggccttt

SEQ ID NO: 2148282 - DNA, 22 bp, Homo sapiens
gaaccgacttttctaaagctct

SEQ ID NO: 2148283 - DNA, 15 bp, Homo sapiens
gaacctttcccttgt

SEQ ID NO: 2148284 - DNA, 16 bp, Homo sapiens
gaacctttcccttgtg

SEQ ID NO: 2148285 - DNA, 16 bp, Homo sapiens
gaactgctggggctgg

SEQ ID NO: 2148286 - DNA, 15 bp, Homo sapiens
gaactgtgctcccac

SEQ ID NO: 2148287 - DNA, 19 bp, Homo sapiens
gaagaatattcaggactta

SEQ ID NO: 2148288 - DNA, 15 bp, Homo sapiens
gaagacatggagact

SEQ ID NO: 2148289 - DNA, 20 bp, Homo sapiens
gaagagggcctgtgggagcc

SEQ ID NO: 2148290 - DNA, 18 bp, Homo sapiens
gaagcatcctccccacca

SEQ ID NO: 2148291 - DNA, 19 bp, Homo sapiens
gaagcatttgtttctactt

SEQ ID NO: 2148292 - DNA, 20 bp, Homo sapiens
gaagggagggagctgaggcc

SEQ ID NO: 2148293 - DNA, 10 bp, Homo sapiens
gaagggccag

SEQ ID NO: 2148294 - DNA, 14 bp, Homo sapiens
gaagggccagtctg

SEQ ID NO: 2148295 - DNA, 20 bp, Homo sapiens
gaagggccagtctgggctgc

SEQ ID NO: 2148296 - DNA, 18 bp, Homo sapiens
gaagtaactcccactcct

SEQ ID NO: 2148297 - DNA, 13 bp, Homo sapiens
gaagtgtatatag

SEQ ID NO: 2148298 - DNA, 14 bp, Homo sapiens
gaatacaattaaag

SEQ ID NO: 2148299 - DNA, 16 bp, Homo sapiens
gaatacaattaaaggt

SEQ ID NO: 2148300 - DNA, 14 bp, Homo sapiens
gaatcctgggcccc

SEQ ID NO: 2148301 - DNA, 17 bp, Homo sapiens
gaatcctgggcccccag

SEQ ID NO: 2148302 - DNA, 14 bp, Homo sapiens
gaatgcacctcccc

SEQ ID NO: 2148303 - DNA, 16 bp, Homo sapiens
gaatgcacctccccaa

SEQ ID NO: 2148304 - DNA, 16 bp, Homo sapiens
gaatggttccatgcct

SEQ ID NO: 2148305 - DNA, 15 bp, Homo sapiens
gaatgtaaagcttgt

SEQ ID NO: 2148306 - DNA, 14 bp, Homo sapiens
gaattacccttcct

SEQ ID NO: 2148307 - DNA, 19 bp, Homo sapiens
gaattacccttcctcatct

SEQ ID NO: 2148308 - DNA, 20 bp, Homo sapiens
gaattacccttcctcatctg

SEQ ID NO: 2148309 - DNA, 20 bp, Homo sapiens
gaattgaaggagaaaatgca

SEQ ID NO: 2148310 - DNA, 22 bp, Homo sapiens
gacaaaccaggggtaccaggca

SEQ ID NO: 2148311 - DNA, 22 bp, Homo sapiens
gacaaagagaataaagacttca

SEQ ID NO: 2148312 - DNA, 14 bp, Homo sapiens
gacaacctgcccct

SEQ ID NO: 2148313 - DNA, 22 bp, Homo sapiens
gacaagccaacttgtaaataca

SEQ ID NO: 2148314 - DNA, 23 bp, Homo sapiens
gacaagccaacttgtaaatacac

SEQ ID NO: 2148315 - DNA, 17 bp, Homo sapiens
gacactaagttatagta

SEQ ID NO: 2148316 - DNA, 18 bp, Homo sapiens
gacactaagttatagtat

SEQ ID NO: 2148317 - DNA, 23 bp, Homo sapiens
gacacttgccttcttcacccagc

SEQ ID NO: 2148318 - DNA, 17 bp, Homo sapiens
gacagatgtcagccgag

SEQ ID NO: 2148319 - DNA, 21 bp, Homo sapiens
gacagtgacgtgactcagagc

SEQ ID NO: 2148320 - DNA, 21 bp, Homo sapiens
gacatcagaagtaactcccac

SEQ ID NO: 2148321 - DNA, 19 bp, Homo sapiens
gacatggagactcctgccc

SEQ ID NO: 2148322 - DNA, 19 bp, Homo sapiens
ttctgctggcctggatctc

SEQ ID NO: 2148323 - DNA, 18 bp, Homo sapiens
ttctgtccagtttccaaa

SEQ ID NO: 2148324 - DNA, 15 bp, Homo sapiens
ttgaggacaaagaga

SEQ ID NO: 2148325 - DNA, 15 bp, Homo sapiens
ttgatatgactgttt

SEQ ID NO: 2148326 - DNA, 15 bp, Homo sapiens
ttgatttgagaaatt

SEQ ID NO: 2148327 - DNA, 12 bp, Homo sapiens
ttgcaaccactg

SEQ ID NO: 2148328 - DNA, 20 bp, Homo sapiens
ttgcacagagggcgctcctg

SEQ ID NO: 2148329 - DNA, 13 bp, Homo sapiens
ttgcactgagggc

SEQ ID NO: 2148330 - DNA, 16 bp, Homo sapiens
ttgcaggggactgggc

SEQ ID NO: 2148331 - DNA, 17 bp, Homo sapiens
ttgcccacacacactcc

SEQ ID NO: 2148332 - DNA, 18 bp, Homo sapiens
ttgcccacacacactcct

SEQ ID NO: 2148333 - DNA, 19 bp, Homo sapiens
ttgccttcttcacccagct

SEQ ID NO: 2148334 - DNA, 19 bp, Homo sapiens
ttgctcaaatctattcaga

SEQ ID NO: 2148335 - DNA, 15 bp, Homo sapiens
ttgctcgaagactgt

SEQ ID NO: 2148336 - DNA, 16 bp, Homo sapiens
ttggcagaactgctgg

SEQ ID NO: 2148337 - DNA, 17 bp, Homo sapiens
ttggcagaactgctggg

SEQ ID NO: 2148338 - DNA, 19 bp, Homo sapiens
ttggcagaactgctggggc

SEQ ID NO: 2148339 - DNA, 13 bp, Homo sapiens
ttggccctgcccc

SEQ ID NO: 2148340 - DNA, 14 bp, Homo sapiens
ttggccctgcccct

SEQ ID NO: 2148341 - DNA, 16 bp, Homo sapiens
ttgggagcactggagt

SEQ ID NO: 2148342 - DNA, 21 bp, Homo sapiens
ttgggcctgacctccagtcct

SEQ ID NO: 2148343 - DNA, 21 bp, Homo sapiens
ttgggggaatgcacctcccca

SEQ ID NO: 2148344 - DNA, 14 bp, Homo sapiens
ttgtcaatattaaa

SEQ ID NO: 2148345 - DNA, 18 bp, Homo sapiens
ttgtcaatattaaataca

SEQ ID NO: 2148346 - DNA, 13 bp, Homo sapiens
ttgtcacttgcca

SEQ ID NO: 2148347 - DNA, 16 bp, Homo sapiens
ttgtcacttgccacat

SEQ ID NO: 2148348 - DNA, 12 bp, Homo sapiens
ttgtccctgggg

SEQ ID NO: 2148349 - DNA, 14 bp, Homo sapiens
ttgtccctggggca

SEQ ID NO: 2148350 - DNA, 19 bp, Homo sapiens
ttgtgcaatagtcagagtg

SEQ ID NO: 2148351 - DNA, 22 bp, Homo sapiens
ttgtggcaagtgaatttgcctg

SEQ ID NO: 2148352 - DNA, 13 bp, Homo sapiens
ttgttcacactcc

SEQ ID NO: 2148353 - DNA, 14 bp, Homo sapiens
ttgtttctactttg

SEQ ID NO: 2148354 - DNA, 23 bp, Homo sapiens
ttgtttctactttgatatgactg

SEQ ID NO: 2148355 - DNA, 15 bp, Homo sapiens
ttgtttgcacagagg

SEQ ID NO: 2148356 - DNA, 17 bp, Homo sapiens
tttatatcagcctgagt

SEQ ID NO: 2148357 - DNA, 14 bp, Homo sapiens
tttatattgtaaat

SEQ ID NO: 2148358 - DNA, 13 bp, Homo sapiens
tttatttgttgag

SEQ ID NO: 2148359 - DNA, 22 bp, Homo sapiens
tttcacctggaagcatttgttt

SEQ ID NO: 2148360 - DNA, 21 bp, Homo sapiens
tttccttttgcaacaagacaa

SEQ ID NO: 2148361 - DNA, 14 bp, Homo sapiens
tttcgaactgtgct

SEQ ID NO: 2148362 - DNA, 14 bp, Homo sapiens
tttgcactgagggc

SEQ ID NO: 2148363 - DNA, 16 bp, Homo sapiens
tttgcactgagggcca

SEQ ID NO: 2148364 - DNA, 18 bp, Homo sapiens
tttgcaggcccagcagac

SEQ ID NO: 2148365 - DNA, 19 bp, Homo sapiens
tttgcaggggactgggcca

SEQ ID NO: 2148366 - DNA, 18 bp, Homo sapiens
tttgcccacacacactcc

SEQ ID NO: 2148367 - DNA, 13 bp, Homo sapiens
tttgcctgtaaca

SEQ ID NO: 2148368 - DNA, 21 bp, Homo sapiens
tttgcctgtaacaagccagat

SEQ ID NO: 2148369 - DNA, 20 bp, Homo sapiens
ttttatttccacataaaggt

SEQ ID NO: 2148370 - DNA, 12 bp, Homo sapiens
ttttctaactgg

SEQ ID NO: 2148371 - DNA, 20 bp, Homo sapiens
ttttgcaggggactgggcca

SEQ ID NO: 2148372 - DNA, 15 bp, Homo sapiens
ttttgtcctgttatt

SEQ ID NO: 2148373 - DNA, 15 bp, Homo sapiens
tttttatttccacat

SEQ ID NO: 2148374 - DNA, 16 bp, Homo sapiens
tttttgcaggggactg

SEQ ID NO: 2148375 - DNA, 15 bp, Homo sapiens
tgatgctcaggcttg

SEQ ID NO: 2148376 - DNA, 12 bp, Homo sapiens
tgatgtccagaa

SEQ ID NO: 2148377 - DNA, 15 bp, Homo sapiens
tgatgtccagaagaa

SEQ ID NO: 2148378 - DNA, 16 bp, Homo sapiens
tgattcacatctcatt

SEQ ID NO: 2148379 - DNA, 22 bp, Homo sapiens
tgatttcagtagcacaagttat

SEQ ID NO: 2148380 - DNA, 17 bp, Homo sapiens
tgcaatagtcagagtgt

SEQ ID NO: 2148381 - DNA, 22 bp, Homo sapiens
tgcaatagtcagagtgtccctt

SEQ ID NO: 2148382 - DNA, 19 bp, Homo sapiens
tgcacagagggcgctcctg

SEQ ID NO: 2148383 - DNA, 20 bp, Homo sapiens
tgcacagagggcgctcctgt

SEQ ID NO: 2148384 - DNA, 19 bp, Homo sapiens
tgcaccagcccttccctgc

SEQ ID NO: 2148385 - DNA, 15 bp, Homo sapiens
tgcacctccccaaag

SEQ ID NO: 2148386 - DNA, 14 bp, Homo sapiens
tgcacctttctagt

SEQ ID NO: 2148387 - DNA, 14 bp, Homo sapiens
tgcactgagggcca

SEQ ID NO: 2148388 - DNA, 21 bp, Homo sapiens
tgcagatctttttgtgaaatt

SEQ ID NO: 2148389 - DNA, 16 bp, Homo sapiens
tgcaggcccagcagac

SEQ ID NO: 2148390 - DNA, 16 bp, Homo sapiens
tgcaggggactgggcc

SEQ ID NO: 2148391 - DNA, 18 bp, Homo sapiens
tgcaggggactgggccat

SEQ ID NO: 2148392 - DNA, 20 bp, Homo sapiens
tgcaggggactgggccatgg

SEQ ID NO: 2148393 - DNA, 20 bp, Homo sapiens
tgccacatggtgtctcccaa

SEQ ID NO: 2148394 - DNA, 12 bp, Homo sapiens
tgccactctgct

SEQ ID NO: 2148395 - DNA, 17 bp, Homo sapiens
tgccactctgctgcctg

SEQ ID NO: 2148396 - DNA, 19 bp, Homo sapiens
tgccactctgctgcctgta

SEQ ID NO: 2148397 - DNA, 21 bp, Homo sapiens
tgccagctctgtcaccctggc

SEQ ID NO: 2148398 - DNA, 21 bp, Homo sapiens
tctctgagtgtctctgcctgg

SEQ ID NO: 2148399 - DNA, 17 bp, Homo sapiens
tctctgcctggagcagg

SEQ ID NO: 2148400 - DNA, 19 bp, Homo sapiens
tctctgcctggagcagggg

SEQ ID NO: 2148401 - DNA, 19 bp, Homo sapiens
tctctggctcagctgtggt

SEQ ID NO: 2148402 - DNA, 15 bp, Homo sapiens
tctgaacaaaagctt

SEQ ID NO: 2148403 - DNA, 19 bp, Homo sapiens
tctgagtgtctctgcctgg

SEQ ID NO: 2148404 - DNA, 22 bp, Homo sapiens
tctgattcgaatgacactgttc

SEQ ID NO: 2148405 - DNA, 12 bp, Homo sapiens
tctgcctcatcc

SEQ ID NO: 2148406 - DNA, 19 bp, Homo sapiens
tctgcctcatcctcctcct

SEQ ID NO: 2148407 - DNA, 22 bp, Homo sapiens
tctgcctcatcctcctcctcat

SEQ ID NO: 2148408 - DNA, 19 bp, Homo sapiens
tctgcctctaactccctcc

SEQ ID NO: 2148409 - DNA, 20 bp, Homo sapiens
tctgcctctaactccctcct

SEQ ID NO: 2148410 - DNA, 23 bp, Homo sapiens
tctgcctctaactccctcctcac

SEQ ID NO: 2148411 - DNA, 11 bp, Homo sapiens
tctgcctgctg

SEQ ID NO: 2148412 - DNA, 18 bp, Homo sapiens
tctgcctgctgggctctt

SEQ ID NO: 2148413 - DNA, 13 bp, Homo sapiens
tctgcctggagca

SEQ ID NO: 2148414 - DNA, 15 bp, Homo sapiens
tctgcctggagcagg

SEQ ID NO: 2148415 - DNA, 15 bp, Homo sapiens
tctgctgcctgtaca

SEQ ID NO: 2148416 - DNA, 16 bp, Homo sapiens
tctgctggcctggatc

SEQ ID NO: 2148417 - DNA, 16 bp, Homo sapiens
tctggctcagctgtgg

SEQ ID NO: 2148418 - DNA, 17 bp, Homo sapiens
tctggctcagctgtggt

SEQ ID NO: 2148419 - DNA, 14 bp, Homo sapiens
tctgtagggctgga

SEQ ID NO: 2148420 - DNA, 16 bp, Homo sapiens
tctgtagggctggacc

SEQ ID NO: 2148421 - DNA, 13 bp, Homo sapiens
tctgtccaacccc

SEQ ID NO: 2148422 - DNA, 16 bp, Homo sapiens
tctgtccaacccctcc

SEQ ID NO: 2148423 - DNA, 15 bp, Homo sapiens
tctgtccatcctcct

SEQ ID NO: 2148424 - DNA, 20 bp, Homo sapiens
tctgtccatcctcctctcca

SEQ ID NO: 2148425 - DNA, 21 bp, Homo sapiens
tctgtccatcctcctctccat

SEQ ID NO: 2148426 - DNA, 12 bp, Homo sapiens
tctgtgaataca

SEQ ID NO: 2148427 - DNA, 16 bp, Homo sapiens
tctgtgaatacaatta

SEQ ID NO: 2148428 - DNA, 19 bp, Homo sapiens
tctgtgaatacaattaaag

SEQ ID NO: 2148429 - DNA, 22 bp, Homo sapiens
tctgtgatcaccctctcggcct

SEQ ID NO: 2148430 - DNA, 22 bp, Homo sapiens
tcttattcatgctttctccttt

SEQ ID NO: 2148431 - DNA, 23 bp, Homo sapiens
tcttattcatgctttctcctttt

SEQ ID NO: 2148432 - DNA, 14 bp, Homo sapiens
tcttccaccagagc

SEQ ID NO: 2148433 - DNA, 19 bp, Homo sapiens
tcttcctagtatattagtt

SEQ ID NO: 2148434 - DNA, 18 bp, Homo sapiens
tcttgctcaaaaatctgt

SEQ ID NO: 2148435 - DNA, 13 bp, Homo sapiens
tcttggcacctgc

SEQ ID NO: 2148436 - DNA, 14 bp, Homo sapiens
tcttggcacctgcc

SEQ ID NO: 2148437 - DNA, 15 bp, Homo sapiens
tcttggcacctgcct

SEQ ID NO: 2148438 - DNA, 17 bp, Homo sapiens
tcttggcacctgcctag

SEQ ID NO: 2148439 - DNA, 19 bp, Homo sapiens
tcttgggcctgacctccag

SEQ ID NO: 2148440 - DNA, 20 bp, Homo sapiens
tcttgggcctgacctccagt

SEQ ID NO: 2148441 - DNA, 21 bp, Homo sapiens
tcttgggcctgacctccagtc

SEQ ID NO: 2148442 - DNA, 18 bp, Homo sapiens
tctttacctgagaccagt

SEQ ID NO: 2148443 - DNA, 17 bp, Homo sapiens
tctttctttacctgaga

SEQ ID NO: 2148444 - DNA, 17 bp, Homo sapiens
tgaaaataaagtgtata

SEQ ID NO: 2148445 - DNA, 22 bp, Homo sapiens
tgaacaatacgtgaaagatgca

SEQ ID NO: 2148446 - DNA, 15 bp, Homo sapiens
tgaacagtgctctgc

SEQ ID NO: 2148447 - DNA, 15 bp, Homo sapiens
tgaaccgacttttct

SEQ ID NO: 2148448 - DNA, 22 bp, Homo sapiens
tgaaccgacttttctaaagctc

SEQ ID NO: 2148449 - DNA, 12 bp, Homo sapiens
tgaactgattca

SEQ ID NO: 2148450 - DNA, 21 bp, Homo sapiens
tgaactgattcacatctcatt

SEQ ID NO: 2148451 - DNA, 23 bp, Homo sapiens
tgaaggagaaaatgcattatgtg

SEQ ID NO: 2148452 - DNA, 12 bp, Homo sapiens
tgaatacaatta

SEQ ID NO: 2148453 - DNA, 17 bp, Homo sapiens
tgaatacaattaaaggt

SEQ ID NO: 2148454 - DNA, 19 bp, Homo sapiens
tgaatggttccatgcctga

SEQ ID NO: 2148455 - DNA, 22 bp, Homo sapiens
tgaatggttccatgcctgaggg

SEQ ID NO: 2148456 - DNA, 23 bp, Homo sapiens
tgaatggttccatgcctgagggt

SEQ ID NO: 2148457 - DNA, 13 bp, Homo sapiens
tgacactgagccc

SEQ ID NO: 2148458 - DNA, 15 bp, Homo sapiens
tgacactgagcccca

SEQ ID NO: 2148459 - DNA, 22 bp, Homo sapiens
tgacagtccgtcaaaacagatt

SEQ ID NO: 2148460 - DNA, 20 bp, Homo sapiens
tgacatcagaagtaactccc

SEQ ID NO: 2148461 - DNA, 21 bp, Homo sapiens
tgacccggattggccctgccc

SEQ ID NO: 2148462 - DNA, 23 bp, Homo sapiens
tgacccggattggccctgcccct

SEQ ID NO: 2148463 - DNA, 22 bp, Homo sapiens
tgacctccagtcctgctggcct

SEQ ID NO: 2148464 - DNA, 15 bp, Homo sapiens
tgacgtgactcagag

SEQ ID NO: 2148465 - DNA, 20 bp, Homo sapiens
tgactatggctctggcacca

SEQ ID NO: 2148466 - DNA, 23 bp, Homo sapiens
tgagaccagttgggagcactgga

SEQ ID NO: 2148467 - DNA, 19 bp, Homo sapiens
tgagagacattaactcatt

SEQ ID NO: 2148468 - DNA, 13 bp, Homo sapiens
tgagagtgtgacc

SEQ ID NO: 2148469 - DNA, 21 bp, Homo sapiens
tgaggatcccctgtcccctgg

SEQ ID NO: 2148470 - DNA, 21 bp, Homo sapiens
tgaggcaaaggccagcagcag

SEQ ID NO: 2148471 - DNA, 15 bp, Homo sapiens
tgaggccccaggccc

SEQ ID NO: 2148472 - DNA, 14 bp, Homo sapiens
tgaggccggccctg

SEQ ID NO: 2148473 - DNA, 18 bp, Homo sapiens
tgaggccggccctgcccc

SEQ ID NO: 2148474 - DNA, 19 bp, Homo sapiens
tgaggccggccctgcccct

SEQ ID NO: 2148475 - DNA, 20 bp, Homo sapiens
tgaggccggccctgcccctc

SEQ ID NO: 2148476 - DNA, 21 bp, Homo sapiens
tgaggccggccctgcccctcc

SEQ ID NO: 2148477 - DNA, 23 bp, Homo sapiens
tgaggccggccctgcccctccct

SEQ ID NO: 2148478 - DNA, 17 bp, Homo sapiens
tgagtaggccctgcttt

SEQ ID NO: 2148479 - DNA, 22 bp, Homo sapiens
gactaagccctgtcgagacact

SEQ ID NO: 2148480 - DNA, 23 bp, Homo sapiens
gactagggcctcggaggctcctc

SEQ ID NO: 2148481 - DNA, 19 bp, Homo sapiens
gactcttccaccagagcag

SEQ ID NO: 2148482 - DNA, 18 bp, Homo sapiens
gactggccgtggctccag

SEQ ID NO: 2148483 - DNA, 16 bp, Homo sapiens
gacttaacggctccag

SEQ ID NO: 2148484 - DNA, 14 bp, Homo sapiens
gagaagagggcctg

SEQ ID NO: 2148485 - DNA, 15 bp, Homo sapiens
gagaagagggcctgt

SEQ ID NO: 2148486 - DNA, 19 bp, Homo sapiens
gagaagagggcctgtggga

SEQ ID NO: 2148487 - DNA, 16 bp, Homo sapiens
gagaaggcctcccctg

SEQ ID NO: 2148488 - DNA, 20 bp, Homo sapiens
gagaaggcctcccctgagga

SEQ ID NO: 2148489 - DNA, 16 bp, Homo sapiens
gagaataaagacttca

SEQ ID NO: 2148490 - DNA, 14 bp, Homo sapiens
gagactaagccctg

SEQ ID NO: 2148491 - DNA, 15 bp, Homo sapiens
gagactgggatggga

SEQ ID NO: 2148492 - DNA, 16 bp, Homo sapiens
gagaggggaagggcca

SEQ ID NO: 2148493 - DNA, 17 bp, Homo sapiens
gagaggggaagggccag

SEQ ID NO: 2148494 - DNA, 15 bp, Homo sapiens
gagcaagagaacatt

SEQ ID NO: 2148495 - DNA, 20 bp, Homo sapiens
gagcactggagtgcagggag

SEQ ID NO: 2148496 - DNA, 13 bp, Homo sapiens
gagcaggggctgc

SEQ ID NO: 2148497 - DNA, 14 bp, Homo sapiens
gagcaggggctgct

SEQ ID NO: 2148498 - DNA, 17 bp, Homo sapiens
gagcaggggctgctggg

SEQ ID NO: 2148499 - DNA, 21 bp, Homo sapiens
gagcagtgggagggtaccagc

SEQ ID NO: 2148500 - DNA, 23 bp, Homo sapiens
gagccactacctttgtccaggcc

SEQ ID NO: 2148501 - DNA, 14 bp, Homo sapiens
gagcccattgtgga

SEQ ID NO: 2148502 - DNA, 13 bp, Homo sapiens
gagccgggcctgg

SEQ ID NO: 2148503 - DNA, 21 bp, Homo sapiens
gagcctgcaaactcactgctc

SEQ ID NO: 2148504 - DNA, 16 bp, Homo sapiens
gagctgaggcctccct

SEQ ID NO: 2148505 - DNA, 15 bp, Homo sapiens
gagctgcctccccaa

SEQ ID NO: 2148506 - DNA, 20 bp, Homo sapiens
gagctgcctccccaatccat

SEQ ID NO: 2148507 - DNA, 16 bp, Homo sapiens
gagctgcgggctgagg

SEQ ID NO: 2148508 - DNA, 17 bp, Homo sapiens
gagctgcgggctgaggg

SEQ ID NO: 2148509 - DNA, 17 bp, Homo sapiens
gagctttgtcacttgcc

SEQ ID NO: 2148510 - DNA, 15 bp, Homo sapiens
gaggatcccctgtcc

SEQ ID NO: 2148511 - DNA, 17 bp, Homo sapiens
gaggcaaaggccagcag

SEQ ID NO: 2148512 - DNA, 14 bp, Homo sapiens
gaggccccaggccc

SEQ ID NO: 2148513 - DNA, 16 bp, Homo sapiens
gaggccccaggcccta

SEQ ID NO: 2148514 - DNA, 17 bp, Homo sapiens
gaggccggccctgcccc

SEQ ID NO: 2148515 - DNA, 23 bp, Homo sapiens
gaggcctcccttgagtaggccct

SEQ ID NO: 2148516 - DNA, 14 bp, Homo sapiens
gaggctcctccctc

SEQ ID NO: 2148517 - DNA, 17 bp, Homo sapiens
gaggctcctccctctgc

SEQ ID NO: 2148518 - DNA, 19 bp, Homo sapiens
gaggctcctccctctgcct

SEQ ID NO: 2148519 - DNA, 14 bp, Homo sapiens
gagggagctgaggc

SEQ ID NO: 2148520 - DNA, 20 bp, Homo sapiens
gagggagctgaggcctccct

SEQ ID NO: 2148521 - DNA, 17 bp, Homo sapiens
gagggcagtggggagca

SEQ ID NO: 2148522 - DNA, 14 bp, Homo sapiens
gagggcgctcctgt

SEQ ID NO: 2148523 - DNA, 14 bp, Homo sapiens
gaggggaagggcca

SEQ ID NO: 2148524 - DNA, 15 bp, Homo sapiens
gaggggaagggccag

SEQ ID NO: 2148525 - DNA, 13 bp, Homo sapiens
gagggtggagact

SEQ ID NO: 2148526 - DNA, 20 bp, Homo sapiens
gagggtggagactaagccct

SEQ ID NO: 2148527 - DNA, 14 bp, Homo sapiens
gagtcaagttgttc

SEQ ID NO: 2148528 - DNA, 14 bp, Homo sapiens
gagtcaccatgcaa

SEQ ID NO: 2148529 - DNA, 16 bp, Homo sapiens
gagtcaccatgcaagg

SEQ ID NO: 2148530 - DNA, 12 bp, Homo sapiens
gagtctctccag

SEQ ID NO: 2148531 - DNA, 14 bp, Homo sapiens
gagtctctccagcc

SEQ ID NO: 2148532 - DNA, 14 bp, Homo sapiens
gagtctctggctca

SEQ ID NO: 2148533 - DNA, 20 bp, Homo sapiens
gagtgtctctgcctggagca

SEQ ID NO: 2148534 - DNA, 14 bp, Homo sapiens
gatagaatgacagt

SEQ ID NO: 2148535 - DNA, 22 bp, Homo sapiens
gatcaccagcccggcctgctcc

SEQ ID NO: 2148536 - DNA, 20 bp, Homo sapiens
gatcccctgtcccctggggc

SEQ ID NO: 2148537 - DNA, 18 bp, Homo sapiens
gatctctcaggagcacag

SEQ ID NO: 2148538 - DNA, 20 bp, Homo sapiens
gatctctcaggagcacaggc

SEQ ID NO: 2148539 - DNA, 22 bp, Homo sapiens
gatctctcaggagcacaggcag

SEQ ID NO: 2148540 - DNA, 23 bp, Homo sapiens
gatctctcaggagcacaggcagc

SEQ ID NO: 2148541 - DNA, 19 bp, Homo sapiens
gatctttttgtgaaattca

SEQ ID NO: 2148542 - DNA, 23 bp, Homo sapiens
gatgagacttccaaacctgacag

SEQ ID NO: 2148543 - DNA, 17 bp, Homo sapiens
gatgcaagatatttata

SEQ ID NO: 2148544 - DNA, 13 bp, Homo sapiens
gatgctggcctct

SEQ ID NO: 2148545 - DNA, 17 bp, Homo sapiens
gatgtggagctcctgct

SEQ ID NO: 2148546 - DNA, 20 bp, Homo sapiens
gattagactggacagcttgt

SEQ ID NO: 2148547 - DNA, 13 bp, Homo sapiens
gattatatatcat

SEQ ID NO: 2148548 - DNA, 21 bp, Homo sapiens
gattatatatcataaagtatg

SEQ ID NO: 2148549 - DNA, 13 bp, Homo sapiens
gattggccctgcc

SEQ ID NO: 2148550 - DNA, 18 bp, Homo sapiens
gattggccctgcccctcc

SEQ ID NO: 2148551 - DNA, 22 bp, Homo sapiens
gattggccctgcccctccccct

SEQ ID NO: 2148552 - DNA, 15 bp, Homo sapiens
gattgtttgcacaga

SEQ ID NO: 2148553 - DNA, 19 bp, Homo sapiens
gcaaactcactgctcaaga

SEQ ID NO: 2148554 - DNA, 16 bp, Homo sapiens
gcaaagaactgcccca

SEQ ID NO: 2148555 - DNA, 13 bp, Homo sapiens
gcaacaggtttta

SEQ ID NO: 2148556 - DNA, 20 bp, Homo sapiens
gcaacaggttttataatttt

SEQ ID NO: 2148557 - DNA, 13 bp, Homo sapiens
gcaagagaacatt

SEQ ID NO: 2148558 - DNA, 13 bp, Homo sapiens
gcaagatatttat

SEQ ID NO: 2148559 - DNA, 21 bp, Homo sapiens
gcaaggacaacctgcccctcc

SEQ ID NO: 2148560 - DNA, 13 bp, Homo sapiens
gcaagtgaatttg

SEQ ID NO: 2148561 - DNA, 20 bp, Homo sapiens
gcaagtgctgtttgggcagg

SEQ ID NO: 2148562 - DNA, 17 bp, Homo sapiens
gcacaagttatttaaat

SEQ ID NO: 2148563 - DNA, 13 bp, Homo sapiens
gcacagagggcgc

SEQ ID NO: 2148564 - DNA, 19 bp, Homo sapiens
gcacagagggcgctcctgt

SEQ ID NO: 2148565 - DNA, 16 bp, Homo sapiens
gcacagctcctcccct

SEQ ID NO: 2148566 - DNA, 21 bp, Homo sapiens
gcacagctcctcccctgccgc

SEQ ID NO: 2148567 - DNA, 21 bp, Homo sapiens
gtcacttgccacatggtgtct

SEQ ID NO: 2148568 - DNA, 16 bp, Homo sapiens
gtcagaacagcagact

SEQ ID NO: 2148569 - DNA, 21 bp, Homo sapiens
gtcagccgagccgggcctggg

SEQ ID NO: 2148570 - DNA, 14 bp, Homo sapiens
gtccaacccctccc

SEQ ID NO: 2148571 - DNA, 17 bp, Homo sapiens
gtccagaagaatattca

SEQ ID NO: 2148572 - DNA, 21 bp, Homo sapiens
gtccagaagaatattcaggac

SEQ ID NO: 2148573 - DNA, 22 bp, Homo sapiens
gtccagaagaatattcaggact

SEQ ID NO: 2148574 - DNA, 22 bp, Homo sapiens
gtccatccccttcccccatccc

SEQ ID NO: 2148575 - DNA, 18 bp, Homo sapiens
gtccatcctcctctccat

SEQ ID NO: 2148576 - DNA, 21 bp, Homo sapiens
gtccatcctcctctccatgca

SEQ ID NO: 2148577 - DNA, 19 bp, Homo sapiens
gtccccctcccctcccagt

SEQ ID NO: 2148578 - DNA, 23 bp, Homo sapiens
gtccccctcccctcccagtcctc

SEQ ID NO: 2148579 - DNA, 13 bp, Homo sapiens
gtcccctcacaga

SEQ ID NO: 2148580 - DNA, 12 bp, Homo sapiens
gtccctggggca

SEQ ID NO: 2148581 - DNA, 20 bp, Homo sapiens
gtccctggggcactccccca

SEQ ID NO: 2148582 - DNA, 21 bp, Homo sapiens
gtccctggggcactcccccag

SEQ ID NO: 2148583 - DNA, 22 bp, Homo sapiens
gtccctggggcactcccccagg

SEQ ID NO: 2148584 - DNA, 22 bp, Homo sapiens
gtccctttttgcaggggactgg

SEQ ID NO: 2148585 - DNA, 16 bp, Homo sapiens
gtcctcacagcctctc

SEQ ID NO: 2148586 - DNA, 20 bp, Homo sapiens
gtcctcacagcctctccctt

SEQ ID NO: 2148587 - DNA, 17 bp, Homo sapiens
gtcctcggcccatctgt

SEQ ID NO: 2148588 - DNA, 20 bp, Homo sapiens
gtcctcggcccatctgtcca

SEQ ID NO: 2148589 - DNA, 11 bp, Homo sapiens
gtcctgctggc

SEQ ID NO: 2148590 - DNA, 14 bp, Homo sapiens
gtcctgctggcctg

SEQ ID NO: 2148591 - DNA, 12 bp, Homo sapiens
gtccttgcctga

SEQ ID NO: 2148592 - DNA, 14 bp, Homo sapiens
gtcgattagactgg

SEQ ID NO: 2148593 - DNA, 14 bp, Homo sapiens
gtcggccctgccca

SEQ ID NO: 2148594 - DNA, 19 bp, Homo sapiens
gtctcacactcctcctgcc

SEQ ID NO: 2148595 - DNA, 16 bp, Homo sapiens
gtctcccaacatggga

SEQ ID NO: 2148596 - DNA, 15 bp, Homo sapiens
gtctcctttgcactg

SEQ ID NO: 2148597 - DNA, 16 bp, Homo sapiens
gtctcctttgcactga

SEQ ID NO: 2148598 - DNA, 12 bp, Homo sapiens
gtctctccagcc

SEQ ID NO: 2148599 - DNA, 18 bp, Homo sapiens
gtctctccagcctcacag

SEQ ID NO: 2148600 - DNA, 12 bp, Homo sapiens
gtctctctgcct

SEQ ID NO: 2148601 - DNA, 18 bp, Homo sapiens
gtctctctgcctgctggg

SEQ ID NO: 2148602 - DNA, 19 bp, Homo sapiens
gtctctctgcctgctgggc

SEQ ID NO: 2148603 - DNA, 22 bp, Homo sapiens
gtctctctgcctgctgggctct

SEQ ID NO: 2148604 - DNA, 18 bp, Homo sapiens
gtctctctgtgaatacaa

SEQ ID NO: 2148605 - DNA, 22 bp, Homo sapiens
gtctctctgtgaatacaattaa

SEQ ID NO: 2148606 - DNA, 16 bp, Homo sapiens
gtctctgcctggagca

SEQ ID NO: 2148607 - DNA, 18 bp, Homo sapiens
gtctctgcctggagcagg

SEQ ID NO: 2148608 - DNA, 17 bp, Homo sapiens
gtctctggctcagctgt

SEQ ID NO: 2148609 - DNA, 19 bp, Homo sapiens
gtctctggctcagctgtgg

SEQ ID NO: 2148610 - DNA, 23 bp, Homo sapiens
tccccctaccgcatggcagctgg

SEQ ID NO: 2148611 - DNA, 17 bp, Homo sapiens
tccccctcccctcccag

SEQ ID NO: 2148612 - DNA, 15 bp, Homo sapiens
tcccctcacagactc

SEQ ID NO: 2148613 - DNA, 17 bp, Homo sapiens
tcccctcacagactctt

SEQ ID NO: 2148614 - DNA, 14 bp, Homo sapiens
tcccctcccagtcc

SEQ ID NO: 2148615 - DNA, 15 bp, Homo sapiens
tcccctcccagtcct

SEQ ID NO: 2148616 - DNA, 13 bp, Homo sapiens
tcccctgccgcct

SEQ ID NO: 2148617 - DNA, 18 bp, Homo sapiens
tcccctgccgcctcccgg

SEQ ID NO: 2148618 - DNA, 20 bp, Homo sapiens
tcccctgccgcctcccggga

SEQ ID NO: 2148619 - DNA, 14 bp, Homo sapiens
tcccctggggctgg

SEQ ID NO: 2148620 - DNA, 15 bp, Homo sapiens
tcccctgtcccctgg

SEQ ID NO: 2148621 - DNA, 18 bp, Homo sapiens
tcccctgtcccctggggc

SEQ ID NO: 2148622 - DNA, 19 bp, Homo sapiens
tcccctgtcccctggggct

SEQ ID NO: 2148623 - DNA, 20 bp, Homo sapiens
tcccctgtcccctggggctg

SEQ ID NO: 2148624 - DNA, 21 bp, Homo sapiens
tccccttcccccatccctacc

SEQ ID NO: 2148625 - DNA, 18 bp, Homo sapiens
tccccttgtccctggggc

SEQ ID NO: 2148626 - DNA, 19 bp, Homo sapiens
tccccttgtccctggggca

SEQ ID NO: 2148627 - DNA, 20 bp, Homo sapiens
tcccgggaagcatcctcccc

SEQ ID NO: 2148628 - DNA, 23 bp, Homo sapiens
tcccgggaagcatcctccccacc

SEQ ID NO: 2148629 - DNA, 21 bp, Homo sapiens
tccctagatccaggcttctcc

SEQ ID NO: 2148630 - DNA, 22 bp, Homo sapiens
tcccttgtgtgtaccacaccct

SEQ ID NO: 2148631 - DNA, 16 bp, Homo sapiens
tccctttttgcagggg

SEQ ID NO: 2148632 - DNA, 23 bp, Homo sapiens
tccctttttgcaggggactgggc

SEQ ID NO: 2148633 - DNA, 14 bp, Homo sapiens
tccgggtgccattc

SEQ ID NO: 2148634 - DNA, 16 bp, Homo sapiens
tccgggtgccattccc

SEQ ID NO: 2148635 - DNA, 23 bp, Homo sapiens
tccgtcaaaacagattgtttgca

SEQ ID NO: 2148636 - DNA, 15 bp, Homo sapiens
tcctcacactccaga

SEQ ID NO: 2148637 - DNA, 12 bp, Homo sapiens
tcctcacagcct

SEQ ID NO: 2148638 - DNA, 13 bp, Homo sapiens
tcctcatctgtgc

SEQ ID NO: 2148639 - DNA, 15 bp, Homo sapiens
tcctcatctgtgcct

SEQ ID NO: 2148640 - DNA, 21 bp, Homo sapiens
tcctcatctgtgcctgtctgt

SEQ ID NO: 2148641 - DNA, 15 bp, Homo sapiens
tcctcattcagacca

SEQ ID NO: 2148642 - DNA, 14 bp, Homo sapiens
tcctccctctgcct

SEQ ID NO: 2148643 - DNA, 19 bp, Homo sapiens
tcctccctctgcctcatcc

SEQ ID NO: 2148644 - DNA, 13 bp, Homo sapiens
tcctcctcctcat

SEQ ID NO: 2148645 - DNA, 14 bp, Homo sapiens
tcctcctctccatg

SEQ ID NO: 2148646 - DNA, 16 bp, Homo sapiens
tcctcctctccatgca

SEQ ID NO: 2148647 - DNA, 12 bp, Homo sapiens
tcctcctgccag

SEQ ID NO: 2148648 - DNA, 12 bp, Homo sapiens
tcctcctgccct

SEQ ID NO: 2148649 - DNA, 13 bp, Homo sapiens
tcctcctgccctg

SEQ ID NO: 2148650 - DNA, 19 bp, Homo sapiens
tcctcctgccctgtccctg

SEQ ID NO: 2148651 - DNA, 14 bp, Homo sapiens
tcctcggcccatct

SEQ ID NO: 2148652 - DNA, 19 bp, Homo sapiens
tcctcggcccatctgtcca

SEQ ID NO: 2148653 - DNA, 23 bp, Homo sapiens
tcctcggcccatctgtccatcct

SEQ ID NO: 2148654 - DNA, 16 bp, Homo sapiens
tcctctccatgcaagt

SEQ ID NO: 2148655 - DNA, 18 bp, Homo sapiens
tcctctccatgcaagtgc

SEQ ID NO: 2148656 - DNA, 20 bp, Homo sapiens
tcctgacccggattggccct

SEQ ID NO: 2148657 - DNA, 22 bp, Homo sapiens
tcctgacccggattggccctgc

SEQ ID NO: 2148658 - DNA, 17 bp, Homo sapiens
tcctgccagctctgtca

SEQ ID NO: 2148659 - DNA, 18 bp, Homo sapiens
tcctgccctgtccctgtc

SEQ ID NO: 2148660 - DNA, 21 bp, Homo sapiens
tcctgccctgtccctgtcccc

SEQ ID NO: 2148661 - DNA, 16 bp, Homo sapiens
tcctgctggatgcgtg

SEQ ID NO: 2148662 - DNA, 14 bp, Homo sapiens
tcctgctggcctgc

SEQ ID NO: 2148663 - DNA, 16 bp, Homo sapiens
tcctgctggcctgctc

SEQ ID NO: 2148664 - DNA, 10 bp, Homo sapiens
tcctgggccc

SEQ ID NO: 2148665 - DNA, 15 bp, Homo sapiens
tcctgggcccccaga

SEQ ID NO: 2148666 - DNA, 16 bp, Homo sapiens
tcctgggcccccagag

SEQ ID NO: 2148667 - DNA, 21 bp, Homo sapiens
tcctgtcgattagactggaca

SEQ ID NO: 2148668 - DNA, 15 bp, Homo sapiens
tccttactcagagct

SEQ ID NO: 2148669 - DNA, 18 bp, Homo sapiens
tccttccccttgtccctg

SEQ ID NO: 2148670 - DNA, 24 bp, Homo sapiens
tccttccccttgtccctggggcac

SEQ ID NO: 2148671 - DNA, 18 bp, Homo sapiens
tccttgcctgaactccag

SEQ ID NO: 2148672 - DNA, 21 bp, Homo sapiens
tccttggcaggctgatttcta

SEQ ID NO: 2148673 - DNA, 20 bp, Homo sapiens
tcgaaacctgtccataaagt

SEQ ID NO: 2148674 - DNA, 13 bp, Homo sapiens
tcgaactgtgctc

SEQ ID NO: 2148675 - DNA, 15 bp, Homo sapiens
tcgaactgtgctccc

SEQ ID NO: 2148676 - DNA, 14 bp, Homo sapiens
tcgaatgacactgt

SEQ ID NO: 2148677 - DNA, 14 bp, Homo sapiens
tcgactcaggatcc

SEQ ID NO: 2148678 - DNA, 14 bp, Homo sapiens
tcgagacacttgcc

SEQ ID NO: 2148679 - DNA, 23 bp, Homo sapiens
tcgatgaatgtgttgatttgaga

SEQ ID NO: 2148680 - DNA, 12 bp, Homo sapiens
tcgattagactg

SEQ ID NO: 2148681 - DNA, 14 bp, Homo sapiens
tcgattagactgga

SEQ ID NO: 2148682 - DNA, 22 bp, Homo sapiens
tcgattagactggacagcttgt

SEQ ID NO: 2148683 - DNA, 22 bp, Homo sapiens
tcgccccagatcaccagcccgg

SEQ ID NO: 2148684 - DNA, 18 bp, Homo sapiens
tcggaggctcctccctct

SEQ ID NO: 2148685 - DNA, 21 bp, Homo sapiens
tcggaggctcctccctctgcc

SEQ ID NO: 2148686 - DNA, 16 bp, Homo sapiens
tcggcccatctgtcca

SEQ ID NO: 2148687 - DNA, 17 bp, Homo sapiens
tcggcccatctgtccat

SEQ ID NO: 2148688 - DNA, 19 bp, Homo sapiens
tgggggagggactgctgac

SEQ ID NO: 2148689 - DNA, 22 bp, Homo sapiens
tgggggggagaaggcctcccct

SEQ ID NO: 2148690 - DNA, 19 bp, Homo sapiens
tgggtcctcggcccatctg

SEQ ID NO: 2148691 - DNA, 14 bp, Homo sapiens
tgggtttggcccct

SEQ ID NO: 2148692 - DNA, 23 bp, Homo sapiens
tggtaaaaagattatatatcata

SEQ ID NO: 2148693 - DNA, 18 bp, Homo sapiens
tggtactgcacattttgt

SEQ ID NO: 2148694 - DNA, 23 bp, Homo sapiens
tggtcccaagtagtagtgtcttc

SEQ ID NO: 2148695 - DNA, 17 bp, Homo sapiens
tggtgaggccggccctg

SEQ ID NO: 2148696 - DNA, 18 bp, Homo sapiens
tggtgaggccggccctgc

SEQ ID NO: 2148697 - DNA, 22 bp, Homo sapiens
tggtgaggccggccctgcccct

SEQ ID NO: 2148698 - DNA, 17 bp, Homo sapiens
tggttgtcaatattaaa

SEQ ID NO: 2148699 - DNA, 23 bp, Homo sapiens
tggtttgaagaatgttaagactt

SEQ ID NO: 2148700 - DNA, 14 bp, Homo sapiens
tgtaaatattgtgt

SEQ ID NO: 2148701 - DNA, 18 bp, Homo sapiens
tgtacaaagatatgctaa

SEQ ID NO: 2148702 - DNA, 12 bp, Homo sapiens
tgtaccacaccc

SEQ ID NO: 2148703 - DNA, 12 bp, Homo sapiens
tgtagggctgga

SEQ ID NO: 2148704 - DNA, 19 bp, Homo sapiens
tgtatagatgcaagatatt

SEQ ID NO: 2148705 - DNA, 12 bp, Homo sapiens
tgtatatagttt

SEQ ID NO: 2148706 - DNA, 15 bp, Homo sapiens
tgtatatatatatat

SEQ ID NO: 2148707 - DNA, 16 bp, Homo sapiens
tgtatatgtatatcta

SEQ ID NO: 2148708 - DNA, 17 bp, Homo sapiens
tgtatatgtatatctat

SEQ ID NO: 2148709 - DNA, 16 bp, Homo sapiens
tgtatattaaggtgtg

SEQ ID NO: 2148710 - DNA, 21 bp, Homo sapiens
tgtcaaacaaatagtctatca

SEQ ID NO: 2148711 - DNA, 13 bp, Homo sapiens
tgtcaatattaaa

SEQ ID NO: 2148712 - DNA, 21 bp, Homo sapiens
tgtcaccctggccaccaccca

SEQ ID NO: 2148713 - DNA, 20 bp, Homo sapiens
tgtcagccgagccgggcctg

SEQ ID NO: 2148714 - DNA, 22 bp, Homo sapiens
tgtcagccgagccgggcctggg

SEQ ID NO: 2148715 - DNA, 15 bp, Homo sapiens
tgtccagaagaatat

SEQ ID NO: 2148716 - DNA, 21 bp, Homo sapiens
tgtccagaagaatattcagga

SEQ ID NO: 2148717 - DNA, 14 bp, Homo sapiens
tgtccatcctcctc

SEQ ID NO: 2148718 - DNA, 15 bp, Homo sapiens
tgtccatcctcctct

SEQ ID NO: 2148719 - DNA, 16 bp, Homo sapiens
tgtccatcctcctctc

SEQ ID NO: 2148720 - DNA, 17 bp, Homo sapiens
tgtccatcctcctctcc

SEQ ID NO: 2148721 - DNA, 22 bp, Homo sapiens
tgtccatcctcctctccatgca

SEQ ID NO: 2148722 - DNA, 23 bp, Homo sapiens
tgtccatcctcctctccatgcaa

SEQ ID NO: 2148723 - DNA, 18 bp, Homo sapiens
tgtccctggggcactccc

SEQ ID NO: 2148724 - DNA, 20 bp, Homo sapiens
tgtccctggggcactccccc

SEQ ID NO: 2148725 - DNA, 22 bp, Homo sapiens
tgtccctggggcactcccccag

SEQ ID NO: 2148726 - DNA, 18 bp, Homo sapiens
tgtccctttttgcagggg

SEQ ID NO: 2148727 - DNA, 16 bp, Homo sapiens
tgtcctaaggacacac

SEQ ID NO: 2148728 - DNA, 18 bp, Homo sapiens
tgtcctaaggacacacta

SEQ ID NO: 2148729 - DNA, 16 bp, Homo sapiens
tgtccttactcagagc

SEQ ID NO: 2148730 - DNA, 20 bp, Homo sapiens
tgtccttactcagagctgcg

SEQ ID NO: 2148731 - DNA, 15 bp, Homo sapiens
tgtcgagacacttgc

SEQ ID NO: 2148732 - DNA, 20 bp, Homo sapiens
tgtcgattagactggacagc

SEQ ID NO: 2148733 - DNA, 22 bp, Homo sapiens
tgtctcccaacatgggagggat

SEQ ID NO: 2148734 - DNA, 13 bp, Homo sapiens
tgtctctgcctgg

SEQ ID NO: 2148735 - DNA, 16 bp, Homo sapiens
tgtctctgcctggagc

SEQ ID NO: 2148736 - DNA, 20 bp, Homo sapiens
tgtctctgcctggagcaggg

SEQ ID NO: 2148737 - DNA, 19 bp, Homo sapiens
tgtcttataggtttccact

SEQ ID NO: 2148738 - DNA, 11 bp, Homo sapiens
tgtgaatacaa

SEQ ID NO: 2148739 - DNA, 17 bp, Homo sapiens
tgtgaatacaattaaag

SEQ ID NO: 2148740 - DNA, 15 bp, Homo sapiens
tgtggcaagtgaatt

SEQ ID NO: 2148741 - DNA, 16 bp, Homo sapiens
tgtggccccaagaggg

SEQ ID NO: 2148742 - DNA, 21 bp, Homo sapiens
tgtgtaccacaccctgcctgc

SEQ ID NO: 2148743 - DNA, 21 bp, Homo sapiens
tgtgtatagatgcaagatatt

SEQ ID NO: 2148744 - DNA, 17 bp, Homo sapiens
tgttaagacttgacagt

SEQ ID NO: 2148745 - DNA, 13 bp, Homo sapiens
tgttactaaagtc

SEQ ID NO: 2148746 - DNA, 12 bp, Homo sapiens
tgttacttacct

SEQ ID NO: 2148747 - DNA, 13 bp, Homo sapiens
tgttcacactcct

SEQ ID NO: 2148748 - DNA, 20 bp, Homo sapiens
tgttctgtccagtttccaaa

SEQ ID NO: 2148749 - DNA, 21 bp, Homo sapiens
tgttctgtccagtttccaaag

SEQ ID NO: 2148750 - DNA, 18 bp, Homo sapiens
tgtttgcacagagggcgc

SEQ ID NO: 2148751 - DNA, 18 bp, Homo sapiens
tgtttgcacctttctagt

SEQ ID NO: 2148752 - DNA, 22 bp, Homo sapiens
tgtttgcacctttctagttgaa

SEQ ID NO: 2148753 - DNA, 20 bp, Homo sapiens
tgtttttaatgctttgatat

SEQ ID NO: 2148754 - DNA, 14 bp, Homo sapiens
ttaaaaactgagtg

SEQ ID NO: 2148755 - DNA, 15 bp, Homo sapiens
ttaacaaaagcaaga

SEQ ID NO: 2148756 - DNA, 16 bp, Homo sapiens
ttaactcattagactg

SEQ ID NO: 2148757 - DNA, 13 bp, Homo sapiens
ttacatgtttgca

SEQ ID NO: 2148758 - DNA, 22 bp, Homo sapiens
ttacccagagaatatatacatt

SEQ ID NO: 2148759 - DNA, 22 bp, Homo sapiens
ttacccttcctcatctgtgcct

SEQ ID NO: 2148760 - DNA, 18 bp, Homo sapiens
ttacctaaacagatataa

SEQ ID NO: 2148761 - DNA, 13 bp, Homo sapiens
ttactcagagctg

SEQ ID NO: 2148762 - DNA, 15 bp, Homo sapiens
ttactcagagctgcg

SEQ ID NO: 2148763 - DNA, 18 bp, Homo sapiens
ttactgacagaaatgcaa

SEQ ID NO: 2148764 - DNA, 13 bp, Homo sapiens
ttacttacctaaa

SEQ ID NO: 2148765 - DNA, 14 bp, Homo sapiens
ttacttcccccacc

SEQ ID NO: 2148766 - DNA, 17 bp, Homo sapiens
ttagactggaacttgaa

SEQ ID NO: 2148767 - DNA, 22 bp, Homo sapiens
ttagactggaacttgaactgat

SEQ ID NO: 2148768 - DNA, 12 bp, Homo sapiens
ttatatatcata

SEQ ID NO: 2148769 - DNA, 16 bp, Homo sapiens
ttatatatcataaagt

SEQ ID NO: 2148770 - DNA, 15 bp, Homo sapiens
ttatatcagcctgag

SEQ ID NO: 2148771 - DNA, 16 bp, Homo sapiens
ttatatcagcctgagt

SEQ ID NO: 2148772 - DNA, 13 bp, Homo sapiens
ttatatggaaatt

SEQ ID NO: 2148773 - DNA, 12 bp, Homo sapiens
ttatttgttgag

SEQ ID NO: 2148774 - DNA, 17 bp, Homo sapiens
ttcaaaaaaacactagt

SEQ ID NO: 2148775 - DNA, 15 bp, Homo sapiens
ttcaatgttagcctc

SEQ ID NO: 2148776 - DNA, 15 bp, Homo sapiens
ttcagacaagcaaca

SEQ ID NO: 2148777 - DNA, 14 bp, Homo sapiens
ttccaccagagcag

SEQ ID NO: 2148778 - DNA, 22 bp, Homo sapiens
ttccaccagagcaggggctgct

SEQ ID NO: 2148779 - DNA, 18 bp, Homo sapiens
ttccactgccaaaacaat

SEQ ID NO: 2148780 - DNA, 14 bp, Homo sapiens
ttccagattgttct

SEQ ID NO: 2148781 - DNA, 19 bp, Homo sapiens
ttcccactaagctttctcc

SEQ ID NO: 2148782 - DNA, 13 bp, Homo sapiens
ttcccccatccct

SEQ ID NO: 2148783 - DNA, 18 bp, Homo sapiens
ttcccccatccctaccac

SEQ ID NO: 2148784 - DNA, 16 bp, Homo sapiens
ttcctacccaaccact

SEQ ID NO: 2148785 - DNA, 17 bp, Homo sapiens
ttcctacccaaccactc

SEQ ID NO: 2148786 - DNA, 21 bp, Homo sapiens
ttcctgacccggattggccct

SEQ ID NO: 2148787 - DNA, 21 bp, Homo sapiens
ttcgaaacctgtccataaagt

SEQ ID NO: 2148788 - DNA, 14 bp, Homo sapiens
ttcgaactgtgctc

SEQ ID NO: 2148789 - DNA, 18 bp, Homo sapiens
ttcgaactgtgctcccac

SEQ ID NO: 2148790 - DNA, 19 bp, Homo sapiens
ttcgaactgtgctcccacg

SEQ ID NO: 2148791 - DNA, 15 bp, Homo sapiens
ttcgaatgacactgt

SEQ ID NO: 2148792 - DNA, 19 bp, Homo sapiens
ttctacacatatatgtata

SEQ ID NO: 2148793 - DNA, 23 bp, Homo sapiens
ttctagtctcctttgcactgagg

SEQ ID NO: 2148794 - DNA, 13 bp, Homo sapiens
ttctccagccagc

SEQ ID NO: 2148795 - DNA, 12 bp, Homo sapiens
ttctgctggcct

SEQ ID NO: 2148796 - DNA, 21 bp, Homo sapiens
atgacagtccgtcaaaacaga

SEQ ID NO: 2148797 - DNA, 22 bp, Homo sapiens
atgacagtccgtcaaaacagat

SEQ ID NO: 2148798 - DNA, 15 bp, Homo sapiens
atgagaagagggcct

SEQ ID NO: 2148799 - DNA, 21 bp, Homo sapiens
atgagaagagggcctgtggga

SEQ ID NO: 2148800 - DNA, 14 bp, Homo sapiens
atgatgtccagaag

SEQ ID NO: 2148801 - DNA, 15 bp, Homo sapiens
atgatgtccagaaga

SEQ ID NO: 2148802 - DNA, 23 bp, Homo sapiens
atgatgtccagaagaatattcag

SEQ ID NO: 2148803 - DNA, 21 bp, Homo sapiens
atgcaagtgctgtttgggcag

SEQ ID NO: 2148804 - DNA, 21 bp, Homo sapiens
atgctggcctcttggcacctg

SEQ ID NO: 2148805 - DNA, 22 bp, Homo sapiens
atgctggcctcttggcacctgc

SEQ ID NO: 2148806 - DNA, 14 bp, Homo sapiens
atggagactcctgc

SEQ ID NO: 2148807 - DNA, 15 bp, Homo sapiens
atggcagctgggccc

SEQ ID NO: 2148808 - DNA, 18 bp, Homo sapiens
atggcagctgggcccaca

SEQ ID NO: 2148809 - DNA, 13 bp, Homo sapiens
atgggagggatca

SEQ ID NO: 2148810 - DNA, 16 bp, Homo sapiens
atgggagtgagacaga

SEQ ID NO: 2148811 - DNA, 13 bp, Homo sapiens
atggtgtctccca

SEQ ID NO: 2148812 - DNA, 20 bp, Homo sapiens
atggttccatgcctgagggt

SEQ ID NO: 2148813 - DNA, 15 bp, Homo sapiens
atgtatatctatatc

SEQ ID NO: 2148814 - DNA, 13 bp, Homo sapiens
atgtatatgtata

SEQ ID NO: 2148815 - DNA, 19 bp, Homo sapiens
atgtatatgtatatctata

SEQ ID NO: 2148816 - DNA, 23 bp, Homo sapiens
atgtcagccgagccgggcctggg

SEQ ID NO: 2148817 - DNA, 18 bp, Homo sapiens
atgtcctaaggacacact

SEQ ID NO: 2148818 - DNA, 20 bp, Homo sapiens
atgtcctaaggacacactaa

SEQ ID NO: 2148819 - DNA, 20 bp, Homo sapiens
atgttaagacttgacagtgg

SEQ ID NO: 2148820 - DNA, 19 bp, Homo sapiens
atgtttgcacctttctagt

SEQ ID NO: 2148821 - DNA, 13 bp, Homo sapiens
attaaaaactgag

SEQ ID NO: 2148822 - DNA, 14 bp, Homo sapiens
attaaaaactgagt

SEQ ID NO: 2148823 - DNA, 19 bp, Homo sapiens
attaaatacagacactaag

SEQ ID NO: 2148824 - DNA, 23 bp, Homo sapiens
attaatctttctttacctgagac

SEQ ID NO: 2148825 - DNA, 15 bp, Homo sapiens
attagactggaactt

SEQ ID NO: 2148826 - DNA, 16 bp, Homo sapiens
attagactggacagct

SEQ ID NO: 2148827 - DNA, 19 bp, Homo sapiens
attaggatttgccccttcc

SEQ ID NO: 2148828 - DNA, 19 bp, Homo sapiens
attagtacacagcaccaga

SEQ ID NO: 2148829 - DNA, 21 bp, Homo sapiens
attagtttgatttaatatctg

SEQ ID NO: 2148830 - DNA, 12 bp, Homo sapiens
attatatatcat

SEQ ID NO: 2148831 - DNA, 19 bp, Homo sapiens
attatatatcataaagtat

SEQ ID NO: 2148832 - DNA, 14 bp, Homo sapiens
attcaacctgtgtc

SEQ ID NO: 2148833 - DNA, 16 bp, Homo sapiens
attcacatctcatttt

SEQ ID NO: 2148834 - DNA, 13 bp, Homo sapiens
attcagacaagca

SEQ ID NO: 2148835 - DNA, 23 bp, Homo sapiens
agccccttctcccagcacacggc

SEQ ID NO: 2148836 - DNA, 19 bp, Homo sapiens
agcccggcctgctcccagc

SEQ ID NO: 2148837 - DNA, 23 bp, Homo sapiens
agccctgtcgagacacttgcctt

SEQ ID NO: 2148838 - DNA, 16 bp, Homo sapiens
agcccttccctgcttt

SEQ ID NO: 2148839 - DNA, 21 bp, Homo sapiens
agccctttgcaggcccagcag

SEQ ID NO: 2148840 - DNA, 18 bp, Homo sapiens
agccgagccgggcctggg

SEQ ID NO: 2148841 - DNA, 14 bp, Homo sapiens
agccgccccagccc

SEQ ID NO: 2148842 - DNA, 18 bp, Homo sapiens
agcctcacagatgctggc

SEQ ID NO: 2148843 - DNA, 20 bp, Homo sapiens
agcctcacagatgctggcct

SEQ ID NO: 2148844 - DNA, 14 bp, Homo sapiens
agcgcctgtcccct

SEQ ID NO: 2148845 - DNA, 13 bp, Homo sapiens
agctaatctgtag

SEQ ID NO: 2148846 - DNA, 19 bp, Homo sapiens
agctaatctgtagggctgg

SEQ ID NO: 2148847 - DNA, 18 bp, Homo sapiens
agctattagcaactgtgc

SEQ ID NO: 2148848 - DNA, 20 bp, Homo sapiens
agctattagcaactgtgcta

SEQ ID NO: 2148849 - DNA, 14 bp, Homo sapiens
agctcctcccctgc

SEQ ID NO: 2148850 - DNA, 19 bp, Homo sapiens
agctcctcccctgccgcct

SEQ ID NO: 2148851 - DNA, 20 bp, Homo sapiens
agctctgacattctgattcg

SEQ ID NO: 2148852 - DNA, 18 bp, Homo sapiens
agctctgtcaccctggcc

SEQ ID NO: 2148853 - DNA, 13 bp, Homo sapiens
agctcttgggcct

SEQ ID NO: 2148854 - DNA, 15 bp, Homo sapiens
agctcttgggcctga

SEQ ID NO: 2148855 - DNA, 17 bp, Homo sapiens
agctcttgggcctgacc

SEQ ID NO: 2148856 - DNA, 22 bp, Homo sapiens
agctcttgggcctgacctccag

SEQ ID NO: 2148857 - DNA, 24 bp, Homo sapiens
agctcttgggcctgacctccagtc

SEQ ID NO: 2148858 - DNA, 12 bp, Homo sapiens
agctgaggcctc

SEQ ID NO: 2148859 - DNA, 13 bp, Homo sapiens
agctgaggcctcc

SEQ ID NO: 2148860 - DNA, 15 bp, Homo sapiens
agctgaggcctccct

SEQ ID NO: 2148861 - DNA, 16 bp, Homo sapiens
agctgcctccccaatc

SEQ ID NO: 2148862 - DNA, 17 bp, Homo sapiens
agctgcctccccaatcc

SEQ ID NO: 2148863 - DNA, 13 bp, Homo sapiens
agctgggcccaca

SEQ ID NO: 2148864 - DNA, 14 bp, Homo sapiens
agctgggcccacag

SEQ ID NO: 2148865 - DNA, 15 bp, Homo sapiens
agctgtggtcccacc

SEQ ID NO: 2148866 - DNA, 16 bp, Homo sapiens
agctgtggtcccaccc

SEQ ID NO: 2148867 - DNA, 12 bp, Homo sapiens
agctttgtcact

SEQ ID NO: 2148868 - DNA, 18 bp, Homo sapiens
agcttttcgaactgtgct

SEQ ID NO: 2148869 - DNA, 17 bp, Homo sapiens
aggaagggagggagctg

SEQ ID NO: 2148870 - DNA, 15 bp, Homo sapiens
aggacaacctgcccc

SEQ ID NO: 2148871 - DNA, 23 bp, Homo sapiens
aggacacaccccacaccccagcc

SEQ ID NO: 2148872 - DNA, 23 bp, Homo sapiens
aggacacactaatcgaactatga

SEQ ID NO: 2148873 - DNA, 16 bp, Homo sapiens
aggactggccgtggct

SEQ ID NO: 2148874 - DNA, 21 bp, Homo sapiens
aggactggccgtggctccaga

SEQ ID NO: 2148875 - DNA, 15 bp, Homo sapiens
aggagcacaggcagc

SEQ ID NO: 2148876 - DNA, 14 bp, Homo sapiens
aggatcccctgtcc

SEQ ID NO: 2148877 - DNA, 19 bp, Homo sapiens
aggatcccctgtcccctgg

SEQ ID NO: 2148878 - DNA, 23 bp, Homo sapiens
aggatcccctgtcccctggggct

SEQ ID NO: 2148879 - DNA, 21 bp, Homo sapiens
aggatctctcaggagcacagg

SEQ ID NO: 2148880 - DNA, 17 bp, Homo sapiens
aggcacatggctggggg

SEQ ID NO: 2148881 - DNA, 20 bp, Homo sapiens
aggcatttctatcacatatt

SEQ ID NO: 2148882 - DNA, 13 bp, Homo sapiens
aggcccagcagac

SEQ ID NO: 2148883 - DNA, 18 bp, Homo sapiens
aggccggccctgcccctc

SEQ ID NO: 2148884 - DNA, 20 bp, Homo sapiens
aggccggccctgcccctccc

SEQ ID NO: 2148885 - DNA, 23 bp, Homo sapiens
aggccggccctgcccctccctag

SEQ ID NO: 2148886 - DNA, 22 bp, Homo sapiens
aggcctcccctgaggatcccct

SEQ ID NO: 2148887 - DNA, 19 bp, Homo sapiens
aggcctctggttgcctccc

SEQ ID NO: 2148888 - DNA, 13 bp, Homo sapiens
aggctcctccctc

SEQ ID NO: 2148889 - DNA, 17 bp, Homo sapiens
aggctcctccctctgcc

SEQ ID NO: 2148890 - DNA, 15 bp, Homo sapiens
aggctgatttctagg

SEQ ID NO: 2148891 - DNA, 18 bp, Homo sapiens
aggcttctcccggacctg

SEQ ID NO: 2148892 - DNA, 16 bp, Homo sapiens
agggactgctgaccca

SEQ ID NO: 2148893 - DNA, 22 bp, Homo sapiens
agggactgctgacccaccaagg

SEQ ID NO: 2148894 - DNA, 18 bp, Homo sapiens
agggccacactattacca

SEQ ID NO: 2148895 - DNA, 19 bp, Homo sapiens
agggccagcaggcagcgcc

SEQ ID NO: 2148896 - DNA, 19 bp, Homo sapiens
agggcctcggaggctcctc

SEQ ID NO: 2148897 - DNA, 21 bp, Homo sapiens
agggcctcggaggctcctccc

SEQ ID NO: 2148898 - DNA, 19 bp, Homo sapiens
agggcctgtgggagcctgc

SEQ ID NO: 2148899 - DNA, 13 bp, Homo sapiens
agggcgctcctgt

SEQ ID NO: 2148900 - DNA, 22 bp, Homo sapiens
agggctggacctatgtcctaag

SEQ ID NO: 2148901 - DNA, 19 bp, Homo sapiens
aggggcaaagaactgcccc

SEQ ID NO: 2148902 - DNA, 16 bp, Homo sapiens
aggggcgggctcagag

SEQ ID NO: 2148903 - DNA, 22 bp, Homo sapiens
aggggctgctgggggctcccct

SEQ ID NO: 2148904 - DNA, 20 bp, Homo sapiens
agggggcccatccctgccca

SEQ ID NO: 2148905 - DNA, 15 bp, Homo sapiens
aggggtcaggctcca

SEQ ID NO: 2148906 - DNA, 16 bp, Homo sapiens
aggggtcaggctccat

SEQ ID NO: 2148907 - DNA, 14 bp, Homo sapiens
agggtaccagcaga

SEQ ID NO: 2148908 - DNA, 12 bp, Homo sapiens
agggtggagact

SEQ ID NO: 2148909 - DNA, 14 bp, Homo sapiens
aggtagaatgtaaa

SEQ ID NO: 2148910 - DNA, 13 bp, Homo sapiens
aggtcctgccctc

SEQ ID NO: 2148911 - DNA, 21 bp, Homo sapiens
aggtccttgcctgaactccag

SEQ ID NO: 2148912 - DNA, 17 bp, Homo sapiens
aggtctcacactcctcc

SEQ ID NO: 2148913 - DNA, 18 bp, Homo sapiens
aggtctcacactcctcct

SEQ ID NO: 2148914 - DNA, 18 bp, Homo sapiens
aggtgtcgggacatggtt

SEQ ID NO: 2148915 - DNA, 20 bp, Homo sapiens
agtacacagcaccagaatgt

SEQ ID NO: 2148916 - DNA, 13 bp, Homo sapiens
agtatatattcta

SEQ ID NO: 2148917 - DNA, 13 bp, Homo sapiens
agtatatctggac

SEQ ID NO: 2148918 - DNA, 15 bp, Homo sapiens
agtatatctggacaa

SEQ ID NO: 2148919 - DNA, 11 bp, Homo sapiens
agtcaccatgc

SEQ ID NO: 2148920 - DNA, 14 bp, Homo sapiens
agtcaccatgcaag

SEQ ID NO: 2148921 - DNA, 15 bp, Homo sapiens
agtcaccatgcaagg

SEQ ID NO: 2148922 - DNA, 17 bp, Homo sapiens
agtcagaacagcagact

SEQ ID NO: 2148923 - DNA, 18 bp, Homo sapiens
agtcatggtactacccca

SEQ ID NO: 2148924 - DNA, 14 bp, Homo sapiens
agtccgtcaaaaca

SEQ ID NO: 2148925 - DNA, 18 bp, Homo sapiens
agtcctcacagcctctcc

SEQ ID NO: 2148926 - DNA, 15 bp, Homo sapiens
agtcctgctggcctg

SEQ ID NO: 2148927 - DNA, 19 bp, Homo sapiens
agtcctgctggcctgctct

SEQ ID NO: 2148928 - DNA, 21 bp, Homo sapiens
agtctcctttgcactgagggc

SEQ ID NO: 2148929 - DNA, 13 bp, Homo sapiens
agtctctccagcc

SEQ ID NO: 2148930 - DNA, 17 bp, Homo sapiens
agtctctccagcctcac

SEQ ID NO: 2148931 - DNA, 14 bp, Homo sapiens
agtctctctgtgaa

SEQ ID NO: 2148932 - DNA, 16 bp, Homo sapiens
agtctctctgtgaata

SEQ ID NO: 2148933 - DNA, 23 bp, Homo sapiens
agtctctctgtgaatacaattaa

SEQ ID NO: 2148934 - DNA, 17 bp, Homo sapiens
agtctctggctcagctg

SEQ ID NO: 2148935 - DNA, 20 bp, Homo sapiens
agtctctggctcagctgtgg

SEQ ID NO: 2148936 - DNA, 18 bp, Homo sapiens
agtgactctatatagctg

SEQ ID NO: 2148937 - DNA, 22 bp, Homo sapiens
agtgagagacattaactcatta

SEQ ID NO: 2148938 - DNA, 20 bp, Homo sapiens
agtgctgtttgggcaggagt

SEQ ID NO: 2148939 - DNA, 22 bp, Homo sapiens
agtggggttgcaaccactgcaa

SEQ ID NO: 2148940 - DNA, 22 bp, Homo sapiens
agtgtccttggcaggctgattt

SEQ ID NO: 2148941 - DNA, 15 bp, Homo sapiens
agtgtctctgcctgg

SEQ ID NO: 2148942 - DNA, 19 bp, Homo sapiens
agtgtgaccaaaagttaca

SEQ ID NO: 2148943 - DNA, 19 bp, Homo sapiens
agttatatttactttaaaa

SEQ ID NO: 2148944 - DNA, 16 bp, Homo sapiens
agtttatttgttgaga

SEQ ID NO: 2148945 - DNA, 21 bp, Homo sapiens
cagacactaagttatagtata

SEQ ID NO: 2148946 - DNA, 21 bp, Homo sapiens
cagaccaccagccgccccagc

SEQ ID NO: 2148947 - DNA, 13 bp, Homo sapiens
cagactcttccac

SEQ ID NO: 2148948 - DNA, 16 bp, Homo sapiens
cagactcttccaccag

SEQ ID NO: 2148949 - DNA, 17 bp, Homo sapiens
cagactcttccaccaga

SEQ ID NO: 2148950 - DNA, 23 bp, Homo sapiens
cagagagtgagagacattaactc

SEQ ID NO: 2148951 - DNA, 21 bp, Homo sapiens
cagagcaggggctgctggggg

SEQ ID NO: 2148952 - DNA, 23 bp, Homo sapiens
cagagcaggggctgctgggggct

SEQ ID NO: 2148953 - DNA, 15 bp, Homo sapiens
cagagctgcctcccc

SEQ ID NO: 2148954 - DNA, 16 bp, Homo sapiens
cagagctgcctcccca

SEQ ID NO: 2148955 - DNA, 22 bp, Homo sapiens
cagagctgcctccccaatccat

SEQ ID NO: 2148956 - DNA, 13 bp, Homo sapiens
cagagctgcgggc

SEQ ID NO: 2148957 - DNA, 20 bp, Homo sapiens
cagagctgcgggctgagggc

SEQ ID NO: 2148958 - DNA, 13 bp, Homo sapiens
cagagctggaaca

SEQ ID NO: 2148959 - DNA, 14 bp, Homo sapiens
cagagctttgtcac

SEQ ID NO: 2148960 - DNA, 19 bp, Homo sapiens
cagagctttgtcacttgcc

SEQ ID NO: 2148961 - DNA, 20 bp, Homo sapiens
cagagctttgtcacttgcca

SEQ ID NO: 2148962 - DNA, 22 bp, Homo sapiens
cagagctttgtcacttgccaca

SEQ ID NO: 2148963 - DNA, 22 bp, Homo sapiens
cagagcttttcgaactgtgctc

SEQ ID NO: 2148964 - DNA, 15 bp, Homo sapiens
catcctcctcctcat

SEQ ID NO: 2148965 - DNA, 19 bp, Homo sapiens
catctctgagtgtctctgc

SEQ ID NO: 2148966 - DNA, 20 bp, Homo sapiens
catctctgagtgtctctgcc

SEQ ID NO: 2148967 - DNA, 13 bp, Homo sapiens
catctgtccatcc

SEQ ID NO: 2148968 - DNA, 14 bp, Homo sapiens
catctgtccatcct

SEQ ID NO: 2148969 - DNA, 22 bp, Homo sapiens
catctgtccatcctcctctcca

SEQ ID NO: 2148970 - DNA, 17 bp, Homo sapiens
catctgtgcctgtctgt

SEQ ID NO: 2148971 - DNA, 18 bp, Homo sapiens
catgagaagagggcctgt

SEQ ID NO: 2148972 - DNA, 17 bp, Homo sapiens
catgcaagtgctgtttg

SEQ ID NO: 2148973 - DNA, 20 bp, Homo sapiens
catgcaagtgctgtttgggc

SEQ ID NO: 2148974 - DNA, 16 bp, Homo sapiens
catgcctgagggtgga

SEQ ID NO: 2148975 - DNA, 20 bp, Homo sapiens
catgcctgagggtggagact

SEQ ID NO: 2148976 - DNA, 14 bp, Homo sapiens
catggagtgagcag

SEQ ID NO: 2148977 - DNA, 17 bp, Homo sapiens
catggcagctgggccca

SEQ ID NO: 2148978 - DNA, 17 bp, Homo sapiens
ccctcaggggaagctgc

SEQ ID NO: 2148979 - DNA, 21 bp, Homo sapiens
ccctcccagtcctccagacca

SEQ ID NO: 2148980 - DNA, 15 bp, Homo sapiens
ccctcccccacgtct

SEQ ID NO: 2148981 - DNA, 23 bp, Homo sapiens
ccctcccccacgtctctctgcct

SEQ ID NO: 2148982 - DNA, 14 bp, Homo sapiens
ccctccccctaccg

SEQ ID NO: 2148983 - DNA, 15 bp, Homo sapiens
ccctccctagatcca

SEQ ID NO: 2148984 - DNA, 16 bp, Homo sapiens
ccctgacccctgcacc

SEQ ID NO: 2148985 - DNA, 10 bp, Homo sapiens
ccctgcccaa

SEQ ID NO: 2148986 - DNA, 14 bp, Homo sapiens
ccctgcccaagggc

SEQ ID NO: 2148987 - DNA, 16 bp, Homo sapiens
ccctgcccaagggcct

SEQ ID NO: 2148988 - DNA, 20 bp, Homo sapiens
ccctgcccaagggcctccca

SEQ ID NO: 2148989 - DNA, 11 bp, Homo sapiens
ccctgcccctc

SEQ ID NO: 2148990 - DNA, 12 bp, Homo sapiens
ccctgcccctcc

SEQ ID NO: 2148991 - DNA, 13 bp, Homo sapiens
ccctgcccctccc

SEQ ID NO: 2148992 - DNA, 22 bp, Homo sapiens
ccctgcccctccccctaccgca

SEQ ID NO: 2148993 - DNA, 15 bp, Homo sapiens
ccctgccgcctcccg

SEQ ID NO: 2148994 - DNA, 18 bp, Homo sapiens
ccctgccgcctcccggga

SEQ ID NO: 2148995 - DNA, 12 bp, Homo sapiens
ccctgcctgctg

SEQ ID NO: 2148996 - DNA, 15 bp, Homo sapiens
ccctgcctgctgtgg

SEQ ID NO: 2148997 - DNA, 14 bp, Homo sapiens
ccctggaacctttc

SEQ ID NO: 2148998 - DNA, 15 bp, Homo sapiens
ccctggaacctttcc

SEQ ID NO: 2148999 - DNA, 19 bp, Homo sapiens
ccctggaacctttcccttg

SEQ ID NO: 2149000 - DNA, 21 bp, Homo sapiens
ccctggccaccacccaacctg

SEQ ID NO: 2149001 - DNA, 19 bp, Homo sapiens
ccctggctgaacagtgctc

SEQ ID NO: 2149002 - DNA, 18 bp, Homo sapiens
ccctggggcactccccca

SEQ ID NO: 2149003 - DNA, 21 bp, Homo sapiens
ccctggggcactcccccagga

SEQ ID NO: 2149004 - DNA, 16 bp, Homo sapiens
ccctggggctggtgga

SEQ ID NO: 2149005 - DNA, 23 bp, Homo sapiens
ccctgggtttggcccctggaacc

SEQ ID NO: 2149006 - DNA, 15 bp, Homo sapiens
ccctgtcccctgggg

SEQ ID NO: 2149007 - DNA, 18 bp, Homo sapiens
ccctgtcccctggggctg

SEQ ID NO: 2149008 - DNA, 16 bp, Homo sapiens
cccttacacgtacctc

SEQ ID NO: 2149009 - DNA, 21 bp, Homo sapiens
cccttcccccatccctaccac

SEQ ID NO: 2149010 - DNA, 19 bp, Homo sapiens
cccttgagtaggccctgct

SEQ ID NO: 2149011 - DNA, 20 bp, Homo sapiens
cccttgagtaggccctgctt

SEQ ID NO: 2149012 - DNA, 21 bp, Homo sapiens
cccttgagtaggccctgcttt

SEQ ID NO: 2149013 - DNA, 14 bp, Homo sapiens
cccttgtccctggg

SEQ ID NO: 2149014 - DNA, 23 bp, Homo sapiens
cccttgtgtgtaccacaccctgc

SEQ ID NO: 2149015 - DNA, 19 bp, Homo sapiens
ccgagccgggcctggggct

SEQ ID NO: 2149016 - DNA, 12 bp, Homo sapiens
ccgcatggcagc

SEQ ID NO: 2149017 - DNA, 14 bp, Homo sapiens
ccgcatggcagctg

SEQ ID NO: 2149018 - DNA, 19 bp, Homo sapiens
ccgcatggcagctgggccc

SEQ ID NO: 2149019 - DNA, 20 bp, Homo sapiens
ccgcatggcagctgggccca

SEQ ID NO: 2149020 - DNA, 14 bp, Homo sapiens
ccgccccagcccct

SEQ ID NO: 2149021 - DNA, 19 bp, Homo sapiens
ccggacctggactagggcc

SEQ ID NO: 2149022 - DNA, 19 bp, Homo sapiens
ccggattggccctgcccct

SEQ ID NO: 2149023 - DNA, 12 bp, Homo sapiens
ccggccctgccc

SEQ ID NO: 2149024 - DNA, 13 bp, Homo sapiens
ccggccctgcccc

SEQ ID NO: 2149025 - DNA, 14 bp, Homo sapiens
ccggccctgcccct

SEQ ID NO: 2149026 - DNA, 22 bp, Homo sapiens
ccggccctgcccctccctagat

SEQ ID NO: 2149027 - DNA, 16 bp, Homo sapiens
ccggcctgctcccagc

SEQ ID NO: 2149028 - DNA, 20 bp, Homo sapiens
ccggcctgctcccagcagcc

SEQ ID NO: 2149029 - DNA, 20 bp, Homo sapiens
ccggctgggtcggccctgcc

SEQ ID NO: 2149030 - DNA, 16 bp, Homo sapiens
ccgggaagcatcctcc

SEQ ID NO: 2149031 - DNA, 20 bp, Homo sapiens
ccgggaagcatcctccccac

SEQ ID NO: 2149032 - DNA, 13 bp, Homo sapiens
ccgggcctggggc

SEQ ID NO: 2149033 - DNA, 16 bp, Homo sapiens
ccgggtgccattccca

SEQ ID NO: 2149034 - DNA, 17 bp, Homo sapiens
ccgggttctagtctcct

SEQ ID NO: 2149035 - DNA, 22 bp, Homo sapiens
ccgtcaaaacagattgtttgca

SEQ ID NO: 2149036 - DNA, 22 bp, Homo sapiens
ccgtggctccagaatgtgctgc

SEQ ID NO: 2149037 - DNA, 23 bp, Homo sapiens
cctaaacagatataaatggctgg

SEQ ID NO: 2149038 - DNA, 14 bp, Homo sapiens
cctaaggacacact

SEQ ID NO: 2149039 - DNA, 17 bp, Homo sapiens
cctaaggacacactaat

SEQ ID NO: 2149040 - DNA, 19 bp, Homo sapiens
cctaaggatctctcaggag

SEQ ID NO: 2149041 - DNA, 24 bp, Homo sapiens
cctaaggatctctcaggagcacag

SEQ ID NO: 2149042 - DNA, 15 bp, Homo sapiens
cctaatcaagagtct

SEQ ID NO: 2149043 - DNA, 18 bp, Homo sapiens
cctaatcaagagtctctc

SEQ ID NO: 2149044 - DNA, 21 bp, Homo sapiens
cctaatcaagagtctctccag

SEQ ID NO: 2149045 - DNA, 17 bp, Homo sapiens
cctaccactgtggcccc

SEQ ID NO: 2149046 - DNA, 20 bp, Homo sapiens
cctaccactgtggccccaag

SEQ ID NO: 2149047 - DNA, 18 bp, Homo sapiens
cctaccgcatggcagctg

SEQ ID NO: 2149048 - DNA, 19 bp, Homo sapiens
cctaccgcatggcagctgg

SEQ ID NO: 2149049 - DNA, 20 bp, Homo sapiens
cctaccgcatggcagctggg

SEQ ID NO: 2149050 - DNA, 13 bp, Homo sapiens
cctagatccaggc

SEQ ID NO: 2149051 - DNA, 14 bp, Homo sapiens
cctagatccaggct

SEQ ID NO: 2149052 - DNA, 16 bp, Homo sapiens
cctagctcttgggcct

SEQ ID NO: 2149053 - DNA, 18 bp, Homo sapiens
cctagctcttgggcctga

SEQ ID NO: 2149054 - DNA, 17 bp, Homo sapiens
cctaggattcctccccc

SEQ ID NO: 2149055 - DNA, 21 bp, Homo sapiens
cctatgtcctaaggacacact

SEQ ID NO: 2149056 - DNA, 13 bp, Homo sapiens
cctcacactccag

SEQ ID NO: 2149057 - DNA, 24 bp, Homo sapiens
cctcacagactcttccaccagagc

SEQ ID NO: 2149058 - DNA, 22 bp, Homo sapiens
cctcacttttaatgaacaaatg

SEQ ID NO: 2149059 - DNA, 15 bp, Homo sapiens
cctcaggggaagctg

SEQ ID NO: 2149060 - DNA, 20 bp, Homo sapiens
cctcaggggaagctgctagg

SEQ ID NO: 2149061 - DNA, 21 bp, Homo sapiens
cctcaggggaagctgctaggg

SEQ ID NO: 2149062 - DNA, 14 bp, Homo sapiens
cctcatcctcctcc

SEQ ID NO: 2149063 - DNA, 15 bp, Homo sapiens
cctcatcctcctcct

SEQ ID NO: 2149064 - DNA, 18 bp, Homo sapiens
cctcatcctcctcctcat

SEQ ID NO: 2149065 - DNA, 14 bp, Homo sapiens
cctcatctgtgcct

SEQ ID NO: 2149066 - DNA, 17 bp, Homo sapiens
cctcatctgtgcctgtc

SEQ ID NO: 2149067 - DNA, 17 bp, Homo sapiens
cctccagaccaccagcc

SEQ ID NO: 2149068 - DNA, 14 bp, Homo sapiens
cctccagtcctgct

SEQ ID NO: 2149069 - DNA, 16 bp, Homo sapiens
cctccagtcctgctgg

SEQ ID NO: 2149070 - DNA, 23 bp, Homo sapiens
cctccagtcctgctggcctgctc

SEQ ID NO: 2149071 - DNA, 13 bp, Homo sapiens
cctcccagtcctc

SEQ ID NO: 2149072 - DNA, 19 bp, Homo sapiens
cctcccatggccttccctc

SEQ ID NO: 2149073 - DNA, 19 bp, Homo sapiens
cctccccaccagagctgcc

SEQ ID NO: 2149074 - DNA, 22 bp, Homo sapiens
cctccccaccagagctgcctcc

SEQ ID NO: 2149075 - DNA, 13 bp, Homo sapiens
cctcccccgcctc

SEQ ID NO: 2149076 - DNA, 21 bp, Homo sapiens
cctccccctaccgcatggcag

SEQ ID NO: 2149077 - DNA, 9 bp, Homo sapiens
cctcccctg

SEQ ID NO: 2149078 - DNA, 12 bp, Homo sapiens
cctcccctgccg

SEQ ID NO: 2149079 - DNA, 21 bp, Homo sapiens
cctcccctgccgcctcccggg

SEQ ID NO: 2149080 - DNA, 14 bp, Homo sapiens
cctccctctgcctc

SEQ ID NO: 2149081 - DNA, 15 bp, Homo sapiens
cctccctctgcctca

SEQ ID NO: 2149082 - DNA, 22 bp, Homo sapiens
cctccctctgcctcatcctcct

SEQ ID NO: 2149083 - DNA, 20 bp, Homo sapiens
cctcccttgagtaggccctg

SEQ ID NO: 2149084 - DNA, 14 bp, Homo sapiens
cggccctgcccctc

SEQ ID NO: 2149085 - DNA, 15 bp, Homo sapiens
cggccctgcccctcc

SEQ ID NO: 2149086 - DNA, 17 bp, Homo sapiens
cggccctgcccctccct

SEQ ID NO: 2149087 - DNA, 15 bp, Homo sapiens
cggctgcctgacact

SEQ ID NO: 2149088 - DNA, 21 bp, Homo sapiens
cggctgcctgacactgagccc

SEQ ID NO: 2149089 - DNA, 22 bp, Homo sapiens
cggctgggtcggccctgcccaa

SEQ ID NO: 2149090 - DNA, 23 bp, Homo sapiens
cggcttagacttcgactcaggat

SEQ ID NO: 2149091 - DNA, 22 bp, Homo sapiens
cgggaagcatcctccccaccag

SEQ ID NO: 2149092 - DNA, 10 bp, Homo sapiens
cgggctcaga

SEQ ID NO: 2149093 - DNA, 22 bp, Homo sapiens
cgggctgagggcatctctgagt

SEQ ID NO: 2149094 - DNA, 22 bp, Homo sapiens
cggtgggggggagaaggcctcc

SEQ ID NO: 2149095 - DNA, 17 bp, Homo sapiens
cgtaagatggcttattt

SEQ ID NO: 2149096 - DNA, 20 bp, Homo sapiens
cgtaccaagccaccgcagct

SEQ ID NO: 2149097 - DNA, 21 bp, Homo sapiens
cgtaccaagccaccgcagctg

SEQ ID NO: 2149098 - DNA, 22 bp, Homo sapiens
cgtaccaagccaccgcagctgc

SEQ ID NO: 2149099 - DNA, 23 bp, Homo sapiens
cgtaccaagccaccgcagctgct

SEQ ID NO: 2149100 - DNA, 13 bp, Homo sapiens
cgtctctctgcct

SEQ ID NO: 2149101 - DNA, 14 bp, Homo sapiens
cgtgactcagagct

SEQ ID NO: 2149102 - DNA, 22 bp, Homo sapiens
cgtggctccagaatgtgctgcc

SEQ ID NO: 2149103 - DNA, 18 bp, Homo sapiens
cgttctgctggcctggat

SEQ ID NO: 2149104 - DNA, 13 bp, Homo sapiens
ctaaacagatata

SEQ ID NO: 2149105 - DNA, 16 bp, Homo sapiens
ctaaagtcacatataa

SEQ ID NO: 2149106 - DNA, 19 bp, Homo sapiens
ctaaccaaagagtctctgg

SEQ ID NO: 2149107 - DNA, 12 bp, Homo sapiens
ctaagccctgtc

SEQ ID NO: 2149108 - DNA, 20 bp, Homo sapiens
ctaagccctgtcgagacact

SEQ ID NO: 2149109 - DNA, 14 bp, Homo sapiens
ctaaggacacacta

SEQ ID NO: 2149110 - DNA, 17 bp, Homo sapiens
ctaaggatctctcagga

SEQ ID NO: 2149111 - DNA, 17 bp, Homo sapiens
ctaagttaatttaaagt

SEQ ID NO: 2149112 - DNA, 21 bp, Homo sapiens
ctaagttaatttaaagttgtt

SEQ ID NO: 2149113 - DNA, 16 bp, Homo sapiens
ctaagttatagtatat

SEQ ID NO: 2149114 - DNA, 21 bp, Homo sapiens
ctaatcaagagtctctccagc

SEQ ID NO: 2149115 - DNA, 22 bp, Homo sapiens
ctaatcaagagtctctccagcc

SEQ ID NO: 2149116 - DNA, 21 bp, Homo sapiens
ctaccactgtggccccaagag

SEQ ID NO: 2149117 - DNA, 23 bp, Homo sapiens
ctaccactgtggccccaagaggg

SEQ ID NO: 2149118 - DNA, 13 bp, Homo sapiens
ctacccaaccact

SEQ ID NO: 2149119 - DNA, 14 bp, Homo sapiens
ctacccaaccactc

SEQ ID NO: 2149120 - DNA, 17 bp, Homo sapiens
ctaccgcatggcagctg

SEQ ID NO: 2149121 - DNA, 14 bp, Homo sapiens
ctacctttttttct

SEQ ID NO: 2149122 - DNA, 13 bp, Homo sapiens
ctacttttcagaa

SEQ ID NO: 2149123 - DNA, 13 bp, Homo sapiens
ctagatccaggct

SEQ ID NO: 2149124 - DNA, 13 bp, Homo sapiens
ctagctcttgggc

SEQ ID NO: 2149125 - DNA, 14 bp, Homo sapiens
ctagctcttgggcc

SEQ ID NO: 2149126 - DNA, 17 bp, Homo sapiens
ctaggattcctccccca

SEQ ID NO: 2149127 - DNA, 23 bp, Homo sapiens
ctaggggaaggactggccgtggc

SEQ ID NO: 2149128 - DNA, 15 bp, Homo sapiens
ctagtctcctttgca

SEQ ID NO: 2149129 - DNA, 20 bp, Homo sapiens
ctagtctcctttgcactgag

SEQ ID NO: 2149130 - DNA, 13 bp, Homo sapiens
ctatgaactacaa

SEQ ID NO: 2149131 - DNA, 14 bp, Homo sapiens
ctatgtcctaagga

SEQ ID NO: 2149132 - DNA, 17 bp, Homo sapiens
ctattaccatgagaaga

SEQ ID NO: 2149133 - DNA, 15 bp, Homo sapiens
ctcaaatctattcag

SEQ ID NO: 2149134 - DNA, 16 bp, Homo sapiens
ctcaaatctattcaga

SEQ ID NO: 2149135 - DNA, 13 bp, Homo sapiens
ctcacactccaga

SEQ ID NO: 2149136 - DNA, 16 bp, Homo sapiens
ctcacactcctcctgc

SEQ ID NO: 2149137 - DNA, 17 bp, Homo sapiens
ctcacactcctcctgcc

SEQ ID NO: 2149138 - DNA, 18 bp, Homo sapiens
ctcacactcctcctgcca

SEQ ID NO: 2149139 - DNA, 16 bp, Homo sapiens
ctcacagactcttcca

SEQ ID NO: 2149140 - DNA, 14 bp, Homo sapiens
ctcacagatgctgg

SEQ ID NO: 2149141 - DNA, 15 bp, Homo sapiens
ctcacagatgctggc

SEQ ID NO: 2149142 - DNA, 19 bp, Homo sapiens
ctcacagatgctggcctct

SEQ ID NO: 2149143 - DNA, 21 bp, Homo sapiens
ctcacagatgctggcctcttg

SEQ ID NO: 2149144 - DNA, 23 bp, Homo sapiens
ctcacagatgctggcctcttggc

SEQ ID NO: 2149145 - DNA, 15 bp, Homo sapiens
ctcacagcctctccc

SEQ ID NO: 2149146 - DNA, 20 bp, Homo sapiens
ctcacagcctctcccttaat

SEQ ID NO: 2149147 - DNA, 14 bp, Homo sapiens
ctcactgctcaaga

SEQ ID NO: 2149148 - DNA, 20 bp, Homo sapiens
ctcactgctcaagaagacat

SEQ ID NO: 2149149 - DNA, 20 bp, Homo sapiens
ctcagagctgcgggctgagg

SEQ ID NO: 2149150 - DNA, 11 bp, Homo sapiens
ctcagagcttt

SEQ ID NO: 2149151 - DNA, 12 bp, Homo sapiens
ctcagagctttg

SEQ ID NO: 2149152 - DNA, 21 bp, Homo sapiens
ctcagagctttgtcacttgcc

SEQ ID NO: 2149153 - DNA, 22 bp, Homo sapiens
ctcagagctttgtcacttgcca

SEQ ID NO: 2149154 - DNA, 18 bp, Homo sapiens
ctcagatagaatgacagt

SEQ ID NO: 2149155 - DNA, 11 bp, Homo sapiens
ctcagcagccc

SEQ ID NO: 2149156 - DNA, 11 bp, Homo sapiens
ctcagctgtgg

SEQ ID NO: 2149157 - DNA, 14 bp, Homo sapiens
ctcagctgtggtcc

SEQ ID NO: 2149158 - DNA, 21 bp, Homo sapiens
ctcagctgtggtcccacccag

SEQ ID NO: 2149159 - DNA, 22 bp, Homo sapiens
ctcagctgtggtcccacccagg

SEQ ID NO: 2149160 - DNA, 23 bp, Homo sapiens
ctcagctgtggtcccacccagga

SEQ ID NO: 2149161 - DNA, 18 bp, Homo sapiens
ctcaggagcacaggcagc

SEQ ID NO: 2149162 - DNA, 15 bp, Homo sapiens
ctcaggggaagctgc

SEQ ID NO: 2149163 - DNA, 24 bp, Homo sapiens
ctcatcagtgtcctcttgctcaaa

SEQ ID NO: 2149164 - DNA, 12 bp, Homo sapiens
ctcatcctcctc

SEQ ID NO: 2149165 - DNA, 17 bp, Homo sapiens
ctcatcctcctcctcat

SEQ ID NO: 2149166 - DNA, 23 bp, Homo sapiens
ctcatctgtgcctgtctgtccaa

SEQ ID NO: 2149167 - DNA, 12 bp, Homo sapiens
ctcattagactg

SEQ ID NO: 2149168 - DNA, 14 bp, Homo sapiens
ctcattagactgga

SEQ ID NO: 2149169 - DNA, 15 bp, Homo sapiens
ctccaagtctctctg

SEQ ID NO: 2149170 - DNA, 17 bp, Homo sapiens
ctccaagtctctctgtg

SEQ ID NO: 2149171 - DNA, 19 bp, Homo sapiens
ctccaagtctctctgtgaa

SEQ ID NO: 2149172 - DNA, 16 bp, Homo sapiens
ctccagaatgtgctgc

SEQ ID NO: 2149173 - DNA, 20 bp, Homo sapiens
ctccagaatgtgctgccttt

SEQ ID NO: 2149174 - DNA, 18 bp, Homo sapiens
ctccagaattacccttcc

SEQ ID NO: 2149175 - DNA, 19 bp, Homo sapiens
ctccagaattacccttcct

SEQ ID NO: 2149176 - DNA, 22 bp, Homo sapiens
ctccagaattacccttcctcat

SEQ ID NO: 2149177 - DNA, 13 bp, Homo sapiens
ctccagccagcaa

SEQ ID NO: 2149178 - DNA, 20 bp, Homo sapiens
ctccagcctcacagatgctg

SEQ ID NO: 2149179 - DNA, 23 bp, Homo sapiens
ctccagcctcacagatgctggcc

SEQ ID NO: 2149180 - DNA, 22 bp, Homo sapiens
ctccagtcatggtactacccca

SEQ ID NO: 2149181 - DNA, 14 bp, Homo sapiens
ctccagtcctgctg

SEQ ID NO: 2149182 - DNA, 19 bp, Homo sapiens
ctccagtcctgctggcctg

SEQ ID NO: 2149183 - DNA, 15 bp, Homo sapiens
ctccatgcaagtgct

SEQ ID NO: 2149184 - DNA, 20 bp, Homo sapiens
ctcccacggggaccactggg

SEQ ID NO: 2149185 - DNA, 11 bp, Homo sapiens
ctcccactcct

SEQ ID NO: 2149186 - DNA, 16 bp, Homo sapiens
ctcccactcctaatca

SEQ ID NO: 2149187 - DNA, 19 bp, Homo sapiens
ctcccagcagccctaagga

SEQ ID NO: 2149188 - DNA, 22 bp, Homo sapiens
ctccccacagtcctcacagcct

SEQ ID NO: 2149189 - DNA, 15 bp, Homo sapiens
ctgcctagctcttgg

SEQ ID NO: 2149190 - DNA, 17 bp, Homo sapiens
ctgcctagctcttgggc

SEQ ID NO: 2149191 - DNA, 13 bp, Homo sapiens
ctgcctcatcctc

SEQ ID NO: 2149192 - DNA, 16 bp, Homo sapiens
ctgcctcatcctcctc

SEQ ID NO: 2149193 - DNA, 20 bp, Homo sapiens
ctgcctcatcctcctcctca

SEQ ID NO: 2149194 - DNA, 21 bp, Homo sapiens
ctgcctcatcctcctcctcat

SEQ ID NO: 2149195 - DNA, 16 bp, Homo sapiens
ctgcctgacactgagc

SEQ ID NO: 2149196 - DNA, 19 bp, Homo sapiens
ctgcctgacactgagcccc

SEQ ID NO: 2149197 - DNA, 20 bp, Homo sapiens
ctgcctgacactgagcccca

SEQ ID NO: 2149198 - DNA, 21 bp, Homo sapiens
ctgcctgacactgagccccac

SEQ ID NO: 2149199 - DNA, 17 bp, Homo sapiens
ctgcctgctgggctctt

SEQ ID NO: 2149200 - DNA, 20 bp, Homo sapiens
ctgcctgctgggctcttaac

SEQ ID NO: 2149201 - DNA, 22 bp, Homo sapiens
cacactcctcctgccagctctg

SEQ ID NO: 2149202 - DNA, 15 bp, Homo sapiens
cacactccttcccct

SEQ ID NO: 2149203 - DNA, 15 bp, Homo sapiens
cacagagggcgctcc

SEQ ID NO: 2149204 - DNA, 16 bp, Homo sapiens
cacagatgctggcctc

SEQ ID NO: 2149205 - DNA, 18 bp, Homo sapiens
cacagatgctggcctctt

SEQ ID NO: 2149206 - DNA, 22 bp, Homo sapiens
cacagatgctggcctcttggca

SEQ ID NO: 2149207 - DNA, 15 bp, Homo sapiens
cacagcctctccctt

SEQ ID NO: 2149208 - DNA, 15 bp, Homo sapiens
cacagctcctcccct

SEQ ID NO: 2149209 - DNA, 16 bp, Homo sapiens
cacagctcctcccctg

SEQ ID NO: 2149210 - DNA, 18 bp, Homo sapiens
cacagctcctcccctgcc

SEQ ID NO: 2149211 - DNA, 21 bp, Homo sapiens
cacagctcctcccctgccgcc

SEQ ID NO: 2149212 - DNA, 22 bp, Homo sapiens
cacagctcctcccctgccgcct

SEQ ID NO: 2149213 - DNA, 16 bp, Homo sapiens
cacaggcagctggatg

SEQ ID NO: 2149214 - DNA, 21 bp, Homo sapiens
cacaggcagctggatgagact

SEQ ID NO: 2149215 - DNA, 22 bp, Homo sapiens
cacaggggcaaagaactgcccc

SEQ ID NO: 2149216 - DNA, 23 bp, Homo sapiens
cacaggggcaaagaactgcccca

SEQ ID NO: 2149217 - DNA, 15 bp, Homo sapiens
cacatatatgtatat

SEQ ID NO: 2149218 - DNA, 12 bp, Homo sapiens
cacatcccaggc

SEQ ID NO: 2149219 - DNA, 23 bp, Homo sapiens
cacatggctgggggagggactgc

SEQ ID NO: 2149220 - DNA, 20 bp, Homo sapiens
cacattttgtacaaagatat

SEQ ID NO: 2149221 - DNA, 17 bp, Homo sapiens
caccaaggtctcacact

SEQ ID NO: 2149222 - DNA, 17 bp, Homo sapiens
caccacccaacctgtcc

SEQ ID NO: 2149223 - DNA, 16 bp, Homo sapiens
caccagagcaggggct

SEQ ID NO: 2149224 - DNA, 18 bp, Homo sapiens
caccagagcaggggctgc

SEQ ID NO: 2149225 - DNA, 21 bp, Homo sapiens
caccagagcaggggctgctgg

SEQ ID NO: 2149226 - DNA, 22 bp, Homo sapiens
caccagagcaggggctgctggg

SEQ ID NO: 2149227 - DNA, 19 bp, Homo sapiens
caccagagctgcctcccca

SEQ ID NO: 2149228 - DNA, 15 bp, Homo sapiens
caccagcccggcctg

SEQ ID NO: 2149229 - DNA, 16 bp, Homo sapiens
caccagcccggcctgc

SEQ ID NO: 2149230 - DNA, 17 bp, Homo sapiens
caccagcccggcctgct

SEQ ID NO: 2149231 - DNA, 22 bp, Homo sapiens
caccagggccagcaggcagcgc

SEQ ID NO: 2149232 - DNA, 11 bp, Homo sapiens
caccatgcaag

SEQ ID NO: 2149233 - DNA, 17 bp, Homo sapiens
cacccaattcaaaacat

SEQ ID NO: 2149234 - DNA, 20 bp, Homo sapiens
cacccaggcaggccctgcct

SEQ ID NO: 2149235 - DNA, 18 bp, Homo sapiens
caccccacaccccagccc

SEQ ID NO: 2149236 - DNA, 20 bp, Homo sapiens
caccccagcacagctcctcc

SEQ ID NO: 2149237 - DNA, 21 bp, Homo sapiens
cacccgttctgctggcctgga

SEQ ID NO: 2149238 - DNA, 18 bp, Homo sapiens
caccctgaatggttccat

SEQ ID NO: 2149239 - DNA, 12 bp, Homo sapiens
caccctgcctgc

SEQ ID NO: 2149240 - DNA, 18 bp, Homo sapiens
caccctgcctgctgtgga

SEQ ID NO: 2149241 - DNA, 22 bp, Homo sapiens
caccctgcctgctgtggagccc

SEQ ID NO: 2149242 - DNA, 15 bp, Homo sapiens
caccgcagctgctgc

SEQ ID NO: 2149243 - DNA, 19 bp, Homo sapiens
caccgcagctgctgccact

SEQ ID NO: 2149244 - DNA, 21 bp, Homo sapiens
caccgcagctgctgccactct

SEQ ID NO: 2149245 - DNA, 14 bp, Homo sapiens
cacctcactcctgt

SEQ ID NO: 2149246 - DNA, 12 bp, Homo sapiens
cacctccccaaa

SEQ ID NO: 2149247 - DNA, 14 bp, Homo sapiens
cacctccccaaagc

SEQ ID NO: 2149248 - DNA, 18 bp, Homo sapiens
cacctgcctagctcttgg

SEQ ID NO: 2149249 - DNA, 13 bp, Homo sapiens
cacctttctagtt

SEQ ID NO: 2149250 - DNA, 20 bp, Homo sapiens
cacggctgcctgacactgag

SEQ ID NO: 2149251 - DNA, 23 bp, Homo sapiens
cacggctgcctgacactgagccc

SEQ ID NO: 2149252 - DNA, 22 bp, Homo sapiens
cacggggaccactgggcccctc

SEQ ID NO: 2149253 - DNA, 21 bp, Homo sapiens
cacgtaccaagccaccgcagc

SEQ ID NO: 2149254 - DNA, 11 bp, Homo sapiens
cacgtctctct

SEQ ID NO: 2149255 - DNA, 20 bp, Homo sapiens
cacgtctctctgcctgctgg

SEQ ID NO: 2149256 - DNA, 22 bp, Homo sapiens
cactaagttatagtatatctgg

SEQ ID NO: 2149257 - DNA, 19 bp, Homo sapiens
cactcaaattaatctttct

SEQ ID NO: 2149258 - DNA, 16 bp, Homo sapiens
cactcctaatcaagag

SEQ ID NO: 2149259 - DNA, 14 bp, Homo sapiens
cactcctcctgcca

SEQ ID NO: 2149260 - DNA, 16 bp, Homo sapiens
cactcctcctgccagc

SEQ ID NO: 2149261 - DNA, 17 bp, Homo sapiens
cactcctcctgccagct

SEQ ID NO: 2149262 - DNA, 13 bp, Homo sapiens
cactccttcccct

SEQ ID NO: 2149263 - DNA, 21 bp, Homo sapiens
cactccttccccttgtccctg

SEQ ID NO: 2149264 - DNA, 14 bp, Homo sapiens
cactctgctgcctg

SEQ ID NO: 2149265 - DNA, 20 bp, Homo sapiens
cactctgctgcctgtacaga

SEQ ID NO: 2149266 - DNA, 14 bp, Homo sapiens
cactgagccccacc

SEQ ID NO: 2149267 - DNA, 10 bp, Homo sapiens
cactgagggc

SEQ ID NO: 2149268 - DNA, 14 bp, Homo sapiens
cactgagggccaca

SEQ ID NO: 2149269 - DNA, 17 bp, Homo sapiens
cactggagtgcagggag

SEQ ID NO: 2149270 - DNA, 11 bp, Homo sapiens
cactgggcccc

SEQ ID NO: 2149271 - DNA, 13 bp, Homo sapiens
cactgggcccctc

SEQ ID NO: 2149272 - DNA, 15 bp, Homo sapiens
cactgggcccctcag

SEQ ID NO: 2149273 - DNA, 17 bp, Homo sapiens
cactgggcccctcaggg

SEQ ID NO: 2149274 - DNA, 23 bp, Homo sapiens
cacttgccacatggtgtctccca

SEQ ID NO: 2149275 - DNA, 17 bp, Homo sapiens
cacttttaatgaacaaa

SEQ ID NO: 2149276 - DNA, 16 bp, Homo sapiens
cagaactgctggggct

SEQ ID NO: 2149277 - DNA, 15 bp, Homo sapiens
cagaagaatattcag

SEQ ID NO: 2149278 - DNA, 16 bp, Homo sapiens
cagaagaatattcagg

SEQ ID NO: 2149279 - DNA, 19 bp, Homo sapiens
cagaagaatattcaggact

SEQ ID NO: 2149280 - DNA, 15 bp, Homo sapiens
cagaagtaactccca

SEQ ID NO: 2149281 - DNA, 16 bp, Homo sapiens
cagaagtaactcccac

SEQ ID NO: 2149282 - DNA, 13 bp, Homo sapiens
cagaatcctgggc

SEQ ID NO: 2149283 - DNA, 15 bp, Homo sapiens
cagaatgtgctgcct

SEQ ID NO: 2149284 - DNA, 18 bp, Homo sapiens
cagaattacccttcctca

SEQ ID NO: 2149285 - DNA, 21 bp, Homo sapiens
cagaattacccttcctcatct

SEQ ID NO: 2149286 - DNA, 11 bp, Homo sapiens
cagacactaag

SEQ ID NO: 2149287 - DNA, 12 bp, Homo sapiens
cagacactaagt

SEQ ID NO: 2149288 - DNA, 12 bp, Homo sapiens
aaaaacactagt

SEQ ID NO: 2149289 - DNA, 18 bp, Homo sapiens
aaaaagattatatatcat

SEQ ID NO: 2149290 - DNA, 16 bp, Homo sapiens
aaaaatgatttcagta

SEQ ID NO: 2149291 - DNA, 20 bp, Homo sapiens
aaaaatgatttcagtagcac

SEQ ID NO: 2149292 - DNA, 14 bp, Homo sapiens
aaaacactagtttt

SEQ ID NO: 2149293 - DNA, 15 bp, Homo sapiens
aaaagattatatatc

SEQ ID NO: 2149294 - DNA, 16 bp, Homo sapiens
aaaagttaaactactt

SEQ ID NO: 2149295 - DNA, 12 bp, Homo sapiens
aaacagatataa

SEQ ID NO: 2149296 - DNA, 12 bp, Homo sapiens
aaacccctggct

SEQ ID NO: 2149297 - DNA, 18 bp, Homo sapiens
aaacctgtccataaagta

SEQ ID NO: 2149298 - DNA, 13 bp, Homo sapiens
aaagaactgcccc

SEQ ID NO: 2149299 - DNA, 15 bp, Homo sapiens
aaagacttcatgttc

SEQ ID NO: 2149300 - DNA, 21 bp, Homo sapiens
aaagattatatatcataaagt

SEQ ID NO: 2149301 - DNA, 14 bp, Homo sapiens
aaagcaagactgtt

SEQ ID NO: 2149302 - DNA, 14 bp, Homo sapiens
aaaggtcctgccct

SEQ ID NO: 2149303 - DNA, 16 bp, Homo sapiens
aaagtgtagcaccctg

SEQ ID NO: 2149304 - DNA, 20 bp, Homo sapiens
aaagttaaactacttgtaaa

SEQ ID NO: 2149305 - DNA, 22 bp, Homo sapiens
aaatacaccacctcactcctgt

SEQ ID NO: 2149306 - DNA, 23 bp, Homo sapiens
aaatacaccacctcactcctgtt

SEQ ID NO: 2149307 - DNA, 22 bp, Homo sapiens
aaatacagacactaagttatag

SEQ ID NO: 2149308 - DNA, 19 bp, Homo sapiens
aaatctattcagacaagca

SEQ ID NO: 2149309 - DNA, 20 bp, Homo sapiens
tgattgtttgcacagagggc

SEQ ID NO: 2149310 - DNA, 16 bp, Homo sapiens
tgcaaactcactgctc

SEQ ID NO: 2149311 - DNA, 11 bp, Homo sapiens
tgcaaccactg

SEQ ID NO: 2149312 - DNA, 15 bp, Homo sapiens
tgcaaccactgcaac

SEQ ID NO: 2149313 - DNA, 16 bp, Homo sapiens
tgcaacggcttagact

SEQ ID NO: 2149314 - DNA, 14 bp, Homo sapiens
tgcaatagtcagag

SEQ ID NO: 2149315 - DNA, 18 bp, Homo sapiens
tgcacagagggcgctcct

SEQ ID NO: 2149316 - DNA, 23 bp, Homo sapiens
tgcacattttgtacaaagatatg

SEQ ID NO: 2149317 - DNA, 22 bp, Homo sapiens
tgcaccagcccttccctgcttt

SEQ ID NO: 2149318 - DNA, 23 bp, Homo sapiens
tgcaccagcccttccctgctttg

SEQ ID NO: 2149319 - DNA, 18 bp, Homo sapiens
tgcacctttctagttgaa

SEQ ID NO: 2149320 - DNA, 15 bp, Homo sapiens
tgcactgagggccac

SEQ ID NO: 2149321 - DNA, 16 bp, Homo sapiens
tgcattagacagatga

SEQ ID NO: 2149322 - DNA, 19 bp, Homo sapiens
tgccacatggtgtctccca

SEQ ID NO: 2149323 - DNA, 13 bp, Homo sapiens
tgccactctgctg

SEQ ID NO: 2149324 - DNA, 14 bp, Homo sapiens
tgccactctgctgc

SEQ ID NO: 2149325 - DNA, 16 bp, Homo sapiens
tgccactctgctgcct

SEQ ID NO: 2149326 - DNA, 18 bp, Homo sapiens
tgccactctgctgcctgt

SEQ ID NO: 2149327 - DNA, 19 bp, Homo sapiens
tgccagccgtgatgctcag

SEQ ID NO: 2149328 - DNA, 20 bp, Homo sapiens
tgccagctctgtcaccctgg

SEQ ID NO: 2149329 - DNA, 11 bp, Homo sapiens
tgccattccca

SEQ ID NO: 2149330 - DNA, 22 bp, Homo sapiens
tgcccaagggcctcccaccaga

SEQ ID NO: 2149331 - DNA, 16 bp, Homo sapiens
tgcccacatcccaggc

SEQ ID NO: 2149332 - DNA, 22 bp, Homo sapiens
tgccccatctcctcccatggcc

SEQ ID NO: 2149333 - DNA, 17 bp, Homo sapiens
tgcccctccccagccct

SEQ ID NO: 2149334 - DNA, 12 bp, Homo sapiens
tgcccctccccc

SEQ ID NO: 2149335 - DNA, 17 bp, Homo sapiens
tgcccctccccctaccg

SEQ ID NO: 2149336 - DNA, 18 bp, Homo sapiens
tgccctgtccctgtcccc

SEQ ID NO: 2149337 - DNA, 20 bp, Homo sapiens
tgccctgttgtgtatagatg

SEQ ID NO: 2149338 - DNA, 14 bp, Homo sapiens
tgcccttcctgacc

SEQ ID NO: 2149339 - DNA, 14 bp, Homo sapiens
tgcctagctcttgg

SEQ ID NO: 2149340 - DNA, 16 bp, Homo sapiens
tgcctcatcctcctcc

SEQ ID NO: 2149341 - DNA, 17 bp, Homo sapiens
tgcctcatcctcctcct

SEQ ID NO: 2149342 - DNA, 20 bp, Homo sapiens
tgcctcatcctcctcctcat

SEQ ID NO: 2149343 - DNA, 13 bp, Homo sapiens
tgcctccccaatc

SEQ ID NO: 2149344 - DNA, 22 bp, Homo sapiens
tgcctctaactccctcctcaca

SEQ ID NO: 2149345 - DNA, 16 bp, Homo sapiens
tgcctgaactccagag

SEQ ID NO: 2149346 - DNA, 17 bp, Homo sapiens
tgcctgacactgagccc

SEQ ID NO: 2149347 - DNA, 18 bp, Homo sapiens
tgcctgagggtggagact

SEQ ID NO: 2149348 - DNA, 11 bp, Homo sapiens
tgcctgctggg

SEQ ID NO: 2149349 - DNA, 12 bp, Homo sapiens
tgcctgctgggc

SEQ ID NO: 2149350 - DNA, 13 bp, Homo sapiens
tgcctgctgggct

SEQ ID NO: 2149351 - DNA, 20 bp, Homo sapiens
tgcctgtagccccagtgaca

SEQ ID NO: 2149352 - DNA, 21 bp, Homo sapiens
tgcctgtagccccagtgacag

SEQ ID NO: 2149353 - DNA, 14 bp, Homo sapiens
tgcctgtctgtcca

SEQ ID NO: 2149354 - DNA, 15 bp, Homo sapiens
tgcctgtctgtccaa

SEQ ID NO: 2149355 - DNA, 20 bp, Homo sapiens
tgcctgtctgtccaacccct

SEQ ID NO: 2149356 - DNA, 21 bp, Homo sapiens
tgcctgtctgtccaacccctc

SEQ ID NO: 2149357 - DNA, 20 bp, Homo sapiens
tctaaccaaagagtctctgg

SEQ ID NO: 2149358 - DNA, 22 bp, Homo sapiens
tctaaccaaagagtctctggct

SEQ ID NO: 2149359 - DNA, 16 bp, Homo sapiens
tctaagttaatttaaa

SEQ ID NO: 2149360 - DNA, 18 bp, Homo sapiens
tctaagttaatttaaagt

SEQ ID NO: 2149361 - DNA, 20 bp, Homo sapiens
tctaagttaatttaaagttg

SEQ ID NO: 2149362 - DNA, 21 bp, Homo sapiens
tctaagttaatttaaagttgt

SEQ ID NO: 2149363 - DNA, 21 bp, Homo sapiens
tctacacatatatgtatatgt

SEQ ID NO: 2149364 - DNA, 19 bp, Homo sapiens
tctatcaaccccagacact

SEQ ID NO: 2149365 - DNA, 16 bp, Homo sapiens
tctcacactcctcctg

SEQ ID NO: 2149366 - DNA, 18 bp, Homo sapiens
tctcacactcctcctgcc

SEQ ID NO: 2149367 - DNA, 20 bp, Homo sapiens
tctcacactcctcctgccag

SEQ ID NO: 2149368 - DNA, 14 bp, Homo sapiens
tctcaggagcacag

SEQ ID NO: 2149369 - DNA, 15 bp, Homo sapiens
tctcatcagtgtcct

SEQ ID NO: 2149370 - DNA, 13 bp, Homo sapiens
tctccagccagca

SEQ ID NO: 2149371 - DNA, 15 bp, Homo sapiens
tctccagccagcaat

SEQ ID NO: 2149372 - DNA, 13 bp, Homo sapiens
tctccatgcaagt

SEQ ID NO: 2149373 - DNA, 13 bp, Homo sapiens
tctcccaacatgg

SEQ ID NO: 2149374 - DNA, 18 bp, Homo sapiens
tctcccaacatgggaggg

SEQ ID NO: 2149375 - DNA, 12 bp, Homo sapiens
tctcccagcaca

SEQ ID NO: 2149376 - DNA, 19 bp, Homo sapiens
tctctcaggagcacaggca

SEQ ID NO: 2149377 - DNA, 17 bp, Homo sapiens
tctctccagcctcacag

SEQ ID NO: 2149378 - DNA, 18 bp, Homo sapiens
tctctccagcctcacaga

SEQ ID NO: 2149379 - DNA, 20 bp, Homo sapiens
tctctccagcctcacagatg

SEQ ID NO: 2149380 - DNA, 13 bp, Homo sapiens
tctctctgcctgc

SEQ ID NO: 2149381 - DNA, 20 bp, Homo sapiens
tctctctgtgaatacaatta

SEQ ID NO: 2149382 - DNA, 23 bp, Homo sapiens
tctctctgtgaatacaattaaag

SEQ ID NO: 2149383 - DNA, 17 bp, Homo sapiens
tctctgagatgcccctc

SEQ ID NO: 2149384 - DNA, 16 bp, Homo sapiens
tctctgagtgtctctg

SEQ ID NO: 2149385 - DNA, 20 bp, Homo sapiens
tctctgagtgtctctgcctg

SEQ ID NO: 2149386 - DNA, 16 bp, Homo sapiens
tctctgcctgctgggc

SEQ ID NO: 2149387 - DNA, 17 bp, Homo sapiens
tctctgcctgctgggct

SEQ ID NO: 2149388 - DNA, 15 bp, Homo sapiens
tctctgcctggagca

SEQ ID NO: 2149389 - DNA, 18 bp, Homo sapiens
tctctgcctggagcaggg

SEQ ID NO: 2149390 - DNA, 14 bp, Homo sapiens
tctctgtgaataca

SEQ ID NO: 2149391 - DNA, 22 bp, Homo sapiens
tctctgtgaatacaattaaagg

SEQ ID NO: 2149392 - DNA, 14 bp, Homo sapiens
tctgagaagtgtat

SEQ ID NO: 2149393 - DNA, 17 bp, Homo sapiens
tctgaggccccaggccc

SEQ ID NO: 2149394 - DNA, 16 bp, Homo sapiens
tctgagtgtctctgcc

SEQ ID NO: 2149395 - DNA, 21 bp, Homo sapiens
tctgagtgtctctgcctggag

SEQ ID NO: 2149396 - DNA, 19 bp, Homo sapiens
tctgattcgaatgacactg

SEQ ID NO: 2149397 - DNA, 16 bp, Homo sapiens
tctgcctcatcctcct

SEQ ID NO: 2149398 - DNA, 21 bp, Homo sapiens
tctgcctcatcctcctcctca

SEQ ID NO: 2149399 - DNA, 18 bp, Homo sapiens
tctgcctctaactccctc

SEQ ID NO: 2149400 - DNA, 21 bp, Homo sapiens
tctgcctctaactccctcctc

SEQ ID NO: 2149401 - DNA, 13 bp, Homo sapiens
tctgcctgctggg

SEQ ID NO: 2149402 - DNA, 14 bp, Homo sapiens
tctgcctgctgggc

SEQ ID NO: 2149403 - DNA, 17 bp, Homo sapiens
tctgcctgctgggctct

SEQ ID NO: 2149404 - DNA, 18 bp, Homo sapiens
tctgctcagatagaatga

SEQ ID NO: 2149405 - DNA, 21 bp, Homo sapiens
tctggacaagccaacttgtaa

SEQ ID NO: 2149406 - DNA, 15 bp, Homo sapiens
tctgtagggctggac

SEQ ID NO: 2149407 - DNA, 15 bp, Homo sapiens
tctgtcaccctggcc

SEQ ID NO: 2149408 - DNA, 17 bp, Homo sapiens
tctgtcaccctggccac

SEQ ID NO: 2149409 - DNA, 19 bp, Homo sapiens
tctgtcaccctggccacca

SEQ ID NO: 2149410 - DNA, 17 bp, Homo sapiens
tctgtccaacccctccc

SEQ ID NO: 2149411 - DNA, 19 bp, Homo sapiens
tctgtccaacccctccccc

SEQ ID NO: 2149412 - DNA, 15 bp, Homo sapiens
tctgtccagtttcca

SEQ ID NO: 2149413 - DNA, 14 bp, Homo sapiens
tctgtccatcctcc

SEQ ID NO: 2149414 - DNA, 22 bp, Homo sapiens
tctgtccatcctcctctccatg

SEQ ID NO: 2149415 - DNA, 24 bp, Homo sapiens
tctgtccatcctcctctccatgca

SEQ ID NO: 2149416 - DNA, 13 bp, Homo sapiens
tctgtgaatacaa

SEQ ID NO: 2149417 - DNA, 15 bp, Homo sapiens
tgtcctaaggacaca

SEQ ID NO: 2149418 - DNA, 15 bp, Homo sapiens
tgtcctcttgctcaa

SEQ ID NO: 2149419 - DNA, 13 bp, Homo sapiens
tgtcgagacactt

SEQ ID NO: 2149420 - DNA, 18 bp, Homo sapiens
tgtcgattagactggaca

SEQ ID NO: 2149421 - DNA, 16 bp, Homo sapiens
tgtctcccaacatggg

SEQ ID NO: 2149422 - DNA, 14 bp, Homo sapiens
tgtctctgcctgga

SEQ ID NO: 2149423 - DNA, 14 bp, Homo sapiens
tgtctgtccaaccc

SEQ ID NO: 2149424 - DNA, 21 bp, Homo sapiens
tgtctgtccaacccctccccc

SEQ ID NO: 2149425 - DNA, 22 bp, Homo sapiens
tgtcttcctagtatattagttt

SEQ ID NO: 2149426 - DNA, 19 bp, Homo sapiens
tgtgaaattcaacctgtgt

SEQ ID NO: 2149427 - DNA, 19 bp, Homo sapiens
tgtgaatacaattaaaggt

SEQ ID NO: 2149428 - DNA, 20 bp, Homo sapiens
tgtgaatacaattaaaggtc

SEQ ID NO: 2149429 - DNA, 18 bp, Homo sapiens
tgtgaccaaaagttacat

SEQ ID NO: 2149430 - DNA, 18 bp, Homo sapiens
tgtgcaatagtcagagtg

SEQ ID NO: 2149431 - DNA, 21 bp, Homo sapiens
tgtgccatgtcaaacaaatag

SEQ ID NO: 2149432 - DNA, 16 bp, Homo sapiens
tgtgcctgtctgtcca

SEQ ID NO: 2149433 - DNA, 16 bp, Homo sapiens
tgtgctcccacgggga

SEQ ID NO: 2149434 - DNA, 18 bp, Homo sapiens
tgtgtaccacaccctgcc

SEQ ID NO: 2149435 - DNA, 19 bp, Homo sapiens
tgtgtaccacaccctgcct

SEQ ID NO: 2149436 - DNA, 23 bp, Homo sapiens
tgtgtaccacaccctgcctgctg

SEQ ID NO: 2149437 - DNA, 21 bp, Homo sapiens
tgtgtatatatatatatatgt

SEQ ID NO: 2149438 - DNA, 21 bp, Homo sapiens
tgtgtgtaccacaccctgcct

SEQ ID NO: 2149439 - DNA, 24 bp, Homo sapiens
tgtgtgtaccacaccctgcctgct

SEQ ID NO: 2149440 - DNA, 20 bp, Homo sapiens
tgttaagacttgacagtgga

SEQ ID NO: 2149441 - DNA, 18 bp, Homo sapiens
tgttaattgattaaaatc

SEQ ID NO: 2149442 - DNA, 20 bp, Homo sapiens
tgttattttttatttccaca

SEQ ID NO: 2149443 - DNA, 19 bp, Homo sapiens
tgttcaaaaaaacactagt

SEQ ID NO: 2149444 - DNA, 14 bp, Homo sapiens
tgttcacactccta

SEQ ID NO: 2149445 - DNA, 17 bp, Homo sapiens
tgttgatttgagaaatt

SEQ ID NO: 2149446 - DNA, 17 bp, Homo sapiens
tgttgctcgaagactgt

SEQ ID NO: 2149447 - DNA, 14 bp, Homo sapiens
tgtttgcacagagg

SEQ ID NO: 2149448 - DNA, 20 bp, Homo sapiens
tgtttgcacctttctagttg

SEQ ID NO: 2149449 - DNA, 15 bp, Homo sapiens
tgtttgttcacactc

SEQ ID NO: 2149450 - DNA, 16 bp, Homo sapiens
tgtttgttcacactcc

SEQ ID NO: 2149451 - DNA, 17 bp, Homo sapiens
ttaaaggtcctgccctc

SEQ ID NO: 2149452 - DNA, 15 bp, Homo sapiens
ttaaagttgtttgtg

SEQ ID NO: 2149453 - DNA, 16 bp, Homo sapiens
ttaaatacagacacta

SEQ ID NO: 2149454 - DNA, 19 bp, Homo sapiens
ttaaatacagacactaagt

SEQ ID NO: 2149455 - DNA, 18 bp, Homo sapiens
ttaaatctgtttttctaa

SEQ ID NO: 2149456 - DNA, 17 bp, Homo sapiens
ttaacggctccaggatt

SEQ ID NO: 2149457 - DNA, 19 bp, Homo sapiens
ttaacggctccaggatttt

SEQ ID NO: 2149458 - DNA, 17 bp, Homo sapiens
ttaactcattagactgg

SEQ ID NO: 2149459 - DNA, 13 bp, Homo sapiens
ttaagtcagaaca

SEQ ID NO: 2149460 - DNA, 17 bp, Homo sapiens
ttaatatctgagaagtg

SEQ ID NO: 2149461 - DNA, 21 bp, Homo sapiens
ttaatctttctttacctgaga

SEQ ID NO: 2149462 - DNA, 23 bp, Homo sapiens
ttaatctttctttacctgagacc

SEQ ID NO: 2149463 - DNA, 14 bp, Homo sapiens
ttacatgtttgcac

SEQ ID NO: 2149464 - DNA, 11 bp, Homo sapiens
ttaccatgaga

SEQ ID NO: 2149465 - DNA, 21 bp, Homo sapiens
ttacctaaacagatataaatg

SEQ ID NO: 2149466 - DNA, 19 bp, Homo sapiens
ttactcagagctgcgggct

SEQ ID NO: 2149467 - DNA, 15 bp, Homo sapiens
ttactgacagaaatg

SEQ ID NO: 2149468 - DNA, 21 bp, Homo sapiens
ttataatttttttattactga

SEQ ID NO: 2149469 - DNA, 20 bp, Homo sapiens
ttatacgagtaatatgcctg

SEQ ID NO: 2149470 - DNA, 15 bp, Homo sapiens
ttatagtatatctgg

SEQ ID NO: 2149471 - DNA, 17 bp, Homo sapiens
ttatatatcataaagta

SEQ ID NO: 2149472 - DNA, 20 bp, Homo sapiens
ttatatatcataaagtatgc

SEQ ID NO: 2149473 - DNA, 21 bp, Homo sapiens
ttatctaagttaatttaaagt

SEQ ID NO: 2149474 - DNA, 17 bp, Homo sapiens
ttatttccacataaagg

SEQ ID NO: 2149475 - DNA, 13 bp, Homo sapiens
ttatttgtataat

SEQ ID NO: 2149476 - DNA, 18 bp, Homo sapiens
ttcaaaacattgtgccat

SEQ ID NO: 2149477 - DNA, 16 bp, Homo sapiens
ttcaaagcatgaaatg

SEQ ID NO: 2149478 - DNA, 16 bp, Homo sapiens
ttcaacctgtgtctta

SEQ ID NO: 2149479 - DNA, 10 bp, Homo sapiens
ttcacactcc

SEQ ID NO: 2149480 - DNA, 21 bp, Homo sapiens
ttccaaagggcagtaaagttt

SEQ ID NO: 2149481 - DNA, 13 bp, Homo sapiens
ttccatgcctgag

SEQ ID NO: 2149482 - DNA, 21 bp, Homo sapiens
ttcccacccaattcaaaacat

SEQ ID NO: 2149483 - DNA, 21 bp, Homo sapiens
ttcccactaagctttctcctt

SEQ ID NO: 2149484 - DNA, 15 bp, Homo sapiens
ttcccccatccctac

SEQ ID NO: 2149485 - DNA, 17 bp, Homo sapiens
ttcccccatccctacca

SEQ ID NO: 2149486 - DNA, 17 bp, Homo sapiens
ttccccttgtccctggg

SEQ ID NO: 2149487 - DNA, 16 bp, Homo sapiens
ttcctcccccagagcc

SEQ ID NO: 2149488 - DNA, 23 bp, Homo sapiens
ttcctgacccggattggccctgc

SEQ ID NO: 2149489 - DNA, 19 bp, Homo sapiens
ttccttaagtcagaacagc

SEQ ID NO: 2149490 - DNA, 20 bp, Homo sapiens
ttccttaagtcagaacagca

SEQ ID NO: 2149491 - DNA, 22 bp, Homo sapiens
ttctaaccaaagagtctctggc

SEQ ID NO: 2149492 - DNA, 23 bp, Homo sapiens
ttctaaccaaagagtctctggct

SEQ ID NO: 2149493 - DNA, 17 bp, Homo sapiens
ttctacacatatatgta

SEQ ID NO: 2149494 - DNA, 14 bp, Homo sapiens
ttctaggtaggaaa

SEQ ID NO: 2149495 - DNA, 21 bp, Homo sapiens
ttctagtctcctttgcactga

SEQ ID NO: 2149496 - DNA, 22 bp, Homo sapiens
ttctagtctcctttgcactgag

SEQ ID NO: 2149497 - DNA, 17 bp, Homo sapiens
ttctatcacatatttga

SEQ ID NO: 2149498 - DNA, 13 bp, Homo sapiens
ttctcctttttct

SEQ ID NO: 2149499 - DNA, 14 bp, Homo sapiens
ttctgctggcctgg

SEQ ID NO: 2149500 - DNA, 18 bp, Homo sapiens
ttctgctggcctggatct

SEQ ID NO: 2149501 - DNA, 14 bp, Homo sapiens
ttcttcacccagct

SEQ ID NO: 2149502 - DNA, 13 bp, Homo sapiens
ttgaactgattca

SEQ ID NO: 2149503 - DNA, 23 bp, Homo sapiens
ttgaagaatgttaagacttgaca

SEQ ID NO: 2149504 - DNA, 13 bp, Homo sapiens
ttgagagtgtgac

SEQ ID NO: 2149505 - DNA, 14 bp, Homo sapiens
ttgagtaggccctg

SEQ ID NO: 2149506 - DNA, 15 bp, Homo sapiens
ttgagtaggccctgc

SEQ ID NO: 2149507 - DNA, 14 bp, Homo sapiens
ttgatttaatatct

SEQ ID NO: 2149508 - DNA, 16 bp, Homo sapiens
ttgcactgagggccac

SEQ ID NO: 2149509 - DNA, 17 bp, Homo sapiens
ttgcaggcccagcagac

SEQ ID NO: 2149510 - DNA, 17 bp, Homo sapiens
ttgcaggggactgggcc

SEQ ID NO: 2149511 - DNA, 15 bp, Homo sapiens
ttgcccttcctgacc

SEQ ID NO: 2149512 - DNA, 15 bp, Homo sapiens
ttgcctgaactccag

SEQ ID NO: 2149513 - DNA, 16 bp, Homo sapiens
ttgcctgaactccaga

SEQ ID NO: 2149514 - DNA, 19 bp, Homo sapiens
ttgcctgtaacaagccaga

SEQ ID NO: 2149515 - DNA, 20 bp, Homo sapiens
ttggatgggagtgagacaga

SEQ ID NO: 2149516 - DNA, 21 bp, Homo sapiens
ttggatgggagtgagacagaa

SEQ ID NO: 2149517 - DNA, 23 bp, Homo sapiens
ttggcacctgcctagctcttggg

SEQ ID NO: 2149518 - DNA, 16 bp, Homo sapiens
ttggcccctggaacct

SEQ ID NO: 2149519 - DNA, 19 bp, Homo sapiens
ttggccctgcccctccccc

SEQ ID NO: 2149520 - DNA, 19 bp, Homo sapiens
ttgggcagaatcctgggcc

SEQ ID NO: 2149521 - DNA, 13 bp, Homo sapiens
ttgggggaatgca

SEQ ID NO: 2149522 - DNA, 12 bp, Homo sapiens
ttggttgtcaat

SEQ ID NO: 2149523 - DNA, 18 bp, Homo sapiens
ttggttgtcaatattaaa

SEQ ID NO: 2149524 - DNA, 15 bp, Homo sapiens
ttgtcacttgccaca

SEQ ID NO: 2149525 - DNA, 19 bp, Homo sapiens
ttgtccctggggcactccc

SEQ ID NO: 2149526 - DNA, 13 bp, Homo sapiens
ttgtgaaagaagg

SEQ ID NO: 2149527 - DNA, 22 bp, Homo sapiens
agctgctgccactctgctgcct

SEQ ID NO: 2149528 - DNA, 20 bp, Homo sapiens
agctgggcccacagccccca

SEQ ID NO: 2149529 - DNA, 21 bp, Homo sapiens
agctgggcccacagcccccac

SEQ ID NO: 2149530 - DNA, 22 bp, Homo sapiens
agctgggcccacagcccccacc

SEQ ID NO: 2149531 - DNA, 17 bp, Homo sapiens
agctgtggtcccaccca

SEQ ID NO: 2149532 - DNA, 19 bp, Homo sapiens
agctgtggtcccacccagg

SEQ ID NO: 2149533 - DNA, 22 bp, Homo sapiens
agctgtggtcccacccaggaag

SEQ ID NO: 2149534 - DNA, 18 bp, Homo sapiens
agcttctatcccaggagg

SEQ ID NO: 2149535 - DNA, 17 bp, Homo sapiens
agcttgtggcaagtgaa

SEQ ID NO: 2149536 - DNA, 18 bp, Homo sapiens
agcttgtggcaagtgaat

SEQ ID NO: 2149537 - DNA, 12 bp, Homo sapiens
agctttctcctt

SEQ ID NO: 2149538 - DNA, 13 bp, Homo sapiens
agctttctccttt

SEQ ID NO: 2149539 - DNA, 13 bp, Homo sapiens
agctttgtcactt

SEQ ID NO: 2149540 - DNA, 16 bp, Homo sapiens
agctttgtcacttgcc

SEQ ID NO: 2149541 - DNA, 21 bp, Homo sapiens
aggaaaattttagcgtgctca

SEQ ID NO: 2149542 - DNA, 18 bp, Homo sapiens
aggaagggagggagctga

SEQ ID NO: 2149543 - DNA, 14 bp, Homo sapiens
aggacaacctgccc

SEQ ID NO: 2149544 - DNA, 21 bp, Homo sapiens
aggacaacctgcccctcccca

SEQ ID NO: 2149545 - DNA, 19 bp, Homo sapiens
aggactggccgtggctcca

SEQ ID NO: 2149546 - DNA, 18 bp, Homo sapiens
aggacttaacggctccag

SEQ ID NO: 2149547 - DNA, 18 bp, Homo sapiens
aggagaggggaagggcca

SEQ ID NO: 2149548 - DNA, 19 bp, Homo sapiens
aggagtcaccatgcaaggg

SEQ ID NO: 2149549 - DNA, 16 bp, Homo sapiens
aggatcccctgtcccc

SEQ ID NO: 2149550 - DNA, 20 bp, Homo sapiens
aggatcccctgtcccctggg

SEQ ID NO: 2149551 - DNA, 19 bp, Homo sapiens
aggatctctcaggagcaca

SEQ ID NO: 2149552 - DNA, 15 bp, Homo sapiens
aggattcctccccca

SEQ ID NO: 2149553 - DNA, 19 bp, Homo sapiens
aggattttaacaaaagcaa

SEQ ID NO: 2149554 - DNA, 23 bp, Homo sapiens
aggattttaacaaaagcaagact

SEQ ID NO: 2149555 - DNA, 16 bp, Homo sapiens
aggcacatggctgggg

SEQ ID NO: 2149556 - DNA, 15 bp, Homo sapiens
aggcagcgcctgtcc

SEQ ID NO: 2149557 - DNA, 18 bp, Homo sapiens
aggcagctggatgagact

SEQ ID NO: 2149558 - DNA, 22 bp, Homo sapiens
aggcagctggatgagacttcca

SEQ ID NO: 2149559 - DNA, 21 bp, Homo sapiens
aggcagtgaacacactcagca

SEQ ID NO: 2149560 - DNA, 22 bp, Homo sapiens
aggccctaggattcctccccca

SEQ ID NO: 2149561 - DNA, 16 bp, Homo sapiens
aggccctgccttcagc

SEQ ID NO: 2149562 - DNA, 14 bp, Homo sapiens
aggccggccctgcc

SEQ ID NO: 2149563 - DNA, 16 bp, Homo sapiens
aggccggccctgcccc

SEQ ID NO: 2149564 - DNA, 22 bp, Homo sapiens
aggccggccctgcccctcccta

SEQ ID NO: 2149565 - DNA, 22 bp, Homo sapiens
aggcctcccttgagtaggccct

SEQ ID NO: 2149566 - DNA, 11 bp, Homo sapiens
aggcctctggt

SEQ ID NO: 2149567 - DNA, 21 bp, Homo sapiens
aggcctctggttgcctccccc

SEQ ID NO: 2149568 - DNA, 14 bp, Homo sapiens
aggctccattagga

SEQ ID NO: 2149569 - DNA, 14 bp, Homo sapiens
aggctcctccctct

SEQ ID NO: 2149570 - DNA, 15 bp, Homo sapiens
aggctcctccctctg

SEQ ID NO: 2149571 - DNA, 16 bp, Homo sapiens
aggctcctccctctgc

SEQ ID NO: 2149572 - DNA, 18 bp, Homo sapiens
aggctcctccctctgcct

SEQ ID NO: 2149573 - DNA, 19 bp, Homo sapiens
aggctcctccctctgcctc

SEQ ID NO: 2149574 - DNA, 23 bp, Homo sapiens
aggctcctccctctgcctcatcc

SEQ ID NO: 2149575 - DNA, 12 bp, Homo sapiens
aggcttcaccct

SEQ ID NO: 2149576 - DNA, 14 bp, Homo sapiens
aggcttctcccgga

SEQ ID NO: 2149577 - DNA, 15 bp, Homo sapiens
agggactgctgaccc

SEQ ID NO: 2149578 - DNA, 18 bp, Homo sapiens
agggactgctgacccacc

SEQ ID NO: 2149579 - DNA, 14 bp, Homo sapiens
agggagctgaggcc

SEQ ID NO: 2149580 - DNA, 21 bp, Homo sapiens
agggagctgaggcctcccttg

SEQ ID NO: 2149581 - DNA, 13 bp, Homo sapiens
agggagggagctg

SEQ ID NO: 2149582 - DNA, 14 bp, Homo sapiens
agggagggagctga

SEQ ID NO: 2149583 - DNA, 16 bp, Homo sapiens
agggcatctctgagtg

SEQ ID NO: 2149584 - DNA, 17 bp, Homo sapiens
agggccagcaggcagcg

SEQ ID NO: 2149585 - DNA, 20 bp, Homo sapiens
agggcctcggaggctcctcc

SEQ ID NO: 2149586 - DNA, 13 bp, Homo sapiens
agggctggaccta

SEQ ID NO: 2149587 - DNA, 14 bp, Homo sapiens
aggggaagctgcta

SEQ ID NO: 2149588 - DNA, 15 bp, Homo sapiens
aggggactgggccat

SEQ ID NO: 2149589 - DNA, 23 bp, Homo sapiens
aggggcgggctcagagctttgtc

SEQ ID NO: 2149590 - DNA, 13 bp, Homo sapiens
aggggctgctggg

SEQ ID NO: 2149591 - DNA, 20 bp, Homo sapiens
aggggctgctgggggctccc

SEQ ID NO: 2149592 - DNA, 23 bp, Homo sapiens
aggggctgctgggggctcccctt

SEQ ID NO: 2149593 - DNA, 23 bp, Homo sapiens
aggggtggtttctacggtgacag

SEQ ID NO: 2149594 - DNA, 21 bp, Homo sapiens
agggtggagactaagccctgt

SEQ ID NO: 2149595 - DNA, 22 bp, Homo sapiens
aggtctcacactcctcctgcca

SEQ ID NO: 2149596 - DNA, 23 bp, Homo sapiens
aggtgtggctttaggagcagtgg

SEQ ID NO: 2149597 - DNA, 21 bp, Homo sapiens
aggtttggatgggagtgagac

SEQ ID NO: 2149598 - DNA, 19 bp, Homo sapiens
agtaactcccactcctaat

SEQ ID NO: 2149599 - DNA, 19 bp, Homo sapiens
agtagaagcctgcagcggc

SEQ ID NO: 2149600 - DNA, 15 bp, Homo sapiens
agtagtagtgtcttc

SEQ ID NO: 2149601 - DNA, 15 bp, Homo sapiens
agtatatattctaca

SEQ ID NO: 2149602 - DNA, 16 bp, Homo sapiens
agtatatctggacaag

SEQ ID NO: 2149603 - DNA, 12 bp, Homo sapiens
agtcagaacagc

SEQ ID NO: 2149604 - DNA, 10 bp, Homo sapiens
agtcatggta

SEQ ID NO: 2149605 - DNA, 15 bp, Homo sapiens
agtccgtcaaaacag

SEQ ID NO: 2149606 - DNA, 13 bp, Homo sapiens
agtcctcacagcc

SEQ ID NO: 2149607 - DNA, 14 bp, Homo sapiens
agtcctcacagcct

SEQ ID NO: 2149608 - DNA, 16 bp, Homo sapiens
agtcctcacagcctct

SEQ ID NO: 2149609 - DNA, 19 bp, Homo sapiens
agtcctcacagcctctccc

SEQ ID NO: 2149610 - DNA, 12 bp, Homo sapiens
agtcctgctggc

SEQ ID NO: 2149611 - DNA, 17 bp, Homo sapiens
agtcctgctggcctgct

SEQ ID NO: 2149612 - DNA, 20 bp, Homo sapiens
agtcctgctggcctgctctt

SEQ ID NO: 2149613 - DNA, 13 bp, Homo sapiens
agtcgtcaagttg

SEQ ID NO: 2149614 - DNA, 22 bp, Homo sapiens
agtctatcaaccccagacactg

SEQ ID NO: 2149615 - DNA, 23 bp, Homo sapiens
agtctatcaaccccagacactgg

SEQ ID NO: 2149616 - DNA, 17 bp, Homo sapiens
agtctcctttgcactga

SEQ ID NO: 2149617 - DNA, 22 bp, Homo sapiens
agtctcctttgcactgagggcc

SEQ ID NO: 2149618 - DNA, 16 bp, Homo sapiens
agtctctccagcctca

SEQ ID NO: 2149619 - DNA, 17 bp, Homo sapiens
agtctctctgtgaatac

SEQ ID NO: 2149620 - DNA, 19 bp, Homo sapiens
agtctctggctcagctgtg

SEQ ID NO: 2149621 - DNA, 20 bp, Homo sapiens
agtctgaggccccaggccct

SEQ ID NO: 2149622 - DNA, 20 bp, Homo sapiens
agtgaacacactcagcagcc

SEQ ID NO: 2149623 - DNA, 11 bp, Homo sapiens
agtgacagcta

SEQ ID NO: 2149624 - DNA, 20 bp, Homo sapiens
agtgacagctaggatgtgca

SEQ ID NO: 2149625 - DNA, 21 bp, Homo sapiens
agtgagagacattaactcatt

SEQ ID NO: 2149626 - DNA, 22 bp, Homo sapiens
agtgggagggtaccagcagaaa

SEQ ID NO: 2149627 - DNA, 13 bp, Homo sapiens
agtgtctctgcct

SEQ ID NO: 2149628 - DNA, 14 bp, Homo sapiens
agtgtctctgcctg

SEQ ID NO: 2149629 - DNA, 16 bp, Homo sapiens
agtgtctctgcctgga

SEQ ID NO: 2149630 - DNA, 20 bp, Homo sapiens
agtgtctctgcctggagcag

SEQ ID NO: 2149631 - DNA, 19 bp, Homo sapiens
agtgtcttcctagtatatt

SEQ ID NO: 2149632 - DNA, 14 bp, Homo sapiens
agttaatttaaagt

SEQ ID NO: 2149633 - DNA, 22 bp, Homo sapiens
agttatctaagttaatttaaag

SEQ ID NO: 2149634 - DNA, 12 bp, Homo sapiens
agttatttaaat

SEQ ID NO: 2149635 - DNA, 16 bp, Homo sapiens
agttgaaaataaagtg

SEQ ID NO: 2149636 - DNA, 23 bp, Homo sapiens
agtttatttgttgagagtgtgac

SEQ ID NO: 2149637 - DNA, 17 bp, Homo sapiens
cagctgtggtcccaccc

SEQ ID NO: 2149638 - DNA, 18 bp, Homo sapiens
cagctgtggtcccaccca

SEQ ID NO: 2149639 - DNA, 23 bp, Homo sapiens
cagctgtggtcccacccaggaag

SEQ ID NO: 2149640 - DNA, 22 bp, Homo sapiens
caggaagggagggagctgaggc

SEQ ID NO: 2149641 - DNA, 24 bp, Homo sapiens
caggaagggagggagctgaggcct

SEQ ID NO: 2149642 - DNA, 20 bp, Homo sapiens
caggacttaacggctccagg

SEQ ID NO: 2149643 - DNA, 17 bp, Homo sapiens
caggagcacaggcagct

SEQ ID NO: 2149644 - DNA, 18 bp, Homo sapiens
caggagcacaggcagctg

SEQ ID NO: 2149645 - DNA, 18 bp, Homo sapiens
caggaggtggctatggcc

SEQ ID NO: 2149646 - DNA, 21 bp, Homo sapiens
caggagtcaccatgcaagggt

SEQ ID NO: 2149647 - DNA, 23 bp, Homo sapiens
caggcacatggctgggggaggga

SEQ ID NO: 2149648 - DNA, 15 bp, Homo sapiens
caggcagcgcctgtc

SEQ ID NO: 2149649 - DNA, 21 bp, Homo sapiens
caggcagcgcctgtcccctca

SEQ ID NO: 2149650 - DNA, 22 bp, Homo sapiens
caggcagcgcctgtcccctcac

SEQ ID NO: 2149651 - DNA, 15 bp, Homo sapiens
caggcttcaccctga

SEQ ID NO: 2149652 - DNA, 22 bp, Homo sapiens
cagggaggagaggggaagggcc

SEQ ID NO: 2149653 - DNA, 21 bp, Homo sapiens
cagggccagcaggcagcgcct

SEQ ID NO: 2149654 - DNA, 18 bp, Homo sapiens
caggggaagctgctaggg

SEQ ID NO: 2149655 - DNA, 18 bp, Homo sapiens
caggggacaaaccagggg

SEQ ID NO: 2149656 - DNA, 12 bp, Homo sapiens
caggggactggg

SEQ ID NO: 2149657 - DNA, 15 bp, Homo sapiens
caggggactgggcca

SEQ ID NO: 2149658 - DNA, 16 bp, Homo sapiens
caggggactgggccat

SEQ ID NO: 2149659 - DNA, 17 bp, Homo sapiens
caggggactgggccatg

SEQ ID NO: 2149660 - DNA, 15 bp, Homo sapiens
caggggctgctgggg

SEQ ID NO: 2149661 - DNA, 17 bp, Homo sapiens
caggggctgctgggggc

SEQ ID NO: 2149662 - DNA, 23 bp, Homo sapiens
caggggctgctgggggctcccct

SEQ ID NO: 2149663 - DNA, 23 bp, Homo sapiens
caggggtaccaggcacatggctg

SEQ ID NO: 2149664 - DNA, 18 bp, Homo sapiens
cagtagcacaagttattt

SEQ ID NO: 2149665 - DNA, 21 bp, Homo sapiens
cagtagcacaagttatttaaa

SEQ ID NO: 2149666 - DNA, 21 bp, Homo sapiens
cagtcctccagaccaccagcc

SEQ ID NO: 2149667 - DNA, 13 bp, Homo sapiens
cagtcctgctggc

SEQ ID NO: 2149668 - DNA, 14 bp, Homo sapiens
cagtcctgctggcc

SEQ ID NO: 2149669 - DNA, 21 bp, Homo sapiens
cagtcctgctggcctgctctt

SEQ ID NO: 2149670 - DNA, 16 bp, Homo sapiens
cagtgcctggcaaggc

SEQ ID NO: 2149671 - DNA, 20 bp, Homo sapiens
cagtgtccttggcaggctga

SEQ ID NO: 2149672 - DNA, 22 bp, Homo sapiens
cagttatctaagttaatttaaa

SEQ ID NO: 2149673 - DNA, 17 bp, Homo sapiens
cagttgggagcactgga

SEQ ID NO: 2149674 - DNA, 20 bp, Homo sapiens
cagttgggagcactggagtg

SEQ ID NO: 2149675 - DNA, 23 bp, Homo sapiens
cataggtagaatgtaaagcttgt

SEQ ID NO: 2149676 - DNA, 20 bp, Homo sapiens
catatatgtatatgtatatc

SEQ ID NO: 2149677 - DNA, 19 bp, Homo sapiens
catcagaagtaactcccac

SEQ ID NO: 2149678 - DNA, 21 bp, Homo sapiens
catccccttcccccatcccta

SEQ ID NO: 2149679 - DNA, 13 bp, Homo sapiens
catccctaccact

SEQ ID NO: 2149680 - DNA, 21 bp, Homo sapiens
catcctccccaccagagctgc

SEQ ID NO: 2149681 - DNA, 14 bp, Homo sapiens
catcctcctctcca

SEQ ID NO: 2149682 - DNA, 18 bp, Homo sapiens
catcctcctctccatgca

SEQ ID NO: 2149683 - DNA, 20 bp, Homo sapiens
catcctcctctccatgcaag

SEQ ID NO: 2149684 - DNA, 11 bp, Homo sapiens
catctctgagt

SEQ ID NO: 2149685 - DNA, 22 bp, Homo sapiens
catctctgagtgtctctgcctg

SEQ ID NO: 2149686 - DNA, 12 bp, Homo sapiens
catctgtccatc

SEQ ID NO: 2149687 - DNA, 17 bp, Homo sapiens
catctgtccatcctcct

SEQ ID NO: 2149688 - DNA, 21 bp, Homo sapiens
catctgtccatcctcctctcc

SEQ ID NO: 2149689 - DNA, 20 bp, Homo sapiens
catctgtgcctgtctgtcca

SEQ ID NO: 2149690 - DNA, 17 bp, Homo sapiens
catgagaagagggcctg

SEQ ID NO: 2149691 - DNA, 22 bp, Homo sapiens
catgagaagagggcctgtggga

SEQ ID NO: 2149692 - DNA, 13 bp, Homo sapiens
catgcaagtgctg

SEQ ID NO: 2149693 - DNA, 14 bp, Homo sapiens
catgcaagtgctgt

SEQ ID NO: 2149694 - DNA, 15 bp, Homo sapiens
catgcaagtgctgtt

SEQ ID NO: 2149695 - DNA, 13 bp, Homo sapiens
catgcctgagggt

SEQ ID NO: 2149696 - DNA, 15 bp, Homo sapiens
catgctttctccttt

SEQ ID NO: 2149697 - DNA, 20 bp, Homo sapiens
catggagactcctgccctgt

SEQ ID NO: 2149698 - DNA, 21 bp, Homo sapiens
catggcagctgggcccacagc

SEQ ID NO: 2149699 - DNA, 13 bp, Homo sapiens
catggccttccct

SEQ ID NO: 2149700 - DNA, 14 bp, Homo sapiens
catggccttccctc

SEQ ID NO: 2149701 - DNA, 15 bp, Homo sapiens
catgggactgtgcct

SEQ ID NO: 2149702 - DNA, 15 bp, Homo sapiens
catgggtcctcggcc

SEQ ID NO: 2149703 - DNA, 16 bp, Homo sapiens
catggtactaccccag

SEQ ID NO: 2149704 - DNA, 18 bp, Homo sapiens
catggtactaccccagcc

SEQ ID NO: 2149705 - DNA, 15 bp, Homo sapiens
catggtgtctcccaa

SEQ ID NO: 2149706 - DNA, 16 bp, Homo sapiens
catggtgtctcccaac

SEQ ID NO: 2149707 - DNA, 18 bp, Homo sapiens
catggtgtctcccaacat

SEQ ID NO: 2149708 - DNA, 19 bp, Homo sapiens
catggtgtctcccaacatg

SEQ ID NO: 2149709 - DNA, 20 bp, Homo sapiens
catggtgtctcccaacatgg

SEQ ID NO: 2149710 - DNA, 18 bp, Homo sapiens
catggttgggggaatgca

SEQ ID NO: 2149711 - DNA, 15 bp, Homo sapiens
cattaactcattaga

SEQ ID NO: 2149712 - DNA, 20 bp, Homo sapiens
cattagactggaacttgaac

SEQ ID NO: 2149713 - DNA, 19 bp, Homo sapiens
cattagctacttttcagaa

SEQ ID NO: 2149714 - DNA, 20 bp, Homo sapiens
cattcccactaagctttctc

SEQ ID NO: 2149715 - DNA, 23 bp, Homo sapiens
cattctgattcgaatgacactgt

SEQ ID NO: 2149716 - DNA, 18 bp, Homo sapiens
cattctttatcttgacat

SEQ ID NO: 2149717 - DNA, 22 bp, Homo sapiens
cattgtgccatgtcaaacaaat

SEQ ID NO: 2149718 - DNA, 20 bp, Homo sapiens
catttggcagaactgctggg

SEQ ID NO: 2149719 - DNA, 21 bp, Homo sapiens
cattttgaaaacccctggctg

SEQ ID NO: 2149720 - DNA, 23 bp, Homo sapiens
cattttgtacaaagatatgctaa

SEQ ID NO: 2149721 - DNA, 17 bp, Homo sapiens
ccaaaagttacatgttt

SEQ ID NO: 2149722 - DNA, 16 bp, Homo sapiens
ccaaagagtctctggc

SEQ ID NO: 2149723 - DNA, 19 bp, Homo sapiens
ccaaagagtctctggctca

SEQ ID NO: 2149724 - DNA, 22 bp, Homo sapiens
ccaaagagtctctggctcagct

SEQ ID NO: 2149725 - DNA, 20 bp, Homo sapiens
ccaacccctcccccacgtct

SEQ ID NO: 2149726 - DNA, 13 bp, Homo sapiens
ccaacctgtcctt

SEQ ID NO: 2149727 - DNA, 17 bp, Homo sapiens
ccaacctgtccttactc

SEQ ID NO: 2149728 - DNA, 23 bp, Homo sapiens
ccaacctgtccttactcagagct

SEQ ID NO: 2149729 - DNA, 17 bp, Homo sapiens
ccaacttgtaaatacac

SEQ ID NO: 2149730 - DNA, 17 bp, Homo sapiens
ccaagaggggcgggctc

SEQ ID NO: 2149731 - DNA, 13 bp, Homo sapiens
ccaagccaccgca

SEQ ID NO: 2149732 - DNA, 16 bp, Homo sapiens
ccaagccaccgcagct

SEQ ID NO: 2149733 - DNA, 17 bp, Homo sapiens
ccaagccaccgcagctg

SEQ ID NO: 2149734 - DNA, 21 bp, Homo sapiens
ccaagccaccgcagctgctgc

SEQ ID NO: 2149735 - DNA, 15 bp, Homo sapiens
ccaaggtctcacact

SEQ ID NO: 2149736 - DNA, 22 bp, Homo sapiens
ccaaggtctcacactcctcctg

SEQ ID NO: 2149737 - DNA, 15 bp, Homo sapiens
ccaagtctctctgtg

SEQ ID NO: 2149738 - DNA, 16 bp, Homo sapiens
ccaagtctctctgtga

SEQ ID NO: 2149739 - DNA, 12 bp, Homo sapiens
ccacaccccagc

SEQ ID NO: 2149740 - DNA, 13 bp, Homo sapiens
ccacaccccagcc

SEQ ID NO: 2149741 - DNA, 20 bp, Homo sapiens
ccacaccccagcccaccctg

SEQ ID NO: 2149742 - DNA, 16 bp, Homo sapiens
ccacaccctgcctgct

SEQ ID NO: 2149743 - DNA, 18 bp, Homo sapiens
ccacactattaccatgag

SEQ ID NO: 2149744 - DNA, 11 bp, Homo sapiens
ccacataaagg

SEQ ID NO: 2149745 - DNA, 12 bp, Homo sapiens
ccacatcccagg

SEQ ID NO: 2149746 - DNA, 22 bp, Homo sapiens
ctaatctgtagggctggaccta

SEQ ID NO: 2149747 - DNA, 14 bp, Homo sapiens
ctacacatatatgt

SEQ ID NO: 2149748 - DNA, 22 bp, Homo sapiens
ctaccactgtggccccaagagg

SEQ ID NO: 2149749 - DNA, 15 bp, Homo sapiens
ctacccaaccactca

SEQ ID NO: 2149750 - DNA, 13 bp, Homo sapiens
ctaccgcatggca

SEQ ID NO: 2149751 - DNA, 19 bp, Homo sapiens
ctaccgcatggcagctggg

SEQ ID NO: 2149752 - DNA, 17 bp, Homo sapiens
ctactttgatatgactg

SEQ ID NO: 2149753 - DNA, 22 bp, Homo sapiens
ctagatccaggcttctcccgga

SEQ ID NO: 2149754 - DNA, 16 bp, Homo sapiens
ctagctcttgggcctg

SEQ ID NO: 2149755 - DNA, 21 bp, Homo sapiens
ctagctcttgggcctgacctc

SEQ ID NO: 2149756 - DNA, 15 bp, Homo sapiens
ctaggattcctcccc

SEQ ID NO: 2149757 - DNA, 20 bp, Homo sapiens
ctagggcctcggaggctcct

SEQ ID NO: 2149758 - DNA, 22 bp, Homo sapiens
ctagggcctcggaggctcctcc

SEQ ID NO: 2149759 - DNA, 16 bp, Homo sapiens
ctaggggaaggactgg

SEQ ID NO: 2149760 - DNA, 17 bp, Homo sapiens
ctaggggaaggactggc

SEQ ID NO: 2149761 - DNA, 18 bp, Homo sapiens
ctaggggtcaggctccat

SEQ ID NO: 2149762 - DNA, 21 bp, Homo sapiens
ctagtctcctttgcactgagg

SEQ ID NO: 2149763 - DNA, 19 bp, Homo sapiens
ctatatagctgatcagttt

SEQ ID NO: 2149764 - DNA, 15 bp, Homo sapiens
ctatatctctaaact

SEQ ID NO: 2149765 - DNA, 19 bp, Homo sapiens
ctatattccgggtgccatt

SEQ ID NO: 2149766 - DNA, 22 bp, Homo sapiens
ctatgtcctaaggacacactaa

SEQ ID NO: 2149767 - DNA, 14 bp, Homo sapiens
ctattagcaactgt

SEQ ID NO: 2149768 - DNA, 13 bp, Homo sapiens
ctattcagacaag

SEQ ID NO: 2149769 - DNA, 17 bp, Homo sapiens
ctattcagacaagcaac

SEQ ID NO: 2149770 - DNA, 13 bp, Homo sapiens
ctcaaatctattc

SEQ ID NO: 2149771 - DNA, 16 bp, Homo sapiens
ctcaaattaatctttc

SEQ ID NO: 2149772 - DNA, 23 bp, Homo sapiens
ctcaaattaatctttctttacct

SEQ ID NO: 2149773 - DNA, 20 bp, Homo sapiens
ctcaagaagacatggagact

SEQ ID NO: 2149774 - DNA, 21 bp, Homo sapiens
ctcaagaagacatggagactc

SEQ ID NO: 2149775 - DNA, 16 bp, Homo sapiens
ctcaatttctgaacac

SEQ ID NO: 2149776 - DNA, 14 bp, Homo sapiens
ctcacactccagaa

SEQ ID NO: 2149777 - DNA, 20 bp, Homo sapiens
ctcacactcctcctgccagc

SEQ ID NO: 2149778 - DNA, 22 bp, Homo sapiens
ctcacagactcttccaccagag

SEQ ID NO: 2149779 - DNA, 17 bp, Homo sapiens
ctcacagatgctggcct

SEQ ID NO: 2149780 - DNA, 20 bp, Homo sapiens
ctcacagatgctggcctctt

SEQ ID NO: 2149781 - DNA, 13 bp, Homo sapiens
ctcacagcctctc

SEQ ID NO: 2149782 - DNA, 17 bp, Homo sapiens
ctcacagcctctccctt

SEQ ID NO: 2149783 - DNA, 18 bp, Homo sapiens
ctcacagcctctccctta

SEQ ID NO: 2149784 - DNA, 12 bp, Homo sapiens
ctcactcctgtt

SEQ ID NO: 2149785 - DNA, 20 bp, Homo sapiens
ctcactcctgttacttacct

SEQ ID NO: 2149786 - DNA, 12 bp, Homo sapiens
ctcactgctcaa

SEQ ID NO: 2149787 - DNA, 16 bp, Homo sapiens
ctcactgctcaagaag

SEQ ID NO: 2149788 - DNA, 19 bp, Homo sapiens
ctcactgctcaagaagaca

SEQ ID NO: 2149789 - DNA, 21 bp, Homo sapiens
ctcactgctcaagaagacatg

SEQ ID NO: 2149790 - DNA, 15 bp, Homo sapiens
ctcagagctgcgggc

SEQ ID NO: 2149791 - DNA, 10 bp, Homo sapiens
ctcagagctt

SEQ ID NO: 2149792 - DNA, 13 bp, Homo sapiens
ctcagagctttgt

SEQ ID NO: 2149793 - DNA, 14 bp, Homo sapiens
ctcagagctttgtc

SEQ ID NO: 2149794 - DNA, 19 bp, Homo sapiens
ctcagagctttgtcacttg

SEQ ID NO: 2149795 - DNA, 20 bp, Homo sapiens
ctcagagctttgtcacttgc

SEQ ID NO: 2149796 - DNA, 22 bp, Homo sapiens
ctcagagcttttcgaactgtgc

SEQ ID NO: 2149797 - DNA, 16 bp, Homo sapiens
ctcagatagaatgaca

SEQ ID NO: 2149798 - DNA, 14 bp, Homo sapiens
ctcagatggagaca

SEQ ID NO: 2149799 - DNA, 13 bp, Homo sapiens
ctcagcagccccc

SEQ ID NO: 2149800 - DNA, 16 bp, Homo sapiens
ctcagctgtggtccca

SEQ ID NO: 2149801 - DNA, 17 bp, Homo sapiens
ctcaggagcacaggcag

SEQ ID NO: 2149802 - DNA, 20 bp, Homo sapiens
ctcaggggaagctgctaggg

SEQ ID NO: 2149803 - DNA, 14 bp, Homo sapiens
ctcatcctcctcct

SEQ ID NO: 2149804 - DNA, 15 bp, Homo sapiens
ctcatcctcctcctc

SEQ ID NO: 2149805 - DNA, 14 bp, Homo sapiens
ctcatctgtgcctg

SEQ ID NO: 2149806 - DNA, 18 bp, Homo sapiens
ctccaagtctctctgtga

SEQ ID NO: 2149807 - DNA, 18 bp, Homo sapiens
ctccagaatgtgctgcct

SEQ ID NO: 2149808 - DNA, 21 bp, Homo sapiens
ctccagaattacccttcctca

SEQ ID NO: 2149809 - DNA, 16 bp, Homo sapiens
ctccagaccaccagcc

SEQ ID NO: 2149810 - DNA, 16 bp, Homo sapiens
ctccagccagcaatga

SEQ ID NO: 2149811 - DNA, 23 bp, Homo sapiens
ctccagccagcaatgatgtccag

SEQ ID NO: 2149812 - DNA, 21 bp, Homo sapiens
ctccagccatcaagagactga

SEQ ID NO: 2149813 - DNA, 19 bp, Homo sapiens
ctccagcctcacagatgct

SEQ ID NO: 2149814 - DNA, 16 bp, Homo sapiens
ctccagtcatggtact

SEQ ID NO: 2149815 - DNA, 20 bp, Homo sapiens
ctccagtcctgctggcctgc

SEQ ID NO: 2149816 - DNA, 23 bp, Homo sapiens
ctccatgcaagtgctgtttgggc

SEQ ID NO: 2149817 - DNA, 21 bp, Homo sapiens
ctcccaacatgggagggatca

SEQ ID NO: 2149818 - DNA, 22 bp, Homo sapiens
ctcccaacatgggagggatcag

SEQ ID NO: 2149819 - DNA, 23 bp, Homo sapiens
ctcccacggggaccactgggccc

SEQ ID NO: 2149820 - DNA, 13 bp, Homo sapiens
ctcccactcctaa

SEQ ID NO: 2149821 - DNA, 20 bp, Homo sapiens
ctcccactcctaatcaagag

SEQ ID NO: 2149822 - DNA, 14 bp, Homo sapiens
ctcccatggccttc

SEQ ID NO: 2149823 - DNA, 13 bp, Homo sapiens
ctccccaatccat

SEQ ID NO: 2149824 - DNA, 16 bp, Homo sapiens
ctccccaccagagctg

SEQ ID NO: 2149825 - DNA, 19 bp, Homo sapiens
ctccccaccagagctgcct

SEQ ID NO: 2149826 - DNA, 13 bp, Homo sapiens
ctccccactctag

SEQ ID NO: 2149827 - DNA, 12 bp, Homo sapiens
ctccccagccct

SEQ ID NO: 2149828 - DNA, 21 bp, Homo sapiens
ctcccccacgtctctctgcct

SEQ ID NO: 2149829 - DNA, 22 bp, Homo sapiens
ctcccccacgtctctctgcctg

SEQ ID NO: 2149830 - DNA, 12 bp, Homo sapiens
ctcccccagagc

SEQ ID NO: 2149831 - DNA, 14 bp, Homo sapiens
ctcccccagagcca

SEQ ID NO: 2149832 - DNA, 11 bp, Homo sapiens
ctcccccgcct

SEQ ID NO: 2149833 - DNA, 12 bp, Homo sapiens
ctcccctcccag

SEQ ID NO: 2149834 - DNA, 19 bp, Homo sapiens
ctcccctgaggatcccctg

SEQ ID NO: 2149835 - DNA, 18 bp, Homo sapiens
ctcccctgccgcctcccg

SEQ ID NO: 2149836 - DNA, 21 bp, Homo sapiens
ctccccttgcccttcctgacc

SEQ ID NO: 2149837 - DNA, 19 bp, Homo sapiens
ctcccggacctggactagg

SEQ ID NO: 2149838 - DNA, 20 bp, Homo sapiens
ctcccgggaagcatcctccc

SEQ ID NO: 2149839 - DNA, 16 bp, Homo sapiens
ctccctcctcacactc

SEQ ID NO: 2149840 - DNA, 14 bp, Homo sapiens
ctccctctgcctca

SEQ ID NO: 2149841 - DNA, 21 bp, Homo sapiens
ctcctaatcaagagtctctcc

SEQ ID NO: 2149842 - DNA, 15 bp, Homo sapiens
ctcctcccatggcct

SEQ ID NO: 2149843 - DNA, 14 bp, Homo sapiens
ctcctcccctgccg

SEQ ID NO: 2149844 - DNA, 10 bp, Homo sapiens
ctcctccctc

SEQ ID NO: 2149845 - DNA, 15 bp, Homo sapiens
ctcctccctctgcct

SEQ ID NO: 2149846 - DNA, 16 bp, Homo sapiens
ctcctcctgccagctc

SEQ ID NO: 2149847 - DNA, 15 bp, Homo sapiens
ctcctcctgccctgt

SEQ ID NO: 2149848 - DNA, 13 bp, Homo sapiens
ctcctgccctgtt

SEQ ID NO: 2149849 - DNA, 22 bp, Homo sapiens
ctcctgtgcccacatcccaggc

SEQ ID NO: 2149850 - DNA, 21 bp, Homo sapiens
ctccttccccttgtccctggg

SEQ ID NO: 2149851 - DNA, 21 bp, Homo sapiens
ctcctttctccagccagcaat

SEQ ID NO: 2149852 - DNA, 15 bp, Homo sapiens
ctcctttgcactgag

SEQ ID NO: 2149853 - DNA, 16 bp, Homo sapiens
ctcctttgcactgagg

SEQ ID NO: 2149854 - DNA, 18 bp, Homo sapiens
ctcctttgcactgagggc

SEQ ID NO: 2149855 - DNA, 17 bp, Homo sapiens
ctcctttttctaccttt

SEQ ID NO: 2149856 - DNA, 14 bp, Homo sapiens
gccactctgctgcc

SEQ ID NO: 2149857 - DNA, 16 bp, Homo sapiens
gccagattttttaaaa

SEQ ID NO: 2149858 - DNA, 17 bp, Homo sapiens
gccagcaggcagcgcct

SEQ ID NO: 2149859 - DNA, 18 bp, Homo sapiens
gccagccgtgatgctcag

SEQ ID NO: 2149860 - DNA, 20 bp, Homo sapiens
gccagccgtgatgctcaggc

SEQ ID NO: 2149861 - DNA, 21 bp, Homo sapiens
gccagccgtgatgctcaggct

SEQ ID NO: 2149862 - DNA, 16 bp, Homo sapiens
gccagctctgtcaccc

SEQ ID NO: 2149863 - DNA, 19 bp, Homo sapiens
gccagctctgtcaccctgg

SEQ ID NO: 2149864 - DNA, 13 bp, Homo sapiens
gccagtctgggct

SEQ ID NO: 2149865 - DNA, 15 bp, Homo sapiens
gccatcaagagactg

SEQ ID NO: 2149866 - DNA, 13 bp, Homo sapiens
gccatgggtcctc

SEQ ID NO: 2149867 - DNA, 17 bp, Homo sapiens
gccatgtcaaacaaata

SEQ ID NO: 2149868 - DNA, 20 bp, Homo sapiens
gcccaagggcctcccaccag

SEQ ID NO: 2149869 - DNA, 14 bp, Homo sapiens
gcccacacacactc

SEQ ID NO: 2149870 - DNA, 19 bp, Homo sapiens
gcccacagcccccacccca

SEQ ID NO: 2149871 - DNA, 23 bp, Homo sapiens
gcccacagcccccaccccagcac

SEQ ID NO: 2149872 - DNA, 10 bp, Homo sapiens
gcccaccctg

SEQ ID NO: 2149873 - DNA, 14 bp, Homo sapiens
gcccatctgtccat

SEQ ID NO: 2149874 - DNA, 21 bp, Homo sapiens
gcccatctgtccatcctcctc

SEQ ID NO: 2149875 - DNA, 23 bp, Homo sapiens
gcccattgtggaggcggtggggg

SEQ ID NO: 2149876 - DNA, 22 bp, Homo sapiens
gccccaagaggggcgggctcag

SEQ ID NO: 2149877 - DNA, 18 bp, Homo sapiens
gccccagatcaccagccc

SEQ ID NO: 2149878 - DNA, 19 bp, Homo sapiens
gccccagatcaccagcccg

SEQ ID NO: 2149879 - DNA, 13 bp, Homo sapiens
gccccatctcctc

SEQ ID NO: 2149880 - DNA, 22 bp, Homo sapiens
gcccccagagacctttgcccac

SEQ ID NO: 2149881 - DNA, 23 bp, Homo sapiens
gccccgcctgtcacaataaagtt

SEQ ID NO: 2149882 - DNA, 23 bp, Homo sapiens
gcccctcaggggaagctgctagg

SEQ ID NO: 2149883 - DNA, 17 bp, Homo sapiens
gcccctccccagccctt

SEQ ID NO: 2149884 - DNA, 17 bp, Homo sapiens
gcccctccccctaccgc

SEQ ID NO: 2149885 - DNA, 20 bp, Homo sapiens
gcccctccccctaccgcatg

SEQ ID NO: 2149886 - DNA, 22 bp, Homo sapiens
gcccctccccctaccgcatggc

SEQ ID NO: 2149887 - DNA, 15 bp, Homo sapiens
gcccctccctagatc

SEQ ID NO: 2149888 - DNA, 20 bp, Homo sapiens
gcccctccctagatccaggc

SEQ ID NO: 2149889 - DNA, 21 bp, Homo sapiens
gcccctccctagatccaggct

SEQ ID NO: 2149890 - DNA, 14 bp, Homo sapiens
gcccgaccccatct

SEQ ID NO: 2149891 - DNA, 11 bp, Homo sapiens
gccctgcccaa

SEQ ID NO: 2149892 - DNA, 17 bp, Homo sapiens
gccctgcccctccccct

SEQ ID NO: 2149893 - DNA, 18 bp, Homo sapiens
gccctgcccctcccccta

SEQ ID NO: 2149894 - DNA, 17 bp, Homo sapiens
gccctgcccctccctag

SEQ ID NO: 2149895 - DNA, 14 bp, Homo sapiens
gccctgccttcagc

SEQ ID NO: 2149896 - DNA, 19 bp, Homo sapiens
gccctggcccagagctgga

SEQ ID NO: 2149897 - DNA, 20 bp, Homo sapiens
gccctgtccctgtccccctc

SEQ ID NO: 2149898 - DNA, 16 bp, Homo sapiens
gccctgtcgagacact

SEQ ID NO: 2149899 - DNA, 13 bp, Homo sapiens
gcccttccctgct

SEQ ID NO: 2149900 - DNA, 14 bp, Homo sapiens
gcccttccctgctt

SEQ ID NO: 2149901 - DNA, 13 bp, Homo sapiens
gcccttcctgacc

SEQ ID NO: 2149902 - DNA, 14 bp, Homo sapiens
gcccttcctgaccc

SEQ ID NO: 2149903 - DNA, 15 bp, Homo sapiens
gccctttgcaggccc

SEQ ID NO: 2149904 - DNA, 16 bp, Homo sapiens
gccctttgcaggccca

SEQ ID NO: 2149905 - DNA, 17 bp, Homo sapiens
gccgagccgggcctggg

SEQ ID NO: 2149906 - DNA, 15 bp, Homo sapiens
gccgccccagcccct

SEQ ID NO: 2149907 - DNA, 13 bp, Homo sapiens
gccgcctcccggg

SEQ ID NO: 2149908 - DNA, 12 bp, Homo sapiens
gccggccctgcc

SEQ ID NO: 2149909 - DNA, 14 bp, Homo sapiens
gccggccctgcccc

SEQ ID NO: 2149910 - DNA, 12 bp, Homo sapiens
gccgggcctggg

SEQ ID NO: 2149911 - DNA, 13 bp, Homo sapiens
gccgtggctccag

SEQ ID NO: 2149912 - DNA, 15 bp, Homo sapiens
gccgtggctccagaa

SEQ ID NO: 2149913 - DNA, 14 bp, Homo sapiens
gcctagctcttggg

SEQ ID NO: 2149914 - DNA, 15 bp, Homo sapiens
gcctagctcttgggc

SEQ ID NO: 2149915 - DNA, 23 bp, Homo sapiens
gcctagctcttgggcctgacctc

SEQ ID NO: 2149916 - DNA, 22 bp, Homo sapiens
gcctcaatttctgaacaccata

SEQ ID NO: 2149917 - DNA, 20 bp, Homo sapiens
gcctcacagatgctggcctc

SEQ ID NO: 2149918 - DNA, 21 bp, Homo sapiens
gcctcacagatgctggcctct

SEQ ID NO: 2149919 - DNA, 22 bp, Homo sapiens
gcctcacttttaatgaacaaat

SEQ ID NO: 2149920 - DNA, 13 bp, Homo sapiens
gcctcatcctcct

SEQ ID NO: 2149921 - DNA, 14 bp, Homo sapiens
gcctcatcctcctc

SEQ ID NO: 2149922 - DNA, 16 bp, Homo sapiens
gcctccagtcatggta

SEQ ID NO: 2149923 - DNA, 15 bp, Homo sapiens
gcctcccctgaggat

SEQ ID NO: 2149924 - DNA, 20 bp, Homo sapiens
gcctcccgggaagcatcctc

SEQ ID NO: 2149925 - DNA, 22 bp, Homo sapiens
gcctcccttgagtaggccctgc

SEQ ID NO: 2149926 - DNA, 16 bp, Homo sapiens
gcctcggaggctcctc

SEQ ID NO: 2149927 - DNA, 19 bp, Homo sapiens
gcctcggaggctcctccct

SEQ ID NO: 2149928 - DNA, 17 bp, Homo sapiens
gcctctaactccctcct

SEQ ID NO: 2149929 - DNA, 17 bp, Homo sapiens
gcctctggttgcctccc

SEQ ID NO: 2149930 - DNA, 21 bp, Homo sapiens
gcctcttggcacctgcctagc

SEQ ID NO: 2149931 - DNA, 23 bp, Homo sapiens
gcctcttggcacctgcctagctc

SEQ ID NO: 2149932 - DNA, 14 bp, Homo sapiens
gcctgaactccaga

SEQ ID NO: 2149933 - DNA, 13 bp, Homo sapiens
gcctgacctccag

SEQ ID NO: 2149934 - DNA, 18 bp, Homo sapiens
gcctgacctccagtcctg

SEQ ID NO: 2149935 - DNA, 15 bp, Homo sapiens
gcctgagtctcctgt

SEQ ID NO: 2149936 - DNA, 18 bp, Homo sapiens
gcctgcagcggcacaaat

SEQ ID NO: 2149937 - DNA, 16 bp, Homo sapiens
gcctgctcccagcagc

SEQ ID NO: 2149938 - DNA, 22 bp, Homo sapiens
gcctgctcttacttcccccacc

SEQ ID NO: 2149939 - DNA, 11 bp, Homo sapiens
gcctgctgggc

SEQ ID NO: 2149940 - DNA, 13 bp, Homo sapiens
gcctgctgggctc

SEQ ID NO: 2149941 - DNA, 14 bp, Homo sapiens
gcctgctgggctct

SEQ ID NO: 2149942 - DNA, 15 bp, Homo sapiens
gcctggagcaggggt

SEQ ID NO: 2149943 - DNA, 17 bp, Homo sapiens
gcctggagcaggggtgg

SEQ ID NO: 2149944 - DNA, 21 bp, Homo sapiens
gcctgtagccccagtgacagc

SEQ ID NO: 2149945 - DNA, 13 bp, Homo sapiens
gcctgtcccctca

SEQ ID NO: 2149946 - DNA, 14 bp, Homo sapiens
gcctgtcccctcac

SEQ ID NO: 2149947 - DNA, 19 bp, Homo sapiens
gccttccctccccacagtc

SEQ ID NO: 2149948 - DNA, 20 bp, Homo sapiens
gcctttgaggcaaaggccag

SEQ ID NO: 2149949 - DNA, 18 bp, Homo sapiens
gcgcctgtcccctcacag

SEQ ID NO: 2149950 - DNA, 16 bp, Homo sapiens
gcgggctgagggcatc

SEQ ID NO: 2149951 - DNA, 21 bp, Homo sapiens
gctaatctgtagggctggacc

SEQ ID NO: 2149952 - DNA, 22 bp, Homo sapiens
gctcaaatctattcagacaagc

SEQ ID NO: 2149953 - DNA, 12 bp, Homo sapiens
gctcagagcttt

SEQ ID NO: 2149954 - DNA, 18 bp, Homo sapiens
gctcagagctttgtcact

SEQ ID NO: 2149955 - DNA, 23 bp, Homo sapiens
gctcagagctttgtcacttgcca

SEQ ID NO: 2149956 - DNA, 18 bp, Homo sapiens
gctccagaatgtgctgcc

SEQ ID NO: 2149957 - DNA, 23 bp, Homo sapiens
gctcccacggggaccactgggcc

SEQ ID NO: 2149958 - DNA, 12 bp, Homo sapiens
gctcccagcagc

SEQ ID NO: 2149959 - DNA, 19 bp, Homo sapiens
gctccccttgcccttcctg

SEQ ID NO: 2149960 - DNA, 20 bp, Homo sapiens
gctccccttgcccttcctga

SEQ ID NO: 2149961 - DNA, 16 bp, Homo sapiens
gctcctcccctgccgc

SEQ ID NO: 2149962 - DNA, 18 bp, Homo sapiens
gctcctcccctgccgcct

SEQ ID NO: 2149963 - DNA, 11 bp, Homo sapiens
gctcctccctc

SEQ ID NO: 2149964 - DNA, 12 bp, Homo sapiens
gctcctccctct

SEQ ID NO: 2149965 - DNA, 13 bp, Homo sapiens
gctcctccctctg

SEQ ID NO: 2149966 - DNA, 11 bp, Homo sapiens
tcaggctccat

SEQ ID NO: 2149967 - DNA, 16 bp, Homo sapiens
tcaggctccattagga

SEQ ID NO: 2149968 - DNA, 16 bp, Homo sapiens
tcaggcttgaaatgca

SEQ ID NO: 2149969 - DNA, 16 bp, Homo sapiens
tcaggggaagctgcta

SEQ ID NO: 2149970 - DNA, 20 bp, Homo sapiens
tcaggggacaaaccaggggt

SEQ ID NO: 2149971 - DNA, 16 bp, Homo sapiens
tcatcctcctcctcat

SEQ ID NO: 2149972 - DNA, 21 bp, Homo sapiens
tcatctgtgcctgtctgtcca

SEQ ID NO: 2149973 - DNA, 18 bp, Homo sapiens
tcatggtactaccccagc

SEQ ID NO: 2149974 - DNA, 16 bp, Homo sapiens
tcattcaggtgttctc

SEQ ID NO: 2149975 - DNA, 17 bp, Homo sapiens
tccaagtctctctgtga

SEQ ID NO: 2149976 - DNA, 18 bp, Homo sapiens
tccaagtctctctgtgaa

SEQ ID NO: 2149977 - DNA, 12 bp, Homo sapiens
tccacataaagg

SEQ ID NO: 2149978 - DNA, 13 bp, Homo sapiens
tccaccagagcag

SEQ ID NO: 2149979 - DNA, 17 bp, Homo sapiens
tccagaagaatattcag

SEQ ID NO: 2149980 - DNA, 20 bp, Homo sapiens
tccagaagaatattcaggac

SEQ ID NO: 2149981 - DNA, 18 bp, Homo sapiens
tccagaatgtgctgcctt

SEQ ID NO: 2149982 - DNA, 17 bp, Homo sapiens
tccagaattacccttcc

SEQ ID NO: 2149983 - DNA, 19 bp, Homo sapiens
tccagaattacccttcctc

SEQ ID NO: 2149984 - DNA, 21 bp, Homo sapiens
tccagaattacccttcctcat

SEQ ID NO: 2149985 - DNA, 20 bp, Homo sapiens
tccagccatcaagagactga

SEQ ID NO: 2149986 - DNA, 20 bp, Homo sapiens
tccagcctcacagatgctgg

SEQ ID NO: 2149987 - DNA, 15 bp, Homo sapiens
tccagtcatggtact

SEQ ID NO: 2149988 - DNA, 19 bp, Homo sapiens
tccagtcatggtactaccc

SEQ ID NO: 2149989 - DNA, 23 bp, Homo sapiens
tccagtcatggtactaccccagc

SEQ ID NO: 2149990 - DNA, 16 bp, Homo sapiens
tccagtcctgctggcc

SEQ ID NO: 2149991 - DNA, 21 bp, Homo sapiens
tccatccccttcccccatccc

SEQ ID NO: 2149992 - DNA, 16 bp, Homo sapiens
tccatcctcctctcca

SEQ ID NO: 2149993 - DNA, 20 bp, Homo sapiens
tccatcctcctctccatgca

SEQ ID NO: 2149994 - DNA, 12 bp, Homo sapiens
tccatgcctgag

SEQ ID NO: 2149995 - DNA, 13 bp, Homo sapiens
tccatgcctgagg

SEQ ID NO: 2149996 - DNA, 21 bp, Homo sapiens
tccatgcctgagggtggagac

SEQ ID NO: 2149997 - DNA, 13 bp, Homo sapiens
tcccaacatggga

SEQ ID NO: 2149998 - DNA, 14 bp, Homo sapiens
tcccaacatgggag

SEQ ID NO: 2149999 - DNA, 14 bp, Homo sapiens
tcccacccaggaag

SEQ ID NO: 2150000 - DNA, 20 bp, Homo sapiens
tcccacggggaccactgggc

SEQ ID NO: 2150001 - DNA, 11 bp, Homo sapiens
tcccactccta

SEQ ID NO: 2150002 - DNA, 18 bp, Homo sapiens
tcccagcagccctaagga

SEQ ID NO: 2150003 - DNA, 22 bp, Homo sapiens
tcccaggcttcaccctgaatgg

SEQ ID NO: 2150004 - DNA, 16 bp, Homo sapiens
tcccatggccttccct

SEQ ID NO: 2150005 - DNA, 18 bp, Homo sapiens
tccccacagtcctcacag

SEQ ID NO: 2150006 - DNA, 15 bp, Homo sapiens
tccccaccagagctg

SEQ ID NO: 2150007 - DNA, 16 bp, Homo sapiens
tccccaccagagctgc

SEQ ID NO: 2150008 - DNA, 20 bp, Homo sapiens
tccccaccagagctgcctcc

SEQ ID NO: 2150009 - DNA, 15 bp, Homo sapiens
tccccagccctttgc

SEQ ID NO: 2150010 - DNA, 12 bp, Homo sapiens
tcccccaccctg

SEQ ID NO: 2150011 - DNA, 17 bp, Homo sapiens
tcccccacgtctctctg

SEQ ID NO: 2150012 - DNA, 18 bp, Homo sapiens
tcccccacgtctctctgc

SEQ ID NO: 2150013 - DNA, 21 bp, Homo sapiens
tcccccacgtctctctgcctg

SEQ ID NO: 2150014 - DNA, 13 bp, Homo sapiens
tcccccatcccta

SEQ ID NO: 2150015 - DNA, 18 bp, Homo sapiens
tcccccatccctaccact

SEQ ID NO: 2150016 - DNA, 20 bp, Homo sapiens
tcccccatccctaccactgt

SEQ ID NO: 2150017 - DNA, 18 bp, Homo sapiens
tccccctaccgcatggca

SEQ ID NO: 2150018 - DNA, 22 bp, Homo sapiens
tccccctaccgcatggcagctg

SEQ ID NO: 2150019 - DNA, 16 bp, Homo sapiens
tcccctcacagactct

SEQ ID NO: 2150020 - DNA, 21 bp, Homo sapiens
tcccctcacagactcttccac

SEQ ID NO: 2150021 - DNA, 22 bp, Homo sapiens
tcccctcacagactcttccacc

SEQ ID NO: 2150022 - DNA, 23 bp, Homo sapiens
tcccctcacagactcttccacca

SEQ ID NO: 2150023 - DNA, 22 bp, Homo sapiens
tcccctgaggatcccctgtccc

SEQ ID NO: 2150024 - DNA, 17 bp, Homo sapiens
tcccctgccgcctcccg

SEQ ID NO: 2150025 - DNA, 16 bp, Homo sapiens
tcccctgtcccctggg

SEQ ID NO: 2150026 - DNA, 15 bp, Homo sapiens
tccccttgcccttcc

SEQ ID NO: 2150027 - DNA, 16 bp, Homo sapiens
tccccttgcccttcct

SEQ ID NO: 2150028 - DNA, 20 bp, Homo sapiens
tccccttgcccttcctgacc

SEQ ID NO: 2150029 - DNA, 15 bp, Homo sapiens
tccccttgtccctgg

SEQ ID NO: 2150030 - DNA, 19 bp, Homo sapiens
tccctaccactgtggcccc

SEQ ID NO: 2150031 - DNA, 16 bp, Homo sapiens
tccctagatccaggct

SEQ ID NO: 2150032 - DNA, 22 bp, Homo sapiens
tccctccccacagtcctcacag

SEQ ID NO: 2150033 - DNA, 13 bp, Homo sapiens
tccctcctcacac

SEQ ID NO: 2150034 - DNA, 15 bp, Homo sapiens
tccctcctcacactc

SEQ ID NO: 2150035 - DNA, 11 bp, Homo sapiens
tccctctgcct

SEQ ID NO: 2150036 - DNA, 18 bp, Homo sapiens
tccctctgcctcatcctc

SEQ ID NO: 2150037 - DNA, 19 bp, Homo sapiens
tccctggggcactccccca

SEQ ID NO: 2150038 - DNA, 20 bp, Homo sapiens
tccctggggcactcccccag

SEQ ID NO: 2150039 - DNA, 22 bp, Homo sapiens
tccctggggcactcccccagga

SEQ ID NO: 2150040 - DNA, 14 bp, Homo sapiens
tccctgtccccctc

SEQ ID NO: 2150041 - DNA, 18 bp, Homo sapiens
tcccttgagtaggccctg

SEQ ID NO: 2150042 - DNA, 22 bp, Homo sapiens
tccctttttgcaggggactggg

SEQ ID NO: 2150043 - DNA, 15 bp, Homo sapiens
tccgtaaaaatgatt

SEQ ID NO: 2150044 - DNA, 16 bp, Homo sapiens
tcctaaggacacacta

SEQ ID NO: 2150045 - DNA, 17 bp, Homo sapiens
tcctaaggacacactaa

SEQ ID NO: 2150046 - DNA, 18 bp, Homo sapiens
tcctaaggacacactaat

SEQ ID NO: 2150047 - DNA, 21 bp, Homo sapiens
tcctaatcaagagtctctcca

SEQ ID NO: 2150048 - DNA, 22 bp, Homo sapiens
tcctaatcaagagtctctccag

SEQ ID NO: 2150049 - DNA, 15 bp, Homo sapiens
tcctacccaaccact

SEQ ID NO: 2150050 - DNA, 23 bp, Homo sapiens
tcctagtatattagtttgattta

SEQ ID NO: 2150051 - DNA, 12 bp, Homo sapiens
tcctcacactcc

SEQ ID NO: 2150052 - DNA, 14 bp, Homo sapiens
tcctcacactccag

SEQ ID NO: 2150053 - DNA, 18 bp, Homo sapiens
tcctcacagcctctccct

SEQ ID NO: 2150054 - DNA, 16 bp, Homo sapiens
tcctcatctgtgcctg

SEQ ID NO: 2150055 - DNA, 18 bp, Homo sapiens
tcctcatctgtgcctgtc

SEQ ID NO: 2150056 - DNA, 18 bp, Homo sapiens
tcctcccatggccttccc

SEQ ID NO: 2150057 - DNA, 20 bp, Homo sapiens
tcctcccatggccttccctc

SEQ ID NO: 2150058 - DNA, 14 bp, Homo sapiens
tcctccccaccaga

SEQ ID NO: 2150059 - DNA, 15 bp, Homo sapiens
tcctccctctgcctc

SEQ ID NO: 2150060 - DNA, 17 bp, Homo sapiens
tcctcctcattcagacc

SEQ ID NO: 2150061 - DNA, 17 bp, Homo sapiens
tcctcctgccagctctg

SEQ ID NO: 2150062 - DNA, 16 bp, Homo sapiens
tcctcctgccctgtcc

SEQ ID NO: 2150063 - DNA, 14 bp, Homo sapiens
tcctctccatgcaa

SEQ ID NO: 2150064 - DNA, 22 bp, Homo sapiens
tcctctccatgcaagtgctgtt

SEQ ID NO: 2150065 - DNA, 21 bp, Homo sapiens
tcctgacccggattggccctg

SEQ ID NO: 2150066 - DNA, 12 bp, Homo sapiens
tcctgccagctc

SEQ ID NO: 2150067 - DNA, 18 bp, Homo sapiens
tcctgccagctctgtcac

SEQ ID NO: 2150068 - DNA, 12 bp, Homo sapiens
tcctgccctgtt

SEQ ID NO: 2150069 - DNA, 12 bp, Homo sapiens
tcctgctggcct

SEQ ID NO: 2150070 - DNA, 17 bp, Homo sapiens
tcctgtgcccacatccc

SEQ ID NO: 2150071 - DNA, 24 bp, Homo sapiens
tcctgttattttttatttccacat

SEQ ID NO: 2150072 - DNA, 16 bp, Homo sapiens
tccttactcagagctg

SEQ ID NO: 2150073 - DNA, 20 bp, Homo sapiens
tccttccccttgtccctggg

SEQ ID NO: 2150074 - DNA, 21 bp, Homo sapiens
tccttgcctgaactccagagg

SEQ ID NO: 2150075 - DNA, 14 bp, Homo sapiens
tcctttgagggcag

SEQ ID NO: 2150076 - DNA, 13 bp, Homo sapiens
tgaggcctccctt

SEQ ID NO: 2150077 - DNA, 14 bp, Homo sapiens
tgaggcctcccttg

SEQ ID NO: 2150078 - DNA, 16 bp, Homo sapiens
tgagggcatctctgag

SEQ ID NO: 2150079 - DNA, 17 bp, Homo sapiens
tgagggcatctctgagt

SEQ ID NO: 2150080 - DNA, 13 bp, Homo sapiens
tgagtaggccctg

SEQ ID NO: 2150081 - DNA, 15 bp, Homo sapiens
tgagtgtctctgcct

SEQ ID NO: 2150082 - DNA, 16 bp, Homo sapiens
tgagtgtctctgcctg

SEQ ID NO: 2150083 - DNA, 21 bp, Homo sapiens
tgatcagttttttcacctgga

SEQ ID NO: 2150084 - DNA, 21 bp, Homo sapiens
tgatccctgttacccagagaa

SEQ ID NO: 2150085 - DNA, 17 bp, Homo sapiens
tgattgtttgcacagag

SEQ ID NO: 2150086 - DNA, 10 bp, Homo sapiens
tgcacagagg

SEQ ID NO: 2150087 - DNA, 19 bp, Homo sapiens
tgcacattttgtacaaaga

SEQ ID NO: 2150088 - DNA, 21 bp, Homo sapiens
tgcaccagcccttccctgctt

SEQ ID NO: 2150089 - DNA, 12 bp, Homo sapiens
tgcactgagggc

SEQ ID NO: 2150090 - DNA, 19 bp, Homo sapiens
tgcactggtcccaagtagt

SEQ ID NO: 2150091 - DNA, 14 bp, Homo sapiens
tgcaggcccagcag

SEQ ID NO: 2150092 - DNA, 17 bp, Homo sapiens
tgcaggcccagcagact

SEQ ID NO: 2150093 - DNA, 13 bp, Homo sapiens
tgcaggggactgg

SEQ ID NO: 2150094 - DNA, 15 bp, Homo sapiens
tgcaggggactgggc

SEQ ID NO: 2150095 - DNA, 17 bp, Homo sapiens
tgcaggggactgggcca

SEQ ID NO: 2150096 - DNA, 18 bp, Homo sapiens
tgccacatggtgtctccc

SEQ ID NO: 2150097 - DNA, 22 bp, Homo sapiens
tgccacatggtgtctcccaaca

SEQ ID NO: 2150098 - DNA, 20 bp, Homo sapiens
tgccactctgctgcctgtac

SEQ ID NO: 2150099 - DNA, 21 bp, Homo sapiens
tgccagccgtgatgctcaggc

SEQ ID NO: 2150100 - DNA, 18 bp, Homo sapiens
tgccagctctgtcaccct

SEQ ID NO: 2150101 - DNA, 12 bp, Homo sapiens
tgccattcccac

SEQ ID NO: 2150102 - DNA, 18 bp, Homo sapiens
tgcccaagggcctcccac

SEQ ID NO: 2150103 - DNA, 21 bp, Homo sapiens
tgcccaagggcctcccaccag

SEQ ID NO: 2150104 - DNA, 21 bp, Homo sapiens
tgcccacacacactccttccc

SEQ ID NO: 2150105 - DNA, 12 bp, Homo sapiens
tgcccctcccta

SEQ ID NO: 2150106 - DNA, 19 bp, Homo sapiens
tgcccctccctagatccag

SEQ ID NO: 2150107 - DNA, 22 bp, Homo sapiens
tgcccctccctagatccaggct

SEQ ID NO: 2150108 - DNA, 21 bp, Homo sapiens
tgccccttcccatctcttcct

SEQ ID NO: 2150109 - DNA, 18 bp, Homo sapiens
tgccctcagatggagaca

SEQ ID NO: 2150110 - DNA, 18 bp, Homo sapiens
tgccctgacccctgcacc

SEQ ID NO: 2150111 - DNA, 14 bp, Homo sapiens
tgccgcctcccggg

SEQ ID NO: 2150112 - DNA, 19 bp, Homo sapiens
tgccgcctcccgggaagca

SEQ ID NO: 2150113 - DNA, 19 bp, Homo sapiens
tgcctcatcctcctcctca

SEQ ID NO: 2150114 - DNA, 23 bp, Homo sapiens
tgcctcatcctcctcctcattca

SEQ ID NO: 2150115 - DNA, 21 bp, Homo sapiens
tgcctctaactccctcctcac

SEQ ID NO: 2150116 - DNA, 14 bp, Homo sapiens
tgcctgagggtgga

SEQ ID NO: 2150117 - DNA, 17 bp, Homo sapiens
tgcctgctatttgaagt

SEQ ID NO: 2150118 - DNA, 14 bp, Homo sapiens
tgcctgctgggctc

SEQ ID NO: 2150119 - DNA, 16 bp, Homo sapiens
tgcctgctgggctctt

SEQ ID NO: 2150120 - DNA, 13 bp, Homo sapiens
tgcctgctgtgga

SEQ ID NO: 2150121 - DNA, 14 bp, Homo sapiens
tgcctggagcaggg

SEQ ID NO: 2150122 - DNA, 16 bp, Homo sapiens
tgcctgggcttatgcc

SEQ ID NO: 2150123 - DNA, 13 bp, Homo sapiens
tgcctgtacagaa

SEQ ID NO: 2150124 - DNA, 17 bp, Homo sapiens
tgccttcttcacccagc

SEQ ID NO: 2150125 - DNA, 14 bp, Homo sapiens
tgcgggctgagggc

SEQ ID NO: 2150126 - DNA, 16 bp, Homo sapiens
tgcgggctgagggcat

SEQ ID NO: 2150127 - DNA, 15 bp, Homo sapiens
tgctcaaaaatctgt

SEQ ID NO: 2150128 - DNA, 19 bp, Homo sapiens
tgctcaggcttgaaatgca

SEQ ID NO: 2150129 - DNA, 17 bp, Homo sapiens
tgctcccacggggacca

SEQ ID NO: 2150130 - DNA, 22 bp, Homo sapiens
tgctcccacggggaccactggg

SEQ ID NO: 2150131 - DNA, 15 bp, Homo sapiens
tgctcccagcagccc

SEQ ID NO: 2150132 - DNA, 17 bp, Homo sapiens
tgctcccagcagcccta

SEQ ID NO: 2150133 - DNA, 20 bp, Homo sapiens
tgctcccagcagccctaagg

SEQ ID NO: 2150134 - DNA, 11 bp, Homo sapiens
tgctcctcctg

SEQ ID NO: 2150135 - DNA, 15 bp, Homo sapiens
tgctcctcctgccct

SEQ ID NO: 2150136 - DNA, 13 bp, Homo sapiens
tgctctgcctcta

SEQ ID NO: 2150137 - DNA, 22 bp, Homo sapiens
tgctcttacttcccccaccctg

SEQ ID NO: 2150138 - DNA, 23 bp, Homo sapiens
tgctgacccaccaaggtctcaca

SEQ ID NO: 2150139 - DNA, 16 bp, Homo sapiens
tgctgccactctgctg

SEQ ID NO: 2150140 - DNA, 18 bp, Homo sapiens
tgctgccactctgctgcc

SEQ ID NO: 2150141 - DNA, 19 bp, Homo sapiens
tgctgccactctgctgcct

SEQ ID NO: 2150142 - DNA, 17 bp, Homo sapiens
tgctggcctcttggcac

SEQ ID NO: 2150143 - DNA, 21 bp, Homo sapiens
tgctggcctcttggcacctgc

SEQ ID NO: 2150144 - DNA, 13 bp, Homo sapiens
tgctggcctgctc

SEQ ID NO: 2150145 - DNA, 12 bp, Homo sapiens
tgctggcctgga

SEQ ID NO: 2150146 - DNA, 22 bp, Homo sapiens
tgctgggggctccccttgccct

SEQ ID NO: 2150147 - DNA, 15 bp, Homo sapiens
tggaacttgaactga

SEQ ID NO: 2150148 - DNA, 12 bp, Homo sapiens
tggacagcttgt

SEQ ID NO: 2150149 - DNA, 13 bp, Homo sapiens
tggacagcttgtg

SEQ ID NO: 2150150 - DNA, 19 bp, Homo sapiens
tggacctatgtcctaagga

SEQ ID NO: 2150151 - DNA, 12 bp, Homo sapiens
tggagtgagcag

SEQ ID NO: 2150152 - DNA, 15 bp, Homo sapiens
tggagtgcagggagg

SEQ ID NO: 2150153 - DNA, 19 bp, Homo sapiens
tggagtgcagggaggagag

SEQ ID NO: 2150154 - DNA, 19 bp, Homo sapiens
tggatctccccactctagg

SEQ ID NO: 2150155 - DNA, 20 bp, Homo sapiens
tggatgagacttccaaacct

SEQ ID NO: 2150156 - DNA, 13 bp, Homo sapiens
tggattgagggta

SEQ ID NO: 2150157 - DNA, 22 bp, Homo sapiens
tggattgggcagaatcctgggc

SEQ ID NO: 2150158 - DNA, 20 bp, Homo sapiens
tggcacctgcctagctcttg

SEQ ID NO: 2150159 - DNA, 15 bp, Homo sapiens
tggcagaactgctgg

SEQ ID NO: 2150160 - DNA, 17 bp, Homo sapiens
tggcagaactgctgggg

SEQ ID NO: 2150161 - DNA, 23 bp, Homo sapiens
tggcagaactgctggggctggtg

SEQ ID NO: 2150162 - DNA, 24 bp, Homo sapiens
tggcagaactgctggggctggtga

SEQ ID NO: 2150163 - DNA, 20 bp, Homo sapiens
tggcagctgggcccacagcc

SEQ ID NO: 2150164 - DNA, 20 bp, Homo sapiens
tggccaccacccaacctgtc

SEQ ID NO: 2150165 - DNA, 22 bp, Homo sapiens
tggccaccacccaacctgtcct

SEQ ID NO: 2150166 - DNA, 23 bp, Homo sapiens
tggccaccacccaacctgtcctt

SEQ ID NO: 2150167 - DNA, 22 bp, Homo sapiens
tggccacccgttctgctggcct

SEQ ID NO: 2150168 - DNA, 12 bp, Homo sapiens
tggccctgcccc

SEQ ID NO: 2150169 - DNA, 14 bp, Homo sapiens
tggccctgcccctc

SEQ ID NO: 2150170 - DNA, 15 bp, Homo sapiens
tggccctgcccctcc

SEQ ID NO: 2150171 - DNA, 18 bp, Homo sapiens
tggccctgcccctccccc

SEQ ID NO: 2150172 - DNA, 19 bp, Homo sapiens
tggccctgtgactatggct

SEQ ID NO: 2150173 - DNA, 16 bp, Homo sapiens
tggccgtggctccaga

SEQ ID NO: 2150174 - DNA, 19 bp, Homo sapiens
tggcctcttggcacctgcc

SEQ ID NO: 2150175 - DNA, 20 bp, Homo sapiens
tggcctcttggcacctgcct

SEQ ID NO: 2150176 - DNA, 12 bp, Homo sapiens
tggcctggatct

SEQ ID NO: 2150177 - DNA, 12 bp, Homo sapiens
tggcctttatta

SEQ ID NO: 2150178 - DNA, 16 bp, Homo sapiens
tggctcagctgtggtc

SEQ ID NO: 2150179 - DNA, 18 bp, Homo sapiens
tggctcagctgtggtccc

SEQ ID NO: 2150180 - DNA, 21 bp, Homo sapiens
tggctccagaatgtgctgcct

SEQ ID NO: 2150181 - DNA, 16 bp, Homo sapiens
tggctgggggagggac

SEQ ID NO: 2150182 - DNA, 20 bp, Homo sapiens
tggctgggggagggactgct

SEQ ID NO: 2150183 - DNA, 23 bp, Homo sapiens
tgggagcactggagtgcagggag

SEQ ID NO: 2150184 - DNA, 20 bp, Homo sapiens
tgggagcctgcaaactcact

SEQ ID NO: 2150185 - DNA, 16 bp, Homo sapiens
tgggcagaatcctggg

SEQ ID NO: 2150186 - DNA, 11 bp, Homo sapiens
aaaaaagtata

SEQ ID NO: 2150187 - DNA, 13 bp, Homo sapiens
aaaaagattatat

SEQ ID NO: 2150188 - DNA, 17 bp, Homo sapiens
aaaaagtatatattcta

SEQ ID NO: 2150189 - DNA, 13 bp, Homo sapiens
aaaagattatata

SEQ ID NO: 2150190 - DNA, 17 bp, Homo sapiens
aaaagattatatatcat

SEQ ID NO: 2150191 - DNA, 22 bp, Homo sapiens
aaaagattatatatcataaagt

SEQ ID NO: 2150192 - DNA, 23 bp, Homo sapiens
aaaagattatatatcataaagta

SEQ ID NO: 2150193 - DNA, 12 bp, Homo sapiens
aaaagcaagact

SEQ ID NO: 2150194 - DNA, 19 bp, Homo sapiens
aaaagttacatgtttgcac

SEQ ID NO: 2150195 - DNA, 19 bp, Homo sapiens
aaaatctgtttgatccctg

SEQ ID NO: 2150196 - DNA, 14 bp, Homo sapiens
aaagaactgcccca

SEQ ID NO: 2150197 - DNA, 15 bp, Homo sapiens
aaagaactgccccat

SEQ ID NO: 2150198 - DNA, 18 bp, Homo sapiens
aaagagaataaagacttc

SEQ ID NO: 2150199 - DNA, 12 bp, Homo sapiens
aaagattatata

SEQ ID NO: 2150200 - DNA, 20 bp, Homo sapiens
aaagcagcaggcctctggtt

SEQ ID NO: 2150201 - DNA, 15 bp, Homo sapiens
aaagccacattttgc

SEQ ID NO: 2150202 - DNA, 19 bp, Homo sapiens
aaagcttctatcccaggag

SEQ ID NO: 2150203 - DNA, 15 bp, Homo sapiens
aaagggcagtaaagt

SEQ ID NO: 2150204 - DNA, 12 bp, Homo sapiens
aaataaaataat

SEQ ID NO: 2150205 - DNA, 14 bp, Homo sapiens
aaatacagacacta

SEQ ID NO: 2150206 - DNA, 17 bp, Homo sapiens
aaatacagacactaagt

SEQ ID NO: 2150207 - DNA, 19 bp, Homo sapiens
aaatcagcgatgtgtcacc

SEQ ID NO: 2150208 - DNA, 17 bp, Homo sapiens
aaatctggcaaagttat

SEQ ID NO: 2150209 - DNA, 22 bp, Homo sapiens
aaatgagcattagctacttttc

SEQ ID NO: 2150210 - DNA, 20 bp, Homo sapiens
aaattcaacctgtgtcttat

SEQ ID NO: 2150211 - DNA, 18 bp, Homo sapiens
aaattttactgacagaaa

SEQ ID NO: 2150212 - DNA, 19 bp, Homo sapiens
aaattttactgacagaaat

SEQ ID NO: 2150213 - DNA, 20 bp, Homo sapiens
aacagcagactcagctctga

SEQ ID NO: 2150214 - DNA, 16 bp, Homo sapiens
aacatgggagggatca

SEQ ID NO: 2150215 - DNA, 21 bp, Homo sapiens
aacattttgaaaacccctggc

SEQ ID NO: 2150216 - DNA, 22 bp, Homo sapiens
aacattttgaaaacccctggct

SEQ ID NO: 2150217 - DNA, 21 bp, Homo sapiens
aaccaaagagtctctggctca

SEQ ID NO: 2150218 - DNA, 20 bp, Homo sapiens
aaccacgtaccaagccaccg

SEQ ID NO: 2150219 - DNA, 22 bp, Homo sapiens
aaccacgtaccaagccaccgca

SEQ ID NO: 2150220 - DNA, 16 bp, Homo sapiens
aaccaggggtaccagg

SEQ ID NO: 2150221 - DNA, 15 bp, Homo sapiens
aaccccagacactgg

SEQ ID NO: 2150222 - DNA, 12 bp, Homo sapiens
aacccctccccc

SEQ ID NO: 2150223 - DNA, 20 bp, Homo sapiens
aacctgacagatgtcagccg

SEQ ID NO: 2150224 - DNA, 22 bp, Homo sapiens
aacctgcccctccccagccctt

SEQ ID NO: 2150225 - DNA, 17 bp, Homo sapiens
aactatgaactacaaag

SEQ ID NO: 2150226 - DNA, 22 bp, Homo sapiens
aactcactgctcaagaagacat

SEQ ID NO: 2150227 - DNA, 10 bp, Homo sapiens
aactccctcc

SEQ ID NO: 2150228 - DNA, 14 bp, Homo sapiens
aactccctcctcac

SEQ ID NO: 2150229 - DNA, 17 bp, Homo sapiens
aactgattcacatctca

SEQ ID NO: 2150230 - DNA, 16 bp, Homo sapiens
aactgctggggctggt

SEQ ID NO: 2150231 - DNA, 14 bp, Homo sapiens
aactgtgctcccac

SEQ ID NO: 2150232 - DNA, 20 bp, Homo sapiens
aactgttgctcgaagactgt

SEQ ID NO: 2150233 - DNA, 14 bp, Homo sapiens
aacttgaactgatt

SEQ ID NO: 2150234 - DNA, 23 bp, Homo sapiens
aagaactgccccatctcctccca

SEQ ID NO: 2150235 - DNA, 17 bp, Homo sapiens
aagaagacatggagact

SEQ ID NO: 2150236 - DNA, 18 bp, Homo sapiens
aagaatgttaagacttga

SEQ ID NO: 2150237 - DNA, 17 bp, Homo sapiens
aagaggggcgggctcag

SEQ ID NO: 2150238 - DNA, 15 bp, Homo sapiens
aagagtctctccagc

SEQ ID NO: 2150239 - DNA, 15 bp, Homo sapiens
aagagtctctggctc

SEQ ID NO: 2150240 - DNA, 21 bp, Homo sapiens
aagagtctctggctcagctgt

SEQ ID NO: 2150241 - DNA, 18 bp, Homo sapiens
aagatatttatatatatt

SEQ ID NO: 2150242 - DNA, 14 bp, Homo sapiens
aagattatatatca

SEQ ID NO: 2150243 - DNA, 23 bp, Homo sapiens
aagattatatatcataaagtatg

SEQ ID NO: 2150244 - DNA, 17 bp, Homo sapiens
aagcaaagccacatttt

SEQ ID NO: 2150245 - DNA, 12 bp, Homo sapiens
aagcatcctccc

SEQ ID NO: 2150246 - DNA, 15 bp, Homo sapiens
aagcatcctccccac

SEQ ID NO: 2150247 - DNA, 21 bp, Homo sapiens
aagcatcctccccaccagagc

SEQ ID NO: 2150248 - DNA, 12 bp, Homo sapiens
aagcatgaaatg

SEQ ID NO: 2150249 - DNA, 12 bp, Homo sapiens
aagccaccgcag

SEQ ID NO: 2150250 - DNA, 18 bp, Homo sapiens
aagccaccgcagctgctg

SEQ ID NO: 2150251 - DNA, 23 bp, Homo sapiens
accagagcaggggctgctggggg

SEQ ID NO: 2150252 - DNA, 13 bp, Homo sapiens
accagagctgcct

SEQ ID NO: 2150253 - DNA, 14 bp, Homo sapiens
accagagctgcctc

SEQ ID NO: 2150254 - DNA, 18 bp, Homo sapiens
accagagctgcctcccca

SEQ ID NO: 2150255 - DNA, 19 bp, Homo sapiens
accagagctgcctccccaa

SEQ ID NO: 2150256 - DNA, 15 bp, Homo sapiens
accagcccggcctgc

SEQ ID NO: 2150257 - DNA, 13 bp, Homo sapiens
accagcccttccc

SEQ ID NO: 2150258 - DNA, 16 bp, Homo sapiens
accagcccttccctgc

SEQ ID NO: 2150259 - DNA, 16 bp, Homo sapiens
accagccgccccagcc

SEQ ID NO: 2150260 - DNA, 17 bp, Homo sapiens
accagccgccccagccc

SEQ ID NO: 2150261 - DNA, 18 bp, Homo sapiens
accaggcacatggctggg

SEQ ID NO: 2150262 - DNA, 18 bp, Homo sapiens
accaggggtaccaggcac

SEQ ID NO: 2150263 - DNA, 20 bp, Homo sapiens
accatgagaagagggcctgt

SEQ ID NO: 2150264 - DNA, 12 bp, Homo sapiens
acccaaccactc

SEQ ID NO: 2150265 - DNA, 19 bp, Homo sapiens
acccaggcaggccctgcct

SEQ ID NO: 2150266 - DNA, 17 bp, Homo sapiens
accccagcacagctcct

SEQ ID NO: 2150267 - DNA, 19 bp, Homo sapiens
accccagcacagctcctcc

SEQ ID NO: 2150268 - DNA, 20 bp, Homo sapiens
accccagcacagctcctccc

SEQ ID NO: 2150269 - DNA, 16 bp, Homo sapiens
accccagcccaccctg

SEQ ID NO: 2150270 - DNA, 20 bp, Homo sapiens
acccctcccccacgtctctc

SEQ ID NO: 2150271 - DNA, 11 bp, Homo sapiens
acccctggctg

SEQ ID NO: 2150272 - DNA, 21 bp, Homo sapiens
acccctggctgaacagtgctc

SEQ ID NO: 2150273 - DNA, 22 bp, Homo sapiens
acccctggctgaacagtgctct

SEQ ID NO: 2150274 - DNA, 16 bp, Homo sapiens
acccggattggccctg

SEQ ID NO: 2150275 - DNA, 23 bp, Homo sapiens
acccggattggccctgcccctcc

SEQ ID NO: 2150276 - DNA, 20 bp, Homo sapiens
acccgttctgctggcctgga

SEQ ID NO: 2150277 - DNA, 22 bp, Homo sapiens
acccgttctgctggcctggatc

SEQ ID NO: 2150278 - DNA, 23 bp, Homo sapiens
acccgttctgctggcctggatct

SEQ ID NO: 2150279 - DNA, 14 bp, Homo sapiens
accctgcctgctgt

SEQ ID NO: 2150280 - DNA, 22 bp, Homo sapiens
accctgcctgctgtggagccca

SEQ ID NO: 2150281 - DNA, 21 bp, Homo sapiens
accctgctcctcctgccctgt

SEQ ID NO: 2150282 - DNA, 21 bp, Homo sapiens
accctggccaccacccaacct

SEQ ID NO: 2150283 - DNA, 17 bp, Homo sapiens
accctgggtttggcccc

SEQ ID NO: 2150284 - DNA, 13 bp, Homo sapiens
acccttcctcatc

SEQ ID NO: 2150285 - DNA, 19 bp, Homo sapiens
acccttcctcatctgtgcc

SEQ ID NO: 2150286 - DNA, 21 bp, Homo sapiens
acccttcctcatctgtgcctg

SEQ ID NO: 2150287 - DNA, 13 bp, Homo sapiens
accgcagctgctg

SEQ ID NO: 2150288 - DNA, 15 bp, Homo sapiens
accgcagctgctgcc

SEQ ID NO: 2150289 - DNA, 20 bp, Homo sapiens
accgcagctgctgccactct

SEQ ID NO: 2150290 - DNA, 17 bp, Homo sapiens
accgcatggcagctggg

SEQ ID NO: 2150291 - DNA, 17 bp, Homo sapiens
acctatgtcctaaggac

SEQ ID NO: 2150292 - DNA, 19 bp, Homo sapiens
acctatgtcctaaggacac

SEQ ID NO: 2150293 - DNA, 15 bp, Homo sapiens
acctccagtcctgct

SEQ ID NO: 2150294 - DNA, 17 bp, Homo sapiens
acctccagtcctgctgg

SEQ ID NO: 2150295 - DNA, 18 bp, Homo sapiens
acctctcatcagtgtcct

SEQ ID NO: 2150296 - DNA, 16 bp, Homo sapiens
acctctccaagtctct

SEQ ID NO: 2150297 - DNA, 23 bp, Homo sapiens
acctctccaagtctctctgtgaa

SEQ ID NO: 2150298 - DNA, 12 bp, Homo sapiens
acctgacagatg

SEQ ID NO: 2150299 - DNA, 14 bp, Homo sapiens
acctgcccctcccc

SEQ ID NO: 2150300 - DNA, 21 bp, Homo sapiens
acctgcctagctcttgggcct

SEQ ID NO: 2150301 - DNA, 17 bp, Homo sapiens
acctggactagggcctc

SEQ ID NO: 2150302 - DNA, 21 bp, Homo sapiens
acctgtccttactcagagctg

SEQ ID NO: 2150303 - DNA, 23 bp, Homo sapiens
acctgtccttactcagagctgcg

SEQ ID NO: 2150304 - DNA, 12 bp, Homo sapiens
acctgtgtctta

SEQ ID NO: 2150305 - DNA, 17 bp, Homo sapiens
acctttgtccaggcctg

SEQ ID NO: 2150306 - DNA, 22 bp, Homo sapiens
acggctgcctgacactgagccc

SEQ ID NO: 2150307 - DNA, 23 bp, Homo sapiens
acggcttagacttcgactcagga

SEQ ID NO: 2150308 - DNA, 18 bp, Homo sapiens
acggggaccactgggccc

SEQ ID NO: 2150309 - DNA, 12 bp, Homo sapiens
acgtctctctgc

SEQ ID NO: 2150310 - DNA, 16 bp, Homo sapiens
acgtctctctgcctgc

SEQ ID NO: 2150311 - DNA, 17 bp, Homo sapiens
acgtctctctgcctgct

SEQ ID NO: 2150312 - DNA, 18 bp, Homo sapiens
acgtctctctgcctgctg

SEQ ID NO: 2150313 - DNA, 19 bp, Homo sapiens
acgtctctctgcctgctgg

SEQ ID NO: 2150314 - DNA, 23 bp, Homo sapiens
acgtctctctgcctgctgggctc

SEQ ID NO: 2150315 - DNA, 15 bp, Homo sapiens
acgtgactcagagct

SEQ ID NO: 2150316 - DNA, 16 bp, Homo sapiens
actaagctttctcctt

SEQ ID NO: 2150317 - DNA, 23 bp, Homo sapiens
actacaaagcttctatcccagga

SEQ ID NO: 2150318 - DNA, 20 bp, Homo sapiens
actacctttgtccaggcctg

SEQ ID NO: 2150319 - DNA, 21 bp, Homo sapiens
actagggcctcggaggctcct

SEQ ID NO: 2150320 - DNA, 15 bp, Homo sapiens
actcactgctcaaga

SEQ ID NO: 2150321 - DNA, 14 bp, Homo sapiens
actcagagctgcgg

SEQ ID NO: 2150322 - DNA, 20 bp, Homo sapiens
actcagagctgcgggctgag

SEQ ID NO: 2150323 - DNA, 13 bp, Homo sapiens
actcattagactg

SEQ ID NO: 2150324 - DNA, 15 bp, Homo sapiens
actcattagactgga

SEQ ID NO: 2150325 - DNA, 21 bp, Homo sapiens
actccagaattacccttcctc

SEQ ID NO: 2150326 - DNA, 12 bp, Homo sapiens
actcccactcct

SEQ ID NO: 2150327 - DNA, 13 bp, Homo sapiens
actcccactccta

SEQ ID NO: 2150328 - DNA, 16 bp, Homo sapiens
actcccactcctaatc

SEQ ID NO: 2150329 - DNA, 12 bp, Homo sapiens
actccctcctca

SEQ ID NO: 2150330 - DNA, 16 bp, Homo sapiens
actcctaatcaagagt

SEQ ID NO: 2150331 - DNA, 24 bp, Homo sapiens
actcctaatcaagagtctctccag

SEQ ID NO: 2150332 - DNA, 12 bp, Homo sapiens
actcctcctgcc

SEQ ID NO: 2150333 - DNA, 15 bp, Homo sapiens
actcctcctgccagc

SEQ ID NO: 2150334 - DNA, 21 bp, Homo sapiens
actcctcctgccagctctgtc

SEQ ID NO: 2150335 - DNA, 17 bp, Homo sapiens
actccttccccttgtcc

SEQ ID NO: 2150336 - DNA, 12 bp, Homo sapiens
actctgctgcct

SEQ ID NO: 2150337 - DNA, 17 bp, Homo sapiens
actcttccaccagagca

SEQ ID NO: 2150338 - DNA, 20 bp, Homo sapiens
actcttccaccagagcaggg

SEQ ID NO: 2150339 - DNA, 12 bp, Homo sapiens
actgagggccac

SEQ ID NO: 2150340 - DNA, 20 bp, Homo sapiens
actgattcacatctcatttt

SEQ ID NO: 2150341 - DNA, 16 bp, Homo sapiens
actgccaaaacaatgc

SEQ ID NO: 2150342 - DNA, 18 bp, Homo sapiens
actgctgacccaccaagg

SEQ ID NO: 2150343 - DNA, 18 bp, Homo sapiens
actggaacttgaactgat

SEQ ID NO: 2150344 - DNA, 13 bp, Homo sapiens
actggccgtggct

SEQ ID NO: 2150345 - DNA, 15 bp, Homo sapiens
actgggggaaaagat

SEQ ID NO: 2150346 - DNA, 15 bp, Homo sapiens
acttaacggctccag

SEQ ID NO: 2150347 - DNA, 17 bp, Homo sapiens
acttaacggctccagga

SEQ ID NO: 2150348 - DNA, 16 bp, Homo sapiens
acttcccccaccctgg

SEQ ID NO: 2150349 - DNA, 19 bp, Homo sapiens
acttcgactcaggatccag

SEQ ID NO: 2150350 - DNA, 20 bp, Homo sapiens
acttgccttcttcacccagc

SEQ ID NO: 2150351 - DNA, 16 bp, Homo sapiens
agaaaggttagtatca

SEQ ID NO: 2150352 - DNA, 22 bp, Homo sapiens
agaaattttactgacagaaatg

SEQ ID NO: 2150353 - DNA, 14 bp, Homo sapiens
agaactgccccatc

SEQ ID NO: 2150354 - DNA, 13 bp, Homo sapiens
agaactgctgggg

SEQ ID NO: 2150355 - DNA, 14 bp, Homo sapiens
agaactgctggggc

SEQ ID NO: 2150356 - DNA, 15 bp, Homo sapiens
agaactgctggggct

SEQ ID NO: 2150357 - DNA, 16 bp, Homo sapiens
agaagaatattcagga

SEQ ID NO: 2150358 - DNA, 20 bp, Homo sapiens
agaagacatggagactcctg

SEQ ID NO: 2150359 - DNA, 21 bp, Homo sapiens
agaaggaaaattttagcgtgc

SEQ ID NO: 2150360 - DNA, 13 bp, Homo sapiens
agaaggcctcccc

SEQ ID NO: 2150361 - DNA, 12 bp, Homo sapiens
atatatgtatat

SEQ ID NO: 2150362 - DNA, 16 bp, Homo sapiens
atatatgtatatgtat

SEQ ID NO: 2150363 - DNA, 21 bp, Homo sapiens
atatatgtatatgtatatcta

SEQ ID NO: 2150364 - DNA, 23 bp, Homo sapiens
atatatgtatatgtatatctata

SEQ ID NO: 2150365 - DNA, 15 bp, Homo sapiens
atatatttttggttg

SEQ ID NO: 2150366 - DNA, 20 bp, Homo sapiens
atatatttttggttgtcaat

SEQ ID NO: 2150367 - DNA, 12 bp, Homo sapiens
atatcagcctga

SEQ ID NO: 2150368 - DNA, 17 bp, Homo sapiens
atatctctaaactgctg

SEQ ID NO: 2150369 - DNA, 15 bp, Homo sapiens
atatctggacaagcc

SEQ ID NO: 2150370 - DNA, 15 bp, Homo sapiens
atatgattgtttgca

SEQ ID NO: 2150371 - DNA, 16 bp, Homo sapiens
atatgtacagttatct

SEQ ID NO: 2150372 - DNA, 12 bp, Homo sapiens
atatgtatatgt

SEQ ID NO: 2150373 - DNA, 13 bp, Homo sapiens
atattaaatacag

SEQ ID NO: 2150374 - DNA, 17 bp, Homo sapiens
atattaaatacagacac

SEQ ID NO: 2150375 - DNA, 13 bp, Homo sapiens
atatttactttaa

SEQ ID NO: 2150376 - DNA, 14 bp, Homo sapiens
atatttactttaaa

SEQ ID NO: 2150377 - DNA, 18 bp, Homo sapiens
atatttttggttgtcaat

SEQ ID NO: 2150378 - DNA, 19 bp, Homo sapiens
atcaaccccagacactggt

SEQ ID NO: 2150379 - DNA, 13 bp, Homo sapiens
atcaagagactga

SEQ ID NO: 2150380 - DNA, 17 bp, Homo sapiens
atcaagagtctctccag

SEQ ID NO: 2150381 - DNA, 18 bp, Homo sapiens
atcaagagtctctccagc

SEQ ID NO: 2150382 - DNA, 15 bp, Homo sapiens
atcaccagcccggcc

SEQ ID NO: 2150383 - DNA, 20 bp, Homo sapiens
atcagaagtaactcccactc

SEQ ID NO: 2150384 - DNA, 17 bp, Homo sapiens
atcagcctgagtctcct

SEQ ID NO: 2150385 - DNA, 18 bp, Homo sapiens
atcagcctgagtctcctg

SEQ ID NO: 2150386 - DNA, 19 bp, Homo sapiens
atcaggggacaaaccaggg

SEQ ID NO: 2150387 - DNA, 13 bp, Homo sapiens
atccaggcttctc

SEQ ID NO: 2150388 - DNA, 15 bp, Homo sapiens
atccaggcttctccc

SEQ ID NO: 2150389 - DNA, 16 bp, Homo sapiens
atccaggcttctcccg

SEQ ID NO: 2150390 - DNA, 18 bp, Homo sapiens
atccaggcttctcccgga

SEQ ID NO: 2150391 - DNA, 14 bp, Homo sapiens
atccatttggcaga

SEQ ID NO: 2150392 - DNA, 15 bp, Homo sapiens
atccatttggcagaa

SEQ ID NO: 2150393 - DNA, 19 bp, Homo sapiens
atcccaggcttcaccctga

SEQ ID NO: 2150394 - DNA, 22 bp, Homo sapiens
atcccctgtcccctggggctgg

SEQ ID NO: 2150395 - DNA, 14 bp, Homo sapiens
atcctccccaccag

SEQ ID NO: 2150396 - DNA, 19 bp, Homo sapiens
atcctccccaccagagctg

SEQ ID NO: 2150397 - DNA, 20 bp, Homo sapiens
atcctccccaccagagctgc

SEQ ID NO: 2150398 - DNA, 12 bp, Homo sapiens
atcctcctcctc

SEQ ID NO: 2150399 - DNA, 13 bp, Homo sapiens
atcctcctcctca

SEQ ID NO: 2150400 - DNA, 14 bp, Homo sapiens
atcctcctcctcat

SEQ ID NO: 2150401 - DNA, 16 bp, Homo sapiens
atctaagttaatttaa

SEQ ID NO: 2150402 - DNA, 15 bp, Homo sapiens
atctattcagacaag

SEQ ID NO: 2150403 - DNA, 17 bp, Homo sapiens
atctattcagacaagca

SEQ ID NO: 2150404 - DNA, 23 bp, Homo sapiens
atctcatttttccgtaaaaatga

SEQ ID NO: 2150405 - DNA, 17 bp, Homo sapiens
atctcctcccatggcct

SEQ ID NO: 2150406 - DNA, 20 bp, Homo sapiens
atctcctcccatggccttcc

SEQ ID NO: 2150407 - DNA, 22 bp, Homo sapiens
atctcctcccatggccttccct

SEQ ID NO: 2150408 - DNA, 13 bp, Homo sapiens
atctctcaggagc

SEQ ID NO: 2150409 - DNA, 14 bp, Homo sapiens
atctctcaggagca

SEQ ID NO: 2150410 - DNA, 23 bp, Homo sapiens
atctctcaggagcacaggcagct

SEQ ID NO: 2150411 - DNA, 17 bp, Homo sapiens
atctctgagtgtctctg

SEQ ID NO: 2150412 - DNA, 14 bp, Homo sapiens
atctgtccatcctc

SEQ ID NO: 2150413 - DNA, 16 bp, Homo sapiens
atctgtccatcctcct

SEQ ID NO: 2150414 - DNA, 19 bp, Homo sapiens
atctgtccatcctcctctc

SEQ ID NO: 2150415 - DNA, 18 bp, Homo sapiens
atctgtgcctgtctgtcc

SEQ ID NO: 2150416 - DNA, 22 bp, Homo sapiens
atctttctttacctgagaccag

SEQ ID NO: 2150417 - DNA, 18 bp, Homo sapiens
atgagaagagggcctgtg

SEQ ID NO: 2150418 - DNA, 18 bp, Homo sapiens
atgatgtccagaagaata

SEQ ID NO: 2150419 - DNA, 19 bp, Homo sapiens
atgatgtccagaagaatat

SEQ ID NO: 2150420 - DNA, 16 bp, Homo sapiens
atgcaagggtgacatc

SEQ ID NO: 2150421 - DNA, 13 bp, Homo sapiens
atgcaagtgctgt

SEQ ID NO: 2150422 - DNA, 14 bp, Homo sapiens
atgcaagtgctgtt

SEQ ID NO: 2150423 - DNA, 15 bp, Homo sapiens
atgcctgagggtgga

SEQ ID NO: 2150424 - DNA, 20 bp, Homo sapiens
atgctggcctcttggcacct

SEQ ID NO: 2150425 - DNA, 14 bp, Homo sapiens
atgctttctccttt

SEQ ID NO: 2150426 - DNA, 18 bp, Homo sapiens
atggaaattctgctcaga

SEQ ID NO: 2150427 - DNA, 20 bp, Homo sapiens
atggagactcctgccctgtt

SEQ ID NO: 2150428 - DNA, 19 bp, Homo sapiens
atggcagctgggcccacag

SEQ ID NO: 2150429 - DNA, 18 bp, Homo sapiens
atggccttccctccccac

SEQ ID NO: 2150430 - DNA, 11 bp, Homo sapiens
atggctggggg

SEQ ID NO: 2150431 - DNA, 22 bp, Homo sapiens
atggggtccatccccttccccc

SEQ ID NO: 2150432 - DNA, 15 bp, Homo sapiens
atgggtcctcggccc

SEQ ID NO: 2150433 - DNA, 19 bp, Homo sapiens
atgggtcctcggcccatct

SEQ ID NO: 2150434 - DNA, 14 bp, Homo sapiens
atggtactacccca

SEQ ID NO: 2150435 - DNA, 19 bp, Homo sapiens
atggtgtctcccaacatgg

SEQ ID NO: 2150436 - DNA, 20 bp, Homo sapiens
atggttgggggaatgcacct

SEQ ID NO: 2150437 - DNA, 16 bp, Homo sapiens
atgtaaagcttgtctg

SEQ ID NO: 2150438 - DNA, 13 bp, Homo sapiens
atgtatatctata

SEQ ID NO: 2150439 - DNA, 20 bp, Homo sapiens
atgtatatctatatctctaa

SEQ ID NO: 2150440 - DNA, 18 bp, Homo sapiens
atgtatatgtatatctat

SEQ ID NO: 2150441 - DNA, 13 bp, Homo sapiens
atgtcaaacaaat

SEQ ID NO: 2150442 - DNA, 21 bp, Homo sapiens
atgtcagaaactcgatgaatg

SEQ ID NO: 2150443 - DNA, 19 bp, Homo sapiens
atgtcagccgagccgggcc

SEQ ID NO: 2150444 - DNA, 21 bp, Homo sapiens
atgtccagaagaatattcagg

SEQ ID NO: 2150445 - DNA, 23 bp, Homo sapiens
atgtccagaagaatattcaggac

SEQ ID NO: 2150446 - DNA, 21 bp, Homo sapiens
atgtcctaaggacacactaat

SEQ ID NO: 2150447 - DNA, 18 bp, Homo sapiens
atgttaagacttgacagt

SEQ ID NO: 2150448 - DNA, 17 bp, Homo sapiens
atgtttgcacctttcta

SEQ ID NO: 2150449 - DNA, 20 bp, Homo sapiens
attaaaaactgagtgactct

SEQ ID NO: 2150450 - DNA, 16 bp, Homo sapiens
attacccttcctcatc

SEQ ID NO: 2150451 - DNA, 22 bp, Homo sapiens
attagactggaacttgaactga

SEQ ID NO: 2150452 - DNA, 15 bp, Homo sapiens
attagactggacagc

SEQ ID NO: 2150453 - DNA, 22 bp, Homo sapiens
attagtttgatttaatatctga

SEQ ID NO: 2150454 - DNA, 18 bp, Homo sapiens
attatatatcataaagta

SEQ ID NO: 2150455 - DNA, 11 bp, Homo sapiens
attcaaaacat

SEQ ID NO: 2150456 - DNA, 18 bp, Homo sapiens
attcaacctgtgtcttat

SEQ ID NO: 2150457 - DNA, 14 bp, Homo sapiens
attcatgctttctc

SEQ ID NO: 2150458 - DNA, 15 bp, Homo sapiens
attcatgctttctcc

SEQ ID NO: 2150459 - DNA, 19 bp, Homo sapiens
attcatgctttctcctttt

SEQ ID NO: 2150460 - DNA, 22 bp, Homo sapiens
attcccacccaattcaaaacat

SEQ ID NO: 2150461 - DNA, 18 bp, Homo sapiens
attctaataaatcaatgt

SEQ ID NO: 2150462 - DNA, 19 bp, Homo sapiens
attctacacatatatgtat

SEQ ID NO: 2150463 - DNA, 24 bp, Homo sapiens
attctacacatatatgtatatgta

SEQ ID NO: 2150464 - DNA, 21 bp, Homo sapiens
attctgattcgaatgacactg

SEQ ID NO: 2150465 - DNA, 19 bp, Homo sapiens
attgaaggagaaaatgcat

SEQ ID NO: 2150466 - DNA, 19 bp, Homo sapiens
attgggcagaatcctgggc

SEQ ID NO: 2150467 - DNA, 22 bp, Homo sapiens
attgggcagaatcctgggcccc

SEQ ID NO: 2150468 - DNA, 18 bp, Homo sapiens
attgtgccatgtcaaaca

SEQ ID NO: 2150469 - DNA, 16 bp, Homo sapiens
atttaatatctgagaa

SEQ ID NO: 2150470 - DNA, 20 bp, Homo sapiens
atttctaggtaggaaatgtg

SEQ ID NO: 2150471 - DNA, 16 bp, Homo sapiens
cccagacactggtttg

SEQ ID NO: 2150472 - DNA, 17 bp, Homo sapiens
cccagcacagctcctcc

SEQ ID NO: 2150473 - DNA, 21 bp, Homo sapiens
cccagcacagctcctcccctg

SEQ ID NO: 2150474 - DNA, 19 bp, Homo sapiens
cccagcccaccctgctcct

SEQ ID NO: 2150475 - DNA, 20 bp, Homo sapiens
cccagcccaccctgctcctc

SEQ ID NO: 2150476 - DNA, 15 bp, Homo sapiens
cccagccccttctcc

SEQ ID NO: 2150477 - DNA, 20 bp, Homo sapiens
cccagccccttctcccagca

SEQ ID NO: 2150478 - DNA, 16 bp, Homo sapiens
cccaggaagggaggga

SEQ ID NO: 2150479 - DNA, 18 bp, Homo sapiens
cccaggaagggagggagc

SEQ ID NO: 2150480 - DNA, 24 bp, Homo sapiens
cccaggaagggagggagctgaggc

SEQ ID NO: 2150481 - DNA, 13 bp, Homo sapiens
cccatctcctccc

SEQ ID NO: 2150482 - DNA, 11 bp, Homo sapiens
cccatctgtcc

SEQ ID NO: 2150483 - DNA, 17 bp, Homo sapiens
cccatctgtccatcctc

SEQ ID NO: 2150484 - DNA, 21 bp, Homo sapiens
cccatctgtccatcctcctct

SEQ ID NO: 2150485 - DNA, 22 bp, Homo sapiens
cccatctgtccatcctcctctc

SEQ ID NO: 2150486 - DNA, 17 bp, Homo sapiens
ccccaagaggggcgggc

SEQ ID NO: 2150487 - DNA, 19 bp, Homo sapiens
ccccacaccccagcccacc

SEQ ID NO: 2150488 - DNA, 13 bp, Homo sapiens
ccccaccccagca

SEQ ID NO: 2150489 - DNA, 18 bp, Homo sapiens
ccccaccccagcacagct

SEQ ID NO: 2150490 - DNA, 19 bp, Homo sapiens
ccccaccccagcacagctc

SEQ ID NO: 2150491 - DNA, 12 bp, Homo sapiens
ccccaccctggg

SEQ ID NO: 2150492 - DNA, 13 bp, Homo sapiens
ccccacctctcca

SEQ ID NO: 2150493 - DNA, 14 bp, Homo sapiens
ccccacctctccaa

SEQ ID NO: 2150494 - DNA, 15 bp, Homo sapiens
ccccacgtctctctg

SEQ ID NO: 2150495 - DNA, 23 bp, Homo sapiens
ccccacgtctctctgcctgctgg

SEQ ID NO: 2150496 - DNA, 20 bp, Homo sapiens
ccccagagacctttgcccac

SEQ ID NO: 2150497 - DNA, 22 bp, Homo sapiens
ccccagagacctttgcccacac

SEQ ID NO: 2150498 - DNA, 15 bp, Homo sapiens
ccccagagccactac

SEQ ID NO: 2150499 - DNA, 21 bp, Homo sapiens
ccccagagccactacctttgt

SEQ ID NO: 2150500 - DNA, 12 bp, Homo sapiens
ccccagcccacc

SEQ ID NO: 2150501 - DNA, 21 bp, Homo sapiens
ccccagccccttctcccagca

SEQ ID NO: 2150502 - DNA, 20 bp, Homo sapiens
ccccatctcctcccatggcc

SEQ ID NO: 2150503 - DNA, 14 bp, Homo sapiens
cccccaccccagca

SEQ ID NO: 2150504 - DNA, 18 bp, Homo sapiens
cccccacgtctctctgcc

SEQ ID NO: 2150505 - DNA, 18 bp, Homo sapiens
cccccagagacctttgcc

SEQ ID NO: 2150506 - DNA, 22 bp, Homo sapiens
cccccagagacctttgcccaca

SEQ ID NO: 2150507 - DNA, 20 bp, Homo sapiens
ccccctaccgcatggcagct

SEQ ID NO: 2150508 - DNA, 18 bp, Homo sapiens
cccctaccgcatggcagc

SEQ ID NO: 2150509 - DNA, 21 bp, Homo sapiens
cccctaccgcatggcagctgg

SEQ ID NO: 2150510 - DNA, 21 bp, Homo sapiens
cccctcaggggaagctgctag

SEQ ID NO: 2150511 - DNA, 23 bp, Homo sapiens
cccctcaggggaagctgctaggg

SEQ ID NO: 2150512 - DNA, 16 bp, Homo sapiens
cccctccccctaccgc

SEQ ID NO: 2150513 - DNA, 16 bp, Homo sapiens
cccctccctagatcca

SEQ ID NO: 2150514 - DNA, 21 bp, Homo sapiens
cccctgaggatcccctgtccc

SEQ ID NO: 2150515 - DNA, 22 bp, Homo sapiens
cccctgcccgaccccatctcat

SEQ ID NO: 2150516 - DNA, 12 bp, Homo sapiens
cccctgccgcct

SEQ ID NO: 2150517 - DNA, 15 bp, Homo sapiens
cccctgccgcctccc

SEQ ID NO: 2150518 - DNA, 16 bp, Homo sapiens
cccctggaacctttcc

SEQ ID NO: 2150519 - DNA, 17 bp, Homo sapiens
cccctggaacctttccc

SEQ ID NO: 2150520 - DNA, 19 bp, Homo sapiens
cccctggaacctttccctt

SEQ ID NO: 2150521 - DNA, 16 bp, Homo sapiens
cccctggctgaacagt

SEQ ID NO: 2150522 - DNA, 15 bp, Homo sapiens
cccctggggctggtg

SEQ ID NO: 2150523 - DNA, 19 bp, Homo sapiens
cccctgtcccctggggctg

SEQ ID NO: 2150524 - DNA, 16 bp, Homo sapiens
ccccttctcccagcac

SEQ ID NO: 2150525 - DNA, 11 bp, Homo sapiens
ccccttgccct

SEQ ID NO: 2150526 - DNA, 15 bp, Homo sapiens
ccccttgcccttcct

SEQ ID NO: 2150527 - DNA, 18 bp, Homo sapiens
ccccttgtccctggggca

SEQ ID NO: 2150528 - DNA, 14 bp, Homo sapiens
cccgaccccatctc

SEQ ID NO: 2150529 - DNA, 14 bp, Homo sapiens
cccgcctgtcacaa

SEQ ID NO: 2150530 - DNA, 17 bp, Homo sapiens
cccggattggccctgcc

SEQ ID NO: 2150531 - DNA, 20 bp, Homo sapiens
cccggattggccctgcccct

SEQ ID NO: 2150532 - DNA, 22 bp, Homo sapiens
cccggattggccctgcccctcc

SEQ ID NO: 2150533 - DNA, 20 bp, Homo sapiens
cccggcctgctcccagcagc

SEQ ID NO: 2150534 - DNA, 22 bp, Homo sapiens
cccgggaagcatcctccccacc

SEQ ID NO: 2150535 - DNA, 19 bp, Homo sapiens
ccctaaggatctctcagga

SEQ ID NO: 2150536 - DNA, 13 bp, Homo sapiens
ccctaccactgtg

SEQ ID NO: 2150537 - DNA, 19 bp, Homo sapiens
ccctaccgcatggcagctg

SEQ ID NO: 2150538 - DNA, 15 bp, Homo sapiens
ccctagatccaggct

SEQ ID NO: 2150539 - DNA, 23 bp, Homo sapiens
ccctagatccaggcttctcccgg

SEQ ID NO: 2150540 - DNA, 18 bp, Homo sapiens
ccctcacagactcttcca

SEQ ID NO: 2150541 - DNA, 23 bp, Homo sapiens
ccctcacagactcttccaccaga

SEQ ID NO: 2150542 - DNA, 16 bp, Homo sapiens
ccctcaggggaagctg

SEQ ID NO: 2150543 - DNA, 13 bp, Homo sapiens
ccctcccagtcct

SEQ ID NO: 2150544 - DNA, 14 bp, Homo sapiens
ccctcccagtcctc

SEQ ID NO: 2150545 - DNA, 16 bp, Homo sapiens
ccctccccacagtcct

SEQ ID NO: 2150546 - DNA, 15 bp, Homo sapiens
ccctccccagccctt

SEQ ID NO: 2150547 - DNA, 22 bp, Homo sapiens
ccctcccccacgtctctctgcc

SEQ ID NO: 2150548 - DNA, 13 bp, Homo sapiens
ccctcctcacact

SEQ ID NO: 2150549 - DNA, 14 bp, Homo sapiens
ccctctgcctcatc

SEQ ID NO: 2150550 - DNA, 16 bp, Homo sapiens
ccctctgcctcatcct

SEQ ID NO: 2150551 - DNA, 17 bp, Homo sapiens
ccctctgcctcatcctc

SEQ ID NO: 2150552 - DNA, 22 bp, Homo sapiens
ccctgcccaagggcctcccacc

SEQ ID NO: 2150553 - DNA, 19 bp, Homo sapiens
ccctgcccctccccctacc

SEQ ID NO: 2150554 - DNA, 21 bp, Homo sapiens
ccctgcccctccccctaccgc

SEQ ID NO: 2150555 - DNA, 21 bp, Homo sapiens
ccctgcctgctgtggagccca

SEQ ID NO: 2150556 - DNA, 20 bp, Homo sapiens
ccctggccaccacccaacct

SEQ ID NO: 2150557 - DNA, 19 bp, Homo sapiens
ccctggggcactcccccag

SEQ ID NO: 2150558 - DNA, 19 bp, Homo sapiens
ccctggggctggtggattg

SEQ ID NO: 2150559 - DNA, 14 bp, Homo sapiens
ccctgtcccctggg

SEQ ID NO: 2150560 - DNA, 16 bp, Homo sapiens
ccctgtcccctggggc

SEQ ID NO: 2150561 - DNA, 17 bp, Homo sapiens
ccctgtcccctggggct

SEQ ID NO: 2150562 - DNA, 19 bp, Homo sapiens
ccctgtcccctggggctgg

SEQ ID NO: 2150563 - DNA, 16 bp, Homo sapiens
ccctgtccctgtcccc

SEQ ID NO: 2150564 - DNA, 15 bp, Homo sapiens
ccctgtcgagacact

SEQ ID NO: 2150565 - DNA, 20 bp, Homo sapiens
ccctgtcgagacacttgcct

SEQ ID NO: 2150566 - DNA, 18 bp, Homo sapiens
ccctgtgactatggctct

SEQ ID NO: 2150567 - DNA, 18 bp, Homo sapiens
cccttcctcatctgtgcc

SEQ ID NO: 2150568 - DNA, 19 bp, Homo sapiens
cccttcctcatctgtgcct

SEQ ID NO: 2150569 - DNA, 12 bp, Homo sapiens
cccttcctgacc

SEQ ID NO: 2150570 - DNA, 13 bp, Homo sapiens
cccttcctgaccc

SEQ ID NO: 2150571 - DNA, 18 bp, Homo sapiens
cccttcctgacccggatt

SEQ ID NO: 2150572 - DNA, 17 bp, Homo sapiens
cccttgagtaggccctg

SEQ ID NO: 2150573 - DNA, 14 bp, Homo sapiens
cccttgcccttcct

SEQ ID NO: 2150574 - DNA, 19 bp, Homo sapiens
cccttgcccttcctgaccc

SEQ ID NO: 2150575 - DNA, 15 bp, Homo sapiens
cccttgtccctgggg

SEQ ID NO: 2150576 - DNA, 16 bp, Homo sapiens
cccttgtccctggggc

SEQ ID NO: 2150577 - DNA, 23 bp, Homo sapiens
cccttgtccctggggcactcccc

SEQ ID NO: 2150578 - DNA, 19 bp, Homo sapiens
cccttgtgtgtaccacacc

SEQ ID NO: 2150579 - DNA, 20 bp, Homo sapiens
ccctttgcaggcccagcaga

SEQ ID NO: 2150580 - DNA, 14 bp, Homo sapiens
ctcggaggctcctc

SEQ ID NO: 2150581 - DNA, 16 bp, Homo sapiens
ctcggaggctcctccc

SEQ ID NO: 2150582 - DNA, 22 bp, Homo sapiens
ctcggaggctcctccctctgcc

SEQ ID NO: 2150583 - DNA, 15 bp, Homo sapiens
ctcggcccatctgtc

SEQ ID NO: 2150584 - DNA, 18 bp, Homo sapiens
ctcggcccatctgtccat

SEQ ID NO: 2150585 - DNA, 14 bp, Homo sapiens
ctctaactccctcc

SEQ ID NO: 2150586 - DNA, 16 bp, Homo sapiens
ctctaactccctcctc

SEQ ID NO: 2150587 - DNA, 18 bp, Homo sapiens
ctctaactccctcctcac

SEQ ID NO: 2150588 - DNA, 15 bp, Homo sapiens
ctctcaggagcacag

SEQ ID NO: 2150589 - DNA, 17 bp, Homo sapiens
ctctcaggagcacaggc

SEQ ID NO: 2150590 - DNA, 19 bp, Homo sapiens
ctctcaggagcacaggcag

SEQ ID NO: 2150591 - DNA, 18 bp, Homo sapiens
ctctccaagtctctctgt

SEQ ID NO: 2150592 - DNA, 19 bp, Homo sapiens
ctctccatgcaagtgctgt

SEQ ID NO: 2150593 - DNA, 20 bp, Homo sapiens
ctctccatgcaagtgctgtt

SEQ ID NO: 2150594 - DNA, 15 bp, Homo sapiens
ctctctgcctgctgg

SEQ ID NO: 2150595 - DNA, 15 bp, Homo sapiens
ctctctgtgaataca

SEQ ID NO: 2150596 - DNA, 21 bp, Homo sapiens
ctctctgtgaatacaattaaa

SEQ ID NO: 2150597 - DNA, 14 bp, Homo sapiens
ctctgcctcatcct

SEQ ID NO: 2150598 - DNA, 16 bp, Homo sapiens
ctctgcctcatcctcc

SEQ ID NO: 2150599 - DNA, 20 bp, Homo sapiens
ctctgcctctaactccctcc

SEQ ID NO: 2150600 - DNA, 15 bp, Homo sapiens
ctctgcctgctgggc

SEQ ID NO: 2150601 - DNA, 14 bp, Homo sapiens
ctctgcctggagca

SEQ ID NO: 2150602 - DNA, 12 bp, Homo sapiens
ctctgctgcctg

SEQ ID NO: 2150603 - DNA, 18 bp, Homo sapiens
ctctggctcagctgtggt

SEQ ID NO: 2150604 - DNA, 19 bp, Homo sapiens
ctctggctcagctgtggtc

SEQ ID NO: 2150605 - DNA, 22 bp, Homo sapiens
ctctggctcagctgtggtccca

SEQ ID NO: 2150606 - DNA, 17 bp, Homo sapiens
ctctgtgaatacaatta

SEQ ID NO: 2150607 - DNA, 18 bp, Homo sapiens
ctctgtgaatacaattaa

SEQ ID NO: 2150608 - DNA, 15 bp, Homo sapiens
ctcttacttccccca

SEQ ID NO: 2150609 - DNA, 18 bp, Homo sapiens
ctcttacttcccccaccc

SEQ ID NO: 2150610 - DNA, 16 bp, Homo sapiens
ctcttccaccagagca

SEQ ID NO: 2150611 - DNA, 17 bp, Homo sapiens
ctcttccaccagagcag

SEQ ID NO: 2150612 - DNA, 19 bp, Homo sapiens
ctcttccaccagagcaggg

SEQ ID NO: 2150613 - DNA, 12 bp, Homo sapiens
ctcttgctcaaa

SEQ ID NO: 2150614 - DNA, 19 bp, Homo sapiens
ctcttgctcaaaaatctgt

SEQ ID NO: 2150615 - DNA, 14 bp, Homo sapiens
ctcttggcacctgc

SEQ ID NO: 2150616 - DNA, 21 bp, Homo sapiens
ctcttggcacctgcctagctc

SEQ ID NO: 2150617 - DNA, 23 bp, Homo sapiens
ctcttggcacctgcctagctctt

SEQ ID NO: 2150618 - DNA, 12 bp, Homo sapiens
ctcttgggcctg

SEQ ID NO: 2150619 - DNA, 16 bp, Homo sapiens
ctcttgggcctgacct

SEQ ID NO: 2150620 - DNA, 17 bp, Homo sapiens
ctcttgggcctgacctc

SEQ ID NO: 2150621 - DNA, 22 bp, Homo sapiens
ctcttgggcctgacctccagtc

SEQ ID NO: 2150622 - DNA, 23 bp, Homo sapiens
ctcttgggcctgacctccagtcc

SEQ ID NO: 2150623 - DNA, 13 bp, Homo sapiens
ctgaacaaaagct

SEQ ID NO: 2150624 - DNA, 12 bp, Homo sapiens
ctgaacagtgct

SEQ ID NO: 2150625 - DNA, 15 bp, Homo sapiens
ctgaacagtgctctg

SEQ ID NO: 2150626 - DNA, 20 bp, Homo sapiens
ctgaacagtgctctgcctct

SEQ ID NO: 2150627 - DNA, 13 bp, Homo sapiens
ctgaactccagag

SEQ ID NO: 2150628 - DNA, 14 bp, Homo sapiens
ctgacactgagccc

SEQ ID NO: 2150629 - DNA, 17 bp, Homo sapiens
ctgacactgagccccac

SEQ ID NO: 2150630 - DNA, 19 bp, Homo sapiens
ctgacactgagccccacct

SEQ ID NO: 2150631 - DNA, 22 bp, Homo sapiens
ctgacccaccaaggtctcacac

SEQ ID NO: 2150632 - DNA, 21 bp, Homo sapiens
ctgacccggattggccctgcc

SEQ ID NO: 2150633 - DNA, 12 bp, Homo sapiens
ctgacctccagt

SEQ ID NO: 2150634 - DNA, 18 bp, Homo sapiens
ctgacctccagtcctgct

SEQ ID NO: 2150635 - DNA, 20 bp, Homo sapiens
ctgacctccagtcctgctgg

SEQ ID NO: 2150636 - DNA, 22 bp, Homo sapiens
ctgacctccagtcctgctggcc

SEQ ID NO: 2150637 - DNA, 24 bp, Homo sapiens
ctgacctccagtcctgctggcctg

SEQ ID NO: 2150638 - DNA, 19 bp, Homo sapiens
ctgagaccagttgggagca

SEQ ID NO: 2150639 - DNA, 15 bp, Homo sapiens
ctgagccccacctct

SEQ ID NO: 2150640 - DNA, 17 bp, Homo sapiens
ctgagccccacctctcc

SEQ ID NO: 2150641 - DNA, 22 bp, Homo sapiens
ctgaggatcccctgtcccctgg

SEQ ID NO: 2150642 - DNA, 23 bp, Homo sapiens
ctgaggatcccctgtcccctggg

SEQ ID NO: 2150643 - DNA, 14 bp, Homo sapiens
ctgaggcctccctt

SEQ ID NO: 2150644 - DNA, 16 bp, Homo sapiens
ctgagggcatctctga

SEQ ID NO: 2150645 - DNA, 13 bp, Homo sapiens
ctgagggccacac

SEQ ID NO: 2150646 - DNA, 16 bp, Homo sapiens
ctgagggccacactat

SEQ ID NO: 2150647 - DNA, 19 bp, Homo sapiens
ctgagggtggagactaagc

SEQ ID NO: 2150648 - DNA, 15 bp, Homo sapiens
ctgagtgtctctgcc

SEQ ID NO: 2150649 - DNA, 22 bp, Homo sapiens
ctgagtgtctctgcctggagca

SEQ ID NO: 2150650 - DNA, 23 bp, Homo sapiens
ctgcaccagcccttccctgcttt

SEQ ID NO: 2150651 - DNA, 12 bp, Homo sapiens
ctgccactctgc

SEQ ID NO: 2150652 - DNA, 14 bp, Homo sapiens
ctgccactctgctg

SEQ ID NO: 2150653 - DNA, 15 bp, Homo sapiens
ctgccactctgctgc

SEQ ID NO: 2150654 - DNA, 17 bp, Homo sapiens
ctgccactctgctgcct

SEQ ID NO: 2150655 - DNA, 17 bp, Homo sapiens
ctgcccaagggcctccc

SEQ ID NO: 2150656 - DNA, 22 bp, Homo sapiens
ctgcccaagggcctcccaccag

SEQ ID NO: 2150657 - DNA, 13 bp, Homo sapiens
ctgccccatctcc

SEQ ID NO: 2150658 - DNA, 16 bp, Homo sapiens
ctgccccatctcctcc

SEQ ID NO: 2150659 - DNA, 11 bp, Homo sapiens
ctgcccctccc

SEQ ID NO: 2150660 - DNA, 21 bp, Homo sapiens
ctgcccctccctagatccagg

SEQ ID NO: 2150661 - DNA, 23 bp, Homo sapiens
ctgcccctccctagatccaggct

SEQ ID NO: 2150662 - DNA, 19 bp, Homo sapiens
ctgccctgttgtgtataga

SEQ ID NO: 2150663 - DNA, 23 bp, Homo sapiens
ctgccgggttctagtctcctttg

SEQ ID NO: 2150664 - DNA, 23 bp, Homo sapiens
ctgcctagctcttgggcctgacc

SEQ ID NO: 2150665 - DNA, 17 bp, Homo sapiens
ctgcctccccaatccat

SEQ ID NO: 2150666 - DNA, 21 bp, Homo sapiens
ctgcctctaactccctcctca

SEQ ID NO: 2150667 - DNA, 22 bp, Homo sapiens
ctgcctctaactccctcctcac

SEQ ID NO: 2150668 - DNA, 12 bp, Homo sapiens
ctgcctgctggg

SEQ ID NO: 2150669 - DNA, 12 bp, Homo sapiens
ctgcctgctgtg

SEQ ID NO: 2150670 - DNA, 13 bp, Homo sapiens
ctgcctgctgtgg

SEQ ID NO: 2150671 - DNA, 16 bp, Homo sapiens
ctgcctgctgtggagc

SEQ ID NO: 2150672 - DNA, 15 bp, Homo sapiens
ctgcctggagcaggg

SEQ ID NO: 2150673 - DNA, 16 bp, Homo sapiens
ctgcctggagcagggg

SEQ ID NO: 2150674 - DNA, 17 bp, Homo sapiens
ctgcctggagcaggggt

SEQ ID NO: 2150675 - DNA, 20 bp, Homo sapiens
ctgcgggctgagggcatctc

SEQ ID NO: 2150676 - DNA, 23 bp, Homo sapiens
ctgctaggggaaggactggccgt

SEQ ID NO: 2150677 - DNA, 14 bp, Homo sapiens
ctgctatttgaagt

SEQ ID NO: 2150678 - DNA, 14 bp, Homo sapiens
ctgctcccagcagc

SEQ ID NO: 2150679 - DNA, 16 bp, Homo sapiens
ctgctcccagcagccc

SEQ ID NO: 2150680 - DNA, 19 bp, Homo sapiens
ctgctcttacttcccccac

SEQ ID NO: 2150681 - DNA, 15 bp, Homo sapiens
ctgctgacccaccaa

SEQ ID NO: 2150682 - DNA, 14 bp, Homo sapiens
ctgctgccactctg

SEQ ID NO: 2150683 - DNA, 20 bp, Homo sapiens
ctgctgccactctgctgcct

SEQ ID NO: 2150684 - DNA, 13 bp, Homo sapiens
ctgctggcctgct

SEQ ID NO: 2150685 - DNA, 14 bp, Homo sapiens
ctgctggcctgctc

SEQ ID NO: 2150686 - DNA, 13 bp, Homo sapiens
ctgctgggctctt

SEQ ID NO: 2150687 - DNA, 15 bp, Homo sapiens
ctgctggggctggtg

SEQ ID NO: 2150688 - DNA, 16 bp, Homo sapiens
ctgctgggggctcccc

SEQ ID NO: 2150689 - DNA, 21 bp, Homo sapiens
ctgctgggggctccccttgcc

SEQ ID NO: 2150690 - DNA, 11 bp, Homo sapiens
gccccagcccc

SEQ ID NO: 2150691 - DNA, 16 bp, Homo sapiens
gccccagccccttctc

SEQ ID NO: 2150692 - DNA, 14 bp, Homo sapiens
gccccagtgacagc

SEQ ID NO: 2150693 - DNA, 20 bp, Homo sapiens
gccccgcctgtcacaataaa

SEQ ID NO: 2150694 - DNA, 18 bp, Homo sapiens
gcccctcaggggaagctg

SEQ ID NO: 2150695 - DNA, 20 bp, Homo sapiens
gcccctcaggggaagctgct

SEQ ID NO: 2150696 - DNA, 21 bp, Homo sapiens
gcccctcaggggaagctgcta

SEQ ID NO: 2150697 - DNA, 16 bp, Homo sapiens
gcccctccccagccct

SEQ ID NO: 2150698 - DNA, 17 bp, Homo sapiens
gcccctccctagatcca

SEQ ID NO: 2150699 - DNA, 20 bp, Homo sapiens
gcccctggaacctttccctt

SEQ ID NO: 2150700 - DNA, 18 bp, Homo sapiens
gccctaggattcctcccc

SEQ ID NO: 2150701 - DNA, 17 bp, Homo sapiens
gccctgacccctgcacc

SEQ ID NO: 2150702 - DNA, 12 bp, Homo sapiens
gccctgcccctc

SEQ ID NO: 2150703 - DNA, 13 bp, Homo sapiens
gccctgcccctcc

SEQ ID NO: 2150704 - DNA, 16 bp, Homo sapiens
gccctgcccctcccta

SEQ ID NO: 2150705 - DNA, 22 bp, Homo sapiens
gccctgcccctccctagatcca

SEQ ID NO: 2150706 - DNA, 20 bp, Homo sapiens
gccctgctttatcaggggac

SEQ ID NO: 2150707 - DNA, 20 bp, Homo sapiens
gccctggcccagagctggaa

SEQ ID NO: 2150708 - DNA, 17 bp, Homo sapiens
gccctgtcgagacactt

SEQ ID NO: 2150709 - DNA, 17 bp, Homo sapiens
gccctgttgtgtataga

SEQ ID NO: 2150710 - DNA, 23 bp, Homo sapiens
gccctttgcaggcccagcagact

SEQ ID NO: 2150711 - DNA, 15 bp, Homo sapiens
gccgagccgggcctg

SEQ ID NO: 2150712 - DNA, 12 bp, Homo sapiens
gccgccccagcc

SEQ ID NO: 2150713 - DNA, 17 bp, Homo sapiens
gccgccccagccccttc

SEQ ID NO: 2150714 - DNA, 18 bp, Homo sapiens
gccggccctgcccctccc

SEQ ID NO: 2150715 - DNA, 22 bp, Homo sapiens
gccgtggctccagaatgtgctg

SEQ ID NO: 2150716 - DNA, 17 bp, Homo sapiens
gcctagctcttgggcct

SEQ ID NO: 2150717 - DNA, 19 bp, Homo sapiens
gcctagctcttgggcctga

SEQ ID NO: 2150718 - DNA, 14 bp, Homo sapiens
gcctcacagatgct

SEQ ID NO: 2150719 - DNA, 22 bp, Homo sapiens
gcctcacagatgctggcctctt

SEQ ID NO: 2150720 - DNA, 15 bp, Homo sapiens
gcctcatcctcctcc

SEQ ID NO: 2150721 - DNA, 16 bp, Homo sapiens
gcctcatcctcctcct

SEQ ID NO: 2150722 - DNA, 18 bp, Homo sapiens
gcctcatcctcctcctca

SEQ ID NO: 2150723 - DNA, 19 bp, Homo sapiens
gcctcatcctcctcctcat

SEQ ID NO: 2150724 - DNA, 23 bp, Homo sapiens
gcctccagtcatggtactacccc

SEQ ID NO: 2150725 - DNA, 14 bp, Homo sapiens
gcctccccaatcca

SEQ ID NO: 2150726 - DNA, 22 bp, Homo sapiens
gcctccccaatccatttggcag

SEQ ID NO: 2150727 - DNA, 14 bp, Homo sapiens
gcctcccccgcctc

SEQ ID NO: 2150728 - DNA, 23 bp, Homo sapiens
gcctcccgggaagcatcctcccc

SEQ ID NO: 2150729 - DNA, 21 bp, Homo sapiens
gcctcccttgagtaggccctg

SEQ ID NO: 2150730 - DNA, 23 bp, Homo sapiens
gcctcccttgagtaggccctgct

SEQ ID NO: 2150731 - DNA, 20 bp, Homo sapiens
gcctcggaggctcctccctc

SEQ ID NO: 2150732 - DNA, 20 bp, Homo sapiens
gcctctaactccctcctcac

SEQ ID NO: 2150733 - DNA, 22 bp, Homo sapiens
gcctctggttgcctcccccgcc

SEQ ID NO: 2150734 - DNA, 13 bp, Homo sapiens
gcctgaactccag

SEQ ID NO: 2150735 - DNA, 15 bp, Homo sapiens
gcctgaactccagag

SEQ ID NO: 2150736 - DNA, 21 bp, Homo sapiens
gcctgacactgagccccacct

SEQ ID NO: 2150737 - DNA, 23 bp, Homo sapiens
gcctgacctccagtcctgctggc

SEQ ID NO: 2150738 - DNA, 12 bp, Homo sapiens
gcctgagggtgg

SEQ ID NO: 2150739 - DNA, 14 bp, Homo sapiens
gcctgagggtggag

SEQ ID NO: 2150740 - DNA, 20 bp, Homo sapiens
gcctgctatttgaagtgtaa

SEQ ID NO: 2150741 - DNA, 19 bp, Homo sapiens
gcctgtaacaagccagatt

SEQ ID NO: 2150742 - DNA, 19 bp, Homo sapiens
gcctgtacagaagaaactg

SEQ ID NO: 2150743 - DNA, 13 bp, Homo sapiens
gcctgtcacaata

SEQ ID NO: 2150744 - DNA, 20 bp, Homo sapiens
gcctgtctgtccaacccctc

SEQ ID NO: 2150745 - DNA, 17 bp, Homo sapiens
gccttcttcacccagct

SEQ ID NO: 2150746 - DNA, 11 bp, Homo sapiens
gcgggctcaga

SEQ ID NO: 2150747 - DNA, 12 bp, Homo sapiens
gcgggctcagag

SEQ ID NO: 2150748 - DNA, 13 bp, Homo sapiens
gcgggctgagggc

SEQ ID NO: 2150749 - DNA, 17 bp, Homo sapiens
gctaatctgtagggctg

SEQ ID NO: 2150750 - DNA, 18 bp, Homo sapiens
gctaatctgtagggctgg

SEQ ID NO: 2150751 - DNA, 19 bp, Homo sapiens
gctaatctgtagggctgga

SEQ ID NO: 2150752 - DNA, 14 bp, Homo sapiens
gctatttgaagtgt

SEQ ID NO: 2150753 - DNA, 11 bp, Homo sapiens
gctcagagctt

SEQ ID NO: 2150754 - DNA, 13 bp, Homo sapiens
gctcagagctttg

SEQ ID NO: 2150755 - DNA, 19 bp, Homo sapiens
gctcagatagaatgacagt

SEQ ID NO: 2150756 - DNA, 17 bp, Homo sapiens
gctccagaatgtgctgc

SEQ ID NO: 2150757 - DNA, 21 bp, Homo sapiens
gctccagaatgtgctgccttt

SEQ ID NO: 2150758 - DNA, 20 bp, Homo sapiens
gctcccacggggaccactgg

SEQ ID NO: 2150759 - DNA, 19 bp, Homo sapiens
gctcccagcagccctaagg

SEQ ID NO: 2150760 - DNA, 17 bp, Homo sapiens
gctcctcccctgccgcc

SEQ ID NO: 2150761 - DNA, 19 bp, Homo sapiens
gctcctcccctgccgcctc

SEQ ID NO: 2150762 - DNA, 16 bp, Homo sapiens
gctcctcctgccctgt

SEQ ID NO: 2150763 - DNA, 17 bp, Homo sapiens
gctcctttctccagcca

SEQ ID NO: 2150764 - DNA, 18 bp, Homo sapiens
gctcctttctccagccag

SEQ ID NO: 2150765 - DNA, 19 bp, Homo sapiens
gctcctttctccagccagc

SEQ ID NO: 2150766 - DNA, 15 bp, Homo sapiens
gctcgaagactgtga

SEQ ID NO: 2150767 - DNA, 21 bp, Homo sapiens
gctctgcctctaactccctcc

SEQ ID NO: 2150768 - DNA, 19 bp, Homo sapiens
gctcttacttcccccaccc

SEQ ID NO: 2150769 - DNA, 23 bp, Homo sapiens
gctcttacttcccccaccctggg

SEQ ID NO: 2150770 - DNA, 20 bp, Homo sapiens
gctcttgggcctgacctcca

SEQ ID NO: 2150771 - DNA, 13 bp, Homo sapiens
gctgagggcatct

SEQ ID NO: 2150772 - DNA, 14 bp, Homo sapiens
gctgccactctgct

SEQ ID NO: 2150773 - DNA, 19 bp, Homo sapiens
gctgccactctgctgcctg

SEQ ID NO: 2150774 - DNA, 22 bp, Homo sapiens
gctgccactctgctgcctgtac

SEQ ID NO: 2150775 - DNA, 22 bp, Homo sapiens
gctgcctgacactgagccccac

SEQ ID NO: 2150776 - DNA, 23 bp, Homo sapiens
gctgcctgacactgagccccacc

SEQ ID NO: 2150777 - DNA, 19 bp, Homo sapiens
gctgctaggggaaggactg

SEQ ID NO: 2150778 - DNA, 20 bp, Homo sapiens
gctgctaggggaaggactgg

SEQ ID NO: 2150779 - DNA, 13 bp, Homo sapiens
gctgctgccactc

SEQ ID NO: 2150780 - DNA, 11 bp, Homo sapiens
gctgctggggg

SEQ ID NO: 2150781 - DNA, 12 bp, Homo sapiens
gctgctgggggc

SEQ ID NO: 2150782 - DNA, 20 bp, Homo sapiens
gctggcctcttggcacctgc

SEQ ID NO: 2150783 - DNA, 11 bp, Homo sapiens
gctggcctgct

SEQ ID NO: 2150784 - DNA, 13 bp, Homo sapiens
gctggcctgctct

SEQ ID NO: 2150785 - DNA, 15 bp, Homo sapiens
gctggcctggatctc

SEQ ID NO: 2150786 - DNA, 13 bp, Homo sapiens
gctgggcccacag

SEQ ID NO: 2150787 - DNA, 16 bp, Homo sapiens
gctgggcccacagccc

SEQ ID NO: 2150788 - DNA, 22 bp, Homo sapiens
gctgggcccacagcccccaccc

SEQ ID NO: 2150789 - DNA, 16 bp, Homo sapiens
gctggggctggtgagg

SEQ ID NO: 2150790 - DNA, 16 bp, Homo sapiens
gctgggggctcccctt

SEQ ID NO: 2150791 - DNA, 18 bp, Homo sapiens
gctgggggctccccttgc

SEQ ID NO: 2150792 - DNA, 12 bp, Homo sapiens
gctggtgaggcc

SEQ ID NO: 2150793 - DNA, 13 bp, Homo sapiens
gctggtgaggccg

SEQ ID NO: 2150794 - DNA, 19 bp, Homo sapiens
gctggtgaggccggccctg

SEQ ID NO: 2150795 - DNA, 23 bp, Homo sapiens
gcttagacttcgactcaggatcc

SEQ ID NO: 2150796 - DNA, 12 bp, Homo sapiens
gcttctatccca

SEQ ID NO: 2150797 - DNA, 20 bp, Homo sapiens
gcttctcccggacctggact

SEQ ID NO: 2150798 - DNA, 15 bp, Homo sapiens
gctttatcaggggac

SEQ ID NO: 2150799 - DNA, 18 bp, Homo sapiens
gctttgtcacttgccaca

SEQ ID NO: 2150800 - DNA, 21 bp, Homo sapiens
tccccaccagagctgcctccc

SEQ ID NO: 2150801 - DNA, 14 bp, Homo sapiens
tcccccaccctggg

SEQ ID NO: 2150802 - DNA, 19 bp, Homo sapiens
tcccccacgtctctctgcc

SEQ ID NO: 2150803 - DNA, 20 bp, Homo sapiens
tcccccacgtctctctgcct

SEQ ID NO: 2150804 - DNA, 19 bp, Homo sapiens
tccccctaccgcatggcag

SEQ ID NO: 2150805 - DNA, 21 bp, Homo sapiens
tccccctaccgcatggcagct

SEQ ID NO: 2150806 - DNA, 13 bp, Homo sapiens
tcccctcacagac

SEQ ID NO: 2150807 - DNA, 20 bp, Homo sapiens
tcccctcacagactcttcca

SEQ ID NO: 2150808 - DNA, 13 bp, Homo sapiens
tcccctggggctg

SEQ ID NO: 2150809 - DNA, 15 bp, Homo sapiens
tcccctggggctggt

SEQ ID NO: 2150810 - DNA, 12 bp, Homo sapiens
tcccctgtcccc

SEQ ID NO: 2150811 - DNA, 13 bp, Homo sapiens
tccccttccccca

SEQ ID NO: 2150812 - DNA, 17 bp, Homo sapiens
tccccttgtccctgggg

SEQ ID NO: 2150813 - DNA, 14 bp, Homo sapiens
tccctaccactgtg

SEQ ID NO: 2150814 - DNA, 12 bp, Homo sapiens
tccctagatcca

SEQ ID NO: 2150815 - DNA, 17 bp, Homo sapiens
tccctagatccaggctt

SEQ ID NO: 2150816 - DNA, 18 bp, Homo sapiens
tccctcctcacactccag

SEQ ID NO: 2150817 - DNA, 19 bp, Homo sapiens
tccctcctcacactccaga

SEQ ID NO: 2150818 - DNA, 13 bp, Homo sapiens
tccctggggcact

SEQ ID NO: 2150819 - DNA, 14 bp, Homo sapiens
tccctggggcactc

SEQ ID NO: 2150820 - DNA, 15 bp, Homo sapiens
tccctggggcactcc

SEQ ID NO: 2150821 - DNA, 17 bp, Homo sapiens
tccctggggcactcccc

SEQ ID NO: 2150822 - DNA, 18 bp, Homo sapiens
tccctggggcactccccc

SEQ ID NO: 2150823 - DNA, 20 bp, Homo sapiens
tcccttgagtaggccctgct

SEQ ID NO: 2150824 - DNA, 21 bp, Homo sapiens
tcccttgagtaggccctgctt

SEQ ID NO: 2150825 - DNA, 17 bp, Homo sapiens
tccctttttgcagggga

SEQ ID NO: 2150826 - DNA, 13 bp, Homo sapiens
tccgtaaaaatga

SEQ ID NO: 2150827 - DNA, 23 bp, Homo sapiens
tcctaatcaagagtctctccagc

SEQ ID NO: 2150828 - DNA, 13 bp, Homo sapiens
tcctagtatatta

SEQ ID NO: 2150829 - DNA, 13 bp, Homo sapiens
tcctcacactcca

SEQ ID NO: 2150830 - DNA, 16 bp, Homo sapiens
tcctcacagcctctcc

SEQ ID NO: 2150831 - DNA, 14 bp, Homo sapiens
tcctcatctgtgcc

SEQ ID NO: 2150832 - DNA, 12 bp, Homo sapiens
tcctccagacca

SEQ ID NO: 2150833 - DNA, 16 bp, Homo sapiens
tcctccagaccaccag

SEQ ID NO: 2150834 - DNA, 14 bp, Homo sapiens
tcctcccatggcct

SEQ ID NO: 2150835 - DNA, 13 bp, Homo sapiens
tcctccccaccag

SEQ ID NO: 2150836 - DNA, 19 bp, Homo sapiens
tcctccccaccagagctgc

SEQ ID NO: 2150837 - DNA, 20 bp, Homo sapiens
tcctccccaccagagctgcc

SEQ ID NO: 2150838 - DNA, 22 bp, Homo sapiens
tcctccccaccagagctgcctc

SEQ ID NO: 2150839 - DNA, 15 bp, Homo sapiens
tcctcccctgccgcc

SEQ ID NO: 2150840 - DNA, 18 bp, Homo sapiens
tcctcccctgccgcctcc

SEQ ID NO: 2150841 - DNA, 20 bp, Homo sapiens
tcctcccctgccgcctcccg

SEQ ID NO: 2150842 - DNA, 13 bp, Homo sapiens
tcctccctctgcc

SEQ ID NO: 2150843 - DNA, 16 bp, Homo sapiens
tcctccctctgcctca

SEQ ID NO: 2150844 - DNA, 15 bp, Homo sapiens
tcctcctctccatgc

SEQ ID NO: 2150845 - DNA, 17 bp, Homo sapiens
tcctcctctccatgcaa

SEQ ID NO: 2150846 - DNA, 21 bp, Homo sapiens
tcctcctctccatgcaagtgc

SEQ ID NO: 2150847 - DNA, 14 bp, Homo sapiens
tcctcctgccagct

SEQ ID NO: 2150848 - DNA, 16 bp, Homo sapiens
tcctcctgccagctct

SEQ ID NO: 2150849 - DNA, 20 bp, Homo sapiens
tcctcctgccagctctgtca

SEQ ID NO: 2150850 - DNA, 21 bp, Homo sapiens
tcctcctgccagctctgtcac

SEQ ID NO: 2150851 - DNA, 20 bp, Homo sapiens
tcctcggcccatctgtccat

SEQ ID NO: 2150852 - DNA, 14 bp, Homo sapiens
tcctcttgctcaaa

SEQ ID NO: 2150853 - DNA, 13 bp, Homo sapiens
tcctgccagctct

SEQ ID NO: 2150854 - DNA, 14 bp, Homo sapiens
tcctgccagctctg

SEQ ID NO: 2150855 - DNA, 12 bp, Homo sapiens
tcctgccctccc

SEQ ID NO: 2150856 - DNA, 18 bp, Homo sapiens
tcctgccctgttgtgtat

SEQ ID NO: 2150857 - DNA, 13 bp, Homo sapiens
tcctgctggcctg

SEQ ID NO: 2150858 - DNA, 17 bp, Homo sapiens
tcctgctggcctgctct

SEQ ID NO: 2150859 - DNA, 18 bp, Homo sapiens
tcctgctggcctgctctt

SEQ ID NO: 2150860 - DNA, 21 bp, Homo sapiens
tcctgctggcctgctcttact

SEQ ID NO: 2150861 - DNA, 12 bp, Homo sapiens
tcctggccctct

SEQ ID NO: 2150862 - DNA, 11 bp, Homo sapiens
tcctgggcccc

SEQ ID NO: 2150863 - DNA, 14 bp, Homo sapiens
tcctgggcccccag

SEQ ID NO: 2150864 - DNA, 17 bp, Homo sapiens
tcctgtcgattagactg

SEQ ID NO: 2150865 - DNA, 17 bp, Homo sapiens
tccttactcagagctgc

SEQ ID NO: 2150866 - DNA, 19 bp, Homo sapiens
tccttactcagagctgcgg

SEQ ID NO: 2150867 - DNA, 21 bp, Homo sapiens
tccttactcagagctgcgggc

SEQ ID NO: 2150868 - DNA, 22 bp, Homo sapiens
tccttactcagagctgcgggct

SEQ ID NO: 2150869 - DNA, 23 bp, Homo sapiens
tccttggcaggctgatttctagg

SEQ ID NO: 2150870 - DNA, 17 bp, Homo sapiens
tcctttctccagccagc

SEQ ID NO: 2150871 - DNA, 18 bp, Homo sapiens
tcctttctccagccagca

SEQ ID NO: 2150872 - DNA, 20 bp, Homo sapiens
tcctttgcactgagggccac

SEQ ID NO: 2150873 - DNA, 19 bp, Homo sapiens
tccttttgcaacaagacaa

SEQ ID NO: 2150874 - DNA, 21 bp, Homo sapiens
tccttttgcaacaagacaaag

SEQ ID NO: 2150875 - DNA, 23 bp, Homo sapiens
tcgaagaacaatgtcagaaactc

SEQ ID NO: 2150876 - DNA, 21 bp, Homo sapiens
tcgactcaggatccagtccct

SEQ ID NO: 2150877 - DNA, 21 bp, Homo sapiens
tcgattagactggacagcttg

SEQ ID NO: 2150878 - DNA, 22 bp, Homo sapiens
tcggaggctcctccctctgcct

SEQ ID NO: 2150879 - DNA, 21 bp, Homo sapiens
tcggcccatctgtccatcctc

SEQ ID NO: 2150880 - DNA, 23 bp, Homo sapiens
tcggcccatctgtccatcctcct

SEQ ID NO: 2150881 - DNA, 14 bp, Homo sapiens
tcggccctgcccaa

SEQ ID NO: 2150882 - DNA, 15 bp, Homo sapiens
tcgttcaaagcatga

SEQ ID NO: 2150883 - DNA, 19 bp, Homo sapiens
tctaaccaaagagtctctg

SEQ ID NO: 2150884 - DNA, 21 bp, Homo sapiens
tctaaccaaagagtctctggc

SEQ ID NO: 2150885 - DNA, 12 bp, Homo sapiens
tctaactccctc

SEQ ID NO: 2150886 - DNA, 22 bp, Homo sapiens
tctaactccctcctcacactcc

SEQ ID NO: 2150887 - DNA, 23 bp, Homo sapiens
tctaactccctcctcacactcca

SEQ ID NO: 2150888 - DNA, 17 bp, Homo sapiens
tctacacatatatgtat

SEQ ID NO: 2150889 - DNA, 21 bp, Homo sapiens
tctacctttttttctctccta

SEQ ID NO: 2150890 - DNA, 19 bp, Homo sapiens
tctaggggtcaggctccat

SEQ ID NO: 2150891 - DNA, 17 bp, Homo sapiens
tctaggtaggaaatgtg

SEQ ID NO: 2150892 - DNA, 22 bp, Homo sapiens
tctatattccgggtgccattcc

SEQ ID NO: 2150893 - DNA, 20 bp, Homo sapiens
tctatcaaccccagacactg

SEQ ID NO: 2150894 - DNA, 21 bp, Homo sapiens
tctatcaaccccagacactgg

SEQ ID NO: 2150895 - DNA, 22 bp, Homo sapiens
tctatcaaccccagacactggt

SEQ ID NO: 2150896 - DNA, 11 bp, Homo sapiens
tctcacactcc

SEQ ID NO: 2150897 - DNA, 17 bp, Homo sapiens
tctcacactcctcctgc

SEQ ID NO: 2150898 - DNA, 21 bp, Homo sapiens
tctcacactcctcctgccagc

SEQ ID NO: 2150899 - DNA, 15 bp, Homo sapiens
tctcaggagcacagg

SEQ ID NO: 2150900 - DNA, 20 bp, Homo sapiens
tctcaggagcacaggcagct

SEQ ID NO: 2150901 - DNA, 23 bp, Homo sapiens
tctcaggagcacaggcagctgga

SEQ ID NO: 2150902 - DNA, 21 bp, Homo sapiens
tctcatttttccgtaaaaatg

SEQ ID NO: 2150903 - DNA, 16 bp, Homo sapiens
tctccaagtctctctg

SEQ ID NO: 2150904 - DNA, 17 bp, Homo sapiens
tctccaagtctctctgt

SEQ ID NO: 2150905 - DNA, 21 bp, Homo sapiens
tctccaagtctctctgtgaat

SEQ ID NO: 2150906 - DNA, 23 bp, Homo sapiens
tctccaagtctctctgtgaatac

SEQ ID NO: 2150907 - DNA, 11 bp, Homo sapiens
tctccagcctc

SEQ ID NO: 2150908 - DNA, 17 bp, Homo sapiens
tctccatgcaagtgctg

SEQ ID NO: 2150909 - DNA, 18 bp, Homo sapiens
tctcctcccatggccttc

SEQ ID NO: 2150910 - DNA, 16 bp, Homo sapiens
ttgcccttcctgaccc

SEQ ID NO: 2150911 - DNA, 14 bp, Homo sapiens
ttggatgtggagct

SEQ ID NO: 2150912 - DNA, 15 bp, Homo sapiens
ttggcacctgcctag

SEQ ID NO: 2150913 - DNA, 18 bp, Homo sapiens
ttggcagaactgctgggg

SEQ ID NO: 2150914 - DNA, 16 bp, Homo sapiens
ttggccctgcccctcc

SEQ ID NO: 2150915 - DNA, 17 bp, Homo sapiens
ttggccctgcccctccc

SEQ ID NO: 2150916 - DNA, 11 bp, Homo sapiens
ttgggagcact

SEQ ID NO: 2150917 - DNA, 13 bp, Homo sapiens
ttgggcctgacct

SEQ ID NO: 2150918 - DNA, 16 bp, Homo sapiens
ttgggggaatgcacct

SEQ ID NO: 2150919 - DNA, 12 bp, Homo sapiens
ttgtaaatacac

SEQ ID NO: 2150920 - DNA, 13 bp, Homo sapiens
ttgtaaatacacc

SEQ ID NO: 2150921 - DNA, 13 bp, Homo sapiens
ttgtaaatattgt

SEQ ID NO: 2150922 - DNA, 15 bp, Homo sapiens
ttgtacaaagatatg

SEQ ID NO: 2150923 - DNA, 18 bp, Homo sapiens
ttgtacaaagatatgcta

SEQ ID NO: 2150924 - DNA, 19 bp, Homo sapiens
ttgtcaatattaaatacag

SEQ ID NO: 2150925 - DNA, 20 bp, Homo sapiens
ttgtcacttgccacatggtg

SEQ ID NO: 2150926 - DNA, 10 bp, Homo sapiens
ttgtccctgg

SEQ ID NO: 2150927 - DNA, 13 bp, Homo sapiens
ttgtccctggggc

SEQ ID NO: 2150928 - DNA, 21 bp, Homo sapiens
ttgtccctggggcactccccc

SEQ ID NO: 2150929 - DNA, 22 bp, Homo sapiens
ttgtccctggggcactccccca

SEQ ID NO: 2150930 - DNA, 19 bp, Homo sapiens
ttgtgaaattcaacctgtg

SEQ ID NO: 2150931 - DNA, 14 bp, Homo sapiens
ttgttcacactcct

SEQ ID NO: 2150932 - DNA, 12 bp, Homo sapiens
tttaaatctgtt

SEQ ID NO: 2150933 - DNA, 15 bp, Homo sapiens
tttaacaaaagcaag

SEQ ID NO: 2150934 - DNA, 14 bp, Homo sapiens
tttactgacagaaa

SEQ ID NO: 2150935 - DNA, 22 bp, Homo sapiens
tttccgtaaaaatgatttcagt

SEQ ID NO: 2150936 - DNA, 18 bp, Homo sapiens
tttcggacagtttatttg

SEQ ID NO: 2150937 - DNA, 16 bp, Homo sapiens
tttctacggtgacagt

SEQ ID NO: 2150938 - DNA, 14 bp, Homo sapiens
tttctatcacatat

SEQ ID NO: 2150939 - DNA, 13 bp, Homo sapiens
tttgaagtgtaat

SEQ ID NO: 2150940 - DNA, 22 bp, Homo sapiens
tttgcaacaagacaaagcaaag

SEQ ID NO: 2150941 - DNA, 14 bp, Homo sapiens
tttgcacagagggc

SEQ ID NO: 2150942 - DNA, 22 bp, Homo sapiens
tttgcacagagggcgctcctgt

SEQ ID NO: 2150943 - DNA, 17 bp, Homo sapiens
tttgcacctttctagtt

SEQ ID NO: 2150944 - DNA, 21 bp, Homo sapiens
tttgcacctttctagttgaaa

SEQ ID NO: 2150945 - DNA, 20 bp, Homo sapiens
tttgcaggggactgggccat

SEQ ID NO: 2150946 - DNA, 22 bp, Homo sapiens
tttgcccacacacactccttcc

SEQ ID NO: 2150947 - DNA, 14 bp, Homo sapiens
tttgcctgtaacaa

SEQ ID NO: 2150948 - DNA, 18 bp, Homo sapiens
tttggcagaactgctggg

SEQ ID NO: 2150949 - DNA, 17 bp, Homo sapiens
tttggcccctggaacct

SEQ ID NO: 2150950 - DNA, 13 bp, Homo sapiens
tttgtcacttgcc

SEQ ID NO: 2150951 - DNA, 19 bp, Homo sapiens
tttgtcacttgccacatgg

SEQ ID NO: 2150952 - DNA, 13 bp, Homo sapiens
tttgtgccagccg

SEQ ID NO: 2150953 - DNA, 19 bp, Homo sapiens
tttgtggtaaaaagattat

SEQ ID NO: 2150954 - DNA, 14 bp, Homo sapiens
tttgttcacactcc

SEQ ID NO: 2150955 - DNA, 16 bp, Homo sapiens
ttttaacaaaagcaag

SEQ ID NO: 2150956 - DNA, 16 bp, Homo sapiens
ttttaatgaacaaatg

SEQ ID NO: 2150957 - DNA, 15 bp, Homo sapiens
ttttactgacagaaa

SEQ ID NO: 2150958 - DNA, 18 bp, Homo sapiens
ttttactgacagaaatgc

SEQ ID NO: 2150959 - DNA, 23 bp, Homo sapiens
ttttctacctttttttctctcct

SEQ ID NO: 2150960 - DNA, 17 bp, Homo sapiens
tccaggcttctcccgga

SEQ ID NO: 2150961 - DNA, 15 bp, Homo sapiens
tccagtcctgctggc

SEQ ID NO: 2150962 - DNA, 17 bp, Homo sapiens
tccagtcctgctggcct

SEQ ID NO: 2150963 - DNA, 19 bp, Homo sapiens
tccagtcctgctggcctgc

SEQ ID NO: 2150964 - DNA, 14 bp, Homo sapiens
tccagtttccaaag

SEQ ID NO: 2150965 - DNA, 15 bp, Homo sapiens
tccatccccttcccc

SEQ ID NO: 2150966 - DNA, 23 bp, Homo sapiens
tccatccccttcccccatcccta

SEQ ID NO: 2150967 - DNA, 13 bp, Homo sapiens
tccatcctcctct

SEQ ID NO: 2150968 - DNA, 14 bp, Homo sapiens
tccatcctcctctc

SEQ ID NO: 2150969 - DNA, 17 bp, Homo sapiens
tccatcctcctctccat

SEQ ID NO: 2150970 - DNA, 21 bp, Homo sapiens
tccatcctcctctccatgcaa

SEQ ID NO: 2150971 - DNA, 23 bp, Homo sapiens
tccatcctcctctccatgcaagt

SEQ ID NO: 2150972 - DNA, 15 bp, Homo sapiens
tccatgcaagtgctg

SEQ ID NO: 2150973 - DNA, 14 bp, Homo sapiens
tccatgcctgaggg

SEQ ID NO: 2150974 - DNA, 21 bp, Homo sapiens
tccatttggcagaactgctgg

SEQ ID NO: 2150975 - DNA, 12 bp, Homo sapiens
tcccaacatggg

SEQ ID NO: 2150976 - DNA, 13 bp, Homo sapiens
tcccacccaggaa

SEQ ID NO: 2150977 - DNA, 22 bp, Homo sapiens
tcccacggggaccactgggccc

SEQ ID NO: 2150978 - DNA, 23 bp, Homo sapiens
tcccacggggaccactgggcccc

SEQ ID NO: 2150979 - DNA, 22 bp, Homo sapiens
tcccactaagctttctcctttg

SEQ ID NO: 2150980 - DNA, 13 bp, Homo sapiens
tcccagcagccct

SEQ ID NO: 2150981 - DNA, 21 bp, Homo sapiens
tcccagcagccctaaggatct

SEQ ID NO: 2150982 - DNA, 14 bp, Homo sapiens
tcccatctcttcct

SEQ ID NO: 2150983 - DNA, 21 bp, Homo sapiens
tccccacagtcctcacagcct

SEQ ID NO: 2150984 - DNA, 17 bp, Homo sapiens
tccccaccagagctgcc

SEQ ID NO: 2150985 - DNA, 18 bp, Homo sapiens
tccccaccagagctgcct

SEQ ID NO: 2150986 - DNA, 13 bp, Homo sapiens
tcccccaccctgg

SEQ ID NO: 2150987 - DNA, 15 bp, Homo sapiens
tcccccaccctgggt

SEQ ID NO: 2150988 - DNA, 21 bp, Homo sapiens
tcccccaccctgggtttggcc

SEQ ID NO: 2150989 - DNA, 22 bp, Homo sapiens
tcccccacgtctctctgcctgc

SEQ ID NO: 2150990 - DNA, 15 bp, Homo sapiens
tcccccatccctacc

SEQ ID NO: 2150991 - DNA, 22 bp, Homo sapiens
tcccccatccctaccactgtgg

SEQ ID NO: 2150992 - DNA, 17 bp, Homo sapiens
tccccctaccgcatggc

SEQ ID NO: 2150993 - DNA, 12 bp, Homo sapiens
tacatgtttgca

SEQ ID NO: 2150994 - DNA, 13 bp, Homo sapiens
tacatgtttgcac

SEQ ID NO: 2150995 - DNA, 22 bp, Homo sapiens
tacatgtttgcacctttctagt

SEQ ID NO: 2150996 - DNA, 23 bp, Homo sapiens
taccaagccaccgcagctgctgc

SEQ ID NO: 2150997 - DNA, 19 bp, Homo sapiens
taccaggcacatggctggg

SEQ ID NO: 2150998 - DNA, 20 bp, Homo sapiens
taccaggcacatggctgggg

SEQ ID NO: 2150999 - DNA, 22 bp, Homo sapiens
taccatgagaagagggcctgtg

SEQ ID NO: 2151000 - DNA, 15 bp, Homo sapiens
tacccagagaatata

SEQ ID NO: 2151001 - DNA, 13 bp, Homo sapiens
tacccttcctcat

SEQ ID NO: 2151002 - DNA, 21 bp, Homo sapiens
tacccttcctcatctgtgcct

SEQ ID NO: 2151003 - DNA, 20 bp, Homo sapiens
taccgcatggcagctgggcc

SEQ ID NO: 2151004 - DNA, 15 bp, Homo sapiens
tacctaaacagatat

SEQ ID NO: 2151005 - DNA, 12 bp, Homo sapiens
tacctgagacca

SEQ ID NO: 2151006 - DNA, 13 bp, Homo sapiens
tacctgagaccag

SEQ ID NO: 2151007 - DNA, 18 bp, Homo sapiens
tacctttttttctctcct

SEQ ID NO: 2151008 - DNA, 14 bp, Homo sapiens
tactcagagctgcg

SEQ ID NO: 2151009 - DNA, 16 bp, Homo sapiens
tactcagagctgcggg

SEQ ID NO: 2151010 - DNA, 15 bp, Homo sapiens
tactgcacattttgt

SEQ ID NO: 2151011 - DNA, 16 bp, Homo sapiens
tacttacctaaacaga

SEQ ID NO: 2151012 - DNA, 16 bp, Homo sapiens
tacttcccccaccctg

SEQ ID NO: 2151013 - DNA, 12 bp, Homo sapiens
tagaatgacagt

SEQ ID NO: 2151014 - DNA, 22 bp, Homo sapiens
tagacttcgactcaggatccag

SEQ ID NO: 2151015 - DNA, 19 bp, Homo sapiens
tagatgcaagatatttata

SEQ ID NO: 2151016 - DNA, 12 bp, Homo sapiens
tagcaactgtgc

SEQ ID NO: 2151017 - DNA, 17 bp, Homo sapiens
tagcgtgctcactgacc

SEQ ID NO: 2151018 - DNA, 15 bp, Homo sapiens
tagctacttttcaga

SEQ ID NO: 2151019 - DNA, 14 bp, Homo sapiens
tagctcttgggcct

SEQ ID NO: 2151020 - DNA, 13 bp, Homo sapiens
tagtagtgtcttc

SEQ ID NO: 2151021 - DNA, 16 bp, Homo sapiens
tatacattctttatct

SEQ ID NO: 2151022 - DNA, 13 bp, Homo sapiens
tatagtatatctg

SEQ ID NO: 2151023 - DNA, 15 bp, Homo sapiens
tatatatatatgtac

SEQ ID NO: 2151024 - DNA, 12 bp, Homo sapiens
tatatatcataa

SEQ ID NO: 2151025 - DNA, 22 bp, Homo sapiens
tatatattctacacatatatgt

SEQ ID NO: 2151026 - DNA, 20 bp, Homo sapiens
tatatatttttggttgtcaa

SEQ ID NO: 2151027 - DNA, 11 bp, Homo sapiens
tatatcagcct

SEQ ID NO: 2151028 - DNA, 12 bp, Homo sapiens
tatatgtacagt

SEQ ID NO: 2151029 - DNA, 22 bp, Homo sapiens
tatattccgggtgccattccca

SEQ ID NO: 2151030 - DNA, 18 bp, Homo sapiens
tatcaaccccagacactg

SEQ ID NO: 2151031 - DNA, 21 bp, Homo sapiens
tatcaaccccagacactggtt

SEQ ID NO: 2151032 - DNA, 13 bp, Homo sapiens
tatcagcctgagt

SEQ ID NO: 2151033 - DNA, 16 bp, Homo sapiens
tatctgagaagtgtat

SEQ ID NO: 2151034 - DNA, 18 bp, Homo sapiens
tatctgagaagtgtatat

SEQ ID NO: 2151035 - DNA, 18 bp, Homo sapiens
tatgcctgctatttgaag

SEQ ID NO: 2151036 - DNA, 17 bp, Homo sapiens
tatgtatatgtatatct

SEQ ID NO: 2151037 - DNA, 19 bp, Homo sapiens
tatgtatatgtatatctat

SEQ ID NO: 2151038 - DNA, 13 bp, Homo sapiens
tatgtcctaagga

SEQ ID NO: 2151039 - DNA, 18 bp, Homo sapiens
tattaaatacagacacta

SEQ ID NO: 2151040 - DNA, 15 bp, Homo sapiens
tattaccatgagaag

SEQ ID NO: 2151041 - DNA, 15 bp, Homo sapiens
tattagcaactgtgc

SEQ ID NO: 2151042 - DNA, 21 bp, Homo sapiens
tattagtttgatttaatatct

SEQ ID NO: 2151043 - DNA, 22 bp, Homo sapiens
tattagtttgatttaatatctg

SEQ ID NO: 2151044 - DNA, 22 bp, Homo sapiens
tattcagacaagcaacaggttt

SEQ ID NO: 2151045 - DNA, 16 bp, Homo sapiens
tattctacacatatat

SEQ ID NO: 2151046 - DNA, 18 bp, Homo sapiens
tattctacacatatatgt

SEQ ID NO: 2151047 - DNA, 22 bp, Homo sapiens
tcaaaacattgtgccatgtcaa

SEQ ID NO: 2151048 - DNA, 17 bp, Homo sapiens
tcaaatctattcagaca

SEQ ID NO: 2151049 - DNA, 23 bp, Homo sapiens
tcaaattaatctttctttacctg

SEQ ID NO: 2151050 - DNA, 17 bp, Homo sapiens
tcaaccccagacactgg

SEQ ID NO: 2151051 - DNA, 18 bp, Homo sapiens
tcaaccccagacactggt

SEQ ID NO: 2151052 - DNA, 15 bp, Homo sapiens
tcaagagactgagtc

SEQ ID NO: 2151053 - DNA, 19 bp, Homo sapiens
tcaatattaaatacagaca

SEQ ID NO: 2151054 - DNA, 14 bp, Homo sapiens
tcacaataaagttt

SEQ ID NO: 2151055 - DNA, 11 bp, Homo sapiens
tcacactccta

SEQ ID NO: 2151056 - DNA, 15 bp, Homo sapiens
tcacactcctcctgc

SEQ ID NO: 2151057 - DNA, 19 bp, Homo sapiens
tcacactcctcctgccagc

SEQ ID NO: 2151058 - DNA, 22 bp, Homo sapiens
tcacactcctcctgccagctct

SEQ ID NO: 2151059 - DNA, 16 bp, Homo sapiens
tcacagactcttccac

SEQ ID NO: 2151060 - DNA, 20 bp, Homo sapiens
tcacagactcttccaccaga

SEQ ID NO: 2151061 - DNA, 17 bp, Homo sapiens
tcacagatgctggcctc

SEQ ID NO: 2151062 - DNA, 18 bp, Homo sapiens
tcacagatgctggcctct

SEQ ID NO: 2151063 - DNA, 19 bp, Homo sapiens
tcacagatgctggcctctt

SEQ ID NO: 2151064 - DNA, 23 bp, Homo sapiens
tcacagatgctggcctcttggca

SEQ ID NO: 2151065 - DNA, 22 bp, Homo sapiens
tcacatataaaagttaaactac

SEQ ID NO: 2151066 - DNA, 21 bp, Homo sapiens
tcaccatgcaagggtgacatc

SEQ ID NO: 2151067 - DNA, 18 bp, Homo sapiens
tcaccctggccaccaccc

SEQ ID NO: 2151068 - DNA, 23 bp, Homo sapiens
tcaccctggccaccacccaacct

SEQ ID NO: 2151069 - DNA, 11 bp, Homo sapiens
tcacttgccac

SEQ ID NO: 2151070 - DNA, 14 bp, Homo sapiens
tcagaacagcagac

SEQ ID NO: 2151071 - DNA, 16 bp, Homo sapiens
tcagaagtaactccca

SEQ ID NO: 2151072 - DNA, 15 bp, Homo sapiens
tcagagctgcgggct

SEQ ID NO: 2151073 - DNA, 21 bp, Homo sapiens
tcagagctgcgggctgagggc

SEQ ID NO: 2151074 - DNA, 10 bp, Homo sapiens
tcagagcttt

SEQ ID NO: 2151075 - DNA, 22 bp, Homo sapiens
tcagagctttgtcacttgccac

SEQ ID NO: 2151076 - DNA, 23 bp, Homo sapiens
tcagagctttgtcacttgccaca

SEQ ID NO: 2151077 - DNA, 14 bp, Homo sapiens
tcagcagccccctg

SEQ ID NO: 2151078 - DNA, 16 bp, Homo sapiens
tcagccccgcctgtca

SEQ ID NO: 2151079 - DNA, 22 bp, Homo sapiens
tcagccccgcctgtcacaataa

SEQ ID NO: 2151080 - DNA, 22 bp, Homo sapiens
tcagccgagccgggcctggggc

SEQ ID NO: 2151081 - DNA, 19 bp, Homo sapiens
tcagcctgagtctcctgtg

SEQ ID NO: 2151082 - DNA, 16 bp, Homo sapiens
tcagctctgacattct

SEQ ID NO: 2151083 - DNA, 21 bp, Homo sapiens
tcagctgtggtcccacccagg

SEQ ID NO: 2151084 - DNA, 22 bp, Homo sapiens
tcagctgtggtcccacccagga

SEQ ID NO: 2151085 - DNA, 19 bp, Homo sapiens
tcaggaatcggaatcctgt

SEQ ID NO: 2151086 - DNA, 20 bp, Homo sapiens
tcaggacttaacggctccag

SEQ ID NO: 2151087 - DNA, 11 bp, Homo sapiens
tcaggagcaca

SEQ ID NO: 2151088 - DNA, 15 bp, Homo sapiens
tcaggctccattagg

SEQ ID NO: 2151089 - DNA, 15 bp, Homo sapiens
tcaggggaagctgct

SEQ ID NO: 2151090 - DNA, 19 bp, Homo sapiens
tcaggggacaaaccagggg

SEQ ID NO: 2151091 - DNA, 13 bp, Homo sapiens
tcataaagtatgc

SEQ ID NO: 2151092 - DNA, 15 bp, Homo sapiens
tcatcctcctcctca

SEQ ID NO: 2151093 - DNA, 17 bp, Homo sapiens
tcatctgtgcctgtctg

SEQ ID NO: 2151094 - DNA, 20 bp, Homo sapiens
tcatctgtgcctgtctgtcc

SEQ ID NO: 2151095 - DNA, 15 bp, Homo sapiens
tcatgctttctcctt

SEQ ID NO: 2151096 - DNA, 16 bp, Homo sapiens
tcatggtactacccca

SEQ ID NO: 2151097 - DNA, 21 bp, Homo sapiens
tccaccagagcaggggctgct

SEQ ID NO: 2151098 - DNA, 19 bp, Homo sapiens
tccagaatgtgctgccttt

SEQ ID NO: 2151099 - DNA, 18 bp, Homo sapiens
tccagaattacccttcct

SEQ ID NO: 2151100 - DNA, 23 bp, Homo sapiens
tccagccagcaatgatgtccaga

SEQ ID NO: 2151101 - DNA, 21 bp, Homo sapiens
tccagccatcaagagactgag

SEQ ID NO: 2151102 - DNA, 18 bp, Homo sapiens
tccagcctcacagatgct

SEQ ID NO: 2151103 - DNA, 23 bp, Homo sapiens
tccagcctcacagatgctggcct

SEQ ID NO: 2151104 - DNA, 13 bp, Homo sapiens
tctaactccctcc

SEQ ID NO: 2151105 - DNA, 14 bp, Homo sapiens
tctaactccctcct

SEQ ID NO: 2151106 - DNA, 19 bp, Homo sapiens
tctacctttttttctctcc

SEQ ID NO: 2151107 - DNA, 20 bp, Homo sapiens
tctagtctcctttgcactga

SEQ ID NO: 2151108 - DNA, 19 bp, Homo sapiens
tctagttgaaaataaagtg

SEQ ID NO: 2151109 - DNA, 16 bp, Homo sapiens
tctattcagacaagca

SEQ ID NO: 2151110 - DNA, 13 bp, Homo sapiens
tctcacactcctc

SEQ ID NO: 2151111 - DNA, 14 bp, Homo sapiens
tctcacactcctcc

SEQ ID NO: 2151112 - DNA, 15 bp, Homo sapiens
tctcacactcctcct

SEQ ID NO: 2151113 - DNA, 16 bp, Homo sapiens
tctcaggagcacaggc

SEQ ID NO: 2151114 - DNA, 19 bp, Homo sapiens
tctcaggagcacaggcagc

SEQ ID NO: 2151115 - DNA, 21 bp, Homo sapiens
tctcatcagtgtcctcttgct

SEQ ID NO: 2151116 - DNA, 21 bp, Homo sapiens
tctcattcaggtgttctcttc

SEQ ID NO: 2151117 - DNA, 18 bp, Homo sapiens
tctccaagtctctctgtg

SEQ ID NO: 2151118 - DNA, 19 bp, Homo sapiens
tctccaagtctctctgtga

SEQ ID NO: 2151119 - DNA, 22 bp, Homo sapiens
tctccaagtctctctgtgaata

SEQ ID NO: 2151120 - DNA, 20 bp, Homo sapiens
tctccagcctcacagatgct

SEQ ID NO: 2151121 - DNA, 21 bp, Homo sapiens
tctccagcctcacagatgctg

SEQ ID NO: 2151122 - DNA, 19 bp, Homo sapiens
tctccatgcaagtgctgtt

SEQ ID NO: 2151123 - DNA, 18 bp, Homo sapiens
tctcccggacctggacta

SEQ ID NO: 2151124 - DNA, 16 bp, Homo sapiens
tctcctttgcactgag

SEQ ID NO: 2151125 - DNA, 19 bp, Homo sapiens
tctcctttgcactgagggc

SEQ ID NO: 2151126 - DNA, 13 bp, Homo sapiens
tctctcaggagca

SEQ ID NO: 2151127 - DNA, 21 bp, Homo sapiens
tctctccagcctcacagatgc

SEQ ID NO: 2151128 - DNA, 11 bp, Homo sapiens
tctctctgcct

SEQ ID NO: 2151129 - DNA, 14 bp, Homo sapiens
tctctctgcctgct

SEQ ID NO: 2151130 - DNA, 16 bp, Homo sapiens
tctctctgcctgctgg

SEQ ID NO: 2151131 - DNA, 17 bp, Homo sapiens
tctctctgcctgctggg

SEQ ID NO: 2151132 - DNA, 14 bp, Homo sapiens
tctctctgtgaata

SEQ ID NO: 2151133 - DNA, 17 bp, Homo sapiens
tgccatgtcaaacaaat

SEQ ID NO: 2151134 - DNA, 19 bp, Homo sapiens
tgcccaagggcctcccacc

SEQ ID NO: 2151135 - DNA, 11 bp, Homo sapiens
tgcccacacac

SEQ ID NO: 2151136 - DNA, 23 bp, Homo sapiens
tgcccacacacactccttcccct

SEQ ID NO: 2151137 - DNA, 23 bp, Homo sapiens
tgcccacatcccaggcttcaccc

SEQ ID NO: 2151138 - DNA, 17 bp, Homo sapiens
tgcccctccctagatcc

SEQ ID NO: 2151139 - DNA, 12 bp, Homo sapiens
tgccctgtccct

SEQ ID NO: 2151140 - DNA, 12 bp, Homo sapiens
tgccgcctcccg

SEQ ID NO: 2151141 - DNA, 19 bp, Homo sapiens
tgccgggttctagtctcct

SEQ ID NO: 2151142 - DNA, 19 bp, Homo sapiens
tgcctagctcttgggcctg

SEQ ID NO: 2151143 - DNA, 20 bp, Homo sapiens
tgcctagctcttgggcctga

SEQ ID NO: 2151144 - DNA, 22 bp, Homo sapiens
tgcctagctcttgggcctgacc

SEQ ID NO: 2151145 - DNA, 15 bp, Homo sapiens
tgcctcatcctcctc

SEQ ID NO: 2151146 - DNA, 16 bp, Homo sapiens
tgcctctaactccctc

SEQ ID NO: 2151147 - DNA, 20 bp, Homo sapiens
tgcctctaactccctcctca

SEQ ID NO: 2151148 - DNA, 15 bp, Homo sapiens
tgcctgaactccaga

SEQ ID NO: 2151149 - DNA, 15 bp, Homo sapiens
tgcctgacactgagc

SEQ ID NO: 2151150 - DNA, 18 bp, Homo sapiens
tgcctgacactgagcccc

SEQ ID NO: 2151151 - DNA, 15 bp, Homo sapiens
tgcctgctgggctct

SEQ ID NO: 2151152 - DNA, 21 bp, Homo sapiens
tgccttcctgtttaaaaaaag

SEQ ID NO: 2151153 - DNA, 14 bp, Homo sapiens
tgccttcttcaccc

SEQ ID NO: 2151154 - DNA, 22 bp, Homo sapiens
tgcctttttatttttgttttta

SEQ ID NO: 2151155 - DNA, 19 bp, Homo sapiens
tgcgggctgagggcatctc

SEQ ID NO: 2151156 - DNA, 22 bp, Homo sapiens
tgcgtgccctgacccctgcacc

SEQ ID NO: 2151157 - DNA, 14 bp, Homo sapiens
tgctaggggaagga

SEQ ID NO: 2151158 - DNA, 18 bp, Homo sapiens
tgctaggggaaggactgg

SEQ ID NO: 2151159 - DNA, 22 bp, Homo sapiens
tgctaggggaaggactggccgt

SEQ ID NO: 2151160 - DNA, 18 bp, Homo sapiens
tgctcaaatctattcaga

SEQ ID NO: 2151161 - DNA, 21 bp, Homo sapiens
tgctcaaatctattcagacaa

SEQ ID NO: 2151162 - DNA, 13 bp, Homo sapiens
tgctcccagcagc

SEQ ID NO: 2151163 - DNA, 14 bp, Homo sapiens
tgctcccagcagcc

SEQ ID NO: 2151164 - DNA, 16 bp, Homo sapiens
tgctcctcctgccctg

SEQ ID NO: 2151165 - DNA, 19 bp, Homo sapiens
tgctcctcctgccctgtcc

SEQ ID NO: 2151166 - DNA, 14 bp, Homo sapiens
tgctcgaagaacaa

SEQ ID NO: 2151167 - DNA, 12 bp, Homo sapiens
tgctctgcctct

SEQ ID NO: 2151168 - DNA, 20 bp, Homo sapiens
tgctctgcctctaactccct

SEQ ID NO: 2151169 - DNA, 14 bp, Homo sapiens
tgctcttacttccc

SEQ ID NO: 2151170 - DNA, 15 bp, Homo sapiens
tgctgccactctgct

SEQ ID NO: 2151171 - DNA, 20 bp, Homo sapiens
tgctgccactctgctgcctg

SEQ ID NO: 2151172 - DNA, 21 bp, Homo sapiens
tgctgccactctgctgcctgt

SEQ ID NO: 2151173 - DNA, 15 bp, Homo sapiens
tgctggcctgctctt

SEQ ID NO: 2151174 - DNA, 18 bp, Homo sapiens
tgctggcctggatctccc

SEQ ID NO: 2151175 - DNA, 12 bp, Homo sapiens
tgctgggggctc

SEQ ID NO: 2151176 - DNA, 14 bp, Homo sapiens
tgctgtttgggcag

SEQ ID NO: 2151177 - DNA, 17 bp, Homo sapiens
tgctttgatatttcaat

SEQ ID NO: 2151178 - DNA, 13 bp, Homo sapiens
tggaacttgaact

SEQ ID NO: 2151179 - DNA, 17 bp, Homo sapiens
tggacaagccaacttgt

SEQ ID NO: 2151180 - DNA, 22 bp, Homo sapiens
tggacctatgtcctaaggacac

SEQ ID NO: 2151181 - DNA, 19 bp, Homo sapiens
tggagactcctgccctgtt

SEQ ID NO: 2151182 - DNA, 17 bp, Homo sapiens
tggagtgcagggaggag

SEQ ID NO: 2151183 - DNA, 15 bp, Homo sapiens
tggatctccccactc

SEQ ID NO: 2151184 - DNA, 14 bp, Homo sapiens
tggcaagtgaattt

SEQ ID NO: 2151185 - DNA, 21 bp, Homo sapiens
tggcaccactagggtcctggc

SEQ ID NO: 2151186 - DNA, 13 bp, Homo sapiens
tggcacctgccta

SEQ ID NO: 2151187 - DNA, 18 bp, Homo sapiens
tggcacctgcctagctct

SEQ ID NO: 2151188 - DNA, 13 bp, Homo sapiens
tggcagctgggcc

SEQ ID NO: 2151189 - DNA, 15 bp, Homo sapiens
tggcagctgggccca

SEQ ID NO: 2151190 - DNA, 16 bp, Homo sapiens
tggcagctgggcccac

SEQ ID NO: 2151191 - DNA, 19 bp, Homo sapiens
tggcagctgggcccacagc

SEQ ID NO: 2151192 - DNA, 12 bp, Homo sapiens
tggccaccaccc

SEQ ID NO: 2151193 - DNA, 13 bp, Homo sapiens
tggccaccaccca

SEQ ID NO: 2151194 - DNA, 19 bp, Homo sapiens
tggccacccgttctgctgg

SEQ ID NO: 2151195 - DNA, 18 bp, Homo sapiens
tggcccagagctggaaca

SEQ ID NO: 2151196 - DNA, 15 bp, Homo sapiens
tggcccctggaacct

SEQ ID NO: 2151197 - DNA, 19 bp, Homo sapiens
tggcccctggaacctttcc

SEQ ID NO: 2151198 - DNA, 13 bp, Homo sapiens
tggccctcttctt

SEQ ID NO: 2151199 - DNA, 14 bp, Homo sapiens
tggcctggatctcc

SEQ ID NO: 2151200 - DNA, 18 bp, Homo sapiens
tggccttccctccccaca

SEQ ID NO: 2151201 - DNA, 14 bp, Homo sapiens
tggctatggccacc

SEQ ID NO: 2151202 - DNA, 15 bp, Homo sapiens
tggctcagctgtggt

SEQ ID NO: 2151203 - DNA, 16 bp, Homo sapiens
tggctccagaatgtgc

SEQ ID NO: 2151204 - DNA, 22 bp, Homo sapiens
tggctgaacagtgctctgcctc

SEQ ID NO: 2151205 - DNA, 23 bp, Homo sapiens
tggctgaacagtgctctgcctct

SEQ ID NO: 2151206 - DNA, 15 bp, Homo sapiens
tggctgggggaggga

SEQ ID NO: 2151207 - DNA, 20 bp, Homo sapiens
tggctttaggagcagtggga

SEQ ID NO: 2151208 - DNA, 13 bp, Homo sapiens
tgggagcactgga

SEQ ID NO: 2151209 - DNA, 22 bp, Homo sapiens
tgggagcctgcaaactcactgc

SEQ ID NO: 2151210 - DNA, 13 bp, Homo sapiens
tgggaggcagcat

SEQ ID NO: 2151211 - DNA, 15 bp, Homo sapiens
tgggagggatcagcc

SEQ ID NO: 2151212 - DNA, 18 bp, Homo sapiens
tgggagggatcagccccg

SEQ ID NO: 2151213 - DNA, 20 bp, Homo sapiens
tgggagggatcagccccgcc

SEQ ID NO: 2151214 - DNA, 19 bp, Homo sapiens
tgggccatgggtcctcggc

SEQ ID NO: 2151215 - DNA, 13 bp, Homo sapiens
tgggcccacagcc

SEQ ID NO: 2151216 - DNA, 14 bp, Homo sapiens
tgggcccacagccc

SEQ ID NO: 2151217 - DNA, 20 bp, Homo sapiens
tgggcccacagcccccaccc

SEQ ID NO: 2151218 - DNA, 22 bp, Homo sapiens
tgggcccccagagacctttgcc

SEQ ID NO: 2151219 - DNA, 16 bp, Homo sapiens
tgggcccctcagggga

SEQ ID NO: 2151220 - DNA, 22 bp, Homo sapiens
tgggcccctcaggggaagctgc

SEQ ID NO: 2151221 - DNA, 16 bp, Homo sapiens
tgggcctgacctccag

SEQ ID NO: 2151222 - DNA, 23 bp, Homo sapiens
tgggcctgacctccagtcctgct

SEQ ID NO: 2151223 - DNA, 11 bp, Homo sapiens
tggggctcctt

SEQ ID NO: 2151224 - DNA, 23 bp, Homo sapiens
tggggctggtgaggccggccctg

SEQ ID NO: 2151225 - DNA, 15 bp, Homo sapiens
aagtgaatttgcctg

SEQ ID NO: 2151226 - DNA, 16 bp, Homo sapiens
aagtgaatttgcctgt

SEQ ID NO: 2151227 - DNA, 17 bp, Homo sapiens
aagtgaatttgcctgta

SEQ ID NO: 2151228 - DNA, 20 bp, Homo sapiens
aagtgctgtttgggcaggag

SEQ ID NO: 2151229 - DNA, 14 bp, Homo sapiens
aagtgtaattgaga

SEQ ID NO: 2151230 - DNA, 15 bp, Homo sapiens
aagttaatttaaagt

SEQ ID NO: 2151231 - DNA, 17 bp, Homo sapiens
aagttaatttaaagttg

SEQ ID NO: 2151232 - DNA, 16 bp, Homo sapiens
aagttatagtatatct

SEQ ID NO: 2151233 - DNA, 12 bp, Homo sapiens
aataaagtgtat

SEQ ID NO: 2151234 - DNA, 13 bp, Homo sapiens
aataaagtttatt

SEQ ID NO: 2151235 - DNA, 13 bp, Homo sapiens
aatacaattaaag

SEQ ID NO: 2151236 - DNA, 15 bp, Homo sapiens
aatacaattaaaggt

SEQ ID NO: 2151237 - DNA, 21 bp, Homo sapiens
aatacaccacctcactcctgt

SEQ ID NO: 2151238 - DNA, 22 bp, Homo sapiens
aatacaccacctcactcctgtt

SEQ ID NO: 2151239 - DNA, 15 bp, Homo sapiens
aatacagacactaag

SEQ ID NO: 2151240 - DNA, 21 bp, Homo sapiens
aatatctgagaagtgtatata

SEQ ID NO: 2151241 - DNA, 19 bp, Homo sapiens
aatattaaatacagacact

SEQ ID NO: 2151242 - DNA, 14 bp, Homo sapiens
aatcaatgtgagtt

SEQ ID NO: 2151243 - DNA, 11 bp, Homo sapiens
aatcctgggcc

SEQ ID NO: 2151244 - DNA, 12 bp, Homo sapiens
aatcctgggccc

SEQ ID NO: 2151245 - DNA, 12 bp, Homo sapiens
aatctattcaga

SEQ ID NO: 2151246 - DNA, 19 bp, Homo sapiens
aatctggcaaagttatatt

SEQ ID NO: 2151247 - DNA, 19 bp, Homo sapiens
aatctgtagggctggacct

SEQ ID NO: 2151248 - DNA, 22 bp, Homo sapiens
aatctttctttacctgagacca

SEQ ID NO: 2151249 - DNA, 12 bp, Homo sapiens
aatgaacaaatg

SEQ ID NO: 2151250 - DNA, 22 bp, Homo sapiens
aatgacagtccgtcaaaacaga

SEQ ID NO: 2151251 - DNA, 14 bp, Homo sapiens
aatgatgtccagaa

SEQ ID NO: 2151252 - DNA, 18 bp, Homo sapiens
aatgatgtccagaagaat

SEQ ID NO: 2151253 - DNA, 17 bp, Homo sapiens
aatgcattattttgaat

SEQ ID NO: 2151254 - DNA, 19 bp, Homo sapiens
aatggtgttactaaagtca

SEQ ID NO: 2151255 - DNA, 19 bp, Homo sapiens
aatgtaaagcttgtctgat

SEQ ID NO: 2151256 - DNA, 14 bp, Homo sapiens
aatgtcagaaactc

SEQ ID NO: 2151257 - DNA, 23 bp, Homo sapiens
aatgtcagaaactcgatgaatgt

SEQ ID NO: 2151258 - DNA, 18 bp, Homo sapiens
aattcaacctgtgtctta

SEQ ID NO: 2151259 - DNA, 15 bp, Homo sapiens
aattgagaaggaaaa

SEQ ID NO: 2151260 - DNA, 22 bp, Homo sapiens
aatttgcctgtaacaagccaga

SEQ ID NO: 2151261 - DNA, 21 bp, Homo sapiens
aattttactgacagaaatgca

SEQ ID NO: 2151262 - DNA, 22 bp, Homo sapiens
acaaagcttctatcccaggagg

SEQ ID NO: 2151263 - DNA, 16 bp, Homo sapiens
acaacctgcccctccc

SEQ ID NO: 2151264 - DNA, 20 bp, Homo sapiens
acacaccccacaccccagcc

SEQ ID NO: 2151265 - DNA, 21 bp, Homo sapiens
acacaccccacaccccagccc

SEQ ID NO: 2151266 - DNA, 13 bp, Homo sapiens
acacactaatcga

SEQ ID NO: 2151267 - DNA, 15 bp, Homo sapiens
acacactcagcagcc

SEQ ID NO: 2151268 - DNA, 13 bp, Homo sapiens
acacactccttcc

SEQ ID NO: 2151269 - DNA, 14 bp, Homo sapiens
acacactccttccc

SEQ ID NO: 2151270 - DNA, 15 bp, Homo sapiens
acacactccttcccc

SEQ ID NO: 2151271 - DNA, 16 bp, Homo sapiens
acacactccttcccct

SEQ ID NO: 2151272 - DNA, 16 bp, Homo sapiens
acacatatatgtatat

SEQ ID NO: 2151273 - DNA, 17 bp, Homo sapiens
acaccataggtagaatg

SEQ ID NO: 2151274 - DNA, 13 bp, Homo sapiens
acaccccagccca

SEQ ID NO: 2151275 - DNA, 14 bp, Homo sapiens
acaccctgcctgct

SEQ ID NO: 2151276 - DNA, 18 bp, Homo sapiens
acaccctgcctgctgtgg

SEQ ID NO: 2151277 - DNA, 19 bp, Homo sapiens
acaccctgcctgctgtgga

SEQ ID NO: 2151278 - DNA, 21 bp, Homo sapiens
acaccctgcctgctgtggagc

SEQ ID NO: 2151279 - DNA, 22 bp, Homo sapiens
acacggctgcctgacactgagc

SEQ ID NO: 2151280 - DNA, 19 bp, Homo sapiens
acactaagttatagtatat

SEQ ID NO: 2151281 - DNA, 18 bp, Homo sapiens
acactattaccatgagaa

SEQ ID NO: 2151282 - DNA, 14 bp, Homo sapiens
acactcagcagccc

SEQ ID NO: 2151283 - DNA, 21 bp, Homo sapiens
attcaggacttaacggctcca

SEQ ID NO: 2151284 - DNA, 17 bp, Homo sapiens
attcaggtgttctcttc

SEQ ID NO: 2151285 - DNA, 18 bp, Homo sapiens
attcatgctttctccttt

SEQ ID NO: 2151286 - DNA, 23 bp, Homo sapiens
attcccactaagctttctccttt

SEQ ID NO: 2151287 - DNA, 16 bp, Homo sapiens
attcgaatgacactgt

SEQ ID NO: 2151288 - DNA, 22 bp, Homo sapiens
attctaataaatcaatgtgagt

SEQ ID NO: 2151289 - DNA, 15 bp, Homo sapiens
attctacacatatat

SEQ ID NO: 2151290 - DNA, 20 bp, Homo sapiens
attctacacatatatgtata

SEQ ID NO: 2151291 - DNA, 20 bp, Homo sapiens
attctgattcgaatgacact

SEQ ID NO: 2151292 - DNA, 22 bp, Homo sapiens
attctgattcgaatgacactgt

SEQ ID NO: 2151293 - DNA, 17 bp, Homo sapiens
attctttatcttgacat

SEQ ID NO: 2151294 - DNA, 16 bp, Homo sapiens
attgaaggagaaaatg

SEQ ID NO: 2151295 - DNA, 14 bp, Homo sapiens
attgattaaaatct

SEQ ID NO: 2151296 - DNA, 18 bp, Homo sapiens
attggccctgcccctccc

SEQ ID NO: 2151297 - DNA, 18 bp, Homo sapiens
attgggcagaatcctggg

SEQ ID NO: 2151298 - DNA, 20 bp, Homo sapiens
attgggcagaatcctgggcc

SEQ ID NO: 2151299 - DNA, 21 bp, Homo sapiens
attgtgccatgtcaaacaaat

SEQ ID NO: 2151300 - DNA, 22 bp, Homo sapiens
attgtgccatgtcaaacaaata

SEQ ID NO: 2151301 - DNA, 16 bp, Homo sapiens
attgtttgcacagagg

SEQ ID NO: 2151302 - DNA, 14 bp, Homo sapiens
atttaaagttgttt

SEQ ID NO: 2151303 - DNA, 22 bp, Homo sapiens
atttaatatctgagaagtgtat

SEQ ID NO: 2151304 - DNA, 14 bp, Homo sapiens
atttagaatatatt

SEQ ID NO: 2151305 - DNA, 18 bp, Homo sapiens
atttatattgtaaatatt

SEQ ID NO: 2151306 - DNA, 15 bp, Homo sapiens
atttccacataaagg

SEQ ID NO: 2151307 - DNA, 21 bp, Homo sapiens
atttccacataaaggtattta

SEQ ID NO: 2151308 - DNA, 19 bp, Homo sapiens
atttctaggtaggaaatgt

SEQ ID NO: 2151309 - DNA, 13 bp, Homo sapiens
atttgcctgtaac

SEQ ID NO: 2151310 - DNA, 22 bp, Homo sapiens
atttgcctgtaacaagccagat

SEQ ID NO: 2151311 - DNA, 20 bp, Homo sapiens
atttggcagaactgctgggg

SEQ ID NO: 2151312 - DNA, 23 bp, Homo sapiens
atttggcagaactgctggggctg

SEQ ID NO: 2151313 - DNA, 13 bp, Homo sapiens
atttgttgagagt

SEQ ID NO: 2151314 - DNA, 13 bp, Homo sapiens
attttaacaaaag

SEQ ID NO: 2151315 - DNA, 18 bp, Homo sapiens
attttaacaaaagcaaga

SEQ ID NO: 2151316 - DNA, 15 bp, Homo sapiens
attttactgacagaa

SEQ ID NO: 2151317 - DNA, 16 bp, Homo sapiens
attttactgacagaaa

SEQ ID NO: 2151318 - DNA, 19 bp, Homo sapiens
attttgtgaaagaaggagc

SEQ ID NO: 2151319 - DNA, 19 bp, Homo sapiens
atttttggttgtcaatatt

SEQ ID NO: 2151320 - DNA, 13 bp, Homo sapiens
caaaaaaacacta

SEQ ID NO: 2151321 - DNA, 16 bp, Homo sapiens
caaaagcaagactgtt

SEQ ID NO: 2151322 - DNA, 19 bp, Homo sapiens
caaaagttacatgtttgca

SEQ ID NO: 2151323 - DNA, 15 bp, Homo sapiens
caaagaactgcccca

SEQ ID NO: 2151324 - DNA, 20 bp, Homo sapiens
caaagaactgccccatctcc

SEQ ID NO: 2151325 - DNA, 16 bp, Homo sapiens
caaagagtctctggct

SEQ ID NO: 2151326 - DNA, 18 bp, Homo sapiens
caaagagtctctggctca

SEQ ID NO: 2151327 - DNA, 19 bp, Homo sapiens
caaagagtctctggctcag

SEQ ID NO: 2151328 - DNA, 20 bp, Homo sapiens
caaagagtctctggctcagc

SEQ ID NO: 2151329 - DNA, 20 bp, Homo sapiens
caaagcttctatcccaggag

SEQ ID NO: 2151330 - DNA, 16 bp, Homo sapiens
caaagggcagtaaagt

SEQ ID NO: 2151331 - DNA, 22 bp, Homo sapiens
caaaggggaggcatcagtgtcc

SEQ ID NO: 2151332 - DNA, 13 bp, Homo sapiens
caaatctattcag

SEQ ID NO: 2151333 - DNA, 16 bp, Homo sapiens
caaatgagcattagct

SEQ ID NO: 2151334 - DNA, 17 bp, Homo sapiens
caacatgggagggatca

SEQ ID NO: 2151335 - DNA, 19 bp, Homo sapiens
caacatgggagggatcagc

SEQ ID NO: 2151336 - DNA, 22 bp, Homo sapiens
caacatgggagggatcagcccc

SEQ ID NO: 2151337 - DNA, 16 bp, Homo sapiens
caaccccagacactgg

SEQ ID NO: 2151338 - DNA, 11 bp, Homo sapiens
caacccctccc

SEQ ID NO: 2151339 - DNA, 17 bp, Homo sapiens
caacctgcccctcccca

SEQ ID NO: 2151340 - DNA, 22 bp, Homo sapiens
caacctgcccctccccagccct

SEQ ID NO: 2151341 - DNA, 14 bp, Homo sapiens
caacctgtccttac

SEQ ID NO: 2151342 - DNA, 21 bp, Homo sapiens
caacctgtccttactcagagc

SEQ ID NO: 2151343 - DNA, 23 bp, Homo sapiens
caacctgtccttactcagagctg

SEQ ID NO: 2151344 - DNA, 14 bp, Homo sapiens
caacctgtgtctta

SEQ ID NO: 2151345 - DNA, 14 bp, Homo sapiens
caagacaaagcaaa

SEQ ID NO: 2151346 - DNA, 14 bp, Homo sapiens
caagactgttgctc

SEQ ID NO: 2151347 - DNA, 18 bp, Homo sapiens
caagactgttgctcaaat

SEQ ID NO: 2151348 - DNA, 12 bp, Homo sapiens
caagagaacatt

SEQ ID NO: 2151349 - DNA, 15 bp, Homo sapiens
caagagactgagtca

SEQ ID NO: 2151350 - DNA, 17 bp, Homo sapiens
caagaggggcgggctca

SEQ ID NO: 2151351 - DNA, 19 bp, Homo sapiens
caagaggggcgggctcaga

SEQ ID NO: 2151352 - DNA, 21 bp, Homo sapiens
caagaggggcgggctcagagc

SEQ ID NO: 2151353 - DNA, 22 bp, Homo sapiens
caagaggggcgggctcagagct

SEQ ID NO: 2151354 - DNA, 23 bp, Homo sapiens
caagaggggcgggctcagagctt

SEQ ID NO: 2151355 - DNA, 16 bp, Homo sapiens
caagagtctctccagc

SEQ ID NO: 2151356 - DNA, 22 bp, Homo sapiens
caagagtctctccagcctcaca

SEQ ID NO: 2151357 - DNA, 15 bp, Homo sapiens
caagccaacttgtaa

SEQ ID NO: 2151358 - DNA, 17 bp, Homo sapiens
caagccaccgcagctgc

SEQ ID NO: 2151359 - DNA, 18 bp, Homo sapiens
caagccaccgcagctgct

SEQ ID NO: 2151360 - DNA, 23 bp, Homo sapiens
caagccaccgcagctgctgccac

SEQ ID NO: 2151361 - DNA, 20 bp, Homo sapiens
caaggtctcacactcctcct

SEQ ID NO: 2151362 - DNA, 24 bp, Homo sapiens
caaggtctcacactcctcctgcca

SEQ ID NO: 2151363 - DNA, 16 bp, Homo sapiens
caagtctctctgtgaa

SEQ ID NO: 2151364 - DNA, 22 bp, Homo sapiens
caagtctctctgtgaatacaat

SEQ ID NO: 2151365 - DNA, 21 bp, Homo sapiens
caagtgctgtttgggcaggag

SEQ ID NO: 2151366 - DNA, 21 bp, Homo sapiens
caagttgttccttaagtcaga

SEQ ID NO: 2151367 - DNA, 19 bp, Homo sapiens
caatccatttggcagaact

SEQ ID NO: 2151368 - DNA, 21 bp, Homo sapiens
caatccatttggcagaactgc

SEQ ID NO: 2151369 - DNA, 23 bp, Homo sapiens
caatccatttggcagaactgctg

SEQ ID NO: 2151370 - DNA, 17 bp, Homo sapiens
caattaaaggtcctgcc

SEQ ID NO: 2151371 - DNA, 20 bp, Homo sapiens
caattaaaggtcctgccctc

SEQ ID NO: 2151372 - DNA, 13 bp, Homo sapiens
caatttctgaaca

SEQ ID NO: 2151373 - DNA, 13 bp, Homo sapiens
cacacacactcct

SEQ ID NO: 2151374 - DNA, 15 bp, Homo sapiens
cacaccccagcccac

SEQ ID NO: 2151375 - DNA, 21 bp, Homo sapiens
cacaccccagcccaccctgct

SEQ ID NO: 2151376 - DNA, 19 bp, Homo sapiens
cacactattaccatgagaa

SEQ ID NO: 2151377 - DNA, 13 bp, Homo sapiens
cacactccagaat

SEQ ID NO: 2151378 - DNA, 19 bp, Homo sapiens
cacactcctcctgccagct

SEQ ID NO: 2151379 - DNA, 18 bp, Homo sapiens
ccaggcaggccctgcctt

SEQ ID NO: 2151380 - DNA, 18 bp, Homo sapiens
ccaggcttcaccctgaat

SEQ ID NO: 2151381 - DNA, 18 bp, Homo sapiens
ccagggccagcaggcagc

SEQ ID NO: 2151382 - DNA, 22 bp, Homo sapiens
ccagtcatggtactaccccagc

SEQ ID NO: 2151383 - DNA, 18 bp, Homo sapiens
ccagtcctccagaccacc

SEQ ID NO: 2151384 - DNA, 14 bp, Homo sapiens
ccagtcctgctggc

SEQ ID NO: 2151385 - DNA, 18 bp, Homo sapiens
ccagttgggagcactgga

SEQ ID NO: 2151386 - DNA, 19 bp, Homo sapiens
ccagttgggagcactggag

SEQ ID NO: 2151387 - DNA, 14 bp, Homo sapiens
ccatccccttcccc

SEQ ID NO: 2151388 - DNA, 12 bp, Homo sapiens
ccatccctacca

SEQ ID NO: 2151389 - DNA, 16 bp, Homo sapiens
ccatccctaccactgt

SEQ ID NO: 2151390 - DNA, 16 bp, Homo sapiens
ccatcctcctctccat

SEQ ID NO: 2151391 - DNA, 23 bp, Homo sapiens
ccatcctcctctccatgcaagtg

SEQ ID NO: 2151392 - DNA, 13 bp, Homo sapiens
ccatctcctccca

SEQ ID NO: 2151393 - DNA, 16 bp, Homo sapiens
ccatctgtccatcctc

SEQ ID NO: 2151394 - DNA, 17 bp, Homo sapiens
ccatctgtccatcctcc

SEQ ID NO: 2151395 - DNA, 22 bp, Homo sapiens
ccatctgtccatcctcctctcc

SEQ ID NO: 2151396 - DNA, 17 bp, Homo sapiens
ccatgagaagagggcct

SEQ ID NO: 2151397 - DNA, 14 bp, Homo sapiens
ccatgcaagtgctg

SEQ ID NO: 2151398 - DNA, 13 bp, Homo sapiens
ccatgcctgaggg

SEQ ID NO: 2151399 - DNA, 21 bp, Homo sapiens
ccatggccttccctccccaca

SEQ ID NO: 2151400 - DNA, 16 bp, Homo sapiens
ccatgtcaaacaaata

SEQ ID NO: 2151401 - DNA, 22 bp, Homo sapiens
ccatttggcagaactgctgggg

SEQ ID NO: 2151402 - DNA, 21 bp, Homo sapiens
cccaacatgggagggatcagc

SEQ ID NO: 2151403 - DNA, 23 bp, Homo sapiens
cccaacctgtccttactcagagc

SEQ ID NO: 2151404 - DNA, 20 bp, Homo sapiens
cccaagaggggcgggctcag

SEQ ID NO: 2151405 - DNA, 16 bp, Homo sapiens
cccaagggcctcccac

SEQ ID NO: 2151406 - DNA, 19 bp, Homo sapiens
cccaagtagtagtgtcttc

SEQ ID NO: 2151407 - DNA, 21 bp, Homo sapiens
cccacacacactccttcccct

SEQ ID NO: 2151408 - DNA, 16 bp, Homo sapiens
cccacaccccagccca

SEQ ID NO: 2151409 - DNA, 15 bp, Homo sapiens
cccacagcccccacc

SEQ ID NO: 2151410 - DNA, 22 bp, Homo sapiens
cccacagtcctcacagcctctc

SEQ ID NO: 2151411 - DNA, 14 bp, Homo sapiens
cccacatcccaggc

SEQ ID NO: 2151412 - DNA, 20 bp, Homo sapiens
cccacatcccaggcttcacc

SEQ ID NO: 2151413 - DNA, 21 bp, Homo sapiens
cccaccaaggtctcacactcc

SEQ ID NO: 2151414 - DNA, 22 bp, Homo sapiens
cccaccaaggtctcacactcct

SEQ ID NO: 2151415 - DNA, 22 bp, Homo sapiens
cccaccagagctgcctccccaa

SEQ ID NO: 2151416 - DNA, 19 bp, Homo sapiens
cccacggggaccactgggc

SEQ ID NO: 2151417 - DNA, 18 bp, Homo sapiens
cccacgtctctctgcctg

SEQ ID NO: 2151418 - DNA, 16 bp, Homo sapiens
cccactaagctttctc

SEQ ID NO: 2151419 - DNA, 12 bp, Homo sapiens
cccactcctaat

SEQ ID NO: 2151420 - DNA, 20 bp, Homo sapiens
cccagagacctttgcccaca

SEQ ID NO: 2151421 - DNA, 13 bp, Homo sapiens
cccagcacagctc

SEQ ID NO: 2151422 - DNA, 14 bp, Homo sapiens
cccagcacagctcc

SEQ ID NO: 2151423 - DNA, 20 bp, Homo sapiens
cccagcacagctcctcccct

SEQ ID NO: 2151424 - DNA, 17 bp, Homo sapiens
cccagcagccctaagga

SEQ ID NO: 2151425 - DNA, 23 bp, Homo sapiens
cccagcccaccctgctcctcctg

SEQ ID NO: 2151426 - DNA, 22 bp, Homo sapiens
cccagccccttctcccagcaca

SEQ ID NO: 2151427 - DNA, 20 bp, Homo sapiens
cccagctaatctgtagggct

SEQ ID NO: 2151428 - DNA, 15 bp, Homo sapiens
cccaggaagggaggg

SEQ ID NO: 2151429 - DNA, 20 bp, Homo sapiens
cccaggaagggagggagctg

SEQ ID NO: 2151430 - DNA, 21 bp, Homo sapiens
cccaggaagggagggagctga

SEQ ID NO: 2151431 - DNA, 18 bp, Homo sapiens
cccatctcttcctaccca

SEQ ID NO: 2151432 - DNA, 13 bp, Homo sapiens
cccatctgtccat

SEQ ID NO: 2151433 - DNA, 16 bp, Homo sapiens
cccatctgtccatcct

SEQ ID NO: 2151434 - DNA, 19 bp, Homo sapiens
cccatctgtccatcctcct

SEQ ID NO: 2151435 - DNA, 23 bp, Homo sapiens
cccatctgtccatcctcctctcc

SEQ ID NO: 2151436 - DNA, 15 bp, Homo sapiens
ccccacaccccagcc

SEQ ID NO: 2151437 - DNA, 16 bp, Homo sapiens
ccccacaccccagccc

SEQ ID NO: 2151438 - DNA, 18 bp, Homo sapiens
ccccacaccccagcccac

SEQ ID NO: 2151439 - DNA, 23 bp, Homo sapiens
ccccacaccccagcccaccctgc

SEQ ID NO: 2151440 - DNA, 12 bp, Homo sapiens
ccccacagtcct

SEQ ID NO: 2151441 - DNA, 16 bp, Homo sapiens
ccccaccagagctgcc

SEQ ID NO: 2151442 - DNA, 17 bp, Homo sapiens
ccccaccagagctgcct

SEQ ID NO: 2151443 - DNA, 21 bp, Homo sapiens
ccccactctaggggtcaggct

SEQ ID NO: 2151444 - DNA, 13 bp, Homo sapiens
ccccagacactgg

SEQ ID NO: 2151445 - DNA, 21 bp, Homo sapiens
ccccagcacagctcctcccct

SEQ ID NO: 2151446 - DNA, 22 bp, Homo sapiens
ccccagccccttctcccagcac

SEQ ID NO: 2151447 - DNA, 21 bp, Homo sapiens
cccccacgtctctctgcctgc

SEQ ID NO: 2151448 - DNA, 12 bp, Homo sapiens
cccccagagacc

SEQ ID NO: 2151449 - DNA, 15 bp, Homo sapiens
cccccagagaccttt

SEQ ID NO: 2151450 - DNA, 23 bp, Homo sapiens
cccccagagacctttgcccacac

SEQ ID NO: 2151451 - DNA, 18 bp, Homo sapiens
cccccaggattgtgcaat

SEQ ID NO: 2151452 - DNA, 18 bp, Homo sapiens
ccccctcccctcccagtc

SEQ ID NO: 2151453 - DNA, 12 bp, Homo sapiens
ccccgcctgtca

SEQ ID NO: 2151454 - DNA, 15 bp, Homo sapiens
cccctaccgcatggc

SEQ ID NO: 2151455 - DNA, 17 bp, Homo sapiens
cccctaccgcatggcag

SEQ ID NO: 2151456 - DNA, 19 bp, Homo sapiens
cccctaccgcatggcagct

SEQ ID NO: 2151457 - DNA, 15 bp, Homo sapiens
cccctcacagactct

SEQ ID NO: 2151458 - DNA, 19 bp, Homo sapiens
cccctcacagactcttcca

SEQ ID NO: 2151459 - DNA, 15 bp, Homo sapiens
cccctcccccacgtc

SEQ ID NO: 2151460 - DNA, 22 bp, Homo sapiens
cccctcccccacgtctctctgc

SEQ ID NO: 2151461 - DNA, 12 bp, Homo sapiens
cccctggaacct

SEQ ID NO: 2151462 - DNA, 22 bp, Homo sapiens
cccctggaacctttcccttgtg

SEQ ID NO: 2151463 - DNA, 21 bp, Homo sapiens
cccctggctgaacagtgctct

SEQ ID NO: 2151464 - DNA, 23 bp, Homo sapiens
cccctggctgaacagtgctctgc

SEQ ID NO: 2151465 - DNA, 14 bp, Homo sapiens
cccctggggctggt

SEQ ID NO: 2151466 - DNA, 17 bp, Homo sapiens
cccctgtcccctggggc

SEQ ID NO: 2151467 - DNA, 17 bp, Homo sapiens
ccccttgcccttcctga

SEQ ID NO: 2151468 - DNA, 20 bp, Homo sapiens
ccccttgcccttcctgaccc

SEQ ID NO: 2151469 - DNA, 13 bp, Homo sapiens
ccccttgtccctg

SEQ ID NO: 2151470 - DNA, 20 bp, Homo sapiens
ccccttgtccctggggcact

SEQ ID NO: 2151471 - DNA, 22 bp, Homo sapiens
ccccttgtccctggggcactcc

SEQ ID NO: 2151472 - DNA, 13 bp, Homo sapiens
cccgcctgtcaca

SEQ ID NO: 2151473 - DNA, 19 bp, Homo sapiens
cccggattggccctgcccc

SEQ ID NO: 2151474 - DNA, 21 bp, Homo sapiens
cccggattggccctgcccctc

SEQ ID NO: 2151475 - DNA, 18 bp, Homo sapiens
cccggcctgctcccagca

SEQ ID NO: 2151476 - DNA, 21 bp, Homo sapiens
cccggctgggtcggccctgcc

SEQ ID NO: 2151477 - DNA, 23 bp, Homo sapiens
cccgggaagcatcctccccacca

SEQ ID NO: 2151478 - DNA, 17 bp, Homo sapiens
cccgttctgctggcctg

SEQ ID NO: 2151479 - DNA, 21 bp, Homo sapiens
ccctaccgcatggcagctggg

SEQ ID NO: 2151480 - DNA, 22 bp, Homo sapiens
ccctagatccaggcttctcccg

SEQ ID NO: 2151481 - DNA, 13 bp, Homo sapiens
ccctcacagactc

SEQ ID NO: 2151482 - DNA, 19 bp, Homo sapiens
ccctcacagactcttccac

SEQ ID NO: 2151483 - DNA, 15 bp, Homo sapiens
ccctcaggggaagct

SEQ ID NO: 2151484 - DNA, 22 bp, Homo sapiens
acgtctctctgcctgctgggct

SEQ ID NO: 2151485 - DNA, 22 bp, Homo sapiens
actaagccctgtcgagacactt

SEQ ID NO: 2151486 - DNA, 18 bp, Homo sapiens
actaagttatagtatatc

SEQ ID NO: 2151487 - DNA, 19 bp, Homo sapiens
actacctttgtccaggcct

SEQ ID NO: 2151488 - DNA, 12 bp, Homo sapiens
actagggcctcg

SEQ ID NO: 2151489 - DNA, 22 bp, Homo sapiens
actagggcctcggaggctcctc

SEQ ID NO: 2151490 - DNA, 22 bp, Homo sapiens
actagggtcctggccctcttct

SEQ ID NO: 2151491 - DNA, 22 bp, Homo sapiens
actcactgctcaagaagacatg

SEQ ID NO: 2151492 - DNA, 11 bp, Homo sapiens
actcagagctg

SEQ ID NO: 2151493 - DNA, 17 bp, Homo sapiens
actcagagctgcgggct

SEQ ID NO: 2151494 - DNA, 21 bp, Homo sapiens
actcagagctgcgggctgagg

SEQ ID NO: 2151495 - DNA, 19 bp, Homo sapiens
actccagaattacccttcc

SEQ ID NO: 2151496 - DNA, 22 bp, Homo sapiens
actccagaattacccttcctca

SEQ ID NO: 2151497 - DNA, 13 bp, Homo sapiens
actccctcctcac

SEQ ID NO: 2151498 - DNA, 20 bp, Homo sapiens
actccctcctcacactccag

SEQ ID NO: 2151499 - DNA, 21 bp, Homo sapiens
actccctcctcacactccaga

SEQ ID NO: 2151500 - DNA, 23 bp, Homo sapiens
actcctaatcaagagtctctcca

SEQ ID NO: 2151501 - DNA, 13 bp, Homo sapiens
actcctcctgcca

SEQ ID NO: 2151502 - DNA, 14 bp, Homo sapiens
actcctcctgccag

SEQ ID NO: 2151503 - DNA, 22 bp, Homo sapiens
actcctcctgccagctctgtca

SEQ ID NO: 2151504 - DNA, 22 bp, Homo sapiens
actcctgccctgttgtgtatag

SEQ ID NO: 2151505 - DNA, 16 bp, Homo sapiens
actcctgttacttacc

SEQ ID NO: 2151506 - DNA, 17 bp, Homo sapiens
actcctgttacttacct

SEQ ID NO: 2151507 - DNA, 20 bp, Homo sapiens
actccttccccttgtccctg

SEQ ID NO: 2151508 - DNA, 21 bp, Homo sapiens
actccttccccttgtccctgg

SEQ ID NO: 2151509 - DNA, 22 bp, Homo sapiens
actctatatagctgatcagttt

SEQ ID NO: 2151510 - DNA, 19 bp, Homo sapiens
actcttccaccagagcagg

SEQ ID NO: 2151511 - DNA, 13 bp, Homo sapiens
actgagccccacc

SEQ ID NO: 2151512 - DNA, 22 bp, Homo sapiens
actgagggccacactattacca

SEQ ID NO: 2151513 - DNA, 22 bp, Homo sapiens
actgattttgttatttttatat

SEQ ID NO: 2151514 - DNA, 15 bp, Homo sapiens
actgccccatctcct

SEQ ID NO: 2151515 - DNA, 12 bp, Homo sapiens
actgctggggct

SEQ ID NO: 2151516 - DNA, 18 bp, Homo sapiens
actgctggggctggtgag

SEQ ID NO: 2151517 - DNA, 22 bp, Homo sapiens
actgctgttaattgattaaaat

SEQ ID NO: 2151518 - DNA, 17 bp, Homo sapiens
actggaacttgaactga

SEQ ID NO: 2151519 - DNA, 23 bp, Homo sapiens
actgggccatgggtcctcggccc

SEQ ID NO: 2151520 - DNA, 12 bp, Homo sapiens
actgggcccctc

SEQ ID NO: 2151521 - DNA, 14 bp, Homo sapiens
actgggcccctcag

SEQ ID NO: 2151522 - DNA, 17 bp, Homo sapiens
actggtgggcagctgag

SEQ ID NO: 2151523 - DNA, 17 bp, Homo sapiens
actggtttgaagaatgt

SEQ ID NO: 2151524 - DNA, 13 bp, Homo sapiens
actgtgctcccac

SEQ ID NO: 2151525 - DNA, 15 bp, Homo sapiens
actgtgctcccacgg

SEQ ID NO: 2151526 - DNA, 12 bp, Homo sapiens
actgttgctcaa

SEQ ID NO: 2151527 - DNA, 21 bp, Homo sapiens
actgttgctcaaatctattca

SEQ ID NO: 2151528 - DNA, 18 bp, Homo sapiens
actgtttttcggacagtt

SEQ ID NO: 2151529 - DNA, 19 bp, Homo sapiens
acttacctaaacagatata

SEQ ID NO: 2151530 - DNA, 15 bp, Homo sapiens
acttcccccaccctg

SEQ ID NO: 2151531 - DNA, 17 bp, Homo sapiens
acttcccccaccctggg

SEQ ID NO: 2151532 - DNA, 21 bp, Homo sapiens
acttgaactgattcacatctc

SEQ ID NO: 2151533 - DNA, 12 bp, Homo sapiens
acttgacagtgg

SEQ ID NO: 2151534 - DNA, 13 bp, Homo sapiens
acttgacagtgga

SEQ ID NO: 2151535 - DNA, 16 bp, Homo sapiens
acttgtaaatacacca

SEQ ID NO: 2151536 - DNA, 18 bp, Homo sapiens
acttttaatgaacaaatg

SEQ ID NO: 2151537 - DNA, 23 bp, Homo sapiens
agaaattttactgacagaaatgc

SEQ ID NO: 2151538 - DNA, 18 bp, Homo sapiens
agaacagcagactcagct

SEQ ID NO: 2151539 - DNA, 21 bp, Homo sapiens
agaactgccccatctcctccc

SEQ ID NO: 2151540 - DNA, 16 bp, Homo sapiens
agaactgctggggctg

SEQ ID NO: 2151541 - DNA, 14 bp, Homo sapiens
agaagacatggaga

SEQ ID NO: 2151542 - DNA, 16 bp, Homo sapiens
agaagacatggagact

SEQ ID NO: 2151543 - DNA, 16 bp, Homo sapiens
agaaggagcaagagaa

SEQ ID NO: 2151544 - DNA, 11 bp, Homo sapiens
agaaggcctcc

SEQ ID NO: 2151545 - DNA, 12 bp, Homo sapiens
agaaggcctccc

SEQ ID NO: 2151546 - DNA, 15 bp, Homo sapiens
agaaggcctcccctg

SEQ ID NO: 2151547 - DNA, 19 bp, Homo sapiens
agaaggcctcccctgagga

SEQ ID NO: 2151548 - DNA, 19 bp, Homo sapiens
agaagtaactcccactcct

SEQ ID NO: 2151549 - DNA, 13 bp, Homo sapiens
agaagtgtatata

SEQ ID NO: 2151550 - DNA, 13 bp, Homo sapiens
agaatatatacat

SEQ ID NO: 2151551 - DNA, 14 bp, Homo sapiens
agaatcctgggccc

SEQ ID NO: 2151552 - DNA, 15 bp, Homo sapiens
agaatcctgggcccc

SEQ ID NO: 2151553 - DNA, 23 bp, Homo sapiens
agaatgtatattaaggtgtggct

SEQ ID NO: 2151554 - DNA, 21 bp, Homo sapiens
agaatgttaagacttgacagt

SEQ ID NO: 2151555 - DNA, 15 bp, Homo sapiens
agacactaagttata

SEQ ID NO: 2151556 - DNA, 19 bp, Homo sapiens
agacatggagactcctgcc

SEQ ID NO: 2151557 - DNA, 20 bp, Homo sapiens
agacattaactcattagact

SEQ ID NO: 2151558 - DNA, 20 bp, Homo sapiens
agaccaccagccgccccagc

SEQ ID NO: 2151559 - DNA, 21 bp, Homo sapiens
agaccaccagccgccccagcc

SEQ ID NO: 2151560 - DNA, 18 bp, Homo sapiens
agaccagttgggagcact

SEQ ID NO: 2151561 - DNA, 22 bp, Homo sapiens
agaccagttgggagcactggag

SEQ ID NO: 2151562 - DNA, 23 bp, Homo sapiens
agaccagttgggagcactggagt

SEQ ID NO: 2151563 - DNA, 13 bp, Homo sapiens
agactaagccctg

SEQ ID NO: 2151564 - DNA, 13 bp, Homo sapiens
agactcagctctg

SEQ ID NO: 2151565 - DNA, 20 bp, Homo sapiens
agactcagctctgacattct

SEQ ID NO: 2151566 - DNA, 15 bp, Homo sapiens
agactcctgccctgt

SEQ ID NO: 2151567 - DNA, 16 bp, Homo sapiens
agactcctgccctgtt

SEQ ID NO: 2151568 - DNA, 18 bp, Homo sapiens
agactcttccaccagagc

SEQ ID NO: 2151569 - DNA, 15 bp, Homo sapiens
agactggacagcttg

SEQ ID NO: 2151570 - DNA, 19 bp, Homo sapiens
agactgtgacatcagaagt

SEQ ID NO: 2151571 - DNA, 15 bp, Homo sapiens
agactgttgctcaaa

SEQ ID NO: 2151572 - DNA, 16 bp, Homo sapiens
agagacctttgcccac

SEQ ID NO: 2151573 - DNA, 15 bp, Homo sapiens
agagcaggggctgct

SEQ ID NO: 2151574 - DNA, 23 bp, Homo sapiens
agagcaggggctgctgggggctc

SEQ ID NO: 2151575 - DNA, 16 bp, Homo sapiens
agagccactacctttg

SEQ ID NO: 2151576 - DNA, 11 bp, Homo sapiens
agagctgcctc

SEQ ID NO: 2151577 - DNA, 22 bp, Homo sapiens
agagctgcgggctgagggcatc

SEQ ID NO: 2151578 - DNA, 23 bp, Homo sapiens
agagctgcgggctgagggcatct

SEQ ID NO: 2151579 - DNA, 11 bp, Homo sapiens
agagctttgtc

SEQ ID NO: 2151580 - DNA, 22 bp, Homo sapiens
agagctttgtcacttgccacat

SEQ ID NO: 2151581 - DNA, 20 bp, Homo sapiens
agagcttttcgaactgtgct

SEQ ID NO: 2151582 - DNA, 14 bp, Homo sapiens
agagggcgctcctg

SEQ ID NO: 2151583 - DNA, 15 bp, Homo sapiens
agagggcgctcctgt

SEQ ID NO: 2151584 - DNA, 16 bp, Homo sapiens
agaggggaagggccag

SEQ ID NO: 2151585 - DNA, 14 bp, Homo sapiens
agaggggcgggctc

SEQ ID NO: 2151586 - DNA, 15 bp, Homo sapiens
agaggggcgggctca

SEQ ID NO: 2151587 - DNA, 18 bp, Homo sapiens
agaggggcgggctcagag

SEQ ID NO: 2151588 - DNA, 13 bp, Homo sapiens
agagtctctccag

SEQ ID NO: 2151589 - DNA, 22 bp, Homo sapiens
agagtctctccagcctcacaga

SEQ ID NO: 2151590 - DNA, 13 bp, Homo sapiens
agagtctctggct

SEQ ID NO: 2151591 - DNA, 17 bp, Homo sapiens
agagtctctggctcagc

SEQ ID NO: 2151592 - DNA, 23 bp, Homo sapiens
agagtctctggctcagctgtggt

SEQ ID NO: 2151593 - DNA, 22 bp, Homo sapiens
agagtgagagacattaactcat

SEQ ID NO: 2151594 - DNA, 11 bp, Homo sapiens
agagtgtgacc

SEQ ID NO: 2151595 - DNA, 15 bp, Homo sapiens
agatagaatgacagt

SEQ ID NO: 2151596 - DNA, 19 bp, Homo sapiens
agatatgctaagcagtagt

SEQ ID NO: 2151597 - DNA, 17 bp, Homo sapiens
agatatttatatatatt

SEQ ID NO: 2151598 - DNA, 15 bp, Homo sapiens
agatccaggcttctc

SEQ ID NO: 2151599 - DNA, 16 bp, Homo sapiens
agatccaggcttctcc

SEQ ID NO: 2151600 - DNA, 20 bp, Homo sapiens
agatccaggcttctcccgga

SEQ ID NO: 2151601 - DNA, 14 bp, Homo sapiens
agatgctggcctct

SEQ ID NO: 2151602 - DNA, 18 bp, Homo sapiens
agatgctggcctcttggc

SEQ ID NO: 2151603 - DNA, 20 bp, Homo sapiens
agatggcttatttgtataat

SEQ ID NO: 2151604 - DNA, 18 bp, Homo sapiens
agatgtcagccgagccgg

SEQ ID NO: 2151605 - DNA, 16 bp, Homo sapiens
agattatatatcataa

SEQ ID NO: 2151606 - DNA, 18 bp, Homo sapiens
agattatatatcataaag

SEQ ID NO: 2151607 - DNA, 22 bp, Homo sapiens
agattatatatcataaagtatg

SEQ ID NO: 2151608 - DNA, 18 bp, Homo sapiens
agcacaagttatttaaat

SEQ ID NO: 2151609 - DNA, 19 bp, Homo sapiens
agcacaagttatttaaatc

SEQ ID NO: 2151610 - DNA, 13 bp, Homo sapiens
agcacagctcctc

SEQ ID NO: 2151611 - DNA, 16 bp, Homo sapiens
agcacagctcctcccc

SEQ ID NO: 2151612 - DNA, 20 bp, Homo sapiens
agcacagctcctcccctgcc

SEQ ID NO: 2151613 - DNA, 20 bp, Homo sapiens
agcactggagtgcagggagg

SEQ ID NO: 2151614 - DNA, 22 bp, Homo sapiens
agcactggagtgcagggaggag

SEQ ID NO: 2151615 - DNA, 16 bp, Homo sapiens
agcagccccctgcccg

SEQ ID NO: 2151616 - DNA, 14 bp, Homo sapiens
agcagccctaagga

SEQ ID NO: 2151617 - DNA, 21 bp, Homo sapiens
agcaggcctctggttgcctcc

SEQ ID NO: 2151618 - DNA, 15 bp, Homo sapiens
agcaggggctgctgg

SEQ ID NO: 2151619 - DNA, 12 bp, Homo sapiens
agcatcctcccc

SEQ ID NO: 2151620 - DNA, 14 bp, Homo sapiens
agcatcctccccac

SEQ ID NO: 2151621 - DNA, 19 bp, Homo sapiens
agcatcctccccaccagag

SEQ ID NO: 2151622 - DNA, 22 bp, Homo sapiens
agcatcctccccaccagagctg

SEQ ID NO: 2151623 - DNA, 23 bp, Homo sapiens
agcatcctccccaccagagctgc

SEQ ID NO: 2151624 - DNA, 22 bp, Homo sapiens
agcattagctacttttcagaat

SEQ ID NO: 2151625 - DNA, 12 bp, Homo sapiens
agccaccgcagc

SEQ ID NO: 2151626 - DNA, 14 bp, Homo sapiens
agccaccgcagctg

SEQ ID NO: 2151627 - DNA, 20 bp, Homo sapiens
agccaccgcagctgctgcca

SEQ ID NO: 2151628 - DNA, 21 bp, Homo sapiens
agccaccgcagctgctgccac

SEQ ID NO: 2151629 - DNA, 23 bp, Homo sapiens
agccaccgcagctgctgccactc

SEQ ID NO: 2151630 - DNA, 22 bp, Homo sapiens
agccagcaatgatgtccagaag

SEQ ID NO: 2151631 - DNA, 23 bp, Homo sapiens
agccagcaatgatgtccagaaga

SEQ ID NO: 2151632 - DNA, 22 bp, Homo sapiens
agccccacctctccaagtctct

SEQ ID NO: 2151633 - DNA, 20 bp, Homo sapiens
agcccccaccccagcacagc

SEQ ID NO: 2151634 - DNA, 23 bp, Homo sapiens
agcccccaccccagcacagctcc

SEQ ID NO: 2151635 - DNA, 16 bp, Homo sapiens
agccccgcctgtcaca

SEQ ID NO: 2151636 - DNA, 14 bp, Homo sapiens
agccccttctccca

SEQ ID NO: 2151637 - DNA, 18 bp, Homo sapiens
agccccttctcccagcac

SEQ ID NO: 2151638 - DNA, 19 bp, Homo sapiens
agtttatttgttgagagtg

SEQ ID NO: 2151639 - DNA, 18 bp, Homo sapiens
agtttctaaccaaagagt

SEQ ID NO: 2151640 - DNA, 13 bp, Homo sapiens
ataaaggtattta

SEQ ID NO: 2151641 - DNA, 21 bp, Homo sapiens
ataaaggtatttagaatatat

SEQ ID NO: 2151642 - DNA, 16 bp, Homo sapiens
ataaatggctggtttt

SEQ ID NO: 2151643 - DNA, 13 bp, Homo sapiens
atacaattaaagg

SEQ ID NO: 2151644 - DNA, 15 bp, Homo sapiens
atacaattaaaggtc

SEQ ID NO: 2151645 - DNA, 23 bp, Homo sapiens
atacaattaaaggtcctgccctc

SEQ ID NO: 2151646 - DNA, 19 bp, Homo sapiens
atacagacactaagttata

SEQ ID NO: 2151647 - DNA, 19 bp, Homo sapiens
atagatgcaagatatttat

SEQ ID NO: 2151648 - DNA, 21 bp, Homo sapiens
atagatgcaagatatttatat

SEQ ID NO: 2151649 - DNA, 14 bp, Homo sapiens
atagctgatcagtt

SEQ ID NO: 2151650 - DNA, 14 bp, Homo sapiens
atagtcagagtgtc

SEQ ID NO: 2151651 - DNA, 17 bp, Homo sapiens
atagtcagagtgtccct

SEQ ID NO: 2151652 - DNA, 18 bp, Homo sapiens
atatacattctttatctt

SEQ ID NO: 2151653 - DNA, 18 bp, Homo sapiens
atatagctgatcagtttt

SEQ ID NO: 2151654 - DNA, 24 bp, Homo sapiens
atatagtttgtggtaaaaagatta

SEQ ID NO: 2151655 - DNA, 13 bp, Homo sapiens
atatatcataaag

SEQ ID NO: 2151656 - DNA, 14 bp, Homo sapiens
atatatcataaagt

SEQ ID NO: 2151657 - DNA, 15 bp, Homo sapiens
atatatcataaagta

SEQ ID NO: 2151658 - DNA, 15 bp, Homo sapiens
atatatgtatatgta

SEQ ID NO: 2151659 - DNA, 20 bp, Homo sapiens
atatatgtatatgtatatct

SEQ ID NO: 2151660 - DNA, 21 bp, Homo sapiens
atatcagcctgagtctcctgt

SEQ ID NO: 2151661 - DNA, 17 bp, Homo sapiens
atatctgagaagtgtat

SEQ ID NO: 2151662 - DNA, 19 bp, Homo sapiens
atatctgagaagtgtatat

SEQ ID NO: 2151663 - DNA, 21 bp, Homo sapiens
atatgactgtttttcggacag

SEQ ID NO: 2151664 - DNA, 13 bp, Homo sapiens
atatgtatatcta

SEQ ID NO: 2151665 - DNA, 22 bp, Homo sapiens
atatgtatatctatatctctaa

SEQ ID NO: 2151666 - DNA, 20 bp, Homo sapiens
atattaaatacagacactaa

SEQ ID NO: 2151667 - DNA, 22 bp, Homo sapiens
atattagtttgatttaatatct

SEQ ID NO: 2151668 - DNA, 21 bp, Homo sapiens
atattctacacatatatgtat

SEQ ID NO: 2151669 - DNA, 12 bp, Homo sapiens
atattgtaaata

SEQ ID NO: 2151670 - DNA, 15 bp, Homo sapiens
atcaagagtctctcc

SEQ ID NO: 2151671 - DNA, 20 bp, Homo sapiens
atcaagagtctctccagcct

SEQ ID NO: 2151672 - DNA, 22 bp, Homo sapiens
atccaggcttctcccggacctg

SEQ ID NO: 2151673 - DNA, 23 bp, Homo sapiens
atccaggcttctcccggacctgg

SEQ ID NO: 2151674 - DNA, 23 bp, Homo sapiens
atccatttggcagaactgctggg

SEQ ID NO: 2151675 - DNA, 17 bp, Homo sapiens
atcccctgtcccctggg

SEQ ID NO: 2151676 - DNA, 18 bp, Homo sapiens
atcccctgtcccctgggg

SEQ ID NO: 2151677 - DNA, 19 bp, Homo sapiens
atcccctgtcccctggggc

SEQ ID NO: 2151678 - DNA, 21 bp, Homo sapiens
atcccctgtcccctggggctg

SEQ ID NO: 2151679 - DNA, 20 bp, Homo sapiens
atccccttcccccatcccta

SEQ ID NO: 2151680 - DNA, 12 bp, Homo sapiens
atccctaccact

SEQ ID NO: 2151681 - DNA, 19 bp, Homo sapiens
atccctgttacccagagaa

SEQ ID NO: 2151682 - DNA, 22 bp, Homo sapiens
atcctccccaccagagctgcct

SEQ ID NO: 2151683 - DNA, 16 bp, Homo sapiens
atcctcctcctcattc

SEQ ID NO: 2151684 - DNA, 22 bp, Homo sapiens
atcctcctcctcattcagacca

SEQ ID NO: 2151685 - DNA, 13 bp, Homo sapiens
atcctcctctcca

SEQ ID NO: 2151686 - DNA, 14 bp, Homo sapiens
atcctcctctccat

SEQ ID NO: 2151687 - DNA, 16 bp, Homo sapiens
atcctgggcccccaga

SEQ ID NO: 2151688 - DNA, 18 bp, Homo sapiens
atcctgggcccccagaga

SEQ ID NO: 2151689 - DNA, 19 bp, Homo sapiens
atcctgggcccccagagac

SEQ ID NO: 2151690 - DNA, 19 bp, Homo sapiens
atcctgtcgattagactgg

SEQ ID NO: 2151691 - DNA, 21 bp, Homo sapiens
atctattcagacaagcaacag

SEQ ID NO: 2151692 - DNA, 16 bp, Homo sapiens
atctctaaactgctgt

SEQ ID NO: 2151693 - DNA, 16 bp, Homo sapiens
atctctcaggagcaca

SEQ ID NO: 2151694 - DNA, 17 bp, Homo sapiens
atctctcaggagcacag

SEQ ID NO: 2151695 - DNA, 22 bp, Homo sapiens
atctctgagtgtctctgcctgg

SEQ ID NO: 2151696 - DNA, 17 bp, Homo sapiens
atctgagaagtgtatat

SEQ ID NO: 2151697 - DNA, 17 bp, Homo sapiens
atctgtagggctggacc

SEQ ID NO: 2151698 - DNA, 18 bp, Homo sapiens
atctgtagggctggacct

SEQ ID NO: 2151699 - DNA, 13 bp, Homo sapiens
atctgtccatcct

SEQ ID NO: 2151700 - DNA, 18 bp, Homo sapiens
atctgtccatcctcctct

SEQ ID NO: 2151701 - DNA, 20 bp, Homo sapiens
atctgtccatcctcctctcc

SEQ ID NO: 2151702 - DNA, 20 bp, Homo sapiens
atctgtgcctgtctgtccaa

SEQ ID NO: 2151703 - DNA, 14 bp, Homo sapiens
atctttctttacct

SEQ ID NO: 2151704 - DNA, 12 bp, Homo sapiens
atgaacaaatgg

SEQ ID NO: 2151705 - DNA, 18 bp, Homo sapiens
atgaatgtgttgatttga

SEQ ID NO: 2151706 - DNA, 19 bp, Homo sapiens
tcctcacagcctctccctt

SEQ ID NO: 2151707 - DNA, 19 bp, Homo sapiens
tcctcatctgtgcctgtct

SEQ ID NO: 2151708 - DNA, 13 bp, Homo sapiens
tcctccagaccac

SEQ ID NO: 2151709 - DNA, 17 bp, Homo sapiens
tcctccagaccaccagc

SEQ ID NO: 2151710 - DNA, 13 bp, Homo sapiens
tcctcccatggcc

SEQ ID NO: 2151711 - DNA, 15 bp, Homo sapiens
tcctcccatggcctt

SEQ ID NO: 2151712 - DNA, 16 bp, Homo sapiens
tcctccccaccagagc

SEQ ID NO: 2151713 - DNA, 17 bp, Homo sapiens
tcctccccaccagagct

SEQ ID NO: 2151714 - DNA, 18 bp, Homo sapiens
tcctccccaccagagctg

SEQ ID NO: 2151715 - DNA, 21 bp, Homo sapiens
tcctccccaccagagctgcct

SEQ ID NO: 2151716 - DNA, 23 bp, Homo sapiens
tcctccccaccagagctgcctcc

SEQ ID NO: 2151717 - DNA, 14 bp, Homo sapiens
tcctcccccagagc

SEQ ID NO: 2151718 - DNA, 15 bp, Homo sapiens
tcctcccccagagcc

SEQ ID NO: 2151719 - DNA, 10 bp, Homo sapiens
tcctcccctg

SEQ ID NO: 2151720 - DNA, 13 bp, Homo sapiens
tcctcccctgccg

SEQ ID NO: 2151721 - DNA, 16 bp, Homo sapiens
tcctcccctgccgcct

SEQ ID NO: 2151722 - DNA, 17 bp, Homo sapiens
tcctcccctgccgcctc

SEQ ID NO: 2151723 - DNA, 10 bp, Homo sapiens
tcctccctct

SEQ ID NO: 2151724 - DNA, 23 bp, Homo sapiens
tcctccctctgcctcatcctcct

SEQ ID NO: 2151725 - DNA, 15 bp, Homo sapiens
tcctcctgccctgtc

SEQ ID NO: 2151726 - DNA, 13 bp, Homo sapiens
tcctctccatgca

SEQ ID NO: 2151727 - DNA, 21 bp, Homo sapiens
tcctctccatgcaagtgctgt

SEQ ID NO: 2151728 - DNA, 13 bp, Homo sapiens
tcctcttgctcaa

SEQ ID NO: 2151729 - DNA, 23 bp, Homo sapiens
tcctgacccggattggccctgcc

SEQ ID NO: 2151730 - DNA, 15 bp, Homo sapiens
tcctgccagctctgt

SEQ ID NO: 2151731 - DNA, 15 bp, Homo sapiens
tcctgccctgtccct

SEQ ID NO: 2151732 - DNA, 15 bp, Homo sapiens
tcctgctggcctgct

SEQ ID NO: 2151733 - DNA, 19 bp, Homo sapiens
tcctgggcccccagagacc

SEQ ID NO: 2151734 - DNA, 22 bp, Homo sapiens
tcctgtcgattagactggacag

SEQ ID NO: 2151735 - DNA, 18 bp, Homo sapiens
tcctgttacttacctaaa

SEQ ID NO: 2151736 - DNA, 17 bp, Homo sapiens
tccttaagtcagaacag

SEQ ID NO: 2151737 - DNA, 14 bp, Homo sapiens
tccttactcagagc

SEQ ID NO: 2151738 - DNA, 18 bp, Homo sapiens
tccttactcagagctgcg

SEQ ID NO: 2151739 - DNA, 19 bp, Homo sapiens
tccttccccttgtccctgg

SEQ ID NO: 2151740 - DNA, 16 bp, Homo sapiens
tcctttctccagccag

SEQ ID NO: 2151741 - DNA, 14 bp, Homo sapiens
tcctttgcactgag

SEQ ID NO: 2151742 - DNA, 17 bp, Homo sapiens
tcgaactgtgctcccac

SEQ ID NO: 2151743 - DNA, 15 bp, Homo sapiens
tcgaatgacactgtt

SEQ ID NO: 2151744 - DNA, 16 bp, Homo sapiens
tcgactcaggatccag

SEQ ID NO: 2151745 - DNA, 20 bp, Homo sapiens
tcgatgaatgtgttgatttg

SEQ ID NO: 2151746 - DNA, 13 bp, Homo sapiens
tcgattagactgg

SEQ ID NO: 2151747 - DNA, 18 bp, Homo sapiens
tcgattagactggacagc

SEQ ID NO: 2151748 - DNA, 20 bp, Homo sapiens
tcgccccagatcaccagccc

SEQ ID NO: 2151749 - DNA, 15 bp, Homo sapiens
tcggaggctcctccc

SEQ ID NO: 2151750 - DNA, 17 bp, Homo sapiens
tcggaggctcctccctc

SEQ ID NO: 2151751 - DNA, 20 bp, Homo sapiens
tcggaggctcctccctctgc

SEQ ID NO: 2151752 - DNA, 22 bp, Homo sapiens
tcgggacatggttgggggaatg

SEQ ID NO: 2151753 - DNA, 18 bp, Homo sapiens
tcgttagaggagcaacag

SEQ ID NO: 2151754 - DNA, 19 bp, Homo sapiens
tgggctcttaactgttgct

SEQ ID NO: 2151755 - DNA, 15 bp, Homo sapiens
tggggctggtgaggc

SEQ ID NO: 2151756 - DNA, 18 bp, Homo sapiens
tgggggaatgcacctccc

SEQ ID NO: 2151757 - DNA, 19 bp, Homo sapiens
tgggggggagaaggcctcc

SEQ ID NO: 2151758 - DNA, 20 bp, Homo sapiens
tgggggggagaaggcctccc

SEQ ID NO: 2151759 - DNA, 16 bp, Homo sapiens
tgggtcctcggcccat

SEQ ID NO: 2151760 - DNA, 16 bp, Homo sapiens
tgggtttggcccctgg

SEQ ID NO: 2151761 - DNA, 20 bp, Homo sapiens
tggtgggcagctgaggacac

SEQ ID NO: 2151762 - DNA, 11 bp, Homo sapiens
tggtgtctccc

SEQ ID NO: 2151763 - DNA, 22 bp, Homo sapiens
tggtgtctcccaacatgggagg

SEQ ID NO: 2151764 - DNA, 16 bp, Homo sapiens
tggtgttactaaagtc

SEQ ID NO: 2151765 - DNA, 12 bp, Homo sapiens
tgtaaatacacc

SEQ ID NO: 2151766 - DNA, 15 bp, Homo sapiens
tgtaaatattgtgtg

SEQ ID NO: 2151767 - DNA, 14 bp, Homo sapiens
tgtaacaagccaga

SEQ ID NO: 2151768 - DNA, 17 bp, Homo sapiens
tgtacagaagaaactga

SEQ ID NO: 2151769 - DNA, 22 bp, Homo sapiens
tgtacagttatctaagttaatt

SEQ ID NO: 2151770 - DNA, 18 bp, Homo sapiens
tgtaccacaccctgcctg

SEQ ID NO: 2151771 - DNA, 19 bp, Homo sapiens
tgtaccacaccctgcctgc

SEQ ID NO: 2151772 - DNA, 20 bp, Homo sapiens
tgtaccacaccctgcctgct

SEQ ID NO: 2151773 - DNA, 21 bp, Homo sapiens
tgtagccccagtgacagctag

SEQ ID NO: 2151774 - DNA, 16 bp, Homo sapiens
tgtagggctggaccta

SEQ ID NO: 2151775 - DNA, 19 bp, Homo sapiens
tgtatattaaggtgtggct

SEQ ID NO: 2151776 - DNA, 17 bp, Homo sapiens
tgtcaatattaaataca

SEQ ID NO: 2151777 - DNA, 11 bp, Homo sapiens
tgtcacaataa

SEQ ID NO: 2151778 - DNA, 17 bp, Homo sapiens
tgtcacaataaagttta

SEQ ID NO: 2151779 - DNA, 18 bp, Homo sapiens
tgtcacaataaagtttat

SEQ ID NO: 2151780 - DNA, 12 bp, Homo sapiens
tgtcagaaactc

SEQ ID NO: 2151781 - DNA, 23 bp, Homo sapiens
tgtcagccgagccgggcctgggg

SEQ ID NO: 2151782 - DNA, 18 bp, Homo sapiens
tgtccaacccctccccca

SEQ ID NO: 2151783 - DNA, 19 bp, Homo sapiens
tgtccaacccctcccccac

SEQ ID NO: 2151784 - DNA, 22 bp, Homo sapiens
tgtccaacccctcccccacgtc

SEQ ID NO: 2151785 - DNA, 16 bp, Homo sapiens
tgtccagaagaatatt

SEQ ID NO: 2151786 - DNA, 20 bp, Homo sapiens
tgtccagaagaatattcagg

SEQ ID NO: 2151787 - DNA, 13 bp, Homo sapiens
tgtccagtttcca

SEQ ID NO: 2151788 - DNA, 23 bp, Homo sapiens
tgtccataaagtaattttgtgaa

SEQ ID NO: 2151789 - DNA, 19 bp, Homo sapiens
tgtccccctcccctcccag

SEQ ID NO: 2151790 - DNA, 20 bp, Homo sapiens
tgtcccctggggctggtgga

SEQ ID NO: 2151791 - DNA, 13 bp, Homo sapiens
tgtccctggggca

SEQ ID NO: 2151792 - DNA, 23 bp, Homo sapiens
tgtccctggggcactcccccagg

SEQ ID NO: 2151793 - DNA, 19 bp, Homo sapiens
tgtccctgtccccctcccc

SEQ ID NO: 2151794 - DNA, 16 bp, Homo sapiens
tgccttcctgtttaaa

SEQ ID NO: 2151795 - DNA, 13 bp, Homo sapiens
tgccttcttcacc

SEQ ID NO: 2151796 - DNA, 20 bp, Homo sapiens
tgctaggggaaggactggcc

SEQ ID NO: 2151797 - DNA, 23 bp, Homo sapiens
tgctaggggaaggactggccgtg

SEQ ID NO: 2151798 - DNA, 19 bp, Homo sapiens
tgctcaaatctattcagac

SEQ ID NO: 2151799 - DNA, 15 bp, Homo sapiens
tgctcaagaagacat

SEQ ID NO: 2151800 - DNA, 22 bp, Homo sapiens
tgctcaagaagacatggagact

SEQ ID NO: 2151801 - DNA, 21 bp, Homo sapiens
tgctcccagcagccctaagga

SEQ ID NO: 2151802 - DNA, 16 bp, Homo sapiens
tgctcttacttccccc

SEQ ID NO: 2151803 - DNA, 21 bp, Homo sapiens
tgctcttacttcccccaccct

SEQ ID NO: 2151804 - DNA, 13 bp, Homo sapiens
tgctgacccacca

SEQ ID NO: 2151805 - DNA, 17 bp, Homo sapiens
tgctgccactctgctgc

SEQ ID NO: 2151806 - DNA, 15 bp, Homo sapiens
tgctgcctgtacaga

SEQ ID NO: 2151807 - DNA, 12 bp, Homo sapiens
tgctggcctctt

SEQ ID NO: 2151808 - DNA, 14 bp, Homo sapiens
tgctggcctcttgg

SEQ ID NO: 2151809 - DNA, 20 bp, Homo sapiens
tgctggcctcttggcacctg

SEQ ID NO: 2151810 - DNA, 22 bp, Homo sapiens
tgctggcctcttggcacctgcc

SEQ ID NO: 2151811 - DNA, 23 bp, Homo sapiens
tgctggcctcttggcacctgcct

SEQ ID NO: 2151812 - DNA, 16 bp, Homo sapiens
tgctggcctggatctc

SEQ ID NO: 2151813 - DNA, 22 bp, Homo sapiens
tgctgggctcttaactgttgct

SEQ ID NO: 2151814 - DNA, 13 bp, Homo sapiens
tgctggggctggt

SEQ ID NO: 2151815 - DNA, 14 bp, Homo sapiens
tgctgggggctccc

SEQ ID NO: 2151816 - DNA, 15 bp, Homo sapiens
tgctgggggctcccc

SEQ ID NO: 2151817 - DNA, 17 bp, Homo sapiens
tgctgggggctcccctt

SEQ ID NO: 2151818 - DNA, 21 bp, Homo sapiens
tgcttgtgatttttgaacaat

SEQ ID NO: 2151819 - DNA, 13 bp, Homo sapiens
tgctttgatattt

SEQ ID NO: 2151820 - DNA, 23 bp, Homo sapiens
tggaactacattagtacacagca

SEQ ID NO: 2151821 - DNA, 16 bp, Homo sapiens
tggaacttgaactgat

SEQ ID NO: 2151822 - DNA, 13 bp, Homo sapiens
tggagactcctgc

SEQ ID NO: 2151823 - DNA, 18 bp, Homo sapiens
tggagactcctgccctgt

SEQ ID NO: 2151824 - DNA, 17 bp, Homo sapiens
tggagtgagcagtagaa

SEQ ID NO: 2151825 - DNA, 17 bp, Homo sapiens
tggatgggagtgagaca

SEQ ID NO: 2151826 - DNA, 14 bp, Homo sapiens
tggcacctgcctag

SEQ ID NO: 2151827 - DNA, 16 bp, Homo sapiens
tggcagaactgctggg

SEQ ID NO: 2151828 - DNA, 20 bp, Homo sapiens
tggcagaactgctggggctg

SEQ ID NO: 2151829 - DNA, 22 bp, Homo sapiens
tggcagaactgctggggctggt

SEQ ID NO: 2151830 - DNA, 12 bp, Homo sapiens
tggcagctgggc

SEQ ID NO: 2151831 - DNA, 11 bp, Homo sapiens
tggccctgccc

SEQ ID NO: 2151832 - DNA, 17 bp, Homo sapiens
tggccctgcccctcccc

SEQ ID NO: 2151833 - DNA, 15 bp, Homo sapiens
tggccgtggctccag

SEQ ID NO: 2151834 - DNA, 15 bp, Homo sapiens
tggcctcttggcacc

SEQ ID NO: 2151835 - DNA, 22 bp, Homo sapiens
tggcctcttggcacctgcctag

SEQ ID NO: 2151836 - DNA, 21 bp, Homo sapiens
tggcctggatctccccactct

SEQ ID NO: 2151837 - DNA, 19 bp, Homo sapiens
tggcctttgaggcaaaggc

SEQ ID NO: 2151838 - DNA, 23 bp, Homo sapiens
tggctcagctgtggtcccaccca

SEQ ID NO: 2151839 - DNA, 16 bp, Homo sapiens
tggctgaacagtgctc

SEQ ID NO: 2151840 - DNA, 21 bp, Homo sapiens
tggctgaacagtgctctgcct

SEQ ID NO: 2151841 - DNA, 11 bp, Homo sapiens
tggctggggga

SEQ ID NO: 2151842 - DNA, 22 bp, Homo sapiens
tggctgggggagggactgctga

SEQ ID NO: 2151843 - DNA, 23 bp, Homo sapiens
tggctgggggagggactgctgac

SEQ ID NO: 2151844 - DNA, 16 bp, Homo sapiens
tggcttatttgtataa

SEQ ID NO: 2151845 - DNA, 17 bp, Homo sapiens
tggctttaggagcagtg

SEQ ID NO: 2151846 - DNA, 17 bp, Homo sapiens
tgggactgtgcctttgg

SEQ ID NO: 2151847 - DNA, 13 bp, Homo sapiens
tgggagggatcag

SEQ ID NO: 2151848 - DNA, 17 bp, Homo sapiens
tgggagggatcagcccc

SEQ ID NO: 2151849 - DNA, 20 bp, Homo sapiens
tgggcagaatcctgggcccc

SEQ ID NO: 2151850 - DNA, 22 bp, Homo sapiens
tgggcagaatcctgggccccca

SEQ ID NO: 2151851 - DNA, 21 bp, Homo sapiens
tgggcaggagtcaccatgcaa

SEQ ID NO: 2151852 - DNA, 16 bp, Homo sapiens
tgggcccacagccccc

SEQ ID NO: 2151853 - DNA, 23 bp, Homo sapiens
tgggcccacagcccccaccccag

SEQ ID NO: 2151854 - DNA, 14 bp, Homo sapiens
tgggcccccagaga

SEQ ID NO: 2151855 - DNA, 23 bp, Homo sapiens
tgggcccccagagacctttgccc

SEQ ID NO: 2151856 - DNA, 15 bp, Homo sapiens
tgggcctgacctcca

SEQ ID NO: 2151857 - DNA, 13 bp, Homo sapiens
gccagctctgtca

SEQ ID NO: 2151858 - DNA, 16 bp, Homo sapiens
gccatcaagagactga

SEQ ID NO: 2151859 - DNA, 19 bp, Homo sapiens
gccatggggtccatcccct

SEQ ID NO: 2151860 - DNA, 12 bp, Homo sapiens
gccattcccact

SEQ ID NO: 2151861 - DNA, 21 bp, Homo sapiens
gcccacacacactccttcccc

SEQ ID NO: 2151862 - DNA, 11 bp, Homo sapiens
gcccacagccc

SEQ ID NO: 2151863 - DNA, 17 bp, Homo sapiens
gcccacagcccccaccc

SEQ ID NO: 2151864 - DNA, 14 bp, Homo sapiens
gcccacatcccagg

SEQ ID NO: 2151865 - DNA, 23 bp, Homo sapiens
gcccatctgtccatcctcctctc

SEQ ID NO: 2151866 - DNA, 21 bp, Homo sapiens
gccccagccccttctcccagc

SEQ ID NO: 2151867 - DNA, 23 bp, Homo sapiens
gccccagccccttctcccagcac

SEQ ID NO: 2151868 - DNA, 22 bp, Homo sapiens
gccccatctcctcccatggcct

SEQ ID NO: 2151869 - DNA, 14 bp, Homo sapiens
gcccccaccccagc

SEQ ID NO: 2151870 - DNA, 14 bp, Homo sapiens
gcccctcaggggaa

SEQ ID NO: 2151871 - DNA, 22 bp, Homo sapiens
gcccctcaggggaagctgctag

SEQ ID NO: 2151872 - DNA, 18 bp, Homo sapiens
gcccctccccctaccgca

SEQ ID NO: 2151873 - DNA, 23 bp, Homo sapiens
gcccctccctagatccaggcttc

SEQ ID NO: 2151874 - DNA, 21 bp, Homo sapiens
gcccctggaacctttcccttg

SEQ ID NO: 2151875 - DNA, 18 bp, Homo sapiens
gcccggcctgctcccagc

SEQ ID NO: 2151876 - DNA, 15 bp, Homo sapiens
gccctaaggatctct

SEQ ID NO: 2151877 - DNA, 20 bp, Homo sapiens
gccctaggattcctccccca

SEQ ID NO: 2151878 - DNA, 23 bp, Homo sapiens
gccctaggattcctcccccagag

SEQ ID NO: 2151879 - DNA, 15 bp, Homo sapiens
gccctgcccctcccc

SEQ ID NO: 2151880 - DNA, 15 bp, Homo sapiens
gccctgcccctccct

SEQ ID NO: 2151881 - DNA, 16 bp, Homo sapiens
gccctgtccctgtccc

SEQ ID NO: 2151882 - DNA, 17 bp, Homo sapiens
gccctgtccctgtcccc

SEQ ID NO: 2151883 - DNA, 21 bp, Homo sapiens
gccctgtcgagacacttgcct

SEQ ID NO: 2151884 - DNA, 12 bp, Homo sapiens
gcccttccctgc

SEQ ID NO: 2151885 - DNA, 16 bp, Homo sapiens
gcccttccctgctttg

SEQ ID NO: 2151886 - DNA, 19 bp, Homo sapiens
gccgagccgggcctggggc

SEQ ID NO: 2151887 - DNA, 20 bp, Homo sapiens
gccgagccgggcctggggct

SEQ ID NO: 2151888 - DNA, 14 bp, Homo sapiens
gccgccccagcccc

SEQ ID NO: 2151889 - DNA, 17 bp, Homo sapiens
gccggccctgcccctcc

SEQ ID NO: 2151890 - DNA, 18 bp, Homo sapiens
gccgggttctagtctcct

SEQ ID NO: 2151891 - DNA, 12 bp, Homo sapiens
gccgtggctcca

SEQ ID NO: 2151892 - DNA, 15 bp, Homo sapiens
gcctcacagatgctg

SEQ ID NO: 2151893 - DNA, 16 bp, Homo sapiens
gcctcacagatgctgg

SEQ ID NO: 2151894 - DNA, 17 bp, Homo sapiens
gcctcacagatgctggc

SEQ ID NO: 2151895 - DNA, 18 bp, Homo sapiens
gcctcacagatgctggcc

SEQ ID NO: 2151896 - DNA, 19 bp, Homo sapiens
gcctcacagatgctggcct

SEQ ID NO: 2151897 - DNA, 23 bp, Homo sapiens
gcctcacagatgctggcctcttg

SEQ ID NO: 2151898 - DNA, 23 bp, Homo sapiens
gcctcacttttaatgaacaaatg

SEQ ID NO: 2151899 - DNA, 20 bp, Homo sapiens
gcctcccctgaggatcccct

SEQ ID NO: 2151900 - DNA, 21 bp, Homo sapiens
gcctcccctgaggatcccctg

SEQ ID NO: 2151901 - DNA, 22 bp, Homo sapiens
gcctcccctgaggatcccctgt

SEQ ID NO: 2151902 - DNA, 22 bp, Homo sapiens
gcctcccgggaagcatcctccc

SEQ ID NO: 2151903 - DNA, 14 bp, Homo sapiens
gcctcggaggctcc

SEQ ID NO: 2151904 - DNA, 18 bp, Homo sapiens
gcctcggaggctcctccc

SEQ ID NO: 2151905 - DNA, 14 bp, Homo sapiens
gcctctaactccct

SEQ ID NO: 2151906 - DNA, 18 bp, Homo sapiens
gcctctaactccctcctc

SEQ ID NO: 2151907 - DNA, 19 bp, Homo sapiens
gcctctaactccctcctca

SEQ ID NO: 2151908 - DNA, 21 bp, Homo sapiens
gcctctaactccctcctcaca

SEQ ID NO: 2151909 - DNA, 12 bp, Homo sapiens
gcctctccctta

SEQ ID NO: 2151910 - DNA, 12 bp, Homo sapiens
gcctctggttgc

SEQ ID NO: 2151911 - DNA, 14 bp, Homo sapiens
gcctctggttgcct

SEQ ID NO: 2151912 - DNA, 15 bp, Homo sapiens
gcctctggttgcctc

SEQ ID NO: 2151913 - DNA, 12 bp, Homo sapiens
gcctcttggcac

SEQ ID NO: 2151914 - DNA, 14 bp, Homo sapiens
gcctcttggcacct

SEQ ID NO: 2151915 - DNA, 15 bp, Homo sapiens
gcctcttggcacctg

SEQ ID NO: 2151916 - DNA, 16 bp, Homo sapiens
gcctcttggcacctgc

SEQ ID NO: 2151917 - DNA, 18 bp, Homo sapiens
gcctcttggcacctgcct

SEQ ID NO: 2151918 - DNA, 19 bp, Homo sapiens
gcctcttggcacctgccta

SEQ ID NO: 2151919 - DNA, 16 bp, Homo sapiens
gcctgacactgagccc

SEQ ID NO: 2151920 - DNA, 15 bp, Homo sapiens
gcctgacctccagtc

SEQ ID NO: 2151921 - DNA, 16 bp, Homo sapiens
gcctgacctccagtcc

SEQ ID NO: 2151922 - DNA, 17 bp, Homo sapiens
gcctgacctccagtcct

SEQ ID NO: 2151923 - DNA, 20 bp, Homo sapiens
gcctgacctccagtcctgct

SEQ ID NO: 2151924 - DNA, 22 bp, Homo sapiens
gcctgacctccagtcctgctgg

SEQ ID NO: 2151925 - DNA, 15 bp, Homo sapiens
gcctgagggtggaga

SEQ ID NO: 2151926 - DNA, 16 bp, Homo sapiens
gcctgagtctcctgtg

SEQ ID NO: 2151927 - DNA, 21 bp, Homo sapiens
gcctgcaaactcactgctcaa

SEQ ID NO: 2151928 - DNA, 17 bp, Homo sapiens
gcctgctcccagcagcc

SEQ ID NO: 2151929 - DNA, 22 bp, Homo sapiens
gcctgctcccagcagccctaag

SEQ ID NO: 2151930 - DNA, 14 bp, Homo sapiens
gcctgctgtggagc

SEQ ID NO: 2151931 - DNA, 12 bp, Homo sapiens
gcctggatctcc

SEQ ID NO: 2151932 - DNA, 23 bp, Homo sapiens
gcctggggctcctttctccagcc

SEQ ID NO: 2151933 - DNA, 15 bp, Homo sapiens
gcctgtcacaataaa

SEQ ID NO: 2151934 - DNA, 18 bp, Homo sapiens
gcctgtcacaataaagtt

SEQ ID NO: 2151935 - DNA, 16 bp, Homo sapiens
gccttccctccccaca

SEQ ID NO: 2151936 - DNA, 21 bp, Homo sapiens
gcctttattaaaaactgagtg

SEQ ID NO: 2151937 - DNA, 14 bp, Homo sapiens
gcgcctgtcccctc

SEQ ID NO: 2151938 - DNA, 16 bp, Homo sapiens
gcgcctgtcccctcac

SEQ ID NO: 2151939 - DNA, 13 bp, Homo sapiens
gcgggctcagagc

SEQ ID NO: 2151940 - DNA, 15 bp, Homo sapiens
gcgggctcagagctt

SEQ ID NO: 2151941 - DNA, 16 bp, Homo sapiens
gcgggctcagagcttt

SEQ ID NO: 2151942 - DNA, 21 bp, Homo sapiens
gcgtgccctgacccctgcacc

SEQ ID NO: 2151943 - DNA, 23 bp, Homo sapiens
gctaggggaaggactggccgtgg

SEQ ID NO: 2151944 - DNA, 14 bp, Homo sapiens
gctcaaatctattc

SEQ ID NO: 2151945 - DNA, 17 bp, Homo sapiens
gctcaaatctattcaga

SEQ ID NO: 2151946 - DNA, 20 bp, Homo sapiens
gctcaaatctattcagacaa

SEQ ID NO: 2151947 - DNA, 21 bp, Homo sapiens
gctcaagaagacatggagact

SEQ ID NO: 2151948 - DNA, 14 bp, Homo sapiens
gctcagagctttgt

SEQ ID NO: 2151949 - DNA, 16 bp, Homo sapiens
gctcagagctttgtca

SEQ ID NO: 2151950 - DNA, 20 bp, Homo sapiens
gctcagagctttgtcacttg

SEQ ID NO: 2151951 - DNA, 19 bp, Homo sapiens
gctccagaatgtgctgcct

SEQ ID NO: 2151952 - DNA, 16 bp, Homo sapiens
gctcctccctctgcct

SEQ ID NO: 2151953 - DNA, 20 bp, Homo sapiens
gctcctccctctgcctcatc

SEQ ID NO: 2151954 - DNA, 14 bp, Homo sapiens
gctcctttctccag

SEQ ID NO: 2151955 - DNA, 16 bp, Homo sapiens
gctcctttctccagcc

SEQ ID NO: 2151956 - DNA, 15 bp, Homo sapiens
gctctgcctctaact

SEQ ID NO: 2151957 - DNA, 20 bp, Homo sapiens
gctctgcctctaactccctc

SEQ ID NO: 2151958 - DNA, 22 bp, Homo sapiens
gctctgcctctaactccctcct

SEQ ID NO: 2151959 - DNA, 18 bp, Homo sapiens
gctctgtcaccctggcca

SEQ ID NO: 2151960 - DNA, 19 bp, Homo sapiens
gctctgtcaccctggccac

SEQ ID NO: 2151961 - DNA, 20 bp, Homo sapiens
gctctgtcaccctggccacc

SEQ ID NO: 2151962 - DNA, 21 bp, Homo sapiens
gctctgtcaccctggccacca

SEQ ID NO: 2151963 - DNA, 17 bp, Homo sapiens
gctcttacttcccccac

SEQ ID NO: 2151964 - DNA, 13 bp, Homo sapiens
gctcttgggcctg

SEQ ID NO: 2151965 - DNA, 14 bp, Homo sapiens
gctgaacagtgctc

SEQ ID NO: 2151966 - DNA, 20 bp, Homo sapiens
gctgaacagtgctctgcctc

SEQ ID NO: 2151967 - DNA, 15 bp, Homo sapiens
gctgaggcctccctt

SEQ ID NO: 2151968 - DNA, 16 bp, Homo sapiens
cctcctcacactccag

SEQ ID NO: 2151969 - DNA, 18 bp, Homo sapiens
cctcctcacactccagaa

SEQ ID NO: 2151970 - DNA, 16 bp, Homo sapiens
cctcctcattcagacc

SEQ ID NO: 2151971 - DNA, 12 bp, Homo sapiens
cctcctcctcat

SEQ ID NO: 2151972 - DNA, 13 bp, Homo sapiens
cctcctcctcatt

SEQ ID NO: 2151973 - DNA, 16 bp, Homo sapiens
cctcctctccatgcaa

SEQ ID NO: 2151974 - DNA, 15 bp, Homo sapiens
cctcctgccagctct

SEQ ID NO: 2151975 - DNA, 20 bp, Homo sapiens
cctcctgccctgtccctgtc

SEQ ID NO: 2151976 - DNA, 14 bp, Homo sapiens
cctcggaggctcct

SEQ ID NO: 2151977 - DNA, 17 bp, Homo sapiens
cctcggaggctcctccc

SEQ ID NO: 2151978 - DNA, 20 bp, Homo sapiens
cctcggaggctcctccctct

SEQ ID NO: 2151979 - DNA, 15 bp, Homo sapiens
cctctaactccctcc

SEQ ID NO: 2151980 - DNA, 19 bp, Homo sapiens
cctctaactccctcctcac

SEQ ID NO: 2151981 - DNA, 22 bp, Homo sapiens
cctctccaagtctctctgtgaa

SEQ ID NO: 2151982 - DNA, 23 bp, Homo sapiens
cctctccaagtctctctgtgaat

SEQ ID NO: 2151983 - DNA, 13 bp, Homo sapiens
cctctccatgcaa

SEQ ID NO: 2151984 - DNA, 15 bp, Homo sapiens
cctctccatgcaagt

SEQ ID NO: 2151985 - DNA, 11 bp, Homo sapiens
cctctgcctca

SEQ ID NO: 2151986 - DNA, 18 bp, Homo sapiens
cctctgcctcatcctcct

SEQ ID NO: 2151987 - DNA, 14 bp, Homo sapiens
cctcttggcacctg

SEQ ID NO: 2151988 - DNA, 17 bp, Homo sapiens
cctcttggcacctgcct

SEQ ID NO: 2151989 - DNA, 18 bp, Homo sapiens
cctcttggcacctgccta

SEQ ID NO: 2151990 - DNA, 20 bp, Homo sapiens
cctgaatggttccatgcctg

SEQ ID NO: 2151991 - DNA, 15 bp, Homo sapiens
cctgacactgagccc

SEQ ID NO: 2151992 - DNA, 20 bp, Homo sapiens
cctgacccggattggccctg

SEQ ID NO: 2151993 - DNA, 12 bp, Homo sapiens
cctgacctccag

SEQ ID NO: 2151994 - DNA, 17 bp, Homo sapiens
cctgacctccagtcctg

SEQ ID NO: 2151995 - DNA, 19 bp, Homo sapiens
cctgacctccagtcctgct

SEQ ID NO: 2151996 - DNA, 23 bp, Homo sapiens
cctgaggatcccctgtcccctgg

SEQ ID NO: 2151997 - DNA, 13 bp, Homo sapiens
cctgagggtggag

SEQ ID NO: 2151998 - DNA, 15 bp, Homo sapiens
cctgagggtggagac

SEQ ID NO: 2151999 - DNA, 14 bp, Homo sapiens
cctgagtctcctgt

SEQ ID NO: 2152000 - DNA, 12 bp, Homo sapiens
cctgccagctct

SEQ ID NO: 2152001 - DNA, 14 bp, Homo sapiens
cctgccagctctgt

SEQ ID NO: 2152002 - DNA, 12 bp, Homo sapiens
cctgcccctccc

SEQ ID NO: 2152003 - DNA, 17 bp, Homo sapiens
cctgcccctccccagcc

SEQ ID NO: 2152004 - DNA, 14 bp, Homo sapiens
cctgcccctccccc

SEQ ID NO: 2152005 - DNA, 16 bp, Homo sapiens
cctgccgcctcccggg

SEQ ID NO: 2152006 - DNA, 17 bp, Homo sapiens
cctgccgcctcccggga

SEQ ID NO: 2152007 - DNA, 23 bp, Homo sapiens
cctgcctgctgtggagcccattg

SEQ ID NO: 2152008 - DNA, 23 bp, Homo sapiens
cctgctcccagcagccctaagga

SEQ ID NO: 2152009 - DNA, 21 bp, Homo sapiens
cctgctcttacttcccccacc

SEQ ID NO: 2152010 - DNA, 11 bp, Homo sapiens
cctgctgtgga

SEQ ID NO: 2152011 - DNA, 19 bp, Homo sapiens
cctggactagggcctcgga

SEQ ID NO: 2152012 - DNA, 13 bp, Homo sapiens
cctggagcagggg

SEQ ID NO: 2152013 - DNA, 12 bp, Homo sapiens
cctggccaccac

SEQ ID NO: 2152014 - DNA, 19 bp, Homo sapiens
cctggccaccacccaacct

SEQ ID NO: 2152015 - DNA, 23 bp, Homo sapiens
cctggctgaacagtgctctgcct

SEQ ID NO: 2152016 - DNA, 12 bp, Homo sapiens
cctgggccccca

SEQ ID NO: 2152017 - DNA, 20 bp, Homo sapiens
cctggggcactcccccagga

SEQ ID NO: 2152018 - DNA, 16 bp, Homo sapiens
cctggggctcctttct

SEQ ID NO: 2152019 - DNA, 14 bp, Homo sapiens
cctgggtttggccc

SEQ ID NO: 2152020 - DNA, 18 bp, Homo sapiens
cctgggtttggcccctgg

SEQ ID NO: 2152021 - DNA, 19 bp, Homo sapiens
cctgggtttggcccctgga

SEQ ID NO: 2152022 - DNA, 20 bp, Homo sapiens
cctgtagccccagtgacagc

SEQ ID NO: 2152023 - DNA, 15 bp, Homo sapiens
cctgtcacaataaag

SEQ ID NO: 2152024 - DNA, 15 bp, Homo sapiens
cctgtccataaagta

SEQ ID NO: 2152025 - DNA, 21 bp, Homo sapiens
cctgtccccctcccctcccag

SEQ ID NO: 2152026 - DNA, 15 bp, Homo sapiens
cctgtcccctcacag

SEQ ID NO: 2152027 - DNA, 14 bp, Homo sapiens
cctgtcccctgggg

SEQ ID NO: 2152028 - DNA, 15 bp, Homo sapiens
cctgtcccctggggc

SEQ ID NO: 2152029 - DNA, 16 bp, Homo sapiens
cctgtccctgtccccc

SEQ ID NO: 2152030 - DNA, 20 bp, Homo sapiens
cctgtccttactcagagctg

SEQ ID NO: 2152031 - DNA, 22 bp, Homo sapiens
cctgtccttactcagagctgcg

SEQ ID NO: 2152032 - DNA, 14 bp, Homo sapiens
cctgtcgagacact

SEQ ID NO: 2152033 - DNA, 15 bp, Homo sapiens
cctgtctgtccaacc

SEQ ID NO: 2152034 - DNA, 14 bp, Homo sapiens
cctgttacttacct

SEQ ID NO: 2152035 - DNA, 23 bp, Homo sapiens
cctgttattttttatttccacat

SEQ ID NO: 2152036 - DNA, 12 bp, Homo sapiens
ccttaagtcaga

SEQ ID NO: 2152037 - DNA, 15 bp, Homo sapiens
ccttactcagagctg

SEQ ID NO: 2152038 - DNA, 22 bp, Homo sapiens
ccttcccccatccctaccactg

SEQ ID NO: 2152039 - DNA, 12 bp, Homo sapiens
ccttccccttgt

SEQ ID NO: 2152040 - DNA, 15 bp, Homo sapiens
ccttccccttgtccc

SEQ ID NO: 2152041 - DNA, 16 bp, Homo sapiens
ccttccccttgtccct

SEQ ID NO: 2152042 - DNA, 21 bp, Homo sapiens
ccttccccttgtccctggggc

SEQ ID NO: 2152043 - DNA, 12 bp, Homo sapiens
ccttcctcatct

SEQ ID NO: 2152044 - DNA, 16 bp, Homo sapiens
ccttcctcatctgtgc

SEQ ID NO: 2152045 - DNA, 20 bp, Homo sapiens
ccttcctcatctgtgcctgt

SEQ ID NO: 2152046 - DNA, 12 bp, Homo sapiens
ccttcctgaccc

SEQ ID NO: 2152047 - DNA, 14 bp, Homo sapiens
ccttctcccagcac

SEQ ID NO: 2152048 - DNA, 16 bp, Homo sapiens
ccttgagtaggccctg

SEQ ID NO: 2152049 - DNA, 17 bp, Homo sapiens
ccttgagtaggccctgc

SEQ ID NO: 2152050 - DNA, 14 bp, Homo sapiens
ccttgcccttcctg

SEQ ID NO: 2152051 - DNA, 17 bp, Homo sapiens
ccttgcccttcctgacc

SEQ ID NO: 2152052 - DNA, 17 bp, Homo sapiens
ccttgcctgaactccag

SEQ ID NO: 2152053 - DNA, 19 bp, Homo sapiens
ccttgcctgaactccagag

SEQ ID NO: 2152054 - DNA, 13 bp, Homo sapiens
ccttgtccctggg

SEQ ID NO: 2152055 - DNA, 14 bp, Homo sapiens
cctttctagttgaa

SEQ ID NO: 2152056 - DNA, 18 bp, Homo sapiens
cctttctccagccagcaa

SEQ ID NO: 2152057 - DNA, 13 bp, Homo sapiens
cctttgcactgag

SEQ ID NO: 2152058 - DNA, 20 bp, Homo sapiens
cctttgcaggcccagcagac

SEQ ID NO: 2152059 - DNA, 14 bp, Homo sapiens
cctttttctacctt

SEQ ID NO: 2152060 - DNA, 23 bp, Homo sapiens
cctttttgcaggggactgggcca

SEQ ID NO: 2152061 - DNA, 16 bp, Homo sapiens
cctttttttctctcct

SEQ ID NO: 2152062 - DNA, 19 bp, Homo sapiens
cgaaacctgtccataaagt

SEQ ID NO: 2152063 - DNA, 21 bp, Homo sapiens
cgaagaacaatgtcagaaact

SEQ ID NO: 2152064 - DNA, 11 bp, Homo sapiens
cgactcaggat

SEQ ID NO: 2152065 - DNA, 15 bp, Homo sapiens
cgagccgggcctggg

SEQ ID NO: 2152066 - DNA, 15 bp, Homo sapiens
cgagtaatatgcctg

SEQ ID NO: 2152067 - DNA, 11 bp, Homo sapiens
cgattagactg

SEQ ID NO: 2152068 - DNA, 14 bp, Homo sapiens
cgcagctgctgcca

SEQ ID NO: 2152069 - DNA, 16 bp, Homo sapiens
cgcagctgctgccact

SEQ ID NO: 2152070 - DNA, 18 bp, Homo sapiens
cgcagctgctgccactct

SEQ ID NO: 2152071 - DNA, 13 bp, Homo sapiens
cgcatggcagctg

SEQ ID NO: 2152072 - DNA, 24 bp, Homo sapiens
cgcatggcagctgggcccacagcc

SEQ ID NO: 2152073 - DNA, 18 bp, Homo sapiens
cgcctgtcccctcacaga

SEQ ID NO: 2152074 - DNA, 19 bp, Homo sapiens
cgcctgtcccctcacagac

SEQ ID NO: 2152075 - DNA, 18 bp, Homo sapiens
cggacctggactagggcc

SEQ ID NO: 2152076 - DNA, 17 bp, Homo sapiens
cggaggctcctccctct

SEQ ID NO: 2152077 - DNA, 12 bp, Homo sapiens
cggattggccct

SEQ ID NO: 2152078 - DNA, 15 bp, Homo sapiens
gtatatgtatatcta

SEQ ID NO: 2152079 - DNA, 20 bp, Homo sapiens
gtcaaaacagattgtttgca

SEQ ID NO: 2152080 - DNA, 14 bp, Homo sapiens
gtcaatattaaata

SEQ ID NO: 2152081 - DNA, 17 bp, Homo sapiens
gtcaatattaaatacag

SEQ ID NO: 2152082 - DNA, 20 bp, Homo sapiens
gtcaatattaaatacagaca

SEQ ID NO: 2152083 - DNA, 23 bp, Homo sapiens
gtcaatattaaatacagacacta

SEQ ID NO: 2152084 - DNA, 15 bp, Homo sapiens
gtcacttgccacatg

SEQ ID NO: 2152085 - DNA, 12 bp, Homo sapiens
gtcaggctccat

SEQ ID NO: 2152086 - DNA, 17 bp, Homo sapiens
gtcaggctccattagga

SEQ ID NO: 2152087 - DNA, 15 bp, Homo sapiens
gtccaacccctcccc

SEQ ID NO: 2152088 - DNA, 17 bp, Homo sapiens
gtccaacccctccccca

SEQ ID NO: 2152089 - DNA, 15 bp, Homo sapiens
gtccagaagaatatt

SEQ ID NO: 2152090 - DNA, 12 bp, Homo sapiens
gtccataaagta

SEQ ID NO: 2152091 - DNA, 19 bp, Homo sapiens
gtccatccccttcccccat

SEQ ID NO: 2152092 - DNA, 14 bp, Homo sapiens
gtccatcctcctct

SEQ ID NO: 2152093 - DNA, 19 bp, Homo sapiens
gtccatcctcctctccatg

SEQ ID NO: 2152094 - DNA, 15 bp, Homo sapiens
gtcccacccaggaag

SEQ ID NO: 2152095 - DNA, 16 bp, Homo sapiens
gtcccctcacagactc

SEQ ID NO: 2152096 - DNA, 20 bp, Homo sapiens
gtcccctcacagactcttcc

SEQ ID NO: 2152097 - DNA, 21 bp, Homo sapiens
gtcccctcacagactcttcca

SEQ ID NO: 2152098 - DNA, 23 bp, Homo sapiens
gtcccctcacagactcttccacc

SEQ ID NO: 2152099 - DNA, 11 bp, Homo sapiens
gtccctggggc

SEQ ID NO: 2152100 - DNA, 16 bp, Homo sapiens
gtccctggggcactcc

SEQ ID NO: 2152101 - DNA, 19 bp, Homo sapiens
gtcctaaggacacactaat

SEQ ID NO: 2152102 - DNA, 17 bp, Homo sapiens
gtcctccagaccaccag

SEQ ID NO: 2152103 - DNA, 12 bp, Homo sapiens
gtcctgctggcc

SEQ ID NO: 2152104 - DNA, 13 bp, Homo sapiens
gtcctgctggcct

SEQ ID NO: 2152105 - DNA, 15 bp, Homo sapiens
gtcctgctggcctgc

SEQ ID NO: 2152106 - DNA, 14 bp, Homo sapiens
gtccttactcagag

SEQ ID NO: 2152107 - DNA, 16 bp, Homo sapiens
gtccttactcagagct

SEQ ID NO: 2152108 - DNA, 20 bp, Homo sapiens
gtccttactcagagctgcgg

SEQ ID NO: 2152109 - DNA, 21 bp, Homo sapiens
gtccttgcctgaactccagag

SEQ ID NO: 2152110 - DNA, 22 bp, Homo sapiens
gtctcacactcctcctgccagc

SEQ ID NO: 2152111 - DNA, 23 bp, Homo sapiens
gtctcctttgcactgagggccac

SEQ ID NO: 2152112 - DNA, 15 bp, Homo sapiens
gtctctccagcctca

SEQ ID NO: 2152113 - DNA, 14 bp, Homo sapiens
gtctctctgcctgc

SEQ ID NO: 2152114 - DNA, 12 bp, Homo sapiens
gtctctgcctgg

SEQ ID NO: 2152115 - DNA, 20 bp, Homo sapiens
gtctctgcctggagcagggg

SEQ ID NO: 2152116 - DNA, 22 bp, Homo sapiens
gtctctgcctggagcaggggtg

SEQ ID NO: 2152117 - DNA, 15 bp, Homo sapiens
gtctgaggccccagg

SEQ ID NO: 2152118 - DNA, 19 bp, Homo sapiens
gtctgaggccccaggccct

SEQ ID NO: 2152119 - DNA, 20 bp, Homo sapiens
gtctgtccaacccctccccc

SEQ ID NO: 2152120 - DNA, 19 bp, Homo sapiens
gtgaaagatgcaagcacct

SEQ ID NO: 2152121 - DNA, 13 bp, Homo sapiens
gtgaatacaatta

SEQ ID NO: 2152122 - DNA, 14 bp, Homo sapiens
gtgaatacaattaa

SEQ ID NO: 2152123 - DNA, 19 bp, Homo sapiens
gtgaatacaattaaaggtc

SEQ ID NO: 2152124 - DNA, 14 bp, Homo sapiens
gtgacatcagaagt

SEQ ID NO: 2152125 - DNA, 16 bp, Homo sapiens
gtgacgtgactcagag

SEQ ID NO: 2152126 - DNA, 17 bp, Homo sapiens
gtgacgtgactcagagc

SEQ ID NO: 2152127 - DNA, 14 bp, Homo sapiens
gtgactcagagctt

SEQ ID NO: 2152128 - DNA, 19 bp, Homo sapiens
gtgagagacattaactcat

SEQ ID NO: 2152129 - DNA, 23 bp, Homo sapiens
gtgagagacattaactcattaga

SEQ ID NO: 2152130 - DNA, 18 bp, Homo sapiens
gtgaggccggccctgccc

SEQ ID NO: 2152131 - DNA, 22 bp, Homo sapiens
gtgaggccggccctgcccctcc

SEQ ID NO: 2152132 - DNA, 14 bp, Homo sapiens
gtgcattctccagc

SEQ ID NO: 2152133 - DNA, 19 bp, Homo sapiens
gtgccatgtcaaacaaata

SEQ ID NO: 2152134 - DNA, 20 bp, Homo sapiens
gtgcccacatcccaggcttc

SEQ ID NO: 2152135 - DNA, 17 bp, Homo sapiens
gtgccctgacccctgca

SEQ ID NO: 2152136 - DNA, 13 bp, Homo sapiens
gtggattgagggt

SEQ ID NO: 2152137 - DNA, 19 bp, Homo sapiens
gtggcaagtgaatttgcct

SEQ ID NO: 2152138 - DNA, 15 bp, Homo sapiens
gtggccccaagaggg

SEQ ID NO: 2152139 - DNA, 22 bp, Homo sapiens
gtggctccagaatgtgctgcct

SEQ ID NO: 2152140 - DNA, 16 bp, Homo sapiens
gtgggagggtaccagc

SEQ ID NO: 2152141 - DNA, 14 bp, Homo sapiens
gtgggcagctgagg

SEQ ID NO: 2152142 - DNA, 23 bp, Homo sapiens
gtgggggggagaaggcctcccct

SEQ ID NO: 2152143 - DNA, 14 bp, Homo sapiens
gtggtcccacccag

SEQ ID NO: 2152144 - DNA, 12 bp, Homo sapiens
gtgtatatatat

SEQ ID NO: 2152145 - DNA, 21 bp, Homo sapiens
gtgtccctttttgcaggggac

SEQ ID NO: 2152146 - DNA, 15 bp, Homo sapiens
gtgtctcccaacatg

SEQ ID NO: 2152147 - DNA, 18 bp, Homo sapiens
gtgttgatttgagaaatt

SEQ ID NO: 2152148 - DNA, 12 bp, Homo sapiens
gttaatttaaag

SEQ ID NO: 2152149 - DNA, 16 bp, Homo sapiens
gttacatgtttgcacc

SEQ ID NO: 2152150 - DNA, 17 bp, Homo sapiens
gttacttacctaaacag

SEQ ID NO: 2152151 - DNA, 15 bp, Homo sapiens
gttatagtatatctg

SEQ ID NO: 2152152 - DNA, 21 bp, Homo sapiens
gttatctaagttaatttaaag

SEQ ID NO: 2152153 - DNA, 16 bp, Homo sapiens
gttatttttatatcag

SEQ ID NO: 2152154 - DNA, 23 bp, Homo sapiens
gttatttttatatcagcctgagt

SEQ ID NO: 2152155 - DNA, 13 bp, Homo sapiens
gttcacactccta

SEQ ID NO: 2152156 - DNA, 17 bp, Homo sapiens
gttccatgcctgagggt

SEQ ID NO: 2152157 - DNA, 21 bp, Homo sapiens
gttctagtctcctttgcactg

SEQ ID NO: 2152158 - DNA, 22 bp, Homo sapiens
gttgaaaataaagtgtatattt

SEQ ID NO: 2152159 - DNA, 15 bp, Homo sapiens
gttgagagtgtgacc

SEQ ID NO: 2152160 - DNA, 17 bp, Homo sapiens
gttgagagtgtgaccaa

SEQ ID NO: 2152161 - DNA, 14 bp, Homo sapiens
gttgcaaccactgc

SEQ ID NO: 2152162 - DNA, 15 bp, Homo sapiens
gttgggagcactgga

SEQ ID NO: 2152163 - DNA, 14 bp, Homo sapiens
gttgggggaatgca

SEQ ID NO: 2152164 - DNA, 17 bp, Homo sapiens
gttgtcaatattaaata

SEQ ID NO: 2152165 - DNA, 21 bp, Homo sapiens
gttgtcaatattaaatacaga

SEQ ID NO: 2152166 - DNA, 13 bp, Homo sapiens
gttttgaaatgct

SEQ ID NO: 2152167 - DNA, 18 bp, Homo sapiens
taaaaaaagtatatattc

SEQ ID NO: 2152168 - DNA, 19 bp, Homo sapiens
taaaaagattatatatcat

SEQ ID NO: 2152169 - DNA, 22 bp, Homo sapiens
taaaagttaaactacttgtaaa

SEQ ID NO: 2152170 - DNA, 14 bp, Homo sapiens
taaaatttatattg

SEQ ID NO: 2152171 - DNA, 16 bp, Homo sapiens
taaagacttcatgttc

SEQ ID NO: 2152172 - DNA, 22 bp, Homo sapiens
taaatacagacactaagttata

SEQ ID NO: 2152173 - DNA, 12 bp, Homo sapiens
taactcattaga

SEQ ID NO: 2152174 - DNA, 22 bp, Homo sapiens
taagatggcttatttgtataat

SEQ ID NO: 2152175 - DNA, 22 bp, Homo sapiens
taagccctgtcgagacacttgc

SEQ ID NO: 2152176 - DNA, 15 bp, Homo sapiens
taagctttctccttt

SEQ ID NO: 2152177 - DNA, 14 bp, Homo sapiens
taaggacacactaa

SEQ ID NO: 2152178 - DNA, 19 bp, Homo sapiens
taatatctgagaagtgtat

SEQ ID NO: 2152179 - DNA, 22 bp, Homo sapiens
taatatctgagaagtgtatata

SEQ ID NO: 2152180 - DNA, 19 bp, Homo sapiens
taatcaagagtctctccag

SEQ ID NO: 2152181 - DNA, 20 bp, Homo sapiens
taatcaagagtctctccagc

SEQ ID NO: 2152182 - DNA, 21 bp, Homo sapiens
taatcaagagtctctccagcc

SEQ ID NO: 2152183 - DNA, 16 bp, Homo sapiens
taatctgtagggctgg

SEQ ID NO: 2152184 - DNA, 17 bp, Homo sapiens
taatctgtagggctgga

SEQ ID NO: 2152185 - DNA, 20 bp, Homo sapiens
taatctgtagggctggacct

SEQ ID NO: 2152186 - DNA, 12 bp, Homo sapiens
tacaattaaagg

SEQ ID NO: 2152187 - DNA, 13 bp, Homo sapiens
tacagacactaag

SEQ ID NO: 2152188 - DNA, 14 bp, Homo sapiens
taccaagccaccgc

SEQ ID NO: 2152189 - DNA, 20 bp, Homo sapiens
taccaagccaccgcagctgc

SEQ ID NO: 2152190 - DNA, 19 bp, Homo sapiens
ggcctcttggcacctgcct

SEQ ID NO: 2152191 - DNA, 19 bp, Homo sapiens
ggcctgacctccagtcctg

SEQ ID NO: 2152192 - DNA, 23 bp, Homo sapiens
ggcctgacctccagtcctgctgg

SEQ ID NO: 2152193 - DNA, 17 bp, Homo sapiens
ggcctgctcccagcagc

SEQ ID NO: 2152194 - DNA, 18 bp, Homo sapiens
ggcctgctcccagcagcc

SEQ ID NO: 2152195 - DNA, 23 bp, Homo sapiens
ggcctggggctcctttctccagc

SEQ ID NO: 2152196 - DNA, 15 bp, Homo sapiens
ggccttccctcccca

SEQ ID NO: 2152197 - DNA, 20 bp, Homo sapiens
ggcgggctcagagctttgtc

SEQ ID NO: 2152198 - DNA, 11 bp, Homo sapiens
ggctcagagct

SEQ ID NO: 2152199 - DNA, 23 bp, Homo sapiens
ggctcagagctttgtcacttgcc

SEQ ID NO: 2152200 - DNA, 12 bp, Homo sapiens
ggctcagctgtg

SEQ ID NO: 2152201 - DNA, 16 bp, Homo sapiens
ggctcagctgtggtcc

SEQ ID NO: 2152202 - DNA, 20 bp, Homo sapiens
ggctcagctgtggtcccacc

SEQ ID NO: 2152203 - DNA, 15 bp, Homo sapiens
ggctccccttgccct

SEQ ID NO: 2152204 - DNA, 12 bp, Homo sapiens
ggctcctccctc

SEQ ID NO: 2152205 - DNA, 16 bp, Homo sapiens
ggctcctccctctgcc

SEQ ID NO: 2152206 - DNA, 22 bp, Homo sapiens
ggctcctccctctgcctcatcc

SEQ ID NO: 2152207 - DNA, 12 bp, Homo sapiens
ggctcctttctc

SEQ ID NO: 2152208 - DNA, 13 bp, Homo sapiens
ggctcctttctcc

SEQ ID NO: 2152209 - DNA, 21 bp, Homo sapiens
ggctcctttctccagccagca

SEQ ID NO: 2152210 - DNA, 14 bp, Homo sapiens
ggctgaacagtgct

SEQ ID NO: 2152211 - DNA, 18 bp, Homo sapiens
ggctgaacagtgctctgc

SEQ ID NO: 2152212 - DNA, 19 bp, Homo sapiens
ggctgaacagtgctctgcc

SEQ ID NO: 2152213 - DNA, 21 bp, Homo sapiens
ggctgagggcatctctgagtg

SEQ ID NO: 2152214 - DNA, 13 bp, Homo sapiens
ggctgctgggggc

SEQ ID NO: 2152215 - DNA, 16 bp, Homo sapiens
ggctgggggagggact

SEQ ID NO: 2152216 - DNA, 18 bp, Homo sapiens
ggctgggtcggccctgcc

SEQ ID NO: 2152217 - DNA, 21 bp, Homo sapiens
ggctggtgaggccggccctgc

SEQ ID NO: 2152218 - DNA, 21 bp, Homo sapiens
ggcttagacttcgactcagga

SEQ ID NO: 2152219 - DNA, 12 bp, Homo sapiens
gggaagctgcta

SEQ ID NO: 2152220 - DNA, 18 bp, Homo sapiens
gggaatgcacctccccaa

SEQ ID NO: 2152221 - DNA, 20 bp, Homo sapiens
gggaccactgggcccctcag

SEQ ID NO: 2152222 - DNA, 12 bp, Homo sapiens
gggactgggcca

SEQ ID NO: 2152223 - DNA, 15 bp, Homo sapiens
gggactgggccatgg

SEQ ID NO: 2152224 - DNA, 19 bp, Homo sapiens
gggagaaggcctcccctga

SEQ ID NO: 2152225 - DNA, 15 bp, Homo sapiens
gggagctgaggcctc

SEQ ID NO: 2152226 - DNA, 16 bp, Homo sapiens
gggagctgaggcctcc

SEQ ID NO: 2152227 - DNA, 13 bp, Homo sapiens
gggagggagctga

SEQ ID NO: 2152228 - DNA, 18 bp, Homo sapiens
gggagggagctgaggcct

SEQ ID NO: 2152229 - DNA, 15 bp, Homo sapiens
gggagggtaccagca

SEQ ID NO: 2152230 - DNA, 19 bp, Homo sapiens
gggagtgagacagaagtaa

SEQ ID NO: 2152231 - DNA, 23 bp, Homo sapiens
gggatcagccccgcctgtcacaa

SEQ ID NO: 2152232 - DNA, 20 bp, Homo sapiens
gggcaaagaactgccccatc

SEQ ID NO: 2152233 - DNA, 12 bp, Homo sapiens
gggcactccccc

SEQ ID NO: 2152234 - DNA, 18 bp, Homo sapiens
gggcagaatcctgggccc

SEQ ID NO: 2152235 - DNA, 17 bp, Homo sapiens
gggccagcaggcagcgc

SEQ ID NO: 2152236 - DNA, 18 bp, Homo sapiens
gggccagcaggcagcgcc

SEQ ID NO: 2152237 - DNA, 23 bp, Homo sapiens
gggccatgggtcctcggcccatc

SEQ ID NO: 2152238 - DNA, 12 bp, Homo sapiens
gggcccacagcc

SEQ ID NO: 2152239 - DNA, 16 bp, Homo sapiens
gggcctcccaccagag

SEQ ID NO: 2152240 - DNA, 18 bp, Homo sapiens
gggcctcggaggctcctc

SEQ ID NO: 2152241 - DNA, 16 bp, Homo sapiens
gggcctgacctccagt

SEQ ID NO: 2152242 - DNA, 13 bp, Homo sapiens
gggctcagagctt

SEQ ID NO: 2152243 - DNA, 21 bp, Homo sapiens
gggctcagagctttgtcactt

SEQ ID NO: 2152244 - DNA, 23 bp, Homo sapiens
gggctcagagctttgtcacttgc

SEQ ID NO: 2152245 - DNA, 20 bp, Homo sapiens
gggctgagggcatctctgag

SEQ ID NO: 2152246 - DNA, 11 bp, Homo sapiens
gggctgctggg

SEQ ID NO: 2152247 - DNA, 20 bp, Homo sapiens
gggctgctgggggctcccct

SEQ ID NO: 2152248 - DNA, 23 bp, Homo sapiens
ggggaagggccagtctgggctgc

SEQ ID NO: 2152249 - DNA, 16 bp, Homo sapiens
ggggaatgcacctccc

SEQ ID NO: 2152250 - DNA, 16 bp, Homo sapiens
ggggaccactgggccc

SEQ ID NO: 2152251 - DNA, 19 bp, Homo sapiens
ggggagaaggcctcccctg

SEQ ID NO: 2152252 - DNA, 18 bp, Homo sapiens
ggggagggactgctgacc

SEQ ID NO: 2152253 - DNA, 17 bp, Homo sapiens
ggggcactcccccagga

SEQ ID NO: 2152254 - DNA, 14 bp, Homo sapiens
ggggcgggctcaga

SEQ ID NO: 2152255 - DNA, 12 bp, Homo sapiens
ggggctgctggg

SEQ ID NO: 2152256 - DNA, 22 bp, Homo sapiens
gggggctccccttgcccttcct

SEQ ID NO: 2152257 - DNA, 14 bp, Homo sapiens
ggggtaccaggcac

SEQ ID NO: 2152258 - DNA, 13 bp, Homo sapiens
gggtaccaggcac

SEQ ID NO: 2152259 - DNA, 13 bp, Homo sapiens
gggtcctcggccc

SEQ ID NO: 2152260 - DNA, 23 bp, Homo sapiens
ggtaccaggcacatggctggggg

SEQ ID NO: 2152261 - DNA, 15 bp, Homo sapiens
ggtagaatgtaaagc

SEQ ID NO: 2152262 - DNA, 19 bp, Homo sapiens
ggtagaatgtaaagcttgt

SEQ ID NO: 2152263 - DNA, 15 bp, Homo sapiens
ggtcccacccaggaa

SEQ ID NO: 2152264 - DNA, 16 bp, Homo sapiens
gctgaggcctcccttg

SEQ ID NO: 2152265 - DNA, 20 bp, Homo sapiens
gctgccactctgctgcctgt

SEQ ID NO: 2152266 - DNA, 12 bp, Homo sapiens
gctgcctcccca

SEQ ID NO: 2152267 - DNA, 15 bp, Homo sapiens
gctgcctgtacagaa

SEQ ID NO: 2152268 - DNA, 16 bp, Homo sapiens
gctgcgggctgagggc

SEQ ID NO: 2152269 - DNA, 18 bp, Homo sapiens
gctgctgccactctgctg

SEQ ID NO: 2152270 - DNA, 19 bp, Homo sapiens
gctgctgggggctcccctt

SEQ ID NO: 2152271 - DNA, 23 bp, Homo sapiens
gctggacctatgtcctaaggaca

SEQ ID NO: 2152272 - DNA, 13 bp, Homo sapiens
gctggcctcttgg

SEQ ID NO: 2152273 - DNA, 21 bp, Homo sapiens
gctggcctcttggcacctgcc

SEQ ID NO: 2152274 - DNA, 12 bp, Homo sapiens
gctggcctggat

SEQ ID NO: 2152275 - DNA, 14 bp, Homo sapiens
gctggcctggatct

SEQ ID NO: 2152276 - DNA, 15 bp, Homo sapiens
gctgggcccacagcc

SEQ ID NO: 2152277 - DNA, 21 bp, Homo sapiens
gctgggctcttaactgttgct

SEQ ID NO: 2152278 - DNA, 20 bp, Homo sapiens
gctgggggctccccttgccc

SEQ ID NO: 2152279 - DNA, 19 bp, Homo sapiens
gctgggtcggccctgccca

SEQ ID NO: 2152280 - DNA, 17 bp, Homo sapiens
gctgtggtcccacccag

SEQ ID NO: 2152281 - DNA, 14 bp, Homo sapiens
gcttctatcccagg

SEQ ID NO: 2152282 - DNA, 23 bp, Homo sapiens
gcttgtggattgagggtaggagg

SEQ ID NO: 2152283 - DNA, 18 bp, Homo sapiens
gcttgtggcaagtgaatt

SEQ ID NO: 2152284 - DNA, 12 bp, Homo sapiens
gctttctccttt

SEQ ID NO: 2152285 - DNA, 17 bp, Homo sapiens
gcttttcgaactgtgct

SEQ ID NO: 2152286 - DNA, 23 bp, Homo sapiens
gcttttcgaactgtgctcccacg

SEQ ID NO: 2152287 - DNA, 16 bp, Homo sapiens
ggaaattctgctcaga

SEQ ID NO: 2152288 - DNA, 22 bp, Homo sapiens
ggaacactggtgggcagctgag

SEQ ID NO: 2152289 - DNA, 23 bp, Homo sapiens
ggaacactggtgggcagctgagg

SEQ ID NO: 2152290 - DNA, 16 bp, Homo sapiens
ggaagctgctagggga

SEQ ID NO: 2152291 - DNA, 12 bp, Homo sapiens
ggaagggccagt

SEQ ID NO: 2152292 - DNA, 14 bp, Homo sapiens
ggaatgcacctccc

SEQ ID NO: 2152293 - DNA, 20 bp, Homo sapiens
ggacaacctgcccctcccca

SEQ ID NO: 2152294 - DNA, 21 bp, Homo sapiens
ggacaagccaacttgtaaata

SEQ ID NO: 2152295 - DNA, 23 bp, Homo sapiens
ggacaagccaacttgtaaataca

SEQ ID NO: 2152296 - DNA, 22 bp, Homo sapiens
ggacatggttgggggaatgcac

SEQ ID NO: 2152297 - DNA, 13 bp, Homo sapiens
ggaccactgggcc

SEQ ID NO: 2152298 - DNA, 19 bp, Homo sapiens
ggaccactgggcccctcag

SEQ ID NO: 2152299 - DNA, 17 bp, Homo sapiens
ggacctatgtcctaagg

SEQ ID NO: 2152300 - DNA, 12 bp, Homo sapiens
ggactagggcct

SEQ ID NO: 2152301 - DNA, 23 bp, Homo sapiens
ggactagggcctcggaggctcct

SEQ ID NO: 2152302 - DNA, 13 bp, Homo sapiens
ggactgctgaccc

SEQ ID NO: 2152303 - DNA, 15 bp, Homo sapiens
ggactgctgacccac

SEQ ID NO: 2152304 - DNA, 21 bp, Homo sapiens
ggactggccgtggctccagaa

SEQ ID NO: 2152305 - DNA, 19 bp, Homo sapiens
ggactgggccatgggtcct

SEQ ID NO: 2152306 - DNA, 20 bp, Homo sapiens
ggactgggccatgggtcctc

SEQ ID NO: 2152307 - DNA, 15 bp, Homo sapiens
ggacttaacggctcc

SEQ ID NO: 2152308 - DNA, 17 bp, Homo sapiens
ggacttaacggctccag

SEQ ID NO: 2152309 - DNA, 17 bp, Homo sapiens
ggagaaggcctcccctg

SEQ ID NO: 2152310 - DNA, 18 bp, Homo sapiens
ggagaaggcctcccctga

SEQ ID NO: 2152311 - DNA, 14 bp, Homo sapiens
ggagcacaggcagc

SEQ ID NO: 2152312 - DNA, 15 bp, Homo sapiens
ggagcacaggcagct

SEQ ID NO: 2152313 - DNA, 13 bp, Homo sapiens
ggagcactggagt

SEQ ID NO: 2152314 - DNA, 12 bp, Homo sapiens
ggagctgaggcc

SEQ ID NO: 2152315 - DNA, 12 bp, Homo sapiens
ggaggcaagaac

SEQ ID NO: 2152316 - DNA, 19 bp, Homo sapiens
ggaggctcctccctctgcc

SEQ ID NO: 2152317 - DNA, 15 bp, Homo sapiens
ggagggactgctgac

SEQ ID NO: 2152318 - DNA, 17 bp, Homo sapiens
ggagggactgctgaccc

SEQ ID NO: 2152319 - DNA, 13 bp, Homo sapiens
ggagggagctgag

SEQ ID NO: 2152320 - DNA, 18 bp, Homo sapiens
ggagggagctgaggcctc

SEQ ID NO: 2152321 - DNA, 21 bp, Homo sapiens
ggagggagctgaggcctccct

SEQ ID NO: 2152322 - DNA, 16 bp, Homo sapiens
ggagggatcagccccg

SEQ ID NO: 2152323 - DNA, 22 bp, Homo sapiens
ggagggatcagccccgcctgtc

SEQ ID NO: 2152324 - DNA, 18 bp, Homo sapiens
ggaggtggctatggccac

SEQ ID NO: 2152325 - DNA, 12 bp, Homo sapiens
ggatcagccccg

SEQ ID NO: 2152326 - DNA, 21 bp, Homo sapiens
ggatcagccccgcctgtcaca

SEQ ID NO: 2152327 - DNA, 17 bp, Homo sapiens
ggatcccctgtcccctg

SEQ ID NO: 2152328 - DNA, 22 bp, Homo sapiens
ggatctctcaggagcacaggca

SEQ ID NO: 2152329 - DNA, 15 bp, Homo sapiens
ggatgggagtgagac

SEQ ID NO: 2152330 - DNA, 15 bp, Homo sapiens
ggattggccctgccc

SEQ ID NO: 2152331 - DNA, 18 bp, Homo sapiens
ggcaaagaactgccccat

SEQ ID NO: 2152332 - DNA, 15 bp, Homo sapiens
ggcacaaatgcacct

SEQ ID NO: 2152333 - DNA, 16 bp, Homo sapiens
ggcacatggctggggg

SEQ ID NO: 2152334 - DNA, 18 bp, Homo sapiens
ggcagaactgctggggct

SEQ ID NO: 2152335 - DNA, 17 bp, Homo sapiens
ggcagaatcctgggccc

SEQ ID NO: 2152336 - DNA, 18 bp, Homo sapiens
ggcagaatcctgggcccc

SEQ ID NO: 2152337 - DNA, 19 bp, Homo sapiens
ggcagcgcctgtcccctca

SEQ ID NO: 2152338 - DNA, 16 bp, Homo sapiens
ggcagctggatgagac

SEQ ID NO: 2152339 - DNA, 19 bp, Homo sapiens
ggcagctgggcccacagcc

SEQ ID NO: 2152340 - DNA, 22 bp, Homo sapiens
ggcagctgggcccacagccccc

SEQ ID NO: 2152341 - DNA, 15 bp, Homo sapiens
aaaaactgagtgact

SEQ ID NO: 2152342 - DNA, 11 bp, Homo sapiens
aaaaagtatat

SEQ ID NO: 2152343 - DNA, 13 bp, Homo sapiens
aaaaagtatatat

SEQ ID NO: 2152344 - DNA, 14 bp, Homo sapiens
aaaaagtatatatt

SEQ ID NO: 2152345 - DNA, 12 bp, Homo sapiens
aaaacccctggc

SEQ ID NO: 2152346 - DNA, 16 bp, Homo sapiens
aaacagattgtttgca

SEQ ID NO: 2152347 - DNA, 15 bp, Homo sapiens
aaactcactgctcaa

SEQ ID NO: 2152348 - DNA, 16 bp, Homo sapiens
aaactcactgctcaag

SEQ ID NO: 2152349 - DNA, 20 bp, Homo sapiens
aaactcactgctcaagaaga

SEQ ID NO: 2152350 - DNA, 13 bp, Homo sapiens
aaactgagtgact

SEQ ID NO: 2152351 - DNA, 17 bp, Homo sapiens
aaagattatatatcata

SEQ ID NO: 2152352 - DNA, 21 bp, Homo sapiens
aaagcttctatcccaggaggt

SEQ ID NO: 2152353 - DNA, 20 bp, Homo sapiens
aaagtcacatataaaagtta

SEQ ID NO: 2152354 - DNA, 21 bp, Homo sapiens
aaatacaccacctcactcctg

SEQ ID NO: 2152355 - DNA, 16 bp, Homo sapiens
aaatacagacactaag

SEQ ID NO: 2152356 - DNA, 13 bp, Homo sapiens
aaatctattcaga

SEQ ID NO: 2152357 - DNA, 22 bp, Homo sapiens
aaatctggcaaagttatattta

SEQ ID NO: 2152358 - DNA, 19 bp, Homo sapiens
aaatctgtttgatccctgt

SEQ ID NO: 2152359 - DNA, 13 bp, Homo sapiens
aaatgcattatgt

SEQ ID NO: 2152360 - DNA, 17 bp, Homo sapiens
aaatggctggtttttag

SEQ ID NO: 2152361 - DNA, 23 bp, Homo sapiens
aaattttagcgtgctcactgacc

SEQ ID NO: 2152362 - DNA, 14 bp, Homo sapiens
aacaatgtcagaaa

SEQ ID NO: 2152363 - DNA, 21 bp, Homo sapiens
aacactctctgagatgcccct

SEQ ID NO: 2152364 - DNA, 16 bp, Homo sapiens
aacagattgtttgcaa

SEQ ID NO: 2152365 - DNA, 19 bp, Homo sapiens
aacagcagactcagctctg

SEQ ID NO: 2152366 - DNA, 21 bp, Homo sapiens
aacatgggagggatcagcccc

SEQ ID NO: 2152367 - DNA, 18 bp, Homo sapiens
aaccaaagagtctctggc

SEQ ID NO: 2152368 - DNA, 13 bp, Homo sapiens
aacccctccccca

SEQ ID NO: 2152369 - DNA, 21 bp, Homo sapiens
aacctgtccttactcagagct

SEQ ID NO: 2152370 - DNA, 22 bp, Homo sapiens
aacctgtccttactcagagctg

SEQ ID NO: 2152371 - DNA, 23 bp, Homo sapiens
aacctgtccttactcagagctgc

SEQ ID NO: 2152372 - DNA, 14 bp, Homo sapiens
aacggctccaggat

SEQ ID NO: 2152373 - DNA, 21 bp, Homo sapiens
aactcactgctcaagaagaca

SEQ ID NO: 2152374 - DNA, 13 bp, Homo sapiens
aactccctcctca

SEQ ID NO: 2152375 - DNA, 13 bp, Homo sapiens
aactgttgctcga

SEQ ID NO: 2152376 - DNA, 21 bp, Homo sapiens
aacttgaactgattcacatct

SEQ ID NO: 2152377 - DNA, 13 bp, Homo sapiens
aagaactgcccca

SEQ ID NO: 2152378 - DNA, 18 bp, Homo sapiens
aagaactgccccatctcc

SEQ ID NO: 2152379 - DNA, 16 bp, Homo sapiens
aagactgttgctcaaa

SEQ ID NO: 2152380 - DNA, 17 bp, Homo sapiens
aagactgttgctcaaat

SEQ ID NO: 2152381 - DNA, 16 bp, Homo sapiens
aagaggggcgggctca

SEQ ID NO: 2152382 - DNA, 21 bp, Homo sapiens
aagaggggcgggctcagagct

SEQ ID NO: 2152383 - DNA, 13 bp, Homo sapiens
aagagtctctggc

SEQ ID NO: 2152384 - DNA, 16 bp, Homo sapiens
aagagtctctggctca

SEQ ID NO: 2152385 - DNA, 22 bp, Homo sapiens
aagagtctctggctcagctgtg

SEQ ID NO: 2152386 - DNA, 13 bp, Homo sapiens
aagatatttatat

SEQ ID NO: 2152387 - DNA, 16 bp, Homo sapiens
aagattatatatcata

SEQ ID NO: 2152388 - DNA, 21 bp, Homo sapiens
accagttgggagcactggagt

SEQ ID NO: 2152389 - DNA, 18 bp, Homo sapiens
accatgagaagagggcct

SEQ ID NO: 2152390 - DNA, 11 bp, Homo sapiens
accatgcaagg

SEQ ID NO: 2152391 - DNA, 14 bp, Homo sapiens
acccaacctgtcct

SEQ ID NO: 2152392 - DNA, 15 bp, Homo sapiens
acccaacctgtcctt

SEQ ID NO: 2152393 - DNA, 23 bp, Homo sapiens
acccaacctgtccttactcagag

SEQ ID NO: 2152394 - DNA, 22 bp, Homo sapiens
acccaggaagggagggagctga

SEQ ID NO: 2152395 - DNA, 16 bp, Homo sapiens
accccacaccccagcc

SEQ ID NO: 2152396 - DNA, 17 bp, Homo sapiens
accccacaccccagccc

SEQ ID NO: 2152397 - DNA, 14 bp, Homo sapiens
accccagcacagct

SEQ ID NO: 2152398 - DNA, 13 bp, Homo sapiens
acccctcccccac

SEQ ID NO: 2152399 - DNA, 12 bp, Homo sapiens
acccctgcacca

SEQ ID NO: 2152400 - DNA, 20 bp, Homo sapiens
acccctgcaccagcccttcc

SEQ ID NO: 2152401 - DNA, 24 bp, Homo sapiens
acccctggctgaacagtgctctgc

SEQ ID NO: 2152402 - DNA, 15 bp, Homo sapiens
acccggattggccct

SEQ ID NO: 2152403 - DNA, 17 bp, Homo sapiens
acccggattggccctgc

SEQ ID NO: 2152404 - DNA, 19 bp, Homo sapiens
acccggattggccctgccc

SEQ ID NO: 2152405 - DNA, 21 bp, Homo sapiens
acccggattggccctgcccct

SEQ ID NO: 2152406 - DNA, 18 bp, Homo sapiens
acccgttctgctggcctg

SEQ ID NO: 2152407 - DNA, 12 bp, Homo sapiens
accctgcctgct

SEQ ID NO: 2152408 - DNA, 13 bp, Homo sapiens
accctgcctgctg

SEQ ID NO: 2152409 - DNA, 19 bp, Homo sapiens
accctgctcctcctgccct

SEQ ID NO: 2152410 - DNA, 21 bp, Homo sapiens
accctgggtttggcccctgga

SEQ ID NO: 2152411 - DNA, 20 bp, Homo sapiens
acccttcctcatctgtgcct

SEQ ID NO: 2152412 - DNA, 14 bp, Homo sapiens
accgcagctgctgc

SEQ ID NO: 2152413 - DNA, 16 bp, Homo sapiens
accgcagctgctgcca

SEQ ID NO: 2152414 - DNA, 18 bp, Homo sapiens
accgcagctgctgccact

SEQ ID NO: 2152415 - DNA, 19 bp, Homo sapiens
accgcagctgctgccactc

SEQ ID NO: 2152416 - DNA, 21 bp, Homo sapiens
accgcagctgctgccactctg

SEQ ID NO: 2152417 - DNA, 13 bp, Homo sapiens
accgcatggcagc

SEQ ID NO: 2152418 - DNA, 21 bp, Homo sapiens
accgcatggcagctgggccca

SEQ ID NO: 2152419 - DNA, 23 bp, Homo sapiens
accgcatggcagctgggcccaca

SEQ ID NO: 2152420 - DNA, 22 bp, Homo sapiens
acctatgtcctaaggacacact

SEQ ID NO: 2152421 - DNA, 13 bp, Homo sapiens
acctcactcctgt

SEQ ID NO: 2152422 - DNA, 19 bp, Homo sapiens
acctccagtcctgctggcc

SEQ ID NO: 2152423 - DNA, 22 bp, Homo sapiens
acctctccaagtctctctgtga

SEQ ID NO: 2152424 - DNA, 22 bp, Homo sapiens
acctgacagatgtcagccgagc

SEQ ID NO: 2152425 - DNA, 23 bp, Homo sapiens
acctgagaccagttgggagcact

SEQ ID NO: 2152426 - DNA, 12 bp, Homo sapiens
acctgcctagct

SEQ ID NO: 2152427 - DNA, 18 bp, Homo sapiens
acctgcctagctcttggg

SEQ ID NO: 2152428 - DNA, 20 bp, Homo sapiens
acctgcctagctcttgggcc

SEQ ID NO: 2152429 - DNA, 18 bp, Homo sapiens
acctggaagcatttgttt

SEQ ID NO: 2152430 - DNA, 19 bp, Homo sapiens
acctgtccttactcagagc

SEQ ID NO: 2152431 - DNA, 22 bp, Homo sapiens
acctgtccttactcagagctgc

SEQ ID NO: 2152432 - DNA, 15 bp, Homo sapiens
acctttgcccacaca

SEQ ID NO: 2152433 - DNA, 22 bp, Homo sapiens
acctttgcccacacacactcct

SEQ ID NO: 2152434 - DNA, 15 bp, Homo sapiens
acctttttttctctc

SEQ ID NO: 2152435 - DNA, 19 bp, Homo sapiens
acctttttttctctcctaa

SEQ ID NO: 2152436 - DNA, 17 bp, Homo sapiens
acggggaccactgggcc

SEQ ID NO: 2152437 - DNA, 18 bp, Homo sapiens
acgtaccaagccaccgca

SEQ ID NO: 2152438 - DNA, 13 bp, Homo sapiens
acgtctctctgcc

SEQ ID NO: 2152439 - DNA, 21 bp, Homo sapiens
acgtctctctgcctgctgggc

SEQ ID NO: 2152440 - DNA, 19 bp, Homo sapiens
acgtgaaagatgcaagcac

SEQ ID NO: 2152441 - DNA, 14 bp, Homo sapiens
acgtgactcagagc

SEQ ID NO: 2152442 - DNA, 13 bp, Homo sapiens
actaagccctgtc

SEQ ID NO: 2152443 - DNA, 18 bp, Homo sapiens
actaagccctgtcgagac

SEQ ID NO: 2152444 - DNA, 17 bp, Homo sapiens
actaagctttctccttt

SEQ ID NO: 2152445 - DNA, 18 bp, Homo sapiens
actaagctttctcctttg

SEQ ID NO: 2152446 - DNA, 23 bp, Homo sapiens
actagggcctcggaggctcctcc

SEQ ID NO: 2152447 - DNA, 24 bp, Homo sapiens
actagggcctcggaggctcctccc

SEQ ID NO: 2152448 - DNA, 17 bp, Homo sapiens
actagttttgtgccagc

SEQ ID NO: 2152449 - DNA, 15 bp, Homo sapiens
actcagagctgcggg

SEQ ID NO: 2152450 - DNA, 18 bp, Homo sapiens
actcagagctgcgggctg

SEQ ID NO: 2152451 - DNA, 11 bp, Homo sapiens
actcagagctt

SEQ ID NO: 2152452 - DNA, 11 bp, Homo sapiens
actcagctctg

SEQ ID NO: 2152453 - DNA, 18 bp, Homo sapiens
actcaggatccagtccct

SEQ ID NO: 2152454 - DNA, 14 bp, Homo sapiens
actcattagactgg

SEQ ID NO: 2152455 - DNA, 21 bp, Homo sapiens
actcattagactggaacttga

SEQ ID NO: 2152456 - DNA, 20 bp, Homo sapiens
actccagaattacccttcct

SEQ ID NO: 2152457 - DNA, 13 bp, Homo sapiens
actcccccaggat

SEQ ID NO: 2152458 - DNA, 16 bp, Homo sapiens
actcctcctgccagct

SEQ ID NO: 2152459 - DNA, 18 bp, Homo sapiens
actcctcctgccagctct

SEQ ID NO: 2152460 - DNA, 19 bp, Homo sapiens
actcctcctgccagctctg

SEQ ID NO: 2152461 - DNA, 20 bp, Homo sapiens
actcctgttacttacctaaa

SEQ ID NO: 2152462 - DNA, 22 bp, Homo sapiens
actccttccccttgtccctggg

SEQ ID NO: 2152463 - DNA, 15 bp, Homo sapiens
actcgatgaatgtgt

SEQ ID NO: 2152464 - DNA, 18 bp, Homo sapiens
actcttccaccagagcag

SEQ ID NO: 2152465 - DNA, 12 bp, Homo sapiens
actgagtgactc

SEQ ID NO: 2152466 - DNA, 23 bp, Homo sapiens
actgagtgactctatatagctga

SEQ ID NO: 2152467 - DNA, 14 bp, Homo sapiens
actgccccatctcc

SEQ ID NO: 2152468 - DNA, 16 bp, Homo sapiens
actgctcaagaagaca

SEQ ID NO: 2152469 - DNA, 15 bp, Homo sapiens
actgctggggctggt

SEQ ID NO: 2152470 - DNA, 16 bp, Homo sapiens
actgctggggctggtg

SEQ ID NO: 2152471 - DNA, 17 bp, Homo sapiens
actgctggggctggtga

SEQ ID NO: 2152472 - DNA, 22 bp, Homo sapiens
actgctggggctggtgaggccg

SEQ ID NO: 2152473 - DNA, 12 bp, Homo sapiens
actggacagctt

SEQ ID NO: 2152474 - DNA, 13 bp, Homo sapiens
actggacagcttg

SEQ ID NO: 2152475 - DNA, 17 bp, Homo sapiens
actggagtgcagggagg

SEQ ID NO: 2152476 - DNA, 18 bp, Homo sapiens
actggagtgcagggagga

SEQ ID NO: 2152477 - DNA, 15 bp, Homo sapiens
actggccgtggctcc

SEQ ID NO: 2152478 - DNA, 22 bp, Homo sapiens
actgggccatgggtcctcggcc

SEQ ID NO: 2152479 - DNA, 16 bp, Homo sapiens
actgggcccctcaggg

SEQ ID NO: 2152480 - DNA, 22 bp, Homo sapiens
actgggcccctcaggggaagct

SEQ ID NO: 2152481 - DNA, 20 bp, Homo sapiens
actggtttgaagaatgttaa

SEQ ID NO: 2152482 - DNA, 17 bp, Homo sapiens
actgtgacatcagaagt

SEQ ID NO: 2152483 - DNA, 14 bp, Homo sapiens
actgtgctcccacg

SEQ ID NO: 2152484 - DNA, 20 bp, Homo sapiens
actgtgctcccacggggacc

SEQ ID NO: 2152485 - DNA, 19 bp, Homo sapiens
actgtttttcggacagttt

SEQ ID NO: 2152486 - DNA, 19 bp, Homo sapiens
acttaacggctccaggatt

SEQ ID NO: 2152487 - DNA, 20 bp, Homo sapiens
acttccaaacctgacagatg

SEQ ID NO: 2152488 - DNA, 13 bp, Homo sapiens
acttgaactgatt

SEQ ID NO: 2152489 - DNA, 13 bp, Homo sapiens
acttgtaaataca

SEQ ID NO: 2152490 - DNA, 14 bp, Homo sapiens
acttgtaaatacac

SEQ ID NO: 2152491 - DNA, 15 bp, Homo sapiens
acttgtaaatacacc

SEQ ID NO: 2152492 - DNA, 15 bp, Homo sapiens
acttttctaaagctc

SEQ ID NO: 2152493 - DNA, 22 bp, Homo sapiens
acttttctaaagctctgaacaa

SEQ ID NO: 2152494 - DNA, 19 bp, Homo sapiens
agaaactcgatgaatgtgt

SEQ ID NO: 2152495 - DNA, 20 bp, Homo sapiens
agaaattttactgacagaaa

SEQ ID NO: 2152496 - DNA, 17 bp, Homo sapiens
agaacaatgtcagaaac

SEQ ID NO: 2152497 - DNA, 19 bp, Homo sapiens
agaactgccccatctcctc

SEQ ID NO: 2152498 - DNA, 17 bp, Homo sapiens
attaaaggtcctgccct

SEQ ID NO: 2152499 - DNA, 12 bp, Homo sapiens
attaactcatta

SEQ ID NO: 2152500 - DNA, 17 bp, Homo sapiens
attagcaactgtgctac

SEQ ID NO: 2152501 - DNA, 17 bp, Homo sapiens
attatatatcataaagt

SEQ ID NO: 2152502 - DNA, 21 bp, Homo sapiens
attcaaggcatttctatcaca

SEQ ID NO: 2152503 - DNA, 15 bp, Homo sapiens
attcacatctcattt

SEQ ID NO: 2152504 - DNA, 22 bp, Homo sapiens
attcaggacttaacggctccag

SEQ ID NO: 2152505 - DNA, 17 bp, Homo sapiens
attcatgctttctcctt

SEQ ID NO: 2152506 - DNA, 23 bp, Homo sapiens
attctccagccatcaagagactg

SEQ ID NO: 2152507 - DNA, 12 bp, Homo sapiens
attggccctgcc

SEQ ID NO: 2152508 - DNA, 15 bp, Homo sapiens
attggccctgcccct

SEQ ID NO: 2152509 - DNA, 16 bp, Homo sapiens
attggccctgcccctc

SEQ ID NO: 2152510 - DNA, 13 bp, Homo sapiens
atttaaatctgtt

SEQ ID NO: 2152511 - DNA, 13 bp, Homo sapiens
atttaatatctga

SEQ ID NO: 2152512 - DNA, 20 bp, Homo sapiens
atttagaatatattaaatcg

SEQ ID NO: 2152513 - DNA, 15 bp, Homo sapiens
atttatattgtaaat

SEQ ID NO: 2152514 - DNA, 21 bp, Homo sapiens
atttatattgtaaatattgtg

SEQ ID NO: 2152515 - DNA, 17 bp, Homo sapiens
atttccacataaaggta

SEQ ID NO: 2152516 - DNA, 11 bp, Homo sapiens
atttctaggta

SEQ ID NO: 2152517 - DNA, 13 bp, Homo sapiens
atttgaagtgtaa

SEQ ID NO: 2152518 - DNA, 22 bp, Homo sapiens
atttgttgagagtgtgaccaaa

SEQ ID NO: 2152519 - DNA, 18 bp, Homo sapiens
attttactgacagaaatg

SEQ ID NO: 2152520 - DNA, 22 bp, Homo sapiens
attttgaaaacccctggctgaa

SEQ ID NO: 2152521 - DNA, 18 bp, Homo sapiens
attttgcattagacagat

SEQ ID NO: 2152522 - DNA, 20 bp, Homo sapiens
attttgtacaaagatatgct

SEQ ID NO: 2152523 - DNA, 16 bp, Homo sapiens
caaaaaaacactagtt

SEQ ID NO: 2152524 - DNA, 13 bp, Homo sapiens
caaaacagattgt

SEQ ID NO: 2152525 - DNA, 14 bp, Homo sapiens
caaaagcaagactg

SEQ ID NO: 2152526 - DNA, 21 bp, Homo sapiens
caaaccaggggtaccaggcac

SEQ ID NO: 2152527 - DNA, 19 bp, Homo sapiens
caaactcactgctcaagaa

SEQ ID NO: 2152528 - DNA, 15 bp, Homo sapiens
caaagagaataaaga

SEQ ID NO: 2152529 - DNA, 14 bp, Homo sapiens
caaagagtctctgg

SEQ ID NO: 2152530 - DNA, 15 bp, Homo sapiens
caaagagtctctggc

SEQ ID NO: 2152531 - DNA, 22 bp, Homo sapiens
caaagagtctctggctcagctg

SEQ ID NO: 2152532 - DNA, 20 bp, Homo sapiens
caaagatatgctaagcagta

SEQ ID NO: 2152533 - DNA, 16 bp, Homo sapiens
caaagcatgaaatgga

SEQ ID NO: 2152534 - DNA, 21 bp, Homo sapiens
caaagcttctatcccaggagg

SEQ ID NO: 2152535 - DNA, 20 bp, Homo sapiens
caaatctattcagacaagca

SEQ ID NO: 2152536 - DNA, 20 bp, Homo sapiens
caaatgagcattagctactt

SEQ ID NO: 2152537 - DNA, 13 bp, Homo sapiens
caacaggttttat

SEQ ID NO: 2152538 - DNA, 10 bp, Homo sapiens
caacatggga

SEQ ID NO: 2152539 - DNA, 18 bp, Homo sapiens
caacatgggagggatcag

SEQ ID NO: 2152540 - DNA, 20 bp, Homo sapiens
caacatgggagggatcagcc

SEQ ID NO: 2152541 - DNA, 22 bp, Homo sapiens
caacctgtccttactcagagct

SEQ ID NO: 2152542 - DNA, 12 bp, Homo sapiens
caagaagacatg

SEQ ID NO: 2152543 - DNA, 17 bp, Homo sapiens
caagacaaagcaaagcc

SEQ ID NO: 2152544 - DNA, 20 bp, Homo sapiens
caagaggggcgggctcagag

SEQ ID NO: 2152545 - DNA, 14 bp, Homo sapiens
caagagtctctcca

SEQ ID NO: 2152546 - DNA, 15 bp, Homo sapiens
caagagtctctccag

SEQ ID NO: 2152547 - DNA, 18 bp, Homo sapiens
caagagtctctccagcct

SEQ ID NO: 2152548 - DNA, 23 bp, Homo sapiens
caagagtctctccagcctcacag

SEQ ID NO: 2152549 - DNA, 18 bp, Homo sapiens
caagccaacttgtaaata

SEQ ID NO: 2152550 - DNA, 20 bp, Homo sapiens
caagccaacttgtaaataca

SEQ ID NO: 2152551 - DNA, 15 bp, Homo sapiens
caagccaccgcagct

SEQ ID NO: 2152552 - DNA, 19 bp, Homo sapiens
caagccaccgcagctgctg

SEQ ID NO: 2152553 - DNA, 20 bp, Homo sapiens
caagccaccgcagctgctgc

SEQ ID NO: 2152554 - DNA, 22 bp, Homo sapiens
caagccaccgcagctgctgcca

SEQ ID NO: 2152555 - DNA, 15 bp, Homo sapiens
caagtctctctgtga

SEQ ID NO: 2152556 - DNA, 15 bp, Homo sapiens
caagttgagaacaaa

SEQ ID NO: 2152557 - DNA, 14 bp, Homo sapiens
caatattaaataca

SEQ ID NO: 2152558 - DNA, 22 bp, Homo sapiens
caatattaaatacagacactaa

SEQ ID NO: 2152559 - DNA, 23 bp, Homo sapiens
caatattaaatacagacactaag

SEQ ID NO: 2152560 - DNA, 21 bp, Homo sapiens
caatgcccgtaagatggctta

SEQ ID NO: 2152561 - DNA, 15 bp, Homo sapiens
caatgtcagaaactc

SEQ ID NO: 2152562 - DNA, 13 bp, Homo sapiens
caattaaaggtcc

SEQ ID NO: 2152563 - DNA, 17 bp, Homo sapiens
cacacactccttcccct

SEQ ID NO: 2152564 - DNA, 13 bp, Homo sapiens
cacaccccacacc

SEQ ID NO: 2152565 - DNA, 19 bp, Homo sapiens
cacaccccacaccccagcc

SEQ ID NO: 2152566 - DNA, 20 bp, Homo sapiens
cacaccccagcccaccctgc

SEQ ID NO: 2152567 - DNA, 12 bp, Homo sapiens
cacaccctgcct

SEQ ID NO: 2152568 - DNA, 13 bp, Homo sapiens
cacaccctgcctg

SEQ ID NO: 2152569 - DNA, 15 bp, Homo sapiens
cacaccctgcctgct

SEQ ID NO: 2152570 - DNA, 20 bp, Homo sapiens
cacaccctgcctgctgtgga

SEQ ID NO: 2152571 - DNA, 20 bp, Homo sapiens
cacactattaccatgagaag

SEQ ID NO: 2152572 - DNA, 13 bp, Homo sapiens
cacactccttccc

SEQ ID NO: 2152573 - DNA, 15 bp, Homo sapiens
cacagactcttccac

SEQ ID NO: 2152574 - DNA, 17 bp, Homo sapiens
cacagactcttccacca

SEQ ID NO: 2152575 - DNA, 18 bp, Homo sapiens
cacagactcttccaccag

SEQ ID NO: 2152576 - DNA, 22 bp, Homo sapiens
cacagactcttccaccagagca

SEQ ID NO: 2152577 - DNA, 16 bp, Homo sapiens
cacagagggcgctcct

SEQ ID NO: 2152578 - DNA, 13 bp, Homo sapiens
cacagatgctggc

SEQ ID NO: 2152579 - DNA, 19 bp, Homo sapiens
cacagcaccagaatgtata

SEQ ID NO: 2152580 - DNA, 14 bp, Homo sapiens
cacagcccccaccc

SEQ ID NO: 2152581 - DNA, 22 bp, Homo sapiens
cacagcccccaccccagcacag

SEQ ID NO: 2152582 - DNA, 12 bp, Homo sapiens
cacagcctctcc

SEQ ID NO: 2152583 - DNA, 13 bp, Homo sapiens
cacagcctctccc

SEQ ID NO: 2152584 - DNA, 12 bp, Homo sapiens
cacagctcctcc

SEQ ID NO: 2152585 - DNA, 19 bp, Homo sapiens
cacagctcctcccctgccg

SEQ ID NO: 2152586 - DNA, 20 bp, Homo sapiens
cacagctcctcccctgccgc

SEQ ID NO: 2152587 - DNA, 11 bp, Homo sapiens
cacaggcagct

SEQ ID NO: 2152588 - DNA, 20 bp, Homo sapiens
cacatataaaagttaaacta

SEQ ID NO: 2152589 - DNA, 14 bp, Homo sapiens
cacatggtgtctcc

SEQ ID NO: 2152590 - DNA, 21 bp, Homo sapiens
caccaaggtctcacactcctc

SEQ ID NO: 2152591 - DNA, 14 bp, Homo sapiens
caccacccaacctg

SEQ ID NO: 2152592 - DNA, 23 bp, Homo sapiens
caccactagggtcctggccctct

SEQ ID NO: 2152593 - DNA, 19 bp, Homo sapiens
caccagagcaggggctgct

SEQ ID NO: 2152594 - DNA, 18 bp, Homo sapiens
caccagcccggcctgctc

SEQ ID NO: 2152595 - DNA, 17 bp, Homo sapiens
caccagccgccccagcc

SEQ ID NO: 2152596 - DNA, 19 bp, Homo sapiens
caccagccgccccagcccc

SEQ ID NO: 2152597 - DNA, 14 bp, Homo sapiens
cacccaggaaggga

SEQ ID NO: 2152598 - DNA, 15 bp, Homo sapiens
caccccacaccccag

SEQ ID NO: 2152599 - DNA, 20 bp, Homo sapiens
caccccacaccccagcccac

SEQ ID NO: 2152600 - DNA, 10 bp, Homo sapiens
caccccagca

SEQ ID NO: 2152601 - DNA, 11 bp, Homo sapiens
caccccagccc

SEQ ID NO: 2152602 - DNA, 18 bp, Homo sapiens
cacccgttctgctggcct

SEQ ID NO: 2152603 - DNA, 13 bp, Homo sapiens
caccctgcctgct

SEQ ID NO: 2152604 - DNA, 14 bp, Homo sapiens
caccctgcctgctg

SEQ ID NO: 2152605 - DNA, 17 bp, Homo sapiens
caccctgcctgctgtgg

SEQ ID NO: 2152606 - DNA, 19 bp, Homo sapiens
caccctgggtttggcccct

SEQ ID NO: 2152607 - DNA, 20 bp, Homo sapiens
caccctgggtttggcccctg

SEQ ID NO: 2152608 - DNA, 12 bp, Homo sapiens
ccgcagctgctg

SEQ ID NO: 2152609 - DNA, 14 bp, Homo sapiens
ccgcagctgctgcc

SEQ ID NO: 2152610 - DNA, 16 bp, Homo sapiens
ccgcagctgctgccac

SEQ ID NO: 2152611 - DNA, 18 bp, Homo sapiens
ccgcagctgctgccactc

SEQ ID NO: 2152612 - DNA, 15 bp, Homo sapiens
ccgcatggcagctgg

SEQ ID NO: 2152613 - DNA, 17 bp, Homo sapiens
ccgcatggcagctgggc

SEQ ID NO: 2152614 - DNA, 15 bp, Homo sapiens
ccggattggccctgc

SEQ ID NO: 2152615 - DNA, 16 bp, Homo sapiens
ccggattggccctgcc

SEQ ID NO: 2152616 - DNA, 11 bp, Homo sapiens
ccggccctgcc

SEQ ID NO: 2152617 - DNA, 18 bp, Homo sapiens
ccggccctgcccctccct

SEQ ID NO: 2152618 - DNA, 15 bp, Homo sapiens
ccgggaagcatcctc

SEQ ID NO: 2152619 - DNA, 21 bp, Homo sapiens
ccgggaagcatcctccccacc

SEQ ID NO: 2152620 - DNA, 22 bp, Homo sapiens
ccgggaagcatcctccccacca

SEQ ID NO: 2152621 - DNA, 17 bp, Homo sapiens
ccgtgatgctcaggctt

SEQ ID NO: 2152622 - DNA, 15 bp, Homo sapiens
ccgttctgctggcct

SEQ ID NO: 2152623 - DNA, 15 bp, Homo sapiens
cctaaggacacacta

SEQ ID NO: 2152624 - DNA, 16 bp, Homo sapiens
cctaaggatctctcag

SEQ ID NO: 2152625 - DNA, 22 bp, Homo sapiens
cctaaggatctctcaggagcac

SEQ ID NO: 2152626 - DNA, 23 bp, Homo sapiens
cctaaggatctctcaggagcaca

SEQ ID NO: 2152627 - DNA, 22 bp, Homo sapiens
cctaatcaagagtctctccagc

SEQ ID NO: 2152628 - DNA, 22 bp, Homo sapiens
cctaccactgtggccccaagag

SEQ ID NO: 2152629 - DNA, 13 bp, Homo sapiens
cctaccgcatggc

SEQ ID NO: 2152630 - DNA, 15 bp, Homo sapiens
cctaccgcatggcag

SEQ ID NO: 2152631 - DNA, 16 bp, Homo sapiens
cctaccgcatggcagc

SEQ ID NO: 2152632 - DNA, 23 bp, Homo sapiens
cctaccgcatggcagctgggccc

SEQ ID NO: 2152633 - DNA, 22 bp, Homo sapiens
cctagatccaggcttctcccgg

SEQ ID NO: 2152634 - DNA, 22 bp, Homo sapiens
cctagctcttgggcctgacctc

SEQ ID NO: 2152635 - DNA, 23 bp, Homo sapiens
cctagctcttgggcctgacctcc

SEQ ID NO: 2152636 - DNA, 16 bp, Homo sapiens
cctaggattcctcccc

SEQ ID NO: 2152637 - DNA, 14 bp, Homo sapiens
cctatgtcctaagg

SEQ ID NO: 2152638 - DNA, 15 bp, Homo sapiens
cctatgtcctaagga

SEQ ID NO: 2152639 - DNA, 22 bp, Homo sapiens
cctatgtcctaaggacacacta

SEQ ID NO: 2152640 - DNA, 16 bp, Homo sapiens
cctcaatttctgaaca

SEQ ID NO: 2152641 - DNA, 14 bp, Homo sapiens
cctcacactccaga

SEQ ID NO: 2152642 - DNA, 17 bp, Homo sapiens
cctcacagactcttcca

SEQ ID NO: 2152643 - DNA, 18 bp, Homo sapiens
cctcacagactcttccac

SEQ ID NO: 2152644 - DNA, 13 bp, Homo sapiens
cctcacagatgct

SEQ ID NO: 2152645 - DNA, 17 bp, Homo sapiens
cctcacagatgctggcc

SEQ ID NO: 2152646 - DNA, 19 bp, Homo sapiens
cctcacagatgctggcctc

SEQ ID NO: 2152647 - DNA, 22 bp, Homo sapiens
cctcacagatgctggcctcttg

SEQ ID NO: 2152648 - DNA, 23 bp, Homo sapiens
cctcacagatgctggcctcttgg

SEQ ID NO: 2152649 - DNA, 15 bp, Homo sapiens
cctcacagcctctcc

SEQ ID NO: 2152650 - DNA, 17 bp, Homo sapiens
cctcacagcctctccct

SEQ ID NO: 2152651 - DNA, 19 bp, Homo sapiens
cctcacagcctctccctta

SEQ ID NO: 2152652 - DNA, 13 bp, Homo sapiens
cctcactcctgtt

SEQ ID NO: 2152653 - DNA, 17 bp, Homo sapiens
cctcaggggaagctgct

SEQ ID NO: 2152654 - DNA, 18 bp, Homo sapiens
cctcaggggaagctgcta

SEQ ID NO: 2152655 - DNA, 19 bp, Homo sapiens
cctcaggggaagctgctag

SEQ ID NO: 2152656 - DNA, 17 bp, Homo sapiens
cctcatcctcctcctca

SEQ ID NO: 2152657 - DNA, 18 bp, Homo sapiens
cctcatctgtgcctgtct

SEQ ID NO: 2152658 - DNA, 18 bp, Homo sapiens
cctcattcagaccaatct

SEQ ID NO: 2152659 - DNA, 14 bp, Homo sapiens
cctccagaccacca

SEQ ID NO: 2152660 - DNA, 18 bp, Homo sapiens
cctccagaccaccagccg

SEQ ID NO: 2152661 - DNA, 13 bp, Homo sapiens
cctccagtcctgc

SEQ ID NO: 2152662 - DNA, 17 bp, Homo sapiens
cctccagtcctgctggc

SEQ ID NO: 2152663 - DNA, 18 bp, Homo sapiens
cctccagtcctgctggcc

SEQ ID NO: 2152664 - DNA, 19 bp, Homo sapiens
cctccagtcctgctggcct

SEQ ID NO: 2152665 - DNA, 22 bp, Homo sapiens
cctccagtcctgctggcctgct

SEQ ID NO: 2152666 - DNA, 18 bp, Homo sapiens
cctcccatggccttccct

SEQ ID NO: 2152667 - DNA, 21 bp, Homo sapiens
cctcccccacgtctctctgcc

SEQ ID NO: 2152668 - DNA, 14 bp, Homo sapiens
cctcccccagagcc

SEQ ID NO: 2152669 - DNA, 17 bp, Homo sapiens
cctcccccagagccact

SEQ ID NO: 2152670 - DNA, 15 bp, Homo sapiens
cctcccctgccgcct

SEQ ID NO: 2152671 - DNA, 21 bp, Homo sapiens
cctcccgggaagcatcctccc

SEQ ID NO: 2152672 - DNA, 17 bp, Homo sapiens
cctccctagatccaggc

SEQ ID NO: 2152673 - DNA, 17 bp, Homo sapiens
cctccctctgcctcatc

SEQ ID NO: 2152674 - DNA, 19 bp, Homo sapiens
cctccctctgcctcatcct

SEQ ID NO: 2152675 - DNA, 15 bp, Homo sapiens
cctcctcacactcca

SEQ ID NO: 2152676 - DNA, 23 bp, Homo sapiens
cctcctctccatgcaagtgctgt

SEQ ID NO: 2152677 - DNA, 12 bp, Homo sapiens
cctcctgccagc

SEQ ID NO: 2152678 - DNA, 17 bp, Homo sapiens
cctcctgccctgtccct

SEQ ID NO: 2152679 - DNA, 13 bp, Homo sapiens
cctcggaggctcc

SEQ ID NO: 2152680 - DNA, 15 bp, Homo sapiens
cctcggaggctcctc

SEQ ID NO: 2152681 - DNA, 16 bp, Homo sapiens
cctcggaggctcctcc

SEQ ID NO: 2152682 - DNA, 19 bp, Homo sapiens
cctcggaggctcctccctc

SEQ ID NO: 2152683 - DNA, 22 bp, Homo sapiens
cctcggaggctcctccctctgc

SEQ ID NO: 2152684 - DNA, 23 bp, Homo sapiens
cctcggaggctcctccctctgcc

SEQ ID NO: 2152685 - DNA, 19 bp, Homo sapiens
cctcggcccatctgtccat

SEQ ID NO: 2152686 - DNA, 21 bp, Homo sapiens
cctcggcccatctgtccatcc

SEQ ID NO: 2152687 - DNA, 16 bp, Homo sapiens
cctctccaagtctctc

SEQ ID NO: 2152688 - DNA, 19 bp, Homo sapiens
cctctccatgcaagtgctg

SEQ ID NO: 2152689 - DNA, 20 bp, Homo sapiens
cctctccatgcaagtgctgt

SEQ ID NO: 2152690 - DNA, 15 bp, Homo sapiens
cctctgcctcatcct

SEQ ID NO: 2152691 - DNA, 17 bp, Homo sapiens
cctctgcctcatcctcc

SEQ ID NO: 2152692 - DNA, 20 bp, Homo sapiens
cctctgcctcatcctcctcc

SEQ ID NO: 2152693 - DNA, 23 bp, Homo sapiens
cctctgcctcatcctcctcctca

SEQ ID NO: 2152694 - DNA, 15 bp, Homo sapiens
cctcttggcacctgc

SEQ ID NO: 2152695 - DNA, 21 bp, Homo sapiens
cctcttggcacctgcctagct

SEQ ID NO: 2152696 - DNA, 14 bp, Homo sapiens
cctgaactccagag

SEQ ID NO: 2152697 - DNA, 16 bp, Homo sapiens
cctgaactccagaggt

SEQ ID NO: 2152698 - DNA, 21 bp, Homo sapiens
cctgaatggttccatgcctga

SEQ ID NO: 2152699 - DNA, 22 bp, Homo sapiens
cctgaatggttccatgcctgag

SEQ ID NO: 2152700 - DNA, 21 bp, Homo sapiens
cctgacactgagccccacctc

SEQ ID NO: 2152701 - DNA, 13 bp, Homo sapiens
cctgacctccagt

SEQ ID NO: 2152702 - DNA, 15 bp, Homo sapiens
cctgacctccagtcc

SEQ ID NO: 2152703 - DNA, 18 bp, Homo sapiens
cctgacctccagtcctgc

SEQ ID NO: 2152704 - DNA, 22 bp, Homo sapiens
cctgacctccagtcctgctggc

SEQ ID NO: 2152705 - DNA, 20 bp, Homo sapiens
cctgaggatcccctgtcccc

SEQ ID NO: 2152706 - DNA, 15 bp, Homo sapiens
cctgagtctcctgtg

SEQ ID NO: 2152707 - DNA, 18 bp, Homo sapiens
cctgcaccagcccttccc

SEQ ID NO: 2152708 - DNA, 22 bp, Homo sapiens
cctgcaccagcccttccctgct

SEQ ID NO: 2152709 - DNA, 13 bp, Homo sapiens
cctgccagctctg

SEQ ID NO: 2152710 - DNA, 16 bp, Homo sapiens
cctgccctgtccctgt

SEQ ID NO: 2152711 - DNA, 21 bp, Homo sapiens
cctgccctgtccctgtccccc

SEQ ID NO: 2152712 - DNA, 17 bp, Homo sapiens
cctgcctagctcttggg

SEQ ID NO: 2152713 - DNA, 18 bp, Homo sapiens
cctgcctagctcttgggc

SEQ ID NO: 2152714 - DNA, 12 bp, Homo sapiens
cctgctcccagc

SEQ ID NO: 2152715 - DNA, 13 bp, Homo sapiens
cctgctcccagca

SEQ ID NO: 2152716 - DNA, 21 bp, Homo sapiens
cctgctcctcctgccctgtcc

SEQ ID NO: 2152717 - DNA, 23 bp, Homo sapiens
ctcgaagaacaatgtcagaaact

SEQ ID NO: 2152718 - DNA, 15 bp, Homo sapiens
ctcggaggctcctcc

SEQ ID NO: 2152719 - DNA, 21 bp, Homo sapiens
ctcggaggctcctccctctgc

SEQ ID NO: 2152720 - DNA, 23 bp, Homo sapiens
ctcggaggctcctccctctgcct

SEQ ID NO: 2152721 - DNA, 13 bp, Homo sapiens
ctcggcccatctg

SEQ ID NO: 2152722 - DNA, 16 bp, Homo sapiens
ctcggcccatctgtcc

SEQ ID NO: 2152723 - DNA, 17 bp, Homo sapiens
ctcggcccatctgtcca

SEQ ID NO: 2152724 - DNA, 19 bp, Homo sapiens
ctcggcccatctgtccatc

SEQ ID NO: 2152725 - DNA, 21 bp, Homo sapiens
ctcggcccatctgtccatcct

SEQ ID NO: 2152726 - DNA, 24 bp, Homo sapiens
ctcggcccatctgtccatcctcct

SEQ ID NO: 2152727 - DNA, 23 bp, Homo sapiens
ctctaactccctcctcacactcc

SEQ ID NO: 2152728 - DNA, 17 bp, Homo sapiens
ctctaggggtcaggctc

SEQ ID NO: 2152729 - DNA, 13 bp, Homo sapiens
ctctcaggagcac

SEQ ID NO: 2152730 - DNA, 20 bp, Homo sapiens
ctctcaggagcacaggcagc

SEQ ID NO: 2152731 - DNA, 19 bp, Homo sapiens
ctctccaagtctctctgtg

SEQ ID NO: 2152732 - DNA, 21 bp, Homo sapiens
ctctccaagtctctctgtgaa

SEQ ID NO: 2152733 - DNA, 22 bp, Homo sapiens
ctctccagcctcacagatgctg

SEQ ID NO: 2152734 - DNA, 12 bp, Homo sapiens
ctctctgcctgc

SEQ ID NO: 2152735 - DNA, 14 bp, Homo sapiens
ctctctgcctgctg

SEQ ID NO: 2152736 - DNA, 16 bp, Homo sapiens
ctctctgcctgctggg

SEQ ID NO: 2152737 - DNA, 17 bp, Homo sapiens
ctctctgcctgctgggc

SEQ ID NO: 2152738 - DNA, 16 bp, Homo sapiens
ctctctgtgaatacaa

SEQ ID NO: 2152739 - DNA, 14 bp, Homo sapiens
ctctgagtgtctct

SEQ ID NO: 2152740 - DNA, 16 bp, Homo sapiens
ctctgagtgtctctgc

SEQ ID NO: 2152741 - DNA, 17 bp, Homo sapiens
ctctgagtgtctctgcc

SEQ ID NO: 2152742 - DNA, 20 bp, Homo sapiens
ctctgagtgtctctgcctgg

SEQ ID NO: 2152743 - DNA, 24 bp, Homo sapiens
ctctgagtgtctctgcctggagca

SEQ ID NO: 2152744 - DNA, 10 bp, Homo sapiens
ctctgcctca

SEQ ID NO: 2152745 - DNA, 20 bp, Homo sapiens
ctctgcctcatcctcctcct

SEQ ID NO: 2152746 - DNA, 21 bp, Homo sapiens
ctctgcctcatcctcctcctc

SEQ ID NO: 2152747 - DNA, 19 bp, Homo sapiens
ctctgcctctaactccctc

SEQ ID NO: 2152748 - DNA, 22 bp, Homo sapiens
ctctgcctctaactccctcctc

SEQ ID NO: 2152749 - DNA, 12 bp, Homo sapiens
ctctgcctgctg

SEQ ID NO: 2152750 - DNA, 19 bp, Homo sapiens
ctctgcctgctgggctctt

SEQ ID NO: 2152751 - DNA, 17 bp, Homo sapiens
ctctgcctggagcaggg

SEQ ID NO: 2152752 - DNA, 17 bp, Homo sapiens
ctctgctgcctgtacag

SEQ ID NO: 2152753 - DNA, 16 bp, Homo sapiens
ctctgcttcagtccac

SEQ ID NO: 2152754 - DNA, 14 bp, Homo sapiens
ctctgtgaatacaa

SEQ ID NO: 2152755 - DNA, 21 bp, Homo sapiens
ctctgtgaatacaattaaagg

SEQ ID NO: 2152756 - DNA, 22 bp, Homo sapiens
ctctgtgaatacaattaaaggt

SEQ ID NO: 2152757 - DNA, 15 bp, Homo sapiens
ctcttccaccagagc

SEQ ID NO: 2152758 - DNA, 12 bp, Homo sapiens
ctcttcctaccc

SEQ ID NO: 2152759 - DNA, 15 bp, Homo sapiens
ctcttcctacccaac

SEQ ID NO: 2152760 - DNA, 19 bp, Homo sapiens
ctcttcctacccaaccact

SEQ ID NO: 2152761 - DNA, 22 bp, Homo sapiens
ctgaacaccataggtagaatgt

SEQ ID NO: 2152762 - DNA, 13 bp, Homo sapiens
ctgaacagtgctc

SEQ ID NO: 2152763 - DNA, 14 bp, Homo sapiens
ctgaacagtgctct

SEQ ID NO: 2152764 - DNA, 17 bp, Homo sapiens
ctgaacagtgctctgcc

SEQ ID NO: 2152765 - DNA, 18 bp, Homo sapiens
ctgaatggttccatgcct

SEQ ID NO: 2152766 - DNA, 13 bp, Homo sapiens
ctgacagaaatgc

SEQ ID NO: 2152767 - DNA, 15 bp, Homo sapiens
ctgacattctgattc

SEQ ID NO: 2152768 - DNA, 21 bp, Homo sapiens
ctgacctccagtcctgctggc

SEQ ID NO: 2152769 - DNA, 22 bp, Homo sapiens
ctgagaccagttgggagcactg

SEQ ID NO: 2152770 - DNA, 23 bp, Homo sapiens
ctgagccccacctctccaagtct

SEQ ID NO: 2152771 - DNA, 18 bp, Homo sapiens
ctgaggatcccctgtccc

SEQ ID NO: 2152772 - DNA, 20 bp, Homo sapiens
ctgaggatcccctgtcccct

SEQ ID NO: 2152773 - DNA, 18 bp, Homo sapiens
ctgaggccccaggcccta

SEQ ID NO: 2152774 - DNA, 13 bp, Homo sapiens
ctgaggcctccct

SEQ ID NO: 2152775 - DNA, 17 bp, Homo sapiens
ctgaggcctcccttgag

SEQ ID NO: 2152776 - DNA, 18 bp, Homo sapiens
ctgagggcatctctgagt

SEQ ID NO: 2152777 - DNA, 14 bp, Homo sapiens
ctgagggccacact

SEQ ID NO: 2152778 - DNA, 16 bp, Homo sapiens
ctgagtcaagttgttc

SEQ ID NO: 2152779 - DNA, 13 bp, Homo sapiens
ctgagtctcctgt

SEQ ID NO: 2152780 - DNA, 14 bp, Homo sapiens
ctgagtgtctctgc

SEQ ID NO: 2152781 - DNA, 16 bp, Homo sapiens
ctgagtgtctctgcct

SEQ ID NO: 2152782 - DNA, 18 bp, Homo sapiens
ctgagtgtctctgcctgg

SEQ ID NO: 2152783 - DNA, 17 bp, Homo sapiens
ctgattcacatctcatt

SEQ ID NO: 2152784 - DNA, 17 bp, Homo sapiens
ctgattcgaatgacact

SEQ ID NO: 2152785 - DNA, 17 bp, Homo sapiens
ctgcaacggcttagact

SEQ ID NO: 2152786 - DNA, 20 bp, Homo sapiens
ctgcaccagcccttccctgc

SEQ ID NO: 2152787 - DNA, 21 bp, Homo sapiens
ctgcatggagtgagcagtaga

SEQ ID NO: 2152788 - DNA, 22 bp, Homo sapiens
ctgccacccaggcaggccctgc

SEQ ID NO: 2152789 - DNA, 12 bp, Homo sapiens
ctgccagctctg

SEQ ID NO: 2152790 - DNA, 21 bp, Homo sapiens
ctgccagctctgtcaccctgg

SEQ ID NO: 2152791 - DNA, 13 bp, Homo sapiens
ctgcccctccccc

SEQ ID NO: 2152792 - DNA, 14 bp, Homo sapiens
ctgcccctccccct

SEQ ID NO: 2152793 - DNA, 18 bp, Homo sapiens
ctgcccctccccctaccg

SEQ ID NO: 2152794 - DNA, 14 bp, Homo sapiens
ctgcccctccctag

SEQ ID NO: 2152795 - DNA, 19 bp, Homo sapiens
ctgcccctccctagatcca

SEQ ID NO: 2152796 - DNA, 22 bp, Homo sapiens
ctgcccctccctagatccaggc

SEQ ID NO: 2152797 - DNA, 15 bp, Homo sapiens
ctgccctgtccctgt

SEQ ID NO: 2152798 - DNA, 14 bp, Homo sapiens
ctgccgcctcccgg

SEQ ID NO: 2152799 - DNA, 19 bp, Homo sapiens
ctgccgggttctagtctcc

SEQ ID NO: 2152800 - DNA, 20 bp, Homo sapiens
ctgccgggttctagtctcct

SEQ ID NO: 2152801 - DNA, 20 bp, Homo sapiens
ctgcctagctcttgggcctg

SEQ ID NO: 2152802 - DNA, 15 bp, Homo sapiens
ctgcctcatcctcct

SEQ ID NO: 2152803 - DNA, 16 bp, Homo sapiens
ctgcctccccaatcca

SEQ ID NO: 2152804 - DNA, 17 bp, Homo sapiens
ctgcctctaactccctc

SEQ ID NO: 2152805 - DNA, 23 bp, Homo sapiens
ctgcctctaactccctcctcaca

SEQ ID NO: 2152806 - DNA, 12 bp, Homo sapiens
ctgcctggagca

SEQ ID NO: 2152807 - DNA, 18 bp, Homo sapiens
ctgcctggagcaggggtg

SEQ ID NO: 2152808 - DNA, 13 bp, Homo sapiens
ctgcgggctgagg

SEQ ID NO: 2152809 - DNA, 14 bp, Homo sapiens
ctgcgggctgaggg

SEQ ID NO: 2152810 - DNA, 21 bp, Homo sapiens
ctgctaggggaaggactggcc

SEQ ID NO: 2152811 - DNA, 21 bp, Homo sapiens
ctgctcccagcagccctaagg

SEQ ID NO: 2152812 - DNA, 22 bp, Homo sapiens
ctgctcccagcagccctaagga

SEQ ID NO: 2152813 - DNA, 16 bp, Homo sapiens
ctgctcgaagaacaat

SEQ ID NO: 2152814 - DNA, 17 bp, Homo sapiens
ctgctcgaagaacaatg

SEQ ID NO: 2152815 - DNA, 18 bp, Homo sapiens
ctgctcttacttccccca

SEQ ID NO: 2152816 - DNA, 21 bp, Homo sapiens
ctgctcttacttcccccaccc

SEQ ID NO: 2152817 - DNA, 18 bp, Homo sapiens
ctgctgccactctgctgc

SEQ ID NO: 2152818 - DNA, 13 bp, Homo sapiens
ctgctggcctgga

SEQ ID NO: 2152819 - DNA, 15 bp, Homo sapiens
ctgctggcctggatc

SEQ ID NO: 2152820 - DNA, 16 bp, Homo sapiens
ctgctggcctggatct

SEQ ID NO: 2152821 - DNA, 13 bp, Homo sapiens
ctgctgtggagcc

SEQ ID NO: 2152822 - DNA, 15 bp, Homo sapiens
ctgctgtggagccca

SEQ ID NO: 2152823 - DNA, 19 bp, Homo sapiens
ctggaacttgaactgattc

SEQ ID NO: 2152824 - DNA, 20 bp, Homo sapiens
ctggaacttgaactgattca

SEQ ID NO: 2152825 - DNA, 15 bp, Homo sapiens
ctggacaagccaact

SEQ ID NO: 2152826 - DNA, 14 bp, Homo sapiens
ctggacagcttgtg

SEQ ID NO: 2152827 - DNA, 14 bp, Homo sapiens
gctcctccctctgc

SEQ ID NO: 2152828 - DNA, 23 bp, Homo sapiens
gctcctccctctgcctcatcctc

SEQ ID NO: 2152829 - DNA, 14 bp, Homo sapiens
gctcctcctgccct

SEQ ID NO: 2152830 - DNA, 20 bp, Homo sapiens
gctcctcctgccctgtccct

SEQ ID NO: 2152831 - DNA, 16 bp, Homo sapiens
gctcttaactgttgct

SEQ ID NO: 2152832 - DNA, 21 bp, Homo sapiens
gctcttacttcccccaccctg

SEQ ID NO: 2152833 - DNA, 12 bp, Homo sapiens
gctcttgggcct

SEQ ID NO: 2152834 - DNA, 17 bp, Homo sapiens
gctgaacagtgctctgc

SEQ ID NO: 2152835 - DNA, 18 bp, Homo sapiens
gctgaacagtgctctgcc

SEQ ID NO: 2152836 - DNA, 19 bp, Homo sapiens
gctgaacagtgctctgcct

SEQ ID NO: 2152837 - DNA, 21 bp, Homo sapiens
gctgaacagtgctctgcctct

SEQ ID NO: 2152838 - DNA, 13 bp, Homo sapiens
gctgaggcctccc

SEQ ID NO: 2152839 - DNA, 20 bp, Homo sapiens
gctgagggcatctctgagtg

SEQ ID NO: 2152840 - DNA, 13 bp, Homo sapiens
gctgatttctagg

SEQ ID NO: 2152841 - DNA, 13 bp, Homo sapiens
gctgccactctgc

SEQ ID NO: 2152842 - DNA, 15 bp, Homo sapiens
gctgcctccccaatc

SEQ ID NO: 2152843 - DNA, 17 bp, Homo sapiens
gctgcctccccaatcca

SEQ ID NO: 2152844 - DNA, 21 bp, Homo sapiens
gctgcctgacactgagcccca

SEQ ID NO: 2152845 - DNA, 21 bp, Homo sapiens
gctgcgggctgagggcatctc

SEQ ID NO: 2152846 - DNA, 18 bp, Homo sapiens
gctgctaggggaaggact

SEQ ID NO: 2152847 - DNA, 12 bp, Homo sapiens
gctgctgccact

SEQ ID NO: 2152848 - DNA, 17 bp, Homo sapiens
gctgctgccactctgct

SEQ ID NO: 2152849 - DNA, 18 bp, Homo sapiens
gctggcctcttggcacct

SEQ ID NO: 2152850 - DNA, 19 bp, Homo sapiens
gctggcctcttggcacctg

SEQ ID NO: 2152851 - DNA, 12 bp, Homo sapiens
gctggcctgctc

SEQ ID NO: 2152852 - DNA, 14 bp, Homo sapiens
gctgggcccacagc

SEQ ID NO: 2152853 - DNA, 21 bp, Homo sapiens
gctgggcccacagcccccacc

SEQ ID NO: 2152854 - DNA, 16 bp, Homo sapiens
gctgggggagggactg

SEQ ID NO: 2152855 - DNA, 18 bp, Homo sapiens
gctgggggagggactgct

SEQ ID NO: 2152856 - DNA, 13 bp, Homo sapiens
gctgggggctccc

SEQ ID NO: 2152857 - DNA, 17 bp, Homo sapiens
gctgggtcggccctgcc

SEQ ID NO: 2152858 - DNA, 20 bp, Homo sapiens
gctggtgaggccggccctgc

SEQ ID NO: 2152859 - DNA, 22 bp, Homo sapiens
gctggtgaggccggccctgccc

SEQ ID NO: 2152860 - DNA, 16 bp, Homo sapiens
gctggtggattgggca

SEQ ID NO: 2152861 - DNA, 18 bp, Homo sapiens
gctggtggattgggcaga

SEQ ID NO: 2152862 - DNA, 17 bp, Homo sapiens
gctgtggagcccattgt

SEQ ID NO: 2152863 - DNA, 21 bp, Homo sapiens
gcttagacttcgactcaggat

SEQ ID NO: 2152864 - DNA, 20 bp, Homo sapiens
gcttctatcccaggaggtgg

SEQ ID NO: 2152865 - DNA, 17 bp, Homo sapiens
gcttctcccggacctgg

SEQ ID NO: 2152866 - DNA, 18 bp, Homo sapiens
gcttctcccggacctgga

SEQ ID NO: 2152867 - DNA, 18 bp, Homo sapiens
gctttgaggacaaagaga

SEQ ID NO: 2152868 - DNA, 13 bp, Homo sapiens
ggaacctttccct

SEQ ID NO: 2152869 - DNA, 14 bp, Homo sapiens
ggaacttgaactga

SEQ ID NO: 2152870 - DNA, 18 bp, Homo sapiens
ggaacttgaactgattca

SEQ ID NO: 2152871 - DNA, 15 bp, Homo sapiens
ggaagcatcctcccc

SEQ ID NO: 2152872 - DNA, 17 bp, Homo sapiens
ggaagcatcctccccac

SEQ ID NO: 2152873 - DNA, 18 bp, Homo sapiens
ggaagcatcctccccacc

SEQ ID NO: 2152874 - DNA, 13 bp, Homo sapiens
ggaagggagggag

SEQ ID NO: 2152875 - DNA, 19 bp, Homo sapiens
ggaagggagggagctgagg

SEQ ID NO: 2152876 - DNA, 21 bp, Homo sapiens
ggaagggccagtctgggctgc

SEQ ID NO: 2152877 - DNA, 16 bp, Homo sapiens
ggaatgcacctcccca

SEQ ID NO: 2152878 - DNA, 12 bp, Homo sapiens
ggacagcttgtg

SEQ ID NO: 2152879 - DNA, 22 bp, Homo sapiens
ggacagcttgtggcaagtgaat

SEQ ID NO: 2152880 - DNA, 15 bp, Homo sapiens
ggaccactgggcccc

SEQ ID NO: 2152881 - DNA, 20 bp, Homo sapiens
ggaccactgggcccctcagg

SEQ ID NO: 2152882 - DNA, 21 bp, Homo sapiens
ggacctatgtcctaaggacac

SEQ ID NO: 2152883 - DNA, 13 bp, Homo sapiens
ggagaaggcctcc

SEQ ID NO: 2152884 - DNA, 14 bp, Homo sapiens
ggagaaggcctccc

SEQ ID NO: 2152885 - DNA, 16 bp, Homo sapiens
ggagaaggcctcccct

SEQ ID NO: 2152886 - DNA, 12 bp, Homo sapiens
ggagactcctgc

SEQ ID NO: 2152887 - DNA, 17 bp, Homo sapiens
ggagactcctgccctgt

SEQ ID NO: 2152888 - DNA, 18 bp, Homo sapiens
ggagcactggagtgcagg

SEQ ID NO: 2152889 - DNA, 17 bp, Homo sapiens
ggagctgaggcctccct

SEQ ID NO: 2152890 - DNA, 14 bp, Homo sapiens
ggaggctcctccct

SEQ ID NO: 2152891 - DNA, 15 bp, Homo sapiens
ggaggctcctccctc

SEQ ID NO: 2152892 - DNA, 16 bp, Homo sapiens
ggaggctcctccctct

SEQ ID NO: 2152893 - DNA, 16 bp, Homo sapiens
ggagggagctgaggcc

SEQ ID NO: 2152894 - DNA, 15 bp, Homo sapiens
ggagggatcagcccc

SEQ ID NO: 2152895 - DNA, 15 bp, Homo sapiens
ggagtcaccatgcaa

SEQ ID NO: 2152896 - DNA, 15 bp, Homo sapiens
ggatcccctgtcccc

SEQ ID NO: 2152897 - DNA, 20 bp, Homo sapiens
ggatcccctgtcccctgggg

SEQ ID NO: 2152898 - DNA, 21 bp, Homo sapiens
ggatcccctgtcccctggggc

SEQ ID NO: 2152899 - DNA, 23 bp, Homo sapiens
ggatcccctgtcccctggggctg

SEQ ID NO: 2152900 - DNA, 14 bp, Homo sapiens
ggatctccccactc

SEQ ID NO: 2152901 - DNA, 13 bp, Homo sapiens
ggatctctcagga

SEQ ID NO: 2152902 - DNA, 16 bp, Homo sapiens
ggatctctcaggagca

SEQ ID NO: 2152903 - DNA, 21 bp, Homo sapiens
ggatctctcaggagcacaggc

SEQ ID NO: 2152904 - DNA, 18 bp, Homo sapiens
ggatgtggagctcctgct

SEQ ID NO: 2152905 - DNA, 16 bp, Homo sapiens
ggattggccctgcccc

SEQ ID NO: 2152906 - DNA, 19 bp, Homo sapiens
ggattggccctgcccctcc

SEQ ID NO: 2152907 - DNA, 22 bp, Homo sapiens
ggattggccctgcccctccccc

SEQ ID NO: 2152908 - DNA, 22 bp, Homo sapiens
ggattgtgcaatagtcagagtg

SEQ ID NO: 2152909 - DNA, 14 bp, Homo sapiens
ggatttgccccttc

SEQ ID NO: 2152910 - DNA, 23 bp, Homo sapiens
ggcaaagaactgccccatctcct

SEQ ID NO: 2152911 - DNA, 22 bp, Homo sapiens
ggcacatggctgggggagggac

SEQ ID NO: 2152912 - DNA, 23 bp, Homo sapiens
ggcaccactagggtcctggccct

SEQ ID NO: 2152913 - DNA, 19 bp, Homo sapiens
ggcagaatcctgggccccc

SEQ ID NO: 2152914 - DNA, 20 bp, Homo sapiens
ggcagcgcctgtcccctcac

SEQ ID NO: 2152915 - DNA, 23 bp, Homo sapiens
ggcagctgaggacacaccccaca

SEQ ID NO: 2152916 - DNA, 14 bp, Homo sapiens
ggcagctgggccca

SEQ ID NO: 2152917 - DNA, 15 bp, Homo sapiens
ggcagctgggcccac

SEQ ID NO: 2152918 - DNA, 18 bp, Homo sapiens
ggcagctgggcccacagc

SEQ ID NO: 2152919 - DNA, 14 bp, Homo sapiens
ggcaggagtcacca

SEQ ID NO: 2152920 - DNA, 18 bp, Homo sapiens
ggccagcaggcagcgcct

SEQ ID NO: 2152921 - DNA, 15 bp, Homo sapiens
ggccatgggtcctcg

SEQ ID NO: 2152922 - DNA, 19 bp, Homo sapiens
ggcccacagcccccacccc

SEQ ID NO: 2152923 - DNA, 22 bp, Homo sapiens
ggcccacagcccccaccccagc

SEQ ID NO: 2152924 - DNA, 13 bp, Homo sapiens
ggccccaggccct

SEQ ID NO: 2152925 - DNA, 19 bp, Homo sapiens
ggccctcttcttattcatg

SEQ ID NO: 2152926 - DNA, 15 bp, Homo sapiens
ggccctgcccctccc

SEQ ID NO: 2152927 - DNA, 21 bp, Homo sapiens
ggccctgcccctccccctacc

SEQ ID NO: 2152928 - DNA, 16 bp, Homo sapiens
ggccctgcccctccct

SEQ ID NO: 2152929 - DNA, 17 bp, Homo sapiens
ggccggccctgcccctc

SEQ ID NO: 2152930 - DNA, 13 bp, Homo sapiens
ggcctcccctgag

SEQ ID NO: 2152931 - DNA, 15 bp, Homo sapiens
ggcctcccctgagga

SEQ ID NO: 2152932 - DNA, 17 bp, Homo sapiens
ggcctcggaggctcctc

SEQ ID NO: 2152933 - DNA, 19 bp, Homo sapiens
ggcctcggaggctcctccc

SEQ ID NO: 2152934 - DNA, 18 bp, Homo sapiens
ggcctctggttgcctccc

SEQ ID NO: 2152935 - DNA, 13 bp, Homo sapiens
ggcctcttggcac

SEQ ID NO: 2152936 - DNA, 18 bp, Homo sapiens
ggcctcttggcacctgcc

SEQ ID NO: 2152937 - DNA, 21 bp, Homo sapiens
gtatatattctacacatatat

SEQ ID NO: 2152938 - DNA, 18 bp, Homo sapiens
gtatatctggacaagcca

SEQ ID NO: 2152939 - DNA, 21 bp, Homo sapiens
gtatatctggacaagccaact

SEQ ID NO: 2152940 - DNA, 16 bp, Homo sapiens
gtatatgtatatctat

SEQ ID NO: 2152941 - DNA, 18 bp, Homo sapiens
gtatatgtatatctatat

SEQ ID NO: 2152942 - DNA, 18 bp, Homo sapiens
gtatgccttcctgtttaa

SEQ ID NO: 2152943 - DNA, 18 bp, Homo sapiens
gtcaatattaaatacaga

SEQ ID NO: 2152944 - DNA, 11 bp, Homo sapiens
gtcacaataaa

SEQ ID NO: 2152945 - DNA, 13 bp, Homo sapiens
gtcacaataaagt

SEQ ID NO: 2152946 - DNA, 13 bp, Homo sapiens
gtcaccatgcaag

SEQ ID NO: 2152947 - DNA, 14 bp, Homo sapiens
gtcaccatgcaagg

SEQ ID NO: 2152948 - DNA, 15 bp, Homo sapiens
gtcaccatgcaaggg

SEQ ID NO: 2152949 - DNA, 15 bp, Homo sapiens
gtcaccctggccacc

SEQ ID NO: 2152950 - DNA, 18 bp, Homo sapiens
gtcaccctggccaccacc

SEQ ID NO: 2152951 - DNA, 13 bp, Homo sapiens
gtcacttgccaca

SEQ ID NO: 2152952 - DNA, 19 bp, Homo sapiens
gtcagaacagcagactcag

SEQ ID NO: 2152953 - DNA, 20 bp, Homo sapiens
gtcagccgagccgggcctgg

SEQ ID NO: 2152954 - DNA, 14 bp, Homo sapiens
gtcatggtactacc

SEQ ID NO: 2152955 - DNA, 19 bp, Homo sapiens
gtccagaagaatattcagg

SEQ ID NO: 2152956 - DNA, 11 bp, Homo sapiens
gtccataaagt

SEQ ID NO: 2152957 - DNA, 13 bp, Homo sapiens
gtccatcctcctc

SEQ ID NO: 2152958 - DNA, 23 bp, Homo sapiens
gtccatcctcctctccatgcaag

SEQ ID NO: 2152959 - DNA, 20 bp, Homo sapiens
gtccccctcccctcccagtc

SEQ ID NO: 2152960 - DNA, 12 bp, Homo sapiens
gtcccctggggc

SEQ ID NO: 2152961 - DNA, 13 bp, Homo sapiens
gtcccctggggct

SEQ ID NO: 2152962 - DNA, 16 bp, Homo sapiens
gtcccctggggctggt

SEQ ID NO: 2152963 - DNA, 17 bp, Homo sapiens
gtcccctggggctggtg

SEQ ID NO: 2152964 - DNA, 18 bp, Homo sapiens
gtcctcacagcctctccc

SEQ ID NO: 2152965 - DNA, 14 bp, Homo sapiens
gtcctcggcccatc

SEQ ID NO: 2152966 - DNA, 16 bp, Homo sapiens
gtcctgctggcctgct

SEQ ID NO: 2152967 - DNA, 15 bp, Homo sapiens
gtccttactcagagc

SEQ ID NO: 2152968 - DNA, 17 bp, Homo sapiens
gtccttactcagagctg

SEQ ID NO: 2152969 - DNA, 22 bp, Homo sapiens
gtccttactcagagctgcgggc

SEQ ID NO: 2152970 - DNA, 19 bp, Homo sapiens
gtccttgcctgaactccag

SEQ ID NO: 2152971 - DNA, 12 bp, Homo sapiens
gtcgagacactt

SEQ ID NO: 2152972 - DNA, 22 bp, Homo sapiens
gtctatcaaccccagacactgg

SEQ ID NO: 2152973 - DNA, 23 bp, Homo sapiens
gtctatcaaccccagacactggt

SEQ ID NO: 2152974 - DNA, 12 bp, Homo sapiens
gtctcacactcc

SEQ ID NO: 2152975 - DNA, 17 bp, Homo sapiens
gtctcacactcctcctg

SEQ ID NO: 2152976 - DNA, 18 bp, Homo sapiens
gtctcacactcctcctgc

SEQ ID NO: 2152977 - DNA, 20 bp, Homo sapiens
gtctcacactcctcctgcca

SEQ ID NO: 2152978 - DNA, 23 bp, Homo sapiens
gtctcacactcctcctgccagct

SEQ ID NO: 2152979 - DNA, 21 bp, Homo sapiens
gtctcctgtgcccacatccca

SEQ ID NO: 2152980 - DNA, 22 bp, Homo sapiens
gtctcctttgcactgagggcca

SEQ ID NO: 2152981 - DNA, 13 bp, Homo sapiens
gtctctccagcct

SEQ ID NO: 2152982 - DNA, 14 bp, Homo sapiens
gtctctccagcctc

SEQ ID NO: 2152983 - DNA, 16 bp, Homo sapiens
gtctctccagcctcac

SEQ ID NO: 2152984 - DNA, 19 bp, Homo sapiens
gtctctccagcctcacaga

SEQ ID NO: 2152985 - DNA, 24 bp, Homo sapiens
gtctctccagcctcacagatgctg

SEQ ID NO: 2152986 - DNA, 15 bp, Homo sapiens
gtctctctgcctgct

SEQ ID NO: 2152987 - DNA, 16 bp, Homo sapiens
gtctctctgcctgctg

SEQ ID NO: 2152988 - DNA, 17 bp, Homo sapiens
gtctctctgcctgctgg

SEQ ID NO: 2152989 - DNA, 21 bp, Homo sapiens
gtctctctgcctgctgggctc

SEQ ID NO: 2152990 - DNA, 11 bp, Homo sapiens
gtctctctgtg

SEQ ID NO: 2152991 - DNA, 14 bp, Homo sapiens
gtctctctgtgaat

SEQ ID NO: 2152992 - DNA, 21 bp, Homo sapiens
gtctctggctcagctgtggtc

SEQ ID NO: 2152993 - DNA, 16 bp, Homo sapiens
gtctgtccaacccctc

SEQ ID NO: 2152994 - DNA, 18 bp, Homo sapiens
gtctgtccaacccctccc

SEQ ID NO: 2152995 - DNA, 18 bp, Homo sapiens
gtcttataggtttccact

SEQ ID NO: 2152996 - DNA, 22 bp, Homo sapiens
gtgaaattcaacctgtgtctta

SEQ ID NO: 2152997 - DNA, 15 bp, Homo sapiens
gtgaatacaattaaa

SEQ ID NO: 2152998 - DNA, 17 bp, Homo sapiens
gtgaccaaaagttacat

SEQ ID NO: 2152999 - DNA, 16 bp, Homo sapiens
gtgaggccggccctgc

SEQ ID NO: 2153000 - DNA, 23 bp, Homo sapiens
gtgaggccggccctgcccctccc

SEQ ID NO: 2153001 - DNA, 22 bp, Homo sapiens
gtgccagccgtgatgctcaggc

SEQ ID NO: 2153002 - DNA, 14 bp, Homo sapiens
gtgcctggcaaggc

SEQ ID NO: 2153003 - DNA, 14 bp, Homo sapiens
gtgcctgtctgtcc

SEQ ID NO: 2153004 - DNA, 13 bp, Homo sapiens
gtgctctgcctct

SEQ ID NO: 2153005 - DNA, 23 bp, Homo sapiens
gtggaactacattagtacacagc

SEQ ID NO: 2153006 - DNA, 23 bp, Homo sapiens
gtggactgaaccgacttttctaa

SEQ ID NO: 2153007 - DNA, 22 bp, Homo sapiens
gtggattgggcagaatcctggg

SEQ ID NO: 2153008 - DNA, 19 bp, Homo sapiens
gtggctttaggagcagtgg

SEQ ID NO: 2153009 - DNA, 15 bp, Homo sapiens
gtgggagggtaccag

SEQ ID NO: 2153010 - DNA, 20 bp, Homo sapiens
gtgggagggtaccagcagaa

SEQ ID NO: 2153011 - DNA, 21 bp, Homo sapiens
gtgggggggagaaggcctccc

SEQ ID NO: 2153012 - DNA, 16 bp, Homo sapiens
gtggtcccacccagga

SEQ ID NO: 2153013 - DNA, 17 bp, Homo sapiens
gtgtaccacaccctgcc

SEQ ID NO: 2153014 - DNA, 21 bp, Homo sapiens
gtgtaccacaccctgcctgct

SEQ ID NO: 2153015 - DNA, 17 bp, Homo sapiens
gtgtctcccaacatggg

SEQ ID NO: 2153016 - DNA, 20 bp, Homo sapiens
gtgtctctgcctggagcagg

SEQ ID NO: 2153017 - DNA, 23 bp, Homo sapiens
gtgtctctgcctggagcaggggt

SEQ ID NO: 2153018 - DNA, 16 bp, Homo sapiens
gtgtgtaccacaccct

SEQ ID NO: 2153019 - DNA, 17 bp, Homo sapiens
gtgtgtaccacaccctg

SEQ ID NO: 2153020 - DNA, 16 bp, Homo sapiens
gtgttactaaagtcac

SEQ ID NO: 2153021 - DNA, 17 bp, Homo sapiens
gttaagacttgacagtg

SEQ ID NO: 2153022 - DNA, 16 bp, Homo sapiens
gttatagtatatctgg

SEQ ID NO: 2153023 - DNA, 15 bp, Homo sapiens
gttatctaagttaat

SEQ ID NO: 2153024 - DNA, 14 bp, Homo sapiens
gttccatgcctgag

SEQ ID NO: 2153025 - DNA, 16 bp, Homo sapiens
gttctgctggcctgga

SEQ ID NO: 2153026 - DNA, 13 bp, Homo sapiens
gttgcaaccactg

SEQ ID NO: 2153027 - DNA, 22 bp, Homo sapiens
gttgcagatctttttgtgaaat

SEQ ID NO: 2153028 - DNA, 21 bp, Homo sapiens
gttgcctcccccgcctccagt

SEQ ID NO: 2153029 - DNA, 23 bp, Homo sapiens
gttgtcaatattaaatacagaca

SEQ ID NO: 2153030 - DNA, 19 bp, Homo sapiens
gtttaaaaaaagtatatat

SEQ ID NO: 2153031 - DNA, 21 bp, Homo sapiens
gtttccaaagggcagtaaagt

SEQ ID NO: 2153032 - DNA, 20 bp, Homo sapiens
gtttctaaccaaagagtctc

SEQ ID NO: 2153033 - DNA, 23 bp, Homo sapiens
gtttgcacagagggcgctcctgt

SEQ ID NO: 2153034 - DNA, 20 bp, Homo sapiens
gtttggatgggagtgagaca

SEQ ID NO: 2153035 - DNA, 23 bp, Homo sapiens
gtttgtgcctttttatttttgtt

SEQ ID NO: 2153036 - DNA, 14 bp, Homo sapiens
taaaaaaagtatat

SEQ ID NO: 2153037 - DNA, 19 bp, Homo sapiens
taaaaatgatttcagtagc

SEQ ID NO: 2153038 - DNA, 17 bp, Homo sapiens
taaaatttatattgtaa

SEQ ID NO: 2153039 - DNA, 15 bp, Homo sapiens
taaagtgtagcaccc

SEQ ID NO: 2153040 - DNA, 14 bp, Homo sapiens
taaatacagacact

SEQ ID NO: 2153041 - DNA, 20 bp, Homo sapiens
taaccaaagagtctctggct

SEQ ID NO: 2153042 - DNA, 15 bp, Homo sapiens
taacggctccaggat

SEQ ID NO: 2153043 - DNA, 18 bp, Homo sapiens
taacggctccaggatttt

SEQ ID NO: 2153044 - DNA, 13 bp, Homo sapiens
taactcccactcc

SEQ ID NO: 2153045 - DNA, 14 bp, Homo sapiens
taactccctcctca

SEQ ID NO: 2153046 - DNA, 21 bp, Homo sapiens
taactccctcctcacactcca

SEQ ID NO: 2153047 - DNA, 19 bp, Homo sapiens
tgggcaggagtcaccatgc

SEQ ID NO: 2153048 - DNA, 22 bp, Homo sapiens
tgggcaggagtcaccatgcaag

SEQ ID NO: 2153049 - DNA, 16 bp, Homo sapiens
tgggccatgggtcctc

SEQ ID NO: 2153050 - DNA, 21 bp, Homo sapiens
tgggccatgggtcctcggccc

SEQ ID NO: 2153051 - DNA, 19 bp, Homo sapiens
tgggcccacagcccccacc

SEQ ID NO: 2153052 - DNA, 13 bp, Homo sapiens
tgggcccctcagg

SEQ ID NO: 2153053 - DNA, 14 bp, Homo sapiens
tgggcccctcaggg

SEQ ID NO: 2153054 - DNA, 23 bp, Homo sapiens
tgggcccctcaggggaagctgct

SEQ ID NO: 2153055 - DNA, 21 bp, Homo sapiens
tgggcctgacctccagtcctg

SEQ ID NO: 2153056 - DNA, 14 bp, Homo sapiens
tgggggctcccctt

SEQ ID NO: 2153057 - DNA, 22 bp, Homo sapiens
tgggggctccccttgcccttcc

SEQ ID NO: 2153058 - DNA, 21 bp, Homo sapiens
tgggggggagaaggcctcccc

SEQ ID NO: 2153059 - DNA, 15 bp, Homo sapiens
tgggtcctcggccca

SEQ ID NO: 2153060 - DNA, 16 bp, Homo sapiens
tgggtcggccctgccc

SEQ ID NO: 2153061 - DNA, 17 bp, Homo sapiens
tgggtcggccctgccca

SEQ ID NO: 2153062 - DNA, 18 bp, Homo sapiens
tgggtcggccctgcccaa

SEQ ID NO: 2153063 - DNA, 15 bp, Homo sapiens
tgggtttggcccctg

SEQ ID NO: 2153064 - DNA, 20 bp, Homo sapiens
tgggtttggcccctggaacc

SEQ ID NO: 2153065 - DNA, 18 bp, Homo sapiens
tggtaaaaagattatata

SEQ ID NO: 2153066 - DNA, 19 bp, Homo sapiens
tggtcccacccaggaaggg

SEQ ID NO: 2153067 - DNA, 16 bp, Homo sapiens
tggtgaggccggccct

SEQ ID NO: 2153068 - DNA, 13 bp, Homo sapiens
tggttccatgcct

SEQ ID NO: 2153069 - DNA, 19 bp, Homo sapiens
tggttccatgcctgagggt

SEQ ID NO: 2153070 - DNA, 15 bp, Homo sapiens
tggttgggggaatgc

SEQ ID NO: 2153071 - DNA, 15 bp, Homo sapiens
tggttgtcaatatta

SEQ ID NO: 2153072 - DNA, 13 bp, Homo sapiens
tgtaaagcttgtc

SEQ ID NO: 2153073 - DNA, 18 bp, Homo sapiens
tgtacagaagaaactgaa

SEQ ID NO: 2153074 - DNA, 17 bp, Homo sapiens
tgtacagttatctaagt

SEQ ID NO: 2153075 - DNA, 21 bp, Homo sapiens
tgtacagttatctaagttaat

SEQ ID NO: 2153076 - DNA, 16 bp, Homo sapiens
tgtaccacaccctgcc

SEQ ID NO: 2153077 - DNA, 17 bp, Homo sapiens
tgtaccacaccctgcct

SEQ ID NO: 2153078 - DNA, 21 bp, Homo sapiens
tgtaccacaccctgcctgctg

SEQ ID NO: 2153079 - DNA, 15 bp, Homo sapiens
tgtagggctggacct

SEQ ID NO: 2153080 - DNA, 20 bp, Homo sapiens
tgtatagatgcaagatattt

SEQ ID NO: 2153081 - DNA, 13 bp, Homo sapiens
tgtatatagtttg

SEQ ID NO: 2153082 - DNA, 19 bp, Homo sapiens
tgtatatctatatctctaa

SEQ ID NO: 2153083 - DNA, 13 bp, Homo sapiens
tgtcaaacaaata

SEQ ID NO: 2153084 - DNA, 18 bp, Homo sapiens
tgtcaatattaaatacag

SEQ ID NO: 2153085 - DNA, 19 bp, Homo sapiens
tgtcaatattaaatacaga

SEQ ID NO: 2153086 - DNA, 16 bp, Homo sapiens
tgtcacaataaagttt

SEQ ID NO: 2153087 - DNA, 14 bp, Homo sapiens
tgtcaccctggcca

SEQ ID NO: 2153088 - DNA, 15 bp, Homo sapiens
tgtcaccctggccac

SEQ ID NO: 2153089 - DNA, 14 bp, Homo sapiens
tgtcacttgccaca

SEQ ID NO: 2153090 - DNA, 19 bp, Homo sapiens
tgtcacttgccacatggtg

SEQ ID NO: 2153091 - DNA, 21 bp, Homo sapiens
tgtcagccgagccgggcctgg

SEQ ID NO: 2153092 - DNA, 15 bp, Homo sapiens
tgtccaacccctccc

SEQ ID NO: 2153093 - DNA, 14 bp, Homo sapiens
tgtccagtttccaa

SEQ ID NO: 2153094 - DNA, 13 bp, Homo sapiens
tgtccataaagta

SEQ ID NO: 2153095 - DNA, 19 bp, Homo sapiens
tgtccatcctcctctccat

SEQ ID NO: 2153096 - DNA, 20 bp, Homo sapiens
tgtccatcctcctctccatg

SEQ ID NO: 2153097 - DNA, 18 bp, Homo sapiens
tgtccccctcccctccca

SEQ ID NO: 2153098 - DNA, 16 bp, Homo sapiens
tgtcccctcacagact

SEQ ID NO: 2153099 - DNA, 14 bp, Homo sapiens
tgtcccctggggct

SEQ ID NO: 2153100 - DNA, 12 bp, Homo sapiens
tgtccctggggc

SEQ ID NO: 2153101 - DNA, 19 bp, Homo sapiens
tgtccctggggcactcccc

SEQ ID NO: 2153102 - DNA, 22 bp, Homo sapiens
tgtccctttttgcaggggactg

SEQ ID NO: 2153103 - DNA, 18 bp, Homo sapiens
tgtccttactcagagctg

SEQ ID NO: 2153104 - DNA, 19 bp, Homo sapiens
tgtccttactcagagctgc

SEQ ID NO: 2153105 - DNA, 23 bp, Homo sapiens
tgtccttactcagagctgcgggc

SEQ ID NO: 2153106 - DNA, 17 bp, Homo sapiens
tgtctctgcctggagca

SEQ ID NO: 2153107 - DNA, 18 bp, Homo sapiens
tgtctctgcctggagcag

SEQ ID NO: 2153108 - DNA, 19 bp, Homo sapiens
tgtctctgcctggagcagg

SEQ ID NO: 2153109 - DNA, 17 bp, Homo sapiens
tgtgaccaaaagttaca

SEQ ID NO: 2153110 - DNA, 16 bp, Homo sapiens
tgtgccatgtcaaaca

SEQ ID NO: 2153111 - DNA, 21 bp, Homo sapiens
tgtgcccacatcccaggcttc

SEQ ID NO: 2153112 - DNA, 17 bp, Homo sapiens
tgtgcctgtctgtccaa

SEQ ID NO: 2153113 - DNA, 21 bp, Homo sapiens
tgtgcctgtctgtccaacccc

SEQ ID NO: 2153114 - DNA, 23 bp, Homo sapiens
tgtgcctttgggaggcagcatca

SEQ ID NO: 2153115 - DNA, 17 bp, Homo sapiens
tgtggccccaagagggg

SEQ ID NO: 2153116 - DNA, 14 bp, Homo sapiens
tgtggtcccaccca

SEQ ID NO: 2153117 - DNA, 19 bp, Homo sapiens
tgtggtcccacccaggaag

SEQ ID NO: 2153118 - DNA, 15 bp, Homo sapiens
tgtgtaccacaccct

SEQ ID NO: 2153119 - DNA, 20 bp, Homo sapiens
tgtgtaccacaccctgcctg

SEQ ID NO: 2153120 - DNA, 22 bp, Homo sapiens
tgtgtaccacaccctgcctgct

SEQ ID NO: 2153121 - DNA, 18 bp, Homo sapiens
tgtgtgtaccacaccctg

SEQ ID NO: 2153122 - DNA, 14 bp, Homo sapiens
tgttaattgattaa

SEQ ID NO: 2153123 - DNA, 14 bp, Homo sapiens
tgttacttacctaa

SEQ ID NO: 2153124 - DNA, 18 bp, Homo sapiens
tgttacttacctaaacag

SEQ ID NO: 2153125 - DNA, 19 bp, Homo sapiens
tgttccttaagtcagaaca

SEQ ID NO: 2153126 - DNA, 18 bp, Homo sapiens
tgttctgtccagtttcca

SEQ ID NO: 2153127 - DNA, 15 bp, Homo sapiens
tgttgagagtgtgac

SEQ ID NO: 2153128 - DNA, 21 bp, Homo sapiens
tgttgctcaaatctattcaga

SEQ ID NO: 2153129 - DNA, 23 bp, Homo sapiens
tgttgctcaaatctattcagaca

SEQ ID NO: 2153130 - DNA, 20 bp, Homo sapiens
tgtttaaaaaaagtatatat

SEQ ID NO: 2153131 - DNA, 22 bp, Homo sapiens
ttaaaaaaagtatatattctac

SEQ ID NO: 2153132 - DNA, 16 bp, Homo sapiens
ttaaaataaaataatt

SEQ ID NO: 2153133 - DNA, 17 bp, Homo sapiens
ttaaatacagacactaa

SEQ ID NO: 2153134 - DNA, 18 bp, Homo sapiens
ttaaatacagacactaag

SEQ ID NO: 2153135 - DNA, 20 bp, Homo sapiens
ttaaatacagacactaagtt

SEQ ID NO: 2153136 - DNA, 13 bp, Homo sapiens
ttaaatcgttaga

SEQ ID NO: 2153137 - DNA, 15 bp, Homo sapiens
ttaactcattagact

SEQ ID NO: 2153138 - DNA, 13 bp, Homo sapiens
ttaagacttgaca

SEQ ID NO: 2153139 - DNA, 14 bp, Homo sapiens
ttaatatctgagaa

SEQ ID NO: 2153140 - DNA, 22 bp, Homo sapiens
ttaatatctgagaagtgtatat

SEQ ID NO: 2153141 - DNA, 17 bp, Homo sapiens
ttaatctttctttacct

SEQ ID NO: 2153142 - DNA, 24 bp, Homo sapiens
ttaatctttctttacctgagacca

SEQ ID NO: 2153143 - DNA, 14 bp, Homo sapiens
ttaatgaacaaatg

SEQ ID NO: 2153144 - DNA, 12 bp, Homo sapiens
ttacatgtttgc

SEQ ID NO: 2153145 - DNA, 20 bp, Homo sapiens
ttaccatgagaagagggcct

SEQ ID NO: 2153146 - DNA, 15 bp, Homo sapiens
ttacccttcctcatc

SEQ ID NO: 2153147 - DNA, 17 bp, Homo sapiens
ttacctaaacagatata

SEQ ID NO: 2153148 - DNA, 19 bp, Homo sapiens
ttacctaaacagatataaa

SEQ ID NO: 2153149 - DNA, 20 bp, Homo sapiens
ttacctaaacagatataaat

SEQ ID NO: 2153150 - DNA, 12 bp, Homo sapiens
ttactaaagtca

SEQ ID NO: 2153151 - DNA, 14 bp, Homo sapiens
ttactcagagctgc

SEQ ID NO: 2153152 - DNA, 20 bp, Homo sapiens
ttactcagagctgcgggctg

SEQ ID NO: 2153153 - DNA, 15 bp, Homo sapiens
ttacttcccccaccc

SEQ ID NO: 2153154 - DNA, 14 bp, Homo sapiens
ttagaatatattaa

SEQ ID NO: 2153155 - DNA, 21 bp, Homo sapiens
ttagactggaacttgaactga

SEQ ID NO: 2153156 - DNA, 16 bp, Homo sapiens
ttagactggacagctt

SEQ ID NO: 2153157 - DNA, 19 bp, Homo sapiens
aagccaccgcagctgctgc

SEQ ID NO: 2153158 - DNA, 20 bp, Homo sapiens
aagccaccgcagctgctgcc

SEQ ID NO: 2153159 - DNA, 14 bp, Homo sapiens
aagctttctccttt

SEQ ID NO: 2153160 - DNA, 16 bp, Homo sapiens
aagctttctcctttga

SEQ ID NO: 2153161 - DNA, 20 bp, Homo sapiens
aaggactggccgtggctcca

SEQ ID NO: 2153162 - DNA, 10 bp, Homo sapiens
aaggcctccc

SEQ ID NO: 2153163 - DNA, 11 bp, Homo sapiens
aaggcctcccc

SEQ ID NO: 2153164 - DNA, 16 bp, Homo sapiens
aaggcctcccctgagg

SEQ ID NO: 2153165 - DNA, 16 bp, Homo sapiens
aagggcagtaaagttt

SEQ ID NO: 2153166 - DNA, 14 bp, Homo sapiens
aagggccagtctgg

SEQ ID NO: 2153167 - DNA, 13 bp, Homo sapiens
aaggtcctgccct

SEQ ID NO: 2153168 - DNA, 21 bp, Homo sapiens
aaggtctcacactcctcctgc

SEQ ID NO: 2153169 - DNA, 14 bp, Homo sapiens
aagtagtagtgtct

SEQ ID NO: 2153170 - DNA, 14 bp, Homo sapiens
aagtatatattcta

SEQ ID NO: 2153171 - DNA, 17 bp, Homo sapiens
aagtcacatataaaagt

SEQ ID NO: 2153172 - DNA, 18 bp, Homo sapiens
aagtcagaacagcagact

SEQ ID NO: 2153173 - DNA, 14 bp, Homo sapiens
aagtctctctgtga

SEQ ID NO: 2153174 - DNA, 15 bp, Homo sapiens
aagtctctctgtgaa

SEQ ID NO: 2153175 - DNA, 17 bp, Homo sapiens
aagtctctctgtgaata

SEQ ID NO: 2153176 - DNA, 18 bp, Homo sapiens
aagtctctctgtgaatac

SEQ ID NO: 2153177 - DNA, 20 bp, Homo sapiens
aagtctctctgtgaatacaa

SEQ ID NO: 2153178 - DNA, 20 bp, Homo sapiens
aagtgaatttgcctgtaaca

SEQ ID NO: 2153179 - DNA, 21 bp, Homo sapiens
aagtgctgtttgggcaggagt

SEQ ID NO: 2153180 - DNA, 20 bp, Homo sapiens
aagtggggttgcaaccactg

SEQ ID NO: 2153181 - DNA, 12 bp, Homo sapiens
aagttaatttaa

SEQ ID NO: 2153182 - DNA, 14 bp, Homo sapiens
aatacaattaaagg

SEQ ID NO: 2153183 - DNA, 23 bp, Homo sapiens
aatatctgagaagtgtatatagt

SEQ ID NO: 2153184 - DNA, 13 bp, Homo sapiens
aatattaaataca

SEQ ID NO: 2153185 - DNA, 14 bp, Homo sapiens
aatattaaatacag

SEQ ID NO: 2153186 - DNA, 20 bp, Homo sapiens
aatattaaatacagacacta

SEQ ID NO: 2153187 - DNA, 16 bp, Homo sapiens
aatcaagagtctctcc

SEQ ID NO: 2153188 - DNA, 17 bp, Homo sapiens
aatcaagagtctctcca

SEQ ID NO: 2153189 - DNA, 18 bp, Homo sapiens
aatcaagagtctctccag

SEQ ID NO: 2153190 - DNA, 19 bp, Homo sapiens
aatctattcagacaagcaa

SEQ ID NO: 2153191 - DNA, 22 bp, Homo sapiens
aatctgtagggctggacctatg

SEQ ID NO: 2153192 - DNA, 17 bp, Homo sapiens
aatctgtttgatccctg

SEQ ID NO: 2153193 - DNA, 16 bp, Homo sapiens
aatctgtttttctaac

SEQ ID NO: 2153194 - DNA, 15 bp, Homo sapiens
aatctttctttacct

SEQ ID NO: 2153195 - DNA, 17 bp, Homo sapiens
aatctttctttacctga

SEQ ID NO: 2153196 - DNA, 15 bp, Homo sapiens
aatgatgtccagaag

SEQ ID NO: 2153197 - DNA, 11 bp, Homo sapiens
aatgatttcag

SEQ ID NO: 2153198 - DNA, 18 bp, Homo sapiens
aatgctttgatatttcaa

SEQ ID NO: 2153199 - DNA, 14 bp, Homo sapiens
aatggttccatgcc

SEQ ID NO: 2153200 - DNA, 22 bp, Homo sapiens
aatgtgttgatttgagaaattt

SEQ ID NO: 2153201 - DNA, 19 bp, Homo sapiens
aatgttaagacttgacagt

SEQ ID NO: 2153202 - DNA, 17 bp, Homo sapiens
aatgttagcctcaattt

SEQ ID NO: 2153203 - DNA, 20 bp, Homo sapiens
aattgaaggagaaaatgcat

SEQ ID NO: 2153204 - DNA, 22 bp, Homo sapiens
aatttaaagttgtttgtgcctt

SEQ ID NO: 2153205 - DNA, 19 bp, Homo sapiens
aattttactgacagaaatg

SEQ ID NO: 2153206 - DNA, 23 bp, Homo sapiens
acaaagagaataaagacttcatg

SEQ ID NO: 2153207 - DNA, 23 bp, Homo sapiens
acaaagcttctatcccaggaggt

SEQ ID NO: 2153208 - DNA, 14 bp, Homo sapiens
acaagccaacttgt

SEQ ID NO: 2153209 - DNA, 21 bp, Homo sapiens
acaagccaacttgtaaataca

SEQ ID NO: 2153210 - DNA, 14 bp, Homo sapiens
acaataaagtttat

SEQ ID NO: 2153211 - DNA, 15 bp, Homo sapiens
acaataaagtttatt

SEQ ID NO: 2153212 - DNA, 23 bp, Homo sapiens
acacaccccacaccccagcccac

SEQ ID NO: 2153213 - DNA, 21 bp, Homo sapiens
acaccataggtagaatgtaaa

SEQ ID NO: 2153214 - DNA, 12 bp, Homo sapiens
acaccccagccc

SEQ ID NO: 2153215 - DNA, 14 bp, Homo sapiens
acaccccagcccac

SEQ ID NO: 2153216 - DNA, 16 bp, Homo sapiens
acaccctgcctgctgt

SEQ ID NO: 2153217 - DNA, 23 bp, Homo sapiens
acactaagttatagtatatctgg

SEQ ID NO: 2153218 - DNA, 22 bp, Homo sapiens
acactccagaattacccttcct

SEQ ID NO: 2153219 - DNA, 15 bp, Homo sapiens
acactcctcctgcca

SEQ ID NO: 2153220 - DNA, 13 bp, Homo sapiens
acactccttcccc

SEQ ID NO: 2153221 - DNA, 17 bp, Homo sapiens
acactgagccccacctc

SEQ ID NO: 2153222 - DNA, 21 bp, Homo sapiens
acactgagccccacctctcca

SEQ ID NO: 2153223 - DNA, 20 bp, Homo sapiens
acactggtgggcagctgagg

SEQ ID NO: 2153224 - DNA, 17 bp, Homo sapiens
acagagggcgctcctgt

SEQ ID NO: 2153225 - DNA, 17 bp, Homo sapiens
acagatataaatggctg

SEQ ID NO: 2153226 - DNA, 15 bp, Homo sapiens
acagatgctggcctc

SEQ ID NO: 2153227 - DNA, 23 bp, Homo sapiens
acagatgctggcctcttggcacc

SEQ ID NO: 2153228 - DNA, 18 bp, Homo sapiens
acagcagactcagctctg

SEQ ID NO: 2153229 - DNA, 19 bp, Homo sapiens
acagcagactcagctctga

SEQ ID NO: 2153230 - DNA, 23 bp, Homo sapiens
acagcagactcagctctgacatt

SEQ ID NO: 2153231 - DNA, 15 bp, Homo sapiens
acagcccccacccca

SEQ ID NO: 2153232 - DNA, 12 bp, Homo sapiens
acagctcctccc

SEQ ID NO: 2153233 - DNA, 13 bp, Homo sapiens
acagctcctcccc

SEQ ID NO: 2153234 - DNA, 15 bp, Homo sapiens
acagctcctcccctg

SEQ ID NO: 2153235 - DNA, 16 bp, Homo sapiens
acagctcctcccctgc

SEQ ID NO: 2153236 - DNA, 19 bp, Homo sapiens
acagctcctcccctgccgc

SEQ ID NO: 2153237 - DNA, 21 bp, Homo sapiens
acaggcagctggatgagactt

SEQ ID NO: 2153238 - DNA, 14 bp, Homo sapiens
acaggttttataat

SEQ ID NO: 2153239 - DNA, 17 bp, Homo sapiens
acagtccgtcaaaacag

SEQ ID NO: 2153240 - DNA, 21 bp, Homo sapiens
acagtccgtcaaaacagattg

SEQ ID NO: 2153241 - DNA, 19 bp, Homo sapiens
acagtcctcacagcctctc

SEQ ID NO: 2153242 - DNA, 20 bp, Homo sapiens
acagtcctcacagcctctcc

SEQ ID NO: 2153243 - DNA, 21 bp, Homo sapiens
acagtgacgtgactcagagct

SEQ ID NO: 2153244 - DNA, 13 bp, Homo sapiens
acagtgctctgcc

SEQ ID NO: 2153245 - DNA, 14 bp, Homo sapiens
acagtgctctgcct

SEQ ID NO: 2153246 - DNA, 12 bp, Homo sapiens
acataaaggtat

SEQ ID NO: 2153247 - DNA, 14 bp, Homo sapiens
acatataaaagtta

SEQ ID NO: 2153248 - DNA, 22 bp, Homo sapiens
acatataaaagttaaactactt

SEQ ID NO: 2153249 - DNA, 21 bp, Homo sapiens
acatcagaagtaactcccact

SEQ ID NO: 2153250 - DNA, 16 bp, Homo sapiens
acatgggagggatcag

SEQ ID NO: 2153251 - DNA, 17 bp, Homo sapiens
acatgggagggatcagc

SEQ ID NO: 2153252 - DNA, 20 bp, Homo sapiens
acatggtgtctcccaacatg

SEQ ID NO: 2153253 - DNA, 20 bp, Homo sapiens
acatggttgggggaatgcac

SEQ ID NO: 2153254 - DNA, 22 bp, Homo sapiens
acatgtttgcacctttctagtt

SEQ ID NO: 2153255 - DNA, 14 bp, Homo sapiens
acattaactcatta

SEQ ID NO: 2153256 - DNA, 22 bp, Homo sapiens
acattaactcattagactggaa

SEQ ID NO: 2153257 - DNA, 14 bp, Homo sapiens
accaaaagttacat

SEQ ID NO: 2153258 - DNA, 18 bp, Homo sapiens
accaaagagtctctggct

SEQ ID NO: 2153259 - DNA, 20 bp, Homo sapiens
accaaagagtctctggctca

SEQ ID NO: 2153260 - DNA, 23 bp, Homo sapiens
accaagccaccgcagctgctgcc

SEQ ID NO: 2153261 - DNA, 22 bp, Homo sapiens
accaaggtctcacactcctcct

SEQ ID NO: 2153262 - DNA, 17 bp, Homo sapiens
accacaccctgcctgct

SEQ ID NO: 2153263 - DNA, 19 bp, Homo sapiens
accactagggtcctggccc

SEQ ID NO: 2153264 - DNA, 20 bp, Homo sapiens
accactcaaattaatctttc

SEQ ID NO: 2153265 - DNA, 15 bp, Homo sapiens
accagagcaggggct

SEQ ID NO: 2153266 - DNA, 21 bp, Homo sapiens
accagagcaggggctgctggg

SEQ ID NO: 2153267 - DNA, 21 bp, Homo sapiens
caccctgctcctcctgccctg

SEQ ID NO: 2153268 - DNA, 14 bp, Homo sapiens
caccctggccacca

SEQ ID NO: 2153269 - DNA, 17 bp, Homo sapiens
caccctggccaccaccc

SEQ ID NO: 2153270 - DNA, 12 bp, Homo sapiens
caccgcagctgc

SEQ ID NO: 2153271 - DNA, 14 bp, Homo sapiens
caccgcagctgctg

SEQ ID NO: 2153272 - DNA, 17 bp, Homo sapiens
caccgcagctgctgcca

SEQ ID NO: 2153273 - DNA, 23 bp, Homo sapiens
cacctctccaagtctctctgtga

SEQ ID NO: 2153274 - DNA, 13 bp, Homo sapiens
cacctgcctagct

SEQ ID NO: 2153275 - DNA, 20 bp, Homo sapiens
cacctgcctagctcttgggc

SEQ ID NO: 2153276 - DNA, 23 bp, Homo sapiens
cacctgcctagctcttgggcctg

SEQ ID NO: 2153277 - DNA, 20 bp, Homo sapiens
cacctggtactgcacatttt

SEQ ID NO: 2153278 - DNA, 20 bp, Homo sapiens
cacggggaccactgggcccc

SEQ ID NO: 2153279 - DNA, 14 bp, Homo sapiens
cacgtaccaagcca

SEQ ID NO: 2153280 - DNA, 23 bp, Homo sapiens
cacgtaccaagccaccgcagctg

SEQ ID NO: 2153281 - DNA, 14 bp, Homo sapiens
cacgtctctctgcc

SEQ ID NO: 2153282 - DNA, 15 bp, Homo sapiens
cacgtctctctgcct

SEQ ID NO: 2153283 - DNA, 16 bp, Homo sapiens
cacgtctctctgcctg

SEQ ID NO: 2153284 - DNA, 18 bp, Homo sapiens
cactaagctttctccttt

SEQ ID NO: 2153285 - DNA, 19 bp, Homo sapiens
cactaagctttctcctttg

SEQ ID NO: 2153286 - DNA, 20 bp, Homo sapiens
cactaagctttctcctttga

SEQ ID NO: 2153287 - DNA, 14 bp, Homo sapiens
cactacctttgtcc

SEQ ID NO: 2153288 - DNA, 21 bp, Homo sapiens
cactacctttgtccaggcctg

SEQ ID NO: 2153289 - DNA, 20 bp, Homo sapiens
cactcaaattaatctttctt

SEQ ID NO: 2153290 - DNA, 13 bp, Homo sapiens
cactcagcagccc

SEQ ID NO: 2153291 - DNA, 20 bp, Homo sapiens
cactcagcagccccctgccc

SEQ ID NO: 2153292 - DNA, 23 bp, Homo sapiens
cactcctaatcaagagtctctcc

SEQ ID NO: 2153293 - DNA, 13 bp, Homo sapiens
cactcctcctgcc

SEQ ID NO: 2153294 - DNA, 18 bp, Homo sapiens
cactcctcctgccagctc

SEQ ID NO: 2153295 - DNA, 19 bp, Homo sapiens
cactcctcctgccagctct

SEQ ID NO: 2153296 - DNA, 14 bp, Homo sapiens
cactccttcccctt

SEQ ID NO: 2153297 - DNA, 19 bp, Homo sapiens
cactctaggggtcaggctc

SEQ ID NO: 2153298 - DNA, 13 bp, Homo sapiens
cactgagggccac

SEQ ID NO: 2153299 - DNA, 16 bp, Homo sapiens
cactggagtgcaggga

SEQ ID NO: 2153300 - DNA, 19 bp, Homo sapiens
cactggtgggcagctgagg

SEQ ID NO: 2153301 - DNA, 14 bp, Homo sapiens
cactggtttgaaga

SEQ ID NO: 2153302 - DNA, 20 bp, Homo sapiens
cagaaactcgatgaatgtgt

SEQ ID NO: 2153303 - DNA, 14 bp, Homo sapiens
cagaactgctgggg

SEQ ID NO: 2153304 - DNA, 18 bp, Homo sapiens
cagaactgctggggctgg

SEQ ID NO: 2153305 - DNA, 20 bp, Homo sapiens
cagaactgctggggctggtg

SEQ ID NO: 2153306 - DNA, 12 bp, Homo sapiens
cagaagaatatt

SEQ ID NO: 2153307 - DNA, 20 bp, Homo sapiens
cagaagtaactcccactcct

SEQ ID NO: 2153308 - DNA, 14 bp, Homo sapiens
cagaatcctgggcc

SEQ ID NO: 2153309 - DNA, 15 bp, Homo sapiens
cagaatcctgggccc

SEQ ID NO: 2153310 - DNA, 19 bp, Homo sapiens
cagaatcctgggcccccag

SEQ ID NO: 2153311 - DNA, 14 bp, Homo sapiens
cagaatgtatatta

SEQ ID NO: 2153312 - DNA, 23 bp, Homo sapiens
cagacaagcaacaggttttataa

SEQ ID NO: 2153313 - DNA, 22 bp, Homo sapiens
cagacactggtttgaagaatgt

SEQ ID NO: 2153314 - DNA, 16 bp, Homo sapiens
cagaccaccagccgcc

SEQ ID NO: 2153315 - DNA, 23 bp, Homo sapiens
cagaccaccagccgccccagccc

SEQ ID NO: 2153316 - DNA, 14 bp, Homo sapiens
cagactcagctctg

SEQ ID NO: 2153317 - DNA, 22 bp, Homo sapiens
cagactcttccaccagagcagg

SEQ ID NO: 2153318 - DNA, 11 bp, Homo sapiens
cagagaatata

SEQ ID NO: 2153319 - DNA, 17 bp, Homo sapiens
cagagacctttgcccac

SEQ ID NO: 2153320 - DNA, 19 bp, Homo sapiens
cagagacctttgcccacac

SEQ ID NO: 2153321 - DNA, 16 bp, Homo sapiens
cagagcaggggctgct

SEQ ID NO: 2153322 - DNA, 17 bp, Homo sapiens
cagagcaggggctgctg

SEQ ID NO: 2153323 - DNA, 13 bp, Homo sapiens
cagagctgcctcc

SEQ ID NO: 2153324 - DNA, 19 bp, Homo sapiens
cagagctgcctccccaatc

SEQ ID NO: 2153325 - DNA, 24 bp, Homo sapiens
cagagctgcgggctgagggcatct

SEQ ID NO: 2153326 - DNA, 15 bp, Homo sapiens
cagagctttgtcact

SEQ ID NO: 2153327 - DNA, 16 bp, Homo sapiens
cagagggcgctcctgt

SEQ ID NO: 2153328 - DNA, 14 bp, Homo sapiens
cagagtgtcccttt

SEQ ID NO: 2153329 - DNA, 12 bp, Homo sapiens
cagatgctggcc

SEQ ID NO: 2153330 - DNA, 15 bp, Homo sapiens
cagatgctggcctct

SEQ ID NO: 2153331 - DNA, 18 bp, Homo sapiens
cagatgctggcctcttgg

SEQ ID NO: 2153332 - DNA, 15 bp, Homo sapiens
cagcacagctcctcc

SEQ ID NO: 2153333 - DNA, 22 bp, Homo sapiens
cagcacagctcctcccctgccg

SEQ ID NO: 2153334 - DNA, 23 bp, Homo sapiens
cagcacagctcctcccctgccgc

SEQ ID NO: 2153335 - DNA, 18 bp, Homo sapiens
cagcagactcagctctga

SEQ ID NO: 2153336 - DNA, 23 bp, Homo sapiens
cagcagactcagctctgacattc

SEQ ID NO: 2153337 - DNA, 15 bp, Homo sapiens
cagcaggcctctggt

SEQ ID NO: 2153338 - DNA, 18 bp, Homo sapiens
cagccatcaagagactga

SEQ ID NO: 2153339 - DNA, 21 bp, Homo sapiens
cagccatggggtccatcccct

SEQ ID NO: 2153340 - DNA, 21 bp, Homo sapiens
cagccccgcctgtcacaataa

SEQ ID NO: 2153341 - DNA, 18 bp, Homo sapiens
cagccccttctcccagca

SEQ ID NO: 2153342 - DNA, 20 bp, Homo sapiens
cagcccggcctgctcccagc

SEQ ID NO: 2153343 - DNA, 19 bp, Homo sapiens
cagccctaaggatctctca

SEQ ID NO: 2153344 - DNA, 12 bp, Homo sapiens
cagcccttccct

SEQ ID NO: 2153345 - DNA, 17 bp, Homo sapiens
cagccgagccgggcctg

SEQ ID NO: 2153346 - DNA, 13 bp, Homo sapiens
cagccgccccagc

SEQ ID NO: 2153347 - DNA, 15 bp, Homo sapiens
cagcctcacagatgc

SEQ ID NO: 2153348 - DNA, 19 bp, Homo sapiens
cagcctcacagatgctggc

SEQ ID NO: 2153349 - DNA, 23 bp, Homo sapiens
cagcctcacagatgctggcctct

SEQ ID NO: 2153350 - DNA, 10 bp, Homo sapiens
cagcctgagt

SEQ ID NO: 2153351 - DNA, 12 bp, Homo sapiens
cagcgcctgtcc

SEQ ID NO: 2153352 - DNA, 18 bp, Homo sapiens
cagcgcctgtcccctcac

SEQ ID NO: 2153353 - DNA, 22 bp, Homo sapiens
cagcgcctgtcccctcacagac

SEQ ID NO: 2153354 - DNA, 12 bp, Homo sapiens
cagctaatctgt

SEQ ID NO: 2153355 - DNA, 21 bp, Homo sapiens
cagctaatctgtagggctgga

SEQ ID NO: 2153356 - DNA, 20 bp, Homo sapiens
cagctcctcccctgccgcct

SEQ ID NO: 2153357 - DNA, 14 bp, Homo sapiens
cagctctgacattc

SEQ ID NO: 2153358 - DNA, 14 bp, Homo sapiens
cagctctgtcaccc

SEQ ID NO: 2153359 - DNA, 23 bp, Homo sapiens
cagctctgtcaccctggccacca

SEQ ID NO: 2153360 - DNA, 20 bp, Homo sapiens
cagctgaggacacaccccac

SEQ ID NO: 2153361 - DNA, 20 bp, Homo sapiens
cagctgctgccactctgctg

SEQ ID NO: 2153362 - DNA, 23 bp, Homo sapiens
cagctgctgccactctgctgcct

SEQ ID NO: 2153363 - DNA, 16 bp, Homo sapiens
cagctgtggtcccacc

SEQ ID NO: 2153364 - DNA, 22 bp, Homo sapiens
cagctgtggtcccacccaggaa

SEQ ID NO: 2153365 - DNA, 18 bp, Homo sapiens
cagcttgtggcaagtgaa

SEQ ID NO: 2153366 - DNA, 20 bp, Homo sapiens
cagcttgtggcaagtgaatt

SEQ ID NO: 2153367 - DNA, 21 bp, Homo sapiens
cagcttgtggcaagtgaattt

SEQ ID NO: 2153368 - DNA, 15 bp, Homo sapiens
caggaagggagggag

SEQ ID NO: 2153369 - DNA, 19 bp, Homo sapiens
caggaagggagggagctga

SEQ ID NO: 2153370 - DNA, 21 bp, Homo sapiens
caggaagggagggagctgagg

SEQ ID NO: 2153371 - DNA, 23 bp, Homo sapiens
caggaagggagggagctgaggcc

SEQ ID NO: 2153372 - DNA, 19 bp, Homo sapiens
caggacttaacggctccag

SEQ ID NO: 2153373 - DNA, 21 bp, Homo sapiens
caggacttaacggctccagga

SEQ ID NO: 2153374 - DNA, 23 bp, Homo sapiens
caggagcacaggcagctggatga

SEQ ID NO: 2153375 - DNA, 22 bp, Homo sapiens
caggaggtggctatggccaccc

SEQ ID NO: 2153376 - DNA, 20 bp, Homo sapiens
ccctttttgcaggggactgg

SEQ ID NO: 2153377 - DNA, 14 bp, Homo sapiens
ccgaccccatctca

SEQ ID NO: 2153378 - DNA, 16 bp, Homo sapiens
ccgagccgggcctggg

SEQ ID NO: 2153379 - DNA, 15 bp, Homo sapiens
ccgcagctgctgcca

SEQ ID NO: 2153380 - DNA, 19 bp, Homo sapiens
ccgcagctgctgccactct

SEQ ID NO: 2153381 - DNA, 22 bp, Homo sapiens
ccgcagctgctgccactctgct

SEQ ID NO: 2153382 - DNA, 23 bp, Homo sapiens
ccgcagctgctgccactctgctg

SEQ ID NO: 2153383 - DNA, 16 bp, Homo sapiens
ccgcatggcagctggg

SEQ ID NO: 2153384 - DNA, 23 bp, Homo sapiens
ccgcatggcagctgggcccacag

SEQ ID NO: 2153385 - DNA, 17 bp, Homo sapiens
ccgccccagccccttct

SEQ ID NO: 2153386 - DNA, 18 bp, Homo sapiens
ccgcctcccgggaagcat

SEQ ID NO: 2153387 - DNA, 16 bp, Homo sapiens
ccgcctgtcacaataa

SEQ ID NO: 2153388 - DNA, 16 bp, Homo sapiens
ccggacctggactagg

SEQ ID NO: 2153389 - DNA, 15 bp, Homo sapiens
ccggccctgcccctc

SEQ ID NO: 2153390 - DNA, 16 bp, Homo sapiens
ccggccctgcccctcc

SEQ ID NO: 2153391 - DNA, 17 bp, Homo sapiens
ccggccctgcccctccc

SEQ ID NO: 2153392 - DNA, 22 bp, Homo sapiens
ccggctgggtcggccctgccca

SEQ ID NO: 2153393 - DNA, 23 bp, Homo sapiens
ccggctgggtcggccctgcccaa

SEQ ID NO: 2153394 - DNA, 18 bp, Homo sapiens
ccgggaagcatcctcccc

SEQ ID NO: 2153395 - DNA, 23 bp, Homo sapiens
ccgttctgctggcctggatctcc

SEQ ID NO: 2153396 - DNA, 13 bp, Homo sapiens
cctaaggacacac

SEQ ID NO: 2153397 - DNA, 20 bp, Homo sapiens
cctaatcaagagtctctcca

SEQ ID NO: 2153398 - DNA, 23 bp, Homo sapiens
cctaatcaagagtctctccagcc

SEQ ID NO: 2153399 - DNA, 22 bp, Homo sapiens
cctaccgcatggcagctgggcc

SEQ ID NO: 2153400 - DNA, 12 bp, Homo sapiens
cctagctcttgg

SEQ ID NO: 2153401 - DNA, 17 bp, Homo sapiens
cctagctcttgggcctg

SEQ ID NO: 2153402 - DNA, 21 bp, Homo sapiens
cctagctcttgggcctgacct

SEQ ID NO: 2153403 - DNA, 19 bp, Homo sapiens
cctatgtcctaaggacaca

SEQ ID NO: 2153404 - DNA, 20 bp, Homo sapiens
cctatgtcctaaggacacac

SEQ ID NO: 2153405 - DNA, 19 bp, Homo sapiens
cctcacagactcttccacc

SEQ ID NO: 2153406 - DNA, 15 bp, Homo sapiens
cctcacagatgctgg

SEQ ID NO: 2153407 - DNA, 16 bp, Homo sapiens
cctcacagatgctggc

SEQ ID NO: 2153408 - DNA, 18 bp, Homo sapiens
cctcacagatgctggcct

SEQ ID NO: 2153409 - DNA, 20 bp, Homo sapiens
cctcacagatgctggcctct

SEQ ID NO: 2153410 - DNA, 13 bp, Homo sapiens
cctcacagcctct

SEQ ID NO: 2153411 - DNA, 18 bp, Homo sapiens
cctcacagcctctccctt

SEQ ID NO: 2153412 - DNA, 12 bp, Homo sapiens
cctcactcctgt

SEQ ID NO: 2153413 - DNA, 16 bp, Homo sapiens
cctcaggggaagctgc

SEQ ID NO: 2153414 - DNA, 15 bp, Homo sapiens
cctcattcagaccaa

SEQ ID NO: 2153415 - DNA, 15 bp, Homo sapiens
cctccagtcctgctg

SEQ ID NO: 2153416 - DNA, 20 bp, Homo sapiens
cctccagtcctgctggcctg

SEQ ID NO: 2153417 - DNA, 13 bp, Homo sapiens
cctccccaatcca

SEQ ID NO: 2153418 - DNA, 14 bp, Homo sapiens
cctccccaatccat

SEQ ID NO: 2153419 - DNA, 13 bp, Homo sapiens
cctccccacagtc

SEQ ID NO: 2153420 - DNA, 15 bp, Homo sapiens
cctccccaccagagc

SEQ ID NO: 2153421 - DNA, 16 bp, Homo sapiens
cctccccaccagagct

SEQ ID NO: 2153422 - DNA, 18 bp, Homo sapiens
cctccccaccagagctgc

SEQ ID NO: 2153423 - DNA, 20 bp, Homo sapiens
cctccccaccagagctgcct

SEQ ID NO: 2153424 - DNA, 19 bp, Homo sapiens
cctcccccacgtctctctg

SEQ ID NO: 2153425 - DNA, 22 bp, Homo sapiens
cctcccccacgtctctctgcct

SEQ ID NO: 2153426 - DNA, 23 bp, Homo sapiens
cctcccccacgtctctctgcctg

SEQ ID NO: 2153427 - DNA, 23 bp, Homo sapiens
cctccccctaccgcatggcagct

SEQ ID NO: 2153428 - DNA, 12 bp, Homo sapiens
cctcccctgagg

SEQ ID NO: 2153429 - DNA, 13 bp, Homo sapiens
cctcccctgagga

SEQ ID NO: 2153430 - DNA, 16 bp, Homo sapiens
cctcccctgccgcctc

SEQ ID NO: 2153431 - DNA, 18 bp, Homo sapiens
cctcccgggaagcatcct

SEQ ID NO: 2153432 - DNA, 19 bp, Homo sapiens
cctcccgggaagcatcctc

SEQ ID NO: 2153433 - DNA, 16 bp, Homo sapiens
cctccctagatccagg

SEQ ID NO: 2153434 - DNA, 22 bp, Homo sapiens
cctccctagatccaggcttctc

SEQ ID NO: 2153435 - DNA, 13 bp, Homo sapiens
cctccctctgcct

SEQ ID NO: 2153436 - DNA, 16 bp, Homo sapiens
cctccctctgcctcat

SEQ ID NO: 2153437 - DNA, 18 bp, Homo sapiens
cctccctctgcctcatcc

SEQ ID NO: 2153438 - DNA, 20 bp, Homo sapiens
cctccctctgcctcatcctc

SEQ ID NO: 2153439 - DNA, 22 bp, Homo sapiens
cctcccttgagtaggccctgct

SEQ ID NO: 2153440 - DNA, 23 bp, Homo sapiens
cctcccttgagtaggccctgctt

SEQ ID NO: 2153441 - DNA, 13 bp, Homo sapiens
cctcctctccatg

SEQ ID NO: 2153442 - DNA, 22 bp, Homo sapiens
cctcctctccatgcaagtgctg

SEQ ID NO: 2153443 - DNA, 20 bp, Homo sapiens
cctcctgccagctctgtcac

SEQ ID NO: 2153444 - DNA, 16 bp, Homo sapiens
cctcctgccctgtccc

SEQ ID NO: 2153445 - DNA, 18 bp, Homo sapiens
cctcggcccatctgtcca

SEQ ID NO: 2153446 - DNA, 22 bp, Homo sapiens
cctcggcccatctgtccatcct

SEQ ID NO: 2153447 - DNA, 14 bp, Homo sapiens
cctctaactccctc

SEQ ID NO: 2153448 - DNA, 16 bp, Homo sapiens
cctctaactccctcct

SEQ ID NO: 2153449 - DNA, 20 bp, Homo sapiens
cctctaactccctcctcaca

SEQ ID NO: 2153450 - DNA, 23 bp, Homo sapiens
cctctcatcagtgtcctcttgct

SEQ ID NO: 2153451 - DNA, 12 bp, Homo sapiens
cctctccatgca

SEQ ID NO: 2153452 - DNA, 18 bp, Homo sapiens
cctctccatgcaagtgct

SEQ ID NO: 2153453 - DNA, 12 bp, Homo sapiens
cctcttgctcaa

SEQ ID NO: 2153454 - DNA, 13 bp, Homo sapiens
cctcttggcacct

SEQ ID NO: 2153455 - DNA, 13 bp, Homo sapiens
cctgaactccaga

SEQ ID NO: 2153456 - DNA, 23 bp, Homo sapiens
cctgaatggttccatgcctgagg

SEQ ID NO: 2153457 - DNA, 17 bp, Homo sapiens
cctgacactgagcccca

SEQ ID NO: 2153458 - DNA, 18 bp, Homo sapiens
cctgacactgagccccac

SEQ ID NO: 2153459 - DNA, 21 bp, Homo sapiens
cctgacagatgtcagccgagc

SEQ ID NO: 2153460 - DNA, 19 bp, Homo sapiens
cctgacccggattggccct

SEQ ID NO: 2153461 - DNA, 23 bp, Homo sapiens
cctgacccggattggccctgccc

SEQ ID NO: 2153462 - DNA, 21 bp, Homo sapiens
cctgacctccagtcctgctgg

SEQ ID NO: 2153463 - DNA, 21 bp, Homo sapiens
cctgagaccagttgggagcac

SEQ ID NO: 2153464 - DNA, 17 bp, Homo sapiens
cctgaggatcccctgtc

SEQ ID NO: 2153465 - DNA, 18 bp, Homo sapiens
cctgaggatcccctgtcc

SEQ ID NO: 2153466 - DNA, 15 bp, Homo sapiens
cctgcaaactcactg

SEQ ID NO: 2153467 - DNA, 17 bp, Homo sapiens
cctgcaaactcactgct

SEQ ID NO: 2153468 - DNA, 22 bp, Homo sapiens
cctgcaaactcactgctcaaga

SEQ ID NO: 2153469 - DNA, 21 bp, Homo sapiens
cctgcaccagcccttccctgc

SEQ ID NO: 2153470 - DNA, 15 bp, Homo sapiens
cctgcccaagggcct

SEQ ID NO: 2153471 - DNA, 23 bp, Homo sapiens
cctgcccctccctagatccaggc

SEQ ID NO: 2153472 - DNA, 15 bp, Homo sapiens
cctgccctgtccctg

SEQ ID NO: 2153473 - DNA, 17 bp, Homo sapiens
cctgccctgtccctgtc

SEQ ID NO: 2153474 - DNA, 21 bp, Homo sapiens
cctgccctgttgtgtatagat

SEQ ID NO: 2153475 - DNA, 19 bp, Homo sapiens
cctgcctagctcttgggcc

SEQ ID NO: 2153476 - DNA, 20 bp, Homo sapiens
cctgcctagctcttgggcct

SEQ ID NO: 2153477 - DNA, 23 bp, Homo sapiens
cctgcctagctcttgggcctgac

SEQ ID NO: 2153478 - DNA, 11 bp, Homo sapiens
cctgcctgctg

SEQ ID NO: 2153479 - DNA, 12 bp, Homo sapiens
cctgcctgctgt

SEQ ID NO: 2153480 - DNA, 13 bp, Homo sapiens
cctgcctgctgtg

SEQ ID NO: 2153481 - DNA, 14 bp, Homo sapiens
cctgcctgctgtgg

SEQ ID NO: 2153482 - DNA, 15 bp, Homo sapiens
cctgctatttgaagt

SEQ ID NO: 2153483 - DNA, 14 bp, Homo sapiens
cctgctcccagcag

SEQ ID NO: 2153484 - DNA, 15 bp, Homo sapiens
cctgctcccagcagc

SEQ ID NO: 2153485 - DNA, 20 bp, Homo sapiens
cttgccttcttcacccagct

SEQ ID NO: 2153486 - DNA, 13 bp, Homo sapiens
cttgtaaatacac

SEQ ID NO: 2153487 - DNA, 13 bp, Homo sapiens
cttgtccctgggg

SEQ ID NO: 2153488 - DNA, 18 bp, Homo sapiens
cttgtccctggggcactc

SEQ ID NO: 2153489 - DNA, 22 bp, Homo sapiens
cttgtccctggggcactccccc

SEQ ID NO: 2153490 - DNA, 18 bp, Homo sapiens
cttgtgtgtaccacaccc

SEQ ID NO: 2153491 - DNA, 23 bp, Homo sapiens
cttgtgtgtaccacaccctgcct

SEQ ID NO: 2153492 - DNA, 14 bp, Homo sapiens
ctttatcttgacat

SEQ ID NO: 2153493 - DNA, 21 bp, Homo sapiens
ctttctagttgaaaataaagt

SEQ ID NO: 2153494 - DNA, 13 bp, Homo sapiens
ctttctccagcca

SEQ ID NO: 2153495 - DNA, 12 bp, Homo sapiens
ctttctcctttg

SEQ ID NO: 2153496 - DNA, 13 bp, Homo sapiens
ctttgcactgagg

SEQ ID NO: 2153497 - DNA, 14 bp, Homo sapiens
ctttgcactgaggg

SEQ ID NO: 2153498 - DNA, 23 bp, Homo sapiens
ctttgcactgagggccacactat

SEQ ID NO: 2153499 - DNA, 22 bp, Homo sapiens
ctttgcccacacacactccttc

SEQ ID NO: 2153500 - DNA, 16 bp, Homo sapiens
ctttgtcacttgccac

SEQ ID NO: 2153501 - DNA, 18 bp, Homo sapiens
cttttaatgaacaaatgg

SEQ ID NO: 2153502 - DNA, 14 bp, Homo sapiens
ctttttctaccttt

SEQ ID NO: 2153503 - DNA, 22 bp, Homo sapiens
ctttttgcaggggactgggcca

SEQ ID NO: 2153504 - DNA, 14 bp, Homo sapiens
ctttttttctctcc

SEQ ID NO: 2153505 - DNA, 11 bp, Homo sapiens
gaaaacccctg

SEQ ID NO: 2153506 - DNA, 13 bp, Homo sapiens
gaaaacccctggc

SEQ ID NO: 2153507 - DNA, 15 bp, Homo sapiens
gaaacatggttttga

SEQ ID NO: 2153508 - DNA, 23 bp, Homo sapiens
gaaatgtggtagcctcactttta

SEQ ID NO: 2153509 - DNA, 22 bp, Homo sapiens
gaaattttactgacagaaatgc

SEQ ID NO: 2153510 - DNA, 20 bp, Homo sapiens
gaacaccataggtagaatgt

SEQ ID NO: 2153511 - DNA, 16 bp, Homo sapiens
gaacagtgctctgcct

SEQ ID NO: 2153512 - DNA, 17 bp, Homo sapiens
gaacagtgctctgcctc

SEQ ID NO: 2153513 - DNA, 12 bp, Homo sapiens
gaactgccccat

SEQ ID NO: 2153514 - DNA, 18 bp, Homo sapiens
gaactgccccatctcctc

SEQ ID NO: 2153515 - DNA, 11 bp, Homo sapiens
gaactgctggg

SEQ ID NO: 2153516 - DNA, 19 bp, Homo sapiens
gaactgctggggctggtga

SEQ ID NO: 2153517 - DNA, 23 bp, Homo sapiens
gaactgctggggctggtgaggcc

SEQ ID NO: 2153518 - DNA, 14 bp, Homo sapiens
gaagcatcctcccc

SEQ ID NO: 2153519 - DNA, 15 bp, Homo sapiens
gaagcatcctcccca

SEQ ID NO: 2153520 - DNA, 14 bp, Homo sapiens
gaaggcctcccctg

SEQ ID NO: 2153521 - DNA, 15 bp, Homo sapiens
gaagggagggagctg

SEQ ID NO: 2153522 - DNA, 18 bp, Homo sapiens
gaagggccagtctgggct

SEQ ID NO: 2153523 - DNA, 21 bp, Homo sapiens
gaaggtccttgcctgaactcc

SEQ ID NO: 2153524 - DNA, 15 bp, Homo sapiens
gaagtaactcccact

SEQ ID NO: 2153525 - DNA, 19 bp, Homo sapiens
gaataaagacttcatgttc

SEQ ID NO: 2153526 - DNA, 15 bp, Homo sapiens
gaatacaattaaagg

SEQ ID NO: 2153527 - DNA, 12 bp, Homo sapiens
gaatattcagga

SEQ ID NO: 2153528 - DNA, 13 bp, Homo sapiens
gaatcctgggccc

SEQ ID NO: 2153529 - DNA, 19 bp, Homo sapiens
gaatcctgggcccccagag

SEQ ID NO: 2153530 - DNA, 15 bp, Homo sapiens
gaatgcacctcccca

SEQ ID NO: 2153531 - DNA, 22 bp, Homo sapiens
gaatggttccatgcctgagggt

SEQ ID NO: 2153532 - DNA, 13 bp, Homo sapiens
gaatgtgctgcct

SEQ ID NO: 2153533 - DNA, 20 bp, Homo sapiens
gaatgttaagacttgacagt

SEQ ID NO: 2153534 - DNA, 15 bp, Homo sapiens
gaattacccttcctc

SEQ ID NO: 2153535 - DNA, 16 bp, Homo sapiens
gaattacccttcctca

SEQ ID NO: 2153536 - DNA, 19 bp, Homo sapiens
gaattgaaggagaaaatgc

SEQ ID NO: 2153537 - DNA, 21 bp, Homo sapiens
gacaaaccaggggtaccaggc

SEQ ID NO: 2153538 - DNA, 20 bp, Homo sapiens
gacaaccacgtaccaagcca

SEQ ID NO: 2153539 - DNA, 21 bp, Homo sapiens
gacacaccccacaccccagcc

SEQ ID NO: 2153540 - DNA, 22 bp, Homo sapiens
gacacaccccacaccccagccc

SEQ ID NO: 2153541 - DNA, 23 bp, Homo sapiens
gacacaccccacaccccagccca

SEQ ID NO: 2153542 - DNA, 12 bp, Homo sapiens
gacactgagccc

SEQ ID NO: 2153543 - DNA, 16 bp, Homo sapiens
gacactggtttgaaga

SEQ ID NO: 2153544 - DNA, 18 bp, Homo sapiens
gacagaaatgcaatctcc

SEQ ID NO: 2153545 - DNA, 21 bp, Homo sapiens
gacagcttgtggcaagtgaat

SEQ ID NO: 2153546 - DNA, 21 bp, Homo sapiens
gacagtccgtcaaaacagatt

SEQ ID NO: 2153547 - DNA, 22 bp, Homo sapiens
gacattaactcattagactgga

SEQ ID NO: 2153548 - DNA, 13 bp, Homo sapiens
gaccactgggccc

SEQ ID NO: 2153549 - DNA, 14 bp, Homo sapiens
gaccagttgggagc

SEQ ID NO: 2153550 - DNA, 17 bp, Homo sapiens
gaccagttgggagcact

SEQ ID NO: 2153551 - DNA, 23 bp, Homo sapiens
gacccctgcaccagcccttccct

SEQ ID NO: 2153552 - DNA, 16 bp, Homo sapiens
gacccggattggccct

SEQ ID NO: 2153553 - DNA, 20 bp, Homo sapiens
gacccggattggccctgccc

SEQ ID NO: 2153554 - DNA, 21 bp, Homo sapiens
gacctccagtcctgctggcct

SEQ ID NO: 2153555 - DNA, 24 bp, Homo sapiens
gacctccagtcctgctggcctgct

SEQ ID NO: 2153556 - DNA, 18 bp, Homo sapiens
gacctggactagggcctc

SEQ ID NO: 2153557 - DNA, 16 bp, Homo sapiens
gacctttgcccacaca

SEQ ID NO: 2153558 - DNA, 13 bp, Homo sapiens
gacgtgactcaga

SEQ ID NO: 2153559 - DNA, 15 bp, Homo sapiens
gacgtgactcagagc

SEQ ID NO: 2153560 - DNA, 23 bp, Homo sapiens
gactaagccctgtcgagacactt

SEQ ID NO: 2153561 - DNA, 14 bp, Homo sapiens
gactgctgacccac

SEQ ID NO: 2153562 - DNA, 19 bp, Homo sapiens
gactggaaggtccttgcct

SEQ ID NO: 2153563 - DNA, 21 bp, Homo sapiens
gactggacagcttgtggcaag

SEQ ID NO: 2153564 - DNA, 17 bp, Homo sapiens
gactggccgtggctcca

SEQ ID NO: 2153565 - DNA, 20 bp, Homo sapiens
gactgggatgggaacactgg

SEQ ID NO: 2153566 - DNA, 18 bp, Homo sapiens
gactgggccatgggtcct

SEQ ID NO: 2153567 - DNA, 19 bp, Homo sapiens
gactgtttttcggacagtt

SEQ ID NO: 2153568 - DNA, 14 bp, Homo sapiens
gacttaacggctcc

SEQ ID NO: 2153569 - DNA, 16 bp, Homo sapiens
gacttcgactcaggat

SEQ ID NO: 2153570 - DNA, 18 bp, Homo sapiens
gagaaggaaaattttagc

SEQ ID NO: 2153571 - DNA, 16 bp, Homo sapiens
gagacattaactcatt

SEQ ID NO: 2153572 - DNA, 22 bp, Homo sapiens
gagacattaactcattagactg

SEQ ID NO: 2153573 - DNA, 20 bp, Homo sapiens
gagaccagttgggagcactg

SEQ ID NO: 2153574 - DNA, 21 bp, Homo sapiens
gagaccagttgggagcactgg

SEQ ID NO: 2153575 - DNA, 23 bp, Homo sapiens
gagaccagttgggagcactggag

SEQ ID NO: 2153576 - DNA, 17 bp, Homo sapiens
gagacctttgcccacac

SEQ ID NO: 2153577 - DNA, 22 bp, Homo sapiens
gagactaagccctgtcgagaca

SEQ ID NO: 2153578 - DNA, 17 bp, Homo sapiens
gagactcctgccctgtt

SEQ ID NO: 2153579 - DNA, 20 bp, Homo sapiens
gagacttccaaacctgacag

SEQ ID NO: 2153580 - DNA, 18 bp, Homo sapiens
gagaggggaagggccagt

SEQ ID NO: 2153581 - DNA, 16 bp, Homo sapiens
gagcaggggctgctgg

SEQ ID NO: 2153582 - DNA, 20 bp, Homo sapiens
gagcaggggctgctgggggc

SEQ ID NO: 2153583 - DNA, 20 bp, Homo sapiens
gagctttgtcacttgccaca

SEQ ID NO: 2153584 - DNA, 14 bp, Homo sapiens
gaggccggccctgc

SEQ ID NO: 2153585 - DNA, 19 bp, Homo sapiens
gaggccggccctgcccctc

SEQ ID NO: 2153586 - DNA, 20 bp, Homo sapiens
gaggccggccctgcccctcc

SEQ ID NO: 2153587 - DNA, 12 bp, Homo sapiens
gaggcctccctt

SEQ ID NO: 2153588 - DNA, 13 bp, Homo sapiens
gaggctcctccct

SEQ ID NO: 2153589 - DNA, 22 bp, Homo sapiens
gaggctcctccctctgcctcat

SEQ ID NO: 2153590 - DNA, 16 bp, Homo sapiens
gagggactgctgaccc

SEQ ID NO: 2153591 - DNA, 15 bp, Homo sapiens
gagggagctgaggcc

SEQ ID NO: 2153592 - DNA, 19 bp, Homo sapiens
gagggcctgtgggagcctg

SEQ ID NO: 2153593 - DNA, 15 bp, Homo sapiens
gaggggcgggctcag

SEQ ID NO: 2153594 - DNA, 14 bp, Homo sapiens
gggcactcccccag

SEQ ID NO: 2153595 - DNA, 14 bp, Homo sapiens
gggcagaatcctgg

SEQ ID NO: 2153596 - DNA, 20 bp, Homo sapiens
gggccagtctgggctgccgg

SEQ ID NO: 2153597 - DNA, 14 bp, Homo sapiens
gggccatgggtcct

SEQ ID NO: 2153598 - DNA, 19 bp, Homo sapiens
gggcccacagcccccaccc

SEQ ID NO: 2153599 - DNA, 13 bp, Homo sapiens
gggcccccagaga

SEQ ID NO: 2153600 - DNA, 20 bp, Homo sapiens
gggcccccagagacctttgc

SEQ ID NO: 2153601 - DNA, 23 bp, Homo sapiens
gggcccccagagacctttgccca

SEQ ID NO: 2153602 - DNA, 19 bp, Homo sapiens
gggcctcggaggctcctcc

SEQ ID NO: 2153603 - DNA, 15 bp, Homo sapiens
gggcgggctcagagc

SEQ ID NO: 2153604 - DNA, 22 bp, Homo sapiens
gggcgggctcagagctttgtca

SEQ ID NO: 2153605 - DNA, 13 bp, Homo sapiens
gggctccccttgc

SEQ ID NO: 2153606 - DNA, 15 bp, Homo sapiens
gggctccccttgccc

SEQ ID NO: 2153607 - DNA, 16 bp, Homo sapiens
gggctccccttgccct

SEQ ID NO: 2153608 - DNA, 18 bp, Homo sapiens
gggctccccttgcccttc

SEQ ID NO: 2153609 - DNA, 20 bp, Homo sapiens
gggctccccttgcccttcct

SEQ ID NO: 2153610 - DNA, 22 bp, Homo sapiens
gggctcctttctccagccagca

SEQ ID NO: 2153611 - DNA, 12 bp, Homo sapiens
gggctgctgggg

SEQ ID NO: 2153612 - DNA, 13 bp, Homo sapiens
gggctgctggggg

SEQ ID NO: 2153613 - DNA, 13 bp, Homo sapiens
ggggactgggcca

SEQ ID NO: 2153614 - DNA, 17 bp, Homo sapiens
ggggcgggctcagagct

SEQ ID NO: 2153615 - DNA, 16 bp, Homo sapiens
ggggctgctgggggct

SEQ ID NO: 2153616 - DNA, 21 bp, Homo sapiens
ggggctgctgggggctcccct

SEQ ID NO: 2153617 - DNA, 22 bp, Homo sapiens
ggggctgctgggggctcccctt

SEQ ID NO: 2153618 - DNA, 21 bp, Homo sapiens
ggggctggtgaggccggccct

SEQ ID NO: 2153619 - DNA, 15 bp, Homo sapiens
ggggtcaggctccat

SEQ ID NO: 2153620 - DNA, 18 bp, Homo sapiens
ggggtccatccccttccc

SEQ ID NO: 2153621 - DNA, 12 bp, Homo sapiens
gggtcctcggcc

SEQ ID NO: 2153622 - DNA, 16 bp, Homo sapiens
gggtcggccctgccca

SEQ ID NO: 2153623 - DNA, 23 bp, Homo sapiens
ggtaaaaagattatatatcataa

SEQ ID NO: 2153624 - DNA, 21 bp, Homo sapiens
ggtaccagcagaaaggttagt

SEQ ID NO: 2153625 - DNA, 21 bp, Homo sapiens
ggtaccaggcacatggctggg

SEQ ID NO: 2153626 - DNA, 12 bp, Homo sapiens
ggtaggaaatgt

SEQ ID NO: 2153627 - DNA, 14 bp, Homo sapiens
ggtcccacccagga

SEQ ID NO: 2153628 - DNA, 21 bp, Homo sapiens
ggtcctcggcccatctgtcca

SEQ ID NO: 2153629 - DNA, 23 bp, Homo sapiens
ggtgacagtgacgtgactcagag

SEQ ID NO: 2153630 - DNA, 13 bp, Homo sapiens
ggttgcctccccc

SEQ ID NO: 2153631 - DNA, 16 bp, Homo sapiens
ggttgggggaatgcac

SEQ ID NO: 2153632 - DNA, 10 bp, Homo sapiens
ggttgtcaat

SEQ ID NO: 2153633 - DNA, 13 bp, Homo sapiens
gtaacaagccaga

SEQ ID NO: 2153634 - DNA, 15 bp, Homo sapiens
gtaacaagccagatt

SEQ ID NO: 2153635 - DNA, 16 bp, Homo sapiens
gtaacaagccagattt

SEQ ID NO: 2153636 - DNA, 18 bp, Homo sapiens
gtaactcccactcctaat

SEQ ID NO: 2153637 - DNA, 22 bp, Homo sapiens
gtaagtggggttgcaaccactg

SEQ ID NO: 2153638 - DNA, 18 bp, Homo sapiens
gtacacagcaccagaatg

SEQ ID NO: 2153639 - DNA, 14 bp, Homo sapiens
gtacagttatctaa

SEQ ID NO: 2153640 - DNA, 20 bp, Homo sapiens
gtacagttatctaagttaat

SEQ ID NO: 2153641 - DNA, 19 bp, Homo sapiens
gtaccacaccctgcctgct

SEQ ID NO: 2153642 - DNA, 22 bp, Homo sapiens
gtaccacaccctgcctgctgtg

SEQ ID NO: 2153643 - DNA, 16 bp, Homo sapiens
gtaccaggcacatggc

SEQ ID NO: 2153644 - DNA, 21 bp, Homo sapiens
gtaccaggcacatggctgggg

SEQ ID NO: 2153645 - DNA, 19 bp, Homo sapiens
gtagccccagtgacagcta

SEQ ID NO: 2153646 - DNA, 13 bp, Homo sapiens
gtaggaaatgtgg

SEQ ID NO: 2153647 - DNA, 14 bp, Homo sapiens
gtaggaggtttgga

SEQ ID NO: 2153648 - DNA, 14 bp, Homo sapiens
gtatagatgcaaga

SEQ ID NO: 2153649 - DNA, 16 bp, Homo sapiens
gtatagatgcaagata

SEQ ID NO: 2153650 - DNA, 18 bp, Homo sapiens
gtatatatatatatatgt

SEQ ID NO: 2153651 - DNA, 23 bp, Homo sapiens
gtatatatatatatatgtacagt

SEQ ID NO: 2153652 - DNA, 17 bp, Homo sapiens
gtatatgtatatctata

SEQ ID NO: 2153653 - DNA, 14 bp, Homo sapiens
gtatattagtttga

SEQ ID NO: 2153654 - DNA, 15 bp, Homo sapiens
gtcaaaacagattgt

SEQ ID NO: 2153655 - DNA, 16 bp, Homo sapiens
gtcaatattaaataca

SEQ ID NO: 2153656 - DNA, 16 bp, Homo sapiens
gtcacaataaagttta

SEQ ID NO: 2153657 - DNA, 14 bp, Homo sapiens
gtcaccctggccac

SEQ ID NO: 2153658 - DNA, 14 bp, Homo sapiens
gtcacttgccacat

SEQ ID NO: 2153659 - DNA, 16 bp, Homo sapiens
gtcagccgagccgggc

SEQ ID NO: 2153660 - DNA, 17 bp, Homo sapiens
gtccatccccttccccc

SEQ ID NO: 2153661 - DNA, 16 bp, Homo sapiens
gtccatcctcctctcc

SEQ ID NO: 2153662 - DNA, 17 bp, Homo sapiens
gtccatcctcctctcca

SEQ ID NO: 2153663 - DNA, 22 bp, Homo sapiens
gtccatcctcctctccatgcaa

SEQ ID NO: 2153664 - DNA, 21 bp, Homo sapiens
gtcccaagtagtagtgtcttc

SEQ ID NO: 2153665 - DNA, 14 bp, Homo sapiens
gtcccacccaggaa

SEQ ID NO: 2153666 - DNA, 15 bp, Homo sapiens
gtcccctcacagact

SEQ ID NO: 2153667 - DNA, 15 bp, Homo sapiens
gtcccctggggctgg

SEQ ID NO: 2153668 - DNA, 19 bp, Homo sapiens
gtcccctggggctggtgga

SEQ ID NO: 2153669 - DNA, 17 bp, Homo sapiens
gtccctggggcactccc

SEQ ID NO: 2153670 - DNA, 19 bp, Homo sapiens
gtccctggggcactccccc

SEQ ID NO: 2153671 - DNA, 19 bp, Homo sapiens
gtccctttttgcaggggac

SEQ ID NO: 2153672 - DNA, 20 bp, Homo sapiens
gtccctttttgcaggggact

SEQ ID NO: 2153673 - DNA, 13 bp, Homo sapiens
gtcctcacagcct

SEQ ID NO: 2153674 - DNA, 15 bp, Homo sapiens
gtcctcacagcctct

SEQ ID NO: 2153675 - DNA, 17 bp, Homo sapiens
gtcctcacagcctctcc

SEQ ID NO: 2153676 - DNA, 19 bp, Homo sapiens
gtcctcggcccatctgtcc

SEQ ID NO: 2153677 - DNA, 17 bp, Homo sapiens
gtcctgctggcctgctc

SEQ ID NO: 2153678 - DNA, 18 bp, Homo sapiens
gtcctgctggcctgctct

SEQ ID NO: 2153679 - DNA, 18 bp, Homo sapiens
gtccttactcagagctgc

SEQ ID NO: 2153680 - DNA, 20 bp, Homo sapiens
gtccttgcctgaactccaga

SEQ ID NO: 2153681 - DNA, 20 bp, Homo sapiens
gtccttggcaggctgatttc

SEQ ID NO: 2153682 - DNA, 16 bp, Homo sapiens
gtcgactttgagctgg

SEQ ID NO: 2153683 - DNA, 13 bp, Homo sapiens
gtcgattagactg

SEQ ID NO: 2153684 - DNA, 21 bp, Homo sapiens
gtctatcaaccccagacactg

SEQ ID NO: 2153685 - DNA, 14 bp, Homo sapiens
gtctcacactcctc

SEQ ID NO: 2153686 - DNA, 15 bp, Homo sapiens
gtctcacactcctcc

SEQ ID NO: 2153687 - DNA, 16 bp, Homo sapiens
gtctcacactcctcct

SEQ ID NO: 2153688 - DNA, 21 bp, Homo sapiens
gtctcacactcctcctgccag

SEQ ID NO: 2153689 - DNA, 11 bp, Homo sapiens
gtctcccaaca

SEQ ID NO: 2153690 - DNA, 22 bp, Homo sapiens
gtctcctgtgcccacatcccag

SEQ ID NO: 2153691 - DNA, 18 bp, Homo sapiens
gtctcctttgcactgagg

SEQ ID NO: 2153692 - DNA, 20 bp, Homo sapiens
gtctcctttgcactgagggc

SEQ ID NO: 2153693 - DNA, 13 bp, Homo sapiens
gtctctctgcctg

SEQ ID NO: 2153694 - DNA, 20 bp, Homo sapiens
gtctctctgcctgctgggct

SEQ ID NO: 2153695 - DNA, 12 bp, Homo sapiens
gtctctctgtga

SEQ ID NO: 2153696 - DNA, 13 bp, Homo sapiens
gtctctctgtgaa

SEQ ID NO: 2153697 - DNA, 16 bp, Homo sapiens
gtctctctgtgaatac

SEQ ID NO: 2153698 - DNA, 21 bp, Homo sapiens
gtctctctgtgaatacaatta

SEQ ID NO: 2153699 - DNA, 19 bp, Homo sapiens
gtctctgcctggagcaggg

SEQ ID NO: 2153700 - DNA, 15 bp, Homo sapiens
gtctctggctcagct

SEQ ID NO: 2153701 - DNA, 18 bp, Homo sapiens
gtctctggctcagctgtg

SEQ ID NO: 2153702 - DNA, 20 bp, Homo sapiens
gtctctggctcagctgtggt

SEQ ID NO: 2153703 - DNA, 21 bp, Homo sapiens
gtctgtccaacccctccccca

SEQ ID NO: 2153704 - DNA, 21 bp, Homo sapiens
tctcctcccatggccttccct

SEQ ID NO: 2153705 - DNA, 15 bp, Homo sapiens
tctcctgtgcccaca

SEQ ID NO: 2153706 - DNA, 17 bp, Homo sapiens
tctcctgtgcccacatc

SEQ ID NO: 2153707 - DNA, 18 bp, Homo sapiens
tctcctgtgcccacatcc

SEQ ID NO: 2153708 - DNA, 17 bp, Homo sapiens
tctcctttgcactgagg

SEQ ID NO: 2153709 - DNA, 22 bp, Homo sapiens
tctcctttgcactgagggccac

SEQ ID NO: 2153710 - DNA, 14 bp, Homo sapiens
tctctcaggagcac

SEQ ID NO: 2153711 - DNA, 15 bp, Homo sapiens
tctctcaggagcaca

SEQ ID NO: 2153712 - DNA, 18 bp, Homo sapiens
tctctcaggagcacaggc

SEQ ID NO: 2153713 - DNA, 11 bp, Homo sapiens
tctctccagcc

SEQ ID NO: 2153714 - DNA, 16 bp, Homo sapiens
tctctccagcctcaca

SEQ ID NO: 2153715 - DNA, 24 bp, Homo sapiens
tctctccagcctcacagatgctgg

SEQ ID NO: 2153716 - DNA, 15 bp, Homo sapiens
tctctctgcctgctg

SEQ ID NO: 2153717 - DNA, 12 bp, Homo sapiens
tctctctgtgaa

SEQ ID NO: 2153718 - DNA, 18 bp, Homo sapiens
tctctgagtgtctctgcc

SEQ ID NO: 2153719 - DNA, 19 bp, Homo sapiens
tctctgagtgtctctgcct

SEQ ID NO: 2153720 - DNA, 22 bp, Homo sapiens
tctctgagtgtctctgcctgga

SEQ ID NO: 2153721 - DNA, 14 bp, Homo sapiens
tctctgcctgctgg

SEQ ID NO: 2153722 - DNA, 13 bp, Homo sapiens
tctctggctcagc

SEQ ID NO: 2153723 - DNA, 15 bp, Homo sapiens
tctctggctcagctg

SEQ ID NO: 2153724 - DNA, 17 bp, Homo sapiens
tctctggctcagctgtg

SEQ ID NO: 2153725 - DNA, 23 bp, Homo sapiens
tctctggctcagctgtggtccca

SEQ ID NO: 2153726 - DNA, 18 bp, Homo sapiens
tctctgtgaatacaatta

SEQ ID NO: 2153727 - DNA, 19 bp, Homo sapiens
tctctgtgaatacaattaa

SEQ ID NO: 2153728 - DNA, 17 bp, Homo sapiens
tctgacattctgattcg

SEQ ID NO: 2153729 - DNA, 16 bp, Homo sapiens
tctgagaagtgtatat

SEQ ID NO: 2153730 - DNA, 15 bp, Homo sapiens
tctgagtgtctctgc

SEQ ID NO: 2153731 - DNA, 17 bp, Homo sapiens
tctgagtgtctctgcct

SEQ ID NO: 2153732 - DNA, 18 bp, Homo sapiens
tctgagtgtctctgcctg

SEQ ID NO: 2153733 - DNA, 20 bp, Homo sapiens
tctgagtgtctctgcctgga

SEQ ID NO: 2153734 - DNA, 20 bp, Homo sapiens
tctgattcgaatgacactgt

SEQ ID NO: 2153735 - DNA, 17 bp, Homo sapiens
tctgcctcatcctcctc

SEQ ID NO: 2153736 - DNA, 18 bp, Homo sapiens
tctgcctcatcctcctcc

SEQ ID NO: 2153737 - DNA, 17 bp, Homo sapiens
tctgcctctaactccct

SEQ ID NO: 2153738 - DNA, 22 bp, Homo sapiens
tctgcctctaactccctcctca

SEQ ID NO: 2153739 - DNA, 15 bp, Homo sapiens
tctgcctgctgggct

SEQ ID NO: 2153740 - DNA, 16 bp, Homo sapiens
tctgcctgctgggctc

SEQ ID NO: 2153741 - DNA, 14 bp, Homo sapiens
tctgctggcctgga

SEQ ID NO: 2153742 - DNA, 12 bp, Homo sapiens
tctggacaagcc

SEQ ID NO: 2153743 - DNA, 20 bp, Homo sapiens
tctggcaccactagggtcct

SEQ ID NO: 2153744 - DNA, 22 bp, Homo sapiens
tctggctcagctgtggtcccac

SEQ ID NO: 2153745 - DNA, 12 bp, Homo sapiens
tctggttgcctc

SEQ ID NO: 2153746 - DNA, 13 bp, Homo sapiens
tctggttgcctcc

SEQ ID NO: 2153747 - DNA, 14 bp, Homo sapiens
tctggttgcctccc

SEQ ID NO: 2153748 - DNA, 15 bp, Homo sapiens
tctggttgcctcccc

SEQ ID NO: 2153749 - DNA, 14 bp, Homo sapiens
tctgtcaccctggc

SEQ ID NO: 2153750 - DNA, 21 bp, Homo sapiens
tctgtcaccctggccaccacc

SEQ ID NO: 2153751 - DNA, 12 bp, Homo sapiens
tctgtccaaccc

SEQ ID NO: 2153752 - DNA, 16 bp, Homo sapiens
tctgtccatcctcctc

SEQ ID NO: 2153753 - DNA, 17 bp, Homo sapiens
tctgtccatcctcctct

SEQ ID NO: 2153754 - DNA, 15 bp, Homo sapiens
tctgtgaatacaatt

SEQ ID NO: 2153755 - DNA, 14 bp, Homo sapiens
tcttaactgttgct

SEQ ID NO: 2153756 - DNA, 15 bp, Homo sapiens
tcttacttcccccac

SEQ ID NO: 2153757 - DNA, 22 bp, Homo sapiens
tcttacttcccccaccctgggt

SEQ ID NO: 2153758 - DNA, 21 bp, Homo sapiens
tcttattcatgctttctcctt

SEQ ID NO: 2153759 - DNA, 21 bp, Homo sapiens
tcttcttattcatgctttctc

SEQ ID NO: 2153760 - DNA, 12 bp, Homo sapiens
tcttgggcctga

SEQ ID NO: 2153761 - DNA, 14 bp, Homo sapiens
tgaaaacccctggc

SEQ ID NO: 2153762 - DNA, 21 bp, Homo sapiens
tgaaattcaacctgtgtctta

SEQ ID NO: 2153763 - DNA, 12 bp, Homo sapiens
tgaacaaaagct

SEQ ID NO: 2153764 - DNA, 16 bp, Homo sapiens
tgaacacactcagcag

SEQ ID NO: 2153765 - DNA, 18 bp, Homo sapiens
tgaacagtgctctgcctc

SEQ ID NO: 2153766 - DNA, 11 bp, Homo sapiens
tgaactccaga

SEQ ID NO: 2153767 - DNA, 12 bp, Homo sapiens
tgaactccagag

SEQ ID NO: 2153768 - DNA, 13 bp, Homo sapiens
tgaactccagagg

SEQ ID NO: 2153769 - DNA, 18 bp, Homo sapiens
tgaatacaattaaaggtc

SEQ ID NO: 2153770 - DNA, 22 bp, Homo sapiens
tgacagatgtcagccgagccgg

SEQ ID NO: 2153771 - DNA, 22 bp, Homo sapiens
tgacagctaggatgtgcattct

SEQ ID NO: 2153772 - DNA, 21 bp, Homo sapiens
tgacatcagaagtaactccca

SEQ ID NO: 2153773 - DNA, 20 bp, Homo sapiens
tgacccggattggccctgcc

SEQ ID NO: 2153774 - DNA, 22 bp, Homo sapiens
tgacccggctgggtcggccctg

SEQ ID NO: 2153775 - DNA, 16 bp, Homo sapiens
tgacctccagtcctgc

SEQ ID NO: 2153776 - DNA, 17 bp, Homo sapiens
tgacctccagtcctgct

SEQ ID NO: 2153777 - DNA, 21 bp, Homo sapiens
tgacctccagtcctgctggcc

SEQ ID NO: 2153778 - DNA, 20 bp, Homo sapiens
tgactgtttttcggacagtt

SEQ ID NO: 2153779 - DNA, 15 bp, Homo sapiens
tgagaagagggcctg

SEQ ID NO: 2153780 - DNA, 16 bp, Homo sapiens
tgagaagagggcctgt

SEQ ID NO: 2153781 - DNA, 20 bp, Homo sapiens
tgagaagagggcctgtggga

SEQ ID NO: 2153782 - DNA, 14 bp, Homo sapiens
tgagaagtgtatat

SEQ ID NO: 2153783 - DNA, 12 bp, Homo sapiens
tgagaccagttg

SEQ ID NO: 2153784 - DNA, 21 bp, Homo sapiens
tgagaccagttgggagcactg

SEQ ID NO: 2153785 - DNA, 14 bp, Homo sapiens
tgagagttccagat

SEQ ID NO: 2153786 - DNA, 16 bp, Homo sapiens
tgagcagtagaagcct

SEQ ID NO: 2153787 - DNA, 19 bp, Homo sapiens
tgagcattagctacttttc

SEQ ID NO: 2153788 - DNA, 11 bp, Homo sapiens
tgagccccacc

SEQ ID NO: 2153789 - DNA, 23 bp, Homo sapiens
tgaggatcccctgtcccctgggg

SEQ ID NO: 2153790 - DNA, 22 bp, Homo sapiens
tgaggccggccctgcccctccc

SEQ ID NO: 2153791 - DNA, 12 bp, Homo sapiens
tgaggcctccct

SEQ ID NO: 2153792 - DNA, 14 bp, Homo sapiens
tgagggtggagact

SEQ ID NO: 2153793 - DNA, 15 bp, Homo sapiens
tgagtaggccctgct

SEQ ID NO: 2153794 - DNA, 15 bp, Homo sapiens
tgagtctgaggcccc

SEQ ID NO: 2153795 - DNA, 18 bp, Homo sapiens
tgagtgtctctgcctgga

SEQ ID NO: 2153796 - DNA, 14 bp, Homo sapiens
tgatgctcaggctt

SEQ ID NO: 2153797 - DNA, 23 bp, Homo sapiens
tgatgtccagaagaatattcagg

SEQ ID NO: 2153798 - DNA, 13 bp, Homo sapiens
tgatttaatatct

SEQ ID NO: 2153799 - DNA, 11 bp, Homo sapiens
tgatttctagg

SEQ ID NO: 2153800 - DNA, 22 bp, Homo sapiens
tgcaacaagacaaagcaaagcc

SEQ ID NO: 2153801 - DNA, 13 bp, Homo sapiens
tgcaaccactgca

SEQ ID NO: 2153802 - DNA, 12 bp, Homo sapiens
tgcacagagggc

SEQ ID NO: 2153803 - DNA, 17 bp, Homo sapiens
tgcaccagcccttccct

SEQ ID NO: 2153804 - DNA, 18 bp, Homo sapiens
tgcaccagcccttccctg

SEQ ID NO: 2153805 - DNA, 13 bp, Homo sapiens
tgcacctccccaa

SEQ ID NO: 2153806 - DNA, 16 bp, Homo sapiens
tgcactgagggccaca

SEQ ID NO: 2153807 - DNA, 17 bp, Homo sapiens
tgcactgagggccacac

SEQ ID NO: 2153808 - DNA, 19 bp, Homo sapiens
tgcactgagggccacacta

SEQ ID NO: 2153809 - DNA, 14 bp, Homo sapiens
tgcaggggactggg

SEQ ID NO: 2153810 - DNA, 15 bp, Homo sapiens
tgccactctgctgcc

SEQ ID NO: 2153811 - DNA, 20 bp, Homo sapiens
tgccagccgtgatgctcagg

SEQ ID NO: 2153812 - DNA, 12 bp, Homo sapiens
tgccagctctgt

SEQ ID NO: 2153813 - DNA, 14 bp, Homo sapiens
tgccagctctgtca

SEQ ID NO: 2153814 - DNA, 19 bp, Homo sapiens
tgccagctctgtcaccctg

SEQ ID NO: 2153815 - DNA, 15 bp, Homo sapiens
agaagtaactcccac

SEQ ID NO: 2153816 - DNA, 16 bp, Homo sapiens
agaagtaactcccact

SEQ ID NO: 2153817 - DNA, 12 bp, Homo sapiens
agaatattcagg

SEQ ID NO: 2153818 - DNA, 17 bp, Homo sapiens
agaatgtaaagcttgtc

SEQ ID NO: 2153819 - DNA, 14 bp, Homo sapiens
agaatgtgctgcct

SEQ ID NO: 2153820 - DNA, 12 bp, Homo sapiens
agacaaagcaaa

SEQ ID NO: 2153821 - DNA, 14 bp, Homo sapiens
agacaagcaacagg

SEQ ID NO: 2153822 - DNA, 12 bp, Homo sapiens
agacactggttt

SEQ ID NO: 2153823 - DNA, 15 bp, Homo sapiens
agacacttgccttct

SEQ ID NO: 2153824 - DNA, 22 bp, Homo sapiens
agacatggagactcctgccctg

SEQ ID NO: 2153825 - DNA, 22 bp, Homo sapiens
agaccaccagccgccccagccc

SEQ ID NO: 2153826 - DNA, 23 bp, Homo sapiens
agaccaccagccgccccagcccc

SEQ ID NO: 2153827 - DNA, 16 bp, Homo sapiens
agacctttgcccacac

SEQ ID NO: 2153828 - DNA, 15 bp, Homo sapiens
agactaagccctgtc

SEQ ID NO: 2153829 - DNA, 23 bp, Homo sapiens
agactaagccctgtcgagacact

SEQ ID NO: 2153830 - DNA, 14 bp, Homo sapiens
agactcctgccctg

SEQ ID NO: 2153831 - DNA, 20 bp, Homo sapiens
agactcttccaccagagcag

SEQ ID NO: 2153832 - DNA, 14 bp, Homo sapiens
agactggacagctt

SEQ ID NO: 2153833 - DNA, 23 bp, Homo sapiens
agactgttgctcaaatctattca

SEQ ID NO: 2153834 - DNA, 19 bp, Homo sapiens
agacttccaaacctgacag

SEQ ID NO: 2153835 - DNA, 21 bp, Homo sapiens
agacttccaaacctgacagat

SEQ ID NO: 2153836 - DNA, 13 bp, Homo sapiens
agacttgacagtg

SEQ ID NO: 2153837 - DNA, 22 bp, Homo sapiens
agagacattaactcattagact

SEQ ID NO: 2153838 - DNA, 23 bp, Homo sapiens
agagacattaactcattagactg

SEQ ID NO: 2153839 - DNA, 17 bp, Homo sapiens
agagcaggggctgctgg

SEQ ID NO: 2153840 - DNA, 18 bp, Homo sapiens
agagcaggggctgctggg

SEQ ID NO: 2153841 - DNA, 12 bp, Homo sapiens
agagctgcctcc

SEQ ID NO: 2153842 - DNA, 16 bp, Homo sapiens
agagctgcgggctgag

SEQ ID NO: 2153843 - DNA, 14 bp, Homo sapiens
agagctttgtcact

SEQ ID NO: 2153844 - DNA, 17 bp, Homo sapiens
agagctttgtcacttgc

SEQ ID NO: 2153845 - DNA, 19 bp, Homo sapiens
agagctttgtcacttgcca

SEQ ID NO: 2153846 - DNA, 23 bp, Homo sapiens
agagcttttcgaactgtgctccc

SEQ ID NO: 2153847 - DNA, 15 bp, Homo sapiens
agagggcctgtggga

SEQ ID NO: 2153848 - DNA, 13 bp, Homo sapiens
agaggggcgggct

SEQ ID NO: 2153849 - DNA, 17 bp, Homo sapiens
agagtctctccagcctc

SEQ ID NO: 2153850 - DNA, 19 bp, Homo sapiens
agagtctctccagcctcac

SEQ ID NO: 2153851 - DNA, 12 bp, Homo sapiens
agagtctctggc

SEQ ID NO: 2153852 - DNA, 12 bp, Homo sapiens
agatagaatgac

SEQ ID NO: 2153853 - DNA, 16 bp, Homo sapiens
agatagaatgacagtc

SEQ ID NO: 2153854 - DNA, 17 bp, Homo sapiens
agatataaatggctggt

SEQ ID NO: 2153855 - DNA, 14 bp, Homo sapiens
agatatttatatat

SEQ ID NO: 2153856 - DNA, 14 bp, Homo sapiens
agatcaccagcccg

SEQ ID NO: 2153857 - DNA, 15 bp, Homo sapiens
agatcaccagcccgg

SEQ ID NO: 2153858 - DNA, 21 bp, Homo sapiens
agatcaccagcccggcctgct

SEQ ID NO: 2153859 - DNA, 13 bp, Homo sapiens
agatccaggcttc

SEQ ID NO: 2153860 - DNA, 20 bp, Homo sapiens
agatctttttgtgaaattca

SEQ ID NO: 2153861 - DNA, 13 bp, Homo sapiens
agatgcaagatat

SEQ ID NO: 2153862 - DNA, 15 bp, Homo sapiens
agattatatatcata

SEQ ID NO: 2153863 - DNA, 18 bp, Homo sapiens
agcaatgatgtccagaag

SEQ ID NO: 2153864 - DNA, 20 bp, Homo sapiens
agcaatgatgtccagaagaa

SEQ ID NO: 2153865 - DNA, 21 bp, Homo sapiens
agcacaagttatttaaatctg

SEQ ID NO: 2153866 - DNA, 14 bp, Homo sapiens
agcacagctcctcc

SEQ ID NO: 2153867 - DNA, 21 bp, Homo sapiens
agcacagctcctcccctgccg

SEQ ID NO: 2153868 - DNA, 14 bp, Homo sapiens
agcaccagaatgta

SEQ ID NO: 2153869 - DNA, 16 bp, Homo sapiens
agcactggagtgcagg

SEQ ID NO: 2153870 - DNA, 23 bp, Homo sapiens
agcactggagtgcagggaggaga

SEQ ID NO: 2153871 - DNA, 19 bp, Homo sapiens
agcagactcagctctgaca

SEQ ID NO: 2153872 - DNA, 18 bp, Homo sapiens
agcagcaggcctctggtt

SEQ ID NO: 2153873 - DNA, 15 bp, Homo sapiens
agcaggcagcgcctg

SEQ ID NO: 2153874 - DNA, 14 bp, Homo sapiens
agcaggcctctggt

SEQ ID NO: 2153875 - DNA, 15 bp, Homo sapiens
agcaggcctctggtt

SEQ ID NO: 2153876 - DNA, 20 bp, Homo sapiens
agcaggcctctggttgcctc

SEQ ID NO: 2153877 - DNA, 16 bp, Homo sapiens
agcaggggctgctggg

SEQ ID NO: 2153878 - DNA, 17 bp, Homo sapiens
agcaggggctgctgggg

SEQ ID NO: 2153879 - DNA, 20 bp, Homo sapiens
agcatcctccccaccagagc

SEQ ID NO: 2153880 - DNA, 22 bp, Homo sapiens
agcatgggactgtgcctttggg

SEQ ID NO: 2153881 - DNA, 18 bp, Homo sapiens
agccaacttgtaaataca

SEQ ID NO: 2153882 - DNA, 19 bp, Homo sapiens
agccaacttgtaaatacac

SEQ ID NO: 2153883 - DNA, 13 bp, Homo sapiens
agccaccgcagct

SEQ ID NO: 2153884 - DNA, 16 bp, Homo sapiens
agccaccgcagctgct

SEQ ID NO: 2153885 - DNA, 17 bp, Homo sapiens
agccaccgcagctgctg

SEQ ID NO: 2153886 - DNA, 18 bp, Homo sapiens
agccaccgcagctgctgc

SEQ ID NO: 2153887 - DNA, 22 bp, Homo sapiens
agccaccgcagctgctgccact

SEQ ID NO: 2153888 - DNA, 18 bp, Homo sapiens
agccagattttttaaaat

SEQ ID NO: 2153889 - DNA, 23 bp, Homo sapiens
agccagattttttaaaatttata

SEQ ID NO: 2153890 - DNA, 17 bp, Homo sapiens
agccatcaagagactga

SEQ ID NO: 2153891 - DNA, 21 bp, Homo sapiens
agcccattgtggaggcggtgg

SEQ ID NO: 2153892 - DNA, 15 bp, Homo sapiens
agccccacctctcca

SEQ ID NO: 2153893 - DNA, 16 bp, Homo sapiens
agcccccaccccagca

SEQ ID NO: 2153894 - DNA, 17 bp, Homo sapiens
agcccccaccccagcac

SEQ ID NO: 2153895 - DNA, 15 bp, Homo sapiens
agccccgcctgtcac

SEQ ID NO: 2153896 - DNA, 21 bp, Homo sapiens
agcccggcctgctcccagcag

SEQ ID NO: 2153897 - DNA, 16 bp, Homo sapiens
agccctaaggatctct

SEQ ID NO: 2153898 - DNA, 17 bp, Homo sapiens
agcccttccctgctttg

SEQ ID NO: 2153899 - DNA, 13 bp, Homo sapiens
agccgggcctggg

SEQ ID NO: 2153900 - DNA, 19 bp, Homo sapiens
agcctcacagatgctggcc

SEQ ID NO: 2153901 - DNA, 22 bp, Homo sapiens
agcctcacagatgctggcctct

SEQ ID NO: 2153902 - DNA, 23 bp, Homo sapiens
agcctcacttttaatgaacaaat

SEQ ID NO: 2153903 - DNA, 16 bp, Homo sapiens
agcctgagtctcctgt

SEQ ID NO: 2153904 - DNA, 17 bp, Homo sapiens
agcctgagtctcctgtg

SEQ ID NO: 2153905 - DNA, 18 bp, Homo sapiens
agcctgagtctcctgtgc

SEQ ID NO: 2153906 - DNA, 22 bp, Homo sapiens
agcgcctgtcccctcacagact

SEQ ID NO: 2153907 - DNA, 17 bp, Homo sapiens
agctaatctgtagggct

SEQ ID NO: 2153908 - DNA, 13 bp, Homo sapiens
agctcctcccctg

SEQ ID NO: 2153909 - DNA, 15 bp, Homo sapiens
agctcctcccctgcc

SEQ ID NO: 2153910 - DNA, 20 bp, Homo sapiens
agctcctcccctgccgcctc

SEQ ID NO: 2153911 - DNA, 22 bp, Homo sapiens
agctcctcccctgccgcctccc

SEQ ID NO: 2153912 - DNA, 19 bp, Homo sapiens
agctctgtcaccctggcca

SEQ ID NO: 2153913 - DNA, 14 bp, Homo sapiens
agctcttgggcctg

SEQ ID NO: 2153914 - DNA, 18 bp, Homo sapiens
agctcttgggcctgacct

SEQ ID NO: 2153915 - DNA, 20 bp, Homo sapiens
agctgaggacacaccccaca

SEQ ID NO: 2153916 - DNA, 16 bp, Homo sapiens
agctgaggcctccctt

SEQ ID NO: 2153917 - DNA, 14 bp, Homo sapiens
agctgcctccccaa

SEQ ID NO: 2153918 - DNA, 18 bp, Homo sapiens
agctgcctccccaatcca

SEQ ID NO: 2153919 - DNA, 16 bp, Homo sapiens
agctgcgggctgaggg

SEQ ID NO: 2153920 - DNA, 17 bp, Homo sapiens
agctgcgggctgagggc

SEQ ID NO: 2153921 - DNA, 13 bp, Homo sapiens
agctgctgccact

SEQ ID NO: 2153922 - DNA, 16 bp, Homo sapiens
agctgctgccactctg

SEQ ID NO: 2153923 - DNA, 18 bp, Homo sapiens
agctgctgccactctgct

SEQ ID NO: 2153924 - DNA, 16 bp, Homo sapiens
agctgggcccacagcc

SEQ ID NO: 2153925 - DNA, 11 bp, Homo sapiens
atttgcctgta

SEQ ID NO: 2153926 - DNA, 15 bp, Homo sapiens
atttgcctgtaacaa

SEQ ID NO: 2153927 - DNA, 21 bp, Homo sapiens
atttggcagaactgctggggc

SEQ ID NO: 2153928 - DNA, 18 bp, Homo sapiens
attttagcgtgctcactg

SEQ ID NO: 2153929 - DNA, 16 bp, Homo sapiens
attttgaaaacccctg

SEQ ID NO: 2153930 - DNA, 19 bp, Homo sapiens
attttgaaaacccctggct

SEQ ID NO: 2153931 - DNA, 17 bp, Homo sapiens
attttgtacaaagatat

SEQ ID NO: 2153932 - DNA, 21 bp, Homo sapiens
attttgtacaaagatatgcta

SEQ ID NO: 2153933 - DNA, 18 bp, Homo sapiens
atttttatatcagcctga

SEQ ID NO: 2153934 - DNA, 16 bp, Homo sapiens
atttttttattactga

SEQ ID NO: 2153935 - DNA, 11 bp, Homo sapiens
caaaacaatgc

SEQ ID NO: 2153936 - DNA, 18 bp, Homo sapiens
caaaacagattgtttgca

SEQ ID NO: 2153937 - DNA, 16 bp, Homo sapiens
caaaagttacatgttt

SEQ ID NO: 2153938 - DNA, 18 bp, Homo sapiens
caaaagttacatgtttgc

SEQ ID NO: 2153939 - DNA, 22 bp, Homo sapiens
caaagaactgccccatctcctc

SEQ ID NO: 2153940 - DNA, 18 bp, Homo sapiens
caaagcagcaggcctctg

SEQ ID NO: 2153941 - DNA, 14 bp, Homo sapiens
caaagccacatttt

SEQ ID NO: 2153942 - DNA, 18 bp, Homo sapiens
caaagggcagtaaagttt

SEQ ID NO: 2153943 - DNA, 20 bp, Homo sapiens
caaagggcagtaaagttttc

SEQ ID NO: 2153944 - DNA, 13 bp, Homo sapiens
caaagttatattt

SEQ ID NO: 2153945 - DNA, 14 bp, Homo sapiens
caaatctattcaga

SEQ ID NO: 2153946 - DNA, 16 bp, Homo sapiens
caaatctattcagaca

SEQ ID NO: 2153947 - DNA, 12 bp, Homo sapiens
caacatgggagg

SEQ ID NO: 2153948 - DNA, 14 bp, Homo sapiens
caacatgggaggga

SEQ ID NO: 2153949 - DNA, 23 bp, Homo sapiens
caacatgggagggatcagccccg

SEQ ID NO: 2153950 - DNA, 12 bp, Homo sapiens
caacctgcccct

SEQ ID NO: 2153951 - DNA, 14 bp, Homo sapiens
caacctgcccctcc

SEQ ID NO: 2153952 - DNA, 16 bp, Homo sapiens
caacttgtaaatacac

SEQ ID NO: 2153953 - DNA, 18 bp, Homo sapiens
caagaagacatggagact

SEQ ID NO: 2153954 - DNA, 17 bp, Homo sapiens
caagactgttgctcaaa

SEQ ID NO: 2153955 - DNA, 12 bp, Homo sapiens
caagagactgag

SEQ ID NO: 2153956 - DNA, 13 bp, Homo sapiens
caagagactgagt

SEQ ID NO: 2153957 - DNA, 17 bp, Homo sapiens
caagagtctctccagcc

SEQ ID NO: 2153958 - DNA, 16 bp, Homo sapiens
caagatatttatatat

SEQ ID NO: 2153959 - DNA, 21 bp, Homo sapiens
caagccaacttgtaaatacac

SEQ ID NO: 2153960 - DNA, 21 bp, Homo sapiens
caagccaccgcagctgctgcc

SEQ ID NO: 2153961 - DNA, 15 bp, Homo sapiens
caagccagatttttt

SEQ ID NO: 2153962 - DNA, 16 bp, Homo sapiens
caaggacaacctgccc

SEQ ID NO: 2153963 - DNA, 18 bp, Homo sapiens
caaggacaacctgcccct

SEQ ID NO: 2153964 - DNA, 20 bp, Homo sapiens
caaggacaacctgcccctcc

SEQ ID NO: 2153965 - DNA, 12 bp, Homo sapiens
caaggtctcaca

SEQ ID NO: 2153966 - DNA, 17 bp, Homo sapiens
caagtagtagtgtcttc

SEQ ID NO: 2153967 - DNA, 14 bp, Homo sapiens
caagtctctctgtg

SEQ ID NO: 2153968 - DNA, 18 bp, Homo sapiens
caagtctctctgtgaata

SEQ ID NO: 2153969 - DNA, 18 bp, Homo sapiens
caagtgctgtttgggcag

SEQ ID NO: 2153970 - DNA, 22 bp, Homo sapiens
caagtgctgtttgggcaggagt

SEQ ID NO: 2153971 - DNA, 20 bp, Homo sapiens
caatattaaatacagacact

SEQ ID NO: 2153972 - DNA, 22 bp, Homo sapiens
caatgttagcctcaatttctga

SEQ ID NO: 2153973 - DNA, 12 bp, Homo sapiens
caattcaaaaca

SEQ ID NO: 2153974 - DNA, 14 bp, Homo sapiens
cacacacactcctt

SEQ ID NO: 2153975 - DNA, 14 bp, Homo sapiens
cacacactccttcc

SEQ ID NO: 2153976 - DNA, 15 bp, Homo sapiens
cacacactccttccc

SEQ ID NO: 2153977 - DNA, 16 bp, Homo sapiens
cacacactccttcccc

SEQ ID NO: 2153978 - DNA, 14 bp, Homo sapiens
cacaccctgcctgc

SEQ ID NO: 2153979 - DNA, 17 bp, Homo sapiens
cacactattaccatgag

SEQ ID NO: 2153980 - DNA, 15 bp, Homo sapiens
cacactcagcagccc

SEQ ID NO: 2153981 - DNA, 14 bp, Homo sapiens
cacactccagaatt

SEQ ID NO: 2153982 - DNA, 10 bp, Homo sapiens
cacactccta

SEQ ID NO: 2153983 - DNA, 14 bp, Homo sapiens
cacactcctcctgc

SEQ ID NO: 2153984 - DNA, 15 bp, Homo sapiens
cacactcctcctgcc

SEQ ID NO: 2153985 - DNA, 16 bp, Homo sapiens
cacagactcttccacc

SEQ ID NO: 2153986 - DNA, 19 bp, Homo sapiens
cacagactcttccaccaga

SEQ ID NO: 2153987 - DNA, 15 bp, Homo sapiens
cacagatgctggcct

SEQ ID NO: 2153988 - DNA, 17 bp, Homo sapiens
cacagatgctggcctct

SEQ ID NO: 2153989 - DNA, 20 bp, Homo sapiens
cacagatgctggcctcttgg

SEQ ID NO: 2153990 - DNA, 21 bp, Homo sapiens
cacagatgctggcctcttggc

SEQ ID NO: 2153991 - DNA, 16 bp, Homo sapiens
cacagcaccagaatgt

SEQ ID NO: 2153992 - DNA, 15 bp, Homo sapiens
cacagcccccacccc

SEQ ID NO: 2153993 - DNA, 17 bp, Homo sapiens
cacagcccccaccccag

SEQ ID NO: 2153994 - DNA, 23 bp, Homo sapiens
cacagcccccaccccagcacagc

SEQ ID NO: 2153995 - DNA, 13 bp, Homo sapiens
cacagctcctccc

SEQ ID NO: 2153996 - DNA, 14 bp, Homo sapiens
cacagctcctcccc

SEQ ID NO: 2153997 - DNA, 13 bp, Homo sapiens
cacagtcctcaca

SEQ ID NO: 2153998 - DNA, 14 bp, Homo sapiens
cacagtcctcacag

SEQ ID NO: 2153999 - DNA, 16 bp, Homo sapiens
cacagtcctcacagcc

SEQ ID NO: 2154000 - DNA, 15 bp, Homo sapiens
cacatatttgatagt

SEQ ID NO: 2154001 - DNA, 12 bp, Homo sapiens
cacatggctggg

SEQ ID NO: 2154002 - DNA, 13 bp, Homo sapiens
cacatggctgggg

SEQ ID NO: 2154003 - DNA, 15 bp, Homo sapiens
cacatggtgtctccc

SEQ ID NO: 2154004 - DNA, 19 bp, Homo sapiens
caccaaggtctcacactcc

SEQ ID NO: 2154005 - DNA, 20 bp, Homo sapiens
caccaaggtctcacactcct

SEQ ID NO: 2154006 - DNA, 22 bp, Homo sapiens
caccaaggtctcacactcctcc

SEQ ID NO: 2154007 - DNA, 23 bp, Homo sapiens
caccaaggtctcacactcctcct

SEQ ID NO: 2154008 - DNA, 16 bp, Homo sapiens
caccacctcactcctg

SEQ ID NO: 2154009 - DNA, 18 bp, Homo sapiens
caccacctcactcctgtt

SEQ ID NO: 2154010 - DNA, 13 bp, Homo sapiens
caccactagggtc

SEQ ID NO: 2154011 - DNA, 21 bp, Homo sapiens
caccactagggtcctggccct

SEQ ID NO: 2154012 - DNA, 20 bp, Homo sapiens
caccagagcaggggctgctg

SEQ ID NO: 2154013 - DNA, 23 bp, Homo sapiens
caccagagcaggggctgctgggg

SEQ ID NO: 2154014 - DNA, 12 bp, Homo sapiens
caccagagctgc

SEQ ID NO: 2154015 - DNA, 14 bp, Homo sapiens
caccagagctgcct

SEQ ID NO: 2154016 - DNA, 15 bp, Homo sapiens
caccagagctgcctc

SEQ ID NO: 2154017 - DNA, 17 bp, Homo sapiens
caccagagctgcctccc

SEQ ID NO: 2154018 - DNA, 18 bp, Homo sapiens
caccagagctgcctcccc

SEQ ID NO: 2154019 - DNA, 23 bp, Homo sapiens
caccagagctgcctccccaatcc

SEQ ID NO: 2154020 - DNA, 14 bp, Homo sapiens
caccagcccttccc

SEQ ID NO: 2154021 - DNA, 15 bp, Homo sapiens
caccagcccttccct

SEQ ID NO: 2154022 - DNA, 20 bp, Homo sapiens
caccagcccttccctgcttt

SEQ ID NO: 2154023 - DNA, 15 bp, Homo sapiens
caccagccgccccag

SEQ ID NO: 2154024 - DNA, 16 bp, Homo sapiens
caccagccgccccagc

SEQ ID NO: 2154025 - DNA, 20 bp, Homo sapiens
caccagccgccccagcccct

SEQ ID NO: 2154026 - DNA, 13 bp, Homo sapiens
caccatgcaaggg

SEQ ID NO: 2154027 - DNA, 15 bp, Homo sapiens
cacccaacctgtcct

SEQ ID NO: 2154028 - DNA, 19 bp, Homo sapiens
cacccaacctgtccttact

SEQ ID NO: 2154029 - DNA, 16 bp, Homo sapiens
caccccacaccccagc

SEQ ID NO: 2154030 - DNA, 15 bp, Homo sapiens
caccccagcacagct

SEQ ID NO: 2154031 - DNA, 21 bp, Homo sapiens
caccccagcacagctcctccc

SEQ ID NO: 2154032 - DNA, 12 bp, Homo sapiens
caccccagccca

SEQ ID NO: 2154033 - DNA, 18 bp, Homo sapiens
caccccagcccaccctgc

SEQ ID NO: 2154034 - DNA, 19 bp, Homo sapiens
cacccgttctgctggcctg

SEQ ID NO: 2154035 - DNA, 23 bp, Homo sapiens
caccctgaatggttccatgcctg

SEQ ID NO: 2154036 - DNA, 21 bp, Homo sapiens
ccaccagagcaggggctgctg

SEQ ID NO: 2154037 - DNA, 17 bp, Homo sapiens
ccaccagagctgcctcc

SEQ ID NO: 2154038 - DNA, 21 bp, Homo sapiens
ccaccagccgccccagcccct

SEQ ID NO: 2154039 - DNA, 15 bp, Homo sapiens
ccacccaacctgtcc

SEQ ID NO: 2154040 - DNA, 22 bp, Homo sapiens
ccacccaattcaaaacattgtg

SEQ ID NO: 2154041 - DNA, 23 bp, Homo sapiens
ccacccaggaagggagggagctg

SEQ ID NO: 2154042 - DNA, 22 bp, Homo sapiens
ccaccccagcacagctcctccc

SEQ ID NO: 2154043 - DNA, 19 bp, Homo sapiens
ccacccgttctgctggcct

SEQ ID NO: 2154044 - DNA, 20 bp, Homo sapiens
ccaccctgggtttggcccct

SEQ ID NO: 2154045 - DNA, 14 bp, Homo sapiens
ccaccgcagctgct

SEQ ID NO: 2154046 - DNA, 16 bp, Homo sapiens
ccaccgcagctgctgc

SEQ ID NO: 2154047 - DNA, 19 bp, Homo sapiens
ccaccgcagctgctgccac

SEQ ID NO: 2154048 - DNA, 15 bp, Homo sapiens
ccacctcactcctgt

SEQ ID NO: 2154049 - DNA, 16 bp, Homo sapiens
ccacctctccaagtct

SEQ ID NO: 2154050 - DNA, 21 bp, Homo sapiens
ccacctctccaagtctctctg

SEQ ID NO: 2154051 - DNA, 18 bp, Homo sapiens
ccacggggaccactgggc

SEQ ID NO: 2154052 - DNA, 23 bp, Homo sapiens
ccacggggaccactgggcccctc

SEQ ID NO: 2154053 - DNA, 14 bp, Homo sapiens
ccacgtctctctgc

SEQ ID NO: 2154054 - DNA, 20 bp, Homo sapiens
ccacgtctctctgcctgctg

SEQ ID NO: 2154055 - DNA, 22 bp, Homo sapiens
ccacgtctctctgcctgctggg

SEQ ID NO: 2154056 - DNA, 17 bp, Homo sapiens
ccactaagctttctcct

SEQ ID NO: 2154057 - DNA, 18 bp, Homo sapiens
ccactaagctttctcctt

SEQ ID NO: 2154058 - DNA, 14 bp, Homo sapiens
ccactacctttgtc

SEQ ID NO: 2154059 - DNA, 22 bp, Homo sapiens
ccactagggtcctggccctctt

SEQ ID NO: 2154060 - DNA, 17 bp, Homo sapiens
ccactctgctgcctgta

SEQ ID NO: 2154061 - DNA, 16 bp, Homo sapiens
ccactgggcccctcag

SEQ ID NO: 2154062 - DNA, 16 bp, Homo sapiens
ccagaagaatattcag

SEQ ID NO: 2154063 - DNA, 19 bp, Homo sapiens
ccagaagaatattcaggac

SEQ ID NO: 2154064 - DNA, 14 bp, Homo sapiens
ccagaatgtgctgc

SEQ ID NO: 2154065 - DNA, 16 bp, Homo sapiens
ccagaatgtgctgcct

SEQ ID NO: 2154066 - DNA, 18 bp, Homo sapiens
ccagaatgtgctgccttt

SEQ ID NO: 2154067 - DNA, 18 bp, Homo sapiens
ccagaattacccttcctc

SEQ ID NO: 2154068 - DNA, 13 bp, Homo sapiens
ccagacactggtt

SEQ ID NO: 2154069 - DNA, 18 bp, Homo sapiens
ccagaccaccagccgccc

SEQ ID NO: 2154070 - DNA, 19 bp, Homo sapiens
ccagagacctttgcccaca

SEQ ID NO: 2154071 - DNA, 12 bp, Homo sapiens
ccagagcagggg

SEQ ID NO: 2154072 - DNA, 16 bp, Homo sapiens
ccagagcaggggctgc

SEQ ID NO: 2154073 - DNA, 13 bp, Homo sapiens
ccagagccactac

SEQ ID NO: 2154074 - DNA, 17 bp, Homo sapiens
ccagagccactaccttt

SEQ ID NO: 2154075 - DNA, 19 bp, Homo sapiens
ccagattgttctgtccagt

SEQ ID NO: 2154076 - DNA, 19 bp, Homo sapiens
ccagcacagctcctcccct

SEQ ID NO: 2154077 - DNA, 16 bp, Homo sapiens
ccagcagacttgagtc

SEQ ID NO: 2154078 - DNA, 14 bp, Homo sapiens
ccagcaggcagcgc

SEQ ID NO: 2154079 - DNA, 16 bp, Homo sapiens
ccagccccttctccca

SEQ ID NO: 2154080 - DNA, 15 bp, Homo sapiens
ccagcccggcctgct

SEQ ID NO: 2154081 - DNA, 17 bp, Homo sapiens
ccagcccggcctgctcc

SEQ ID NO: 2154082 - DNA, 19 bp, Homo sapiens
ccagcccggcctgctccca

SEQ ID NO: 2154083 - DNA, 20 bp, Homo sapiens
ccagcccggcctgctcccag

SEQ ID NO: 2154084 - DNA, 16 bp, Homo sapiens
ccagccgccccagccc

SEQ ID NO: 2154085 - DNA, 17 bp, Homo sapiens
ccagccgccccagcccc

SEQ ID NO: 2154086 - DNA, 18 bp, Homo sapiens
ccagccgccccagcccct

SEQ ID NO: 2154087 - DNA, 19 bp, Homo sapiens
ccagccgtgatgctcaggc

SEQ ID NO: 2154088 - DNA, 23 bp, Homo sapiens
ccagccgtgatgctcaggcttga

SEQ ID NO: 2154089 - DNA, 17 bp, Homo sapiens
ccagcctcacagatgct

SEQ ID NO: 2154090 - DNA, 19 bp, Homo sapiens
ccagcctcacagatgctgg

SEQ ID NO: 2154091 - DNA, 21 bp, Homo sapiens
ccagctaatctgtagggctgg

SEQ ID NO: 2154092 - DNA, 22 bp, Homo sapiens
ccagctaatctgtagggctgga

SEQ ID NO: 2154093 - DNA, 23 bp, Homo sapiens
ccagctaatctgtagggctggac

SEQ ID NO: 2154094 - DNA, 22 bp, Homo sapiens
ccaggaagggagggagctgagg

SEQ ID NO: 2154095 - DNA, 22 bp, Homo sapiens
ccaggaggtggctatggccacc

SEQ ID NO: 2154096 - DNA, 17 bp, Homo sapiens
ccaggcacatggctggg

SEQ ID NO: 2154097 - DNA, 18 bp, Homo sapiens
ccaggcacatggctgggg

SEQ ID NO: 2154098 - DNA, 19 bp, Homo sapiens
ccaggcttctcccggacct

SEQ ID NO: 2154099 - DNA, 21 bp, Homo sapiens
ccaggggtaccaggcacatgg

SEQ ID NO: 2154100 - DNA, 21 bp, Homo sapiens
ccagtcatggtactaccccag

SEQ ID NO: 2154101 - DNA, 14 bp, Homo sapiens
ccagtgacagctag

SEQ ID NO: 2154102 - DNA, 22 bp, Homo sapiens
ccatccccttcccccatcccta

SEQ ID NO: 2154103 - DNA, 14 bp, Homo sapiens
ccatcctcctctcc

SEQ ID NO: 2154104 - DNA, 15 bp, Homo sapiens
ccatcctcctctcca

SEQ ID NO: 2154105 - DNA, 19 bp, Homo sapiens
ccatcctcctctccatgca

SEQ ID NO: 2154106 - DNA, 18 bp, Homo sapiens
ccatctcctcccatggcc

SEQ ID NO: 2154107 - DNA, 15 bp, Homo sapiens
ccatctgtccatcct

SEQ ID NO: 2154108 - DNA, 18 bp, Homo sapiens
ccatctgtccatcctcct

SEQ ID NO: 2154109 - DNA, 20 bp, Homo sapiens
ccatctgtccatcctcctct

SEQ ID NO: 2154110 - DNA, 13 bp, Homo sapiens
ccatgagaagagg

SEQ ID NO: 2154111 - DNA, 18 bp, Homo sapiens
ccatgagaagagggcctg

SEQ ID NO: 2154112 - DNA, 21 bp, Homo sapiens
ccatgagaagagggcctgtgg

SEQ ID NO: 2154113 - DNA, 16 bp, Homo sapiens
ccatgcaagtgctgtt

SEQ ID NO: 2154114 - DNA, 15 bp, Homo sapiens
ccatgcctgagggtg

SEQ ID NO: 2154115 - DNA, 12 bp, Homo sapiens
ccatggccttcc

SEQ ID NO: 2154116 - DNA, 16 bp, Homo sapiens
ccatttggcagaactg

SEQ ID NO: 2154117 - DNA, 20 bp, Homo sapiens
ccatttggcagaactgctgg

SEQ ID NO: 2154118 - DNA, 23 bp, Homo sapiens
ccatttggcagaactgctggggc

SEQ ID NO: 2154119 - DNA, 22 bp, Homo sapiens
cccaaagcagcaggcctctggt

SEQ ID NO: 2154120 - DNA, 23 bp, Homo sapiens
cccaaagcagcaggcctctggtt

SEQ ID NO: 2154121 - DNA, 19 bp, Homo sapiens
cccaacatgggagggatca

SEQ ID NO: 2154122 - DNA, 23 bp, Homo sapiens
cccaacatgggagggatcagccc

SEQ ID NO: 2154123 - DNA, 23 bp, Homo sapiens
cccaatccatttggcagaactgc

SEQ ID NO: 2154124 - DNA, 14 bp, Homo sapiens
cccacacacactcc

SEQ ID NO: 2154125 - DNA, 16 bp, Homo sapiens
cccacacacactcctt

SEQ ID NO: 2154126 - DNA, 19 bp, Homo sapiens
cccacacacactccttccc

SEQ ID NO: 2154127 - DNA, 22 bp, Homo sapiens
cccacaccccagcccaccctgc

SEQ ID NO: 2154128 - DNA, 16 bp, Homo sapiens
cccacagcccccaccc

SEQ ID NO: 2154129 - DNA, 16 bp, Homo sapiens
cccacatcccaggctt

SEQ ID NO: 2154130 - DNA, 20 bp, Homo sapiens
cccaccaaggtctcacactc

SEQ ID NO: 2154131 - DNA, 12 bp, Homo sapiens
cccaccagagct

SEQ ID NO: 2154132 - DNA, 13 bp, Homo sapiens
cccaccagagctg

SEQ ID NO: 2154133 - DNA, 15 bp, Homo sapiens
cccaccagagctgcc

SEQ ID NO: 2154134 - DNA, 17 bp, Homo sapiens
cccaccagagctgcctc

SEQ ID NO: 2154135 - DNA, 12 bp, Homo sapiens
cccacccaggaa

SEQ ID NO: 2154136 - DNA, 12 bp, Homo sapiens
cccaccccagca

SEQ ID NO: 2154137 - DNA, 15 bp, Homo sapiens
cccaccccagcacag

SEQ ID NO: 2154138 - DNA, 16 bp, Homo sapiens
cccaccccagcacagc

SEQ ID NO: 2154139 - DNA, 12 bp, Homo sapiens
cccaccctgggt

SEQ ID NO: 2154140 - DNA, 22 bp, Homo sapiens
cccaccctgggtttggcccctg

SEQ ID NO: 2154141 - DNA, 12 bp, Homo sapiens
cccacgtctctc

SEQ ID NO: 2154142 - DNA, 16 bp, Homo sapiens
cccacgtctctctgcc

SEQ ID NO: 2154143 - DNA, 17 bp, Homo sapiens
cccacgtctctctgcct

SEQ ID NO: 2154144 - DNA, 21 bp, Homo sapiens
cccacgtctctctgcctgctg

SEQ ID NO: 2154145 - DNA, 18 bp, Homo sapiens
ctacacatatatgtatat

SEQ ID NO: 2154146 - DNA, 19 bp, Homo sapiens
ctacacatatatgtatatg

SEQ ID NO: 2154147 - DNA, 16 bp, Homo sapiens
ctacccaaccactcaa

SEQ ID NO: 2154148 - DNA, 15 bp, Homo sapiens
ctaccgcatggcagc

SEQ ID NO: 2154149 - DNA, 21 bp, Homo sapiens
ctaccgcatggcagctgggcc

SEQ ID NO: 2154150 - DNA, 22 bp, Homo sapiens
ctaccgcatggcagctgggccc

SEQ ID NO: 2154151 - DNA, 19 bp, Homo sapiens
ctacctttttttctctcct

SEQ ID NO: 2154152 - DNA, 15 bp, Homo sapiens
ctagctcttgggcct

SEQ ID NO: 2154153 - DNA, 19 bp, Homo sapiens
ctagctcttgggcctgacc

SEQ ID NO: 2154154 - DNA, 20 bp, Homo sapiens
ctagctcttgggcctgacct

SEQ ID NO: 2154155 - DNA, 22 bp, Homo sapiens
ctagctcttgggcctgacctcc

SEQ ID NO: 2154156 - DNA, 23 bp, Homo sapiens
ctagctcttgggcctgacctcca

SEQ ID NO: 2154157 - DNA, 14 bp, Homo sapiens
ctaggattcctccc

SEQ ID NO: 2154158 - DNA, 22 bp, Homo sapiens
ctaggattcctcccccagagcc

SEQ ID NO: 2154159 - DNA, 20 bp, Homo sapiens
ctaggggaaggactggccgt

SEQ ID NO: 2154160 - DNA, 17 bp, Homo sapiens
ctagggtcctggccctc

SEQ ID NO: 2154161 - DNA, 17 bp, Homo sapiens
ctaggtaggaaatgtgg

SEQ ID NO: 2154162 - DNA, 19 bp, Homo sapiens
ctagtctcctttgcactga

SEQ ID NO: 2154163 - DNA, 20 bp, Homo sapiens
ctatattccgggtgccattc

SEQ ID NO: 2154164 - DNA, 17 bp, Homo sapiens
ctatcaaccccagacac

SEQ ID NO: 2154165 - DNA, 19 bp, Homo sapiens
ctatcaaccccagacactg

SEQ ID NO: 2154166 - DNA, 20 bp, Homo sapiens
ctatcaaccccagacactgg

SEQ ID NO: 2154167 - DNA, 21 bp, Homo sapiens
ctatcaaccccagacactggt

SEQ ID NO: 2154168 - DNA, 15 bp, Homo sapiens
ctatgtcctaaggac

SEQ ID NO: 2154169 - DNA, 21 bp, Homo sapiens
ctatgtcctaaggacacacta

SEQ ID NO: 2154170 - DNA, 22 bp, Homo sapiens
ctcaaatctattcagacaagca

SEQ ID NO: 2154171 - DNA, 19 bp, Homo sapiens
ctcaagaagacatggagac

SEQ ID NO: 2154172 - DNA, 22 bp, Homo sapiens
ctcaagaagacatggagactcc

SEQ ID NO: 2154173 - DNA, 14 bp, Homo sapiens
ctcacactcctcct

SEQ ID NO: 2154174 - DNA, 15 bp, Homo sapiens
ctcacactcctcctg

SEQ ID NO: 2154175 - DNA, 19 bp, Homo sapiens
ctcacactcctcctgccag

SEQ ID NO: 2154176 - DNA, 16 bp, Homo sapiens
ctcacagatgctggcc

SEQ ID NO: 2154177 - DNA, 18 bp, Homo sapiens
ctcacagatgctggcctc

SEQ ID NO: 2154178 - DNA, 14 bp, Homo sapiens
ctcacagcctctcc

SEQ ID NO: 2154179 - DNA, 12 bp, Homo sapiens
ctcagagctgcg

SEQ ID NO: 2154180 - DNA, 23 bp, Homo sapiens
ctcagagcttttcgaactgtgct

SEQ ID NO: 2154181 - DNA, 21 bp, Homo sapiens
ctcagatggagacattggatg

SEQ ID NO: 2154182 - DNA, 18 bp, Homo sapiens
ctcagcagccccctgccc

SEQ ID NO: 2154183 - DNA, 19 bp, Homo sapiens
ctcagcagccccctgcccg

SEQ ID NO: 2154184 - DNA, 18 bp, Homo sapiens
ctcagctgtggtcccacc

SEQ ID NO: 2154185 - DNA, 12 bp, Homo sapiens
ctcaggagcaca

SEQ ID NO: 2154186 - DNA, 14 bp, Homo sapiens
ctcaggagcacagg

SEQ ID NO: 2154187 - DNA, 15 bp, Homo sapiens
ctcaggagcacaggc

SEQ ID NO: 2154188 - DNA, 17 bp, Homo sapiens
ctcaggggaagctgcta

SEQ ID NO: 2154189 - DNA, 22 bp, Homo sapiens
ctcaggggaagctgctagggga

SEQ ID NO: 2154190 - DNA, 12 bp, Homo sapiens
ctcatctgtgcc

SEQ ID NO: 2154191 - DNA, 13 bp, Homo sapiens
ctcatctgtgcct

SEQ ID NO: 2154192 - DNA, 17 bp, Homo sapiens
ctcatctgtgcctgtct

SEQ ID NO: 2154193 - DNA, 22 bp, Homo sapiens
ctcatctgtgcctgtctgtcca

SEQ ID NO: 2154194 - DNA, 13 bp, Homo sapiens
ctcattagactgg

SEQ ID NO: 2154195 - DNA, 22 bp, Homo sapiens
ctcatttttccgtaaaaatgat

SEQ ID NO: 2154196 - DNA, 16 bp, Homo sapiens
ctccaagtctctctgt

SEQ ID NO: 2154197 - DNA, 20 bp, Homo sapiens
ctccaagtctctctgtgaat

SEQ ID NO: 2154198 - DNA, 21 bp, Homo sapiens
ctccaagtctctctgtgaata

SEQ ID NO: 2154199 - DNA, 17 bp, Homo sapiens
ctccagaatgtgctgcc

SEQ ID NO: 2154200 - DNA, 23 bp, Homo sapiens
ctccagaattacccttcctcatc

SEQ ID NO: 2154201 - DNA, 12 bp, Homo sapiens
ctccagccagca

SEQ ID NO: 2154202 - DNA, 20 bp, Homo sapiens
ctccagccatcaagagactg

SEQ ID NO: 2154203 - DNA, 15 bp, Homo sapiens
ctccagcctcacaga

SEQ ID NO: 2154204 - DNA, 14 bp, Homo sapiens
ctccagtcatggta

SEQ ID NO: 2154205 - DNA, 23 bp, Homo sapiens
ctccagtcatggtactaccccag

SEQ ID NO: 2154206 - DNA, 17 bp, Homo sapiens
ctccagtcctgctggcc

SEQ ID NO: 2154207 - DNA, 18 bp, Homo sapiens
ctccagtcctgctggcct

SEQ ID NO: 2154208 - DNA, 21 bp, Homo sapiens
ctccagtcctgctggcctgct

SEQ ID NO: 2154209 - DNA, 22 bp, Homo sapiens
ctccagtcctgctggcctgctc

SEQ ID NO: 2154210 - DNA, 16 bp, Homo sapiens
ctcccagtcctccaga

SEQ ID NO: 2154211 - DNA, 18 bp, Homo sapiens
ctcccagtcctccagacc

SEQ ID NO: 2154212 - DNA, 19 bp, Homo sapiens
ctcccagtcctccagacca

SEQ ID NO: 2154213 - DNA, 17 bp, Homo sapiens
ctcccatggccttccct

SEQ ID NO: 2154214 - DNA, 14 bp, Homo sapiens
ctccccacagtcct

SEQ ID NO: 2154215 - DNA, 19 bp, Homo sapiens
ctccccacagtcctcacag

SEQ ID NO: 2154216 - DNA, 21 bp, Homo sapiens
ctccccacagtcctcacagcc

SEQ ID NO: 2154217 - DNA, 12 bp, Homo sapiens
ctccccaccaga

SEQ ID NO: 2154218 - DNA, 17 bp, Homo sapiens
ctccccaccagagctgc

SEQ ID NO: 2154219 - DNA, 18 bp, Homo sapiens
ctccccaccagagctgcc

SEQ ID NO: 2154220 - DNA, 22 bp, Homo sapiens
ctccccaccagagctgcctccc

SEQ ID NO: 2154221 - DNA, 13 bp, Homo sapiens
ctcccccagagcc

SEQ ID NO: 2154222 - DNA, 20 bp, Homo sapiens
ctcccctgaggatcccctgt

SEQ ID NO: 2154223 - DNA, 12 bp, Homo sapiens
ctcccctgccgc

SEQ ID NO: 2154224 - DNA, 20 bp, Homo sapiens
ctcccctgccgcctcccggg

SEQ ID NO: 2154225 - DNA, 22 bp, Homo sapiens
ctcccgggaagcatcctcccca

SEQ ID NO: 2154226 - DNA, 20 bp, Homo sapiens
ctccctagatccaggcttct

SEQ ID NO: 2154227 - DNA, 14 bp, Homo sapiens
ctccctcctcacac

SEQ ID NO: 2154228 - DNA, 19 bp, Homo sapiens
ctcccttgagtaggccctg

SEQ ID NO: 2154229 - DNA, 20 bp, Homo sapiens
ctcccttgagtaggccctgc

SEQ ID NO: 2154230 - DNA, 22 bp, Homo sapiens
ctcctaatcaagagtctctcca

SEQ ID NO: 2154231 - DNA, 15 bp, Homo sapiens
ctcctcacactccag

SEQ ID NO: 2154232 - DNA, 14 bp, Homo sapiens
ctcctcccatggcc

SEQ ID NO: 2154233 - DNA, 16 bp, Homo sapiens
ctcctcccatggcctt

SEQ ID NO: 2154234 - DNA, 15 bp, Homo sapiens
ctcctcccctgccgc

SEQ ID NO: 2154235 - DNA, 16 bp, Homo sapiens
ctcctccctctgcctc

SEQ ID NO: 2154236 - DNA, 13 bp, Homo sapiens
ctcctcctgccag

SEQ ID NO: 2154237 - DNA, 21 bp, Homo sapiens
ctcctcctgccagctctgtca

SEQ ID NO: 2154238 - DNA, 14 bp, Homo sapiens
ctcctcctgccctg

SEQ ID NO: 2154239 - DNA, 16 bp, Homo sapiens
ctcctcctgccctgtc

SEQ ID NO: 2154240 - DNA, 15 bp, Homo sapiens
ctcctctccatgcaa

SEQ ID NO: 2154241 - DNA, 21 bp, Homo sapiens
ctcctctccatgcaagtgctg

SEQ ID NO: 2154242 - DNA, 22 bp, Homo sapiens
ctcctctccatgcaagtgctgt

SEQ ID NO: 2154243 - DNA, 16 bp, Homo sapiens
ctcctgccagctctgt

SEQ ID NO: 2154244 - DNA, 16 bp, Homo sapiens
ctcctgccctgtccct

SEQ ID NO: 2154245 - DNA, 21 bp, Homo sapiens
ctcctgtgcccacatcccagg

SEQ ID NO: 2154246 - DNA, 18 bp, Homo sapiens
ctccttccccttgtccct

SEQ ID NO: 2154247 - DNA, 14 bp, Homo sapiens
ctcctttctccagc

SEQ ID NO: 2154248 - DNA, 17 bp, Homo sapiens
ctcctttctccagccag

SEQ ID NO: 2154249 - DNA, 18 bp, Homo sapiens
ctcctttctccagccagc

SEQ ID NO: 2154250 - DNA, 14 bp, Homo sapiens
ctcctttgcactga

SEQ ID NO: 2154251 - DNA, 20 bp, Homo sapiens
ctcctttgcactgagggcca

SEQ ID NO: 2154252 - DNA, 21 bp, Homo sapiens
ctcctttgcactgagggccac

SEQ ID NO: 2154253 - DNA, 16 bp, Homo sapiens
ctcctttttctacctt

SEQ ID NO: 2154254 - DNA, 16 bp, Homo sapiens
gaggggcgggctcaga

SEQ ID NO: 2154255 - DNA, 19 bp, Homo sapiens
gaggggcgggctcagagct

SEQ ID NO: 2154256 - DNA, 13 bp, Homo sapiens
gagtcaccatgca

SEQ ID NO: 2154257 - DNA, 16 bp, Homo sapiens
gagtctctccagcctc

SEQ ID NO: 2154258 - DNA, 20 bp, Homo sapiens
gagtctctccagcctcacag

SEQ ID NO: 2154259 - DNA, 21 bp, Homo sapiens
gagtctctggctcagctgtgg

SEQ ID NO: 2154260 - DNA, 23 bp, Homo sapiens
gagtgagcagtagaagcctgcag

SEQ ID NO: 2154261 - DNA, 14 bp, Homo sapiens
gagtgtctctgcct

SEQ ID NO: 2154262 - DNA, 16 bp, Homo sapiens
gatataaatggctggt

SEQ ID NO: 2154263 - DNA, 16 bp, Homo sapiens
gatatttatatatatt

SEQ ID NO: 2154264 - DNA, 14 bp, Homo sapiens
gatcaccagcccgg

SEQ ID NO: 2154265 - DNA, 15 bp, Homo sapiens
gatcaccagcccggc

SEQ ID NO: 2154266 - DNA, 18 bp, Homo sapiens
gatcagccccgcctgtca

SEQ ID NO: 2154267 - DNA, 21 bp, Homo sapiens
gatcagccccgcctgtcacaa

SEQ ID NO: 2154268 - DNA, 15 bp, Homo sapiens
gatccaggcttctcc

SEQ ID NO: 2154269 - DNA, 21 bp, Homo sapiens
gatcccctgtcccctggggct

SEQ ID NO: 2154270 - DNA, 18 bp, Homo sapiens
gatccctgttacccagag

SEQ ID NO: 2154271 - DNA, 13 bp, Homo sapiens
gatctctcaggag

SEQ ID NO: 2154272 - DNA, 14 bp, Homo sapiens
gatctctcaggagc

SEQ ID NO: 2154273 - DNA, 17 bp, Homo sapiens
gatctctcaggagcaca

SEQ ID NO: 2154274 - DNA, 21 bp, Homo sapiens
gatgctcaggcttgaaatgca

SEQ ID NO: 2154275 - DNA, 11 bp, Homo sapiens
gatgctggcct

SEQ ID NO: 2154276 - DNA, 12 bp, Homo sapiens
gatgctggcctc

SEQ ID NO: 2154277 - DNA, 14 bp, Homo sapiens
gatgctggcctctt

SEQ ID NO: 2154278 - DNA, 16 bp, Homo sapiens
gatgctggcctcttgg

SEQ ID NO: 2154279 - DNA, 22 bp, Homo sapiens
gatgctggcctcttggcacctg

SEQ ID NO: 2154280 - DNA, 15 bp, Homo sapiens
gatgggagtgagaca

SEQ ID NO: 2154281 - DNA, 19 bp, Homo sapiens
gattatatatcataaagta

SEQ ID NO: 2154282 - DNA, 22 bp, Homo sapiens
gattatatatcataaagtatgc

SEQ ID NO: 2154283 - DNA, 16 bp, Homo sapiens
gattcacatctcattt

SEQ ID NO: 2154284 - DNA, 17 bp, Homo sapiens
gattcctcccccagagc

SEQ ID NO: 2154285 - DNA, 18 bp, Homo sapiens
gattcctcccccagagcc

SEQ ID NO: 2154286 - DNA, 15 bp, Homo sapiens
gattggccctgcccc

SEQ ID NO: 2154287 - DNA, 19 bp, Homo sapiens
gattggccctgcccctccc

SEQ ID NO: 2154288 - DNA, 20 bp, Homo sapiens
gattgggcagaatcctgggc

SEQ ID NO: 2154289 - DNA, 19 bp, Homo sapiens
gattgtgcaatagtcagag

SEQ ID NO: 2154290 - DNA, 22 bp, Homo sapiens
gattgttctgtccagtttccaa

SEQ ID NO: 2154291 - DNA, 16 bp, Homo sapiens
gattgtttgcacagag

SEQ ID NO: 2154292 - DNA, 17 bp, Homo sapiens
gcaaagaactgccccat

SEQ ID NO: 2154293 - DNA, 13 bp, Homo sapiens
gcaaagttatatt

SEQ ID NO: 2154294 - DNA, 19 bp, Homo sapiens
gcaaggacaacctgcccct

SEQ ID NO: 2154295 - DNA, 21 bp, Homo sapiens
gcaataaagtgtagcaccctg

SEQ ID NO: 2154296 - DNA, 11 bp, Homo sapiens
gcacagctcct

SEQ ID NO: 2154297 - DNA, 14 bp, Homo sapiens
gcacaggcagctgg

SEQ ID NO: 2154298 - DNA, 16 bp, Homo sapiens
gcaccagaatgtatat

SEQ ID NO: 2154299 - DNA, 17 bp, Homo sapiens
gcaccagcccttccctg

SEQ ID NO: 2154300 - DNA, 18 bp, Homo sapiens
gcaccagcccttccctgc

SEQ ID NO: 2154301 - DNA, 18 bp, Homo sapiens
gcacctgcctagctcttg

SEQ ID NO: 2154302 - DNA, 12 bp, Homo sapiens
gcactcccccag

SEQ ID NO: 2154303 - DNA, 14 bp, Homo sapiens
gcactcccccagga

SEQ ID NO: 2154304 - DNA, 15 bp, Homo sapiens
gcactcccccaggat

SEQ ID NO: 2154305 - DNA, 16 bp, Homo sapiens
gcactgagggccacac

SEQ ID NO: 2154306 - DNA, 14 bp, Homo sapiens
gcactggagtgcag

SEQ ID NO: 2154307 - DNA, 19 bp, Homo sapiens
gcagaactgctggggctgg

SEQ ID NO: 2154308 - DNA, 20 bp, Homo sapiens
gcagaatcctgggcccccag

SEQ ID NO: 2154309 - DNA, 16 bp, Homo sapiens
gcagactcagctctga

SEQ ID NO: 2154310 - DNA, 15 bp, Homo sapiens
gcagatctttttgtg

SEQ ID NO: 2154311 - DNA, 24 bp, Homo sapiens
gcagccctaaggatctctcaggag

SEQ ID NO: 2154312 - DNA, 17 bp, Homo sapiens
gcagcgcctgtcccctc

SEQ ID NO: 2154313 - DNA, 18 bp, Homo sapiens
gcagcgcctgtcccctca

SEQ ID NO: 2154314 - DNA, 20 bp, Homo sapiens
gcagcgcctgtcccctcaca

SEQ ID NO: 2154315 - DNA, 21 bp, Homo sapiens
gcagcgcctgtcccctcacag

SEQ ID NO: 2154316 - DNA, 21 bp, Homo sapiens
gcagctgaggacacaccccac

SEQ ID NO: 2154317 - DNA, 12 bp, Homo sapiens
gcagctgctgcc

SEQ ID NO: 2154318 - DNA, 15 bp, Homo sapiens
gcagctgctgccact

SEQ ID NO: 2154319 - DNA, 22 bp, Homo sapiens
gcagctgctgccactctgctgc

SEQ ID NO: 2154320 - DNA, 16 bp, Homo sapiens
gcagctgggcccacag

SEQ ID NO: 2154321 - DNA, 20 bp, Homo sapiens
gcaggagtcaccatgcaagg

SEQ ID NO: 2154322 - DNA, 23 bp, Homo sapiens
gcaggagtcaccatgcaagggtg

SEQ ID NO: 2154323 - DNA, 19 bp, Homo sapiens
gcaggcctctggttgcctc

SEQ ID NO: 2154324 - DNA, 23 bp, Homo sapiens
gcaggcctctggttgcctccccc

SEQ ID NO: 2154325 - DNA, 13 bp, Homo sapiens
gcaggggactggg

SEQ ID NO: 2154326 - DNA, 16 bp, Homo sapiens
gcaggggactgggcca

SEQ ID NO: 2154327 - DNA, 12 bp, Homo sapiens
gcatcctcccca

SEQ ID NO: 2154328 - DNA, 19 bp, Homo sapiens
gcatcctccccaccagagc

SEQ ID NO: 2154329 - DNA, 22 bp, Homo sapiens
gcatcctccccaccagagctgc

SEQ ID NO: 2154330 - DNA, 21 bp, Homo sapiens
gcatctctgagtgtctctgcc

SEQ ID NO: 2154331 - DNA, 14 bp, Homo sapiens
gcatggcagctggg

SEQ ID NO: 2154332 - DNA, 23 bp, Homo sapiens
gcatggcagctgggcccacagcc

SEQ ID NO: 2154333 - DNA, 21 bp, Homo sapiens
gccaaaacaatgcccgtaaga

SEQ ID NO: 2154334 - DNA, 18 bp, Homo sapiens
gccaacttgtaaatacac

SEQ ID NO: 2154335 - DNA, 18 bp, Homo sapiens
gccacatggtgtctccca

SEQ ID NO: 2154336 - DNA, 22 bp, Homo sapiens
gccacccgttctgctggcctgg

SEQ ID NO: 2154337 - DNA, 13 bp, Homo sapiens
gccaccgcagctg

SEQ ID NO: 2154338 - DNA, 23 bp, Homo sapiens
gccaccgcagctgctgccactct

SEQ ID NO: 2154339 - DNA, 15 bp, Homo sapiens
gccactctgctgcct

SEQ ID NO: 2154340 - DNA, 22 bp, Homo sapiens
gccactctgctgcctgtacaga

SEQ ID NO: 2154341 - DNA, 12 bp, Homo sapiens
gccagatttttt

SEQ ID NO: 2154342 - DNA, 13 bp, Homo sapiens
gccagatttttta

SEQ ID NO: 2154343 - DNA, 23 bp, Homo sapiens
gccagattttttaaaatttatat

SEQ ID NO: 2154344 - DNA, 21 bp, Homo sapiens
gccagcaatgatgtccagaag

SEQ ID NO: 2154345 - DNA, 12 bp, Homo sapiens
gccagcagcaga

SEQ ID NO: 2154346 - DNA, 15 bp, Homo sapiens
gccagcaggcagcgc

SEQ ID NO: 2154347 - DNA, 21 bp, Homo sapiens
gccagcaggcagcgcctgtcc

SEQ ID NO: 2154348 - DNA, 14 bp, Homo sapiens
gccagctctgtcac

SEQ ID NO: 2154349 - DNA, 20 bp, Homo sapiens
gccagctctgtcaccctggc

SEQ ID NO: 2154350 - DNA, 21 bp, Homo sapiens
gccagctctgtcaccctggcc

SEQ ID NO: 2154351 - DNA, 22 bp, Homo sapiens
gccagctctgtcaccctggcca

SEQ ID NO: 2154352 - DNA, 15 bp, Homo sapiens
gccagtctgggctgc

SEQ ID NO: 2154353 - DNA, 16 bp, Homo sapiens
gccagtctgggctgcc

SEQ ID NO: 2154354 - DNA, 16 bp, Homo sapiens
gccatggggtccatcc

SEQ ID NO: 2154355 - DNA, 23 bp, Homo sapiens
gccatgggtcctcggcccatctg

SEQ ID NO: 2154356 - DNA, 18 bp, Homo sapiens
gcccaagggcctcccacc

SEQ ID NO: 2154357 - DNA, 22 bp, Homo sapiens
gcccaagggcctcccaccagag

SEQ ID NO: 2154358 - DNA, 17 bp, Homo sapiens
gcccacacacactcctt

SEQ ID NO: 2154359 - DNA, 18 bp, Homo sapiens
gcccacacacactccttc

SEQ ID NO: 2154360 - DNA, 20 bp, Homo sapiens
gcccacacacactccttccc

SEQ ID NO: 2154361 - DNA, 12 bp, Homo sapiens
gcccatctgtcc

SEQ ID NO: 2154362 - DNA, 18 bp, Homo sapiens
gcccatctgtccatcctc

SEQ ID NO: 2154363 - DNA, 20 bp, Homo sapiens
gccccagatcaccagcccgg

SEQ ID NO: 2154364 - DNA, 17 bp, Homo sapiens
gtgaatacaattaaagg

SEQ ID NO: 2154365 - DNA, 18 bp, Homo sapiens
gtgacatcgacaaccacg

SEQ ID NO: 2154366 - DNA, 13 bp, Homo sapiens
gtgactcagagct

SEQ ID NO: 2154367 - DNA, 16 bp, Homo sapiens
gtgatgctcaggcttg

SEQ ID NO: 2154368 - DNA, 15 bp, Homo sapiens
gtgcccacatcccag

SEQ ID NO: 2154369 - DNA, 16 bp, Homo sapiens
gtgcctgtctgtccaa

SEQ ID NO: 2154370 - DNA, 23 bp, Homo sapiens
gtgctcccacggggaccactggg

SEQ ID NO: 2154371 - DNA, 15 bp, Homo sapiens
gtgggcagctgagga

SEQ ID NO: 2154372 - DNA, 18 bp, Homo sapiens
gtggtcccacccaggaag

SEQ ID NO: 2154373 - DNA, 18 bp, Homo sapiens
gtgtaccacaccctgcct

SEQ ID NO: 2154374 - DNA, 22 bp, Homo sapiens
gtgtaccacaccctgcctgctg

SEQ ID NO: 2154375 - DNA, 20 bp, Homo sapiens
gtgtccctttttgcagggga

SEQ ID NO: 2154376 - DNA, 18 bp, Homo sapiens
gtgtctcccaacatggga

SEQ ID NO: 2154377 - DNA, 12 bp, Homo sapiens
gtgtctctgcct

SEQ ID NO: 2154378 - DNA, 14 bp, Homo sapiens
gtgtctctgcctgg

SEQ ID NO: 2154379 - DNA, 15 bp, Homo sapiens
gtgtctctgcctgga

SEQ ID NO: 2154380 - DNA, 18 bp, Homo sapiens
gtgtctctgcctggagca

SEQ ID NO: 2154381 - DNA, 23 bp, Homo sapiens
gtgtgtaccacaccctgcctgct

SEQ ID NO: 2154382 - DNA, 15 bp, Homo sapiens
gtgtgtgtatatata

SEQ ID NO: 2154383 - DNA, 15 bp, Homo sapiens
gttaagacttgacag

SEQ ID NO: 2154384 - DNA, 19 bp, Homo sapiens
gttaagacttgacagtgga

SEQ ID NO: 2154385 - DNA, 23 bp, Homo sapiens
gttaatttaaagttgtttgtgcc

SEQ ID NO: 2154386 - DNA, 14 bp, Homo sapiens
gttacatgtttgca

SEQ ID NO: 2154387 - DNA, 13 bp, Homo sapiens
gttacccagagaa

SEQ ID NO: 2154388 - DNA, 20 bp, Homo sapiens
gttccatgcctgagggtgga

SEQ ID NO: 2154389 - DNA, 13 bp, Homo sapiens
gttctgctggcct

SEQ ID NO: 2154390 - DNA, 14 bp, Homo sapiens
gttctgctggcctg

SEQ ID NO: 2154391 - DNA, 19 bp, Homo sapiens
gttctgctggcctggatct

SEQ ID NO: 2154392 - DNA, 20 bp, Homo sapiens
gttgctcaaatctattcaga

SEQ ID NO: 2154393 - DNA, 15 bp, Homo sapiens
gttgctcgaagactg

SEQ ID NO: 2154394 - DNA, 14 bp, Homo sapiens
gttgggagcactgg

SEQ ID NO: 2154395 - DNA, 16 bp, Homo sapiens
gttgggagcactggag

SEQ ID NO: 2154396 - DNA, 22 bp, Homo sapiens
gttgggggaatgcacctcccca

SEQ ID NO: 2154397 - DNA, 19 bp, Homo sapiens
gttgtcaatattaaataca

SEQ ID NO: 2154398 - DNA, 18 bp, Homo sapiens
gtttaaaaaaagtatata

SEQ ID NO: 2154399 - DNA, 20 bp, Homo sapiens
gtttaaaaaaagtatatatt

SEQ ID NO: 2154400 - DNA, 22 bp, Homo sapiens
gtttaaaaaaagtatatattct

SEQ ID NO: 2154401 - DNA, 23 bp, Homo sapiens
gtttaaaaaaagtatatattcta

SEQ ID NO: 2154402 - DNA, 24 bp, Homo sapiens
gtttctaaccaaagagtctctggc

SEQ ID NO: 2154403 - DNA, 17 bp, Homo sapiens
gtttgcacctttctagt

SEQ ID NO: 2154404 - DNA, 14 bp, Homo sapiens
gtttggcccctgga

SEQ ID NO: 2154405 - DNA, 16 bp, Homo sapiens
taaaaactgagtgact

SEQ ID NO: 2154406 - DNA, 12 bp, Homo sapiens
taaaaagattat

SEQ ID NO: 2154407 - DNA, 16 bp, Homo sapiens
taaaaatgatttcagt

SEQ ID NO: 2154408 - DNA, 19 bp, Homo sapiens
taaaatctggcaaagttat

SEQ ID NO: 2154409 - DNA, 20 bp, Homo sapiens
taaaatctggcaaagttata

SEQ ID NO: 2154410 - DNA, 21 bp, Homo sapiens
taaaatctggcaaagttatat

SEQ ID NO: 2154411 - DNA, 21 bp, Homo sapiens
taaacagatataaatggctgg

SEQ ID NO: 2154412 - DNA, 11 bp, Homo sapiens
taaagcttgtc

SEQ ID NO: 2154413 - DNA, 15 bp, Homo sapiens
taaaggtcctgccct

SEQ ID NO: 2154414 - DNA, 18 bp, Homo sapiens
taaagttgtttgtgcctt

SEQ ID NO: 2154415 - DNA, 12 bp, Homo sapiens
taaagtttatta

SEQ ID NO: 2154416 - DNA, 23 bp, Homo sapiens
taaatacaccacctcactcctgt

SEQ ID NO: 2154417 - DNA, 15 bp, Homo sapiens
taaatacagacacta

SEQ ID NO: 2154418 - DNA, 16 bp, Homo sapiens
taaatacagacactaa

SEQ ID NO: 2154419 - DNA, 17 bp, Homo sapiens
taaatacagacactaag

SEQ ID NO: 2154420 - DNA, 18 bp, Homo sapiens
taaatacagacactaagt

SEQ ID NO: 2154421 - DNA, 19 bp, Homo sapiens
taaatacagacactaagtt

SEQ ID NO: 2154422 - DNA, 16 bp, Homo sapiens
taactcattagactgg

SEQ ID NO: 2154423 - DNA, 17 bp, Homo sapiens
taactgggggaaaagat

SEQ ID NO: 2154424 - DNA, 21 bp, Homo sapiens
taactgttgctcgaagactgt

SEQ ID NO: 2154425 - DNA, 11 bp, Homo sapiens
taagccctgtc

SEQ ID NO: 2154426 - DNA, 14 bp, Homo sapiens
taagctttctcctt

SEQ ID NO: 2154427 - DNA, 16 bp, Homo sapiens
taagctttctcctttg

SEQ ID NO: 2154428 - DNA, 21 bp, Homo sapiens
taagtggggttgcaaccactg

SEQ ID NO: 2154429 - DNA, 14 bp, Homo sapiens
taagttatagtata

SEQ ID NO: 2154430 - DNA, 21 bp, Homo sapiens
taatatctgagaagtgtatat

SEQ ID NO: 2154431 - DNA, 18 bp, Homo sapiens
taatcaagagtctctcca

SEQ ID NO: 2154432 - DNA, 22 bp, Homo sapiens
taatcaagagtctctccagcct

SEQ ID NO: 2154433 - DNA, 19 bp, Homo sapiens
taatggtgttactaaagtc

SEQ ID NO: 2154434 - DNA, 21 bp, Homo sapiens
tacaattaaaggtcctgccct

SEQ ID NO: 2154435 - DNA, 17 bp, Homo sapiens
tacacagcaccagaatg

SEQ ID NO: 2154436 - DNA, 18 bp, Homo sapiens
tacagacactaagttata

SEQ ID NO: 2154437 - DNA, 19 bp, Homo sapiens
tacagacactaagttatag

SEQ ID NO: 2154438 - DNA, 13 bp, Homo sapiens
taccaagccaccg

SEQ ID NO: 2154439 - DNA, 16 bp, Homo sapiens
taccacaccctgcctg

SEQ ID NO: 2154440 - DNA, 19 bp, Homo sapiens
taccacaccctgcctgctg

SEQ ID NO: 2154441 - DNA, 23 bp, Homo sapiens
taccacaccctgcctgctgtgga

SEQ ID NO: 2154442 - DNA, 16 bp, Homo sapiens
taccaggcacatggct

SEQ ID NO: 2154443 - DNA, 20 bp, Homo sapiens
taccatgagaagagggcctg

SEQ ID NO: 2154444 - DNA, 21 bp, Homo sapiens
tacccaaccactcaaattaat

SEQ ID NO: 2154445 - DNA, 19 bp, Homo sapiens
tacccttcctcatctgtgc

SEQ ID NO: 2154446 - DNA, 14 bp, Homo sapiens
taccgcatggcagc

SEQ ID NO: 2154447 - DNA, 17 bp, Homo sapiens
taccgcatggcagctgg

SEQ ID NO: 2154448 - DNA, 18 bp, Homo sapiens
taccgcatggcagctggg

SEQ ID NO: 2154449 - DNA, 14 bp, Homo sapiens
tacctaaacagata

SEQ ID NO: 2154450 - DNA, 17 bp, Homo sapiens
tactcagagctgcgggc

SEQ ID NO: 2154451 - DNA, 19 bp, Homo sapiens
tactcagagctgcgggctg

SEQ ID NO: 2154452 - DNA, 23 bp, Homo sapiens
tactcagagctgcgggctgaggg

SEQ ID NO: 2154453 - DNA, 13 bp, Homo sapiens
tactgcacatttt

SEQ ID NO: 2154454 - DNA, 22 bp, Homo sapiens
tacttacctaaacagatataaa

SEQ ID NO: 2154455 - DNA, 19 bp, Homo sapiens
tacttcccccaccctgggt

SEQ ID NO: 2154456 - DNA, 15 bp, Homo sapiens
tagaatgtaaagctt

SEQ ID NO: 2154457 - DNA, 18 bp, Homo sapiens
tagacttcgactcaggat

SEQ ID NO: 2154458 - DNA, 13 bp, Homo sapiens
tagccccagtgac

SEQ ID NO: 2154459 - DNA, 18 bp, Homo sapiens
tagcctcacttttaatga

SEQ ID NO: 2154460 - DNA, 23 bp, Homo sapiens
tagcctcacttttaatgaacaaa

SEQ ID NO: 2154461 - DNA, 16 bp, Homo sapiens
tagcgtgctcactgac

SEQ ID NO: 2154462 - DNA, 16 bp, Homo sapiens
tagctcttgggcctga

SEQ ID NO: 2154463 - DNA, 20 bp, Homo sapiens
tagctcttgggcctgacctc

SEQ ID NO: 2154464 - DNA, 16 bp, Homo sapiens
tagggcctcggaggct

SEQ ID NO: 2154465 - DNA, 19 bp, Homo sapiens
tagggcctcggaggctcct

SEQ ID NO: 2154466 - DNA, 17 bp, Homo sapiens
taggggtcaggctccat

SEQ ID NO: 2154467 - DNA, 19 bp, Homo sapiens
tagtatatctggacaagcc

SEQ ID NO: 2154468 - DNA, 17 bp, Homo sapiens
tagtctcctttgcactg

SEQ ID NO: 2154469 - DNA, 19 bp, Homo sapiens
tagtctcctttgcactgag

SEQ ID NO: 2154470 - DNA, 20 bp, Homo sapiens
tagtctcctttgcactgagg

SEQ ID NO: 2154471 - DNA, 20 bp, Homo sapiens
tataatttttttattactga

SEQ ID NO: 2154472 - DNA, 15 bp, Homo sapiens
tatatatcataaagt

SEQ ID NO: 2154473 - DNA, 18 bp, Homo sapiens
tgccatgtcaaacaaata

SEQ ID NO: 2154474 - DNA, 17 bp, Homo sapiens
tgcccaagggcctccca

SEQ ID NO: 2154475 - DNA, 17 bp, Homo sapiens
tgcccacacacactcct

SEQ ID NO: 2154476 - DNA, 18 bp, Homo sapiens
tgcccacacacactcctt

SEQ ID NO: 2154477 - DNA, 19 bp, Homo sapiens
tgcccacacacactccttc

SEQ ID NO: 2154478 - DNA, 20 bp, Homo sapiens
tgcccacacacactccttcc

SEQ ID NO: 2154479 - DNA, 17 bp, Homo sapiens
tgccccatctcctccca

SEQ ID NO: 2154480 - DNA, 21 bp, Homo sapiens
tgccccatctcctcccatggc

SEQ ID NO: 2154481 - DNA, 19 bp, Homo sapiens
tgccccttcccatctcttc

SEQ ID NO: 2154482 - DNA, 16 bp, Homo sapiens
tgccctgacccctgca

SEQ ID NO: 2154483 - DNA, 19 bp, Homo sapiens
tgccctgttgtgtatagat

SEQ ID NO: 2154484 - DNA, 15 bp, Homo sapiens
tgcccttcctgaccc

SEQ ID NO: 2154485 - DNA, 13 bp, Homo sapiens
tgccgcctcccgg

SEQ ID NO: 2154486 - DNA, 16 bp, Homo sapiens
tgcctagctcttgggc

SEQ ID NO: 2154487 - DNA, 17 bp, Homo sapiens
tgcctagctcttgggcc

SEQ ID NO: 2154488 - DNA, 18 bp, Homo sapiens
tgcctagctcttgggcct

SEQ ID NO: 2154489 - DNA, 23 bp, Homo sapiens
tgcctagctcttgggcctgacct

SEQ ID NO: 2154490 - DNA, 15 bp, Homo sapiens
tgcctccccaatcca

SEQ ID NO: 2154491 - DNA, 21 bp, Homo sapiens
tgcctcccccgcctccagtca

SEQ ID NO: 2154492 - DNA, 14 bp, Homo sapiens
tgcctctaactccc

SEQ ID NO: 2154493 - DNA, 17 bp, Homo sapiens
tgcctctaactccctcc

SEQ ID NO: 2154494 - DNA, 18 bp, Homo sapiens
tgcctctaactccctcct

SEQ ID NO: 2154495 - DNA, 19 bp, Homo sapiens
tgcctctaactccctcctc

SEQ ID NO: 2154496 - DNA, 14 bp, Homo sapiens
tgcctgaactccag

SEQ ID NO: 2154497 - DNA, 19 bp, Homo sapiens
tgcctgacactgagcccca

SEQ ID NO: 2154498 - DNA, 22 bp, Homo sapiens
tgcctgacactgagccccacct

SEQ ID NO: 2154499 - DNA, 11 bp, Homo sapiens
tgcctgagggt

SEQ ID NO: 2154500 - DNA, 22 bp, Homo sapiens
tgcctgtagccccagtgacagc

SEQ ID NO: 2154501 - DNA, 23 bp, Homo sapiens
tgcctgtctgtccaacccctccc

SEQ ID NO: 2154502 - DNA, 16 bp, Homo sapiens
tgccttcttcacccag

SEQ ID NO: 2154503 - DNA, 13 bp, Homo sapiens
tgcgggctgaggg

SEQ ID NO: 2154504 - DNA, 13 bp, Homo sapiens
tgctatttgaagt

SEQ ID NO: 2154505 - DNA, 14 bp, Homo sapiens
tgctcaagaagaca

SEQ ID NO: 2154506 - DNA, 21 bp, Homo sapiens
tgctcccacggggaccactgg

SEQ ID NO: 2154507 - DNA, 13 bp, Homo sapiens
tgctcctcctgcc

SEQ ID NO: 2154508 - DNA, 14 bp, Homo sapiens
tgctgacccaccaa

SEQ ID NO: 2154509 - DNA, 22 bp, Homo sapiens
tgctgccactctgctgcctgta

SEQ ID NO: 2154510 - DNA, 19 bp, Homo sapiens
tgctggcctcttggcacct

SEQ ID NO: 2154511 - DNA, 12 bp, Homo sapiens
tgctggcctgct

SEQ ID NO: 2154512 - DNA, 14 bp, Homo sapiens
tgctggcctgctct

SEQ ID NO: 2154513 - DNA, 14 bp, Homo sapiens
tgctggcctggatc

SEQ ID NO: 2154514 - DNA, 15 bp, Homo sapiens
tgctggcctggatct

SEQ ID NO: 2154515 - DNA, 16 bp, Homo sapiens
tgctgggcctctgcct

SEQ ID NO: 2154516 - DNA, 19 bp, Homo sapiens
tgctggggctggtgaggcc

SEQ ID NO: 2154517 - DNA, 14 bp, Homo sapiens
tggactagggcctc

SEQ ID NO: 2154518 - DNA, 15 bp, Homo sapiens
tggactagggcctcg

SEQ ID NO: 2154519 - DNA, 17 bp, Homo sapiens
tggactagggcctcgga

SEQ ID NO: 2154520 - DNA, 18 bp, Homo sapiens
tggagactaagccctgtc

SEQ ID NO: 2154521 - DNA, 22 bp, Homo sapiens
tggcacctgcctagctcttggg

SEQ ID NO: 2154522 - DNA, 18 bp, Homo sapiens
tggcagaactgctggggc

SEQ ID NO: 2154523 - DNA, 19 bp, Homo sapiens
tggcagaactgctggggct

SEQ ID NO: 2154524 - DNA, 11 bp, Homo sapiens
tggcagctggg

SEQ ID NO: 2154525 - DNA, 14 bp, Homo sapiens
tggcagctgggccc

SEQ ID NO: 2154526 - DNA, 23 bp, Homo sapiens
tggcagctgggcccacagccccc

SEQ ID NO: 2154527 - DNA, 17 bp, Homo sapiens
tggccaccacccaacct

SEQ ID NO: 2154528 - DNA, 21 bp, Homo sapiens
tggccccaagaggggcgggct

SEQ ID NO: 2154529 - DNA, 13 bp, Homo sapiens
tggcccctggaac

SEQ ID NO: 2154530 - DNA, 13 bp, Homo sapiens
tggccctgcccct

SEQ ID NO: 2154531 - DNA, 14 bp, Homo sapiens
tggccgtggctcca

SEQ ID NO: 2154532 - DNA, 17 bp, Homo sapiens
tggcctcttggcacctg

SEQ ID NO: 2154533 - DNA, 11 bp, Homo sapiens
tggccttccct

SEQ ID NO: 2154534 - DNA, 22 bp, Homo sapiens
tggcctttattaaaaactgagt

SEQ ID NO: 2154535 - DNA, 19 bp, Homo sapiens
tggctccagaatgtgctgc

SEQ ID NO: 2154536 - DNA, 20 bp, Homo sapiens
tggctccagaatgtgctgcc

SEQ ID NO: 2154537 - DNA, 22 bp, Homo sapiens
tggctccagaatgtgctgcctt

SEQ ID NO: 2154538 - DNA, 18 bp, Homo sapiens
tggctgaacagtgctctg

SEQ ID NO: 2154539 - DNA, 20 bp, Homo sapiens
tggctgaacagtgctctgcc

SEQ ID NO: 2154540 - DNA, 18 bp, Homo sapiens
tggctgggggagggactg

SEQ ID NO: 2154541 - DNA, 12 bp, Homo sapiens
tgggagcactgg

SEQ ID NO: 2154542 - DNA, 17 bp, Homo sapiens
tgggcagaatcctgggc

SEQ ID NO: 2154543 - DNA, 18 bp, Homo sapiens
tgggcagaatcctgggcc

SEQ ID NO: 2154544 - DNA, 19 bp, Homo sapiens
tgggcagaatcctgggccc

SEQ ID NO: 2154545 - DNA, 23 bp, Homo sapiens
tgggcagaatcctgggcccccag

SEQ ID NO: 2154546 - DNA, 13 bp, Homo sapiens
tgggcagctgagg

SEQ ID NO: 2154547 - DNA, 17 bp, Homo sapiens
tgggcaggagtcaccat

SEQ ID NO: 2154548 - DNA, 20 bp, Homo sapiens
tgggccatgggtcctcggcc

SEQ ID NO: 2154549 - DNA, 18 bp, Homo sapiens
tgggcccacagcccccac

SEQ ID NO: 2154550 - DNA, 12 bp, Homo sapiens
tgggcccctcag

SEQ ID NO: 2154551 - DNA, 16 bp, Homo sapiens
tggggcactcccccag

SEQ ID NO: 2154552 - DNA, 21 bp, Homo sapiens
tggggctcctttctccagcca

SEQ ID NO: 2154553 - DNA, 23 bp, Homo sapiens
tggggctcctttctccagccagc

SEQ ID NO: 2154554 - DNA, 16 bp, Homo sapiens
tggggctggtgaggcc

SEQ ID NO: 2154555 - DNA, 17 bp, Homo sapiens
tggggctggtgaggccg

SEQ ID NO: 2154556 - DNA, 13 bp, Homo sapiens
tggggctggtgga

SEQ ID NO: 2154557 - DNA, 21 bp, Homo sapiens
tgggggagggactgctgaccc

SEQ ID NO: 2154558 - DNA, 19 bp, Homo sapiens
tggggtccatccccttccc

SEQ ID NO: 2154559 - DNA, 16 bp, Homo sapiens
tggggttgcaaccact

SEQ ID NO: 2154560 - DNA, 17 bp, Homo sapiens
tgggtcctcggcccatc

SEQ ID NO: 2154561 - DNA, 23 bp, Homo sapiens
tgggtcctcggcccatctgtcca

SEQ ID NO: 2154562 - DNA, 15 bp, Homo sapiens
tgggtcggccctgcc

SEQ ID NO: 2154563 - DNA, 16 bp, Homo sapiens
tggtactaccccagcc

SEQ ID NO: 2154564 - DNA, 20 bp, Homo sapiens
tggtcccacccaggaaggga

SEQ ID NO: 2154565 - DNA, 19 bp, Homo sapiens
tggtgaggccggccctgcc

SEQ ID NO: 2154566 - DNA, 20 bp, Homo sapiens
tggtgaggccggccctgccc

SEQ ID NO: 2154567 - DNA, 15 bp, Homo sapiens
tggttccatgcctga

SEQ ID NO: 2154568 - DNA, 17 bp, Homo sapiens
tggttccatgcctgagg

SEQ ID NO: 2154569 - DNA, 22 bp, Homo sapiens
tggttccatgcctgagggtgga

SEQ ID NO: 2154570 - DNA, 12 bp, Homo sapiens
tggttgcctccc

SEQ ID NO: 2154571 - DNA, 17 bp, Homo sapiens
tggttgcctcccccgcc

SEQ ID NO: 2154572 - DNA, 18 bp, Homo sapiens
tgtaacaagccagatttt

SEQ ID NO: 2154573 - DNA, 18 bp, Homo sapiens
tgtacagttatctaagtt

SEQ ID NO: 2154574 - DNA, 16 bp, Homo sapiens
tgtagccccagtgaca

SEQ ID NO: 2154575 - DNA, 18 bp, Homo sapiens
tgtatagatgcaagatat

SEQ ID NO: 2154576 - DNA, 14 bp, Homo sapiens
tgtcaatattaaat

SEQ ID NO: 2154577 - DNA, 21 bp, Homo sapiens
tgtcaatattaaatacagaca

SEQ ID NO: 2154578 - DNA, 23 bp, Homo sapiens
tgtcaatattaaatacagacact

SEQ ID NO: 2154579 - DNA, 13 bp, Homo sapiens
tgtcacaataaag

SEQ ID NO: 2154580 - DNA, 19 bp, Homo sapiens
tgtcacaataaagtttatt

SEQ ID NO: 2154581 - DNA, 18 bp, Homo sapiens
tgtcaccctggccaccac

SEQ ID NO: 2154582 - DNA, 16 bp, Homo sapiens
tgtcacttgccacatg

SEQ ID NO: 2154583 - DNA, 12 bp, Homo sapiens
agaactgctggg

SEQ ID NO: 2154584 - DNA, 14 bp, Homo sapiens
agaagaatattcag

SEQ ID NO: 2154585 - DNA, 18 bp, Homo sapiens
agaagaatattcaggact

SEQ ID NO: 2154586 - DNA, 19 bp, Homo sapiens
agaagaatattcaggactt

SEQ ID NO: 2154587 - DNA, 22 bp, Homo sapiens
agaagacatggagactcctgcc

SEQ ID NO: 2154588 - DNA, 16 bp, Homo sapiens
agaagagggcctgtgg

SEQ ID NO: 2154589 - DNA, 18 bp, Homo sapiens
agaagagggcctgtggga

SEQ ID NO: 2154590 - DNA, 20 bp, Homo sapiens
agaaggcctcccctgaggat

SEQ ID NO: 2154591 - DNA, 13 bp, Homo sapiens
agaatattcagga

SEQ ID NO: 2154592 - DNA, 13 bp, Homo sapiens
agaatcctgggcc

SEQ ID NO: 2154593 - DNA, 12 bp, Homo sapiens
agaatgtaaagc

SEQ ID NO: 2154594 - DNA, 16 bp, Homo sapiens
agaatgtaaagcttgt

SEQ ID NO: 2154595 - DNA, 14 bp, Homo sapiens
agaatgttaagact

SEQ ID NO: 2154596 - DNA, 19 bp, Homo sapiens
agaatgttaagacttgaca

SEQ ID NO: 2154597 - DNA, 15 bp, Homo sapiens
agaattacccttcct

SEQ ID NO: 2154598 - DNA, 19 bp, Homo sapiens
agaattgaaggagaaaatg

SEQ ID NO: 2154599 - DNA, 13 bp, Homo sapiens
agacacttgcctt

SEQ ID NO: 2154600 - DNA, 18 bp, Homo sapiens
agacatggagactcctgc

SEQ ID NO: 2154601 - DNA, 13 bp, Homo sapiens
agaccagttggga

SEQ ID NO: 2154602 - DNA, 19 bp, Homo sapiens
agaccagttgggagcactg

SEQ ID NO: 2154603 - DNA, 17 bp, Homo sapiens
agacccggtcctgccct

SEQ ID NO: 2154604 - DNA, 14 bp, Homo sapiens
agacctttgcccac

SEQ ID NO: 2154605 - DNA, 14 bp, Homo sapiens
agactaagccctgt

SEQ ID NO: 2154606 - DNA, 17 bp, Homo sapiens
agactggaacttgaact

SEQ ID NO: 2154607 - DNA, 11 bp, Homo sapiens
agactggacag

SEQ ID NO: 2154608 - DNA, 13 bp, Homo sapiens
agactggacagct

SEQ ID NO: 2154609 - DNA, 17 bp, Homo sapiens
agactggacagcttgtg

SEQ ID NO: 2154610 - DNA, 14 bp, Homo sapiens
agactgttgctcaa

SEQ ID NO: 2154611 - DNA, 16 bp, Homo sapiens
agacttcgactcagga

SEQ ID NO: 2154612 - DNA, 12 bp, Homo sapiens
agacttgacagt

SEQ ID NO: 2154613 - DNA, 14 bp, Homo sapiens
agacttgacagtgg

SEQ ID NO: 2154614 - DNA, 19 bp, Homo sapiens
agagaataaagacttcatg

SEQ ID NO: 2154615 - DNA, 18 bp, Homo sapiens
agagacattaactcatta

SEQ ID NO: 2154616 - DNA, 13 bp, Homo sapiens
agagacctttgcc

SEQ ID NO: 2154617 - DNA, 17 bp, Homo sapiens
agagacctttgcccaca

SEQ ID NO: 2154618 - DNA, 20 bp, Homo sapiens
agagcaggggctgctggggg

SEQ ID NO: 2154619 - DNA, 21 bp, Homo sapiens
agagctgcctccccaatccat

SEQ ID NO: 2154620 - DNA, 20 bp, Homo sapiens
agagctgcgggctgagggca

SEQ ID NO: 2154621 - DNA, 12 bp, Homo sapiens
agagctttgtca

SEQ ID NO: 2154622 - DNA, 13 bp, Homo sapiens
agagctttgtcac

SEQ ID NO: 2154623 - DNA, 21 bp, Homo sapiens
agagctttgtcacttgccaca

SEQ ID NO: 2154624 - DNA, 19 bp, Homo sapiens
agagggcctgtgggagcct

SEQ ID NO: 2154625 - DNA, 20 bp, Homo sapiens
agaggggcgggctcagagct

SEQ ID NO: 2154626 - DNA, 21 bp, Homo sapiens
agaggggcgggctcagagctt

SEQ ID NO: 2154627 - DNA, 12 bp, Homo sapiens
agagtctctcca

SEQ ID NO: 2154628 - DNA, 14 bp, Homo sapiens
agagtctctccagc

SEQ ID NO: 2154629 - DNA, 15 bp, Homo sapiens
agagtctctccagcc

SEQ ID NO: 2154630 - DNA, 16 bp, Homo sapiens
agagtctctccagcct

SEQ ID NO: 2154631 - DNA, 14 bp, Homo sapiens
agagtctctggctc

SEQ ID NO: 2154632 - DNA, 15 bp, Homo sapiens
agagtctctggctca

SEQ ID NO: 2154633 - DNA, 18 bp, Homo sapiens
agagtctctggctcagct

SEQ ID NO: 2154634 - DNA, 22 bp, Homo sapiens
agagtgtccctttttgcagggg

SEQ ID NO: 2154635 - DNA, 23 bp, Homo sapiens
agagtgtccctttttgcagggga

SEQ ID NO: 2154636 - DNA, 14 bp, Homo sapiens
agagtgtgaccaaa

SEQ ID NO: 2154637 - DNA, 21 bp, Homo sapiens
agagtgtgaccaaaagttaca

SEQ ID NO: 2154638 - DNA, 15 bp, Homo sapiens
agatctttttgtgaa

SEQ ID NO: 2154639 - DNA, 15 bp, Homo sapiens
agatgctggcctctt

SEQ ID NO: 2154640 - DNA, 20 bp, Homo sapiens
agattatatatcataaagta

SEQ ID NO: 2154641 - DNA, 16 bp, Homo sapiens
agcaagactgttgctc

SEQ ID NO: 2154642 - DNA, 20 bp, Homo sapiens
agcaaggacaacctgcccct

SEQ ID NO: 2154643 - DNA, 19 bp, Homo sapiens
agcaatgatgtccagaaga

SEQ ID NO: 2154644 - DNA, 23 bp, Homo sapiens
agcaatgatgtccagaagaatat

SEQ ID NO: 2154645 - DNA, 15 bp, Homo sapiens
agcacagctcctccc

SEQ ID NO: 2154646 - DNA, 18 bp, Homo sapiens
agcacagctcctcccctg

SEQ ID NO: 2154647 - DNA, 22 bp, Homo sapiens
agcaggcagcgcctgtcccctc

SEQ ID NO: 2154648 - DNA, 13 bp, Homo sapiens
agcaggggctgct

SEQ ID NO: 2154649 - DNA, 14 bp, Homo sapiens
agcaggggctgctg

SEQ ID NO: 2154650 - DNA, 23 bp, Homo sapiens
agcaggggctgctgggggctccc

SEQ ID NO: 2154651 - DNA, 17 bp, Homo sapiens
agcatcctccccaccag

SEQ ID NO: 2154652 - DNA, 20 bp, Homo sapiens
agccaacttgtaaatacacc

SEQ ID NO: 2154653 - DNA, 19 bp, Homo sapiens
agccaccgcagctgctgcc

SEQ ID NO: 2154654 - DNA, 16 bp, Homo sapiens
agccactacctttgtc

SEQ ID NO: 2154655 - DNA, 17 bp, Homo sapiens
agccccagtgacagcta

SEQ ID NO: 2154656 - DNA, 11 bp, Homo sapiens
agcccggcctg

SEQ ID NO: 2154657 - DNA, 22 bp, Homo sapiens
agcccggcctgctcccagcagc

SEQ ID NO: 2154658 - DNA, 21 bp, Homo sapiens
agccctaaggatctctcagga

SEQ ID NO: 2154659 - DNA, 17 bp, Homo sapiens
agccctgtcgagacact

SEQ ID NO: 2154660 - DNA, 13 bp, Homo sapiens
agcccttccctgc

SEQ ID NO: 2154661 - DNA, 20 bp, Homo sapiens
agccctttgcaggcccagca

SEQ ID NO: 2154662 - DNA, 17 bp, Homo sapiens
agccgagccgggcctgg

SEQ ID NO: 2154663 - DNA, 21 bp, Homo sapiens
agccgagccgggcctggggct

SEQ ID NO: 2154664 - DNA, 13 bp, Homo sapiens
agccgccccagcc

SEQ ID NO: 2154665 - DNA, 15 bp, Homo sapiens
agccgccccagcccc

SEQ ID NO: 2154666 - DNA, 18 bp, Homo sapiens
agccgtgatgctcaggct

SEQ ID NO: 2154667 - DNA, 19 bp, Homo sapiens
agccgtgatgctcaggctt

SEQ ID NO: 2154668 - DNA, 15 bp, Homo sapiens
agcctcaatttctga

SEQ ID NO: 2154669 - DNA, 16 bp, Homo sapiens
agcctcacagatgctg

SEQ ID NO: 2154670 - DNA, 17 bp, Homo sapiens
agcctcacagatgctgg

SEQ ID NO: 2154671 - DNA, 21 bp, Homo sapiens
agcctcacagatgctggcctc

SEQ ID NO: 2154672 - DNA, 23 bp, Homo sapiens
agcctcacagatgctggcctctt

SEQ ID NO: 2154673 - DNA, 10 bp, Homo sapiens
agcctctccc

SEQ ID NO: 2154674 - DNA, 15 bp, Homo sapiens
agcctgagtctcctg

SEQ ID NO: 2154675 - DNA, 18 bp, Homo sapiens
agcctgcaaactcactgc

SEQ ID NO: 2154676 - DNA, 19 bp, Homo sapiens
agcctgcaaactcactgct

SEQ ID NO: 2154677 - DNA, 12 bp, Homo sapiens
agcgcctgtccc

SEQ ID NO: 2154678 - DNA, 18 bp, Homo sapiens
agcgcctgtcccctcaca

SEQ ID NO: 2154679 - DNA, 19 bp, Homo sapiens
agcgcctgtcccctcacag

SEQ ID NO: 2154680 - DNA, 20 bp, Homo sapiens
agctaatctgtagggctgga

SEQ ID NO: 2154681 - DNA, 12 bp, Homo sapiens
agctcctcccct

SEQ ID NO: 2154682 - DNA, 16 bp, Homo sapiens
agctcctcccctgccg

SEQ ID NO: 2154683 - DNA, 17 bp, Homo sapiens
agctcctcccctgccgc

SEQ ID NO: 2154684 - DNA, 16 bp, Homo sapiens
agctctgtcaccctgg

SEQ ID NO: 2154685 - DNA, 20 bp, Homo sapiens
agctctgtcaccctggccac

SEQ ID NO: 2154686 - DNA, 21 bp, Homo sapiens
agctctgtcaccctggccacc

SEQ ID NO: 2154687 - DNA, 13 bp, Homo sapiens
agctgatcagttt

SEQ ID NO: 2154688 - DNA, 22 bp, Homo sapiens
agctgcgggctgagggcatctc

SEQ ID NO: 2154689 - DNA, 24 bp, Homo sapiens
agctgcgggctgagggcatctctg

SEQ ID NO: 2154690 - DNA, 20 bp, Homo sapiens
agctgctaggggaaggactg

SEQ ID NO: 2154691 - DNA, 19 bp, Homo sapiens
agctgctgccactctgctg

SEQ ID NO: 2154692 - DNA, 21 bp, Homo sapiens
agctgctgccactctgctgcc

SEQ ID NO: 2154693 - DNA, 22 bp, Homo sapiens
caccctgggtttggcccctgga

SEQ ID NO: 2154694 - DNA, 18 bp, Homo sapiens
caccgcagctgctgccac

SEQ ID NO: 2154695 - DNA, 13 bp, Homo sapiens
cacctcactcctg

SEQ ID NO: 2154696 - DNA, 15 bp, Homo sapiens
cacctcactcctgtt

SEQ ID NO: 2154697 - DNA, 15 bp, Homo sapiens
cacctctccaagtct

SEQ ID NO: 2154698 - DNA, 15 bp, Homo sapiens
cacctgcctagctct

SEQ ID NO: 2154699 - DNA, 21 bp, Homo sapiens
cacctggaagcatttgtttct

SEQ ID NO: 2154700 - DNA, 22 bp, Homo sapiens
cacctggaagcatttgtttcta

SEQ ID NO: 2154701 - DNA, 12 bp, Homo sapiens
cacctttctagt

SEQ ID NO: 2154702 - DNA, 17 bp, Homo sapiens
cacctttctagttgaaa

SEQ ID NO: 2154703 - DNA, 18 bp, Homo sapiens
cacggggaccactgggcc

SEQ ID NO: 2154704 - DNA, 19 bp, Homo sapiens
cacggggaccactgggccc

SEQ ID NO: 2154705 - DNA, 18 bp, Homo sapiens
cacgtctctctgcctgct

SEQ ID NO: 2154706 - DNA, 19 bp, Homo sapiens
cacgtctctctgcctgctg

SEQ ID NO: 2154707 - DNA, 14 bp, Homo sapiens
cactaagttatagt

SEQ ID NO: 2154708 - DNA, 17 bp, Homo sapiens
cactaagttatagtata

SEQ ID NO: 2154709 - DNA, 12 bp, Homo sapiens
cactagttttgt

SEQ ID NO: 2154710 - DNA, 17 bp, Homo sapiens
cactagttttgtgccag

SEQ ID NO: 2154711 - DNA, 14 bp, Homo sapiens
cactcagcagcccc

SEQ ID NO: 2154712 - DNA, 15 bp, Homo sapiens
cactcagcagccccc

SEQ ID NO: 2154713 - DNA, 14 bp, Homo sapiens
cactcccccaggat

SEQ ID NO: 2154714 - DNA, 20 bp, Homo sapiens
cactcccccaggattgtgca

SEQ ID NO: 2154715 - DNA, 15 bp, Homo sapiens
cactcctcctgccag

SEQ ID NO: 2154716 - DNA, 18 bp, Homo sapiens
cactcctgttacttacct

SEQ ID NO: 2154717 - DNA, 12 bp, Homo sapiens
cactccttcccc

SEQ ID NO: 2154718 - DNA, 22 bp, Homo sapiens
cactccttccccttgtccctgg

SEQ ID NO: 2154719 - DNA, 17 bp, Homo sapiens
cactctaggggtcaggc

SEQ ID NO: 2154720 - DNA, 12 bp, Homo sapiens
cactctgctgcc

SEQ ID NO: 2154721 - DNA, 15 bp, Homo sapiens
cactctgctgcctgt

SEQ ID NO: 2154722 - DNA, 18 bp, Homo sapiens
cactgagggccacactat

SEQ ID NO: 2154723 - DNA, 19 bp, Homo sapiens
cactgctcaagaagacatg

SEQ ID NO: 2154724 - DNA, 18 bp, Homo sapiens
cactggagtgcagggagg

SEQ ID NO: 2154725 - DNA, 20 bp, Homo sapiens
cactggagtgcagggaggag

SEQ ID NO: 2154726 - DNA, 13 bp, Homo sapiens
cacttgccacatg

SEQ ID NO: 2154727 - DNA, 13 bp, Homo sapiens
cagaactgctggg

SEQ ID NO: 2154728 - DNA, 17 bp, Homo sapiens
cagaactgctggggctg

SEQ ID NO: 2154729 - DNA, 18 bp, Homo sapiens
cagaagaatattcaggac

SEQ ID NO: 2154730 - DNA, 17 bp, Homo sapiens
cagaagtaactcccact

SEQ ID NO: 2154731 - DNA, 21 bp, Homo sapiens
cagaatcctgggcccccagag

SEQ ID NO: 2154732 - DNA, 23 bp, Homo sapiens
cagaatcctgggcccccagagac

SEQ ID NO: 2154733 - DNA, 13 bp, Homo sapiens
cagaatgtgctgc

SEQ ID NO: 2154734 - DNA, 14 bp, Homo sapiens
cagaatgtgctgcc

SEQ ID NO: 2154735 - DNA, 16 bp, Homo sapiens
cagaattacccttcct

SEQ ID NO: 2154736 - DNA, 17 bp, Homo sapiens
cagaattacccttcctc

SEQ ID NO: 2154737 - DNA, 19 bp, Homo sapiens
cagaattacccttcctcat

SEQ ID NO: 2154738 - DNA, 16 bp, Homo sapiens
cagaattgaaggagaa

SEQ ID NO: 2154739 - DNA, 17 bp, Homo sapiens
cagaccaccagccgccc

SEQ ID NO: 2154740 - DNA, 15 bp, Homo sapiens
cagactcagctctga

SEQ ID NO: 2154741 - DNA, 19 bp, Homo sapiens
cagactcttccaccagagc

SEQ ID NO: 2154742 - DNA, 21 bp, Homo sapiens
cagactcttccaccagagcag

SEQ ID NO: 2154743 - DNA, 13 bp, Homo sapiens
cagagacctttgc

SEQ ID NO: 2154744 - DNA, 18 bp, Homo sapiens
cagagacctttgcccaca

SEQ ID NO: 2154745 - DNA, 18 bp, Homo sapiens
cagagcaggggctgctgg

SEQ ID NO: 2154746 - DNA, 19 bp, Homo sapiens
cagagcaggggctgctggg

SEQ ID NO: 2154747 - DNA, 20 bp, Homo sapiens
cagagcaggggctgctgggg

SEQ ID NO: 2154748 - DNA, 22 bp, Homo sapiens
cagagcaggggctgctgggggc

SEQ ID NO: 2154749 - DNA, 11 bp, Homo sapiens
cagagctgcct

SEQ ID NO: 2154750 - DNA, 17 bp, Homo sapiens
cagagctgcctccccaa

SEQ ID NO: 2154751 - DNA, 10 bp, Homo sapiens
cagagctgcg

SEQ ID NO: 2154752 - DNA, 14 bp, Homo sapiens
cagagctgcgggct

SEQ ID NO: 2154753 - DNA, 13 bp, Homo sapiens
cagagctttgtca

SEQ ID NO: 2154754 - DNA, 21 bp, Homo sapiens
cagagcttttcgaactgtgct

SEQ ID NO: 2154755 - DNA, 18 bp, Homo sapiens
cagatataaatggctggt

SEQ ID NO: 2154756 - DNA, 20 bp, Homo sapiens
cagatataaatggctggttt

SEQ ID NO: 2154757 - DNA, 22 bp, Homo sapiens
cagatataaatggctggttttt

SEQ ID NO: 2154758 - DNA, 23 bp, Homo sapiens
cagatataaatggctggttttta

SEQ ID NO: 2154759 - DNA, 13 bp, Homo sapiens
cagatctttttgt

SEQ ID NO: 2154760 - DNA, 16 bp, Homo sapiens
cagatctttttgtgaa

SEQ ID NO: 2154761 - DNA, 13 bp, Homo sapiens
cagatgctggcct

SEQ ID NO: 2154762 - DNA, 18 bp, Homo sapiens
cagcaatgatgtccagaa

SEQ ID NO: 2154763 - DNA, 16 bp, Homo sapiens
cagcacagctcctccc

SEQ ID NO: 2154764 - DNA, 16 bp, Homo sapiens
cagcagccccctgccc

SEQ ID NO: 2154765 - DNA, 11 bp, Homo sapiens
cagcagcccta

SEQ ID NO: 2154766 - DNA, 24 bp, Homo sapiens
cagcagccctaaggatctctcagg

SEQ ID NO: 2154767 - DNA, 15 bp, Homo sapiens
cagcaggcagcgcct

SEQ ID NO: 2154768 - DNA, 20 bp, Homo sapiens
cagcaggcagcgcctgtccc

SEQ ID NO: 2154769 - DNA, 20 bp, Homo sapiens
cagcaggcctctggttgcct

SEQ ID NO: 2154770 - DNA, 22 bp, Homo sapiens
cagcaggcctctggttgcctcc

SEQ ID NO: 2154771 - DNA, 13 bp, Homo sapiens
cagccagcaatga

SEQ ID NO: 2154772 - DNA, 22 bp, Homo sapiens
cagccagcaatgatgtccagaa

SEQ ID NO: 2154773 - DNA, 23 bp, Homo sapiens
cagccagcaatgatgtccagaag

SEQ ID NO: 2154774 - DNA, 21 bp, Homo sapiens
cagccatcaagagactgagtc

SEQ ID NO: 2154775 - DNA, 21 bp, Homo sapiens
cagcccaccctgctcctcctg

SEQ ID NO: 2154776 - DNA, 22 bp, Homo sapiens
cagcccccaccccagcacagct

SEQ ID NO: 2154777 - DNA, 13 bp, Homo sapiens
cagccccgcctgt

SEQ ID NO: 2154778 - DNA, 20 bp, Homo sapiens
cagccccttctcccagcaca

SEQ ID NO: 2154779 - DNA, 14 bp, Homo sapiens
cagcccggcctgct

SEQ ID NO: 2154780 - DNA, 17 bp, Homo sapiens
cagccctaaggatctct

SEQ ID NO: 2154781 - DNA, 15 bp, Homo sapiens
cagcccttccctgct

SEQ ID NO: 2154782 - DNA, 17 bp, Homo sapiens
cagcccttccctgcttt

SEQ ID NO: 2154783 - DNA, 22 bp, Homo sapiens
cagcccttccctgctttgagga

SEQ ID NO: 2154784 - DNA, 14 bp, Homo sapiens
cagccgagccgggc

SEQ ID NO: 2154785 - DNA, 19 bp, Homo sapiens
cagccgagccgggcctggg

SEQ ID NO: 2154786 - DNA, 16 bp, Homo sapiens
cagccgccccagcccc

SEQ ID NO: 2154787 - DNA, 18 bp, Homo sapiens
cagccgccccagcccctt

SEQ ID NO: 2154788 - DNA, 22 bp, Homo sapiens
cagcctcacagatgctggcctc

SEQ ID NO: 2154789 - DNA, 16 bp, Homo sapiens
cagcctgagtctcctg

SEQ ID NO: 2154790 - DNA, 20 bp, Homo sapiens
cagcctgagtctcctgtgcc

SEQ ID NO: 2154791 - DNA, 14 bp, Homo sapiens
cagctaatctgtag

SEQ ID NO: 2154792 - DNA, 14 bp, Homo sapiens
cagctcctcccctg

SEQ ID NO: 2154793 - DNA, 23 bp, Homo sapiens
cagctcctcccctgccgcctccc

SEQ ID NO: 2154794 - DNA, 19 bp, Homo sapiens
cagctctgtcaccctggcc

SEQ ID NO: 2154795 - DNA, 20 bp, Homo sapiens
cagctctgtcaccctggcca

SEQ ID NO: 2154796 - DNA, 13 bp, Homo sapiens
cagctgctgccac

SEQ ID NO: 2154797 - DNA, 22 bp, Homo sapiens
cagctgctgccactctgctgcc

SEQ ID NO: 2154798 - DNA, 21 bp, Homo sapiens
cagctggatgagacttccaaa

SEQ ID NO: 2154799 - DNA, 12 bp, Homo sapiens
cagctgggccca

SEQ ID NO: 2154800 - DNA, 19 bp, Homo sapiens
cagctgggcccacagcccc

SEQ ID NO: 2154801 - DNA, 21 bp, Homo sapiens
cagctgggcccacagccccca

SEQ ID NO: 2154802 - DNA, 22 bp, Homo sapiens
cagctgggcccacagcccccac

SEQ ID NO: 2154803 - DNA, 23 bp, Homo sapiens
cccaccctgggtttggcccctgg

SEQ ID NO: 2154804 - DNA, 20 bp, Homo sapiens
cccacggggaccactgggcc

SEQ ID NO: 2154805 - DNA, 13 bp, Homo sapiens
cccacgtctctct

SEQ ID NO: 2154806 - DNA, 19 bp, Homo sapiens
cccacgtctctctgcctgc

SEQ ID NO: 2154807 - DNA, 20 bp, Homo sapiens
cccacgtctctctgcctgct

SEQ ID NO: 2154808 - DNA, 19 bp, Homo sapiens
cccactaagctttctcctt

SEQ ID NO: 2154809 - DNA, 18 bp, Homo sapiens
cccagagccactaccttt

SEQ ID NO: 2154810 - DNA, 12 bp, Homo sapiens
cccagcacagct

SEQ ID NO: 2154811 - DNA, 15 bp, Homo sapiens
cccagcacagctcct

SEQ ID NO: 2154812 - DNA, 16 bp, Homo sapiens
cccagcacagctcctc

SEQ ID NO: 2154813 - DNA, 22 bp, Homo sapiens
cccagcacagctcctcccctgc

SEQ ID NO: 2154814 - DNA, 22 bp, Homo sapiens
cccagcagccctaaggatctct

SEQ ID NO: 2154815 - DNA, 11 bp, Homo sapiens
cccagcccacc

SEQ ID NO: 2154816 - DNA, 17 bp, Homo sapiens
cccagccccttctccca

SEQ ID NO: 2154817 - DNA, 18 bp, Homo sapiens
cccagccccttctcccag

SEQ ID NO: 2154818 - DNA, 18 bp, Homo sapiens
cccagctaatctgtaggg

SEQ ID NO: 2154819 - DNA, 19 bp, Homo sapiens
cccagctaatctgtagggc

SEQ ID NO: 2154820 - DNA, 19 bp, Homo sapiens
cccaggaagggagggagct

SEQ ID NO: 2154821 - DNA, 23 bp, Homo sapiens
cccaggaagggagggagctgagg

SEQ ID NO: 2154822 - DNA, 14 bp, Homo sapiens
cccagtgacagcta

SEQ ID NO: 2154823 - DNA, 12 bp, Homo sapiens
cccatccctacc

SEQ ID NO: 2154824 - DNA, 20 bp, Homo sapiens
cccatctcctcccatggcct

SEQ ID NO: 2154825 - DNA, 24 bp, Homo sapiens
cccatctgtccatcctcctctcca

SEQ ID NO: 2154826 - DNA, 21 bp, Homo sapiens
ccccaaagcagcaggcctctg

SEQ ID NO: 2154827 - DNA, 21 bp, Homo sapiens
ccccaagaggggcgggctcag

SEQ ID NO: 2154828 - DNA, 22 bp, Homo sapiens
ccccaatccatttggcagaact

SEQ ID NO: 2154829 - DNA, 17 bp, Homo sapiens
ccccacaccccagccca

SEQ ID NO: 2154830 - DNA, 22 bp, Homo sapiens
ccccaccagagctgcctcccca

SEQ ID NO: 2154831 - DNA, 14 bp, Homo sapiens
ccccaccccagcac

SEQ ID NO: 2154832 - DNA, 13 bp, Homo sapiens
ccccaccctgggt

SEQ ID NO: 2154833 - DNA, 17 bp, Homo sapiens
ccccacgtctctctgcc

SEQ ID NO: 2154834 - DNA, 18 bp, Homo sapiens
ccccacgtctctctgcct

SEQ ID NO: 2154835 - DNA, 17 bp, Homo sapiens
ccccagagacctttgcc

SEQ ID NO: 2154836 - DNA, 22 bp, Homo sapiens
ccccagagccactacctttgtc

SEQ ID NO: 2154837 - DNA, 18 bp, Homo sapiens
ccccagatcaccagcccg

SEQ ID NO: 2154838 - DNA, 14 bp, Homo sapiens
ccccagcacagctc

SEQ ID NO: 2154839 - DNA, 18 bp, Homo sapiens
ccccagcacagctcctcc

SEQ ID NO: 2154840 - DNA, 19 bp, Homo sapiens
ccccagcacagctcctccc

SEQ ID NO: 2154841 - DNA, 14 bp, Homo sapiens
ccccagccccttct

SEQ ID NO: 2154842 - DNA, 13 bp, Homo sapiens
ccccatccctacc

SEQ ID NO: 2154843 - DNA, 21 bp, Homo sapiens
ccccatctcctcccatggcct

SEQ ID NO: 2154844 - DNA, 22 bp, Homo sapiens
cccccacgtctctctgcctgct

SEQ ID NO: 2154845 - DNA, 23 bp, Homo sapiens
cccccacgtctctctgcctgctg

SEQ ID NO: 2154846 - DNA, 22 bp, Homo sapiens
ccccctaccgcatggcagctgg

SEQ ID NO: 2154847 - DNA, 22 bp, Homo sapiens
cccctaccgcatggcagctggg

SEQ ID NO: 2154848 - DNA, 14 bp, Homo sapiens
cccctcacagactc

SEQ ID NO: 2154849 - DNA, 22 bp, Homo sapiens
cccctcaggggaagctgctagg

SEQ ID NO: 2154850 - DNA, 14 bp, Homo sapiens
cccctccccagccc

SEQ ID NO: 2154851 - DNA, 21 bp, Homo sapiens
cccctcccccacgtctctctg

SEQ ID NO: 2154852 - DNA, 22 bp, Homo sapiens
cccctggctgaacagtgctctg

SEQ ID NO: 2154853 - DNA, 16 bp, Homo sapiens
cccctggggctggtgg

SEQ ID NO: 2154854 - DNA, 17 bp, Homo sapiens
cccctggggctggtgga

SEQ ID NO: 2154855 - DNA, 23 bp, Homo sapiens
cccctggggctggtggattgggc

SEQ ID NO: 2154856 - DNA, 13 bp, Homo sapiens
cccctgtcccctg

SEQ ID NO: 2154857 - DNA, 14 bp, Homo sapiens
cccctgtcccctgg

SEQ ID NO: 2154858 - DNA, 18 bp, Homo sapiens
cccctgtcccctggggct

SEQ ID NO: 2154859 - DNA, 15 bp, Homo sapiens
cccggattggccctg

SEQ ID NO: 2154860 - DNA, 17 bp, Homo sapiens
cccggcctgctcccagc

SEQ ID NO: 2154861 - DNA, 21 bp, Homo sapiens
cccggcctgctcccagcagcc

SEQ ID NO: 2154862 - DNA, 16 bp, Homo sapiens
cccgggaagcatcctc

SEQ ID NO: 2154863 - DNA, 19 bp, Homo sapiens
cccgttctgctggcctgga

SEQ ID NO: 2154864 - DNA, 18 bp, Homo sapiens
ccctaccgcatggcagct

SEQ ID NO: 2154865 - DNA, 23 bp, Homo sapiens
ccctaccgcatggcagctgggcc

SEQ ID NO: 2154866 - DNA, 14 bp, Homo sapiens
ccctcacagactct

SEQ ID NO: 2154867 - DNA, 21 bp, Homo sapiens
ccctccccacagtcctcacag

SEQ ID NO: 2154868 - DNA, 13 bp, Homo sapiens
ccctccccagccc

SEQ ID NO: 2154869 - DNA, 17 bp, Homo sapiens
ccctcccctcccagtcc

SEQ ID NO: 2154870 - DNA, 19 bp, Homo sapiens
ccctccctagatccaggct

SEQ ID NO: 2154871 - DNA, 14 bp, Homo sapiens
ccctcctcacactc

SEQ ID NO: 2154872 - DNA, 15 bp, Homo sapiens
ccctcctcacactcc

SEQ ID NO: 2154873 - DNA, 16 bp, Homo sapiens
ccctcctcacactcca

SEQ ID NO: 2154874 - DNA, 18 bp, Homo sapiens
ccctcctcacactccaga

SEQ ID NO: 2154875 - DNA, 12 bp, Homo sapiens
ccctctgcctca

SEQ ID NO: 2154876 - DNA, 20 bp, Homo sapiens
ccctctgcctcatcctcctc

SEQ ID NO: 2154877 - DNA, 20 bp, Homo sapiens
ccctgaatggttccatgcct

SEQ ID NO: 2154878 - DNA, 19 bp, Homo sapiens
ccctgaggatcccctgtcc

SEQ ID NO: 2154879 - DNA, 21 bp, Homo sapiens
ccctgaggatcccctgtcccc

SEQ ID NO: 2154880 - DNA, 10 bp, Homo sapiens
ccctgcccct

SEQ ID NO: 2154881 - DNA, 15 bp, Homo sapiens
ccctgcccctcccta

SEQ ID NO: 2154882 - DNA, 13 bp, Homo sapiens
ccctgcctgctgt

SEQ ID NO: 2154883 - DNA, 14 bp, Homo sapiens
ccctgcctgctgtg

SEQ ID NO: 2154884 - DNA, 18 bp, Homo sapiens
ccctgcctgctgtggagc

SEQ ID NO: 2154885 - DNA, 14 bp, Homo sapiens
ccctgctcctcctg

SEQ ID NO: 2154886 - DNA, 17 bp, Homo sapiens
ccctggaacctttccct

SEQ ID NO: 2154887 - DNA, 12 bp, Homo sapiens
ccctggccacca

SEQ ID NO: 2154888 - DNA, 13 bp, Homo sapiens
ccctggccaccac

SEQ ID NO: 2154889 - DNA, 14 bp, Homo sapiens
ccctggccaccacc

SEQ ID NO: 2154890 - DNA, 22 bp, Homo sapiens
ccctggcctttgaggcaaaggc

SEQ ID NO: 2154891 - DNA, 18 bp, Homo sapiens
ccctggctgaacagtgct

SEQ ID NO: 2154892 - DNA, 21 bp, Homo sapiens
ccctggctgaacagtgctctg

SEQ ID NO: 2154893 - DNA, 12 bp, Homo sapiens
ccctggggcact

SEQ ID NO: 2154894 - DNA, 16 bp, Homo sapiens
ccctggggcactcccc

SEQ ID NO: 2154895 - DNA, 20 bp, Homo sapiens
ccctggggcactcccccagg

SEQ ID NO: 2154896 - DNA, 13 bp, Homo sapiens
ccctggggctggt

SEQ ID NO: 2154897 - DNA, 15 bp, Homo sapiens
ccctggggctggtgg

SEQ ID NO: 2154898 - DNA, 16 bp, Homo sapiens
ccctgggtttggcccc

SEQ ID NO: 2154899 - DNA, 18 bp, Homo sapiens
ccctgggtttggcccctg

SEQ ID NO: 2154900 - DNA, 21 bp, Homo sapiens
ccctgtccccctcccctccca

SEQ ID NO: 2154901 - DNA, 22 bp, Homo sapiens
ccctgtccccctcccctcccag

SEQ ID NO: 2154902 - DNA, 16 bp, Homo sapiens
ccctgtcgagacactt

SEQ ID NO: 2154903 - DNA, 15 bp, Homo sapiens
cccttacacgtacct

SEQ ID NO: 2154904 - DNA, 14 bp, Homo sapiens
cccttcctcatctg

SEQ ID NO: 2154905 - DNA, 23 bp, Homo sapiens
cccttcctcatctgtgcctgtct

SEQ ID NO: 2154906 - DNA, 15 bp, Homo sapiens
cccttctcccagcac

SEQ ID NO: 2154907 - DNA, 18 bp, Homo sapiens
cccttgagtaggccctgc

SEQ ID NO: 2154908 - DNA, 18 bp, Homo sapiens
cccttgcccttcctgacc

SEQ ID NO: 2154909 - DNA, 23 bp, Homo sapiens
cccttttcaagttgagaacaaaa

SEQ ID NO: 2154910 - DNA, 15 bp, Homo sapiens
ccctttttgcagggg

SEQ ID NO: 2154911 - DNA, 23 bp, Homo sapiens
ccctttttgcaggggactgggcc

SEQ ID NO: 2154912 - DNA, 19 bp, Homo sapiens
ctggacctatgtcctaagg

SEQ ID NO: 2154913 - DNA, 16 bp, Homo sapiens
ctggactagggcctcg

SEQ ID NO: 2154914 - DNA, 19 bp, Homo sapiens
ctggactagggcctcggag

SEQ ID NO: 2154915 - DNA, 16 bp, Homo sapiens
ctggagtgcagggagg

SEQ ID NO: 2154916 - DNA, 15 bp, Homo sapiens
ctggccgtggctcca

SEQ ID NO: 2154917 - DNA, 19 bp, Homo sapiens
ctggccgtggctccagaat

SEQ ID NO: 2154918 - DNA, 17 bp, Homo sapiens
ctggcctcttggcacct

SEQ ID NO: 2154919 - DNA, 21 bp, Homo sapiens
ctggcctcttggcacctgcct

SEQ ID NO: 2154920 - DNA, 12 bp, Homo sapiens
ctggcctgctct

SEQ ID NO: 2154921 - DNA, 15 bp, Homo sapiens
ctggcctgctcttac

SEQ ID NO: 2154922 - DNA, 21 bp, Homo sapiens
ctggcctgctcttacttcccc

SEQ ID NO: 2154923 - DNA, 14 bp, Homo sapiens
ctggcctggatctc

SEQ ID NO: 2154924 - DNA, 22 bp, Homo sapiens
ctggcctggatctccccactct

SEQ ID NO: 2154925 - DNA, 13 bp, Homo sapiens
ctggctcagctgt

SEQ ID NO: 2154926 - DNA, 14 bp, Homo sapiens
ctggctcagctgtg

SEQ ID NO: 2154927 - DNA, 15 bp, Homo sapiens
ctggctcagctgtgg

SEQ ID NO: 2154928 - DNA, 16 bp, Homo sapiens
ctggctgaacagtgct

SEQ ID NO: 2154929 - DNA, 17 bp, Homo sapiens
ctggctgaacagtgctc

SEQ ID NO: 2154930 - DNA, 19 bp, Homo sapiens
ctggctgaacagtgctctg

SEQ ID NO: 2154931 - DNA, 21 bp, Homo sapiens
ctggctgaacagtgctctgcc

SEQ ID NO: 2154932 - DNA, 22 bp, Homo sapiens
ctggctgaacagtgctctgcct

SEQ ID NO: 2154933 - DNA, 23 bp, Homo sapiens
ctgggccatgggtcctcggccca

SEQ ID NO: 2154934 - DNA, 13 bp, Homo sapiens
ctgggcccccaga

SEQ ID NO: 2154935 - DNA, 23 bp, Homo sapiens
ctgggcccctcaggggaagctgc

SEQ ID NO: 2154936 - DNA, 19 bp, Homo sapiens
ctggggcactcccccagga

SEQ ID NO: 2154937 - DNA, 12 bp, Homo sapiens
ctggggctggtg

SEQ ID NO: 2154938 - DNA, 17 bp, Homo sapiens
ctggggctggtgaggcc

SEQ ID NO: 2154939 - DNA, 23 bp, Homo sapiens
ctggggctggtggattgggcaga

SEQ ID NO: 2154940 - DNA, 18 bp, Homo sapiens
ctgggggctccccttgcc

SEQ ID NO: 2154941 - DNA, 18 bp, Homo sapiens
ctgggtttggcccctgga

SEQ ID NO: 2154942 - DNA, 21 bp, Homo sapiens
ctggtgaggccggccctgccc

SEQ ID NO: 2154943 - DNA, 22 bp, Homo sapiens
ctggtgaggccggccctgcccc

SEQ ID NO: 2154944 - DNA, 23 bp, Homo sapiens
ctggtgaggccggccctgcccct

SEQ ID NO: 2154945 - DNA, 17 bp, Homo sapiens
ctggtggattgggcaga

SEQ ID NO: 2154946 - DNA, 17 bp, Homo sapiens
ctggtttgaagaatgtt

SEQ ID NO: 2154947 - DNA, 22 bp, Homo sapiens
ctgtacagaagaaactgaatct

SEQ ID NO: 2154948 - DNA, 17 bp, Homo sapiens
ctgtagccccagtgaca

SEQ ID NO: 2154949 - DNA, 15 bp, Homo sapiens
ctgtagggctggacc

SEQ ID NO: 2154950 - DNA, 16 bp, Homo sapiens
ctgtagggctggacct

SEQ ID NO: 2154951 - DNA, 17 bp, Homo sapiens
ctgtagggctggaccta

SEQ ID NO: 2154952 - DNA, 18 bp, Homo sapiens
ctgtagggctggacctat

SEQ ID NO: 2154953 - DNA, 11 bp, Homo sapiens
ctgtcacaata

SEQ ID NO: 2154954 - DNA, 13 bp, Homo sapiens
ctgtcacaataaa

SEQ ID NO: 2154955 - DNA, 20 bp, Homo sapiens
ctgtcacaataaagtttatt

SEQ ID NO: 2154956 - DNA, 15 bp, Homo sapiens
ctgtcaccctggcca

SEQ ID NO: 2154957 - DNA, 16 bp, Homo sapiens
ctgtccaacccctccc

SEQ ID NO: 2154958 - DNA, 18 bp, Homo sapiens
ctgtccaacccctccccc

SEQ ID NO: 2154959 - DNA, 14 bp, Homo sapiens
ctgtccagtttcca

SEQ ID NO: 2154960 - DNA, 15 bp, Homo sapiens
ctgtccatcctcctc

SEQ ID NO: 2154961 - DNA, 21 bp, Homo sapiens
ctgtccatcctcctctccatg

SEQ ID NO: 2154962 - DNA, 20 bp, Homo sapiens
ctgtccccctcccctcccag

SEQ ID NO: 2154963 - DNA, 13 bp, Homo sapiens
ctgtcccctcaca

SEQ ID NO: 2154964 - DNA, 14 bp, Homo sapiens
ctgtcccctcacag

SEQ ID NO: 2154965 - DNA, 21 bp, Homo sapiens
ctgtcccctggggctggtgga

SEQ ID NO: 2154966 - DNA, 24 bp, Homo sapiens
ctgtccttactcagagctgcgggc

SEQ ID NO: 2154967 - DNA, 13 bp, Homo sapiens
ctgtcgagacact

SEQ ID NO: 2154968 - DNA, 19 bp, Homo sapiens
ctgtcgattagactggaca

SEQ ID NO: 2154969 - DNA, 18 bp, Homo sapiens
ctgtctgtccaacccctc

SEQ ID NO: 2154970 - DNA, 14 bp, Homo sapiens
ctgtgaatacaatt

SEQ ID NO: 2154971 - DNA, 16 bp, Homo sapiens
ctgtgaatacaattaa

SEQ ID NO: 2154972 - DNA, 18 bp, Homo sapiens
ctgtgcccacatcccagg

SEQ ID NO: 2154973 - DNA, 23 bp, Homo sapiens
ctgtgcccacatcccaggcttca

SEQ ID NO: 2154974 - DNA, 17 bp, Homo sapiens
ctgtgcctgtctgtcca

SEQ ID NO: 2154975 - DNA, 18 bp, Homo sapiens
ctgtgcctgtctgtccaa

SEQ ID NO: 2154976 - DNA, 11 bp, Homo sapiens
ctgtgctccca

SEQ ID NO: 2154977 - DNA, 13 bp, Homo sapiens
ctgtggtcccacc

SEQ ID NO: 2154978 - DNA, 17 bp, Homo sapiens
ctgtggtcccacccagg

SEQ ID NO: 2154979 - DNA, 18 bp, Homo sapiens
ctgtggtcccacccagga

SEQ ID NO: 2154980 - DNA, 18 bp, Homo sapiens
ctgttacccagagaatat

SEQ ID NO: 2154981 - DNA, 21 bp, Homo sapiens
ctgttgtgtatagatgcaaga

SEQ ID NO: 2154982 - DNA, 21 bp, Homo sapiens
ctgtttaaaaaaagtatatat

SEQ ID NO: 2154983 - DNA, 23 bp, Homo sapiens
ctgtttaaaaaaagtatatattc

SEQ ID NO: 2154984 - DNA, 16 bp, Homo sapiens
cttaacggctccagga

SEQ ID NO: 2154985 - DNA, 18 bp, Homo sapiens
cttacctaaacagatata

SEQ ID NO: 2154986 - DNA, 21 bp, Homo sapiens
cttacctaaacagatataaat

SEQ ID NO: 2154987 - DNA, 22 bp, Homo sapiens
cttacctaaacagatataaatg

SEQ ID NO: 2154988 - DNA, 13 bp, Homo sapiens
cttactcagagct

SEQ ID NO: 2154989 - DNA, 16 bp, Homo sapiens
cttacttcccccaccc

SEQ ID NO: 2154990 - DNA, 16 bp, Homo sapiens
cttatacgagtaatat

SEQ ID NO: 2154991 - DNA, 20 bp, Homo sapiens
cttattcatgctttctcctt

SEQ ID NO: 2154992 - DNA, 22 bp, Homo sapiens
cttattcatgctttctcctttt

SEQ ID NO: 2154993 - DNA, 14 bp, Homo sapiens
cttatttgtataat

SEQ ID NO: 2154994 - DNA, 24 bp, Homo sapiens
cttcacccagctaatctgtagggc

SEQ ID NO: 2154995 - DNA, 22 bp, Homo sapiens
cttccaccagagcaggggctgc

SEQ ID NO: 2154996 - DNA, 23 bp, Homo sapiens
cttccaccagagcaggggctgct

SEQ ID NO: 2154997 - DNA, 24 bp, Homo sapiens
cttccaccagagcaggggctgctg

SEQ ID NO: 2154998 - DNA, 15 bp, Homo sapiens
cttcccccaccctgg

SEQ ID NO: 2154999 - DNA, 14 bp, Homo sapiens
cttcccccatccct

SEQ ID NO: 2155000 - DNA, 16 bp, Homo sapiens
cttccccttgtccctg

SEQ ID NO: 2155001 - DNA, 21 bp, Homo sapiens
cttcctcatctgtgcctgtct

SEQ ID NO: 2155002 - DNA, 22 bp, Homo sapiens
cttcctcatctgtgcctgtctg

SEQ ID NO: 2155003 - DNA, 23 bp, Homo sapiens
cttcctgacccggattggccctg

SEQ ID NO: 2155004 - DNA, 14 bp, Homo sapiens
cttcgactcaggat

SEQ ID NO: 2155005 - DNA, 15 bp, Homo sapiens
cttctatcccaggag

SEQ ID NO: 2155006 - DNA, 15 bp, Homo sapiens
cttctcccagcacac

SEQ ID NO: 2155007 - DNA, 14 bp, Homo sapiens
cttctcccggacct

SEQ ID NO: 2155008 - DNA, 16 bp, Homo sapiens
cttctcccggacctgg

SEQ ID NO: 2155009 - DNA, 14 bp, Homo sapiens
cttgacattcaagg

SEQ ID NO: 2155010 - DNA, 17 bp, Homo sapiens
cttgagtaggccctgct

SEQ ID NO: 2155011 - DNA, 21 bp, Homo sapiens
cttgccacatggtgtctccca

SEQ ID NO: 2155012 - DNA, 22 bp, Homo sapiens
cttgccacatggtgtctcccaa

SEQ ID NO: 2155013 - DNA, 13 bp, Homo sapiens
cttgcccttcctg

SEQ ID NO: 2155014 - DNA, 12 bp, Homo sapiens
cttggcacctgc

SEQ ID NO: 2155015 - DNA, 13 bp, Homo sapiens
cttggcacctgcc

SEQ ID NO: 2155016 - DNA, 17 bp, Homo sapiens
cttggcacctgcctagc

SEQ ID NO: 2155017 - DNA, 18 bp, Homo sapiens
cttggcacctgcctagct

SEQ ID NO: 2155018 - DNA, 18 bp, Homo sapiens
cttgggcctgacctccag

SEQ ID NO: 2155019 - DNA, 14 bp, Homo sapiens
cttgtccctggggc

SEQ ID NO: 2155020 - DNA, 15 bp, Homo sapiens
cttgtccctggggca

SEQ ID NO: 2155021 - DNA, 15 bp, Homo sapiens
ggcctgacctccagt

SEQ ID NO: 2155022 - DNA, 21 bp, Homo sapiens
ggcctgctcttacttccccca

SEQ ID NO: 2155023 - DNA, 18 bp, Homo sapiens
ggcctggggctcctttct

SEQ ID NO: 2155024 - DNA, 17 bp, Homo sapiens
ggcctgtgggagcctgc

SEQ ID NO: 2155025 - DNA, 18 bp, Homo sapiens
ggcgctgccacctgcccc

SEQ ID NO: 2155026 - DNA, 13 bp, Homo sapiens
ggcgggctcagag

SEQ ID NO: 2155027 - DNA, 14 bp, Homo sapiens
ggcgggctcagagc

SEQ ID NO: 2155028 - DNA, 18 bp, Homo sapiens
ggcgggctcagagctttg

SEQ ID NO: 2155029 - DNA, 12 bp, Homo sapiens
ggctcagagctt

SEQ ID NO: 2155030 - DNA, 14 bp, Homo sapiens
ggctcagagctttg

SEQ ID NO: 2155031 - DNA, 18 bp, Homo sapiens
ggctccagaatgtgctgc

SEQ ID NO: 2155032 - DNA, 21 bp, Homo sapiens
ggctccagaatgtgctgcctt

SEQ ID NO: 2155033 - DNA, 19 bp, Homo sapiens
ggctcctccctctgcctca

SEQ ID NO: 2155034 - DNA, 21 bp, Homo sapiens
ggctcctccctctgcctcatc

SEQ ID NO: 2155035 - DNA, 19 bp, Homo sapiens
ggctcctttctccagccag

SEQ ID NO: 2155036 - DNA, 20 bp, Homo sapiens
ggctcctttctccagccagc

SEQ ID NO: 2155037 - DNA, 17 bp, Homo sapiens
ggctgagggcatctctg

SEQ ID NO: 2155038 - DNA, 11 bp, Homo sapiens
ggctgctgggg

SEQ ID NO: 2155039 - DNA, 20 bp, Homo sapiens
ggctgctgggggctcccctt

SEQ ID NO: 2155040 - DNA, 22 bp, Homo sapiens
ggctgctgggggctccccttgc

SEQ ID NO: 2155041 - DNA, 23 bp, Homo sapiens
ggctgctgggggctccccttgcc

SEQ ID NO: 2155042 - DNA, 16 bp, Homo sapiens
ggctggacctatgtcc

SEQ ID NO: 2155043 - DNA, 22 bp, Homo sapiens
ggctggacctatgtcctaagga

SEQ ID NO: 2155044 - DNA, 16 bp, Homo sapiens
ggctggtgaggccggc

SEQ ID NO: 2155045 - DNA, 17 bp, Homo sapiens
gggaagcatcctcccca

SEQ ID NO: 2155046 - DNA, 18 bp, Homo sapiens
gggaagcatcctccccac

SEQ ID NO: 2155047 - DNA, 12 bp, Homo sapiens
gggaagggccag

SEQ ID NO: 2155048 - DNA, 16 bp, Homo sapiens
gggaagggccagtctg

SEQ ID NO: 2155049 - DNA, 16 bp, Homo sapiens
gggaccactgggcccc

SEQ ID NO: 2155050 - DNA, 19 bp, Homo sapiens
gggaccactgggcccctca

SEQ ID NO: 2155051 - DNA, 17 bp, Homo sapiens
gggactgggccatgggt

SEQ ID NO: 2155052 - DNA, 15 bp, Homo sapiens
gggagaaggcctccc

SEQ ID NO: 2155053 - DNA, 17 bp, Homo sapiens
gggagaaggcctcccct

SEQ ID NO: 2155054 - DNA, 11 bp, Homo sapiens
gggagcactgg

SEQ ID NO: 2155055 - DNA, 20 bp, Homo sapiens
gggagggactgctgacccac

SEQ ID NO: 2155056 - DNA, 16 bp, Homo sapiens
gggagggatcagcccc

SEQ ID NO: 2155057 - DNA, 13 bp, Homo sapiens
gggcactccccca

SEQ ID NO: 2155058 - DNA, 22 bp, Homo sapiens
gggcagaatcctgggcccccag

SEQ ID NO: 2155059 - DNA, 15 bp, Homo sapiens
gggcagtggggagca

SEQ ID NO: 2155060 - DNA, 19 bp, Homo sapiens
gggccagcaggcagcgcct

SEQ ID NO: 2155061 - DNA, 13 bp, Homo sapiens
gggccatgggtcc

SEQ ID NO: 2155062 - DNA, 15 bp, Homo sapiens
gggcccacagccccc

SEQ ID NO: 2155063 - DNA, 17 bp, Homo sapiens
gggcccacagcccccac

SEQ ID NO: 2155064 - DNA, 20 bp, Homo sapiens
gggcccacagcccccacccc

SEQ ID NO: 2155065 - DNA, 15 bp, Homo sapiens
gggcccccagagacc

SEQ ID NO: 2155066 - DNA, 12 bp, Homo sapiens
gggcccctcagg

SEQ ID NO: 2155067 - DNA, 20 bp, Homo sapiens
gggcctcggaggctcctccc

SEQ ID NO: 2155068 - DNA, 21 bp, Homo sapiens
gggcctcggaggctcctccct

SEQ ID NO: 2155069 - DNA, 22 bp, Homo sapiens
gggcctcggaggctcctccctc

SEQ ID NO: 2155070 - DNA, 15 bp, Homo sapiens
gggcctgacctccag

SEQ ID NO: 2155071 - DNA, 21 bp, Homo sapiens
gggcctgacctccagtcctgc

SEQ ID NO: 2155072 - DNA, 13 bp, Homo sapiens
gggcgggctcaga

SEQ ID NO: 2155073 - DNA, 17 bp, Homo sapiens
gggcgggctcagagctt

SEQ ID NO: 2155074 - DNA, 20 bp, Homo sapiens
gggctcagagctttgtcact

SEQ ID NO: 2155075 - DNA, 22 bp, Homo sapiens
gggctcagagctttgtcacttg

SEQ ID NO: 2155076 - DNA, 14 bp, Homo sapiens
gggctccccttgcc

SEQ ID NO: 2155077 - DNA, 18 bp, Homo sapiens
gggctcctttctccagcc

SEQ ID NO: 2155078 - DNA, 20 bp, Homo sapiens
gggctcctttctccagccag

SEQ ID NO: 2155079 - DNA, 14 bp, Homo sapiens
gggctgctgggggc

SEQ ID NO: 2155080 - DNA, 15 bp, Homo sapiens
gggctgctgggggct

SEQ ID NO: 2155081 - DNA, 22 bp, Homo sapiens
gggctggtgaggccggccctgc

SEQ ID NO: 2155082 - DNA, 23 bp, Homo sapiens
gggctggtgaggccggccctgcc

SEQ ID NO: 2155083 - DNA, 13 bp, Homo sapiens
ggggaagctgcta

SEQ ID NO: 2155084 - DNA, 15 bp, Homo sapiens
ggggaaggactggcc

SEQ ID NO: 2155085 - DNA, 22 bp, Homo sapiens
ggggaagggccagtctgggctg

SEQ ID NO: 2155086 - DNA, 14 bp, Homo sapiens
ggggaccactgggc

SEQ ID NO: 2155087 - DNA, 15 bp, Homo sapiens
ggggaccactgggcc

SEQ ID NO: 2155088 - DNA, 21 bp, Homo sapiens
ggggaccactgggcccctcag

SEQ ID NO: 2155089 - DNA, 12 bp, Homo sapiens
ggggactgggcc

SEQ ID NO: 2155090 - DNA, 22 bp, Homo sapiens
ggggactgggccatgggtcctc

SEQ ID NO: 2155091 - DNA, 16 bp, Homo sapiens
ggggagaaggcctccc

SEQ ID NO: 2155092 - DNA, 13 bp, Homo sapiens
ggggcgggctcag

SEQ ID NO: 2155093 - DNA, 22 bp, Homo sapiens
ggggctcctttctccagccagc

SEQ ID NO: 2155094 - DNA, 14 bp, Homo sapiens
ggggctgctggggg

SEQ ID NO: 2155095 - DNA, 17 bp, Homo sapiens
gggggaatgcacctccc

SEQ ID NO: 2155096 - DNA, 13 bp, Homo sapiens
gggggctcccctt

SEQ ID NO: 2155097 - DNA, 15 bp, Homo sapiens
ggggtccatcccctt

SEQ ID NO: 2155098 - DNA, 21 bp, Homo sapiens
gggtaccaggcacatggctgg

SEQ ID NO: 2155099 - DNA, 13 bp, Homo sapiens
ggtactaccccag

SEQ ID NO: 2155100 - DNA, 13 bp, Homo sapiens
ggtcaggctccat

SEQ ID NO: 2155101 - DNA, 22 bp, Homo sapiens
ggtcccaagtagtagtgtcttc

SEQ ID NO: 2155102 - DNA, 15 bp, Homo sapiens
ggtcctcggcccatc

SEQ ID NO: 2155103 - DNA, 20 bp, Homo sapiens
ggtccttgcctgaactccag

SEQ ID NO: 2155104 - DNA, 13 bp, Homo sapiens
ggtcggccctgcc

SEQ ID NO: 2155105 - DNA, 15 bp, Homo sapiens
ggtcggccctgccca

SEQ ID NO: 2155106 - DNA, 15 bp, Homo sapiens
ggtctcacactcctc

SEQ ID NO: 2155107 - DNA, 16 bp, Homo sapiens
ggtctcacactcctcc

SEQ ID NO: 2155108 - DNA, 18 bp, Homo sapiens
ggtctcacactcctcctg

SEQ ID NO: 2155109 - DNA, 19 bp, Homo sapiens
ggtctcacactcctcctgc

SEQ ID NO: 2155110 - DNA, 24 bp, Homo sapiens
ggtctcacactcctcctgccagct

SEQ ID NO: 2155111 - DNA, 19 bp, Homo sapiens
ggtgaggccggccctgccc

SEQ ID NO: 2155112 - DNA, 18 bp, Homo sapiens
ggtgtctcccaacatggg

SEQ ID NO: 2155113 - DNA, 14 bp, Homo sapiens
ggttgcaaccactg

SEQ ID NO: 2155114 - DNA, 13 bp, Homo sapiens
ggttgtcaatatt

SEQ ID NO: 2155115 - DNA, 17 bp, Homo sapiens
gtaaaaagattatatat

SEQ ID NO: 2155116 - DNA, 12 bp, Homo sapiens
gtaactcccact

SEQ ID NO: 2155117 - DNA, 15 bp, Homo sapiens
gtaactcccactcct

SEQ ID NO: 2155118 - DNA, 19 bp, Homo sapiens
gtaagatggcttatttgta

SEQ ID NO: 2155119 - DNA, 16 bp, Homo sapiens
gtacaaagatatgcta

SEQ ID NO: 2155120 - DNA, 16 bp, Homo sapiens
gtacacagcaccagaa

SEQ ID NO: 2155121 - DNA, 19 bp, Homo sapiens
gtaccaagccaccgcagct

SEQ ID NO: 2155122 - DNA, 16 bp, Homo sapiens
gtaccacaccctgcct

SEQ ID NO: 2155123 - DNA, 18 bp, Homo sapiens
gtaccaggcacatggctg

SEQ ID NO: 2155124 - DNA, 22 bp, Homo sapiens
gtaccaggcacatggctggggg

SEQ ID NO: 2155125 - DNA, 23 bp, Homo sapiens
gtaccaggcacatggctggggga

SEQ ID NO: 2155126 - DNA, 16 bp, Homo sapiens
gtagaatgtaaagctt

SEQ ID NO: 2155127 - DNA, 19 bp, Homo sapiens
gtagaatgtaaagcttgtc

SEQ ID NO: 2155128 - DNA, 23 bp, Homo sapiens
gtagcacaagttatttaaatctg

SEQ ID NO: 2155129 - DNA, 22 bp, Homo sapiens
gtagtgtcttcctagtatatta

SEQ ID NO: 2155130 - DNA, 10 bp, Homo sapiens
gtatatatat

SEQ ID NO: 2155131 - DNA, 15 bp, Homo sapiens
tcctttgcactgagg

SEQ ID NO: 2155132 - DNA, 17 bp, Homo sapiens
tcctttgcactgagggc

SEQ ID NO: 2155133 - DNA, 21 bp, Homo sapiens
tcgaaacctgtccataaagta

SEQ ID NO: 2155134 - DNA, 14 bp, Homo sapiens
tcgaactgtgctcc

SEQ ID NO: 2155135 - DNA, 18 bp, Homo sapiens
tcgaactgtgctcccacg

SEQ ID NO: 2155136 - DNA, 15 bp, Homo sapiens
tcgccccagatcacc

SEQ ID NO: 2155137 - DNA, 18 bp, Homo sapiens
tcgccccagatcaccagc

SEQ ID NO: 2155138 - DNA, 13 bp, Homo sapiens
tcggaggctcctc

SEQ ID NO: 2155139 - DNA, 16 bp, Homo sapiens
tcggaggctcctccct

SEQ ID NO: 2155140 - DNA, 13 bp, Homo sapiens
tcggccctgccca

SEQ ID NO: 2155141 - DNA, 15 bp, Homo sapiens
tctaactccctcctc

SEQ ID NO: 2155142 - DNA, 16 bp, Homo sapiens
tctaactccctcctca

SEQ ID NO: 2155143 - DNA, 14 bp, Homo sapiens
tctaagttaattta

SEQ ID NO: 2155144 - DNA, 19 bp, Homo sapiens
tctacacatatatgtatat

SEQ ID NO: 2155145 - DNA, 22 bp, Homo sapiens
tctagtctcctttgcactgagg

SEQ ID NO: 2155146 - DNA, 18 bp, Homo sapiens
tctcaggagcacaggcag

SEQ ID NO: 2155147 - DNA, 17 bp, Homo sapiens
tctcatttttccgtaaa

SEQ ID NO: 2155148 - DNA, 20 bp, Homo sapiens
tctccaagtctctctgtgaa

SEQ ID NO: 2155149 - DNA, 12 bp, Homo sapiens
tctccagccagc

SEQ ID NO: 2155150 - DNA, 16 bp, Homo sapiens
tctccagccagcaatg

SEQ ID NO: 2155151 - DNA, 15 bp, Homo sapiens
tctccatgcaagtgc

SEQ ID NO: 2155152 - DNA, 16 bp, Homo sapiens
tctccatgcaagtgct

SEQ ID NO: 2155153 - DNA, 12 bp, Homo sapiens
tctcccaacatg

SEQ ID NO: 2155154 - DNA, 14 bp, Homo sapiens
tctcccaacatggg

SEQ ID NO: 2155155 - DNA, 17 bp, Homo sapiens
tctcccaacatgggagg

SEQ ID NO: 2155156 - DNA, 16 bp, Homo sapiens
tctcctcccatggcct

SEQ ID NO: 2155157 - DNA, 16 bp, Homo sapiens
tctcctgtgcccacat

SEQ ID NO: 2155158 - DNA, 21 bp, Homo sapiens
tctcctttgcactgagggcca

SEQ ID NO: 2155159 - DNA, 23 bp, Homo sapiens
tctcctttgcactgagggccaca

SEQ ID NO: 2155160 - DNA, 20 bp, Homo sapiens
tctctaaactgctgttaatt

SEQ ID NO: 2155161 - DNA, 17 bp, Homo sapiens
tctctcaggagcacagg

SEQ ID NO: 2155162 - DNA, 21 bp, Homo sapiens
tctctcaggagcacaggcagc

SEQ ID NO: 2155163 - DNA, 22 bp, Homo sapiens
tctctcaggagcacaggcagct

SEQ ID NO: 2155164 - DNA, 12 bp, Homo sapiens
tctctccagcct

SEQ ID NO: 2155165 - DNA, 13 bp, Homo sapiens
tctctccagcctc

SEQ ID NO: 2155166 - DNA, 12 bp, Homo sapiens
tctctctgcctg

SEQ ID NO: 2155167 - DNA, 19 bp, Homo sapiens
tctctctgcctgctgggct

SEQ ID NO: 2155168 - DNA, 13 bp, Homo sapiens
tctctctgtgaat

SEQ ID NO: 2155169 - DNA, 22 bp, Homo sapiens
tctctgagatgcccctctgcct

SEQ ID NO: 2155170 - DNA, 13 bp, Homo sapiens
tctctgcctgctg

SEQ ID NO: 2155171 - DNA, 15 bp, Homo sapiens
tctctgcctgctggg

SEQ ID NO: 2155172 - DNA, 18 bp, Homo sapiens
tctctgcctgctgggctc

SEQ ID NO: 2155173 - DNA, 15 bp, Homo sapiens
tctctgtgaatacaa

SEQ ID NO: 2155174 - DNA, 20 bp, Homo sapiens
tctctgtgaatacaattaaa

SEQ ID NO: 2155175 - DNA, 11 bp, Homo sapiens
tctcttcctac

SEQ ID NO: 2155176 - DNA, 18 bp, Homo sapiens
tctgaggccccaggccct

SEQ ID NO: 2155177 - DNA, 22 bp, Homo sapiens
tctgagtgtctctgcctggagc

SEQ ID NO: 2155178 - DNA, 23 bp, Homo sapiens
tctgagtgtctctgcctggagca

SEQ ID NO: 2155179 - DNA, 14 bp, Homo sapiens
tctgcctcatcctc

SEQ ID NO: 2155180 - DNA, 15 bp, Homo sapiens
tctgctggcctggat

SEQ ID NO: 2155181 - DNA, 17 bp, Homo sapiens
tctgctggcctggatct

SEQ ID NO: 2155182 - DNA, 18 bp, Homo sapiens
tctgctggcctggatctc

SEQ ID NO: 2155183 - DNA, 23 bp, Homo sapiens
tctggacaagccaacttgtaaat

SEQ ID NO: 2155184 - DNA, 18 bp, Homo sapiens
tctggcaaagttatattt

SEQ ID NO: 2155185 - DNA, 14 bp, Homo sapiens
tctggctcagctgt

SEQ ID NO: 2155186 - DNA, 19 bp, Homo sapiens
tctggctcagctgtggtcc

SEQ ID NO: 2155187 - DNA, 21 bp, Homo sapiens
tctggctcagctgtggtccca

SEQ ID NO: 2155188 - DNA, 17 bp, Homo sapiens
tctgtagggctggacct

SEQ ID NO: 2155189 - DNA, 16 bp, Homo sapiens
tctgtcaccctggcca

SEQ ID NO: 2155190 - DNA, 18 bp, Homo sapiens
tctgtcaccctggccacc

SEQ ID NO: 2155191 - DNA, 20 bp, Homo sapiens
tctgtccaacccctccccca

SEQ ID NO: 2155192 - DNA, 19 bp, Homo sapiens
tctgtccatcctcctctcc

SEQ ID NO: 2155193 - DNA, 20 bp, Homo sapiens
tctgtgaatacaattaaagg

SEQ ID NO: 2155194 - DNA, 22 bp, Homo sapiens
tctgtgaatacaattaaaggtc

SEQ ID NO: 2155195 - DNA, 18 bp, Homo sapiens
tctgtgcctgtctgtcca

SEQ ID NO: 2155196 - DNA, 17 bp, Homo sapiens
tcttataggtttccact

SEQ ID NO: 2155197 - DNA, 19 bp, Homo sapiens
tcttcacccagctaatctg

SEQ ID NO: 2155198 - DNA, 20 bp, Homo sapiens
tcttcacccagctaatctgt

SEQ ID NO: 2155199 - DNA, 17 bp, Homo sapiens
tcttccaccagagcagg

SEQ ID NO: 2155200 - DNA, 16 bp, Homo sapiens
tcttggcacctgccta

SEQ ID NO: 2155201 - DNA, 18 bp, Homo sapiens
tcttgggcctgacctcca

SEQ ID NO: 2155202 - DNA, 23 bp, Homo sapiens
tcttgggcctgacctccagtcct

SEQ ID NO: 2155203 - DNA, 13 bp, Homo sapiens
tctttacctgaga

SEQ ID NO: 2155204 - DNA, 16 bp, Homo sapiens
tctttacctgagacca

SEQ ID NO: 2155205 - DNA, 21 bp, Homo sapiens
tctttctttacctgagaccag

SEQ ID NO: 2155206 - DNA, 17 bp, Homo sapiens
tgaaaacccctggctga

SEQ ID NO: 2155207 - DNA, 17 bp, Homo sapiens
tgaaattcaacctgtgt

SEQ ID NO: 2155208 - DNA, 17 bp, Homo sapiens
tgaacaaaagcttttct

SEQ ID NO: 2155209 - DNA, 15 bp, Homo sapiens
tgaacaaatggcctt

SEQ ID NO: 2155210 - DNA, 13 bp, Homo sapiens
tgaagaatgttaa

SEQ ID NO: 2155211 - DNA, 15 bp, Homo sapiens
tgaatacaattaaag

SEQ ID NO: 2155212 - DNA, 20 bp, Homo sapiens
tgaatacaattaaaggtcct

SEQ ID NO: 2155213 - DNA, 14 bp, Homo sapiens
tgacagaaatgcaa

SEQ ID NO: 2155214 - DNA, 19 bp, Homo sapiens
tgacagatgtcagccgagc

SEQ ID NO: 2155215 - DNA, 23 bp, Homo sapiens
tgacagtgacgtgactcagagct

SEQ ID NO: 2155216 - DNA, 16 bp, Homo sapiens
tgacagtggaactaca

SEQ ID NO: 2155217 - DNA, 18 bp, Homo sapiens
tgacagtggaactacatt

SEQ ID NO: 2155218 - DNA, 23 bp, Homo sapiens
tgacatcagaagtaactcccact

SEQ ID NO: 2155219 - DNA, 15 bp, Homo sapiens
tgacattcaaggcat

SEQ ID NO: 2155220 - DNA, 15 bp, Homo sapiens
tgaccaaaagttaca

SEQ ID NO: 2155221 - DNA, 16 bp, Homo sapiens
tgaccaaaagttacat

SEQ ID NO: 2155222 - DNA, 22 bp, Homo sapiens
tgaccaaaagttacatgtttgc

SEQ ID NO: 2155223 - DNA, 23 bp, Homo sapiens
tgaccaaaagttacatgtttgca

SEQ ID NO: 2155224 - DNA, 21 bp, Homo sapiens
tgacccaccaaggtctcacac

SEQ ID NO: 2155225 - DNA, 18 bp, Homo sapiens
tgacctccagtcctgctg

SEQ ID NO: 2155226 - DNA, 19 bp, Homo sapiens
tgacctccagtcctgctgg

SEQ ID NO: 2155227 - DNA, 20 bp, Homo sapiens
tgacctccagtcctgctggc

SEQ ID NO: 2155228 - DNA, 13 bp, Homo sapiens
tgacgtgactcag

SEQ ID NO: 2155229 - DNA, 16 bp, Homo sapiens
tgacgtgactcagagc

SEQ ID NO: 2155230 - DNA, 17 bp, Homo sapiens
tgacgtgactcagagct

SEQ ID NO: 2155231 - DNA, 18 bp, Homo sapiens
tgacgtgactcagagctt

SEQ ID NO: 2155232 - DNA, 12 bp, Homo sapiens
tgactcagagct

SEQ ID NO: 2155233 - DNA, 13 bp, Homo sapiens
tgactcagagctt

SEQ ID NO: 2155234 - DNA, 18 bp, Homo sapiens
tgagagacattaactcat

SEQ ID NO: 2155235 - DNA, 12 bp, Homo sapiens
tgagagtgtgac

SEQ ID NO: 2155236 - DNA, 20 bp, Homo sapiens
tgagcaaggacaacctgccc

SEQ ID NO: 2155237 - DNA, 20 bp, Homo sapiens
tgaggcaaaggccagcagca

SEQ ID NO: 2155238 - DNA, 13 bp, Homo sapiens
tgaggccccaggc

SEQ ID NO: 2155239 - DNA, 16 bp, Homo sapiens
tgaggccccaggccct

SEQ ID NO: 2155240 - DNA, 16 bp, Homo sapiens
tgaggccggccctgcc

SEQ ID NO: 2155241 - DNA, 20 bp, Homo sapiens
aaaagattatatatcataaa

SEQ ID NO: 2155242 - DNA, 14 bp, Homo sapiens
aaaagcaagactgt

SEQ ID NO: 2155243 - DNA, 11 bp, Homo sapiens
aaaagtatata

SEQ ID NO: 2155244 - DNA, 18 bp, Homo sapiens
aaaagttacatgtttgca

SEQ ID NO: 2155245 - DNA, 15 bp, Homo sapiens
aaaatgcattatgtg

SEQ ID NO: 2155246 - DNA, 20 bp, Homo sapiens
aaaatttatattgtaaatat

SEQ ID NO: 2155247 - DNA, 15 bp, Homo sapiens
aaacagatataaatg

SEQ ID NO: 2155248 - DNA, 17 bp, Homo sapiens
aaacctgtccataaagt

SEQ ID NO: 2155249 - DNA, 14 bp, Homo sapiens
aaactgctgttaat

SEQ ID NO: 2155250 - DNA, 17 bp, Homo sapiens
aaagagtctctggctca

SEQ ID NO: 2155251 - DNA, 22 bp, Homo sapiens
aaagagtctctggctcagctgt

SEQ ID NO: 2155252 - DNA, 15 bp, Homo sapiens
aaagattatatatca

SEQ ID NO: 2155253 - DNA, 22 bp, Homo sapiens
aaagattatatatcataaagta

SEQ ID NO: 2155254 - DNA, 13 bp, Homo sapiens
aaagccacatttt

SEQ ID NO: 2155255 - DNA, 18 bp, Homo sapiens
aaagctctgaacaaaagc

SEQ ID NO: 2155256 - DNA, 13 bp, Homo sapiens
aaaggtatttaga

SEQ ID NO: 2155257 - DNA, 15 bp, Homo sapiens
aaaggtcctgccctc

SEQ ID NO: 2155258 - DNA, 16 bp, Homo sapiens
aaagtaattttgtgaa

SEQ ID NO: 2155259 - DNA, 14 bp, Homo sapiens
aaagtatatattct

SEQ ID NO: 2155260 - DNA, 15 bp, Homo sapiens
aaagtatatattcta

SEQ ID NO: 2155261 - DNA, 21 bp, Homo sapiens
aaagtatgccttcctgtttaa

SEQ ID NO: 2155262 - DNA, 15 bp, Homo sapiens
aaatgagcattagct

SEQ ID NO: 2155263 - DNA, 16 bp, Homo sapiens
aaatttatattgtaaa

SEQ ID NO: 2155264 - DNA, 15 bp, Homo sapiens
aacaaaagcaagact

SEQ ID NO: 2155265 - DNA, 16 bp, Homo sapiens
aacaaatagtctatca

SEQ ID NO: 2155266 - DNA, 16 bp, Homo sapiens
aacaatgtcagaaact

SEQ ID NO: 2155267 - DNA, 22 bp, Homo sapiens
aacacagtgcctggcaaggcct

SEQ ID NO: 2155268 - DNA, 20 bp, Homo sapiens
aacaccataggtagaatgta

SEQ ID NO: 2155269 - DNA, 20 bp, Homo sapiens
aacagatataaatggctggt

SEQ ID NO: 2155270 - DNA, 12 bp, Homo sapiens
aacatgggaggg

SEQ ID NO: 2155271 - DNA, 23 bp, Homo sapiens
aacatgggagggatcagccccgc

SEQ ID NO: 2155272 - DNA, 19 bp, Homo sapiens
aaccaggggtaccaggcac

SEQ ID NO: 2155273 - DNA, 23 bp, Homo sapiens
aacctgacagatgtcagccgagc

SEQ ID NO: 2155274 - DNA, 16 bp, Homo sapiens
aacctgtccataaagt

SEQ ID NO: 2155275 - DNA, 17 bp, Homo sapiens
aacctgtccataaagta

SEQ ID NO: 2155276 - DNA, 21 bp, Homo sapiens
aacctgtccataaagtaattt

SEQ ID NO: 2155277 - DNA, 13 bp, Homo sapiens
aacctgtgtctta

SEQ ID NO: 2155278 - DNA, 23 bp, Homo sapiens
aactcattagactggaacttgaa

SEQ ID NO: 2155279 - DNA, 19 bp, Homo sapiens
aactgattcacatctcatt

SEQ ID NO: 2155280 - DNA, 12 bp, Homo sapiens
aactgctggggc

SEQ ID NO: 2155281 - DNA, 20 bp, Homo sapiens
aactgctgttaattgattaa

SEQ ID NO: 2155282 - DNA, 14 bp, Homo sapiens
aacttgtaaataca

SEQ ID NO: 2155283 - DNA, 13 bp, Homo sapiens
aagaatattcagg

SEQ ID NO: 2155284 - DNA, 19 bp, Homo sapiens
aagaatgttaagacttgac

SEQ ID NO: 2155285 - DNA, 18 bp, Homo sapiens
aagacatggagactcctg

SEQ ID NO: 2155286 - DNA, 13 bp, Homo sapiens
aagacttgacagt

SEQ ID NO: 2155287 - DNA, 14 bp, Homo sapiens
aagacttgacagtg

SEQ ID NO: 2155288 - DNA, 12 bp, Homo sapiens
aagagaataaag

SEQ ID NO: 2155289 - DNA, 12 bp, Homo sapiens
aagagggcctgt

SEQ ID NO: 2155290 - DNA, 14 bp, Homo sapiens
aagagggcctgtgg

SEQ ID NO: 2155291 - DNA, 19 bp, Homo sapiens
aagagggcctgtgggagcc

SEQ ID NO: 2155292 - DNA, 18 bp, Homo sapiens
aagaggggcgggctcaga

SEQ ID NO: 2155293 - DNA, 20 bp, Homo sapiens
aagaggggcgggctcagagc

SEQ ID NO: 2155294 - DNA, 18 bp, Homo sapiens
aagagtctctggctcagc

SEQ ID NO: 2155295 - DNA, 20 bp, Homo sapiens
aagattatatatcataaagt

SEQ ID NO: 2155296 - DNA, 21 bp, Homo sapiens
aagattatatatcataaagta

SEQ ID NO: 2155297 - DNA, 18 bp, Homo sapiens
aagcagcaggcctctggt

SEQ ID NO: 2155298 - DNA, 19 bp, Homo sapiens
aagcatttgtttctacttt

SEQ ID NO: 2155299 - DNA, 23 bp, Homo sapiens
aagcatttgtttctactttgata

SEQ ID NO: 2155300 - DNA, 16 bp, Homo sapiens
aagccaacttgtaaat

SEQ ID NO: 2155301 - DNA, 19 bp, Homo sapiens
aagccaacttgtaaataca

SEQ ID NO: 2155302 - DNA, 18 bp, Homo sapiens
aagccctgtcgagacact

SEQ ID NO: 2155303 - DNA, 18 bp, Homo sapiens
aagctctgaacaaaagct

SEQ ID NO: 2155304 - DNA, 17 bp, Homo sapiens
aaggacaacctgcccct

SEQ ID NO: 2155305 - DNA, 14 bp, Homo sapiens
aaggacacactaat

SEQ ID NO: 2155306 - DNA, 21 bp, Homo sapiens
aaggactggccgtggctccag

SEQ ID NO: 2155307 - DNA, 22 bp, Homo sapiens
aaggactggccgtggctccaga

SEQ ID NO: 2155308 - DNA, 16 bp, Homo sapiens
aaggatctctcaggag

SEQ ID NO: 2155309 - DNA, 21 bp, Homo sapiens
aaggatctctcaggagcacag

SEQ ID NO: 2155310 - DNA, 23 bp, Homo sapiens
aaggcagtgaacacactcagcag

SEQ ID NO: 2155311 - DNA, 9 bp, Homo sapiens
aagggccag

SEQ ID NO: 2155312 - DNA, 19 bp, Homo sapiens
aaggtctcacactcctcct

SEQ ID NO: 2155313 - DNA, 20 bp, Homo sapiens
aaggtctcacactcctcctg

SEQ ID NO: 2155314 - DNA, 14 bp, Homo sapiens
aagtaactcccact

SEQ ID NO: 2155315 - DNA, 16 bp, Homo sapiens
aagtagtagtgtcttc

SEQ ID NO: 2155316 - DNA, 16 bp, Homo sapiens
aagtctctctgtgaat

SEQ ID NO: 2155317 - DNA, 16 bp, Homo sapiens
aagttaatttaaagtt

SEQ ID NO: 2155318 - DNA, 19 bp, Homo sapiens
aagttacatgtttgcacct

SEQ ID NO: 2155319 - DNA, 20 bp, Homo sapiens
aagttacatgtttgcacctt

SEQ ID NO: 2155320 - DNA, 12 bp, Homo sapiens
aagttatattta

SEQ ID NO: 2155321 - DNA, 16 bp, Homo sapiens
aagttatttaaatctg

SEQ ID NO: 2155322 - DNA, 20 bp, Homo sapiens
aagttgttccttaagtcaga

SEQ ID NO: 2155323 - DNA, 17 bp, Homo sapiens
aataaagacttcatgtt

SEQ ID NO: 2155324 - DNA, 22 bp, Homo sapiens
aatacaattaaaggtcctgccc

SEQ ID NO: 2155325 - DNA, 20 bp, Homo sapiens
aatacaccacctcactcctg

SEQ ID NO: 2155326 - DNA, 13 bp, Homo sapiens
aatacagacacta

SEQ ID NO: 2155327 - DNA, 20 bp, Homo sapiens
aatacagacactaagttata

SEQ ID NO: 2155328 - DNA, 21 bp, Homo sapiens
aatacagacactaagttatag

SEQ ID NO: 2155329 - DNA, 18 bp, Homo sapiens
aatatctgagaagtgtat

SEQ ID NO: 2155330 - DNA, 22 bp, Homo sapiens
aatattaaatacagacactaag

SEQ ID NO: 2155331 - DNA, 21 bp, Homo sapiens
aatcaagagtctctccagcct

SEQ ID NO: 2155332 - DNA, 15 bp, Homo sapiens
aatccatttggcaga

SEQ ID NO: 2155333 - DNA, 23 bp, Homo sapiens
aatccatttggcagaactgctgg

SEQ ID NO: 2155334 - DNA, 19 bp, Homo sapiens
aatcctgtcgattagactg

SEQ ID NO: 2155335 - DNA, 21 bp, Homo sapiens
aatcctgtcgattagactgga

SEQ ID NO: 2155336 - DNA, 13 bp, Homo sapiens
aatctattcagac

SEQ ID NO: 2155337 - DNA, 16 bp, Homo sapiens
aatctggcaaagttat

SEQ ID NO: 2155338 - DNA, 19 bp, Homo sapiens
aatctttctttacctgaga

SEQ ID NO: 2155339 - DNA, 14 bp, Homo sapiens
aatgcacctcccca

SEQ ID NO: 2155340 - DNA, 16 bp, Homo sapiens
aatgcacctccccaaa

SEQ ID NO: 2155341 - DNA, 19 bp, Homo sapiens
aatggttccatgcctgagg

SEQ ID NO: 2155342 - DNA, 21 bp, Homo sapiens
aatggttccatgcctgagggt

SEQ ID NO: 2155343 - DNA, 17 bp, Homo sapiens
aatgtgttgatttgaga

SEQ ID NO: 2155344 - DNA, 17 bp, Homo sapiens
aattgaaggagaaaatg

SEQ ID NO: 2155345 - DNA, 17 bp, Homo sapiens
aatttttttattactga

SEQ ID NO: 2155346 - DNA, 23 bp, Homo sapiens
acaaaagcaagactgttgctcaa

SEQ ID NO: 2155347 - DNA, 16 bp, Homo sapiens
acaaagagaataaaga

SEQ ID NO: 2155348 - DNA, 20 bp, Homo sapiens
acaaagcttctatcccagga

SEQ ID NO: 2155349 - DNA, 18 bp, Homo sapiens
acaacctgcccctcccca

SEQ ID NO: 2155350 - DNA, 17 bp, Homo sapiens
acaagttatttaaatct

SEQ ID NO: 2155351 - DNA, 17 bp, Homo sapiens
acaataaagtttattat

SEQ ID NO: 2155352 - DNA, 13 bp, Homo sapiens
acacacactcctt

SEQ ID NO: 2155353 - DNA, 18 bp, Homo sapiens
acacacactccttcccct

SEQ ID NO: 2155354 - DNA, 19 bp, Homo sapiens
acacactcagcagccccct

SEQ ID NO: 2155355 - DNA, 18 bp, Homo sapiens
acaccacctcactcctgt

SEQ ID NO: 2155356 - DNA, 18 bp, Homo sapiens
acaccccacaccccagcc

SEQ ID NO: 2155357 - DNA, 19 bp, Homo sapiens
acaccccacaccccagccc

SEQ ID NO: 2155358 - DNA, 11 bp, Homo sapiens
acaccccagcc

SEQ ID NO: 2155359 - DNA, 11 bp, Homo sapiens
acaccctgcct

SEQ ID NO: 2155360 - DNA, 13 bp, Homo sapiens
acaccctgcctgc

SEQ ID NO: 2155361 - DNA, 23 bp, Homo sapiens
acaccctgcctgctgtggagccc

SEQ ID NO: 2155362 - DNA, 19 bp, Homo sapiens
acacgtacctctcatcagt

SEQ ID NO: 2155363 - DNA, 18 bp, Homo sapiens
acactagttttgtgccag

SEQ ID NO: 2155364 - DNA, 23 bp, Homo sapiens
acactagttttgtgccagccgtg

SEQ ID NO: 2155365 - DNA, 21 bp, Homo sapiens
acactccagaattacccttcc

SEQ ID NO: 2155366 - DNA, 16 bp, Homo sapiens
acactcctcctgccag

SEQ ID NO: 2155367 - DNA, 19 bp, Homo sapiens
acactcctcctgccagctc

SEQ ID NO: 2155368 - DNA, 11 bp, Homo sapiens
acactgagccc

SEQ ID NO: 2155369 - DNA, 18 bp, Homo sapiens
acacttgccttcttcacc

SEQ ID NO: 2155370 - DNA, 18 bp, Homo sapiens
acagacactaagttatag

SEQ ID NO: 2155371 - DNA, 16 bp, Homo sapiens
acagactcttccacca

SEQ ID NO: 2155372 - DNA, 20 bp, Homo sapiens
acagactcttccaccagagc

SEQ ID NO: 2155373 - DNA, 23 bp, Homo sapiens
acagactcttccaccagagcagg

SEQ ID NO: 2155374 - DNA, 14 bp, Homo sapiens
acagatataaatgg

SEQ ID NO: 2155375 - DNA, 13 bp, Homo sapiens
acagatgctggcc

SEQ ID NO: 2155376 - DNA, 14 bp, Homo sapiens
acagatgctggcct

SEQ ID NO: 2155377 - DNA, 16 bp, Homo sapiens
acagatgctggcctct

SEQ ID NO: 2155378 - DNA, 20 bp, Homo sapiens
acagatgctggcctcttggc

SEQ ID NO: 2155379 - DNA, 20 bp, Homo sapiens
acagatgtcagccgagccgg

SEQ ID NO: 2155380 - DNA, 14 bp, Homo sapiens
acagattgtttgca

SEQ ID NO: 2155381 - DNA, 15 bp, Homo sapiens
acagattgtttgcaa

SEQ ID NO: 2155382 - DNA, 14 bp, Homo sapiens
acagcccccacccc

SEQ ID NO: 2155383 - DNA, 17 bp, Homo sapiens
acagcccccaccccagc

SEQ ID NO: 2155384 - DNA, 18 bp, Homo sapiens
acagcccccaccccagca

SEQ ID NO: 2155385 - DNA, 18 bp, Homo sapiens
acagctcctcccctgccg

SEQ ID NO: 2155386 - DNA, 22 bp, Homo sapiens
acagctcctcccctgccgcctc

SEQ ID NO: 2155387 - DNA, 21 bp, Homo sapiens
acagtcctcacagcctctccc

SEQ ID NO: 2155388 - DNA, 18 bp, Homo sapiens
acagtggaactacattag

SEQ ID NO: 2155389 - DNA, 12 bp, Homo sapiens
acatataaaagt

SEQ ID NO: 2155390 - DNA, 17 bp, Homo sapiens
acatatatgtatatgta

SEQ ID NO: 2155391 - DNA, 21 bp, Homo sapiens
acatcgacaaccacgtaccaa

SEQ ID NO: 2155392 - DNA, 15 bp, Homo sapiens
acatggagactcctg

SEQ ID NO: 2155393 - DNA, 16 bp, Homo sapiens
acatggagactcctgc

SEQ ID NO: 2155394 - DNA, 18 bp, Homo sapiens
acatgggagggatcagcc

SEQ ID NO: 2155395 - DNA, 15 bp, Homo sapiens
acatggtgtctccca

SEQ ID NO: 2155396 - DNA, 19 bp, Homo sapiens
acatggttgggggaatgca

SEQ ID NO: 2155397 - DNA, 21 bp, Homo sapiens
acatgtttgcacctttctagt

SEQ ID NO: 2155398 - DNA, 13 bp, Homo sapiens
acattaactcatt

SEQ ID NO: 2155399 - DNA, 23 bp, Homo sapiens
acattctgattcgaatgacactg

SEQ ID NO: 2155400 - DNA, 22 bp, Homo sapiens
accaaagagtctctggctcagc

SEQ ID NO: 2155401 - DNA, 23 bp, Homo sapiens
accaaagagtctctggctcagct

SEQ ID NO: 2155402 - DNA, 21 bp, Homo sapiens
accaaatgagcattagctact

SEQ ID NO: 2155403 - DNA, 21 bp, Homo sapiens
accaaggtctcacactcctcc

SEQ ID NO: 2155404 - DNA, 13 bp, Homo sapiens
accacaccctgcc

SEQ ID NO: 2155405 - DNA, 15 bp, Homo sapiens
accacaccctgcctg

SEQ ID NO: 2155406 - DNA, 19 bp, Homo sapiens
accacaccctgcctgctgt

SEQ ID NO: 2155407 - DNA, 22 bp, Homo sapiens
accacaccctgcctgctgtgga

SEQ ID NO: 2155408 - DNA, 17 bp, Homo sapiens
accacgtaccaagccac

SEQ ID NO: 2155409 - DNA, 19 bp, Homo sapiens
accagagcaggggctgctg

SEQ ID NO: 2155410 - DNA, 20 bp, Homo sapiens
accagagcaggggctgctgg

SEQ ID NO: 2155411 - DNA, 22 bp, Homo sapiens
accagagcaggggctgctgggg

SEQ ID NO: 2155412 - DNA, 12 bp, Homo sapiens
accagagctgcc

SEQ ID NO: 2155413 - DNA, 15 bp, Homo sapiens
accagagctgcctcc

SEQ ID NO: 2155414 - DNA, 17 bp, Homo sapiens
accagagctgcctcccc

SEQ ID NO: 2155415 - DNA, 16 bp, Homo sapiens
accagcccggcctgct

SEQ ID NO: 2155416 - DNA, 17 bp, Homo sapiens
accaggggtaccaggca

SEQ ID NO: 2155417 - DNA, 19 bp, Homo sapiens
accagttgggagcactgga

SEQ ID NO: 2155418 - DNA, 21 bp, Homo sapiens
accatgagaagagggcctgtg

SEQ ID NO: 2155419 - DNA, 18 bp, Homo sapiens
acccaggaagggagggag

SEQ ID NO: 2155420 - DNA, 20 bp, Homo sapiens
accccacaccccagcccacc

SEQ ID NO: 2155421 - DNA, 14 bp, Homo sapiens
accccagacactgg

SEQ ID NO: 2155422 - DNA, 20 bp, Homo sapiens
accccagcccaccctgctcc

SEQ ID NO: 2155423 - DNA, 21 bp, Homo sapiens
accccagcccaccctgctcct

SEQ ID NO: 2155424 - DNA, 19 bp, Homo sapiens
acccctcccccacgtctct

SEQ ID NO: 2155425 - DNA, 24 bp, Homo sapiens
acccctcccccacgtctctctgcc

SEQ ID NO: 2155426 - DNA, 17 bp, Homo sapiens
acccctggctgaacagt

SEQ ID NO: 2155427 - DNA, 18 bp, Homo sapiens
acccggattggccctgcc

SEQ ID NO: 2155428 - DNA, 23 bp, Homo sapiens
acccggctgggtcggccctgccc

SEQ ID NO: 2155429 - DNA, 21 bp, Homo sapiens
accctgaatggttccatgcct

SEQ ID NO: 2155430 - DNA, 15 bp, Homo sapiens
accctgcctgctgtg

SEQ ID NO: 2155431 - DNA, 16 bp, Homo sapiens
accctgcctgctgtgg

SEQ ID NO: 2155432 - DNA, 15 bp, Homo sapiens
accctggccaccacc

SEQ ID NO: 2155433 - DNA, 16 bp, Homo sapiens
accctggccaccaccc

SEQ ID NO: 2155434 - DNA, 17 bp, Homo sapiens
accctggccaccaccca

SEQ ID NO: 2155435 - DNA, 22 bp, Homo sapiens
accctggccaccacccaacctg

SEQ ID NO: 2155436 - DNA, 18 bp, Homo sapiens
accctgggtttggcccct

SEQ ID NO: 2155437 - DNA, 20 bp, Homo sapiens
accctgggtttggcccctgg

SEQ ID NO: 2155438 - DNA, 14 bp, Homo sapiens
acccttcctcatct

SEQ ID NO: 2155439 - DNA, 18 bp, Homo sapiens
acccttcctcatctgtgc

SEQ ID NO: 2155440 - DNA, 12 bp, Homo sapiens
accgcagctgct

SEQ ID NO: 2155441 - DNA, 19 bp, Homo sapiens
accgcatggcagctgggcc

SEQ ID NO: 2155442 - DNA, 14 bp, Homo sapiens
acctcactcctgtt

SEQ ID NO: 2155443 - DNA, 14 bp, Homo sapiens
acctccagtcctgc

SEQ ID NO: 2155444 - DNA, 21 bp, Homo sapiens
acctccagtcctgctggcctg

SEQ ID NO: 2155445 - DNA, 22 bp, Homo sapiens
acctccagtcctgctggcctgc

SEQ ID NO: 2155446 - DNA, 11 bp, Homo sapiens
acctccccaaa

SEQ ID NO: 2155447 - DNA, 14 bp, Homo sapiens
acctccccaaagca

SEQ ID NO: 2155448 - DNA, 18 bp, Homo sapiens
acctctccaagtctctct

SEQ ID NO: 2155449 - DNA, 17 bp, Homo sapiens
acctgcctagctcttgg

SEQ ID NO: 2155450 - DNA, 19 bp, Homo sapiens
acctgcctagctcttgggc

SEQ ID NO: 2155451 - DNA, 22 bp, Homo sapiens
acctgcctagctcttgggcctg

SEQ ID NO: 2155452 - DNA, 20 bp, Homo sapiens
acctgtccttactcagagct

SEQ ID NO: 2155453 - DNA, 11 bp, Homo sapiens
acctttctagt

SEQ ID NO: 2155454 - DNA, 17 bp, Homo sapiens
acctttttttctctcct

SEQ ID NO: 2155455 - DNA, 16 bp, Homo sapiens
acgtgactcagagctt

SEQ ID NO: 2155456 - DNA, 16 bp, Homo sapiens
actaagccctgtcgag

SEQ ID NO: 2155457 - DNA, 17 bp, Homo sapiens
actaagttatagtatat

SEQ ID NO: 2155458 - DNA, 19 bp, Homo sapiens
actaatcgaactatgaact

SEQ ID NO: 2155459 - DNA, 15 bp, Homo sapiens
actagggcctcggag

SEQ ID NO: 2155460 - DNA, 18 bp, Homo sapiens
actatgaactacaaagct

SEQ ID NO: 2155461 - DNA, 19 bp, Homo sapiens
actcaaattaatctttctt

SEQ ID NO: 2155462 - DNA, 12 bp, Homo sapiens
actcagagctgc

SEQ ID NO: 2155463 - DNA, 13 bp, Homo sapiens
actcagagctgcg

SEQ ID NO: 2155464 - DNA, 19 bp, Homo sapiens
actcagctctgacattctg

SEQ ID NO: 2155465 - DNA, 14 bp, Homo sapiens
actcccactcctaa

SEQ ID NO: 2155466 - DNA, 12 bp, Homo sapiens
actcccccagga

SEQ ID NO: 2155467 - DNA, 10 bp, Homo sapiens
actccctcct

SEQ ID NO: 2155468 - DNA, 15 bp, Homo sapiens
actccctcctcacac

SEQ ID NO: 2155469 - DNA, 22 bp, Homo sapiens
actcctaatcaagagtctctcc

SEQ ID NO: 2155470 - DNA, 14 bp, Homo sapiens
actcctgccctgtt

SEQ ID NO: 2155471 - DNA, 21 bp, Homo sapiens
actctaggggtcaggctccat

SEQ ID NO: 2155472 - DNA, 11 bp, Homo sapiens
actctgctgcc

SEQ ID NO: 2155473 - DNA, 13 bp, Homo sapiens
actctgctgcctg

SEQ ID NO: 2155474 - DNA, 15 bp, Homo sapiens
actcttccaccagag

SEQ ID NO: 2155475 - DNA, 21 bp, Homo sapiens
actcttccaccagagcagggg

SEQ ID NO: 2155476 - DNA, 23 bp, Homo sapiens
actcttccaccagagcaggggct

SEQ ID NO: 2155477 - DNA, 21 bp, Homo sapiens
actgaaccgacttttctaaag

SEQ ID NO: 2155478 - DNA, 14 bp, Homo sapiens
actgagccccacct

SEQ ID NO: 2155479 - DNA, 19 bp, Homo sapiens
actgattcacatctcattt

SEQ ID NO: 2155480 - DNA, 15 bp, Homo sapiens
actgccaaaacaatg

SEQ ID NO: 2155481 - DNA, 18 bp, Homo sapiens
actgctcaagaagacatg

SEQ ID NO: 2155482 - DNA, 15 bp, Homo sapiens
actgctgacccacca

SEQ ID NO: 2155483 - DNA, 14 bp, Homo sapiens
actgctggggctgg

SEQ ID NO: 2155484 - DNA, 14 bp, Homo sapiens
actggacagcttgt

SEQ ID NO: 2155485 - DNA, 15 bp, Homo sapiens
actggacagcttgtg

SEQ ID NO: 2155486 - DNA, 13 bp, Homo sapiens
actggagtgcagg

SEQ ID NO: 2155487 - DNA, 17 bp, Homo sapiens
actggccgtggctccag

SEQ ID NO: 2155488 - DNA, 18 bp, Homo sapiens
actggccgtggctccaga

SEQ ID NO: 2155489 - DNA, 22 bp, Homo sapiens
actgggatgggaacactggtgg

SEQ ID NO: 2155490 - DNA, 14 bp, Homo sapiens
actgggccatgggt

SEQ ID NO: 2155491 - DNA, 13 bp, Homo sapiens
actgggcccctca

SEQ ID NO: 2155492 - DNA, 15 bp, Homo sapiens
actgggcccctcagg

SEQ ID NO: 2155493 - DNA, 12 bp, Homo sapiens
actgtgctccca

SEQ ID NO: 2155494 - DNA, 14 bp, Homo sapiens
actgtggccccaag

SEQ ID NO: 2155495 - DNA, 18 bp, Homo sapiens
acttatatggaaattctg

SEQ ID NO: 2155496 - DNA, 16 bp, Homo sapiens
acttcactaccaaatg

SEQ ID NO: 2155497 - DNA, 15 bp, Homo sapiens
acttcgactcaggat

SEQ ID NO: 2155498 - DNA, 14 bp, Homo sapiens
acttgacagtggaa

SEQ ID NO: 2155499 - DNA, 23 bp, Homo sapiens
acttgccacatggtgtctcccaa

SEQ ID NO: 2155500 - DNA, 15 bp, Homo sapiens
actttaaaataaaat

SEQ ID NO: 2155501 - DNA, 21 bp, Homo sapiens
acttttcagaattgaaggaga

SEQ ID NO: 2155502 - DNA, 14 bp, Homo sapiens
agaaacatggtttt

SEQ ID NO: 2155503 - DNA, 22 bp, Homo sapiens
agaacacagtgcctggcaaggc

SEQ ID NO: 2155504 - DNA, 18 bp, Homo sapiens
agaactgctggggctggt

SEQ ID NO: 2155505 - DNA, 15 bp, Homo sapiens
agaagaatattcagg

SEQ ID NO: 2155506 - DNA, 19 bp, Homo sapiens
agaagacatggagactcct

SEQ ID NO: 2155507 - DNA, 14 bp, Homo sapiens
agaagagggcctgt

SEQ ID NO: 2155508 - DNA, 24 bp, Homo sapiens
agaagagggcctgtgggagcctgc

SEQ ID NO: 2155509 - DNA, 14 bp, Homo sapiens
agaaggcctcccct

SEQ ID NO: 2155510 - DNA, 12 bp, Homo sapiens
agaagtgtatat

SEQ ID NO: 2155511 - DNA, 15 bp, Homo sapiens
agaatattcaggact

SEQ ID NO: 2155512 - DNA, 19 bp, Homo sapiens
agaatcctgggcccccaga

SEQ ID NO: 2155513 - DNA, 20 bp, Homo sapiens
agaatcctgggcccccagag

SEQ ID NO: 2155514 - DNA, 13 bp, Homo sapiens
agaatgtaaagct

SEQ ID NO: 2155515 - DNA, 13 bp, Homo sapiens
agaatgtgctgcc

SEQ ID NO: 2155516 - DNA, 15 bp, Homo sapiens
agaatgtgctgcctt

SEQ ID NO: 2155517 - DNA, 16 bp, Homo sapiens
agaattacccttcctc

SEQ ID NO: 2155518 - DNA, 13 bp, Homo sapiens
agacatggagact

SEQ ID NO: 2155519 - DNA, 22 bp, Homo sapiens
agacattaactcattagactgg

SEQ ID NO: 2155520 - DNA, 20 bp, Homo sapiens
agaccagttgggagcactgg

SEQ ID NO: 2155521 - DNA, 21 bp, Homo sapiens
agaccagttgggagcactgga

SEQ ID NO: 2155522 - DNA, 17 bp, Homo sapiens
agacctttgcccacaca

SEQ ID NO: 2155523 - DNA, 18 bp, Homo sapiens
agactcagctctgacatt

SEQ ID NO: 2155524 - DNA, 22 bp, Homo sapiens
agactcttccaccagagcaggg

SEQ ID NO: 2155525 - DNA, 13 bp, Homo sapiens
agactggaacttg

SEQ ID NO: 2155526 - DNA, 18 bp, Homo sapiens
agactggaacttgaactg

SEQ ID NO: 2155527 - DNA, 23 bp, Homo sapiens
agactggaacttgaactgattca

SEQ ID NO: 2155528 - DNA, 16 bp, Homo sapiens
agactggacagcttgt

SEQ ID NO: 2155529 - DNA, 20 bp, Homo sapiens
agacttccaaacctgacaga

SEQ ID NO: 2155530 - DNA, 20 bp, Homo sapiens
agacttcgactcaggatcca

SEQ ID NO: 2155531 - DNA, 15 bp, Homo sapiens
agacttgacagtgga

SEQ ID NO: 2155532 - DNA, 13 bp, Homo sapiens
agagaataaagac

SEQ ID NO: 2155533 - DNA, 14 bp, Homo sapiens
agagacctttgccc

SEQ ID NO: 2155534 - DNA, 16 bp, Homo sapiens
agagcaggggctgctg

SEQ ID NO: 2155535 - DNA, 19 bp, Homo sapiens
agagcaggggctgctgggg

SEQ ID NO: 2155536 - DNA, 13 bp, Homo sapiens
agagctgcctccc

SEQ ID NO: 2155537 - DNA, 15 bp, Homo sapiens
agagctgcctcccca

SEQ ID NO: 2155538 - DNA, 16 bp, Homo sapiens
agagctgcctccccaa

SEQ ID NO: 2155539 - DNA, 14 bp, Homo sapiens
agagctgcgggctg

SEQ ID NO: 2155540 - DNA, 15 bp, Homo sapiens
agagctgcgggctga

SEQ ID NO: 2155541 - DNA, 17 bp, Homo sapiens
agagctgcgggctgagg

SEQ ID NO: 2155542 - DNA, 15 bp, Homo sapiens
agagctttgtcactt

SEQ ID NO: 2155543 - DNA, 20 bp, Homo sapiens
agagctttgtcacttgccac

SEQ ID NO: 2155544 - DNA, 16 bp, Homo sapiens
agagggcctgtgggag

SEQ ID NO: 2155545 - DNA, 17 bp, Homo sapiens
agaggggcgggctcaga

SEQ ID NO: 2155546 - DNA, 19 bp, Homo sapiens
agaggggcgggctcagagc

SEQ ID NO: 2155547 - DNA, 19 bp, Homo sapiens
agaggtgtcgggacatggt

SEQ ID NO: 2155548 - DNA, 19 bp, Homo sapiens
agagtctctggctcagctg

SEQ ID NO: 2155549 - DNA, 22 bp, Homo sapiens
agagtctctggctcagctgtgg

SEQ ID NO: 2155550 - DNA, 13 bp, Homo sapiens
agagtgagagaca

SEQ ID NO: 2155551 - DNA, 21 bp, Homo sapiens
agagtgtccctttttgcaggg

SEQ ID NO: 2155552 - DNA, 15 bp, Homo sapiens
agatataaatggctg

SEQ ID NO: 2155553 - DNA, 13 bp, Homo sapiens
agatatttatata

SEQ ID NO: 2155554 - DNA, 16 bp, Homo sapiens
agatcaccagcccggc

SEQ ID NO: 2155555 - DNA, 10 bp, Homo sapiens
agatccaggc

SEQ ID NO: 2155556 - DNA, 14 bp, Homo sapiens
agatccaggcttct

SEQ ID NO: 2155557 - DNA, 20 bp, Homo sapiens
agatgtcagccgagccgggc

SEQ ID NO: 2155558 - DNA, 19 bp, Homo sapiens
agattatatatcataaagt

SEQ ID NO: 2155559 - DNA, 12 bp, Homo sapiens
agattgtttgca

SEQ ID NO: 2155560 - DNA, 19 bp, Homo sapiens
agcaaagccacattttgca

SEQ ID NO: 2155561 - DNA, 18 bp, Homo sapiens
agcaacaggttttataat

SEQ ID NO: 2155562 - DNA, 19 bp, Homo sapiens
agcaacaggttttataatt

SEQ ID NO: 2155563 - DNA, 17 bp, Homo sapiens
agcacaagttatttaaa

SEQ ID NO: 2155564 - DNA, 17 bp, Homo sapiens
agcacagctcctcccct

SEQ ID NO: 2155565 - DNA, 12 bp, Homo sapiens
agcacaggcagc

SEQ ID NO: 2155566 - DNA, 13 bp, Homo sapiens
agcacaggcagct

SEQ ID NO: 2155567 - DNA, 15 bp, Homo sapiens
agcacaggcagctgg

SEQ ID NO: 2155568 - DNA, 17 bp, Homo sapiens
agcactggagtgcaggg

SEQ ID NO: 2155569 - DNA, 19 bp, Homo sapiens
agcactggagtgcagggag

SEQ ID NO: 2155570 - DNA, 16 bp, Homo sapiens
agcagactcagctctg

SEQ ID NO: 2155571 - DNA, 20 bp, Homo sapiens
agcagactcagctctgacat

SEQ ID NO: 2155572 - DNA, 18 bp, Homo sapiens
agcagccctaaggatctc

SEQ ID NO: 2155573 - DNA, 18 bp, Homo sapiens
agcagccgtttctccttg

SEQ ID NO: 2155574 - DNA, 17 bp, Homo sapiens
agcaggcctctggttgc

SEQ ID NO: 2155575 - DNA, 19 bp, Homo sapiens
agcaggcctctggttgcct

SEQ ID NO: 2155576 - DNA, 18 bp, Homo sapiens
agcaggggctgctggggg

SEQ ID NO: 2155577 - DNA, 13 bp, Homo sapiens
agcatcctcccca

SEQ ID NO: 2155578 - DNA, 18 bp, Homo sapiens
agcatcctccccaccaga

SEQ ID NO: 2155579 - DNA, 21 bp, Homo sapiens
agcatgggactgtgcctttgg

SEQ ID NO: 2155580 - DNA, 14 bp, Homo sapiens
agcatttgtttcta

SEQ ID NO: 2155581 - DNA, 17 bp, Homo sapiens
agcatttgtttctactt

SEQ ID NO: 2155582 - DNA, 19 bp, Homo sapiens
agcatttgtttctactttg

SEQ ID NO: 2155583 - DNA, 15 bp, Homo sapiens
agccaacttgtaaat

SEQ ID NO: 2155584 - DNA, 15 bp, Homo sapiens
agccaccgcagctgc

SEQ ID NO: 2155585 - DNA, 22 bp, Homo sapiens
agccagattttttaaaatttat

SEQ ID NO: 2155586 - DNA, 22 bp, Homo sapiens
agccatggggtccatccccttc

SEQ ID NO: 2155587 - DNA, 19 bp, Homo sapiens
agccccacctctccaagtc

SEQ ID NO: 2155588 - DNA, 23 bp, Homo sapiens
agccccacctctccaagtctctc

SEQ ID NO: 2155589 - DNA, 13 bp, Homo sapiens
agccccgcctgtc

SEQ ID NO: 2155590 - DNA, 14 bp, Homo sapiens
agccccgcctgtca

SEQ ID NO: 2155591 - DNA, 20 bp, Homo sapiens
agccccgcctgtcacaataa

SEQ ID NO: 2155592 - DNA, 20 bp, Homo sapiens
agcccggcctgctcccagca

SEQ ID NO: 2155593 - DNA, 18 bp, Homo sapiens
agccctggcccagagctg

SEQ ID NO: 2155594 - DNA, 18 bp, Homo sapiens
agccctgtcgagacactt

SEQ ID NO: 2155595 - DNA, 21 bp, Homo sapiens
agccctgtcgagacacttgcc

SEQ ID NO: 2155596 - DNA, 11 bp, Homo sapiens
agcccttccct

SEQ ID NO: 2155597 - DNA, 14 bp, Homo sapiens
agcccttccctgct

SEQ ID NO: 2155598 - DNA, 15 bp, Homo sapiens
agcccttccctgctt

SEQ ID NO: 2155599 - DNA, 16 bp, Homo sapiens
agccgagccgggcctg

SEQ ID NO: 2155600 - DNA, 19 bp, Homo sapiens
agccgggcctggggctcct

SEQ ID NO: 2155601 - DNA, 17 bp, Homo sapiens
agccgtgatgctcaggc

SEQ ID NO: 2155602 - DNA, 20 bp, Homo sapiens
agccgtgatgctcaggcttg

SEQ ID NO: 2155603 - DNA, 15 bp, Homo sapiens
agcctcacagatgct

SEQ ID NO: 2155604 - DNA, 22 bp, Homo sapiens
agcctcacttttaatgaacaaa

SEQ ID NO: 2155605 - DNA, 17 bp, Homo sapiens
agcctgcaaactcactg

SEQ ID NO: 2155606 - DNA, 16 bp, Homo sapiens
agcgcctgtcccctca

SEQ ID NO: 2155607 - DNA, 20 bp, Homo sapiens
agcgcctgtcccctcacaga

SEQ ID NO: 2155608 - DNA, 23 bp, Homo sapiens
agctaatctgtagggctggacct

SEQ ID NO: 2155609 - DNA, 15 bp, Homo sapiens
agctattagcaactg

SEQ ID NO: 2155610 - DNA, 18 bp, Homo sapiens
agctcctcccctgccgcc

SEQ ID NO: 2155611 - DNA, 23 bp, Homo sapiens
agctcctcccctgccgcctcccg

SEQ ID NO: 2155612 - DNA, 20 bp, Homo sapiens
agctcttgggcctgacctcc

SEQ ID NO: 2155613 - DNA, 14 bp, Homo sapiens
agctgaggcctccc

SEQ ID NO: 2155614 - DNA, 14 bp, Homo sapiens
agctgcgggctgag

SEQ ID NO: 2155615 - DNA, 18 bp, Homo sapiens
agctgcgggctgagggca

SEQ ID NO: 2155616 - DNA, 23 bp, Homo sapiens
agctgcgggctgagggcatctct

SEQ ID NO: 2155617 - DNA, 21 bp, Homo sapiens
agctgctaggggaaggactgg

SEQ ID NO: 2155618 - DNA, 15 bp, Homo sapiens
agctgctgccactct

SEQ ID NO: 2155619 - DNA, 23 bp, Homo sapiens
agctgctgccactctgctgcctg

SEQ ID NO: 2155620 - DNA, 15 bp, Homo sapiens
agctggaaagcagcc

SEQ ID NO: 2155621 - DNA, 12 bp, Homo sapiens
agctgggcccac

SEQ ID NO: 2155622 - DNA, 15 bp, Homo sapiens
agctgggcccacagc

SEQ ID NO: 2155623 - DNA, 19 bp, Homo sapiens
agctgggcccacagccccc

SEQ ID NO: 2155624 - DNA, 14 bp, Homo sapiens
agctgtggtcccac

SEQ ID NO: 2155625 - DNA, 17 bp, Homo sapiens
agcttctatcccaggag

SEQ ID NO: 2155626 - DNA, 17 bp, Homo sapiens
agctttgtcacttgcca

SEQ ID NO: 2155627 - DNA, 19 bp, Homo sapiens
agctttgtcacttgccaca

SEQ ID NO: 2155628 - DNA, 18 bp, Homo sapiens
aggacaacctgcccctcc

SEQ ID NO: 2155629 - DNA, 20 bp, Homo sapiens
aggacacaccccacacccca

SEQ ID NO: 2155630 - DNA, 17 bp, Homo sapiens
aggacttaacggctcca

SEQ ID NO: 2155631 - DNA, 21 bp, Homo sapiens
aggacttaacggctccaggat

SEQ ID NO: 2155632 - DNA, 14 bp, Homo sapiens
aggagaaaatgcat

SEQ ID NO: 2155633 - DNA, 19 bp, Homo sapiens
aggagaggggaagggccag

SEQ ID NO: 2155634 - DNA, 14 bp, Homo sapiens
aggaggtttggatg

SEQ ID NO: 2155635 - DNA, 18 bp, Homo sapiens
aggagtcaccatgcaagg

SEQ ID NO: 2155636 - DNA, 18 bp, Homo sapiens
aggatcccctgtcccctg

SEQ ID NO: 2155637 - DNA, 14 bp, Homo sapiens
aggatctctcagga

SEQ ID NO: 2155638 - DNA, 15 bp, Homo sapiens
aggatctctcaggag

SEQ ID NO: 2155639 - DNA, 20 bp, Homo sapiens
aggatctctcaggagcacag

SEQ ID NO: 2155640 - DNA, 15 bp, Homo sapiens
aggcacatggctggg

SEQ ID NO: 2155641 - DNA, 18 bp, Homo sapiens
aggcacatggctggggga

SEQ ID NO: 2155642 - DNA, 16 bp, Homo sapiens
aggcagcgcctgtccc

SEQ ID NO: 2155643 - DNA, 17 bp, Homo sapiens
aggcagcgcctgtcccc

SEQ ID NO: 2155644 - DNA, 19 bp, Homo sapiens
aggcagcgcctgtcccctc

SEQ ID NO: 2155645 - DNA, 13 bp, Homo sapiens
aggccggccctgc

SEQ ID NO: 2155646 - DNA, 15 bp, Homo sapiens
aggccggccctgccc

SEQ ID NO: 2155647 - DNA, 17 bp, Homo sapiens
aggcttctcccggacct

SEQ ID NO: 2155648 - DNA, 20 bp, Homo sapiens
agggactgctgacccaccaa

SEQ ID NO: 2155649 - DNA, 19 bp, Homo sapiens
agggagctgaggcctccct

SEQ ID NO: 2155650 - DNA, 20 bp, Homo sapiens
agggagctgaggcctccctt

SEQ ID NO: 2155651 - DNA, 21 bp, Homo sapiens
agggatcagccccgcctgtca

SEQ ID NO: 2155652 - DNA, 18 bp, Homo sapiens
agggccagcaggcagcgc

SEQ ID NO: 2155653 - DNA, 22 bp, Homo sapiens
agggccagcaggcagcgcctgt

SEQ ID NO: 2155654 - DNA, 18 bp, Homo sapiens
agggcctcggaggctcct

SEQ ID NO: 2155655 - DNA, 22 bp, Homo sapiens
agggcctcggaggctcctccct

SEQ ID NO: 2155656 - DNA, 23 bp, Homo sapiens
agggcctcggaggctcctccctc

SEQ ID NO: 2155657 - DNA, 12 bp, Homo sapiens
agggcctgtggg

SEQ ID NO: 2155658 - DNA, 14 bp, Homo sapiens
agggcgctcctgtt

SEQ ID NO: 2155659 - DNA, 14 bp, Homo sapiens
aggggaaggactgg

SEQ ID NO: 2155660 - DNA, 23 bp, Homo sapiens
aggggaagggccagtctgggctg

SEQ ID NO: 2155661 - DNA, 14 bp, Homo sapiens
aggggactgggcca

SEQ ID NO: 2155662 - DNA, 15 bp, Homo sapiens
aggggcgggctcaga

SEQ ID NO: 2155663 - DNA, 17 bp, Homo sapiens
aggggcgggctcagagc

SEQ ID NO: 2155664 - DNA, 12 bp, Homo sapiens
aggggctgctgg

SEQ ID NO: 2155665 - DNA, 15 bp, Homo sapiens
aggggctgctggggg

SEQ ID NO: 2155666 - DNA, 17 bp, Homo sapiens
aggggctgctgggggct

SEQ ID NO: 2155667 - DNA, 21 bp, Homo sapiens
agggtaggaggtttggatggg

SEQ ID NO: 2155668 - DNA, 19 bp, Homo sapiens
aggtagaatgtaaagcttg

SEQ ID NO: 2155669 - DNA, 12 bp, Homo sapiens
aggtcctgccct

SEQ ID NO: 2155670 - DNA, 23 bp, Homo sapiens
aggtccttgcctgaactccagag

SEQ ID NO: 2155671 - DNA, 21 bp, Homo sapiens
aggtctcacactcctcctgcc

SEQ ID NO: 2155672 - DNA, 17 bp, Homo sapiens
aggtggctatggccacc

SEQ ID NO: 2155673 - DNA, 16 bp, Homo sapiens
agtaactcccactcct

SEQ ID NO: 2155674 - DNA, 23 bp, Homo sapiens
agtaagtggggttgcaaccactg

SEQ ID NO: 2155675 - DNA, 22 bp, Homo sapiens
agtaatatgcctgctatttgaa

SEQ ID NO: 2155676 - DNA, 12 bp, Homo sapiens
agtaggccctgc

SEQ ID NO: 2155677 - DNA, 13 bp, Homo sapiens
agtaggccctgct

SEQ ID NO: 2155678 - DNA, 19 bp, Homo sapiens
agtatattagtttgattta

SEQ ID NO: 2155679 - DNA, 20 bp, Homo sapiens
agtatcatcagatagcatct

SEQ ID NO: 2155680 - DNA, 21 bp, Homo sapiens
agtatgccttcctgtttaaaa

SEQ ID NO: 2155681 - DNA, 14 bp, Homo sapiens
agtcagaacagcag

SEQ ID NO: 2155682 - DNA, 15 bp, Homo sapiens
agtcagaacagcaga

SEQ ID NO: 2155683 - DNA, 12 bp, Homo sapiens
agtcatggtact

SEQ ID NO: 2155684 - DNA, 21 bp, Homo sapiens
agtcctcacagcctctccctt

SEQ ID NO: 2155685 - DNA, 16 bp, Homo sapiens
agtcctgctggcctgc

SEQ ID NO: 2155686 - DNA, 18 bp, Homo sapiens
agtctcctttgcactgag

SEQ ID NO: 2155687 - DNA, 19 bp, Homo sapiens
agtctcctttgcactgagg

SEQ ID NO: 2155688 - DNA, 14 bp, Homo sapiens
agtctctccagcct

SEQ ID NO: 2155689 - DNA, 15 bp, Homo sapiens
agtctctccagcctc

SEQ ID NO: 2155690 - DNA, 19 bp, Homo sapiens
agtctctccagcctcacag

SEQ ID NO: 2155691 - DNA, 13 bp, Homo sapiens
agtctctctgtga

SEQ ID NO: 2155692 - DNA, 15 bp, Homo sapiens
agtctctctgtgaat

SEQ ID NO: 2155693 - DNA, 18 bp, Homo sapiens
agtctctctgtgaataca

SEQ ID NO: 2155694 - DNA, 20 bp, Homo sapiens
agtctctctgtgaatacaat

SEQ ID NO: 2155695 - DNA, 22 bp, Homo sapiens
agtctctctgtgaatacaatta

SEQ ID NO: 2155696 - DNA, 13 bp, Homo sapiens
agtctctggctca

SEQ ID NO: 2155697 - DNA, 14 bp, Homo sapiens
agtctctggctcag

SEQ ID NO: 2155698 - DNA, 16 bp, Homo sapiens
agtctctggctcagct

SEQ ID NO: 2155699 - DNA, 16 bp, Homo sapiens
agtctgggctgccggg

SEQ ID NO: 2155700 - DNA, 12 bp, Homo sapiens
agtgacagctag

SEQ ID NO: 2155701 - DNA, 18 bp, Homo sapiens
agtgacgtgactcagagc

SEQ ID NO: 2155702 - DNA, 13 bp, Homo sapiens
agtgagacagaag

SEQ ID NO: 2155703 - DNA, 13 bp, Homo sapiens
agtgagagacatt

SEQ ID NO: 2155704 - DNA, 13 bp, Homo sapiens
agtgagcagtaga

SEQ ID NO: 2155705 - DNA, 17 bp, Homo sapiens
agtgcctggcaaggcct

SEQ ID NO: 2155706 - DNA, 12 bp, Homo sapiens
agtgctctgcct

SEQ ID NO: 2155707 - DNA, 14 bp, Homo sapiens
agtgtaattgagaa

SEQ ID NO: 2155708 - DNA, 12 bp, Homo sapiens
agtgtctctgcc

SEQ ID NO: 2155709 - DNA, 22 bp, Homo sapiens
agtgtgaccaaaagttacatgt

SEQ ID NO: 2155710 - DNA, 15 bp, Homo sapiens
agttatctaagttaa

SEQ ID NO: 2155711 - DNA, 19 bp, Homo sapiens
agttgaaaataaagtgtat

SEQ ID NO: 2155712 - DNA, 15 bp, Homo sapiens
agttgggagcactgg

SEQ ID NO: 2155713 - DNA, 16 bp, Homo sapiens
agttgggagcactgga

SEQ ID NO: 2155714 - DNA, 19 bp, Homo sapiens
agttgttccttaagtcaga

SEQ ID NO: 2155715 - DNA, 15 bp, Homo sapiens
agttgtttgtgcctt

SEQ ID NO: 2155716 - DNA, 18 bp, Homo sapiens
agtttatttgttgagagt

SEQ ID NO: 2155717 - DNA, 17 bp, Homo sapiens
agtttgtggtaaaaaga

SEQ ID NO: 2155718 - DNA, 14 bp, Homo sapiens
ataaaataatttta

SEQ ID NO: 2155719 - DNA, 16 bp, Homo sapiens
ataaaataattttatt

SEQ ID NO: 2155720 - DNA, 23 bp, Homo sapiens
ataatttttttattactgatttt

SEQ ID NO: 2155721 - DNA, 16 bp, Homo sapiens
atacaattaaaggtcc

SEQ ID NO: 2155722 - DNA, 20 bp, Homo sapiens
atacaccacctcactcctgt

SEQ ID NO: 2155723 - DNA, 21 bp, Homo sapiens
atacaccacctcactcctgtt

SEQ ID NO: 2155724 - DNA, 18 bp, Homo sapiens
atacagacactaagttat

SEQ ID NO: 2155725 - DNA, 23 bp, Homo sapiens
atacagacactaagttatagtat

SEQ ID NO: 2155726 - DNA, 13 bp, Homo sapiens
atagaatgacagt

SEQ ID NO: 2155727 - DNA, 16 bp, Homo sapiens
atagatgcaagatatt

SEQ ID NO: 2155728 - DNA, 20 bp, Homo sapiens
ataggtagaatgtaaagctt

SEQ ID NO: 2155729 - DNA, 12 bp, Homo sapiens
ataggtttccac

SEQ ID NO: 2155730 - DNA, 18 bp, Homo sapiens
atataaatggctggtttt

SEQ ID NO: 2155731 - DNA, 23 bp, Homo sapiens
atataaatggctggtttttagaa

SEQ ID NO: 2155732 - DNA, 16 bp, Homo sapiens
atatatatatatatgt

SEQ ID NO: 2155733 - DNA, 16 bp, Homo sapiens
atatatatgtacagtt

SEQ ID NO: 2155734 - DNA, 20 bp, Homo sapiens
atatatatgtacagttatct

SEQ ID NO: 2155735 - DNA, 21 bp, Homo sapiens
atatatgattgtttgcacaga

SEQ ID NO: 2155736 - DNA, 13 bp, Homo sapiens
atatatgtacagt

SEQ ID NO: 2155737 - DNA, 14 bp, Homo sapiens
atatatgtatatgt

SEQ ID NO: 2155738 - DNA, 19 bp, Homo sapiens
atatattctacacatatat

SEQ ID NO: 2155739 - DNA, 23 bp, Homo sapiens
atatattctacacatatatgtat

SEQ ID NO: 2155740 - DNA, 22 bp, Homo sapiens
atatcagcctgagtctcctgtg

SEQ ID NO: 2155741 - DNA, 15 bp, Homo sapiens
atatcataaagtatg

SEQ ID NO: 2155742 - DNA, 18 bp, Homo sapiens
atatctatatctctaaac

SEQ ID NO: 2155743 - DNA, 14 bp, Homo sapiens
atatgtacagttat

SEQ ID NO: 2155744 - DNA, 16 bp, Homo sapiens
atatgtatatgtatat

SEQ ID NO: 2155745 - DNA, 12 bp, Homo sapiens
atattaaataca

SEQ ID NO: 2155746 - DNA, 21 bp, Homo sapiens
atattccgggtgccattccca

SEQ ID NO: 2155747 - DNA, 18 bp, Homo sapiens
atcaaccccagacactgg

SEQ ID NO: 2155748 - DNA, 19 bp, Homo sapiens
atcaagagtctctccagcc

SEQ ID NO: 2155749 - DNA, 21 bp, Homo sapiens
atcaagagtctctccagcctc

SEQ ID NO: 2155750 - DNA, 22 bp, Homo sapiens
atcaagagtctctccagcctca

SEQ ID NO: 2155751 - DNA, 22 bp, Homo sapiens
atcagaagtaactcccactcct

SEQ ID NO: 2155752 - DNA, 14 bp, Homo sapiens
atcagccccgcctg

SEQ ID NO: 2155753 - DNA, 19 bp, Homo sapiens
atcagccccgcctgtcaca

SEQ ID NO: 2155754 - DNA, 21 bp, Homo sapiens
atcagccccgcctgtcacaat

SEQ ID NO: 2155755 - DNA, 22 bp, Homo sapiens
atcagccccgcctgtcacaata

SEQ ID NO: 2155756 - DNA, 12 bp, Homo sapiens
atcagcctgagt

SEQ ID NO: 2155757 - DNA, 19 bp, Homo sapiens
atcagcctgagtctcctgt

SEQ ID NO: 2155758 - DNA, 22 bp, Homo sapiens
atcagcctgagtctcctgtgcc

SEQ ID NO: 2155759 - DNA, 17 bp, Homo sapiens
atcagtgtcctcttgct

SEQ ID NO: 2155760 - DNA, 21 bp, Homo sapiens
atcagttttttcacctggaag

SEQ ID NO: 2155761 - DNA, 11 bp, Homo sapiens
atcataaagta

SEQ ID NO: 2155762 - DNA, 14 bp, Homo sapiens
atccaggcttctcc

SEQ ID NO: 2155763 - DNA, 20 bp, Homo sapiens
atccatttggcagaactgct

SEQ ID NO: 2155764 - DNA, 16 bp, Homo sapiens
atcccctgtcccctgg

SEQ ID NO: 2155765 - DNA, 21 bp, Homo sapiens
atccccttcccccatccctac

SEQ ID NO: 2155766 - DNA, 18 bp, Homo sapiens
atccctgttacccagaga

SEQ ID NO: 2155767 - DNA, 13 bp, Homo sapiens
atcctccccacca

SEQ ID NO: 2155768 - DNA, 12 bp, Homo sapiens
atcctcctctcc

SEQ ID NO: 2155769 - DNA, 19 bp, Homo sapiens
atcctcctctccatgcaag

SEQ ID NO: 2155770 - DNA, 11 bp, Homo sapiens
atcctgggccc

SEQ ID NO: 2155771 - DNA, 17 bp, Homo sapiens
atcctgggcccccagag

SEQ ID NO: 2155772 - DNA, 21 bp, Homo sapiens
atcctgtcgattagactggac

SEQ ID NO: 2155773 - DNA, 22 bp, Homo sapiens
atctcattcaggtgttctcttc

SEQ ID NO: 2155774 - DNA, 13 bp, Homo sapiens
atctccccactct

SEQ ID NO: 2155775 - DNA, 15 bp, Homo sapiens
atctctaaactgctg

SEQ ID NO: 2155776 - DNA, 18 bp, Homo sapiens
atctctcaggagcacagg

SEQ ID NO: 2155777 - DNA, 22 bp, Homo sapiens
atctctcaggagcacaggcagc

SEQ ID NO: 2155778 - DNA, 18 bp, Homo sapiens
atctctgagtgtctctgc

SEQ ID NO: 2155779 - DNA, 20 bp, Homo sapiens
atctctgagtgtctctgcct

SEQ ID NO: 2155780 - DNA, 18 bp, Homo sapiens
atctgagaagtgtatata

SEQ ID NO: 2155781 - DNA, 19 bp, Homo sapiens
atctgagaagtgtatatag

SEQ ID NO: 2155782 - DNA, 14 bp, Homo sapiens
atctgtagggctgg

SEQ ID NO: 2155783 - DNA, 15 bp, Homo sapiens
atctgtagggctgga

SEQ ID NO: 2155784 - DNA, 15 bp, Homo sapiens
atctgtccatcctcc

SEQ ID NO: 2155785 - DNA, 14 bp, Homo sapiens
atctgtttttctaa

SEQ ID NO: 2155786 - DNA, 17 bp, Homo sapiens
atctttctttacctgag

SEQ ID NO: 2155787 - DNA, 18 bp, Homo sapiens
atctttctttacctgaga

SEQ ID NO: 2155788 - DNA, 20 bp, Homo sapiens
atctttctttacctgagacc

SEQ ID NO: 2155789 - DNA, 16 bp, Homo sapiens
atgacactgttcagga

SEQ ID NO: 2155790 - DNA, 19 bp, Homo sapiens
atgactgtttttcggacag

SEQ ID NO: 2155791 - DNA, 21 bp, Homo sapiens
atgactgtttttcggacagtt

SEQ ID NO: 2155792 - DNA, 22 bp, Homo sapiens
atgactgtttttcggacagttt

SEQ ID NO: 2155793 - DNA, 16 bp, Homo sapiens
atgagaagagggcctg

SEQ ID NO: 2155794 - DNA, 17 bp, Homo sapiens
atgattgtttgcacaga

SEQ ID NO: 2155795 - DNA, 12 bp, Homo sapiens
atgcctgagggt

SEQ ID NO: 2155796 - DNA, 17 bp, Homo sapiens
atgcctgagggtggaga

SEQ ID NO: 2155797 - DNA, 15 bp, Homo sapiens
atgctttctcctttt

SEQ ID NO: 2155798 - DNA, 16 bp, Homo sapiens
atgctttctccttttt

SEQ ID NO: 2155799 - DNA, 11 bp, Homo sapiens
atggcagctgg

SEQ ID NO: 2155800 - DNA, 12 bp, Homo sapiens
atggcagctggg

SEQ ID NO: 2155801 - DNA, 13 bp, Homo sapiens
atggcagctgggc

SEQ ID NO: 2155802 - DNA, 14 bp, Homo sapiens
atggcagctgggcc

SEQ ID NO: 2155803 - DNA, 16 bp, Homo sapiens
atggcagctgggccca

SEQ ID NO: 2155804 - DNA, 21 bp, Homo sapiens
atggcagctgggcccacagcc

SEQ ID NO: 2155805 - DNA, 14 bp, Homo sapiens
atggccttccctcc

SEQ ID NO: 2155806 - DNA, 19 bp, Homo sapiens
atggcttatttgtataatg

SEQ ID NO: 2155807 - DNA, 15 bp, Homo sapiens
atgggagggatcagc

SEQ ID NO: 2155808 - DNA, 20 bp, Homo sapiens
atggggtccatccccttccc

SEQ ID NO: 2155809 - DNA, 12 bp, Homo sapiens
atggtgtctccc

SEQ ID NO: 2155810 - DNA, 14 bp, Homo sapiens
atggtgtctcccaa

SEQ ID NO: 2155811 - DNA, 16 bp, Homo sapiens
atggttccatgcctga

SEQ ID NO: 2155812 - DNA, 18 bp, Homo sapiens
atggttccatgcctgagg

SEQ ID NO: 2155813 - DNA, 16 bp, Homo sapiens
atggttgggggaatgc

SEQ ID NO: 2155814 - DNA, 14 bp, Homo sapiens
atgtaaagcttgtc

SEQ ID NO: 2155815 - DNA, 14 bp, Homo sapiens
atgtatatgtatat

SEQ ID NO: 2155816 - DNA, 17 bp, Homo sapiens
atgtatatgtatatcta

SEQ ID NO: 2155817 - DNA, 14 bp, Homo sapiens
atgtcaaacaaata

SEQ ID NO: 2155818 - DNA, 12 bp, Homo sapiens
atgtccagaaga

SEQ ID NO: 2155819 - DNA, 19 bp, Homo sapiens
atgtcctaaggacacacta

SEQ ID NO: 2155820 - DNA, 17 bp, Homo sapiens
atgtgcattctccagcc

SEQ ID NO: 2155821 - DNA, 16 bp, Homo sapiens
atgttaagacttgaca

SEQ ID NO: 2155822 - DNA, 21 bp, Homo sapiens
atgtttgcacctttctagttg

SEQ ID NO: 2155823 - DNA, 12 bp, Homo sapiens
attaaatacaga

SEQ ID NO: 2155824 - DNA, 14 bp, Homo sapiens
attaaatacagaca

SEQ ID NO: 2155825 - DNA, 17 bp, Homo sapiens
attaaatacagacacta

SEQ ID NO: 2155826 - DNA, 20 bp, Homo sapiens
attaaatacagacactaagt

SEQ ID NO: 2155827 - DNA, 17 bp, Homo sapiens
attaactcattagactg

SEQ ID NO: 2155828 - DNA, 18 bp, Homo sapiens
attaatctttctttacct

SEQ ID NO: 2155829 - DNA, 20 bp, Homo sapiens
attaccatgagaagagggcc

SEQ ID NO: 2155830 - DNA, 12 bp, Homo sapiens
attacccttcct

SEQ ID NO: 2155831 - DNA, 13 bp, Homo sapiens
attacccttcctc

SEQ ID NO: 2155832 - DNA, 14 bp, Homo sapiens
attacccttcctca

SEQ ID NO: 2155833 - DNA, 14 bp, Homo sapiens
attagactggacag

SEQ ID NO: 2155834 - DNA, 19 bp, Homo sapiens
attagactggacagcttgt

SEQ ID NO: 2155835 - DNA, 20 bp, Homo sapiens
attagactggacagcttgtg

SEQ ID NO: 2155836 - DNA, 22 bp, Homo sapiens
attagctacttttcagaattga

SEQ ID NO: 2155837 - DNA, 20 bp, Homo sapiens
attagtttgatttaatatct

SEQ ID NO: 2155838 - DNA, 13 bp, Homo sapiens
attatatatcata

SEQ ID NO: 2155839 - DNA, 16 bp, Homo sapiens
attcatgctttctcct

SEQ ID NO: 2155840 - DNA, 19 bp, Homo sapiens
attcccactaagctttctc

SEQ ID NO: 2155841 - DNA, 20 bp, Homo sapiens
attcccactaagctttctcc

SEQ ID NO: 2155842 - DNA, 21 bp, Homo sapiens
attcccactaagctttctcct

SEQ ID NO: 2155843 - DNA, 22 bp, Homo sapiens
attcccactaagctttctcctt

SEQ ID NO: 2155844 - DNA, 17 bp, Homo sapiens
attcctcccccagagcc

SEQ ID NO: 2155845 - DNA, 17 bp, Homo sapiens
attgaaggagaaaatgc

SEQ ID NO: 2155846 - DNA, 13 bp, Homo sapiens
attggccctgccc

SEQ ID NO: 2155847 - DNA, 17 bp, Homo sapiens
attggccctgcccctcc

SEQ ID NO: 2155848 - DNA, 21 bp, Homo sapiens
attgggcagaatcctgggccc

SEQ ID NO: 2155849 - DNA, 14 bp, Homo sapiens
attgtaaatattgt

SEQ ID NO: 2155850 - DNA, 15 bp, Homo sapiens
attgtgcaatagtca

SEQ ID NO: 2155851 - DNA, 22 bp, Homo sapiens
atttaaagttgtttgtgccttt

SEQ ID NO: 2155852 - DNA, 13 bp, Homo sapiens
atttagaatatat

SEQ ID NO: 2155853 - DNA, 20 bp, Homo sapiens
atttatattgtaaatattgt

SEQ ID NO: 2155854 - DNA, 16 bp, Homo sapiens
atttgcctgtaacaag

SEQ ID NO: 2155855 - DNA, 19 bp, Homo sapiens
atttggcagaactgctggg

SEQ ID NO: 2155856 - DNA, 22 bp, Homo sapiens
atttggcagaactgctggggct

SEQ ID NO: 2155857 - DNA, 13 bp, Homo sapiens
atttgtttctact

SEQ ID NO: 2155858 - DNA, 16 bp, Homo sapiens
attttaacaaaagcaa

SEQ ID NO: 2155859 - DNA, 19 bp, Homo sapiens
attttactgacagaaatgc

SEQ ID NO: 2155860 - DNA, 21 bp, Homo sapiens
attttactgacagaaatgcaa

SEQ ID NO: 2155861 - DNA, 20 bp, Homo sapiens
atttttatatcagcctgagt

SEQ ID NO: 2155862 - DNA, 16 bp, Homo sapiens
attttttatttccaca

SEQ ID NO: 2155863 - DNA, 23 bp, Homo sapiens
caaaagcaagactgttgctcaaa

SEQ ID NO: 2155864 - DNA, 18 bp, Homo sapiens
caaactcactgctcaaga

SEQ ID NO: 2155865 - DNA, 17 bp, Homo sapiens
caaagagtctctggctc

SEQ ID NO: 2155866 - DNA, 23 bp, Homo sapiens
caaagagtctctggctcagctgt

SEQ ID NO: 2155867 - DNA, 19 bp, Homo sapiens
caaagcagcaggcctctgg

SEQ ID NO: 2155868 - DNA, 18 bp, Homo sapiens
caaagcttctatcccagg

SEQ ID NO: 2155869 - DNA, 19 bp, Homo sapiens
caaagcttctatcccagga

SEQ ID NO: 2155870 - DNA, 16 bp, Homo sapiens
caaaggccagcagcag

SEQ ID NO: 2155871 - DNA, 14 bp, Homo sapiens
caaagttatattta

SEQ ID NO: 2155872 - DNA, 17 bp, Homo sapiens
caaagttatatttactt

SEQ ID NO: 2155873 - DNA, 22 bp, Homo sapiens
caaatctattcagacaagcaac

SEQ ID NO: 2155874 - DNA, 15 bp, Homo sapiens
caaattaatctttct

SEQ ID NO: 2155875 - DNA, 13 bp, Homo sapiens
caacccctccccc

SEQ ID NO: 2155876 - DNA, 19 bp, Homo sapiens
caacccctcccccacgtct

SEQ ID NO: 2155877 - DNA, 22 bp, Homo sapiens
caacttgtaaatacaccacctc

SEQ ID NO: 2155878 - DNA, 16 bp, Homo sapiens
caagactgttgctcaa

SEQ ID NO: 2155879 - DNA, 18 bp, Homo sapiens
caagaggggcgggctcag

SEQ ID NO: 2155880 - DNA, 13 bp, Homo sapiens
caagagtctctcc

SEQ ID NO: 2155881 - DNA, 20 bp, Homo sapiens
caagagtctctccagcctca

SEQ ID NO: 2155882 - DNA, 16 bp, Homo sapiens
caagccaccgcagctg

SEQ ID NO: 2155883 - DNA, 17 bp, Homo sapiens
caaggacaacctgcccc

SEQ ID NO: 2155884 - DNA, 23 bp, Homo sapiens
caaggacaacctgcccctcccca

SEQ ID NO: 2155885 - DNA, 15 bp, Homo sapiens
caaggtctcacactc

SEQ ID NO: 2155886 - DNA, 16 bp, Homo sapiens
caaggtctcacactcc

SEQ ID NO: 2155887 - DNA, 21 bp, Homo sapiens
caaggtctcacactcctcctg

SEQ ID NO: 2155888 - DNA, 19 bp, Homo sapiens
caagtgctgtttgggcagg

SEQ ID NO: 2155889 - DNA, 22 bp, Homo sapiens
caagttgttccttaagtcagaa

SEQ ID NO: 2155890 - DNA, 12 bp, Homo sapiens
caatattaaata

SEQ ID NO: 2155891 - DNA, 15 bp, Homo sapiens
caatattaaatacag

SEQ ID NO: 2155892 - DNA, 21 bp, Homo sapiens
caatattaaatacagacacta

SEQ ID NO: 2155893 - DNA, 16 bp, Homo sapiens
caatccatttggcaga

SEQ ID NO: 2155894 - DNA, 20 bp, Homo sapiens
caatccatttggcagaactg

SEQ ID NO: 2155895 - DNA, 14 bp, Homo sapiens
caatgatgtccaga

SEQ ID NO: 2155896 - DNA, 14 bp, Homo sapiens
caatgtcagaaact

SEQ ID NO: 2155897 - DNA, 15 bp, Homo sapiens
caatgttagcctcaa

SEQ ID NO: 2155898 - DNA, 16 bp, Homo sapiens
cacaagttatttaaat

SEQ ID NO: 2155899 - DNA, 14 bp, Homo sapiens
cacaccccacaccc

SEQ ID NO: 2155900 - DNA, 13 bp, Homo sapiens
cacaccccagccc

SEQ ID NO: 2155901 - DNA, 14 bp, Homo sapiens
cacaccccagccca

SEQ ID NO: 2155902 - DNA, 16 bp, Homo sapiens
cacaccctgcctgctg

SEQ ID NO: 2155903 - DNA, 18 bp, Homo sapiens
cacactattaccatgaga

SEQ ID NO: 2155904 - DNA, 12 bp, Homo sapiens
cacactcagcag

SEQ ID NO: 2155905 - DNA, 13 bp, Homo sapiens
cacactcagcagc

SEQ ID NO: 2155906 - DNA, 13 bp, Homo sapiens
cacactcctcctg

SEQ ID NO: 2155907 - DNA, 18 bp, Homo sapiens
cacactcctcctgccagc

SEQ ID NO: 2155908 - DNA, 14 bp, Homo sapiens
cacactccttcccc

SEQ ID NO: 2155909 - DNA, 23 bp, Homo sapiens
cacactccttccccttgtccctg

SEQ ID NO: 2155910 - DNA, 20 bp, Homo sapiens
cacagactcttccaccagag

SEQ ID NO: 2155911 - DNA, 21 bp, Homo sapiens
cacagactcttccaccagagc

SEQ ID NO: 2155912 - DNA, 23 bp, Homo sapiens
cacagactcttccaccagagcag

SEQ ID NO: 2155913 - DNA, 13 bp, Homo sapiens
cacagagggcgct

SEQ ID NO: 2155914 - DNA, 17 bp, Homo sapiens
cacagagggcgctcctg

SEQ ID NO: 2155915 - DNA, 18 bp, Homo sapiens
cacagagggcgctcctgt

SEQ ID NO: 2155916 - DNA, 14 bp, Homo sapiens
cacagatgctggcc

SEQ ID NO: 2155917 - DNA, 19 bp, Homo sapiens
cacagatgctggcctcttg

SEQ ID NO: 2155918 - DNA, 20 bp, Homo sapiens
cacagcccccaccccagcac

SEQ ID NO: 2155919 - DNA, 14 bp, Homo sapiens
cacagcctctccct

SEQ ID NO: 2155920 - DNA, 11 bp, Homo sapiens
cacagctcctc

SEQ ID NO: 2155921 - DNA, 17 bp, Homo sapiens
cacagtcctcacagcct

SEQ ID NO: 2155922 - DNA, 20 bp, Homo sapiens
cacagtcctcacagcctctc

SEQ ID NO: 2155923 - DNA, 10 bp, Homo sapiens
cacataaagg

SEQ ID NO: 2155924 - DNA, 13 bp, Homo sapiens
cacataaaggtat

SEQ ID NO: 2155925 - DNA, 20 bp, Homo sapiens
cacataaaggtatttagaat

SEQ ID NO: 2155926 - DNA, 12 bp, Homo sapiens
cacatatatgta

SEQ ID NO: 2155927 - DNA, 22 bp, Homo sapiens
cacatcccaggcttcaccctga

SEQ ID NO: 2155928 - DNA, 14 bp, Homo sapiens
cacatggctggggg

SEQ ID NO: 2155929 - DNA, 16 bp, Homo sapiens
cacatggtgtctccca

SEQ ID NO: 2155930 - DNA, 17 bp, Homo sapiens
cacatggtgtctcccaa

SEQ ID NO: 2155931 - DNA, 21 bp, Homo sapiens
cacatggtgtctcccaacatg

SEQ ID NO: 2155932 - DNA, 22 bp, Homo sapiens
cacatggtgtctcccaacatgg

SEQ ID NO: 2155933 - DNA, 19 bp, Homo sapiens
cacattttgtacaaagata

SEQ ID NO: 2155934 - DNA, 16 bp, Homo sapiens
caccaaggtctcacac

SEQ ID NO: 2155935 - DNA, 19 bp, Homo sapiens
caccacccaacctgtcctt

SEQ ID NO: 2155936 - DNA, 17 bp, Homo sapiens
caccacctcactcctgt

SEQ ID NO: 2155937 - DNA, 11 bp, Homo sapiens
caccagagctg

SEQ ID NO: 2155938 - DNA, 13 bp, Homo sapiens
caccagagctgcc

SEQ ID NO: 2155939 - DNA, 16 bp, Homo sapiens
caccagagctgcctcc

SEQ ID NO: 2155940 - DNA, 19 bp, Homo sapiens
caccagcccttccctgctt

SEQ ID NO: 2155941 - DNA, 18 bp, Homo sapiens
caccagccgccccagccc

SEQ ID NO: 2155942 - DNA, 17 bp, Homo sapiens
caccataggtagaatgt

SEQ ID NO: 2155943 - DNA, 12 bp, Homo sapiens
caccatgcaagg

SEQ ID NO: 2155944 - DNA, 16 bp, Homo sapiens
cacccaattcaaaaca

SEQ ID NO: 2155945 - DNA, 22 bp, Homo sapiens
cacccaggaagggagggagctg

SEQ ID NO: 2155946 - DNA, 23 bp, Homo sapiens
cacccaggaagggagggagctga

SEQ ID NO: 2155947 - DNA, 19 bp, Homo sapiens
caccccagcacagctcctc

SEQ ID NO: 2155948 - DNA, 23 bp, Homo sapiens
caccccagcacagctcctcccct

SEQ ID NO: 2155949 - DNA, 14 bp, Homo sapiens
caccccagcccacc

SEQ ID NO: 2155950 - DNA, 20 bp, Homo sapiens
cacccgttctgctggcctgg

SEQ ID NO: 2155951 - DNA, 15 bp, Homo sapiens
caccctgcctgctgt

SEQ ID NO: 2155952 - DNA, 16 bp, Homo sapiens
caccctgcctgctgtg

SEQ ID NO: 2155953 - DNA, 16 bp, Homo sapiens
caccctgctcctcctg

SEQ ID NO: 2155954 - DNA, 21 bp, Homo sapiens
caccctgggtttggcccctgg

SEQ ID NO: 2155955 - DNA, 20 bp, Homo sapiens
caccgcagctgctgccactc

SEQ ID NO: 2155956 - DNA, 22 bp, Homo sapiens
caccgcagctgctgccactctg

SEQ ID NO: 2155957 - DNA, 18 bp, Homo sapiens
cacctctccaagtctctc

SEQ ID NO: 2155958 - DNA, 22 bp, Homo sapiens
cacctgcctagctcttgggcct

SEQ ID NO: 2155959 - DNA, 15 bp, Homo sapiens
cacgtaccaagccac

SEQ ID NO: 2155960 - DNA, 17 bp, Homo sapiens
cacgtctctctgcctgc

SEQ ID NO: 2155961 - DNA, 21 bp, Homo sapiens
cacgtctctctgcctgctggg

SEQ ID NO: 2155962 - DNA, 22 bp, Homo sapiens
cacgtctctctgcctgctgggc

SEQ ID NO: 2155963 - DNA, 23 bp, Homo sapiens
cacgtctctctgcctgctgggct

SEQ ID NO: 2155964 - DNA, 17 bp, Homo sapiens
cactaagctttctcctt

SEQ ID NO: 2155965 - DNA, 20 bp, Homo sapiens
cactacctttgtccaggcct

SEQ ID NO: 2155966 - DNA, 16 bp, Homo sapiens
cactcaaattaatctt

SEQ ID NO: 2155967 - DNA, 12 bp, Homo sapiens
cactcagcagcc

SEQ ID NO: 2155968 - DNA, 23 bp, Homo sapiens
cactccagaattacccttcctca

SEQ ID NO: 2155969 - DNA, 20 bp, Homo sapiens
cactcctcctgccagctctg

SEQ ID NO: 2155970 - DNA, 21 bp, Homo sapiens
cactcctcctgccagctctgt

SEQ ID NO: 2155971 - DNA, 18 bp, Homo sapiens
cactccttccccttgtcc

SEQ ID NO: 2155972 - DNA, 22 bp, Homo sapiens
cactctaggggtcaggctccat

SEQ ID NO: 2155973 - DNA, 13 bp, Homo sapiens
cactctgctgcct

SEQ ID NO: 2155974 - DNA, 17 bp, Homo sapiens
cactctgctgcctgtac

SEQ ID NO: 2155975 - DNA, 22 bp, Homo sapiens
cactgctcaagaagacatggag

SEQ ID NO: 2155976 - DNA, 23 bp, Homo sapiens
cactggagtgcagggaggagagg

SEQ ID NO: 2155977 - DNA, 15 bp, Homo sapiens
cactggtgggcagct

SEQ ID NO: 2155978 - DNA, 18 bp, Homo sapiens
cactggtgggcagctgag

SEQ ID NO: 2155979 - DNA, 14 bp, Homo sapiens
cactgtggccccaa

SEQ ID NO: 2155980 - DNA, 14 bp, Homo sapiens
cacttgccacatgg

SEQ ID NO: 2155981 - DNA, 15 bp, Homo sapiens
cagaactgctggggc

SEQ ID NO: 2155982 - DNA, 19 bp, Homo sapiens
cagaactgctggggctggt

SEQ ID NO: 2155983 - DNA, 14 bp, Homo sapiens
cagaagaatattca

SEQ ID NO: 2155984 - DNA, 17 bp, Homo sapiens
cagaagaatattcagga

SEQ ID NO: 2155985 - DNA, 20 bp, Homo sapiens
cagaagaatattcaggactt

SEQ ID NO: 2155986 - DNA, 16 bp, Homo sapiens
cagaatcctgggcccc

SEQ ID NO: 2155987 - DNA, 16 bp, Homo sapiens
cagaatgtgctgcctt

SEQ ID NO: 2155988 - DNA, 17 bp, Homo sapiens
cagaatgtgctgccttt

SEQ ID NO: 2155989 - DNA, 19 bp, Homo sapiens
cagacaagcaacaggtttt

SEQ ID NO: 2155990 - DNA, 18 bp, Homo sapiens
cagacactaagttatagt

SEQ ID NO: 2155991 - DNA, 19 bp, Homo sapiens
cagaccaccagccgcccca

SEQ ID NO: 2155992 - DNA, 20 bp, Homo sapiens
cagactcttccaccagagca

SEQ ID NO: 2155993 - DNA, 21 bp, Homo sapiens
cagagacctttgcccacacac

SEQ ID NO: 2155994 - DNA, 13 bp, Homo sapiens
cagagcaggggct

SEQ ID NO: 2155995 - DNA, 12 bp, Homo sapiens
cagagctgcctc

SEQ ID NO: 2155996 - DNA, 14 bp, Homo sapiens
cagagctgcctccc

SEQ ID NO: 2155997 - DNA, 20 bp, Homo sapiens
cagagctgcctccccaatcc

SEQ ID NO: 2155998 - DNA, 17 bp, Homo sapiens
cagagctgcgggctgag

SEQ ID NO: 2155999 - DNA, 12 bp, Homo sapiens
cagagctttgtc

SEQ ID NO: 2156000 - DNA, 16 bp, Homo sapiens
cagagctttgtcactt

SEQ ID NO: 2156001 - DNA, 14 bp, Homo sapiens
cagagggcgctcct

SEQ ID NO: 2156002 - DNA, 15 bp, Homo sapiens
cagagggcgctcctg

SEQ ID NO: 2156003 - DNA, 17 bp, Homo sapiens
cagagggcgctcctgtt

SEQ ID NO: 2156004 - DNA, 22 bp, Homo sapiens
cagagtgtccctttttgcaggg

SEQ ID NO: 2156005 - DNA, 21 bp, Homo sapiens
cagatcaccagcccggcctgc

SEQ ID NO: 2156006 - DNA, 22 bp, Homo sapiens
cagatcaccagcccggcctgct

SEQ ID NO: 2156007 - DNA, 13 bp, Homo sapiens
cagattgtttgca

SEQ ID NO: 2156008 - DNA, 14 bp, Homo sapiens
cagcacagctcctc

SEQ ID NO: 2156009 - DNA, 18 bp, Homo sapiens
cagcacagctcctcccct

SEQ ID NO: 2156010 - DNA, 21 bp, Homo sapiens
cagcagactcagctctgacat

SEQ ID NO: 2156011 - DNA, 17 bp, Homo sapiens
cagcagccccctgcccg

SEQ ID NO: 2156012 - DNA, 20 bp, Homo sapiens
cagcagccctaaggatctct

SEQ ID NO: 2156013 - DNA, 23 bp, Homo sapiens
cagcagccctaaggatctctcag

SEQ ID NO: 2156014 - DNA, 11 bp, Homo sapiens
cagcccaccct

SEQ ID NO: 2156015 - DNA, 19 bp, Homo sapiens
cagcccaccctgctcctcc

SEQ ID NO: 2156016 - DNA, 18 bp, Homo sapiens
cagcccccaccccagcac

SEQ ID NO: 2156017 - DNA, 15 bp, Homo sapiens
cagccccgcctgtca

SEQ ID NO: 2156018 - DNA, 17 bp, Homo sapiens
cagccccgcctgtcaca

SEQ ID NO: 2156019 - DNA, 18 bp, Homo sapiens
cagccccgcctgtcacaa

SEQ ID NO: 2156020 - DNA, 16 bp, Homo sapiens
cagccccttctcccag

SEQ ID NO: 2156021 - DNA, 17 bp, Homo sapiens
cagccccttctcccagc

SEQ ID NO: 2156022 - DNA, 21 bp, Homo sapiens
cagccccttctcccagcacac

SEQ ID NO: 2156023 - DNA, 21 bp, Homo sapiens
cagcccggcctgctcccagca

SEQ ID NO: 2156024 - DNA, 18 bp, Homo sapiens
cagccctaaggatctctc

SEQ ID NO: 2156025 - DNA, 20 bp, Homo sapiens
cagccctaaggatctctcag

SEQ ID NO: 2156026 - DNA, 21 bp, Homo sapiens
cagccctaaggatctctcagg

SEQ ID NO: 2156027 - DNA, 22 bp, Homo sapiens
cagccctaaggatctctcagga

SEQ ID NO: 2156028 - DNA, 16 bp, Homo sapiens
cagcccttccctgctt

SEQ ID NO: 2156029 - DNA, 12 bp, Homo sapiens
cagccgagccgg

SEQ ID NO: 2156030 - DNA, 17 bp, Homo sapiens
cagccgtgatgctcagg

SEQ ID NO: 2156031 - DNA, 16 bp, Homo sapiens
cagcctcacagatgct

SEQ ID NO: 2156032 - DNA, 17 bp, Homo sapiens
cagcctcacagatgctg

SEQ ID NO: 2156033 - DNA, 15 bp, Homo sapiens
cagcctgagtctcct

SEQ ID NO: 2156034 - DNA, 17 bp, Homo sapiens
cagcctgagtctcctgt

SEQ ID NO: 2156035 - DNA, 18 bp, Homo sapiens
cagcctgagtctcctgtg

SEQ ID NO: 2156036 - DNA, 19 bp, Homo sapiens
cagcctgagtctcctgtgc

SEQ ID NO: 2156037 - DNA, 22 bp, Homo sapiens
cagcctgagtctcctgtgccca

SEQ ID NO: 2156038 - DNA, 13 bp, Homo sapiens
cagcgcctgtccc

SEQ ID NO: 2156039 - DNA, 14 bp, Homo sapiens
cagcgcctgtcccc

SEQ ID NO: 2156040 - DNA, 21 bp, Homo sapiens
cagcgcctgtcccctcacaga

SEQ ID NO: 2156041 - DNA, 23 bp, Homo sapiens
cagcgcctgtcccctcacagact

SEQ ID NO: 2156042 - DNA, 16 bp, Homo sapiens
cagctaatctgtaggg

SEQ ID NO: 2156043 - DNA, 17 bp, Homo sapiens
cagctaatctgtagggc

SEQ ID NO: 2156044 - DNA, 19 bp, Homo sapiens
cagctattagcaactgtgc

SEQ ID NO: 2156045 - DNA, 13 bp, Homo sapiens
cagctcctcccct

SEQ ID NO: 2156046 - DNA, 15 bp, Homo sapiens
cagctcctcccctgc

SEQ ID NO: 2156047 - DNA, 17 bp, Homo sapiens
cagctcctcccctgccg

SEQ ID NO: 2156048 - DNA, 21 bp, Homo sapiens
cagctcctcccctgccgcctc

SEQ ID NO: 2156049 - DNA, 21 bp, Homo sapiens
cagctctgtcaccctggccac

SEQ ID NO: 2156050 - DNA, 19 bp, Homo sapiens
cagctgaggacacacccca

SEQ ID NO: 2156051 - DNA, 12 bp, Homo sapiens
cagctgctgcca

SEQ ID NO: 2156052 - DNA, 14 bp, Homo sapiens
cagctgctgccact

SEQ ID NO: 2156053 - DNA, 16 bp, Homo sapiens
cagctgctgccactct

SEQ ID NO: 2156054 - DNA, 15 bp, Homo sapiens
cagctgggcccacag

SEQ ID NO: 2156055 - DNA, 16 bp, Homo sapiens
cagctgggcccacagc

SEQ ID NO: 2156056 - DNA, 18 bp, Homo sapiens
cagctgggcccacagccc

SEQ ID NO: 2156057 - DNA, 14 bp, Homo sapiens
cagctgtggtccca

SEQ ID NO: 2156058 - DNA, 18 bp, Homo sapiens
caggaagggagggagctg

SEQ ID NO: 2156059 - DNA, 23 bp, Homo sapiens
caggacttaacggctccaggatt

SEQ ID NO: 2156060 - DNA, 16 bp, Homo sapiens
caggagcacaggcagc

SEQ ID NO: 2156061 - DNA, 18 bp, Homo sapiens
caggagtcaccatgcaag

SEQ ID NO: 2156062 - DNA, 23 bp, Homo sapiens
caggattgtgcaatagtcagagt

SEQ ID NO: 2156063 - DNA, 13 bp, Homo sapiens
caggcacatggct

SEQ ID NO: 2156064 - DNA, 16 bp, Homo sapiens
caggcacatggctggg

SEQ ID NO: 2156065 - DNA, 17 bp, Homo sapiens
caggcacatggctgggg

SEQ ID NO: 2156066 - DNA, 18 bp, Homo sapiens
caggcacatggctggggg

SEQ ID NO: 2156067 - DNA, 18 bp, Homo sapiens
caggcagcgcctgtcccc

SEQ ID NO: 2156068 - DNA, 19 bp, Homo sapiens
caggcagcgcctgtcccct

SEQ ID NO: 2156069 - DNA, 20 bp, Homo sapiens
caggcctctggttgcctccc

SEQ ID NO: 2156070 - DNA, 15 bp, Homo sapiens
caggcttctcccgga

SEQ ID NO: 2156071 - DNA, 23 bp, Homo sapiens
cagggaggagaggggaagggcca

SEQ ID NO: 2156072 - DNA, 19 bp, Homo sapiens
cagggccagcaggcagcgc

SEQ ID NO: 2156073 - DNA, 22 bp, Homo sapiens
cagggccagcaggcagcgcctg

SEQ ID NO: 2156074 - DNA, 11 bp, Homo sapiens
caggggactgg

SEQ ID NO: 2156075 - DNA, 14 bp, Homo sapiens
caggggactgggcc

SEQ ID NO: 2156076 - DNA, 20 bp, Homo sapiens
caggggcaaagaactgcccc

SEQ ID NO: 2156077 - DNA, 19 bp, Homo sapiens
caggggtaccaggcacatg

SEQ ID NO: 2156078 - DNA, 23 bp, Homo sapiens
cagtagcacaagttatttaaatc

SEQ ID NO: 2156079 - DNA, 13 bp, Homo sapiens
cagtcatggtact

SEQ ID NO: 2156080 - DNA, 21 bp, Homo sapiens
cagtcatggtactaccccagc

SEQ ID NO: 2156081 - DNA, 19 bp, Homo sapiens
cagtcctcacagcctctcc

SEQ ID NO: 2156082 - DNA, 20 bp, Homo sapiens
cagtcctcacagcctctccc

SEQ ID NO: 2156083 - DNA, 20 bp, Homo sapiens
cagtcctgctggcctgctct

SEQ ID NO: 2156084 - DNA, 19 bp, Homo sapiens
cagtgaacacactcagcag

SEQ ID NO: 2156085 - DNA, 12 bp, Homo sapiens
cagtgacagcta

SEQ ID NO: 2156086 - DNA, 18 bp, Homo sapiens
cagtgacgtgactcagag

SEQ ID NO: 2156087 - DNA, 12 bp, Homo sapiens
cagtgctctgcc

SEQ ID NO: 2156088 - DNA, 14 bp, Homo sapiens
cagtgctctgcctc

SEQ ID NO: 2156089 - DNA, 16 bp, Homo sapiens
cagtgctctgcctcta

SEQ ID NO: 2156090 - DNA, 16 bp, Homo sapiens
cagttatctaagttaa

SEQ ID NO: 2156091 - DNA, 14 bp, Homo sapiens
cagttgggagcact

SEQ ID NO: 2156092 - DNA, 16 bp, Homo sapiens
cagttgggagcactgg

SEQ ID NO: 2156093 - DNA, 21 bp, Homo sapiens
cagttgggagcactggagtgc

SEQ ID NO: 2156094 - DNA, 14 bp, Homo sapiens
catatatgtatatg

SEQ ID NO: 2156095 - DNA, 18 bp, Homo sapiens
catatatgtatatgtata

SEQ ID NO: 2156096 - DNA, 17 bp, Homo sapiens
gctccccttgcccttcc

SEQ ID NO: 2156097 - DNA, 18 bp, Homo sapiens
gctccccttgcccttcct

SEQ ID NO: 2156098 - DNA, 11 bp, Homo sapiens
gctcctcccct

SEQ ID NO: 2156099 - DNA, 12 bp, Homo sapiens
gctcctcccctg

SEQ ID NO: 2156100 - DNA, 14 bp, Homo sapiens
gctcctcccctgcc

SEQ ID NO: 2156101 - DNA, 15 bp, Homo sapiens
gctcctcccctgccg

SEQ ID NO: 2156102 - DNA, 20 bp, Homo sapiens
gctcctcccctgccgcctcc

SEQ ID NO: 2156103 - DNA, 23 bp, Homo sapiens
gctcctcccctgccgcctcccgg

SEQ ID NO: 2156104 - DNA, 15 bp, Homo sapiens
gctcctccctctgcc

SEQ ID NO: 2156105 - DNA, 17 bp, Homo sapiens
gctcctccctctgcctc

SEQ ID NO: 2156106 - DNA, 18 bp, Homo sapiens
gctcctccctctgcctca

SEQ ID NO: 2156107 - DNA, 18 bp, Homo sapiens
gctcctcctgccctgtcc

SEQ ID NO: 2156108 - DNA, 20 bp, Homo sapiens
gctcctttctccagccagca

SEQ ID NO: 2156109 - DNA, 19 bp, Homo sapiens
gctctgcctctaactccct

SEQ ID NO: 2156110 - DNA, 23 bp, Homo sapiens
gctctgcctctaactccctcctc

SEQ ID NO: 2156111 - DNA, 16 bp, Homo sapiens
gctctgtcaccctggc

SEQ ID NO: 2156112 - DNA, 17 bp, Homo sapiens
gctctgtcaccctggcc

SEQ ID NO: 2156113 - DNA, 22 bp, Homo sapiens
gctctgtcaccctggccaccac

SEQ ID NO: 2156114 - DNA, 16 bp, Homo sapiens
gctcttacttccccca

SEQ ID NO: 2156115 - DNA, 20 bp, Homo sapiens
gctcttacttcccccaccct

SEQ ID NO: 2156116 - DNA, 14 bp, Homo sapiens
gctcttgggcctga

SEQ ID NO: 2156117 - DNA, 21 bp, Homo sapiens
gctcttgggcctgacctccag

SEQ ID NO: 2156118 - DNA, 23 bp, Homo sapiens
gctcttgggcctgacctccagtc

SEQ ID NO: 2156119 - DNA, 15 bp, Homo sapiens
gctgacccaccaagg

SEQ ID NO: 2156120 - DNA, 12 bp, Homo sapiens
gctgaggcctcc

SEQ ID NO: 2156121 - DNA, 16 bp, Homo sapiens
gctgagggcatctctg

SEQ ID NO: 2156122 - DNA, 23 bp, Homo sapiens
gctgatttctaggtaggaaatgt

SEQ ID NO: 2156123 - DNA, 15 bp, Homo sapiens
gctgccactctgctg

SEQ ID NO: 2156124 - DNA, 16 bp, Homo sapiens
gctgccactctgctgc

SEQ ID NO: 2156125 - DNA, 18 bp, Homo sapiens
gctgccactctgctgcct

SEQ ID NO: 2156126 - DNA, 19 bp, Homo sapiens
gctgcctgacactgagccc

SEQ ID NO: 2156127 - DNA, 14 bp, Homo sapiens
gctgcgggctgagg

SEQ ID NO: 2156128 - DNA, 15 bp, Homo sapiens
gctgcgggctgaggg

SEQ ID NO: 2156129 - DNA, 17 bp, Homo sapiens
gctgcgggctgagggca

SEQ ID NO: 2156130 - DNA, 19 bp, Homo sapiens
gctgctgccactctgctgc

SEQ ID NO: 2156131 - DNA, 17 bp, Homo sapiens
gctgctgggggctcccc

SEQ ID NO: 2156132 - DNA, 18 bp, Homo sapiens
gctgctgggggctcccct

SEQ ID NO: 2156133 - DNA, 20 bp, Homo sapiens
gctggatgagacttccaaac

SEQ ID NO: 2156134 - DNA, 14 bp, Homo sapiens
gctggcctcttggc

SEQ ID NO: 2156135 - DNA, 17 bp, Homo sapiens
gctggcctgctcttact

SEQ ID NO: 2156136 - DNA, 20 bp, Homo sapiens
gctgggcccacagcccccac

SEQ ID NO: 2156137 - DNA, 20 bp, Homo sapiens
gctgggctcttaactgttgc

SEQ ID NO: 2156138 - DNA, 15 bp, Homo sapiens
gctgggggagggact

SEQ ID NO: 2156139 - DNA, 23 bp, Homo sapiens
gctgggggctccccttgcccttc

SEQ ID NO: 2156140 - DNA, 21 bp, Homo sapiens
gctggtgaggccggccctgcc

SEQ ID NO: 2156141 - DNA, 20 bp, Homo sapiens
gctggtggattgggcagaat

SEQ ID NO: 2156142 - DNA, 22 bp, Homo sapiens
gcttcaccctgaatggttccat

SEQ ID NO: 2156143 - DNA, 18 bp, Homo sapiens
gcttctatcccaggaggt

SEQ ID NO: 2156144 - DNA, 13 bp, Homo sapiens
gctttgtcacttg

SEQ ID NO: 2156145 - DNA, 16 bp, Homo sapiens
ggaagcatcctcccca

SEQ ID NO: 2156146 - DNA, 19 bp, Homo sapiens
ggaagcatcctccccacca

SEQ ID NO: 2156147 - DNA, 14 bp, Homo sapiens
ggaagggagggagc

SEQ ID NO: 2156148 - DNA, 16 bp, Homo sapiens
ggaagggagggagctg

SEQ ID NO: 2156149 - DNA, 11 bp, Homo sapiens
ggaagggccag

SEQ ID NO: 2156150 - DNA, 17 bp, Homo sapiens
ggaatgcacctccccaa

SEQ ID NO: 2156151 - DNA, 19 bp, Homo sapiens
ggacaacctgcccctcccc

SEQ ID NO: 2156152 - DNA, 20 bp, Homo sapiens
ggacaagccaacttgtaaat

SEQ ID NO: 2156153 - DNA, 22 bp, Homo sapiens
ggacacaccccacaccccagcc

SEQ ID NO: 2156154 - DNA, 23 bp, Homo sapiens
ggacacaccccacaccccagccc

SEQ ID NO: 2156155 - DNA, 18 bp, Homo sapiens
ggaccactgggcccctca

SEQ ID NO: 2156156 - DNA, 16 bp, Homo sapiens
ggacctggactagggc

SEQ ID NO: 2156157 - DNA, 20 bp, Homo sapiens
ggacctggactagggcctcg

SEQ ID NO: 2156158 - DNA, 17 bp, Homo sapiens
ggactagggcctcggag

SEQ ID NO: 2156159 - DNA, 14 bp, Homo sapiens
ggactgctgaccca

SEQ ID NO: 2156160 - DNA, 17 bp, Homo sapiens
ggactggccgtggctcc

SEQ ID NO: 2156161 - DNA, 18 bp, Homo sapiens
ggactggccgtggctcca

SEQ ID NO: 2156162 - DNA, 19 bp, Homo sapiens
ggacttaacggctccagga

SEQ ID NO: 2156163 - DNA, 20 bp, Homo sapiens
ggacttaacggctccaggat

SEQ ID NO: 2156164 - DNA, 18 bp, Homo sapiens
ggagaggggaagggccag

SEQ ID NO: 2156165 - DNA, 22 bp, Homo sapiens
ggagaggggaagggccagtctg

SEQ ID NO: 2156166 - DNA, 13 bp, Homo sapiens
ggagcacaggcag

SEQ ID NO: 2156167 - DNA, 13 bp, Homo sapiens
ggagcaggggtgg

SEQ ID NO: 2156168 - DNA, 15 bp, Homo sapiens
ggagctgaggcctcc

SEQ ID NO: 2156169 - DNA, 16 bp, Homo sapiens
ggagctgaggcctccc

SEQ ID NO: 2156170 - DNA, 20 bp, Homo sapiens
ggagggactgctgacccacc

SEQ ID NO: 2156171 - DNA, 12 bp, Homo sapiens
ggagggagctga

SEQ ID NO: 2156172 - DNA, 17 bp, Homo sapiens
ggagggagctgaggcct

SEQ ID NO: 2156173 - DNA, 19 bp, Homo sapiens
ggagggagctgaggcctcc

SEQ ID NO: 2156174 - DNA, 15 bp, Homo sapiens
ggagtgcagggagga

SEQ ID NO: 2156175 - DNA, 18 bp, Homo sapiens
ggagtgcagggaggagag

SEQ ID NO: 2156176 - DNA, 14 bp, Homo sapiens
ggatcagccccgcc

SEQ ID NO: 2156177 - DNA, 16 bp, Homo sapiens
ggatcccctgtcccct

SEQ ID NO: 2156178 - DNA, 22 bp, Homo sapiens
ggatcccctgtcccctggggct

SEQ ID NO: 2156179 - DNA, 23 bp, Homo sapiens
ggatgcgtgccctgacccctgca

SEQ ID NO: 2156180 - DNA, 21 bp, Homo sapiens
ggattggccctgcccctcccc

SEQ ID NO: 2156181 - DNA, 22 bp, Homo sapiens
ggatttgccccttcccatctct

SEQ ID NO: 2156182 - DNA, 16 bp, Homo sapiens
ggcaaagaactgcccc

SEQ ID NO: 2156183 - DNA, 15 bp, Homo sapiens
ggcacatggctgggg

SEQ ID NO: 2156184 - DNA, 14 bp, Homo sapiens
ggcacctgcctagc

SEQ ID NO: 2156185 - DNA, 16 bp, Homo sapiens
ggcactcccccaggat

SEQ ID NO: 2156186 - DNA, 14 bp, Homo sapiens
ggcagaactgctgg

SEQ ID NO: 2156187 - DNA, 19 bp, Homo sapiens
ggcagaactgctggggctg

SEQ ID NO: 2156188 - DNA, 20 bp, Homo sapiens
ggcagaactgctggggctgg

SEQ ID NO: 2156189 - DNA, 23 bp, Homo sapiens
ggcagaactgctggggctggtga

SEQ ID NO: 2156190 - DNA, 14 bp, Homo sapiens
ggcagaatcctggg

SEQ ID NO: 2156191 - DNA, 16 bp, Homo sapiens
ggcagcgcctgtcccc

SEQ ID NO: 2156192 - DNA, 20 bp, Homo sapiens
ggcagctgggcccacagccc

SEQ ID NO: 2156193 - DNA, 23 bp, Homo sapiens
ggcagctgggcccacagccccca

SEQ ID NO: 2156194 - DNA, 21 bp, Homo sapiens
ggcaggagtcaccatgcaagg

SEQ ID NO: 2156195 - DNA, 24 bp, Homo sapiens
ggcagtgaacacactcagcagccc

SEQ ID NO: 2156196 - DNA, 20 bp, Homo sapiens
ggcatctctgagtgtctctg

SEQ ID NO: 2156197 - DNA, 21 bp, Homo sapiens
ggccacactattaccatgaga

SEQ ID NO: 2156198 - DNA, 16 bp, Homo sapiens
ggccagtctgggctgc

SEQ ID NO: 2156199 - DNA, 14 bp, Homo sapiens
ggccatgggtcctc

SEQ ID NO: 2156200 - DNA, 12 bp, Homo sapiens
ggcccacagccc

SEQ ID NO: 2156201 - DNA, 13 bp, Homo sapiens
ggcccacagcccc

SEQ ID NO: 2156202 - DNA, 15 bp, Homo sapiens
ggcccacagccccca

SEQ ID NO: 2156203 - DNA, 23 bp, Homo sapiens
ggcccacagcccccaccccagca

SEQ ID NO: 2156204 - DNA, 13 bp, Homo sapiens
ggcccatctgtcc

SEQ ID NO: 2156205 - DNA, 22 bp, Homo sapiens
ggcccccagagacctttgccca

SEQ ID NO: 2156206 - DNA, 22 bp, Homo sapiens
ggcccctcaggggaagctgcta

SEQ ID NO: 2156207 - DNA, 14 bp, Homo sapiens
gacattaactcatt

SEQ ID NO: 2156208 - DNA, 22 bp, Homo sapiens
gacattctgattcgaatgacac

SEQ ID NO: 2156209 - DNA, 23 bp, Homo sapiens
gacattctgattcgaatgacact

SEQ ID NO: 2156210 - DNA, 19 bp, Homo sapiens
gaccaaaagttacatgttt

SEQ ID NO: 2156211 - DNA, 21 bp, Homo sapiens
gaccaccagccgccccagccc

SEQ ID NO: 2156212 - DNA, 12 bp, Homo sapiens
gaccactgggcc

SEQ ID NO: 2156213 - DNA, 14 bp, Homo sapiens
gaccactgggcccc

SEQ ID NO: 2156214 - DNA, 17 bp, Homo sapiens
gaccactgggcccctca

SEQ ID NO: 2156215 - DNA, 18 bp, Homo sapiens
gaccactgggcccctcag

SEQ ID NO: 2156216 - DNA, 14 bp, Homo sapiens
gaccccatctcatt

SEQ ID NO: 2156217 - DNA, 22 bp, Homo sapiens
gacccggctgggtcggccctgc

SEQ ID NO: 2156218 - DNA, 22 bp, Homo sapiens
gacctatgtcctaaggacacac

SEQ ID NO: 2156219 - DNA, 19 bp, Homo sapiens
gacctccagtcctgctggc

SEQ ID NO: 2156220 - DNA, 12 bp, Homo sapiens
gacctgcctgta

SEQ ID NO: 2156221 - DNA, 16 bp, Homo sapiens
gacctggactagggcc

SEQ ID NO: 2156222 - DNA, 17 bp, Homo sapiens
gacctggactagggcct

SEQ ID NO: 2156223 - DNA, 19 bp, Homo sapiens
gacctggactagggcctcg

SEQ ID NO: 2156224 - DNA, 22 bp, Homo sapiens
gcacagctcctcccctgccgcc

SEQ ID NO: 2156225 - DNA, 20 bp, Homo sapiens
gcaccagcccttccctgctt

SEQ ID NO: 2156226 - DNA, 15 bp, Homo sapiens
gcacctgcctagctc

SEQ ID NO: 2156227 - DNA, 19 bp, Homo sapiens
gcacctgcctagctcttgg

SEQ ID NO: 2156228 - DNA, 11 bp, Homo sapiens
gcactgagggc

SEQ ID NO: 2156229 - DNA, 16 bp, Homo sapiens
gcactggagtgcaggg

SEQ ID NO: 2156230 - DNA, 15 bp, Homo sapiens
gcagaactgctgggg

SEQ ID NO: 2156231 - DNA, 17 bp, Homo sapiens
gcagaactgctggggct

SEQ ID NO: 2156232 - DNA, 15 bp, Homo sapiens
gcagaatcctgggcc

SEQ ID NO: 2156233 - DNA, 22 bp, Homo sapiens
gcagaatcctgggcccccagag

SEQ ID NO: 2156234 - DNA, 23 bp, Homo sapiens
gcagccctaaggatctctcagga

SEQ ID NO: 2156235 - DNA, 11 bp, Homo sapiens
gcagctgctgc

SEQ ID NO: 2156236 - DNA, 13 bp, Homo sapiens
gcagctgggccca

SEQ ID NO: 2156237 - DNA, 19 bp, Homo sapiens
gcagctgggcccacagccc

SEQ ID NO: 2156238 - DNA, 22 bp, Homo sapiens
gcagctgggcccacagccccca

SEQ ID NO: 2156239 - DNA, 17 bp, Homo sapiens
gcaggcagcgcctgtcc

SEQ ID NO: 2156240 - DNA, 20 bp, Homo sapiens
gcaggcagcgcctgtcccct

SEQ ID NO: 2156241 - DNA, 14 bp, Homo sapiens
gcaggccctgcctt

SEQ ID NO: 2156242 - DNA, 12 bp, Homo sapiens
gcaggctgattt

SEQ ID NO: 2156243 - DNA, 17 bp, Homo sapiens
gcaggggactgggccat

SEQ ID NO: 2156244 - DNA, 18 bp, Homo sapiens
gcaggggctgctgggggc

SEQ ID NO: 2156245 - DNA, 21 bp, Homo sapiens
gcaggggctgctgggggctcc

SEQ ID NO: 2156246 - DNA, 22 bp, Homo sapiens
gcaggggctgctgggggctccc

SEQ ID NO: 2156247 - DNA, 23 bp, Homo sapiens
gcagtgaacacactcagcagccc

SEQ ID NO: 2156248 - DNA, 12 bp, Homo sapiens
gcctgctgggct

SEQ ID NO: 2156249 - DNA, 15 bp, Homo sapiens
gcctgctgggctctt

SEQ ID NO: 2156250 - DNA, 12 bp, Homo sapiens
gcctgctgtgga

SEQ ID NO: 2156251 - DNA, 15 bp, Homo sapiens
gcctggcaaggcctc

SEQ ID NO: 2156252 - DNA, 22 bp, Homo sapiens
gcctggggctcctttctccagc

SEQ ID NO: 2156253 - DNA, 20 bp, Homo sapiens
gcctgtagccccagtgacag

SEQ ID NO: 2156254 - DNA, 16 bp, Homo sapiens
gcctgtcccctcacag

SEQ ID NO: 2156255 - DNA, 17 bp, Homo sapiens
gcctgtcccctcacaga

SEQ ID NO: 2156256 - DNA, 18 bp, Homo sapiens
gcctgtcccctcacagac

SEQ ID NO: 2156257 - DNA, 19 bp, Homo sapiens
gcctgtcccctcacagact

SEQ ID NO: 2156258 - DNA, 13 bp, Homo sapiens
gcctgtctgtcca

SEQ ID NO: 2156259 - DNA, 16 bp, Homo sapiens
gcctgtctgtccaacc

SEQ ID NO: 2156260 - DNA, 17 bp, Homo sapiens
gcctgtctgtccaaccc

SEQ ID NO: 2156261 - DNA, 15 bp, Homo sapiens
gccttcttcacccag

SEQ ID NO: 2156262 - DNA, 19 bp, Homo sapiens
gcctttgggaggcagcatc

SEQ ID NO: 2156263 - DNA, 21 bp, Homo sapiens
gcgcctgtcccctcacagact

SEQ ID NO: 2156264 - DNA, 14 bp, Homo sapiens
gcgggctcagagct

SEQ ID NO: 2156265 - DNA, 20 bp, Homo sapiens
gctaatctgtagggctggac

SEQ ID NO: 2156266 - DNA, 22 bp, Homo sapiens
gctaatctgtagggctggacct

SEQ ID NO: 2156267 - DNA, 18 bp, Homo sapiens
gctcaaatctattcagac

SEQ ID NO: 2156268 - DNA, 23 bp, Homo sapiens
gctcaaatctattcagacaagca

SEQ ID NO: 2156269 - DNA, 19 bp, Homo sapiens
gctcactgacctgcctgta

SEQ ID NO: 2156270 - DNA, 17 bp, Homo sapiens
gctcagagctttgtcac

SEQ ID NO: 2156271 - DNA, 19 bp, Homo sapiens
gctcagagctttgtcactt

SEQ ID NO: 2156272 - DNA, 15 bp, Homo sapiens
gctcagatagaatga

SEQ ID NO: 2156273 - DNA, 17 bp, Homo sapiens
gctcagctgtggtccca

SEQ ID NO: 2156274 - DNA, 21 bp, Homo sapiens
gctcagctgtggtcccaccca

SEQ ID NO: 2156275 - DNA, 20 bp, Homo sapiens
gctccagaatgtgctgcctt

SEQ ID NO: 2156276 - DNA, 14 bp, Homo sapiens
gctcccacggggac

SEQ ID NO: 2156277 - DNA, 23 bp, Homo sapiens
gctcccagcagccctaaggatct

SEQ ID NO: 2156278 - DNA, 16 bp, Homo sapiens
ctaccgcatggcagct

SEQ ID NO: 2156279 - DNA, 18 bp, Homo sapiens
ctaccgcatggcagctgg

SEQ ID NO: 2156280 - DNA, 20 bp, Homo sapiens
ctaccgcatggcagctgggc

SEQ ID NO: 2156281 - DNA, 23 bp, Homo sapiens
ctaccgcatggcagctgggccca

SEQ ID NO: 2156282 - DNA, 20 bp, Homo sapiens
ctacctttttttctctccta

SEQ ID NO: 2156283 - DNA, 21 bp, Homo sapiens
ctactttgatatgactgtttt

SEQ ID NO: 2156284 - DNA, 17 bp, Homo sapiens
ctagctcttgggcctga

SEQ ID NO: 2156285 - DNA, 22 bp, Homo sapiens
ctaggatgtgcattctccagcc

SEQ ID NO: 2156286 - DNA, 23 bp, Homo sapiens
ctaggattcctcccccagagcca

SEQ ID NO: 2156287 - DNA, 23 bp, Homo sapiens
ctagggcctcggaggctcctccc

SEQ ID NO: 2156288 - DNA, 22 bp, Homo sapiens
ctaggggaaggactggccgtgg

SEQ ID NO: 2156289 - DNA, 16 bp, Homo sapiens
ctaggggtcaggctcc

SEQ ID NO: 2156290 - DNA, 11 bp, Homo sapiens
ctagtatatta

SEQ ID NO: 2156291 - DNA, 21 bp, Homo sapiens
ctagtatattagtttgattta

SEQ ID NO: 2156292 - DNA, 23 bp, Homo sapiens
ctagtctcctttgcactgagggc

SEQ ID NO: 2156293 - DNA, 14 bp, Homo sapiens
ctatatctctaaac

SEQ ID NO: 2156294 - DNA, 18 bp, Homo sapiens
ctatgtcctaaggacaca

SEQ ID NO: 2156295 - DNA, 20 bp, Homo sapiens
ctatgtcctaaggacacact

SEQ ID NO: 2156296 - DNA, 23 bp, Homo sapiens
ctatgtcctaaggacacactaat

SEQ ID NO: 2156297 - DNA, 14 bp, Homo sapiens
ctattcagacaagc

SEQ ID NO: 2156298 - DNA, 15 bp, Homo sapiens
ctattcagacaagca

SEQ ID NO: 2156299 - DNA, 12 bp, Homo sapiens
ctcacactcctc

SEQ ID NO: 2156300 - DNA, 13 bp, Homo sapiens
ctcacactcctcc

SEQ ID NO: 2156301 - DNA, 15 bp, Homo sapiens
ctcacagactcttcc

SEQ ID NO: 2156302 - DNA, 19 bp, Homo sapiens
ctcacagactcttccacca

SEQ ID NO: 2156303 - DNA, 20 bp, Homo sapiens
ctcacagactcttccaccag

SEQ ID NO: 2156304 - DNA, 21 bp, Homo sapiens
ctcacagactcttccaccaga

SEQ ID NO: 2156305 - DNA, 22 bp, Homo sapiens
ctcacagatgctggcctcttgg

SEQ ID NO: 2156306 - DNA, 11 bp, Homo sapiens
ctcactcctgt

SEQ ID NO: 2156307 - DNA, 21 bp, Homo sapiens
ctcacttttaatgaacaaatg

SEQ ID NO: 2156308 - DNA, 22 bp, Homo sapiens
ctcacttttaatgaacaaatgg

SEQ ID NO: 2156309 - DNA, 13 bp, Homo sapiens
ctcagagctgcgg

SEQ ID NO: 2156310 - DNA, 14 bp, Homo sapiens
ctcagagctgcggg

SEQ ID NO: 2156311 - DNA, 16 bp, Homo sapiens
ctcagagctgcgggct

SEQ ID NO: 2156312 - DNA, 17 bp, Homo sapiens
ctcagagctgcgggctg

SEQ ID NO: 2156313 - DNA, 18 bp, Homo sapiens
ctcagagctgcgggctga

SEQ ID NO: 2156314 - DNA, 22 bp, Homo sapiens
ctcagagctgcgggctgagggc

SEQ ID NO: 2156315 - DNA, 15 bp, Homo sapiens
ctcagagctttgtca

SEQ ID NO: 2156316 - DNA, 17 bp, Homo sapiens
ctcagagctttgtcact

SEQ ID NO: 2156317 - DNA, 18 bp, Homo sapiens
ctcagagctttgtcactt

SEQ ID NO: 2156318 - DNA, 14 bp, Homo sapiens
ctcagcagccccct

SEQ ID NO: 2156319 - DNA, 23 bp, Homo sapiens
ctcagctctgacattctgattcg

SEQ ID NO: 2156320 - DNA, 19 bp, Homo sapiens
ctcagctgtggtcccaccc

SEQ ID NO: 2156321 - DNA, 22 bp, Homo sapiens
ctcaggagcacaggcagctgga

SEQ ID NO: 2156322 - DNA, 15 bp, Homo sapiens
ctcaggcttgaaatg

SEQ ID NO: 2156323 - DNA, 16 bp, Homo sapiens
ctcaggggaagctgct

SEQ ID NO: 2156324 - DNA, 24 bp, Homo sapiens
ctcagtctggtgctccagttccag

SEQ ID NO: 2156325 - DNA, 13 bp, Homo sapiens
ctcatcctcctcc

SEQ ID NO: 2156326 - DNA, 16 bp, Homo sapiens
ctcatcctcctcctca

SEQ ID NO: 2156327 - DNA, 15 bp, Homo sapiens
ctcatctgtgcctgt

SEQ ID NO: 2156328 - DNA, 18 bp, Homo sapiens
ctcatctgtgcctgtctg

SEQ ID NO: 2156329 - DNA, 21 bp, Homo sapiens
ctcatctgtgcctgtctgtcc

SEQ ID NO: 2156330 - DNA, 13 bp, Homo sapiens
ctccaagtctctc

SEQ ID NO: 2156331 - DNA, 15 bp, Homo sapiens
ctccagaatgtgctg

SEQ ID NO: 2156332 - DNA, 19 bp, Homo sapiens
ctccagaatgtgctgcctt

SEQ ID NO: 2156333 - DNA, 11 bp, Homo sapiens
ctccagccagc

SEQ ID NO: 2156334 - DNA, 24 bp, Homo sapiens
ctccagccagcaatgatgtccaga

SEQ ID NO: 2156335 - DNA, 23 bp, Homo sapiens
ctccagccatcaagagactgagt

SEQ ID NO: 2156336 - DNA, 14 bp, Homo sapiens
ctccagcctcacag

SEQ ID NO: 2156337 - DNA, 22 bp, Homo sapiens
ctccagcctcacagatgctggc

SEQ ID NO: 2156338 - DNA, 13 bp, Homo sapiens
ctccagtcctgct

SEQ ID NO: 2156339 - DNA, 15 bp, Homo sapiens
ctccagtcctgctgg

SEQ ID NO: 2156340 - DNA, 16 bp, Homo sapiens
ctccagtcctgctggc

SEQ ID NO: 2156341 - DNA, 23 bp, Homo sapiens
ctccagtcctgctggcctgctct

SEQ ID NO: 2156342 - DNA, 16 bp, Homo sapiens
ctccatgcaagtgctg

SEQ ID NO: 2156343 - DNA, 22 bp, Homo sapiens
ctccattaggatttgccccttc

SEQ ID NO: 2156344 - DNA, 19 bp, Homo sapiens
ctcccaacatgggagggat

SEQ ID NO: 2156345 - DNA, 14 bp, Homo sapiens
ctcccaccagagac

SEQ ID NO: 2156346 - DNA, 14 bp, Homo sapiens
ctcccacggggacc

SEQ ID NO: 2156347 - DNA, 18 bp, Homo sapiens
ctcccacggggaccactg

SEQ ID NO: 2156348 - DNA, 19 bp, Homo sapiens
ctcccacggggaccactgg

SEQ ID NO: 2156349 - DNA, 22 bp, Homo sapiens
ctcccacggggaccactgggcc

SEQ ID NO: 2156350 - DNA, 12 bp, Homo sapiens
ctcccactccta

SEQ ID NO: 2156351 - DNA, 20 bp, Homo sapiens
ctgagggtggagactaagcc

SEQ ID NO: 2156352 - DNA, 15 bp, Homo sapiens
ctgagtcaagttgtt

SEQ ID NO: 2156353 - DNA, 14 bp, Homo sapiens
ctgagtctcctgtg

SEQ ID NO: 2156354 - DNA, 15 bp, Homo sapiens
ctgagtctcctgtgc

SEQ ID NO: 2156355 - DNA, 16 bp, Homo sapiens
ctgagtctcctgtgcc

SEQ ID NO: 2156356 - DNA, 11 bp, Homo sapiens
ctgagtgactc

SEQ ID NO: 2156357 - DNA, 17 bp, Homo sapiens
ctgagtgtctctgcctg

SEQ ID NO: 2156358 - DNA, 19 bp, Homo sapiens
ctgagtgtctctgcctgga

SEQ ID NO: 2156359 - DNA, 21 bp, Homo sapiens
ctgattcacatctcatttttc

SEQ ID NO: 2156360 - DNA, 19 bp, Homo sapiens
ctgattcgaatgacactgt

SEQ ID NO: 2156361 - DNA, 16 bp, Homo sapiens
ctgcaaactcactgct

SEQ ID NO: 2156362 - DNA, 18 bp, Homo sapiens
ctgcaccagcccttccct

SEQ ID NO: 2156363 - DNA, 19 bp, Homo sapiens
ctgccactctgctgcctgt

SEQ ID NO: 2156364 - DNA, 13 bp, Homo sapiens
ctgccagctctgt

SEQ ID NO: 2156365 - DNA, 18 bp, Homo sapiens
ctgccagctctgtcaccc

SEQ ID NO: 2156366 - DNA, 21 bp, Homo sapiens
ctgcccaagggcctcccacca

SEQ ID NO: 2156367 - DNA, 18 bp, Homo sapiens
ctgcccctccccagccct

SEQ ID NO: 2156368 - DNA, 22 bp, Homo sapiens
ctgcccctccccctaccgcatg

SEQ ID NO: 2156369 - DNA, 13 bp, Homo sapiens
ctgcccctcccta

SEQ ID NO: 2156370 - DNA, 15 bp, Homo sapiens
ctgcccctccctaga

SEQ ID NO: 2156371 - DNA, 16 bp, Homo sapiens
ctgccctgtccctgtc

SEQ ID NO: 2156372 - DNA, 21 bp, Homo sapiens
ctgccctgttgtgtatagatg

SEQ ID NO: 2156373 - DNA, 14 bp, Homo sapiens
ctgccgggttctag

SEQ ID NO: 2156374 - DNA, 21 bp, Homo sapiens
ctgccgggttctagtctcctt

SEQ ID NO: 2156375 - DNA, 18 bp, Homo sapiens
ctgcctagctcttgggcc

SEQ ID NO: 2156376 - DNA, 12 bp, Homo sapiens
ctgcctcatcct

SEQ ID NO: 2156377 - DNA, 17 bp, Homo sapiens
ctgcctcatcctcctcc

SEQ ID NO: 2156378 - DNA, 14 bp, Homo sapiens
ctgcctctaactcc

SEQ ID NO: 2156379 - DNA, 19 bp, Homo sapiens
ctgcctctaactccctcct

SEQ ID NO: 2156380 - DNA, 18 bp, Homo sapiens
ctgcctgacactgagccc

SEQ ID NO: 2156381 - DNA, 13 bp, Homo sapiens
ctgcctgctgggc

SEQ ID NO: 2156382 - DNA, 14 bp, Homo sapiens
ctgcctgctgggct

SEQ ID NO: 2156383 - DNA, 15 bp, Homo sapiens
ctgcctgctgggctc

SEQ ID NO: 2156384 - DNA, 16 bp, Homo sapiens
ctgcctgctgggctct

SEQ ID NO: 2156385 - DNA, 14 bp, Homo sapiens
ctgcctgctgtgga

SEQ ID NO: 2156386 - DNA, 14 bp, Homo sapiens
ctgcctggagcagg

SEQ ID NO: 2156387 - DNA, 18 bp, Homo sapiens
ctgcctgtacagaagaaa

SEQ ID NO: 2156388 - DNA, 15 bp, Homo sapiens
ctgcgggctgagggc

SEQ ID NO: 2156389 - DNA, 21 bp, Homo sapiens
ctgcgggctgagggcatctct

SEQ ID NO: 2156390 - DNA, 20 bp, Homo sapiens
ctgctcaagaagacatggag

SEQ ID NO: 2156391 - DNA, 23 bp, Homo sapiens
ctgctcaagaagacatggagact

SEQ ID NO: 2156392 - DNA, 17 bp, Homo sapiens
ctgctcccagcagccct

SEQ ID NO: 2156393 - DNA, 14 bp, Homo sapiens
ctgctcgaagaaca

SEQ ID NO: 2156394 - DNA, 13 bp, Homo sapiens
ctgctgacccacc

SEQ ID NO: 2156395 - DNA, 15 bp, Homo sapiens
ctgctgccactctgc

SEQ ID NO: 2156396 - DNA, 21 bp, Homo sapiens
ctgctgccactctgctgcctg

SEQ ID NO: 2156397 - DNA, 22 bp, Homo sapiens
ctgctgccactctgctgcctgt

SEQ ID NO: 2156398 - DNA, 16 bp, Homo sapiens
ctgctggcctgctctt

SEQ ID NO: 2156399 - DNA, 12 bp, Homo sapiens
ctgctggcctgg

SEQ ID NO: 2156400 - DNA, 14 bp, Homo sapiens
ctgctggcctggat

SEQ ID NO: 2156401 - DNA, 12 bp, Homo sapiens
ctgctgggctct

SEQ ID NO: 2156402 - DNA, 17 bp, Homo sapiens
ctgctgggggctcccct

SEQ ID NO: 2156403 - DNA, 18 bp, Homo sapiens
ctgctgggggctcccctt

SEQ ID NO: 2156404 - DNA, 23 bp, Homo sapiens
ctgctgggggctccccttgccct

SEQ ID NO: 2156405 - DNA, 13 bp, Homo sapiens
ctggaacctttcc

SEQ ID NO: 2156406 - DNA, 11 bp, Homo sapiens
ctggacaagcc

SEQ ID NO: 2156407 - DNA, 22 bp, Homo sapiens
ctggactagggcctcggaggct

SEQ ID NO: 2156408 - DNA, 15 bp, Homo sapiens
ctggatctccccact

SEQ ID NO: 2156409 - DNA, 13 bp, Homo sapiens
ctggccaccaccc

SEQ ID NO: 2156410 - DNA, 22 bp, Homo sapiens
ctggccaccacccaacctgtcc

SEQ ID NO: 2156411 - DNA, 14 bp, Homo sapiens
ctggccgtggctcc

SEQ ID NO: 2156412 - DNA, 17 bp, Homo sapiens
ctggccgtggctccaga

SEQ ID NO: 2156413 - DNA, 18 bp, Homo sapiens
ctggcctcttggcacctg

SEQ ID NO: 2156414 - DNA, 19 bp, Homo sapiens
ctggcctcttggcacctgc

SEQ ID NO: 2156415 - DNA, 14 bp, Homo sapiens
ctggcctgctctta

SEQ ID NO: 2156416 - DNA, 22 bp, Homo sapiens
ctggcctgctcttacttccccc

SEQ ID NO: 2156417 - DNA, 12 bp, Homo sapiens
ctggcctggatc

SEQ ID NO: 2156418 - DNA, 21 bp, Homo sapiens
ctggcctggatctccccactc

SEQ ID NO: 2156419 - DNA, 16 bp, Homo sapiens
ctggctcagctgtggt

SEQ ID NO: 2156420 - DNA, 17 bp, Homo sapiens
ctggctcagctgtggtc

SEQ ID NO: 2156421 - DNA, 19 bp, Homo sapiens
ctggctcagctgtggtccc

SEQ ID NO: 2156422 - DNA, 18 bp, Homo sapiens
ctggctgaacagtgctct

SEQ ID NO: 2156423 - DNA, 20 bp, Homo sapiens
ctgggcccacagcccccacc

SEQ ID NO: 2156424 - DNA, 15 bp, Homo sapiens
ctgggcccccagaga

SEQ ID NO: 2156425 - DNA, 17 bp, Homo sapiens
ctgggcccccagagacc

SEQ ID NO: 2156426 - DNA, 13 bp, Homo sapiens
ctggggcactccc

SEQ ID NO: 2156427 - DNA, 20 bp, Homo sapiens
ctggggctcctttctccagc

SEQ ID NO: 2156428 - DNA, 11 bp, Homo sapiens
ctggggctggt

SEQ ID NO: 2156429 - DNA, 17 bp, Homo sapiens
ctgggggagggactgct

SEQ ID NO: 2156430 - DNA, 19 bp, Homo sapiens
ctgggggagggactgctga

SEQ ID NO: 2156431 - DNA, 23 bp, Homo sapiens
ctgggggagggactgctgaccca

SEQ ID NO: 2156432 - DNA, 24 bp, Homo sapiens
ctgggggagggactgctgacccac

SEQ ID NO: 2156433 - DNA, 12 bp, Homo sapiens
ctgggggctccc

SEQ ID NO: 2156434 - DNA, 13 bp, Homo sapiens
ctgggggctcccc

SEQ ID NO: 2156435 - DNA, 23 bp, Homo sapiens
ctgggggctccccttgcccttcc

SEQ ID NO: 2156436 - DNA, 17 bp, Homo sapiens
ctgggtcggccctgccc

SEQ ID NO: 2156437 - DNA, 19 bp, Homo sapiens
ctgggtcggccctgcccaa

SEQ ID NO: 2156438 - DNA, 17 bp, Homo sapiens
ctgggtttggcccctgg

SEQ ID NO: 2156439 - DNA, 12 bp, Homo sapiens
ctggtgaggccg

SEQ ID NO: 2156440 - DNA, 18 bp, Homo sapiens
ctggtgggcagctgagga

SEQ ID NO: 2156441 - DNA, 16 bp, Homo sapiens
ctgtaacaagccagat

SEQ ID NO: 2156442 - DNA, 19 bp, Homo sapiens
ctgtacagaagaaactgaa

SEQ ID NO: 2156443 - DNA, 18 bp, Homo sapiens
ctgtagccccagtgacag

SEQ ID NO: 2156444 - DNA, 20 bp, Homo sapiens
ctgtagccccagtgacagct

SEQ ID NO: 2156445 - DNA, 21 bp, Homo sapiens
ctgtagggctggacctatgtc

SEQ ID NO: 2156446 - DNA, 12 bp, Homo sapiens
ctgtcacaataa

SEQ ID NO: 2156447 - DNA, 15 bp, Homo sapiens
ctgtccaacccctcc

SEQ ID NO: 2156448 - DNA, 17 bp, Homo sapiens
ctgtccaacccctcccc

SEQ ID NO: 2156449 - DNA, 16 bp, Homo sapiens
ctgtccagtttccaaa

SEQ ID NO: 2156450 - DNA, 23 bp, Homo sapiens
ctgtccataaagtaattttgtga

SEQ ID NO: 2156451 - DNA, 20 bp, Homo sapiens
ctgtccatcctcctctccat

SEQ ID NO: 2156452 - DNA, 22 bp, Homo sapiens
ctgtccatcctcctctccatgc

SEQ ID NO: 2156453 - DNA, 23 bp, Homo sapiens
ctgtccatcctcctctccatgca

SEQ ID NO: 2156454 - DNA, 22 bp, Homo sapiens
ctgtccccctcccctcccagtc

SEQ ID NO: 2156455 - DNA, 19 bp, Homo sapiens
ctgtcccctcacagactct

SEQ ID NO: 2156456 - DNA, 12 bp, Homo sapiens
ctgtcccctggg

SEQ ID NO: 2156457 - DNA, 21 bp, Homo sapiens
ctgtccttactcagagctgcg

SEQ ID NO: 2156458 - DNA, 14 bp, Homo sapiens
ctgtcgagacactt

SEQ ID NO: 2156459 - DNA, 15 bp, Homo sapiens
ctgtcgattagactg

SEQ ID NO: 2156460 - DNA, 20 bp, Homo sapiens
ctgtcgattagactggacag

SEQ ID NO: 2156461 - DNA, 15 bp, Homo sapiens
ctgtctgtccaaccc

SEQ ID NO: 2156462 - DNA, 23 bp, Homo sapiens
ctgtctgtccaacccctccccca

SEQ ID NO: 2156463 - DNA, 18 bp, Homo sapiens
ccagagcaggggctgctg

SEQ ID NO: 2156464 - DNA, 19 bp, Homo sapiens
ccagagcaggggctgctgg

SEQ ID NO: 2156465 - DNA, 12 bp, Homo sapiens
ccagagctgcct

SEQ ID NO: 2156466 - DNA, 16 bp, Homo sapiens
ccagagctgcctcccc

SEQ ID NO: 2156467 - DNA, 21 bp, Homo sapiens
ccagagctgcctccccaatcc

SEQ ID NO: 2156468 - DNA, 22 bp, Homo sapiens
ccagaggtgtcgggacatggtt

SEQ ID NO: 2156469 - DNA, 21 bp, Homo sapiens
ccagatcaccagcccggcctg

SEQ ID NO: 2156470 - DNA, 12 bp, Homo sapiens
ccagcacagctc

SEQ ID NO: 2156471 - DNA, 14 bp, Homo sapiens
ccagcacagctcct

SEQ ID NO: 2156472 - DNA, 22 bp, Homo sapiens
ccagcacagctcctcccctgcc

SEQ ID NO: 2156473 - DNA, 21 bp, Homo sapiens
ccagcagccctaaggatctct

SEQ ID NO: 2156474 - DNA, 17 bp, Homo sapiens
ccagcaggcagcgcctg

SEQ ID NO: 2156475 - DNA, 19 bp, Homo sapiens
ccagcaggcagcgcctgtc

SEQ ID NO: 2156476 - DNA, 21 bp, Homo sapiens
ccagcaggcagcgcctgtccc

SEQ ID NO: 2156477 - DNA, 15 bp, Homo sapiens
ccagcccaccctgct

SEQ ID NO: 2156478 - DNA, 21 bp, Homo sapiens
ccagcccaccctgctcctcct

SEQ ID NO: 2156479 - DNA, 22 bp, Homo sapiens
ccagcccaccctgctcctcctg

SEQ ID NO: 2156480 - DNA, 15 bp, Homo sapiens
ccagccccttctccc

SEQ ID NO: 2156481 - DNA, 14 bp, Homo sapiens
ccagcccggcctgc

SEQ ID NO: 2156482 - DNA, 15 bp, Homo sapiens
ccagcccttccctgc

SEQ ID NO: 2156483 - DNA, 18 bp, Homo sapiens
ccagccgtgatgctcagg

SEQ ID NO: 2156484 - DNA, 20 bp, Homo sapiens
ccagccgtgatgctcaggct

SEQ ID NO: 2156485 - DNA, 21 bp, Homo sapiens
ccagccgtgatgctcaggctt

SEQ ID NO: 2156486 - DNA, 20 bp, Homo sapiens
ccagcctcacagatgctggc

SEQ ID NO: 2156487 - DNA, 20 bp, Homo sapiens
ccagctaatctgtagggctg

SEQ ID NO: 2156488 - DNA, 13 bp, Homo sapiens
ccagctctgtcac

SEQ ID NO: 2156489 - DNA, 20 bp, Homo sapiens
ccagctctgtcaccctggcc

SEQ ID NO: 2156490 - DNA, 22 bp, Homo sapiens
ccagctctgtcaccctggccac

SEQ ID NO: 2156491 - DNA, 17 bp, Homo sapiens
ccaggacatctctgccc

SEQ ID NO: 2156492 - DNA, 15 bp, Homo sapiens
ccaggcacatggctg

SEQ ID NO: 2156493 - DNA, 21 bp, Homo sapiens
ccaggccctaggattcctccc

SEQ ID NO: 2156494 - DNA, 22 bp, Homo sapiens
ccaggccctaggattcctcccc

SEQ ID NO: 2156495 - DNA, 16 bp, Homo sapiens
ccaggcttctcccgga

SEQ ID NO: 2156496 - DNA, 18 bp, Homo sapiens
ccaggcttctcccggacc

SEQ ID NO: 2156497 - DNA, 21 bp, Homo sapiens
ccaggcttctcccggacctgg

SEQ ID NO: 2156498 - DNA, 19 bp, Homo sapiens
ccagggccccagaacacag

SEQ ID NO: 2156499 - DNA, 17 bp, Homo sapiens
ccaggggtaccaggcac

SEQ ID NO: 2156500 - DNA, 15 bp, Homo sapiens
ccagtcctgctggcc

SEQ ID NO: 2156501 - DNA, 19 bp, Homo sapiens
ccagtcctgctggcctgct

SEQ ID NO: 2156502 - DNA, 21 bp, Homo sapiens
ccagtcctgctggcctgctct

SEQ ID NO: 2156503 - DNA, 19 bp, Homo sapiens
ccagtctgggctgccgggt

SEQ ID NO: 2156504 - DNA, 20 bp, Homo sapiens
ccagttgggagcactggagt

SEQ ID NO: 2156505 - DNA, 15 bp, Homo sapiens
ccataggtagaatgt

SEQ ID NO: 2156506 - DNA, 15 bp, Homo sapiens
ccatccctaccactg

SEQ ID NO: 2156507 - DNA, 17 bp, Homo sapiens
ccatccctaccactgtg

SEQ ID NO: 2156508 - DNA, 13 bp, Homo sapiens
ccatcctcctctc

SEQ ID NO: 2156509 - DNA, 13 bp, Homo sapiens
ccatctcttccta

SEQ ID NO: 2156510 - DNA, 21 bp, Homo sapiens
ccatctcttcctacccaacca

SEQ ID NO: 2156511 - DNA, 12 bp, Homo sapiens
ccatctgtccat

SEQ ID NO: 2156512 - DNA, 21 bp, Homo sapiens
ccatctgtccatcctcctctc

SEQ ID NO: 2156513 - DNA, 19 bp, Homo sapiens
ccatgagaagagggcctgt

SEQ ID NO: 2156514 - DNA, 15 bp, Homo sapiens
ccatgcaagtgctgt

SEQ ID NO: 2156515 - DNA, 14 bp, Homo sapiens
ccatgcctgagggt

SEQ ID NO: 2156516 - DNA, 16 bp, Homo sapiens
ccatgcctgagggtgg

SEQ ID NO: 2156517 - DNA, 17 bp, Homo sapiens
ccatgcctgagggtgga

SEQ ID NO: 2156518 - DNA, 18 bp, Homo sapiens
ccatgcctgagggtggag

SEQ ID NO: 2156519 - DNA, 15 bp, Homo sapiens
ccatggccttccctc

SEQ ID NO: 2156520 - DNA, 15 bp, Homo sapiens
ccatggggtccatcc

SEQ ID NO: 2156521 - DNA, 17 bp, Homo sapiens
ccatggggtccatcccc

SEQ ID NO: 2156522 - DNA, 21 bp, Homo sapiens
ccatgggtcctcggcccatct

SEQ ID NO: 2156523 - DNA, 14 bp, Homo sapiens
cccaacatgggagg

SEQ ID NO: 2156524 - DNA, 16 bp, Homo sapiens
cccaacatgggaggga

SEQ ID NO: 2156525 - DNA, 22 bp, Homo sapiens
cccaacatgggagggatcagcc

SEQ ID NO: 2156526 - DNA, 13 bp, Homo sapiens
cccaacctgtcct

SEQ ID NO: 2156527 - DNA, 17 bp, Homo sapiens
cccaacctgtccttact

SEQ ID NO: 2156528 - DNA, 21 bp, Homo sapiens
cccaagaggggcgggctcaga

SEQ ID NO: 2156529 - DNA, 18 bp, Homo sapiens
cccacacacactccttcc

SEQ ID NO: 2156530 - DNA, 15 bp, Homo sapiens
cccacaccccagccc

SEQ ID NO: 2156531 - DNA, 21 bp, Homo sapiens
cccacagcccccaccccagca

SEQ ID NO: 2156532 - DNA, 23 bp, Homo sapiens
cccaccaaggtctcacactcctc

SEQ ID NO: 2156533 - DNA, 18 bp, Homo sapiens
cccaccagagctgcctcc

SEQ ID NO: 2156534 - DNA, 23 bp, Homo sapiens
cccaccagagctgcctccccaat

SEQ ID NO: 2156535 - DNA, 19 bp, Homo sapiens
cccaccctgggtttggccc

SEQ ID NO: 2156536 - DNA, 17 bp, Homo sapiens
cccacggggaccactgg

SEQ ID NO: 2156537 - DNA, 21 bp, Homo sapiens
cccacggggaccactgggccc

SEQ ID NO: 2156538 - DNA, 14 bp, Homo sapiens
cccacgtctctctg

SEQ ID NO: 2156539 - DNA, 22 bp, Homo sapiens
cccacgtctctctgcctgctgg

SEQ ID NO: 2156540 - DNA, 23 bp, Homo sapiens
cccacgtctctctgcctgctggg

SEQ ID NO: 2156541 - DNA, 24 bp, Homo sapiens
cccacgtctctctgcctgctgggc

SEQ ID NO: 2156542 - DNA, 20 bp, Homo sapiens
cccactaagctttctccttt

SEQ ID NO: 2156543 - DNA, 22 bp, Homo sapiens
cccactaagctttctcctttga

SEQ ID NO: 2156544 - DNA, 21 bp, Homo sapiens
cccactctaggggtcaggctc

SEQ ID NO: 2156545 - DNA, 19 bp, Homo sapiens
cccagagacctttgcccac

SEQ ID NO: 2156546 - DNA, 21 bp, Homo sapiens
cccagagacctttgcccacac

SEQ ID NO: 2156547 - DNA, 18 bp, Homo sapiens
cccagcacagctcctccc

SEQ ID NO: 2156548 - DNA, 19 bp, Homo sapiens
cccagcacagctcctcccc

SEQ ID NO: 2156549 - DNA, 14 bp, Homo sapiens
cccagccatggggt

SEQ ID NO: 2156550 - DNA, 15 bp, Homo sapiens
cccagcccaccctgc

SEQ ID NO: 2156551 - DNA, 16 bp, Homo sapiens
cccagcccaccctgct

SEQ ID NO: 2156552 - DNA, 23 bp, Homo sapiens
cccagctaatctgtagggctgga

SEQ ID NO: 2156553 - DNA, 18 bp, Homo sapiens
cccaggattgtgcaatag

SEQ ID NO: 2156554 - DNA, 23 bp, Homo sapiens
cccaggattgtgcaatagtcaga

SEQ ID NO: 2156555 - DNA, 15 bp, Homo sapiens
cccagtgacagctag

SEQ ID NO: 2156556 - DNA, 15 bp, Homo sapiens
cccatccctaccact

SEQ ID NO: 2156557 - DNA, 15 bp, Homo sapiens
cccatctcctcccat

SEQ ID NO: 2156558 - DNA, 15 bp, Homo sapiens
cccatctgtccatcc

SEQ ID NO: 2156559 - DNA, 20 bp, Homo sapiens
cccatctgtccatcctcctc

SEQ ID NO: 2156560 - DNA, 20 bp, Homo sapiens
cccatggccttccctcccca

SEQ ID NO: 2156561 - DNA, 13 bp, Homo sapiens
cccattgtggagg

SEQ ID NO: 2156562 - DNA, 23 bp, Homo sapiens
ccccaaagcagcaggcctctggt

SEQ ID NO: 2156563 - DNA, 18 bp, Homo sapiens
ccccaagaggggcgggct

SEQ ID NO: 2156564 - DNA, 13 bp, Homo sapiens
ccccaccagagct

SEQ ID NO: 2156565 - DNA, 14 bp, Homo sapiens
ccccaccagagctg

SEQ ID NO: 2156566 - DNA, 15 bp, Homo sapiens
ccccaccagagctgc

SEQ ID NO: 2156567 - DNA, 19 bp, Homo sapiens
ccccacgtctctctgcctg

SEQ ID NO: 2156568 - DNA, 20 bp, Homo sapiens
ccccacgtctctctgcctgc

SEQ ID NO: 2156569 - DNA, 21 bp, Homo sapiens
ccccacgtctctctgcctgct

SEQ ID NO: 2156570 - DNA, 22 bp, Homo sapiens
ccccacgtctctctgcctgctg

SEQ ID NO: 2156571 - DNA, 17 bp, Homo sapiens
ccccagcacagctcctc

SEQ ID NO: 2156572 - DNA, 18 bp, Homo sapiens
ccccaggattgtgcaata

SEQ ID NO: 2156573 - DNA, 15 bp, Homo sapiens
ccccagtgacagcta

SEQ ID NO: 2156574 - DNA, 18 bp, Homo sapiens
ccccatccctaccactgt

SEQ ID NO: 2156575 - DNA, 17 bp, Homo sapiens
cccccaccccagcacag

SEQ ID NO: 2156576 - DNA, 18 bp, Homo sapiens
cccccatccctaccactg

SEQ ID NO: 2156577 - DNA, 23 bp, Homo sapiens
ccccctaccgcatggcagctggg

SEQ ID NO: 2156578 - DNA, 13 bp, Homo sapiens
cccctcacagact

SEQ ID NO: 2156579 - DNA, 20 bp, Homo sapiens
cccctcacagactcttccac

SEQ ID NO: 2156580 - DNA, 23 bp, Homo sapiens
cccctcacagactcttccaccag

SEQ ID NO: 2156581 - DNA, 16 bp, Homo sapiens
cccctcaggggaagct

SEQ ID NO: 2156582 - DNA, 18 bp, Homo sapiens
cccctcaggggaagctgc

SEQ ID NO: 2156583 - DNA, 18 bp, Homo sapiens
cccctgaggatcccctgt

SEQ ID NO: 2156584 - DNA, 19 bp, Homo sapiens
cccctggctgaacagtgct

SEQ ID NO: 2156585 - DNA, 16 bp, Homo sapiens
ccccttgcccttcctg

SEQ ID NO: 2156586 - DNA, 17 bp, Homo sapiens
ccccttgtccctggggc

SEQ ID NO: 2156587 - DNA, 23 bp, Homo sapiens
cccggctgggtcggccctgccca

SEQ ID NO: 2156588 - DNA, 17 bp, Homo sapiens
cccgggaagcatcctcc

SEQ ID NO: 2156589 - DNA, 19 bp, Homo sapiens
cccgggaagcatcctcccc

SEQ ID NO: 2156590 - DNA, 17 bp, Homo sapiens
ccctaccgcatggcagc

SEQ ID NO: 2156591 - DNA, 20 bp, Homo sapiens
ccctaccgcatggcagctgg

SEQ ID NO: 2156592 - DNA, 22 bp, Homo sapiens
ccctaccgcatggcagctgggc

SEQ ID NO: 2156593 - DNA, 13 bp, Homo sapiens
ccctagatccagg

SEQ ID NO: 2156594 - DNA, 20 bp, Homo sapiens
ccctagatccaggcttctcc

SEQ ID NO: 2156595 - DNA, 22 bp, Homo sapiens
ccctcaggggaagctgctaggg

SEQ ID NO: 2156596 - DNA, 15 bp, Homo sapiens
ccctcccagtcctcc

SEQ ID NO: 2156597 - DNA, 17 bp, Homo sapiens
ccctccccacagtcctc

SEQ ID NO: 2156598 - DNA, 18 bp, Homo sapiens
ccctccccacagtcctca

SEQ ID NO: 2156599 - DNA, 14 bp, Homo sapiens
ccctccccagccct

SEQ ID NO: 2156600 - DNA, 21 bp, Homo sapiens
ccctcccccacgtctctctgc

SEQ ID NO: 2156601 - DNA, 18 bp, Homo sapiens
ccctcccctcccagtcct

SEQ ID NO: 2156602 - DNA, 12 bp, Homo sapiens
ccctcctcacac

SEQ ID NO: 2156603 - DNA, 19 bp, Homo sapiens
ccctctgcctcatcctcct

SEQ ID NO: 2156604 - DNA, 16 bp, Homo sapiens
ccctgaggatcccctg

SEQ ID NO: 2156605 - DNA, 23 bp, Homo sapiens
ccctgaggatcccctgtcccctg

SEQ ID NO: 2156606 - DNA, 23 bp, Homo sapiens
ccctgcaccagcccttccctgct

SEQ ID NO: 2156607 - DNA, 16 bp, Homo sapiens
ccctgcccctccccct

SEQ ID NO: 2156608 - DNA, 14 bp, Homo sapiens
ccctgcccctccct

SEQ ID NO: 2156609 - DNA, 19 bp, Homo sapiens
ccctgcccgaccccatctc

SEQ ID NO: 2156610 - DNA, 13 bp, Homo sapiens
ccctgccgcctcc

SEQ ID NO: 2156611 - DNA, 11 bp, Homo sapiens
ccctgcctgct

SEQ ID NO: 2156612 - DNA, 16 bp, Homo sapiens
ccctgcctgctgtgga

SEQ ID NO: 2156613 - DNA, 18 bp, Homo sapiens
ccctgctcctcctgccct

SEQ ID NO: 2156614 - DNA, 19 bp, Homo sapiens
ccctgctcctcctgccctg

SEQ ID NO: 2156615 - DNA, 21 bp, Homo sapiens
ccctggaacctttcccttgtg

SEQ ID NO: 2156616 - DNA, 22 bp, Homo sapiens
ccctggctgaacagtgctctgc

SEQ ID NO: 2156617 - DNA, 23 bp, Homo sapiens
ccctggctgaacagtgctctgcc

SEQ ID NO: 2156618 - DNA, 13 bp, Homo sapiens
ccctggggcactc

SEQ ID NO: 2156619 - DNA, 14 bp, Homo sapiens
ccctggggcactcc

SEQ ID NO: 2156620 - DNA, 17 bp, Homo sapiens
ccctgggtttggcccct

SEQ ID NO: 2156621 - DNA, 20 bp, Homo sapiens
ccctgggtttggcccctgga

SEQ ID NO: 2156622 - DNA, 18 bp, Homo sapiens
cccttcccatctcttcct

SEQ ID NO: 2156623 - DNA, 12 bp, Homo sapiens
cccttccctgct

SEQ ID NO: 2156624 - DNA, 15 bp, Homo sapiens
cccttccctgctttg

SEQ ID NO: 2156625 - DNA, 12 bp, Homo sapiens
cccttcctcatc

SEQ ID NO: 2156626 - DNA, 17 bp, Homo sapiens
cccttcctcatctgtgc

SEQ ID NO: 2156627 - DNA, 20 bp, Homo sapiens
cccttcctcatctgtgcctg

SEQ ID NO: 2156628 - DNA, 21 bp, Homo sapiens
cccttcctcatctgtgcctgt

SEQ ID NO: 2156629 - DNA, 15 bp, Homo sapiens
cccttgcccttcctg

SEQ ID NO: 2156630 - DNA, 17 bp, Homo sapiens
cccttgtccctggggca

SEQ ID NO: 2156631 - DNA, 20 bp, Homo sapiens
cccttgtgtgtaccacaccc

SEQ ID NO: 2156632 - DNA, 21 bp, Homo sapiens
cccttgtgtgtaccacaccct

SEQ ID NO: 2156633 - DNA, 13 bp, Homo sapiens
ccgacttttctaa

SEQ ID NO: 2156634 - DNA, 13 bp, Homo sapiens
ccgcagctgctgc

SEQ ID NO: 2156635 - DNA, 17 bp, Homo sapiens
ccgcagctgctgccact

SEQ ID NO: 2156636 - DNA, 13 bp, Homo sapiens
ccgcatggcagct

SEQ ID NO: 2156637 - DNA, 12 bp, Homo sapiens
ccgcctgtcaca

SEQ ID NO: 2156638 - DNA, 17 bp, Homo sapiens
ccgcctgtcacaataaa

SEQ ID NO: 2156639 - DNA, 12 bp, Homo sapiens
ccggattggccc

SEQ ID NO: 2156640 - DNA, 14 bp, Homo sapiens
ccggattggccctg

SEQ ID NO: 2156641 - DNA, 18 bp, Homo sapiens
ccggattggccctgcccc

SEQ ID NO: 2156642 - DNA, 20 bp, Homo sapiens
ccggattggccctgcccctc

SEQ ID NO: 2156643 - DNA, 21 bp, Homo sapiens
ccggattggccctgcccctcc

SEQ ID NO: 2156644 - DNA, 19 bp, Homo sapiens
ccggccctgcccctcccta

SEQ ID NO: 2156645 - DNA, 14 bp, Homo sapiens
ccgggtgccattcc

SEQ ID NO: 2156646 - DNA, 20 bp, Homo sapiens
ccgggttctagtctcctttg

SEQ ID NO: 2156647 - DNA, 23 bp, Homo sapiens
ccgtggctccagaatgtgctgcc

SEQ ID NO: 2156648 - DNA, 18 bp, Homo sapiens
ccgttctgctggcctgga

SEQ ID NO: 2156649 - DNA, 17 bp, Homo sapiens
cctaaggatctctcagg

SEQ ID NO: 2156650 - DNA, 23 bp, Homo sapiens
cctaccactgtggccccaagagg

SEQ ID NO: 2156651 - DNA, 15 bp, Homo sapiens
cctacccaaccactc

SEQ ID NO: 2156652 - DNA, 21 bp, Homo sapiens
cctaccgcatggcagctgggc

SEQ ID NO: 2156653 - DNA, 15 bp, Homo sapiens
cctagatccaggctt

SEQ ID NO: 2156654 - DNA, 20 bp, Homo sapiens
cctagatccaggcttctccc

SEQ ID NO: 2156655 - DNA, 23 bp, Homo sapiens
cctatgtcctaaggacacactaa

SEQ ID NO: 2156656 - DNA, 24 bp, Homo sapiens
cctatgtcctaaggacacactaat

SEQ ID NO: 2156657 - DNA, 12 bp, Homo sapiens
cctcacagactc

SEQ ID NO: 2156658 - DNA, 13 bp, Homo sapiens
cctcacagactct

SEQ ID NO: 2156659 - DNA, 21 bp, Homo sapiens
cctcacagactcttccaccag

SEQ ID NO: 2156660 - DNA, 14 bp, Homo sapiens
cctcacagatgctg

SEQ ID NO: 2156661 - DNA, 21 bp, Homo sapiens
cctcacagatgctggcctctt

SEQ ID NO: 2156662 - DNA, 12 bp, Homo sapiens
cctcacagcctc

SEQ ID NO: 2156663 - DNA, 18 bp, Homo sapiens
cctcacttttaatgaaca

SEQ ID NO: 2156664 - DNA, 13 bp, Homo sapiens
cctcatcctcctc

SEQ ID NO: 2156665 - DNA, 15 bp, Homo sapiens
cctcatctgtgcctg

SEQ ID NO: 2156666 - DNA, 16 bp, Homo sapiens
cctcatctgtgcctgt

SEQ ID NO: 2156667 - DNA, 15 bp, Homo sapiens
cctccagaccaccag

SEQ ID NO: 2156668 - DNA, 16 bp, Homo sapiens
cctccagaccaccagc

SEQ ID NO: 2156669 - DNA, 16 bp, Homo sapiens
cctccagtcatggtac

SEQ ID NO: 2156670 - DNA, 21 bp, Homo sapiens
cctccagtcctgctggcctgc

SEQ ID NO: 2156671 - DNA, 12 bp, Homo sapiens
cctcccatggcc

SEQ ID NO: 2156672 - DNA, 23 bp, Homo sapiens
cctccccacagtcctcacagcct

SEQ ID NO: 2156673 - DNA, 17 bp, Homo sapiens
cctccccaccagagctg

SEQ ID NO: 2156674 - DNA, 23 bp, Homo sapiens
cctccccaccagagctgcctccc

SEQ ID NO: 2156675 - DNA, 15 bp, Homo sapiens
cctcccccagagcca

SEQ ID NO: 2156676 - DNA, 14 bp, Homo sapiens
cctcccctcccagt

SEQ ID NO: 2156677 - DNA, 16 bp, Homo sapiens
cctcccctcccagtcc

SEQ ID NO: 2156678 - DNA, 20 bp, Homo sapiens
cctcccctgaggatcccctg

SEQ ID NO: 2156679 - DNA, 14 bp, Homo sapiens
cctccctagatcca

SEQ ID NO: 2156680 - DNA, 18 bp, Homo sapiens
cctccctagatccaggct

SEQ ID NO: 2156681 - DNA, 21 bp, Homo sapiens
cctcccttgagtaggccctgc

SEQ ID NO: 2156682 - DNA, 14 bp, Homo sapiens
cctcctcacactcc

SEQ ID NO: 2156683 - DNA, 15 bp, Homo sapiens
cctcctcattcagac

SEQ ID NO: 2156684 - DNA, 21 bp, Homo sapiens
catatatgtatatgtatatct

SEQ ID NO: 2156685 - DNA, 20 bp, Homo sapiens
catcagaagtaactcccact

SEQ ID NO: 2156686 - DNA, 14 bp, Homo sapiens
catccccttccccc

SEQ ID NO: 2156687 - DNA, 20 bp, Homo sapiens
catccccttcccccatccct

SEQ ID NO: 2156688 - DNA, 17 bp, Homo sapiens
catcctccccaccagag

SEQ ID NO: 2156689 - DNA, 22 bp, Homo sapiens
catcctccccaccagagctgcc

SEQ ID NO: 2156690 - DNA, 14 bp, Homo sapiens
catcctcctcctca

SEQ ID NO: 2156691 - DNA, 11 bp, Homo sapiens
catcctcctct

SEQ ID NO: 2156692 - DNA, 12 bp, Homo sapiens
catcctcctctc

SEQ ID NO: 2156693 - DNA, 15 bp, Homo sapiens
catcctcctctccat

SEQ ID NO: 2156694 - DNA, 21 bp, Homo sapiens
catcctcctctccatgcaagt

SEQ ID NO: 2156695 - DNA, 23 bp, Homo sapiens
catctcctcccatggccttccct

SEQ ID NO: 2156696 - DNA, 12 bp, Homo sapiens
catctctgagtg

SEQ ID NO: 2156697 - DNA, 15 bp, Homo sapiens
catctctgagtgtct

SEQ ID NO: 2156698 - DNA, 21 bp, Homo sapiens
catctctgagtgtctctgcct

SEQ ID NO: 2156699 - DNA, 23 bp, Homo sapiens
catctctgagtgtctctgcctgg

SEQ ID NO: 2156700 - DNA, 15 bp, Homo sapiens
catctgtccatcctc

SEQ ID NO: 2156701 - DNA, 16 bp, Homo sapiens
catctgtccatcctcc

SEQ ID NO: 2156702 - DNA, 19 bp, Homo sapiens
catctgtccatcctcctct

SEQ ID NO: 2156703 - DNA, 19 bp, Homo sapiens
catctgtgcctgtctgtcc

SEQ ID NO: 2156704 - DNA, 15 bp, Homo sapiens
catgagaagagggcc

SEQ ID NO: 2156705 - DNA, 11 bp, Homo sapiens
catgcctgagg

SEQ ID NO: 2156706 - DNA, 15 bp, Homo sapiens
catgcctgagggtgg

SEQ ID NO: 2156707 - DNA, 13 bp, Homo sapiens
catgctttctcct

SEQ ID NO: 2156708 - DNA, 16 bp, Homo sapiens
catgctttctcctttt

SEQ ID NO: 2156709 - DNA, 21 bp, Homo sapiens
catggagactcctgccctgtt

SEQ ID NO: 2156710 - DNA, 13 bp, Homo sapiens
catggcagctggg

SEQ ID NO: 2156711 - DNA, 14 bp, Homo sapiens
catggcagctgggc

SEQ ID NO: 2156712 - DNA, 19 bp, Homo sapiens
catggcagctgggcccaca

SEQ ID NO: 2156713 - DNA, 20 bp, Homo sapiens
catggcagctgggcccacag

SEQ ID NO: 2156714 - DNA, 12 bp, Homo sapiens
catggccttccc

SEQ ID NO: 2156715 - DNA, 17 bp, Homo sapiens
catggctgggggaggga

SEQ ID NO: 2156716 - DNA, 21 bp, Homo sapiens
catggctgggggagggactgc

SEQ ID NO: 2156717 - DNA, 12 bp, Homo sapiens
catgggagggat

SEQ ID NO: 2156718 - DNA, 14 bp, Homo sapiens
catgggagggatca

SEQ ID NO: 2156719 - DNA, 15 bp, Homo sapiens
catgggagggatcag

SEQ ID NO: 2156720 - DNA, 17 bp, Homo sapiens
catgggagggatcagcc

SEQ ID NO: 2156721 - DNA, 18 bp, Homo sapiens
catgggagggatcagccc

SEQ ID NO: 2156722 - DNA, 21 bp, Homo sapiens
catggggtccatccccttccc

SEQ ID NO: 2156723 - DNA, 18 bp, Homo sapiens
catgggtcctcggcccat

SEQ ID NO: 2156724 - DNA, 17 bp, Homo sapiens
catggtgtctcccaaca

SEQ ID NO: 2156725 - DNA, 14 bp, Homo sapiens
catggttgggggaa

SEQ ID NO: 2156726 - DNA, 15 bp, Homo sapiens
catgtcaaacaaata

SEQ ID NO: 2156727 - DNA, 18 bp, Homo sapiens
cattcaggtgttctcttc

SEQ ID NO: 2156728 - DNA, 22 bp, Homo sapiens
cattggatgtggagctcctgct

SEQ ID NO: 2156729 - DNA, 18 bp, Homo sapiens
cattttgaaaacccctgg

SEQ ID NO: 2156730 - DNA, 23 bp, Homo sapiens
cattttgaaaacccctggctgaa

SEQ ID NO: 2156731 - DNA, 19 bp, Homo sapiens
cattttgcattagacagat

SEQ ID NO: 2156732 - DNA, 16 bp, Homo sapiens
catttttccgtaaaaa

SEQ ID NO: 2156733 - DNA, 15 bp, Homo sapiens
ccaaagagtctctgg

SEQ ID NO: 2156734 - DNA, 18 bp, Homo sapiens
ccaaagagtctctggctc

SEQ ID NO: 2156735 - DNA, 14 bp, Homo sapiens
ccaacatgggaggg

SEQ ID NO: 2156736 - DNA, 15 bp, Homo sapiens
ccaacatgggaggga

SEQ ID NO: 2156737 - DNA, 22 bp, Homo sapiens
ccaacctgtccttactcagagc

SEQ ID NO: 2156738 - DNA, 21 bp, Homo sapiens
ccaagaggggcgggctcagag

SEQ ID NO: 2156739 - DNA, 22 bp, Homo sapiens
ccaagaggggcgggctcagagc

SEQ ID NO: 2156740 - DNA, 19 bp, Homo sapiens
ccaagccaccgcagctgct

SEQ ID NO: 2156741 - DNA, 20 bp, Homo sapiens
ccaagccaccgcagctgctg

SEQ ID NO: 2156742 - DNA, 17 bp, Homo sapiens
ccaagggcctcccacca

SEQ ID NO: 2156743 - DNA, 21 bp, Homo sapiens
ccaaggtctcacactcctcct

SEQ ID NO: 2156744 - DNA, 21 bp, Homo sapiens
ccaagtctctctgtgaataca

SEQ ID NO: 2156745 - DNA, 23 bp, Homo sapiens
ccaatccatttggcagaactgct

SEQ ID NO: 2156746 - DNA, 23 bp, Homo sapiens
ccaatcttagtttctaaccaaag

SEQ ID NO: 2156747 - DNA, 14 bp, Homo sapiens
ccacacacactcct

SEQ ID NO: 2156748 - DNA, 16 bp, Homo sapiens
ccacacacactccttc

SEQ ID NO: 2156749 - DNA, 17 bp, Homo sapiens
ccacacacactccttcc

SEQ ID NO: 2156750 - DNA, 18 bp, Homo sapiens
ccacacacactccttccc

SEQ ID NO: 2156751 - DNA, 14 bp, Homo sapiens
ccacaccccagccc

SEQ ID NO: 2156752 - DNA, 15 bp, Homo sapiens
ccacaccccagccca

SEQ ID NO: 2156753 - DNA, 17 bp, Homo sapiens
ccacactattaccatga

SEQ ID NO: 2156754 - DNA, 20 bp, Homo sapiens
ccacagcccccaccccagca

SEQ ID NO: 2156755 - DNA, 18 bp, Homo sapiens
ccacatcccaggcttcac

SEQ ID NO: 2156756 - DNA, 18 bp, Homo sapiens
ccacatggtgtctcccaa

SEQ ID NO: 2156757 - DNA, 22 bp, Homo sapiens
ccacatggtgtctcccaacatg

SEQ ID NO: 2156758 - DNA, 18 bp, Homo sapiens
ccaccaaggtctcacact

SEQ ID NO: 2156759 - DNA, 19 bp, Homo sapiens
ccaccaaggtctcacactc

SEQ ID NO: 2156760 - DNA, 22 bp, Homo sapiens
ccaccaaggtctcacactcctc

SEQ ID NO: 2156761 - DNA, 15 bp, Homo sapiens
ccaccagagactggg

SEQ ID NO: 2156762 - DNA, 22 bp, Homo sapiens
ccaccagagcaggggctgctgg

SEQ ID NO: 2156763 - DNA, 23 bp, Homo sapiens
ccaccagagcaggggctgctggg

SEQ ID NO: 2156764 - DNA, 19 bp, Homo sapiens
ccaccagagctgcctcccc

SEQ ID NO: 2156765 - DNA, 20 bp, Homo sapiens
ccaccagccgccccagcccc

SEQ ID NO: 2156766 - DNA, 17 bp, Homo sapiens
ccacccaacctgtcctt

SEQ ID NO: 2156767 - DNA, 21 bp, Homo sapiens
ccacccgttctgctggcctgg

SEQ ID NO: 2156768 - DNA, 13 bp, Homo sapiens
ccaccctgctcct

SEQ ID NO: 2156769 - DNA, 15 bp, Homo sapiens
ccaccctgctcctcc

SEQ ID NO: 2156770 - DNA, 22 bp, Homo sapiens
ccaccctgctcctcctgccctg

SEQ ID NO: 2156771 - DNA, 22 bp, Homo sapiens
ccaccctgggtttggcccctgg

SEQ ID NO: 2156772 - DNA, 12 bp, Homo sapiens
ccaccgcagctg

SEQ ID NO: 2156773 - DNA, 17 bp, Homo sapiens
ccaccgcagctgctgcc

SEQ ID NO: 2156774 - DNA, 18 bp, Homo sapiens
ccaccgcagctgctgcca

SEQ ID NO: 2156775 - DNA, 23 bp, Homo sapiens
ccacctctccaagtctctctgtg

SEQ ID NO: 2156776 - DNA, 14 bp, Homo sapiens
ccacggggaccact

SEQ ID NO: 2156777 - DNA, 20 bp, Homo sapiens
ccacggggaccactgggccc

SEQ ID NO: 2156778 - DNA, 16 bp, Homo sapiens
ccacgtaccaagccac

SEQ ID NO: 2156779 - DNA, 23 bp, Homo sapiens
ccacgtaccaagccaccgcagct

SEQ ID NO: 2156780 - DNA, 18 bp, Homo sapiens
ccacgtctctctgcctgc

SEQ ID NO: 2156781 - DNA, 19 bp, Homo sapiens
ccacgtctctctgcctgct

SEQ ID NO: 2156782 - DNA, 23 bp, Homo sapiens
ccacgtctctctgcctgctgggc

SEQ ID NO: 2156783 - DNA, 20 bp, Homo sapiens
ccactagggtcctggccctc

SEQ ID NO: 2156784 - DNA, 20 bp, Homo sapiens
ccactcaaattaatctttct

SEQ ID NO: 2156785 - DNA, 22 bp, Homo sapiens
ccactcctaatcaagagtctct

SEQ ID NO: 2156786 - DNA, 21 bp, Homo sapiens
ccactctaggggtcaggctcc

SEQ ID NO: 2156787 - DNA, 22 bp, Homo sapiens
ccactctaggggtcaggctcca

SEQ ID NO: 2156788 - DNA, 12 bp, Homo sapiens
ccactctgctgc

SEQ ID NO: 2156789 - DNA, 14 bp, Homo sapiens
ccactctgctgcct

SEQ ID NO: 2156790 - DNA, 13 bp, Homo sapiens
ccactgggcccct

SEQ ID NO: 2156791 - DNA, 19 bp, Homo sapiens
ccactgtggccccaagagg

SEQ ID NO: 2156792 - DNA, 18 bp, Homo sapiens
ccagagacctttgcccac

SEQ ID NO: 2156793 - DNA, 15 bp, Homo sapiens
ccagagcaggggctg

SEQ ID NO: 2156794 - DNA, 15 bp, Homo sapiens
cctggaacctttccc

SEQ ID NO: 2156795 - DNA, 16 bp, Homo sapiens
cctggaacctttccct

SEQ ID NO: 2156796 - DNA, 18 bp, Homo sapiens
cctggaacctttcccttg

SEQ ID NO: 2156797 - DNA, 20 bp, Homo sapiens
cctggaacctttcccttgtg

SEQ ID NO: 2156798 - DNA, 14 bp, Homo sapiens
cctggactagggcc

SEQ ID NO: 2156799 - DNA, 22 bp, Homo sapiens
cctggactagggcctcggaggc

SEQ ID NO: 2156800 - DNA, 23 bp, Homo sapiens
cctggactagggcctcggaggct

SEQ ID NO: 2156801 - DNA, 15 bp, Homo sapiens
cctggagcaggggtg

SEQ ID NO: 2156802 - DNA, 15 bp, Homo sapiens
cctggccctcttctt

SEQ ID NO: 2156803 - DNA, 20 bp, Homo sapiens
cctggctgaacagtgctctg

SEQ ID NO: 2156804 - DNA, 16 bp, Homo sapiens
cctgggcccccagaga

SEQ ID NO: 2156805 - DNA, 12 bp, Homo sapiens
cctggggcactc

SEQ ID NO: 2156806 - DNA, 17 bp, Homo sapiens
cctggggcactccccca

SEQ ID NO: 2156807 - DNA, 21 bp, Homo sapiens
cctggggctcctttctccagc

SEQ ID NO: 2156808 - DNA, 15 bp, Homo sapiens
cctggggctggtgga

SEQ ID NO: 2156809 - DNA, 22 bp, Homo sapiens
cctgtagccccagtgacagcta

SEQ ID NO: 2156810 - DNA, 11 bp, Homo sapiens
cctgtcacaat

SEQ ID NO: 2156811 - DNA, 13 bp, Homo sapiens
cctgtcccctcac

SEQ ID NO: 2156812 - DNA, 16 bp, Homo sapiens
cctgtcccctcacaga

SEQ ID NO: 2156813 - DNA, 13 bp, Homo sapiens
cctgtcccctggg

SEQ ID NO: 2156814 - DNA, 16 bp, Homo sapiens
cctgtcccctggggct

SEQ ID NO: 2156815 - DNA, 17 bp, Homo sapiens
cctgtccttactcagag

SEQ ID NO: 2156816 - DNA, 19 bp, Homo sapiens
cctgtccttactcagagct

SEQ ID NO: 2156817 - DNA, 21 bp, Homo sapiens
cctgtccttactcagagctgc

SEQ ID NO: 2156818 - DNA, 16 bp, Homo sapiens
cctgtcgattagactg

SEQ ID NO: 2156819 - DNA, 22 bp, Homo sapiens
cctgtcgattagactggacagc

SEQ ID NO: 2156820 - DNA, 13 bp, Homo sapiens
cctgtctgtccaa

SEQ ID NO: 2156821 - DNA, 14 bp, Homo sapiens
cctgtgggagcctg

SEQ ID NO: 2156822 - DNA, 11 bp, Homo sapiens
cctgtgtctta

SEQ ID NO: 2156823 - DNA, 15 bp, Homo sapiens
cctgttacccagaga

SEQ ID NO: 2156824 - DNA, 17 bp, Homo sapiens
cctgtttaaaaaaagta

SEQ ID NO: 2156825 - DNA, 14 bp, Homo sapiens
ccttactcagagct

SEQ ID NO: 2156826 - DNA, 16 bp, Homo sapiens
ccttactcagagctgc

SEQ ID NO: 2156827 - DNA, 15 bp, Homo sapiens
ccttcccatctcttc

SEQ ID NO: 2156828 - DNA, 18 bp, Homo sapiens
ccttcccccatccctacc

SEQ ID NO: 2156829 - DNA, 18 bp, Homo sapiens
ccttcctcatctgtgcct

SEQ ID NO: 2156830 - DNA, 23 bp, Homo sapiens
ccttcctcatctgtgcctgtctg

SEQ ID NO: 2156831 - DNA, 13 bp, Homo sapiens
ccttctcccagca

SEQ ID NO: 2156832 - DNA, 14 bp, Homo sapiens
ccttcttcacccag

SEQ ID NO: 2156833 - DNA, 19 bp, Homo sapiens
ccttcttcacccagctaat

SEQ ID NO: 2156834 - DNA, 18 bp, Homo sapiens
ccttgcccttcctgaccc

SEQ ID NO: 2156835 - DNA, 19 bp, Homo sapiens
ccttgcccttcctgacccg

SEQ ID NO: 2156836 - DNA, 20 bp, Homo sapiens
ccttgcctgaactccagagg

SEQ ID NO: 2156837 - DNA, 13 bp, Homo sapiens
cctttctccagcc

SEQ ID NO: 2156838 - DNA, 14 bp, Homo sapiens
cctttgcactgagg

SEQ ID NO: 2156839 - DNA, 17 bp, Homo sapiens
cctttgcactgagggcc

SEQ ID NO: 2156840 - DNA, 20 bp, Homo sapiens
cctttgcccacacacactcc

SEQ ID NO: 2156841 - DNA, 16 bp, Homo sapiens
cctttttctacctttt

SEQ ID NO: 2156842 - DNA, 20 bp, Homo sapiens
cgaaacctgtccataaagta

SEQ ID NO: 2156843 - DNA, 15 bp, Homo sapiens
cgaactgtgctccca

SEQ ID NO: 2156844 - DNA, 20 bp, Homo sapiens
cgaactgtgctcccacgggg

SEQ ID NO: 2156845 - DNA, 12 bp, Homo sapiens
cgaatgacactg

SEQ ID NO: 2156846 - DNA, 13 bp, Homo sapiens
cgaatgacactgt

SEQ ID NO: 2156847 - DNA, 13 bp, Homo sapiens
cgaccccatctca

SEQ ID NO: 2156848 - DNA, 18 bp, Homo sapiens
cgactttgagctggaaag

SEQ ID NO: 2156849 - DNA, 14 bp, Homo sapiens
cgagccgggcctgg

SEQ ID NO: 2156850 - DNA, 11 bp, Homo sapiens
cgcagctgctg

SEQ ID NO: 2156851 - DNA, 23 bp, Homo sapiens
cgcagctgctgccactctgctgc

SEQ ID NO: 2156852 - DNA, 12 bp, Homo sapiens
cgcatggcagct

SEQ ID NO: 2156853 - DNA, 16 bp, Homo sapiens
cgcatggcagctgggc

SEQ ID NO: 2156854 - DNA, 18 bp, Homo sapiens
cgcatggcagctgggccc

SEQ ID NO: 2156855 - DNA, 22 bp, Homo sapiens
cgcatggcagctgggcccacag

SEQ ID NO: 2156856 - DNA, 21 bp, Homo sapiens
cgccccagatcaccagcccgg

SEQ ID NO: 2156857 - DNA, 18 bp, Homo sapiens
cgcctgtcacaataaagt

SEQ ID NO: 2156858 - DNA, 16 bp, Homo sapiens
cgcctgtcccctcaca

SEQ ID NO: 2156859 - DNA, 21 bp, Homo sapiens
cggaatcctgtcgattagact

SEQ ID NO: 2156860 - DNA, 15 bp, Homo sapiens
cggaggctcctccct

SEQ ID NO: 2156861 - DNA, 22 bp, Homo sapiens
cggcccatctgtccatcctcct

SEQ ID NO: 2156862 - DNA, 14 bp, Homo sapiens
cggattggccctgc

SEQ ID NO: 2156863 - DNA, 19 bp, Homo sapiens
cggattggccctgcccctc

SEQ ID NO: 2156864 - DNA, 16 bp, Homo sapiens
cggcccatctgtccat

SEQ ID NO: 2156865 - DNA, 13 bp, Homo sapiens
gtctgtccaaccc

SEQ ID NO: 2156866 - DNA, 17 bp, Homo sapiens
gtctgtccaacccctcc

SEQ ID NO: 2156867 - DNA, 22 bp, Homo sapiens
gtctgtccaacccctcccccac

SEQ ID NO: 2156868 - DNA, 18 bp, Homo sapiens
gtgacgtgactcagagct

SEQ ID NO: 2156869 - DNA, 19 bp, Homo sapiens
gtgaggccggccctgcccc

SEQ ID NO: 2156870 - DNA, 18 bp, Homo sapiens
gtgccctgacccctgcac

SEQ ID NO: 2156871 - DNA, 15 bp, Homo sapiens
gtgcctgtctgtcca

SEQ ID NO: 2156872 - DNA, 18 bp, Homo sapiens
gtgctctgcctctaactc

SEQ ID NO: 2156873 - DNA, 17 bp, Homo sapiens
gtgctgtttgggcagga

SEQ ID NO: 2156874 - DNA, 23 bp, Homo sapiens
gtggctccagaatgtgctgcctt

SEQ ID NO: 2156875 - DNA, 20 bp, Homo sapiens
gtggtttctacggtgacagt

SEQ ID NO: 2156876 - DNA, 18 bp, Homo sapiens
gtgtaattgagaaggaaa

SEQ ID NO: 2156877 - DNA, 13 bp, Homo sapiens
gtgtctcccaaca

SEQ ID NO: 2156878 - DNA, 16 bp, Homo sapiens
gttaagacttgacagt

SEQ ID NO: 2156879 - DNA, 19 bp, Homo sapiens
gttaattgattaaaatctg

SEQ ID NO: 2156880 - DNA, 19 bp, Homo sapiens
gttatagtatatctggaca

SEQ ID NO: 2156881 - DNA, 18 bp, Homo sapiens
gttatctaagttaattta

SEQ ID NO: 2156882 - DNA, 11 bp, Homo sapiens
gttatttaaat

SEQ ID NO: 2156883 - DNA, 15 bp, Homo sapiens
gttccatgcctgagg

SEQ ID NO: 2156884 - DNA, 14 bp, Homo sapiens
gttctagtctcctt

SEQ ID NO: 2156885 - DNA, 23 bp, Homo sapiens
gttctagtctcctttgcactgag

SEQ ID NO: 2156886 - DNA, 23 bp, Homo sapiens
gttgagaacaaaaattgggtttt

SEQ ID NO: 2156887 - DNA, 12 bp, Homo sapiens
gttgcctccccc

SEQ ID NO: 2156888 - DNA, 15 bp, Homo sapiens
gttgtcaatattaaa

SEQ ID NO: 2156889 - DNA, 16 bp, Homo sapiens
gttgtcaatattaaat

SEQ ID NO: 2156890 - DNA, 14 bp, Homo sapiens
gttgtgtatagatg

SEQ ID NO: 2156891 - DNA, 13 bp, Homo sapiens
gttgtttgtgcct

SEQ ID NO: 2156892 - DNA, 14 bp, Homo sapiens
gtttaaaaaaagta

SEQ ID NO: 2156893 - DNA, 17 bp, Homo sapiens
gtttaaaaaaagtatat

SEQ ID NO: 2156894 - DNA, 11 bp, Homo sapiens
gtttgcacaga

SEQ ID NO: 2156895 - DNA, 22 bp, Homo sapiens
gtttgcacagagggcgctcctg

SEQ ID NO: 2156896 - DNA, 15 bp, Homo sapiens
gtttgttcacactcc

SEQ ID NO: 2156897 - DNA, 16 bp, Homo sapiens
gtttttcggacagttt

SEQ ID NO: 2156898 - DNA, 21 bp, Homo sapiens
taaaaactgagtgactctata

SEQ ID NO: 2156899 - DNA, 14 bp, Homo sapiens
taaaaagattatat

SEQ ID NO: 2156900 - DNA, 16 bp, Homo sapiens
taaacagatataaatg

SEQ ID NO: 2156901 - DNA, 15 bp, Homo sapiens
taaagacttcatgtt

SEQ ID NO: 2156902 - DNA, 22 bp, Homo sapiens
taaaggtatttagaatatatta

SEQ ID NO: 2156903 - DNA, 15 bp, Homo sapiens
taaagtaattttgtg

SEQ ID NO: 2156904 - DNA, 15 bp, Homo sapiens
taacaagccagattt

SEQ ID NO: 2156905 - DNA, 18 bp, Homo sapiens
taaccaaagagtctctgg

SEQ ID NO: 2156906 - DNA, 12 bp, Homo sapiens
taacggctccag

SEQ ID NO: 2156907 - DNA, 13 bp, Homo sapiens
taacggctccagg

SEQ ID NO: 2156908 - DNA, 14 bp, Homo sapiens
taactcccactcct

SEQ ID NO: 2156909 - DNA, 15 bp, Homo sapiens
taactcccactccta

SEQ ID NO: 2156910 - DNA, 16 bp, Homo sapiens
taactcccactcctaa

SEQ ID NO: 2156911 - DNA, 11 bp, Homo sapiens
taactccctcc

SEQ ID NO: 2156912 - DNA, 12 bp, Homo sapiens
taactccctcct

SEQ ID NO: 2156913 - DNA, 13 bp, Homo sapiens
taactccctcctc

SEQ ID NO: 2156914 - DNA, 15 bp, Homo sapiens
taactccctcctcac

SEQ ID NO: 2156915 - DNA, 14 bp, Homo sapiens
taagacttgacagt

SEQ ID NO: 2156916 - DNA, 17 bp, Homo sapiens
taagacttgacagtgga

SEQ ID NO: 2156917 - DNA, 20 bp, Homo sapiens
taagccctgtcgagacactt

SEQ ID NO: 2156918 - DNA, 15 bp, Homo sapiens
taaggacacactaat

SEQ ID NO: 2156919 - DNA, 16 bp, Homo sapiens
taaggatctctcagga

SEQ ID NO: 2156920 - DNA, 13 bp, Homo sapiens
taagtcagaacag

SEQ ID NO: 2156921 - DNA, 20 bp, Homo sapiens
taagtggggttgcaaccact

SEQ ID NO: 2156922 - DNA, 24 bp, Homo sapiens
taagttttgtttgttcacactcct

SEQ ID NO: 2156923 - DNA, 17 bp, Homo sapiens
taatatctgagaagtgt

SEQ ID NO: 2156924 - DNA, 18 bp, Homo sapiens
taatctttctttacctga

SEQ ID NO: 2156925 - DNA, 21 bp, Homo sapiens
taatctttctttacctgagac

SEQ ID NO: 2156926 - DNA, 13 bp, Homo sapiens
taatgaacaaatg

SEQ ID NO: 2156927 - DNA, 14 bp, Homo sapiens
taatgaacaaatgg

SEQ ID NO: 2156928 - DNA, 22 bp, Homo sapiens
tacaattaaaggtcctgccctc

SEQ ID NO: 2156929 - DNA, 15 bp, Homo sapiens
tacacatatatgtat

SEQ ID NO: 2156930 - DNA, 17 bp, Homo sapiens
tacacatatatgtatat

SEQ ID NO: 2156931 - DNA, 18 bp, Homo sapiens
tacaccacctcactcctg

SEQ ID NO: 2156932 - DNA, 19 bp, Homo sapiens
tacaccacctcactcctgt

SEQ ID NO: 2156933 - DNA, 14 bp, Homo sapiens
tacagacactaagt

SEQ ID NO: 2156934 - DNA, 17 bp, Homo sapiens
acactcctcctgccagc

SEQ ID NO: 2156935 - DNA, 20 bp, Homo sapiens
acactcctcctgccagctct

SEQ ID NO: 2156936 - DNA, 21 bp, Homo sapiens
acactcctcctgccagctctg

SEQ ID NO: 2156937 - DNA, 22 bp, Homo sapiens
acactcctcctgccagctctgt

SEQ ID NO: 2156938 - DNA, 21 bp, Homo sapiens
acactccttccccttgtccct

SEQ ID NO: 2156939 - DNA, 22 bp, Homo sapiens
acactccttccccttgtccctg

SEQ ID NO: 2156940 - DNA, 14 bp, Homo sapiens
acactgagccccac

SEQ ID NO: 2156941 - DNA, 21 bp, Homo sapiens
acactggtgggcagctgagga

SEQ ID NO: 2156942 - DNA, 15 bp, Homo sapiens
acagactcttccacc

SEQ ID NO: 2156943 - DNA, 13 bp, Homo sapiens
acagcagactcag

SEQ ID NO: 2156944 - DNA, 13 bp, Homo sapiens
acagcccccaccc

SEQ ID NO: 2156945 - DNA, 20 bp, Homo sapiens
acagctcctcccctgccgcc

SEQ ID NO: 2156946 - DNA, 16 bp, Homo sapiens
acagtcctcacagcct

SEQ ID NO: 2156947 - DNA, 18 bp, Homo sapiens
acagtcctcacagcctct

SEQ ID NO: 2156948 - DNA, 22 bp, Homo sapiens
acagtcctcacagcctctccct

SEQ ID NO: 2156949 - DNA, 22 bp, Homo sapiens
acagtgacgtgactcagagctt

SEQ ID NO: 2156950 - DNA, 16 bp, Homo sapiens
acagtgctctgcctct

SEQ ID NO: 2156951 - DNA, 15 bp, Homo sapiens
acagttatctaagtt

SEQ ID NO: 2156952 - DNA, 16 bp, Homo sapiens
acagttatctaagtta

SEQ ID NO: 2156953 - DNA, 17 bp, Homo sapiens
acagttatctaagttaa

SEQ ID NO: 2156954 - DNA, 15 bp, Homo sapiens
acagtttatttgttg

SEQ ID NO: 2156955 - DNA, 13 bp, Homo sapiens
acatatatgtata

SEQ ID NO: 2156956 - DNA, 22 bp, Homo sapiens
acatcagaagtaactcccactc

SEQ ID NO: 2156957 - DNA, 22 bp, Homo sapiens
acatggagactcctgccctgtt

SEQ ID NO: 2156958 - DNA, 13 bp, Homo sapiens
acatggctggggg

SEQ ID NO: 2156959 - DNA, 14 bp, Homo sapiens
acatggtgtctccc

SEQ ID NO: 2156960 - DNA, 16 bp, Homo sapiens
acatggtgtctcccaa

SEQ ID NO: 2156961 - DNA, 22 bp, Homo sapiens
acatggtgtctcccaacatggg

SEQ ID NO: 2156962 - DNA, 14 bp, Homo sapiens
acatggttggggga

SEQ ID NO: 2156963 - DNA, 15 bp, Homo sapiens
acattaactcattag

SEQ ID NO: 2156964 - DNA, 13 bp, Homo sapiens
acattcaaggcat

SEQ ID NO: 2156965 - DNA, 15 bp, Homo sapiens
acattcctctgcagc

SEQ ID NO: 2156966 - DNA, 20 bp, Homo sapiens
acattttgtacaaagatatg

SEQ ID NO: 2156967 - DNA, 21 bp, Homo sapiens
accaaaagttacatgtttgca

SEQ ID NO: 2156968 - DNA, 23 bp, Homo sapiens
accaaaagttacatgtttgcacc

SEQ ID NO: 2156969 - DNA, 19 bp, Homo sapiens
accaaagagtctctggctc

SEQ ID NO: 2156970 - DNA, 19 bp, Homo sapiens
accaagccaccgcagctgc

SEQ ID NO: 2156971 - DNA, 20 bp, Homo sapiens
accaagccaccgcagctgct

SEQ ID NO: 2156972 - DNA, 21 bp, Homo sapiens
accaagccaccgcagctgctg

SEQ ID NO: 2156973 - DNA, 14 bp, Homo sapiens
accacaccctgcct

SEQ ID NO: 2156974 - DNA, 16 bp, Homo sapiens
accacaccctgcctgc

SEQ ID NO: 2156975 - DNA, 18 bp, Homo sapiens
accacaccctgcctgctg

SEQ ID NO: 2156976 - DNA, 21 bp, Homo sapiens
accacaccctgcctgctgtgg

SEQ ID NO: 2156977 - DNA, 21 bp, Homo sapiens
accactagggtcctggccctc

SEQ ID NO: 2156978 - DNA, 12 bp, Homo sapiens
accactgggccc

SEQ ID NO: 2156979 - DNA, 15 bp, Homo sapiens
accactgggcccctc

SEQ ID NO: 2156980 - DNA, 17 bp, Homo sapiens
accactgggcccctcag

SEQ ID NO: 2156981 - DNA, 19 bp, Homo sapiens
accactgggcccctcaggg

SEQ ID NO: 2156982 - DNA, 16 bp, Homo sapiens
accagagcaggggctg

SEQ ID NO: 2156983 - DNA, 16 bp, Homo sapiens
accagagctgcctccc

SEQ ID NO: 2156984 - DNA, 17 bp, Homo sapiens
accagcccttccctgct

SEQ ID NO: 2156985 - DNA, 15 bp, Homo sapiens
accagccgccccagc

SEQ ID NO: 2156986 - DNA, 16 bp, Homo sapiens
accaggcacatggctg

SEQ ID NO: 2156987 - DNA, 20 bp, Homo sapiens
accagttgggagcactggag

SEQ ID NO: 2156988 - DNA, 13 bp, Homo sapiens
acccaacctgtcc

SEQ ID NO: 2156989 - DNA, 22 bp, Homo sapiens
acccaacctgtccttactcaga

SEQ ID NO: 2156990 - DNA, 14 bp, Homo sapiens
acccagagaatata

SEQ ID NO: 2156991 - DNA, 18 bp, Homo sapiens
acccagagaatatataca

SEQ ID NO: 2156992 - DNA, 21 bp, Homo sapiens
acccaggaagggagggagctg

SEQ ID NO: 2156993 - DNA, 15 bp, Homo sapiens
accccacaccccagc

SEQ ID NO: 2156994 - DNA, 19 bp, Homo sapiens
accccacaccccagcccac

SEQ ID NO: 2156995 - DNA, 15 bp, Homo sapiens
accccagcacagctc

SEQ ID NO: 2156996 - DNA, 18 bp, Homo sapiens
accccagcacagctcctc

SEQ ID NO: 2156997 - DNA, 22 bp, Homo sapiens
accccagcacagctcctcccct

SEQ ID NO: 2156998 - DNA, 11 bp, Homo sapiens
accccagccca

SEQ ID NO: 2156999 - DNA, 12 bp, Homo sapiens
accccagcccac

SEQ ID NO: 2157000 - DNA, 11 bp, Homo sapiens
acccctccccc

SEQ ID NO: 2157001 - DNA, 14 bp, Homo sapiens
acccctcccccacg

SEQ ID NO: 2157002 - DNA, 15 bp, Homo sapiens
acccctcccccacgt

SEQ ID NO: 2157003 - DNA, 21 bp, Homo sapiens
acccctcccccacgtctctct

SEQ ID NO: 2157004 - DNA, 22 bp, Homo sapiens
acccctcccccacgtctctctg

SEQ ID NO: 2157005 - DNA, 23 bp, Homo sapiens
acccctggctgaacagtgctctg

SEQ ID NO: 2157006 - DNA, 20 bp, Homo sapiens
acccggattggccctgcccc

SEQ ID NO: 2157007 - DNA, 22 bp, Homo sapiens
acccggattggccctgcccctc

SEQ ID NO: 2157008 - DNA, 22 bp, Homo sapiens
acccggctgggtcggccctgcc

SEQ ID NO: 2157009 - DNA, 22 bp, Homo sapiens
accctgaatggttccatgcctg

SEQ ID NO: 2157010 - DNA, 17 bp, Homo sapiens
accctgcctgctgtgga

SEQ ID NO: 2157011 - DNA, 14 bp, Homo sapiens
accctgctcctcct

SEQ ID NO: 2157012 - DNA, 15 bp, Homo sapiens
accctgctcctcctg

SEQ ID NO: 2157013 - DNA, 18 bp, Homo sapiens
accctgctcctcctgccc

SEQ ID NO: 2157014 - DNA, 19 bp, Homo sapiens
accctgggtttggcccctg

SEQ ID NO: 2157015 - DNA, 11 bp, Homo sapiens
acccttcctca

SEQ ID NO: 2157016 - DNA, 24 bp, Homo sapiens
acccttcctcatctgtgcctgtct

SEQ ID NO: 2157017 - DNA, 17 bp, Homo sapiens
accgcagctgctgccac

SEQ ID NO: 2157018 - DNA, 14 bp, Homo sapiens
accgcatggcagct

SEQ ID NO: 2157019 - DNA, 15 bp, Homo sapiens
accgcatggcagctg

SEQ ID NO: 2157020 - DNA, 16 bp, Homo sapiens
accgcatggcagctgg

SEQ ID NO: 2157021 - DNA, 18 bp, Homo sapiens
accgcatggcagctgggc

SEQ ID NO: 2157022 - DNA, 20 bp, Homo sapiens
accgcatggcagctgggccc

SEQ ID NO: 2157023 - DNA, 23 bp, Homo sapiens
acctatgtcctaaggacacacta

SEQ ID NO: 2157024 - DNA, 11 bp, Homo sapiens
acctccagtcc

SEQ ID NO: 2157025 - DNA, 12 bp, Homo sapiens
acctccagtcct

SEQ ID NO: 2157026 - DNA, 18 bp, Homo sapiens
acctccagtcctgctggc

SEQ ID NO: 2157027 - DNA, 20 bp, Homo sapiens
acctccagtcctgctggcct

SEQ ID NO: 2157028 - DNA, 23 bp, Homo sapiens
acctccagtcctgctggcctgct

SEQ ID NO: 2157029 - DNA, 12 bp, Homo sapiens
acctccccaaag

SEQ ID NO: 2157030 - DNA, 23 bp, Homo sapiens
acctggaagcatttgtttctact

SEQ ID NO: 2157031 - DNA, 15 bp, Homo sapiens
acctggactagggcc

SEQ ID NO: 2157032 - DNA, 19 bp, Homo sapiens
acctggtactgcacatttt

SEQ ID NO: 2157033 - DNA, 15 bp, Homo sapiens
acctgtccataaagt

SEQ ID NO: 2157034 - DNA, 16 bp, Homo sapiens
acctgtccataaagta

SEQ ID NO: 2157035 - DNA, 17 bp, Homo sapiens
acctgtccttactcaga

SEQ ID NO: 2157036 - DNA, 15 bp, Homo sapiens
acctttctagttgaa

SEQ ID NO: 2157037 - DNA, 18 bp, Homo sapiens
acctttttttctctccta

SEQ ID NO: 2157038 - DNA, 16 bp, Homo sapiens
acggggaccactgggc

SEQ ID NO: 2157039 - DNA, 22 bp, Homo sapiens
acggggaccactgggcccctca

SEQ ID NO: 2157040 - DNA, 23 bp, Homo sapiens
acggggaccactgggcccctcag

SEQ ID NO: 2157041 - DNA, 23 bp, Homo sapiens
acggtgacagtgacgtgactcag

SEQ ID NO: 2157042 - DNA, 23 bp, Homo sapiens
acgtaccaagccaccgcagctgc

SEQ ID NO: 2157043 - DNA, 14 bp, Homo sapiens
acgtctctctgcct

SEQ ID NO: 2157044 - DNA, 20 bp, Homo sapiens
acgtctctctgcctgctggg

SEQ ID NO: 2157045 - DNA, 21 bp, Homo sapiens
ttgtgccatgtcaaacaaata

SEQ ID NO: 2157046 - DNA, 18 bp, Homo sapiens
ttgtggcaagtgaatttg

SEQ ID NO: 2157047 - DNA, 22 bp, Homo sapiens
ttgtgtgtaccacaccctgcct

SEQ ID NO: 2157048 - DNA, 13 bp, Homo sapiens
ttgtttgcacaga

SEQ ID NO: 2157049 - DNA, 14 bp, Homo sapiens
ttgtttgcacagag

SEQ ID NO: 2157050 - DNA, 17 bp, Homo sapiens
tttaaaatttatattgt

SEQ ID NO: 2157051 - DNA, 20 bp, Homo sapiens
tttaaaatttatattgtaaa

SEQ ID NO: 2157052 - DNA, 17 bp, Homo sapiens
tttaaagttgtttgtgc

SEQ ID NO: 2157053 - DNA, 21 bp, Homo sapiens
tttaatatctgagaagtgtat

SEQ ID NO: 2157054 - DNA, 23 bp, Homo sapiens
tttaatatctgagaagtgtatat

SEQ ID NO: 2157055 - DNA, 15 bp, Homo sapiens
tttaatgaacaaatg

SEQ ID NO: 2157056 - DNA, 16 bp, Homo sapiens
tttacctgagaccagt

SEQ ID NO: 2157057 - DNA, 15 bp, Homo sapiens
tttactgacagaaat

SEQ ID NO: 2157058 - DNA, 14 bp, Homo sapiens
tttagaatatatta

SEQ ID NO: 2157059 - DNA, 13 bp, Homo sapiens
tttaggagcagtg

SEQ ID NO: 2157060 - DNA, 19 bp, Homo sapiens
tttatattgtaaatattgt

SEQ ID NO: 2157061 - DNA, 13 bp, Homo sapiens
tttattaaaaact

SEQ ID NO: 2157062 - DNA, 13 bp, Homo sapiens
tttattactgatt

SEQ ID NO: 2157063 - DNA, 12 bp, Homo sapiens
tttatttgttga

SEQ ID NO: 2157064 - DNA, 18 bp, Homo sapiens
tttatttgttgagagtgt

SEQ ID NO: 2157065 - DNA, 23 bp, Homo sapiens
tttcagaattgaaggagaaaatg

SEQ ID NO: 2157066 - DNA, 19 bp, Homo sapiens
tttctaaagctctgaacaa

SEQ ID NO: 2157067 - DNA, 17 bp, Homo sapiens
tttctaggtaggaaatg

SEQ ID NO: 2157068 - DNA, 21 bp, Homo sapiens
tttctaggtaggaaatgtggt

SEQ ID NO: 2157069 - DNA, 13 bp, Homo sapiens
tttctagttgaaa

SEQ ID NO: 2157070 - DNA, 16 bp, Homo sapiens
tttgcacagagggcgc

SEQ ID NO: 2157071 - DNA, 16 bp, Homo sapiens
tttgcacctttctagt

SEQ ID NO: 2157072 - DNA, 19 bp, Homo sapiens
tttggatgggagtgagaca

SEQ ID NO: 2157073 - DNA, 20 bp, Homo sapiens
tttggcagaactgctggggc

SEQ ID NO: 2157074 - DNA, 23 bp, Homo sapiens
tttgggcaggagtcaccatgcaa

SEQ ID NO: 2157075 - DNA, 23 bp, Homo sapiens
tttgtcacttgccacatggtgtc

SEQ ID NO: 2157076 - DNA, 20 bp, Homo sapiens
ttttaacaaaagcaagactg

SEQ ID NO: 2157077 - DNA, 14 bp, Homo sapiens
ttttactgacagaa

SEQ ID NO: 2157078 - DNA, 17 bp, Homo sapiens
ttttatttccacataaa

SEQ ID NO: 2157079 - DNA, 21 bp, Homo sapiens
ttttcgaactgtgctcccacg

SEQ ID NO: 2157080 - DNA, 16 bp, Homo sapiens
ttttgcaggggactgg

SEQ ID NO: 2157081 - DNA, 22 bp, Homo sapiens
ttttgcaggggactgggccatg

SEQ ID NO: 2157082 - DNA, 14 bp, Homo sapiens
tttttccgtaaaaa

SEQ ID NO: 2157083 - DNA, 16 bp, Homo sapiens
tttttccgtaaaaatg

SEQ ID NO: 2157084 - DNA, 18 bp, Homo sapiens
tttttggttgtcaatatt

SEQ ID NO: 2157085 - DNA, 14 bp, Homo sapiens
tttttgtgaaattc

SEQ ID NO: 2157086 - DNA, 13 bp, Homo sapiens
ttttttatttcca

SEQ ID NO: 2157087 - DNA, 16 bp, Homo sapiens
tccaccagagcagggg

SEQ ID NO: 2157088 - DNA, 19 bp, Homo sapiens
tccaccagagcaggggctg

SEQ ID NO: 2157089 - DNA, 16 bp, Homo sapiens
tccactgccaaaacaa

SEQ ID NO: 2157090 - DNA, 16 bp, Homo sapiens
tccagaagaatattca

SEQ ID NO: 2157091 - DNA, 18 bp, Homo sapiens
tccagaagaatattcagg

SEQ ID NO: 2157092 - DNA, 22 bp, Homo sapiens
tccagaagaatattcaggactt

SEQ ID NO: 2157093 - DNA, 16 bp, Homo sapiens
tccagaatgtgctgcc

SEQ ID NO: 2157094 - DNA, 17 bp, Homo sapiens
tccagaatgtgctgcct

SEQ ID NO: 2157095 - DNA, 22 bp, Homo sapiens
tccagaggtgtcgggacatggt

SEQ ID NO: 2157096 - DNA, 19 bp, Homo sapiens
tccagccatcaagagactg

SEQ ID NO: 2157097 - DNA, 24 bp, Homo sapiens
tccagccatcaagagactgagtca

SEQ ID NO: 2157098 - DNA, 14 bp, Homo sapiens
tccagcctcacaga

SEQ ID NO: 2157099 - DNA, 21 bp, Homo sapiens
tccagcctcacagatgctggc

SEQ ID NO: 2157100 - DNA, 22 bp, Homo sapiens
tccagcctcacagatgctggcc

SEQ ID NO: 2157101 - DNA, 14 bp, Homo sapiens
tccaggcttctccc

SEQ ID NO: 2157102 - DNA, 20 bp, Homo sapiens
tccaggcttctcccggacct

SEQ ID NO: 2157103 - DNA, 13 bp, Homo sapiens
tccagtcctgctg

SEQ ID NO: 2157104 - DNA, 22 bp, Homo sapiens
tccagtcctgctggcctgctct

SEQ ID NO: 2157105 - DNA, 13 bp, Homo sapiens
tccagtttccaaa

SEQ ID NO: 2157106 - DNA, 21 bp, Homo sapiens
tccataaagtaattttgtgaa

SEQ ID NO: 2157107 - DNA, 15 bp, Homo sapiens
tccatcctcctctcc

SEQ ID NO: 2157108 - DNA, 16 bp, Homo sapiens
tccatgcaagtgctgt

SEQ ID NO: 2157109 - DNA, 15 bp, Homo sapiens
tccatgcctgagggt

SEQ ID NO: 2157110 - DNA, 16 bp, Homo sapiens
tccatgcctgagggtg

SEQ ID NO: 2157111 - DNA, 14 bp, Homo sapiens
tccattaggatttg

SEQ ID NO: 2157112 - DNA, 19 bp, Homo sapiens
tccatttggcagaactgct

SEQ ID NO: 2157113 - DNA, 20 bp, Homo sapiens
tcccaacatgggagggatca

SEQ ID NO: 2157114 - DNA, 21 bp, Homo sapiens
tcccaacatgggagggatcag

SEQ ID NO: 2157115 - DNA, 20 bp, Homo sapiens
tcccaagtagtagtgtcttc

SEQ ID NO: 2157116 - DNA, 19 bp, Homo sapiens
tcccacccaattcaaaaca

SEQ ID NO: 2157117 - DNA, 15 bp, Homo sapiens
tcccaggcttcaccc

SEQ ID NO: 2157118 - DNA, 18 bp, Homo sapiens
tcccaggcttcaccctga

SEQ ID NO: 2157119 - DNA, 15 bp, Homo sapiens
tcccagtcctccaga

SEQ ID NO: 2157120 - DNA, 23 bp, Homo sapiens
tccccaatccatttggcagaact

SEQ ID NO: 2157121 - DNA, 23 bp, Homo sapiens
tccccacagtcctcacagcctct

SEQ ID NO: 2157122 - DNA, 14 bp, Homo sapiens
tccccaccagagct

SEQ ID NO: 2157123 - DNA, 23 bp, Homo sapiens
tcccccacgtctctctgcctgct

SEQ ID NO: 2157124 - DNA, 15 bp, Homo sapiens
tcccccagagccact

SEQ ID NO: 2157125 - DNA, 14 bp, Homo sapiens
tcccctcacagact

SEQ ID NO: 2157126 - DNA, 13 bp, Homo sapiens
tcccctcccagtc

SEQ ID NO: 2157127 - DNA, 16 bp, Homo sapiens
tcccctgccgcctccc

SEQ ID NO: 2157128 - DNA, 19 bp, Homo sapiens
tcccctgccgcctcccggg

SEQ ID NO: 2157129 - DNA, 21 bp, Homo sapiens
tcccctgtcccctggggctgg

SEQ ID NO: 2157130 - DNA, 17 bp, Homo sapiens
tccccttgcccttcctg

SEQ ID NO: 2157131 - DNA, 18 bp, Homo sapiens
tccccttgcccttcctga

SEQ ID NO: 2157132 - DNA, 21 bp, Homo sapiens
tccccttgcccttcctgaccc

SEQ ID NO: 2157133 - DNA, 16 bp, Homo sapiens
tccccttgtccctggg

SEQ ID NO: 2157134 - DNA, 16 bp, Homo sapiens
tcccgggaagcatcct

SEQ ID NO: 2157135 - DNA, 22 bp, Homo sapiens
tcccgggaagcatcctccccac

SEQ ID NO: 2157136 - DNA, 18 bp, Homo sapiens
tccctagcctgcttttgt

SEQ ID NO: 2157137 - DNA, 12 bp, Homo sapiens
tccctcctcaca

SEQ ID NO: 2157138 - DNA, 17 bp, Homo sapiens
tccctcctcacactcca

SEQ ID NO: 2157139 - DNA, 12 bp, Homo sapiens
tccctctgcctc

SEQ ID NO: 2157140 - DNA, 13 bp, Homo sapiens
tccctctgcctca

SEQ ID NO: 2157141 - DNA, 15 bp, Homo sapiens
tccctctgcctcatc

SEQ ID NO: 2157142 - DNA, 16 bp, Homo sapiens
tccctctgcctcatcc

SEQ ID NO: 2157143 - DNA, 17 bp, Homo sapiens
tccctctgcctcatcct

SEQ ID NO: 2157144 - DNA, 21 bp, Homo sapiens
tccctggggcactcccccagg

SEQ ID NO: 2157145 - DNA, 19 bp, Homo sapiens
tcccttgagtaggccctgc

SEQ ID NO: 2157146 - DNA, 16 bp, Homo sapiens
tccgtcaaaacagatt

SEQ ID NO: 2157147 - DNA, 12 bp, Homo sapiens
tcctaaggacac

SEQ ID NO: 2157148 - DNA, 16 bp, Homo sapiens
tcctacccaaccactc

SEQ ID NO: 2157149 - DNA, 15 bp, Homo sapiens
tcctcacagcctctc

SEQ ID NO: 2157150 - DNA, 21 bp, Homo sapiens
tctgtgaatacaattaaaggt

SEQ ID NO: 2157151 - DNA, 15 bp, Homo sapiens
tctgtgcctgtctgt

SEQ ID NO: 2157152 - DNA, 18 bp, Homo sapiens
tctgtttttctaactggg

SEQ ID NO: 2157153 - DNA, 15 bp, Homo sapiens
tcttccaccagagca

SEQ ID NO: 2157154 - DNA, 19 bp, Homo sapiens
tcttgacattcaaggcatt

SEQ ID NO: 2157155 - DNA, 15 bp, Homo sapiens
tgaaaacccctggct

SEQ ID NO: 2157156 - DNA, 14 bp, Homo sapiens
tgaaagaaggagca

SEQ ID NO: 2157157 - DNA, 15 bp, Homo sapiens
tgaaagatgcaagca

SEQ ID NO: 2157158 - DNA, 17 bp, Homo sapiens
tgaaatggatacttata

SEQ ID NO: 2157159 - DNA, 16 bp, Homo sapiens
tgaacagtgctctgcc

SEQ ID NO: 2157160 - DNA, 17 bp, Homo sapiens
tgaacagtgctctgcct

SEQ ID NO: 2157161 - DNA, 19 bp, Homo sapiens
tgaacagtgctctgcctct

SEQ ID NO: 2157162 - DNA, 14 bp, Homo sapiens
tgaaccgacttttc

SEQ ID NO: 2157163 - DNA, 17 bp, Homo sapiens
tgaactgattcacatct

SEQ ID NO: 2157164 - DNA, 20 bp, Homo sapiens
tgaactgattcacatctcat

SEQ ID NO: 2157165 - DNA, 13 bp, Homo sapiens
tgaaggagaaaat

SEQ ID NO: 2157166 - DNA, 21 bp, Homo sapiens
tgaatggttccatgcctgagg

SEQ ID NO: 2157167 - DNA, 16 bp, Homo sapiens
tgaatgtgttgatttg

SEQ ID NO: 2157168 - DNA, 17 bp, Homo sapiens
tgacactgagccccacc

SEQ ID NO: 2157169 - DNA, 18 bp, Homo sapiens
tgacactgagccccacct

SEQ ID NO: 2157170 - DNA, 20 bp, Homo sapiens
tgacagctaggatgtgcatt

SEQ ID NO: 2157171 - DNA, 18 bp, Homo sapiens
tgacagtccgtcaaaaca

SEQ ID NO: 2157172 - DNA, 22 bp, Homo sapiens
tgacagtgacgtgactcagagc

SEQ ID NO: 2157173 - DNA, 22 bp, Homo sapiens
tgacatcagaagtaactcccac

SEQ ID NO: 2157174 - DNA, 24 bp, Homo sapiens
tgacatcagaagtaactcccactc

SEQ ID NO: 2157175 - DNA, 18 bp, Homo sapiens
tgacccggattggccctg

SEQ ID NO: 2157176 - DNA, 22 bp, Homo sapiens
tgacccggattggccctgcccc

SEQ ID NO: 2157177 - DNA, 21 bp, Homo sapiens
tgacccggctgggtcggccct

SEQ ID NO: 2157178 - DNA, 15 bp, Homo sapiens
tgacctccagtcctg

SEQ ID NO: 2157179 - DNA, 19 bp, Homo sapiens
tgactgtttttcggacagt

SEQ ID NO: 2157180 - DNA, 17 bp, Homo sapiens
tgagaagagggcctgtg

SEQ ID NO: 2157181 - DNA, 21 bp, Homo sapiens
tgagaagagggcctgtgggag

SEQ ID NO: 2157182 - DNA, 23 bp, Homo sapiens
tgagaagagggcctgtgggagcc

SEQ ID NO: 2157183 - DNA, 18 bp, Homo sapiens
tgagaagtgtatatagtt

SEQ ID NO: 2157184 - DNA, 12 bp, Homo sapiens
tgagacttccaa

SEQ ID NO: 2157185 - DNA, 14 bp, Homo sapiens
tgagagtgtgacca

SEQ ID NO: 2157186 - DNA, 19 bp, Homo sapiens
tgagccccacctctccaag

SEQ ID NO: 2157187 - DNA, 20 bp, Homo sapiens
tgagccccacctctccaagt

SEQ ID NO: 2157188 - DNA, 15 bp, Homo sapiens
tgaggacaaagagaa

SEQ ID NO: 2157189 - DNA, 20 bp, Homo sapiens
tgaggacacaccccacaccc

SEQ ID NO: 2157190 - DNA, 17 bp, Homo sapiens
tgaggatcccctgtccc

SEQ ID NO: 2157191 - DNA, 22 bp, Homo sapiens
tgaggatcccctgtcccctggg

SEQ ID NO: 2157192 - DNA, 15 bp, Homo sapiens
tgaggccggccctgc

SEQ ID NO: 2157193 - DNA, 17 bp, Homo sapiens
tgaggccggccctgccc

SEQ ID NO: 2157194 - DNA, 19 bp, Homo sapiens
tgagggcagtggggagcat

SEQ ID NO: 2157195 - DNA, 15 bp, Homo sapiens
tgagggcatctctga

SEQ ID NO: 2157196 - DNA, 14 bp, Homo sapiens
tgagtaggccctgc

SEQ ID NO: 2157197 - DNA, 18 bp, Homo sapiens
tgagtcaagttgttcctt

SEQ ID NO: 2157198 - DNA, 14 bp, Homo sapiens
tgagtgtctctgcc

SEQ ID NO: 2157199 - DNA, 13 bp, Homo sapiens
tgatgtccagaag

SEQ ID NO: 2157200 - DNA, 18 bp, Homo sapiens
tgattcgaatgacactgt

SEQ ID NO: 2157201 - DNA, 21 bp, Homo sapiens
taccaagccaccgcagctgct

SEQ ID NO: 2157202 - DNA, 22 bp, Homo sapiens
taccaagccaccgcagctgctg

SEQ ID NO: 2157203 - DNA, 15 bp, Homo sapiens
taccacaccctgcct

SEQ ID NO: 2157204 - DNA, 22 bp, Homo sapiens
taccacaccctgcctgctgtgg

SEQ ID NO: 2157205 - DNA, 20 bp, Homo sapiens
taccactgtggccccaagag

SEQ ID NO: 2157206 - DNA, 15 bp, Homo sapiens
taccaggcacatggc

SEQ ID NO: 2157207 - DNA, 21 bp, Homo sapiens
taccgcatggcagctgggccc

SEQ ID NO: 2157208 - DNA, 11 bp, Homo sapiens
tactcagagct

SEQ ID NO: 2157209 - DNA, 13 bp, Homo sapiens
tactcagagctgc

SEQ ID NO: 2157210 - DNA, 15 bp, Homo sapiens
tactcagagctgcgg

SEQ ID NO: 2157211 - DNA, 22 bp, Homo sapiens
tactcagagctgcgggctgagg

SEQ ID NO: 2157212 - DNA, 14 bp, Homo sapiens
tactgacagaaatg

SEQ ID NO: 2157213 - DNA, 16 bp, Homo sapiens
tacttatatggaaatt

SEQ ID NO: 2157214 - DNA, 20 bp, Homo sapiens
tacttcccccaccctgggtt

SEQ ID NO: 2157215 - DNA, 23 bp, Homo sapiens
tagaaacatggttttgaaatgct

SEQ ID NO: 2157216 - DNA, 14 bp, Homo sapiens
tagactggacagct

SEQ ID NO: 2157217 - DNA, 20 bp, Homo sapiens
tagatccaggcttctcccgg

SEQ ID NO: 2157218 - DNA, 21 bp, Homo sapiens
tagatccaggcttctcccgga

SEQ ID NO: 2157219 - DNA, 17 bp, Homo sapiens
tagccccagtgacagct

SEQ ID NO: 2157220 - DNA, 14 bp, Homo sapiens
tagggcctcggagg

SEQ ID NO: 2157221 - DNA, 20 bp, Homo sapiens
tagggcctcggaggctcctc

SEQ ID NO: 2157222 - DNA, 22 bp, Homo sapiens
tagggcctcggaggctcctccc

SEQ ID NO: 2157223 - DNA, 23 bp, Homo sapiens
tagggcctcggaggctcctccct

SEQ ID NO: 2157224 - DNA, 17 bp, Homo sapiens
tagggtcctggccctct

SEQ ID NO: 2157225 - DNA, 16 bp, Homo sapiens
tagtatatctggacaa

SEQ ID NO: 2157226 - DNA, 20 bp, Homo sapiens
tagtatattagtttgattta

SEQ ID NO: 2157227 - DNA, 18 bp, Homo sapiens
tagtatcatcagatagca

SEQ ID NO: 2157228 - DNA, 17 bp, Homo sapiens
tagttgaaaataaagtg

SEQ ID NO: 2157229 - DNA, 15 bp, Homo sapiens
tagttggtgttcaaa

SEQ ID NO: 2157230 - DNA, 20 bp, Homo sapiens
tagtttgatttaatatctga

SEQ ID NO: 2157231 - DNA, 17 bp, Homo sapiens
tatacattctttatctt

SEQ ID NO: 2157232 - DNA, 22 bp, Homo sapiens
tatacattctttatcttgacat

SEQ ID NO: 2157233 - DNA, 22 bp, Homo sapiens
tatagatgcaagatatttatat

SEQ ID NO: 2157234 - DNA, 14 bp, Homo sapiens
tatatatatatatg

SEQ ID NO: 2157235 - DNA, 14 bp, Homo sapiens
tatatatcataaag

SEQ ID NO: 2157236 - DNA, 17 bp, Homo sapiens
tatatatcataaagtat

SEQ ID NO: 2157237 - DNA, 19 bp, Homo sapiens
tatatatgtacagttatct

SEQ ID NO: 2157238 - DNA, 14 bp, Homo sapiens
tatatgtatatcta

SEQ ID NO: 2157239 - DNA, 19 bp, Homo sapiens
tatatgtatatctatatct

SEQ ID NO: 2157240 - DNA, 17 bp, Homo sapiens
tatatgtatatgtatat

SEQ ID NO: 2157241 - DNA, 18 bp, Homo sapiens
tatatttttggttgtcaa

SEQ ID NO: 2157242 - DNA, 19 bp, Homo sapiens
tatcaaccccagacactgg

SEQ ID NO: 2157243 - DNA, 12 bp, Homo sapiens
tatcataaagta

SEQ ID NO: 2157244 - DNA, 13 bp, Homo sapiens
tatcataaagtat

SEQ ID NO: 2157245 - DNA, 18 bp, Homo sapiens
tatcatcagatagcatct

SEQ ID NO: 2157246 - DNA, 20 bp, Homo sapiens
tatctaagttaatttaaagt

SEQ ID NO: 2157247 - DNA, 17 bp, Homo sapiens
tatctatatctctaaac

SEQ ID NO: 2157248 - DNA, 23 bp, Homo sapiens
tatctatatctctaaactgctgt

SEQ ID NO: 2157249 - DNA, 21 bp, Homo sapiens
tatctctaaactgctgttaat

SEQ ID NO: 2157250 - DNA, 22 bp, Homo sapiens
tatctgagaagtgtatatagtt

SEQ ID NO: 2157251 - DNA, 21 bp, Homo sapiens
tatgattgtttgcacagaggg

SEQ ID NO: 2157252 - DNA, 18 bp, Homo sapiens
tatgtatatgtatatcta

SEQ ID NO: 2157253 - DNA, 16 bp, Homo sapiens
tattcatgctttctcc

SEQ ID NO: 2157254 - DNA, 19 bp, Homo sapiens
tattcatgctttctccttt

SEQ ID NO: 2157255 - DNA, 21 bp, Homo sapiens
tattctaataaatcaatgtga

SEQ ID NO: 2157256 - DNA, 15 bp, Homo sapiens
tattgtaaatattgt

SEQ ID NO: 2157257 - DNA, 20 bp, Homo sapiens
tatttagaatatattaaatc

SEQ ID NO: 2157258 - DNA, 15 bp, Homo sapiens
tatttcaatgttagc

SEQ ID NO: 2157259 - DNA, 18 bp, Homo sapiens
tattttttatttccacat

SEQ ID NO: 2157260 - DNA, 16 bp, Homo sapiens
tcaaaaaaacactagt

SEQ ID NO: 2157261 - DNA, 14 bp, Homo sapiens
tcaaaacagattgt

SEQ ID NO: 2157262 - DNA, 19 bp, Homo sapiens
tcaaaacagattgtttgca

SEQ ID NO: 2157263 - DNA, 13 bp, Homo sapiens
tcaaatctattca

SEQ ID NO: 2157264 - DNA, 18 bp, Homo sapiens
tcaaatctattcagacaa

SEQ ID NO: 2157265 - DNA, 16 bp, Homo sapiens
tcaaccccagacactg

SEQ ID NO: 2157266 - DNA, 12 bp, Homo sapiens
tcaagaagacat

SEQ ID NO: 2157267 - DNA, 19 bp, Homo sapiens
tcaagaagacatggagact

SEQ ID NO: 2157268 - DNA, 20 bp, Homo sapiens
tcaagagtctctccagcctc

SEQ ID NO: 2157269 - DNA, 14 bp, Homo sapiens
tcacactcctcctg

SEQ ID NO: 2157270 - DNA, 20 bp, Homo sapiens
tcacactcctcctgccagct

SEQ ID NO: 2157271 - DNA, 17 bp, Homo sapiens
tcacagactcttccacc

SEQ ID NO: 2157272 - DNA, 13 bp, Homo sapiens
tcacagatgctgg

SEQ ID NO: 2157273 - DNA, 15 bp, Homo sapiens
tcacagatgctggcc

SEQ ID NO: 2157274 - DNA, 16 bp, Homo sapiens
tcacagatgctggcct

SEQ ID NO: 2157275 - DNA, 15 bp, Homo sapiens
tcacagcctctccct

SEQ ID NO: 2157276 - DNA, 21 bp, Homo sapiens
tcacatataaaagttaaacta

SEQ ID NO: 2157277 - DNA, 19 bp, Homo sapiens
tcaccagcccggcctgctc

SEQ ID NO: 2157278 - DNA, 15 bp, Homo sapiens
tcaccctggccacca

SEQ ID NO: 2157279 - DNA, 16 bp, Homo sapiens
tcaccctggccaccac

SEQ ID NO: 2157280 - DNA, 17 bp, Homo sapiens
tcaccctggccaccacc

SEQ ID NO: 2157281 - DNA, 13 bp, Homo sapiens
tcacttgccacat

SEQ ID NO: 2157282 - DNA, 17 bp, Homo sapiens
tcagaagtaactcccac

SEQ ID NO: 2157283 - DNA, 12 bp, Homo sapiens
tcagagctgcgg

SEQ ID NO: 2157284 - DNA, 13 bp, Homo sapiens
tcagagctgcggg

SEQ ID NO: 2157285 - DNA, 14 bp, Homo sapiens
tcagagctgcgggc

SEQ ID NO: 2157286 - DNA, 17 bp, Homo sapiens
tcagagctgcgggctga

SEQ ID NO: 2157287 - DNA, 23 bp, Homo sapiens
tcagagctgcgggctgagggcat

SEQ ID NO: 2157288 - DNA, 19 bp, Homo sapiens
tcagagctttgtcacttgc

SEQ ID NO: 2157289 - DNA, 21 bp, Homo sapiens
tcagagctttgtcacttgcca

SEQ ID NO: 2157290 - DNA, 17 bp, Homo sapiens
tcagatagaatgacagt

SEQ ID NO: 2157291 - DNA, 19 bp, Homo sapiens
tcagccccgcctgtcacaa

SEQ ID NO: 2157292 - DNA, 20 bp, Homo sapiens
tcagccgagccgggcctggg

SEQ ID NO: 2157293 - DNA, 21 bp, Homo sapiens
tcagccgagccgggcctgggg

SEQ ID NO: 2157294 - DNA, 10 bp, Homo sapiens
tcagcctgag

SEQ ID NO: 2157295 - DNA, 22 bp, Homo sapiens
tcagctctgacattctgattcg

SEQ ID NO: 2157296 - DNA, 18 bp, Homo sapiens
tcagctgtggtcccaccc

SEQ ID NO: 2157297 - DNA, 20 bp, Homo sapiens
tcagctgtggtcccacccag

SEQ ID NO: 2157298 - DNA, 18 bp, Homo sapiens
tcaggcttgaaatgcatt

SEQ ID NO: 2157299 - DNA, 19 bp, Homo sapiens
tcagtgtcctcttgctcaa

SEQ ID NO: 2157300 - DNA, 12 bp, Homo sapiens
tcatcctcctcc

SEQ ID NO: 2157301 - DNA, 13 bp, Homo sapiens
tcatcctcctcct

SEQ ID NO: 2157302 - DNA, 16 bp, Homo sapiens
tcatctgtgcctgtct

SEQ ID NO: 2157303 - DNA, 18 bp, Homo sapiens
tcatctgtgcctgtctgt

SEQ ID NO: 2157304 - DNA, 17 bp, Homo sapiens
tcatggtactaccccag

SEQ ID NO: 2157305 - DNA, 20 bp, Homo sapiens
tcattagactggaacttgaa

SEQ ID NO: 2157306 - DNA, 19 bp, Homo sapiens
tcattcaggtgttctcttc

SEQ ID NO: 2157307 - DNA, 20 bp, Homo sapiens
tccaaagggcagtaaagttt

SEQ ID NO: 2157308 - DNA, 13 bp, Homo sapiens
tccaacccctccc

SEQ ID NO: 2157309 - DNA, 16 bp, Homo sapiens
tccaacccctccccca

SEQ ID NO: 2157310 - DNA, 19 bp, Homo sapiens
tccaagtctctctgtgaat

SEQ ID NO: 2157311 - DNA, 15 bp, Homo sapiens
tccaccagagcaggg

SEQ ID NO: 2157312 - DNA, 11 bp, Homo sapiens
ggtcctgccct

SEQ ID NO: 2157313 - DNA, 22 bp, Homo sapiens
ggtccttgcctgaactccagag

SEQ ID NO: 2157314 - DNA, 22 bp, Homo sapiens
ggtctcacactcctcctgccag

SEQ ID NO: 2157315 - DNA, 18 bp, Homo sapiens
ggtgaggccggccctgcc

SEQ ID NO: 2157316 - DNA, 21 bp, Homo sapiens
ggtgaggccggccctgcccct

SEQ ID NO: 2157317 - DNA, 23 bp, Homo sapiens
ggtgaggccggccctgcccctcc

SEQ ID NO: 2157318 - DNA, 23 bp, Homo sapiens
ggtggattgggcagaatcctggg

SEQ ID NO: 2157319 - DNA, 22 bp, Homo sapiens
ggtgggggggagaaggcctccc

SEQ ID NO: 2157320 - DNA, 12 bp, Homo sapiens
ggtgtctcccaa

SEQ ID NO: 2157321 - DNA, 14 bp, Homo sapiens
ggtgtctcccaaca

SEQ ID NO: 2157322 - DNA, 14 bp, Homo sapiens
ggttccatgcctga

SEQ ID NO: 2157323 - DNA, 16 bp, Homo sapiens
ggttccatgcctgagg

SEQ ID NO: 2157324 - DNA, 18 bp, Homo sapiens
ggttccatgcctgagggt

SEQ ID NO: 2157325 - DNA, 14 bp, Homo sapiens
ggtttggcccctgg

SEQ ID NO: 2157326 - DNA, 15 bp, Homo sapiens
gtaaaaagattatat

SEQ ID NO: 2157327 - DNA, 20 bp, Homo sapiens
gtaaaaagattatatatcat

SEQ ID NO: 2157328 - DNA, 21 bp, Homo sapiens
gtaaaaagattatatatcata

SEQ ID NO: 2157329 - DNA, 15 bp, Homo sapiens
gtaaaaatgatttca

SEQ ID NO: 2157330 - DNA, 16 bp, Homo sapiens
gtaaagcttgtctgat

SEQ ID NO: 2157331 - DNA, 23 bp, Homo sapiens
gtaacaagccagattttttaaaa

SEQ ID NO: 2157332 - DNA, 13 bp, Homo sapiens
gtaactcccactc

SEQ ID NO: 2157333 - DNA, 16 bp, Homo sapiens
gtaactcccactccta

SEQ ID NO: 2157334 - DNA, 21 bp, Homo sapiens
gtaagtggggttgcaaccact

SEQ ID NO: 2157335 - DNA, 16 bp, Homo sapiens
gtaattttgtgaaaga

SEQ ID NO: 2157336 - DNA, 20 bp, Homo sapiens
gtacaaagatatgctaagca

SEQ ID NO: 2157337 - DNA, 21 bp, Homo sapiens
gtaccaagccaccgcagctgc

SEQ ID NO: 2157338 - DNA, 17 bp, Homo sapiens
gtaccacaccctgcctg

SEQ ID NO: 2157339 - DNA, 18 bp, Homo sapiens
gtaccacaccctgcctgc

SEQ ID NO: 2157340 - DNA, 21 bp, Homo sapiens
gtaccacaccctgcctgctgt

SEQ ID NO: 2157341 - DNA, 23 bp, Homo sapiens
gtaccacaccctgcctgctgtgg

SEQ ID NO: 2157342 - DNA, 15 bp, Homo sapiens
gtaccaggcacatgg

SEQ ID NO: 2157343 - DNA, 17 bp, Homo sapiens
gtaccaggcacatggct

SEQ ID NO: 2157344 - DNA, 21 bp, Homo sapiens
gtagaatgtaaagcttgtctg

SEQ ID NO: 2157345 - DNA, 15 bp, Homo sapiens
gtagccccagtgaca

SEQ ID NO: 2157346 - DNA, 21 bp, Homo sapiens
gtagtgtcttcctagtatatt

SEQ ID NO: 2157347 - DNA, 14 bp, Homo sapiens
gtatatattctaca

SEQ ID NO: 2157348 - DNA, 16 bp, Homo sapiens
gtatatctatatctct

SEQ ID NO: 2157349 - DNA, 18 bp, Homo sapiens
ggcaggagtcaccatgca

SEQ ID NO: 2157350 - DNA, 23 bp, Homo sapiens
ggcagtgaacacactcagcagcc

SEQ ID NO: 2157351 - DNA, 13 bp, Homo sapiens
ggcatctctgagt

SEQ ID NO: 2157352 - DNA, 19 bp, Homo sapiens
ggcatctctgagtgtctct

SEQ ID NO: 2157353 - DNA, 22 bp, Homo sapiens
ggcatctctgagtgtctctgcc

SEQ ID NO: 2157354 - DNA, 23 bp, Homo sapiens
ggcatctctgagtgtctctgcct

SEQ ID NO: 2157355 - DNA, 22 bp, Homo sapiens
ggccacactattaccatgagaa

SEQ ID NO: 2157356 - DNA, 17 bp, Homo sapiens
ggccaccacccaacctg

SEQ ID NO: 2157357 - DNA, 22 bp, Homo sapiens
ggccaccacccaacctgtcctt

SEQ ID NO: 2157358 - DNA, 23 bp, Homo sapiens
ggccacccgttctgctggcctgg

SEQ ID NO: 2157359 - DNA, 24 bp, Homo sapiens
ggccacccgttctgctggcctgga

SEQ ID NO: 2157360 - DNA, 13 bp, Homo sapiens
ggccagcaggcag

SEQ ID NO: 2157361 - DNA, 15 bp, Homo sapiens
ggccagcaggcagcg

SEQ ID NO: 2157362 - DNA, 17 bp, Homo sapiens
ggccagtctgggctgcc

SEQ ID NO: 2157363 - DNA, 20 bp, Homo sapiens
ggccatgggtcctcggccca

SEQ ID NO: 2157364 - DNA, 22 bp, Homo sapiens
ggccatgggtcctcggcccatc

SEQ ID NO: 2157365 - DNA, 14 bp, Homo sapiens
ggcccatctgtcca

SEQ ID NO: 2157366 - DNA, 19 bp, Homo sapiens
ggcccatctgtccatcctc

SEQ ID NO: 2157367 - DNA, 20 bp, Homo sapiens
ggcccatctgtccatcctcc

SEQ ID NO: 2157368 - DNA, 23 bp, Homo sapiens
ggcccatctgtccatcctcctct

SEQ ID NO: 2157369 - DNA, 17 bp, Homo sapiens
ggcccctcaggggaagc

SEQ ID NO: 2157370 - DNA, 10 bp, Homo sapiens
ggcccctgga

SEQ ID NO: 2157371 - DNA, 11 bp, Homo sapiens
ggccctgcccc

SEQ ID NO: 2157372 - DNA, 13 bp, Homo sapiens
ggccctgcccctc

SEQ ID NO: 2157373 - DNA, 18 bp, Homo sapiens
ggccctgcccctccccct

SEQ ID NO: 2157374 - DNA, 12 bp, Homo sapiens
ggccggccctgc

SEQ ID NO: 2157375 - DNA, 15 bp, Homo sapiens
ggccggccctgcccc

SEQ ID NO: 2157376 - DNA, 15 bp, Homo sapiens
ggccgtggctccaga

SEQ ID NO: 2157377 - DNA, 13 bp, Homo sapiens
ggcctcccttgag

SEQ ID NO: 2157378 - DNA, 20 bp, Homo sapiens
ggcctcggaggctcctccct

SEQ ID NO: 2157379 - DNA, 21 bp, Homo sapiens
ggcctcggaggctcctccctc

SEQ ID NO: 2157380 - DNA, 22 bp, Homo sapiens
ggcctcggaggctcctccctct

SEQ ID NO: 2157381 - DNA, 10 bp, Homo sapiens
ggcctctggt

SEQ ID NO: 2157382 - DNA, 16 bp, Homo sapiens
ggcctcttggcacctg

SEQ ID NO: 2157383 - DNA, 23 bp, Homo sapiens
cagagcttttcgaactgtgctcc

SEQ ID NO: 2157384 - DNA, 24 bp, Homo sapiens
cagagcttttcgaactgtgctccc

SEQ ID NO: 2157385 - DNA, 15 bp, Homo sapiens
cagatctttttgtga

SEQ ID NO: 2157386 - DNA, 14 bp, Homo sapiens
cagatgctggcctc

SEQ ID NO: 2157387 - DNA, 17 bp, Homo sapiens
cagatgctggcctcttg

SEQ ID NO: 2157388 - DNA, 20 bp, Homo sapiens
cagatgctggcctcttggca

SEQ ID NO: 2157389 - DNA, 23 bp, Homo sapiens
cagatgctggcctcttggcacct

SEQ ID NO: 2157390 - DNA, 20 bp, Homo sapiens
cagcaatgatgtccagaaga

SEQ ID NO: 2157391 - DNA, 22 bp, Homo sapiens
cagcaatgatgtccagaagaat

SEQ ID NO: 2157392 - DNA, 11 bp, Homo sapiens
cagcacagctc

SEQ ID NO: 2157393 - DNA, 14 bp, Homo sapiens
cagcaccagaatgt

SEQ ID NO: 2157394 - DNA, 15 bp, Homo sapiens
cagcagactcagctc

SEQ ID NO: 2157395 - DNA, 17 bp, Homo sapiens
cagcagactcagctctg

SEQ ID NO: 2157396 - DNA, 16 bp, Homo sapiens
cagcagccctaaggat

SEQ ID NO: 2157397 - DNA, 16 bp, Homo sapiens
cagcaggcctctggtt

SEQ ID NO: 2157398 - DNA, 20 bp, Homo sapiens
cagccagcaatgatgtccag

SEQ ID NO: 2157399 - DNA, 17 bp, Homo sapiens
cagcccaccctgctcct

SEQ ID NO: 2157400 - DNA, 16 bp, Homo sapiens
cagccccgcctgtcac

SEQ ID NO: 2157401 - DNA, 13 bp, Homo sapiens
cagccccttctcc

SEQ ID NO: 2157402 - DNA, 12 bp, Homo sapiens
cagcccggcctg

SEQ ID NO: 2157403 - DNA, 23 bp, Homo sapiens
cagcccggcctgctcccagcagc

SEQ ID NO: 2157404 - DNA, 22 bp, Homo sapiens
cagccctggcccagagctggaa

SEQ ID NO: 2157405 - DNA, 17 bp, Homo sapiens
cagccctttgcaggccc

SEQ ID NO: 2157406 - DNA, 22 bp, Homo sapiens
cagccctttgcaggcccagcag

SEQ ID NO: 2157407 - DNA, 18 bp, Homo sapiens
cagccgagccgggcctgg

SEQ ID NO: 2157408 - DNA, 15 bp, Homo sapiens
cagccgccccagccc

SEQ ID NO: 2157409 - DNA, 16 bp, Homo sapiens
cagccgtgatgctcag

SEQ ID NO: 2157410 - DNA, 19 bp, Homo sapiens
cagccgtgatgctcaggct

SEQ ID NO: 2157411 - DNA, 12 bp, Homo sapiens
cagcctcacaga

SEQ ID NO: 2157412 - DNA, 20 bp, Homo sapiens
cagcctcacagatgctggcc

SEQ ID NO: 2157413 - DNA, 21 bp, Homo sapiens
cagcctcacagatgctggcct

SEQ ID NO: 2157414 - DNA, 14 bp, Homo sapiens
cagcctgagtctcc

SEQ ID NO: 2157415 - DNA, 20 bp, Homo sapiens
cagcgcctgtcccctcacag

SEQ ID NO: 2157416 - DNA, 24 bp, Homo sapiens
cagcgcctgtcccctcacagactc

SEQ ID NO: 2157417 - DNA, 19 bp, Homo sapiens
cagctaatctgtagggctg

SEQ ID NO: 2157418 - DNA, 18 bp, Homo sapiens
cagctcctcccctgccgc

SEQ ID NO: 2157419 - DNA, 19 bp, Homo sapiens
cagctcctcccctgccgcc

SEQ ID NO: 2157420 - DNA, 22 bp, Homo sapiens
cagctcctcccctgccgcctcc

SEQ ID NO: 2157421 - DNA, 20 bp, Homo sapiens
cagctctgacattctgattc

SEQ ID NO: 2157422 - DNA, 21 bp, Homo sapiens
cagctctgacattctgattcg

SEQ ID NO: 2157423 - DNA, 22 bp, Homo sapiens
cagctctgtcaccctggccacc

SEQ ID NO: 2157424 - DNA, 22 bp, Homo sapiens
cagctgaggacacaccccacac

SEQ ID NO: 2157425 - DNA, 17 bp, Homo sapiens
cagctgctgccactctg

SEQ ID NO: 2157426 - DNA, 18 bp, Homo sapiens
cagctgctgccactctgc

SEQ ID NO: 2157427 - DNA, 21 bp, Homo sapiens
cagctgctgccactctgctgc

SEQ ID NO: 2157428 - DNA, 14 bp, Homo sapiens
cagctgggcccaca

SEQ ID NO: 2157429 - DNA, 17 bp, Homo sapiens
cagctgggcccacagcc

SEQ ID NO: 2157430 - DNA, 20 bp, Homo sapiens
cagctgggcccacagccccc

SEQ ID NO: 2157431 - DNA, 23 bp, Homo sapiens
cagctgggcccacagcccccacc

SEQ ID NO: 2157432 - DNA, 15 bp, Homo sapiens
cagctgtggtcccac

SEQ ID NO: 2157433 - DNA, 15 bp, Homo sapiens
caggagcacaggcag

SEQ ID NO: 2157434 - DNA, 16 bp, Homo sapiens
caggagtcaccatgca

SEQ ID NO: 2157435 - DNA, 17 bp, Homo sapiens
caggagtcaccatgcaa

SEQ ID NO: 2157436 - DNA, 19 bp, Homo sapiens
caggagtcaccatgcaagg

SEQ ID NO: 2157437 - DNA, 20 bp, Homo sapiens
caggagtcaccatgcaaggg

SEQ ID NO: 2157438 - DNA, 22 bp, Homo sapiens
caggattttaacaaaagcaaga

SEQ ID NO: 2157439 - DNA, 20 bp, Homo sapiens
caggcagcgcctgtcccctc

SEQ ID NO: 2157440 - DNA, 15 bp, Homo sapiens
caggcagctggatga

SEQ ID NO: 2157441 - DNA, 18 bp, Homo sapiens
caggcagctggatgagac

SEQ ID NO: 2157442 - DNA, 18 bp, Homo sapiens
caggcctctggttgcctc

SEQ ID NO: 2157443 - DNA, 19 bp, Homo sapiens
caggcctctggttgcctcc

SEQ ID NO: 2157444 - DNA, 22 bp, Homo sapiens
caggcttcaccctgaatggttc

SEQ ID NO: 2157445 - DNA, 12 bp, Homo sapiens
caggcttctccc

SEQ ID NO: 2157446 - DNA, 16 bp, Homo sapiens
cagggccagcaggcag

SEQ ID NO: 2157447 - DNA, 18 bp, Homo sapiens
cagggccagcaggcagcg

SEQ ID NO: 2157448 - DNA, 13 bp, Homo sapiens
caggggactgggc

SEQ ID NO: 2157449 - DNA, 13 bp, Homo sapiens
caggggctgctgg

SEQ ID NO: 2157450 - DNA, 14 bp, Homo sapiens
caggggctgctggg

SEQ ID NO: 2157451 - DNA, 16 bp, Homo sapiens
caggggtaccaggcac

SEQ ID NO: 2157452 - DNA, 20 bp, Homo sapiens
caggggtaccaggcacatgg

SEQ ID NO: 2157453 - DNA, 22 bp, Homo sapiens
caggggtaccaggcacatggct

SEQ ID NO: 2157454 - DNA, 16 bp, Homo sapiens
cagtagtcgtcaagtt

SEQ ID NO: 2157455 - DNA, 18 bp, Homo sapiens
cagtcatggtactacccc

SEQ ID NO: 2157456 - DNA, 22 bp, Homo sapiens
cagtcctccagaccaccagccg

SEQ ID NO: 2157457 - DNA, 17 bp, Homo sapiens
cagtcctgctggcctgc

SEQ ID NO: 2157458 - DNA, 19 bp, Homo sapiens
cagtcctgctggcctgctc

SEQ ID NO: 2157459 - DNA, 15 bp, Homo sapiens
cagtgacagctagga

SEQ ID NO: 2157460 - DNA, 20 bp, Homo sapiens
cagtgacgtgactcagagct

SEQ ID NO: 2157461 - DNA, 14 bp, Homo sapiens
cagtgcctggcaag

SEQ ID NO: 2157462 - DNA, 15 bp, Homo sapiens
cagtgctctgcctct

SEQ ID NO: 2157463 - DNA, 18 bp, Homo sapiens
cagtgctctgcctctaac

SEQ ID NO: 2157464 - DNA, 23 bp, Homo sapiens
cagtgctctgcctctaactccct

SEQ ID NO: 2157465 - DNA, 16 bp, Homo sapiens
cataaagtatgccttc

SEQ ID NO: 2157466 - DNA, 20 bp, Homo sapiens
cataaagtatgccttcctgt

SEQ ID NO: 2157467 - DNA, 23 bp, Homo sapiens
catagctggttatttctcccttg

SEQ ID NO: 2157468 - DNA, 18 bp, Homo sapiens
catcagaagtaactccca

SEQ ID NO: 2157469 - DNA, 21 bp, Homo sapiens
catcagaagtaactcccactc

SEQ ID NO: 2157470 - DNA, 22 bp, Homo sapiens
catccccttcccccatccctac

SEQ ID NO: 2157471 - DNA, 13 bp, Homo sapiens
catcctccccacc

SEQ ID NO: 2157472 - DNA, 19 bp, Homo sapiens
catcctccccaccagagct

SEQ ID NO: 2157473 - DNA, 20 bp, Homo sapiens
catcctccccaccagagctg

SEQ ID NO: 2157474 - DNA, 13 bp, Homo sapiens
ccagcccggcctg

SEQ ID NO: 2157475 - DNA, 16 bp, Homo sapiens
ccagcctcacagatgc

SEQ ID NO: 2157476 - DNA, 18 bp, Homo sapiens
ccagcctcacagatgctg

SEQ ID NO: 2157477 - DNA, 21 bp, Homo sapiens
ccagcctcacagatgctggcc

SEQ ID NO: 2157478 - DNA, 22 bp, Homo sapiens
ccagcctcacagatgctggcct

SEQ ID NO: 2157479 - DNA, 16 bp, Homo sapiens
ccaggaagggagggag

SEQ ID NO: 2157480 - DNA, 20 bp, Homo sapiens
ccaggaagggagggagctga

SEQ ID NO: 2157481 - DNA, 23 bp, Homo sapiens
ccaggattttaacaaaagcaaga

SEQ ID NO: 2157482 - DNA, 19 bp, Homo sapiens
ccaggcacatggctggggg

SEQ ID NO: 2157483 - DNA, 17 bp, Homo sapiens
ccaggcaggccctgcct

SEQ ID NO: 2157484 - DNA, 18 bp, Homo sapiens
aaatctgtttgatccctg

SEQ ID NO: 2157485 - DNA, 19 bp, Homo sapiens
aaattcaacctgtgtctta

SEQ ID NO: 2157486 - DNA, 15 bp, Homo sapiens
aaattctgctcagat

SEQ ID NO: 2157487 - DNA, 15 bp, Homo sapiens
aacagattgtttgca

SEQ ID NO: 2157488 - DNA, 16 bp, Homo sapiens
aacaggttttataatt

SEQ ID NO: 2157489 - DNA, 14 bp, Homo sapiens
aacagtgctctgcc

SEQ ID NO: 2157490 - DNA, 15 bp, Homo sapiens
aacagtgctctgcct

SEQ ID NO: 2157491 - DNA, 16 bp, Homo sapiens
aacagtgctctgcctc

SEQ ID NO: 2157492 - DNA, 17 bp, Homo sapiens
aacagtgctctgcctct

SEQ ID NO: 2157493 - DNA, 17 bp, Homo sapiens
aacatgggagggatcag

SEQ ID NO: 2157494 - DNA, 20 bp, Homo sapiens
aacatgggagggatcagccc

SEQ ID NO: 2157495 - DNA, 20 bp, Homo sapiens
aacatggttttgaaatgctt

SEQ ID NO: 2157496 - DNA, 19 bp, Homo sapiens
aaccaaagagtctctggct

SEQ ID NO: 2157497 - DNA, 19 bp, Homo sapiens
aaccactcaaattaatctt

SEQ ID NO: 2157498 - DNA, 14 bp, Homo sapiens
aaccactgcaacgg

SEQ ID NO: 2157499 - DNA, 12 bp, Homo sapiens
aaccgacttttc

SEQ ID NO: 2157500 - DNA, 15 bp, Homo sapiens
aacctgtccttactc

SEQ ID NO: 2157501 - DNA, 20 bp, Homo sapiens
aacctgtccttactcagagc

SEQ ID NO: 2157502 - DNA, 14 bp, Homo sapiens
aactcactgctcaa

SEQ ID NO: 2157503 - DNA, 15 bp, Homo sapiens
aactcattagactgg

SEQ ID NO: 2157504 - DNA, 11 bp, Homo sapiens
aactccctcct

SEQ ID NO: 2157505 - DNA, 23 bp, Homo sapiens
aactcgatgaatgtgttgatttg

SEQ ID NO: 2157506 - DNA, 13 bp, Homo sapiens
aactgctggggct

SEQ ID NO: 2157507 - DNA, 14 bp, Homo sapiens
aactgctggggctg

SEQ ID NO: 2157508 - DNA, 16 bp, Homo sapiens
aactgggggaaaagat

SEQ ID NO: 2157509 - DNA, 15 bp, Homo sapiens
aacttgtaaatacac

SEQ ID NO: 2157510 - DNA, 12 bp, Homo sapiens
aagaatgttaag

SEQ ID NO: 2157511 - DNA, 19 bp, Homo sapiens
aagacatggagactcctgc

SEQ ID NO: 2157512 - DNA, 24 bp, Homo sapiens
aagactgttgctcaaatctattca

SEQ ID NO: 2157513 - DNA, 13 bp, Homo sapiens
aagacttcatgtt

SEQ ID NO: 2157514 - DNA, 23 bp, Homo sapiens
aagaggggcgggctcagagcttt

SEQ ID NO: 2157515 - DNA, 16 bp, Homo sapiens
aagagtctctccagcc

SEQ ID NO: 2157516 - DNA, 19 bp, Homo sapiens
aagagtctctccagcctca

SEQ ID NO: 2157517 - DNA, 19 bp, Homo sapiens
aagagtctctggctcagct

SEQ ID NO: 2157518 - DNA, 15 bp, Homo sapiens
aagatatttatatat

SEQ ID NO: 2157519 - DNA, 21 bp, Homo sapiens
aagatggcttatttgtataat

SEQ ID NO: 2157520 - DNA, 15 bp, Homo sapiens
aagattatatatcat

SEQ ID NO: 2157521 - DNA, 17 bp, Homo sapiens
aagccaacttgtaaata

SEQ ID NO: 2157522 - DNA, 13 bp, Homo sapiens
aagccaccgcagc

SEQ ID NO: 2157523 - DNA, 14 bp, Homo sapiens
aagccaccgcagct

SEQ ID NO: 2157524 - DNA, 17 bp, Homo sapiens
aagccaccgcagctgct

SEQ ID NO: 2157525 - DNA, 23 bp, Homo sapiens
aagccaccgcagctgctgccact

SEQ ID NO: 2157526 - DNA, 19 bp, Homo sapiens
aagccctgtcgagacactt

SEQ ID NO: 2157527 - DNA, 20 bp, Homo sapiens
aaggatctctcaggagcaca

SEQ ID NO: 2157528 - DNA, 12 bp, Homo sapiens
aaggcctcccct

SEQ ID NO: 2157529 - DNA, 14 bp, Homo sapiens
aaggcctcccctga

SEQ ID NO: 2157530 - DNA, 18 bp, Homo sapiens
aagggagggagctgaggc

SEQ ID NO: 2157531 - DNA, 19 bp, Homo sapiens
aagggagggagctgaggcc

SEQ ID NO: 2157532 - DNA, 20 bp, Homo sapiens
aagggagggagctgaggcct

SEQ ID NO: 2157533 - DNA, 20 bp, Homo sapiens
aaggtatttagaatatatta

SEQ ID NO: 2157534 - DNA, 23 bp, Homo sapiens
aaggtccttgcctgaactccaga

SEQ ID NO: 2157535 - DNA, 22 bp, Homo sapiens
aaggtctcacactcctcctgcc

SEQ ID NO: 2157536 - DNA, 23 bp, Homo sapiens
aagtatatattctacacatatat

SEQ ID NO: 2157537 - DNA, 23 bp, Homo sapiens
aagtctctctgtgaatacaatta

SEQ ID NO: 2157538 - DNA, 18 bp, Homo sapiens
catggcagctgggcccac

SEQ ID NO: 2157539 - DNA, 22 bp, Homo sapiens
catggcagctgggcccacagcc

SEQ ID NO: 2157540 - DNA, 13 bp, Homo sapiens
catggctggggga

SEQ ID NO: 2157541 - DNA, 20 bp, Homo sapiens
catgggagggatcagccccg

SEQ ID NO: 2157542 - DNA, 20 bp, Homo sapiens
catgggtcctcggcccatct

SEQ ID NO: 2157543 - DNA, 23 bp, Homo sapiens
catgggtcctcggcccatctgtc

SEQ ID NO: 2157544 - DNA, 14 bp, Homo sapiens
catggtactacccc

SEQ ID NO: 2157545 - DNA, 15 bp, Homo sapiens
catggtactacccca

SEQ ID NO: 2157546 - DNA, 17 bp, Homo sapiens
catggtactaccccagc

SEQ ID NO: 2157547 - DNA, 21 bp, Homo sapiens
catgtttgcacctttctagtt

SEQ ID NO: 2157548 - DNA, 18 bp, Homo sapiens
cattaactcattagactg

SEQ ID NO: 2157549 - DNA, 21 bp, Homo sapiens
cattagtacacagcaccagaa

SEQ ID NO: 2157550 - DNA, 19 bp, Homo sapiens
cattcaggtgttctcttct

SEQ ID NO: 2157551 - DNA, 22 bp, Homo sapiens
cattctgattcgaatgacactg

SEQ ID NO: 2157552 - DNA, 21 bp, Homo sapiens
catttggcagaactgctgggg

SEQ ID NO: 2157553 - DNA, 23 bp, Homo sapiens
catttggcagaactgctggggct

SEQ ID NO: 2157554 - DNA, 14 bp, Homo sapiens
ccaaagagtctctg

SEQ ID NO: 2157555 - DNA, 19 bp, Homo sapiens
ccaaagcagcaggcctctg

SEQ ID NO: 2157556 - DNA, 17 bp, Homo sapiens
ccaacatgggagggatc

SEQ ID NO: 2157557 - DNA, 19 bp, Homo sapiens
ccaacatgggagggatcag

SEQ ID NO: 2157558 - DNA, 22 bp, Homo sapiens
ccaacatgggagggatcagccc

SEQ ID NO: 2157559 - DNA, 12 bp, Homo sapiens
ccaacctgtcct

SEQ ID NO: 2157560 - DNA, 18 bp, Homo sapiens
ccaagccaccgcagctgc

SEQ ID NO: 2157561 - DNA, 19 bp, Homo sapiens
ccaagggcctcccaccaga

SEQ ID NO: 2157562 - DNA, 16 bp, Homo sapiens
ccaaggtctcacactc

SEQ ID NO: 2157563 - DNA, 18 bp, Homo sapiens
ccaaggtctcacactcct

SEQ ID NO: 2157564 - DNA, 23 bp, Homo sapiens
ccaaggtctcacactcctcctgc

SEQ ID NO: 2157565 - DNA, 12 bp, Homo sapiens
ccaagtctctct

SEQ ID NO: 2157566 - DNA, 18 bp, Homo sapiens
ccaagtctctctgtgaat

SEQ ID NO: 2157567 - DNA, 12 bp, Homo sapiens
ccacacacactc

SEQ ID NO: 2157568 - DNA, 15 bp, Homo sapiens
ccacacacactcctt

SEQ ID NO: 2157569 - DNA, 19 bp, Homo sapiens
ccacacacactccttcccc

SEQ ID NO: 2157570 - DNA, 17 bp, Homo sapiens
ccacaccccagcccacc

SEQ ID NO: 2157571 - DNA, 13 bp, Homo sapiens
ccacaccctgcct

SEQ ID NO: 2157572 - DNA, 14 bp, Homo sapiens
ccacaccctgcctg

SEQ ID NO: 2157573 - DNA, 15 bp, Homo sapiens
ccacaccctgcctgc

SEQ ID NO: 2157574 - DNA, 18 bp, Homo sapiens
ccacaccctgcctgctgt

SEQ ID NO: 2157575 - DNA, 19 bp, Homo sapiens
ccacaccctgcctgctgtg

SEQ ID NO: 2157576 - DNA, 23 bp, Homo sapiens
ccacaccctgcctgctgtggagc

SEQ ID NO: 2157577 - DNA, 15 bp, Homo sapiens
ccacagcccccaccc

SEQ ID NO: 2157578 - DNA, 16 bp, Homo sapiens
ccacagcccccacccc

SEQ ID NO: 2157579 - DNA, 13 bp, Homo sapiens
ccacatcccaggc

SEQ ID NO: 2157580 - DNA, 15 bp, Homo sapiens
ccacatcccaggctt

SEQ ID NO: 2157581 - DNA, 20 bp, Homo sapiens
ccaccaaggtctcacactcc

SEQ ID NO: 2157582 - DNA, 21 bp, Homo sapiens
ccaccaaggtctcacactcct

SEQ ID NO: 2157583 - DNA, 23 bp, Homo sapiens
ccaccaaggtctcacactcctcc

SEQ ID NO: 2157584 - DNA, 14 bp, Homo sapiens
ccaccacccaacct

SEQ ID NO: 2157585 - DNA, 19 bp, Homo sapiens
ccaccacccaacctgtcct

SEQ ID NO: 2157586 - DNA, 20 bp, Homo sapiens
ccaccagagcaggggctgct

SEQ ID NO: 2157587 - DNA, 13 bp, Homo sapiens
ccaccagagctgc

SEQ ID NO: 2157588 - DNA, 14 bp, Homo sapiens
ccaccagagctgcc

SEQ ID NO: 2157589 - DNA, 13 bp, Homo sapiens
ccaccagccgccc

SEQ ID NO: 2157590 - DNA, 17 bp, Homo sapiens
ccaccagccgccccagc

SEQ ID NO: 2157591 - DNA, 18 bp, Homo sapiens
ccaccagccgccccagcc

SEQ ID NO: 2157592 - DNA, 19 bp, Homo sapiens
ccaccagccgccccagccc

SEQ ID NO: 2157593 - DNA, 16 bp, Homo sapiens
ccacccaacctgtcct

SEQ ID NO: 2157594 - DNA, 18 bp, Homo sapiens
ccacccaacctgtcctta

SEQ ID NO: 2157595 - DNA, 15 bp, Homo sapiens
ccacccaggcaggcc

SEQ ID NO: 2157596 - DNA, 12 bp, Homo sapiens
ccaccccagcac

SEQ ID NO: 2157597 - DNA, 15 bp, Homo sapiens
ccaccccagcacagc

SEQ ID NO: 2157598 - DNA, 18 bp, Homo sapiens
ccaccccagcacagctcc

SEQ ID NO: 2157599 - DNA, 22 bp, Homo sapiens
ccacccgttctgctggcctgga

SEQ ID NO: 2157600 - DNA, 11 bp, Homo sapiens
ccaccctgggt

SEQ ID NO: 2157601 - DNA, 15 bp, Homo sapiens
ccaccgcagctgctg

SEQ ID NO: 2157602 - DNA, 21 bp, Homo sapiens
ccaccgcagctgctgccactc

SEQ ID NO: 2157603 - DNA, 16 bp, Homo sapiens
ccacggggaccactgg

SEQ ID NO: 2157604 - DNA, 17 bp, Homo sapiens
ccacggggaccactggg

SEQ ID NO: 2157605 - DNA, 19 bp, Homo sapiens
ccacggggaccactgggcc

SEQ ID NO: 2157606 - DNA, 20 bp, Homo sapiens
ccacgtaccaagccaccgca

SEQ ID NO: 2157607 - DNA, 22 bp, Homo sapiens
ccacgtaccaagccaccgcagc

SEQ ID NO: 2157608 - DNA, 15 bp, Homo sapiens
ccacgtctctctgcc

SEQ ID NO: 2157609 - DNA, 16 bp, Homo sapiens
ccacgtctctctgcct

SEQ ID NO: 2157610 - DNA, 17 bp, Homo sapiens
ccacgtctctctgcctg

SEQ ID NO: 2157611 - DNA, 21 bp, Homo sapiens
ccacgtctctctgcctgctgg

SEQ ID NO: 2157612 - DNA, 21 bp, Homo sapiens
ccactaagctttctcctttga

SEQ ID NO: 2157613 - DNA, 23 bp, Homo sapiens
ccactctaggggtcaggctccat

SEQ ID NO: 2157614 - DNA, 15 bp, Homo sapiens
ccactctgctgcctg

SEQ ID NO: 2157615 - DNA, 16 bp, Homo sapiens
ccactgtggccccaag

SEQ ID NO: 2157616 - DNA, 18 bp, Homo sapiens
ccagaagaatattcagga

SEQ ID NO: 2157617 - DNA, 17 bp, Homo sapiens
ccagaatgtgctgcctt

SEQ ID NO: 2157618 - DNA, 17 bp, Homo sapiens
ccagaattacccttcct

SEQ ID NO: 2157619 - DNA, 12 bp, Homo sapiens
ccagacactggt

SEQ ID NO: 2157620 - DNA, 13 bp, Homo sapiens
ccagagcaggggc

SEQ ID NO: 2157621 - DNA, 17 bp, Homo sapiens
ccagagcaggggctgct

SEQ ID NO: 2157622 - DNA, 20 bp, Homo sapiens
ccagagcaggggctgctggg

SEQ ID NO: 2157623 - DNA, 22 bp, Homo sapiens
ccagagcaggggctgctggggg

SEQ ID NO: 2157624 - DNA, 20 bp, Homo sapiens
ccagagccactacctttgtc

SEQ ID NO: 2157625 - DNA, 13 bp, Homo sapiens
ccagagctgcctc

SEQ ID NO: 2157626 - DNA, 18 bp, Homo sapiens
ccagagctgcctccccaa

SEQ ID NO: 2157627 - DNA, 23 bp, Homo sapiens
ccagagctgcctccccaatccat

SEQ ID NO: 2157628 - DNA, 17 bp, Homo sapiens
ccagcaatgatgtccag

SEQ ID NO: 2157629 - DNA, 18 bp, Homo sapiens
ccagcaatgatgtccaga

SEQ ID NO: 2157630 - DNA, 17 bp, Homo sapiens
ccagcacagctcctccc

SEQ ID NO: 2157631 - DNA, 12 bp, Homo sapiens
ccagcagcccta

SEQ ID NO: 2157632 - DNA, 22 bp, Homo sapiens
ccagccagcaatgatgtccaga

SEQ ID NO: 2157633 - DNA, 18 bp, Homo sapiens
ccagccatcaagagactg

SEQ ID NO: 2157634 - DNA, 20 bp, Homo sapiens
ccagccatcaagagactgag

SEQ ID NO: 2157635 - DNA, 14 bp, Homo sapiens
ctccccaccagagc

SEQ ID NO: 2157636 - DNA, 15 bp, Homo sapiens
ctccccaccagagct

SEQ ID NO: 2157637 - DNA, 20 bp, Homo sapiens
ctccccaccagagctgcctc

SEQ ID NO: 2157638 - DNA, 18 bp, Homo sapiens
ctcccccacgtctctctg

SEQ ID NO: 2157639 - DNA, 23 bp, Homo sapiens
ctcccccacgtctctctgcctgc

SEQ ID NO: 2157640 - DNA, 23 bp, Homo sapiens
ctccccctaccgcatggcagctg

SEQ ID NO: 2157641 - DNA, 15 bp, Homo sapiens
ctcccctcccagtcc

SEQ ID NO: 2157642 - DNA, 22 bp, Homo sapiens
ctcccctcccagtcctccagac

SEQ ID NO: 2157643 - DNA, 23 bp, Homo sapiens
ctcccctgaggatcccctgtccc

SEQ ID NO: 2157644 - DNA, 12 bp, Homo sapiens
ctccccttgccc

SEQ ID NO: 2157645 - DNA, 13 bp, Homo sapiens
ctcccggacctgg

SEQ ID NO: 2157646 - DNA, 13 bp, Homo sapiens
ctccctagatcca

SEQ ID NO: 2157647 - DNA, 16 bp, Homo sapiens
ctccctagatccaggc

SEQ ID NO: 2157648 - DNA, 17 bp, Homo sapiens
ctccctagatccaggct

SEQ ID NO: 2157649 - DNA, 15 bp, Homo sapiens
ctccctctgcctcat

SEQ ID NO: 2157650 - DNA, 19 bp, Homo sapiens
ctccctctgcctcatcctc

SEQ ID NO: 2157651 - DNA, 21 bp, Homo sapiens
ctccctctgcctcatcctcct

SEQ ID NO: 2157652 - DNA, 18 bp, Homo sapiens
ctcccttgagtaggccct

SEQ ID NO: 2157653 - DNA, 20 bp, Homo sapiens
ctcctaatcaagagtctctc

SEQ ID NO: 2157654 - DNA, 23 bp, Homo sapiens
ctcctaatcaagagtctctccag

SEQ ID NO: 2157655 - DNA, 13 bp, Homo sapiens
ctcctcacactcc

SEQ ID NO: 2157656 - DNA, 18 bp, Homo sapiens
ctcctcacactccagaat

SEQ ID NO: 2157657 - DNA, 16 bp, Homo sapiens
ctcctcattcagacca

SEQ ID NO: 2157658 - DNA, 14 bp, Homo sapiens
ctcctccctctgcc

SEQ ID NO: 2157659 - DNA, 14 bp, Homo sapiens
ctcctcctgccagc

SEQ ID NO: 2157660 - DNA, 15 bp, Homo sapiens
ctcctcctgccagct

SEQ ID NO: 2157661 - DNA, 17 bp, Homo sapiens
ctcctcctgccagctct

SEQ ID NO: 2157662 - DNA, 18 bp, Homo sapiens
ctcctcctgccagctctg

SEQ ID NO: 2157663 - DNA, 12 bp, Homo sapiens
ctcctcctgccc

SEQ ID NO: 2157664 - DNA, 13 bp, Homo sapiens
ctcctcctgccct

SEQ ID NO: 2157665 - DNA, 13 bp, Homo sapiens
ctcctctccatgc

SEQ ID NO: 2157666 - DNA, 14 bp, Homo sapiens
ctcctctccatgca

SEQ ID NO: 2157667 - DNA, 16 bp, Homo sapiens
ctcctctccatgcaag

SEQ ID NO: 2157668 - DNA, 14 bp, Homo sapiens
ctcctgccagctct

SEQ ID NO: 2157669 - DNA, 15 bp, Homo sapiens
ctcctgccagctctg

SEQ ID NO: 2157670 - DNA, 14 bp, Homo sapiens
ctcctgtgcccaca

SEQ ID NO: 2157671 - DNA, 10 bp, Homo sapiens
ctccttcccc

SEQ ID NO: 2157672 - DNA, 19 bp, Homo sapiens
ctcctttctccagccagca

SEQ ID NO: 2157673 - DNA, 15 bp, Homo sapiens
ctcgaagaacaatgt

SEQ ID NO: 2157674 - DNA, 17 bp, Homo sapiens
ctcggaggctcctccct

SEQ ID NO: 2157675 - DNA, 13 bp, Homo sapiens
ctctaactccctc

SEQ ID NO: 2157676 - DNA, 15 bp, Homo sapiens
ctctaactccctcct

SEQ ID NO: 2157677 - DNA, 17 bp, Homo sapiens
ctctaactccctcctca

SEQ ID NO: 2157678 - DNA, 20 bp, Homo sapiens
ctctaggggtcaggctccat

SEQ ID NO: 2157679 - DNA, 16 bp, Homo sapiens
ctctcaggagcacagg

SEQ ID NO: 2157680 - DNA, 21 bp, Homo sapiens
ctctcaggagcacaggcagct

SEQ ID NO: 2157681 - DNA, 13 bp, Homo sapiens
ctctccaagtctc

SEQ ID NO: 2157682 - DNA, 16 bp, Homo sapiens
ctctccaagtctctct

SEQ ID NO: 2157683 - DNA, 17 bp, Homo sapiens
ctctccaagtctctctg

SEQ ID NO: 2157684 - DNA, 20 bp, Homo sapiens
ctctccaagtctctctgtga

SEQ ID NO: 2157685 - DNA, 13 bp, Homo sapiens
ctctccagcctca

SEQ ID NO: 2157686 - DNA, 12 bp, Homo sapiens
ctctccatgcaa

SEQ ID NO: 2157687 - DNA, 15 bp, Homo sapiens
ctctccatgcaagtg

SEQ ID NO: 2157688 - DNA, 14 bp, Homo sapiens
ctctctgtgaatac

SEQ ID NO: 2157689 - DNA, 17 bp, Homo sapiens
ctctctgtgaatacaat

SEQ ID NO: 2157690 - DNA, 13 bp, Homo sapiens
ctctgagtgtctc

SEQ ID NO: 2157691 - DNA, 23 bp, Homo sapiens
ctctgagtgtctctgcctggagc

SEQ ID NO: 2157692 - DNA, 13 bp, Homo sapiens
ctctgcctcatcc

SEQ ID NO: 2157693 - DNA, 19 bp, Homo sapiens
ctctgcctcatcctcctcc

SEQ ID NO: 2157694 - DNA, 16 bp, Homo sapiens
ctctgcctctaactcc

SEQ ID NO: 2157695 - DNA, 21 bp, Homo sapiens
ctctgcctctaactccctcct

SEQ ID NO: 2157696 - DNA, 23 bp, Homo sapiens
ctctgcctctaactccctcctca

SEQ ID NO: 2157697 - DNA, 16 bp, Homo sapiens
ctctgcctgctgggct

SEQ ID NO: 2157698 - DNA, 13 bp, Homo sapiens
ctctgcctggagc

SEQ ID NO: 2157699 - DNA, 13 bp, Homo sapiens
ctctgctgcctgt

SEQ ID NO: 2157700 - DNA, 15 bp, Homo sapiens
ctctgctgcctgtac

SEQ ID NO: 2157701 - DNA, 13 bp, Homo sapiens
ctctggctcagct

SEQ ID NO: 2157702 - DNA, 16 bp, Homo sapiens
ctctggctcagctgtg

SEQ ID NO: 2157703 - DNA, 15 bp, Homo sapiens
ctctgtcaccctggc

SEQ ID NO: 2157704 - DNA, 18 bp, Homo sapiens
ctctgtcaccctggccac

SEQ ID NO: 2157705 - DNA, 20 bp, Homo sapiens
ctctgtgaatacaattaaag

SEQ ID NO: 2157706 - DNA, 21 bp, Homo sapiens
ctcttccaccagagcaggggc

SEQ ID NO: 2157707 - DNA, 22 bp, Homo sapiens
ctcttcttattcatgctttctc

SEQ ID NO: 2157708 - DNA, 20 bp, Homo sapiens
ctcttgctcaaaaatctgtt

SEQ ID NO: 2157709 - DNA, 15 bp, Homo sapiens
ctcttggcacctgcc

SEQ ID NO: 2157710 - DNA, 18 bp, Homo sapiens
ctcttggcacctgcctag

SEQ ID NO: 2157711 - DNA, 20 bp, Homo sapiens
ctcttggcacctgcctagct

SEQ ID NO: 2157712 - DNA, 18 bp, Homo sapiens
ctcttgggcctgacctcc

SEQ ID NO: 2157713 - DNA, 12 bp, Homo sapiens
ctgaactccaga

SEQ ID NO: 2157714 - DNA, 18 bp, Homo sapiens
ctgacagatgtcagccga

SEQ ID NO: 2157715 - DNA, 19 bp, Homo sapiens
ctgacccaccaaggtctca

SEQ ID NO: 2157716 - DNA, 18 bp, Homo sapiens
ctgacccggattggccct

SEQ ID NO: 2157717 - DNA, 17 bp, Homo sapiens
ctgacctccagtcctgc

SEQ ID NO: 2157718 - DNA, 23 bp, Homo sapiens
ctgacctccagtcctgctggcct

SEQ ID NO: 2157719 - DNA, 14 bp, Homo sapiens
ctgagaccagttgg

SEQ ID NO: 2157720 - DNA, 23 bp, Homo sapiens
ctgagaccagttgggagcactgg

SEQ ID NO: 2157721 - DNA, 17 bp, Homo sapiens
ctgaggacacaccccac

SEQ ID NO: 2157722 - DNA, 11 bp, Homo sapiens
ctgaggcctcc

SEQ ID NO: 2157723 - DNA, 15 bp, Homo sapiens
ctgagggcatctctg

SEQ ID NO: 2157724 - DNA, 15 bp, Homo sapiens
ctgagggccacacta

SEQ ID NO: 2157725 - DNA, 21 bp, Homo sapiens
ctgagtgactctatatagctg

SEQ ID NO: 2157726 - DNA, 13 bp, Homo sapiens
ctgagtgtctctg

SEQ ID NO: 2157727 - DNA, 12 bp, Homo sapiens
ctgatttctagg

SEQ ID NO: 2157728 - DNA, 20 bp, Homo sapiens
ctgcaaactcactgctcaag

SEQ ID NO: 2157729 - DNA, 12 bp, Homo sapiens
ctgccaaaacaa

SEQ ID NO: 2157730 - DNA, 13 bp, Homo sapiens
ctgccactctgct

SEQ ID NO: 2157731 - DNA, 16 bp, Homo sapiens
ctgccactctgctgcc

SEQ ID NO: 2157732 - DNA, 18 bp, Homo sapiens
ctgccactctgctgcctg

SEQ ID NO: 2157733 - DNA, 14 bp, Homo sapiens
ctgccagctctgtc

SEQ ID NO: 2157734 - DNA, 15 bp, Homo sapiens
ctgccagctctgtca

SEQ ID NO: 2157735 - DNA, 23 bp, Homo sapiens
ctgccagctctgtcaccctggcc

SEQ ID NO: 2157736 - DNA, 19 bp, Homo sapiens
ctgcccaagggcctcccac

SEQ ID NO: 2157737 - DNA, 20 bp, Homo sapiens
ctgcccctccctagatccag

SEQ ID NO: 2157738 - DNA, 14 bp, Homo sapiens
ctgccctgtccctg

SEQ ID NO: 2157739 - DNA, 18 bp, Homo sapiens
ctgccctgtccctgtccc

SEQ ID NO: 2157740 - DNA, 13 bp, Homo sapiens
ctgccgcctcccg

SEQ ID NO: 2157741 - DNA, 18 bp, Homo sapiens
ctgccttcagccctggcc

SEQ ID NO: 2157742 - DNA, 15 bp, Homo sapiens
ctgctcccagcagcc

SEQ ID NO: 2157743 - DNA, 15 bp, Homo sapiens
ctgctcctcctgccc

SEQ ID NO: 2157744 - DNA, 16 bp, Homo sapiens
ctgctcttacttcccc

SEQ ID NO: 2157745 - DNA, 20 bp, Homo sapiens
ctgctcttacttcccccacc

SEQ ID NO: 2157746 - DNA, 22 bp, Homo sapiens
ctgctcttacttcccccaccct

SEQ ID NO: 2157747 - DNA, 23 bp, Homo sapiens
ctgctcttacttcccccaccctg

SEQ ID NO: 2157748 - DNA, 17 bp, Homo sapiens
ctgctgccactctgctg

SEQ ID NO: 2157749 - DNA, 14 bp, Homo sapiens
ctgctgcctgtaca

SEQ ID NO: 2157750 - DNA, 15 bp, Homo sapiens
ctgctgcctgtacag

SEQ ID NO: 2157751 - DNA, 23 bp, Homo sapiens
ctgctggcctgctcttacttccc

SEQ ID NO: 2157752 - DNA, 14 bp, Homo sapiens
ctgctggggctggt

SEQ ID NO: 2157753 - DNA, 17 bp, Homo sapiens
ctgctggggctggtgag

SEQ ID NO: 2157754 - DNA, 10 bp, Homo sapiens
ctgctggggg

SEQ ID NO: 2157755 - DNA, 15 bp, Homo sapiens
ctgctgggggctccc

SEQ ID NO: 2157756 - DNA, 14 bp, Homo sapiens
ctgctgtggagccc

SEQ ID NO: 2157757 - DNA, 23 bp, Homo sapiens
ctgctgttaattgattaaaatct

SEQ ID NO: 2157758 - DNA, 17 bp, Homo sapiens
ctgctttatcaggggac

SEQ ID NO: 2157759 - DNA, 14 bp, Homo sapiens
ctggaacctttccc

SEQ ID NO: 2157760 - DNA, 23 bp, Homo sapiens
ctggacaagccaacttgtaaata

SEQ ID NO: 2157761 - DNA, 12 bp, Homo sapiens
ctggacagcttg

SEQ ID NO: 2157762 - DNA, 15 bp, Homo sapiens
ctggactagggcctc

SEQ ID NO: 2157763 - DNA, 19 bp, Homo sapiens
ctggcaaagttatatttac

SEQ ID NO: 2157764 - DNA, 12 bp, Homo sapiens
ctggccaccacc

SEQ ID NO: 2157765 - DNA, 17 bp, Homo sapiens
ctggcccagagctggaa

SEQ ID NO: 2157766 - DNA, 14 bp, Homo sapiens
ctggcctcttggca

SEQ ID NO: 2157767 - DNA, 15 bp, Homo sapiens
ctggcctcttggcac

SEQ ID NO: 2157768 - DNA, 20 bp, Homo sapiens
ctggcctcttggcacctgcc

SEQ ID NO: 2157769 - DNA, 23 bp, Homo sapiens
ctggcctcttggcacctgcctag

SEQ ID NO: 2157770 - DNA, 24 bp, Homo sapiens
ctggcctcttggcacctgcctagc

SEQ ID NO: 2157771 - DNA, 15 bp, Homo sapiens
ctggcctggatctcc

SEQ ID NO: 2157772 - DNA, 12 bp, Homo sapiens
ctggctcagctg

SEQ ID NO: 2157773 - DNA, 18 bp, Homo sapiens
ctggctcagctgtggtcc

SEQ ID NO: 2157774 - DNA, 19 bp, Homo sapiens
ctgggatgggaacactggt

SEQ ID NO: 2157775 - DNA, 11 bp, Homo sapiens
ctgggccatgg

SEQ ID NO: 2157776 - DNA, 17 bp, Homo sapiens
ctgggccatgggtcctc

SEQ ID NO: 2157777 - DNA, 15 bp, Homo sapiens
ctgggcccacagccc

SEQ ID NO: 2157778 - DNA, 21 bp, Homo sapiens
ctgggcccacagcccccaccc

SEQ ID NO: 2157779 - DNA, 22 bp, Homo sapiens
ctgggcccacagcccccacccc

SEQ ID NO: 2157780 - DNA, 22 bp, Homo sapiens
ctgggcccctcaggggaagctg

SEQ ID NO: 2157781 - DNA, 17 bp, Homo sapiens
ctggggcactcccccag

SEQ ID NO: 2157782 - DNA, 18 bp, Homo sapiens
ctggggcactcccccagg

SEQ ID NO: 2157783 - DNA, 23 bp, Homo sapiens
ctggggctcctttctccagccag

SEQ ID NO: 2157784 - DNA, 16 bp, Homo sapiens
ctgggggagggactgc

SEQ ID NO: 2157785 - DNA, 20 bp, Homo sapiens
ctgggggagggactgctgac

SEQ ID NO: 2157786 - DNA, 15 bp, Homo sapiens
ctgggggctcccctt

SEQ ID NO: 2157787 - DNA, 16 bp, Homo sapiens
ctgggtcggccctgcc

SEQ ID NO: 2157788 - DNA, 19 bp, Homo sapiens
ctggtgaggccggccctgc

SEQ ID NO: 2157789 - DNA, 20 bp, Homo sapiens
ctggtgaggccggccctgcc

SEQ ID NO: 2157790 - DNA, 17 bp, Homo sapiens
ctggtgggcagctgagg

SEQ ID NO: 2157791 - DNA, 19 bp, Homo sapiens
ctggttgcctcccccgcct

SEQ ID NO: 2157792 - DNA, 21 bp, Homo sapiens
ctgtagccccagtgacagcta

SEQ ID NO: 2157793 - DNA, 21 bp, Homo sapiens
ctgtcaccctggccaccaccc

SEQ ID NO: 2157794 - DNA, 14 bp, Homo sapiens
ctgtccataaagta

SEQ ID NO: 2157795 - DNA, 12 bp, Homo sapiens
ctgtccatcctc

SEQ ID NO: 2157796 - DNA, 14 bp, Homo sapiens
ctgtccatcctcct

SEQ ID NO: 2157797 - DNA, 18 bp, Homo sapiens
ctgtccatcctcctctcc

SEQ ID NO: 2157798 - DNA, 23 bp, Homo sapiens
ctgtccccctcccctcccagtcc

SEQ ID NO: 2157799 - DNA, 15 bp, Homo sapiens
ctgtcccctcacaga

SEQ ID NO: 2157800 - DNA, 17 bp, Homo sapiens
ctgtcccctcacagact

SEQ ID NO: 2157801 - DNA, 22 bp, Homo sapiens
ctgtcccctcacagactcttcc

SEQ ID NO: 2157802 - DNA, 14 bp, Homo sapiens
ctgtcccctggggc

SEQ ID NO: 2157803 - DNA, 15 bp, Homo sapiens
ctgtcccctggggct

SEQ ID NO: 2157804 - DNA, 16 bp, Homo sapiens
ctgtcccctggggctg

SEQ ID NO: 2157805 - DNA, 18 bp, Homo sapiens
ctgtcccctggggctggt

SEQ ID NO: 2157806 - DNA, 19 bp, Homo sapiens
ctgtcccctggggctggtg

SEQ ID NO: 2157807 - DNA, 18 bp, Homo sapiens
ctgtccctgtccccctcc

SEQ ID NO: 2157808 - DNA, 16 bp, Homo sapiens
ctgtccttactcagag

SEQ ID NO: 2157809 - DNA, 20 bp, Homo sapiens
ctgtccttactcagagctgc

SEQ ID NO: 2157810 - DNA, 18 bp, Homo sapiens
ctgtcgagacacttgcct

SEQ ID NO: 2157811 - DNA, 23 bp, Homo sapiens
ctgtcgattagactggacagctt

SEQ ID NO: 2157812 - DNA, 19 bp, Homo sapiens
ctgtctgtccaacccctcc

SEQ ID NO: 2157813 - DNA, 12 bp, Homo sapiens
ctgtgaatacaa

SEQ ID NO: 2157814 - DNA, 15 bp, Homo sapiens
ctgtgaatacaatta

SEQ ID NO: 2157815 - DNA, 21 bp, Homo sapiens
ctgtgaatacaattaaaggtc

SEQ ID NO: 2157816 - DNA, 22 bp, Homo sapiens
ctgtgcccacatcccaggcttc

SEQ ID NO: 2157817 - DNA, 12 bp, Homo sapiens
ctgtgcctttgg

SEQ ID NO: 2157818 - DNA, 22 bp, Homo sapiens
ctgtgctcccacggggaccact

SEQ ID NO: 2157819 - DNA, 14 bp, Homo sapiens
ctgtgggagcctgc

SEQ ID NO: 2157820 - DNA, 22 bp, Homo sapiens
ctgttgctcaaatctattcaga

SEQ ID NO: 2157821 - DNA, 19 bp, Homo sapiens
ctgtttaaaaaaagtatat

SEQ ID NO: 2157822 - DNA, 13 bp, Homo sapiens
ctgtttgggcagg

SEQ ID NO: 2157823 - DNA, 16 bp, Homo sapiens
ctgtttgggcaggagt

SEQ ID NO: 2157824 - DNA, 20 bp, Homo sapiens
ctgtttttcggacagtttat

SEQ ID NO: 2157825 - DNA, 17 bp, Homo sapiens
ctgtttttctaactggg

SEQ ID NO: 2157826 - DNA, 17 bp, Homo sapiens
cttaagtcagaacagca

SEQ ID NO: 2157827 - DNA, 18 bp, Homo sapiens
cttaagtcagaacagcag

SEQ ID NO: 2157828 - DNA, 16 bp, Homo sapiens
cttactcagagctgcg

SEQ ID NO: 2157829 - DNA, 19 bp, Homo sapiens
cttagacttcgactcagga

SEQ ID NO: 2157830 - DNA, 22 bp, Homo sapiens
cttcacccagctaatctgtagg

SEQ ID NO: 2157831 - DNA, 13 bp, Homo sapiens
cttcagccctggc

SEQ ID NO: 2157832 - DNA, 14 bp, Homo sapiens
cttccaccagagca

SEQ ID NO: 2157833 - DNA, 16 bp, Homo sapiens
cttccaccagagcagg

SEQ ID NO: 2157834 - DNA, 20 bp, Homo sapiens
cttccaccagagcaggggct

SEQ ID NO: 2157835 - DNA, 15 bp, Homo sapiens
cttcccccatcccta

SEQ ID NO: 2157836 - DNA, 17 bp, Homo sapiens
cttccccttgtccctgg

SEQ ID NO: 2157837 - DNA, 20 bp, Homo sapiens
cttccccttgtccctggggc

SEQ ID NO: 2157838 - DNA, 22 bp, Homo sapiens
cttccccttgtccctggggcac

SEQ ID NO: 2157839 - DNA, 19 bp, Homo sapiens
cttccctccccacagtcct

SEQ ID NO: 2157840 - DNA, 11 bp, Homo sapiens
cttccctgctt

SEQ ID NO: 2157841 - DNA, 19 bp, Homo sapiens
cttcctgacccggattggc

SEQ ID NO: 2157842 - DNA, 21 bp, Homo sapiens
cttcctgacccggattggccc

SEQ ID NO: 2157843 - DNA, 15 bp, Homo sapiens
cttcgactcaggatc

SEQ ID NO: 2157844 - DNA, 18 bp, Homo sapiens
cttcgactcaggatccag

SEQ ID NO: 2157845 - DNA, 13 bp, Homo sapiens
cttctcccagcac

SEQ ID NO: 2157846 - DNA, 15 bp, Homo sapiens
cttctcccggacctg

SEQ ID NO: 2157847 - DNA, 23 bp, Homo sapiens
cttcttattcatgctttctcctt

SEQ ID NO: 2157848 - DNA, 18 bp, Homo sapiens
cttcttcacccagctaat

SEQ ID NO: 2157849 - DNA, 22 bp, Homo sapiens
cttcttcacccagctaatctgt

SEQ ID NO: 2157850 - DNA, 23 bp, Homo sapiens
cttcttcacccagctaatctgta

SEQ ID NO: 2157851 - DNA, 23 bp, Homo sapiens
cttgccacatggtgtctcccaac

SEQ ID NO: 2157852 - DNA, 15 bp, Homo sapiens
cttgcccttcctgac

SEQ ID NO: 2157853 - DNA, 16 bp, Homo sapiens
cttggcacctgcctag

SEQ ID NO: 2157854 - DNA, 22 bp, Homo sapiens
cttgggcctgacctccagtcct

SEQ ID NO: 2157855 - DNA, 12 bp, Homo sapiens
cttgtaaataca

SEQ ID NO: 2157856 - DNA, 15 bp, Homo sapiens
cttgtaaatacacca

SEQ ID NO: 2157857 - DNA, 12 bp, Homo sapiens
cttgtccctggg

SEQ ID NO: 2157858 - DNA, 17 bp, Homo sapiens
cttgtccctggggcact

SEQ ID NO: 2157859 - DNA, 22 bp, Homo sapiens
ctttatcaggggacaaaccagg

SEQ ID NO: 2157860 - DNA, 14 bp, Homo sapiens
ctttattaaaaact

SEQ ID NO: 2157861 - DNA, 17 bp, Homo sapiens
ctttattaaaaactgag

SEQ ID NO: 2157862 - DNA, 15 bp, Homo sapiens
ctttctccagccagc

SEQ ID NO: 2157863 - DNA, 19 bp, Homo sapiens
ctttctccagccagcaatg

SEQ ID NO: 2157864 - DNA, 20 bp, Homo sapiens
ctttctccagccagcaatga

SEQ ID NO: 2157865 - DNA, 17 bp, Homo sapiens
ctttctttacctgagac

SEQ ID NO: 2157866 - DNA, 18 bp, Homo sapiens
ctttctttacctgagacc

SEQ ID NO: 2157867 - DNA, 15 bp, Homo sapiens
ctttgcactgagggc

SEQ ID NO: 2157868 - DNA, 18 bp, Homo sapiens
ctttgcactgagggccac

SEQ ID NO: 2157869 - DNA, 15 bp, Homo sapiens
ctttgcccacacaca

SEQ ID NO: 2157870 - DNA, 21 bp, Homo sapiens
ctttgcccacacacactcctt

SEQ ID NO: 2157871 - DNA, 15 bp, Homo sapiens
cttttaatgaacaaa

SEQ ID NO: 2157872 - DNA, 20 bp, Homo sapiens
cttttcgaactgtgctccca

SEQ ID NO: 2157873 - DNA, 21 bp, Homo sapiens
ctttttgcaggggactgggcc

SEQ ID NO: 2157874 - DNA, 20 bp, Homo sapiens
gaaacctgtccataaagtaa

SEQ ID NO: 2157875 - DNA, 20 bp, Homo sapiens
gaaatgcattattttgaatg

SEQ ID NO: 2157876 - DNA, 22 bp, Homo sapiens
gaaatgcttgtggattgagggt

SEQ ID NO: 2157877 - DNA, 19 bp, Homo sapiens
gaaattttactgacagaaa

SEQ ID NO: 2157878 - DNA, 15 bp, Homo sapiens
gaacaatgtcagaaa

SEQ ID NO: 2157879 - DNA, 15 bp, Homo sapiens
gaacacactcagcag

SEQ ID NO: 2157880 - DNA, 20 bp, Homo sapiens
gaacacactcagcagccccc

SEQ ID NO: 2157881 - DNA, 15 bp, Homo sapiens
gaactatgaactaca

SEQ ID NO: 2157882 - DNA, 21 bp, Homo sapiens
gaactgattcacatctcattt

SEQ ID NO: 2157883 - DNA, 23 bp, Homo sapiens
gaactgattcacatctcattttt

SEQ ID NO: 2157884 - DNA, 13 bp, Homo sapiens
gaactgctggggc

SEQ ID NO: 2157885 - DNA, 14 bp, Homo sapiens
gaactgctggggct

SEQ ID NO: 2157886 - DNA, 16 bp, Homo sapiens
gaactgtgctcccacg

SEQ ID NO: 2157887 - DNA, 18 bp, Homo sapiens
gaactgtgctcccacggg

SEQ ID NO: 2157888 - DNA, 15 bp, Homo sapiens
gaacttgaactgatt

SEQ ID NO: 2157889 - DNA, 16 bp, Homo sapiens
gaacttgaactgattc

SEQ ID NO: 2157890 - DNA, 21 bp, Homo sapiens
gaagacatggagactcctgcc

SEQ ID NO: 2157891 - DNA, 15 bp, Homo sapiens
gaagactgtgacatc

SEQ ID NO: 2157892 - DNA, 13 bp, Homo sapiens
gaagcatcctccc

SEQ ID NO: 2157893 - DNA, 20 bp, Homo sapiens
gaagcatcctccccaccaga

SEQ ID NO: 2157894 - DNA, 22 bp, Homo sapiens
gaagcatcctccccaccagagc

SEQ ID NO: 2157895 - DNA, 23 bp, Homo sapiens
gaagcatcctccccaccagagct

SEQ ID NO: 2157896 - DNA, 13 bp, Homo sapiens
gaagcatttgttt

SEQ ID NO: 2157897 - DNA, 20 bp, Homo sapiens
gaaggactggccgtggctcc

SEQ ID NO: 2157898 - DNA, 16 bp, Homo sapiens
gaaggtccttgcctga

SEQ ID NO: 2157899 - DNA, 23 bp, Homo sapiens
gaaggtccttgcctgaactccag

SEQ ID NO: 2157900 - DNA, 11 bp, Homo sapiens
gaatattcagg

SEQ ID NO: 2157901 - DNA, 15 bp, Homo sapiens
gaatattcaggactt

SEQ ID NO: 2157902 - DNA, 22 bp, Homo sapiens
gaatcctgtcgattagactgga

SEQ ID NO: 2157903 - DNA, 13 bp, Homo sapiens
gaatgcacctccc

SEQ ID NO: 2157904 - DNA, 17 bp, Homo sapiens
gaatgcacctccccaaa

SEQ ID NO: 2157905 - DNA, 20 bp, Homo sapiens
gacactaagttatagtatat

SEQ ID NO: 2157906 - DNA, 16 bp, Homo sapiens
gacactgagccccacc

SEQ ID NO: 2157907 - DNA, 22 bp, Homo sapiens
gacacttgccttcttcacccag

SEQ ID NO: 2157908 - DNA, 18 bp, Homo sapiens
gacagatgtcagccgagc

SEQ ID NO: 2157909 - DNA, 18 bp, Homo sapiens
gacagtgacgtgactcag

SEQ ID NO: 2157910 - DNA, 22 bp, Homo sapiens
gacagtgacgtgactcagagct

SEQ ID NO: 2157911 - DNA, 23 bp, Homo sapiens
gacagtgacgtgactcagagctt

SEQ ID NO: 2157912 - DNA, 20 bp, Homo sapiens
gacatcagaagtaactccca

SEQ ID NO: 2157913 - DNA, 22 bp, Homo sapiens
gacatcagaagtaactcccact

SEQ ID NO: 2157914 - DNA, 17 bp, Homo sapiens
gacatggagactcctgc

SEQ ID NO: 2157915 - DNA, 20 bp, Homo sapiens
gacatggagactcctgccct

SEQ ID NO: 2157916 - DNA, 21 bp, Homo sapiens
gacatggttgggggaatgcac

SEQ ID NO: 2157917 - DNA, 22 bp, Homo sapiens
gacatggttgggggaatgcacc

SEQ ID NO: 2157918 - DNA, 21 bp, Homo sapiens
gacattaactcattagactgg

SEQ ID NO: 2157919 - DNA, 13 bp, Homo sapiens
gacattctgattc

SEQ ID NO: 2157920 - DNA, 20 bp, Homo sapiens
gaccaccagccgccccagcc

SEQ ID NO: 2157921 - DNA, 19 bp, Homo sapiens
gaccactgggcccctcagg

SEQ ID NO: 2157922 - DNA, 23 bp, Homo sapiens
gaccactgggcccctcaggggaa

SEQ ID NO: 2157923 - DNA, 15 bp, Homo sapiens
gaccagttgggagca

SEQ ID NO: 2157924 - DNA, 17 bp, Homo sapiens
gacccggattggccctg

SEQ ID NO: 2157925 - DNA, 21 bp, Homo sapiens
gacccggattggccctgcccc

SEQ ID NO: 2157926 - DNA, 23 bp, Homo sapiens
gacctatgtcctaaggacacact

SEQ ID NO: 2157927 - DNA, 15 bp, Homo sapiens
gacctccagtcctgc

SEQ ID NO: 2157928 - DNA, 16 bp, Homo sapiens
gacctccagtcctgct

SEQ ID NO: 2157929 - DNA, 20 bp, Homo sapiens
gacctccagtcctgctggcc

SEQ ID NO: 2157930 - DNA, 13 bp, Homo sapiens
gacctttgcccac

SEQ ID NO: 2157931 - DNA, 14 bp, Homo sapiens
gacctttgcccaca

SEQ ID NO: 2157932 - DNA, 14 bp, Homo sapiens
gactaagccctgtc

SEQ ID NO: 2157933 - DNA, 11 bp, Homo sapiens
gactcagagct

SEQ ID NO: 2157934 - DNA, 12 bp, Homo sapiens
gactcagagctt

SEQ ID NO: 2157935 - DNA, 22 bp, Homo sapiens
gactcagctctgacattctgat

SEQ ID NO: 2157936 - DNA, 23 bp, Homo sapiens
gactcagctctgacattctgatt

SEQ ID NO: 2157937 - DNA, 17 bp, Homo sapiens
gactcaggatccagtcc

SEQ ID NO: 2157938 - DNA, 13 bp, Homo sapiens
gactcctgccctg

SEQ ID NO: 2157939 - DNA, 14 bp, Homo sapiens
gactcttccaccag

SEQ ID NO: 2157940 - DNA, 18 bp, Homo sapiens
gactcttccaccagagca

SEQ ID NO: 2157941 - DNA, 23 bp, Homo sapiens
gactcttccaccagagcaggggc

SEQ ID NO: 2157942 - DNA, 16 bp, Homo sapiens
gactgctgacccacca

SEQ ID NO: 2157943 - DNA, 15 bp, Homo sapiens
gactggacagcttgt

SEQ ID NO: 2157944 - DNA, 16 bp, Homo sapiens
gactgggccatgggtc

SEQ ID NO: 2157945 - DNA, 18 bp, Homo sapiens
gactgtttttcggacagt

SEQ ID NO: 2157946 - DNA, 15 bp, Homo sapiens
gacttcgactcagga

SEQ ID NO: 2157947 - DNA, 21 bp, Homo sapiens
gagaaattttactgacagaaa

SEQ ID NO: 2157948 - DNA, 15 bp, Homo sapiens
gagaaggcctcccct

SEQ ID NO: 2157949 - DNA, 22 bp, Homo sapiens
gagaccagttgggagcactgga

SEQ ID NO: 2157950 - DNA, 15 bp, Homo sapiens
gagacctttgcccac

SEQ ID NO: 2157951 - DNA, 16 bp, Homo sapiens
gagacctttgcccaca

SEQ ID NO: 2157952 - DNA, 18 bp, Homo sapiens
gagacctttgcccacaca

SEQ ID NO: 2157953 - DNA, 15 bp, Homo sapiens
gagactaagccctgt

SEQ ID NO: 2157954 - DNA, 16 bp, Homo sapiens
gagactaagccctgtc

SEQ ID NO: 2157955 - DNA, 15 bp, Homo sapiens
gagcacaggcagctg

SEQ ID NO: 2157956 - DNA, 20 bp, Homo sapiens
gagccgggcctggggctcct

SEQ ID NO: 2157957 - DNA, 14 bp, Homo sapiens
gagctgcctcccca

SEQ ID NO: 2157958 - DNA, 13 bp, Homo sapiens
gagctgcgggctg

SEQ ID NO: 2157959 - DNA, 18 bp, Homo sapiens
gagctgcgggctgagggc

SEQ ID NO: 2157960 - DNA, 19 bp, Homo sapiens
gagctgcgggctgagggca

SEQ ID NO: 2157961 - DNA, 20 bp, Homo sapiens
gagcttttcgaactgtgctc

SEQ ID NO: 2157962 - DNA, 20 bp, Homo sapiens
gaggagaggggaagggccag

SEQ ID NO: 2157963 - DNA, 19 bp, Homo sapiens
gaggatcccctgtcccctg

SEQ ID NO: 2157964 - DNA, 21 bp, Homo sapiens
gaggatcccctgtcccctggg

SEQ ID NO: 2157965 - DNA, 15 bp, Homo sapiens
gaggccggccctgcc

SEQ ID NO: 2157966 - DNA, 16 bp, Homo sapiens
gaggccggccctgccc

SEQ ID NO: 2157967 - DNA, 12 bp, Homo sapiens
gaggctcctccc

SEQ ID NO: 2157968 - DNA, 15 bp, Homo sapiens
gaggctcctccctct

SEQ ID NO: 2157969 - DNA, 18 bp, Homo sapiens
gaggctcctccctctgcc

SEQ ID NO: 2157970 - DNA, 14 bp, Homo sapiens
gagggactgctgac

SEQ ID NO: 2157971 - DNA, 13 bp, Homo sapiens
gagggatcagccc

SEQ ID NO: 2157972 - DNA, 15 bp, Homo sapiens
gagggcatctctgag

SEQ ID NO: 2157973 - DNA, 18 bp, Homo sapiens
gaggggcgggctcagagc

SEQ ID NO: 2157974 - DNA, 18 bp, Homo sapiens
gagtcaccatgcaagggt

SEQ ID NO: 2157975 - DNA, 12 bp, Homo sapiens
gagtctcctgtg

SEQ ID NO: 2157976 - DNA, 11 bp, Homo sapiens
gagtctctcca

SEQ ID NO: 2157977 - DNA, 15 bp, Homo sapiens
gagtctctccagcct

SEQ ID NO: 2157978 - DNA, 11 bp, Homo sapiens
gagtctctggc

SEQ ID NO: 2157979 - DNA, 17 bp, Homo sapiens
gagtctctggctcagct

SEQ ID NO: 2157980 - DNA, 18 bp, Homo sapiens
gagtctctggctcagctg

SEQ ID NO: 2157981 - DNA, 22 bp, Homo sapiens
gagtctctggctcagctgtggt

SEQ ID NO: 2157982 - DNA, 20 bp, Homo sapiens
gagtgtccctttttgcaggg

SEQ ID NO: 2157983 - DNA, 23 bp, Homo sapiens
gagtgtccctttttgcaggggac

SEQ ID NO: 2157984 - DNA, 13 bp, Homo sapiens
gagtgtctctgcc

SEQ ID NO: 2157985 - DNA, 15 bp, Homo sapiens
gagtgtctctgcctg

SEQ ID NO: 2157986 - DNA, 12 bp, Homo sapiens
gagtgtgaccaa

SEQ ID NO: 2157987 - DNA, 20 bp, Homo sapiens
gagtgtgaccaaaagttaca

SEQ ID NO: 2157988 - DNA, 12 bp, Homo sapiens
gatagaatgaca

SEQ ID NO: 2157989 - DNA, 15 bp, Homo sapiens
gatataaatggctgg

SEQ ID NO: 2157990 - DNA, 18 bp, Homo sapiens
gatcaccagcccggcctg

SEQ ID NO: 2157991 - DNA, 20 bp, Homo sapiens
gatcagccccgcctgtcaca

SEQ ID NO: 2157992 - DNA, 18 bp, Homo sapiens
gatccaggcttctcccgg

SEQ ID NO: 2157993 - DNA, 13 bp, Homo sapiens
gatcccctgtccc

SEQ ID NO: 2157994 - DNA, 18 bp, Homo sapiens
gatcccctgtcccctggg

SEQ ID NO: 2157995 - DNA, 22 bp, Homo sapiens
gatcccctgtcccctggggctg

SEQ ID NO: 2157996 - DNA, 12 bp, Homo sapiens
gatctctcagga

SEQ ID NO: 2157997 - DNA, 16 bp, Homo sapiens
gatctctcaggagcac

SEQ ID NO: 2157998 - DNA, 23 bp, Homo sapiens
gatgctggcctcttggcacctgc

SEQ ID NO: 2157999 - DNA, 11 bp, Homo sapiens
gatgtgcattc

SEQ ID NO: 2158000 - DNA, 19 bp, Homo sapiens
gattagactggacagcttg

SEQ ID NO: 2158001 - DNA, 18 bp, Homo sapiens
gattatatatcataaagt

SEQ ID NO: 2158002 - DNA, 20 bp, Homo sapiens
gattatatatcataaagtat

SEQ ID NO: 2158003 - DNA, 15 bp, Homo sapiens
gattcacatctcatt

SEQ ID NO: 2158004 - DNA, 16 bp, Homo sapiens
gattcgaatgacactg

SEQ ID NO: 2158005 - DNA, 22 bp, Homo sapiens
gattgtgcaatagtcagagtgt

SEQ ID NO: 2158006 - DNA, 21 bp, Homo sapiens
gattgttctgtccagtttcca

SEQ ID NO: 2158007 - DNA, 18 bp, Homo sapiens
gatttctaggtaggaaat

SEQ ID NO: 2158008 - DNA, 14 bp, Homo sapiens
gatttgagaaattt

SEQ ID NO: 2158009 - DNA, 15 bp, Homo sapiens
gcaaagaactgcccc

SEQ ID NO: 2158010 - DNA, 14 bp, Homo sapiens
gcaaagttatattt

SEQ ID NO: 2158011 - DNA, 16 bp, Homo sapiens
gcaagatatttatata

SEQ ID NO: 2158012 - DNA, 14 bp, Homo sapiens
gcaagggtgacatc

SEQ ID NO: 2158013 - DNA, 14 bp, Homo sapiens
gcaagtgctgtttg

SEQ ID NO: 2158014 - DNA, 23 bp, Homo sapiens
gcaagtgctgtttgggcaggagt

SEQ ID NO: 2158015 - DNA, 13 bp, Homo sapiens
gcacagctcctcc

SEQ ID NO: 2158016 - DNA, 14 bp, Homo sapiens
gcacagctcctccc

SEQ ID NO: 2158017 - DNA, 17 bp, Homo sapiens
gcacagctcctcccctg

SEQ ID NO: 2158018 - DNA, 19 bp, Homo sapiens
gcacagctcctcccctgcc

SEQ ID NO: 2158019 - DNA, 20 bp, Homo sapiens
gcacagctcctcccctgccg

SEQ ID NO: 2158020 - DNA, 12 bp, Homo sapiens
gcacaggcagct

SEQ ID NO: 2158021 - DNA, 13 bp, Homo sapiens
gcacatggctggg

SEQ ID NO: 2158022 - DNA, 16 bp, Homo sapiens
gcacatggctggggga

SEQ ID NO: 2158023 - DNA, 16 bp, Homo sapiens
gcaccagcccttccct

SEQ ID NO: 2158024 - DNA, 19 bp, Homo sapiens
gcaccagcccttccctgct

SEQ ID NO: 2158025 - DNA, 22 bp, Homo sapiens
gcaccagcccttccctgctttg

SEQ ID NO: 2158026 - DNA, 23 bp, Homo sapiens
gcacctcccagtttgctgggttt

SEQ ID NO: 2158027 - DNA, 16 bp, Homo sapiens
gcacctgcctagctct

SEQ ID NO: 2158028 - DNA, 21 bp, Homo sapiens
gcacctgcctagctcttgggc

SEQ ID NO: 2158029 - DNA, 13 bp, Homo sapiens
gcacctttctagt

SEQ ID NO: 2158030 - DNA, 17 bp, Homo sapiens
gcacctttctagttgaa

SEQ ID NO: 2158031 - DNA, 12 bp, Homo sapiens
gcactgagggcc

SEQ ID NO: 2158032 - DNA, 13 bp, Homo sapiens
gcactgagggcca

SEQ ID NO: 2158033 - DNA, 14 bp, Homo sapiens
gcactgagggccac

SEQ ID NO: 2158034 - DNA, 15 bp, Homo sapiens
gcactgagggccaca

SEQ ID NO: 2158035 - DNA, 20 bp, Homo sapiens
gcactgagggccacactatt

SEQ ID NO: 2158036 - DNA, 13 bp, Homo sapiens
gcagaatcctggg

SEQ ID NO: 2158037 - DNA, 17 bp, Homo sapiens
gcagaatcctgggcccc

SEQ ID NO: 2158038 - DNA, 15 bp, Homo sapiens
gcagactcagctctg

SEQ ID NO: 2158039 - DNA, 23 bp, Homo sapiens
gcagatctttttgtgaaattcaa

SEQ ID NO: 2158040 - DNA, 14 bp, Homo sapiens
gcagcgcctgtccc

SEQ ID NO: 2158041 - DNA, 13 bp, Homo sapiens
gcagctgctgcca

SEQ ID NO: 2158042 - DNA, 14 bp, Homo sapiens
gcagctgctgccac

SEQ ID NO: 2158043 - DNA, 20 bp, Homo sapiens
gcagctgctgccactctgct

SEQ ID NO: 2158044 - DNA, 21 bp, Homo sapiens
gcagctgctgccactctgctg

SEQ ID NO: 2158045 - DNA, 12 bp, Homo sapiens
gcagctgggccc

SEQ ID NO: 2158046 - DNA, 15 bp, Homo sapiens
gcagctgggcccaca

SEQ ID NO: 2158047 - DNA, 17 bp, Homo sapiens
gcagctgggcccacagc

SEQ ID NO: 2158048 - DNA, 18 bp, Homo sapiens
gcagctgggcccacagcc

SEQ ID NO: 2158049 - DNA, 23 bp, Homo sapiens
gcagctgggcccacagcccccac

SEQ ID NO: 2158050 - DNA, 15 bp, Homo sapiens
gcaggcccagcagac

SEQ ID NO: 2158051 - DNA, 14 bp, Homo sapiens
gcaggcctctggtt

SEQ ID NO: 2158052 - DNA, 17 bp, Homo sapiens
gcaggctgatttctagg

SEQ ID NO: 2158053 - DNA, 12 bp, Homo sapiens
gcaggggactgg

SEQ ID NO: 2158054 - DNA, 13 bp, Homo sapiens
gcaggggctgctg

SEQ ID NO: 2158055 - DNA, 21 bp, Homo sapiens
gcagtgaacacactcagcagc

SEQ ID NO: 2158056 - DNA, 20 bp, Homo sapiens
gcatcctccccaccagagct

SEQ ID NO: 2158057 - DNA, 12 bp, Homo sapiens
gcatctctgagt

SEQ ID NO: 2158058 - DNA, 22 bp, Homo sapiens
gcatctctgagtgtctctgcct

SEQ ID NO: 2158059 - DNA, 23 bp, Homo sapiens
gcatctctgagtgtctctgcctg

SEQ ID NO: 2158060 - DNA, 24 bp, Homo sapiens
gcatctctgagtgtctctgcctgg

SEQ ID NO: 2158061 - DNA, 15 bp, Homo sapiens
gcatggcagctgggc

SEQ ID NO: 2158062 - DNA, 17 bp, Homo sapiens
gcatggcagctgggccc

SEQ ID NO: 2158063 - DNA, 18 bp, Homo sapiens
gcatggcagctgggccca

SEQ ID NO: 2158064 - DNA, 15 bp, Homo sapiens
gccaacttgtaaata

SEQ ID NO: 2158065 - DNA, 17 bp, Homo sapiens
gccacatggtgtctccc

SEQ ID NO: 2158066 - DNA, 20 bp, Homo sapiens
gccacatggtgtctcccaac

SEQ ID NO: 2158067 - DNA, 23 bp, Homo sapiens
gccacatggtgtctcccaacatg

SEQ ID NO: 2158068 - DNA, 22 bp, Homo sapiens
gccacccaggcaggccctgcct

SEQ ID NO: 2158069 - DNA, 18 bp, Homo sapiens
gccacccgttctgctggc

SEQ ID NO: 2158070 - DNA, 21 bp, Homo sapiens
gccacccgttctgctggcctg

SEQ ID NO: 2158071 - DNA, 16 bp, Homo sapiens
gccaccgcagctgctg

SEQ ID NO: 2158072 - DNA, 15 bp, Homo sapiens
gccactacctttgtc

SEQ ID NO: 2158073 - DNA, 22 bp, Homo sapiens
gccactacctttgtccaggcct

SEQ ID NO: 2158074 - DNA, 18 bp, Homo sapiens
gccagcaggcagcgcctg

SEQ ID NO: 2158075 - DNA, 23 bp, Homo sapiens
agctgggcccacagcccccaccc

SEQ ID NO: 2158076 - DNA, 21 bp, Homo sapiens
agctgtggtcccacccaggaa

SEQ ID NO: 2158077 - DNA, 14 bp, Homo sapiens
agctttctcctttg

SEQ ID NO: 2158078 - DNA, 21 bp, Homo sapiens
agctttgtcacttgccacatg

SEQ ID NO: 2158079 - DNA, 23 bp, Homo sapiens
aggaaatgtggtagcctcacttt

SEQ ID NO: 2158080 - DNA, 14 bp, Homo sapiens
aggaagggagggag

SEQ ID NO: 2158081 - DNA, 15 bp, Homo sapiens
aggaagggagggagc

SEQ ID NO: 2158082 - DNA, 21 bp, Homo sapiens
aggaagggagggagctgaggc

SEQ ID NO: 2158083 - DNA, 18 bp, Homo sapiens
aggacaaagagaataaag

SEQ ID NO: 2158084 - DNA, 22 bp, Homo sapiens
aggacacaccccacaccccagc

SEQ ID NO: 2158085 - DNA, 13 bp, Homo sapiens
aggacacactaat

SEQ ID NO: 2158086 - DNA, 20 bp, Homo sapiens
aggacttaacggctccagga

SEQ ID NO: 2158087 - DNA, 22 bp, Homo sapiens
aggagaggggaagggccagtct

SEQ ID NO: 2158088 - DNA, 22 bp, Homo sapiens
aggagcacaggcagctggatga

SEQ ID NO: 2158089 - DNA, 13 bp, Homo sapiens
aggatctctcagg

SEQ ID NO: 2158090 - DNA, 22 bp, Homo sapiens
aggatctctcaggagcacaggc

SEQ ID NO: 2158091 - DNA, 20 bp, Homo sapiens
aggcaaaggccagcagcaga

SEQ ID NO: 2158092 - DNA, 13 bp, Homo sapiens
aggcacatggctg

SEQ ID NO: 2158093 - DNA, 14 bp, Homo sapiens
aggccccaggccct

SEQ ID NO: 2158094 - DNA, 17 bp, Homo sapiens
aggccctaggattcctc

SEQ ID NO: 2158095 - DNA, 17 bp, Homo sapiens
aggccggccctgcccct

SEQ ID NO: 2158096 - DNA, 19 bp, Homo sapiens
aggccggccctgcccctcc

SEQ ID NO: 2158097 - DNA, 21 bp, Homo sapiens
aggccggccctgcccctccct

SEQ ID NO: 2158098 - DNA, 24 bp, Homo sapiens
aggccggccctgcccctccctaga

SEQ ID NO: 2158099 - DNA, 11 bp, Homo sapiens
aggcctcccct

SEQ ID NO: 2158100 - DNA, 12 bp, Homo sapiens
aggcctcccctg

SEQ ID NO: 2158101 - DNA, 13 bp, Homo sapiens
aggcctcccctga

SEQ ID NO: 2158102 - DNA, 12 bp, Homo sapiens
aggcctctggtt

SEQ ID NO: 2158103 - DNA, 18 bp, Homo sapiens
aggcctctggttgcctcc

SEQ ID NO: 2158104 - DNA, 20 bp, Homo sapiens
aggctcctccctctgcctca

SEQ ID NO: 2158105 - DNA, 21 bp, Homo sapiens
aggctcctccctctgcctcat

SEQ ID NO: 2158106 - DNA, 12 bp, Homo sapiens
agggactgctga

SEQ ID NO: 2158107 - DNA, 15 bp, Homo sapiens
agggagctgaggcct

SEQ ID NO: 2158108 - DNA, 16 bp, Homo sapiens
agggagctgaggcctc

SEQ ID NO: 2158109 - DNA, 18 bp, Homo sapiens
agggagctgaggcctccc

SEQ ID NO: 2158110 - DNA, 15 bp, Homo sapiens
agggagggagctgag

SEQ ID NO: 2158111 - DNA, 22 bp, Homo sapiens
agggatcagccccgcctgtcac

SEQ ID NO: 2158112 - DNA, 23 bp, Homo sapiens
agggatcagccccgcctgtcaca

SEQ ID NO: 2158113 - DNA, 15 bp, Homo sapiens
agggcatctctgagt

SEQ ID NO: 2158114 - DNA, 23 bp, Homo sapiens
agggcatctctgagtgtctctgc

SEQ ID NO: 2158115 - DNA, 24 bp, Homo sapiens
agggccacactattaccatgagaa

SEQ ID NO: 2158116 - DNA, 15 bp, Homo sapiens
agggccagtctgggc

SEQ ID NO: 2158117 - DNA, 19 bp, Homo sapiens
agggcctcccaccagagac

SEQ ID NO: 2158118 - DNA, 18 bp, Homo sapiens
agggcctgtgggagcctg

SEQ ID NO: 2158119 - DNA, 12 bp, Homo sapiens
agggctggacct

SEQ ID NO: 2158120 - DNA, 14 bp, Homo sapiens
aggggaagggccag

SEQ ID NO: 2158121 - DNA, 13 bp, Homo sapiens
aggggactgggcc

SEQ ID NO: 2158122 - DNA, 17 bp, Homo sapiens
aggggaggcatcagtgt

SEQ ID NO: 2158123 - DNA, 18 bp, Homo sapiens
aggggcaaagaactgccc

SEQ ID NO: 2158124 - DNA, 14 bp, Homo sapiens
aggggcgggctcag

SEQ ID NO: 2158125 - DNA, 14 bp, Homo sapiens
aggggctgctgggg

SEQ ID NO: 2158126 - DNA, 16 bp, Homo sapiens
aggggctgctgggggc

SEQ ID NO: 2158127 - DNA, 15 bp, Homo sapiens
aggggtaccaggcac

SEQ ID NO: 2158128 - DNA, 13 bp, Homo sapiens
aggggtcaggctc

SEQ ID NO: 2158129 - DNA, 15 bp, Homo sapiens
agggtaccagcagaa

SEQ ID NO: 2158130 - DNA, 21 bp, Homo sapiens
aggtagaatgtaaagcttgtc

SEQ ID NO: 2158131 - DNA, 22 bp, Homo sapiens
aggtccttgcctgaactccaga

SEQ ID NO: 2158132 - DNA, 19 bp, Homo sapiens
aggtctcacactcctcctg

SEQ ID NO: 2158133 - DNA, 20 bp, Homo sapiens
aggtctcacactcctcctgc

SEQ ID NO: 2158134 - DNA, 11 bp, Homo sapiens
agtaaagtttt

SEQ ID NO: 2158135 - DNA, 14 bp, Homo sapiens
agtaactcccactc

SEQ ID NO: 2158136 - DNA, 23 bp, Homo sapiens
agtagcacaagttatttaaatct

SEQ ID NO: 2158137 - DNA, 21 bp, Homo sapiens
agtagtgtcttcctagtatat

SEQ ID NO: 2158138 - DNA, 22 bp, Homo sapiens
agtagtgtcttcctagtatatt

SEQ ID NO: 2158139 - DNA, 21 bp, Homo sapiens
agtatatattctacacatata

SEQ ID NO: 2158140 - DNA, 18 bp, Homo sapiens
agtatatctggacaagcc

SEQ ID NO: 2158141 - DNA, 22 bp, Homo sapiens
agtatatctggacaagccaact

SEQ ID NO: 2158142 - DNA, 13 bp, Homo sapiens
agtcaccatgcaa

SEQ ID NO: 2158143 - DNA, 22 bp, Homo sapiens
agtcagaacagcagactcagct

SEQ ID NO: 2158144 - DNA, 16 bp, Homo sapiens
agtcagagtgtccctt

SEQ ID NO: 2158145 - DNA, 19 bp, Homo sapiens
agtcatggtactaccccag

SEQ ID NO: 2158146 - DNA, 20 bp, Homo sapiens
agtcctcacagcctctccct

SEQ ID NO: 2158147 - DNA, 14 bp, Homo sapiens
agtcctgctggcct

SEQ ID NO: 2158148 - DNA, 18 bp, Homo sapiens
agtcctgctggcctgctc

SEQ ID NO: 2158149 - DNA, 23 bp, Homo sapiens
agtctcctttgcactgagggcca

SEQ ID NO: 2158150 - DNA, 18 bp, Homo sapiens
agtctctccagcctcaca

SEQ ID NO: 2158151 - DNA, 20 bp, Homo sapiens
agtctctccagcctcacaga

SEQ ID NO: 2158152 - DNA, 21 bp, Homo sapiens
agtctctccagcctcacagat

SEQ ID NO: 2158153 - DNA, 12 bp, Homo sapiens
agtctctctgtg

SEQ ID NO: 2158154 - DNA, 21 bp, Homo sapiens
agtctctctgtgaatacaatt

SEQ ID NO: 2158155 - DNA, 21 bp, Homo sapiens
agtctctggctcagctgtggt

SEQ ID NO: 2158156 - DNA, 22 bp, Homo sapiens
agtctgaggccccaggccctag

SEQ ID NO: 2158157 - DNA, 14 bp, Homo sapiens
agtctgggctgccg

SEQ ID NO: 2158158 - DNA, 14 bp, Homo sapiens
agtgaatttgcctg

SEQ ID NO: 2158159 - DNA, 20 bp, Homo sapiens
agtgacgtgactcagagctt

SEQ ID NO: 2158160 - DNA, 12 bp, Homo sapiens
agtgagacagaa

SEQ ID NO: 2158161 - DNA, 13 bp, Homo sapiens
agtgctctgcctc

SEQ ID NO: 2158162 - DNA, 14 bp, Homo sapiens
agtgctctgcctct

SEQ ID NO: 2158163 - DNA, 23 bp, Homo sapiens
agtgctctgcctctaactccctc

SEQ ID NO: 2158164 - DNA, 16 bp, Homo sapiens
agtgctgtttgggcag

SEQ ID NO: 2158165 - DNA, 19 bp, Homo sapiens
agtggggttgcaaccactg

SEQ ID NO: 2158166 - DNA, 17 bp, Homo sapiens
agtgtgaccaaaagtta

SEQ ID NO: 2158167 - DNA, 15 bp, Homo sapiens
agttacatgtttgca

SEQ ID NO: 2158168 - DNA, 19 bp, Homo sapiens
agttatagtatatctggac

SEQ ID NO: 2158169 - DNA, 18 bp, Homo sapiens
agttgaaaataaagtgta

SEQ ID NO: 2158170 - DNA, 13 bp, Homo sapiens
agttgggagcact

SEQ ID NO: 2158171 - DNA, 13 bp, Homo sapiens
agtttatttgttg

SEQ ID NO: 2158172 - DNA, 20 bp, Homo sapiens
agtttatttgttgagagtgt

SEQ ID NO: 2158173 - DNA, 16 bp, Homo sapiens
agtttgatttaatatc

SEQ ID NO: 2158174 - DNA, 19 bp, Homo sapiens
agtttgatttaatatctga

SEQ ID NO: 2158175 - DNA, 15 bp, Homo sapiens
agtttgctgggttta

SEQ ID NO: 2158176 - DNA, 22 bp, Homo sapiens
agttttgtttgttcacactcct

SEQ ID NO: 2158177 - DNA, 14 bp, Homo sapiens
ataaaggtatttag

SEQ ID NO: 2158178 - DNA, 15 bp, Homo sapiens
ataaagtatgccttc

SEQ ID NO: 2158179 - DNA, 13 bp, Homo sapiens
ataaatggctggt

SEQ ID NO: 2158180 - DNA, 11 bp, Homo sapiens
atacaattaaa

SEQ ID NO: 2158181 - DNA, 14 bp, Homo sapiens
atacaattaaaggt

SEQ ID NO: 2158182 - DNA, 18 bp, Homo sapiens
ataggtagaatgtaaagc

SEQ ID NO: 2158183 - DNA, 16 bp, Homo sapiens
atagtatatctggaca

SEQ ID NO: 2158184 - DNA, 16 bp, Homo sapiens
atatatcataaagtat

SEQ ID NO: 2158185 - DNA, 17 bp, Homo sapiens
caggcagcgcctgtccc

SEQ ID NO: 2158186 - DNA, 16 bp, Homo sapiens
caggctgatttctagg

SEQ ID NO: 2158187 - DNA, 17 bp, Homo sapiens
caggctgatttctaggt

SEQ ID NO: 2158188 - DNA, 14 bp, Homo sapiens
caggcttctcccgg

SEQ ID NO: 2158189 - DNA, 12 bp, Homo sapiens
cagggaggagag

SEQ ID NO: 2158190 - DNA, 14 bp, Homo sapiens
caggggaagctgct

SEQ ID NO: 2158191 - DNA, 15 bp, Homo sapiens
caggggaagctgcta

SEQ ID NO: 2158192 - DNA, 19 bp, Homo sapiens
caggggaagctgctagggg

SEQ ID NO: 2158193 - DNA, 18 bp, Homo sapiens
caggggctgctgggggct

SEQ ID NO: 2158194 - DNA, 12 bp, Homo sapiens
cagtcatggtac

SEQ ID NO: 2158195 - DNA, 19 bp, Homo sapiens
cagtccgtcaaaacagatt

SEQ ID NO: 2158196 - DNA, 17 bp, Homo sapiens
cagtcctcacagcctct

SEQ ID NO: 2158197 - DNA, 22 bp, Homo sapiens
cagtcctcacagcctctccctt

SEQ ID NO: 2158198 - DNA, 18 bp, Homo sapiens
cagtcctccagaccacca

SEQ ID NO: 2158199 - DNA, 20 bp, Homo sapiens
cagtcctccagaccaccagc

SEQ ID NO: 2158200 - DNA, 15 bp, Homo sapiens
cagtcctgctggcct

SEQ ID NO: 2158201 - DNA, 16 bp, Homo sapiens
cagtcctgctggcctg

SEQ ID NO: 2158202 - DNA, 18 bp, Homo sapiens
cagtcctgctggcctgct

SEQ ID NO: 2158203 - DNA, 19 bp, Homo sapiens
cagtgacgtgactcagagc

SEQ ID NO: 2158204 - DNA, 21 bp, Homo sapiens
cagtgacgtgactcagagctt

SEQ ID NO: 2158205 - DNA, 13 bp, Homo sapiens
cagtgctctgcct

SEQ ID NO: 2158206 - DNA, 22 bp, Homo sapiens
cagtgggagggtaccagcagaa

SEQ ID NO: 2158207 - DNA, 18 bp, Homo sapiens
cagtgtcctcttgctcaa

SEQ ID NO: 2158208 - DNA, 19 bp, Homo sapiens
cagtgtcctcttgctcaaa

SEQ ID NO: 2158209 - DNA, 15 bp, Homo sapiens
cagttgggagcactg

SEQ ID NO: 2158210 - DNA, 18 bp, Homo sapiens
cagttgggagcactggag

SEQ ID NO: 2158211 - DNA, 14 bp, Homo sapiens
cagtttatttgttg

SEQ ID NO: 2158212 - DNA, 19 bp, Homo sapiens
cagttttttcacctggaag

SEQ ID NO: 2158213 - DNA, 16 bp, Homo sapiens
cataaaggtatttaga

SEQ ID NO: 2158214 - DNA, 23 bp, Homo sapiens
cataaaggtatttagaatatatt

SEQ ID NO: 2158215 - DNA, 17 bp, Homo sapiens
cataggtagaatgtaaa

SEQ ID NO: 2158216 - DNA, 17 bp, Homo sapiens
catcaagagactgagtc

SEQ ID NO: 2158217 - DNA, 22 bp, Homo sapiens
catcagaagtaactcccactcc

SEQ ID NO: 2158218 - DNA, 23 bp, Homo sapiens
catcagaagtaactcccactcct

SEQ ID NO: 2158219 - DNA, 19 bp, Homo sapiens
catcccaggcttcaccctg

SEQ ID NO: 2158220 - DNA, 15 bp, Homo sapiens
catccccttccccca

SEQ ID NO: 2158221 - DNA, 19 bp, Homo sapiens
catccccttcccccatccc

SEQ ID NO: 2158222 - DNA, 14 bp, Homo sapiens
catccctaccactg

SEQ ID NO: 2158223 - DNA, 15 bp, Homo sapiens
catccctaccactgt

SEQ ID NO: 2158224 - DNA, 16 bp, Homo sapiens
catccctaccactgtg

SEQ ID NO: 2158225 - DNA, 15 bp, Homo sapiens
catcctccccaccag

SEQ ID NO: 2158226 - DNA, 18 bp, Homo sapiens
catcctccccaccagagc

SEQ ID NO: 2158227 - DNA, 23 bp, Homo sapiens
catcctccccaccagagctgcct

SEQ ID NO: 2158228 - DNA, 11 bp, Homo sapiens
catcctcctcc

SEQ ID NO: 2158229 - DNA, 13 bp, Homo sapiens
catcctcctctcc

SEQ ID NO: 2158230 - DNA, 17 bp, Homo sapiens
catcctcctctccatgc

SEQ ID NO: 2158231 - DNA, 19 bp, Homo sapiens
catcctcctctccatgcaa

SEQ ID NO: 2158232 - DNA, 20 bp, Homo sapiens
catctcctcccatggccttc

SEQ ID NO: 2158233 - DNA, 18 bp, Homo sapiens
catctctgagtgtctctg

SEQ ID NO: 2158234 - DNA, 23 bp, Homo sapiens
catctcttcctacccaaccactc

SEQ ID NO: 2158235 - DNA, 13 bp, Homo sapiens
catctgtgcctgt

SEQ ID NO: 2158236 - DNA, 15 bp, Homo sapiens
catctgtgcctgtct

SEQ ID NO: 2158237 - DNA, 21 bp, Homo sapiens
catctgtgcctgtctgtccaa

SEQ ID NO: 2158238 - DNA, 14 bp, Homo sapiens
catgagaagagggc

SEQ ID NO: 2158239 - DNA, 16 bp, Homo sapiens
catgagaagagggcct

SEQ ID NO: 2158240 - DNA, 14 bp, Homo sapiens
catgctttctcctt

SEQ ID NO: 2158241 - DNA, 17 bp, Homo sapiens
catgctttctccttttt

SEQ ID NO: 2158242 - DNA, 15 bp, Homo sapiens
catggagactcctgc

SEQ ID NO: 2158243 - DNA, 16 bp, Homo sapiens
catggagactcctgcc

SEQ ID NO: 2158244 - DNA, 19 bp, Homo sapiens
catggagactcctgccctg

SEQ ID NO: 2158245 - DNA, 23 bp, Homo sapiens
catggagtgagcagtagaagcct

SEQ ID NO: 2158246 - DNA, 12 bp, Homo sapiens
catggcagctgg

SEQ ID NO: 2158247 - DNA, 15 bp, Homo sapiens
catggcagctgggcc

SEQ ID NO: 2158248 - DNA, 16 bp, Homo sapiens
catggcagctgggccc

SEQ ID NO: 2158249 - DNA, 23 bp, Homo sapiens
catggcagctgggcccacagccc

SEQ ID NO: 2158250 - DNA, 18 bp, Homo sapiens
catggctgggggagggac

SEQ ID NO: 2158251 - DNA, 23 bp, Homo sapiens
catggctgggggagggactgctg

SEQ ID NO: 2158252 - DNA, 17 bp, Homo sapiens
catgggactgtgccttt

SEQ ID NO: 2158253 - DNA, 19 bp, Homo sapiens
catgggagggatcagcccc

SEQ ID NO: 2158254 - DNA, 13 bp, Homo sapiens
catggttggggga

SEQ ID NO: 2158255 - DNA, 14 bp, Homo sapiens
catgtcaaacaaat

SEQ ID NO: 2158256 - DNA, 20 bp, Homo sapiens
catgtttgcacctttctagt

SEQ ID NO: 2158257 - DNA, 22 bp, Homo sapiens
catgtttgcacctttctagttg

SEQ ID NO: 2158258 - DNA, 16 bp, Homo sapiens
cattagactggaactt

SEQ ID NO: 2158259 - DNA, 23 bp, Homo sapiens
cattcccactaagctttctcctt

SEQ ID NO: 2158260 - DNA, 12 bp, Homo sapiens
catttggcagaa

SEQ ID NO: 2158261 - DNA, 22 bp, Homo sapiens
catttggcagaactgctggggc

SEQ ID NO: 2158262 - DNA, 15 bp, Homo sapiens
catttgtttctactt

SEQ ID NO: 2158263 - DNA, 19 bp, Homo sapiens
cattttgaaaacccctggc

SEQ ID NO: 2158264 - DNA, 20 bp, Homo sapiens
ccaaaagttacatgtttgca

SEQ ID NO: 2158265 - DNA, 15 bp, Homo sapiens
ccaaacctgacagat

SEQ ID NO: 2158266 - DNA, 17 bp, Homo sapiens
ccaaagagtctctggct

SEQ ID NO: 2158267 - DNA, 23 bp, Homo sapiens
ccaacatgggagggatcagcccc

SEQ ID NO: 2158268 - DNA, 19 bp, Homo sapiens
ccaagaggggcgggctcag

SEQ ID NO: 2158269 - DNA, 23 bp, Homo sapiens
ccaagaggggcgggctcagagct

SEQ ID NO: 2158270 - DNA, 15 bp, Homo sapiens
ccaagccaccgcagc

SEQ ID NO: 2158271 - DNA, 22 bp, Homo sapiens
ccaagccaccgcagctgctgcc

SEQ ID NO: 2158272 - DNA, 23 bp, Homo sapiens
ccaagccaccgcagctgctgcca

SEQ ID NO: 2158273 - DNA, 20 bp, Homo sapiens
ccaagggcctcccaccagag

SEQ ID NO: 2158274 - DNA, 22 bp, Homo sapiens
ccaagggcctcccaccagagac

SEQ ID NO: 2158275 - DNA, 19 bp, Homo sapiens
ccaaggtctcacactcctc

SEQ ID NO: 2158276 - DNA, 20 bp, Homo sapiens
ccaaggtctcacactcctcc

SEQ ID NO: 2158277 - DNA, 14 bp, Homo sapiens
ccaagtctctctgt

SEQ ID NO: 2158278 - DNA, 17 bp, Homo sapiens
ccaagtctctctgtgaa

SEQ ID NO: 2158279 - DNA, 19 bp, Homo sapiens
ccaagtctctctgtgaata

SEQ ID NO: 2158280 - DNA, 17 bp, Homo sapiens
ccaatccatttggcaga

SEQ ID NO: 2158281 - DNA, 20 bp, Homo sapiens
ccaatccatttggcagaact

SEQ ID NO: 2158282 - DNA, 21 bp, Homo sapiens
ccacacacactccttcccctt

SEQ ID NO: 2158283 - DNA, 16 bp, Homo sapiens
ccacaccccagcccac

SEQ ID NO: 2158284 - DNA, 17 bp, Homo sapiens
ccacaccctgcctgctg

SEQ ID NO: 2158285 - DNA, 20 bp, Homo sapiens
ccacactattaccatgagaa

SEQ ID NO: 2158286 - DNA, 19 bp, Homo sapiens
ccacagcccccaccccagc

SEQ ID NO: 2158287 - DNA, 15 bp, Homo sapiens
ccacagtcctcacag

SEQ ID NO: 2158288 - DNA, 18 bp, Homo sapiens
ccacagtcctcacagcct

SEQ ID NO: 2158289 - DNA, 17 bp, Homo sapiens
ccacatggtgtctccca

SEQ ID NO: 2158290 - DNA, 20 bp, Homo sapiens
ccacatggtgtctcccaaca

SEQ ID NO: 2158291 - DNA, 20 bp, Homo sapiens
ccaccacccaacctgtcctt

SEQ ID NO: 2158292 - DNA, 14 bp, Homo sapiens
ccaccagagcaggg

SEQ ID NO: 2158293 - DNA, 19 bp, Homo sapiens
ccaccagagcaggggctgc

SEQ ID NO: 2158294 - DNA, 16 bp, Homo sapiens
cctgctcccagcagcc

SEQ ID NO: 2158295 - DNA, 12 bp, Homo sapiens
cctgctcctcct

SEQ ID NO: 2158296 - DNA, 13 bp, Homo sapiens
cctgctcctcctg

SEQ ID NO: 2158297 - DNA, 16 bp, Homo sapiens
cctgctcctcctgccc

SEQ ID NO: 2158298 - DNA, 22 bp, Homo sapiens
cctgctcctcctgccctgtccc

SEQ ID NO: 2158299 - DNA, 19 bp, Homo sapiens
cctgctcttacttccccca

SEQ ID NO: 2158300 - DNA, 13 bp, Homo sapiens
cctgctggcctgc

SEQ ID NO: 2158301 - DNA, 14 bp, Homo sapiens
cctgctggcctgct

SEQ ID NO: 2158302 - DNA, 17 bp, Homo sapiens
cctgctggcctgctctt

SEQ ID NO: 2158303 - DNA, 19 bp, Homo sapiens
cctgctggcctgctcttac

SEQ ID NO: 2158304 - DNA, 13 bp, Homo sapiens
cctgctgtggagc

SEQ ID NO: 2158305 - DNA, 14 bp, Homo sapiens
cctgctgtggagcc

SEQ ID NO: 2158306 - DNA, 14 bp, Homo sapiens
cctggaacctttcc

SEQ ID NO: 2158307 - DNA, 23 bp, Homo sapiens
cctggaagcatttgtttctactt

SEQ ID NO: 2158308 - DNA, 15 bp, Homo sapiens
cctggactagggcct

SEQ ID NO: 2158309 - DNA, 16 bp, Homo sapiens
cctggactagggcctc

SEQ ID NO: 2158310 - DNA, 19 bp, Homo sapiens
cctggcccagagctggaac

SEQ ID NO: 2158311 - DNA, 17 bp, Homo sapiens
cctggctgaacagtgct

SEQ ID NO: 2158312 - DNA, 19 bp, Homo sapiens
cctggctgaacagtgctct

SEQ ID NO: 2158313 - DNA, 21 bp, Homo sapiens
cctggctgaacagtgctctgc

SEQ ID NO: 2158314 - DNA, 14 bp, Homo sapiens
cctggggcactccc

SEQ ID NO: 2158315 - DNA, 21 bp, Homo sapiens
cctggggcactcccccaggat

SEQ ID NO: 2158316 - DNA, 22 bp, Homo sapiens
cctggggctcctttctccagcc

SEQ ID NO: 2158317 - DNA, 14 bp, Homo sapiens
cctggggctggtgg

SEQ ID NO: 2158318 - DNA, 23 bp, Homo sapiens
cctgggtggtatagggcgtttgg

SEQ ID NO: 2158319 - DNA, 22 bp, Homo sapiens
cctgggtttggcccctggaacc

SEQ ID NO: 2158320 - DNA, 16 bp, Homo sapiens
cctgtaacaagccaga

SEQ ID NO: 2158321 - DNA, 13 bp, Homo sapiens
cctgtcacaataa

SEQ ID NO: 2158322 - DNA, 14 bp, Homo sapiens
cctgtccataaagt

SEQ ID NO: 2158323 - DNA, 16 bp, Homo sapiens
cctgtccataaagtaa

SEQ ID NO: 2158324 - DNA, 17 bp, Homo sapiens
cctgtccccctcccctc

SEQ ID NO: 2158325 - DNA, 23 bp, Homo sapiens
cctgtccccctcccctcccagtc

SEQ ID NO: 2158326 - DNA, 23 bp, Homo sapiens
cctgtcccctcacagactcttcc

SEQ ID NO: 2158327 - DNA, 18 bp, Homo sapiens
cctgtcgagacacttgcc

SEQ ID NO: 2158328 - DNA, 20 bp, Homo sapiens
cctgtcgagacacttgcctt

SEQ ID NO: 2158329 - DNA, 17 bp, Homo sapiens
cctgtctgtccaacccc

SEQ ID NO: 2158330 - DNA, 20 bp, Homo sapiens
cctgtctgtccaacccctcc

SEQ ID NO: 2158331 - DNA, 21 bp, Homo sapiens
cctgtctgtccaacccctccc

SEQ ID NO: 2158332 - DNA, 23 bp, Homo sapiens
cctgtgcccacatcccaggcttc

SEQ ID NO: 2158333 - DNA, 13 bp, Homo sapiens
ccttactcagagc

SEQ ID NO: 2158334 - DNA, 20 bp, Homo sapiens
ccttactcagagctgcgggc

SEQ ID NO: 2158335 - DNA, 17 bp, Homo sapiens
ccttccccttgtccctg

SEQ ID NO: 2158336 - DNA, 18 bp, Homo sapiens
ccttccctccccacagtc

SEQ ID NO: 2158337 - DNA, 13 bp, Homo sapiens
ccttccctgcttt

SEQ ID NO: 2158338 - DNA, 22 bp, Homo sapiens
ccttcctcatctgtgcctgtct

SEQ ID NO: 2158339 - DNA, 23 bp, Homo sapiens
ccttcttcacccagctaatctgt

SEQ ID NO: 2158340 - DNA, 18 bp, Homo sapiens
ccttgagtaggccctgct

SEQ ID NO: 2158341 - DNA, 13 bp, Homo sapiens
ccttgcccttcct

SEQ ID NO: 2158342 - DNA, 14 bp, Homo sapiens
ccttgtccctgggg

SEQ ID NO: 2158343 - DNA, 16 bp, Homo sapiens
ccttgtccctggggca

SEQ ID NO: 2158344 - DNA, 21 bp, Homo sapiens
ccttgtccctggggcactccc

SEQ ID NO: 2158345 - DNA, 23 bp, Homo sapiens
ccttgtgtgtaccacaccctgcc

SEQ ID NO: 2158346 - DNA, 15 bp, Homo sapiens
cctttctccagccag

SEQ ID NO: 2158347 - DNA, 16 bp, Homo sapiens
cctttctccagccagc

SEQ ID NO: 2158348 - DNA, 17 bp, Homo sapiens
cctttctccagccagca

SEQ ID NO: 2158349 - DNA, 20 bp, Homo sapiens
cctttctccagccagcaatg

SEQ ID NO: 2158350 - DNA, 19 bp, Homo sapiens
cctttgaggcaaaggccag

SEQ ID NO: 2158351 - DNA, 16 bp, Homo sapiens
cctttgcactgagggc

SEQ ID NO: 2158352 - DNA, 15 bp, Homo sapiens
cctttgcaggcccag

SEQ ID NO: 2158353 - DNA, 18 bp, Homo sapiens
cctttgcaggcccagcag

SEQ ID NO: 2158354 - DNA, 12 bp, Homo sapiens
cctttgcccaca

SEQ ID NO: 2158355 - DNA, 19 bp, Homo sapiens
cctttgcccacacacactc

SEQ ID NO: 2158356 - DNA, 20 bp, Homo sapiens
cctttttgcaggggactggg

SEQ ID NO: 2158357 - DNA, 14 bp, Homo sapiens
cgaactgtgctccc

SEQ ID NO: 2158358 - DNA, 13 bp, Homo sapiens
cgcagctgctgcc

SEQ ID NO: 2158359 - DNA, 24 bp, Homo sapiens
cgcagctgctgccactctgctgcc

SEQ ID NO: 2158360 - DNA, 23 bp, Homo sapiens
cgcatggcagctgggcccacagc

SEQ ID NO: 2158361 - DNA, 19 bp, Homo sapiens
cgcctgtcacaataaagtt

SEQ ID NO: 2158362 - DNA, 22 bp, Homo sapiens
cgcctgtcacaataaagtttat

SEQ ID NO: 2158363 - DNA, 20 bp, Homo sapiens
cggaggctcctccctctgcc

SEQ ID NO: 2158364 - DNA, 21 bp, Homo sapiens
cggaggctcctccctctgcct

SEQ ID NO: 2158365 - DNA, 22 bp, Homo sapiens
cggaggctcctccctctgcctc

SEQ ID NO: 2158366 - DNA, 23 bp, Homo sapiens
cggaggctcctccctctgcctca

SEQ ID NO: 2158367 - DNA, 16 bp, Homo sapiens
cggattggccctgccc

SEQ ID NO: 2158368 - DNA, 18 bp, Homo sapiens
cggattggccctgcccct

SEQ ID NO: 2158369 - DNA, 15 bp, Homo sapiens
cggcccatctgtcca

SEQ ID NO: 2158370 - DNA, 19 bp, Homo sapiens
cggcccatctgtccatcct

SEQ ID NO: 2158371 - DNA, 13 bp, Homo sapiens
cggccctgcccaa

SEQ ID NO: 2158372 - DNA, 13 bp, Homo sapiens
cggcctgctccca

SEQ ID NO: 2158373 - DNA, 15 bp, Homo sapiens
cggcctgctcccagc

SEQ ID NO: 2158374 - DNA, 19 bp, Homo sapiens
cggcctgctcccagcagcc

SEQ ID NO: 2158375 - DNA, 19 bp, Homo sapiens
cggctgcctgacactgagc

SEQ ID NO: 2158376 - DNA, 18 bp, Homo sapiens
cgggaagcatcctcccca

SEQ ID NO: 2158377 - DNA, 19 bp, Homo sapiens
cgggaagcatcctccccac

SEQ ID NO: 2158378 - DNA, 13 bp, Homo sapiens
cgggctcagagct

SEQ ID NO: 2158379 - DNA, 15 bp, Homo sapiens
cgggctgagggcatc

SEQ ID NO: 2158380 - DNA, 17 bp, Homo sapiens
cgggctgagggcatctc

SEQ ID NO: 2158381 - DNA, 19 bp, Homo sapiens
cgggctgagggcatctctg

SEQ ID NO: 2158382 - DNA, 18 bp, Homo sapiens
cggggaccactgggcccc

SEQ ID NO: 2158383 - DNA, 19 bp, Homo sapiens
cggggaccactgggcccct

SEQ ID NO: 2158384 - DNA, 23 bp, Homo sapiens
cggttttcagctattagcaactg

SEQ ID NO: 2158385 - DNA, 19 bp, Homo sapiens
cgtaagatggcttatttgt

SEQ ID NO: 2158386 - DNA, 12 bp, Homo sapiens
cgtctctctgcc

SEQ ID NO: 2158387 - DNA, 15 bp, Homo sapiens
cgtctctctgcctgc

SEQ ID NO: 2158388 - DNA, 21 bp, Homo sapiens
cgtctctctgcctgctgggct

SEQ ID NO: 2158389 - DNA, 15 bp, Homo sapiens
cgtgactcagagctt

SEQ ID NO: 2158390 - DNA, 20 bp, Homo sapiens
cgtgccctgacccctgcacc

SEQ ID NO: 2158391 - DNA, 17 bp, Homo sapiens
ctaaccaaagagtctct

SEQ ID NO: 2158392 - DNA, 20 bp, Homo sapiens
ctaaccaaagagtctctggc

SEQ ID NO: 2158393 - DNA, 12 bp, Homo sapiens
ctaactccctcc

SEQ ID NO: 2158394 - DNA, 19 bp, Homo sapiens
ctaactccctcctcacact

SEQ ID NO: 2158395 - DNA, 15 bp, Homo sapiens
ctaagctttctcctt

SEQ ID NO: 2158396 - DNA, 16 bp, Homo sapiens
ctaagctttctccttt

SEQ ID NO: 2158397 - DNA, 11 bp, Homo sapiens
ctaaggacaca

SEQ ID NO: 2158398 - DNA, 18 bp, Homo sapiens
ctaaggatctctcaggag

SEQ ID NO: 2158399 - DNA, 23 bp, Homo sapiens
ctaaggatctctcaggagcacag

SEQ ID NO: 2158400 - DNA, 15 bp, Homo sapiens
ctaagttaatttaaa

SEQ ID NO: 2158401 - DNA, 23 bp, Homo sapiens
ctaatcaagagtctctccagcct

SEQ ID NO: 2158402 - DNA, 14 bp, Homo sapiens
ctaatctgtagggc

SEQ ID NO: 2158403 - DNA, 16 bp, Homo sapiens
ctggaacttgaactga

SEQ ID NO: 2158404 - DNA, 22 bp, Homo sapiens
ctggaagcatttgtttctactt

SEQ ID NO: 2158405 - DNA, 21 bp, Homo sapiens
ctggacaagccaacttgtaaa

SEQ ID NO: 2158406 - DNA, 20 bp, Homo sapiens
ctggacctatgtcctaagga

SEQ ID NO: 2158407 - DNA, 14 bp, Homo sapiens
ctggactagggcct

SEQ ID NO: 2158408 - DNA, 12 bp, Homo sapiens
ctggagtgcagg

SEQ ID NO: 2158409 - DNA, 13 bp, Homo sapiens
ctggatgagactt

SEQ ID NO: 2158410 - DNA, 18 bp, Homo sapiens
ctggccaccacccaacct

SEQ ID NO: 2158411 - DNA, 19 bp, Homo sapiens
ctggccaccacccaacctg

SEQ ID NO: 2158412 - DNA, 16 bp, Homo sapiens
ctggccgtggctccag

SEQ ID NO: 2158413 - DNA, 13 bp, Homo sapiens
ctggcctcttggc

SEQ ID NO: 2158414 - DNA, 16 bp, Homo sapiens
ctggcctcttggcacc

SEQ ID NO: 2158415 - DNA, 13 bp, Homo sapiens
ctggcctgctctt

SEQ ID NO: 2158416 - DNA, 20 bp, Homo sapiens
ctggctcagctgtggtccca

SEQ ID NO: 2158417 - DNA, 23 bp, Homo sapiens
ctggctcagctgtggtcccaccc

SEQ ID NO: 2158418 - DNA, 20 bp, Homo sapiens
ctggctgaacagtgctctgc

SEQ ID NO: 2158419 - DNA, 23 bp, Homo sapiens
ctggctgaacagtgctctgcctc

SEQ ID NO: 2158420 - DNA, 13 bp, Homo sapiens
ctgggccatgggt

SEQ ID NO: 2158421 - DNA, 16 bp, Homo sapiens
ctgggccatgggtcct

SEQ ID NO: 2158422 - DNA, 18 bp, Homo sapiens
ctgggccatgggtcctcg

SEQ ID NO: 2158423 - DNA, 14 bp, Homo sapiens
ctgggcccacagcc

SEQ ID NO: 2158424 - DNA, 17 bp, Homo sapiens
ctgggcccacagccccc

SEQ ID NO: 2158425 - DNA, 12 bp, Homo sapiens
ctgggcccccag

SEQ ID NO: 2158426 - DNA, 14 bp, Homo sapiens
ctgggcccccagag

SEQ ID NO: 2158427 - DNA, 13 bp, Homo sapiens
ctgggcccctcag

SEQ ID NO: 2158428 - DNA, 14 bp, Homo sapiens
ctgggcccctcagg

SEQ ID NO: 2158429 - DNA, 20 bp, Homo sapiens
ctgggctcttaactgttgct

SEQ ID NO: 2158430 - DNA, 12 bp, Homo sapiens
ctggggcactcc

SEQ ID NO: 2158431 - DNA, 16 bp, Homo sapiens
ctggggcactccccca

SEQ ID NO: 2158432 - DNA, 20 bp, Homo sapiens
ctggggcactcccccaggat

SEQ ID NO: 2158433 - DNA, 19 bp, Homo sapiens
ctggggctcctttctccag

SEQ ID NO: 2158434 - DNA, 16 bp, Homo sapiens
ctggggctggtgaggc

SEQ ID NO: 2158435 - DNA, 15 bp, Homo sapiens
ctgggggagggactg

SEQ ID NO: 2158436 - DNA, 22 bp, Homo sapiens
ctgggggagggactgctgaccc

SEQ ID NO: 2158437 - DNA, 14 bp, Homo sapiens
ctgggggctcccct

SEQ ID NO: 2158438 - DNA, 14 bp, Homo sapiens
ctgggtttggcccc

SEQ ID NO: 2158439 - DNA, 15 bp, Homo sapiens
ctgggtttggcccct

SEQ ID NO: 2158440 - DNA, 16 bp, Homo sapiens
ctgggtttggcccctg

SEQ ID NO: 2158441 - DNA, 22 bp, Homo sapiens
ctgggtttggcccctggaacct

SEQ ID NO: 2158442 - DNA, 17 bp, Homo sapiens
ctggtgaggccggccct

SEQ ID NO: 2158443 - DNA, 16 bp, Homo sapiens
ctggtgggcagctgag

SEQ ID NO: 2158444 - DNA, 13 bp, Homo sapiens
ctggttgcctccc

SEQ ID NO: 2158445 - DNA, 14 bp, Homo sapiens
ctgtagggctggac

SEQ ID NO: 2158446 - DNA, 14 bp, Homo sapiens
ctgtcacaataaag

SEQ ID NO: 2158447 - DNA, 14 bp, Homo sapiens
ctgtcaccctggcc

SEQ ID NO: 2158448 - DNA, 16 bp, Homo sapiens
ctgtcaccctggccac

SEQ ID NO: 2158449 - DNA, 20 bp, Homo sapiens
ctgtcaccctggccaccacc

SEQ ID NO: 2158450 - DNA, 23 bp, Homo sapiens
ctgtccaacccctcccccacgtc

SEQ ID NO: 2158451 - DNA, 13 bp, Homo sapiens
ctgtccataaagt

SEQ ID NO: 2158452 - DNA, 17 bp, Homo sapiens
ctgtccatcctcctctc

SEQ ID NO: 2158453 - DNA, 18 bp, Homo sapiens
ctgtcccctcacagactc

SEQ ID NO: 2158454 - DNA, 14 bp, Homo sapiens
ctgtccctgtcccc

SEQ ID NO: 2158455 - DNA, 17 bp, Homo sapiens
ctgtccttactcagagc

SEQ ID NO: 2158456 - DNA, 18 bp, Homo sapiens
ctgtccttactcagagct

SEQ ID NO: 2158457 - DNA, 19 bp, Homo sapiens
ctgtccttactcagagctg

SEQ ID NO: 2158458 - DNA, 17 bp, Homo sapiens
ctgtcgattagactgga

SEQ ID NO: 2158459 - DNA, 13 bp, Homo sapiens
ctgtgaatacaat

SEQ ID NO: 2158460 - DNA, 17 bp, Homo sapiens
ctgtgaatacaattaaa

SEQ ID NO: 2158461 - DNA, 18 bp, Homo sapiens
ctgtgaatacaattaaag

SEQ ID NO: 2158462 - DNA, 20 bp, Homo sapiens
ctgtgaatacaattaaaggt

SEQ ID NO: 2158463 - DNA, 11 bp, Homo sapiens
ctgtgcctttg

SEQ ID NO: 2158464 - DNA, 18 bp, Homo sapiens
ctgtgcctttgggaggca

SEQ ID NO: 2158465 - DNA, 15 bp, Homo sapiens
ctgtggccccaagag

SEQ ID NO: 2158466 - DNA, 17 bp, Homo sapiens
ctgtggccccaagaggg

SEQ ID NO: 2158467 - DNA, 14 bp, Homo sapiens
ctgtggctctgcat

SEQ ID NO: 2158468 - DNA, 14 bp, Homo sapiens
ctgtggtcccaccc

SEQ ID NO: 2158469 - DNA, 19 bp, Homo sapiens
ctgtggtcccacccaggaa

SEQ ID NO: 2158470 - DNA, 20 bp, Homo sapiens
ctgtggtcccacccaggaag

SEQ ID NO: 2158471 - DNA, 15 bp, Homo sapiens
ctgttacttacctaa

SEQ ID NO: 2158472 - DNA, 19 bp, Homo sapiens
ctgttacttacctaaacag

SEQ ID NO: 2158473 - DNA, 19 bp, Homo sapiens
ctgttattttttatttcca

SEQ ID NO: 2158474 - DNA, 21 bp, Homo sapiens
ctgttattttttatttccaca

SEQ ID NO: 2158475 - DNA, 11 bp, Homo sapiens
ctgttgctcaa

SEQ ID NO: 2158476 - DNA, 18 bp, Homo sapiens
ctgtttaaaaaaagtata

SEQ ID NO: 2158477 - DNA, 22 bp, Homo sapiens
ctgtttaaaaaaagtatatatt

SEQ ID NO: 2158478 - DNA, 17 bp, Homo sapiens
ctgtttttcggacagtt

SEQ ID NO: 2158479 - DNA, 22 bp, Homo sapiens
ctgtttttcggacagtttattt

SEQ ID NO: 2158480 - DNA, 19 bp, Homo sapiens
cttacctaaacagatataa

SEQ ID NO: 2158481 - DNA, 14 bp, Homo sapiens
cttactcagagctg

SEQ ID NO: 2158482 - DNA, 20 bp, Homo sapiens
cttactcagagctgcgggct

SEQ ID NO: 2158483 - DNA, 21 bp, Homo sapiens
cttacttcccccaccctgggt

SEQ ID NO: 2158484 - DNA, 20 bp, Homo sapiens
cttagacttcgactcaggat

SEQ ID NO: 2158485 - DNA, 23 bp, Homo sapiens
cttagtttctaaccaaagagtct

SEQ ID NO: 2158486 - DNA, 21 bp, Homo sapiens
cttattcatgctttctccttt

SEQ ID NO: 2158487 - DNA, 23 bp, Homo sapiens
cttattcatgctttctccttttt

SEQ ID NO: 2158488 - DNA, 21 bp, Homo sapiens
cttcaccctgaatggttccat

SEQ ID NO: 2158489 - DNA, 13 bp, Homo sapiens
cttccaccagagc

SEQ ID NO: 2158490 - DNA, 21 bp, Homo sapiens
cttccaccagagcaggggctg

SEQ ID NO: 2158491 - DNA, 16 bp, Homo sapiens
cttcccccaccctggg

SEQ ID NO: 2158492 - DNA, 16 bp, Homo sapiens
cttcccccatccctac

SEQ ID NO: 2158493 - DNA, 23 bp, Homo sapiens
cttcccccatccctaccactgtg

SEQ ID NO: 2158494 - DNA, 21 bp, Homo sapiens
cttccccttgtccctggggca

SEQ ID NO: 2158495 - DNA, 11 bp, Homo sapiens
cttcctcatct

SEQ ID NO: 2158496 - DNA, 17 bp, Homo sapiens
cttcctcatctgtgcct

SEQ ID NO: 2158497 - DNA, 18 bp, Homo sapiens
cttcctcatctgtgcctg

SEQ ID NO: 2158498 - DNA, 19 bp, Homo sapiens
cttcctcatctgtgcctgt

SEQ ID NO: 2158499 - DNA, 18 bp, Homo sapiens
cttctcccggacctggac

SEQ ID NO: 2158500 - DNA, 21 bp, Homo sapiens
cttctcccggacctggactag

SEQ ID NO: 2158501 - DNA, 14 bp, Homo sapiens
cttcttcacccagc

SEQ ID NO: 2158502 - DNA, 15 bp, Homo sapiens
cttcttcacccagct

SEQ ID NO: 2158503 - DNA, 20 bp, Homo sapiens
cttgacagtggaactacatt

SEQ ID NO: 2158504 - DNA, 15 bp, Homo sapiens
cttgagtaggccctg

SEQ ID NO: 2158505 - DNA, 16 bp, Homo sapiens
cttgagtaggccctgc

SEQ ID NO: 2158506 - DNA, 19 bp, Homo sapiens
cttgagtaggccctgcttt

SEQ ID NO: 2158507 - DNA, 16 bp, Homo sapiens
cttgcctgaactccag

SEQ ID NO: 2158508 - DNA, 17 bp, Homo sapiens
cttgcctgaactccaga

SEQ ID NO: 2158509 - DNA, 18 bp, Homo sapiens
cttgcctgaactccagag

SEQ ID NO: 2158510 - DNA, 19 bp, Homo sapiens
cttgcctgaactccagagg

SEQ ID NO: 2158511 - DNA, 20 bp, Homo sapiens
cttgcctgaactccagaggt

SEQ ID NO: 2158512 - DNA, 19 bp, Homo sapiens
cttgccttcttcacccagc

SEQ ID NO: 2158513 - DNA, 19 bp, Homo sapiens
gctttgtcacttgccacat

SEQ ID NO: 2158514 - DNA, 20 bp, Homo sapiens
gctttgtcacttgccacatg

SEQ ID NO: 2158515 - DNA, 18 bp, Homo sapiens
gcttttcgaactgtgctc

SEQ ID NO: 2158516 - DNA, 16 bp, Homo sapiens
ggaacttgaactgatt

SEQ ID NO: 2158517 - DNA, 21 bp, Homo sapiens
ggaagcatcctccccaccaga

SEQ ID NO: 2158518 - DNA, 19 bp, Homo sapiens
ggaagcatttgtttctact

SEQ ID NO: 2158519 - DNA, 13 bp, Homo sapiens
ggaagctgctagg

SEQ ID NO: 2158520 - DNA, 15 bp, Homo sapiens
ggaagggagggagct

SEQ ID NO: 2158521 - DNA, 14 bp, Homo sapiens
ggacaacctgcccc

SEQ ID NO: 2158522 - DNA, 12 bp, Homo sapiens
ggacacactaat

SEQ ID NO: 2158523 - DNA, 14 bp, Homo sapiens
ggaccactgggccc

SEQ ID NO: 2158524 - DNA, 17 bp, Homo sapiens
ggaccactgggcccctc

SEQ ID NO: 2158525 - DNA, 17 bp, Homo sapiens
ggactgctgacccacca

SEQ ID NO: 2158526 - DNA, 15 bp, Homo sapiens
ggactggccgtggct

SEQ ID NO: 2158527 - DNA, 16 bp, Homo sapiens
ggagactaagccctgt

SEQ ID NO: 2158528 - DNA, 15 bp, Homo sapiens
ggagcactggagtgc

SEQ ID NO: 2158529 - DNA, 22 bp, Homo sapiens
ggagcctgcaaactcactgctc

SEQ ID NO: 2158530 - DNA, 13 bp, Homo sapiens
ggagctgaggcct

SEQ ID NO: 2158531 - DNA, 18 bp, Homo sapiens
ggagctgaggcctccctt

SEQ ID NO: 2158532 - DNA, 16 bp, Homo sapiens
ggaggcatcagtgtcc

SEQ ID NO: 2158533 - DNA, 20 bp, Homo sapiens
ggaggctcctccctctgcct

SEQ ID NO: 2158534 - DNA, 22 bp, Homo sapiens
ggaggctcctccctctgcctca

SEQ ID NO: 2158535 - DNA, 14 bp, Homo sapiens
ggagggactgctga

SEQ ID NO: 2158536 - DNA, 23 bp, Homo sapiens
ggagggagctgaggcctcccttg

SEQ ID NO: 2158537 - DNA, 11 bp, Homo sapiens
ggagggatcag

SEQ ID NO: 2158538 - DNA, 18 bp, Homo sapiens
ggatacttatatggaaat

SEQ ID NO: 2158539 - DNA, 14 bp, Homo sapiens
ggatgggaacactg

SEQ ID NO: 2158540 - DNA, 18 bp, Homo sapiens
ggatgggaacactggtgg

SEQ ID NO: 2158541 - DNA, 14 bp, Homo sapiens
ggattggccctgcc

SEQ ID NO: 2158542 - DNA, 17 bp, Homo sapiens
ggattggccctgcccct

SEQ ID NO: 2158543 - DNA, 22 bp, Homo sapiens
ggattttaacaaaagcaagact

SEQ ID NO: 2158544 - DNA, 20 bp, Homo sapiens
ggcaaagaactgccccatct

SEQ ID NO: 2158545 - DNA, 14 bp, Homo sapiens
ggcacatggctggg

SEQ ID NO: 2158546 - DNA, 24 bp, Homo sapiens
ggcaccactagggtcctggccctc

SEQ ID NO: 2158547 - DNA, 21 bp, Homo sapiens
ggcacctgcctagctcttggg

SEQ ID NO: 2158548 - DNA, 15 bp, Homo sapiens
ggcagaactgctggg

SEQ ID NO: 2158549 - DNA, 16 bp, Homo sapiens
ggcagaactgctgggg

SEQ ID NO: 2158550 - DNA, 17 bp, Homo sapiens
ggcagaactgctggggc

SEQ ID NO: 2158551 - DNA, 16 bp, Homo sapiens
ggcagaatcctgggcc

SEQ ID NO: 2158552 - DNA, 21 bp, Homo sapiens
ggcagaatcctgggcccccag

SEQ ID NO: 2158553 - DNA, 15 bp, Homo sapiens
ggcagcgcctgtccc

SEQ ID NO: 2158554 - DNA, 18 bp, Homo sapiens
ggcagcgcctgtcccctc

SEQ ID NO: 2158555 - DNA, 21 bp, Homo sapiens
ggcagcgcctgtcccctcaca

SEQ ID NO: 2158556 - DNA, 12 bp, Homo sapiens
ggcagctgggcc

SEQ ID NO: 2158557 - DNA, 13 bp, Homo sapiens
ggcagctgggccc

SEQ ID NO: 2158558 - DNA, 17 bp, Homo sapiens
ggcagctgggcccacag

SEQ ID NO: 2158559 - DNA, 19 bp, Homo sapiens
ggcaggagtcaccatgcaa

SEQ ID NO: 2158560 - DNA, 23 bp, Homo sapiens
ggcaggagtcaccatgcaagggt

SEQ ID NO: 2158561 - DNA, 20 bp, Homo sapiens
ggcatcagtgtccttggcag

SEQ ID NO: 2158562 - DNA, 21 bp, Homo sapiens
ggccacccgttctgctggcct

SEQ ID NO: 2158563 - DNA, 14 bp, Homo sapiens
ggccagcaggcagc

SEQ ID NO: 2158564 - DNA, 17 bp, Homo sapiens
ggccagcaggcagcgcc

SEQ ID NO: 2158565 - DNA, 19 bp, Homo sapiens
ggccagcaggcagcgcctg

SEQ ID NO: 2158566 - DNA, 15 bp, Homo sapiens
ggccagtctgggctg

SEQ ID NO: 2158567 - DNA, 17 bp, Homo sapiens
ggcccagagctggaaca

SEQ ID NO: 2158568 - DNA, 22 bp, Homo sapiens
ggcccagagctggaacactctc

SEQ ID NO: 2158569 - DNA, 22 bp, Homo sapiens
ggcccatctgtccatcctcctc

SEQ ID NO: 2158570 - DNA, 23 bp, Homo sapiens
ggccccaagaggggcgggctcag

SEQ ID NO: 2158571 - DNA, 13 bp, Homo sapiens
ggcccccagagac

SEQ ID NO: 2158572 - DNA, 19 bp, Homo sapiens
ggcccccagagacctttgc

SEQ ID NO: 2158573 - DNA, 21 bp, Homo sapiens
ggccctaggattcctccccca

SEQ ID NO: 2158574 - DNA, 11 bp, Homo sapiens
ggccctgccca

SEQ ID NO: 2158575 - DNA, 17 bp, Homo sapiens
ggccctgcccctccccc

SEQ ID NO: 2158576 - DNA, 14 bp, Homo sapiens
ggccggccctgccc

SEQ ID NO: 2158577 - DNA, 16 bp, Homo sapiens
ggccggccctgcccct

SEQ ID NO: 2158578 - DNA, 14 bp, Homo sapiens
ggccgtggctccag

SEQ ID NO: 2158579 - DNA, 23 bp, Homo sapiens
ggcctcccttgagtaggccctgc

SEQ ID NO: 2158580 - DNA, 15 bp, Homo sapiens
ggcctcttggcacct

SEQ ID NO: 2158581 - DNA, 21 bp, Homo sapiens
ggcctcttggcacctgcctag

SEQ ID NO: 2158582 - DNA, 22 bp, Homo sapiens
ggcctcttggcacctgcctagc

SEQ ID NO: 2158583 - DNA, 13 bp, Homo sapiens
ggcctgacctcca

SEQ ID NO: 2158584 - DNA, 21 bp, Homo sapiens
ggcctgacctccagtcctgct

SEQ ID NO: 2158585 - DNA, 22 bp, Homo sapiens
ggcctgacctccagtcctgctg

SEQ ID NO: 2158586 - DNA, 21 bp, Homo sapiens
ggcctggatctccccactcta

SEQ ID NO: 2158587 - DNA, 16 bp, Homo sapiens
ggctcagagctttgtc

SEQ ID NO: 2158588 - DNA, 20 bp, Homo sapiens
ggctcagagctttgtcactt

SEQ ID NO: 2158589 - DNA, 13 bp, Homo sapiens
ggctcagctgtgg

SEQ ID NO: 2158590 - DNA, 17 bp, Homo sapiens
ggctccagaatgtgctg

SEQ ID NO: 2158591 - DNA, 15 bp, Homo sapiens
ggctcctccctctgc

SEQ ID NO: 2158592 - DNA, 17 bp, Homo sapiens
ggctcctccctctgcct

SEQ ID NO: 2158593 - DNA, 20 bp, Homo sapiens
ggctcctccctctgcctcat

SEQ ID NO: 2158594 - DNA, 23 bp, Homo sapiens
ggctcctccctctgcctcatcct

SEQ ID NO: 2158595 - DNA, 17 bp, Homo sapiens
ggctcctttctccagcc

SEQ ID NO: 2158596 - DNA, 18 bp, Homo sapiens
ggctcttaactgttgctc

SEQ ID NO: 2158597 - DNA, 15 bp, Homo sapiens
ggctgaacagtgctc

SEQ ID NO: 2158598 - DNA, 16 bp, Homo sapiens
ggctgaacagtgctct

SEQ ID NO: 2158599 - DNA, 17 bp, Homo sapiens
ggctgaacagtgctctg

SEQ ID NO: 2158600 - DNA, 20 bp, Homo sapiens
ggctgaacagtgctctgcct

SEQ ID NO: 2158601 - DNA, 15 bp, Homo sapiens
ggctgagggcatctc

SEQ ID NO: 2158602 - DNA, 18 bp, Homo sapiens
ggctgagggcatctctga

SEQ ID NO: 2158603 - DNA, 14 bp, Homo sapiens
ggctgatttctagg

SEQ ID NO: 2158604 - DNA, 21 bp, Homo sapiens
ggctgccgggttctagtctcc

SEQ ID NO: 2158605 - DNA, 17 bp, Homo sapiens
ggctgctgggggctccc

SEQ ID NO: 2158606 - DNA, 17 bp, Homo sapiens
ggctgggggagggactg

SEQ ID NO: 2158607 - DNA, 19 bp, Homo sapiens
ggctgggtcggccctgccc

SEQ ID NO: 2158608 - DNA, 20 bp, Homo sapiens
ggctggtgaggccggccctg

SEQ ID NO: 2158609 - DNA, 22 bp, Homo sapiens
ggctggtgaggccggccctgcc

SEQ ID NO: 2158610 - DNA, 13 bp, Homo sapiens
gggaagggccagt

SEQ ID NO: 2158611 - DNA, 22 bp, Homo sapiens
gggaagggccagtctgggctgc

SEQ ID NO: 2158612 - DNA, 15 bp, Homo sapiens
gggactgtgcctttg

SEQ ID NO: 2158613 - DNA, 13 bp, Homo sapiens
gggagaaggcctc

SEQ ID NO: 2158614 - DNA, 18 bp, Homo sapiens
gggagaaggcctcccctg

SEQ ID NO: 2158615 - DNA, 14 bp, Homo sapiens
gggagcactggagt

SEQ ID NO: 2158616 - DNA, 19 bp, Homo sapiens
gggagctgaggcctccctt

SEQ ID NO: 2158617 - DNA, 21 bp, Homo sapiens
gggaggagaggggaagggcca

SEQ ID NO: 2158618 - DNA, 12 bp, Homo sapiens
gggagggactgc

SEQ ID NO: 2158619 - DNA, 12 bp, Homo sapiens
gggagggagctg

SEQ ID NO: 2158620 - DNA, 12 bp, Homo sapiens
gggagggatcag

SEQ ID NO: 2158621 - DNA, 15 bp, Homo sapiens
gggatcagccccgcc

SEQ ID NO: 2158622 - DNA, 11 bp, Homo sapiens
gggcactcccc

SEQ ID NO: 2158623 - DNA, 14 bp, Homo sapiens
tatatatgtacagt

SEQ ID NO: 2158624 - DNA, 17 bp, Homo sapiens
tatatatgtacagttat

SEQ ID NO: 2158625 - DNA, 21 bp, Homo sapiens
tatatattctacacatatatg

SEQ ID NO: 2158626 - DNA, 15 bp, Homo sapiens
tatatcagcctgagt

SEQ ID NO: 2158627 - DNA, 13 bp, Homo sapiens
tatatcataaagt

SEQ ID NO: 2158628 - DNA, 18 bp, Homo sapiens
tatatctatatctctaaa

SEQ ID NO: 2158629 - DNA, 17 bp, Homo sapiens
tatatggaaattctgct

SEQ ID NO: 2158630 - DNA, 13 bp, Homo sapiens
tatatgtatatct

SEQ ID NO: 2158631 - DNA, 19 bp, Homo sapiens
tatatttttggttgtcaat

SEQ ID NO: 2158632 - DNA, 17 bp, Homo sapiens
tatcaaccccagacact

SEQ ID NO: 2158633 - DNA, 11 bp, Homo sapiens
tatcataaagt

SEQ ID NO: 2158634 - DNA, 22 bp, Homo sapiens
tatctaagttaatttaaagttg

SEQ ID NO: 2158635 - DNA, 14 bp, Homo sapiens
tatctatatctcta

SEQ ID NO: 2158636 - DNA, 15 bp, Homo sapiens
tatctatatctctaa

SEQ ID NO: 2158637 - DNA, 16 bp, Homo sapiens
tatctctaaactgctg

SEQ ID NO: 2158638 - DNA, 19 bp, Homo sapiens
tatctgagaagtgtatata

SEQ ID NO: 2158639 - DNA, 17 bp, Homo sapiens
tatgattgtttgcacag

SEQ ID NO: 2158640 - DNA, 12 bp, Homo sapiens
tatgtacagtta

SEQ ID NO: 2158641 - DNA, 16 bp, Homo sapiens
tatgtatatgtatatc

SEQ ID NO: 2158642 - DNA, 12 bp, Homo sapiens
tattaaatacag

SEQ ID NO: 2158643 - DNA, 17 bp, Homo sapiens
tattaaatacagacact

SEQ ID NO: 2158644 - DNA, 16 bp, Homo sapiens
tattaaggtgtggctt

SEQ ID NO: 2158645 - DNA, 14 bp, Homo sapiens
tattcagacaagca

SEQ ID NO: 2158646 - DNA, 18 bp, Homo sapiens
tattcagacaagcaacag

SEQ ID NO: 2158647 - DNA, 22 bp, Homo sapiens
tattctacacatatatgtatat

SEQ ID NO: 2158648 - DNA, 13 bp, Homo sapiens
tatttagaatata

SEQ ID NO: 2158649 - DNA, 14 bp, Homo sapiens
tatttatatatatt

SEQ ID NO: 2158650 - DNA, 16 bp, Homo sapiens
tatttcaatgttagcc

SEQ ID NO: 2158651 - DNA, 19 bp, Homo sapiens
tatttccacataaaggtat

SEQ ID NO: 2158652 - DNA, 15 bp, Homo sapiens
tattttagagaatgg

SEQ ID NO: 2158653 - DNA, 14 bp, Homo sapiens
tcaaaaaaacacta

SEQ ID NO: 2158654 - DNA, 14 bp, Homo sapiens
tcaaatctattcag

SEQ ID NO: 2158655 - DNA, 15 bp, Homo sapiens
tcaaatctattcaga

SEQ ID NO: 2158656 - DNA, 15 bp, Homo sapiens
tcaagagtctctcca

SEQ ID NO: 2158657 - DNA, 16 bp, Homo sapiens
tcaagagtctctccag

SEQ ID NO: 2158658 - DNA, 19 bp, Homo sapiens
tcaagagtctctccagcct

SEQ ID NO: 2158659 - DNA, 21 bp, Homo sapiens
tcaagagtctctccagcctca

SEQ ID NO: 2158660 - DNA, 14 bp, Homo sapiens
tcaatattaaatac

SEQ ID NO: 2158661 - DNA, 16 bp, Homo sapiens
tcaatattaaatacag

SEQ ID NO: 2158662 - DNA, 21 bp, Homo sapiens
tcaatattaaatacagacact

SEQ ID NO: 2158663 - DNA, 22 bp, Homo sapiens
tcaatattaaatacagacacta

SEQ ID NO: 2158664 - DNA, 24 bp, Homo sapiens
tcacactccagaattacccttcct

SEQ ID NO: 2158665 - DNA, 16 bp, Homo sapiens
tcacactcctcctgcc

SEQ ID NO: 2158666 - DNA, 21 bp, Homo sapiens
tcacactcctcctgccagctc

SEQ ID NO: 2158667 - DNA, 15 bp, Homo sapiens
tcacagactcttcca

SEQ ID NO: 2158668 - DNA, 21 bp, Homo sapiens
tcacagatgctggcctcttgg

SEQ ID NO: 2158669 - DNA, 22 bp, Homo sapiens
tcacagatgctggcctcttggc

SEQ ID NO: 2158670 - DNA, 16 bp, Homo sapiens
tcacagcctctccctt

SEQ ID NO: 2158671 - DNA, 14 bp, Homo sapiens
tcacatctctgcct

SEQ ID NO: 2158672 - DNA, 13 bp, Homo sapiens
tcaccatgcaagg

SEQ ID NO: 2158673 - DNA, 17 bp, Homo sapiens
tcacccagctaatctgt

SEQ ID NO: 2158674 - DNA, 13 bp, Homo sapiens
tcacctggaagca

SEQ ID NO: 2158675 - DNA, 10 bp, Homo sapiens
tcactcctgt

SEQ ID NO: 2158676 - DNA, 14 bp, Homo sapiens
tcacttgccacatg

SEQ ID NO: 2158677 - DNA, 19 bp, Homo sapiens
tcacttttaatgaacaaat

SEQ ID NO: 2158678 - DNA, 22 bp, Homo sapiens
tcagaaactcgatgaatgtgtt

SEQ ID NO: 2158679 - DNA, 18 bp, Homo sapiens
tcagaagtaactcccact

SEQ ID NO: 2158680 - DNA, 22 bp, Homo sapiens
tcagaagtaactcccactccta

SEQ ID NO: 2158681 - DNA, 17 bp, Homo sapiens
tcagaattgaaggagaa

SEQ ID NO: 2158682 - DNA, 16 bp, Homo sapiens
tcagagctgcgggctg

SEQ ID NO: 2158683 - DNA, 17 bp, Homo sapiens
tcagagctttgtcactt

SEQ ID NO: 2158684 - DNA, 17 bp, Homo sapiens
tcagcagccccctgccc

SEQ ID NO: 2158685 - DNA, 18 bp, Homo sapiens
tcagccccgcctgtcaca

SEQ ID NO: 2158686 - DNA, 20 bp, Homo sapiens
tcagccccgcctgtcacaat

SEQ ID NO: 2158687 - DNA, 23 bp, Homo sapiens
tcagccccgcctgtcacaataaa

SEQ ID NO: 2158688 - DNA, 18 bp, Homo sapiens
tcagccgagccgggcctg

SEQ ID NO: 2158689 - DNA, 11 bp, Homo sapiens
tcagcctgagt

SEQ ID NO: 2158690 - DNA, 15 bp, Homo sapiens
tcagcctgagtctcc

SEQ ID NO: 2158691 - DNA, 20 bp, Homo sapiens
tcaggctccattaggatttg

SEQ ID NO: 2158692 - DNA, 14 bp, Homo sapiens
tcatcctcctcctc

SEQ ID NO: 2158693 - DNA, 15 bp, Homo sapiens
tcatttttccgtaaa

SEQ ID NO: 2158694 - DNA, 15 bp, Homo sapiens
tccaacccctccccc

SEQ ID NO: 2158695 - DNA, 17 bp, Homo sapiens
tccaacccctcccccac

SEQ ID NO: 2158696 - DNA, 16 bp, Homo sapiens
tccaagtctctctgtg

SEQ ID NO: 2158697 - DNA, 20 bp, Homo sapiens
tccaagtctctctgtgaata

SEQ ID NO: 2158698 - DNA, 14 bp, Homo sapiens
tccacataaaggta

SEQ ID NO: 2158699 - DNA, 18 bp, Homo sapiens
tccaccagagcaggggct

SEQ ID NO: 2158700 - DNA, 20 bp, Homo sapiens
tccaccagagcaggggctgc

SEQ ID NO: 2158701 - DNA, 22 bp, Homo sapiens
tccaccagagcaggggctgctg

SEQ ID NO: 2158702 - DNA, 23 bp, Homo sapiens
tccaccagagcaggggctgctgg

SEQ ID NO: 2158703 - DNA, 18 bp, Homo sapiens
tccactgccaaaacaatg

SEQ ID NO: 2158704 - DNA, 19 bp, Homo sapiens
tccagaagaatattcagga

SEQ ID NO: 2158705 - DNA, 21 bp, Homo sapiens
tccagaagaatattcaggact

SEQ ID NO: 2158706 - DNA, 15 bp, Homo sapiens
tccagaatgtgctgc

SEQ ID NO: 2158707 - DNA, 20 bp, Homo sapiens
tccagaattacccttcctca

SEQ ID NO: 2158708 - DNA, 19 bp, Homo sapiens
tccagcctcacagatgctg

SEQ ID NO: 2158709 - DNA, 16 bp, Homo sapiens
tccaggcttctcccgg

SEQ ID NO: 2158710 - DNA, 22 bp, Homo sapiens
tccaggcttctcccggacctgg

SEQ ID NO: 2158711 - DNA, 14 bp, Homo sapiens
tccagtcctgctgg

SEQ ID NO: 2158712 - DNA, 18 bp, Homo sapiens
tccagtcctgctggcctg

SEQ ID NO: 2158713 - DNA, 20 bp, Homo sapiens
tccagtcctgctggcctgct

SEQ ID NO: 2158714 - DNA, 12 bp, Homo sapiens
tccataaagtaa

SEQ ID NO: 2158715 - DNA, 14 bp, Homo sapiens
tccatgcaagtgct

SEQ ID NO: 2158716 - DNA, 13 bp, Homo sapiens
tccatttggcaga

SEQ ID NO: 2158717 - DNA, 20 bp, Homo sapiens
tccatttggcagaactgctg

SEQ ID NO: 2158718 - DNA, 22 bp, Homo sapiens
tccatttggcagaactgctggg

SEQ ID NO: 2158719 - DNA, 23 bp, Homo sapiens
tccatttggcagaactgctgggg

SEQ ID NO: 2158720 - DNA, 16 bp, Homo sapiens
tcccaacatgggaggg

SEQ ID NO: 2158721 - DNA, 19 bp, Homo sapiens
tcccacggggaccactggg

SEQ ID NO: 2158722 - DNA, 21 bp, Homo sapiens
tcccacggggaccactgggcc

SEQ ID NO: 2158723 - DNA, 18 bp, Homo sapiens
tcccactaagctttctcc

SEQ ID NO: 2158724 - DNA, 20 bp, Homo sapiens
tcccactaagctttctcctt

SEQ ID NO: 2158725 - DNA, 13 bp, Homo sapiens
tcccactcctaat

SEQ ID NO: 2158726 - DNA, 23 bp, Homo sapiens
tcccactcctaatcaagagtctc

SEQ ID NO: 2158727 - DNA, 16 bp, Homo sapiens
tcccagtcctccagac

SEQ ID NO: 2158728 - DNA, 13 bp, Homo sapiens
tcccatggccttc

SEQ ID NO: 2158729 - DNA, 14 bp, Homo sapiens
tcccatggccttcc

SEQ ID NO: 2158730 - DNA, 15 bp, Homo sapiens
tcccatggccttccc

SEQ ID NO: 2158731 - DNA, 20 bp, Homo sapiens
tccccaatccatttggcaga

SEQ ID NO: 2158732 - DNA, 20 bp, Homo sapiens
tccccacagtcctcacagcc

SEQ ID NO: 2158733 - DNA, 17 bp, Homo sapiens
tgtccaacccctccccc

SEQ ID NO: 2158734 - DNA, 20 bp, Homo sapiens
tgtccaacccctcccccacg

SEQ ID NO: 2158735 - DNA, 21 bp, Homo sapiens
tgtccaacccctcccccacgt

SEQ ID NO: 2158736 - DNA, 12 bp, Homo sapiens
tgtccataaagt

SEQ ID NO: 2158737 - DNA, 14 bp, Homo sapiens
tgtcccctcacaga

SEQ ID NO: 2158738 - DNA, 17 bp, Homo sapiens
tgtcccctcacagactc

SEQ ID NO: 2158739 - DNA, 13 bp, Homo sapiens
tgtcccctggggc

SEQ ID NO: 2158740 - DNA, 15 bp, Homo sapiens
tgtcccctggggctg

SEQ ID NO: 2158741 - DNA, 14 bp, Homo sapiens
tgtccctggggcac

SEQ ID NO: 2158742 - DNA, 15 bp, Homo sapiens
tgtccctggggcact

SEQ ID NO: 2158743 - DNA, 20 bp, Homo sapiens
tgtcctaaggacacactaat

SEQ ID NO: 2158744 - DNA, 23 bp, Homo sapiens
tgtcctcttgctcaaaaatctgt

SEQ ID NO: 2158745 - DNA, 23 bp, Homo sapiens
tgtcctgttattttttatttcca

SEQ ID NO: 2158746 - DNA, 15 bp, Homo sapiens
tgtccttactcagag

SEQ ID NO: 2158747 - DNA, 17 bp, Homo sapiens
tgtccttactcagagct

SEQ ID NO: 2158748 - DNA, 14 bp, Homo sapiens
tgtcgattagactg

SEQ ID NO: 2158749 - DNA, 23 bp, Homo sapiens
tgtcgattagactggacagcttg

SEQ ID NO: 2158750 - DNA, 10 bp, Homo sapiens
tgtctcccaa

SEQ ID NO: 2158751 - DNA, 17 bp, Homo sapiens
tgtctcccaacatggga

SEQ ID NO: 2158752 - DNA, 20 bp, Homo sapiens
tgtctcccaacatgggaggg

SEQ ID NO: 2158753 - DNA, 21 bp, Homo sapiens
tgtctgatcgttcaaagcatg

SEQ ID NO: 2158754 - DNA, 18 bp, Homo sapiens
tgtctgtccaacccctcc

SEQ ID NO: 2158755 - DNA, 22 bp, Homo sapiens
tgtctgtccaacccctccccca

SEQ ID NO: 2158756 - DNA, 20 bp, Homo sapiens
tgtcttcctagtatattagt

SEQ ID NO: 2158757 - DNA, 23 bp, Homo sapiens
tgtgaaattcaacctgtgtctta

SEQ ID NO: 2158758 - DNA, 12 bp, Homo sapiens
tgtgaatacaat

SEQ ID NO: 2158759 - DNA, 15 bp, Homo sapiens
tgtgaatacaattaa

SEQ ID NO: 2158760 - DNA, 17 bp, Homo sapiens
tgtgcccacatcccagg

SEQ ID NO: 2158761 - DNA, 20 bp, Homo sapiens
tgtgcccacatcccaggctt

SEQ ID NO: 2158762 - DNA, 17 bp, Homo sapiens
tgtgcctttgggaggca

SEQ ID NO: 2158763 - DNA, 11 bp, Homo sapiens
tgtgctcccac

SEQ ID NO: 2158764 - DNA, 13 bp, Homo sapiens
tgtgctcccacgg

SEQ ID NO: 2158765 - DNA, 14 bp, Homo sapiens
tgtgctcccacggg

SEQ ID NO: 2158766 - DNA, 14 bp, Homo sapiens
tgtggcaagtgaat

SEQ ID NO: 2158767 - DNA, 13 bp, Homo sapiens
tgtgtaccacacc

SEQ ID NO: 2158768 - DNA, 15 bp, Homo sapiens
tgttaagacttgaca

SEQ ID NO: 2158769 - DNA, 22 bp, Homo sapiens
tgttactaaagtcacatataaa

SEQ ID NO: 2158770 - DNA, 19 bp, Homo sapiens
tgttagcctcaatttctga

SEQ ID NO: 2158771 - DNA, 22 bp, Homo sapiens
tgttatttttatatcagcctga

SEQ ID NO: 2158772 - DNA, 21 bp, Homo sapiens
tgttattttttatttccacat

SEQ ID NO: 2158773 - DNA, 17 bp, Homo sapiens
tgtttctactttgatat

SEQ ID NO: 2158774 - DNA, 23 bp, Homo sapiens
tgtttgcacctttctagttgaaa

SEQ ID NO: 2158775 - DNA, 18 bp, Homo sapiens
ttaaaaaaagtatatatt

SEQ ID NO: 2158776 - DNA, 22 bp, Homo sapiens
ttaaaattaaagtatacatttt

SEQ ID NO: 2158777 - DNA, 16 bp, Homo sapiens
ttaaaggtcctgccct

SEQ ID NO: 2158778 - DNA, 17 bp, Homo sapiens
ttaagacttgacagtgg

SEQ ID NO: 2158779 - DNA, 21 bp, Homo sapiens
ttacccagagaatatatacat

SEQ ID NO: 2158780 - DNA, 14 bp, Homo sapiens
ttacccttcctcat

SEQ ID NO: 2158781 - DNA, 21 bp, Homo sapiens
ttacccttcctcatctgtgcc

SEQ ID NO: 2158782 - DNA, 23 bp, Homo sapiens
ttacccttcctcatctgtgcctg

SEQ ID NO: 2158783 - DNA, 16 bp, Homo sapiens
ttacctaaacagatat

SEQ ID NO: 2158784 - DNA, 17 bp, Homo sapiens
ttactgacagaaatgca

SEQ ID NO: 2158785 - DNA, 12 bp, Homo sapiens
ttacttccccca

SEQ ID NO: 2158786 - DNA, 17 bp, Homo sapiens
ttacttcccccaccctg

SEQ ID NO: 2158787 - DNA, 17 bp, Homo sapiens
ttagaaacatggttttg

SEQ ID NO: 2158788 - DNA, 12 bp, Homo sapiens
ttagaatatatt

SEQ ID NO: 2158789 - DNA, 15 bp, Homo sapiens
ttagactggaacttg

SEQ ID NO: 2158790 - DNA, 16 bp, Homo sapiens
ttagactggaacttga

SEQ ID NO: 2158791 - DNA, 15 bp, Homo sapiens
ttagactggacagct

SEQ ID NO: 2158792 - DNA, 17 bp, Homo sapiens
ttagactggacagcttg

SEQ ID NO: 2158793 - DNA, 19 bp, Homo sapiens
ttagactggacagcttgtg

SEQ ID NO: 2158794 - DNA, 21 bp, Homo sapiens
ttagacttcgactcaggatcc

SEQ ID NO: 2158795 - DNA, 19 bp, Homo sapiens
ttagtttgatttaatatct

SEQ ID NO: 2158796 - DNA, 13 bp, Homo sapiens
ttatatatcataa

SEQ ID NO: 2158797 - DNA, 14 bp, Homo sapiens
ttatatatcataaa

SEQ ID NO: 2158798 - DNA, 14 bp, Homo sapiens
ttatatggaaattc

SEQ ID NO: 2158799 - DNA, 21 bp, Homo sapiens
ttattcatgctttctcctttt

SEQ ID NO: 2158800 - DNA, 14 bp, Homo sapiens
ttatttaaatctgt

SEQ ID NO: 2158801 - DNA, 14 bp, Homo sapiens
ttatttgttgagag

SEQ ID NO: 2158802 - DNA, 19 bp, Homo sapiens
ttatttgttgagagtgtga

SEQ ID NO: 2158803 - DNA, 13 bp, Homo sapiens
ttcacatctcatt

SEQ ID NO: 2158804 - DNA, 14 bp, Homo sapiens
ttcactaccaaatg

SEQ ID NO: 2158805 - DNA, 22 bp, Homo sapiens
ttcagaattgaaggagaaaatg

SEQ ID NO: 2158806 - DNA, 20 bp, Homo sapiens
ttcagacaagcaacaggttt

SEQ ID NO: 2158807 - DNA, 21 bp, Homo sapiens
ttcagacaagcaacaggtttt

SEQ ID NO: 2158808 - DNA, 18 bp, Homo sapiens
ttcagctattagcaactg

SEQ ID NO: 2158809 - DNA, 21 bp, Homo sapiens
ttcaggacttaacggctccag

SEQ ID NO: 2158810 - DNA, 16 bp, Homo sapiens
ttccaaacctgacaga

SEQ ID NO: 2158811 - DNA, 13 bp, Homo sapiens
ttccacataaagg

SEQ ID NO: 2158812 - DNA, 15 bp, Homo sapiens
ttccaccagagcagg

SEQ ID NO: 2158813 - DNA, 19 bp, Homo sapiens
ttccactgccaaaacaatg

SEQ ID NO: 2158814 - DNA, 16 bp, Homo sapiens
ttccatgcctgagggt

SEQ ID NO: 2158815 - DNA, 18 bp, Homo sapiens
ttccatgcctgagggtgg

SEQ ID NO: 2158816 - DNA, 20 bp, Homo sapiens
ttcccactaagctttctcct

SEQ ID NO: 2158817 - DNA, 14 bp, Homo sapiens
ttcccccatcccta

SEQ ID NO: 2158818 - DNA, 12 bp, Homo sapiens
ttccctgctttg

SEQ ID NO: 2158819 - DNA, 14 bp, Homo sapiens
ttcctagtatatta

SEQ ID NO: 2158820 - DNA, 13 bp, Homo sapiens
ttcctcatctgtg

SEQ ID NO: 2158821 - DNA, 20 bp, Homo sapiens
ttccttttgcaacaagacaa

SEQ ID NO: 2158822 - DNA, 19 bp, Homo sapiens
ttcggacagtttatttgtt

SEQ ID NO: 2158823 - DNA, 18 bp, Homo sapiens
ttctacacatatatgtat

SEQ ID NO: 2158824 - DNA, 21 bp, Homo sapiens
ttctacctttttttctctcct

SEQ ID NO: 2158825 - DNA, 19 bp, Homo sapiens
ttctactttgatatgactg

SEQ ID NO: 2158826 - DNA, 18 bp, Homo sapiens
ttctaggtaggaaatgtg

SEQ ID NO: 2158827 - DNA, 14 bp, Homo sapiens
ttctagttgaaaat

SEQ ID NO: 2158828 - DNA, 21 bp, Homo sapiens
ttctgattcgaatgacactgt

SEQ ID NO: 2158829 - DNA, 15 bp, Homo sapiens
ttctgctggcctgga

SEQ ID NO: 2158830 - DNA, 21 bp, Homo sapiens
ttcttcacccagctaatctgt

SEQ ID NO: 2158831 - DNA, 15 bp, Homo sapiens
ttgaaaacccctggc

SEQ ID NO: 2158832 - DNA, 15 bp, Homo sapiens
ttgaagaatgttaag

SEQ ID NO: 2158833 - DNA, 18 bp, Homo sapiens
ttgaatgtaagaacatga

SEQ ID NO: 2158834 - DNA, 20 bp, Homo sapiens
ttgagaaggaaaattttagc

SEQ ID NO: 2158835 - DNA, 15 bp, Homo sapiens
ttgagagtgtgacca

SEQ ID NO: 2158836 - DNA, 21 bp, Homo sapiens
ttgaggcaaaggccagcagca

SEQ ID NO: 2158837 - DNA, 21 bp, Homo sapiens
ttgatccctgttacccagaga

SEQ ID NO: 2158838 - DNA, 15 bp, Homo sapiens
ttgcacctttctagt

SEQ ID NO: 2158839 - DNA, 12 bp, Homo sapiens
ttgcactgaggg

SEQ ID NO: 2158840 - DNA, 18 bp, Homo sapiens
ttgcaggggactgggcca

SEQ ID NO: 2158841 - DNA, 22 bp, Homo sapiens
ttgcccacacacactccttccc

SEQ ID NO: 2158842 - DNA, 23 bp, Homo sapiens
ttgcccacacacactccttcccc

SEQ ID NO: 2158843 - DNA, 14 bp, Homo sapiens
aagcaacaggtttt

SEQ ID NO: 2158844 - DNA, 13 bp, Homo sapiens
aagcatcctcccc

SEQ ID NO: 2158845 - DNA, 14 bp, Homo sapiens
aagcatcctcccca

SEQ ID NO: 2158846 - DNA, 23 bp, Homo sapiens
aagcatcctccccaccagagctg

SEQ ID NO: 2158847 - DNA, 16 bp, Homo sapiens
aagccaccgcagctgc

SEQ ID NO: 2158848 - DNA, 21 bp, Homo sapiens
aagccaccgcagctgctgcca

SEQ ID NO: 2158849 - DNA, 23 bp, Homo sapiens
aagccagattttttaaaatttat

SEQ ID NO: 2158850 - DNA, 20 bp, Homo sapiens
aagccctgtcgagacacttg

SEQ ID NO: 2158851 - DNA, 19 bp, Homo sapiens
aagctctgaacaaaagctt

SEQ ID NO: 2158852 - DNA, 12 bp, Homo sapiens
aagctttctcct

SEQ ID NO: 2158853 - DNA, 21 bp, Homo sapiens
aaggacaacctgcccctcccc

SEQ ID NO: 2158854 - DNA, 20 bp, Homo sapiens
aaggagaaaatgcattatgt

SEQ ID NO: 2158855 - DNA, 22 bp, Homo sapiens
aaggatctctcaggagcacagg

SEQ ID NO: 2158856 - DNA, 13 bp, Homo sapiens
aaggcctcccctg

SEQ ID NO: 2158857 - DNA, 15 bp, Homo sapiens
aagggagggagctga

SEQ ID NO: 2158858 - DNA, 18 bp, Homo sapiens
aagggccagtctgggctg

SEQ ID NO: 2158859 - DNA, 18 bp, Homo sapiens
aaggtctcacactcctcc

SEQ ID NO: 2158860 - DNA, 19 bp, Homo sapiens
aagtaactcccactcctaa

SEQ ID NO: 2158861 - DNA, 13 bp, Homo sapiens
aagtctctctgtg

SEQ ID NO: 2158862 - DNA, 16 bp, Homo sapiens
aagttacatgtttgca

SEQ ID NO: 2158863 - DNA, 17 bp, Homo sapiens
aagttatagtatatctg

SEQ ID NO: 2158864 - DNA, 16 bp, Homo sapiens
aatacaattaaaggtc

SEQ ID NO: 2158865 - DNA, 14 bp, Homo sapiens
aatagtcagagtgt

SEQ ID NO: 2158866 - DNA, 20 bp, Homo sapiens
aatatctgagaagtgtatat

SEQ ID NO: 2158867 - DNA, 21 bp, Homo sapiens
aatatgcctgctatttgaagt

SEQ ID NO: 2158868 - DNA, 16 bp, Homo sapiens
aatattaaatacagac

SEQ ID NO: 2158869 - DNA, 17 bp, Homo sapiens
aatattaaatacagaca

SEQ ID NO: 2158870 - DNA, 9 bp, Homo sapiens
aatattgtg

SEQ ID NO: 2158871 - DNA, 20 bp, Homo sapiens
aatcaagagtctctccagcc

SEQ ID NO: 2158872 - DNA, 23 bp, Homo sapiens
aatcaagagtctctccagcctca

SEQ ID NO: 2158873 - DNA, 13 bp, Homo sapiens
aatcctgggcccc

SEQ ID NO: 2158874 - DNA, 19 bp, Homo sapiens
aatcctgggcccccagaga

SEQ ID NO: 2158875 - DNA, 20 bp, Homo sapiens
aatcctgtcgattagactgg

SEQ ID NO: 2158876 - DNA, 18 bp, Homo sapiens
aatctattcagacaagca

SEQ ID NO: 2158877 - DNA, 18 bp, Homo sapiens
aatctggcaaagttatat

SEQ ID NO: 2158878 - DNA, 15 bp, Homo sapiens
aatctgtagggctgg

SEQ ID NO: 2158879 - DNA, 16 bp, Homo sapiens
aatctgtagggctgga

SEQ ID NO: 2158880 - DNA, 15 bp, Homo sapiens
aatctgtttttctaa

SEQ ID NO: 2158881 - DNA, 21 bp, Homo sapiens
aatctttctttacctgagacc

SEQ ID NO: 2158882 - DNA, 11 bp, Homo sapiens
aatgacactgt

SEQ ID NO: 2158883 - DNA, 14 bp, Homo sapiens
aatgagcattagct

SEQ ID NO: 2158884 - DNA, 20 bp, Homo sapiens
aatgcttgtggattgagggt

SEQ ID NO: 2158885 - DNA, 12 bp, Homo sapiens
aatgctttgata

SEQ ID NO: 2158886 - DNA, 13 bp, Homo sapiens
aatggcctttatt

SEQ ID NO: 2158887 - DNA, 17 bp, Homo sapiens
aatggtgttactaaagt

SEQ ID NO: 2158888 - DNA, 18 bp, Homo sapiens
aatggtgttactaaagtc

SEQ ID NO: 2158889 - DNA, 16 bp, Homo sapiens
aatgtggtagcctcac

SEQ ID NO: 2158890 - DNA, 18 bp, Homo sapiens
aattaaaggtcctgccct

SEQ ID NO: 2158891 - DNA, 15 bp, Homo sapiens
aattacccttcctca

SEQ ID NO: 2158892 - DNA, 17 bp, Homo sapiens
aattcaacctgtgtctt

SEQ ID NO: 2158893 - DNA, 16 bp, Homo sapiens
aattctgctcagatag

SEQ ID NO: 2158894 - DNA, 16 bp, Homo sapiens
aatttatattgtaaat

SEQ ID NO: 2158895 - DNA, 16 bp, Homo sapiens
aatttgcctgtaacaa

SEQ ID NO: 2158896 - DNA, 18 bp, Homo sapiens
aattttactgacagaaat

SEQ ID NO: 2158897 - DNA, 15 bp, Homo sapiens
aatttttttattact

SEQ ID NO: 2158898 - DNA, 18 bp, Homo sapiens
acaaagagaataaagact

SEQ ID NO: 2158899 - DNA, 21 bp, Homo sapiens
acaaagcttctatcccaggag

SEQ ID NO: 2158900 - DNA, 14 bp, Homo sapiens
acaaatggccttta

SEQ ID NO: 2158901 - DNA, 15 bp, Homo sapiens
acaacctgcccctcc

SEQ ID NO: 2158902 - DNA, 16 bp, Homo sapiens
acaagttatttaaatc

SEQ ID NO: 2158903 - DNA, 22 bp, Homo sapiens
acaagttatttaaatctgtttt

SEQ ID NO: 2158904 - DNA, 19 bp, Homo sapiens
acacaccccacaccccagc

SEQ ID NO: 2158905 - DNA, 13 bp, Homo sapiens
acacactcagcag

SEQ ID NO: 2158906 - DNA, 12 bp, Homo sapiens
acacactccttc

SEQ ID NO: 2158907 - DNA, 17 bp, Homo sapiens
acaccctgcctgctgtg

SEQ ID NO: 2158908 - DNA, 19 bp, Homo sapiens
acactagttttgtgccagc

SEQ ID NO: 2158909 - DNA, 23 bp, Homo sapiens
acactccagaattacccttcctc

SEQ ID NO: 2158910 - DNA, 13 bp, Homo sapiens
acactcctcctgc

SEQ ID NO: 2158911 - DNA, 14 bp, Homo sapiens
acactcctcctgcc

SEQ ID NO: 2158912 - DNA, 18 bp, Homo sapiens
acactccttccccttgtc

SEQ ID NO: 2158913 - DNA, 20 bp, Homo sapiens
acacttgccttcttcaccca

SEQ ID NO: 2158914 - DNA, 21 bp, Homo sapiens
acagactcttccaccagagca

SEQ ID NO: 2158915 - DNA, 15 bp, Homo sapiens
acagagggcgctcct

SEQ ID NO: 2158916 - DNA, 16 bp, Homo sapiens
acagcccccaccccag

SEQ ID NO: 2158917 - DNA, 19 bp, Homo sapiens
acagcccccaccccagcac

SEQ ID NO: 2158918 - DNA, 13 bp, Homo sapiens
acagcctctccct

SEQ ID NO: 2158919 - DNA, 14 bp, Homo sapiens
acagctcctcccct

SEQ ID NO: 2158920 - DNA, 17 bp, Homo sapiens
acagctcctcccctgcc

SEQ ID NO: 2158921 - DNA, 20 bp, Homo sapiens
acagtgacgtgactcagagc

SEQ ID NO: 2158922 - DNA, 15 bp, Homo sapiens
acagtgctctgcctc

SEQ ID NO: 2158923 - DNA, 17 bp, Homo sapiens
acagtgctctgcctcta

SEQ ID NO: 2158924 - DNA, 16 bp, Homo sapiens
acagtggaactacatt

SEQ ID NO: 2158925 - DNA, 23 bp, Homo sapiens
acagttatctaagttaatttaaa

SEQ ID NO: 2158926 - DNA, 14 bp, Homo sapiens
acatatatgtatat

SEQ ID NO: 2158927 - DNA, 23 bp, Homo sapiens
acatatatgtatatgtatatcta

SEQ ID NO: 2158928 - DNA, 20 bp, Homo sapiens
acatcagaagtaactcccac

SEQ ID NO: 2158929 - DNA, 12 bp, Homo sapiens
acatctcatttt

SEQ ID NO: 2158930 - DNA, 17 bp, Homo sapiens
acatggagactcctgcc

SEQ ID NO: 2158931 - DNA, 21 bp, Homo sapiens
acatggagactcctgccctgt

SEQ ID NO: 2158932 - DNA, 21 bp, Homo sapiens
acatggctgggggagggactg

SEQ ID NO: 2158933 - DNA, 12 bp, Homo sapiens
acatgggaggga

SEQ ID NO: 2158934 - DNA, 15 bp, Homo sapiens
acatgggagggatca

SEQ ID NO: 2158935 - DNA, 19 bp, Homo sapiens
acatgggagggatcagccc

SEQ ID NO: 2158936 - DNA, 11 bp, Homo sapiens
acattgtgcca

SEQ ID NO: 2158937 - DNA, 16 bp, Homo sapiens
accaaagagtctctgg

SEQ ID NO: 2158938 - DNA, 17 bp, Homo sapiens
accaaagagtctctggc

SEQ ID NO: 2158939 - DNA, 19 bp, Homo sapiens
accaaggtctcacactcct

SEQ ID NO: 2158940 - DNA, 20 bp, Homo sapiens
accaaggtctcacactcctc

SEQ ID NO: 2158941 - DNA, 15 bp, Homo sapiens
accacctcactcctg

SEQ ID NO: 2158942 - DNA, 16 bp, Homo sapiens
accacctcactcctgt

SEQ ID NO: 2158943 - DNA, 13 bp, Homo sapiens
accactgggcccc

SEQ ID NO: 2158944 - DNA, 14 bp, Homo sapiens
accactgggcccct

SEQ ID NO: 2158945 - DNA, 16 bp, Homo sapiens
accactgggcccctca

SEQ ID NO: 2158946 - DNA, 17 bp, Homo sapiens
accagagcaggggctgc

SEQ ID NO: 2158947 - DNA, 11 bp, Homo sapiens
accagagctgc

SEQ ID NO: 2158948 - DNA, 14 bp, Homo sapiens
accagcccggcctg

SEQ ID NO: 2158949 - DNA, 21 bp, Homo sapiens
accagcccggcctgctcccag

SEQ ID NO: 2158950 - DNA, 15 bp, Homo sapiens
accagcccttccctg

SEQ ID NO: 2158951 - DNA, 18 bp, Homo sapiens
accagcccttccctgctt

SEQ ID NO: 2158952 - DNA, 15 bp, Homo sapiens
accagttgggagcac

SEQ ID NO: 2158953 - DNA, 18 bp, Homo sapiens
accagttgggagcactgg

SEQ ID NO: 2158954 - DNA, 22 bp, Homo sapiens
agtttccaaagggcagtaaagt

SEQ ID NO: 2158955 - DNA, 19 bp, Homo sapiens
agtttgtggtaaaaagatt

SEQ ID NO: 2158956 - DNA, 16 bp, Homo sapiens
ataaagacttcatgtt

SEQ ID NO: 2158957 - DNA, 19 bp, Homo sapiens
ataatggtgttactaaagt

SEQ ID NO: 2158958 - DNA, 21 bp, Homo sapiens
ataatggtgttactaaagtca

SEQ ID NO: 2158959 - DNA, 22 bp, Homo sapiens
atacaattaaaggtcctgccct

SEQ ID NO: 2158960 - DNA, 12 bp, Homo sapiens
atacagacacta

SEQ ID NO: 2158961 - DNA, 14 bp, Homo sapiens
atacagacactaag

SEQ ID NO: 2158962 - DNA, 15 bp, Homo sapiens
atacagacactaagt

SEQ ID NO: 2158963 - DNA, 19 bp, Homo sapiens
atacttatatggaaattct

SEQ ID NO: 2158964 - DNA, 23 bp, Homo sapiens
ataggtagaatgtaaagcttgtc

SEQ ID NO: 2158965 - DNA, 15 bp, Homo sapiens
atagtatatctggac

SEQ ID NO: 2158966 - DNA, 17 bp, Homo sapiens
atagtatatctggacaa

SEQ ID NO: 2158967 - DNA, 20 bp, Homo sapiens
atataaaagttaaactactt

SEQ ID NO: 2158968 - DNA, 15 bp, Homo sapiens
atataaatggctggt

SEQ ID NO: 2158969 - DNA, 17 bp, Homo sapiens
atatagctgatcagttt

SEQ ID NO: 2158970 - DNA, 14 bp, Homo sapiens
atatatatatatgt

SEQ ID NO: 2158971 - DNA, 15 bp, Homo sapiens
atatatatatgtaca

SEQ ID NO: 2158972 - DNA, 15 bp, Homo sapiens
atatatatgtacagt

SEQ ID NO: 2158973 - DNA, 14 bp, Homo sapiens
atatatgtacagtt

SEQ ID NO: 2158974 - DNA, 14 bp, Homo sapiens
atatcagcctgagt

SEQ ID NO: 2158975 - DNA, 20 bp, Homo sapiens
atatcagcctgagtctcctg

SEQ ID NO: 2158976 - DNA, 12 bp, Homo sapiens
atatcataaagt

SEQ ID NO: 2158977 - DNA, 13 bp, Homo sapiens
atatcataaagta

SEQ ID NO: 2158978 - DNA, 13 bp, Homo sapiens
atatctatatctc

SEQ ID NO: 2158979 - DNA, 18 bp, Homo sapiens
atatctgagaagtgtata

SEQ ID NO: 2158980 - DNA, 22 bp, Homo sapiens
atatgactgtttttcggacagt

SEQ ID NO: 2158981 - DNA, 14 bp, Homo sapiens
atatgtatatctat

SEQ ID NO: 2158982 - DNA, 19 bp, Homo sapiens
atattaaatacagacacta

SEQ ID NO: 2158983 - DNA, 22 bp, Homo sapiens
atattctacacatatatgtata

SEQ ID NO: 2158984 - DNA, 15 bp, Homo sapiens
atatttatatatatt

SEQ ID NO: 2158985 - DNA, 21 bp, Homo sapiens
atatttttggttgtcaatatt

SEQ ID NO: 2158986 - DNA, 12 bp, Homo sapiens
atcaagagtctc

SEQ ID NO: 2158987 - DNA, 16 bp, Homo sapiens
atcaagagtctctcca

SEQ ID NO: 2158988 - DNA, 21 bp, Homo sapiens
atcaccagcccggcctgctcc

SEQ ID NO: 2158989 - DNA, 17 bp, Homo sapiens
atcagaagtaactccca

SEQ ID NO: 2158990 - DNA, 19 bp, Homo sapiens
atcagaagtaactcccact

SEQ ID NO: 2158991 - DNA, 21 bp, Homo sapiens
atcagaagtaactcccactcc

SEQ ID NO: 2158992 - DNA, 15 bp, Homo sapiens
atcagatagcatctt

SEQ ID NO: 2158993 - DNA, 13 bp, Homo sapiens
atcagccccgcct

SEQ ID NO: 2158994 - DNA, 17 bp, Homo sapiens
atcagccccgcctgtca

SEQ ID NO: 2158995 - DNA, 20 bp, Homo sapiens
atcagccccgcctgtcacaa

SEQ ID NO: 2158996 - DNA, 23 bp, Homo sapiens
atcagccccgcctgtcacaataa

SEQ ID NO: 2158997 - DNA, 20 bp, Homo sapiens
atcagcctgagtctcctgtg

SEQ ID NO: 2158998 - DNA, 12 bp, Homo sapiens
atcataaagtat

SEQ ID NO: 2158999 - DNA, 18 bp, Homo sapiens
atccatttggcagaactg

SEQ ID NO: 2159000 - DNA, 22 bp, Homo sapiens
atccatttggcagaactgctgg

SEQ ID NO: 2159001 - DNA, 23 bp, Homo sapiens
atcccctgtcccctggggctggt

SEQ ID NO: 2159002 - DNA, 19 bp, Homo sapiens
atccccttcccccatccct

SEQ ID NO: 2159003 - DNA, 14 bp, Homo sapiens
atccctaccactgt

SEQ ID NO: 2159004 - DNA, 16 bp, Homo sapiens
atccctaccactgtgg

SEQ ID NO: 2159005 - DNA, 17 bp, Homo sapiens
atcctccccaccagagc

SEQ ID NO: 2159006 - DNA, 18 bp, Homo sapiens
atcctccccaccagagct

SEQ ID NO: 2159007 - DNA, 21 bp, Homo sapiens
atcctccccaccagagctgcc

SEQ ID NO: 2159008 - DNA, 18 bp, Homo sapiens
atcctcctctccatgcaa

SEQ ID NO: 2159009 - DNA, 20 bp, Homo sapiens
atcctcctctccatgcaagt

SEQ ID NO: 2159010 - DNA, 12 bp, Homo sapiens
atcctgggcccc

SEQ ID NO: 2159011 - DNA, 14 bp, Homo sapiens
atcctgggccccca

SEQ ID NO: 2159012 - DNA, 17 bp, Homo sapiens
atctaagttaatttaaa

SEQ ID NO: 2159013 - DNA, 18 bp, Homo sapiens
atctaagttaatttaaag

SEQ ID NO: 2159014 - DNA, 18 bp, Homo sapiens
atctatatctctaaactg

SEQ ID NO: 2159015 - DNA, 21 bp, Homo sapiens
atctatatctctaaactgctg

SEQ ID NO: 2159016 - DNA, 22 bp, Homo sapiens
atctattcagacaagcaacagg

SEQ ID NO: 2159017 - DNA, 21 bp, Homo sapiens
atctcatttttccgtaaaaat

SEQ ID NO: 2159018 - DNA, 14 bp, Homo sapiens
atctccccactcta

SEQ ID NO: 2159019 - DNA, 21 bp, Homo sapiens
atctctcaggagcacaggcag

SEQ ID NO: 2159020 - DNA, 13 bp, Homo sapiens
atctctgagtgtc

SEQ ID NO: 2159021 - DNA, 19 bp, Homo sapiens
atctctgagtgtctctgcc

SEQ ID NO: 2159022 - DNA, 21 bp, Homo sapiens
atctctgagtgtctctgcctg

SEQ ID NO: 2159023 - DNA, 23 bp, Homo sapiens
atctctgagtgtctctgcctgga

SEQ ID NO: 2159024 - DNA, 22 bp, Homo sapiens
atctcttcctacccaaccactc

SEQ ID NO: 2159025 - DNA, 17 bp, Homo sapiens
atctgtccatcctcctc

SEQ ID NO: 2159026 - DNA, 21 bp, Homo sapiens
atctgtccatcctcctctcca

SEQ ID NO: 2159027 - DNA, 22 bp, Homo sapiens
atctgtccatcctcctctccat

SEQ ID NO: 2159028 - DNA, 17 bp, Homo sapiens
atcttgacattcaaggc

SEQ ID NO: 2159029 - DNA, 21 bp, Homo sapiens
atctttctttacctgagacca

SEQ ID NO: 2159030 - DNA, 19 bp, Homo sapiens
atgacagtccgtcaaaaca

SEQ ID NO: 2159031 - DNA, 20 bp, Homo sapiens
atgacagtccgtcaaaacag

SEQ ID NO: 2159032 - DNA, 23 bp, Homo sapiens
atgagacttccaaacctgacaga

SEQ ID NO: 2159033 - DNA, 18 bp, Homo sapiens
atgagagttccagattgt

SEQ ID NO: 2159034 - DNA, 15 bp, Homo sapiens
atgattgtttgcaca

SEQ ID NO: 2159035 - DNA, 19 bp, Homo sapiens
atgattgtttgcacagagg

SEQ ID NO: 2159036 - DNA, 14 bp, Homo sapiens
atgatttcagtagc

SEQ ID NO: 2159037 - DNA, 15 bp, Homo sapiens
atgcaagggtgacat

SEQ ID NO: 2159038 - DNA, 18 bp, Homo sapiens
atgcccctctgcctgggc

SEQ ID NO: 2159039 - DNA, 14 bp, Homo sapiens
atgcctgagggtgg

SEQ ID NO: 2159040 - DNA, 11 bp, Homo sapiens
atgctggcctc

SEQ ID NO: 2159041 - DNA, 14 bp, Homo sapiens
atgctggcctcttg

SEQ ID NO: 2159042 - DNA, 23 bp, Homo sapiens
atgctggcctcttggcacctgcc

SEQ ID NO: 2159043 - DNA, 13 bp, Homo sapiens
atgctttctcctt

SEQ ID NO: 2159044 - DNA, 18 bp, Homo sapiens
atggagactcctgccctg

SEQ ID NO: 2159045 - DNA, 16 bp, Homo sapiens
atggagtgagcagtag

SEQ ID NO: 2159046 - DNA, 22 bp, Homo sapiens
atggcagctgggcccacagccc

SEQ ID NO: 2159047 - DNA, 12 bp, Homo sapiens
atggccttccct

SEQ ID NO: 2159048 - DNA, 17 bp, Homo sapiens
atggctgggggagggac

SEQ ID NO: 2159049 - DNA, 21 bp, Homo sapiens
atggctgggggagggactgct

SEQ ID NO: 2159050 - DNA, 18 bp, Homo sapiens
atgggactgtgcctttgg

SEQ ID NO: 2159051 - DNA, 16 bp, Homo sapiens
atgggagggatcagcc

SEQ ID NO: 2159052 - DNA, 17 bp, Homo sapiens
atggttccatgcctgag

SEQ ID NO: 2159053 - DNA, 22 bp, Homo sapiens
atggttccatgcctgagggtgg

SEQ ID NO: 2159054 - DNA, 17 bp, Homo sapiens
atggttgggggaatgca

SEQ ID NO: 2159055 - DNA, 19 bp, Homo sapiens
atgtatatctatatctcta

SEQ ID NO: 2159056 - DNA, 13 bp, Homo sapiens
atgtcagaaactc

SEQ ID NO: 2159057 - DNA, 22 bp, Homo sapiens
atgtccagaagaatattcagga

SEQ ID NO: 2159058 - DNA, 16 bp, Homo sapiens
atgtcctaaggacaca

SEQ ID NO: 2159059 - DNA, 17 bp, Homo sapiens
atgtcctaaggacacac

SEQ ID NO: 2159060 - DNA, 22 bp, Homo sapiens
atgtttgcacctttctagttga

SEQ ID NO: 2159061 - DNA, 21 bp, Homo sapiens
attaaaatctggcaaagttat

SEQ ID NO: 2159062 - DNA, 23 bp, Homo sapiens
attaaaatctggcaaagttatat

SEQ ID NO: 2159063 - DNA, 16 bp, Homo sapiens
ccacatggtgtctccc

SEQ ID NO: 2159064 - DNA, 17 bp, Homo sapiens
ccaccaaggtctcacac

SEQ ID NO: 2159065 - DNA, 15 bp, Homo sapiens
ccaccagagcagggg

SEQ ID NO: 2159066 - DNA, 18 bp, Homo sapiens
ccaccagagcaggggctg

SEQ ID NO: 2159067 - DNA, 12 bp, Homo sapiens
ccaccagagctg

SEQ ID NO: 2159068 - DNA, 15 bp, Homo sapiens
ccaccagagctgcct

SEQ ID NO: 2159069 - DNA, 16 bp, Homo sapiens
ccaccagagctgcctc

SEQ ID NO: 2159070 - DNA, 22 bp, Homo sapiens
ccacccaggaagggagggagct

SEQ ID NO: 2159071 - DNA, 16 bp, Homo sapiens
ccaccccagcacagct

SEQ ID NO: 2159072 - DNA, 17 bp, Homo sapiens
ccaccctgctcctcctg

SEQ ID NO: 2159073 - DNA, 20 bp, Homo sapiens
ccaccctgctcctcctgccc

SEQ ID NO: 2159074 - DNA, 21 bp, Homo sapiens
ccaccctgggtttggcccctg

SEQ ID NO: 2159075 - DNA, 23 bp, Homo sapiens
ccaccctgggtttggcccctgga

SEQ ID NO: 2159076 - DNA, 13 bp, Homo sapiens
ccaccgcagctgc

SEQ ID NO: 2159077 - DNA, 22 bp, Homo sapiens
ccaccgcagctgctgccactct

SEQ ID NO: 2159078 - DNA, 16 bp, Homo sapiens
ccacctcactcctgtt

SEQ ID NO: 2159079 - DNA, 18 bp, Homo sapiens
ccacctcactcctgttac

SEQ ID NO: 2159080 - DNA, 21 bp, Homo sapiens
ccacggggaccactgggcccc

SEQ ID NO: 2159081 - DNA, 19 bp, Homo sapiens
ccacgtaccaagccaccgc

SEQ ID NO: 2159082 - DNA, 19 bp, Homo sapiens
ccactaagctttctccttt

SEQ ID NO: 2159083 - DNA, 22 bp, Homo sapiens
ccactacctttgtccaggcctg

SEQ ID NO: 2159084 - DNA, 13 bp, Homo sapiens
ccactctgctgcc

SEQ ID NO: 2159085 - DNA, 16 bp, Homo sapiens
ccactctgctgcctgt

SEQ ID NO: 2159086 - DNA, 12 bp, Homo sapiens
ccactgggcccc

SEQ ID NO: 2159087 - DNA, 14 bp, Homo sapiens
ccactgggcccctc

SEQ ID NO: 2159088 - DNA, 17 bp, Homo sapiens
ccagaagaatattcagg

SEQ ID NO: 2159089 - DNA, 20 bp, Homo sapiens
ccagaagaatattcaggact

SEQ ID NO: 2159090 - DNA, 19 bp, Homo sapiens
ccagaattacccttcctca

SEQ ID NO: 2159091 - DNA, 11 bp, Homo sapiens
ccagacactgg

SEQ ID NO: 2159092 - DNA, 16 bp, Homo sapiens
ccagagacctttgccc

SEQ ID NO: 2159093 - DNA, 18 bp, Homo sapiens
ccagagactgggatggga

SEQ ID NO: 2159094 - DNA, 14 bp, Homo sapiens
ccagagcaggggct

SEQ ID NO: 2159095 - DNA, 21 bp, Homo sapiens
ccagagcaggggctgctgggg

SEQ ID NO: 2159096 - DNA, 23 bp, Homo sapiens
ccagagcaggggctgctgggggc

SEQ ID NO: 2159097 - DNA, 11 bp, Homo sapiens
ccagagctgcc

SEQ ID NO: 2159098 - DNA, 14 bp, Homo sapiens
ccagagctgcctcc

SEQ ID NO: 2159099 - DNA, 15 bp, Homo sapiens
ccagagctgcctccc

SEQ ID NO: 2159100 - DNA, 17 bp, Homo sapiens
ccagagctgcctcccca

SEQ ID NO: 2159101 - DNA, 20 bp, Homo sapiens
ccagagctgcctccccaatc

SEQ ID NO: 2159102 - DNA, 18 bp, Homo sapiens
ccagatcaccagcccggc

SEQ ID NO: 2159103 - DNA, 22 bp, Homo sapiens
ccagattttttaaaatttatat

SEQ ID NO: 2159104 - DNA, 15 bp, Homo sapiens
ccagcacagctcctc

SEQ ID NO: 2159105 - DNA, 16 bp, Homo sapiens
ccagcacagctcctcc

SEQ ID NO: 2159106 - DNA, 20 bp, Homo sapiens
ccagcacagctcctcccctg

SEQ ID NO: 2159107 - DNA, 15 bp, Homo sapiens
ccagcaggcagcgcc

SEQ ID NO: 2159108 - DNA, 16 bp, Homo sapiens
ccagcaggcagcgcct

SEQ ID NO: 2159109 - DNA, 22 bp, Homo sapiens
ccagcaggcagcgcctgtcccc

SEQ ID NO: 2159110 - DNA, 16 bp, Homo sapiens
ccagcccaccctgctc

SEQ ID NO: 2159111 - DNA, 17 bp, Homo sapiens
ccagccccttctcccag

SEQ ID NO: 2159112 - DNA, 21 bp, Homo sapiens
ccagccccttctcccagcaca

SEQ ID NO: 2159113 - DNA, 16 bp, Homo sapiens
ccagcccttccctgct

SEQ ID NO: 2159114 - DNA, 17 bp, Homo sapiens
ccagcccttccctgctt

SEQ ID NO: 2159115 - DNA, 18 bp, Homo sapiens
ccagccctttgcaggccc

SEQ ID NO: 2159116 - DNA, 22 bp, Homo sapiens
ccagccctttgcaggcccagca

SEQ ID NO: 2159117 - DNA, 23 bp, Homo sapiens
ccagccctttgcaggcccagcag

SEQ ID NO: 2159118 - DNA, 15 bp, Homo sapiens
ccagccgccccagcc

SEQ ID NO: 2159119 - DNA, 17 bp, Homo sapiens
ccagctaatctgtaggg

SEQ ID NO: 2159120 - DNA, 17 bp, Homo sapiens
ccagctctgtcaccctg

SEQ ID NO: 2159121 - DNA, 21 bp, Homo sapiens
ccagctctgtcaccctggcca

SEQ ID NO: 2159122 - DNA, 19 bp, Homo sapiens
ccaggaagggagggagctg

SEQ ID NO: 2159123 - DNA, 23 bp, Homo sapiens
ccaggaagggagggagctgaggc

SEQ ID NO: 2159124 - DNA, 20 bp, Homo sapiens
ccaggattttaacaaaagca

SEQ ID NO: 2159125 - DNA, 16 bp, Homo sapiens
ccaggcttcaccctga

SEQ ID NO: 2159126 - DNA, 22 bp, Homo sapiens
ccagggccagcaggcagcgcct

SEQ ID NO: 2159127 - DNA, 20 bp, Homo sapiens
ccaggggtaccaggcacatg

SEQ ID NO: 2159128 - DNA, 12 bp, Homo sapiens
ccagtcatggta

SEQ ID NO: 2159129 - DNA, 19 bp, Homo sapiens
ccagtcatggtactacccc

SEQ ID NO: 2159130 - DNA, 20 bp, Homo sapiens
ccagtcatggtactacccca

SEQ ID NO: 2159131 - DNA, 16 bp, Homo sapiens
ccagtcctccagacca

SEQ ID NO: 2159132 - DNA, 19 bp, Homo sapiens
ccagtcctccagaccacca

SEQ ID NO: 2159133 - DNA, 12 bp, Homo sapiens
ccagtcctgctg

SEQ ID NO: 2159134 - DNA, 13 bp, Homo sapiens
ccagtcctgctgg

SEQ ID NO: 2159135 - DNA, 16 bp, Homo sapiens
ccagtcctgctggcct

SEQ ID NO: 2159136 - DNA, 18 bp, Homo sapiens
ccagtcctgctggcctgc

SEQ ID NO: 2159137 - DNA, 20 bp, Homo sapiens
ccagtcctgctggcctgctc

SEQ ID NO: 2159138 - DNA, 22 bp, Homo sapiens
ccagtcctgctggcctgctctt

SEQ ID NO: 2159139 - DNA, 16 bp, Homo sapiens
ccagtctgggctgccg

SEQ ID NO: 2159140 - DNA, 18 bp, Homo sapiens
ccagtctgggctgccggg

SEQ ID NO: 2159141 - DNA, 12 bp, Homo sapiens
ccagtgacagct

SEQ ID NO: 2159142 - DNA, 17 bp, Homo sapiens
ccagttgggagcactgg

SEQ ID NO: 2159143 - DNA, 18 bp, Homo sapiens
ccatcctcctctccatgc

SEQ ID NO: 2159144 - DNA, 22 bp, Homo sapiens
ccatcctcctctccatgcaagt

SEQ ID NO: 2159145 - DNA, 19 bp, Homo sapiens
ccatctgtccatcctcctc

SEQ ID NO: 2159146 - DNA, 18 bp, Homo sapiens
ccatgcaagtgctgtttg

SEQ ID NO: 2159147 - DNA, 12 bp, Homo sapiens
ccatgcctgagg

SEQ ID NO: 2159148 - DNA, 21 bp, Homo sapiens
ccatttggcagaactgctggg

SEQ ID NO: 2159149 - DNA, 12 bp, Homo sapiens
cccaacatggga

SEQ ID NO: 2159150 - DNA, 23 bp, Homo sapiens
cccaagaggggcgggctcagagc

SEQ ID NO: 2159151 - DNA, 19 bp, Homo sapiens
cccaagggcctcccaccag

SEQ ID NO: 2159152 - DNA, 22 bp, Homo sapiens
cccaagtagtagtgtcttccta

SEQ ID NO: 2159153 - DNA, 18 bp, Homo sapiens
cccaatccatttggcaga

SEQ ID NO: 2159154 - DNA, 19 bp, Homo sapiens
cccaatccatttggcagaa

SEQ ID NO: 2159155 - DNA, 13 bp, Homo sapiens
cccacacacactc

SEQ ID NO: 2159156 - DNA, 15 bp, Homo sapiens
cccacacacactcct

SEQ ID NO: 2159157 - DNA, 13 bp, Homo sapiens
cccacaccccagc

SEQ ID NO: 2159158 - DNA, 14 bp, Homo sapiens
cccacaccccagcc

SEQ ID NO: 2159159 - DNA, 17 bp, Homo sapiens
cccacaccccagcccac

SEQ ID NO: 2159160 - DNA, 21 bp, Homo sapiens
cccacagtcctcacagcctct

SEQ ID NO: 2159161 - DNA, 13 bp, Homo sapiens
cccacatcccagg

SEQ ID NO: 2159162 - DNA, 18 bp, Homo sapiens
cccaccaaggtctcacac

SEQ ID NO: 2159163 - DNA, 19 bp, Homo sapiens
cccaccaaggtctcacact

SEQ ID NO: 2159164 - DNA, 14 bp, Homo sapiens
cccaccagagctgc

SEQ ID NO: 2159165 - DNA, 13 bp, Homo sapiens
cccaccccagcac

SEQ ID NO: 2159166 - DNA, 18 bp, Homo sapiens
cccaccccagcacagctc

SEQ ID NO: 2159167 - DNA, 19 bp, Homo sapiens
cccaccccagcacagctcc

SEQ ID NO: 2159168 - DNA, 21 bp, Homo sapiens
cccaccccagcacagctcctc

SEQ ID NO: 2159169 - DNA, 21 bp, Homo sapiens
cccaccctgctcctcctgccc

SEQ ID NO: 2159170 - DNA, 22 bp, Homo sapiens
cccaccctgctcctcctgccct

SEQ ID NO: 2159171 - DNA, 21 bp, Homo sapiens
cccaccctgggtttggcccct

SEQ ID NO: 2159172 - DNA, 17 bp, Homo sapiens
cctgctcttacttcccc

SEQ ID NO: 2159173 - DNA, 12 bp, Homo sapiens
cctgctggcctg

SEQ ID NO: 2159174 - DNA, 15 bp, Homo sapiens
cctgctggcctgctc

SEQ ID NO: 2159175 - DNA, 23 bp, Homo sapiens
cctgctgggctcttaactgttgc

SEQ ID NO: 2159176 - DNA, 16 bp, Homo sapiens
cctgctgtggagccca

SEQ ID NO: 2159177 - DNA, 19 bp, Homo sapiens
cctggaacctttcccttgt

SEQ ID NO: 2159178 - DNA, 19 bp, Homo sapiens
cctggatctccccactcta

SEQ ID NO: 2159179 - DNA, 16 bp, Homo sapiens
cctggccaccacccaa

SEQ ID NO: 2159180 - DNA, 20 bp, Homo sapiens
cctggccaccacccaacctg

SEQ ID NO: 2159181 - DNA, 22 bp, Homo sapiens
cctggccaccacccaacctgtc

SEQ ID NO: 2159182 - DNA, 14 bp, Homo sapiens
cctggccctcttct

SEQ ID NO: 2159183 - DNA, 18 bp, Homo sapiens
cctggctgaacagtgctc

SEQ ID NO: 2159184 - DNA, 22 bp, Homo sapiens
cctggctgaacagtgctctgcc

SEQ ID NO: 2159185 - DNA, 23 bp, Homo sapiens
cctgggcccccagagacctttgc

SEQ ID NO: 2159186 - DNA, 15 bp, Homo sapiens
cctggggctcctttc

SEQ ID NO: 2159187 - DNA, 20 bp, Homo sapiens
cctggggctcctttctccag

SEQ ID NO: 2159188 - DNA, 12 bp, Homo sapiens
cctggggctggt

SEQ ID NO: 2159189 - DNA, 15 bp, Homo sapiens
cctgggtttggcccc

SEQ ID NO: 2159190 - DNA, 16 bp, Homo sapiens
cctgggtttggcccct

SEQ ID NO: 2159191 - DNA, 17 bp, Homo sapiens
cctgggtttggcccctg

SEQ ID NO: 2159192 - DNA, 18 bp, Homo sapiens
cctggtactgcacatttt

SEQ ID NO: 2159193 - DNA, 16 bp, Homo sapiens
cctgtccccctcccct

SEQ ID NO: 2159194 - DNA, 14 bp, Homo sapiens
cctgtcccctcaca

SEQ ID NO: 2159195 - DNA, 20 bp, Homo sapiens
cctgtcccctcacagactct

SEQ ID NO: 2159196 - DNA, 19 bp, Homo sapiens
cctgtcccctggggctggt

SEQ ID NO: 2159197 - DNA, 18 bp, Homo sapiens
cctgtccttactcagagc

SEQ ID NO: 2159198 - DNA, 15 bp, Homo sapiens
cctgtcgagacactt

SEQ ID NO: 2159199 - DNA, 17 bp, Homo sapiens
cctgtcgagacacttgc

SEQ ID NO: 2159200 - DNA, 23 bp, Homo sapiens
cctgtctgtccaacccctccccc

SEQ ID NO: 2159201 - DNA, 15 bp, Homo sapiens
cctgtgactatggct

SEQ ID NO: 2159202 - DNA, 18 bp, Homo sapiens
cctgtgactatggctctg

SEQ ID NO: 2159203 - DNA, 15 bp, Homo sapiens
cctgtgggagcctgc

SEQ ID NO: 2159204 - DNA, 22 bp, Homo sapiens
ccttacacgtacctctcatcag

SEQ ID NO: 2159205 - DNA, 17 bp, Homo sapiens
ccttactcagagctgcg

SEQ ID NO: 2159206 - DNA, 15 bp, Homo sapiens
ccttcccccatccct

SEQ ID NO: 2159207 - DNA, 21 bp, Homo sapiens
ccttcccccatccctaccact

SEQ ID NO: 2159208 - DNA, 20 bp, Homo sapiens
ccttccccttgtccctgggg

SEQ ID NO: 2159209 - DNA, 14 bp, Homo sapiens
ccttccctgctttg

SEQ ID NO: 2159210 - DNA, 20 bp, Homo sapiens
ccttccctgctttgaggaca

SEQ ID NO: 2159211 - DNA, 17 bp, Homo sapiens
ccttcctcatctgtgcc

SEQ ID NO: 2159212 - DNA, 15 bp, Homo sapiens
ccttctcccagcaca

SEQ ID NO: 2159213 - DNA, 15 bp, Homo sapiens
ccttcttcacccagc

SEQ ID NO: 2159214 - DNA, 18 bp, Homo sapiens
ccttgcctgaactccaga

SEQ ID NO: 2159215 - DNA, 15 bp, Homo sapiens
ccttgtccctggggc

SEQ ID NO: 2159216 - DNA, 17 bp, Homo sapiens
ccttgtccctggggcac

SEQ ID NO: 2159217 - DNA, 16 bp, Homo sapiens
ccttgtgtgtaccaca

SEQ ID NO: 2159218 - DNA, 13 bp, Homo sapiens
cctttcccttgtg

SEQ ID NO: 2159219 - DNA, 15 bp, Homo sapiens
cctttctagttgaaa

SEQ ID NO: 2159220 - DNA, 22 bp, Homo sapiens
cctttctccagccagcaatgat

SEQ ID NO: 2159221 - DNA, 22 bp, Homo sapiens
cctttgagggcagtggggagca

SEQ ID NO: 2159222 - DNA, 18 bp, Homo sapiens
cctttgcactgagggcca

SEQ ID NO: 2159223 - DNA, 19 bp, Homo sapiens
cctttgcactgagggccac

SEQ ID NO: 2159224 - DNA, 18 bp, Homo sapiens
cctttgcccacacacact

SEQ ID NO: 2159225 - DNA, 17 bp, Homo sapiens
cgaactgtgctcccacg

SEQ ID NO: 2159226 - DNA, 16 bp, Homo sapiens
cgaatgacactgttca

SEQ ID NO: 2159227 - DNA, 22 bp, Homo sapiens
cgacttttctaaagctctgaac

SEQ ID NO: 2159228 - DNA, 14 bp, Homo sapiens
cgagacacttgcct

SEQ ID NO: 2159229 - DNA, 17 bp, Homo sapiens
cgagccgggcctggggc

SEQ ID NO: 2159230 - DNA, 23 bp, Homo sapiens
cgatgaatgtgttgatttgagaa

SEQ ID NO: 2159231 - DNA, 18 bp, Homo sapiens
cgattagactggacagct

SEQ ID NO: 2159232 - DNA, 12 bp, Homo sapiens
cgcagctgctgc

SEQ ID NO: 2159233 - DNA, 15 bp, Homo sapiens
cgcagctgctgccac

SEQ ID NO: 2159234 - DNA, 20 bp, Homo sapiens
cgcagctgctgccactctgc

SEQ ID NO: 2159235 - DNA, 21 bp, Homo sapiens
cgcagctgctgccactctgct

SEQ ID NO: 2159236 - DNA, 22 bp, Homo sapiens
cgcagctgctgccactctgctg

SEQ ID NO: 2159237 - DNA, 14 bp, Homo sapiens
cgcatggcagctgg

SEQ ID NO: 2159238 - DNA, 17 bp, Homo sapiens
cgcatggcagctgggcc

SEQ ID NO: 2159239 - DNA, 19 bp, Homo sapiens
cgcatggcagctgggccca

SEQ ID NO: 2159240 - DNA, 21 bp, Homo sapiens
cgcctcccgggaagcatcctc

SEQ ID NO: 2159241 - DNA, 14 bp, Homo sapiens
cgcctgtcccctca

SEQ ID NO: 2159242 - DNA, 15 bp, Homo sapiens
cgcctgtcccctcac

SEQ ID NO: 2159243 - DNA, 20 bp, Homo sapiens
cgcctgtcccctcacagact

SEQ ID NO: 2159244 - DNA, 22 bp, Homo sapiens
cgcctgtcccctcacagactct

SEQ ID NO: 2159245 - DNA, 22 bp, Homo sapiens
cggaatcctgtcgattagactg

SEQ ID NO: 2159246 - DNA, 20 bp, Homo sapiens
cggacctggactagggcctc

SEQ ID NO: 2159247 - DNA, 12 bp, Homo sapiens
cggaggctcctc

SEQ ID NO: 2159248 - DNA, 14 bp, Homo sapiens
cggaggctcctccc

SEQ ID NO: 2159249 - DNA, 16 bp, Homo sapiens
cggaggctcctccctc

SEQ ID NO: 2159250 - DNA, 15 bp, Homo sapiens
cggattggccctgcc

SEQ ID NO: 2159251 - DNA, 21 bp, Homo sapiens
cggattggccctgcccctccc

SEQ ID NO: 2159252 - DNA, 23 bp, Homo sapiens
cggattggccctgcccctccccc

SEQ ID NO: 2159253 - DNA, 20 bp, Homo sapiens
cggcccatctgtccatcctc

SEQ ID NO: 2159254 - DNA, 16 bp, Homo sapiens
cggccctgcccctccc

SEQ ID NO: 2159255 - DNA, 21 bp, Homo sapiens
cggctgggtcggccctgccca

SEQ ID NO: 2159256 - DNA, 21 bp, Homo sapiens
cgggaagcatcctccccacca

SEQ ID NO: 2159257 - DNA, 23 bp, Homo sapiens
cgggacatggttgggggaatgca

SEQ ID NO: 2159258 - DNA, 12 bp, Homo sapiens
cgggctcagagc

SEQ ID NO: 2159259 - DNA, 15 bp, Homo sapiens
cgggctcagagcttt

SEQ ID NO: 2159260 - DNA, 17 bp, Homo sapiens
cgggctcagagctttgt

SEQ ID NO: 2159261 - DNA, 20 bp, Homo sapiens
cgggctgagggcatctctga

SEQ ID NO: 2159262 - DNA, 16 bp, Homo sapiens
cggggaccactgggcc

SEQ ID NO: 2159263 - DNA, 17 bp, Homo sapiens
cggggaccactgggccc

SEQ ID NO: 2159264 - DNA, 20 bp, Homo sapiens
cggggaccactgggcccctc

SEQ ID NO: 2159265 - DNA, 15 bp, Homo sapiens
cgtaccaagccaccg

SEQ ID NO: 2159266 - DNA, 21 bp, Homo sapiens
cgtcaaaacagattgtttgca

SEQ ID NO: 2159267 - DNA, 22 bp, Homo sapiens
cgtcaaaacagattgtttgcaa

SEQ ID NO: 2159268 - DNA, 16 bp, Homo sapiens
cgtctctctgcctgct

SEQ ID NO: 2159269 - DNA, 19 bp, Homo sapiens
cgtctctctgcctgctggg

SEQ ID NO: 2159270 - DNA, 20 bp, Homo sapiens
cgtctctctgcctgctgggc

SEQ ID NO: 2159271 - DNA, 17 bp, Homo sapiens
cgttagaggagcaacag

SEQ ID NO: 2159272 - DNA, 17 bp, Homo sapiens
ctaaacagatataaatg

SEQ ID NO: 2159273 - DNA, 22 bp, Homo sapiens
ctaaccaaagagtctctggctc

SEQ ID NO: 2159274 - DNA, 15 bp, Homo sapiens
ctaactccctcctca

SEQ ID NO: 2159275 - DNA, 18 bp, Homo sapiens
ctaactccctcctcacac

SEQ ID NO: 2159276 - DNA, 13 bp, Homo sapiens
ctaaggacacact

SEQ ID NO: 2159277 - DNA, 15 bp, Homo sapiens
ctaaggatctctcag

SEQ ID NO: 2159278 - DNA, 12 bp, Homo sapiens
ctaataaatcaa

SEQ ID NO: 2159279 - DNA, 13 bp, Homo sapiens
ctaatctgtaggg

SEQ ID NO: 2159280 - DNA, 21 bp, Homo sapiens
ctaatctgtagggctggacct

SEQ ID NO: 2159281 - DNA, 20 bp, Homo sapiens
cttgtccctggggcactccc

SEQ ID NO: 2159282 - DNA, 21 bp, Homo sapiens
cttgtccctggggcactcccc

SEQ ID NO: 2159283 - DNA, 23 bp, Homo sapiens
cttgtccctggggcactccccca

SEQ ID NO: 2159284 - DNA, 15 bp, Homo sapiens
cttgtgtgtaccaca

SEQ ID NO: 2159285 - DNA, 22 bp, Homo sapiens
cttgtgtgtaccacaccctgcc

SEQ ID NO: 2159286 - DNA, 16 bp, Homo sapiens
ctttacctgagaccag

SEQ ID NO: 2159287 - DNA, 14 bp, Homo sapiens
ctttctccagccag

SEQ ID NO: 2159288 - DNA, 15 bp, Homo sapiens
ctttctttacctgag

SEQ ID NO: 2159289 - DNA, 15 bp, Homo sapiens
ctttgatatttcaat

SEQ ID NO: 2159290 - DNA, 16 bp, Homo sapiens
ctttgcactgagggcc

SEQ ID NO: 2159291 - DNA, 22 bp, Homo sapiens
ctttgcactgagggccacacta

SEQ ID NO: 2159292 - DNA, 18 bp, Homo sapiens
ctttgcccacacacactc

SEQ ID NO: 2159293 - DNA, 19 bp, Homo sapiens
ctttgcccacacacactcc

SEQ ID NO: 2159294 - DNA, 15 bp, Homo sapiens
ctttgtcacttgcca

SEQ ID NO: 2159295 - DNA, 16 bp, Homo sapiens
cttttaatgaacaaat

SEQ ID NO: 2159296 - DNA, 21 bp, Homo sapiens
cttttcaagttgagaacaaaa

SEQ ID NO: 2159297 - DNA, 19 bp, Homo sapiens
cttttcgaactgtgctccc

SEQ ID NO: 2159298 - DNA, 18 bp, Homo sapiens
cttttgcaacaagacaaa

SEQ ID NO: 2159299 - DNA, 23 bp, Homo sapiens
ctttttgcaggggactgggccat

SEQ ID NO: 2159300 - DNA, 15 bp, Homo sapiens
gaaaatgcattatgt

SEQ ID NO: 2159301 - DNA, 18 bp, Homo sapiens
gaaacctgtccataaagt

SEQ ID NO: 2159302 - DNA, 19 bp, Homo sapiens
gaaacctgtccataaagta

SEQ ID NO: 2159303 - DNA, 20 bp, Homo sapiens
gaaattcaacctgtgtctta

SEQ ID NO: 2159304 - DNA, 18 bp, Homo sapiens
gaaattttactgacagaa

SEQ ID NO: 2159305 - DNA, 17 bp, Homo sapiens
gaacaaaaattgggttt

SEQ ID NO: 2159306 - DNA, 14 bp, Homo sapiens
gaacacactcagca

SEQ ID NO: 2159307 - DNA, 17 bp, Homo sapiens
gaacacactcagcagcc

SEQ ID NO: 2159308 - DNA, 20 bp, Homo sapiens
gaacagcagactcagctctg

SEQ ID NO: 2159309 - DNA, 21 bp, Homo sapiens
gaacagcagactcagctctga

SEQ ID NO: 2159310 - DNA, 14 bp, Homo sapiens
gaacagtgctctgc

SEQ ID NO: 2159311 - DNA, 15 bp, Homo sapiens
gaacagtgctctgcc

SEQ ID NO: 2159312 - DNA, 18 bp, Homo sapiens
gaacagtgctctgcctct

SEQ ID NO: 2159313 - DNA, 12 bp, Homo sapiens
gaactgctgggg

SEQ ID NO: 2159314 - DNA, 15 bp, Homo sapiens
gaactgctggggctg

SEQ ID NO: 2159315 - DNA, 13 bp, Homo sapiens
gaactgtgctccc

SEQ ID NO: 2159316 - DNA, 14 bp, Homo sapiens
gaagaatattcagg

SEQ ID NO: 2159317 - DNA, 17 bp, Homo sapiens
gaagaatattcaggact

SEQ ID NO: 2159318 - DNA, 22 bp, Homo sapiens
gaagaatgttaagacttgacag

SEQ ID NO: 2159319 - DNA, 20 bp, Homo sapiens
gaagacatggagactcctgc

SEQ ID NO: 2159320 - DNA, 13 bp, Homo sapiens
gaagagggcctgt

SEQ ID NO: 2159321 - DNA, 16 bp, Homo sapiens
gaagcatcctccccac

SEQ ID NO: 2159322 - DNA, 17 bp, Homo sapiens
gaagcatcctccccacc

SEQ ID NO: 2159323 - DNA, 17 bp, Homo sapiens
gaaggactggccgtggc

SEQ ID NO: 2159324 - DNA, 13 bp, Homo sapiens
gaaggcctcccct

SEQ ID NO: 2159325 - DNA, 19 bp, Homo sapiens
gaaggcctcccctgaggat

SEQ ID NO: 2159326 - DNA, 11 bp, Homo sapiens
gaagggccagt

SEQ ID NO: 2159327 - DNA, 19 bp, Homo sapiens
gaagggccagtctgggctg

SEQ ID NO: 2159328 - DNA, 20 bp, Homo sapiens
gaagtaactcccactcctaa

SEQ ID NO: 2159329 - DNA, 17 bp, Homo sapiens
gaagtaagtggggttgc

SEQ ID NO: 2159330 - DNA, 17 bp, Homo sapiens
gaatacaattaaaggtc

SEQ ID NO: 2159331 - DNA, 16 bp, Homo sapiens
gaatcctgggccccca

SEQ ID NO: 2159332 - DNA, 21 bp, Homo sapiens
gaatcctgggcccccagagac

SEQ ID NO: 2159333 - DNA, 14 bp, Homo sapiens
gaatcctgtcgatt

SEQ ID NO: 2159334 - DNA, 12 bp, Homo sapiens
gaatgacactgt

SEQ ID NO: 2159335 - DNA, 18 bp, Homo sapiens
gaatgcacctccccaaag

SEQ ID NO: 2159336 - DNA, 19 bp, Homo sapiens
gaatggttccatgcctgag

SEQ ID NO: 2159337 - DNA, 20 bp, Homo sapiens
gaatggttccatgcctgagg

SEQ ID NO: 2159338 - DNA, 20 bp, Homo sapiens
gaatgtaaagcttgtctgat

SEQ ID NO: 2159339 - DNA, 14 bp, Homo sapiens
gaatgtgctgcctt

SEQ ID NO: 2159340 - DNA, 19 bp, Homo sapiens
gacaagccaacttgtaaat

SEQ ID NO: 2159341 - DNA, 20 bp, Homo sapiens
gacacaccccacaccccagc

SEQ ID NO: 2159342 - DNA, 22 bp, Homo sapiens
gacactgagccccacctctcca

SEQ ID NO: 2159343 - DNA, 15 bp, Homo sapiens
gacacttgccttctt

SEQ ID NO: 2159344 - DNA, 16 bp, Homo sapiens
gacagtttatttgttg

SEQ ID NO: 2159345 - DNA, 22 bp, Homo sapiens
gacatggagactcctgccctgt

SEQ ID NO: 2159346 - DNA, 16 bp, Homo sapiens
gacatggttgggggaa

SEQ ID NO: 2159347 - DNA, 14 bp, Homo sapiens
gaccaaaagttaca

SEQ ID NO: 2159348 - DNA, 22 bp, Homo sapiens
gaccaccagccgccccagcccc

SEQ ID NO: 2159349 - DNA, 23 bp, Homo sapiens
gaccaccagccgccccagcccct

SEQ ID NO: 2159350 - DNA, 16 bp, Homo sapiens
gaccactgggcccctc

SEQ ID NO: 2159351 - DNA, 20 bp, Homo sapiens
gaccagttgggagcactgga

SEQ ID NO: 2159352 - DNA, 19 bp, Homo sapiens
gacccaccaaggtctcaca

SEQ ID NO: 2159353 - DNA, 18 bp, Homo sapiens
gacccggattggccctgc

SEQ ID NO: 2159354 - DNA, 19 bp, Homo sapiens
gacccggattggccctgcc

SEQ ID NO: 2159355 - DNA, 22 bp, Homo sapiens
gacccggattggccctgcccct

SEQ ID NO: 2159356 - DNA, 23 bp, Homo sapiens
gacccggattggccctgcccctc

SEQ ID NO: 2159357 - DNA, 21 bp, Homo sapiens
gacctatgtcctaaggacaca

SEQ ID NO: 2159358 - DNA, 17 bp, Homo sapiens
gacctccagtcctgctg

SEQ ID NO: 2159359 - DNA, 18 bp, Homo sapiens
gacctccagtcctgctgg

SEQ ID NO: 2159360 - DNA, 23 bp, Homo sapiens
gacctccagtcctgctggcctgc

SEQ ID NO: 2159361 - DNA, 15 bp, Homo sapiens
gacctttgcccacac

SEQ ID NO: 2159362 - DNA, 14 bp, Homo sapiens
gacgtgactcagag

SEQ ID NO: 2159363 - DNA, 17 bp, Homo sapiens
gacgtgactcagagctt

SEQ ID NO: 2159364 - DNA, 22 bp, Homo sapiens
gactagggcctcggaggctcct

SEQ ID NO: 2159365 - DNA, 12 bp, Homo sapiens
gactcagctctg

SEQ ID NO: 2159366 - DNA, 14 bp, Homo sapiens
gactcctgccctgt

SEQ ID NO: 2159367 - DNA, 17 bp, Homo sapiens
gactcttccaccagagc

SEQ ID NO: 2159368 - DNA, 22 bp, Homo sapiens
gactcttccaccagagcagggg

SEQ ID NO: 2159369 - DNA, 21 bp, Homo sapiens
gactggaaggtccttgcctga

SEQ ID NO: 2159370 - DNA, 13 bp, Homo sapiens
gactggacagctt

SEQ ID NO: 2159371 - DNA, 14 bp, Homo sapiens
gactggacagcttg

SEQ ID NO: 2159372 - DNA, 19 bp, Homo sapiens
gactggccgtggctccaga

SEQ ID NO: 2159373 - DNA, 19 bp, Homo sapiens
gactgggccatgggtcctc

SEQ ID NO: 2159374 - DNA, 12 bp, Homo sapiens
gactgtgacatc

SEQ ID NO: 2159375 - DNA, 19 bp, Homo sapiens
gacttaacggctccaggat

SEQ ID NO: 2159376 - DNA, 13 bp, Homo sapiens
gacttcatgttca

SEQ ID NO: 2159377 - DNA, 16 bp, Homo sapiens
gacttgacagtggaac

SEQ ID NO: 2159378 - DNA, 16 bp, Homo sapiens
gacttttctaaagctc

SEQ ID NO: 2159379 - DNA, 16 bp, Homo sapiens
gagaagagggcctgtg

SEQ ID NO: 2159380 - DNA, 14 bp, Homo sapiens
gagaaggcctcccc

SEQ ID NO: 2159381 - DNA, 12 bp, Homo sapiens
gagaatatatac

SEQ ID NO: 2159382 - DNA, 14 bp, Homo sapiens
gagaatatatacat

SEQ ID NO: 2159383 - DNA, 17 bp, Homo sapiens
gagacacttgccttctt

SEQ ID NO: 2159384 - DNA, 11 bp, Homo sapiens
gagagtgtgac

SEQ ID NO: 2159385 - DNA, 20 bp, Homo sapiens
gagcaaggacaacctgcccc

SEQ ID NO: 2159386 - DNA, 13 bp, Homo sapiens
gagcacaggcagc

SEQ ID NO: 2159387 - DNA, 14 bp, Homo sapiens
gagcacaggcagct

SEQ ID NO: 2159388 - DNA, 14 bp, Homo sapiens
gagcactggagtgc

SEQ ID NO: 2159389 - DNA, 15 bp, Homo sapiens
gagcaggggctgctg

SEQ ID NO: 2159390 - DNA, 18 bp, Homo sapiens
gagcaggggctgctgggg

SEQ ID NO: 2159391 - DNA, 19 bp, Homo sapiens
gagcaggggctgctggggg

SEQ ID NO: 2159392 - DNA, 15 bp, Homo sapiens
gagccactacctttg

SEQ ID NO: 2159393 - DNA, 17 bp, Homo sapiens
gagccactacctttgtc

SEQ ID NO: 2159394 - DNA, 14 bp, Homo sapiens
gagccgggcctggg

SEQ ID NO: 2159395 - DNA, 12 bp, Homo sapiens
gagctgaggcct

SEQ ID NO: 2159396 - DNA, 11 bp, Homo sapiens
gagctgcctcc

SEQ ID NO: 2159397 - DNA, 12 bp, Homo sapiens
gagctgcctccc

SEQ ID NO: 2159398 - DNA, 12 bp, Homo sapiens
gagctgcgggct

SEQ ID NO: 2159399 - DNA, 13 bp, Homo sapiens
gagctttgtcact

SEQ ID NO: 2159400 - DNA, 16 bp, Homo sapiens
gagctttgtcacttgc

SEQ ID NO: 2159401 - DNA, 19 bp, Homo sapiens
gagcttttcgaactgtgct

SEQ ID NO: 2159402 - DNA, 21 bp, Homo sapiens
gagcttttcgaactgtgctcc

SEQ ID NO: 2159403 - DNA, 20 bp, Homo sapiens
gaggacaaagagaataaaga

SEQ ID NO: 2159404 - DNA, 18 bp, Homo sapiens
gaggatcccctgtcccct

SEQ ID NO: 2159405 - DNA, 18 bp, Homo sapiens
gaggccggccctgcccct

SEQ ID NO: 2159406 - DNA, 12 bp, Homo sapiens
gaggcggtgggg

SEQ ID NO: 2159407 - DNA, 21 bp, Homo sapiens
gaggctcctccctctgcctca

SEQ ID NO: 2159408 - DNA, 16 bp, Homo sapiens
gagggagctgaggcct

SEQ ID NO: 2159409 - DNA, 18 bp, Homo sapiens
gagggagctgaggcctcc

SEQ ID NO: 2159410 - DNA, 19 bp, Homo sapiens
gagggagctgaggcctccc

SEQ ID NO: 2159411 - DNA, 21 bp, Homo sapiens
gagggagctgaggcctccctt

SEQ ID NO: 2159412 - DNA, 14 bp, Homo sapiens
gagggatcagcccc

SEQ ID NO: 2159413 - DNA, 15 bp, Homo sapiens
gagggatcagccccg

SEQ ID NO: 2159414 - DNA, 16 bp, Homo sapiens
gagggcatctctgagt

SEQ ID NO: 2159415 - DNA, 16 bp, Homo sapiens
gagtaatatgcctgct

SEQ ID NO: 2159416 - DNA, 12 bp, Homo sapiens
gagtctctggct

SEQ ID NO: 2159417 - DNA, 19 bp, Homo sapiens
gagtctctggctcagctgt

SEQ ID NO: 2159418 - DNA, 16 bp, Homo sapiens
gagtgtctctgcctgg

SEQ ID NO: 2159419 - DNA, 21 bp, Homo sapiens
gagtgtgaccaaaagttacat

SEQ ID NO: 2159420 - DNA, 13 bp, Homo sapiens
gatatttatatat

SEQ ID NO: 2159421 - DNA, 20 bp, Homo sapiens
gatcaccagcccggcctgct

SEQ ID NO: 2159422 - DNA, 15 bp, Homo sapiens
gatcagccccgcctg

SEQ ID NO: 2159423 - DNA, 19 bp, Homo sapiens
gatcagccccgcctgtcac

SEQ ID NO: 2159424 - DNA, 14 bp, Homo sapiens
gatccaggcttctc

SEQ ID NO: 2159425 - DNA, 17 bp, Homo sapiens
gatcccctgtcccctgg

SEQ ID NO: 2159426 - DNA, 23 bp, Homo sapiens
gatcccctgtcccctggggctgg

SEQ ID NO: 2159427 - DNA, 20 bp, Homo sapiens
gatccctgttacccagagaa

SEQ ID NO: 2159428 - DNA, 16 bp, Homo sapiens
gatcgttcaaagcatg

SEQ ID NO: 2159429 - DNA, 19 bp, Homo sapiens
gatctctcaggagcacagg

SEQ ID NO: 2159430 - DNA, 21 bp, Homo sapiens
gatctctcaggagcacaggca

SEQ ID NO: 2159431 - DNA, 24 bp, Homo sapiens
gatctctcaggagcacaggcagct

SEQ ID NO: 2159432 - DNA, 14 bp, Homo sapiens
gatgctcaggcttg

SEQ ID NO: 2159433 - DNA, 21 bp, Homo sapiens
gatgctggcctcttggcacct

SEQ ID NO: 2159434 - DNA, 19 bp, Homo sapiens
gatggcttatttgtataat

SEQ ID NO: 2159435 - DNA, 19 bp, Homo sapiens
gatgggaacactggtgggc

SEQ ID NO: 2159436 - DNA, 22 bp, Homo sapiens
gatgtcagccgagccgggcctg

SEQ ID NO: 2159437 - DNA, 12 bp, Homo sapiens
gatgtccagaag

SEQ ID NO: 2159438 - DNA, 18 bp, Homo sapiens
gattagactggacagctt

SEQ ID NO: 2159439 - DNA, 15 bp, Homo sapiens
gattatatatcataa

SEQ ID NO: 2159440 - DNA, 17 bp, Homo sapiens
gattcgaatgacactgt

SEQ ID NO: 2159441 - DNA, 14 bp, Homo sapiens
gattggccctgccc

SEQ ID NO: 2159442 - DNA, 16 bp, Homo sapiens
gattggccctgcccct

SEQ ID NO: 2159443 - DNA, 21 bp, Homo sapiens
gattggccctgcccctccccc

SEQ ID NO: 2159444 - DNA, 11 bp, Homo sapiens
gattgtttgca

SEQ ID NO: 2159445 - DNA, 19 bp, Homo sapiens
gattgtttgcacagagggc

SEQ ID NO: 2159446 - DNA, 20 bp, Homo sapiens
gattttaacaaaagcaagac

SEQ ID NO: 2159447 - DNA, 17 bp, Homo sapiens
gcaaactcactgctcaa

SEQ ID NO: 2159448 - DNA, 18 bp, Homo sapiens
gcaagactgttgctcaaa

SEQ ID NO: 2159449 - DNA, 15 bp, Homo sapiens
gcaagatatttatat

SEQ ID NO: 2159450 - DNA, 15 bp, Homo sapiens
gcaatgatgtccaga

SEQ ID NO: 2159451 - DNA, 17 bp, Homo sapiens
gcaatgatgtccagaag

SEQ ID NO: 2159452 - DNA, 18 bp, Homo sapiens
gcacagagggcgctcctg

SEQ ID NO: 2159453 - DNA, 15 bp, Homo sapiens
gcacagctcctcccc

SEQ ID NO: 2159454 - DNA, 24 bp, Homo sapiens
gcacagctcctcccctgccgcctc

SEQ ID NO: 2159455 - DNA, 21 bp, Homo sapiens
gcacatggctgggggagggac

SEQ ID NO: 2159456 - DNA, 23 bp, Homo sapiens
gcacatggctgggggagggactg

SEQ ID NO: 2159457 - DNA, 15 bp, Homo sapiens
gcaccagcccttccc

SEQ ID NO: 2159458 - DNA, 14 bp, Homo sapiens
gcacctccccaaag

SEQ ID NO: 2159459 - DNA, 14 bp, Homo sapiens
gcacctgcctagct

SEQ ID NO: 2159460 - DNA, 18 bp, Homo sapiens
gcacctttctagttgaaa

SEQ ID NO: 2159461 - DNA, 24 bp, Homo sapiens
gcactgagggccacactattacca

SEQ ID NO: 2159462 - DNA, 15 bp, Homo sapiens
gcactggagtgcagg

SEQ ID NO: 2159463 - DNA, 14 bp, Homo sapiens
gcagaactgctggg

SEQ ID NO: 2159464 - DNA, 16 bp, Homo sapiens
gcagaactgctggggc

SEQ ID NO: 2159465 - DNA, 18 bp, Homo sapiens
gcagaactgctggggctg

SEQ ID NO: 2159466 - DNA, 14 bp, Homo sapiens
gcagaatcctgggc

SEQ ID NO: 2159467 - DNA, 16 bp, Homo sapiens
gcagaatcctgggccc

SEQ ID NO: 2159468 - DNA, 22 bp, Homo sapiens
gcagacttgagtctgaggcccc

SEQ ID NO: 2159469 - DNA, 23 bp, Homo sapiens
gcagcaggcctctggttgcctcc

SEQ ID NO: 2159470 - DNA, 22 bp, Homo sapiens
gcagccctaaggatctctcagg

SEQ ID NO: 2159471 - DNA, 13 bp, Homo sapiens
gcagcgcctgtcc

SEQ ID NO: 2159472 - DNA, 16 bp, Homo sapiens
gcagcgcctgtcccct

SEQ ID NO: 2159473 - DNA, 17 bp, Homo sapiens
gcagctgctgccactct

SEQ ID NO: 2159474 - DNA, 11 bp, Homo sapiens
gcagctgggcc

SEQ ID NO: 2159475 - DNA, 14 bp, Homo sapiens
gcagctgggcccac

SEQ ID NO: 2159476 - DNA, 14 bp, Homo sapiens
gcaggcagcgcctg

SEQ ID NO: 2159477 - DNA, 18 bp, Homo sapiens
gcaggcagcgcctgtccc

SEQ ID NO: 2159478 - DNA, 22 bp, Homo sapiens
gcaggcctctggttgcctcccc

SEQ ID NO: 2159479 - DNA, 15 bp, Homo sapiens
gcaggggactgggcc

SEQ ID NO: 2159480 - DNA, 18 bp, Homo sapiens
gcaggggactgggccatg

SEQ ID NO: 2159481 - DNA, 14 bp, Homo sapiens
gcaggggctgctgg

SEQ ID NO: 2159482 - DNA, 15 bp, Homo sapiens
gcaggggctgctggg

SEQ ID NO: 2159483 - DNA, 16 bp, Homo sapiens
gcaggggctgctgggg

SEQ ID NO: 2159484 - DNA, 18 bp, Homo sapiens
gcagtgggagggtaccag

SEQ ID NO: 2159485 - DNA, 14 bp, Homo sapiens
gcatcctccccacc

SEQ ID NO: 2159486 - DNA, 16 bp, Homo sapiens
gcatcctccccaccag

SEQ ID NO: 2159487 - DNA, 18 bp, Homo sapiens
gcatcctccccaccagag

SEQ ID NO: 2159488 - DNA, 20 bp, Homo sapiens
gcatctctgagtgtctctgc

SEQ ID NO: 2159489 - DNA, 11 bp, Homo sapiens
gcatggcagct

SEQ ID NO: 2159490 - DNA, 12 bp, Homo sapiens
gcatggcagctg

SEQ ID NO: 2159491 - DNA, 14 bp, Homo sapiens
gccaacttgtaaat

SEQ ID NO: 2159492 - DNA, 20 bp, Homo sapiens
gccaacttgtaaatacacca

SEQ ID NO: 2159493 - DNA, 22 bp, Homo sapiens
gccacatggtgtctcccaacat

SEQ ID NO: 2159494 - DNA, 11 bp, Homo sapiens
gccacattttg

SEQ ID NO: 2159495 - DNA, 15 bp, Homo sapiens
gccaccacccaacct

SEQ ID NO: 2159496 - DNA, 19 bp, Homo sapiens
gccaccacccaacctgtcc

SEQ ID NO: 2159497 - DNA, 20 bp, Homo sapiens
gccaccacccaacctgtcct

SEQ ID NO: 2159498 - DNA, 14 bp, Homo sapiens
gccaccgcagctgc

SEQ ID NO: 2159499 - DNA, 18 bp, Homo sapiens
gccaccgcagctgctgcc

SEQ ID NO: 2159500 - DNA, 20 bp, Homo sapiens
gccaccgcagctgctgccac

SEQ ID NO: 2159501 - DNA, 16 bp, Homo sapiens
taagccctgtcgagac

SEQ ID NO: 2159502 - DNA, 14 bp, Homo sapiens
taagtcagaacagc

SEQ ID NO: 2159503 - DNA, 14 bp, Homo sapiens
taagttaatttaaa

SEQ ID NO: 2159504 - DNA, 23 bp, Homo sapiens
taatctttctttacctgagacca

SEQ ID NO: 2159505 - DNA, 11 bp, Homo sapiens
tacagacacta

SEQ ID NO: 2159506 - DNA, 19 bp, Homo sapiens
tacagttatctaagttaat

SEQ ID NO: 2159507 - DNA, 13 bp, Homo sapiens
taccacaccctgc

SEQ ID NO: 2159508 - DNA, 14 bp, Homo sapiens
taccacaccctgcc

SEQ ID NO: 2159509 - DNA, 17 bp, Homo sapiens
taccacaccctgcctgc

SEQ ID NO: 2159510 - DNA, 18 bp, Homo sapiens
taccacaccctgcctgct

SEQ ID NO: 2159511 - DNA, 21 bp, Homo sapiens
taccaggcacatggctggggg

SEQ ID NO: 2159512 - DNA, 13 bp, Homo sapiens
tacccaaccactc

SEQ ID NO: 2159513 - DNA, 20 bp, Homo sapiens
tacccagagaatatatacat

SEQ ID NO: 2159514 - DNA, 12 bp, Homo sapiens
tacccttcctca

SEQ ID NO: 2159515 - DNA, 15 bp, Homo sapiens
tacccttcctcatct

SEQ ID NO: 2159516 - DNA, 12 bp, Homo sapiens
taccgcatggca

SEQ ID NO: 2159517 - DNA, 16 bp, Homo sapiens
taccgcatggcagctg

SEQ ID NO: 2159518 - DNA, 19 bp, Homo sapiens
taccgcatggcagctgggc

SEQ ID NO: 2159519 - DNA, 22 bp, Homo sapiens
taccgcatggcagctgggccca

SEQ ID NO: 2159520 - DNA, 19 bp, Homo sapiens
tacctaaacagatataaat

SEQ ID NO: 2159521 - DNA, 22 bp, Homo sapiens
tacctaaacagatataaatggc

SEQ ID NO: 2159522 - DNA, 12 bp, Homo sapiens
tactcagagctg

SEQ ID NO: 2159523 - DNA, 13 bp, Homo sapiens
tacttcccccacc

SEQ ID NO: 2159524 - DNA, 18 bp, Homo sapiens
tacttcccccaccctggg

SEQ ID NO: 2159525 - DNA, 17 bp, Homo sapiens
tagaatgtaaagcttgt

SEQ ID NO: 2159526 - DNA, 18 bp, Homo sapiens
tagaatgtaaagcttgtc

SEQ ID NO: 2159527 - DNA, 19 bp, Homo sapiens
tagactggaacttgaactg

SEQ ID NO: 2159528 - DNA, 16 bp, Homo sapiens
tagactggacagcttg

SEQ ID NO: 2159529 - DNA, 18 bp, Homo sapiens
tagactggacagcttgtg

SEQ ID NO: 2159530 - DNA, 20 bp, Homo sapiens
tagacttcgactcaggatcc

SEQ ID NO: 2159531 - DNA, 13 bp, Homo sapiens
tagcacaagttat

SEQ ID NO: 2159532 - DNA, 19 bp, Homo sapiens
tagcacaagttatttaaat

SEQ ID NO: 2159533 - DNA, 19 bp, Homo sapiens
tagcctcaatttctgaaca

SEQ ID NO: 2159534 - DNA, 15 bp, Homo sapiens
tagctcttgggcctg

SEQ ID NO: 2159535 - DNA, 18 bp, Homo sapiens
tagctcttgggcctgacc

SEQ ID NO: 2159536 - DNA, 14 bp, Homo sapiens
tagctgatcagttt

SEQ ID NO: 2159537 - DNA, 18 bp, Homo sapiens
tagggcctcggaggctcc

SEQ ID NO: 2159538 - DNA, 21 bp, Homo sapiens
tagggcctcggaggctcctcc

SEQ ID NO: 2159539 - DNA, 14 bp, Homo sapiens
tagggctggaccta

SEQ ID NO: 2159540 - DNA, 14 bp, Homo sapiens
taggtaggaaatgt

SEQ ID NO: 2159541 - DNA, 17 bp, Homo sapiens
tagtcagagtgtccctt

SEQ ID NO: 2159542 - DNA, 18 bp, Homo sapiens
tagtctcctttgcactga

SEQ ID NO: 2159543 - DNA, 21 bp, Homo sapiens
tagtctcctttgcactgaggg

SEQ ID NO: 2159544 - DNA, 22 bp, Homo sapiens
tagtctcctttgcactgagggc

SEQ ID NO: 2159545 - DNA, 20 bp, Homo sapiens
tagtgtcttcctagtatatt

SEQ ID NO: 2159546 - DNA, 18 bp, Homo sapiens
tatagtatatctggacaa

SEQ ID NO: 2159547 - DNA, 22 bp, Homo sapiens
tatatatttttggttgtcaata

SEQ ID NO: 2159548 - DNA, 23 bp, Homo sapiens
tatatcagcctgagtctcctgtg

SEQ ID NO: 2159549 - DNA, 14 bp, Homo sapiens
tatatcataaagta

SEQ ID NO: 2159550 - DNA, 17 bp, Homo sapiens
tatatctatatctctaa

SEQ ID NO: 2159551 - DNA, 15 bp, Homo sapiens
tatatgtatatgtat

SEQ ID NO: 2159552 - DNA, 19 bp, Homo sapiens
tatcagcctgagtctcctg

SEQ ID NO: 2159553 - DNA, 14 bp, Homo sapiens
tatcataaagtatg

SEQ ID NO: 2159554 - DNA, 19 bp, Homo sapiens
tatctaagttaatttaaag

SEQ ID NO: 2159555 - DNA, 23 bp, Homo sapiens
tatctaagttaatttaaagttgt

SEQ ID NO: 2159556 - DNA, 18 bp, Homo sapiens
tatctggacaagccaact

SEQ ID NO: 2159557 - DNA, 15 bp, Homo sapiens
tatgattgtttgcac

SEQ ID NO: 2159558 - DNA, 20 bp, Homo sapiens
tatgccctcagatggagaca

SEQ ID NO: 2159559 - DNA, 14 bp, Homo sapiens
tatgcctgctattt

SEQ ID NO: 2159560 - DNA, 17 bp, Homo sapiens
tatgccttcctgtttaa

SEQ ID NO: 2159561 - DNA, 13 bp, Homo sapiens
tattaaatacaga

SEQ ID NO: 2159562 - DNA, 21 bp, Homo sapiens
tattaaatacagacactaagt

SEQ ID NO: 2159563 - DNA, 12 bp, Homo sapiens
tattcaggactt

SEQ ID NO: 2159564 - DNA, 18 bp, Homo sapiens
tattcatgctttctcctt

SEQ ID NO: 2159565 - DNA, 20 bp, Homo sapiens
tattcatgctttctcctttt

SEQ ID NO: 2159566 - DNA, 20 bp, Homo sapiens
tattctacacatatatgtat

SEQ ID NO: 2159567 - DNA, 16 bp, Homo sapiens
tatttccacataaagg

SEQ ID NO: 2159568 - DNA, 18 bp, Homo sapiens
tatttccacataaaggta

SEQ ID NO: 2159569 - DNA, 16 bp, Homo sapiens
tattttgaatgtgaag

SEQ ID NO: 2159570 - DNA, 15 bp, Homo sapiens
tattttttatttcca

SEQ ID NO: 2159571 - DNA, 16 bp, Homo sapiens
tcaaaacagattgttt

SEQ ID NO: 2159572 - DNA, 12 bp, Homo sapiens
tcaaaacattgt

SEQ ID NO: 2159573 - DNA, 16 bp, Homo sapiens
tcaaatctattcagac

SEQ ID NO: 2159574 - DNA, 15 bp, Homo sapiens
tcaacctgtgtctta

SEQ ID NO: 2159575 - DNA, 17 bp, Homo sapiens
tcaagagtctctccagc

SEQ ID NO: 2159576 - DNA, 18 bp, Homo sapiens
tcaagagtctctccagcc

SEQ ID NO: 2159577 - DNA, 23 bp, Homo sapiens
tcaagttgttccttaagtcagaa

SEQ ID NO: 2159578 - DNA, 15 bp, Homo sapiens
tcaatattaaataca

SEQ ID NO: 2159579 - DNA, 17 bp, Homo sapiens
tcaatattaaatacaga

SEQ ID NO: 2159580 - DNA, 15 bp, Homo sapiens
tcaatttctgaacac

SEQ ID NO: 2159581 - DNA, 12 bp, Homo sapiens
tcacactccaga

SEQ ID NO: 2159582 - DNA, 13 bp, Homo sapiens
tcacactcctcct

SEQ ID NO: 2159583 - DNA, 17 bp, Homo sapiens
tcacactcctcctgcca

SEQ ID NO: 2159584 - DNA, 18 bp, Homo sapiens
tcacactcctcctgccag

SEQ ID NO: 2159585 - DNA, 14 bp, Homo sapiens
tcacagactcttcc

SEQ ID NO: 2159586 - DNA, 18 bp, Homo sapiens
tcacagactcttccacca

SEQ ID NO: 2159587 - DNA, 14 bp, Homo sapiens
tcacagatgctggc

SEQ ID NO: 2159588 - DNA, 13 bp, Homo sapiens
tcacagcctctcc

SEQ ID NO: 2159589 - DNA, 14 bp, Homo sapiens
tcacagcctctccc

SEQ ID NO: 2159590 - DNA, 11 bp, Homo sapiens
tcaccatgcaa

SEQ ID NO: 2159591 - DNA, 21 bp, Homo sapiens
tcacccagctaatctgtaggg

SEQ ID NO: 2159592 - DNA, 19 bp, Homo sapiens
tcaccctggccaccaccca

SEQ ID NO: 2159593 - DNA, 19 bp, Homo sapiens
tcacctggaagcatttgtt

SEQ ID NO: 2159594 - DNA, 20 bp, Homo sapiens
tcactcctgttacttaccta

SEQ ID NO: 2159595 - DNA, 21 bp, Homo sapiens
tcacttttaatgaacaaatgg

SEQ ID NO: 2159596 - DNA, 23 bp, Homo sapiens
tcagaacagcagactcagctctg

SEQ ID NO: 2159597 - DNA, 11 bp, Homo sapiens
tcagacaagca

SEQ ID NO: 2159598 - DNA, 14 bp, Homo sapiens
tcagagctttgtca

SEQ ID NO: 2159599 - DNA, 16 bp, Homo sapiens
tcagagctttgtcact

SEQ ID NO: 2159600 - DNA, 22 bp, Homo sapiens
tcagagcttttcgaactgtgct

SEQ ID NO: 2159601 - DNA, 23 bp, Homo sapiens
tcagagcttttcgaactgtgctc

SEQ ID NO: 2159602 - DNA, 23 bp, Homo sapiens
tcagagtgtccctttttgcaggg

SEQ ID NO: 2159603 - DNA, 12 bp, Homo sapiens
tcagcagccccc

SEQ ID NO: 2159604 - DNA, 14 bp, Homo sapiens
tcagccccgcctgt

SEQ ID NO: 2159605 - DNA, 17 bp, Homo sapiens
tcagccccgcctgtcac

SEQ ID NO: 2159606 - DNA, 21 bp, Homo sapiens
tcagccccgcctgtcacaata

SEQ ID NO: 2159607 - DNA, 19 bp, Homo sapiens
tcagccgagccgggcctgg

SEQ ID NO: 2159608 - DNA, 16 bp, Homo sapiens
tcagcctgagtctcct

SEQ ID NO: 2159609 - DNA, 17 bp, Homo sapiens
tcagctgtggtcccacc

SEQ ID NO: 2159610 - DNA, 18 bp, Homo sapiens
tcaggagcacaggcagct

SEQ ID NO: 2159611 - DNA, 20 bp, Homo sapiens
ttagcctcaatttctgaaca

SEQ ID NO: 2159612 - DNA, 18 bp, Homo sapiens
ttatagtatatctggaca

SEQ ID NO: 2159613 - DNA, 20 bp, Homo sapiens
ttatttttatatcagcctga

SEQ ID NO: 2159614 - DNA, 14 bp, Homo sapiens
ttcaaaaaaacact

SEQ ID NO: 2159615 - DNA, 18 bp, Homo sapiens
ttcaaaaaaacactagtt

SEQ ID NO: 2159616 - DNA, 18 bp, Homo sapiens
ttcacccagctaatctgt

SEQ ID NO: 2159617 - DNA, 21 bp, Homo sapiens
ttcacctggaagcatttgttt

SEQ ID NO: 2159618 - DNA, 14 bp, Homo sapiens
ttcatgctttctcc

SEQ ID NO: 2159619 - DNA, 16 bp, Homo sapiens
ttcatgctttctcctt

SEQ ID NO: 2159620 - DNA, 23 bp, Homo sapiens
ttccaccagagcaggggctgctg

SEQ ID NO: 2159621 - DNA, 14 bp, Homo sapiens
ttccatgcctgagg

SEQ ID NO: 2159622 - DNA, 15 bp, Homo sapiens
ttccatgcctgaggg

SEQ ID NO: 2159623 - DNA, 22 bp, Homo sapiens
ttccatgcctgagggtggagac

SEQ ID NO: 2159624 - DNA, 23 bp, Homo sapiens
ttccatgcctgagggtggagact

SEQ ID NO: 2159625 - DNA, 16 bp, Homo sapiens
ttcccccaccctgggt

SEQ ID NO: 2159626 - DNA, 16 bp, Homo sapiens
ttcccccatccctacc

SEQ ID NO: 2159627 - DNA, 19 bp, Homo sapiens
ttccccttgtccctggggc

SEQ ID NO: 2159628 - DNA, 20 bp, Homo sapiens
ttccctccccacagtcctca

SEQ ID NO: 2159629 - DNA, 16 bp, Homo sapiens
ttcctcatctgtgcct

SEQ ID NO: 2159630 - DNA, 18 bp, Homo sapiens
ttcctcatctgtgcctgt

SEQ ID NO: 2159631 - DNA, 22 bp, Homo sapiens
ttcctgacccggattggccctg

SEQ ID NO: 2159632 - DNA, 22 bp, Homo sapiens
ttcgaaacctgtccataaagta

SEQ ID NO: 2159633 - DNA, 20 bp, Homo sapiens
ttcggacagtttatttgttg

SEQ ID NO: 2159634 - DNA, 19 bp, Homo sapiens
ttctaataaatcaatgtga

SEQ ID NO: 2159635 - DNA, 14 bp, Homo sapiens
ttctatcacatatt

SEQ ID NO: 2159636 - DNA, 14 bp, Homo sapiens
ttctccagccagca

SEQ ID NO: 2159637 - DNA, 12 bp, Homo sapiens
ttctcccagcac

SEQ ID NO: 2159638 - DNA, 13 bp, Homo sapiens
ttctgctggcctg

SEQ ID NO: 2159639 - DNA, 16 bp, Homo sapiens
ttctgtccagtttcca

SEQ ID NO: 2159640 - DNA, 22 bp, Homo sapiens
ttcttattcatgctttctcctt

SEQ ID NO: 2159641 - DNA, 14 bp, Homo sapiens
ttctttacctgaga

SEQ ID NO: 2159642 - DNA, 20 bp, Homo sapiens
ttctttacctgagaccagtt

SEQ ID NO: 2159643 - DNA, 14 bp, Homo sapiens
ttgaaaacccctgg

SEQ ID NO: 2159644 - DNA, 16 bp, Homo sapiens
ttgaaaacccctggct

SEQ ID NO: 2159645 - DNA, 19 bp, Homo sapiens
ttgaagaatgttaagactt

SEQ ID NO: 2159646 - DNA, 21 bp, Homo sapiens
ttgaagaatgttaagacttga

SEQ ID NO: 2159647 - DNA, 18 bp, Homo sapiens
ttgaaggagaaaatgcat

SEQ ID NO: 2159648 - DNA, 19 bp, Homo sapiens
ttgagaaggaaaattttag

SEQ ID NO: 2159649 - DNA, 13 bp, Homo sapiens
ttgagggtaggag

SEQ ID NO: 2159650 - DNA, 21 bp, Homo sapiens
ttgcactgagggccacactat

SEQ ID NO: 2159651 - DNA, 14 bp, Homo sapiens
ttgcaggggactgg

SEQ ID NO: 2159652 - DNA, 21 bp, Homo sapiens
ttgccacatggtgtctcccaa

SEQ ID NO: 2159653 - DNA, 23 bp, Homo sapiens
ttgccacatggtgtctcccaaca

SEQ ID NO: 2159654 - DNA, 21 bp, Homo sapiens
ttgcccacacacactccttcc

SEQ ID NO: 2159655 - DNA, 12 bp, Homo sapiens
ttgcccttcctg

SEQ ID NO: 2159656 - DNA, 13 bp, Homo sapiens
ttgcccttcctga

SEQ ID NO: 2159657 - DNA, 17 bp, Homo sapiens
ttgcctgaactccagag

SEQ ID NO: 2159658 - DNA, 14 bp, Homo sapiens
ttgcctgtaacaag

SEQ ID NO: 2159659 - DNA, 16 bp, Homo sapiens
ttgctcaaaaatctgt

SEQ ID NO: 2159660 - DNA, 21 bp, Homo sapiens
ttgctcgaagactgtgacatc

SEQ ID NO: 2159661 - DNA, 20 bp, Homo sapiens
ttggcagaactgctggggct

SEQ ID NO: 2159662 - DNA, 15 bp, Homo sapiens
ttggcccctggaacc

SEQ ID NO: 2159663 - DNA, 21 bp, Homo sapiens
ttggcccctggaacctttccc

SEQ ID NO: 2159664 - DNA, 12 bp, Homo sapiens
ttggccctgccc

SEQ ID NO: 2159665 - DNA, 15 bp, Homo sapiens
ttggccctgcccctc

SEQ ID NO: 2159666 - DNA, 23 bp, Homo sapiens
ttggccctgcccctccccctacc

SEQ ID NO: 2159667 - DNA, 15 bp, Homo sapiens
ttgggagcactggag

SEQ ID NO: 2159668 - DNA, 22 bp, Homo sapiens
ttgggagcactggagtgcaggg

SEQ ID NO: 2159669 - DNA, 20 bp, Homo sapiens
ttgggcagaatcctgggccc

SEQ ID NO: 2159670 - DNA, 22 bp, Homo sapiens
ttggttgtcaatattaaataca

SEQ ID NO: 2159671 - DNA, 11 bp, Homo sapiens
ttgtaaataca

SEQ ID NO: 2159672 - DNA, 14 bp, Homo sapiens
ttgtaaatacacca

SEQ ID NO: 2159673 - DNA, 14 bp, Homo sapiens
ttgtaaatattgtg

SEQ ID NO: 2159674 - DNA, 16 bp, Homo sapiens
ttgtacaaagatatgc

SEQ ID NO: 2159675 - DNA, 14 bp, Homo sapiens
ttgtcacttgccac

SEQ ID NO: 2159676 - DNA, 17 bp, Homo sapiens
ttgtcacttgccacatg

SEQ ID NO: 2159677 - DNA, 17 bp, Homo sapiens
ttgtccctggggcactc

SEQ ID NO: 2159678 - DNA, 20 bp, Homo sapiens
ttgtgaaattcaacctgtgt

SEQ ID NO: 2159679 - DNA, 16 bp, Homo sapiens
ttgtggcaagtgaatt

SEQ ID NO: 2159680 - DNA, 14 bp, Homo sapiens
ttgtggtaaaaaga

SEQ ID NO: 2159681 - DNA, 14 bp, Homo sapiens
ttgtttgttcacac

SEQ ID NO: 2159682 - DNA, 18 bp, Homo sapiens
tttaaaaaaagtatatat

SEQ ID NO: 2159683 - DNA, 22 bp, Homo sapiens
tttaaaaaaagtatatattcta

SEQ ID NO: 2159684 - DNA, 20 bp, Homo sapiens
tttaaatctgtttttctaac

SEQ ID NO: 2159685 - DNA, 16 bp, Homo sapiens
tttaacaaaagcaaga

SEQ ID NO: 2159686 - DNA, 22 bp, Homo sapiens
tttaagttttgtttgttcacac

SEQ ID NO: 2159687 - DNA, 16 bp, Homo sapiens
tttaatgaacaaatgg

SEQ ID NO: 2159688 - DNA, 13 bp, Homo sapiens
tttacctgagacc

SEQ ID NO: 2159689 - DNA, 16 bp, Homo sapiens
tttatattgtaaatat

SEQ ID NO: 2159690 - DNA, 18 bp, Homo sapiens
tttattaaaaactgagtg

SEQ ID NO: 2159691 - DNA, 18 bp, Homo sapiens
tttatttccacataaagg

SEQ ID NO: 2159692 - DNA, 14 bp, Homo sapiens
tttatttgttgaga

SEQ ID NO: 2159693 - DNA, 18 bp, Homo sapiens
tttcacctggaagcattt

SEQ ID NO: 2159694 - DNA, 21 bp, Homo sapiens
tttcagctattagcaactgtg

SEQ ID NO: 2159695 - DNA, 23 bp, Homo sapiens
tttcagctattagcaactgtgct

SEQ ID NO: 2159696 - DNA, 14 bp, Homo sapiens
tttccacataaagg

SEQ ID NO: 2159697 - DNA, 15 bp, Homo sapiens
tttccactgccaaaa

SEQ ID NO: 2159698 - DNA, 22 bp, Homo sapiens
tttctaaagctctgaacaaaag

SEQ ID NO: 2159699 - DNA, 18 bp, Homo sapiens
tttctccagccagcaatg

SEQ ID NO: 2159700 - DNA, 20 bp, Homo sapiens
tttgcacctttctagttgaa

SEQ ID NO: 2159701 - DNA, 12 bp, Homo sapiens
tttgcactgagg

SEQ ID NO: 2159702 - DNA, 17 bp, Homo sapiens
tttgcactgagggccac

SEQ ID NO: 2159703 - DNA, 22 bp, Homo sapiens
tttgcactgagggccacactat

SEQ ID NO: 2159704 - DNA, 16 bp, Homo sapiens
tttgcattagacagat

SEQ ID NO: 2159705 - DNA, 12 bp, Homo sapiens
tttgcctgtaac

SEQ ID NO: 2159706 - DNA, 21 bp, Homo sapiens
tttggatgggagtgagacaga

SEQ ID NO: 2159707 - DNA, 17 bp, Homo sapiens
tttggcagaactgctgg

SEQ ID NO: 2159708 - DNA, 21 bp, Homo sapiens
tttggcagaactgctggggct

SEQ ID NO: 2159709 - DNA, 14 bp, Homo sapiens
tttgtccaggcctg

SEQ ID NO: 2159710 - DNA, 23 bp, Homo sapiens
ttttcacctggaagcatttgttt

SEQ ID NO: 2159711 - DNA, 24 bp, Homo sapiens
ttttcagaattgaaggagaaaatg

SEQ ID NO: 2159712 - DNA, 20 bp, Homo sapiens
ttttcagctattagcaactg

SEQ ID NO: 2159713 - DNA, 18 bp, Homo sapiens
ttttgaaaacccctggct

SEQ ID NO: 2159714 - DNA, 15 bp, Homo sapiens
ttttgcaggggactg

SEQ ID NO: 2159715 - DNA, 22 bp, Homo sapiens
ttttggttgtcaatattaaata

SEQ ID NO: 2159716 - DNA, 15 bp, Homo sapiens
tttttccgtaaaaat

SEQ ID NO: 2159717 - DNA, 12 bp, Homo sapiens
aaacactgtgta

SEQ ID NO: 2159718 - DNA, 19 bp, Homo sapiens
aaacttgtgtatgatccaa

SEQ ID NO: 2159719 - DNA, 14 bp, Homo sapiens
aaatataaacttgt

SEQ ID NO: 2159720 - DNA, 14 bp, Homo sapiens
aaatatacaaacat

SEQ ID NO: 2159721 - DNA, 20 bp, Homo sapiens
aaatgcaaacactgtgtatt

SEQ ID NO: 2159722 - DNA, 22 bp, Homo sapiens
aaatgtagtatggcctgtgtca

SEQ ID NO: 2159723 - DNA, 19 bp, Homo sapiens
aaatgtgtaaatgtggaca

SEQ ID NO: 2159724 - DNA, 15 bp, Homo sapiens
aacaccactttgtct

SEQ ID NO: 2159725 - DNA, 16 bp, Homo sapiens
aacactgtgtatttat

SEQ ID NO: 2159726 - DNA, 13 bp, Homo sapiens
aacctcaaactgg

SEQ ID NO: 2159727 - DNA, 22 bp, Homo sapiens
aactaccgttcccaaattggtg

SEQ ID NO: 2159728 - DNA, 18 bp, Homo sapiens
aacttcctttgagaattg

SEQ ID NO: 2159729 - DNA, 21 bp, Homo sapiens
aagaaggcacaggtgtaaata

SEQ ID NO: 2159730 - DNA, 19 bp, Homo sapiens
aagacttctctttgcctca

SEQ ID NO: 2159731 - DNA, 17 bp, Homo sapiens
aaggcacaggtgtaaat

SEQ ID NO: 2159732 - DNA, 15 bp, Homo sapiens
aatatggacaaagaa

SEQ ID NO: 2159733 - DNA, 12 bp, Homo sapiens
aatgctaaatgc

SEQ ID NO: 2159734 - DNA, 21 bp, Homo sapiens
aattgtgcgacttcacaaaat

SEQ ID NO: 2159735 - DNA, 19 bp, Homo sapiens
acaccactttgtctctgag

SEQ ID NO: 2159736 - DNA, 18 bp, Homo sapiens
acagaaaaaaataaaaac

SEQ ID NO: 2159737 - DNA, 12 bp, Homo sapiens
acaggtgtaaat

SEQ ID NO: 2159738 - DNA, 13 bp, Homo sapiens
acaggtgtaaata

SEQ ID NO: 2159739 - DNA, 19 bp, Homo sapiens
acataaaatatacaaacat

SEQ ID NO: 2159740 - DNA, 20 bp, Homo sapiens
acataaaatatacaaacatg

SEQ ID NO: 2159741 - DNA, 17 bp, Homo sapiens
accaaatataaacttgt

SEQ ID NO: 2159742 - DNA, 14 bp, Homo sapiens
accagctgccaaaa

SEQ ID NO: 2159743 - DNA, 14 bp, Homo sapiens
acctcaaactgggt

SEQ ID NO: 2159744 - DNA, 18 bp, Homo sapiens
acctgtgtttcttgcctc

SEQ ID NO: 2159745 - DNA, 20 bp, Homo sapiens
acctgtgtttcttgcctcat

SEQ ID NO: 2159746 - DNA, 17 bp, Homo sapiens
actggaatcctttcagc

SEQ ID NO: 2159747 - DNA, 17 bp, Homo sapiens
aaaacataaaatataca

SEQ ID NO: 2159748 - DNA, 18 bp, Homo sapiens
aaaataaaaacataaaat

SEQ ID NO: 2159749 - DNA, 17 bp, Homo sapiens
aaaatatacaaacatgt

SEQ ID NO: 2159750 - DNA, 18 bp, Homo sapiens
gctgttccacttctctag

SEQ ID NO: 2159751 - DNA, 17 bp, Homo sapiens
ggaactggaatcctttc

SEQ ID NO: 2159752 - DNA, 15 bp, Homo sapiens
gtatggcctgtgtca

SEQ ID NO: 2159753 - DNA, 22 bp, Homo sapiens
gtattttatctgtgttgtctct

SEQ ID NO: 2159754 - DNA, 17 bp, Homo sapiens
gtgcgacttcacaaaat

SEQ ID NO: 2159755 - DNA, 18 bp, Homo sapiens
gtgctcttctgttctcaa

SEQ ID NO: 2159756 - DNA, 14 bp, Homo sapiens
gtgtttcttgcctc

SEQ ID NO: 2159757 - DNA, 14 bp, Homo sapiens
gttccacttctcta

SEQ ID NO: 2159758 - DNA, 13 bp, Homo sapiens
gttgtctctctaa

SEQ ID NO: 2159759 - DNA, 22 bp, Homo sapiens
gtttcttgcctcatttttttcc

SEQ ID NO: 2159760 - DNA, 13 bp, Homo sapiens
taaaaacataaaa

SEQ ID NO: 2159761 - DNA, 17 bp, Homo sapiens
taaaaagtgcttttgtg

SEQ ID NO: 2159762 - DNA, 14 bp, Homo sapiens
taaaatatacaaac

SEQ ID NO: 2159763 - DNA, 15 bp, Homo sapiens
taaaatatacaaaca

SEQ ID NO: 2159764 - DNA, 18 bp, Homo sapiens
taaaatatacaaacatgt

SEQ ID NO: 2159765 - DNA, 13 bp, Homo sapiens
taaacttgtgtat

SEQ ID NO: 2159766 - DNA, 20 bp, Homo sapiens
taaagacagaaaaaaataaa

SEQ ID NO: 2159767 - DNA, 12 bp, Homo sapiens
taaatgtgtaaa

SEQ ID NO: 2159768 - DNA, 18 bp, Homo sapiens
taccaaatataaacttgt

SEQ ID NO: 2159769 - DNA, 14 bp, Homo sapiens
taggtgtgccaaac

SEQ ID NO: 2159770 - DNA, 16 bp, Homo sapiens
tagttaggtgtgccaa

SEQ ID NO: 2159771 - DNA, 20 bp, Homo sapiens
tagttaggtgtgccaaacta

SEQ ID NO: 2159772 - DNA, 15 bp, Homo sapiens
tatacaaacatgtgg

SEQ ID NO: 2159773 - DNA, 21 bp, Homo sapiens
tattagttaggtgtgccaaac

SEQ ID NO: 2159774 - DNA, 17 bp, Homo sapiens
tcaaaatagtgccacta

SEQ ID NO: 2159775 - DNA, 13 bp, Homo sapiens
tcaaatgctaaat

SEQ ID NO: 2159776 - DNA, 22 bp, Homo sapiens
tcaagagccctgtcagtagagt

SEQ ID NO: 2159777 - DNA, 12 bp, Homo sapiens
tcacaaaatgca

SEQ ID NO: 2159778 - DNA, 13 bp, Homo sapiens
tcacaaaatgcaa

SEQ ID NO: 2159779 - DNA, 20 bp, Homo sapiens
tcaccagctgccaaaatcgt

SEQ ID NO: 2159780 - DNA, 15 bp, Homo sapiens
tcatttttttccttg

SEQ ID NO: 2159781 - DNA, 13 bp, Homo sapiens
tccaagtatttta

SEQ ID NO: 2159782 - DNA, 17 bp, Homo sapiens
tccaagtattttatctg

SEQ ID NO: 2159783 - DNA, 21 bp, Homo sapiens
tccaagtattttatctgtgtt

SEQ ID NO: 2159784 - DNA, 16 bp, Homo sapiens
tcctaccaaatataaa

SEQ ID NO: 2159785 - DNA, 19 bp, Homo sapiens
tctcaaatgctaaatgcaa

SEQ ID NO: 2159786 - DNA, 14 bp, Homo sapiens
tctctgagaacaga

SEQ ID NO: 2159787 - DNA, 22 bp, Homo sapiens
tcttccagtttgctttgccctt

SEQ ID NO: 2159788 - DNA, 13 bp, Homo sapiens
tcttctgttctca

SEQ ID NO: 2159789 - DNA, 15 bp, Homo sapiens
tgaatgacatcaaca

SEQ ID NO: 2159790 - DNA, 17 bp, Homo sapiens
tgacctatacctgtgtt

SEQ ID NO: 2159791 - DNA, 23 bp, Homo sapiens
tgacctatacctgtgtttcttgc

SEQ ID NO: 2159792 - DNA, 15 bp, Homo sapiens
tgcaaacactgtgta

SEQ ID NO: 2159793 - DNA, 20 bp, Homo sapiens
tgcacgtgctcttctgttct

SEQ ID NO: 2159794 - DNA, 16 bp, Homo sapiens
tgcccttctttctacc

SEQ ID NO: 2159795 - DNA, 21 bp, Homo sapiens
tgcccttctttctaccctgct

SEQ ID NO: 2159796 - DNA, 12 bp, Homo sapiens
tgcctcaaataa

SEQ ID NO: 2159797 - DNA, 15 bp, Homo sapiens
tgctcttctgttctc

SEQ ID NO: 2159798 - DNA, 20 bp, Homo sapiens
tggaactggaatcctttcag

SEQ ID NO: 2159799 - DNA, 16 bp, Homo sapiens
tggcctgtgtcactca

SEQ ID NO: 2159800 - DNA, 17 bp, Homo sapiens
tgtgtttcttgcctcat

SEQ ID NO: 2159801 - DNA, 17 bp, Homo sapiens
ttagttaggtgtgccaa

SEQ ID NO: 2159802 - DNA, 17 bp, Homo sapiens
ttatggagtgtcaccag

SEQ ID NO: 2159803 - DNA, 14 bp, Homo sapiens
ttccacttctctag

SEQ ID NO: 2159804 - DNA, 14 bp, Homo sapiens
ttctctttgcctca

SEQ ID NO: 2159805 - DNA, 12 bp, Homo sapiens
ttcttgcctcat

SEQ ID NO: 2159806 - DNA, 22 bp, Homo sapiens
ttgcaaatgtagtatggcctgt

SEQ ID NO: 2159807 - DNA, 20 bp, Homo sapiens
ttgctcaccaagctgttcca

SEQ ID NO: 2159808 - DNA, 14 bp, Homo sapiens
tttctgaccaaaga

SEQ ID NO: 2159809 - DNA, 12 bp, Homo sapiens
tttcttgcctca

SEQ ID NO: 2159810 - DNA, 13 bp, Homo sapiens
aaacactgtgtat

SEQ ID NO: 2159811 - DNA, 24 bp, Homo sapiens
aaacataaaatatacaaacatgtg

SEQ ID NO: 2159812 - DNA, 17 bp, Homo sapiens
aaacccaaataaatgtg

SEQ ID NO: 2159813 - DNA, 16 bp, Homo sapiens
aaataaaaagtgcttt

SEQ ID NO: 2159814 - DNA, 15 bp, Homo sapiens
aaataaatgtgtaaa

SEQ ID NO: 2159815 - DNA, 20 bp, Homo sapiens
aaatataaacttgtgtatga

SEQ ID NO: 2159816 - DNA, 15 bp, Homo sapiens
aaatgctaaatgcaa

SEQ ID NO: 2159817 - DNA, 14 bp, Homo sapiens
aaattggtgtttct

SEQ ID NO: 2159818 - DNA, 15 bp, Homo sapiens
aacataaaatataca

SEQ ID NO: 2159819 - DNA, 20 bp, Homo sapiens
aacctgttcttcctaccaaa

SEQ ID NO: 2159820 - DNA, 23 bp, Homo sapiens
aagaaggcacaggtgtaaatata

SEQ ID NO: 2159821 - DNA, 12 bp, Homo sapiens
aagctgttccac

SEQ ID NO: 2159822 - DNA, 17 bp, Homo sapiens
aataaatgtgtaaatgt

SEQ ID NO: 2159823 - DNA, 18 bp, Homo sapiens
aataaatgtgtaaatgtg

SEQ ID NO: 2159824 - DNA, 12 bp, Homo sapiens
aatataaacttg

SEQ ID NO: 2159825 - DNA, 14 bp, Homo sapiens
aatatacaaacatg

SEQ ID NO: 2159826 - DNA, 15 bp, Homo sapiens
aatatacaaacatgt

SEQ ID NO: 2159827 - DNA, 20 bp, Homo sapiens
aatatacaaacatgtggcaa

SEQ ID NO: 2159828 - DNA, 18 bp, Homo sapiens
acaccactttgtctctga

SEQ ID NO: 2159829 - DNA, 20 bp, Homo sapiens
accagctgccaaaatcgtag

SEQ ID NO: 2159830 - DNA, 13 bp, Homo sapiens
acccaaataaatg

SEQ ID NO: 2159831 - DNA, 15 bp, Homo sapiens
acccaaataaatgtg

SEQ ID NO: 2159832 - DNA, 21 bp, Homo sapiens
acccaaataaatgtgtaaatg

SEQ ID NO: 2159833 - DNA, 18 bp, Homo sapiens
acctatacctgtgtttct

SEQ ID NO: 2159834 - DNA, 17 bp, Homo sapiens
acctgtgtttcttgcct

SEQ ID NO: 2159835 - DNA, 22 bp, Homo sapiens
acgtgctcttctgttctcaaat

SEQ ID NO: 2159836 - DNA, 11 bp, Homo sapiens
acttctctaga

SEQ ID NO: 2159837 - DNA, 17 bp, Homo sapiens
acttctctttgcctcaa

SEQ ID NO: 2159838 - DNA, 19 bp, Homo sapiens
agaaggcacaggtgtaaat

SEQ ID NO: 2159839 - DNA, 23 bp, Homo sapiens
agaattgtgcgacttcacaaaat

SEQ ID NO: 2159840 - DNA, 17 bp, Homo sapiens
agacagaaaaaaataaa

SEQ ID NO: 2159841 - DNA, 21 bp, Homo sapiens
agacagaaaaaaataaaaaca

SEQ ID NO: 2159842 - DNA, 17 bp, Homo sapiens
agacgttaccaattatg

SEQ ID NO: 2159843 - DNA, 19 bp, Homo sapiens
agacttctctttgcctcaa

SEQ ID NO: 2159844 - DNA, 20 bp, Homo sapiens
agacttctctttgcctcaaa

SEQ ID NO: 2159845 - DNA, 22 bp, Homo sapiens
agcaagacttctctttgcctca

SEQ ID NO: 2159846 - DNA, 19 bp, Homo sapiens
agctgttccacttctctag

SEQ ID NO: 2159847 - DNA, 17 bp, Homo sapiens
aggcacaggtgtaaata

SEQ ID NO: 2159848 - DNA, 20 bp, Homo sapiens
aggtcaaaatagtgccacta

SEQ ID NO: 2159849 - DNA, 23 bp, Homo sapiens
aggtgaacaccactttgtctctg

SEQ ID NO: 2159850 - DNA, 14 bp, Homo sapiens
aggtgtaaatatag

SEQ ID NO: 2159851 - DNA, 14 bp, Homo sapiens
agttaggtgtgcca

SEQ ID NO: 2159852 - DNA, 13 bp, Homo sapiens
ataaacttgtgta

SEQ ID NO: 2159853 - DNA, 14 bp, Homo sapiens
ataaatgtgtaaat

SEQ ID NO: 2159854 - DNA, 16 bp, Homo sapiens
ataaatgtgtaaatgt

SEQ ID NO: 2159855 - DNA, 16 bp, Homo sapiens
atacaaacatgtggca

SEQ ID NO: 2159856 - DNA, 21 bp, Homo sapiens
atacctgtgtttcttgcctca

SEQ ID NO: 2159857 - DNA, 22 bp, Homo sapiens
atacctgtgtttcttgcctcat

SEQ ID NO: 2159858 - DNA, 15 bp, Homo sapiens
atatacaaacatgtg

SEQ ID NO: 2159859 - DNA, 15 bp, Homo sapiens
atgaggaacctcaaa

SEQ ID NO: 2159860 - DNA, 17 bp, Homo sapiens
atgatccaagtatttta

SEQ ID NO: 2159861 - DNA, 18 bp, Homo sapiens
attactaaagacagaaaa

SEQ ID NO: 2159862 - DNA, 20 bp, Homo sapiens
attagttaggtgtgccaaac

SEQ ID NO: 2159863 - DNA, 16 bp, Homo sapiens
caaaatagtgccacta

SEQ ID NO: 2159864 - DNA, 11 bp, Homo sapiens
caaacatgtgg

SEQ ID NO: 2159865 - DNA, 23 bp, Homo sapiens
caaagaaggcacaggtgtaaata

SEQ ID NO: 2159866 - DNA, 17 bp, Homo sapiens
caaataaatgtgtaaat

SEQ ID NO: 2159867 - DNA, 12 bp, Homo sapiens
caaatataaact

SEQ ID NO: 2159868 - DNA, 15 bp, Homo sapiens
caaatataaacttgt

SEQ ID NO: 2159869 - DNA, 22 bp, Homo sapiens
caaatgtagtatggcctgtgtc

SEQ ID NO: 2159870 - DNA, 24 bp, Homo sapiens
caacctgaatacccttttctgacc

SEQ ID NO: 2159871 - DNA, 20 bp, Homo sapiens
caagacttctctttgcctca

SEQ ID NO: 2159872 - DNA, 14 bp, Homo sapiens
cacaggtgtaaata

SEQ ID NO: 2159873 - DNA, 20 bp, Homo sapiens
caccagctgccaaaatcgta

SEQ ID NO: 2159874 - DNA, 21 bp, Homo sapiens
caggtgtaaatatagtagcag

SEQ ID NO: 2159875 - DNA, 17 bp, Homo sapiens
cataaaatatacaaaca

SEQ ID NO: 2159876 - DNA, 13 bp, Homo sapiens
ccaaataaatgtg

SEQ ID NO: 2159877 - DNA, 22 bp, Homo sapiens
ccaagtgacctatacctgtgtt

SEQ ID NO: 2159878 - DNA, 17 bp, Homo sapiens
ccagcgagggcgtgtct

SEQ ID NO: 2159879 - DNA, 13 bp, Homo sapiens
ccagtttgctttg

SEQ ID NO: 2159880 - DNA, 19 bp, Homo sapiens
cccaaataaatgtgtaaat

SEQ ID NO: 2159881 - DNA, 14 bp, Homo sapiens
ccctactgagaaac

SEQ ID NO: 2159882 - DNA, 11 bp, Homo sapiens
cctcaaactgg

SEQ ID NO: 2159883 - DNA, 18 bp, Homo sapiens
cctcaaataaaaagtgct

SEQ ID NO: 2159884 - DNA, 21 bp, Homo sapiens
cctgaatacccttttctgacc

SEQ ID NO: 2159885 - DNA, 18 bp, Homo sapiens
cctgctcgtccccaagtg

SEQ ID NO: 2159886 - DNA, 18 bp, Homo sapiens
cctgtgtttcttgcctca

SEQ ID NO: 2159887 - DNA, 19 bp, Homo sapiens
cctgtgtttcttgcctcat

SEQ ID NO: 2159888 - DNA, 18 bp, Homo sapiens
ccttgctcaccaagctgt

SEQ ID NO: 2159889 - DNA, 13 bp, Homo sapiens
ccttttctgacca

SEQ ID NO: 2159890 - DNA, 14 bp, Homo sapiens
ctaaacccaaataa

SEQ ID NO: 2159891 - DNA, 19 bp, Homo sapiens
ctaaacccaaataaatgtg

SEQ ID NO: 2159892 - DNA, 12 bp, Homo sapiens
ctaaagacagaa

SEQ ID NO: 2159893 - DNA, 17 bp, Homo sapiens
ctaaatgcaaacactgt

SEQ ID NO: 2159894 - DNA, 16 bp, Homo sapiens
ctaccaaatataaact

SEQ ID NO: 2159895 - DNA, 18 bp, Homo sapiens
ctaccaaatataaacttg

SEQ ID NO: 2159896 - DNA, 19 bp, Homo sapiens
ctaccaaatataaacttgt

SEQ ID NO: 2159897 - DNA, 24 bp, Homo sapiens
ctcaaatgctaaatgcaaacactg

SEQ ID NO: 2159898 - DNA, 12 bp, Homo sapiens
ctctgagaacag

SEQ ID NO: 2159899 - DNA, 15 bp, Homo sapiens
ctcttctgttctcaa

SEQ ID NO: 2159900 - DNA, 19 bp, Homo sapiens
ctcttctgttctcaaatgc

SEQ ID NO: 2159901 - DNA, 16 bp, Homo sapiens
ctgttccacttctcta

SEQ ID NO: 2159902 - DNA, 17 bp, Homo sapiens
ctgttccacttctctag

SEQ ID NO: 2159903 - DNA, 22 bp, Homo sapiens
cttcctaccaaatataaacttg

SEQ ID NO: 2159904 - DNA, 13 bp, Homo sapiens
cttgcctcatttt

SEQ ID NO: 2159905 - DNA, 10 bp, Homo sapiens
cttgtgtatg

SEQ ID NO: 2159906 - DNA, 21 bp, Homo sapiens
gaaggcacaggtgtaaatata

SEQ ID NO: 2159907 - DNA, 22 bp, Homo sapiens
gaattgtgcgacttcacaaaat

SEQ ID NO: 2159908 - DNA, 20 bp, Homo sapiens
gacctatacctgtgtttctt

SEQ ID NO: 2159909 - DNA, 18 bp, Homo sapiens
gacttctctttgcctcaa

SEQ ID NO: 2159910 - DNA, 19 bp, Homo sapiens
gcaaacactgtgtatttat

SEQ ID NO: 2159911 - DNA, 22 bp, Homo sapiens
gcaagacttctctttgcctcaa

SEQ ID NO: 2159912 - DNA, 22 bp, Homo sapiens
gcaaggtgaacaccactttgtc

SEQ ID NO: 2159913 - DNA, 15 bp, Homo sapiens
gcctcatttttttcc

SEQ ID NO: 2159914 - DNA, 21 bp, Homo sapiens
gcctcatttttttccttgcaa

SEQ ID NO: 2159915 - DNA, 21 bp, Homo sapiens
gctaagccccctactgagaaa

SEQ ID NO: 2159916 - DNA, 19 bp, Homo sapiens
gctcgtccccaagtgacct

SEQ ID NO: 2159917 - DNA, 20 bp, Homo sapiens
gctcttctgttctcaaatgc

SEQ ID NO: 2159918 - DNA, 20 bp, Homo sapiens
taaatgcaaacactgtgtat

SEQ ID NO: 2159919 - DNA, 23 bp, Homo sapiens
taccaaatataaacttgtgtatg

SEQ ID NO: 2159920 - DNA, 21 bp, Homo sapiens
tactcttcagaatatggacaa

SEQ ID NO: 2159921 - DNA, 16 bp, Homo sapiens
tagtatggcctgtgtc

SEQ ID NO: 2159922 - DNA, 17 bp, Homo sapiens
tagttaggtgtgccaaa

SEQ ID NO: 2159923 - DNA, 21 bp, Homo sapiens
tagttaggtgtgccaaactac

SEQ ID NO: 2159924 - DNA, 14 bp, Homo sapiens
tataaacttgtgta

SEQ ID NO: 2159925 - DNA, 12 bp, Homo sapiens
tatacctgtgtt

SEQ ID NO: 2159926 - DNA, 22 bp, Homo sapiens
tatacctgtgtttcttgcctca

SEQ ID NO: 2159927 - DNA, 13 bp, Homo sapiens
tatgatccaagta

SEQ ID NO: 2159928 - DNA, 13 bp, Homo sapiens
tatggcctgtgtc

SEQ ID NO: 2159929 - DNA, 17 bp, Homo sapiens
tcaaatgctaaatgcaa

SEQ ID NO: 2159930 - DNA, 19 bp, Homo sapiens
tcagcaagacttctctttg

SEQ ID NO: 2159931 - DNA, 23 bp, Homo sapiens
tcagctaagccccctactgagaa

SEQ ID NO: 2159932 - DNA, 14 bp, Homo sapiens
tccacttctctaga

SEQ ID NO: 2159933 - DNA, 17 bp, Homo sapiens
tccacttctctagagaa

SEQ ID NO: 2159934 - DNA, 16 bp, Homo sapiens
tccattactaaagaca

SEQ ID NO: 2159935 - DNA, 23 bp, Homo sapiens
tctaaacccaaataaatgtgtaa

SEQ ID NO: 2159936 - DNA, 17 bp, Homo sapiens
tctcaaatgctaaatgc

SEQ ID NO: 2159937 - DNA, 15 bp, Homo sapiens
tctcaagagccctgt

SEQ ID NO: 2159938 - DNA, 14 bp, Homo sapiens
tctctaaacccaaa

SEQ ID NO: 2159939 - DNA, 13 bp, Homo sapiens
tctctagagaaca

SEQ ID NO: 2159940 - DNA, 14 bp, Homo sapiens
tctctagagaacat

SEQ ID NO: 2159941 - DNA, 21 bp, Homo sapiens
tctgagaacagacgttaccaa

SEQ ID NO: 2159942 - DNA, 13 bp, Homo sapiens
tctgctggtcact

SEQ ID NO: 2159943 - DNA, 13 bp, Homo sapiens
actggagtagttg

SEQ ID NO: 2159944 - DNA, 16 bp, Homo sapiens
actggagtagttgcta

SEQ ID NO: 2159945 - DNA, 16 bp, Homo sapiens
acttctctttgcctca

SEQ ID NO: 2159946 - DNA, 22 bp, Homo sapiens
agaaacttcctttgagaattgt

SEQ ID NO: 2159947 - DNA, 18 bp, Homo sapiens
agaacagacgttaccaat

SEQ ID NO: 2159948 - DNA, 14 bp, Homo sapiens
agaatatggacaaa

SEQ ID NO: 2159949 - DNA, 16 bp, Homo sapiens
agacttctctttgcct

SEQ ID NO: 2159950 - DNA, 18 bp, Homo sapiens
agacttctctttgcctca

SEQ ID NO: 2159951 - DNA, 17 bp, Homo sapiens
agctgccaaaatcgtag

SEQ ID NO: 2159952 - DNA, 22 bp, Homo sapiens
agcttgatgttggatctcaaga

SEQ ID NO: 2159953 - DNA, 19 bp, Homo sapiens
aggtgaacaccactttgtc

SEQ ID NO: 2159954 - DNA, 13 bp, Homo sapiens
aggtgtgccaaac

SEQ ID NO: 2159955 - DNA, 19 bp, Homo sapiens
agtagaagtctcttccagt

SEQ ID NO: 2159956 - DNA, 15 bp, Homo sapiens
agtatggcctgtgtc

SEQ ID NO: 2159957 - DNA, 17 bp, Homo sapiens
agttaggtgtgccaaac

SEQ ID NO: 2159958 - DNA, 19 bp, Homo sapiens
ataaaatatacaaacatgt

SEQ ID NO: 2159959 - DNA, 13 bp, Homo sapiens
ataaatgtgtaaa

SEQ ID NO: 2159960 - DNA, 20 bp, Homo sapiens
atacctgtgtttcttgcctc

SEQ ID NO: 2159961 - DNA, 12 bp, Homo sapiens
atataaacttgt

SEQ ID NO: 2159962 - DNA, 13 bp, Homo sapiens
atataaacttgtg

SEQ ID NO: 2159963 - DNA, 22 bp, Homo sapiens
atccaagtattttatctgtgtt

SEQ ID NO: 2159964 - DNA, 19 bp, Homo sapiens
atgaggaacctcaaactgg

SEQ ID NO: 2159965 - DNA, 22 bp, Homo sapiens
atgaggaacctcaaactgggta

SEQ ID NO: 2159966 - DNA, 23 bp, Homo sapiens
atttattagttaggtgtgccaaa

SEQ ID NO: 2159967 - DNA, 21 bp, Homo sapiens
attttatctgtgttgtctctc

SEQ ID NO: 2159968 - DNA, 11 bp, Homo sapiens
caaaatgcaag

SEQ ID NO: 2159969 - DNA, 15 bp, Homo sapiens
caaacactgtgtatt

SEQ ID NO: 2159970 - DNA, 19 bp, Homo sapiens
caaacatgtggcaacctgt

SEQ ID NO: 2159971 - DNA, 22 bp, Homo sapiens
caaacatgtggcaacctgttct

SEQ ID NO: 2159972 - DNA, 14 bp, Homo sapiens
caaagaaggcacag

SEQ ID NO: 2159973 - DNA, 22 bp, Homo sapiens
caaagaaggcacaggtgtaaat

SEQ ID NO: 2159974 - DNA, 18 bp, Homo sapiens
caaataaaaagtgctttt

SEQ ID NO: 2159975 - DNA, 12 bp, Homo sapiens
caaataaatgtg

SEQ ID NO: 2159976 - DNA, 19 bp, Homo sapiens
caaataaatgtgtaaatgt

SEQ ID NO: 2159977 - DNA, 10 bp, Homo sapiens
tgtgtaaatg

SEQ ID NO: 2159978 - DNA, 14 bp, Homo sapiens
tgtttcttgcctca

SEQ ID NO: 2159979 - DNA, 15 bp, Homo sapiens
tgtttcttgcctcat

SEQ ID NO: 2159980 - DNA, 18 bp, Homo sapiens
ttcagcaagacttctctt

SEQ ID NO: 2159981 - DNA, 17 bp, Homo sapiens
ttgagttttgactgctt

SEQ ID NO: 2159982 - DNA, 21 bp, Homo sapiens
ttgctcaccaagctgttccac

SEQ ID NO: 2159983 - DNA, 11 bp, Homo sapiens
ttgtctctgag

SEQ ID NO: 2159984 - DNA, 15 bp, Homo sapiens
ttgtgtatgatccaa

SEQ ID NO: 2159985 - DNA, 22 bp, Homo sapiens
tttatctgtgttgtctctctaa

SEQ ID NO: 2159986 - DNA, 13 bp, Homo sapiens
tttcttgcctcat

SEQ ID NO: 2159987 - DNA, 14 bp, Homo sapiens
tttgcctcaaataa

SEQ ID NO: 2159988 - DNA, 18 bp, Homo sapiens
tttgtctctgagaacaga

SEQ ID NO: 2159989 - DNA, 13 bp, Homo sapiens
ttttgactgcttg

SEQ ID NO: 2159990 - DNA, 14 bp, Homo sapiens
caccaagctgttcc

SEQ ID NO: 2159991 - DNA, 19 bp, Homo sapiens
cacgtgctcttctgttctc

SEQ ID NO: 2159992 - DNA, 22 bp, Homo sapiens
cagaatatggacaaagaaggca

SEQ ID NO: 2159993 - DNA, 20 bp, Homo sapiens
cagcaagacttctctttgcc

SEQ ID NO: 2159994 - DNA, 21 bp, Homo sapiens
caggatgaggaacctcaaact

SEQ ID NO: 2159995 - DNA, 23 bp, Homo sapiens
caggatgaggaacctcaaactgg

SEQ ID NO: 2159996 - DNA, 9 bp, Homo sapiens
cataaaata

SEQ ID NO: 2159997 - DNA, 12 bp, Homo sapiens
cataaaatatac

SEQ ID NO: 2159998 - DNA, 20 bp, Homo sapiens
cataaaatatacaaacatgt

SEQ ID NO: 2159999 - DNA, 18 bp, Homo sapiens
ccaaataaatgtgtaaat

SEQ ID NO: 2160000 - DNA, 20 bp, Homo sapiens
ccaaataaatgtgtaaatgt

SEQ ID NO: 2160001 - DNA, 21 bp, Homo sapiens
ccaagtattttatctgtgttg

SEQ ID NO: 2160002 - DNA, 14 bp, Homo sapiens
cccaaataaatgtg

SEQ ID NO: 2160003 - DNA, 14 bp, Homo sapiens
cctaccaaatataa

SEQ ID NO: 2160004 - DNA, 21 bp, Homo sapiens
cctcaaataaaaagtgctttt

SEQ ID NO: 2160005 - DNA, 18 bp, Homo sapiens
cctcatttttttccttgc

SEQ ID NO: 2160006 - DNA, 13 bp, Homo sapiens
ccttctttctacc

SEQ ID NO: 2160007 - DNA, 19 bp, Homo sapiens
ccttctttctaccctgctg

SEQ ID NO: 2160008 - DNA, 22 bp, Homo sapiens
ccttgctcaccaagctgttcca

SEQ ID NO: 2160009 - DNA, 12 bp, Homo sapiens
ccttttctgacc

SEQ ID NO: 2160010 - DNA, 21 bp, Homo sapiens
ctaaatgcaaacactgtgtat

SEQ ID NO: 2160011 - DNA, 13 bp, Homo sapiens
ctaccaaatataa

SEQ ID NO: 2160012 - DNA, 14 bp, Homo sapiens
ctactgagaaactt

SEQ ID NO: 2160013 - DNA, 23 bp, Homo sapiens
ctatacctgtgtttcttgcctca

SEQ ID NO: 2160014 - DNA, 18 bp, Homo sapiens
ctcgtccccaagtgacct

SEQ ID NO: 2160015 - DNA, 19 bp, Homo sapiens
ctctaaacccaaataaatg

SEQ ID NO: 2160016 - DNA, 13 bp, Homo sapiens
ctctagagaacat

SEQ ID NO: 2160017 - DNA, 17 bp, Homo sapiens
ctgaatacccttttctg

SEQ ID NO: 2160018 - DNA, 21 bp, Homo sapiens
ctgctcgtccccaagtgacct

SEQ ID NO: 2160019 - DNA, 15 bp, Homo sapiens
ctgtgtttcttgcct

SEQ ID NO: 2160020 - DNA, 12 bp, Homo sapiens
ctgttctcaaat

SEQ ID NO: 2160021 - DNA, 15 bp, Homo sapiens
ctgttctcaaatgct

SEQ ID NO: 2160022 - DNA, 14 bp, Homo sapiens
cttcacaaaatgca

SEQ ID NO: 2160023 - DNA, 21 bp, Homo sapiens
cttcagaatatggacaaagaa

SEQ ID NO: 2160024 - DNA, 21 bp, Homo sapiens
cttccagtttgctttgccctt

SEQ ID NO: 2160025 - DNA, 15 bp, Homo sapiens
cttctctttgcctca

SEQ ID NO: 2160026 - DNA, 11 bp, Homo sapiens
ctttgcctcaa

SEQ ID NO: 2160027 - DNA, 14 bp, Homo sapiens
gaacctcaaactgg

SEQ ID NO: 2160028 - DNA, 18 bp, Homo sapiens
gaaggcacaggtgtaaat

SEQ ID NO: 2160029 - DNA, 19 bp, Homo sapiens
gaaggcacaggtgtaaata

SEQ ID NO: 2160030 - DNA, 13 bp, Homo sapiens
gaatatggacaaa

SEQ ID NO: 2160031 - DNA, 22 bp, Homo sapiens
gaatgacatcaacattccccca

SEQ ID NO: 2160032 - DNA, 14 bp, Homo sapiens
gacagaaaaaaata

SEQ ID NO: 2160033 - DNA, 19 bp, Homo sapiens
gcaagacttctctttgcct

SEQ ID NO: 2160034 - DNA, 21 bp, Homo sapiens
gcaagacttctctttgcctca

SEQ ID NO: 2160035 - DNA, 20 bp, Homo sapiens
gcctcaaataaaaagtgctt

SEQ ID NO: 2160036 - DNA, 12 bp, Homo sapiens
gctaaatgcaaa

SEQ ID NO: 2160037 - DNA, 21 bp, Homo sapiens
gctaaatgcaaacactgtgta

SEQ ID NO: 2160038 - DNA, 18 bp, Homo sapiens
gctcaccaagctgttcca

SEQ ID NO: 2160039 - DNA, 16 bp, Homo sapiens
gctcttctgttctcaa

SEQ ID NO: 2160040 - DNA, 17 bp, Homo sapiens
gctttgcccttctttct

SEQ ID NO: 2160041 - DNA, 16 bp, Homo sapiens
ggcacaggtgtaaata

SEQ ID NO: 2160042 - DNA, 15 bp, Homo sapiens
ggtgtgccaaactac

SEQ ID NO: 2160043 - DNA, 13 bp, Homo sapiens
gtaaatatagtag

SEQ ID NO: 2160044 - DNA, 22 bp, Homo sapiens
gtagcaggatgaggaacctcaa

SEQ ID NO: 2160045 - DNA, 20 bp, Homo sapiens
gtagtatggcctgtgtcact

SEQ ID NO: 2160046 - DNA, 12 bp, Homo sapiens
gtctctgagaac

SEQ ID NO: 2160047 - DNA, 22 bp, Homo sapiens
gtgcgacttcacaaaatgcaag

SEQ ID NO: 2160048 - DNA, 21 bp, Homo sapiens
gtggccagcgagggcgtgtct

SEQ ID NO: 2160049 - DNA, 15 bp, Homo sapiens
gtgtttcttgcctca

SEQ ID NO: 2160050 - DNA, 16 bp, Homo sapiens
gtgtttcttgcctcat

SEQ ID NO: 2160051 - DNA, 18 bp, Homo sapiens
gtttctgaatgacatcaa

SEQ ID NO: 2160052 - DNA, 13 bp, Homo sapiens
gtttcttgcctca

SEQ ID NO: 2160053 - DNA, 14 bp, Homo sapiens
taaacccaaataaa

SEQ ID NO: 2160054 - DNA, 16 bp, Homo sapiens
taaatgcaaacactgt

SEQ ID NO: 2160055 - DNA, 18 bp, Homo sapiens
taaatgcaaacactgtgt

SEQ ID NO: 2160056 - DNA, 17 bp, Homo sapiens
taaatgtgtaaatgtgg

SEQ ID NO: 2160057 - DNA, 16 bp, Homo sapiens
taccaaatataaactt

SEQ ID NO: 2160058 - DNA, 17 bp, Homo sapiens
taccaaatataaacttg

SEQ ID NO: 2160059 - DNA, 22 bp, Homo sapiens
tacccttttctgaccaaagaga

SEQ ID NO: 2160060 - DNA, 17 bp, Homo sapiens
tacctgtgtttcttgcc

SEQ ID NO: 2160061 - DNA, 20 bp, Homo sapiens
tacctgtgtttcttgcctca

SEQ ID NO: 2160062 - DNA, 21 bp, Homo sapiens
tacctgtgtttcttgcctcat

SEQ ID NO: 2160063 - DNA, 22 bp, Homo sapiens
tactcttcagaatatggacaaa

SEQ ID NO: 2160064 - DNA, 17 bp, Homo sapiens
tagagtagaagtctctt

SEQ ID NO: 2160065 - DNA, 19 bp, Homo sapiens
tagtatggcctgtgtcact

SEQ ID NO: 2160066 - DNA, 15 bp, Homo sapiens
tagttaggtgtgcca

SEQ ID NO: 2160067 - DNA, 23 bp, Homo sapiens
tatacctgtgtttcttgcctcat

SEQ ID NO: 2160068 - DNA, 14 bp, Homo sapiens
tatggcctgtgtca

SEQ ID NO: 2160069 - DNA, 16 bp, Homo sapiens
tcaaatgctaaatgca

SEQ ID NO: 2160070 - DNA, 19 bp, Homo sapiens
tcagaatatggacaaagaa

SEQ ID NO: 2160071 - DNA, 13 bp, Homo sapiens
tcattttgcacgt

SEQ ID NO: 2160072 - DNA, 18 bp, Homo sapiens
tcatttttttccttgcaa

SEQ ID NO: 2160073 - DNA, 14 bp, Homo sapiens
tcgtccccaagtga

SEQ ID NO: 2160074 - DNA, 20 bp, Homo sapiens
tctaaacccaaataaatgtg

SEQ ID NO: 2160075 - DNA, 12 bp, Homo sapiens
tctctagagaac

SEQ ID NO: 2160076 - DNA, 13 bp, Homo sapiens
tctctttgcctca

SEQ ID NO: 2160077 - DNA, 21 bp, Homo sapiens
tctgttctcaaatgctaaatg

SEQ ID NO: 2160078 - DNA, 22 bp, Homo sapiens
tcttcctaccaaatataaactt

SEQ ID NO: 2160079 - DNA, 16 bp, Homo sapiens
tgaacaccactttgtc

SEQ ID NO: 2160080 - DNA, 18 bp, Homo sapiens
tgaggaacctcaaactgg

SEQ ID NO: 2160081 - DNA, 23 bp, Homo sapiens
tgcacgtgctcttctgttctcaa

SEQ ID NO: 2160082 - DNA, 12 bp, Homo sapiens
tggagtgtcacc

SEQ ID NO: 2160083 - DNA, 16 bp, Homo sapiens
tgggacagcaacctgt

SEQ ID NO: 2160084 - DNA, 18 bp, Homo sapiens
tgtcaccagctgccaaaa

SEQ ID NO: 2160085 - DNA, 22 bp, Homo sapiens
tgtcaccagctgccaaaatcgt

SEQ ID NO: 2160086 - DNA, 12 bp, Homo sapiens
tgtgccaaacta

SEQ ID NO: 2160087 - DNA, 11 bp, Homo sapiens
ttatctgtgtt

SEQ ID NO: 2160088 - DNA, 15 bp, Homo sapiens
ttatctgtgttgtct

SEQ ID NO: 2160089 - DNA, 15 bp, Homo sapiens
ttctctttgcctcaa

SEQ ID NO: 2160090 - DNA, 23 bp, Homo sapiens
ttgcctcaaataaaaagtgcttt

SEQ ID NO: 2160091 - DNA, 13 bp, Homo sapiens
caaatataaactt

SEQ ID NO: 2160092 - DNA, 23 bp, Homo sapiens
caaatgtagtatggcctgtgtca

SEQ ID NO: 2160093 - DNA, 17 bp, Homo sapiens
caaattggtgtttctga

SEQ ID NO: 2160094 - DNA, 21 bp, Homo sapiens
caacctgaatacccttttctg

SEQ ID NO: 2160095 - DNA, 13 bp, Homo sapiens
caagctgttccac

SEQ ID NO: 2160096 - DNA, 18 bp, Homo sapiens
caagtattttatctgtgt

SEQ ID NO: 2160097 - DNA, 12 bp, Homo sapiens
cacaaaatgcaa

SEQ ID NO: 2160098 - DNA, 13 bp, Homo sapiens
cacaggtgtaaat

SEQ ID NO: 2160099 - DNA, 16 bp, Homo sapiens
cacaggtgtaaatata

SEQ ID NO: 2160100 - DNA, 22 bp, Homo sapiens
caccactttgtctctgagaaca

SEQ ID NO: 2160101 - DNA, 21 bp, Homo sapiens
cactaacggttgagttttgac

SEQ ID NO: 2160102 - DNA, 12 bp, Homo sapiens
cacttctctaga

SEQ ID NO: 2160103 - DNA, 12 bp, Homo sapiens
caggtgtaaata

SEQ ID NO: 2160104 - DNA, 16 bp, Homo sapiens
cagtttgctttgccct

SEQ ID NO: 2160105 - DNA, 17 bp, Homo sapiens
ccaaataaatgtgtaaa

SEQ ID NO: 2160106 - DNA, 19 bp, Homo sapiens
ccaaataaatgtgtaaatg

SEQ ID NO: 2160107 - DNA, 22 bp, Homo sapiens
ccaaataaatgtgtaaatgtgg

SEQ ID NO: 2160108 - DNA, 16 bp, Homo sapiens
ccaaattggtgtttct

SEQ ID NO: 2160109 - DNA, 21 bp, Homo sapiens
ccaagctgttccacttctcta

SEQ ID NO: 2160110 - DNA, 18 bp, Homo sapiens
cctaccaaatataaactt

SEQ ID NO: 2160111 - DNA, 18 bp, Homo sapiens
cctatacctgtgtttctt

SEQ ID NO: 2160112 - DNA, 18 bp, Homo sapiens
cgtgctcttctgttctca

SEQ ID NO: 2160113 - DNA, 15 bp, Homo sapiens
ctaaacccaaataaa

SEQ ID NO: 2160114 - DNA, 20 bp, Homo sapiens
ctaaatgcaaacactgtgta

SEQ ID NO: 2160115 - DNA, 22 bp, Homo sapiens
ctaccaggtcaaaatagtgcca

SEQ ID NO: 2160116 - DNA, 18 bp, Homo sapiens
ctaccgttcccaaattgg

SEQ ID NO: 2160117 - DNA, 13 bp, Homo sapiens
ctatacctgtgtt

SEQ ID NO: 2160118 - DNA, 13 bp, Homo sapiens
ctcaaactgggta

SEQ ID NO: 2160119 - DNA, 19 bp, Homo sapiens
ctcaaataaaaagtgcttt

SEQ ID NO: 2160120 - DNA, 13 bp, Homo sapiens
ctctgagaacaga

SEQ ID NO: 2160121 - DNA, 12 bp, Homo sapiens
ctctttgcctca

SEQ ID NO: 2160122 - DNA, 13 bp, Homo sapiens
ctctttgcctcaa

SEQ ID NO: 2160123 - DNA, 22 bp, Homo sapiens
ctgctcgtccccaagtgaccta

SEQ ID NO: 2160124 - DNA, 17 bp, Homo sapiens
ctgtgtttcttgcctca

SEQ ID NO: 2160125 - DNA, 18 bp, Homo sapiens
ctgtgtttcttgcctcat

SEQ ID NO: 2160126 - DNA, 14 bp, Homo sapiens
ctgttccacttctc

SEQ ID NO: 2160127 - DNA, 14 bp, Homo sapiens
cttccagtttgctt

SEQ ID NO: 2160128 - DNA, 17 bp, Homo sapiens
cttccagtttgctttgc

SEQ ID NO: 2160129 - DNA, 16 bp, Homo sapiens
cttctctttgcctcaa

SEQ ID NO: 2160130 - DNA, 12 bp, Homo sapiens
cttctgttctca

SEQ ID NO: 2160131 - DNA, 19 bp, Homo sapiens
ctttgcccttctttctacc

SEQ ID NO: 2160132 - DNA, 12 bp, Homo sapiens
ctttgcctcaaa

SEQ ID NO: 2160133 - DNA, 16 bp, Homo sapiens
cttttctgaccaaaga

SEQ ID NO: 2160134 - DNA, 20 bp, Homo sapiens
gaacatgccctcagctaagc

SEQ ID NO: 2160135 - DNA, 12 bp, Homo sapiens
gaataccctttt

SEQ ID NO: 2160136 - DNA, 12 bp, Homo sapiens
gaatcctttcag

SEQ ID NO: 2160137 - DNA, 20 bp, Homo sapiens
gacagaaaaaaataaaaaca

SEQ ID NO: 2160138 - DNA, 16 bp, Homo sapiens
gacctatacctgtgtt

SEQ ID NO: 2160139 - DNA, 12 bp, Homo sapiens
gacttcacaaaa

SEQ ID NO: 2160140 - DNA, 22 bp, Homo sapiens
gagaattgtgcgacttcacaaa

SEQ ID NO: 2160141 - DNA, 12 bp, Homo sapiens
gagggcgtgtct

SEQ ID NO: 2160142 - DNA, 14 bp, Homo sapiens
gcaaacactgtgta

SEQ ID NO: 2160143 - DNA, 15 bp, Homo sapiens
gcacaggtgtaaata

SEQ ID NO: 2160144 - DNA, 12 bp, Homo sapiens
gcccttctttct

SEQ ID NO: 2160145 - DNA, 17 bp, Homo sapiens
gcgacttcacaaaatgc

SEQ ID NO: 2160146 - DNA, 13 bp, Homo sapiens
gctaaatgcaaac

SEQ ID NO: 2160147 - DNA, 13 bp, Homo sapiens
ggaacctcaaact

SEQ ID NO: 2160148 - DNA, 15 bp, Homo sapiens
ggaacctcaaactgg

SEQ ID NO: 2160149 - DNA, 10 bp, Homo sapiens
ggtgtaaata

SEQ ID NO: 2160150 - DNA, 17 bp, Homo sapiens
gtagtatggcctgtgtc

SEQ ID NO: 2160151 - DNA, 21 bp, Homo sapiens
gtatcattttgcacgtgctct

SEQ ID NO: 2160152 - DNA, 14 bp, Homo sapiens
gtatggcctgtgtc

SEQ ID NO: 2160153 - DNA, 21 bp, Homo sapiens
gtctcttccagtttgctttgc

SEQ ID NO: 2160154 - DNA, 18 bp, Homo sapiens
gtgacctatacctgtgtt

SEQ ID NO: 2160155 - DNA, 15 bp, Homo sapiens
gtgcgacttcacaaa

SEQ ID NO: 2160156 - DNA, 20 bp, Homo sapiens
gtgcgacttcacaaaatgca

SEQ ID NO: 2160157 - DNA, 17 bp, Homo sapiens
gtgctcttctgttctca

SEQ ID NO: 2160158 - DNA, 17 bp, Homo sapiens
gtgtaaatgtggacaca

SEQ ID NO: 2160159 - DNA, 14 bp, Homo sapiens
gttctcaaatgcta

SEQ ID NO: 2160160 - DNA, 14 bp, Homo sapiens
gtttcttgcctcat

SEQ ID NO: 2160161 - DNA, 15 bp, Homo sapiens
taaaaacataaaata

SEQ ID NO: 2160162 - DNA, 17 bp, Homo sapiens
taaaaacataaaatata

SEQ ID NO: 2160163 - DNA, 16 bp, Homo sapiens
taaaatatacaaacat

SEQ ID NO: 2160164 - DNA, 20 bp, Homo sapiens
taaaatatacaaacatgtgg

SEQ ID NO: 2160165 - DNA, 17 bp, Homo sapiens
taaacccaaataaatgt

SEQ ID NO: 2160166 - DNA, 20 bp, Homo sapiens
taaacttgtgtatgatccaa

SEQ ID NO: 2160167 - DNA, 14 bp, Homo sapiens
taaagacagaaaaa

SEQ ID NO: 2160168 - DNA, 12 bp, Homo sapiens
tctgttctcaaa

SEQ ID NO: 2160169 - DNA, 17 bp, Homo sapiens
tcttcctaccaaatata

SEQ ID NO: 2160170 - DNA, 14 bp, Homo sapiens
tcttctgttctcaa

SEQ ID NO: 2160171 - DNA, 23 bp, Homo sapiens
tgaacaccactttgtctctgaga

SEQ ID NO: 2160172 - DNA, 14 bp, Homo sapiens
tgcaaacactgtgt

SEQ ID NO: 2160173 - DNA, 13 bp, Homo sapiens
tgcccttctttct

SEQ ID NO: 2160174 - DNA, 22 bp, Homo sapiens
tgcctcaaataaaaagtgcttt

SEQ ID NO: 2160175 - DNA, 16 bp, Homo sapiens
tgcctcatttttttcc

SEQ ID NO: 2160176 - DNA, 19 bp, Homo sapiens
tgctaaatgcaaacactgt

SEQ ID NO: 2160177 - DNA, 19 bp, Homo sapiens
tgctcaccaagctgttcca

SEQ ID NO: 2160178 - DNA, 13 bp, Homo sapiens
tggaatcctttca

SEQ ID NO: 2160179 - DNA, 11 bp, Homo sapiens
tgtaaatatag

SEQ ID NO: 2160180 - DNA, 17 bp, Homo sapiens
tgtcaccagctgccaaa

SEQ ID NO: 2160181 - DNA, 9 bp, Homo sapiens
tgtgtaaat

SEQ ID NO: 2160182 - DNA, 14 bp, Homo sapiens
tgtgtatgatccaa

SEQ ID NO: 2160183 - DNA, 22 bp, Homo sapiens
tgttccacttctctagagaaca

SEQ ID NO: 2160184 - DNA, 14 bp, Homo sapiens
ttcacaaaatgcaa

SEQ ID NO: 2160185 - DNA, 18 bp, Homo sapiens
ttctcaaatgctaaatgc

SEQ ID NO: 2160186 - DNA, 18 bp, Homo sapiens
ttgagttttgactgcttg

SEQ ID NO: 2160187 - DNA, 13 bp, Homo sapiens
ttgctttgccctt

SEQ ID NO: 2160188 - DNA, 23 bp, Homo sapiens
tttgcctcaaataaaaagtgctt

SEQ ID NO: 2160189 - DNA, 18 bp, Homo sapiens
aaaaataaaaacataaaa

SEQ ID NO: 2160190 - DNA, 17 bp, Homo sapiens
aaaataaaaacataaaa

SEQ ID NO: 2160191 - DNA, 18 bp, Homo sapiens
aaacataaaatatacaaa

SEQ ID NO: 2160192 - DNA, 22 bp, Homo sapiens
aaacatgtggcaacctgttctt

SEQ ID NO: 2160193 - DNA, 23 bp, Homo sapiens
aaacccaaataaatgtgtaaatg

SEQ ID NO: 2160194 - DNA, 13 bp, Homo sapiens
aaatataaacttg

SEQ ID NO: 2160195 - DNA, 16 bp, Homo sapiens
aaatatacaaacatgt

SEQ ID NO: 2160196 - DNA, 15 bp, Homo sapiens
aaatgcaaacactgt

SEQ ID NO: 2160197 - DNA, 16 bp, Homo sapiens
aaatgcaaacactgtg

SEQ ID NO: 2160198 - DNA, 18 bp, Homo sapiens
aaatgctaaatgcaaaca

SEQ ID NO: 2160199 - DNA, 12 bp, Homo sapiens
aaatgtgtaaat

SEQ ID NO: 2160200 - DNA, 18 bp, Homo sapiens
aacaccactttgtctctg

SEQ ID NO: 2160201 - DNA, 14 bp, Homo sapiens
aacactgtgtattt

SEQ ID NO: 2160202 - DNA, 16 bp, Homo sapiens
aacccaaataaatgtg

SEQ ID NO: 2160203 - DNA, 11 bp, Homo sapiens
aacctcaaact

SEQ ID NO: 2160204 - DNA, 20 bp, Homo sapiens
aagtattttatctgtgttgt

SEQ ID NO: 2160205 - DNA, 13 bp, Homo sapiens
aataaatgtgtaa

SEQ ID NO: 2160206 - DNA, 14 bp, Homo sapiens
aataaatgtgtaaa

SEQ ID NO: 2160207 - DNA, 15 bp, Homo sapiens
aataaatgtgtaaat

SEQ ID NO: 2160208 - DNA, 16 bp, Homo sapiens
aatatacaaacatgtg

SEQ ID NO: 2160209 - DNA, 14 bp, Homo sapiens
aatgctaaatgcaa

SEQ ID NO: 2160210 - DNA, 12 bp, Homo sapiens
aatgtgtaaatg

SEQ ID NO: 2160211 - DNA, 11 bp, Homo sapiens
acaaaatgcaa

SEQ ID NO: 2160212 - DNA, 13 bp, Homo sapiens
acatcaacattcc

SEQ ID NO: 2160213 - DNA, 21 bp, Homo sapiens
accaaatataaacttgtgtat

SEQ ID NO: 2160214 - DNA, 18 bp, Homo sapiens
acgtgctcttctgttctc

SEQ ID NO: 2160215 - DNA, 13 bp, Homo sapiens
acttcacaaaatg

SEQ ID NO: 2160216 - DNA, 14 bp, Homo sapiens
acttctctttgcct

SEQ ID NO: 2160217 - DNA, 15 bp, Homo sapiens
acttctctttgcctc

SEQ ID NO: 2160218 - DNA, 21 bp, Homo sapiens
acttctctttgcctcaaataa

SEQ ID NO: 2160219 - DNA, 23 bp, Homo sapiens
acttgtgtatgatccaagtattt

SEQ ID NO: 2160220 - DNA, 13 bp, Homo sapiens
actttgtctctga

SEQ ID NO: 2160221 - DNA, 21 bp, Homo sapiens
agaattgtgcgacttcacaaa

SEQ ID NO: 2160222 - DNA, 22 bp, Homo sapiens
agaattgtgcgacttcacaaaa

SEQ ID NO: 2160223 - DNA, 15 bp, Homo sapiens
agcaaaatctaccag

SEQ ID NO: 2160224 - DNA, 15 bp, Homo sapiens
agcaacctgtagagt

SEQ ID NO: 2160225 - DNA, 21 bp, Homo sapiens
agcaagacttctctttgcctc

SEQ ID NO: 2160226 - DNA, 23 bp, Homo sapiens
agcaagacttctctttgcctcaa

SEQ ID NO: 2160227 - DNA, 15 bp, Homo sapiens
agcgagggcgtgtct

SEQ ID NO: 2160228 - DNA, 16 bp, Homo sapiens
agtatggcctgtgtca

SEQ ID NO: 2160229 - DNA, 20 bp, Homo sapiens
agtgtcaccagctgccaaaa

SEQ ID NO: 2160230 - DNA, 16 bp, Homo sapiens
ataaaaagtgcttttg

SEQ ID NO: 2160231 - DNA, 19 bp, Homo sapiens
ataaatgtgtaaatgtgga

SEQ ID NO: 2160232 - DNA, 21 bp, Homo sapiens
ataaatgtgtaaatgtggaca

SEQ ID NO: 2160233 - DNA, 23 bp, Homo sapiens
atataaacttgtgtatgatccaa

SEQ ID NO: 2160234 - DNA, 14 bp, Homo sapiens
atatacaaacatgt

SEQ ID NO: 2160235 - DNA, 16 bp, Homo sapiens
atctgtgttgtctctc

SEQ ID NO: 2160236 - DNA, 19 bp, Homo sapiens
atctgtgttgtctctctaa

SEQ ID NO: 2160237 - DNA, 13 bp, Homo sapiens
atgcaaacactgt

SEQ ID NO: 2160238 - DNA, 13 bp, Homo sapiens
atgctaaatgcaa

SEQ ID NO: 2160239 - DNA, 19 bp, Homo sapiens
atgctaaatgcaaacactg

SEQ ID NO: 2160240 - DNA, 20 bp, Homo sapiens
atgctaaatgcaaacactgt

SEQ ID NO: 2160241 - DNA, 16 bp, Homo sapiens
atttttttccttgcaa

SEQ ID NO: 2160242 - DNA, 21 bp, Homo sapiens
caaagaaggcacaggtgtaaa

SEQ ID NO: 2160243 - DNA, 15 bp, Homo sapiens
caaataaatgtgtaa

SEQ ID NO: 2160244 - DNA, 18 bp, Homo sapiens
caaataaatgtgtaaatg

SEQ ID NO: 2160245 - DNA, 14 bp, Homo sapiens
caaatataaacttg

SEQ ID NO: 2160246 - DNA, 14 bp, Homo sapiens
caaatgctaaatgc

SEQ ID NO: 2160247 - DNA, 17 bp, Homo sapiens
caaatgctaaatgcaaa

SEQ ID NO: 2160248 - DNA, 19 bp, Homo sapiens
caacattcccccaacatta

SEQ ID NO: 2160249 - DNA, 18 bp, Homo sapiens
caacctgtagagtggcca

SEQ ID NO: 2160250 - DNA, 13 bp, Homo sapiens
caagagccctgtc

SEQ ID NO: 2160251 - DNA, 14 bp, Homo sapiens
cagaaaaaaataaa

SEQ ID NO: 2160252 - DNA, 23 bp, Homo sapiens
cagcaagacttctctttgcctca

SEQ ID NO: 2160253 - DNA, 14 bp, Homo sapiens
caggtgtaaatata

SEQ ID NO: 2160254 - DNA, 14 bp, Homo sapiens
cagtttgctttgcc

SEQ ID NO: 2160255 - DNA, 15 bp, Homo sapiens
catgtggcaacctgt

SEQ ID NO: 2160256 - DNA, 18 bp, Homo sapiens
catttttttccttgcaaa

SEQ ID NO: 2160257 - DNA, 15 bp, Homo sapiens
ccaaactaccgttcc

SEQ ID NO: 2160258 - DNA, 15 bp, Homo sapiens
ccaaataaatgtgta

SEQ ID NO: 2160259 - DNA, 16 bp, Homo sapiens
ccaaataaatgtgtaa

SEQ ID NO: 2160260 - DNA, 14 bp, Homo sapiens
ccaaatataaactt

SEQ ID NO: 2160261 - DNA, 20 bp, Homo sapiens
ccaagtattttatctgtgtt

SEQ ID NO: 2160262 - DNA, 18 bp, Homo sapiens
ccattactaaagacagaa

SEQ ID NO: 2160263 - DNA, 17 bp, Homo sapiens
cccaaattggtgtttct

SEQ ID NO: 2160264 - DNA, 22 bp, Homo sapiens
cctcaaataaaaagtgcttttg

SEQ ID NO: 2160265 - DNA, 14 bp, Homo sapiens
cctgtgtttcttgc

SEQ ID NO: 2160266 - DNA, 23 bp, Homo sapiens
ccttgctcaccaagctgttccac

SEQ ID NO: 2160267 - DNA, 18 bp, Homo sapiens
ccttttctgaccaaagag

SEQ ID NO: 2160268 - DNA, 21 bp, Homo sapiens
cggttgagttttgactgcttg

SEQ ID NO: 2160269 - DNA, 17 bp, Homo sapiens
cgtgctcttctgttctc

SEQ ID NO: 2160270 - DNA, 19 bp, Homo sapiens
cgtgctcttctgttctcaa

SEQ ID NO: 2160271 - DNA, 20 bp, Homo sapiens
cgtgctcttctgttctcaaa

SEQ ID NO: 2160272 - DNA, 17 bp, Homo sapiens
ctaaacccaaataaatg

SEQ ID NO: 2160273 - DNA, 14 bp, Homo sapiens
ctaaagacagaaaa

SEQ ID NO: 2160274 - DNA, 21 bp, Homo sapiens
ctcaaataaaaagtgcttttg

SEQ ID NO: 2160275 - DNA, 16 bp, Homo sapiens
ctcaaatgctaaatgc

SEQ ID NO: 2160276 - DNA, 17 bp, Homo sapiens
ctcaaatgctaaatgca

SEQ ID NO: 2160277 - DNA, 18 bp, Homo sapiens
ctcaaatgctaaatgcaa

SEQ ID NO: 2160278 - DNA, 19 bp, Homo sapiens
ctcatttttttccttgcaa

SEQ ID NO: 2160279 - DNA, 20 bp, Homo sapiens
ctctctaaacccaaataaat

SEQ ID NO: 2160280 - DNA, 23 bp, Homo sapiens
ctcttcagaatatggacaaagaa

SEQ ID NO: 2160281 - DNA, 14 bp, Homo sapiens
ctcttccagtttgc

SEQ ID NO: 2160282 - DNA, 16 bp, Homo sapiens
ctcttctgttctcaaa

SEQ ID NO: 2160283 - DNA, 18 bp, Homo sapiens
ctgctcgtccccaagtga

SEQ ID NO: 2160284 - DNA, 13 bp, Homo sapiens
ctgtgtttcttgc

SEQ ID NO: 2160285 - DNA, 14 bp, Homo sapiens
ctgttctcaaatgc

SEQ ID NO: 2160286 - DNA, 13 bp, Homo sapiens
cttcacaaaatgc

SEQ ID NO: 2160287 - DNA, 17 bp, Homo sapiens
cttcctaccaaatataa

SEQ ID NO: 2160288 - DNA, 13 bp, Homo sapiens
cttctctttgcct

SEQ ID NO: 2160289 - DNA, 15 bp, Homo sapiens
cttctgttctcaaat

SEQ ID NO: 2160290 - DNA, 23 bp, Homo sapiens
cttgcctcatttttttccttgca

SEQ ID NO: 2160291 - DNA, 22 bp, Homo sapiens
cttgctcaccaagctgttccac

SEQ ID NO: 2160292 - DNA, 20 bp, Homo sapiens
ctttcagcaagacttctctt

SEQ ID NO: 2160293 - DNA, 16 bp, Homo sapiens
ctttgcccttctttct

SEQ ID NO: 2160294 - DNA, 20 bp, Homo sapiens
gaacaccactttgtctctga

SEQ ID NO: 2160295 - DNA, 16 bp, Homo sapiens
gaatatggacaaagaa

SEQ ID NO: 2160296 - DNA, 18 bp, Homo sapiens
gacagcaacctgtagagt

SEQ ID NO: 2160297 - DNA, 15 bp, Homo sapiens
gacttcacaaaatgc

SEQ ID NO: 2160298 - DNA, 17 bp, Homo sapiens
gacttcacaaaatgcaa

SEQ ID NO: 2160299 - DNA, 18 bp, Homo sapiens
gacttcacaaaatgcaag

SEQ ID NO: 2160300 - DNA, 14 bp, Homo sapiens
gacttctctttgcc

SEQ ID NO: 2160301 - DNA, 17 bp, Homo sapiens
gaggaacctcaaactgg

SEQ ID NO: 2160302 - DNA, 16 bp, Homo sapiens
gcaaacactgtgtatt

SEQ ID NO: 2160303 - DNA, 23 bp, Homo sapiens
gcaaatgtagtatggcctgtgtc

SEQ ID NO: 2160304 - DNA, 13 bp, Homo sapiens
gcaacctgttctt

SEQ ID NO: 2160305 - DNA, 20 bp, Homo sapiens
gcaacctgttcttcctacca

SEQ ID NO: 2160306 - DNA, 14 bp, Homo sapiens
gcacaggtgtaaat

SEQ ID NO: 2160307 - DNA, 16 bp, Homo sapiens
gcacaggtgtaaatat

SEQ ID NO: 2160308 - DNA, 13 bp, Homo sapiens
gcccttctttcta

SEQ ID NO: 2160309 - DNA, 16 bp, Homo sapiens
gcccttctttctaccc

SEQ ID NO: 2160310 - DNA, 19 bp, Homo sapiens
gcctcatttttttccttgc

SEQ ID NO: 2160311 - DNA, 20 bp, Homo sapiens
gctaaatgcaaacactgtgt

SEQ ID NO: 2160312 - DNA, 14 bp, Homo sapiens
gctactcttcagaa

SEQ ID NO: 2160313 - DNA, 23 bp, Homo sapiens
gctcttctgttctcaaatgctaa

SEQ ID NO: 2160314 - DNA, 17 bp, Homo sapiens
gctgttccacttctcta

SEQ ID NO: 2160315 - DNA, 18 bp, Homo sapiens
ggaacctcaaactgggta

SEQ ID NO: 2160316 - DNA, 18 bp, Homo sapiens
ggcacaggtgtaaatata

SEQ ID NO: 2160317 - DNA, 19 bp, Homo sapiens
gggaggcccctcctgccca

SEQ ID NO: 2160318 - DNA, 18 bp, Homo sapiens
ggtcaaaatagtgccact

SEQ ID NO: 2160319 - DNA, 17 bp, Homo sapiens
ggtcactggagtagttg

SEQ ID NO: 2160320 - DNA, 15 bp, Homo sapiens
gtaaatgtggacaca

SEQ ID NO: 2160321 - DNA, 18 bp, Homo sapiens
gtcaaaatagtgccacta

SEQ ID NO: 2160322 - DNA, 22 bp, Homo sapiens
gtgccaaactaccgttcccaaa

SEQ ID NO: 2160323 - DNA, 14 bp, Homo sapiens
gtgtatgatccaag

SEQ ID NO: 2160324 - DNA, 21 bp, Homo sapiens
gtgttggctctgctggtcact

SEQ ID NO: 2160325 - DNA, 15 bp, Homo sapiens
gttccacttctctag

SEQ ID NO: 2160326 - DNA, 19 bp, Homo sapiens
gttccacttctctagagaa

SEQ ID NO: 2160327 - DNA, 23 bp, Homo sapiens
gtttcttgcctcatttttttcct

SEQ ID NO: 2160328 - DNA, 20 bp, Homo sapiens
gtttgctttgcccttctttc

SEQ ID NO: 2160329 - DNA, 22 bp, Homo sapiens
taaagacagaaaaaaataaaaa

SEQ ID NO: 2160330 - DNA, 17 bp, Homo sapiens
taaatgcaaacactgtg

SEQ ID NO: 2160331 - DNA, 13 bp, Homo sapiens
taaatgtgtaaat

SEQ ID NO: 2160332 - DNA, 14 bp, Homo sapiens
taaatgtgtaaatg

SEQ ID NO: 2160333 - DNA, 14 bp, Homo sapiens
taccaaatataaac

SEQ ID NO: 2160334 - DNA, 17 bp, Homo sapiens
tagtatggcctgtgtca

SEQ ID NO: 2160335 - DNA, 15 bp, Homo sapiens
tattttatctgtgtt

SEQ ID NO: 2160336 - DNA, 13 bp, Homo sapiens
tcaaactgggtat

SEQ ID NO: 2160337 - DNA, 15 bp, Homo sapiens
tcaaatgctaaatgc

SEQ ID NO: 2160338 - DNA, 20 bp, Homo sapiens
tcactggagtagttgctact

SEQ ID NO: 2160339 - DNA, 22 bp, Homo sapiens
tccaagtattttatctgtgttg

SEQ ID NO: 2160340 - DNA, 20 bp, Homo sapiens
tccacttctctagagaacat

SEQ ID NO: 2160341 - DNA, 22 bp, Homo sapiens
tcccaaattggtgtttctgaat

SEQ ID NO: 2160342 - DNA, 16 bp, Homo sapiens
tctcaaatgctaaatg

SEQ ID NO: 2160343 - DNA, 14 bp, Homo sapiens
tctctttgcctcaa

SEQ ID NO: 2160344 - DNA, 18 bp, Homo sapiens
tcttcctaccaaatataa

SEQ ID NO: 2160345 - DNA, 12 bp, Homo sapiens
tctttgcctcaa

SEQ ID NO: 2160346 - DNA, 19 bp, Homo sapiens
tgaacaccactttgtctct

SEQ ID NO: 2160347 - DNA, 16 bp, Homo sapiens
tgaatacccttttctg

SEQ ID NO: 2160348 - DNA, 16 bp, Homo sapiens
tgaggaacctcaaact

SEQ ID NO: 2160349 - DNA, 19 bp, Homo sapiens
tgcaaacactgtgtattta

SEQ ID NO: 2160350 - DNA, 14 bp, Homo sapiens
tgcccttctttcta

SEQ ID NO: 2160351 - DNA, 21 bp, Homo sapiens
tgcctcaaataaaaagtgctt

SEQ ID NO: 2160352 - DNA, 21 bp, Homo sapiens
tgcctcatttttttccttgca

SEQ ID NO: 2160353 - DNA, 22 bp, Homo sapiens
tgctttgcccttctttctaccc

SEQ ID NO: 2160354 - DNA, 14 bp, Homo sapiens
tggcaacctgttct

SEQ ID NO: 2160355 - DNA, 18 bp, Homo sapiens
tgtagtatggcctgtgtc

SEQ ID NO: 2160356 - DNA, 11 bp, Homo sapiens
aaataaatgtg

SEQ ID NO: 2160357 - DNA, 11 bp, Homo sapiens
aaatataaact

SEQ ID NO: 2160358 - DNA, 20 bp, Homo sapiens
aaatatacaaacatgtggca

SEQ ID NO: 2160359 - DNA, 13 bp, Homo sapiens
aaatatagtagca

SEQ ID NO: 2160360 - DNA, 17 bp, Homo sapiens
aaatgcaaacactgtgt

SEQ ID NO: 2160361 - DNA, 21 bp, Homo sapiens
aaatgcaaacactgtgtattt

SEQ ID NO: 2160362 - DNA, 22 bp, Homo sapiens
aacccaaataaatgtgtaaatg

SEQ ID NO: 2160363 - DNA, 20 bp, Homo sapiens
aagaaggcacaggtgtaaat

SEQ ID NO: 2160364 - DNA, 20 bp, Homo sapiens
aagacttctctttgcctcaa

SEQ ID NO: 2160365 - DNA, 18 bp, Homo sapiens
aagtattttatctgtgtt

SEQ ID NO: 2160366 - DNA, 20 bp, Homo sapiens
aagtgacctatacctgtgtt

SEQ ID NO: 2160367 - DNA, 17 bp, Homo sapiens
aatataaacttgtgtat

SEQ ID NO: 2160368 - DNA, 18 bp, Homo sapiens
aatgcaaacactgtgtat

SEQ ID NO: 2160369 - DNA, 13 bp, Homo sapiens
aatgtgtaaatgt

SEQ ID NO: 2160370 - DNA, 16 bp, Homo sapiens
acaaagaaggcacagg

SEQ ID NO: 2160371 - DNA, 16 bp, Homo sapiens
acaggtgtaaatatag

SEQ ID NO: 2160372 - DNA, 13 bp, Homo sapiens
acataaaatatac

SEQ ID NO: 2160373 - DNA, 12 bp, Homo sapiens
accaaatataaa

SEQ ID NO: 2160374 - DNA, 23 bp, Homo sapiens
accaagctgttccacttctctag

SEQ ID NO: 2160375 - DNA, 16 bp, Homo sapiens
acccaaataaatgtgt

SEQ ID NO: 2160376 - DNA, 15 bp, Homo sapiens
acctatacctgtgtt

SEQ ID NO: 2160377 - DNA, 12 bp, Homo sapiens
acctcaaactgg

SEQ ID NO: 2160378 - DNA, 19 bp, Homo sapiens
acctgtgtttcttgcctca

SEQ ID NO: 2160379 - DNA, 21 bp, Homo sapiens
acctgtgtttcttgcctcatt

SEQ ID NO: 2160380 - DNA, 18 bp, Homo sapiens
actccattactaaagaca

SEQ ID NO: 2160381 - DNA, 21 bp, Homo sapiens
actccattactaaagacagaa

SEQ ID NO: 2160382 - DNA, 16 bp, Homo sapiens
actggaatcctttcag

SEQ ID NO: 2160383 - DNA, 17 bp, Homo sapiens
acttgtgtatgatccaa

SEQ ID NO: 2160384 - DNA, 22 bp, Homo sapiens
agaaggcacaggtgtaaatata

SEQ ID NO: 2160385 - DNA, 15 bp, Homo sapiens
agaagtctcttccag

SEQ ID NO: 2160386 - DNA, 17 bp, Homo sapiens
agacttctctttgcctc

SEQ ID NO: 2160387 - DNA, 19 bp, Homo sapiens
agagccctgtcagtagagt

SEQ ID NO: 2160388 - DNA, 16 bp, Homo sapiens
aggaacctcaaactgg

SEQ ID NO: 2160389 - DNA, 22 bp, Homo sapiens
aggatgaggaacctcaaactgg

SEQ ID NO: 2160390 - DNA, 23 bp, Homo sapiens
aggatgaggaacctcaaactggg

SEQ ID NO: 2160391 - DNA, 11 bp, Homo sapiens
aggtgtaaata

SEQ ID NO: 2160392 - DNA, 16 bp, Homo sapiens
agtattttatctgtgt

SEQ ID NO: 2160393 - DNA, 20 bp, Homo sapiens
agttgctactcttcagaata

SEQ ID NO: 2160394 - DNA, 15 bp, Homo sapiens
agtttgctttgccct

SEQ ID NO: 2160395 - DNA, 16 bp, Homo sapiens
ataaaaacataaaata

SEQ ID NO: 2160396 - DNA, 15 bp, Homo sapiens
ataaacttgtgtatg

SEQ ID NO: 2160397 - DNA, 15 bp, Homo sapiens
ataaatgtgtaaatg

SEQ ID NO: 2160398 - DNA, 19 bp, Homo sapiens
atacctgtgtttcttgcct

SEQ ID NO: 2160399 - DNA, 16 bp, Homo sapiens
atataaacttgtgtat

SEQ ID NO: 2160400 - DNA, 16 bp, Homo sapiens
atgcaaacactgtgta

SEQ ID NO: 2160401 - DNA, 20 bp, Homo sapiens
atgcaaacactgtgtattta

SEQ ID NO: 2160402 - DNA, 21 bp, Homo sapiens
atggagtgtcaccagctgcca

SEQ ID NO: 2160403 - DNA, 11 bp, Homo sapiens
atgtgtaaatg

SEQ ID NO: 2160404 - DNA, 19 bp, Homo sapiens
atgtgtaaatgtggacaca

SEQ ID NO: 2160405 - DNA, 14 bp, Homo sapiens
attttatctgtgtt

SEQ ID NO: 2160406 - DNA, 14 bp, Homo sapiens
caaacactgtgtat

SEQ ID NO: 2160407 - DNA, 17 bp, Homo sapiens
caaataaaaagtgcttt

SEQ ID NO: 2160408 - DNA, 13 bp, Homo sapiens
caaataaatgtgt

SEQ ID NO: 2160409 - DNA, 14 bp, Homo sapiens
caaataaatgtgta

SEQ ID NO: 2160410 - DNA, 20 bp, Homo sapiens
caaataaatgtgtaaatgtg

SEQ ID NO: 2160411 - DNA, 16 bp, Homo sapiens
caaatgctaaatgcaa

SEQ ID NO: 2160412 - DNA, 15 bp, Homo sapiens
caaattggtgtttct

SEQ ID NO: 2160413 - DNA, 21 bp, Homo sapiens
caagacttctctttgcctcaa

SEQ ID NO: 2160414 - DNA, 20 bp, Homo sapiens
caagtattttatctgtgttg

SEQ ID NO: 2160415 - DNA, 21 bp, Homo sapiens
caagtgacctatacctgtgtt

SEQ ID NO: 2160416 - DNA, 16 bp, Homo sapiens
caaaacatgcaccctg

SEQ ID NO: 2160417 - DNA, 19 bp, Homo sapiens
caaatacctccattaaatg

SEQ ID NO: 2160418 - DNA, 22 bp, Homo sapiens
caaatacctccattaaatggtc

SEQ ID NO: 2160419 - DNA, 13 bp, Homo sapiens
caacactctactt

SEQ ID NO: 2160420 - DNA, 19 bp, Homo sapiens
caacactctacttgaagca

SEQ ID NO: 2160421 - DNA, 16 bp, Homo sapiens
caacatttcaaaatga

SEQ ID NO: 2160422 - DNA, 19 bp, Homo sapiens
caaccctcctaaaagttca

SEQ ID NO: 2160423 - DNA, 16 bp, Homo sapiens
caagagaaacttccta

SEQ ID NO: 2160424 - DNA, 17 bp, Homo sapiens
caagccttggctctacc

SEQ ID NO: 2160425 - DNA, 16 bp, Homo sapiens
caaggttctagtctct

SEQ ID NO: 2160426 - DNA, 13 bp, Homo sapiens
caagtaaacattc

SEQ ID NO: 2160427 - DNA, 15 bp, Homo sapiens
caataaaagagcttt

SEQ ID NO: 2160428 - DNA, 12 bp, Homo sapiens
caataccctaga

SEQ ID NO: 2160429 - DNA, 20 bp, Homo sapiens
caataccctagaagaaaacc

SEQ ID NO: 2160430 - DNA, 18 bp, Homo sapiens
caatgcatacaataaaag

SEQ ID NO: 2160431 - DNA, 19 bp, Homo sapiens
caatgcatacaataaaaga

SEQ ID NO: 2160432 - DNA, 22 bp, Homo sapiens
caatgcatacaataaaagagct

SEQ ID NO: 2160433 - DNA, 13 bp, Homo sapiens
caattttaaagac

SEQ ID NO: 2160434 - DNA, 18 bp, Homo sapiens
cacaaggacagaaccctc

SEQ ID NO: 2160435 - DNA, 18 bp, Homo sapiens
cacaggacacgaaggctg

SEQ ID NO: 2160436 - DNA, 20 bp, Homo sapiens
cacaggacacgaaggctgcc

SEQ ID NO: 2160437 - DNA, 13 bp, Homo sapiens
cacagtccctcac

SEQ ID NO: 2160438 - DNA, 14 bp, Homo sapiens
cacatcacagatga

SEQ ID NO: 2160439 - DNA, 20 bp, Homo sapiens
cacccctacccccaaccctc

SEQ ID NO: 2160440 - DNA, 12 bp, Homo sapiens
cacccctccttg

SEQ ID NO: 2160441 - DNA, 14 bp, Homo sapiens
cacccttccctgtg

SEQ ID NO: 2160442 - DNA, 19 bp, Homo sapiens
cacgtgtggcctgttcttc

SEQ ID NO: 2160443 - DNA, 13 bp, Homo sapiens
ctcagaaaggcaa

SEQ ID NO: 2160444 - DNA, 16 bp, Homo sapiens
ctcagttcctcaccat

SEQ ID NO: 2160445 - DNA, 17 bp, Homo sapiens
ctcattccagaggaagg

SEQ ID NO: 2160446 - DNA, 18 bp, Homo sapiens
ctccaactggattataaa

SEQ ID NO: 2160447 - DNA, 23 bp, Homo sapiens
ctccacccctacccccaaccctc

SEQ ID NO: 2160448 - DNA, 17 bp, Homo sapiens
ctccattggtgttgaca

SEQ ID NO: 2160449 - DNA, 15 bp, Homo sapiens
ctcccaaatttgagt

SEQ ID NO: 2160450 - DNA, 17 bp, Homo sapiens
ctcctcagttcctcacc

SEQ ID NO: 2160451 - DNA, 16 bp, Homo sapiens
ctctaatagaaaagtc

SEQ ID NO: 2160452 - DNA, 20 bp, Homo sapiens
ctctaatagaaaagtctcca

SEQ ID NO: 2160453 - DNA, 12 bp, Homo sapiens
ctgagcaggtgt

SEQ ID NO: 2160454 - DNA, 13 bp, Homo sapiens
ctgattgtattta

SEQ ID NO: 2160455 - DNA, 15 bp, Homo sapiens
ctgcccctgtaaggt

SEQ ID NO: 2160456 - DNA, 23 bp, Homo sapiens
ctggccctatgcttccggcctcc

SEQ ID NO: 2160457 - DNA, 17 bp, Homo sapiens
ctggggatgtctctcat

SEQ ID NO: 2160458 - DNA, 16 bp, Homo sapiens
ctggtctttagcccca

SEQ ID NO: 2160459 - DNA, 18 bp, Homo sapiens
ctggtctttagccccact

SEQ ID NO: 2160460 - DNA, 13 bp, Homo sapiens
ctgtaaagcaaaa

SEQ ID NO: 2160461 - DNA, 17 bp, Homo sapiens
ctgtgactgaagaagat

SEQ ID NO: 2160462 - DNA, 19 bp, Homo sapiens
ctgtgaggggctctctcat

SEQ ID NO: 2160463 - DNA, 16 bp, Homo sapiens
ctgtgtgtttatgtgt

SEQ ID NO: 2160464 - DNA, 20 bp, Homo sapiens
ctgtgtgtttatgtgtgtgt

SEQ ID NO: 2160465 - DNA, 13 bp, Homo sapiens
cttatacacccct

SEQ ID NO: 2160466 - DNA, 14 bp, Homo sapiens
cttatacacccctg

SEQ ID NO: 2160467 - DNA, 16 bp, Homo sapiens
cttatgagctcagcct

SEQ ID NO: 2160468 - DNA, 20 bp, Homo sapiens
cttatttcctttccaagtat

SEQ ID NO: 2160469 - DNA, 17 bp, Homo sapiens
cttctacctcttggctg

SEQ ID NO: 2160470 - DNA, 16 bp, Homo sapiens
cttctggatggatttt

SEQ ID NO: 2160471 - DNA, 23 bp, Homo sapiens
cttgcactgatgtccctcctttt

SEQ ID NO: 2160472 - DNA, 14 bp, Homo sapiens
cttgcatccaaggt

SEQ ID NO: 2160473 - DNA, 16 bp, Homo sapiens
cttgtctaagaccccc

SEQ ID NO: 2160474 - DNA, 16 bp, Homo sapiens
ctttacttaaaaatat

SEQ ID NO: 2160475 - DNA, 10 bp, Homo sapiens
ctttagcccc

SEQ ID NO: 2160476 - DNA, 17 bp, Homo sapiens
ctttagccccactgctt

SEQ ID NO: 2160477 - DNA, 16 bp, Homo sapiens
ctttattatagtccta

SEQ ID NO: 2160478 - DNA, 21 bp, Homo sapiens
cttttcccaatactagccccc

SEQ ID NO: 2160479 - DNA, 14 bp, Homo sapiens
cttttgtcccagaa

SEQ ID NO: 2160480 - DNA, 15 bp, Homo sapiens
gaaaaaaaagaaagc

SEQ ID NO: 2160481 - DNA, 10 bp, Homo sapiens
gaaaacttca

SEQ ID NO: 2160482 - DNA, 20 bp, Homo sapiens
gaaaattaagggccgattta

SEQ ID NO: 2160483 - DNA, 21 bp, Homo sapiens
gaaactagaaagcagagattt

SEQ ID NO: 2160484 - DNA, 19 bp, Homo sapiens
gaaatacacaagtaaacat

SEQ ID NO: 2160485 - DNA, 13 bp, Homo sapiens
gaaatactcatgt

SEQ ID NO: 2160486 - DNA, 13 bp, Homo sapiens
gaacctcccaaat

SEQ ID NO: 2160487 - DNA, 24 bp, Homo sapiens
gaagtgtgggtctgtgtgtgtgta

SEQ ID NO: 2160488 - DNA, 17 bp, Homo sapiens
gaatattatcttcataa

SEQ ID NO: 2160489 - DNA, 13 bp, Homo sapiens
gacaatttataat

SEQ ID NO: 2160490 - DNA, 18 bp, Homo sapiens
gacacgaaggctgcccct

SEQ ID NO: 2160491 - DNA, 22 bp, Homo sapiens
gacccatttgatattttttaaa

SEQ ID NO: 2160492 - DNA, 16 bp, Homo sapiens
gacctcacccctcctt

SEQ ID NO: 2160493 - DNA, 15 bp, Homo sapiens
gactatggagctgag

SEQ ID NO: 2160494 - DNA, 11 bp, Homo sapiens
gagaaaaacaa

SEQ ID NO: 2160495 - DNA, 17 bp, Homo sapiens
gagatctatgggcattt

SEQ ID NO: 2160496 - DNA, 23 bp, Homo sapiens
gagcagtaggatattggcatttg

SEQ ID NO: 2160497 - DNA, 23 bp, Homo sapiens
gagccttgcagatatctgcatgt

SEQ ID NO: 2160498 - DNA, 15 bp, Homo sapiens
gaggatgtctgggcc

SEQ ID NO: 2160499 - DNA, 22 bp, Homo sapiens
gaggcctctcattccagaggaa

SEQ ID NO: 2160500 - DNA, 20 bp, Homo sapiens
gagggacagcagattccaca

SEQ ID NO: 2160501 - DNA, 13 bp, Homo sapiens
gagtgtgtaattt

SEQ ID NO: 2160502 - DNA, 21 bp, Homo sapiens
gagtgtgtaatttaaaattgt

SEQ ID NO: 2160503 - DNA, 16 bp, Homo sapiens
gagttgcacccttccc

SEQ ID NO: 2160504 - DNA, 13 bp, Homo sapiens
gagttggctggga

SEQ ID NO: 2160505 - DNA, 14 bp, Homo sapiens
gatagatgtgtgga

SEQ ID NO: 2160506 - DNA, 13 bp, Homo sapiens
gatggattttata

SEQ ID NO: 2160507 - DNA, 20 bp, Homo sapiens
gatggcaaagaaggagagca

SEQ ID NO: 2160508 - DNA, 14 bp, Homo sapiens
gatgtgccttaaat

SEQ ID NO: 2160509 - DNA, 15 bp, Homo sapiens
gcactgaacagaatt

SEQ ID NO: 2160510 - DNA, 12 bp, Homo sapiens
gcagattccaca

SEQ ID NO: 2160511 - DNA, 15 bp, Homo sapiens
gcatacaataaaaga

SEQ ID NO: 2160512 - DNA, 19 bp, Homo sapiens
gcatacaataaaagagctt

SEQ ID NO: 2160513 - DNA, 21 bp, Homo sapiens
gcatacaataaaagagcttta

SEQ ID NO: 2160514 - DNA, 18 bp, Homo sapiens
gcattatatttgtaaatt

SEQ ID NO: 2160515 - DNA, 23 bp, Homo sapiens
gccaaaatggttaatttttcctg

SEQ ID NO: 2160516 - DNA, 14 bp, Homo sapiens
gccaggatggaatg

SEQ ID NO: 2160517 - DNA, 21 bp, Homo sapiens
gccatcatgtttacagaggac

SEQ ID NO: 2160518 - DNA, 13 bp, Homo sapiens
gcccatcccagtg

SEQ ID NO: 2160519 - DNA, 14 bp, Homo sapiens
gcccctcccagata

SEQ ID NO: 2160520 - DNA, 16 bp, Homo sapiens
gcctaaaagtaaacat

SEQ ID NO: 2160521 - DNA, 19 bp, Homo sapiens
gcctctcattccagaggaa

SEQ ID NO: 2160522 - DNA, 18 bp, Homo sapiens
gcctgactaggaaaagtt

SEQ ID NO: 2160523 - DNA, 18 bp, Homo sapiens
gcgacattagcataaaca

SEQ ID NO: 2160524 - DNA, 21 bp, Homo sapiens
gcgttaacagttcctttcaaa

SEQ ID NO: 2160525 - DNA, 14 bp, Homo sapiens
gctaagacttccta

SEQ ID NO: 2160526 - DNA, 19 bp, Homo sapiens
gctacatggggctcactca

SEQ ID NO: 2160527 - DNA, 19 bp, Homo sapiens
gctatggggatagatgtgt

SEQ ID NO: 2160528 - DNA, 21 bp, Homo sapiens
gctatggggatagatgtgtgg

SEQ ID NO: 2160529 - DNA, 20 bp, Homo sapiens
gctcagcctcgctttgaggt

SEQ ID NO: 2160530 - DNA, 19 bp, Homo sapiens
gctctcctcagaagaaaga

SEQ ID NO: 2160531 - DNA, 13 bp, Homo sapiens
gctggatctgtga

SEQ ID NO: 2160532 - DNA, 14 bp, Homo sapiens
gctggggatgtctc

SEQ ID NO: 2160533 - DNA, 16 bp, Homo sapiens
gcttgctaattatttt

SEQ ID NO: 2160534 - DNA, 20 bp, Homo sapiens
ggaactgctgggcttggcag

SEQ ID NO: 2160535 - DNA, 21 bp, Homo sapiens
ggaagtgtgggtctgtgtgtg

SEQ ID NO: 2160536 - DNA, 19 bp, Homo sapiens
ggacacgaaggctgcccct

SEQ ID NO: 2160537 - DNA, 22 bp, Homo sapiens
ggactggcgagtccagagagga

SEQ ID NO: 2160538 - DNA, 12 bp, Homo sapiens
ggagggatttgg

SEQ ID NO: 2160539 - DNA, 11 bp, Homo sapiens
ggagtgtgtaa

SEQ ID NO: 2160540 - DNA, 22 bp, Homo sapiens
ggagtgtgtaatttaaaattgt

SEQ ID NO: 2160541 - DNA, 17 bp, Homo sapiens
ggccctgtgccttggtg

SEQ ID NO: 2160542 - DNA, 16 bp, Homo sapiens
ggcctgactctcagca

SEQ ID NO: 2160543 - DNA, 21 bp, Homo sapiens
ggctatggggatagatgtgtg

SEQ ID NO: 2160544 - DNA, 14 bp, Homo sapiens
ggctcagagtgggg

SEQ ID NO: 2160545 - DNA, 19 bp, Homo sapiens
gggagaatgtcagtatgtg

SEQ ID NO: 2160546 - DNA, 11 bp, Homo sapiens
gggagtgtgta

SEQ ID NO: 2160547 - DNA, 13 bp, Homo sapiens
ggggatagatgtg

SEQ ID NO: 2160548 - DNA, 19 bp, Homo sapiens
ggggcctgactaggaaaag

SEQ ID NO: 2160549 - DNA, 18 bp, Homo sapiens
gggtcattcatggcctgg

SEQ ID NO: 2160550 - DNA, 11 bp, Homo sapiens
ggtctgtgtgt

SEQ ID NO: 2160551 - DNA, 21 bp, Homo sapiens
ggtctgtgtgtgtgtatgtgg

SEQ ID NO: 2160552 - DNA, 16 bp, Homo sapiens
ggtctttagccccact

SEQ ID NO: 2160553 - DNA, 19 bp, Homo sapiens
ggttaatttttcctgcatg

SEQ ID NO: 2160554 - DNA, 20 bp, Homo sapiens
ggttaatttttcctgcatgt

SEQ ID NO: 2160555 - DNA, 21 bp, Homo sapiens
ggttaatttttcctgcatgtt

SEQ ID NO: 2160556 - DNA, 19 bp, Homo sapiens
ggttgggagaatgtcagta

SEQ ID NO: 2160557 - DNA, 22 bp, Homo sapiens
ggtttcaatgcatacaataaaa

SEQ ID NO: 2160558 - DNA, 22 bp, Homo sapiens
ggtttgtttagaagaagtgtgt

SEQ ID NO: 2160559 - DNA, 17 bp, Homo sapiens
gtaagggtgacaaatgg

SEQ ID NO: 2160560 - DNA, 15 bp, Homo sapiens
gtaaggtttcaatgc

SEQ ID NO: 2160561 - DNA, 20 bp, Homo sapiens
gtaatttaaaattgtgatgt

SEQ ID NO: 2160562 - DNA, 19 bp, Homo sapiens
gtaggaaaaataaaaacag

SEQ ID NO: 2160563 - DNA, 12 bp, Homo sapiens
gtataaaaacaa

SEQ ID NO: 2160564 - DNA, 17 bp, Homo sapiens
gtcagtatgtggaagtg

SEQ ID NO: 2160565 - DNA, 21 bp, Homo sapiens
gtcagtatgtggaagtgtggg

SEQ ID NO: 2160566 - DNA, 13 bp, Homo sapiens
gtcagttgtatca

SEQ ID NO: 2160567 - DNA, 14 bp, Homo sapiens
gtcatgaagaatgt

SEQ ID NO: 2160568 - DNA, 15 bp, Homo sapiens
gtctaagacccccat

SEQ ID NO: 2160569 - DNA, 17 bp, Homo sapiens
gtctatatgaaaaacaa

SEQ ID NO: 2160570 - DNA, 11 bp, Homo sapiens
gtctgtgtgtg

SEQ ID NO: 2160571 - DNA, 21 bp, Homo sapiens
gtctgtgtgtttatgtgtgtg

SEQ ID NO: 2160572 - DNA, 21 bp, Homo sapiens
gtgactatggagctgagcagg

SEQ ID NO: 2160573 - DNA, 13 bp, Homo sapiens
gtgagagaatgta

SEQ ID NO: 2160574 - DNA, 15 bp, Homo sapiens
gtgagagaatgtatt

SEQ ID NO: 2160575 - DNA, 15 bp, Homo sapiens
gtgcaataggtgaga

SEQ ID NO: 2160576 - DNA, 21 bp, Homo sapiens
gtgccaggatggaatgatggg

SEQ ID NO: 2160577 - DNA, 23 bp, Homo sapiens
gtgctattgtagagccagaggtc

SEQ ID NO: 2160578 - DNA, 15 bp, Homo sapiens
gtggaagtgtgggtc

SEQ ID NO: 2160579 - DNA, 22 bp, Homo sapiens
gtggaagtgtgggtctgtgtgt

SEQ ID NO: 2160580 - DNA, 18 bp, Homo sapiens
gtggccaagagaaacttc

SEQ ID NO: 2160581 - DNA, 14 bp, Homo sapiens
gtgggagtgtgtaa

SEQ ID NO: 2160582 - DNA, 14 bp, Homo sapiens
gtgggggtctgtgt

SEQ ID NO: 2160583 - DNA, 13 bp, Homo sapiens
gtgggtctgtgtg

SEQ ID NO: 2160584 - DNA, 21 bp, Homo sapiens
gtggtgaacagaacctcccaa

SEQ ID NO: 2160585 - DNA, 22 bp, Homo sapiens
gtgtaatttaaaattgtgatgt

SEQ ID NO: 2160586 - DNA, 14 bp, Homo sapiens
gtgtgtgtatgtgg

SEQ ID NO: 2160587 - DNA, 20 bp, Homo sapiens
aaaataaacaggtcaatgaa

SEQ ID NO: 2160588 - DNA, 14 bp, Homo sapiens
aaaatattcaataa

SEQ ID NO: 2160589 - DNA, 22 bp, Homo sapiens
aaaccatgctctggcatgttga

SEQ ID NO: 2160590 - DNA, 17 bp, Homo sapiens
aaatacacaagtaaaca

SEQ ID NO: 2160591 - DNA, 19 bp, Homo sapiens
aaatggttaatttttcctg

SEQ ID NO: 2160592 - DNA, 12 bp, Homo sapiens
aaattgtgatgt

SEQ ID NO: 2160593 - DNA, 12 bp, Homo sapiens
aaatttatgtga

SEQ ID NO: 2160594 - DNA, 19 bp, Homo sapiens
aacaaagagaaaaaataca

SEQ ID NO: 2160595 - DNA, 18 bp, Homo sapiens
aacagtatctcaaacaat

SEQ ID NO: 2160596 - DNA, 13 bp, Homo sapiens
aacatgcaccctg

SEQ ID NO: 2160597 - DNA, 15 bp, Homo sapiens
aaccctcagacagac

SEQ ID NO: 2160598 - DNA, 17 bp, Homo sapiens
aacctcccaaatttgag

SEQ ID NO: 2160599 - DNA, 15 bp, Homo sapiens
aacttcagacacaaa

SEQ ID NO: 2160600 - DNA, 16 bp, Homo sapiens
aagaaaaaaaaaatat

SEQ ID NO: 2160601 - DNA, 17 bp, Homo sapiens
aagcagaatcctcagtt

SEQ ID NO: 2160602 - DNA, 23 bp, Homo sapiens
aagcagagattttcaacatttca

SEQ ID NO: 2160603 - DNA, 23 bp, Homo sapiens
aaggctatggggatagatgtgtg

SEQ ID NO: 2160604 - DNA, 19 bp, Homo sapiens
aaggctgcccctgtaaggt

SEQ ID NO: 2160605 - DNA, 21 bp, Homo sapiens
aaggctgcccctgtaaggttt

SEQ ID NO: 2160606 - DNA, 19 bp, Homo sapiens
aagtagatgataaaggcca

SEQ ID NO: 2160607 - DNA, 17 bp, Homo sapiens
aagtgtatgtgtgaatt

SEQ ID NO: 2160608 - DNA, 18 bp, Homo sapiens
aagtgtgggtctgtgtgt

SEQ ID NO: 2160609 - DNA, 13 bp, Homo sapiens
aataaaagagctt

SEQ ID NO: 2160610 - DNA, 18 bp, Homo sapiens
aatatctaataaaaagtc

SEQ ID NO: 2160611 - DNA, 16 bp, Homo sapiens
aatatgctaattctca

SEQ ID NO: 2160612 - DNA, 22 bp, Homo sapiens
aatattaaggtagttattcaca

SEQ ID NO: 2160613 - DNA, 13 bp, Homo sapiens
aatctatttttcc

SEQ ID NO: 2160614 - DNA, 23 bp, Homo sapiens
aatgatttcctctgtaatctatt

SEQ ID NO: 2160615 - DNA, 16 bp, Homo sapiens
aatgcatacaataaaa

SEQ ID NO: 2160616 - DNA, 23 bp, Homo sapiens
aatgcatacaataaaagagcttt

SEQ ID NO: 2160617 - DNA, 16 bp, Homo sapiens
aatgtcagtatgtgga

SEQ ID NO: 2160618 - DNA, 13 bp, Homo sapiens
aattaagaatctc

SEQ ID NO: 2160619 - DNA, 19 bp, Homo sapiens
aattacattactgaaaact

SEQ ID NO: 2160620 - DNA, 22 bp, Homo sapiens
aattctttgacctgttgggagt

SEQ ID NO: 2160621 - DNA, 18 bp, Homo sapiens
aattggtatcaagaaagt

SEQ ID NO: 2160622 - DNA, 14 bp, Homo sapiens
aattgtgatgtgtc

SEQ ID NO: 2160623 - DNA, 15 bp, Homo sapiens
aatttataatgatta

SEQ ID NO: 2160624 - DNA, 19 bp, Homo sapiens
aattttgtttataagaaat

SEQ ID NO: 2160625 - DNA, 13 bp, Homo sapiens
aatttttcctgca

SEQ ID NO: 2160626 - DNA, 12 bp, Homo sapiens
acaaatacctcc

SEQ ID NO: 2160627 - DNA, 11 bp, Homo sapiens
acaataaaaga

SEQ ID NO: 2160628 - DNA, 23 bp, Homo sapiens
acacgtggccaagagaaacttcc

SEQ ID NO: 2160629 - DNA, 14 bp, Homo sapiens
acagaaccctccac

SEQ ID NO: 2160630 - DNA, 17 bp, Homo sapiens
acagaacctcccaaatt

SEQ ID NO: 2160631 - DNA, 23 bp, Homo sapiens
acagatatgggtgtttttaataa

SEQ ID NO: 2160632 - DNA, 15 bp, Homo sapiens
acagcagattccaca

SEQ ID NO: 2160633 - DNA, 15 bp, Homo sapiens
acattactgaaaact

SEQ ID NO: 2160634 - DNA, 20 bp, Homo sapiens
acattactgaaaacttcatt

SEQ ID NO: 2160635 - DNA, 16 bp, Homo sapiens
acattcttatatttca

SEQ ID NO: 2160636 - DNA, 18 bp, Homo sapiens
accacagtccctcacctc

SEQ ID NO: 2160637 - DNA, 14 bp, Homo sapiens
accagatgatgtcc

SEQ ID NO: 2160638 - DNA, 22 bp, Homo sapiens
acccagctatggttctctcgca

SEQ ID NO: 2160639 - DNA, 23 bp, Homo sapiens
acccctacacaaggacagaaccc

SEQ ID NO: 2160640 - DNA, 22 bp, Homo sapiens
acccctccttggtttctccctc

SEQ ID NO: 2160641 - DNA, 19 bp, Homo sapiens
acccgagggacagcagatt

SEQ ID NO: 2160642 - DNA, 20 bp, Homo sapiens
accgtcctgtcagctccttg

SEQ ID NO: 2160643 - DNA, 18 bp, Homo sapiens
acctcacccctccttggt

SEQ ID NO: 2160644 - DNA, 14 bp, Homo sapiens
acctccattaaatg

SEQ ID NO: 2160645 - DNA, 19 bp, Homo sapiens
acctccggcctccacatga

SEQ ID NO: 2160646 - DNA, 14 bp, Homo sapiens
acgaaacaaagaca

SEQ ID NO: 2160647 - DNA, 16 bp, Homo sapiens
acgcaaagagagattt

SEQ ID NO: 2160648 - DNA, 11 bp, Homo sapiens
actagcccccc

SEQ ID NO: 2160649 - DNA, 13 bp, Homo sapiens
actcagtctttaa

SEQ ID NO: 2160650 - DNA, 20 bp, Homo sapiens
actcctcagttcctcaccat

SEQ ID NO: 2160651 - DNA, 15 bp, Homo sapiens
actgataaagaaaga

SEQ ID NO: 2160652 - DNA, 12 bp, Homo sapiens
tggttaattttt

SEQ ID NO: 2160653 - DNA, 15 bp, Homo sapiens
tgtaaatttatgtga

SEQ ID NO: 2160654 - DNA, 17 bp, Homo sapiens
tgtaatttaaaattgtg

SEQ ID NO: 2160655 - DNA, 22 bp, Homo sapiens
tgtatccatccatggggctgat

SEQ ID NO: 2160656 - DNA, 21 bp, Homo sapiens
tgtatgtgggggtctgtgtgt

SEQ ID NO: 2160657 - DNA, 16 bp, Homo sapiens
tgtcaatttataatga

SEQ ID NO: 2160658 - DNA, 22 bp, Homo sapiens
tgtcacccttaggccagcacca

SEQ ID NO: 2160659 - DNA, 18 bp, Homo sapiens
tgtcagtatgtggaagtg

SEQ ID NO: 2160660 - DNA, 20 bp, Homo sapiens
tgtcagtatgtggaagtgtg

SEQ ID NO: 2160661 - DNA, 20 bp, Homo sapiens
tgtcccaccacagtccctca

SEQ ID NO: 2160662 - DNA, 19 bp, Homo sapiens
tgtctattcaaaatatcaa

SEQ ID NO: 2160663 - DNA, 20 bp, Homo sapiens
tgtgactgaagaagatgagc

SEQ ID NO: 2160664 - DNA, 21 bp, Homo sapiens
tgtgactgaagaagatgagcc

SEQ ID NO: 2160665 - DNA, 18 bp, Homo sapiens
tgtgaggggctctctcat

SEQ ID NO: 2160666 - DNA, 16 bp, Homo sapiens
tgtggccttatgagct

SEQ ID NO: 2160667 - DNA, 14 bp, Homo sapiens
tgtgggagtgtgta

SEQ ID NO: 2160668 - DNA, 12 bp, Homo sapiens
tgtgtatgtggg

SEQ ID NO: 2160669 - DNA, 14 bp, Homo sapiens
tgtgtatgtggggg

SEQ ID NO: 2160670 - DNA, 23 bp, Homo sapiens
tgtgtatgtgggggtctgtgtgt

SEQ ID NO: 2160671 - DNA, 20 bp, Homo sapiens
tgtgtgtgggagtgtgtaat

SEQ ID NO: 2160672 - DNA, 14 bp, Homo sapiens
tgtgtgtgtatgtg

SEQ ID NO: 2160673 - DNA, 18 bp, Homo sapiens
tgtgtgttgtgtgtggga

SEQ ID NO: 2160674 - DNA, 13 bp, Homo sapiens
tgtgtttatgtgt

SEQ ID NO: 2160675 - DNA, 18 bp, Homo sapiens
tgttgggagtgaggatgt

SEQ ID NO: 2160676 - DNA, 14 bp, Homo sapiens
tgttgtgtgtggga

SEQ ID NO: 2160677 - DNA, 12 bp, Homo sapiens
ttaaaataatat

SEQ ID NO: 2160678 - DNA, 18 bp, Homo sapiens
ttaacagttcctttcaaa

SEQ ID NO: 2160679 - DNA, 12 bp, Homo sapiens
ttaactcagtct

SEQ ID NO: 2160680 - DNA, 19 bp, Homo sapiens
ttaatactataaataatat

SEQ ID NO: 2160681 - DNA, 17 bp, Homo sapiens
ttacacattaagcaaat

SEQ ID NO: 2160682 - DNA, 15 bp, Homo sapiens
ttactaattattcct

SEQ ID NO: 2160683 - DNA, 15 bp, Homo sapiens
ttagaagaagtgtgt

SEQ ID NO: 2160684 - DNA, 16 bp, Homo sapiens
ttagaagaagtgtgtc

SEQ ID NO: 2160685 - DNA, 16 bp, Homo sapiens
ttagcctttgtcccag

SEQ ID NO: 2160686 - DNA, 12 bp, Homo sapiens
ttatgtgtgtgt

SEQ ID NO: 2160687 - DNA, 14 bp, Homo sapiens
ttatgtgtgtgtgt

SEQ ID NO: 2160688 - DNA, 20 bp, Homo sapiens
ttattttgggcctgttcctt

SEQ ID NO: 2160689 - DNA, 15 bp, Homo sapiens
ttcaataagagatta

SEQ ID NO: 2160690 - DNA, 16 bp, Homo sapiens
ttcaatgcatacaata

SEQ ID NO: 2160691 - DNA, 18 bp, Homo sapiens
ttcaatgcatacaataaa

SEQ ID NO: 2160692 - DNA, 15 bp, Homo sapiens
ttcacagcaacactc

SEQ ID NO: 2160693 - DNA, 17 bp, Homo sapiens
ttcactttcaaaaacat

SEQ ID NO: 2160694 - DNA, 17 bp, Homo sapiens
ttcagtggttccttctg

SEQ ID NO: 2160695 - DNA, 21 bp, Homo sapiens
ttcatctaatgtattatgagc

SEQ ID NO: 2160696 - DNA, 19 bp, Homo sapiens
ttcatttccaactcaggtt

SEQ ID NO: 2160697 - DNA, 14 bp, Homo sapiens
ttccaactcaggtt

SEQ ID NO: 2160698 - DNA, 11 bp, Homo sapiens
ttccctgtggc

SEQ ID NO: 2160699 - DNA, 18 bp, Homo sapiens
ttccctgtggccttatga

SEQ ID NO: 2160700 - DNA, 18 bp, Homo sapiens
ttcctctttgcccaaaat

SEQ ID NO: 2160701 - DNA, 11 bp, Homo sapiens
ttcctgcatgt

SEQ ID NO: 2160702 - DNA, 14 bp, Homo sapiens
ttgaaaagtgtcct

SEQ ID NO: 2160703 - DNA, 23 bp, Homo sapiens
ttgatgtgccttaaattatacca

SEQ ID NO: 2160704 - DNA, 18 bp, Homo sapiens
ttgcactgatgtccctcc

SEQ ID NO: 2160705 - DNA, 16 bp, Homo sapiens
ttggcagctctactct

SEQ ID NO: 2160706 - DNA, 12 bp, Homo sapiens
ttgtgagatggg

SEQ ID NO: 2160707 - DNA, 16 bp, Homo sapiens
ttgtgtgtgggagtgt

SEQ ID NO: 2160708 - DNA, 18 bp, Homo sapiens
ttgtttagaagaagtgtg

SEQ ID NO: 2160709 - DNA, 16 bp, Homo sapiens
tttaaaattgtgatgt

SEQ ID NO: 2160710 - DNA, 16 bp, Homo sapiens
tttaaacatagaaagt

SEQ ID NO: 2160711 - DNA, 17 bp, Homo sapiens
tttaaagaagaaaaaaa

SEQ ID NO: 2160712 - DNA, 16 bp, Homo sapiens
tttacactcaaccatg

SEQ ID NO: 2160713 - DNA, 21 bp, Homo sapiens
tttattttaaaacagaagaat

SEQ ID NO: 2160714 - DNA, 23 bp, Homo sapiens
tttcacagcaacactctacttga

SEQ ID NO: 2160715 - DNA, 12 bp, Homo sapiens
tttcatagatgt

SEQ ID NO: 2160716 - DNA, 15 bp, Homo sapiens
tttctttaagaaagt

SEQ ID NO: 2160717 - DNA, 16 bp, Homo sapiens
tttctttaagaaagta

SEQ ID NO: 2160718 - DNA, 20 bp, Homo sapiens
tttgagaataggggattttt

SEQ ID NO: 2160719 - DNA, 19 bp, Homo sapiens
tttgctatgagctggggat

SEQ ID NO: 2160720 - DNA, 16 bp, Homo sapiens
tttgggcctgttcctt

SEQ ID NO: 2160721 - DNA, 12 bp, Homo sapiens
ttttagagaaaa

SEQ ID NO: 2160722 - DNA, 21 bp, Homo sapiens
ttttatttttctcatgatgag

SEQ ID NO: 2160723 - DNA, 18 bp, Homo sapiens
ttttcctgcatgttctgt

SEQ ID NO: 2160724 - DNA, 18 bp, Homo sapiens
tttttcctgcatgttctg

SEQ ID NO: 2160725 - DNA, 12 bp, Homo sapiens
cagtccctcacc

SEQ ID NO: 2160726 - DNA, 18 bp, Homo sapiens
cagtggctggatctgtga

SEQ ID NO: 2160727 - DNA, 17 bp, Homo sapiens
cagttcctcaccatcat

SEQ ID NO: 2160728 - DNA, 12 bp, Homo sapiens
catacaataaaa

SEQ ID NO: 2160729 - DNA, 17 bp, Homo sapiens
catacaataaaagagct

SEQ ID NO: 2160730 - DNA, 18 bp, Homo sapiens
catacaataaaagagctt

SEQ ID NO: 2160731 - DNA, 19 bp, Homo sapiens
catacaataaaagagcttt

SEQ ID NO: 2160732 - DNA, 13 bp, Homo sapiens
catcatgtttaca

SEQ ID NO: 2160733 - DNA, 22 bp, Homo sapiens
catccaaggttctagtctctgt

SEQ ID NO: 2160734 - DNA, 15 bp, Homo sapiens
catcccagtgtccta

SEQ ID NO: 2160735 - DNA, 17 bp, Homo sapiens
catctgtacctctgcct

SEQ ID NO: 2160736 - DNA, 21 bp, Homo sapiens
catcttgtctaagacccccat

SEQ ID NO: 2160737 - DNA, 17 bp, Homo sapiens
catgaagaatgtttctg

SEQ ID NO: 2160738 - DNA, 19 bp, Homo sapiens
catgagttggctgggaata

SEQ ID NO: 2160739 - DNA, 21 bp, Homo sapiens
catgcaccctggacttctcta

SEQ ID NO: 2160740 - DNA, 15 bp, Homo sapiens
catgcccatcccagt

SEQ ID NO: 2160741 - DNA, 22 bp, Homo sapiens
cattacctcagtgagaagccag

SEQ ID NO: 2160742 - DNA, 13 bp, Homo sapiens
cattccagaggaa

SEQ ID NO: 2160743 - DNA, 17 bp, Homo sapiens
ccaaaacatgcaccctg

SEQ ID NO: 2160744 - DNA, 21 bp, Homo sapiens
ccaacaacttttccctcactg

SEQ ID NO: 2160745 - DNA, 14 bp, Homo sapiens
ccaaccctcagaca

SEQ ID NO: 2160746 - DNA, 17 bp, Homo sapiens
ccaagagaaacttccta

SEQ ID NO: 2160747 - DNA, 19 bp, Homo sapiens
ccaagccttggctctaccc

SEQ ID NO: 2160748 - DNA, 14 bp, Homo sapiens
ccaagtatttcaca

SEQ ID NO: 2160749 - DNA, 16 bp, Homo sapiens
ccaccacagtccctca

SEQ ID NO: 2160750 - DNA, 15 bp, Homo sapiens
ccagattgaaaagtg

SEQ ID NO: 2160751 - DNA, 19 bp, Homo sapiens
ccagattgaaaagtgtcct

SEQ ID NO: 2160752 - DNA, 16 bp, Homo sapiens
ccatgacctcacccct

SEQ ID NO: 2160753 - DNA, 18 bp, Homo sapiens
cccagaatgcctcctgca

SEQ ID NO: 2160754 - DNA, 13 bp, Homo sapiens
cccagcccagcct

SEQ ID NO: 2160755 - DNA, 17 bp, Homo sapiens
cccatcccagtgtccta

SEQ ID NO: 2160756 - DNA, 10 bp, Homo sapiens
ccctccaccc

SEQ ID NO: 2160757 - DNA, 19 bp, Homo sapiens
ccctgtaaggtttcaatgc

SEQ ID NO: 2160758 - DNA, 15 bp, Homo sapiens
cctaaaagtaaacat

SEQ ID NO: 2160759 - DNA, 13 bp, Homo sapiens
cctagaagaaaac

SEQ ID NO: 2160760 - DNA, 16 bp, Homo sapiens
cctagaagaaaacccg

SEQ ID NO: 2160761 - DNA, 16 bp, Homo sapiens
cctaggaccttttccc

SEQ ID NO: 2160762 - DNA, 15 bp, Homo sapiens
cctcagttcctcacc

SEQ ID NO: 2160763 - DNA, 16 bp, Homo sapiens
cctcagttggaatcat

SEQ ID NO: 2160764 - DNA, 14 bp, Homo sapiens
cctcgctttgaggt

SEQ ID NO: 2160765 - DNA, 13 bp, Homo sapiens
cctgcatgttctg

SEQ ID NO: 2160766 - DNA, 14 bp, Homo sapiens
cctttgtcccagaa

SEQ ID NO: 2160767 - DNA, 15 bp, Homo sapiens
cgcaaagagagattt

SEQ ID NO: 2160768 - DNA, 16 bp, Homo sapiens
cgcaaagagagatttt

SEQ ID NO: 2160769 - DNA, 17 bp, Homo sapiens
cgctgctttttcatcaa

SEQ ID NO: 2160770 - DNA, 13 bp, Homo sapiens
ctaaaagtaaaca

SEQ ID NO: 2160771 - DNA, 14 bp, Homo sapiens
ctaaaagtaaacat

SEQ ID NO: 2160772 - DNA, 13 bp, Homo sapiens
ctaagacttccta

SEQ ID NO: 2160773 - DNA, 14 bp, Homo sapiens
ctaatagaaaagtc

SEQ ID NO: 2160774 - DNA, 18 bp, Homo sapiens
ctaatagaaaagtctcca

SEQ ID NO: 2160775 - DNA, 18 bp, Homo sapiens
ctaatgtattatgagcca

SEQ ID NO: 2160776 - DNA, 21 bp, Homo sapiens
ctacacaaggacagaaccctc

SEQ ID NO: 2160777 - DNA, 13 bp, Homo sapiens
ctagaagaaaacc

SEQ ID NO: 2160778 - DNA, 18 bp, Homo sapiens
ctagaagaaaacccgagg

SEQ ID NO: 2160779 - DNA, 20 bp, Homo sapiens
ctagaagaaaacccgaggga

SEQ ID NO: 2160780 - DNA, 18 bp, Homo sapiens
ctagactgtgctaagaga

SEQ ID NO: 2160781 - DNA, 18 bp, Homo sapiens
ctaggaccttttcccaat

SEQ ID NO: 2160782 - DNA, 18 bp, Homo sapiens
ctaggcccagacccagcc

SEQ ID NO: 2160783 - DNA, 20 bp, Homo sapiens
ctatggggatagatgtgtgg

SEQ ID NO: 2160784 - DNA, 21 bp, Homo sapiens
ctatggggatagatgtgtgga

SEQ ID NO: 2160785 - DNA, 15 bp, Homo sapiens
ctcacccctccttgg

SEQ ID NO: 2160786 - DNA, 14 bp, Homo sapiens
ctcagttggaatca

SEQ ID NO: 2160787 - DNA, 20 bp, Homo sapiens
ctcatgtgcaataggtgaga

SEQ ID NO: 2160788 - DNA, 15 bp, Homo sapiens
ctcattccagaggaa

SEQ ID NO: 2160789 - DNA, 13 bp, Homo sapiens
ctcctcagttcct

SEQ ID NO: 2160790 - DNA, 15 bp, Homo sapiens
ctctaatagaaaagt

SEQ ID NO: 2160791 - DNA, 18 bp, Homo sapiens
ctctacttgaagcaactt

SEQ ID NO: 2160792 - DNA, 14 bp, Homo sapiens
ctgaacagaattaa

SEQ ID NO: 2160793 - DNA, 21 bp, Homo sapiens
ctgaagagaagggcagggctg

SEQ ID NO: 2160794 - DNA, 16 bp, Homo sapiens
ctgactaggaaaagtt

SEQ ID NO: 2160795 - DNA, 18 bp, Homo sapiens
ctgaggaagagggactgt

SEQ ID NO: 2160796 - DNA, 23 bp, Homo sapiens
ctgaggaagagggactgttcttt

SEQ ID NO: 2160797 - DNA, 19 bp, Homo sapiens
ctgaggcctaaaagtaaac

SEQ ID NO: 2160798 - DNA, 20 bp, Homo sapiens
ctgagtagctgggattacag

SEQ ID NO: 2160799 - DNA, 14 bp, Homo sapiens
ctgataaagaaaga

SEQ ID NO: 2160800 - DNA, 23 bp, Homo sapiens
ctgcccctgtaaggtttcaatgc

SEQ ID NO: 2160801 - DNA, 12 bp, Homo sapiens
ctggaggtttgt

SEQ ID NO: 2160802 - DNA, 14 bp, Homo sapiens
ctggatctgtgagg

SEQ ID NO: 2160803 - DNA, 14 bp, Homo sapiens
ctggcaccagatga

SEQ ID NO: 2160804 - DNA, 13 bp, Homo sapiens
ctggccctgtgcc

SEQ ID NO: 2160805 - DNA, 18 bp, Homo sapiens
ctgggaataagtgccagg

SEQ ID NO: 2160806 - DNA, 16 bp, Homo sapiens
ctggggatgtctctca

SEQ ID NO: 2160807 - DNA, 17 bp, Homo sapiens
ctgtaaggtttcaatgc

SEQ ID NO: 2160808 - DNA, 15 bp, Homo sapiens
ctgtcagctccttga

SEQ ID NO: 2160809 - DNA, 16 bp, Homo sapiens
ctgtgccttttgccat

SEQ ID NO: 2160810 - DNA, 22 bp, Homo sapiens
ctgtgctggtctttagccccac

SEQ ID NO: 2160811 - DNA, 18 bp, Homo sapiens
ctgtgtgtgtgtatgtgg

SEQ ID NO: 2160812 - DNA, 20 bp, Homo sapiens
ctgtgtgtgtgtatgtgggg

SEQ ID NO: 2160813 - DNA, 19 bp, Homo sapiens
cttaaattataccaaagat

SEQ ID NO: 2160814 - DNA, 15 bp, Homo sapiens
cttaggccagcacca

SEQ ID NO: 2160815 - DNA, 18 bp, Homo sapiens
cttctggatggattttat

SEQ ID NO: 2160816 - DNA, 20 bp, Homo sapiens
cttgaaaattttattaaaaa

SEQ ID NO: 2160817 - DNA, 20 bp, Homo sapiens
cttgactaaaaaaaaaagaa

SEQ ID NO: 2160818 - DNA, 20 bp, Homo sapiens
cttgcactgatgtccctcct

SEQ ID NO: 2160819 - DNA, 22 bp, Homo sapiens
cttgcactgatgtccctccttt

SEQ ID NO: 2160820 - DNA, 19 bp, Homo sapiens
cttgcagatatctgcatgt

SEQ ID NO: 2160821 - DNA, 18 bp, Homo sapiens
cttgtctaagacccccat

SEQ ID NO: 2160822 - DNA, 21 bp, Homo sapiens
cttgtctaagacccccattat

SEQ ID NO: 2160823 - DNA, 14 bp, Homo sapiens
ctttcaaaaacatg

SEQ ID NO: 2160824 - DNA, 13 bp, Homo sapiens
gaaaacccgaggg

SEQ ID NO: 2160825 - DNA, 23 bp, Homo sapiens
gaaaatgtctattcaaaatatca

SEQ ID NO: 2160826 - DNA, 20 bp, Homo sapiens
gaaacaaagacaatttataa

SEQ ID NO: 2160827 - DNA, 12 bp, Homo sapiens
gaacagtaaaca

SEQ ID NO: 2160828 - DNA, 13 bp, Homo sapiens
gaagaagtgtgtc

SEQ ID NO: 2160829 - DNA, 12 bp, Homo sapiens
gaagatgagcct

SEQ ID NO: 2160830 - DNA, 15 bp, Homo sapiens
gaaggctatggggat

SEQ ID NO: 2160831 - DNA, 19 bp, Homo sapiens
gaagggcagggctgaggcc

SEQ ID NO: 2160832 - DNA, 18 bp, Homo sapiens
gaagtgtgggtctgtgtg

SEQ ID NO: 2160833 - DNA, 21 bp, Homo sapiens
gaagtgtgggtctgtgtgtgt

SEQ ID NO: 2160834 - DNA, 18 bp, Homo sapiens
gaatcctcagttggaatc

SEQ ID NO: 2160835 - DNA, 19 bp, Homo sapiens
gaatcctcagttggaatca

SEQ ID NO: 2160836 - DNA, 14 bp, Homo sapiens
tacaataaaagagc

SEQ ID NO: 2160837 - DNA, 16 bp, Homo sapiens
tacaataaaagagctt

SEQ ID NO: 2160838 - DNA, 17 bp, Homo sapiens
tacaataaaagagcttt

SEQ ID NO: 2160839 - DNA, 19 bp, Homo sapiens
tacaataaaagagctttat

SEQ ID NO: 2160840 - DNA, 18 bp, Homo sapiens
tacacaaggacagaaccc

SEQ ID NO: 2160841 - DNA, 17 bp, Homo sapiens
tacccccaaccctcaga

SEQ ID NO: 2160842 - DNA, 22 bp, Homo sapiens
tactgaggcctaaaagtaaaca

SEQ ID NO: 2160843 - DNA, 16 bp, Homo sapiens
tactgataaagaaaga

SEQ ID NO: 2160844 - DNA, 16 bp, Homo sapiens
tagaaagcagagattt

SEQ ID NO: 2160845 - DNA, 13 bp, Homo sapiens
tagaagaaaaccc

SEQ ID NO: 2160846 - DNA, 14 bp, Homo sapiens
tagaagaaaacccg

SEQ ID NO: 2160847 - DNA, 19 bp, Homo sapiens
tagaatgtgtgtcaattta

SEQ ID NO: 2160848 - DNA, 21 bp, Homo sapiens
tagacatttgctatgagctgg

SEQ ID NO: 2160849 - DNA, 11 bp, Homo sapiens
tagatgtgtgg

SEQ ID NO: 2160850 - DNA, 14 bp, Homo sapiens
tagccccactgctt

SEQ ID NO: 2160851 - DNA, 15 bp, Homo sapiens
taggaactgctgggc

SEQ ID NO: 2160852 - DNA, 16 bp, Homo sapiens
taggtcagatatttga

SEQ ID NO: 2160853 - DNA, 11 bp, Homo sapiens
tataaaaacaa

SEQ ID NO: 2160854 - DNA, 20 bp, Homo sapiens
tatatttgtaaatttatgtg

SEQ ID NO: 2160855 - DNA, 12 bp, Homo sapiens
tatcaagaaagt

SEQ ID NO: 2160856 - DNA, 14 bp, Homo sapiens
tatcagcacgtgtg

SEQ ID NO: 2160857 - DNA, 22 bp, Homo sapiens
tatcagtcttgtaccaaggcaa

SEQ ID NO: 2160858 - DNA, 20 bp, Homo sapiens
tatctactgataaagaaaga

SEQ ID NO: 2160859 - DNA, 12 bp, Homo sapiens
tatctcaaacaa

SEQ ID NO: 2160860 - DNA, 23 bp, Homo sapiens
tatgagctggggatgtctctcat

SEQ ID NO: 2160861 - DNA, 18 bp, Homo sapiens
tatgggcatttggtggat

SEQ ID NO: 2160862 - DNA, 20 bp, Homo sapiens
tatggggatagatgtgtgga

SEQ ID NO: 2160863 - DNA, 12 bp, Homo sapiens
tatgtggaagtg

SEQ ID NO: 2160864 - DNA, 18 bp, Homo sapiens
tatgtgggggtctgtgtg

SEQ ID NO: 2160865 - DNA, 17 bp, Homo sapiens
tattaccaaaagtcaac

SEQ ID NO: 2160866 - DNA, 20 bp, Homo sapiens
tattccaataccctagaaga

SEQ ID NO: 2160867 - DNA, 12 bp, Homo sapiens
tattcccatgag

SEQ ID NO: 2160868 - DNA, 20 bp, Homo sapiens
tattgtttctttaagaaagt

SEQ ID NO: 2160869 - DNA, 22 bp, Homo sapiens
tattttctggtaaaaagaaaaa

SEQ ID NO: 2160870 - DNA, 19 bp, Homo sapiens
tattttgggcctgttcctt

SEQ ID NO: 2160871 - DNA, 21 bp, Homo sapiens
tcaaaatgatttcctctgtaa

SEQ ID NO: 2160872 - DNA, 21 bp, Homo sapiens
tcaaccatgacctcacccctc

SEQ ID NO: 2160873 - DNA, 22 bp, Homo sapiens
tcaatgcatacaataaaagagc

SEQ ID NO: 2160874 - DNA, 23 bp, Homo sapiens
tcaatgcatacaataaaagagct

SEQ ID NO: 2160875 - DNA, 16 bp, Homo sapiens
tcaattactctataat

SEQ ID NO: 2160876 - DNA, 17 bp, Homo sapiens
tcactgttccccaaaac

SEQ ID NO: 2160877 - DNA, 12 bp, Homo sapiens
tcagacagactt

SEQ ID NO: 2160878 - DNA, 17 bp, Homo sapiens
tcagatttgccttattg

SEQ ID NO: 2160879 - DNA, 15 bp, Homo sapiens
tcaggccgaaggagg

SEQ ID NO: 2160880 - DNA, 22 bp, Homo sapiens
tcagtctttaatctgagaggcc

SEQ ID NO: 2160881 - DNA, 18 bp, Homo sapiens
tcatcaaaacctaccctg

SEQ ID NO: 2160882 - DNA, 12 bp, Homo sapiens
tcatcatcttgt

SEQ ID NO: 2160883 - DNA, 18 bp, Homo sapiens
tcatgaagaatgtttctg

SEQ ID NO: 2160884 - DNA, 22 bp, Homo sapiens
tcatgatagaaggctatgggga

SEQ ID NO: 2160885 - DNA, 14 bp, Homo sapiens
tcattccagaggaa

SEQ ID NO: 2160886 - DNA, 19 bp, Homo sapiens
tcatttccaactcaggtta

SEQ ID NO: 2160887 - DNA, 13 bp, Homo sapiens
tccaactcaggtt

SEQ ID NO: 2160888 - DNA, 21 bp, Homo sapiens
tccaactggattataaataaa

SEQ ID NO: 2160889 - DNA, 15 bp, Homo sapiens
tccaataccctagaa

SEQ ID NO: 2160890 - DNA, 19 bp, Homo sapiens
tccaataccctagaagaaa

SEQ ID NO: 2160891 - DNA, 22 bp, Homo sapiens
tccacaggacacgaaggctgcc

SEQ ID NO: 2160892 - DNA, 20 bp, Homo sapiens
tccacatgacagaaccaatt

SEQ ID NO: 2160893 - DNA, 13 bp, Homo sapiens
tccacccctaccc

SEQ ID NO: 2160894 - DNA, 13 bp, Homo sapiens
tccattaaatggt

SEQ ID NO: 2160895 - DNA, 15 bp, Homo sapiens
tcccagagtcctctg

SEQ ID NO: 2160896 - DNA, 12 bp, Homo sapiens
tccctaacttct

SEQ ID NO: 2160897 - DNA, 16 bp, Homo sapiens
tcctagagatctatgg

SEQ ID NO: 2160898 - DNA, 22 bp, Homo sapiens
tcctatagttttactcctcagt

SEQ ID NO: 2160899 - DNA, 19 bp, Homo sapiens
tcctcagttcctcaccatc

SEQ ID NO: 2160900 - DNA, 23 bp, Homo sapiens
tcctctttgcccaaaatacttgc

SEQ ID NO: 2160901 - DNA, 15 bp, Homo sapiens
tcctgtcagctcctt

SEQ ID NO: 2160902 - DNA, 19 bp, Homo sapiens
tcctgtccctcatccatag

SEQ ID NO: 2160903 - DNA, 22 bp, Homo sapiens
tctaatagaaaagtctccaccc

SEQ ID NO: 2160904 - DNA, 16 bp, Homo sapiens
tctcattccagaggaa

SEQ ID NO: 2160905 - DNA, 18 bp, Homo sapiens
tctctaatagaaaagtct

SEQ ID NO: 2160906 - DNA, 19 bp, Homo sapiens
tctgtgtgtttatgtgtgt

SEQ ID NO: 2160907 - DNA, 22 bp, Homo sapiens
tgaaactagaaagcagagattt

SEQ ID NO: 2160908 - DNA, 11 bp, Homo sapiens
tgaattaaaac

SEQ ID NO: 2160909 - DNA, 13 bp, Homo sapiens
tgacctatgagcc

SEQ ID NO: 2160910 - DNA, 20 bp, Homo sapiens
tgactgaagaagatgagcct

SEQ ID NO: 2160911 - DNA, 16 bp, Homo sapiens
tgagaataggggattt

SEQ ID NO: 2160912 - DNA, 20 bp, Homo sapiens
tgagctggggatgtctctca

SEQ ID NO: 2160913 - DNA, 17 bp, Homo sapiens
tgaggaagagggactgt

SEQ ID NO: 2160914 - DNA, 18 bp, Homo sapiens
tgagttcataaatttatg

SEQ ID NO: 2160915 - DNA, 12 bp, Homo sapiens
tgcaaaaaatag

SEQ ID NO: 2160916 - DNA, 21 bp, Homo sapiens
tgcaataggtgagagaatgta

SEQ ID NO: 2160917 - DNA, 18 bp, Homo sapiens
tgcactgaacagaattaa

SEQ ID NO: 2160918 - DNA, 17 bp, Homo sapiens
tgcactgatgtccctcc

SEQ ID NO: 2160919 - DNA, 19 bp, Homo sapiens
tgcagatatctgcatgtgt

SEQ ID NO: 2160920 - DNA, 14 bp, Homo sapiens
tgcagtgaacttcc

SEQ ID NO: 2160921 - DNA, 18 bp, Homo sapiens
tgcatacaataaaagagc

SEQ ID NO: 2160922 - DNA, 22 bp, Homo sapiens
tgccatcatgtttacagaggac

SEQ ID NO: 2160923 - DNA, 18 bp, Homo sapiens
tgcccatcccagtgtcct

SEQ ID NO: 2160924 - DNA, 22 bp, Homo sapiens
tgcccctgtaaggtttcaatgc

SEQ ID NO: 2160925 - DNA, 22 bp, Homo sapiens
tggaacacctaccaaaaaataa

SEQ ID NO: 2160926 - DNA, 23 bp, Homo sapiens
tggaagtgtgggtctgtgtgtgt

SEQ ID NO: 2160927 - DNA, 19 bp, Homo sapiens
tggatctgtgaggggctct

SEQ ID NO: 2160928 - DNA, 16 bp, Homo sapiens
tggccagtggctggat

SEQ ID NO: 2160929 - DNA, 19 bp, Homo sapiens
tgggagaatgtcagtatgt

SEQ ID NO: 2160930 - DNA, 22 bp, Homo sapiens
tgggagtgaggatgtctgggcc

SEQ ID NO: 2160931 - DNA, 11 bp, Homo sapiens
tgggagtgtgt

SEQ ID NO: 2160932 - DNA, 19 bp, Homo sapiens
tgggagttaaggaggaaat

SEQ ID NO: 2160933 - DNA, 18 bp, Homo sapiens
gccttatgagctcagcct

SEQ ID NO: 2160934 - DNA, 18 bp, Homo sapiens
gccttgcagatatctgca

SEQ ID NO: 2160935 - DNA, 19 bp, Homo sapiens
gccttgcagatatctgcat

SEQ ID NO: 2160936 - DNA, 23 bp, Homo sapiens
gcgagatagggggaagacagata

SEQ ID NO: 2160937 - DNA, 20 bp, Homo sapiens
gctaattctcagaaaggcaa

SEQ ID NO: 2160938 - DNA, 17 bp, Homo sapiens
gctatgagctggggatg

SEQ ID NO: 2160939 - DNA, 14 bp, Homo sapiens
gctgaggcctctca

SEQ ID NO: 2160940 - DNA, 14 bp, Homo sapiens
gctgagtggccact

SEQ ID NO: 2160941 - DNA, 22 bp, Homo sapiens
gcttgcactgatgtccctcctt

SEQ ID NO: 2160942 - DNA, 23 bp, Homo sapiens
ggaagggacaccaagccttggct

SEQ ID NO: 2160943 - DNA, 12 bp, Homo sapiens
ggaagtgtgggt

SEQ ID NO: 2160944 - DNA, 22 bp, Homo sapiens
ggaagtgtgggtctgtgtgtgt

SEQ ID NO: 2160945 - DNA, 21 bp, Homo sapiens
ggaatggaaaaagcagaaggc

SEQ ID NO: 2160946 - DNA, 18 bp, Homo sapiens
ggacagtatttgtgggga

SEQ ID NO: 2160947 - DNA, 22 bp, Homo sapiens
ggacttctctaatagaaaagtc

SEQ ID NO: 2160948 - DNA, 13 bp, Homo sapiens
ggatagatgtgtg

SEQ ID NO: 2160949 - DNA, 13 bp, Homo sapiens
ggatgtctgggcc

SEQ ID NO: 2160950 - DNA, 16 bp, Homo sapiens
ggcctaaaagtaaaca

SEQ ID NO: 2160951 - DNA, 12 bp, Homo sapiens
ggcctgttcctt

SEQ ID NO: 2160952 - DNA, 20 bp, Homo sapiens
gggacaccaagccttggctc

SEQ ID NO: 2160953 - DNA, 13 bp, Homo sapiens
gggatagatgtgt

SEQ ID NO: 2160954 - DNA, 21 bp, Homo sapiens
ggggcctgactaggaaaagtt

SEQ ID NO: 2160955 - DNA, 21 bp, Homo sapiens
gggtcatctgtacctctgcct

SEQ ID NO: 2160956 - DNA, 12 bp, Homo sapiens
ggtaggaatttc

SEQ ID NO: 2160957 - DNA, 15 bp, Homo sapiens
ggtatcaagaaagtc

SEQ ID NO: 2160958 - DNA, 14 bp, Homo sapiens
ggtattagaaagtg

SEQ ID NO: 2160959 - DNA, 18 bp, Homo sapiens
ggtccagattgaaaagtg

SEQ ID NO: 2160960 - DNA, 17 bp, Homo sapiens
ggtctgtgtgtgtgtat

SEQ ID NO: 2160961 - DNA, 20 bp, Homo sapiens
ggtctgtgtgtgtgtatgtg

SEQ ID NO: 2160962 - DNA, 16 bp, Homo sapiens
gtaaatttatgtgatg

SEQ ID NO: 2160963 - DNA, 15 bp, Homo sapiens
gtagagccagaggtc

SEQ ID NO: 2160964 - DNA, 16 bp, Homo sapiens
gtaggaactgctgggc

SEQ ID NO: 2160965 - DNA, 16 bp, Homo sapiens
gtaggatattggcatt

SEQ ID NO: 2160966 - DNA, 17 bp, Homo sapiens
gtaggtcagatatttga

SEQ ID NO: 2160967 - DNA, 16 bp, Homo sapiens
gtatgtggaagtgtgg

SEQ ID NO: 2160968 - DNA, 17 bp, Homo sapiens
gtatgtggaagtgtggg

SEQ ID NO: 2160969 - DNA, 18 bp, Homo sapiens
gtatgtggaagtgtgggt

SEQ ID NO: 2160970 - DNA, 20 bp, Homo sapiens
gtatgtgggggtctgtgtgt

SEQ ID NO: 2160971 - DNA, 13 bp, Homo sapiens
gtcaatttataat

SEQ ID NO: 2160972 - DNA, 20 bp, Homo sapiens
gtcccagaatgcctcctgca

SEQ ID NO: 2160973 - DNA, 12 bp, Homo sapiens
gtctgtgtgtgt

SEQ ID NO: 2160974 - DNA, 20 bp, Homo sapiens
gtctgtgtgtgtgtatgtgg

SEQ ID NO: 2160975 - DNA, 10 bp, Homo sapiens
gtgatgtgtc

SEQ ID NO: 2160976 - DNA, 21 bp, Homo sapiens
gtgcaataggtgagagaatgt

SEQ ID NO: 2160977 - DNA, 19 bp, Homo sapiens
gtgctggtctttagcccca

SEQ ID NO: 2160978 - DNA, 14 bp, Homo sapiens
gtggaagtgtgggt

SEQ ID NO: 2160979 - DNA, 20 bp, Homo sapiens
gtggaagtgtgggtctgtgt

SEQ ID NO: 2160980 - DNA, 21 bp, Homo sapiens
gtggaagtgtgggtctgtgtg

SEQ ID NO: 2160981 - DNA, 17 bp, Homo sapiens
gtggctggatctgtgag

SEQ ID NO: 2160982 - DNA, 15 bp, Homo sapiens
gtgggggtctgtgtg

SEQ ID NO: 2160983 - DNA, 16 bp, Homo sapiens
gtgggggtctgtgtgt

SEQ ID NO: 2160984 - DNA, 17 bp, Homo sapiens
gtgtgggagtgtgtaat

SEQ ID NO: 2160985 - DNA, 14 bp, Homo sapiens
gtgtgggtctgtgt

SEQ ID NO: 2160986 - DNA, 12 bp, Homo sapiens
gtgtgtatgtgg

SEQ ID NO: 2160987 - DNA, 15 bp, Homo sapiens
gtgtgtatgtggggg

SEQ ID NO: 2160988 - DNA, 20 bp, Homo sapiens
gtgtgtcacccttaggccag

SEQ ID NO: 2160989 - DNA, 16 bp, Homo sapiens
gtgtgtgggagtgtgt

SEQ ID NO: 2160990 - DNA, 17 bp, Homo sapiens
gtgtgtgttgtgtgtgg

SEQ ID NO: 2160991 - DNA, 12 bp, Homo sapiens
gtgtgttgtgtg

SEQ ID NO: 2160992 - DNA, 14 bp, Homo sapiens
gtgtgtttatgtgt

SEQ ID NO: 2160993 - DNA, 16 bp, Homo sapiens
gtgtttatgtgtgtgt

SEQ ID NO: 2160994 - DNA, 16 bp, Homo sapiens
gttaatttttcctgca

SEQ ID NO: 2160995 - DNA, 20 bp, Homo sapiens
gttaatttttcctgcatgtt

SEQ ID NO: 2160996 - DNA, 19 bp, Homo sapiens
gttagttaaaggcttaaat

SEQ ID NO: 2160997 - DNA, 15 bp, Homo sapiens
gttattacttcctca

SEQ ID NO: 2160998 - DNA, 22 bp, Homo sapiens
gttccccaaaacatgcaccctg

SEQ ID NO: 2160999 - DNA, 21 bp, Homo sapiens
gttgggagaatgtcagtatgt

SEQ ID NO: 2161000 - DNA, 18 bp, Homo sapiens
gttgtatcagcacgtgtg

SEQ ID NO: 2161001 - DNA, 13 bp, Homo sapiens
gttgtgtgtggga

SEQ ID NO: 2161002 - DNA, 16 bp, Homo sapiens
gtttagaagaagtgtg

SEQ ID NO: 2161003 - DNA, 21 bp, Homo sapiens
gtttcaatgcatacaataaaa

SEQ ID NO: 2161004 - DNA, 23 bp, Homo sapiens
gtttcaatgcatacaataaaaga

SEQ ID NO: 2161005 - DNA, 22 bp, Homo sapiens
taaacgaaacaaagacaattta

SEQ ID NO: 2161006 - DNA, 10 bp, Homo sapiens
taaagcaaaa

SEQ ID NO: 2161007 - DNA, 13 bp, Homo sapiens
taacttctgttac

SEQ ID NO: 2161008 - DNA, 19 bp, Homo sapiens
taagaaatactcatgtgca

SEQ ID NO: 2161009 - DNA, 14 bp, Homo sapiens
taatagaaaagtct

SEQ ID NO: 2161010 - DNA, 15 bp, Homo sapiens
taatttttcctgcat

SEQ ID NO: 2161011 - DNA, 16 bp, Homo sapiens
taatttttcctgcatg

SEQ ID NO: 2161012 - DNA, 14 bp, Homo sapiens
tacacaagtaaaca

SEQ ID NO: 2161013 - DNA, 16 bp, Homo sapiens
taccctagaagaaaac

SEQ ID NO: 2161014 - DNA, 15 bp, Homo sapiens
tacctccattaaatg

SEQ ID NO: 2161015 - DNA, 12 bp, Homo sapiens
tactagcccccc

SEQ ID NO: 2161016 - DNA, 14 bp, Homo sapiens
tactgaaaacttca

SEQ ID NO: 2161017 - DNA, 21 bp, Homo sapiens
tagaaaagaaaaaaaaaatat

SEQ ID NO: 2161018 - DNA, 21 bp, Homo sapiens
tagagaaaactaaagaaattt

SEQ ID NO: 2161019 - DNA, 12 bp, Homo sapiens
tagcatatcaat

SEQ ID NO: 2161020 - DNA, 18 bp, Homo sapiens
taggaactgctgggcttg

SEQ ID NO: 2161021 - DNA, 18 bp, Homo sapiens
taggtcagatatttgaga

SEQ ID NO: 2161022 - DNA, 17 bp, Homo sapiens
tagttattcacaaaaat

SEQ ID NO: 2161023 - DNA, 17 bp, Homo sapiens
tataaggtttaaaaaga

SEQ ID NO: 2161024 - DNA, 15 bp, Homo sapiens
tatactttaaataat

SEQ ID NO: 2161025 - DNA, 23 bp, Homo sapiens
tatctcaaacaattgaagtcaat

SEQ ID NO: 2161026 - DNA, 18 bp, Homo sapiens
tatgaaaaacaaaaataa

SEQ ID NO: 2161027 - DNA, 17 bp, Homo sapiens
tatggggatagatgtgt

SEQ ID NO: 2161028 - DNA, 21 bp, Homo sapiens
tatggtaggaactgctgggct

SEQ ID NO: 2161029 - DNA, 16 bp, Homo sapiens
tatgtggaagtgtggg

SEQ ID NO: 2161030 - DNA, 22 bp, Homo sapiens
tatgtgtgtgtgttgtgtgtgg

SEQ ID NO: 2161031 - DNA, 16 bp, Homo sapiens
tattcatctaatgtat

SEQ ID NO: 2161032 - DNA, 11 bp, Homo sapiens
tattggcattt

SEQ ID NO: 2161033 - DNA, 22 bp, Homo sapiens
tatttgtaaatttatgtgatgg

SEQ ID NO: 2161034 - DNA, 15 bp, Homo sapiens
tcaaaacctaccctg

SEQ ID NO: 2161035 - DNA, 20 bp, Homo sapiens
tcaaaacctttcaaatatca

SEQ ID NO: 2161036 - DNA, 16 bp, Homo sapiens
tcaatgcatacaataa

SEQ ID NO: 2161037 - DNA, 14 bp, Homo sapiens
tcagtatgtggaag

SEQ ID NO: 2161038 - DNA, 16 bp, Homo sapiens
tcataaatttatggtt

SEQ ID NO: 2161039 - DNA, 22 bp, Homo sapiens
tcatgcgctgctttttcatcaa

SEQ ID NO: 2161040 - DNA, 22 bp, Homo sapiens
tcattatgcacttgggagaaaa

SEQ ID NO: 2161041 - DNA, 14 bp, Homo sapiens
tccaactcaggtta

SEQ ID NO: 2161042 - DNA, 14 bp, Homo sapiens
tccaataccctaga

SEQ ID NO: 2161043 - DNA, 16 bp, Homo sapiens
caattatggaaaaaaa

SEQ ID NO: 2161044 - DNA, 15 bp, Homo sapiens
caattttaaagacat

SEQ ID NO: 2161045 - DNA, 20 bp, Homo sapiens
cacaaggacagaaccctcca

SEQ ID NO: 2161046 - DNA, 15 bp, Homo sapiens
cacagtccctcacct

SEQ ID NO: 2161047 - DNA, 16 bp, Homo sapiens
cacagtccctcacctc

SEQ ID NO: 2161048 - DNA, 16 bp, Homo sapiens
caccagatgatgtccc

SEQ ID NO: 2161049 - DNA, 17 bp, Homo sapiens
caccgtcctgtcagctc

SEQ ID NO: 2161050 - DNA, 14 bp, Homo sapiens
cactgaacagaatt

SEQ ID NO: 2161051 - DNA, 16 bp, Homo sapiens
cactgatgtccctcct

SEQ ID NO: 2161052 - DNA, 18 bp, Homo sapiens
cactgatgtccctccttt

SEQ ID NO: 2161053 - DNA, 22 bp, Homo sapiens
cagaattaagaaatactcatgt

SEQ ID NO: 2161054 - DNA, 23 bp, Homo sapiens
cagatcattatcagcctgtgcca

SEQ ID NO: 2161055 - DNA, 17 bp, Homo sapiens
cagcagattccacagga

SEQ ID NO: 2161056 - DNA, 15 bp, Homo sapiens
cagcccctcccagat

SEQ ID NO: 2161057 - DNA, 16 bp, Homo sapiens
cagcctcgctttgagg

SEQ ID NO: 2161058 - DNA, 20 bp, Homo sapiens
cagctccttgacctatgagc

SEQ ID NO: 2161059 - DNA, 14 bp, Homo sapiens
caggagtccctgcc

SEQ ID NO: 2161060 - DNA, 15 bp, Homo sapiens
caggcctgactctca

SEQ ID NO: 2161061 - DNA, 12 bp, Homo sapiens
caggtgttcttc

SEQ ID NO: 2161062 - DNA, 10 bp, Homo sapiens
cagtaaacat

SEQ ID NO: 2161063 - DNA, 19 bp, Homo sapiens
cagtaggatattggcattt

SEQ ID NO: 2161064 - DNA, 13 bp, Homo sapiens
cagtccctcacct

SEQ ID NO: 2161065 - DNA, 15 bp, Homo sapiens
cagtccctcacctcc

SEQ ID NO: 2161066 - DNA, 20 bp, Homo sapiens
cagtggctggatctgtgagg

SEQ ID NO: 2161067 - DNA, 20 bp, Homo sapiens
cagttcctcaccatcatcat

SEQ ID NO: 2161068 - DNA, 18 bp, Homo sapiens
cataatcacaacccttca

SEQ ID NO: 2161069 - DNA, 20 bp, Homo sapiens
catacaataaaagagcttta

SEQ ID NO: 2161070 - DNA, 15 bp, Homo sapiens
catacctggccctgt

SEQ ID NO: 2161071 - DNA, 22 bp, Homo sapiens
catcaaaacctaccctgtccta

SEQ ID NO: 2161072 - DNA, 19 bp, Homo sapiens
catccatggggctgattgt

SEQ ID NO: 2161073 - DNA, 14 bp, Homo sapiens
catctaatgtatta

SEQ ID NO: 2161074 - DNA, 21 bp, Homo sapiens
catctaatgtattatgagcca

SEQ ID NO: 2161075 - DNA, 19 bp, Homo sapiens
catgcaccctggacttctc

SEQ ID NO: 2161076 - DNA, 17 bp, Homo sapiens
catttccaactcaggtt

SEQ ID NO: 2161077 - DNA, 19 bp, Homo sapiens
ccaacaacttttccctcac

SEQ ID NO: 2161078 - DNA, 11 bp, Homo sapiens
ccaaccctcag

SEQ ID NO: 2161079 - DNA, 20 bp, Homo sapiens
ccaaggttctagtctctgtt

SEQ ID NO: 2161080 - DNA, 19 bp, Homo sapiens
ccaataccctagaagaaaa

SEQ ID NO: 2161081 - DNA, 22 bp, Homo sapiens
ccaataccctagaagaaaaccc

SEQ ID NO: 2161082 - DNA, 20 bp, Homo sapiens
ccaatttacactcaaccatg

SEQ ID NO: 2161083 - DNA, 20 bp, Homo sapiens
ccacacagacttgggcaggg

SEQ ID NO: 2161084 - DNA, 18 bp, Homo sapiens
ccacaggacacgaaggct

SEQ ID NO: 2161085 - DNA, 16 bp, Homo sapiens
ccacagtccctcacct

SEQ ID NO: 2161086 - DNA, 22 bp, Homo sapiens
ccaccgtcctgtcagctccttg

SEQ ID NO: 2161087 - DNA, 18 bp, Homo sapiens
ccactgcttgcactgatg

SEQ ID NO: 2161088 - DNA, 18 bp, Homo sapiens
ccagacccagcccagcct

SEQ ID NO: 2161089 - DNA, 14 bp, Homo sapiens
ccatatactttaaa

SEQ ID NO: 2161090 - DNA, 20 bp, Homo sapiens
ccatcatgtttacagaggac

SEQ ID NO: 2161091 - DNA, 13 bp, Homo sapiens
ccatgacctcacc

SEQ ID NO: 2161092 - DNA, 19 bp, Homo sapiens
ccatgacctcacccctcct

SEQ ID NO: 2161093 - DNA, 21 bp, Homo sapiens
ccatgacgcaaagagagattt

SEQ ID NO: 2161094 - DNA, 23 bp, Homo sapiens
cccactgcttgcactgatgtccc

SEQ ID NO: 2161095 - DNA, 20 bp, Homo sapiens
cccagtggtgaacagaacct

SEQ ID NO: 2161096 - DNA, 20 bp, Homo sapiens
cccatcccagtgtcctagga

SEQ ID NO: 2161097 - DNA, 16 bp, Homo sapiens
ccctacccccaaccct

SEQ ID NO: 2161098 - DNA, 18 bp, Homo sapiens
ccctacccccaaccctca

SEQ ID NO: 2161099 - DNA, 15 bp, Homo sapiens
ccctagaagaaaacc

SEQ ID NO: 2161100 - DNA, 14 bp, Homo sapiens
ccctggacttctct

SEQ ID NO: 2161101 - DNA, 12 bp, Homo sapiens
ccctgtaaggtt

SEQ ID NO: 2161102 - DNA, 24 bp, Homo sapiens
ccctgtgccttggtgtgctgtatc

SEQ ID NO: 2161103 - DNA, 12 bp, Homo sapiens
cccttccctgtg

SEQ ID NO: 2161104 - DNA, 14 bp, Homo sapiens
cctaaaagtaaaca

SEQ ID NO: 2161105 - DNA, 13 bp, Homo sapiens
cctaaatttaaaa

SEQ ID NO: 2161106 - DNA, 14 bp, Homo sapiens
cctagaagaaaacc

SEQ ID NO: 2161107 - DNA, 14 bp, Homo sapiens
cctatagttttact

SEQ ID NO: 2161108 - DNA, 14 bp, Homo sapiens
cctcagacagactt

SEQ ID NO: 2161109 - DNA, 18 bp, Homo sapiens
cctcagttcctcaccatc

SEQ ID NO: 2161110 - DNA, 21 bp, Homo sapiens
cctcttaatgtatgattacat

SEQ ID NO: 2161111 - DNA, 15 bp, Homo sapiens
cctgcatgttctgtg

SEQ ID NO: 2161112 - DNA, 18 bp, Homo sapiens
cctgtaaggtttcaatgc

SEQ ID NO: 2161113 - DNA, 17 bp, Homo sapiens
cctgtcctagagatcta

SEQ ID NO: 2161114 - DNA, 17 bp, Homo sapiens
cctgtgccttttgccat

SEQ ID NO: 2161115 - DNA, 16 bp, Homo sapiens
ccttatgagctcagcc

SEQ ID NO: 2161116 - DNA, 17 bp, Homo sapiens
ccttatgagctcagcct

SEQ ID NO: 2161117 - DNA, 23 bp, Homo sapiens
ccttgcaaagaccataaagtcca

SEQ ID NO: 2161118 - DNA, 20 bp, Homo sapiens
ccttgcagatatctgcatgt

SEQ ID NO: 2161119 - DNA, 21 bp, Homo sapiens
ccttgcagatatctgcatgtg

SEQ ID NO: 2161120 - DNA, 16 bp, Homo sapiens
ccttggtttctccctc

SEQ ID NO: 2161121 - DNA, 21 bp, Homo sapiens
cgagatagggggaagacagat

SEQ ID NO: 2161122 - DNA, 22 bp, Homo sapiens
cggggcctgactaggaaaagtt

SEQ ID NO: 2161123 - DNA, 15 bp, Homo sapiens
ctaatagaaaagtct

SEQ ID NO: 2161124 - DNA, 22 bp, Homo sapiens
ctaattctttgacctgttggga

SEQ ID NO: 2161125 - DNA, 22 bp, Homo sapiens
ctactctggaggtttgtttaga

SEQ ID NO: 2161126 - DNA, 18 bp, Homo sapiens
ctagaaagcagagatttt

SEQ ID NO: 2161127 - DNA, 21 bp, Homo sapiens
ctagaaagcagagattttcaa

SEQ ID NO: 2161128 - DNA, 15 bp, Homo sapiens
ctaggaaaagttggg

SEQ ID NO: 2161129 - DNA, 21 bp, Homo sapiens
ctattgtttctttaagaaagt

SEQ ID NO: 2161130 - DNA, 18 bp, Homo sapiens
ctcaaccatgacctcacc

SEQ ID NO: 2161131 - DNA, 15 bp, Homo sapiens
ctcaccttcctcatc

SEQ ID NO: 2161132 - DNA, 13 bp, Homo sapiens
ctcagaagaaaga

SEQ ID NO: 2161133 - DNA, 23 bp, Homo sapiens
ctcaggccgaaggaggagtcagg

SEQ ID NO: 2161134 - DNA, 14 bp, Homo sapiens
ctcagttcctcacc

SEQ ID NO: 2161135 - DNA, 15 bp, Homo sapiens
ctccttgacctatga

SEQ ID NO: 2161136 - DNA, 15 bp, Homo sapiens
ctctgaatttcttct

SEQ ID NO: 2161137 - DNA, 17 bp, Homo sapiens
ctgaagaagatgagcct

SEQ ID NO: 2161138 - DNA, 21 bp, Homo sapiens
ctgaggcctaaaagtaaacat

SEQ ID NO: 2161139 - DNA, 15 bp, Homo sapiens
ctgaggtacaggatg

SEQ ID NO: 2161140 - DNA, 22 bp, Homo sapiens
ctgcatgtgtcatgaagaatgt

SEQ ID NO: 2161141 - DNA, 20 bp, Homo sapiens
ctgcttgcactgatgtccct

SEQ ID NO: 2161142 - DNA, 22 bp, Homo sapiens
ctggggatgtctctcatgacca

SEQ ID NO: 2161143 - DNA, 16 bp, Homo sapiens
ctgtaaagcaaaagat

SEQ ID NO: 2161144 - DNA, 14 bp, Homo sapiens
ctgtgtgtgtgtat

SEQ ID NO: 2161145 - DNA, 18 bp, Homo sapiens
ctgtgtgtttatgtgtgt

SEQ ID NO: 2161146 - DNA, 13 bp, Homo sapiens
cttatgagatggg

SEQ ID NO: 2161147 - DNA, 19 bp, Homo sapiens
cttcagacacaaaagtcca

SEQ ID NO: 2161148 - DNA, 16 bp, Homo sapiens
cttccccaaataatat

SEQ ID NO: 2161149 - DNA, 16 bp, Homo sapiens
cttgaagcaacttggt

SEQ ID NO: 2161150 - DNA, 16 bp, Homo sapiens
cttgcactgatgtccc

SEQ ID NO: 2161151 - DNA, 18 bp, Homo sapiens
cttgcagatatctgcatg

SEQ ID NO: 2161152 - DNA, 21 bp, Homo sapiens
cttggtccagattgaaaagtg

SEQ ID NO: 2161153 - DNA, 10 bp, Homo sapiens
aaaaaaagag

SEQ ID NO: 2161154 - DNA, 10 bp, Homo sapiens
aaaagaaagc

SEQ ID NO: 2161155 - DNA, 16 bp, Homo sapiens
aaaagaacagtaaaca

SEQ ID NO: 2161156 - DNA, 12 bp, Homo sapiens
aaaagagcttta

SEQ ID NO: 2161157 - DNA, 20 bp, Homo sapiens
aaaatattcaataagagatt

SEQ ID NO: 2161158 - DNA, 22 bp, Homo sapiens
aaactagaaagcagagattttc

SEQ ID NO: 2161159 - DNA, 23 bp, Homo sapiens
aaactagaaagcagagattttca

SEQ ID NO: 2161160 - DNA, 15 bp, Homo sapiens
aaagagagatttttt

SEQ ID NO: 2161161 - DNA, 22 bp, Homo sapiens
aaagcaaaagatccctttttct

SEQ ID NO: 2161162 - DNA, 15 bp, Homo sapiens
aaagcagagattttc

SEQ ID NO: 2161163 - DNA, 20 bp, Homo sapiens
aaatacctccattaaatggt

SEQ ID NO: 2161164 - DNA, 15 bp, Homo sapiens
aaatgtgtattttaa

SEQ ID NO: 2161165 - DNA, 23 bp, Homo sapiens
aaattacattactgaaaacttca

SEQ ID NO: 2161166 - DNA, 20 bp, Homo sapiens
aaattggtatcaagaaagtc

SEQ ID NO: 2161167 - DNA, 15 bp, Homo sapiens
aaattgtgatgtgtc

SEQ ID NO: 2161168 - DNA, 15 bp, Homo sapiens
aaatttatgtgatgg

SEQ ID NO: 2161169 - DNA, 20 bp, Homo sapiens
aaattttgtttataagaaat

SEQ ID NO: 2161170 - DNA, 12 bp, Homo sapiens
aacaaagacaat

SEQ ID NO: 2161171 - DNA, 14 bp, Homo sapiens
aacacatttcaaat

SEQ ID NO: 2161172 - DNA, 16 bp, Homo sapiens
aacacatttcaaatga

SEQ ID NO: 2161173 - DNA, 21 bp, Homo sapiens
aacacatttcaaatgagtttt

SEQ ID NO: 2161174 - DNA, 23 bp, Homo sapiens
aacactctacttgaagcaacttg

SEQ ID NO: 2161175 - DNA, 17 bp, Homo sapiens
aacagttcctttcaaag

SEQ ID NO: 2161176 - DNA, 22 bp, Homo sapiens
aacttggtccagattgaaaagt

SEQ ID NO: 2161177 - DNA, 13 bp, Homo sapiens
aagaaaacccgag

SEQ ID NO: 2161178 - DNA, 17 bp, Homo sapiens
aagaaactatacatcat

SEQ ID NO: 2161179 - DNA, 14 bp, Homo sapiens
aagaagatgagcct

SEQ ID NO: 2161180 - DNA, 19 bp, Homo sapiens
aagaagtgtgtcaccctta

SEQ ID NO: 2161181 - DNA, 23 bp, Homo sapiens
aagaatgtccaatggtaggaatt

SEQ ID NO: 2161182 - DNA, 13 bp, Homo sapiens
aagaatgtttctg

SEQ ID NO: 2161183 - DNA, 15 bp, Homo sapiens
aagaatgtttctgga

SEQ ID NO: 2161184 - DNA, 18 bp, Homo sapiens
aagacattcttatatttc

SEQ ID NO: 2161185 - DNA, 22 bp, Homo sapiens
aagacattcttatatttcatat

SEQ ID NO: 2161186 - DNA, 18 bp, Homo sapiens
aagagaagggcagggctg

SEQ ID NO: 2161187 - DNA, 13 bp, Homo sapiens
aagatgacacaag

SEQ ID NO: 2161188 - DNA, 19 bp, Homo sapiens
aagcagagattttcaacat

SEQ ID NO: 2161189 - DNA, 14 bp, Homo sapiens
aagccaatttcaat

SEQ ID NO: 2161190 - DNA, 12 bp, Homo sapiens
aaggctgcccct

SEQ ID NO: 2161191 - DNA, 21 bp, Homo sapiens
aagtcactggccagtggctgg

SEQ ID NO: 2161192 - DNA, 20 bp, Homo sapiens
aagtgtgggtctgtgtgtgt

SEQ ID NO: 2161193 - DNA, 14 bp, Homo sapiens
aataaaagagcttt

SEQ ID NO: 2161194 - DNA, 18 bp, Homo sapiens
aataaaagagctttatcc

SEQ ID NO: 2161195 - DNA, 19 bp, Homo sapiens
aataaaagagctttatccc

SEQ ID NO: 2161196 - DNA, 21 bp, Homo sapiens
aataccctagaagaaaacccg

SEQ ID NO: 2161197 - DNA, 14 bp, Homo sapiens
aatactcatgtgca

SEQ ID NO: 2161198 - DNA, 12 bp, Homo sapiens
aatagaaaagtc

SEQ ID NO: 2161199 - DNA, 14 bp, Homo sapiens
aatgaaatacacaa

SEQ ID NO: 2161200 - DNA, 12 bp, Homo sapiens
aatgattatttt

SEQ ID NO: 2161201 - DNA, 22 bp, Homo sapiens
aatgcatacaataaaagagctt

SEQ ID NO: 2161202 - DNA, 20 bp, Homo sapiens
aatggttaatttttcctgca

SEQ ID NO: 2161203 - DNA, 22 bp, Homo sapiens
aatgtattttcatagatgtgtt

SEQ ID NO: 2161204 - DNA, 22 bp, Homo sapiens
aatgtcagtatgtggaagtgtg

SEQ ID NO: 2161205 - DNA, 16 bp, Homo sapiens
aatgtgtgtcaattta

SEQ ID NO: 2161206 - DNA, 20 bp, Homo sapiens
aattaagaaatactcatgtg

SEQ ID NO: 2161207 - DNA, 18 bp, Homo sapiens
aattaagggccgatttaa

SEQ ID NO: 2161208 - DNA, 22 bp, Homo sapiens
aattacattactgaaaacttca

SEQ ID NO: 2161209 - DNA, 21 bp, Homo sapiens
aattatggaaaaaaaatattc

SEQ ID NO: 2161210 - DNA, 11 bp, Homo sapiens
aattgtgatgt

SEQ ID NO: 2161211 - DNA, 20 bp, Homo sapiens
aatttttcctgcatgttctg

SEQ ID NO: 2161212 - DNA, 17 bp, Homo sapiens
acaacttttccctcact

SEQ ID NO: 2161213 - DNA, 16 bp, Homo sapiens
acaataaaagagcttt

SEQ ID NO: 2161214 - DNA, 17 bp, Homo sapiens
acaattgaagtcaatta

SEQ ID NO: 2161215 - DNA, 14 bp, Homo sapiens
acacaaggacagaa

SEQ ID NO: 2161216 - DNA, 14 bp, Homo sapiens
acacaagtaaacat

SEQ ID NO: 2161217 - DNA, 15 bp, Homo sapiens
acacatttcaaatga

SEQ ID NO: 2161218 - DNA, 21 bp, Homo sapiens
acagacactcccacttggcat

SEQ ID NO: 2161219 - DNA, 17 bp, Homo sapiens
acagcaacactctactt

SEQ ID NO: 2161220 - DNA, 19 bp, Homo sapiens
acagcagattccacaggac

SEQ ID NO: 2161221 - DNA, 17 bp, Homo sapiens
acaggacacgaaggctg

SEQ ID NO: 2161222 - DNA, 19 bp, Homo sapiens
acaggataaagatatcaat

SEQ ID NO: 2161223 - DNA, 14 bp, Homo sapiens
acagtccctcacct

SEQ ID NO: 2161224 - DNA, 17 bp, Homo sapiens
acatgcaccctggactt

SEQ ID NO: 2161225 - DNA, 21 bp, Homo sapiens
acatgcccatcccagtgtcct

SEQ ID NO: 2161226 - DNA, 17 bp, Homo sapiens
accacagtccctcacct

SEQ ID NO: 2161227 - DNA, 14 bp, Homo sapiens
accatctctttacc

SEQ ID NO: 2161228 - DNA, 17 bp, Homo sapiens
accatgacgcaaagaga

SEQ ID NO: 2161229 - DNA, 23 bp, Homo sapiens
acccaccgtcctgtcagctcctt

SEQ ID NO: 2161230 - DNA, 24 bp, Homo sapiens
acccctacccccaaccctcagaca

SEQ ID NO: 2161231 - DNA, 18 bp, Homo sapiens
accctagaagaaaacccg

SEQ ID NO: 2161232 - DNA, 15 bp, Homo sapiens
accctgtcctagaga

SEQ ID NO: 2161233 - DNA, 13 bp, Homo sapiens
acctaaaacttaa

SEQ ID NO: 2161234 - DNA, 15 bp, Homo sapiens
acctgcaaaaaatag

SEQ ID NO: 2161235 - DNA, 15 bp, Homo sapiens
acgaaggctgcccct

SEQ ID NO: 2161236 - DNA, 17 bp, Homo sapiens
acgaaggctgcccctgt

SEQ ID NO: 2161237 - DNA, 17 bp, Homo sapiens
acgcaaagagagatttt

SEQ ID NO: 2161238 - DNA, 21 bp, Homo sapiens
actcatgtgcaataggtgaga

SEQ ID NO: 2161239 - DNA, 14 bp, Homo sapiens
actccctttcagtg

SEQ ID NO: 2161240 - DNA, 16 bp, Homo sapiens
actgatgtccctcctt

SEQ ID NO: 2161241 - DNA, 20 bp, Homo sapiens
acttctctaatagaaaagtc

SEQ ID NO: 2161242 - DNA, 21 bp, Homo sapiens
acttggtccagattgaaaagt

SEQ ID NO: 2161243 - DNA, 19 bp, Homo sapiens
agaaaaatgtgtattttaa

SEQ ID NO: 2161244 - DNA, 14 bp, Homo sapiens
agaaagcagagatt

SEQ ID NO: 2161245 - DNA, 11 bp, Homo sapiens
agaagaaaacc

SEQ ID NO: 2161246 - DNA, 17 bp, Homo sapiens
agaatgtattttcatag

SEQ ID NO: 2161247 - DNA, 23 bp, Homo sapiens
agaatgtattttcatagatgtgt

SEQ ID NO: 2161248 - DNA, 17 bp, Homo sapiens
agaatgtcaatatttga

SEQ ID NO: 2161249 - DNA, 15 bp, Homo sapiens
agaatgtcagtatgt

SEQ ID NO: 2161250 - DNA, 16 bp, Homo sapiens
agaatgtcagtatgtg

SEQ ID NO: 2161251 - DNA, 21 bp, Homo sapiens
agacatttgctatgagctggg

SEQ ID NO: 2161252 - DNA, 14 bp, Homo sapiens
agacttatcaacat

SEQ ID NO: 2161253 - DNA, 16 bp, Homo sapiens
agagaaaactaaagaa

SEQ ID NO: 2161254 - DNA, 18 bp, Homo sapiens
agagaatgtattttcata

SEQ ID NO: 2161255 - DNA, 15 bp, Homo sapiens
agagattttcaacat

SEQ ID NO: 2161256 - DNA, 21 bp, Homo sapiens
agagattttcaacatttcaaa

SEQ ID NO: 2161257 - DNA, 17 bp, Homo sapiens
agagatttttttttaaa

SEQ ID NO: 2161258 - DNA, 21 bp, Homo sapiens
agagatttttttttaaagaag

SEQ ID NO: 2161259 - DNA, 19 bp, Homo sapiens
agagtggggtaggttggga

SEQ ID NO: 2161260 - DNA, 14 bp, Homo sapiens
agatatctgcatgt

SEQ ID NO: 2161261 - DNA, 13 bp, Homo sapiens
agattgaaaagtg

SEQ ID NO: 2161262 - DNA, 14 bp, Homo sapiens
agattgaaaagtgt

SEQ ID NO: 2161263 - DNA, 17 bp, Homo sapiens
agattgaaaagtgtcct

SEQ ID NO: 2161264 - DNA, 23 bp, Homo sapiens
agcagaatcctcagttggaatca

SEQ ID NO: 2161265 - DNA, 17 bp, Homo sapiens
agcagattccacaggac

SEQ ID NO: 2161266 - DNA, 22 bp, Homo sapiens
agcagtaggatattggcatttg

SEQ ID NO: 2161267 - DNA, 17 bp, Homo sapiens
agctccttgacctatga

SEQ ID NO: 2161268 - DNA, 14 bp, Homo sapiens
agctgcctgtgcct

SEQ ID NO: 2161269 - DNA, 22 bp, Homo sapiens
aggaactgctgggcttggcagc

SEQ ID NO: 2161270 - DNA, 12 bp, Homo sapiens
aggacagtattt

SEQ ID NO: 2161271 - DNA, 19 bp, Homo sapiens
aggacagtatttgtgggga

SEQ ID NO: 2161272 - DNA, 14 bp, Homo sapiens
aggagaatgaatca

SEQ ID NO: 2161273 - DNA, 14 bp, Homo sapiens
aggatattggcatt

SEQ ID NO: 2161274 - DNA, 19 bp, Homo sapiens
aggcaacagtttgacattt

SEQ ID NO: 2161275 - DNA, 17 bp, Homo sapiens
aggcctaaaagtaaaca

SEQ ID NO: 2161276 - DNA, 19 bp, Homo sapiens
aggctatggggatagatgt

SEQ ID NO: 2161277 - DNA, 23 bp, Homo sapiens
aggttgggagaatgtcagtatgt

SEQ ID NO: 2161278 - DNA, 12 bp, Homo sapiens
aggtttcaatgc

SEQ ID NO: 2161279 - DNA, 14 bp, Homo sapiens
agtatttgtgggga

SEQ ID NO: 2161280 - DNA, 17 bp, Homo sapiens
agtcaattactctataa

SEQ ID NO: 2161281 - DNA, 21 bp, Homo sapiens
agtcaattactctataataca

SEQ ID NO: 2161282 - DNA, 16 bp, Homo sapiens
agtgtgggtctgtgtg

SEQ ID NO: 2161283 - DNA, 19 bp, Homo sapiens
agtgtgggtctgtgtgtgt

SEQ ID NO: 2161284 - DNA, 14 bp, Homo sapiens
agttttactcctca

SEQ ID NO: 2161285 - DNA, 17 bp, Homo sapiens
ataaggtttaaaaagat

SEQ ID NO: 2161286 - DNA, 13 bp, Homo sapiens
atacaataaaaga

SEQ ID NO: 2161287 - DNA, 14 bp, Homo sapiens
atacaataaaagag

SEQ ID NO: 2161288 - DNA, 17 bp, Homo sapiens
atacaataaaagagctt

SEQ ID NO: 2161289 - DNA, 18 bp, Homo sapiens
atacaataaaagagcttt

SEQ ID NO: 2161290 - DNA, 20 bp, Homo sapiens
atacaataaaagagctttat

SEQ ID NO: 2161291 - DNA, 11 bp, Homo sapiens
ataccctagaa

SEQ ID NO: 2161292 - DNA, 20 bp, Homo sapiens
ataccctagaagaaaacccg

SEQ ID NO: 2161293 - DNA, 16 bp, Homo sapiens
atacctccattaaatg

SEQ ID NO: 2161294 - DNA, 21 bp, Homo sapiens
atagaaaagtctccaccccta

SEQ ID NO: 2161295 - DNA, 11 bp, Homo sapiens
atagatgtgtg

SEQ ID NO: 2161296 - DNA, 12 bp, Homo sapiens
atagatgtgtgg

SEQ ID NO: 2161297 - DNA, 14 bp, Homo sapiens
atagatgtgtggac

SEQ ID NO: 2161298 - DNA, 21 bp, Homo sapiens
ataggggatttttttgatgtg

SEQ ID NO: 2161299 - DNA, 22 bp, Homo sapiens
atatatttcacgtgttccctct

SEQ ID NO: 2161300 - DNA, 13 bp, Homo sapiens
atcaggccattgt

SEQ ID NO: 2161301 - DNA, 16 bp, Homo sapiens
atcaggccattgtccc

SEQ ID NO: 2161302 - DNA, 19 bp, Homo sapiens
atccatagcacctccacat

SEQ ID NO: 2161303 - DNA, 13 bp, Homo sapiens
atcccagtgtcct

SEQ ID NO: 2161304 - DNA, 11 bp, Homo sapiens
atctgcatgtg

SEQ ID NO: 2161305 - DNA, 23 bp, Homo sapiens
atgaaactagaaagcagagattt

SEQ ID NO: 2161306 - DNA, 22 bp, Homo sapiens
atgagccttgcagatatctgca

SEQ ID NO: 2161307 - DNA, 23 bp, Homo sapiens
atgagctcagcctcgctttgagg

SEQ ID NO: 2161308 - DNA, 19 bp, Homo sapiens
atgcagaacacatttcaaa

SEQ ID NO: 2161309 - DNA, 15 bp, Homo sapiens
atgcatacaataaaa

SEQ ID NO: 2161310 - DNA, 21 bp, Homo sapiens
atgcatacaataaaagagctt

SEQ ID NO: 2161311 - DNA, 19 bp, Homo sapiens
atgctgcacagatggattt

SEQ ID NO: 2161312 - DNA, 20 bp, Homo sapiens
atggggatagatgtgtggac

SEQ ID NO: 2161313 - DNA, 15 bp, Homo sapiens
atgtggaagtgtggg

SEQ ID NO: 2161314 - DNA, 17 bp, Homo sapiens
atgtgggggtctgtgtg

SEQ ID NO: 2161315 - DNA, 15 bp, Homo sapiens
atgtttacagaggac

SEQ ID NO: 2161316 - DNA, 21 bp, Homo sapiens
atgttttaaacatagaaagtt

SEQ ID NO: 2161317 - DNA, 12 bp, Homo sapiens
attaagaatctc

SEQ ID NO: 2161318 - DNA, 21 bp, Homo sapiens
attacattactgaaaacttca

SEQ ID NO: 2161319 - DNA, 22 bp, Homo sapiens
attacattactgaaaacttcat

SEQ ID NO: 2161320 - DNA, 12 bp, Homo sapiens
attcacaaaaat

SEQ ID NO: 2161321 - DNA, 21 bp, Homo sapiens
attccaataccctagaagaaa

SEQ ID NO: 2161322 - DNA, 12 bp, Homo sapiens
attccagaggaa

SEQ ID NO: 2161323 - DNA, 23 bp, Homo sapiens
attgcaggagtccctgccatcat

SEQ ID NO: 2161324 - DNA, 13 bp, Homo sapiens
attgtgatgtgtc

SEQ ID NO: 2161325 - DNA, 19 bp, Homo sapiens
attgtttctttaagaaagt

SEQ ID NO: 2161326 - DNA, 20 bp, Homo sapiens
attgtttctttaagaaagta

SEQ ID NO: 2161327 - DNA, 21 bp, Homo sapiens
atttcatttccaactcaggtt

SEQ ID NO: 2161328 - DNA, 23 bp, Homo sapiens
atttcatttccaactcaggttaa

SEQ ID NO: 2161329 - DNA, 21 bp, Homo sapiens
attttcaacatttcaaaatga

SEQ ID NO: 2161330 - DNA, 16 bp, Homo sapiens
attttcatagatgtgt

SEQ ID NO: 2161331 - DNA, 14 bp, Homo sapiens
attttctaaaaaag

SEQ ID NO: 2161332 - DNA, 16 bp, Homo sapiens
attttctggtaaaaag

SEQ ID NO: 2161333 - DNA, 17 bp, Homo sapiens
attttctggtaaaaaga

SEQ ID NO: 2161334 - DNA, 18 bp, Homo sapiens
attttgggcctgttcctt

SEQ ID NO: 2161335 - DNA, 17 bp, Homo sapiens
gtgttattacttcctca

SEQ ID NO: 2161336 - DNA, 19 bp, Homo sapiens
gttaatttttcctgcatgt

SEQ ID NO: 2161337 - DNA, 12 bp, Homo sapiens
gttgtgtgtggg

SEQ ID NO: 2161338 - DNA, 16 bp, Homo sapiens
gttgtgtgtgggagtg

SEQ ID NO: 2161339 - DNA, 22 bp, Homo sapiens
gttgtgtgtgggagtgtgtaat

SEQ ID NO: 2161340 - DNA, 22 bp, Homo sapiens
taaaaaagtttagaatgtgtgt

SEQ ID NO: 2161341 - DNA, 18 bp, Homo sapiens
taaaaagaaaaatgtgta

SEQ ID NO: 2161342 - DNA, 22 bp, Homo sapiens
taaaaatatgctaattctcaga

SEQ ID NO: 2161343 - DNA, 17 bp, Homo sapiens
taaaagaacagtaaaca

SEQ ID NO: 2161344 - DNA, 11 bp, Homo sapiens
taaaagagctt

SEQ ID NO: 2161345 - DNA, 16 bp, Homo sapiens
taaaattgtgatgtgt

SEQ ID NO: 2161346 - DNA, 19 bp, Homo sapiens
taaaggcttaaatcaaaag

SEQ ID NO: 2161347 - DNA, 15 bp, Homo sapiens
taagaaatactcatg

SEQ ID NO: 2161348 - DNA, 22 bp, Homo sapiens
taagaacaaagagaaaaaatac

SEQ ID NO: 2161349 - DNA, 16 bp, Homo sapiens
taagggtgacaaatgg

SEQ ID NO: 2161350 - DNA, 16 bp, Homo sapiens
taagttaataaataag

SEQ ID NO: 2161351 - DNA, 22 bp, Homo sapiens
taatagaaaagtctccacccct

SEQ ID NO: 2161352 - DNA, 19 bp, Homo sapiens
taattctttgacctgttgg

SEQ ID NO: 2161353 - DNA, 16 bp, Homo sapiens
taattgagaagaaaaa

SEQ ID NO: 2161354 - DNA, 13 bp, Homo sapiens
tacaataaaagag

SEQ ID NO: 2161355 - DNA, 15 bp, Homo sapiens
tacaataaaagagct

SEQ ID NO: 2161356 - DNA, 18 bp, Homo sapiens
tacaataaaagagcttta

SEQ ID NO: 2161357 - DNA, 21 bp, Homo sapiens
tacacaaggacagaaccctcc

SEQ ID NO: 2161358 - DNA, 15 bp, Homo sapiens
tacacaagtaaacat

SEQ ID NO: 2161359 - DNA, 18 bp, Homo sapiens
tacagaggacagtatttg

SEQ ID NO: 2161360 - DNA, 13 bp, Homo sapiens
tacctcttggctg

SEQ ID NO: 2161361 - DNA, 19 bp, Homo sapiens
tacctttctccttcccaaa

SEQ ID NO: 2161362 - DNA, 21 bp, Homo sapiens
tactagccccccagtggtgaa

SEQ ID NO: 2161363 - DNA, 19 bp, Homo sapiens
tactttgaaaccagaaaat

SEQ ID NO: 2161364 - DNA, 14 bp, Homo sapiens
tagaaaagtctcca

SEQ ID NO: 2161365 - DNA, 23 bp, Homo sapiens
tagcataaacacatcacagatga

SEQ ID NO: 2161366 - DNA, 18 bp, Homo sapiens
tagcattccttaatgttt

SEQ ID NO: 2161367 - DNA, 17 bp, Homo sapiens
taggatattggcatttg

SEQ ID NO: 2161368 - DNA, 18 bp, Homo sapiens
tagttaaaggcttaaatc

SEQ ID NO: 2161369 - DNA, 12 bp, Homo sapiens
tatctgcatgtg

SEQ ID NO: 2161370 - DNA, 22 bp, Homo sapiens
tatctgcatgtgtcatgaagaa

SEQ ID NO: 2161371 - DNA, 18 bp, Homo sapiens
tatgcagaacacatttca

SEQ ID NO: 2161372 - DNA, 20 bp, Homo sapiens
tatgcagaacacatttcaaa

SEQ ID NO: 2161373 - DNA, 20 bp, Homo sapiens
tatgtgggggtctgtgtgtt

SEQ ID NO: 2161374 - DNA, 11 bp, Homo sapiens
tatgtgtgtgt

SEQ ID NO: 2161375 - DNA, 23 bp, Homo sapiens
tatgtgtgtgtgttgtgtgtggg

SEQ ID NO: 2161376 - DNA, 20 bp, Homo sapiens
tatttcacagcaacactcta

SEQ ID NO: 2161377 - DNA, 12 bp, Homo sapiens
tcaaaagaatgt

SEQ ID NO: 2161378 - DNA, 15 bp, Homo sapiens
tcaattactctataa

SEQ ID NO: 2161379 - DNA, 15 bp, Homo sapiens
tcaatttaaataacc

SEQ ID NO: 2161380 - DNA, 14 bp, Homo sapiens
tcacagcaacactc

SEQ ID NO: 2161381 - DNA, 17 bp, Homo sapiens
tcacagcaacactctac

SEQ ID NO: 2161382 - DNA, 23 bp, Homo sapiens
tcacagcaagtcactggccagtg

SEQ ID NO: 2161383 - DNA, 19 bp, Homo sapiens
tcacctccggcctccacat

SEQ ID NO: 2161384 - DNA, 21 bp, Homo sapiens
tcacctccggcctccacatga

SEQ ID NO: 2161385 - DNA, 12 bp, Homo sapiens
tcagaagaaaga

SEQ ID NO: 2161386 - DNA, 21 bp, Homo sapiens
tcagacagacttatacacccc

SEQ ID NO: 2161387 - DNA, 23 bp, Homo sapiens
tcagacagacttatacacccctg

SEQ ID NO: 2161388 - DNA, 16 bp, Homo sapiens
tcagtatgtggaagtg

SEQ ID NO: 2161389 - DNA, 21 bp, Homo sapiens
tcagttcatatttcatttcca

SEQ ID NO: 2161390 - DNA, 19 bp, Homo sapiens
tcagttggaatcattgcta

SEQ ID NO: 2161391 - DNA, 16 bp, Homo sapiens
tcatctaaaagaaaaa

SEQ ID NO: 2161392 - DNA, 22 bp, Homo sapiens
tcatctaatgtattatgagcca

SEQ ID NO: 2161393 - DNA, 17 bp, Homo sapiens
tcatgtttacagaggac

SEQ ID NO: 2161394 - DNA, 23 bp, Homo sapiens
tccaaaatttgaaatattaaaat

SEQ ID NO: 2161395 - DNA, 22 bp, Homo sapiens
tccaataccctagaagaaaacc

SEQ ID NO: 2161396 - DNA, 12 bp, Homo sapiens
tccacccctaca

SEQ ID NO: 2161397 - DNA, 12 bp, Homo sapiens
tccacccctacc

SEQ ID NO: 2161398 - DNA, 17 bp, Homo sapiens
tccagattgaaaagtgt

SEQ ID NO: 2161399 - DNA, 23 bp, Homo sapiens
tcccaccacagtccctcacctcc

SEQ ID NO: 2161400 - DNA, 15 bp, Homo sapiens
tcctatagttttact

SEQ ID NO: 2161401 - DNA, 17 bp, Homo sapiens
tcctcaccatcatcatc

SEQ ID NO: 2161402 - DNA, 17 bp, Homo sapiens
tcctcagttcctcacca

SEQ ID NO: 2161403 - DNA, 11 bp, Homo sapiens
tcctgcatgtt

SEQ ID NO: 2161404 - DNA, 15 bp, Homo sapiens
tctaatagaaaagtc

SEQ ID NO: 2161405 - DNA, 13 bp, Homo sapiens
tctataaataacc

SEQ ID NO: 2161406 - DNA, 14 bp, Homo sapiens
tctccacccctaca

SEQ ID NO: 2161407 - DNA, 11 bp, Homo sapiens
tctgtgtgtgt

SEQ ID NO: 2161408 - DNA, 22 bp, Homo sapiens
tctgtgtgtgtgtatgtggggg

SEQ ID NO: 2161409 - DNA, 15 bp, Homo sapiens
tctgtgtgtttatgt

SEQ ID NO: 2161410 - DNA, 23 bp, Homo sapiens
tcttctgcatttttcagagaata

SEQ ID NO: 2161411 - DNA, 20 bp, Homo sapiens
tctttagccccactgcttgc

SEQ ID NO: 2161412 - DNA, 13 bp, Homo sapiens
tgaaaagtgtcct

SEQ ID NO: 2161413 - DNA, 20 bp, Homo sapiens
tgaagagaagggcagggctg

SEQ ID NO: 2161414 - DNA, 22 bp, Homo sapiens
tgaagagaagggcagggctgag

SEQ ID NO: 2161415 - DNA, 18 bp, Homo sapiens
tgactgaagaagatgagc

SEQ ID NO: 2161416 - DNA, 23 bp, Homo sapiens
tgagccttgcagatatctgcatg

SEQ ID NO: 2161417 - DNA, 14 bp, Homo sapiens
tgagttgcaccctt

SEQ ID NO: 2161418 - DNA, 24 bp, Homo sapiens
tgataagcagtcatcctcagatca

SEQ ID NO: 2161419 - DNA, 20 bp, Homo sapiens
tgatgtccctccttttcacg

SEQ ID NO: 2161420 - DNA, 15 bp, Homo sapiens
tgcacctaaaactta

SEQ ID NO: 2161421 - DNA, 14 bp, Homo sapiens
tgcagaacacattt

SEQ ID NO: 2161422 - DNA, 18 bp, Homo sapiens
tgcagatatctgcatgtg

SEQ ID NO: 2161423 - DNA, 14 bp, Homo sapiens
tgcatacaataaaa

SEQ ID NO: 2161424 - DNA, 15 bp, Homo sapiens
tgcatacaataaaag

SEQ ID NO: 2161425 - DNA, 20 bp, Homo sapiens
tgcatacaataaaagagctt

SEQ ID NO: 2161426 - DNA, 21 bp, Homo sapiens
tgcatacaataaaagagcttt

SEQ ID NO: 2161427 - DNA, 22 bp, Homo sapiens
tgcatacaataaaagagcttta

SEQ ID NO: 2161428 - DNA, 21 bp, Homo sapiens
tgcattatatttgtaaattta

SEQ ID NO: 2161429 - DNA, 19 bp, Homo sapiens
tgcccatcccagtgtccta

SEQ ID NO: 2161430 - DNA, 16 bp, Homo sapiens
tgctatgagctgggga

SEQ ID NO: 2161431 - DNA, 22 bp, Homo sapiens
tgctatgagctggggatgtctc

SEQ ID NO: 2161432 - DNA, 22 bp, Homo sapiens
tgctattgtagagccagaggtc

SEQ ID NO: 2161433 - DNA, 17 bp, Homo sapiens
tgctctgaatttcttct

SEQ ID NO: 2161434 - DNA, 17 bp, Homo sapiens
tgctttttcatcaaaac

SEQ ID NO: 2161435 - DNA, 20 bp, Homo sapiens
tggaagtgtgggtctgtgtg

SEQ ID NO: 2161436 - DNA, 20 bp, Homo sapiens
tggaatgatgggtcagttgt

SEQ ID NO: 2161437 - DNA, 18 bp, Homo sapiens
tggcaatttattttaaga

SEQ ID NO: 2161438 - DNA, 20 bp, Homo sapiens
tggccttatgagctcagcct

SEQ ID NO: 2161439 - DNA, 20 bp, Homo sapiens
tggctccattggtgttgaca

SEQ ID NO: 2161440 - DNA, 23 bp, Homo sapiens
tgggaataagtgccaggatggaa

SEQ ID NO: 2161441 - DNA, 22 bp, Homo sapiens
tgggagaatgtcagtatgtgga

SEQ ID NO: 2161442 - DNA, 21 bp, Homo sapiens
tgggagtgaggatgtctgggc

SEQ ID NO: 2161443 - DNA, 13 bp, Homo sapiens
tgggagtgtgtaa

SEQ ID NO: 2161444 - DNA, 18 bp, Homo sapiens
tggggatagatgtgtgga

SEQ ID NO: 2161445 - DNA, 17 bp, Homo sapiens
cactcaaccatgacctc

SEQ ID NO: 2161446 - DNA, 20 bp, Homo sapiens
cagaaccaatttacactcaa

SEQ ID NO: 2161447 - DNA, 16 bp, Homo sapiens
cagagctatcattatg

SEQ ID NO: 2161448 - DNA, 22 bp, Homo sapiens
cagaggacagtatttgtgggga

SEQ ID NO: 2161449 - DNA, 14 bp, Homo sapiens
cagattccacagga

SEQ ID NO: 2161450 - DNA, 15 bp, Homo sapiens
cagattccacaggac

SEQ ID NO: 2161451 - DNA, 14 bp, Homo sapiens
cagattgaaaagtg

SEQ ID NO: 2161452 - DNA, 22 bp, Homo sapiens
cagcagattccacaggacacga

SEQ ID NO: 2161453 - DNA, 13 bp, Homo sapiens
cagcccctcccag

SEQ ID NO: 2161454 - DNA, 16 bp, Homo sapiens
cagcccctcccagata

SEQ ID NO: 2161455 - DNA, 21 bp, Homo sapiens
caggagtccctgccatcatgt

SEQ ID NO: 2161456 - DNA, 16 bp, Homo sapiens
cagggctgaggcctct

SEQ ID NO: 2161457 - DNA, 16 bp, Homo sapiens
cagtatctcaaacaat

SEQ ID NO: 2161458 - DNA, 15 bp, Homo sapiens
cagtatttgtgggga

SEQ ID NO: 2161459 - DNA, 17 bp, Homo sapiens
cagtttaatattccaat

SEQ ID NO: 2161460 - DNA, 19 bp, Homo sapiens
cagtttaatattccaatac

SEQ ID NO: 2161461 - DNA, 20 bp, Homo sapiens
cataaacacatcacagatga

SEQ ID NO: 2161462 - DNA, 13 bp, Homo sapiens
catacaataaaag

SEQ ID NO: 2161463 - DNA, 14 bp, Homo sapiens
catacaataaaaga

SEQ ID NO: 2161464 - DNA, 22 bp, Homo sapiens
catacaataaaagagctttatc

SEQ ID NO: 2161465 - DNA, 21 bp, Homo sapiens
catagcatagctagagattgg

SEQ ID NO: 2161466 - DNA, 21 bp, Homo sapiens
catcatgcttacaaaaaagaa

SEQ ID NO: 2161467 - DNA, 19 bp, Homo sapiens
catcatgtttacagaggac

SEQ ID NO: 2161468 - DNA, 21 bp, Homo sapiens
catcatgtttacagaggacag

SEQ ID NO: 2161469 - DNA, 12 bp, Homo sapiens
catgaagaatgt

SEQ ID NO: 2161470 - DNA, 18 bp, Homo sapiens
catgacctcacccctcct

SEQ ID NO: 2161471 - DNA, 19 bp, Homo sapiens
catgacctcacccctcctt

SEQ ID NO: 2161472 - DNA, 20 bp, Homo sapiens
catgacgcaaagagagattt

SEQ ID NO: 2161473 - DNA, 21 bp, Homo sapiens
catgcccatcccagtgtccta

SEQ ID NO: 2161474 - DNA, 17 bp, Homo sapiens
cattactgaaaacttca

SEQ ID NO: 2161475 - DNA, 14 bp, Homo sapiens
cattccagaggaag

SEQ ID NO: 2161476 - DNA, 18 bp, Homo sapiens
catttccaactcaggtta

SEQ ID NO: 2161477 - DNA, 14 bp, Homo sapiens
ccaacaacttttcc

SEQ ID NO: 2161478 - DNA, 15 bp, Homo sapiens
ccaacaacttttccc

SEQ ID NO: 2161479 - DNA, 15 bp, Homo sapiens
ccaagagaaacttcc

SEQ ID NO: 2161480 - DNA, 14 bp, Homo sapiens
ccaataccctagaa

SEQ ID NO: 2161481 - DNA, 20 bp, Homo sapiens
ccaatactagccccccagtg

SEQ ID NO: 2161482 - DNA, 23 bp, Homo sapiens
ccaatgaaatacacaagtaaaca

SEQ ID NO: 2161483 - DNA, 14 bp, Homo sapiens
ccacagtccctcac

SEQ ID NO: 2161484 - DNA, 17 bp, Homo sapiens
ccacagtccctcacctc

SEQ ID NO: 2161485 - DNA, 12 bp, Homo sapiens
ccagattgaaaa

SEQ ID NO: 2161486 - DNA, 22 bp, Homo sapiens
ccatcatgtttacagaggacag

SEQ ID NO: 2161487 - DNA, 16 bp, Homo sapiens
ccatcccagtgtccta

SEQ ID NO: 2161488 - DNA, 16 bp, Homo sapiens
ccattataatattcat

SEQ ID NO: 2161489 - DNA, 13 bp, Homo sapiens
ccattggtgttga

SEQ ID NO: 2161490 - DNA, 23 bp, Homo sapiens
cccaaaatacttgcatccaaggt

SEQ ID NO: 2161491 - DNA, 23 bp, Homo sapiens
cccagacccagcccagcctgagc

SEQ ID NO: 2161492 - DNA, 21 bp, Homo sapiens
cccagctatggttctctcgca

SEQ ID NO: 2161493 - DNA, 22 bp, Homo sapiens
ccctacacaaggacagaaccct

SEQ ID NO: 2161494 - DNA, 22 bp, Homo sapiens
ccctagaagaaaacccgaggga

SEQ ID NO: 2161495 - DNA, 20 bp, Homo sapiens
ccctgccatcatgtttacag

SEQ ID NO: 2161496 - DNA, 22 bp, Homo sapiens
ccgggtcatctgtacctctgcc

SEQ ID NO: 2161497 - DNA, 23 bp, Homo sapiens
cctatagttttactcctcagttc

SEQ ID NO: 2161498 - DNA, 15 bp, Homo sapiens
cctcagttggaatca

SEQ ID NO: 2161499 - DNA, 16 bp, Homo sapiens
cctccggcctccacat

SEQ ID NO: 2161500 - DNA, 18 bp, Homo sapiens
cctctcattccagaggaa

SEQ ID NO: 2161501 - DNA, 19 bp, Homo sapiens
cctgaagagaagggcaggg

SEQ ID NO: 2161502 - DNA, 14 bp, Homo sapiens
cctgactctcagca

SEQ ID NO: 2161503 - DNA, 19 bp, Homo sapiens
cctgaggaagagggactgt

SEQ ID NO: 2161504 - DNA, 21 bp, Homo sapiens
cctgagtagctgggattacag

SEQ ID NO: 2161505 - DNA, 15 bp, Homo sapiens
cctgagtgaggatta

SEQ ID NO: 2161506 - DNA, 10 bp, Homo sapiens
cctgcatgtt

SEQ ID NO: 2161507 - DNA, 18 bp, Homo sapiens
cctgccatcatgtttaca

SEQ ID NO: 2161508 - DNA, 16 bp, Homo sapiens
cctgtcagctccttga

SEQ ID NO: 2161509 - DNA, 18 bp, Homo sapiens
ccttatgagctcagcctc

SEQ ID NO: 2161510 - DNA, 22 bp, Homo sapiens
ccttatgagctcagcctcgctt

SEQ ID NO: 2161511 - DNA, 21 bp, Homo sapiens
cgattgcaggagtccctgcca

SEQ ID NO: 2161512 - DNA, 23 bp, Homo sapiens
cgattgcaggagtccctgccatc

SEQ ID NO: 2161513 - DNA, 14 bp, Homo sapiens
cggcctccacatga

SEQ ID NO: 2161514 - DNA, 21 bp, Homo sapiens
ctaattctttgacctgttggg

SEQ ID NO: 2161515 - DNA, 14 bp, Homo sapiens
ctacccccaaccct

SEQ ID NO: 2161516 - DNA, 15 bp, Homo sapiens
ctacccccaaccctc

SEQ ID NO: 2161517 - DNA, 17 bp, Homo sapiens
ctagaaagcagagattt

SEQ ID NO: 2161518 - DNA, 15 bp, Homo sapiens
ctatatgaaaaacaa

SEQ ID NO: 2161519 - DNA, 19 bp, Homo sapiens
ctatggggatagatgtgtg

SEQ ID NO: 2161520 - DNA, 14 bp, Homo sapiens
ctattgtagagcca

SEQ ID NO: 2161521 - DNA, 20 bp, Homo sapiens
ctcaaccatgacctcacccc

SEQ ID NO: 2161522 - DNA, 15 bp, Homo sapiens
ctcaccatcatcatc

SEQ ID NO: 2161523 - DNA, 20 bp, Homo sapiens
tggggatagatgtgtggaca

SEQ ID NO: 2161524 - DNA, 11 bp, Homo sapiens
tgggggatgta

SEQ ID NO: 2161525 - DNA, 12 bp, Homo sapiens
tggtaggaattt

SEQ ID NO: 2161526 - DNA, 15 bp, Homo sapiens
tggtatcaagaaagt

SEQ ID NO: 2161527 - DNA, 23 bp, Homo sapiens
tggtccagattgaaaagtgtcct

SEQ ID NO: 2161528 - DNA, 15 bp, Homo sapiens
tggtgaacagaacct

SEQ ID NO: 2161529 - DNA, 19 bp, Homo sapiens
tgtaaaagaacagtaaaca

SEQ ID NO: 2161530 - DNA, 19 bp, Homo sapiens
tgtaaagtaggaaaaataa

SEQ ID NO: 2161531 - DNA, 16 bp, Homo sapiens
tgtaaatttatgtgat

SEQ ID NO: 2161532 - DNA, 20 bp, Homo sapiens
tgtaatttaaaattgtgatg

SEQ ID NO: 2161533 - DNA, 21 bp, Homo sapiens
tgtaatttaaaattgtgatgt

SEQ ID NO: 2161534 - DNA, 14 bp, Homo sapiens
tgtacctctgcctc

SEQ ID NO: 2161535 - DNA, 12 bp, Homo sapiens
tgtatgtggggg

SEQ ID NO: 2161536 - DNA, 11 bp, Homo sapiens
tgtatgtgtga

SEQ ID NO: 2161537 - DNA, 14 bp, Homo sapiens
tgtattatgagcca

SEQ ID NO: 2161538 - DNA, 22 bp, Homo sapiens
tgtcagtatgtggaagtgtggg

SEQ ID NO: 2161539 - DNA, 20 bp, Homo sapiens
tgtcatgaagaatgtttctg

SEQ ID NO: 2161540 - DNA, 22 bp, Homo sapiens
tgtgactgaagaagatgagcct

SEQ ID NO: 2161541 - DNA, 20 bp, Homo sapiens
tgtgctggtctttagcccca

SEQ ID NO: 2161542 - DNA, 15 bp, Homo sapiens
tgtgggagtgtgtaa

SEQ ID NO: 2161543 - DNA, 14 bp, Homo sapiens
tgtgggtctgtgtg

SEQ ID NO: 2161544 - DNA, 20 bp, Homo sapiens
tgtgggtctgtgtgtgtgta

SEQ ID NO: 2161545 - DNA, 18 bp, Homo sapiens
tgtgtaatttaaaattgt

SEQ ID NO: 2161546 - DNA, 13 bp, Homo sapiens
tgtgtatgtgggg

SEQ ID NO: 2161547 - DNA, 21 bp, Homo sapiens
tgtgtcatgaagaatgtttct

SEQ ID NO: 2161548 - DNA, 12 bp, Homo sapiens
tgtgtgtgggag

SEQ ID NO: 2161549 - DNA, 13 bp, Homo sapiens
tgtgtgtgtgtat

SEQ ID NO: 2161550 - DNA, 15 bp, Homo sapiens
tgtgtttatgtgtgt

SEQ ID NO: 2161551 - DNA, 13 bp, Homo sapiens
tgttggaaaaaat

SEQ ID NO: 2161552 - DNA, 16 bp, Homo sapiens
tgtttagaagaagtgt

SEQ ID NO: 2161553 - DNA, 16 bp, Homo sapiens
tgtttatgtgtgtgtg

SEQ ID NO: 2161554 - DNA, 11 bp, Homo sapiens
ttaaaaaacaa

SEQ ID NO: 2161555 - DNA, 18 bp, Homo sapiens
ttaaattataccaaagat

SEQ ID NO: 2161556 - DNA, 16 bp, Homo sapiens
ttaacagtatctcaaa

SEQ ID NO: 2161557 - DNA, 22 bp, Homo sapiens
ttaacagttcctttcaaaggag

SEQ ID NO: 2161558 - DNA, 13 bp, Homo sapiens
ttcaaaatgattt

SEQ ID NO: 2161559 - DNA, 19 bp, Homo sapiens
ttcaatgcatacaataaaa

SEQ ID NO: 2161560 - DNA, 21 bp, Homo sapiens
ttcctttccaagtatttcaca

SEQ ID NO: 2161561 - DNA, 14 bp, Homo sapiens
ttctagtctctgtt

SEQ ID NO: 2161562 - DNA, 15 bp, Homo sapiens
ttgaaaagtgtcctc

SEQ ID NO: 2161563 - DNA, 14 bp, Homo sapiens
ttgaaagagatggc

SEQ ID NO: 2161564 - DNA, 20 bp, Homo sapiens
ttgctatgagctggggatgt

SEQ ID NO: 2161565 - DNA, 16 bp, Homo sapiens
ttggtatcaagaaagt

SEQ ID NO: 2161566 - DNA, 17 bp, Homo sapiens
ttggtatcaagaaagtc

SEQ ID NO: 2161567 - DNA, 19 bp, Homo sapiens
ttggtgctctgaatttctt

SEQ ID NO: 2161568 - DNA, 20 bp, Homo sapiens
ttgtaaaagaacagtaaaca

SEQ ID NO: 2161569 - DNA, 21 bp, Homo sapiens
ttgtaaaagaacagtaaacat

SEQ ID NO: 2161570 - DNA, 18 bp, Homo sapiens
ttgtccctgaagagaagg

SEQ ID NO: 2161571 - DNA, 12 bp, Homo sapiens
ttgtgatgtgtc

SEQ ID NO: 2161572 - DNA, 10 bp, Homo sapiens
ttgtgtgtgg

SEQ ID NO: 2161573 - DNA, 20 bp, Homo sapiens
tttacagaggacagtatttg

SEQ ID NO: 2161574 - DNA, 13 bp, Homo sapiens
tttatgtgtgtgt

SEQ ID NO: 2161575 - DNA, 23 bp, Homo sapiens
tttcaatgcatacaataaaagag

SEQ ID NO: 2161576 - DNA, 15 bp, Homo sapiens
tttccaagtatttca

SEQ ID NO: 2161577 - DNA, 19 bp, Homo sapiens
tttccctcactgttcccca

SEQ ID NO: 2161578 - DNA, 12 bp, Homo sapiens
tttcctgcatgt

SEQ ID NO: 2161579 - DNA, 23 bp, Homo sapiens
tttgacctgttgggagtgaggat

SEQ ID NO: 2161580 - DNA, 23 bp, Homo sapiens
tttgcccaaaatacttgcatcca

SEQ ID NO: 2161581 - DNA, 21 bp, Homo sapiens
tttgtaaaagaacagtaaaca

SEQ ID NO: 2161582 - DNA, 11 bp, Homo sapiens
tttgtggggag

SEQ ID NO: 2161583 - DNA, 20 bp, Homo sapiens
ttttactcctcagttcctca

SEQ ID NO: 2161584 - DNA, 21 bp, Homo sapiens
ttttccctcactgttccccaa

SEQ ID NO: 2161585 - DNA, 13 bp, Homo sapiens
agcagcccctccc

SEQ ID NO: 2161586 - DNA, 13 bp, Homo sapiens
agcatctcccagt

SEQ ID NO: 2161587 - DNA, 15 bp, Homo sapiens
agccccaacaacttt

SEQ ID NO: 2161588 - DNA, 23 bp, Homo sapiens
agccttgcagatatctgcatgtg

SEQ ID NO: 2161589 - DNA, 21 bp, Homo sapiens
agctcagcctcgctttgaggt

SEQ ID NO: 2161590 - DNA, 15 bp, Homo sapiens
agctggggatgtctc

SEQ ID NO: 2161591 - DNA, 21 bp, Homo sapiens
aggaaattagcattccttaat

SEQ ID NO: 2161592 - DNA, 16 bp, Homo sapiens
aggaactgctgggctt

SEQ ID NO: 2161593 - DNA, 13 bp, Homo sapiens
aggagaaaaacaa

SEQ ID NO: 2161594 - DNA, 22 bp, Homo sapiens
aggccaagtgtgataaataaac

SEQ ID NO: 2161595 - DNA, 16 bp, Homo sapiens
aggcctgactctcagc

SEQ ID NO: 2161596 - DNA, 21 bp, Homo sapiens
aggctatggggatagatgtgt

SEQ ID NO: 2161597 - DNA, 22 bp, Homo sapiens
agggatttggggctcagagtgg

SEQ ID NO: 2161598 - DNA, 19 bp, Homo sapiens
aggtaagggtgacaaatgg

SEQ ID NO: 2161599 - DNA, 21 bp, Homo sapiens
aggtgtaggtcagatatttga

SEQ ID NO: 2161600 - DNA, 13 bp, Homo sapiens
aggtttcaatgca

SEQ ID NO: 2161601 - DNA, 23 bp, Homo sapiens
aggtttgtttagaagaagtgtgt

SEQ ID NO: 2161602 - DNA, 21 bp, Homo sapiens
agtagcaattatggaaaaaaa

SEQ ID NO: 2161603 - DNA, 13 bp, Homo sapiens
agtataaaaacaa

SEQ ID NO: 2161604 - DNA, 17 bp, Homo sapiens
agtatgtggaagtgtgg

SEQ ID NO: 2161605 - DNA, 11 bp, Homo sapiens
agtctccaccc

SEQ ID NO: 2161606 - DNA, 18 bp, Homo sapiens
agtgccaggatggaatga

SEQ ID NO: 2161607 - DNA, 16 bp, Homo sapiens
agtggggtaggttggg

SEQ ID NO: 2161608 - DNA, 9 bp, Homo sapiens
agtgtgtaa

SEQ ID NO: 2161609 - DNA, 13 bp, Homo sapiens
agttcctttcaaa

SEQ ID NO: 2161610 - DNA, 23 bp, Homo sapiens
agttgcacccttccctgtggcct

SEQ ID NO: 2161611 - DNA, 19 bp, Homo sapiens
ataaaggccccaaatacca

SEQ ID NO: 2161612 - DNA, 18 bp, Homo sapiens
ataatcacaacccttcag

SEQ ID NO: 2161613 - DNA, 17 bp, Homo sapiens
ataatttgaattttatg

SEQ ID NO: 2161614 - DNA, 11 bp, Homo sapiens
atacaaagcat

SEQ ID NO: 2161615 - DNA, 15 bp, Homo sapiens
atacaataaaagagc

SEQ ID NO: 2161616 - DNA, 19 bp, Homo sapiens
ataccctagaagaaaaccc

SEQ ID NO: 2161617 - DNA, 17 bp, Homo sapiens
atacctccattaaatgg

SEQ ID NO: 2161618 - DNA, 18 bp, Homo sapiens
atacctccattaaatggt

SEQ ID NO: 2161619 - DNA, 23 bp, Homo sapiens
atattttacattcttggaaagtc

SEQ ID NO: 2161620 - DNA, 19 bp, Homo sapiens
atcaaaacctaccctgtcc

SEQ ID NO: 2161621 - DNA, 16 bp, Homo sapiens
atcaaaagaatgtcca

SEQ ID NO: 2161622 - DNA, 16 bp, Homo sapiens
atcacaacaagaaatt

SEQ ID NO: 2161623 - DNA, 14 bp, Homo sapiens
atcagcctgtgcca

SEQ ID NO: 2161624 - DNA, 18 bp, Homo sapiens
atcatgtttacagaggac

SEQ ID NO: 2161625 - DNA, 23 bp, Homo sapiens
atcatgtttacagaggacagtat

SEQ ID NO: 2161626 - DNA, 20 bp, Homo sapiens
atcattatcagcctgtgcca

SEQ ID NO: 2161627 - DNA, 23 bp, Homo sapiens
atccaagcttttttaaagtaaaa

SEQ ID NO: 2161628 - DNA, 20 bp, Homo sapiens
atccatggggctgattgtat

SEQ ID NO: 2161629 - DNA, 14 bp, Homo sapiens
atcccagtgtccta

SEQ ID NO: 2161630 - DNA, 17 bp, Homo sapiens
atcctcagttggaatca

SEQ ID NO: 2161631 - DNA, 15 bp, Homo sapiens
atctaataattattc

SEQ ID NO: 2161632 - DNA, 15 bp, Homo sapiens
atctcaaacaattga

SEQ ID NO: 2161633 - DNA, 20 bp, Homo sapiens
atctgagaggccacagtgca

SEQ ID NO: 2161634 - DNA, 19 bp, Homo sapiens
atgaaatacacaagtaaac

SEQ ID NO: 2161635 - DNA, 17 bp, Homo sapiens
atgacctcacccctcct

SEQ ID NO: 2161636 - DNA, 13 bp, Homo sapiens
atgacgcaaagag

SEQ ID NO: 2161637 - DNA, 18 bp, Homo sapiens
atgagcgtgacactcatt

SEQ ID NO: 2161638 - DNA, 20 bp, Homo sapiens
atgcatacaataaaagagct

SEQ ID NO: 2161639 - DNA, 22 bp, Homo sapiens
atgcatacaataaaagagcttt

SEQ ID NO: 2161640 - DNA, 18 bp, Homo sapiens
atgggtgtttttaataaa

SEQ ID NO: 2161641 - DNA, 22 bp, Homo sapiens
atggttaatttttcctgcatgt

SEQ ID NO: 2161642 - DNA, 14 bp, Homo sapiens
atgtcaatatttga

SEQ ID NO: 2161643 - DNA, 13 bp, Homo sapiens
atgtcagtatgtg

SEQ ID NO: 2161644 - DNA, 16 bp, Homo sapiens
atgtcagtatgtggaa

SEQ ID NO: 2161645 - DNA, 14 bp, Homo sapiens
atgtccctcctttt

SEQ ID NO: 2161646 - DNA, 16 bp, Homo sapiens
atgtggaagtgtgggt

SEQ ID NO: 2161647 - DNA, 22 bp, Homo sapiens
atgtggaagtgtgggtctgtgt

SEQ ID NO: 2161648 - DNA, 23 bp, Homo sapiens
atgtggaagtgtgggtctgtgtg

SEQ ID NO: 2161649 - DNA, 18 bp, Homo sapiens
atgtgggggtctgtgtgt

SEQ ID NO: 2161650 - DNA, 23 bp, Homo sapiens
atgtgtcatgaagaatgtttctg

SEQ ID NO: 2161651 - DNA, 22 bp, Homo sapiens
atgtgtgtgtgttgtgtgtggg

SEQ ID NO: 2161652 - DNA, 16 bp, Homo sapiens
atgttctgtgactgaa

SEQ ID NO: 2161653 - DNA, 17 bp, Homo sapiens
atgtttacagaggacag

SEQ ID NO: 2161654 - DNA, 12 bp, Homo sapiens
attaaaaaacaa

SEQ ID NO: 2161655 - DNA, 11 bp, Homo sapiens
attaagcaaat

SEQ ID NO: 2161656 - DNA, 20 bp, Homo sapiens
attaagggccgatttaatta

SEQ ID NO: 2161657 - DNA, 17 bp, Homo sapiens
attaaggtagttattca

SEQ ID NO: 2161658 - DNA, 12 bp, Homo sapiens
attattccctct

SEQ ID NO: 2161659 - DNA, 17 bp, Homo sapiens
attcatggcctggggga

SEQ ID NO: 2161660 - DNA, 14 bp, Homo sapiens
attccacaggacac

SEQ ID NO: 2161661 - DNA, 19 bp, Homo sapiens
attcctctttgcccaaaat

SEQ ID NO: 2161662 - DNA, 15 bp, Homo sapiens
attgaaaagtgtcct

SEQ ID NO: 2161663 - DNA, 17 bp, Homo sapiens
attggtatcaagaaagt

SEQ ID NO: 2161664 - DNA, 14 bp, Homo sapiens
attgtgatgtgtcc

SEQ ID NO: 2161665 - DNA, 19 bp, Homo sapiens
atttaaaattgtgatgtgt

SEQ ID NO: 2161666 - DNA, 19 bp, Homo sapiens
atttcctctgtaatctatt

SEQ ID NO: 2161667 - DNA, 17 bp, Homo sapiens
atttgatattttttaaa

SEQ ID NO: 2161668 - DNA, 19 bp, Homo sapiens
attttataggaaaaaataa

SEQ ID NO: 2161669 - DNA, 17 bp, Homo sapiens
attttcaacatttcaaa

SEQ ID NO: 2161670 - DNA, 14 bp, Homo sapiens
attttgtttataag

SEQ ID NO: 2161671 - DNA, 17 bp, Homo sapiens
atttttcagagaataga

SEQ ID NO: 2161672 - DNA, 14 bp, Homo sapiens
atttttcctgcatg

SEQ ID NO: 2161673 - DNA, 16 bp, Homo sapiens
atttttcctgcatgtt

SEQ ID NO: 2161674 - DNA, 14 bp, Homo sapiens
caaaacctaccctg

SEQ ID NO: 2161675 - DNA, 12 bp, Homo sapiens
caagaaagtcca

SEQ ID NO: 2161676 - DNA, 13 bp, Homo sapiens
caataaaagagct

SEQ ID NO: 2161677 - DNA, 16 bp, Homo sapiens
caataaaagagcttta

SEQ ID NO: 2161678 - DNA, 17 bp, Homo sapiens
caataaaagagctttat

SEQ ID NO: 2161679 - DNA, 22 bp, Homo sapiens
caatgaaatacacaagtaaaca

SEQ ID NO: 2161680 - DNA, 15 bp, Homo sapiens
caatgcatacaataa

SEQ ID NO: 2161681 - DNA, 13 bp, Homo sapiens
cacaagtaaacat

SEQ ID NO: 2161682 - DNA, 17 bp, Homo sapiens
cacaggacacgaaggct

SEQ ID NO: 2161683 - DNA, 19 bp, Homo sapiens
cacaggacacgaaggctgc

SEQ ID NO: 2161684 - DNA, 14 bp, Homo sapiens
cacagtccctcacc

SEQ ID NO: 2161685 - DNA, 21 bp, Homo sapiens
caccgtcctgtcagctccttg

SEQ ID NO: 2161686 - DNA, 20 bp, Homo sapiens
cactcaaccatgacctcacc

SEQ ID NO: 2161687 - DNA, 15 bp, Homo sapiens
cagaacctcccaaat

SEQ ID NO: 2161688 - DNA, 14 bp, Homo sapiens
cagaatcctcagtt

SEQ ID NO: 2161689 - DNA, 18 bp, Homo sapiens
cagaatgaggaataataa

SEQ ID NO: 2161690 - DNA, 17 bp, Homo sapiens
cagattccacaggacac

SEQ ID NO: 2161691 - DNA, 19 bp, Homo sapiens
cagattgaaaagtgtcctc

SEQ ID NO: 2161692 - DNA, 14 bp, Homo sapiens
cagcctgagcccca

SEQ ID NO: 2161693 - DNA, 21 bp, Homo sapiens
caggaaaaaaaaaaaaaagac

SEQ ID NO: 2161694 - DNA, 23 bp, Homo sapiens
caggacacgaaggctgcccctgt

SEQ ID NO: 2161695 - DNA, 23 bp, Homo sapiens
gaatgaggaataataagttaaac

SEQ ID NO: 2161696 - DNA, 15 bp, Homo sapiens
gacagtatttgtggg

SEQ ID NO: 2161697 - DNA, 17 bp, Homo sapiens
gacctttcctgaggaag

SEQ ID NO: 2161698 - DNA, 19 bp, Homo sapiens
gactgaagaagatgagcct

SEQ ID NO: 2161699 - DNA, 20 bp, Homo sapiens
gacttctctaatagaaaagt

SEQ ID NO: 2161700 - DNA, 22 bp, Homo sapiens
gagaagccagctttcctcatca

SEQ ID NO: 2161701 - DNA, 15 bp, Homo sapiens
gagcagcccctccca

SEQ ID NO: 2161702 - DNA, 23 bp, Homo sapiens
gagccccaacaacttttccctca

SEQ ID NO: 2161703 - DNA, 23 bp, Homo sapiens
gagggacagcagattccacagga

SEQ ID NO: 2161704 - DNA, 18 bp, Homo sapiens
gagtgaggatgtctgggc

SEQ ID NO: 2161705 - DNA, 21 bp, Homo sapiens
gagtgccttatttcctttcca

SEQ ID NO: 2161706 - DNA, 22 bp, Homo sapiens
gagtgtgtaatttaaaattgtg

SEQ ID NO: 2161707 - DNA, 15 bp, Homo sapiens
gataaagatatcaat

SEQ ID NO: 2161708 - DNA, 13 bp, Homo sapiens
gatagatgtgtgg

SEQ ID NO: 2161709 - DNA, 22 bp, Homo sapiens
gatagatgtgtggacacattgg

SEQ ID NO: 2161710 - DNA, 15 bp, Homo sapiens
gatatctgcatgtgt

SEQ ID NO: 2161711 - DNA, 18 bp, Homo sapiens
gatgtagcagaatatttc

SEQ ID NO: 2161712 - DNA, 15 bp, Homo sapiens
gatgtccctcctttt

SEQ ID NO: 2161713 - DNA, 20 bp, Homo sapiens
gatgtgttattacttcctca

SEQ ID NO: 2161714 - DNA, 14 bp, Homo sapiens
gcaaagagagattt

SEQ ID NO: 2161715 - DNA, 18 bp, Homo sapiens
gcaacactctacttgaag

SEQ ID NO: 2161716 - DNA, 19 bp, Homo sapiens
gcaataggtgagagaatgt

SEQ ID NO: 2161717 - DNA, 14 bp, Homo sapiens
gcacctaaaactta

SEQ ID NO: 2161718 - DNA, 19 bp, Homo sapiens
gcagagattttcaacattt

SEQ ID NO: 2161719 - DNA, 12 bp, Homo sapiens
gcatacaataaa

SEQ ID NO: 2161720 - DNA, 16 bp, Homo sapiens
gcatacaataaaagag

SEQ ID NO: 2161721 - DNA, 18 bp, Homo sapiens
gcatacaataaaagagct

SEQ ID NO: 2161722 - DNA, 12 bp, Homo sapiens
gcatctcactcc

SEQ ID NO: 2161723 - DNA, 15 bp, Homo sapiens
gcatggagaataaac

SEQ ID NO: 2161724 - DNA, 14 bp, Homo sapiens
gccagtggctggat

SEQ ID NO: 2161725 - DNA, 23 bp, Homo sapiens
gccagtggctggatctgtgaggg

SEQ ID NO: 2161726 - DNA, 22 bp, Homo sapiens
gcccctgtaaggtttcaatgca

SEQ ID NO: 2161727 - DNA, 21 bp, Homo sapiens
gcctgactaggaaaagttggg

SEQ ID NO: 2161728 - DNA, 19 bp, Homo sapiens
gcctgagccccaacaactt

SEQ ID NO: 2161729 - DNA, 14 bp, Homo sapiens
gctcattttggact

SEQ ID NO: 2161730 - DNA, 14 bp, Homo sapiens
gctgattgtattta

SEQ ID NO: 2161731 - DNA, 20 bp, Homo sapiens
gctgggaataagtgccagga

SEQ ID NO: 2161732 - DNA, 22 bp, Homo sapiens
gctgggcttggcagcccgggtc

SEQ ID NO: 2161733 - DNA, 20 bp, Homo sapiens
gctgtagacatttgctatga

SEQ ID NO: 2161734 - DNA, 15 bp, Homo sapiens
gctttgaggtaccca

SEQ ID NO: 2161735 - DNA, 22 bp, Homo sapiens
gcttttcctcaaagggagagag

SEQ ID NO: 2161736 - DNA, 14 bp, Homo sapiens
ggaactgctgggct

SEQ ID NO: 2161737 - DNA, 15 bp, Homo sapiens
ggacacgaaggctgc

SEQ ID NO: 2161738 - DNA, 14 bp, Homo sapiens
ggatagatgtgtgg

SEQ ID NO: 2161739 - DNA, 17 bp, Homo sapiens
ggatggaatgatgggtc

SEQ ID NO: 2161740 - DNA, 19 bp, Homo sapiens
ggccaagagaaacttccta

SEQ ID NO: 2161741 - DNA, 19 bp, Homo sapiens
ggccagtggctggatctgt

SEQ ID NO: 2161742 - DNA, 12 bp, Homo sapiens
ggccctgtgcct

SEQ ID NO: 2161743 - DNA, 17 bp, Homo sapiens
ggcctaaaagtaaacat

SEQ ID NO: 2161744 - DNA, 20 bp, Homo sapiens
ggctctcctcagaagaaaga

SEQ ID NO: 2161745 - DNA, 23 bp, Homo sapiens
ggctgcccctgtaaggtttcaat

SEQ ID NO: 2161746 - DNA, 22 bp, Homo sapiens
gggagaatgtcagtatgtggaa

SEQ ID NO: 2161747 - DNA, 14 bp, Homo sapiens
gggatagatgtgtg

SEQ ID NO: 2161748 - DNA, 23 bp, Homo sapiens
ggggtctgtgtgtttatgtgtgt

SEQ ID NO: 2161749 - DNA, 16 bp, Homo sapiens
ggtaggaactgctggg

SEQ ID NO: 2161750 - DNA, 18 bp, Homo sapiens
ggtaggaactgctgggct

SEQ ID NO: 2161751 - DNA, 21 bp, Homo sapiens
ggtcagatatttgagaatagg

SEQ ID NO: 2161752 - DNA, 14 bp, Homo sapiens
ggtccagattgaaa

SEQ ID NO: 2161753 - DNA, 15 bp, Homo sapiens
ggtgtttttaataaa

SEQ ID NO: 2161754 - DNA, 15 bp, Homo sapiens
ggttaatttttcctg

SEQ ID NO: 2161755 - DNA, 17 bp, Homo sapiens
gtaaatttatgtgatgg

SEQ ID NO: 2161756 - DNA, 19 bp, Homo sapiens
gtaatttaaaattgtgatg

SEQ ID NO: 2161757 - DNA, 23 bp, Homo sapiens
gtaatttaaaattgtgatgtgtc

SEQ ID NO: 2161758 - DNA, 19 bp, Homo sapiens
gtaggtcagatatttgaga

SEQ ID NO: 2161759 - DNA, 14 bp, Homo sapiens
gtaggttgggagaa

SEQ ID NO: 2161760 - DNA, 15 bp, Homo sapiens
gtatgtggaagtgtg

SEQ ID NO: 2161761 - DNA, 19 bp, Homo sapiens
gtatgtgggggtctgtgtg

SEQ ID NO: 2161762 - DNA, 13 bp, Homo sapiens
gtattatgagcca

SEQ ID NO: 2161763 - DNA, 19 bp, Homo sapiens
gtcatgaagaatgtttctg

SEQ ID NO: 2161764 - DNA, 21 bp, Homo sapiens
gtcccaccacagtccctcacc

SEQ ID NO: 2161765 - DNA, 16 bp, Homo sapiens
gtccctgaagagaagg

SEQ ID NO: 2161766 - DNA, 23 bp, Homo sapiens
gtcctagagatctatgggcattt

SEQ ID NO: 2161767 - DNA, 11 bp, Homo sapiens
gtctgtgtgtt

SEQ ID NO: 2161768 - DNA, 15 bp, Homo sapiens
gtgactgaagaagat

SEQ ID NO: 2161769 - DNA, 14 bp, Homo sapiens
gtgccttttgccat

SEQ ID NO: 2161770 - DNA, 19 bp, Homo sapiens
gtggaagtgtgggtctgtg

SEQ ID NO: 2161771 - DNA, 13 bp, Homo sapiens
gtgggagtgtgta

SEQ ID NO: 2161772 - DNA, 19 bp, Homo sapiens
gtggggtaggttgggagaa

SEQ ID NO: 2161773 - DNA, 16 bp, Homo sapiens
gtgggtctgtgtgtgt

SEQ ID NO: 2161774 - DNA, 20 bp, Homo sapiens
gtgtaatttaaaattgtgat

SEQ ID NO: 2161775 - DNA, 23 bp, Homo sapiens
gtgtaatttaaaattgtgatgtg

SEQ ID NO: 2161776 - DNA, 13 bp, Homo sapiens
gtgtatgtggggg

SEQ ID NO: 2161777 - DNA, 21 bp, Homo sapiens
gtgtatgtgggggtctgtgtg

SEQ ID NO: 2161778 - DNA, 14 bp, Homo sapiens
gtgtgttgtgtgtg

SEQ ID NO: 2161779 - DNA, 16 bp, Homo sapiens
gtgtgtttatgtgtgt

SEQ ID NO: 2161780 - DNA, 15 bp, Homo sapiens
gtgttgtgtgtggga

SEQ ID NO: 2161781 - DNA, 14 bp, Homo sapiens
gttctgtgactgaa

SEQ ID NO: 2161782 - DNA, 11 bp, Homo sapiens
gttgcaccctt

SEQ ID NO: 2161783 - DNA, 14 bp, Homo sapiens
gttgtgtgtgggag

SEQ ID NO: 2161784 - DNA, 16 bp, Homo sapiens
gtttatgtgtgtgtgt

SEQ ID NO: 2161785 - DNA, 17 bp, Homo sapiens
gtttctttaagaaagta

SEQ ID NO: 2161786 - DNA, 18 bp, Homo sapiens
taaaagaacagtaaacat

SEQ ID NO: 2161787 - DNA, 16 bp, Homo sapiens
tggggatagatgtgtg

SEQ ID NO: 2161788 - DNA, 17 bp, Homo sapiens
tggggatagatgtgtgg

SEQ ID NO: 2161789 - DNA, 14 bp, Homo sapiens
tggggctgattgta

SEQ ID NO: 2161790 - DNA, 18 bp, Homo sapiens
tgggggtctgtgtgttta

SEQ ID NO: 2161791 - DNA, 15 bp, Homo sapiens
tggggtaggttggga

SEQ ID NO: 2161792 - DNA, 21 bp, Homo sapiens
tggggtaggttgggagaatgt

SEQ ID NO: 2161793 - DNA, 14 bp, Homo sapiens
tggtaaaaagaaaa

SEQ ID NO: 2161794 - DNA, 13 bp, Homo sapiens
tggtaggaactgc

SEQ ID NO: 2161795 - DNA, 20 bp, Homo sapiens
tggtaggaactgctgggctt

SEQ ID NO: 2161796 - DNA, 23 bp, Homo sapiens
aaaaactcaattaaaattttgtt

SEQ ID NO: 2161797 - DNA, 11 bp, Homo sapiens
aaaagtaaaca

SEQ ID NO: 2161798 - DNA, 14 bp, Homo sapiens
aaaagttgggagtt

SEQ ID NO: 2161799 - DNA, 16 bp, Homo sapiens
aaaattgtgatgtgtc

SEQ ID NO: 2161800 - DNA, 15 bp, Homo sapiens
aaacccgagggacag

SEQ ID NO: 2161801 - DNA, 15 bp, Homo sapiens
aaagaacagtaaaca

SEQ ID NO: 2161802 - DNA, 13 bp, Homo sapiens
aaagagagatttt

SEQ ID NO: 2161803 - DNA, 14 bp, Homo sapiens
aaagcagagatttt

SEQ ID NO: 2161804 - DNA, 21 bp, Homo sapiens
tccaatggtaggaatttcaag

SEQ ID NO: 2161805 - DNA, 12 bp, Homo sapiens
tccacaggacac

SEQ ID NO: 2161806 - DNA, 16 bp, Homo sapiens
tccagattgaaaagtg

SEQ ID NO: 2161807 - DNA, 14 bp, Homo sapiens
tccattaaatggtc

SEQ ID NO: 2161808 - DNA, 15 bp, Homo sapiens
tcccagatagaatgt

SEQ ID NO: 2161809 - DNA, 17 bp, Homo sapiens
tcctcagttggaatcat

SEQ ID NO: 2161810 - DNA, 15 bp, Homo sapiens
tcctctttgcccaaa

SEQ ID NO: 2161811 - DNA, 14 bp, Homo sapiens
tcctgcatgttctg

SEQ ID NO: 2161812 - DNA, 18 bp, Homo sapiens
tctaaaagaaaaaggcat

SEQ ID NO: 2161813 - DNA, 13 bp, Homo sapiens
tctatgggcattt

SEQ ID NO: 2161814 - DNA, 23 bp, Homo sapiens
tctctaatagaaaagtctccacc

SEQ ID NO: 2161815 - DNA, 20 bp, Homo sapiens
tctgcatttttcagagaata

SEQ ID NO: 2161816 - DNA, 11 bp, Homo sapiens
tctggccctat

SEQ ID NO: 2161817 - DNA, 13 bp, Homo sapiens
tctgtgtgtgtgt

SEQ ID NO: 2161818 - DNA, 18 bp, Homo sapiens
tctgtgtgtgtgtatgtg

SEQ ID NO: 2161819 - DNA, 19 bp, Homo sapiens
tctgtgtgtgtgtatgtgg

SEQ ID NO: 2161820 - DNA, 16 bp, Homo sapiens
tctgtgtgtttatgtg

SEQ ID NO: 2161821 - DNA, 22 bp, Homo sapiens
tcttcattacctcagtgagaag

SEQ ID NO: 2161822 - DNA, 14 bp, Homo sapiens
tctttaagaaagta

SEQ ID NO: 2161823 - DNA, 20 bp, Homo sapiens
tgaaaagtagcaattatgga

SEQ ID NO: 2161824 - DNA, 19 bp, Homo sapiens
tgaaatacacaagtaaaca

SEQ ID NO: 2161825 - DNA, 20 bp, Homo sapiens
tgaagtcaattactctataa

SEQ ID NO: 2161826 - DNA, 17 bp, Homo sapiens
tgacatacatccaacat

SEQ ID NO: 2161827 - DNA, 15 bp, Homo sapiens
tgactaggaaaagtt

SEQ ID NO: 2161828 - DNA, 23 bp, Homo sapiens
tgagcagcccctcccagatagaa

SEQ ID NO: 2161829 - DNA, 19 bp, Homo sapiens
tgaggcctaaaagtaaaca

SEQ ID NO: 2161830 - DNA, 16 bp, Homo sapiens
tgagttggctgggaat

SEQ ID NO: 2161831 - DNA, 17 bp, Homo sapiens
tgataaaggccagatta

SEQ ID NO: 2161832 - DNA, 21 bp, Homo sapiens
tgatagaaggctatggggata

SEQ ID NO: 2161833 - DNA, 23 bp, Homo sapiens
tgatgtcccaccacagtccctca

SEQ ID NO: 2161834 - DNA, 20 bp, Homo sapiens
tgattatttttttctgtaaa

SEQ ID NO: 2161835 - DNA, 19 bp, Homo sapiens
tgcactgatgtccctcctt

SEQ ID NO: 2161836 - DNA, 19 bp, Homo sapiens
tgcagtgaacttccagaca

SEQ ID NO: 2161837 - DNA, 16 bp, Homo sapiens
tgcatacaataaaaga

SEQ ID NO: 2161838 - DNA, 17 bp, Homo sapiens
tgcatacaataaaagag

SEQ ID NO: 2161839 - DNA, 18 bp, Homo sapiens
tgccaggatggaatgatg

SEQ ID NO: 2161840 - DNA, 16 bp, Homo sapiens
tgccatcatgtttaca

SEQ ID NO: 2161841 - DNA, 13 bp, Homo sapiens
tgcccatcccagt

SEQ ID NO: 2161842 - DNA, 16 bp, Homo sapiens
tgccttggtgtgctgt

SEQ ID NO: 2161843 - DNA, 19 bp, Homo sapiens
tgctatgagctggggatgt

SEQ ID NO: 2161844 - DNA, 13 bp, Homo sapiens
tggaagtgtgggt

SEQ ID NO: 2161845 - DNA, 12 bp, Homo sapiens
tggcaccagatg

SEQ ID NO: 2161846 - DNA, 14 bp, Homo sapiens
tggccaagagaaac

SEQ ID NO: 2161847 - DNA, 15 bp, Homo sapiens
tggccagtggctgga

SEQ ID NO: 2161848 - DNA, 21 bp, Homo sapiens
tggcctgttcttctatgggtt

SEQ ID NO: 2161849 - DNA, 22 bp, Homo sapiens
tggctgccttgtgaaggaatta

SEQ ID NO: 2161850 - DNA, 21 bp, Homo sapiens
tgggaaagaaggcaaagtccc

SEQ ID NO: 2161851 - DNA, 20 bp, Homo sapiens
tgggagaatgtcagtatgtg

SEQ ID NO: 2161852 - DNA, 14 bp, Homo sapiens
tgggggtctgtgtg

SEQ ID NO: 2161853 - DNA, 12 bp, Homo sapiens
tgggtctgtgtg

SEQ ID NO: 2161854 - DNA, 13 bp, Homo sapiens
tgggtctgtgtgt

SEQ ID NO: 2161855 - DNA, 17 bp, Homo sapiens
tgtaaatttatgtgatg

SEQ ID NO: 2161856 - DNA, 15 bp, Homo sapiens
tgtaaggtttcaatg

SEQ ID NO: 2161857 - DNA, 16 bp, Homo sapiens
tgtaaggtttcaatgc

SEQ ID NO: 2161858 - DNA, 22 bp, Homo sapiens
tgtaatttaaaattgtgatgtg

SEQ ID NO: 2161859 - DNA, 19 bp, Homo sapiens
tgtattttcatagatgtgt

SEQ ID NO: 2161860 - DNA, 19 bp, Homo sapiens
tgtcaatttataatgatta

SEQ ID NO: 2161861 - DNA, 11 bp, Homo sapiens
tgtgatgtgtc

SEQ ID NO: 2161862 - DNA, 14 bp, Homo sapiens
tgtgcaataggtga

SEQ ID NO: 2161863 - DNA, 22 bp, Homo sapiens
tgtgcaataggtgagagaatgt

SEQ ID NO: 2161864 - DNA, 15 bp, Homo sapiens
tgtggaagtgtgggt

SEQ ID NO: 2161865 - DNA, 16 bp, Homo sapiens
tgtgggggtctgtgtg

SEQ ID NO: 2161866 - DNA, 23 bp, Homo sapiens
tgtgtaatttaaaattgtgatgt

SEQ ID NO: 2161867 - DNA, 16 bp, Homo sapiens
tgtgtgggagtgtgta

SEQ ID NO: 2161868 - DNA, 14 bp, Homo sapiens
tgtgttgtgtgtgg

SEQ ID NO: 2161869 - DNA, 23 bp, Homo sapiens
tgtgttgtgtgtgggagtgtgta

SEQ ID NO: 2161870 - DNA, 17 bp, Homo sapiens
tgttagttaaaggctta

SEQ ID NO: 2161871 - DNA, 16 bp, Homo sapiens
tgttcttttgtcccag

SEQ ID NO: 2161872 - DNA, 16 bp, Homo sapiens
tgttgtgtgtgggagt

SEQ ID NO: 2161873 - DNA, 14 bp, Homo sapiens
tgtttacagaggac

SEQ ID NO: 2161874 - DNA, 20 bp, Homo sapiens
tgttttaaacatagaaagtt

SEQ ID NO: 2161875 - DNA, 13 bp, Homo sapiens
ttaaaattgtgat

SEQ ID NO: 2161876 - DNA, 15 bp, Homo sapiens
ttacagaggacagta

SEQ ID NO: 2161877 - DNA, 23 bp, Homo sapiens
ttacatgcccatcccagtgtcct

SEQ ID NO: 2161878 - DNA, 15 bp, Homo sapiens
ttaccaaaagtcaac

SEQ ID NO: 2161879 - DNA, 14 bp, Homo sapiens
ttagaagaagtgtg

SEQ ID NO: 2161880 - DNA, 13 bp, Homo sapiens
ttagagaaaacta

SEQ ID NO: 2161881 - DNA, 10 bp, Homo sapiens
ttatgtgtgt

SEQ ID NO: 2161882 - DNA, 21 bp, Homo sapiens
ttcaatgcatacaataaaaga

SEQ ID NO: 2161883 - DNA, 23 bp, Homo sapiens
ttcaatgcatacaataaaagagc

SEQ ID NO: 2161884 - DNA, 14 bp, Homo sapiens
ttcatacaaagcat

SEQ ID NO: 2161885 - DNA, 19 bp, Homo sapiens
ttcatcaaaacctaccctg

SEQ ID NO: 2161886 - DNA, 21 bp, Homo sapiens
ttcctgaggaagagggactgt

SEQ ID NO: 2161887 - DNA, 23 bp, Homo sapiens
ttcctgttaggtattagaaagtg

SEQ ID NO: 2161888 - DNA, 16 bp, Homo sapiens
ttctggtaaaaagaaa

SEQ ID NO: 2161889 - DNA, 14 bp, Homo sapiens
ttctgtaaagcaaa

SEQ ID NO: 2161890 - DNA, 23 bp, Homo sapiens
ttctgtgactgaagaagatgagc

SEQ ID NO: 2161891 - DNA, 18 bp, Homo sapiens
ttgcagatatctgcatgt

SEQ ID NO: 2161892 - DNA, 15 bp, Homo sapiens
ttgggcctgttcctt

SEQ ID NO: 2161893 - DNA, 20 bp, Homo sapiens
ttggtccagattgaaaagtg

SEQ ID NO: 2161894 - DNA, 23 bp, Homo sapiens
ttgtaaaagaacagtaaacattg

SEQ ID NO: 2161895 - DNA, 15 bp, Homo sapiens
ttgtttagaagaagt

SEQ ID NO: 2161896 - DNA, 17 bp, Homo sapiens
tttagaagaagtgtgtc

SEQ ID NO: 2161897 - DNA, 12 bp, Homo sapiens
tttataggaaaa

SEQ ID NO: 2161898 - DNA, 13 bp, Homo sapiens
tttcaaatatcac

SEQ ID NO: 2161899 - DNA, 19 bp, Homo sapiens
tttcccaatactagccccc

SEQ ID NO: 2161900 - DNA, 23 bp, Homo sapiens
tttgtaaaagaacagtaaacatt

SEQ ID NO: 2161901 - DNA, 17 bp, Homo sapiens
tttgtaaatttatgtga

SEQ ID NO: 2161902 - DNA, 15 bp, Homo sapiens
ttttcatagatgtgt

SEQ ID NO: 2161903 - DNA, 13 bp, Homo sapiens
ttttcctgcatgt

SEQ ID NO: 2161904 - DNA, 11 bp, Homo sapiens
tttttcctgca

SEQ ID NO: 2161905 - DNA, 15 bp, Homo sapiens
acacattaagcaaat

SEQ ID NO: 2161906 - DNA, 18 bp, Homo sapiens
acacctaccaaaaaataa

SEQ ID NO: 2161907 - DNA, 15 bp, Homo sapiens
acagaacctcccaaa

SEQ ID NO: 2161908 - DNA, 19 bp, Homo sapiens
acagacttatacacccctg

SEQ ID NO: 2161909 - DNA, 23 bp, Homo sapiens
acagaggacagtatttgtgggga

SEQ ID NO: 2161910 - DNA, 20 bp, Homo sapiens
acagtatctcaaacaattga

SEQ ID NO: 2161911 - DNA, 16 bp, Homo sapiens
acagtccctcacctcc

SEQ ID NO: 2161912 - DNA, 20 bp, Homo sapiens
accaacacgtggccaagaga

SEQ ID NO: 2161913 - DNA, 19 bp, Homo sapiens
acccctacccccaaccctc

SEQ ID NO: 2161914 - DNA, 22 bp, Homo sapiens
acccctacccccaaccctcaga

SEQ ID NO: 2161915 - DNA, 16 bp, Homo sapiens
accctagaagaaaacc

SEQ ID NO: 2161916 - DNA, 17 bp, Homo sapiens
accctagaagaaaaccc

SEQ ID NO: 2161917 - DNA, 11 bp, Homo sapiens
accctccaccc

SEQ ID NO: 2161918 - DNA, 14 bp, Homo sapiens
acctaccaaaaaat

SEQ ID NO: 2161919 - DNA, 14 bp, Homo sapiens
acctcacccctcct

SEQ ID NO: 2161920 - DNA, 14 bp, Homo sapiens
accttcctcatcta

SEQ ID NO: 2161921 - DNA, 20 bp, Homo sapiens
acgtggccaagagaaacttc

SEQ ID NO: 2161922 - DNA, 22 bp, Homo sapiens
actaattattcctctttgccca

SEQ ID NO: 2161923 - DNA, 12 bp, Homo sapiens
actaggaaaagt

SEQ ID NO: 2161924 - DNA, 15 bp, Homo sapiens
actgatgtccctcct

SEQ ID NO: 2161925 - DNA, 18 bp, Homo sapiens
acttaggtaagaagattc

SEQ ID NO: 2161926 - DNA, 14 bp, Homo sapiens
acttcctcaataaa

SEQ ID NO: 2161927 - DNA, 19 bp, Homo sapiens
acttctctaatagaaaagt

SEQ ID NO: 2161928 - DNA, 14 bp, Homo sapiens
agaaatactcatgt

SEQ ID NO: 2161929 - DNA, 15 bp, Homo sapiens
agaaccctccacccc

SEQ ID NO: 2161930 - DNA, 20 bp, Homo sapiens
agaatcctcagttggaatca

SEQ ID NO: 2161931 - DNA, 19 bp, Homo sapiens
agaatgtcagtatgtggaa

SEQ ID NO: 2161932 - DNA, 21 bp, Homo sapiens
agaatgtgtgtcaatttataa

SEQ ID NO: 2161933 - DNA, 17 bp, Homo sapiens
agagatctatgggcatt

SEQ ID NO: 2161934 - DNA, 18 bp, Homo sapiens
agatagggggaagacaga

SEQ ID NO: 2161935 - DNA, 23 bp, Homo sapiens
agcagtaggatattggcatttgt

SEQ ID NO: 2161936 - DNA, 13 bp, Homo sapiens
agccagaggtctg

SEQ ID NO: 2161937 - DNA, 13 bp, Homo sapiens
agcctgagcccca

SEQ ID NO: 2161938 - DNA, 19 bp, Homo sapiens
agctaattctttgacctgt

SEQ ID NO: 2161939 - DNA, 14 bp, Homo sapiens
agctgagcaggtgt

SEQ ID NO: 2161940 - DNA, 15 bp, Homo sapiens
aggaaaaaataaaca

SEQ ID NO: 2161941 - DNA, 16 bp, Homo sapiens
aggaccttttcccaat

SEQ ID NO: 2161942 - DNA, 17 bp, Homo sapiens
aggatattggcatttgt

SEQ ID NO: 2161943 - DNA, 13 bp, Homo sapiens
aggatgtctgggc

SEQ ID NO: 2161944 - DNA, 21 bp, Homo sapiens
aggcctctcattccagaggaa

SEQ ID NO: 2161945 - DNA, 13 bp, Homo sapiens
aggctgcccctgt

SEQ ID NO: 2161946 - DNA, 22 bp, Homo sapiens
aggggatttttttgatgtgcct

SEQ ID NO: 2161947 - DNA, 15 bp, Homo sapiens
aggtacccaccgtcc

SEQ ID NO: 2161948 - DNA, 13 bp, Homo sapiens
agtattttctaaa

SEQ ID NO: 2161949 - DNA, 22 bp, Homo sapiens
agtcaaccctcctaaaagttca

SEQ ID NO: 2161950 - DNA, 11 bp, Homo sapiens
agtccctcacc

SEQ ID NO: 2161951 - DNA, 22 bp, Homo sapiens
agtggccactaggcccagaccc

SEQ ID NO: 2161952 - DNA, 16 bp, Homo sapiens
agtggctggatctgtg

SEQ ID NO: 2161953 - DNA, 18 bp, Homo sapiens
agttcataaatttatggt

SEQ ID NO: 2161954 - DNA, 19 bp, Homo sapiens
agttgcacccttccctgtg

SEQ ID NO: 2161955 - DNA, 23 bp, Homo sapiens
agttgtatcagcacgtgtggcct

SEQ ID NO: 2161956 - DNA, 16 bp, Homo sapiens
agttttactcctcagt

SEQ ID NO: 2161957 - DNA, 13 bp, Homo sapiens
ataaaagagcttt

SEQ ID NO: 2161958 - DNA, 22 bp, Homo sapiens
ataaacacatcacagatgaata

SEQ ID NO: 2161959 - DNA, 17 bp, Homo sapiens
atacttgcatccaaggt

SEQ ID NO: 2161960 - DNA, 11 bp, Homo sapiens
atagaaaagtc

SEQ ID NO: 2161961 - DNA, 19 bp, Homo sapiens
atagaaggctatggggata

SEQ ID NO: 2161962 - DNA, 13 bp, Homo sapiens
atagatgtgtgga

SEQ ID NO: 2161963 - DNA, 18 bp, Homo sapiens
atagggggaagacagata

SEQ ID NO: 2161964 - DNA, 13 bp, Homo sapiens
atatctgcatgtg

SEQ ID NO: 2161965 - DNA, 16 bp, Homo sapiens
atatctgcatgtgtca

SEQ ID NO: 2161966 - DNA, 12 bp, Homo sapiens
atcaagaaagtc

SEQ ID NO: 2161967 - DNA, 12 bp, Homo sapiens
atcccagtgtcc

SEQ ID NO: 2161968 - DNA, 22 bp, Homo sapiens
atcccagtttaatattccaata

SEQ ID NO: 2161969 - DNA, 21 bp, Homo sapiens
atcctaatgacttctaaaaat

SEQ ID NO: 2161970 - DNA, 19 bp, Homo sapiens
atcctcagttggaatcatt

SEQ ID NO: 2161971 - DNA, 17 bp, Homo sapiens
atgaaactagaaagcag

SEQ ID NO: 2161972 - DNA, 20 bp, Homo sapiens
atgaaatacacaagtaaaca

SEQ ID NO: 2161973 - DNA, 12 bp, Homo sapiens
atgaatataaaa

SEQ ID NO: 2161974 - DNA, 16 bp, Homo sapiens
atgagcagcccctccc

SEQ ID NO: 2161975 - DNA, 18 bp, Homo sapiens
atgagcagcccctcccag

SEQ ID NO: 2161976 - DNA, 13 bp, Homo sapiens
atgagctcagcct

SEQ ID NO: 2161977 - DNA, 18 bp, Homo sapiens
atgagttggctgggaata

SEQ ID NO: 2161978 - DNA, 17 bp, Homo sapiens
atgcatacaataaaaga

SEQ ID NO: 2161979 - DNA, 23 bp, Homo sapiens
atgcattttattttagacacaaa

SEQ ID NO: 2161980 - DNA, 19 bp, Homo sapiens
atgcccatcccagtgtcct

SEQ ID NO: 2161981 - DNA, 19 bp, Homo sapiens
atggcagaggaatatcaat

SEQ ID NO: 2161982 - DNA, 16 bp, Homo sapiens
atggcctgggggatgt

SEQ ID NO: 2161983 - DNA, 20 bp, Homo sapiens
atggttaatttttcctgcat

SEQ ID NO: 2161984 - DNA, 21 bp, Homo sapiens
atggttaatttttcctgcatg

SEQ ID NO: 2161985 - DNA, 23 bp, Homo sapiens
atggttaatttttcctgcatgtt

SEQ ID NO: 2161986 - DNA, 16 bp, Homo sapiens
atggttctcaggcctg

SEQ ID NO: 2161987 - DNA, 14 bp, Homo sapiens
atgtcagtatgtgg

SEQ ID NO: 2161988 - DNA, 13 bp, Homo sapiens
atgtggaagtgtg

SEQ ID NO: 2161989 - DNA, 15 bp, Homo sapiens
atgtgtcatgaagaa

SEQ ID NO: 2161990 - DNA, 10 bp, Homo sapiens
atgtgtgtgt

SEQ ID NO: 2161991 - DNA, 19 bp, Homo sapiens
atgtgttattacttcctca

SEQ ID NO: 2161992 - DNA, 15 bp, Homo sapiens
attagcattccttaa

SEQ ID NO: 2161993 - DNA, 18 bp, Homo sapiens
attatggaaaaaaaatat

SEQ ID NO: 2161994 - DNA, 14 bp, Homo sapiens
attcctctttgccc

SEQ ID NO: 2161995 - DNA, 16 bp, Homo sapiens
attgaaaagtgtcctc

SEQ ID NO: 2161996 - DNA, 20 bp, Homo sapiens
attgaagtcaattactctat

SEQ ID NO: 2161997 - DNA, 12 bp, Homo sapiens
attggtgttgac

SEQ ID NO: 2161998 - DNA, 15 bp, Homo sapiens
attgtgatgtgtcct

SEQ ID NO: 2161999 - DNA, 15 bp, Homo sapiens
atttaaaattgtgat

SEQ ID NO: 2162000 - DNA, 12 bp, Homo sapiens
atttacactcaa

SEQ ID NO: 2162001 - DNA, 15 bp, Homo sapiens
atttcaaaatgattt

SEQ ID NO: 2162002 - DNA, 19 bp, Homo sapiens
atttgtaaatttatgtgat

SEQ ID NO: 2162003 - DNA, 22 bp, Homo sapiens
atttgtggggagggatttgggg

SEQ ID NO: 2162004 - DNA, 18 bp, Homo sapiens
attttcatagatgtgtta

SEQ ID NO: 2162005 - DNA, 23 bp, Homo sapiens
atttttttttaaagaagaaaaaa

SEQ ID NO: 2162006 - DNA, 21 bp, Homo sapiens
caaagagagatttttttttaa

SEQ ID NO: 2162007 - DNA, 14 bp, Homo sapiens
caaccatgacctca

SEQ ID NO: 2162008 - DNA, 15 bp, Homo sapiens
caacttggtccagat

SEQ ID NO: 2162009 - DNA, 23 bp, Homo sapiens
caaggacagaaccctccacccct

SEQ ID NO: 2162010 - DNA, 14 bp, Homo sapiens
caataaaagagctt

SEQ ID NO: 2162011 - DNA, 18 bp, Homo sapiens
caataaaagagctttatc

SEQ ID NO: 2162012 - DNA, 17 bp, Homo sapiens
caatgcatacaataaaa

SEQ ID NO: 2162013 - DNA, 21 bp, Homo sapiens
caatgcatacaataaaagagc

SEQ ID NO: 2162014 - DNA, 23 bp, Homo sapiens
caatgcatacaataaaagagctt

SEQ ID NO: 2162015 - DNA, 20 bp, Homo sapiens
ctttcaaaggagaatgaatc

SEQ ID NO: 2162016 - DNA, 12 bp, Homo sapiens
gaaaagtgtcct

SEQ ID NO: 2162017 - DNA, 23 bp, Homo sapiens
gaaaattaagggccgatttaatt

SEQ ID NO: 2162018 - DNA, 18 bp, Homo sapiens
gaaatacacaagtaaaca

SEQ ID NO: 2162019 - DNA, 14 bp, Homo sapiens
gaaatactcatgtg

SEQ ID NO: 2162020 - DNA, 13 bp, Homo sapiens
gaacagtaaacat

SEQ ID NO: 2162021 - DNA, 13 bp, Homo sapiens
gaactattagagc

SEQ ID NO: 2162022 - DNA, 17 bp, Homo sapiens
gaactgctgggcttggc

SEQ ID NO: 2162023 - DNA, 19 bp, Homo sapiens
gaagaaaaaaaaaaattca

SEQ ID NO: 2162024 - DNA, 17 bp, Homo sapiens
gaagagaagggcagggc

SEQ ID NO: 2162025 - DNA, 16 bp, Homo sapiens
gaatgtcaatatttga

SEQ ID NO: 2162026 - DNA, 13 bp, Homo sapiens
gaatgtcagtatg

SEQ ID NO: 2162027 - DNA, 16 bp, Homo sapiens
gaatgtcagtatgtgg

SEQ ID NO: 2162028 - DNA, 14 bp, Homo sapiens
gactaggaaaagtt

SEQ ID NO: 2162029 - DNA, 16 bp, Homo sapiens
gagaaaactaaagaaa

SEQ ID NO: 2162030 - DNA, 21 bp, Homo sapiens
gagaatgtattttcatagatg

SEQ ID NO: 2162031 - DNA, 17 bp, Homo sapiens
gagaatgtcagtatgtg

SEQ ID NO: 2162032 - DNA, 17 bp, Homo sapiens
gagaattgggattacat

SEQ ID NO: 2162033 - DNA, 21 bp, Homo sapiens
gagattttcaacatttcaaaa

SEQ ID NO: 2162034 - DNA, 19 bp, Homo sapiens
gagcagcccctcccagata

SEQ ID NO: 2162035 - DNA, 22 bp, Homo sapiens
gagccaaaatggttaatttttc

SEQ ID NO: 2162036 - DNA, 21 bp, Homo sapiens
gagccttgcagatatctgcat

SEQ ID NO: 2162037 - DNA, 13 bp, Homo sapiens
gaggaatatcaat

SEQ ID NO: 2162038 - DNA, 19 bp, Homo sapiens
gaggcctaaaagtaaacat

SEQ ID NO: 2162039 - DNA, 22 bp, Homo sapiens
gaggtttgtttagaagaagtgt

SEQ ID NO: 2162040 - DNA, 23 bp, Homo sapiens
gagtattttctggtaaaaagaaa

SEQ ID NO: 2162041 - DNA, 13 bp, Homo sapiens
gatatctgcatgt

SEQ ID NO: 2162042 - DNA, 14 bp, Homo sapiens
gatcattatcagcc

SEQ ID NO: 2162043 - DNA, 12 bp, Homo sapiens
gatggattttat

SEQ ID NO: 2162044 - DNA, 15 bp, Homo sapiens
gatgggtcagttgta

SEQ ID NO: 2162045 - DNA, 21 bp, Homo sapiens
gatgggtcagttgtatcagca

SEQ ID NO: 2162046 - DNA, 21 bp, Homo sapiens
gatgtgtcctgataagctgag

SEQ ID NO: 2162047 - DNA, 16 bp, Homo sapiens
gattgaaaagtgtcct

SEQ ID NO: 2162048 - DNA, 23 bp, Homo sapiens
gattgcaggagtccctgccatca

SEQ ID NO: 2162049 - DNA, 17 bp, Homo sapiens
gcaacagtttgacattt

SEQ ID NO: 2162050 - DNA, 15 bp, Homo sapiens
gcactatctttaaac

SEQ ID NO: 2162051 - DNA, 18 bp, Homo sapiens
gcactgatgtccctcctt

SEQ ID NO: 2162052 - DNA, 18 bp, Homo sapiens
gcagatatctgcatgtgt

SEQ ID NO: 2162053 - DNA, 17 bp, Homo sapiens
gcatacaataaaagagc

SEQ ID NO: 2162054 - DNA, 22 bp, Homo sapiens
gcatacaataaaagagctttat

SEQ ID NO: 2162055 - DNA, 18 bp, Homo sapiens
gccaagagaaacttccta

SEQ ID NO: 2162056 - DNA, 15 bp, Homo sapiens
gccacgattgcagga

SEQ ID NO: 2162057 - DNA, 17 bp, Homo sapiens
gccatcatgtttacaga

SEQ ID NO: 2162058 - DNA, 18 bp, Homo sapiens
gcccagcctgagccccaa

SEQ ID NO: 2162059 - DNA, 17 bp, Homo sapiens
gcccatcccagtgtcct

SEQ ID NO: 2162060 - DNA, 17 bp, Homo sapiens
gcccatgtgttccctct

SEQ ID NO: 2162061 - DNA, 19 bp, Homo sapiens
gcccctgtaaggtttcaat

SEQ ID NO: 2162062 - DNA, 15 bp, Homo sapiens
gcctaaaagtaaaca

SEQ ID NO: 2162063 - DNA, 21 bp, Homo sapiens
gccttgcagatatctgcatgt

SEQ ID NO: 2162064 - DNA, 22 bp, Homo sapiens
gccttgcagatatctgcatgtg

SEQ ID NO: 2162065 - DNA, 22 bp, Homo sapiens
gctaattctttgacctgttggg

SEQ ID NO: 2162066 - DNA, 22 bp, Homo sapiens
gctattgtttctttaagaaagt

SEQ ID NO: 2162067 - DNA, 19 bp, Homo sapiens
gctttcctcatcaggccat

SEQ ID NO: 2162068 - DNA, 14 bp, Homo sapiens
gcttttgaattgca

SEQ ID NO: 2162069 - DNA, 15 bp, Homo sapiens
ggaactgctgggctt

SEQ ID NO: 2162070 - DNA, 16 bp, Homo sapiens
ggaatttcaaggtgta

SEQ ID NO: 2162071 - DNA, 17 bp, Homo sapiens
ggacagcagattccaca

SEQ ID NO: 2162072 - DNA, 19 bp, Homo sapiens
ggacagtatttgtggggag

SEQ ID NO: 2162073 - DNA, 23 bp, Homo sapiens
ggacttctctaatagaaaagtct

SEQ ID NO: 2162074 - DNA, 12 bp, Homo sapiens
ggagaaaaacaa

SEQ ID NO: 2162075 - DNA, 22 bp, Homo sapiens
ggagaatgtcagtatgtggaag

SEQ ID NO: 2162076 - DNA, 15 bp, Homo sapiens
ggatagatgtgtgga

SEQ ID NO: 2162077 - DNA, 15 bp, Homo sapiens
ggcagggctgaggcc

SEQ ID NO: 2162078 - DNA, 18 bp, Homo sapiens
ggccagcaccatctcttt

SEQ ID NO: 2162079 - DNA, 20 bp, Homo sapiens
ggcctctcattccagaggaa

SEQ ID NO: 2162080 - DNA, 15 bp, Homo sapiens
ggctaagacttccta

SEQ ID NO: 2162081 - DNA, 17 bp, Homo sapiens
ggctggatctgtgaggg

SEQ ID NO: 2162082 - DNA, 14 bp, Homo sapiens
gggatgtctctcat

SEQ ID NO: 2162083 - DNA, 18 bp, Homo sapiens
gggctcagagtggggtag

SEQ ID NO: 2162084 - DNA, 15 bp, Homo sapiens
ggggctaagacttcc

SEQ ID NO: 2162085 - DNA, 14 bp, Homo sapiens
ggtcagatatttga

SEQ ID NO: 2162086 - DNA, 19 bp, Homo sapiens
ggtgtaggtcagatatttg

SEQ ID NO: 2162087 - DNA, 17 bp, Homo sapiens
ggttaatttttcctgca

SEQ ID NO: 2162088 - DNA, 18 bp, Homo sapiens
gtaaaagaacagtaaaca

SEQ ID NO: 2162089 - DNA, 19 bp, Homo sapiens
gtaaatttagcatatcaat

SEQ ID NO: 2162090 - DNA, 16 bp, Homo sapiens
gtaaggtttcaatgca

SEQ ID NO: 2162091 - DNA, 18 bp, Homo sapiens
gtaggtcagatatttgag

SEQ ID NO: 2162092 - DNA, 21 bp, Homo sapiens
gtatgtggaagtgtgggtctg

SEQ ID NO: 2162093 - DNA, 15 bp, Homo sapiens
gtcagctccttgacc

SEQ ID NO: 2162094 - DNA, 17 bp, Homo sapiens
gtccagattgaaaagtg

SEQ ID NO: 2162095 - DNA, 13 bp, Homo sapiens
gtccctcacctcc

SEQ ID NO: 2162096 - DNA, 21 bp, Homo sapiens
gtctatgacttatttccttca

SEQ ID NO: 2162097 - DNA, 16 bp, Homo sapiens
gtctgtgtgtgtgtat

SEQ ID NO: 2162098 - DNA, 22 bp, Homo sapiens
gtctgtgtgtttatgtgtgtgt

SEQ ID NO: 2162099 - DNA, 20 bp, Homo sapiens
gtctttagccccactgcttg

SEQ ID NO: 2162100 - DNA, 19 bp, Homo sapiens
gtgactgaagaagatgagc

SEQ ID NO: 2162101 - DNA, 23 bp, Homo sapiens
gtgagagaatgtattttcataga

SEQ ID NO: 2162102 - DNA, 15 bp, Homo sapiens
gtgaggatgtctggg

SEQ ID NO: 2162103 - DNA, 16 bp, Homo sapiens
gtgtcatgaagaatgt

SEQ ID NO: 2162104 - DNA, 17 bp, Homo sapiens
gtgtcatgaagaatgtt

SEQ ID NO: 2162105 - DNA, 14 bp, Homo sapiens
gtgtgtaatttaaa

SEQ ID NO: 2162106 - DNA, 13 bp, Homo sapiens
gtgtgtatgtggg

SEQ ID NO: 2162107 - DNA, 13 bp, Homo sapiens
gtgtgtgtatgtg

SEQ ID NO: 2162108 - DNA, 17 bp, Homo sapiens
gtgtgttgtgtgtggga

SEQ ID NO: 2162109 - DNA, 15 bp, Homo sapiens
gtgtgtttatgtgtg

SEQ ID NO: 2162110 - DNA, 12 bp, Homo sapiens
gtgtttatgtgt

SEQ ID NO: 2162111 - DNA, 21 bp, Homo sapiens
gttaatttttcctgcatgttc

SEQ ID NO: 2162112 - DNA, 22 bp, Homo sapiens
gttaatttttcctgcatgttct

SEQ ID NO: 2162113 - DNA, 23 bp, Homo sapiens
gttaatttttcctgcatgttctg

SEQ ID NO: 2162114 - DNA, 22 bp, Homo sapiens
gttctgtgactgaagaagatga

SEQ ID NO: 2162115 - DNA, 14 bp, Homo sapiens
gttgggagaatgtc

SEQ ID NO: 2162116 - DNA, 16 bp, Homo sapiens
gtttaatattccaata

SEQ ID NO: 2162117 - DNA, 13 bp, Homo sapiens
gtttatgtgtgtg

SEQ ID NO: 2162118 - DNA, 22 bp, Homo sapiens
gtttcaatgcatacaataaaag

SEQ ID NO: 2162119 - DNA, 19 bp, Homo sapiens
gttttaaacatagaaagtt

SEQ ID NO: 2162120 - DNA, 16 bp, Homo sapiens
gttttcttaacttaaa

SEQ ID NO: 2162121 - DNA, 12 bp, Homo sapiens
taaaagagcttt

SEQ ID NO: 2162122 - DNA, 15 bp, Homo sapiens
taaaattgtgatgtg

SEQ ID NO: 2162123 - DNA, 15 bp, Homo sapiens
taaacgaaacaaaga

SEQ ID NO: 2162124 - DNA, 23 bp, Homo sapiens
taaagaagaaaaaaaaaaattca

SEQ ID NO: 2162125 - DNA, 16 bp, Homo sapiens
aaagcagagattttca

SEQ ID NO: 2162126 - DNA, 15 bp, Homo sapiens
aaaggagaatgaatc

SEQ ID NO: 2162127 - DNA, 16 bp, Homo sapiens
aaagtctccaccccta

SEQ ID NO: 2162128 - DNA, 15 bp, Homo sapiens
aaatactcatgtgca

SEQ ID NO: 2162129 - DNA, 18 bp, Homo sapiens
aaatttttaggaaactca

SEQ ID NO: 2162130 - DNA, 13 bp, Homo sapiens
aacttaagccaat

SEQ ID NO: 2162131 - DNA, 22 bp, Homo sapiens
aacttaagccaatttcaatctt

SEQ ID NO: 2162132 - DNA, 15 bp, Homo sapiens
aacttttccctcact

SEQ ID NO: 2162133 - DNA, 15 bp, Homo sapiens
aagaaaacccgaggg

SEQ ID NO: 2162134 - DNA, 16 bp, Homo sapiens
aagaaaacccgaggga

SEQ ID NO: 2162135 - DNA, 17 bp, Homo sapiens
aagaaatactcatgtgc

SEQ ID NO: 2162136 - DNA, 21 bp, Homo sapiens
aagaacaaagagaaaaaatac

SEQ ID NO: 2162137 - DNA, 12 bp, Homo sapiens
aagaagatgagc

SEQ ID NO: 2162138 - DNA, 22 bp, Homo sapiens
aagatgagccttgcagatatct

SEQ ID NO: 2162139 - DNA, 17 bp, Homo sapiens
aagctatccaaataact

SEQ ID NO: 2162140 - DNA, 14 bp, Homo sapiens
aagctttatctatt

SEQ ID NO: 2162141 - DNA, 14 bp, Homo sapiens
aaggagaatgaatc

SEQ ID NO: 2162142 - DNA, 22 bp, Homo sapiens
aaggtgtaggtcagatatttga

SEQ ID NO: 2162143 - DNA, 15 bp, Homo sapiens
aagtaggaaaaataa

SEQ ID NO: 2162144 - DNA, 13 bp, Homo sapiens
aagtctccacccc

SEQ ID NO: 2162145 - DNA, 17 bp, Homo sapiens
aagtgtcctctggctga

SEQ ID NO: 2162146 - DNA, 10 bp, Homo sapiens
aagtgtgggt

SEQ ID NO: 2162147 - DNA, 17 bp, Homo sapiens
aagtgtgggtctgtgtg

SEQ ID NO: 2162148 - DNA, 19 bp, Homo sapiens
aataattattcatctaatg

SEQ ID NO: 2162149 - DNA, 17 bp, Homo sapiens
aatacacaagtaaacat

SEQ ID NO: 2162150 - DNA, 19 bp, Homo sapiens
aatacctccattaaatggt

SEQ ID NO: 2162151 - DNA, 13 bp, Homo sapiens
aatgaatgaaact

SEQ ID NO: 2162152 - DNA, 14 bp, Homo sapiens
aatgcatacaataa

SEQ ID NO: 2162153 - DNA, 21 bp, Homo sapiens
aatgcatacaataaaagagct

SEQ ID NO: 2162154 - DNA, 18 bp, Homo sapiens
aatggttaatttttcctg

SEQ ID NO: 2162155 - DNA, 13 bp, Homo sapiens
aatgtcagtatgt

SEQ ID NO: 2162156 - DNA, 12 bp, Homo sapiens
aattaaacttag

SEQ ID NO: 2162157 - DNA, 16 bp, Homo sapiens
aattccacaccctcac

SEQ ID NO: 2162158 - DNA, 18 bp, Homo sapiens
aattctttgacctgttgg

SEQ ID NO: 2162159 - DNA, 15 bp, Homo sapiens
aattgtgatgtgtcc

SEQ ID NO: 2162160 - DNA, 16 bp, Homo sapiens
aatttttcctgcatgt

SEQ ID NO: 2162161 - DNA, 17 bp, Homo sapiens
aatttttcctgcatgtt

SEQ ID NO: 2162162 - DNA, 19 bp, Homo sapiens
acaacttttccctcactgt

SEQ ID NO: 2162163 - DNA, 20 bp, Homo sapiens
acaaggacagaaccctccac

SEQ ID NO: 2162164 - DNA, 15 bp, Homo sapiens
acaataaaagagctt

SEQ ID NO: 2162165 - DNA, 13 bp, Homo sapiens
acacaagtaaaca

SEQ ID NO: 2162166 - DNA, 22 bp, Homo sapiens
acactcaaccatgacctcaccc

SEQ ID NO: 2162167 - DNA, 13 bp, Homo sapiens
acagaaccctcca

SEQ ID NO: 2162168 - DNA, 14 bp, Homo sapiens
acagaacctcccaa

SEQ ID NO: 2162169 - DNA, 15 bp, Homo sapiens
acaggacacgaaggc

SEQ ID NO: 2162170 - DNA, 18 bp, Homo sapiens
acaggacacgaaggctgc

SEQ ID NO: 2162171 - DNA, 12 bp, Homo sapiens
acagtaaacatt

SEQ ID NO: 2162172 - DNA, 12 bp, Homo sapiens
acatagaaagtt

SEQ ID NO: 2162173 - DNA, 13 bp, Homo sapiens
acatcacagatga

SEQ ID NO: 2162174 - DNA, 12 bp, Homo sapiens
acatgcaccctg

SEQ ID NO: 2162175 - DNA, 17 bp, Homo sapiens
acattactgaaaacttc

SEQ ID NO: 2162176 - DNA, 16 bp, Homo sapiens
acattggtaagaatga

SEQ ID NO: 2162177 - DNA, 16 bp, Homo sapiens
accacagtccctcacc

SEQ ID NO: 2162178 - DNA, 14 bp, Homo sapiens
acccagcccagcct

SEQ ID NO: 2162179 - DNA, 15 bp, Homo sapiens
accctagaagaaaac

SEQ ID NO: 2162180 - DNA, 22 bp, Homo sapiens
acccttccctgtggccttatga

SEQ ID NO: 2162181 - DNA, 16 bp, Homo sapiens
acctccattaaatggt

SEQ ID NO: 2162182 - DNA, 13 bp, Homo sapiens
acctgcaaaaaat

SEQ ID NO: 2162183 - DNA, 17 bp, Homo sapiens
actagccccccagtggt

SEQ ID NO: 2162184 - DNA, 13 bp, Homo sapiens
actaggaaaagtt

SEQ ID NO: 2162185 - DNA, 13 bp, Homo sapiens
actcctcagttcc

SEQ ID NO: 2162186 - DNA, 21 bp, Homo sapiens
actctggaggtttgtttagaa

SEQ ID NO: 2162187 - DNA, 18 bp, Homo sapiens
actgaagaagatgagcct

SEQ ID NO: 2162188 - DNA, 21 bp, Homo sapiens
actgaggcctaaaagtaaaca

SEQ ID NO: 2162189 - DNA, 22 bp, Homo sapiens
acttcaagcagaatcctcagtt

SEQ ID NO: 2162190 - DNA, 14 bp, Homo sapiens
acttttccctcact

SEQ ID NO: 2162191 - DNA, 13 bp, Homo sapiens
agaaaacccgagg

SEQ ID NO: 2162192 - DNA, 17 bp, Homo sapiens
agaaaagtctccacccc

SEQ ID NO: 2162193 - DNA, 16 bp, Homo sapiens
agaaatactcatgtgc

SEQ ID NO: 2162194 - DNA, 13 bp, Homo sapiens
agaacagtaaaca

SEQ ID NO: 2162195 - DNA, 13 bp, Homo sapiens
agaagaaaacccg

SEQ ID NO: 2162196 - DNA, 14 bp, Homo sapiens
agaagaagtgtgtc

SEQ ID NO: 2162197 - DNA, 13 bp, Homo sapiens
agaagatgagcct

SEQ ID NO: 2162198 - DNA, 21 bp, Homo sapiens
agaatcctcagttggaatcat

SEQ ID NO: 2162199 - DNA, 11 bp, Homo sapiens
agaatgtattt

SEQ ID NO: 2162200 - DNA, 23 bp, Homo sapiens
agaatgtccaatggtaggaattt

SEQ ID NO: 2162201 - DNA, 14 bp, Homo sapiens
agacttcctagact

SEQ ID NO: 2162202 - DNA, 22 bp, Homo sapiens
agagaatgtattttcatagatg

SEQ ID NO: 2162203 - DNA, 20 bp, Homo sapiens
agagatttttttttaaagaa

SEQ ID NO: 2162204 - DNA, 20 bp, Homo sapiens
agaggacagtatttgtgggg

SEQ ID NO: 2162205 - DNA, 22 bp, Homo sapiens
agagggactgttcttttgtccc

SEQ ID NO: 2162206 - DNA, 12 bp, Homo sapiens
agatagaatgtc

SEQ ID NO: 2162207 - DNA, 13 bp, Homo sapiens
agatatctgcatg

SEQ ID NO: 2162208 - DNA, 16 bp, Homo sapiens
agatatctgcatgtgt

SEQ ID NO: 2162209 - DNA, 22 bp, Homo sapiens
agatatgggtgtttttaataaa

SEQ ID NO: 2162210 - DNA, 18 bp, Homo sapiens
agatctatgggcatttgg

SEQ ID NO: 2162211 - DNA, 23 bp, Homo sapiens
agattccacaggacacgaaggct

SEQ ID NO: 2162212 - DNA, 16 bp, Homo sapiens
agattgaaaagtgtcc

SEQ ID NO: 2162213 - DNA, 16 bp, Homo sapiens
agcccagcctgagccc

SEQ ID NO: 2162214 - DNA, 20 bp, Homo sapiens
agccttgcagatatctgcat

SEQ ID NO: 2162215 - DNA, 15 bp, Homo sapiens
agctcagcctcgctt

SEQ ID NO: 2162216 - DNA, 20 bp, Homo sapiens
aggacacgaaggctgcccct

SEQ ID NO: 2162217 - DNA, 21 bp, Homo sapiens
aggagtccctgccatcatgtt

SEQ ID NO: 2162218 - DNA, 15 bp, Homo sapiens
aggatattggcattt

SEQ ID NO: 2162219 - DNA, 18 bp, Homo sapiens
aggccagattacaaatta

SEQ ID NO: 2162220 - DNA, 16 bp, Homo sapiens
aggcctaaaagtaaac

SEQ ID NO: 2162221 - DNA, 22 bp, Homo sapiens
aggctatggggatagatgtgtg

SEQ ID NO: 2162222 - DNA, 20 bp, Homo sapiens
aggctggagtgcagtggcat

SEQ ID NO: 2162223 - DNA, 16 bp, Homo sapiens
agggggctaagacttc

SEQ ID NO: 2162224 - DNA, 15 bp, Homo sapiens
agtatgtggaagtgt

SEQ ID NO: 2162225 - DNA, 19 bp, Homo sapiens
agtatgtggaagtgtgggt

SEQ ID NO: 2162226 - DNA, 21 bp, Homo sapiens
agtatttcacagcaacactct

SEQ ID NO: 2162227 - DNA, 12 bp, Homo sapiens
agtccctcacct

SEQ ID NO: 2162228 - DNA, 18 bp, Homo sapiens
agtctatatgaaaaacaa

SEQ ID NO: 2162229 - DNA, 14 bp, Homo sapiens
agtgaggatgtctg

SEQ ID NO: 2162230 - DNA, 20 bp, Homo sapiens
agtgccttatttcctttcca

SEQ ID NO: 2162231 - DNA, 15 bp, Homo sapiens
agtgtcctaggacct

SEQ ID NO: 2162232 - DNA, 15 bp, Homo sapiens
agtgtgggtctgtgt

SEQ ID NO: 2162233 - DNA, 17 bp, Homo sapiens
agtgtgggtctgtgtgt

SEQ ID NO: 2162234 - DNA, 23 bp, Homo sapiens
agtgtgggtctgtgtgtgtgtat

SEQ ID NO: 2162235 - DNA, 19 bp, Homo sapiens
agttattcacaaaaattga

SEQ ID NO: 2162236 - DNA, 16 bp, Homo sapiens
ccacaccctcactgct

SEQ ID NO: 2162237 - DNA, 20 bp, Homo sapiens
ccacaggacacgaaggctgc

SEQ ID NO: 2162238 - DNA, 15 bp, Homo sapiens
ccacagtccctcacc

SEQ ID NO: 2162239 - DNA, 21 bp, Homo sapiens
ccactgcttgcactgatgtcc

SEQ ID NO: 2162240 - DNA, 14 bp, Homo sapiens
ccagatgatgtccc

SEQ ID NO: 2162241 - DNA, 20 bp, Homo sapiens
ccagattgaaaagtgtcctc

SEQ ID NO: 2162242 - DNA, 15 bp, Homo sapiens
ccatcccagtgtcct

SEQ ID NO: 2162243 - DNA, 20 bp, Homo sapiens
ccatgacctcacccctcctt

SEQ ID NO: 2162244 - DNA, 22 bp, Homo sapiens
ccatgacgcaaagagagatttt

SEQ ID NO: 2162245 - DNA, 14 bp, Homo sapiens
ccctagaagaaaac

SEQ ID NO: 2162246 - DNA, 17 bp, Homo sapiens
ccctagaagaaaacccg

SEQ ID NO: 2162247 - DNA, 17 bp, Homo sapiens
cctagaagaaaacccga

SEQ ID NO: 2162248 - DNA, 15 bp, Homo sapiens
cctcagacagactta

SEQ ID NO: 2162249 - DNA, 15 bp, Homo sapiens
cctcttggctgcctt

SEQ ID NO: 2162250 - DNA, 17 bp, Homo sapiens
cctgactaggaaaagtt

SEQ ID NO: 2162251 - DNA, 20 bp, Homo sapiens
cctgccatcatgtttacaga

SEQ ID NO: 2162252 - DNA, 19 bp, Homo sapiens
cctgtaaggtttcaatgca

SEQ ID NO: 2162253 - DNA, 18 bp, Homo sapiens
ccttttcacggagaccta

SEQ ID NO: 2162254 - DNA, 15 bp, Homo sapiens
cgggtcatctgtacc

SEQ ID NO: 2162255 - DNA, 22 bp, Homo sapiens
cgggtcatctgtacctctgcct

SEQ ID NO: 2162256 - DNA, 15 bp, Homo sapiens
ctaaaagtaaacatt

SEQ ID NO: 2162257 - DNA, 17 bp, Homo sapiens
ctactgataaagaaaga

SEQ ID NO: 2162258 - DNA, 15 bp, Homo sapiens
ctagaagaaaacccg

SEQ ID NO: 2162259 - DNA, 15 bp, Homo sapiens
ctagatactcttatt

SEQ ID NO: 2162260 - DNA, 21 bp, Homo sapiens
ctatgagaattgggattacat

SEQ ID NO: 2162261 - DNA, 15 bp, Homo sapiens
ctatttaaaaaagag

SEQ ID NO: 2162262 - DNA, 13 bp, Homo sapiens
ctcaaacaattga

SEQ ID NO: 2162263 - DNA, 13 bp, Homo sapiens
ctcaccatcatca

SEQ ID NO: 2162264 - DNA, 14 bp, Homo sapiens
ctcacccctccttg

SEQ ID NO: 2162265 - DNA, 16 bp, Homo sapiens
ctcagcctcgctttga

SEQ ID NO: 2162266 - DNA, 20 bp, Homo sapiens
ctcaggcctgactctcagca

SEQ ID NO: 2162267 - DNA, 23 bp, Homo sapiens
ctcatgatagaaggctatgggga

SEQ ID NO: 2162268 - DNA, 20 bp, Homo sapiens
ctccacacacataatggcag

SEQ ID NO: 2162269 - DNA, 17 bp, Homo sapiens
ctccttggtttctccct

SEQ ID NO: 2162270 - DNA, 18 bp, Homo sapiens
ctccttggtttctccctc

SEQ ID NO: 2162271 - DNA, 23 bp, Homo sapiens
ctctaatagaaaagtctccaccc

SEQ ID NO: 2162272 - DNA, 17 bp, Homo sapiens
ctctgaatttcttcttt

SEQ ID NO: 2162273 - DNA, 13 bp, Homo sapiens
ctctgttgctgtg

SEQ ID NO: 2162274 - DNA, 17 bp, Homo sapiens
ctgaaaacttcattctt

SEQ ID NO: 2162275 - DNA, 12 bp, Homo sapiens
ctgagaggccac

SEQ ID NO: 2162276 - DNA, 23 bp, Homo sapiens
ctgaggcctaaaagtaaacatta

SEQ ID NO: 2162277 - DNA, 12 bp, Homo sapiens
ctgcatttttca

SEQ ID NO: 2162278 - DNA, 22 bp, Homo sapiens
ctgccatcatgtttacagagga

SEQ ID NO: 2162279 - DNA, 23 bp, Homo sapiens
ctgccatcatgtttacagaggac

SEQ ID NO: 2162280 - DNA, 11 bp, Homo sapiens
ctgctgggctt

SEQ ID NO: 2162281 - DNA, 21 bp, Homo sapiens
ctggccagtggctggatctgt

SEQ ID NO: 2162282 - DNA, 14 bp, Homo sapiens
ctgtacctctgcct

SEQ ID NO: 2162283 - DNA, 23 bp, Homo sapiens
ctgtgactgaagaagatgagcct

SEQ ID NO: 2162284 - DNA, 15 bp, Homo sapiens
ctgtgtgtgtgtatg

SEQ ID NO: 2162285 - DNA, 16 bp, Homo sapiens
ctgtgtgtgtgtatgt

SEQ ID NO: 2162286 - DNA, 21 bp, Homo sapiens
ctgtgtgtgtgtatgtggggg

SEQ ID NO: 2162287 - DNA, 17 bp, Homo sapiens
ctgtgtgtttatgtgtg

SEQ ID NO: 2162288 - DNA, 23 bp, Homo sapiens
ctgttccccaaaacatgcaccct

SEQ ID NO: 2162289 - DNA, 13 bp, Homo sapiens
cttaaatcaaaag

SEQ ID NO: 2162290 - DNA, 17 bp, Homo sapiens
cttacacattaagcaaa

SEQ ID NO: 2162291 - DNA, 18 bp, Homo sapiens
cttattggcagctctact

SEQ ID NO: 2162292 - DNA, 21 bp, Homo sapiens
cttcaagcagaatcctcagtt

SEQ ID NO: 2162293 - DNA, 19 bp, Homo sapiens
cttctctaatagaaaagtc

SEQ ID NO: 2162294 - DNA, 18 bp, Homo sapiens
cttctttattatagtcct

SEQ ID NO: 2162295 - DNA, 15 bp, Homo sapiens
cttgaagcaacttgg

SEQ ID NO: 2162296 - DNA, 14 bp, Homo sapiens
ctttgacctgttgg

SEQ ID NO: 2162297 - DNA, 13 bp, Homo sapiens
cttttccctcact

SEQ ID NO: 2162298 - DNA, 12 bp, Homo sapiens
ctttttcatcaa

SEQ ID NO: 2162299 - DNA, 20 bp, Homo sapiens
gaaaaatgtgtattttaaga

SEQ ID NO: 2162300 - DNA, 15 bp, Homo sapiens
gaaatactcatgtgc

SEQ ID NO: 2162301 - DNA, 20 bp, Homo sapiens
gaactgctgggcttggcagc

SEQ ID NO: 2162302 - DNA, 13 bp, Homo sapiens
gaagaaaaactca

SEQ ID NO: 2162303 - DNA, 15 bp, Homo sapiens
gaagaaaacccgagg

SEQ ID NO: 2162304 - DNA, 19 bp, Homo sapiens
gaagaaaacccgagggaca

SEQ ID NO: 2162305 - DNA, 14 bp, Homo sapiens
gaagaatgtttctg

SEQ ID NO: 2162306 - DNA, 13 bp, Homo sapiens
gaaggctgcccct

SEQ ID NO: 2162307 - DNA, 19 bp, Homo sapiens
gaagtcaattactctataa

SEQ ID NO: 2162308 - DNA, 17 bp, Homo sapiens
gaagtgtgggtctgtgt

SEQ ID NO: 2162309 - DNA, 19 bp, Homo sapiens
gaagtgtgggtctgtgtgt

SEQ ID NO: 2162310 - DNA, 20 bp, Homo sapiens
gaataagtgccaggatggaa

SEQ ID NO: 2162311 - DNA, 22 bp, Homo sapiens
gaatgtattttcatagatgtgt

SEQ ID NO: 2162312 - DNA, 15 bp, Homo sapiens
gaatgtcaatatttg

SEQ ID NO: 2162313 - DNA, 17 bp, Homo sapiens
gaatgtcaatatttgag

SEQ ID NO: 2162314 - DNA, 18 bp, Homo sapiens
gaatgtcagtatgtggaa

SEQ ID NO: 2162315 - DNA, 19 bp, Homo sapiens
gaatgtcagtatgtggaag

SEQ ID NO: 2162316 - DNA, 13 bp, Homo sapiens
gactgaagaagat

SEQ ID NO: 2162317 - DNA, 21 bp, Homo sapiens
gacttctctaatagaaaagtc

SEQ ID NO: 2162318 - DNA, 11 bp, Homo sapiens
gagaaacttcc

SEQ ID NO: 2162319 - DNA, 18 bp, Homo sapiens
gagatctatgggcatttg

SEQ ID NO: 2162320 - DNA, 22 bp, Homo sapiens
gagccttgcagatatctgcatg

SEQ ID NO: 2162321 - DNA, 22 bp, Homo sapiens
gaggacagtatttgtggggagg

SEQ ID NO: 2162322 - DNA, 18 bp, Homo sapiens
gagtcagggagagctgaa

SEQ ID NO: 2162323 - DNA, 14 bp, Homo sapiens
gagtccctgccatc

SEQ ID NO: 2162324 - DNA, 14 bp, Homo sapiens
gatatctgcatgtg

SEQ ID NO: 2162325 - DNA, 13 bp, Homo sapiens
gatattggcattt

SEQ ID NO: 2162326 - DNA, 20 bp, Homo sapiens
gatgagccttgcagatatct

SEQ ID NO: 2162327 - DNA, 13 bp, Homo sapiens
gatggaatgatgg

SEQ ID NO: 2162328 - DNA, 21 bp, Homo sapiens
gattactaattattcctcttt

SEQ ID NO: 2162329 - DNA, 15 bp, Homo sapiens
gattccacaggacac

SEQ ID NO: 2162330 - DNA, 20 bp, Homo sapiens
gatttggggctcagagtggg

SEQ ID NO: 2162331 - DNA, 23 bp, Homo sapiens
gcaacaaatacctccattaaatg

SEQ ID NO: 2162332 - DNA, 16 bp, Homo sapiens
gcaacttggtccagat

SEQ ID NO: 2162333 - DNA, 15 bp, Homo sapiens
gcacagatggatttg

SEQ ID NO: 2162334 - DNA, 23 bp, Homo sapiens
gcacagatggatttgtttggacc

SEQ ID NO: 2162335 - DNA, 19 bp, Homo sapiens
gcactatctttaaacgaaa

SEQ ID NO: 2162336 - DNA, 13 bp, Homo sapiens
gcactgatgtccc

SEQ ID NO: 2162337 - DNA, 18 bp, Homo sapiens
gcagaacacatttcaaat

SEQ ID NO: 2162338 - DNA, 16 bp, Homo sapiens
gcagcccctcccagat

SEQ ID NO: 2162339 - DNA, 13 bp, Homo sapiens
gcatacaataaaa

SEQ ID NO: 2162340 - DNA, 20 bp, Homo sapiens
gcatacaataaaagagcttt

SEQ ID NO: 2162341 - DNA, 16 bp, Homo sapiens
gccactaggcccagac

SEQ ID NO: 2162342 - DNA, 22 bp, Homo sapiens
gcccagacccagcccagcctga

SEQ ID NO: 2162343 - DNA, 20 bp, Homo sapiens
gcccctgtaaggtttcaatg

SEQ ID NO: 2162344 - DNA, 20 bp, Homo sapiens
gcctctcattccagaggaag

SEQ ID NO: 2162345 - DNA, 11 bp, Homo sapiens
gcctgttcctt

SEQ ID NO: 2162346 - DNA, 20 bp, Homo sapiens
tggtgaacagaacctcccaa

SEQ ID NO: 2162347 - DNA, 15 bp, Homo sapiens
tggttaatttttcct

SEQ ID NO: 2162348 - DNA, 20 bp, Homo sapiens
tggttaatttttcctgcatg

SEQ ID NO: 2162349 - DNA, 21 bp, Homo sapiens
tggttaatttttcctgcatgt

SEQ ID NO: 2162350 - DNA, 22 bp, Homo sapiens
tggttaatttttcctgcatgtt

SEQ ID NO: 2162351 - DNA, 18 bp, Homo sapiens
tgtaatttaaaattgtga

SEQ ID NO: 2162352 - DNA, 20 bp, Homo sapiens
tgtatgtgggggtctgtgtg

SEQ ID NO: 2162353 - DNA, 22 bp, Homo sapiens
tgtatgtgggggtctgtgtgtt

SEQ ID NO: 2162354 - DNA, 13 bp, Homo sapiens
tgtcaatatttga

SEQ ID NO: 2162355 - DNA, 19 bp, Homo sapiens
tgtcagtatgtggaagtgt

SEQ ID NO: 2162356 - DNA, 15 bp, Homo sapiens
tgtcatgaagaatgt

SEQ ID NO: 2162357 - DNA, 17 bp, Homo sapiens
tgtgcacctaaaactta

SEQ ID NO: 2162358 - DNA, 13 bp, Homo sapiens
tgtgccttaaatt

SEQ ID NO: 2162359 - DNA, 17 bp, Homo sapiens
tgtgccttggtgtgctg

SEQ ID NO: 2162360 - DNA, 16 bp, Homo sapiens
tgtgccttttgccatc

SEQ ID NO: 2162361 - DNA, 16 bp, Homo sapiens
tgtgggtctgtgtgtg

SEQ ID NO: 2162362 - DNA, 11 bp, Homo sapiens
tgtgtaattta

SEQ ID NO: 2162363 - DNA, 19 bp, Homo sapiens
tgtgtaatttaaaattgtg

SEQ ID NO: 2162364 - DNA, 22 bp, Homo sapiens
tgtgtaatttaaaattgtgatg

SEQ ID NO: 2162365 - DNA, 11 bp, Homo sapiens
tgtgtatgtgg

SEQ ID NO: 2162366 - DNA, 22 bp, Homo sapiens
tgtgtcatgaagaatgtttctg

SEQ ID NO: 2162367 - DNA, 14 bp, Homo sapiens
tgtgtgggagtgtg

SEQ ID NO: 2162368 - DNA, 15 bp, Homo sapiens
tgtgtgggagtgtgt

SEQ ID NO: 2162369 - DNA, 11 bp, Homo sapiens
tgtgtgtatgt

SEQ ID NO: 2162370 - DNA, 16 bp, Homo sapiens
tgtgtgtgtgtatgtg

SEQ ID NO: 2162371 - DNA, 15 bp, Homo sapiens
tgttgtgtgtgggag

SEQ ID NO: 2162372 - DNA, 21 bp, Homo sapiens
tgtttacagaggacagtattt

SEQ ID NO: 2162373 - DNA, 19 bp, Homo sapiens
tgtttagaagaagtgtgtc

SEQ ID NO: 2162374 - DNA, 13 bp, Homo sapiens
tgtttatgtgtgt

SEQ ID NO: 2162375 - DNA, 18 bp, Homo sapiens
ttaaaattgtgatgtgtc

SEQ ID NO: 2162376 - DNA, 18 bp, Homo sapiens
ttaatttttcctgcatgt

SEQ ID NO: 2162377 - DNA, 18 bp, Homo sapiens
ttactaattattcctctt

SEQ ID NO: 2162378 - DNA, 19 bp, Homo sapiens
ttagaatattatcttcata

SEQ ID NO: 2162379 - DNA, 14 bp, Homo sapiens
ttatcaacatttgt

SEQ ID NO: 2162380 - DNA, 14 bp, Homo sapiens
ttattcacaaaaat

SEQ ID NO: 2162381 - DNA, 19 bp, Homo sapiens
ttcaaaatgatttcctctg

SEQ ID NO: 2162382 - DNA, 22 bp, Homo sapiens
ttcaaaatgatttcctctgtaa

SEQ ID NO: 2162383 - DNA, 23 bp, Homo sapiens
ttcaaaatgatttcctctgtaat

SEQ ID NO: 2162384 - DNA, 16 bp, Homo sapiens
ttcagatttgccttat

SEQ ID NO: 2162385 - DNA, 23 bp, Homo sapiens
ttcatctaatgtattatgagcca

SEQ ID NO: 2162386 - DNA, 17 bp, Homo sapiens
ttcattttgaaaaacac

SEQ ID NO: 2162387 - DNA, 20 bp, Homo sapiens
ttccaataccctagaagaaa

SEQ ID NO: 2162388 - DNA, 23 bp, Homo sapiens
ttccaataccctagaagaaaacc

SEQ ID NO: 2162389 - DNA, 21 bp, Homo sapiens
ttccacaggacacgaaggctg

SEQ ID NO: 2162390 - DNA, 23 bp, Homo sapiens
ttctggatggattttataggaaa

SEQ ID NO: 2162391 - DNA, 21 bp, Homo sapiens
ttgcactgatgtccctccttt

SEQ ID NO: 2162392 - DNA, 19 bp, Homo sapiens
ttgtaaatttatgtgatgg

SEQ ID NO: 2162393 - DNA, 13 bp, Homo sapiens
ttgtgtgtgggag

SEQ ID NO: 2162394 - DNA, 16 bp, Homo sapiens
tttacctgcaaaaaat

SEQ ID NO: 2162395 - DNA, 19 bp, Homo sapiens
tttagaagaagtgtgtcac

SEQ ID NO: 2162396 - DNA, 19 bp, Homo sapiens
tttagccccactgcttgca

SEQ ID NO: 2162397 - DNA, 21 bp, Homo sapiens
tttatccattcaactgaaaat

SEQ ID NO: 2162398 - DNA, 12 bp, Homo sapiens
tttatgtgatgg

SEQ ID NO: 2162399 - DNA, 11 bp, Homo sapiens
tttatgtgtgt

SEQ ID NO: 2162400 - DNA, 19 bp, Homo sapiens
tttcaatgcatacaataaa

SEQ ID NO: 2162401 - DNA, 13 bp, Homo sapiens
tttcctgcatgtt

SEQ ID NO: 2162402 - DNA, 15 bp, Homo sapiens
tttgagttgcaccct

SEQ ID NO: 2162403 - DNA, 12 bp, Homo sapiens
tttgatgtgcct

SEQ ID NO: 2162404 - DNA, 23 bp, Homo sapiens
tttggctctcctcagaagaaaga

SEQ ID NO: 2162405 - DNA, 13 bp, Homo sapiens
ttttcatcaaaac

SEQ ID NO: 2162406 - DNA, 14 bp, Homo sapiens
ttttcctgcatgtt

SEQ ID NO: 2162407 - DNA, 13 bp, Homo sapiens
taaaagagcttta

SEQ ID NO: 2162408 - DNA, 12 bp, Homo sapiens
taaaagtaaaca

SEQ ID NO: 2162409 - DNA, 13 bp, Homo sapiens
taaaagtaaacat

SEQ ID NO: 2162410 - DNA, 14 bp, Homo sapiens
taaaagtaaacatt

SEQ ID NO: 2162411 - DNA, 13 bp, Homo sapiens
taaagaagaaaaa

SEQ ID NO: 2162412 - DNA, 11 bp, Homo sapiens
taaagacattc

SEQ ID NO: 2162413 - DNA, 16 bp, Homo sapiens
taaatcaaaagaatgt

SEQ ID NO: 2162414 - DNA, 13 bp, Homo sapiens
taaatttatgtga

SEQ ID NO: 2162415 - DNA, 15 bp, Homo sapiens
taacagtatctcaaa

SEQ ID NO: 2162416 - DNA, 17 bp, Homo sapiens
taacagttcctttcaaa

SEQ ID NO: 2162417 - DNA, 20 bp, Homo sapiens
taattgagaagaaaaactca

SEQ ID NO: 2162418 - DNA, 16 bp, Homo sapiens
taatttaaaattgtga

SEQ ID NO: 2162419 - DNA, 19 bp, Homo sapiens
taatttaaaattgtgatgt

SEQ ID NO: 2162420 - DNA, 20 bp, Homo sapiens
taatttaaaattgtgatgtg

SEQ ID NO: 2162421 - DNA, 23 bp, Homo sapiens
actggccagtggctggatctgtg

SEQ ID NO: 2162422 - DNA, 22 bp, Homo sapiens
agaaaattaagggccgatttaa

SEQ ID NO: 2162423 - DNA, 15 bp, Homo sapiens
agaaatactcatgtg

SEQ ID NO: 2162424 - DNA, 14 bp, Homo sapiens
agaacagtaaacat

SEQ ID NO: 2162425 - DNA, 18 bp, Homo sapiens
agaatattatcttcataa

SEQ ID NO: 2162426 - DNA, 20 bp, Homo sapiens
agaatgtcaatatttgagca

SEQ ID NO: 2162427 - DNA, 13 bp, Homo sapiens
agaatgtcagtat

SEQ ID NO: 2162428 - DNA, 17 bp, Homo sapiens
agaatgtcagtatgtgg

SEQ ID NO: 2162429 - DNA, 23 bp, Homo sapiens
agaattaagaaatactcatgtgc

SEQ ID NO: 2162430 - DNA, 17 bp, Homo sapiens
agagaatgtattttcat

SEQ ID NO: 2162431 - DNA, 18 bp, Homo sapiens
agagatctatgggcattt

SEQ ID NO: 2162432 - DNA, 22 bp, Homo sapiens
agagtgccttatttcctttcca

SEQ ID NO: 2162433 - DNA, 18 bp, Homo sapiens
agatactcttattttact

SEQ ID NO: 2162434 - DNA, 18 bp, Homo sapiens
agatagaatgtcaatatt

SEQ ID NO: 2162435 - DNA, 15 bp, Homo sapiens
agatatctgcatgtg

SEQ ID NO: 2162436 - DNA, 18 bp, Homo sapiens
agatatctgcatgtgtca

SEQ ID NO: 2162437 - DNA, 16 bp, Homo sapiens
agatctatgggcattt

SEQ ID NO: 2162438 - DNA, 14 bp, Homo sapiens
agattccacaggac

SEQ ID NO: 2162439 - DNA, 13 bp, Homo sapiens
agcagattccaca

SEQ ID NO: 2162440 - DNA, 15 bp, Homo sapiens
agcagattccacagg

SEQ ID NO: 2162441 - DNA, 16 bp, Homo sapiens
agcagattccacagga

SEQ ID NO: 2162442 - DNA, 10 bp, Homo sapiens
aaaaaaagaa

SEQ ID NO: 2162443 - DNA, 19 bp, Homo sapiens
aaaacccgagggacagcag

SEQ ID NO: 2162444 - DNA, 13 bp, Homo sapiens
aaaagagctttat

SEQ ID NO: 2162445 - DNA, 16 bp, Homo sapiens
aaaagagctttatccc

SEQ ID NO: 2162446 - DNA, 13 bp, Homo sapiens
aaaagtagcaatt

SEQ ID NO: 2162447 - DNA, 11 bp, Homo sapiens
aaaagtgtcct

SEQ ID NO: 2162448 - DNA, 16 bp, Homo sapiens
aaaattttgtttataa

SEQ ID NO: 2162449 - DNA, 22 bp, Homo sapiens
aaacaggtcaatgaatgaaact

SEQ ID NO: 2162450 - DNA, 19 bp, Homo sapiens
aaactaaagaaatttctca

SEQ ID NO: 2162451 - DNA, 15 bp, Homo sapiens
aaacttaagccaatt

SEQ ID NO: 2162452 - DNA, 18 bp, Homo sapiens
aaagaaaaaaaagaaagc

SEQ ID NO: 2162453 - DNA, 14 bp, Homo sapiens
aaagagagattttt

SEQ ID NO: 2162454 - DNA, 20 bp, Homo sapiens
aaatcaaaagaatgtccaat

SEQ ID NO: 2162455 - DNA, 21 bp, Homo sapiens
aaatgatttcctctgtaatct

SEQ ID NO: 2162456 - DNA, 11 bp, Homo sapiens
aacaaaaataa

SEQ ID NO: 2162457 - DNA, 16 bp, Homo sapiens
aacacatcacagatga

SEQ ID NO: 2162458 - DNA, 15 bp, Homo sapiens
aaccatgacgcaaag

SEQ ID NO: 2162459 - DNA, 14 bp, Homo sapiens
aaccctccacccct

SEQ ID NO: 2162460 - DNA, 15 bp, Homo sapiens
aaccctccaccccta

SEQ ID NO: 2162461 - DNA, 10 bp, Homo sapiens
aactcaggtt

SEQ ID NO: 2162462 - DNA, 17 bp, Homo sapiens
aagaaaaaaaagaaagc

SEQ ID NO: 2162463 - DNA, 16 bp, Homo sapiens
aagaaagcatagacat

SEQ ID NO: 2162464 - DNA, 13 bp, Homo sapiens
aagagaaacttcc

SEQ ID NO: 2162465 - DNA, 15 bp, Homo sapiens
aagagaggacacaaa

SEQ ID NO: 2162466 - DNA, 19 bp, Homo sapiens
aagatgagccttgcagata

SEQ ID NO: 2162467 - DNA, 19 bp, Homo sapiens
aagcaacttggtccagatt

SEQ ID NO: 2162468 - DNA, 21 bp, Homo sapiens
aagccaatttcaatcttattt

SEQ ID NO: 2162469 - DNA, 16 bp, Homo sapiens
aaggctgcccctgtaa

SEQ ID NO: 2162470 - DNA, 13 bp, Homo sapiens
aaggtttcaatgc

SEQ ID NO: 2162471 - DNA, 14 bp, Homo sapiens
aagtctccacccct

SEQ ID NO: 2162472 - DNA, 19 bp, Homo sapiens
aagtctccacccctacaca

SEQ ID NO: 2162473 - DNA, 17 bp, Homo sapiens
aataagtgccaggatgg

SEQ ID NO: 2162474 - DNA, 15 bp, Homo sapiens
aatacacaagtaaac

SEQ ID NO: 2162475 - DNA, 20 bp, Homo sapiens
aatgaaactagaaagcagag

SEQ ID NO: 2162476 - DNA, 20 bp, Homo sapiens
aatgatttcctctgtaatct

SEQ ID NO: 2162477 - DNA, 18 bp, Homo sapiens
aatgcatacaataaaaga

SEQ ID NO: 2162478 - DNA, 19 bp, Homo sapiens
aatgcatacaataaaagag

SEQ ID NO: 2162479 - DNA, 20 bp, Homo sapiens
aatgcatacaataaaagagc

SEQ ID NO: 2162480 - DNA, 23 bp, Homo sapiens
aatggttaatttttcctgcatgt

SEQ ID NO: 2162481 - DNA, 16 bp, Homo sapiens
aatgtattatgagcca

SEQ ID NO: 2162482 - DNA, 15 bp, Homo sapiens
aatgtcagtatgtgg

SEQ ID NO: 2162483 - DNA, 23 bp, Homo sapiens
aattaagaaatactcatgtgcaa

SEQ ID NO: 2162484 - DNA, 18 bp, Homo sapiens
aattattcctctttgccc

SEQ ID NO: 2162485 - DNA, 14 bp, Homo sapiens
aatttatgtgatgg

SEQ ID NO: 2162486 - DNA, 11 bp, Homo sapiens
aatttcaaggt

SEQ ID NO: 2162487 - DNA, 14 bp, Homo sapiens
aatttttcctgcat

SEQ ID NO: 2162488 - DNA, 12 bp, Homo sapiens
acaaaaataaca

SEQ ID NO: 2162489 - DNA, 22 bp, Homo sapiens
acaaatacctccattaaatggt

SEQ ID NO: 2162490 - DNA, 12 bp, Homo sapiens
acaataaaagag

SEQ ID NO: 2162491 - DNA, 15 bp, Homo sapiens
acacatcacagatga

SEQ ID NO: 2162492 - DNA, 22 bp, Homo sapiens
taacttaaaagaacatgtatat

SEQ ID NO: 2162493 - DNA, 16 bp, Homo sapiens
taagaaatactcatgt

SEQ ID NO: 2162494 - DNA, 15 bp, Homo sapiens
taagccaatttcaat

SEQ ID NO: 2162495 - DNA, 14 bp, Homo sapiens
taaggtttcaatgc

SEQ ID NO: 2162496 - DNA, 22 bp, Homo sapiens
taagtgccaggatggaatgatg

SEQ ID NO: 2162497 - DNA, 11 bp, Homo sapiens
taatattccaa

SEQ ID NO: 2162498 - DNA, 20 bp, Homo sapiens
taatgagcagcccctcccag

SEQ ID NO: 2162499 - DNA, 16 bp, Homo sapiens
taatgtattatgagcc

SEQ ID NO: 2162500 - DNA, 19 bp, Homo sapiens
taattctcagaaaggcaag

SEQ ID NO: 2162501 - DNA, 15 bp, Homo sapiens
taatttaaaattgtg

SEQ ID NO: 2162502 - DNA, 17 bp, Homo sapiens
taatttttcctgcatgt

SEQ ID NO: 2162503 - DNA, 18 bp, Homo sapiens
taatttttcctgcatgtt

SEQ ID NO: 2162504 - DNA, 21 bp, Homo sapiens
taatttttcctgcatgttctg

SEQ ID NO: 2162505 - DNA, 16 bp, Homo sapiens
tacacaagtaaacatt

SEQ ID NO: 2162506 - DNA, 14 bp, Homo sapiens
tacagaggacagta

SEQ ID NO: 2162507 - DNA, 22 bp, Homo sapiens
tacatgcccatcccagtgtcct

SEQ ID NO: 2162508 - DNA, 15 bp, Homo sapiens
tacccccaaccctca

SEQ ID NO: 2162509 - DNA, 17 bp, Homo sapiens
taccctagaagaaaacc

SEQ ID NO: 2162510 - DNA, 18 bp, Homo sapiens
taccctagaagaaaaccc

SEQ ID NO: 2162511 - DNA, 19 bp, Homo sapiens
taccctagaagaaaacccg

SEQ ID NO: 2162512 - DNA, 17 bp, Homo sapiens
tagaaagcagagatttt

SEQ ID NO: 2162513 - DNA, 14 bp, Homo sapiens
tagaagaagtgtgt

SEQ ID NO: 2162514 - DNA, 20 bp, Homo sapiens
tagagatctatgggcatttg

SEQ ID NO: 2162515 - DNA, 22 bp, Homo sapiens
tagagatctatgggcatttggt

SEQ ID NO: 2162516 - DNA, 18 bp, Homo sapiens
tagcataaacacatcaca

SEQ ID NO: 2162517 - DNA, 18 bp, Homo sapiens
taggatattggcatttgt

SEQ ID NO: 2162518 - DNA, 23 bp, Homo sapiens
taggcccagacccagcccagcct

SEQ ID NO: 2162519 - DNA, 13 bp, Homo sapiens
tagtattttctaa

SEQ ID NO: 2162520 - DNA, 14 bp, Homo sapiens
tagtattttctaaa

SEQ ID NO: 2162521 - DNA, 22 bp, Homo sapiens
tataaacatgcttgcattatat

SEQ ID NO: 2162522 - DNA, 13 bp, Homo sapiens
tataatgattatt

SEQ ID NO: 2162523 - DNA, 18 bp, Homo sapiens
tatactttaaataatggt

SEQ ID NO: 2162524 - DNA, 16 bp, Homo sapiens
tatagtcctatagttt

SEQ ID NO: 2162525 - DNA, 15 bp, Homo sapiens
tatcagcacgtgtgg

SEQ ID NO: 2162526 - DNA, 15 bp, Homo sapiens
tatctgcatgtgtca

SEQ ID NO: 2162527 - DNA, 17 bp, Homo sapiens
tatctgcatgtgtcatg

SEQ ID NO: 2162528 - DNA, 24 bp, Homo sapiens
tatctttaaacgaaacaaagacaa

SEQ ID NO: 2162529 - DNA, 18 bp, Homo sapiens
tatggggatagatgtgtg

SEQ ID NO: 2162530 - DNA, 19 bp, Homo sapiens
tatggggatagatgtgtgg

SEQ ID NO: 2162531 - DNA, 19 bp, Homo sapiens
tatgtgggggtctgtgtgt

SEQ ID NO: 2162532 - DNA, 14 bp, Homo sapiens
tatgtgtgtgtgtt

SEQ ID NO: 2162533 - DNA, 13 bp, Homo sapiens
tattaaaaaacaa

SEQ ID NO: 2162534 - DNA, 20 bp, Homo sapiens
tattacttcctcaataaaaa

SEQ ID NO: 2162535 - DNA, 12 bp, Homo sapiens
tattatgagcca

SEQ ID NO: 2162536 - DNA, 17 bp, Homo sapiens
tattcaataagagatta

SEQ ID NO: 2162537 - DNA, 13 bp, Homo sapiens
tattggcatttgt

SEQ ID NO: 2162538 - DNA, 23 bp, Homo sapiens
tatttgtaaaagaacagtaaaca

SEQ ID NO: 2162539 - DNA, 16 bp, Homo sapiens
tatttgtaaatttatg

SEQ ID NO: 2162540 - DNA, 17 bp, Homo sapiens
tatttgtaaatttatgt

SEQ ID NO: 2162541 - DNA, 18 bp, Homo sapiens
tattttgggcctgttcct

SEQ ID NO: 2162542 - DNA, 22 bp, Homo sapiens
tcaaaatgatttcctctgtaat

SEQ ID NO: 2162543 - DNA, 19 bp, Homo sapiens
tcaacctgttcatcttgaa

SEQ ID NO: 2162544 - DNA, 17 bp, Homo sapiens
tcaatgcatacaataaa

SEQ ID NO: 2162545 - DNA, 20 bp, Homo sapiens
tcagatcattatcagcctgt

SEQ ID NO: 2162546 - DNA, 22 bp, Homo sapiens
tcagatttgccttattggcagc

SEQ ID NO: 2162547 - DNA, 12 bp, Homo sapiens
tcagtatgtgga

SEQ ID NO: 2162548 - DNA, 21 bp, Homo sapiens
tcatcttgtctaagaccccca

SEQ ID NO: 2162549 - DNA, 17 bp, Homo sapiens
tccacacacataatggc

SEQ ID NO: 2162550 - DNA, 21 bp, Homo sapiens
tccacaggacacgaaggctgc

SEQ ID NO: 2162551 - DNA, 17 bp, Homo sapiens
tccacatgacagaacca

SEQ ID NO: 2162552 - DNA, 14 bp, Homo sapiens
tccacccctacaca

SEQ ID NO: 2162553 - DNA, 20 bp, Homo sapiens
tccagattgaaaagtgtcct

SEQ ID NO: 2162554 - DNA, 13 bp, Homo sapiens
tcccaaatttgag

SEQ ID NO: 2162555 - DNA, 16 bp, Homo sapiens
tcctcagttggaatca

SEQ ID NO: 2162556 - DNA, 22 bp, Homo sapiens
tcctgttaggtattagaaagtg

SEQ ID NO: 2162557 - DNA, 23 bp, Homo sapiens
tcctttccaagtatttcacagca

SEQ ID NO: 2162558 - DNA, 19 bp, Homo sapiens
tctaatagaaaagtctcca

SEQ ID NO: 2162559 - DNA, 15 bp, Homo sapiens
tctacctcttggctg

SEQ ID NO: 2162560 - DNA, 15 bp, Homo sapiens
tctatgggcatttgg

SEQ ID NO: 2162561 - DNA, 16 bp, Homo sapiens
tctccacccctacaca

SEQ ID NO: 2162562 - DNA, 15 bp, Homo sapiens
tctgtgtgtgtgtat

SEQ ID NO: 2162563 - DNA, 21 bp, Homo sapiens
tctgtgtgtgtgtatgtgggg

SEQ ID NO: 2162564 - DNA, 20 bp, Homo sapiens
tctgtgtgtttatgtgtgtg

SEQ ID NO: 2162565 - DNA, 19 bp, Homo sapiens
tcttgtctaagacccccat

SEQ ID NO: 2162566 - DNA, 12 bp, Homo sapiens
tctttagcccca

SEQ ID NO: 2162567 - DNA, 14 bp, Homo sapiens
tgaaaagtgtcctc

SEQ ID NO: 2162568 - DNA, 17 bp, Homo sapiens
tgaacagaacctcccaa

SEQ ID NO: 2162569 - DNA, 15 bp, Homo sapiens
tgaagaagatgagcc

SEQ ID NO: 2162570 - DNA, 15 bp, Homo sapiens
tgagccttgcagata

SEQ ID NO: 2162571 - DNA, 22 bp, Homo sapiens
tgagccttgcagatatctgcat

SEQ ID NO: 2162572 - DNA, 15 bp, Homo sapiens
tgagcgtgacactca

SEQ ID NO: 2162573 - DNA, 22 bp, Homo sapiens
tgagggtgactatggagctgag

SEQ ID NO: 2162574 - DNA, 14 bp, Homo sapiens
tgagttggctggga

SEQ ID NO: 2162575 - DNA, 17 bp, Homo sapiens
tgagttggctgggaata

SEQ ID NO: 2162576 - DNA, 15 bp, Homo sapiens
tgatgggtcagttgt

SEQ ID NO: 2162577 - DNA, 21 bp, Homo sapiens
tgcagaacacatttcaaatga

SEQ ID NO: 2162578 - DNA, 16 bp, Homo sapiens
tgcagatatctgcatg

SEQ ID NO: 2162579 - DNA, 17 bp, Homo sapiens
tgcagatatctgcatgt

SEQ ID NO: 2162580 - DNA, 12 bp, Homo sapiens
tgcatacaataa

SEQ ID NO: 2162581 - DNA, 19 bp, Homo sapiens
tgcatacaataaaagagct

SEQ ID NO: 2162582 - DNA, 19 bp, Homo sapiens
tgccttgtgaaggaattat

SEQ ID NO: 2162583 - DNA, 20 bp, Homo sapiens
tgctatgagctggggatgtc

SEQ ID NO: 2162584 - DNA, 18 bp, Homo sapiens
tgctattgtagagccaga

SEQ ID NO: 2162585 - DNA, 19 bp, Homo sapiens
tgctggtctttagccccac

SEQ ID NO: 2162586 - DNA, 15 bp, Homo sapiens
tgctgtagacatttg

SEQ ID NO: 2162587 - DNA, 23 bp, Homo sapiens
tgctgtatccatccatggggctg

SEQ ID NO: 2162588 - DNA, 14 bp, Homo sapiens
tggaagtgtgggtc

SEQ ID NO: 2162589 - DNA, 21 bp, Homo sapiens
tggaagtgtgggtctgtgtgt

SEQ ID NO: 2162590 - DNA, 22 bp, Homo sapiens
tggacctttcctgaggaagagg

SEQ ID NO: 2162591 - DNA, 15 bp, Homo sapiens
tggatctgtgagggg

SEQ ID NO: 2162592 - DNA, 18 bp, Homo sapiens
tggccaagagaaacttcc

SEQ ID NO: 2162593 - DNA, 20 bp, Homo sapiens
tggccaagagaaacttccta

SEQ ID NO: 2162594 - DNA, 14 bp, Homo sapiens
tggccagtggctgg

SEQ ID NO: 2162595 - DNA, 23 bp, Homo sapiens
tggccagtggctggatctgtgag

SEQ ID NO: 2162596 - DNA, 14 bp, Homo sapiens
tgggcctgttcctt

SEQ ID NO: 2162597 - DNA, 14 bp, Homo sapiens
tggggagggatttg

SEQ ID NO: 2162598 - DNA, 22 bp, Homo sapiens
tggggagggatttggggctcag

SEQ ID NO: 2162599 - DNA, 15 bp, Homo sapiens
tggggctcagagtgg

SEQ ID NO: 2162600 - DNA, 15 bp, Homo sapiens
tgggggtctgtgtgt

SEQ ID NO: 2162601 - DNA, 15 bp, Homo sapiens
tgggtctgtgtgtgt

SEQ ID NO: 2162602 - DNA, 20 bp, Homo sapiens
agttgtatcagcacgtgtgg

SEQ ID NO: 2162603 - DNA, 12 bp, Homo sapiens
ataaaagagctt

SEQ ID NO: 2162604 - DNA, 15 bp, Homo sapiens
ataaaagagctttat

SEQ ID NO: 2162605 - DNA, 19 bp, Homo sapiens
ataaacaggtcaatgaatg

SEQ ID NO: 2162606 - DNA, 20 bp, Homo sapiens
ataaacgcgggaaaaaagat

SEQ ID NO: 2162607 - DNA, 21 bp, Homo sapiens
ataaatctaataattattcat

SEQ ID NO: 2162608 - DNA, 11 bp, Homo sapiens
atacaataaaa

SEQ ID NO: 2162609 - DNA, 16 bp, Homo sapiens
atacaataaaagagct

SEQ ID NO: 2162610 - DNA, 15 bp, Homo sapiens
atacacaagtaaaca

SEQ ID NO: 2162611 - DNA, 18 bp, Homo sapiens
ataccctagaagaaaacc

SEQ ID NO: 2162612 - DNA, 16 bp, Homo sapiens
atactagccccccagt

SEQ ID NO: 2162613 - DNA, 14 bp, Homo sapiens
atactcatgtgcaa

SEQ ID NO: 2162614 - DNA, 19 bp, Homo sapiens
atagaaaagtctccacccc

SEQ ID NO: 2162615 - DNA, 14 bp, Homo sapiens
atatctgcatgtgt

SEQ ID NO: 2162616 - DNA, 17 bp, Homo sapiens
atatctgcatgtgtcat

SEQ ID NO: 2162617 - DNA, 17 bp, Homo sapiens
atattaaggtagttatt

SEQ ID NO: 2162618 - DNA, 20 bp, Homo sapiens
atatttgtaaatttatgtga

SEQ ID NO: 2162619 - DNA, 21 bp, Homo sapiens
atcaaaacctttcaaatatca

SEQ ID NO: 2162620 - DNA, 14 bp, Homo sapiens
atcaaaagaatgtc

SEQ ID NO: 2162621 - DNA, 23 bp, Homo sapiens
atcccagtttaatattccaatac

SEQ ID NO: 2162622 - DNA, 15 bp, Homo sapiens
atctatgggcatttg

SEQ ID NO: 2162623 - DNA, 18 bp, Homo sapiens
atctatgggcatttggtg

SEQ ID NO: 2162624 - DNA, 16 bp, Homo sapiens
atctgtacctctgcct

SEQ ID NO: 2162625 - DNA, 21 bp, Homo sapiens
atctgtgaggggctctctcat

SEQ ID NO: 2162626 - DNA, 22 bp, Homo sapiens
atctgtgaggggctctctcatg

SEQ ID NO: 2162627 - DNA, 20 bp, Homo sapiens
atgaaaaacaaaaataacat

SEQ ID NO: 2162628 - DNA, 16 bp, Homo sapiens
atgatgggtcagttgt

SEQ ID NO: 2162629 - DNA, 20 bp, Homo sapiens
atgattatttttttctgtaa

SEQ ID NO: 2162630 - DNA, 12 bp, Homo sapiens
atgcaaaaagaa

SEQ ID NO: 2162631 - DNA, 21 bp, Homo sapiens
atgctaattctcagaaaggca

SEQ ID NO: 2162632 - DNA, 15 bp, Homo sapiens
atgcttacaaaaaag

SEQ ID NO: 2162633 - DNA, 21 bp, Homo sapiens
atggaatgatgggtcagttgt

SEQ ID NO: 2162634 - DNA, 17 bp, Homo sapiens
atgtatataaacatgct

SEQ ID NO: 2162635 - DNA, 14 bp, Homo sapiens
atgtatgattacat

SEQ ID NO: 2162636 - DNA, 15 bp, Homo sapiens
atgtattatgagcca

SEQ ID NO: 2162637 - DNA, 15 bp, Homo sapiens
atgtcaatatttgag

SEQ ID NO: 2162638 - DNA, 16 bp, Homo sapiens
atgtcaatatttgagc

SEQ ID NO: 2162639 - DNA, 19 bp, Homo sapiens
atgtccaatggtaggaatt

SEQ ID NO: 2162640 - DNA, 16 bp, Homo sapiens
atgtgggggtctgtgt

SEQ ID NO: 2162641 - DNA, 18 bp, Homo sapiens
atgtgtgtgtgttgtgtg

SEQ ID NO: 2162642 - DNA, 23 bp, Homo sapiens
atgtgtgtgtgttgtgtgtggga

SEQ ID NO: 2162643 - DNA, 19 bp, Homo sapiens
atgtttacagaggacagta

SEQ ID NO: 2162644 - DNA, 17 bp, Homo sapiens
atgttttccttgccaaa

SEQ ID NO: 2162645 - DNA, 16 bp, Homo sapiens
attactgaaaacttca

SEQ ID NO: 2162646 - DNA, 11 bp, Homo sapiens
attatgagcca

SEQ ID NO: 2162647 - DNA, 15 bp, Homo sapiens
attcacaaaaattga

SEQ ID NO: 2162648 - DNA, 15 bp, Homo sapiens
attcatctaatgtat

SEQ ID NO: 2162649 - DNA, 14 bp, Homo sapiens
attcatttaagtca

SEQ ID NO: 2162650 - DNA, 22 bp, Homo sapiens
attccacaggacacgaaggctg

SEQ ID NO: 2162651 - DNA, 16 bp, Homo sapiens
attctcagaaaggcaa

SEQ ID NO: 2162652 - DNA, 19 bp, Homo sapiens
attctttgacctgttggga

SEQ ID NO: 2162653 - DNA, 18 bp, Homo sapiens
attgagaagaaaaactca

SEQ ID NO: 2162654 - DNA, 21 bp, Homo sapiens
attgagaagaaaaactcaatt

SEQ ID NO: 2162655 - DNA, 18 bp, Homo sapiens
attggtatcaagaaagtc

SEQ ID NO: 2162656 - DNA, 17 bp, Homo sapiens
attgtagagccagaggt

SEQ ID NO: 2162657 - DNA, 18 bp, Homo sapiens
attgtagagccagaggtc

SEQ ID NO: 2162658 - DNA, 20 bp, Homo sapiens
atttaaaattgtgatgtgtc

SEQ ID NO: 2162659 - DNA, 16 bp, Homo sapiens
atttccaactcaggtt

SEQ ID NO: 2162660 - DNA, 13 bp, Homo sapiens
atttcttctttat

SEQ ID NO: 2162661 - DNA, 16 bp, Homo sapiens
atttgctatgagctgg

SEQ ID NO: 2162662 - DNA, 20 bp, Homo sapiens
atttgctatgagctggggat

SEQ ID NO: 2162663 - DNA, 23 bp, Homo sapiens
atttgtaaaagaacagtaaacat

SEQ ID NO: 2162664 - DNA, 18 bp, Homo sapiens
atttgtaaatttatgtga

SEQ ID NO: 2162665 - DNA, 17 bp, Homo sapiens
attttataggaaaaaat

SEQ ID NO: 2162666 - DNA, 23 bp, Homo sapiens
attttcttgatgtagcagaatat

SEQ ID NO: 2162667 - DNA, 12 bp, Homo sapiens
atttttctcatg

SEQ ID NO: 2162668 - DNA, 18 bp, Homo sapiens
caaacaattgaagtcaat

SEQ ID NO: 2162669 - DNA, 12 bp, Homo sapiens
caacaacttttc

SEQ ID NO: 2162670 - DNA, 21 bp, Homo sapiens
caacaacttttccctcactgt

SEQ ID NO: 2162671 - DNA, 14 bp, Homo sapiens
caacactctacttg

SEQ ID NO: 2162672 - DNA, 14 bp, Homo sapiens
caagagaaacttcc

SEQ ID NO: 2162673 - DNA, 17 bp, Homo sapiens
caataccctagaagaaa

SEQ ID NO: 2162674 - DNA, 21 bp, Homo sapiens
caataccctagaagaaaaccc

SEQ ID NO: 2162675 - DNA, 23 bp, Homo sapiens
caataccctagaagaaaacccga

SEQ ID NO: 2162676 - DNA, 23 bp, Homo sapiens
caatgaaatacacaagtaaacat

SEQ ID NO: 2162677 - DNA, 16 bp, Homo sapiens
caatgcatacaataaa

SEQ ID NO: 2162678 - DNA, 20 bp, Homo sapiens
caatgcatacaataaaagag

SEQ ID NO: 2162679 - DNA, 18 bp, Homo sapiens
caattatggaaaaaaaat

SEQ ID NO: 2162680 - DNA, 17 bp, Homo sapiens
cacagtccctcacctcc

SEQ ID NO: 2162681 - DNA, 14 bp, Homo sapiens
cactaggcccagac

SEQ ID NO: 2162682 - DNA, 17 bp, Homo sapiens
cactaggcccagaccca

SEQ ID NO: 2162683 - DNA, 18 bp, Homo sapiens
cactcaaccatgacctca

SEQ ID NO: 2162684 - DNA, 19 bp, Homo sapiens
cactgatgtccctcctttt

SEQ ID NO: 2162685 - DNA, 19 bp, Homo sapiens
cagaacacatttcaaatga

SEQ ID NO: 2162686 - DNA, 11 bp, Homo sapiens
cagaagaaaga

SEQ ID NO: 2162687 - DNA, 23 bp, Homo sapiens
cagaatcctcagttggaatcatt

SEQ ID NO: 2162688 - DNA, 15 bp, Homo sapiens
cagatatctgcatgt

SEQ ID NO: 2162689 - DNA, 16 bp, Homo sapiens
cagatatctgcatgtg

SEQ ID NO: 2162690 - DNA, 13 bp, Homo sapiens
cagatatttgaga

SEQ ID NO: 2162691 - DNA, 15 bp, Homo sapiens
cagattgaaaagtgt

SEQ ID NO: 2162692 - DNA, 17 bp, Homo sapiens
cagcacgtgtggcctgt

SEQ ID NO: 2162693 - DNA, 20 bp, Homo sapiens
cagcagattccacaggacac

SEQ ID NO: 2162694 - DNA, 21 bp, Homo sapiens
caggacacgaaggctgcccct

SEQ ID NO: 2162695 - DNA, 15 bp, Homo sapiens
caggagtccctgcca

SEQ ID NO: 2162696 - DNA, 18 bp, Homo sapiens
cagggctgaggcctctca

SEQ ID NO: 2162697 - DNA, 12 bp, Homo sapiens
cagtatgtggaa

SEQ ID NO: 2162698 - DNA, 22 bp, Homo sapiens
cagtctttaatctgagaggcca

SEQ ID NO: 2162699 - DNA, 16 bp, Homo sapiens
cagtggctggatctgt

SEQ ID NO: 2162700 - DNA, 15 bp, Homo sapiens
cagttcctttcaaag

SEQ ID NO: 2162701 - DNA, 15 bp, Homo sapiens
catacaataaaagag

SEQ ID NO: 2162702 - DNA, 21 bp, Homo sapiens
catacaataaaagagctttat

SEQ ID NO: 2162703 - DNA, 14 bp, Homo sapiens
catcccagtgtcct

SEQ ID NO: 2162704 - DNA, 19 bp, Homo sapiens
catggggctgattgtattt

SEQ ID NO: 2162705 - DNA, 24 bp, Homo sapiens
catgtgtcatgaagaatgtttctg

SEQ ID NO: 2162706 - DNA, 21 bp, Homo sapiens
cattacctcagtgagaagcca

SEQ ID NO: 2162707 - DNA, 19 bp, Homo sapiens
cattgtccctgaagagaag

SEQ ID NO: 2162708 - DNA, 14 bp, Homo sapiens
catttcaaaatgat

SEQ ID NO: 2162709 - DNA, 20 bp, Homo sapiens
ccaaattgctgggattacag

SEQ ID NO: 2162710 - DNA, 13 bp, Homo sapiens
ccaaatttgagtt

SEQ ID NO: 2162711 - DNA, 19 bp, Homo sapiens
ccaatggtaggaatttcaa

SEQ ID NO: 2162712 - DNA, 20 bp, Homo sapiens
gagagacttgtgctcaagga

SEQ ID NO: 2162713 - DNA, 17 bp, Homo sapiens
gagctctgtatggtcag

SEQ ID NO: 2162714 - DNA, 17 bp, Homo sapiens
gatctgccattgggacc

SEQ ID NO: 2162715 - DNA, 14 bp, Homo sapiens
gatgagttaactgt

SEQ ID NO: 2162716 - DNA, 12 bp, Homo sapiens
gattgagaagcc

SEQ ID NO: 2162717 - DNA, 18 bp, Homo sapiens
aatctggcttagtgccac

SEQ ID NO: 2162718 - DNA, 20 bp, Homo sapiens
aatgcctcttaaattatata

SEQ ID NO: 2162719 - DNA, 18 bp, Homo sapiens
acaaagattgagaagcca

SEQ ID NO: 2162720 - DNA, 14 bp, Homo sapiens
acaactatttttgt

SEQ ID NO: 2162721 - DNA, 15 bp, Homo sapiens
acaacttgtatttcc

SEQ ID NO: 2162722 - DNA, 16 bp, Homo sapiens
acaacttgtatttcca

SEQ ID NO: 2162723 - DNA, 18 bp, Homo sapiens
acaatctaacaataatat

SEQ ID NO: 2162724 - DNA, 21 bp, Homo sapiens
acaatctaacaataatatttc

SEQ ID NO: 2162725 - DNA, 16 bp, Homo sapiens
acacttatcttctgga

SEQ ID NO: 2162726 - DNA, 20 bp, Homo sapiens
acatttctctaactcctgcc

SEQ ID NO: 2162727 - DNA, 20 bp, Homo sapiens
accaaaccccacttcccctc

SEQ ID NO: 2162728 - DNA, 17 bp, Homo sapiens
accacaagcctgagaac

SEQ ID NO: 2162729 - DNA, 20 bp, Homo sapiens
accagagccttcaagtgcca

SEQ ID NO: 2162730 - DNA, 23 bp, Homo sapiens
actcaagtaccaccaagggatct

SEQ ID NO: 2162731 - DNA, 20 bp, Homo sapiens
actcctcatccccacaatct

SEQ ID NO: 2162732 - DNA, 24 bp, Homo sapiens
actgaaaaaaaaaaagaagaagaa

SEQ ID NO: 2162733 - DNA, 15 bp, Homo sapiens
actgcagaggggaaa

SEQ ID NO: 2162734 - DNA, 14 bp, Homo sapiens
actgctacctctga

SEQ ID NO: 2162735 - DNA, 13 bp, Homo sapiens
actggaagaaagc

SEQ ID NO: 2162736 - DNA, 20 bp, Homo sapiens
actgtgaaataccacaagcc

SEQ ID NO: 2162737 - DNA, 17 bp, Homo sapiens
actgttactttggcaat

SEQ ID NO: 2162738 - DNA, 18 bp, Homo sapiens
acttcagtcttgcctagg

SEQ ID NO: 2162739 - DNA, 15 bp, Homo sapiens
acttggtcagagcca

SEQ ID NO: 2162740 - DNA, 16 bp, Homo sapiens
acttggtcagagccac

SEQ ID NO: 2162741 - DNA, 14 bp, Homo sapiens
acttgtatttccaa

SEQ ID NO: 2162742 - DNA, 20 bp, Homo sapiens
actttgcaatccaaataaag

SEQ ID NO: 2162743 - DNA, 22 bp, Homo sapiens
agaagaaagcaaaagcaaggga

SEQ ID NO: 2162744 - DNA, 12 bp, Homo sapiens
agaagaaggaga

SEQ ID NO: 2162745 - DNA, 23 bp, Homo sapiens
agaagacacaaggtgatttcaga

SEQ ID NO: 2162746 - DNA, 10 bp, Homo sapiens
agacatttct

SEQ ID NO: 2162747 - DNA, 21 bp, Homo sapiens
agactgcagaggggaaagact

SEQ ID NO: 2162748 - DNA, 15 bp, Homo sapiens
agactgttactttgg

SEQ ID NO: 2162749 - DNA, 16 bp, Homo sapiens
agagccactctatgag

SEQ ID NO: 2162750 - DNA, 15 bp, Homo sapiens
agagccttcaagtgc

SEQ ID NO: 2162751 - DNA, 17 bp, Homo sapiens
agagccttcaagtgcca

SEQ ID NO: 2162752 - DNA, 19 bp, Homo sapiens
agagccttcaagtgccaaa

SEQ ID NO: 2162753 - DNA, 20 bp, Homo sapiens
agaggacagtctggagaagg

SEQ ID NO: 2162754 - DNA, 13 bp, Homo sapiens
agattgagaagcc

SEQ ID NO: 2162755 - DNA, 14 bp, Homo sapiens
agattgagaagcca

SEQ ID NO: 2162756 - DNA, 15 bp, Homo sapiens
agattgagaagccat

SEQ ID NO: 2162757 - DNA, 18 bp, Homo sapiens
agatttgtgaactggaag

SEQ ID NO: 2162758 - DNA, 16 bp, Homo sapiens
agcaaaaggctgagaa

SEQ ID NO: 2162759 - DNA, 22 bp, Homo sapiens
agcaagaaggaaagatttgtga

SEQ ID NO: 2162760 - DNA, 19 bp, Homo sapiens
agcaagggaccttcatgcc

SEQ ID NO: 2162761 - DNA, 23 bp, Homo sapiens
agcaagggaccttcatgcccttc

SEQ ID NO: 2162762 - DNA, 13 bp, Homo sapiens
agccttcaagtgc

SEQ ID NO: 2162763 - DNA, 17 bp, Homo sapiens
agccttcaagtgccaaa

SEQ ID NO: 2162764 - DNA, 13 bp, Homo sapiens
agctgactgttct

SEQ ID NO: 2162765 - DNA, 16 bp, Homo sapiens
aggaatcggctgggga

SEQ ID NO: 2162766 - DNA, 17 bp, Homo sapiens
aggaatcggctggggac

SEQ ID NO: 2162767 - DNA, 23 bp, Homo sapiens
aggaatcggctggggactgctac

SEQ ID NO: 2162768 - DNA, 13 bp, Homo sapiens
aggacagtctgga

SEQ ID NO: 2162769 - DNA, 20 bp, Homo sapiens
aggatgtaggggttaacttg

SEQ ID NO: 2162770 - DNA, 13 bp, Homo sapiens
aggctgagaagga

SEQ ID NO: 2162771 - DNA, 20 bp, Homo sapiens
agggatctgccattgggacc

SEQ ID NO: 2162772 - DNA, 20 bp, Homo sapiens
aggggtcagtgcagcagagg

SEQ ID NO: 2162773 - DNA, 23 bp, Homo sapiens
aggtgctgatgtcaaagtgtaac

SEQ ID NO: 2162774 - DNA, 19 bp, Homo sapiens
agtaatttattgtctgtct

SEQ ID NO: 2162775 - DNA, 13 bp, Homo sapiens
agtcacaaagact

SEQ ID NO: 2162776 - DNA, 23 bp, Homo sapiens
agtgcagcagaggacagtctgga

SEQ ID NO: 2162777 - DNA, 20 bp, Homo sapiens
agtgccacccacctttgcca

SEQ ID NO: 2162778 - DNA, 22 bp, Homo sapiens
agtgccacccacctttgccaca

SEQ ID NO: 2162779 - DNA, 17 bp, Homo sapiens
agtgcctagactgttac

SEQ ID NO: 2162780 - DNA, 18 bp, Homo sapiens
agtgtaacagatatcagt

SEQ ID NO: 2162781 - DNA, 14 bp, Homo sapiens
agttaactgtgaaa

SEQ ID NO: 2162782 - DNA, 22 bp, Homo sapiens
agtttctggtgccatttctgaa

SEQ ID NO: 2162783 - DNA, 21 bp, Homo sapiens
ataaagataacccttattcca

SEQ ID NO: 2162784 - DNA, 20 bp, Homo sapiens
ataacaactatttttgttgt

SEQ ID NO: 2162785 - DNA, 13 bp, Homo sapiens
ataccacaagcct

SEQ ID NO: 2162786 - DNA, 20 bp, Homo sapiens
ataccacaagcctgagaact

SEQ ID NO: 2162787 - DNA, 15 bp, Homo sapiens
atatatttattttat

SEQ ID NO: 2162788 - DNA, 13 bp, Homo sapiens
atcccacccacct

SEQ ID NO: 2162789 - DNA, 17 bp, Homo sapiens
atctggcttagtgccac

SEQ ID NO: 2162790 - DNA, 19 bp, Homo sapiens
atctgggtaagaagaaagc

SEQ ID NO: 2162791 - DNA, 23 bp, Homo sapiens
atctgtagtaatttattgtctgt

SEQ ID NO: 2162792 - DNA, 13 bp, Homo sapiens
atctttgactgaa

SEQ ID NO: 2162793 - DNA, 18 bp, Homo sapiens
atgcaggggtcagtgcag

SEQ ID NO: 2162794 - DNA, 16 bp, Homo sapiens
atgcccttctgattcc

SEQ ID NO: 2162795 - DNA, 23 bp, Homo sapiens
atgcccttctgattcccctccac

SEQ ID NO: 2162796 - DNA, 13 bp, Homo sapiens
atgcctcttaaat

SEQ ID NO: 2162797 - DNA, 22 bp, Homo sapiens
atgcctgtagctttcctggtcc

SEQ ID NO: 2162798 - DNA, 24 bp, Homo sapiens
atgcctgtagctttcctggtccct

SEQ ID NO: 2162799 - DNA, 23 bp, Homo sapiens
atgctgtcatggtcctttctgga

SEQ ID NO: 2162800 - DNA, 13 bp, Homo sapiens
atggttctgtgac

SEQ ID NO: 2162801 - DNA, 13 bp, Homo sapiens
atgtatgttaatt

SEQ ID NO: 2162802 - DNA, 16 bp, Homo sapiens
atgttaatttatttag

SEQ ID NO: 2162803 - DNA, 19 bp, Homo sapiens
attacctgccaattgctac

SEQ ID NO: 2162804 - DNA, 21 bp, Homo sapiens
attctatgtatgttaatttat

SEQ ID NO: 2162805 - DNA, 20 bp, Homo sapiens
attcttctggtgctactcca

SEQ ID NO: 2162806 - DNA, 11 bp, Homo sapiens
attgagaagcc

SEQ ID NO: 2162807 - DNA, 15 bp, Homo sapiens
attgctttgccaaaa

SEQ ID NO: 2162808 - DNA, 17 bp, Homo sapiens
attggagctgactgttc

SEQ ID NO: 2162809 - DNA, 22 bp, Homo sapiens
attggagctgactgttcttggt

SEQ ID NO: 2162810 - DNA, 13 bp, Homo sapiens
atttattgtctgt

SEQ ID NO: 2162811 - DNA, 19 bp, Homo sapiens
atttattgtctgtctacat

SEQ ID NO: 2162812 - DNA, 18 bp, Homo sapiens
atttattttattctatgt

SEQ ID NO: 2162813 - DNA, 16 bp, Homo sapiens
atttcagactgcagag

SEQ ID NO: 2162814 - DNA, 16 bp, Homo sapiens
atttctgaactgttac

SEQ ID NO: 2162815 - DNA, 15 bp, Homo sapiens
atttgtgaactggaa

SEQ ID NO: 2162816 - DNA, 15 bp, Homo sapiens
caaaacgatgaagtt

SEQ ID NO: 2162817 - DNA, 22 bp, Homo sapiens
caaaacgatgaagttatgctgt

SEQ ID NO: 2162818 - DNA, 15 bp, Homo sapiens
caaaaggctgagaag

SEQ ID NO: 2162819 - DNA, 16 bp, Homo sapiens
caaaaggctgagaagg

SEQ ID NO: 2162820 - DNA, 18 bp, Homo sapiens
caaaccccacttcccctc

SEQ ID NO: 2162821 - DNA, 13 bp, Homo sapiens
caaagattgagaa

SEQ ID NO: 2162822 - DNA, 14 bp, Homo sapiens
caaagattgagaag

SEQ ID NO: 2162823 - DNA, 15 bp, Homo sapiens
caaagattgagaagc

SEQ ID NO: 2162824 - DNA, 17 bp, Homo sapiens
caaagattgagaagcca

SEQ ID NO: 2162825 - DNA, 18 bp, Homo sapiens
caaagctaggatggttct

SEQ ID NO: 2162826 - DNA, 23 bp, Homo sapiens
caaagctaggatggttctgtgac

SEQ ID NO: 2162827 - DNA, 17 bp, Homo sapiens
caacaaagattgagaag

SEQ ID NO: 2162828 - DNA, 16 bp, Homo sapiens
caacttgtatttccaa

SEQ ID NO: 2162829 - DNA, 12 bp, Homo sapiens
caagacatttct

SEQ ID NO: 2162830 - DNA, 13 bp, Homo sapiens
caagcctgagaac

SEQ ID NO: 2162831 - DNA, 13 bp, Homo sapiens
caagggaccttca

SEQ ID NO: 2162832 - DNA, 15 bp, Homo sapiens
caaggtgatttcaga

SEQ ID NO: 2162833 - DNA, 21 bp, Homo sapiens
caaggtgctgatgtcaaagtg

SEQ ID NO: 2162834 - DNA, 12 bp, Homo sapiens
caagtgcctaga

SEQ ID NO: 2162835 - DNA, 17 bp, Homo sapiens
caagtgcctagactgtt

SEQ ID NO: 2162836 - DNA, 20 bp, Homo sapiens
caagtgcctagactgttact

SEQ ID NO: 2162837 - DNA, 14 bp, Homo sapiens
caatctaacaataa

SEQ ID NO: 2162838 - DNA, 17 bp, Homo sapiens
caatctaacaataatat

SEQ ID NO: 2162839 - DNA, 21 bp, Homo sapiens
caatctaacaataatatttca

SEQ ID NO: 2162840 - DNA, 13 bp, Homo sapiens
caatttcctggcc

SEQ ID NO: 2162841 - DNA, 19 bp, Homo sapiens
cacaagcctgagaactgaa

SEQ ID NO: 2162842 - DNA, 13 bp, Homo sapiens
cactctatgagtt

SEQ ID NO: 2162843 - DNA, 18 bp, Homo sapiens
cactctatgagttggact

SEQ ID NO: 2162844 - DNA, 15 bp, Homo sapiens
cacttatcttctgga

SEQ ID NO: 2162845 - DNA, 19 bp, Homo sapiens
cagaagaggttgggcttcc

SEQ ID NO: 2162846 - DNA, 23 bp, Homo sapiens
cagactgcagaggggaaagactt

SEQ ID NO: 2162847 - DNA, 12 bp, Homo sapiens
cagagccactct

SEQ ID NO: 2162848 - DNA, 11 bp, Homo sapiens
cagagccttca

SEQ ID NO: 2162849 - DNA, 14 bp, Homo sapiens
aaatgcctcttaaa

SEQ ID NO: 2162850 - DNA, 22 bp, Homo sapiens
aaattatatatttattttattc

SEQ ID NO: 2162851 - DNA, 15 bp, Homo sapiens
aacaataatatttca

SEQ ID NO: 2162852 - DNA, 17 bp, Homo sapiens
aacacttatcttctgga

SEQ ID NO: 2162853 - DNA, 17 bp, Homo sapiens
aacagatatcagtgtct

SEQ ID NO: 2162854 - DNA, 19 bp, Homo sapiens
aacattggagctgactgtt

SEQ ID NO: 2162855 - DNA, 16 bp, Homo sapiens
aactgaattttgggac

SEQ ID NO: 2162856 - DNA, 19 bp, Homo sapiens
aactgtgaaataccacaag

SEQ ID NO: 2162857 - DNA, 14 bp, Homo sapiens
aactgttacaactt

SEQ ID NO: 2162858 - DNA, 15 bp, Homo sapiens
aagaagaagaagaag

SEQ ID NO: 2162859 - DNA, 14 bp, Homo sapiens
aagaaggagagcaa

SEQ ID NO: 2162860 - DNA, 21 bp, Homo sapiens
aagacacaaggtgatttcaga

SEQ ID NO: 2162861 - DNA, 22 bp, Homo sapiens
aagaggttgggcttccatgcct

SEQ ID NO: 2162862 - DNA, 23 bp, Homo sapiens
aagaggttgggcttccatgcctg

SEQ ID NO: 2162863 - DNA, 15 bp, Homo sapiens
aagattgagaagcca

SEQ ID NO: 2162864 - DNA, 18 bp, Homo sapiens
aagatttgtgaactggaa

SEQ ID NO: 2162865 - DNA, 22 bp, Homo sapiens
aagatttgtgaactggaagaaa

SEQ ID NO: 2162866 - DNA, 16 bp, Homo sapiens
aagcaaaagcaaggga

SEQ ID NO: 2162867 - DNA, 17 bp, Homo sapiens
aagcccaaggtgctgat

SEQ ID NO: 2162868 - DNA, 12 bp, Homo sapiens
aaggctgagaag

SEQ ID NO: 2162869 - DNA, 19 bp, Homo sapiens
aagtgcctagactgttact

SEQ ID NO: 2162870 - DNA, 14 bp, Homo sapiens
aataatatttcaag

SEQ ID NO: 2162871 - DNA, 22 bp, Homo sapiens
aataccagagccttcaagtgcc

SEQ ID NO: 2162872 - DNA, 13 bp, Homo sapiens
aatatttcaagtg

SEQ ID NO: 2162873 - DNA, 19 bp, Homo sapiens
aatctaacaataatatttc

SEQ ID NO: 2162874 - DNA, 18 bp, Homo sapiens
aatgccggttaaattcca

SEQ ID NO: 2162875 - DNA, 15 bp, Homo sapiens
aattgctttgccaaa

SEQ ID NO: 2162876 - DNA, 23 bp, Homo sapiens
aattgctttgccaaaataccaga

SEQ ID NO: 2162877 - DNA, 15 bp, Homo sapiens
aatttattgtctgtc

SEQ ID NO: 2162878 - DNA, 19 bp, Homo sapiens
aatttattgtctgtctaca

SEQ ID NO: 2162879 - DNA, 20 bp, Homo sapiens
aatttattgtctgtctacat

SEQ ID NO: 2162880 - DNA, 21 bp, Homo sapiens
aatttcctggccctccactcc

SEQ ID NO: 2162881 - DNA, 16 bp, Homo sapiens
acaaagattgagaagc

SEQ ID NO: 2162882 - DNA, 17 bp, Homo sapiens
acaacttgtatttccaa

SEQ ID NO: 2162883 - DNA, 13 bp, Homo sapiens
acaagcctgagaa

SEQ ID NO: 2162884 - DNA, 17 bp, Homo sapiens
acaagcctgagaactga

SEQ ID NO: 2162885 - DNA, 13 bp, Homo sapiens
acaataatatttc

SEQ ID NO: 2162886 - DNA, 18 bp, Homo sapiens
acaataatatttcaagtg

SEQ ID NO: 2162887 - DNA, 21 bp, Homo sapiens
acaataatatttcaagtgcct

SEQ ID NO: 2162888 - DNA, 17 bp, Homo sapiens
acacaaggtgatttcag

SEQ ID NO: 2162889 - DNA, 15 bp, Homo sapiens
acacttatcttctgg

SEQ ID NO: 2162890 - DNA, 20 bp, Homo sapiens
acagggaacattggagctga

SEQ ID NO: 2162891 - DNA, 14 bp, Homo sapiens
acatttctctaact

SEQ ID NO: 2162892 - DNA, 22 bp, Homo sapiens
acatttctctaactcctgccat

SEQ ID NO: 2162893 - DNA, 15 bp, Homo sapiens
accacaagcctgaga

SEQ ID NO: 2162894 - DNA, 21 bp, Homo sapiens
accagagccttcaagtgccaa

SEQ ID NO: 2162895 - DNA, 21 bp, Homo sapiens
acccacctttgccacaaagct

SEQ ID NO: 2162896 - DNA, 21 bp, Homo sapiens
acccagatggaaaaataacaa

SEQ ID NO: 2162897 - DNA, 10 bp, Homo sapiens
acccatctgt

SEQ ID NO: 2162898 - DNA, 16 bp, Homo sapiens
accctccagtgctgga

SEQ ID NO: 2162899 - DNA, 19 bp, Homo sapiens
accctccagtgctggattt

SEQ ID NO: 2162900 - DNA, 12 bp, Homo sapiens
acctctgagaag

SEQ ID NO: 2162901 - DNA, 13 bp, Homo sapiens
acctctgagaaga

SEQ ID NO: 2162902 - DNA, 16 bp, Homo sapiens
accttcatgcccttct

SEQ ID NO: 2162903 - DNA, 23 bp, Homo sapiens
actcactttcccttgtgtcaaga

SEQ ID NO: 2162904 - DNA, 18 bp, Homo sapiens
actgaaaaaaaaaaagaa

SEQ ID NO: 2162905 - DNA, 15 bp, Homo sapiens
actgattacctgcca

SEQ ID NO: 2162906 - DNA, 17 bp, Homo sapiens
actgattacctgccaat

SEQ ID NO: 2162907 - DNA, 19 bp, Homo sapiens
actgcagaggggaaagact

SEQ ID NO: 2162908 - DNA, 17 bp, Homo sapiens
actgcgggagctctgta

SEQ ID NO: 2162909 - DNA, 22 bp, Homo sapiens
actgttacaacttgtatttcca

SEQ ID NO: 2162910 - DNA, 23 bp, Homo sapiens
actgttacaacttgtatttccaa

SEQ ID NO: 2162911 - DNA, 13 bp, Homo sapiens
actgttactttgg

SEQ ID NO: 2162912 - DNA, 15 bp, Homo sapiens
actgttactttggca

SEQ ID NO: 2162913 - DNA, 14 bp, Homo sapiens
acttatcttctgga

SEQ ID NO: 2162914 - DNA, 18 bp, Homo sapiens
acttctacccagatggaa

SEQ ID NO: 2162915 - DNA, 16 bp, Homo sapiens
actttggcaatttcct

SEQ ID NO: 2162916 - DNA, 18 bp, Homo sapiens
actttggcaatttcctgg

SEQ ID NO: 2162917 - DNA, 23 bp, Homo sapiens
agaagaaagcaaaagcaagggac

SEQ ID NO: 2162918 - DNA, 18 bp, Homo sapiens
agaagaagaaggagagca

SEQ ID NO: 2162919 - DNA, 14 bp, Homo sapiens
agaagaaggagagc

SEQ ID NO: 2162920 - DNA, 19 bp, Homo sapiens
agaagaaggagagcaagaa

SEQ ID NO: 2162921 - DNA, 16 bp, Homo sapiens
agaatgccggttaaat

SEQ ID NO: 2162922 - DNA, 17 bp, Homo sapiens
agacttgtgctcaagga

SEQ ID NO: 2162923 - DNA, 13 bp, Homo sapiens
agagcaagaagga

SEQ ID NO: 2162924 - DNA, 15 bp, Homo sapiens
agagcaagaaggaaa

SEQ ID NO: 2162925 - DNA, 18 bp, Homo sapiens
agataacccttattccat

SEQ ID NO: 2162926 - DNA, 14 bp, Homo sapiens
agatatcagtgtct

SEQ ID NO: 2162927 - DNA, 17 bp, Homo sapiens
agatatcagtgtctccc

SEQ ID NO: 2162928 - DNA, 18 bp, Homo sapiens
agatcttccgtggtcaga

SEQ ID NO: 2162929 - DNA, 21 bp, Homo sapiens
agatggaaaaataacaactat

SEQ ID NO: 2162930 - DNA, 18 bp, Homo sapiens
agcaaaaggctgagaagg

SEQ ID NO: 2162931 - DNA, 20 bp, Homo sapiens
agcaaagcaaaaggctgaga

SEQ ID NO: 2162932 - DNA, 16 bp, Homo sapiens
agcaagaaggaaagat

SEQ ID NO: 2162933 - DNA, 21 bp, Homo sapiens
agccactctatgagttggact

SEQ ID NO: 2162934 - DNA, 23 bp, Homo sapiens
agcccaaggtgctgatgtcaaag

SEQ ID NO: 2162935 - DNA, 15 bp, Homo sapiens
agccttcaagtgcca

SEQ ID NO: 2162936 - DNA, 19 bp, Homo sapiens
agctctgtatggtcaggat

SEQ ID NO: 2162937 - DNA, 12 bp, Homo sapiens
agctttcctggt

SEQ ID NO: 2162938 - DNA, 14 bp, Homo sapiens
agctttcctggtcc

SEQ ID NO: 2162939 - DNA, 18 bp, Homo sapiens
aggacagtctggagaagg

SEQ ID NO: 2162940 - DNA, 17 bp, Homo sapiens
aggcgattttgtctacc

SEQ ID NO: 2162941 - DNA, 17 bp, Homo sapiens
aggggaaagacttccat

SEQ ID NO: 2162942 - DNA, 18 bp, Homo sapiens
aggggttaacttggtcag

SEQ ID NO: 2162943 - DNA, 15 bp, Homo sapiens
aggtattagcaaagc

SEQ ID NO: 2162944 - DNA, 16 bp, Homo sapiens
aggtgatttcagactg

SEQ ID NO: 2162945 - DNA, 18 bp, Homo sapiens
aggttgggcttccatgcc

SEQ ID NO: 2162946 - DNA, 12 bp, Homo sapiens
agtcttgcctag

SEQ ID NO: 2162947 - DNA, 15 bp, Homo sapiens
agtgcctagactgtt

SEQ ID NO: 2162948 - DNA, 22 bp, Homo sapiens
agtgcctagactgttactttgg

SEQ ID NO: 2162949 - DNA, 12 bp, Homo sapiens
agtgctggattt

SEQ ID NO: 2162950 - DNA, 22 bp, Homo sapiens
agtttgtttaaacacttatctt

SEQ ID NO: 2162951 - DNA, 20 bp, Homo sapiens
ataatatttcaagtgcctag

SEQ ID NO: 2162952 - DNA, 18 bp, Homo sapiens
ataattgctttgccaaaa

SEQ ID NO: 2162953 - DNA, 23 bp, Homo sapiens
ataattgctttgccaaaatacca

SEQ ID NO: 2162954 - DNA, 15 bp, Homo sapiens
ataccagagccttca

SEQ ID NO: 2162955 - DNA, 19 bp, Homo sapiens
ataccagagccttcaagtg

SEQ ID NO: 2162956 - DNA, 23 bp, Homo sapiens
ataccagagccttcaagtgccaa

SEQ ID NO: 2162957 - DNA, 15 bp, Homo sapiens
atatttatactttgc

SEQ ID NO: 2162958 - DNA, 12 bp, Homo sapiens
atatttcaagtg

SEQ ID NO: 2162959 - DNA, 15 bp, Homo sapiens
atatttcaagtgcct

SEQ ID NO: 2162960 - DNA, 19 bp, Homo sapiens
atctaacaataatatttca

SEQ ID NO: 2162961 - DNA, 16 bp, Homo sapiens
atctgggtaagaagaa

SEQ ID NO: 2162962 - DNA, 17 bp, Homo sapiens
atctgggtaagaagaaa

SEQ ID NO: 2162963 - DNA, 21 bp, Homo sapiens
atctgtagtaatttattgtct

SEQ ID NO: 2162964 - DNA, 23 bp, Homo sapiens
atcttccgtggtcagagtgccac

SEQ ID NO: 2162965 - DNA, 11 bp, Homo sapiens
atcttctggat

SEQ ID NO: 2162966 - DNA, 17 bp, Homo sapiens
atctttgactgaaaaaa

SEQ ID NO: 2162967 - DNA, 22 bp, Homo sapiens
atgagttaactgtgaaatacca

SEQ ID NO: 2162968 - DNA, 14 bp, Homo sapiens
atgagttggacttc

SEQ ID NO: 2162969 - DNA, 17 bp, Homo sapiens
atgagttggacttcagt

SEQ ID NO: 2162970 - DNA, 18 bp, Homo sapiens
atgagttggacttcagtc

SEQ ID NO: 2162971 - DNA, 21 bp, Homo sapiens
atgcctgtagctttcctggtc

SEQ ID NO: 2162972 - DNA, 14 bp, Homo sapiens
atgctccaggatct

SEQ ID NO: 2162973 - DNA, 22 bp, Homo sapiens
atgctccaggatctttgactga

SEQ ID NO: 2162974 - DNA, 16 bp, Homo sapiens
atggaaaaataacaac

SEQ ID NO: 2162975 - DNA, 15 bp, Homo sapiens
atgtcaaagtgtaac

SEQ ID NO: 2162976 - DNA, 19 bp, Homo sapiens
atgtcaaagtgtaacagat

SEQ ID NO: 2162977 - DNA, 16 bp, Homo sapiens
ttcctggccctccact

SEQ ID NO: 2162978 - DNA, 12 bp, Homo sapiens
ttctatgtatgt

SEQ ID NO: 2162979 - DNA, 18 bp, Homo sapiens
ttctctaactcctgccat

SEQ ID NO: 2162980 - DNA, 14 bp, Homo sapiens
ttctgaactgttac

SEQ ID NO: 2162981 - DNA, 17 bp, Homo sapiens
ttctgtgacccatctgt

SEQ ID NO: 2162982 - DNA, 18 bp, Homo sapiens
ttctgtgacccatctgta

SEQ ID NO: 2162983 - DNA, 19 bp, Homo sapiens
ttgccaaaataccagagcc

SEQ ID NO: 2162984 - DNA, 23 bp, Homo sapiens
ttgccaaaataccagagccttca

SEQ ID NO: 2162985 - DNA, 22 bp, Homo sapiens
ttgccgtctaggattgggcctc

SEQ ID NO: 2162986 - DNA, 11 bp, Homo sapiens
ttggagctgac

SEQ ID NO: 2162987 - DNA, 17 bp, Homo sapiens
ttgggaccctccagtgc

SEQ ID NO: 2162988 - DNA, 16 bp, Homo sapiens
ttgggcttccatgcct

SEQ ID NO: 2162989 - DNA, 20 bp, Homo sapiens
ttggtaactgattacctgcc

SEQ ID NO: 2162990 - DNA, 17 bp, Homo sapiens
ttggtcagagccactct

SEQ ID NO: 2162991 - DNA, 12 bp, Homo sapiens
ttgtaaatgcct

SEQ ID NO: 2162992 - DNA, 18 bp, Homo sapiens
ttgtgaactggaagaaag

SEQ ID NO: 2162993 - DNA, 18 bp, Homo sapiens
ttgtgtcaagacatttct

SEQ ID NO: 2162994 - DNA, 22 bp, Homo sapiens
ttgtttgtaaatgcctcttaaa

SEQ ID NO: 2162995 - DNA, 19 bp, Homo sapiens
tttatttagtttttaacaa

SEQ ID NO: 2162996 - DNA, 21 bp, Homo sapiens
tttcaagtgcctagactgtta

SEQ ID NO: 2162997 - DNA, 22 bp, Homo sapiens
tttcaagtgcctagactgttac

SEQ ID NO: 2162998 - DNA, 16 bp, Homo sapiens
tttcctggccctccac

SEQ ID NO: 2162999 - DNA, 13 bp, Homo sapiens
tttgactgaaaaa

SEQ ID NO: 2163000 - DNA, 19 bp, Homo sapiens
tttggcaatttcctggccc

SEQ ID NO: 2163001 - DNA, 14 bp, Homo sapiens
tttgggacttctac

SEQ ID NO: 2163002 - DNA, 21 bp, Homo sapiens
tttgtaaatgcctcttaaatt

SEQ ID NO: 2163003 - DNA, 18 bp, Homo sapiens
tttgtgaactggaagaaa

SEQ ID NO: 2163004 - DNA, 11 bp, Homo sapiens
ttttgggactt

SEQ ID NO: 2163005 - DNA, 23 bp, Homo sapiens
gagaaggttggaggtggggaagg

SEQ ID NO: 2163006 - DNA, 15 bp, Homo sapiens
gagagcaagaaggaa

SEQ ID NO: 2163007 - DNA, 14 bp, Homo sapiens
gagcaagaaggaaa

SEQ ID NO: 2163008 - DNA, 13 bp, Homo sapiens
gagccttcaagtg

SEQ ID NO: 2163009 - DNA, 17 bp, Homo sapiens
gagccttcaagtgccaa

SEQ ID NO: 2163010 - DNA, 15 bp, Homo sapiens
gaggacagtctggag

SEQ ID NO: 2163011 - DNA, 20 bp, Homo sapiens
gagttaactgtgaaatacca

SEQ ID NO: 2163012 - DNA, 18 bp, Homo sapiens
gatcttccgtggtcagag

SEQ ID NO: 2163013 - DNA, 15 bp, Homo sapiens
gatctttgactgaaa

SEQ ID NO: 2163014 - DNA, 16 bp, Homo sapiens
gatctttgactgaaaa

SEQ ID NO: 2163015 - DNA, 16 bp, Homo sapiens
gatggaaaaataacaa

SEQ ID NO: 2163016 - DNA, 23 bp, Homo sapiens
gatggtatctgggtaagaagaaa

SEQ ID NO: 2163017 - DNA, 14 bp, Homo sapiens
gatggttctgtgac

SEQ ID NO: 2163018 - DNA, 14 bp, Homo sapiens
gattacctgccaat

SEQ ID NO: 2163019 - DNA, 14 bp, Homo sapiens
gattgagaagccat

SEQ ID NO: 2163020 - DNA, 23 bp, Homo sapiens
gatttgatgagttaactgtgaaa

SEQ ID NO: 2163021 - DNA, 20 bp, Homo sapiens
gcaaaagcaagggaccttca

SEQ ID NO: 2163022 - DNA, 17 bp, Homo sapiens
gcaacaaagattgagaa

SEQ ID NO: 2163023 - DNA, 19 bp, Homo sapiens
gcagaggacagtctggaga

SEQ ID NO: 2163024 - DNA, 22 bp, Homo sapiens
gcagatcttccgtggtcagagt

SEQ ID NO: 2163025 - DNA, 23 bp, Homo sapiens
gcagatcttccgtggtcagagtg

SEQ ID NO: 2163026 - DNA, 23 bp, Homo sapiens
gcagcagaggacagtctggagaa

SEQ ID NO: 2163027 - DNA, 16 bp, Homo sapiens
gccaagtctcagaaga

SEQ ID NO: 2163028 - DNA, 20 bp, Homo sapiens
gccattcttctggtgctact

SEQ ID NO: 2163029 - DNA, 20 bp, Homo sapiens
gccatttctgaactgttaca

SEQ ID NO: 2163030 - DNA, 20 bp, Homo sapiens
gcctgtagctttcctggtcc

SEQ ID NO: 2163031 - DNA, 15 bp, Homo sapiens
gcgattttgtctacc

SEQ ID NO: 2163032 - DNA, 15 bp, Homo sapiens
gcgggagctctgtat

SEQ ID NO: 2163033 - DNA, 17 bp, Homo sapiens
gctgactgttcttggta

SEQ ID NO: 2163034 - DNA, 16 bp, Homo sapiens
gctgagaaggaacagg

SEQ ID NO: 2163035 - DNA, 14 bp, Homo sapiens
gctgatgtcaaagt

SEQ ID NO: 2163036 - DNA, 15 bp, Homo sapiens
gctttcctggtccct

SEQ ID NO: 2163037 - DNA, 14 bp, Homo sapiens
ggaggtggggaagg

SEQ ID NO: 2163038 - DNA, 14 bp, Homo sapiens
ggatctttgactga

SEQ ID NO: 2163039 - DNA, 10 bp, Homo sapiens
ggctgagaag

SEQ ID NO: 2163040 - DNA, 14 bp, Homo sapiens
ggctgagaaggaac

SEQ ID NO: 2163041 - DNA, 18 bp, Homo sapiens
gggcttccatgcctgtag

SEQ ID NO: 2163042 - DNA, 21 bp, Homo sapiens
gggttaacttggtcagagcca

SEQ ID NO: 2163043 - DNA, 15 bp, Homo sapiens
ggtaagaagaaagca

SEQ ID NO: 2163044 - DNA, 17 bp, Homo sapiens
ggtattagcaaagcaaa

SEQ ID NO: 2163045 - DNA, 23 bp, Homo sapiens
ggtattagcaaagcaaaaggctg

SEQ ID NO: 2163046 - DNA, 14 bp, Homo sapiens
ggtcagagccactc

SEQ ID NO: 2163047 - DNA, 23 bp, Homo sapiens
ggtcctttctggaagtttctggt

SEQ ID NO: 2163048 - DNA, 22 bp, Homo sapiens
gtaaatgcctcttaaattatat

SEQ ID NO: 2163049 - DNA, 15 bp, Homo sapiens
gtaagaagaaagcaa

SEQ ID NO: 2163050 - DNA, 15 bp, Homo sapiens
gtaatttattgtctg

SEQ ID NO: 2163051 - DNA, 23 bp, Homo sapiens
gtaggggttaacttggtcagagc

SEQ ID NO: 2163052 - DNA, 14 bp, Homo sapiens
gtagtaatttattg

SEQ ID NO: 2163053 - DNA, 18 bp, Homo sapiens
gtcctctccctgccaagt

SEQ ID NO: 2163054 - DNA, 15 bp, Homo sapiens
gtcctttctggaagt

SEQ ID NO: 2163055 - DNA, 18 bp, Homo sapiens
gtgaaataccacaagcct

SEQ ID NO: 2163056 - DNA, 13 bp, Homo sapiens
gtgacccatctgt

SEQ ID NO: 2163057 - DNA, 16 bp, Homo sapiens
gtgacccatctgtagt

SEQ ID NO: 2163058 - DNA, 20 bp, Homo sapiens
gtgctactccatgcaggggt

SEQ ID NO: 2163059 - DNA, 16 bp, Homo sapiens
gtgtcctctccctgcc

SEQ ID NO: 2163060 - DNA, 16 bp, Homo sapiens
gtgtctccccgtgtcc

SEQ ID NO: 2163061 - DNA, 22 bp, Homo sapiens
gtgtctccccgtgtcctctccc

SEQ ID NO: 2163062 - DNA, 18 bp, Homo sapiens
gttaaattccatatgctc

SEQ ID NO: 2163063 - DNA, 14 bp, Homo sapiens
gttaacttggtcag

SEQ ID NO: 2163064 - DNA, 14 bp, Homo sapiens
gttaatttatttag

SEQ ID NO: 2163065 - DNA, 12 bp, Homo sapiens
gttactttggca

SEQ ID NO: 2163066 - DNA, 21 bp, Homo sapiens
gttctgtgacccatctgtagt

SEQ ID NO: 2163067 - DNA, 20 bp, Homo sapiens
gttggaggtggggaaggctt

SEQ ID NO: 2163068 - DNA, 17 bp, Homo sapiens
gttgtttgtaaatgcct

SEQ ID NO: 2163069 - DNA, 15 bp, Homo sapiens
gtttgtaaatgcctc

SEQ ID NO: 2163070 - DNA, 21 bp, Homo sapiens
taaagataacccttattccat

SEQ ID NO: 2163071 - DNA, 21 bp, Homo sapiens
taacaatctaacaataatatt

SEQ ID NO: 2163072 - DNA, 17 bp, Homo sapiens
taacttggtcagagcca

SEQ ID NO: 2163073 - DNA, 14 bp, Homo sapiens
taattgctttgcca

SEQ ID NO: 2163074 - DNA, 18 bp, Homo sapiens
tacaacttgtatttccaa

SEQ ID NO: 2163075 - DNA, 15 bp, Homo sapiens
tacatttctgcagat

SEQ ID NO: 2163076 - DNA, 18 bp, Homo sapiens
tactttgcaatccaaata

SEQ ID NO: 2163077 - DNA, 16 bp, Homo sapiens
tactttggcaatttcc

SEQ ID NO: 2163078 - DNA, 17 bp, Homo sapiens
tactttggcaatttcct

SEQ ID NO: 2163079 - DNA, 16 bp, Homo sapiens
tagaatgccggttaaa

SEQ ID NO: 2163080 - DNA, 22 bp, Homo sapiens
tagaatgccggttaaattccat

SEQ ID NO: 2163081 - DNA, 17 bp, Homo sapiens
tagcaaagcaaaaggct

SEQ ID NO: 2163082 - DNA, 13 bp, Homo sapiens
tagctttcctggt

SEQ ID NO: 2163083 - DNA, 14 bp, Homo sapiens
tagctttcctggtc

SEQ ID NO: 2163084 - DNA, 16 bp, Homo sapiens
taggatggttctgtga

SEQ ID NO: 2163085 - DNA, 22 bp, Homo sapiens
tagtttttaacaatctaacaat

SEQ ID NO: 2163086 - DNA, 22 bp, Homo sapiens
tatctgggtaagaagaaagcaa

SEQ ID NO: 2163087 - DNA, 13 bp, Homo sapiens
tatcttctggatt

SEQ ID NO: 2163088 - DNA, 13 bp, Homo sapiens
tatgtatgttaat

SEQ ID NO: 2163089 - DNA, 19 bp, Homo sapiens
tattgtctgtctacatttc

SEQ ID NO: 2163090 - DNA, 20 bp, Homo sapiens
tattgtctgtctacatttct

SEQ ID NO: 2163091 - DNA, 12 bp, Homo sapiens
tatttcaagtgc

SEQ ID NO: 2163092 - DNA, 15 bp, Homo sapiens
tatttcaagtgccta

SEQ ID NO: 2163093 - DNA, 22 bp, Homo sapiens
tcaaagtgtaacagatatcagt

SEQ ID NO: 2163094 - DNA, 13 bp, Homo sapiens
tcaagtgccaaac

SEQ ID NO: 2163095 - DNA, 18 bp, Homo sapiens
tcaagtgccaaacagagt

SEQ ID NO: 2163096 - DNA, 11 bp, Homo sapiens
tcaagtgccta

SEQ ID NO: 2163097 - DNA, 23 bp, Homo sapiens
tcagagccactctatgagttgga

SEQ ID NO: 2163098 - DNA, 12 bp, Homo sapiens
tcagagtgccac

SEQ ID NO: 2163099 - DNA, 21 bp, Homo sapiens
tcaggatgtaggggttaactt

SEQ ID NO: 2163100 - DNA, 15 bp, Homo sapiens
tcatgcccttctgat

SEQ ID NO: 2163101 - DNA, 22 bp, Homo sapiens
tccaaacctggttcatatttat

SEQ ID NO: 2163102 - DNA, 16 bp, Homo sapiens
tccagtgctggatttg

SEQ ID NO: 2163103 - DNA, 22 bp, Homo sapiens
tccatgcctgtagctttcctgg

SEQ ID NO: 2163104 - DNA, 16 bp, Homo sapiens
tcccacccacctcacc

SEQ ID NO: 2163105 - DNA, 22 bp, Homo sapiens
tcccataattgctttgccaaaa

SEQ ID NO: 2163106 - DNA, 22 bp, Homo sapiens
tccccgtgtcctctccctgcca

SEQ ID NO: 2163107 - DNA, 10 bp, Homo sapiens
tccctgccaa

SEQ ID NO: 2163108 - DNA, 14 bp, Homo sapiens
tccgatggtatctg

SEQ ID NO: 2163109 - DNA, 19 bp, Homo sapiens
tccgtggtcagagtgccac

SEQ ID NO: 2163110 - DNA, 13 bp, Homo sapiens
tcctctccctgcc

SEQ ID NO: 2163111 - DNA, 14 bp, Homo sapiens
tcctctccctgcca

SEQ ID NO: 2163112 - DNA, 16 bp, Homo sapiens
tcctggccctccactc

SEQ ID NO: 2163113 - DNA, 19 bp, Homo sapiens
tcctggccctccactcctc

SEQ ID NO: 2163114 - DNA, 20 bp, Homo sapiens
tccttcgtccccagttgccg

SEQ ID NO: 2163115 - DNA, 19 bp, Homo sapiens
tcctttctggaagtttctg

SEQ ID NO: 2163116 - DNA, 19 bp, Homo sapiens
tcggctggggactgctacc

SEQ ID NO: 2163117 - DNA, 20 bp, Homo sapiens
tctaacaataatatttcaag

SEQ ID NO: 2163118 - DNA, 22 bp, Homo sapiens
tctaacaataatatttcaagtg

SEQ ID NO: 2163119 - DNA, 20 bp, Homo sapiens
tctccctgccaagtctcaga

SEQ ID NO: 2163120 - DNA, 15 bp, Homo sapiens
tctgaactgttacaa

SEQ ID NO: 2163121 - DNA, 24 bp, Homo sapiens
tctgccattgggaccctccagtgc

SEQ ID NO: 2163122 - DNA, 13 bp, Homo sapiens
tctggcttagtgc

SEQ ID NO: 2163123 - DNA, 22 bp, Homo sapiens
tctggcttagtgccacccacct

SEQ ID NO: 2163124 - DNA, 18 bp, Homo sapiens
tctgggtaagaagaaagc

SEQ ID NO: 2163125 - DNA, 16 bp, Homo sapiens
tctggtgctactccat

SEQ ID NO: 2163126 - DNA, 19 bp, Homo sapiens
tctggtgctactccatgca

SEQ ID NO: 2163127 - DNA, 16 bp, Homo sapiens
tctgtagtaatttatt

SEQ ID NO: 2163128 - DNA, 13 bp, Homo sapiens
tctgtatggtcag

SEQ ID NO: 2163129 - DNA, 14 bp, Homo sapiens
tctgtctacatttc

SEQ ID NO: 2163130 - DNA, 15 bp, Homo sapiens
tctgtgacccatctg

SEQ ID NO: 2163131 - DNA, 16 bp, Homo sapiens
tctgtgacccatctgt

SEQ ID NO: 2163132 - DNA, 20 bp, Homo sapiens
tctgtgacccatctgtagta

SEQ ID NO: 2163133 - DNA, 21 bp, Homo sapiens
atgtccgatggtatctgggta

SEQ ID NO: 2163134 - DNA, 12 bp, Homo sapiens
atgttaatttat

SEQ ID NO: 2163135 - DNA, 22 bp, Homo sapiens
attagcaaagcaaaaggctgag

SEQ ID NO: 2163136 - DNA, 12 bp, Homo sapiens
attggagctgac

SEQ ID NO: 2163137 - DNA, 20 bp, Homo sapiens
attggagctgactgttcttg

SEQ ID NO: 2163138 - DNA, 17 bp, Homo sapiens
atttagtttttaacaat

SEQ ID NO: 2163139 - DNA, 13 bp, Homo sapiens
atttatactttgc

SEQ ID NO: 2163140 - DNA, 22 bp, Homo sapiens
atttatactttgcaatccaaat

SEQ ID NO: 2163141 - DNA, 23 bp, Homo sapiens
atttattgtctgtctacatttct

SEQ ID NO: 2163142 - DNA, 22 bp, Homo sapiens
atttattttattctatgtatgt

SEQ ID NO: 2163143 - DNA, 21 bp, Homo sapiens
atttccaaacctggttcatat

SEQ ID NO: 2163144 - DNA, 13 bp, Homo sapiens
atttcctggccct

SEQ ID NO: 2163145 - DNA, 20 bp, Homo sapiens
atttctctaactcctgccat

SEQ ID NO: 2163146 - DNA, 13 bp, Homo sapiens
atttctgaactgt

SEQ ID NO: 2163147 - DNA, 17 bp, Homo sapiens
atttctgaactgttaca

SEQ ID NO: 2163148 - DNA, 12 bp, Homo sapiens
atttgtgttttg

SEQ ID NO: 2163149 - DNA, 18 bp, Homo sapiens
caaaaggctgagaaggaa

SEQ ID NO: 2163150 - DNA, 14 bp, Homo sapiens
caaaataccagagc

SEQ ID NO: 2163151 - DNA, 19 bp, Homo sapiens
caacaaagattgagaagcc

SEQ ID NO: 2163152 - DNA, 21 bp, Homo sapiens
caacaaagattgagaagccat

SEQ ID NO: 2163153 - DNA, 13 bp, Homo sapiens
caactatttttgt

SEQ ID NO: 2163154 - DNA, 21 bp, Homo sapiens
caagaaggaaagatttgtgaa

SEQ ID NO: 2163155 - DNA, 22 bp, Homo sapiens
caagggatctgccattgggacc

SEQ ID NO: 2163156 - DNA, 18 bp, Homo sapiens
caaggtgatttcagactg

SEQ ID NO: 2163157 - DNA, 20 bp, Homo sapiens
caagtaccaccaagggatct

SEQ ID NO: 2163158 - DNA, 21 bp, Homo sapiens
caagtgcctagactgttactt

SEQ ID NO: 2163159 - DNA, 14 bp, Homo sapiens
caataatatttcaa

SEQ ID NO: 2163160 - DNA, 17 bp, Homo sapiens
caataatatttcaagtg

SEQ ID NO: 2163161 - DNA, 20 bp, Homo sapiens
caataatatttcaagtgcct

SEQ ID NO: 2163162 - DNA, 15 bp, Homo sapiens
caatccaaataaaga

SEQ ID NO: 2163163 - DNA, 20 bp, Homo sapiens
caatctggcttagtgccacc

SEQ ID NO: 2163164 - DNA, 14 bp, Homo sapiens
caatttcctggccc

SEQ ID NO: 2163165 - DNA, 17 bp, Homo sapiens
cacaaagactccttcgt

SEQ ID NO: 2163166 - DNA, 20 bp, Homo sapiens
cacaatctggcttagtgcca

SEQ ID NO: 2163167 - DNA, 12 bp, Homo sapiens
cacccccatggc

SEQ ID NO: 2163168 - DNA, 18 bp, Homo sapiens
cacttatcttctggatta

SEQ ID NO: 2163169 - DNA, 18 bp, Homo sapiens
cactttcccttgtgtcaa

SEQ ID NO: 2163170 - DNA, 17 bp, Homo sapiens
cagagccactctatgag

SEQ ID NO: 2163171 - DNA, 22 bp, Homo sapiens
cagagccactctatgagttgga

SEQ ID NO: 2163172 - DNA, 16 bp, Homo sapiens
cagagccttcaagtgc

SEQ ID NO: 2163173 - DNA, 20 bp, Homo sapiens
cagagccttcaagtgccaaa

SEQ ID NO: 2163174 - DNA, 18 bp, Homo sapiens
cagaggacagtctggaga

SEQ ID NO: 2163175 - DNA, 11 bp, Homo sapiens
cagagtgccac

SEQ ID NO: 2163176 - DNA, 14 bp, Homo sapiens
cagcagaggacagt

SEQ ID NO: 2163177 - DNA, 15 bp, Homo sapiens
caggatctttgactg

SEQ ID NO: 2163178 - DNA, 18 bp, Homo sapiens
caggatgtaggggttaac

SEQ ID NO: 2163179 - DNA, 21 bp, Homo sapiens
caggcccacagcgtgggaact

SEQ ID NO: 2163180 - DNA, 20 bp, Homo sapiens
cagggaacattggagctgac

SEQ ID NO: 2163181 - DNA, 13 bp, Homo sapiens
caggggtcagtgc

SEQ ID NO: 2163182 - DNA, 15 bp, Homo sapiens
cagtctggagaaggt

SEQ ID NO: 2163183 - DNA, 13 bp, Homo sapiens
cagtcttgcctag

SEQ ID NO: 2163184 - DNA, 14 bp, Homo sapiens
cagtcttgcctagg

SEQ ID NO: 2163185 - DNA, 13 bp, Homo sapiens
cagtgctggattt

SEQ ID NO: 2163186 - DNA, 19 bp, Homo sapiens
cagtgctggatttgatgag

SEQ ID NO: 2163187 - DNA, 19 bp, Homo sapiens
cagttgccgtctaggattg

SEQ ID NO: 2163188 - DNA, 17 bp, Homo sapiens
cataagtttgtttaaac

SEQ ID NO: 2163189 - DNA, 21 bp, Homo sapiens
catatgctccaggatctttga

SEQ ID NO: 2163190 - DNA, 16 bp, Homo sapiens
catccccacaatctgg

SEQ ID NO: 2163191 - DNA, 12 bp, Homo sapiens
catgcccttctg

SEQ ID NO: 2163192 - DNA, 14 bp, Homo sapiens
catgcccttctgat

SEQ ID NO: 2163193 - DNA, 22 bp, Homo sapiens
catgcctgtagctttcctggtc

SEQ ID NO: 2163194 - DNA, 15 bp, Homo sapiens
catggccccaggccc

SEQ ID NO: 2163195 - DNA, 10 bp, Homo sapiens
cattggagct

SEQ ID NO: 2163196 - DNA, 12 bp, Homo sapiens
cattggagctga

SEQ ID NO: 2163197 - DNA, 20 bp, Homo sapiens
cattgggaccctccagtgct

SEQ ID NO: 2163198 - DNA, 21 bp, Homo sapiens
catttctctaactcctgccat

SEQ ID NO: 2163199 - DNA, 18 bp, Homo sapiens
catttctgaactgttaca

SEQ ID NO: 2163200 - DNA, 16 bp, Homo sapiens
ccaaataaagataacc

SEQ ID NO: 2163201 - DNA, 14 bp, Homo sapiens
ccaaggtgctgatg

SEQ ID NO: 2163202 - DNA, 21 bp, Homo sapiens
ccaaggtgctgatgtcaaagt

SEQ ID NO: 2163203 - DNA, 15 bp, Homo sapiens
ccacaagcctgagaa

SEQ ID NO: 2163204 - DNA, 21 bp, Homo sapiens
ccacaatctggcttagtgcca

SEQ ID NO: 2163205 - DNA, 21 bp, Homo sapiens
ccactgcgggagctctgtatg

SEQ ID NO: 2163206 - DNA, 19 bp, Homo sapiens
ccagagccttcaagtgcca

SEQ ID NO: 2163207 - DNA, 22 bp, Homo sapiens
ccagagccttcaagtgccaaac

SEQ ID NO: 2163208 - DNA, 19 bp, Homo sapiens
ccaggatctttgactgaaa

SEQ ID NO: 2163209 - DNA, 15 bp, Homo sapiens
ccatatgctccagga

SEQ ID NO: 2163210 - DNA, 20 bp, Homo sapiens
ccatctagtcacaaagactc

SEQ ID NO: 2163211 - DNA, 21 bp, Homo sapiens
ccatctgtagtaatttattgt

SEQ ID NO: 2163212 - DNA, 19 bp, Homo sapiens
ccatgcaggggtcagtgca

SEQ ID NO: 2163213 - DNA, 23 bp, Homo sapiens
ccatgcctgtagctttcctggtc

SEQ ID NO: 2163214 - DNA, 18 bp, Homo sapiens
ccatgtactcaagtacca

SEQ ID NO: 2163215 - DNA, 14 bp, Homo sapiens
ccattcttctggtg

SEQ ID NO: 2163216 - DNA, 17 bp, Homo sapiens
ccattgggaccctccag

SEQ ID NO: 2163217 - DNA, 20 bp, Homo sapiens
ccattgggaccctccagtgc

SEQ ID NO: 2163218 - DNA, 20 bp, Homo sapiens
ccatttctgaactgttacaa

SEQ ID NO: 2163219 - DNA, 21 bp, Homo sapiens
cccaaggtgctgatgtcaaag

SEQ ID NO: 2163220 - DNA, 23 bp, Homo sapiens
cccacaatctggcttagtgccac

SEQ ID NO: 2163221 - DNA, 19 bp, Homo sapiens
cccatctgtagtaatttat

SEQ ID NO: 2163222 - DNA, 22 bp, Homo sapiens
ccccgtgtcctctccctgccaa

SEQ ID NO: 2163223 - DNA, 17 bp, Homo sapiens
ccctcacccccatggcc

SEQ ID NO: 2163224 - DNA, 18 bp, Homo sapiens
ccctccactcctcatccc

SEQ ID NO: 2163225 - DNA, 19 bp, Homo sapiens
ccgtggtcagagtgccact

SEQ ID NO: 2163226 - DNA, 21 bp, Homo sapiens
ccgtggtcagagtgccactgc

SEQ ID NO: 2163227 - DNA, 19 bp, Homo sapiens
ccgtgtcctctccctgcca

SEQ ID NO: 2163228 - DNA, 15 bp, Homo sapiens
cctagactgttactt

SEQ ID NO: 2163229 - DNA, 22 bp, Homo sapiens
cctcccataattgctttgccaa

SEQ ID NO: 2163230 - DNA, 13 bp, Homo sapiens
cctctccctgcca

SEQ ID NO: 2163231 - DNA, 14 bp, Homo sapiens
cctctccctgccaa

SEQ ID NO: 2163232 - DNA, 23 bp, Homo sapiens
cctcttaaattatatatttattt

SEQ ID NO: 2163233 - DNA, 13 bp, Homo sapiens
cctggccctccac

SEQ ID NO: 2163234 - DNA, 22 bp, Homo sapiens
cctggttcatatttatactttg

SEQ ID NO: 2163235 - DNA, 18 bp, Homo sapiens
cctgtagctttcctggtc

SEQ ID NO: 2163236 - DNA, 13 bp, Homo sapiens
ccttcaagtgcca

SEQ ID NO: 2163237 - DNA, 20 bp, Homo sapiens
ccttgtgtcaagacatttct

SEQ ID NO: 2163238 - DNA, 13 bp, Homo sapiens
cctttctggaagt

SEQ ID NO: 2163239 - DNA, 17 bp, Homo sapiens
cctttctggaagtttct

SEQ ID NO: 2163240 - DNA, 22 bp, Homo sapiens
cctttctggaagtttctggtgc

SEQ ID NO: 2163241 - DNA, 18 bp, Homo sapiens
cgggagctctgtatggtc

SEQ ID NO: 2163242 - DNA, 14 bp, Homo sapiens
cgtggtcagagtgc

SEQ ID NO: 2163243 - DNA, 23 bp, Homo sapiens
ctaacaataatatttcaagtgcc

SEQ ID NO: 2163244 - DNA, 15 bp, Homo sapiens
ctacctctgagaaga

SEQ ID NO: 2163245 - DNA, 17 bp, Homo sapiens
ctacctctgagaagaca

SEQ ID NO: 2163246 - DNA, 16 bp, Homo sapiens
ctagactgttactttg

SEQ ID NO: 2163247 - DNA, 20 bp, Homo sapiens
ctagactgttactttggcaa

SEQ ID NO: 2163248 - DNA, 20 bp, Homo sapiens
ctatgtatgttaatttattt

SEQ ID NO: 2163249 - DNA, 15 bp, Homo sapiens
ctccaggatctttga

SEQ ID NO: 2163250 - DNA, 16 bp, Homo sapiens
ctccagtgctggattt

SEQ ID NO: 2163251 - DNA, 18 bp, Homo sapiens
ctccagtgctggatttga

SEQ ID NO: 2163252 - DNA, 22 bp, Homo sapiens
ctcccataattgctttgccaaa

SEQ ID NO: 2163253 - DNA, 21 bp, Homo sapiens
ctccctgccaagtctcagaag

SEQ ID NO: 2163254 - DNA, 14 bp, Homo sapiens
ctcctgccattctt

SEQ ID NO: 2163255 - DNA, 13 bp, Homo sapiens
ctctccctgccaa

SEQ ID NO: 2163256 - DNA, 15 bp, Homo sapiens
ctctccctgccaagt

SEQ ID NO: 2163257 - DNA, 20 bp, Homo sapiens
ctcttaaattatatatttat

SEQ ID NO: 2163258 - DNA, 21 bp, Homo sapiens
ctgaaaaaaaaaaagaagaag

SEQ ID NO: 2163259 - DNA, 16 bp, Homo sapiens
ctgaattttgggactt

SEQ ID NO: 2163260 - DNA, 19 bp, Homo sapiens
aaaacgatgaagttatgct

SEQ ID NO: 2163261 - DNA, 12 bp, Homo sapiens
aaaagaagaaga

SEQ ID NO: 2163262 - DNA, 17 bp, Homo sapiens
aaaaggctgagaaggaa

SEQ ID NO: 2163263 - DNA, 19 bp, Homo sapiens
aaaataccagagccttcaa

SEQ ID NO: 2163264 - DNA, 22 bp, Homo sapiens
aaaataccagagccttcaagtg

SEQ ID NO: 2163265 - DNA, 21 bp, Homo sapiens
aaacacttatcttctggatta

SEQ ID NO: 2163266 - DNA, 12 bp, Homo sapiens
aaacctggttca

SEQ ID NO: 2163267 - DNA, 19 bp, Homo sapiens
aaagaagaagaagaaggag

SEQ ID NO: 2163268 - DNA, 22 bp, Homo sapiens
aaagatttgtgaactggaagaa

SEQ ID NO: 2163269 - DNA, 23 bp, Homo sapiens
aaagcaacaaagattgagaagcc

SEQ ID NO: 2163270 - DNA, 15 bp, Homo sapiens
aaagtgtaacagata

SEQ ID NO: 2163271 - DNA, 22 bp, Homo sapiens
aaataccacaagcctgagaact

SEQ ID NO: 2163272 - DNA, 13 bp, Homo sapiens
aaataccagagcc

SEQ ID NO: 2163273 - DNA, 22 bp, Homo sapiens
aaataccagagccttcaagtgc

SEQ ID NO: 2163274 - DNA, 22 bp, Homo sapiens
aacctggttcatatttatactt

SEQ ID NO: 2163275 - DNA, 17 bp, Homo sapiens
aactgattacctgccaa

SEQ ID NO: 2163276 - DNA, 15 bp, Homo sapiens
aactggaagaaagca

SEQ ID NO: 2163277 - DNA, 22 bp, Homo sapiens
aactgtgaaataccacaagcct

SEQ ID NO: 2163278 - DNA, 14 bp, Homo sapiens
aacttggtcagagc

SEQ ID NO: 2163279 - DNA, 16 bp, Homo sapiens
aacttggtcagagcca

SEQ ID NO: 2163280 - DNA, 23 bp, Homo sapiens
aacttggtcagagccactctatg

SEQ ID NO: 2163281 - DNA, 16 bp, Homo sapiens
aagaaagcaaaagcaa

SEQ ID NO: 2163282 - DNA, 13 bp, Homo sapiens
aagaagaaagcaa

SEQ ID NO: 2163283 - DNA, 15 bp, Homo sapiens
aagaagaaggagagc

SEQ ID NO: 2163284 - DNA, 21 bp, Homo sapiens
aagaaggagagcaagaaggaa

SEQ ID NO: 2163285 - DNA, 18 bp, Homo sapiens
aagataacccttattcca

SEQ ID NO: 2163286 - DNA, 19 bp, Homo sapiens
aagataacccttattccat

SEQ ID NO: 2163287 - DNA, 20 bp, Homo sapiens
aagatttgtgaactggaaga

SEQ ID NO: 2163288 - DNA, 14 bp, Homo sapiens
aagcaaaaggctga

SEQ ID NO: 2163289 - DNA, 20 bp, Homo sapiens
aagcaaaaggctgagaagga

SEQ ID NO: 2163290 - DNA, 21 bp, Homo sapiens
aagcaaaaggctgagaaggaa

SEQ ID NO: 2163291 - DNA, 21 bp, Homo sapiens
aagcaacaaagattgagaagc

SEQ ID NO: 2163292 - DNA, 21 bp, Homo sapiens
aagccatgtactcaagtacca

SEQ ID NO: 2163293 - DNA, 15 bp, Homo sapiens
aaggaaagatttgtg

SEQ ID NO: 2163294 - DNA, 22 bp, Homo sapiens
aaggagagcaagaaggaaagat

SEQ ID NO: 2163295 - DNA, 15 bp, Homo sapiens
aagtctcagaagagg

SEQ ID NO: 2163296 - DNA, 13 bp, Homo sapiens
aataaagataacc

SEQ ID NO: 2163297 - DNA, 15 bp, Homo sapiens
aataatatttcaagt

SEQ ID NO: 2163298 - DNA, 14 bp, Homo sapiens
aataccacaagcct

SEQ ID NO: 2163299 - DNA, 16 bp, Homo sapiens
aataccacaagcctga

SEQ ID NO: 2163300 - DNA, 14 bp, Homo sapiens
aatatttcaagtgc

SEQ ID NO: 2163301 - DNA, 18 bp, Homo sapiens
aatatttcaagtgcctag

SEQ ID NO: 2163302 - DNA, 23 bp, Homo sapiens
aatatttcaagtgcctagactgt

SEQ ID NO: 2163303 - DNA, 20 bp, Homo sapiens
aatctaacaataatatttca

SEQ ID NO: 2163304 - DNA, 17 bp, Homo sapiens
aatctggcttagtgcca

SEQ ID NO: 2163305 - DNA, 23 bp, Homo sapiens
aatgcctcttaaattatatattt

SEQ ID NO: 2163306 - DNA, 21 bp, Homo sapiens
aattgctttgccaaaatacca

SEQ ID NO: 2163307 - DNA, 17 bp, Homo sapiens
aatttattgtctgtcta

SEQ ID NO: 2163308 - DNA, 17 bp, Homo sapiens
aatttatttagttttta

SEQ ID NO: 2163309 - DNA, 11 bp, Homo sapiens
aatttcctggc

SEQ ID NO: 2163310 - DNA, 14 bp, Homo sapiens
acaaagattgagaa

SEQ ID NO: 2163311 - DNA, 23 bp, Homo sapiens
acaaagctaggatggttctgtga

SEQ ID NO: 2163312 - DNA, 14 bp, Homo sapiens
acaagcctgagaac

SEQ ID NO: 2163313 - DNA, 15 bp, Homo sapiens
acaataatatttcaa

SEQ ID NO: 2163314 - DNA, 20 bp, Homo sapiens
acaataatatttcaagtgcc

SEQ ID NO: 2163315 - DNA, 22 bp, Homo sapiens
acaataatatttcaagtgccta

SEQ ID NO: 2163316 - DNA, 19 bp, Homo sapiens
tcttaaattatatatttat

SEQ ID NO: 2163317 - DNA, 13 bp, Homo sapiens
tctttgactgaaa

SEQ ID NO: 2163318 - DNA, 23 bp, Homo sapiens
tgaaataccacaagcctgagaac

SEQ ID NO: 2163319 - DNA, 15 bp, Homo sapiens
tgaactggaagaaag

SEQ ID NO: 2163320 - DNA, 16 bp, Homo sapiens
tgaactggaagaaagc

SEQ ID NO: 2163321 - DNA, 22 bp, Homo sapiens
tgactgaaaaaaaaaaagaaga

SEQ ID NO: 2163322 - DNA, 17 bp, Homo sapiens
tgatgagttaactgtga

SEQ ID NO: 2163323 - DNA, 18 bp, Homo sapiens
tgatgagttaactgtgaa

SEQ ID NO: 2163324 - DNA, 13 bp, Homo sapiens
tgattacctgcca

SEQ ID NO: 2163325 - DNA, 21 bp, Homo sapiens
tgatttcagactgcagagggg

SEQ ID NO: 2163326 - DNA, 14 bp, Homo sapiens
tgcagcagaggaca

SEQ ID NO: 2163327 - DNA, 15 bp, Homo sapiens
tgcagcagaggacag

SEQ ID NO: 2163328 - DNA, 22 bp, Homo sapiens
tgcagcagaggacagtctggag

SEQ ID NO: 2163329 - DNA, 15 bp, Homo sapiens
tgccaagtctcagaa

SEQ ID NO: 2163330 - DNA, 18 bp, Homo sapiens
tgccaagtctcagaagag

SEQ ID NO: 2163331 - DNA, 18 bp, Homo sapiens
tgccaattgctaccgaga

SEQ ID NO: 2163332 - DNA, 13 bp, Homo sapiens
tgccacccacctt

SEQ ID NO: 2163333 - DNA, 16 bp, Homo sapiens
tgccattcttctggtg

SEQ ID NO: 2163334 - DNA, 21 bp, Homo sapiens
tgccattcttctggtgctact

SEQ ID NO: 2163335 - DNA, 19 bp, Homo sapiens
tgccattgggaccctccag

SEQ ID NO: 2163336 - DNA, 21 bp, Homo sapiens
tgccatttctgaactgttaca

SEQ ID NO: 2163337 - DNA, 21 bp, Homo sapiens
tgcctaggcgattttgtctac

SEQ ID NO: 2163338 - DNA, 22 bp, Homo sapiens
tgcctgtagctttcctggtccc

SEQ ID NO: 2163339 - DNA, 23 bp, Homo sapiens
tgcctgtagctttcctggtccct

SEQ ID NO: 2163340 - DNA, 17 bp, Homo sapiens
tgcgggagctctgtatg

SEQ ID NO: 2163341 - DNA, 15 bp, Homo sapiens
tgctacctctgagaa

SEQ ID NO: 2163342 - DNA, 13 bp, Homo sapiens
tgctggatttgat

SEQ ID NO: 2163343 - DNA, 23 bp, Homo sapiens
tgctgtcatggtcctttctggaa

SEQ ID NO: 2163344 - DNA, 20 bp, Homo sapiens
tgctttgccaaaataccaga

SEQ ID NO: 2163345 - DNA, 13 bp, Homo sapiens
tggagctgactgt

SEQ ID NO: 2163346 - DNA, 15 bp, Homo sapiens
tggcaatttcctggc

SEQ ID NO: 2163347 - DNA, 19 bp, Homo sapiens
tggcaatttcctggccctc

SEQ ID NO: 2163348 - DNA, 22 bp, Homo sapiens
tggccccaggcccacagcgtgg

SEQ ID NO: 2163349 - DNA, 11 bp, Homo sapiens
tggccctccac

SEQ ID NO: 2163350 - DNA, 23 bp, Homo sapiens
tgggaccctccagtgctggattt

SEQ ID NO: 2163351 - DNA, 15 bp, Homo sapiens
tgggcttccatgcct

SEQ ID NO: 2163352 - DNA, 23 bp, Homo sapiens
tggggactgctacctctgagaag

SEQ ID NO: 2163353 - DNA, 16 bp, Homo sapiens
tgggtaagaagaaagc

SEQ ID NO: 2163354 - DNA, 22 bp, Homo sapiens
tggtaactgattacctgccaat

SEQ ID NO: 2163355 - DNA, 17 bp, Homo sapiens
tggtcagagtgccactg

SEQ ID NO: 2163356 - DNA, 13 bp, Homo sapiens
tggtccctcaccc

SEQ ID NO: 2163357 - DNA, 15 bp, Homo sapiens
tggtcctttctggaa

SEQ ID NO: 2163358 - DNA, 17 bp, Homo sapiens
tggtcctttctggaagt

SEQ ID NO: 2163359 - DNA, 20 bp, Homo sapiens
tggtgccatttctgaactgt

SEQ ID NO: 2163360 - DNA, 18 bp, Homo sapiens
tggttctgtgacccatct

SEQ ID NO: 2163361 - DNA, 19 bp, Homo sapiens
tggttctgtgacccatctg

SEQ ID NO: 2163362 - DNA, 15 bp, Homo sapiens
tgtagctttcctggt

SEQ ID NO: 2163363 - DNA, 17 bp, Homo sapiens
tgtagctttcctggtcc

SEQ ID NO: 2163364 - DNA, 20 bp, Homo sapiens
tgtagctttcctggtccctc

SEQ ID NO: 2163365 - DNA, 15 bp, Homo sapiens
tgtaggggttaactt

SEQ ID NO: 2163366 - DNA, 22 bp, Homo sapiens
tgtaggggttaacttggtcaga

SEQ ID NO: 2163367 - DNA, 14 bp, Homo sapiens
tgtagtaatttatt

SEQ ID NO: 2163368 - DNA, 20 bp, Homo sapiens
tgtataatcccacccacctc

SEQ ID NO: 2163369 - DNA, 12 bp, Homo sapiens
tgtcatggtcct

SEQ ID NO: 2163370 - DNA, 21 bp, Homo sapiens
tgtcatggtcctttctggaag

SEQ ID NO: 2163371 - DNA, 17 bp, Homo sapiens
tgtcctctccctgccaa

SEQ ID NO: 2163372 - DNA, 18 bp, Homo sapiens
tgtcctctccctgccaag

SEQ ID NO: 2163373 - DNA, 17 bp, Homo sapiens
tgtctgtctacatttct

SEQ ID NO: 2163374 - DNA, 16 bp, Homo sapiens
tgtgaactggaagaaa

SEQ ID NO: 2163375 - DNA, 23 bp, Homo sapiens
tgtttaaacacttatcttctgga

SEQ ID NO: 2163376 - DNA, 16 bp, Homo sapiens
ttaactgtgaaatacc

SEQ ID NO: 2163377 - DNA, 15 bp, Homo sapiens
ttaatttatttagtt

SEQ ID NO: 2163378 - DNA, 18 bp, Homo sapiens
ttacctgccaattgctac

SEQ ID NO: 2163379 - DNA, 12 bp, Homo sapiens
ttcaagtgccta

SEQ ID NO: 2163380 - DNA, 14 bp, Homo sapiens
ttccatatgctcca

SEQ ID NO: 2163381 - DNA, 14 bp, Homo sapiens
ttccatctagtcac

SEQ ID NO: 2163382 - DNA, 23 bp, Homo sapiens
ttccatgcctgtagctttcctgg

SEQ ID NO: 2163383 - DNA, 15 bp, Homo sapiens
ttcctggccctccac

SEQ ID NO: 2163384 - DNA, 17 bp, Homo sapiens
ttctctaactcctgcca

SEQ ID NO: 2163385 - DNA, 20 bp, Homo sapiens
ttctgattcccctccaccaa

SEQ ID NO: 2163386 - DNA, 16 bp, Homo sapiens
ttcttctggtgctact

SEQ ID NO: 2163387 - DNA, 23 bp, Homo sapiens
ttcttctggtgctactccatgca

SEQ ID NO: 2163388 - DNA, 19 bp, Homo sapiens
ttcttggtaactgattacc

SEQ ID NO: 2163389 - DNA, 20 bp, Homo sapiens
ttgatgagttaactgtgaaa

SEQ ID NO: 2163390 - DNA, 23 bp, Homo sapiens
ttgcctaggcgattttgtctacc

SEQ ID NO: 2163391 - DNA, 14 bp, Homo sapiens
ttgctttgccaaaa

SEQ ID NO: 2163392 - DNA, 14 bp, Homo sapiens
ttggagctgactgt

SEQ ID NO: 2163393 - DNA, 21 bp, Homo sapiens
ttggagctgactgttcttggt

SEQ ID NO: 2163394 - DNA, 16 bp, Homo sapiens
ttgtgctcaaggaatc

SEQ ID NO: 2163395 - DNA, 15 bp, Homo sapiens
ttgtgtcaagacatt

SEQ ID NO: 2163396 - DNA, 16 bp, Homo sapiens
ttgtttgtaaatgcct

SEQ ID NO: 2163397 - DNA, 16 bp, Homo sapiens
tttaacaatctaacaa

SEQ ID NO: 2163398 - DNA, 16 bp, Homo sapiens
tttagtttttaacaat

SEQ ID NO: 2163399 - DNA, 18 bp, Homo sapiens
tttattttattctatgta

SEQ ID NO: 2163400 - DNA, 13 bp, Homo sapiens
tttcaagtgccta

SEQ ID NO: 2163401 - DNA, 15 bp, Homo sapiens
tttcaagtgcctaga

SEQ ID NO: 2163402 - DNA, 15 bp, Homo sapiens
tttcagactgcagag

SEQ ID NO: 2163403 - DNA, 20 bp, Homo sapiens
tttcccttgtgtcaagacat

SEQ ID NO: 2163404 - DNA, 16 bp, Homo sapiens
tttctgaactgttaca

SEQ ID NO: 2163405 - DNA, 17 bp, Homo sapiens
tttctggtgccatttct

SEQ ID NO: 2163406 - DNA, 24 bp, Homo sapiens
tttctggtgccatttctgaactgt

SEQ ID NO: 2163407 - DNA, 15 bp, Homo sapiens
tttgactgaaaaaaa

SEQ ID NO: 2163408 - DNA, 21 bp, Homo sapiens
tttgccaaaataccagagcct

SEQ ID NO: 2163409 - DNA, 12 bp, Homo sapiens
tttgtgaactgg

SEQ ID NO: 2163410 - DNA, 15 bp, Homo sapiens
tttgtgaactggaag

SEQ ID NO: 2163411 - DNA, 21 bp, Homo sapiens
tttgtgaactggaagaaagca

SEQ ID NO: 2163412 - DNA, 18 bp, Homo sapiens
tttttaacaatctaacaa

SEQ ID NO: 2163413 - DNA, 17 bp, Homo sapiens
tctggtgccatttctga

SEQ ID NO: 2163414 - DNA, 23 bp, Homo sapiens
tctgtagtaatttattgtctgtc

SEQ ID NO: 2163415 - DNA, 21 bp, Homo sapiens
tcttccgtggtcagagtgcca

SEQ ID NO: 2163416 - DNA, 21 bp, Homo sapiens
tcttctggtgctactccatgc

SEQ ID NO: 2163417 - DNA, 23 bp, Homo sapiens
tctttgactgaaaaaaaaaaaga

SEQ ID NO: 2163418 - DNA, 19 bp, Homo sapiens
tgaaaaaaaaaaagaagaa

SEQ ID NO: 2163419 - DNA, 14 bp, Homo sapiens
tgaactggaagaaa

SEQ ID NO: 2163420 - DNA, 11 bp, Homo sapiens
tgaactgttac

SEQ ID NO: 2163421 - DNA, 22 bp, Homo sapiens
tgaactgttacaacttgtattt

SEQ ID NO: 2163422 - DNA, 15 bp, Homo sapiens
tgaattttgggactt

SEQ ID NO: 2163423 - DNA, 14 bp, Homo sapiens
tgacccatctgtag

SEQ ID NO: 2163424 - DNA, 15 bp, Homo sapiens
tgacccatctgtagt

SEQ ID NO: 2163425 - DNA, 23 bp, Homo sapiens
tgactgaaaaaaaaaaagaagaa

SEQ ID NO: 2163426 - DNA, 15 bp, Homo sapiens
tgagaactgaatttt

SEQ ID NO: 2163427 - DNA, 17 bp, Homo sapiens
tgagttggacttcagtc

SEQ ID NO: 2163428 - DNA, 19 bp, Homo sapiens
tgagttggacttcagtctt

SEQ ID NO: 2163429 - DNA, 16 bp, Homo sapiens
tgcagaggggaaagac

SEQ ID NO: 2163430 - DNA, 21 bp, Homo sapiens
tgcagatcttccgtggtcaga

SEQ ID NO: 2163431 - DNA, 23 bp, Homo sapiens
tgcagcagaggacagtctggaga

SEQ ID NO: 2163432 - DNA, 23 bp, Homo sapiens
tgccaattgctaccgagaaggtt

SEQ ID NO: 2163433 - DNA, 13 bp, Homo sapiens
tgccattcttctg

SEQ ID NO: 2163434 - DNA, 18 bp, Homo sapiens
tgccattcttctggtgct

SEQ ID NO: 2163435 - DNA, 13 bp, Homo sapiens
tgccattgggacc

SEQ ID NO: 2163436 - DNA, 17 bp, Homo sapiens
tgccatttctgaactgt

SEQ ID NO: 2163437 - DNA, 22 bp, Homo sapiens
tgccatttctgaactgttacaa

SEQ ID NO: 2163438 - DNA, 22 bp, Homo sapiens
tgcccttctgattcccctccac

SEQ ID NO: 2163439 - DNA, 16 bp, Homo sapiens
tgcgggagctctgtat

SEQ ID NO: 2163440 - DNA, 20 bp, Homo sapiens
tgctacctctgagaagacac

SEQ ID NO: 2163441 - DNA, 14 bp, Homo sapiens
tgctgatgtcaaag

SEQ ID NO: 2163442 - DNA, 22 bp, Homo sapiens
tgctgatgtcaaagtgtaacag

SEQ ID NO: 2163443 - DNA, 16 bp, Homo sapiens
tgctgtcatggtcctt

SEQ ID NO: 2163444 - DNA, 21 bp, Homo sapiens
tggagaaggtattagcaaagc

SEQ ID NO: 2163445 - DNA, 14 bp, Homo sapiens
tggaggtggggaag

SEQ ID NO: 2163446 - DNA, 17 bp, Homo sapiens
tggaggtggggaaggct

SEQ ID NO: 2163447 - DNA, 16 bp, Homo sapiens
tggcaatttcctggcc

SEQ ID NO: 2163448 - DNA, 18 bp, Homo sapiens
tggcaatttcctggccct

SEQ ID NO: 2163449 - DNA, 22 bp, Homo sapiens
tggcaatttcctggccctccac

SEQ ID NO: 2163450 - DNA, 14 bp, Homo sapiens
tggcttagtgccac

SEQ ID NO: 2163451 - DNA, 13 bp, Homo sapiens
tgggaccctccag

SEQ ID NO: 2163452 - DNA, 14 bp, Homo sapiens
tgggacttctaccc

SEQ ID NO: 2163453 - DNA, 21 bp, Homo sapiens
tgggacttctacccagatgga

SEQ ID NO: 2163454 - DNA, 23 bp, Homo sapiens
tgggacttctacccagatggaaa

SEQ ID NO: 2163455 - DNA, 12 bp, Homo sapiens
tgggtaagaaga

SEQ ID NO: 2163456 - DNA, 19 bp, Homo sapiens
tggtatctgggtaagaaga

SEQ ID NO: 2163457 - DNA, 14 bp, Homo sapiens
tggtcagagtgcca

SEQ ID NO: 2163458 - DNA, 18 bp, Homo sapiens
tgtaaatgcctcttaaat

SEQ ID NO: 2163459 - DNA, 14 bp, Homo sapiens
tgtcaagacatttc

SEQ ID NO: 2163460 - DNA, 15 bp, Homo sapiens
tgtcaagacatttct

SEQ ID NO: 2163461 - DNA, 20 bp, Homo sapiens
tgtcatggtcctttctggaa

SEQ ID NO: 2163462 - DNA, 20 bp, Homo sapiens
tgtgaactggaagaaagcaa

SEQ ID NO: 2163463 - DNA, 19 bp, Homo sapiens
tgttactttggcaatttcc

SEQ ID NO: 2163464 - DNA, 24 bp, Homo sapiens
tgtttaaacacttatcttctggat

SEQ ID NO: 2163465 - DNA, 15 bp, Homo sapiens
tgtttgtaaatgcct

SEQ ID NO: 2163466 - DNA, 18 bp, Homo sapiens
ttaaattatatatttatt

SEQ ID NO: 2163467 - DNA, 15 bp, Homo sapiens
ttaacaatctaacaa

SEQ ID NO: 2163468 - DNA, 16 bp, Homo sapiens
ttaacttggtcagagc

SEQ ID NO: 2163469 - DNA, 17 bp, Homo sapiens
ttaacttggtcagagcc

SEQ ID NO: 2163470 - DNA, 19 bp, Homo sapiens
ttaacttggtcagagccac

SEQ ID NO: 2163471 - DNA, 12 bp, Homo sapiens
ttacctgccaat

SEQ ID NO: 2163472 - DNA, 23 bp, Homo sapiens
ttagaatgccggttaaattccat

SEQ ID NO: 2163473 - DNA, 23 bp, Homo sapiens
ttagtttttaacaatctaacaat

SEQ ID NO: 2163474 - DNA, 14 bp, Homo sapiens
ttatgctgtcatgg

SEQ ID NO: 2163475 - DNA, 16 bp, Homo sapiens
ttattgtctgtctaca

SEQ ID NO: 2163476 - DNA, 14 bp, Homo sapiens
ttcaagtgccaaac

SEQ ID NO: 2163477 - DNA, 11 bp, Homo sapiens
ttcaagtgcct

SEQ ID NO: 2163478 - DNA, 15 bp, Homo sapiens
ttcaagtgcctagac

SEQ ID NO: 2163479 - DNA, 23 bp, Homo sapiens
ttcaagtgcctagactgttactt

SEQ ID NO: 2163480 - DNA, 17 bp, Homo sapiens
ttccatatgctccagga

SEQ ID NO: 2163481 - DNA, 13 bp, Homo sapiens
ttcccctccacca

SEQ ID NO: 2163482 - DNA, 20 bp, Homo sapiens
ttccgtggtcagagtgccac

SEQ ID NO: 2163483 - DNA, 14 bp, Homo sapiens
ttcctggtccctca

SEQ ID NO: 2163484 - DNA, 20 bp, Homo sapiens
ttctacccagatggaaaaat

SEQ ID NO: 2163485 - DNA, 22 bp, Homo sapiens
ttctgaactgttacaacttgta

SEQ ID NO: 2163486 - DNA, 20 bp, Homo sapiens
ttctgcagatcttccgtggt

SEQ ID NO: 2163487 - DNA, 19 bp, Homo sapiens
ttctggattagaatgccgg

SEQ ID NO: 2163488 - DNA, 20 bp, Homo sapiens
ttctggtgctactccatgca

SEQ ID NO: 2163489 - DNA, 22 bp, Homo sapiens
ttctggtgctactccatgcagg

SEQ ID NO: 2163490 - DNA, 15 bp, Homo sapiens
ttctgtgacccatct

SEQ ID NO: 2163491 - DNA, 19 bp, Homo sapiens
ttctgtgacccatctgtag

SEQ ID NO: 2163492 - DNA, 14 bp, Homo sapiens
ttcttctggtgcta

SEQ ID NO: 2163493 - DNA, 18 bp, Homo sapiens
ttgatgagttaactgtga

SEQ ID NO: 2163494 - DNA, 16 bp, Homo sapiens
ttgccaaaataccaga

SEQ ID NO: 2163495 - DNA, 18 bp, Homo sapiens
ttgccaaaataccagagc

SEQ ID NO: 2163496 - DNA, 22 bp, Homo sapiens
ttgccaaaataccagagccttc

SEQ ID NO: 2163497 - DNA, 15 bp, Homo sapiens
ttgccgtctaggatt

SEQ ID NO: 2163498 - DNA, 19 bp, Homo sapiens
ttgctttgccaaaatacca

SEQ ID NO: 2163499 - DNA, 20 bp, Homo sapiens
ttggcaatttcctggccctc

SEQ ID NO: 2163500 - DNA, 12 bp, Homo sapiens
ttgggacttcta

SEQ ID NO: 2163501 - DNA, 18 bp, Homo sapiens
ttgtctgtctacatttct

SEQ ID NO: 2163502 - DNA, 12 bp, Homo sapiens
ttgtgaactgga

SEQ ID NO: 2163503 - DNA, 21 bp, Homo sapiens
ttgtgaactggaagaaagcaa

SEQ ID NO: 2163504 - DNA, 13 bp, Homo sapiens
ttgttgtttgtaa

SEQ ID NO: 2163505 - DNA, 21 bp, Homo sapiens
tttaaacacttatcttctgga

SEQ ID NO: 2163506 - DNA, 18 bp, Homo sapiens
tttattctatgtatgtta

SEQ ID NO: 2163507 - DNA, 19 bp, Homo sapiens
tttattgtctgtctacatt

SEQ ID NO: 2163508 - DNA, 22 bp, Homo sapiens
tttattgtctgtctacatttct

SEQ ID NO: 2163509 - DNA, 15 bp, Homo sapiens
tttatttagttttta

SEQ ID NO: 2163510 - DNA, 12 bp, Homo sapiens
tttcaagtgcct

SEQ ID NO: 2163511 - DNA, 19 bp, Homo sapiens
tttcaagtgcctagactgt

SEQ ID NO: 2163512 - DNA, 19 bp, Homo sapiens
tttcctggccctccactcc

SEQ ID NO: 2163513 - DNA, 15 bp, Homo sapiens
tttctgaactgttac

SEQ ID NO: 2163514 - DNA, 20 bp, Homo sapiens
tttggcaatttcctggccct

SEQ ID NO: 2163515 - DNA, 19 bp, Homo sapiens
tttgtaaatgcctcttaaa

SEQ ID NO: 2163516 - DNA, 23 bp, Homo sapiens
accagagccttcaagtgccaaac

SEQ ID NO: 2163517 - DNA, 20 bp, Homo sapiens
acccccatggccccaggccc

SEQ ID NO: 2163518 - DNA, 15 bp, Homo sapiens
acctggttcatattt

SEQ ID NO: 2163519 - DNA, 18 bp, Homo sapiens
accttcatgcccttctga

SEQ ID NO: 2163520 - DNA, 19 bp, Homo sapiens
actcctgccattcttctgg

SEQ ID NO: 2163521 - DNA, 21 bp, Homo sapiens
actgaaaaaaaaaaagaagaa

SEQ ID NO: 2163522 - DNA, 22 bp, Homo sapiens
actgaaaaaaaaaaagaagaag

SEQ ID NO: 2163523 - DNA, 15 bp, Homo sapiens
actgaattttgggac

SEQ ID NO: 2163524 - DNA, 19 bp, Homo sapiens
actgaattttgggacttct

SEQ ID NO: 2163525 - DNA, 23 bp, Homo sapiens
actgcgggagctctgtatggtca

SEQ ID NO: 2163526 - DNA, 15 bp, Homo sapiens
actgctacctctgag

SEQ ID NO: 2163527 - DNA, 17 bp, Homo sapiens
actgctacctctgagaa

SEQ ID NO: 2163528 - DNA, 14 bp, Homo sapiens
actggaagaaagca

SEQ ID NO: 2163529 - DNA, 21 bp, Homo sapiens
actgtgaaataccacaagcct

SEQ ID NO: 2163530 - DNA, 21 bp, Homo sapiens
actgttacaacttgtatttcc

SEQ ID NO: 2163531 - DNA, 21 bp, Homo sapiens
actgttactttggcaatttcc

SEQ ID NO: 2163532 - DNA, 22 bp, Homo sapiens
actgttactttggcaatttcct

SEQ ID NO: 2163533 - DNA, 15 bp, Homo sapiens
actgttcttggtaac

SEQ ID NO: 2163534 - DNA, 19 bp, Homo sapiens
acttctacccagatggaaa

SEQ ID NO: 2163535 - DNA, 22 bp, Homo sapiens
acttctacccagatggaaaaat

SEQ ID NO: 2163536 - DNA, 22 bp, Homo sapiens
acttgtatttccaaacctggtt

SEQ ID NO: 2163537 - DNA, 19 bp, Homo sapiens
actttggcaatttcctggc

SEQ ID NO: 2163538 - DNA, 17 bp, Homo sapiens
agaactgaattttggga

SEQ ID NO: 2163539 - DNA, 19 bp, Homo sapiens
agaactgaattttgggact

SEQ ID NO: 2163540 - DNA, 11 bp, Homo sapiens
agaagaaagca

SEQ ID NO: 2163541 - DNA, 12 bp, Homo sapiens
agaagaaagcaa

SEQ ID NO: 2163542 - DNA, 13 bp, Homo sapiens
agaagaaagcaaa

SEQ ID NO: 2163543 - DNA, 21 bp, Homo sapiens
agaaggtattagcaaagcaaa

SEQ ID NO: 2163544 - DNA, 22 bp, Homo sapiens
agacacaaggtgatttcagact

SEQ ID NO: 2163545 - DNA, 19 bp, Homo sapiens
agagacttgtgctcaagga

SEQ ID NO: 2163546 - DNA, 21 bp, Homo sapiens
agagcaagaaggaaagatttg

SEQ ID NO: 2163547 - DNA, 16 bp, Homo sapiens
agaggacagtctggag

SEQ ID NO: 2163548 - DNA, 18 bp, Homo sapiens
agaggacagtctggagaa

SEQ ID NO: 2163549 - DNA, 20 bp, Homo sapiens
agaggttgggcttccatgcc

SEQ ID NO: 2163550 - DNA, 14 bp, Homo sapiens
agagtgccactgcg

SEQ ID NO: 2163551 - DNA, 18 bp, Homo sapiens
agagtgccactgcgggag

SEQ ID NO: 2163552 - DNA, 17 bp, Homo sapiens
agatcttccgtggtcag

SEQ ID NO: 2163553 - DNA, 20 bp, Homo sapiens
agatcttccgtggtcagagt

SEQ ID NO: 2163554 - DNA, 16 bp, Homo sapiens
agatggaaaaataaca

SEQ ID NO: 2163555 - DNA, 17 bp, Homo sapiens
agatggaaaaataacaa

SEQ ID NO: 2163556 - DNA, 17 bp, Homo sapiens
agattgagaagccatgt

SEQ ID NO: 2163557 - DNA, 16 bp, Homo sapiens
agatttgtgaactgga

SEQ ID NO: 2163558 - DNA, 20 bp, Homo sapiens
agcaacaaagattgagaagc

SEQ ID NO: 2163559 - DNA, 22 bp, Homo sapiens
agcaacaaagattgagaagcca

SEQ ID NO: 2163560 - DNA, 16 bp, Homo sapiens
agccttcaagtgccaa

SEQ ID NO: 2163561 - DNA, 18 bp, Homo sapiens
agccttcaagtgccaaac

SEQ ID NO: 2163562 - DNA, 19 bp, Homo sapiens
agctaggatggttctgtga

SEQ ID NO: 2163563 - DNA, 21 bp, Homo sapiens
agctaggatggttctgtgacc

SEQ ID NO: 2163564 - DNA, 20 bp, Homo sapiens
agctttcctggtccctcacc

SEQ ID NO: 2163565 - DNA, 17 bp, Homo sapiens
aggacagtctggagaag

SEQ ID NO: 2163566 - DNA, 20 bp, Homo sapiens
aggacagtctggagaaggta

SEQ ID NO: 2163567 - DNA, 15 bp, Homo sapiens
aggatctttgactga

SEQ ID NO: 2163568 - DNA, 16 bp, Homo sapiens
aggatggttctgtgac

SEQ ID NO: 2163569 - DNA, 23 bp, Homo sapiens
agggaccttcatgcccttctgat

SEQ ID NO: 2163570 - DNA, 21 bp, Homo sapiens
aggggttaacttggtcagagc

SEQ ID NO: 2163571 - DNA, 18 bp, Homo sapiens
aggtgctgatgtcaaagt

SEQ ID NO: 2163572 - DNA, 20 bp, Homo sapiens
aggtgctgatgtcaaagtgt

SEQ ID NO: 2163573 - DNA, 22 bp, Homo sapiens
agtaatttattgtctgtctaca

SEQ ID NO: 2163574 - DNA, 12 bp, Homo sapiens
agtcacaaagac

SEQ ID NO: 2163575 - DNA, 13 bp, Homo sapiens
agtctcagaagag

SEQ ID NO: 2163576 - DNA, 15 bp, Homo sapiens
agtgcagcagaggac

SEQ ID NO: 2163577 - DNA, 16 bp, Homo sapiens
agtgcagcagaggaca

SEQ ID NO: 2163578 - DNA, 15 bp, Homo sapiens
agtgccaaacagagt

SEQ ID NO: 2163579 - DNA, 21 bp, Homo sapiens
agtgccacccacctttgccac

SEQ ID NO: 2163580 - DNA, 15 bp, Homo sapiens
ttctgaactgttaca

SEQ ID NO: 2163581 - DNA, 16 bp, Homo sapiens
ttctgtgacccatctg

SEQ ID NO: 2163582 - DNA, 20 bp, Homo sapiens
ttgactgaaaaaaaaaaaga

SEQ ID NO: 2163583 - DNA, 14 bp, Homo sapiens
ttgccaaaatacca

SEQ ID NO: 2163584 - DNA, 20 bp, Homo sapiens
ttgccaaaataccagagcct

SEQ ID NO: 2163585 - DNA, 22 bp, Homo sapiens
ttggacttcagtcttgcctagg

SEQ ID NO: 2163586 - DNA, 16 bp, Homo sapiens
ttggcaatttcctggc

SEQ ID NO: 2163587 - DNA, 19 bp, Homo sapiens
ttggcaatttcctggccct

SEQ ID NO: 2163588 - DNA, 21 bp, Homo sapiens
ttgggcctcccataattgctt

SEQ ID NO: 2163589 - DNA, 13 bp, Homo sapiens
ttgtaaatgcctc

SEQ ID NO: 2163590 - DNA, 12 bp, Homo sapiens
ttgtctgtctac

SEQ ID NO: 2163591 - DNA, 14 bp, Homo sapiens
ttgtgaactggaag

SEQ ID NO: 2163592 - DNA, 19 bp, Homo sapiens
ttgtgaactggaagaaagc

SEQ ID NO: 2163593 - DNA, 21 bp, Homo sapiens
tttatactttgcaatccaaat

SEQ ID NO: 2163594 - DNA, 23 bp, Homo sapiens
tttcaagtgcctagactgttact

SEQ ID NO: 2163595 - DNA, 14 bp, Homo sapiens
tttctgaactgtta

SEQ ID NO: 2163596 - DNA, 17 bp, Homo sapiens
tttctgaactgttacaa

SEQ ID NO: 2163597 - DNA, 22 bp, Homo sapiens
ttttgttgttgttgtttgtaaa

SEQ ID NO: 2163598 - DNA, 21 bp, Homo sapiens
cagagccttcaagtgccaaac

SEQ ID NO: 2163599 - DNA, 15 bp, Homo sapiens
cagaggacagtctgg

SEQ ID NO: 2163600 - DNA, 20 bp, Homo sapiens
cagagtatgtccgatggtat

SEQ ID NO: 2163601 - DNA, 22 bp, Homo sapiens
cagagtatgtccgatggtatct

SEQ ID NO: 2163602 - DNA, 13 bp, Homo sapiens
cagatggaaaaat

SEQ ID NO: 2163603 - DNA, 22 bp, Homo sapiens
cagcagaggacagtctggagaa

SEQ ID NO: 2163604 - DNA, 17 bp, Homo sapiens
caggatctttgactgaa

SEQ ID NO: 2163605 - DNA, 18 bp, Homo sapiens
cagggaacattggagctg

SEQ ID NO: 2163606 - DNA, 15 bp, Homo sapiens
cagtgcagcagagga

SEQ ID NO: 2163607 - DNA, 14 bp, Homo sapiens
cataattgctttgc

SEQ ID NO: 2163608 - DNA, 19 bp, Homo sapiens
cataattgctttgccaaaa

SEQ ID NO: 2163609 - DNA, 13 bp, Homo sapiens
catatttatactt

SEQ ID NO: 2163610 - DNA, 14 bp, Homo sapiens
catatttatacttt

SEQ ID NO: 2163611 - DNA, 16 bp, Homo sapiens
catatttatactttgc

SEQ ID NO: 2163612 - DNA, 19 bp, Homo sapiens
catccccacaatctggctt

SEQ ID NO: 2163613 - DNA, 19 bp, Homo sapiens
catgcaggggtcagtgcag

SEQ ID NO: 2163614 - DNA, 20 bp, Homo sapiens
catgcctgtagctttcctgg

SEQ ID NO: 2163615 - DNA, 21 bp, Homo sapiens
catgcctgtagctttcctggt

SEQ ID NO: 2163616 - DNA, 19 bp, Homo sapiens
cattggagctgactgttct

SEQ ID NO: 2163617 - DNA, 22 bp, Homo sapiens
cattggagctgactgttcttgg

SEQ ID NO: 2163618 - DNA, 16 bp, Homo sapiens
cattgggaccctccag

SEQ ID NO: 2163619 - DNA, 23 bp, Homo sapiens
cattgggaccctccagtgctgga

SEQ ID NO: 2163620 - DNA, 20 bp, Homo sapiens
catttctctaactcctgcca

SEQ ID NO: 2163621 - DNA, 17 bp, Homo sapiens
catttctgaactgttac

SEQ ID NO: 2163622 - DNA, 17 bp, Homo sapiens
ccaaaataccagagcct

SEQ ID NO: 2163623 - DNA, 16 bp, Homo sapiens
ccaagtctcagaagag

SEQ ID NO: 2163624 - DNA, 22 bp, Homo sapiens
ccacaaagctaggatggttctg

SEQ ID NO: 2163625 - DNA, 13 bp, Homo sapiens
ccacaatctggct

SEQ ID NO: 2163626 - DNA, 17 bp, Homo sapiens
ccacagcgtgggaactc

SEQ ID NO: 2163627 - DNA, 15 bp, Homo sapiens
ccaccaagggatctg

SEQ ID NO: 2163628 - DNA, 12 bp, Homo sapiens
ccacttcccctc

SEQ ID NO: 2163629 - DNA, 12 bp, Homo sapiens
ccagagccttca

SEQ ID NO: 2163630 - DNA, 17 bp, Homo sapiens
ccagagccttcaagtgc

SEQ ID NO: 2163631 - DNA, 17 bp, Homo sapiens
ccaggatctttgactga

SEQ ID NO: 2163632 - DNA, 19 bp, Homo sapiens
ccatttctgaactgttaca

SEQ ID NO: 2163633 - DNA, 22 bp, Homo sapiens
ccatttgtgttttgaaagccca

SEQ ID NO: 2163634 - DNA, 17 bp, Homo sapiens
ccctcataagtttgttt

SEQ ID NO: 2163635 - DNA, 23 bp, Homo sapiens
ccctcataagtttgtttaaacac

SEQ ID NO: 2163636 - DNA, 14 bp, Homo sapiens
ccgtgtcctctccc

SEQ ID NO: 2163637 - DNA, 17 bp, Homo sapiens
ccgtgtcctctccctgc

SEQ ID NO: 2163638 - DNA, 18 bp, Homo sapiens
cctccaccaaaccccact

SEQ ID NO: 2163639 - DNA, 16 bp, Homo sapiens
cctcccataattgctt

SEQ ID NO: 2163640 - DNA, 14 bp, Homo sapiens
cctcttaaattata

SEQ ID NO: 2163641 - DNA, 19 bp, Homo sapiens
cctcttaaattatatattt

SEQ ID NO: 2163642 - DNA, 20 bp, Homo sapiens
cctggccctccactcctcat

SEQ ID NO: 2163643 - DNA, 15 bp, Homo sapiens
cctggtccctcaccc

SEQ ID NO: 2163644 - DNA, 23 bp, Homo sapiens
cctggtccctcacccccatggcc

SEQ ID NO: 2163645 - DNA, 14 bp, Homo sapiens
cctggttcatattt

SEQ ID NO: 2163646 - DNA, 16 bp, Homo sapiens
cctggttcatatttat

SEQ ID NO: 2163647 - DNA, 19 bp, Homo sapiens
cctgtagctttcctggtcc

SEQ ID NO: 2163648 - DNA, 22 bp, Homo sapiens
cctgtagctttcctggtccctc

SEQ ID NO: 2163649 - DNA, 14 bp, Homo sapiens
ccttcaagtgccaa

SEQ ID NO: 2163650 - DNA, 15 bp, Homo sapiens
ccttcaagtgccaaa

SEQ ID NO: 2163651 - DNA, 16 bp, Homo sapiens
ccttcaagtgccaaac

SEQ ID NO: 2163652 - DNA, 21 bp, Homo sapiens
cctttctggaagtttctggtg

SEQ ID NO: 2163653 - DNA, 15 bp, Homo sapiens
cggctggggactgct

SEQ ID NO: 2163654 - DNA, 16 bp, Homo sapiens
cggctggggactgcta

SEQ ID NO: 2163655 - DNA, 21 bp, Homo sapiens
cgtccccagttgccgtctagg

SEQ ID NO: 2163656 - DNA, 20 bp, Homo sapiens
cgtgtcctctccctgccaag

SEQ ID NO: 2163657 - DNA, 21 bp, Homo sapiens
ctaacaataatatttcaagtg

SEQ ID NO: 2163658 - DNA, 22 bp, Homo sapiens
ctaacaataatatttcaagtgc

SEQ ID NO: 2163659 - DNA, 15 bp, Homo sapiens
ctagactgttacttt

SEQ ID NO: 2163660 - DNA, 24 bp, Homo sapiens
ctaggcgattttgtctaccatttg

SEQ ID NO: 2163661 - DNA, 15 bp, Homo sapiens
ctatgagttggactt

SEQ ID NO: 2163662 - DNA, 11 bp, Homo sapiens
ctatgtatgtt

SEQ ID NO: 2163663 - DNA, 14 bp, Homo sapiens
ctatgtatgttaat

SEQ ID NO: 2163664 - DNA, 18 bp, Homo sapiens
ctatgtatgttaatttat

SEQ ID NO: 2163665 - DNA, 22 bp, Homo sapiens
ctcagaagaggttgggcttcca

SEQ ID NO: 2163666 - DNA, 22 bp, Homo sapiens
ctccatgcaggggtcagtgcag

SEQ ID NO: 2163667 - DNA, 16 bp, Homo sapiens
ctctaactcctgccat

SEQ ID NO: 2163668 - DNA, 21 bp, Homo sapiens
ctctccctgccaagtctcaga

SEQ ID NO: 2163669 - DNA, 20 bp, Homo sapiens
ctgaaaaaaaaaaagaagaa

SEQ ID NO: 2163670 - DNA, 13 bp, Homo sapiens
ctgaactgttaca

SEQ ID NO: 2163671 - DNA, 20 bp, Homo sapiens
ctgaattttgggacttctac

SEQ ID NO: 2163672 - DNA, 21 bp, Homo sapiens
ctgagaaggaacagggaacat

SEQ ID NO: 2163673 - DNA, 14 bp, Homo sapiens
ctgatgtcaaagtg

SEQ ID NO: 2163674 - DNA, 15 bp, Homo sapiens
ctgattcccctccac

SEQ ID NO: 2163675 - DNA, 17 bp, Homo sapiens
ctgcagatcttccgtgg

SEQ ID NO: 2163676 - DNA, 16 bp, Homo sapiens
ctgccattcttctggt

SEQ ID NO: 2163677 - DNA, 19 bp, Homo sapiens
ctgccattgggaccctcca

SEQ ID NO: 2163678 - DNA, 15 bp, Homo sapiens
ctgctacctctgaga

SEQ ID NO: 2163679 - DNA, 16 bp, Homo sapiens
ctggccctccactcct

SEQ ID NO: 2163680 - DNA, 21 bp, Homo sapiens
ctggccctccactcctcatcc

SEQ ID NO: 2163681 - DNA, 14 bp, Homo sapiens
ctggcttagtgcca

SEQ ID NO: 2163682 - DNA, 15 bp, Homo sapiens
ctggcttagtgccac

SEQ ID NO: 2163683 - DNA, 15 bp, Homo sapiens
ctgggtaagaagaaa

SEQ ID NO: 2163684 - DNA, 23 bp, Homo sapiens
ctgggtaagaagaaagcaaaagc

SEQ ID NO: 2163685 - DNA, 15 bp, Homo sapiens
ctggtgccatttctg

SEQ ID NO: 2163686 - DNA, 16 bp, Homo sapiens
ctgtagctttcctggt

SEQ ID NO: 2163687 - DNA, 22 bp, Homo sapiens
ctgtagctttcctggtccctca

SEQ ID NO: 2163688 - DNA, 19 bp, Homo sapiens
ctgtagtaatttattgtct

SEQ ID NO: 2163689 - DNA, 18 bp, Homo sapiens
ctgtcatggtcctttctg

SEQ ID NO: 2163690 - DNA, 13 bp, Homo sapiens
ctgtctacatttc

SEQ ID NO: 2163691 - DNA, 20 bp, Homo sapiens
ctgtgaaataccacaagcct

SEQ ID NO: 2163692 - DNA, 13 bp, Homo sapiens
ctgtgacccatct

SEQ ID NO: 2163693 - DNA, 14 bp, Homo sapiens
ctgtgacccatctg

SEQ ID NO: 2163694 - DNA, 22 bp, Homo sapiens
ctgttcttggtaactgattacc

SEQ ID NO: 2163695 - DNA, 18 bp, Homo sapiens
cttagtgccacccacctt

SEQ ID NO: 2163696 - DNA, 12 bp, Homo sapiens
cttcaagtgcca

SEQ ID NO: 2163697 - DNA, 19 bp, Homo sapiens
cttcaagtgccaaacagag

SEQ ID NO: 2163698 - DNA, 23 bp, Homo sapiens
cttccgtggtcagagtgccactg

SEQ ID NO: 2163699 - DNA, 15 bp, Homo sapiens
cttctgattcccctc

SEQ ID NO: 2163700 - DNA, 15 bp, Homo sapiens
cttctggtgctactc

SEQ ID NO: 2163701 - DNA, 19 bp, Homo sapiens
cttctggtgctactccatg

SEQ ID NO: 2163702 - DNA, 14 bp, Homo sapiens
cttggtcagagcca

SEQ ID NO: 2163703 - DNA, 15 bp, Homo sapiens
cttggtcagagccac

SEQ ID NO: 2163704 - DNA, 18 bp, Homo sapiens
cttgtgtcaagacatttc

SEQ ID NO: 2163705 - DNA, 19 bp, Homo sapiens
cttgtgtcaagacatttct

SEQ ID NO: 2163706 - DNA, 18 bp, Homo sapiens
ctttcccttgtgtcaaga

SEQ ID NO: 2163707 - DNA, 19 bp, Homo sapiens
ctttgcaatccaaataaag

SEQ ID NO: 2163708 - DNA, 16 bp, Homo sapiens
ctttgccaaaatacca

SEQ ID NO: 2163709 - DNA, 17 bp, Homo sapiens
ctttggcaatttcctgg

SEQ ID NO: 2163710 - DNA, 16 bp, Homo sapiens
gaaaaataacaactat

SEQ ID NO: 2163711 - DNA, 22 bp, Homo sapiens
gaaagcaacaaagattgagaag

SEQ ID NO: 2163712 - DNA, 13 bp, Homo sapiens
gaaagcccaaggt

SEQ ID NO: 2163713 - DNA, 16 bp, Homo sapiens
gaacattggagctgac

SEQ ID NO: 2163714 - DNA, 18 bp, Homo sapiens
gaactgaattttgggact

SEQ ID NO: 2163715 - DNA, 14 bp, Homo sapiens
gaatcggctgggga

SEQ ID NO: 2163716 - DNA, 22 bp, Homo sapiens
gacatttctctaactcctgcca

SEQ ID NO: 2163717 - DNA, 22 bp, Homo sapiens
gactgaaaaaaaaaaagaagaa

SEQ ID NO: 2163718 - DNA, 23 bp, Homo sapiens
gactgaaaaaaaaaaagaagaag

SEQ ID NO: 2163719 - DNA, 16 bp, Homo sapiens
gactgcagaggggaaa

SEQ ID NO: 2163720 - DNA, 23 bp, Homo sapiens
gactgcagaggggaaagacttcc

SEQ ID NO: 2163721 - DNA, 19 bp, Homo sapiens
gactgctacctctgagaag

SEQ ID NO: 2163722 - DNA, 21 bp, Homo sapiens
gactgctacctctgagaagac

SEQ ID NO: 2163723 - DNA, 14 bp, Homo sapiens
gacttctacccaga

SEQ ID NO: 2163724 - DNA, 15 bp, Homo sapiens
gagaagccatgtact

SEQ ID NO: 2163725 - DNA, 14 bp, Homo sapiens
aaaaggctgagaag

SEQ ID NO: 2163726 - DNA, 15 bp, Homo sapiens
aaaaggctgagaagg

SEQ ID NO: 2163727 - DNA, 21 bp, Homo sapiens
aaaataccagagccttcaagt

SEQ ID NO: 2163728 - DNA, 21 bp, Homo sapiens
aaacctggttcatatttatac

SEQ ID NO: 2163729 - DNA, 18 bp, Homo sapiens
aaagatttgtgaactgga

SEQ ID NO: 2163730 - DNA, 21 bp, Homo sapiens
aaagatttgtgaactggaaga

SEQ ID NO: 2163731 - DNA, 17 bp, Homo sapiens
aaagcaaaaggctgaga

SEQ ID NO: 2163732 - DNA, 13 bp, Homo sapiens
aaaggctgagaag

SEQ ID NO: 2163733 - DNA, 17 bp, Homo sapiens
aaataaagataaccctt

SEQ ID NO: 2163734 - DNA, 14 bp, Homo sapiens
aaataccacaagcc

SEQ ID NO: 2163735 - DNA, 19 bp, Homo sapiens
aaataccacaagcctgaga

SEQ ID NO: 2163736 - DNA, 14 bp, Homo sapiens
taatatttcaagtg

SEQ ID NO: 2163737 - DNA, 19 bp, Homo sapiens
taatttattgtctgtctac

SEQ ID NO: 2163738 - DNA, 20 bp, Homo sapiens
taatttattgtctgtctaca

SEQ ID NO: 2163739 - DNA, 19 bp, Homo sapiens
taatttatttagtttttaa

SEQ ID NO: 2163740 - DNA, 17 bp, Homo sapiens
taccacaagcctgagaa

SEQ ID NO: 2163741 - DNA, 18 bp, Homo sapiens
taccagagccttcaagtg

SEQ ID NO: 2163742 - DNA, 12 bp, Homo sapiens
taccatttgtgt

SEQ ID NO: 2163743 - DNA, 13 bp, Homo sapiens
tacctctgagaag

SEQ ID NO: 2163744 - DNA, 13 bp, Homo sapiens
tactcaagtacca

SEQ ID NO: 2163745 - DNA, 22 bp, Homo sapiens
tactttgcaatccaaataaaga

SEQ ID NO: 2163746 - DNA, 23 bp, Homo sapiens
tagcaaagcaaaaggctgagaag

SEQ ID NO: 2163747 - DNA, 21 bp, Homo sapiens
tagtaatttattgtctgtcta

SEQ ID NO: 2163748 - DNA, 23 bp, Homo sapiens
tagtaatttattgtctgtctaca

SEQ ID NO: 2163749 - DNA, 13 bp, Homo sapiens
tagtgccacccac

SEQ ID NO: 2163750 - DNA, 16 bp, Homo sapiens
tagtgccacccacctt

SEQ ID NO: 2163751 - DNA, 12 bp, Homo sapiens
tatcttctggat

SEQ ID NO: 2163752 - DNA, 14 bp, Homo sapiens
tattgtctgtctac

SEQ ID NO: 2163753 - DNA, 11 bp, Homo sapiens
tatttcaagtg

SEQ ID NO: 2163754 - DNA, 13 bp, Homo sapiens
tatttttgttgtt

SEQ ID NO: 2163755 - DNA, 13 bp, Homo sapiens
tcaagacatttct

SEQ ID NO: 2163756 - DNA, 14 bp, Homo sapiens
tcaaggaatcggct

SEQ ID NO: 2163757 - DNA, 22 bp, Homo sapiens
tcaagtaccaccaagggatctg

SEQ ID NO: 2163758 - DNA, 21 bp, Homo sapiens
tcactttcccttgtgtcaaga

SEQ ID NO: 2163759 - DNA, 11 bp, Homo sapiens
tcagagccact

SEQ ID NO: 2163760 - DNA, 12 bp, Homo sapiens
tcagagccactc

SEQ ID NO: 2163761 - DNA, 18 bp, Homo sapiens
tcagagccactctatgag

SEQ ID NO: 2163762 - DNA, 13 bp, Homo sapiens
tcagagtgccact

SEQ ID NO: 2163763 - DNA, 17 bp, Homo sapiens
tcagtgcagcagaggac

SEQ ID NO: 2163764 - DNA, 19 bp, Homo sapiens
tcagtgtctccccgtgtcc

SEQ ID NO: 2163765 - DNA, 15 bp, Homo sapiens
tcatggtcctttctg

SEQ ID NO: 2163766 - DNA, 13 bp, Homo sapiens
tccagtgctggat

SEQ ID NO: 2163767 - DNA, 19 bp, Homo sapiens
tccagtgctggatttgatg

SEQ ID NO: 2163768 - DNA, 21 bp, Homo sapiens
tccatgcctgtagctttcctg

SEQ ID NO: 2163769 - DNA, 23 bp, Homo sapiens
tccatgcctgtagctttcctggt

SEQ ID NO: 2163770 - DNA, 16 bp, Homo sapiens
tccccagttgccgtct

SEQ ID NO: 2163771 - DNA, 19 bp, Homo sapiens
tccccgtgtcctctccctg

SEQ ID NO: 2163772 - DNA, 15 bp, Homo sapiens
tcccttgtgtcaaga

SEQ ID NO: 2163773 - DNA, 22 bp, Homo sapiens
tcccttgtgtcaagacatttct

SEQ ID NO: 2163774 - DNA, 18 bp, Homo sapiens
tccgtggtcagagtgcca

SEQ ID NO: 2163775 - DNA, 21 bp, Homo sapiens
tccgtggtcagagtgccactg

SEQ ID NO: 2163776 - DNA, 17 bp, Homo sapiens
tcctctccctgccaagt

SEQ ID NO: 2163777 - DNA, 18 bp, Homo sapiens
tcctctccctgccaagtc

SEQ ID NO: 2163778 - DNA, 13 bp, Homo sapiens
tcctggtccctca

SEQ ID NO: 2163779 - DNA, 15 bp, Homo sapiens
tctaacaataatatt

SEQ ID NO: 2163780 - DNA, 18 bp, Homo sapiens
tctaacaataatatttca

SEQ ID NO: 2163781 - DNA, 23 bp, Homo sapiens
tctaacaataatatttcaagtgc

SEQ ID NO: 2163782 - DNA, 15 bp, Homo sapiens
tctaactcctgccat

SEQ ID NO: 2163783 - DNA, 20 bp, Homo sapiens
tctacatttctgcagatctt

SEQ ID NO: 2163784 - DNA, 16 bp, Homo sapiens
tctaggattgggcctc

SEQ ID NO: 2163785 - DNA, 20 bp, Homo sapiens
tctaggattgggcctcccat

SEQ ID NO: 2163786 - DNA, 19 bp, Homo sapiens
tctagtcacaaagactcct

SEQ ID NO: 2163787 - DNA, 12 bp, Homo sapiens
tctatgtatgtt

SEQ ID NO: 2163788 - DNA, 20 bp, Homo sapiens
tctatgtatgttaatttatt

SEQ ID NO: 2163789 - DNA, 23 bp, Homo sapiens
tctatgtatgttaatttatttag

SEQ ID NO: 2163790 - DNA, 23 bp, Homo sapiens
tctccctgccaagtctcagaaga

SEQ ID NO: 2163791 - DNA, 16 bp, Homo sapiens
tctctaactcctgcca

SEQ ID NO: 2163792 - DNA, 13 bp, Homo sapiens
tctgaactgttac

SEQ ID NO: 2163793 - DNA, 14 bp, Homo sapiens
tctgaactgttaca

SEQ ID NO: 2163794 - DNA, 18 bp, Homo sapiens
tctgaactgttacaactt

SEQ ID NO: 2163795 - DNA, 11 bp, Homo sapiens
tctgagaagac

SEQ ID NO: 2163796 - DNA, 22 bp, Homo sapiens
tctgcagatcttccgtggtcag

SEQ ID NO: 2163797 - DNA, 15 bp, Homo sapiens
tctgccattgggacc

SEQ ID NO: 2163798 - DNA, 17 bp, Homo sapiens
tctgccattgggaccct

SEQ ID NO: 2163799 - DNA, 16 bp, Homo sapiens
tctggaagtttctggt

SEQ ID NO: 2163800 - DNA, 15 bp, Homo sapiens
tctggcttagtgcca

SEQ ID NO: 2163801 - DNA, 17 bp, Homo sapiens
tctgggtaagaagaaag

SEQ ID NO: 2163802 - DNA, 24 bp, Homo sapiens
tctgtagtaatttattgtctgtct

SEQ ID NO: 2163803 - DNA, 20 bp, Homo sapiens
tgaaaaaaaaaaagaagaag

SEQ ID NO: 2163804 - DNA, 12 bp, Homo sapiens
tgaactggaaga

SEQ ID NO: 2163805 - DNA, 13 bp, Homo sapiens
tgaactgttacaa

SEQ ID NO: 2163806 - DNA, 22 bp, Homo sapiens
tgagaagccatgtactcaagta

SEQ ID NO: 2163807 - DNA, 13 bp, Homo sapiens
tgagaaggaacag

SEQ ID NO: 2163808 - DNA, 19 bp, Homo sapiens
tgatgagttaactgtgaaa

SEQ ID NO: 2163809 - DNA, 20 bp, Homo sapiens
tgatgagttaactgtgaaat

SEQ ID NO: 2163810 - DNA, 14 bp, Homo sapiens
tgattacctgccaa

SEQ ID NO: 2163811 - DNA, 15 bp, Homo sapiens
tgattacctgccaat

SEQ ID NO: 2163812 - DNA, 23 bp, Homo sapiens
tgcaggggtcagtgcagcagagg

SEQ ID NO: 2163813 - DNA, 19 bp, Homo sapiens
tgccaaaataccagagcct

SEQ ID NO: 2163814 - DNA, 15 bp, Homo sapiens
tgccaattgctaccg

SEQ ID NO: 2163815 - DNA, 23 bp, Homo sapiens
tgccactgcgggagctctgtatg

SEQ ID NO: 2163816 - DNA, 17 bp, Homo sapiens
tgccattgggaccctcc

SEQ ID NO: 2163817 - DNA, 21 bp, Homo sapiens
tgccattgggaccctccagtg

SEQ ID NO: 2163818 - DNA, 12 bp, Homo sapiens
tgcccttctgat

SEQ ID NO: 2163819 - DNA, 20 bp, Homo sapiens
tgccgtctaggattgggcct

SEQ ID NO: 2163820 - DNA, 15 bp, Homo sapiens
tgcctagactgttac

SEQ ID NO: 2163821 - DNA, 16 bp, Homo sapiens
tgcctagactgttact

SEQ ID NO: 2163822 - DNA, 17 bp, Homo sapiens
tgcctaggcgattttgt

SEQ ID NO: 2163823 - DNA, 19 bp, Homo sapiens
tgcctcttaaattatatat

SEQ ID NO: 2163824 - DNA, 19 bp, Homo sapiens
tgcctgtagctttcctggt

SEQ ID NO: 2163825 - DNA, 20 bp, Homo sapiens
tgcctgtagctttcctggtc

SEQ ID NO: 2163826 - DNA, 15 bp, Homo sapiens
tgctaccgagaaggt

SEQ ID NO: 2163827 - DNA, 17 bp, Homo sapiens
tgctacctctgagaaga

SEQ ID NO: 2163828 - DNA, 18 bp, Homo sapiens
tgctacctctgagaagac

SEQ ID NO: 2163829 - DNA, 14 bp, Homo sapiens
tgctactccatgca

SEQ ID NO: 2163830 - DNA, 15 bp, Homo sapiens
tgctgtcatggtcct

SEQ ID NO: 2163831 - DNA, 16 bp, Homo sapiens
tggagctgactgttct

SEQ ID NO: 2163832 - DNA, 15 bp, Homo sapiens
tggccctccactcct

SEQ ID NO: 2163833 - DNA, 20 bp, Homo sapiens
tgggaccctccagtgctgga

SEQ ID NO: 2163834 - DNA, 21 bp, Homo sapiens
tgggaccctccagtgctggat

SEQ ID NO: 2163835 - DNA, 16 bp, Homo sapiens
tgggacttctacccag

SEQ ID NO: 2163836 - DNA, 14 bp, Homo sapiens
tggggactgctacc

SEQ ID NO: 2163837 - DNA, 21 bp, Homo sapiens
tggtgccatttctgaactgtt

SEQ ID NO: 2163838 - DNA, 19 bp, Homo sapiens
tggttcatatttatacttt

SEQ ID NO: 2163839 - DNA, 12 bp, Homo sapiens
tggttctgtgac

SEQ ID NO: 2163840 - DNA, 11 bp, Homo sapiens
tgtaaatgcct

SEQ ID NO: 2163841 - DNA, 13 bp, Homo sapiens
tgtagtaatttat

SEQ ID NO: 2163842 - DNA, 22 bp, Homo sapiens
tgtatttccaaacctggttcat

SEQ ID NO: 2163843 - DNA, 19 bp, Homo sapiens
tgtcatggtcctttctgga

SEQ ID NO: 2163844 - DNA, 14 bp, Homo sapiens
tgtcctctccctgc

SEQ ID NO: 2163845 - DNA, 13 bp, Homo sapiens
tgtctacatttct

SEQ ID NO: 2163846 - DNA, 12 bp, Homo sapiens
tgtctgtctaca

SEQ ID NO: 2163847 - DNA, 13 bp, Homo sapiens
tgtgaaataccac

SEQ ID NO: 2163848 - DNA, 15 bp, Homo sapiens
tgttaatttatttag

SEQ ID NO: 2163849 - DNA, 20 bp, Homo sapiens
tgttacaacttgtatttcca

SEQ ID NO: 2163850 - DNA, 17 bp, Homo sapiens
tgtttgtaaatgcctct

SEQ ID NO: 2163851 - DNA, 22 bp, Homo sapiens
tgtttgtaaatgcctcttaaat

SEQ ID NO: 2163852 - DNA, 17 bp, Homo sapiens
ttaacaatctaacaata

SEQ ID NO: 2163853 - DNA, 18 bp, Homo sapiens
ttaacttggtcagagcca

SEQ ID NO: 2163854 - DNA, 20 bp, Homo sapiens
ttacctgccaattgctaccg

SEQ ID NO: 2163855 - DNA, 20 bp, Homo sapiens
ttactttggcaatttcctgg

SEQ ID NO: 2163856 - DNA, 17 bp, Homo sapiens
ttagtttttaacaatct

SEQ ID NO: 2163857 - DNA, 14 bp, Homo sapiens
ttatcttctggatt

SEQ ID NO: 2163858 - DNA, 23 bp, Homo sapiens
ttcatgcccttctgattcccctc

SEQ ID NO: 2163859 - DNA, 17 bp, Homo sapiens
ttccaaacctggttcat

SEQ ID NO: 2163860 - DNA, 16 bp, Homo sapiens
ttccatatgctccagg

SEQ ID NO: 2163861 - DNA, 23 bp, Homo sapiens
ttcccttgtgtcaagacatttct

SEQ ID NO: 2163862 - DNA, 19 bp, Homo sapiens
ttccgtggtcagagtgcca

SEQ ID NO: 2163863 - DNA, 21 bp, Homo sapiens
ttccgtggtcagagtgccact

SEQ ID NO: 2163864 - DNA, 23 bp, Homo sapiens
aaaataccagagccttcaagtgc

SEQ ID NO: 2163865 - DNA, 21 bp, Homo sapiens
aaagaagaagaagaaggagag

SEQ ID NO: 2163866 - DNA, 19 bp, Homo sapiens
aaataacaactatttttgt

SEQ ID NO: 2163867 - DNA, 15 bp, Homo sapiens
aaataccacaagcct

SEQ ID NO: 2163868 - DNA, 14 bp, Homo sapiens
aaataccagagcct

SEQ ID NO: 2163869 - DNA, 13 bp, Homo sapiens
aaatgcctcttaa

SEQ ID NO: 2163870 - DNA, 17 bp, Homo sapiens
aaatgcctcttaaatta

SEQ ID NO: 2163871 - DNA, 22 bp, Homo sapiens
aaatgcctcttaaattatatat

SEQ ID NO: 2163872 - DNA, 15 bp, Homo sapiens
aaattatatatttat

SEQ ID NO: 2163873 - DNA, 14 bp, Homo sapiens
aacaaagattgaga

SEQ ID NO: 2163874 - DNA, 20 bp, Homo sapiens
aacaataatatttcaagtgc

SEQ ID NO: 2163875 - DNA, 15 bp, Homo sapiens
aacaatctaacaata

SEQ ID NO: 2163876 - DNA, 18 bp, Homo sapiens
aacacttatcttctggat

SEQ ID NO: 2163877 - DNA, 14 bp, Homo sapiens
aacccttattccat

SEQ ID NO: 2163878 - DNA, 15 bp, Homo sapiens
aacctggttcatatt

SEQ ID NO: 2163879 - DNA, 15 bp, Homo sapiens
aactcctgccattct

SEQ ID NO: 2163880 - DNA, 17 bp, Homo sapiens
aacttggtcagagccac

SEQ ID NO: 2163881 - DNA, 12 bp, Homo sapiens
aagaagaaagca

SEQ ID NO: 2163882 - DNA, 16 bp, Homo sapiens
aagaaggagagcaaga

SEQ ID NO: 2163883 - DNA, 14 bp, Homo sapiens
aagattgagaagcc

SEQ ID NO: 2163884 - DNA, 16 bp, Homo sapiens
aagatttgtgaactgg

SEQ ID NO: 2163885 - DNA, 20 bp, Homo sapiens
aagcaacaaagattgagaag

SEQ ID NO: 2163886 - DNA, 19 bp, Homo sapiens
aaggaaagatttgtgaact

SEQ ID NO: 2163887 - DNA, 14 bp, Homo sapiens
aaggagagcaagaa

SEQ ID NO: 2163888 - DNA, 14 bp, Homo sapiens
aaggctgagaagga

SEQ ID NO: 2163889 - DNA, 15 bp, Homo sapiens
aaggtattagcaaag

SEQ ID NO: 2163890 - DNA, 13 bp, Homo sapiens
aagtctcagaaga

SEQ ID NO: 2163891 - DNA, 14 bp, Homo sapiens
aagtgccaaacaga

SEQ ID NO: 2163892 - DNA, 17 bp, Homo sapiens
aagtttctggtgccatt

SEQ ID NO: 2163893 - DNA, 22 bp, Homo sapiens
aagtttctggtgccatttctga

SEQ ID NO: 2163894 - DNA, 17 bp, Homo sapiens
aataatatttcaagtgc

SEQ ID NO: 2163895 - DNA, 18 bp, Homo sapiens
aataatatttcaagtgcc

SEQ ID NO: 2163896 - DNA, 19 bp, Homo sapiens
aataatatttcaagtgcct

SEQ ID NO: 2163897 - DNA, 23 bp, Homo sapiens
aataccagagccttcaagtgcca

SEQ ID NO: 2163898 - DNA, 18 bp, Homo sapiens
aatcggctggggactgct

SEQ ID NO: 2163899 - DNA, 17 bp, Homo sapiens
aatctaacaataatatt

SEQ ID NO: 2163900 - DNA, 15 bp, Homo sapiens
cagagccttcaagtg

SEQ ID NO: 2163901 - DNA, 18 bp, Homo sapiens
cagagccttcaagtgcca

SEQ ID NO: 2163902 - DNA, 21 bp, Homo sapiens
cagaggacagtctggagaagg

SEQ ID NO: 2163903 - DNA, 14 bp, Homo sapiens
cagagtgccactgc

SEQ ID NO: 2163904 - DNA, 15 bp, Homo sapiens
cagatatcagtgtct

SEQ ID NO: 2163905 - DNA, 23 bp, Homo sapiens
cagatcttccgtggtcagagtgc

SEQ ID NO: 2163906 - DNA, 17 bp, Homo sapiens
cagatggaaaaataaca

SEQ ID NO: 2163907 - DNA, 21 bp, Homo sapiens
cagcagaggacagtctggaga

SEQ ID NO: 2163908 - DNA, 22 bp, Homo sapiens
cagcgtgggaactcactttccc

SEQ ID NO: 2163909 - DNA, 22 bp, Homo sapiens
caggcccacagcgtgggaactc

SEQ ID NO: 2163910 - DNA, 15 bp, Homo sapiens
caggggtcagtgcag

SEQ ID NO: 2163911 - DNA, 21 bp, Homo sapiens
caggggtcagtgcagcagagg

SEQ ID NO: 2163912 - DNA, 16 bp, Homo sapiens
cagtgcagcagaggac

SEQ ID NO: 2163913 - DNA, 21 bp, Homo sapiens
cagtgctggatttgatgagtt

SEQ ID NO: 2163914 - DNA, 14 bp, Homo sapiens
catggtcctttctg

SEQ ID NO: 2163915 - DNA, 18 bp, Homo sapiens
catggtcctttctggaag

SEQ ID NO: 2163916 - DNA, 19 bp, Homo sapiens
catggtcctttctggaagt

SEQ ID NO: 2163917 - DNA, 18 bp, Homo sapiens
cattcttctggtgctact

SEQ ID NO: 2163918 - DNA, 17 bp, Homo sapiens
cattgggaccctccagt

SEQ ID NO: 2163919 - DNA, 22 bp, Homo sapiens
catttgtgttttgaaagcccaa

SEQ ID NO: 2163920 - DNA, 20 bp, Homo sapiens
ccaaaataccagagccttca

SEQ ID NO: 2163921 - DNA, 17 bp, Homo sapiens
ccacaagcctgagaact

SEQ ID NO: 2163922 - DNA, 23 bp, Homo sapiens
ccacaagcctgagaactgaattt

SEQ ID NO: 2163923 - DNA, 17 bp, Homo sapiens
ccactctatgagttgga

SEQ ID NO: 2163924 - DNA, 18 bp, Homo sapiens
ccagagccttcaagtgcc

SEQ ID NO: 2163925 - DNA, 18 bp, Homo sapiens
ccagatggaaaaataaca

SEQ ID NO: 2163926 - DNA, 16 bp, Homo sapiens
ccaggatctttgactg

SEQ ID NO: 2163927 - DNA, 19 bp, Homo sapiens
ccataattgctttgccaaa

SEQ ID NO: 2163928 - DNA, 12 bp, Homo sapiens
ccatatgctcca

SEQ ID NO: 2163929 - DNA, 14 bp, Homo sapiens
ccatggccccaggc

SEQ ID NO: 2163930 - DNA, 15 bp, Homo sapiens
ccatggccccaggcc

SEQ ID NO: 2163931 - DNA, 16 bp, Homo sapiens
ccatggccccaggccc

SEQ ID NO: 2163932 - DNA, 14 bp, Homo sapiens
cccgtgtcctctcc

SEQ ID NO: 2163933 - DNA, 20 bp, Homo sapiens
cccgtgtcctctccctgcca

SEQ ID NO: 2163934 - DNA, 18 bp, Homo sapiens
ccctccagtgctggattt

SEQ ID NO: 2163935 - DNA, 17 bp, Homo sapiens
ccctgccaagtctcaga

SEQ ID NO: 2163936 - DNA, 14 bp, Homo sapiens
cccttgtgtcaaga

SEQ ID NO: 2163937 - DNA, 19 bp, Homo sapiens
ccggttaaattccatatgc

SEQ ID NO: 2163938 - DNA, 23 bp, Homo sapiens
cctaggcgattttgtctaccatt

SEQ ID NO: 2163939 - DNA, 21 bp, Homo sapiens
cctcaccaaaacgatgaagtt

SEQ ID NO: 2163940 - DNA, 16 bp, Homo sapiens
cctccagtgctggatt

SEQ ID NO: 2163941 - DNA, 13 bp, Homo sapiens
cctgagaactgaa

SEQ ID NO: 2163942 - DNA, 23 bp, Homo sapiens
cctgagaactgaattttgggact

SEQ ID NO: 2163943 - DNA, 20 bp, Homo sapiens
cctgccaagtctcagaagag

SEQ ID NO: 2163944 - DNA, 13 bp, Homo sapiens
cctgccaattgct

SEQ ID NO: 2163945 - DNA, 16 bp, Homo sapiens
cctgccattcttctgg

SEQ ID NO: 2163946 - DNA, 17 bp, Homo sapiens
cctgccattcttctggt

SEQ ID NO: 2163947 - DNA, 23 bp, Homo sapiens
cctgccattcttctggtgctact

SEQ ID NO: 2163948 - DNA, 19 bp, Homo sapiens
ccttcgtccccagttgccg

SEQ ID NO: 2163949 - DNA, 20 bp, Homo sapiens
cctttctggaagtttctggt

SEQ ID NO: 2163950 - DNA, 14 bp, Homo sapiens
cgattttgtctacc

SEQ ID NO: 2163951 - DNA, 19 bp, Homo sapiens
cggctggggactgctacct

SEQ ID NO: 2163952 - DNA, 14 bp, Homo sapiens
cggttaaattccat

SEQ ID NO: 2163953 - DNA, 17 bp, Homo sapiens
cgtggtcagagtgccac

SEQ ID NO: 2163954 - DNA, 12 bp, Homo sapiens
cgtgtcctctcc

SEQ ID NO: 2163955 - DNA, 18 bp, Homo sapiens
ctaacaataatatttcaa

SEQ ID NO: 2163956 - DNA, 22 bp, Homo sapiens
ctaactcctgccattcttctgg

SEQ ID NO: 2163957 - DNA, 20 bp, Homo sapiens
ctaccatttgtgttttgaaa

SEQ ID NO: 2163958 - DNA, 13 bp, Homo sapiens
ctacctctgagaa

SEQ ID NO: 2163959 - DNA, 14 bp, Homo sapiens
ctaggatggttctg

SEQ ID NO: 2163960 - DNA, 16 bp, Homo sapiens
ctaggatggttctgtg

SEQ ID NO: 2163961 - DNA, 19 bp, Homo sapiens
ctaggcgattttgtctacc

SEQ ID NO: 2163962 - DNA, 18 bp, Homo sapiens
ctagtcacaaagactcct

SEQ ID NO: 2163963 - DNA, 13 bp, Homo sapiens
ctatttttgttgt

SEQ ID NO: 2163964 - DNA, 17 bp, Homo sapiens
ctccagtgctggatttg

SEQ ID NO: 2163965 - DNA, 22 bp, Homo sapiens
ctccccgtgtcctctccctgcc

SEQ ID NO: 2163966 - DNA, 17 bp, Homo sapiens
ctccctgccaagtctca

SEQ ID NO: 2163967 - DNA, 19 bp, Homo sapiens
ctcctgccattcttctggt

SEQ ID NO: 2163968 - DNA, 14 bp, Homo sapiens
ctcttaaattatat

SEQ ID NO: 2163969 - DNA, 18 bp, Homo sapiens
ctcttaaattatatattt

SEQ ID NO: 2163970 - DNA, 21 bp, Homo sapiens
ctcttaaattatatatttatt

SEQ ID NO: 2163971 - DNA, 18 bp, Homo sapiens
ctgaaaaaaaaaaagaag

SEQ ID NO: 2163972 - DNA, 19 bp, Homo sapiens
ctgaaaaaaaaaaagaaga

SEQ ID NO: 2163973 - DNA, 15 bp, Homo sapiens
ctgaattttgggact

SEQ ID NO: 2163974 - DNA, 16 bp, Homo sapiens
ctgattacctgccaat

SEQ ID NO: 2163975 - DNA, 11 bp, Homo sapiens
ctgcagagggg

SEQ ID NO: 2163976 - DNA, 23 bp, Homo sapiens
ctgccaattgctaccgagaaggt

SEQ ID NO: 2163977 - DNA, 17 bp, Homo sapiens
ctgccattcttctggtg

SEQ ID NO: 2163978 - DNA, 14 bp, Homo sapiens
ctgccattgggacc

SEQ ID NO: 2163979 - DNA, 23 bp, Homo sapiens
ctgccattgggaccctccagtgc

SEQ ID NO: 2163980 - DNA, 17 bp, Homo sapiens
ctgctacctctgagaag

SEQ ID NO: 2163981 - DNA, 20 bp, Homo sapiens
ctgctacctctgagaagaca

SEQ ID NO: 2163982 - DNA, 13 bp, Homo sapiens
ctggaagaaagca

SEQ ID NO: 2163983 - DNA, 14 bp, Homo sapiens
ctggaagaaagcaa

SEQ ID NO: 2163984 - DNA, 20 bp, Homo sapiens
ctggaagaaagcaacaaaga

SEQ ID NO: 2163985 - DNA, 23 bp, Homo sapiens
ctggaagtttctggtgccatttc

SEQ ID NO: 2163986 - DNA, 22 bp, Homo sapiens
ctggagaaggtattagcaaagc

SEQ ID NO: 2163987 - DNA, 21 bp, Homo sapiens
ctggcttagtgccacccacct

SEQ ID NO: 2163988 - DNA, 22 bp, Homo sapiens
ctggcttagtgccacccacctt

SEQ ID NO: 2163989 - DNA, 14 bp, Homo sapiens
ctgggtaagaagaa

SEQ ID NO: 2163990 - DNA, 16 bp, Homo sapiens
ctgggtaagaagaaag

SEQ ID NO: 2163991 - DNA, 14 bp, Homo sapiens
ctgtagctttcctg

SEQ ID NO: 2163992 - DNA, 20 bp, Homo sapiens
ctgtcatggtcctttctgga

SEQ ID NO: 2163993 - DNA, 23 bp, Homo sapiens
ctgtcatggtcctttctggaagt

SEQ ID NO: 2163994 - DNA, 18 bp, Homo sapiens
ctgtgacccatctgtagt

SEQ ID NO: 2163995 - DNA, 23 bp, Homo sapiens
ctgttactttggcaatttcctgg

SEQ ID NO: 2163996 - DNA, 16 bp, Homo sapiens
cttatcttctggatta

SEQ ID NO: 2163997 - DNA, 13 bp, Homo sapiens
cttcaagtgccaa

SEQ ID NO: 2163998 - DNA, 21 bp, Homo sapiens
cttccatgcctgtagctttcc

SEQ ID NO: 2163999 - DNA, 20 bp, Homo sapiens
cttccgtggtcagagtgcca

SEQ ID NO: 2164000 - DNA, 21 bp, Homo sapiens
cttctggtgctactccatgca

SEQ ID NO: 2164001 - DNA, 13 bp, Homo sapiens
cttggtcagagcc

SEQ ID NO: 2164002 - DNA, 21 bp, Homo sapiens
cttgtgtcaagacatttctct

SEQ ID NO: 2164003 - DNA, 12 bp, Homo sapiens
ctttgactgaaa

SEQ ID NO: 2164004 - DNA, 15 bp, Homo sapiens
ctttgcaatccaaat

SEQ ID NO: 2164005 - DNA, 23 bp, Homo sapiens
ctttgtataatcccacccacctc

SEQ ID NO: 2164006 - DNA, 22 bp, Homo sapiens
gaaataccacaagcctgagaac

SEQ ID NO: 2164007 - DNA, 23 bp, Homo sapiens
gaacagggaacattggagctgac

SEQ ID NO: 2164008 - DNA, 19 bp, Homo sapiens
gaacattggagctgactgt

SEQ ID NO: 2164009 - DNA, 16 bp, Homo sapiens
gaactggaagaaagca

SEQ ID NO: 2164010 - DNA, 17 bp, Homo sapiens
gaaggtattagcaaagc

SEQ ID NO: 2164011 - DNA, 22 bp, Homo sapiens
gacacaaggtgatttcagactg

SEQ ID NO: 2164012 - DNA, 13 bp, Homo sapiens
gacagtctggaga

SEQ ID NO: 2164013 - DNA, 21 bp, Homo sapiens
gacatttctctaactcctgcc

SEQ ID NO: 2164014 - DNA, 11 bp, Homo sapiens
gacccatctgt

SEQ ID NO: 2164015 - DNA, 15 bp, Homo sapiens
gaccctccagtgctg

SEQ ID NO: 2164016 - DNA, 18 bp, Homo sapiens
gaccttcatgcccttctg

SEQ ID NO: 2164017 - DNA, 17 bp, Homo sapiens
gactgctacctctgaga

SEQ ID NO: 2164018 - DNA, 18 bp, Homo sapiens
gactgctacctctgagaa

SEQ ID NO: 2164019 - DNA, 23 bp, Homo sapiens
gactgctacctctgagaagacac

SEQ ID NO: 2164020 - DNA, 22 bp, Homo sapiens
gactgttactttggcaatttcc

SEQ ID NO: 2164021 - DNA, 21 bp, Homo sapiens
gactgttcttggtaactgatt

SEQ ID NO: 2164022 - DNA, 13 bp, Homo sapiens
gagaaggaacagg

SEQ ID NO: 2164023 - DNA, 19 bp, Homo sapiens
gagaaggtattagcaaagc

SEQ ID NO: 2164024 - DNA, 21 bp, Homo sapiens
gagacttgtgctcaaggaatc

SEQ ID NO: 2164025 - DNA, 14 bp, Homo sapiens
gatttgtgaactgg

SEQ ID NO: 2164026 - DNA, 14 bp, Homo sapiens
gcaagaaggaaaga

SEQ ID NO: 2164027 - DNA, 13 bp, Homo sapiens
gcaagggaccttc

SEQ ID NO: 2164028 - DNA, 21 bp, Homo sapiens
gcagaggacagtctggagaag

SEQ ID NO: 2164029 - DNA, 22 bp, Homo sapiens
gcagaggacagtctggagaagg

SEQ ID NO: 2164030 - DNA, 17 bp, Homo sapiens
gccaagtctcagaagag

SEQ ID NO: 2164031 - DNA, 13 bp, Homo sapiens
gccaattgctacc

SEQ ID NO: 2164032 - DNA, 20 bp, Homo sapiens
gccaattgctaccgagaagg

SEQ ID NO: 2164033 - DNA, 21 bp, Homo sapiens
gccactctatgagttggactt

SEQ ID NO: 2164034 - DNA, 16 bp, Homo sapiens
gccattgggaccctcc

SEQ ID NO: 2164035 - DNA, 22 bp, Homo sapiens
gccattgggaccctccagtgct

SEQ ID NO: 2164036 - DNA, 21 bp, Homo sapiens
gcccttctgattcccctccac

SEQ ID NO: 2164037 - DNA, 15 bp, Homo sapiens
gcctagactgttact

SEQ ID NO: 2164038 - DNA, 19 bp, Homo sapiens
gcctgtagctttcctggtc

SEQ ID NO: 2164039 - DNA, 14 bp, Homo sapiens
gccttcaagtgcca

SEQ ID NO: 2164040 - DNA, 15 bp, Homo sapiens
gccttcaagtgccaa

SEQ ID NO: 2164041 - DNA, 14 bp, Homo sapiens
gctaggatggttct

SEQ ID NO: 2164042 - DNA, 16 bp, Homo sapiens
gctttcctggtccctc

SEQ ID NO: 2164043 - DNA, 20 bp, Homo sapiens
ggaaagatttgtgaactgga

SEQ ID NO: 2164044 - DNA, 17 bp, Homo sapiens
ggagagcaagaaggaaa

SEQ ID NO: 2164045 - DNA, 15 bp, Homo sapiens
ggatggttctgtgac

SEQ ID NO: 2164046 - DNA, 18 bp, Homo sapiens
ggcaatttcctggccctc

SEQ ID NO: 2164047 - DNA, 19 bp, Homo sapiens
ggggttaacttggtcagag

SEQ ID NO: 2164048 - DNA, 14 bp, Homo sapiens
ggtaagaagaaagc

SEQ ID NO: 2164049 - DNA, 13 bp, Homo sapiens
ggtcagagccact

SEQ ID NO: 2164050 - DNA, 16 bp, Homo sapiens
ggtcagagtgccactg

SEQ ID NO: 2164051 - DNA, 16 bp, Homo sapiens
ggtcctttctggaagt

SEQ ID NO: 2164052 - DNA, 22 bp, Homo sapiens
ggtgccatttctgaactgttac

SEQ ID NO: 2164053 - DNA, 13 bp, Homo sapiens
ggttcatatttat

SEQ ID NO: 2164054 - DNA, 20 bp, Homo sapiens
gtaacagatatcagtgtctc

SEQ ID NO: 2164055 - DNA, 12 bp, Homo sapiens
gtaagaagaaag

SEQ ID NO: 2164056 - DNA, 14 bp, Homo sapiens
gtagctttcctggt

SEQ ID NO: 2164057 - DNA, 18 bp, Homo sapiens
gtataatcccacccacct

SEQ ID NO: 2164058 - DNA, 18 bp, Homo sapiens
gtatctgggtaagaagaa

SEQ ID NO: 2164059 - DNA, 14 bp, Homo sapiens
gtcaagacatttct

SEQ ID NO: 2164060 - DNA, 13 bp, Homo sapiens
gtcagagccactc

SEQ ID NO: 2164061 - DNA, 13 bp, Homo sapiens
gtcagagtgccac

SEQ ID NO: 2164062 - DNA, 16 bp, Homo sapiens
gtcagtgcagcagagg

SEQ ID NO: 2164063 - DNA, 21 bp, Homo sapiens
gtcatggtcctttctggaagt

SEQ ID NO: 2164064 - DNA, 14 bp, Homo sapiens
gtccccagttgccg

SEQ ID NO: 2164065 - DNA, 20 bp, Homo sapiens
gtcctttctggaagtttctg

SEQ ID NO: 2164066 - DNA, 12 bp, Homo sapiens
gtctacatttct

SEQ ID NO: 2164067 - DNA, 17 bp, Homo sapiens
gtctaggattgggcctc

SEQ ID NO: 2164068 - DNA, 13 bp, Homo sapiens
gtctcagaagagg

SEQ ID NO: 2164069 - DNA, 16 bp, Homo sapiens
gtctggagaaggtatt

SEQ ID NO: 2164070 - DNA, 23 bp, Homo sapiens
gtgaaataccacaagcctgagaa

SEQ ID NO: 2164071 - DNA, 15 bp, Homo sapiens
gtgaactggaagaaa

SEQ ID NO: 2164072 - DNA, 15 bp, Homo sapiens
gtgacccatctgtag

SEQ ID NO: 2164073 - DNA, 19 bp, Homo sapiens
gtgccacccacctttgcca

SEQ ID NO: 2164074 - DNA, 22 bp, Homo sapiens
gtgccacccacctttgccacaa

SEQ ID NO: 2164075 - DNA, 16 bp, Homo sapiens
gtgcctagactgttac

SEQ ID NO: 2164076 - DNA, 17 bp, Homo sapiens
gtgcctagactgttact

SEQ ID NO: 2164077 - DNA, 18 bp, Homo sapiens
gtgcctagactgttactt

SEQ ID NO: 2164078 - DNA, 19 bp, Homo sapiens
gttaactgtgaaataccac

SEQ ID NO: 2164079 - DNA, 15 bp, Homo sapiens
gttaacttggtcaga

SEQ ID NO: 2164080 - DNA, 16 bp, Homo sapiens
gttaatttatttagtt

SEQ ID NO: 2164081 - DNA, 17 bp, Homo sapiens
gttacaacttgtatttc

SEQ ID NO: 2164082 - DNA, 13 bp, Homo sapiens
gttatgctgtcat

SEQ ID NO: 2164083 - DNA, 18 bp, Homo sapiens
gttctgtgacccatctgt

SEQ ID NO: 2164084 - DNA, 18 bp, Homo sapiens
gtttctggtgccatttct

SEQ ID NO: 2164085 - DNA, 18 bp, Homo sapiens
gtttttaacaatctaaca

SEQ ID NO: 2164086 - DNA, 19 bp, Homo sapiens
taaacacttatcttctgga

SEQ ID NO: 2164087 - DNA, 20 bp, Homo sapiens
taaacacttatcttctggat

SEQ ID NO: 2164088 - DNA, 21 bp, Homo sapiens
taaacacttatcttctggatt

SEQ ID NO: 2164089 - DNA, 22 bp, Homo sapiens
taaacacttatcttctggatta

SEQ ID NO: 2164090 - DNA, 20 bp, Homo sapiens
taaagataacccttattcca

SEQ ID NO: 2164091 - DNA, 15 bp, Homo sapiens
taaatgcctcttaaa

SEQ ID NO: 2164092 - DNA, 16 bp, Homo sapiens
taacaataatatttca

SEQ ID NO: 2164093 - DNA, 17 bp, Homo sapiens
taacaataatatttcaa

SEQ ID NO: 2164094 - DNA, 14 bp, Homo sapiens
taactgtgaaatac

SEQ ID NO: 2164095 - DNA, 16 bp, Homo sapiens
taactgtgaaatacca

SEQ ID NO: 2164096 - DNA, 13 bp, Homo sapiens
taagaagaaagca

SEQ ID NO: 2164097 - DNA, 12 bp, Homo sapiens
taccacaagcct

SEQ ID NO: 2164098 - DNA, 21 bp, Homo sapiens
taccagagccttcaagtgcca

SEQ ID NO: 2164099 - DNA, 16 bp, Homo sapiens
tacctctgagaagaca

SEQ ID NO: 2164100 - DNA, 19 bp, Homo sapiens
tagactgttactttggcaa

SEQ ID NO: 2164101 - DNA, 20 bp, Homo sapiens
tagcaaagcaaaaggctgag

SEQ ID NO: 2164102 - DNA, 24 bp, Homo sapiens
tagtaatttattgtctgtctacat

SEQ ID NO: 2164103 - DNA, 20 bp, Homo sapiens
tatatatttattttattcta

SEQ ID NO: 2164104 - DNA, 17 bp, Homo sapiens
tatctgggtaagaagaa

SEQ ID NO: 2164105 - DNA, 21 bp, Homo sapiens
tatcttctggattagaatgcc

SEQ ID NO: 2164106 - DNA, 16 bp, Homo sapiens
tatgagttggacttca

SEQ ID NO: 2164107 - DNA, 15 bp, Homo sapiens
tatgctgtcatggtc

SEQ ID NO: 2164108 - DNA, 14 bp, Homo sapiens
tatttagtttttaa

SEQ ID NO: 2164109 - DNA, 14 bp, Homo sapiens
tatttcaagtgcct

SEQ ID NO: 2164110 - DNA, 22 bp, Homo sapiens
tatttcaagtgcctagactgtt

SEQ ID NO: 2164111 - DNA, 18 bp, Homo sapiens
tatttccaaacctggttc

SEQ ID NO: 2164112 - DNA, 19 bp, Homo sapiens
tatttccaaacctggttca

SEQ ID NO: 2164113 - DNA, 19 bp, Homo sapiens
tattttattctatgtatgt

SEQ ID NO: 2164114 - DNA, 22 bp, Homo sapiens
tatttttgttgttgttgtttgt

SEQ ID NO: 2164115 - DNA, 19 bp, Homo sapiens
tcaagtaccaccaagggat

SEQ ID NO: 2164116 - DNA, 18 bp, Homo sapiens
tcaagtgcctagactgtt

SEQ ID NO: 2164117 - DNA, 21 bp, Homo sapiens
tcaagtgcctagactgttact

SEQ ID NO: 2164118 - DNA, 15 bp, Homo sapiens
tcagactgcagaggg

SEQ ID NO: 2164119 - DNA, 22 bp, Homo sapiens
tcataagtttgtttaaacactt

SEQ ID NO: 2164120 - DNA, 14 bp, Homo sapiens
tcatatttatactt

SEQ ID NO: 2164121 - DNA, 21 bp, Homo sapiens
tcatccccacaatctggctta

SEQ ID NO: 2164122 - DNA, 16 bp, Homo sapiens
tcatgcccttctgatt

SEQ ID NO: 2164123 - DNA, 14 bp, Homo sapiens
tccaaacctggttc

SEQ ID NO: 2164124 - DNA, 21 bp, Homo sapiens
tccaggatctttgactgaaaa

SEQ ID NO: 2164125 - DNA, 15 bp, Homo sapiens
tccagtgctggattt

SEQ ID NO: 2164126 - DNA, 14 bp, Homo sapiens
tccatatgctccag

SEQ ID NO: 2164127 - DNA, 19 bp, Homo sapiens
tccctgccaagtctcagaa

SEQ ID NO: 2164128 - DNA, 21 bp, Homo sapiens
tcccttgtgtcaagacatttc

SEQ ID NO: 2164129 - DNA, 17 bp, Homo sapiens
tccgatggtatctgggt

SEQ ID NO: 2164130 - DNA, 18 bp, Homo sapiens
tcctgccattcttctggt

SEQ ID NO: 2164131 - DNA, 18 bp, Homo sapiens
tcggctggggactgctac

SEQ ID NO: 2164132 - DNA, 14 bp, Homo sapiens
tctaacaataatat

SEQ ID NO: 2164133 - DNA, 19 bp, Homo sapiens
tctaacaataatatttcaa

SEQ ID NO: 2164134 - DNA, 16 bp, Homo sapiens
tctacatttctgcaga

SEQ ID NO: 2164135 - DNA, 16 bp, Homo sapiens
tctatgtatgttaatt

SEQ ID NO: 2164136 - DNA, 19 bp, Homo sapiens
tctccccgtgtcctctccc

SEQ ID NO: 2164137 - DNA, 14 bp, Homo sapiens
tctccctgccaagt

SEQ ID NO: 2164138 - DNA, 19 bp, Homo sapiens
tctgcagatcttccgtggt

SEQ ID NO: 2164139 - DNA, 18 bp, Homo sapiens
tctggaagtttctggtgc

SEQ ID NO: 2164140 - DNA, 16 bp, Homo sapiens
tctggcttagtgccac

SEQ ID NO: 2164141 - DNA, 17 bp, Homo sapiens
tctggcttagtgccacc

SEQ ID NO: 2164142 - DNA, 19 bp, Homo sapiens
aaaataacaactatttttg

SEQ ID NO: 2164143 - DNA, 15 bp, Homo sapiens
aaaataccagagcct

SEQ ID NO: 2164144 - DNA, 18 bp, Homo sapiens
aaacacttatcttctgga

SEQ ID NO: 2164145 - DNA, 19 bp, Homo sapiens
aaacacttatcttctggat

SEQ ID NO: 2164146 - DNA, 22 bp, Homo sapiens
aaacctggttcatatttatact

SEQ ID NO: 2164147 - DNA, 20 bp, Homo sapiens
aaagatttgtgaactggaag

SEQ ID NO: 2164148 - DNA, 16 bp, Homo sapiens
aaagcaaaagcaaggg

SEQ ID NO: 2164149 - DNA, 14 bp, Homo sapiens
aaaggctgagaagg

SEQ ID NO: 2164150 - DNA, 13 bp, Homo sapiens
aaattatatattt

SEQ ID NO: 2164151 - DNA, 19 bp, Homo sapiens
aacaataatatttcaagtg

SEQ ID NO: 2164152 - DNA, 19 bp, Homo sapiens
aacaatctaacaataatat

SEQ ID NO: 2164153 - DNA, 16 bp, Homo sapiens
aacacttatcttctgg

SEQ ID NO: 2164154 - DNA, 15 bp, Homo sapiens
aactgtgaaatacca

SEQ ID NO: 2164155 - DNA, 20 bp, Homo sapiens
aactgttacaacttgtattt

SEQ ID NO: 2164156 - DNA, 23 bp, Homo sapiens
aactgttacaacttgtatttcca

SEQ ID NO: 2164157 - DNA, 20 bp, Homo sapiens
aacttggtcagagccactct

SEQ ID NO: 2164158 - DNA, 14 bp, Homo sapiens
aacttgtatttcca

SEQ ID NO: 2164159 - DNA, 15 bp, Homo sapiens
aacttgtatttccaa

SEQ ID NO: 2164160 - DNA, 16 bp, Homo sapiens
aagaagaaagcaaaag

SEQ ID NO: 2164161 - DNA, 13 bp, Homo sapiens
aagaagaagaagg

SEQ ID NO: 2164162 - DNA, 22 bp, Homo sapiens
aagacacaaggtgatttcagac

SEQ ID NO: 2164163 - DNA, 11 bp, Homo sapiens
aagacatttct

SEQ ID NO: 2164164 - DNA, 19 bp, Homo sapiens
aagatttgtgaactggaag

SEQ ID NO: 2164165 - DNA, 18 bp, Homo sapiens
aagcaaaaggctgagaag

SEQ ID NO: 2164166 - DNA, 18 bp, Homo sapiens
aagccatgtactcaagta

SEQ ID NO: 2164167 - DNA, 17 bp, Homo sapiens
aaggaaagatttgtgaa

SEQ ID NO: 2164168 - DNA, 17 bp, Homo sapiens
aaggagagcaagaagga

SEQ ID NO: 2164169 - DNA, 14 bp, Homo sapiens
aaggtgatttcaga

SEQ ID NO: 2164170 - DNA, 19 bp, Homo sapiens
aaggtgatttcagactgca

SEQ ID NO: 2164171 - DNA, 11 bp, Homo sapiens
aagtgccaaac

SEQ ID NO: 2164172 - DNA, 18 bp, Homo sapiens
aagtgcctagactgttac

SEQ ID NO: 2164173 - DNA, 20 bp, Homo sapiens
aagtttctggtgccatttct

SEQ ID NO: 2164174 - DNA, 16 bp, Homo sapiens
aataatatttcaagtg

SEQ ID NO: 2164175 - DNA, 22 bp, Homo sapiens
aataatatttcaagtgcctaga

SEQ ID NO: 2164176 - DNA, 13 bp, Homo sapiens
aataccagagcct

SEQ ID NO: 2164177 - DNA, 20 bp, Homo sapiens
aataccagagccttcaagtg

SEQ ID NO: 2164178 - DNA, 16 bp, Homo sapiens
aatatttcaagtgcct

SEQ ID NO: 2164179 - DNA, 16 bp, Homo sapiens
aatcccacccacctca

SEQ ID NO: 2164180 - DNA, 18 bp, Homo sapiens
aatctaacaataatattt

SEQ ID NO: 2164181 - DNA, 23 bp, Homo sapiens
aatctaacaataatatttcaagt

SEQ ID NO: 2164182 - DNA, 19 bp, Homo sapiens
aatgccggttaaattccat

SEQ ID NO: 2164183 - DNA, 12 bp, Homo sapiens
aattatatattt

SEQ ID NO: 2164184 - DNA, 17 bp, Homo sapiens
aattccatatgctccag

SEQ ID NO: 2164185 - DNA, 19 bp, Homo sapiens
aattccatatgctccagga

SEQ ID NO: 2164186 - DNA, 14 bp, Homo sapiens
aattgctttgccaa

SEQ ID NO: 2164187 - DNA, 16 bp, Homo sapiens
aattgctttgccaaaa

SEQ ID NO: 2164188 - DNA, 18 bp, Homo sapiens
aattgctttgccaaaata

SEQ ID NO: 2164189 - DNA, 20 bp, Homo sapiens
aattgctttgccaaaatacc

SEQ ID NO: 2164190 - DNA, 22 bp, Homo sapiens
acaaagctaggatggttctgtg

SEQ ID NO: 2164191 - DNA, 22 bp, Homo sapiens
acaatctaacaataatatttca

SEQ ID NO: 2164192 - DNA, 19 bp, Homo sapiens
acaatctggcttagtgcca

SEQ ID NO: 2164193 - DNA, 20 bp, Homo sapiens
acaatctggcttagtgccac

SEQ ID NO: 2164194 - DNA, 16 bp, Homo sapiens
acagatatcagtgtct

SEQ ID NO: 2164195 - DNA, 21 bp, Homo sapiens
acatttctctaactcctgcca

SEQ ID NO: 2164196 - DNA, 23 bp, Homo sapiens
acatttctctaactcctgccatt

SEQ ID NO: 2164197 - DNA, 17 bp, Homo sapiens
accagagccttcaagtg

SEQ ID NO: 2164198 - DNA, 18 bp, Homo sapiens
accagagccttcaagtgc

SEQ ID NO: 2164199 - DNA, 19 bp, Homo sapiens
accagagccttcaagtgcc

SEQ ID NO: 2164200 - DNA, 17 bp, Homo sapiens
cactgcgggagctctgt

SEQ ID NO: 2164201 - DNA, 20 bp, Homo sapiens
cactgcgggagctctgtatg

SEQ ID NO: 2164202 - DNA, 14 bp, Homo sapiens
cacttatcttctgg

SEQ ID NO: 2164203 - DNA, 17 bp, Homo sapiens
cacttatcttctggatt

SEQ ID NO: 2164204 - DNA, 22 bp, Homo sapiens
cagaagaggttgggcttccatg

SEQ ID NO: 2164205 - DNA, 15 bp, Homo sapiens
cagagtgccactgcg

SEQ ID NO: 2164206 - DNA, 21 bp, Homo sapiens
cagatcttccgtggtcagagt

SEQ ID NO: 2164207 - DNA, 22 bp, Homo sapiens
cagatcttccgtggtcagagtg

SEQ ID NO: 2164208 - DNA, 23 bp, Homo sapiens
cagcagaggacagtctggagaag

SEQ ID NO: 2164209 - DNA, 16 bp, Homo sapiens
caggatctttgactga

SEQ ID NO: 2164210 - DNA, 19 bp, Homo sapiens
cagggaacattggagctga

SEQ ID NO: 2164211 - DNA, 14 bp, Homo sapiens
caggggtcagtgca

SEQ ID NO: 2164212 - DNA, 14 bp, Homo sapiens
cagtgcagcagagg

SEQ ID NO: 2164213 - DNA, 18 bp, Homo sapiens
cagttgccgtctaggatt

SEQ ID NO: 2164214 - DNA, 14 bp, Homo sapiens
catatgctccagga

SEQ ID NO: 2164215 - DNA, 13 bp, Homo sapiens
catgcccttctga

SEQ ID NO: 2164216 - DNA, 17 bp, Homo sapiens
catgtactcaagtacca

SEQ ID NO: 2164217 - DNA, 16 bp, Homo sapiens
cattggagctgactgt

SEQ ID NO: 2164218 - DNA, 13 bp, Homo sapiens
ccaaacctggttc

SEQ ID NO: 2164219 - DNA, 13 bp, Homo sapiens
ccaattgctaccg

SEQ ID NO: 2164220 - DNA, 16 bp, Homo sapiens
ccacaagcctgagaac

SEQ ID NO: 2164221 - DNA, 20 bp, Homo sapiens
ccacaatctggcttagtgcc

SEQ ID NO: 2164222 - DNA, 23 bp, Homo sapiens
ccactgcgggagctctgtatggt

SEQ ID NO: 2164223 - DNA, 13 bp, Homo sapiens
ccaggatctttga

SEQ ID NO: 2164224 - DNA, 20 bp, Homo sapiens
ccaggatctttgactgaaaa

SEQ ID NO: 2164225 - DNA, 14 bp, Homo sapiens
ccagtgctggattt

SEQ ID NO: 2164226 - DNA, 20 bp, Homo sapiens
ccataattgctttgccaaaa

SEQ ID NO: 2164227 - DNA, 16 bp, Homo sapiens
ccatatgctccaggat

SEQ ID NO: 2164228 - DNA, 22 bp, Homo sapiens
ccatatgctccaggatctttga

SEQ ID NO: 2164229 - DNA, 14 bp, Homo sapiens
ccatctagtcacaa

SEQ ID NO: 2164230 - DNA, 22 bp, Homo sapiens
ccatgcctgtagctttcctggt

SEQ ID NO: 2164231 - DNA, 15 bp, Homo sapiens
ccattcttctggtgc

SEQ ID NO: 2164232 - DNA, 11 bp, Homo sapiens
ccattgggacc

SEQ ID NO: 2164233 - DNA, 22 bp, Homo sapiens
cccacaatctggcttagtgcca

SEQ ID NO: 2164234 - DNA, 21 bp, Homo sapiens
cccataattgctttgccaaaa

SEQ ID NO: 2164235 - DNA, 17 bp, Homo sapiens
cccatggccccaggccc

SEQ ID NO: 2164236 - DNA, 13 bp, Homo sapiens
ccccacaatctgg

SEQ ID NO: 2164237 - DNA, 18 bp, Homo sapiens
ccccatggccccaggccc

SEQ ID NO: 2164238 - DNA, 20 bp, Homo sapiens
ccccatggccccaggcccac

SEQ ID NO: 2164239 - DNA, 18 bp, Homo sapiens
ccgtctaggattgggcct

SEQ ID NO: 2164240 - DNA, 19 bp, Homo sapiens
ccgtctaggattgggcctc

SEQ ID NO: 2164241 - DNA, 15 bp, Homo sapiens
ccgtggtcagagtgc

SEQ ID NO: 2164242 - DNA, 17 bp, Homo sapiens
ccgtggtcagagtgcca

SEQ ID NO: 2164243 - DNA, 14 bp, Homo sapiens
cctagactgttact

SEQ ID NO: 2164244 - DNA, 18 bp, Homo sapiens
cctagactgttactttgg

SEQ ID NO: 2164245 - DNA, 17 bp, Homo sapiens
cctccaccaaaccccac

SEQ ID NO: 2164246 - DNA, 11 bp, Homo sapiens
cctctgagaag

SEQ ID NO: 2164247 - DNA, 15 bp, Homo sapiens
cctcttaaattatat

SEQ ID NO: 2164248 - DNA, 18 bp, Homo sapiens
cctgccattcttctggtg

SEQ ID NO: 2164249 - DNA, 21 bp, Homo sapiens
cctgccattcttctggtgcta

SEQ ID NO: 2164250 - DNA, 16 bp, Homo sapiens
cctgtagctttcctgg

SEQ ID NO: 2164251 - DNA, 17 bp, Homo sapiens
cctgtagctttcctggt

SEQ ID NO: 2164252 - DNA, 20 bp, Homo sapiens
cctgtagctttcctggtccc

SEQ ID NO: 2164253 - DNA, 19 bp, Homo sapiens
cctttctggaagtttctgg

SEQ ID NO: 2164254 - DNA, 13 bp, Homo sapiens
cgattttgtctac

SEQ ID NO: 2164255 - DNA, 18 bp, Homo sapiens
cggctggggactgctacc

SEQ ID NO: 2164256 - DNA, 13 bp, Homo sapiens
cgggagctctgta

SEQ ID NO: 2164257 - DNA, 15 bp, Homo sapiens
ctaacaataatattt

SEQ ID NO: 2164258 - DNA, 17 bp, Homo sapiens
ctaacaataatatttca

SEQ ID NO: 2164259 - DNA, 23 bp, Homo sapiens
ctaactcctgccattcttctggt

SEQ ID NO: 2164260 - DNA, 15 bp, Homo sapiens
ctacatttctgcaga

SEQ ID NO: 2164261 - DNA, 19 bp, Homo sapiens
ctacccagatggaaaaata

SEQ ID NO: 2164262 - DNA, 16 bp, Homo sapiens
ctacctctgagaagac

SEQ ID NO: 2164263 - DNA, 17 bp, Homo sapiens
ctagactgttactttgg

SEQ ID NO: 2164264 - DNA, 18 bp, Homo sapiens
ctagactgttactttggc

SEQ ID NO: 2164265 - DNA, 14 bp, Homo sapiens
ctaggattgggcct

SEQ ID NO: 2164266 - DNA, 18 bp, Homo sapiens
ctaggattgggcctccca

SEQ ID NO: 2164267 - DNA, 14 bp, Homo sapiens
ctagtcacaaagac

SEQ ID NO: 2164268 - DNA, 20 bp, Homo sapiens
ctcactttcccttgtgtcaa

SEQ ID NO: 2164269 - DNA, 18 bp, Homo sapiens
ctcataagtttgtttaaa

SEQ ID NO: 2164270 - DNA, 18 bp, Homo sapiens
ctccactcctcatcccca

SEQ ID NO: 2164271 - DNA, 22 bp, Homo sapiens
ctccaggatctttgactgaaaa

SEQ ID NO: 2164272 - DNA, 19 bp, Homo sapiens
ctccctgccaagtctcaga

SEQ ID NO: 2164273 - DNA, 22 bp, Homo sapiens
ctccctgccaagtctcagaaga

SEQ ID NO: 2164274 - DNA, 21 bp, Homo sapiens
ctcctcatccccacaatctgg

SEQ ID NO: 2164275 - DNA, 13 bp, Homo sapiens
ctctgagaagaca

SEQ ID NO: 2164276 - DNA, 15 bp, Homo sapiens
ctgactgttcttggt

SEQ ID NO: 2164277 - DNA, 15 bp, Homo sapiens
ctgagaactgaattt

SEQ ID NO: 2164278 - DNA, 16 bp, Homo sapiens
ctgcagatcttccgtg

SEQ ID NO: 2164279 - DNA, 18 bp, Homo sapiens
ctgcagatcttccgtggt

SEQ ID NO: 2164280 - DNA, 19 bp, Homo sapiens
ctgccaattgctaccgaga

SEQ ID NO: 2164281 - DNA, 15 bp, Homo sapiens
ctgccattcttctgg

SEQ ID NO: 2164282 - DNA, 17 bp, Homo sapiens
ctgcgggagctctgtat

SEQ ID NO: 2164283 - DNA, 15 bp, Homo sapiens
ctggaagtttctggt

SEQ ID NO: 2164284 - DNA, 12 bp, Homo sapiens
ctggccctccac

SEQ ID NO: 2164285 - DNA, 20 bp, Homo sapiens
ctggggactgctacctctga

SEQ ID NO: 2164286 - DNA, 17 bp, Homo sapiens
ctggtgctactccatgc

SEQ ID NO: 2164287 - DNA, 15 bp, Homo sapiens
ctgtagctttcctgg

SEQ ID NO: 2164288 - DNA, 19 bp, Homo sapiens
ctgtcatggtcctttctgg

SEQ ID NO: 2164289 - DNA, 11 bp, Homo sapiens
ctgtctacatt

SEQ ID NO: 2164290 - DNA, 13 bp, Homo sapiens
ctgtgaaatacca

SEQ ID NO: 2164291 - DNA, 24 bp, Homo sapiens
ctgtgaaataccacaagcctgaga

SEQ ID NO: 2164292 - DNA, 15 bp, Homo sapiens
ctgtgacccatctgt

SEQ ID NO: 2164293 - DNA, 22 bp, Homo sapiens
ctgttacaacttgtatttccaa

SEQ ID NO: 2164294 - DNA, 18 bp, Homo sapiens
cttaaattatatatttat

SEQ ID NO: 2164295 - DNA, 20 bp, Homo sapiens
cttaaattatatatttattt

SEQ ID NO: 2164296 - DNA, 16 bp, Homo sapiens
cttagtgccacccacc

SEQ ID NO: 2164297 - DNA, 15 bp, Homo sapiens
cttatcttctggatt

SEQ ID NO: 2164298 - DNA, 17 bp, Homo sapiens
cttccatctagtcacaa

SEQ ID NO: 2164299 - DNA, 11 bp, Homo sapiens
cttccatgcct

SEQ ID NO: 2164300 - DNA, 22 bp, Homo sapiens
cttctacccagatggaaaaata

SEQ ID NO: 2164301 - DNA, 18 bp, Homo sapiens
ctttgcaatccaaataaa

SEQ ID NO: 2164302 - DNA, 11 bp, Homo sapiens
ctttgccacaa

SEQ ID NO: 2164303 - DNA, 18 bp, Homo sapiens
ctttggcaatttcctggc

SEQ ID NO: 2164304 - DNA, 15 bp, Homo sapiens
ctttgtataatccca

SEQ ID NO: 2164305 - DNA, 19 bp, Homo sapiens
gaaaaaaaaaaagaagaag

SEQ ID NO: 2164306 - DNA, 16 bp, Homo sapiens
gaaataccacaagcct

SEQ ID NO: 2164307 - DNA, 14 bp, Homo sapiens
gaactggaagaaag

SEQ ID NO: 2164308 - DNA, 17 bp, Homo sapiens
gaactggaagaaagcaa

SEQ ID NO: 2164309 - DNA, 11 bp, Homo sapiens
gaactgttaca

SEQ ID NO: 2164310 - DNA, 22 bp, Homo sapiens
gaagaggttgggcttccatgcc

SEQ ID NO: 2164311 - DNA, 23 bp, Homo sapiens
gaaggaaagatttgtgaactgga

SEQ ID NO: 2164312 - DNA, 19 bp, Homo sapiens
gaaggagagcaagaaggaa

SEQ ID NO: 2164313 - DNA, 20 bp, Homo sapiens
gaaggagagcaagaaggaaa

SEQ ID NO: 2164314 - DNA, 15 bp, Homo sapiens
gacagtctggagaag

SEQ ID NO: 2164315 - DNA, 14 bp, Homo sapiens
gactgctacctctg

SEQ ID NO: 2164316 - DNA, 16 bp, Homo sapiens
gactgctacctctgag

SEQ ID NO: 2164317 - DNA, 21 bp, Homo sapiens
gagaagccatgtactcaagta

SEQ ID NO: 2164318 - DNA, 21 bp, Homo sapiens
gagccactctatgagttggac

SEQ ID NO: 2164319 - DNA, 18 bp, Homo sapiens
gagctctgtatggtcagg

SEQ ID NO: 2164320 - DNA, 12 bp, Homo sapiens
gaggttgggctt

SEQ ID NO: 2164321 - DNA, 13 bp, Homo sapiens
gatctttgactga

SEQ ID NO: 2164322 - DNA, 22 bp, Homo sapiens
gatggtatctgggtaagaagaa

SEQ ID NO: 2164323 - DNA, 21 bp, Homo sapiens
gatgtcaaagtgtaacagata

SEQ ID NO: 2164324 - DNA, 13 bp, Homo sapiens
gattcccctccac

SEQ ID NO: 2164325 - DNA, 15 bp, Homo sapiens
gcaaaaggctgagaa

SEQ ID NO: 2164326 - DNA, 15 bp, Homo sapiens
gcaagaaggaaagat

SEQ ID NO: 2164327 - DNA, 14 bp, Homo sapiens
gcaatttcctggcc

SEQ ID NO: 2164328 - DNA, 22 bp, Homo sapiens
gcagcagaggacagtctggaga

SEQ ID NO: 2164329 - DNA, 14 bp, Homo sapiens
gccaagtctcagaa

SEQ ID NO: 2164330 - DNA, 20 bp, Homo sapiens
gccacaaagctaggatggtt

SEQ ID NO: 2164331 - DNA, 15 bp, Homo sapiens
gccactctatgagtt

SEQ ID NO: 2164332 - DNA, 21 bp, Homo sapiens
gccactgcgggagctctgtat

SEQ ID NO: 2164333 - DNA, 17 bp, Homo sapiens
gcccaaggtgctgatgt

SEQ ID NO: 2164334 - DNA, 19 bp, Homo sapiens
gcccttctgattcccctcc

SEQ ID NO: 2164335 - DNA, 20 bp, Homo sapiens
gcctagactgttactttggc

SEQ ID NO: 2164336 - DNA, 12 bp, Homo sapiens
gccttcaagtgc

SEQ ID NO: 2164337 - DNA, 17 bp, Homo sapiens
gccttcaagtgccaaac

SEQ ID NO: 2164338 - DNA, 15 bp, Homo sapiens
gctacctctgagaag

SEQ ID NO: 2164339 - DNA, 16 bp, Homo sapiens
gctccaggatctttga

SEQ ID NO: 2164340 - DNA, 17 bp, Homo sapiens
gctggatttgatgagtt

SEQ ID NO: 2164341 - DNA, 12 bp, Homo sapiens
gcttccatgcct

SEQ ID NO: 2164342 - DNA, 12 bp, Homo sapiens
gctttgccaaaa

SEQ ID NO: 2164343 - DNA, 18 bp, Homo sapiens
gctttgccaaaataccag

SEQ ID NO: 2164344 - DNA, 21 bp, Homo sapiens
gctttgccaaaataccagagc

SEQ ID NO: 2164345 - DNA, 13 bp, Homo sapiens
ggcttagtgccac

SEQ ID NO: 2164346 - DNA, 15 bp, Homo sapiens
ggcttagtgccaccc

SEQ ID NO: 2164347 - DNA, 13 bp, Homo sapiens
gggagctctgtat

SEQ ID NO: 2164348 - DNA, 23 bp, Homo sapiens
gggcctcccataattgctttgcc

SEQ ID NO: 2164349 - DNA, 14 bp, Homo sapiens
gggcttccatgcct

SEQ ID NO: 2164350 - DNA, 17 bp, Homo sapiens
gggttaacttggtcaga

SEQ ID NO: 2164351 - DNA, 13 bp, Homo sapiens
ggtaagaagaaag

SEQ ID NO: 2164352 - DNA, 15 bp, Homo sapiens
ggtcagagccactct

SEQ ID NO: 2164353 - DNA, 14 bp, Homo sapiens
ggtcagagtgccac

SEQ ID NO: 2164354 - DNA, 20 bp, Homo sapiens
ggtccctcacccccatggcc

SEQ ID NO: 2164355 - DNA, 23 bp, Homo sapiens
ggtgatttcagactgcagagggg

SEQ ID NO: 2164356 - DNA, 16 bp, Homo sapiens
ggtgccatttctgaac

SEQ ID NO: 2164357 - DNA, 13 bp, Homo sapiens
gtaatttattgtc

SEQ ID NO: 2164358 - DNA, 21 bp, Homo sapiens
gtaatttattgtctgtctaca

SEQ ID NO: 2164359 - DNA, 19 bp, Homo sapiens
gtagtaatttattgtctgt

SEQ ID NO: 2164360 - DNA, 24 bp, Homo sapiens
gtagtaatttattgtctgtctaca

SEQ ID NO: 2164361 - DNA, 19 bp, Homo sapiens
gtatctgggtaagaagaaa

SEQ ID NO: 2164362 - DNA, 23 bp, Homo sapiens
gtatctgggtaagaagaaagcaa

SEQ ID NO: 2164363 - DNA, 14 bp, Homo sapiens
gtatggtcaggatg

SEQ ID NO: 2164364 - DNA, 15 bp, Homo sapiens
gtcagagtgccactg

SEQ ID NO: 2164365 - DNA, 14 bp, Homo sapiens
gtctcagaagaggt

SEQ ID NO: 2164366 - DNA, 16 bp, Homo sapiens
gtctgtctacatttct

SEQ ID NO: 2164367 - DNA, 21 bp, Homo sapiens
gtctgtctacatttctgcaga

SEQ ID NO: 2164368 - DNA, 13 bp, Homo sapiens
gtgaactggaaga

SEQ ID NO: 2164369 - DNA, 17 bp, Homo sapiens
gtgaactggaagaaagc

SEQ ID NO: 2164370 - DNA, 18 bp, Homo sapiens
gtgaactggaagaaagca

SEQ ID NO: 2164371 - DNA, 19 bp, Homo sapiens
gtgatttcagactgcagag

SEQ ID NO: 2164372 - DNA, 16 bp, Homo sapiens
gtgtcaagacatttct

SEQ ID NO: 2164373 - DNA, 15 bp, Homo sapiens
gtgtcctctccctgc

SEQ ID NO: 2164374 - DNA, 19 bp, Homo sapiens
gtgtcctctccctgccaag

SEQ ID NO: 2164375 - DNA, 19 bp, Homo sapiens
gttaacttggtcagagcca

SEQ ID NO: 2164376 - DNA, 19 bp, Homo sapiens
gttcatatttatactttgc

SEQ ID NO: 2164377 - DNA, 16 bp, Homo sapiens
gttctgtgacccatct

SEQ ID NO: 2164378 - DNA, 22 bp, Homo sapiens
gttctgtgacccatctgtagta

SEQ ID NO: 2164379 - DNA, 16 bp, Homo sapiens
gttcttggtaactgat

SEQ ID NO: 2164380 - DNA, 13 bp, Homo sapiens
gttgttgttgttt

SEQ ID NO: 2164381 - DNA, 13 bp, Homo sapiens
gtttgtaaatgcc

SEQ ID NO: 2164382 - DNA, 14 bp, Homo sapiens
gtttgtaaatgcct

SEQ ID NO: 2164383 - DNA, 22 bp, Homo sapiens
gtttgtttaaacacttatcttc

SEQ ID NO: 2164384 - DNA, 16 bp, Homo sapiens
taaatgcctcttaaat

SEQ ID NO: 2164385 - DNA, 17 bp, Homo sapiens
taaatgcctcttaaatt

SEQ ID NO: 2164386 - DNA, 19 bp, Homo sapiens
taaatgcctcttaaattat

SEQ ID NO: 2164387 - DNA, 14 bp, Homo sapiens
taaattatatattt

SEQ ID NO: 2164388 - DNA, 18 bp, Homo sapiens
taaattccatatgctcca

SEQ ID NO: 2164389 - DNA, 16 bp, Homo sapiens
taacaactatttttgt

SEQ ID NO: 2164390 - DNA, 20 bp, Homo sapiens
taacaataatatttcaagtg

SEQ ID NO: 2164391 - DNA, 23 bp, Homo sapiens
taacaataatatttcaagtgcct

SEQ ID NO: 2164392 - DNA, 19 bp, Homo sapiens
taactgattacctgccaat

SEQ ID NO: 2164393 - DNA, 14 bp, Homo sapiens
taagaagaaagcaa

SEQ ID NO: 2164394 - DNA, 17 bp, Homo sapiens
taatatttcaagtgcct

SEQ ID NO: 2164395 - DNA, 18 bp, Homo sapiens
taatatttcaagtgccta

SEQ ID NO: 2164396 - DNA, 16 bp, Homo sapiens
taatcccacccacctc

SEQ ID NO: 2164397 - DNA, 17 bp, Homo sapiens
taattgctttgccaaaa

SEQ ID NO: 2164398 - DNA, 11 bp, Homo sapiens
tacatttctgc

SEQ ID NO: 2164399 - DNA, 18 bp, Homo sapiens
taccacaagcctgagaac

SEQ ID NO: 2164400 - DNA, 17 bp, Homo sapiens
tacctctgagaagacac

SEQ ID NO: 2164401 - DNA, 23 bp, Homo sapiens
tactttggcaatttcctggccct

SEQ ID NO: 2164402 - DNA, 15 bp, Homo sapiens
tagcaaagcaaaagg

SEQ ID NO: 2164403 - DNA, 17 bp, Homo sapiens
taggatggttctgtgac

SEQ ID NO: 2164404 - DNA, 21 bp, Homo sapiens
tatctgggtaagaagaaagca

SEQ ID NO: 2164405 - DNA, 14 bp, Homo sapiens
tatcttctggatta

SEQ ID NO: 2164406 - DNA, 13 bp, Homo sapiens
tatgctgtcatgg

SEQ ID NO: 2164407 - DNA, 17 bp, Homo sapiens
tattctatgtatgttaa

SEQ ID NO: 2164408 - DNA, 15 bp, Homo sapiens
tattgtctgtctaca

SEQ ID NO: 2164409 - DNA, 14 bp, Homo sapiens
tcacccccatggcc

SEQ ID NO: 2164410 - DNA, 22 bp, Homo sapiens
tcacccccatggccccaggccc

SEQ ID NO: 2164411 - DNA, 13 bp, Homo sapiens
tcagactgcagag

SEQ ID NO: 2164412 - DNA, 17 bp, Homo sapiens
tcatccccacaatctgg

SEQ ID NO: 2164413 - DNA, 18 bp, Homo sapiens
tcatggtcctttctggaa

SEQ ID NO: 2164414 - DNA, 19 bp, Homo sapiens
tccaccaaaccccacttcc

SEQ ID NO: 2164415 - DNA, 19 bp, Homo sapiens
tccaggatctttgactgaa

SEQ ID NO: 2164416 - DNA, 20 bp, Homo sapiens
tccaggatctttgactgaaa

SEQ ID NO: 2164417 - DNA, 16 bp, Homo sapiens
tccatatgctccagga

SEQ ID NO: 2164418 - DNA, 20 bp, Homo sapiens
tccatgcctgtagctttcct

SEQ ID NO: 2164419 - DNA, 11 bp, Homo sapiens
tcccacccacc

SEQ ID NO: 2164420 - DNA, 21 bp, Homo sapiens
tcccataattgctttgccaaa

SEQ ID NO: 2164421 - DNA, 15 bp, Homo sapiens
tccctcacccccatg

SEQ ID NO: 2164422 - DNA, 22 bp, Homo sapiens
tccctgccaagtctcagaagag

SEQ ID NO: 2164423 - DNA, 19 bp, Homo sapiens
tcccttgtgtcaagacatt

SEQ ID NO: 2164424 - DNA, 14 bp, Homo sapiens
tccgtggtcagagt

SEQ ID NO: 2164425 - DNA, 15 bp, Homo sapiens
tcctctccctgccaa

SEQ ID NO: 2164426 - DNA, 16 bp, Homo sapiens
tcctctccctgccaag

SEQ ID NO: 2164427 - DNA, 17 bp, Homo sapiens
tcctgccattcttctgg

SEQ ID NO: 2164428 - DNA, 20 bp, Homo sapiens
tcggctggggactgctacct

SEQ ID NO: 2164429 - DNA, 21 bp, Homo sapiens
tctaacaataatatttcaagt

SEQ ID NO: 2164430 - DNA, 20 bp, Homo sapiens
tctatgagttggacttcagt

SEQ ID NO: 2164431 - DNA, 13 bp, Homo sapiens
tctatgtatgtta

SEQ ID NO: 2164432 - DNA, 19 bp, Homo sapiens
tctatgtatgttaatttat

SEQ ID NO: 2164433 - DNA, 17 bp, Homo sapiens
tctctaactcctgccat

SEQ ID NO: 2164434 - DNA, 18 bp, Homo sapiens
tctgagaagacacaaggt

SEQ ID NO: 2164435 - DNA, 23 bp, Homo sapiens
tctgccattgggaccctccagtg

SEQ ID NO: 2164436 - DNA, 16 bp, Homo sapiens
tctgggtaagaagaaa

SEQ ID NO: 2164437 - DNA, 15 bp, Homo sapiens
tctgtagtaatttat

SEQ ID NO: 2164438 - DNA, 22 bp, Homo sapiens
tctgtagtaatttattgtctgt

SEQ ID NO: 2164439 - DNA, 15 bp, Homo sapiens
tctgtctacatttct

SEQ ID NO: 2164440 - DNA, 18 bp, Homo sapiens
tgaaaaaaaaaaagaaga

SEQ ID NO: 2164441 - DNA, 21 bp, Homo sapiens
tgaaaaaaaaaaagaagaaga

SEQ ID NO: 2164442 - DNA, 17 bp, Homo sapiens
tgaactggaagaaagca

SEQ ID NO: 2164443 - DNA, 16 bp, Homo sapiens
tgaagttatgctgtca

SEQ ID NO: 2164444 - DNA, 21 bp, Homo sapiens
tgactgaaaaaaaaaaagaag

SEQ ID NO: 2164445 - DNA, 15 bp, Homo sapiens
tgactgttcttggta

SEQ ID NO: 2164446 - DNA, 13 bp, Homo sapiens
tgagttaactgtg

SEQ ID NO: 2164447 - DNA, 15 bp, Homo sapiens
tgagttaactgtgaa

SEQ ID NO: 2164448 - DNA, 14 bp, Homo sapiens
tgatgtcaaagtgt

SEQ ID NO: 2164449 - DNA, 17 bp, Homo sapiens
tgcaatccaaataaaga

SEQ ID NO: 2164450 - DNA, 15 bp, Homo sapiens
tgcagaggggaaaga

SEQ ID NO: 2164451 - DNA, 18 bp, Homo sapiens
tgcagaggggaaagactt

SEQ ID NO: 2164452 - DNA, 13 bp, Homo sapiens
tgcagcagaggac

SEQ ID NO: 2164453 - DNA, 21 bp, Homo sapiens
tgccaaaataccagagccttc

SEQ ID NO: 2164454 - DNA, 13 bp, Homo sapiens
tgccaaacagagt

SEQ ID NO: 2164455 - DNA, 17 bp, Homo sapiens
tgccaagtctcagaaga

SEQ ID NO: 2164456 - DNA, 17 bp, Homo sapiens
tgccggttaaattccat

SEQ ID NO: 2164457 - DNA, 19 bp, Homo sapiens
tgcctagactgttactttg

SEQ ID NO: 2164458 - DNA, 16 bp, Homo sapiens
tgcctgtagctttcct

SEQ ID NO: 2164459 - DNA, 14 bp, Homo sapiens
tgctacctctgaga

SEQ ID NO: 2164460 - DNA, 16 bp, Homo sapiens
tgctacctctgagaag

SEQ ID NO: 2164461 - DNA, 12 bp, Homo sapiens
tgctactccatg

SEQ ID NO: 2164462 - DNA, 13 bp, Homo sapiens
tgctactccatgc

SEQ ID NO: 2164463 - DNA, 18 bp, Homo sapiens
tgctactccatgcagggg

SEQ ID NO: 2164464 - DNA, 14 bp, Homo sapiens
agtgcctagactgt

SEQ ID NO: 2164465 - DNA, 17 bp, Homo sapiens
agtgctggatttgatga

SEQ ID NO: 2164466 - DNA, 17 bp, Homo sapiens
agtgtctccccgtgtcc

SEQ ID NO: 2164467 - DNA, 18 bp, Homo sapiens
agttaactgtgaaatacc

SEQ ID NO: 2164468 - DNA, 18 bp, Homo sapiens
agttgccgtctaggattg

SEQ ID NO: 2164469 - DNA, 22 bp, Homo sapiens
ataaagataacccttattccat

SEQ ID NO: 2164470 - DNA, 21 bp, Homo sapiens
ataacaactatttttgttgtt

SEQ ID NO: 2164471 - DNA, 14 bp, Homo sapiens
ataatatttcaagt

SEQ ID NO: 2164472 - DNA, 18 bp, Homo sapiens
ataatatttcaagtgcct

SEQ ID NO: 2164473 - DNA, 19 bp, Homo sapiens
ataatatttcaagtgccta

SEQ ID NO: 2164474 - DNA, 12 bp, Homo sapiens
ataccagagcct

SEQ ID NO: 2164475 - DNA, 18 bp, Homo sapiens
atatatttattttattct

SEQ ID NO: 2164476 - DNA, 22 bp, Homo sapiens
atatgctccaggatctttgact

SEQ ID NO: 2164477 - DNA, 20 bp, Homo sapiens
atcggctggggactgctacc

SEQ ID NO: 2164478 - DNA, 20 bp, Homo sapiens
atctaacaataatatttcaa

SEQ ID NO: 2164479 - DNA, 16 bp, Homo sapiens
atctagtcacaaagac

SEQ ID NO: 2164480 - DNA, 23 bp, Homo sapiens
atctggcttagtgccacccacct

SEQ ID NO: 2164481 - DNA, 22 bp, Homo sapiens
atctgtagtaatttattgtctg

SEQ ID NO: 2164482 - DNA, 17 bp, Homo sapiens
atgagttaactgtgaaa

SEQ ID NO: 2164483 - DNA, 16 bp, Homo sapiens
atgcaggggtcagtgc

SEQ ID NO: 2164484 - DNA, 20 bp, Homo sapiens
atgccggttaaattccatat

SEQ ID NO: 2164485 - DNA, 20 bp, Homo sapiens
atgcctgtagctttcctggt

SEQ ID NO: 2164486 - DNA, 14 bp, Homo sapiens
atggaaaaataaca

SEQ ID NO: 2164487 - DNA, 21 bp, Homo sapiens
atggtatctgggtaagaagaa

SEQ ID NO: 2164488 - DNA, 21 bp, Homo sapiens
atggttctgtgacccatctgt

SEQ ID NO: 2164489 - DNA, 12 bp, Homo sapiens
atgtatgttaat

SEQ ID NO: 2164490 - DNA, 17 bp, Homo sapiens
atgttaatttatttagt

SEQ ID NO: 2164491 - DNA, 18 bp, Homo sapiens
attacctgccaattgcta

SEQ ID NO: 2164492 - DNA, 14 bp, Homo sapiens
attgctttgccaaa

SEQ ID NO: 2164493 - DNA, 20 bp, Homo sapiens
attgctttgccaaaatacca

SEQ ID NO: 2164494 - DNA, 23 bp, Homo sapiens
attgctttgccaaaataccagag

SEQ ID NO: 2164495 - DNA, 14 bp, Homo sapiens
attgtctgtctaca

SEQ ID NO: 2164496 - DNA, 14 bp, Homo sapiens
atttagtttttaac

SEQ ID NO: 2164497 - DNA, 14 bp, Homo sapiens
atttatactttgca

SEQ ID NO: 2164498 - DNA, 14 bp, Homo sapiens
atttattgtctgtc

SEQ ID NO: 2164499 - DNA, 16 bp, Homo sapiens
atttattgtctgtcta

SEQ ID NO: 2164500 - DNA, 17 bp, Homo sapiens
atttattgtctgtctac

SEQ ID NO: 2164501 - DNA, 15 bp, Homo sapiens
atttattttattcta

SEQ ID NO: 2164502 - DNA, 16 bp, Homo sapiens
atttattttattctat

SEQ ID NO: 2164503 - DNA, 19 bp, Homo sapiens
atttattttattctatgta

SEQ ID NO: 2164504 - DNA, 21 bp, Homo sapiens
atttattttattctatgtatg

SEQ ID NO: 2164505 - DNA, 14 bp, Homo sapiens
atttcaagtgccta

SEQ ID NO: 2164506 - DNA, 16 bp, Homo sapiens
atttcctggccctcca

SEQ ID NO: 2164507 - DNA, 21 bp, Homo sapiens
atttctgcagatcttccgtgg

SEQ ID NO: 2164508 - DNA, 22 bp, Homo sapiens
atttgatgagttaactgtgaaa

SEQ ID NO: 2164509 - DNA, 17 bp, Homo sapiens
atttgtgaactggaaga

SEQ ID NO: 2164510 - DNA, 14 bp, Homo sapiens
attttattctatgt

SEQ ID NO: 2164511 - DNA, 16 bp, Homo sapiens
attttgggacttctac

SEQ ID NO: 2164512 - DNA, 12 bp, Homo sapiens
attttgtctacc

SEQ ID NO: 2164513 - DNA, 20 bp, Homo sapiens
caaaagcaagggaccttcat

SEQ ID NO: 2164514 - DNA, 16 bp, Homo sapiens
caaaataccagagcct

SEQ ID NO: 2164515 - DNA, 22 bp, Homo sapiens
caaacagagtatgtccgatggt

SEQ ID NO: 2164516 - DNA, 16 bp, Homo sapiens
caaagattgagaagcc

SEQ ID NO: 2164517 - DNA, 16 bp, Homo sapiens
caaagctaggatggtt

SEQ ID NO: 2164518 - DNA, 20 bp, Homo sapiens
caagaaggaaagatttgtga

SEQ ID NO: 2164519 - DNA, 15 bp, Homo sapiens
caagggaccttcatg

SEQ ID NO: 2164520 - DNA, 21 bp, Homo sapiens
caaggtgatttcagactgcag

SEQ ID NO: 2164521 - DNA, 14 bp, Homo sapiens
caagtaccaccaag

SEQ ID NO: 2164522 - DNA, 15 bp, Homo sapiens
caagtgccaaacaga

SEQ ID NO: 2164523 - DNA, 18 bp, Homo sapiens
caataatatttcaagtgc

SEQ ID NO: 2164524 - DNA, 19 bp, Homo sapiens
caataatatttcaagtgcc

SEQ ID NO: 2164525 - DNA, 19 bp, Homo sapiens
caatctggcttagtgccac

SEQ ID NO: 2164526 - DNA, 12 bp, Homo sapiens
caatttcctggc

SEQ ID NO: 2164527 - DNA, 15 bp, Homo sapiens
cacaagcctgagaac

SEQ ID NO: 2164528 - DNA, 21 bp, Homo sapiens
cacaatctggcttagtgccac

SEQ ID NO: 2164529 - DNA, 22 bp, Homo sapiens
cacccacctttgccacaaagct

SEQ ID NO: 2164530 - DNA, 15 bp, Homo sapiens
tgctgatgtcaaagt

SEQ ID NO: 2164531 - DNA, 13 bp, Homo sapiens
tgctttgccaaaa

SEQ ID NO: 2164532 - DNA, 17 bp, Homo sapiens
tgctttgccaaaatacc

SEQ ID NO: 2164533 - DNA, 17 bp, Homo sapiens
tggaaaaataacaacta

SEQ ID NO: 2164534 - DNA, 21 bp, Homo sapiens
tggatttgatgagttaactgt

SEQ ID NO: 2164535 - DNA, 24 bp, Homo sapiens
tggatttgatgagttaactgtgaa

SEQ ID NO: 2164536 - DNA, 21 bp, Homo sapiens
tggcaatttcctggccctcca

SEQ ID NO: 2164537 - DNA, 20 bp, Homo sapiens
tgggacttctacccagatgg

SEQ ID NO: 2164538 - DNA, 14 bp, Homo sapiens
tgggtaagaagaaa

SEQ ID NO: 2164539 - DNA, 21 bp, Homo sapiens
tggtaactgattacctgccaa

SEQ ID NO: 2164540 - DNA, 15 bp, Homo sapiens
tggtcagagccactc

SEQ ID NO: 2164541 - DNA, 12 bp, Homo sapiens
tggtcagagtgc

SEQ ID NO: 2164542 - DNA, 15 bp, Homo sapiens
tggtcagagtgccac

SEQ ID NO: 2164543 - DNA, 22 bp, Homo sapiens
tggtgccatttctgaactgtta

SEQ ID NO: 2164544 - DNA, 13 bp, Homo sapiens
tggttctgtgacc

SEQ ID NO: 2164545 - DNA, 13 bp, Homo sapiens
tgtataatcccac

SEQ ID NO: 2164546 - DNA, 19 bp, Homo sapiens
tgtccgatggtatctgggt

SEQ ID NO: 2164547 - DNA, 14 bp, Homo sapiens
tgtctgtctacatt

SEQ ID NO: 2164548 - DNA, 23 bp, Homo sapiens
tgtgaaataccacaagcctgaga

SEQ ID NO: 2164549 - DNA, 13 bp, Homo sapiens
tgtgaactggaag

SEQ ID NO: 2164550 - DNA, 19 bp, Homo sapiens
tgtgaactggaagaaagca

SEQ ID NO: 2164551 - DNA, 17 bp, Homo sapiens
tgtgtcaagacatttct

SEQ ID NO: 2164552 - DNA, 23 bp, Homo sapiens
tgttactttggcaatttcctggc

SEQ ID NO: 2164553 - DNA, 12 bp, Homo sapiens
tgttgtttgtaa

SEQ ID NO: 2164554 - DNA, 14 bp, Homo sapiens
tgtttgtaaatgcc

SEQ ID NO: 2164555 - DNA, 16 bp, Homo sapiens
tgtttgtaaatgcctc

SEQ ID NO: 2164556 - DNA, 21 bp, Homo sapiens
ttaaacacttatcttctggat

SEQ ID NO: 2164557 - DNA, 12 bp, Homo sapiens
ttaaattatata

SEQ ID NO: 2164558 - DNA, 13 bp, Homo sapiens
ttacaacttgtat

SEQ ID NO: 2164559 - DNA, 19 bp, Homo sapiens
ttactttggcaatttcctg

SEQ ID NO: 2164560 - DNA, 22 bp, Homo sapiens
ttagcaaagcaaaaggctgaga

SEQ ID NO: 2164561 - DNA, 18 bp, Homo sapiens
ttagtttttaacaatcta

SEQ ID NO: 2164562 - DNA, 21 bp, Homo sapiens
ttatactttgcaatccaaata

SEQ ID NO: 2164563 - DNA, 14 bp, Homo sapiens
ttattgtctgtcta

SEQ ID NO: 2164564 - DNA, 21 bp, Homo sapiens
ttattgtctgtctacatttct

SEQ ID NO: 2164565 - DNA, 22 bp, Homo sapiens
ttattgtctgtctacatttctg

SEQ ID NO: 2164566 - DNA, 12 bp, Homo sapiens
ttcaagtgccaa

SEQ ID NO: 2164567 - DNA, 14 bp, Homo sapiens
ttcaagtgcctaga

SEQ ID NO: 2164568 - DNA, 18 bp, Homo sapiens
ttcaagtgcctagactgt

SEQ ID NO: 2164569 - DNA, 18 bp, Homo sapiens
ttcatatttatactttgc

SEQ ID NO: 2164570 - DNA, 16 bp, Homo sapiens
ttcatgcccttctgat

SEQ ID NO: 2164571 - DNA, 16 bp, Homo sapiens
ttccaaacctggttca

SEQ ID NO: 2164572 - DNA, 17 bp, Homo sapiens
ttcccttgtgtcaagac

SEQ ID NO: 2164573 - DNA, 14 bp, Homo sapiens
ttctatgtatgtta

SEQ ID NO: 2164574 - DNA, 17 bp, Homo sapiens
ttctatgtatgttaatt

SEQ ID NO: 2164575 - DNA, 16 bp, Homo sapiens
ttctctaactcctgcc

SEQ ID NO: 2164576 - DNA, 12 bp, Homo sapiens
acaatctaacaa

SEQ ID NO: 2164577 - DNA, 15 bp, Homo sapiens
acacaaggtgatttc

SEQ ID NO: 2164578 - DNA, 18 bp, Homo sapiens
acacaaggtgatttcaga

SEQ ID NO: 2164579 - DNA, 14 bp, Homo sapiens
acacttatcttctg

SEQ ID NO: 2164580 - DNA, 19 bp, Homo sapiens
acacttatcttctggatta

SEQ ID NO: 2164581 - DNA, 16 bp, Homo sapiens
acagtctggagaaggt

SEQ ID NO: 2164582 - DNA, 16 bp, Homo sapiens
accacaagcctgagaa

SEQ ID NO: 2164583 - DNA, 13 bp, Homo sapiens
accagagccttca

SEQ ID NO: 2164584 - DNA, 16 bp, Homo sapiens
accagagccttcaagt

SEQ ID NO: 2164585 - DNA, 15 bp, Homo sapiens
accatttgtgttttg

SEQ ID NO: 2164586 - DNA, 13 bp, Homo sapiens
acccatctgtagt

SEQ ID NO: 2164587 - DNA, 20 bp, Homo sapiens
acccatctgtagtaatttat

SEQ ID NO: 2164588 - DNA, 20 bp, Homo sapiens
accctccagtgctggatttg

SEQ ID NO: 2164589 - DNA, 14 bp, Homo sapiens
acctctgagaagac

SEQ ID NO: 2164590 - DNA, 15 bp, Homo sapiens
actcactttcccttg

SEQ ID NO: 2164591 - DNA, 21 bp, Homo sapiens
actcactttcccttgtgtcaa

SEQ ID NO: 2164592 - DNA, 21 bp, Homo sapiens
actcctgccattcttctggtg

SEQ ID NO: 2164593 - DNA, 23 bp, Homo sapiens
actgaaaaaaaaaaagaagaaga

SEQ ID NO: 2164594 - DNA, 18 bp, Homo sapiens
actgaattttgggacttc

SEQ ID NO: 2164595 - DNA, 20 bp, Homo sapiens
actgaattttgggacttcta

SEQ ID NO: 2164596 - DNA, 16 bp, Homo sapiens
actgattacctgccaa

SEQ ID NO: 2164597 - DNA, 21 bp, Homo sapiens
actgcagaggggaaagacttc

SEQ ID NO: 2164598 - DNA, 15 bp, Homo sapiens
actggaagaaagcaa

SEQ ID NO: 2164599 - DNA, 14 bp, Homo sapiens
actgtgaaatacca

SEQ ID NO: 2164600 - DNA, 17 bp, Homo sapiens
acttatcttctggatta

SEQ ID NO: 2164601 - DNA, 15 bp, Homo sapiens
agaagaagaagaagg

SEQ ID NO: 2164602 - DNA, 22 bp, Homo sapiens
agaagacacaaggtgatttcag

SEQ ID NO: 2164603 - DNA, 20 bp, Homo sapiens
agaagaggttgggcttccat

SEQ ID NO: 2164604 - DNA, 20 bp, Homo sapiens
agaagccatgtactcaagta

SEQ ID NO: 2164605 - DNA, 18 bp, Homo sapiens
agactccttcgtccccag

SEQ ID NO: 2164606 - DNA, 14 bp, Homo sapiens
agactgcagagggg

SEQ ID NO: 2164607 - DNA, 12 bp, Homo sapiens
agagcaagaagg

SEQ ID NO: 2164608 - DNA, 14 bp, Homo sapiens
agagccttcaagtg

SEQ ID NO: 2164609 - DNA, 20 bp, Homo sapiens
agagccttcaagtgccaaac

SEQ ID NO: 2164610 - DNA, 17 bp, Homo sapiens
agaggacagtctggaga

SEQ ID NO: 2164611 - DNA, 19 bp, Homo sapiens
agaggacagtctggagaag

SEQ ID NO: 2164612 - DNA, 17 bp, Homo sapiens
agataacccttattcca

SEQ ID NO: 2164613 - DNA, 22 bp, Homo sapiens
agatcttccgtggtcagagtgc

SEQ ID NO: 2164614 - DNA, 19 bp, Homo sapiens
agatttgtgaactggaaga

SEQ ID NO: 2164615 - DNA, 15 bp, Homo sapiens
agcaaaaggctgaga

SEQ ID NO: 2164616 - DNA, 21 bp, Homo sapiens
agcagaggacagtctggagaa

SEQ ID NO: 2164617 - DNA, 22 bp, Homo sapiens
agcagaggacagtctggagaag

SEQ ID NO: 2164618 - DNA, 14 bp, Homo sapiens
agccactctatgag

SEQ ID NO: 2164619 - DNA, 20 bp, Homo sapiens
agccatgtactcaagtacca

SEQ ID NO: 2164620 - DNA, 24 bp, Homo sapiens
agcccaaggtgctgatgtcaaagt

SEQ ID NO: 2164621 - DNA, 12 bp, Homo sapiens
agccttcaagtg

SEQ ID NO: 2164622 - DNA, 24 bp, Homo sapiens
agccttcaagtgccaaacagagta

SEQ ID NO: 2164623 - DNA, 20 bp, Homo sapiens
agctaggatggttctgtgac

SEQ ID NO: 2164624 - DNA, 16 bp, Homo sapiens
agctctgtatggtcag

SEQ ID NO: 2164625 - DNA, 18 bp, Homo sapiens
agctttcctggtccctca

SEQ ID NO: 2164626 - DNA, 14 bp, Homo sapiens
aggacagtctggag

SEQ ID NO: 2164627 - DNA, 15 bp, Homo sapiens
aggacagtctggaga

SEQ ID NO: 2164628 - DNA, 16 bp, Homo sapiens
aggacagtctggagaa

SEQ ID NO: 2164629 - DNA, 19 bp, Homo sapiens
aggacagtctggagaaggt

SEQ ID NO: 2164630 - DNA, 23 bp, Homo sapiens
aggatgtaggggttaacttggtc

SEQ ID NO: 2164631 - DNA, 20 bp, Homo sapiens
aggctgagaaggaacaggga

SEQ ID NO: 2164632 - DNA, 16 bp, Homo sapiens
agggaccttcatgccc

SEQ ID NO: 2164633 - DNA, 22 bp, Homo sapiens
agggaccttcatgcccttctga

SEQ ID NO: 2164634 - DNA, 20 bp, Homo sapiens
aggggaaagacttccatcta

SEQ ID NO: 2164635 - DNA, 23 bp, Homo sapiens
aggggttaacttggtcagagcca

SEQ ID NO: 2164636 - DNA, 19 bp, Homo sapiens
aggttgggcttccatgcct

SEQ ID NO: 2164637 - DNA, 14 bp, Homo sapiens
agtctggagaaggt

SEQ ID NO: 2164638 - DNA, 14 bp, Homo sapiens
agtgcagcagagga

SEQ ID NO: 2164639 - DNA, 21 bp, Homo sapiens
agtttttaacaatctaacaat

SEQ ID NO: 2164640 - DNA, 16 bp, Homo sapiens
ataatatttcaagtgc

SEQ ID NO: 2164641 - DNA, 21 bp, Homo sapiens
ataccagagccttcaagtgcc

SEQ ID NO: 2164642 - DNA, 22 bp, Homo sapiens
ataccagagccttcaagtgcca

SEQ ID NO: 2164643 - DNA, 18 bp, Homo sapiens
atactttgcaatccaaat

SEQ ID NO: 2164644 - DNA, 22 bp, Homo sapiens
atatatttattttattctatgt

SEQ ID NO: 2164645 - DNA, 19 bp, Homo sapiens
atatttattttattctatg

SEQ ID NO: 2164646 - DNA, 23 bp, Homo sapiens
atatttcaagtgcctagactgtt

SEQ ID NO: 2164647 - DNA, 14 bp, Homo sapiens
atccaaataaagat

SEQ ID NO: 2164648 - DNA, 15 bp, Homo sapiens
atctaacaataatat

SEQ ID NO: 2164649 - DNA, 22 bp, Homo sapiens
atctaacaataatatttcaagt

SEQ ID NO: 2164650 - DNA, 23 bp, Homo sapiens
atctaacaataatatttcaagtg

SEQ ID NO: 2164651 - DNA, 17 bp, Homo sapiens
atctagtcacaaagact

SEQ ID NO: 2164652 - DNA, 22 bp, Homo sapiens
atctgccattgggaccctccag

SEQ ID NO: 2164653 - DNA, 16 bp, Homo sapiens
atctggcttagtgcca

SEQ ID NO: 2164654 - DNA, 23 bp, Homo sapiens
atctgggtaagaagaaagcaaaa

SEQ ID NO: 2164655 - DNA, 13 bp, Homo sapiens
atctgtagtaatt

SEQ ID NO: 2164656 - DNA, 22 bp, Homo sapiens
atcttccgtggtcagagtgcca

SEQ ID NO: 2164657 - DNA, 12 bp, Homo sapiens
atcttctggatt

SEQ ID NO: 2164658 - DNA, 18 bp, Homo sapiens
atgagttaactgtgaaat

SEQ ID NO: 2164659 - DNA, 17 bp, Homo sapiens
atggtcctttctggaag

SEQ ID NO: 2164660 - DNA, 23 bp, Homo sapiens
atgtaggggttaacttggtcaga

SEQ ID NO: 2164661 - DNA, 12 bp, Homo sapiens
attacctgccaa

SEQ ID NO: 2164662 - DNA, 20 bp, Homo sapiens
attacctgccaattgctacc

SEQ ID NO: 2164663 - DNA, 12 bp, Homo sapiens
attagaatgccg

SEQ ID NO: 2164664 - DNA, 13 bp, Homo sapiens
attctatgtatgt

SEQ ID NO: 2164665 - DNA, 16 bp, Homo sapiens
attctatgtatgttaa

SEQ ID NO: 2164666 - DNA, 22 bp, Homo sapiens
attcttctggtgctactccatg

SEQ ID NO: 2164667 - DNA, 17 bp, Homo sapiens
attgctaccgagaaggt

SEQ ID NO: 2164668 - DNA, 12 bp, Homo sapiens
attgctttgcca

SEQ ID NO: 2164669 - DNA, 15 bp, Homo sapiens
attgggaccctccag

SEQ ID NO: 2164670 - DNA, 19 bp, Homo sapiens
attgtctgtctacatttct

SEQ ID NO: 2164671 - DNA, 21 bp, Homo sapiens
attgtctgtctacatttctgc

SEQ ID NO: 2164672 - DNA, 11 bp, Homo sapiens
atttcaagtgc

SEQ ID NO: 2164673 - DNA, 12 bp, Homo sapiens
atttcaagtgcc

SEQ ID NO: 2164674 - DNA, 13 bp, Homo sapiens
atttcaagtgcct

SEQ ID NO: 2164675 - DNA, 16 bp, Homo sapiens
atttcaagtgcctaga

SEQ ID NO: 2164676 - DNA, 23 bp, Homo sapiens
atttcaagtgcctagactgttac

SEQ ID NO: 2164677 - DNA, 20 bp, Homo sapiens
atttcagactgcagagggga

SEQ ID NO: 2164678 - DNA, 17 bp, Homo sapiens
atttgatgagttaactg

SEQ ID NO: 2164679 - DNA, 21 bp, Homo sapiens
atttgatgagttaactgtgaa

SEQ ID NO: 2164680 - DNA, 20 bp, Homo sapiens
atttgtgaactggaagaaag

SEQ ID NO: 2164681 - DNA, 19 bp, Homo sapiens
attttattctatgtatgtt

SEQ ID NO: 2164682 - DNA, 16 bp, Homo sapiens
atttttgttgttgttg

SEQ ID NO: 2164683 - DNA, 22 bp, Homo sapiens
caaaataccagagccttcaagt

SEQ ID NO: 2164684 - DNA, 23 bp, Homo sapiens
caaaataccagagccttcaagtg

SEQ ID NO: 2164685 - DNA, 14 bp, Homo sapiens
caaacagagtatgt

SEQ ID NO: 2164686 - DNA, 13 bp, Homo sapiens
caaacctggttca

SEQ ID NO: 2164687 - DNA, 13 bp, Homo sapiens
caaagctaggatg

SEQ ID NO: 2164688 - DNA, 14 bp, Homo sapiens
caagcctgagaact

SEQ ID NO: 2164689 - DNA, 23 bp, Homo sapiens
caaggtgatttcagactgcagag

SEQ ID NO: 2164690 - DNA, 15 bp, Homo sapiens
caaggtgctgatgtc

SEQ ID NO: 2164691 - DNA, 14 bp, Homo sapiens
caagtctcagaaga

SEQ ID NO: 2164692 - DNA, 15 bp, Homo sapiens
caagtctcagaagag

SEQ ID NO: 2164693 - DNA, 12 bp, Homo sapiens
caagtgccaaac

SEQ ID NO: 2164694 - DNA, 18 bp, Homo sapiens
caagtgccaaacagagta

SEQ ID NO: 2164695 - DNA, 15 bp, Homo sapiens
caagtgcctagactg

SEQ ID NO: 2164696 - DNA, 21 bp, Homo sapiens
caataatatttcaagtgccta

SEQ ID NO: 2164697 - DNA, 19 bp, Homo sapiens
caatctaacaataatattt

SEQ ID NO: 2164698 - DNA, 18 bp, Homo sapiens
caatctggcttagtgcca

SEQ ID NO: 2164699 - DNA, 14 bp, Homo sapiens
caccaagggatctg

SEQ ID NO: 2164700 - DNA, 14 bp, Homo sapiens
cacctttgccacaa

SEQ ID NO: 2164701 - DNA, 18 bp, Homo sapiens
cactgcgggagctctgta

SEQ ID NO: 2164702 - DNA, 16 bp, Homo sapiens
cagagccactctatga

SEQ ID NO: 2164703 - DNA, 19 bp, Homo sapiens
cagagccttcaagtgccaa

SEQ ID NO: 2164704 - DNA, 14 bp, Homo sapiens
ctgactgttcttgg

SEQ ID NO: 2164705 - DNA, 22 bp, Homo sapiens
ctgactgttcttggtaactgat

SEQ ID NO: 2164706 - DNA, 22 bp, Homo sapiens
ctgagaactgaattttgggact

SEQ ID NO: 2164707 - DNA, 21 bp, Homo sapiens
ctgcagaggggaaagacttcc

SEQ ID NO: 2164708 - DNA, 22 bp, Homo sapiens
ctgcagaggggaaagacttcca

SEQ ID NO: 2164709 - DNA, 19 bp, Homo sapiens
ctgcagatcttccgtggtc

SEQ ID NO: 2164710 - DNA, 19 bp, Homo sapiens
ctgccaagtctcagaagag

SEQ ID NO: 2164711 - DNA, 22 bp, Homo sapiens
ctgccattcttctggtgctact

SEQ ID NO: 2164712 - DNA, 21 bp, Homo sapiens
ctgccattgggaccctccagt

SEQ ID NO: 2164713 - DNA, 16 bp, Homo sapiens
ctgctacctctgagaa

SEQ ID NO: 2164714 - DNA, 18 bp, Homo sapiens
ctgctacctctgagaaga

SEQ ID NO: 2164715 - DNA, 13 bp, Homo sapiens
ctggatttgatga

SEQ ID NO: 2164716 - DNA, 17 bp, Homo sapiens
ctgggtaagaagaaagc

SEQ ID NO: 2164717 - DNA, 15 bp, Homo sapiens
ctggtgctactccat

SEQ ID NO: 2164718 - DNA, 14 bp, Homo sapiens
ctgtcatggtcctt

SEQ ID NO: 2164719 - DNA, 14 bp, Homo sapiens
ctgtctacatttct

SEQ ID NO: 2164720 - DNA, 20 bp, Homo sapiens
ctgtctacatttctgcagat

SEQ ID NO: 2164721 - DNA, 15 bp, Homo sapiens
ctgttactttggcaa

SEQ ID NO: 2164722 - DNA, 13 bp, Homo sapiens
ctgttcttggtaa

SEQ ID NO: 2164723 - DNA, 13 bp, Homo sapiens
cttatcttctgga

SEQ ID NO: 2164724 - DNA, 15 bp, Homo sapiens
cttcaagtgccaaac

SEQ ID NO: 2164725 - DNA, 15 bp, Homo sapiens
cttcatgcccttctg

SEQ ID NO: 2164726 - DNA, 18 bp, Homo sapiens
cttcatgcccttctgatt

SEQ ID NO: 2164727 - DNA, 14 bp, Homo sapiens
cttccatgcctgta

SEQ ID NO: 2164728 - DNA, 17 bp, Homo sapiens
cttccatgcctgtagct

SEQ ID NO: 2164729 - DNA, 21 bp, Homo sapiens
cttccgtggtcagagtgccac

SEQ ID NO: 2164730 - DNA, 22 bp, Homo sapiens
cttccgtggtcagagtgccact

SEQ ID NO: 2164731 - DNA, 12 bp, Homo sapiens
cttctacccaga

SEQ ID NO: 2164732 - DNA, 18 bp, Homo sapiens
cttctgattcccctccac

SEQ ID NO: 2164733 - DNA, 13 bp, Homo sapiens
cttgtatttccaa

SEQ ID NO: 2164734 - DNA, 15 bp, Homo sapiens
cttgtatttccaaac

SEQ ID NO: 2164735 - DNA, 15 bp, Homo sapiens
ctttgccaaaatacc

SEQ ID NO: 2164736 - DNA, 22 bp, Homo sapiens
ctttgccaaaataccagagcct

SEQ ID NO: 2164737 - DNA, 16 bp, Homo sapiens
ctttggcaatttcctg

SEQ ID NO: 2164738 - DNA, 22 bp, Homo sapiens
ctttggcaatttcctggccctc

SEQ ID NO: 2164739 - DNA, 20 bp, Homo sapiens
gaaaaaaaaaaagaagaaga

SEQ ID NO: 2164740 - DNA, 23 bp, Homo sapiens
gaaagatttgtgaactggaagaa

SEQ ID NO: 2164741 - DNA, 19 bp, Homo sapiens
gaaagcccaaggtgctgat

SEQ ID NO: 2164742 - DNA, 13 bp, Homo sapiens
gaactggaagaaa

SEQ ID NO: 2164743 - DNA, 21 bp, Homo sapiens
gaactgttacaacttgtattt

SEQ ID NO: 2164744 - DNA, 20 bp, Homo sapiens
gaatgccggttaaattccat

SEQ ID NO: 2164745 - DNA, 19 bp, Homo sapiens
gacacaaggtgatttcaga

SEQ ID NO: 2164746 - DNA, 21 bp, Homo sapiens
gaccttcatgcccttctgatt

SEQ ID NO: 2164747 - DNA, 20 bp, Homo sapiens
gactgctacctctgagaaga

SEQ ID NO: 2164748 - DNA, 15 bp, Homo sapiens
gacttcagtcttgcc

SEQ ID NO: 2164749 - DNA, 16 bp, Homo sapiens
gacttcagtcttgcct

SEQ ID NO: 2164750 - DNA, 14 bp, Homo sapiens
gacttccatctagt

SEQ ID NO: 2164751 - DNA, 21 bp, Homo sapiens
gagaactgaattttgggactt

SEQ ID NO: 2164752 - DNA, 17 bp, Homo sapiens
gagaaggttggaggtgg

SEQ ID NO: 2164753 - DNA, 14 bp, Homo sapiens
gagccttcaagtgc

SEQ ID NO: 2164754 - DNA, 18 bp, Homo sapiens
gagccttcaagtgccaaa

SEQ ID NO: 2164755 - DNA, 19 bp, Homo sapiens
gagccttcaagtgccaaac

SEQ ID NO: 2164756 - DNA, 16 bp, Homo sapiens
gaggacagtctggaga

SEQ ID NO: 2164757 - DNA, 20 bp, Homo sapiens
gaggacagtctggagaaggt

SEQ ID NO: 2164758 - DNA, 23 bp, Homo sapiens
gagttggacttcagtcttgccta

SEQ ID NO: 2164759 - DNA, 17 bp, Homo sapiens
gataacccttattccat

SEQ ID NO: 2164760 - DNA, 17 bp, Homo sapiens
gatcttccgtggtcaga

SEQ ID NO: 2164761 - DNA, 18 bp, Homo sapiens
gatgagttaactgtgaaa

SEQ ID NO: 2164762 - DNA, 19 bp, Homo sapiens
gatttgatgagttaactgt

SEQ ID NO: 2164763 - DNA, 21 bp, Homo sapiens
gatttgatgagttaactgtga

SEQ ID NO: 2164764 - DNA, 16 bp, Homo sapiens
gatttgtgaactggaa

SEQ ID NO: 2164765 - DNA, 22 bp, Homo sapiens
gatttgtgaactggaagaaagc

SEQ ID NO: 2164766 - DNA, 13 bp, Homo sapiens
gcaaaaggctgag

SEQ ID NO: 2164767 - DNA, 16 bp, Homo sapiens
gcaaaaggctgagaag

SEQ ID NO: 2164768 - DNA, 21 bp, Homo sapiens
gcaaagcaaaaggctgagaag

SEQ ID NO: 2164769 - DNA, 18 bp, Homo sapiens
gcaatttcctggccctcc

SEQ ID NO: 2164770 - DNA, 20 bp, Homo sapiens
gcaatttcctggccctccac

SEQ ID NO: 2164771 - DNA, 20 bp, Homo sapiens
gcagatcttccgtggtcaga

SEQ ID NO: 2164772 - DNA, 19 bp, Homo sapiens
gcaggggtcagtgcagcag

SEQ ID NO: 2164773 - DNA, 22 bp, Homo sapiens
gcaggggtcagtgcagcagagg

SEQ ID NO: 2164774 - DNA, 18 bp, Homo sapiens
gccaaaataccagagcct

SEQ ID NO: 2164775 - DNA, 19 bp, Homo sapiens
gccatgtactcaagtacca

SEQ ID NO: 2164776 - DNA, 18 bp, Homo sapiens
gccattgggaccctccag

SEQ ID NO: 2164777 - DNA, 16 bp, Homo sapiens
gccatttctgaactgt

SEQ ID NO: 2164778 - DNA, 21 bp, Homo sapiens
gccgtctaggattgggcctcc

SEQ ID NO: 2164779 - DNA, 21 bp, Homo sapiens
gcctcccataattgctttgcc

SEQ ID NO: 2164780 - DNA, 21 bp, Homo sapiens
gctgtcatggtcctttctgga

SEQ ID NO: 2164781 - DNA, 22 bp, Homo sapiens
gctgtcatggtcctttctggaa

SEQ ID NO: 2164782 - DNA, 11 bp, Homo sapiens
gcttccatgcc

SEQ ID NO: 2164783 - DNA, 22 bp, Homo sapiens
gcttccatgcctgtagctttcc

SEQ ID NO: 2164784 - DNA, 17 bp, Homo sapiens
gctttgccaaaatacca

SEQ ID NO: 2164785 - DNA, 23 bp, Homo sapiens
gctttgccaaaataccagagcct

SEQ ID NO: 2164786 - DNA, 14 bp, Homo sapiens
ggaagaaagcaaca

SEQ ID NO: 2164787 - DNA, 16 bp, Homo sapiens
ggagctctgtatggtc

SEQ ID NO: 2164788 - DNA, 23 bp, Homo sapiens
ggatttgatgagttaactgtgaa

SEQ ID NO: 2164789 - DNA, 14 bp, Homo sapiens
ggcaatttcctggc

SEQ ID NO: 2164790 - DNA, 13 bp, Homo sapiens
ggctgagaaggaa

SEQ ID NO: 2164791 - DNA, 19 bp, Homo sapiens
ggctgagaaggaacaggga

SEQ ID NO: 2164792 - DNA, 19 bp, Homo sapiens
ggctggggactgctacctc

SEQ ID NO: 2164793 - DNA, 19 bp, Homo sapiens
ggcttagtgccacccacct

SEQ ID NO: 2164794 - DNA, 21 bp, Homo sapiens
gggactgctacctctgagaag

SEQ ID NO: 2164795 - DNA, 18 bp, Homo sapiens
gggcctcccataattgct

SEQ ID NO: 2164796 - DNA, 22 bp, Homo sapiens
ggggttaacttggtcagagcca

SEQ ID NO: 2164797 - DNA, 19 bp, Homo sapiens
gggtcagtgcagcagagga

SEQ ID NO: 2164798 - DNA, 17 bp, Homo sapiens
ggtaagaagaaagcaaa

SEQ ID NO: 2164799 - DNA, 17 bp, Homo sapiens
ggtcagagtgccactgc

SEQ ID NO: 2164800 - DNA, 22 bp, Homo sapiens
ggtcaggatgtaggggttaact

SEQ ID NO: 2164801 - DNA, 17 bp, Homo sapiens
ggtcagtgcagcagagg

SEQ ID NO: 2164802 - DNA, 19 bp, Homo sapiens
ggttctgtgacccatctgt

SEQ ID NO: 2164803 - DNA, 10 bp, Homo sapiens
gtaaatgcct

SEQ ID NO: 2164804 - DNA, 19 bp, Homo sapiens
gtaactgattacctgccaa

SEQ ID NO: 2164805 - DNA, 14 bp, Homo sapiens
gtaagaagaaagca

SEQ ID NO: 2164806 - DNA, 13 bp, Homo sapiens
gtattagcaaagc

SEQ ID NO: 2164807 - DNA, 12 bp, Homo sapiens
gtcagagccact

SEQ ID NO: 2164808 - DNA, 16 bp, Homo sapiens
gtcctctccctgccaa

SEQ ID NO: 2164809 - DNA, 17 bp, Homo sapiens
gtctacatttctgcaga

SEQ ID NO: 2164810 - DNA, 11 bp, Homo sapiens
gtctcagaaga

SEQ ID NO: 2164811 - DNA, 23 bp, Homo sapiens
gtgatttcagactgcagagggga

SEQ ID NO: 2164812 - DNA, 13 bp, Homo sapiens
gtgccactgcggg

SEQ ID NO: 2164813 - DNA, 19 bp, Homo sapiens
gtgccactgcgggagctct

SEQ ID NO: 2164814 - DNA, 21 bp, Homo sapiens
gtgccatttctgaactgttac

SEQ ID NO: 2164815 - DNA, 18 bp, Homo sapiens
gtgctactccatgcaggg

SEQ ID NO: 2164816 - DNA, 17 bp, Homo sapiens
gtgggaactcactttcc

SEQ ID NO: 2164817 - DNA, 15 bp, Homo sapiens
gtggtcagagtgcca

SEQ ID NO: 2164818 - DNA, 17 bp, Homo sapiens
gtgtcctctccctgcca

SEQ ID NO: 2164819 - DNA, 18 bp, Homo sapiens
gttaactgtgaaatacca

SEQ ID NO: 2164820 - DNA, 16 bp, Homo sapiens
gttaacttggtcagag

SEQ ID NO: 2164821 - DNA, 14 bp, Homo sapiens
gttggacttcagtc

SEQ ID NO: 2164822 - DNA, 22 bp, Homo sapiens
gtttaaacacttatcttctgga

SEQ ID NO: 2164823 - DNA, 21 bp, Homo sapiens
taaatgcctcttaaattatat

SEQ ID NO: 2164824 - DNA, 13 bp, Homo sapiens
taaattatatatt

SEQ ID NO: 2164825 - DNA, 21 bp, Homo sapiens
taaattccatatgctccagga

SEQ ID NO: 2164826 - DNA, 19 bp, Homo sapiens
taacaataatatttcaagt

SEQ ID NO: 2164827 - DNA, 24 bp, Homo sapiens
taacaataatatttcaagtgccta

SEQ ID NO: 2164828 - DNA, 15 bp, Homo sapiens
taacaatctaacaat

SEQ ID NO: 2164829 - DNA, 19 bp, Homo sapiens
taactcctgccattcttct

SEQ ID NO: 2164830 - DNA, 21 bp, Homo sapiens
taacttggtcagagccactct

SEQ ID NO: 2164831 - DNA, 22 bp, Homo sapiens
accttcccttctacaaggactc

SEQ ID NO: 2164832 - DNA, 18 bp, Homo sapiens
acgtttcttctttctaga

SEQ ID NO: 2164833 - DNA, 22 bp, Homo sapiens
actcgttcacctccaagcattt

SEQ ID NO: 2164834 - DNA, 22 bp, Homo sapiens
actctcaccatgatgtgaagag

SEQ ID NO: 2164835 - DNA, 13 bp, Homo sapiens
actgccaggctgt

SEQ ID NO: 2164836 - DNA, 23 bp, Homo sapiens
actgtcagttctctgggaagtgg

SEQ ID NO: 2164837 - DNA, 15 bp, Homo sapiens
acttaactttaactt

SEQ ID NO: 2164838 - DNA, 15 bp, Homo sapiens
actttgtgttcattt

SEQ ID NO: 2164839 - DNA, 18 bp, Homo sapiens
actttgtgttcatttcat

SEQ ID NO: 2164840 - DNA, 13 bp, Homo sapiens
acttttgaaaaga

SEQ ID NO: 2164841 - DNA, 22 bp, Homo sapiens
acttttgaaaagaccaagactt

SEQ ID NO: 2164842 - DNA, 14 bp, Homo sapiens
agaagaatggcttt

SEQ ID NO: 2164843 - DNA, 18 bp, Homo sapiens
agaagaatggctttcaat

SEQ ID NO: 2164844 - DNA, 14 bp, Homo sapiens
agaataaaattcct

SEQ ID NO: 2164845 - DNA, 15 bp, Homo sapiens
agaataaaattccta

SEQ ID NO: 2164846 - DNA, 18 bp, Homo sapiens
agaataaaattcctatct

SEQ ID NO: 2164847 - DNA, 19 bp, Homo sapiens
agaataaaattcctatctc

SEQ ID NO: 2164848 - DNA, 15 bp, Homo sapiens
agacaaggtgctaac

SEQ ID NO: 2164849 - DNA, 14 bp, Homo sapiens
agacattctcacat

SEQ ID NO: 2164850 - DNA, 14 bp, Homo sapiens
agaccctccccaca

SEQ ID NO: 2164851 - DNA, 21 bp, Homo sapiens
agaccctccccacagtgccac

SEQ ID NO: 2164852 - DNA, 10 bp, Homo sapiens
agagaaactt

SEQ ID NO: 2164853 - DNA, 18 bp, Homo sapiens
agagcaaaagcctcagaa

SEQ ID NO: 2164854 - DNA, 16 bp, Homo sapiens
agagttccttctcact

SEQ ID NO: 2164855 - DNA, 18 bp, Homo sapiens
agcatttcatgaaaaagc

SEQ ID NO: 2164856 - DNA, 14 bp, Homo sapiens
agccccctcttcct

SEQ ID NO: 2164857 - DNA, 21 bp, Homo sapiens
agcccgaacaccattgaggga

SEQ ID NO: 2164858 - DNA, 15 bp, Homo sapiens
agcttcaacttttct

SEQ ID NO: 2164859 - DNA, 18 bp, Homo sapiens
agctttctcaatgtcttc

SEQ ID NO: 2164860 - DNA, 21 bp, Homo sapiens
agctttctcaatgtcttccca

SEQ ID NO: 2164861 - DNA, 19 bp, Homo sapiens
aggaaggccaaaatcaaga

SEQ ID NO: 2164862 - DNA, 15 bp, Homo sapiens
aggagctttctcaat

SEQ ID NO: 2164863 - DNA, 19 bp, Homo sapiens
aggagctttctcaatgtct

SEQ ID NO: 2164864 - DNA, 14 bp, Homo sapiens
aggcatgtggcctt

SEQ ID NO: 2164865 - DNA, 19 bp, Homo sapiens
aggcgtcaccatccacctt

SEQ ID NO: 2164866 - DNA, 18 bp, Homo sapiens
aggctcagtggtgggaga

SEQ ID NO: 2164867 - DNA, 21 bp, Homo sapiens
agggaatgagagttccttctc

SEQ ID NO: 2164868 - DNA, 18 bp, Homo sapiens
agggactgccaggctgtt

SEQ ID NO: 2164869 - DNA, 16 bp, Homo sapiens
aggtgctaacatagat

SEQ ID NO: 2164870 - DNA, 18 bp, Homo sapiens
agtcccatttttctcttg

SEQ ID NO: 2164871 - DNA, 22 bp, Homo sapiens
agtgccacccatgcagctgctc

SEQ ID NO: 2164872 - DNA, 14 bp, Homo sapiens
agtggatggaatat

SEQ ID NO: 2164873 - DNA, 15 bp, Homo sapiens
agttctctttggaaa

SEQ ID NO: 2164874 - DNA, 16 bp, Homo sapiens
agttctctttggaaat

SEQ ID NO: 2164875 - DNA, 17 bp, Homo sapiens
agttctctttggaaata

SEQ ID NO: 2164876 - DNA, 15 bp, Homo sapiens
agttggccaagcaga

SEQ ID NO: 2164877 - DNA, 20 bp, Homo sapiens
agtttcacaaatccttcaaa

SEQ ID NO: 2164878 - DNA, 17 bp, Homo sapiens
ataaacatgtgccctca

SEQ ID NO: 2164879 - DNA, 15 bp, Homo sapiens
atacaaactctcacc

SEQ ID NO: 2164880 - DNA, 16 bp, Homo sapiens
atagacattctcacat

SEQ ID NO: 2164881 - DNA, 20 bp, Homo sapiens
atatctgtacagatcaagaa

SEQ ID NO: 2164882 - DNA, 13 bp, Homo sapiens
atatggtggaaaa

SEQ ID NO: 2164883 - DNA, 16 bp, Homo sapiens
atcaagaaaaaaaggg

SEQ ID NO: 2164884 - DNA, 21 bp, Homo sapiens
atcaagaaaaaaagggagaat

SEQ ID NO: 2164885 - DNA, 16 bp, Homo sapiens
atcaagagaaacttca

SEQ ID NO: 2164886 - DNA, 17 bp, Homo sapiens
atcagaagtatatctgt

SEQ ID NO: 2164887 - DNA, 15 bp, Homo sapiens
atcatacaaactctc

SEQ ID NO: 2164888 - DNA, 20 bp, Homo sapiens
atccatctcctggtgttctg

SEQ ID NO: 2164889 - DNA, 15 bp, Homo sapiens
atcctgcagggcttc

SEQ ID NO: 2164890 - DNA, 19 bp, Homo sapiens
atcctgcagggcttctcct

SEQ ID NO: 2164891 - DNA, 20 bp, Homo sapiens
atccttcaaaataaaaagta

SEQ ID NO: 2164892 - DNA, 13 bp, Homo sapiens
atctcctggtgtt

SEQ ID NO: 2164893 - DNA, 17 bp, Homo sapiens
atctgcaagaacactgg

SEQ ID NO: 2164894 - DNA, 15 bp, Homo sapiens
atgacaggctgttca

SEQ ID NO: 2164895 - DNA, 17 bp, Homo sapiens
atgacaggctgttcagc

SEQ ID NO: 2164896 - DNA, 15 bp, Homo sapiens
atgacttagaaactg

SEQ ID NO: 2164897 - DNA, 17 bp, Homo sapiens
atgagagttccttctca

SEQ ID NO: 2164898 - DNA, 19 bp, Homo sapiens
atgagagttccttctcact

SEQ ID NO: 2164899 - DNA, 14 bp, Homo sapiens
atggaatatcagaa

SEQ ID NO: 2164900 - DNA, 15 bp, Homo sapiens
atggaatatcagaag

SEQ ID NO: 2164901 - DNA, 21 bp, Homo sapiens
atgtgtatttttcaaggcatt

SEQ ID NO: 2164902 - DNA, 14 bp, Homo sapiens
attaacggtgctaa

SEQ ID NO: 2164903 - DNA, 15 bp, Homo sapiens
attaacggtgctaaa

SEQ ID NO: 2164904 - DNA, 16 bp, Homo sapiens
attaatcatacaaact

SEQ ID NO: 2164905 - DNA, 20 bp, Homo sapiens
attaatcatacaaactctca

SEQ ID NO: 2164906 - DNA, 21 bp, Homo sapiens
attaatcatacaaactctcac

SEQ ID NO: 2164907 - DNA, 14 bp, Homo sapiens
attactgtcccctt

SEQ ID NO: 2164908 - DNA, 11 bp, Homo sapiens
attaggctgtt

SEQ ID NO: 2164909 - DNA, 22 bp, Homo sapiens
attgggtgaatatggtggaaaa

SEQ ID NO: 2164910 - DNA, 15 bp, Homo sapiens
attggtaattacctg

SEQ ID NO: 2164911 - DNA, 12 bp, Homo sapiens
atttattgccat

SEQ ID NO: 2164912 - DNA, 11 bp, Homo sapiens
atttcctcctt

SEQ ID NO: 2164913 - DNA, 16 bp, Homo sapiens
caaaggagctttctca

SEQ ID NO: 2164914 - DNA, 22 bp, Homo sapiens
caaaggagctttctcaatgtct

SEQ ID NO: 2164915 - DNA, 14 bp, Homo sapiens
caaatccttcaaaa

SEQ ID NO: 2164916 - DNA, 15 bp, Homo sapiens
caagaaaaaaaggga

SEQ ID NO: 2164917 - DNA, 16 bp, Homo sapiens
caagaacactggacct

SEQ ID NO: 2164918 - DNA, 22 bp, Homo sapiens
caagagtgagatgtagaaagtt

SEQ ID NO: 2164919 - DNA, 16 bp, Homo sapiens
caagcatttcatgaaa

SEQ ID NO: 2164920 - DNA, 20 bp, Homo sapiens
caagcatttcatgaaaaagc

SEQ ID NO: 2164921 - DNA, 14 bp, Homo sapiens
caaggtgctaacat

SEQ ID NO: 2164922 - DNA, 15 bp, Homo sapiens
caatattctgtaact

SEQ ID NO: 2164923 - DNA, 14 bp, Homo sapiens
caatgtcttcccac

SEQ ID NO: 2164924 - DNA, 16 bp, Homo sapiens
cacaaatccttcaaaa

SEQ ID NO: 2164925 - DNA, 20 bp, Homo sapiens
cacacgatgttgtcaaggat

SEQ ID NO: 2164926 - DNA, 14 bp, Homo sapiens
cacccatgcagctg

SEQ ID NO: 2164927 - DNA, 15 bp, Homo sapiens
caccccgctgatgga

SEQ ID NO: 2164928 - DNA, 22 bp, Homo sapiens
cacctccaagcatttcatgaaa

SEQ ID NO: 2164929 - DNA, 21 bp, Homo sapiens
caccttcccttctacaaggac

SEQ ID NO: 2164930 - DNA, 18 bp, Homo sapiens
caccttgacgtttcttct

SEQ ID NO: 2164931 - DNA, 13 bp, Homo sapiens
caccttgtctgct

SEQ ID NO: 2164932 - DNA, 15 bp, Homo sapiens
cctcttcctccctgg

SEQ ID NO: 2164933 - DNA, 17 bp, Homo sapiens
cctcttcctccctgggg

SEQ ID NO: 2164934 - DNA, 18 bp, Homo sapiens
ccttctacaaggactcca

SEQ ID NO: 2164935 - DNA, 21 bp, Homo sapiens
cctttgggttctttctggggg

SEQ ID NO: 2164936 - DNA, 15 bp, Homo sapiens
cgatgttgtcaagga

SEQ ID NO: 2164937 - DNA, 23 bp, Homo sapiens
cgccagctgccgcaccagcccga

SEQ ID NO: 2164938 - DNA, 15 bp, Homo sapiens
cgctgatggagcccc

SEQ ID NO: 2164939 - DNA, 20 bp, Homo sapiens
cgctgatggagccccacctt

SEQ ID NO: 2164940 - DNA, 19 bp, Homo sapiens
cggtgctaaaaatgaaaat

SEQ ID NO: 2164941 - DNA, 21 bp, Homo sapiens
cgtggtttgcctgaggctgta

SEQ ID NO: 2164942 - DNA, 22 bp, Homo sapiens
cgttcacctccaagcatttcat

SEQ ID NO: 2164943 - DNA, 15 bp, Homo sapiens
ctaaaaatgaaaatt

SEQ ID NO: 2164944 - DNA, 17 bp, Homo sapiens
ctaaataaacatgtgcc

SEQ ID NO: 2164945 - DNA, 21 bp, Homo sapiens
ctacaaggactccattggatc

SEQ ID NO: 2164946 - DNA, 18 bp, Homo sapiens
ctattaatcaagagaaac

SEQ ID NO: 2164947 - DNA, 19 bp, Homo sapiens
ctcaaaggagctttctcaa

SEQ ID NO: 2164948 - DNA, 14 bp, Homo sapiens
ctcacaggctgaga

SEQ ID NO: 2164949 - DNA, 13 bp, Homo sapiens
ctcacataagccc

SEQ ID NO: 2164950 - DNA, 19 bp, Homo sapiens
ctcaccatgatgtgaagag

SEQ ID NO: 2164951 - DNA, 19 bp, Homo sapiens
ctccaagcatttcatgaaa

SEQ ID NO: 2164952 - DNA, 14 bp, Homo sapiens
ctccccacagtgcc

SEQ ID NO: 2164953 - DNA, 14 bp, Homo sapiens
ctccccaggccacc

SEQ ID NO: 2164954 - DNA, 15 bp, Homo sapiens
ctccccaggccaccc

SEQ ID NO: 2164955 - DNA, 21 bp, Homo sapiens
ctcctggcgagttctctttgg

SEQ ID NO: 2164956 - DNA, 22 bp, Homo sapiens
ctctcaccatgatgtgaagagt

SEQ ID NO: 2164957 - DNA, 21 bp, Homo sapiens
ctcttgccatttgtagctttg

SEQ ID NO: 2164958 - DNA, 18 bp, Homo sapiens
ctctttagtgttctgttt

SEQ ID NO: 2164959 - DNA, 16 bp, Homo sapiens
ctgatggagccccacc

SEQ ID NO: 2164960 - DNA, 16 bp, Homo sapiens
ctgcagggcttctcct

SEQ ID NO: 2164961 - DNA, 13 bp, Homo sapiens
ctgccaggctgtt

SEQ ID NO: 2164962 - DNA, 14 bp, Homo sapiens
ctgccgcaccagcc

SEQ ID NO: 2164963 - DNA, 19 bp, Homo sapiens
ctgggagaccctccccaca

SEQ ID NO: 2164964 - DNA, 14 bp, Homo sapiens
ctggggctgtgtta

SEQ ID NO: 2164965 - DNA, 14 bp, Homo sapiens
ctgggggccccagg

SEQ ID NO: 2164966 - DNA, 18 bp, Homo sapiens
ctggggggatatttccta

SEQ ID NO: 2164967 - DNA, 15 bp, Homo sapiens
ctgtgttatgaaaat

SEQ ID NO: 2164968 - DNA, 16 bp, Homo sapiens
cttcaacttttctctt

SEQ ID NO: 2164969 - DNA, 16 bp, Homo sapiens
cttctattaatcaaga

SEQ ID NO: 2164970 - DNA, 18 bp, Homo sapiens
cttctattaatcaagaga

SEQ ID NO: 2164971 - DNA, 14 bp, Homo sapiens
cttctctcagatgg

SEQ ID NO: 2164972 - DNA, 21 bp, Homo sapiens
cttgacgtttcttctttctag

SEQ ID NO: 2164973 - DNA, 15 bp, Homo sapiens
ctttagtgttctgtt

SEQ ID NO: 2164974 - DNA, 23 bp, Homo sapiens
ctttagtgttctgtttgaaacta

SEQ ID NO: 2164975 - DNA, 16 bp, Homo sapiens
ctttggaaatagcatg

SEQ ID NO: 2164976 - DNA, 14 bp, Homo sapiens
ctttgtgttcattt

SEQ ID NO: 2164977 - DNA, 19 bp, Homo sapiens
cttttcacattaggctgtt

SEQ ID NO: 2164978 - DNA, 23 bp, Homo sapiens
cttttggagaaccagggctcttc

SEQ ID NO: 2164979 - DNA, 12 bp, Homo sapiens
gaagaatggctt

SEQ ID NO: 2164980 - DNA, 15 bp, Homo sapiens
gaagaatggctttca

SEQ ID NO: 2164981 - DNA, 17 bp, Homo sapiens
gaagaatggctttcaat

SEQ ID NO: 2164982 - DNA, 15 bp, Homo sapiens
gaagatgaatggtct

SEQ ID NO: 2164983 - DNA, 15 bp, Homo sapiens
gaagtaacagacaca

SEQ ID NO: 2164984 - DNA, 14 bp, Homo sapiens
gaataaaattccta

SEQ ID NO: 2164985 - DNA, 17 bp, Homo sapiens
gaatatggtggaaaata

SEQ ID NO: 2164986 - DNA, 17 bp, Homo sapiens
gaatgagagttccttct

SEQ ID NO: 2164987 - DNA, 13 bp, Homo sapiens
gaatggctttcaa

SEQ ID NO: 2164988 - DNA, 22 bp, Homo sapiens
gaatggtctggcaatattctgt

SEQ ID NO: 2164989 - DNA, 23 bp, Homo sapiens
gacattcttagctgtaacttaac

SEQ ID NO: 2164990 - DNA, 21 bp, Homo sapiens
gaccctccccacagtgccacc

SEQ ID NO: 2164991 - DNA, 20 bp, Homo sapiens
gacctttgggttctttctgg

SEQ ID NO: 2164992 - DNA, 13 bp, Homo sapiens
gactgtcagttct

SEQ ID NO: 2164993 - DNA, 15 bp, Homo sapiens
gacttaactttaact

SEQ ID NO: 2164994 - DNA, 19 bp, Homo sapiens
gactttgtgttcatttcat

SEQ ID NO: 2164995 - DNA, 20 bp, Homo sapiens
gacttttgtctgatcaagtg

SEQ ID NO: 2164996 - DNA, 21 bp, Homo sapiens
gagaactcgttcacctccaag

SEQ ID NO: 2164997 - DNA, 20 bp, Homo sapiens
gagcagttggccaagcagaa

SEQ ID NO: 2164998 - DNA, 11 bp, Homo sapiens
gagccccacct

SEQ ID NO: 2164999 - DNA, 18 bp, Homo sapiens
gagctttctcaatgtctt

SEQ ID NO: 2165000 - DNA, 21 bp, Homo sapiens
gaggctgtaactgagagaaag

SEQ ID NO: 2165001 - DNA, 17 bp, Homo sapiens
gatatttcctaaggcat

SEQ ID NO: 2165002 - DNA, 20 bp, Homo sapiens
gatcaagaaaaaaagggaga

SEQ ID NO: 2165003 - DNA, 19 bp, Homo sapiens
gatctgctgggctctgcct

SEQ ID NO: 2165004 - DNA, 15 bp, Homo sapiens
gatggagccccacct

SEQ ID NO: 2165005 - DNA, 23 bp, Homo sapiens
gatggagccccaccttgtctgct

SEQ ID NO: 2165006 - DNA, 13 bp, Homo sapiens
gatgtagaaagtt

SEQ ID NO: 2165007 - DNA, 21 bp, Homo sapiens
gcaatattctgtaactattgg

SEQ ID NO: 2165008 - DNA, 19 bp, Homo sapiens
gcaccagcccgaacaccat

SEQ ID NO: 2165009 - DNA, 19 bp, Homo sapiens
gcagaacccaccaaccaga

SEQ ID NO: 2165010 - DNA, 19 bp, Homo sapiens
gcagttggccaagcagaaa

SEQ ID NO: 2165011 - DNA, 23 bp, Homo sapiens
gcatgttcctccttttcttcacc

SEQ ID NO: 2165012 - DNA, 22 bp, Homo sapiens
gcatttcatgaaaaagctgctt

SEQ ID NO: 2165013 - DNA, 14 bp, Homo sapiens
gccagctgccgcac

SEQ ID NO: 2165014 - DNA, 12 bp, Homo sapiens
gccgcaccagcc

SEQ ID NO: 2165015 - DNA, 16 bp, Homo sapiens
gccgccagctgccgca

SEQ ID NO: 2165016 - DNA, 17 bp, Homo sapiens
gccgccagctgccgcac

SEQ ID NO: 2165017 - DNA, 13 bp, Homo sapiens
gcctgtgggcttc

SEQ ID NO: 2165018 - DNA, 13 bp, Homo sapiens
gctgggagaccct

SEQ ID NO: 2165019 - DNA, 20 bp, Homo sapiens
gctgggagaccctccccaca

SEQ ID NO: 2165020 - DNA, 13 bp, Homo sapiens
gctttctcaatgt

SEQ ID NO: 2165021 - DNA, 20 bp, Homo sapiens
ggagccccaccttgtctgct

SEQ ID NO: 2165022 - DNA, 19 bp, Homo sapiens
ggagctttctcaatgtctt

SEQ ID NO: 2165023 - DNA, 11 bp, Homo sapiens
ggatctcacag

SEQ ID NO: 2165024 - DNA, 23 bp, Homo sapiens
ggattgctttgcattactgtccc

SEQ ID NO: 2165025 - DNA, 21 bp, Homo sapiens
ggcatgtggcctttatctcaa

SEQ ID NO: 2165026 - DNA, 13 bp, Homo sapiens
ggccaagcagaaa

SEQ ID NO: 2165027 - DNA, 20 bp, Homo sapiens
ggccaagcagaaaaaaaagt

SEQ ID NO: 2165028 - DNA, 17 bp, Homo sapiens
ggccacacgctgcacct

SEQ ID NO: 2165029 - DNA, 20 bp, Homo sapiens
ggctgtaactgagagaaaga

SEQ ID NO: 2165030 - DNA, 20 bp, Homo sapiens
ggctgtgttatgaaaatata

SEQ ID NO: 2165031 - DNA, 14 bp, Homo sapiens
ggcttctcctcctc

SEQ ID NO: 2165032 - DNA, 20 bp, Homo sapiens
gggagcacggactgtcagtt

SEQ ID NO: 2165033 - DNA, 13 bp, Homo sapiens
gggatatttccta

SEQ ID NO: 2165034 - DNA, 22 bp, Homo sapiens
gggctcttctcaggggctctag

SEQ ID NO: 2165035 - DNA, 14 bp, Homo sapiens
gtaactgagagaaa

SEQ ID NO: 2165036 - DNA, 15 bp, Homo sapiens
gtaactgagagaaag

SEQ ID NO: 2165037 - DNA, 22 bp, Homo sapiens
gtgaatacattaacggtgctaa

SEQ ID NO: 2165038 - DNA, 19 bp, Homo sapiens
gtgtctcaaaggagctttc

SEQ ID NO: 2165039 - DNA, 14 bp, Homo sapiens
gttctctttggaaa

SEQ ID NO: 2165040 - DNA, 15 bp, Homo sapiens
gttctctttggaaat

SEQ ID NO: 2165041 - DNA, 12 bp, Homo sapiens
gttctttctggg

SEQ ID NO: 2165042 - DNA, 17 bp, Homo sapiens
gttgtaaaatagaaaaa

SEQ ID NO: 2165043 - DNA, 18 bp, Homo sapiens
taactattgggtgaatat

SEQ ID NO: 2165044 - DNA, 22 bp, Homo sapiens
taatcaagagaaacttcaaagt

SEQ ID NO: 2165045 - DNA, 14 bp, Homo sapiens
taatcatacaaact

SEQ ID NO: 2165046 - DNA, 14 bp, Homo sapiens
taatgacttagaaa

SEQ ID NO: 2165047 - DNA, 13 bp, Homo sapiens
tacagatcaagaa

SEQ ID NO: 2165048 - DNA, 14 bp, Homo sapiens
tacattaacggtgc

SEQ ID NO: 2165049 - DNA, 18 bp, Homo sapiens
tactatggtgtgttgtat

SEQ ID NO: 2165050 - DNA, 15 bp, Homo sapiens
tagacattctcacat

SEQ ID NO: 2165051 - DNA, 21 bp, Homo sapiens
tagaggctcagtggtgggaga

SEQ ID NO: 2165052 - DNA, 14 bp, Homo sapiens
atttttcaaggcat

SEQ ID NO: 2165053 - DNA, 13 bp, Homo sapiens
caaaatcaagagt

SEQ ID NO: 2165054 - DNA, 19 bp, Homo sapiens
caaagttaatgggatggtc

SEQ ID NO: 2165055 - DNA, 22 bp, Homo sapiens
caacggaagccccctcttcctc

SEQ ID NO: 2165056 - DNA, 12 bp, Homo sapiens
caagcagaaaaa

SEQ ID NO: 2165057 - DNA, 12 bp, Homo sapiens
caagcatttcat

SEQ ID NO: 2165058 - DNA, 11 bp, Homo sapiens
caaggtgctaa

SEQ ID NO: 2165059 - DNA, 16 bp, Homo sapiens
caattaagaaattcca

SEQ ID NO: 2165060 - DNA, 22 bp, Homo sapiens
cacaggtgccgccagctgccgc

SEQ ID NO: 2165061 - DNA, 23 bp, Homo sapiens
cacaggtgccgccagctgccgca

SEQ ID NO: 2165062 - DNA, 17 bp, Homo sapiens
cacagtaccggattctc

SEQ ID NO: 2165063 - DNA, 18 bp, Homo sapiens
cacagtaccggattctct

SEQ ID NO: 2165064 - DNA, 19 bp, Homo sapiens
cacataagcccagttcatc

SEQ ID NO: 2165065 - DNA, 18 bp, Homo sapiens
caccatgatgtgaagagt

SEQ ID NO: 2165066 - DNA, 17 bp, Homo sapiens
cacccatgcagctgctc

SEQ ID NO: 2165067 - DNA, 13 bp, Homo sapiens
caccttcccttct

SEQ ID NO: 2165068 - DNA, 23 bp, Homo sapiens
caccttgacgtttcttctttcta

SEQ ID NO: 2165069 - DNA, 14 bp, Homo sapiens
cagaaaaaaaagtg

SEQ ID NO: 2165070 - DNA, 22 bp, Homo sapiens
cagaaaaaaaagtgtctcaaag

SEQ ID NO: 2165071 - DNA, 13 bp, Homo sapiens
cagaccactgtct

SEQ ID NO: 2165072 - DNA, 15 bp, Homo sapiens
cagaccactgtctcc

SEQ ID NO: 2165073 - DNA, 20 bp, Homo sapiens
cagatgggaacagtaaagaa

SEQ ID NO: 2165074 - DNA, 16 bp, Homo sapiens
cagcgcatcctgcagg

SEQ ID NO: 2165075 - DNA, 18 bp, Homo sapiens
caggccaccccgctgatg

SEQ ID NO: 2165076 - DNA, 22 bp, Homo sapiens
cagggtcttggctgcctgtggg

SEQ ID NO: 2165077 - DNA, 16 bp, Homo sapiens
caggtgccgccagctg

SEQ ID NO: 2165078 - DNA, 22 bp, Homo sapiens
caggtgccgccagctgccgcac

SEQ ID NO: 2165079 - DNA, 22 bp, Homo sapiens
cagtgcagtttcttttcacatt

SEQ ID NO: 2165080 - DNA, 14 bp, Homo sapiens
cagtgccacccatg

SEQ ID NO: 2165081 - DNA, 23 bp, Homo sapiens
cagtttcttttcacattaggctg

SEQ ID NO: 2165082 - DNA, 17 bp, Homo sapiens
catacaaactctcacca

SEQ ID NO: 2165083 - DNA, 23 bp, Homo sapiens
catattaaaatctgatgtaacaa

SEQ ID NO: 2165084 - DNA, 14 bp, Homo sapiens
catccaccttccct

SEQ ID NO: 2165085 - DNA, 14 bp, Homo sapiens
catgaaaaagctgc

SEQ ID NO: 2165086 - DNA, 21 bp, Homo sapiens
catgatgtgaagagtttcaca

SEQ ID NO: 2165087 - DNA, 17 bp, Homo sapiens
catgtggcctttatctc

SEQ ID NO: 2165088 - DNA, 23 bp, Homo sapiens
catgtggcctttatctcaacgga

SEQ ID NO: 2165089 - DNA, 15 bp, Homo sapiens
cattaacggtgctaa

SEQ ID NO: 2165090 - DNA, 13 bp, Homo sapiens
cattactgtcccc

SEQ ID NO: 2165091 - DNA, 13 bp, Homo sapiens
cattgcagcttca

SEQ ID NO: 2165092 - DNA, 14 bp, Homo sapiens
catttcatgaaaaa

SEQ ID NO: 2165093 - DNA, 23 bp, Homo sapiens
catttcatgaaaaagctgcttct

SEQ ID NO: 2165094 - DNA, 13 bp, Homo sapiens
ccaagcatttcat

SEQ ID NO: 2165095 - DNA, 16 bp, Homo sapiens
ccacagtgccacccat

SEQ ID NO: 2165096 - DNA, 16 bp, Homo sapiens
ccacccatgcagctgc

SEQ ID NO: 2165097 - DNA, 23 bp, Homo sapiens
ccacccatgcagctgctccccag

SEQ ID NO: 2165098 - DNA, 21 bp, Homo sapiens
ccagaacgtggtttgcctgag

SEQ ID NO: 2165099 - DNA, 17 bp, Homo sapiens
ccagcccgaacaccatt

SEQ ID NO: 2165100 - DNA, 15 bp, Homo sapiens
ccagctgccgcacca

SEQ ID NO: 2165101 - DNA, 15 bp, Homo sapiens
ccagggctcttctca

SEQ ID NO: 2165102 - DNA, 16 bp, Homo sapiens
ccatgcagctgctccc

SEQ ID NO: 2165103 - DNA, 14 bp, Homo sapiens
ccatttttctcttg

SEQ ID NO: 2165104 - DNA, 14 bp, Homo sapiens
cccacagtgccacc

SEQ ID NO: 2165105 - DNA, 15 bp, Homo sapiens
cccacagtgccaccc

SEQ ID NO: 2165106 - DNA, 13 bp, Homo sapiens
cccagaccactgt

SEQ ID NO: 2165107 - DNA, 15 bp, Homo sapiens
cccatgcagctgctc

SEQ ID NO: 2165108 - DNA, 19 bp, Homo sapiens
cccatgcagctgctcccca

SEQ ID NO: 2165109 - DNA, 16 bp, Homo sapiens
ccccacagtgccaccc

SEQ ID NO: 2165110 - DNA, 17 bp, Homo sapiens
ccccgctgatggagccc

SEQ ID NO: 2165111 - DNA, 20 bp, Homo sapiens
ccccgctgatggagccccac

SEQ ID NO: 2165112 - DNA, 21 bp, Homo sapiens
ccctattctatccatctcctg

SEQ ID NO: 2165113 - DNA, 19 bp, Homo sapiens
ccctccccacagtgccacc

SEQ ID NO: 2165114 - DNA, 23 bp, Homo sapiens
ccctccccacagtgccacccatg

SEQ ID NO: 2165115 - DNA, 22 bp, Homo sapiens
ccctccccttcgtgtttccccc

SEQ ID NO: 2165116 - DNA, 23 bp, Homo sapiens
ccgaagggaattaaaaagaagat

SEQ ID NO: 2165117 - DNA, 15 bp, Homo sapiens
ccgccagctgccgca

SEQ ID NO: 2165118 - DNA, 21 bp, Homo sapiens
cctattctatccatctcctgg

SEQ ID NO: 2165119 - DNA, 14 bp, Homo sapiens
cctccaagcatttc

SEQ ID NO: 2165120 - DNA, 18 bp, Homo sapiens
cctccaagcatttcatga

SEQ ID NO: 2165121 - DNA, 18 bp, Homo sapiens
cctggagacaaggtgcta

SEQ ID NO: 2165122 - DNA, 19 bp, Homo sapiens
cctggagacaaggtgctaa

SEQ ID NO: 2165123 - DNA, 14 bp, Homo sapiens
cctggaggtgggca

SEQ ID NO: 2165124 - DNA, 23 bp, Homo sapiens
cctggcgagttctctttggaaat

SEQ ID NO: 2165125 - DNA, 14 bp, Homo sapiens
ccttctacaaggac

SEQ ID NO: 2165126 - DNA, 15 bp, Homo sapiens
ccttctacaaggact

SEQ ID NO: 2165127 - DNA, 17 bp, Homo sapiens
cgagttctctttggaaa

SEQ ID NO: 2165128 - DNA, 20 bp, Homo sapiens
cgccagctgccgcaccagcc

SEQ ID NO: 2165129 - DNA, 16 bp, Homo sapiens
cgctgatggagcccca

SEQ ID NO: 2165130 - DNA, 18 bp, Homo sapiens
cgctgatggagccccacc

SEQ ID NO: 2165131 - DNA, 19 bp, Homo sapiens
cgtcaccatccaccttccc

SEQ ID NO: 2165132 - DNA, 15 bp, Homo sapiens
ctatccatctcctgg

SEQ ID NO: 2165133 - DNA, 13 bp, Homo sapiens
ctattaatcaaga

SEQ ID NO: 2165134 - DNA, 14 bp, Homo sapiens
ctattaatcaagag

SEQ ID NO: 2165135 - DNA, 21 bp, Homo sapiens
ctattctatccatctcctggt

SEQ ID NO: 2165136 - DNA, 22 bp, Homo sapiens
ctcaacggaagccccctcttcc

SEQ ID NO: 2165137 - DNA, 17 bp, Homo sapiens
ctccccacagtgccacc

SEQ ID NO: 2165138 - DNA, 18 bp, Homo sapiens
ctccccacagtgccaccc

SEQ ID NO: 2165139 - DNA, 22 bp, Homo sapiens
ctccccaggccaccccgctgat

SEQ ID NO: 2165140 - DNA, 20 bp, Homo sapiens
ctccccttttttcttctatt

SEQ ID NO: 2165141 - DNA, 21 bp, Homo sapiens
ctctagggactgccaggctgt

SEQ ID NO: 2165142 - DNA, 21 bp, Homo sapiens
ctctgtcttttggagaaccag

SEQ ID NO: 2165143 - DNA, 12 bp, Homo sapiens
ctgatggagccc

SEQ ID NO: 2165144 - DNA, 18 bp, Homo sapiens
ctgatggagccccacctt

SEQ ID NO: 2165145 - DNA, 16 bp, Homo sapiens
ctgcagtcatctcccc

SEQ ID NO: 2165146 - DNA, 23 bp, Homo sapiens
ctgcagtcatctcccctcctggc

SEQ ID NO: 2165147 - DNA, 15 bp, Homo sapiens
ctgccaggctgtttc

SEQ ID NO: 2165148 - DNA, 20 bp, Homo sapiens
ctgcctggagacaaggtgct

SEQ ID NO: 2165149 - DNA, 23 bp, Homo sapiens
ctgcctggagacaaggtgctaac

SEQ ID NO: 2165150 - DNA, 15 bp, Homo sapiens
ctgctaaataaacat

SEQ ID NO: 2165151 - DNA, 19 bp, Homo sapiens
ctggacctttgggttcttt

SEQ ID NO: 2165152 - DNA, 16 bp, Homo sapiens
ctggagacaaggtgct

SEQ ID NO: 2165153 - DNA, 16 bp, Homo sapiens
ctgtacagatcaagaa

SEQ ID NO: 2165154 - DNA, 16 bp, Homo sapiens
ctgtgttatgaaaata

SEQ ID NO: 2165155 - DNA, 15 bp, Homo sapiens
ctgttggttcaaact

SEQ ID NO: 2165156 - DNA, 18 bp, Homo sapiens
cttcaacttttctcttta

SEQ ID NO: 2165157 - DNA, 19 bp, Homo sapiens
cttctattaatcaagagaa

SEQ ID NO: 2165158 - DNA, 23 bp, Homo sapiens
cttctattaatcaagagaaactt

SEQ ID NO: 2165159 - DNA, 16 bp, Homo sapiens
cttctttctagagcag

SEQ ID NO: 2165160 - DNA, 15 bp, Homo sapiens
cttgacgtttcttct

SEQ ID NO: 2165161 - DNA, 20 bp, Homo sapiens
cttgacgtttcttctttcta

SEQ ID NO: 2165162 - DNA, 17 bp, Homo sapiens
cttgatataaaaaatct

SEQ ID NO: 2165163 - DNA, 16 bp, Homo sapiens
ctttatctcaacggaa

SEQ ID NO: 2165164 - DNA, 17 bp, Homo sapiens
ctttcagtgcagtttct

SEQ ID NO: 2165165 - DNA, 21 bp, Homo sapiens
ctttctagagcagttggccaa

SEQ ID NO: 2165166 - DNA, 17 bp, Homo sapiens
ctttctcaatgtcttcc

SEQ ID NO: 2165167 - DNA, 22 bp, Homo sapiens
ctttctggggggatatttccta

SEQ ID NO: 2165168 - DNA, 16 bp, Homo sapiens
ctttgtgttcatttca

SEQ ID NO: 2165169 - DNA, 18 bp, Homo sapiens
ctttgtgttcatttcatt

SEQ ID NO: 2165170 - DNA, 20 bp, Homo sapiens
cttttcacattaggctgttg

SEQ ID NO: 2165171 - DNA, 23 bp, Homo sapiens
aaaaagtaatgacttagaaactg

SEQ ID NO: 2165172 - DNA, 21 bp, Homo sapiens
aaaagtaatgacttagaaact

SEQ ID NO: 2165173 - DNA, 15 bp, Homo sapiens
aaaagtgtctcaaag

SEQ ID NO: 2165174 - DNA, 10 bp, Homo sapiens
aaaatcaaga

SEQ ID NO: 2165175 - DNA, 16 bp, Homo sapiens
aaaatcaagagtgaga

SEQ ID NO: 2165176 - DNA, 20 bp, Homo sapiens
aaaatgtgtatttttcaagg

SEQ ID NO: 2165177 - DNA, 11 bp, Homo sapiens
aaacacacatt

SEQ ID NO: 2165178 - DNA, 13 bp, Homo sapiens
aaagaaagcagaa

SEQ ID NO: 2165179 - DNA, 15 bp, Homo sapiens
aaagaccaagacttt

SEQ ID NO: 2165180 - DNA, 19 bp, Homo sapiens
aaataaaaagtaatgactt

SEQ ID NO: 2165181 - DNA, 19 bp, Homo sapiens
aaatctttagggaatgaga

SEQ ID NO: 2165182 - DNA, 22 bp, Homo sapiens
aaatggtcccaattaagaaatt

SEQ ID NO: 2165183 - DNA, 19 bp, Homo sapiens
aaatgtttggatggtttgt

SEQ ID NO: 2165184 - DNA, 19 bp, Homo sapiens
aaattccatacttctctca

SEQ ID NO: 2165185 - DNA, 23 bp, Homo sapiens
aacgtggtttgcctgaggctgta

SEQ ID NO: 2165186 - DNA, 15 bp, Homo sapiens
aactattgggtgaat

SEQ ID NO: 2165187 - DNA, 13 bp, Homo sapiens
aactgagagaaag

SEQ ID NO: 2165188 - DNA, 14 bp, Homo sapiens
aactgagagaaaga

SEQ ID NO: 2165189 - DNA, 15 bp, Homo sapiens
aactgagagaaagat

SEQ ID NO: 2165190 - DNA, 15 bp, Homo sapiens
aagaatggctttcaa

SEQ ID NO: 2165191 - DNA, 21 bp, Homo sapiens
aagaccaagacttttgtctga

SEQ ID NO: 2165192 - DNA, 22 bp, Homo sapiens
aagatgaatggtctggcaatat

SEQ ID NO: 2165193 - DNA, 17 bp, Homo sapiens
aaggcatttattgccat

SEQ ID NO: 2165194 - DNA, 16 bp, Homo sapiens
aaggccaaaatcaaga

SEQ ID NO: 2165195 - DNA, 18 bp, Homo sapiens
aaggccaaaatcaagagt

SEQ ID NO: 2165196 - DNA, 13 bp, Homo sapiens
aaggtgctaacat

SEQ ID NO: 2165197 - DNA, 17 bp, Homo sapiens
aatacattaacggtgct

SEQ ID NO: 2165198 - DNA, 12 bp, Homo sapiens
aatagaaaaagt

SEQ ID NO: 2165199 - DNA, 20 bp, Homo sapiens
aatccttcaaaataaaaagt

SEQ ID NO: 2165200 - DNA, 18 bp, Homo sapiens
aatctgatgtaacaaggt

SEQ ID NO: 2165201 - DNA, 18 bp, Homo sapiens
aatgagagttccttctca

SEQ ID NO: 2165202 - DNA, 13 bp, Homo sapiens
aatggtctggcaa

SEQ ID NO: 2165203 - DNA, 15 bp, Homo sapiens
aatgtttggatggtt

SEQ ID NO: 2165204 - DNA, 14 bp, Homo sapiens
aattctaacccaag

SEQ ID NO: 2165205 - DNA, 21 bp, Homo sapiens
aatttagtggatggaatatca

SEQ ID NO: 2165206 - DNA, 20 bp, Homo sapiens
acacattgcagcttcaactt

SEQ ID NO: 2165207 - DNA, 23 bp, Homo sapiens
acacgatgttgtcaaggatggtt

SEQ ID NO: 2165208 - DNA, 16 bp, Homo sapiens
acactggacctttggg

SEQ ID NO: 2165209 - DNA, 17 bp, Homo sapiens
acagtaaagaaagcaga

SEQ ID NO: 2165210 - DNA, 12 bp, Homo sapiens
acagtgccaccc

SEQ ID NO: 2165211 - DNA, 13 bp, Homo sapiens
acattctcacata

SEQ ID NO: 2165212 - DNA, 23 bp, Homo sapiens
accaagacttttgtctgatcaag

SEQ ID NO: 2165213 - DNA, 23 bp, Homo sapiens
accactgtctccacccaccttga

SEQ ID NO: 2165214 - DNA, 14 bp, Homo sapiens
accatccaccttcc

SEQ ID NO: 2165215 - DNA, 18 bp, Homo sapiens
accatccaccttcccttc

SEQ ID NO: 2165216 - DNA, 19 bp, Homo sapiens
accatccaccttcccttct

SEQ ID NO: 2165217 - DNA, 16 bp, Homo sapiens
acccatgcagctgctc

SEQ ID NO: 2165218 - DNA, 18 bp, Homo sapiens
accccgctgatggagccc

SEQ ID NO: 2165219 - DNA, 21 bp, Homo sapiens
accctattctatccatctcct

SEQ ID NO: 2165220 - DNA, 22 bp, Homo sapiens
accctattctatccatctcctg

SEQ ID NO: 2165221 - DNA, 21 bp, Homo sapiens
accctccccacagtgccaccc

SEQ ID NO: 2165222 - DNA, 14 bp, Homo sapiens
accggattctctct

SEQ ID NO: 2165223 - DNA, 21 bp, Homo sapiens
acctaaagcctaccctattct

SEQ ID NO: 2165224 - DNA, 17 bp, Homo sapiens
accttgacgtttcttct

SEQ ID NO: 2165225 - DNA, 12 bp, Homo sapiens
accttgtctgct

SEQ ID NO: 2165226 - DNA, 21 bp, Homo sapiens
accttgtctgctaaataaaca

SEQ ID NO: 2165227 - DNA, 19 bp, Homo sapiens
acctttcagtgcagtttct

SEQ ID NO: 2165228 - DNA, 20 bp, Homo sapiens
acggaagccccctcttcctc

SEQ ID NO: 2165229 - DNA, 14 bp, Homo sapiens
acggatctgctggg

SEQ ID NO: 2165230 - DNA, 17 bp, Homo sapiens
acgtttcttctttctag

SEQ ID NO: 2165231 - DNA, 10 bp, Homo sapiens
actatggtgt

SEQ ID NO: 2165232 - DNA, 21 bp, Homo sapiens
actctcaccatgatgtgaaga

SEQ ID NO: 2165233 - DNA, 17 bp, Homo sapiens
actgccaggctgtttca

SEQ ID NO: 2165234 - DNA, 18 bp, Homo sapiens
actgtcagttctctggga

SEQ ID NO: 2165235 - DNA, 12 bp, Homo sapiens
acttagaaactg

SEQ ID NO: 2165236 - DNA, 19 bp, Homo sapiens
agaagaatggctttcaata

SEQ ID NO: 2165237 - DNA, 16 bp, Homo sapiens
agaatggctttcaata

SEQ ID NO: 2165238 - DNA, 22 bp, Homo sapiens
agaatggctttcaatacccttt

SEQ ID NO: 2165239 - DNA, 12 bp, Homo sapiens
agacaaggtgct

SEQ ID NO: 2165240 - DNA, 13 bp, Homo sapiens
agacaaggtgcta

SEQ ID NO: 2165241 - DNA, 12 bp, Homo sapiens
agaccactgtct

SEQ ID NO: 2165242 - DNA, 19 bp, Homo sapiens
agagatccctgcagaaccc

SEQ ID NO: 2165243 - DNA, 21 bp, Homo sapiens
agagcaaaagcctcagaaagg

SEQ ID NO: 2165244 - DNA, 12 bp, Homo sapiens
agagttccttct

SEQ ID NO: 2165245 - DNA, 17 bp, Homo sapiens
agagttccttctcactt

SEQ ID NO: 2165246 - DNA, 16 bp, Homo sapiens
agatccctgcagaacc

SEQ ID NO: 2165247 - DNA, 18 bp, Homo sapiens
agatgaatggtctggcaa

SEQ ID NO: 2165248 - DNA, 22 bp, Homo sapiens
agatttaagtgaatacattaac

SEQ ID NO: 2165249 - DNA, 23 bp, Homo sapiens
agatttaagtgaatacattaacg

SEQ ID NO: 2165250 - DNA, 17 bp, Homo sapiens
agcacggactgtcagtt

SEQ ID NO: 2165251 - DNA, 19 bp, Homo sapiens
agcagaaaaaaaagtgtct

SEQ ID NO: 2165252 - DNA, 23 bp, Homo sapiens
agcagaaaaaaaagtgtctcaaa

SEQ ID NO: 2165253 - DNA, 22 bp, Homo sapiens
agcatgttcctccttttcttca

SEQ ID NO: 2165254 - DNA, 11 bp, Homo sapiens
agcatttcatg

SEQ ID NO: 2165255 - DNA, 11 bp, Homo sapiens
agccccacctt

SEQ ID NO: 2165256 - DNA, 15 bp, Homo sapiens
agccccctcttcctc

SEQ ID NO: 2165257 - DNA, 16 bp, Homo sapiens
agccccctcttcctcc

SEQ ID NO: 2165258 - DNA, 18 bp, Homo sapiens
agcctcagaaagggattg

SEQ ID NO: 2165259 - DNA, 22 bp, Homo sapiens
agctgccgcaccagcccgaaca

SEQ ID NO: 2165260 - DNA, 12 bp, Homo sapiens
agctgctcccca

SEQ ID NO: 2165261 - DNA, 13 bp, Homo sapiens
agctgctccccag

SEQ ID NO: 2165262 - DNA, 20 bp, Homo sapiens
agctgggagaccctccccac

SEQ ID NO: 2165263 - DNA, 18 bp, Homo sapiens
agcttcaacttttctctt

SEQ ID NO: 2165264 - DNA, 14 bp, Homo sapiens
agctttctcaatgt

SEQ ID NO: 2165265 - DNA, 21 bp, Homo sapiens
aggctgtaactgagagaaaga

SEQ ID NO: 2165266 - DNA, 20 bp, Homo sapiens
agggaatgagagttccttct

SEQ ID NO: 2165267 - DNA, 19 bp, Homo sapiens
aggtgccgccagctgccgc

SEQ ID NO: 2165268 - DNA, 15 bp, Homo sapiens
aggtgctaacataga

SEQ ID NO: 2165269 - DNA, 18 bp, Homo sapiens
aggtgctaacatagattt

SEQ ID NO: 2165270 - DNA, 16 bp, Homo sapiens
agtaatgacttagaaa

SEQ ID NO: 2165271 - DNA, 22 bp, Homo sapiens
agtgaatacattaacggtgcta

SEQ ID NO: 2165272 - DNA, 17 bp, Homo sapiens
agtgagatgtagaaagt

SEQ ID NO: 2165273 - DNA, 14 bp, Homo sapiens
agtgtctcaaagga

SEQ ID NO: 2165274 - DNA, 23 bp, Homo sapiens
agtgtctcaaaggagctttctca

SEQ ID NO: 2165275 - DNA, 16 bp, Homo sapiens
agttctctgggaagtg

SEQ ID NO: 2165276 - DNA, 23 bp, Homo sapiens
agtttaaaatgtgtatttttcaa

SEQ ID NO: 2165277 - DNA, 16 bp, Homo sapiens
atacaaactctcacca

SEQ ID NO: 2165278 - DNA, 19 bp, Homo sapiens
atacattaacggtgctaaa

SEQ ID NO: 2165279 - DNA, 15 bp, Homo sapiens
atagacattctcaca

SEQ ID NO: 2165280 - DNA, 13 bp, Homo sapiens
atcaagagaaact

SEQ ID NO: 2165281 - DNA, 22 bp, Homo sapiens
atcagaagtatatctgtacaga

SEQ ID NO: 2165282 - DNA, 18 bp, Homo sapiens
atccttcaaaataaaaag

SEQ ID NO: 2165283 - DNA, 16 bp, Homo sapiens
atctcacaggctgaga

SEQ ID NO: 2165284 - DNA, 17 bp, Homo sapiens
atgaaaaagctgcttct

SEQ ID NO: 2165285 - DNA, 12 bp, Homo sapiens
atgaatggtctg

SEQ ID NO: 2165286 - DNA, 15 bp, Homo sapiens
atgagagttccttct

SEQ ID NO: 2165287 - DNA, 18 bp, Homo sapiens
atggaatatcagaagtat

SEQ ID NO: 2165288 - DNA, 14 bp, Homo sapiens
atggagccccacct

SEQ ID NO: 2165289 - DNA, 15 bp, Homo sapiens
atggagccccacctt

SEQ ID NO: 2165290 - DNA, 21 bp, Homo sapiens
atggagccccaccttgtctgc

SEQ ID NO: 2165291 - DNA, 22 bp, Homo sapiens
atggctttcaatacccttttaa

SEQ ID NO: 2165292 - DNA, 23 bp, Homo sapiens
atgggaacagtaaagaaagcaga

SEQ ID NO: 2165293 - DNA, 20 bp, Homo sapiens
atggtcggatctcacaggct

SEQ ID NO: 2165294 - DNA, 20 bp, Homo sapiens
atgtgtatttttcaaggcat

SEQ ID NO: 2165295 - DNA, 14 bp, Homo sapiens
atgttgtcaaggat

SEQ ID NO: 2165296 - DNA, 14 bp, Homo sapiens
atgtttggatggtt

SEQ ID NO: 2165297 - DNA, 14 bp, Homo sapiens
attaaaaagaagat

SEQ ID NO: 2165298 - DNA, 14 bp, Homo sapiens
attaaaatctgatg

SEQ ID NO: 2165299 - DNA, 18 bp, Homo sapiens
attaatcaagagaaactt

SEQ ID NO: 2165300 - DNA, 20 bp, Homo sapiens
attaatcaagagaaacttca

SEQ ID NO: 2165301 - DNA, 14 bp, Homo sapiens
attaatcatacaaa

SEQ ID NO: 2165302 - DNA, 18 bp, Homo sapiens
attaatcatacaaactct

SEQ ID NO: 2165303 - DNA, 12 bp, Homo sapiens
attactgtcccc

SEQ ID NO: 2165304 - DNA, 16 bp, Homo sapiens
attccatacttctctc

SEQ ID NO: 2165305 - DNA, 20 bp, Homo sapiens
attcttagctgtaacttaac

SEQ ID NO: 2165306 - DNA, 22 bp, Homo sapiens
attgccatattaaaatctgatg

SEQ ID NO: 2165307 - DNA, 18 bp, Homo sapiens
atttagtggatggaatat

SEQ ID NO: 2165308 - DNA, 16 bp, Homo sapiens
atttcatgaaaaagct

SEQ ID NO: 2165309 - DNA, 17 bp, Homo sapiens
atttcatgaaaaagctg

SEQ ID NO: 2165310 - DNA, 16 bp, Homo sapiens
atttgtagctttgccc

SEQ ID NO: 2165311 - DNA, 19 bp, Homo sapiens
caaaagcctcagaaaggga

SEQ ID NO: 2165312 - DNA, 13 bp, Homo sapiens
caagagaaacttc

SEQ ID NO: 2165313 - DNA, 13 bp, Homo sapiens
caaggtgctaaca

SEQ ID NO: 2165314 - DNA, 22 bp, Homo sapiens
caatacccttttaagtttaaaa

SEQ ID NO: 2165315 - DNA, 18 bp, Homo sapiens
cacaggtgccgccagctg

SEQ ID NO: 2165316 - DNA, 21 bp, Homo sapiens
cacaggtgccgccagctgccg

SEQ ID NO: 2165317 - DNA, 13 bp, Homo sapiens
cacagtgccaccc

SEQ ID NO: 2165318 - DNA, 18 bp, Homo sapiens
caccatccaccttccctt

SEQ ID NO: 2165319 - DNA, 19 bp, Homo sapiens
cacccaccttgacgtttct

SEQ ID NO: 2165320 - DNA, 19 bp, Homo sapiens
cacccatgcagctgctccc

SEQ ID NO: 2165321 - DNA, 23 bp, Homo sapiens
caccccgctgatggagccccacc

SEQ ID NO: 2165322 - DNA, 22 bp, Homo sapiens
cacctaaagcctaccctattct

SEQ ID NO: 2165323 - DNA, 20 bp, Homo sapiens
caccttcccttctacaagga

SEQ ID NO: 2165324 - DNA, 20 bp, Homo sapiens
cagactttgtgttcatttca

SEQ ID NO: 2165325 - DNA, 22 bp, Homo sapiens
cagactttgtgttcatttcatt

SEQ ID NO: 2165326 - DNA, 18 bp, Homo sapiens
cagcttcaacttttctct

SEQ ID NO: 2165327 - DNA, 21 bp, Homo sapiens
cagcttcaacttttctcttta

SEQ ID NO: 2165328 - DNA, 14 bp, Homo sapiens
caggctgagaactc

SEQ ID NO: 2165329 - DNA, 23 bp, Homo sapiens
caggctgagaactcgttcacctc

SEQ ID NO: 2165330 - DNA, 18 bp, Homo sapiens
cagtaaagaaagcagaat

SEQ ID NO: 2165331 - DNA, 12 bp, Homo sapiens
cagtcatctccc

SEQ ID NO: 2165332 - DNA, 19 bp, Homo sapiens
cagtcatctcccctcctgg

SEQ ID NO: 2165333 - DNA, 18 bp, Homo sapiens
cagtgcagtttcttttca

SEQ ID NO: 2165334 - DNA, 13 bp, Homo sapiens
cagtgccacccat

SEQ ID NO: 2165335 - DNA, 20 bp, Homo sapiens
cagtgccacccatgcagctg

SEQ ID NO: 2165336 - DNA, 23 bp, Homo sapiens
cagttcatcaccatttcctcctt

SEQ ID NO: 2165337 - DNA, 15 bp, Homo sapiens
catctcccctcctgg

SEQ ID NO: 2165338 - DNA, 17 bp, Homo sapiens
catgcagctgctcccca

SEQ ID NO: 2165339 - DNA, 18 bp, Homo sapiens
catgcagctgctccccag

SEQ ID NO: 2165340 - DNA, 24 bp, Homo sapiens
catgcagctgctccccaggccacc

SEQ ID NO: 2165341 - DNA, 24 bp, Homo sapiens
catgtggcctttatctcaacggaa

SEQ ID NO: 2165342 - DNA, 13 bp, Homo sapiens
catgttcctcctt

SEQ ID NO: 2165343 - DNA, 15 bp, Homo sapiens
catttcatgaaaaag

SEQ ID NO: 2165344 - DNA, 11 bp, Homo sapiens
ccaagcagaaa

SEQ ID NO: 2165345 - DNA, 14 bp, Homo sapiens
ccaagcatttcatg

SEQ ID NO: 2165346 - DNA, 12 bp, Homo sapiens
ccaccttccctt

SEQ ID NO: 2165347 - DNA, 14 bp, Homo sapiens
ccaccttgtctgct

SEQ ID NO: 2165348 - DNA, 16 bp, Homo sapiens
ccagaacgtggtttgc

SEQ ID NO: 2165349 - DNA, 18 bp, Homo sapiens
ccagctgccgcaccagcc

SEQ ID NO: 2165350 - DNA, 13 bp, Homo sapiens
ccaggctgtttca

SEQ ID NO: 2165351 - DNA, 13 bp, Homo sapiens
ccatacttctctc

SEQ ID NO: 2165352 - DNA, 14 bp, Homo sapiens
ccatacttctctca

SEQ ID NO: 2165353 - DNA, 14 bp, Homo sapiens
ccatgcagctgctc

SEQ ID NO: 2165354 - DNA, 15 bp, Homo sapiens
ccccacagtgccacc

SEQ ID NO: 2165355 - DNA, 19 bp, Homo sapiens
ccccctcttcctccctggg

SEQ ID NO: 2165356 - DNA, 20 bp, Homo sapiens
cccgctgatggagccccacc

SEQ ID NO: 2165357 - DNA, 23 bp, Homo sapiens
cccgctgatggagccccaccttg

SEQ ID NO: 2165358 - DNA, 14 bp, Homo sapiens
ccctccccacagtg

SEQ ID NO: 2165359 - DNA, 12 bp, Homo sapiens
ccctcttcctcc

SEQ ID NO: 2165360 - DNA, 14 bp, Homo sapiens
ccctgcagaaccca

SEQ ID NO: 2165361 - DNA, 15 bp, Homo sapiens
cccttctacaaggac

SEQ ID NO: 2165362 - DNA, 22 bp, Homo sapiens
ccgccagctgccgcaccagccc

SEQ ID NO: 2165363 - DNA, 14 bp, Homo sapiens
ccgctgatggagcc

SEQ ID NO: 2165364 - DNA, 17 bp, Homo sapiens
ccgctgatggagcccca

SEQ ID NO: 2165365 - DNA, 11 bp, Homo sapiens
cctaaggcatg

SEQ ID NO: 2165366 - DNA, 16 bp, Homo sapiens
cctcttcctccctggg

SEQ ID NO: 2165367 - DNA, 15 bp, Homo sapiens
cctgcagggcttctc

SEQ ID NO: 2165368 - DNA, 19 bp, Homo sapiens
cctggagaagaatggcttt

SEQ ID NO: 2165369 - DNA, 16 bp, Homo sapiens
cctggagacaaggtgc

SEQ ID NO: 2165370 - DNA, 17 bp, Homo sapiens
cctggagacaaggtgct

SEQ ID NO: 2165371 - DNA, 19 bp, Homo sapiens
cctgggggccccaggatgg

SEQ ID NO: 2165372 - DNA, 20 bp, Homo sapiens
cgatgttgtcaaggatggtt

SEQ ID NO: 2165373 - DNA, 24 bp, Homo sapiens
cggaagccccctcttcctccctgg

SEQ ID NO: 2165374 - DNA, 19 bp, Homo sapiens
cggatctcacaggctgaga

SEQ ID NO: 2165375 - DNA, 16 bp, Homo sapiens
cggatctgctgggctc

SEQ ID NO: 2165376 - DNA, 18 bp, Homo sapiens
cggtgctaaaaatgaaaa

SEQ ID NO: 2165377 - DNA, 21 bp, Homo sapiens
cggttgttctttcctcacatt

SEQ ID NO: 2165378 - DNA, 21 bp, Homo sapiens
ctaaagcctaccctattctat

SEQ ID NO: 2165379 - DNA, 12 bp, Homo sapiens
ctaaataaacat

SEQ ID NO: 2165380 - DNA, 23 bp, Homo sapiens
ctagagcagttggccaagcagaa

SEQ ID NO: 2165381 - DNA, 19 bp, Homo sapiens
ctagggactgccaggctgt

SEQ ID NO: 2165382 - DNA, 15 bp, Homo sapiens
ctattaatcaagaga

SEQ ID NO: 2165383 - DNA, 14 bp, Homo sapiens
ctcagaaagggatt

SEQ ID NO: 2165384 - DNA, 16 bp, Homo sapiens
ctccaagcatttcatg

SEQ ID NO: 2165385 - DNA, 18 bp, Homo sapiens
ctcctggtgttctgcagt

SEQ ID NO: 2165386 - DNA, 20 bp, Homo sapiens
ctccttttcttcaccctccc

SEQ ID NO: 2165387 - DNA, 19 bp, Homo sapiens
ctctcaccatgatgtgaag

SEQ ID NO: 2165388 - DNA, 15 bp, Homo sapiens
ctcttcctccctggg

SEQ ID NO: 2165389 - DNA, 18 bp, Homo sapiens
ctctttggaaatagcatg

SEQ ID NO: 2165390 - DNA, 22 bp, Homo sapiens
ctgacttaactttaacttttga

SEQ ID NO: 2165391 - DNA, 16 bp, Homo sapiens
ctgatgtaacaaggtg

SEQ ID NO: 2165392 - DNA, 22 bp, Homo sapiens
ctgcaagaacactggacctttg

SEQ ID NO: 2165393 - DNA, 13 bp, Homo sapiens
ctgcagaacccac

SEQ ID NO: 2165394 - DNA, 14 bp, Homo sapiens
ctgcagggcttctc

SEQ ID NO: 2165395 - DNA, 22 bp, Homo sapiens
ctgcctggagacaaggtgctaa

SEQ ID NO: 2165396 - DNA, 13 bp, Homo sapiens
ctgctaaataaac

SEQ ID NO: 2165397 - DNA, 16 bp, Homo sapiens
ctgctccccaggccac

SEQ ID NO: 2165398 - DNA, 18 bp, Homo sapiens
ctgctccccaggccaccc

SEQ ID NO: 2165399 - DNA, 15 bp, Homo sapiens
ctggcgagttctctt

SEQ ID NO: 2165400 - DNA, 12 bp, Homo sapiens
ctgggagaccct

SEQ ID NO: 2165401 - DNA, 18 bp, Homo sapiens
ctgggagaccctccccac

SEQ ID NO: 2165402 - DNA, 16 bp, Homo sapiens
ctgtaactattgggtg

SEQ ID NO: 2165403 - DNA, 19 bp, Homo sapiens
ctgtacagatcaagaaaaa

SEQ ID NO: 2165404 - DNA, 21 bp, Homo sapiens
cttattaatcatacaaactct

SEQ ID NO: 2165405 - DNA, 17 bp, Homo sapiens
cttctttctagagcagt

SEQ ID NO: 2165406 - DNA, 21 bp, Homo sapiens
cttggctgcctgtgggcttcc

SEQ ID NO: 2165407 - DNA, 15 bp, Homo sapiens
ctttcctcacatttg

SEQ ID NO: 2165408 - DNA, 14 bp, Homo sapiens
ctttctcaatgtct

SEQ ID NO: 2165409 - DNA, 20 bp, Homo sapiens
ctttggaaatagcatgacag

SEQ ID NO: 2165410 - DNA, 15 bp, Homo sapiens
ctttgtaagagcaaa

SEQ ID NO: 2165411 - DNA, 15 bp, Homo sapiens
ctttgtgttcatttc

SEQ ID NO: 2165412 - DNA, 17 bp, Homo sapiens
ctttgtgttcatttcat

SEQ ID NO: 2165413 - DNA, 19 bp, Homo sapiens
cttttgaaaagaccaagac

SEQ ID NO: 2165414 - DNA, 15 bp, Homo sapiens
gaaagcagaatcaac

SEQ ID NO: 2165415 - DNA, 22 bp, Homo sapiens
gaaagttgtaaaatagaaaaag

SEQ ID NO: 2165416 - DNA, 21 bp, Homo sapiens
gaaatagcatgacaggctgtt

SEQ ID NO: 2165417 - DNA, 13 bp, Homo sapiens
gaacactggacct

SEQ ID NO: 2165418 - DNA, 20 bp, Homo sapiens
gaacagtaaagaaagcagaa

SEQ ID NO: 2165419 - DNA, 17 bp, Homo sapiens
gaacccaccaaccagaa

SEQ ID NO: 2165420 - DNA, 13 bp, Homo sapiens
gaacgtggtttgc

SEQ ID NO: 2165421 - DNA, 18 bp, Homo sapiens
gaagccccctcttcctcc

SEQ ID NO: 2165422 - DNA, 15 bp, Homo sapiens
gaatccgaagggaat

SEQ ID NO: 2165423 - DNA, 19 bp, Homo sapiens
gaatgagagttccttctca

SEQ ID NO: 2165424 - DNA, 14 bp, Homo sapiens
gacaaggtgctaac

SEQ ID NO: 2165425 - DNA, 19 bp, Homo sapiens
gacctttgggttctttctg

SEQ ID NO: 2165426 - DNA, 16 bp, Homo sapiens
gacgtttcttctttct

SEQ ID NO: 2165427 - DNA, 16 bp, Homo sapiens
gactgccaggctgttt

SEQ ID NO: 2165428 - DNA, 16 bp, Homo sapiens
gagaataaaattccta

SEQ ID NO: 2165429 - DNA, 20 bp, Homo sapiens
gagaccctccccacagtgcc

SEQ ID NO: 2165430 - DNA, 23 bp, Homo sapiens
gagaccctccccacagtgccacc

SEQ ID NO: 2165431 - DNA, 21 bp, Homo sapiens
gagcagttggccaagcagaaa

SEQ ID NO: 2165432 - DNA, 20 bp, Homo sapiens
gagccccaccttgtctgcta

SEQ ID NO: 2165433 - DNA, 20 bp, Homo sapiens
gagctgggagaccctcccca

SEQ ID NO: 2165434 - DNA, 22 bp, Homo sapiens
gagctttctcaatgtcttccca

SEQ ID NO: 2165435 - DNA, 11 bp, Homo sapiens
gatatttccta

SEQ ID NO: 2165436 - DNA, 12 bp, Homo sapiens
gatatttcctaa

SEQ ID NO: 2165437 - DNA, 18 bp, Homo sapiens
gatctgctgggctctgcc

SEQ ID NO: 2165438 - DNA, 14 bp, Homo sapiens
gatggagccccacc

SEQ ID NO: 2165439 - DNA, 16 bp, Homo sapiens
gatggagccccacctt

SEQ ID NO: 2165440 - DNA, 17 bp, Homo sapiens
gatgggaacagtaaaga

SEQ ID NO: 2165441 - DNA, 18 bp, Homo sapiens
gatggtcggatctcacag

SEQ ID NO: 2165442 - DNA, 16 bp, Homo sapiens
gcaaaagcctcagaaa

SEQ ID NO: 2165443 - DNA, 15 bp, Homo sapiens
gcagctgctccccag

SEQ ID NO: 2165444 - DNA, 14 bp, Homo sapiens
gcagggcttctcct

SEQ ID NO: 2165445 - DNA, 17 bp, Homo sapiens
gcagtttcttttcacat

SEQ ID NO: 2165446 - DNA, 20 bp, Homo sapiens
gcatgtggcctttatctcaa

SEQ ID NO: 2165447 - DNA, 22 bp, Homo sapiens
gccacccatgcagctgctcccc

SEQ ID NO: 2165448 - DNA, 17 bp, Homo sapiens
gccagctgccgcaccag

SEQ ID NO: 2165449 - DNA, 19 bp, Homo sapiens
gccagctgccgcaccagcc

SEQ ID NO: 2165450 - DNA, 16 bp, Homo sapiens
gcctcagaaagggatt

SEQ ID NO: 2165451 - DNA, 12 bp, Homo sapiens
gctaaataaaca

SEQ ID NO: 2165452 - DNA, 16 bp, Homo sapiens
gctccccaggccaccc

SEQ ID NO: 2165453 - DNA, 23 bp, Homo sapiens
gctctagggactgccaggctgtt

SEQ ID NO: 2165454 - DNA, 13 bp, Homo sapiens
gctcttctcaggg

SEQ ID NO: 2165455 - DNA, 15 bp, Homo sapiens
gctgccgcaccagcc

SEQ ID NO: 2165456 - DNA, 13 bp, Homo sapiens
gctgctccccagg

SEQ ID NO: 2165457 - DNA, 16 bp, Homo sapiens
gctgctccccaggcca

SEQ ID NO: 2165458 - DNA, 18 bp, Homo sapiens
gctgtaactgagagaaag

SEQ ID NO: 2165459 - DNA, 15 bp, Homo sapiens
ggaaatagcatgaca

SEQ ID NO: 2165460 - DNA, 22 bp, Homo sapiens
ggaacagtaaagaaagcagaat

SEQ ID NO: 2165461 - DNA, 16 bp, Homo sapiens
ggactgccaggctgtt

SEQ ID NO: 2165462 - DNA, 17 bp, Homo sapiens
ggactgccaggctgttt

SEQ ID NO: 2165463 - DNA, 12 bp, Homo sapiens
ggagccccacct

SEQ ID NO: 2165464 - DNA, 21 bp, Homo sapiens
ggagctgggagaccctcccca

SEQ ID NO: 2165465 - DNA, 23 bp, Homo sapiens
ggagctttctcaatgtcttccca

SEQ ID NO: 2165466 - DNA, 14 bp, Homo sapiens
ggccaaaatcaaga

SEQ ID NO: 2165467 - DNA, 19 bp, Homo sapiens
ggctgcctgtgggcttccc

SEQ ID NO: 2165468 - DNA, 23 bp, Homo sapiens
gggaacagtaaagaaagcagaat

SEQ ID NO: 2165469 - DNA, 14 bp, Homo sapiens
gggaagtaacagac

SEQ ID NO: 2165470 - DNA, 16 bp, Homo sapiens
gggagaccctccccac

SEQ ID NO: 2165471 - DNA, 21 bp, Homo sapiens
gggagagatccctgcagaacc

SEQ ID NO: 2165472 - DNA, 23 bp, Homo sapiens
gggagctgggagaccctccccac

SEQ ID NO: 2165473 - DNA, 14 bp, Homo sapiens
ggggatatttccta

SEQ ID NO: 2165474 - DNA, 18 bp, Homo sapiens
ggtgctaaaaatgaaaat

SEQ ID NO: 2165475 - DNA, 18 bp, Homo sapiens
ggtggcctggaggtgggc

SEQ ID NO: 2165476 - DNA, 11 bp, Homo sapiens
gtaacagacac

SEQ ID NO: 2165477 - DNA, 16 bp, Homo sapiens
gtacagatcaagaaaa

SEQ ID NO: 2165478 - DNA, 22 bp, Homo sapiens
gtagaaagttgtaaaatagaaa

SEQ ID NO: 2165479 - DNA, 23 bp, Homo sapiens
gtcagactttgtgttcatttcat

SEQ ID NO: 2165480 - DNA, 16 bp, Homo sapiens
gtcatctcccctcctg

SEQ ID NO: 2165481 - DNA, 16 bp, Homo sapiens
gtctgctaaataaaca

SEQ ID NO: 2165482 - DNA, 17 bp, Homo sapiens
gtctgctaaataaacat

SEQ ID NO: 2165483 - DNA, 23 bp, Homo sapiens
gtgccacccatgcagctgctccc

SEQ ID NO: 2165484 - DNA, 15 bp, Homo sapiens
gtgccgccagctgcc

SEQ ID NO: 2165485 - DNA, 16 bp, Homo sapiens
gtgctaaaaatgaaaa

SEQ ID NO: 2165486 - DNA, 18 bp, Homo sapiens
gtgttctgtttgaaacta

SEQ ID NO: 2165487 - DNA, 11 bp, Homo sapiens
gttatgaaaat

SEQ ID NO: 2165488 - DNA, 13 bp, Homo sapiens
gttctgcagtcat

SEQ ID NO: 2165489 - DNA, 16 bp, Homo sapiens
gttggccaagcagaaa

SEQ ID NO: 2165490 - DNA, 20 bp, Homo sapiens
gtttttagcatgttcctcct

SEQ ID NO: 2165491 - DNA, 21 bp, Homo sapiens
taaaaagtaatgacttagaaa

SEQ ID NO: 2165492 - DNA, 14 bp, Homo sapiens
taaaatagaaaaag

SEQ ID NO: 2165493 - DNA, 17 bp, Homo sapiens
taaaatgtgtatttttc

SEQ ID NO: 2165494 - DNA, 20 bp, Homo sapiens
taaaatgtgtatttttcaag

SEQ ID NO: 2165495 - DNA, 14 bp, Homo sapiens
taaagaaagcagaa

SEQ ID NO: 2165496 - DNA, 21 bp, Homo sapiens
taaagcctaccctattctatc

SEQ ID NO: 2165497 - DNA, 14 bp, Homo sapiens
taactgagagaaag

SEQ ID NO: 2165498 - DNA, 16 bp, Homo sapiens
taatcaagagaaactt

SEQ ID NO: 2165499 - DNA, 18 bp, Homo sapiens
taatcaagagaaacttca

SEQ ID NO: 2165500 - DNA, 13 bp, Homo sapiens
tacaaactctcac

SEQ ID NO: 2165501 - DNA, 15 bp, Homo sapiens
tacattaacggtgct

SEQ ID NO: 2165502 - DNA, 17 bp, Homo sapiens
tacattaacggtgctaa

SEQ ID NO: 2165503 - DNA, 23 bp, Homo sapiens
tacctggagaagaatggctttca

SEQ ID NO: 2165504 - DNA, 13 bp, Homo sapiens
tacttctctcaga

SEQ ID NO: 2165505 - DNA, 14 bp, Homo sapiens
tagcatgacaggct

SEQ ID NO: 2165506 - DNA, 18 bp, Homo sapiens
tatcagaagtatatctgt

SEQ ID NO: 2165507 - DNA, 15 bp, Homo sapiens
tatttttcaaggcat

SEQ ID NO: 2165508 - DNA, 17 bp, Homo sapiens
tcaaaggagctttctca

SEQ ID NO: 2165509 - DNA, 11 bp, Homo sapiens
tcaagagaaac

SEQ ID NO: 2165510 - DNA, 16 bp, Homo sapiens
tcaagagaaacttcaa

SEQ ID NO: 2165511 - DNA, 23 bp, Homo sapiens
tcaagagtgagatgtagaaagtt

SEQ ID NO: 2165512 - DNA, 15 bp, Homo sapiens
tcaccatgatgtgaa

SEQ ID NO: 2165513 - DNA, 17 bp, Homo sapiens
tcatctcccctcctggc

SEQ ID NO: 2165514 - DNA, 19 bp, Homo sapiens
tcatttcagggtcttggct

SEQ ID NO: 2165515 - DNA, 12 bp, Homo sapiens
tccaagcatttc

SEQ ID NO: 2165516 - DNA, 17 bp, Homo sapiens
tccaagcatttcatgaa

SEQ ID NO: 2165517 - DNA, 20 bp, Homo sapiens
tccaagcatttcatgaaaaa

SEQ ID NO: 2165518 - DNA, 13 bp, Homo sapiens
tccaccttccctt

SEQ ID NO: 2165519 - DNA, 16 bp, Homo sapiens
tccattggatctgcaa

SEQ ID NO: 2165520 - DNA, 19 bp, Homo sapiens
tccattggatctgcaagaa

SEQ ID NO: 2165521 - DNA, 19 bp, Homo sapiens
tccctgggggccccaggat

SEQ ID NO: 2165522 - DNA, 14 bp, Homo sapiens
tcctccctgggggc

SEQ ID NO: 2165523 - DNA, 13 bp, Homo sapiens
tcggatctcacag

SEQ ID NO: 2165524 - DNA, 14 bp, Homo sapiens
tctatccatctcct

SEQ ID NO: 2165525 - DNA, 17 bp, Homo sapiens
tctatccatctcctggt

SEQ ID NO: 2165526 - DNA, 21 bp, Homo sapiens
tctcaaaggagctttctcaat

SEQ ID NO: 2165527 - DNA, 20 bp, Homo sapiens
tctcaacggaagccccctct

SEQ ID NO: 2165528 - DNA, 15 bp, Homo sapiens
tctcctggtgttctg

SEQ ID NO: 2165529 - DNA, 18 bp, Homo sapiens
tctctctttaaccctccc

SEQ ID NO: 2165530 - DNA, 19 bp, Homo sapiens
tctctttggaaatagcatg

SEQ ID NO: 2165531 - DNA, 17 bp, Homo sapiens
tctgcagtcatctcccc

SEQ ID NO: 2165532 - DNA, 15 bp, Homo sapiens
tctggggctgtgtta

SEQ ID NO: 2165533 - DNA, 17 bp, Homo sapiens
tctgtaactattgggtg

SEQ ID NO: 2165534 - DNA, 13 bp, Homo sapiens
tctgtttgaaact

SEQ ID NO: 2165535 - DNA, 22 bp, Homo sapiens
tcttattaatcatacaaactct

SEQ ID NO: 2165536 - DNA, 15 bp, Homo sapiens
tctttcctcacattt

SEQ ID NO: 2165537 - DNA, 13 bp, Homo sapiens
tctttctagagca

SEQ ID NO: 2165538 - DNA, 17 bp, Homo sapiens
tctttggaaatagcatg

SEQ ID NO: 2165539 - DNA, 15 bp, Homo sapiens
tctttgtaagagcaa

SEQ ID NO: 2165540 - DNA, 18 bp, Homo sapiens
tgaaaagaccaagacttt

SEQ ID NO: 2165541 - DNA, 15 bp, Homo sapiens
tgaaaatatagacat

SEQ ID NO: 2165542 - DNA, 21 bp, Homo sapiens
tgaaaatatagacattctcac

SEQ ID NO: 2165543 - DNA, 23 bp, Homo sapiens
tgaaaatatagacattctcacat

SEQ ID NO: 2165544 - DNA, 14 bp, Homo sapiens
tgacattcttagct

SEQ ID NO: 2165545 - DNA, 14 bp, Homo sapiens
tgacgtttcttctt

SEQ ID NO: 2165546 - DNA, 17 bp, Homo sapiens
tgacttaactttaactt

SEQ ID NO: 2165547 - DNA, 13 bp, Homo sapiens
tgacttagaaact

SEQ ID NO: 2165548 - DNA, 16 bp, Homo sapiens
tgagagttccttctca

SEQ ID NO: 2165549 - DNA, 11 bp, Homo sapiens
tgatggagccc

SEQ ID NO: 2165550 - DNA, 16 bp, Homo sapiens
tgatggagccccacct

SEQ ID NO: 2165551 - DNA, 20 bp, Homo sapiens
tgatgtgaagagtttcacaa

SEQ ID NO: 2165552 - DNA, 18 bp, Homo sapiens
tgcagctgctccccaggc

SEQ ID NO: 2165553 - DNA, 12 bp, Homo sapiens
tgcagtttcttt

SEQ ID NO: 2165554 - DNA, 16 bp, Homo sapiens
tgcagtttcttttcac

SEQ ID NO: 2165555 - DNA, 18 bp, Homo sapiens
tgcagtttcttttcacat

SEQ ID NO: 2165556 - DNA, 16 bp, Homo sapiens
tgccaggctgtttcag

SEQ ID NO: 2165557 - DNA, 14 bp, Homo sapiens
tgctccccaggcca

SEQ ID NO: 2165558 - DNA, 15 bp, Homo sapiens
tgctccccaggccac

SEQ ID NO: 2165559 - DNA, 21 bp, Homo sapiens
tggaaaataatttagtggatg

SEQ ID NO: 2165560 - DNA, 21 bp, Homo sapiens
tggacctttgggttctttctg

SEQ ID NO: 2165561 - DNA, 23 bp, Homo sapiens
tggagaaccagggctcttctcag

SEQ ID NO: 2165562 - DNA, 19 bp, Homo sapiens
tggagaagaatggctttca

SEQ ID NO: 2165563 - DNA, 18 bp, Homo sapiens
tggagccccaccttgtct

SEQ ID NO: 2165564 - DNA, 19 bp, Homo sapiens
tggagccccaccttgtctg

SEQ ID NO: 2165565 - DNA, 15 bp, Homo sapiens
tggcaatattctgta

SEQ ID NO: 2165566 - DNA, 19 bp, Homo sapiens
tggcaatattctgtaacta

SEQ ID NO: 2165567 - DNA, 20 bp, Homo sapiens
tggcaatattctgtaactat

SEQ ID NO: 2165568 - DNA, 16 bp, Homo sapiens
tgggcaaagggaagta

SEQ ID NO: 2165569 - DNA, 20 bp, Homo sapiens
tggggctgtgttatgaaaat

SEQ ID NO: 2165570 - DNA, 21 bp, Homo sapiens
tgggtgaatatggtggaaaat

SEQ ID NO: 2165571 - DNA, 16 bp, Homo sapiens
tggtcggatctcacag

SEQ ID NO: 2165572 - DNA, 22 bp, Homo sapiens
tggtcggatctcacaggctgag

SEQ ID NO: 2165573 - DNA, 16 bp, Homo sapiens
tgtaaaatagaaaaag

SEQ ID NO: 2165574 - DNA, 16 bp, Homo sapiens
tgtaactgagagaaag

SEQ ID NO: 2165575 - DNA, 21 bp, Homo sapiens
tgtatttttcaaggcatttat

SEQ ID NO: 2165576 - DNA, 12 bp, Homo sapiens
tgtgttcatttc

SEQ ID NO: 2165577 - DNA, 15 bp, Homo sapiens
tgtgttcatttcatt

SEQ ID NO: 2165578 - DNA, 13 bp, Homo sapiens
tgttcatttcatt

SEQ ID NO: 2165579 - DNA, 16 bp, Homo sapiens
tgttctgtttgaaact

SEQ ID NO: 2165580 - DNA, 18 bp, Homo sapiens
tgttgttctgcctggaga

SEQ ID NO: 2165581 - DNA, 16 bp, Homo sapiens
ttaactttaacttttg

SEQ ID NO: 2165582 - DNA, 12 bp, Homo sapiens
ttaatcaagaga

SEQ ID NO: 2165583 - DNA, 17 bp, Homo sapiens
ttaatcaagagaaactt

SEQ ID NO: 2165584 - DNA, 20 bp, Homo sapiens
ttagcatgttcctccttttc

SEQ ID NO: 2165585 - DNA, 11 bp, Homo sapiens
ttcaaggcatt

SEQ ID NO: 2165586 - DNA, 16 bp, Homo sapiens
ttcacattaggctgtt

SEQ ID NO: 2165587 - DNA, 11 bp, Homo sapiens
ttcatttcatt

SEQ ID NO: 2165588 - DNA, 13 bp, Homo sapiens
ttcctaaggcatg

SEQ ID NO: 2165589 - DNA, 15 bp, Homo sapiens
ttcctaaggcatgtg

SEQ ID NO: 2165590 - DNA, 15 bp, Homo sapiens
ttcctcctttacctt

SEQ ID NO: 2165591 - DNA, 16 bp, Homo sapiens
ttctatccatctcctg

SEQ ID NO: 2165592 - DNA, 19 bp, Homo sapiens
ttctctttggaaatagcat

SEQ ID NO: 2165593 - DNA, 20 bp, Homo sapiens
ttcttctattaatcaagaga

SEQ ID NO: 2165594 - DNA, 12 bp, Homo sapiens
ttcttctttcta

SEQ ID NO: 2165595 - DNA, 13 bp, Homo sapiens
ttcttttcacatt

SEQ ID NO: 2165596 - DNA, 14 bp, Homo sapiens
ttgcagcttcaact

SEQ ID NO: 2165597 - DNA, 18 bp, Homo sapiens
ttgccatttgtagctttg

SEQ ID NO: 2165598 - DNA, 19 bp, Homo sapiens
ttgggttctttctgggggg

SEQ ID NO: 2165599 - DNA, 23 bp, Homo sapiens
ttgtcaaggatggttttgggact

SEQ ID NO: 2165600 - DNA, 16 bp, Homo sapiens
ttgtgttcatttcatt

SEQ ID NO: 2165601 - DNA, 12 bp, Homo sapiens
tttaacttttga

SEQ ID NO: 2165602 - DNA, 23 bp, Homo sapiens
tttattgccatattaaaatctga

SEQ ID NO: 2165603 - DNA, 12 bp, Homo sapiens
tttcatgaaaaa

SEQ ID NO: 2165604 - DNA, 20 bp, Homo sapiens
tttcatgaaaaagctgcttc

SEQ ID NO: 2165605 - DNA, 14 bp, Homo sapiens
tttccacacgcatt

SEQ ID NO: 2165606 - DNA, 14 bp, Homo sapiens
tttcctaaggcatg

SEQ ID NO: 2165607 - DNA, 13 bp, Homo sapiens
tttctcaatgtct

SEQ ID NO: 2165608 - DNA, 18 bp, Homo sapiens
tttctcaatgtcttccca

SEQ ID NO: 2165609 - DNA, 18 bp, Homo sapiens
tttctggggggatatttc

SEQ ID NO: 2165610 - DNA, 20 bp, Homo sapiens
tttctggggggatatttcct

SEQ ID NO: 2165611 - DNA, 14 bp, Homo sapiens
tttcttctttctag

SEQ ID NO: 2165612 - DNA, 18 bp, Homo sapiens
tttgaaaagaccaagact

SEQ ID NO: 2165613 - DNA, 12 bp, Homo sapiens
ttttcaaggcat

SEQ ID NO: 2165614 - DNA, 14 bp, Homo sapiens
aaaaagtgtctcaa

SEQ ID NO: 2165615 - DNA, 22 bp, Homo sapiens
aaaagggagaataaaattccta

SEQ ID NO: 2165616 - DNA, 24 bp, Homo sapiens
aaaatcaagagtgagatgtagaaa

SEQ ID NO: 2165617 - DNA, 16 bp, Homo sapiens
aaagcctcagaaaggg

SEQ ID NO: 2165618 - DNA, 21 bp, Homo sapiens
aaaggagctttctcaatgtct

SEQ ID NO: 2165619 - DNA, 22 bp, Homo sapiens
aaaggagctttctcaatgtctt

SEQ ID NO: 2165620 - DNA, 11 bp, Homo sapiens
aaagggaagta

SEQ ID NO: 2165621 - DNA, 24 bp, Homo sapiens
aaagggaagtaacagacacacgat

SEQ ID NO: 2165622 - DNA, 21 bp, Homo sapiens
aaagtaatgacttagaaactg

SEQ ID NO: 2165623 - DNA, 18 bp, Homo sapiens
aaagtgtctcaaaggagc

SEQ ID NO: 2165624 - DNA, 18 bp, Homo sapiens
aaagttaatgggatggtc

SEQ ID NO: 2165625 - DNA, 22 bp, Homo sapiens
aaagttgtaaaatagaaaaagt

SEQ ID NO: 2165626 - DNA, 19 bp, Homo sapiens
aacagtaaagaaagcagaa

SEQ ID NO: 2165627 - DNA, 22 bp, Homo sapiens
aactctcaccatgatgtgaaga

SEQ ID NO: 2165628 - DNA, 11 bp, Homo sapiens
aagcatttcat

SEQ ID NO: 2165629 - DNA, 14 bp, Homo sapiens
aaggagctttctca

SEQ ID NO: 2165630 - DNA, 23 bp, Homo sapiens
aagggagaataaaattcctatct

SEQ ID NO: 2165631 - DNA, 19 bp, Homo sapiens
aagtaatgacttagaaact

SEQ ID NO: 2165632 - DNA, 15 bp, Homo sapiens
aagttgtaaaataga

SEQ ID NO: 2165633 - DNA, 15 bp, Homo sapiens
aatatggtggaaaat

SEQ ID NO: 2165634 - DNA, 13 bp, Homo sapiens
aatcaagagaaac

SEQ ID NO: 2165635 - DNA, 14 bp, Homo sapiens
aatcaagagaaact

SEQ ID NO: 2165636 - DNA, 19 bp, Homo sapiens
aatcatacaaactctcacc

SEQ ID NO: 2165637 - DNA, 20 bp, Homo sapiens
aatcatacaaactctcacca

SEQ ID NO: 2165638 - DNA, 13 bp, Homo sapiens
aatgacttagaaa

SEQ ID NO: 2165639 - DNA, 15 bp, Homo sapiens
aatgacttagaaact

SEQ ID NO: 2165640 - DNA, 23 bp, Homo sapiens
aatgggatggtcggatctcacag

SEQ ID NO: 2165641 - DNA, 15 bp, Homo sapiens
aatggtctggcaata

SEQ ID NO: 2165642 - DNA, 22 bp, Homo sapiens
aatgtgtatttttcaaggcatt

SEQ ID NO: 2165643 - DNA, 20 bp, Homo sapiens
aattccatacttctctcaga

SEQ ID NO: 2165644 - DNA, 12 bp, Homo sapiens
acaaggtgctaa

SEQ ID NO: 2165645 - DNA, 19 bp, Homo sapiens
acacggatctgctgggctc

SEQ ID NO: 2165646 - DNA, 14 bp, Homo sapiens
acagatcaagaaaa

SEQ ID NO: 2165647 - DNA, 22 bp, Homo sapiens
acaggtgccgccagctgccgca

SEQ ID NO: 2165648 - DNA, 16 bp, Homo sapiens
acattaacggtgctaa

SEQ ID NO: 2165649 - DNA, 13 bp, Homo sapiens
acattaggctgtt

SEQ ID NO: 2165650 - DNA, 12 bp, Homo sapiens
accactgtctcc

SEQ ID NO: 2165651 - DNA, 17 bp, Homo sapiens
acccatgcagctgctcc

SEQ ID NO: 2165652 - DNA, 23 bp, Homo sapiens
accctattctatccatctcctgg

SEQ ID NO: 2165653 - DNA, 11 bp, Homo sapiens
accctccccac

SEQ ID NO: 2165654 - DNA, 22 bp, Homo sapiens
cagaacgtggtttgcctgaggc

SEQ ID NO: 2165655 - DNA, 16 bp, Homo sapiens
cagctgccgcaccagc

SEQ ID NO: 2165656 - DNA, 13 bp, Homo sapiens
cagctgctcccca

SEQ ID NO: 2165657 - DNA, 14 bp, Homo sapiens
cagctgctccccag

SEQ ID NO: 2165658 - DNA, 20 bp, Homo sapiens
cagctgctccccaggccacc

SEQ ID NO: 2165659 - DNA, 15 bp, Homo sapiens
caggctgtttcagcc

SEQ ID NO: 2165660 - DNA, 17 bp, Homo sapiens
cagggcttctcctcctc

SEQ ID NO: 2165661 - DNA, 17 bp, Homo sapiens
caggtgccgccagctgc

SEQ ID NO: 2165662 - DNA, 19 bp, Homo sapiens
caggtgccgccagctgccg

SEQ ID NO: 2165663 - DNA, 21 bp, Homo sapiens
cagtgcagtttcttttcacat

SEQ ID NO: 2165664 - DNA, 12 bp, Homo sapiens
cagtgccaccca

SEQ ID NO: 2165665 - DNA, 21 bp, Homo sapiens
cagtgccacccatgcagctgc

SEQ ID NO: 2165666 - DNA, 12 bp, Homo sapiens
cagttctctggg

SEQ ID NO: 2165667 - DNA, 18 bp, Homo sapiens
cagttggccaagcagaaa

SEQ ID NO: 2165668 - DNA, 16 bp, Homo sapiens
catacttctctcagat

SEQ ID NO: 2165669 - DNA, 14 bp, Homo sapiens
catcaccatttcct

SEQ ID NO: 2165670 - DNA, 18 bp, Homo sapiens
catcaccatttcctcctt

SEQ ID NO: 2165671 - DNA, 17 bp, Homo sapiens
catccaccttcccttct

SEQ ID NO: 2165672 - DNA, 15 bp, Homo sapiens
catgaaaaagctgct

SEQ ID NO: 2165673 - DNA, 14 bp, Homo sapiens
catgacaggctgtt

SEQ ID NO: 2165674 - DNA, 15 bp, Homo sapiens
catgatgtgaagagt

SEQ ID NO: 2165675 - DNA, 14 bp, Homo sapiens
catgcagctgctcc

SEQ ID NO: 2165676 - DNA, 22 bp, Homo sapiens
catgcagctgctccccaggcca

SEQ ID NO: 2165677 - DNA, 15 bp, Homo sapiens
gccttaaacacacat

SEQ ID NO: 2165678 - DNA, 21 bp, Homo sapiens
gccttttccacacgcattaat

SEQ ID NO: 2165679 - DNA, 13 bp, Homo sapiens
gctgatggagccc

SEQ ID NO: 2165680 - DNA, 18 bp, Homo sapiens
gctgatggagccccacct

SEQ ID NO: 2165681 - DNA, 19 bp, Homo sapiens
gctgatggagccccacctt

SEQ ID NO: 2165682 - DNA, 16 bp, Homo sapiens
gctgccgcaccagccc

SEQ ID NO: 2165683 - DNA, 17 bp, Homo sapiens
gctgctccccaggccac

SEQ ID NO: 2165684 - DNA, 15 bp, Homo sapiens
gctgggctctgcctt

SEQ ID NO: 2165685 - DNA, 22 bp, Homo sapiens
ggaagccccctcttcctccctg

SEQ ID NO: 2165686 - DNA, 14 bp, Homo sapiens
ggagaagaatggct

SEQ ID NO: 2165687 - DNA, 15 bp, Homo sapiens
ggagaagaatggctt

SEQ ID NO: 2165688 - DNA, 15 bp, Homo sapiens
ggagaccctccccac

SEQ ID NO: 2165689 - DNA, 21 bp, Homo sapiens
ggaggtgggcaaagggaagta

SEQ ID NO: 2165690 - DNA, 12 bp, Homo sapiens
ggatatttccta

SEQ ID NO: 2165691 - DNA, 17 bp, Homo sapiens
ggatctcacaggctgag

SEQ ID NO: 2165692 - DNA, 17 bp, Homo sapiens
ggatctgctgggctctg

SEQ ID NO: 2165693 - DNA, 11 bp, Homo sapiens
ggatggtttgt

SEQ ID NO: 2165694 - DNA, 21 bp, Homo sapiens
ggcctttatctcaacggaagc

SEQ ID NO: 2165695 - DNA, 19 bp, Homo sapiens
ggcgagttctctttggaaa

SEQ ID NO: 2165696 - DNA, 16 bp, Homo sapiens
ggcttctcctcctctg

SEQ ID NO: 2165697 - DNA, 21 bp, Homo sapiens
gggatatttcctaaggcatgt

SEQ ID NO: 2165698 - DNA, 20 bp, Homo sapiens
gggatggtcggatctcacag

SEQ ID NO: 2165699 - DNA, 14 bp, Homo sapiens
gggcttctcctcct

SEQ ID NO: 2165700 - DNA, 15 bp, Homo sapiens
ggtcttggctgcctg

SEQ ID NO: 2165701 - DNA, 21 bp, Homo sapiens
ggtgggcccagaccactgtct

SEQ ID NO: 2165702 - DNA, 19 bp, Homo sapiens
gtaactattgggtgaatat

SEQ ID NO: 2165703 - DNA, 16 bp, Homo sapiens
gtaagagcaaaagcct

SEQ ID NO: 2165704 - DNA, 18 bp, Homo sapiens
gtaatgacttagaaactg

SEQ ID NO: 2165705 - DNA, 16 bp, Homo sapiens
gtaattacctggagaa

SEQ ID NO: 2165706 - DNA, 17 bp, Homo sapiens
gtaattacctggagaag

SEQ ID NO: 2165707 - DNA, 12 bp, Homo sapiens
gtaattggtaat

SEQ ID NO: 2165708 - DNA, 18 bp, Homo sapiens
gtaattggtaattacctg

SEQ ID NO: 2165709 - DNA, 16 bp, Homo sapiens
gtatttttcaaggcat

SEQ ID NO: 2165710 - DNA, 16 bp, Homo sapiens
gtcccatttttctctt

SEQ ID NO: 2165711 - DNA, 19 bp, Homo sapiens
gtcccatttttctcttgcc

SEQ ID NO: 2165712 - DNA, 14 bp, Homo sapiens
gtcggatctcacag

SEQ ID NO: 2165713 - DNA, 14 bp, Homo sapiens
gtgcagtttctttt

SEQ ID NO: 2165714 - DNA, 21 bp, Homo sapiens
gtgccacccatgcagctgctc

SEQ ID NO: 2165715 - DNA, 14 bp, Homo sapiens
gtgttcatttcatt

SEQ ID NO: 2165716 - DNA, 18 bp, Homo sapiens
gttcatcaccatttcctc

SEQ ID NO: 2165717 - DNA, 20 bp, Homo sapiens
gttcatcaccatttcctcct

SEQ ID NO: 2165718 - DNA, 12 bp, Homo sapiens
gttcatttcatt

SEQ ID NO: 2165719 - DNA, 13 bp, Homo sapiens
gttgttctgcctg

SEQ ID NO: 2165720 - DNA, 17 bp, Homo sapiens
gtttcttctttctagag

SEQ ID NO: 2165721 - DNA, 23 bp, Homo sapiens
gtttcttttcacattaggctgtt

SEQ ID NO: 2165722 - DNA, 21 bp, Homo sapiens
taaaaagaagatgaatggtct

SEQ ID NO: 2165723 - DNA, 21 bp, Homo sapiens
taaaatgtgtatttttcaagg

SEQ ID NO: 2165724 - DNA, 21 bp, Homo sapiens
taaaatgtttggatggtttgt

SEQ ID NO: 2165725 - DNA, 15 bp, Homo sapiens
taaagaaagcagaat

SEQ ID NO: 2165726 - DNA, 17 bp, Homo sapiens
taactattgggtgaata

SEQ ID NO: 2165727 - DNA, 11 bp, Homo sapiens
taatcaagaga

SEQ ID NO: 2165728 - DNA, 13 bp, Homo sapiens
taatcaagagaaa

SEQ ID NO: 2165729 - DNA, 15 bp, Homo sapiens
taatcaagagaaact

SEQ ID NO: 2165730 - DNA, 15 bp, Homo sapiens
taatcatacaaactc

SEQ ID NO: 2165731 - DNA, 18 bp, Homo sapiens
taatcatacaaactctca

SEQ ID NO: 2165732 - DNA, 16 bp, Homo sapiens
taatgacttagaaact

SEQ ID NO: 2165733 - DNA, 17 bp, Homo sapiens
taatgacttagaaactg

SEQ ID NO: 2165734 - DNA, 21 bp, Homo sapiens
taatttagtggatggaatatc

SEQ ID NO: 2165735 - DNA, 23 bp, Homo sapiens
taatttagtggatggaatatcag

SEQ ID NO: 2165736 - DNA, 12 bp, Homo sapiens
tacaaactctca

SEQ ID NO: 2165737 - DNA, 16 bp, Homo sapiens
tacattaacggtgcta

SEQ ID NO: 2165738 - DNA, 15 bp, Homo sapiens
tacctggagaagaat

SEQ ID NO: 2165739 - DNA, 19 bp, Homo sapiens
tacctggagaagaatggct

SEQ ID NO: 2165740 - DNA, 16 bp, Homo sapiens
tagaatccgaagggaa

SEQ ID NO: 2165741 - DNA, 23 bp, Homo sapiens
tagcatgttcctccttttcttca

SEQ ID NO: 2165742 - DNA, 21 bp, Homo sapiens
tagggaatgagagttccttct

SEQ ID NO: 2165743 - DNA, 21 bp, Homo sapiens
tagggactgccaggctgtttc

SEQ ID NO: 2165744 - DNA, 20 bp, Homo sapiens
tagtcccatttttctcttgc

SEQ ID NO: 2165745 - DNA, 15 bp, Homo sapiens
tagtggatggaatat

SEQ ID NO: 2165746 - DNA, 15 bp, Homo sapiens
tatttcctaaggcat

SEQ ID NO: 2165747 - DNA, 22 bp, Homo sapiens
tcaacggaagccccctcttcct

SEQ ID NO: 2165748 - DNA, 12 bp, Homo sapiens
tcaagagaaact

SEQ ID NO: 2165749 - DNA, 22 bp, Homo sapiens
tcaaggatggttttgggactag

SEQ ID NO: 2165750 - DNA, 16 bp, Homo sapiens
tcacaggctgagaact

SEQ ID NO: 2165751 - DNA, 15 bp, Homo sapiens
tcaccatttcctcct

SEQ ID NO: 2165752 - DNA, 16 bp, Homo sapiens
tcagaagtatatctgt

SEQ ID NO: 2165753 - DNA, 20 bp, Homo sapiens
tcaggggctctagggactgc

SEQ ID NO: 2165754 - DNA, 14 bp, Homo sapiens
tcagtggtgggaga

SEQ ID NO: 2165755 - DNA, 15 bp, Homo sapiens
tcatacaaactctca

SEQ ID NO: 2165756 - DNA, 16 bp, Homo sapiens
tcatacaaactctcac

SEQ ID NO: 2165757 - DNA, 18 bp, Homo sapiens
tcatacaaactctcacca

SEQ ID NO: 2165758 - DNA, 15 bp, Homo sapiens
tccaagcatttcatg

SEQ ID NO: 2165759 - DNA, 21 bp, Homo sapiens
tccaagcatttcatgaaaaag

SEQ ID NO: 2165760 - DNA, 23 bp, Homo sapiens
tccattggatctgcaagaacact

SEQ ID NO: 2165761 - DNA, 19 bp, Homo sapiens
tccccacagtgccacccat

SEQ ID NO: 2165762 - DNA, 20 bp, Homo sapiens
tcccttctacaaggactcca

SEQ ID NO: 2165763 - DNA, 15 bp, Homo sapiens
tcctttacctttcag

SEQ ID NO: 2165764 - DNA, 19 bp, Homo sapiens
tccttttcttcaccctccc

SEQ ID NO: 2165765 - DNA, 18 bp, Homo sapiens
tcggatctcacaggctga

SEQ ID NO: 2165766 - DNA, 15 bp, Homo sapiens
tctaacccaagacat

SEQ ID NO: 2165767 - DNA, 20 bp, Homo sapiens
tctatccatctcctggtgtt

SEQ ID NO: 2165768 - DNA, 21 bp, Homo sapiens
tctattaatcaagagaaactt

SEQ ID NO: 2165769 - DNA, 23 bp, Homo sapiens
tctcaatgtcttcccacaaatgg

SEQ ID NO: 2165770 - DNA, 13 bp, Homo sapiens
tctcacaggctga

SEQ ID NO: 2165771 - DNA, 17 bp, Homo sapiens
tctcctcctctgtcttt

SEQ ID NO: 2165772 - DNA, 21 bp, Homo sapiens
tctcttgccatttgtagcttt

SEQ ID NO: 2165773 - DNA, 14 bp, Homo sapiens
tctctttggaaata

SEQ ID NO: 2165774 - DNA, 18 bp, Homo sapiens
tctctttggaaatagcat

SEQ ID NO: 2165775 - DNA, 23 bp, Homo sapiens
tctgcctggagacaaggtgctaa

SEQ ID NO: 2165776 - DNA, 23 bp, Homo sapiens
tctgccttaaacacacattgcag

SEQ ID NO: 2165777 - DNA, 15 bp, Homo sapiens
tctgctaaataaaca

SEQ ID NO: 2165778 - DNA, 17 bp, Homo sapiens
tctgctgggctctgcct

SEQ ID NO: 2165779 - DNA, 15 bp, Homo sapiens
tctggcaatattctg

SEQ ID NO: 2165780 - DNA, 13 bp, Homo sapiens
tctggggctgtgt

SEQ ID NO: 2165781 - DNA, 19 bp, Homo sapiens
tctgtcttttggagaacca

SEQ ID NO: 2165782 - DNA, 20 bp, Homo sapiens
tcttattaatcatacaaact

SEQ ID NO: 2165783 - DNA, 16 bp, Homo sapiens
tcttcaccctcccctt

SEQ ID NO: 2165784 - DNA, 10 bp, Homo sapiens
tcttctatta

SEQ ID NO: 2165785 - DNA, 19 bp, Homo sapiens
tcttggctgcctgtgggct

SEQ ID NO: 2165786 - DNA, 22 bp, Homo sapiens
tgaaaattctaacccaagacat

SEQ ID NO: 2165787 - DNA, 15 bp, Homo sapiens
tgaagagtttcacaa

SEQ ID NO: 2165788 - DNA, 12 bp, Homo sapiens
tgacaggctgtt

SEQ ID NO: 2165789 - DNA, 23 bp, Homo sapiens
tgagaactcgttcacctccaagc

SEQ ID NO: 2165790 - DNA, 15 bp, Homo sapiens
tgagagttccttctc

SEQ ID NO: 2165791 - DNA, 22 bp, Homo sapiens
tgagagttccttctcacttaga

SEQ ID NO: 2165792 - DNA, 19 bp, Homo sapiens
tgatgtgaagagtttcaca

SEQ ID NO: 2165793 - DNA, 12 bp, Homo sapiens
tgcagctgctcc

SEQ ID NO: 2165794 - DNA, 15 bp, Homo sapiens
tgcagctgctcccca

SEQ ID NO: 2165795 - DNA, 15 bp, Homo sapiens
tgcagggcttctcct

SEQ ID NO: 2165796 - DNA, 15 bp, Homo sapiens
tgcagtttcttttca

SEQ ID NO: 2165797 - DNA, 18 bp, Homo sapiens
tgccatattaaaatctga

SEQ ID NO: 2165798 - DNA, 21 bp, Homo sapiens
tgccgccagctgccgcaccag

SEQ ID NO: 2165799 - DNA, 18 bp, Homo sapiens
tgctccccaggccacccc

SEQ ID NO: 2165800 - DNA, 14 bp, Homo sapiens
tgctttgcattact

SEQ ID NO: 2165801 - DNA, 20 bp, Homo sapiens
tggacctttgggttctttct

SEQ ID NO: 2165802 - DNA, 17 bp, Homo sapiens
tggagacaaggtgctaa

SEQ ID NO: 2165803 - DNA, 21 bp, Homo sapiens
tggagccccaccttgtctgct

SEQ ID NO: 2165804 - DNA, 13 bp, Homo sapiens
tggccaagcagaa

SEQ ID NO: 2165805 - DNA, 22 bp, Homo sapiens
tggcgagttctctttggaaata

SEQ ID NO: 2165806 - DNA, 22 bp, Homo sapiens
tgggaacagtaaagaaagcaga

SEQ ID NO: 2165807 - DNA, 19 bp, Homo sapiens
tgggatggtcggatctcac

SEQ ID NO: 2165808 - DNA, 20 bp, Homo sapiens
tgggatggtcggatctcaca

SEQ ID NO: 2165809 - DNA, 21 bp, Homo sapiens
tgggatggtcggatctcacag

SEQ ID NO: 2165810 - DNA, 21 bp, Homo sapiens
tgggcccagaccactgtctcc

SEQ ID NO: 2165811 - DNA, 22 bp, Homo sapiens
tgggcttccccaggtggcctgg

SEQ ID NO: 2165812 - DNA, 12 bp, Homo sapiens
tgggttctttct

SEQ ID NO: 2165813 - DNA, 22 bp, Homo sapiens
tggtgggcccagaccactgtct

SEQ ID NO: 2165814 - DNA, 19 bp, Homo sapiens
tggtttgcctgaggctgta

SEQ ID NO: 2165815 - DNA, 19 bp, Homo sapiens
tgtatctttgtaagagcaa

SEQ ID NO: 2165816 - DNA, 20 bp, Homo sapiens
tgtcagttctctgggaagtg

SEQ ID NO: 2165817 - DNA, 21 bp, Homo sapiens
tgtcctttggtactatggtgt

SEQ ID NO: 2165818 - DNA, 22 bp, Homo sapiens
tgtctcaaaggagctttctcaa

SEQ ID NO: 2165819 - DNA, 17 bp, Homo sapiens
tgtctgctaaataaaca

SEQ ID NO: 2165820 - DNA, 19 bp, Homo sapiens
tgtggcctttatctcaacg

SEQ ID NO: 2165821 - DNA, 14 bp, Homo sapiens
tgtgttcatttcat

SEQ ID NO: 2165822 - DNA, 17 bp, Homo sapiens
ttaaaatgtttggatgg

SEQ ID NO: 2165823 - DNA, 14 bp, Homo sapiens
ttaaccctcccctt

SEQ ID NO: 2165824 - DNA, 15 bp, Homo sapiens
ttaacggtgctaaaa

SEQ ID NO: 2165825 - DNA, 19 bp, Homo sapiens
ttaatcaagagaaacttca

SEQ ID NO: 2165826 - DNA, 15 bp, Homo sapiens
ttaggctgttggttc

SEQ ID NO: 2165827 - DNA, 16 bp, Homo sapiens
ttagtggatggaatat

SEQ ID NO: 2165828 - DNA, 14 bp, Homo sapiens
ttatctcaacggaa

SEQ ID NO: 2165829 - DNA, 21 bp, Homo sapiens
ttcacctccaagcatttcatg

SEQ ID NO: 2165830 - DNA, 22 bp, Homo sapiens
ttcatgaaaaagctgcttctta

SEQ ID NO: 2165831 - DNA, 16 bp, Homo sapiens
ttccacacgcattaat

SEQ ID NO: 2165832 - DNA, 19 bp, Homo sapiens
ttcctccctgggggcccca

SEQ ID NO: 2165833 - DNA, 17 bp, Homo sapiens
ttccttctcacttagaa

SEQ ID NO: 2165834 - DNA, 13 bp, Homo sapiens
ttctacaaggact

SEQ ID NO: 2165835 - DNA, 14 bp, Homo sapiens
ttctacaaggactc

SEQ ID NO: 2165836 - DNA, 16 bp, Homo sapiens
ttctacaaggactcca

SEQ ID NO: 2165837 - DNA, 22 bp, Homo sapiens
ttctattaatcaagagaaactt

SEQ ID NO: 2165838 - DNA, 15 bp, Homo sapiens
ttctctttggaaata

SEQ ID NO: 2165839 - DNA, 19 bp, Homo sapiens
ttcttagctgtaacttaac

SEQ ID NO: 2165840 - DNA, 13 bp, Homo sapiens
ttcttctttctag

SEQ ID NO: 2165841 - DNA, 15 bp, Homo sapiens
ttgacgtttcttctt

SEQ ID NO: 2165842 - DNA, 19 bp, Homo sapiens
ttgacgtttcttctttcta

SEQ ID NO: 2165843 - DNA, 18 bp, Homo sapiens
ttgagggagctgggagac

SEQ ID NO: 2165844 - DNA, 15 bp, Homo sapiens
ttggccaagcagaaa

SEQ ID NO: 2165845 - DNA, 17 bp, Homo sapiens
ttgtaaaatagaaaaag

SEQ ID NO: 2165846 - DNA, 18 bp, Homo sapiens
ttgtaaaatagaaaaagt

SEQ ID NO: 2165847 - DNA, 21 bp, Homo sapiens
tttcaaggcatttattgccat

SEQ ID NO: 2165848 - DNA, 17 bp, Homo sapiens
tttcaatacccttttaa

SEQ ID NO: 2165849 - DNA, 20 bp, Homo sapiens
tttcacaaatccttcaaaat

SEQ ID NO: 2165850 - DNA, 21 bp, Homo sapiens
tttctggggggatatttccta

SEQ ID NO: 2165851 - DNA, 14 bp, Homo sapiens
tttggatggtttgt

SEQ ID NO: 2165852 - DNA, 21 bp, Homo sapiens
ttttaagtttaaaatgtgtat

SEQ ID NO: 2165853 - DNA, 23 bp, Homo sapiens
tttttcaaggcatttattgccat

SEQ ID NO: 2165854 - DNA, 17 bp, Homo sapiens
cattaacggtgctaaaa

SEQ ID NO: 2165855 - DNA, 11 bp, Homo sapiens
cattctcacat

SEQ ID NO: 2165856 - DNA, 14 bp, Homo sapiens
cattggatctgcaa

SEQ ID NO: 2165857 - DNA, 17 bp, Homo sapiens
catttcatgaaaaagct

SEQ ID NO: 2165858 - DNA, 20 bp, Homo sapiens
catttcatgaaaaagctgct

SEQ ID NO: 2165859 - DNA, 21 bp, Homo sapiens
catttcatgaaaaagctgctt

SEQ ID NO: 2165860 - DNA, 14 bp, Homo sapiens
ccacagtgccaccc

SEQ ID NO: 2165861 - DNA, 20 bp, Homo sapiens
ccaccttgacgtttcttctt

SEQ ID NO: 2165862 - DNA, 23 bp, Homo sapiens
ccaggaaggccaaaatcaagagt

SEQ ID NO: 2165863 - DNA, 19 bp, Homo sapiens
ccagttcatcaccatttcc

SEQ ID NO: 2165864 - DNA, 14 bp, Homo sapiens
ccatattaaaatct

SEQ ID NO: 2165865 - DNA, 15 bp, Homo sapiens
ccatgcagctgctcc

SEQ ID NO: 2165866 - DNA, 17 bp, Homo sapiens
ccatgcagctgctcccc

SEQ ID NO: 2165867 - DNA, 14 bp, Homo sapiens
cccaatgtttaaaa

SEQ ID NO: 2165868 - DNA, 17 bp, Homo sapiens
cccagaccactgtctcc

SEQ ID NO: 2165869 - DNA, 15 bp, Homo sapiens
cccaggtggcctgga

SEQ ID NO: 2165870 - DNA, 13 bp, Homo sapiens
cccatttttctct

SEQ ID NO: 2165871 - DNA, 16 bp, Homo sapiens
cccctcttcctccctg

SEQ ID NO: 2165872 - DNA, 16 bp, Homo sapiens
cccgctgatggagccc

SEQ ID NO: 2165873 - DNA, 16 bp, Homo sapiens
ccctcttcctccctgg

SEQ ID NO: 2165874 - DNA, 21 bp, Homo sapiens
ccgcaccagcccgaacaccat

SEQ ID NO: 2165875 - DNA, 17 bp, Homo sapiens
ccgccagctgccgcacc

SEQ ID NO: 2165876 - DNA, 17 bp, Homo sapiens
cctccaagcatttcatg

SEQ ID NO: 2165877 - DNA, 17 bp, Homo sapiens
cctccctgggggcccca

SEQ ID NO: 2165878 - DNA, 20 bp, Homo sapiens
cctggagacaaggtgctaac

SEQ ID NO: 2165879 - DNA, 12 bp, Homo sapiens
cctgtgggcttc

SEQ ID NO: 2165880 - DNA, 20 bp, Homo sapiens
ccttaggggtaattggtaat

SEQ ID NO: 2165881 - DNA, 22 bp, Homo sapiens
ccttgatataaaaaatctttag

SEQ ID NO: 2165882 - DNA, 22 bp, Homo sapiens
cctttcagtgcagtttcttttc

SEQ ID NO: 2165883 - DNA, 16 bp, Homo sapiens
ccttttccacacgcat

SEQ ID NO: 2165884 - DNA, 20 bp, Homo sapiens
cgcaccagcccgaacaccat

SEQ ID NO: 2165885 - DNA, 15 bp, Homo sapiens
cgccagctgccgcac

SEQ ID NO: 2165886 - DNA, 14 bp, Homo sapiens
cgctgatggagccc

SEQ ID NO: 2165887 - DNA, 14 bp, Homo sapiens
cggttgttctttcc

SEQ ID NO: 2165888 - DNA, 10 bp, Homo sapiens
cgtggtttgc

SEQ ID NO: 2165889 - DNA, 19 bp, Homo sapiens
cgtggtttgcctgaggctg

SEQ ID NO: 2165890 - DNA, 23 bp, Homo sapiens
cgttcacctccaagcatttcatg

SEQ ID NO: 2165891 - DNA, 23 bp, Homo sapiens
ctaacccaagacatgacattctt

SEQ ID NO: 2165892 - DNA, 16 bp, Homo sapiens
ctatccatctcctggt

SEQ ID NO: 2165893 - DNA, 20 bp, Homo sapiens
ctattaatcaagagaaactt

SEQ ID NO: 2165894 - DNA, 15 bp, Homo sapiens
ctcaaaggagctttc

SEQ ID NO: 2165895 - DNA, 17 bp, Homo sapiens
ctcaaaggagctttctc

SEQ ID NO: 2165896 - DNA, 18 bp, Homo sapiens
ctcaaaggagctttctca

SEQ ID NO: 2165897 - DNA, 14 bp, Homo sapiens
ctcaatgtcttccc

SEQ ID NO: 2165898 - DNA, 16 bp, Homo sapiens
ctcaatgtcttcccac

SEQ ID NO: 2165899 - DNA, 12 bp, Homo sapiens
ctcacaggctga

SEQ ID NO: 2165900 - DNA, 21 bp, Homo sapiens
ctcacataagcccagttcatc

SEQ ID NO: 2165901 - DNA, 16 bp, Homo sapiens
ctcaggggctctaggg

SEQ ID NO: 2165902 - DNA, 14 bp, Homo sapiens
ctccaagcatttca

SEQ ID NO: 2165903 - DNA, 15 bp, Homo sapiens
ctccaagcatttcat

SEQ ID NO: 2165904 - DNA, 22 bp, Homo sapiens
ctccaagcatttcatgaaaaag

SEQ ID NO: 2165905 - DNA, 22 bp, Homo sapiens
ctcccctcctggcgagttctct

SEQ ID NO: 2165906 - DNA, 18 bp, Homo sapiens
ctcctggcgagttctctt

SEQ ID NO: 2165907 - DNA, 17 bp, Homo sapiens
ctctctttaaccctccc

SEQ ID NO: 2165908 - DNA, 15 bp, Homo sapiens
ctctttaaccctccc

SEQ ID NO: 2165909 - DNA, 17 bp, Homo sapiens
ctctttagtgttctgtt

SEQ ID NO: 2165910 - DNA, 13 bp, Homo sapiens
ctctttggaaata

SEQ ID NO: 2165911 - DNA, 18 bp, Homo sapiens
ctgacttaactttaactt

SEQ ID NO: 2165912 - DNA, 20 bp, Homo sapiens
ctgagaactcgttcacctcc

SEQ ID NO: 2165913 - DNA, 15 bp, Homo sapiens
ctgatggagccccac

SEQ ID NO: 2165914 - DNA, 17 bp, Homo sapiens
ctgatggagccccacct

SEQ ID NO: 2165915 - DNA, 12 bp, Homo sapiens
ctgcagaaccca

SEQ ID NO: 2165916 - DNA, 15 bp, Homo sapiens
ctgcagaacccacca

SEQ ID NO: 2165917 - DNA, 21 bp, Homo sapiens
ctgcagtcatctcccctcctg

SEQ ID NO: 2165918 - DNA, 14 bp, Homo sapiens
ctgccaggctgttt

SEQ ID NO: 2165919 - DNA, 13 bp, Homo sapiens
ctgcctgtgggct

SEQ ID NO: 2165920 - DNA, 15 bp, Homo sapiens
ctgcctgtgggcttc

SEQ ID NO: 2165921 - DNA, 17 bp, Homo sapiens
ctgccttaaacacacat

SEQ ID NO: 2165922 - DNA, 17 bp, Homo sapiens
ctgctccccaggccacc

SEQ ID NO: 2165923 - DNA, 13 bp, Homo sapiens
ctgctgggctctg

SEQ ID NO: 2165924 - DNA, 22 bp, Homo sapiens
ctggacctttgggttctttctg

SEQ ID NO: 2165925 - DNA, 17 bp, Homo sapiens
ctggagacaaggtgcta

SEQ ID NO: 2165926 - DNA, 18 bp, Homo sapiens
ctggagacaaggtgctaa

SEQ ID NO: 2165927 - DNA, 22 bp, Homo sapiens
ctggcgagttctctttggaaat

SEQ ID NO: 2165928 - DNA, 14 bp, Homo sapiens
ctgtaactgagaga

SEQ ID NO: 2165929 - DNA, 17 bp, Homo sapiens
ctgtaactgagagaaag

SEQ ID NO: 2165930 - DNA, 15 bp, Homo sapiens
ctgtgggcttcccca

SEQ ID NO: 2165931 - DNA, 23 bp, Homo sapiens
cttaactattaaggccttttcca

SEQ ID NO: 2165932 - DNA, 13 bp, Homo sapiens
cttaactttaact

SEQ ID NO: 2165933 - DNA, 11 bp, Homo sapiens
cttagaaactg

SEQ ID NO: 2165934 - DNA, 14 bp, Homo sapiens
cttcctccctgggg

SEQ ID NO: 2165935 - DNA, 19 bp, Homo sapiens
cttctcctcctctgtcttt

SEQ ID NO: 2165936 - DNA, 16 bp, Homo sapiens
cttgccatttgtagct

SEQ ID NO: 2165937 - DNA, 18 bp, Homo sapiens
cttgccatttgtagcttt

SEQ ID NO: 2165938 - DNA, 19 bp, Homo sapiens
ctttagtgttctgtttgaa

SEQ ID NO: 2165939 - DNA, 21 bp, Homo sapiens
ctttcagtgcagtttcttttc

SEQ ID NO: 2165940 - DNA, 22 bp, Homo sapiens
ctttcagtgcagtttcttttca

SEQ ID NO: 2165941 - DNA, 13 bp, Homo sapiens
ctttcctcacatt

SEQ ID NO: 2165942 - DNA, 23 bp, Homo sapiens
ctttctggggggatatttcctaa

SEQ ID NO: 2165943 - DNA, 19 bp, Homo sapiens
ctttgggttctttctgggg

SEQ ID NO: 2165944 - DNA, 17 bp, Homo sapiens
cttttgaaaagaccaag

SEQ ID NO: 2165945 - DNA, 17 bp, Homo sapiens
gaaaaagctgcttctta

SEQ ID NO: 2165946 - DNA, 21 bp, Homo sapiens
gaaaattctaacccaagacat

SEQ ID NO: 2165947 - DNA, 22 bp, Homo sapiens
gaagatgaatggtctggcaata

SEQ ID NO: 2165948 - DNA, 19 bp, Homo sapiens
gaaggccaaaatcaagagt

SEQ ID NO: 2165949 - DNA, 19 bp, Homo sapiens
gaataaaattcctatctca

SEQ ID NO: 2165950 - DNA, 21 bp, Homo sapiens
gaatacattaacggtgctaaa

SEQ ID NO: 2165951 - DNA, 14 bp, Homo sapiens
gaatccgaagggaa

SEQ ID NO: 2165952 - DNA, 16 bp, Homo sapiens
gaattaaaaagaagat

SEQ ID NO: 2165953 - DNA, 13 bp, Homo sapiens
gacattctcacat

SEQ ID NO: 2165954 - DNA, 22 bp, Homo sapiens
gaccactgtctccacccacctt

SEQ ID NO: 2165955 - DNA, 22 bp, Homo sapiens
gaccctccccacagtgccaccc

SEQ ID NO: 2165956 - DNA, 22 bp, Homo sapiens
gacttaactttaacttttgaaa

SEQ ID NO: 2165957 - DNA, 20 bp, Homo sapiens
gactttgtgttcatttcatt

SEQ ID NO: 2165958 - DNA, 14 bp, Homo sapiens
gagaaacttcaaag

SEQ ID NO: 2165959 - DNA, 15 bp, Homo sapiens
gagatgtagaaagtt

SEQ ID NO: 2165960 - DNA, 14 bp, Homo sapiens
gagctttctcaatg

SEQ ID NO: 2165961 - DNA, 13 bp, Homo sapiens
gagggagctggga

SEQ ID NO: 2165962 - DNA, 19 bp, Homo sapiens
gagtgagatgtagaaagtt

SEQ ID NO: 2165963 - DNA, 16 bp, Homo sapiens
gatctcacaggctgag

SEQ ID NO: 2165964 - DNA, 22 bp, Homo sapiens
gatctgcaagaacactggacct

SEQ ID NO: 2165965 - DNA, 16 bp, Homo sapiens
gattctctctttaacc

SEQ ID NO: 2165966 - DNA, 17 bp, Homo sapiens
gatttaagtgaatacat

SEQ ID NO: 2165967 - DNA, 19 bp, Homo sapiens
gatttaagtgaatacatta

SEQ ID NO: 2165968 - DNA, 21 bp, Homo sapiens
gcagcttcaacttttctcttt

SEQ ID NO: 2165969 - DNA, 13 bp, Homo sapiens
gcagggcttctcc

SEQ ID NO: 2165970 - DNA, 18 bp, Homo sapiens
gcagttggccaagcagaa

SEQ ID NO: 2165971 - DNA, 21 bp, Homo sapiens
gccacccatgcagctgctccc

SEQ ID NO: 2165972 - DNA, 18 bp, Homo sapiens
gcccagttcatcaccatt

SEQ ID NO: 2165973 - DNA, 17 bp, Homo sapiens
gccccaccttgtctgct

SEQ ID NO: 2165974 - DNA, 11 bp, Homo sapiens
gccgccagctg

SEQ ID NO: 2165975 - DNA, 13 bp, Homo sapiens
gcctgaggctgta

SEQ ID NO: 2165976 - DNA, 20 bp, Homo sapiens
gcctggagacaaggtgctaa

SEQ ID NO: 2165977 - DNA, 14 bp, Homo sapiens
tataaaaaatcttt

SEQ ID NO: 2165978 - DNA, 21 bp, Homo sapiens
tatgaaaatatagacattctc

SEQ ID NO: 2165979 - DNA, 22 bp, Homo sapiens
tatgaaaatatagacattctca

SEQ ID NO: 2165980 - DNA, 19 bp, Homo sapiens
tattaatcaagagaaactt

SEQ ID NO: 2165981 - DNA, 20 bp, Homo sapiens
tattaatcaagagaaacttc

SEQ ID NO: 2165982 - DNA, 16 bp, Homo sapiens
tcaaaggagctttctc

SEQ ID NO: 2165983 - DNA, 16 bp, Homo sapiens
tcaagaaaaaaaggga

SEQ ID NO: 2165984 - DNA, 13 bp, Homo sapiens
tcaagagaaactt

SEQ ID NO: 2165985 - DNA, 15 bp, Homo sapiens
tcaagagaaacttca

SEQ ID NO: 2165986 - DNA, 14 bp, Homo sapiens
tcaatgtcttccca

SEQ ID NO: 2165987 - DNA, 15 bp, Homo sapiens
tcaatgtcttcccac

SEQ ID NO: 2165988 - DNA, 15 bp, Homo sapiens
tcacaggctgagaac

SEQ ID NO: 2165989 - DNA, 18 bp, Homo sapiens
tcaccatccaccttccct

SEQ ID NO: 2165990 - DNA, 17 bp, Homo sapiens
tcagaagtatatctgta

SEQ ID NO: 2165991 - DNA, 22 bp, Homo sapiens
tcagactttgtgttcatttcat

SEQ ID NO: 2165992 - DNA, 13 bp, Homo sapiens
tcagtgcagtttc

SEQ ID NO: 2165993 - DNA, 14 bp, Homo sapiens
tcagtgcagtttct

SEQ ID NO: 2165994 - DNA, 14 bp, Homo sapiens
tcatcaccatttcc

SEQ ID NO: 2165995 - DNA, 13 bp, Homo sapiens
tcatctcccctcc

SEQ ID NO: 2165996 - DNA, 14 bp, Homo sapiens
tccaagcatttcat

SEQ ID NO: 2165997 - DNA, 15 bp, Homo sapiens
tccatacttctctca

SEQ ID NO: 2165998 - DNA, 14 bp, Homo sapiens
tccccaggccaccc

SEQ ID NO: 2165999 - DNA, 22 bp, Homo sapiens
tccgaagggaattaaaaagaag

SEQ ID NO: 2166000 - DNA, 12 bp, Homo sapiens
tcctaaggcatg

SEQ ID NO: 2166001 - DNA, 22 bp, Homo sapiens
tcctccttttcttcaccctccc

SEQ ID NO: 2166002 - DNA, 15 bp, Homo sapiens
tcctgcagggcttct

SEQ ID NO: 2166003 - DNA, 19 bp, Homo sapiens
tcctgcagggcttctcctc

SEQ ID NO: 2166004 - DNA, 17 bp, Homo sapiens
tcctttacctttcagtg

SEQ ID NO: 2166005 - DNA, 15 bp, Homo sapiens
tctacaaggactcca

SEQ ID NO: 2166006 - DNA, 23 bp, Homo sapiens
tctagggactgccaggctgtttc

SEQ ID NO: 2166007 - DNA, 23 bp, Homo sapiens
tctattaatcaagagaaacttca

SEQ ID NO: 2166008 - DNA, 11 bp, Homo sapiens
tctcaaaggag

SEQ ID NO: 2166009 - DNA, 14 bp, Homo sapiens
tctcaaaggagctt

SEQ ID NO: 2166010 - DNA, 18 bp, Homo sapiens
tctcacaggctgagaact

SEQ ID NO: 2166011 - DNA, 19 bp, Homo sapiens
tctcacaggctgagaactc

SEQ ID NO: 2166012 - DNA, 16 bp, Homo sapiens
tctgctaaataaacat

SEQ ID NO: 2166013 - DNA, 23 bp, Homo sapiens
tctggggctgtgttatgaaaata

SEQ ID NO: 2166014 - DNA, 17 bp, Homo sapiens
tctgtacagatcaagaa

SEQ ID NO: 2166015 - DNA, 19 bp, Homo sapiens
tcttctattaatcaagaga

SEQ ID NO: 2166016 - DNA, 16 bp, Homo sapiens
tctttggaaatagcat

SEQ ID NO: 2166017 - DNA, 17 bp, Homo sapiens
tctttgtaagagcaaaa

SEQ ID NO: 2166018 - DNA, 13 bp, Homo sapiens
tcttttcacatta

SEQ ID NO: 2166019 - DNA, 16 bp, Homo sapiens
tgaaaaagctgcttct

SEQ ID NO: 2166020 - DNA, 22 bp, Homo sapiens
tgaaaatatagacattctcaca

SEQ ID NO: 2166021 - DNA, 23 bp, Homo sapiens
tgaatacattaacggtgctaaaa

SEQ ID NO: 2166022 - DNA, 18 bp, Homo sapiens
tgacgtttcttctttcta

SEQ ID NO: 2166023 - DNA, 21 bp, Homo sapiens
tgacttaactttaacttttga

SEQ ID NO: 2166024 - DNA, 14 bp, Homo sapiens
tgacttagaaactg

SEQ ID NO: 2166025 - DNA, 18 bp, Homo sapiens
tgagagttccttctcact

SEQ ID NO: 2166026 - DNA, 19 bp, Homo sapiens
tgagagttccttctcactt

SEQ ID NO: 2166027 - DNA, 14 bp, Homo sapiens
tgatcaagtggttt

SEQ ID NO: 2166028 - DNA, 14 bp, Homo sapiens
tgatggagccccac

SEQ ID NO: 2166029 - DNA, 22 bp, Homo sapiens
tgatggagccccaccttgtctg

SEQ ID NO: 2166030 - DNA, 20 bp, Homo sapiens
tgcagcttcaacttttctct

SEQ ID NO: 2166031 - DNA, 17 bp, Homo sapiens
tgcagtttcttttcaca

SEQ ID NO: 2166032 - DNA, 12 bp, Homo sapiens
tgccaggctgtt

SEQ ID NO: 2166033 - DNA, 16 bp, Homo sapiens
tgccgccagctgccgc

SEQ ID NO: 2166034 - DNA, 23 bp, Homo sapiens
tgccgccagctgccgcaccagcc

SEQ ID NO: 2166035 - DNA, 19 bp, Homo sapiens
tgcctggagacaaggtgct

SEQ ID NO: 2166036 - DNA, 20 bp, Homo sapiens
tgcctggagacaaggtgcta

SEQ ID NO: 2166037 - DNA, 13 bp, Homo sapiens
tgctaaataaaca

SEQ ID NO: 2166038 - DNA, 24 bp, Homo sapiens
tgctaaataaacatgtgccctcag

SEQ ID NO: 2166039 - DNA, 16 bp, Homo sapiens
tgctccccaggccacc

SEQ ID NO: 2166040 - DNA, 16 bp, Homo sapiens
tggaaatagcatgaca

SEQ ID NO: 2166041 - DNA, 20 bp, Homo sapiens
tggagacaaggtgctaacat

SEQ ID NO: 2166042 - DNA, 13 bp, Homo sapiens
tggagccccacct

SEQ ID NO: 2166043 - DNA, 17 bp, Homo sapiens
tggatggaatatcagaa

SEQ ID NO: 2166044 - DNA, 12 bp, Homo sapiens
tggatggtttgt

SEQ ID NO: 2166045 - DNA, 17 bp, Homo sapiens
tggggacgtgtgtcctt

SEQ ID NO: 2166046 - DNA, 20 bp, Homo sapiens
tggggacgtgtgtcctttgg

SEQ ID NO: 2166047 - DNA, 20 bp, Homo sapiens
tggtcggatctcacaggctg

SEQ ID NO: 2166048 - DNA, 18 bp, Homo sapiens
tgtctcaaaggagctttc

SEQ ID NO: 2166049 - DNA, 18 bp, Homo sapiens
tgtctccacccaccttga

SEQ ID NO: 2166050 - DNA, 18 bp, Homo sapiens
tgtctgctaaataaacat

SEQ ID NO: 2166051 - DNA, 17 bp, Homo sapiens
tgttggttcaaactttt

SEQ ID NO: 2166052 - DNA, 15 bp, Homo sapiens
tgttgtatctttgta

SEQ ID NO: 2166053 - DNA, 13 bp, Homo sapiens
ttaacggtgctaa

SEQ ID NO: 2166054 - DNA, 14 bp, Homo sapiens
ttaacggtgctaaa

SEQ ID NO: 2166055 - DNA, 19 bp, Homo sapiens
ttaagtgaatacattaacg

SEQ ID NO: 2166056 - DNA, 16 bp, Homo sapiens
ttaatcaagagaaact

SEQ ID NO: 2166057 - DNA, 15 bp, Homo sapiens
ttaatcatacaaact

SEQ ID NO: 2166058 - DNA, 21 bp, Homo sapiens
ttaatcatacaaactctcacc

SEQ ID NO: 2166059 - DNA, 19 bp, Homo sapiens
ttactgtccccttgatata

SEQ ID NO: 2166060 - DNA, 10 bp, Homo sapiens
ttagaaactg

SEQ ID NO: 2166061 - DNA, 15 bp, Homo sapiens
ttcaaaataaaaagt

SEQ ID NO: 2166062 - DNA, 14 bp, Homo sapiens
ttcaaggcatttat

SEQ ID NO: 2166063 - DNA, 14 bp, Homo sapiens
ttccatacttctct

SEQ ID NO: 2166064 - DNA, 15 bp, Homo sapiens
ttccatacttctctc

SEQ ID NO: 2166065 - DNA, 15 bp, Homo sapiens
ttcctccctgggggc

SEQ ID NO: 2166066 - DNA, 18 bp, Homo sapiens
ttcctcctttacctttca

SEQ ID NO: 2166067 - DNA, 23 bp, Homo sapiens
ttctctttggaaatagcatgaca

SEQ ID NO: 2166068 - DNA, 19 bp, Homo sapiens
ttctgcagtcatctcccct

SEQ ID NO: 2166069 - DNA, 19 bp, Homo sapiens
ttctggggggatatttcct

SEQ ID NO: 2166070 - DNA, 15 bp, Homo sapiens
ttcttctttctagag

SEQ ID NO: 2166071 - DNA, 21 bp, Homo sapiens
ttcttttcacattaggctgtt

SEQ ID NO: 2166072 - DNA, 20 bp, Homo sapiens
ttgacgtttcttctttctag

SEQ ID NO: 2166073 - DNA, 15 bp, Homo sapiens
ttgcctgaggctgta

SEQ ID NO: 2166074 - DNA, 22 bp, Homo sapiens
ttggagaaccagggctcttctc

SEQ ID NO: 2166075 - DNA, 16 bp, Homo sapiens
ttgttctgcctggaga

SEQ ID NO: 2166076 - DNA, 22 bp, Homo sapiens
tttaacttttgaaaagaccaag

SEQ ID NO: 2166077 - DNA, 22 bp, Homo sapiens
tttagcatgttcctccttttct

SEQ ID NO: 2166078 - DNA, 17 bp, Homo sapiens
tttagtggatggaatat

SEQ ID NO: 2166079 - DNA, 17 bp, Homo sapiens
tttcacattaggctgtt

SEQ ID NO: 2166080 - DNA, 16 bp, Homo sapiens
tttgcctgaggctgta

SEQ ID NO: 2166081 - DNA, 16 bp, Homo sapiens
tttgggttctttctgg

SEQ ID NO: 2166082 - DNA, 14 bp, Homo sapiens
ttttcaaggcattt

SEQ ID NO: 2166083 - DNA, 15 bp, Homo sapiens
aataaaattcctatc

SEQ ID NO: 2166084 - DNA, 19 bp, Homo sapiens
aatacattaacggtgctaa

SEQ ID NO: 2166085 - DNA, 19 bp, Homo sapiens
aatatagacattctcacat

SEQ ID NO: 2166086 - DNA, 15 bp, Homo sapiens
aatcaagagaaactt

SEQ ID NO: 2166087 - DNA, 10 bp, Homo sapiens
aatcaagagt

SEQ ID NO: 2166088 - DNA, 14 bp, Homo sapiens
aatcatacaaactc

SEQ ID NO: 2166089 - DNA, 21 bp, Homo sapiens
aatcatacaaactctcaccat

SEQ ID NO: 2166090 - DNA, 19 bp, Homo sapiens
aatgagagttccttctcac

SEQ ID NO: 2166091 - DNA, 18 bp, Homo sapiens
aatggtcccaattaagaa

SEQ ID NO: 2166092 - DNA, 21 bp, Homo sapiens
aatggtcccaattaagaaatt

SEQ ID NO: 2166093 - DNA, 16 bp, Homo sapiens
aattaagaaattccat

SEQ ID NO: 2166094 - DNA, 17 bp, Homo sapiens
aattccatacttctctc

SEQ ID NO: 2166095 - DNA, 21 bp, Homo sapiens
aattctaacccaagacatgac

SEQ ID NO: 2166096 - DNA, 16 bp, Homo sapiens
acaaactctcaccatg

SEQ ID NO: 2166097 - DNA, 9 bp, Homo sapiens
acaaggact

SEQ ID NO: 2166098 - DNA, 10 bp, Homo sapiens
acaaggactc

SEQ ID NO: 2166099 - DNA, 19 bp, Homo sapiens
acaaggtgctaacatagat

SEQ ID NO: 2166100 - DNA, 21 bp, Homo sapiens
acacggatctgctgggctctg

SEQ ID NO: 2166101 - DNA, 15 bp, Homo sapiens
acaggctgagaactc

SEQ ID NO: 2166102 - DNA, 20 bp, Homo sapiens
acaggtgccgccagctgccg

SEQ ID NO: 2166103 - DNA, 14 bp, Homo sapiens
acattaacggtgct

SEQ ID NO: 2166104 - DNA, 17 bp, Homo sapiens
acattaacggtgctaaa

SEQ ID NO: 2166105 - DNA, 18 bp, Homo sapiens
acattaacggtgctaaaa

SEQ ID NO: 2166106 - DNA, 12 bp, Homo sapiens
acattctcacat

SEQ ID NO: 2166107 - DNA, 21 bp, Homo sapiens
accagaacgtggtttgcctga

SEQ ID NO: 2166108 - DNA, 23 bp, Homo sapiens
accccgctgatggagccccacct

SEQ ID NO: 2166109 - DNA, 22 bp, Homo sapiens
accctccccacagtgccaccca

SEQ ID NO: 2166110 - DNA, 17 bp, Homo sapiens
acctccaagcatttcat

SEQ ID NO: 2166111 - DNA, 18 bp, Homo sapiens
acctccaagcatttcatg

SEQ ID NO: 2166112 - DNA, 20 bp, Homo sapiens
accttgacgtttcttctttc

SEQ ID NO: 2166113 - DNA, 17 bp, Homo sapiens
acctttgggttctttct

SEQ ID NO: 2166114 - DNA, 18 bp, Homo sapiens
acctttgggttctttctg

SEQ ID NO: 2166115 - DNA, 19 bp, Homo sapiens
acctttgggttctttctgg

SEQ ID NO: 2166116 - DNA, 18 bp, Homo sapiens
acggaagccccctcttcc

SEQ ID NO: 2166117 - DNA, 13 bp, Homo sapiens
acggtgctaaaaa

SEQ ID NO: 2166118 - DNA, 19 bp, Homo sapiens
actatggtgtgttgtatct

SEQ ID NO: 2166119 - DNA, 15 bp, Homo sapiens
actattgggtgaata

SEQ ID NO: 2166120 - DNA, 22 bp, Homo sapiens
actggacctttgggttctttct

SEQ ID NO: 2166121 - DNA, 22 bp, Homo sapiens
acttagaatccgaagggaatta

SEQ ID NO: 2166122 - DNA, 17 bp, Homo sapiens
actttaacttttgaaaa

SEQ ID NO: 2166123 - DNA, 12 bp, Homo sapiens
acttttctcttt

SEQ ID NO: 2166124 - DNA, 16 bp, Homo sapiens
agaaaaaaagggagaa

SEQ ID NO: 2166125 - DNA, 17 bp, Homo sapiens
agaaaaaaagggagaat

SEQ ID NO: 2166126 - DNA, 16 bp, Homo sapiens
agaagatgaatggtct

SEQ ID NO: 2166127 - DNA, 23 bp, Homo sapiens
agaatggctttcaataccctttt

SEQ ID NO: 2166128 - DNA, 14 bp, Homo sapiens
agacaaggtgctaa

SEQ ID NO: 2166129 - DNA, 19 bp, Homo sapiens
agacattctcacataagcc

SEQ ID NO: 2166130 - DNA, 23 bp, Homo sapiens
agaccactgtctccacccacctt

SEQ ID NO: 2166131 - DNA, 15 bp, Homo sapiens
agagatccctgcaga

SEQ ID NO: 2166132 - DNA, 20 bp, Homo sapiens
agagatccctgcagaaccca

SEQ ID NO: 2166133 - DNA, 21 bp, Homo sapiens
agagcagttggccaagcagaa

SEQ ID NO: 2166134 - DNA, 18 bp, Homo sapiens
agatcaagaaaaaaaggg

SEQ ID NO: 2166135 - DNA, 17 bp, Homo sapiens
agatccctgcagaaccc

SEQ ID NO: 2166136 - DNA, 20 bp, Homo sapiens
agcagttggccaagcagaaa

SEQ ID NO: 2166137 - DNA, 14 bp, Homo sapiens
agcatgttcctcct

SEQ ID NO: 2166138 - DNA, 14 bp, Homo sapiens
agcatttcatgaaa

SEQ ID NO: 2166139 - DNA, 14 bp, Homo sapiens
agcccgaacaccat

SEQ ID NO: 2166140 - DNA, 17 bp, Homo sapiens
agctgccgcaccagccc

SEQ ID NO: 2166141 - DNA, 16 bp, Homo sapiens
agctgctccccaggcc

SEQ ID NO: 2166142 - DNA, 12 bp, Homo sapiens
agctttctcaat

SEQ ID NO: 2166143 - DNA, 21 bp, Homo sapiens
aggaaggccaaaatcaagagt

SEQ ID NO: 2166144 - DNA, 21 bp, Homo sapiens
aggactccattggatctgcaa

SEQ ID NO: 2166145 - DNA, 16 bp, Homo sapiens
aggagctttctcaatg

SEQ ID NO: 2166146 - DNA, 15 bp, Homo sapiens
aggccaaaatcaaga

SEQ ID NO: 2166147 - DNA, 17 bp, Homo sapiens
aggccaaaatcaagagt

SEQ ID NO: 2166148 - DNA, 19 bp, Homo sapiens
aggccaccccgctgatgga

SEQ ID NO: 2166149 - DNA, 20 bp, Homo sapiens
aggctcagtggtgggagaga

SEQ ID NO: 2166150 - DNA, 21 bp, Homo sapiens
aggctgttggttcaaactttt

SEQ ID NO: 2166151 - DNA, 17 bp, Homo sapiens
agggaagtaacagacac

SEQ ID NO: 2166152 - DNA, 22 bp, Homo sapiens
agggaattaaaaagaagatgaa

SEQ ID NO: 2166153 - DNA, 17 bp, Homo sapiens
agggactgccaggctgt

SEQ ID NO: 2166154 - DNA, 19 bp, Homo sapiens
agggagaataaaattccta

SEQ ID NO: 2166155 - DNA, 19 bp, Homo sapiens
agggtcttggctgcctgtg

SEQ ID NO: 2166156 - DNA, 19 bp, Homo sapiens
aggtgggcaaagggaagta

SEQ ID NO: 2166157 - DNA, 19 bp, Homo sapiens
agtaatgacttagaaactg

SEQ ID NO: 2166158 - DNA, 11 bp, Homo sapiens
agtcatctccc

SEQ ID NO: 2166159 - DNA, 20 bp, Homo sapiens
agtgaatacattaacggtgc

SEQ ID NO: 2166160 - DNA, 23 bp, Homo sapiens
agtgaatacattaacggtgctaa

SEQ ID NO: 2166161 - DNA, 22 bp, Homo sapiens
agttctctgggaagtggtcagc

SEQ ID NO: 2166162 - DNA, 22 bp, Homo sapiens
agttctctttggaaatagcatg

SEQ ID NO: 2166163 - DNA, 21 bp, Homo sapiens
agttgtaaaatagaaaaagtg

SEQ ID NO: 2166164 - DNA, 17 bp, Homo sapiens
ataaaaagtaatgactt

SEQ ID NO: 2166165 - DNA, 15 bp, Homo sapiens
ataaaattcctatct

SEQ ID NO: 2166166 - DNA, 16 bp, Homo sapiens
ataaaattcctatctc

SEQ ID NO: 2166167 - DNA, 18 bp, Homo sapiens
atacaaactctcaccatg

SEQ ID NO: 2166168 - DNA, 17 bp, Homo sapiens
atacattaacggtgcta

SEQ ID NO: 2166169 - DNA, 18 bp, Homo sapiens
atattaaaatctgatgta

SEQ ID NO: 2166170 - DNA, 10 bp, Homo sapiens
atatttccta

SEQ ID NO: 2166171 - DNA, 12 bp, Homo sapiens
atcaagagaaac

SEQ ID NO: 2166172 - DNA, 14 bp, Homo sapiens
atcaagagaaactt

SEQ ID NO: 2166173 - DNA, 15 bp, Homo sapiens
atcaagagaaacttc

SEQ ID NO: 2166174 - DNA, 15 bp, Homo sapiens
atccgaagggaatta

SEQ ID NO: 2166175 - DNA, 14 bp, Homo sapiens
atctcacaggctga

SEQ ID NO: 2166176 - DNA, 17 bp, Homo sapiens
atctcacaggctgagaa

SEQ ID NO: 2166177 - DNA, 17 bp, Homo sapiens
atctcctggtgttctgc

SEQ ID NO: 2166178 - DNA, 19 bp, Homo sapiens
atctcctggtgttctgcag

SEQ ID NO: 2166179 - DNA, 16 bp, Homo sapiens
atgaaaaagctgcttc

SEQ ID NO: 2166180 - DNA, 16 bp, Homo sapiens
atgcagctgctcccca

SEQ ID NO: 2166181 - DNA, 13 bp, Homo sapiens
atggagccccacc

SEQ ID NO: 2166182 - DNA, 16 bp, Homo sapiens
atggagccccaccttg

SEQ ID NO: 2166183 - DNA, 22 bp, Homo sapiens
atggagccccaccttgtctgct

SEQ ID NO: 2166184 - DNA, 16 bp, Homo sapiens
atggtcggatctcaca

SEQ ID NO: 2166185 - DNA, 22 bp, Homo sapiens
atggtcggatctcacaggctga

SEQ ID NO: 2166186 - DNA, 20 bp, Homo sapiens
atggtctggcaatattctgt

SEQ ID NO: 2166187 - DNA, 22 bp, Homo sapiens
atggtttgttgttctgcctgga

SEQ ID NO: 2166188 - DNA, 13 bp, Homo sapiens
attaatcaagaga

SEQ ID NO: 2166189 - DNA, 16 bp, Homo sapiens
attaatcaagagaaac

SEQ ID NO: 2166190 - DNA, 22 bp, Homo sapiens
attaatcaagagaaacttcaaa

SEQ ID NO: 2166191 - DNA, 22 bp, Homo sapiens
attaatcatacaaactctcacc

SEQ ID NO: 2166192 - DNA, 12 bp, Homo sapiens
attaggctgttg

SEQ ID NO: 2166193 - DNA, 17 bp, Homo sapiens
attccatacttctctca

SEQ ID NO: 2166194 - DNA, 17 bp, Homo sapiens
attctatccatctcctg

SEQ ID NO: 2166195 - DNA, 19 bp, Homo sapiens
attctatccatctcctggt

SEQ ID NO: 2166196 - DNA, 23 bp, Homo sapiens
attctcacataagcccagttcat

SEQ ID NO: 2166197 - DNA, 22 bp, Homo sapiens
attggtaattacctggagaaga

SEQ ID NO: 2166198 - DNA, 14 bp, Homo sapiens
atttattgccatat

SEQ ID NO: 2166199 - DNA, 14 bp, Homo sapiens
atttcatgaaaaag

SEQ ID NO: 2166200 - DNA, 19 bp, Homo sapiens
atttcatgaaaaagctgct

SEQ ID NO: 2166201 - DNA, 15 bp, Homo sapiens
atttcctaaggcatg

SEQ ID NO: 2166202 - DNA, 18 bp, Homo sapiens
atttggatgattgtcata

SEQ ID NO: 2166203 - DNA, 14 bp, Homo sapiens
tcaccatccacctt

SEQ ID NO: 2166204 - DNA, 19 bp, Homo sapiens
tcacctccaagcatttcat

SEQ ID NO: 2166205 - DNA, 20 bp, Homo sapiens
tcacctccaagcatttcatg

SEQ ID NO: 2166206 - DNA, 23 bp, Homo sapiens
tcagactttgtgttcatttcatt

SEQ ID NO: 2166207 - DNA, 15 bp, Homo sapiens
tcagatgggaacagt

SEQ ID NO: 2166208 - DNA, 15 bp, Homo sapiens
tcagttctctgggaa

SEQ ID NO: 2166209 - DNA, 19 bp, Homo sapiens
tcatcaccatttcctcctt

SEQ ID NO: 2166210 - DNA, 21 bp, Homo sapiens
tcatgaaaaagctgcttctta

SEQ ID NO: 2166211 - DNA, 23 bp, Homo sapiens
tccaagcatttcatgaaaaagct

SEQ ID NO: 2166212 - DNA, 22 bp, Homo sapiens
tccaccttcccttctacaagga

SEQ ID NO: 2166213 - DNA, 17 bp, Homo sapiens
tccatacttctctcaga

SEQ ID NO: 2166214 - DNA, 15 bp, Homo sapiens
tccccacagtgccac

SEQ ID NO: 2166215 - DNA, 17 bp, Homo sapiens
tccccacagtgccaccc

SEQ ID NO: 2166216 - DNA, 15 bp, Homo sapiens
tccctgggggcccca

SEQ ID NO: 2166217 - DNA, 17 bp, Homo sapiens
tcccttctacaaggact

SEQ ID NO: 2166218 - DNA, 13 bp, Homo sapiens
tctacaaggactc

SEQ ID NO: 2166219 - DNA, 22 bp, Homo sapiens
tctacaaggactccattggatc

SEQ ID NO: 2166220 - DNA, 18 bp, Homo sapiens
tctagagcagttggccaa

SEQ ID NO: 2166221 - DNA, 21 bp, Homo sapiens
tctagggactgccaggctgtt

SEQ ID NO: 2166222 - DNA, 14 bp, Homo sapiens
tctccacccacctt

SEQ ID NO: 2166223 - DNA, 16 bp, Homo sapiens
tctctttaaccctccc

SEQ ID NO: 2166224 - DNA, 13 bp, Homo sapiens
tctgcaagaacac

SEQ ID NO: 2166225 - DNA, 19 bp, Homo sapiens
tctggggggatatttccta

SEQ ID NO: 2166226 - DNA, 17 bp, Homo sapiens
tcttcctccctgggggc

SEQ ID NO: 2166227 - DNA, 21 bp, Homo sapiens
tcttcctccctgggggcccca

SEQ ID NO: 2166228 - DNA, 20 bp, Homo sapiens
tcttctattaatcaagagaa

SEQ ID NO: 2166229 - DNA, 23 bp, Homo sapiens
tctttctggggggatatttccta

SEQ ID NO: 2166230 - DNA, 12 bp, Homo sapiens
tctttggaaata

SEQ ID NO: 2166231 - DNA, 22 bp, Homo sapiens
tgaaaaagctgcttcttattaa

SEQ ID NO: 2166232 - DNA, 13 bp, Homo sapiens
tgaatacattaac

SEQ ID NO: 2166233 - DNA, 20 bp, Homo sapiens
tgaatacattaacggtgcta

SEQ ID NO: 2166234 - DNA, 18 bp, Homo sapiens
tgacattcttagctgtaa

SEQ ID NO: 2166235 - DNA, 19 bp, Homo sapiens
tgacgtttcttctttctag

SEQ ID NO: 2166236 - DNA, 17 bp, Homo sapiens
tgagagttccttctcac

SEQ ID NO: 2166237 - DNA, 16 bp, Homo sapiens
tgagatgtagaaagtt

SEQ ID NO: 2166238 - DNA, 22 bp, Homo sapiens
tgaggctgtaactgagagaaag

SEQ ID NO: 2166239 - DNA, 20 bp, Homo sapiens
tgagggagctgggagaccct

SEQ ID NO: 2166240 - DNA, 18 bp, Homo sapiens
tgatgtgaagagtttcac

SEQ ID NO: 2166241 - DNA, 21 bp, Homo sapiens
tgatgtgaagagtttcacaaa

SEQ ID NO: 2166242 - DNA, 22 bp, Homo sapiens
tgcaagaacactggacctttgg

SEQ ID NO: 2166243 - DNA, 22 bp, Homo sapiens
tgcacaggtgccgccagctgcc

SEQ ID NO: 2166244 - DNA, 13 bp, Homo sapiens
tgcagctgctccc

SEQ ID NO: 2166245 - DNA, 16 bp, Homo sapiens
tgcagctgctccccag

SEQ ID NO: 2166246 - DNA, 14 bp, Homo sapiens
tgcagtttcttttc

SEQ ID NO: 2166247 - DNA, 21 bp, Homo sapiens
tgccatattaaaatctgatgt

SEQ ID NO: 2166248 - DNA, 12 bp, Homo sapiens
tgccgcaccagc

SEQ ID NO: 2166249 - DNA, 17 bp, Homo sapiens
tgccgcaccagcccgaa

SEQ ID NO: 2166250 - DNA, 17 bp, Homo sapiens
tgccgccagctgccgca

SEQ ID NO: 2166251 - DNA, 20 bp, Homo sapiens
tgccgccagctgccgcacca

SEQ ID NO: 2166252 - DNA, 14 bp, Homo sapiens
tgcctgaggctgta

SEQ ID NO: 2166253 - DNA, 22 bp, Homo sapiens
tgcctggagacaaggtgctaac

SEQ ID NO: 2166254 - DNA, 23 bp, Homo sapiens
tgcctggagacaaggtgctaaca

SEQ ID NO: 2166255 - DNA, 17 bp, Homo sapiens
tgccttaaacacacatt

SEQ ID NO: 2166256 - DNA, 13 bp, Homo sapiens
tgctgggctctgc

SEQ ID NO: 2166257 - DNA, 18 bp, Homo sapiens
tgctttgcattactgtcc

SEQ ID NO: 2166258 - DNA, 22 bp, Homo sapiens
tggagaaccagggctcttctca

SEQ ID NO: 2166259 - DNA, 11 bp, Homo sapiens
tggagaagaat

SEQ ID NO: 2166260 - DNA, 16 bp, Homo sapiens
tggagaagaatggctt

SEQ ID NO: 2166261 - DNA, 17 bp, Homo sapiens
tggagaagaatggcttt

SEQ ID NO: 2166262 - DNA, 14 bp, Homo sapiens
tggagacaaggtgc

SEQ ID NO: 2166263 - DNA, 16 bp, Homo sapiens
tggagacaaggtgcta

SEQ ID NO: 2166264 - DNA, 18 bp, Homo sapiens
tggagacaaggtgctaac

SEQ ID NO: 2166265 - DNA, 14 bp, Homo sapiens
tggagccccacctt

SEQ ID NO: 2166266 - DNA, 22 bp, Homo sapiens
tggagccccaccttgtctgcta

SEQ ID NO: 2166267 - DNA, 13 bp, Homo sapiens
tggaggtgggcaa

SEQ ID NO: 2166268 - DNA, 22 bp, Homo sapiens
tggatggtttgttgttctgcct

SEQ ID NO: 2166269 - DNA, 23 bp, Homo sapiens
tgggaacagtaaagaaagcagaa

SEQ ID NO: 2166270 - DNA, 22 bp, Homo sapiens
tgggactagaggctcagtggtg

SEQ ID NO: 2166271 - DNA, 22 bp, Homo sapiens
tgggcccagaccactgtctcca

SEQ ID NO: 2166272 - DNA, 18 bp, Homo sapiens
tgggttctttctgggggg

SEQ ID NO: 2166273 - DNA, 18 bp, Homo sapiens
tgtaactattgggtgaat

SEQ ID NO: 2166274 - DNA, 15 bp, Homo sapiens
tgtacagatcaagaa

SEQ ID NO: 2166275 - DNA, 12 bp, Homo sapiens
tgtatctttgta

SEQ ID NO: 2166276 - DNA, 16 bp, Homo sapiens
tgtcataaggttttta

SEQ ID NO: 2166277 - DNA, 19 bp, Homo sapiens
tgtctcaaaggagctttct

SEQ ID NO: 2166278 - DNA, 17 bp, Homo sapiens
tgtgtatttttcaaggc

SEQ ID NO: 2166279 - DNA, 18 bp, Homo sapiens
tgtgtcctttggtactat

SEQ ID NO: 2166280 - DNA, 15 bp, Homo sapiens
tgttctttcctcaca

SEQ ID NO: 2166281 - DNA, 14 bp, Homo sapiens
tgttggttcaaact

SEQ ID NO: 2166282 - DNA, 12 bp, Homo sapiens
tgttgtcaagga

SEQ ID NO: 2166283 - DNA, 19 bp, Homo sapiens
tgttgtcaaggatggtttt

SEQ ID NO: 2166284 - DNA, 20 bp, Homo sapiens
ttaaaatgtgtatttttcaa

SEQ ID NO: 2166285 - DNA, 20 bp, Homo sapiens
ttaagaaattccatacttct

SEQ ID NO: 2166286 - DNA, 14 bp, Homo sapiens
ttagggaatgagag

SEQ ID NO: 2166287 - DNA, 15 bp, Homo sapiens
ttagtggatggaata

SEQ ID NO: 2166288 - DNA, 22 bp, Homo sapiens
ttattaatcatacaaactctca

SEQ ID NO: 2166289 - DNA, 16 bp, Homo sapiens
ttcaaaataaaaagta

SEQ ID NO: 2166290 - DNA, 12 bp, Homo sapiens
ttcaacttttct

SEQ ID NO: 2166291 - DNA, 18 bp, Homo sapiens
ttcacattaggctgttgg

SEQ ID NO: 2166292 - DNA, 21 bp, Homo sapiens
ttcagtgcagtttcttttcac

SEQ ID NO: 2166293 - DNA, 18 bp, Homo sapiens
ttcatttcagggtcttgg

SEQ ID NO: 2166294 - DNA, 15 bp, Homo sapiens
ttcatttcatttcag

SEQ ID NO: 2166295 - DNA, 17 bp, Homo sapiens
ttccatacttctctcag

SEQ ID NO: 2166296 - DNA, 18 bp, Homo sapiens
ttccatacttctctcaga

SEQ ID NO: 2166297 - DNA, 21 bp, Homo sapiens
ttcccttctacaaggactcca

SEQ ID NO: 2166298 - DNA, 12 bp, Homo sapiens
ttcctaaggcat

SEQ ID NO: 2166299 - DNA, 13 bp, Homo sapiens
ttcctcacatttg

SEQ ID NO: 2166300 - DNA, 22 bp, Homo sapiens
ttctacaaggactccattggat

SEQ ID NO: 2166301 - DNA, 17 bp, Homo sapiens
ttctattaatcaagaga

SEQ ID NO: 2166302 - DNA, 20 bp, Homo sapiens
ttctctttggaaatagcatg

SEQ ID NO: 2166303 - DNA, 16 bp, Homo sapiens
ttctggggctgtgtta

SEQ ID NO: 2166304 - DNA, 23 bp, Homo sapiens
ttctgtaactattgggtgaatat

SEQ ID NO: 2166305 - DNA, 14 bp, Homo sapiens
ttcttctttctaga

SEQ ID NO: 2166306 - DNA, 19 bp, Homo sapiens
ttgaaaagaccaagacttt

SEQ ID NO: 2166307 - DNA, 22 bp, Homo sapiens
ttgagggagctgggagaccctc

SEQ ID NO: 2166308 - DNA, 21 bp, Homo sapiens
ttgggtgaatatggtggaaaa

SEQ ID NO: 2166309 - DNA, 22 bp, Homo sapiens
ttggtgaatcggttgttctttc

SEQ ID NO: 2166310 - DNA, 20 bp, Homo sapiens
tttaagtgaatacattaacg

SEQ ID NO: 2166311 - DNA, 17 bp, Homo sapiens
tttacctttcagtgcag

SEQ ID NO: 2166312 - DNA, 20 bp, Homo sapiens
tttcagggtcttggctgcct

SEQ ID NO: 2166313 - DNA, 15 bp, Homo sapiens
tttcatgaaaaagct

SEQ ID NO: 2166314 - DNA, 18 bp, Homo sapiens
tttccacacgcattaata

SEQ ID NO: 2166315 - DNA, 13 bp, Homo sapiens
tttcttctattaa

SEQ ID NO: 2166316 - DNA, 10 bp, Homo sapiens
tttggaaata

SEQ ID NO: 2166317 - DNA, 23 bp, Homo sapiens
tttttcttctattaatcaagaga

SEQ ID NO: 2166318 - DNA, 15 bp, Homo sapiens
agtgaatacattaac

SEQ ID NO: 2166319 - DNA, 18 bp, Homo sapiens
agtgagatgtagaaagtt

SEQ ID NO: 2166320 - DNA, 20 bp, Homo sapiens
agtggatggaatatcagaag

SEQ ID NO: 2166321 - DNA, 19 bp, Homo sapiens
agtgttctgtttgaaacta

SEQ ID NO: 2166322 - DNA, 19 bp, Homo sapiens
agttcatcaccatttcctc

SEQ ID NO: 2166323 - DNA, 18 bp, Homo sapiens
agttccttctcacttaga

SEQ ID NO: 2166324 - DNA, 16 bp, Homo sapiens
agttgtaaaatagaaa

SEQ ID NO: 2166325 - DNA, 20 bp, Homo sapiens
ataaaaaatctttagggaat

SEQ ID NO: 2166326 - DNA, 17 bp, Homo sapiens
ataaaattcctatctca

SEQ ID NO: 2166327 - DNA, 21 bp, Homo sapiens
ataatttagtggatggaatat

SEQ ID NO: 2166328 - DNA, 13 bp, Homo sapiens
atacaaactctca

SEQ ID NO: 2166329 - DNA, 15 bp, Homo sapiens
atacttctctcagat

SEQ ID NO: 2166330 - DNA, 20 bp, Homo sapiens
atagcatgacaggctgttca

SEQ ID NO: 2166331 - DNA, 18 bp, Homo sapiens
atatagacattctcacat

SEQ ID NO: 2166332 - DNA, 13 bp, Homo sapiens
atatctgtacaga

SEQ ID NO: 2166333 - DNA, 16 bp, Homo sapiens
atatttcctaaggcat

SEQ ID NO: 2166334 - DNA, 17 bp, Homo sapiens
atatttcctaaggcatg

SEQ ID NO: 2166335 - DNA, 23 bp, Homo sapiens
atatttcctaaggcatgtggcct

SEQ ID NO: 2166336 - DNA, 16 bp, Homo sapiens
atcatacaaactctca

SEQ ID NO: 2166337 - DNA, 21 bp, Homo sapiens
atccaccttcccttctacaag

SEQ ID NO: 2166338 - DNA, 11 bp, Homo sapiens
atccctgcaga

SEQ ID NO: 2166339 - DNA, 13 bp, Homo sapiens
atccgaagggaat

SEQ ID NO: 2166340 - DNA, 20 bp, Homo sapiens
atcctgcagggcttctcctc

SEQ ID NO: 2166341 - DNA, 16 bp, Homo sapiens
atcggttgttctttcc

SEQ ID NO: 2166342 - DNA, 13 bp, Homo sapiens
atctcacaggctg

SEQ ID NO: 2166343 - DNA, 22 bp, Homo sapiens
atctcccctcctggcgagttct

SEQ ID NO: 2166344 - DNA, 22 bp, Homo sapiens
atgaaaatatagacattctcac

SEQ ID NO: 2166345 - DNA, 18 bp, Homo sapiens
atgaatggtctggcaata

SEQ ID NO: 2166346 - DNA, 17 bp, Homo sapiens
atgcagctgctccccag

SEQ ID NO: 2166347 - DNA, 21 bp, Homo sapiens
atgggatggtcggatctcaca

SEQ ID NO: 2166348 - DNA, 22 bp, Homo sapiens
atgggatggtcggatctcacag

SEQ ID NO: 2166349 - DNA, 16 bp, Homo sapiens
atgggtggacacggat

SEQ ID NO: 2166350 - DNA, 15 bp, Homo sapiens
atggtcggatctcac

SEQ ID NO: 2166351 - DNA, 17 bp, Homo sapiens
atggtcggatctcacag

SEQ ID NO: 2166352 - DNA, 20 bp, Homo sapiens
atgtagaaagttgtaaaata

SEQ ID NO: 2166353 - DNA, 12 bp, Homo sapiens
atgttcctcctt

SEQ ID NO: 2166354 - DNA, 23 bp, Homo sapiens
atgttcctccttttcttcaccct

SEQ ID NO: 2166355 - DNA, 11 bp, Homo sapiens
attaatcaaga

SEQ ID NO: 2166356 - DNA, 17 bp, Homo sapiens
attaatcaagagaaact

SEQ ID NO: 2166357 - DNA, 21 bp, Homo sapiens
attaatcaagagaaacttcaa

SEQ ID NO: 2166358 - DNA, 21 bp, Homo sapiens
attacctggagaagaatggct

SEQ ID NO: 2166359 - DNA, 12 bp, Homo sapiens
attctctcttta

SEQ ID NO: 2166360 - DNA, 23 bp, Homo sapiens
attgggtgaatatggtggaaaat

SEQ ID NO: 2166361 - DNA, 18 bp, Homo sapiens
atttcatgaaaaagctgc

SEQ ID NO: 2166362 - DNA, 14 bp, Homo sapiens
atttcctaaggcat

SEQ ID NO: 2166363 - DNA, 12 bp, Homo sapiens
atttttcaaggc

SEQ ID NO: 2166364 - DNA, 17 bp, Homo sapiens
caaaggagctttctcaa

SEQ ID NO: 2166365 - DNA, 20 bp, Homo sapiens
caaagggaagtaacagacac

SEQ ID NO: 2166366 - DNA, 12 bp, Homo sapiens
caagagaaactt

SEQ ID NO: 2166367 - DNA, 13 bp, Homo sapiens
caagcatttcatg

SEQ ID NO: 2166368 - DNA, 19 bp, Homo sapiens
caagcatttcatgaaaaag

SEQ ID NO: 2166369 - DNA, 12 bp, Homo sapiens
caaggtgctaac

SEQ ID NO: 2166370 - DNA, 16 bp, Homo sapiens
caatattctgtaacta

SEQ ID NO: 2166371 - DNA, 14 bp, Homo sapiens
cacacgctgcacct

SEQ ID NO: 2166372 - DNA, 17 bp, Homo sapiens
cacaggctgagaactcg

SEQ ID NO: 2166373 - DNA, 14 bp, Homo sapiens
cacagtgccaccca

SEQ ID NO: 2166374 - DNA, 15 bp, Homo sapiens
cacattaggctgttg

SEQ ID NO: 2166375 - DNA, 20 bp, Homo sapiens
caccatccaccttcccttct

SEQ ID NO: 2166376 - DNA, 22 bp, Homo sapiens
cacccaccttgacgtttcttct

SEQ ID NO: 2166377 - DNA, 17 bp, Homo sapiens
cacctccaagcatttca

SEQ ID NO: 2166378 - DNA, 18 bp, Homo sapiens
cacctccaagcatttcat

SEQ ID NO: 2166379 - DNA, 19 bp, Homo sapiens
cacctccaagcatttcatg

SEQ ID NO: 2166380 - DNA, 19 bp, Homo sapiens
caccttgacgtttcttctt

SEQ ID NO: 2166381 - DNA, 22 bp, Homo sapiens
caccttgtctgctaaataaaca

SEQ ID NO: 2166382 - DNA, 21 bp, Homo sapiens
cagactttgtgttcatttcat

SEQ ID NO: 2166383 - DNA, 13 bp, Homo sapiens
cagcccgaacacc

SEQ ID NO: 2166384 - DNA, 17 bp, Homo sapiens
cagctgccgcaccagcc

SEQ ID NO: 2166385 - DNA, 18 bp, Homo sapiens
cagctgctccccaggcca

SEQ ID NO: 2166386 - DNA, 22 bp, Homo sapiens
caggaaggccaaaatcaagagt

SEQ ID NO: 2166387 - DNA, 19 bp, Homo sapiens
caggccaccccgctgatgg

SEQ ID NO: 2166388 - DNA, 13 bp, Homo sapiens
caggctgtttcag

SEQ ID NO: 2166389 - DNA, 14 bp, Homo sapiens
cagggtcttggctg

SEQ ID NO: 2166390 - DNA, 23 bp, Homo sapiens
caggtgccgccagctgccgcacc

SEQ ID NO: 2166391 - DNA, 15 bp, Homo sapiens
caggtggcctggagg

SEQ ID NO: 2166392 - DNA, 15 bp, Homo sapiens
cagtcatctcccctc

SEQ ID NO: 2166393 - DNA, 19 bp, Homo sapiens
cagttcatcaccatttcct

SEQ ID NO: 2166394 - DNA, 16 bp, Homo sapiens
catacaaactctcacc

SEQ ID NO: 2166395 - DNA, 14 bp, Homo sapiens
catacttctctcag

SEQ ID NO: 2166396 - DNA, 20 bp, Homo sapiens
catagatttaagtgaataca

SEQ ID NO: 2166397 - DNA, 15 bp, Homo sapiens
catccaccttccctt

SEQ ID NO: 2166398 - DNA, 16 bp, Homo sapiens
catccaccttcccttc

SEQ ID NO: 2166399 - DNA, 21 bp, Homo sapiens
catcctgcagggcttctcctc

SEQ ID NO: 2166400 - DNA, 16 bp, Homo sapiens
catctcccctcctggc

SEQ ID NO: 2166401 - DNA, 17 bp, Homo sapiens
catctcccctcctggcg

SEQ ID NO: 2166402 - DNA, 22 bp, Homo sapiens
catgatgtgaagagtttcacaa

SEQ ID NO: 2166403 - DNA, 16 bp, Homo sapiens
catgcagctgctcccc

SEQ ID NO: 2166404 - DNA, 23 bp, Homo sapiens
catgcagctgctccccaggccac

SEQ ID NO: 2166405 - DNA, 13 bp, Homo sapiens
catgtgccctcag

SEQ ID NO: 2166406 - DNA, 16 bp, Homo sapiens
cattaacggtgctaaa

SEQ ID NO: 2166407 - DNA, 15 bp, Homo sapiens
cattactgtcccctt

SEQ ID NO: 2166408 - DNA, 19 bp, Homo sapiens
cattaggctgttggttcaa

SEQ ID NO: 2166409 - DNA, 19 bp, Homo sapiens
catttcagggtcttggctg

SEQ ID NO: 2166410 - DNA, 13 bp, Homo sapiens
catttcatgaaaa

SEQ ID NO: 2166411 - DNA, 12 bp, Homo sapiens
ccaaaatcaaga

SEQ ID NO: 2166412 - DNA, 14 bp, Homo sapiens
ccaaaatcaagagt

SEQ ID NO: 2166413 - DNA, 22 bp, Homo sapiens
ccaagcatttcatgaaaaagct

SEQ ID NO: 2166414 - DNA, 20 bp, Homo sapiens
ccacccatgcagctgctccc

SEQ ID NO: 2166415 - DNA, 16 bp, Homo sapiens
ccaccccgctgatgga

SEQ ID NO: 2166416 - DNA, 19 bp, Homo sapiens
ccactgtctccacccacct

SEQ ID NO: 2166417 - DNA, 22 bp, Homo sapiens
ccactgtctccacccaccttga

SEQ ID NO: 2166418 - DNA, 23 bp, Homo sapiens
ccagcaggcgtcaccatccacct

SEQ ID NO: 2166419 - DNA, 16 bp, Homo sapiens
ccagcccgaacaccat

SEQ ID NO: 2166420 - DNA, 17 bp, Homo sapiens
ccagctgccgcaccagc

SEQ ID NO: 2166421 - DNA, 22 bp, Homo sapiens
ccaggaaggccaaaatcaagag

SEQ ID NO: 2166422 - DNA, 16 bp, Homo sapiens
ccattggatctgcaag

SEQ ID NO: 2166423 - DNA, 21 bp, Homo sapiens
cccagttcatcaccatttcct

SEQ ID NO: 2166424 - DNA, 15 bp, Homo sapiens
ccccaccttgtctgc

SEQ ID NO: 2166425 - DNA, 13 bp, Homo sapiens
ccccaggccaccc

SEQ ID NO: 2166426 - DNA, 22 bp, Homo sapiens
cccgctgatggagccccacctt

SEQ ID NO: 2166427 - DNA, 23 bp, Homo sapiens
ccctcctggcgagttctctttgg

SEQ ID NO: 2166428 - DNA, 11 bp, Homo sapiens
ccctcttcctc

SEQ ID NO: 2166429 - DNA, 14 bp, Homo sapiens
ccgccagctgccgc

SEQ ID NO: 2166430 - DNA, 15 bp, Homo sapiens
ccgctgatggagccc

SEQ ID NO: 2166431 - DNA, 18 bp, Homo sapiens
ccgctgatggagccccac

SEQ ID NO: 2166432 - DNA, 19 bp, Homo sapiens
ccgctgatggagccccacc

SEQ ID NO: 2166433 - DNA, 20 bp, Homo sapiens
cctattctatccatctcctg

SEQ ID NO: 2166434 - DNA, 18 bp, Homo sapiens
cctccccacagtgccacc

SEQ ID NO: 2166435 - DNA, 19 bp, Homo sapiens
cctccccacagtgccaccc

SEQ ID NO: 2166436 - DNA, 21 bp, Homo sapiens
cctccctgggggccccaggat

SEQ ID NO: 2166437 - DNA, 17 bp, Homo sapiens
cctccttttcttcaccc

SEQ ID NO: 2166438 - DNA, 12 bp, Homo sapiens
aaaaagtgtctc

SEQ ID NO: 2166439 - DNA, 17 bp, Homo sapiens
aaaagtgtctcaaagga

SEQ ID NO: 2166440 - DNA, 12 bp, Homo sapiens
aaaatcaagagt

SEQ ID NO: 2166441 - DNA, 15 bp, Homo sapiens
aaaattcctatctca

SEQ ID NO: 2166442 - DNA, 19 bp, Homo sapiens
aaagattctggggctgtgt

SEQ ID NO: 2166443 - DNA, 17 bp, Homo sapiens
aaagcctaccctattct

SEQ ID NO: 2166444 - DNA, 15 bp, Homo sapiens
aaagcctcagaaagg

SEQ ID NO: 2166445 - DNA, 13 bp, Homo sapiens
aaagttgtaaaat

SEQ ID NO: 2166446 - DNA, 14 bp, Homo sapiens
aacggtgctaaaaa

SEQ ID NO: 2166447 - DNA, 20 bp, Homo sapiens
aacggtgctaaaaatgaaaa

SEQ ID NO: 2166448 - DNA, 22 bp, Homo sapiens
aactattgggtgaatatggtgg

SEQ ID NO: 2166449 - DNA, 13 bp, Homo sapiens
aacttttctcttt

SEQ ID NO: 2166450 - DNA, 13 bp, Homo sapiens
aacttttgggagc

SEQ ID NO: 2166451 - DNA, 21 bp, Homo sapiens
aagaaattccatacttctctc

SEQ ID NO: 2166452 - DNA, 22 bp, Homo sapiens
aagaacactggacctttgggtt

SEQ ID NO: 2166453 - DNA, 11 bp, Homo sapiens
aagagaaactt

SEQ ID NO: 2166454 - DNA, 16 bp, Homo sapiens
aagcatttcatgaaaa

SEQ ID NO: 2166455 - DNA, 19 bp, Homo sapiens
aagcatttcatgaaaaagc

SEQ ID NO: 2166456 - DNA, 21 bp, Homo sapiens
aagcatttcatgaaaaagctg

SEQ ID NO: 2166457 - DNA, 23 bp, Homo sapiens
aagcatttcatgaaaaagctgct

SEQ ID NO: 2166458 - DNA, 13 bp, Homo sapiens
aaggagctttctc

SEQ ID NO: 2166459 - DNA, 21 bp, Homo sapiens
aaggcatgtggcctttatctc

SEQ ID NO: 2166460 - DNA, 22 bp, Homo sapiens
aaggcatgtggcctttatctca

SEQ ID NO: 2166461 - DNA, 17 bp, Homo sapiens
aaggccaaaatcaagag

SEQ ID NO: 2166462 - DNA, 20 bp, Homo sapiens
aagggagaataaaattccta

SEQ ID NO: 2166463 - DNA, 14 bp, Homo sapiens
aaggtgctaacata

SEQ ID NO: 2166464 - DNA, 17 bp, Homo sapiens
aagtaatgacttagaaa

SEQ ID NO: 2166465 - DNA, 20 bp, Homo sapiens
aagtaatgacttagaaactg

SEQ ID NO: 2166466 - DNA, 13 bp, Homo sapiens
aataaaattccta

SEQ ID NO: 2166467 - DNA, 22 bp, Homo sapiens
cttttgaaaagaccaagacttt

SEQ ID NO: 2166468 - DNA, 17 bp, Homo sapiens
gaaaaaaaagtgtctca

SEQ ID NO: 2166469 - DNA, 20 bp, Homo sapiens
gaaaaaaaagtgtctcaaag

SEQ ID NO: 2166470 - DNA, 17 bp, Homo sapiens
gaaaaaaagggagaata

SEQ ID NO: 2166471 - DNA, 22 bp, Homo sapiens
gaaaatatagacattctcacat

SEQ ID NO: 2166472 - DNA, 21 bp, Homo sapiens
gaaattccatacttctctcag

SEQ ID NO: 2166473 - DNA, 21 bp, Homo sapiens
gaacagtaaagaaagcagaat

SEQ ID NO: 2166474 - DNA, 18 bp, Homo sapiens
gaaccagggctcttctca

SEQ ID NO: 2166475 - DNA, 18 bp, Homo sapiens
gaagaatggctttcaata

SEQ ID NO: 2166476 - DNA, 20 bp, Homo sapiens
gaatacattaacggtgctaa

SEQ ID NO: 2166477 - DNA, 21 bp, Homo sapiens
gaatatcagaagtatatctgt

SEQ ID NO: 2166478 - DNA, 13 bp, Homo sapiens
gacaaggtgctaa

SEQ ID NO: 2166479 - DNA, 11 bp, Homo sapiens
gaccactgtct

SEQ ID NO: 2166480 - DNA, 17 bp, Homo sapiens
gacctttgggttctttc

SEQ ID NO: 2166481 - DNA, 18 bp, Homo sapiens
gacctttgggttctttct

SEQ ID NO: 2166482 - DNA, 13 bp, Homo sapiens
gacttagaaactg

SEQ ID NO: 2166483 - DNA, 20 bp, Homo sapiens
gagaataaaattcctatctc

SEQ ID NO: 2166484 - DNA, 15 bp, Homo sapiens
gagacaaggtgctaa

SEQ ID NO: 2166485 - DNA, 16 bp, Homo sapiens
gagacaaggtgctaac

SEQ ID NO: 2166486 - DNA, 14 bp, Homo sapiens
gagaccctccccac

SEQ ID NO: 2166487 - DNA, 20 bp, Homo sapiens
gagatccctgcagaacccac

SEQ ID NO: 2166488 - DNA, 22 bp, Homo sapiens
gagcaaaagcctcagaaaggga

SEQ ID NO: 2166489 - DNA, 14 bp, Homo sapiens
gagctgggagaccc

SEQ ID NO: 2166490 - DNA, 17 bp, Homo sapiens
gagctttctcaatgtct

SEQ ID NO: 2166491 - DNA, 20 bp, Homo sapiens
gagctttctcaatgtcttcc

SEQ ID NO: 2166492 - DNA, 13 bp, Homo sapiens
gagttccttctca

SEQ ID NO: 2166493 - DNA, 18 bp, Homo sapiens
gatggagccccaccttgt

SEQ ID NO: 2166494 - DNA, 15 bp, Homo sapiens
gattctggggctgtg

SEQ ID NO: 2166495 - DNA, 21 bp, Homo sapiens
gattgctttgcattactgtcc

SEQ ID NO: 2166496 - DNA, 22 bp, Homo sapiens
gatttaagtgaatacattaacg

SEQ ID NO: 2166497 - DNA, 18 bp, Homo sapiens
gcaaaagcctcagaaagg

SEQ ID NO: 2166498 - DNA, 13 bp, Homo sapiens
gcagctgctcccc

SEQ ID NO: 2166499 - DNA, 14 bp, Homo sapiens
gcagctgctcccca

SEQ ID NO: 2166500 - DNA, 22 bp, Homo sapiens
gcagctgctccccaggccaccc

SEQ ID NO: 2166501 - DNA, 20 bp, Homo sapiens
gcatcctgcagggcttctcc

SEQ ID NO: 2166502 - DNA, 16 bp, Homo sapiens
gcatgtggcctttatc

SEQ ID NO: 2166503 - DNA, 13 bp, Homo sapiens
gcatgttcctcct

SEQ ID NO: 2166504 - DNA, 14 bp, Homo sapiens
gcatgttcctcctt

SEQ ID NO: 2166505 - DNA, 21 bp, Homo sapiens
gcattactgtccccttgatat

SEQ ID NO: 2166506 - DNA, 15 bp, Homo sapiens
gccaaaatcaagagt

SEQ ID NO: 2166507 - DNA, 20 bp, Homo sapiens
gccaagcagaaaaaaaagtg

SEQ ID NO: 2166508 - DNA, 22 bp, Homo sapiens
gccaccccgctgatggagcccc

SEQ ID NO: 2166509 - DNA, 13 bp, Homo sapiens
gccagctgccgca

SEQ ID NO: 2166510 - DNA, 18 bp, Homo sapiens
gccagctgccgcaccagc

SEQ ID NO: 2166511 - DNA, 13 bp, Homo sapiens
gccgcaccagccc

SEQ ID NO: 2166512 - DNA, 21 bp, Homo sapiens
gcctggagacaaggtgctaac

SEQ ID NO: 2166513 - DNA, 17 bp, Homo sapiens
gccttttccacacgcat

SEQ ID NO: 2166514 - DNA, 22 bp, Homo sapiens
gcgcatcctgcagggcttctcc

SEQ ID NO: 2166515 - DNA, 15 bp, Homo sapiens
gctaaaaatgaaaat

SEQ ID NO: 2166516 - DNA, 13 bp, Homo sapiens
gctaaataaacat

SEQ ID NO: 2166517 - DNA, 22 bp, Homo sapiens
gctaaataaacatgtgccctca

SEQ ID NO: 2166518 - DNA, 22 bp, Homo sapiens
gctctagggactgccaggctgt

SEQ ID NO: 2166519 - DNA, 15 bp, Homo sapiens
gctgatggagcccca

SEQ ID NO: 2166520 - DNA, 17 bp, Homo sapiens
gctgatggagccccacc

SEQ ID NO: 2166521 - DNA, 21 bp, Homo sapiens
gcttcttattaatcatacaaa

SEQ ID NO: 2166522 - DNA, 12 bp, Homo sapiens
gctttctcaatg

SEQ ID NO: 2166523 - DNA, 21 bp, Homo sapiens
ggaacagtaaagaaagcagaa

SEQ ID NO: 2166524 - DNA, 18 bp, Homo sapiens
ggaagccccctcttcctc

SEQ ID NO: 2166525 - DNA, 16 bp, Homo sapiens
ggaagtaacagacaca

SEQ ID NO: 2166526 - DNA, 14 bp, Homo sapiens
ggaattaaaaagaa

SEQ ID NO: 2166527 - DNA, 16 bp, Homo sapiens
ggaattaaaaagaaga

SEQ ID NO: 2166528 - DNA, 11 bp, Homo sapiens
ggagaaccagg

SEQ ID NO: 2166529 - DNA, 21 bp, Homo sapiens
ggagaaccagggctcttctca

SEQ ID NO: 2166530 - DNA, 16 bp, Homo sapiens
ggagacaaggtgctaa

SEQ ID NO: 2166531 - DNA, 22 bp, Homo sapiens
ggagagatccctgcagaaccca

SEQ ID NO: 2166532 - DNA, 12 bp, Homo sapiens
ggagctgggaga

SEQ ID NO: 2166533 - DNA, 14 bp, Homo sapiens
ggagctttctcaat

SEQ ID NO: 2166534 - DNA, 18 bp, Homo sapiens
ggagctttctcaatgtct

SEQ ID NO: 2166535 - DNA, 22 bp, Homo sapiens
ggagttggtgaatcggttgttc

SEQ ID NO: 2166536 - DNA, 16 bp, Homo sapiens
ggccaaaatcaagagt

SEQ ID NO: 2166537 - DNA, 12 bp, Homo sapiens
ggccaagcagaa

SEQ ID NO: 2166538 - DNA, 14 bp, Homo sapiens
ggccaagcagaaaa

SEQ ID NO: 2166539 - DNA, 17 bp, Homo sapiens
ggcccagaccactgtct

SEQ ID NO: 2166540 - DNA, 23 bp, Homo sapiens
ggcgtcaccatccaccttccctt

SEQ ID NO: 2166541 - DNA, 16 bp, Homo sapiens
ggctgtgttatgaaaa

SEQ ID NO: 2166542 - DNA, 21 bp, Homo sapiens
gggaacagtaaagaaagcaga

SEQ ID NO: 2166543 - DNA, 17 bp, Homo sapiens
gggaattaaaaagaaga

SEQ ID NO: 2166544 - DNA, 22 bp, Homo sapiens
gggaattaaaaagaagatgaat

SEQ ID NO: 2166545 - DNA, 17 bp, Homo sapiens
gggactgccaggctgtt

SEQ ID NO: 2166546 - DNA, 21 bp, Homo sapiens
gggcttctcctcctctgtctt

SEQ ID NO: 2166547 - DNA, 14 bp, Homo sapiens
ggtcggatctcaca

SEQ ID NO: 2166548 - DNA, 15 bp, Homo sapiens
ggtcggatctcacag

SEQ ID NO: 2166549 - DNA, 18 bp, Homo sapiens
ggtgaatatggtggaaaa

SEQ ID NO: 2166550 - DNA, 17 bp, Homo sapiens
gtaacagacacacgatg

SEQ ID NO: 2166551 - DNA, 12 bp, Homo sapiens
gtacagatcaag

SEQ ID NO: 2166552 - DNA, 22 bp, Homo sapiens
gtcagactttgtgttcatttca

SEQ ID NO: 2166553 - DNA, 13 bp, Homo sapiens
gtcggatctcaca

SEQ ID NO: 2166554 - DNA, 16 bp, Homo sapiens
gtgaagagtttcacaa

SEQ ID NO: 2166555 - DNA, 19 bp, Homo sapiens
gtgcagtttcttttcacat

SEQ ID NO: 2166556 - DNA, 21 bp, Homo sapiens
gttcacctccaagcatttcat

SEQ ID NO: 2166557 - DNA, 22 bp, Homo sapiens
gttcacctccaagcatttcatg

SEQ ID NO: 2166558 - DNA, 19 bp, Homo sapiens
gttcctccttttcttcacc

SEQ ID NO: 2166559 - DNA, 12 bp, Homo sapiens
gttctctttgga

SEQ ID NO: 2166560 - DNA, 12 bp, Homo sapiens
gttctgcctgga

SEQ ID NO: 2166561 - DNA, 15 bp, Homo sapiens
gttctttctgggggg

SEQ ID NO: 2166562 - DNA, 13 bp, Homo sapiens
gtttaaaatgtgt

SEQ ID NO: 2166563 - DNA, 14 bp, Homo sapiens
gtttcttctttcta

SEQ ID NO: 2166564 - DNA, 13 bp, Homo sapiens
taacggtgctaaa

SEQ ID NO: 2166565 - DNA, 14 bp, Homo sapiens
taacggtgctaaaa

SEQ ID NO: 2166566 - DNA, 22 bp, Homo sapiens
taatcatacaaactctcaccat

SEQ ID NO: 2166567 - DNA, 14 bp, Homo sapiens
tacaaactctcacc

SEQ ID NO: 2166568 - DNA, 18 bp, Homo sapiens
tacattaacggtgctaaa

SEQ ID NO: 2166569 - DNA, 19 bp, Homo sapiens
tacattaacggtgctaaaa

SEQ ID NO: 2166570 - DNA, 23 bp, Homo sapiens
taccctattctatccatctcctg

SEQ ID NO: 2166571 - DNA, 18 bp, Homo sapiens
taccggattctctcttta

SEQ ID NO: 2166572 - DNA, 17 bp, Homo sapiens
tatagacattctcacat

SEQ ID NO: 2166573 - DNA, 13 bp, Homo sapiens
tatccatctcctg

SEQ ID NO: 2166574 - DNA, 17 bp, Homo sapiens
tatgaaaatatagacat

SEQ ID NO: 2166575 - DNA, 23 bp, Homo sapiens
tatggtgtgttgtatctttgtaa

SEQ ID NO: 2166576 - DNA, 14 bp, Homo sapiens
tattaatcaagaga

SEQ ID NO: 2166577 - DNA, 18 bp, Homo sapiens
tattaatcaagagaaact

SEQ ID NO: 2166578 - DNA, 20 bp, Homo sapiens
tattaatcatacaaactctc

SEQ ID NO: 2166579 - DNA, 22 bp, Homo sapiens
tattctatccatctcctggtgt

SEQ ID NO: 2166580 - DNA, 16 bp, Homo sapiens
tatttttcaaggcatt

SEQ ID NO: 2166581 - DNA, 13 bp, Homo sapiens
tcaaaataaaaag

SEQ ID NO: 2166582 - DNA, 18 bp, Homo sapiens
tcaaaggagctttctcaa

SEQ ID NO: 2166583 - DNA, 22 bp, Homo sapiens
tcaactgcccctgacttaactt

SEQ ID NO: 2166584 - DNA, 12 bp, Homo sapiens
tcaatgtcttcc

SEQ ID NO: 2166585 - DNA, 14 bp, Homo sapiens
tcacaggctgagaa

SEQ ID NO: 2166586 - DNA, 15 bp, Homo sapiens
tcacattaggctgtt

SEQ ID NO: 2166587 - DNA, 16 bp, Homo sapiens
aaaaagtgtctcaaag

SEQ ID NO: 2166588 - DNA, 14 bp, Homo sapiens
aaaagaccaagact

SEQ ID NO: 2166589 - DNA, 15 bp, Homo sapiens
aaaagaccaagactt

SEQ ID NO: 2166590 - DNA, 16 bp, Homo sapiens
aaaagaccaagacttt

SEQ ID NO: 2166591 - DNA, 13 bp, Homo sapiens
aaaagggagaata

SEQ ID NO: 2166592 - DNA, 22 bp, Homo sapiens
aaaagtaatgacttagaaactg

SEQ ID NO: 2166593 - DNA, 21 bp, Homo sapiens
aaaagtgtctcaaaggagctt

SEQ ID NO: 2166594 - DNA, 17 bp, Homo sapiens
aaaatagaaaaagtgga

SEQ ID NO: 2166595 - DNA, 15 bp, Homo sapiens
aaaggagctttctca

SEQ ID NO: 2166596 - DNA, 14 bp, Homo sapiens
aaagtgtctcaaag

SEQ ID NO: 2166597 - DNA, 21 bp, Homo sapiens
aaagtgtctcaaaggagcttt

SEQ ID NO: 2166598 - DNA, 18 bp, Homo sapiens
aaagttgtaaaatagaaa

SEQ ID NO: 2166599 - DNA, 11 bp, Homo sapiens
aaatgaaaatt

SEQ ID NO: 2166600 - DNA, 19 bp, Homo sapiens
aaatggtcccaattaagaa

SEQ ID NO: 2166601 - DNA, 19 bp, Homo sapiens
aaatgtgtatttttcaagg

SEQ ID NO: 2166602 - DNA, 18 bp, Homo sapiens
aaccagaacgtggtttgc

SEQ ID NO: 2166603 - DNA, 20 bp, Homo sapiens
aactattgggtgaatatggt

SEQ ID NO: 2166604 - DNA, 13 bp, Homo sapiens
aagaaagcagaat

SEQ ID NO: 2166605 - DNA, 22 bp, Homo sapiens
aagaaattccatacttctctca

SEQ ID NO: 2166606 - DNA, 23 bp, Homo sapiens
aagaaattccatacttctctcag

SEQ ID NO: 2166607 - DNA, 12 bp, Homo sapiens
aagcatttcatg

SEQ ID NO: 2166608 - DNA, 14 bp, Homo sapiens
aagcccagttcatc

SEQ ID NO: 2166609 - DNA, 17 bp, Homo sapiens
aagccccctcttcctcc

SEQ ID NO: 2166610 - DNA, 16 bp, Homo sapiens
aaggagctttctcaat

SEQ ID NO: 2166611 - DNA, 20 bp, Homo sapiens
aaggagctttctcaatgtct

SEQ ID NO: 2166612 - DNA, 13 bp, Homo sapiens
aaggtttttagca

SEQ ID NO: 2166613 - DNA, 19 bp, Homo sapiens
aagtgtctcaaaggagctt

SEQ ID NO: 2166614 - DNA, 18 bp, Homo sapiens
aataaaattcctatctca

SEQ ID NO: 2166615 - DNA, 19 bp, Homo sapiens
aatagcatgacaggctgtt

SEQ ID NO: 2166616 - DNA, 18 bp, Homo sapiens
aatatagacattctcaca

SEQ ID NO: 2166617 - DNA, 20 bp, Homo sapiens
aatatagacattctcacata

SEQ ID NO: 2166618 - DNA, 14 bp, Homo sapiens
aatattctgtaact

SEQ ID NO: 2166619 - DNA, 23 bp, Homo sapiens
aatattctgtaactattgggtga

SEQ ID NO: 2166620 - DNA, 10 bp, Homo sapiens
aatcaagaga

SEQ ID NO: 2166621 - DNA, 13 bp, Homo sapiens
aatcatacaaact

SEQ ID NO: 2166622 - DNA, 20 bp, Homo sapiens
aatccgaagggaattaaaaa

SEQ ID NO: 2166623 - DNA, 16 bp, Homo sapiens
aatgacttagaaactg

SEQ ID NO: 2166624 - DNA, 22 bp, Homo sapiens
aatgggatggtcggatctcaca

SEQ ID NO: 2166625 - DNA, 16 bp, Homo sapiens
aattggtaattacctg

SEQ ID NO: 2166626 - DNA, 18 bp, Homo sapiens
aatttagtggatggaata

SEQ ID NO: 2166627 - DNA, 15 bp, Homo sapiens
acaaggtgctaacat

SEQ ID NO: 2166628 - DNA, 14 bp, Homo sapiens
acagctaccaccct

SEQ ID NO: 2166629 - DNA, 16 bp, Homo sapiens
acagctaccaccctta

SEQ ID NO: 2166630 - DNA, 19 bp, Homo sapiens
acaggtgccgccagctgcc

SEQ ID NO: 2166631 - DNA, 17 bp, Homo sapiens
acatgacattcttagct

SEQ ID NO: 2166632 - DNA, 14 bp, Homo sapiens
acatgtgccctcag

SEQ ID NO: 2166633 - DNA, 18 bp, Homo sapiens
acattctcacataagccc

SEQ ID NO: 2166634 - DNA, 22 bp, Homo sapiens
acattcttagctgtaacttaac

SEQ ID NO: 2166635 - DNA, 17 bp, Homo sapiens
accagcccgaacaccat

SEQ ID NO: 2166636 - DNA, 16 bp, Homo sapiens
acccaagacatgacat

SEQ ID NO: 2166637 - DNA, 15 bp, Homo sapiens
acccaccttgacgtt

SEQ ID NO: 2166638 - DNA, 18 bp, Homo sapiens
acccatgcagctgctccc

SEQ ID NO: 2166639 - DNA, 19 bp, Homo sapiens
accctattctatccatctc

SEQ ID NO: 2166640 - DNA, 19 bp, Homo sapiens
accctccccttttttcttc

SEQ ID NO: 2166641 - DNA, 23 bp, Homo sapiens
acccttttaagtttaaaatgtgt

SEQ ID NO: 2166642 - DNA, 12 bp, Homo sapiens
acctccaagcat

SEQ ID NO: 2166643 - DNA, 17 bp, Homo sapiens
accttcccttctacaag

SEQ ID NO: 2166644 - DNA, 22 bp, Homo sapiens
accttgtctgctaaataaacat

SEQ ID NO: 2166645 - DNA, 23 bp, Homo sapiens
acctttcagtgcagtttcttttc

SEQ ID NO: 2166646 - DNA, 12 bp, Homo sapiens
actctcaccatg

SEQ ID NO: 2166647 - DNA, 14 bp, Homo sapiens
actgagagaaagat

SEQ ID NO: 2166648 - DNA, 19 bp, Homo sapiens
actttgtgttcatttcatt

SEQ ID NO: 2166649 - DNA, 16 bp, Homo sapiens
agaaaaaaaagtgtct

SEQ ID NO: 2166650 - DNA, 23 bp, Homo sapiens
agaaaaaaaagtgtctcaaagga

SEQ ID NO: 2166651 - DNA, 15 bp, Homo sapiens
agaaagggattgctt

SEQ ID NO: 2166652 - DNA, 21 bp, Homo sapiens
agaaattccatacttctctca

SEQ ID NO: 2166653 - DNA, 23 bp, Homo sapiens
agaaattccatacttctctcaga

SEQ ID NO: 2166654 - DNA, 13 bp, Homo sapiens
agaagaatggctt

SEQ ID NO: 2166655 - DNA, 23 bp, Homo sapiens
agaagaatggctttcaataccct

SEQ ID NO: 2166656 - DNA, 15 bp, Homo sapiens
agacattctcacata

SEQ ID NO: 2166657 - DNA, 15 bp, Homo sapiens
agaccctccccacag

SEQ ID NO: 2166658 - DNA, 21 bp, Homo sapiens
agactttgtgttcatttcatt

SEQ ID NO: 2166659 - DNA, 16 bp, Homo sapiens
agagaaacttcaaagt

SEQ ID NO: 2166660 - DNA, 20 bp, Homo sapiens
agagcaaaagcctcagaaag

SEQ ID NO: 2166661 - DNA, 14 bp, Homo sapiens
agagttccttctca

SEQ ID NO: 2166662 - DNA, 22 bp, Homo sapiens
agctaccacccttaggggtaat

SEQ ID NO: 2166663 - DNA, 19 bp, Homo sapiens
agctgctccccaggccacc

SEQ ID NO: 2166664 - DNA, 20 bp, Homo sapiens
agctgctccccaggccaccc

SEQ ID NO: 2166665 - DNA, 21 bp, Homo sapiens
agctgggagaccctccccaca

SEQ ID NO: 2166666 - DNA, 11 bp, Homo sapiens
agctttctcaa

SEQ ID NO: 2166667 - DNA, 17 bp, Homo sapiens
agctttctcaatgtctt

SEQ ID NO: 2166668 - DNA, 20 bp, Homo sapiens
agctttctcaatgtcttccc

SEQ ID NO: 2166669 - DNA, 14 bp, Homo sapiens
aggaaggccaaaat

SEQ ID NO: 2166670 - DNA, 23 bp, Homo sapiens
aggatggttttgggactagaggc

SEQ ID NO: 2166671 - DNA, 23 bp, Homo sapiens
aggccaccccgctgatggagccc

SEQ ID NO: 2166672 - DNA, 21 bp, Homo sapiens
aggctgagaactcgttcacct

SEQ ID NO: 2166673 - DNA, 17 bp, Homo sapiens
aggctgtaactgagaga

SEQ ID NO: 2166674 - DNA, 20 bp, Homo sapiens
aggctgtaactgagagaaag

SEQ ID NO: 2166675 - DNA, 16 bp, Homo sapiens
agggcttctcctcctc

SEQ ID NO: 2166676 - DNA, 20 bp, Homo sapiens
aggtgccgccagctgccgca

SEQ ID NO: 2166677 - DNA, 16 bp, Homo sapiens
agtaaagaaagcagaa

SEQ ID NO: 2166678 - DNA, 13 bp, Homo sapiens
agtaacagacaca

SEQ ID NO: 2166679 - DNA, 15 bp, Homo sapiens
agtcatctcccctcc

SEQ ID NO: 2166680 - DNA, 19 bp, Homo sapiens
agtcatctcccctcctggc

SEQ ID NO: 2166681 - DNA, 23 bp, Homo sapiens
gggggtggagagaccagcctttc

SEQ ID NO: 2166682 - DNA, 13 bp, Homo sapiens
ggggtgaagctgg

SEQ ID NO: 2166683 - DNA, 21 bp, Homo sapiens
ggggtgccctccactgccctc

SEQ ID NO: 2166684 - DNA, 19 bp, Homo sapiens
ggggtgtcacagaggcagt

SEQ ID NO: 2166685 - DNA, 20 bp, Homo sapiens
ggggtttttttcatccctgc

SEQ ID NO: 2166686 - DNA, 21 bp, Homo sapiens
gggtaaaaagagaaggcaagc

SEQ ID NO: 2166687 - DNA, 21 bp, Homo sapiens
gggtagcttctgacctcagca

SEQ ID NO: 2166688 - DNA, 19 bp, Homo sapiens
gggtcagtgtgccaccctc

SEQ ID NO: 2166689 - DNA, 22 bp, Homo sapiens
gggtcccagctaaagaggtggg

SEQ ID NO: 2166690 - DNA, 14 bp, Homo sapiens
gggtcgtgaggcaa

SEQ ID NO: 2166691 - DNA, 22 bp, Homo sapiens
gggtctccctatgttgcccagg

SEQ ID NO: 2166692 - DNA, 16 bp, Homo sapiens
gggtctgggaggcagg

SEQ ID NO: 2166693 - DNA, 18 bp, Homo sapiens
gggtctgggaggcaggtc

SEQ ID NO: 2166694 - DNA, 18 bp, Homo sapiens
gggtgaaaagtatggcag

SEQ ID NO: 2166695 - DNA, 14 bp, Homo sapiens
gggtgaagctgggg

SEQ ID NO: 2166696 - DNA, 23 bp, Homo sapiens
gggtgccaaccacctctggccct

SEQ ID NO: 2166697 - DNA, 13 bp, Homo sapiens
gggtgcccacagc

SEQ ID NO: 2166698 - DNA, 15 bp, Homo sapiens
gggtggggcgggagg

SEQ ID NO: 2166699 - DNA, 14 bp, Homo sapiens
gggtgggggcctgc

SEQ ID NO: 2166700 - DNA, 24 bp, Homo sapiens
gggtgggggcctgctgtgggtcag

SEQ ID NO: 2166701 - DNA, 19 bp, Homo sapiens
gggtgtcacagaggcagtg

SEQ ID NO: 2166702 - DNA, 19 bp, Homo sapiens
gggtgttttttttttttct

SEQ ID NO: 2166703 - DNA, 14 bp, Homo sapiens
gggttggctgggta

SEQ ID NO: 2166704 - DNA, 17 bp, Homo sapiens
ggtacaggaaggcttgc

SEQ ID NO: 2166705 - DNA, 17 bp, Homo sapiens
ggtacctgccctctatt

SEQ ID NO: 2166706 - DNA, 23 bp, Homo sapiens
ggtaggcaaggctgccggctgca

SEQ ID NO: 2166707 - DNA, 12 bp, Homo sapiens
ggtcaaaaacaa

SEQ ID NO: 2166708 - DNA, 13 bp, Homo sapiens
ggtcaaaaacaaa

SEQ ID NO: 2166709 - DNA, 18 bp, Homo sapiens
ggtcaataattgtggaga

SEQ ID NO: 2166710 - DNA, 20 bp, Homo sapiens
ggtcaataattgtggagagg

SEQ ID NO: 2166711 - DNA, 21 bp, Homo sapiens
ggtcaataattgtggagagga

SEQ ID NO: 2166712 - DNA, 22 bp, Homo sapiens
ggtcaataattgtggagaggag

SEQ ID NO: 2166713 - DNA, 22 bp, Homo sapiens
ggtcaccaggggaggagcctgt

SEQ ID NO: 2166714 - DNA, 19 bp, Homo sapiens
ggtcactgaaacttcaagc

SEQ ID NO: 2166715 - DNA, 14 bp, Homo sapiens
ggtcagggctatgg

SEQ ID NO: 2166716 - DNA, 12 bp, Homo sapiens
ggtcagtaccca

SEQ ID NO: 2166717 - DNA, 17 bp, Homo sapiens
ggtcagtacccacctga

SEQ ID NO: 2166718 - DNA, 20 bp, Homo sapiens
ggtcagtacccacctgagct

SEQ ID NO: 2166719 - DNA, 15 bp, Homo sapiens
ggtcagtgtgccacc

SEQ ID NO: 2166720 - DNA, 17 bp, Homo sapiens
ggtcagtgtgccaccct

SEQ ID NO: 2166721 - DNA, 17 bp, Homo sapiens
ggtcatttgccaactaa

SEQ ID NO: 2166722 - DNA, 23 bp, Homo sapiens
ggtcccaaggcaaggggtgcctg

SEQ ID NO: 2166723 - DNA, 20 bp, Homo sapiens
ggtcccgagccccctgtcct

SEQ ID NO: 2166724 - DNA, 21 bp, Homo sapiens
ggtcccgagccccctgtcctt

SEQ ID NO: 2166725 - DNA, 20 bp, Homo sapiens
ggtcctccggggctcagccc

SEQ ID NO: 2166726 - DNA, 17 bp, Homo sapiens
ggtcctgtctcccctct

SEQ ID NO: 2166727 - DNA, 18 bp, Homo sapiens
ggtctatttctcccttca

SEQ ID NO: 2166728 - DNA, 20 bp, Homo sapiens
ggtctatttctcccttcaat

SEQ ID NO: 2166729 - DNA, 15 bp, Homo sapiens
ggtctccaggggcct

SEQ ID NO: 2166730 - DNA, 21 bp, Homo sapiens
ggtctccctatgttgcccagg

SEQ ID NO: 2166731 - DNA, 11 bp, Homo sapiens
ggtctgggagg

SEQ ID NO: 2166732 - DNA, 20 bp, Homo sapiens
ggtctgggggtcaggaggca

SEQ ID NO: 2166733 - DNA, 19 bp, Homo sapiens
ggtcttggtcatttgccaa

SEQ ID NO: 2166734 - DNA, 17 bp, Homo sapiens
ggtgaccagtttcttaa

SEQ ID NO: 2166735 - DNA, 17 bp, Homo sapiens
ggtgaccggcctggacc

SEQ ID NO: 2166736 - DNA, 14 bp, Homo sapiens
ggtgactgccaccg

SEQ ID NO: 2166737 - DNA, 12 bp, Homo sapiens
ggtgagtttttc

SEQ ID NO: 2166738 - DNA, 15 bp, Homo sapiens
ggtgattttcctgtg

SEQ ID NO: 2166739 - DNA, 13 bp, Homo sapiens
ggtgcacatgaca

SEQ ID NO: 2166740 - DNA, 23 bp, Homo sapiens
ggtgccacagagggctgtgtctt

SEQ ID NO: 2166741 - DNA, 14 bp, Homo sapiens
ggtgccaccaccct

SEQ ID NO: 2166742 - DNA, 21 bp, Homo sapiens
ggtgcccagactcaaggcctc

SEQ ID NO: 2166743 - DNA, 16 bp, Homo sapiens
ggtgctaaccccgtct

SEQ ID NO: 2166744 - DNA, 17 bp, Homo sapiens
ggtgctgaactgtgcat

SEQ ID NO: 2166745 - DNA, 20 bp, Homo sapiens
ggtggacatttcggaagtgg

SEQ ID NO: 2166746 - DNA, 15 bp, Homo sapiens
ggtggcatggaagag

SEQ ID NO: 2166747 - DNA, 16 bp, Homo sapiens
ggtggccgggggtggg

SEQ ID NO: 2166748 - DNA, 13 bp, Homo sapiens
ggtggctctgaga

SEQ ID NO: 2166749 - DNA, 14 bp, Homo sapiens
ggtggctggaggca

SEQ ID NO: 2166750 - DNA, 22 bp, Homo sapiens
ggtggcttgggacttgggagag

SEQ ID NO: 2166751 - DNA, 18 bp, Homo sapiens
ggtgggcaccaagagcca

SEQ ID NO: 2166752 - DNA, 14 bp, Homo sapiens
ggtgggcagccatg

SEQ ID NO: 2166753 - DNA, 12 bp, Homo sapiens
ggtggggaagag

SEQ ID NO: 2166754 - DNA, 20 bp, Homo sapiens
ggtggggaagagagcctgcc

SEQ ID NO: 2166755 - DNA, 13 bp, Homo sapiens
gtctgggaggcag

SEQ ID NO: 2166756 - DNA, 21 bp, Homo sapiens
gtctgtcacccaggctggagt

SEQ ID NO: 2166757 - DNA, 21 bp, Homo sapiens
gtctgtgaaagtctcctgtat

SEQ ID NO: 2166758 - DNA, 13 bp, Homo sapiens
gtctgtgcctgga

SEQ ID NO: 2166759 - DNA, 16 bp, Homo sapiens
gtctgtgcctggagct

SEQ ID NO: 2166760 - DNA, 17 bp, Homo sapiens
gtctgtgcctggagctc

SEQ ID NO: 2166761 - DNA, 15 bp, Homo sapiens
gtctgtgtgctgtgg

SEQ ID NO: 2166762 - DNA, 14 bp, Homo sapiens
gtcttccaggccca

SEQ ID NO: 2166763 - DNA, 18 bp, Homo sapiens
gtcttccaggcccagtcc

SEQ ID NO: 2166764 - DNA, 15 bp, Homo sapiens
gtcttccatcagcag

SEQ ID NO: 2166765 - DNA, 16 bp, Homo sapiens
gtcttccatcagcagt

SEQ ID NO: 2166766 - DNA, 19 bp, Homo sapiens
gtcttccatcagcagtgat

SEQ ID NO: 2166767 - DNA, 17 bp, Homo sapiens
gtcttccctagggctgg

SEQ ID NO: 2166768 - DNA, 21 bp, Homo sapiens
gtcttccctagggctgggtgt

SEQ ID NO: 2166769 - DNA, 15 bp, Homo sapiens
gtcttcctcctcccc

SEQ ID NO: 2166770 - DNA, 13 bp, Homo sapiens
gtcttctgttcat

SEQ ID NO: 2166771 - DNA, 18 bp, Homo sapiens
gtcttgagagcgctggcc

SEQ ID NO: 2166772 - DNA, 20 bp, Homo sapiens
gtcttgagagcgctggcctc

SEQ ID NO: 2166773 - DNA, 18 bp, Homo sapiens
gtcttggtcatttgccaa

SEQ ID NO: 2166774 - DNA, 20 bp, Homo sapiens
gtgaaaattacacccatgca

SEQ ID NO: 2166775 - DNA, 15 bp, Homo sapiens
gtgaaataatattga

SEQ ID NO: 2166776 - DNA, 20 bp, Homo sapiens
gtgaaatgtatgtctgtcta

SEQ ID NO: 2166777 - DNA, 20 bp, Homo sapiens
gtgaaatttgttaatatata

SEQ ID NO: 2166778 - DNA, 14 bp, Homo sapiens
gtgaacaaatttca

SEQ ID NO: 2166779 - DNA, 18 bp, Homo sapiens
gtgaagctggggacagct

SEQ ID NO: 2166780 - DNA, 18 bp, Homo sapiens
gtgaaggaaaaacatgct

SEQ ID NO: 2166781 - DNA, 12 bp, Homo sapiens
gtgaaggcagaa

SEQ ID NO: 2166782 - DNA, 15 bp, Homo sapiens
gtgaagtatgcacta

SEQ ID NO: 2166783 - DNA, 22 bp, Homo sapiens
gtgaagtttgtcaggcacagta

SEQ ID NO: 2166784 - DNA, 16 bp, Homo sapiens
gtgaccaaaatcccct

SEQ ID NO: 2166785 - DNA, 15 bp, Homo sapiens
gtgaccagtttctta

SEQ ID NO: 2166786 - DNA, 22 bp, Homo sapiens
gtgacccacccgccttggcctc

SEQ ID NO: 2166787 - DNA, 19 bp, Homo sapiens
gtgactaccacttatttct

SEQ ID NO: 2166788 - DNA, 21 bp, Homo sapiens
gtgactaccacttatttctaa

SEQ ID NO: 2166789 - DNA, 21 bp, Homo sapiens
gtgactgatgttaggctgggc

SEQ ID NO: 2166790 - DNA, 16 bp, Homo sapiens
gtgactgccaccgtgc

SEQ ID NO: 2166791 - DNA, 16 bp, Homo sapiens
gtgagagaaagagaga

SEQ ID NO: 2166792 - DNA, 23 bp, Homo sapiens
gtgagagaaagagagaagccagc

SEQ ID NO: 2166793 - DNA, 17 bp, Homo sapiens
gtgagcaaacctgcccc

SEQ ID NO: 2166794 - DNA, 21 bp, Homo sapiens
gtgagcagtgtgtctcctgca

SEQ ID NO: 2166795 - DNA, 20 bp, Homo sapiens
gtgagccaccacacccagcc

SEQ ID NO: 2166796 - DNA, 19 bp, Homo sapiens
gtgagccactgtgcccagc

SEQ ID NO: 2166797 - DNA, 19 bp, Homo sapiens
gtgaggggcaagctaggcc

SEQ ID NO: 2166798 - DNA, 23 bp, Homo sapiens
gtgatcctcctgtcttggcctcc

SEQ ID NO: 2166799 - DNA, 23 bp, Homo sapiens
gtgatctcccctcacactttgcc

SEQ ID NO: 2166800 - DNA, 21 bp, Homo sapiens
gtgatggcattactctgcact

SEQ ID NO: 2166801 - DNA, 11 bp, Homo sapiens
gtgatgtatgt

SEQ ID NO: 2166802 - DNA, 12 bp, Homo sapiens
gtgatgtgttcg

SEQ ID NO: 2166803 - DNA, 17 bp, Homo sapiens
gtgattattctgtatca

SEQ ID NO: 2166804 - DNA, 22 bp, Homo sapiens
gtgattgaagtatctgtacctg

SEQ ID NO: 2166805 - DNA, 18 bp, Homo sapiens
gtgattgccatttcttcc

SEQ ID NO: 2166806 - DNA, 15 bp, Homo sapiens
gtgatttatttggag

SEQ ID NO: 2166807 - DNA, 12 bp, Homo sapiens
gtgatttgctat

SEQ ID NO: 2166808 - DNA, 12 bp, Homo sapiens
gtgcaaagctgc

SEQ ID NO: 2166809 - DNA, 13 bp, Homo sapiens
gtgcaaagctgct

SEQ ID NO: 2166810 - DNA, 22 bp, Homo sapiens
gtgcagcggtggaaggagcctg

SEQ ID NO: 2166811 - DNA, 17 bp, Homo sapiens
gtgcagtgtttttcctg

SEQ ID NO: 2166812 - DNA, 22 bp, Homo sapiens
gtgcattgtgtgtcacaaagct

SEQ ID NO: 2166813 - DNA, 17 bp, Homo sapiens
gtgccaaccacctctgg

SEQ ID NO: 2166814 - DNA, 14 bp, Homo sapiens
gtgccaccctctgc

SEQ ID NO: 2166815 - DNA, 16 bp, Homo sapiens
gtgccaccctctgcag

SEQ ID NO: 2166816 - DNA, 19 bp, Homo sapiens
gtgccaccctctgcagggc

SEQ ID NO: 2166817 - DNA, 21 bp, Homo sapiens
gtgccaccctctgcagggcag

SEQ ID NO: 2166818 - DNA, 12 bp, Homo sapiens
gtgcccacagcc

SEQ ID NO: 2166819 - DNA, 22 bp, Homo sapiens
gtgcccacagcccgcatgcagc

SEQ ID NO: 2166820 - DNA, 20 bp, Homo sapiens
gtgcccagcagtttcccaga

SEQ ID NO: 2166821 - DNA, 12 bp, Homo sapiens
gtgcccagctca

SEQ ID NO: 2166822 - DNA, 13 bp, Homo sapiens
gtgcccagctcag

SEQ ID NO: 2166823 - DNA, 15 bp, Homo sapiens
gtgcccagtgatggc

SEQ ID NO: 2166824 - DNA, 18 bp, Homo sapiens
gtgcccagtgatggcatt

SEQ ID NO: 2166825 - DNA, 21 bp, Homo sapiens
gtgcccagtgatggcattact

SEQ ID NO: 2166826 - DNA, 13 bp, Homo sapiens
gtgcccctagctt

SEQ ID NO: 2166827 - DNA, 18 bp, Homo sapiens
gtgcccggctaatgtttg

SEQ ID NO: 2166828 - DNA, 18 bp, Homo sapiens
gtgccctccactgccctc

SEQ ID NO: 2166829 - DNA, 20 bp, Homo sapiens
gtgccctccactgccctctg

SEQ ID NO: 2166830 - DNA, 13 bp, Homo sapiens
gtgcccttgctgg

SEQ ID NO: 2166831 - DNA, 14 bp, Homo sapiens
gtgccgaagtgttt

SEQ ID NO: 2166832 - DNA, 18 bp, Homo sapiens
gtgcctggagctcctggg

SEQ ID NO: 2166833 - DNA, 14 bp, Homo sapiens
gtgctcagttccaa

SEQ ID NO: 2166834 - DNA, 23 bp, Homo sapiens
gtgctcatgtctgttaataaaga

SEQ ID NO: 2166835 - DNA, 20 bp, Homo sapiens
gtgctggaatggggacctgg

SEQ ID NO: 2166836 - DNA, 12 bp, Homo sapiens
gtgctggagagt

SEQ ID NO: 2166837 - DNA, 12 bp, Homo sapiens
gtgctggagcca

SEQ ID NO: 2166838 - DNA, 18 bp, Homo sapiens
gtgctggagccactaact

SEQ ID NO: 2166839 - DNA, 19 bp, Homo sapiens
gtgctgggattacaggtgt

SEQ ID NO: 2166840 - DNA, 15 bp, Homo sapiens
gtgctgtggttcctg

SEQ ID NO: 2166841 - DNA, 18 bp, Homo sapiens
gtgctgttgtctgccgtg

SEQ ID NO: 2166842 - DNA, 19 bp, Homo sapiens
gtgcttttaaactggagag

SEQ ID NO: 2166843 - DNA, 20 bp, Homo sapiens
gtggaaagaaaagacaaatg

SEQ ID NO: 2166844 - DNA, 15 bp, Homo sapiens
gtagaagagggagaa

SEQ ID NO: 2166845 - DNA, 14 bp, Homo sapiens
gtagacccctggct

SEQ ID NO: 2166846 - DNA, 16 bp, Homo sapiens
gtagacccctggctgg

SEQ ID NO: 2166847 - DNA, 14 bp, Homo sapiens
gtagagaatgtgtg

SEQ ID NO: 2166848 - DNA, 21 bp, Homo sapiens
gtagagaatgtgtgtagatac

SEQ ID NO: 2166849 - DNA, 20 bp, Homo sapiens
gtagcaaattccaatacatt

SEQ ID NO: 2166850 - DNA, 15 bp, Homo sapiens
gtagccatgggacca

SEQ ID NO: 2166851 - DNA, 21 bp, Homo sapiens
gtagccccaagaaggctgggg

SEQ ID NO: 2166852 - DNA, 20 bp, Homo sapiens
gtagcctgcgtcatggctca

SEQ ID NO: 2166853 - DNA, 22 bp, Homo sapiens
gtagggatgcggatcctgctgg

SEQ ID NO: 2166854 - DNA, 15 bp, Homo sapiens
gtaggttctgtctgt

SEQ ID NO: 2166855 - DNA, 20 bp, Homo sapiens
gtaggttggaagctagctcc

SEQ ID NO: 2166856 - DNA, 14 bp, Homo sapiens
gtaggttgtctaaa

SEQ ID NO: 2166857 - DNA, 19 bp, Homo sapiens
gtatagcaatatcaaaagg

SEQ ID NO: 2166858 - DNA, 20 bp, Homo sapiens
gtatcaaacagctcaggctg

SEQ ID NO: 2166859 - DNA, 23 bp, Homo sapiens
gtatctgtacctgcccccactca

SEQ ID NO: 2166860 - DNA, 20 bp, Homo sapiens
gtatgcactaatcaatactt

SEQ ID NO: 2166861 - DNA, 22 bp, Homo sapiens
gtatgcactaatcaatactttg

SEQ ID NO: 2166862 - DNA, 17 bp, Homo sapiens
gtatgggtttctcccag

SEQ ID NO: 2166863 - DNA, 13 bp, Homo sapiens
gtatgtatgtgta

SEQ ID NO: 2166864 - DNA, 18 bp, Homo sapiens
gtatgtgtctagcaaagc

SEQ ID NO: 2166865 - DNA, 20 bp, Homo sapiens
gtatgtgtctagcaaagcca

SEQ ID NO: 2166866 - DNA, 17 bp, Homo sapiens
gtattaacctacctgtg

SEQ ID NO: 2166867 - DNA, 13 bp, Homo sapiens
gtattcagagcca

SEQ ID NO: 2166868 - DNA, 15 bp, Homo sapiens
gtattctctgtccag

SEQ ID NO: 2166869 - DNA, 19 bp, Homo sapiens
gtattctctgtccagggct

SEQ ID NO: 2166870 - DNA, 15 bp, Homo sapiens
gtattgtgaaatttg

SEQ ID NO: 2166871 - DNA, 17 bp, Homo sapiens
gtatttaacagaaattg

SEQ ID NO: 2166872 - DNA, 19 bp, Homo sapiens
gtatttaacagaaattgta

SEQ ID NO: 2166873 - DNA, 20 bp, Homo sapiens
gtatttaacagaaattgtat

SEQ ID NO: 2166874 - DNA, 18 bp, Homo sapiens
gtatttagtaaaaataaa

SEQ ID NO: 2166875 - DNA, 19 bp, Homo sapiens
gtatttagtaaaaataaat

SEQ ID NO: 2166876 - DNA, 12 bp, Homo sapiens
gtcaaaaacaaa

SEQ ID NO: 2166877 - DNA, 23 bp, Homo sapiens
gtcaacctgcttttttctgtttt

SEQ ID NO: 2166878 - DNA, 17 bp, Homo sapiens
gtcaaccttgtgtgagt

SEQ ID NO: 2166879 - DNA, 21 bp, Homo sapiens
gtcaaggcctgtccctggcca

SEQ ID NO: 2166880 - DNA, 19 bp, Homo sapiens
gtcaataattgtggagagg

SEQ ID NO: 2166881 - DNA, 22 bp, Homo sapiens
gtcaataattgtggagaggaga

SEQ ID NO: 2166882 - DNA, 19 bp, Homo sapiens
gtcacagagaactagtggt

SEQ ID NO: 2166883 - DNA, 13 bp, Homo sapiens
gtcacagaggcag

SEQ ID NO: 2166884 - DNA, 17 bp, Homo sapiens
gtcacagaggcagtggc

SEQ ID NO: 2166885 - DNA, 17 bp, Homo sapiens
gtcaccaggggaggagc

SEQ ID NO: 2166886 - DNA, 22 bp, Homo sapiens
gtcaccaggggaggagcctgtg

SEQ ID NO: 2166887 - DNA, 22 bp, Homo sapiens
gtcacctgcacagggccctctg

SEQ ID NO: 2166888 - DNA, 23 bp, Homo sapiens
gtcacctgccccgtagagaatgt

SEQ ID NO: 2166889 - DNA, 21 bp, Homo sapiens
gtcacctgtgcagggccctct

SEQ ID NO: 2166890 - DNA, 16 bp, Homo sapiens
gtcactggggctgcgc

SEQ ID NO: 2166891 - DNA, 17 bp, Homo sapiens
gtcagaataaagaacat

SEQ ID NO: 2166892 - DNA, 20 bp, Homo sapiens
gtcagaataaagaacattct

SEQ ID NO: 2166893 - DNA, 23 bp, Homo sapiens
gtcagtgtgccaccctctgcagg

SEQ ID NO: 2166894 - DNA, 16 bp, Homo sapiens
gtcatcagtattgtgt

SEQ ID NO: 2166895 - DNA, 12 bp, Homo sapiens
gtcatcttgagc

SEQ ID NO: 2166896 - DNA, 23 bp, Homo sapiens
gtcatgaagctcagtttggctgt

SEQ ID NO: 2166897 - DNA, 19 bp, Homo sapiens
gtcatggctctgaactgca

SEQ ID NO: 2166898 - DNA, 19 bp, Homo sapiens
gtcatttttgtttttggtt

SEQ ID NO: 2166899 - DNA, 16 bp, Homo sapiens
gtccacatctaacaaa

SEQ ID NO: 2166900 - DNA, 20 bp, Homo sapiens
gtccacccgtttccaagcct

SEQ ID NO: 2166901 - DNA, 16 bp, Homo sapiens
gtccaggatcaaaaga

SEQ ID NO: 2166902 - DNA, 22 bp, Homo sapiens
gtcccaaggcaaggggtgcctg

SEQ ID NO: 2166903 - DNA, 20 bp, Homo sapiens
gtcccaatttaagagtcctg

SEQ ID NO: 2166904 - DNA, 12 bp, Homo sapiens
gtcccacagctt

SEQ ID NO: 2166905 - DNA, 20 bp, Homo sapiens
gtcccagctaaagaggtggg

SEQ ID NO: 2166906 - DNA, 21 bp, Homo sapiens
gtcccagctgaaggcagtggc

SEQ ID NO: 2166907 - DNA, 12 bp, Homo sapiens
gtccctgcaggg

SEQ ID NO: 2166908 - DNA, 13 bp, Homo sapiens
gtccctgcagggc

SEQ ID NO: 2166909 - DNA, 14 bp, Homo sapiens
gtccctgcagggcc

SEQ ID NO: 2166910 - DNA, 17 bp, Homo sapiens
gtccctgccccctcccc

SEQ ID NO: 2166911 - DNA, 18 bp, Homo sapiens
gtcccttccacaccccca

SEQ ID NO: 2166912 - DNA, 19 bp, Homo sapiens
gtccgccctcttcccctct

SEQ ID NO: 2166913 - DNA, 15 bp, Homo sapiens
gtcctcacaagcctc

SEQ ID NO: 2166914 - DNA, 14 bp, Homo sapiens
gtcctcattcttct

SEQ ID NO: 2166915 - DNA, 21 bp, Homo sapiens
gtcctcccacccctccccact

SEQ ID NO: 2166916 - DNA, 18 bp, Homo sapiens
gtcctccggggctcagcc

SEQ ID NO: 2166917 - DNA, 20 bp, Homo sapiens
gtcctccggggctcagccct

SEQ ID NO: 2166918 - DNA, 23 bp, Homo sapiens
gtcctccggggctcagccctgag

SEQ ID NO: 2166919 - DNA, 17 bp, Homo sapiens
gtcctgaggcagaacct

SEQ ID NO: 2166920 - DNA, 23 bp, Homo sapiens
gtcctgaggcagaacctggtggc

SEQ ID NO: 2166921 - DNA, 13 bp, Homo sapiens
gtcctgcagagct

SEQ ID NO: 2166922 - DNA, 21 bp, Homo sapiens
gtcctgctatttcccaagctg

SEQ ID NO: 2166923 - DNA, 22 bp, Homo sapiens
gtcctggcgcctggcagtccgt

SEQ ID NO: 2166924 - DNA, 18 bp, Homo sapiens
gtcctgtctcccctctgc

SEQ ID NO: 2166925 - DNA, 13 bp, Homo sapiens
tcaaatctgtaat

SEQ ID NO: 2166926 - DNA, 18 bp, Homo sapiens
tcaacaacatcagaaaga

SEQ ID NO: 2166927 - DNA, 17 bp, Homo sapiens
tcaacaacgtgagagaa

SEQ ID NO: 2166928 - DNA, 21 bp, Homo sapiens
tcaacaacgtgagagaaagag

SEQ ID NO: 2166929 - DNA, 19 bp, Homo sapiens
tcaacatggaaaaatcctg

SEQ ID NO: 2166930 - DNA, 18 bp, Homo sapiens
tcaaccatgtcatctttt

SEQ ID NO: 2166931 - DNA, 18 bp, Homo sapiens
tcaagacgaggggcaggg

SEQ ID NO: 2166932 - DNA, 19 bp, Homo sapiens
tcaagcaatcctcctgagt

SEQ ID NO: 2166933 - DNA, 19 bp, Homo sapiens
tcaaggccgtgtccccttg

SEQ ID NO: 2166934 - DNA, 22 bp, Homo sapiens
tcaagggactgggggtgccaac

SEQ ID NO: 2166935 - DNA, 16 bp, Homo sapiens
tcatatgttgtaggaa

SEQ ID NO: 2166936 - DNA, 22 bp, Homo sapiens
tcatattaatataagtttcttt

SEQ ID NO: 2166937 - DNA, 20 bp, Homo sapiens
tcatccacacaacaccagga

SEQ ID NO: 2166938 - DNA, 23 bp, Homo sapiens
tcatccacacaacaccaggactt

SEQ ID NO: 2166939 - DNA, 20 bp, Homo sapiens
tcatcccaacagccaagacc

SEQ ID NO: 2166940 - DNA, 18 bp, Homo sapiens
tcatccttagcaacagcc

SEQ ID NO: 2166941 - DNA, 18 bp, Homo sapiens
tcatggctcactgcagcc

SEQ ID NO: 2166942 - DNA, 19 bp, Homo sapiens
tcatggctcactgcagcct

SEQ ID NO: 2166943 - DNA, 17 bp, Homo sapiens
tcatgtaggttgtctaa

SEQ ID NO: 2166944 - DNA, 22 bp, Homo sapiens
tcatgttaatcctagctgtgtg

SEQ ID NO: 2166945 - DNA, 20 bp, Homo sapiens
tcatgttagttttgctcctt

SEQ ID NO: 2166946 - DNA, 15 bp, Homo sapiens
tcatgtttgtgcatg

SEQ ID NO: 2166947 - DNA, 13 bp, Homo sapiens
tcattaagaggca

SEQ ID NO: 2166948 - DNA, 21 bp, Homo sapiens
tcattcagtgagacacagagt

SEQ ID NO: 2166949 - DNA, 16 bp, Homo sapiens
tcattccatttgctga

SEQ ID NO: 2166950 - DNA, 17 bp, Homo sapiens
tcattctctctgaacac

SEQ ID NO: 2166951 - DNA, 13 bp, Homo sapiens
tcattctctttct

SEQ ID NO: 2166952 - DNA, 14 bp, Homo sapiens
tcattgaaatgtaa

SEQ ID NO: 2166953 - DNA, 21 bp, Homo sapiens
tcattgaaatgtaatttcagt

SEQ ID NO: 2166954 - DNA, 14 bp, Homo sapiens
tcatttatttccat

SEQ ID NO: 2166955 - DNA, 17 bp, Homo sapiens
tcatttgcagctgctgg

SEQ ID NO: 2166956 - DNA, 17 bp, Homo sapiens
tcattttcacttttaaa

SEQ ID NO: 2166957 - DNA, 17 bp, Homo sapiens
tcattttgtatgtatgt

SEQ ID NO: 2166958 - DNA, 19 bp, Homo sapiens
tcatttttgtttctacctc

SEQ ID NO: 2166959 - DNA, 17 bp, Homo sapiens
tccaaagctttcctgga

SEQ ID NO: 2166960 - DNA, 19 bp, Homo sapiens
tccaaattgatgggtgggc

SEQ ID NO: 2166961 - DNA, 19 bp, Homo sapiens
tccaacatttcctcaggca

SEQ ID NO: 2166962 - DNA, 12 bp, Homo sapiens
tccaagaaaaat

SEQ ID NO: 2166963 - DNA, 19 bp, Homo sapiens
tccaagcctgggccactgg

SEQ ID NO: 2166964 - DNA, 20 bp, Homo sapiens
tccaagcctgggccactggc

SEQ ID NO: 2166965 - DNA, 13 bp, Homo sapiens
tccaagtgtttct

SEQ ID NO: 2166966 - DNA, 17 bp, Homo sapiens
tccaagtgtttcttgtt

SEQ ID NO: 2166967 - DNA, 17 bp, Homo sapiens
tccaatatttataatta

SEQ ID NO: 2166968 - DNA, 15 bp, Homo sapiens
tccaatgtgcccagt

SEQ ID NO: 2166969 - DNA, 20 bp, Homo sapiens
tccaatgtgcccagtcatga

SEQ ID NO: 2166970 - DNA, 20 bp, Homo sapiens
tccacacaacaccaggactt

SEQ ID NO: 2166971 - DNA, 13 bp, Homo sapiens
tccacacccccac

SEQ ID NO: 2166972 - DNA, 18 bp, Homo sapiens
tccacagaaaccctgttt

SEQ ID NO: 2166973 - DNA, 13 bp, Homo sapiens
tccacaggattcc

SEQ ID NO: 2166974 - DNA, 21 bp, Homo sapiens
tccacagggacacagtctggt

SEQ ID NO: 2166975 - DNA, 18 bp, Homo sapiens
tccacccctccttccctg

SEQ ID NO: 2166976 - DNA, 23 bp, Homo sapiens
tccacccgtttccaagcctgggc

SEQ ID NO: 2166977 - DNA, 16 bp, Homo sapiens
tccacctccttctctg

SEQ ID NO: 2166978 - DNA, 21 bp, Homo sapiens
tccactgcaaataaagccttt

SEQ ID NO: 2166979 - DNA, 13 bp, Homo sapiens
tccactggaaact

SEQ ID NO: 2166980 - DNA, 23 bp, Homo sapiens
tccactttcaggagggaaaaccc

SEQ ID NO: 2166981 - DNA, 18 bp, Homo sapiens
tccagatctgcagtcact

SEQ ID NO: 2166982 - DNA, 14 bp, Homo sapiens
tccagattgtagct

SEQ ID NO: 2166983 - DNA, 11 bp, Homo sapiens
tccagcttccc

SEQ ID NO: 2166984 - DNA, 22 bp, Homo sapiens
tccaggaaagtggccaagaagc

SEQ ID NO: 2166985 - DNA, 17 bp, Homo sapiens
tccaggaaggggctgga

SEQ ID NO: 2166986 - DNA, 15 bp, Homo sapiens
tccagggcagcagcc

SEQ ID NO: 2166987 - DNA, 16 bp, Homo sapiens
tccagggcagcagccg

SEQ ID NO: 2166988 - DNA, 21 bp, Homo sapiens
tccagggtaggcaaggctgcc

SEQ ID NO: 2166989 - DNA, 16 bp, Homo sapiens
tccaggtcgggctcag

SEQ ID NO: 2166990 - DNA, 17 bp, Homo sapiens
tccagtcctgctctcta

SEQ ID NO: 2166991 - DNA, 15 bp, Homo sapiens
tccagttttgtgtgc

SEQ ID NO: 2166992 - DNA, 17 bp, Homo sapiens
tccataagatttgcaaa

SEQ ID NO: 2166993 - DNA, 16 bp, Homo sapiens
tccatcagcagtgatt

SEQ ID NO: 2166994 - DNA, 17 bp, Homo sapiens
tccatcctgtacaagtg

SEQ ID NO: 2166995 - DNA, 18 bp, Homo sapiens
tccatgtagaagagggag

SEQ ID NO: 2166996 - DNA, 17 bp, Homo sapiens
tccatgtgctgctgtgg

SEQ ID NO: 2166997 - DNA, 15 bp, Homo sapiens
tccatgttgctgact

SEQ ID NO: 2166998 - DNA, 20 bp, Homo sapiens
tccattgaccttaatttctt

SEQ ID NO: 2166999 - DNA, 15 bp, Homo sapiens
tccatttctctccaa

SEQ ID NO: 2167000 - DNA, 13 bp, Homo sapiens
tccatttgctgat

SEQ ID NO: 2167001 - DNA, 21 bp, Homo sapiens
tccatttggaatcatatggga

SEQ ID NO: 2167002 - DNA, 15 bp, Homo sapiens
tcccaaagtgctgag

SEQ ID NO: 2167003 - DNA, 18 bp, Homo sapiens
tcccaacacttcagactg

SEQ ID NO: 2167004 - DNA, 18 bp, Homo sapiens
tcccaagaacagcaggcc

SEQ ID NO: 2167005 - DNA, 12 bp, Homo sapiens
tcccaagctgga

SEQ ID NO: 2167006 - DNA, 22 bp, Homo sapiens
tcccaagctggagtgcagtggt

SEQ ID NO: 2167007 - DNA, 18 bp, Homo sapiens
tcccaagctgtatgtact

SEQ ID NO: 2167008 - DNA, 23 bp, Homo sapiens
tcccaaggcaaggggtgcctggg

SEQ ID NO: 2167009 - DNA, 12 bp, Homo sapiens
tcccaattcatt

SEQ ID NO: 2167010 - DNA, 16 bp, Homo sapiens
tcccaattcatttcat

SEQ ID NO: 2167011 - DNA, 19 bp, Homo sapiens
tcccaatttaagagtcctg

SEQ ID NO: 2167012 - DNA, 23 bp, Homo sapiens
tcccaatttaagagtcctgaggc

SEQ ID NO: 2167013 - DNA, 19 bp, Homo sapiens
tcccaccggttgcttctgg

SEQ ID NO: 2167014 - DNA, 21 bp, Homo sapiens
tcccaccggttgcttctggga

SEQ ID NO: 2167015 - DNA, 16 bp, Homo sapiens
tcccacggccactgca

SEQ ID NO: 2167016 - DNA, 19 bp, Homo sapiens
tcccacggccactgcagtc

SEQ ID NO: 2167017 - DNA, 13 bp, Homo sapiens
tcccactttgggg

SEQ ID NO: 2167018 - DNA, 16 bp, Homo sapiens
tcccagaggctcctgg

SEQ ID NO: 2167019 - DNA, 17 bp, Homo sapiens
tcccagaggctcctgga

SEQ ID NO: 2167020 - DNA, 19 bp, Homo sapiens
tcccagaggctcctggagc

SEQ ID NO: 2167021 - DNA, 20 bp, Homo sapiens
tcccagaggctcctggagcc

SEQ ID NO: 2167022 - DNA, 23 bp, Homo sapiens
tcccagaggtggggaagagagcc

SEQ ID NO: 2167023 - DNA, 17 bp, Homo sapiens
tcccagatcggatctgt

SEQ ID NO: 2167024 - DNA, 21 bp, Homo sapiens
tcccagccttggcatctagag

SEQ ID NO: 2167025 - DNA, 19 bp, Homo sapiens
tcccagctaaagaggtggg

SEQ ID NO: 2167026 - DNA, 15 bp, Homo sapiens
tcccagctgaaggca

SEQ ID NO: 2167027 - DNA, 13 bp, Homo sapiens
tcccagttcatgt

SEQ ID NO: 2167028 - DNA, 14 bp, Homo sapiens
tcccagttcatgtt

SEQ ID NO: 2167029 - DNA, 14 bp, Homo sapiens
tcccatctgcattt

SEQ ID NO: 2167030 - DNA, 20 bp, Homo sapiens
tccccaaaggtcaaaaacaa

SEQ ID NO: 2167031 - DNA, 14 bp, Homo sapiens
tccccaagctggcc

SEQ ID NO: 2167032 - DNA, 19 bp, Homo sapiens
tccccaagggccctggcac

SEQ ID NO: 2167033 - DNA, 14 bp, Homo sapiens
tccccacactccta

SEQ ID NO: 2167034 - DNA, 23 bp, Homo sapiens
tccccaccccgggctctcctgcc

SEQ ID NO: 2167035 - DNA, 14 bp, Homo sapiens
tccccagcccactg

SEQ ID NO: 2167036 - DNA, 16 bp, Homo sapiens
tccccatactctgtct

SEQ ID NO: 2167037 - DNA, 20 bp, Homo sapiens
tccccatagcaaagggtctg

SEQ ID NO: 2167038 - DNA, 14 bp, Homo sapiens
tcccccacctcttt

SEQ ID NO: 2167039 - DNA, 14 bp, Homo sapiens
tccccctccttgcc

SEQ ID NO: 2167040 - DNA, 23 bp, Homo sapiens
tccccctggccaccaccccccac

SEQ ID NO: 2167041 - DNA, 13 bp, Homo sapiens
tccccgctggctg

SEQ ID NO: 2167042 - DNA, 16 bp, Homo sapiens
tccccgctggctgggg

SEQ ID NO: 2167043 - DNA, 17 bp, Homo sapiens
tccccgctggctggggg

SEQ ID NO: 2167044 - DNA, 17 bp, Homo sapiens
tcccctaccactgtctt

SEQ ID NO: 2167045 - DNA, 21 bp, Homo sapiens
tcccctcccgtcttcctcctc

SEQ ID NO: 2167046 - DNA, 14 bp, Homo sapiens
tcccctcctctccc

SEQ ID NO: 2167047 - DNA, 15 bp, Homo sapiens
tccccttctcatcac

SEQ ID NO: 2167048 - DNA, 14 bp, Homo sapiens
tccccttgcactgg

SEQ ID NO: 2167049 - DNA, 16 bp, Homo sapiens
tccccttgttctaatg

SEQ ID NO: 2167050 - DNA, 13 bp, Homo sapiens
tcccgagccccct

SEQ ID NO: 2167051 - DNA, 19 bp, Homo sapiens
tcccgagccccctgtcctt

SEQ ID NO: 2167052 - DNA, 23 bp, Homo sapiens
tcccgagtagttgggattacagg

SEQ ID NO: 2167053 - DNA, 16 bp, Homo sapiens
tcccgtcttcctcctc

SEQ ID NO: 2167054 - DNA, 22 bp, Homo sapiens
tcccgtgcaaaacatgctacct

SEQ ID NO: 2167055 - DNA, 17 bp, Homo sapiens
tccctacccacagggcc

SEQ ID NO: 2167056 - DNA, 18 bp, Homo sapiens
tccctacccacagggcct

SEQ ID NO: 2167057 - DNA, 16 bp, Homo sapiens
tccctacttccaagaa

SEQ ID NO: 2167058 - DNA, 21 bp, Homo sapiens
tccctcagtgtgaagcctgtc

SEQ ID NO: 2167059 - DNA, 15 bp, Homo sapiens
tccctcccctcagcc

SEQ ID NO: 2167060 - DNA, 15 bp, Homo sapiens
taagagtcctgaggc

SEQ ID NO: 2167061 - DNA, 16 bp, Homo sapiens
taagagtcctgaggca

SEQ ID NO: 2167062 - DNA, 16 bp, Homo sapiens
taagcaacatgaatta

SEQ ID NO: 2167063 - DNA, 15 bp, Homo sapiens
taagcaactggaaaa

SEQ ID NO: 2167064 - DNA, 16 bp, Homo sapiens
taagcacctttagaat

SEQ ID NO: 2167065 - DNA, 13 bp, Homo sapiens
taagcctgatgat

SEQ ID NO: 2167066 - DNA, 14 bp, Homo sapiens
taaggaaaaaaaac

SEQ ID NO: 2167067 - DNA, 23 bp, Homo sapiens
taaggaaaaaagatttttaaaat

SEQ ID NO: 2167068 - DNA, 20 bp, Homo sapiens
taaggaagatcactttgctc

SEQ ID NO: 2167069 - DNA, 16 bp, Homo sapiens
taaggcctgtgggggg

SEQ ID NO: 2167070 - DNA, 22 bp, Homo sapiens
taagtaaattagtaatgtacta

SEQ ID NO: 2167071 - DNA, 17 bp, Homo sapiens
taagtgcttttaaactg

SEQ ID NO: 2167072 - DNA, 19 bp, Homo sapiens
taagtggcctgcaggggcc

SEQ ID NO: 2167073 - DNA, 19 bp, Homo sapiens
taagttactatcctggctt

SEQ ID NO: 2167074 - DNA, 17 bp, Homo sapiens
taagttcgaggtggcta

SEQ ID NO: 2167075 - DNA, 18 bp, Homo sapiens
taagtttagaaattacaa

SEQ ID NO: 2167076 - DNA, 23 bp, Homo sapiens
taagtttttctctttttcagaca

SEQ ID NO: 2167077 - DNA, 18 bp, Homo sapiens
taataaaaatttattatt

SEQ ID NO: 2167078 - DNA, 22 bp, Homo sapiens
taataaaacccagcatgtacaa

SEQ ID NO: 2167079 - DNA, 13 bp, Homo sapiens
taataaaatacat

SEQ ID NO: 2167080 - DNA, 14 bp, Homo sapiens
taataaaattcatt

SEQ ID NO: 2167081 - DNA, 18 bp, Homo sapiens
taataaatcatgttttga

SEQ ID NO: 2167082 - DNA, 17 bp, Homo sapiens
taataatcattttagaa

SEQ ID NO: 2167083 - DNA, 18 bp, Homo sapiens
taataatcattttagaat

SEQ ID NO: 2167084 - DNA, 14 bp, Homo sapiens
taataccaccaaca

SEQ ID NO: 2167085 - DNA, 21 bp, Homo sapiens
taataccaccaacaaatatag

SEQ ID NO: 2167086 - DNA, 11 bp, Homo sapiens
taatatgtatt

SEQ ID NO: 2167087 - DNA, 14 bp, Homo sapiens
taatattgcagttc

SEQ ID NO: 2167088 - DNA, 23 bp, Homo sapiens
taatcaatactttgaacacaaag

SEQ ID NO: 2167089 - DNA, 22 bp, Homo sapiens
taatcagtgtagccccaagaag

SEQ ID NO: 2167090 - DNA, 17 bp, Homo sapiens
taatcattttagaatta

SEQ ID NO: 2167091 - DNA, 20 bp, Homo sapiens
taatccatgtgctgctgtgg

SEQ ID NO: 2167092 - DNA, 22 bp, Homo sapiens
taatccatgtgctgctgtggca

SEQ ID NO: 2167093 - DNA, 18 bp, Homo sapiens
taatcttataattgttct

SEQ ID NO: 2167094 - DNA, 22 bp, Homo sapiens
taatcttataattgttctcaga

SEQ ID NO: 2167095 - DNA, 18 bp, Homo sapiens
taatgacgtattgtgaaa

SEQ ID NO: 2167096 - DNA, 19 bp, Homo sapiens
taatgacgtattgtgaaat

SEQ ID NO: 2167097 - DNA, 22 bp, Homo sapiens
taatgatactgtctaagaataa

SEQ ID NO: 2167098 - DNA, 14 bp, Homo sapiens
taatgtaacacagt

SEQ ID NO: 2167099 - DNA, 16 bp, Homo sapiens
taatgtagccatggga

SEQ ID NO: 2167100 - DNA, 15 bp, Homo sapiens
taatgtgtatgtctg

SEQ ID NO: 2167101 - DNA, 20 bp, Homo sapiens
taatgtgtatttactgtact

SEQ ID NO: 2167102 - DNA, 13 bp, Homo sapiens
taattaaagaaaa

SEQ ID NO: 2167103 - DNA, 18 bp, Homo sapiens
taattaaagaaaattgcc

SEQ ID NO: 2167104 - DNA, 19 bp, Homo sapiens
taattaaagaaaattgcca

SEQ ID NO: 2167105 - DNA, 20 bp, Homo sapiens
taattaaagaaaattgccaa

SEQ ID NO: 2167106 - DNA, 16 bp, Homo sapiens
taattaaatatttctt

SEQ ID NO: 2167107 - DNA, 19 bp, Homo sapiens
taattaaatatttcttaag

SEQ ID NO: 2167108 - DNA, 17 bp, Homo sapiens
taattagaaaatatagt

SEQ ID NO: 2167109 - DNA, 13 bp, Homo sapiens
taattagtaataa

SEQ ID NO: 2167110 - DNA, 16 bp, Homo sapiens
taattatataactgta

SEQ ID NO: 2167111 - DNA, 13 bp, Homo sapiens
taattcaagaggc

SEQ ID NO: 2167112 - DNA, 16 bp, Homo sapiens
taattctttatcacat

SEQ ID NO: 2167113 - DNA, 14 bp, Homo sapiens
taattgcctttgag

SEQ ID NO: 2167114 - DNA, 14 bp, Homo sapiens
taattgtggagagg

SEQ ID NO: 2167115 - DNA, 16 bp, Homo sapiens
taattgttctcagaat

SEQ ID NO: 2167116 - DNA, 19 bp, Homo sapiens
taatttaaagctgtttcta

SEQ ID NO: 2167117 - DNA, 21 bp, Homo sapiens
taatttaattccccttccctt

SEQ ID NO: 2167118 - DNA, 18 bp, Homo sapiens
taatttatagttaatgtt

SEQ ID NO: 2167119 - DNA, 14 bp, Homo sapiens
taatttatatttgt

SEQ ID NO: 2167120 - DNA, 17 bp, Homo sapiens
taatttatatttgtctc

SEQ ID NO: 2167121 - DNA, 14 bp, Homo sapiens
taatttatcaaaaa

SEQ ID NO: 2167122 - DNA, 19 bp, Homo sapiens
taatttatcaaaaaacaag

SEQ ID NO: 2167123 - DNA, 15 bp, Homo sapiens
taatttcaaatctgt

SEQ ID NO: 2167124 - DNA, 17 bp, Homo sapiens
taatttcaaatctgtaa

SEQ ID NO: 2167125 - DNA, 21 bp, Homo sapiens
taattttgttaagaatttcaa

SEQ ID NO: 2167126 - DNA, 22 bp, Homo sapiens
tacaaaaaaacctttattcttt

SEQ ID NO: 2167127 - DNA, 22 bp, Homo sapiens
tacaaaaggagaagaggaacat

SEQ ID NO: 2167128 - DNA, 15 bp, Homo sapiens
tacaaaagtaccata

SEQ ID NO: 2167129 - DNA, 17 bp, Homo sapiens
tacaaaagtaccataga

SEQ ID NO: 2167130 - DNA, 21 bp, Homo sapiens
tacaagacggggagtgagact

SEQ ID NO: 2167131 - DNA, 15 bp, Homo sapiens
tacaagactaacctt

SEQ ID NO: 2167132 - DNA, 19 bp, Homo sapiens
tacaagactaacctttgtt

SEQ ID NO: 2167133 - DNA, 17 bp, Homo sapiens
tacaaggcaggcctttc

SEQ ID NO: 2167134 - DNA, 18 bp, Homo sapiens
tacaagtgctcagttcca

SEQ ID NO: 2167135 - DNA, 14 bp, Homo sapiens
tacaagtttcagta

SEQ ID NO: 2167136 - DNA, 12 bp, Homo sapiens
tacaataccaga

SEQ ID NO: 2167137 - DNA, 19 bp, Homo sapiens
tacaataccagatcactca

SEQ ID NO: 2167138 - DNA, 17 bp, Homo sapiens
tacacaaaaagaaagct

SEQ ID NO: 2167139 - DNA, 22 bp, Homo sapiens
tacacctaactcacctaactca

SEQ ID NO: 2167140 - DNA, 16 bp, Homo sapiens
tacactcattgaaatg

SEQ ID NO: 2167141 - DNA, 14 bp, Homo sapiens
tacacttactgttg

SEQ ID NO: 2167142 - DNA, 15 bp, Homo sapiens
tacacttgtaaataa

SEQ ID NO: 2167143 - DNA, 18 bp, Homo sapiens
tacagccagtaaggcagc

SEQ ID NO: 2167144 - DNA, 15 bp, Homo sapiens
tacagctatttctca

SEQ ID NO: 2167145 - DNA, 13 bp, Homo sapiens
tacagcttttctc

SEQ ID NO: 2167146 - DNA, 21 bp, Homo sapiens
tacaggaagctttttgtatta

SEQ ID NO: 2167147 - DNA, 15 bp, Homo sapiens
tacagggcccaggtg

SEQ ID NO: 2167148 - DNA, 23 bp, Homo sapiens
tacaggtgtgagccaccacaccc

SEQ ID NO: 2167149 - DNA, 23 bp, Homo sapiens
tacagtaaaacaattgtgacagc

SEQ ID NO: 2167150 - DNA, 17 bp, Homo sapiens
tacagtatgtgtctagc

SEQ ID NO: 2167151 - DNA, 18 bp, Homo sapiens
tacagtgtaaaaattcag

SEQ ID NO: 2167152 - DNA, 16 bp, Homo sapiens
tacagttgactggctt

SEQ ID NO: 2167153 - DNA, 21 bp, Homo sapiens
tacagttgactggctttcctc

SEQ ID NO: 2167154 - DNA, 18 bp, Homo sapiens
tacataaactgtctcatt

SEQ ID NO: 2167155 - DNA, 18 bp, Homo sapiens
tacatactatagattctt

SEQ ID NO: 2167156 - DNA, 19 bp, Homo sapiens
tacatactatagattcttt

SEQ ID NO: 2167157 - DNA, 20 bp, Homo sapiens
tacatagatgtatcattaat

SEQ ID NO: 2167158 - DNA, 23 bp, Homo sapiens
tacatagatgtatcattaatgta

SEQ ID NO: 2167159 - DNA, 15 bp, Homo sapiens
tacatatgatcaaat

SEQ ID NO: 2167160 - DNA, 14 bp, Homo sapiens
tacatcttttggga

SEQ ID NO: 2167161 - DNA, 16 bp, Homo sapiens
tacatcttttgggaag

SEQ ID NO: 2167162 - DNA, 20 bp, Homo sapiens
tacattattggacttccatt

SEQ ID NO: 2167163 - DNA, 16 bp, Homo sapiens
taccaagttttattgt

SEQ ID NO: 2167164 - DNA, 14 bp, Homo sapiens
taccacactcatgg

SEQ ID NO: 2167165 - DNA, 11 bp, Homo sapiens
taccaccaaca

SEQ ID NO: 2167166 - DNA, 15 bp, Homo sapiens
taccacccccacacc

SEQ ID NO: 2167167 - DNA, 21 bp, Homo sapiens
taccacttatttctaaatcct

SEQ ID NO: 2167168 - DNA, 14 bp, Homo sapiens
taccatagaacaga

SEQ ID NO: 2167169 - DNA, 17 bp, Homo sapiens
taccatagaacagaact

SEQ ID NO: 2167170 - DNA, 14 bp, Homo sapiens
taccattttgcgat

SEQ ID NO: 2167171 - DNA, 20 bp, Homo sapiens
taccattttgcgatgtgttt

SEQ ID NO: 2167172 - DNA, 15 bp, Homo sapiens
tacccacagggcctg

SEQ ID NO: 2167173 - DNA, 20 bp, Homo sapiens
tacccacagggcctgacttt

SEQ ID NO: 2167174 - DNA, 15 bp, Homo sapiens
tacccacctgagctt

SEQ ID NO: 2167175 - DNA, 14 bp, Homo sapiens
tacccagcccatct

SEQ ID NO: 2167176 - DNA, 16 bp, Homo sapiens
tacccagcccatcttg

SEQ ID NO: 2167177 - DNA, 16 bp, Homo sapiens
taccccacgaagacat

SEQ ID NO: 2167178 - DNA, 21 bp, Homo sapiens
tacccttctgtgcccagctca

SEQ ID NO: 2167179 - DNA, 23 bp, Homo sapiens
tacctcattcacagctccttgtg

SEQ ID NO: 2167180 - DNA, 12 bp, Homo sapiens
tacctgccctct

SEQ ID NO: 2167181 - DNA, 16 bp, Homo sapiens
tacctgggatatgaca

SEQ ID NO: 2167182 - DNA, 22 bp, Homo sapiens
gtgggggtgtcacagaggcagt

SEQ ID NO: 2167183 - DNA, 17 bp, Homo sapiens
gtgggtttctctgtgct

SEQ ID NO: 2167184 - DNA, 19 bp, Homo sapiens
gtgggtttctctgtgctct

SEQ ID NO: 2167185 - DNA, 14 bp, Homo sapiens
gtggtacaggaagg

SEQ ID NO: 2167186 - DNA, 14 bp, Homo sapiens
gtggtagcaggaaa

SEQ ID NO: 2167187 - DNA, 21 bp, Homo sapiens
gtggtattggccgatgagctg

SEQ ID NO: 2167188 - DNA, 20 bp, Homo sapiens
gtggtgatcgcacaaggaca

SEQ ID NO: 2167189 - DNA, 13 bp, Homo sapiens
gtggttgcctggg

SEQ ID NO: 2167190 - DNA, 16 bp, Homo sapiens
gtggtttataatctga

SEQ ID NO: 2167191 - DNA, 15 bp, Homo sapiens
gtgtaaaaattcaga

SEQ ID NO: 2167192 - DNA, 23 bp, Homo sapiens
gtgtaaaatatctacctgccctc

SEQ ID NO: 2167193 - DNA, 20 bp, Homo sapiens
gtgtagccccaagaaggctg

SEQ ID NO: 2167194 - DNA, 23 bp, Homo sapiens
gtgtatcaccctcagctggcgga

SEQ ID NO: 2167195 - DNA, 20 bp, Homo sapiens
gtgtatctcgaagtcttcca

SEQ ID NO: 2167196 - DNA, 19 bp, Homo sapiens
gtgtatgtgtttataattg

SEQ ID NO: 2167197 - DNA, 14 bp, Homo sapiens
gtgtcacagaggca

SEQ ID NO: 2167198 - DNA, 16 bp, Homo sapiens
gtgtcacagaggcagt

SEQ ID NO: 2167199 - DNA, 23 bp, Homo sapiens
gtgtcacagaggcagtggcagca

SEQ ID NO: 2167200 - DNA, 22 bp, Homo sapiens
gtgtcacctgcacagggccctc

SEQ ID NO: 2167201 - DNA, 13 bp, Homo sapiens
gtgtcacgcaggc

SEQ ID NO: 2167202 - DNA, 18 bp, Homo sapiens
gtgtcatgaggaaaaaaa

SEQ ID NO: 2167203 - DNA, 16 bp, Homo sapiens
gtgtccttctcctctt

SEQ ID NO: 2167204 - DNA, 22 bp, Homo sapiens
gtgtccttctcctcttgtagcc

SEQ ID NO: 2167205 - DNA, 22 bp, Homo sapiens
gtgtctaaaatacttgagaaat

SEQ ID NO: 2167206 - DNA, 15 bp, Homo sapiens
gtgtctcctgcatgc

SEQ ID NO: 2167207 - DNA, 20 bp, Homo sapiens
gtgtctgtttccttctcttt

SEQ ID NO: 2167208 - DNA, 20 bp, Homo sapiens
gtgtcttacaaggcaggcct

SEQ ID NO: 2167209 - DNA, 22 bp, Homo sapiens
gtgtcttacaaggcaggccttt

SEQ ID NO: 2167210 - DNA, 22 bp, Homo sapiens
gtgtcttttaatgatactgtct

SEQ ID NO: 2167211 - DNA, 17 bp, Homo sapiens
gtgtgacgggggttggg

SEQ ID NO: 2167212 - DNA, 13 bp, Homo sapiens
gtgtgatgtatgt

SEQ ID NO: 2167213 - DNA, 18 bp, Homo sapiens
gtgtgccaccctctgcag

SEQ ID NO: 2167214 - DNA, 23 bp, Homo sapiens
gtgtgccaccctctgcagggcag

SEQ ID NO: 2167215 - DNA, 13 bp, Homo sapiens
gtgtgctcttctt

SEQ ID NO: 2167216 - DNA, 19 bp, Homo sapiens
gtgtgcttcccaaatacat

SEQ ID NO: 2167217 - DNA, 21 bp, Homo sapiens
gtgtgggggtctgggaggcag

SEQ ID NO: 2167218 - DNA, 18 bp, Homo sapiens
gtgtgtatcaccctcagc

SEQ ID NO: 2167219 - DNA, 19 bp, Homo sapiens
gtgtgtttgtgagtatgtg

SEQ ID NO: 2167220 - DNA, 18 bp, Homo sapiens
gtgttcgtggagccacag

SEQ ID NO: 2167221 - DNA, 23 bp, Homo sapiens
gtgttcgtggagccacaggcaga

SEQ ID NO: 2167222 - DNA, 14 bp, Homo sapiens
gtgtttgtatataa

SEQ ID NO: 2167223 - DNA, 17 bp, Homo sapiens
gtgtttgtgagtatgtg

SEQ ID NO: 2167224 - DNA, 14 bp, Homo sapiens
gttaacatctttta

SEQ ID NO: 2167225 - DNA, 19 bp, Homo sapiens
gttaacattttttttgttt

SEQ ID NO: 2167226 - DNA, 12 bp, Homo sapiens
gttaacctacct

SEQ ID NO: 2167227 - DNA, 14 bp, Homo sapiens
gttaagcagccgcc

SEQ ID NO: 2167228 - DNA, 16 bp, Homo sapiens
gttaataaaggtttcg

SEQ ID NO: 2167229 - DNA, 13 bp, Homo sapiens
gttaatattaatt

SEQ ID NO: 2167230 - DNA, 20 bp, Homo sapiens
gttaatcacttaacctgctt

SEQ ID NO: 2167231 - DNA, 9 bp, Homo sapiens
gttaattta

SEQ ID NO: 2167232 - DNA, 14 bp, Homo sapiens
gttacccatttgaa

SEQ ID NO: 2167233 - DNA, 19 bp, Homo sapiens
gttatgcggtctagggaat

SEQ ID NO: 2167234 - DNA, 20 bp, Homo sapiens
gttattcactctcccagagg

SEQ ID NO: 2167235 - DNA, 13 bp, Homo sapiens
gttatttttgtct

SEQ ID NO: 2167236 - DNA, 21 bp, Homo sapiens
gttcaaaatgttaataaaggt

SEQ ID NO: 2167237 - DNA, 19 bp, Homo sapiens
gttcaatgaatattgtaaa

SEQ ID NO: 2167238 - DNA, 16 bp, Homo sapiens
gttcaggtcagggcta

SEQ ID NO: 2167239 - DNA, 22 bp, Homo sapiens
gttcagtaacagggccttgcta

SEQ ID NO: 2167240 - DNA, 12 bp, Homo sapiens
gttcatgaatac

SEQ ID NO: 2167241 - DNA, 23 bp, Homo sapiens
gttcatgttagttttgctccttc

SEQ ID NO: 2167242 - DNA, 20 bp, Homo sapiens
gttccactgcaaataaagcc

SEQ ID NO: 2167243 - DNA, 21 bp, Homo sapiens
gttccactgcaaataaagcct

SEQ ID NO: 2167244 - DNA, 21 bp, Homo sapiens
gttccatcctgtacaagtgct

SEQ ID NO: 2167245 - DNA, 13 bp, Homo sapiens
gttcccagaaaac

SEQ ID NO: 2167246 - DNA, 17 bp, Homo sapiens
gttcccctcacccaaaa

SEQ ID NO: 2167247 - DNA, 18 bp, Homo sapiens
gttccctcagtgtgaagc

SEQ ID NO: 2167248 - DNA, 13 bp, Homo sapiens
gttcccttctcct

SEQ ID NO: 2167249 - DNA, 23 bp, Homo sapiens
gttccttaagtggctgtgattaa

SEQ ID NO: 2167250 - DNA, 14 bp, Homo sapiens
gttccttgctctct

SEQ ID NO: 2167251 - DNA, 16 bp, Homo sapiens
gttcgtggagccacag

SEQ ID NO: 2167252 - DNA, 14 bp, Homo sapiens
gttctaaaaagatg

SEQ ID NO: 2167253 - DNA, 17 bp, Homo sapiens
gttctatccccaagctg

SEQ ID NO: 2167254 - DNA, 18 bp, Homo sapiens
gttctatttcagtgccaa

SEQ ID NO: 2167255 - DNA, 18 bp, Homo sapiens
gttctcaaaccctgttta

SEQ ID NO: 2167256 - DNA, 20 bp, Homo sapiens
gttctcaaaccctgtttacg

SEQ ID NO: 2167257 - DNA, 18 bp, Homo sapiens
gttctcatgtttgtgcat

SEQ ID NO: 2167258 - DNA, 21 bp, Homo sapiens
gttctcatgtttgtgcatgta

SEQ ID NO: 2167259 - DNA, 15 bp, Homo sapiens
gttctcttctctctt

SEQ ID NO: 2167260 - DNA, 21 bp, Homo sapiens
gttctgaaggttggaactgct

SEQ ID NO: 2167261 - DNA, 16 bp, Homo sapiens
gttctggctgtttgag

SEQ ID NO: 2167262 - DNA, 17 bp, Homo sapiens
gttctggttagctcagc

SEQ ID NO: 2167263 - DNA, 18 bp, Homo sapiens
gttctgtcccttggagct

SEQ ID NO: 2167264 - DNA, 17 bp, Homo sapiens
gttcttctattgtgctt

SEQ ID NO: 2167265 - DNA, 23 bp, Homo sapiens
gttcttgggcctcaggctctgca

SEQ ID NO: 2167266 - DNA, 13 bp, Homo sapiens
gttcttttctggt

SEQ ID NO: 2167267 - DNA, 17 bp, Homo sapiens
gttgaaagtaagttgtt

SEQ ID NO: 2167268 - DNA, 21 bp, Homo sapiens
gttgaggggcttccctctgct

SEQ ID NO: 2167269 - DNA, 15 bp, Homo sapiens
gttgagtattacaca

SEQ ID NO: 2167270 - DNA, 22 bp, Homo sapiens
gttgagtattacacattaaagt

SEQ ID NO: 2167271 - DNA, 15 bp, Homo sapiens
gttgagtttcttcta

SEQ ID NO: 2167272 - DNA, 20 bp, Homo sapiens
gttgataggagacttgtaca

SEQ ID NO: 2167273 - DNA, 17 bp, Homo sapiens
gttgcaaattccacccc

SEQ ID NO: 2167274 - DNA, 15 bp, Homo sapiens
gttgcccaggctgga

SEQ ID NO: 2167275 - DNA, 22 bp, Homo sapiens
gttgcgtgtctgtttccttctc

SEQ ID NO: 2167276 - DNA, 22 bp, Homo sapiens
ttactatcctggctttgcccaa

SEQ ID NO: 2167277 - DNA, 15 bp, Homo sapiens
ttactcaaccctctc

SEQ ID NO: 2167278 - DNA, 22 bp, Homo sapiens
ttactctgcactatagccattt

SEQ ID NO: 2167279 - DNA, 16 bp, Homo sapiens
ttactctttgctttgt

SEQ ID NO: 2167280 - DNA, 17 bp, Homo sapiens
ttactgggtaggttctg

SEQ ID NO: 2167281 - DNA, 13 bp, Homo sapiens
ttactgttcatgg

SEQ ID NO: 2167282 - DNA, 21 bp, Homo sapiens
ttactgtttgtcttctcccca

SEQ ID NO: 2167283 - DNA, 19 bp, Homo sapiens
ttagaaaacccaagttttt

SEQ ID NO: 2167284 - DNA, 15 bp, Homo sapiens
ttagaaaatatagtt

SEQ ID NO: 2167285 - DNA, 20 bp, Homo sapiens
ttagaaattacaagtttcag

SEQ ID NO: 2167286 - DNA, 18 bp, Homo sapiens
ttagaacttagttttgtt

SEQ ID NO: 2167287 - DNA, 19 bp, Homo sapiens
ttagaacttagttttgttc

SEQ ID NO: 2167288 - DNA, 18 bp, Homo sapiens
ttagaagatattagtctt

SEQ ID NO: 2167289 - DNA, 14 bp, Homo sapiens
ttagagcctccctc

SEQ ID NO: 2167290 - DNA, 21 bp, Homo sapiens
ttagatattgttttgtgactt

SEQ ID NO: 2167291 - DNA, 22 bp, Homo sapiens
ttagcaacgcctgccttctggg

SEQ ID NO: 2167292 - DNA, 15 bp, Homo sapiens
ttagcagatattaaa

SEQ ID NO: 2167293 - DNA, 19 bp, Homo sapiens
ttagcagcttctgtcctct

SEQ ID NO: 2167294 - DNA, 12 bp, Homo sapiens
ttagcccccacc

SEQ ID NO: 2167295 - DNA, 14 bp, Homo sapiens
ttagcttacaggaa

SEQ ID NO: 2167296 - DNA, 18 bp, Homo sapiens
ttagtaacctttaaaaat

SEQ ID NO: 2167297 - DNA, 22 bp, Homo sapiens
ttagtaataaaacccagcatgt

SEQ ID NO: 2167298 - DNA, 15 bp, Homo sapiens
ttagtacccacctga

SEQ ID NO: 2167299 - DNA, 18 bp, Homo sapiens
ttagtgatgtcatctgtc

SEQ ID NO: 2167300 - DNA, 15 bp, Homo sapiens
ttagtgcaatttctt

SEQ ID NO: 2167301 - DNA, 17 bp, Homo sapiens
ttagtgcaatttcttct

SEQ ID NO: 2167302 - DNA, 17 bp, Homo sapiens
ttagtgttcaaatactt

SEQ ID NO: 2167303 - DNA, 13 bp, Homo sapiens
ttagttaaaatct

SEQ ID NO: 2167304 - DNA, 23 bp, Homo sapiens
ttagttaaaatctattttgtctg

SEQ ID NO: 2167305 - DNA, 19 bp, Homo sapiens
ttagtttaggtgtttggga

SEQ ID NO: 2167306 - DNA, 15 bp, Homo sapiens
ttagtttgaaacaga

SEQ ID NO: 2167307 - DNA, 15 bp, Homo sapiens
ttagtttgtttttgt

SEQ ID NO: 2167308 - DNA, 14 bp, Homo sapiens
ttagttttgttcca

SEQ ID NO: 2167309 - DNA, 24 bp, Homo sapiens
ttataaatgcattaaataagagtt

SEQ ID NO: 2167310 - DNA, 15 bp, Homo sapiens
ttataagcaacatga

SEQ ID NO: 2167311 - DNA, 15 bp, Homo sapiens
ttataattaaagaaa

SEQ ID NO: 2167312 - DNA, 12 bp, Homo sapiens
ttatataactgt

SEQ ID NO: 2167313 - DNA, 20 bp, Homo sapiens
ttatatatgtcctattcatt

SEQ ID NO: 2167314 - DNA, 22 bp, Homo sapiens
ttatatttgtccaacaactgtc

SEQ ID NO: 2167315 - DNA, 17 bp, Homo sapiens
ttatcaggggaatttca

SEQ ID NO: 2167316 - DNA, 18 bp, Homo sapiens
ttatccaggggcttcacc

SEQ ID NO: 2167317 - DNA, 16 bp, Homo sapiens
ttatctgagtcacttg

SEQ ID NO: 2167318 - DNA, 16 bp, Homo sapiens
ttatgcaaaacttttt

SEQ ID NO: 2167319 - DNA, 20 bp, Homo sapiens
ttatgcagagacagctgttt

SEQ ID NO: 2167320 - DNA, 22 bp, Homo sapiens
ttatgcagagacagctgtttga

SEQ ID NO: 2167321 - DNA, 16 bp, Homo sapiens
ttatgcggtctaggga

SEQ ID NO: 2167322 - DNA, 18 bp, Homo sapiens
ttatgtaattattttctt

SEQ ID NO: 2167323 - DNA, 12 bp, Homo sapiens
ttatgttacagt

SEQ ID NO: 2167324 - DNA, 17 bp, Homo sapiens
ttattcacttgtgtttg

SEQ ID NO: 2167325 - DNA, 13 bp, Homo sapiens
ttatttctaaatc

SEQ ID NO: 2167326 - DNA, 18 bp, Homo sapiens
ttatttttaaaataattt

SEQ ID NO: 2167327 - DNA, 13 bp, Homo sapiens
ttatttttacgta

SEQ ID NO: 2167328 - DNA, 16 bp, Homo sapiens
ttatttttgtactgtg

SEQ ID NO: 2167329 - DNA, 19 bp, Homo sapiens
ttatttttgtactgtgctg

SEQ ID NO: 2167330 - DNA, 21 bp, Homo sapiens
ttatttttgtactgtgctgat

SEQ ID NO: 2167331 - DNA, 13 bp, Homo sapiens
ttcaaaatgttaa

SEQ ID NO: 2167332 - DNA, 22 bp, Homo sapiens
ttcaaaatgttaataaaggttt

SEQ ID NO: 2167333 - DNA, 23 bp, Homo sapiens
ttcaaaatgttaataaaggtttc

SEQ ID NO: 2167334 - DNA, 14 bp, Homo sapiens
ttcaaacaattcaa

SEQ ID NO: 2167335 - DNA, 16 bp, Homo sapiens
ttcaaacaattcaatc

SEQ ID NO: 2167336 - DNA, 23 bp, Homo sapiens
ttcaaacaattcaatcaaagcta

SEQ ID NO: 2167337 - DNA, 19 bp, Homo sapiens
ttcaaatctcctctttgtg

SEQ ID NO: 2167338 - DNA, 21 bp, Homo sapiens
ttcaacaacgtgagagaaaga

SEQ ID NO: 2167339 - DNA, 22 bp, Homo sapiens
ttcaacaagatttcttaatgct

SEQ ID NO: 2167340 - DNA, 11 bp, Homo sapiens
ttcaagctttc

SEQ ID NO: 2167341 - DNA, 21 bp, Homo sapiens
ttcaagtctgtgcctggagct

SEQ ID NO: 2167342 - DNA, 17 bp, Homo sapiens
ttcaataaaatgcactg

SEQ ID NO: 2167343 - DNA, 12 bp, Homo sapiens
ttcaatcaaagc

SEQ ID NO: 2167344 - DNA, 17 bp, Homo sapiens
ttcaatcaaagctacct

SEQ ID NO: 2167345 - DNA, 18 bp, Homo sapiens
ttcaatcaaagctacctt

SEQ ID NO: 2167346 - DNA, 22 bp, Homo sapiens
ttcaatcctgtcaatgtttgct

SEQ ID NO: 2167347 - DNA, 12 bp, Homo sapiens
ttcaatctctgg

SEQ ID NO: 2167348 - DNA, 17 bp, Homo sapiens
ttcaatctctgttctgc

SEQ ID NO: 2167349 - DNA, 18 bp, Homo sapiens
ttcaatctctgttctgct

SEQ ID NO: 2167350 - DNA, 17 bp, Homo sapiens
ttcacaagctgcctccc

SEQ ID NO: 2167351 - DNA, 19 bp, Homo sapiens
ttcacaagctgcctccctg

SEQ ID NO: 2167352 - DNA, 20 bp, Homo sapiens
ttcacactatcaacactgca

SEQ ID NO: 2167353 - DNA, 19 bp, Homo sapiens
ttcacagaaaacattgact

SEQ ID NO: 2167354 - DNA, 14 bp, Homo sapiens
ttcaccctcctcat

SEQ ID NO: 2167355 - DNA, 15 bp, Homo sapiens
ttcactgaagtgaat

SEQ ID NO: 2167356 - DNA, 21 bp, Homo sapiens
ttcactgaagtgaatacatgg

SEQ ID NO: 2167357 - DNA, 15 bp, Homo sapiens
ttcagaagttagttt

SEQ ID NO: 2167358 - DNA, 14 bp, Homo sapiens
ttcagctttgtgta

SEQ ID NO: 2167359 - DNA, 16 bp, Homo sapiens
ttcaggaacctggacc

SEQ ID NO: 2167360 - DNA, 16 bp, Homo sapiens
ttcagtgagacacaga

SEQ ID NO: 2167361 - DNA, 15 bp, Homo sapiens
ttcagtgccttcaac

SEQ ID NO: 2167362 - DNA, 19 bp, Homo sapiens
ttcagtttttaacataatt

SEQ ID NO: 2167363 - DNA, 21 bp, Homo sapiens
ttcataaaggtttacagtgaa

SEQ ID NO: 2167364 - DNA, 15 bp, Homo sapiens
ttcatataaatggaa

SEQ ID NO: 2167365 - DNA, 19 bp, Homo sapiens
ttcatattaatataagttt

SEQ ID NO: 2167366 - DNA, 21 bp, Homo sapiens
ttcatattaatataagtttct

SEQ ID NO: 2167367 - DNA, 22 bp, Homo sapiens
ttcatattaatataagtttctt

SEQ ID NO: 2167368 - DNA, 13 bp, Homo sapiens
ttcatccctgcca

SEQ ID NO: 2167369 - DNA, 13 bp, Homo sapiens
ttcatctactaca

SEQ ID NO: 2167370 - DNA, 15 bp, Homo sapiens
ttcatctttccaaat

SEQ ID NO: 2167371 - DNA, 16 bp, Homo sapiens
ttcatctttccaaatt

SEQ ID NO: 2167372 - DNA, 15 bp, Homo sapiens
ttccaaattgatggg

SEQ ID NO: 2167373 - DNA, 15 bp, Homo sapiens
ttccaacaggcacct

SEQ ID NO: 2167374 - DNA, 16 bp, Homo sapiens
ttccaacagttaaact

SEQ ID NO: 2167375 - DNA, 14 bp, Homo sapiens
ttccaagcctgggc

SEQ ID NO: 2167376 - DNA, 16 bp, Homo sapiens
ttccaagcctgggcca

SEQ ID NO: 2167377 - DNA, 20 bp, Homo sapiens
ttccaagtcatttttgtttt

SEQ ID NO: 2167378 - DNA, 18 bp, Homo sapiens
ttccaagtggacggcaga

SEQ ID NO: 2167379 - DNA, 12 bp, Homo sapiens
ttccaatgtgcc

SEQ ID NO: 2167380 - DNA, 14 bp, Homo sapiens
ttccaatgtgccca

SEQ ID NO: 2167381 - DNA, 18 bp, Homo sapiens
ttccaatgtgcccagtca

SEQ ID NO: 2167382 - DNA, 20 bp, Homo sapiens
ttccaatgtgcccagtcatg

SEQ ID NO: 2167383 - DNA, 13 bp, Homo sapiens
ttccacaacagtc

SEQ ID NO: 2167384 - DNA, 13 bp, Homo sapiens
ttccacccctcct

SEQ ID NO: 2167385 - DNA, 15 bp, Homo sapiens
ttccacccctccttc

SEQ ID NO: 2167386 - DNA, 20 bp, Homo sapiens
ttccacccctccttccctgg

SEQ ID NO: 2167387 - DNA, 16 bp, Homo sapiens
ttccagtggcctggct

SEQ ID NO: 2167388 - DNA, 17 bp, Homo sapiens
ttccagtggcctggctc

SEQ ID NO: 2167389 - DNA, 19 bp, Homo sapiens
ttccatcagcagtgattga

SEQ ID NO: 2167390 - DNA, 19 bp, Homo sapiens
ttccattagtaaaacacaa

SEQ ID NO: 2167391 - DNA, 23 bp, Homo sapiens
ttcccagaatatatttaaatgca

SEQ ID NO: 2167392 - DNA, 18 bp, Homo sapiens
ttcccagagaacttcaca

SEQ ID NO: 2167393 - DNA, 12 bp, Homo sapiens
ttcccattttaa

SEQ ID NO: 2167394 - DNA, 20 bp, Homo sapiens
ttccccctggccaccacccc

SEQ ID NO: 2167395 - DNA, 15 bp, Homo sapiens
ttccctacccacagg

SEQ ID NO: 2167396 - DNA, 19 bp, Homo sapiens
ttccctacccacagggcct

SEQ ID NO: 2167397 - DNA, 17 bp, Homo sapiens
ttccctcagtgtgaagc

SEQ ID NO: 2167398 - DNA, 19 bp, Homo sapiens
ttccctggaccagatgctg

SEQ ID NO: 2167399 - DNA, 17 bp, Homo sapiens
ttcccttctccttccaa

SEQ ID NO: 2167400 - DNA, 19 bp, Homo sapiens
ttccctttcactgaagtga

SEQ ID NO: 2167401 - DNA, 18 bp, Homo sapiens
tgtgggagaagggacagc

SEQ ID NO: 2167402 - DNA, 22 bp, Homo sapiens
tgtgggggtctgggaggcaggt

SEQ ID NO: 2167403 - DNA, 22 bp, Homo sapiens
tgtgggggtgtcacagaggcag

SEQ ID NO: 2167404 - DNA, 16 bp, Homo sapiens
tgtgggtttctctgtg

SEQ ID NO: 2167405 - DNA, 19 bp, Homo sapiens
tgtggtgaggttgggcagc

SEQ ID NO: 2167406 - DNA, 19 bp, Homo sapiens
tgtgtaaatctgaaaaact

SEQ ID NO: 2167407 - DNA, 21 bp, Homo sapiens
tgtgtaacagggtcacaagaa

SEQ ID NO: 2167408 - DNA, 15 bp, Homo sapiens
tgtgtacagtatgtg

SEQ ID NO: 2167409 - DNA, 16 bp, Homo sapiens
tgtgtacagtatgtgt

SEQ ID NO: 2167410 - DNA, 17 bp, Homo sapiens
tgtgtacagtatgtgtc

SEQ ID NO: 2167411 - DNA, 19 bp, Homo sapiens
tgtgtacagtatgtgtcta

SEQ ID NO: 2167412 - DNA, 23 bp, Homo sapiens
tgtgtacagtatgtgtctagcaa

SEQ ID NO: 2167413 - DNA, 16 bp, Homo sapiens
tgtgtatattgtaacg

SEQ ID NO: 2167414 - DNA, 20 bp, Homo sapiens
tgtgtatcaccctcagctgg

SEQ ID NO: 2167415 - DNA, 19 bp, Homo sapiens
tgtgtatgtgtttataatt

SEQ ID NO: 2167416 - DNA, 15 bp, Homo sapiens
tgtgtcacaaagcta

SEQ ID NO: 2167417 - DNA, 19 bp, Homo sapiens
tgtgtcacgcaggctgagt

SEQ ID NO: 2167418 - DNA, 16 bp, Homo sapiens
tgtgtcataaagttga

SEQ ID NO: 2167419 - DNA, 13 bp, Homo sapiens
tgtgtctcctgca

SEQ ID NO: 2167420 - DNA, 19 bp, Homo sapiens
tgtgtctcctgcatgcaga

SEQ ID NO: 2167421 - DNA, 14 bp, Homo sapiens
tgtgtctttagaca

SEQ ID NO: 2167422 - DNA, 21 bp, Homo sapiens
tgtgtgcagtctctcttaccc

SEQ ID NO: 2167423 - DNA, 22 bp, Homo sapiens
tgtgtgctgtggttcctggggt

SEQ ID NO: 2167424 - DNA, 19 bp, Homo sapiens
tgtgtgggggtctgggagg

SEQ ID NO: 2167425 - DNA, 20 bp, Homo sapiens
tgtgttgtacaataccagat

SEQ ID NO: 2167426 - DNA, 15 bp, Homo sapiens
tgttaagaatttcaa

SEQ ID NO: 2167427 - DNA, 13 bp, Homo sapiens
tgttaataaaggt

SEQ ID NO: 2167428 - DNA, 23 bp, Homo sapiens
tgttaatatatataatacttaaa

SEQ ID NO: 2167429 - DNA, 19 bp, Homo sapiens
tgttaatatgtatttgttg

SEQ ID NO: 2167430 - DNA, 16 bp, Homo sapiens
tgttaatattaattta

SEQ ID NO: 2167431 - DNA, 21 bp, Homo sapiens
tgttaatattaatttatattt

SEQ ID NO: 2167432 - DNA, 18 bp, Homo sapiens
tgttaattaaatatttct

SEQ ID NO: 2167433 - DNA, 14 bp, Homo sapiens
tgttacccatttga

SEQ ID NO: 2167434 - DNA, 16 bp, Homo sapiens
tgttacccatttgaaa

SEQ ID NO: 2167435 - DNA, 23 bp, Homo sapiens
tgttacccatttgaaagaatatt

SEQ ID NO: 2167436 - DNA, 16 bp, Homo sapiens
tgttagtgatttgcta

SEQ ID NO: 2167437 - DNA, 17 bp, Homo sapiens
tgttagtgatttgctat

SEQ ID NO: 2167438 - DNA, 18 bp, Homo sapiens
tgttagttttgctccttc

SEQ ID NO: 2167439 - DNA, 22 bp, Homo sapiens
tgttccaacagttaaacttgca

SEQ ID NO: 2167440 - DNA, 19 bp, Homo sapiens
tgttcgtggagccacaggc

SEQ ID NO: 2167441 - DNA, 20 bp, Homo sapiens
tgttctctccccttgcactg

SEQ ID NO: 2167442 - DNA, 15 bp, Homo sapiens
tgttctttccggcca

SEQ ID NO: 2167443 - DNA, 18 bp, Homo sapiens
tgttgaagtcaaatttgg

SEQ ID NO: 2167444 - DNA, 14 bp, Homo sapiens
tgttgaataggaaa

SEQ ID NO: 2167445 - DNA, 22 bp, Homo sapiens
tgttgcaaattccacccctcct

SEQ ID NO: 2167446 - DNA, 18 bp, Homo sapiens
tgttgctgttgttcagaa

SEQ ID NO: 2167447 - DNA, 22 bp, Homo sapiens
tgttgtgggggtgtcacagagg

SEQ ID NO: 2167448 - DNA, 12 bp, Homo sapiens
tgtttccctgct

SEQ ID NO: 2167449 - DNA, 15 bp, Homo sapiens
tgtttccctgctgaa

SEQ ID NO: 2167450 - DNA, 15 bp, Homo sapiens
tgtttcttgggaaaa

SEQ ID NO: 2167451 - DNA, 12 bp, Homo sapiens
tgtttgatgtgt

SEQ ID NO: 2167452 - DNA, 14 bp, Homo sapiens
tgtttgatgtgtat

SEQ ID NO: 2167453 - DNA, 20 bp, Homo sapiens
tgtttgatgtgtatgtgttt

SEQ ID NO: 2167454 - DNA, 21 bp, Homo sapiens
tgtttggtataaattaatttg

SEQ ID NO: 2167455 - DNA, 17 bp, Homo sapiens
tgtttgtcttctcccca

SEQ ID NO: 2167456 - DNA, 21 bp, Homo sapiens
tgttttattgagttctgaagg

SEQ ID NO: 2167457 - DNA, 22 bp, Homo sapiens
tgttttattgagttctgaaggt

SEQ ID NO: 2167458 - DNA, 23 bp, Homo sapiens
tgttttggtatgcactggttcct

SEQ ID NO: 2167459 - DNA, 11 bp, Homo sapiens
tgttttgttct

SEQ ID NO: 2167460 - DNA, 20 bp, Homo sapiens
tgtttttaagaaaaacatgt

SEQ ID NO: 2167461 - DNA, 14 bp, Homo sapiens
tgtttttatagaag

SEQ ID NO: 2167462 - DNA, 14 bp, Homo sapiens
tgtttttggtttct

SEQ ID NO: 2167463 - DNA, 15 bp, Homo sapiens
tgtttttttgtttgt

SEQ ID NO: 2167464 - DNA, 23 bp, Homo sapiens
ttaaaaacacctaagtgactacc

SEQ ID NO: 2167465 - DNA, 12 bp, Homo sapiens
ttaaaaattaga

SEQ ID NO: 2167466 - DNA, 18 bp, Homo sapiens
ttaaaaattgaaaacttt

SEQ ID NO: 2167467 - DNA, 14 bp, Homo sapiens
ttaaaagataagtt

SEQ ID NO: 2167468 - DNA, 21 bp, Homo sapiens
ttaaaataaaacgttatctca

SEQ ID NO: 2167469 - DNA, 15 bp, Homo sapiens
ttaaaataattatat

SEQ ID NO: 2167470 - DNA, 21 bp, Homo sapiens
ttaaaataatttatcaaaaaa

SEQ ID NO: 2167471 - DNA, 22 bp, Homo sapiens
ttaaaatcacaaactcatccat

SEQ ID NO: 2167472 - DNA, 14 bp, Homo sapiens
ttaaaatttattct

SEQ ID NO: 2167473 - DNA, 13 bp, Homo sapiens
ttaaaatttgtag

SEQ ID NO: 2167474 - DNA, 13 bp, Homo sapiens
ttaaacttgaact

SEQ ID NO: 2167475 - DNA, 16 bp, Homo sapiens
ttaaagaaaattgcca

SEQ ID NO: 2167476 - DNA, 19 bp, Homo sapiens
ttaaagatctcaacatgga

SEQ ID NO: 2167477 - DNA, 13 bp, Homo sapiens
ttaaagctgtttc

SEQ ID NO: 2167478 - DNA, 15 bp, Homo sapiens
ttaaatatttcttaa

SEQ ID NO: 2167479 - DNA, 16 bp, Homo sapiens
ttaaatatttcttaag

SEQ ID NO: 2167480 - DNA, 16 bp, Homo sapiens
ttaaatcagttttgtg

SEQ ID NO: 2167481 - DNA, 17 bp, Homo sapiens
ttaaatgtcagttgaaa

SEQ ID NO: 2167482 - DNA, 20 bp, Homo sapiens
ttaaattattatcttcttaa

SEQ ID NO: 2167483 - DNA, 13 bp, Homo sapiens
ttaacacactgaa

SEQ ID NO: 2167484 - DNA, 13 bp, Homo sapiens
ttaacagaaattg

SEQ ID NO: 2167485 - DNA, 19 bp, Homo sapiens
ttaacagaaattgtatatt

SEQ ID NO: 2167486 - DNA, 21 bp, Homo sapiens
ttaacagaaattgtatattgt

SEQ ID NO: 2167487 - DNA, 13 bp, Homo sapiens
ttaacagttgtat

SEQ ID NO: 2167488 - DNA, 15 bp, Homo sapiens
ttaacagttgtattt

SEQ ID NO: 2167489 - DNA, 15 bp, Homo sapiens
ttaacctacctgtaa

SEQ ID NO: 2167490 - DNA, 14 bp, Homo sapiens
ttaacctacctgtg

SEQ ID NO: 2167491 - DNA, 19 bp, Homo sapiens
ttaactacttatctctaaa

SEQ ID NO: 2167492 - DNA, 17 bp, Homo sapiens
ttaagaaaaacatgtca

SEQ ID NO: 2167493 - DNA, 20 bp, Homo sapiens
ttaagaaaaacatgtcatgt

SEQ ID NO: 2167494 - DNA, 16 bp, Homo sapiens
ttaagtataaacctta

SEQ ID NO: 2167495 - DNA, 13 bp, Homo sapiens
ttaagttgttgaa

SEQ ID NO: 2167496 - DNA, 11 bp, Homo sapiens
ttaagtttaga

SEQ ID NO: 2167497 - DNA, 18 bp, Homo sapiens
ttaagtttagaaattaca

SEQ ID NO: 2167498 - DNA, 21 bp, Homo sapiens
ttaataatggttactcatttt

SEQ ID NO: 2167499 - DNA, 15 bp, Homo sapiens
ttaataccaccaaca

SEQ ID NO: 2167500 - DNA, 20 bp, Homo sapiens
ttaatagccatttgaagaag

SEQ ID NO: 2167501 - DNA, 16 bp, Homo sapiens
ttaatataagtttctt

SEQ ID NO: 2167502 - DNA, 21 bp, Homo sapiens
ttaatcctagctgtgtgcagt

SEQ ID NO: 2167503 - DNA, 20 bp, Homo sapiens
ttaatcgtttttgttttaag

SEQ ID NO: 2167504 - DNA, 21 bp, Homo sapiens
ttaatgaatagaataaataca

SEQ ID NO: 2167505 - DNA, 15 bp, Homo sapiens
ttaatgtagataaag

SEQ ID NO: 2167506 - DNA, 18 bp, Homo sapiens
ttaattggttaatcactt

SEQ ID NO: 2167507 - DNA, 18 bp, Homo sapiens
ttaatttatatttgtctc

SEQ ID NO: 2167508 - DNA, 12 bp, Homo sapiens
ttaatttcaaat

SEQ ID NO: 2167509 - DNA, 22 bp, Homo sapiens
ttaatttcttgggaaacttcta

SEQ ID NO: 2167510 - DNA, 13 bp, Homo sapiens
ttaatttgaccat

SEQ ID NO: 2167511 - DNA, 20 bp, Homo sapiens
ttaatttttacatgaccaga

SEQ ID NO: 2167512 - DNA, 13 bp, Homo sapiens
ttacaagtttcag

SEQ ID NO: 2167513 - DNA, 17 bp, Homo sapiens
ttacaattaaactcaaa

SEQ ID NO: 2167514 - DNA, 15 bp, Homo sapiens
ttacacattaaagta

SEQ ID NO: 2167515 - DNA, 22 bp, Homo sapiens
ttacacattaaagtaaagtaca

SEQ ID NO: 2167516 - DNA, 15 bp, Homo sapiens
ttacacttactgttg

SEQ ID NO: 2167517 - DNA, 11 bp, Homo sapiens
ttacagctttt

SEQ ID NO: 2167518 - DNA, 14 bp, Homo sapiens
ttacaggaagcttt

SEQ ID NO: 2167519 - DNA, 17 bp, Homo sapiens
ttacagggcccaggtga

SEQ ID NO: 2167520 - DNA, 16 bp, Homo sapiens
ttacatagtaaatggt

SEQ ID NO: 2167521 - DNA, 12 bp, Homo sapiens
ttaccaccccca

SEQ ID NO: 2167522 - DNA, 15 bp, Homo sapiens
ttaccacccccacac

SEQ ID NO: 2167523 - DNA, 16 bp, Homo sapiens
ttaccctactggctgt

SEQ ID NO: 2167524 - DNA, 20 bp, Homo sapiens
ttacccttctgtgcccagct

SEQ ID NO: 2167525 - DNA, 22 bp, Homo sapiens
ttacccttctgtgcccagctca

SEQ ID NO: 2167526 - DNA, 22 bp, Homo sapiens
tggtgtaaaaaacaaacatttg

SEQ ID NO: 2167527 - DNA, 15 bp, Homo sapiens
tggtgtcatgaggaa

SEQ ID NO: 2167528 - DNA, 16 bp, Homo sapiens
tggtgtcatgaggaaa

SEQ ID NO: 2167529 - DNA, 15 bp, Homo sapiens
tggtgtgttcgtgga

SEQ ID NO: 2167530 - DNA, 15 bp, Homo sapiens
tggttactcatttta

SEQ ID NO: 2167531 - DNA, 13 bp, Homo sapiens
tggttagctcagc

SEQ ID NO: 2167532 - DNA, 15 bp, Homo sapiens
tggttcccagaaaac

SEQ ID NO: 2167533 - DNA, 17 bp, Homo sapiens
tggttctggctgtttga

SEQ ID NO: 2167534 - DNA, 16 bp, Homo sapiens
tggttttggtttccac

SEQ ID NO: 2167535 - DNA, 14 bp, Homo sapiens
tggttttgtttctg

SEQ ID NO: 2167536 - DNA, 18 bp, Homo sapiens
tgtaaaatatctacctgc

SEQ ID NO: 2167537 - DNA, 14 bp, Homo sapiens
tgtaaatacaattc

SEQ ID NO: 2167538 - DNA, 16 bp, Homo sapiens
tgtaaatacaattcaa

SEQ ID NO: 2167539 - DNA, 18 bp, Homo sapiens
tgtaataatcattttaga

SEQ ID NO: 2167540 - DNA, 14 bp, Homo sapiens
tgtacaaaagtacc

SEQ ID NO: 2167541 - DNA, 22 bp, Homo sapiens
tgtacaagtgctcagttccaat

SEQ ID NO: 2167542 - DNA, 20 bp, Homo sapiens
tgtacagtatgtgtctagca

SEQ ID NO: 2167543 - DNA, 18 bp, Homo sapiens
tgtacatagatgtatcat

SEQ ID NO: 2167544 - DNA, 16 bp, Homo sapiens
tgtacatttgggagtt

SEQ ID NO: 2167545 - DNA, 13 bp, Homo sapiens
tgtaccaaagctg

SEQ ID NO: 2167546 - DNA, 22 bp, Homo sapiens
tgtacctgcccccactcagcat

SEQ ID NO: 2167547 - DNA, 12 bp, Homo sapiens
tgtactgggaca

SEQ ID NO: 2167548 - DNA, 13 bp, Homo sapiens
tgtactgtgacct

SEQ ID NO: 2167549 - DNA, 21 bp, Homo sapiens
tgtactgtgacctaagaacaa

SEQ ID NO: 2167550 - DNA, 14 bp, Homo sapiens
tgtagaattgaaaa

SEQ ID NO: 2167551 - DNA, 18 bp, Homo sapiens
tgtagacattttaagcat

SEQ ID NO: 2167552 - DNA, 17 bp, Homo sapiens
tgtagagtggtctattt

SEQ ID NO: 2167553 - DNA, 21 bp, Homo sapiens
tgtagagtggtctatttctcc

SEQ ID NO: 2167554 - DNA, 20 bp, Homo sapiens
tgtagcaaattccaatacat

SEQ ID NO: 2167555 - DNA, 19 bp, Homo sapiens
tgtagccacccaactttgt

SEQ ID NO: 2167556 - DNA, 21 bp, Homo sapiens
tgtagccagaattctggacaa

SEQ ID NO: 2167557 - DNA, 11 bp, Homo sapiens
tgtagccatgg

SEQ ID NO: 2167558 - DNA, 22 bp, Homo sapiens
tgtagccccaagaaggctgggg

SEQ ID NO: 2167559 - DNA, 17 bp, Homo sapiens
tgtagcctgcgtcatgg

SEQ ID NO: 2167560 - DNA, 24 bp, Homo sapiens
tgtagcgtttcctttcttccctca

SEQ ID NO: 2167561 - DNA, 20 bp, Homo sapiens
tgtaggaaaagctgttccca

SEQ ID NO: 2167562 - DNA, 19 bp, Homo sapiens
tgtaggtggagaggtggaa

SEQ ID NO: 2167563 - DNA, 17 bp, Homo sapiens
tgtaggttgtctaaaaa

SEQ ID NO: 2167564 - DNA, 20 bp, Homo sapiens
tgtatatattattataatct

SEQ ID NO: 2167565 - DNA, 17 bp, Homo sapiens
tgtatcaccctcagctg

SEQ ID NO: 2167566 - DNA, 14 bp, Homo sapiens
tgtatcattaatgt

SEQ ID NO: 2167567 - DNA, 11 bp, Homo sapiens
tgtatgtatgt

SEQ ID NO: 2167568 - DNA, 19 bp, Homo sapiens
tgtatgtgtttataattgt

SEQ ID NO: 2167569 - DNA, 23 bp, Homo sapiens
tgtattaggactggctttgtccc

SEQ ID NO: 2167570 - DNA, 21 bp, Homo sapiens
tgtattatttacatttaatag

SEQ ID NO: 2167571 - DNA, 14 bp, Homo sapiens
tgtatttaacagaa

SEQ ID NO: 2167572 - DNA, 15 bp, Homo sapiens
tgtatttaacagaaa

SEQ ID NO: 2167573 - DNA, 13 bp, Homo sapiens
tgtatttactgta

SEQ ID NO: 2167574 - DNA, 17 bp, Homo sapiens
tgtatttagtaaaaata

SEQ ID NO: 2167575 - DNA, 17 bp, Homo sapiens
tgtatttgaaataagaa

SEQ ID NO: 2167576 - DNA, 13 bp, Homo sapiens
tgtatttttagta

SEQ ID NO: 2167577 - DNA, 15 bp, Homo sapiens
tgtcaactgacctaa

SEQ ID NO: 2167578 - DNA, 22 bp, Homo sapiens
tgtcaagcctgtggatgatttt

SEQ ID NO: 2167579 - DNA, 18 bp, Homo sapiens
tgtcaagcttcattatta

SEQ ID NO: 2167580 - DNA, 20 bp, Homo sapiens
tgtcacagaggcagtggcag

SEQ ID NO: 2167581 - DNA, 13 bp, Homo sapiens
tgtcacgcaggct

SEQ ID NO: 2167582 - DNA, 15 bp, Homo sapiens
tgtcacgcaggctga

SEQ ID NO: 2167583 - DNA, 16 bp, Homo sapiens
tgtcagaataaagaac

SEQ ID NO: 2167584 - DNA, 19 bp, Homo sapiens
tgtcagaccttcttccaca

SEQ ID NO: 2167585 - DNA, 22 bp, Homo sapiens
tgtcagccctgctgtcagacct

SEQ ID NO: 2167586 - DNA, 23 bp, Homo sapiens
tgtcatccacacaacaccaggac

SEQ ID NO: 2167587 - DNA, 19 bp, Homo sapiens
tgtcatggctctgaactgc

SEQ ID NO: 2167588 - DNA, 19 bp, Homo sapiens
tgtcatgtaggttgtctaa

SEQ ID NO: 2167589 - DNA, 21 bp, Homo sapiens
tgtcatgtaggttgtctaaaa

SEQ ID NO: 2167590 - DNA, 15 bp, Homo sapiens
tgtcatttcagaagt

SEQ ID NO: 2167591 - DNA, 16 bp, Homo sapiens
tgtcatttcagaagtt

SEQ ID NO: 2167592 - DNA, 15 bp, Homo sapiens
tgtccagggcttcag

SEQ ID NO: 2167593 - DNA, 17 bp, Homo sapiens
tgtcccacagcttgggg

SEQ ID NO: 2167594 - DNA, 14 bp, Homo sapiens
tgtccccacactcc

SEQ ID NO: 2167595 - DNA, 12 bp, Homo sapiens
tgtcccccacct

SEQ ID NO: 2167596 - DNA, 12 bp, Homo sapiens
tgtccctgcagg

SEQ ID NO: 2167597 - DNA, 14 bp, Homo sapiens
tgtccctgcagggc

SEQ ID NO: 2167598 - DNA, 15 bp, Homo sapiens
tgtccctgcagggcc

SEQ ID NO: 2167599 - DNA, 22 bp, Homo sapiens
tgcgtcatggctcaaggattca

SEQ ID NO: 2167600 - DNA, 14 bp, Homo sapiens
tgcgtcccagctga

SEQ ID NO: 2167601 - DNA, 20 bp, Homo sapiens
tgcgtcccagctgaaggcag

SEQ ID NO: 2167602 - DNA, 21 bp, Homo sapiens
tgcgtcccagctgaaggcagt

SEQ ID NO: 2167603 - DNA, 19 bp, Homo sapiens
tgctaaatactgtacatag

SEQ ID NO: 2167604 - DNA, 18 bp, Homo sapiens
tgctaagtaaattagtaa

SEQ ID NO: 2167605 - DNA, 21 bp, Homo sapiens
tgctaataaagttaaattgca

SEQ ID NO: 2167606 - DNA, 22 bp, Homo sapiens
tgctaataaagttaaattgcac

SEQ ID NO: 2167607 - DNA, 13 bp, Homo sapiens
tgctaattacaca

SEQ ID NO: 2167608 - DNA, 20 bp, Homo sapiens
tgctacaaatagtgctaata

SEQ ID NO: 2167609 - DNA, 18 bp, Homo sapiens
tgctacctgatcccactc

SEQ ID NO: 2167610 - DNA, 19 bp, Homo sapiens
tgctacctgatcccactcc

SEQ ID NO: 2167611 - DNA, 21 bp, Homo sapiens
tgctaggggttttaggtctct

SEQ ID NO: 2167612 - DNA, 17 bp, Homo sapiens
tgctataaagttaaagt

SEQ ID NO: 2167613 - DNA, 22 bp, Homo sapiens
tgctatcatatattataagatt

SEQ ID NO: 2167614 - DNA, 18 bp, Homo sapiens
tgctattaaaaaaaaaga

SEQ ID NO: 2167615 - DNA, 16 bp, Homo sapiens
tgctcagaagagaatc

SEQ ID NO: 2167616 - DNA, 12 bp, Homo sapiens
tgctcagctggc

SEQ ID NO: 2167617 - DNA, 20 bp, Homo sapiens
tgctcagttccaatgtgccc

SEQ ID NO: 2167618 - DNA, 17 bp, Homo sapiens
tgctccaccccactcac

SEQ ID NO: 2167619 - DNA, 20 bp, Homo sapiens
tgctcccccattttaacttg

SEQ ID NO: 2167620 - DNA, 12 bp, Homo sapiens
tgctcctccctc

SEQ ID NO: 2167621 - DNA, 17 bp, Homo sapiens
tgctctaagcacacgga

SEQ ID NO: 2167622 - DNA, 18 bp, Homo sapiens
tgctctaagcacacggag

SEQ ID NO: 2167623 - DNA, 16 bp, Homo sapiens
tgctctcaaaatgtga

SEQ ID NO: 2167624 - DNA, 18 bp, Homo sapiens
tgctctcaaaatgtgaac

SEQ ID NO: 2167625 - DNA, 16 bp, Homo sapiens
tgctctctacccagcc

SEQ ID NO: 2167626 - DNA, 18 bp, Homo sapiens
tgctctctacccagccca

SEQ ID NO: 2167627 - DNA, 13 bp, Homo sapiens
tgctctgcccaga

SEQ ID NO: 2167628 - DNA, 15 bp, Homo sapiens
tgctctgcccagagc

SEQ ID NO: 2167629 - DNA, 20 bp, Homo sapiens
tgctctgcccagagctgggt

SEQ ID NO: 2167630 - DNA, 22 bp, Homo sapiens
tgctctgcccagagctgggtga

SEQ ID NO: 2167631 - DNA, 14 bp, Homo sapiens
tgctctggaagcct

SEQ ID NO: 2167632 - DNA, 15 bp, Homo sapiens
tgctctggaagcctg

SEQ ID NO: 2167633 - DNA, 19 bp, Homo sapiens
tgctctggaagcctgctga

SEQ ID NO: 2167634 - DNA, 16 bp, Homo sapiens
tgctgagattacaggt

SEQ ID NO: 2167635 - DNA, 15 bp, Homo sapiens
tgctgctttgcacac

SEQ ID NO: 2167636 - DNA, 17 bp, Homo sapiens
tgctgctttgcacacac

SEQ ID NO: 2167637 - DNA, 18 bp, Homo sapiens
tgctggaatggggacctg

SEQ ID NO: 2167638 - DNA, 16 bp, Homo sapiens
tgctggacaggtctgg

SEQ ID NO: 2167639 - DNA, 22 bp, Homo sapiens
tgctggagagtagacatccccc

SEQ ID NO: 2167640 - DNA, 20 bp, Homo sapiens
tgctggagccactaactaga

SEQ ID NO: 2167641 - DNA, 13 bp, Homo sapiens
tgctggagcggct

SEQ ID NO: 2167642 - DNA, 13 bp, Homo sapiens
tgctggcacagac

SEQ ID NO: 2167643 - DNA, 16 bp, Homo sapiens
tgctggccgggcacag

SEQ ID NO: 2167644 - DNA, 19 bp, Homo sapiens
tgctggccgggcacagctg

SEQ ID NO: 2167645 - DNA, 23 bp, Homo sapiens
tgctgggtttccacacagcctgt

SEQ ID NO: 2167646 - DNA, 13 bp, Homo sapiens
tgctgtggcatca

SEQ ID NO: 2167647 - DNA, 19 bp, Homo sapiens
tgctgtgggtcagtgtgcc

SEQ ID NO: 2167648 - DNA, 16 bp, Homo sapiens
tgctgtggttcctggg

SEQ ID NO: 2167649 - DNA, 17 bp, Homo sapiens
tgctgtggttcctgggg

SEQ ID NO: 2167650 - DNA, 13 bp, Homo sapiens
tgcttaaacaaaa

SEQ ID NO: 2167651 - DNA, 15 bp, Homo sapiens
tgcttactcttgctt

SEQ ID NO: 2167652 - DNA, 23 bp, Homo sapiens
tgcttataagcaacatgaattaa

SEQ ID NO: 2167653 - DNA, 23 bp, Homo sapiens
tgcttcaatacccaaatcctctc

SEQ ID NO: 2167654 - DNA, 22 bp, Homo sapiens
tgcttccctttcactgaagtga

SEQ ID NO: 2167655 - DNA, 13 bp, Homo sapiens
tgcttctggggga

SEQ ID NO: 2167656 - DNA, 17 bp, Homo sapiens
tgctttcggagctcctg

SEQ ID NO: 2167657 - DNA, 15 bp, Homo sapiens
tgctttctatctaat

SEQ ID NO: 2167658 - DNA, 22 bp, Homo sapiens
tgctttctcctttaattgtaaa

SEQ ID NO: 2167659 - DNA, 14 bp, Homo sapiens
tgctttctgaactc

SEQ ID NO: 2167660 - DNA, 20 bp, Homo sapiens
tgctttctgaactcgcttct

SEQ ID NO: 2167661 - DNA, 20 bp, Homo sapiens
tgcttttacggtgatattgt

SEQ ID NO: 2167662 - DNA, 21 bp, Homo sapiens
tgcttttgtgtctaccttgtt

SEQ ID NO: 2167663 - DNA, 16 bp, Homo sapiens
tggaaaagtgttcctt

SEQ ID NO: 2167664 - DNA, 17 bp, Homo sapiens
tggaaactgttggttga

SEQ ID NO: 2167665 - DNA, 19 bp, Homo sapiens
tggaaactgttggttgaga

SEQ ID NO: 2167666 - DNA, 19 bp, Homo sapiens
tggaaacttagagtcatga

SEQ ID NO: 2167667 - DNA, 15 bp, Homo sapiens
tggaaagattgtgtc

SEQ ID NO: 2167668 - DNA, 17 bp, Homo sapiens
tggaaagattgtgtctg

SEQ ID NO: 2167669 - DNA, 15 bp, Homo sapiens
tggaaccagagccac

SEQ ID NO: 2167670 - DNA, 20 bp, Homo sapiens
tggaactcgcccccctaccc

SEQ ID NO: 2167671 - DNA, 22 bp, Homo sapiens
tggaagagggagggtcagtgcc

SEQ ID NO: 2167672 - DNA, 22 bp, Homo sapiens
tggaagctagctcccctcctct

SEQ ID NO: 2167673 - DNA, 18 bp, Homo sapiens
tggaatctactagaacct

SEQ ID NO: 2167674 - DNA, 17 bp, Homo sapiens
tggaatggggacctggg

SEQ ID NO: 2167675 - DNA, 22 bp, Homo sapiens
tggaattttgcaaagatttaat

SEQ ID NO: 2167676 - DNA, 14 bp, Homo sapiens
tggacacacacagc

SEQ ID NO: 2167677 - DNA, 19 bp, Homo sapiens
tggacagcggttgtaaata

SEQ ID NO: 2167678 - DNA, 22 bp, Homo sapiens
tggacagcggttgtaaatacaa

SEQ ID NO: 2167679 - DNA, 13 bp, Homo sapiens
tggacaggtctgg

SEQ ID NO: 2167680 - DNA, 14 bp, Homo sapiens
tggaccaaagctga

SEQ ID NO: 2167681 - DNA, 14 bp, Homo sapiens
tggagaaagagctg

SEQ ID NO: 2167682 - DNA, 18 bp, Homo sapiens
tggagaaagagctgcctg

SEQ ID NO: 2167683 - DNA, 20 bp, Homo sapiens
tggagaaagagctgcctgga

SEQ ID NO: 2167684 - DNA, 13 bp, Homo sapiens
tgcaacctccacc

SEQ ID NO: 2167685 - DNA, 20 bp, Homo sapiens
tgcaacctccacctcccagg

SEQ ID NO: 2167686 - DNA, 21 bp, Homo sapiens
tgcaacctccacctcccaggt

SEQ ID NO: 2167687 - DNA, 13 bp, Homo sapiens
tgcaacgtgtaac

SEQ ID NO: 2167688 - DNA, 22 bp, Homo sapiens
tgcaacgtgtaacttgtgcttt

SEQ ID NO: 2167689 - DNA, 13 bp, Homo sapiens
tgcaagcaaagca

SEQ ID NO: 2167690 - DNA, 12 bp, Homo sapiens
tgcaatgtggaa

SEQ ID NO: 2167691 - DNA, 13 bp, Homo sapiens
tgcaatgtggaaa

SEQ ID NO: 2167692 - DNA, 22 bp, Homo sapiens
tgcaattccattttgtgtctgt

SEQ ID NO: 2167693 - DNA, 17 bp, Homo sapiens
tgcacacggcacagagc

SEQ ID NO: 2167694 - DNA, 15 bp, Homo sapiens
tgcacagacaagcag

SEQ ID NO: 2167695 - DNA, 15 bp, Homo sapiens
tgcacataatttgca

SEQ ID NO: 2167696 - DNA, 22 bp, Homo sapiens
tgcacctgaggcccagcagagc

SEQ ID NO: 2167697 - DNA, 12 bp, Homo sapiens
tgcaccttgtga

SEQ ID NO: 2167698 - DNA, 14 bp, Homo sapiens
tgcaccttgtgaag

SEQ ID NO: 2167699 - DNA, 23 bp, Homo sapiens
tgcaccttgtgaaggaaaaacat

SEQ ID NO: 2167700 - DNA, 11 bp, Homo sapiens
tgcacgtgcaa

SEQ ID NO: 2167701 - DNA, 14 bp, Homo sapiens
tgcacgtgcaatac

SEQ ID NO: 2167702 - DNA, 16 bp, Homo sapiens
tgcactactgaaattt

SEQ ID NO: 2167703 - DNA, 19 bp, Homo sapiens
tgcactatagccatttgcc

SEQ ID NO: 2167704 - DNA, 19 bp, Homo sapiens
tgcactggcaggatcacag

SEQ ID NO: 2167705 - DNA, 11 bp, Homo sapiens
tgcagacctgg

SEQ ID NO: 2167706 - DNA, 17 bp, Homo sapiens
tgcagacctgggacttt

SEQ ID NO: 2167707 - DNA, 12 bp, Homo sapiens
tgcagcagcttg

SEQ ID NO: 2167708 - DNA, 19 bp, Homo sapiens
tgcagcctcgaactcctgg

SEQ ID NO: 2167709 - DNA, 23 bp, Homo sapiens
tgcagcctcgaactcctgggctc

SEQ ID NO: 2167710 - DNA, 23 bp, Homo sapiens
tgcagcgtctgagcggccgcctg

SEQ ID NO: 2167711 - DNA, 18 bp, Homo sapiens
tgcagctgctggttttgg

SEQ ID NO: 2167712 - DNA, 17 bp, Homo sapiens
tgcagcttccttccaag

SEQ ID NO: 2167713 - DNA, 13 bp, Homo sapiens
tgcaggcagcctt

SEQ ID NO: 2167714 - DNA, 23 bp, Homo sapiens
tgcagggccatctgactgccaag

SEQ ID NO: 2167715 - DNA, 22 bp, Homo sapiens
tgcagggtagggggcctgagtt

SEQ ID NO: 2167716 - DNA, 18 bp, Homo sapiens
tgcagtcaccctgtggca

SEQ ID NO: 2167717 - DNA, 17 bp, Homo sapiens
tgcagtgcccctagctt

SEQ ID NO: 2167718 - DNA, 19 bp, Homo sapiens
tgcagttattagaacttag

SEQ ID NO: 2167719 - DNA, 17 bp, Homo sapiens
tgcatcaaccaggaaga

SEQ ID NO: 2167720 - DNA, 22 bp, Homo sapiens
tgcatcccaaaccacgcctctt

SEQ ID NO: 2167721 - DNA, 23 bp, Homo sapiens
tgcatccgtgagcagtgtgtctc

SEQ ID NO: 2167722 - DNA, 17 bp, Homo sapiens
tgcatgcaaaccaggag

SEQ ID NO: 2167723 - DNA, 15 bp, Homo sapiens
tgcatgcctgtaatc

SEQ ID NO: 2167724 - DNA, 17 bp, Homo sapiens
tgcatgcttctttataa

SEQ ID NO: 2167725 - DNA, 13 bp, Homo sapiens
tgcatgctttgga

SEQ ID NO: 2167726 - DNA, 17 bp, Homo sapiens
tgcatgtatattactga

SEQ ID NO: 2167727 - DNA, 17 bp, Homo sapiens
tgcatgtgttgtacaat

SEQ ID NO: 2167728 - DNA, 15 bp, Homo sapiens
tgcattaaatgcttt

SEQ ID NO: 2167729 - DNA, 13 bp, Homo sapiens
tgcattcaattta

SEQ ID NO: 2167730 - DNA, 16 bp, Homo sapiens
tgcattgtaaacataa

SEQ ID NO: 2167731 - DNA, 17 bp, Homo sapiens
tgcattgtgtgtcacaa

SEQ ID NO: 2167732 - DNA, 18 bp, Homo sapiens
tgcatttaaactcatttg

SEQ ID NO: 2167733 - DNA, 20 bp, Homo sapiens
tgcatttttttagtttgttt

SEQ ID NO: 2167734 - DNA, 22 bp, Homo sapiens
tgcatttttttagtttgttttt

SEQ ID NO: 2167735 - DNA, 16 bp, Homo sapiens
tgccaaccacctctgg

SEQ ID NO: 2167736 - DNA, 16 bp, Homo sapiens
tgccaaccctgtgtca

SEQ ID NO: 2167737 - DNA, 16 bp, Homo sapiens
tgccaagaactctggg

SEQ ID NO: 2167738 - DNA, 17 bp, Homo sapiens
tgccaagaactctgggc

SEQ ID NO: 2167739 - DNA, 22 bp, Homo sapiens
tgccaagcatttaatgtagcca

SEQ ID NO: 2167740 - DNA, 12 bp, Homo sapiens
tgccaagccaga

SEQ ID NO: 2167741 - DNA, 17 bp, Homo sapiens
tgccaagtctcaggagg

SEQ ID NO: 2167742 - DNA, 14 bp, Homo sapiens
tgccaatggaacct

SEQ ID NO: 2167743 - DNA, 17 bp, Homo sapiens
tgccaccaccctgcccc

SEQ ID NO: 2167744 - DNA, 17 bp, Homo sapiens
tgccaccctctgcaggg

SEQ ID NO: 2167745 - DNA, 20 bp, Homo sapiens
tgccaccctctgcagggcag

SEQ ID NO: 2167746 - DNA, 16 bp, Homo sapiens
tgccactaggctgggt

SEQ ID NO: 2167747 - DNA, 21 bp, Homo sapiens
tgccactaggctgggtgccca

SEQ ID NO: 2167748 - DNA, 21 bp, Homo sapiens
tgccactgttttgttggccca

SEQ ID NO: 2167749 - DNA, 18 bp, Homo sapiens
tgccagaagtgtgttttg

SEQ ID NO: 2167750 - DNA, 19 bp, Homo sapiens
tgccagagcaaagggccag

SEQ ID NO: 2167751 - DNA, 14 bp, Homo sapiens
tgccagatcaaaat

SEQ ID NO: 2167752 - DNA, 17 bp, Homo sapiens
tgccagatcaaaattgt

SEQ ID NO: 2167753 - DNA, 17 bp, Homo sapiens
tgccaggacagctgcag

SEQ ID NO: 2167754 - DNA, 20 bp, Homo sapiens
tgccaggacagctgcaggtg

SEQ ID NO: 2167755 - DNA, 18 bp, Homo sapiens
tgccataaaatctcacgc

SEQ ID NO: 2167756 - DNA, 17 bp, Homo sapiens
tgcccaacctcagcaac

SEQ ID NO: 2167757 - DNA, 19 bp, Homo sapiens
tgcccaacctcagcaacct

SEQ ID NO: 2167758 - DNA, 17 bp, Homo sapiens
tgcccagagctgggtga

SEQ ID NO: 2167759 - DNA, 20 bp, Homo sapiens
tgcccagcagtttcccagaa

SEQ ID NO: 2167760 - DNA, 15 bp, Homo sapiens
tgcccagctcagtct

SEQ ID NO: 2167761 - DNA, 20 bp, Homo sapiens
tgcccagggtcctgtgcctg

SEQ ID NO: 2167762 - DNA, 21 bp, Homo sapiens
tgccccaaaggaagctttctc

SEQ ID NO: 2167763 - DNA, 19 bp, Homo sapiens
tgccccaacttaagtttag

SEQ ID NO: 2167764 - DNA, 22 bp, Homo sapiens
tgccccaacttaagtttagaaa

SEQ ID NO: 2167765 - DNA, 13 bp, Homo sapiens
tgccccacctgcc

SEQ ID NO: 2167766 - DNA, 19 bp, Homo sapiens
tgccccatcagcagcttga

SEQ ID NO: 2167767 - DNA, 17 bp, Homo sapiens
tgcccccagctgctcct

SEQ ID NO: 2167768 - DNA, 19 bp, Homo sapiens
tgccccccctaagagacac

SEQ ID NO: 2167769 - DNA, 15 bp, Homo sapiens
tgccccgtagagaat

SEQ ID NO: 2167770 - DNA, 15 bp, Homo sapiens
tgcccctccctgctt

SEQ ID NO: 2167771 - DNA, 17 bp, Homo sapiens
tgcccctccctgcttca

SEQ ID NO: 2167772 - DNA, 13 bp, Homo sapiens
tgcccgccctccc

SEQ ID NO: 2167773 - DNA, 15 bp, Homo sapiens
tgcccgccctccctc

SEQ ID NO: 2167774 - DNA, 15 bp, Homo sapiens
tgccctccactgccc

SEQ ID NO: 2167775 - DNA, 16 bp, Homo sapiens
tgccctccactgccct

SEQ ID NO: 2167776 - DNA, 17 bp, Homo sapiens
tctggtgcctatttatt

SEQ ID NO: 2167777 - DNA, 16 bp, Homo sapiens
tctgtattcctgatat

SEQ ID NO: 2167778 - DNA, 14 bp, Homo sapiens
tctgtccagggctt

SEQ ID NO: 2167779 - DNA, 19 bp, Homo sapiens
tctgtcctcttctgtgagt

SEQ ID NO: 2167780 - DNA, 18 bp, Homo sapiens
tctgtctaccatctccct

SEQ ID NO: 2167781 - DNA, 13 bp, Homo sapiens
tctgtctctcttg

SEQ ID NO: 2167782 - DNA, 18 bp, Homo sapiens
tctgtcttccaggcccag

SEQ ID NO: 2167783 - DNA, 21 bp, Homo sapiens
tctgtgattgccatttcttcc

SEQ ID NO: 2167784 - DNA, 22 bp, Homo sapiens
tctgtgattgccatttcttccc

SEQ ID NO: 2167785 - DNA, 12 bp, Homo sapiens
tctgtgcccagc

SEQ ID NO: 2167786 - DNA, 16 bp, Homo sapiens
tctgtgcccagctcag

SEQ ID NO: 2167787 - DNA, 16 bp, Homo sapiens
tctgtggccagttgac

SEQ ID NO: 2167788 - DNA, 18 bp, Homo sapiens
tctgtgtttttttctgaa

SEQ ID NO: 2167789 - DNA, 15 bp, Homo sapiens
tgaccccttcctgtc

SEQ ID NO: 2167790 - DNA, 17 bp, Homo sapiens
tgaccccttcctgtctg

SEQ ID NO: 2167791 - DNA, 17 bp, Homo sapiens
tgaccctatgaccaaaa

SEQ ID NO: 2167792 - DNA, 12 bp, Homo sapiens
tgaccctccctt

SEQ ID NO: 2167793 - DNA, 16 bp, Homo sapiens
tgaccctcccttcctg

SEQ ID NO: 2167794 - DNA, 12 bp, Homo sapiens
tgaccctgcaga

SEQ ID NO: 2167795 - DNA, 14 bp, Homo sapiens
tgaccctgtgacaa

SEQ ID NO: 2167796 - DNA, 18 bp, Homo sapiens
tgacctcgtgacccaccc

SEQ ID NO: 2167797 - DNA, 23 bp, Homo sapiens
tgacctgcccctgccgcctgtgc

SEQ ID NO: 2167798 - DNA, 15 bp, Homo sapiens
tgaccttctcttaga

SEQ ID NO: 2167799 - DNA, 21 bp, Homo sapiens
tgaccttgaggagtcttgtgt

SEQ ID NO: 2167800 - DNA, 22 bp, Homo sapiens
tgaccttgaggagtcttgtgtg

SEQ ID NO: 2167801 - DNA, 14 bp, Homo sapiens
tgacgaggctgggc

SEQ ID NO: 2167802 - DNA, 18 bp, Homo sapiens
tgacgcgtggtcacagga

SEQ ID NO: 2167803 - DNA, 19 bp, Homo sapiens
tgacgggggttggggtggg

SEQ ID NO: 2167804 - DNA, 17 bp, Homo sapiens
tgacgtattgtgaaatt

SEQ ID NO: 2167805 - DNA, 20 bp, Homo sapiens
tgacgtattgtgaaatttgt

SEQ ID NO: 2167806 - DNA, 20 bp, Homo sapiens
tgactcccaaagagctgcct

SEQ ID NO: 2167807 - DNA, 14 bp, Homo sapiens
tgactcctgctggt

SEQ ID NO: 2167808 - DNA, 17 bp, Homo sapiens
tgactcctgctggtacc

SEQ ID NO: 2167809 - DNA, 23 bp, Homo sapiens
tgactcctgctggtacctgccct

SEQ ID NO: 2167810 - DNA, 13 bp, Homo sapiens
tgactgaatttct

SEQ ID NO: 2167811 - DNA, 14 bp, Homo sapiens
tgactgccaagcca

SEQ ID NO: 2167812 - DNA, 16 bp, Homo sapiens
tgactgccaagccaga

SEQ ID NO: 2167813 - DNA, 20 bp, Homo sapiens
tgactgccaagccagattct

SEQ ID NO: 2167814 - DNA, 13 bp, Homo sapiens
tgactgcgcagag

SEQ ID NO: 2167815 - DNA, 21 bp, Homo sapiens
tgactggacagcggttgtaaa

SEQ ID NO: 2167816 - DNA, 19 bp, Homo sapiens
tgactgtgatttatttgga

SEQ ID NO: 2167817 - DNA, 14 bp, Homo sapiens
tgacttagttctta

SEQ ID NO: 2167818 - DNA, 14 bp, Homo sapiens
tgacttttacagct

SEQ ID NO: 2167819 - DNA, 21 bp, Homo sapiens
tgacttttacagcttttctct

SEQ ID NO: 2167820 - DNA, 21 bp, Homo sapiens
tgacttttagacagtggtaaa

SEQ ID NO: 2167821 - DNA, 15 bp, Homo sapiens
tgactttttaaattt

SEQ ID NO: 2167822 - DNA, 21 bp, Homo sapiens
tgagaaacagctcagccagtg

SEQ ID NO: 2167823 - DNA, 23 bp, Homo sapiens
tgagaaacagctcagccagtggg

SEQ ID NO: 2167824 - DNA, 18 bp, Homo sapiens
tgagaaacttaaatgtta

SEQ ID NO: 2167825 - DNA, 22 bp, Homo sapiens
tgagaaatttgtggttgcatgt

SEQ ID NO: 2167826 - DNA, 19 bp, Homo sapiens
tgagaatgtagaagtggca

SEQ ID NO: 2167827 - DNA, 14 bp, Homo sapiens
tgagaattaaaata

SEQ ID NO: 2167828 - DNA, 17 bp, Homo sapiens
tgagaattcagctgccc

SEQ ID NO: 2167829 - DNA, 23 bp, Homo sapiens
tgagaattcagctgcccccgctc

SEQ ID NO: 2167830 - DNA, 15 bp, Homo sapiens
tgagactttgcccag

SEQ ID NO: 2167831 - DNA, 16 bp, Homo sapiens
tgagagaaagagagaa

SEQ ID NO: 2167832 - DNA, 13 bp, Homo sapiens
tgagagagtgtgg

SEQ ID NO: 2167833 - DNA, 15 bp, Homo sapiens
tgagagagtgtggaa

SEQ ID NO: 2167834 - DNA, 22 bp, Homo sapiens
tgagattctcaaaggagcgagc

SEQ ID NO: 2167835 - DNA, 17 bp, Homo sapiens
tgagcaaacctgcccca

SEQ ID NO: 2167836 - DNA, 21 bp, Homo sapiens
tgagcaaacctgccccatccc

SEQ ID NO: 2167837 - DNA, 15 bp, Homo sapiens
tgagcagacaggctg

SEQ ID NO: 2167838 - DNA, 19 bp, Homo sapiens
tgagcggccgcctgtcctt

SEQ ID NO: 2167839 - DNA, 20 bp, Homo sapiens
tgagcggccgcctgtccttg

SEQ ID NO: 2167840 - DNA, 17 bp, Homo sapiens
tgagctcaggagagagc

SEQ ID NO: 2167841 - DNA, 17 bp, Homo sapiens
tgagctggcctcacctg

SEQ ID NO: 2167842 - DNA, 15 bp, Homo sapiens
tgagctggtttgact

SEQ ID NO: 2167843 - DNA, 22 bp, Homo sapiens
tgagctttggacgcacacagct

SEQ ID NO: 2167844 - DNA, 12 bp, Homo sapiens
tgaggaaaaaaa

SEQ ID NO: 2167845 - DNA, 16 bp, Homo sapiens
tgaggaagctccagtc

SEQ ID NO: 2167846 - DNA, 13 bp, Homo sapiens
tgaggcagaacct

SEQ ID NO: 2167847 - DNA, 18 bp, Homo sapiens
tgaggcccagcagagccg

SEQ ID NO: 2167848 - DNA, 19 bp, Homo sapiens
tgaggcccagcagagccgt

SEQ ID NO: 2167849 - DNA, 23 bp, Homo sapiens
tgagggacgaggtcaaggagata

SEQ ID NO: 2167850 - DNA, 21 bp, Homo sapiens
tgaggtcaccaggggaggagc

SEQ ID NO: 2167851 - DNA, 17 bp, Homo sapiens
tgagtattacacattaa

SEQ ID NO: 2167852 - DNA, 20 bp, Homo sapiens
tgagtattacacattaaagt

SEQ ID NO: 2167853 - DNA, 21 bp, Homo sapiens
tgagtcccttccaggccatca

SEQ ID NO: 2167854 - DNA, 15 bp, Homo sapiens
tgagtgcaagcaaag

SEQ ID NO: 2167855 - DNA, 20 bp, Homo sapiens
tgagtgccaccacactcagc

SEQ ID NO: 2167856 - DNA, 12 bp, Homo sapiens
tgagtgggaagc

SEQ ID NO: 2167857 - DNA, 22 bp, Homo sapiens
tgagtggggagacacctcagag

SEQ ID NO: 2167858 - DNA, 19 bp, Homo sapiens
tgagtgtgcaagcaaagaa

SEQ ID NO: 2167859 - DNA, 22 bp, Homo sapiens
tgagttgaggggcttccctctg

SEQ ID NO: 2167860 - DNA, 18 bp, Homo sapiens
tgagtttccagctaagcc

SEQ ID NO: 2167861 - DNA, 13 bp, Homo sapiens
tgagtttcttcta

SEQ ID NO: 2167862 - DNA, 15 bp, Homo sapiens
tgagtttgtttcttg

SEQ ID NO: 2167863 - DNA, 15 bp, Homo sapiens
tgataaaaatgatat

SEQ ID NO: 2167864 - DNA, 16 bp, Homo sapiens
tgataaaaatgatatt

SEQ ID NO: 2167865 - DNA, 16 bp, Homo sapiens
tgataagaattcttaa

SEQ ID NO: 2167866 - DNA, 15 bp, Homo sapiens
tgataataaaattca

SEQ ID NO: 2167867 - DNA, 22 bp, Homo sapiens
tgataataaaattcattccatt

SEQ ID NO: 2167868 - DNA, 18 bp, Homo sapiens
tgatactgactttttaaa

SEQ ID NO: 2167869 - DNA, 20 bp, Homo sapiens
tgatactgtctaagaataat

SEQ ID NO: 2167870 - DNA, 19 bp, Homo sapiens
tgatatacttgagtgtgca

SEQ ID NO: 2167871 - DNA, 15 bp, Homo sapiens
tgatatctgtttgct

SEQ ID NO: 2167872 - DNA, 18 bp, Homo sapiens
tgatatgactaattcagg

SEQ ID NO: 2167873 - DNA, 14 bp, Homo sapiens
tgatattggtgtga

SEQ ID NO: 2167874 - DNA, 17 bp, Homo sapiens
tgatattggtgtgaatg

SEQ ID NO: 2167875 - DNA, 16 bp, Homo sapiens
tgatcagaatcccaaa

SEQ ID NO: 2167876 - DNA, 20 bp, Homo sapiens
tgatcatttgcagctgctgg

SEQ ID NO: 2167877 - DNA, 21 bp, Homo sapiens
tgatcctcctgtcttggcctc

SEQ ID NO: 2167878 - DNA, 12 bp, Homo sapiens
tgatctcccctc

SEQ ID NO: 2167879 - DNA, 16 bp, Homo sapiens
tgatctgggaactccc

SEQ ID NO: 2167880 - DNA, 17 bp, Homo sapiens
tgatgaagggaggaggt

SEQ ID NO: 2167881 - DNA, 13 bp, Homo sapiens
tgatgactgctga

SEQ ID NO: 2167882 - DNA, 15 bp, Homo sapiens
tgatggcattactct

SEQ ID NO: 2167883 - DNA, 16 bp, Homo sapiens
tgatggcattactctg

SEQ ID NO: 2167884 - DNA, 12 bp, Homo sapiens
tgatgggtgggc

SEQ ID NO: 2167885 - DNA, 22 bp, Homo sapiens
tgatgtaggaaatggtttccat

SEQ ID NO: 2167886 - DNA, 19 bp, Homo sapiens
tgatgtatgttggtttttt

SEQ ID NO: 2167887 - DNA, 20 bp, Homo sapiens
tgatgtatgttggtttttta

SEQ ID NO: 2167888 - DNA, 17 bp, Homo sapiens
tgatgtcatctgtcact

SEQ ID NO: 2167889 - DNA, 13 bp, Homo sapiens
tgatgtcatcttg

SEQ ID NO: 2167890 - DNA, 17 bp, Homo sapiens
tgattattgagttctga

SEQ ID NO: 2167891 - DNA, 18 bp, Homo sapiens
tgattattgagttctgaa

SEQ ID NO: 2167892 - DNA, 23 bp, Homo sapiens
tgattcaataaaatgcactgacc

SEQ ID NO: 2167893 - DNA, 16 bp, Homo sapiens
tgattccattttaagt

SEQ ID NO: 2167894 - DNA, 16 bp, Homo sapiens
tgattgccaacagtgg

SEQ ID NO: 2167895 - DNA, 17 bp, Homo sapiens
tgattgccatttcttcc

SEQ ID NO: 2167896 - DNA, 22 bp, Homo sapiens
tgattgtctgaaattttctaga

SEQ ID NO: 2167897 - DNA, 13 bp, Homo sapiens
tgatttaggcact

SEQ ID NO: 2167898 - DNA, 19 bp, Homo sapiens
tgatttatttggagtggag

SEQ ID NO: 2167899 - DNA, 22 bp, Homo sapiens
tgatttatttggagtggaggca

SEQ ID NO: 2167900 - DNA, 12 bp, Homo sapiens
tgatttcacata

SEQ ID NO: 2167901 - DNA, 16 bp, Homo sapiens
tgatttgcatgtgtaa

SEQ ID NO: 2167902 - DNA, 12 bp, Homo sapiens
tgatttgctatc

SEQ ID NO: 2167903 - DNA, 15 bp, Homo sapiens
tgatttgctgttttc

SEQ ID NO: 2167904 - DNA, 16 bp, Homo sapiens
tgatttgctgttttct

SEQ ID NO: 2167905 - DNA, 13 bp, Homo sapiens
tgattttcctgtg

SEQ ID NO: 2167906 - DNA, 22 bp, Homo sapiens
tgattttttttttaacttgaaa

SEQ ID NO: 2167907 - DNA, 14 bp, Homo sapiens
tgcaaaaatatata

SEQ ID NO: 2167908 - DNA, 18 bp, Homo sapiens
tgcaaaacatgctacctg

SEQ ID NO: 2167909 - DNA, 12 bp, Homo sapiens
tgcaaagctgct

SEQ ID NO: 2167910 - DNA, 17 bp, Homo sapiens
tgcaaagctgcttgaat

SEQ ID NO: 2167911 - DNA, 16 bp, Homo sapiens
tgcaaagggacattga

SEQ ID NO: 2167912 - DNA, 13 bp, Homo sapiens
tgcaaataaagcc

SEQ ID NO: 2167913 - DNA, 15 bp, Homo sapiens
tgcaacaggtaaaca

SEQ ID NO: 2167914 - DNA, 17 bp, Homo sapiens
ttccctttgctccaccc

SEQ ID NO: 2167915 - DNA, 22 bp, Homo sapiens
ttccgctttgaaagaagcaaga

SEQ ID NO: 2167916 - DNA, 18 bp, Homo sapiens
ttcctagttttatgtttc

SEQ ID NO: 2167917 - DNA, 19 bp, Homo sapiens
ttcctagttttatgtttct

SEQ ID NO: 2167918 - DNA, 13 bp, Homo sapiens
ttcctcaccttga

SEQ ID NO: 2167919 - DNA, 19 bp, Homo sapiens
ttcctccctccctgcaggg

SEQ ID NO: 2167920 - DNA, 23 bp, Homo sapiens
ttcctcctcccctggcaactgct

SEQ ID NO: 2167921 - DNA, 20 bp, Homo sapiens
ttcctggaatgcattcactc

SEQ ID NO: 2167922 - DNA, 20 bp, Homo sapiens
ttcctggggtgccctccact

SEQ ID NO: 2167923 - DNA, 14 bp, Homo sapiens
ttcctgtctggccc

SEQ ID NO: 2167924 - DNA, 23 bp, Homo sapiens
ttccttatttttacttgtatgta

SEQ ID NO: 2167925 - DNA, 19 bp, Homo sapiens
ttccttcaaatcctgccac

SEQ ID NO: 2167926 - DNA, 16 bp, Homo sapiens
ttccttgtccccacac

SEQ ID NO: 2167927 - DNA, 21 bp, Homo sapiens
ttccttgtccccacactccta

SEQ ID NO: 2167928 - DNA, 18 bp, Homo sapiens
ttcgtggagccacaggca

SEQ ID NO: 2167929 - DNA, 14 bp, Homo sapiens
ttctaaaaagatgt

SEQ ID NO: 2167930 - DNA, 12 bp, Homo sapiens
ttctaaaatcaa

SEQ ID NO: 2167931 - DNA, 18 bp, Homo sapiens
ttctaaaggtttcactgt

SEQ ID NO: 2167932 - DNA, 15 bp, Homo sapiens
ttctaagtggcctgc

SEQ ID NO: 2167933 - DNA, 17 bp, Homo sapiens
ttctacagtattatgta

SEQ ID NO: 2167934 - DNA, 13 bp, Homo sapiens
ttctacttttaaa

SEQ ID NO: 2167935 - DNA, 16 bp, Homo sapiens
ttctacttttaaataa

SEQ ID NO: 2167936 - DNA, 14 bp, Homo sapiens
ttctagattcactg

SEQ ID NO: 2167937 - DNA, 13 bp, Homo sapiens
ttctagtttgttt

SEQ ID NO: 2167938 - DNA, 15 bp, Homo sapiens
ttctcatcactcccc

SEQ ID NO: 2167939 - DNA, 20 bp, Homo sapiens
ttctccccccaacacaatct

SEQ ID NO: 2167940 - DNA, 12 bp, Homo sapiens
ttctcctgtgcc

SEQ ID NO: 2167941 - DNA, 13 bp, Homo sapiens
ttctcctgtgccc

SEQ ID NO: 2167942 - DNA, 20 bp, Homo sapiens
ttctctaatgtaacttcctc

SEQ ID NO: 2167943 - DNA, 20 bp, Homo sapiens
ttctctactgtctggattaa

SEQ ID NO: 2167944 - DNA, 15 bp, Homo sapiens
ttctctccaacatga

SEQ ID NO: 2167945 - DNA, 13 bp, Homo sapiens
ttctctcttcaat

SEQ ID NO: 2167946 - DNA, 11 bp, Homo sapiens
ttctctgcttc

SEQ ID NO: 2167947 - DNA, 15 bp, Homo sapiens
ttctctgcttcagct

SEQ ID NO: 2167948 - DNA, 19 bp, Homo sapiens
ttctctgcttcagcttgct

SEQ ID NO: 2167949 - DNA, 15 bp, Homo sapiens
ttctctgtccagggc

SEQ ID NO: 2167950 - DNA, 17 bp, Homo sapiens
ttctctgtctcatgtgt

SEQ ID NO: 2167951 - DNA, 12 bp, Homo sapiens
ttctcttctctg

SEQ ID NO: 2167952 - DNA, 15 bp, Homo sapiens
ttctcttgaataaag

SEQ ID NO: 2167953 - DNA, 17 bp, Homo sapiens
ttctctttctttttctg

SEQ ID NO: 2167954 - DNA, 19 bp, Homo sapiens
ttctctttttcttgtaaac

SEQ ID NO: 2167955 - DNA, 11 bp, Homo sapiens
ttctgaacagc

SEQ ID NO: 2167956 - DNA, 12 bp, Homo sapiens
ttctgaactcgc

SEQ ID NO: 2167957 - DNA, 23 bp, Homo sapiens
ttctgaagatcagaacattcagc

SEQ ID NO: 2167958 - DNA, 19 bp, Homo sapiens
ttctgaaggtaaagggaca

SEQ ID NO: 2167959 - DNA, 21 bp, Homo sapiens
ttctgaaggttggaactgctg

SEQ ID NO: 2167960 - DNA, 12 bp, Homo sapiens
ttctgaagtttt

SEQ ID NO: 2167961 - DNA, 14 bp, Homo sapiens
ttctgacctcagca

SEQ ID NO: 2167962 - DNA, 12 bp, Homo sapiens
ttctgaggagga

SEQ ID NO: 2167963 - DNA, 17 bp, Homo sapiens
ttctgcactttgacaca

SEQ ID NO: 2167964 - DNA, 19 bp, Homo sapiens
ttctggttagctcagcccc

SEQ ID NO: 2167965 - DNA, 17 bp, Homo sapiens
ttctgtcttccaggccc

SEQ ID NO: 2167966 - DNA, 18 bp, Homo sapiens
ttctgtttttacagtgga

SEQ ID NO: 2167967 - DNA, 14 bp, Homo sapiens
agcacacaacaggc

SEQ ID NO: 2167968 - DNA, 22 bp, Homo sapiens
agcacagggacacaaagaggaa

SEQ ID NO: 2167969 - DNA, 13 bp, Homo sapiens
agcaccagggaag

SEQ ID NO: 2167970 - DNA, 17 bp, Homo sapiens
agcacctcctctctgct

SEQ ID NO: 2167971 - DNA, 18 bp, Homo sapiens
agcacctcctctctgctg

SEQ ID NO: 2167972 - DNA, 23 bp, Homo sapiens
agcacctttagaatattaaaaat

SEQ ID NO: 2167973 - DNA, 21 bp, Homo sapiens
agcactcacatgctggacagg

SEQ ID NO: 2167974 - DNA, 20 bp, Homo sapiens
agcactgtttggatatgaga

SEQ ID NO: 2167975 - DNA, 16 bp, Homo sapiens
agcagaaacccatgtg

SEQ ID NO: 2167976 - DNA, 10 bp, Homo sapiens
agcagagccg

SEQ ID NO: 2167977 - DNA, 17 bp, Homo sapiens
agcagaggctggcctca

SEQ ID NO: 2167978 - DNA, 19 bp, Homo sapiens
agcagaggctggcctcaga

SEQ ID NO: 2167979 - DNA, 17 bp, Homo sapiens
agcagcatttacagaaa

SEQ ID NO: 2167980 - DNA, 15 bp, Homo sapiens
agcagccctggagtc

SEQ ID NO: 2167981 - DNA, 19 bp, Homo sapiens
agcagccctggagtcatgc

SEQ ID NO: 2167982 - DNA, 17 bp, Homo sapiens
agcagctccgcctggca

SEQ ID NO: 2167983 - DNA, 18 bp, Homo sapiens
agcagctccgcctggcac

SEQ ID NO: 2167984 - DNA, 19 bp, Homo sapiens
agcagctccgcctggcacc

SEQ ID NO: 2167985 - DNA, 17 bp, Homo sapiens
agcagcttgctgcaccc

SEQ ID NO: 2167986 - DNA, 13 bp, Homo sapiens
agcaggcccacct

SEQ ID NO: 2167987 - DNA, 14 bp, Homo sapiens
agcaggcccaccta

SEQ ID NO: 2167988 - DNA, 16 bp, Homo sapiens
agcaggcccagctggg

SEQ ID NO: 2167989 - DNA, 14 bp, Homo sapiens
agcagggtctttgt

SEQ ID NO: 2167990 - DNA, 19 bp, Homo sapiens
agcagggtctttgtgtgct

SEQ ID NO: 2167991 - DNA, 16 bp, Homo sapiens
agcaggttccccaagg

SEQ ID NO: 2167992 - DNA, 20 bp, Homo sapiens
agcaggttccccaagggccc

SEQ ID NO: 2167993 - DNA, 23 bp, Homo sapiens
agcaggttccccaagggccctgg

SEQ ID NO: 2167994 - DNA, 20 bp, Homo sapiens
agcaggttggcttttttccc

SEQ ID NO: 2167995 - DNA, 22 bp, Homo sapiens
agcaggttggcttttttccctg

SEQ ID NO: 2167996 - DNA, 14 bp, Homo sapiens
agcagtattctagt

SEQ ID NO: 2167997 - DNA, 12 bp, Homo sapiens
agcagtattttt

SEQ ID NO: 2167998 - DNA, 19 bp, Homo sapiens
agcagtggccttattgcat

SEQ ID NO: 2167999 - DNA, 15 bp, Homo sapiens
agcagtgtgtctcct

SEQ ID NO: 2168000 - DNA, 21 bp, Homo sapiens
agcagtgtgtctcctgcatgc

SEQ ID NO: 2168001 - DNA, 22 bp, Homo sapiens
agcagtgtgtctcctgcatgca

SEQ ID NO: 2168002 - DNA, 14 bp, Homo sapiens
agcagtgtttaaaa

SEQ ID NO: 2168003 - DNA, 14 bp, Homo sapiens
agcagtttcccaga

SEQ ID NO: 2168004 - DNA, 24 bp, Homo sapiens
agcatagagaacgggagtggccat

SEQ ID NO: 2168005 - DNA, 16 bp, Homo sapiens
agcatccacctccttc

SEQ ID NO: 2168006 - DNA, 14 bp, Homo sapiens
agcatccgtctccc

SEQ ID NO: 2168007 - DNA, 19 bp, Homo sapiens
agcatccgtctcccctcgt

SEQ ID NO: 2168008 - DNA, 21 bp, Homo sapiens
agcatgactggacagcggttg

SEQ ID NO: 2168009 - DNA, 15 bp, Homo sapiens
agcatggtgcatgcc

SEQ ID NO: 2168010 - DNA, 16 bp, Homo sapiens
agcatggtgcatgccg

SEQ ID NO: 2168011 - DNA, 12 bp, Homo sapiens
agcatgtacaaa

SEQ ID NO: 2168012 - DNA, 21 bp, Homo sapiens
agcatgtacaaaagtaccata

SEQ ID NO: 2168013 - DNA, 20 bp, Homo sapiens
agcatttaatgtagccatgg

SEQ ID NO: 2168014 - DNA, 18 bp, Homo sapiens
agccaactgtttccctgc

SEQ ID NO: 2168015 - DNA, 12 bp, Homo sapiens
agctgtgaaatt

SEQ ID NO: 2168016 - DNA, 17 bp, Homo sapiens
agctgtgaaattgaagt

SEQ ID NO: 2168017 - DNA, 15 bp, Homo sapiens
agctgttctgtccct

SEQ ID NO: 2168018 - DNA, 14 bp, Homo sapiens
agcttacaggaagc

SEQ ID NO: 2168019 - DNA, 17 bp, Homo sapiens
agcttacctcccacctt

SEQ ID NO: 2168020 - DNA, 16 bp, Homo sapiens
agcttcaagtctgtgc

SEQ ID NO: 2168021 - DNA, 19 bp, Homo sapiens
agcttcaagtctgtgcctg

SEQ ID NO: 2168022 - DNA, 23 bp, Homo sapiens
agcttccacaaacaccatcttca

SEQ ID NO: 2168023 - DNA, 20 bp, Homo sapiens
agcttccgctttgaaagaag

SEQ ID NO: 2168024 - DNA, 14 bp, Homo sapiens
agcttccttccaag

SEQ ID NO: 2168025 - DNA, 17 bp, Homo sapiens
agcttctgacctcagca

SEQ ID NO: 2168026 - DNA, 20 bp, Homo sapiens
agcttgcttcattgggctgt

SEQ ID NO: 2168027 - DNA, 12 bp, Homo sapiens
agctttcctggg

SEQ ID NO: 2168028 - DNA, 16 bp, Homo sapiens
agctttctctgcttca

SEQ ID NO: 2168029 - DNA, 19 bp, Homo sapiens
agctttggacacacacagc

SEQ ID NO: 2168030 - DNA, 21 bp, Homo sapiens
agctttggacgcacacagctt

SEQ ID NO: 2168031 - DNA, 17 bp, Homo sapiens
agcttttagtacccacc

SEQ ID NO: 2168032 - DNA, 19 bp, Homo sapiens
agcttttagtacccacctg

SEQ ID NO: 2168033 - DNA, 18 bp, Homo sapiens
aggaaagaagggggccct

SEQ ID NO: 2168034 - DNA, 21 bp, Homo sapiens
aggaaagaagggggccctgct

SEQ ID NO: 2168035 - DNA, 23 bp, Homo sapiens
aggaaagaagggggccctgctac

SEQ ID NO: 2168036 - DNA, 14 bp, Homo sapiens
aggaagaaaccatt

SEQ ID NO: 2168037 - DNA, 17 bp, Homo sapiens
aggaagaatataatggg

SEQ ID NO: 2168038 - DNA, 22 bp, Homo sapiens
aggaagcacaagaagtgggagt

SEQ ID NO: 2168039 - DNA, 20 bp, Homo sapiens
aggaagctccagtcctgctc

SEQ ID NO: 2168040 - DNA, 21 bp, Homo sapiens
aggaagctccagtcctgctct

SEQ ID NO: 2168041 - DNA, 17 bp, Homo sapiens
aggaagctttctctgct

SEQ ID NO: 2168042 - DNA, 17 bp, Homo sapiens
aggaatcttttactgtg

SEQ ID NO: 2168043 - DNA, 14 bp, Homo sapiens
aggaattttagaag

SEQ ID NO: 2168044 - DNA, 21 bp, Homo sapiens
aggacatttgggactgtcttg

SEQ ID NO: 2168045 - DNA, 20 bp, Homo sapiens
aggaccctcaggaattcagt

SEQ ID NO: 2168046 - DNA, 14 bp, Homo sapiens
aggacctctgggct

SEQ ID NO: 2168047 - DNA, 13 bp, Homo sapiens
aggacgcattcca

SEQ ID NO: 2168048 - DNA, 22 bp, Homo sapiens
aggactgacctgcccctgccgc

SEQ ID NO: 2168049 - DNA, 22 bp, Homo sapiens
aggactggctttgtcccacagc

SEQ ID NO: 2168050 - DNA, 13 bp, Homo sapiens
aggacttgtgcct

SEQ ID NO: 2168051 - DNA, 14 bp, Homo sapiens
aggacttgtgcctc

SEQ ID NO: 2168052 - DNA, 21 bp, Homo sapiens
aggacttgtgcctcttgggag

SEQ ID NO: 2168053 - DNA, 15 bp, Homo sapiens
aggactttgtacatt

SEQ ID NO: 2168054 - DNA, 12 bp, Homo sapiens
aggagacttgta

SEQ ID NO: 2168055 - DNA, 11 bp, Homo sapiens
aggagagagac

SEQ ID NO: 2168056 - DNA, 14 bp, Homo sapiens
aggagaggctctga

SEQ ID NO: 2168057 - DNA, 20 bp, Homo sapiens
aggagattaacacactgaac

SEQ ID NO: 2168058 - DNA, 20 bp, Homo sapiens
aggagcatccacctccttct

SEQ ID NO: 2168059 - DNA, 11 bp, Homo sapiens
aggagcctgcg

SEQ ID NO: 2168060 - DNA, 15 bp, Homo sapiens
aggagcgagcatgtc

SEQ ID NO: 2168061 - DNA, 18 bp, Homo sapiens
aggagcttacctcccacc

SEQ ID NO: 2168062 - DNA, 21 bp, Homo sapiens
aggaggaaataaattgcagag

SEQ ID NO: 2168063 - DNA, 20 bp, Homo sapiens
aggaggagattaacacactg

SEQ ID NO: 2168064 - DNA, 22 bp, Homo sapiens
aggaggagattaacacactgaa

SEQ ID NO: 2168065 - DNA, 20 bp, Homo sapiens
aggaggcagaaagcagaggc

SEQ ID NO: 2168066 - DNA, 22 bp, Homo sapiens
aggaggcagaaagcagaggctg

SEQ ID NO: 2168067 - DNA, 22 bp, Homo sapiens
aggaggggtggtgtccttctcc

SEQ ID NO: 2168068 - DNA, 14 bp, Homo sapiens
aggagggtgggaag

SEQ ID NO: 2168069 - DNA, 13 bp, Homo sapiens
aggaggtggacat

SEQ ID NO: 2168070 - DNA, 20 bp, Homo sapiens
aggaggttgagaatgcagtg

SEQ ID NO: 2168071 - DNA, 18 bp, Homo sapiens
aggatatactgcagcttt

SEQ ID NO: 2168072 - DNA, 21 bp, Homo sapiens
aggatatgttcacacctagcg

SEQ ID NO: 2168073 - DNA, 16 bp, Homo sapiens
aggatgattttggcct

SEQ ID NO: 2168074 - DNA, 20 bp, Homo sapiens
aggatgtttcaccaaggaaa

SEQ ID NO: 2168075 - DNA, 15 bp, Homo sapiens
aggattagaaaattt

SEQ ID NO: 2168076 - DNA, 19 bp, Homo sapiens
aggattaggtttagaatca

SEQ ID NO: 2168077 - DNA, 15 bp, Homo sapiens
aggattccagttgcg

SEQ ID NO: 2168078 - DNA, 21 bp, Homo sapiens
aggattgaaaatgtccaggaa

SEQ ID NO: 2168079 - DNA, 15 bp, Homo sapiens
aggatttaatttgtt

SEQ ID NO: 2168080 - DNA, 17 bp, Homo sapiens
aggatttggtttttctc

SEQ ID NO: 2168081 - DNA, 20 bp, Homo sapiens
aggcaagatccccgccaccc

SEQ ID NO: 2168082 - DNA, 17 bp, Homo sapiens
aggcaagctggcaggag

SEQ ID NO: 2168083 - DNA, 14 bp, Homo sapiens
aggcaaggctgccg

SEQ ID NO: 2168084 - DNA, 20 bp, Homo sapiens
aggcaaggctgccggctgca

SEQ ID NO: 2168085 - DNA, 22 bp, Homo sapiens
aggcaccacctctgtcacgttc

SEQ ID NO: 2168086 - DNA, 16 bp, Homo sapiens
aggcaccccctggctt

SEQ ID NO: 2168087 - DNA, 23 bp, Homo sapiens
aggcaccccctggcttgaacctt

SEQ ID NO: 2168088 - DNA, 16 bp, Homo sapiens
aggcagaaagcagagg

SEQ ID NO: 2168089 - DNA, 21 bp, Homo sapiens
aggcagaaagcagaggctggc

SEQ ID NO: 2168090 - DNA, 23 bp, Homo sapiens
aggcagaaagcagaggctggcct

SEQ ID NO: 2168091 - DNA, 17 bp, Homo sapiens
aggcagaacctggtggc

SEQ ID NO: 2168092 - DNA, 19 bp, Homo sapiens
aggcagagtgccccacctg

SEQ ID NO: 2168093 - DNA, 20 bp, Homo sapiens
aggcagagtgccccacctgc

SEQ ID NO: 2168094 - DNA, 15 bp, Homo sapiens
aggcaggcctttcct

SEQ ID NO: 2168095 - DNA, 19 bp, Homo sapiens
aggcaggggctgggcagag

SEQ ID NO: 2168096 - DNA, 23 bp, Homo sapiens
aggcagggttttatctctgtcta

SEQ ID NO: 2168097 - DNA, 12 bp, Homo sapiens
aggcagtggcag

SEQ ID NO: 2168098 - DNA, 16 bp, Homo sapiens
aggcagtggggctggg

SEQ ID NO: 2168099 - DNA, 12 bp, Homo sapiens
aggcattaaatg

SEQ ID NO: 2168100 - DNA, 21 bp, Homo sapiens
gaggtcaccaggggaggagcc

SEQ ID NO: 2168101 - DNA, 12 bp, Homo sapiens
gaggtctccagg

SEQ ID NO: 2168102 - DNA, 22 bp, Homo sapiens
gaggtctccaggggcctgcaga

SEQ ID NO: 2168103 - DNA, 23 bp, Homo sapiens
gaggtgaactgtttccacattca

SEQ ID NO: 2168104 - DNA, 20 bp, Homo sapiens
gaggtgggaggcccctggtg

SEQ ID NO: 2168105 - DNA, 20 bp, Homo sapiens
gaggtggggaagagagcctg

SEQ ID NO: 2168106 - DNA, 18 bp, Homo sapiens
gagtagacccctggctgg

SEQ ID NO: 2168107 - DNA, 20 bp, Homo sapiens
gagtagctgagactacaggt

SEQ ID NO: 2168108 - DNA, 16 bp, Homo sapiens
gagtataggccggtct

SEQ ID NO: 2168109 - DNA, 14 bp, Homo sapiens
gagtccaggaaggg

SEQ ID NO: 2168110 - DNA, 20 bp, Homo sapiens
gagtctggctctgtcgccca

SEQ ID NO: 2168111 - DNA, 23 bp, Homo sapiens
gagtctttgtaagtaaactgccc

SEQ ID NO: 2168112 - DNA, 17 bp, Homo sapiens
gagtgcaagcaaagcag

SEQ ID NO: 2168113 - DNA, 14 bp, Homo sapiens
ggcccccgccctct

SEQ ID NO: 2168114 - DNA, 16 bp, Homo sapiens
ggcccccgccctctgc

SEQ ID NO: 2168115 - DNA, 24 bp, Homo sapiens
ggcccctctgactcccaaagagct

SEQ ID NO: 2168116 - DNA, 18 bp, Homo sapiens
ggcccgccgtgcctgcat

SEQ ID NO: 2168117 - DNA, 15 bp, Homo sapiens
ggccctacagccctg

SEQ ID NO: 2168118 - DNA, 20 bp, Homo sapiens
ggccctctgaggctcagccc

SEQ ID NO: 2168119 - DNA, 14 bp, Homo sapiens
ggccctctggggct

SEQ ID NO: 2168120 - DNA, 15 bp, Homo sapiens
ggccctggcaccccc

SEQ ID NO: 2168121 - DNA, 13 bp, Homo sapiens
ggccctggctggg

SEQ ID NO: 2168122 - DNA, 16 bp, Homo sapiens
ggcccttttctggctc

SEQ ID NO: 2168123 - DNA, 17 bp, Homo sapiens
ggcccttttctggctcc

SEQ ID NO: 2168124 - DNA, 18 bp, Homo sapiens
ggcccttttctggctcct

SEQ ID NO: 2168125 - DNA, 13 bp, Homo sapiens
ggccgaggcaggg

SEQ ID NO: 2168126 - DNA, 15 bp, Homo sapiens
ggccgccacggcctg

SEQ ID NO: 2168127 - DNA, 17 bp, Homo sapiens
ggccgccacggcctggc

SEQ ID NO: 2168128 - DNA, 22 bp, Homo sapiens
ggccgccacggcctggctggtg

SEQ ID NO: 2168129 - DNA, 15 bp, Homo sapiens
ggccgcccacctgca

SEQ ID NO: 2168130 - DNA, 12 bp, Homo sapiens
ggccgggcacag

SEQ ID NO: 2168131 - DNA, 13 bp, Homo sapiens
ggcctcaccctgc

SEQ ID NO: 2168132 - DNA, 18 bp, Homo sapiens
ggcctcactccaggaagg

SEQ ID NO: 2168133 - DNA, 15 bp, Homo sapiens
ggcctcaggctctgc

SEQ ID NO: 2168134 - DNA, 17 bp, Homo sapiens
ggcctcgtgaggggcaa

SEQ ID NO: 2168135 - DNA, 13 bp, Homo sapiens
ggcctctggctgc

SEQ ID NO: 2168136 - DNA, 16 bp, Homo sapiens
ggcctctggctgcctg

SEQ ID NO: 2168137 - DNA, 15 bp, Homo sapiens
ggcctcttgctggtg

SEQ ID NO: 2168138 - DNA, 14 bp, Homo sapiens
ggcctgcagaagga

SEQ ID NO: 2168139 - DNA, 18 bp, Homo sapiens
ggcctggctccgctgtgt

SEQ ID NO: 2168140 - DNA, 16 bp, Homo sapiens
ggcctggctggtggga

SEQ ID NO: 2168141 - DNA, 20 bp, Homo sapiens
ggcctggctggtgggaaggc

SEQ ID NO: 2168142 - DNA, 13 bp, Homo sapiens
gccatgggaccaa

SEQ ID NO: 2168143 - DNA, 13 bp, Homo sapiens
gccatttccctga

SEQ ID NO: 2168144 - DNA, 18 bp, Homo sapiens
gccatttccctgaacaga

SEQ ID NO: 2168145 - DNA, 14 bp, Homo sapiens
gccatttcttccca

SEQ ID NO: 2168146 - DNA, 16 bp, Homo sapiens
gccatttcttcccaag

SEQ ID NO: 2168147 - DNA, 14 bp, Homo sapiens
gcccaacctcagca

SEQ ID NO: 2168148 - DNA, 22 bp, Homo sapiens
gcccaagcctggtctcctccca

SEQ ID NO: 2168149 - DNA, 17 bp, Homo sapiens
gcccacagcccgcatgc

SEQ ID NO: 2168150 - DNA, 22 bp, Homo sapiens
gcccacagcccgcatgcagcag

SEQ ID NO: 2168151 - DNA, 18 bp, Homo sapiens
gcccacaggtgtccccag

SEQ ID NO: 2168152 - DNA, 14 bp, Homo sapiens
gcccacctgcatca

SEQ ID NO: 2168153 - DNA, 15 bp, Homo sapiens
gcccacctgcatcag

SEQ ID NO: 2168154 - DNA, 19 bp, Homo sapiens
gcccagagctgggtgagtg

SEQ ID NO: 2168155 - DNA, 12 bp, Homo sapiens
gcccagcagagc

SEQ ID NO: 2168156 - DNA, 21 bp, Homo sapiens
gcccagcagagccgttcctgg

SEQ ID NO: 2168157 - DNA, 22 bp, Homo sapiens
gcccagcagagccgttcctggg

SEQ ID NO: 2168158 - DNA, 19 bp, Homo sapiens
gcccagcagtttcccagaa

SEQ ID NO: 2168159 - DNA, 13 bp, Homo sapiens
gcccagctgctct

SEQ ID NO: 2168160 - DNA, 18 bp, Homo sapiens
gcccagctgctctgccca

SEQ ID NO: 2168161 - DNA, 20 bp, Homo sapiens
gcccagctgctctgcccaga

SEQ ID NO: 2168162 - DNA, 21 bp, Homo sapiens
gcccagctgctctgcccagag

SEQ ID NO: 2168163 - DNA, 23 bp, Homo sapiens
gcccagctgctctgcccagagct

SEQ ID NO: 2168164 - DNA, 20 bp, Homo sapiens
gcccagctggggcccctcgg

SEQ ID NO: 2168165 - DNA, 23 bp, Homo sapiens
gcccagctggggcccctcggcta

SEQ ID NO: 2168166 - DNA, 20 bp, Homo sapiens
gcccatcttgcctccatggt

SEQ ID NO: 2168167 - DNA, 21 bp, Homo sapiens
gcccatcttgcctccatggtg

SEQ ID NO: 2168168 - DNA, 17 bp, Homo sapiens
gccccaagaaggctggg

SEQ ID NO: 2168169 - DNA, 11 bp, Homo sapiens
gccccacctgc

SEQ ID NO: 2168170 - DNA, 20 bp, Homo sapiens
gccccacctgccactaggct

SEQ ID NO: 2168171 - DNA, 14 bp, Homo sapiens
gccccagaggccct

SEQ ID NO: 2168172 - DNA, 17 bp, Homo sapiens
gccccagaggccctgga

SEQ ID NO: 2168173 - DNA, 21 bp, Homo sapiens
gccccagatgcctcctctgtc

SEQ ID NO: 2168174 - DNA, 18 bp, Homo sapiens
gcccccagctgctcctcg

SEQ ID NO: 2168175 - DNA, 15 bp, Homo sapiens
gcccccgccctctgc

SEQ ID NO: 2168176 - DNA, 16 bp, Homo sapiens
gcccccgccctctgcc

SEQ ID NO: 2168177 - DNA, 14 bp, Homo sapiens
gccccctgtccttc

SEQ ID NO: 2168178 - DNA, 21 bp, Homo sapiens
gccccctgtccttcccacggc

SEQ ID NO: 2168179 - DNA, 15 bp, Homo sapiens
gccccgtagagaatg

SEQ ID NO: 2168180 - DNA, 20 bp, Homo sapiens
gccccgtctcctgagggtcc

SEQ ID NO: 2168181 - DNA, 21 bp, Homo sapiens
gcccctcggctaccccccgtc

SEQ ID NO: 2168182 - DNA, 13 bp, Homo sapiens
gcccctggtggca

SEQ ID NO: 2168183 - DNA, 19 bp, Homo sapiens
gcccgcatgcagcagcttg

SEQ ID NO: 2168184 - DNA, 19 bp, Homo sapiens
gcccggaagttgctgtgcc

SEQ ID NO: 2168185 - DNA, 18 bp, Homo sapiens
gccctccactgccctctg

SEQ ID NO: 2168186 - DNA, 14 bp, Homo sapiens
gccctcccatcccg

SEQ ID NO: 2168187 - DNA, 21 bp, Homo sapiens
gccctccctcctgcctgcgca

SEQ ID NO: 2168188 - DNA, 21 bp, Homo sapiens
gccctctatttattagccaac

SEQ ID NO: 2168189 - DNA, 13 bp, Homo sapiens
gccctctctcagt

SEQ ID NO: 2168190 - DNA, 13 bp, Homo sapiens
gccctctgaggct

SEQ ID NO: 2168191 - DNA, 20 bp, Homo sapiens
gccctctgaggctcagccct

SEQ ID NO: 2168192 - DNA, 20 bp, Homo sapiens
gccctctgcccccagctgct

SEQ ID NO: 2168193 - DNA, 21 bp, Homo sapiens
gccctctgcccccagctgctc

SEQ ID NO: 2168194 - DNA, 23 bp, Homo sapiens
gccctctgcccccagctgctcct

SEQ ID NO: 2168195 - DNA, 20 bp, Homo sapiens
gccctctggggctcagccct

SEQ ID NO: 2168196 - DNA, 21 bp, Homo sapiens
gccctgagctggcctcacctg

SEQ ID NO: 2168197 - DNA, 21 bp, Homo sapiens
gccctgagctggcgtcacctg

SEQ ID NO: 2168198 - DNA, 23 bp, Homo sapiens
gccctgagttggcatcacctgcg

SEQ ID NO: 2168199 - DNA, 15 bp, Homo sapiens
gccctgcctctgttt

SEQ ID NO: 2168200 - DNA, 20 bp, Homo sapiens
gccctggaggtctccagggg

SEQ ID NO: 2168201 - DNA, 15 bp, Homo sapiens
gccctggagtcatgc

SEQ ID NO: 2168202 - DNA, 20 bp, Homo sapiens
gccctggcacccccacaagc

SEQ ID NO: 2168203 - DNA, 20 bp, Homo sapiens
gcccttacacttactgttgt

SEQ ID NO: 2168204 - DNA, 15 bp, Homo sapiens
gcccttgctgggtcc

SEQ ID NO: 2168205 - DNA, 13 bp, Homo sapiens
gcccttttctggc

SEQ ID NO: 2168206 - DNA, 18 bp, Homo sapiens
gccgagatcggggtggca

SEQ ID NO: 2168207 - DNA, 16 bp, Homo sapiens
gccgaggagcgcccgg

SEQ ID NO: 2168208 - DNA, 16 bp, Homo sapiens
gccgatgagctggttt

SEQ ID NO: 2168209 - DNA, 21 bp, Homo sapiens
gccgcactagcctccctctcc

SEQ ID NO: 2168210 - DNA, 16 bp, Homo sapiens
gccgccacggcctggc

SEQ ID NO: 2168211 - DNA, 15 bp, Homo sapiens
gccgcccacctgcat

SEQ ID NO: 2168212 - DNA, 16 bp, Homo sapiens
gccgcctagtgcagag

SEQ ID NO: 2168213 - DNA, 18 bp, Homo sapiens
gccgcctagtgcagagag

SEQ ID NO: 2168214 - DNA, 12 bp, Homo sapiens
gccgctgggaga

SEQ ID NO: 2168215 - DNA, 14 bp, Homo sapiens
gccgctgggagagc

SEQ ID NO: 2168216 - DNA, 14 bp, Homo sapiens
gccggatcttggag

SEQ ID NO: 2168217 - DNA, 20 bp, Homo sapiens
gccgggaccaccctgagccg

SEQ ID NO: 2168218 - DNA, 22 bp, Homo sapiens
gccgggaccaccctgagccggc

SEQ ID NO: 2168219 - DNA, 13 bp, Homo sapiens
gccgggcacagct

SEQ ID NO: 2168220 - DNA, 22 bp, Homo sapiens
gccgggggtgggggcctgctgt

SEQ ID NO: 2168221 - DNA, 20 bp, Homo sapiens
gccgggttggaggcctcacc

SEQ ID NO: 2168222 - DNA, 24 bp, Homo sapiens
gccgggttggaggcctcaccctgc

SEQ ID NO: 2168223 - DNA, 11 bp, Homo sapiens
gccgtgagagc

SEQ ID NO: 2168224 - DNA, 23 bp, Homo sapiens
gccgtgagagcccaatcactgcc

SEQ ID NO: 2168225 - DNA, 12 bp, Homo sapiens
gccgttcctggg

SEQ ID NO: 2168226 - DNA, 13 bp, Homo sapiens
gcctaccatttca

SEQ ID NO: 2168227 - DNA, 18 bp, Homo sapiens
gcctatgccacctgcagc

SEQ ID NO: 2168228 - DNA, 18 bp, Homo sapiens
gcctatttattcattcag

SEQ ID NO: 2168229 - DNA, 17 bp, Homo sapiens
gcctcaataagccttgt

SEQ ID NO: 2168230 - DNA, 12 bp, Homo sapiens
gcctcaccctgc

SEQ ID NO: 2168231 - DNA, 14 bp, Homo sapiens
gcctcaccctgctt

SEQ ID NO: 2168232 - DNA, 23 bp, Homo sapiens
gcctcaccctgcttggggcctgg

SEQ ID NO: 2168233 - DNA, 15 bp, Homo sapiens
gcctcacctttccca

SEQ ID NO: 2168234 - DNA, 13 bp, Homo sapiens
gcctcaggctctg

SEQ ID NO: 2168235 - DNA, 15 bp, Homo sapiens
gcctcaggctctgca

SEQ ID NO: 2168236 - DNA, 19 bp, Homo sapiens
gcctccatggtgcctctgg

SEQ ID NO: 2168237 - DNA, 16 bp, Homo sapiens
gcctccctcccctgcc

SEQ ID NO: 2168238 - DNA, 18 bp, Homo sapiens
gcctccctcccctgccct

SEQ ID NO: 2168239 - DNA, 19 bp, Homo sapiens
gcctccctctcctctgtcc

SEQ ID NO: 2168240 - DNA, 19 bp, Homo sapiens
gcctccctgaccctgcaga

SEQ ID NO: 2168241 - DNA, 13 bp, Homo sapiens
gcctccctgtcca

SEQ ID NO: 2168242 - DNA, 13 bp, Homo sapiens
gcctcctctgtcc

SEQ ID NO: 2168243 - DNA, 19 bp, Homo sapiens
gcctcgaactcctgggctc

SEQ ID NO: 2168244 - DNA, 21 bp, Homo sapiens
gcctcgaactcctgggctcaa

SEQ ID NO: 2168245 - DNA, 13 bp, Homo sapiens
gcctcgctccctt

SEQ ID NO: 2168246 - DNA, 16 bp, Homo sapiens
gcctcgtgaggggcaa

SEQ ID NO: 2168247 - DNA, 19 bp, Homo sapiens
gcctcgtgaggggcaagct

SEQ ID NO: 2168248 - DNA, 12 bp, Homo sapiens
gcctctcatccc

SEQ ID NO: 2168249 - DNA, 20 bp, Homo sapiens
gcctctggaggcctctgggc

SEQ ID NO: 2168250 - DNA, 17 bp, Homo sapiens
gcctctgtttgacaaac

SEQ ID NO: 2168251 - DNA, 13 bp, Homo sapiens
gcctcttgaccag

SEQ ID NO: 2168252 - DNA, 22 bp, Homo sapiens
gcctgacttttacagcttttct

SEQ ID NO: 2168253 - DNA, 20 bp, Homo sapiens
gcctgatttaggcactgctt

SEQ ID NO: 2168254 - DNA, 17 bp, Homo sapiens
gcctgcctagcactcac

SEQ ID NO: 2168255 - DNA, 15 bp, Homo sapiens
gcctgcgcagctcct

SEQ ID NO: 2168256 - DNA, 22 bp, Homo sapiens
gcctgcggctgctggcacagac

SEQ ID NO: 2168257 - DNA, 15 bp, Homo sapiens
gcctggagctcctgg

SEQ ID NO: 2168258 - DNA, 16 bp, Homo sapiens
gcctggagctcctggg

SEQ ID NO: 2168259 - DNA, 21 bp, Homo sapiens
gcctggatgagaaacagctca

SEQ ID NO: 2168260 - DNA, 17 bp, Homo sapiens
ggagagaatgagagagt

SEQ ID NO: 2168261 - DNA, 18 bp, Homo sapiens
ggagagaatgagagagtg

SEQ ID NO: 2168262 - DNA, 19 bp, Homo sapiens
ggagagaatgagagagtgt

SEQ ID NO: 2168263 - DNA, 15 bp, Homo sapiens
ggagagagaccccgc

SEQ ID NO: 2168264 - DNA, 13 bp, Homo sapiens
ggagaggagagaa

SEQ ID NO: 2168265 - DNA, 16 bp, Homo sapiens
ggagaggcagagtgcc

SEQ ID NO: 2168266 - DNA, 18 bp, Homo sapiens
ggagaggctctgaaagct

SEQ ID NO: 2168267 - DNA, 17 bp, Homo sapiens
ggagagggagcaagcct

SEQ ID NO: 2168268 - DNA, 19 bp, Homo sapiens
ggagatcggggccagaggc

SEQ ID NO: 2168269 - DNA, 14 bp, Homo sapiens
ggagcaaagcagca

SEQ ID NO: 2168270 - DNA, 12 bp, Homo sapiens
ggagcagagaag

SEQ ID NO: 2168271 - DNA, 16 bp, Homo sapiens
ggagcagagaaggcca

SEQ ID NO: 2168272 - DNA, 23 bp, Homo sapiens
ggagcaggttccccaagggccct

SEQ ID NO: 2168273 - DNA, 14 bp, Homo sapiens
ggagccacaggcag

SEQ ID NO: 2168274 - DNA, 21 bp, Homo sapiens
ggagccagaattcactaggag

SEQ ID NO: 2168275 - DNA, 11 bp, Homo sapiens
ggagctcctgg

SEQ ID NO: 2168276 - DNA, 18 bp, Homo sapiens
ggaggaatcttttactgt

SEQ ID NO: 2168277 - DNA, 15 bp, Homo sapiens
ggaggacctctgggc

SEQ ID NO: 2168278 - DNA, 14 bp, Homo sapiens
ggaggagagagacc

SEQ ID NO: 2168279 - DNA, 22 bp, Homo sapiens
ggaggagattaacacactgaac

SEQ ID NO: 2168280 - DNA, 19 bp, Homo sapiens
ggaggcaggtcccgagccc

SEQ ID NO: 2168281 - DNA, 22 bp, Homo sapiens
ggaggcaggtcccgagccccct

SEQ ID NO: 2168282 - DNA, 19 bp, Homo sapiens
cttcctccctccctgcagg

SEQ ID NO: 2168283 - DNA, 15 bp, Homo sapiens
cttcctgtctggccc

SEQ ID NO: 2168284 - DNA, 20 bp, Homo sapiens
cttccttcaaatcctgccac

SEQ ID NO: 2168285 - DNA, 17 bp, Homo sapiens
cttcgctttcctgagcc

SEQ ID NO: 2168286 - DNA, 14 bp, Homo sapiens
cttcggaggtggca

SEQ ID NO: 2168287 - DNA, 21 bp, Homo sapiens
cttcgtgggatctgcccctcc

SEQ ID NO: 2168288 - DNA, 21 bp, Homo sapiens
cttctaatccatgtgctgctg

SEQ ID NO: 2168289 - DNA, 17 bp, Homo sapiens
cttctcaagcactgaca

SEQ ID NO: 2168290 - DNA, 18 bp, Homo sapiens
cttctccttccaactgct

SEQ ID NO: 2168291 - DNA, 21 bp, Homo sapiens
cttctctcttcaatctctgga

SEQ ID NO: 2168292 - DNA, 16 bp, Homo sapiens
cttctgcacaaagatg

SEQ ID NO: 2168293 - DNA, 18 bp, Homo sapiens
cttctgcttccaacaggc

SEQ ID NO: 2168294 - DNA, 16 bp, Homo sapiens
cttctgcttgtcatcc

SEQ ID NO: 2168295 - DNA, 22 bp, Homo sapiens
cttctgggaaggggtttctaac

SEQ ID NO: 2168296 - DNA, 18 bp, Homo sapiens
cttctgggcaaggtgagg

SEQ ID NO: 2168297 - DNA, 18 bp, Homo sapiens
cttctgtagctattcttt

SEQ ID NO: 2168298 - DNA, 14 bp, Homo sapiens
cttctgtgcccagc

SEQ ID NO: 2168299 - DNA, 16 bp, Homo sapiens
cttctgtgcccagctc

SEQ ID NO: 2168300 - DNA, 17 bp, Homo sapiens
cttctgtgcccagctca

SEQ ID NO: 2168301 - DNA, 19 bp, Homo sapiens
cttcttcggaggtggcagc

SEQ ID NO: 2168302 - DNA, 22 bp, Homo sapiens
cttcttctgaagatcagaacat

SEQ ID NO: 2168303 - DNA, 21 bp, Homo sapiens
cttcttttgaccccttcctgt

SEQ ID NO: 2168304 - DNA, 22 bp, Homo sapiens
cttcttttgaccccttcctgtc

SEQ ID NO: 2168305 - DNA, 16 bp, Homo sapiens
cttgaaaagattgcaa

SEQ ID NO: 2168306 - DNA, 18 bp, Homo sapiens
cttgaaaagattgcaaag

SEQ ID NO: 2168307 - DNA, 20 bp, Homo sapiens
cttgaaacttggttcccaga

SEQ ID NO: 2168308 - DNA, 17 bp, Homo sapiens
cttgaaagaaaggggca

SEQ ID NO: 2168309 - DNA, 14 bp, Homo sapiens
cttgaactcctgac

SEQ ID NO: 2168310 - DNA, 17 bp, Homo sapiens
cttgaactcctgacctc

SEQ ID NO: 2168311 - DNA, 13 bp, Homo sapiens
cttgaccaggctg

SEQ ID NO: 2168312 - DNA, 22 bp, Homo sapiens
cttgagaccaagccggtgccca

SEQ ID NO: 2168313 - DNA, 14 bp, Homo sapiens
cttgagagcgctgg

SEQ ID NO: 2168314 - DNA, 18 bp, Homo sapiens
cttgagagcgctggcctc

SEQ ID NO: 2168315 - DNA, 12 bp, Homo sapiens
cttgagtttgtt

SEQ ID NO: 2168316 - DNA, 16 bp, Homo sapiens
cttgagtttgtttctt

SEQ ID NO: 2168317 - DNA, 22 bp, Homo sapiens
cttgatgaatttggtctgcctc

SEQ ID NO: 2168318 - DNA, 20 bp, Homo sapiens
cttgcaatgaaaagaaaatg

SEQ ID NO: 2168319 - DNA, 17 bp, Homo sapiens
cttgcactattggactt

SEQ ID NO: 2168320 - DNA, 13 bp, Homo sapiens
cttgcagagaagc

SEQ ID NO: 2168321 - DNA, 12 bp, Homo sapiens
cttgccaaggcc

SEQ ID NO: 2168322 - DNA, 22 bp, Homo sapiens
cttgccccagatgcctcctctg

SEQ ID NO: 2168323 - DNA, 20 bp, Homo sapiens
cttgcctccatggtgcctct

SEQ ID NO: 2168324 - DNA, 21 bp, Homo sapiens
cttgcctccatggtgcctctg

SEQ ID NO: 2168325 - DNA, 18 bp, Homo sapiens
cttgctggagagtggcat

SEQ ID NO: 2168326 - DNA, 20 bp, Homo sapiens
cttgctggagagtggcatca

SEQ ID NO: 2168327 - DNA, 12 bp, Homo sapiens
cttgctggtgca

SEQ ID NO: 2168328 - DNA, 15 bp, Homo sapiens
cttgctttcggagct

SEQ ID NO: 2168329 - DNA, 19 bp, Homo sapiens
cttttgtagtatactttca

SEQ ID NO: 2168330 - DNA, 19 bp, Homo sapiens
cttttgtgggtttctctgt

SEQ ID NO: 2168331 - DNA, 20 bp, Homo sapiens
cttttgtgggtttctctgtg

SEQ ID NO: 2168332 - DNA, 22 bp, Homo sapiens
ctttttaacatagtaacgtgtt

SEQ ID NO: 2168333 - DNA, 14 bp, Homo sapiens
ctttttcacgttta

SEQ ID NO: 2168334 - DNA, 14 bp, Homo sapiens
ctttttctgtctct

SEQ ID NO: 2168335 - DNA, 16 bp, Homo sapiens
ctttttctgtctctct

SEQ ID NO: 2168336 - DNA, 12 bp, Homo sapiens
ctttttcttgta

SEQ ID NO: 2168337 - DNA, 17 bp, Homo sapiens
ctttttgaccagtttct

SEQ ID NO: 2168338 - DNA, 19 bp, Homo sapiens
ctttttgaccagtttcttt

SEQ ID NO: 2168339 - DNA, 20 bp, Homo sapiens
cttttttggaaactgttggt

SEQ ID NO: 2168340 - DNA, 18 bp, Homo sapiens
ctttttttttgttttgtt

SEQ ID NO: 2168341 - DNA, 14 bp, Homo sapiens
gaaaaacatgtcat

SEQ ID NO: 2168342 - DNA, 15 bp, Homo sapiens
gaaaaacatgtcatg

SEQ ID NO: 2168343 - DNA, 23 bp, Homo sapiens
gaaaaactaaactacagaaacct

SEQ ID NO: 2168344 - DNA, 18 bp, Homo sapiens
gaaaaattaagttgttga

SEQ ID NO: 2168345 - DNA, 23 bp, Homo sapiens
gaaaacagaggccacactttctg

SEQ ID NO: 2168346 - DNA, 15 bp, Homo sapiens
gaaaagctgttccca

SEQ ID NO: 2168347 - DNA, 21 bp, Homo sapiens
gaaaagtatggcagtgggaga

SEQ ID NO: 2168348 - DNA, 17 bp, Homo sapiens
gaaaatatcactttgta

SEQ ID NO: 2168349 - DNA, 15 bp, Homo sapiens
gaaaatgtccaggaa

SEQ ID NO: 2168350 - DNA, 12 bp, Homo sapiens
gaaaattgccaa

SEQ ID NO: 2168351 - DNA, 15 bp, Homo sapiens
gaaacagctcagcca

SEQ ID NO: 2168352 - DNA, 18 bp, Homo sapiens
gaaaccatttttaatgag

SEQ ID NO: 2168353 - DNA, 20 bp, Homo sapiens
gaaactatgcacctataaat

SEQ ID NO: 2168354 - DNA, 21 bp, Homo sapiens
gaaactatgcacctataaata

SEQ ID NO: 2168355 - DNA, 24 bp, Homo sapiens
gaaactatgcacctataaatacta

SEQ ID NO: 2168356 - DNA, 17 bp, Homo sapiens
gaaactgctaattacac

SEQ ID NO: 2168357 - DNA, 19 bp, Homo sapiens
gaaacttaaatgttattat

SEQ ID NO: 2168358 - DNA, 17 bp, Homo sapiens
gaaacttcaagcaccag

SEQ ID NO: 2168359 - DNA, 15 bp, Homo sapiens
gaaagaaaagacaaa

SEQ ID NO: 2168360 - DNA, 13 bp, Homo sapiens
gaaagaagcaaga

SEQ ID NO: 2168361 - DNA, 14 bp, Homo sapiens
gaaagaagggggcc

SEQ ID NO: 2168362 - DNA, 17 bp, Homo sapiens
gaaagactttctaaatc

SEQ ID NO: 2168363 - DNA, 14 bp, Homo sapiens
gaaagagagaagcc

SEQ ID NO: 2168364 - DNA, 15 bp, Homo sapiens
gaaagagagaagcca

SEQ ID NO: 2168365 - DNA, 19 bp, Homo sapiens
gaaagagagaagccagcca

SEQ ID NO: 2168366 - DNA, 14 bp, Homo sapiens
gaaagagctgcctg

SEQ ID NO: 2168367 - DNA, 16 bp, Homo sapiens
gaaagagctgcctgga

SEQ ID NO: 2168368 - DNA, 21 bp, Homo sapiens
gacaaaccactgtacatatat

SEQ ID NO: 2168369 - DNA, 13 bp, Homo sapiens
gacaaatgggact

SEQ ID NO: 2168370 - DNA, 17 bp, Homo sapiens
gacaaatgggactgatg

SEQ ID NO: 2168371 - DNA, 21 bp, Homo sapiens
gacaaatgggactgatgtcat

SEQ ID NO: 2168372 - DNA, 23 bp, Homo sapiens
gacaaatgggactgatgtcatct

SEQ ID NO: 2168373 - DNA, 14 bp, Homo sapiens
gacaagcagccctt

SEQ ID NO: 2168374 - DNA, 21 bp, Homo sapiens
gacaaggtagacatggatttg

SEQ ID NO: 2168375 - DNA, 12 bp, Homo sapiens
gacaataaataa

SEQ ID NO: 2168376 - DNA, 13 bp, Homo sapiens
gacacacacagct

SEQ ID NO: 2168377 - DNA, 22 bp, Homo sapiens
gacacagagtggagccctcagt

SEQ ID NO: 2168378 - DNA, 19 bp, Homo sapiens
gacacagctgagctggcct

SEQ ID NO: 2168379 - DNA, 11 bp, Homo sapiens
gacacctcaga

SEQ ID NO: 2168380 - DNA, 17 bp, Homo sapiens
gacacgtggcctcgtga

SEQ ID NO: 2168381 - DNA, 23 bp, Homo sapiens
gacacgtggcctcgtgaggggca

SEQ ID NO: 2168382 - DNA, 20 bp, Homo sapiens
gacactggatccagaagcta

SEQ ID NO: 2168383 - DNA, 23 bp, Homo sapiens
gacagatgttccatcctgtacaa

SEQ ID NO: 2168384 - DNA, 21 bp, Homo sapiens
gacagcagtttgagcttgctg

SEQ ID NO: 2168385 - DNA, 18 bp, Homo sapiens
gacagccggatcttggag

SEQ ID NO: 2168386 - DNA, 22 bp, Homo sapiens
gacagcgggtaaaaagagaagg

SEQ ID NO: 2168387 - DNA, 14 bp, Homo sapiens
gacagcggttgtaa

SEQ ID NO: 2168388 - DNA, 11 bp, Homo sapiens
gacagctgcag

SEQ ID NO: 2168389 - DNA, 17 bp, Homo sapiens
gacagctgcaggtgccc

SEQ ID NO: 2168390 - DNA, 18 bp, Homo sapiens
gacagctgcaggtgccca

SEQ ID NO: 2168391 - DNA, 11 bp, Homo sapiens
gacaggaccct

SEQ ID NO: 2168392 - DNA, 12 bp, Homo sapiens
gacaggaccctc

SEQ ID NO: 2168393 - DNA, 14 bp, Homo sapiens
gacaggacctagga

SEQ ID NO: 2168394 - DNA, 15 bp, Homo sapiens
gacagggtcctgcta

SEQ ID NO: 2168395 - DNA, 19 bp, Homo sapiens
gacagggtctccctatgtt

SEQ ID NO: 2168396 - DNA, 24 bp, Homo sapiens
gacagggtctccctatgttgccca

SEQ ID NO: 2168397 - DNA, 15 bp, Homo sapiens
gacatattcccatgg

SEQ ID NO: 2168398 - DNA, 18 bp, Homo sapiens
gacatcaagatacacttg

SEQ ID NO: 2168399 - DNA, 16 bp, Homo sapiens
gacatgaacaatgtgt

SEQ ID NO: 2168400 - DNA, 14 bp, Homo sapiens
gacattaattatct

SEQ ID NO: 2168401 - DNA, 20 bp, Homo sapiens
gacattgaagtgtttaaaag

SEQ ID NO: 2168402 - DNA, 19 bp, Homo sapiens
gacatttgtcctgcagagc

SEQ ID NO: 2168403 - DNA, 13 bp, Homo sapiens
gaccaaacctagc

SEQ ID NO: 2168404 - DNA, 13 bp, Homo sapiens
gaccaaactgtgg

SEQ ID NO: 2168405 - DNA, 14 bp, Homo sapiens
gaccaatgtgaaga

SEQ ID NO: 2168406 - DNA, 14 bp, Homo sapiens
gaccaccctgagcc

SEQ ID NO: 2168407 - DNA, 17 bp, Homo sapiens
gaccacttgatatgact

SEQ ID NO: 2168408 - DNA, 14 bp, Homo sapiens
gaccagagctctgg

SEQ ID NO: 2168409 - DNA, 23 bp, Homo sapiens
gaccagaggtgggaggcccctgg

SEQ ID NO: 2168410 - DNA, 18 bp, Homo sapiens
gaccagcactgaccccga

SEQ ID NO: 2168411 - DNA, 19 bp, Homo sapiens
gaccagctgctccgaggac

SEQ ID NO: 2168412 - DNA, 15 bp, Homo sapiens
gaccaggctgcctcc

SEQ ID NO: 2168413 - DNA, 11 bp, Homo sapiens
gacccctcctc

SEQ ID NO: 2168414 - DNA, 12 bp, Homo sapiens
gacccctcctcc

SEQ ID NO: 2168415 - DNA, 16 bp, Homo sapiens
gaccccttcctgtctg

SEQ ID NO: 2168416 - DNA, 17 bp, Homo sapiens
gaccccttcctgtctgg

SEQ ID NO: 2168417 - DNA, 14 bp, Homo sapiens
gaccggaagctcct

SEQ ID NO: 2168418 - DNA, 22 bp, Homo sapiens
gacctaaaatttgccctcccat

SEQ ID NO: 2168419 - DNA, 20 bp, Homo sapiens
gacctaggatatcttctcca

SEQ ID NO: 2168420 - DNA, 22 bp, Homo sapiens
gacctcagtttctgttgtttct

SEQ ID NO: 2168421 - DNA, 16 bp, Homo sapiens
gacctccttagaaaag

SEQ ID NO: 2168422 - DNA, 11 bp, Homo sapiens
gacctctgggc

SEQ ID NO: 2168423 - DNA, 13 bp, Homo sapiens
gacctctgggctt

SEQ ID NO: 2168424 - DNA, 15 bp, Homo sapiens
gacctgactcaggca

SEQ ID NO: 2168425 - DNA, 17 bp, Homo sapiens
gacctgcccctgccgcc

SEQ ID NO: 2168426 - DNA, 19 bp, Homo sapiens
gacctggggtggggaggca

SEQ ID NO: 2168427 - DNA, 21 bp, Homo sapiens
gacctggggtggggaggcaga

SEQ ID NO: 2168428 - DNA, 19 bp, Homo sapiens
gaccttgatgtcttgagag

SEQ ID NO: 2168429 - DNA, 14 bp, Homo sapiens
gaccttgattgcac

SEQ ID NO: 2168430 - DNA, 14 bp, Homo sapiens
gacgaggctgggcc

SEQ ID NO: 2168431 - DNA, 18 bp, Homo sapiens
gacgggggttggggtggg

SEQ ID NO: 2168432 - DNA, 19 bp, Homo sapiens
gacgggggttggggtgggg

SEQ ID NO: 2168433 - DNA, 13 bp, Homo sapiens
gactaacctttgt

SEQ ID NO: 2168434 - DNA, 20 bp, Homo sapiens
gactacaggtgagtgccacc

SEQ ID NO: 2168435 - DNA, 12 bp, Homo sapiens
gactacaggtgc

SEQ ID NO: 2168436 - DNA, 18 bp, Homo sapiens
gactcattaatttctctc

SEQ ID NO: 2168437 - DNA, 16 bp, Homo sapiens
gactcccaaagagctg

SEQ ID NO: 2168438 - DNA, 18 bp, Homo sapiens
gactcccaaagagctgcc

SEQ ID NO: 2168439 - DNA, 17 bp, Homo sapiens
gactcctgattgctctg

SEQ ID NO: 2168440 - DNA, 13 bp, Homo sapiens
gactcctgctggt

SEQ ID NO: 2168441 - DNA, 20 bp, Homo sapiens
gactcggccccgtctcctga

SEQ ID NO: 2168442 - DNA, 17 bp, Homo sapiens
gactctcctgcctcagc

SEQ ID NO: 2168443 - DNA, 16 bp, Homo sapiens
gactgacctgcccctg

SEQ ID NO: 2168444 - DNA, 14 bp, Homo sapiens
gactgagtgggaag

SEQ ID NO: 2168445 - DNA, 17 bp, Homo sapiens
gactgagtgggaagccc

SEQ ID NO: 2168446 - DNA, 17 bp, Homo sapiens
gactgatgtcatcttga

SEQ ID NO: 2168447 - DNA, 23 bp, Homo sapiens
gactgatgttaggctgggcccag

SEQ ID NO: 2168448 - DNA, 14 bp, Homo sapiens
gactgccaagccag

SEQ ID NO: 2168449 - DNA, 13 bp, Homo sapiens
gactggacagcgg

SEQ ID NO: 2168450 - DNA, 21 bp, Homo sapiens
gactggacagcggttgtaaat

SEQ ID NO: 2168451 - DNA, 16 bp, Homo sapiens
gactggagacaatgca

SEQ ID NO: 2168452 - DNA, 19 bp, Homo sapiens
gactggctttgtcccacag

SEQ ID NO: 2168453 - DNA, 21 bp, Homo sapiens
gactggctttgtcccacagct

SEQ ID NO: 2168454 - DNA, 17 bp, Homo sapiens
gactgtgatttatttgg

SEQ ID NO: 2168455 - DNA, 15 bp, Homo sapiens
gacttaagacaaatg

SEQ ID NO: 2168456 - DNA, 18 bp, Homo sapiens
gacttggccgcttcccta

SEQ ID NO: 2168457 - DNA, 15 bp, Homo sapiens
gacttgtgcctcttg

SEQ ID NO: 2168458 - DNA, 17 bp, Homo sapiens
gagaaacagctcagcca

SEQ ID NO: 2168459 - DNA, 13 bp, Homo sapiens
gagaaagagagaa

SEQ ID NO: 2168460 - DNA, 21 bp, Homo sapiens
gagaaatttgtggttgcatgt

SEQ ID NO: 2168461 - DNA, 20 bp, Homo sapiens
gagaactagtggtggctctg

SEQ ID NO: 2168462 - DNA, 22 bp, Homo sapiens
gagaactagtggtggctctgag

SEQ ID NO: 2168463 - DNA, 19 bp, Homo sapiens
gtagcttctgacctcagca

SEQ ID NO: 2168464 - DNA, 17 bp, Homo sapiens
gtaggagggtgggaagg

SEQ ID NO: 2168465 - DNA, 16 bp, Homo sapiens
gtaggcaaggctgccg

SEQ ID NO: 2168466 - DNA, 17 bp, Homo sapiens
gtaggcaaggctgccgg

SEQ ID NO: 2168467 - DNA, 21 bp, Homo sapiens
gtaggcaaggctgccggctgc

SEQ ID NO: 2168468 - DNA, 17 bp, Homo sapiens
gtaggctcaactaggga

SEQ ID NO: 2168469 - DNA, 16 bp, Homo sapiens
gtaggttctgaacagc

SEQ ID NO: 2168470 - DNA, 15 bp, Homo sapiens
gtaggttgtctaaaa

SEQ ID NO: 2168471 - DNA, 17 bp, Homo sapiens
gtagtggaaatgagtga

SEQ ID NO: 2168472 - DNA, 20 bp, Homo sapiens
gtagttgagacgctgttgca

SEQ ID NO: 2168473 - DNA, 22 bp, Homo sapiens
gtagttgagacgctgttgcaaa

SEQ ID NO: 2168474 - DNA, 17 bp, Homo sapiens
gtagtttgctttgcttt

SEQ ID NO: 2168475 - DNA, 11 bp, Homo sapiens
gtatataaatg

SEQ ID NO: 2168476 - DNA, 22 bp, Homo sapiens
gtatattactgatttacaagac

SEQ ID NO: 2168477 - DNA, 23 bp, Homo sapiens
gtatattcaaaaattatattttg

SEQ ID NO: 2168478 - DNA, 24 bp, Homo sapiens
gtatattcaaaaattatattttga

SEQ ID NO: 2168479 - DNA, 15 bp, Homo sapiens
gtatcacctttccca

SEQ ID NO: 2168480 - DNA, 19 bp, Homo sapiens
gtatcagaaatgaaacaga

SEQ ID NO: 2168481 - DNA, 16 bp, Homo sapiens
gtatgtacttccagta

SEQ ID NO: 2168482 - DNA, 13 bp, Homo sapiens
gtatgtgtagtgt

SEQ ID NO: 2168483 - DNA, 17 bp, Homo sapiens
gtattaaacctttccat

SEQ ID NO: 2168484 - DNA, 16 bp, Homo sapiens
gtattagtagagcaac

SEQ ID NO: 2168485 - DNA, 20 bp, Homo sapiens
gtattctctgtccagggctt

SEQ ID NO: 2168486 - DNA, 13 bp, Homo sapiens
gtattttaaaata

SEQ ID NO: 2168487 - DNA, 13 bp, Homo sapiens
gtatttttcttga

SEQ ID NO: 2168488 - DNA, 21 bp, Homo sapiens
gtcaacctgcttttttctgtt

SEQ ID NO: 2168489 - DNA, 21 bp, Homo sapiens
gtcaaccttgtgtgagtgtga

SEQ ID NO: 2168490 - DNA, 14 bp, Homo sapiens
gtcaatgtttgctt

SEQ ID NO: 2168491 - DNA, 14 bp, Homo sapiens
gtcacaatttcaga

SEQ ID NO: 2168492 - DNA, 14 bp, Homo sapiens
gtcacacatttcta

SEQ ID NO: 2168493 - DNA, 14 bp, Homo sapiens
gtcacagaggcagt

SEQ ID NO: 2168494 - DNA, 15 bp, Homo sapiens
gtcacagaggcagtg

SEQ ID NO: 2168495 - DNA, 19 bp, Homo sapiens
gtcacagaggcagtggcag

SEQ ID NO: 2168496 - DNA, 21 bp, Homo sapiens
gtcacagaggcagtggcagca

SEQ ID NO: 2168497 - DNA, 19 bp, Homo sapiens
gtcacccaggctggagtga

SEQ ID NO: 2168498 - DNA, 22 bp, Homo sapiens
gtcacctgccccgtagagaatg

SEQ ID NO: 2168499 - DNA, 19 bp, Homo sapiens
gtcacctgtgcagggccct

SEQ ID NO: 2168500 - DNA, 12 bp, Homo sapiens
gtcaccttcctc

SEQ ID NO: 2168501 - DNA, 16 bp, Homo sapiens
gtcacgttctggaaca

SEQ ID NO: 2168502 - DNA, 18 bp, Homo sapiens
gtcagtacccacctgagc

SEQ ID NO: 2168503 - DNA, 19 bp, Homo sapiens
gtcagtgtgccaccctctg

SEQ ID NO: 2168504 - DNA, 20 bp, Homo sapiens
gtcatccacacaacaccagg

SEQ ID NO: 2168505 - DNA, 21 bp, Homo sapiens
gtcatccacacaacaccagga

SEQ ID NO: 2168506 - DNA, 22 bp, Homo sapiens
gtcatccacacaacaccaggac

SEQ ID NO: 2168507 - DNA, 13 bp, Homo sapiens
gtcatcttgagct

SEQ ID NO: 2168508 - DNA, 16 bp, Homo sapiens
gtcatgacatttctca

SEQ ID NO: 2168509 - DNA, 19 bp, Homo sapiens
gtcatggctcaaggattca

SEQ ID NO: 2168510 - DNA, 22 bp, Homo sapiens
gtcatggctctgaactgcacaa

SEQ ID NO: 2168511 - DNA, 19 bp, Homo sapiens
gtccaaacccatcttcatg

SEQ ID NO: 2168512 - DNA, 15 bp, Homo sapiens
gtccaagtgtttctt

SEQ ID NO: 2168513 - DNA, 18 bp, Homo sapiens
gtccaggtcgggctcagc

SEQ ID NO: 2168514 - DNA, 19 bp, Homo sapiens
gtccaggtcgggctcagct

SEQ ID NO: 2168515 - DNA, 23 bp, Homo sapiens
gtccaggtcgggctcagctctgg

SEQ ID NO: 2168516 - DNA, 13 bp, Homo sapiens
gtccagttttgtg

SEQ ID NO: 2168517 - DNA, 20 bp, Homo sapiens
gtcccaccatgcagtgcccc

SEQ ID NO: 2168518 - DNA, 19 bp, Homo sapiens
gtcccaccggttgcttctg

SEQ ID NO: 2168519 - DNA, 23 bp, Homo sapiens
gtcccacctcaaatgggtctggg

SEQ ID NO: 2168520 - DNA, 16 bp, Homo sapiens
gtcccagctgaaggca

SEQ ID NO: 2168521 - DNA, 13 bp, Homo sapiens
gtccccagcccac

SEQ ID NO: 2168522 - DNA, 15 bp, Homo sapiens
gtcccgagccccctg

SEQ ID NO: 2168523 - DNA, 19 bp, Homo sapiens
gtcccgagccccctgtcct

SEQ ID NO: 2168524 - DNA, 16 bp, Homo sapiens
gtccctgcagggccat

SEQ ID NO: 2168525 - DNA, 18 bp, Homo sapiens
gtccctgcagggccatct

SEQ ID NO: 2168526 - DNA, 21 bp, Homo sapiens
gtccctgcagggccatctgac

SEQ ID NO: 2168527 - DNA, 15 bp, Homo sapiens
gtccctggccatctc

SEQ ID NO: 2168528 - DNA, 12 bp, Homo sapiens
gtccgccctctt

SEQ ID NO: 2168529 - DNA, 18 bp, Homo sapiens
gtcctaagtccctgcccc

SEQ ID NO: 2168530 - DNA, 19 bp, Homo sapiens
gtcctcaaggggccatcct

SEQ ID NO: 2168531 - DNA, 13 bp, Homo sapiens
gtcctccctgctc

SEQ ID NO: 2168532 - DNA, 14 bp, Homo sapiens
gtcctccctgctca

SEQ ID NO: 2168533 - DNA, 17 bp, Homo sapiens
gtcctccctgctcagct

SEQ ID NO: 2168534 - DNA, 19 bp, Homo sapiens
gtcctgaggcagaacctgg

SEQ ID NO: 2168535 - DNA, 19 bp, Homo sapiens
taaagtatgtattatttac

SEQ ID NO: 2168536 - DNA, 19 bp, Homo sapiens
taaagtcacacatttctat

SEQ ID NO: 2168537 - DNA, 16 bp, Homo sapiens
taaagtgctctattta

SEQ ID NO: 2168538 - DNA, 19 bp, Homo sapiens
taaagtgctctatttatta

SEQ ID NO: 2168539 - DNA, 12 bp, Homo sapiens
taaatacaattc

SEQ ID NO: 2168540 - DNA, 13 bp, Homo sapiens
taaatactgtaca

SEQ ID NO: 2168541 - DNA, 14 bp, Homo sapiens
taaatatgaaattt

SEQ ID NO: 2168542 - DNA, 15 bp, Homo sapiens
taaatatgtgattat

SEQ ID NO: 2168543 - DNA, 21 bp, Homo sapiens
taaatcatgttaatcctagct

SEQ ID NO: 2168544 - DNA, 18 bp, Homo sapiens
taaatggtgagaattaaa

SEQ ID NO: 2168545 - DNA, 16 bp, Homo sapiens
taaatgtcagttgaaa

SEQ ID NO: 2168546 - DNA, 17 bp, Homo sapiens
taaatgtcagttgaaaa

SEQ ID NO: 2168547 - DNA, 23 bp, Homo sapiens
taaatgtgaatggaaacttggaa

SEQ ID NO: 2168548 - DNA, 13 bp, Homo sapiens
taaatgttattat

SEQ ID NO: 2168549 - DNA, 17 bp, Homo sapiens
taaattagtaatgtact

SEQ ID NO: 2168550 - DNA, 23 bp, Homo sapiens
taaattagtgtacctattaaaag

SEQ ID NO: 2168551 - DNA, 21 bp, Homo sapiens
taaattatgaatattaaaggt

SEQ ID NO: 2168552 - DNA, 19 bp, Homo sapiens
taacaaagaagtgtattta

SEQ ID NO: 2168553 - DNA, 20 bp, Homo sapiens
taacaatgcatgctttggaa

SEQ ID NO: 2168554 - DNA, 18 bp, Homo sapiens
taacactagtctgtgtgc

SEQ ID NO: 2168555 - DNA, 13 bp, Homo sapiens
taacagaaattgt

SEQ ID NO: 2168556 - DNA, 22 bp, Homo sapiens
taacaggacttgaattcaaagc

SEQ ID NO: 2168557 - DNA, 23 bp, Homo sapiens
taacagttgtatttaacagaaat

SEQ ID NO: 2168558 - DNA, 21 bp, Homo sapiens
taacatagtaacgtgttactg

SEQ ID NO: 2168559 - DNA, 16 bp, Homo sapiens
taacatatattgttat

SEQ ID NO: 2168560 - DNA, 18 bp, Homo sapiens
taacatggaagggaagaa

SEQ ID NO: 2168561 - DNA, 11 bp, Homo sapiens
taaccaagctg

SEQ ID NO: 2168562 - DNA, 22 bp, Homo sapiens
taaccctttcttcaatacaaaa

SEQ ID NO: 2168563 - DNA, 17 bp, Homo sapiens
taacctcaggttccaaa

SEQ ID NO: 2168564 - DNA, 14 bp, Homo sapiens
taacctttaaaaat

SEQ ID NO: 2168565 - DNA, 21 bp, Homo sapiens
taactagagcagccctggagt

SEQ ID NO: 2168566 - DNA, 19 bp, Homo sapiens
taactctgcccaccctcct

SEQ ID NO: 2168567 - DNA, 16 bp, Homo sapiens
taactgatgaaggatt

SEQ ID NO: 2168568 - DNA, 14 bp, Homo sapiens
taactgcattctat

SEQ ID NO: 2168569 - DNA, 14 bp, Homo sapiens
taactgtatttgaa

SEQ ID NO: 2168570 - DNA, 19 bp, Homo sapiens
taacttcagatacttgtga

SEQ ID NO: 2168571 - DNA, 20 bp, Homo sapiens
taacttcagatacttgtgaa

SEQ ID NO: 2168572 - DNA, 18 bp, Homo sapiens
taactttccttcctcatt

SEQ ID NO: 2168573 - DNA, 16 bp, Homo sapiens
taagaaaaacatgtca

SEQ ID NO: 2168574 - DNA, 18 bp, Homo sapiens
taagaaaaacatgtcatg

SEQ ID NO: 2168575 - DNA, 16 bp, Homo sapiens
taagaattcagacatc

SEQ ID NO: 2168576 - DNA, 14 bp, Homo sapiens
taagacaaatggga

SEQ ID NO: 2168577 - DNA, 16 bp, Homo sapiens
taagacaaatgggact

SEQ ID NO: 2168578 - DNA, 23 bp, Homo sapiens
taagaccggaagctcctggtatg

SEQ ID NO: 2168579 - DNA, 22 bp, Homo sapiens
taagagggagccggtttgggag

SEQ ID NO: 2168580 - DNA, 21 bp, Homo sapiens
taagagtaagcacctttagaa

SEQ ID NO: 2168581 - DNA, 19 bp, Homo sapiens
taagagtcacaatttgcaa

SEQ ID NO: 2168582 - DNA, 19 bp, Homo sapiens
taagcattttctacacagc

SEQ ID NO: 2168583 - DNA, 16 bp, Homo sapiens
taaggacttgtgcctc

SEQ ID NO: 2168584 - DNA, 16 bp, Homo sapiens
taaggcctcttgctgg

SEQ ID NO: 2168585 - DNA, 17 bp, Homo sapiens
taaggcctcttgctggt

SEQ ID NO: 2168586 - DNA, 18 bp, Homo sapiens
taagggggtgaccatgca

SEQ ID NO: 2168587 - DNA, 19 bp, Homo sapiens
taaggtgtgcagtgttttt

SEQ ID NO: 2168588 - DNA, 13 bp, Homo sapiens
taagtaaactgcc

SEQ ID NO: 2168589 - DNA, 22 bp, Homo sapiens
taagtaatttccccactctgag

SEQ ID NO: 2168590 - DNA, 14 bp, Homo sapiens
taagtataaacctt

SEQ ID NO: 2168591 - DNA, 15 bp, Homo sapiens
taagtccctgccccc

SEQ ID NO: 2168592 - DNA, 24 bp, Homo sapiens
taagtggctgtgattaattattga

SEQ ID NO: 2168593 - DNA, 15 bp, Homo sapiens
taagttcgaggtggc

SEQ ID NO: 2168594 - DNA, 15 bp, Homo sapiens
taagtttagaaatta

SEQ ID NO: 2168595 - DNA, 21 bp, Homo sapiens
taagtttagaaattacaagtt

SEQ ID NO: 2168596 - DNA, 14 bp, Homo sapiens
taataaaaatttat

SEQ ID NO: 2168597 - DNA, 14 bp, Homo sapiens
taataaaatacata

SEQ ID NO: 2168598 - DNA, 20 bp, Homo sapiens
taataaaattcattccattt

SEQ ID NO: 2168599 - DNA, 21 bp, Homo sapiens
taataatggttactcatttta

SEQ ID NO: 2168600 - DNA, 20 bp, Homo sapiens
taataccaccaacaaatata

SEQ ID NO: 2168601 - DNA, 15 bp, Homo sapiens
taatacttaaaaata

SEQ ID NO: 2168602 - DNA, 20 bp, Homo sapiens
taatataagtttctttagaa

SEQ ID NO: 2168603 - DNA, 20 bp, Homo sapiens
taatatatcctgaaagcatt

SEQ ID NO: 2168604 - DNA, 14 bp, Homo sapiens
taatcaatactttg

SEQ ID NO: 2168605 - DNA, 20 bp, Homo sapiens
taatcaatactttgaacaca

SEQ ID NO: 2168606 - DNA, 23 bp, Homo sapiens
taatcattttagaattaaaattt

SEQ ID NO: 2168607 - DNA, 14 bp, Homo sapiens
taatccctgctttt

SEQ ID NO: 2168608 - DNA, 17 bp, Homo sapiens
taatccctgctttttgt

SEQ ID NO: 2168609 - DNA, 13 bp, Homo sapiens
taatcttagaaca

SEQ ID NO: 2168610 - DNA, 22 bp, Homo sapiens
taatcttagaacagatggctgt

SEQ ID NO: 2168611 - DNA, 15 bp, Homo sapiens
taatcttataattgt

SEQ ID NO: 2168612 - DNA, 18 bp, Homo sapiens
taatgaaaatagatgcaa

SEQ ID NO: 2168613 - DNA, 23 bp, Homo sapiens
taatgaaaatgatgtagacattt

SEQ ID NO: 2168614 - DNA, 16 bp, Homo sapiens
taatgaatagaataaa

SEQ ID NO: 2168615 - DNA, 19 bp, Homo sapiens
taatgacaattttgagaaa

SEQ ID NO: 2168616 - DNA, 17 bp, Homo sapiens
taatgacgtattgtgaa

SEQ ID NO: 2168617 - DNA, 21 bp, Homo sapiens
taatgacgtattgtgaaattt

SEQ ID NO: 2168618 - DNA, 14 bp, Homo sapiens
taatgacttttaaa

SEQ ID NO: 2168619 - DNA, 19 bp, Homo sapiens
taatgatactgtctaagaa

SEQ ID NO: 2168620 - DNA, 22 bp, Homo sapiens
taatgatcaacaatttaatgta

SEQ ID NO: 2168621 - DNA, 13 bp, Homo sapiens
taatgctggagcg

SEQ ID NO: 2168622 - DNA, 21 bp, Homo sapiens
taatgtgatatgaaaatatct

SEQ ID NO: 2168623 - DNA, 22 bp, Homo sapiens
taattaaagaaaattgccaaaa

SEQ ID NO: 2168624 - DNA, 22 bp, Homo sapiens
taattaggcagcctgctataaa

SEQ ID NO: 2168625 - DNA, 14 bp, Homo sapiens
taattcagatggat

SEQ ID NO: 2168626 - DNA, 17 bp, Homo sapiens
taattctttatcacatg

SEQ ID NO: 2168627 - DNA, 20 bp, Homo sapiens
taattctttatcacatgttg

SEQ ID NO: 2168628 - DNA, 22 bp, Homo sapiens
taattgagccttttattaacat

SEQ ID NO: 2168629 - DNA, 15 bp, Homo sapiens
taatttatatttgtc

SEQ ID NO: 2168630 - DNA, 14 bp, Homo sapiens
taatttatgcagag

SEQ ID NO: 2168631 - DNA, 21 bp, Homo sapiens
taatttattgtaccaaagctg

SEQ ID NO: 2168632 - DNA, 22 bp, Homo sapiens
taattttgttaagaatttcaat

SEQ ID NO: 2168633 - DNA, 19 bp, Homo sapiens
taattttttagttaaaatc

SEQ ID NO: 2168634 - DNA, 22 bp, Homo sapiens
tacaaaaaaaagtgtattgcaa

SEQ ID NO: 2168635 - DNA, 23 bp, Homo sapiens
tacaagacggggagtgagactcc

SEQ ID NO: 2168636 - DNA, 17 bp, Homo sapiens
tacaagagggcaaagct

SEQ ID NO: 2168637 - DNA, 19 bp, Homo sapiens
tacaagagggcaaagctga

SEQ ID NO: 2168638 - DNA, 20 bp, Homo sapiens
tacaagagggcaaagctgat

SEQ ID NO: 2168639 - DNA, 21 bp, Homo sapiens
tacaaggcaggcctttcctac

SEQ ID NO: 2168640 - DNA, 22 bp, Homo sapiens
tacaaggcaggcctttcctaca

SEQ ID NO: 2168641 - DNA, 15 bp, Homo sapiens
tacaagtttcagtaa

SEQ ID NO: 2168642 - DNA, 21 bp, Homo sapiens
tacaataggatttaatttgtt

SEQ ID NO: 2168643 - DNA, 16 bp, Homo sapiens
tacaatcgttctgtgt

SEQ ID NO: 2168644 - DNA, 21 bp, Homo sapiens
tacaattcaaacaattcaatc

SEQ ID NO: 2168645 - DNA, 14 bp, Homo sapiens
tacacaaaaagaaa

SEQ ID NO: 2168646 - DNA, 15 bp, Homo sapiens
tacacaaaaagaaag

SEQ ID NO: 2168647 - DNA, 21 bp, Homo sapiens
tacacaaaaagaaagctgtga

SEQ ID NO: 2168648 - DNA, 23 bp, Homo sapiens
tacacaaaaagaaagctgtgaaa

SEQ ID NO: 2168649 - DNA, 13 bp, Homo sapiens
tacacattaaagt

SEQ ID NO: 2168650 - DNA, 19 bp, Homo sapiens
tacacttactgttgtccta

SEQ ID NO: 2168651 - DNA, 13 bp, Homo sapiens
tacacttgggtga

SEQ ID NO: 2168652 - DNA, 18 bp, Homo sapiens
tacagaggattctgtctt

SEQ ID NO: 2168653 - DNA, 23 bp, Homo sapiens
tacagagtgggccccgggctgga

SEQ ID NO: 2168654 - DNA, 20 bp, Homo sapiens
tacagatgaaccaagtgtct

SEQ ID NO: 2168655 - DNA, 13 bp, Homo sapiens
tacagcactttga

SEQ ID NO: 2168656 - DNA, 12 bp, Homo sapiens
tacagtatgtgt

SEQ ID NO: 2168657 - DNA, 24 bp, Homo sapiens
tacagtgtatctcgaagtcttcca

SEQ ID NO: 2168658 - DNA, 11 bp, Homo sapiens
tactgtacata

SEQ ID NO: 2168659 - DNA, 19 bp, Homo sapiens
tactgtgctgattcaataa

SEQ ID NO: 2168660 - DNA, 11 bp, Homo sapiens
tactgtggagg

SEQ ID NO: 2168661 - DNA, 15 bp, Homo sapiens
tactgtggaggtggc

SEQ ID NO: 2168662 - DNA, 16 bp, Homo sapiens
tactgtggaggtggct

SEQ ID NO: 2168663 - DNA, 12 bp, Homo sapiens
tactgtttgtct

SEQ ID NO: 2168664 - DNA, 21 bp, Homo sapiens
tacttaaaaatatgtgagcat

SEQ ID NO: 2168665 - DNA, 13 bp, Homo sapiens
tacttcaaatcat

SEQ ID NO: 2168666 - DNA, 14 bp, Homo sapiens
tacttcagctttgt

SEQ ID NO: 2168667 - DNA, 19 bp, Homo sapiens
tacttcatcgcagtggact

SEQ ID NO: 2168668 - DNA, 16 bp, Homo sapiens
tacttgagaaatttgt

SEQ ID NO: 2168669 - DNA, 13 bp, Homo sapiens
tacttgagtgtgc

SEQ ID NO: 2168670 - DNA, 15 bp, Homo sapiens
tacttgagtgtgcaa

SEQ ID NO: 2168671 - DNA, 18 bp, Homo sapiens
tactttattagtttaaaa

SEQ ID NO: 2168672 - DNA, 22 bp, Homo sapiens
tactttccacttgattttgcaa

SEQ ID NO: 2168673 - DNA, 18 bp, Homo sapiens
tactttgattccatttta

SEQ ID NO: 2168674 - DNA, 13 bp, Homo sapiens
tacttttaaataa

SEQ ID NO: 2168675 - DNA, 18 bp, Homo sapiens
tacttttcagtttttaac

SEQ ID NO: 2168676 - DNA, 12 bp, Homo sapiens
tagaaaaattag

SEQ ID NO: 2168677 - DNA, 19 bp, Homo sapiens
tagaaaacccaagttttta

SEQ ID NO: 2168678 - DNA, 19 bp, Homo sapiens
tagaaattacaagtttcag

SEQ ID NO: 2168679 - DNA, 13 bp, Homo sapiens
tagaaccttctaa

SEQ ID NO: 2168680 - DNA, 23 bp, Homo sapiens
tagaacttagttttgttccaaca

SEQ ID NO: 2168681 - DNA, 17 bp, Homo sapiens
tagaagagggagaagga

SEQ ID NO: 2168682 - DNA, 23 bp, Homo sapiens
tagaagatattagtcttggggca

SEQ ID NO: 2168683 - DNA, 22 bp, Homo sapiens
tagaatattaaaaattaattct

SEQ ID NO: 2168684 - DNA, 23 bp, Homo sapiens
tagaatattaaaaattaattctt

SEQ ID NO: 2168685 - DNA, 18 bp, Homo sapiens
tagaatcaagtctgtgaa

SEQ ID NO: 2168686 - DNA, 14 bp, Homo sapiens
tagacccctggctg

SEQ ID NO: 2168687 - DNA, 20 bp, Homo sapiens
tagagaggggcctctggctg

SEQ ID NO: 2168688 - DNA, 21 bp, Homo sapiens
tagagaggggcctctggctgc

SEQ ID NO: 2168689 - DNA, 23 bp, Homo sapiens
tagagaggggcctctggctgcct

SEQ ID NO: 2168690 - DNA, 16 bp, Homo sapiens
tagagatgcctccctg

SEQ ID NO: 2168691 - DNA, 14 bp, Homo sapiens
tagagcagggcaag

SEQ ID NO: 2168692 - DNA, 14 bp, Homo sapiens
tagataaagcactg

SEQ ID NO: 2168693 - DNA, 23 bp, Homo sapiens
tagatatataactttagaaataa

SEQ ID NO: 2168694 - DNA, 11 bp, Homo sapiens
tagatgcttag

SEQ ID NO: 2168695 - DNA, 15 bp, Homo sapiens
tagattctttattag

SEQ ID NO: 2168696 - DNA, 18 bp, Homo sapiens
tagcaaattccaatacat

SEQ ID NO: 2168697 - DNA, 16 bp, Homo sapiens
tagcagaaaacagagg

SEQ ID NO: 2168698 - DNA, 19 bp, Homo sapiens
tagcagatattaaaaattg

SEQ ID NO: 2168699 - DNA, 15 bp, Homo sapiens
tagcaggcccagctg

SEQ ID NO: 2168700 - DNA, 15 bp, Homo sapiens
tagcagtttcactgc

SEQ ID NO: 2168701 - DNA, 19 bp, Homo sapiens
tagccaactgtttccctgc

SEQ ID NO: 2168702 - DNA, 20 bp, Homo sapiens
tagccaactgtttccctgct

SEQ ID NO: 2168703 - DNA, 21 bp, Homo sapiens
tagccaactgtttccctgctg

SEQ ID NO: 2168704 - DNA, 23 bp, Homo sapiens
tagccaactgtttccctgctgaa

SEQ ID NO: 2168705 - DNA, 14 bp, Homo sapiens
tagccactggaaat

SEQ ID NO: 2168706 - DNA, 15 bp, Homo sapiens
tagccatttgaagaa

SEQ ID NO: 2168707 - DNA, 22 bp, Homo sapiens
tagccccaagaaggctggggct

SEQ ID NO: 2168708 - DNA, 12 bp, Homo sapiens
tagctattcttt

SEQ ID NO: 2168709 - DNA, 17 bp, Homo sapiens
tagctcagccccagccc

SEQ ID NO: 2168710 - DNA, 18 bp, Homo sapiens
tagctcagccccagccca

SEQ ID NO: 2168711 - DNA, 15 bp, Homo sapiens
tagctcccctcctct

SEQ ID NO: 2168712 - DNA, 20 bp, Homo sapiens
tagctcccctcctctcccct

SEQ ID NO: 2168713 - DNA, 17 bp, Homo sapiens
tagctcttagtcctccc

SEQ ID NO: 2168714 - DNA, 22 bp, Homo sapiens
tagctcttagtcctccctgctc

SEQ ID NO: 2168715 - DNA, 17 bp, Homo sapiens
tagctgagactacaggt

SEQ ID NO: 2168716 - DNA, 18 bp, Homo sapiens
tagcttctgacctcagca

SEQ ID NO: 2168717 - DNA, 15 bp, Homo sapiens
taggaaataaaatta

SEQ ID NO: 2168718 - DNA, 18 bp, Homo sapiens
taggaaataaaattaatg

SEQ ID NO: 2168719 - DNA, 20 bp, Homo sapiens
taggaagaacttgaagtgaa

SEQ ID NO: 2168720 - DNA, 15 bp, Homo sapiens
taggattagaaaatt

SEQ ID NO: 2168721 - DNA, 18 bp, Homo sapiens
taggcaactattaataat

SEQ ID NO: 2168722 - DNA, 16 bp, Homo sapiens
taggcaattagagaaa

SEQ ID NO: 2168723 - DNA, 13 bp, Homo sapiens
taggcaccacctc

SEQ ID NO: 2168724 - DNA, 21 bp, Homo sapiens
taggccccagaggccctggag

SEQ ID NO: 2168725 - DNA, 22 bp, Homo sapiens
taggccccagaggccctggagg

SEQ ID NO: 2168726 - DNA, 19 bp, Homo sapiens
taggctacccttgccaagg

SEQ ID NO: 2168727 - DNA, 11 bp, Homo sapiens
taggctgggtg

SEQ ID NO: 2168728 - DNA, 17 bp, Homo sapiens
tagggaaggccacctgc

SEQ ID NO: 2168729 - DNA, 14 bp, Homo sapiens
tagggacccctcct

SEQ ID NO: 2168730 - DNA, 20 bp, Homo sapiens
tagggatgcggatcctgctg

SEQ ID NO: 2168731 - DNA, 21 bp, Homo sapiens
tagggatgcggatcctgctgg

SEQ ID NO: 2168732 - DNA, 17 bp, Homo sapiens
tagggttttctatttct

SEQ ID NO: 2168733 - DNA, 18 bp, Homo sapiens
taggtcaattttttttct

SEQ ID NO: 2168734 - DNA, 16 bp, Homo sapiens
taggtgaaggcagaag

SEQ ID NO: 2168735 - DNA, 13 bp, Homo sapiens
taggtgtttggga

SEQ ID NO: 2168736 - DNA, 14 bp, Homo sapiens
taggtgtttgggat

SEQ ID NO: 2168737 - DNA, 24 bp, Homo sapiens
taggttggaagctagctcccctcc

SEQ ID NO: 2168738 - DNA, 18 bp, Homo sapiens
tagtaaaaataaatcaag

SEQ ID NO: 2168739 - DNA, 22 bp, Homo sapiens
tagtaacctttaaaaatgtata

SEQ ID NO: 2168740 - DNA, 17 bp, Homo sapiens
tagtacccacctgagct

SEQ ID NO: 2168741 - DNA, 13 bp, Homo sapiens
tagtagatctgtg

SEQ ID NO: 2168742 - DNA, 17 bp, Homo sapiens
tagtagatctgtggcga

SEQ ID NO: 2168743 - DNA, 20 bp, Homo sapiens
tcacaagctgcctccctgtc

SEQ ID NO: 2168744 - DNA, 20 bp, Homo sapiens
tcacacctagcgtcagtatt

SEQ ID NO: 2168745 - DNA, 13 bp, Homo sapiens
tcacactcttcag

SEQ ID NO: 2168746 - DNA, 14 bp, Homo sapiens
tcacagactggaga

SEQ ID NO: 2168747 - DNA, 18 bp, Homo sapiens
tcacagaggcagtggcag

SEQ ID NO: 2168748 - DNA, 16 bp, Homo sapiens
tcacagctcacggcag

SEQ ID NO: 2168749 - DNA, 18 bp, Homo sapiens
tcacagtgcttttaagtg

SEQ ID NO: 2168750 - DNA, 12 bp, Homo sapiens
tcacatgctgga

SEQ ID NO: 2168751 - DNA, 23 bp, Homo sapiens
tcacatgctggacaggtctggga

SEQ ID NO: 2168752 - DNA, 16 bp, Homo sapiens
tcaccaggggaggagc

SEQ ID NO: 2168753 - DNA, 24 bp, Homo sapiens
tcaccaggggaggagcctgtgcgt

SEQ ID NO: 2168754 - DNA, 16 bp, Homo sapiens
tcaccatcttggccag

SEQ ID NO: 2168755 - DNA, 20 bp, Homo sapiens
tcaccatcttggccaggctg

SEQ ID NO: 2168756 - DNA, 23 bp, Homo sapiens
tcacctgcacagggccctctgag

SEQ ID NO: 2168757 - DNA, 12 bp, Homo sapiens
tcacctgtcatc

SEQ ID NO: 2168758 - DNA, 17 bp, Homo sapiens
tcaccttcctctgcctt

SEQ ID NO: 2168759 - DNA, 12 bp, Homo sapiens
tcacctttccca

SEQ ID NO: 2168760 - DNA, 13 bp, Homo sapiens
tcacgagccttgc

SEQ ID NO: 2168761 - DNA, 23 bp, Homo sapiens
tcacgctcccaacacaaggtggg

SEQ ID NO: 2168762 - DNA, 21 bp, Homo sapiens
tcactatttttttgttgctgt

SEQ ID NO: 2168763 - DNA, 14 bp, Homo sapiens
tcactcagaattat

SEQ ID NO: 2168764 - DNA, 23 bp, Homo sapiens
tcactcagaattattcatagctg

SEQ ID NO: 2168765 - DNA, 14 bp, Homo sapiens
tcactcatttattt

SEQ ID NO: 2168766 - DNA, 19 bp, Homo sapiens
tcactcatttatttccata

SEQ ID NO: 2168767 - DNA, 21 bp, Homo sapiens
tcactccaggaaggggctgga

SEQ ID NO: 2168768 - DNA, 17 bp, Homo sapiens
tcactctcccagaggct

SEQ ID NO: 2168769 - DNA, 22 bp, Homo sapiens
tcactctcccagaggctcctgg

SEQ ID NO: 2168770 - DNA, 16 bp, Homo sapiens
tcactgaagtgaatac

SEQ ID NO: 2168771 - DNA, 15 bp, Homo sapiens
tcactgagtttgtgg

SEQ ID NO: 2168772 - DNA, 18 bp, Homo sapiens
tcactgcaacctccacct

SEQ ID NO: 2168773 - DNA, 17 bp, Homo sapiens
tcactggggctgcgcag

SEQ ID NO: 2168774 - DNA, 15 bp, Homo sapiens
tcactgtgagttctg

SEQ ID NO: 2168775 - DNA, 16 bp, Homo sapiens
tcacttaacctgcttt

SEQ ID NO: 2168776 - DNA, 16 bp, Homo sapiens
tcacttcgtgggatct

SEQ ID NO: 2168777 - DNA, 22 bp, Homo sapiens
tcacttcgttggtgaccagttt

SEQ ID NO: 2168778 - DNA, 22 bp, Homo sapiens
tcacttgaaacttggttcccag

SEQ ID NO: 2168779 - DNA, 23 bp, Homo sapiens
tcacttgaaacttggttcccaga

SEQ ID NO: 2168780 - DNA, 15 bp, Homo sapiens
tcacttgtgtttgta

SEQ ID NO: 2168781 - DNA, 18 bp, Homo sapiens
tcacttgtgtttgtatat

SEQ ID NO: 2168782 - DNA, 23 bp, Homo sapiens
tcacttgtgtttgtatataaatg

SEQ ID NO: 2168783 - DNA, 12 bp, Homo sapiens
tcactttgctct

SEQ ID NO: 2168784 - DNA, 22 bp, Homo sapiens
tcagaaagaattgatcagaatc

SEQ ID NO: 2168785 - DNA, 17 bp, Homo sapiens
tcagaagttagtttgta

SEQ ID NO: 2168786 - DNA, 19 bp, Homo sapiens
tcagaagttgttagtgatt

SEQ ID NO: 2168787 - DNA, 19 bp, Homo sapiens
tcagacatctgaggtttta

SEQ ID NO: 2168788 - DNA, 22 bp, Homo sapiens
tcagagccacccaggccactga

SEQ ID NO: 2168789 - DNA, 18 bp, Homo sapiens
tcagagctacttgggcca

SEQ ID NO: 2168790 - DNA, 14 bp, Homo sapiens
tcagatcctgctgc

SEQ ID NO: 2168791 - DNA, 15 bp, Homo sapiens
tcagatcctgctgcc

SEQ ID NO: 2168792 - DNA, 18 bp, Homo sapiens
tcagatcctgctgccgcg

SEQ ID NO: 2168793 - DNA, 14 bp, Homo sapiens
tcagcaaaagttaa

SEQ ID NO: 2168794 - DNA, 15 bp, Homo sapiens
tcagcacatgcacta

SEQ ID NO: 2168795 - DNA, 18 bp, Homo sapiens
tcagcacatgcactactg

SEQ ID NO: 2168796 - DNA, 12 bp, Homo sapiens
tcagcagtgatt

SEQ ID NO: 2168797 - DNA, 17 bp, Homo sapiens
tcagccagccccatcag

SEQ ID NO: 2168798 - DNA, 16 bp, Homo sapiens
tcagccagtggggatg

SEQ ID NO: 2168799 - DNA, 16 bp, Homo sapiens
tcagccccagcccagc

SEQ ID NO: 2168800 - DNA, 22 bp, Homo sapiens
tcagccccagcccagcccagct

SEQ ID NO: 2168801 - DNA, 24 bp, Homo sapiens
tcagccctgagctggcctcacctg

SEQ ID NO: 2168802 - DNA, 20 bp, Homo sapiens
tcagcctcccgagtagctgg

SEQ ID NO: 2168803 - DNA, 13 bp, Homo sapiens
tcagctcactgca

SEQ ID NO: 2168804 - DNA, 16 bp, Homo sapiens
tcagctctggctcaca

SEQ ID NO: 2168805 - DNA, 17 bp, Homo sapiens
tcagctctggctcacag

SEQ ID NO: 2168806 - DNA, 21 bp, Homo sapiens
tcagctggcggaacctggctg

SEQ ID NO: 2168807 - DNA, 19 bp, Homo sapiens
tcagcttcaaataaagtaa

SEQ ID NO: 2168808 - DNA, 16 bp, Homo sapiens
tcaggaacctggacca

SEQ ID NO: 2168809 - DNA, 16 bp, Homo sapiens
tcaggaattcagtgcc

SEQ ID NO: 2168810 - DNA, 18 bp, Homo sapiens
tcaggaattcagtgcctt

SEQ ID NO: 2168811 - DNA, 22 bp, Homo sapiens
tcaggactaccgttaccaagag

SEQ ID NO: 2168812 - DNA, 13 bp, Homo sapiens
tcaggaggcaggg

SEQ ID NO: 2168813 - DNA, 17 bp, Homo sapiens
tcaggcatttttccaaa

SEQ ID NO: 2168814 - DNA, 20 bp, Homo sapiens
tcaggccaaagacctcccaa

SEQ ID NO: 2168815 - DNA, 13 bp, Homo sapiens
tcaggctctgcac

SEQ ID NO: 2168816 - DNA, 18 bp, Homo sapiens
tcaggctctgcacagaca

SEQ ID NO: 2168817 - DNA, 14 bp, Homo sapiens
tcaggtcagggcta

SEQ ID NO: 2168818 - DNA, 13 bp, Homo sapiens
tcagtaatagctg

SEQ ID NO: 2168819 - DNA, 14 bp, Homo sapiens
tcagtaatagctga

SEQ ID NO: 2168820 - DNA, 15 bp, Homo sapiens
tcagtacccacctga

SEQ ID NO: 2168821 - DNA, 14 bp, Homo sapiens
tcagtattgtgtaa

SEQ ID NO: 2168822 - DNA, 16 bp, Homo sapiens
tcagtattgtgtaaag

SEQ ID NO: 2168823 - DNA, 17 bp, Homo sapiens
tcagtattgtgtaaagg

SEQ ID NO: 2168824 - DNA, 20 bp, Homo sapiens
tcagtattgtgtaaaggaac

SEQ ID NO: 2168825 - DNA, 16 bp, Homo sapiens
tcagtattttccctgc

SEQ ID NO: 2168826 - DNA, 18 bp, Homo sapiens
tcagtattttccctgcta

SEQ ID NO: 2168827 - DNA, 17 bp, Homo sapiens
tcagtctgctttctcta

SEQ ID NO: 2168828 - DNA, 13 bp, Homo sapiens
tcagtgactcctg

SEQ ID NO: 2168829 - DNA, 22 bp, Homo sapiens
tcagtgccaataaaatttagga

SEQ ID NO: 2168830 - DNA, 23 bp, Homo sapiens
tcagtgtgccaccctctgcaggg

SEQ ID NO: 2168831 - DNA, 15 bp, Homo sapiens
tcagttacttacctg

SEQ ID NO: 2168832 - DNA, 16 bp, Homo sapiens
tcatacagaaggtggg

SEQ ID NO: 2168833 - DNA, 19 bp, Homo sapiens
tcatactgtgctggagcca

SEQ ID NO: 2168834 - DNA, 20 bp, Homo sapiens
tcatactgtgctggagccac

SEQ ID NO: 2168835 - DNA, 15 bp, Homo sapiens
tcatatattataaga

SEQ ID NO: 2168836 - DNA, 21 bp, Homo sapiens
tcatattaatataagtttctt

SEQ ID NO: 2168837 - DNA, 17 bp, Homo sapiens
tcatccacacaacacca

SEQ ID NO: 2168838 - DNA, 18 bp, Homo sapiens
tcatccacacaacaccag

SEQ ID NO: 2168839 - DNA, 15 bp, Homo sapiens
tcatgacatttctca

SEQ ID NO: 2168840 - DNA, 15 bp, Homo sapiens
tcatgcttataagca

SEQ ID NO: 2168841 - DNA, 18 bp, Homo sapiens
tcatggctcaaggattca

SEQ ID NO: 2168842 - DNA, 20 bp, Homo sapiens
tcatggctctgaactgcaca

SEQ ID NO: 2168843 - DNA, 17 bp, Homo sapiens
tcatgggcccctctgac

SEQ ID NO: 2168844 - DNA, 14 bp, Homo sapiens
tcatgtgtgctctt

SEQ ID NO: 2168845 - DNA, 16 bp, Homo sapiens
tcatgtgtgctcttct

SEQ ID NO: 2168846 - DNA, 10 bp, Homo sapiens
tcatgttctc

SEQ ID NO: 2168847 - DNA, 16 bp, Homo sapiens
tcatgttctcatgttt

SEQ ID NO: 2168848 - DNA, 19 bp, Homo sapiens
tcattctaaaccaaaacag

SEQ ID NO: 2168849 - DNA, 21 bp, Homo sapiens
tcatttatttttaaaataatt

SEQ ID NO: 2168850 - DNA, 22 bp, Homo sapiens
tcatttcaagttatgattcagt

SEQ ID NO: 2168851 - DNA, 21 bp, Homo sapiens
tcatttcagaagttagtttgt

SEQ ID NO: 2168852 - DNA, 20 bp, Homo sapiens
tcatttgccaactaatttta

SEQ ID NO: 2168853 - DNA, 14 bp, Homo sapiens
tcattttgtatgta

SEQ ID NO: 2168854 - DNA, 22 bp, Homo sapiens
tcattttgtatgtatgtgtagt

SEQ ID NO: 2168855 - DNA, 12 bp, Homo sapiens
tccaaaaacaaa

SEQ ID NO: 2168856 - DNA, 23 bp, Homo sapiens
tccaaaaacaaagtgcaaagctg

SEQ ID NO: 2168857 - DNA, 15 bp, Homo sapiens
tccaacaactgtcag

SEQ ID NO: 2168858 - DNA, 12 bp, Homo sapiens
tccaactgctgc

SEQ ID NO: 2168859 - DNA, 16 bp, Homo sapiens
tccaactgctgcccca

SEQ ID NO: 2168860 - DNA, 12 bp, Homo sapiens
tccaagcctggg

SEQ ID NO: 2168861 - DNA, 14 bp, Homo sapiens
tccaagcctgggcc

SEQ ID NO: 2168862 - DNA, 15 bp, Homo sapiens
tccaagcctgggcca

SEQ ID NO: 2168863 - DNA, 16 bp, Homo sapiens
tccaagcctgggccac

SEQ ID NO: 2168864 - DNA, 15 bp, Homo sapiens
tccaagtgtttcttg

SEQ ID NO: 2168865 - DNA, 15 bp, Homo sapiens
tccaatatttataat

SEQ ID NO: 2168866 - DNA, 20 bp, Homo sapiens
tccaatatttataattaaag

SEQ ID NO: 2168867 - DNA, 18 bp, Homo sapiens
tccaatgtgcccagtcat

SEQ ID NO: 2168868 - DNA, 16 bp, Homo sapiens
tccacacaacaccagg

SEQ ID NO: 2168869 - DNA, 17 bp, Homo sapiens
tccacacaacaccagga

SEQ ID NO: 2168870 - DNA, 21 bp, Homo sapiens
tccacacaacaccaggactta

SEQ ID NO: 2168871 - DNA, 12 bp, Homo sapiens
tccacaccccca

SEQ ID NO: 2168872 - DNA, 15 bp, Homo sapiens
tccacacccccaccc

SEQ ID NO: 2168873 - DNA, 19 bp, Homo sapiens
tccacagaaaccctgtttt

SEQ ID NO: 2168874 - DNA, 22 bp, Homo sapiens
tccacagccatcccagccttgg

SEQ ID NO: 2168875 - DNA, 23 bp, Homo sapiens
tccacagggacacagtctggtgc

SEQ ID NO: 2168876 - DNA, 12 bp, Homo sapiens
tccaccccactc

SEQ ID NO: 2168877 - DNA, 23 bp, Homo sapiens
tccacccccgcctccctcccctg

SEQ ID NO: 2168878 - DNA, 17 bp, Homo sapiens
tccactgcaaataaagc

SEQ ID NO: 2168879 - DNA, 20 bp, Homo sapiens
tccactgcaaataaagcctt

SEQ ID NO: 2168880 - DNA, 19 bp, Homo sapiens
tccactggggagtgctgga

SEQ ID NO: 2168881 - DNA, 22 bp, Homo sapiens
tccagacgcactgatctttgca

SEQ ID NO: 2168882 - DNA, 12 bp, Homo sapiens
tccagcctagag

SEQ ID NO: 2168883 - DNA, 22 bp, Homo sapiens
tccagctaagcctgatgatgga

SEQ ID NO: 2168884 - DNA, 20 bp, Homo sapiens
tccagctataacagtaggga

SEQ ID NO: 2168885 - DNA, 18 bp, Homo sapiens
tccaggggcctgcagaag

SEQ ID NO: 2168886 - DNA, 18 bp, Homo sapiens
tccaggtcgggctcagct

SEQ ID NO: 2168887 - DNA, 20 bp, Homo sapiens
tccaggtcgggctcagctct

SEQ ID NO: 2168888 - DNA, 21 bp, Homo sapiens
tccagtcctgctctctaccca

SEQ ID NO: 2168889 - DNA, 17 bp, Homo sapiens
tccagtggcctggctcc

SEQ ID NO: 2168890 - DNA, 12 bp, Homo sapiens
tccatctccttg

SEQ ID NO: 2168891 - DNA, 13 bp, Homo sapiens
tccatggtgcctc

SEQ ID NO: 2168892 - DNA, 16 bp, Homo sapiens
tccatggtgcctctgg

SEQ ID NO: 2168893 - DNA, 17 bp, Homo sapiens
tccatggtgcctctgga

SEQ ID NO: 2168894 - DNA, 13 bp, Homo sapiens
tccatgttgctga

SEQ ID NO: 2168895 - DNA, 21 bp, Homo sapiens
tccattaatgtagataaagca

SEQ ID NO: 2168896 - DNA, 18 bp, Homo sapiens
tccattagtaaaacacaa

SEQ ID NO: 2168897 - DNA, 15 bp, Homo sapiens
tcccaaaatactaca

SEQ ID NO: 2168898 - DNA, 15 bp, Homo sapiens
tcccaaagagctgcc

SEQ ID NO: 2168899 - DNA, 19 bp, Homo sapiens
tcccaacacaaggtgggca

SEQ ID NO: 2168900 - DNA, 14 bp, Homo sapiens
tcccaacactttgg

SEQ ID NO: 2168901 - DNA, 19 bp, Homo sapiens
tcccaagaacagcaggccc

SEQ ID NO: 2168902 - DNA, 21 bp, Homo sapiens
tcccaagaacagcaggcccac

SEQ ID NO: 2168903 - DNA, 20 bp, Homo sapiens
tcccaagctgtatgtacttc

SEQ ID NO: 2168904 - DNA, 14 bp, Homo sapiens
tcccacacaagcag

SEQ ID NO: 2168905 - DNA, 17 bp, Homo sapiens
tcccaccaatcctcacc

SEQ ID NO: 2168906 - DNA, 18 bp, Homo sapiens
tcccaccaatcctcacct

SEQ ID NO: 2168907 - DNA, 21 bp, Homo sapiens
tcccacccctccccactcatc

SEQ ID NO: 2168908 - DNA, 20 bp, Homo sapiens
tcccaccggttgcttctggg

SEQ ID NO: 2168909 - DNA, 22 bp, Homo sapiens
tcccacctcaaatgggtctggg

SEQ ID NO: 2168910 - DNA, 11 bp, Homo sapiens
tcccagaggct

SEQ ID NO: 2168911 - DNA, 15 bp, Homo sapiens
tcccagaggctcctg

SEQ ID NO: 2168912 - DNA, 23 bp, Homo sapiens
tcccagatgccttctagattcac

SEQ ID NO: 2168913 - DNA, 18 bp, Homo sapiens
tcccagccacgttggtgg

SEQ ID NO: 2168914 - DNA, 21 bp, Homo sapiens
tcccagccacgttggtggtat

SEQ ID NO: 2168915 - DNA, 17 bp, Homo sapiens
tcccagttcatgttgct

SEQ ID NO: 2168916 - DNA, 19 bp, Homo sapiens
tcccatggatgtttcttct

SEQ ID NO: 2168917 - DNA, 21 bp, Homo sapiens
tccccaaaggtcaaaaacaaa

SEQ ID NO: 2168918 - DNA, 15 bp, Homo sapiens
tccccaactccttcc

SEQ ID NO: 2168919 - DNA, 17 bp, Homo sapiens
tccccaactccttcctc

SEQ ID NO: 2168920 - DNA, 13 bp, Homo sapiens
tccccaagggccc

SEQ ID NO: 2168921 - DNA, 16 bp, Homo sapiens
tccccaagggccctgg

SEQ ID NO: 2168922 - DNA, 17 bp, Homo sapiens
tccccaagggccctggc

SEQ ID NO: 2168923 - DNA, 18 bp, Homo sapiens
tccccatactctgtctcc

SEQ ID NO: 2168924 - DNA, 19 bp, Homo sapiens
tccccatactctgtctccc

SEQ ID NO: 2168925 - DNA, 18 bp, Homo sapiens
tccccattcattcctgat

SEQ ID NO: 2168926 - DNA, 19 bp, Homo sapiens
tccccattcattcctgatg

SEQ ID NO: 2168927 - DNA, 16 bp, Homo sapiens
tcccccacctcttttc

SEQ ID NO: 2168928 - DNA, 13 bp, Homo sapiens
tccccctccttgc

SEQ ID NO: 2168929 - DNA, 17 bp, Homo sapiens
tccccctcttcttctga

SEQ ID NO: 2168930 - DNA, 15 bp, Homo sapiens
tcccctcagcctcct

SEQ ID NO: 2168931 - DNA, 13 bp, Homo sapiens
tcccctctgctgg

SEQ ID NO: 2168932 - DNA, 19 bp, Homo sapiens
tccccttctcatcactccc

SEQ ID NO: 2168933 - DNA, 13 bp, Homo sapiens
tccccttgttcta

SEQ ID NO: 2168934 - DNA, 17 bp, Homo sapiens
tcccgagccccctgtcc

SEQ ID NO: 2168935 - DNA, 18 bp, Homo sapiens
tcccgagccccctgtcct

SEQ ID NO: 2168936 - DNA, 16 bp, Homo sapiens
tccctacccacagggc

SEQ ID NO: 2168937 - DNA, 14 bp, Homo sapiens
tccctacttccaag

SEQ ID NO: 2168938 - DNA, 16 bp, Homo sapiens
tccctaggcacctctg

SEQ ID NO: 2168939 - DNA, 20 bp, Homo sapiens
tccctaggcacctctgtgct

SEQ ID NO: 2168940 - DNA, 16 bp, Homo sapiens
tccctatgttgcccag

SEQ ID NO: 2168941 - DNA, 19 bp, Homo sapiens
tccctcagtgtgaagcctg

SEQ ID NO: 2168942 - DNA, 16 bp, Homo sapiens
tccctcccctgccctc

SEQ ID NO: 2168943 - DNA, 17 bp, Homo sapiens
tccctgaacagatacat

SEQ ID NO: 2168944 - DNA, 16 bp, Homo sapiens
tccctgaccctgcaga

SEQ ID NO: 2168945 - DNA, 14 bp, Homo sapiens
tccctgcagggtag

SEQ ID NO: 2168946 - DNA, 22 bp, Homo sapiens
tccctgcagggtagggggcctg

SEQ ID NO: 2168947 - DNA, 12 bp, Homo sapiens
tccctgctgaat

SEQ ID NO: 2168948 - DNA, 15 bp, Homo sapiens
tccctgctgaatgcc

SEQ ID NO: 2168949 - DNA, 15 bp, Homo sapiens
tccctggccatctct

SEQ ID NO: 2168950 - DNA, 19 bp, Homo sapiens
tccctgggaccccctcccc

SEQ ID NO: 2168951 - DNA, 12 bp, Homo sapiens
tccctgtccacc

SEQ ID NO: 2168952 - DNA, 20 bp, Homo sapiens
tcccttcaagacgaggggca

SEQ ID NO: 2168953 - DNA, 18 bp, Homo sapiens
tcccttccacacccccac

SEQ ID NO: 2168954 - DNA, 11 bp, Homo sapiens
tccctttgctc

SEQ ID NO: 2168955 - DNA, 16 bp, Homo sapiens
tccctttgctccaccc

SEQ ID NO: 2168956 - DNA, 14 bp, Homo sapiens
tccctttttccttg

SEQ ID NO: 2168957 - DNA, 15 bp, Homo sapiens
tccctttttccttgt

SEQ ID NO: 2168958 - DNA, 16 bp, Homo sapiens
tccctttttccttgtc

SEQ ID NO: 2168959 - DNA, 14 bp, Homo sapiens
tccgcaaatatcct

SEQ ID NO: 2168960 - DNA, 15 bp, Homo sapiens
tccggccctggctgg

SEQ ID NO: 2168961 - DNA, 18 bp, Homo sapiens
tccgtatttattttttta

SEQ ID NO: 2168962 - DNA, 14 bp, Homo sapiens
tccgtctcccctcg

SEQ ID NO: 2168963 - DNA, 23 bp, Homo sapiens
tccgtgagcagtgtgtctcctgc

SEQ ID NO: 2168964 - DNA, 21 bp, Homo sapiens
tcctaaaagttttaacctcag

SEQ ID NO: 2168965 - DNA, 15 bp, Homo sapiens
tcctacacctaactc

SEQ ID NO: 2168966 - DNA, 14 bp, Homo sapiens
tcctacagtacaat

SEQ ID NO: 2168967 - DNA, 19 bp, Homo sapiens
tcctaccccaattccttgt

SEQ ID NO: 2168968 - DNA, 14 bp, Homo sapiens
tcctagctgtgtgc

SEQ ID NO: 2168969 - DNA, 21 bp, Homo sapiens
tcctattctgggcaaatagat

SEQ ID NO: 2168970 - DNA, 22 bp, Homo sapiens
tctcccctcgttaacacatggc

SEQ ID NO: 2168971 - DNA, 18 bp, Homo sapiens
tctccctataatgctgga

SEQ ID NO: 2168972 - DNA, 19 bp, Homo sapiens
tctcctgcctcagcctccc

SEQ ID NO: 2168973 - DNA, 14 bp, Homo sapiens
tctcctgtatcatt

SEQ ID NO: 2168974 - DNA, 15 bp, Homo sapiens
tctcctttaattgta

SEQ ID NO: 2168975 - DNA, 17 bp, Homo sapiens
tctcgaagcagtattct

SEQ ID NO: 2168976 - DNA, 19 bp, Homo sapiens
tctctacagcaccttaaaa

SEQ ID NO: 2168977 - DNA, 18 bp, Homo sapiens
tctctacccagcccatct

SEQ ID NO: 2168978 - DNA, 22 bp, Homo sapiens
tctctagggaaggccacctgca

SEQ ID NO: 2168979 - DNA, 13 bp, Homo sapiens
tctctccctgggg

SEQ ID NO: 2168980 - DNA, 16 bp, Homo sapiens
tctctgaacttcagct

SEQ ID NO: 2168981 - DNA, 14 bp, Homo sapiens
tctctgggccccag

SEQ ID NO: 2168982 - DNA, 18 bp, Homo sapiens
tctctgggccccaggcac

SEQ ID NO: 2168983 - DNA, 15 bp, Homo sapiens
tctctgtccagggct

SEQ ID NO: 2168984 - DNA, 16 bp, Homo sapiens
tctctgtctcatgtgt

SEQ ID NO: 2168985 - DNA, 13 bp, Homo sapiens
tctctgtgctctg

SEQ ID NO: 2168986 - DNA, 11 bp, Homo sapiens
tctcttagatt

SEQ ID NO: 2168987 - DNA, 13 bp, Homo sapiens
tctcttcccctct

SEQ ID NO: 2168988 - DNA, 13 bp, Homo sapiens
tctcttgctttgt

SEQ ID NO: 2168989 - DNA, 13 bp, Homo sapiens
tctctttgtaagg

SEQ ID NO: 2168990 - DNA, 16 bp, Homo sapiens
tctgaaagctgcttct

SEQ ID NO: 2168991 - DNA, 16 bp, Homo sapiens
tctgaaattttctaga

SEQ ID NO: 2168992 - DNA, 18 bp, Homo sapiens
tctgaaattttctagaat

SEQ ID NO: 2168993 - DNA, 22 bp, Homo sapiens
tctgaaattttctagaatacta

SEQ ID NO: 2168994 - DNA, 16 bp, Homo sapiens
tctgaacaaaagcagg

SEQ ID NO: 2168995 - DNA, 15 bp, Homo sapiens
tctgaacacacattg

SEQ ID NO: 2168996 - DNA, 17 bp, Homo sapiens
tctgaactcgcttctct

SEQ ID NO: 2168997 - DNA, 21 bp, Homo sapiens
tctgaactcgcttctctgtga

SEQ ID NO: 2168998 - DNA, 15 bp, Homo sapiens
tctgaacttcagcta

SEQ ID NO: 2168999 - DNA, 14 bp, Homo sapiens
tctgaagatggaag

SEQ ID NO: 2169000 - DNA, 23 bp, Homo sapiens
tctgaagtctcaagaactgccat

SEQ ID NO: 2169001 - DNA, 15 bp, Homo sapiens
tctgaagttttattt

SEQ ID NO: 2169002 - DNA, 18 bp, Homo sapiens
tctgaagttttattttaa

SEQ ID NO: 2169003 - DNA, 16 bp, Homo sapiens
tctgaatgggagccag

SEQ ID NO: 2169004 - DNA, 18 bp, Homo sapiens
tctgaatgggagccagaa

SEQ ID NO: 2169005 - DNA, 21 bp, Homo sapiens
tctgacaaagtcatgaagctc

SEQ ID NO: 2169006 - DNA, 12 bp, Homo sapiens
tctgactcccaa

SEQ ID NO: 2169007 - DNA, 16 bp, Homo sapiens
tctgactgccaagcca

SEQ ID NO: 2169008 - DNA, 17 bp, Homo sapiens
tctgactgccaagccag

SEQ ID NO: 2169009 - DNA, 18 bp, Homo sapiens
tctgactgccaagccaga

SEQ ID NO: 2169010 - DNA, 22 bp, Homo sapiens
tctgagacggagtctcagtctg

SEQ ID NO: 2169011 - DNA, 23 bp, Homo sapiens
tctgagcaggggaacaaaataag

SEQ ID NO: 2169012 - DNA, 16 bp, Homo sapiens
tctgagcggccgcctg

SEQ ID NO: 2169013 - DNA, 17 bp, Homo sapiens
tctgagcggccgcctgt

SEQ ID NO: 2169014 - DNA, 18 bp, Homo sapiens
tctgcacaaagatgtctt

SEQ ID NO: 2169015 - DNA, 19 bp, Homo sapiens
tctgcacagacaagcagcc

SEQ ID NO: 2169016 - DNA, 22 bp, Homo sapiens
tctgcacagacaagcagccctt

SEQ ID NO: 2169017 - DNA, 15 bp, Homo sapiens
tctgcagggcagcct

SEQ ID NO: 2169018 - DNA, 17 bp, Homo sapiens
tctgcagggcagcctgt

SEQ ID NO: 2169019 - DNA, 18 bp, Homo sapiens
tctgcagggcagcctgtg

SEQ ID NO: 2169020 - DNA, 20 bp, Homo sapiens
tctgcagtcacttcgtggga

SEQ ID NO: 2169021 - DNA, 13 bp, Homo sapiens
tctgcccaccctc

SEQ ID NO: 2169022 - DNA, 14 bp, Homo sapiens
tctgcccccagctg

SEQ ID NO: 2169023 - DNA, 20 bp, Homo sapiens
tctgcccccagctgctcctc

SEQ ID NO: 2169024 - DNA, 15 bp, Homo sapiens
tctgcctctgagcca

SEQ ID NO: 2169025 - DNA, 14 bp, Homo sapiens
tctgccttccttgc

SEQ ID NO: 2169026 - DNA, 15 bp, Homo sapiens
tctgccttccttgct

SEQ ID NO: 2169027 - DNA, 16 bp, Homo sapiens
tctgccttccttgcta

SEQ ID NO: 2169028 - DNA, 13 bp, Homo sapiens
tctgccttgctgc

SEQ ID NO: 2169029 - DNA, 15 bp, Homo sapiens
tctgccttgctgcac

SEQ ID NO: 2169030 - DNA, 16 bp, Homo sapiens
tctgcctttgttcact

SEQ ID NO: 2169031 - DNA, 20 bp, Homo sapiens
tctgcctttgttcactgtga

SEQ ID NO: 2169032 - DNA, 15 bp, Homo sapiens
tctgcgccgctgtgc

SEQ ID NO: 2169033 - DNA, 16 bp, Homo sapiens
tctgcgccgctgtgct

SEQ ID NO: 2169034 - DNA, 18 bp, Homo sapiens
tctgcgccgctgtgctgt

SEQ ID NO: 2169035 - DNA, 22 bp, Homo sapiens
tctgcgccgctgtgctgttgtc

SEQ ID NO: 2169036 - DNA, 14 bp, Homo sapiens
tctgctcctccctc

SEQ ID NO: 2169037 - DNA, 19 bp, Homo sapiens
tctgctgacagatgttcca

SEQ ID NO: 2169038 - DNA, 15 bp, Homo sapiens
tctgctgctcccagc

SEQ ID NO: 2169039 - DNA, 16 bp, Homo sapiens
tctgctgggtttccac

SEQ ID NO: 2169040 - DNA, 21 bp, Homo sapiens
tctgctgggtttccacacagc

SEQ ID NO: 2169041 - DNA, 16 bp, Homo sapiens
tctgcttttaagtttt

SEQ ID NO: 2169042 - DNA, 23 bp, Homo sapiens
tctggagccacctgtcccacctc

SEQ ID NO: 2169043 - DNA, 15 bp, Homo sapiens
tctggaggcctctgg

SEQ ID NO: 2169044 - DNA, 16 bp, Homo sapiens
tctggaggcctctggg

SEQ ID NO: 2169045 - DNA, 17 bp, Homo sapiens
tctggaggcctctgggc

SEQ ID NO: 2169046 - DNA, 12 bp, Homo sapiens
tctggagtgtgt

SEQ ID NO: 2169047 - DNA, 15 bp, Homo sapiens
tctggagtgtgtggg

SEQ ID NO: 2169048 - DNA, 12 bp, Homo sapiens
tctggcaaggac

SEQ ID NO: 2169049 - DNA, 15 bp, Homo sapiens
tctggccctgttgtg

SEQ ID NO: 2169050 - DNA, 19 bp, Homo sapiens
tctggctgcctggcccagg

SEQ ID NO: 2169051 - DNA, 21 bp, Homo sapiens
tctgggcttatatctggcctc

SEQ ID NO: 2169052 - DNA, 17 bp, Homo sapiens
tctggggctcagccctg

SEQ ID NO: 2169053 - DNA, 21 bp, Homo sapiens
tctggtgggaaaatgtccccc

SEQ ID NO: 2169054 - DNA, 14 bp, Homo sapiens
tctggttggaggcc

SEQ ID NO: 2169055 - DNA, 14 bp, Homo sapiens
tctgtagaatttag

SEQ ID NO: 2169056 - DNA, 16 bp, Homo sapiens
tctgtagagcagggca

SEQ ID NO: 2169057 - DNA, 16 bp, Homo sapiens
tctgtcacccaggctg

SEQ ID NO: 2169058 - DNA, 15 bp, Homo sapiens
tctgtcccttggagc

SEQ ID NO: 2169059 - DNA, 14 bp, Homo sapiens
tctgtctaccatct

SEQ ID NO: 2169060 - DNA, 23 bp, Homo sapiens
tctgtgaaagtctcctgtatcat

SEQ ID NO: 2169061 - DNA, 15 bp, Homo sapiens
tctgtgagtcagtca

SEQ ID NO: 2169062 - DNA, 14 bp, Homo sapiens
tctgtgcccagctc

SEQ ID NO: 2169063 - DNA, 15 bp, Homo sapiens
tctgtgcctggagct

SEQ ID NO: 2169064 - DNA, 20 bp, Homo sapiens
tctgtgcctggagctcctgg

SEQ ID NO: 2169065 - DNA, 15 bp, Homo sapiens
tctgttctgctccca

SEQ ID NO: 2169066 - DNA, 12 bp, Homo sapiens
tctgttgcaaac

SEQ ID NO: 2169067 - DNA, 20 bp, Homo sapiens
tctgtttccttctctttctc

SEQ ID NO: 2169068 - DNA, 16 bp, Homo sapiens
tcttattcaaagatga

SEQ ID NO: 2169069 - DNA, 17 bp, Homo sapiens
tcttattcaaagatgat

SEQ ID NO: 2169070 - DNA, 17 bp, Homo sapiens
tcttcaaggtgtaaaat

SEQ ID NO: 2169071 - DNA, 19 bp, Homo sapiens
tcttcaatacaaaaagcca

SEQ ID NO: 2169072 - DNA, 18 bp, Homo sapiens
tcttcagatcctgctgcc

SEQ ID NO: 2169073 - DNA, 16 bp, Homo sapiens
tcttcagtgactcctg

SEQ ID NO: 2169074 - DNA, 19 bp, Homo sapiens
tcttcagtgactcctgctg

SEQ ID NO: 2169075 - DNA, 21 bp, Homo sapiens
tcttcagtgactcctgctggt

SEQ ID NO: 2169076 - DNA, 17 bp, Homo sapiens
tcttccatcagcagtga

SEQ ID NO: 2169077 - DNA, 14 bp, Homo sapiens
tcttcccaaggcca

SEQ ID NO: 2169078 - DNA, 20 bp, Homo sapiens
tcttcccaaggccagtctga

SEQ ID NO: 2169079 - DNA, 24 bp, Homo sapiens
tcttcccctctaatgctcacgctc

SEQ ID NO: 2169080 - DNA, 13 bp, Homo sapiens
tcttcctccctcc

SEQ ID NO: 2169081 - DNA, 20 bp, Homo sapiens
tcttcctccctccctgcagg

SEQ ID NO: 2169082 - DNA, 15 bp, Homo sapiens
tcttcggaggtggca

SEQ ID NO: 2169083 - DNA, 15 bp, Homo sapiens
tcttcgtaacttcat

SEQ ID NO: 2169084 - DNA, 15 bp, Homo sapiens
tcttctgaagatgga

SEQ ID NO: 2169085 - DNA, 14 bp, Homo sapiens
tcttcttctgaaga

SEQ ID NO: 2169086 - DNA, 16 bp, Homo sapiens
tcttgaactcctagac

SEQ ID NO: 2169087 - DNA, 16 bp, Homo sapiens
tcttgaactcctgacc

SEQ ID NO: 2169088 - DNA, 15 bp, Homo sapiens
tcttgatgactgctg

SEQ ID NO: 2169089 - DNA, 19 bp, Homo sapiens
tcttgatgatcctcaagga

SEQ ID NO: 2169090 - DNA, 17 bp, Homo sapiens
tcttgattttcaagctt

SEQ ID NO: 2169091 - DNA, 19 bp, Homo sapiens
tcttgattttcaagctttc

SEQ ID NO: 2169092 - DNA, 16 bp, Homo sapiens
tcttgtactgtgacct

SEQ ID NO: 2169093 - DNA, 22 bp, Homo sapiens
tcttgtactgtgacctaagaac

SEQ ID NO: 2169094 - DNA, 22 bp, Homo sapiens
tctttagacaaccctgaggtat

SEQ ID NO: 2169095 - DNA, 20 bp, Homo sapiens
tctttagtgttcaaatactt

SEQ ID NO: 2169096 - DNA, 18 bp, Homo sapiens
tctttccatgcagttatt

SEQ ID NO: 2169097 - DNA, 13 bp, Homo sapiens
tctttccggccaa

SEQ ID NO: 2169098 - DNA, 15 bp, Homo sapiens
tctttccggccaagg

SEQ ID NO: 2169099 - DNA, 15 bp, Homo sapiens
tctttctttttctgt

SEQ ID NO: 2169100 - DNA, 19 bp, Homo sapiens
tctttctttttctgtctct

SEQ ID NO: 2169101 - DNA, 20 bp, Homo sapiens
tctttgagtcaagtcaaata

SEQ ID NO: 2169102 - DNA, 22 bp, Homo sapiens
tctttgtaaggacttgtgcctc

SEQ ID NO: 2169103 - DNA, 12 bp, Homo sapiens
tctttgtgaaat

SEQ ID NO: 2169104 - DNA, 14 bp, Homo sapiens
tctttgtgtgctgt

SEQ ID NO: 2169105 - DNA, 17 bp, Homo sapiens
tctttgttccactggaa

SEQ ID NO: 2169106 - DNA, 11 bp, Homo sapiens
tcttttactgt

SEQ ID NO: 2169107 - DNA, 17 bp, Homo sapiens
tcttttgaataatgtag

SEQ ID NO: 2169108 - DNA, 22 bp, Homo sapiens
tcttttgaccccttcctgtctg

SEQ ID NO: 2169109 - DNA, 13 bp, Homo sapiens
tcttttgtacttt

SEQ ID NO: 2169110 - DNA, 19 bp, Homo sapiens
tgaaaagaaaatgtgccat

SEQ ID NO: 2169111 - DNA, 15 bp, Homo sapiens
tgaaaagattgcaaa

SEQ ID NO: 2169112 - DNA, 17 bp, Homo sapiens
tgaaaagattgcaaagg

SEQ ID NO: 2169113 - DNA, 17 bp, Homo sapiens
tgaaaattgtataaatt

SEQ ID NO: 2169114 - DNA, 22 bp, Homo sapiens
tgaaacagtgtttggtgacata

SEQ ID NO: 2169115 - DNA, 18 bp, Homo sapiens
tgaaactgctaattacac

SEQ ID NO: 2169116 - DNA, 18 bp, Homo sapiens
tgaaacttcaagcaccag

SEQ ID NO: 2169117 - DNA, 17 bp, Homo sapiens
tgaaacttggttcccag

SEQ ID NO: 2169118 - DNA, 19 bp, Homo sapiens
tgaaacttggttcccagaa

SEQ ID NO: 2169119 - DNA, 21 bp, Homo sapiens
tgaaagaaaggggcaggagct

SEQ ID NO: 2169120 - DNA, 14 bp, Homo sapiens
tgaaagaagcaaga

SEQ ID NO: 2169121 - DNA, 16 bp, Homo sapiens
tgaaagaagcaagaca

SEQ ID NO: 2169122 - DNA, 15 bp, Homo sapiens
tgaaagctttaatgt

SEQ ID NO: 2169123 - DNA, 22 bp, Homo sapiens
tgaaagtggggtgttgaagacc

SEQ ID NO: 2169124 - DNA, 23 bp, Homo sapiens
tgaaatgggaacaatatcaatat

SEQ ID NO: 2169125 - DNA, 14 bp, Homo sapiens
tgaaatgtaatttc

SEQ ID NO: 2169126 - DNA, 19 bp, Homo sapiens
tgaaatgtaatttcagttc

SEQ ID NO: 2169127 - DNA, 19 bp, Homo sapiens
tgaaattcctctgtagaat

SEQ ID NO: 2169128 - DNA, 15 bp, Homo sapiens
tgaaatttgttaata

SEQ ID NO: 2169129 - DNA, 13 bp, Homo sapiens
tgaaattttctag

SEQ ID NO: 2169130 - DNA, 16 bp, Homo sapiens
tgaaattttctagaat

SEQ ID NO: 2169131 - DNA, 18 bp, Homo sapiens
tgaaattttctagaatac

SEQ ID NO: 2169132 - DNA, 20 bp, Homo sapiens
tgaaattttctagaatacta

SEQ ID NO: 2169133 - DNA, 21 bp, Homo sapiens
tgaacaaaagcaggtttttat

SEQ ID NO: 2169134 - DNA, 13 bp, Homo sapiens
tgaacatttttaa

SEQ ID NO: 2169135 - DNA, 18 bp, Homo sapiens
tgaaccgctacaagaggg

SEQ ID NO: 2169136 - DNA, 20 bp, Homo sapiens
tgaacctgttcaaaatgtta

SEQ ID NO: 2169137 - DNA, 21 bp, Homo sapiens
tgaactcctagactcaagtga

SEQ ID NO: 2169138 - DNA, 23 bp, Homo sapiens
tgaacttggtagttcataaaggt

SEQ ID NO: 2169139 - DNA, 21 bp, Homo sapiens
tgaagataagtaatttacctg

SEQ ID NO: 2169140 - DNA, 16 bp, Homo sapiens
tgaagccatgtagcca

SEQ ID NO: 2169141 - DNA, 19 bp, Homo sapiens
tgaagccatgtagccaccc

SEQ ID NO: 2169142 - DNA, 11 bp, Homo sapiens
tgaagctgggg

SEQ ID NO: 2169143 - DNA, 23 bp, Homo sapiens
tgaagctggggacagctttcctg

SEQ ID NO: 2169144 - DNA, 19 bp, Homo sapiens
tgaaggcagtggcagggga

SEQ ID NO: 2169145 - DNA, 16 bp, Homo sapiens
tgaaggcttttgatcc

SEQ ID NO: 2169146 - DNA, 23 bp, Homo sapiens
tgaaggttggaactgctgccatg

SEQ ID NO: 2169147 - DNA, 17 bp, Homo sapiens
tgaagtatctgtacctg

SEQ ID NO: 2169148 - DNA, 14 bp, Homo sapiens
tgaagtatgcacta

SEQ ID NO: 2169149 - DNA, 22 bp, Homo sapiens
tgaagtctcaagaactgccata

SEQ ID NO: 2169150 - DNA, 19 bp, Homo sapiens
tgaagtgaacaaatttcaa

SEQ ID NO: 2169151 - DNA, 20 bp, Homo sapiens
tgaagtgaacaaatttcaaa

SEQ ID NO: 2169152 - DNA, 18 bp, Homo sapiens
tgaagtgaatacatggta

SEQ ID NO: 2169153 - DNA, 18 bp, Homo sapiens
tgaagttttattttaaat

SEQ ID NO: 2169154 - DNA, 18 bp, Homo sapiens
tgaatacatggtagcagg

SEQ ID NO: 2169155 - DNA, 21 bp, Homo sapiens
tgaataggcattaaatgcaaa

SEQ ID NO: 2169156 - DNA, 12 bp, Homo sapiens
tgaatatactgt

SEQ ID NO: 2169157 - DNA, 20 bp, Homo sapiens
tgaatatatgatttgcatgt

SEQ ID NO: 2169158 - DNA, 13 bp, Homo sapiens
tgaatatttgtaa

SEQ ID NO: 2169159 - DNA, 22 bp, Homo sapiens
tgaatgaccacttgatatgact

SEQ ID NO: 2169160 - DNA, 19 bp, Homo sapiens
tgaatgcctcgctcccttc

SEQ ID NO: 2169161 - DNA, 22 bp, Homo sapiens
tgaatgctgtacctttctgaca

SEQ ID NO: 2169162 - DNA, 15 bp, Homo sapiens
tgaattttacaaaaa

SEQ ID NO: 2169163 - DNA, 14 bp, Homo sapiens
tgacaataaataat

SEQ ID NO: 2169164 - DNA, 18 bp, Homo sapiens
tgacactgcgaactctca

SEQ ID NO: 2169165 - DNA, 14 bp, Homo sapiens
tgacagatgttcca

SEQ ID NO: 2169166 - DNA, 20 bp, Homo sapiens
tgacatttgtcctgcagagc

SEQ ID NO: 2169167 - DNA, 16 bp, Homo sapiens
tgaccaggctgcctcc

SEQ ID NO: 2169168 - DNA, 21 bp, Homo sapiens
tgacccacccgccttggcctc

SEQ ID NO: 2169169 - DNA, 14 bp, Homo sapiens
tgaccccttcctgt

SEQ ID NO: 2169170 - DNA, 22 bp, Homo sapiens
tgacccggcccccgccctctgc

SEQ ID NO: 2169171 - DNA, 14 bp, Homo sapiens
tgaccggaggcaaa

SEQ ID NO: 2169172 - DNA, 20 bp, Homo sapiens
tgaccggcctggaccttggc

SEQ ID NO: 2169173 - DNA, 13 bp, Homo sapiens
tgacctaagaaca

SEQ ID NO: 2169174 - DNA, 14 bp, Homo sapiens
tgacctaagaacaa

SEQ ID NO: 2169175 - DNA, 19 bp, Homo sapiens
tgacctcccactttgggga

SEQ ID NO: 2169176 - DNA, 15 bp, Homo sapiens
tgaccttaatttctt

SEQ ID NO: 2169177 - DNA, 15 bp, Homo sapiens
tgacgaggctgggcc

SEQ ID NO: 2169178 - DNA, 20 bp, Homo sapiens
tgacgggggttggggtgggg

SEQ ID NO: 2169179 - DNA, 20 bp, Homo sapiens
tgactaccacttatttctaa

SEQ ID NO: 2169180 - DNA, 15 bp, Homo sapiens
tgactataacaaaat

SEQ ID NO: 2169181 - DNA, 19 bp, Homo sapiens
tgactataacaaaatctgg

SEQ ID NO: 2169182 - DNA, 17 bp, Homo sapiens
tgactcccaaagagctg

SEQ ID NO: 2169183 - DNA, 22 bp, Homo sapiens
tgactcccaaagagctgcctaa

SEQ ID NO: 2169184 - DNA, 22 bp, Homo sapiens
tgactcctgctggtacctgccc

SEQ ID NO: 2169185 - DNA, 14 bp, Homo sapiens
tgactgaagtactg

SEQ ID NO: 2169186 - DNA, 15 bp, Homo sapiens
tgactgccaagccag

SEQ ID NO: 2169187 - DNA, 21 bp, Homo sapiens
tgactgccaagccagattctc

SEQ ID NO: 2169188 - DNA, 13 bp, Homo sapiens
tgactgtgattta

SEQ ID NO: 2169189 - DNA, 14 bp, Homo sapiens
tgactgtgatttat

SEQ ID NO: 2169190 - DNA, 20 bp, Homo sapiens
tgacttagttcttagaagct

SEQ ID NO: 2169191 - DNA, 15 bp, Homo sapiens
tgacttccctccacc

SEQ ID NO: 2169192 - DNA, 16 bp, Homo sapiens
tgacttttaaaatttg

SEQ ID NO: 2169193 - DNA, 21 bp, Homo sapiens
tgagaaaacgaaactgctcta

SEQ ID NO: 2169194 - DNA, 22 bp, Homo sapiens
tgagaattcagctgcccccgct

SEQ ID NO: 2169195 - DNA, 23 bp, Homo sapiens
tgagacacagagtggagccctca

SEQ ID NO: 2169196 - DNA, 21 bp, Homo sapiens
tgagacagccggatcttggag

SEQ ID NO: 2169197 - DNA, 20 bp, Homo sapiens
tgagaccaagccggtgccca

SEQ ID NO: 2169198 - DNA, 15 bp, Homo sapiens
tgagactacaggtga

SEQ ID NO: 2169199 - DNA, 13 bp, Homo sapiens
tgagactcctgat

SEQ ID NO: 2169200 - DNA, 17 bp, Homo sapiens
tgagagaaagagagaag

SEQ ID NO: 2169201 - DNA, 21 bp, Homo sapiens
tgagagaaagagagaagccag

SEQ ID NO: 2169202 - DNA, 16 bp, Homo sapiens
tgagagcgctggcctc

SEQ ID NO: 2169203 - DNA, 21 bp, Homo sapiens
tgagatgtagcaaattccaat

SEQ ID NO: 2169204 - DNA, 19 bp, Homo sapiens
tgcccagcagtttcccaga

SEQ ID NO: 2169205 - DNA, 21 bp, Homo sapiens
tgcccagctcagtcttcccta

SEQ ID NO: 2169206 - DNA, 18 bp, Homo sapiens
tgcccagtcatgacattt

SEQ ID NO: 2169207 - DNA, 22 bp, Homo sapiens
tgcccagtcatgacatttctca

SEQ ID NO: 2169208 - DNA, 18 bp, Homo sapiens
tgcccagtgatggcatta

SEQ ID NO: 2169209 - DNA, 16 bp, Homo sapiens
tgccccacctgccact

SEQ ID NO: 2169210 - DNA, 21 bp, Homo sapiens
tgccccacctgccactaggct

SEQ ID NO: 2169211 - DNA, 20 bp, Homo sapiens
tgccccatcagcagcttgac

SEQ ID NO: 2169212 - DNA, 18 bp, Homo sapiens
tgccccccctaagagaca

SEQ ID NO: 2169213 - DNA, 20 bp, Homo sapiens
tgccccccctaagagacaca

SEQ ID NO: 2169214 - DNA, 16 bp, Homo sapiens
tgcccgccctccctcc

SEQ ID NO: 2169215 - DNA, 17 bp, Homo sapiens
tgcccgccctccctcct

SEQ ID NO: 2169216 - DNA, 21 bp, Homo sapiens
tgcccgccctccctcctgcct

SEQ ID NO: 2169217 - DNA, 19 bp, Homo sapiens
tgcccggctaatgtttgta

SEQ ID NO: 2169218 - DNA, 14 bp, Homo sapiens
tgccctcatttgtg

SEQ ID NO: 2169219 - DNA, 14 bp, Homo sapiens
tgccctccactgcc

SEQ ID NO: 2169220 - DNA, 15 bp, Homo sapiens
tgccctcccatcccg

SEQ ID NO: 2169221 - DNA, 22 bp, Homo sapiens
tgccctctatttattagccaac

SEQ ID NO: 2169222 - DNA, 14 bp, Homo sapiens
tgccctctctcagt

SEQ ID NO: 2169223 - DNA, 15 bp, Homo sapiens
tgccctgccctcctg

SEQ ID NO: 2169224 - DNA, 20 bp, Homo sapiens
tgcccttacacttactgttg

SEQ ID NO: 2169225 - DNA, 20 bp, Homo sapiens
tgccgcactagcctccctct

SEQ ID NO: 2169226 - DNA, 23 bp, Homo sapiens
tgccgcctgtgcccttgctgggt

SEQ ID NO: 2169227 - DNA, 14 bp, Homo sapiens
tgccgctgggagag

SEQ ID NO: 2169228 - DNA, 22 bp, Homo sapiens
tgccggctgcaccctgtatgga

SEQ ID NO: 2169229 - DNA, 22 bp, Homo sapiens
tgcctatttattcattcagtga

SEQ ID NO: 2169230 - DNA, 16 bp, Homo sapiens
tgcctcagcctcccga

SEQ ID NO: 2169231 - DNA, 15 bp, Homo sapiens
tgcctcagtctgctt

SEQ ID NO: 2169232 - DNA, 14 bp, Homo sapiens
tgcctccatggtgc

SEQ ID NO: 2169233 - DNA, 15 bp, Homo sapiens
tgcctccctgtccac

SEQ ID NO: 2169234 - DNA, 16 bp, Homo sapiens
tgcctccctgtccacc

SEQ ID NO: 2169235 - DNA, 16 bp, Homo sapiens
tgcctctgtttgacaa

SEQ ID NO: 2169236 - DNA, 15 bp, Homo sapiens
tgcctcttgggagac

SEQ ID NO: 2169237 - DNA, 19 bp, Homo sapiens
tgcctgcgcagctccttcc

SEQ ID NO: 2169238 - DNA, 14 bp, Homo sapiens
tgcctggcctggca

SEQ ID NO: 2169239 - DNA, 18 bp, Homo sapiens
tgcctgggaaccttcctg

SEQ ID NO: 2169240 - DNA, 17 bp, Homo sapiens
tgccttaaagtcagtaa

SEQ ID NO: 2169241 - DNA, 18 bp, Homo sapiens
tgccttatgtaattattt

SEQ ID NO: 2169242 - DNA, 16 bp, Homo sapiens
tgccttccttagcagc

SEQ ID NO: 2169243 - DNA, 17 bp, Homo sapiens
tgccttccttagcagct

SEQ ID NO: 2169244 - DNA, 12 bp, Homo sapiens
tgccttccttgc

SEQ ID NO: 2169245 - DNA, 22 bp, Homo sapiens
tgccttctagattcactgtctt

SEQ ID NO: 2169246 - DNA, 13 bp, Homo sapiens
tgccttctgggca

SEQ ID NO: 2169247 - DNA, 17 bp, Homo sapiens
tgccttgctgcacctga

SEQ ID NO: 2169248 - DNA, 13 bp, Homo sapiens
tgcgaactgtgca

SEQ ID NO: 2169249 - DNA, 20 bp, Homo sapiens
tgcgaccagaggtgggaggc

SEQ ID NO: 2169250 - DNA, 15 bp, Homo sapiens
tgcgatcatggctca

SEQ ID NO: 2169251 - DNA, 21 bp, Homo sapiens
tgcgatcatggctcactgcag

SEQ ID NO: 2169252 - DNA, 12 bp, Homo sapiens
tgcgatgtgttt

SEQ ID NO: 2169253 - DNA, 17 bp, Homo sapiens
tgcgcagggctctttga

SEQ ID NO: 2169254 - DNA, 15 bp, Homo sapiens
tgcggatcctgctgg

SEQ ID NO: 2169255 - DNA, 19 bp, Homo sapiens
tgcggctgctggcacagac

SEQ ID NO: 2169256 - DNA, 14 bp, Homo sapiens
tgcggtctagggaa

SEQ ID NO: 2169257 - DNA, 14 bp, Homo sapiens
tgcgtcatggctca

SEQ ID NO: 2169258 - DNA, 13 bp, Homo sapiens
tgcgtgtctgttt

SEQ ID NO: 2169259 - DNA, 16 bp, Homo sapiens
tgcgtgtctgtttcct

SEQ ID NO: 2169260 - DNA, 22 bp, Homo sapiens
tgctaaccccgtctgctcctcc

SEQ ID NO: 2169261 - DNA, 19 bp, Homo sapiens
tgctaatctctcttttgtt

SEQ ID NO: 2169262 - DNA, 21 bp, Homo sapiens
tgctacaaatagtgctaataa

SEQ ID NO: 2169263 - DNA, 18 bp, Homo sapiens
tgctagccactggaaatg

SEQ ID NO: 2169264 - DNA, 17 bp, Homo sapiens
tgctatctcgctagcca

SEQ ID NO: 2169265 - DNA, 15 bp, Homo sapiens
tgctcagctggccgg

SEQ ID NO: 2169266 - DNA, 14 bp, Homo sapiens
tgctcagttccaat

SEQ ID NO: 2169267 - DNA, 15 bp, Homo sapiens
tgctccaccccactc

SEQ ID NO: 2169268 - DNA, 17 bp, Homo sapiens
tgctcccagatgccttc

SEQ ID NO: 2169269 - DNA, 18 bp, Homo sapiens
tgctccgaggacccagga

SEQ ID NO: 2169270 - DNA, 14 bp, Homo sapiens
tgctcctccctccc

SEQ ID NO: 2169271 - DNA, 14 bp, Homo sapiens
tgctctatatgtaa

SEQ ID NO: 2169272 - DNA, 14 bp, Homo sapiens
tgctctcaaaatgt

SEQ ID NO: 2169273 - DNA, 17 bp, Homo sapiens
tgctctctacccagccc

SEQ ID NO: 2169274 - DNA, 20 bp, Homo sapiens
tgctctctacccagcccatc

SEQ ID NO: 2169275 - DNA, 22 bp, Homo sapiens
tgctctctacccagcccatctt

SEQ ID NO: 2169276 - DNA, 20 bp, Homo sapiens
tgctctgaatgggagccaga

SEQ ID NO: 2169277 - DNA, 17 bp, Homo sapiens
tgctctgcccagagctg

SEQ ID NO: 2169278 - DNA, 17 bp, Homo sapiens
tgctctggaagcctgct

SEQ ID NO: 2169279 - DNA, 15 bp, Homo sapiens
tgctgaactgtgcat

SEQ ID NO: 2169280 - DNA, 23 bp, Homo sapiens
tgctgaatgcctcgctcccttca

SEQ ID NO: 2169281 - DNA, 20 bp, Homo sapiens
tgctgagcacacaacaggct

SEQ ID NO: 2169282 - DNA, 20 bp, Homo sapiens
tgctgcacaccagttactgt

SEQ ID NO: 2169283 - DNA, 17 bp, Homo sapiens
tgctgcacctgaggccc

SEQ ID NO: 2169284 - DNA, 13 bp, Homo sapiens
tgctgcagactca

SEQ ID NO: 2169285 - DNA, 19 bp, Homo sapiens
tgctggacaggtctgggag

SEQ ID NO: 2169286 - DNA, 19 bp, Homo sapiens
tgctggagccactaactag

SEQ ID NO: 2169287 - DNA, 17 bp, Homo sapiens
tgctggccgggcacagc

SEQ ID NO: 2169288 - DNA, 15 bp, Homo sapiens
tgctgggattacagg

SEQ ID NO: 2169289 - DNA, 19 bp, Homo sapiens
tgctgggattacaggtgtg

SEQ ID NO: 2169290 - DNA, 13 bp, Homo sapiens
tgctgggtttcca

SEQ ID NO: 2169291 - DNA, 15 bp, Homo sapiens
tgctgggtttccaca

SEQ ID NO: 2169292 - DNA, 13 bp, Homo sapiens
tgctggtacctgc

SEQ ID NO: 2169293 - DNA, 23 bp, Homo sapiens
tgctgtcagaccttcttccacag

SEQ ID NO: 2169294 - DNA, 20 bp, Homo sapiens
tgctgtcagccctgctgtca

SEQ ID NO: 2169295 - DNA, 18 bp, Homo sapiens
tgctgtgaattagctcac

SEQ ID NO: 2169296 - DNA, 19 bp, Homo sapiens
tgctgtgaattagctcact

SEQ ID NO: 2169297 - DNA, 12 bp, Homo sapiens
tgctgtggattt

SEQ ID NO: 2169298 - DNA, 23 bp, Homo sapiens
tgctgtgggtcagtgtgccaccc

SEQ ID NO: 2169299 - DNA, 17 bp, Homo sapiens
tgctgttgtctgccgtg

SEQ ID NO: 2169300 - DNA, 17 bp, Homo sapiens
tgctgttgttcagaagt

SEQ ID NO: 2169301 - DNA, 18 bp, Homo sapiens
tgctgttgttcagaagtt

SEQ ID NO: 2169302 - DNA, 21 bp, Homo sapiens
tgctgttgttgttaattttgt

SEQ ID NO: 2169303 - DNA, 17 bp, Homo sapiens
tgcttaaacaaaactgg

SEQ ID NO: 2169304 - DNA, 14 bp, Homo sapiens
tgcttcagcttgct

SEQ ID NO: 2169305 - DNA, 15 bp, Homo sapiens
tgcttcagcttgctt

SEQ ID NO: 2169306 - DNA, 13 bp, Homo sapiens
tgcttccaacagg

SEQ ID NO: 2169307 - DNA, 17 bp, Homo sapiens
tgcttggggcctggcgt

SEQ ID NO: 2169308 - DNA, 20 bp, Homo sapiens
tgctttctcctttaattgta

SEQ ID NO: 2169309 - DNA, 15 bp, Homo sapiens
tgctttgctttgtag

SEQ ID NO: 2169310 - DNA, 11 bp, Homo sapiens
tgctttgtagg

SEQ ID NO: 2169311 - DNA, 21 bp, Homo sapiens
tgctttgtagtttgctttgct

SEQ ID NO: 2169312 - DNA, 19 bp, Homo sapiens
tgctttgttctttatttgt

SEQ ID NO: 2169313 - DNA, 13 bp, Homo sapiens
tgcttttaagttt

SEQ ID NO: 2169314 - DNA, 15 bp, Homo sapiens
tggaaaaaaaaagaa

SEQ ID NO: 2169315 - DNA, 19 bp, Homo sapiens
tggaaaaattaagttgttg

SEQ ID NO: 2169316 - DNA, 14 bp, Homo sapiens
tggaaacttagagt

SEQ ID NO: 2169317 - DNA, 16 bp, Homo sapiens
tggaaatccagctggt

SEQ ID NO: 2169318 - DNA, 14 bp, Homo sapiens
tggaactgctgcca

SEQ ID NO: 2169319 - DNA, 14 bp, Homo sapiens
tggaagcctgctga

SEQ ID NO: 2169320 - DNA, 14 bp, Homo sapiens
tggaagctagctcc

SEQ ID NO: 2169321 - DNA, 13 bp, Homo sapiens
tggaaggagcctg

SEQ ID NO: 2169322 - DNA, 14 bp, Homo sapiens
tggaaggagcctgc

SEQ ID NO: 2169323 - DNA, 17 bp, Homo sapiens
tggaagggaagaaaagg

SEQ ID NO: 2169324 - DNA, 16 bp, Homo sapiens
tggaatcgaggctgtg

SEQ ID NO: 2169325 - DNA, 15 bp, Homo sapiens
tggaattttgcaaag

SEQ ID NO: 2169326 - DNA, 15 bp, Homo sapiens
tggacacacacagct

SEQ ID NO: 2169327 - DNA, 16 bp, Homo sapiens
tggacaggtctgggag

SEQ ID NO: 2169328 - DNA, 22 bp, Homo sapiens
tggacaggtctgggagaggcag

SEQ ID NO: 2169329 - DNA, 23 bp, Homo sapiens
tgggatcggacctcagtttctgt

SEQ ID NO: 2169330 - DNA, 18 bp, Homo sapiens
tgggatctgcccctccct

SEQ ID NO: 2169331 - DNA, 22 bp, Homo sapiens
tgggcaccaagagccaatggag

SEQ ID NO: 2169332 - DNA, 14 bp, Homo sapiens
tgggcagaggggag

SEQ ID NO: 2169333 - DNA, 16 bp, Homo sapiens
tgggcagaggggagag

SEQ ID NO: 2169334 - DNA, 17 bp, Homo sapiens
tgggcagaggggagagg

SEQ ID NO: 2169335 - DNA, 19 bp, Homo sapiens
tgggcagaggggagaggaa

SEQ ID NO: 2169336 - DNA, 16 bp, Homo sapiens
tgggcagatctacccc

SEQ ID NO: 2169337 - DNA, 16 bp, Homo sapiens
tgggcagccatgagaa

SEQ ID NO: 2169338 - DNA, 17 bp, Homo sapiens
tgggcagctgaacagtg

SEQ ID NO: 2169339 - DNA, 21 bp, Homo sapiens
tgggcagggaggcaccattca

SEQ ID NO: 2169340 - DNA, 20 bp, Homo sapiens
tgggcaggggttccagcttc

SEQ ID NO: 2169341 - DNA, 22 bp, Homo sapiens
tgggcataagcaaactatattt

SEQ ID NO: 2169342 - DNA, 19 bp, Homo sapiens
tgggccactggcatctctg

SEQ ID NO: 2169343 - DNA, 18 bp, Homo sapiens
tgggccatagctcctgct

SEQ ID NO: 2169344 - DNA, 19 bp, Homo sapiens
tgggcccagaggcacagcc

SEQ ID NO: 2169345 - DNA, 19 bp, Homo sapiens
tgggccccgggctggagaa

SEQ ID NO: 2169346 - DNA, 13 bp, Homo sapiens
tgggccctgcctc

SEQ ID NO: 2169347 - DNA, 11 bp, Homo sapiens
tgggcctcagg

SEQ ID NO: 2169348 - DNA, 19 bp, Homo sapiens
tgggcctcaggctctgcac

SEQ ID NO: 2169349 - DNA, 23 bp, Homo sapiens
tgggctcaagcaatcctcctgag

SEQ ID NO: 2169350 - DNA, 15 bp, Homo sapiens
tgggctctggctccc

SEQ ID NO: 2169351 - DNA, 22 bp, Homo sapiens
tgggcttatatctggcctctgc

SEQ ID NO: 2169352 - DNA, 12 bp, Homo sapiens
tgggcttggcca

SEQ ID NO: 2169353 - DNA, 22 bp, Homo sapiens
tggggacctggggtggggaggc

SEQ ID NO: 2169354 - DNA, 17 bp, Homo sapiens
tggggactaagggaaga

SEQ ID NO: 2169355 - DNA, 18 bp, Homo sapiens
tggggagacacctcagag

SEQ ID NO: 2169356 - DNA, 20 bp, Homo sapiens
tggggagacacctcagagcc

SEQ ID NO: 2169357 - DNA, 15 bp, Homo sapiens
tggggatgaggtcac

SEQ ID NO: 2169358 - DNA, 19 bp, Homo sapiens
tggggatgtaaccaagctg

SEQ ID NO: 2169359 - DNA, 14 bp, Homo sapiens
tggggccacagcca

SEQ ID NO: 2169360 - DNA, 15 bp, Homo sapiens
tggggcccaggggct

SEQ ID NO: 2169361 - DNA, 22 bp, Homo sapiens
tggggcggtcaataattgtgga

SEQ ID NO: 2169362 - DNA, 17 bp, Homo sapiens
tggggctgcgcagggct

SEQ ID NO: 2169363 - DNA, 17 bp, Homo sapiens
tgggggaaatggtgcct

SEQ ID NO: 2169364 - DNA, 22 bp, Homo sapiens
tgggggatttcaagggactggg

SEQ ID NO: 2169365 - DNA, 18 bp, Homo sapiens
ttgaagtatctgtacctg

SEQ ID NO: 2169366 - DNA, 18 bp, Homo sapiens
ttgaagtcccaatttaag

SEQ ID NO: 2169367 - DNA, 15 bp, Homo sapiens
ttgaataaagtattc

SEQ ID NO: 2169368 - DNA, 18 bp, Homo sapiens
ttgaatagagaagtgtga

SEQ ID NO: 2169369 - DNA, 22 bp, Homo sapiens
ttgaataggcattaaatgcaaa

SEQ ID NO: 2169370 - DNA, 17 bp, Homo sapiens
ttgaccaaactgtgggt

SEQ ID NO: 2169371 - DNA, 17 bp, Homo sapiens
ttgaccacggctgttcc

SEQ ID NO: 2169372 - DNA, 15 bp, Homo sapiens
ttgaccagtttcttt

SEQ ID NO: 2169373 - DNA, 15 bp, Homo sapiens
ttgactataacaaaa

SEQ ID NO: 2169374 - DNA, 17 bp, Homo sapiens
ttgactcattaatttct

SEQ ID NO: 2169375 - DNA, 16 bp, Homo sapiens
ttgactggctttcctc

SEQ ID NO: 2169376 - DNA, 23 bp, Homo sapiens
ttgagaccaagccggtgcccacc

SEQ ID NO: 2169377 - DNA, 16 bp, Homo sapiens
ttgagctcttcattta

SEQ ID NO: 2169378 - DNA, 12 bp, Homo sapiens
ttgagcttgctg

SEQ ID NO: 2169379 - DNA, 20 bp, Homo sapiens
ttgagtttcttctaaagagg

SEQ ID NO: 2169380 - DNA, 17 bp, Homo sapiens
ttgataataaaattcat

SEQ ID NO: 2169381 - DNA, 19 bp, Homo sapiens
ttgataggagacttgtaca

SEQ ID NO: 2169382 - DNA, 21 bp, Homo sapiens
ttgatatattctttccatgca

SEQ ID NO: 2169383 - DNA, 14 bp, Homo sapiens
ttgatatttgtgta

SEQ ID NO: 2169384 - DNA, 12 bp, Homo sapiens
ttgatcagaatc

SEQ ID NO: 2169385 - DNA, 14 bp, Homo sapiens
ttgatctgaaattc

SEQ ID NO: 2169386 - DNA, 15 bp, Homo sapiens
ttgatgtcattttgt

SEQ ID NO: 2169387 - DNA, 15 bp, Homo sapiens
ttgatgtgtatgtgt

SEQ ID NO: 2169388 - DNA, 22 bp, Homo sapiens
ttgatgtgtatgtgtttataat

SEQ ID NO: 2169389 - DNA, 17 bp, Homo sapiens
ttgattccattttaagt

SEQ ID NO: 2169390 - DNA, 14 bp, Homo sapiens
ttgattgttcatat

SEQ ID NO: 2169391 - DNA, 14 bp, Homo sapiens
ttgattttcaagct

SEQ ID NO: 2169392 - DNA, 15 bp, Homo sapiens
ttgcaaaagaagttg

SEQ ID NO: 2169393 - DNA, 20 bp, Homo sapiens
ttgcaaattccacccctcct

SEQ ID NO: 2169394 - DNA, 13 bp, Homo sapiens
ttgcaaccaggaa

SEQ ID NO: 2169395 - DNA, 11 bp, Homo sapiens
ttgcagctgct

SEQ ID NO: 2169396 - DNA, 14 bp, Homo sapiens
ttgcagctgctggt

SEQ ID NO: 2169397 - DNA, 16 bp, Homo sapiens
ttgcagtatgatggca

SEQ ID NO: 2169398 - DNA, 16 bp, Homo sapiens
ttgcagttcatactga

SEQ ID NO: 2169399 - DNA, 17 bp, Homo sapiens
ttgccaactaattttaa

SEQ ID NO: 2169400 - DNA, 19 bp, Homo sapiens
ttgccaaggccgcccacct

SEQ ID NO: 2169401 - DNA, 24 bp, Homo sapiens
ttgccatttcttcccaaggccagt

SEQ ID NO: 2169402 - DNA, 13 bp, Homo sapiens
ttgcccaacctca

SEQ ID NO: 2169403 - DNA, 16 bp, Homo sapiens
ttgcccaacctcagca

SEQ ID NO: 2169404 - DNA, 12 bp, Homo sapiens
ttgccctcccat

SEQ ID NO: 2169405 - DNA, 14 bp, Homo sapiens
ttgccgctgggaga

SEQ ID NO: 2169406 - DNA, 15 bp, Homo sapiens
ttgccgctgggagag

SEQ ID NO: 2169407 - DNA, 19 bp, Homo sapiens
ttgccttttgcaaccagga

SEQ ID NO: 2169408 - DNA, 12 bp, Homo sapiens
ttgcgatgtgtt

SEQ ID NO: 2169409 - DNA, 12 bp, Homo sapiens
ttgcgtgtctgt

SEQ ID NO: 2169410 - DNA, 16 bp, Homo sapiens
ttgcgtgtctgtttcc

SEQ ID NO: 2169411 - DNA, 21 bp, Homo sapiens
ttgcgtgtgtcataaagttga

SEQ ID NO: 2169412 - DNA, 18 bp, Homo sapiens
ttgctaatcgggttgtca

SEQ ID NO: 2169413 - DNA, 13 bp, Homo sapiens
ttgctcccagttt

SEQ ID NO: 2169414 - DNA, 23 bp, Homo sapiens
ttgctctatatgtaatatatcct

SEQ ID NO: 2169415 - DNA, 20 bp, Homo sapiens
ttgctgttgttgttaatttt

SEQ ID NO: 2169416 - DNA, 19 bp, Homo sapiens
ttgcttttacggtgatatt

SEQ ID NO: 2169417 - DNA, 22 bp, Homo sapiens
ttgcttttacggtgatattgtg

SEQ ID NO: 2169418 - DNA, 22 bp, Homo sapiens
ttggaaagcacaaacttctgta

SEQ ID NO: 2169419 - DNA, 15 bp, Homo sapiens
ttggaactgctgcca

SEQ ID NO: 2169420 - DNA, 23 bp, Homo sapiens
ttggaggcccttttctggctcct

SEQ ID NO: 2169421 - DNA, 24 bp, Homo sapiens
ttggaggcccttttctggctcctg

SEQ ID NO: 2169422 - DNA, 13 bp, Homo sapiens
ttggaggcctcac

SEQ ID NO: 2169423 - DNA, 20 bp, Homo sapiens
ttggaggcctcaccctgctt

SEQ ID NO: 2169424 - DNA, 23 bp, Homo sapiens
ttggaggcctcaccctgcttggg

SEQ ID NO: 2169425 - DNA, 19 bp, Homo sapiens
ttggaggggtttatgctca

SEQ ID NO: 2169426 - DNA, 19 bp, Homo sapiens
ttggagtggaggcattgtt

SEQ ID NO: 2169427 - DNA, 20 bp, Homo sapiens
ttggcaattcttcttctcaa

SEQ ID NO: 2169428 - DNA, 22 bp, Homo sapiens
ttggccactttgcagacctggg

SEQ ID NO: 2169429 - DNA, 14 bp, Homo sapiens
ttggcgttgtgggc

SEQ ID NO: 2169430 - DNA, 17 bp, Homo sapiens
ttggctcgggacttcaa

SEQ ID NO: 2169431 - DNA, 21 bp, Homo sapiens
ttggctttcatgaggaggcag

SEQ ID NO: 2169432 - DNA, 13 bp, Homo sapiens
ttgggactgtctt

SEQ ID NO: 2169433 - DNA, 23 bp, Homo sapiens
ttgggcctcaggctctgcacaga

SEQ ID NO: 2169434 - DNA, 23 bp, Homo sapiens
ttggtgtgttcgtggagccacag

SEQ ID NO: 2169435 - DNA, 17 bp, Homo sapiens
ttggttaatcacttaac

SEQ ID NO: 2169436 - DNA, 13 bp, Homo sapiens
ttggttcccagaa

SEQ ID NO: 2169437 - DNA, 23 bp, Homo sapiens
ttggttctgaagccatgtagcca

SEQ ID NO: 2169438 - DNA, 15 bp, Homo sapiens
ttggtttttctcttt

SEQ ID NO: 2169439 - DNA, 21 bp, Homo sapiens
ttgtaaaataaaaccaccaaa

SEQ ID NO: 2169440 - DNA, 14 bp, Homo sapiens
ttgtaaatacaatt

SEQ ID NO: 2169441 - DNA, 19 bp, Homo sapiens
ttgtaaatacaattcaaac

SEQ ID NO: 2169442 - DNA, 18 bp, Homo sapiens
ttgtaaggtattgcaagg

SEQ ID NO: 2169443 - DNA, 19 bp, Homo sapiens
ttgtaagtaaactgccctg

SEQ ID NO: 2169444 - DNA, 16 bp, Homo sapiens
ttgtaattagtaataa

SEQ ID NO: 2169445 - DNA, 16 bp, Homo sapiens
ttgtaatttaaaataa

SEQ ID NO: 2169446 - DNA, 17 bp, Homo sapiens
ttgtacgttcttctatt

SEQ ID NO: 2169447 - DNA, 11 bp, Homo sapiens
ttgtataaatt

SEQ ID NO: 2169448 - DNA, 16 bp, Homo sapiens
ttgtatataaatggtg

SEQ ID NO: 2169449 - DNA, 14 bp, Homo sapiens
ttgtatattgtaat

SEQ ID NO: 2169450 - DNA, 13 bp, Homo sapiens
ttgtatttaacag

SEQ ID NO: 2169451 - DNA, 18 bp, Homo sapiens
ttgtatttaacagaaatt

SEQ ID NO: 2169452 - DNA, 14 bp, Homo sapiens
ttgtcccacagctt

SEQ ID NO: 2169453 - DNA, 13 bp, Homo sapiens
ttgtcctgcagag

SEQ ID NO: 2169454 - DNA, 22 bp, Homo sapiens
ttgtcgttgactttagggactc

SEQ ID NO: 2169455 - DNA, 16 bp, Homo sapiens
ttgtctgctgctccca

SEQ ID NO: 2169456 - DNA, 20 bp, Homo sapiens
ttgtctggcaaggactttgt

SEQ ID NO: 2169457 - DNA, 16 bp, Homo sapiens
ttgtcttctccccagg

SEQ ID NO: 2169458 - DNA, 17 bp, Homo sapiens
ttgtgaacatgccttat

SEQ ID NO: 2169459 - DNA, 21 bp, Homo sapiens
ttgtgaagaaacatttatctt

SEQ ID NO: 2169460 - DNA, 22 bp, Homo sapiens
ttgtgaaggaaaaacatgctta

SEQ ID NO: 2169461 - DNA, 15 bp, Homo sapiens
ttgtgctttctatct

SEQ ID NO: 2169462 - DNA, 17 bp, Homo sapiens
ttgtgggtttctctgtg

SEQ ID NO: 2169463 - DNA, 22 bp, Homo sapiens
ttgtggtgatcgcacaaggaca

SEQ ID NO: 2169464 - DNA, 20 bp, Homo sapiens
ttgtgtacagtatgtgtcta

SEQ ID NO: 2169465 - DNA, 20 bp, Homo sapiens
ttgtgtgtcacaaagctaaa

SEQ ID NO: 2169466 - DNA, 12 bp, Homo sapiens
ttgtgtttgtat

SEQ ID NO: 2169467 - DNA, 18 bp, Homo sapiens
ttgtgtttgtatataaat

SEQ ID NO: 2169468 - DNA, 16 bp, Homo sapiens
ttgttaagaatttcaa

SEQ ID NO: 2169469 - DNA, 15 bp, Homo sapiens
ttgttaattaaatat

SEQ ID NO: 2169470 - DNA, 15 bp, Homo sapiens
ttgttttgtgacttt

SEQ ID NO: 2169471 - DNA, 16 bp, Homo sapiens
ttgtttttggtttctt

SEQ ID NO: 2169472 - DNA, 13 bp, Homo sapiens
tttaaaaatgtat

SEQ ID NO: 2169473 - DNA, 14 bp, Homo sapiens
tttaaaacatggca

SEQ ID NO: 2169474 - DNA, 20 bp, Homo sapiens
tttaaaatgaatcttatgca

SEQ ID NO: 2169475 - DNA, 22 bp, Homo sapiens
tttaaagacaaagacattattt

SEQ ID NO: 2169476 - DNA, 23 bp, Homo sapiens
tttaaagtaaaaggcactgcaca

SEQ ID NO: 2169477 - DNA, 13 bp, Homo sapiens
tttaaataaatta

SEQ ID NO: 2169478 - DNA, 11 bp, Homo sapiens
tttaaatcatc

SEQ ID NO: 2169479 - DNA, 13 bp, Homo sapiens
tttaacagaaatt

SEQ ID NO: 2169480 - DNA, 18 bp, Homo sapiens
tttaagaaaaacatgtca

SEQ ID NO: 2169481 - DNA, 23 bp, Homo sapiens
tttaaggaacaagaattgctaaa

SEQ ID NO: 2169482 - DNA, 12 bp, Homo sapiens
ttttacttgtat

SEQ ID NO: 2169483 - DNA, 16 bp, Homo sapiens
ttttagaattaaaatt

SEQ ID NO: 2169484 - DNA, 18 bp, Homo sapiens
ttttagacagtggtaaat

SEQ ID NO: 2169485 - DNA, 22 bp, Homo sapiens
ttttagtgcaatttcttctgta

SEQ ID NO: 2169486 - DNA, 20 bp, Homo sapiens
ttttattcacttgtgtttgt

SEQ ID NO: 2169487 - DNA, 13 bp, Homo sapiens
ttttattgctgga

SEQ ID NO: 2169488 - DNA, 16 bp, Homo sapiens
ttttcagacaaattac

SEQ ID NO: 2169489 - DNA, 20 bp, Homo sapiens
ttttccaaaaacaaagtgca

SEQ ID NO: 2169490 - DNA, 15 bp, Homo sapiens
ttttccccctggaat

SEQ ID NO: 2169491 - DNA, 20 bp, Homo sapiens
ttttcctagttttatgtttc

SEQ ID NO: 2169492 - DNA, 13 bp, Homo sapiens
ttttctagaatac

SEQ ID NO: 2169493 - DNA, 21 bp, Homo sapiens
ttttctatgaaagctatgaat

SEQ ID NO: 2169494 - DNA, 17 bp, Homo sapiens
ttttctggctcctgtgt

SEQ ID NO: 2169495 - DNA, 15 bp, Homo sapiens
ttttctgtctctctt

SEQ ID NO: 2169496 - DNA, 15 bp, Homo sapiens
ttttcttccccctcc

SEQ ID NO: 2169497 - DNA, 17 bp, Homo sapiens
ttttctttctagtttgt

SEQ ID NO: 2169498 - DNA, 17 bp, Homo sapiens
ttttgcaaagatttaat

SEQ ID NO: 2169499 - DNA, 15 bp, Homo sapiens
ttttgccttttgcaa

SEQ ID NO: 2169500 - DNA, 18 bp, Homo sapiens
ttttgcgatgtgttttat

SEQ ID NO: 2169501 - DNA, 21 bp, Homo sapiens
ttttgcgatgtgttttattca

SEQ ID NO: 2169502 - DNA, 22 bp, Homo sapiens
ttttgctcccccattttaactt

SEQ ID NO: 2169503 - DNA, 15 bp, Homo sapiens
ttttggaaactgttg

SEQ ID NO: 2169504 - DNA, 21 bp, Homo sapiens
ttttggtttcttattcaaaga

SEQ ID NO: 2169505 - DNA, 13 bp, Homo sapiens
ttttgtactgtgc

SEQ ID NO: 2169506 - DNA, 14 bp, Homo sapiens
ttttgtatgtatgt

SEQ ID NO: 2169507 - DNA, 15 bp, Homo sapiens
ttttgtctcgaaata

SEQ ID NO: 2169508 - DNA, 21 bp, Homo sapiens
ttttgtgaagaaacatttatc

SEQ ID NO: 2169509 - DNA, 14 bp, Homo sapiens
ttttgttttgttct

SEQ ID NO: 2169510 - DNA, 14 bp, Homo sapiens
tttttaaaataatt

SEQ ID NO: 2169511 - DNA, 23 bp, Homo sapiens
tttttaaaatgaatcttatgcaa

SEQ ID NO: 2169512 - DNA, 19 bp, Homo sapiens
tttttaaatgtcagttgaa

SEQ ID NO: 2169513 - DNA, 22 bp, Homo sapiens
tttttaatcgtttttgttttaa

SEQ ID NO: 2169514 - DNA, 20 bp, Homo sapiens
tttttaatgagatgaaaata

SEQ ID NO: 2169515 - DNA, 18 bp, Homo sapiens
tttttacggaattccaat

SEQ ID NO: 2169516 - DNA, 19 bp, Homo sapiens
tttttataaactacaaaaa

SEQ ID NO: 2169517 - DNA, 20 bp, Homo sapiens
tttttctctttttcttgtaa

SEQ ID NO: 2169518 - DNA, 13 bp, Homo sapiens
tttttctgtctct

SEQ ID NO: 2169519 - DNA, 11 bp, Homo sapiens
tttttctttcc

SEQ ID NO: 2169520 - DNA, 14 bp, Homo sapiens
tttttgataattta

SEQ ID NO: 2169521 - DNA, 22 bp, Homo sapiens
tttttggggggttttcttgcct

SEQ ID NO: 2169522 - DNA, 14 bp, Homo sapiens
tttttgtactgtgc

SEQ ID NO: 2169523 - DNA, 17 bp, Homo sapiens
tttttgtagacagggtc

SEQ ID NO: 2169524 - DNA, 16 bp, Homo sapiens
tttttgtttggtataa

SEQ ID NO: 2169525 - DNA, 11 bp, Homo sapiens
ttttttaactg

SEQ ID NO: 2169526 - DNA, 20 bp, Homo sapiens
ttttttacggaattccaata

SEQ ID NO: 2169527 - DNA, 21 bp, Homo sapiens
ttttttacggaattccaatat

SEQ ID NO: 2169528 - DNA, 16 bp, Homo sapiens
tataattttgaccata

SEQ ID NO: 2169529 - DNA, 22 bp, Homo sapiens
tataattttgaccataaattaa

SEQ ID NO: 2169530 - DNA, 14 bp, Homo sapiens
tatacatatgatca

SEQ ID NO: 2169531 - DNA, 20 bp, Homo sapiens
tatacatatgatcaaatact

SEQ ID NO: 2169532 - DNA, 20 bp, Homo sapiens
tatagattctttattagtga

SEQ ID NO: 2169533 - DNA, 15 bp, Homo sapiens
tatagcacatagatg

SEQ ID NO: 2169534 - DNA, 15 bp, Homo sapiens
tatataatacttaaa

SEQ ID NO: 2169535 - DNA, 20 bp, Homo sapiens
tatataatacttaaaaatat

SEQ ID NO: 2169536 - DNA, 17 bp, Homo sapiens
tatatagtacctttgct

SEQ ID NO: 2169537 - DNA, 18 bp, Homo sapiens
tatatagtacctttgctc

SEQ ID NO: 2169538 - DNA, 14 bp, Homo sapiens
tatatataatactt

SEQ ID NO: 2169539 - DNA, 15 bp, Homo sapiens
tatatatgtagccag

SEQ ID NO: 2169540 - DNA, 15 bp, Homo sapiens
tatatgccttatgta

SEQ ID NO: 2169541 - DNA, 19 bp, Homo sapiens
tatatgtcctattcattca

SEQ ID NO: 2169542 - DNA, 14 bp, Homo sapiens
tatattataagatt

SEQ ID NO: 2169543 - DNA, 11 bp, Homo sapiens
tatattctttc

SEQ ID NO: 2169544 - DNA, 15 bp, Homo sapiens
tatatttaaatgcaa

SEQ ID NO: 2169545 - DNA, 19 bp, Homo sapiens
tatatttaatttttacatg

SEQ ID NO: 2169546 - DNA, 15 bp, Homo sapiens
tatattttgaacaac

SEQ ID NO: 2169547 - DNA, 21 bp, Homo sapiens
tatattttgaacaactcgaat

SEQ ID NO: 2169548 - DNA, 13 bp, Homo sapiens
tatcacatgttgt

SEQ ID NO: 2169549 - DNA, 13 bp, Homo sapiens
tatcacctgtcat

SEQ ID NO: 2169550 - DNA, 14 bp, Homo sapiens
tatcacctttccca

SEQ ID NO: 2169551 - DNA, 17 bp, Homo sapiens
tatcaggggaatttcag

SEQ ID NO: 2169552 - DNA, 18 bp, Homo sapiens
tatcaggggaatttcagg

SEQ ID NO: 2169553 - DNA, 19 bp, Homo sapiens
tatccaaatcctaagggga

SEQ ID NO: 2169554 - DNA, 11 bp, Homo sapiens
tatccaggagt

SEQ ID NO: 2169555 - DNA, 13 bp, Homo sapiens
tatccccaagctg

SEQ ID NO: 2169556 - DNA, 17 bp, Homo sapiens
tatcctggctttgccca

SEQ ID NO: 2169557 - DNA, 20 bp, Homo sapiens
tatcgctgatattaagtaat

SEQ ID NO: 2169558 - DNA, 22 bp, Homo sapiens
tatcggagcagttcaataacaa

SEQ ID NO: 2169559 - DNA, 21 bp, Homo sapiens
tatctatatagtacctttgct

SEQ ID NO: 2169560 - DNA, 23 bp, Homo sapiens
tatctcgaagtcttccatcagca

SEQ ID NO: 2169561 - DNA, 20 bp, Homo sapiens
tatctcgctagccatatatt

SEQ ID NO: 2169562 - DNA, 12 bp, Homo sapiens
tatctgtacctg

SEQ ID NO: 2169563 - DNA, 24 bp, Homo sapiens
tatctgtacctgcccccactcagc

SEQ ID NO: 2169564 - DNA, 13 bp, Homo sapiens
tatgacatttcta

SEQ ID NO: 2169565 - DNA, 15 bp, Homo sapiens
tatgatcaaatactc

SEQ ID NO: 2169566 - DNA, 14 bp, Homo sapiens
tatgatgtattagt

SEQ ID NO: 2169567 - DNA, 17 bp, Homo sapiens
tatgattcagtgcattt

SEQ ID NO: 2169568 - DNA, 20 bp, Homo sapiens
tatgccacctgcagcgtctg

SEQ ID NO: 2169569 - DNA, 18 bp, Homo sapiens
tatgccttatgtaattat

SEQ ID NO: 2169570 - DNA, 23 bp, Homo sapiens
tatgccttatgtaattattttct

SEQ ID NO: 2169571 - DNA, 23 bp, Homo sapiens
tatgctcacctgacattaattat

SEQ ID NO: 2169572 - DNA, 15 bp, Homo sapiens
tatggcagtgggaga

SEQ ID NO: 2169573 - DNA, 22 bp, Homo sapiens
tatggctagaatatcctacttc

SEQ ID NO: 2169574 - DNA, 21 bp, Homo sapiens
tatgggtatcaaacagctcag

SEQ ID NO: 2169575 - DNA, 15 bp, Homo sapiens
tatgtaaacagtgag

SEQ ID NO: 2169576 - DNA, 14 bp, Homo sapiens
tatgtaaatgtgaa

SEQ ID NO: 2169577 - DNA, 16 bp, Homo sapiens
tatgtattttaaaata

SEQ ID NO: 2169578 - DNA, 17 bp, Homo sapiens
tatgtgattatcattta

SEQ ID NO: 2169579 - DNA, 18 bp, Homo sapiens
tatgtgattatcatttat

SEQ ID NO: 2169580 - DNA, 14 bp, Homo sapiens
tatgttcacaccta

SEQ ID NO: 2169581 - DNA, 23 bp, Homo sapiens
tatgttctcccctacattagtaa

SEQ ID NO: 2169582 - DNA, 13 bp, Homo sapiens
tattaaaatcaca

SEQ ID NO: 2169583 - DNA, 23 bp, Homo sapiens
tattaaaggtgaaaattgtataa

SEQ ID NO: 2169584 - DNA, 20 bp, Homo sapiens
tattaaatcagttttgtgta

SEQ ID NO: 2169585 - DNA, 20 bp, Homo sapiens
tattaacatatattgttatt

SEQ ID NO: 2169586 - DNA, 22 bp, Homo sapiens
tattacaggggcttgaacaaca

SEQ ID NO: 2169587 - DNA, 13 bp, Homo sapiens
tattagccaactg

SEQ ID NO: 2169588 - DNA, 16 bp, Homo sapiens
tattagtgatgtcatc

SEQ ID NO: 2169589 - DNA, 21 bp, Homo sapiens
tattatcttcttaacagttta

SEQ ID NO: 2169590 - DNA, 22 bp, Homo sapiens
tattattataatcttataattg

SEQ ID NO: 2169591 - DNA, 14 bp, Homo sapiens
tattcaaaaattat

SEQ ID NO: 2169592 - DNA, 22 bp, Homo sapiens
tattcaaagatgataatttagt

SEQ ID NO: 2169593 - DNA, 20 bp, Homo sapiens
tattcaatttgattctatga

SEQ ID NO: 2169594 - DNA, 20 bp, Homo sapiens
tattcattcagtgagacaca

SEQ ID NO: 2169595 - DNA, 23 bp, Homo sapiens
tattgaataggcattaaatgcaa

SEQ ID NO: 2169596 - DNA, 18 bp, Homo sapiens
tattgaatgaaacaagca

SEQ ID NO: 2169597 - DNA, 17 bp, Homo sapiens
tattgataataaaattc

SEQ ID NO: 2169598 - DNA, 18 bp, Homo sapiens
tattgctggaatctacta

SEQ ID NO: 2169599 - DNA, 23 bp, Homo sapiens
tattggctaaattgaaacctgga

SEQ ID NO: 2169600 - DNA, 16 bp, Homo sapiens
tattgtaccaaagctg

SEQ ID NO: 2169601 - DNA, 19 bp, Homo sapiens
tattgtgctttctatctaa

SEQ ID NO: 2169602 - DNA, 13 bp, Homo sapiens
tatttaacagaaa

SEQ ID NO: 2169603 - DNA, 20 bp, Homo sapiens
tatttaatttttacatgacc

SEQ ID NO: 2169604 - DNA, 14 bp, Homo sapiens
tatttacatttaat

SEQ ID NO: 2169605 - DNA, 22 bp, Homo sapiens
tatttataacaatgttaaatgc

SEQ ID NO: 2169606 - DNA, 12 bp, Homo sapiens
tatttattaccg

SEQ ID NO: 2169607 - DNA, 11 bp, Homo sapiens
tatttccatgg

SEQ ID NO: 2169608 - DNA, 21 bp, Homo sapiens
tatttctcccttcaatcctgt

SEQ ID NO: 2169609 - DNA, 17 bp, Homo sapiens
tatttgaaactgctaat

SEQ ID NO: 2169610 - DNA, 16 bp, Homo sapiens
tatttgacttctgagt

SEQ ID NO: 2169611 - DNA, 18 bp, Homo sapiens
tatttggagtggaggcat

SEQ ID NO: 2169612 - DNA, 19 bp, Homo sapiens
tatttggagtggaggcatt

SEQ ID NO: 2169613 - DNA, 22 bp, Homo sapiens
tattttgcaaacactgtgatta

SEQ ID NO: 2169614 - DNA, 19 bp, Homo sapiens
tatttttaaaataatttat

SEQ ID NO: 2169615 - DNA, 20 bp, Homo sapiens
tatttttttgttgctgttgt

SEQ ID NO: 2169616 - DNA, 12 bp, Homo sapiens
tcaaaaacaaac

SEQ ID NO: 2169617 - DNA, 12 bp, Homo sapiens
tcaaaatgtgaa

SEQ ID NO: 2169618 - DNA, 18 bp, Homo sapiens
tcaaaatgttaataaagg

SEQ ID NO: 2169619 - DNA, 19 bp, Homo sapiens
tcaaaatgttaataaaggt

SEQ ID NO: 2169620 - DNA, 22 bp, Homo sapiens
tcaaacaattcaatcaaagcta

SEQ ID NO: 2169621 - DNA, 23 bp, Homo sapiens
aaaactttggagaactcatttca

SEQ ID NO: 2169622 - DNA, 22 bp, Homo sapiens
aaaactttttgaccagtttctt

SEQ ID NO: 2169623 - DNA, 20 bp, Homo sapiens
aaaagaaattccctggacca

SEQ ID NO: 2169624 - DNA, 12 bp, Homo sapiens
aaaagagaaggc

SEQ ID NO: 2169625 - DNA, 15 bp, Homo sapiens
aaaagatgtaataat

SEQ ID NO: 2169626 - DNA, 22 bp, Homo sapiens
aaaaggcactgcacataatttg

SEQ ID NO: 2169627 - DNA, 14 bp, Homo sapiens
aaaagtaccataga

SEQ ID NO: 2169628 - DNA, 21 bp, Homo sapiens
aaaagttaatattcagatgtt

SEQ ID NO: 2169629 - DNA, 18 bp, Homo sapiens
aaaataaaatgcatttaa

SEQ ID NO: 2169630 - DNA, 19 bp, Homo sapiens
aaaataaaatgcatttaaa

SEQ ID NO: 2169631 - DNA, 13 bp, Homo sapiens
aaaataaatcaag

SEQ ID NO: 2169632 - DNA, 14 bp, Homo sapiens
aaaatatctgaata

SEQ ID NO: 2169633 - DNA, 18 bp, Homo sapiens
aaaatatgtgagcatgaa

SEQ ID NO: 2169634 - DNA, 21 bp, Homo sapiens
aaaatatgtgagcatgaaact

SEQ ID NO: 2169635 - DNA, 18 bp, Homo sapiens
aaaatcaggcatttttcc

SEQ ID NO: 2169636 - DNA, 16 bp, Homo sapiens
aaaatcattaacactt

SEQ ID NO: 2169637 - DNA, 16 bp, Homo sapiens
aaaatctattttgtct

SEQ ID NO: 2169638 - DNA, 21 bp, Homo sapiens
aaaatctggggaggacaaagg

SEQ ID NO: 2169639 - DNA, 17 bp, Homo sapiens
aaaatgatgtagacatt

SEQ ID NO: 2169640 - DNA, 14 bp, Homo sapiens
aaaatggaacatta

SEQ ID NO: 2169641 - DNA, 21 bp, Homo sapiens
aaaatgtataatgacttttaa

SEQ ID NO: 2169642 - DNA, 12 bp, Homo sapiens
aaaatgttaata

SEQ ID NO: 2169643 - DNA, 23 bp, Homo sapiens
aaaattaattctttatcacatgt

SEQ ID NO: 2169644 - DNA, 21 bp, Homo sapiens
aaaattactcccttattggca

SEQ ID NO: 2169645 - DNA, 23 bp, Homo sapiens
aaaattgccagattaaatgaata

SEQ ID NO: 2169646 - DNA, 16 bp, Homo sapiens
aaaattgtataaatta

SEQ ID NO: 2169647 - DNA, 12 bp, Homo sapiens
aaaatttattct

SEQ ID NO: 2169648 - DNA, 20 bp, Homo sapiens
aaacaaaaattcacaagctg

SEQ ID NO: 2169649 - DNA, 17 bp, Homo sapiens
aaacaaagtgcaaagct

SEQ ID NO: 2169650 - DNA, 18 bp, Homo sapiens
aaacaaagtgcaaagctg

SEQ ID NO: 2169651 - DNA, 19 bp, Homo sapiens
aaacaaagtgcaaagctgc

SEQ ID NO: 2169652 - DNA, 19 bp, Homo sapiens
aaacaattcaatcaaagct

SEQ ID NO: 2169653 - DNA, 23 bp, Homo sapiens
aaacaattcaatcaaagctacct

SEQ ID NO: 2169654 - DNA, 16 bp, Homo sapiens
aaacaattgtgacagc

SEQ ID NO: 2169655 - DNA, 12 bp, Homo sapiens
aaacacagagag

SEQ ID NO: 2169656 - DNA, 21 bp, Homo sapiens
aaacaccatcttcagctgtat

SEQ ID NO: 2169657 - DNA, 16 bp, Homo sapiens
aaacacctaagtgact

SEQ ID NO: 2169658 - DNA, 19 bp, Homo sapiens
aaacacctaagtgactacc

SEQ ID NO: 2169659 - DNA, 12 bp, Homo sapiens
aaacatgtcatg

SEQ ID NO: 2169660 - DNA, 13 bp, Homo sapiens
aaacatttatctt

SEQ ID NO: 2169661 - DNA, 13 bp, Homo sapiens
aaaccaaaacaga

SEQ ID NO: 2169662 - DNA, 14 bp, Homo sapiens
aaaccaagccttgg

SEQ ID NO: 2169663 - DNA, 21 bp, Homo sapiens
aaaccaggagcattttgtgtc

SEQ ID NO: 2169664 - DNA, 23 bp, Homo sapiens
aaaccaggagcattttgtgtctt

SEQ ID NO: 2169665 - DNA, 15 bp, Homo sapiens
aaaccatgaaaaaat

SEQ ID NO: 2169666 - DNA, 15 bp, Homo sapiens
aaacccaagttttta

SEQ ID NO: 2169667 - DNA, 14 bp, Homo sapiens
aaaccctgtcctcc

SEQ ID NO: 2169668 - DNA, 14 bp, Homo sapiens
aaacctttccattt

SEQ ID NO: 2169669 - DNA, 16 bp, Homo sapiens
aaacgaaactgctcta

SEQ ID NO: 2169670 - DNA, 14 bp, Homo sapiens
aaacgtgccctctg

SEQ ID NO: 2169671 - DNA, 14 bp, Homo sapiens
aaactaaagcagtt

SEQ ID NO: 2169672 - DNA, 22 bp, Homo sapiens
aaactactatttttctttccaa

SEQ ID NO: 2169673 - DNA, 23 bp, Homo sapiens
aaactcagcctcaataagccttg

SEQ ID NO: 2169674 - DNA, 21 bp, Homo sapiens
aaactctccttttccttacca

SEQ ID NO: 2169675 - DNA, 19 bp, Homo sapiens
aaactgctctaagcacacg

SEQ ID NO: 2169676 - DNA, 20 bp, Homo sapiens
aaacttgcaatgaaaagaaa

SEQ ID NO: 2169677 - DNA, 20 bp, Homo sapiens
aaactttggagaactcattt

SEQ ID NO: 2169678 - DNA, 21 bp, Homo sapiens
aaactttttgaccagtttctt

SEQ ID NO: 2169679 - DNA, 13 bp, Homo sapiens
aaagaaaattgcc

SEQ ID NO: 2169680 - DNA, 17 bp, Homo sapiens
aaagaaaattgccaaaa

SEQ ID NO: 2169681 - DNA, 22 bp, Homo sapiens
aaagaaaattgccaaaatatat

SEQ ID NO: 2169682 - DNA, 20 bp, Homo sapiens
aaagaagagtaaaatggctg

SEQ ID NO: 2169683 - DNA, 13 bp, Homo sapiens
aaagaagcaagac

SEQ ID NO: 2169684 - DNA, 19 bp, Homo sapiens
aaagaccaatgtgaagaca

SEQ ID NO: 2169685 - DNA, 13 bp, Homo sapiens
aaagagagaagcc

SEQ ID NO: 2169686 - DNA, 20 bp, Homo sapiens
aaagagagaagccagccaca

SEQ ID NO: 2169687 - DNA, 12 bp, Homo sapiens
aaagagctgcct

SEQ ID NO: 2169688 - DNA, 16 bp, Homo sapiens
aaagagctgcctggat

SEQ ID NO: 2169689 - DNA, 13 bp, Homo sapiens
aaagattgtgtct

SEQ ID NO: 2169690 - DNA, 15 bp, Homo sapiens
aaagcagtatttttc

SEQ ID NO: 2169691 - DNA, 14 bp, Homo sapiens
aaagcagtttttaa

SEQ ID NO: 2169692 - DNA, 16 bp, Homo sapiens
aaagccttttaaatca

SEQ ID NO: 2169693 - DNA, 18 bp, Homo sapiens
aaagccttttaaatcatc

SEQ ID NO: 2169694 - DNA, 19 bp, Homo sapiens
aaagctgacgaggctgggc

SEQ ID NO: 2169695 - DNA, 12 bp, Homo sapiens
aaagctgtgaaa

SEQ ID NO: 2169696 - DNA, 14 bp, Homo sapiens
aaagctgtttttat

SEQ ID NO: 2169697 - DNA, 15 bp, Homo sapiens
aaagctttcctggag

SEQ ID NO: 2169698 - DNA, 19 bp, Homo sapiens
aaaggaagtagcaggccca

SEQ ID NO: 2169699 - DNA, 14 bp, Homo sapiens
aaaggcactgcaca

SEQ ID NO: 2169700 - DNA, 17 bp, Homo sapiens
aaaggcagtggggctgg

SEQ ID NO: 2169701 - DNA, 16 bp, Homo sapiens
aaaggtcaaaaacaaa

SEQ ID NO: 2169702 - DNA, 14 bp, Homo sapiens
aaaggtgtgtcaaa

SEQ ID NO: 2169703 - DNA, 19 bp, Homo sapiens
aaaggtttcactgttcatg

SEQ ID NO: 2169704 - DNA, 22 bp, Homo sapiens
aaaggtttcactgttcatgaat

SEQ ID NO: 2169705 - DNA, 16 bp, Homo sapiens
aaagtatgtattattt

SEQ ID NO: 2169706 - DNA, 16 bp, Homo sapiens
aaagtccattgatgtc

SEQ ID NO: 2169707 - DNA, 15 bp, Homo sapiens
aaagtgcaaagctgc

SEQ ID NO: 2169708 - DNA, 16 bp, Homo sapiens
aaagtggaattaaagg

SEQ ID NO: 2169709 - DNA, 19 bp, Homo sapiens
aaagtggccaagaagcagt

SEQ ID NO: 2169710 - DNA, 14 bp, Homo sapiens
aaagttaaattgca

SEQ ID NO: 2169711 - DNA, 12 bp, Homo sapiens
aaataaagcctt

SEQ ID NO: 2169712 - DNA, 16 bp, Homo sapiens
aaataaagccttttaa

SEQ ID NO: 2169713 - DNA, 21 bp, Homo sapiens
aaataaagccttttaaatcat

SEQ ID NO: 2169714 - DNA, 14 bp, Homo sapiens
aaataatattgatt

SEQ ID NO: 2169715 - DNA, 23 bp, Homo sapiens
aaataattatataactgtatttg

SEQ ID NO: 2169716 - DNA, 15 bp, Homo sapiens
aaataattgtgtcat

SEQ ID NO: 2169717 - DNA, 12 bp, Homo sapiens
aaataatttatc

SEQ ID NO: 2169718 - DNA, 14 bp, Homo sapiens
aaatacaattcaaa

SEQ ID NO: 2169719 - DNA, 12 bp, Homo sapiens
aaatacattaac

SEQ ID NO: 2169720 - DNA, 16 bp, Homo sapiens
aaatactcgtttttat

SEQ ID NO: 2169721 - DNA, 12 bp, Homo sapiens
aaatactgtaca

SEQ ID NO: 2169722 - DNA, 14 bp, Homo sapiens
aaatactgtacata

SEQ ID NO: 2169723 - DNA, 16 bp, Homo sapiens
aaatactgtacataga

SEQ ID NO: 2169724 - DNA, 18 bp, Homo sapiens
aaatacttcaaatcatat

SEQ ID NO: 2169725 - DNA, 16 bp, Homo sapiens
aaatacttgagaaatt

SEQ ID NO: 2169726 - DNA, 14 bp, Homo sapiens
aaatagacttttgt

SEQ ID NO: 2169727 - DNA, 15 bp, Homo sapiens
aaatagctacagctg

SEQ ID NO: 2169728 - DNA, 15 bp, Homo sapiens
aaataggcaattaga

SEQ ID NO: 2169729 - DNA, 19 bp, Homo sapiens
aaatataggggttaaggaa

SEQ ID NO: 2169730 - DNA, 22 bp, Homo sapiens
aaatatagtttgattcttcatt

SEQ ID NO: 2169731 - DNA, 15 bp, Homo sapiens
aaatatgaaatttta

SEQ ID NO: 2169732 - DNA, 19 bp, Homo sapiens
aaatatttaaaaaaaaaca

SEQ ID NO: 2169733 - DNA, 22 bp, Homo sapiens
aaatcacaaactcatccattaa

SEQ ID NO: 2169734 - DNA, 15 bp, Homo sapiens
aaatcctgccactgt

SEQ ID NO: 2169735 - DNA, 12 bp, Homo sapiens
aaatcctgtcat

SEQ ID NO: 2169736 - DNA, 18 bp, Homo sapiens
aaatcctttcataaagca

SEQ ID NO: 2169737 - DNA, 16 bp, Homo sapiens
aaatgaatggctcact

SEQ ID NO: 2169738 - DNA, 17 bp, Homo sapiens
aaatgccaggacagctg

SEQ ID NO: 2169739 - DNA, 20 bp, Homo sapiens
aaatgggactgatgtcatct

SEQ ID NO: 2169740 - DNA, 18 bp, Homo sapiens
aaatggtgagaattaaaa

SEQ ID NO: 2169741 - DNA, 14 bp, Homo sapiens
aaatggtgccttca

SEQ ID NO: 2169742 - DNA, 22 bp, Homo sapiens
aaatgtgaatggaaacttggaa

SEQ ID NO: 2169743 - DNA, 23 bp, Homo sapiens
aaatgtgcctcattaagaggcag

SEQ ID NO: 2169744 - DNA, 19 bp, Homo sapiens
aagtccaggtcgggctcag

SEQ ID NO: 2169745 - DNA, 21 bp, Homo sapiens
aagtccaggtcgggctcagct

SEQ ID NO: 2169746 - DNA, 23 bp, Homo sapiens
aagtcccaccggttgcttctggg

SEQ ID NO: 2169747 - DNA, 13 bp, Homo sapiens
aagtccctgcccc

SEQ ID NO: 2169748 - DNA, 15 bp, Homo sapiens
aagtctcctgtatca

SEQ ID NO: 2169749 - DNA, 22 bp, Homo sapiens
aagtcttcaagggctgcttcaa

SEQ ID NO: 2169750 - DNA, 20 bp, Homo sapiens
aagtcttccatcagcagtga

SEQ ID NO: 2169751 - DNA, 11 bp, Homo sapiens
aagtcttcctg

SEQ ID NO: 2169752 - DNA, 17 bp, Homo sapiens
aagtgaacaaatttcaa

SEQ ID NO: 2169753 - DNA, 18 bp, Homo sapiens
aagtgaacaaatttcaaa

SEQ ID NO: 2169754 - DNA, 16 bp, Homo sapiens
aagtgatgattgtaag

SEQ ID NO: 2169755 - DNA, 11 bp, Homo sapiens
aagtgcaaagc

SEQ ID NO: 2169756 - DNA, 18 bp, Homo sapiens
aagtgcaaagtgccctca

SEQ ID NO: 2169757 - DNA, 19 bp, Homo sapiens
aagtgccagatcaaaattg

SEQ ID NO: 2169758 - DNA, 16 bp, Homo sapiens
aagtgctcagttccaa

SEQ ID NO: 2169759 - DNA, 17 bp, Homo sapiens
aagtgctcagttccaat

SEQ ID NO: 2169760 - DNA, 21 bp, Homo sapiens
aagtgcttttaaactggagag

SEQ ID NO: 2169761 - DNA, 15 bp, Homo sapiens
aagtggacggcagac

SEQ ID NO: 2169762 - DNA, 16 bp, Homo sapiens
aagtgggagtgggaga

SEQ ID NO: 2169763 - DNA, 20 bp, Homo sapiens
aagtgggagtgggagaggaa

SEQ ID NO: 2169764 - DNA, 15 bp, Homo sapiens
aagttagtttgtata

SEQ ID NO: 2169765 - DNA, 17 bp, Homo sapiens
aagttagtttgtatata

SEQ ID NO: 2169766 - DNA, 22 bp, Homo sapiens
aagttagtttgtatatattatt

SEQ ID NO: 2169767 - DNA, 16 bp, Homo sapiens
aagttgctgtgcccca

SEQ ID NO: 2169768 - DNA, 17 bp, Homo sapiens
aagttgtaaagtatgta

SEQ ID NO: 2169769 - DNA, 19 bp, Homo sapiens
aagtttactcaaccctctc

SEQ ID NO: 2169770 - DNA, 13 bp, Homo sapiens
aagtttagaaatt

SEQ ID NO: 2169771 - DNA, 16 bp, Homo sapiens
aagtttcagtaatagc

SEQ ID NO: 2169772 - DNA, 10 bp, Homo sapiens
aagtttcttt

SEQ ID NO: 2169773 - DNA, 20 bp, Homo sapiens
aagtttgtcaggcacagtaa

SEQ ID NO: 2169774 - DNA, 15 bp, Homo sapiens
aagttttaacctcag

SEQ ID NO: 2169775 - DNA, 15 bp, Homo sapiens
aagtttttacagtgt

SEQ ID NO: 2169776 - DNA, 19 bp, Homo sapiens
aagtttttacagtgtatct

SEQ ID NO: 2169777 - DNA, 19 bp, Homo sapiens
aataaaaaaaaacctacaa

SEQ ID NO: 2169778 - DNA, 13 bp, Homo sapiens
aataaaatattta

SEQ ID NO: 2169779 - DNA, 16 bp, Homo sapiens
aataaaattcattcca

SEQ ID NO: 2169780 - DNA, 12 bp, Homo sapiens
aataaagaacat

SEQ ID NO: 2169781 - DNA, 21 bp, Homo sapiens
aataaagccttttaaatcatc

SEQ ID NO: 2169782 - DNA, 15 bp, Homo sapiens
aataaatcatgttaa

SEQ ID NO: 2169783 - DNA, 16 bp, Homo sapiens
aataaattatgaatat

SEQ ID NO: 2169784 - DNA, 16 bp, Homo sapiens
aataacaacaacaaaa

SEQ ID NO: 2169785 - DNA, 23 bp, Homo sapiens
aataaggattctgaagttttatt

SEQ ID NO: 2169786 - DNA, 19 bp, Homo sapiens
aataatagttcaggatttg

SEQ ID NO: 2169787 - DNA, 15 bp, Homo sapiens
aataatattgatttc

SEQ ID NO: 2169788 - DNA, 22 bp, Homo sapiens
aataatgacgtattgtgaaatt

SEQ ID NO: 2169789 - DNA, 14 bp, Homo sapiens
aataattgtggaga

SEQ ID NO: 2169790 - DNA, 16 bp, Homo sapiens
aataattgtggagagg

SEQ ID NO: 2169791 - DNA, 19 bp, Homo sapiens
aataatttatcaaaaaaca

SEQ ID NO: 2169792 - DNA, 23 bp, Homo sapiens
aatacatactatagattctttat

SEQ ID NO: 2169793 - DNA, 16 bp, Homo sapiens
aatactaaatatgaaa

SEQ ID NO: 2169794 - DNA, 15 bp, Homo sapiens
aatactaataaaata

SEQ ID NO: 2169795 - DNA, 18 bp, Homo sapiens
aatactaataaaatacat

SEQ ID NO: 2169796 - DNA, 16 bp, Homo sapiens
aatactacacatccaa

SEQ ID NO: 2169797 - DNA, 14 bp, Homo sapiens
aatactgtacatag

SEQ ID NO: 2169798 - DNA, 16 bp, Homo sapiens
aatactgtacatagat

SEQ ID NO: 2169799 - DNA, 23 bp, Homo sapiens
aatacttaaaaatatgtgagcat

SEQ ID NO: 2169800 - DNA, 20 bp, Homo sapiens
aatagattcttaaagtggct

SEQ ID NO: 2169801 - DNA, 18 bp, Homo sapiens
aataggcattaaatgcaa

SEQ ID NO: 2169802 - DNA, 17 bp, Homo sapiens
aataggttttccctgtt

SEQ ID NO: 2169803 - DNA, 16 bp, Homo sapiens
aatatatatgtagcca

SEQ ID NO: 2169804 - DNA, 19 bp, Homo sapiens
aatatatcctgaaagcatt

SEQ ID NO: 2169805 - DNA, 16 bp, Homo sapiens
aatatatgatttgcat

SEQ ID NO: 2169806 - DNA, 23 bp, Homo sapiens
aatatattgaataggcattaaat

SEQ ID NO: 2169807 - DNA, 17 bp, Homo sapiens
aatatattttctttcta

SEQ ID NO: 2169808 - DNA, 12 bp, Homo sapiens
aatatcaaaagg

SEQ ID NO: 2169809 - DNA, 15 bp, Homo sapiens
aatatcgctgatatt

SEQ ID NO: 2169810 - DNA, 14 bp, Homo sapiens
aatatctacctgcc

SEQ ID NO: 2169811 - DNA, 12 bp, Homo sapiens
aatatctgaata

SEQ ID NO: 2169812 - DNA, 17 bp, Homo sapiens
aatatctgaatatatga

SEQ ID NO: 2169813 - DNA, 17 bp, Homo sapiens
aatatggtgtcttgata

SEQ ID NO: 2169814 - DNA, 17 bp, Homo sapiens
aatatgtgattatcatt

SEQ ID NO: 2169815 - DNA, 11 bp, Homo sapiens
aatattaaaaa

SEQ ID NO: 2169816 - DNA, 18 bp, Homo sapiens
aatattaaaaattaattc

SEQ ID NO: 2169817 - DNA, 21 bp, Homo sapiens
aatattagttgtatataaaat

SEQ ID NO: 2169818 - DNA, 24 bp, Homo sapiens
aatatttaaaaaaaaacattcaaa

SEQ ID NO: 2169819 - DNA, 20 bp, Homo sapiens
aatatttataattaaagaaa

SEQ ID NO: 2169820 - DNA, 19 bp, Homo sapiens
aatatttcttaagtataaa

SEQ ID NO: 2169821 - DNA, 16 bp, Homo sapiens
aatattttttttaact

SEQ ID NO: 2169822 - DNA, 13 bp, Homo sapiens
aatcaaagctacc

SEQ ID NO: 2169823 - DNA, 15 bp, Homo sapiens
aatcaaagctacctt

SEQ ID NO: 2169824 - DNA, 19 bp, Homo sapiens
aatcacaaactcatccatt

SEQ ID NO: 2169825 - DNA, 17 bp, Homo sapiens
aatcactcatttatttc

SEQ ID NO: 2169826 - DNA, 22 bp, Homo sapiens
aatcactcatttatttccatat

SEQ ID NO: 2169827 - DNA, 21 bp, Homo sapiens
aatcaggaggagattaacaca

SEQ ID NO: 2169828 - DNA, 23 bp, Homo sapiens
aatcaggaggagattaacacact

SEQ ID NO: 2169829 - DNA, 21 bp, Homo sapiens
aatcagttagataaaaataaa

SEQ ID NO: 2169830 - DNA, 16 bp, Homo sapiens
aatcagttttgtgtac

SEQ ID NO: 2169831 - DNA, 20 bp, Homo sapiens
aatcatatgggatactgctg

SEQ ID NO: 2169832 - DNA, 23 bp, Homo sapiens
aatcatgttttgatgagaaaaaa

SEQ ID NO: 2169833 - DNA, 22 bp, Homo sapiens
aatcccttaacagttgtattta

SEQ ID NO: 2169834 - DNA, 17 bp, Homo sapiens
aatcctaagttaccttt

SEQ ID NO: 2169835 - DNA, 13 bp, Homo sapiens
aatcctttcataa

SEQ ID NO: 2169836 - DNA, 16 bp, Homo sapiens
aatcggtgcagcggtg

SEQ ID NO: 2169837 - DNA, 16 bp, Homo sapiens
aatctacgatgttaaa

SEQ ID NO: 2169838 - DNA, 15 bp, Homo sapiens
aatctactagaacct

SEQ ID NO: 2169839 - DNA, 21 bp, Homo sapiens
aatctaggcgaggcgaagctg

SEQ ID NO: 2169840 - DNA, 15 bp, Homo sapiens
aatctgtaattacca

SEQ ID NO: 2169841 - DNA, 14 bp, Homo sapiens
aatcttagaacaga

SEQ ID NO: 2169842 - DNA, 20 bp, Homo sapiens
aatcttagaacagatggctg

SEQ ID NO: 2169843 - DNA, 20 bp, Homo sapiens
aatctttccttgtctctcat

SEQ ID NO: 2169844 - DNA, 23 bp, Homo sapiens
aatcttttactgtggaggtggct

SEQ ID NO: 2169845 - DNA, 15 bp, Homo sapiens
aatcttttgtagttt

SEQ ID NO: 2169846 - DNA, 13 bp, Homo sapiens
aatgaaacaagca

SEQ ID NO: 2169847 - DNA, 15 bp, Homo sapiens
aatgaaacaagcagg

SEQ ID NO: 2169848 - DNA, 16 bp, Homo sapiens
aatgaatattgtaaat

SEQ ID NO: 2169849 - DNA, 19 bp, Homo sapiens
aatgacgtattgtgaaatt

SEQ ID NO: 2169850 - DNA, 13 bp, Homo sapiens
aatgacttttaaa

SEQ ID NO: 2169851 - DNA, 17 bp, Homo sapiens
aatgacttttaaaattt

SEQ ID NO: 2169852 - DNA, 10 bp, Homo sapiens
aatgagagag

SEQ ID NO: 2169853 - DNA, 16 bp, Homo sapiens
aatgatactgtctaag

SEQ ID NO: 2169854 - DNA, 22 bp, Homo sapiens
aatgatgtagacattttaagca

SEQ ID NO: 2169855 - DNA, 14 bp, Homo sapiens
aatgcaaaaatata

SEQ ID NO: 2169856 - DNA, 18 bp, Homo sapiens
aatgcatttttaagaatt

SEQ ID NO: 2169857 - DNA, 16 bp, Homo sapiens
aatgccaaaaatgtgc

SEQ ID NO: 2169858 - DNA, 21 bp, Homo sapiens
aatgccaagggtaaacaagcc

SEQ ID NO: 2169859 - DNA, 18 bp, Homo sapiens
aatgcccttacacttact

SEQ ID NO: 2169860 - DNA, 12 bp, Homo sapiens
aatgctggagcg

SEQ ID NO: 2169861 - DNA, 16 bp, Homo sapiens
aatgctgtacctttct

SEQ ID NO: 2169862 - DNA, 14 bp, Homo sapiens
aatgctttgattgt

SEQ ID NO: 2169863 - DNA, 16 bp, Homo sapiens
aatggaacctcctttc

SEQ ID NO: 2169864 - DNA, 22 bp, Homo sapiens
aatgggactgatgtcatcttga

SEQ ID NO: 2169865 - DNA, 14 bp, Homo sapiens
aatgggagccagaa

SEQ ID NO: 2169866 - DNA, 19 bp, Homo sapiens
actgtttgtcttctcccca

SEQ ID NO: 2169867 - DNA, 21 bp, Homo sapiens
actgtttgtcttctccccagg

SEQ ID NO: 2169868 - DNA, 19 bp, Homo sapiens
acttaagacaaatgggact

SEQ ID NO: 2169869 - DNA, 13 bp, Homo sapiens
acttaagtttaga

SEQ ID NO: 2169870 - DNA, 18 bp, Homo sapiens
acttaagtttagaaatta

SEQ ID NO: 2169871 - DNA, 15 bp, Homo sapiens
acttaataaatctgc

SEQ ID NO: 2169872 - DNA, 19 bp, Homo sapiens
acttaataaatctgccatt

SEQ ID NO: 2169873 - DNA, 14 bp, Homo sapiens
acttatctgagtca

SEQ ID NO: 2169874 - DNA, 13 bp, Homo sapiens
acttatttccatg

SEQ ID NO: 2169875 - DNA, 13 bp, Homo sapiens
acttatttctaaa

SEQ ID NO: 2169876 - DNA, 14 bp, Homo sapiens
acttatttctaaat

SEQ ID NO: 2169877 - DNA, 15 bp, Homo sapiens
acttcaaaatcagtg

SEQ ID NO: 2169878 - DNA, 18 bp, Homo sapiens
acttcaagcaccagggaa

SEQ ID NO: 2169879 - DNA, 16 bp, Homo sapiens
acttcagctagagctt

SEQ ID NO: 2169880 - DNA, 17 bp, Homo sapiens
acttcatattaatataa

SEQ ID NO: 2169881 - DNA, 13 bp, Homo sapiens
acttcattctaaa

SEQ ID NO: 2169882 - DNA, 18 bp, Homo sapiens
acttcattctaaaccaaa

SEQ ID NO: 2169883 - DNA, 20 bp, Homo sapiens
acttcattctaaaccaaaac

SEQ ID NO: 2169884 - DNA, 15 bp, Homo sapiens
acttccaagaaaaat

SEQ ID NO: 2169885 - DNA, 21 bp, Homo sapiens
acttccccctcttcttctgaa

SEQ ID NO: 2169886 - DNA, 22 bp, Homo sapiens
acttccccctcttcttctgaag

SEQ ID NO: 2169887 - DNA, 18 bp, Homo sapiens
acttcctgcctcagtctg

SEQ ID NO: 2169888 - DNA, 23 bp, Homo sapiens
acttcgttggtgaccagtttctt

SEQ ID NO: 2169889 - DNA, 23 bp, Homo sapiens
acttctgagtgaagcaaaaacta

SEQ ID NO: 2169890 - DNA, 17 bp, Homo sapiens
acttcttcggaggtggc

SEQ ID NO: 2169891 - DNA, 18 bp, Homo sapiens
acttcttcggaggtggca

SEQ ID NO: 2169892 - DNA, 17 bp, Homo sapiens
acttgaaaagattgcaa

SEQ ID NO: 2169893 - DNA, 15 bp, Homo sapiens
acttggttcccagaa

SEQ ID NO: 2169894 - DNA, 16 bp, Homo sapiens
acttgtaaacttgaaa

SEQ ID NO: 2169895 - DNA, 18 bp, Homo sapiens
acttgtgtttgtatataa

SEQ ID NO: 2169896 - DNA, 18 bp, Homo sapiens
acttgttcttttctggta

SEQ ID NO: 2169897 - DNA, 15 bp, Homo sapiens
actttaataataaaa

SEQ ID NO: 2169898 - DNA, 15 bp, Homo sapiens
actttccttcctcat

SEQ ID NO: 2169899 - DNA, 17 bp, Homo sapiens
actttgcagacctggga

SEQ ID NO: 2169900 - DNA, 17 bp, Homo sapiens
actttggtattcaattt

SEQ ID NO: 2169901 - DNA, 17 bp, Homo sapiens
actttgtacatttggga

SEQ ID NO: 2169902 - DNA, 17 bp, Homo sapiens
actttgtattctctgtc

SEQ ID NO: 2169903 - DNA, 18 bp, Homo sapiens
actttgtattctctgtcc

SEQ ID NO: 2169904 - DNA, 23 bp, Homo sapiens
acttttgaactcacgagccttgc

SEQ ID NO: 2169905 - DNA, 16 bp, Homo sapiens
actttttcttttgctt

SEQ ID NO: 2169906 - DNA, 17 bp, Homo sapiens
actttttcttttgcttt

SEQ ID NO: 2169907 - DNA, 11 bp, Homo sapiens
agaaaaacatg

SEQ ID NO: 2169908 - DNA, 15 bp, Homo sapiens
agaaaaacatgtcat

SEQ ID NO: 2169909 - DNA, 14 bp, Homo sapiens
agaaaaaggagctt

SEQ ID NO: 2169910 - DNA, 19 bp, Homo sapiens
agaaaaattagatgactga

SEQ ID NO: 2169911 - DNA, 16 bp, Homo sapiens
agaaaacacatttctg

SEQ ID NO: 2169912 - DNA, 21 bp, Homo sapiens
agaaaacttcgtaagaacatg

SEQ ID NO: 2169913 - DNA, 17 bp, Homo sapiens
agaaaagaaaatatagt

SEQ ID NO: 2169914 - DNA, 18 bp, Homo sapiens
agaaacactgaagccatt

SEQ ID NO: 2169915 - DNA, 13 bp, Homo sapiens
agaaacagctcag

SEQ ID NO: 2169916 - DNA, 20 bp, Homo sapiens
agaaaccatttttaatgaga

SEQ ID NO: 2169917 - DNA, 19 bp, Homo sapiens
agaaacctagggttttcta

SEQ ID NO: 2169918 - DNA, 16 bp, Homo sapiens
agaaagagagaagcca

SEQ ID NO: 2169919 - DNA, 21 bp, Homo sapiens
agaaagagagaagccagccac

SEQ ID NO: 2169920 - DNA, 17 bp, Homo sapiens
agaaagagctgcctgga

SEQ ID NO: 2169921 - DNA, 22 bp, Homo sapiens
agaaagaggcaccaggaagccg

SEQ ID NO: 2169922 - DNA, 16 bp, Homo sapiens
agaaagctgtgaaatt

SEQ ID NO: 2169923 - DNA, 23 bp, Homo sapiens
agaaaggggcaggagctcagatg

SEQ ID NO: 2169924 - DNA, 18 bp, Homo sapiens
agaaagtccattgatgtc

SEQ ID NO: 2169925 - DNA, 16 bp, Homo sapiens
agaaatcccagttcat

SEQ ID NO: 2169926 - DNA, 18 bp, Homo sapiens
agaaatcccagttcatgt

SEQ ID NO: 2169927 - DNA, 22 bp, Homo sapiens
agaaatcccagttcatgttgct

SEQ ID NO: 2169928 - DNA, 12 bp, Homo sapiens
agaaattacaag

SEQ ID NO: 2169929 - DNA, 18 bp, Homo sapiens
agaaattccctggaccag

SEQ ID NO: 2169930 - DNA, 14 bp, Homo sapiens
agaaattgaggttg

SEQ ID NO: 2169931 - DNA, 23 bp, Homo sapiens
agaaattgaggttgttcaaagtt

SEQ ID NO: 2169932 - DNA, 14 bp, Homo sapiens
agaaattgtatatt

SEQ ID NO: 2169933 - DNA, 20 bp, Homo sapiens
agaaatttgtggttgcatgt

SEQ ID NO: 2169934 - DNA, 19 bp, Homo sapiens
agaacagatctccaaagct

SEQ ID NO: 2169935 - DNA, 13 bp, Homo sapiens
agaacagcaggcc

SEQ ID NO: 2169936 - DNA, 17 bp, Homo sapiens
agaacagcaggcccacc

SEQ ID NO: 2169937 - DNA, 19 bp, Homo sapiens
agaacatgttacgtgtgca

SEQ ID NO: 2169938 - DNA, 16 bp, Homo sapiens
agaacattcagctctg

SEQ ID NO: 2169939 - DNA, 17 bp, Homo sapiens
agaacattcagctctgg

SEQ ID NO: 2169940 - DNA, 23 bp, Homo sapiens
agaacccatttgccatgctgcta

SEQ ID NO: 2169941 - DNA, 18 bp, Homo sapiens
agaacctggtggctggag

SEQ ID NO: 2169942 - DNA, 13 bp, Homo sapiens
agaaccttctaat

SEQ ID NO: 2169943 - DNA, 13 bp, Homo sapiens
agaactcatttca

SEQ ID NO: 2169944 - DNA, 21 bp, Homo sapiens
agaactctcctatctgaacct

SEQ ID NO: 2169945 - DNA, 15 bp, Homo sapiens
agaactctctagttc

SEQ ID NO: 2169946 - DNA, 23 bp, Homo sapiens
agaactctctagttccctcagtg

SEQ ID NO: 2169947 - DNA, 20 bp, Homo sapiens
agaactgctaaatactgtac

SEQ ID NO: 2169948 - DNA, 16 bp, Homo sapiens
agaacttgaatacttt

SEQ ID NO: 2169949 - DNA, 13 bp, Homo sapiens
agaagaggaacat

SEQ ID NO: 2169950 - DNA, 14 bp, Homo sapiens
agaagagtccagga

SEQ ID NO: 2169951 - DNA, 22 bp, Homo sapiens
agaagatattagtcttggggca

SEQ ID NO: 2169952 - DNA, 16 bp, Homo sapiens
agaagatcctacccca

SEQ ID NO: 2169953 - DNA, 20 bp, Homo sapiens
agaagatgtattcagagcca

SEQ ID NO: 2169954 - DNA, 22 bp, Homo sapiens
agaagcaagacacgtggcctcg

SEQ ID NO: 2169955 - DNA, 10 bp, Homo sapiens
agaagccagc

SEQ ID NO: 2169956 - DNA, 11 bp, Homo sapiens
agaagccagcc

SEQ ID NO: 2169957 - DNA, 12 bp, Homo sapiens
agaagccagcca

SEQ ID NO: 2169958 - DNA, 13 bp, Homo sapiens
agaaggaaagaag

SEQ ID NO: 2169959 - DNA, 13 bp, Homo sapiens
agaaggagaggct

SEQ ID NO: 2169960 - DNA, 13 bp, Homo sapiens
agaaggaggaatt

SEQ ID NO: 2169961 - DNA, 17 bp, Homo sapiens
agaaggcaagctggcag

SEQ ID NO: 2169962 - DNA, 18 bp, Homo sapiens
agaagggaaggggagagg

SEQ ID NO: 2169963 - DNA, 15 bp, Homo sapiens
agaagggggccctgc

SEQ ID NO: 2169964 - DNA, 21 bp, Homo sapiens
agaagggggccctgctacctg

SEQ ID NO: 2169965 - DNA, 19 bp, Homo sapiens
agaaggtgggggttggctg

SEQ ID NO: 2169966 - DNA, 20 bp, Homo sapiens
agaaggtgggggttggctgg

SEQ ID NO: 2169967 - DNA, 16 bp, Homo sapiens
agaagtagtggtttgc

SEQ ID NO: 2169968 - DNA, 22 bp, Homo sapiens
agaagtggcatctgaaaacaat

SEQ ID NO: 2169969 - DNA, 13 bp, Homo sapiens
agaagtgggagtg

SEQ ID NO: 2169970 - DNA, 22 bp, Homo sapiens
agaagtgggagtgggagaggaa

SEQ ID NO: 2169971 - DNA, 13 bp, Homo sapiens
agaagtgtgtttt

SEQ ID NO: 2169972 - DNA, 19 bp, Homo sapiens
agaagttagtttgtatata

SEQ ID NO: 2169973 - DNA, 22 bp, Homo sapiens
agaagttgttagtgatttgcta

SEQ ID NO: 2169974 - DNA, 14 bp, Homo sapiens
agaataaagaacat

SEQ ID NO: 2169975 - DNA, 21 bp, Homo sapiens
agaatattatagtttaaaagt

SEQ ID NO: 2169976 - DNA, 22 bp, Homo sapiens
agaatcccttaacagttgtatt

SEQ ID NO: 2169977 - DNA, 22 bp, Homo sapiens
agaatgaagataagtaatttac

SEQ ID NO: 2169978 - DNA, 17 bp, Homo sapiens
agaatgagagagtgtgg

SEQ ID NO: 2169979 - DNA, 16 bp, Homo sapiens
agaattaaaatttatt

SEQ ID NO: 2169980 - DNA, 17 bp, Homo sapiens
agaattcagctgccccc

SEQ ID NO: 2169981 - DNA, 11 bp, Homo sapiens
agaatttatta

SEQ ID NO: 2169982 - DNA, 17 bp, Homo sapiens
agacaaaccactgtaca

SEQ ID NO: 2169983 - DNA, 22 bp, Homo sapiens
agacaaatgggactgatgtcat

SEQ ID NO: 2169984 - DNA, 22 bp, Homo sapiens
agacaaccctgaggtatctgtg

SEQ ID NO: 2169985 - DNA, 23 bp, Homo sapiens
agacaaccctgaggtatctgtgt

SEQ ID NO: 2169986 - DNA, 18 bp, Homo sapiens
agacaagcagcccttgct

SEQ ID NO: 2169987 - DNA, 17 bp, Homo sapiens
agacaatgcagatgcca

SEQ ID NO: 2169988 - DNA, 23 bp, Homo sapiens
aggcccacctaccttcaaagctg

SEQ ID NO: 2169989 - DNA, 20 bp, Homo sapiens
aggccccagaggccctggag

SEQ ID NO: 2169990 - DNA, 13 bp, Homo sapiens
aggcccctggtgg

SEQ ID NO: 2169991 - DNA, 15 bp, Homo sapiens
aggcccttttctggc

SEQ ID NO: 2169992 - DNA, 20 bp, Homo sapiens
aggcccttttctggctcctg

SEQ ID NO: 2169993 - DNA, 19 bp, Homo sapiens
aggccgaggcaggggctgg

SEQ ID NO: 2169994 - DNA, 14 bp, Homo sapiens
aggccgcccacctg

SEQ ID NO: 2169995 - DNA, 16 bp, Homo sapiens
aggccgcccacctgca

SEQ ID NO: 2169996 - DNA, 16 bp, Homo sapiens
aggccgctgctgacca

SEQ ID NO: 2169997 - DNA, 16 bp, Homo sapiens
aggcctcaccctgctt

SEQ ID NO: 2169998 - DNA, 12 bp, Homo sapiens
aggcctctgggc

SEQ ID NO: 2169999 - DNA, 14 bp, Homo sapiens
aggcctcttgctgg

SEQ ID NO: 2170000 - DNA, 17 bp, Homo sapiens
aggcctcttgctggtgc

SEQ ID NO: 2170001 - DNA, 18 bp, Homo sapiens
aggcctcttgctggtgca

SEQ ID NO: 2170002 - DNA, 16 bp, Homo sapiens
aggcctgtccctggcc

SEQ ID NO: 2170003 - DNA, 17 bp, Homo sapiens
aggcctgtccctggcca

SEQ ID NO: 2170004 - DNA, 14 bp, Homo sapiens
aggcctttcctaca

SEQ ID NO: 2170005 - DNA, 16 bp, Homo sapiens
aggcgaggcgaagctg

SEQ ID NO: 2170006 - DNA, 18 bp, Homo sapiens
aggcgatgtggtgacccc

SEQ ID NO: 2170007 - DNA, 22 bp, Homo sapiens
aggcgcggttcaggtcagggct

SEQ ID NO: 2170008 - DNA, 16 bp, Homo sapiens
aggctacccttgccaa

SEQ ID NO: 2170009 - DNA, 13 bp, Homo sapiens
aggctactcacct

SEQ ID NO: 2170010 - DNA, 16 bp, Homo sapiens
aggctaggaagaactt

SEQ ID NO: 2170011 - DNA, 17 bp, Homo sapiens
aggctatcggagcagtt

SEQ ID NO: 2170012 - DNA, 19 bp, Homo sapiens
aggctcagccctgagctgg

SEQ ID NO: 2170013 - DNA, 13 bp, Homo sapiens
aggctcctggagc

SEQ ID NO: 2170014 - DNA, 20 bp, Homo sapiens
aggctctgaaagctgcttct

SEQ ID NO: 2170015 - DNA, 17 bp, Homo sapiens
aggctgcggtgggcagc

SEQ ID NO: 2170016 - DNA, 20 bp, Homo sapiens
aggctggagtgcagtggcac

SEQ ID NO: 2170017 - DNA, 16 bp, Homo sapiens
aggctggcctcagact

SEQ ID NO: 2170018 - DNA, 20 bp, Homo sapiens
aggctgggccaagccaggga

SEQ ID NO: 2170019 - DNA, 15 bp, Homo sapiens
aggctgggcccagag

SEQ ID NO: 2170020 - DNA, 22 bp, Homo sapiens
aggctggtcttgaactcctaga

SEQ ID NO: 2170021 - DNA, 17 bp, Homo sapiens
agggacattgaagtgtt

SEQ ID NO: 2170022 - DNA, 15 bp, Homo sapiens
agggacccctcctcc

SEQ ID NO: 2170023 - DNA, 15 bp, Homo sapiens
agggagaaggagagg

SEQ ID NO: 2170024 - DNA, 23 bp, Homo sapiens
agggagcagagaaggccaggggc

SEQ ID NO: 2170025 - DNA, 20 bp, Homo sapiens
agggatgcggatcctgctgg

SEQ ID NO: 2170026 - DNA, 11 bp, Homo sapiens
agggcaaagct

SEQ ID NO: 2170027 - DNA, 14 bp, Homo sapiens
agggcaaagctgat

SEQ ID NO: 2170028 - DNA, 16 bp, Homo sapiens
agggcaaagctgattt

SEQ ID NO: 2170029 - DNA, 20 bp, Homo sapiens
agggcaccaagcccacaggt

SEQ ID NO: 2170030 - DNA, 18 bp, Homo sapiens
agggcagcctgtgggaga

SEQ ID NO: 2170031 - DNA, 15 bp, Homo sapiens
agggccatctgactg

SEQ ID NO: 2170032 - DNA, 16 bp, Homo sapiens
agggccctctggggct

SEQ ID NO: 2170033 - DNA, 19 bp, Homo sapiens
agggccgactaagagaagt

SEQ ID NO: 2170034 - DNA, 17 bp, Homo sapiens
agggcctgacttttaca

SEQ ID NO: 2170035 - DNA, 18 bp, Homo sapiens
agggcctgacttttacag

SEQ ID NO: 2170036 - DNA, 17 bp, Homo sapiens
aggggaggacctctggg

SEQ ID NO: 2170037 - DNA, 18 bp, Homo sapiens
aggggcaagctaggcccc

SEQ ID NO: 2170038 - DNA, 22 bp, Homo sapiens
aggggcaagctaggccccagag

SEQ ID NO: 2170039 - DNA, 14 bp, Homo sapiens
aggggcaggagctc

SEQ ID NO: 2170040 - DNA, 17 bp, Homo sapiens
aggggcaggagctcaga

SEQ ID NO: 2170041 - DNA, 19 bp, Homo sapiens
aggggcaggagctcagatg

SEQ ID NO: 2170042 - DNA, 23 bp, Homo sapiens
aggggcagggaaggacaggaccc

SEQ ID NO: 2170043 - DNA, 14 bp, Homo sapiens
aggggcctctggct

SEQ ID NO: 2170044 - DNA, 19 bp, Homo sapiens
aggggcctctggctgcctg

SEQ ID NO: 2170045 - DNA, 20 bp, Homo sapiens
aggggcctgcagaaggaaag

SEQ ID NO: 2170046 - DNA, 15 bp, Homo sapiens
aggggctggactggc

SEQ ID NO: 2170047 - DNA, 17 bp, Homo sapiens
aggggcttccctctgct

SEQ ID NO: 2170048 - DNA, 13 bp, Homo sapiens
agggggccctgct

SEQ ID NO: 2170049 - DNA, 21 bp, Homo sapiens
aggggtggtgtccttctcctc

SEQ ID NO: 2170050 - DNA, 22 bp, Homo sapiens
aggggttttaggtctcttcccc

SEQ ID NO: 2170051 - DNA, 22 bp, Homo sapiens
agggtcctgctatttcccaagc

SEQ ID NO: 2170052 - DNA, 23 bp, Homo sapiens
agggtctccctatgttgcccagg

SEQ ID NO: 2170053 - DNA, 11 bp, Homo sapiens
agggtgttttt

SEQ ID NO: 2170054 - DNA, 19 bp, Homo sapiens
agggttctccattacagtg

SEQ ID NO: 2170055 - DNA, 19 bp, Homo sapiens
agggttgatatattctttc

SEQ ID NO: 2170056 - DNA, 14 bp, Homo sapiens
aggtcaaaaacaaa

SEQ ID NO: 2170057 - DNA, 21 bp, Homo sapiens
aggtcaaggcctgtccctggc

SEQ ID NO: 2170058 - DNA, 14 bp, Homo sapiens
aggtcaccagggga

SEQ ID NO: 2170059 - DNA, 20 bp, Homo sapiens
aggtcaccaggggaggagcc

SEQ ID NO: 2170060 - DNA, 22 bp, Homo sapiens
aggtcaccaggggaggagcctg

SEQ ID NO: 2170061 - DNA, 18 bp, Homo sapiens
aggtcagtacccacctga

SEQ ID NO: 2170062 - DNA, 21 bp, Homo sapiens
aggtcatacaatccattctta

SEQ ID NO: 2170063 - DNA, 16 bp, Homo sapiens
aggtcccaaggcaagg

SEQ ID NO: 2170064 - DNA, 23 bp, Homo sapiens
aggtcccgagccccctgtccttc

SEQ ID NO: 2170065 - DNA, 17 bp, Homo sapiens
aggtctccaggggcctg

SEQ ID NO: 2170066 - DNA, 15 bp, Homo sapiens
aggtctcttcccctc

SEQ ID NO: 2170067 - DNA, 21 bp, Homo sapiens
aggtctgggagaggcagagtg

SEQ ID NO: 2170068 - DNA, 21 bp, Homo sapiens
aggtgaaaattgtataaatta

SEQ ID NO: 2170069 - DNA, 22 bp, Homo sapiens
aggtgaccaaaatccccttctc

SEQ ID NO: 2170070 - DNA, 20 bp, Homo sapiens
aggtgattttcctgtgtcca

SEQ ID NO: 2170071 - DNA, 14 bp, Homo sapiens
aggtgccaccaccc

SEQ ID NO: 2170072 - DNA, 18 bp, Homo sapiens
aggtgccaccaccctgcc

SEQ ID NO: 2170073 - DNA, 20 bp, Homo sapiens
aggtggaggttgcagtgagc

SEQ ID NO: 2170074 - DNA, 13 bp, Homo sapiens
aggtgggaggccc

SEQ ID NO: 2170075 - DNA, 16 bp, Homo sapiens
aggtgggaggcccctg

SEQ ID NO: 2170076 - DNA, 21 bp, Homo sapiens
aggtgggaggcccctggtggc

SEQ ID NO: 2170077 - DNA, 18 bp, Homo sapiens
aggtggggaagagagcct

SEQ ID NO: 2170078 - DNA, 18 bp, Homo sapiens
aggtgggggttggctggg

SEQ ID NO: 2170079 - DNA, 17 bp, Homo sapiens
aggtggggtgaagctgg

SEQ ID NO: 2170080 - DNA, 21 bp, Homo sapiens
aggtggggtgaagctggggac

SEQ ID NO: 2170081 - DNA, 19 bp, Homo sapiens
aggttccccaagggccctg

SEQ ID NO: 2170082 - DNA, 22 bp, Homo sapiens
aggttccccaagggccctggca

SEQ ID NO: 2170083 - DNA, 14 bp, Homo sapiens
aggttctgaacagc

SEQ ID NO: 2170084 - DNA, 20 bp, Homo sapiens
aggttctggttagctcagcc

SEQ ID NO: 2170085 - DNA, 18 bp, Homo sapiens
aggttggaactgctgcca

SEQ ID NO: 2170086 - DNA, 13 bp, Homo sapiens
aggtttacagtga

SEQ ID NO: 2170087 - DNA, 22 bp, Homo sapiens
aggtttagaatcaagtctgtga

SEQ ID NO: 2170088 - DNA, 16 bp, Homo sapiens
agtaacaatgcatgct

SEQ ID NO: 2170089 - DNA, 16 bp, Homo sapiens
agtaacctttaaaaat

SEQ ID NO: 2170090 - DNA, 20 bp, Homo sapiens
agtaacctttaaaaatgtat

SEQ ID NO: 2170091 - DNA, 17 bp, Homo sapiens
agtaagcacctttagaa

SEQ ID NO: 2170092 - DNA, 20 bp, Homo sapiens
agtaagcacctttagaatat

SEQ ID NO: 2170093 - DNA, 18 bp, Homo sapiens
agtaaggcagctctgtcg

SEQ ID NO: 2170094 - DNA, 15 bp, Homo sapiens
agtaatagctgaacc

SEQ ID NO: 2170095 - DNA, 19 bp, Homo sapiens
agtacaagctgtaaacttg

SEQ ID NO: 2170096 - DNA, 12 bp, Homo sapiens
agtacaatcagc

SEQ ID NO: 2170097 - DNA, 15 bp, Homo sapiens
agtaccatagaacag

SEQ ID NO: 2170098 - DNA, 21 bp, Homo sapiens
agtacccaaaagctcagccag

SEQ ID NO: 2170099 - DNA, 14 bp, Homo sapiens
agtacctttgctct

SEQ ID NO: 2170100 - DNA, 17 bp, Homo sapiens
agtacctttgctcttgc

SEQ ID NO: 2170101 - DNA, 15 bp, Homo sapiens
agtactgcaaaatgc

SEQ ID NO: 2170102 - DNA, 18 bp, Homo sapiens
agtactgcaaaatgcttt

SEQ ID NO: 2170103 - DNA, 16 bp, Homo sapiens
agtagcaccttcagaa

SEQ ID NO: 2170104 - DNA, 13 bp, Homo sapiens
agtagcaggccca

SEQ ID NO: 2170105 - DNA, 13 bp, Homo sapiens
agtagctgagact

SEQ ID NO: 2170106 - DNA, 21 bp, Homo sapiens
agtagctgagactacaggtga

SEQ ID NO: 2170107 - DNA, 19 bp, Homo sapiens
agtagggatgcggatcctg

SEQ ID NO: 2170108 - DNA, 23 bp, Homo sapiens
agtaggttggaagctagctcccc

SEQ ID NO: 2170109 - DNA, 15 bp, Homo sapiens
agtagtggtttgctt

SEQ ID NO: 2170110 - DNA, 13 bp, Homo sapiens
caaagtgccctca

SEQ ID NO: 2170111 - DNA, 19 bp, Homo sapiens
caaagtgctgggattacag

SEQ ID NO: 2170112 - DNA, 23 bp, Homo sapiens
caaagtggtacaggaaggcttgc

SEQ ID NO: 2170113 - DNA, 16 bp, Homo sapiens
caaagttaacctacct

SEQ ID NO: 2170114 - DNA, 17 bp, Homo sapiens
caaagttaacctacctg

SEQ ID NO: 2170115 - DNA, 17 bp, Homo sapiens
caaagtttttacagtgt

SEQ ID NO: 2170116 - DNA, 13 bp, Homo sapiens
caaataaagcctt

SEQ ID NO: 2170117 - DNA, 14 bp, Homo sapiens
caaataaagccttt

SEQ ID NO: 2170118 - DNA, 15 bp, Homo sapiens
caaataaagcctttt

SEQ ID NO: 2170119 - DNA, 22 bp, Homo sapiens
caaataaagccttttaaatcat

SEQ ID NO: 2170120 - DNA, 18 bp, Homo sapiens
caaatacattaacaagct

SEQ ID NO: 2170121 - DNA, 18 bp, Homo sapiens
caaatacttcaaatcata

SEQ ID NO: 2170122 - DNA, 11 bp, Homo sapiens
caaatgggact

SEQ ID NO: 2170123 - DNA, 22 bp, Homo sapiens
caaatggttccagatacttcag

SEQ ID NO: 2170124 - DNA, 12 bp, Homo sapiens
caaatgtgtact

SEQ ID NO: 2170125 - DNA, 13 bp, Homo sapiens
caaattccaatac

SEQ ID NO: 2170126 - DNA, 16 bp, Homo sapiens
caaattccaatacatt

SEQ ID NO: 2170127 - DNA, 17 bp, Homo sapiens
caaatttcatctttcca

SEQ ID NO: 2170128 - DNA, 13 bp, Homo sapiens
caacaaaccaaga

SEQ ID NO: 2170129 - DNA, 13 bp, Homo sapiens
caacaacatcaga

SEQ ID NO: 2170130 - DNA, 16 bp, Homo sapiens
caacaacgtgagagaa

SEQ ID NO: 2170131 - DNA, 19 bp, Homo sapiens
caacacttcagactgcaag

SEQ ID NO: 2170132 - DNA, 23 bp, Homo sapiens
caacagcacttgcttgcggaact

SEQ ID NO: 2170133 - DNA, 15 bp, Homo sapiens
caacaggctgtgtgt

SEQ ID NO: 2170134 - DNA, 21 bp, Homo sapiens
caacaggtgctgaactgtgca

SEQ ID NO: 2170135 - DNA, 13 bp, Homo sapiens
caacagttaaact

SEQ ID NO: 2170136 - DNA, 13 bp, Homo sapiens
caacataaaacaa

SEQ ID NO: 2170137 - DNA, 17 bp, Homo sapiens
caacataaaacaaaacc

SEQ ID NO: 2170138 - DNA, 20 bp, Homo sapiens
caacataaaacaaaaccaag

SEQ ID NO: 2170139 - DNA, 15 bp, Homo sapiens
caacatcagaaagaa

SEQ ID NO: 2170140 - DNA, 16 bp, Homo sapiens
caaccatgtcatttca

SEQ ID NO: 2170141 - DNA, 22 bp, Homo sapiens
caaccatgtcatttcagaagtt

SEQ ID NO: 2170142 - DNA, 20 bp, Homo sapiens
caaccctgaggtatctgtgt

SEQ ID NO: 2170143 - DNA, 15 bp, Homo sapiens
caacctgtaagactg

SEQ ID NO: 2170144 - DNA, 22 bp, Homo sapiens
caacgtgagagaaagagagaag

SEQ ID NO: 2170145 - DNA, 12 bp, Homo sapiens
caactccttcct

SEQ ID NO: 2170146 - DNA, 17 bp, Homo sapiens
caactccttcctctttg

SEQ ID NO: 2170147 - DNA, 16 bp, Homo sapiens
caactgatcatttgca

SEQ ID NO: 2170148 - DNA, 21 bp, Homo sapiens
caactgctctcaaaatgtgaa

SEQ ID NO: 2170149 - DNA, 13 bp, Homo sapiens
caactgctgcccc

SEQ ID NO: 2170150 - DNA, 11 bp, Homo sapiens
caactggaaaa

SEQ ID NO: 2170151 - DNA, 23 bp, Homo sapiens
caactggaaaagtgttccttgct

SEQ ID NO: 2170152 - DNA, 16 bp, Homo sapiens
caactgtttccctgct

SEQ ID NO: 2170153 - DNA, 18 bp, Homo sapiens
caactgtttccctgctga

SEQ ID NO: 2170154 - DNA, 19 bp, Homo sapiens
caactgtttccctgctgaa

SEQ ID NO: 2170155 - DNA, 14 bp, Homo sapiens
caacttaagtttag

SEQ ID NO: 2170156 - DNA, 23 bp, Homo sapiens
caacttaagtttagaaattacaa

SEQ ID NO: 2170157 - DNA, 14 bp, Homo sapiens
caagaagcagtggc

SEQ ID NO: 2170158 - DNA, 12 bp, Homo sapiens
caagaaggctgg

SEQ ID NO: 2170159 - DNA, 14 bp, Homo sapiens
caagaagtgggagt

SEQ ID NO: 2170160 - DNA, 22 bp, Homo sapiens
caagaagtgggagtgggagagg

SEQ ID NO: 2170161 - DNA, 17 bp, Homo sapiens
caagacacgtggcctcg

SEQ ID NO: 2170162 - DNA, 21 bp, Homo sapiens
caagacacgtggcctcgtgag

SEQ ID NO: 2170163 - DNA, 18 bp, Homo sapiens
caagaccatttcacagaa

SEQ ID NO: 2170164 - DNA, 14 bp, Homo sapiens
caagacctgactca

SEQ ID NO: 2170165 - DNA, 20 bp, Homo sapiens
caagaccttcaccaaacata

SEQ ID NO: 2170166 - DNA, 13 bp, Homo sapiens
caagactaacctt

SEQ ID NO: 2170167 - DNA, 20 bp, Homo sapiens
caagactaacctttgttcgt

SEQ ID NO: 2170168 - DNA, 20 bp, Homo sapiens
caagaggcctttcttttaaa

SEQ ID NO: 2170169 - DNA, 15 bp, Homo sapiens
caagcagcccttgct

SEQ ID NO: 2170170 - DNA, 22 bp, Homo sapiens
caagcatttaatgtagccatgg

SEQ ID NO: 2170171 - DNA, 18 bp, Homo sapiens
caagccagattctcttga

SEQ ID NO: 2170172 - DNA, 23 bp, Homo sapiens
caagcccacaggtgtccccagcc

SEQ ID NO: 2170173 - DNA, 14 bp, Homo sapiens
caagcctgggccac

SEQ ID NO: 2170174 - DNA, 17 bp, Homo sapiens
caagcctgggccactgg

SEQ ID NO: 2170175 - DNA, 18 bp, Homo sapiens
caagcctgggccactggc

SEQ ID NO: 2170176 - DNA, 16 bp, Homo sapiens
caagcctggtctcctc

SEQ ID NO: 2170177 - DNA, 20 bp, Homo sapiens
caagccttggctcgttctct

SEQ ID NO: 2170178 - DNA, 15 bp, Homo sapiens
caagcgactctcctg

SEQ ID NO: 2170179 - DNA, 23 bp, Homo sapiens
caagcgactctcctgcctcagcc

SEQ ID NO: 2170180 - DNA, 22 bp, Homo sapiens
caagcgatccctcccctcagcc

SEQ ID NO: 2170181 - DNA, 16 bp, Homo sapiens
caagctaggccccaga

SEQ ID NO: 2170182 - DNA, 19 bp, Homo sapiens
caagctaggccccagaggc

SEQ ID NO: 2170183 - DNA, 23 bp, Homo sapiens
caagctaggccccagaggccctg

SEQ ID NO: 2170184 - DNA, 16 bp, Homo sapiens
caagctcttctcctca

SEQ ID NO: 2170185 - DNA, 20 bp, Homo sapiens
caagctcttctcctcagctt

SEQ ID NO: 2170186 - DNA, 14 bp, Homo sapiens
caagctgcctccct

SEQ ID NO: 2170187 - DNA, 15 bp, Homo sapiens
caagctgcctccctg

SEQ ID NO: 2170188 - DNA, 12 bp, Homo sapiens
caagctggcagg

SEQ ID NO: 2170189 - DNA, 18 bp, Homo sapiens
caagctggcaggagggtg

SEQ ID NO: 2170190 - DNA, 21 bp, Homo sapiens
caagctgtatgtacttccagt

SEQ ID NO: 2170191 - DNA, 13 bp, Homo sapiens
caagctgtccctg

SEQ ID NO: 2170192 - DNA, 14 bp, Homo sapiens
caagctgtccctgc

SEQ ID NO: 2170193 - DNA, 16 bp, Homo sapiens
caagctgtccctgcag

SEQ ID NO: 2170194 - DNA, 18 bp, Homo sapiens
caagctgtccctgcaggg

SEQ ID NO: 2170195 - DNA, 23 bp, Homo sapiens
caaggaaatacaacctagggtgc

SEQ ID NO: 2170196 - DNA, 15 bp, Homo sapiens
caaggacatttggga

SEQ ID NO: 2170197 - DNA, 13 bp, Homo sapiens
caaggcaaggggt

SEQ ID NO: 2170198 - DNA, 21 bp, Homo sapiens
caaggcaaggggtgcctggga

SEQ ID NO: 2170199 - DNA, 14 bp, Homo sapiens
caaggccgcccacc

SEQ ID NO: 2170200 - DNA, 13 bp, Homo sapiens
caagggccctggc

SEQ ID NO: 2170201 - DNA, 23 bp, Homo sapiens
caagtcccaccggttgcttctgg

SEQ ID NO: 2170202 - DNA, 13 bp, Homo sapiens
caagtctgtgaaa

SEQ ID NO: 2170203 - DNA, 19 bp, Homo sapiens
caagtctgtgcctggagct

SEQ ID NO: 2170204 - DNA, 23 bp, Homo sapiens
caagtctgtgcctggagctcctg

SEQ ID NO: 2170205 - DNA, 20 bp, Homo sapiens
caagtgaatgagtttccagc

SEQ ID NO: 2170206 - DNA, 13 bp, Homo sapiens
caagtttcagtaa

SEQ ID NO: 2170207 - DNA, 19 bp, Homo sapiens
caagtttttaatcgttttt

SEQ ID NO: 2170208 - DNA, 22 bp, Homo sapiens
caataaagtactgcaaaatgct

SEQ ID NO: 2170209 - DNA, 22 bp, Homo sapiens
caataattgtggagaggagaga

SEQ ID NO: 2170210 - DNA, 19 bp, Homo sapiens
caatacccaaatcctctcc

SEQ ID NO: 2170211 - DNA, 16 bp, Homo sapiens
caatagcacatatgga

SEQ ID NO: 2170212 - DNA, 15 bp, Homo sapiens
caatatcaatatggt

SEQ ID NO: 2170213 - DNA, 13 bp, Homo sapiens
caatcaaagctac

SEQ ID NO: 2170214 - DNA, 20 bp, Homo sapiens
caatcaaagctacctttttt

SEQ ID NO: 2170215 - DNA, 20 bp, Homo sapiens
caatctattaatagctgcct

SEQ ID NO: 2170216 - DNA, 11 bp, Homo sapiens
caatctctgtt

SEQ ID NO: 2170217 - DNA, 18 bp, Homo sapiens
caatctttccttgtctct

SEQ ID NO: 2170218 - DNA, 15 bp, Homo sapiens
caatgaaaagaaaat

SEQ ID NO: 2170219 - DNA, 19 bp, Homo sapiens
caatgaaaagaaaatgtgc

SEQ ID NO: 2170220 - DNA, 17 bp, Homo sapiens
caatgcagatgccagag

SEQ ID NO: 2170221 - DNA, 18 bp, Homo sapiens
caatgcagatgccagagc

SEQ ID NO: 2170222 - DNA, 22 bp, Homo sapiens
caatgcatttttaagaatttat

SEQ ID NO: 2170223 - DNA, 19 bp, Homo sapiens
caattcaaacaattcaatc

SEQ ID NO: 2170224 - DNA, 13 bp, Homo sapiens
caattgtgacagc

SEQ ID NO: 2170225 - DNA, 14 bp, Homo sapiens
caattgtgacagca

SEQ ID NO: 2170226 - DNA, 19 bp, Homo sapiens
caatttcttctgtagctat

SEQ ID NO: 2170227 - DNA, 22 bp, Homo sapiens
caattttttttctgaacaaaag

SEQ ID NO: 2170228 - DNA, 20 bp, Homo sapiens
cacaaaagtatattcaaaaa

SEQ ID NO: 2170229 - DNA, 14 bp, Homo sapiens
cacaaatgtgtact

SEQ ID NO: 2170230 - DNA, 23 bp, Homo sapiens
cacaacaggctgtgtgtggaaat

SEQ ID NO: 2170231 - DNA, 18 bp, Homo sapiens
cacaacctcctcctccag

SEQ ID NO: 2170232 - DNA, 22 bp, Homo sapiens
cagtgatttttagtaaccttta

SEQ ID NO: 2170233 - DNA, 18 bp, Homo sapiens
cagtgcccagtgatggca

SEQ ID NO: 2170234 - DNA, 12 bp, Homo sapiens
cagtggcagcaa

SEQ ID NO: 2170235 - DNA, 22 bp, Homo sapiens
cagtggcagcaacaaaggattt

SEQ ID NO: 2170236 - DNA, 23 bp, Homo sapiens
cagtggcctggctccgctgtgtg

SEQ ID NO: 2170237 - DNA, 13 bp, Homo sapiens
cagtggggctggg

SEQ ID NO: 2170238 - DNA, 22 bp, Homo sapiens
cagtggggtcgtgaggcaagat

SEQ ID NO: 2170239 - DNA, 14 bp, Homo sapiens
cagtgtagccccaa

SEQ ID NO: 2170240 - DNA, 23 bp, Homo sapiens
cagtgtatctcgaagtcttccat

SEQ ID NO: 2170241 - DNA, 12 bp, Homo sapiens
cagtgtgaagcc

SEQ ID NO: 2170242 - DNA, 16 bp, Homo sapiens
cagtgtgccaccctct

SEQ ID NO: 2170243 - DNA, 18 bp, Homo sapiens
cagtgtgccaccctctgc

SEQ ID NO: 2170244 - DNA, 15 bp, Homo sapiens
cagtgtgtctcctgc

SEQ ID NO: 2170245 - DNA, 16 bp, Homo sapiens
cagtgtgtctcctgca

SEQ ID NO: 2170246 - DNA, 17 bp, Homo sapiens
cagtgtttggtgacata

SEQ ID NO: 2170247 - DNA, 15 bp, Homo sapiens
cagttaaacttgcaa

SEQ ID NO: 2170248 - DNA, 19 bp, Homo sapiens
cagttaagcagccgccaca

SEQ ID NO: 2170249 - DNA, 18 bp, Homo sapiens
cagttacagggcccaggt

SEQ ID NO: 2170250 - DNA, 18 bp, Homo sapiens
cagttagagatgcctccc

SEQ ID NO: 2170251 - DNA, 22 bp, Homo sapiens
cagttattagaacttagttttg

SEQ ID NO: 2170252 - DNA, 22 bp, Homo sapiens
cagttcatgttgctcagaagag

SEQ ID NO: 2170253 - DNA, 16 bp, Homo sapiens
cagttccaatgtgccc

SEQ ID NO: 2170254 - DNA, 21 bp, Homo sapiens
cagttccaatgtgcccagtca

SEQ ID NO: 2170255 - DNA, 16 bp, Homo sapiens
cagttgaataatttgt

SEQ ID NO: 2170256 - DNA, 20 bp, Homo sapiens
cagttgactggctttcctct

SEQ ID NO: 2170257 - DNA, 21 bp, Homo sapiens
cagttgactggctttcctctc

SEQ ID NO: 2170258 - DNA, 22 bp, Homo sapiens
cagttgagtttcttctaaagag

SEQ ID NO: 2170259 - DNA, 21 bp, Homo sapiens
cagttgtatttaacagaaatt

SEQ ID NO: 2170260 - DNA, 18 bp, Homo sapiens
cagtttctgttgtttctt

SEQ ID NO: 2170261 - DNA, 12 bp, Homo sapiens
cagtttcttaaa

SEQ ID NO: 2170262 - DNA, 21 bp, Homo sapiens
cagtttgagcttgctggagag

SEQ ID NO: 2170263 - DNA, 20 bp, Homo sapiens
cagtttgataactagggaag

SEQ ID NO: 2170264 - DNA, 20 bp, Homo sapiens
cagtttggctgtaatttaat

SEQ ID NO: 2170265 - DNA, 14 bp, Homo sapiens
cagttttgtgtaca

SEQ ID NO: 2170266 - DNA, 15 bp, Homo sapiens
cagttttgtgtacag

SEQ ID NO: 2170267 - DNA, 21 bp, Homo sapiens
cagttttgtgtacagtatgtg

SEQ ID NO: 2170268 - DNA, 15 bp, Homo sapiens
cataaaacaaaacca

SEQ ID NO: 2170269 - DNA, 22 bp, Homo sapiens
cataaaacaaaaccaagccttg

SEQ ID NO: 2170270 - DNA, 15 bp, Homo sapiens
cataaagcaccagca

SEQ ID NO: 2170271 - DNA, 15 bp, Homo sapiens
cataaattaatttga

SEQ ID NO: 2170272 - DNA, 22 bp, Homo sapiens
cataactggcttctgcttgtca

SEQ ID NO: 2170273 - DNA, 17 bp, Homo sapiens
cataatttgcataaagg

SEQ ID NO: 2170274 - DNA, 15 bp, Homo sapiens
catacagagtgggcc

SEQ ID NO: 2170275 - DNA, 22 bp, Homo sapiens
cataccactttgacacgcttca

SEQ ID NO: 2170276 - DNA, 17 bp, Homo sapiens
catactgtgctggagcc

SEQ ID NO: 2170277 - DNA, 18 bp, Homo sapiens
catactgtgctggagcca

SEQ ID NO: 2170278 - DNA, 14 bp, Homo sapiens
catagctcctgctc

SEQ ID NO: 2170279 - DNA, 15 bp, Homo sapiens
catagctcctgctcc

SEQ ID NO: 2170280 - DNA, 15 bp, Homo sapiens
catagctgtatattt

SEQ ID NO: 2170281 - DNA, 14 bp, Homo sapiens
catataaatggaat

SEQ ID NO: 2170282 - DNA, 17 bp, Homo sapiens
catataaatggaatcac

SEQ ID NO: 2170283 - DNA, 13 bp, Homo sapiens
catattaaaatca

SEQ ID NO: 2170284 - DNA, 19 bp, Homo sapiens
catattaatataagtttct

SEQ ID NO: 2170285 - DNA, 20 bp, Homo sapiens
catattaatataagtttctt

SEQ ID NO: 2170286 - DNA, 21 bp, Homo sapiens
catattaatataagtttcttt

SEQ ID NO: 2170287 - DNA, 18 bp, Homo sapiens
catattgataataaaatt

SEQ ID NO: 2170288 - DNA, 19 bp, Homo sapiens
catattgataataaaattc

SEQ ID NO: 2170289 - DNA, 22 bp, Homo sapiens
catattgataataaaattcatt

SEQ ID NO: 2170290 - DNA, 16 bp, Homo sapiens
catcaagatacacttg

SEQ ID NO: 2170291 - DNA, 16 bp, Homo sapiens
catcaattctctatca

SEQ ID NO: 2170292 - DNA, 20 bp, Homo sapiens
catcagaggcctagtcagcc

SEQ ID NO: 2170293 - DNA, 13 bp, Homo sapiens
catcagcagcttg

SEQ ID NO: 2170294 - DNA, 14 bp, Homo sapiens
catcagcctctggc

SEQ ID NO: 2170295 - DNA, 16 bp, Homo sapiens
catcagcctctggcca

SEQ ID NO: 2170296 - DNA, 15 bp, Homo sapiens
catcaggactcttgt

SEQ ID NO: 2170297 - DNA, 21 bp, Homo sapiens
catccacacaacaccaggact

SEQ ID NO: 2170298 - DNA, 22 bp, Homo sapiens
catccacacaacaccaggactt

SEQ ID NO: 2170299 - DNA, 13 bp, Homo sapiens
catccacctcctt

SEQ ID NO: 2170300 - DNA, 14 bp, Homo sapiens
catccacctccttc

SEQ ID NO: 2170301 - DNA, 16 bp, Homo sapiens
catccacctccttctc

SEQ ID NO: 2170302 - DNA, 11 bp, Homo sapiens
catccccctcc

SEQ ID NO: 2170303 - DNA, 13 bp, Homo sapiens
catccccctcctt

SEQ ID NO: 2170304 - DNA, 18 bp, Homo sapiens
catccctgccaagaactc

SEQ ID NO: 2170305 - DNA, 14 bp, Homo sapiens
catccgtctcccct

SEQ ID NO: 2170306 - DNA, 20 bp, Homo sapiens
catccgtgagcagtgtgtct

SEQ ID NO: 2170307 - DNA, 14 bp, Homo sapiens
catcctgtacaagt

SEQ ID NO: 2170308 - DNA, 17 bp, Homo sapiens
catcggtcctgtctccc

SEQ ID NO: 2170309 - DNA, 22 bp, Homo sapiens
catcggtcctgtctcccctctg

SEQ ID NO: 2170310 - DNA, 19 bp, Homo sapiens
catctagagcttgatgcca

SEQ ID NO: 2170311 - DNA, 14 bp, Homo sapiens
catctatgtgaata

SEQ ID NO: 2170312 - DNA, 17 bp, Homo sapiens
catctatgtgaatattt

SEQ ID NO: 2170313 - DNA, 20 bp, Homo sapiens
catctcagttcactgcaact

SEQ ID NO: 2170314 - DNA, 13 bp, Homo sapiens
catctctggagtg

SEQ ID NO: 2170315 - DNA, 19 bp, Homo sapiens
catctctggagtgtgtggg

SEQ ID NO: 2170316 - DNA, 12 bp, Homo sapiens
catctgactgcc

SEQ ID NO: 2170317 - DNA, 13 bp, Homo sapiens
catctgactgcca

SEQ ID NO: 2170318 - DNA, 15 bp, Homo sapiens
catctgaggttttat

SEQ ID NO: 2170319 - DNA, 21 bp, Homo sapiens
catctgaggttttatttcatt

SEQ ID NO: 2170320 - DNA, 14 bp, Homo sapiens
catctgccttgctg

SEQ ID NO: 2170321 - DNA, 16 bp, Homo sapiens
catctgccttgctgca

SEQ ID NO: 2170322 - DNA, 17 bp, Homo sapiens
catctgccttgctgcac

SEQ ID NO: 2170323 - DNA, 11 bp, Homo sapiens
catctggaaat

SEQ ID NO: 2170324 - DNA, 12 bp, Homo sapiens
catctggaaatc

SEQ ID NO: 2170325 - DNA, 18 bp, Homo sapiens
catctggaaatccagctg

SEQ ID NO: 2170326 - DNA, 20 bp, Homo sapiens
catctggaaatccagctggt

SEQ ID NO: 2170327 - DNA, 23 bp, Homo sapiens
catctgttacattctaagtgtgt

SEQ ID NO: 2170328 - DNA, 11 bp, Homo sapiens
catcttgagct

SEQ ID NO: 2170329 - DNA, 23 bp, Homo sapiens
catcttttgggaagccaggaaag

SEQ ID NO: 2170330 - DNA, 13 bp, Homo sapiens
catgaatacacaa

SEQ ID NO: 2170331 - DNA, 14 bp, Homo sapiens
catgacatttctca

SEQ ID NO: 2170332 - DNA, 15 bp, Homo sapiens
catgacatttctcaa

SEQ ID NO: 2170333 - DNA, 14 bp, Homo sapiens
catgactggacagc

SEQ ID NO: 2170334 - DNA, 20 bp, Homo sapiens
catgacttccctccacccct

SEQ ID NO: 2170335 - DNA, 14 bp, Homo sapiens
catgagggtgtttt

SEQ ID NO: 2170336 - DNA, 15 bp, Homo sapiens
catgagtcttgtaat

SEQ ID NO: 2170337 - DNA, 13 bp, Homo sapiens
catgcactactga

SEQ ID NO: 2170338 - DNA, 21 bp, Homo sapiens
catgccgctgcatccgtgagc

SEQ ID NO: 2170339 - DNA, 20 bp, Homo sapiens
catgctacctgatcccactc

SEQ ID NO: 2170340 - DNA, 16 bp, Homo sapiens
catgctgctatgaaga

SEQ ID NO: 2170341 - DNA, 18 bp, Homo sapiens
catgctgctttgcacaca

SEQ ID NO: 2170342 - DNA, 18 bp, Homo sapiens
catgctggacaggtctgg

SEQ ID NO: 2170343 - DNA, 20 bp, Homo sapiens
catgctggacaggtctggga

SEQ ID NO: 2170344 - DNA, 15 bp, Homo sapiens
catggcaataaatgg

SEQ ID NO: 2170345 - DNA, 13 bp, Homo sapiens
catggccacatcc

SEQ ID NO: 2170346 - DNA, 14 bp, Homo sapiens
catggctcactgca

SEQ ID NO: 2170347 - DNA, 17 bp, Homo sapiens
catggctctgaactgca

SEQ ID NO: 2170348 - DNA, 20 bp, Homo sapiens
catggctctgaactgcacaa

SEQ ID NO: 2170349 - DNA, 19 bp, Homo sapiens
catgggcccctctgactcc

SEQ ID NO: 2170350 - DNA, 17 bp, Homo sapiens
catggtagactgtgaca

SEQ ID NO: 2170351 - DNA, 16 bp, Homo sapiens
catggtgcctctggag

SEQ ID NO: 2170352 - DNA, 17 bp, Homo sapiens
catgtagaagagggaga

SEQ ID NO: 2170353 - DNA, 23 bp, Homo sapiens
catgtagaagagggagaaggaga

SEQ ID NO: 2170354 - DNA, 21 bp, Homo sapiens
ccccttcctgtctggcccaaa

SEQ ID NO: 2170355 - DNA, 15 bp, Homo sapiens
ccccttctcatcact

SEQ ID NO: 2170356 - DNA, 15 bp, Homo sapiens
cccgagccccctgtc

SEQ ID NO: 2170357 - DNA, 19 bp, Homo sapiens
cccgagccccctgtccttc

SEQ ID NO: 2170358 - DNA, 22 bp, Homo sapiens
cccgcatgcagcagcttgctgc

SEQ ID NO: 2170359 - DNA, 16 bp, Homo sapiens
cccgccgtgcctgcat

SEQ ID NO: 2170360 - DNA, 18 bp, Homo sapiens
cccgcctccctcccctgc

SEQ ID NO: 2170361 - DNA, 19 bp, Homo sapiens
cccgccttggcctcccaaa

SEQ ID NO: 2170362 - DNA, 13 bp, Homo sapiens
cccgctggctggg

SEQ ID NO: 2170363 - DNA, 19 bp, Homo sapiens
cccggcccccgccctctgc

SEQ ID NO: 2170364 - DNA, 21 bp, Homo sapiens
cccggccggagaacatctgcc

SEQ ID NO: 2170365 - DNA, 22 bp, Homo sapiens
cccggccggagaacatctgcct

SEQ ID NO: 2170366 - DNA, 13 bp, Homo sapiens
cccgtctgctcct

SEQ ID NO: 2170367 - DNA, 15 bp, Homo sapiens
cccgtcttcctcctc

SEQ ID NO: 2170368 - DNA, 20 bp, Homo sapiens
cccgtcttcctcctcccctg

SEQ ID NO: 2170369 - DNA, 18 bp, Homo sapiens
cccgtgcaaaacatgcta

SEQ ID NO: 2170370 - DNA, 17 bp, Homo sapiens
cccgtttccaagcctgg

SEQ ID NO: 2170371 - DNA, 16 bp, Homo sapiens
ccctacattagtaaaa

SEQ ID NO: 2170372 - DNA, 18 bp, Homo sapiens
ccctacttccaagaaaaa

SEQ ID NO: 2170373 - DNA, 22 bp, Homo sapiens
ccctagctgggcaaacccttct

SEQ ID NO: 2170374 - DNA, 13 bp, Homo sapiens
ccctagggctggg

SEQ ID NO: 2170375 - DNA, 18 bp, Homo sapiens
ccctataatgctggagcg

SEQ ID NO: 2170376 - DNA, 15 bp, Homo sapiens
ccctcaggaattcag

SEQ ID NO: 2170377 - DNA, 18 bp, Homo sapiens
ccctcagtgtgaagcctg

SEQ ID NO: 2170378 - DNA, 16 bp, Homo sapiens
ccctcccgcagagact

SEQ ID NO: 2170379 - DNA, 15 bp, Homo sapiens
ccctccctgcagggt

SEQ ID NO: 2170380 - DNA, 19 bp, Homo sapiens
ccctccttccctggtccag

SEQ ID NO: 2170381 - DNA, 22 bp, Homo sapiens
ccctccttgccgctgggagagc

SEQ ID NO: 2170382 - DNA, 15 bp, Homo sapiens
ccctcggtcttcggc

SEQ ID NO: 2170383 - DNA, 20 bp, Homo sapiens
ccctcggtgcagaaactacc

SEQ ID NO: 2170384 - DNA, 12 bp, Homo sapiens
ccctctatttat

SEQ ID NO: 2170385 - DNA, 13 bp, Homo sapiens
ccctctatttatt

SEQ ID NO: 2170386 - DNA, 18 bp, Homo sapiens
ccctctatttattagcca

SEQ ID NO: 2170387 - DNA, 19 bp, Homo sapiens
ccctctgaggctcagccct

SEQ ID NO: 2170388 - DNA, 15 bp, Homo sapiens
ccctctgcagggcag

SEQ ID NO: 2170389 - DNA, 21 bp, Homo sapiens
ccctctgcagggcagcctgtg

SEQ ID NO: 2170390 - DNA, 14 bp, Homo sapiens
ccctctgcccccag

SEQ ID NO: 2170391 - DNA, 15 bp, Homo sapiens
ccctctgcccccagc

SEQ ID NO: 2170392 - DNA, 14 bp, Homo sapiens
ccctctgctggccg

SEQ ID NO: 2170393 - DNA, 18 bp, Homo sapiens
ccctctggcccacacaga

SEQ ID NO: 2170394 - DNA, 17 bp, Homo sapiens
ccctctgttcagtaaca

SEQ ID NO: 2170395 - DNA, 12 bp, Homo sapiens
ccctgagccggc

SEQ ID NO: 2170396 - DNA, 20 bp, Homo sapiens
ccctgagctggcctcacctg

SEQ ID NO: 2170397 - DNA, 16 bp, Homo sapiens
ccctgagttggcatca

SEQ ID NO: 2170398 - DNA, 20 bp, Homo sapiens
ccctgagttggcatcacctg

SEQ ID NO: 2170399 - DNA, 23 bp, Homo sapiens
ccctgcagggtagggggcctgag

SEQ ID NO: 2170400 - DNA, 11 bp, Homo sapiens
ccctgctacct

SEQ ID NO: 2170401 - DNA, 17 bp, Homo sapiens
ccctgctgaatgcctcg

SEQ ID NO: 2170402 - DNA, 21 bp, Homo sapiens
ccctgcttcaatacccaaatc

SEQ ID NO: 2170403 - DNA, 18 bp, Homo sapiens
ccctggaggtctccaggg

SEQ ID NO: 2170404 - DNA, 19 bp, Homo sapiens
ccctggaggtctccagggg

SEQ ID NO: 2170405 - DNA, 21 bp, Homo sapiens
ccctggcacccccacaagctg

SEQ ID NO: 2170406 - DNA, 20 bp, Homo sapiens
ccctggccaccaccccccac

SEQ ID NO: 2170407 - DNA, 23 bp, Homo sapiens
ccctggccaccaccccccactct

SEQ ID NO: 2170408 - DNA, 13 bp, Homo sapiens
ccctggccatctc

SEQ ID NO: 2170409 - DNA, 16 bp, Homo sapiens
ccctggctggggactt

SEQ ID NO: 2170410 - DNA, 17 bp, Homo sapiens
ccctggctggggacttg

SEQ ID NO: 2170411 - DNA, 11 bp, Homo sapiens
ccctggctggt

SEQ ID NO: 2170412 - DNA, 19 bp, Homo sapiens
ccctggtccagattgtagc

SEQ ID NO: 2170413 - DNA, 14 bp, Homo sapiens
ccctggtgaggaag

SEQ ID NO: 2170414 - DNA, 21 bp, Homo sapiens
ccctggtgaggaagctccagt

SEQ ID NO: 2170415 - DNA, 17 bp, Homo sapiens
ccctgtatggagctaga

SEQ ID NO: 2170416 - DNA, 22 bp, Homo sapiens
ccctgtccttcccacggccact

SEQ ID NO: 2170417 - DNA, 15 bp, Homo sapiens
ccctgttctggacat

SEQ ID NO: 2170418 - DNA, 22 bp, Homo sapiens
cccttagcccccacccacttcc

SEQ ID NO: 2170419 - DNA, 20 bp, Homo sapiens
cccttcaagacgaggggcag

SEQ ID NO: 2170420 - DNA, 17 bp, Homo sapiens
cccttccacacccccac

SEQ ID NO: 2170421 - DNA, 17 bp, Homo sapiens
cccttccaggccatcag

SEQ ID NO: 2170422 - DNA, 14 bp, Homo sapiens
cccttcctgtctgg

SEQ ID NO: 2170423 - DNA, 15 bp, Homo sapiens
cccttctcatcactc

SEQ ID NO: 2170424 - DNA, 19 bp, Homo sapiens
cccttctcatcactcccct

SEQ ID NO: 2170425 - DNA, 17 bp, Homo sapiens
cccttctgtgcccagct

SEQ ID NO: 2170426 - DNA, 18 bp, Homo sapiens
cccttctgtgcccagctc

SEQ ID NO: 2170427 - DNA, 14 bp, Homo sapiens
cccttgccaaggcc

SEQ ID NO: 2170428 - DNA, 15 bp, Homo sapiens
cccttgccaaggccg

SEQ ID NO: 2170429 - DNA, 16 bp, Homo sapiens
cccttgctgggtccag

SEQ ID NO: 2170430 - DNA, 15 bp, Homo sapiens
cccttgtctgctgct

SEQ ID NO: 2170431 - DNA, 16 bp, Homo sapiens
cccttgtctgctgctc

SEQ ID NO: 2170432 - DNA, 22 bp, Homo sapiens
cccttgtgcattgtgtgtcaca

SEQ ID NO: 2170433 - DNA, 18 bp, Homo sapiens
ccctttcactgaagtgaa

SEQ ID NO: 2170434 - DNA, 14 bp, Homo sapiens
cccttttctggctc

SEQ ID NO: 2170435 - DNA, 16 bp, Homo sapiens
ccctttttccttgtcc

SEQ ID NO: 2170436 - DNA, 23 bp, Homo sapiens
ccctttttccttgtccccacact

SEQ ID NO: 2170437 - DNA, 19 bp, Homo sapiens
ccgagatcggggtggcaga

SEQ ID NO: 2170438 - DNA, 16 bp, Homo sapiens
ccgagccccctgtcct

SEQ ID NO: 2170439 - DNA, 17 bp, Homo sapiens
ccgaggacccaggaaag

SEQ ID NO: 2170440 - DNA, 12 bp, Homo sapiens
ccgaggcagggg

SEQ ID NO: 2170441 - DNA, 15 bp, Homo sapiens
ccgaggcaggggctg

SEQ ID NO: 2170442 - DNA, 20 bp, Homo sapiens
ccgaggcaggggctgggcag

SEQ ID NO: 2170443 - DNA, 13 bp, Homo sapiens
ccgatgagctggt

SEQ ID NO: 2170444 - DNA, 17 bp, Homo sapiens
ccgcaaaacccactgac

SEQ ID NO: 2170445 - DNA, 21 bp, Homo sapiens
ccgcagagactggggcctgga

SEQ ID NO: 2170446 - DNA, 13 bp, Homo sapiens
ccgcattggtggc

SEQ ID NO: 2170447 - DNA, 13 bp, Homo sapiens
ccgccacggcctg

SEQ ID NO: 2170448 - DNA, 17 bp, Homo sapiens
ccgccacggcctggctg

SEQ ID NO: 2170449 - DNA, 20 bp, Homo sapiens
ccgccacggcctggctggtg

SEQ ID NO: 2170450 - DNA, 17 bp, Homo sapiens
ccgcccacctgcatcag

SEQ ID NO: 2170451 - DNA, 13 bp, Homo sapiens
ccgccctctgccc

SEQ ID NO: 2170452 - DNA, 21 bp, Homo sapiens
ccgcctccctcccctgccctc

SEQ ID NO: 2170453 - DNA, 15 bp, Homo sapiens
ccgcctgtccttggt

SEQ ID NO: 2170454 - DNA, 21 bp, Homo sapiens
ccgctacaagagggcaaagct

SEQ ID NO: 2170455 - DNA, 22 bp, Homo sapiens
ccgctacaagagggcaaagctg

SEQ ID NO: 2170456 - DNA, 14 bp, Homo sapiens
ccgctgccttcctt

SEQ ID NO: 2170457 - DNA, 11 bp, Homo sapiens
ccgctgggaga

SEQ ID NO: 2170458 - DNA, 19 bp, Homo sapiens
ccgctgggagagccaaggc

SEQ ID NO: 2170459 - DNA, 20 bp, Homo sapiens
ccgctgggagagccaaggcc

SEQ ID NO: 2170460 - DNA, 23 bp, Homo sapiens
ccgctgggagagccaaggcctat

SEQ ID NO: 2170461 - DNA, 19 bp, Homo sapiens
ccgctgtgctgttgtctgc

SEQ ID NO: 2170462 - DNA, 22 bp, Homo sapiens
ccgcttccctacccacagggcc

SEQ ID NO: 2170463 - DNA, 21 bp, Homo sapiens
ccggagaacatctgccttgct

SEQ ID NO: 2170464 - DNA, 13 bp, Homo sapiens
ccggatcttggag

SEQ ID NO: 2170465 - DNA, 14 bp, Homo sapiens
ccggccctggctgg

SEQ ID NO: 2170466 - DNA, 14 bp, Homo sapiens
ccgggttggaggcc

SEQ ID NO: 2170467 - DNA, 23 bp, Homo sapiens
ccgtatttatttttttattcttc

SEQ ID NO: 2170468 - DNA, 22 bp, Homo sapiens
ccgtctcctgccgggcaggtcc

SEQ ID NO: 2170469 - DNA, 17 bp, Homo sapiens
ccgtctgctcctccctc

SEQ ID NO: 2170470 - DNA, 23 bp, Homo sapiens
ccgtcttcaatctctgttctgct

SEQ ID NO: 2170471 - DNA, 21 bp, Homo sapiens
ccgtgagcagtgtgtctcctg

SEQ ID NO: 2170472 - DNA, 14 bp, Homo sapiens
ccgtgatctcccct

SEQ ID NO: 2170473 - DNA, 21 bp, Homo sapiens
ccgtgcaacgtgtaacttgtg

SEQ ID NO: 2170474 - DNA, 14 bp, Homo sapiens
cctaaaatttgccc

SEQ ID NO: 2170475 - DNA, 22 bp, Homo sapiens
cctaaaatttgccctcccatcc

SEQ ID NO: 2170476 - DNA, 17 bp, Homo sapiens
ctaaggcctcttgctgg

SEQ ID NO: 2170477 - DNA, 18 bp, Homo sapiens
ctaagtccctgccccctc

SEQ ID NO: 2170478 - DNA, 10 bp, Homo sapiens
ctaagtgact

SEQ ID NO: 2170479 - DNA, 21 bp, Homo sapiens
ctaagtgactaccacttattt

SEQ ID NO: 2170480 - DNA, 11 bp, Homo sapiens
ctaatgctgca

SEQ ID NO: 2170481 - DNA, 21 bp, Homo sapiens
ctaattacacacgtgtgatgt

SEQ ID NO: 2170482 - DNA, 14 bp, Homo sapiens
ctacaagagggcaa

SEQ ID NO: 2170483 - DNA, 15 bp, Homo sapiens
ctacaagagggcaaa

SEQ ID NO: 2170484 - DNA, 18 bp, Homo sapiens
ctacaagagggcaaagct

SEQ ID NO: 2170485 - DNA, 13 bp, Homo sapiens
ctacacctaactc

SEQ ID NO: 2170486 - DNA, 21 bp, Homo sapiens
ctacactcattgaaatgtaat

SEQ ID NO: 2170487 - DNA, 18 bp, Homo sapiens
ctacagccagtaaggcag

SEQ ID NO: 2170488 - DNA, 22 bp, Homo sapiens
ctacagccagtaaggcagctct

SEQ ID NO: 2170489 - DNA, 16 bp, Homo sapiens
ctacagccctggaggc

SEQ ID NO: 2170490 - DNA, 12 bp, Homo sapiens
ctacagtacaat

SEQ ID NO: 2170491 - DNA, 17 bp, Homo sapiens
ctaccactggtgtaaaa

SEQ ID NO: 2170492 - DNA, 16 bp, Homo sapiens
ctacccacagggcctg

SEQ ID NO: 2170493 - DNA, 18 bp, Homo sapiens
ctacccacagggcctgac

SEQ ID NO: 2170494 - DNA, 21 bp, Homo sapiens
ctacccacagggcctgacttt

SEQ ID NO: 2170495 - DNA, 18 bp, Homo sapiens
ctacccccttgtctgctg

SEQ ID NO: 2170496 - DNA, 18 bp, Homo sapiens
ctacccttgccaaggccg

SEQ ID NO: 2170497 - DNA, 18 bp, Homo sapiens
ctacctgccctctctcag

SEQ ID NO: 2170498 - DNA, 22 bp, Homo sapiens
ctacctgccctctctcagttat

SEQ ID NO: 2170499 - DNA, 16 bp, Homo sapiens
ctactctattctgtag

SEQ ID NO: 2170500 - DNA, 12 bp, Homo sapiens
ctactgaaattt

SEQ ID NO: 2170501 - DNA, 20 bp, Homo sapiens
ctactggtttgtatgatgta

SEQ ID NO: 2170502 - DNA, 17 bp, Homo sapiens
ctacttccaagaaaaat

SEQ ID NO: 2170503 - DNA, 17 bp, Homo sapiens
ctacttgtaaacttgaa

SEQ ID NO: 2170504 - DNA, 14 bp, Homo sapiens
ctacttttaaataa

SEQ ID NO: 2170505 - DNA, 21 bp, Homo sapiens
ctagaaagcatccattaatta

SEQ ID NO: 2170506 - DNA, 13 bp, Homo sapiens
ctagaagggaagg

SEQ ID NO: 2170507 - DNA, 18 bp, Homo sapiens
ctagaatactaataaaat

SEQ ID NO: 2170508 - DNA, 19 bp, Homo sapiens
ctagaatactaataaaata

SEQ ID NO: 2170509 - DNA, 19 bp, Homo sapiens
ctagaatatcctacttctc

SEQ ID NO: 2170510 - DNA, 17 bp, Homo sapiens
ctagactcaagtgatcc

SEQ ID NO: 2170511 - DNA, 13 bp, Homo sapiens
ctagagaggggcc

SEQ ID NO: 2170512 - DNA, 18 bp, Homo sapiens
ctagagaggggcctctgg

SEQ ID NO: 2170513 - DNA, 19 bp, Homo sapiens
ctagagaggggcctctggc

SEQ ID NO: 2170514 - DNA, 22 bp, Homo sapiens
ctagagcttcaagtctgtgcct

SEQ ID NO: 2170515 - DNA, 16 bp, Homo sapiens
ctagcactcacatgct

SEQ ID NO: 2170516 - DNA, 23 bp, Homo sapiens
ctagctgggcaaacccttctctt

SEQ ID NO: 2170517 - DNA, 19 bp, Homo sapiens
ctagcttagagcctccctc

SEQ ID NO: 2170518 - DNA, 16 bp, Homo sapiens
ctaggccccagaggcc

SEQ ID NO: 2170519 - DNA, 19 bp, Homo sapiens
ctaggccccagaggccctg

SEQ ID NO: 2170520 - DNA, 20 bp, Homo sapiens
ctaggccccagaggccctgg

SEQ ID NO: 2170521 - DNA, 22 bp, Homo sapiens
ctaggccccagaggccctggag

SEQ ID NO: 2170522 - DNA, 12 bp, Homo sapiens
ctaggctgggtg

SEQ ID NO: 2170523 - DNA, 20 bp, Homo sapiens
ctaggctgggtgcccacagc

SEQ ID NO: 2170524 - DNA, 21 bp, Homo sapiens
ctaggctgggtgcccacagcc

SEQ ID NO: 2170525 - DNA, 16 bp, Homo sapiens
ctagggaaggccacct

SEQ ID NO: 2170526 - DNA, 18 bp, Homo sapiens
ctagggaaggccacctgc

SEQ ID NO: 2170527 - DNA, 19 bp, Homo sapiens
ctagggaaggccacctgca

SEQ ID NO: 2170528 - DNA, 17 bp, Homo sapiens
ctagggacccctcctcc

SEQ ID NO: 2170529 - DNA, 16 bp, Homo sapiens
ctaggtcaaggcctgt

SEQ ID NO: 2170530 - DNA, 20 bp, Homo sapiens
ctaggtcaaggcctgtccct

SEQ ID NO: 2170531 - DNA, 21 bp, Homo sapiens
ctaggtcagtacccacctgag

SEQ ID NO: 2170532 - DNA, 17 bp, Homo sapiens
ctaggttaacatttgta

SEQ ID NO: 2170533 - DNA, 14 bp, Homo sapiens
ctagtcagccacat

SEQ ID NO: 2170534 - DNA, 16 bp, Homo sapiens
ctagtcagccacatgg

SEQ ID NO: 2170535 - DNA, 15 bp, Homo sapiens
ctagtcccttccaca

SEQ ID NO: 2170536 - DNA, 23 bp, Homo sapiens
ctagtgatttctggggccccacc

SEQ ID NO: 2170537 - DNA, 20 bp, Homo sapiens
ctagtggaaagattgtgtct

SEQ ID NO: 2170538 - DNA, 21 bp, Homo sapiens
ctagtggaaagattgtgtctg

SEQ ID NO: 2170539 - DNA, 20 bp, Homo sapiens
ctagttccctcagtgtgaag

SEQ ID NO: 2170540 - DNA, 16 bp, Homo sapiens
ctagttgtaatgtgta

SEQ ID NO: 2170541 - DNA, 16 bp, Homo sapiens
ctagtttgtttagtta

SEQ ID NO: 2170542 - DNA, 14 bp, Homo sapiens
ctataaagcagtat

SEQ ID NO: 2170543 - DNA, 18 bp, Homo sapiens
ctataaagcagtattttt

SEQ ID NO: 2170544 - DNA, 14 bp, Homo sapiens
ctatagattcttta

SEQ ID NO: 2170545 - DNA, 22 bp, Homo sapiens
ctatagattctttattagtgaa

SEQ ID NO: 2170546 - DNA, 23 bp, Homo sapiens
ctatagccatttgccccaactta

SEQ ID NO: 2170547 - DNA, 16 bp, Homo sapiens
ctatatggtttttcca

SEQ ID NO: 2170548 - DNA, 13 bp, Homo sapiens
ctatcacctgtca

SEQ ID NO: 2170549 - DNA, 22 bp, Homo sapiens
ctatcacggcttttccttattt

SEQ ID NO: 2170550 - DNA, 14 bp, Homo sapiens
ctatcctggctttg

SEQ ID NO: 2170551 - DNA, 18 bp, Homo sapiens
ctatcctggctttgccca

SEQ ID NO: 2170552 - DNA, 18 bp, Homo sapiens
ctatctaatttttattaa

SEQ ID NO: 2170553 - DNA, 16 bp, Homo sapiens
ctatgcacctataaat

SEQ ID NO: 2170554 - DNA, 20 bp, Homo sapiens
ctatggattttctaaggaag

SEQ ID NO: 2170555 - DNA, 23 bp, Homo sapiens
ctatggcatattgataataaaat

SEQ ID NO: 2170556 - DNA, 23 bp, Homo sapiens
ctatgggtatcaaacagctcagg

SEQ ID NO: 2170557 - DNA, 14 bp, Homo sapiens
ctatggtgccaatg

SEQ ID NO: 2170558 - DNA, 22 bp, Homo sapiens
ctattcatgtgggaaaaaaaga

SEQ ID NO: 2170559 - DNA, 22 bp, Homo sapiens
ctattctttgaccaaactgtgg

SEQ ID NO: 2170560 - DNA, 14 bp, Homo sapiens
ctattgcttaaaca

SEQ ID NO: 2170561 - DNA, 20 bp, Homo sapiens
ctattgtgctttctatctaa

SEQ ID NO: 2170562 - DNA, 16 bp, Homo sapiens
ctatttttctttccaa

SEQ ID NO: 2170563 - DNA, 23 bp, Homo sapiens
ctcaaaatattttttttaactgc

SEQ ID NO: 2170564 - DNA, 21 bp, Homo sapiens
ctcaaagtttttacagtgtat

SEQ ID NO: 2170565 - DNA, 20 bp, Homo sapiens
ctcaacaaaagtgctttgga

SEQ ID NO: 2170566 - DNA, 17 bp, Homo sapiens
ctcaacgacttcttcct

SEQ ID NO: 2170567 - DNA, 20 bp, Homo sapiens
ctcaagcaatcctcctgagt

SEQ ID NO: 2170568 - DNA, 23 bp, Homo sapiens
ctcaagcgatccctcccctcagc

SEQ ID NO: 2170569 - DNA, 14 bp, Homo sapiens
ctcaaggcctccag

SEQ ID NO: 2170570 - DNA, 22 bp, Homo sapiens
ctcaaggggccatcctgtccca

SEQ ID NO: 2170571 - DNA, 17 bp, Homo sapiens
ctcacaagcctcttctg

SEQ ID NO: 2170572 - DNA, 16 bp, Homo sapiens
ctcacagagacacagg

SEQ ID NO: 2170573 - DNA, 15 bp, Homo sapiens
ctcacagtgctttta

SEQ ID NO: 2170574 - DNA, 13 bp, Homo sapiens
ctcacatgctgga

SEQ ID NO: 2170575 - DNA, 15 bp, Homo sapiens
ctcaccctgcttggg

SEQ ID NO: 2170576 - DNA, 12 bp, Homo sapiens
ctcacctgacat

SEQ ID NO: 2170577 - DNA, 20 bp, Homo sapiens
ctcacctgggttccccaccc

SEQ ID NO: 2170578 - DNA, 15 bp, Homo sapiens
ctcacgagccttgcg

SEQ ID NO: 2170579 - DNA, 12 bp, Homo sapiens
ctcactcccctc

SEQ ID NO: 2170580 - DNA, 23 bp, Homo sapiens
ctcactgcaacctccacctccca

SEQ ID NO: 2170581 - DNA, 22 bp, Homo sapiens
ctcagaattattcatagctgta

SEQ ID NO: 2170582 - DNA, 12 bp, Homo sapiens
ctcagagagtac

SEQ ID NO: 2170583 - DNA, 23 bp, Homo sapiens
ctcagaggtatcctctttttgct

SEQ ID NO: 2170584 - DNA, 23 bp, Homo sapiens
ctcagcaggttggcttttttccc

SEQ ID NO: 2170585 - DNA, 13 bp, Homo sapiens
ctcagcatcctcc

SEQ ID NO: 2170586 - DNA, 14 bp, Homo sapiens
ctcagcatcctcca

SEQ ID NO: 2170587 - DNA, 20 bp, Homo sapiens
ctcagcatcctccacgggct

SEQ ID NO: 2170588 - DNA, 16 bp, Homo sapiens
ctcagccagccccatc

SEQ ID NO: 2170589 - DNA, 15 bp, Homo sapiens
ctcagccctgagctg

SEQ ID NO: 2170590 - DNA, 17 bp, Homo sapiens
ctcagccctgagctggc

SEQ ID NO: 2170591 - DNA, 14 bp, Homo sapiens
ctcagcctcctgag

SEQ ID NO: 2170592 - DNA, 17 bp, Homo sapiens
ctcagctctggctcaca

SEQ ID NO: 2170593 - DNA, 18 bp, Homo sapiens
ctcagctctggctcacag

SEQ ID NO: 2170594 - DNA, 21 bp, Homo sapiens
ctcagctggccgggttggagg

SEQ ID NO: 2170595 - DNA, 22 bp, Homo sapiens
ctcagctggcggaacctggctg

SEQ ID NO: 2170596 - DNA, 17 bp, Homo sapiens
ctcaggaattcagtgcc

SEQ ID NO: 2170597 - DNA, 15 bp, Homo sapiens
ctgcagaaggaaaga

SEQ ID NO: 2170598 - DNA, 20 bp, Homo sapiens
ctgcagaaggaaagaagggg

SEQ ID NO: 2170599 - DNA, 14 bp, Homo sapiens
ctgcagagctgggg

SEQ ID NO: 2170600 - DNA, 15 bp, Homo sapiens
ctgcagagctggggg

SEQ ID NO: 2170601 - DNA, 19 bp, Homo sapiens
ctgcagcctcgaactcctg

SEQ ID NO: 2170602 - DNA, 22 bp, Homo sapiens
ctgcagcctcgaactcctgggc

SEQ ID NO: 2170603 - DNA, 12 bp, Homo sapiens
ctgcagggcagc

SEQ ID NO: 2170604 - DNA, 13 bp, Homo sapiens
ctgcagggcagcc

SEQ ID NO: 2170605 - DNA, 17 bp, Homo sapiens
ctgcagggcagcctgtg

SEQ ID NO: 2170606 - DNA, 18 bp, Homo sapiens
ctgcagggcagcctgtgg

SEQ ID NO: 2170607 - DNA, 14 bp, Homo sapiens
ctgcagggccatct

SEQ ID NO: 2170608 - DNA, 18 bp, Homo sapiens
ctgcagtcacccctgtct

SEQ ID NO: 2170609 - DNA, 19 bp, Homo sapiens
ctgcagtcacccctgtctg

SEQ ID NO: 2170610 - DNA, 21 bp, Homo sapiens
ctgcagtcacccctgtctgcg

SEQ ID NO: 2170611 - DNA, 19 bp, Homo sapiens
ctgcagtcacttcgtggga

SEQ ID NO: 2170612 - DNA, 12 bp, Homo sapiens
ctgcatgtgtat

SEQ ID NO: 2170613 - DNA, 17 bp, Homo sapiens
ctgcatgtgttgtacaa

SEQ ID NO: 2170614 - DNA, 19 bp, Homo sapiens
ctgcatgtgttgtacaata

SEQ ID NO: 2170615 - DNA, 17 bp, Homo sapiens
ctgcattttctgggttc

SEQ ID NO: 2170616 - DNA, 23 bp, Homo sapiens
ctgccaacttttagtgggtgaga

SEQ ID NO: 2170617 - DNA, 17 bp, Homo sapiens
ctgccaagaactctggg

SEQ ID NO: 2170618 - DNA, 19 bp, Homo sapiens
ctgccaagaactctgggca

SEQ ID NO: 2170619 - DNA, 14 bp, Homo sapiens
ctgccaagccagat

SEQ ID NO: 2170620 - DNA, 18 bp, Homo sapiens
ctgccactaggctgggtg

SEQ ID NO: 2170621 - DNA, 14 bp, Homo sapiens
ctgccactgttttg

SEQ ID NO: 2170622 - DNA, 17 bp, Homo sapiens
ctgccatttccctgaac

SEQ ID NO: 2170623 - DNA, 14 bp, Homo sapiens
ctgcccaccctcct

SEQ ID NO: 2170624 - DNA, 18 bp, Homo sapiens
ctgccccccctaagagac

SEQ ID NO: 2170625 - DNA, 17 bp, Homo sapiens
ctgccccgtagagaatg

SEQ ID NO: 2170626 - DNA, 22 bp, Homo sapiens
ctgccgcctgtgcccttgctgg

SEQ ID NO: 2170627 - DNA, 17 bp, Homo sapiens
ctgcctagcactcacat

SEQ ID NO: 2170628 - DNA, 19 bp, Homo sapiens
ctgcctagcactcacatgc

SEQ ID NO: 2170629 - DNA, 20 bp, Homo sapiens
ctgcctagcactcacatgct

SEQ ID NO: 2170630 - DNA, 15 bp, Homo sapiens
ctgcctccctgtcca

SEQ ID NO: 2170631 - DNA, 17 bp, Homo sapiens
ctgcctccctgtccacc

SEQ ID NO: 2170632 - DNA, 16 bp, Homo sapiens
ctgcctcccttgtggc

SEQ ID NO: 2170633 - DNA, 18 bp, Homo sapiens
ctgcctggatgagaaaca

SEQ ID NO: 2170634 - DNA, 14 bp, Homo sapiens
ctgcctggcccagg

SEQ ID NO: 2170635 - DNA, 15 bp, Homo sapiens
ctgcctggcctggca

SEQ ID NO: 2170636 - DNA, 13 bp, Homo sapiens
ctgccttccttgc

SEQ ID NO: 2170637 - DNA, 12 bp, Homo sapiens
ctgccttgctgc

SEQ ID NO: 2170638 - DNA, 19 bp, Homo sapiens
ctgcctttgttcactgtga

SEQ ID NO: 2170639 - DNA, 20 bp, Homo sapiens
ctgcctttgttcactgtgag

SEQ ID NO: 2170640 - DNA, 16 bp, Homo sapiens
ctgcgcagctccttcc

SEQ ID NO: 2170641 - DNA, 18 bp, Homo sapiens
ctgcgcagggccctctgg

SEQ ID NO: 2170642 - DNA, 22 bp, Homo sapiens
ctgcgcagggccctctggggct

SEQ ID NO: 2170643 - DNA, 15 bp, Homo sapiens
ctgcggctgctggca

SEQ ID NO: 2170644 - DNA, 13 bp, Homo sapiens
ctgcgtcatggct

SEQ ID NO: 2170645 - DNA, 14 bp, Homo sapiens
ctgcgtcatggctc

SEQ ID NO: 2170646 - DNA, 19 bp, Homo sapiens
ctgctaaatactgtacata

SEQ ID NO: 2170647 - DNA, 14 bp, Homo sapiens
ctgctatgaagact

SEQ ID NO: 2170648 - DNA, 17 bp, Homo sapiens
ctgctatttcccaagct

SEQ ID NO: 2170649 - DNA, 19 bp, Homo sapiens
ctgctatttcccaagctgg

SEQ ID NO: 2170650 - DNA, 23 bp, Homo sapiens
ctgctcccagatgccttctagat

SEQ ID NO: 2170651 - DNA, 12 bp, Homo sapiens
ctgctcctcgca

SEQ ID NO: 2170652 - DNA, 17 bp, Homo sapiens
ctgctcctcgcagttcg

SEQ ID NO: 2170653 - DNA, 17 bp, Homo sapiens
ctgctctctacccagcc

SEQ ID NO: 2170654 - DNA, 22 bp, Homo sapiens
ctgctctctacccagcccatct

SEQ ID NO: 2170655 - DNA, 12 bp, Homo sapiens
ctgctctgccca

SEQ ID NO: 2170656 - DNA, 22 bp, Homo sapiens
ctgctgaatgcctcgctccctt

SEQ ID NO: 2170657 - DNA, 18 bp, Homo sapiens
ctgctgccatgattttgg

SEQ ID NO: 2170658 - DNA, 18 bp, Homo sapiens
ctgctgccccaaaggaag

SEQ ID NO: 2170659 - DNA, 19 bp, Homo sapiens
ctgctgccccaaaggaagc

SEQ ID NO: 2170660 - DNA, 14 bp, Homo sapiens
ctgctgctcccagc

SEQ ID NO: 2170661 - DNA, 14 bp, Homo sapiens
ctgctggtacctgc

SEQ ID NO: 2170662 - DNA, 16 bp, Homo sapiens
ctgctggtacctgccc

SEQ ID NO: 2170663 - DNA, 20 bp, Homo sapiens
ctgctggttttggtttccac

SEQ ID NO: 2170664 - DNA, 18 bp, Homo sapiens
ctgctgtgggtcagtgtg

SEQ ID NO: 2170665 - DNA, 22 bp, Homo sapiens
ctgcttgaatcaggaggagatt

SEQ ID NO: 2170666 - DNA, 14 bp, Homo sapiens
ctgcttggggcctg

SEQ ID NO: 2170667 - DNA, 17 bp, Homo sapiens
ctgcttggggcctggcg

SEQ ID NO: 2170668 - DNA, 21 bp, Homo sapiens
ctgctttgcacacacactagc

SEQ ID NO: 2170669 - DNA, 19 bp, Homo sapiens
ctggaaaaattaagttgtt

SEQ ID NO: 2170670 - DNA, 22 bp, Homo sapiens
ctggaaaaattaagttgttgaa

SEQ ID NO: 2170671 - DNA, 17 bp, Homo sapiens
ctggaaaagtgttcctt

SEQ ID NO: 2170672 - DNA, 17 bp, Homo sapiens
ctggaaatccagctggt

SEQ ID NO: 2170673 - DNA, 14 bp, Homo sapiens
ctggaaccagagcc

SEQ ID NO: 2170674 - DNA, 13 bp, Homo sapiens
ctggaagcctgct

SEQ ID NO: 2170675 - DNA, 20 bp, Homo sapiens
ctggaatcgaggctgtgtgt

SEQ ID NO: 2170676 - DNA, 22 bp, Homo sapiens
ctggaatgcattcactcagcat

SEQ ID NO: 2170677 - DNA, 16 bp, Homo sapiens
ctggaatggggacctg

SEQ ID NO: 2170678 - DNA, 18 bp, Homo sapiens
ctggacagcggttgtaaa

SEQ ID NO: 2170679 - DNA, 22 bp, Homo sapiens
ctggacagcggttgtaaataca

SEQ ID NO: 2170680 - DNA, 23 bp, Homo sapiens
ctggacagcggttgtaaatacaa

SEQ ID NO: 2170681 - DNA, 14 bp, Homo sapiens
ctggacaggtctgg

SEQ ID NO: 2170682 - DNA, 18 bp, Homo sapiens
ctggacaggtctgggaga

SEQ ID NO: 2170683 - DNA, 15 bp, Homo sapiens
ctggaccaaagctga

SEQ ID NO: 2170684 - DNA, 22 bp, Homo sapiens
ctggaccaaagctgacgaggct

SEQ ID NO: 2170685 - DNA, 14 bp, Homo sapiens
ctggaccagatgct

SEQ ID NO: 2170686 - DNA, 15 bp, Homo sapiens
ctggaccagatgctg

SEQ ID NO: 2170687 - DNA, 15 bp, Homo sapiens
ctggacccggcctcc

SEQ ID NO: 2170688 - DNA, 16 bp, Homo sapiens
ctggactggctgtcct

SEQ ID NO: 2170689 - DNA, 17 bp, Homo sapiens
ctggacttttgcagctt

SEQ ID NO: 2170690 - DNA, 18 bp, Homo sapiens
ctggacttttgcagcttc

SEQ ID NO: 2170691 - DNA, 13 bp, Homo sapiens
ctggagaaagagc

SEQ ID NO: 2170692 - DNA, 20 bp, Homo sapiens
ctggagaaagagctgcctgg

SEQ ID NO: 2170693 - DNA, 23 bp, Homo sapiens
ctggagaaagagctgcctggatg

SEQ ID NO: 2170694 - DNA, 24 bp, Homo sapiens
ctggagaaagagctgcctggatga

SEQ ID NO: 2170695 - DNA, 21 bp, Homo sapiens
ctggagacaatgcagatgcca

SEQ ID NO: 2170696 - DNA, 17 bp, Homo sapiens
ctggagaggctaacctc

SEQ ID NO: 2170697 - DNA, 23 bp, Homo sapiens
ctggagagtagacatccccctcc

SEQ ID NO: 2170698 - DNA, 19 bp, Homo sapiens
ctggagatttcagttactt

SEQ ID NO: 2170699 - DNA, 14 bp, Homo sapiens
ctggagccacctgt

SEQ ID NO: 2170700 - DNA, 20 bp, Homo sapiens
ctggagccacctgtcccacc

SEQ ID NO: 2170701 - DNA, 14 bp, Homo sapiens
ctggagctcctggg

SEQ ID NO: 2170702 - DNA, 16 bp, Homo sapiens
ctggagctcctgggaa

SEQ ID NO: 2170703 - DNA, 15 bp, Homo sapiens
ctggaggcctctggg

SEQ ID NO: 2170704 - DNA, 17 bp, Homo sapiens
ctggaggcctctgggcc

SEQ ID NO: 2170705 - DNA, 20 bp, Homo sapiens
ctggagtcatgccaagcatt

SEQ ID NO: 2170706 - DNA, 20 bp, Homo sapiens
ctggagtgatctcagctcac

SEQ ID NO: 2170707 - DNA, 23 bp, Homo sapiens
ctggagtgatctcagctcactgc

SEQ ID NO: 2170708 - DNA, 22 bp, Homo sapiens
ctggatgagaaacagctcagcc

SEQ ID NO: 2170709 - DNA, 23 bp, Homo sapiens
ctggatgagaaacagctcagcca

SEQ ID NO: 2170710 - DNA, 21 bp, Homo sapiens
ctggatgggggtgcaggcagc

SEQ ID NO: 2170711 - DNA, 17 bp, Homo sapiens
ctggcacccccacaagc

SEQ ID NO: 2170712 - DNA, 17 bp, Homo sapiens
ctggcaccgttatccct

SEQ ID NO: 2170713 - DNA, 16 bp, Homo sapiens
ctggcaggagggtggc

SEQ ID NO: 2170714 - DNA, 16 bp, Homo sapiens
ctggcaggatcacagc

SEQ ID NO: 2170715 - DNA, 19 bp, Homo sapiens
ctggccaccaccccccact

SEQ ID NO: 2170716 - DNA, 21 bp, Homo sapiens
ctggccaccaccccccactct

SEQ ID NO: 2170717 - DNA, 12 bp, Homo sapiens
ctggccatctct

SEQ ID NO: 2170718 - DNA, 14 bp, Homo sapiens
ctggccctgttgtg

SEQ ID NO: 2170719 - DNA, 16 bp, Homo sapiens
gaatgagagagtgtgg

SEQ ID NO: 2170720 - DNA, 21 bp, Homo sapiens
gaatgcaaggccttgaagaca

SEQ ID NO: 2170721 - DNA, 19 bp, Homo sapiens
gaatgcattcactcagcat

SEQ ID NO: 2170722 - DNA, 17 bp, Homo sapiens
gaatgcctcgctccctt

SEQ ID NO: 2170723 - DNA, 19 bp, Homo sapiens
gaatgcctcgctcccttca

SEQ ID NO: 2170724 - DNA, 14 bp, Homo sapiens
gaatgctgtacctt

SEQ ID NO: 2170725 - DNA, 22 bp, Homo sapiens
gaatgggagccagaattcacta

SEQ ID NO: 2170726 - DNA, 13 bp, Homo sapiens
gaatggggacctg

SEQ ID NO: 2170727 - DNA, 17 bp, Homo sapiens
gaatggggacctggggt

SEQ ID NO: 2170728 - DNA, 18 bp, Homo sapiens
gaatgggtaattcaagag

SEQ ID NO: 2170729 - DNA, 12 bp, Homo sapiens
gaattaagaact

SEQ ID NO: 2170730 - DNA, 14 bp, Homo sapiens
gaattcagctgccc

SEQ ID NO: 2170731 - DNA, 13 bp, Homo sapiens
gaattcagtgcct

SEQ ID NO: 2170732 - DNA, 19 bp, Homo sapiens
gaatttagcttatacaatt

SEQ ID NO: 2170733 - DNA, 20 bp, Homo sapiens
gaatttggtctgcctctgag

SEQ ID NO: 2170734 - DNA, 17 bp, Homo sapiens
gaattttacaaaaattt

SEQ ID NO: 2170735 - DNA, 21 bp, Homo sapiens
gaattttgcaaagatttaatc

SEQ ID NO: 2170736 - DNA, 14 bp, Homo sapiens
gacaaatgggactg

SEQ ID NO: 2170737 - DNA, 22 bp, Homo sapiens
gacaaattactgataaaaatga

SEQ ID NO: 2170738 - DNA, 15 bp, Homo sapiens
gacaagcagcccttg

SEQ ID NO: 2170739 - DNA, 19 bp, Homo sapiens
gacaatgcagatgccagag

SEQ ID NO: 2170740 - DNA, 19 bp, Homo sapiens
gacacatacagagtgggcc

SEQ ID NO: 2170741 - DNA, 18 bp, Homo sapiens
gacactacagaggattct

SEQ ID NO: 2170742 - DNA, 18 bp, Homo sapiens
gacactcattaccgtctg

SEQ ID NO: 2170743 - DNA, 13 bp, Homo sapiens
gacagcatggtgc

SEQ ID NO: 2170744 - DNA, 18 bp, Homo sapiens
gacagcatggtgcatgcc

SEQ ID NO: 2170745 - DNA, 22 bp, Homo sapiens
gacagcatggtgcatgccgctg

SEQ ID NO: 2170746 - DNA, 18 bp, Homo sapiens
gacagcgggtaaaaagag

SEQ ID NO: 2170747 - DNA, 19 bp, Homo sapiens
gacagcgggtaaaaagaga

SEQ ID NO: 2170748 - DNA, 16 bp, Homo sapiens
gacagcggttgtaaat

SEQ ID NO: 2170749 - DNA, 20 bp, Homo sapiens
gacagcggttgtaaatacaa

SEQ ID NO: 2170750 - DNA, 15 bp, Homo sapiens
gacagctgcaggtgc

SEQ ID NO: 2170751 - DNA, 13 bp, Homo sapiens
gacagctttcctg

SEQ ID NO: 2170752 - DNA, 16 bp, Homo sapiens
gacagctttcctgggt

SEQ ID NO: 2170753 - DNA, 15 bp, Homo sapiens
gacagtgtcatggtg

SEQ ID NO: 2170754 - DNA, 18 bp, Homo sapiens
gacatccccctccttgcc

SEQ ID NO: 2170755 - DNA, 16 bp, Homo sapiens
gacatgttcccttctc

SEQ ID NO: 2170756 - DNA, 19 bp, Homo sapiens
gacatttgggactgtcttg

SEQ ID NO: 2170757 - DNA, 18 bp, Homo sapiens
gacatttgtcctgcagag

SEQ ID NO: 2170758 - DNA, 17 bp, Homo sapiens
gaccaaacctagcccct

SEQ ID NO: 2170759 - DNA, 23 bp, Homo sapiens
gaccaaactgtgggtattgttaa

SEQ ID NO: 2170760 - DNA, 17 bp, Homo sapiens
gaccaagccggtgccca

SEQ ID NO: 2170761 - DNA, 18 bp, Homo sapiens
gaccaagccggtgcccac

SEQ ID NO: 2170762 - DNA, 11 bp, Homo sapiens
gaccagagctc

SEQ ID NO: 2170763 - DNA, 17 bp, Homo sapiens
gaccagagctctggagc

SEQ ID NO: 2170764 - DNA, 13 bp, Homo sapiens
gaccagctgctcc

SEQ ID NO: 2170765 - DNA, 15 bp, Homo sapiens
gaccagctgctccga

SEQ ID NO: 2170766 - DNA, 23 bp, Homo sapiens
gaccagctgctccgaggacccag

SEQ ID NO: 2170767 - DNA, 13 bp, Homo sapiens
gaccataaattaa

SEQ ID NO: 2170768 - DNA, 20 bp, Homo sapiens
gacccacccgccttggcctc

SEQ ID NO: 2170769 - DNA, 21 bp, Homo sapiens
gacccacccgccttggcctcc

SEQ ID NO: 2170770 - DNA, 11 bp, Homo sapiens
gaccccctccc

SEQ ID NO: 2170771 - DNA, 21 bp, Homo sapiens
gaccccgacctcagagagtac

SEQ ID NO: 2170772 - DNA, 13 bp, Homo sapiens
gacccctcctccc

SEQ ID NO: 2170773 - DNA, 16 bp, Homo sapiens
gacccctcctcccttt

SEQ ID NO: 2170774 - DNA, 12 bp, Homo sapiens
gacccctggctg

SEQ ID NO: 2170775 - DNA, 14 bp, Homo sapiens
gacccctgggagct

SEQ ID NO: 2170776 - DNA, 20 bp, Homo sapiens
gaccccttcctgtctggccc

SEQ ID NO: 2170777 - DNA, 19 bp, Homo sapiens
gacccggcccccgccctct

SEQ ID NO: 2170778 - DNA, 21 bp, Homo sapiens
gacccggcccccgccctctgc

SEQ ID NO: 2170779 - DNA, 15 bp, Homo sapiens
gaccctgcagagatg

SEQ ID NO: 2170780 - DNA, 16 bp, Homo sapiens
gaccggaagctcctgg

SEQ ID NO: 2170781 - DNA, 17 bp, Homo sapiens
gaccggaagctcctggt

SEQ ID NO: 2170782 - DNA, 21 bp, Homo sapiens
gaccggaggcaaaaggcagtg

SEQ ID NO: 2170783 - DNA, 17 bp, Homo sapiens
gaccgtgggtcatgcag

SEQ ID NO: 2170784 - DNA, 20 bp, Homo sapiens
gacctaaaatttgccctccc

SEQ ID NO: 2170785 - DNA, 12 bp, Homo sapiens
gacctaagaaca

SEQ ID NO: 2170786 - DNA, 13 bp, Homo sapiens
gacctaagaacaa

SEQ ID NO: 2170787 - DNA, 21 bp, Homo sapiens
gacctcaaaataagccatgct

SEQ ID NO: 2170788 - DNA, 14 bp, Homo sapiens
gacctcaagcaacc

SEQ ID NO: 2170789 - DNA, 15 bp, Homo sapiens
gacctcaagcaacca

SEQ ID NO: 2170790 - DNA, 16 bp, Homo sapiens
gacctgcccctgccgc

SEQ ID NO: 2170791 - DNA, 19 bp, Homo sapiens
gaccttcaccaaacatact

SEQ ID NO: 2170792 - DNA, 12 bp, Homo sapiens
gacgaggggcag

SEQ ID NO: 2170793 - DNA, 19 bp, Homo sapiens
gacgatgtcaaccttgtgt

SEQ ID NO: 2170794 - DNA, 17 bp, Homo sapiens
gacgctaataaaaattt

SEQ ID NO: 2170795 - DNA, 17 bp, Homo sapiens
gacggggcttcaccatc

SEQ ID NO: 2170796 - DNA, 20 bp, Homo sapiens
gactactattcctttccaga

SEQ ID NO: 2170797 - DNA, 14 bp, Homo sapiens
gactaggtcaattt

SEQ ID NO: 2170798 - DNA, 17 bp, Homo sapiens
gactaggtcaatttttt

SEQ ID NO: 2170799 - DNA, 22 bp, Homo sapiens
gactcaagtgatcctcctgtct

SEQ ID NO: 2170800 - DNA, 17 bp, Homo sapiens
gactcaatttctcccca

SEQ ID NO: 2170801 - DNA, 17 bp, Homo sapiens
gactcccaaagagctgc

SEQ ID NO: 2170802 - DNA, 18 bp, Homo sapiens
gactcctgattgctctgg

SEQ ID NO: 2170803 - DNA, 21 bp, Homo sapiens
gactcctgattgctctggaag

SEQ ID NO: 2170804 - DNA, 23 bp, Homo sapiens
gactcctgattgctctggaagcc

SEQ ID NO: 2170805 - DNA, 12 bp, Homo sapiens
gactcctgctgg

SEQ ID NO: 2170806 - DNA, 16 bp, Homo sapiens
gactcggccccgtctc

SEQ ID NO: 2170807 - DNA, 18 bp, Homo sapiens
gactctcctgcctcagcc

SEQ ID NO: 2170808 - DNA, 14 bp, Homo sapiens
gactgacctgcccc

SEQ ID NO: 2170809 - DNA, 15 bp, Homo sapiens
gactgccaagccaga

SEQ ID NO: 2170810 - DNA, 18 bp, Homo sapiens
gactgccaagccagattc

SEQ ID NO: 2170811 - DNA, 14 bp, Homo sapiens
gactggctttcctc

SEQ ID NO: 2170812 - DNA, 15 bp, Homo sapiens
gactggctttcctct

SEQ ID NO: 2170813 - DNA, 20 bp, Homo sapiens
gactggctttgtcccacagc

SEQ ID NO: 2170814 - DNA, 17 bp, Homo sapiens
gactgggccctgcctct

SEQ ID NO: 2170815 - DNA, 14 bp, Homo sapiens
gactgggggtgcca

SEQ ID NO: 2170816 - DNA, 22 bp, Homo sapiens
gactgtattatacatgggtagc

SEQ ID NO: 2170817 - DNA, 22 bp, Homo sapiens
gactgtcagataatcggtgcag

SEQ ID NO: 2170818 - DNA, 19 bp, Homo sapiens
gactgtgatttatttggag

SEQ ID NO: 2170819 - DNA, 23 bp, Homo sapiens
gactgtgatttatttggagtgga

SEQ ID NO: 2170820 - DNA, 16 bp, Homo sapiens
gacttaagacaaatgg

SEQ ID NO: 2170821 - DNA, 19 bp, Homo sapiens
gacttaagacaaatgggac

SEQ ID NO: 2170822 - DNA, 16 bp, Homo sapiens
gacttgaaagaaaggg

SEQ ID NO: 2170823 - DNA, 23 bp, Homo sapiens
gacttggccgcttccctacccac

SEQ ID NO: 2170824 - DNA, 21 bp, Homo sapiens
gacttgggagagggagcaagc

SEQ ID NO: 2170825 - DNA, 22 bp, Homo sapiens
gacttgggagagggagcaagcc

SEQ ID NO: 2170826 - DNA, 21 bp, Homo sapiens
gacttgtacagttgactggct

SEQ ID NO: 2170827 - DNA, 23 bp, Homo sapiens
gacttgtacagttgactggcttt

SEQ ID NO: 2170828 - DNA, 14 bp, Homo sapiens
gacttttaaaattt

SEQ ID NO: 2170829 - DNA, 20 bp, Homo sapiens
gacttttacagcttttctct

SEQ ID NO: 2170830 - DNA, 23 bp, Homo sapiens
gacttttagacagtggtaaatat

SEQ ID NO: 2170831 - DNA, 19 bp, Homo sapiens
gagaaacagctcagccagt

SEQ ID NO: 2170832 - DNA, 15 bp, Homo sapiens
gagaaagagagaagc

SEQ ID NO: 2170833 - DNA, 17 bp, Homo sapiens
gagaaagagagaagcca

SEQ ID NO: 2170834 - DNA, 23 bp, Homo sapiens
gagaaagagagaagccagccaca

SEQ ID NO: 2170835 - DNA, 14 bp, Homo sapiens
gagaaagagctgcc

SEQ ID NO: 2170836 - DNA, 19 bp, Homo sapiens
gagaaagaggcaccaggaa

SEQ ID NO: 2170837 - DNA, 21 bp, Homo sapiens
gagaacagatctccaaagctt

SEQ ID NO: 2170838 - DNA, 12 bp, Homo sapiens
gagaacagtggt

SEQ ID NO: 2170839 - DNA, 17 bp, Homo sapiens
gagaacagtggttgcct

SEQ ID NO: 2170840 - DNA, 20 bp, Homo sapiens
gagaacagtggttgcctggg

SEQ ID NO: 2170841 - DNA, 16 bp, Homo sapiens
gatcagaacattcagc

SEQ ID NO: 2170842 - DNA, 21 bp, Homo sapiens
gatcagaacattcagctctgg

SEQ ID NO: 2170843 - DNA, 13 bp, Homo sapiens
gatcagaatccca

SEQ ID NO: 2170844 - DNA, 14 bp, Homo sapiens
gatcatggctcact

SEQ ID NO: 2170845 - DNA, 17 bp, Homo sapiens
gatcatttgcagctgct

SEQ ID NO: 2170846 - DNA, 12 bp, Homo sapiens
gatccagccact

SEQ ID NO: 2170847 - DNA, 20 bp, Homo sapiens
gatccattcccttttgttat

SEQ ID NO: 2170848 - DNA, 23 bp, Homo sapiens
gatcccaattcatttcatctact

SEQ ID NO: 2170849 - DNA, 22 bp, Homo sapiens
gatcccactcctaggacatgtt

SEQ ID NO: 2170850 - DNA, 12 bp, Homo sapiens
gatcctgctgcc

SEQ ID NO: 2170851 - DNA, 13 bp, Homo sapiens
gatcctgctgccg

SEQ ID NO: 2170852 - DNA, 11 bp, Homo sapiens
gatcctgctgg

SEQ ID NO: 2170853 - DNA, 12 bp, Homo sapiens
gatcctgctggg

SEQ ID NO: 2170854 - DNA, 14 bp, Homo sapiens
gatcgcacaaggac

SEQ ID NO: 2170855 - DNA, 17 bp, Homo sapiens
gatcggggtggcagaaa

SEQ ID NO: 2170856 - DNA, 14 bp, Homo sapiens
gatctatcacctgt

SEQ ID NO: 2170857 - DNA, 15 bp, Homo sapiens
gatctatcacctgtc

SEQ ID NO: 2170858 - DNA, 16 bp, Homo sapiens
gatctatcacctgtca

SEQ ID NO: 2170859 - DNA, 19 bp, Homo sapiens
gatctatcacctgtcatca

SEQ ID NO: 2170860 - DNA, 16 bp, Homo sapiens
gatctcagctcactgc

SEQ ID NO: 2170861 - DNA, 17 bp, Homo sapiens
gatctcagctcactgca

SEQ ID NO: 2170862 - DNA, 12 bp, Homo sapiens
gatctccaaagc

SEQ ID NO: 2170863 - DNA, 14 bp, Homo sapiens
gatctccaaagctt

SEQ ID NO: 2170864 - DNA, 13 bp, Homo sapiens
gatgaacacaggc

SEQ ID NO: 2170865 - DNA, 12 bp, Homo sapiens
gatgagaaaaaa

SEQ ID NO: 2170866 - DNA, 18 bp, Homo sapiens
gatgagaattcagctgcc

SEQ ID NO: 2170867 - DNA, 14 bp, Homo sapiens
gatgagctggtttg

SEQ ID NO: 2170868 - DNA, 18 bp, Homo sapiens
gatgaggtcaccagggga

SEQ ID NO: 2170869 - DNA, 22 bp, Homo sapiens
gatgcctccctgaccctgcaga

SEQ ID NO: 2170870 - DNA, 15 bp, Homo sapiens
gatgcctcctctgtc

SEQ ID NO: 2170871 - DNA, 15 bp, Homo sapiens
gatgcggatcctgct

SEQ ID NO: 2170872 - DNA, 17 bp, Homo sapiens
gatgcggatcctgctgg

SEQ ID NO: 2170873 - DNA, 17 bp, Homo sapiens
gatggcattactctgca

SEQ ID NO: 2170874 - DNA, 20 bp, Homo sapiens
gatggctgtgaaaattacac

SEQ ID NO: 2170875 - DNA, 23 bp, Homo sapiens
gatggtgcagatgcctgcagtgc

SEQ ID NO: 2170876 - DNA, 16 bp, Homo sapiens
gatgtaaccaagctgt

SEQ ID NO: 2170877 - DNA, 16 bp, Homo sapiens
gatgtattcagagcca

SEQ ID NO: 2170878 - DNA, 20 bp, Homo sapiens
gatgtcaaccttgtgtgagt

SEQ ID NO: 2170879 - DNA, 18 bp, Homo sapiens
gatgtcttgagagcgctg

SEQ ID NO: 2170880 - DNA, 22 bp, Homo sapiens
gatgtcttgagagcgctggcct

SEQ ID NO: 2170881 - DNA, 17 bp, Homo sapiens
gattaagttcgaggtgg

SEQ ID NO: 2170882 - DNA, 13 bp, Homo sapiens
gattacaggtgtg

SEQ ID NO: 2170883 - DNA, 22 bp, Homo sapiens
gattacaggtgtgagccactgt

SEQ ID NO: 2170884 - DNA, 19 bp, Homo sapiens
gattactctttgctttgta

SEQ ID NO: 2170885 - DNA, 18 bp, Homo sapiens
gattcaataaaatgcact

SEQ ID NO: 2170886 - DNA, 17 bp, Homo sapiens
gattcactgtcttttga

SEQ ID NO: 2170887 - DNA, 18 bp, Homo sapiens
gattcccggctggacttt

SEQ ID NO: 2170888 - DNA, 16 bp, Homo sapiens
gattccggccctggct

SEQ ID NO: 2170889 - DNA, 17 bp, Homo sapiens
gattccggccctggctg

SEQ ID NO: 2170890 - DNA, 20 bp, Homo sapiens
gattgaaaatgtccaggaaa

SEQ ID NO: 2170891 - DNA, 15 bp, Homo sapiens
gattgaacgttctca

SEQ ID NO: 2170892 - DNA, 19 bp, Homo sapiens
gattgaagtatctgtacct

SEQ ID NO: 2170893 - DNA, 11 bp, Homo sapiens
gattgcaaagg

SEQ ID NO: 2170894 - DNA, 15 bp, Homo sapiens
gattgcaaagggaca

SEQ ID NO: 2170895 - DNA, 16 bp, Homo sapiens
gattgccatttcttcc

SEQ ID NO: 2170896 - DNA, 20 bp, Homo sapiens
gattgctctggaagcctgct

SEQ ID NO: 2170897 - DNA, 17 bp, Homo sapiens
gattgtctgaaattttc

SEQ ID NO: 2170898 - DNA, 12 bp, Homo sapiens
gatttatttgga

SEQ ID NO: 2170899 - DNA, 16 bp, Homo sapiens
gatttatttggagtgg

SEQ ID NO: 2170900 - DNA, 15 bp, Homo sapiens
gatttcactgacact

SEQ ID NO: 2170901 - DNA, 20 bp, Homo sapiens
gatttcagcacatgcactac

SEQ ID NO: 2170902 - DNA, 22 bp, Homo sapiens
gatttctacaactgatcatttg

SEQ ID NO: 2170903 - DNA, 17 bp, Homo sapiens
gatttggtttttctctt

SEQ ID NO: 2170904 - DNA, 12 bp, Homo sapiens
gattttctttct

SEQ ID NO: 2170905 - DNA, 13 bp, Homo sapiens
gattttctttcta

SEQ ID NO: 2170906 - DNA, 19 bp, Homo sapiens
gattttggcctcattactt

SEQ ID NO: 2170907 - DNA, 13 bp, Homo sapiens
gatttttaaaatg

SEQ ID NO: 2170908 - DNA, 14 bp, Homo sapiens
gatttttaaaatga

SEQ ID NO: 2170909 - DNA, 17 bp, Homo sapiens
gattttttttttaactt

SEQ ID NO: 2170910 - DNA, 11 bp, Homo sapiens
gcaaaaatatt

SEQ ID NO: 2170911 - DNA, 21 bp, Homo sapiens
gcaaaaggcagtggggctggg

SEQ ID NO: 2170912 - DNA, 19 bp, Homo sapiens
gcaaacccttctcttctcc

SEQ ID NO: 2170913 - DNA, 13 bp, Homo sapiens
gcaaacctgcccc

SEQ ID NO: 2170914 - DNA, 14 bp, Homo sapiens
gcaaacctgcccca

SEQ ID NO: 2170915 - DNA, 16 bp, Homo sapiens
gcaaagatttaatctg

SEQ ID NO: 2170916 - DNA, 12 bp, Homo sapiens
gcaaagctgctt

SEQ ID NO: 2170917 - DNA, 15 bp, Homo sapiens
gcaaaggttgggtct

SEQ ID NO: 2170918 - DNA, 17 bp, Homo sapiens
gcaaagtggaattaaag

SEQ ID NO: 2170919 - DNA, 22 bp, Homo sapiens
gcaaatatcctccactttcagg

SEQ ID NO: 2170920 - DNA, 20 bp, Homo sapiens
gcaaatgccaggacagctgc

SEQ ID NO: 2170921 - DNA, 22 bp, Homo sapiens
gcaacactgccagaagtgtgtt

SEQ ID NO: 2170922 - DNA, 11 bp, Homo sapiens
gcaaccaggaa

SEQ ID NO: 2170923 - DNA, 17 bp, Homo sapiens
gcaacctccacctccca

SEQ ID NO: 2170924 - DNA, 17 bp, Homo sapiens
gcaacctgtaagactga

SEQ ID NO: 2170925 - DNA, 11 bp, Homo sapiens
gcaactggaaa

SEQ ID NO: 2170926 - DNA, 23 bp, Homo sapiens
gcaagacacgtggcctcgtgagg

SEQ ID NO: 2170927 - DNA, 14 bp, Homo sapiens
gcaagcgcacttga

SEQ ID NO: 2170928 - DNA, 16 bp, Homo sapiens
gcaagctaggccccag

SEQ ID NO: 2170929 - DNA, 17 bp, Homo sapiens
gcaagctaggccccaga

SEQ ID NO: 2170930 - DNA, 17 bp, Homo sapiens
gcaagctcttctcctca

SEQ ID NO: 2170931 - DNA, 15 bp, Homo sapiens
gcaagctggcaggag

SEQ ID NO: 2170932 - DNA, 19 bp, Homo sapiens
gcaaggccttgaagacatg

SEQ ID NO: 2170933 - DNA, 18 bp, Homo sapiens
gcaaggggtgcctgggaa

SEQ ID NO: 2170934 - DNA, 21 bp, Homo sapiens
gcaagtgagcaaacctgcccc

SEQ ID NO: 2170935 - DNA, 22 bp, Homo sapiens
gcaagtgagcaaacctgcccca

SEQ ID NO: 2170936 - DNA, 13 bp, Homo sapiens
gcaataaatggct

SEQ ID NO: 2170937 - DNA, 15 bp, Homo sapiens
gcaataaatggctcg

SEQ ID NO: 2170938 - DNA, 14 bp, Homo sapiens
gcaatcatttcccc

SEQ ID NO: 2170939 - DNA, 17 bp, Homo sapiens
gcaatcatttcccctcc

SEQ ID NO: 2170940 - DNA, 20 bp, Homo sapiens
gcaatcatttcccctcccgt

SEQ ID NO: 2170941 - DNA, 14 bp, Homo sapiens
gcaatcctcctgag

SEQ ID NO: 2170942 - DNA, 17 bp, Homo sapiens
gcacaagaagtgggagt

SEQ ID NO: 2170943 - DNA, 18 bp, Homo sapiens
gcacacaacaggctgtgt

SEQ ID NO: 2170944 - DNA, 15 bp, Homo sapiens
gcacacacactagcc

SEQ ID NO: 2170945 - DNA, 14 bp, Homo sapiens
gcacaccagttact

SEQ ID NO: 2170946 - DNA, 16 bp, Homo sapiens
gcacacggcacagagc

SEQ ID NO: 2170947 - DNA, 15 bp, Homo sapiens
gcacagacaagcagc

SEQ ID NO: 2170948 - DNA, 19 bp, Homo sapiens
gcacagacaagcagccctt

SEQ ID NO: 2170949 - DNA, 18 bp, Homo sapiens
gcacagacttcacacagc

SEQ ID NO: 2170950 - DNA, 16 bp, Homo sapiens
gcacagccggggcctg

SEQ ID NO: 2170951 - DNA, 15 bp, Homo sapiens
gcacagctaattcta

SEQ ID NO: 2170952 - DNA, 22 bp, Homo sapiens
gcacatgacatttgtcctgcag

SEQ ID NO: 2170953 - DNA, 18 bp, Homo sapiens
gcaccaaaccctgtcctc

SEQ ID NO: 2170954 - DNA, 13 bp, Homo sapiens
gcaccagggaaga

SEQ ID NO: 2170955 - DNA, 15 bp, Homo sapiens
gcaccattcaggaac

SEQ ID NO: 2170956 - DNA, 15 bp, Homo sapiens
gcaccccctggcttg

SEQ ID NO: 2170957 - DNA, 18 bp, Homo sapiens
gcaccccctggcttgaac

SEQ ID NO: 2170958 - DNA, 20 bp, Homo sapiens
gcaccctgtatggagctaga

SEQ ID NO: 2170959 - DNA, 13 bp, Homo sapiens
gcacctataaata

SEQ ID NO: 2170960 - DNA, 19 bp, Homo sapiens
gcacctgaggcccagcaga

SEQ ID NO: 2170961 - DNA, 22 bp, Homo sapiens
gcacctgaggcccagcagagcc

SEQ ID NO: 2170962 - DNA, 15 bp, Homo sapiens
gcaccttcagaatat

SEQ ID NO: 2170963 - DNA, 21 bp, Homo sapiens
gcaccttgtgaaggaaaaaca

SEQ ID NO: 2170964 - DNA, 17 bp, Homo sapiens
gctcgtgggctctggct

SEQ ID NO: 2170965 - DNA, 19 bp, Homo sapiens
gctcgtgggctctggctcc

SEQ ID NO: 2170966 - DNA, 17 bp, Homo sapiens
gctcgtgtatttattac

SEQ ID NO: 2170967 - DNA, 18 bp, Homo sapiens
gctctatgggcagatcta

SEQ ID NO: 2170968 - DNA, 22 bp, Homo sapiens
gctctcctgccctgccctcctg

SEQ ID NO: 2170969 - DNA, 21 bp, Homo sapiens
gctctctacccagcccatctt

SEQ ID NO: 2170970 - DNA, 16 bp, Homo sapiens
gctctgaaagctgctt

SEQ ID NO: 2170971 - DNA, 17 bp, Homo sapiens
gctctgcacagacaagc

SEQ ID NO: 2170972 - DNA, 14 bp, Homo sapiens
gctctgcccagagc

SEQ ID NO: 2170973 - DNA, 17 bp, Homo sapiens
gctctgcccagagctgg

SEQ ID NO: 2170974 - DNA, 17 bp, Homo sapiens
gctctggaagcctgctg

SEQ ID NO: 2170975 - DNA, 13 bp, Homo sapiens
gctctggagaaca

SEQ ID NO: 2170976 - DNA, 15 bp, Homo sapiens
gctctggagaacagt

SEQ ID NO: 2170977 - DNA, 17 bp, Homo sapiens
gctctggagccacctgt

SEQ ID NO: 2170978 - DNA, 14 bp, Homo sapiens
gctctggctcacag

SEQ ID NO: 2170979 - DNA, 12 bp, Homo sapiens
gctcttgcctta

SEQ ID NO: 2170980 - DNA, 15 bp, Homo sapiens
gctgaatgcctcgct

SEQ ID NO: 2170981 - DNA, 17 bp, Homo sapiens
gctgacgaggctgggcc

SEQ ID NO: 2170982 - DNA, 23 bp, Homo sapiens
gctgagatcacaccactgtactc

SEQ ID NO: 2170983 - DNA, 14 bp, Homo sapiens
gctgagctggccta

SEQ ID NO: 2170984 - DNA, 15 bp, Homo sapiens
gctgagtgcactggc

SEQ ID NO: 2170985 - DNA, 17 bp, Homo sapiens
gctgagtgcactggcag

SEQ ID NO: 2170986 - DNA, 18 bp, Homo sapiens
gctgagtgcactggcagg

SEQ ID NO: 2170987 - DNA, 21 bp, Homo sapiens
gctgattttttttttaacttg

SEQ ID NO: 2170988 - DNA, 14 bp, Homo sapiens
gctgcacctgaggc

SEQ ID NO: 2170989 - DNA, 13 bp, Homo sapiens
gctgcaggtgccc

SEQ ID NO: 2170990 - DNA, 22 bp, Homo sapiens
gctgcatcccaccagcctgagc

SEQ ID NO: 2170991 - DNA, 21 bp, Homo sapiens
gctgcatccgtgagcagtgtg

SEQ ID NO: 2170992 - DNA, 16 bp, Homo sapiens
gctgccatttccctga

SEQ ID NO: 2170993 - DNA, 17 bp, Homo sapiens
gctgccatttccctgaa

SEQ ID NO: 2170994 - DNA, 14 bp, Homo sapiens
gctgcccccgctca

SEQ ID NO: 2170995 - DNA, 13 bp, Homo sapiens
gctgccggctgca

SEQ ID NO: 2170996 - DNA, 15 bp, Homo sapiens
gctgcctaagaggca

SEQ ID NO: 2170997 - DNA, 23 bp, Homo sapiens
gctgctcccagccacgttggtgg

SEQ ID NO: 2170998 - DNA, 20 bp, Homo sapiens
gctgctcctcgcagttcggt

SEQ ID NO: 2170999 - DNA, 16 bp, Homo sapiens
gctgctctgcccagag

SEQ ID NO: 2171000 - DNA, 20 bp, Homo sapiens
gctgctctgcccagagctgg

SEQ ID NO: 2171001 - DNA, 22 bp, Homo sapiens
gctgctttgcacacacactagc

SEQ ID NO: 2171002 - DNA, 20 bp, Homo sapiens
gctggaatggggacctgggg

SEQ ID NO: 2171003 - DNA, 12 bp, Homo sapiens
gctggactggct

SEQ ID NO: 2171004 - DNA, 13 bp, Homo sapiens
gctggactggctg

SEQ ID NO: 2171005 - DNA, 14 bp, Homo sapiens
gctggactggctgt

SEQ ID NO: 2171006 - DNA, 20 bp, Homo sapiens
gctggagaaagagctgcctg

SEQ ID NO: 2171007 - DNA, 15 bp, Homo sapiens
gctggagccactaac

SEQ ID NO: 2171008 - DNA, 16 bp, Homo sapiens
gctggagtgcaggggc

SEQ ID NO: 2171009 - DNA, 17 bp, Homo sapiens
gctggccgggcacagct

SEQ ID NO: 2171010 - DNA, 20 bp, Homo sapiens
gctggccgggttggaggcct

SEQ ID NO: 2171011 - DNA, 23 bp, Homo sapiens
gctggccgggttggaggcctcac

SEQ ID NO: 2171012 - DNA, 13 bp, Homo sapiens
gctggcctcagac

SEQ ID NO: 2171013 - DNA, 13 bp, Homo sapiens
gctggcctcttcc

SEQ ID NO: 2171014 - DNA, 19 bp, Homo sapiens
gctggcggaacctggctgc

SEQ ID NO: 2171015 - DNA, 21 bp, Homo sapiens
gctggctgggggcctcactcc

SEQ ID NO: 2171016 - DNA, 11 bp, Homo sapiens
gctgggagagc

SEQ ID NO: 2171017 - DNA, 15 bp, Homo sapiens
gctgggattacaggt

SEQ ID NO: 2171018 - DNA, 20 bp, Homo sapiens
gctgggcaaacccttctctt

SEQ ID NO: 2171019 - DNA, 19 bp, Homo sapiens
gctgggcagaggggagagg

SEQ ID NO: 2171020 - DNA, 15 bp, Homo sapiens
gctgggcccagaggc

SEQ ID NO: 2171021 - DNA, 18 bp, Homo sapiens
gctgggcccagaggcaca

SEQ ID NO: 2171022 - DNA, 20 bp, Homo sapiens
gctgggcccagaggcacagc

SEQ ID NO: 2171023 - DNA, 22 bp, Homo sapiens
gctgggcggtgcggagcgggcc

SEQ ID NO: 2171024 - DNA, 21 bp, Homo sapiens
gctggggacagctttcctggg

SEQ ID NO: 2171025 - DNA, 14 bp, Homo sapiens
gctggggccgccac

SEQ ID NO: 2171026 - DNA, 22 bp, Homo sapiens
gctggggccgccacggcctggc

SEQ ID NO: 2171027 - DNA, 23 bp, Homo sapiens
gctggggccgccacggcctggct

SEQ ID NO: 2171028 - DNA, 14 bp, Homo sapiens
gctgggggcctcac

SEQ ID NO: 2171029 - DNA, 20 bp, Homo sapiens
gctgggggcctcactccagg

SEQ ID NO: 2171030 - DNA, 22 bp, Homo sapiens
gctgggtccagggtaggcaagg

SEQ ID NO: 2171031 - DNA, 22 bp, Homo sapiens
gctgggtgtattaggactggct

SEQ ID NO: 2171032 - DNA, 20 bp, Homo sapiens
gctgggtttccacacagcct

SEQ ID NO: 2171033 - DNA, 18 bp, Homo sapiens
gctggtaagggccaagtc

SEQ ID NO: 2171034 - DNA, 23 bp, Homo sapiens
gctggtaagggccaagtcccacc

SEQ ID NO: 2171035 - DNA, 21 bp, Homo sapiens
gctggtcttgaactcctagac

SEQ ID NO: 2171036 - DNA, 21 bp, Homo sapiens
gctggtgggcaccaagagcca

SEQ ID NO: 2171037 - DNA, 15 bp, Homo sapiens
gctggtttttcccac

SEQ ID NO: 2171038 - DNA, 12 bp, Homo sapiens
gctgtaaaaaca

SEQ ID NO: 2171039 - DNA, 12 bp, Homo sapiens
gctgtaatttaa

SEQ ID NO: 2171040 - DNA, 14 bp, Homo sapiens
gctgtaatttaatt

SEQ ID NO: 2171041 - DNA, 16 bp, Homo sapiens
gctgtcagaccttctt

SEQ ID NO: 2171042 - DNA, 19 bp, Homo sapiens
gctgtcttgatgactgctg

SEQ ID NO: 2171043 - DNA, 12 bp, Homo sapiens
gctgtgaaattg

SEQ ID NO: 2171044 - DNA, 20 bp, Homo sapiens
gctgtggagaacaaagacca

SEQ ID NO: 2171045 - DNA, 20 bp, Homo sapiens
gctgtgggtcagtgtgccac

SEQ ID NO: 2171046 - DNA, 13 bp, Homo sapiens
gctgtggttcctg

SEQ ID NO: 2171047 - DNA, 16 bp, Homo sapiens
gctgtgtcttactaga

SEQ ID NO: 2171048 - DNA, 13 bp, Homo sapiens
gctgtgtgcagtc

SEQ ID NO: 2171049 - DNA, 18 bp, Homo sapiens
gctgttgttgttaatttt

SEQ ID NO: 2171050 - DNA, 15 bp, Homo sapiens
gcttacctcccacct

SEQ ID NO: 2171051 - DNA, 11 bp, Homo sapiens
gcttatatctg

SEQ ID NO: 2171052 - DNA, 20 bp, Homo sapiens
gcttatatctggcctctgct

SEQ ID NO: 2171053 - DNA, 15 bp, Homo sapiens
gcttcaaataaagta

SEQ ID NO: 2171054 - DNA, 19 bp, Homo sapiens
gcttcaaataaagtaaatt

SEQ ID NO: 2171055 - DNA, 19 bp, Homo sapiens
gcttcaaggatatactgca

SEQ ID NO: 2171056 - DNA, 23 bp, Homo sapiens
gcttcaagtctgtgcctggagct

SEQ ID NO: 2171057 - DNA, 22 bp, Homo sapiens
gcttcacccatgaaattaataa

SEQ ID NO: 2171058 - DNA, 21 bp, Homo sapiens
gcttccctacccacagggcct

SEQ ID NO: 2171059 - DNA, 13 bp, Homo sapiens
gcttccctctgct

SEQ ID NO: 2171060 - DNA, 19 bp, Homo sapiens
gcttctctgtgactgatgt

SEQ ID NO: 2171061 - DNA, 15 bp, Homo sapiens
gcttctgacctcagc

SEQ ID NO: 2171062 - DNA, 13 bp, Homo sapiens
gcttctgcttcca

SEQ ID NO: 2171063 - DNA, 20 bp, Homo sapiens
gcttctggttttcgaagact

SEQ ID NO: 2171064 - DNA, 14 bp, Homo sapiens
gcttcttttggaaa

SEQ ID NO: 2171065 - DNA, 12 bp, Homo sapiens
gcttgaaccttc

SEQ ID NO: 2171066 - DNA, 16 bp, Homo sapiens
gcttgacaggacagca

SEQ ID NO: 2171067 - DNA, 21 bp, Homo sapiens
gcttgctgcaccccaagtcca

SEQ ID NO: 2171068 - DNA, 20 bp, Homo sapiens
gcttggtttcctcaccttga

SEQ ID NO: 2171069 - DNA, 15 bp, Homo sapiens
gcttgtactgggaca

SEQ ID NO: 2171070 - DNA, 11 bp, Homo sapiens
gcttgtcatcc

SEQ ID NO: 2171071 - DNA, 23 bp, Homo sapiens
gcttgtcatccacacaacaccag

SEQ ID NO: 2171072 - DNA, 16 bp, Homo sapiens
gcttgtgatctgggaa

SEQ ID NO: 2171073 - DNA, 17 bp, Homo sapiens
gcttgtgatctgggaac

SEQ ID NO: 2171074 - DNA, 16 bp, Homo sapiens
gctttctcctgtgccc

SEQ ID NO: 2171075 - DNA, 18 bp, Homo sapiens
gctttctctgcttcagct

SEQ ID NO: 2171076 - DNA, 17 bp, Homo sapiens
gctttgaaagaagcaag

SEQ ID NO: 2171077 - DNA, 16 bp, Homo sapiens
gctttgattccatctc

SEQ ID NO: 2171078 - DNA, 20 bp, Homo sapiens
gctttgattccatctccttg

SEQ ID NO: 2171079 - DNA, 19 bp, Homo sapiens
gctttgcccaacctcagca

SEQ ID NO: 2171080 - DNA, 11 bp, Homo sapiens
gctttgctttg

SEQ ID NO: 2171081 - DNA, 13 bp, Homo sapiens
gctttgctttgta

SEQ ID NO: 2171082 - DNA, 18 bp, Homo sapiens
gctttggacacacacagc

SEQ ID NO: 2171083 - DNA, 19 bp, Homo sapiens
gctttggacgcacacagct

SEQ ID NO: 2171084 - DNA, 16 bp, Homo sapiens
gctttggtggcccctc

SEQ ID NO: 2171085 - DNA, 13 bp, Homo sapiens
gctttgtagtttg

SEQ ID NO: 2171086 - DNA, 13 bp, Homo sapiens
gtaaacctggagg

SEQ ID NO: 2171087 - DNA, 22 bp, Homo sapiens
gtaaataggtattatattttgg

SEQ ID NO: 2171088 - DNA, 16 bp, Homo sapiens
gtaaatatagaaccat

SEQ ID NO: 2171089 - DNA, 14 bp, Homo sapiens
gtaaatctgaaaaa

SEQ ID NO: 2171090 - DNA, 15 bp, Homo sapiens
gtaaatctgaaaaac

SEQ ID NO: 2171091 - DNA, 16 bp, Homo sapiens
gtaaatctgaaaaact

SEQ ID NO: 2171092 - DNA, 14 bp, Homo sapiens
gtaaatgttcaagt

SEQ ID NO: 2171093 - DNA, 23 bp, Homo sapiens
gtaacgggtcgtgctcatgtctg

SEQ ID NO: 2171094 - DNA, 14 bp, Homo sapiens
gtaacgtgttactg

SEQ ID NO: 2171095 - DNA, 12 bp, Homo sapiens
gtaacttcctct

SEQ ID NO: 2171096 - DNA, 16 bp, Homo sapiens
gtaaggcagctctgtc

SEQ ID NO: 2171097 - DNA, 17 bp, Homo sapiens
gtaaggcagctctgtcg

SEQ ID NO: 2171098 - DNA, 17 bp, Homo sapiens
gtaagtaaactgccctg

SEQ ID NO: 2171099 - DNA, 19 bp, Homo sapiens
gtaataaaacccagcatgt

SEQ ID NO: 2171100 - DNA, 21 bp, Homo sapiens
gtaatttaaaataattatata

SEQ ID NO: 2171101 - DNA, 19 bp, Homo sapiens
gtaatttccccactctgag

SEQ ID NO: 2171102 - DNA, 16 bp, Homo sapiens
gtaatttttttctagt

SEQ ID NO: 2171103 - DNA, 14 bp, Homo sapiens
gtacaagctgtaaa

SEQ ID NO: 2171104 - DNA, 19 bp, Homo sapiens
gtacaggctaggaagaact

SEQ ID NO: 2171105 - DNA, 13 bp, Homo sapiens
gtacagtatgtgt

SEQ ID NO: 2171106 - DNA, 14 bp, Homo sapiens
gtacagtatgtgtc

SEQ ID NO: 2171107 - DNA, 17 bp, Homo sapiens
gtacagtatgtgtctag

SEQ ID NO: 2171108 - DNA, 21 bp, Homo sapiens
gtacatagatgtatcattaat

SEQ ID NO: 2171109 - DNA, 12 bp, Homo sapiens
gtaccaaagctg

SEQ ID NO: 2171110 - DNA, 15 bp, Homo sapiens
gtacccacctgagct

SEQ ID NO: 2171111 - DNA, 17 bp, Homo sapiens
gtacccacctgagcttt

SEQ ID NO: 2171112 - DNA, 17 bp, Homo sapiens
gtaccgtcgacaagaat

SEQ ID NO: 2171113 - DNA, 23 bp, Homo sapiens
gtacctttgctcttgcagagaag

SEQ ID NO: 2171114 - DNA, 14 bp, Homo sapiens
gtactgtgctgatt

SEQ ID NO: 2171115 - DNA, 18 bp, Homo sapiens
gtacttggtaagagggag

SEQ ID NO: 2171116 - DNA, 16 bp, Homo sapiens
gtagaagagggagaag

SEQ ID NO: 2171117 - DNA, 12 bp, Homo sapiens
gtagacatttta

SEQ ID NO: 2171118 - DNA, 14 bp, Homo sapiens
gtagataaagcact

SEQ ID NO: 2171119 - DNA, 15 bp, Homo sapiens
gtagatctgtggcga

SEQ ID NO: 2171120 - DNA, 18 bp, Homo sapiens
gtagcaggaaaaggtcct

SEQ ID NO: 2171121 - DNA, 13 bp, Homo sapiens
gtagcatatataa

SEQ ID NO: 2171122 - DNA, 14 bp, Homo sapiens
gtagccccaagaag

SEQ ID NO: 2171123 - DNA, 23 bp, Homo sapiens
gtagccccaagaaggctggggct

SEQ ID NO: 2171124 - DNA, 14 bp, Homo sapiens
gtagctccacaaga

SEQ ID NO: 2171125 - DNA, 22 bp, Homo sapiens
gtagctcttagtcctccctgct

SEQ ID NO: 2171126 - DNA, 20 bp, Homo sapiens
gtagctgagactacaggtga

SEQ ID NO: 2171127 - DNA, 11 bp, Homo sapiens
gtagcttctga

SEQ ID NO: 2171128 - DNA, 15 bp, Homo sapiens
gtaggcaaggctgcc

SEQ ID NO: 2171129 - DNA, 22 bp, Homo sapiens
gtaggcaaggctgccggctgca

SEQ ID NO: 2171130 - DNA, 19 bp, Homo sapiens
gtaggctcaactagggagt

SEQ ID NO: 2171131 - DNA, 20 bp, Homo sapiens
gtagggatgcggatcctgct

SEQ ID NO: 2171132 - DNA, 23 bp, Homo sapiens
gtagggatgcggatcctgctggg

SEQ ID NO: 2171133 - DNA, 20 bp, Homo sapiens
gtaggttctgaacagcagaa

SEQ ID NO: 2171134 - DNA, 16 bp, Homo sapiens
gtaggttgtctaaaaa

SEQ ID NO: 2171135 - DNA, 11 bp, Homo sapiens
gtagtgcagtc

SEQ ID NO: 2171136 - DNA, 18 bp, Homo sapiens
gtagttgggattacaggt

SEQ ID NO: 2171137 - DNA, 15 bp, Homo sapiens
gtatataaagttaca

SEQ ID NO: 2171138 - DNA, 13 bp, Homo sapiens
gtatattactgat

SEQ ID NO: 2171139 - DNA, 17 bp, Homo sapiens
gtatatttgaaactgct

SEQ ID NO: 2171140 - DNA, 16 bp, Homo sapiens
gtatcaccctcagctg

SEQ ID NO: 2171141 - DNA, 17 bp, Homo sapiens
gtatcaccctcagctgg

SEQ ID NO: 2171142 - DNA, 21 bp, Homo sapiens
gtatcaccctcagctggcgga

SEQ ID NO: 2171143 - DNA, 16 bp, Homo sapiens
gtatcacctttcccag

SEQ ID NO: 2171144 - DNA, 23 bp, Homo sapiens
gtatctgatatctgtttgcttct

SEQ ID NO: 2171145 - DNA, 14 bp, Homo sapiens
gtatgaaaatgatt

SEQ ID NO: 2171146 - DNA, 18 bp, Homo sapiens
gtatgatgtattagtaga

SEQ ID NO: 2171147 - DNA, 16 bp, Homo sapiens
gtatgcatttttttag

SEQ ID NO: 2171148 - DNA, 23 bp, Homo sapiens
gtatgtagcagcatttacagaaa

SEQ ID NO: 2171149 - DNA, 12 bp, Homo sapiens
gtatgtatgtgt

SEQ ID NO: 2171150 - DNA, 11 bp, Homo sapiens
gtatgtgtcta

SEQ ID NO: 2171151 - DNA, 20 bp, Homo sapiens
gtatgtgtggtttataatct

SEQ ID NO: 2171152 - DNA, 14 bp, Homo sapiens
gtattaaacttgaa

SEQ ID NO: 2171153 - DNA, 13 bp, Homo sapiens
gtattacacatta

SEQ ID NO: 2171154 - DNA, 15 bp, Homo sapiens
gtattacacattaaa

SEQ ID NO: 2171155 - DNA, 21 bp, Homo sapiens
gtattatgtactctactgata

SEQ ID NO: 2171156 - DNA, 16 bp, Homo sapiens
gtattcagagccaccc

SEQ ID NO: 2171157 - DNA, 18 bp, Homo sapiens
gtattctctgtccagggc

SEQ ID NO: 2171158 - DNA, 15 bp, Homo sapiens
gtattgcaagtgaaa

SEQ ID NO: 2171159 - DNA, 14 bp, Homo sapiens
gtatttactgtact

SEQ ID NO: 2171160 - DNA, 20 bp, Homo sapiens
gtatttactgtactaattag

SEQ ID NO: 2171161 - DNA, 17 bp, Homo sapiens
gtatttagtaaaaataa

SEQ ID NO: 2171162 - DNA, 18 bp, Homo sapiens
gtatttattaccgtcaca

SEQ ID NO: 2171163 - DNA, 18 bp, Homo sapiens
gtcaataattgtggagag

SEQ ID NO: 2171164 - DNA, 20 bp, Homo sapiens
gtcaataattgtggagagga

SEQ ID NO: 2171165 - DNA, 17 bp, Homo sapiens
gtcaatggactgcacct

SEQ ID NO: 2171166 - DNA, 13 bp, Homo sapiens
gtcaattctgtta

SEQ ID NO: 2171167 - DNA, 12 bp, Homo sapiens
gtcacagaggca

SEQ ID NO: 2171168 - DNA, 20 bp, Homo sapiens
gtcacagaggcagtggcagc

SEQ ID NO: 2171169 - DNA, 22 bp, Homo sapiens
gtcacaggacgatttcactgac

SEQ ID NO: 2171170 - DNA, 13 bp, Homo sapiens
gtcaccaggggag

SEQ ID NO: 2171171 - DNA, 18 bp, Homo sapiens
gtcaccaggggaggagcc

SEQ ID NO: 2171172 - DNA, 13 bp, Homo sapiens
gtcacccctgtct

SEQ ID NO: 2171173 - DNA, 21 bp, Homo sapiens
gtcacctgccccgtagagaat

SEQ ID NO: 2171174 - DNA, 22 bp, Homo sapiens
gtcacctgtgcagggccctctg

SEQ ID NO: 2171175 - DNA, 19 bp, Homo sapiens
gtcagaccttcttccacag

SEQ ID NO: 2171176 - DNA, 13 bp, Homo sapiens
gtcagtacccacc

SEQ ID NO: 2171177 - DNA, 20 bp, Homo sapiens
gtcagtacccacctgagctt

SEQ ID NO: 2171178 - DNA, 16 bp, Homo sapiens
gtcagtgtgccaccct

SEQ ID NO: 2171179 - DNA, 17 bp, Homo sapiens
gtcatacaatccattct

SEQ ID NO: 2171180 - DNA, 17 bp, Homo sapiens
gtcatgacatttctcaa

SEQ ID NO: 2171181 - DNA, 16 bp, Homo sapiens
gtcatgattaatgtgt

SEQ ID NO: 2171182 - DNA, 15 bp, Homo sapiens
gtcatggctcaagga

SEQ ID NO: 2171183 - DNA, 16 bp, Homo sapiens
gtccaacaactgtcag

SEQ ID NO: 2171184 - DNA, 14 bp, Homo sapiens
gtccaagtgtttct

SEQ ID NO: 2171185 - DNA, 19 bp, Homo sapiens
gtccacccgtttccaagcc

SEQ ID NO: 2171186 - DNA, 14 bp, Homo sapiens
gtccagggcttcag

SEQ ID NO: 2171187 - DNA, 17 bp, Homo sapiens
gtccaggtcgggctcag

SEQ ID NO: 2171188 - DNA, 22 bp, Homo sapiens
gtccaggtcgggctcagctctg

SEQ ID NO: 2171189 - DNA, 14 bp, Homo sapiens
gtccattgatgtca

SEQ ID NO: 2171190 - DNA, 15 bp, Homo sapiens
gtcccacagcttggg

SEQ ID NO: 2171191 - DNA, 23 bp, Homo sapiens
gtcccaccggttgcttctgggaa

SEQ ID NO: 2171192 - DNA, 22 bp, Homo sapiens
gtcccagctgaaggcagtggca

SEQ ID NO: 2171193 - DNA, 16 bp, Homo sapiens
gtccccaaaacactgt

SEQ ID NO: 2171194 - DNA, 11 bp, Homo sapiens
gtccccacact

SEQ ID NO: 2171195 - DNA, 15 bp, Homo sapiens
gtccccagcccactg

SEQ ID NO: 2171196 - DNA, 17 bp, Homo sapiens
gtcccgagccccctgtc

SEQ ID NO: 2171197 - DNA, 14 bp, Homo sapiens
gtccctgccccctc

SEQ ID NO: 2171198 - DNA, 20 bp, Homo sapiens
gtcccttccacacccccacc

SEQ ID NO: 2171199 - DNA, 22 bp, Homo sapiens
gtcccttccacacccccacccc

SEQ ID NO: 2171200 - DNA, 16 bp, Homo sapiens
gtcccttccaggccat

SEQ ID NO: 2171201 - DNA, 20 bp, Homo sapiens
gtcctcaaggggccatcctg

SEQ ID NO: 2171202 - DNA, 21 bp, Homo sapiens
gtcctcacaagcctcttctga

SEQ ID NO: 2171203 - DNA, 12 bp, Homo sapiens
gtcctcccaccc

SEQ ID NO: 2171204 - DNA, 16 bp, Homo sapiens
gtcctcccacccctcc

SEQ ID NO: 2171205 - DNA, 18 bp, Homo sapiens
gtcctcccacccctcccc

SEQ ID NO: 2171206 - DNA, 12 bp, Homo sapiens
gtcctccctgct

SEQ ID NO: 2171207 - DNA, 16 bp, Homo sapiens
gtcctccggggctcag

SEQ ID NO: 2171208 - DNA, 16 bp, Homo sapiens
gtcctgaggcagaacc

SEQ ID NO: 2171209 - DNA, 21 bp, Homo sapiens
taagggggtgaccatgcaatt

SEQ ID NO: 2171210 - DNA, 14 bp, Homo sapiens
taaggtattgcaag

SEQ ID NO: 2171211 - DNA, 15 bp, Homo sapiens
taagtcccatgaata

SEQ ID NO: 2171212 - DNA, 18 bp, Homo sapiens
taagtccctgccccctcc

SEQ ID NO: 2171213 - DNA, 12 bp, Homo sapiens
taagtgactacc

SEQ ID NO: 2171214 - DNA, 20 bp, Homo sapiens
taagttgttttcccatttaa

SEQ ID NO: 2171215 - DNA, 20 bp, Homo sapiens
taagtttagaaattacaagt

SEQ ID NO: 2171216 - DNA, 19 bp, Homo sapiens
taataaaaatttattattt

SEQ ID NO: 2171217 - DNA, 16 bp, Homo sapiens
taataaaatacatact

SEQ ID NO: 2171218 - DNA, 19 bp, Homo sapiens
taataaaattcattccatt

SEQ ID NO: 2171219 - DNA, 22 bp, Homo sapiens
taataatggttactcattttat

SEQ ID NO: 2171220 - DNA, 15 bp, Homo sapiens
taatagctgaacctg

SEQ ID NO: 2171221 - DNA, 17 bp, Homo sapiens
taatagttcaggatttg

SEQ ID NO: 2171222 - DNA, 18 bp, Homo sapiens
taatataagaagctttca

SEQ ID NO: 2171223 - DNA, 22 bp, Homo sapiens
taatataagaagctttcagtat

SEQ ID NO: 2171224 - DNA, 21 bp, Homo sapiens
taatataagtttctttagaaa

SEQ ID NO: 2171225 - DNA, 18 bp, Homo sapiens
taatatatataatactta

SEQ ID NO: 2171226 - DNA, 19 bp, Homo sapiens
taatattaatttatatttg

SEQ ID NO: 2171227 - DNA, 19 bp, Homo sapiens
taatcacttaacctgcttt

SEQ ID NO: 2171228 - DNA, 18 bp, Homo sapiens
taatcagtgtagccccaa

SEQ ID NO: 2171229 - DNA, 23 bp, Homo sapiens
taatcagttagataaaaataaaa

SEQ ID NO: 2171230 - DNA, 21 bp, Homo sapiens
taatcattttagaattaaaat

SEQ ID NO: 2171231 - DNA, 16 bp, Homo sapiens
taatccatgtgctgct

SEQ ID NO: 2171232 - DNA, 21 bp, Homo sapiens
taatccctgctttttgtgttt

SEQ ID NO: 2171233 - DNA, 17 bp, Homo sapiens
taatcctagctgtgtgc

SEQ ID NO: 2171234 - DNA, 20 bp, Homo sapiens
taatctgacaaagtcatgaa

SEQ ID NO: 2171235 - DNA, 16 bp, Homo sapiens
taatgacccggccccc

SEQ ID NO: 2171236 - DNA, 16 bp, Homo sapiens
taatgacgtattgtga

SEQ ID NO: 2171237 - DNA, 17 bp, Homo sapiens
taatgacttttaaaatt

SEQ ID NO: 2171238 - DNA, 23 bp, Homo sapiens
taatgacttttaaaatttgtaga

SEQ ID NO: 2171239 - DNA, 24 bp, Homo sapiens
taatgatactgtctaagaataatg

SEQ ID NO: 2171240 - DNA, 15 bp, Homo sapiens
taatgccaagggtaa

SEQ ID NO: 2171241 - DNA, 23 bp, Homo sapiens
taatgctgcacaccagttactgt

SEQ ID NO: 2171242 - DNA, 16 bp, Homo sapiens
taatgggcctatttga

SEQ ID NO: 2171243 - DNA, 12 bp, Homo sapiens
taatgtaacaca

SEQ ID NO: 2171244 - DNA, 16 bp, Homo sapiens
taatgtaacttcctct

SEQ ID NO: 2171245 - DNA, 19 bp, Homo sapiens
taatgtaggtttagatata

SEQ ID NO: 2171246 - DNA, 20 bp, Homo sapiens
taatgtaggtttagatatat

SEQ ID NO: 2171247 - DNA, 18 bp, Homo sapiens
taatgtgtatttactgta

SEQ ID NO: 2171248 - DNA, 21 bp, Homo sapiens
taatgtgtatttactgtacta

SEQ ID NO: 2171249 - DNA, 17 bp, Homo sapiens
taatgttacatagtaaa

SEQ ID NO: 2171250 - DNA, 14 bp, Homo sapiens
taattatataactg

SEQ ID NO: 2171251 - DNA, 17 bp, Homo sapiens
taattatataactgtat

SEQ ID NO: 2171252 - DNA, 20 bp, Homo sapiens
taattatataactgtatttg

SEQ ID NO: 2171253 - DNA, 16 bp, Homo sapiens
taattcaagattacaa

SEQ ID NO: 2171254 - DNA, 23 bp, Homo sapiens
taattcactaggctcgtgtttgc

SEQ ID NO: 2171255 - DNA, 23 bp, Homo sapiens
taattgcttattgttttattgta

SEQ ID NO: 2171256 - DNA, 14 bp, Homo sapiens
taatttaaagctgt

SEQ ID NO: 2171257 - DNA, 15 bp, Homo sapiens
taatttaaagctgtt

SEQ ID NO: 2171258 - DNA, 16 bp, Homo sapiens
taatttagtggattaa

SEQ ID NO: 2171259 - DNA, 14 bp, Homo sapiens
taatttcagttcta

SEQ ID NO: 2171260 - DNA, 16 bp, Homo sapiens
taatttgcataaaggg

SEQ ID NO: 2171261 - DNA, 22 bp, Homo sapiens
taattttgaccataaattaatt

SEQ ID NO: 2171262 - DNA, 16 bp, Homo sapiens
taatttttacatgacc

SEQ ID NO: 2171263 - DNA, 22 bp, Homo sapiens
taatttttacatgaccagaaaa

SEQ ID NO: 2171264 - DNA, 12 bp, Homo sapiens
taatttttatta

SEQ ID NO: 2171265 - DNA, 18 bp, Homo sapiens
taatttttttctagttgt

SEQ ID NO: 2171266 - DNA, 20 bp, Homo sapiens
tacaaaaaaacctttattct

SEQ ID NO: 2171267 - DNA, 21 bp, Homo sapiens
tacaaaaactttttgttgttt

SEQ ID NO: 2171268 - DNA, 16 bp, Homo sapiens
tacaaaaagcaaaaat

SEQ ID NO: 2171269 - DNA, 21 bp, Homo sapiens
tacaaaaggagaagaggaaca

SEQ ID NO: 2171270 - DNA, 14 bp, Homo sapiens
tacaagagggcaaa

SEQ ID NO: 2171271 - DNA, 22 bp, Homo sapiens
tacaagagggcaaagctgattt

SEQ ID NO: 2171272 - DNA, 20 bp, Homo sapiens
tacaaggcaggcctttccta

SEQ ID NO: 2171273 - DNA, 20 bp, Homo sapiens
tacaagtgctcagttccaat

SEQ ID NO: 2171274 - DNA, 21 bp, Homo sapiens
tacaagtttcagtaatagctg

SEQ ID NO: 2171275 - DNA, 19 bp, Homo sapiens
tacacacgtgtgatgtatg

SEQ ID NO: 2171276 - DNA, 16 bp, Homo sapiens
tacacaggtgagaaag

SEQ ID NO: 2171277 - DNA, 23 bp, Homo sapiens
tacagaaatgccaaaaatgtgcc

SEQ ID NO: 2171278 - DNA, 13 bp, Homo sapiens
tacagaggattct

SEQ ID NO: 2171279 - DNA, 17 bp, Homo sapiens
tacagatgaaccaagtg

SEQ ID NO: 2171280 - DNA, 18 bp, Homo sapiens
tacagcttttctcttttt

SEQ ID NO: 2171281 - DNA, 15 bp, Homo sapiens
tacaggaaggcttgc

SEQ ID NO: 2171282 - DNA, 14 bp, Homo sapiens
tacaggtgactgcc

SEQ ID NO: 2171283 - DNA, 18 bp, Homo sapiens
tacaggtgtgagccacca

SEQ ID NO: 2171284 - DNA, 15 bp, Homo sapiens
tacagtatgtgtcta

SEQ ID NO: 2171285 - DNA, 16 bp, Homo sapiens
tacagtgaataaaagg

SEQ ID NO: 2171286 - DNA, 16 bp, Homo sapiens
tacagtgtatctcgaa

SEQ ID NO: 2171287 - DNA, 19 bp, Homo sapiens
tacatagatgtatcattaa

SEQ ID NO: 2171288 - DNA, 16 bp, Homo sapiens
tacatatgatcaaata

SEQ ID NO: 2171289 - DNA, 15 bp, Homo sapiens
tacatcttttgggaa

SEQ ID NO: 2171290 - DNA, 22 bp, Homo sapiens
tacatgaccagaaaacaaatct

SEQ ID NO: 2171291 - DNA, 14 bp, Homo sapiens
tacatggtagcagg

SEQ ID NO: 2171292 - DNA, 22 bp, Homo sapiens
tacattgaaacttgagtttgtt

SEQ ID NO: 2171293 - DNA, 21 bp, Homo sapiens
tacatttgggagtttttatga

SEQ ID NO: 2171294 - DNA, 14 bp, Homo sapiens
taccaaagctgttt

SEQ ID NO: 2171295 - DNA, 16 bp, Homo sapiens
taccaagtgctgtctt

SEQ ID NO: 2171296 - DNA, 18 bp, Homo sapiens
taccacactcatgggtca

SEQ ID NO: 2171297 - DNA, 12 bp, Homo sapiens
taccaccaacaa

SEQ ID NO: 2171298 - DNA, 13 bp, Homo sapiens
taccaccaacaaa

SEQ ID NO: 2171299 - DNA, 16 bp, Homo sapiens
taccacttatttctaa

SEQ ID NO: 2171300 - DNA, 13 bp, Homo sapiens
taccatctccctc

SEQ ID NO: 2171301 - DNA, 17 bp, Homo sapiens
tacccaaatcctctcca

SEQ ID NO: 2171302 - DNA, 11 bp, Homo sapiens
tacccacctga

SEQ ID NO: 2171303 - DNA, 23 bp, Homo sapiens
tacccacctgagctttggacaca

SEQ ID NO: 2171304 - DNA, 15 bp, Homo sapiens
tacccagcccatctt

SEQ ID NO: 2171305 - DNA, 22 bp, Homo sapiens
tacccagcccatcttgcctcca

SEQ ID NO: 2171306 - DNA, 23 bp, Homo sapiens
tacccatttgaaagaatattagt

SEQ ID NO: 2171307 - DNA, 18 bp, Homo sapiens
taccccccgtctcctgcc

SEQ ID NO: 2171308 - DNA, 19 bp, Homo sapiens
taccccccgtctcctgccg

SEQ ID NO: 2171309 - DNA, 15 bp, Homo sapiens
tacccccttgtctgc

SEQ ID NO: 2171310 - DNA, 20 bp, Homo sapiens
tacccttctgtgcccagctc

SEQ ID NO: 2171311 - DNA, 14 bp, Homo sapiens
tacccttgccaagg

SEQ ID NO: 2171312 - DNA, 17 bp, Homo sapiens
tacccttgccaaggccg

SEQ ID NO: 2171313 - DNA, 23 bp, Homo sapiens
tacccttgccaaggccgcccacc

SEQ ID NO: 2171314 - DNA, 19 bp, Homo sapiens
taccgtcgacaagaatgtc

SEQ ID NO: 2171315 - DNA, 16 bp, Homo sapiens
tacctcccacctttgg

SEQ ID NO: 2171316 - DNA, 15 bp, Homo sapiens
tacctgatcccactc

SEQ ID NO: 2171317 - DNA, 24 bp, Homo sapiens
tacctgccctctatttattagcca

SEQ ID NO: 2171318 - DNA, 16 bp, Homo sapiens
tacctgcttctggttt

SEQ ID NO: 2171319 - DNA, 20 bp, Homo sapiens
tacctgtccaggatcaaaag

SEQ ID NO: 2171320 - DNA, 12 bp, Homo sapiens
tacctttctgac

SEQ ID NO: 2171321 - DNA, 20 bp, Homo sapiens
taccttttttttacggaatt

SEQ ID NO: 2171322 - DNA, 16 bp, Homo sapiens
tacggaacactgtcaa

SEQ ID NO: 2171323 - DNA, 20 bp, Homo sapiens
tacggaacactgtcaatgga

SEQ ID NO: 2171324 - DNA, 13 bp, Homo sapiens
tacggaattccaa

SEQ ID NO: 2171325 - DNA, 17 bp, Homo sapiens
tacgtggcaaaatccct

SEQ ID NO: 2171326 - DNA, 22 bp, Homo sapiens
tacgttgcatccacaggattcc

SEQ ID NO: 2171327 - DNA, 12 bp, Homo sapiens
tactaaatatga

SEQ ID NO: 2171328 - DNA, 16 bp, Homo sapiens
tactaataaaatacat

SEQ ID NO: 2171329 - DNA, 18 bp, Homo sapiens
tactatagatataactgt

SEQ ID NO: 2171330 - DNA, 14 bp, Homo sapiens
tcatcactcccctc

SEQ ID NO: 2171331 - DNA, 16 bp, Homo sapiens
tcatcactcccctcca

SEQ ID NO: 2171332 - DNA, 17 bp, Homo sapiens
tcatcagtattgtgtaa

SEQ ID NO: 2171333 - DNA, 23 bp, Homo sapiens
tcatccctgccaagaactctggg

SEQ ID NO: 2171334 - DNA, 18 bp, Homo sapiens
tcatcttagttctgtata

SEQ ID NO: 2171335 - DNA, 13 bp, Homo sapiens
tcatctttccaaa

SEQ ID NO: 2171336 - DNA, 20 bp, Homo sapiens
tcatgaagctcagtttggct

SEQ ID NO: 2171337 - DNA, 16 bp, Homo sapiens
tcatgacatttctcaa

SEQ ID NO: 2171338 - DNA, 16 bp, Homo sapiens
tcatgccaagcattta

SEQ ID NO: 2171339 - DNA, 22 bp, Homo sapiens
tcatggcattcgcagtgcccag

SEQ ID NO: 2171340 - DNA, 13 bp, Homo sapiens
tcatggctcaagg

SEQ ID NO: 2171341 - DNA, 15 bp, Homo sapiens
tcatggctcactgca

SEQ ID NO: 2171342 - DNA, 16 bp, Homo sapiens
tcatggctcactgcag

SEQ ID NO: 2171343 - DNA, 18 bp, Homo sapiens
tcatggctctgaactgca

SEQ ID NO: 2171344 - DNA, 18 bp, Homo sapiens
tcatgtaggttgtctaaa

SEQ ID NO: 2171345 - DNA, 21 bp, Homo sapiens
tcatgttaatcctagctgtgt

SEQ ID NO: 2171346 - DNA, 15 bp, Homo sapiens
tcatgttgaagtcaa

SEQ ID NO: 2171347 - DNA, 18 bp, Homo sapiens
tcattactttaccacccc

SEQ ID NO: 2171348 - DNA, 20 bp, Homo sapiens
tcattcagtgagacacagag

SEQ ID NO: 2171349 - DNA, 23 bp, Homo sapiens
tcattgggctgttttctcaacaa

SEQ ID NO: 2171350 - DNA, 19 bp, Homo sapiens
tcatttatttccatattaa

SEQ ID NO: 2171351 - DNA, 20 bp, Homo sapiens
tcatttatttccatattaaa

SEQ ID NO: 2171352 - DNA, 22 bp, Homo sapiens
tcatttatttccatattaaaat

SEQ ID NO: 2171353 - DNA, 14 bp, Homo sapiens
tcatttattttgac

SEQ ID NO: 2171354 - DNA, 13 bp, Homo sapiens
tcatttcagaagt

SEQ ID NO: 2171355 - DNA, 19 bp, Homo sapiens
tcatttcccctcccgtctt

SEQ ID NO: 2171356 - DNA, 15 bp, Homo sapiens
tcatttgcagctgct

SEQ ID NO: 2171357 - DNA, 19 bp, Homo sapiens
tcatttgcagctgctggtt

SEQ ID NO: 2171358 - DNA, 19 bp, Homo sapiens
tcatttgccaactaatttt

SEQ ID NO: 2171359 - DNA, 15 bp, Homo sapiens
tcattttcactttta

SEQ ID NO: 2171360 - DNA, 18 bp, Homo sapiens
tcattttgtatgtatgtg

SEQ ID NO: 2171361 - DNA, 20 bp, Homo sapiens
tcattttgtatgtatgtgta

SEQ ID NO: 2171362 - DNA, 19 bp, Homo sapiens
tcatttttcaatagcacat

SEQ ID NO: 2171363 - DNA, 23 bp, Homo sapiens
tcatttttgtttttggtttctta

SEQ ID NO: 2171364 - DNA, 13 bp, Homo sapiens
tccaaaaacaaag

SEQ ID NO: 2171365 - DNA, 15 bp, Homo sapiens
tccaaagctttcctg

SEQ ID NO: 2171366 - DNA, 19 bp, Homo sapiens
tccaaatatgttaagggct

SEQ ID NO: 2171367 - DNA, 18 bp, Homo sapiens
tccaaattgatgggtggg

SEQ ID NO: 2171368 - DNA, 20 bp, Homo sapiens
tccaactcctggagatttca

SEQ ID NO: 2171369 - DNA, 13 bp, Homo sapiens
tccaagcctgggc

SEQ ID NO: 2171370 - DNA, 21 bp, Homo sapiens
tccaagcctgggccactggca

SEQ ID NO: 2171371 - DNA, 22 bp, Homo sapiens
tccaagcctgggccactggcat

SEQ ID NO: 2171372 - DNA, 19 bp, Homo sapiens
tccaagtggacggcagacc

SEQ ID NO: 2171373 - DNA, 14 bp, Homo sapiens
tccaatatttataa

SEQ ID NO: 2171374 - DNA, 19 bp, Homo sapiens
tccaatatttataattaaa

SEQ ID NO: 2171375 - DNA, 21 bp, Homo sapiens
tccaatatttataattaaaga

SEQ ID NO: 2171376 - DNA, 23 bp, Homo sapiens
tccaatatttataattaaagaaa

SEQ ID NO: 2171377 - DNA, 19 bp, Homo sapiens
tccaatgtgcccagtcatg

SEQ ID NO: 2171378 - DNA, 17 bp, Homo sapiens
tccacaacctcctcctc

SEQ ID NO: 2171379 - DNA, 13 bp, Homo sapiens
tccacacaacacc

SEQ ID NO: 2171380 - DNA, 18 bp, Homo sapiens
tccacacaacaccaggac

SEQ ID NO: 2171381 - DNA, 13 bp, Homo sapiens
tccacacagcctg

SEQ ID NO: 2171382 - DNA, 20 bp, Homo sapiens
tccacagaaaccctgtttta

SEQ ID NO: 2171383 - DNA, 15 bp, Homo sapiens
tccaccaaattctga

SEQ ID NO: 2171384 - DNA, 24 bp, Homo sapiens
tccaccatggctaaggcaccagcc

SEQ ID NO: 2171385 - DNA, 17 bp, Homo sapiens
tccacccctccttccct

SEQ ID NO: 2171386 - DNA, 21 bp, Homo sapiens
tccacccgtttccaagcctgg

SEQ ID NO: 2171387 - DNA, 12 bp, Homo sapiens
tccacctccttc

SEQ ID NO: 2171388 - DNA, 13 bp, Homo sapiens
tccacctccttct

SEQ ID NO: 2171389 - DNA, 22 bp, Homo sapiens
tccaccttaccctactggctgt

SEQ ID NO: 2171390 - DNA, 20 bp, Homo sapiens
tccacctttctgaatggaaa

SEQ ID NO: 2171391 - DNA, 18 bp, Homo sapiens
tccactgcaaataaagcc

SEQ ID NO: 2171392 - DNA, 19 bp, Homo sapiens
tccactgcaaataaagcct

SEQ ID NO: 2171393 - DNA, 12 bp, Homo sapiens
tccactggaaac

SEQ ID NO: 2171394 - DNA, 21 bp, Homo sapiens
tccagaggaggggtggtgtcc

SEQ ID NO: 2171395 - DNA, 18 bp, Homo sapiens
tccagagtatgagtgcaa

SEQ ID NO: 2171396 - DNA, 13 bp, Homo sapiens
tccagattgtagc

SEQ ID NO: 2171397 - DNA, 10 bp, Homo sapiens
tccagccact

SEQ ID NO: 2171398 - DNA, 11 bp, Homo sapiens
tccagccactt

SEQ ID NO: 2171399 - DNA, 19 bp, Homo sapiens
tccagctaagcctgatgat

SEQ ID NO: 2171400 - DNA, 21 bp, Homo sapiens
tccaggccatcagaggcctag

SEQ ID NO: 2171401 - DNA, 13 bp, Homo sapiens
tccaggggcctgc

SEQ ID NO: 2171402 - DNA, 16 bp, Homo sapiens
tccaggggcctgcaga

SEQ ID NO: 2171403 - DNA, 21 bp, Homo sapiens
tccaggggcctgcagaaggaa

SEQ ID NO: 2171404 - DNA, 22 bp, Homo sapiens
tccagggtaggcaaggctgccg

SEQ ID NO: 2171405 - DNA, 14 bp, Homo sapiens
tccaggtcgggctc

SEQ ID NO: 2171406 - DNA, 22 bp, Homo sapiens
tccaggtcgggctcagctctgg

SEQ ID NO: 2171407 - DNA, 16 bp, Homo sapiens
tccagtatcctgaaac

SEQ ID NO: 2171408 - DNA, 16 bp, Homo sapiens
tccagtcctgctctct

SEQ ID NO: 2171409 - DNA, 16 bp, Homo sapiens
tccagtggcctggctc

SEQ ID NO: 2171410 - DNA, 14 bp, Homo sapiens
tccagttctgatga

SEQ ID NO: 2171411 - DNA, 12 bp, Homo sapiens
tccatcagcagt

SEQ ID NO: 2171412 - DNA, 16 bp, Homo sapiens
tccatcctgtacaagt

SEQ ID NO: 2171413 - DNA, 22 bp, Homo sapiens
tccatggcccatcactcggctg

SEQ ID NO: 2171414 - DNA, 15 bp, Homo sapiens
tccatggtgcctctg

SEQ ID NO: 2171415 - DNA, 23 bp, Homo sapiens
tccatgtagaagagggagaagga

SEQ ID NO: 2171416 - DNA, 16 bp, Homo sapiens
tccattaatgtagata

SEQ ID NO: 2171417 - DNA, 12 bp, Homo sapiens
tccattgatgtc

SEQ ID NO: 2171418 - DNA, 20 bp, Homo sapiens
tcccaaagtgctgggattac

SEQ ID NO: 2171419 - DNA, 17 bp, Homo sapiens
tcccaagaacagcaggc

SEQ ID NO: 2171420 - DNA, 20 bp, Homo sapiens
tcccaagctggagtgcagtg

SEQ ID NO: 2171421 - DNA, 13 bp, Homo sapiens
tcccaattcattt

SEQ ID NO: 2171422 - DNA, 21 bp, Homo sapiens
tcccaatttaagagtcctgag

SEQ ID NO: 2171423 - DNA, 20 bp, Homo sapiens
tcccacagtctctccctggg

SEQ ID NO: 2171424 - DNA, 21 bp, Homo sapiens
tcccacagtctctccctgggg

SEQ ID NO: 2171425 - DNA, 14 bp, Homo sapiens
tcccacggccactg

SEQ ID NO: 2171426 - DNA, 15 bp, Homo sapiens
tcccacggccactgc

SEQ ID NO: 2171427 - DNA, 18 bp, Homo sapiens
tcccacggccactgcagt

SEQ ID NO: 2171428 - DNA, 11 bp, Homo sapiens
tcccagatgcc

SEQ ID NO: 2171429 - DNA, 13 bp, Homo sapiens
tcccagccttggc

SEQ ID NO: 2171430 - DNA, 14 bp, Homo sapiens
tcccagccttggca

SEQ ID NO: 2171431 - DNA, 21 bp, Homo sapiens
tcccatggatgtttcttcttt

SEQ ID NO: 2171432 - DNA, 14 bp, Homo sapiens
tcccatttcttaat

SEQ ID NO: 2171433 - DNA, 18 bp, Homo sapiens
tccccaaaacactgtctg

SEQ ID NO: 2171434 - DNA, 20 bp, Homo sapiens
tccccaactccttcctcttt

SEQ ID NO: 2171435 - DNA, 22 bp, Homo sapiens
tccccaactccttcctctttgc

SEQ ID NO: 2171436 - DNA, 12 bp, Homo sapiens
tccccaagctgg

SEQ ID NO: 2171437 - DNA, 19 bp, Homo sapiens
tccccagcccactggatca

SEQ ID NO: 2171438 - DNA, 15 bp, Homo sapiens
tccccatactctgtc

SEQ ID NO: 2171439 - DNA, 23 bp, Homo sapiens
tccccatagctggtttttcccac

SEQ ID NO: 2171440 - DNA, 11 bp, Homo sapiens
tcccccacctc

SEQ ID NO: 2171441 - DNA, 20 bp, Homo sapiens
tccccctcttcttctgaaga

SEQ ID NO: 2171442 - DNA, 23 bp, Homo sapiens
tccccctggaatcgaggctgtgt

SEQ ID NO: 2171443 - DNA, 21 bp, Homo sapiens
tccccctggccaccacccccc

SEQ ID NO: 2171444 - DNA, 16 bp, Homo sapiens
tcccctcctctcccct

SEQ ID NO: 2171445 - DNA, 18 bp, Homo sapiens
tcccctcctctcccctac

SEQ ID NO: 2171446 - DNA, 14 bp, Homo sapiens
tcccctctgctggc

SEQ ID NO: 2171447 - DNA, 20 bp, Homo sapiens
tcccgagccccctgtccttc

SEQ ID NO: 2171448 - DNA, 20 bp, Homo sapiens
tcccgagtagttgggattac

SEQ ID NO: 2171449 - DNA, 19 bp, Homo sapiens
tcccgcagagactggggcc

SEQ ID NO: 2171450 - DNA, 14 bp, Homo sapiens
tcccggctggactt

SEQ ID NO: 2171451 - DNA, 14 bp, Homo sapiens
tcccgtcttcctcc

SEQ ID NO: 2171452 - DNA, 15 bp, Homo sapiens
tcttacccttctgtg

SEQ ID NO: 2171453 - DNA, 16 bp, Homo sapiens
tcttacccttctgtgc

SEQ ID NO: 2171454 - DNA, 21 bp, Homo sapiens
tcttacccttctgtgcccagc

SEQ ID NO: 2171455 - DNA, 19 bp, Homo sapiens
tcttagaacagatggctgt

SEQ ID NO: 2171456 - DNA, 17 bp, Homo sapiens
tcttagcttacaggaag

SEQ ID NO: 2171457 - DNA, 18 bp, Homo sapiens
tcttagtcctccctgctc

SEQ ID NO: 2171458 - DNA, 20 bp, Homo sapiens
tcttagtcctccctgctcag

SEQ ID NO: 2171459 - DNA, 19 bp, Homo sapiens
tcttagttctgtatataaa

SEQ ID NO: 2171460 - DNA, 21 bp, Homo sapiens
tcttagttctgtatataaata

SEQ ID NO: 2171461 - DNA, 21 bp, Homo sapiens
tcttataattgttctcagaat

SEQ ID NO: 2171462 - DNA, 17 bp, Homo sapiens
tcttatgcaaaactttt

SEQ ID NO: 2171463 - DNA, 17 bp, Homo sapiens
tcttcaatctctgttct

SEQ ID NO: 2171464 - DNA, 21 bp, Homo sapiens
tcttcacactatcaacactgc

SEQ ID NO: 2171465 - DNA, 15 bp, Homo sapiens
tcttcagatcctgct

SEQ ID NO: 2171466 - DNA, 21 bp, Homo sapiens
tcttcagggtcctgagattta

SEQ ID NO: 2171467 - DNA, 15 bp, Homo sapiens
tcttcatccttagca

SEQ ID NO: 2171468 - DNA, 16 bp, Homo sapiens
tcttcatccttagcaa

SEQ ID NO: 2171469 - DNA, 19 bp, Homo sapiens
tcttccacagcaaatgaga

SEQ ID NO: 2171470 - DNA, 23 bp, Homo sapiens
tcttccaggcccagtccactggg

SEQ ID NO: 2171471 - DNA, 14 bp, Homo sapiens
tcttcccctctcag

SEQ ID NO: 2171472 - DNA, 20 bp, Homo sapiens
tcttccctagggctgggtgt

SEQ ID NO: 2171473 - DNA, 14 bp, Homo sapiens
tcttctccaggatg

SEQ ID NO: 2171474 - DNA, 15 bp, Homo sapiens
tcttctctcccacac

SEQ ID NO: 2171475 - DNA, 19 bp, Homo sapiens
tcttctgtagctattcttt

SEQ ID NO: 2171476 - DNA, 20 bp, Homo sapiens
tcttctgtagctattctttg

SEQ ID NO: 2171477 - DNA, 12 bp, Homo sapiens
tcttcttctcaa

SEQ ID NO: 2171478 - DNA, 13 bp, Homo sapiens
tcttcttctcaag

SEQ ID NO: 2171479 - DNA, 15 bp, Homo sapiens
tcttcttctcaagca

SEQ ID NO: 2171480 - DNA, 19 bp, Homo sapiens
tcttctttgactataacaa

SEQ ID NO: 2171481 - DNA, 19 bp, Homo sapiens
tcttgaataaagtattcta

SEQ ID NO: 2171482 - DNA, 20 bp, Homo sapiens
tcttgacaccagctgttctg

SEQ ID NO: 2171483 - DNA, 21 bp, Homo sapiens
tcttgacaccagctgttctgt

SEQ ID NO: 2171484 - DNA, 20 bp, Homo sapiens
tcttgagagcgctggcctct

SEQ ID NO: 2171485 - DNA, 14 bp, Homo sapiens
tcttgagatctgct

SEQ ID NO: 2171486 - DNA, 18 bp, Homo sapiens
tcttgcagagaagccttg

SEQ ID NO: 2171487 - DNA, 12 bp, Homo sapiens
tcttgctggtgc

SEQ ID NO: 2171488 - DNA, 18 bp, Homo sapiens
tcttggagacaattacaa

SEQ ID NO: 2171489 - DNA, 21 bp, Homo sapiens
tcttggcctcccaaagtgctg

SEQ ID NO: 2171490 - DNA, 21 bp, Homo sapiens
tcttgggaaaatatcactttg

SEQ ID NO: 2171491 - DNA, 15 bp, Homo sapiens
tcttggtatgatcat

SEQ ID NO: 2171492 - DNA, 20 bp, Homo sapiens
tcttgtaaacctggagggtt

SEQ ID NO: 2171493 - DNA, 13 bp, Homo sapiens
tctttaaaagtca

SEQ ID NO: 2171494 - DNA, 21 bp, Homo sapiens
tctttagaaaacccaagtttt

SEQ ID NO: 2171495 - DNA, 14 bp, Homo sapiens
tctttattagtgaa

SEQ ID NO: 2171496 - DNA, 13 bp, Homo sapiens
tctttccatgcag

SEQ ID NO: 2171497 - DNA, 16 bp, Homo sapiens
tctttccttgtctctc

SEQ ID NO: 2171498 - DNA, 13 bp, Homo sapiens
tctttctagtttg

SEQ ID NO: 2171499 - DNA, 17 bp, Homo sapiens
tctttgaccaaactgtg

SEQ ID NO: 2171500 - DNA, 12 bp, Homo sapiens
tctttgagaggg

SEQ ID NO: 2171501 - DNA, 16 bp, Homo sapiens
tctttgctcccagttt

SEQ ID NO: 2171502 - DNA, 12 bp, Homo sapiens
tctttgcttggg

SEQ ID NO: 2171503 - DNA, 20 bp, Homo sapiens
tctttgctttgtagtttgct

SEQ ID NO: 2171504 - DNA, 21 bp, Homo sapiens
tctttgctttgtagtttgctt

SEQ ID NO: 2171505 - DNA, 22 bp, Homo sapiens
tctttgtaagtaaactgccctg

SEQ ID NO: 2171506 - DNA, 13 bp, Homo sapiens
tctttgtgaaatc

SEQ ID NO: 2171507 - DNA, 15 bp, Homo sapiens
tcttttaatgatact

SEQ ID NO: 2171508 - DNA, 19 bp, Homo sapiens
tcttttctggtaggttctg

SEQ ID NO: 2171509 - DNA, 12 bp, Homo sapiens
tcttttgattct

SEQ ID NO: 2171510 - DNA, 13 bp, Homo sapiens
tctttttgtaatt

SEQ ID NO: 2171511 - DNA, 16 bp, Homo sapiens
tctttttttagggaga

SEQ ID NO: 2171512 - DNA, 14 bp, Homo sapiens
tgaaaagattgcaa

SEQ ID NO: 2171513 - DNA, 19 bp, Homo sapiens
tgaaaatgatgtagacatt

SEQ ID NO: 2171514 - DNA, 14 bp, Homo sapiens
tgaaacttgagttt

SEQ ID NO: 2171515 - DNA, 15 bp, Homo sapiens
tgaaacttggtgtgt

SEQ ID NO: 2171516 - DNA, 18 bp, Homo sapiens
tgaaacttggttcccaga

SEQ ID NO: 2171517 - DNA, 23 bp, Homo sapiens
tgaaacttggttcccagaaaaca

SEQ ID NO: 2171518 - DNA, 13 bp, Homo sapiens
tgaaagaagcaag

SEQ ID NO: 2171519 - DNA, 20 bp, Homo sapiens
tgaaagctatgaatgttact

SEQ ID NO: 2171520 - DNA, 20 bp, Homo sapiens
tgaaagtctcctgtatcatt

SEQ ID NO: 2171521 - DNA, 16 bp, Homo sapiens
tgaaatgggaacaata

SEQ ID NO: 2171522 - DNA, 18 bp, Homo sapiens
tgaacaactcgaatcact

SEQ ID NO: 2171523 - DNA, 23 bp, Homo sapiens
tgaacaactcgaatcactcattt

SEQ ID NO: 2171524 - DNA, 17 bp, Homo sapiens
tgaacataggtgtgctt

SEQ ID NO: 2171525 - DNA, 17 bp, Homo sapiens
tgaactcacgagccttg

SEQ ID NO: 2171526 - DNA, 15 bp, Homo sapiens
tgaactccgctgcct

SEQ ID NO: 2171527 - DNA, 14 bp, Homo sapiens
tgaactcttgataa

SEQ ID NO: 2171528 - DNA, 19 bp, Homo sapiens
tgaactcttgataacacca

SEQ ID NO: 2171529 - DNA, 18 bp, Homo sapiens
tgaagaaacatttatctt

SEQ ID NO: 2171530 - DNA, 22 bp, Homo sapiens
tgaagacccttgtgcattgtgt

SEQ ID NO: 2171531 - DNA, 15 bp, Homo sapiens
tgaagatcagaacat

SEQ ID NO: 2171532 - DNA, 21 bp, Homo sapiens
tgaagatcagaacattcagct

SEQ ID NO: 2171533 - DNA, 13 bp, Homo sapiens
tgaagctggggac

SEQ ID NO: 2171534 - DNA, 17 bp, Homo sapiens
tgaaggaaaaacatgct

SEQ ID NO: 2171535 - DNA, 18 bp, Homo sapiens
tgaaggttggaactgctg

SEQ ID NO: 2171536 - DNA, 16 bp, Homo sapiens
tgaagtatctgtacct

SEQ ID NO: 2171537 - DNA, 21 bp, Homo sapiens
tgaagtatgcactaatcaata

SEQ ID NO: 2171538 - DNA, 17 bp, Homo sapiens
tgaagtcccaatttaag

SEQ ID NO: 2171539 - DNA, 17 bp, Homo sapiens
tgaagtgaatacatggt

SEQ ID NO: 2171540 - DNA, 18 bp, Homo sapiens
tgaagtttgtcaggcaca

SEQ ID NO: 2171541 - DNA, 23 bp, Homo sapiens
tgaagttttattttaaattatta

SEQ ID NO: 2171542 - DNA, 19 bp, Homo sapiens
tgaataggaaataaaatta

SEQ ID NO: 2171543 - DNA, 22 bp, Homo sapiens
tgaataggcattaaatgcaaaa

SEQ ID NO: 2171544 - DNA, 13 bp, Homo sapiens
tgaatattgtaaa

SEQ ID NO: 2171545 - DNA, 13 bp, Homo sapiens
tgaatgagtgtgt

SEQ ID NO: 2171546 - DNA, 14 bp, Homo sapiens
tgaatgctgtacct

SEQ ID NO: 2171547 - DNA, 15 bp, Homo sapiens
tgaatgctgtacctt

SEQ ID NO: 2171548 - DNA, 20 bp, Homo sapiens
tgaatgctgtacctttctga

SEQ ID NO: 2171549 - DNA, 17 bp, Homo sapiens
tgaatggaaacttggaa

SEQ ID NO: 2171550 - DNA, 13 bp, Homo sapiens
tgaattggacccc

SEQ ID NO: 2171551 - DNA, 21 bp, Homo sapiens
tgaatttctatggcatattga

SEQ ID NO: 2171552 - DNA, 16 bp, Homo sapiens
tgacaaggtagacatg

SEQ ID NO: 2171553 - DNA, 23 bp, Homo sapiens
tgacacaaaggacaaaaatataa

SEQ ID NO: 2171554 - DNA, 24 bp, Homo sapiens
tgacaccagctgttctgtcccttg

SEQ ID NO: 2171555 - DNA, 13 bp, Homo sapiens
tgacactgagaac

SEQ ID NO: 2171556 - DNA, 15 bp, Homo sapiens
tgacatctaattcaa

SEQ ID NO: 2171557 - DNA, 17 bp, Homo sapiens
tgacatttgtcctgcag

SEQ ID NO: 2171558 - DNA, 16 bp, Homo sapiens
tgaccagcactgaccc

SEQ ID NO: 2171559 - DNA, 15 bp, Homo sapiens
tgaccagtttctttt

SEQ ID NO: 2171560 - DNA, 14 bp, Homo sapiens
tgacccactaattg

SEQ ID NO: 2171561 - DNA, 18 bp, Homo sapiens
tgaccccttcctgtctgg

SEQ ID NO: 2171562 - DNA, 22 bp, Homo sapiens
tgaccccttcctgtctggccca

SEQ ID NO: 2171563 - DNA, 23 bp, Homo sapiens
tgacccggcccccgccctctgcc

SEQ ID NO: 2171564 - DNA, 20 bp, Homo sapiens
tgacctcaggtgatccaccc

SEQ ID NO: 2171565 - DNA, 17 bp, Homo sapiens
tgacctcccactttggg

SEQ ID NO: 2171566 - DNA, 16 bp, Homo sapiens
tgaccttgatgtcttg

SEQ ID NO: 2171567 - DNA, 20 bp, Homo sapiens
tgaccttgatgtcttgagag

SEQ ID NO: 2171568 - DNA, 20 bp, Homo sapiens
tgacgcgtggtcacaggacg

SEQ ID NO: 2171569 - DNA, 18 bp, Homo sapiens
tgacgtattgtgaaattt

SEQ ID NO: 2171570 - DNA, 19 bp, Homo sapiens
tgactaaactacattataa

SEQ ID NO: 2171571 - DNA, 20 bp, Homo sapiens
tgactaaactacattataaa

SEQ ID NO: 2171572 - DNA, 18 bp, Homo sapiens
tgactcccaaagagctgc

SEQ ID NO: 2171573 - DNA, 15 bp, Homo sapiens
tgactcctgctggta

SEQ ID NO: 2171574 - DNA, 13 bp, Homo sapiens
tgctgctgtggca

SEQ ID NO: 2171575 - DNA, 11 bp, Homo sapiens
tgctggagagt

SEQ ID NO: 2171576 - DNA, 18 bp, Homo sapiens
tgctggagagtggcatca

SEQ ID NO: 2171577 - DNA, 18 bp, Homo sapiens
tgctggccgggcacagct

SEQ ID NO: 2171578 - DNA, 22 bp, Homo sapiens
tgctggggccgccacggcctgg

SEQ ID NO: 2171579 - DNA, 20 bp, Homo sapiens
tgctggtgaccggcctggac

SEQ ID NO: 2171580 - DNA, 22 bp, Homo sapiens
tgctgtcagaccttcttccaca

SEQ ID NO: 2171581 - DNA, 22 bp, Homo sapiens
tgctgtcttgatgactgctgat

SEQ ID NO: 2171582 - DNA, 21 bp, Homo sapiens
tgctgtggattttgtggcttc

SEQ ID NO: 2171583 - DNA, 12 bp, Homo sapiens
tgcttaaacaaa

SEQ ID NO: 2171584 - DNA, 14 bp, Homo sapiens
tgcttaaacaaaac

SEQ ID NO: 2171585 - DNA, 19 bp, Homo sapiens
tgcttaagggggtgtaatg

SEQ ID NO: 2171586 - DNA, 21 bp, Homo sapiens
tgcttcaaactcaaacacaga

SEQ ID NO: 2171587 - DNA, 16 bp, Homo sapiens
tgcttcccaaatacat

SEQ ID NO: 2171588 - DNA, 14 bp, Homo sapiens
tgcttctgggaagg

SEQ ID NO: 2171589 - DNA, 14 bp, Homo sapiens
tgcttctttataaa

SEQ ID NO: 2171590 - DNA, 14 bp, Homo sapiens
tgcttggggcctgg

SEQ ID NO: 2171591 - DNA, 16 bp, Homo sapiens
tgcttgtactgggaca

SEQ ID NO: 2171592 - DNA, 14 bp, Homo sapiens
tgcttgtcatccac

SEQ ID NO: 2171593 - DNA, 15 bp, Homo sapiens
tgctttctcctttaa

SEQ ID NO: 2171594 - DNA, 18 bp, Homo sapiens
tgctttgattgttcatat

SEQ ID NO: 2171595 - DNA, 16 bp, Homo sapiens
tgctttttgtgttttt

SEQ ID NO: 2171596 - DNA, 17 bp, Homo sapiens
tggaaaaattaagttgt

SEQ ID NO: 2171597 - DNA, 20 bp, Homo sapiens
tggaaagattgtgtctggtc

SEQ ID NO: 2171598 - DNA, 21 bp, Homo sapiens
tggaacattctgtcatcaccc

SEQ ID NO: 2171599 - DNA, 12 bp, Homo sapiens
tggaacctcctt

SEQ ID NO: 2171600 - DNA, 13 bp, Homo sapiens
tggaacctccttt

SEQ ID NO: 2171601 - DNA, 19 bp, Homo sapiens
tggaagcctgctgatttct

SEQ ID NO: 2171602 - DNA, 12 bp, Homo sapiens
tggaagctagct

SEQ ID NO: 2171603 - DNA, 15 bp, Homo sapiens
tggaaggagcctgcg

SEQ ID NO: 2171604 - DNA, 21 bp, Homo sapiens
tggaaggagcctgcggctgct

SEQ ID NO: 2171605 - DNA, 18 bp, Homo sapiens
tggaagggccttctccac

SEQ ID NO: 2171606 - DNA, 23 bp, Homo sapiens
tggaattttgcaaagatttaatc

SEQ ID NO: 2171607 - DNA, 16 bp, Homo sapiens
tggacacacacagact

SEQ ID NO: 2171608 - DNA, 22 bp, Homo sapiens
tggacatttcatataaatggaa

SEQ ID NO: 2171609 - DNA, 23 bp, Homo sapiens
tggacatttcatataaatggaat

SEQ ID NO: 2171610 - DNA, 13 bp, Homo sapiens
tggaccagatgct

SEQ ID NO: 2171611 - DNA, 14 bp, Homo sapiens
tggaccagatgctg

SEQ ID NO: 2171612 - DNA, 14 bp, Homo sapiens
tggacgtgtgagga

SEQ ID NO: 2171613 - DNA, 12 bp, Homo sapiens
tggactgtgtcc

SEQ ID NO: 2171614 - DNA, 16 bp, Homo sapiens
tggagaaagagctgcc

SEQ ID NO: 2171615 - DNA, 18 bp, Homo sapiens
tggagaactcatttcaag

SEQ ID NO: 2171616 - DNA, 20 bp, Homo sapiens
tggagacaatgcagatgcca

SEQ ID NO: 2171617 - DNA, 20 bp, Homo sapiens
tggagagaccagcctttctt

SEQ ID NO: 2171618 - DNA, 22 bp, Homo sapiens
tggagagaccagcctttcttcc

SEQ ID NO: 2171619 - DNA, 22 bp, Homo sapiens
tggagaggagagaatgagagag

SEQ ID NO: 2171620 - DNA, 12 bp, Homo sapiens
tggagccctcag

SEQ ID NO: 2171621 - DNA, 14 bp, Homo sapiens
tggagctagagagg

SEQ ID NO: 2171622 - DNA, 22 bp, Homo sapiens
tggagctagagaggggcctctg

SEQ ID NO: 2171623 - DNA, 13 bp, Homo sapiens
tggagctcctggg

SEQ ID NO: 2171624 - DNA, 14 bp, Homo sapiens
tggagctcctggga

SEQ ID NO: 2171625 - DNA, 23 bp, Homo sapiens
tggaggaagctgttttgagccag

SEQ ID NO: 2171626 - DNA, 13 bp, Homo sapiens
tggaggagagaga

SEQ ID NO: 2171627 - DNA, 21 bp, Homo sapiens
tggaggcccttttctggctcc

SEQ ID NO: 2171628 - DNA, 22 bp, Homo sapiens
tggaggcccttttctggctcct

SEQ ID NO: 2171629 - DNA, 12 bp, Homo sapiens
tggaggcctcac

SEQ ID NO: 2171630 - DNA, 19 bp, Homo sapiens
tggaggcctcaccctgctt

SEQ ID NO: 2171631 - DNA, 12 bp, Homo sapiens
tggaggtgatga

SEQ ID NO: 2171632 - DNA, 20 bp, Homo sapiens
tggagtagacccctggctgg

SEQ ID NO: 2171633 - DNA, 18 bp, Homo sapiens
tggagtgatctcagctca

SEQ ID NO: 2171634 - DNA, 15 bp, Homo sapiens
tggagtggaggcatt

SEQ ID NO: 2171635 - DNA, 19 bp, Homo sapiens
tggagtggaggcattgttt

SEQ ID NO: 2171636 - DNA, 14 bp, Homo sapiens
tggagtgtgtgggg

SEQ ID NO: 2171637 - DNA, 20 bp, Homo sapiens
tggagtgtgtgggggtctgg

SEQ ID NO: 2171638 - DNA, 15 bp, Homo sapiens
tggatagctcagagg

SEQ ID NO: 2171639 - DNA, 23 bp, Homo sapiens
tggatcaaaatctgtagagcagg

SEQ ID NO: 2171640 - DNA, 15 bp, Homo sapiens
tggatccagaagcta

SEQ ID NO: 2171641 - DNA, 17 bp, Homo sapiens
tggatcccaattcattt

SEQ ID NO: 2171642 - DNA, 14 bp, Homo sapiens
tggatgaaaaaagc

SEQ ID NO: 2171643 - DNA, 15 bp, Homo sapiens
tggatggggcccagg

SEQ ID NO: 2171644 - DNA, 21 bp, Homo sapiens
tggatgggggaaatggtgcct

SEQ ID NO: 2171645 - DNA, 13 bp, Homo sapiens
tggcacccactcc

SEQ ID NO: 2171646 - DNA, 18 bp, Homo sapiens
tggcacccccacaagctg

SEQ ID NO: 2171647 - DNA, 20 bp, Homo sapiens
tggcagaaatcccagttcat

SEQ ID NO: 2171648 - DNA, 20 bp, Homo sapiens
tggcagcaacggcacagcta

SEQ ID NO: 2171649 - DNA, 13 bp, Homo sapiens
tggcaggggagca

SEQ ID NO: 2171650 - DNA, 18 bp, Homo sapiens
tggcagtccgtgggacgg

SEQ ID NO: 2171651 - DNA, 17 bp, Homo sapiens
tggcatctgaaaacaat

SEQ ID NO: 2171652 - DNA, 17 bp, Homo sapiens
tggcatctttggaggaa

SEQ ID NO: 2171653 - DNA, 13 bp, Homo sapiens
tggcattactctg

SEQ ID NO: 2171654 - DNA, 18 bp, Homo sapiens
tggcattactctgcacta

SEQ ID NO: 2171655 - DNA, 16 bp, Homo sapiens
tggccaagaagcagtg

SEQ ID NO: 2171656 - DNA, 22 bp, Homo sapiens
tggccaagaagcagtggcctta

SEQ ID NO: 2171657 - DNA, 16 bp, Homo sapiens
tggccagaccagagct

SEQ ID NO: 2171658 - DNA, 17 bp, Homo sapiens
tggccagaccagagctc

SEQ ID NO: 2171659 - DNA, 11 bp, Homo sapiens
tggccaggctg

SEQ ID NO: 2171660 - DNA, 13 bp, Homo sapiens
tggcccacacaga

SEQ ID NO: 2171661 - DNA, 18 bp, Homo sapiens
tggccgcttccctaccca

SEQ ID NO: 2171662 - DNA, 14 bp, Homo sapiens
tggccgggcacagc

SEQ ID NO: 2171663 - DNA, 16 bp, Homo sapiens
tggcctaaagccagca

SEQ ID NO: 2171664 - DNA, 23 bp, Homo sapiens
tggcctcacctgggttccccacc

SEQ ID NO: 2171665 - DNA, 17 bp, Homo sapiens
tggcctcgtgaggggca

SEQ ID NO: 2171666 - DNA, 18 bp, Homo sapiens
tggcctcgtgaggggcaa

SEQ ID NO: 2171667 - DNA, 19 bp, Homo sapiens
tggcctcgtgaggggcaag

SEQ ID NO: 2171668 - DNA, 21 bp, Homo sapiens
tggcctcttcctccctccctg

SEQ ID NO: 2171669 - DNA, 14 bp, Homo sapiens
tggcctgcaggggc

SEQ ID NO: 2171670 - DNA, 12 bp, Homo sapiens
tggcctggctcc

SEQ ID NO: 2171671 - DNA, 18 bp, Homo sapiens
tggcctggctccgctgtg

SEQ ID NO: 2171672 - DNA, 18 bp, Homo sapiens
tggccttatggatttgga

SEQ ID NO: 2171673 - DNA, 14 bp, Homo sapiens
tggcggaacctggc

SEQ ID NO: 2171674 - DNA, 18 bp, Homo sapiens
tggcggaacctggctgcg

SEQ ID NO: 2171675 - DNA, 20 bp, Homo sapiens
tggcgtggggggagctctgg

SEQ ID NO: 2171676 - DNA, 17 bp, Homo sapiens
tggcgttgtgggcaggc

SEQ ID NO: 2171677 - DNA, 17 bp, Homo sapiens
tggctaaggcaccagcc

SEQ ID NO: 2171678 - DNA, 14 bp, Homo sapiens
tggctcacagactg

SEQ ID NO: 2171679 - DNA, 13 bp, Homo sapiens
tggctcctgtgtg

SEQ ID NO: 2171680 - DNA, 15 bp, Homo sapiens
tggctcgggacttca

SEQ ID NO: 2171681 - DNA, 14 bp, Homo sapiens
tggctcgtgggctc

SEQ ID NO: 2171682 - DNA, 18 bp, Homo sapiens
tggctcgtgggctctggc

SEQ ID NO: 2171683 - DNA, 17 bp, Homo sapiens
tggctcgttctcttctc

SEQ ID NO: 2171684 - DNA, 22 bp, Homo sapiens
tggctgcactcaagaccctcga

SEQ ID NO: 2171685 - DNA, 15 bp, Homo sapiens
tggctgcctggccca

SEQ ID NO: 2171686 - DNA, 20 bp, Homo sapiens
tggctggggacttggccgct

SEQ ID NO: 2171687 - DNA, 22 bp, Homo sapiens
tggctggtaagggccaagtccc

SEQ ID NO: 2171688 - DNA, 12 bp, Homo sapiens
tggctgtgaaaa

SEQ ID NO: 2171689 - DNA, 14 bp, Homo sapiens
tggctgtttgagat

SEQ ID NO: 2171690 - DNA, 14 bp, Homo sapiens
tggcttcctaaatg

SEQ ID NO: 2171691 - DNA, 19 bp, Homo sapiens
tggcttctgcttgtcatcc

SEQ ID NO: 2171692 - DNA, 19 bp, Homo sapiens
tggctttcctctcgttggt

SEQ ID NO: 2171693 - DNA, 17 bp, Homo sapiens
tggctttgcccaacctc

SEQ ID NO: 2171694 - DNA, 22 bp, Homo sapiens
tggctttgtcccacagcttggg

SEQ ID NO: 2171695 - DNA, 19 bp, Homo sapiens
tgggaagcccatcctgacc

SEQ ID NO: 2171696 - DNA, 16 bp, Homo sapiens
tgggaaggccggcagc

SEQ ID NO: 2171697 - DNA, 18 bp, Homo sapiens
ttccttcaaatcctgcca

SEQ ID NO: 2171698 - DNA, 13 bp, Homo sapiens
ttccttgctaatg

SEQ ID NO: 2171699 - DNA, 14 bp, Homo sapiens
ttccttgtctctca

SEQ ID NO: 2171700 - DNA, 17 bp, Homo sapiens
ttcgaaggatatggact

SEQ ID NO: 2171701 - DNA, 20 bp, Homo sapiens
ttcgttggtgaccagtttct

SEQ ID NO: 2171702 - DNA, 22 bp, Homo sapiens
ttcgttggtgaccagtttctta

SEQ ID NO: 2171703 - DNA, 17 bp, Homo sapiens
ttctagattcactgtct

SEQ ID NO: 2171704 - DNA, 22 bp, Homo sapiens
ttctcaaaccctgtttacggta

SEQ ID NO: 2171705 - DNA, 18 bp, Homo sapiens
ttctcaaaggagcgagca

SEQ ID NO: 2171706 - DNA, 23 bp, Homo sapiens
ttctcaaagtttttacagtgtat

SEQ ID NO: 2171707 - DNA, 16 bp, Homo sapiens
ttctcatcactcccct

SEQ ID NO: 2171708 - DNA, 14 bp, Homo sapiens
ttctcatgtttgtg

SEQ ID NO: 2171709 - DNA, 16 bp, Homo sapiens
ttctcccctccaagtg

SEQ ID NO: 2171710 - DNA, 22 bp, Homo sapiens
ttctccttccaactgctgcccc

SEQ ID NO: 2171711 - DNA, 18 bp, Homo sapiens
ttctccttcgctttcctg

SEQ ID NO: 2171712 - DNA, 18 bp, Homo sapiens
ttctctccccttgcactg

SEQ ID NO: 2171713 - DNA, 19 bp, Homo sapiens
ttctctcttcaatctctgg

SEQ ID NO: 2171714 - DNA, 16 bp, Homo sapiens
ttctctgtccagggct

SEQ ID NO: 2171715 - DNA, 15 bp, Homo sapiens
ttctctgtgctctga

SEQ ID NO: 2171716 - DNA, 14 bp, Homo sapiens
ttctcttctctgtt

SEQ ID NO: 2171717 - DNA, 13 bp, Homo sapiens
ttctgaagtttta

SEQ ID NO: 2171718 - DNA, 23 bp, Homo sapiens
ttctgaagttttattttaaatta

SEQ ID NO: 2171719 - DNA, 18 bp, Homo sapiens
ttctgcttttaagttttt

SEQ ID NO: 2171720 - DNA, 12 bp, Homo sapiens
ttctggctcctg

SEQ ID NO: 2171721 - DNA, 21 bp, Homo sapiens
ttctggtcacattccatttct

SEQ ID NO: 2171722 - DNA, 16 bp, Homo sapiens
ttctggttagctcagc

SEQ ID NO: 2171723 - DNA, 16 bp, Homo sapiens
ttctgtagctattctt

SEQ ID NO: 2171724 - DNA, 17 bp, Homo sapiens
ttctgtcccttggagct

SEQ ID NO: 2171725 - DNA, 13 bp, Homo sapiens
ttctgtctctctt

SEQ ID NO: 2171726 - DNA, 13 bp, Homo sapiens
ttctgtgcccagc

SEQ ID NO: 2171727 - DNA, 14 bp, Homo sapiens
ttctgttgtttctt

SEQ ID NO: 2171728 - DNA, 14 bp, Homo sapiens
ttctgtttgaaaaa

SEQ ID NO: 2171729 - DNA, 19 bp, Homo sapiens
ttcttaaactgaaagcttt

SEQ ID NO: 2171730 - DNA, 17 bp, Homo sapiens
ttcttaagtataaacct

SEQ ID NO: 2171731 - DNA, 14 bp, Homo sapiens
ttcttcaatacaaa

SEQ ID NO: 2171732 - DNA, 23 bp, Homo sapiens
ttcttctaaagaggaagccttgc

SEQ ID NO: 2171733 - DNA, 19 bp, Homo sapiens
ttcttgattttcaagcttt

SEQ ID NO: 2171734 - DNA, 22 bp, Homo sapiens
ttcttgggcctcaggctctgca

SEQ ID NO: 2171735 - DNA, 23 bp, Homo sapiens
ttcttgggcctcaggctctgcac

SEQ ID NO: 2171736 - DNA, 13 bp, Homo sapiens
ttctttaattgtt

SEQ ID NO: 2171737 - DNA, 22 bp, Homo sapiens
ttctttagaaaacccaagtttt

SEQ ID NO: 2171738 - DNA, 16 bp, Homo sapiens
ttctttttctgtctct

SEQ ID NO: 2171739 - DNA, 17 bp, Homo sapiens
ttctttttctgtctctc

SEQ ID NO: 2171740 - DNA, 17 bp, Homo sapiens
ttgaaaagattgcaaag

SEQ ID NO: 2171741 - DNA, 18 bp, Homo sapiens
ttgaaacttgagtttgtt

SEQ ID NO: 2171742 - DNA, 19 bp, Homo sapiens
ttgaaacttggttcccaga

SEQ ID NO: 2171743 - DNA, 11 bp, Homo sapiens
ttgaaatgtaa

SEQ ID NO: 2171744 - DNA, 14 bp, Homo sapiens
ttgaaatgtaattt

SEQ ID NO: 2171745 - DNA, 14 bp, Homo sapiens
ttgaactcctgacc

SEQ ID NO: 2171746 - DNA, 22 bp, Homo sapiens
ttgaagaaggaggaattttaga

SEQ ID NO: 2171747 - DNA, 16 bp, Homo sapiens
ttgaaggtcacagaag

SEQ ID NO: 2171748 - DNA, 21 bp, Homo sapiens
ttgaataaagtattctagtgt

SEQ ID NO: 2171749 - DNA, 20 bp, Homo sapiens
ttgaatcaggaggagattaa

SEQ ID NO: 2171750 - DNA, 17 bp, Homo sapiens
ttgacatccaggatggc

SEQ ID NO: 2171751 - DNA, 19 bp, Homo sapiens
ttgaccaaactgtgggtat

SEQ ID NO: 2171752 - DNA, 14 bp, Homo sapiens
ttgaccataaatta

SEQ ID NO: 2171753 - DNA, 14 bp, Homo sapiens
ttgaccccttcctg

SEQ ID NO: 2171754 - DNA, 16 bp, Homo sapiens
ttgaccccttcctgtc

SEQ ID NO: 2171755 - DNA, 14 bp, Homo sapiens
ttgaccttaatttc

SEQ ID NO: 2171756 - DNA, 20 bp, Homo sapiens
ttgactgtgatttatttgga

SEQ ID NO: 2171757 - DNA, 18 bp, Homo sapiens
ttgagagcgctggcctct

SEQ ID NO: 2171758 - DNA, 21 bp, Homo sapiens
ttgagagcgctggcctcttcc

SEQ ID NO: 2171759 - DNA, 15 bp, Homo sapiens
ttgagccttttatta

SEQ ID NO: 2171760 - DNA, 20 bp, Homo sapiens
ttgaggggcttccctctgct

SEQ ID NO: 2171761 - DNA, 21 bp, Homo sapiens
ttgaggtagaggggaaggaaa

SEQ ID NO: 2171762 - DNA, 14 bp, Homo sapiens
ttgagtttcttcta

SEQ ID NO: 2171763 - DNA, 18 bp, Homo sapiens
ttgataggagacttgtac

SEQ ID NO: 2171764 - DNA, 14 bp, Homo sapiens
ttgatatattcttt

SEQ ID NO: 2171765 - DNA, 16 bp, Homo sapiens
ttgatatattctttcc

SEQ ID NO: 2171766 - DNA, 17 bp, Homo sapiens
ttgatatattctttcca

SEQ ID NO: 2171767 - DNA, 23 bp, Homo sapiens
ttgatatattctttccatgcagt

SEQ ID NO: 2171768 - DNA, 13 bp, Homo sapiens
ttgatcagaatcc

SEQ ID NO: 2171769 - DNA, 15 bp, Homo sapiens
ttgatgactgctgat

SEQ ID NO: 2171770 - DNA, 20 bp, Homo sapiens
ttgatgattgccaacagtgg

SEQ ID NO: 2171771 - DNA, 22 bp, Homo sapiens
ttgatgattgccaacagtggct

SEQ ID NO: 2171772 - DNA, 18 bp, Homo sapiens
ttgatgtgtatgtgttta

SEQ ID NO: 2171773 - DNA, 14 bp, Homo sapiens
ttgattccatctcc

SEQ ID NO: 2171774 - DNA, 17 bp, Homo sapiens
ttgcaaaaatattttat

SEQ ID NO: 2171775 - DNA, 18 bp, Homo sapiens
ttgcaaccaggaacagca

SEQ ID NO: 2171776 - DNA, 21 bp, Homo sapiens
ttgcaaggtcactttgcgtgt

SEQ ID NO: 2171777 - DNA, 17 bp, Homo sapiens
ttgcagcttccttccaa

SEQ ID NO: 2171778 - DNA, 18 bp, Homo sapiens
ttgcagttcatactgaat

SEQ ID NO: 2171779 - DNA, 20 bp, Homo sapiens
ttgcagttcatactgaatga

SEQ ID NO: 2171780 - DNA, 14 bp, Homo sapiens
ttgccaaaatatat

SEQ ID NO: 2171781 - DNA, 16 bp, Homo sapiens
ttgccaaccctgtgtc

SEQ ID NO: 2171782 - DNA, 21 bp, Homo sapiens
ttgccagattaaatgaatata

SEQ ID NO: 2171783 - DNA, 18 bp, Homo sapiens
ttgccattataattttga

SEQ ID NO: 2171784 - DNA, 17 bp, Homo sapiens
ttgccatttcttcccaa

SEQ ID NO: 2171785 - DNA, 18 bp, Homo sapiens
ttgccatttcttcccaag

SEQ ID NO: 2171786 - DNA, 19 bp, Homo sapiens
ttgcccaacctcagcaacc

SEQ ID NO: 2171787 - DNA, 18 bp, Homo sapiens
ttgcccagggtcctgtgc

SEQ ID NO: 2171788 - DNA, 15 bp, Homo sapiens
ttgccctcccatccc

SEQ ID NO: 2171789 - DNA, 16 bp, Homo sapiens
ttgccgctgggagagc

SEQ ID NO: 2171790 - DNA, 23 bp, Homo sapiens
ttgcctgggggcttttgccactc

SEQ ID NO: 2171791 - DNA, 13 bp, Homo sapiens
ttgcgatgtgttt

SEQ ID NO: 2171792 - DNA, 14 bp, Homo sapiens
ttgcgatgtgtttt

SEQ ID NO: 2171793 - DNA, 15 bp, Homo sapiens
ttgcgatgtgtttta

SEQ ID NO: 2171794 - DNA, 12 bp, Homo sapiens
ttgctccacccc

SEQ ID NO: 2171795 - DNA, 20 bp, Homo sapiens
ttgctccaccccactcacag

SEQ ID NO: 2171796 - DNA, 14 bp, Homo sapiens
ttgctctggaagcc

SEQ ID NO: 2171797 - DNA, 19 bp, Homo sapiens
ttgctctggaagcctgctg

SEQ ID NO: 2171798 - DNA, 21 bp, Homo sapiens
ttgctgttgttgttaattttg

SEQ ID NO: 2171799 - DNA, 14 bp, Homo sapiens
ttgcttaaacaaaa

SEQ ID NO: 2171800 - DNA, 15 bp, Homo sapiens
ttgcttctgggaagg

SEQ ID NO: 2171801 - DNA, 12 bp, Homo sapiens
ttgctttgcttt

SEQ ID NO: 2171802 - DNA, 12 bp, Homo sapiens
ttgctttgtagg

SEQ ID NO: 2171803 - DNA, 23 bp, Homo sapiens
ttggaagctagctcccctcctct

SEQ ID NO: 2171804 - DNA, 16 bp, Homo sapiens
ttggacacacacagct

SEQ ID NO: 2171805 - DNA, 15 bp, Homo sapiens
ttggacgcacacagc

SEQ ID NO: 2171806 - DNA, 15 bp, Homo sapiens
ttggaggcctcaccc

SEQ ID NO: 2171807 - DNA, 17 bp, Homo sapiens
ttggatctatcacctgt

SEQ ID NO: 2171808 - DNA, 19 bp, Homo sapiens
ttggatctatcacctgtca

SEQ ID NO: 2171809 - DNA, 16 bp, Homo sapiens
ttggccgatgagctgg

SEQ ID NO: 2171810 - DNA, 14 bp, Homo sapiens
ttggcctctgtctc

SEQ ID NO: 2171811 - DNA, 18 bp, Homo sapiens
ttggctcgggacttcaaa

SEQ ID NO: 2171812 - DNA, 11 bp, Homo sapiens
ttggctgggta

SEQ ID NO: 2171813 - DNA, 15 bp, Homo sapiens
ttggctgtaatttaa

SEQ ID NO: 2171814 - DNA, 13 bp, Homo sapiens
ttggcttttttcc

SEQ ID NO: 2171815 - DNA, 12 bp, Homo sapiens
ttgggcctcagg

SEQ ID NO: 2171816 - DNA, 19 bp, Homo sapiens
ttgggcctcaggctctgca

SEQ ID NO: 2171817 - DNA, 11 bp, Homo sapiens
ttggggtgggg

SEQ ID NO: 2171818 - DNA, 21 bp, Homo sapiens
ttggggtggggcgggaggcca

SEQ ID NO: 2171819 - DNA, 20 bp, Homo sapiens
ttgggtcccagctaaagagg

SEQ ID NO: 2171820 - DNA, 14 bp, Homo sapiens
aaaaataatgaatg

SEQ ID NO: 2171821 - DNA, 20 bp, Homo sapiens
aaaaatgagcttccattaat

SEQ ID NO: 2171822 - DNA, 13 bp, Homo sapiens
aaaaatgcagaat

SEQ ID NO: 2171823 - DNA, 23 bp, Homo sapiens
aaaacaaaaattcacaagctgcc

SEQ ID NO: 2171824 - DNA, 17 bp, Homo sapiens
aaaacaaaaccaagcct

SEQ ID NO: 2171825 - DNA, 16 bp, Homo sapiens
aaaacaaagtgcaaag

SEQ ID NO: 2171826 - DNA, 14 bp, Homo sapiens
aaaacaaatcttca

SEQ ID NO: 2171827 - DNA, 17 bp, Homo sapiens
aaaacacctaagtgact

SEQ ID NO: 2171828 - DNA, 14 bp, Homo sapiens
aaaacatgtcatgt

SEQ ID NO: 2171829 - DNA, 13 bp, Homo sapiens
aaaactaatgtga

SEQ ID NO: 2171830 - DNA, 12 bp, Homo sapiens
aaaactgtaact

SEQ ID NO: 2171831 - DNA, 22 bp, Homo sapiens
aaaacttcattctaaaccaaaa

SEQ ID NO: 2171832 - DNA, 22 bp, Homo sapiens
aaaacttcgtaagaacatgtta

SEQ ID NO: 2171833 - DNA, 23 bp, Homo sapiens
aaaactttttgaccagtttcttt

SEQ ID NO: 2171834 - DNA, 13 bp, Homo sapiens
aaaagaaaggcta

SEQ ID NO: 2171835 - DNA, 15 bp, Homo sapiens
aaaagactgaccttg

SEQ ID NO: 2171836 - DNA, 16 bp, Homo sapiens
aaaagagaagctgtgt

SEQ ID NO: 2171837 - DNA, 22 bp, Homo sapiens
aaaagagagaagagtccaggaa

SEQ ID NO: 2171838 - DNA, 15 bp, Homo sapiens
aaaagattgcaaagg

SEQ ID NO: 2171839 - DNA, 17 bp, Homo sapiens
aaaagattgcaaaggga

SEQ ID NO: 2171840 - DNA, 21 bp, Homo sapiens
aaaagatttttaaaatgaatc

SEQ ID NO: 2171841 - DNA, 21 bp, Homo sapiens
aaaagctataaagcagtattt

SEQ ID NO: 2171842 - DNA, 16 bp, Homo sapiens
aaaataaaatgcattt

SEQ ID NO: 2171843 - DNA, 12 bp, Homo sapiens
aaaataatttat

SEQ ID NO: 2171844 - DNA, 15 bp, Homo sapiens
aaaataatttatcaa

SEQ ID NO: 2171845 - DNA, 14 bp, Homo sapiens
aaaatacatactat

SEQ ID NO: 2171846 - DNA, 13 bp, Homo sapiens
aaaatatcacttt

SEQ ID NO: 2171847 - DNA, 20 bp, Homo sapiens
aaaatatcactttgtattct

SEQ ID NO: 2171848 - DNA, 18 bp, Homo sapiens
aaaatctgtagagcaggg

SEQ ID NO: 2171849 - DNA, 19 bp, Homo sapiens
aaaatgagcttccattaat

SEQ ID NO: 2171850 - DNA, 13 bp, Homo sapiens
aaaatgttaataa

SEQ ID NO: 2171851 - DNA, 16 bp, Homo sapiens
aaaattaattctttat

SEQ ID NO: 2171852 - DNA, 18 bp, Homo sapiens
aaaattcattccatttgc

SEQ ID NO: 2171853 - DNA, 14 bp, Homo sapiens
aaacaaaaccaagc

SEQ ID NO: 2171854 - DNA, 15 bp, Homo sapiens
aaacaaccatgtcat

SEQ ID NO: 2171855 - DNA, 13 bp, Homo sapiens
aaacagctcagcc

SEQ ID NO: 2171856 - DNA, 14 bp, Homo sapiens
aaacagctcaggct

SEQ ID NO: 2171857 - DNA, 18 bp, Homo sapiens
aaacagtgagaaaagaaa

SEQ ID NO: 2171858 - DNA, 19 bp, Homo sapiens
aaacagtgtttggtgacat

SEQ ID NO: 2171859 - DNA, 14 bp, Homo sapiens
aaacagttgaataa

SEQ ID NO: 2171860 - DNA, 12 bp, Homo sapiens
aaacatgcttaa

SEQ ID NO: 2171861 - DNA, 13 bp, Homo sapiens
aaaccactgtaca

SEQ ID NO: 2171862 - DNA, 15 bp, Homo sapiens
aaaccactgtacata

SEQ ID NO: 2171863 - DNA, 17 bp, Homo sapiens
aaacccagcatgtacaa

SEQ ID NO: 2171864 - DNA, 18 bp, Homo sapiens
aaacccagcatgtacaaa

SEQ ID NO: 2171865 - DNA, 12 bp, Homo sapiens
aaacccatcttc

SEQ ID NO: 2171866 - DNA, 12 bp, Homo sapiens
aaaccctgttta

SEQ ID NO: 2171867 - DNA, 16 bp, Homo sapiens
aaacctaggatggata

SEQ ID NO: 2171868 - DNA, 23 bp, Homo sapiens
aaacctagggttttctatttctt

SEQ ID NO: 2171869 - DNA, 17 bp, Homo sapiens
aaacctctccttcctca

SEQ ID NO: 2171870 - DNA, 11 bp, Homo sapiens
aaacctggagg

SEQ ID NO: 2171871 - DNA, 15 bp, Homo sapiens
aaacctttccatttt

SEQ ID NO: 2171872 - DNA, 16 bp, Homo sapiens
aaactaaactacagaa

SEQ ID NO: 2171873 - DNA, 12 bp, Homo sapiens
aaactaatgtga

SEQ ID NO: 2171874 - DNA, 17 bp, Homo sapiens
aaactactatttttctt

SEQ ID NO: 2171875 - DNA, 18 bp, Homo sapiens
aaactatgcacctataaa

SEQ ID NO: 2171876 - DNA, 19 bp, Homo sapiens
aaactgtgtcacgcaggct

SEQ ID NO: 2171877 - DNA, 16 bp, Homo sapiens
aaacttaaatgttatt

SEQ ID NO: 2171878 - DNA, 17 bp, Homo sapiens
aaacttaaatgttatta

SEQ ID NO: 2171879 - DNA, 22 bp, Homo sapiens
aaacttatctgagtcacttgaa

SEQ ID NO: 2171880 - DNA, 17 bp, Homo sapiens
aaacttcgtaagaacat

SEQ ID NO: 2171881 - DNA, 11 bp, Homo sapiens
aaacttgaaag

SEQ ID NO: 2171882 - DNA, 16 bp, Homo sapiens
aaacttgagtttgttt

SEQ ID NO: 2171883 - DNA, 17 bp, Homo sapiens
aaacttggttcccagaa

SEQ ID NO: 2171884 - DNA, 21 bp, Homo sapiens
aaactttggagaactcatttc

SEQ ID NO: 2171885 - DNA, 14 bp, Homo sapiens
aaagaaaattgcca

SEQ ID NO: 2171886 - DNA, 23 bp, Homo sapiens
aaagaaaattgccaaaatatatt

SEQ ID NO: 2171887 - DNA, 16 bp, Homo sapiens
aaagaaagctgtgaaa

SEQ ID NO: 2171888 - DNA, 17 bp, Homo sapiens
aaagaagcctagaaaag

SEQ ID NO: 2171889 - DNA, 23 bp, Homo sapiens
aaagaagcctagaaaagaagcag

SEQ ID NO: 2171890 - DNA, 18 bp, Homo sapiens
aaagaagggggccctgct

SEQ ID NO: 2171891 - DNA, 19 bp, Homo sapiens
aaagaagggggccctgcta

SEQ ID NO: 2171892 - DNA, 23 bp, Homo sapiens
aaagaagggggccctgctacctg

SEQ ID NO: 2171893 - DNA, 18 bp, Homo sapiens
aaagacattatttctcat

SEQ ID NO: 2171894 - DNA, 19 bp, Homo sapiens
aaagacattatttctcata

SEQ ID NO: 2171895 - DNA, 15 bp, Homo sapiens
aaagacatttaaaga

SEQ ID NO: 2171896 - DNA, 19 bp, Homo sapiens
aaagagagaagccagccac

SEQ ID NO: 2171897 - DNA, 13 bp, Homo sapiens
aaagagctgccta

SEQ ID NO: 2171898 - DNA, 22 bp, Homo sapiens
aaagaggaagccttgcccagca

SEQ ID NO: 2171899 - DNA, 15 bp, Homo sapiens
aaagatctcaacatg

SEQ ID NO: 2171900 - DNA, 22 bp, Homo sapiens
aaagcaagaccttgattgcacc

SEQ ID NO: 2171901 - DNA, 21 bp, Homo sapiens
aaagcagaggctggcctcaga

SEQ ID NO: 2171902 - DNA, 16 bp, Homo sapiens
aaagcagtatttttct

SEQ ID NO: 2171903 - DNA, 16 bp, Homo sapiens
aaagcattattttttg

SEQ ID NO: 2171904 - DNA, 23 bp, Homo sapiens
aaagctaccttttttttacggaa

SEQ ID NO: 2171905 - DNA, 18 bp, Homo sapiens
aaagctatgaatgttact

SEQ ID NO: 2171906 - DNA, 15 bp, Homo sapiens
aaagctgaagccgcc

SEQ ID NO: 2171907 - DNA, 20 bp, Homo sapiens
aaagctgtttttatagcaca

SEQ ID NO: 2171908 - DNA, 13 bp, Homo sapiens
aaaggaagctttc

SEQ ID NO: 2171909 - DNA, 13 bp, Homo sapiens
aaaggactgacct

SEQ ID NO: 2171910 - DNA, 16 bp, Homo sapiens
aaaggactgacctgcc

SEQ ID NO: 2171911 - DNA, 23 bp, Homo sapiens
aaaggatttgaaacttggtgtgt

SEQ ID NO: 2171912 - DNA, 13 bp, Homo sapiens
aaagggacactgg

SEQ ID NO: 2171913 - DNA, 23 bp, Homo sapiens
aaagggacactggatccagaagc

SEQ ID NO: 2171914 - DNA, 18 bp, Homo sapiens
aaaggtcccaaggcaagg

SEQ ID NO: 2171915 - DNA, 16 bp, Homo sapiens
aaaggtttacagtgaa

SEQ ID NO: 2171916 - DNA, 13 bp, Homo sapiens
aaagtaaattgaa

SEQ ID NO: 2171917 - DNA, 13 bp, Homo sapiens
aaagtatattcaa

SEQ ID NO: 2171918 - DNA, 23 bp, Homo sapiens
aaagtatattcaaaaattatatt

SEQ ID NO: 2171919 - DNA, 21 bp, Homo sapiens
aaagtatggcagtgggagact

SEQ ID NO: 2171920 - DNA, 17 bp, Homo sapiens
aaagtatgtattattta

SEQ ID NO: 2171921 - DNA, 19 bp, Homo sapiens
aaagtatgtattatttaca

SEQ ID NO: 2171922 - DNA, 15 bp, Homo sapiens
aaagtccattgatgt

SEQ ID NO: 2171923 - DNA, 14 bp, Homo sapiens
aaagtgcaaagctg

SEQ ID NO: 2171924 - DNA, 17 bp, Homo sapiens
aaagtggtacaggaagg

SEQ ID NO: 2171925 - DNA, 20 bp, Homo sapiens
aaagttaacctacctgtaac

SEQ ID NO: 2171926 - DNA, 15 bp, Homo sapiens
aaataaaatgcattt

SEQ ID NO: 2171927 - DNA, 13 bp, Homo sapiens
aaataaatgtgca

SEQ ID NO: 2171928 - DNA, 14 bp, Homo sapiens
aaataaattgcaga

SEQ ID NO: 2171929 - DNA, 17 bp, Homo sapiens
aaataactgatgaagga

SEQ ID NO: 2171930 - DNA, 21 bp, Homo sapiens
aaataattatataactgtatt

SEQ ID NO: 2171931 - DNA, 22 bp, Homo sapiens
aaataattatataactgtattt

SEQ ID NO: 2171932 - DNA, 22 bp, Homo sapiens
aaatacagttattaaaatgtta

SEQ ID NO: 2171933 - DNA, 18 bp, Homo sapiens
aaatacattaacaagctc

SEQ ID NO: 2171934 - DNA, 13 bp, Homo sapiens
aaatactacacat

SEQ ID NO: 2171935 - DNA, 13 bp, Homo sapiens
aaatactgtacat

SEQ ID NO: 2171936 - DNA, 15 bp, Homo sapiens
aaatactgtacatag

SEQ ID NO: 2171937 - DNA, 18 bp, Homo sapiens
aaataggttttccctgtt

SEQ ID NO: 2171938 - DNA, 21 bp, Homo sapiens
aaatataggggttaaggaaaa

SEQ ID NO: 2171939 - DNA, 21 bp, Homo sapiens
aaatatagtttgattcttcat

SEQ ID NO: 2171940 - DNA, 15 bp, Homo sapiens
aaatatcactttgta

SEQ ID NO: 2171941 - DNA, 19 bp, Homo sapiens
aaatatctacctgccctct

SEQ ID NO: 2171942 - DNA, 13 bp, Homo sapiens
aaatatgaaattt

SEQ ID NO: 2171943 - DNA, 20 bp, Homo sapiens
aattaaagaaaattgccaaa

SEQ ID NO: 2171944 - DNA, 19 bp, Homo sapiens
aattaagttgttgaaagta

SEQ ID NO: 2171945 - DNA, 14 bp, Homo sapiens
aattaattctttat

SEQ ID NO: 2171946 - DNA, 11 bp, Homo sapiens
aattacaagtt

SEQ ID NO: 2171947 - DNA, 12 bp, Homo sapiens
aattacaagttt

SEQ ID NO: 2171948 - DNA, 16 bp, Homo sapiens
aattagaaaatatagt

SEQ ID NO: 2171949 - DNA, 21 bp, Homo sapiens
aattagaacttgaatactttg

SEQ ID NO: 2171950 - DNA, 13 bp, Homo sapiens
aattagaagagcc

SEQ ID NO: 2171951 - DNA, 16 bp, Homo sapiens
aattagatgactgaat

SEQ ID NO: 2171952 - DNA, 21 bp, Homo sapiens
aattatataactgtatttgaa

SEQ ID NO: 2171953 - DNA, 19 bp, Homo sapiens
aattatcatcccaacagcc

SEQ ID NO: 2171954 - DNA, 21 bp, Homo sapiens
aattatgctgtgaattttaca

SEQ ID NO: 2171955 - DNA, 17 bp, Homo sapiens
aattattatcttcttaa

SEQ ID NO: 2171956 - DNA, 13 bp, Homo sapiens
aattcaatcaaag

SEQ ID NO: 2171957 - DNA, 14 bp, Homo sapiens
aattcaatcaaagc

SEQ ID NO: 2171958 - DNA, 18 bp, Homo sapiens
aattcacaagctgcctcc

SEQ ID NO: 2171959 - DNA, 22 bp, Homo sapiens
aattcagacatctgaggtttta

SEQ ID NO: 2171960 - DNA, 22 bp, Homo sapiens
aattcagtagttactgctgttt

SEQ ID NO: 2171961 - DNA, 13 bp, Homo sapiens
aattccaatacat

SEQ ID NO: 2171962 - DNA, 17 bp, Homo sapiens
aattccaatacattatt

SEQ ID NO: 2171963 - DNA, 22 bp, Homo sapiens
aattccaatatttataattaaa

SEQ ID NO: 2171964 - DNA, 17 bp, Homo sapiens
aattccccttcccttat

SEQ ID NO: 2171965 - DNA, 13 bp, Homo sapiens
aattccctggacc

SEQ ID NO: 2171966 - DNA, 20 bp, Homo sapiens
aattctcccgcattggtggc

SEQ ID NO: 2171967 - DNA, 14 bp, Homo sapiens
aattgaagaaaatc

SEQ ID NO: 2171968 - DNA, 19 bp, Homo sapiens
aattgagcgctatgggtgt

SEQ ID NO: 2171969 - DNA, 20 bp, Homo sapiens
aattgaggttgttcaaagtt

SEQ ID NO: 2171970 - DNA, 15 bp, Homo sapiens
aattgatgggtgggc

SEQ ID NO: 2171971 - DNA, 12 bp, Homo sapiens
aattgccaaaat

SEQ ID NO: 2171972 - DNA, 15 bp, Homo sapiens
aattgccaaaatata

SEQ ID NO: 2171973 - DNA, 21 bp, Homo sapiens
aattgtaaagtaaaagctata

SEQ ID NO: 2171974 - DNA, 16 bp, Homo sapiens
aattgtggtgtcttac

SEQ ID NO: 2171975 - DNA, 18 bp, Homo sapiens
aattgttacccatttgaa

SEQ ID NO: 2171976 - DNA, 13 bp, Homo sapiens
aatttatcaaaaa

SEQ ID NO: 2171977 - DNA, 14 bp, Homo sapiens
aatttattattaaa

SEQ ID NO: 2171978 - DNA, 17 bp, Homo sapiens
aatttattgtaccaaag

SEQ ID NO: 2171979 - DNA, 20 bp, Homo sapiens
aatttattgtaccaaagctg

SEQ ID NO: 2171980 - DNA, 15 bp, Homo sapiens
aatttcaaatctgta

SEQ ID NO: 2171981 - DNA, 12 bp, Homo sapiens
aatttctatggc

SEQ ID NO: 2171982 - DNA, 12 bp, Homo sapiens
aatttctcccca

SEQ ID NO: 2171983 - DNA, 19 bp, Homo sapiens
aatttctctcaatttgggt

SEQ ID NO: 2171984 - DNA, 15 bp, Homo sapiens
aatttgggtttttaa

SEQ ID NO: 2171985 - DNA, 12 bp, Homo sapiens
aatttgttaatt

SEQ ID NO: 2171986 - DNA, 15 bp, Homo sapiens
aatttgttgttaata

SEQ ID NO: 2171987 - DNA, 23 bp, Homo sapiens
acaaaaaaaagtgtattgcaagt

SEQ ID NO: 2171988 - DNA, 14 bp, Homo sapiens
acaaaaagaaagct

SEQ ID NO: 2171989 - DNA, 17 bp, Homo sapiens
acaaaaagaaagctgtg

SEQ ID NO: 2171990 - DNA, 16 bp, Homo sapiens
acaaaaagagaagctg

SEQ ID NO: 2171991 - DNA, 15 bp, Homo sapiens
acaaaaagcaaaaat

SEQ ID NO: 2171992 - DNA, 17 bp, Homo sapiens
acaaaaattcacaagct

SEQ ID NO: 2171993 - DNA, 23 bp, Homo sapiens
acaaaaatttattttcttttttg

SEQ ID NO: 2171994 - DNA, 14 bp, Homo sapiens
acaaaactgtaact

SEQ ID NO: 2171995 - DNA, 21 bp, Homo sapiens
acaaaaggagaagaggaacat

SEQ ID NO: 2171996 - DNA, 16 bp, Homo sapiens
acaaaagtgctttgga

SEQ ID NO: 2171997 - DNA, 22 bp, Homo sapiens
acaaacatttgaagacccttgt

SEQ ID NO: 2171998 - DNA, 14 bp, Homo sapiens
acaaaccactgtac

SEQ ID NO: 2171999 - DNA, 17 bp, Homo sapiens
acaaaccactgtacata

SEQ ID NO: 2172000 - DNA, 16 bp, Homo sapiens
acaaagctaaatacat

SEQ ID NO: 2172001 - DNA, 22 bp, Homo sapiens
acaaagctaaatacatggaaat

SEQ ID NO: 2172002 - DNA, 13 bp, Homo sapiens
acaaagtgcaaag

SEQ ID NO: 2172003 - DNA, 16 bp, Homo sapiens
acaaagtgcaaagctg

SEQ ID NO: 2172004 - DNA, 17 bp, Homo sapiens
acaaagtgcaaagctgc

SEQ ID NO: 2172005 - DNA, 23 bp, Homo sapiens
acaaagtgcaaagctgcttgaat

SEQ ID NO: 2172006 - DNA, 16 bp, Homo sapiens
acaaatcttcaaggtg

SEQ ID NO: 2172007 - DNA, 19 bp, Homo sapiens
acaaatgggactgatgtca

SEQ ID NO: 2172008 - DNA, 20 bp, Homo sapiens
acaaatgggactgatgtcat

SEQ ID NO: 2172009 - DNA, 22 bp, Homo sapiens
acaaatgggactgatgtcatct

SEQ ID NO: 2172010 - DNA, 11 bp, Homo sapiens
acaacaaaaaa

SEQ ID NO: 2172011 - DNA, 14 bp, Homo sapiens
acaacaggctgtgt

SEQ ID NO: 2172012 - DNA, 22 bp, Homo sapiens
acaacaggctgtgtgtggaaat

SEQ ID NO: 2172013 - DNA, 17 bp, Homo sapiens
acaactgatcatttgca

SEQ ID NO: 2172014 - DNA, 22 bp, Homo sapiens
acaagaagtgggagtgggagag

SEQ ID NO: 2172015 - DNA, 14 bp, Homo sapiens
acaagactaacctt

SEQ ID NO: 2172016 - DNA, 13 bp, Homo sapiens
acaagcagccctt

SEQ ID NO: 2172017 - DNA, 16 bp, Homo sapiens
acaagcctcttctgaa

SEQ ID NO: 2172018 - DNA, 11 bp, Homo sapiens
acaagctgcct

SEQ ID NO: 2172019 - DNA, 16 bp, Homo sapiens
acaagctgcctccctg

SEQ ID NO: 2172020 - DNA, 16 bp, Homo sapiens
acaagctgtccctgca

SEQ ID NO: 2172021 - DNA, 13 bp, Homo sapiens
acaaggcaggcct

SEQ ID NO: 2172022 - DNA, 11 bp, Homo sapiens
acaagtgtcta

SEQ ID NO: 2172023 - DNA, 12 bp, Homo sapiens
acaagtttcagt

SEQ ID NO: 2172024 - DNA, 15 bp, Homo sapiens
acaagtttcagtaat

SEQ ID NO: 2172025 - DNA, 20 bp, Homo sapiens
acaagtttcagtaatagctg

SEQ ID NO: 2172026 - DNA, 18 bp, Homo sapiens
acaatccctacagggtgt

SEQ ID NO: 2172027 - DNA, 15 bp, Homo sapiens
acaatcgttctgtgt

SEQ ID NO: 2172028 - DNA, 22 bp, Homo sapiens
acaatctcatcccaacaaactt

SEQ ID NO: 2172029 - DNA, 16 bp, Homo sapiens
acaatctttccttgtc

SEQ ID NO: 2172030 - DNA, 16 bp, Homo sapiens
acaatgcatgctttgg

SEQ ID NO: 2172031 - DNA, 23 bp, Homo sapiens
acaatgtgtgggataatgtcatt

SEQ ID NO: 2172032 - DNA, 13 bp, Homo sapiens
acaatgttaaatg

SEQ ID NO: 2172033 - DNA, 15 bp, Homo sapiens
acaattcaatcaaag

SEQ ID NO: 2172034 - DNA, 14 bp, Homo sapiens
acaattgtgacagc

SEQ ID NO: 2172035 - DNA, 21 bp, Homo sapiens
acaatttgcaaatttaggacc

SEQ ID NO: 2172036 - DNA, 12 bp, Homo sapiens
acacaacaccag

SEQ ID NO: 2172037 - DNA, 15 bp, Homo sapiens
acacaacaccaggac

SEQ ID NO: 2172038 - DNA, 16 bp, Homo sapiens
acacaacaccaggact

SEQ ID NO: 2172039 - DNA, 16 bp, Homo sapiens
acacaacaggctgtgt

SEQ ID NO: 2172040 - DNA, 17 bp, Homo sapiens
acacaacgctgctgcct

SEQ ID NO: 2172041 - DNA, 20 bp, Homo sapiens
acacaactccactgtcttta

SEQ ID NO: 2172042 - DNA, 12 bp, Homo sapiens
acacacacagct

SEQ ID NO: 2172043 - DNA, 17 bp, Homo sapiens
acacacattgctattcc

SEQ ID NO: 2172044 - DNA, 17 bp, Homo sapiens
acacacgtgtgatgtat

SEQ ID NO: 2172045 - DNA, 18 bp, Homo sapiens
acacacgtgtgatgtatg

SEQ ID NO: 2172046 - DNA, 14 bp, Homo sapiens
acacagactatttt

SEQ ID NO: 2172047 - DNA, 21 bp, Homo sapiens
acacagagaatgggtaattca

SEQ ID NO: 2172048 - DNA, 12 bp, Homo sapiens
acacagcctgtc

SEQ ID NO: 2172049 - DNA, 21 bp, Homo sapiens
acacagctgagctggcctatt

SEQ ID NO: 2172050 - DNA, 14 bp, Homo sapiens
acacagtctggtgc

SEQ ID NO: 2172051 - DNA, 13 bp, Homo sapiens
acacagtttggtt

SEQ ID NO: 2172052 - DNA, 13 bp, Homo sapiens
acaccactgtact

SEQ ID NO: 2172053 - DNA, 18 bp, Homo sapiens
acaccatcttcagctgta

SEQ ID NO: 2172054 - DNA, 15 bp, Homo sapiens
acacctaactcacct

SEQ ID NO: 2172055 - DNA, 20 bp, Homo sapiens
acacctaagtgactaccact

SEQ ID NO: 2172056 - DNA, 14 bp, Homo sapiens
acacgtgtgatgta

SEQ ID NO: 2172057 - DNA, 17 bp, Homo sapiens
acacgtgtgatgtatgt

SEQ ID NO: 2172058 - DNA, 21 bp, Homo sapiens
acactacagaggattctgtct

SEQ ID NO: 2172059 - DNA, 17 bp, Homo sapiens
acactcaccgagaggaa

SEQ ID NO: 2172060 - DNA, 20 bp, Homo sapiens
acactcatcctacttcaaga

SEQ ID NO: 2172061 - DNA, 16 bp, Homo sapiens
acactcctacacctaa

SEQ ID NO: 2172062 - DNA, 23 bp, Homo sapiens
acactcttcagtgactcctgctg

SEQ ID NO: 2172063 - DNA, 21 bp, Homo sapiens
acactgaaccgctacaagagg

SEQ ID NO: 2172064 - DNA, 18 bp, Homo sapiens
acactggatccagaagct

SEQ ID NO: 2172065 - DNA, 23 bp, Homo sapiens
acactgtcaatggactgcacctt

SEQ ID NO: 2172066 - DNA, 23 bp, Homo sapiens
actttagggctaaccagttctct

SEQ ID NO: 2172067 - DNA, 16 bp, Homo sapiens
actttattgattttct

SEQ ID NO: 2172068 - DNA, 19 bp, Homo sapiens
actttattgattttctttc

SEQ ID NO: 2172069 - DNA, 21 bp, Homo sapiens
actttccccatactctgtctc

SEQ ID NO: 2172070 - DNA, 20 bp, Homo sapiens
actttctcttaacttaattt

SEQ ID NO: 2172071 - DNA, 20 bp, Homo sapiens
actttgattccattttaagt

SEQ ID NO: 2172072 - DNA, 18 bp, Homo sapiens
actttgcagacctgggac

SEQ ID NO: 2172073 - DNA, 23 bp, Homo sapiens
actttgcccagggtcctgtgcct

SEQ ID NO: 2172074 - DNA, 19 bp, Homo sapiens
actttgcgtgtgtcataaa

SEQ ID NO: 2172075 - DNA, 13 bp, Homo sapiens
acttttacagctt

SEQ ID NO: 2172076 - DNA, 17 bp, Homo sapiens
acttttacagcttttct

SEQ ID NO: 2172077 - DNA, 19 bp, Homo sapiens
acttttacagcttttctct

SEQ ID NO: 2172078 - DNA, 19 bp, Homo sapiens
acttttagacagtggtaaa

SEQ ID NO: 2172079 - DNA, 20 bp, Homo sapiens
acttttagacagtggtaaat

SEQ ID NO: 2172080 - DNA, 19 bp, Homo sapiens
acttttgcagcttccttcc

SEQ ID NO: 2172081 - DNA, 17 bp, Homo sapiens
agaaaacaaatcttcaa

SEQ ID NO: 2172082 - DNA, 18 bp, Homo sapiens
agaaaatcctaactttca

SEQ ID NO: 2172083 - DNA, 16 bp, Homo sapiens
agaaaatggaacatta

SEQ ID NO: 2172084 - DNA, 12 bp, Homo sapiens
agaaaattgcca

SEQ ID NO: 2172085 - DNA, 13 bp, Homo sapiens
agaaaattgccaa

SEQ ID NO: 2172086 - DNA, 21 bp, Homo sapiens
agaaaattgccaaaatatatt

SEQ ID NO: 2172087 - DNA, 11 bp, Homo sapiens
agaaaatttta

SEQ ID NO: 2172088 - DNA, 20 bp, Homo sapiens
agaaacttaaatgttattat

SEQ ID NO: 2172089 - DNA, 23 bp, Homo sapiens
agaaacttaaatgttattatctg

SEQ ID NO: 2172090 - DNA, 16 bp, Homo sapiens
agaaagagctgcctgg

SEQ ID NO: 2172091 - DNA, 18 bp, Homo sapiens
agaaagagctgcctggat

SEQ ID NO: 2172092 - DNA, 14 bp, Homo sapiens
agaaagcagaggct

SEQ ID NO: 2172093 - DNA, 15 bp, Homo sapiens
agaaagcagaggctg

SEQ ID NO: 2172094 - DNA, 16 bp, Homo sapiens
agaaagcagaggctgg

SEQ ID NO: 2172095 - DNA, 22 bp, Homo sapiens
agaaaggggcaggagctcagat

SEQ ID NO: 2172096 - DNA, 13 bp, Homo sapiens
agaaatccagatc

SEQ ID NO: 2172097 - DNA, 17 bp, Homo sapiens
agaaatcctttcataaa

SEQ ID NO: 2172098 - DNA, 19 bp, Homo sapiens
agaaatcctttcataaagc

SEQ ID NO: 2172099 - DNA, 14 bp, Homo sapiens
agaaatgaaacaga

SEQ ID NO: 2172100 - DNA, 22 bp, Homo sapiens
agaaattccctggaccagatgc

SEQ ID NO: 2172101 - DNA, 23 bp, Homo sapiens
agaaattccctggaccagatgct

SEQ ID NO: 2172102 - DNA, 24 bp, Homo sapiens
agaaattccctggaccagatgctg

SEQ ID NO: 2172103 - DNA, 17 bp, Homo sapiens
agaaattgtatattgta

SEQ ID NO: 2172104 - DNA, 20 bp, Homo sapiens
agaaattgtatattgtaatt

SEQ ID NO: 2172105 - DNA, 21 bp, Homo sapiens
agaaattgtatattgtaattt

SEQ ID NO: 2172106 - DNA, 18 bp, Homo sapiens
agaacagtggttgcctgg

SEQ ID NO: 2172107 - DNA, 20 bp, Homo sapiens
agaacagtggttgcctgggg

SEQ ID NO: 2172108 - DNA, 20 bp, Homo sapiens
agaacatctgccttgctgca

SEQ ID NO: 2172109 - DNA, 22 bp, Homo sapiens
agaacatgttacgtgtgcaaca

SEQ ID NO: 2172110 - DNA, 20 bp, Homo sapiens
agaacattcagctctggaga

SEQ ID NO: 2172111 - DNA, 20 bp, Homo sapiens
agaaccctggtgaggaagct

SEQ ID NO: 2172112 - DNA, 21 bp, Homo sapiens
agaactctgggcacttttgaa

SEQ ID NO: 2172113 - DNA, 22 bp, Homo sapiens
agaactgccataaaatctcacg

SEQ ID NO: 2172114 - DNA, 16 bp, Homo sapiens
agaacttagttttgtt

SEQ ID NO: 2172115 - DNA, 15 bp, Homo sapiens
agaacttgaagtgaa

SEQ ID NO: 2172116 - DNA, 12 bp, Homo sapiens
agaagcaagaca

SEQ ID NO: 2172117 - DNA, 15 bp, Homo sapiens
agaagcagtggcctt

SEQ ID NO: 2172118 - DNA, 13 bp, Homo sapiens
agaagccagccac

SEQ ID NO: 2172119 - DNA, 19 bp, Homo sapiens
agaagccagccacagaccc

SEQ ID NO: 2172120 - DNA, 17 bp, Homo sapiens
agaagcctagaaaagaa

SEQ ID NO: 2172121 - DNA, 14 bp, Homo sapiens
agaagccttggtac

SEQ ID NO: 2172122 - DNA, 13 bp, Homo sapiens
agaagctgtgtct

SEQ ID NO: 2172123 - DNA, 19 bp, Homo sapiens
agaaggaggaattttagaa

SEQ ID NO: 2172124 - DNA, 18 bp, Homo sapiens
agaaggcaagctggcagg

SEQ ID NO: 2172125 - DNA, 13 bp, Homo sapiens
agaagggggccct

SEQ ID NO: 2172126 - DNA, 16 bp, Homo sapiens
agaagggggccctgct

SEQ ID NO: 2172127 - DNA, 22 bp, Homo sapiens
agaaggtgggggttggctgggt

SEQ ID NO: 2172128 - DNA, 16 bp, Homo sapiens
agaagtcggccaggta

SEQ ID NO: 2172129 - DNA, 21 bp, Homo sapiens
agaagtgggagtgggagagga

SEQ ID NO: 2172130 - DNA, 16 bp, Homo sapiens
agaagttagtttgtat

SEQ ID NO: 2172131 - DNA, 12 bp, Homo sapiens
agaataaagaac

SEQ ID NO: 2172132 - DNA, 19 bp, Homo sapiens
agaatattaaaaattaatt

SEQ ID NO: 2172133 - DNA, 14 bp, Homo sapiens
agaatcaagtctgt

SEQ ID NO: 2172134 - DNA, 16 bp, Homo sapiens
agaatgaccctgtcaa

SEQ ID NO: 2172135 - DNA, 14 bp, Homo sapiens
agaatgagagagtg

SEQ ID NO: 2172136 - DNA, 15 bp, Homo sapiens
agaatgagagagtgt

SEQ ID NO: 2172137 - DNA, 20 bp, Homo sapiens
agaatgggtaattcaagagg

SEQ ID NO: 2172138 - DNA, 18 bp, Homo sapiens
agacaaaccactgtacat

SEQ ID NO: 2172139 - DNA, 23 bp, Homo sapiens
agacaaattactgataaaaatga

SEQ ID NO: 2172140 - DNA, 14 bp, Homo sapiens
agacaagcagccct

SEQ ID NO: 2172141 - DNA, 15 bp, Homo sapiens
agacaagcagccctt

SEQ ID NO: 2172142 - DNA, 16 bp, Homo sapiens
agacaagcagcccttg

SEQ ID NO: 2172143 - DNA, 22 bp, Homo sapiens
agacacagagtggagccctcag

SEQ ID NO: 2172144 - DNA, 19 bp, Homo sapiens
agacacgtggcctcgtgag

SEQ ID NO: 2172145 - DNA, 22 bp, Homo sapiens
agacagccggatcttggagaca

SEQ ID NO: 2172146 - DNA, 15 bp, Homo sapiens
agaccaagccggtgc

SEQ ID NO: 2172147 - DNA, 16 bp, Homo sapiens
agaccagagctctgga

SEQ ID NO: 2172148 - DNA, 14 bp, Homo sapiens
agaccagcctttct

SEQ ID NO: 2172149 - DNA, 16 bp, Homo sapiens
agaccggaagctcctg

SEQ ID NO: 2172150 - DNA, 14 bp, Homo sapiens
agacctggaaccag

SEQ ID NO: 2172151 - DNA, 16 bp, Homo sapiens
agaccttcaccaaaca

SEQ ID NO: 2172152 - DNA, 19 bp, Homo sapiens
agacgcactgatctttgca

SEQ ID NO: 2172153 - DNA, 17 bp, Homo sapiens
agacgctaataaaaatt

SEQ ID NO: 2172154 - DNA, 18 bp, Homo sapiens
agacggagtctcagtctg

SEQ ID NO: 2172155 - DNA, 21 bp, Homo sapiens
agacggtagaattaaagaaga

SEQ ID NO: 2172156 - DNA, 20 bp, Homo sapiens
agactcaagtgatcctcctg

SEQ ID NO: 2172157 - DNA, 21 bp, Homo sapiens
agactcaagtgatcctcctgt

SEQ ID NO: 2172158 - DNA, 18 bp, Homo sapiens
agactcatacagaaggtg

SEQ ID NO: 2172159 - DNA, 18 bp, Homo sapiens
agactcctgattgctctg

SEQ ID NO: 2172160 - DNA, 23 bp, Homo sapiens
agactgaccttgatgtcttgaga

SEQ ID NO: 2172161 - DNA, 15 bp, Homo sapiens
agacttaatttcaaa

SEQ ID NO: 2172162 - DNA, 11 bp, Homo sapiens
agacttgtaca

SEQ ID NO: 2172163 - DNA, 19 bp, Homo sapiens
agacttgtacagttgactg

SEQ ID NO: 2172164 - DNA, 23 bp, Homo sapiens
agacttgtacagttgactggctt

SEQ ID NO: 2172165 - DNA, 16 bp, Homo sapiens
agagaaagagagaagc

SEQ ID NO: 2172166 - DNA, 15 bp, Homo sapiens
agagaagagtccagg

SEQ ID NO: 2172167 - DNA, 17 bp, Homo sapiens
agagaagagtccaggaa

SEQ ID NO: 2172168 - DNA, 12 bp, Homo sapiens
agagaagccagc

SEQ ID NO: 2172169 - DNA, 19 bp, Homo sapiens
agagaagccagccacagac

SEQ ID NO: 2172170 - DNA, 12 bp, Homo sapiens
agagaagttgta

SEQ ID NO: 2172171 - DNA, 15 bp, Homo sapiens
agagaatgagagagt

SEQ ID NO: 2172172 - DNA, 19 bp, Homo sapiens
agagaatgagagagtgtgg

SEQ ID NO: 2172173 - DNA, 19 bp, Homo sapiens
agagacacatacagagtgg

SEQ ID NO: 2172174 - DNA, 15 bp, Homo sapiens
agagaccacatgggg

SEQ ID NO: 2172175 - DNA, 19 bp, Homo sapiens
agagaccagcctttcttcc

SEQ ID NO: 2172176 - DNA, 19 bp, Homo sapiens
agagaccccgcacccggct

SEQ ID NO: 2172177 - DNA, 18 bp, Homo sapiens
agagagaagtcggccagg

SEQ ID NO: 2172178 - DNA, 17 bp, Homo sapiens
agagagaccccgcaccc

SEQ ID NO: 2172179 - DNA, 19 bp, Homo sapiens
agagagaccccgcacccgg

SEQ ID NO: 2172180 - DNA, 21 bp, Homo sapiens
agagagaccccgcacccggct

SEQ ID NO: 2172181 - DNA, 18 bp, Homo sapiens
agagagcttcctgtttct

SEQ ID NO: 2172182 - DNA, 20 bp, Homo sapiens
agagagcttcctgtttctaa

SEQ ID NO: 2172183 - DNA, 14 bp, Homo sapiens
agagaggggcctct

SEQ ID NO: 2172184 - DNA, 17 bp, Homo sapiens
agagatgatactgactt

SEQ ID NO: 2172185 - DNA, 16 bp, Homo sapiens
agagatgcctccctga

SEQ ID NO: 2172186 - DNA, 19 bp, Homo sapiens
agagcaaagggccaggaag

SEQ ID NO: 2172187 - DNA, 14 bp, Homo sapiens
aggcccttttctgg

SEQ ID NO: 2172188 - DNA, 14 bp, Homo sapiens
aggccgaggcaggg

SEQ ID NO: 2172189 - DNA, 24 bp, Homo sapiens
aggccgaggcaggggctgggcaga

SEQ ID NO: 2172190 - DNA, 12 bp, Homo sapiens
aggccgcccacc

SEQ ID NO: 2172191 - DNA, 15 bp, Homo sapiens
aggccgcccacctgc

SEQ ID NO: 2172192 - DNA, 18 bp, Homo sapiens
aggccggcagcgggcgga

SEQ ID NO: 2172193 - DNA, 20 bp, Homo sapiens
aggcctatgccacctgcagc

SEQ ID NO: 2172194 - DNA, 13 bp, Homo sapiens
aggcctcaccctg

SEQ ID NO: 2172195 - DNA, 23 bp, Homo sapiens
aggcctcaccctgcttggggcct

SEQ ID NO: 2172196 - DNA, 13 bp, Homo sapiens
aggcctcttgctg

SEQ ID NO: 2172197 - DNA, 16 bp, Homo sapiens
aggcctcttgctggtg

SEQ ID NO: 2172198 - DNA, 21 bp, Homo sapiens
aggcctgacctcaagcaacca

SEQ ID NO: 2172199 - DNA, 15 bp, Homo sapiens
aggcctgtccctggc

SEQ ID NO: 2172200 - DNA, 15 bp, Homo sapiens
aggctcaactaggga

SEQ ID NO: 2172201 - DNA, 12 bp, Homo sapiens
aggctcctggag

SEQ ID NO: 2172202 - DNA, 14 bp, Homo sapiens
aggctcctggagcc

SEQ ID NO: 2172203 - DNA, 18 bp, Homo sapiens
aggctcctggagccagcc

SEQ ID NO: 2172204 - DNA, 18 bp, Homo sapiens
aggctcgtggactgagtg

SEQ ID NO: 2172205 - DNA, 19 bp, Homo sapiens
aggctgagtgcactggcag

SEQ ID NO: 2172206 - DNA, 14 bp, Homo sapiens
aggctgccggctgc

SEQ ID NO: 2172207 - DNA, 15 bp, Homo sapiens
aggctgccggctgca

SEQ ID NO: 2172208 - DNA, 21 bp, Homo sapiens
aggctgggcccagaggcacag

SEQ ID NO: 2172209 - DNA, 17 bp, Homo sapiens
aggctgggtgcccacag

SEQ ID NO: 2172210 - DNA, 18 bp, Homo sapiens
aggctgggtgcccacagc

SEQ ID NO: 2172211 - DNA, 19 bp, Homo sapiens
aggctgggtgcccacagcc

SEQ ID NO: 2172212 - DNA, 12 bp, Homo sapiens
aggcttctccac

SEQ ID NO: 2172213 - DNA, 12 bp, Homo sapiens
agggaagaactc

SEQ ID NO: 2172214 - DNA, 14 bp, Homo sapiens
agggaaggacagga

SEQ ID NO: 2172215 - DNA, 22 bp, Homo sapiens
agggaaggacaggaccctcagg

SEQ ID NO: 2172216 - DNA, 12 bp, Homo sapiens
agggacccctcc

SEQ ID NO: 2172217 - DNA, 14 bp, Homo sapiens
agggacccctcctc

SEQ ID NO: 2172218 - DNA, 20 bp, Homo sapiens
agggagcagagaaggccagg

SEQ ID NO: 2172219 - DNA, 20 bp, Homo sapiens
agggagccggtttgggagag

SEQ ID NO: 2172220 - DNA, 23 bp, Homo sapiens
agggcagcctgtgggagaaggga

SEQ ID NO: 2172221 - DNA, 20 bp, Homo sapiens
agggccctctgaggctcagc

SEQ ID NO: 2172222 - DNA, 22 bp, Homo sapiens
agggccctctggggctcagccc

SEQ ID NO: 2172223 - DNA, 11 bp, Homo sapiens
agggccctggc

SEQ ID NO: 2172224 - DNA, 17 bp, Homo sapiens
agggcctcacctttccc

SEQ ID NO: 2172225 - DNA, 22 bp, Homo sapiens
agggcctgacttttacagcttt

SEQ ID NO: 2172226 - DNA, 16 bp, Homo sapiens
agggctaaccagttct

SEQ ID NO: 2172227 - DNA, 20 bp, Homo sapiens
agggctaaggcctcttgctg

SEQ ID NO: 2172228 - DNA, 21 bp, Homo sapiens
agggctgggcactcctcccct

SEQ ID NO: 2172229 - DNA, 12 bp, Homo sapiens
agggctgggtgt

SEQ ID NO: 2172230 - DNA, 14 bp, Homo sapiens
aggggatccagcca

SEQ ID NO: 2172231 - DNA, 15 bp, Homo sapiens
aggggatccagccac

SEQ ID NO: 2172232 - DNA, 16 bp, Homo sapiens
aggggatccagccact

SEQ ID NO: 2172233 - DNA, 16 bp, Homo sapiens
aggggcagggaaggac

SEQ ID NO: 2172234 - DNA, 16 bp, Homo sapiens
aggggcctctggctgc

SEQ ID NO: 2172235 - DNA, 18 bp, Homo sapiens
aggggcctctggctgcct

SEQ ID NO: 2172236 - DNA, 15 bp, Homo sapiens
aggggcctgcagaag

SEQ ID NO: 2172237 - DNA, 16 bp, Homo sapiens
aggggcctgcagaagg

SEQ ID NO: 2172238 - DNA, 13 bp, Homo sapiens
aggggctgggcag

SEQ ID NO: 2172239 - DNA, 14 bp, Homo sapiens
agggggacagtgat

SEQ ID NO: 2172240 - DNA, 14 bp, Homo sapiens
agggggccctgcta

SEQ ID NO: 2172241 - DNA, 21 bp, Homo sapiens
agggggtgtaatgaaaatgat

SEQ ID NO: 2172242 - DNA, 15 bp, Homo sapiens
aggggtttctaacac

SEQ ID NO: 2172243 - DNA, 20 bp, Homo sapiens
agggtaggagggtgggaagg

SEQ ID NO: 2172244 - DNA, 13 bp, Homo sapiens
agggtaggcaagg

SEQ ID NO: 2172245 - DNA, 22 bp, Homo sapiens
agggtctccctatgttgcccag

SEQ ID NO: 2172246 - DNA, 18 bp, Homo sapiens
agggttctgcttttaagt

SEQ ID NO: 2172247 - DNA, 18 bp, Homo sapiens
aggtattgcaaggtcact

SEQ ID NO: 2172248 - DNA, 17 bp, Homo sapiens
aggtcaaaaacaaacta

SEQ ID NO: 2172249 - DNA, 19 bp, Homo sapiens
aggtcaaggcctgtccctg

SEQ ID NO: 2172250 - DNA, 15 bp, Homo sapiens
aggtcagtacccacc

SEQ ID NO: 2172251 - DNA, 17 bp, Homo sapiens
aggtcagtacccacctg

SEQ ID NO: 2172252 - DNA, 21 bp, Homo sapiens
aggtcccgagccccctgtcct

SEQ ID NO: 2172253 - DNA, 16 bp, Homo sapiens
aggtcgcgctcttgca

SEQ ID NO: 2172254 - DNA, 13 bp, Homo sapiens
aggtcgggctcag

SEQ ID NO: 2172255 - DNA, 15 bp, Homo sapiens
aggtcgggctcagct

SEQ ID NO: 2172256 - DNA, 18 bp, Homo sapiens
aggtctccaggggcctgc

SEQ ID NO: 2172257 - DNA, 21 bp, Homo sapiens
aggtctccaggggcctgcaga

SEQ ID NO: 2172258 - DNA, 13 bp, Homo sapiens
aggtctgagtggt

SEQ ID NO: 2172259 - DNA, 22 bp, Homo sapiens
aggtctgggagaggcagagtgc

SEQ ID NO: 2172260 - DNA, 19 bp, Homo sapiens
aggtgactgggccctgcct

SEQ ID NO: 2172261 - DNA, 20 bp, Homo sapiens
aggtgactgggccctgcctc

SEQ ID NO: 2172262 - DNA, 13 bp, Homo sapiens
aggtgccaccacc

SEQ ID NO: 2172263 - DNA, 20 bp, Homo sapiens
aggtgccaccaccctgcccc

SEQ ID NO: 2172264 - DNA, 21 bp, Homo sapiens
aggtgctctcctggcacccag

SEQ ID NO: 2172265 - DNA, 22 bp, Homo sapiens
aggtgggaggcccctggtggca

SEQ ID NO: 2172266 - DNA, 20 bp, Homo sapiens
aggtggggaagagagcctgc

SEQ ID NO: 2172267 - DNA, 21 bp, Homo sapiens
aggtggggaagagagcctgcc

SEQ ID NO: 2172268 - DNA, 23 bp, Homo sapiens
aggtggggaagagagcctgcccg

SEQ ID NO: 2172269 - DNA, 15 bp, Homo sapiens
aggtggggtgaagct

SEQ ID NO: 2172270 - DNA, 19 bp, Homo sapiens
aggtgtaaaatatctacct

SEQ ID NO: 2172271 - DNA, 22 bp, Homo sapiens
aggttagattttgtattcaggg

SEQ ID NO: 2172272 - DNA, 21 bp, Homo sapiens
aggttcaagcgactctcctgc

SEQ ID NO: 2172273 - DNA, 19 bp, Homo sapiens
aggttctggttagctcagc

SEQ ID NO: 2172274 - DNA, 13 bp, Homo sapiens
aggttctgtctgt

SEQ ID NO: 2172275 - DNA, 15 bp, Homo sapiens
aggttgatcagtgag

SEQ ID NO: 2172276 - DNA, 16 bp, Homo sapiens
aggttggaactgctgc

SEQ ID NO: 2172277 - DNA, 19 bp, Homo sapiens
aggttggaagctagctccc

SEQ ID NO: 2172278 - DNA, 17 bp, Homo sapiens
aggttggcttttttccc

SEQ ID NO: 2172279 - DNA, 20 bp, Homo sapiens
aggtttacagtgaataaaag

SEQ ID NO: 2172280 - DNA, 20 bp, Homo sapiens
aggttttatttcatttttca

SEQ ID NO: 2172281 - DNA, 12 bp, Homo sapiens
agtaaaaacact

SEQ ID NO: 2172282 - DNA, 12 bp, Homo sapiens
agtaaaaataaa

SEQ ID NO: 2172283 - DNA, 14 bp, Homo sapiens
agtaaactgccctg

SEQ ID NO: 2172284 - DNA, 17 bp, Homo sapiens
agtaaagtacaagctgt

SEQ ID NO: 2172285 - DNA, 19 bp, Homo sapiens
agtaacaatgcatgctttg

SEQ ID NO: 2172286 - DNA, 13 bp, Homo sapiens
agtaacctttaaa

SEQ ID NO: 2172287 - DNA, 16 bp, Homo sapiens
agtaacgtgttactgg

SEQ ID NO: 2172288 - DNA, 22 bp, Homo sapiens
agtaagaccggaagctcctggt

SEQ ID NO: 2172289 - DNA, 17 bp, Homo sapiens
agtaataaaacccagca

SEQ ID NO: 2172290 - DNA, 23 bp, Homo sapiens
agtaataaaacccagcatgtaca

SEQ ID NO: 2172291 - DNA, 12 bp, Homo sapiens
agtaatagctga

SEQ ID NO: 2172292 - DNA, 16 bp, Homo sapiens
agtaatagctgaacct

SEQ ID NO: 2172293 - DNA, 17 bp, Homo sapiens
agtacccacctgagctt

SEQ ID NO: 2172294 - DNA, 22 bp, Homo sapiens
agtacccacctgagctttggac

SEQ ID NO: 2172295 - DNA, 16 bp, Homo sapiens
agtacctttgctcttg

SEQ ID NO: 2172296 - DNA, 21 bp, Homo sapiens
agtacctttgctcttgcagag

SEQ ID NO: 2172297 - DNA, 19 bp, Homo sapiens
agtactttattagtttaaa

SEQ ID NO: 2172298 - DNA, 21 bp, Homo sapiens
agtagttgggattacaggtga

SEQ ID NO: 2172299 - DNA, 17 bp, Homo sapiens
agtatcctgaaacagtg

SEQ ID NO: 2172300 - DNA, 22 bp, Homo sapiens
agtatgcactaatcaatacttt

SEQ ID NO: 2172301 - DNA, 16 bp, Homo sapiens
agtattacacattaaa

SEQ ID NO: 2172302 - DNA, 12 bp, Homo sapiens
agtattgctaat

SEQ ID NO: 2172303 - DNA, 14 bp, Homo sapiens
agtcaaatgcattt

SEQ ID NO: 2172304 - DNA, 17 bp, Homo sapiens
agtcacaatttgcaaat

SEQ ID NO: 2172305 - DNA, 11 bp, Homo sapiens
agtcacagtgg

SEQ ID NO: 2172306 - DNA, 14 bp, Homo sapiens
agtcacccctgtct

SEQ ID NO: 2172307 - DNA, 16 bp, Homo sapiens
agtcaccctgtggcaa

SEQ ID NO: 2172308 - DNA, 14 bp, Homo sapiens
agtcatttttgttt

SEQ ID NO: 2172309 - DNA, 14 bp, Homo sapiens
atattttctttcta

SEQ ID NO: 2172310 - DNA, 20 bp, Homo sapiens
atattttctttctagtttgt

SEQ ID NO: 2172311 - DNA, 22 bp, Homo sapiens
atcaaaagaagcctagaaaaga

SEQ ID NO: 2172312 - DNA, 10 bp, Homo sapiens
atcaaagcta

SEQ ID NO: 2172313 - DNA, 13 bp, Homo sapiens
atcaaagctacct

SEQ ID NO: 2172314 - DNA, 12 bp, Homo sapiens
atcaacactgca

SEQ ID NO: 2172315 - DNA, 14 bp, Homo sapiens
atcaccctcagctg

SEQ ID NO: 2172316 - DNA, 16 bp, Homo sapiens
atcaccctcagctggc

SEQ ID NO: 2172317 - DNA, 11 bp, Homo sapiens
atcacctgtca

SEQ ID NO: 2172318 - DNA, 14 bp, Homo sapiens
atcactcccctcca

SEQ ID NO: 2172319 - DNA, 14 bp, Homo sapiens
atcactgagtttgt

SEQ ID NO: 2172320 - DNA, 23 bp, Homo sapiens
atcagaactctcctatctgaacc

SEQ ID NO: 2172321 - DNA, 15 bp, Homo sapiens
atcagcctctggcca

SEQ ID NO: 2172322 - DNA, 18 bp, Homo sapiens
atcagcctctggccagac

SEQ ID NO: 2172323 - DNA, 22 bp, Homo sapiens
atcaggaggagattaacacact

SEQ ID NO: 2172324 - DNA, 22 bp, Homo sapiens
atcagtgagctcaggagagagc

SEQ ID NO: 2172325 - DNA, 14 bp, Homo sapiens
atcagttttgtgta

SEQ ID NO: 2172326 - DNA, 15 bp, Homo sapiens
atcatggctcactgc

SEQ ID NO: 2172327 - DNA, 18 bp, Homo sapiens
atcatgttaatcctagct

SEQ ID NO: 2172328 - DNA, 22 bp, Homo sapiens
atcattggtatctgatatctgt

SEQ ID NO: 2172329 - DNA, 18 bp, Homo sapiens
atcatttgcagctgctgg

SEQ ID NO: 2172330 - DNA, 19 bp, Homo sapiens
atcatttgcagctgctggt

SEQ ID NO: 2172331 - DNA, 13 bp, Homo sapiens
atcattttagaat

SEQ ID NO: 2172332 - DNA, 14 bp, Homo sapiens
atccaacatttcct

SEQ ID NO: 2172333 - DNA, 21 bp, Homo sapiens
atccacacaacaccaggactt

SEQ ID NO: 2172334 - DNA, 18 bp, Homo sapiens
atccaccagtgtgttgaa

SEQ ID NO: 2172335 - DNA, 14 bp, Homo sapiens
atccacctccttct

SEQ ID NO: 2172336 - DNA, 17 bp, Homo sapiens
atccaggggcttcaccc

SEQ ID NO: 2172337 - DNA, 20 bp, Homo sapiens
atccagtgggttcctcccag

SEQ ID NO: 2172338 - DNA, 22 bp, Homo sapiens
atccatagccaatacatttaca

SEQ ID NO: 2172339 - DNA, 16 bp, Homo sapiens
atcccaattcatttca

SEQ ID NO: 2172340 - DNA, 13 bp, Homo sapiens
atcccagccttgg

SEQ ID NO: 2172341 - DNA, 13 bp, Homo sapiens
atccccaagctgg

SEQ ID NO: 2172342 - DNA, 17 bp, Homo sapiens
atccccaagctggccac

SEQ ID NO: 2172343 - DNA, 19 bp, Homo sapiens
atcccgtgcaaaacatgct

SEQ ID NO: 2172344 - DNA, 18 bp, Homo sapiens
atccctcccctcagcctc

SEQ ID NO: 2172345 - DNA, 20 bp, Homo sapiens
atccctctggcccacacaga

SEQ ID NO: 2172346 - DNA, 12 bp, Homo sapiens
atccgtctcccc

SEQ ID NO: 2172347 - DNA, 13 bp, Homo sapiens
atcctagctgtgt

SEQ ID NO: 2172348 - DNA, 15 bp, Homo sapiens
atcctagctgtgtgc

SEQ ID NO: 2172349 - DNA, 13 bp, Homo sapiens
atcctccacgggc

SEQ ID NO: 2172350 - DNA, 21 bp, Homo sapiens
atcctcctgtcttggcctccc

SEQ ID NO: 2172351 - DNA, 14 bp, Homo sapiens
atcctgccactgtt

SEQ ID NO: 2172352 - DNA, 15 bp, Homo sapiens
atcctggctttgccc

SEQ ID NO: 2172353 - DNA, 14 bp, Homo sapiens
atcggggccagagg

SEQ ID NO: 2172354 - DNA, 19 bp, Homo sapiens
atcggtgcagcggtggaag

SEQ ID NO: 2172355 - DNA, 16 bp, Homo sapiens
atcgttctaaaatcaa

SEQ ID NO: 2172356 - DNA, 14 bp, Homo sapiens
atcgtttttgtttt

SEQ ID NO: 2172357 - DNA, 17 bp, Homo sapiens
atctaattcagatggat

SEQ ID NO: 2172358 - DNA, 18 bp, Homo sapiens
atctaatttttattaatt

SEQ ID NO: 2172359 - DNA, 17 bp, Homo sapiens
atctacctgccctctct

SEQ ID NO: 2172360 - DNA, 23 bp, Homo sapiens
atctcacgctgccatttccctga

SEQ ID NO: 2172361 - DNA, 20 bp, Homo sapiens
atctcactttaataataaaa

SEQ ID NO: 2172362 - DNA, 13 bp, Homo sapiens
atctcagctcact

SEQ ID NO: 2172363 - DNA, 14 bp, Homo sapiens
atctcagctcactg

SEQ ID NO: 2172364 - DNA, 23 bp, Homo sapiens
atctcaggataaagtttgctaag

SEQ ID NO: 2172365 - DNA, 21 bp, Homo sapiens
atctccttttatgctcacctg

SEQ ID NO: 2172366 - DNA, 13 bp, Homo sapiens
atctcgctagcca

SEQ ID NO: 2172367 - DNA, 17 bp, Homo sapiens
atctctggaaaaataag

SEQ ID NO: 2172368 - DNA, 23 bp, Homo sapiens
atctgcattttctgggttctggg

SEQ ID NO: 2172369 - DNA, 16 bp, Homo sapiens
atctgccaagggccga

SEQ ID NO: 2172370 - DNA, 20 bp, Homo sapiens
atctgctgacagatgttcca

SEQ ID NO: 2172371 - DNA, 16 bp, Homo sapiens
atctgggaactcccaa

SEQ ID NO: 2172372 - DNA, 19 bp, Homo sapiens
atctgggaactcccaagaa

SEQ ID NO: 2172373 - DNA, 14 bp, Homo sapiens
atctgtttgcttct

SEQ ID NO: 2172374 - DNA, 15 bp, Homo sapiens
atcttagttctgtat

SEQ ID NO: 2172375 - DNA, 14 bp, Homo sapiens
atcttataattgtt

SEQ ID NO: 2172376 - DNA, 16 bp, Homo sapiens
atcttatgcaaaactt

SEQ ID NO: 2172377 - DNA, 15 bp, Homo sapiens
atcttcaaggtgtaa

SEQ ID NO: 2172378 - DNA, 20 bp, Homo sapiens
atcttcagctgtatgaaagg

SEQ ID NO: 2172379 - DNA, 15 bp, Homo sapiens
atcttctccaggatg

SEQ ID NO: 2172380 - DNA, 19 bp, Homo sapiens
atcttggagacaattacaa

SEQ ID NO: 2172381 - DNA, 20 bp, Homo sapiens
atgaaaatgatgtagacatt

SEQ ID NO: 2172382 - DNA, 12 bp, Homo sapiens
atgaaacaagca

SEQ ID NO: 2172383 - DNA, 17 bp, Homo sapiens
atgaaagctatgaatgt

SEQ ID NO: 2172384 - DNA, 14 bp, Homo sapiens
atgaaattaataaa

SEQ ID NO: 2172385 - DNA, 22 bp, Homo sapiens
atgaaattttaccattttgcga

SEQ ID NO: 2172386 - DNA, 23 bp, Homo sapiens
atgaaattttaccattttgcgat

SEQ ID NO: 2172387 - DNA, 22 bp, Homo sapiens
atgaactcagctattaagaaaa

SEQ ID NO: 2172388 - DNA, 17 bp, Homo sapiens
atgaaggatcaaaaaat

SEQ ID NO: 2172389 - DNA, 23 bp, Homo sapiens
atgaatggctcactatggtgcca

SEQ ID NO: 2172390 - DNA, 15 bp, Homo sapiens
atgaatttggtctgc

SEQ ID NO: 2172391 - DNA, 16 bp, Homo sapiens
atgacactgagaacag

SEQ ID NO: 2172392 - DNA, 17 bp, Homo sapiens
atgacatttctcaaagt

SEQ ID NO: 2172393 - DNA, 14 bp, Homo sapiens
atgacattttgcca

SEQ ID NO: 2172394 - DNA, 22 bp, Homo sapiens
atgaccctgtcaagcttcatta

SEQ ID NO: 2172395 - DNA, 19 bp, Homo sapiens
atgacctccttagaaaaga

SEQ ID NO: 2172396 - DNA, 17 bp, Homo sapiens
atgacgtattgtgaaat

SEQ ID NO: 2172397 - DNA, 16 bp, Homo sapiens
atgactgaatttctat

SEQ ID NO: 2172398 - DNA, 15 bp, Homo sapiens
atgagaaacagctca

SEQ ID NO: 2172399 - DNA, 16 bp, Homo sapiens
atgagaaacagctcag

SEQ ID NO: 2172400 - DNA, 17 bp, Homo sapiens
atgagaaacagctcagc

SEQ ID NO: 2172401 - DNA, 19 bp, Homo sapiens
atgagaaacagctcagcca

SEQ ID NO: 2172402 - DNA, 16 bp, Homo sapiens
atgagaattcagctgc

SEQ ID NO: 2172403 - DNA, 10 bp, Homo sapiens
atgagagagt

SEQ ID NO: 2172404 - DNA, 13 bp, Homo sapiens
atgagtcctattc

SEQ ID NO: 2172405 - DNA, 13 bp, Homo sapiens
atgagtcttgtaa

SEQ ID NO: 2172406 - DNA, 15 bp, Homo sapiens
atgatactgtctaag

SEQ ID NO: 2172407 - DNA, 17 bp, Homo sapiens
atgattaatgtgtattt

SEQ ID NO: 2172408 - DNA, 15 bp, Homo sapiens
atgattgccaacagt

SEQ ID NO: 2172409 - DNA, 16 bp, Homo sapiens
atgattgtaagtccca

SEQ ID NO: 2172410 - DNA, 15 bp, Homo sapiens
atgattttggccact

SEQ ID NO: 2172411 - DNA, 23 bp, Homo sapiens
atgcaaaaactctttgagagggt

SEQ ID NO: 2172412 - DNA, 16 bp, Homo sapiens
atgcaaaccaggagca

SEQ ID NO: 2172413 - DNA, 22 bp, Homo sapiens
atgcaaagttacatgaggggaa

SEQ ID NO: 2172414 - DNA, 16 bp, Homo sapiens
atgcactactgaaatt

SEQ ID NO: 2172415 - DNA, 22 bp, Homo sapiens
atgcactactgaaatttacaca

SEQ ID NO: 2172416 - DNA, 14 bp, Homo sapiens
atgcagatgccaga

SEQ ID NO: 2172417 - DNA, 16 bp, Homo sapiens
atgcagatgccagagc

SEQ ID NO: 2172418 - DNA, 14 bp, Homo sapiens
atgcattcactcag

SEQ ID NO: 2172419 - DNA, 16 bp, Homo sapiens
atgcatttttaagaat

SEQ ID NO: 2172420 - DNA, 13 bp, Homo sapiens
atgccacctgcag

SEQ ID NO: 2172421 - DNA, 18 bp, Homo sapiens
atgccaggacagctgcag

SEQ ID NO: 2172422 - DNA, 23 bp, Homo sapiens
atgccaggacagctgcaggtgcc

SEQ ID NO: 2172423 - DNA, 20 bp, Homo sapiens
atgccagtaggctcaactag

SEQ ID NO: 2172424 - DNA, 22 bp, Homo sapiens
atgccgctgcatccgtgagcag

SEQ ID NO: 2172425 - DNA, 22 bp, Homo sapiens
atgcctccctgaccctgcagag

SEQ ID NO: 2172426 - DNA, 15 bp, Homo sapiens
atgcctcgctccctt

SEQ ID NO: 2172427 - DNA, 12 bp, Homo sapiens
atgcctgtaatc

SEQ ID NO: 2172428 - DNA, 18 bp, Homo sapiens
atgccttatgtaattatt

SEQ ID NO: 2172429 - DNA, 15 bp, Homo sapiens
atgcggtctagggaa

SEQ ID NO: 2172430 - DNA, 19 bp, Homo sapiens
atgctatctcgctagccat

SEQ ID NO: 2172431 - DNA, 21 bp, Homo sapiens
atgctatttgccaagaccatt

SEQ ID NO: 2172432 - DNA, 21 bp, Homo sapiens
caaggccagtctgaacctgag

SEQ ID NO: 2172433 - DNA, 17 bp, Homo sapiens
caaggccgcccacctgc

SEQ ID NO: 2172434 - DNA, 24 bp, Homo sapiens
caaggccgcccacctgcatcagcc

SEQ ID NO: 2172435 - DNA, 21 bp, Homo sapiens
caaggcctatgccacctgcag

SEQ ID NO: 2172436 - DNA, 16 bp, Homo sapiens
caaggcctccagccac

SEQ ID NO: 2172437 - DNA, 18 bp, Homo sapiens
caaggcctgtccctggcc

SEQ ID NO: 2172438 - DNA, 17 bp, Homo sapiens
caaggctgccggctgca

SEQ ID NO: 2172439 - DNA, 14 bp, Homo sapiens
caaggggtgcctgg

SEQ ID NO: 2172440 - DNA, 18 bp, Homo sapiens
caaggggtgcctgggaac

SEQ ID NO: 2172441 - DNA, 13 bp, Homo sapiens
caaggtagacatg

SEQ ID NO: 2172442 - DNA, 21 bp, Homo sapiens
caagtacaaaaggagaagagg

SEQ ID NO: 2172443 - DNA, 19 bp, Homo sapiens
caagtattgttaatgaata

SEQ ID NO: 2172444 - DNA, 20 bp, Homo sapiens
caagtccaggtcgggctcag

SEQ ID NO: 2172445 - DNA, 22 bp, Homo sapiens
caagtcccaccggttgcttctg

SEQ ID NO: 2172446 - DNA, 21 bp, Homo sapiens
caagtgagcaaacctgcccca

SEQ ID NO: 2172447 - DNA, 19 bp, Homo sapiens
caagtttcagtaatagctg

SEQ ID NO: 2172448 - DNA, 15 bp, Homo sapiens
caataaaatgcactg

SEQ ID NO: 2172449 - DNA, 18 bp, Homo sapiens
caataaaatgcactgacc

SEQ ID NO: 2172450 - DNA, 13 bp, Homo sapiens
caataagccttgt

SEQ ID NO: 2172451 - DNA, 17 bp, Homo sapiens
caataattgtggagagg

SEQ ID NO: 2172452 - DNA, 18 bp, Homo sapiens
caataattgtggagagga

SEQ ID NO: 2172453 - DNA, 19 bp, Homo sapiens
caataattgtggagaggag

SEQ ID NO: 2172454 - DNA, 23 bp, Homo sapiens
caataattgtggagaggagagaa

SEQ ID NO: 2172455 - DNA, 17 bp, Homo sapiens
caatagcacatatggaa

SEQ ID NO: 2172456 - DNA, 12 bp, Homo sapiens
caatatttataa

SEQ ID NO: 2172457 - DNA, 13 bp, Homo sapiens
caatatttataat

SEQ ID NO: 2172458 - DNA, 16 bp, Homo sapiens
caatatttataattaa

SEQ ID NO: 2172459 - DNA, 18 bp, Homo sapiens
caatatttataattaaag

SEQ ID NO: 2172460 - DNA, 18 bp, Homo sapiens
caatcaaagctacctttt

SEQ ID NO: 2172461 - DNA, 20 bp, Homo sapiens
caatcctcacctaacagtta

SEQ ID NO: 2172462 - DNA, 20 bp, Homo sapiens
caatctacgatgttaaaaca

SEQ ID NO: 2172463 - DNA, 23 bp, Homo sapiens
caatctaggcgaggcgaagctga

SEQ ID NO: 2172464 - DNA, 18 bp, Homo sapiens
caatctctggaaaaataa

SEQ ID NO: 2172465 - DNA, 16 bp, Homo sapiens
caatgaatattgtaaa

SEQ ID NO: 2172466 - DNA, 17 bp, Homo sapiens
caatgactgcgcagagt

SEQ ID NO: 2172467 - DNA, 14 bp, Homo sapiens
caatgcagatgcca

SEQ ID NO: 2172468 - DNA, 21 bp, Homo sapiens
caatgcttctgcatactgtgt

SEQ ID NO: 2172469 - DNA, 17 bp, Homo sapiens
caatggaacctcctttc

SEQ ID NO: 2172470 - DNA, 19 bp, Homo sapiens
caatggattatacaaaaaa

SEQ ID NO: 2172471 - DNA, 14 bp, Homo sapiens
caatgtggaaattg

SEQ ID NO: 2172472 - DNA, 21 bp, Homo sapiens
caattcaaacaattcaatcaa

SEQ ID NO: 2172473 - DNA, 14 bp, Homo sapiens
caattcagagaata

SEQ ID NO: 2172474 - DNA, 15 bp, Homo sapiens
caattcttcttctca

SEQ ID NO: 2172475 - DNA, 13 bp, Homo sapiens
caatttctcccca

SEQ ID NO: 2172476 - DNA, 22 bp, Homo sapiens
cacaaaaagaaagctgtgaaat

SEQ ID NO: 2172477 - DNA, 21 bp, Homo sapiens
cacaaagcctgtgttactgat

SEQ ID NO: 2172478 - DNA, 23 bp, Homo sapiens
cacaaagctaaatacatggaaat

SEQ ID NO: 2172479 - DNA, 16 bp, Homo sapiens
cacaagctgtccctgc

SEQ ID NO: 2172480 - DNA, 18 bp, Homo sapiens
cacaagctgtccctgcag

SEQ ID NO: 2172481 - DNA, 19 bp, Homo sapiens
cacaatctttccttgtctc

SEQ ID NO: 2172482 - DNA, 21 bp, Homo sapiens
cacaatctttccttgtctctc

SEQ ID NO: 2172483 - DNA, 23 bp, Homo sapiens
cacaatctttccttgtctctcat

SEQ ID NO: 2172484 - DNA, 16 bp, Homo sapiens
cacacaacaccaggac

SEQ ID NO: 2172485 - DNA, 19 bp, Homo sapiens
cacactatcaacactgcag

SEQ ID NO: 2172486 - DNA, 14 bp, Homo sapiens
cacactgaaccgct

SEQ ID NO: 2172487 - DNA, 14 bp, Homo sapiens
cacactgcaacagg

SEQ ID NO: 2172488 - DNA, 16 bp, Homo sapiens
cacagacaagcagccc

SEQ ID NO: 2172489 - DNA, 23 bp, Homo sapiens
cacagagaactagtggtggctct

SEQ ID NO: 2172490 - DNA, 18 bp, Homo sapiens
cacagagacacagggcat

SEQ ID NO: 2172491 - DNA, 21 bp, Homo sapiens
cacagagcatccgtctcccct

SEQ ID NO: 2172492 - DNA, 11 bp, Homo sapiens
cacagaggcag

SEQ ID NO: 2172493 - DNA, 16 bp, Homo sapiens
cacagcacctcctctc

SEQ ID NO: 2172494 - DNA, 20 bp, Homo sapiens
cacagcacctcctctctgct

SEQ ID NO: 2172495 - DNA, 13 bp, Homo sapiens
cacagccagaacc

SEQ ID NO: 2172496 - DNA, 22 bp, Homo sapiens
cacaggaagccgcctagtgcag

SEQ ID NO: 2172497 - DNA, 19 bp, Homo sapiens
cacaggacgatttcactga

SEQ ID NO: 2172498 - DNA, 12 bp, Homo sapiens
cacaggcagacg

SEQ ID NO: 2172499 - DNA, 14 bp, Homo sapiens
cacagggcctgact

SEQ ID NO: 2172500 - DNA, 14 bp, Homo sapiens
cacaggtgagaaag

SEQ ID NO: 2172501 - DNA, 21 bp, Homo sapiens
cacaggtgtccccagcccact

SEQ ID NO: 2172502 - DNA, 18 bp, Homo sapiens
cacagtctctccctgggg

SEQ ID NO: 2172503 - DNA, 12 bp, Homo sapiens
cacataatttgc

SEQ ID NO: 2172504 - DNA, 20 bp, Homo sapiens
cacatccaacatttcctcag

SEQ ID NO: 2172505 - DNA, 20 bp, Homo sapiens
cacatgacatttgtcctgca

SEQ ID NO: 2172506 - DNA, 21 bp, Homo sapiens
cacatgacatttgtcctgcag

SEQ ID NO: 2172507 - DNA, 15 bp, Homo sapiens
cacatgctggacagg

SEQ ID NO: 2172508 - DNA, 19 bp, Homo sapiens
cacattaaagtaaagtaca

SEQ ID NO: 2172509 - DNA, 16 bp, Homo sapiens
caccaaacatactaga

SEQ ID NO: 2172510 - DNA, 20 bp, Homo sapiens
caccaaaccctgtcctccca

SEQ ID NO: 2172511 - DNA, 13 bp, Homo sapiens
caccaagcccaca

SEQ ID NO: 2172512 - DNA, 14 bp, Homo sapiens
caccaagcccacag

SEQ ID NO: 2172513 - DNA, 15 bp, Homo sapiens
caccaagcccacagg

SEQ ID NO: 2172514 - DNA, 16 bp, Homo sapiens
caccaatcctcaccta

SEQ ID NO: 2172515 - DNA, 14 bp, Homo sapiens
caccaccccccact

SEQ ID NO: 2172516 - DNA, 22 bp, Homo sapiens
caccaccccccactctgtgcct

SEQ ID NO: 2172517 - DNA, 16 bp, Homo sapiens
caccagccggggaaga

SEQ ID NO: 2172518 - DNA, 18 bp, Homo sapiens
caccatcttggccaggct

SEQ ID NO: 2172519 - DNA, 20 bp, Homo sapiens
caccatggctaaggcaccag

SEQ ID NO: 2172520 - DNA, 22 bp, Homo sapiens
caccatggctaaggcaccagcc

SEQ ID NO: 2172521 - DNA, 15 bp, Homo sapiens
caccattctccttcc

SEQ ID NO: 2172522 - DNA, 21 bp, Homo sapiens
cacccactccggattccggcc

SEQ ID NO: 2172523 - DNA, 19 bp, Homo sapiens
cacccccacaagctgtccc

SEQ ID NO: 2172524 - DNA, 12 bp, Homo sapiens
cacccccacacc

SEQ ID NO: 2172525 - DNA, 16 bp, Homo sapiens
cacccccgcctccctc

SEQ ID NO: 2172526 - DNA, 17 bp, Homo sapiens
cacccctccttccctgg

SEQ ID NO: 2172527 - DNA, 17 bp, Homo sapiens
caccccttggaggagag

SEQ ID NO: 2172528 - DNA, 14 bp, Homo sapiens
cacccgttaattta

SEQ ID NO: 2172529 - DNA, 17 bp, Homo sapiens
cacccgtttccaagcct

SEQ ID NO: 2172530 - DNA, 23 bp, Homo sapiens
cacccgtttccaagcctgggcca

SEQ ID NO: 2172531 - DNA, 18 bp, Homo sapiens
caccctaactgagctgcc

SEQ ID NO: 2172532 - DNA, 22 bp, Homo sapiens
caccctcagctggcggaacctg

SEQ ID NO: 2172533 - DNA, 16 bp, Homo sapiens
caccctctgcagggca

SEQ ID NO: 2172534 - DNA, 18 bp, Homo sapiens
caccctctgcagggcagc

SEQ ID NO: 2172535 - DNA, 19 bp, Homo sapiens
caccctctgcagggcagcc

SEQ ID NO: 2172536 - DNA, 14 bp, Homo sapiens
caccctgagccggc

SEQ ID NO: 2172537 - DNA, 20 bp, Homo sapiens
caccctgcttggggcctggc

SEQ ID NO: 2172538 - DNA, 21 bp, Homo sapiens
cacccttgcccacttctcctt

SEQ ID NO: 2172539 - DNA, 15 bp, Homo sapiens
caccggttgcttctg

SEQ ID NO: 2172540 - DNA, 21 bp, Homo sapiens
caccggttgcttctgggaagg

SEQ ID NO: 2172541 - DNA, 20 bp, Homo sapiens
caccgtaaagtgagcatgct

SEQ ID NO: 2172542 - DNA, 19 bp, Homo sapiens
cacctaagggctaaggcct

SEQ ID NO: 2172543 - DNA, 18 bp, Homo sapiens
cacctaccttcaaagctg

SEQ ID NO: 2172544 - DNA, 12 bp, Homo sapiens
cacctataaata

SEQ ID NO: 2172545 - DNA, 20 bp, Homo sapiens
cacctcccaggttcaagcga

SEQ ID NO: 2172546 - DNA, 14 bp, Homo sapiens
cacctcctctctgc

SEQ ID NO: 2172547 - DNA, 12 bp, Homo sapiens
cacctccttctc

SEQ ID NO: 2172548 - DNA, 22 bp, Homo sapiens
cacctctgtgctgcatcccacc

SEQ ID NO: 2172549 - DNA, 13 bp, Homo sapiens
cacctcttttcct

SEQ ID NO: 2172550 - DNA, 16 bp, Homo sapiens
cacctgagctttggac

SEQ ID NO: 2172551 - DNA, 13 bp, Homo sapiens
cacctgaggccca

SEQ ID NO: 2172552 - DNA, 16 bp, Homo sapiens
cacctgaggcccagca

SEQ ID NO: 2172553 - DNA, 18 bp, Homo sapiens
catggcctccagaggagg

SEQ ID NO: 2172554 - DNA, 16 bp, Homo sapiens
catggctaaggcacca

SEQ ID NO: 2172555 - DNA, 18 bp, Homo sapiens
catggctaaggcaccagc

SEQ ID NO: 2172556 - DNA, 19 bp, Homo sapiens
catggctaaggcaccagcc

SEQ ID NO: 2172557 - DNA, 15 bp, Homo sapiens
catggctcactgcag

SEQ ID NO: 2172558 - DNA, 15 bp, Homo sapiens
catgggtagcttctg

SEQ ID NO: 2172559 - DNA, 23 bp, Homo sapiens
catgggtagcttctgacctcagc

SEQ ID NO: 2172560 - DNA, 19 bp, Homo sapiens
catgtagaagagggagaag

SEQ ID NO: 2172561 - DNA, 18 bp, Homo sapiens
catgtcatttcagaagtt

SEQ ID NO: 2172562 - DNA, 21 bp, Homo sapiens
catgtcgtggacacacacaga

SEQ ID NO: 2172563 - DNA, 23 bp, Homo sapiens
catgtgcagggtgggctggtgaa

SEQ ID NO: 2172564 - DNA, 17 bp, Homo sapiens
catgtgctgctgtggca

SEQ ID NO: 2172565 - DNA, 18 bp, Homo sapiens
catgtgtgctcttcttct

SEQ ID NO: 2172566 - DNA, 23 bp, Homo sapiens
catgtgtgtatcaccctcagctg

SEQ ID NO: 2172567 - DNA, 15 bp, Homo sapiens
catgtgttgtacaat

SEQ ID NO: 2172568 - DNA, 17 bp, Homo sapiens
catgttaatcctagctg

SEQ ID NO: 2172569 - DNA, 15 bp, Homo sapiens
catgttgctgacttt

SEQ ID NO: 2172570 - DNA, 13 bp, Homo sapiens
cattaaatgcaaa

SEQ ID NO: 2172571 - DNA, 15 bp, Homo sapiens
cattaaatgctttga

SEQ ID NO: 2172572 - DNA, 21 bp, Homo sapiens
cattagaaaccatgaaaaaat

SEQ ID NO: 2172573 - DNA, 22 bp, Homo sapiens
cattagaagatattagtcttgg

SEQ ID NO: 2172574 - DNA, 23 bp, Homo sapiens
cattcaaaaacatggccacatcc

SEQ ID NO: 2172575 - DNA, 16 bp, Homo sapiens
cattcagctctggaga

SEQ ID NO: 2172576 - DNA, 20 bp, Homo sapiens
cattcagctctggagaacag

SEQ ID NO: 2172577 - DNA, 19 bp, Homo sapiens
cattcaggaacctggacca

SEQ ID NO: 2172578 - DNA, 14 bp, Homo sapiens
cattcagtgagaca

SEQ ID NO: 2172579 - DNA, 14 bp, Homo sapiens
cattccatttctct

SEQ ID NO: 2172580 - DNA, 13 bp, Homo sapiens
cattcgcagcagc

SEQ ID NO: 2172581 - DNA, 14 bp, Homo sapiens
cattcgcagcagct

SEQ ID NO: 2172582 - DNA, 21 bp, Homo sapiens
cattcgcagtgcccagtgatg

SEQ ID NO: 2172583 - DNA, 18 bp, Homo sapiens
cattctaaaccaaaacag

SEQ ID NO: 2172584 - DNA, 15 bp, Homo sapiens
cattctaagtgtgtt

SEQ ID NO: 2172585 - DNA, 12 bp, Homo sapiens
cattctccttcc

SEQ ID NO: 2172586 - DNA, 15 bp, Homo sapiens
cattcttctctccca

SEQ ID NO: 2172587 - DNA, 16 bp, Homo sapiens
cattgaaacttgagtt

SEQ ID NO: 2172588 - DNA, 22 bp, Homo sapiens
cattgaaacttgagtttgtttc

SEQ ID NO: 2172589 - DNA, 13 bp, Homo sapiens
cattgaaatgtaa

SEQ ID NO: 2172590 - DNA, 15 bp, Homo sapiens
cattggcctctgtct

SEQ ID NO: 2172591 - DNA, 16 bp, Homo sapiens
cattggcctctgtctc

SEQ ID NO: 2172592 - DNA, 14 bp, Homo sapiens
cattggtggcttgg

SEQ ID NO: 2172593 - DNA, 17 bp, Homo sapiens
cattggttccctttgct

SEQ ID NO: 2172594 - DNA, 18 bp, Homo sapiens
cattggttccctttgctc

SEQ ID NO: 2172595 - DNA, 23 bp, Homo sapiens
cattgtttttaagaaaaacatgt

SEQ ID NO: 2172596 - DNA, 13 bp, Homo sapiens
catttaatagact

SEQ ID NO: 2172597 - DNA, 21 bp, Homo sapiens
catttaatgtagccatgggac

SEQ ID NO: 2172598 - DNA, 22 bp, Homo sapiens
catttattttgactgtgattta

SEQ ID NO: 2172599 - DNA, 20 bp, Homo sapiens
catttccagggcagcagccg

SEQ ID NO: 2172600 - DNA, 16 bp, Homo sapiens
catttccctgaacaga

SEQ ID NO: 2172601 - DNA, 19 bp, Homo sapiens
catttcctcaggcaattcc

SEQ ID NO: 2172602 - DNA, 13 bp, Homo sapiens
catttgcagctgc

SEQ ID NO: 2172603 - DNA, 11 bp, Homo sapiens
catttgccaac

SEQ ID NO: 2172604 - DNA, 19 bp, Homo sapiens
catttgccaactaatttta

SEQ ID NO: 2172605 - DNA, 14 bp, Homo sapiens
catttgccatgctg

SEQ ID NO: 2172606 - DNA, 15 bp, Homo sapiens
catttgccatgctgc

SEQ ID NO: 2172607 - DNA, 16 bp, Homo sapiens
catttgccatgctgct

SEQ ID NO: 2172608 - DNA, 22 bp, Homo sapiens
catttgccccaacttaagttta

SEQ ID NO: 2172609 - DNA, 23 bp, Homo sapiens
catttgctgattgtctgaaattt

SEQ ID NO: 2172610 - DNA, 14 bp, Homo sapiens
catttggaatcata

SEQ ID NO: 2172611 - DNA, 18 bp, Homo sapiens
catttgggactgtcttga

SEQ ID NO: 2172612 - DNA, 22 bp, Homo sapiens
catttgggactgtcttgagaaa

SEQ ID NO: 2172613 - DNA, 23 bp, Homo sapiens
catttgggagtttttatgagaaa

SEQ ID NO: 2172614 - DNA, 21 bp, Homo sapiens
catttgtaatttttttctagt

SEQ ID NO: 2172615 - DNA, 13 bp, Homo sapiens
catttgtcctgca

SEQ ID NO: 2172616 - DNA, 16 bp, Homo sapiens
cattttacgttttaga

SEQ ID NO: 2172617 - DNA, 22 bp, Homo sapiens
cattttacgttttagaaaattt

SEQ ID NO: 2172618 - DNA, 21 bp, Homo sapiens
cattttatcaggggaatttca

SEQ ID NO: 2172619 - DNA, 21 bp, Homo sapiens
cattttctgggttctgggtgg

SEQ ID NO: 2172620 - DNA, 13 bp, Homo sapiens
cattttgccaaaa

SEQ ID NO: 2172621 - DNA, 15 bp, Homo sapiens
cattttgcgatgtgt

SEQ ID NO: 2172622 - DNA, 19 bp, Homo sapiens
cattttgcgatgtgtttta

SEQ ID NO: 2172623 - DNA, 12 bp, Homo sapiens
catttttccaaa

SEQ ID NO: 2172624 - DNA, 20 bp, Homo sapiens
catttttttcactcagaatt

SEQ ID NO: 2172625 - DNA, 16 bp, Homo sapiens
ccaaaaacaaagtgca

SEQ ID NO: 2172626 - DNA, 21 bp, Homo sapiens
ccaaaaacaaagtgcaaagct

SEQ ID NO: 2172627 - DNA, 11 bp, Homo sapiens
ccaaaatatat

SEQ ID NO: 2172628 - DNA, 15 bp, Homo sapiens
ccaaaccctgtcctc

SEQ ID NO: 2172629 - DNA, 17 bp, Homo sapiens
ccaaactgtgtcacgca

SEQ ID NO: 2172630 - DNA, 20 bp, Homo sapiens
ccaaagctgacgaggctggg

SEQ ID NO: 2172631 - DNA, 21 bp, Homo sapiens
ccaaagctgacgaggctgggc

SEQ ID NO: 2172632 - DNA, 22 bp, Homo sapiens
ccaaagtgctgggattacaggt

SEQ ID NO: 2172633 - DNA, 23 bp, Homo sapiens
ccaaataaaggttttcactcctc

SEQ ID NO: 2172634 - DNA, 13 bp, Homo sapiens
ccaaatcctctcc

SEQ ID NO: 2172635 - DNA, 11 bp, Homo sapiens
ccaacagtggc

SEQ ID NO: 2172636 - DNA, 14 bp, Homo sapiens
ccaacataaaacaa

SEQ ID NO: 2172637 - DNA, 21 bp, Homo sapiens
ccaacatgaaggatcaaaaaa

SEQ ID NO: 2172638 - DNA, 15 bp, Homo sapiens
ccaaccacctctggc

SEQ ID NO: 2172639 - DNA, 19 bp, Homo sapiens
ccaaccacctctggccctg

SEQ ID NO: 2172640 - DNA, 21 bp, Homo sapiens
ccaaccacctctggccctgtt

SEQ ID NO: 2172641 - DNA, 11 bp, Homo sapiens
ccaacctcagc

SEQ ID NO: 2172642 - DNA, 15 bp, Homo sapiens
ccaactgctgcccca

SEQ ID NO: 2172643 - DNA, 14 bp, Homo sapiens
ccaactgtttccct

SEQ ID NO: 2172644 - DNA, 16 bp, Homo sapiens
ccaactgtttccctgc

SEQ ID NO: 2172645 - DNA, 19 bp, Homo sapiens
ccaactgtttccctgctga

SEQ ID NO: 2172646 - DNA, 18 bp, Homo sapiens
ccaagaacagcaggccca

SEQ ID NO: 2172647 - DNA, 18 bp, Homo sapiens
ccaagaagcagtggcctt

SEQ ID NO: 2172648 - DNA, 13 bp, Homo sapiens
ccaagaaggctgg

SEQ ID NO: 2172649 - DNA, 14 bp, Homo sapiens
ccaagaaggctggg

SEQ ID NO: 2172650 - DNA, 16 bp, Homo sapiens
ccaagccagattctct

SEQ ID NO: 2172651 - DNA, 15 bp, Homo sapiens
ccaagcctgggccac

SEQ ID NO: 2172652 - DNA, 19 bp, Homo sapiens
ccaagcctgggccactggc

SEQ ID NO: 2172653 - DNA, 23 bp, Homo sapiens
ccaagcctgggccactggcatct

SEQ ID NO: 2172654 - DNA, 22 bp, Homo sapiens
ccaagctggagtgcagtggtgc

SEQ ID NO: 2172655 - DNA, 18 bp, Homo sapiens
ccaagctgtatgtacttc

SEQ ID NO: 2172656 - DNA, 23 bp, Homo sapiens
ccaaggaaatattgagagagaag

SEQ ID NO: 2172657 - DNA, 22 bp, Homo sapiens
ccaaggcaaggggtgcctggga

SEQ ID NO: 2172658 - DNA, 17 bp, Homo sapiens
ccaaggcctatgccacc

SEQ ID NO: 2172659 - DNA, 19 bp, Homo sapiens
ccaaggcctatgccacctg

SEQ ID NO: 2172660 - DNA, 14 bp, Homo sapiens
ccaagggccctggc

SEQ ID NO: 2172661 - DNA, 23 bp, Homo sapiens
ccaagtcccaccggttgcttctg

SEQ ID NO: 2172662 - DNA, 18 bp, Homo sapiens
ccaagtctcaggaggagg

SEQ ID NO: 2172663 - DNA, 21 bp, Homo sapiens
ccaagtttactcaaccctctc

SEQ ID NO: 2172664 - DNA, 13 bp, Homo sapiens
ccaataattctgt

SEQ ID NO: 2172665 - DNA, 20 bp, Homo sapiens
ccaatatttataattaaaga

SEQ ID NO: 2172666 - DNA, 13 bp, Homo sapiens
ccaatcactgcct

SEQ ID NO: 2172667 - DNA, 14 bp, Homo sapiens
ccaatcctcaccta

SEQ ID NO: 2172668 - DNA, 18 bp, Homo sapiens
ccaatgtgcccagtcatg

SEQ ID NO: 2172669 - DNA, 14 bp, Homo sapiens
ccaattccttgtag

SEQ ID NO: 2172670 - DNA, 13 bp, Homo sapiens
ccacaaaaagaga

SEQ ID NO: 2172671 - DNA, 20 bp, Homo sapiens
ccacaagcaggctcaacata

SEQ ID NO: 2172672 - DNA, 20 bp, Homo sapiens
ccacaagctgtccctgcagg

SEQ ID NO: 2172673 - DNA, 13 bp, Homo sapiens
ccacagccatccc

SEQ ID NO: 2172674 - DNA, 19 bp, Homo sapiens
ccacagcccgcatgcagca

SEQ ID NO: 2172675 - DNA, 16 bp, Homo sapiens
cctgtctgcgccgctg

SEQ ID NO: 2172676 - DNA, 13 bp, Homo sapiens
cctgtcttggcct

SEQ ID NO: 2172677 - DNA, 15 bp, Homo sapiens
cctgtgcccttgctg

SEQ ID NO: 2172678 - DNA, 19 bp, Homo sapiens
cctgtgcccttgctgggtc

SEQ ID NO: 2172679 - DNA, 18 bp, Homo sapiens
cctgtggcaaatgccagg

SEQ ID NO: 2172680 - DNA, 15 bp, Homo sapiens
cctgtgggagaaggg

SEQ ID NO: 2172681 - DNA, 19 bp, Homo sapiens
cctgtgggagaagggacag

SEQ ID NO: 2172682 - DNA, 22 bp, Homo sapiens
cctgtggggggtaatccctgct

SEQ ID NO: 2172683 - DNA, 16 bp, Homo sapiens
cctgttcaaaatgtta

SEQ ID NO: 2172684 - DNA, 16 bp, Homo sapiens
ccttaacagttgtatt

SEQ ID NO: 2172685 - DNA, 15 bp, Homo sapiens
ccttacacttactgt

SEQ ID NO: 2172686 - DNA, 17 bp, Homo sapiens
ccttaccctactggctg

SEQ ID NO: 2172687 - DNA, 21 bp, Homo sapiens
ccttagcagcttctgtcctct

SEQ ID NO: 2172688 - DNA, 19 bp, Homo sapiens
ccttatgtaattattttct

SEQ ID NO: 2172689 - DNA, 17 bp, Homo sapiens
ccttatttttacttgta

SEQ ID NO: 2172690 - DNA, 21 bp, Homo sapiens
ccttatttttacttgtatgta

SEQ ID NO: 2172691 - DNA, 17 bp, Homo sapiens
ccttatttttatttatt

SEQ ID NO: 2172692 - DNA, 17 bp, Homo sapiens
ccttcaaagcttttgta

SEQ ID NO: 2172693 - DNA, 13 bp, Homo sapiens
ccttcaagacctt

SEQ ID NO: 2172694 - DNA, 18 bp, Homo sapiens
ccttcaagacgaggggca

SEQ ID NO: 2172695 - DNA, 19 bp, Homo sapiens
ccttcaagacgaggggcag

SEQ ID NO: 2172696 - DNA, 21 bp, Homo sapiens
ccttcaagacgaggggcaggg

SEQ ID NO: 2172697 - DNA, 22 bp, Homo sapiens
ccttcaagacgaggggcaggga

SEQ ID NO: 2172698 - DNA, 19 bp, Homo sapiens
ccttccaactgctgcccca

SEQ ID NO: 2172699 - DNA, 15 bp, Homo sapiens
ccttccacaccccca

SEQ ID NO: 2172700 - DNA, 19 bp, Homo sapiens
ccttccctaggcacctctg

SEQ ID NO: 2172701 - DNA, 18 bp, Homo sapiens
ccttcctcagaatagtga

SEQ ID NO: 2172702 - DNA, 16 bp, Homo sapiens
ccttcctgtccgccct

SEQ ID NO: 2172703 - DNA, 12 bp, Homo sapiens
ccttcctgtgcc

SEQ ID NO: 2172704 - DNA, 14 bp, Homo sapiens
ccttccttgctaat

SEQ ID NO: 2172705 - DNA, 22 bp, Homo sapiens
ccttctaatccatgtgctgctg

SEQ ID NO: 2172706 - DNA, 13 bp, Homo sapiens
ccttctcatcact

SEQ ID NO: 2172707 - DNA, 17 bp, Homo sapiens
ccttctcatcactcccc

SEQ ID NO: 2172708 - DNA, 21 bp, Homo sapiens
ccttctcatcactcccctcca

SEQ ID NO: 2172709 - DNA, 12 bp, Homo sapiens
ccttctcccctc

SEQ ID NO: 2172710 - DNA, 15 bp, Homo sapiens
ccttctcctcttgta

SEQ ID NO: 2172711 - DNA, 13 bp, Homo sapiens
ccttctgtgccca

SEQ ID NO: 2172712 - DNA, 15 bp, Homo sapiens
ccttcttccacagca

SEQ ID NO: 2172713 - DNA, 21 bp, Homo sapiens
ccttgagaccaagccggtgcc

SEQ ID NO: 2172714 - DNA, 16 bp, Homo sapiens
ccttgaggagtcttgt

SEQ ID NO: 2172715 - DNA, 14 bp, Homo sapiens
ccttgatgtcttga

SEQ ID NO: 2172716 - DNA, 13 bp, Homo sapiens
ccttgcactggtc

SEQ ID NO: 2172717 - DNA, 14 bp, Homo sapiens
ccttgccaaggccg

SEQ ID NO: 2172718 - DNA, 18 bp, Homo sapiens
ccttgccgctgggagagc

SEQ ID NO: 2172719 - DNA, 18 bp, Homo sapiens
ccttgctgcacctgaggc

SEQ ID NO: 2172720 - DNA, 17 bp, Homo sapiens
ccttgctgggtccaggg

SEQ ID NO: 2172721 - DNA, 17 bp, Homo sapiens
ccttggaggagagagac

SEQ ID NO: 2172722 - DNA, 19 bp, Homo sapiens
ccttggaggagagagaccc

SEQ ID NO: 2172723 - DNA, 20 bp, Homo sapiens
ccttggaggagagagacccc

SEQ ID NO: 2172724 - DNA, 14 bp, Homo sapiens
ccttgtccccacac

SEQ ID NO: 2172725 - DNA, 17 bp, Homo sapiens
ccttgtccccacactcc

SEQ ID NO: 2172726 - DNA, 12 bp, Homo sapiens
ccttgtctctca

SEQ ID NO: 2172727 - DNA, 14 bp, Homo sapiens
ccttgtctctcatt

SEQ ID NO: 2172728 - DNA, 12 bp, Homo sapiens
ccttgtctgctg

SEQ ID NO: 2172729 - DNA, 14 bp, Homo sapiens
ccttgtctgctgct

SEQ ID NO: 2172730 - DNA, 15 bp, Homo sapiens
ccttgtctgctgctc

SEQ ID NO: 2172731 - DNA, 16 bp, Homo sapiens
cctttagaatattaaa

SEQ ID NO: 2172732 - DNA, 13 bp, Homo sapiens
cctttattcttta

SEQ ID NO: 2172733 - DNA, 16 bp, Homo sapiens
cctttattctttaatt

SEQ ID NO: 2172734 - DNA, 20 bp, Homo sapiens
cctttccagtggcctggctc

SEQ ID NO: 2172735 - DNA, 11 bp, Homo sapiens
cctttcttcct

SEQ ID NO: 2172736 - DNA, 18 bp, Homo sapiens
cctttggcaaaaggcatg

SEQ ID NO: 2172737 - DNA, 15 bp, Homo sapiens
ccttttatgctcacc

SEQ ID NO: 2172738 - DNA, 17 bp, Homo sapiens
ccttttatgctcacctg

SEQ ID NO: 2172739 - DNA, 20 bp, Homo sapiens
ccttttgtgggtttctctgt

SEQ ID NO: 2172740 - DNA, 13 bp, Homo sapiens
cctttttccttgt

SEQ ID NO: 2172741 - DNA, 17 bp, Homo sapiens
cctttttccttgtcccc

SEQ ID NO: 2172742 - DNA, 23 bp, Homo sapiens
ccttttttttacggaattccaat

SEQ ID NO: 2172743 - DNA, 12 bp, Homo sapiens
cgaactcctggg

SEQ ID NO: 2172744 - DNA, 16 bp, Homo sapiens
cgaactcctgggctca

SEQ ID NO: 2172745 - DNA, 14 bp, Homo sapiens
cgaccagaggtggg

SEQ ID NO: 2172746 - DNA, 15 bp, Homo sapiens
cgactctcctgcctc

SEQ ID NO: 2172747 - DNA, 22 bp, Homo sapiens
cgactctcctgcctcagcctcc

SEQ ID NO: 2172748 - DNA, 22 bp, Homo sapiens
cgacttcttcggaggtggcagc

SEQ ID NO: 2172749 - DNA, 21 bp, Homo sapiens
cgagaaagaggcaccaggaag

SEQ ID NO: 2172750 - DNA, 15 bp, Homo sapiens
cgaggacccaggaaa

SEQ ID NO: 2172751 - DNA, 16 bp, Homo sapiens
cgaggcgaagctgagc

SEQ ID NO: 2172752 - DNA, 15 bp, Homo sapiens
cgaggctgggccaag

SEQ ID NO: 2172753 - DNA, 16 bp, Homo sapiens
cgaggctgggccaagc

SEQ ID NO: 2172754 - DNA, 15 bp, Homo sapiens
cgatatgagagggat

SEQ ID NO: 2172755 - DNA, 12 bp, Homo sapiens
cgatgagctggt

SEQ ID NO: 2172756 - DNA, 13 bp, Homo sapiens
cgatgtggtgacc

SEQ ID NO: 2172757 - DNA, 19 bp, Homo sapiens
cgatgtggtgaccccaccc

SEQ ID NO: 2172758 - DNA, 13 bp, Homo sapiens
cgcacaaggacat

SEQ ID NO: 2172759 - DNA, 16 bp, Homo sapiens
cgcactagcctccctc

SEQ ID NO: 2172760 - DNA, 13 bp, Homo sapiens
cgcagctccttcc

SEQ ID NO: 2172761 - DNA, 22 bp, Homo sapiens
cgcaggctgagtgcactggcag

SEQ ID NO: 2172762 - DNA, 22 bp, Homo sapiens
cgcagggccctctggggctcag

SEQ ID NO: 2172763 - DNA, 16 bp, Homo sapiens
cgcatgcagcagcttg

SEQ ID NO: 2172764 - DNA, 11 bp, Homo sapiens
cgcatgtgtgt

SEQ ID NO: 2172765 - DNA, 18 bp, Homo sapiens
cgccaaagaatgccttga

SEQ ID NO: 2172766 - DNA, 19 bp, Homo sapiens
cgccacatccccgctggct

SEQ ID NO: 2172767 - DNA, 16 bp, Homo sapiens
cgccagccctaggcta

SEQ ID NO: 2172768 - DNA, 23 bp, Homo sapiens
cgcccccctacccccttgtctgc

SEQ ID NO: 2172769 - DNA, 18 bp, Homo sapiens
cgccgctgtgctgttgtc

SEQ ID NO: 2172770 - DNA, 12 bp, Homo sapiens
cgccgtgcctgc

SEQ ID NO: 2172771 - DNA, 15 bp, Homo sapiens
cgcctcttgaccagg

SEQ ID NO: 2172772 - DNA, 12 bp, Homo sapiens
cgccttggcctc

SEQ ID NO: 2172773 - DNA, 15 bp, Homo sapiens
cgcgcgccggtgccg

SEQ ID NO: 2172774 - DNA, 18 bp, Homo sapiens
cgctcatgggcccctctg

SEQ ID NO: 2172775 - DNA, 19 bp, Homo sapiens
cgctcccaacacaaggtgg

SEQ ID NO: 2172776 - DNA, 14 bp, Homo sapiens
cgctggctgcactc

SEQ ID NO: 2172777 - DNA, 20 bp, Homo sapiens
cgctggctgggggcctcact

SEQ ID NO: 2172778 - DNA, 22 bp, Homo sapiens
cgcttccctacccacagggcct

SEQ ID NO: 2172779 - DNA, 16 bp, Homo sapiens
cgctttctcctgtgcc

SEQ ID NO: 2172780 - DNA, 17 bp, Homo sapiens
cgctttctcctgtgccc

SEQ ID NO: 2172781 - DNA, 13 bp, Homo sapiens
cggaattccaata

SEQ ID NO: 2172782 - DNA, 20 bp, Homo sapiens
cggaattccaatatttataa

SEQ ID NO: 2172783 - DNA, 23 bp, Homo sapiens
cggaattccaatatttataatta

SEQ ID NO: 2172784 - DNA, 22 bp, Homo sapiens
cggagaacatctgccttgctgc

SEQ ID NO: 2172785 - DNA, 21 bp, Homo sapiens
cggagacgtgatgaagggagg

SEQ ID NO: 2172786 - DNA, 21 bp, Homo sapiens
cggaggagggaagcatagaga

SEQ ID NO: 2172787 - DNA, 12 bp, Homo sapiens
cggaggcaaaag

SEQ ID NO: 2172788 - DNA, 14 bp, Homo sapiens
cggaggggatccag

SEQ ID NO: 2172789 - DNA, 23 bp, Homo sapiens
cggcagcctcaacctccctggct

SEQ ID NO: 2172790 - DNA, 23 bp, Homo sapiens
cggccaaggtgccaccaccctgc

SEQ ID NO: 2172791 - DNA, 17 bp, Homo sapiens
cggccactgcagtcacc

SEQ ID NO: 2172792 - DNA, 17 bp, Homo sapiens
cggcccccgccctctgc

SEQ ID NO: 2172793 - DNA, 18 bp, Homo sapiens
cggcccgccgtgcctgca

SEQ ID NO: 2172794 - DNA, 13 bp, Homo sapiens
cggccctggctgg

SEQ ID NO: 2172795 - DNA, 20 bp, Homo sapiens
cggccctggctggggacttg

SEQ ID NO: 2172796 - DNA, 22 bp, Homo sapiens
cggctaccccccgtctcctgcc

SEQ ID NO: 2172797 - DNA, 16 bp, Homo sapiens
cggctcgtgtatttat

SEQ ID NO: 2172798 - DNA, 15 bp, Homo sapiens
ctgcagtcacccctg

SEQ ID NO: 2172799 - DNA, 16 bp, Homo sapiens
ctgcatcagcctctgg

SEQ ID NO: 2172800 - DNA, 20 bp, Homo sapiens
ctgcatcagcctctggccag

SEQ ID NO: 2172801 - DNA, 13 bp, Homo sapiens
ctgcatcccacca

SEQ ID NO: 2172802 - DNA, 11 bp, Homo sapiens
ctgcatgcaga

SEQ ID NO: 2172803 - DNA, 15 bp, Homo sapiens
ctgcattttctgggt

SEQ ID NO: 2172804 - DNA, 22 bp, Homo sapiens
ctgccaagccagattctcttga

SEQ ID NO: 2172805 - DNA, 23 bp, Homo sapiens
ctgccaagccagattctcttgaa

SEQ ID NO: 2172806 - DNA, 15 bp, Homo sapiens
ctgccactaggctgg

SEQ ID NO: 2172807 - DNA, 22 bp, Homo sapiens
ctgccagtggggtcgtgaggca

SEQ ID NO: 2172808 - DNA, 20 bp, Homo sapiens
ctgccatgattttggccact

SEQ ID NO: 2172809 - DNA, 12 bp, Homo sapiens
ctgcccaccctc

SEQ ID NO: 2172810 - DNA, 13 bp, Homo sapiens
ctgcccagagctg

SEQ ID NO: 2172811 - DNA, 15 bp, Homo sapiens
ctgcccagagctggg

SEQ ID NO: 2172812 - DNA, 12 bp, Homo sapiens
ctgccccatccc

SEQ ID NO: 2172813 - DNA, 17 bp, Homo sapiens
ctgccccccctaagaga

SEQ ID NO: 2172814 - DNA, 17 bp, Homo sapiens
ctgcccccgctcatggg

SEQ ID NO: 2172815 - DNA, 15 bp, Homo sapiens
ctgcccctccctgct

SEQ ID NO: 2172816 - DNA, 18 bp, Homo sapiens
ctgcccctgccgcctgtg

SEQ ID NO: 2172817 - DNA, 14 bp, Homo sapiens
ctgccctctctcag

SEQ ID NO: 2172818 - DNA, 15 bp, Homo sapiens
ctgccgcctgtgccc

SEQ ID NO: 2172819 - DNA, 21 bp, Homo sapiens
ctgccgcctgtgcccttgctg

SEQ ID NO: 2172820 - DNA, 23 bp, Homo sapiens
ctgccgcctgtgcccttgctggg

SEQ ID NO: 2172821 - DNA, 17 bp, Homo sapiens
ctgccgggcaggtccca

SEQ ID NO: 2172822 - DNA, 22 bp, Homo sapiens
ctgccgggcaggtcccaggttg

SEQ ID NO: 2172823 - DNA, 14 bp, Homo sapiens
ctgccgtgagagcc

SEQ ID NO: 2172824 - DNA, 16 bp, Homo sapiens
ctgccgtgagagccca

SEQ ID NO: 2172825 - DNA, 22 bp, Homo sapiens
ctgcctagcactcacatgctgg

SEQ ID NO: 2172826 - DNA, 16 bp, Homo sapiens
ctgcctctgagccact

SEQ ID NO: 2172827 - DNA, 18 bp, Homo sapiens
ctgcctgcgcagctcctt

SEQ ID NO: 2172828 - DNA, 18 bp, Homo sapiens
ctgcctggcccagggagg

SEQ ID NO: 2172829 - DNA, 20 bp, Homo sapiens
ctgccttaaagtcagtaact

SEQ ID NO: 2172830 - DNA, 19 bp, Homo sapiens
ctgccttctcccctccaag

SEQ ID NO: 2172831 - DNA, 14 bp, Homo sapiens
ctgccttgctgcac

SEQ ID NO: 2172832 - DNA, 21 bp, Homo sapiens
ctgccttgctgcacctgaggc

SEQ ID NO: 2172833 - DNA, 15 bp, Homo sapiens
ctgcgaactgtgcag

SEQ ID NO: 2172834 - DNA, 16 bp, Homo sapiens
ctgcgcagggccctct

SEQ ID NO: 2172835 - DNA, 15 bp, Homo sapiens
ctgcgccgctgtgct

SEQ ID NO: 2172836 - DNA, 12 bp, Homo sapiens
ctgcggctgctg

SEQ ID NO: 2172837 - DNA, 15 bp, Homo sapiens
ctgcggtgggcagcc

SEQ ID NO: 2172838 - DNA, 18 bp, Homo sapiens
ctgcgtaggagagaacag

SEQ ID NO: 2172839 - DNA, 15 bp, Homo sapiens
ctgcgtcatggctca

SEQ ID NO: 2172840 - DNA, 17 bp, Homo sapiens
ctgcgtcatggctcaag

SEQ ID NO: 2172841 - DNA, 17 bp, Homo sapiens
ctgctaaatactgtaca

SEQ ID NO: 2172842 - DNA, 14 bp, Homo sapiens
ctgctacctgttct

SEQ ID NO: 2172843 - DNA, 15 bp, Homo sapiens
ctgctacctgttctt

SEQ ID NO: 2172844 - DNA, 23 bp, Homo sapiens
ctgctatgcagatgtctaagaca

SEQ ID NO: 2172845 - DNA, 18 bp, Homo sapiens
ctgctatttcccaagctg

SEQ ID NO: 2172846 - DNA, 17 bp, Homo sapiens
ctgctccacagaaaccc

SEQ ID NO: 2172847 - DNA, 20 bp, Homo sapiens
ctgctccacagaaaccctgt

SEQ ID NO: 2172848 - DNA, 14 bp, Homo sapiens
ctgctcctccctcc

SEQ ID NO: 2172849 - DNA, 18 bp, Homo sapiens
ctgctcggggctgagctg

SEQ ID NO: 2172850 - DNA, 17 bp, Homo sapiens
ctgctctaagcacacgg

SEQ ID NO: 2172851 - DNA, 22 bp, Homo sapiens
ctgctctcaaaatgtgaactga

SEQ ID NO: 2172852 - DNA, 16 bp, Homo sapiens
ctgctctctacccagc

SEQ ID NO: 2172853 - DNA, 13 bp, Homo sapiens
ctgctctgcccag

SEQ ID NO: 2172854 - DNA, 14 bp, Homo sapiens
ctgctctgcccaga

SEQ ID NO: 2172855 - DNA, 17 bp, Homo sapiens
ctgctgccatgattttg

SEQ ID NO: 2172856 - DNA, 15 bp, Homo sapiens
ctgctgctcccagcc

SEQ ID NO: 2172857 - DNA, 14 bp, Homo sapiens
ctgctggcacagac

SEQ ID NO: 2172858 - DNA, 20 bp, Homo sapiens
ctgctggccgggcacagctg

SEQ ID NO: 2172859 - DNA, 19 bp, Homo sapiens
ctgctggggccgccacggc

SEQ ID NO: 2172860 - DNA, 21 bp, Homo sapiens
ctgctggtacctgccctctat

SEQ ID NO: 2172861 - DNA, 20 bp, Homo sapiens
ctgctggtgaccggcctgga

SEQ ID NO: 2172862 - DNA, 19 bp, Homo sapiens
ctgctgtatccagaagaaa

SEQ ID NO: 2172863 - DNA, 20 bp, Homo sapiens
ctgctgtcagaccttcttcc

SEQ ID NO: 2172864 - DNA, 14 bp, Homo sapiens
ctgctgtggcatca

SEQ ID NO: 2172865 - DNA, 21 bp, Homo sapiens
ctgctgtgggtcagtgtgcca

SEQ ID NO: 2172866 - DNA, 21 bp, Homo sapiens
ctgcttcaatacccaaatcct

SEQ ID NO: 2172867 - DNA, 15 bp, Homo sapiens
ctgcttccaacaggc

SEQ ID NO: 2172868 - DNA, 15 bp, Homo sapiens
ctgcttggggcctgg

SEQ ID NO: 2172869 - DNA, 13 bp, Homo sapiens
ctgcttgtcatcc

SEQ ID NO: 2172870 - DNA, 22 bp, Homo sapiens
ctgctttatccaggggcttcac

SEQ ID NO: 2172871 - DNA, 13 bp, Homo sapiens
ctgctttgcacac

SEQ ID NO: 2172872 - DNA, 12 bp, Homo sapiens
ctgcttttaagt

SEQ ID NO: 2172873 - DNA, 23 bp, Homo sapiens
ctgcttttgtcactcggctttgg

SEQ ID NO: 2172874 - DNA, 14 bp, Homo sapiens
ctggaaaaattaag

SEQ ID NO: 2172875 - DNA, 14 bp, Homo sapiens
ctggaaaagtgttc

SEQ ID NO: 2172876 - DNA, 18 bp, Homo sapiens
ctggaaatccagctggtt

SEQ ID NO: 2172877 - DNA, 15 bp, Homo sapiens
ctggaagcctgctga

SEQ ID NO: 2172878 - DNA, 17 bp, Homo sapiens
ctggaatcgaggctgtg

SEQ ID NO: 2172879 - DNA, 21 bp, Homo sapiens
ctggaatcgaggctgtgtgtc

SEQ ID NO: 2172880 - DNA, 16 bp, Homo sapiens
ctggaatctactagaa

SEQ ID NO: 2172881 - DNA, 17 bp, Homo sapiens
ctggaatggggacctgg

SEQ ID NO: 2172882 - DNA, 22 bp, Homo sapiens
ctggaatggggacctggggtgg

SEQ ID NO: 2172883 - DNA, 21 bp, Homo sapiens
ctggacatttcatataaatgg

SEQ ID NO: 2172884 - DNA, 22 bp, Homo sapiens
ctggacatttcatataaatgga

SEQ ID NO: 2172885 - DNA, 13 bp, Homo sapiens
ctggaccagatgc

SEQ ID NO: 2172886 - DNA, 13 bp, Homo sapiens
ctggactggctgt

SEQ ID NO: 2172887 - DNA, 20 bp, Homo sapiens
ctggacttttgcagcttcct

SEQ ID NO: 2172888 - DNA, 22 bp, Homo sapiens
ctggacttttgcagcttccttc

SEQ ID NO: 2172889 - DNA, 17 bp, Homo sapiens
ctggagaaagagctgcc

SEQ ID NO: 2172890 - DNA, 18 bp, Homo sapiens
ctggagaaagagctgcct

SEQ ID NO: 2172891 - DNA, 21 bp, Homo sapiens
ctggagaaagagctgcctgga

SEQ ID NO: 2172892 - DNA, 21 bp, Homo sapiens
ctggagaacagtggttgcctg

SEQ ID NO: 2172893 - DNA, 23 bp, Homo sapiens
ctggagagtctcactcccctcct

SEQ ID NO: 2172894 - DNA, 16 bp, Homo sapiens
ctggagatactgatta

SEQ ID NO: 2172895 - DNA, 16 bp, Homo sapiens
ctggagccacctgtcc

SEQ ID NO: 2172896 - DNA, 19 bp, Homo sapiens
ctggagccacctgtcccac

SEQ ID NO: 2172897 - DNA, 16 bp, Homo sapiens
ctggagccactaacta

SEQ ID NO: 2172898 - DNA, 13 bp, Homo sapiens
ctggagctcctgg

SEQ ID NO: 2172899 - DNA, 15 bp, Homo sapiens
ctggagctcctggga

SEQ ID NO: 2172900 - DNA, 12 bp, Homo sapiens
ctggaggcctct

SEQ ID NO: 2172901 - DNA, 14 bp, Homo sapiens
ctggaggcctctgg

SEQ ID NO: 2172902 - DNA, 21 bp, Homo sapiens
ctggaggcctctgggcctcct

SEQ ID NO: 2172903 - DNA, 16 bp, Homo sapiens
ctggaggtctccaggg

SEQ ID NO: 2172904 - DNA, 18 bp, Homo sapiens
ctggaggtctccaggggc

SEQ ID NO: 2172905 - DNA, 16 bp, Homo sapiens
ctggatccagaagcta

SEQ ID NO: 2172906 - DNA, 19 bp, Homo sapiens
ctggatgagaaacagctca

SEQ ID NO: 2172907 - DNA, 22 bp, Homo sapiens
ctggatgggggtgcaggcagcc

SEQ ID NO: 2172908 - DNA, 20 bp, Homo sapiens
ctggcaaggactttgtacat

SEQ ID NO: 2172909 - DNA, 22 bp, Homo sapiens
ctggcacagacttcacacagca

SEQ ID NO: 2172910 - DNA, 14 bp, Homo sapiens
ctggcacccactcc

SEQ ID NO: 2172911 - DNA, 14 bp, Homo sapiens
ctggcaggagggtg

SEQ ID NO: 2172912 - DNA, 14 bp, Homo sapiens
ctggccaccacccc

SEQ ID NO: 2172913 - DNA, 14 bp, Homo sapiens
ctggccagacggcc

SEQ ID NO: 2172914 - DNA, 15 bp, Homo sapiens
ctggccgggcacagc

SEQ ID NO: 2172915 - DNA, 16 bp, Homo sapiens
ctggccgggcacagct

SEQ ID NO: 2172916 - DNA, 12 bp, Homo sapiens
ctggcctagtcc

SEQ ID NO: 2172917 - DNA, 17 bp, Homo sapiens
ctggcctagtcccttcc

SEQ ID NO: 2172918 - DNA, 14 bp, Homo sapiens
ctggcctcacctgg

SEQ ID NO: 2172919 - DNA, 14 bp, Homo sapiens
ctggcggaacctgg

SEQ ID NO: 2172920 - DNA, 16 bp, Homo sapiens
ctggctcacagactgg

SEQ ID NO: 2172921 - DNA, 11 bp, Homo sapiens
ctttgtattct

SEQ ID NO: 2172922 - DNA, 18 bp, Homo sapiens
ctttgtattctctgtcca

SEQ ID NO: 2172923 - DNA, 14 bp, Homo sapiens
ctttgtcattttca

SEQ ID NO: 2172924 - DNA, 12 bp, Homo sapiens
ctttgtgtgctg

SEQ ID NO: 2172925 - DNA, 17 bp, Homo sapiens
ctttgttctttatttgt

SEQ ID NO: 2172926 - DNA, 17 bp, Homo sapiens
cttttaaaatttgtaga

SEQ ID NO: 2172927 - DNA, 12 bp, Homo sapiens
cttttaaatcat

SEQ ID NO: 2172928 - DNA, 13 bp, Homo sapiens
cttttaaatcatc

SEQ ID NO: 2172929 - DNA, 19 bp, Homo sapiens
cttttaatgatactgtcta

SEQ ID NO: 2172930 - DNA, 20 bp, Homo sapiens
cttttacagcttttctcttt

SEQ ID NO: 2172931 - DNA, 20 bp, Homo sapiens
cttttactgtggaggtggct

SEQ ID NO: 2172932 - DNA, 17 bp, Homo sapiens
cttttagacagtggtaa

SEQ ID NO: 2172933 - DNA, 21 bp, Homo sapiens
cttttagtacccacctgagct

SEQ ID NO: 2172934 - DNA, 22 bp, Homo sapiens
cttttagtacccacctgagctt

SEQ ID NO: 2172935 - DNA, 22 bp, Homo sapiens
cttttcctagttttatgtttct

SEQ ID NO: 2172936 - DNA, 16 bp, Homo sapiens
cttttctggctcctgt

SEQ ID NO: 2172937 - DNA, 22 bp, Homo sapiens
cttttctggtaggttctgtctg

SEQ ID NO: 2172938 - DNA, 20 bp, Homo sapiens
cttttctgtttgaaaaacct

SEQ ID NO: 2172939 - DNA, 20 bp, Homo sapiens
cttttgaactcacgagcctt

SEQ ID NO: 2172940 - DNA, 18 bp, Homo sapiens
cttttgaccccttcctgt

SEQ ID NO: 2172941 - DNA, 15 bp, Homo sapiens
cttttgcaaccagga

SEQ ID NO: 2172942 - DNA, 17 bp, Homo sapiens
cttttgcaaccaggaac

SEQ ID NO: 2172943 - DNA, 20 bp, Homo sapiens
cttttgccttttgcaaccag

SEQ ID NO: 2172944 - DNA, 11 bp, Homo sapiens
cttttggaaag

SEQ ID NO: 2172945 - DNA, 12 bp, Homo sapiens
cttttggaaagt

SEQ ID NO: 2172946 - DNA, 16 bp, Homo sapiens
cttttgggaagccagg

SEQ ID NO: 2172947 - DNA, 15 bp, Homo sapiens
cttttgtacttttca

SEQ ID NO: 2172948 - DNA, 17 bp, Homo sapiens
cttttgtgggtttctct

SEQ ID NO: 2172949 - DNA, 22 bp, Homo sapiens
cttttgtgggtttctctgtgct

SEQ ID NO: 2172950 - DNA, 14 bp, Homo sapiens
ctttttaattagta

SEQ ID NO: 2172951 - DNA, 17 bp, Homo sapiens
ctttttccttgtcccca

SEQ ID NO: 2172952 - DNA, 17 bp, Homo sapiens
ctttttctgtctctctt

SEQ ID NO: 2172953 - DNA, 22 bp, Homo sapiens
ctttttcttgtaaacctggagg

SEQ ID NO: 2172954 - DNA, 15 bp, Homo sapiens
ctttttgtgtttttt

SEQ ID NO: 2172955 - DNA, 21 bp, Homo sapiens
cttttttcttccccctccatg

SEQ ID NO: 2172956 - DNA, 23 bp, Homo sapiens
gaaaaaagaaattccctggacca

SEQ ID NO: 2172957 - DNA, 14 bp, Homo sapiens
gaaaaaagattttt

SEQ ID NO: 2172958 - DNA, 16 bp, Homo sapiens
gaaaaaagatttttaa

SEQ ID NO: 2172959 - DNA, 17 bp, Homo sapiens
gaaaaacatgtcatgta

SEQ ID NO: 2172960 - DNA, 21 bp, Homo sapiens
gaaaaaggagcttacctccca

SEQ ID NO: 2172961 - DNA, 22 bp, Homo sapiens
gaaaaattaagttgttgaaagt

SEQ ID NO: 2172962 - DNA, 22 bp, Homo sapiens
gaaaacttcgtaagaacatgtt

SEQ ID NO: 2172963 - DNA, 22 bp, Homo sapiens
gaaaatggtcgagaaagaggca

SEQ ID NO: 2172964 - DNA, 14 bp, Homo sapiens
gaaaatgtccagga

SEQ ID NO: 2172965 - DNA, 11 bp, Homo sapiens
gaaaattacac

SEQ ID NO: 2172966 - DNA, 14 bp, Homo sapiens
gaaaattgtataaa

SEQ ID NO: 2172967 - DNA, 20 bp, Homo sapiens
gaaaattttatgtattttaa

SEQ ID NO: 2172968 - DNA, 15 bp, Homo sapiens
gaaactatgcaccta

SEQ ID NO: 2172969 - DNA, 13 bp, Homo sapiens
gaaacttccaaga

SEQ ID NO: 2172970 - DNA, 18 bp, Homo sapiens
gaaacttggttcccagaa

SEQ ID NO: 2172971 - DNA, 11 bp, Homo sapiens
gaaagaagcaa

SEQ ID NO: 2172972 - DNA, 14 bp, Homo sapiens
gaaagaagcaagac

SEQ ID NO: 2172973 - DNA, 15 bp, Homo sapiens
gaaagaagcaagaca

SEQ ID NO: 2172974 - DNA, 19 bp, Homo sapiens
gaaagaagggggccctgct

SEQ ID NO: 2172975 - DNA, 20 bp, Homo sapiens
gaaagaagggggccctgcta

SEQ ID NO: 2172976 - DNA, 17 bp, Homo sapiens
gaaagagagaagccagc

SEQ ID NO: 2172977 - DNA, 15 bp, Homo sapiens
gaaagagctgcctgg

SEQ ID NO: 2172978 - DNA, 17 bp, Homo sapiens
gaaagagctgcctggat

SEQ ID NO: 2172979 - DNA, 21 bp, Homo sapiens
gaaagaggcaccaggaagccg

SEQ ID NO: 2172980 - DNA, 23 bp, Homo sapiens
gaaagcaagaccttgattgcacc

SEQ ID NO: 2172981 - DNA, 14 bp, Homo sapiens
gaaagcagaggctg

SEQ ID NO: 2172982 - DNA, 19 bp, Homo sapiens
gaaagcagaggctggcctc

SEQ ID NO: 2172983 - DNA, 16 bp, Homo sapiens
gaaagctatgaatgtt

SEQ ID NO: 2172984 - DNA, 19 bp, Homo sapiens
gaaagctatgaatgttact

SEQ ID NO: 2172985 - DNA, 20 bp, Homo sapiens
gaaagctatgaatgttacta

SEQ ID NO: 2172986 - DNA, 22 bp, Homo sapiens
gaaagctgtgaaattgaagtcc

SEQ ID NO: 2172987 - DNA, 21 bp, Homo sapiens
gaaaggaagatgtaagaagct

SEQ ID NO: 2172988 - DNA, 21 bp, Homo sapiens
gaaagttgtgtaggcaccacc

SEQ ID NO: 2172989 - DNA, 16 bp, Homo sapiens
gaaatactcgttttta

SEQ ID NO: 2172990 - DNA, 16 bp, Homo sapiens
gaaatagctacagctg

SEQ ID NO: 2172991 - DNA, 14 bp, Homo sapiens
gaaattacaagttt

SEQ ID NO: 2172992 - DNA, 17 bp, Homo sapiens
gaaattacaagtttcag

SEQ ID NO: 2172993 - DNA, 13 bp, Homo sapiens
gaaattccctgga

SEQ ID NO: 2172994 - DNA, 15 bp, Homo sapiens
gaaattccctggacc

SEQ ID NO: 2172995 - DNA, 18 bp, Homo sapiens
gaaattccctggaccaga

SEQ ID NO: 2172996 - DNA, 22 bp, Homo sapiens
gaaattccctggaccagatgct

SEQ ID NO: 2172997 - DNA, 12 bp, Homo sapiens
gaaattgattga

SEQ ID NO: 2172998 - DNA, 16 bp, Homo sapiens
gaaatttgggttttta

SEQ ID NO: 2172999 - DNA, 14 bp, Homo sapiens
gaaattttctagaa

SEQ ID NO: 2173000 - DNA, 15 bp, Homo sapiens
gaaattttctagaat

SEQ ID NO: 2173001 - DNA, 13 bp, Homo sapiens
gaacagcaggccc

SEQ ID NO: 2173002 - DNA, 14 bp, Homo sapiens
gaacagcaggccca

SEQ ID NO: 2173003 - DNA, 21 bp, Homo sapiens
gaacagcaggcccacctacct

SEQ ID NO: 2173004 - DNA, 19 bp, Homo sapiens
gaacagtggttgcctgggg

SEQ ID NO: 2173005 - DNA, 19 bp, Homo sapiens
gaacatctgccttgctgca

SEQ ID NO: 2173006 - DNA, 18 bp, Homo sapiens
gaacatgttacgtgtgca

SEQ ID NO: 2173007 - DNA, 20 bp, Homo sapiens
gaacatgttacgtgtgcaac

SEQ ID NO: 2173008 - DNA, 14 bp, Homo sapiens
gaacattcagctct

SEQ ID NO: 2173009 - DNA, 17 bp, Homo sapiens
gaacattcagctctgga

SEQ ID NO: 2173010 - DNA, 18 bp, Homo sapiens
gaacattcagctctggag

SEQ ID NO: 2173011 - DNA, 18 bp, Homo sapiens
gaacattctgtcatcacc

SEQ ID NO: 2173012 - DNA, 13 bp, Homo sapiens
gaaccagagccac

SEQ ID NO: 2173013 - DNA, 14 bp, Homo sapiens
gaacccacactgca

SEQ ID NO: 2173014 - DNA, 22 bp, Homo sapiens
gaacccatttgccatgctgcta

SEQ ID NO: 2173015 - DNA, 22 bp, Homo sapiens
gaaccctggtgaggaagctcca

SEQ ID NO: 2173016 - DNA, 17 bp, Homo sapiens
gaacctggtggctggag

SEQ ID NO: 2173017 - DNA, 19 bp, Homo sapiens
gaactagtggtggctctga

SEQ ID NO: 2173018 - DNA, 13 bp, Homo sapiens
gaactatatttaa

SEQ ID NO: 2173019 - DNA, 23 bp, Homo sapiens
gaactatatttaataccaccaac

SEQ ID NO: 2173020 - DNA, 16 bp, Homo sapiens
gaactcacgagccttg

SEQ ID NO: 2173021 - DNA, 12 bp, Homo sapiens
gaactcatttca

SEQ ID NO: 2173022 - DNA, 14 bp, Homo sapiens
gaactcatttcaag

SEQ ID NO: 2173023 - DNA, 14 bp, Homo sapiens
gaactcccaagaac

SEQ ID NO: 2173024 - DNA, 20 bp, Homo sapiens
gaactcccaagaacagcagg

SEQ ID NO: 2173025 - DNA, 23 bp, Homo sapiens
gaactcttcctggaatgcattca

SEQ ID NO: 2173026 - DNA, 14 bp, Homo sapiens
gaactgagaccttg

SEQ ID NO: 2173027 - DNA, 16 bp, Homo sapiens
gaactgatgacactga

SEQ ID NO: 2173028 - DNA, 12 bp, Homo sapiens
gaactgctgcca

SEQ ID NO: 2173029 - DNA, 12 bp, Homo sapiens
gaactgtgcagt

SEQ ID NO: 2173030 - DNA, 20 bp, Homo sapiens
gaactgttgtttgatgtgta

SEQ ID NO: 2173031 - DNA, 14 bp, Homo sapiens
gaagaacttgaagt

SEQ ID NO: 2173032 - DNA, 17 bp, Homo sapiens
gaagaacttgaagtgaa

SEQ ID NO: 2173033 - DNA, 16 bp, Homo sapiens
gaagacaaaccactgt

SEQ ID NO: 2173034 - DNA, 20 bp, Homo sapiens
gaagacaaaccactgtacat

SEQ ID NO: 2173035 - DNA, 23 bp, Homo sapiens
gaagacaaaccactgtacatata

SEQ ID NO: 2173036 - DNA, 21 bp, Homo sapiens
gaagacactacagaggattct

SEQ ID NO: 2173037 - DNA, 14 bp, Homo sapiens
gaagagagcctgcc

SEQ ID NO: 2173038 - DNA, 15 bp, Homo sapiens
gaagagagcctgccc

SEQ ID NO: 2173039 - DNA, 15 bp, Homo sapiens
gaagagtccaggaag

SEQ ID NO: 2173040 - DNA, 19 bp, Homo sapiens
gaagatcactttgctctga

SEQ ID NO: 2173041 - DNA, 13 bp, Homo sapiens
gaagatcctaccc

SEQ ID NO: 2173042 - DNA, 18 bp, Homo sapiens
gaagatgtattcagagcc

SEQ ID NO: 2173043 - DNA, 14 bp, Homo sapiens
gactgaatttctat

SEQ ID NO: 2173044 - DNA, 16 bp, Homo sapiens
gactgagtgggaagcc

SEQ ID NO: 2173045 - DNA, 13 bp, Homo sapiens
gactgatgtcatc

SEQ ID NO: 2173046 - DNA, 19 bp, Homo sapiens
gactgatgtcatcttgagc

SEQ ID NO: 2173047 - DNA, 20 bp, Homo sapiens
gactgatgttaggctgggcc

SEQ ID NO: 2173048 - DNA, 21 bp, Homo sapiens
gactgatgttaggctgggccc

SEQ ID NO: 2173049 - DNA, 14 bp, Homo sapiens
gactgcaccttgtg

SEQ ID NO: 2173050 - DNA, 17 bp, Homo sapiens
gactgcaccttgtgaag

SEQ ID NO: 2173051 - DNA, 16 bp, Homo sapiens
gactgccaagccagat

SEQ ID NO: 2173052 - DNA, 23 bp, Homo sapiens
gactggagacaatgcagatgcca

SEQ ID NO: 2173053 - DNA, 14 bp, Homo sapiens
gactgggccctgcc

SEQ ID NO: 2173054 - DNA, 23 bp, Homo sapiens
gactgggggtgccaaccacctct

SEQ ID NO: 2173055 - DNA, 18 bp, Homo sapiens
gactgtattatacatggg

SEQ ID NO: 2173056 - DNA, 15 bp, Homo sapiens
gactgtcttgagaaa

SEQ ID NO: 2173057 - DNA, 12 bp, Homo sapiens
gactgtgattta

SEQ ID NO: 2173058 - DNA, 18 bp, Homo sapiens
gactgtgatttatttgga

SEQ ID NO: 2173059 - DNA, 22 bp, Homo sapiens
gacttaagacaaatgggactga

SEQ ID NO: 2173060 - DNA, 17 bp, Homo sapiens
gacttcacacagcacct

SEQ ID NO: 2173061 - DNA, 15 bp, Homo sapiens
gacttccatttggaa

SEQ ID NO: 2173062 - DNA, 24 bp, Homo sapiens
gacttccatttggaatcatatggg

SEQ ID NO: 2173063 - DNA, 19 bp, Homo sapiens
gacttccttattggttgaa

SEQ ID NO: 2173064 - DNA, 21 bp, Homo sapiens
gacttcttcggaggtggcagc

SEQ ID NO: 2173065 - DNA, 16 bp, Homo sapiens
gacttggccgcttccc

SEQ ID NO: 2173066 - DNA, 17 bp, Homo sapiens
gacttggttctgaagcc

SEQ ID NO: 2173067 - DNA, 20 bp, Homo sapiens
gacttgtgcctcttgggaga

SEQ ID NO: 2173068 - DNA, 21 bp, Homo sapiens
gacttgtgcctcttgggagac

SEQ ID NO: 2173069 - DNA, 13 bp, Homo sapiens
gactttagggact

SEQ ID NO: 2173070 - DNA, 12 bp, Homo sapiens
gacttttaaaat

SEQ ID NO: 2173071 - DNA, 13 bp, Homo sapiens
gacttttaaaatt

SEQ ID NO: 2173072 - DNA, 16 bp, Homo sapiens
gagaaacagctcagcc

SEQ ID NO: 2173073 - DNA, 24 bp, Homo sapiens
gagaaacttaaatgttattatctg

SEQ ID NO: 2173074 - DNA, 19 bp, Homo sapiens
gagaaagagagaagccagc

SEQ ID NO: 2173075 - DNA, 18 bp, Homo sapiens
gagaaagagctgcctgga

SEQ ID NO: 2173076 - DNA, 16 bp, Homo sapiens
gagaacaaaacctctt

SEQ ID NO: 2173077 - DNA, 19 bp, Homo sapiens
gagaacagtggttgcctgg

SEQ ID NO: 2173078 - DNA, 24 bp, Homo sapiens
gagaacatctgccttgctgcacct

SEQ ID NO: 2173079 - DNA, 17 bp, Homo sapiens
gagaacgggagtggcca

SEQ ID NO: 2173080 - DNA, 15 bp, Homo sapiens
gagaactcatttcaa

SEQ ID NO: 2173081 - DNA, 17 bp, Homo sapiens
gagaagagtccaggaag

SEQ ID NO: 2173082 - DNA, 11 bp, Homo sapiens
gagaagccagc

SEQ ID NO: 2173083 - DNA, 15 bp, Homo sapiens
gagaagccagccaca

SEQ ID NO: 2173084 - DNA, 20 bp, Homo sapiens
gagaaggcaagctggcagga

SEQ ID NO: 2173085 - DNA, 15 bp, Homo sapiens
gagaagggcttttct

SEQ ID NO: 2173086 - DNA, 22 bp, Homo sapiens
gagaaggggaggacctctgggc

SEQ ID NO: 2173087 - DNA, 18 bp, Homo sapiens
gagaagtcggccaggtag

SEQ ID NO: 2173088 - DNA, 18 bp, Homo sapiens
gagaatagcagtttcact

SEQ ID NO: 2173089 - DNA, 14 bp, Homo sapiens
gagaatcaaggccg

SEQ ID NO: 2173090 - DNA, 14 bp, Homo sapiens
gagaatgtgtgtag

SEQ ID NO: 2173091 - DNA, 15 bp, Homo sapiens
gagaattcagctgcc

SEQ ID NO: 2173092 - DNA, 14 bp, Homo sapiens
gagacagggtcctg

SEQ ID NO: 2173093 - DNA, 13 bp, Homo sapiens
gagaccagccttt

SEQ ID NO: 2173094 - DNA, 16 bp, Homo sapiens
gagacctggaaccaga

SEQ ID NO: 2173095 - DNA, 11 bp, Homo sapiens
gagagaagcca

SEQ ID NO: 2173096 - DNA, 12 bp, Homo sapiens
gagagaagccag

SEQ ID NO: 2173097 - DNA, 13 bp, Homo sapiens
gagagaagccagc

SEQ ID NO: 2173098 - DNA, 16 bp, Homo sapiens
gagagaccagcctttc

SEQ ID NO: 2173099 - DNA, 22 bp, Homo sapiens
gagagaccagcctttcttcctt

SEQ ID NO: 2173100 - DNA, 15 bp, Homo sapiens
gagagaccccgcacc

SEQ ID NO: 2173101 - DNA, 20 bp, Homo sapiens
gagagaccccgcacccggct

SEQ ID NO: 2173102 - DNA, 13 bp, Homo sapiens
gagagagtgtgga

SEQ ID NO: 2173103 - DNA, 22 bp, Homo sapiens
gagagccaaggcctatgccacc

SEQ ID NO: 2173104 - DNA, 18 bp, Homo sapiens
gagagcccaatcactgcc

SEQ ID NO: 2173105 - DNA, 19 bp, Homo sapiens
gagagcccaatcactgcct

SEQ ID NO: 2173106 - DNA, 21 bp, Homo sapiens
gagagcccaatcactgcctat

SEQ ID NO: 2173107 - DNA, 14 bp, Homo sapiens
gagagcgctggcct

SEQ ID NO: 2173108 - DNA, 17 bp, Homo sapiens
gagagcttcctgtttct

SEQ ID NO: 2173109 - DNA, 21 bp, Homo sapiens
gagaggaagccacgtgctgga

SEQ ID NO: 2173110 - DNA, 23 bp, Homo sapiens
gagaggaagccacgtgctggaga

SEQ ID NO: 2173111 - DNA, 11 bp, Homo sapiens
gagaggagaga

SEQ ID NO: 2173112 - DNA, 15 bp, Homo sapiens
gagaggagagaatga

SEQ ID NO: 2173113 - DNA, 21 bp, Homo sapiens
gagaggctctgaaagctgctt

SEQ ID NO: 2173114 - DNA, 13 bp, Homo sapiens
gagagggagcaag

SEQ ID NO: 2173115 - DNA, 17 bp, Homo sapiens
gagagggagcaagcctt

SEQ ID NO: 2173116 - DNA, 20 bp, Homo sapiens
gagaggggcctctggctgcc

SEQ ID NO: 2173117 - DNA, 22 bp, Homo sapiens
gagagtgtggaaaaaaaaagaa

SEQ ID NO: 2173118 - DNA, 15 bp, Homo sapiens
gagatgtagcaaatt

SEQ ID NO: 2173119 - DNA, 16 bp, Homo sapiens
gagatgtatgcccaaa

SEQ ID NO: 2173120 - DNA, 15 bp, Homo sapiens
gagcaaacctgcccc

SEQ ID NO: 2173121 - DNA, 14 bp, Homo sapiens
gagcacacaacagg

SEQ ID NO: 2173122 - DNA, 14 bp, Homo sapiens
gagcaggcaccagc

SEQ ID NO: 2173123 - DNA, 19 bp, Homo sapiens
gagcagtgtgtctcctgca

SEQ ID NO: 2173124 - DNA, 23 bp, Homo sapiens
gagcagtgtgtctcctgcatgca

SEQ ID NO: 2173125 - DNA, 18 bp, Homo sapiens
gagcatccgtctcccctc

SEQ ID NO: 2173126 - DNA, 21 bp, Homo sapiens
gagcatgaaactatgcaccta

SEQ ID NO: 2173127 - DNA, 15 bp, Homo sapiens
gagcatgtcgtggac

SEQ ID NO: 2173128 - DNA, 14 bp, Homo sapiens
gagcattttgtgtc

SEQ ID NO: 2173129 - DNA, 13 bp, Homo sapiens
gagccacaggcag

SEQ ID NO: 2173130 - DNA, 22 bp, Homo sapiens
gagccaccacacccagcctctg

SEQ ID NO: 2173131 - DNA, 19 bp, Homo sapiens
gagccacctgtcccacctc

SEQ ID NO: 2173132 - DNA, 14 bp, Homo sapiens
gagccactaactag

SEQ ID NO: 2173133 - DNA, 22 bp, Homo sapiens
gagccccctgtccttcccacgg

SEQ ID NO: 2173134 - DNA, 16 bp, Homo sapiens
gagccctacttccagg

SEQ ID NO: 2173135 - DNA, 15 bp, Homo sapiens
gagccgttcctggga

SEQ ID NO: 2173136 - DNA, 23 bp, Homo sapiens
gagccgttcctgggactgtcaga

SEQ ID NO: 2173137 - DNA, 16 bp, Homo sapiens
gagccttttattaaca

SEQ ID NO: 2173138 - DNA, 17 bp, Homo sapiens
gagcggccgcctgtcct

SEQ ID NO: 2173139 - DNA, 19 bp, Homo sapiens
gagcggccgcctgtccttg

SEQ ID NO: 2173140 - DNA, 20 bp, Homo sapiens
gagctagagaggggcctctg

SEQ ID NO: 2173141 - DNA, 15 bp, Homo sapiens
gagctcaggagagag

SEQ ID NO: 2173142 - DNA, 11 bp, Homo sapiens
gagctgccagt

SEQ ID NO: 2173143 - DNA, 21 bp, Homo sapiens
gagctgcctggatgagaaaca

SEQ ID NO: 2173144 - DNA, 23 bp, Homo sapiens
gagctgcctggatgagaaacagc

SEQ ID NO: 2173145 - DNA, 15 bp, Homo sapiens
gaggaagccttgccc

SEQ ID NO: 2173146 - DNA, 15 bp, Homo sapiens
gaggaatcttttact

SEQ ID NO: 2173147 - DNA, 11 bp, Homo sapiens
gaggacccagg

SEQ ID NO: 2173148 - DNA, 12 bp, Homo sapiens
gaggacccagga

SEQ ID NO: 2173149 - DNA, 14 bp, Homo sapiens
gaggagagagaccc

SEQ ID NO: 2173150 - DNA, 17 bp, Homo sapiens
gaggagagagaccccgc

SEQ ID NO: 2173151 - DNA, 13 bp, Homo sapiens
gaggagcaaagca

SEQ ID NO: 2173152 - DNA, 14 bp, Homo sapiens
gaggagtcttgtgt

SEQ ID NO: 2173153 - DNA, 14 bp, Homo sapiens
gaggattctgtctt

SEQ ID NO: 2173154 - DNA, 18 bp, Homo sapiens
gaggcaccattcaggaac

SEQ ID NO: 2173155 - DNA, 21 bp, Homo sapiens
gaggcaccattcaggaacctg

SEQ ID NO: 2173156 - DNA, 17 bp, Homo sapiens
gaggcagaacctggtgg

SEQ ID NO: 2173157 - DNA, 19 bp, Homo sapiens
gaggcaggggctgggcaga

SEQ ID NO: 2173158 - DNA, 13 bp, Homo sapiens
gaggcagtggcag

SEQ ID NO: 2173159 - DNA, 16 bp, Homo sapiens
gaggcagtggcagcaa

SEQ ID NO: 2173160 - DNA, 15 bp, Homo sapiens
gaggcattcccagag

SEQ ID NO: 2173161 - DNA, 11 bp, Homo sapiens
gaggccctgga

SEQ ID NO: 2173162 - DNA, 13 bp, Homo sapiens
gaggccctggagg

SEQ ID NO: 2173163 - DNA, 14 bp, Homo sapiens
gaggccctggaggt

SEQ ID NO: 2173164 - DNA, 14 bp, Homo sapiens
gaggccgaggcagg

SEQ ID NO: 2173165 - DNA, 15 bp, Homo sapiens
gaggccgaggcaggg

SEQ ID NO: 2173166 - DNA, 18 bp, Homo sapiens
gcgatccctcccctcagc

SEQ ID NO: 2173167 - DNA, 20 bp, Homo sapiens
gcgcaaagtgctagccactg

SEQ ID NO: 2173168 - DNA, 13 bp, Homo sapiens
gcgcagctccttc

SEQ ID NO: 2173169 - DNA, 16 bp, Homo sapiens
gcgcagctccttccct

SEQ ID NO: 2173170 - DNA, 15 bp, Homo sapiens
gcgcatggtgcagtg

SEQ ID NO: 2173171 - DNA, 12 bp, Homo sapiens
gcgcatgtgtgt

SEQ ID NO: 2173172 - DNA, 15 bp, Homo sapiens
gcgctggctgcactc

SEQ ID NO: 2173173 - DNA, 16 bp, Homo sapiens
gcgctggctgcactca

SEQ ID NO: 2173174 - DNA, 18 bp, Homo sapiens
gcgctttctcctgtgccc

SEQ ID NO: 2173175 - DNA, 16 bp, Homo sapiens
gcggccgcctgtcctt

SEQ ID NO: 2173176 - DNA, 12 bp, Homo sapiens
gcgggaggccac

SEQ ID NO: 2173177 - DNA, 18 bp, Homo sapiens
gcggggagaagcctgggt

SEQ ID NO: 2173178 - DNA, 14 bp, Homo sapiens
gcgggtaaaaagag

SEQ ID NO: 2173179 - DNA, 18 bp, Homo sapiens
gcgggtaaaaagagaagg

SEQ ID NO: 2173180 - DNA, 22 bp, Homo sapiens
gcgggtaaaaagagaaggcaag

SEQ ID NO: 2173181 - DNA, 21 bp, Homo sapiens
gcggtcaataattgtggagag

SEQ ID NO: 2173182 - DNA, 23 bp, Homo sapiens
gcggtcaataattgtggagagga

SEQ ID NO: 2173183 - DNA, 18 bp, Homo sapiens
gcggtggaaggagcctgc

SEQ ID NO: 2173184 - DNA, 16 bp, Homo sapiens
gcggttgtaaatacaa

SEQ ID NO: 2173185 - DNA, 23 bp, Homo sapiens
gcgtcccagctgaaggcagtggc

SEQ ID NO: 2173186 - DNA, 18 bp, Homo sapiens
gcgtctgagcggccgcct

SEQ ID NO: 2173187 - DNA, 21 bp, Homo sapiens
gcgtctgagcggccgcctgtc

SEQ ID NO: 2173188 - DNA, 16 bp, Homo sapiens
gcgtgaagagcagtga

SEQ ID NO: 2173189 - DNA, 16 bp, Homo sapiens
gcgttgtgggcaggct

SEQ ID NO: 2173190 - DNA, 20 bp, Homo sapiens
gctaaagaggtggggtgaag

SEQ ID NO: 2173191 - DNA, 16 bp, Homo sapiens
gctaaatactgtacat

SEQ ID NO: 2173192 - DNA, 18 bp, Homo sapiens
gctaaatactgtacatag

SEQ ID NO: 2173193 - DNA, 19 bp, Homo sapiens
gctaaatactgtacataga

SEQ ID NO: 2173194 - DNA, 14 bp, Homo sapiens
gctaaccccgtctg

SEQ ID NO: 2173195 - DNA, 19 bp, Homo sapiens
gctaaccccgtctgctcct

SEQ ID NO: 2173196 - DNA, 15 bp, Homo sapiens
gctaaggcaccagcc

SEQ ID NO: 2173197 - DNA, 16 bp, Homo sapiens
gctaaggcctcttgct

SEQ ID NO: 2173198 - DNA, 22 bp, Homo sapiens
gctaaggcctcttgctggtgca

SEQ ID NO: 2173199 - DNA, 20 bp, Homo sapiens
gctaataaagttaaattgca

SEQ ID NO: 2173200 - DNA, 21 bp, Homo sapiens
gctacactcattgaaatgtaa

SEQ ID NO: 2173201 - DNA, 22 bp, Homo sapiens
gctacagctgtgtcccttcctg

SEQ ID NO: 2173202 - DNA, 18 bp, Homo sapiens
gctacctgatcccactcc

SEQ ID NO: 2173203 - DNA, 19 bp, Homo sapiens
gctacctgatcccactcct

SEQ ID NO: 2173204 - DNA, 20 bp, Homo sapiens
gctaccttttttttacggaa

SEQ ID NO: 2173205 - DNA, 17 bp, Homo sapiens
gctagaatatcctactt

SEQ ID NO: 2173206 - DNA, 20 bp, Homo sapiens
gctagagaggggcctctggc

SEQ ID NO: 2173207 - DNA, 21 bp, Homo sapiens
gctagagaggggcctctggct

SEQ ID NO: 2173208 - DNA, 23 bp, Homo sapiens
gctagagaggggcctctggctgc

SEQ ID NO: 2173209 - DNA, 14 bp, Homo sapiens
gctagccatatatt

SEQ ID NO: 2173210 - DNA, 16 bp, Homo sapiens
gctagctcccctcctc

SEQ ID NO: 2173211 - DNA, 19 bp, Homo sapiens
gctaggccccagaggccct

SEQ ID NO: 2173212 - DNA, 21 bp, Homo sapiens
gctaggccccagaggccctgg

SEQ ID NO: 2173213 - DNA, 22 bp, Homo sapiens
gctaggccccagaggccctgga

SEQ ID NO: 2173214 - DNA, 21 bp, Homo sapiens
gctatgaagactacttttaga

SEQ ID NO: 2173215 - DNA, 12 bp, Homo sapiens
gctatgaatgtt

SEQ ID NO: 2173216 - DNA, 15 bp, Homo sapiens
gctatgaatgttact

SEQ ID NO: 2173217 - DNA, 19 bp, Homo sapiens
gctatggatggggcccagg

SEQ ID NO: 2173218 - DNA, 22 bp, Homo sapiens
gctatggattttctaaggaaga

SEQ ID NO: 2173219 - DNA, 17 bp, Homo sapiens
gctatgtaatttaataa

SEQ ID NO: 2173220 - DNA, 21 bp, Homo sapiens
gctattctttgaccaaactgt

SEQ ID NO: 2173221 - DNA, 17 bp, Homo sapiens
gctcacagactggagac

SEQ ID NO: 2173222 - DNA, 17 bp, Homo sapiens
gctcacggcagcctcaa

SEQ ID NO: 2173223 - DNA, 17 bp, Homo sapiens
gctcactgcagcctcga

SEQ ID NO: 2173224 - DNA, 14 bp, Homo sapiens
gctcagcatcctcc

SEQ ID NO: 2173225 - DNA, 15 bp, Homo sapiens
gctcagcatcctcca

SEQ ID NO: 2173226 - DNA, 18 bp, Homo sapiens
gctcagccccagcccagc

SEQ ID NO: 2173227 - DNA, 15 bp, Homo sapiens
gctcagccctgagct

SEQ ID NO: 2173228 - DNA, 16 bp, Homo sapiens
gctcagccctgagcta

SEQ ID NO: 2173229 - DNA, 21 bp, Homo sapiens
gctcagccctgagctggcctc

SEQ ID NO: 2173230 - DNA, 21 bp, Homo sapiens
gctcagctctggctcacagac

SEQ ID NO: 2173231 - DNA, 20 bp, Homo sapiens
gctcagtttggctgtaattt

SEQ ID NO: 2173232 - DNA, 21 bp, Homo sapiens
gctcatgggcccctctgactc

SEQ ID NO: 2173233 - DNA, 19 bp, Homo sapiens
gctccaccccactcacaga

SEQ ID NO: 2173234 - DNA, 18 bp, Homo sapiens
gctcccccattttaactt

SEQ ID NO: 2173235 - DNA, 23 bp, Homo sapiens
gctcccttcaagacgaggggcag

SEQ ID NO: 2173236 - DNA, 15 bp, Homo sapiens
gctccgaggacccag

SEQ ID NO: 2173237 - DNA, 14 bp, Homo sapiens
gctccgcctggcac

SEQ ID NO: 2173238 - DNA, 13 bp, Homo sapiens
gctccgctgtgtg

SEQ ID NO: 2173239 - DNA, 14 bp, Homo sapiens
gctcctgctccaca

SEQ ID NO: 2173240 - DNA, 17 bp, Homo sapiens
gctcctggagccagcca

SEQ ID NO: 2173241 - DNA, 20 bp, Homo sapiens
gctcctggagccagccaccc

SEQ ID NO: 2173242 - DNA, 15 bp, Homo sapiens
gctccttccctaggc

SEQ ID NO: 2173243 - DNA, 15 bp, Homo sapiens
gctcgggacttcaaa

SEQ ID NO: 2173244 - DNA, 14 bp, Homo sapiens
gctcgtgggctctg

SEQ ID NO: 2173245 - DNA, 18 bp, Homo sapiens
gctcgtgggctctggctc

SEQ ID NO: 2173246 - DNA, 21 bp, Homo sapiens
gctctatgggcagatctaccc

SEQ ID NO: 2173247 - DNA, 20 bp, Homo sapiens
gctctctacccagcccatct

SEQ ID NO: 2173248 - DNA, 12 bp, Homo sapiens
gctctgcccaga

SEQ ID NO: 2173249 - DNA, 18 bp, Homo sapiens
gctctgcccagagctggg

SEQ ID NO: 2173250 - DNA, 21 bp, Homo sapiens
gctctggaagcctgctgattt

SEQ ID NO: 2173251 - DNA, 16 bp, Homo sapiens
gctctggagccacctg

SEQ ID NO: 2173252 - DNA, 18 bp, Homo sapiens
gctctggagccacctgtc

SEQ ID NO: 2173253 - DNA, 22 bp, Homo sapiens
gctctggagccacctgtcccac

SEQ ID NO: 2173254 - DNA, 18 bp, Homo sapiens
gctctggctcacagactg

SEQ ID NO: 2173255 - DNA, 13 bp, Homo sapiens
gctctggctccct

SEQ ID NO: 2173256 - DNA, 19 bp, Homo sapiens
gctctggctccctgggacc

SEQ ID NO: 2173257 - DNA, 20 bp, Homo sapiens
gctctgtcgtggtagcagat

SEQ ID NO: 2173258 - DNA, 23 bp, Homo sapiens
gctcttagtcctccctgctcagc

SEQ ID NO: 2173259 - DNA, 14 bp, Homo sapiens
gctcttctcctcag

SEQ ID NO: 2173260 - DNA, 14 bp, Homo sapiens
gctcttcttctttc

SEQ ID NO: 2173261 - DNA, 16 bp, Homo sapiens
gctgaaaacacagaga

SEQ ID NO: 2173262 - DNA, 23 bp, Homo sapiens
gctgaacctgttcaaaatgttaa

SEQ ID NO: 2173263 - DNA, 12 bp, Homo sapiens
gctgaaggcagt

SEQ ID NO: 2173264 - DNA, 15 bp, Homo sapiens
gctgacgaggctggg

SEQ ID NO: 2173265 - DNA, 18 bp, Homo sapiens
gctgacgaggctgggcca

SEQ ID NO: 2173266 - DNA, 20 bp, Homo sapiens
gctgacttggttctgaagcc

SEQ ID NO: 2173267 - DNA, 21 bp, Homo sapiens
gctgagcgggtctagtggaaa

SEQ ID NO: 2173268 - DNA, 15 bp, Homo sapiens
gctgatttggtcacc

SEQ ID NO: 2173269 - DNA, 21 bp, Homo sapiens
gctgccatttccctgaacaga

SEQ ID NO: 2173270 - DNA, 21 bp, Homo sapiens
gctgcccccgctcatgggccc

SEQ ID NO: 2173271 - DNA, 21 bp, Homo sapiens
gctgcctcccttgtggcagca

SEQ ID NO: 2173272 - DNA, 16 bp, Homo sapiens
gctgcctggatgagaa

SEQ ID NO: 2173273 - DNA, 13 bp, Homo sapiens
gctgcgcagggct

SEQ ID NO: 2173274 - DNA, 17 bp, Homo sapiens
gctgcggtgggcagcca

SEQ ID NO: 2173275 - DNA, 15 bp, Homo sapiens
gctgctcccagccac

SEQ ID NO: 2173276 - DNA, 14 bp, Homo sapiens
gctgctcctcgcag

SEQ ID NO: 2173277 - DNA, 13 bp, Homo sapiens
gctgctctgccca

SEQ ID NO: 2173278 - DNA, 17 bp, Homo sapiens
gctgctctgcccagagc

SEQ ID NO: 2173279 - DNA, 19 bp, Homo sapiens
gctgctctgcccagagctg

SEQ ID NO: 2173280 - DNA, 13 bp, Homo sapiens
gctgctggttttg

SEQ ID NO: 2173281 - DNA, 16 bp, Homo sapiens
gctgctttatcaaaat

SEQ ID NO: 2173282 - DNA, 15 bp, Homo sapiens
gctggacaggtctgg

SEQ ID NO: 2173283 - DNA, 17 bp, Homo sapiens
gctggagaaagagctgc

SEQ ID NO: 2173284 - DNA, 19 bp, Homo sapiens
gctggagaaagagctgcct

SEQ ID NO: 2173285 - DNA, 21 bp, Homo sapiens
gctggagaaagagctgcctgg

SEQ ID NO: 2173286 - DNA, 22 bp, Homo sapiens
gctggagaaagagctgcctgga

SEQ ID NO: 2173287 - DNA, 15 bp, Homo sapiens
gggcttttgccactc

SEQ ID NO: 2173288 - DNA, 18 bp, Homo sapiens
ggggaagagagcctgccc

SEQ ID NO: 2173289 - DNA, 13 bp, Homo sapiens
ggggacagctttc

SEQ ID NO: 2173290 - DNA, 16 bp, Homo sapiens
ggggagacacctcaga

SEQ ID NO: 2173291 - DNA, 19 bp, Homo sapiens
ggggagatcggggccagag

SEQ ID NO: 2173292 - DNA, 19 bp, Homo sapiens
ggggaggccgaggcagggg

SEQ ID NO: 2173293 - DNA, 14 bp, Homo sapiens
ggggatccagccac

SEQ ID NO: 2173294 - DNA, 13 bp, Homo sapiens
ggggcaagctagg

SEQ ID NO: 2173295 - DNA, 21 bp, Homo sapiens
ggggccacagccagaaccccg

SEQ ID NO: 2173296 - DNA, 22 bp, Homo sapiens
ggggccactctctactggtagg

SEQ ID NO: 2173297 - DNA, 14 bp, Homo sapiens
ggggcccaggggct

SEQ ID NO: 2173298 - DNA, 18 bp, Homo sapiens
ggggcccaggggctttgg

SEQ ID NO: 2173299 - DNA, 14 bp, Homo sapiens
ggggcccctcggct

SEQ ID NO: 2173300 - DNA, 18 bp, Homo sapiens
ggggccgccacggcctgg

SEQ ID NO: 2173301 - DNA, 12 bp, Homo sapiens
ggggcctgcaga

SEQ ID NO: 2173302 - DNA, 14 bp, Homo sapiens
ggggcctggactgg

SEQ ID NO: 2173303 - DNA, 13 bp, Homo sapiens
ggggcgggaggcc

SEQ ID NO: 2173304 - DNA, 20 bp, Homo sapiens
ggggctcagccctgagctgg

SEQ ID NO: 2173305 - DNA, 13 bp, Homo sapiens
ggggctgggcaga

SEQ ID NO: 2173306 - DNA, 14 bp, Homo sapiens
ggggcttccctctg

SEQ ID NO: 2173307 - DNA, 18 bp, Homo sapiens
ggggctttggtggcccct

SEQ ID NO: 2173308 - DNA, 16 bp, Homo sapiens
ggggcttttgccactc

SEQ ID NO: 2173309 - DNA, 11 bp, Homo sapiens
gggggccctgc

SEQ ID NO: 2173310 - DNA, 13 bp, Homo sapiens
gggggccctgcta

SEQ ID NO: 2173311 - DNA, 22 bp, Homo sapiens
gggggtgtcacagaggcagtgg

SEQ ID NO: 2173312 - DNA, 14 bp, Homo sapiens
ggggtctgggaggc

SEQ ID NO: 2173313 - DNA, 13 bp, Homo sapiens
ggggttggctggg

SEQ ID NO: 2173314 - DNA, 14 bp, Homo sapiens
gggtaaaaagagaa

SEQ ID NO: 2173315 - DNA, 19 bp, Homo sapiens
gggtaggagggtgggaagg

SEQ ID NO: 2173316 - DNA, 23 bp, Homo sapiens
gggtcaggtcattttttttttct

SEQ ID NO: 2173317 - DNA, 15 bp, Homo sapiens
gggtctgggaggcag

SEQ ID NO: 2173318 - DNA, 17 bp, Homo sapiens
gggtctgggaggcaggt

SEQ ID NO: 2173319 - DNA, 19 bp, Homo sapiens
gggtgcaggcagccttgac

SEQ ID NO: 2173320 - DNA, 13 bp, Homo sapiens
gggtggcagaaat

SEQ ID NO: 2173321 - DNA, 22 bp, Homo sapiens
gggtggctcagcatcctccacg

SEQ ID NO: 2173322 - DNA, 17 bp, Homo sapiens
gggtgtcacagaggcag

SEQ ID NO: 2173323 - DNA, 16 bp, Homo sapiens
gggttccagcttccct

SEQ ID NO: 2173324 - DNA, 15 bp, Homo sapiens
gggttggaggcctca

SEQ ID NO: 2173325 - DNA, 13 bp, Homo sapiens
gggttggctgggt

SEQ ID NO: 2173326 - DNA, 20 bp, Homo sapiens
ggtaactgcctggcctggca

SEQ ID NO: 2173327 - DNA, 19 bp, Homo sapiens
ggtagcttctgacctcagc

SEQ ID NO: 2173328 - DNA, 17 bp, Homo sapiens
ggtaggagggtgggaag

SEQ ID NO: 2173329 - DNA, 18 bp, Homo sapiens
ggtatcaaacagctcagg

SEQ ID NO: 2173330 - DNA, 21 bp, Homo sapiens
ggtatcaaacagctcaggctg

SEQ ID NO: 2173331 - DNA, 15 bp, Homo sapiens
ggtattcaatttgat

SEQ ID NO: 2173332 - DNA, 21 bp, Homo sapiens
ggtcagtacccacctgagctt

SEQ ID NO: 2173333 - DNA, 10 bp, Homo sapiens
ggtccagatt

SEQ ID NO: 2173334 - DNA, 22 bp, Homo sapiens
ggtcctcacaagcctcttctga

SEQ ID NO: 2173335 - DNA, 17 bp, Homo sapiens
ggtcgtgctcatgtctg

SEQ ID NO: 2173336 - DNA, 16 bp, Homo sapiens
ggtcgtggtataacaa

SEQ ID NO: 2173337 - DNA, 18 bp, Homo sapiens
ggtctaaagtgagctcta

SEQ ID NO: 2173338 - DNA, 20 bp, Homo sapiens
ggtctgggagaggcagagtg

SEQ ID NO: 2173339 - DNA, 16 bp, Homo sapiens
ggtctgggaggcaggt

SEQ ID NO: 2173340 - DNA, 16 bp, Homo sapiens
ggtcttggtcatttgc

SEQ ID NO: 2173341 - DNA, 22 bp, Homo sapiens
ggtgaaaagtatggcagtggga

SEQ ID NO: 2173342 - DNA, 16 bp, Homo sapiens
ggtgaagctggggaca

SEQ ID NO: 2173343 - DNA, 19 bp, Homo sapiens
ggtgaagctggggacagct

SEQ ID NO: 2173344 - DNA, 13 bp, Homo sapiens
ggtgaaggcagaa

SEQ ID NO: 2173345 - DNA, 21 bp, Homo sapiens
ggtgaccaaaatccccttctc

SEQ ID NO: 2173346 - DNA, 19 bp, Homo sapiens
ggtgactgggccctgcctc

SEQ ID NO: 2173347 - DNA, 16 bp, Homo sapiens
ggtgagaattaaaata

SEQ ID NO: 2173348 - DNA, 22 bp, Homo sapiens
ggtgagtgccaccacactcagc

SEQ ID NO: 2173349 - DNA, 14 bp, Homo sapiens
ggtgagtttttctt

SEQ ID NO: 2173350 - DNA, 17 bp, Homo sapiens
ggtgatcgcacaaggac

SEQ ID NO: 2173351 - DNA, 21 bp, Homo sapiens
ggtgcagcggtggaaggagcc

SEQ ID NO: 2173352 - DNA, 22 bp, Homo sapiens
ggtgccaatggaacctcctttc

SEQ ID NO: 2173353 - DNA, 17 bp, Homo sapiens
ggtgccaccaccctgcc

SEQ ID NO: 2173354 - DNA, 15 bp, Homo sapiens
ggtgcttccctttca

SEQ ID NO: 2173355 - DNA, 15 bp, Homo sapiens
ggtggcccctcccca

SEQ ID NO: 2173356 - DNA, 14 bp, Homo sapiens
ggtggctggtcacg

SEQ ID NO: 2173357 - DNA, 16 bp, Homo sapiens
ggtggggaagagagcc

SEQ ID NO: 2173358 - DNA, 16 bp, Homo sapiens
ggtgggggcctgctgt

SEQ ID NO: 2173359 - DNA, 22 bp, Homo sapiens
ggtggtattggccgatgagctg

SEQ ID NO: 2173360 - DNA, 22 bp, Homo sapiens
ggtgtaaaatatctacctgccc

SEQ ID NO: 2173361 - DNA, 19 bp, Homo sapiens
ggtgtcacagaggcagtgg

SEQ ID NO: 2173362 - DNA, 16 bp, Homo sapiens
ggtgtccccagcccac

SEQ ID NO: 2173363 - DNA, 16 bp, Homo sapiens
ggtgtgttcgtggagc

SEQ ID NO: 2173364 - DNA, 21 bp, Homo sapiens
ggtgtgttcgtggagccacag

SEQ ID NO: 2173365 - DNA, 17 bp, Homo sapiens
ggttcaggtcagggcta

SEQ ID NO: 2173366 - DNA, 19 bp, Homo sapiens
ggttcaggtcagggctatg

SEQ ID NO: 2173367 - DNA, 14 bp, Homo sapiens
ggttccccaagggc

SEQ ID NO: 2173368 - DNA, 18 bp, Homo sapiens
ggttctggttagctcagc

SEQ ID NO: 2173369 - DNA, 10 bp, Homo sapiens
ggttgcatgt

SEQ ID NO: 2173370 - DNA, 14 bp, Homo sapiens
ggttgcctgggggc

SEQ ID NO: 2173371 - DNA, 15 bp, Homo sapiens
ggttgcttctgggaa

SEQ ID NO: 2173372 - DNA, 18 bp, Homo sapiens
ggttggaactgctgccat

SEQ ID NO: 2173373 - DNA, 15 bp, Homo sapiens
ggttgtcactcaaca

SEQ ID NO: 2173374 - DNA, 21 bp, Homo sapiens
ggtttctctgtgctctgaatg

SEQ ID NO: 2173375 - DNA, 10 bp, Homo sapiens
ggtttcttat

SEQ ID NO: 2173376 - DNA, 12 bp, Homo sapiens
ggttttccctgt

SEQ ID NO: 2173377 - DNA, 12 bp, Homo sapiens
ggtttttctctt

SEQ ID NO: 2173378 - DNA, 14 bp, Homo sapiens
ggttttttggccta

SEQ ID NO: 2173379 - DNA, 16 bp, Homo sapiens
ggtttttttgtctttc

SEQ ID NO: 2173380 - DNA, 15 bp, Homo sapiens
gtaaaaaacaaacat

SEQ ID NO: 2173381 - DNA, 17 bp, Homo sapiens
gtaaaaggcactgcaca

SEQ ID NO: 2173382 - DNA, 19 bp, Homo sapiens
gtaaaataaaaccaccaaa

SEQ ID NO: 2173383 - DNA, 16 bp, Homo sapiens
gtaaagggacactgga

SEQ ID NO: 2173384 - DNA, 22 bp, Homo sapiens
gtaaagtatgtattatttacat

SEQ ID NO: 2173385 - DNA, 15 bp, Homo sapiens
gtaacctttaaaaat

SEQ ID NO: 2173386 - DNA, 19 bp, Homo sapiens
gtaacctttaaaaatgtat

SEQ ID NO: 2173387 - DNA, 21 bp, Homo sapiens
gtaacgttaaatgaaaaaaga

SEQ ID NO: 2173388 - DNA, 21 bp, Homo sapiens
gtaagaccggaagctcctggt

SEQ ID NO: 2173389 - DNA, 23 bp, Homo sapiens
gtaataaaacccagcatgtacaa

SEQ ID NO: 2173390 - DNA, 13 bp, Homo sapiens
gtaatagctgaac

SEQ ID NO: 2173391 - DNA, 13 bp, Homo sapiens
gtaatccctgctt

SEQ ID NO: 2173392 - DNA, 23 bp, Homo sapiens
gtacaaaaattgttcaacctaaa

SEQ ID NO: 2173393 - DNA, 23 bp, Homo sapiens
gtacaaaaggagaagaggaacat

SEQ ID NO: 2173394 - DNA, 22 bp, Homo sapiens
gtacaaaagtaccatagaacag

SEQ ID NO: 2173395 - DNA, 21 bp, Homo sapiens
gtacaagtgctcagttccaat

SEQ ID NO: 2173396 - DNA, 16 bp, Homo sapiens
gtacagtatgtgtcta

SEQ ID NO: 2173397 - DNA, 13 bp, Homo sapiens
gtaccaaagctgt

SEQ ID NO: 2173398 - DNA, 19 bp, Homo sapiens
gtaccaaagctgtttttat

SEQ ID NO: 2173399 - DNA, 14 bp, Homo sapiens
gtacccacctgagc

SEQ ID NO: 2173400 - DNA, 20 bp, Homo sapiens
gtacctgcccccactcagca

SEQ ID NO: 2173401 - DNA, 22 bp, Homo sapiens
gtacctttctgacaataaataa

SEQ ID NO: 2173402 - DNA, 14 bp, Homo sapiens
gtactgggacattg

SEQ ID NO: 2173403 - DNA, 11 bp, Homo sapiens
gtactgtgctg

SEQ ID NO: 2173404 - DNA, 21 bp, Homo sapiens
gtagaagtggcatctgaaaac

SEQ ID NO: 2173405 - DNA, 15 bp, Homo sapiens
gtagacccctggctg

SEQ ID NO: 2173406 - DNA, 17 bp, Homo sapiens
gtagacccctggctggt

SEQ ID NO: 2173407 - DNA, 17 bp, Homo sapiens
gtagaggagcagggtct

SEQ ID NO: 2173408 - DNA, 15 bp, Homo sapiens
gtagataaagcactg

SEQ ID NO: 2173409 - DNA, 21 bp, Homo sapiens
gtagcagggtctttgtgtgct

SEQ ID NO: 2173410 - DNA, 16 bp, Homo sapiens
tgacatttctcaaagt

SEQ ID NO: 2173411 - DNA, 22 bp, Homo sapiens
tgacatttgtcctgcagagctg

SEQ ID NO: 2173412 - DNA, 14 bp, Homo sapiens
tgacattttgccaa

SEQ ID NO: 2173413 - DNA, 16 bp, Homo sapiens
tgaccaaaatcccctt

SEQ ID NO: 2173414 - DNA, 19 bp, Homo sapiens
tgaccagcactgaccccga

SEQ ID NO: 2173415 - DNA, 15 bp, Homo sapiens
tgaccagtttcttaa

SEQ ID NO: 2173416 - DNA, 22 bp, Homo sapiens
tgaccagtttcttttcttttgt

SEQ ID NO: 2173417 - DNA, 16 bp, Homo sapiens
tgaccataaattaatt

SEQ ID NO: 2173418 - DNA, 21 bp, Homo sapiens
tgaccatctctcttattaata

SEQ ID NO: 2173419 - DNA, 13 bp, Homo sapiens
tgaccatgcaatt

SEQ ID NO: 2173420 - DNA, 11 bp, Homo sapiens
tgaccccttcc

SEQ ID NO: 2173421 - DNA, 13 bp, Homo sapiens
tgaccccttcctg

SEQ ID NO: 2173422 - DNA, 13 bp, Homo sapiens
tgaccctcccttc

SEQ ID NO: 2173423 - DNA, 16 bp, Homo sapiens
tgaccctgcagagatg

SEQ ID NO: 2173424 - DNA, 16 bp, Homo sapiens
tgaccttaatttcttg

SEQ ID NO: 2173425 - DNA, 22 bp, Homo sapiens
tgaccttctcttagattatgtt

SEQ ID NO: 2173426 - DNA, 20 bp, Homo sapiens
tgaccttgaggagtcttgtg

SEQ ID NO: 2173427 - DNA, 15 bp, Homo sapiens
tgacgtattgtgaaa

SEQ ID NO: 2173428 - DNA, 13 bp, Homo sapiens
tgactcctgctgg

SEQ ID NO: 2173429 - DNA, 20 bp, Homo sapiens
tgactgatgttaggctgggc

SEQ ID NO: 2173430 - DNA, 14 bp, Homo sapiens
tgactggctttcct

SEQ ID NO: 2173431 - DNA, 21 bp, Homo sapiens
tgactgggccctgcctctgtt

SEQ ID NO: 2173432 - DNA, 23 bp, Homo sapiens
tgacttagttcttagaagctcac

SEQ ID NO: 2173433 - DNA, 19 bp, Homo sapiens
tgacttggttctgaagcca

SEQ ID NO: 2173434 - DNA, 17 bp, Homo sapiens
tgacttttacagctttt

SEQ ID NO: 2173435 - DNA, 16 bp, Homo sapiens
tgagaaaaaagaccct

SEQ ID NO: 2173436 - DNA, 15 bp, Homo sapiens
tgagaaacagctcag

SEQ ID NO: 2173437 - DNA, 19 bp, Homo sapiens
tgagaaacagctcagccag

SEQ ID NO: 2173438 - DNA, 20 bp, Homo sapiens
tgagaaacagctcagccagt

SEQ ID NO: 2173439 - DNA, 19 bp, Homo sapiens
tgagaaacttaaatgttat

SEQ ID NO: 2173440 - DNA, 21 bp, Homo sapiens
tgagaacagatctccaaagct

SEQ ID NO: 2173441 - DNA, 23 bp, Homo sapiens
tgagaaggggaggacctctgggc

SEQ ID NO: 2173442 - DNA, 18 bp, Homo sapiens
tgagaattcagctgcccc

SEQ ID NO: 2173443 - DNA, 17 bp, Homo sapiens
tgagaccaagccggtgc

SEQ ID NO: 2173444 - DNA, 17 bp, Homo sapiens
tgagacctggaaccaga

SEQ ID NO: 2173445 - DNA, 19 bp, Homo sapiens
tgagacggagtctcagtct

SEQ ID NO: 2173446 - DNA, 19 bp, Homo sapiens
tgagagaaagagagaagcc

SEQ ID NO: 2173447 - DNA, 22 bp, Homo sapiens
tgagagaaagagagaagccagc

SEQ ID NO: 2173448 - DNA, 23 bp, Homo sapiens
tgagagaaagagagaagccagcc

SEQ ID NO: 2173449 - DNA, 23 bp, Homo sapiens
tgagagagaagtcggccaggtag

SEQ ID NO: 2173450 - DNA, 15 bp, Homo sapiens
tgagagcgctggcct

SEQ ID NO: 2173451 - DNA, 22 bp, Homo sapiens
tgagatgtagcaaattccaata

SEQ ID NO: 2173452 - DNA, 12 bp, Homo sapiens
tgagattacagg

SEQ ID NO: 2173453 - DNA, 17 bp, Homo sapiens
tgagattacgctgcctt

SEQ ID NO: 2173454 - DNA, 20 bp, Homo sapiens
tgagcaaacctgccccatcc

SEQ ID NO: 2173455 - DNA, 18 bp, Homo sapiens
tgagcaagacgccctctc

SEQ ID NO: 2173456 - DNA, 14 bp, Homo sapiens
tgagcacacaacag

SEQ ID NO: 2173457 - DNA, 20 bp, Homo sapiens
tgagcacacaacaggctgtg

SEQ ID NO: 2173458 - DNA, 23 bp, Homo sapiens
tgagcacacaacaggctgtgtgt

SEQ ID NO: 2173459 - DNA, 18 bp, Homo sapiens
tgagcggccgcctgtcct

SEQ ID NO: 2173460 - DNA, 21 bp, Homo sapiens
tgagcgggtctagtggaaaga

SEQ ID NO: 2173461 - DNA, 20 bp, Homo sapiens
tgagcttgctggagagtggc

SEQ ID NO: 2173462 - DNA, 17 bp, Homo sapiens
tgagctttggacacaca

SEQ ID NO: 2173463 - DNA, 19 bp, Homo sapiens
tgagctttggacgcacaca

SEQ ID NO: 2173464 - DNA, 21 bp, Homo sapiens
tgagctttggacgcacacagc

SEQ ID NO: 2173465 - DNA, 20 bp, Homo sapiens
tgaggaagctccagtcctgc

SEQ ID NO: 2173466 - DNA, 14 bp, Homo sapiens
tgaggagcaaagca

SEQ ID NO: 2173467 - DNA, 17 bp, Homo sapiens
tgaggaggcagaaagca

SEQ ID NO: 2173468 - DNA, 15 bp, Homo sapiens
tgaggagtcttgtgt

SEQ ID NO: 2173469 - DNA, 20 bp, Homo sapiens
tgaggcagaacctggtggct

SEQ ID NO: 2173470 - DNA, 16 bp, Homo sapiens
tgaggcccagcagagc

SEQ ID NO: 2173471 - DNA, 16 bp, Homo sapiens
tgagggtcctgctggt

SEQ ID NO: 2173472 - DNA, 14 bp, Homo sapiens
tgagggtgtttttt

SEQ ID NO: 2173473 - DNA, 13 bp, Homo sapiens
tgaggtcaccagg

SEQ ID NO: 2173474 - DNA, 16 bp, Homo sapiens
tgaggtcaccagggga

SEQ ID NO: 2173475 - DNA, 15 bp, Homo sapiens
tgagtagcagaaaac

SEQ ID NO: 2173476 - DNA, 15 bp, Homo sapiens
tgagtagcatatata

SEQ ID NO: 2173477 - DNA, 11 bp, Homo sapiens
tgagtatgtgt

SEQ ID NO: 2173478 - DNA, 12 bp, Homo sapiens
tgagtatgtgtg

SEQ ID NO: 2173479 - DNA, 21 bp, Homo sapiens
tgagtcagtcagcgagtgctt

SEQ ID NO: 2173480 - DNA, 18 bp, Homo sapiens
tgagtcccttccaggcca

SEQ ID NO: 2173481 - DNA, 12 bp, Homo sapiens
tgagtcttgtaa

SEQ ID NO: 2173482 - DNA, 17 bp, Homo sapiens
tgagtgatcccatttct

SEQ ID NO: 2173483 - DNA, 20 bp, Homo sapiens
tgagtggggagacacctcag

SEQ ID NO: 2173484 - DNA, 23 bp, Homo sapiens
tgagtggggagacacctcagagc

SEQ ID NO: 2173485 - DNA, 21 bp, Homo sapiens
tgagtgtgacgggggttgggg

SEQ ID NO: 2173486 - DNA, 18 bp, Homo sapiens
tgagttgagtattacaca

SEQ ID NO: 2173487 - DNA, 14 bp, Homo sapiens
tgagtttgtttctt

SEQ ID NO: 2173488 - DNA, 18 bp, Homo sapiens
tgataaacagttgaataa

SEQ ID NO: 2173489 - DNA, 14 bp, Homo sapiens
tgataataaaattc

SEQ ID NO: 2173490 - DNA, 18 bp, Homo sapiens
tgatacacaggtgagaaa

SEQ ID NO: 2173491 - DNA, 15 bp, Homo sapiens
tgatactgacttttt

SEQ ID NO: 2173492 - DNA, 16 bp, Homo sapiens
tgatactgtctaagaa

SEQ ID NO: 2173493 - DNA, 19 bp, Homo sapiens
tgatagtgttttgtacttg

SEQ ID NO: 2173494 - DNA, 21 bp, Homo sapiens
tgatatacttgagtgtgcaag

SEQ ID NO: 2173495 - DNA, 15 bp, Homo sapiens
tgatatattctttcc

SEQ ID NO: 2173496 - DNA, 18 bp, Homo sapiens
tgatatatttataaatat

SEQ ID NO: 2173497 - DNA, 21 bp, Homo sapiens
tgatcatttgcagctgctggt

SEQ ID NO: 2173498 - DNA, 15 bp, Homo sapiens
tgatcctcctgtctt

SEQ ID NO: 2173499 - DNA, 17 bp, Homo sapiens
tgatctcagctcactgc

SEQ ID NO: 2173500 - DNA, 18 bp, Homo sapiens
tgatctgggaactcccaa

SEQ ID NO: 2173501 - DNA, 12 bp, Homo sapiens
tgatgatgtgtt

SEQ ID NO: 2173502 - DNA, 20 bp, Homo sapiens
tgatgatgtgtttaaactga

SEQ ID NO: 2173503 - DNA, 17 bp, Homo sapiens
tgatgattgccaacagt

SEQ ID NO: 2173504 - DNA, 19 bp, Homo sapiens
tgatgattgccaacagtgg

SEQ ID NO: 2173505 - DNA, 11 bp, Homo sapiens
tgatgggagta

SEQ ID NO: 2173506 - DNA, 22 bp, Homo sapiens
tgatgtcttgagagcgctggcc

SEQ ID NO: 2173507 - DNA, 16 bp, Homo sapiens
tgatgtgtatgtgttt

SEQ ID NO: 2173508 - DNA, 19 bp, Homo sapiens
tgatgtgtttaaactgagt

SEQ ID NO: 2173509 - DNA, 22 bp, Homo sapiens
tgattactctttgctttgtagt

SEQ ID NO: 2173510 - DNA, 19 bp, Homo sapiens
tgattattgagttctgaag

SEQ ID NO: 2173511 - DNA, 13 bp, Homo sapiens
tgattccatctcc

SEQ ID NO: 2173512 - DNA, 19 bp, Homo sapiens
tgattgaagtatctgtacc

SEQ ID NO: 2173513 - DNA, 20 bp, Homo sapiens
tgattgaagtatctgtacct

SEQ ID NO: 2173514 - DNA, 15 bp, Homo sapiens
tgattgtaagtccca

SEQ ID NO: 2173515 - DNA, 13 bp, Homo sapiens
tgatttatttgga

SEQ ID NO: 2173516 - DNA, 13 bp, Homo sapiens
tgatttcacatat

SEQ ID NO: 2173517 - DNA, 17 bp, Homo sapiens
tgatttctacaactgat

SEQ ID NO: 2173518 - DNA, 16 bp, Homo sapiens
tgattttcctgtgtcc

SEQ ID NO: 2173519 - DNA, 13 bp, Homo sapiens
tgattttgcaaat

SEQ ID NO: 2173520 - DNA, 18 bp, Homo sapiens
tgattttttttttaactt

SEQ ID NO: 2173521 - DNA, 23 bp, Homo sapiens
tgattttttttttaacttgaaaa

SEQ ID NO: 2173522 - DNA, 21 bp, Homo sapiens
tgcaaaaactctttgagaggg

SEQ ID NO: 2173523 - DNA, 10 bp, Homo sapiens
tgcaaagctg

SEQ ID NO: 2173524 - DNA, 12 bp, Homo sapiens
tgcaaaggcttc

SEQ ID NO: 2173525 - DNA, 17 bp, Homo sapiens
tgcaaagggacattgaa

SEQ ID NO: 2173526 - DNA, 15 bp, Homo sapiens
tgcaaataaagcctt

SEQ ID NO: 2173527 - DNA, 12 bp, Homo sapiens
tgcaaccaggaa

SEQ ID NO: 2173528 - DNA, 17 bp, Homo sapiens
tgcaaccaggaacagca

SEQ ID NO: 2173529 - DNA, 20 bp, Homo sapiens
tgcaaccaggaacagcaaat

SEQ ID NO: 2173530 - DNA, 15 bp, Homo sapiens
tgcaagcaaagaacc

SEQ ID NO: 2173531 - DNA, 23 bp, Homo sapiens
tgcaagtgagcaaacctgcccca

SEQ ID NO: 2173532 - DNA, 17 bp, Homo sapiens
tgtacagtatgtgtcta

SEQ ID NO: 2173533 - DNA, 18 bp, Homo sapiens
tgtacagtatgtgtctag

SEQ ID NO: 2173534 - DNA, 18 bp, Homo sapiens
tgtacagttgactggctt

SEQ ID NO: 2173535 - DNA, 15 bp, Homo sapiens
tgtacatagatgtat

SEQ ID NO: 2173536 - DNA, 14 bp, Homo sapiens
tgtaccaaagctgt

SEQ ID NO: 2173537 - DNA, 21 bp, Homo sapiens
tgtacctgcccccactcagca

SEQ ID NO: 2173538 - DNA, 12 bp, Homo sapiens
tgtactgtgctg

SEQ ID NO: 2173539 - DNA, 17 bp, Homo sapiens
tgtacttaaattacaca

SEQ ID NO: 2173540 - DNA, 14 bp, Homo sapiens
tgtagaagagggag

SEQ ID NO: 2173541 - DNA, 15 bp, Homo sapiens
tgtagaagagggaga

SEQ ID NO: 2173542 - DNA, 19 bp, Homo sapiens
tgtagaagagggagaagga

SEQ ID NO: 2173543 - DNA, 16 bp, Homo sapiens
tgtagagcagggcaag

SEQ ID NO: 2173544 - DNA, 16 bp, Homo sapiens
tgtagccagacagttt

SEQ ID NO: 2173545 - DNA, 15 bp, Homo sapiens
tgtagccatgggacc

SEQ ID NO: 2173546 - DNA, 20 bp, Homo sapiens
tgtagcctgcgtcatggctc

SEQ ID NO: 2173547 - DNA, 21 bp, Homo sapiens
tgtagcctgcgtcatggctca

SEQ ID NO: 2173548 - DNA, 14 bp, Homo sapiens
tgtaggcaccacct

SEQ ID NO: 2173549 - DNA, 23 bp, Homo sapiens
tgtagtggctcatgcctgtaatc

SEQ ID NO: 2173550 - DNA, 23 bp, Homo sapiens
tgtagtgtgtttgtgagtatgtg

SEQ ID NO: 2173551 - DNA, 15 bp, Homo sapiens
tgtataatgactttt

SEQ ID NO: 2173552 - DNA, 21 bp, Homo sapiens
tgtataatgacttttaaaatt

SEQ ID NO: 2173553 - DNA, 14 bp, Homo sapiens
tgtatatattatta

SEQ ID NO: 2173554 - DNA, 17 bp, Homo sapiens
tgtatattgtaatttaa

SEQ ID NO: 2173555 - DNA, 18 bp, Homo sapiens
tgtatatttgaaactgct

SEQ ID NO: 2173556 - DNA, 12 bp, Homo sapiens
tgtatgatgtat

SEQ ID NO: 2173557 - DNA, 15 bp, Homo sapiens
tgtatgtgtagtgtg

SEQ ID NO: 2173558 - DNA, 20 bp, Homo sapiens
tgtatgtgtttataattgtt

SEQ ID NO: 2173559 - DNA, 18 bp, Homo sapiens
tgtattaggactggcttt

SEQ ID NO: 2173560 - DNA, 18 bp, Homo sapiens
tgtattatttacatttaa

SEQ ID NO: 2173561 - DNA, 16 bp, Homo sapiens
tgtatttaacagaaat

SEQ ID NO: 2173562 - DNA, 20 bp, Homo sapiens
tgtatttagtaaaaataaat

SEQ ID NO: 2173563 - DNA, 20 bp, Homo sapiens
tgtatttgttgaaattaaaa

SEQ ID NO: 2173564 - DNA, 18 bp, Homo sapiens
tgtcaaagattttacctg

SEQ ID NO: 2173565 - DNA, 22 bp, Homo sapiens
tgtcaaccttgtgtgagtgtga

SEQ ID NO: 2173566 - DNA, 14 bp, Homo sapiens
tgtcacagaggcag

SEQ ID NO: 2173567 - DNA, 15 bp, Homo sapiens
tgtcacagaggcagt

SEQ ID NO: 2173568 - DNA, 18 bp, Homo sapiens
tgtcacccaggctggagt

SEQ ID NO: 2173569 - DNA, 22 bp, Homo sapiens
tgtcaggcacagtaagcatgct

SEQ ID NO: 2173570 - DNA, 14 bp, Homo sapiens
tgtcagttgaaaat

SEQ ID NO: 2173571 - DNA, 16 bp, Homo sapiens
tgtcatccaccagtgt

SEQ ID NO: 2173572 - DNA, 23 bp, Homo sapiens
tgtcattcccctcttttgtcttc

SEQ ID NO: 2173573 - DNA, 19 bp, Homo sapiens
tgtccaacaactgtcagaa

SEQ ID NO: 2173574 - DNA, 16 bp, Homo sapiens
tgtccaagtgtttctt

SEQ ID NO: 2173575 - DNA, 17 bp, Homo sapiens
tgtccaagtgtttcttg

SEQ ID NO: 2173576 - DNA, 18 bp, Homo sapiens
tgtccaggatcaaaagaa

SEQ ID NO: 2173577 - DNA, 20 bp, Homo sapiens
tgtcccacagcttggggcca

SEQ ID NO: 2173578 - DNA, 12 bp, Homo sapiens
tgtccccacact

SEQ ID NO: 2173579 - DNA, 16 bp, Homo sapiens
tgtccccacactccta

SEQ ID NO: 2173580 - DNA, 13 bp, Homo sapiens
tgtccccagccca

SEQ ID NO: 2173581 - DNA, 20 bp, Homo sapiens
tgtcccccacctcttttcct

SEQ ID NO: 2173582 - DNA, 16 bp, Homo sapiens
tgtccctggccatctc

SEQ ID NO: 2173583 - DNA, 12 bp, Homo sapiens
tgtccgccctct

SEQ ID NO: 2173584 - DNA, 13 bp, Homo sapiens
tgtccgccctctt

SEQ ID NO: 2173585 - DNA, 17 bp, Homo sapiens
tgtccgccctcttcccc

SEQ ID NO: 2173586 - DNA, 20 bp, Homo sapiens
tgtccttcccacggccactg

SEQ ID NO: 2173587 - DNA, 15 bp, Homo sapiens
tgtccttctcctctt

SEQ ID NO: 2173588 - DNA, 20 bp, Homo sapiens
tgtcgtggacacacacagac

SEQ ID NO: 2173589 - DNA, 21 bp, Homo sapiens
tgtctaaaatacttgagaaat

SEQ ID NO: 2173590 - DNA, 22 bp, Homo sapiens
tgtctaaaatacttgagaaatt

SEQ ID NO: 2173591 - DNA, 18 bp, Homo sapiens
tgtctaggtcagtaccca

SEQ ID NO: 2173592 - DNA, 21 bp, Homo sapiens
tgtctaggtcagtacccacct

SEQ ID NO: 2173593 - DNA, 17 bp, Homo sapiens
tgtctcattttgtatgt

SEQ ID NO: 2173594 - DNA, 21 bp, Homo sapiens
tgtctcattttgtatgtatgt

SEQ ID NO: 2173595 - DNA, 23 bp, Homo sapiens
tgtctccctataatgctggagcg

SEQ ID NO: 2173596 - DNA, 16 bp, Homo sapiens
tgtctctcattctctt

SEQ ID NO: 2173597 - DNA, 21 bp, Homo sapiens
tgtctctcattctctttcttt

SEQ ID NO: 2173598 - DNA, 18 bp, Homo sapiens
tgtctgcgccgctgtgct

SEQ ID NO: 2173599 - DNA, 19 bp, Homo sapiens
tgtctgcgccgctgtgctg

SEQ ID NO: 2173600 - DNA, 15 bp, Homo sapiens
tgtctgctgctccca

SEQ ID NO: 2173601 - DNA, 20 bp, Homo sapiens
tgtctggcaaggactttgta

SEQ ID NO: 2173602 - DNA, 13 bp, Homo sapiens
tgtctgtttcctt

SEQ ID NO: 2173603 - DNA, 22 bp, Homo sapiens
tgtcttacaaggcaggcctttc

SEQ ID NO: 2173604 - DNA, 19 bp, Homo sapiens
tgtcttcagatcctgctgc

SEQ ID NO: 2173605 - DNA, 21 bp, Homo sapiens
tgtcttcagatcctgctgccg

SEQ ID NO: 2173606 - DNA, 18 bp, Homo sapiens
tgtcttgatgactgctga

SEQ ID NO: 2173607 - DNA, 15 bp, Homo sapiens
tgtgaaagtctcctg

SEQ ID NO: 2173608 - DNA, 10 bp, Homo sapiens
tgtgaaattg

SEQ ID NO: 2173609 - DNA, 14 bp, Homo sapiens
tgtgaacatgcctt

SEQ ID NO: 2173610 - DNA, 22 bp, Homo sapiens
tgtgaacatgccttatatttgt

SEQ ID NO: 2173611 - DNA, 20 bp, Homo sapiens
tgtgactgatgttaggctgg

SEQ ID NO: 2173612 - DNA, 20 bp, Homo sapiens
tgtgagccactgtgcccagc

SEQ ID NO: 2173613 - DNA, 13 bp, Homo sapiens
tgtgagtatgtgt

SEQ ID NO: 2173614 - DNA, 14 bp, Homo sapiens
tgtgagtgtgtgca

SEQ ID NO: 2173615 - DNA, 13 bp, Homo sapiens
tgtgatctgggaa

SEQ ID NO: 2173616 - DNA, 19 bp, Homo sapiens
tgtgattgccatttcttcc

SEQ ID NO: 2173617 - DNA, 15 bp, Homo sapiens
tgtgatttatttgga

SEQ ID NO: 2173618 - DNA, 18 bp, Homo sapiens
tgtgcaacaggtaaacag

SEQ ID NO: 2173619 - DNA, 16 bp, Homo sapiens
tgtgcagtgtttttcc

SEQ ID NO: 2173620 - DNA, 15 bp, Homo sapiens
tgtgcattgtgtgtc

SEQ ID NO: 2173621 - DNA, 21 bp, Homo sapiens
tgtgcattgtgtgtcacaaag

SEQ ID NO: 2173622 - DNA, 15 bp, Homo sapiens
tgtgccaccctctgc

SEQ ID NO: 2173623 - DNA, 19 bp, Homo sapiens
tgtgccaccctctgcaggg

SEQ ID NO: 2173624 - DNA, 22 bp, Homo sapiens
tgtgccaccctctgcagggcag

SEQ ID NO: 2173625 - DNA, 20 bp, Homo sapiens
tgtgcccagcagtttcccag

SEQ ID NO: 2173626 - DNA, 14 bp, Homo sapiens
tgtgcccagctcag

SEQ ID NO: 2173627 - DNA, 13 bp, Homo sapiens
tgtgcccagtcat

SEQ ID NO: 2173628 - DNA, 19 bp, Homo sapiens
tgtgccccatcagcagctt

SEQ ID NO: 2173629 - DNA, 16 bp, Homo sapiens
tgtgcctcttgggaga

SEQ ID NO: 2173630 - DNA, 17 bp, Homo sapiens
tgtgcctcttgggagac

SEQ ID NO: 2173631 - DNA, 13 bp, Homo sapiens
tgtgcctggagct

SEQ ID NO: 2173632 - DNA, 19 bp, Homo sapiens
tgtgcctggagctcctggg

SEQ ID NO: 2173633 - DNA, 18 bp, Homo sapiens
tgtgctgcatcccaccag

SEQ ID NO: 2173634 - DNA, 15 bp, Homo sapiens
tgtgctgctgtggca

SEQ ID NO: 2173635 - DNA, 19 bp, Homo sapiens
tgtgctggagccactaact

SEQ ID NO: 2173636 - DNA, 20 bp, Homo sapiens
tgtgcttttgcaaaagaagt

SEQ ID NO: 2173637 - DNA, 22 bp, Homo sapiens
tgtgcttttgcaaaagaagttg

SEQ ID NO: 2173638 - DNA, 18 bp, Homo sapiens
tgtggagttattcactct

SEQ ID NO: 2173639 - DNA, 23 bp, Homo sapiens
tgtggatggaggtgatgaaaacc

SEQ ID NO: 2173640 - DNA, 20 bp, Homo sapiens
tgtggcgatatgagagggat

SEQ ID NO: 2173641 - DNA, 17 bp, Homo sapiens
tgtgggggtctgggagg

SEQ ID NO: 2173642 - DNA, 20 bp, Homo sapiens
tgtggtgatcgcacaaggac

SEQ ID NO: 2173643 - DNA, 13 bp, Homo sapiens
tgtggttgcatgt

SEQ ID NO: 2173644 - DNA, 13 bp, Homo sapiens
tgtgtaaaggaac

SEQ ID NO: 2173645 - DNA, 18 bp, Homo sapiens
tgtgtaaatctgaaaaac

SEQ ID NO: 2173646 - DNA, 14 bp, Homo sapiens
tgtgtacagtatgt

SEQ ID NO: 2173647 - DNA, 14 bp, Homo sapiens
tgtgtatgtgttta

SEQ ID NO: 2173648 - DNA, 13 bp, Homo sapiens
tgtgtcacgcagg

SEQ ID NO: 2173649 - DNA, 19 bp, Homo sapiens
tgtgtcctgtgtaaattag

SEQ ID NO: 2173650 - DNA, 15 bp, Homo sapiens
tgtgtctaccttgtt

SEQ ID NO: 2173651 - DNA, 16 bp, Homo sapiens
tgtgtttaaactgagt

SEQ ID NO: 2173652 - DNA, 17 bp, Homo sapiens
tgtgtttataattgtta

SEQ ID NO: 2173653 - DNA, 22 bp, Homo sapiens
tgtgtttgatatttgtgtaaag

SEQ ID NO: 2173654 - DNA, 21 bp, Homo sapiens
ttgtatatattattataatct

SEQ ID NO: 2173655 - DNA, 13 bp, Homo sapiens
ttgtatgatgtat

SEQ ID NO: 2173656 - DNA, 12 bp, Homo sapiens
ttgtatgtatgt

SEQ ID NO: 2173657 - DNA, 16 bp, Homo sapiens
ttgtattaaacttgaa

SEQ ID NO: 2173658 - DNA, 15 bp, Homo sapiens
ttgtattctctgtcc

SEQ ID NO: 2173659 - DNA, 21 bp, Homo sapiens
ttgtattctctgtccagggct

SEQ ID NO: 2173660 - DNA, 11 bp, Homo sapiens
ttgtccccaca

SEQ ID NO: 2173661 - DNA, 12 bp, Homo sapiens
ttgtccccacac

SEQ ID NO: 2173662 - DNA, 11 bp, Homo sapiens
ttgtcctgcag

SEQ ID NO: 2173663 - DNA, 22 bp, Homo sapiens
ttgtctaaaataggttttccct

SEQ ID NO: 2173664 - DNA, 11 bp, Homo sapiens
ttgtctctcat

SEQ ID NO: 2173665 - DNA, 16 bp, Homo sapiens
ttgtctgaaattttct

SEQ ID NO: 2173666 - DNA, 20 bp, Homo sapiens
ttgtctgccgtgagagccca

SEQ ID NO: 2173667 - DNA, 11 bp, Homo sapiens
ttgtctgctgc

SEQ ID NO: 2173668 - DNA, 16 bp, Homo sapiens
ttgtgaaatttgttaa

SEQ ID NO: 2173669 - DNA, 19 bp, Homo sapiens
ttgtgaaatttgttaatat

SEQ ID NO: 2173670 - DNA, 13 bp, Homo sapiens
ttgtgagtatgtg

SEQ ID NO: 2173671 - DNA, 17 bp, Homo sapiens
ttgtgcctcttgggaga

SEQ ID NO: 2173672 - DNA, 18 bp, Homo sapiens
ttgtgcctcttgggagac

SEQ ID NO: 2173673 - DNA, 13 bp, Homo sapiens
ttgtggagaggag

SEQ ID NO: 2173674 - DNA, 15 bp, Homo sapiens
ttgtggagaggagag

SEQ ID NO: 2173675 - DNA, 16 bp, Homo sapiens
ttgtggcccaagcctg

SEQ ID NO: 2173676 - DNA, 13 bp, Homo sapiens
ttgtggtgtctta

SEQ ID NO: 2173677 - DNA, 13 bp, Homo sapiens
ttgtgtaaaggaa

SEQ ID NO: 2173678 - DNA, 15 bp, Homo sapiens
ttgtgtacagtatgt

SEQ ID NO: 2173679 - DNA, 17 bp, Homo sapiens
ttgtgtacagtatgtgt

SEQ ID NO: 2173680 - DNA, 18 bp, Homo sapiens
ttgtgtacagtatgtgtc

SEQ ID NO: 2173681 - DNA, 16 bp, Homo sapiens
ttgtgtttgtatataa

SEQ ID NO: 2173682 - DNA, 14 bp, Homo sapiens
ttgttaagtgcttt

SEQ ID NO: 2173683 - DNA, 23 bp, Homo sapiens
ttgttaatatatataatacttaa

SEQ ID NO: 2173684 - DNA, 15 bp, Homo sapiens
ttgttaatattaatt

SEQ ID NO: 2173685 - DNA, 16 bp, Homo sapiens
ttgttacccatttgaa

SEQ ID NO: 2173686 - DNA, 21 bp, Homo sapiens
ttgttagatctgtagggactt

SEQ ID NO: 2173687 - DNA, 16 bp, Homo sapiens
ttgttagtgatttgct

SEQ ID NO: 2173688 - DNA, 12 bp, Homo sapiens
ttgttcatatca

SEQ ID NO: 2173689 - DNA, 21 bp, Homo sapiens
ttgttccactggaaacttaga

SEQ ID NO: 2173690 - DNA, 15 bp, Homo sapiens
ttgttccccttttct

SEQ ID NO: 2173691 - DNA, 23 bp, Homo sapiens
ttgttctcagaatcccttaacag

SEQ ID NO: 2173692 - DNA, 23 bp, Homo sapiens
ttgttgttttacatcttttggga

SEQ ID NO: 2173693 - DNA, 17 bp, Homo sapiens
ttgtttctacctcccag

SEQ ID NO: 2173694 - DNA, 16 bp, Homo sapiens
ttgtttgatgtgtatg

SEQ ID NO: 2173695 - DNA, 23 bp, Homo sapiens
ttgtttggatcaaaatctgtaga

SEQ ID NO: 2173696 - DNA, 22 bp, Homo sapiens
ttgttttaaggaaaaaagattt

SEQ ID NO: 2173697 - DNA, 20 bp, Homo sapiens
tttaaaaaaaaacattcaaa

SEQ ID NO: 2173698 - DNA, 19 bp, Homo sapiens
tttaaataaattatgaata

SEQ ID NO: 2173699 - DNA, 14 bp, Homo sapiens
tttaacagaaattg

SEQ ID NO: 2173700 - DNA, 16 bp, Homo sapiens
tttaacagaaattgta

SEQ ID NO: 2173701 - DNA, 15 bp, Homo sapiens
tttaactgcattcta

SEQ ID NO: 2173702 - DNA, 12 bp, Homo sapiens
tttaacttgaaa

SEQ ID NO: 2173703 - DNA, 15 bp, Homo sapiens
tttaacttgaaaaga

SEQ ID NO: 2173704 - DNA, 17 bp, Homo sapiens
tttaacttgaaaagatt

SEQ ID NO: 2173705 - DNA, 13 bp, Homo sapiens
tttaagcaattca

SEQ ID NO: 2173706 - DNA, 21 bp, Homo sapiens
tttaagtcctctaaacacact

SEQ ID NO: 2173707 - DNA, 13 bp, Homo sapiens
tttaataataaaa

SEQ ID NO: 2173708 - DNA, 21 bp, Homo sapiens
tttaatgatactgtctaagaa

SEQ ID NO: 2173709 - DNA, 22 bp, Homo sapiens
tttaattccccttcccttattt

SEQ ID NO: 2173710 - DNA, 18 bp, Homo sapiens
tttaatttttacatgacc

SEQ ID NO: 2173711 - DNA, 15 bp, Homo sapiens
tttaccacccccaca

SEQ ID NO: 2173712 - DNA, 17 bp, Homo sapiens
tttacggaattccaata

SEQ ID NO: 2173713 - DNA, 19 bp, Homo sapiens
tttacgtagtcatcaacaa

SEQ ID NO: 2173714 - DNA, 21 bp, Homo sapiens
tttactcaaccctctcaggtg

SEQ ID NO: 2173715 - DNA, 18 bp, Homo sapiens
tttagaaaacccaagttt

SEQ ID NO: 2173716 - DNA, 20 bp, Homo sapiens
tttagaaaacccaagttttt

SEQ ID NO: 2173717 - DNA, 14 bp, Homo sapiens
tttagaaattacaa

SEQ ID NO: 2173718 - DNA, 17 bp, Homo sapiens
tttagaaattacaagtt

SEQ ID NO: 2173719 - DNA, 19 bp, Homo sapiens
tttagaaattacaagtttc

SEQ ID NO: 2173720 - DNA, 15 bp, Homo sapiens
tttagacagtggtaa

SEQ ID NO: 2173721 - DNA, 19 bp, Homo sapiens
tttagattttcttttgcct

SEQ ID NO: 2173722 - DNA, 19 bp, Homo sapiens
tttagtacccacctgagct

SEQ ID NO: 2173723 - DNA, 15 bp, Homo sapiens
tttagtgcaatttct

SEQ ID NO: 2173724 - DNA, 13 bp, Homo sapiens
tttagtgccaggc

SEQ ID NO: 2173725 - DNA, 12 bp, Homo sapiens
tttagtttgttt

SEQ ID NO: 2173726 - DNA, 16 bp, Homo sapiens
tttataaactacaaaa

SEQ ID NO: 2173727 - DNA, 22 bp, Homo sapiens
tttataaatatgtgattatcat

SEQ ID NO: 2173728 - DNA, 21 bp, Homo sapiens
tttatagaagtggtgtttttt

SEQ ID NO: 2173729 - DNA, 24 bp, Homo sapiens
tttatggatcccaattcatttcat

SEQ ID NO: 2173730 - DNA, 22 bp, Homo sapiens
tttattaacatatattgttatt

SEQ ID NO: 2173731 - DNA, 14 bp, Homo sapiens
tttattagtgaagt

SEQ ID NO: 2173732 - DNA, 20 bp, Homo sapiens
tttattcacttgtgtttgta

SEQ ID NO: 2173733 - DNA, 19 bp, Homo sapiens
tttattgtaccaaagctgt

SEQ ID NO: 2173734 - DNA, 13 bp, Homo sapiens
tttatttccatat

SEQ ID NO: 2173735 - DNA, 17 bp, Homo sapiens
tttatttttgtactgtg

SEQ ID NO: 2173736 - DNA, 15 bp, Homo sapiens
tttcaaatctgtaat

SEQ ID NO: 2173737 - DNA, 18 bp, Homo sapiens
tttcaagctttcaaatcc

SEQ ID NO: 2173738 - DNA, 20 bp, Homo sapiens
tttcagaagttagtttgtat

SEQ ID NO: 2173739 - DNA, 18 bp, Homo sapiens
tttcagtgatttttagta

SEQ ID NO: 2173740 - DNA, 15 bp, Homo sapiens
tttcatctttccaaa

SEQ ID NO: 2173741 - DNA, 19 bp, Homo sapiens
tttcatctttccaaattga

SEQ ID NO: 2173742 - DNA, 21 bp, Homo sapiens
tttccccattcattcctgatg

SEQ ID NO: 2173743 - DNA, 21 bp, Homo sapiens
tttcccctcccgtcttcctcc

SEQ ID NO: 2173744 - DNA, 14 bp, Homo sapiens
tttccctgaacaga

SEQ ID NO: 2173745 - DNA, 11 bp, Homo sapiens
tttccctgctg

SEQ ID NO: 2173746 - DNA, 13 bp, Homo sapiens
tttcctcagtctc

SEQ ID NO: 2173747 - DNA, 22 bp, Homo sapiens
tttcctgtgtccacatctaaca

SEQ ID NO: 2173748 - DNA, 23 bp, Homo sapiens
tttctaaacagttgagtttcttc

SEQ ID NO: 2173749 - DNA, 22 bp, Homo sapiens
tttctaacactagtctgtgtgc

SEQ ID NO: 2173750 - DNA, 23 bp, Homo sapiens
tttctaccactggtgtaaaaaac

SEQ ID NO: 2173751 - DNA, 15 bp, Homo sapiens
tttctacctcccaga

SEQ ID NO: 2173752 - DNA, 15 bp, Homo sapiens
tttctagaatactaa

SEQ ID NO: 2173753 - DNA, 16 bp, Homo sapiens
tttctagttgtaatgt

SEQ ID NO: 2173754 - DNA, 20 bp, Homo sapiens
tttctattcagcaaaagtta

SEQ ID NO: 2173755 - DNA, 14 bp, Homo sapiens
tttctcaaagtttt

SEQ ID NO: 2173756 - DNA, 21 bp, Homo sapiens
tttctcaaagtttttacagtg

SEQ ID NO: 2173757 - DNA, 16 bp, Homo sapiens
tttctccgtatttatt

SEQ ID NO: 2173758 - DNA, 12 bp, Homo sapiens
tttctcctgtgc

SEQ ID NO: 2173759 - DNA, 21 bp, Homo sapiens
tttctctgcttcagcttgctt

SEQ ID NO: 2173760 - DNA, 11 bp, Homo sapiens
tttctctgtgc

SEQ ID NO: 2173761 - DNA, 15 bp, Homo sapiens
tttctgccttccttg

SEQ ID NO: 2173762 - DNA, 11 bp, Homo sapiens
tttctgggaaa

SEQ ID NO: 2173763 - DNA, 18 bp, Homo sapiens
tttctgttgtttctttta

SEQ ID NO: 2173764 - DNA, 12 bp, Homo sapiens
tttcttctgtag

SEQ ID NO: 2173765 - DNA, 17 bp, Homo sapiens
tttcttgagatctgctg

SEQ ID NO: 2173766 - DNA, 22 bp, Homo sapiens
tttcttgagatctgctgacaga

SEQ ID NO: 2173767 - DNA, 13 bp, Homo sapiens
tttctttttctgt

SEQ ID NO: 2173768 - DNA, 17 bp, Homo sapiens
tttctttttctgtctct

SEQ ID NO: 2173769 - DNA, 15 bp, Homo sapiens
tttctttttgtaatt

SEQ ID NO: 2173770 - DNA, 15 bp, Homo sapiens
tttgaacaactcgaa

SEQ ID NO: 2173771 - DNA, 16 bp, Homo sapiens
tttgaacaactcgaat

SEQ ID NO: 2173772 - DNA, 22 bp, Homo sapiens
tttgaacaactcgaatcactca

SEQ ID NO: 2173773 - DNA, 22 bp, Homo sapiens
tttgaactccgctgccttcctt

SEQ ID NO: 2173774 - DNA, 15 bp, Homo sapiens
tttgaataatgtagt

SEQ ID NO: 2173775 - DNA, 21 bp, Homo sapiens
tttgatgtgtatgtgtttata

SEQ ID NO: 2173776 - DNA, 13 bp, Homo sapiens
tttgattccattt

SEQ ID NO: 2173777 - DNA, 16 bp, Homo sapiens
acaattcaatcaaagc

SEQ ID NO: 2173778 - DNA, 14 bp, Homo sapiens
acaatttaatgtat

SEQ ID NO: 2173779 - DNA, 14 bp, Homo sapiens
acaattttctacca

SEQ ID NO: 2173780 - DNA, 18 bp, Homo sapiens
acaattttctaccactgg

SEQ ID NO: 2173781 - DNA, 13 bp, Homo sapiens
acacaaaaagaaa

SEQ ID NO: 2173782 - DNA, 14 bp, Homo sapiens
acacaacaccagga

SEQ ID NO: 2173783 - DNA, 14 bp, Homo sapiens
acacaacaggctgt

SEQ ID NO: 2173784 - DNA, 16 bp, Homo sapiens
acacaatctttccttg

SEQ ID NO: 2173785 - DNA, 13 bp, Homo sapiens
acacacacagctt

SEQ ID NO: 2173786 - DNA, 19 bp, Homo sapiens
acacacggttttggcagct

SEQ ID NO: 2173787 - DNA, 20 bp, Homo sapiens
acacacggttttggcagctg

SEQ ID NO: 2173788 - DNA, 21 bp, Homo sapiens
acacacggttttggcagctga

SEQ ID NO: 2173789 - DNA, 21 bp, Homo sapiens
acacacgtgtgatgtatgttg

SEQ ID NO: 2173790 - DNA, 21 bp, Homo sapiens
acacagtctggcagttgctaa

SEQ ID NO: 2173791 - DNA, 20 bp, Homo sapiens
acacatggcttcctaaatgg

SEQ ID NO: 2173792 - DNA, 18 bp, Homo sapiens
acaccaactgctctcaaa

SEQ ID NO: 2173793 - DNA, 20 bp, Homo sapiens
acaccaagagtagcaccttc

SEQ ID NO: 2173794 - DNA, 23 bp, Homo sapiens
acaccagctgttctgtcccttgg

SEQ ID NO: 2173795 - DNA, 22 bp, Homo sapiens
acaccaggacttaagacaaatg

SEQ ID NO: 2173796 - DNA, 15 bp, Homo sapiens
acaccagttactgtt

SEQ ID NO: 2173797 - DNA, 17 bp, Homo sapiens
acaccagttactgttca

SEQ ID NO: 2173798 - DNA, 20 bp, Homo sapiens
acaccagttactgttcatgg

SEQ ID NO: 2173799 - DNA, 12 bp, Homo sapiens
acacccatgcac

SEQ ID NO: 2173800 - DNA, 23 bp, Homo sapiens
aacgggagtggccatctggaaat

SEQ ID NO: 2173801 - DNA, 20 bp, Homo sapiens
aacgtgagagaaagagagaa

SEQ ID NO: 2173802 - DNA, 20 bp, Homo sapiens
aacgtgagctacatgtgtaa

SEQ ID NO: 2173803 - DNA, 17 bp, Homo sapiens
aacgtgttactggaaaa

SEQ ID NO: 2173804 - DNA, 15 bp, Homo sapiens
aactatgcacctata

SEQ ID NO: 2173805 - DNA, 24 bp, Homo sapiens
aactatgcacctataaatactaaa

SEQ ID NO: 2173806 - DNA, 14 bp, Homo sapiens
aactcaaacacaga

SEQ ID NO: 2173807 - DNA, 24 bp, Homo sapiens
aactcaaagcaagctcttctcctc

SEQ ID NO: 2173808 - DNA, 23 bp, Homo sapiens
aactcatactgtgctggagccac

SEQ ID NO: 2173809 - DNA, 13 bp, Homo sapiens
aactcccaagaac

SEQ ID NO: 2173810 - DNA, 16 bp, Homo sapiens
aactctgcccaccctc

SEQ ID NO: 2173811 - DNA, 19 bp, Homo sapiens
aactgaaagctttaatgtt

SEQ ID NO: 2173812 - DNA, 17 bp, Homo sapiens
aactgagctgccagtgg

SEQ ID NO: 2173813 - DNA, 22 bp, Homo sapiens
aactgatcatttgcagctgctg

SEQ ID NO: 2173814 - DNA, 20 bp, Homo sapiens
aactgctaaatactgtacat

SEQ ID NO: 2173815 - DNA, 22 bp, Homo sapiens
aactgtcagaataaagaacatt

SEQ ID NO: 2173816 - DNA, 22 bp, Homo sapiens
aactgtgcatcaaccaggaaga

SEQ ID NO: 2173817 - DNA, 21 bp, Homo sapiens
aacttaaatgttattatctgg

SEQ ID NO: 2173818 - DNA, 17 bp, Homo sapiens
aacttaagtttagaaat

SEQ ID NO: 2173819 - DNA, 21 bp, Homo sapiens
aacttaagtttagaaattaca

SEQ ID NO: 2173820 - DNA, 21 bp, Homo sapiens
aacttcagatacttgtgaaca

SEQ ID NO: 2173821 - DNA, 21 bp, Homo sapiens
aacttcatattaatataagtt

SEQ ID NO: 2173822 - DNA, 21 bp, Homo sapiens
aacttcattctaaaccaaaac

SEQ ID NO: 2173823 - DNA, 22 bp, Homo sapiens
aacttcattctaaaccaaaaca

SEQ ID NO: 2173824 - DNA, 20 bp, Homo sapiens
aacttccaagacctgactca

SEQ ID NO: 2173825 - DNA, 9 bp, Homo sapiens
aacttgaaa

SEQ ID NO: 2173826 - DNA, 22 bp, Homo sapiens
aacttgaaaagattgcaaaggg

SEQ ID NO: 2173827 - DNA, 14 bp, Homo sapiens
aacttgagtttgtt

SEQ ID NO: 2173828 - DNA, 14 bp, Homo sapiens
aactttagaaataa

SEQ ID NO: 2173829 - DNA, 16 bp, Homo sapiens
aagaaaaacatgtcat

SEQ ID NO: 2173830 - DNA, 13 bp, Homo sapiens
aagaaaagacaaa

SEQ ID NO: 2173831 - DNA, 13 bp, Homo sapiens
aagaaaattgcca

SEQ ID NO: 2173832 - DNA, 14 bp, Homo sapiens
aagaaaattgccaa

SEQ ID NO: 2173833 - DNA, 16 bp, Homo sapiens
aagaaaattgccaaaa

SEQ ID NO: 2173834 - DNA, 20 bp, Homo sapiens
aagaaaattgccaaaatata

SEQ ID NO: 2173835 - DNA, 12 bp, Homo sapiens
aagaacaaaact

SEQ ID NO: 2173836 - DNA, 22 bp, Homo sapiens
aagaactctgggcacttttgaa

SEQ ID NO: 2173837 - DNA, 16 bp, Homo sapiens
aagaacttgaagtgaa

SEQ ID NO: 2173838 - DNA, 15 bp, Homo sapiens
aagaagcctagaaaa

SEQ ID NO: 2173839 - DNA, 17 bp, Homo sapiens
aagaagcctagaaaaga

SEQ ID NO: 2173840 - DNA, 14 bp, Homo sapiens
aagaaggaggaatt

SEQ ID NO: 2173841 - DNA, 15 bp, Homo sapiens
aagaagggggccctg

SEQ ID NO: 2173842 - DNA, 19 bp, Homo sapiens
aagaagggggccctgctac

SEQ ID NO: 2173843 - DNA, 13 bp, Homo sapiens
aagaagtgggagt

SEQ ID NO: 2173844 - DNA, 22 bp, Homo sapiens
aagaagtgggagtgggagagga

SEQ ID NO: 2173845 - DNA, 15 bp, Homo sapiens
aagaattcttaacat

SEQ ID NO: 2173846 - DNA, 18 bp, Homo sapiens
aagaattcttaacatagc

SEQ ID NO: 2173847 - DNA, 16 bp, Homo sapiens
aagaatttcaatatca

SEQ ID NO: 2173848 - DNA, 20 bp, Homo sapiens
aagacaaaccactgtacata

SEQ ID NO: 2173849 - DNA, 22 bp, Homo sapiens
aagacaaaccactgtacatata

SEQ ID NO: 2173850 - DNA, 13 bp, Homo sapiens
aagacaaatggga

SEQ ID NO: 2173851 - DNA, 18 bp, Homo sapiens
aagaccggaagctcctgg

SEQ ID NO: 2173852 - DNA, 20 bp, Homo sapiens
aagacgaggggcagggaagg

SEQ ID NO: 2173853 - DNA, 22 bp, Homo sapiens
aagactactattcctttccaga

SEQ ID NO: 2173854 - DNA, 21 bp, Homo sapiens
aagagaactgatgacactgag

SEQ ID NO: 2173855 - DNA, 14 bp, Homo sapiens
aagagagaagccag

SEQ ID NO: 2173856 - DNA, 13 bp, Homo sapiens
aagagagcctgcc

SEQ ID NO: 2173857 - DNA, 16 bp, Homo sapiens
aagagctgcctggatg

SEQ ID NO: 2173858 - DNA, 17 bp, Homo sapiens
aagagctgcctggatga

SEQ ID NO: 2173859 - DNA, 17 bp, Homo sapiens
aagagggagaaggagag

SEQ ID NO: 2173860 - DNA, 19 bp, Homo sapiens
aagagggcaaagctgattt

SEQ ID NO: 2173861 - DNA, 16 bp, Homo sapiens
aagaggtgactgggcc

SEQ ID NO: 2173862 - DNA, 22 bp, Homo sapiens
aagagtaagcacctttagaata

SEQ ID NO: 2173863 - DNA, 19 bp, Homo sapiens
aagagtcacaatttgcaaa

SEQ ID NO: 2173864 - DNA, 17 bp, Homo sapiens
aagagttctatccccaa

SEQ ID NO: 2173865 - DNA, 18 bp, Homo sapiens
aagatcactttgctctga

SEQ ID NO: 2173866 - DNA, 16 bp, Homo sapiens
aagatctcaacatgga

SEQ ID NO: 2173867 - DNA, 15 bp, Homo sapiens
aagatgtaagaagct

SEQ ID NO: 2173868 - DNA, 18 bp, Homo sapiens
aagatgtattcagagcca

SEQ ID NO: 2173869 - DNA, 18 bp, Homo sapiens
aagattacaacatctgtt

SEQ ID NO: 2173870 - DNA, 14 bp, Homo sapiens
aagattgcaaaggg

SEQ ID NO: 2173871 - DNA, 15 bp, Homo sapiens
aagcaaactatattt

SEQ ID NO: 2173872 - DNA, 17 bp, Homo sapiens
aagcacaaacttctgta

SEQ ID NO: 2173873 - DNA, 17 bp, Homo sapiens
aagcaccaaaaaactaa

SEQ ID NO: 2173874 - DNA, 13 bp, Homo sapiens
aagcactgacact

SEQ ID NO: 2173875 - DNA, 13 bp, Homo sapiens
aagcagaggctgg

SEQ ID NO: 2173876 - DNA, 15 bp, Homo sapiens
aagcagcccttgctt

SEQ ID NO: 2173877 - DNA, 16 bp, Homo sapiens
aagcaggctcaacata

SEQ ID NO: 2173878 - DNA, 20 bp, Homo sapiens
aagcatccattaattaatga

SEQ ID NO: 2173879 - DNA, 20 bp, Homo sapiens
aagcatttaatgtagccatg

SEQ ID NO: 2173880 - DNA, 18 bp, Homo sapiens
aagccaccaagggcctca

SEQ ID NO: 2173881 - DNA, 17 bp, Homo sapiens
aagccacgtgctggaga

SEQ ID NO: 2173882 - DNA, 20 bp, Homo sapiens
aagccacgtgctggagagta

SEQ ID NO: 2173883 - DNA, 17 bp, Homo sapiens
aagccagattctcttga

SEQ ID NO: 2173884 - DNA, 23 bp, Homo sapiens
aagccagggatggggccacagcc

SEQ ID NO: 2173885 - DNA, 13 bp, Homo sapiens
aagccgtcctggc

SEQ ID NO: 2173886 - DNA, 18 bp, Homo sapiens
aagcctggtctcctccca

SEQ ID NO: 2173887 - DNA, 14 bp, Homo sapiens
aagccttgcccagc

SEQ ID NO: 2173888 - DNA, 14 bp, Homo sapiens
aagccttttaaatc

SEQ ID NO: 2173889 - DNA, 15 bp, Homo sapiens
aagccttttaaatca

SEQ ID NO: 2173890 - DNA, 19 bp, Homo sapiens
aagcgcacttgatggtcag

SEQ ID NO: 2173891 - DNA, 18 bp, Homo sapiens
aagctaccttttttttac

SEQ ID NO: 2173892 - DNA, 22 bp, Homo sapiens
aagctaccttttttttacggaa

SEQ ID NO: 2173893 - DNA, 15 bp, Homo sapiens
aagctagaaaaatta

SEQ ID NO: 2173894 - DNA, 12 bp, Homo sapiens
aagctagctccc

SEQ ID NO: 2173895 - DNA, 14 bp, Homo sapiens
aagctaggccccag

SEQ ID NO: 2173896 - DNA, 23 bp, Homo sapiens
aagctaggccccagaggccctgg

SEQ ID NO: 2173897 - DNA, 20 bp, Homo sapiens
aagctataaagcagtatttt

SEQ ID NO: 2173898 - DNA, 16 bp, Homo sapiens
aagctcagtttggctg

SEQ ID NO: 2173899 - DNA, 23 bp, Homo sapiens
aagctcctggtatgggtttctcc

SEQ ID NO: 2173900 - DNA, 15 bp, Homo sapiens
aagctgcctccctgt

SEQ ID NO: 2173901 - DNA, 20 bp, Homo sapiens
aagctgcctccctgtccacc

SEQ ID NO: 2173902 - DNA, 23 bp, Homo sapiens
aagctggggacagctttcctggg

SEQ ID NO: 2173903 - DNA, 16 bp, Homo sapiens
aagctgtacccttgag

SEQ ID NO: 2173904 - DNA, 13 bp, Homo sapiens
aagctgtccctgc

SEQ ID NO: 2173905 - DNA, 16 bp, Homo sapiens
aagctgtccctgcagg

SEQ ID NO: 2173906 - DNA, 14 bp, Homo sapiens
aagctgtgaaattg

SEQ ID NO: 2173907 - DNA, 20 bp, Homo sapiens
aagctgtgtctttagacaac

SEQ ID NO: 2173908 - DNA, 19 bp, Homo sapiens
aagctttctctgcttcagc

SEQ ID NO: 2173909 - DNA, 17 bp, Homo sapiens
aaggaaaaacatgctta

SEQ ID NO: 2173910 - DNA, 13 bp, Homo sapiens
aaggaagaaacca

SEQ ID NO: 2173911 - DNA, 22 bp, Homo sapiens
aaggaagatcactttgctctga

SEQ ID NO: 2173912 - DNA, 22 bp, Homo sapiens
aaggacatttgggactgtcttg

SEQ ID NO: 2173913 - DNA, 15 bp, Homo sapiens
aaggacttgtgcctc

SEQ ID NO: 2173914 - DNA, 17 bp, Homo sapiens
aaggactttgtacattt

SEQ ID NO: 2173915 - DNA, 21 bp, Homo sapiens
aaggagcctgcggctgctggc

SEQ ID NO: 2173916 - DNA, 14 bp, Homo sapiens
aaggatatactgca

SEQ ID NO: 2173917 - DNA, 23 bp, Homo sapiens
aatcctcctgagtgatcccattt

SEQ ID NO: 2173918 - DNA, 20 bp, Homo sapiens
aatcctgtcaatgtttgctt

SEQ ID NO: 2173919 - DNA, 14 bp, Homo sapiens
aatcgaggctgtgt

SEQ ID NO: 2173920 - DNA, 22 bp, Homo sapiens
aatctattaatagctgccttaa

SEQ ID NO: 2173921 - DNA, 18 bp, Homo sapiens
aatctcacgctgccattt

SEQ ID NO: 2173922 - DNA, 23 bp, Homo sapiens
aatctgacaaagtcatgaagctc

SEQ ID NO: 2173923 - DNA, 11 bp, Homo sapiens
aatctgtaatt

SEQ ID NO: 2173924 - DNA, 15 bp, Homo sapiens
aatcttataattgtt

SEQ ID NO: 2173925 - DNA, 17 bp, Homo sapiens
aatcttataattgttct

SEQ ID NO: 2173926 - DNA, 14 bp, Homo sapiens
aatcttttactgtg

SEQ ID NO: 2173927 - DNA, 22 bp, Homo sapiens
aatcttttgtagtttgtattaa

SEQ ID NO: 2173928 - DNA, 21 bp, Homo sapiens
aatgaaaagaaaatgtgccat

SEQ ID NO: 2173929 - DNA, 14 bp, Homo sapiens
aatgaatattgtaa

SEQ ID NO: 2173930 - DNA, 15 bp, Homo sapiens
aatgacattttgcca

SEQ ID NO: 2173931 - DNA, 20 bp, Homo sapiens
aatgactgcgcagagtggat

SEQ ID NO: 2173932 - DNA, 14 bp, Homo sapiens
accaaacctagccc

SEQ ID NO: 2173933 - DNA, 16 bp, Homo sapiens
accaaacggaactctt

SEQ ID NO: 2173934 - DNA, 18 bp, Homo sapiens
accaaacggaactcttca

SEQ ID NO: 2173935 - DNA, 18 bp, Homo sapiens
accaaagctgtttttata

SEQ ID NO: 2173936 - DNA, 12 bp, Homo sapiens
accaaattctga

SEQ ID NO: 2173937 - DNA, 14 bp, Homo sapiens
accaacataaaaca

SEQ ID NO: 2173938 - DNA, 15 bp, Homo sapiens
accaacataaaacaa

SEQ ID NO: 2173939 - DNA, 20 bp, Homo sapiens
accaagccggtgcccaccta

SEQ ID NO: 2173940 - DNA, 16 bp, Homo sapiens
accaaggtgcactgag

SEQ ID NO: 2173941 - DNA, 19 bp, Homo sapiens
accaaggtgcactgagaag

SEQ ID NO: 2173942 - DNA, 17 bp, Homo sapiens
accacacccagcctctg

SEQ ID NO: 2173943 - DNA, 23 bp, Homo sapiens
accaccacttatgcccctagaag

SEQ ID NO: 2173944 - DNA, 13 bp, Homo sapiens
accacctctggcc

SEQ ID NO: 2173945 - DNA, 22 bp, Homo sapiens
accaccttgcactattggactt

SEQ ID NO: 2173946 - DNA, 18 bp, Homo sapiens
accacgcttgacaggaca

SEQ ID NO: 2173947 - DNA, 16 bp, Homo sapiens
accactcaagcaacaa

SEQ ID NO: 2173948 - DNA, 13 bp, Homo sapiens
accactgtacata

SEQ ID NO: 2173949 - DNA, 15 bp, Homo sapiens
accagagctctggag

SEQ ID NO: 2173950 - DNA, 17 bp, Homo sapiens
accagagctctggagcc

SEQ ID NO: 2173951 - DNA, 18 bp, Homo sapiens
accagagctctggagcca

SEQ ID NO: 2173952 - DNA, 14 bp, Homo sapiens
accagatcactcaa

SEQ ID NO: 2173953 - DNA, 17 bp, Homo sapiens
accagcagtgtttaaaa

SEQ ID NO: 2173954 - DNA, 11 bp, Homo sapiens
accagcctttc

SEQ ID NO: 2173955 - DNA, 12 bp, Homo sapiens
accagcctttct

SEQ ID NO: 2173956 - DNA, 22 bp, Homo sapiens
accagctgctccgaggacccag

SEQ ID NO: 2173957 - DNA, 13 bp, Homo sapiens
accaggaacagca

SEQ ID NO: 2173958 - DNA, 12 bp, Homo sapiens
accaggaagccg

SEQ ID NO: 2173959 - DNA, 18 bp, Homo sapiens
accagggcaccaagccca

SEQ ID NO: 2173960 - DNA, 15 bp, Homo sapiens
accaggggaggagcc

SEQ ID NO: 2173961 - DNA, 15 bp, Homo sapiens
accagtgagacagcc

SEQ ID NO: 2173962 - DNA, 14 bp, Homo sapiens
accagtttcttaaa

SEQ ID NO: 2173963 - DNA, 12 bp, Homo sapiens
accagtttcttt

SEQ ID NO: 2173964 - DNA, 17 bp, Homo sapiens
accagtttcttttcttt

SEQ ID NO: 2173965 - DNA, 21 bp, Homo sapiens
agacacagagtggagccctca

SEQ ID NO: 2173966 - DNA, 23 bp, Homo sapiens
agacacagagtggagccctcagt

SEQ ID NO: 2173967 - DNA, 21 bp, Homo sapiens
agacacagggcatccaactga

SEQ ID NO: 2173968 - DNA, 14 bp, Homo sapiens
agacacctcagagc

SEQ ID NO: 2173969 - DNA, 19 bp, Homo sapiens
agacagccggatcttggag

SEQ ID NO: 2173970 - DNA, 21 bp, Homo sapiens
agacagtggtaaatatagaac

SEQ ID NO: 2173971 - DNA, 22 bp, Homo sapiens
agacatcaagatacacttgtaa

SEQ ID NO: 2173972 - DNA, 14 bp, Homo sapiens
agacatggatttga

SEQ ID NO: 2173973 - DNA, 14 bp, Homo sapiens
agacattttaagca

SEQ ID NO: 2173974 - DNA, 20 bp, Homo sapiens
agaccaagccggtgcccacc

SEQ ID NO: 2173975 - DNA, 20 bp, Homo sapiens
agaccagagctctggagcca

SEQ ID NO: 2173976 - DNA, 16 bp, Homo sapiens
agaccagcctttcttc

SEQ ID NO: 2173977 - DNA, 16 bp, Homo sapiens
agaccatttcacagaa

SEQ ID NO: 2173978 - DNA, 19 bp, Homo sapiens
agaccatttcacagaaaac

SEQ ID NO: 2173979 - DNA, 18 bp, Homo sapiens
agaccggaagctcctggt

SEQ ID NO: 2173980 - DNA, 14 bp, Homo sapiens
agacctgactcagg

SEQ ID NO: 2173981 - DNA, 21 bp, Homo sapiens
agaccttcttccacagcaaat

SEQ ID NO: 2173982 - DNA, 19 bp, Homo sapiens
agacgaggggcagggaagg

SEQ ID NO: 2173983 - DNA, 21 bp, Homo sapiens
agacgctaataaaaatttatt

SEQ ID NO: 2173984 - DNA, 21 bp, Homo sapiens
agacgtccacccgtttccaag

SEQ ID NO: 2173985 - DNA, 19 bp, Homo sapiens
agactgactggcaccaaca

SEQ ID NO: 2173986 - DNA, 23 bp, Homo sapiens
agactgactggcaccaacacttt

SEQ ID NO: 2173987 - DNA, 21 bp, Homo sapiens
agactgcaagtgagcaaacct

SEQ ID NO: 2173988 - DNA, 16 bp, Homo sapiens
agactggggcctggac

SEQ ID NO: 2173989 - DNA, 23 bp, Homo sapiens
agacttacagggataaggcctgt

SEQ ID NO: 2173990 - DNA, 17 bp, Homo sapiens
agacttgaaagaaaggg

SEQ ID NO: 2173991 - DNA, 23 bp, Homo sapiens
agactttgcccagggtcctgtgc

SEQ ID NO: 2173992 - DNA, 13 bp, Homo sapiens
agagaaagagaga

SEQ ID NO: 2173993 - DNA, 18 bp, Homo sapiens
agagaaagagagaagcca

SEQ ID NO: 2173994 - DNA, 19 bp, Homo sapiens
agagaagagtccaggaagg

SEQ ID NO: 2173995 - DNA, 13 bp, Homo sapiens
agagaagcctgtg

SEQ ID NO: 2173996 - DNA, 14 bp, Homo sapiens
agagaagccttggt

SEQ ID NO: 2173997 - DNA, 14 bp, Homo sapiens
agagaatgagagag

SEQ ID NO: 2173998 - DNA, 23 bp, Homo sapiens
agagacacatacagagtgggccc

SEQ ID NO: 2173999 - DNA, 17 bp, Homo sapiens
agagaccagcctttctt

SEQ ID NO: 2174000 - DNA, 14 bp, Homo sapiens
agagagaagccagc

SEQ ID NO: 2174001 - DNA, 15 bp, Homo sapiens
agagagaagccagcc

SEQ ID NO: 2174002 - DNA, 17 bp, Homo sapiens
agagagaagccagccac

SEQ ID NO: 2174003 - DNA, 12 bp, Homo sapiens
agagagcctgcc

SEQ ID NO: 2174004 - DNA, 22 bp, Homo sapiens
agagagcctgcccggccggaga

SEQ ID NO: 2174005 - DNA, 14 bp, Homo sapiens
agagagcttcctgt

SEQ ID NO: 2174006 - DNA, 20 bp, Homo sapiens
agagaggggcctctggctgc

SEQ ID NO: 2174007 - DNA, 21 bp, Homo sapiens
agagaggggcctctggctgcc

SEQ ID NO: 2174008 - DNA, 22 bp, Homo sapiens
agagccaaggcctatgccacct

SEQ ID NO: 2174009 - DNA, 23 bp, Homo sapiens
agagccacaggccccttttgtgg

SEQ ID NO: 2174010 - DNA, 22 bp, Homo sapiens
agagccccgcaaaacccactga

SEQ ID NO: 2174011 - DNA, 15 bp, Homo sapiens
agagcctgcccggcc

SEQ ID NO: 2174012 - DNA, 16 bp, Homo sapiens
agagcgctggcctctt

SEQ ID NO: 2174013 - DNA, 19 bp, Homo sapiens
agagctctggagccacctg

SEQ ID NO: 2174014 - DNA, 18 bp, Homo sapiens
agagctgcctaagaggca

SEQ ID NO: 2174015 - DNA, 21 bp, Homo sapiens
agagctgcctaagaggcaatg

SEQ ID NO: 2174016 - DNA, 16 bp, Homo sapiens
agagctgggtgagtgg

SEQ ID NO: 2174017 - DNA, 16 bp, Homo sapiens
agagcttcctgtttct

SEQ ID NO: 2174018 - DNA, 22 bp, Homo sapiens
agaggaagccacgtgctggaga

SEQ ID NO: 2174019 - DNA, 16 bp, Homo sapiens
agaggaagccttgccc

SEQ ID NO: 2174020 - DNA, 19 bp, Homo sapiens
agaggcagaaccctggtga

SEQ ID NO: 2174021 - DNA, 21 bp, Homo sapiens
agaggcagagtgccccacctg

SEQ ID NO: 2174022 - DNA, 16 bp, Homo sapiens
agaggcagtggcagca

SEQ ID NO: 2174023 - DNA, 14 bp, Homo sapiens
agaggccctggagg

SEQ ID NO: 2174024 - DNA, 20 bp, Homo sapiens
agaggctcctggagccagcc

SEQ ID NO: 2174025 - DNA, 15 bp, Homo sapiens
agagggagaaggaga

SEQ ID NO: 2174026 - DNA, 19 bp, Homo sapiens
agagggagaaggagaggct

SEQ ID NO: 2174027 - DNA, 21 bp, Homo sapiens
agtagggatgcggatcctgct

SEQ ID NO: 2174028 - DNA, 23 bp, Homo sapiens
agtagggatgcggatcctgctgg

SEQ ID NO: 2174029 - DNA, 19 bp, Homo sapiens
agtagttgggattacaggt

SEQ ID NO: 2174030 - DNA, 13 bp, Homo sapiens
agtatctgtacct

SEQ ID NO: 2174031 - DNA, 17 bp, Homo sapiens
agtatctgtacctgccc

SEQ ID NO: 2174032 - DNA, 22 bp, Homo sapiens
agtatgagtgcaagcaaagcag

SEQ ID NO: 2174033 - DNA, 18 bp, Homo sapiens
agtatgcactaatcaata

SEQ ID NO: 2174034 - DNA, 17 bp, Homo sapiens
agtatggcagtgggaga

SEQ ID NO: 2174035 - DNA, 13 bp, Homo sapiens
agtatgtattatt

SEQ ID NO: 2174036 - DNA, 15 bp, Homo sapiens
agtattgttaatgaa

SEQ ID NO: 2174037 - DNA, 17 bp, Homo sapiens
agtattgttaatgaata

SEQ ID NO: 2174038 - DNA, 19 bp, Homo sapiens
agtattttccctgctaggg

SEQ ID NO: 2174039 - DNA, 16 bp, Homo sapiens
agtcaacctgcttttt

SEQ ID NO: 2174040 - DNA, 14 bp, Homo sapiens
agtcaagtcaaata

SEQ ID NO: 2174041 - DNA, 15 bp, Homo sapiens
agtcacaatttgcaa

SEQ ID NO: 2174042 - DNA, 24 bp, Homo sapiens
agtcacttcgtgggatctgcccct

SEQ ID NO: 2174043 - DNA, 13 bp, Homo sapiens
agtcatgacattt

SEQ ID NO: 2174044 - DNA, 18 bp, Homo sapiens
agtcatgacatttctcaa

SEQ ID NO: 2174045 - DNA, 22 bp, Homo sapiens
agtccaggtcgggctcagctct

SEQ ID NO: 2174046 - DNA, 14 bp, Homo sapiens
agtccagttttgtg

SEQ ID NO: 2174047 - DNA, 20 bp, Homo sapiens
agtccagttttgtgtgcttt

SEQ ID NO: 2174048 - DNA, 15 bp, Homo sapiens
agtcccttccacacc

SEQ ID NO: 2174049 - DNA, 18 bp, Homo sapiens
agtcctccctgctcagct

SEQ ID NO: 2174050 - DNA, 12 bp, Homo sapiens
agtcctgaggca

SEQ ID NO: 2174051 - DNA, 16 bp, Homo sapiens
agtctcactcccctcc

SEQ ID NO: 2174052 - DNA, 21 bp, Homo sapiens
agtctcactcccctcctttcc

SEQ ID NO: 2174053 - DNA, 23 bp, Homo sapiens
agtctcaggaggagggcgcatgt

SEQ ID NO: 2174054 - DNA, 15 bp, Homo sapiens
agtctctcttaccct

SEQ ID NO: 2174055 - DNA, 13 bp, Homo sapiens
agtctgctttctc

SEQ ID NO: 2174056 - DNA, 15 bp, Homo sapiens
agtctgctttctcta

SEQ ID NO: 2174057 - DNA, 17 bp, Homo sapiens
agtctgtattcctgata

SEQ ID NO: 2174058 - DNA, 22 bp, Homo sapiens
agtctgtcacccaggctggagt

SEQ ID NO: 2174059 - DNA, 16 bp, Homo sapiens
agtctgtgcctggagc

SEQ ID NO: 2174060 - DNA, 11 bp, Homo sapiens
agtctgtgtgc

SEQ ID NO: 2174061 - DNA, 16 bp, Homo sapiens
agtcttccatcagcag

SEQ ID NO: 2174062 - DNA, 18 bp, Homo sapiens
agtcttccatcagcagtg

SEQ ID NO: 2174063 - DNA, 19 bp, Homo sapiens
agtcttccctagggctggg

SEQ ID NO: 2174064 - DNA, 20 bp, Homo sapiens
agtcttccctagggctgggt

SEQ ID NO: 2174065 - DNA, 18 bp, Homo sapiens
agtcttgtactgtgacct

SEQ ID NO: 2174066 - DNA, 21 bp, Homo sapiens
agtctttagtgttcaaatact

SEQ ID NO: 2174067 - DNA, 22 bp, Homo sapiens
agtctttgtaagtaaactgccc

SEQ ID NO: 2174068 - DNA, 16 bp, Homo sapiens
agtgaatacatggtag

SEQ ID NO: 2174069 - DNA, 23 bp, Homo sapiens
agtgactaccacttatttctaaa

SEQ ID NO: 2174070 - DNA, 12 bp, Homo sapiens
agtgagacacag

SEQ ID NO: 2174071 - DNA, 14 bp, Homo sapiens
agtgagacacagag

SEQ ID NO: 2174072 - DNA, 15 bp, Homo sapiens
agtgagacacagagt

SEQ ID NO: 2174073 - DNA, 23 bp, Homo sapiens
agtgagacacagagtggagccct

SEQ ID NO: 2174074 - DNA, 21 bp, Homo sapiens
agtgagactcctgattgctct

SEQ ID NO: 2174075 - DNA, 22 bp, Homo sapiens
agtgagactcctgattgctctg

SEQ ID NO: 2174076 - DNA, 21 bp, Homo sapiens
agtgagcatgctttctgaact

SEQ ID NO: 2174077 - DNA, 17 bp, Homo sapiens
agtgagctctatgggca

SEQ ID NO: 2174078 - DNA, 14 bp, Homo sapiens
agtgatcctcctgt

SEQ ID NO: 2174079 - DNA, 16 bp, Homo sapiens
agtgatgattgtaagt

SEQ ID NO: 2174080 - DNA, 21 bp, Homo sapiens
agtgatggcattactctgcac

SEQ ID NO: 2174081 - DNA, 23 bp, Homo sapiens
agtgattgaagtatctgtacctg

SEQ ID NO: 2174082 - DNA, 21 bp, Homo sapiens
agtgatttctggggccccacc

SEQ ID NO: 2174083 - DNA, 12 bp, Homo sapiens
agtgatttgcta

SEQ ID NO: 2174084 - DNA, 16 bp, Homo sapiens
agtgatttgctatcat

SEQ ID NO: 2174085 - DNA, 10 bp, Homo sapiens
agtgcaaagc

SEQ ID NO: 2174086 - DNA, 13 bp, Homo sapiens
agtgcaaagctgc

SEQ ID NO: 2174087 - DNA, 16 bp, Homo sapiens
agtgcaaagctgcttg

SEQ ID NO: 2174088 - DNA, 15 bp, Homo sapiens
agtgcaagcaaagca

SEQ ID NO: 2174089 - DNA, 14 bp, Homo sapiens
agtgcaatttcttc

SEQ ID NO: 2174090 - DNA, 20 bp, Homo sapiens
agtgcagtcaccctgtggca

SEQ ID NO: 2174091 - DNA, 20 bp, Homo sapiens
agtgcattttcaacattgat

SEQ ID NO: 2174092 - DNA, 23 bp, Homo sapiens
agtgccaggctgcggtgggcagc

SEQ ID NO: 2174093 - DNA, 14 bp, Homo sapiens
agtgcccagtgatg

SEQ ID NO: 2174094 - DNA, 18 bp, Homo sapiens
agtgcccagtgatggcat

SEQ ID NO: 2174095 - DNA, 13 bp, Homo sapiens
agtgctagccact

SEQ ID NO: 2174096 - DNA, 14 bp, Homo sapiens
agtgctcagttcca

SEQ ID NO: 2174097 - DNA, 21 bp, Homo sapiens
agtgctggaatggggacctgg

SEQ ID NO: 2174098 - DNA, 18 bp, Homo sapiens
agtgctgggattacaggt

SEQ ID NO: 2174099 - DNA, 17 bp, Homo sapiens
agtgcttttaaactgga

SEQ ID NO: 2174100 - DNA, 19 bp, Homo sapiens
agtggaaagattgtgtctg

SEQ ID NO: 2174101 - DNA, 16 bp, Homo sapiens
agtggaggcattgttt

SEQ ID NO: 2174102 - DNA, 21 bp, Homo sapiens
agtggatagatgccctgctag

SEQ ID NO: 2174103 - DNA, 15 bp, Homo sapiens
agtggattaaaggca

SEQ ID NO: 2174104 - DNA, 14 bp, Homo sapiens
agtggcaggggagc

SEQ ID NO: 2174105 - DNA, 18 bp, Homo sapiens
agtggcaggggagcaggt

SEQ ID NO: 2174106 - DNA, 18 bp, Homo sapiens
agtggccaagaagcagtg

SEQ ID NO: 2174107 - DNA, 14 bp, Homo sapiens
agtggccagaccag

SEQ ID NO: 2174108 - DNA, 23 bp, Homo sapiens
agtggccagaccagagctctgga

SEQ ID NO: 2174109 - DNA, 17 bp, Homo sapiens
agtggccatctggaaat

SEQ ID NO: 2174110 - DNA, 17 bp, Homo sapiens
agtggcctgcaggggcc

SEQ ID NO: 2174111 - DNA, 14 bp, Homo sapiens
agtggcctggctcc

SEQ ID NO: 2174112 - DNA, 17 bp, Homo sapiens
agtggcctggctccgct

SEQ ID NO: 2174113 - DNA, 12 bp, Homo sapiens
agtgggaagccc

SEQ ID NO: 2174114 - DNA, 14 bp, Homo sapiens
agtgggagtgggag

SEQ ID NO: 2174115 - DNA, 22 bp, Homo sapiens
agtgggccccgggctggagaaa

SEQ ID NO: 2174116 - DNA, 19 bp, Homo sapiens
agtggggagacacctcaga

SEQ ID NO: 2174117 - DNA, 15 bp, Homo sapiens
agtggtggctctgag

SEQ ID NO: 2174118 - DNA, 16 bp, Homo sapiens
agtggtggctctgaga

SEQ ID NO: 2174119 - DNA, 16 bp, Homo sapiens
agtgtaaaaattcaga

SEQ ID NO: 2174120 - DNA, 17 bp, Homo sapiens
agtgtagccccaagaag

SEQ ID NO: 2174121 - DNA, 21 bp, Homo sapiens
agtgtagccccaagaaggctg

SEQ ID NO: 2174122 - DNA, 13 bp, Homo sapiens
agtgtatctcgaa

SEQ ID NO: 2174123 - DNA, 23 bp, Homo sapiens
agtgtatctcgaagtcttccatc

SEQ ID NO: 2174124 - DNA, 12 bp, Homo sapiens
agtgtcacctgc

SEQ ID NO: 2174125 - DNA, 15 bp, Homo sapiens
agtgtcacctgcaca

SEQ ID NO: 2174126 - DNA, 10 bp, Homo sapiens
agtgtgaagc

SEQ ID NO: 2174127 - DNA, 15 bp, Homo sapiens
agtgtgaagcctgtc

SEQ ID NO: 2174128 - DNA, 20 bp, Homo sapiens
agtgtgacgggggttggggt

SEQ ID NO: 2174129 - DNA, 14 bp, Homo sapiens
agtgtgtctcctgc

SEQ ID NO: 2174130 - DNA, 19 bp, Homo sapiens
agtgtgtctcctgcatgca

SEQ ID NO: 2174131 - DNA, 14 bp, Homo sapiens
agtgtgtttgtgag

SEQ ID NO: 2174132 - DNA, 22 bp, Homo sapiens
agtgtgtttgtgagtatgtgtg

SEQ ID NO: 2174133 - DNA, 19 bp, Homo sapiens
agtgttatgcggtctaggg

SEQ ID NO: 2174134 - DNA, 22 bp, Homo sapiens
agttaaattgcacgtgcaatac

SEQ ID NO: 2174135 - DNA, 13 bp, Homo sapiens
agttactgttcat

SEQ ID NO: 2174136 - DNA, 15 bp, Homo sapiens
agttacttacctgca

SEQ ID NO: 2174137 - DNA, 14 bp, Homo sapiens
agttagtttgtata

SEQ ID NO: 2174138 - DNA, 13 bp, Homo sapiens
agttcaggatttg

SEQ ID NO: 2174139 - DNA, 14 bp, Homo sapiens
agttcatactgaat

SEQ ID NO: 2174140 - DNA, 15 bp, Homo sapiens
agttcatactgaatg

SEQ ID NO: 2174141 - DNA, 16 bp, Homo sapiens
agttcatactgaatga

SEQ ID NO: 2174142 - DNA, 14 bp, Homo sapiens
agttccaatgtgcc

SEQ ID NO: 2174143 - DNA, 19 bp, Homo sapiens
agttctatccccaagctgg

SEQ ID NO: 2174144 - DNA, 20 bp, Homo sapiens
agttctgaaggttggaactg

SEQ ID NO: 2174145 - DNA, 12 bp, Homo sapiens
agttctgatgag

SEQ ID NO: 2174146 - DNA, 11 bp, Homo sapiens
agttctgtata

SEQ ID NO: 2174147 - DNA, 20 bp, Homo sapiens
agttctgtatataaatatat

SEQ ID NO: 2174148 - DNA, 15 bp, Homo sapiens
agttgcgtgtctgtt

SEQ ID NO: 2174149 - DNA, 19 bp, Homo sapiens
agttgcgtgtctgtttcct

SEQ ID NO: 2174150 - DNA, 17 bp, Homo sapiens
agttggcatcacctgcg

SEQ ID NO: 2174151 - DNA, 22 bp, Homo sapiens
agttgtatttaacagaaattgt

SEQ ID NO: 2174152 - DNA, 20 bp, Homo sapiens
atctagagcttgatgccagt

SEQ ID NO: 2174153 - DNA, 21 bp, Homo sapiens
atctatatagtacctttgctc

SEQ ID NO: 2174154 - DNA, 16 bp, Homo sapiens
atctatcacctgtcat

SEQ ID NO: 2174155 - DNA, 17 bp, Homo sapiens
atctcactttaataata

SEQ ID NO: 2174156 - DNA, 19 bp, Homo sapiens
atctcatcccaacaaactt

SEQ ID NO: 2174157 - DNA, 23 bp, Homo sapiens
atctccctcgaacccacactgca

SEQ ID NO: 2174158 - DNA, 18 bp, Homo sapiens
atctccttttatgctcac

SEQ ID NO: 2174159 - DNA, 19 bp, Homo sapiens
atctccttttatgctcacc

SEQ ID NO: 2174160 - DNA, 17 bp, Homo sapiens
atctctgaacttcagct

SEQ ID NO: 2174161 - DNA, 15 bp, Homo sapiens
atctctggaaaaata

SEQ ID NO: 2174162 - DNA, 16 bp, Homo sapiens
atctctggaaaaataa

SEQ ID NO: 2174163 - DNA, 19 bp, Homo sapiens
atctctgtctaccatctcc

SEQ ID NO: 2174164 - DNA, 14 bp, Homo sapiens
atctgaaaacaatt

SEQ ID NO: 2174165 - DNA, 19 bp, Homo sapiens
atctgactgccaagccaga

SEQ ID NO: 2174166 - DNA, 14 bp, Homo sapiens
atctgattttcaaa

SEQ ID NO: 2174167 - DNA, 16 bp, Homo sapiens
atctgcccctccctgc

SEQ ID NO: 2174168 - DNA, 14 bp, Homo sapiens
atctgccttgctgc

SEQ ID NO: 2174169 - DNA, 23 bp, Homo sapiens
atctgtggcgatatgagagggat

SEQ ID NO: 2174170 - DNA, 22 bp, Homo sapiens
atctgtgttacaatcgttctgt

SEQ ID NO: 2174171 - DNA, 13 bp, Homo sapiens
atctgttgcaaac

SEQ ID NO: 2174172 - DNA, 18 bp, Homo sapiens
atctgttgcaaactcagc

SEQ ID NO: 2174173 - DNA, 15 bp, Homo sapiens
atctgtttgcttcta

SEQ ID NO: 2174174 - DNA, 18 bp, Homo sapiens
atcttagaacagatggct

SEQ ID NO: 2174175 - DNA, 18 bp, Homo sapiens
atcttatgcaaaactttt

SEQ ID NO: 2174176 - DNA, 12 bp, Homo sapiens
atcttcaaggtg

SEQ ID NO: 2174177 - DNA, 21 bp, Homo sapiens
atcttggagacaattacaaga

SEQ ID NO: 2174178 - DNA, 12 bp, Homo sapiens
atctttccaaat

SEQ ID NO: 2174179 - DNA, 16 bp, Homo sapiens
atctttccttgtctct

SEQ ID NO: 2174180 - DNA, 15 bp, Homo sapiens
atctttgctcccagt

SEQ ID NO: 2174181 - DNA, 22 bp, Homo sapiens
atcttttactgtggaggtggct

SEQ ID NO: 2174182 - DNA, 12 bp, Homo sapiens
atgaaaatatct

SEQ ID NO: 2174183 - DNA, 14 bp, Homo sapiens
atgaaagtgcaaag

SEQ ID NO: 2174184 - DNA, 21 bp, Homo sapiens
atgtataatgacttttaaaat

SEQ ID NO: 2174185 - DNA, 16 bp, Homo sapiens
atgtatcattaatgta

SEQ ID NO: 2174186 - DNA, 12 bp, Homo sapiens
atgtatgataaa

SEQ ID NO: 2174187 - DNA, 11 bp, Homo sapiens
atgtatgtgta

SEQ ID NO: 2174188 - DNA, 18 bp, Homo sapiens
atgtatgttggtttttta

SEQ ID NO: 2174189 - DNA, 14 bp, Homo sapiens
atgtattttaaaat

SEQ ID NO: 2174190 - DNA, 14 bp, Homo sapiens
atgtcccccacctc

SEQ ID NO: 2174191 - DNA, 19 bp, Homo sapiens
atgtcctatattggctaaa

SEQ ID NO: 2174192 - DNA, 17 bp, Homo sapiens
atgtctaacaggacttg

SEQ ID NO: 2174193 - DNA, 21 bp, Homo sapiens
atgtctaacaggacttgaatt

SEQ ID NO: 2174194 - DNA, 12 bp, Homo sapiens
atgtctatgaca

SEQ ID NO: 2174195 - DNA, 13 bp, Homo sapiens
atgtcttagtgac

SEQ ID NO: 2174196 - DNA, 16 bp, Homo sapiens
atgtgagcatgaaact

SEQ ID NO: 2174197 - DNA, 14 bp, Homo sapiens
atgtgattatcatt

SEQ ID NO: 2174198 - DNA, 23 bp, Homo sapiens
atgtgccaccaacataaaacaaa

SEQ ID NO: 2174199 - DNA, 16 bp, Homo sapiens
atgtgcccagtcatga

SEQ ID NO: 2174200 - DNA, 15 bp, Homo sapiens
atgtgcctcattaag

SEQ ID NO: 2174201 - DNA, 15 bp, Homo sapiens
atgtgggaaaaaaag

SEQ ID NO: 2174202 - DNA, 21 bp, Homo sapiens
atgtgtatgtctggtaaatag

SEQ ID NO: 2174203 - DNA, 15 bp, Homo sapiens
atgtgtatgtgttta

SEQ ID NO: 2174204 - DNA, 15 bp, Homo sapiens
atgtgtggtttataa

SEQ ID NO: 2174205 - DNA, 17 bp, Homo sapiens
atgtgtttataattgtt

SEQ ID NO: 2174206 - DNA, 18 bp, Homo sapiens
atgttaaaacaaattaaa

SEQ ID NO: 2174207 - DNA, 14 bp, Homo sapiens
atgttaataaaggt

SEQ ID NO: 2174208 - DNA, 15 bp, Homo sapiens
atgttaataaaggtt

SEQ ID NO: 2174209 - DNA, 18 bp, Homo sapiens
atgttaatcctagctgtg

SEQ ID NO: 2174210 - DNA, 13 bp, Homo sapiens
atgttattatctg

SEQ ID NO: 2174211 - DNA, 19 bp, Homo sapiens
atgttcaagtattgttaat

SEQ ID NO: 2174212 - DNA, 21 bp, Homo sapiens
atgttggtcttggtcatttgc

SEQ ID NO: 2174213 - DNA, 11 bp, Homo sapiens
atgttggtttt

SEQ ID NO: 2174214 - DNA, 11 bp, Homo sapiens
atgttgtattg

SEQ ID NO: 2174215 - DNA, 15 bp, Homo sapiens
attaaacctttccat

SEQ ID NO: 2174216 - DNA, 12 bp, Homo sapiens
attaaagaaaat

SEQ ID NO: 2174217 - DNA, 14 bp, Homo sapiens
attaaagaaaattg

SEQ ID NO: 2174218 - DNA, 17 bp, Homo sapiens
attaaagaaaattgcca

SEQ ID NO: 2174219 - DNA, 18 bp, Homo sapiens
attaaagaaaattgccaa

SEQ ID NO: 2174220 - DNA, 21 bp, Homo sapiens
attaaagaaaattgccaaaat

SEQ ID NO: 2174221 - DNA, 23 bp, Homo sapiens
attaaagaaaattgccaaaatat

SEQ ID NO: 2174222 - DNA, 19 bp, Homo sapiens
attaaaggtgaaaattgta

SEQ ID NO: 2174223 - DNA, 22 bp, Homo sapiens
attaaaggtgaaaattgtataa

SEQ ID NO: 2174224 - DNA, 15 bp, Homo sapiens
attaaatcagttttg

SEQ ID NO: 2174225 - DNA, 14 bp, Homo sapiens
attaaatgaatata

SEQ ID NO: 2174226 - DNA, 13 bp, Homo sapiens
attaacacactga

SEQ ID NO: 2174227 - DNA, 14 bp, Homo sapiens
attaacctacctgt

SEQ ID NO: 2174228 - DNA, 15 bp, Homo sapiens
attaacctacctgtg

SEQ ID NO: 2174229 - DNA, 14 bp, Homo sapiens
attaagttgttgaa

SEQ ID NO: 2174230 - DNA, 17 bp, Homo sapiens
attaagttgttgaaagt

SEQ ID NO: 2174231 - DNA, 23 bp, Homo sapiens
attaataaaacttatctgagtca

SEQ ID NO: 2174232 - DNA, 22 bp, Homo sapiens
attaatgagacacacttaacta

SEQ ID NO: 2174233 - DNA, 22 bp, Homo sapiens
attaatttctctcaatttgggt

SEQ ID NO: 2174234 - DNA, 22 bp, Homo sapiens
attaatttgttaattaaatatt

SEQ ID NO: 2174235 - DNA, 13 bp, Homo sapiens
attacaagtttca

SEQ ID NO: 2174236 - DNA, 20 bp, Homo sapiens
attacaagtttcagtaatag

SEQ ID NO: 2174237 - DNA, 22 bp, Homo sapiens
attacacacgtgtgatgtatgt

SEQ ID NO: 2174238 - DNA, 14 bp, Homo sapiens
attacacccatgca

SEQ ID NO: 2174239 - DNA, 15 bp, Homo sapiens
attacacccatgcac

SEQ ID NO: 2174240 - DNA, 16 bp, Homo sapiens
attacacccatgcaca

SEQ ID NO: 2174241 - DNA, 17 bp, Homo sapiens
attacaggtgtgagcca

SEQ ID NO: 2174242 - DNA, 21 bp, Homo sapiens
attacagtgtaaaaattcaga

SEQ ID NO: 2174243 - DNA, 20 bp, Homo sapiens
attaccgtcacactcttcag

SEQ ID NO: 2174244 - DNA, 20 bp, Homo sapiens
attactctttgctttgtagt

SEQ ID NO: 2174245 - DNA, 23 bp, Homo sapiens
attactgatccccaatatgttga

SEQ ID NO: 2174246 - DNA, 12 bp, Homo sapiens
attactttacca

SEQ ID NO: 2174247 - DNA, 15 bp, Homo sapiens
attagaaaccatgaa

SEQ ID NO: 2174248 - DNA, 20 bp, Homo sapiens
attagaaagactttctaaat

SEQ ID NO: 2174249 - DNA, 18 bp, Homo sapiens
attagaacttagttttgt

SEQ ID NO: 2174250 - DNA, 22 bp, Homo sapiens
attagccaactgtttccctgct

SEQ ID NO: 2174251 - DNA, 15 bp, Homo sapiens
attagtgaagtatgc

SEQ ID NO: 2174252 - DNA, 17 bp, Homo sapiens
attagttgtatataaaa

SEQ ID NO: 2174253 - DNA, 18 bp, Homo sapiens
attataatcttataattg

SEQ ID NO: 2174254 - DNA, 14 bp, Homo sapiens
attataattttgac

SEQ ID NO: 2174255 - DNA, 21 bp, Homo sapiens
attatacatgggtagcttctg

SEQ ID NO: 2174256 - DNA, 17 bp, Homo sapiens
attatacgtatgcattt

SEQ ID NO: 2174257 - DNA, 17 bp, Homo sapiens
attatataactgtattt

SEQ ID NO: 2174258 - DNA, 22 bp, Homo sapiens
attatcatttatttttaaaata

SEQ ID NO: 2174259 - DNA, 13 bp, Homo sapiens
attattactgttt

SEQ ID NO: 2174260 - DNA, 22 bp, Homo sapiens
attattcatagctgtatatttg

SEQ ID NO: 2174261 - DNA, 17 bp, Homo sapiens
attattggacttccatt

SEQ ID NO: 2174262 - DNA, 22 bp, Homo sapiens
attcaaacaattcaatcaaagc

SEQ ID NO: 2174263 - DNA, 13 bp, Homo sapiens
attcaatcaaagc

SEQ ID NO: 2174264 - DNA, 21 bp, Homo sapiens
attcaatttgattctatgact

SEQ ID NO: 2174265 - DNA, 22 bp, Homo sapiens
attcaatttgattctatgactg

SEQ ID NO: 2174266 - DNA, 14 bp, Homo sapiens
attcacaagctgcc

SEQ ID NO: 2174267 - DNA, 16 bp, Homo sapiens
attcacaagctgcctc

SEQ ID NO: 2174268 - DNA, 20 bp, Homo sapiens
attcacaagctgcctccctg

SEQ ID NO: 2174269 - DNA, 18 bp, Homo sapiens
attcacttgtgtttgtat

SEQ ID NO: 2174270 - DNA, 19 bp, Homo sapiens
attcagattgacaaggtag

SEQ ID NO: 2174271 - DNA, 13 bp, Homo sapiens
attcagctgcccc

SEQ ID NO: 2174272 - DNA, 18 bp, Homo sapiens
attcagtgagacacagag

SEQ ID NO: 2174273 - DNA, 13 bp, Homo sapiens
attcatacctgtt

SEQ ID NO: 2174274 - DNA, 13 bp, Homo sapiens
attcattcagtga

SEQ ID NO: 2174275 - DNA, 14 bp, Homo sapiens
attcatttcatcta

SEQ ID NO: 2174276 - DNA, 16 bp, Homo sapiens
attccaatacattatt

SEQ ID NO: 2174277 - DNA, 13 bp, Homo sapiens
attccaatattta

SEQ ID NO: 2174278 - DNA, 15 bp, Homo sapiens
attccaatatttata

SEQ ID NO: 2174279 - DNA, 21 bp, Homo sapiens
attccaatatttataattaaa

SEQ ID NO: 2174280 - DNA, 16 bp, Homo sapiens
attccatttgctgatt

SEQ ID NO: 2174281 - DNA, 14 bp, Homo sapiens
attcccagaggtgg

SEQ ID NO: 2174282 - DNA, 16 bp, Homo sapiens
attcccagaggtgggg

SEQ ID NO: 2174283 - DNA, 20 bp, Homo sapiens
attcccatggtagactgtga

SEQ ID NO: 2174284 - DNA, 22 bp, Homo sapiens
attcccatggtagactgtgaca

SEQ ID NO: 2174285 - DNA, 23 bp, Homo sapiens
attccccctggccaccacccccc

SEQ ID NO: 2174286 - DNA, 14 bp, Homo sapiens
attccggccctggc

SEQ ID NO: 2174287 - DNA, 19 bp, Homo sapiens
attcctttccagaatgcaa

SEQ ID NO: 2174288 - DNA, 16 bp, Homo sapiens
attctgaagttttatt

SEQ ID NO: 2174289 - DNA, 17 bp, Homo sapiens
attctgggcaaatagat

SEQ ID NO: 2174290 - DNA, 19 bp, Homo sapiens
attcttaaagtacttgtta

SEQ ID NO: 2174291 - DNA, 12 bp, Homo sapiens
attcttaaagtg

SEQ ID NO: 2174292 - DNA, 17 bp, Homo sapiens
attctttaattgttgct

SEQ ID NO: 2174293 - DNA, 14 bp, Homo sapiens
attctttccatgca

SEQ ID NO: 2174294 - DNA, 21 bp, Homo sapiens
attcttttttcttccccctcc

SEQ ID NO: 2174295 - DNA, 23 bp, Homo sapiens
attcttttttcttccccctccat

SEQ ID NO: 2174296 - DNA, 23 bp, Homo sapiens
attgaaaagacgctaataaaaat

SEQ ID NO: 2174297 - DNA, 19 bp, Homo sapiens
attgaggttgttcaaagtt

SEQ ID NO: 2174298 - DNA, 13 bp, Homo sapiens
attgataataaaa

SEQ ID NO: 2174299 - DNA, 15 bp, Homo sapiens
attgataataaaatt

SEQ ID NO: 2174300 - DNA, 18 bp, Homo sapiens
attgataataaaattcat

SEQ ID NO: 2174301 - DNA, 21 bp, Homo sapiens
atttcagaagttagtttgtat

SEQ ID NO: 2174302 - DNA, 17 bp, Homo sapiens
atttcagcacatgcact

SEQ ID NO: 2174303 - DNA, 15 bp, Homo sapiens
atttcatctttccaa

SEQ ID NO: 2174304 - DNA, 18 bp, Homo sapiens
atttccatattaaaatca

SEQ ID NO: 2174305 - DNA, 14 bp, Homo sapiens
atttcccaagctgg

SEQ ID NO: 2174306 - DNA, 22 bp, Homo sapiens
atttcccctcccgtcttcctcc

SEQ ID NO: 2174307 - DNA, 23 bp, Homo sapiens
atttcccctcccgtcttcctcct

SEQ ID NO: 2174308 - DNA, 21 bp, Homo sapiens
atttctacaactgatcatttg

SEQ ID NO: 2174309 - DNA, 19 bp, Homo sapiens
atttctatggcatattgat

SEQ ID NO: 2174310 - DNA, 22 bp, Homo sapiens
atttctcaaagtttttacagtg

SEQ ID NO: 2174311 - DNA, 23 bp, Homo sapiens
atttctcaaagtttttacagtgt

SEQ ID NO: 2174312 - DNA, 23 bp, Homo sapiens
atttctcatagcaggaaatgtag

SEQ ID NO: 2174313 - DNA, 22 bp, Homo sapiens
atttctcatcaattctctatca

SEQ ID NO: 2174314 - DNA, 19 bp, Homo sapiens
atttctctcaatttgggtc

SEQ ID NO: 2174315 - DNA, 12 bp, Homo sapiens
atttcttcccaa

SEQ ID NO: 2174316 - DNA, 13 bp, Homo sapiens
atttcttgggaaa

SEQ ID NO: 2174317 - DNA, 22 bp, Homo sapiens
atttgccccaacttaagtttag

SEQ ID NO: 2174318 - DNA, 22 bp, Homo sapiens
atttggagtggaggcattgttt

SEQ ID NO: 2174319 - DNA, 16 bp, Homo sapiens
atttgggtttttaagt

SEQ ID NO: 2174320 - DNA, 15 bp, Homo sapiens
atttggtcaccttcc

SEQ ID NO: 2174321 - DNA, 20 bp, Homo sapiens
atttgtaaaaataatgaatg

SEQ ID NO: 2174322 - DNA, 12 bp, Homo sapiens
atttgtgtaaag

SEQ ID NO: 2174323 - DNA, 18 bp, Homo sapiens
atttgtgttcccatttta

SEQ ID NO: 2174324 - DNA, 17 bp, Homo sapiens
atttgttaatatatata

SEQ ID NO: 2174325 - DNA, 16 bp, Homo sapiens
atttgttaattaaata

SEQ ID NO: 2174326 - DNA, 11 bp, Homo sapiens
attttaacttg

SEQ ID NO: 2174327 - DNA, 22 bp, Homo sapiens
attttacgttttagaaaatttt

SEQ ID NO: 2174328 - DNA, 21 bp, Homo sapiens
attttatcaggggaatttcag

SEQ ID NO: 2174329 - DNA, 14 bp, Homo sapiens
attttcaacattga

SEQ ID NO: 2174330 - DNA, 18 bp, Homo sapiens
attttcaacattgatttt

SEQ ID NO: 2174331 - DNA, 17 bp, Homo sapiens
attttcctgtgtccaca

SEQ ID NO: 2174332 - DNA, 14 bp, Homo sapiens
attttctagaatac

SEQ ID NO: 2174333 - DNA, 22 bp, Homo sapiens
attttctagaatactaataaaa

SEQ ID NO: 2174334 - DNA, 23 bp, Homo sapiens
attttctagaatactaataaaat

SEQ ID NO: 2174335 - DNA, 12 bp, Homo sapiens
attttctttcta

SEQ ID NO: 2174336 - DNA, 20 bp, Homo sapiens
attttcttttttgataattt

SEQ ID NO: 2174337 - DNA, 21 bp, Homo sapiens
attttgcaaacactgtgatta

SEQ ID NO: 2174338 - DNA, 20 bp, Homo sapiens
attttgcacgaattttaaaa

SEQ ID NO: 2174339 - DNA, 17 bp, Homo sapiens
attttgcgatgtgtttt

SEQ ID NO: 2174340 - DNA, 16 bp, Homo sapiens
attttggacgtgtgag

SEQ ID NO: 2174341 - DNA, 16 bp, Homo sapiens
attttggccactttgc

SEQ ID NO: 2174342 - DNA, 14 bp, Homo sapiens
attttgtaattaac

SEQ ID NO: 2174343 - DNA, 15 bp, Homo sapiens
attttgtgtcttaag

SEQ ID NO: 2174344 - DNA, 13 bp, Homo sapiens
atttttaaaataa

SEQ ID NO: 2174345 - DNA, 14 bp, Homo sapiens
atttttaaaatgaa

SEQ ID NO: 2174346 - DNA, 15 bp, Homo sapiens
atttttaaaatgaat

SEQ ID NO: 2174347 - DNA, 19 bp, Homo sapiens
atttttaggtgtcttttaa

SEQ ID NO: 2174348 - DNA, 22 bp, Homo sapiens
atttttagtaacctttaaaaat

SEQ ID NO: 2174349 - DNA, 19 bp, Homo sapiens
atttttatcccatctcact

SEQ ID NO: 2174350 - DNA, 18 bp, Homo sapiens
atttttattaatttgtaa

SEQ ID NO: 2174351 - DNA, 22 bp, Homo sapiens
atttttcaatagcacatatgga

SEQ ID NO: 2174352 - DNA, 13 bp, Homo sapiens
atttttcctcaaa

SEQ ID NO: 2174353 - DNA, 14 bp, Homo sapiens
atttttgtactgtg

SEQ ID NO: 2174354 - DNA, 17 bp, Homo sapiens
atttttgtactgtgctg

SEQ ID NO: 2174355 - DNA, 19 bp, Homo sapiens
atttttgtactgtgctgat

SEQ ID NO: 2174356 - DNA, 12 bp, Homo sapiens
attttttgttga

SEQ ID NO: 2174357 - DNA, 15 bp, Homo sapiens
attttttgttgaata

SEQ ID NO: 2174358 - DNA, 14 bp, Homo sapiens
atttttttagtttg

SEQ ID NO: 2174359 - DNA, 16 bp, Homo sapiens
atttttttagtttgtt

SEQ ID NO: 2174360 - DNA, 15 bp, Homo sapiens
atttttttgttgctg

SEQ ID NO: 2174361 - DNA, 19 bp, Homo sapiens
attttttttttaacttgaa

SEQ ID NO: 2174362 - DNA, 20 bp, Homo sapiens
attttttttttaacttgaaa

SEQ ID NO: 2174363 - DNA, 22 bp, Homo sapiens
attttttttttaacttgaaaag

SEQ ID NO: 2174364 - DNA, 16 bp, Homo sapiens
caaaaaactaaagcag

SEQ ID NO: 2174365 - DNA, 16 bp, Homo sapiens
caaaaacaaagtgcaa

SEQ ID NO: 2174366 - DNA, 19 bp, Homo sapiens
caaaaacaaagtgcaaagc

SEQ ID NO: 2174367 - DNA, 23 bp, Homo sapiens
caaaaacaaagtgcaaagctgct

SEQ ID NO: 2174368 - DNA, 12 bp, Homo sapiens
caaaaacaagca

SEQ ID NO: 2174369 - DNA, 20 bp, Homo sapiens
caaaaattcacaagctgcct

SEQ ID NO: 2174370 - DNA, 14 bp, Homo sapiens
caatgtttgcttta

SEQ ID NO: 2174371 - DNA, 23 bp, Homo sapiens
caattattttggatctatcacct

SEQ ID NO: 2174372 - DNA, 16 bp, Homo sapiens
caattcaaacaattca

SEQ ID NO: 2174373 - DNA, 13 bp, Homo sapiens
caattcaatcaaa

SEQ ID NO: 2174374 - DNA, 15 bp, Homo sapiens
caattcaatcaaagc

SEQ ID NO: 2174375 - DNA, 17 bp, Homo sapiens
caattcaatcaaagcta

SEQ ID NO: 2174376 - DNA, 23 bp, Homo sapiens
caattcagagaatagcagtttca

SEQ ID NO: 2174377 - DNA, 17 bp, Homo sapiens
caattccattttgtgtc

SEQ ID NO: 2174378 - DNA, 12 bp, Homo sapiens
caatttctcccc

SEQ ID NO: 2174379 - DNA, 23 bp, Homo sapiens
caatttgggtcccagctaaagag

SEQ ID NO: 2174380 - DNA, 23 bp, Homo sapiens
caattttttttctgaacaaaagc

SEQ ID NO: 2174381 - DNA, 21 bp, Homo sapiens
cacaaaaagaaagctgtgaaa

SEQ ID NO: 2174382 - DNA, 20 bp, Homo sapiens
cacaaaaagagaagctgtgt

SEQ ID NO: 2174383 - DNA, 14 bp, Homo sapiens
cacaaaagcctctc

SEQ ID NO: 2174384 - DNA, 20 bp, Homo sapiens
cacaaagctaaatacatgga

SEQ ID NO: 2174385 - DNA, 14 bp, Homo sapiens
cacaacaccaggac

SEQ ID NO: 2174386 - DNA, 13 bp, Homo sapiens
cacaacgctgctg

SEQ ID NO: 2174387 - DNA, 12 bp, Homo sapiens
cacaagaagtgg

SEQ ID NO: 2174388 - DNA, 17 bp, Homo sapiens
cacaagaagtgggagtg

SEQ ID NO: 2174389 - DNA, 23 bp, Homo sapiens
cacaagcctcttctgaagatgga

SEQ ID NO: 2174390 - DNA, 16 bp, Homo sapiens
cacaagctgcctccct

SEQ ID NO: 2174391 - DNA, 22 bp, Homo sapiens
cacaagctgcctccctgtccac

SEQ ID NO: 2174392 - DNA, 15 bp, Homo sapiens
cacaagctgtccctg

SEQ ID NO: 2174393 - DNA, 22 bp, Homo sapiens
cacaatctttccttgtctctca

SEQ ID NO: 2174394 - DNA, 17 bp, Homo sapiens
cacaattatgctgtgaa

SEQ ID NO: 2174395 - DNA, 14 bp, Homo sapiens
cacacaacaccagg

SEQ ID NO: 2174396 - DNA, 15 bp, Homo sapiens
cacacaacaccagga

SEQ ID NO: 2174397 - DNA, 16 bp, Homo sapiens
cacaccagttactgtt

SEQ ID NO: 2174398 - DNA, 15 bp, Homo sapiens
cacacccagcctctg

SEQ ID NO: 2174399 - DNA, 13 bp, Homo sapiens
cacacccccaccc

SEQ ID NO: 2174400 - DNA, 14 bp, Homo sapiens
cacacctagcgtca

SEQ ID NO: 2174401 - DNA, 22 bp, Homo sapiens
cacactcttcagtgactcctgc

SEQ ID NO: 2174402 - DNA, 21 bp, Homo sapiens
cacacttcactaaagtgtcat

SEQ ID NO: 2174403 - DNA, 14 bp, Homo sapiens
cacagaaaccctgt

SEQ ID NO: 2174404 - DNA, 14 bp, Homo sapiens
cacagaacaagcca

SEQ ID NO: 2174405 - DNA, 21 bp, Homo sapiens
cacagacaagcagcccttgct

SEQ ID NO: 2174406 - DNA, 15 bp, Homo sapiens
cacagacccctggga

SEQ ID NO: 2174407 - DNA, 17 bp, Homo sapiens
cacagacccctgggagc

SEQ ID NO: 2174408 - DNA, 13 bp, Homo sapiens
cacagactatttt

SEQ ID NO: 2174409 - DNA, 20 bp, Homo sapiens
cacagactggagacaatgca

SEQ ID NO: 2174410 - DNA, 12 bp, Homo sapiens
cacagagagaaa

SEQ ID NO: 2174411 - DNA, 19 bp, Homo sapiens
cacagagcatggcctccag

SEQ ID NO: 2174412 - DNA, 19 bp, Homo sapiens
cacagaggcagtggcagca

SEQ ID NO: 2174413 - DNA, 19 bp, Homo sapiens
cacagagtggagccctcag

SEQ ID NO: 2174414 - DNA, 22 bp, Homo sapiens
cacagagtggagccctcagttt

SEQ ID NO: 2174415 - DNA, 22 bp, Homo sapiens
cacagcacctcctctctgctgg

SEQ ID NO: 2174416 - DNA, 20 bp, Homo sapiens
cacagccatcccagccttgg

SEQ ID NO: 2174417 - DNA, 19 bp, Homo sapiens
cacagccggggcctgccta

SEQ ID NO: 2174418 - DNA, 14 bp, Homo sapiens
cacagcctgtcttc

SEQ ID NO: 2174419 - DNA, 18 bp, Homo sapiens
cacagctcacggcagcct

SEQ ID NO: 2174420 - DNA, 22 bp, Homo sapiens
cacagctcacggcagcctcaac

SEQ ID NO: 2174421 - DNA, 17 bp, Homo sapiens
cacagctgagctggcct

SEQ ID NO: 2174422 - DNA, 18 bp, Homo sapiens
cacagctgagctggccta

SEQ ID NO: 2174423 - DNA, 23 bp, Homo sapiens
cacgcaggctgagtgcactggca

SEQ ID NO: 2174424 - DNA, 22 bp, Homo sapiens
cacgcttcaaggatatactgca

SEQ ID NO: 2174425 - DNA, 14 bp, Homo sapiens
cacggcagcctcaa

SEQ ID NO: 2174426 - DNA, 14 bp, Homo sapiens
cacggccactgcag

SEQ ID NO: 2174427 - DNA, 16 bp, Homo sapiens
cacggccactgcagtc

SEQ ID NO: 2174428 - DNA, 19 bp, Homo sapiens
cacggccactgcagtcacc

SEQ ID NO: 2174429 - DNA, 16 bp, Homo sapiens
cacggcctggctggtg

SEQ ID NO: 2174430 - DNA, 22 bp, Homo sapiens
cacgggctgcgccgtctgctcg

SEQ ID NO: 2174431 - DNA, 20 bp, Homo sapiens
cacgggggaggccgaggcag

SEQ ID NO: 2174432 - DNA, 14 bp, Homo sapiens
cacgtgctggagag

SEQ ID NO: 2174433 - DNA, 19 bp, Homo sapiens
cacgtttagtaactgtttt

SEQ ID NO: 2174434 - DNA, 20 bp, Homo sapiens
cactaactagagcagccctg

SEQ ID NO: 2174435 - DNA, 13 bp, Homo sapiens
cactaggctgggt

SEQ ID NO: 2174436 - DNA, 21 bp, Homo sapiens
cactaggctgggtgcccacag

SEQ ID NO: 2174437 - DNA, 22 bp, Homo sapiens
cactaggctgggtgcccacagc

SEQ ID NO: 2174438 - DNA, 15 bp, Homo sapiens
cactagtctgtgtgc

SEQ ID NO: 2174439 - DNA, 20 bp, Homo sapiens
cactagtctgtgtgctgtgg

SEQ ID NO: 2174440 - DNA, 16 bp, Homo sapiens
cactatagccatttgc

SEQ ID NO: 2174441 - DNA, 22 bp, Homo sapiens
cactatggtgccaatggaacct

SEQ ID NO: 2174442 - DNA, 13 bp, Homo sapiens
cactattggactt

SEQ ID NO: 2174443 - DNA, 14 bp, Homo sapiens
cactattggacttt

SEQ ID NO: 2174444 - DNA, 21 bp, Homo sapiens
cactcaaaaaggtgtgtcaaa

SEQ ID NO: 2174445 - DNA, 22 bp, Homo sapiens
cactcaacaaaagtgctttgga

SEQ ID NO: 2174446 - DNA, 17 bp, Homo sapiens
cactcaagcaacaagcc

SEQ ID NO: 2174447 - DNA, 17 bp, Homo sapiens
cactcacagagacacag

SEQ ID NO: 2174448 - DNA, 18 bp, Homo sapiens
cactcacagagacacagg

SEQ ID NO: 2174449 - DNA, 12 bp, Homo sapiens
cactcacatgct

SEQ ID NO: 2174450 - DNA, 23 bp, Homo sapiens
cactcagcatccccaaccgtgca

SEQ ID NO: 2174451 - DNA, 22 bp, Homo sapiens
cactcatttatttccatattaa

SEQ ID NO: 2174452 - DNA, 20 bp, Homo sapiens
cactccaggaaggggctgga

SEQ ID NO: 2174453 - DNA, 16 bp, Homo sapiens
cactccggattccggc

SEQ ID NO: 2174454 - DNA, 21 bp, Homo sapiens
cactctcccagaggctcctgg

SEQ ID NO: 2174455 - DNA, 20 bp, Homo sapiens
cactcttcagtgactcctgc

SEQ ID NO: 2174456 - DNA, 17 bp, Homo sapiens
cactgatctttgcaaag

SEQ ID NO: 2174457 - DNA, 16 bp, Homo sapiens
cactgcaaataaagcc

SEQ ID NO: 2174458 - DNA, 18 bp, Homo sapiens
cactgcacataatttgca

SEQ ID NO: 2174459 - DNA, 20 bp, Homo sapiens
cactggcaggatcacagctc

SEQ ID NO: 2174460 - DNA, 16 bp, Homo sapiens
cactggcatctctgga

SEQ ID NO: 2174461 - DNA, 18 bp, Homo sapiens
cactggtgtaaaaaacaa

SEQ ID NO: 2174462 - DNA, 18 bp, Homo sapiens
cactgttttgttggccca

SEQ ID NO: 2174463 - DNA, 14 bp, Homo sapiens
cacttatttccatg

SEQ ID NO: 2174464 - DNA, 19 bp, Homo sapiens
cacttccctgggcaaatga

SEQ ID NO: 2174465 - DNA, 22 bp, Homo sapiens
cacttgaaacttggttcccaga

SEQ ID NO: 2174466 - DNA, 20 bp, Homo sapiens
cacttggtgatatgtcctat

SEQ ID NO: 2174467 - DNA, 22 bp, Homo sapiens
cagccttgaccacggctgttcc

SEQ ID NO: 2174468 - DNA, 17 bp, Homo sapiens
cagccttggcatctaga

SEQ ID NO: 2174469 - DNA, 13 bp, Homo sapiens
cagcctttcttcc

SEQ ID NO: 2174470 - DNA, 13 bp, Homo sapiens
cagcgagtgcttg

SEQ ID NO: 2174471 - DNA, 14 bp, Homo sapiens
cagcgggcggaggg

SEQ ID NO: 2174472 - DNA, 17 bp, Homo sapiens
cagcggtggaaggagcc

SEQ ID NO: 2174473 - DNA, 21 bp, Homo sapiens
cagcggtggaaggagcctgcg

SEQ ID NO: 2174474 - DNA, 17 bp, Homo sapiens
cagcggttgtaaataca

SEQ ID NO: 2174475 - DNA, 18 bp, Homo sapiens
cagcggttgtaaatacaa

SEQ ID NO: 2174476 - DNA, 19 bp, Homo sapiens
cagcgtctgagcggccgcc

SEQ ID NO: 2174477 - DNA, 21 bp, Homo sapiens
cagcgtctgagcggccgcctg

SEQ ID NO: 2174478 - DNA, 15 bp, Homo sapiens
cagctaagcctgatg

SEQ ID NO: 2174479 - DNA, 19 bp, Homo sapiens
cagctaagcctgatgatgg

SEQ ID NO: 2174480 - DNA, 22 bp, Homo sapiens
cagctaattctactcacagtgc

SEQ ID NO: 2174481 - DNA, 18 bp, Homo sapiens
cagctataacagtaggga

SEQ ID NO: 2174482 - DNA, 18 bp, Homo sapiens
cagctattaagaaaatca

SEQ ID NO: 2174483 - DNA, 23 bp, Homo sapiens
cagctatttctcatcaattctct

SEQ ID NO: 2174484 - DNA, 15 bp, Homo sapiens
cagctcagccagtgg

SEQ ID NO: 2174485 - DNA, 23 bp, Homo sapiens
cagctcaggctgtttttgggtgc

SEQ ID NO: 2174486 - DNA, 14 bp, Homo sapiens
cagctccgcctggc

SEQ ID NO: 2174487 - DNA, 12 bp, Homo sapiens
cagctctggaga

SEQ ID NO: 2174488 - DNA, 13 bp, Homo sapiens
cagctctggagaa

SEQ ID NO: 2174489 - DNA, 15 bp, Homo sapiens
cagctctggagaaca

SEQ ID NO: 2174490 - DNA, 20 bp, Homo sapiens
cagctctggctcacagactg

SEQ ID NO: 2174491 - DNA, 14 bp, Homo sapiens
cagctgaaggcagt

SEQ ID NO: 2174492 - DNA, 19 bp, Homo sapiens
cagctgaaggcagtggcag

SEQ ID NO: 2174493 - DNA, 21 bp, Homo sapiens
cagctgacttggttctgaagc

SEQ ID NO: 2174494 - DNA, 23 bp, Homo sapiens
cagctgacttggttctgaagcca

SEQ ID NO: 2174495 - DNA, 17 bp, Homo sapiens
cagctgcaggtgcccat

SEQ ID NO: 2174496 - DNA, 15 bp, Homo sapiens
cagctgcccccgctc

SEQ ID NO: 2174497 - DNA, 15 bp, Homo sapiens
cagctgctcctcgca

SEQ ID NO: 2174498 - DNA, 14 bp, Homo sapiens
cagctgctctgccc

SEQ ID NO: 2174499 - DNA, 16 bp, Homo sapiens
cagctggcggaacctg

SEQ ID NO: 2174500 - DNA, 19 bp, Homo sapiens
cagctggcggaacctggct

SEQ ID NO: 2174501 - DNA, 22 bp, Homo sapiens
cagctggcggaacctggctgcg

SEQ ID NO: 2174502 - DNA, 14 bp, Homo sapiens
cagctggggcccct

SEQ ID NO: 2174503 - DNA, 15 bp, Homo sapiens
cagctggggcccctc

SEQ ID NO: 2174504 - DNA, 19 bp, Homo sapiens
cagctggggcccctcggct

SEQ ID NO: 2174505 - DNA, 22 bp, Homo sapiens
cagcttctgtcctcttctgtga

SEQ ID NO: 2174506 - DNA, 19 bp, Homo sapiens
cagcttggggcagccattg

SEQ ID NO: 2174507 - DNA, 17 bp, Homo sapiens
cagcttggggccatcgg

SEQ ID NO: 2174508 - DNA, 15 bp, Homo sapiens
cagcttttctctttt

SEQ ID NO: 2174509 - DNA, 16 bp, Homo sapiens
cagcttttctcttttt

SEQ ID NO: 2174510 - DNA, 12 bp, Homo sapiens
caggaaatgtag

SEQ ID NO: 2174511 - DNA, 18 bp, Homo sapiens
caggaagccgtcctggcg

SEQ ID NO: 2174512 - DNA, 23 bp, Homo sapiens
caggaaggggctggactggctgt

SEQ ID NO: 2174513 - DNA, 12 bp, Homo sapiens
caggaattcagt

SEQ ID NO: 2174514 - DNA, 19 bp, Homo sapiens
caggaattcagtgccttca

SEQ ID NO: 2174515 - DNA, 23 bp, Homo sapiens
caggacagcatggtgcatgccgc

SEQ ID NO: 2174516 - DNA, 15 bp, Homo sapiens
caggacagctgcagg

SEQ ID NO: 2174517 - DNA, 21 bp, Homo sapiens
caggacctaggatatcttctc

SEQ ID NO: 2174518 - DNA, 23 bp, Homo sapiens
caggacctaggatatcttctcca

SEQ ID NO: 2174519 - DNA, 22 bp, Homo sapiens
caggacttctgtgcattgtaaa

SEQ ID NO: 2174520 - DNA, 23 bp, Homo sapiens
caggagagagcttcctgtttcta

SEQ ID NO: 2174521 - DNA, 20 bp, Homo sapiens
caggagcatccacctccttc

SEQ ID NO: 2174522 - DNA, 22 bp, Homo sapiens
caggagcatccacctccttctc

SEQ ID NO: 2174523 - DNA, 16 bp, Homo sapiens
caggagcattttgtgt

SEQ ID NO: 2174524 - DNA, 16 bp, Homo sapiens
caggagcctggacccg

SEQ ID NO: 2174525 - DNA, 12 bp, Homo sapiens
caggagctcaga

SEQ ID NO: 2174526 - DNA, 20 bp, Homo sapiens
caggaggagattaacacact

SEQ ID NO: 2174527 - DNA, 18 bp, Homo sapiens
caggatcacagctcacgg

SEQ ID NO: 2174528 - DNA, 19 bp, Homo sapiens
caggatcacagctcacggc

SEQ ID NO: 2174529 - DNA, 19 bp, Homo sapiens
caggcacagtaagcatgct

SEQ ID NO: 2174530 - DNA, 22 bp, Homo sapiens
caggcatcattccaccatggct

SEQ ID NO: 2174531 - DNA, 15 bp, Homo sapiens
caggccaaagacctc

SEQ ID NO: 2174532 - DNA, 12 bp, Homo sapiens
caggcccaccta

SEQ ID NO: 2174533 - DNA, 14 bp, Homo sapiens
caggcccagctggg

SEQ ID NO: 2174534 - DNA, 18 bp, Homo sapiens
caggctactggtttgtat

SEQ ID NO: 2174535 - DNA, 12 bp, Homo sapiens
caggctctgcac

SEQ ID NO: 2174536 - DNA, 23 bp, Homo sapiens
caggctgagtgcactggcaggat

SEQ ID NO: 2174537 - DNA, 14 bp, Homo sapiens
cagggaaggacagg

SEQ ID NO: 2174538 - DNA, 15 bp, Homo sapiens
cagggaaggacagga

SEQ ID NO: 2174539 - DNA, 19 bp, Homo sapiens
cagggacacaaagaggaat

SEQ ID NO: 2174540 - DNA, 18 bp, Homo sapiens
cagggatggggccacagc

SEQ ID NO: 2174541 - DNA, 15 bp, Homo sapiens
cagggcagcctgtgg

SEQ ID NO: 2174542 - DNA, 18 bp, Homo sapiens
cagggccctctgaggctc

SEQ ID NO: 2174543 - DNA, 17 bp, Homo sapiens
caggggaggagcctgtg

SEQ ID NO: 2174544 - DNA, 13 bp, Homo sapiens
caggggcctgcag

SEQ ID NO: 2174545 - DNA, 14 bp, Homo sapiens
caggggcctgcaga

SEQ ID NO: 2174546 - DNA, 18 bp, Homo sapiens
caggggcgctggctgcac

SEQ ID NO: 2174547 - DNA, 15 bp, Homo sapiens
caggggctggtgggc

SEQ ID NO: 2174548 - DNA, 23 bp, Homo sapiens
caggggcttcacccatgaaatta

SEQ ID NO: 2174549 - DNA, 18 bp, Homo sapiens
caggggttccagcttccc

SEQ ID NO: 2174550 - DNA, 14 bp, Homo sapiens
cagggtagaaaaag

SEQ ID NO: 2174551 - DNA, 12 bp, Homo sapiens
cagggtcctgct

SEQ ID NO: 2174552 - DNA, 13 bp, Homo sapiens
cagggtcctgcta

SEQ ID NO: 2174553 - DNA, 15 bp, Homo sapiens
cagggtgtctgtcag

SEQ ID NO: 2174554 - DNA, 19 bp, Homo sapiens
cagtcttgtactgtgacct

SEQ ID NO: 2174555 - DNA, 15 bp, Homo sapiens
cagtgactcctgctg

SEQ ID NO: 2174556 - DNA, 19 bp, Homo sapiens
cagtgactcctgctggtac

SEQ ID NO: 2174557 - DNA, 13 bp, Homo sapiens
cagtgagacacag

SEQ ID NO: 2174558 - DNA, 16 bp, Homo sapiens
cagtgagacacagagt

SEQ ID NO: 2174559 - DNA, 18 bp, Homo sapiens
cagtgagacacagagtgg

SEQ ID NO: 2174560 - DNA, 13 bp, Homo sapiens
cagtgagacagcc

SEQ ID NO: 2174561 - DNA, 17 bp, Homo sapiens
cagtgatggcattactc

SEQ ID NO: 2174562 - DNA, 21 bp, Homo sapiens
cagtgatgggagtaagagcaa

SEQ ID NO: 2174563 - DNA, 23 bp, Homo sapiens
cagtgattgaagtatctgtacct

SEQ ID NO: 2174564 - DNA, 14 bp, Homo sapiens
cagtgatttttagt

SEQ ID NO: 2174565 - DNA, 22 bp, Homo sapiens
cagtgcattttcaacattgatt

SEQ ID NO: 2174566 - DNA, 13 bp, Homo sapiens
cagtgcccagtga

SEQ ID NO: 2174567 - DNA, 13 bp, Homo sapiens
cagtgccttcaac

SEQ ID NO: 2174568 - DNA, 14 bp, Homo sapiens
cagtgcctttcccc

SEQ ID NO: 2174569 - DNA, 15 bp, Homo sapiens
cagtggcaggggagc

SEQ ID NO: 2174570 - DNA, 17 bp, Homo sapiens
cagtggcaggggagcag

SEQ ID NO: 2174571 - DNA, 18 bp, Homo sapiens
cagtggcaggggagcagg

SEQ ID NO: 2174572 - DNA, 14 bp, Homo sapiens
cagtggcctggctc

SEQ ID NO: 2174573 - DNA, 15 bp, Homo sapiens
cagtggcctggctcc

SEQ ID NO: 2174574 - DNA, 18 bp, Homo sapiens
cagtggcctggctccgct

SEQ ID NO: 2174575 - DNA, 15 bp, Homo sapiens
cagtggttgcctggg

SEQ ID NO: 2174576 - DNA, 14 bp, Homo sapiens
cagtgtgccaccct

SEQ ID NO: 2174577 - DNA, 15 bp, Homo sapiens
cagtgtgccaccctc

SEQ ID NO: 2174578 - DNA, 21 bp, Homo sapiens
cagtgtgccaccctctgcagg

SEQ ID NO: 2174579 - DNA, 13 bp, Homo sapiens
cagtgtttttcct

SEQ ID NO: 2174580 - DNA, 17 bp, Homo sapiens
cagttaaacttgcaatg

SEQ ID NO: 2174581 - DNA, 13 bp, Homo sapiens
cagttactgttca

SEQ ID NO: 2174582 - DNA, 16 bp, Homo sapiens
cagttcatactgaatg

SEQ ID NO: 2174583 - DNA, 14 bp, Homo sapiens
cagttcatgttgct

SEQ ID NO: 2174584 - DNA, 16 bp, Homo sapiens
cagttcatgttgctca

SEQ ID NO: 2174585 - DNA, 13 bp, Homo sapiens
cagttctgatgag

SEQ ID NO: 2174586 - DNA, 19 bp, Homo sapiens
cagttgactggctttcctc

SEQ ID NO: 2174587 - DNA, 19 bp, Homo sapiens
cagttgctaaatttgtgtt

SEQ ID NO: 2174588 - DNA, 14 bp, Homo sapiens
cagttgtatttaac

SEQ ID NO: 2174589 - DNA, 13 bp, Homo sapiens
cagtttcccagaa

SEQ ID NO: 2174590 - DNA, 15 bp, Homo sapiens
cagtttctgttgttt

SEQ ID NO: 2174591 - DNA, 14 bp, Homo sapiens
cagtttcttttctt

SEQ ID NO: 2174592 - DNA, 17 bp, Homo sapiens
cagtttggctgtaattt

SEQ ID NO: 2174593 - DNA, 20 bp, Homo sapiens
cagttttccaaactgtgtca

SEQ ID NO: 2174594 - DNA, 11 bp, Homo sapiens
cagttttgtgt

SEQ ID NO: 2174595 - DNA, 12 bp, Homo sapiens
cagttttgtgta

SEQ ID NO: 2174596 - DNA, 15 bp, Homo sapiens
cataaaatctcacgc

SEQ ID NO: 2174597 - DNA, 18 bp, Homo sapiens
cataaaggtttacagtga

SEQ ID NO: 2174598 - DNA, 19 bp, Homo sapiens
catacctgttgtacacttg

SEQ ID NO: 2174599 - DNA, 15 bp, Homo sapiens
catactctgtctccc

SEQ ID NO: 2174600 - DNA, 20 bp, Homo sapiens
catagtaacgtgttactgga

SEQ ID NO: 2174601 - DNA, 22 bp, Homo sapiens
catatacatatgatcaaatact

SEQ ID NO: 2174602 - DNA, 19 bp, Homo sapiens
catatatatgccttatgta

SEQ ID NO: 2174603 - DNA, 18 bp, Homo sapiens
catatattcatacctgtt

SEQ ID NO: 2174604 - DNA, 21 bp, Homo sapiens
catatattgttatttttgtct

SEQ ID NO: 2174605 - DNA, 11 bp, Homo sapiens
catatcaagaa

SEQ ID NO: 2174606 - DNA, 19 bp, Homo sapiens
catatcctcagatatattt

SEQ ID NO: 2174607 - DNA, 17 bp, Homo sapiens
catatgcttactcttgc

SEQ ID NO: 2174608 - DNA, 12 bp, Homo sapiens
catattaaaatc

SEQ ID NO: 2174609 - DNA, 15 bp, Homo sapiens
catattaaaatcaca

SEQ ID NO: 2174610 - DNA, 16 bp, Homo sapiens
catattaaaatcacaa

SEQ ID NO: 2174611 - DNA, 15 bp, Homo sapiens
catattgataataaa

SEQ ID NO: 2174612 - DNA, 17 bp, Homo sapiens
catattgataataaaat

SEQ ID NO: 2174613 - DNA, 15 bp, Homo sapiens
catcaaccaggaaga

SEQ ID NO: 2174614 - DNA, 18 bp, Homo sapiens
catcaagatacacttgta

SEQ ID NO: 2174615 - DNA, 14 bp, Homo sapiens
catcactcccctcc

SEQ ID NO: 2174616 - DNA, 15 bp, Homo sapiens
catcactcccctcca

SEQ ID NO: 2174617 - DNA, 16 bp, Homo sapiens
catcactcggctgtgg

SEQ ID NO: 2174618 - DNA, 15 bp, Homo sapiens
catcagaaagaattg

SEQ ID NO: 2174619 - DNA, 23 bp, Homo sapiens
catcagaaagaattgatcagaat

SEQ ID NO: 2174620 - DNA, 13 bp, Homo sapiens
catcagcagtgat

SEQ ID NO: 2174621 - DNA, 24 bp, Homo sapiens
catcataactggcttctgcttgtc

SEQ ID NO: 2174622 - DNA, 13 bp, Homo sapiens
catccattaatta

SEQ ID NO: 2174623 - DNA, 17 bp, Homo sapiens
catcccaacagccaaga

SEQ ID NO: 2174624 - DNA, 14 bp, Homo sapiens
catcccagccttgg

SEQ ID NO: 2174625 - DNA, 20 bp, Homo sapiens
catccccctccttgccgctg

SEQ ID NO: 2174626 - DNA, 17 bp, Homo sapiens
catcctgtacaagtgct

SEQ ID NO: 2174627 - DNA, 18 bp, Homo sapiens
catcctgtcccaccatgc

SEQ ID NO: 2174628 - DNA, 20 bp, Homo sapiens
catcctgtcccaccatgcag

SEQ ID NO: 2174629 - DNA, 17 bp, Homo sapiens
catccttagcaacagcc

SEQ ID NO: 2174630 - DNA, 17 bp, Homo sapiens
catcgttctaaaatcaa

SEQ ID NO: 2174631 - DNA, 20 bp, Homo sapiens
catctaattcaagattacaa

SEQ ID NO: 2174632 - DNA, 21 bp, Homo sapiens
catctatgtgaatatttgtaa

SEQ ID NO: 2174633 - DNA, 24 bp, Homo sapiens
catctccctcgaacccacactgca

SEQ ID NO: 2174634 - DNA, 18 bp, Homo sapiens
catctctgaacttcagct

SEQ ID NO: 2174635 - DNA, 14 bp, Homo sapiens
catctgaaaacaat

SEQ ID NO: 2174636 - DNA, 14 bp, Homo sapiens
catcttagcaagca

SEQ ID NO: 2174637 - DNA, 17 bp, Homo sapiens
catcttagttctgtata

SEQ ID NO: 2174638 - DNA, 23 bp, Homo sapiens
catcttagttctgtatataaata

SEQ ID NO: 2174639 - DNA, 12 bp, Homo sapiens
catctttccaaa

SEQ ID NO: 2174640 - DNA, 15 bp, Homo sapiens
catcttttgggaagc

SEQ ID NO: 2174641 - DNA, 14 bp, Homo sapiens
catgaaattaataa

SEQ ID NO: 2174642 - DNA, 12 bp, Homo sapiens
catgaatcatag

SEQ ID NO: 2174643 - DNA, 16 bp, Homo sapiens
catgacatttctcaaa

SEQ ID NO: 2174644 - DNA, 22 bp, Homo sapiens
catgacatttctcaaagttttt

SEQ ID NO: 2174645 - DNA, 19 bp, Homo sapiens
catgacatttgtcctgcag

SEQ ID NO: 2174646 - DNA, 15 bp, Homo sapiens
catgattttggccac

SEQ ID NO: 2174647 - DNA, 13 bp, Homo sapiens
catgcagcagctt

SEQ ID NO: 2174648 - DNA, 14 bp, Homo sapiens
catgcagcagcttg

SEQ ID NO: 2174649 - DNA, 18 bp, Homo sapiens
catgcagttattagaact

SEQ ID NO: 2174650 - DNA, 18 bp, Homo sapiens
ctccatggtgcctctgga

SEQ ID NO: 2174651 - DNA, 19 bp, Homo sapiens
ctccatgtagaagagggag

SEQ ID NO: 2174652 - DNA, 21 bp, Homo sapiens
ctcccaaagagctgcctaaga

SEQ ID NO: 2174653 - DNA, 23 bp, Homo sapiens
ctcccaaagtgctgagattacag

SEQ ID NO: 2174654 - DNA, 14 bp, Homo sapiens
ctcccactttgggg

SEQ ID NO: 2174655 - DNA, 15 bp, Homo sapiens
ctcccagaggctcct

SEQ ID NO: 2174656 - DNA, 16 bp, Homo sapiens
ctcccagaggctcctg

SEQ ID NO: 2174657 - DNA, 17 bp, Homo sapiens
ctcccagaggctcctgg

SEQ ID NO: 2174658 - DNA, 20 bp, Homo sapiens
ctcccagttctctagggaag

SEQ ID NO: 2174659 - DNA, 22 bp, Homo sapiens
ctccccaactccttcctctttg

SEQ ID NO: 2174660 - DNA, 13 bp, Homo sapiens
ctcccccatttta

SEQ ID NO: 2174661 - DNA, 13 bp, Homo sapiens
ctcccctcagcct

SEQ ID NO: 2174662 - DNA, 13 bp, Homo sapiens
ctcccctccaagt

SEQ ID NO: 2174663 - DNA, 17 bp, Homo sapiens
ctcccctcctctcccct

SEQ ID NO: 2174664 - DNA, 13 bp, Homo sapiens
ctcccctgccctc

SEQ ID NO: 2174665 - DNA, 14 bp, Homo sapiens
ctcccgtcttcctc

SEQ ID NO: 2174666 - DNA, 16 bp, Homo sapiens
ctcccgtcttcctcct

SEQ ID NO: 2174667 - DNA, 16 bp, Homo sapiens
ctccctataatgctgg

SEQ ID NO: 2174668 - DNA, 15 bp, Homo sapiens
ctccctcccctgccc

SEQ ID NO: 2174669 - DNA, 13 bp, Homo sapiens
ctccctccctgca

SEQ ID NO: 2174670 - DNA, 20 bp, Homo sapiens
ctccctcgaacccacactgc

SEQ ID NO: 2174671 - DNA, 21 bp, Homo sapiens
ctccctcgaacccacactgca

SEQ ID NO: 2174672 - DNA, 16 bp, Homo sapiens
ctccctgaccctgcag

SEQ ID NO: 2174673 - DNA, 11 bp, Homo sapiens
ctccctgcagg

SEQ ID NO: 2174674 - DNA, 16 bp, Homo sapiens
ctccctttttccttgt

SEQ ID NO: 2174675 - DNA, 13 bp, Homo sapiens
ctccgctgccttc

SEQ ID NO: 2174676 - DNA, 12 bp, Homo sapiens
ctccgctgtgtg

SEQ ID NO: 2174677 - DNA, 16 bp, Homo sapiens
ctccggggctcagccc

SEQ ID NO: 2174678 - DNA, 18 bp, Homo sapiens
ctccggggctcagccctg

SEQ ID NO: 2174679 - DNA, 20 bp, Homo sapiens
ctcctccagttctgatgagg

SEQ ID NO: 2174680 - DNA, 21 bp, Homo sapiens
ctcctcccctggcaactgctg

SEQ ID NO: 2174681 - DNA, 21 bp, Homo sapiens
ctcctctaacaggggctggtg

SEQ ID NO: 2174682 - DNA, 11 bp, Homo sapiens
ctcctctgtcc

SEQ ID NO: 2174683 - DNA, 16 bp, Homo sapiens
ctcctctttgtgaaat

SEQ ID NO: 2174684 - DNA, 17 bp, Homo sapiens
ctcctgagtagctgaga

SEQ ID NO: 2174685 - DNA, 12 bp, Homo sapiens
ctcctgcatgca

SEQ ID NO: 2174686 - DNA, 12 bp, Homo sapiens
ctcctgctggta

SEQ ID NO: 2174687 - DNA, 14 bp, Homo sapiens
ctcctgctggtacc

SEQ ID NO: 2174688 - DNA, 15 bp, Homo sapiens
ctcctgctggtacct

SEQ ID NO: 2174689 - DNA, 16 bp, Homo sapiens
ctgagccggccccagg

SEQ ID NO: 2174690 - DNA, 20 bp, Homo sapiens
ctgagcggccgcctgtcctt

SEQ ID NO: 2174691 - DNA, 21 bp, Homo sapiens
ctgagcgggtctagtggaaag

SEQ ID NO: 2174692 - DNA, 15 bp, Homo sapiens
ctgagctgccagtgg

SEQ ID NO: 2174693 - DNA, 13 bp, Homo sapiens
ctgagctggcctc

SEQ ID NO: 2174694 - DNA, 21 bp, Homo sapiens
ctgagctggcgtcacctgtgc

SEQ ID NO: 2174695 - DNA, 23 bp, Homo sapiens
ctgagctttggacgcacacagct

SEQ ID NO: 2174696 - DNA, 15 bp, Homo sapiens
ctgaggagcaaagca

SEQ ID NO: 2174697 - DNA, 19 bp, Homo sapiens
ctgaggcccagcagagccg

SEQ ID NO: 2174698 - DNA, 13 bp, Homo sapiens
ctgaggctcagcc

SEQ ID NO: 2174699 - DNA, 16 bp, Homo sapiens
ctgaggctcagccctg

SEQ ID NO: 2174700 - DNA, 21 bp, Homo sapiens
ctgaggctcagccctgagctg

SEQ ID NO: 2174701 - DNA, 14 bp, Homo sapiens
ctgagtgcactggc

SEQ ID NO: 2174702 - DNA, 13 bp, Homo sapiens
ctgagtgggaagc

SEQ ID NO: 2174703 - DNA, 21 bp, Homo sapiens
ctgagtgggaagcccatcctg

SEQ ID NO: 2174704 - DNA, 19 bp, Homo sapiens
ctgagttggcatcacctgc

SEQ ID NO: 2174705 - DNA, 23 bp, Homo sapiens
ctgagttggcgttgtgggcaggc

SEQ ID NO: 2174706 - DNA, 21 bp, Homo sapiens
ctgataaaccaaaattgagca

SEQ ID NO: 2174707 - DNA, 22 bp, Homo sapiens
ctgatatacttgagtgtgcaag

SEQ ID NO: 2174708 - DNA, 19 bp, Homo sapiens
ctgatatctgtttgcttct

SEQ ID NO: 2174709 - DNA, 20 bp, Homo sapiens
ctgatcatttgcagctgctg

SEQ ID NO: 2174710 - DNA, 15 bp, Homo sapiens
ctgatgacactgaga

SEQ ID NO: 2174711 - DNA, 12 bp, Homo sapiens
ctgatgtcatct

SEQ ID NO: 2174712 - DNA, 19 bp, Homo sapiens
ctgatgtcttagtgactta

SEQ ID NO: 2174713 - DNA, 16 bp, Homo sapiens
ctgatgttaggctggg

SEQ ID NO: 2174714 - DNA, 17 bp, Homo sapiens
ctgatgttaggctgggc

SEQ ID NO: 2174715 - DNA, 21 bp, Homo sapiens
ctgatgttaggctgggcccag

SEQ ID NO: 2174716 - DNA, 12 bp, Homo sapiens
ctgattgctctg

SEQ ID NO: 2174717 - DNA, 18 bp, Homo sapiens
ctgatttacaagactaac

SEQ ID NO: 2174718 - DNA, 19 bp, Homo sapiens
ctgatttagaccaaaagat

SEQ ID NO: 2174719 - DNA, 17 bp, Homo sapiens
ctgatttaggcactgct

SEQ ID NO: 2174720 - DNA, 13 bp, Homo sapiens
ctgatttgctgtt

SEQ ID NO: 2174721 - DNA, 21 bp, Homo sapiens
ctgatttggccgttttgtgaa

SEQ ID NO: 2174722 - DNA, 18 bp, Homo sapiens
ctgatttggtcaccttcc

SEQ ID NO: 2174723 - DNA, 22 bp, Homo sapiens
ctgattttttttttaacttgaa

SEQ ID NO: 2174724 - DNA, 15 bp, Homo sapiens
ctgcaaataaagcct

SEQ ID NO: 2174725 - DNA, 20 bp, Homo sapiens
ctgcacaaagatgtcttctg

SEQ ID NO: 2174726 - DNA, 17 bp, Homo sapiens
ctgcacacggcacagag

SEQ ID NO: 2174727 - DNA, 19 bp, Homo sapiens
ctgcacagacaagcagccc

SEQ ID NO: 2174728 - DNA, 21 bp, Homo sapiens
ctgcacagacaagcagccctt

SEQ ID NO: 2174729 - DNA, 17 bp, Homo sapiens
ctgcacagggccctctg

SEQ ID NO: 2174730 - DNA, 18 bp, Homo sapiens
ctgcacagggccctctga

SEQ ID NO: 2174731 - DNA, 22 bp, Homo sapiens
ctgcaccctgtatggagctaga

SEQ ID NO: 2174732 - DNA, 13 bp, Homo sapiens
ctgcacctgaggc

SEQ ID NO: 2174733 - DNA, 17 bp, Homo sapiens
ctgcacctgaggcccag

SEQ ID NO: 2174734 - DNA, 18 bp, Homo sapiens
ctgcacctgaggcccagc

SEQ ID NO: 2174735 - DNA, 17 bp, Homo sapiens
ctgcactatagccattt

SEQ ID NO: 2174736 - DNA, 21 bp, Homo sapiens
ctgcagagctggggggaaggc

SEQ ID NO: 2174737 - DNA, 21 bp, Homo sapiens
ctgcagcctcgaactcctggg

SEQ ID NO: 2174738 - DNA, 23 bp, Homo sapiens
ctgcagcctcgaactcctgggct

SEQ ID NO: 2174739 - DNA, 15 bp, Homo sapiens
ctgcagggcagcctg

SEQ ID NO: 2174740 - DNA, 22 bp, Homo sapiens
ctgcagggcagcctgtgggaga

SEQ ID NO: 2174741 - DNA, 16 bp, Homo sapiens
ctgcagggtagggggc

SEQ ID NO: 2174742 - DNA, 13 bp, Homo sapiens
ctgcaggtgccca

SEQ ID NO: 2174743 - DNA, 14 bp, Homo sapiens
ctgcaggtgcccat

SEQ ID NO: 2174744 - DNA, 17 bp, Homo sapiens
ctgcagtcacccctgtc

SEQ ID NO: 2174745 - DNA, 16 bp, Homo sapiens
ctgcattcgcagcagc

SEQ ID NO: 2174746 - DNA, 17 bp, Homo sapiens
ctgcattcgcagcagct

SEQ ID NO: 2174747 - DNA, 21 bp, Homo sapiens
ctgcattttctgggttctggg

SEQ ID NO: 2174748 - DNA, 13 bp, Homo sapiens
ctgccaagccaga

SEQ ID NO: 2174749 - DNA, 18 bp, Homo sapiens
ctgccaccgtgcccggct

SEQ ID NO: 2174750 - DNA, 16 bp, Homo sapiens
ctgccactaggctggg

SEQ ID NO: 2174751 - DNA, 19 bp, Homo sapiens
ctgccactaggctgggtgc

SEQ ID NO: 2174752 - DNA, 23 bp, Homo sapiens
ctgccactaggctgggtgcccac

SEQ ID NO: 2174753 - DNA, 16 bp, Homo sapiens
ctgccagaagtgtgtt

SEQ ID NO: 2174754 - DNA, 23 bp, Homo sapiens
ctgccagtggggtcgtgaggcaa

SEQ ID NO: 2174755 - DNA, 19 bp, Homo sapiens
ctgccataaaatctcacgc

SEQ ID NO: 2174756 - DNA, 21 bp, Homo sapiens
ctgccatgattttggccactt

SEQ ID NO: 2174757 - DNA, 15 bp, Homo sapiens
ctgccatttccctga

SEQ ID NO: 2174758 - DNA, 22 bp, Homo sapiens
ctgcccacctcagcctcccaaa

SEQ ID NO: 2174759 - DNA, 21 bp, Homo sapiens
ctgtgtgctgtggttcctggg

SEQ ID NO: 2174760 - DNA, 13 bp, Homo sapiens
ctgtgttactgat

SEQ ID NO: 2174761 - DNA, 23 bp, Homo sapiens
ctgttaataaagaaatccagatc

SEQ ID NO: 2174762 - DNA, 17 bp, Homo sapiens
ctgttcaaaatgttaat

SEQ ID NO: 2174763 - DNA, 16 bp, Homo sapiens
ctgttgtcctatggga

SEQ ID NO: 2174764 - DNA, 15 bp, Homo sapiens
ctgttgttcagaagt

SEQ ID NO: 2174765 - DNA, 13 bp, Homo sapiens
ctgtttccctgct

SEQ ID NO: 2174766 - DNA, 16 bp, Homo sapiens
ctgtttccctgctgaa

SEQ ID NO: 2174767 - DNA, 17 bp, Homo sapiens
ctgtttccctgctgaat

SEQ ID NO: 2174768 - DNA, 17 bp, Homo sapiens
ctgttttagtgccaggc

SEQ ID NO: 2174769 - DNA, 20 bp, Homo sapiens
cttaaaaatacttaataaat

SEQ ID NO: 2174770 - DNA, 15 bp, Homo sapiens
cttaaaaattagaac

SEQ ID NO: 2174771 - DNA, 14 bp, Homo sapiens
cttaaacaaaactg

SEQ ID NO: 2174772 - DNA, 16 bp, Homo sapiens
cttaacagttgtattt

SEQ ID NO: 2174773 - DNA, 15 bp, Homo sapiens
cttaagacaaatggg

SEQ ID NO: 2174774 - DNA, 19 bp, Homo sapiens
cttaagacaaatgggactg

SEQ ID NO: 2174775 - DNA, 20 bp, Homo sapiens
cttaagacaaatgggactga

SEQ ID NO: 2174776 - DNA, 21 bp, Homo sapiens
cttaagacaaatgggactgat

SEQ ID NO: 2174777 - DNA, 15 bp, Homo sapiens
cttaagtataaacct

SEQ ID NO: 2174778 - DNA, 20 bp, Homo sapiens
cttaagtttagaaattacaa

SEQ ID NO: 2174779 - DNA, 19 bp, Homo sapiens
cttaatttcaaatctgtaa

SEQ ID NO: 2174780 - DNA, 16 bp, Homo sapiens
cttacaaggcaggcct

SEQ ID NO: 2174781 - DNA, 18 bp, Homo sapiens
cttacaaggcaggccttt

SEQ ID NO: 2174782 - DNA, 14 bp, Homo sapiens
cttaccataccact

SEQ ID NO: 2174783 - DNA, 12 bp, Homo sapiens
cttaccctactg

SEQ ID NO: 2174784 - DNA, 17 bp, Homo sapiens
cttaccctactggctgt

SEQ ID NO: 2174785 - DNA, 17 bp, Homo sapiens
cttacccttctgtgccc

SEQ ID NO: 2174786 - DNA, 20 bp, Homo sapiens
cttacccttctgtgcccagc

SEQ ID NO: 2174787 - DNA, 18 bp, Homo sapiens
cttagaacagatggctgt

SEQ ID NO: 2174788 - DNA, 12 bp, Homo sapiens
cttagcaacagc

SEQ ID NO: 2174789 - DNA, 15 bp, Homo sapiens
cttagtgacttagtt

SEQ ID NO: 2174790 - DNA, 16 bp, Homo sapiens
cttatatctggcctct

SEQ ID NO: 2174791 - DNA, 18 bp, Homo sapiens
cttatattggtttttcca

SEQ ID NO: 2174792 - DNA, 16 bp, Homo sapiens
cttatgcaaaactttt

SEQ ID NO: 2174793 - DNA, 13 bp, Homo sapiens
cttatttctaaat

SEQ ID NO: 2174794 - DNA, 22 bp, Homo sapiens
cttcaaggatatactgcagctt

SEQ ID NO: 2174795 - DNA, 16 bp, Homo sapiens
cttcaagtctgtgcct

SEQ ID NO: 2174796 - DNA, 18 bp, Homo sapiens
cttcaagtctgtgcctgg

SEQ ID NO: 2174797 - DNA, 23 bp, Homo sapiens
cttcaagtctgtgcctggagctc

SEQ ID NO: 2174798 - DNA, 18 bp, Homo sapiens
cttcaatcctgtcaatgt

SEQ ID NO: 2174799 - DNA, 17 bp, Homo sapiens
cttcaatctctgttctg

SEQ ID NO: 2174800 - DNA, 16 bp, Homo sapiens
cttcagatattttgca

SEQ ID NO: 2174801 - DNA, 17 bp, Homo sapiens
cttcagatcctgctgcc

SEQ ID NO: 2174802 - DNA, 19 bp, Homo sapiens
cttcagtgactcctgctgg

SEQ ID NO: 2174803 - DNA, 20 bp, Homo sapiens
cttcagtgactcctgctggt

SEQ ID NO: 2174804 - DNA, 21 bp, Homo sapiens
cttcagtgactcctgctggta

SEQ ID NO: 2174805 - DNA, 19 bp, Homo sapiens
cttcatccttagcaacagc

SEQ ID NO: 2174806 - DNA, 18 bp, Homo sapiens
cttcatcgcagtggactg

SEQ ID NO: 2174807 - DNA, 19 bp, Homo sapiens
cttcatcgcagtggactgt

SEQ ID NO: 2174808 - DNA, 18 bp, Homo sapiens
cttcattctaaaccaaaa

SEQ ID NO: 2174809 - DNA, 15 bp, Homo sapiens
cttccaactgctgcc

SEQ ID NO: 2174810 - DNA, 18 bp, Homo sapiens
cttccaactgctgcccca

SEQ ID NO: 2174811 - DNA, 19 bp, Homo sapiens
cttccaactgctgccccaa

SEQ ID NO: 2174812 - DNA, 13 bp, Homo sapiens
cttccaagacctg

SEQ ID NO: 2174813 - DNA, 20 bp, Homo sapiens
cttccacaaacaccatcttc

SEQ ID NO: 2174814 - DNA, 14 bp, Homo sapiens
cttccaggccatca

SEQ ID NO: 2174815 - DNA, 22 bp, Homo sapiens
cttccaggcccagtccactggg

SEQ ID NO: 2174816 - DNA, 18 bp, Homo sapiens
cttccatcagcagtgatt

SEQ ID NO: 2174817 - DNA, 20 bp, Homo sapiens
cttccatcagcagtgattga

SEQ ID NO: 2174818 - DNA, 23 bp, Homo sapiens
cttcccaaatacattaacaagct

SEQ ID NO: 2174819 - DNA, 17 bp, Homo sapiens
cttcccacggccactgc

SEQ ID NO: 2174820 - DNA, 18 bp, Homo sapiens
cttcccacggccactgca

SEQ ID NO: 2174821 - DNA, 20 bp, Homo sapiens
cttcccacggccactgcagt

SEQ ID NO: 2174822 - DNA, 16 bp, Homo sapiens
cttccctacccacagg

SEQ ID NO: 2174823 - DNA, 18 bp, Homo sapiens
cttccctctgctccacag

SEQ ID NO: 2174824 - DNA, 20 bp, Homo sapiens
cttccctggtccagattgta

SEQ ID NO: 2174825 - DNA, 20 bp, Homo sapiens
cttccgctttgaaagaagca

SEQ ID NO: 2174826 - DNA, 17 bp, Homo sapiens
cttcctccctccctgca

SEQ ID NO: 2174827 - DNA, 18 bp, Homo sapiens
cttcctccctccctgcag

SEQ ID NO: 2174828 - DNA, 15 bp, Homo sapiens
cttggaggagagaga

SEQ ID NO: 2174829 - DNA, 16 bp, Homo sapiens
cttggaggagagagac

SEQ ID NO: 2174830 - DNA, 18 bp, Homo sapiens
cttggatgattgcagtta

SEQ ID NO: 2174831 - DNA, 21 bp, Homo sapiens
cttggcctcccaaagtgctgg

SEQ ID NO: 2174832 - DNA, 18 bp, Homo sapiens
cttgggaaaatatcactt

SEQ ID NO: 2174833 - DNA, 19 bp, Homo sapiens
cttgggaaaatatcacttt

SEQ ID NO: 2174834 - DNA, 16 bp, Homo sapiens
cttgggacttgggaga

SEQ ID NO: 2174835 - DNA, 16 bp, Homo sapiens
cttgggccatagctcc

SEQ ID NO: 2174836 - DNA, 17 bp, Homo sapiens
cttgggcctcaggctct

SEQ ID NO: 2174837 - DNA, 18 bp, Homo sapiens
cttggtagttcataaagg

SEQ ID NO: 2174838 - DNA, 13 bp, Homo sapiens
cttggttcccaga

SEQ ID NO: 2174839 - DNA, 15 bp, Homo sapiens
cttggttctgaagcc

SEQ ID NO: 2174840 - DNA, 15 bp, Homo sapiens
cttgtaaacttgaaa

SEQ ID NO: 2174841 - DNA, 20 bp, Homo sapiens
cttgtacagttgactggctt

SEQ ID NO: 2174842 - DNA, 12 bp, Homo sapiens
cttgtccccaca

SEQ ID NO: 2174843 - DNA, 20 bp, Homo sapiens
cttgtccccacactcctaca

SEQ ID NO: 2174844 - DNA, 12 bp, Homo sapiens
cttgtctctcat

SEQ ID NO: 2174845 - DNA, 16 bp, Homo sapiens
cttgtgagtgtgtgca

SEQ ID NO: 2174846 - DNA, 16 bp, Homo sapiens
cttgtgcctcttggga

SEQ ID NO: 2174847 - DNA, 14 bp, Homo sapiens
cttgttcttttctg

SEQ ID NO: 2174848 - DNA, 19 bp, Homo sapiens
cttgttcttttctggtagg

SEQ ID NO: 2174849 - DNA, 15 bp, Homo sapiens
ctttaatacaaaaag

SEQ ID NO: 2174850 - DNA, 19 bp, Homo sapiens
ctttactacacagtttggt

SEQ ID NO: 2174851 - DNA, 16 bp, Homo sapiens
ctttagaatattaaaa

SEQ ID NO: 2174852 - DNA, 16 bp, Homo sapiens
ctttcaaatcctccct

SEQ ID NO: 2174853 - DNA, 13 bp, Homo sapiens
ctttcactgaagt

SEQ ID NO: 2174854 - DNA, 16 bp, Homo sapiens
ctttcactgaagtgaa

SEQ ID NO: 2174855 - DNA, 12 bp, Homo sapiens
ctttccatgcag

SEQ ID NO: 2174856 - DNA, 22 bp, Homo sapiens
ctttcccaacacttcagactgc

SEQ ID NO: 2174857 - DNA, 21 bp, Homo sapiens
ctttcctggagagtctcactc

SEQ ID NO: 2174858 - DNA, 12 bp, Homo sapiens
ctttccttgtct

SEQ ID NO: 2174859 - DNA, 14 bp, Homo sapiens
ctttccttgtctct

SEQ ID NO: 2174860 - DNA, 16 bp, Homo sapiens
ctttccttgtctctca

SEQ ID NO: 2174861 - DNA, 14 bp, Homo sapiens
ctttcggagctcct

SEQ ID NO: 2174862 - DNA, 15 bp, Homo sapiens
ctttcggagctcctg

SEQ ID NO: 2174863 - DNA, 14 bp, Homo sapiens
ctttctcctgtgcc

SEQ ID NO: 2174864 - DNA, 12 bp, Homo sapiens
ctttctctgctt

SEQ ID NO: 2174865 - DNA, 16 bp, Homo sapiens
ctttctctgcttcagc

SEQ ID NO: 2174866 - DNA, 19 bp, Homo sapiens
ctttctgacaataaataat

SEQ ID NO: 2174867 - DNA, 15 bp, Homo sapiens
ctttcttcaatacaa

SEQ ID NO: 2174868 - DNA, 15 bp, Homo sapiens
ctttgaaagaagcaa

SEQ ID NO: 2174869 - DNA, 15 bp, Homo sapiens
ctttgattccatctc

SEQ ID NO: 2174870 - DNA, 15 bp, Homo sapiens
ctttgcaacagcact

SEQ ID NO: 2174871 - DNA, 22 bp, Homo sapiens
ctttgcacacacactagccttc

SEQ ID NO: 2174872 - DNA, 18 bp, Homo sapiens
ctttgcccaacctcagca

SEQ ID NO: 2174873 - DNA, 20 bp, Homo sapiens
ctttgcccagggtcctgtgc

SEQ ID NO: 2174874 - DNA, 21 bp, Homo sapiens
ctttgcccagggtcctgtgcc

SEQ ID NO: 2174875 - DNA, 14 bp, Homo sapiens
ctttgctcccagtt

SEQ ID NO: 2174876 - DNA, 13 bp, Homo sapiens
ctttgctttgtag

SEQ ID NO: 2174877 - DNA, 14 bp, Homo sapiens
ctttgctttgtagg

SEQ ID NO: 2174878 - DNA, 17 bp, Homo sapiens
ctttgctttgtagtttg

SEQ ID NO: 2174879 - DNA, 19 bp, Homo sapiens
ctttgctttgtagtttgct

SEQ ID NO: 2174880 - DNA, 22 bp, Homo sapiens
ctttggaaatttggaagatggt

SEQ ID NO: 2174881 - DNA, 19 bp, Homo sapiens
ctttggacacacacagctt

SEQ ID NO: 2174882 - DNA, 19 bp, Homo sapiens
ctttggacgcacacagctt

SEQ ID NO: 2174883 - DNA, 23 bp, Homo sapiens
ctttggcaattcttcttctcaag

SEQ ID NO: 2174884 - DNA, 23 bp, Homo sapiens
ctttggtcctaagtccctgcccc

SEQ ID NO: 2174885 - DNA, 15 bp, Homo sapiens
ctttgtagtttgctt

SEQ ID NO: 2174886 - DNA, 22 bp, Homo sapiens
ctttgtattctctgtccagggc

SEQ ID NO: 2174887 - DNA, 13 bp, Homo sapiens
ctttgtgtgctgt

SEQ ID NO: 2174888 - DNA, 15 bp, Homo sapiens
ctttgtgtgctgtgg

SEQ ID NO: 2174889 - DNA, 15 bp, Homo sapiens
ctttgttcactgtga

SEQ ID NO: 2174890 - DNA, 22 bp, Homo sapiens
cttttaaaatttgtagaattga

SEQ ID NO: 2174891 - DNA, 16 bp, Homo sapiens
cttttaatgatactgt

SEQ ID NO: 2174892 - DNA, 14 bp, Homo sapiens
cttttacagctttt

SEQ ID NO: 2174893 - DNA, 16 bp, Homo sapiens
cttttacagcttttct

SEQ ID NO: 2174894 - DNA, 19 bp, Homo sapiens
cttttagatcaacaataaa

SEQ ID NO: 2174895 - DNA, 18 bp, Homo sapiens
cttttagtacccacctga

SEQ ID NO: 2174896 - DNA, 22 bp, Homo sapiens
cttttattaacatatattgtta

SEQ ID NO: 2174897 - DNA, 20 bp, Homo sapiens
cttttatttataacaatgtt

SEQ ID NO: 2174898 - DNA, 13 bp, Homo sapiens
cttttccttacca

SEQ ID NO: 2174899 - DNA, 23 bp, Homo sapiens
cttttgaactcacgagccttgcg

SEQ ID NO: 2174900 - DNA, 22 bp, Homo sapiens
cttttgaccccttcctgtctgg

SEQ ID NO: 2174901 - DNA, 18 bp, Homo sapiens
cttttgcaaaagaagttg

SEQ ID NO: 2174902 - DNA, 12 bp, Homo sapiens
cttttgcagctt

SEQ ID NO: 2174903 - DNA, 21 bp, Homo sapiens
cttttgcagcttccttccaag

SEQ ID NO: 2174904 - DNA, 13 bp, Homo sapiens
cttttgccactcc

SEQ ID NO: 2174905 - DNA, 16 bp, Homo sapiens
cttttgtacttttcat

SEQ ID NO: 2174906 - DNA, 17 bp, Homo sapiens
gaaagaggcaccaggaa

SEQ ID NO: 2174907 - DNA, 19 bp, Homo sapiens
gaaagcacaaacttctgta

SEQ ID NO: 2174908 - DNA, 18 bp, Homo sapiens
gaaagcagaggctggcct

SEQ ID NO: 2174909 - DNA, 15 bp, Homo sapiens
gaaagctgcttctgg

SEQ ID NO: 2174910 - DNA, 17 bp, Homo sapiens
gaaagggagcagagaag

SEQ ID NO: 2174911 - DNA, 20 bp, Homo sapiens
gaaaggggcaggagctcaga

SEQ ID NO: 2174912 - DNA, 20 bp, Homo sapiens
gaaagtgcaaagtgccctca

SEQ ID NO: 2174913 - DNA, 17 bp, Homo sapiens
gaaatactcgtttttat

SEQ ID NO: 2174914 - DNA, 14 bp, Homo sapiens
gaaatcccagttca

SEQ ID NO: 2174915 - DNA, 17 bp, Homo sapiens
gaaatcccagttcatgt

SEQ ID NO: 2174916 - DNA, 22 bp, Homo sapiens
gaaatcctttcataaagcacca

SEQ ID NO: 2174917 - DNA, 20 bp, Homo sapiens
gaaatgccaaaaatgtgcct

SEQ ID NO: 2174918 - DNA, 20 bp, Homo sapiens
gaaattaataaaacttatct

SEQ ID NO: 2174919 - DNA, 13 bp, Homo sapiens
gaaattacaagtt

SEQ ID NO: 2174920 - DNA, 23 bp, Homo sapiens
gaaattacaagtttcagtaatag

SEQ ID NO: 2174921 - DNA, 23 bp, Homo sapiens
gaaattccctggaccagatgctg

SEQ ID NO: 2174922 - DNA, 17 bp, Homo sapiens
gaaatttgggtttttaa

SEQ ID NO: 2174923 - DNA, 22 bp, Homo sapiens
gaacaaaacctcttctgtattt

SEQ ID NO: 2174924 - DNA, 21 bp, Homo sapiens
gaacaaagaccaatgtgaaga

SEQ ID NO: 2174925 - DNA, 13 bp, Homo sapiens
gaacaactcgaat

SEQ ID NO: 2174926 - DNA, 18 bp, Homo sapiens
gaacagatctccaaagct

SEQ ID NO: 2174927 - DNA, 19 bp, Homo sapiens
gaacagatctccaaagctt

SEQ ID NO: 2174928 - DNA, 15 bp, Homo sapiens
gaacagatggctgtg

SEQ ID NO: 2174929 - DNA, 17 bp, Homo sapiens
gaacagatggctgtgaa

SEQ ID NO: 2174930 - DNA, 18 bp, Homo sapiens
gaacagatggctgtgaaa

SEQ ID NO: 2174931 - DNA, 21 bp, Homo sapiens
gaacagatggctgtgaaaatt

SEQ ID NO: 2174932 - DNA, 15 bp, Homo sapiens
gaacagcaggcccac

SEQ ID NO: 2174933 - DNA, 20 bp, Homo sapiens
gaacagtggttgcctggggg

SEQ ID NO: 2174934 - DNA, 21 bp, Homo sapiens
gaacatccgttgaatgagtgt

SEQ ID NO: 2174935 - DNA, 18 bp, Homo sapiens
gaacatctgccttgctgc

SEQ ID NO: 2174936 - DNA, 21 bp, Homo sapiens
gaacatgttacgtgtgcaaca

SEQ ID NO: 2174937 - DNA, 16 bp, Homo sapiens
gaacattcagctctgg

SEQ ID NO: 2174938 - DNA, 21 bp, Homo sapiens
gaacccatttgccatgctgct

SEQ ID NO: 2174939 - DNA, 23 bp, Homo sapiens
gaaccctggtgaggaagctccag

SEQ ID NO: 2174940 - DNA, 12 bp, Homo sapiens
gaacctggacca

SEQ ID NO: 2174941 - DNA, 16 bp, Homo sapiens
gaacctggaccaaagc

SEQ ID NO: 2174942 - DNA, 22 bp, Homo sapiens
gaacctggctgcgaactgtgca

SEQ ID NO: 2174943 - DNA, 16 bp, Homo sapiens
gaacctggtggctgga

SEQ ID NO: 2174944 - DNA, 14 bp, Homo sapiens
gaactatatttaat

SEQ ID NO: 2174945 - DNA, 20 bp, Homo sapiens
gaactctctagttccctcag

SEQ ID NO: 2174946 - DNA, 21 bp, Homo sapiens
gaactctctagttccctcagt

SEQ ID NO: 2174947 - DNA, 23 bp, Homo sapiens
gaactgtgcatcaaccaggaaga

SEQ ID NO: 2174948 - DNA, 23 bp, Homo sapiens
gaacttgaatactttgagtaaac

SEQ ID NO: 2174949 - DNA, 12 bp, Homo sapiens
gaagagagcctg

SEQ ID NO: 2174950 - DNA, 14 bp, Homo sapiens
gaagagggagaagg

SEQ ID NO: 2174951 - DNA, 23 bp, Homo sapiens
gaagagtcattttcacttttaaa

SEQ ID NO: 2174952 - DNA, 14 bp, Homo sapiens
gaagagtccaggaa

SEQ ID NO: 2174953 - DNA, 23 bp, Homo sapiens
gaagagttctatccccaagctgg

SEQ ID NO: 2174954 - DNA, 20 bp, Homo sapiens
gaagataagtaatttacctg

SEQ ID NO: 2174955 - DNA, 15 bp, Homo sapiens
gaagcacaagaagtg

SEQ ID NO: 2174956 - DNA, 19 bp, Homo sapiens
gaagcacaagaagtgggag

SEQ ID NO: 2174957 - DNA, 20 bp, Homo sapiens
gaagcacaagaagtgggagt

SEQ ID NO: 2174958 - DNA, 14 bp, Homo sapiens
gaagccagccacag

SEQ ID NO: 2174959 - DNA, 16 bp, Homo sapiens
gaagccagccacagac

SEQ ID NO: 2174960 - DNA, 21 bp, Homo sapiens
gaagccagccacagacccctg

SEQ ID NO: 2174961 - DNA, 17 bp, Homo sapiens
gaagcccatcctgacca

SEQ ID NO: 2174962 - DNA, 21 bp, Homo sapiens
gaagcccatcctgaccagctg

SEQ ID NO: 2174963 - DNA, 20 bp, Homo sapiens
gaagccgcctagtgcagaga

SEQ ID NO: 2174964 - DNA, 23 bp, Homo sapiens
gaagccgcctagtgcagagaggt

SEQ ID NO: 2174965 - DNA, 22 bp, Homo sapiens
gaagccgtcctggcgcctggca

SEQ ID NO: 2174966 - DNA, 12 bp, Homo sapiens
gaagctagctcc

SEQ ID NO: 2174967 - DNA, 14 bp, Homo sapiens
gaagctagctcccc

SEQ ID NO: 2174968 - DNA, 15 bp, Homo sapiens
gaagctagctcccct

SEQ ID NO: 2174969 - DNA, 19 bp, Homo sapiens
gaagctccagtcctgctct

SEQ ID NO: 2174970 - DNA, 13 bp, Homo sapiens
gaagctggggaca

SEQ ID NO: 2174971 - DNA, 14 bp, Homo sapiens
gaagctttcagtat

SEQ ID NO: 2174972 - DNA, 15 bp, Homo sapiens
gaagctttctctgct

SEQ ID NO: 2174973 - DNA, 15 bp, Homo sapiens
gaaggaaaaacatgc

SEQ ID NO: 2174974 - DNA, 21 bp, Homo sapiens
gaaggaaagaagggggccctg

SEQ ID NO: 2174975 - DNA, 19 bp, Homo sapiens
gaaggacaggaccctcagg

SEQ ID NO: 2174976 - DNA, 13 bp, Homo sapiens
gaaggagcctgcg

SEQ ID NO: 2174977 - DNA, 17 bp, Homo sapiens
gaaggcaagctggcagg

SEQ ID NO: 2174978 - DNA, 14 bp, Homo sapiens
gaaggccacctgca

SEQ ID NO: 2174979 - DNA, 16 bp, Homo sapiens
gaaggccacctgcagg

SEQ ID NO: 2174980 - DNA, 22 bp, Homo sapiens
gaaggggcggggagaagcctgg

SEQ ID NO: 2174981 - DNA, 19 bp, Homo sapiens
gaaggggctggactggctg

SEQ ID NO: 2174982 - DNA, 20 bp, Homo sapiens
gaaggggctggactggctgt

SEQ ID NO: 2174983 - DNA, 16 bp, Homo sapiens
gaagggggccctgcta

SEQ ID NO: 2174984 - DNA, 20 bp, Homo sapiens
gaagggggccctgctacctg

SEQ ID NO: 2174985 - DNA, 20 bp, Homo sapiens
gaaggttggaactgctgcca

SEQ ID NO: 2174986 - DNA, 18 bp, Homo sapiens
gaagtcttccatcagcag

SEQ ID NO: 2174987 - DNA, 20 bp, Homo sapiens
gaagtcttccatcagcagtg

SEQ ID NO: 2174988 - DNA, 13 bp, Homo sapiens
gaagtgggagtgg

SEQ ID NO: 2174989 - DNA, 21 bp, Homo sapiens
gaagtgggagtgggagaggaa

SEQ ID NO: 2174990 - DNA, 12 bp, Homo sapiens
gaagtgtttctg

SEQ ID NO: 2174991 - DNA, 10 bp, Homo sapiens
gagtggaggc

SEQ ID NO: 2174992 - DNA, 13 bp, Homo sapiens
gagtgggaagccc

SEQ ID NO: 2174993 - DNA, 11 bp, Homo sapiens
gagtgggagag

SEQ ID NO: 2174994 - DNA, 20 bp, Homo sapiens
gagtgtggaaaaaaaaagaa

SEQ ID NO: 2174995 - DNA, 21 bp, Homo sapiens
gagttattcactctcccagag

SEQ ID NO: 2174996 - DNA, 20 bp, Homo sapiens
gagttctatccccaagctgg

SEQ ID NO: 2174997 - DNA, 22 bp, Homo sapiens
gagttgaggggcttccctctgc

SEQ ID NO: 2174998 - DNA, 21 bp, Homo sapiens
gataaaaagatgttcagtcat

SEQ ID NO: 2174999 - DNA, 17 bp, Homo sapiens
gataacctgtttaagat

SEQ ID NO: 2175000 - DNA, 15 bp, Homo sapiens
gatacacttgtaaat

SEQ ID NO: 2175001 - DNA, 17 bp, Homo sapiens
gatactgtctaagaata

SEQ ID NO: 2175002 - DNA, 21 bp, Homo sapiens
gatacttcctgccctaactct

SEQ ID NO: 2175003 - DNA, 15 bp, Homo sapiens
gatatactgcagctt

SEQ ID NO: 2175004 - DNA, 12 bp, Homo sapiens
gatatgacaagc

SEQ ID NO: 2175005 - DNA, 20 bp, Homo sapiens
gatattggtgtgaatgctgt

SEQ ID NO: 2175006 - DNA, 14 bp, Homo sapiens
gatatttgtgtaaa

SEQ ID NO: 2175007 - DNA, 17 bp, Homo sapiens
gatcacagctcacggca

SEQ ID NO: 2175008 - DNA, 20 bp, Homo sapiens
gatcactcaaaaaggtgtgt

SEQ ID NO: 2175009 - DNA, 20 bp, Homo sapiens
gatcagaacattcagctctg

SEQ ID NO: 2175010 - DNA, 20 bp, Homo sapiens
gatcattggtatctgatatc

SEQ ID NO: 2175011 - DNA, 18 bp, Homo sapiens
gatcatttgcagctgctg

SEQ ID NO: 2175012 - DNA, 19 bp, Homo sapiens
gatcatttgcagctgctgg

SEQ ID NO: 2175013 - DNA, 21 bp, Homo sapiens
gatcatttgcagctgctggtt

SEQ ID NO: 2175014 - DNA, 21 bp, Homo sapiens
gatcctcctgtcttggcctcc

SEQ ID NO: 2175015 - DNA, 22 bp, Homo sapiens
gatcctcctgtcttggcctccc

SEQ ID NO: 2175016 - DNA, 17 bp, Homo sapiens
gatctaccccttactta

SEQ ID NO: 2175017 - DNA, 18 bp, Homo sapiens
gatctatcacctgtcatc

SEQ ID NO: 2175018 - DNA, 13 bp, Homo sapiens
gatctgcccctcc

SEQ ID NO: 2175019 - DNA, 14 bp, Homo sapiens
gatctgcccctccc

SEQ ID NO: 2175020 - DNA, 20 bp, Homo sapiens
gatctgcccctccctgcttc

SEQ ID NO: 2175021 - DNA, 21 bp, Homo sapiens
gatctgttgcaaactcagcct

SEQ ID NO: 2175022 - DNA, 23 bp, Homo sapiens
gatgaaagtgcaaagtgccctca

SEQ ID NO: 2175023 - DNA, 14 bp, Homo sapiens
gatgactgctgatt

SEQ ID NO: 2175024 - DNA, 22 bp, Homo sapiens
gatgcaatcacttttggacatg

SEQ ID NO: 2175025 - DNA, 21 bp, Homo sapiens
gatgccagtaggctcaactag

SEQ ID NO: 2175026 - DNA, 19 bp, Homo sapiens
gatgcctccctgaccctgc

SEQ ID NO: 2175027 - DNA, 16 bp, Homo sapiens
gatgcggatcctgctg

SEQ ID NO: 2175028 - DNA, 20 bp, Homo sapiens
gatgcggatcctgctggggc

SEQ ID NO: 2175029 - DNA, 14 bp, Homo sapiens
gatgctaattttca

SEQ ID NO: 2175030 - DNA, 16 bp, Homo sapiens
gatgctaattttcagg

SEQ ID NO: 2175031 - DNA, 20 bp, Homo sapiens
gatgcttaggtgaaggcaga

SEQ ID NO: 2175032 - DNA, 13 bp, Homo sapiens
gatggctgtgaaa

SEQ ID NO: 2175033 - DNA, 15 bp, Homo sapiens
gatggggccacagcc

SEQ ID NO: 2175034 - DNA, 11 bp, Homo sapiens
gatgggtgggc

SEQ ID NO: 2175035 - DNA, 15 bp, Homo sapiens
gatgtaaccaagctg

SEQ ID NO: 2175036 - DNA, 14 bp, Homo sapiens
gatgtagccaggga

SEQ ID NO: 2175037 - DNA, 14 bp, Homo sapiens
gatgtcaaccttgt

SEQ ID NO: 2175038 - DNA, 18 bp, Homo sapiens
gatgtcaaccttgtgtga

SEQ ID NO: 2175039 - DNA, 22 bp, Homo sapiens
gatgtcaaccttgtgtgagtgt

SEQ ID NO: 2175040 - DNA, 23 bp, Homo sapiens
gatgtcaaccttgtgtgagtgtg

SEQ ID NO: 2175041 - DNA, 14 bp, Homo sapiens
gatgtcatcttgag

SEQ ID NO: 2175042 - DNA, 12 bp, Homo sapiens
gatgtggagcac

SEQ ID NO: 2175043 - DNA, 24 bp, Homo sapiens
gatgtggagcacaaaagcctctca

SEQ ID NO: 2175044 - DNA, 22 bp, Homo sapiens
gatgtgtttaaactgagtagca

SEQ ID NO: 2175045 - DNA, 18 bp, Homo sapiens
gatgttccttttatttat

SEQ ID NO: 2175046 - DNA, 18 bp, Homo sapiens
gatgttggtcttggtcat

SEQ ID NO: 2175047 - DNA, 17 bp, Homo sapiens
gatgtttcaccaaggaa

SEQ ID NO: 2175048 - DNA, 12 bp, Homo sapiens
gatgtttcttct

SEQ ID NO: 2175049 - DNA, 15 bp, Homo sapiens
gattaacacactgaa

SEQ ID NO: 2175050 - DNA, 20 bp, Homo sapiens
gattccagttgcgtgtctgt

SEQ ID NO: 2175051 - DNA, 18 bp, Homo sapiens
gattgaaaatgtccagga

SEQ ID NO: 2175052 - DNA, 21 bp, Homo sapiens
gattgctctggaagcctgctg

SEQ ID NO: 2175053 - DNA, 17 bp, Homo sapiens
gattggtaactgcctgg

SEQ ID NO: 2175054 - DNA, 21 bp, Homo sapiens
gattgttcatatcaagaaatt

SEQ ID NO: 2175055 - DNA, 19 bp, Homo sapiens
gatttgaaacttggtgtgt

SEQ ID NO: 2175056 - DNA, 12 bp, Homo sapiens
gatttggttttt

SEQ ID NO: 2175057 - DNA, 18 bp, Homo sapiens
gattttcctgtgtccaca

SEQ ID NO: 2175058 - DNA, 13 bp, Homo sapiens
gcaaaagaagttg

SEQ ID NO: 2175059 - DNA, 13 bp, Homo sapiens
gcaaaatgctttt

SEQ ID NO: 2175060 - DNA, 14 bp, Homo sapiens
gcaaaccaggagca

SEQ ID NO: 2175061 - DNA, 14 bp, Homo sapiens
gcaaacctctcctt

SEQ ID NO: 2175062 - DNA, 13 bp, Homo sapiens
gcaaagctgattt

SEQ ID NO: 2175063 - DNA, 12 bp, Homo sapiens
gcaaagggacat

SEQ ID NO: 2175064 - DNA, 11 bp, Homo sapiens
gcaaatgccct

SEQ ID NO: 2175065 - DNA, 14 bp, Homo sapiens
gcaaattccaatac

SEQ ID NO: 2175066 - DNA, 17 bp, Homo sapiens
gcaaattccaatacatt

SEQ ID NO: 2175067 - DNA, 22 bp, Homo sapiens
gcaacaggtaaacagaaatcct

SEQ ID NO: 2175068 - DNA, 19 bp, Homo sapiens
gcaacgcctgccttctggg

SEQ ID NO: 2175069 - DNA, 21 bp, Homo sapiens
gcaacgcctgccttctgggca

SEQ ID NO: 2175070 - DNA, 18 bp, Homo sapiens
gcaagctaggccccagag

SEQ ID NO: 2175071 - DNA, 22 bp, Homo sapiens
gcaagctaggccccagaggccc

SEQ ID NO: 2175072 - DNA, 23 bp, Homo sapiens
gcaagctaggccccagaggccct

SEQ ID NO: 2175073 - DNA, 16 bp, Homo sapiens
gcaaggactttgtaca

SEQ ID NO: 2175074 - DNA, 18 bp, Homo sapiens
gcaaggctgccggctgca

SEQ ID NO: 2175075 - DNA, 16 bp, Homo sapiens
gcaaggggtgcctggg

SEQ ID NO: 2175076 - DNA, 19 bp, Homo sapiens
gcaaggggtgcctgggaac

SEQ ID NO: 2175077 - DNA, 17 bp, Homo sapiens
gcaaggtgagggatgcc

SEQ ID NO: 2175078 - DNA, 21 bp, Homo sapiens
gcaataaatggctcgtgggct

SEQ ID NO: 2175079 - DNA, 17 bp, Homo sapiens
gcaatacggaacactgt

SEQ ID NO: 2175080 - DNA, 23 bp, Homo sapiens
gcaatctattaatagctgcctta

SEQ ID NO: 2175081 - DNA, 20 bp, Homo sapiens
gcaatgagtgtgttggcttg

SEQ ID NO: 2175082 - DNA, 13 bp, Homo sapiens
gcaattattttgg

SEQ ID NO: 2175083 - DNA, 23 bp, Homo sapiens
gcacaagaagtgggagtgggaga

SEQ ID NO: 2175084 - DNA, 17 bp, Homo sapiens
gcacacaacaggctgtg

SEQ ID NO: 2175085 - DNA, 21 bp, Homo sapiens
gcacacagcttttagtaccca

SEQ ID NO: 2175086 - DNA, 19 bp, Homo sapiens
gcacagagcatccgtctcc

SEQ ID NO: 2175087 - DNA, 21 bp, Homo sapiens
gcacagagcatccgtctcccc

SEQ ID NO: 2175088 - DNA, 22 bp, Homo sapiens
gcacagagcatccgtctcccct

SEQ ID NO: 2175089 - DNA, 14 bp, Homo sapiens
gcacagctgtggtg

SEQ ID NO: 2175090 - DNA, 16 bp, Homo sapiens
gcaccaaaaaactaaa

SEQ ID NO: 2175091 - DNA, 23 bp, Homo sapiens
gcaccaaaccctgtcctcccacc

SEQ ID NO: 2175092 - DNA, 23 bp, Homo sapiens
gcaccattcaggaacctggacca

SEQ ID NO: 2175093 - DNA, 19 bp, Homo sapiens
gcacccagcctctagggac

SEQ ID NO: 2175094 - DNA, 21 bp, Homo sapiens
gcacccagcctctagggaccc

SEQ ID NO: 2175095 - DNA, 15 bp, Homo sapiens
gcaccccaagtccag

SEQ ID NO: 2175096 - DNA, 12 bp, Homo sapiens
gcacccccacaa

SEQ ID NO: 2175097 - DNA, 21 bp, Homo sapiens
gcacccccacaagctgtccct

SEQ ID NO: 2175098 - DNA, 22 bp, Homo sapiens
gcacccccacaagctgtccctg

SEQ ID NO: 2175099 - DNA, 21 bp, Homo sapiens
gcaccccctggcttgaacctt

SEQ ID NO: 2175100 - DNA, 13 bp, Homo sapiens
gcacccggctcgt

SEQ ID NO: 2175101 - DNA, 17 bp, Homo sapiens
gcaccctgtatggagct

SEQ ID NO: 2175102 - DNA, 17 bp, Homo sapiens
gcctggctccgctgtgt

SEQ ID NO: 2175103 - DNA, 21 bp, Homo sapiens
gcctgggaaccttcctgtctt

SEQ ID NO: 2175104 - DNA, 14 bp, Homo sapiens
gcctgggccactgg

SEQ ID NO: 2175105 - DNA, 16 bp, Homo sapiens
gcctgggccactggca

SEQ ID NO: 2175106 - DNA, 20 bp, Homo sapiens
gcctggggatgtaaccaagc

SEQ ID NO: 2175107 - DNA, 23 bp, Homo sapiens
gcctggggatgtaaccaagctgt

SEQ ID NO: 2175108 - DNA, 17 bp, Homo sapiens
ggcctgtccctggccat

SEQ ID NO: 2175109 - DNA, 16 bp, Homo sapiens
ggcgaagctgagcggg

SEQ ID NO: 2175110 - DNA, 21 bp, Homo sapiens
ggcgaagctgagcgggtctag

SEQ ID NO: 2175111 - DNA, 15 bp, Homo sapiens
ggcgaggcgaagctg

SEQ ID NO: 2175112 - DNA, 21 bp, Homo sapiens
ggcgcatgtgtgtatcaccct

SEQ ID NO: 2175113 - DNA, 17 bp, Homo sapiens
ggcgctttctcctgtgc

SEQ ID NO: 2175114 - DNA, 16 bp, Homo sapiens
ggcggaggggatccag

SEQ ID NO: 2175115 - DNA, 21 bp, Homo sapiens
ggcggaggggatccagccact

SEQ ID NO: 2175116 - DNA, 23 bp, Homo sapiens
ggcggtcaataattgtggagagg

SEQ ID NO: 2175117 - DNA, 15 bp, Homo sapiens
ggctaaggcaccagc

SEQ ID NO: 2175118 - DNA, 23 bp, Homo sapiens
ggctaaggcctcttgctggtgca

SEQ ID NO: 2175119 - DNA, 20 bp, Homo sapiens
ggctaccccccgtctcctgc

SEQ ID NO: 2175120 - DNA, 19 bp, Homo sapiens
ggctatggatggggcccag

SEQ ID NO: 2175121 - DNA, 14 bp, Homo sapiens
ggctcacagactgg

SEQ ID NO: 2175122 - DNA, 18 bp, Homo sapiens
ggctcactatggtgccaa

SEQ ID NO: 2175123 - DNA, 17 bp, Homo sapiens
ggctcagcatcctccac

SEQ ID NO: 2175124 - DNA, 15 bp, Homo sapiens
ggctcagccctgagc

SEQ ID NO: 2175125 - DNA, 17 bp, Homo sapiens
ggctcagccctgagctg

SEQ ID NO: 2175126 - DNA, 12 bp, Homo sapiens
ggctcctggagc

SEQ ID NO: 2175127 - DNA, 15 bp, Homo sapiens
ggctcctggagccag

SEQ ID NO: 2175128 - DNA, 16 bp, Homo sapiens
ggctcctgtgtggagt

SEQ ID NO: 2175129 - DNA, 19 bp, Homo sapiens
ggctcgtggactgagtggg

SEQ ID NO: 2175130 - DNA, 17 bp, Homo sapiens
ggctcgtgggctctggc

SEQ ID NO: 2175131 - DNA, 23 bp, Homo sapiens
ggctctgaaagctgcttctgggg

SEQ ID NO: 2175132 - DNA, 18 bp, Homo sapiens
ggctctgagaaggggagg

SEQ ID NO: 2175133 - DNA, 20 bp, Homo sapiens
ggctctgcacagacaagcag

SEQ ID NO: 2175134 - DNA, 16 bp, Homo sapiens
ggctgccggctgcacc

SEQ ID NO: 2175135 - DNA, 20 bp, Homo sapiens
ggctgcctcccttgtggcag

SEQ ID NO: 2175136 - DNA, 13 bp, Homo sapiens
ggctgcctggccc

SEQ ID NO: 2175137 - DNA, 21 bp, Homo sapiens
ggctgcctggcccagggagga

SEQ ID NO: 2175138 - DNA, 23 bp, Homo sapiens
ggctgcctggcccagggaggaat

SEQ ID NO: 2175139 - DNA, 18 bp, Homo sapiens
ggctgcgaactgtgcagt

SEQ ID NO: 2175140 - DNA, 13 bp, Homo sapiens
ggctgctggcaca

SEQ ID NO: 2175141 - DNA, 14 bp, Homo sapiens
ggctggactggctg

SEQ ID NO: 2175142 - DNA, 19 bp, Homo sapiens
ggctggagaaagagctgcc

SEQ ID NO: 2175143 - DNA, 15 bp, Homo sapiens
ggctggaggcattcc

SEQ ID NO: 2175144 - DNA, 12 bp, Homo sapiens
ggctgggcagag

SEQ ID NO: 2175145 - DNA, 13 bp, Homo sapiens
ggctgggcagagg

SEQ ID NO: 2175146 - DNA, 18 bp, Homo sapiens
ggctgggcagaggggaga

SEQ ID NO: 2175147 - DNA, 16 bp, Homo sapiens
ggctgggcccagaggc

SEQ ID NO: 2175148 - DNA, 17 bp, Homo sapiens
ggctgggcccagaggca

SEQ ID NO: 2175149 - DNA, 14 bp, Homo sapiens
ggctgggtgcccac

SEQ ID NO: 2175150 - DNA, 15 bp, Homo sapiens
ggctgggtgcccaca

SEQ ID NO: 2175151 - DNA, 17 bp, Homo sapiens
ggctgggtgcccacagc

SEQ ID NO: 2175152 - DNA, 15 bp, Homo sapiens
ggctggtgggaaggc

SEQ ID NO: 2175153 - DNA, 18 bp, Homo sapiens
ggctggtgggaaggccgg

SEQ ID NO: 2175154 - DNA, 19 bp, Homo sapiens
ggctgtcctttccagtggc

SEQ ID NO: 2175155 - DNA, 22 bp, Homo sapiens
ggctgtcctttccagtggcctg

SEQ ID NO: 2175156 - DNA, 18 bp, Homo sapiens
ggcttatatctggcctct

SEQ ID NO: 2175157 - DNA, 20 bp, Homo sapiens
ggcttcaatctacgatgtta

SEQ ID NO: 2175158 - DNA, 17 bp, Homo sapiens
ggcttccctctgctcca

SEQ ID NO: 2175159 - DNA, 17 bp, Homo sapiens
ggcttggccaaaacagg

SEQ ID NO: 2175160 - DNA, 16 bp, Homo sapiens
ggctttaatacaaaaa

SEQ ID NO: 2175161 - DNA, 16 bp, Homo sapiens
ggctttcatgaggagg

SEQ ID NO: 2175162 - DNA, 18 bp, Homo sapiens
ggctttgattccatctcc

SEQ ID NO: 2175163 - DNA, 24 bp, Homo sapiens
ggctttgattccatctccttgtct

SEQ ID NO: 2175164 - DNA, 19 bp, Homo sapiens
ggctttgcccaacctcagc

SEQ ID NO: 2175165 - DNA, 20 bp, Homo sapiens
gggaaaatgtcccccacctc

SEQ ID NO: 2175166 - DNA, 21 bp, Homo sapiens
gggaaaatgtcccccacctct

SEQ ID NO: 2175167 - DNA, 15 bp, Homo sapiens
gggaagagagcctgc

SEQ ID NO: 2175168 - DNA, 19 bp, Homo sapiens
gggaagcccatcctgacca

SEQ ID NO: 2175169 - DNA, 14 bp, Homo sapiens
gggaaggacaggac

SEQ ID NO: 2175170 - DNA, 22 bp, Homo sapiens
gggaaggacaggaccctcagga

SEQ ID NO: 2175171 - DNA, 16 bp, Homo sapiens
gggacagctttcctgg

SEQ ID NO: 2175172 - DNA, 14 bp, Homo sapiens
gggactgtcagata

SEQ ID NO: 2175173 - DNA, 21 bp, Homo sapiens
gggacttcaaaatcagtgatg

SEQ ID NO: 2175174 - DNA, 21 bp, Homo sapiens
gggagacacctcagagccccg

SEQ ID NO: 2175175 - DNA, 22 bp, Homo sapiens
gggagagccaaggcctatgcca

SEQ ID NO: 2175176 - DNA, 18 bp, Homo sapiens
gggagagggagcaagcct

SEQ ID NO: 2175177 - DNA, 20 bp, Homo sapiens
gggagatcggggccagaggc

SEQ ID NO: 2175178 - DNA, 21 bp, Homo sapiens
gggagcaggttccccaagggc

SEQ ID NO: 2175179 - DNA, 15 bp, Homo sapiens
gggaggacctctggg

SEQ ID NO: 2175180 - DNA, 20 bp, Homo sapiens
gggaggccgaggcaggggct

SEQ ID NO: 2175181 - DNA, 15 bp, Homo sapiens
gggatccagccactt

SEQ ID NO: 2175182 - DNA, 23 bp, Homo sapiens
gggatgaggtcaccaggggagga

SEQ ID NO: 2175183 - DNA, 16 bp, Homo sapiens
gggatgcggatcctgc

SEQ ID NO: 2175184 - DNA, 17 bp, Homo sapiens
gggatggggccacagcc

SEQ ID NO: 2175185 - DNA, 18 bp, Homo sapiens
gggatttcaagggactgg

SEQ ID NO: 2175186 - DNA, 13 bp, Homo sapiens
gggcacggaaatg

SEQ ID NO: 2175187 - DNA, 14 bp, Homo sapiens
gggcagaggggaga

SEQ ID NO: 2175188 - DNA, 16 bp, Homo sapiens
gggcagaggggagagg

SEQ ID NO: 2175189 - DNA, 20 bp, Homo sapiens
gggcagaggggagaggaagc

SEQ ID NO: 2175190 - DNA, 18 bp, Homo sapiens
gggcagccattggcctct

SEQ ID NO: 2175191 - DNA, 23 bp, Homo sapiens
gggccactggcatctctggagtg

SEQ ID NO: 2175192 - DNA, 15 bp, Homo sapiens
gggccatagctcctg

SEQ ID NO: 2175193 - DNA, 24 bp, Homo sapiens
gggccatctgactgccaagccaga

SEQ ID NO: 2175194 - DNA, 13 bp, Homo sapiens
gggccctctgagg

SEQ ID NO: 2175195 - DNA, 21 bp, Homo sapiens
gggccctctggggctcagccc

SEQ ID NO: 2175196 - DNA, 19 bp, Homo sapiens
ggttgatatattctttcca

SEQ ID NO: 2175197 - DNA, 21 bp, Homo sapiens
ggttggaagctagctcccctc

SEQ ID NO: 2175198 - DNA, 21 bp, Homo sapiens
ggttggaggcctcaccctgct

SEQ ID NO: 2175199 - DNA, 13 bp, Homo sapiens
ggttgtaaataca

SEQ ID NO: 2175200 - DNA, 15 bp, Homo sapiens
ggttgtgaaaacagc

SEQ ID NO: 2175201 - DNA, 12 bp, Homo sapiens
ggtttctctgtg

SEQ ID NO: 2175202 - DNA, 20 bp, Homo sapiens
ggttttttgtgtactttttg

SEQ ID NO: 2175203 - DNA, 18 bp, Homo sapiens
gtaaaaacacaaatgtgt

SEQ ID NO: 2175204 - DNA, 15 bp, Homo sapiens
gtaaaaagagaaggc

SEQ ID NO: 2175205 - DNA, 13 bp, Homo sapiens
gtaaactgccctg

SEQ ID NO: 2175206 - DNA, 14 bp, Homo sapiens
gtaaactgccctgt

SEQ ID NO: 2175207 - DNA, 12 bp, Homo sapiens
gtaaacttgaaa

SEQ ID NO: 2175208 - DNA, 18 bp, Homo sapiens
gtaaagtacaagctgtaa

SEQ ID NO: 2175209 - DNA, 15 bp, Homo sapiens
gtaaagtatgtatta

SEQ ID NO: 2175210 - DNA, 19 bp, Homo sapiens
gtaacaatgcatgctttgg

SEQ ID NO: 2175211 - DNA, 13 bp, Homo sapiens
gtaacaatgtttg

SEQ ID NO: 2175212 - DNA, 13 bp, Homo sapiens
gtaaccaagctgt

SEQ ID NO: 2175213 - DNA, 15 bp, Homo sapiens
gtaacgtgttactgg

SEQ ID NO: 2175214 - DNA, 22 bp, Homo sapiens
gtaactagaccatttttaaatg

SEQ ID NO: 2175215 - DNA, 13 bp, Homo sapiens
gtaagagggagcc

SEQ ID NO: 2175216 - DNA, 14 bp, Homo sapiens
gtaaggacttgtgc

SEQ ID NO: 2175217 - DNA, 21 bp, Homo sapiens
gtaagtcccatgaatacacaa

SEQ ID NO: 2175218 - DNA, 12 bp, Homo sapiens
gtaatagctgaa

SEQ ID NO: 2175219 - DNA, 18 bp, Homo sapiens
gtaatccctgctttttgt

SEQ ID NO: 2175220 - DNA, 21 bp, Homo sapiens
gtaatttaattccccttccct

SEQ ID NO: 2175221 - DNA, 16 bp, Homo sapiens
gtacaaaagtaccata

SEQ ID NO: 2175222 - DNA, 20 bp, Homo sapiens
gtacaagtgctcagttccaa

SEQ ID NO: 2175223 - DNA, 23 bp, Homo sapiens
gtacaagtgctcagttccaatgt

SEQ ID NO: 2175224 - DNA, 15 bp, Homo sapiens
gtacagacatgtgct

SEQ ID NO: 2175225 - DNA, 14 bp, Homo sapiens
gtaccaaagctgtt

SEQ ID NO: 2175226 - DNA, 12 bp, Homo sapiens
gtaccacaggaa

SEQ ID NO: 2175227 - DNA, 18 bp, Homo sapiens
gtacccaaaagctcagcc

SEQ ID NO: 2175228 - DNA, 16 bp, Homo sapiens
gtacccacctgagctt

SEQ ID NO: 2175229 - DNA, 14 bp, Homo sapiens
gtacctgccctcta

SEQ ID NO: 2175230 - DNA, 19 bp, Homo sapiens
gtactaggattagaaaatt

SEQ ID NO: 2175231 - DNA, 22 bp, Homo sapiens
gtactgtgctgattcaataaaa

SEQ ID NO: 2175232 - DNA, 14 bp, Homo sapiens
gtagaagagggaga

SEQ ID NO: 2175233 - DNA, 21 bp, Homo sapiens
gtagaagagggagaaggagag

SEQ ID NO: 2175234 - DNA, 13 bp, Homo sapiens
gtagactgtgaca

SEQ ID NO: 2175235 - DNA, 12 bp, Homo sapiens
gtagagaatgtg

SEQ ID NO: 2175236 - DNA, 16 bp, Homo sapiens
gtagatacttcctgcc

SEQ ID NO: 2175237 - DNA, 14 bp, Homo sapiens
gtagccatgggacc

SEQ ID NO: 2175238 - DNA, 14 bp, Homo sapiens
gtagctattctttg

SEQ ID NO: 2175239 - DNA, 21 bp, Homo sapiens
gtagctccacaagagagatga

SEQ ID NO: 2175240 - DNA, 20 bp, Homo sapiens
gtagctcttagtcctccctg

SEQ ID NO: 2175241 - DNA, 14 bp, Homo sapiens
gctgggcccagagg

SEQ ID NO: 2175242 - DNA, 19 bp, Homo sapiens
gctgggcccagaggcacag

SEQ ID NO: 2175243 - DNA, 21 bp, Homo sapiens
gctgggcccagaggcacagcc

SEQ ID NO: 2175244 - DNA, 13 bp, Homo sapiens
gctggggacagct

SEQ ID NO: 2175245 - DNA, 20 bp, Homo sapiens
gctggggcccctcggctacc

SEQ ID NO: 2175246 - DNA, 18 bp, Homo sapiens
gctggggccgccacggcc

SEQ ID NO: 2175247 - DNA, 21 bp, Homo sapiens
gctggggccgccacggcctgg

SEQ ID NO: 2175248 - DNA, 13 bp, Homo sapiens
gctgggtccaggg

SEQ ID NO: 2175249 - DNA, 16 bp, Homo sapiens
gctgggtgcccacagc

SEQ ID NO: 2175250 - DNA, 17 bp, Homo sapiens
gctgggtgcccacagcc

SEQ ID NO: 2175251 - DNA, 16 bp, Homo sapiens
gctggtgggaaggccg

SEQ ID NO: 2175252 - DNA, 21 bp, Homo sapiens
gctggtgggaaggccggcagc

SEQ ID NO: 2175253 - DNA, 22 bp, Homo sapiens
gctggtgggaaggccggcagcg

SEQ ID NO: 2175254 - DNA, 17 bp, Homo sapiens
gctggtttttcccacca

SEQ ID NO: 2175255 - DNA, 15 bp, Homo sapiens
gctgtacccttgaga

SEQ ID NO: 2175256 - DNA, 18 bp, Homo sapiens
gctgtatttagtaaaaat

SEQ ID NO: 2175257 - DNA, 20 bp, Homo sapiens
gctgtatttagtaaaaataa

SEQ ID NO: 2175258 - DNA, 19 bp, Homo sapiens
gctgtcagaccttcttcca

SEQ ID NO: 2175259 - DNA, 22 bp, Homo sapiens
gctgtcagaccttcttccacag

SEQ ID NO: 2175260 - DNA, 12 bp, Homo sapiens
gctgtccctgca

SEQ ID NO: 2175261 - DNA, 14 bp, Homo sapiens
gctgtccctgcagg

SEQ ID NO: 2175262 - DNA, 15 bp, Homo sapiens
gctgtccctgcaggg

SEQ ID NO: 2175263 - DNA, 16 bp, Homo sapiens
gctgtccctgcagggc

SEQ ID NO: 2175264 - DNA, 10 bp, Homo sapiens
gctgtgaaat

SEQ ID NO: 2175265 - DNA, 20 bp, Homo sapiens
gctgtgccccatcagcagct

SEQ ID NO: 2175266 - DNA, 19 bp, Homo sapiens
gctgtggcatcaggaaagg

SEQ ID NO: 2175267 - DNA, 18 bp, Homo sapiens
gcttaaacaaaactggaa

SEQ ID NO: 2175268 - DNA, 14 bp, Homo sapiens
gcttacctcccacc

SEQ ID NO: 2175269 - DNA, 14 bp, Homo sapiens
gcttcaaataaagt

SEQ ID NO: 2175270 - DNA, 21 bp, Homo sapiens
gcttcaaggatatactgcagc

SEQ ID NO: 2175271 - DNA, 22 bp, Homo sapiens
gcttcaagtctgtgcctggagc

SEQ ID NO: 2175272 - DNA, 22 bp, Homo sapiens
gcttcaatacccaaatcctctc

SEQ ID NO: 2175273 - DNA, 19 bp, Homo sapiens
gcttcaatctacgatgtta

SEQ ID NO: 2175274 - DNA, 16 bp, Homo sapiens
gcttcagatattttgc

SEQ ID NO: 2175275 - DNA, 19 bp, Homo sapiens
gcttccctacccacagggc

SEQ ID NO: 2175276 - DNA, 20 bp, Homo sapiens
gcttccctacccacagggcc

SEQ ID NO: 2175277 - DNA, 16 bp, Homo sapiens
gcttccctctgctcca

SEQ ID NO: 2175278 - DNA, 17 bp, Homo sapiens
gcttcctgtttctaagt

SEQ ID NO: 2175279 - DNA, 23 bp, Homo sapiens
gcttctccacaacctcctcctcc

SEQ ID NO: 2175280 - DNA, 15 bp, Homo sapiens
gcttgacaggacagc

SEQ ID NO: 2175281 - DNA, 15 bp, Homo sapiens
gcttggggcctggcg

SEQ ID NO: 2175282 - DNA, 18 bp, Homo sapiens
gcttgggttcctttttca

SEQ ID NO: 2175283 - DNA, 12 bp, Homo sapiens
gctttcagtatt

SEQ ID NO: 2175284 - DNA, 23 bp, Homo sapiens
gctttcctggagagtctcactcc

SEQ ID NO: 2175285 - DNA, 17 bp, Homo sapiens
gctttcggagctcctgt

SEQ ID NO: 2175286 - DNA, 16 bp, Homo sapiens
gctttgaaagaagcaa

SEQ ID NO: 2175287 - DNA, 20 bp, Homo sapiens
gctttgaaagaagcaagaca

SEQ ID NO: 2175288 - DNA, 18 bp, Homo sapiens
gctttggaaatttggaag

SEQ ID NO: 2175289 - DNA, 21 bp, Homo sapiens
gctttggctcgggacttcaaa

SEQ ID NO: 2175290 - DNA, 18 bp, Homo sapiens
gctttggtggcccctccc

SEQ ID NO: 2175291 - DNA, 20 bp, Homo sapiens
gctttggtggcccctcccca

SEQ ID NO: 2175292 - DNA, 19 bp, Homo sapiens
gctttgtcccacagcttgg

SEQ ID NO: 2175293 - DNA, 15 bp, Homo sapiens
gcttttaagtttttc

SEQ ID NO: 2175294 - DNA, 19 bp, Homo sapiens
gcttttagtacccacctga

SEQ ID NO: 2175295 - DNA, 17 bp, Homo sapiens
gcttttctcttgctaat

SEQ ID NO: 2175296 - DNA, 18 bp, Homo sapiens
gcttttgccactccttgt

SEQ ID NO: 2175297 - DNA, 17 bp, Homo sapiens
ggaaaaaagatttttaa

SEQ ID NO: 2175298 - DNA, 21 bp, Homo sapiens
ggaaaaaagatttttaaaatg

SEQ ID NO: 2175299 - DNA, 15 bp, Homo sapiens
ggaaagaagggggcc

SEQ ID NO: 2175300 - DNA, 23 bp, Homo sapiens
ggaaagtggccaagaagcagtgg

SEQ ID NO: 2175301 - DNA, 13 bp, Homo sapiens
ggaaatggtgcct

SEQ ID NO: 2175302 - DNA, 12 bp, Homo sapiens
ggaacctccttt

SEQ ID NO: 2175303 - DNA, 13 bp, Homo sapiens
ggaacctggctgc

SEQ ID NO: 2175304 - DNA, 15 bp, Homo sapiens
ggaactcccaagaac

SEQ ID NO: 2175305 - DNA, 22 bp, Homo sapiens
ggaagcacaagaagtgggagtg

SEQ ID NO: 2175306 - DNA, 16 bp, Homo sapiens
ggaagctagctcccct

SEQ ID NO: 2175307 - DNA, 20 bp, Homo sapiens
ggaagctagctcccctcctc

SEQ ID NO: 2175308 - DNA, 22 bp, Homo sapiens
ggaagctagctcccctcctctc

SEQ ID NO: 2175309 - DNA, 20 bp, Homo sapiens
ggaagctccagtcctgctct

SEQ ID NO: 2175310 - DNA, 19 bp, Homo sapiens
ggaaggacaggaccctcag

SEQ ID NO: 2175311 - DNA, 13 bp, Homo sapiens
ggaaggagcctgc

SEQ ID NO: 2175312 - DNA, 20 bp, Homo sapiens
ggaaggggctggactggctg

SEQ ID NO: 2175313 - DNA, 16 bp, Homo sapiens
ggaagtagcaggccca

SEQ ID NO: 2175314 - DNA, 17 bp, Homo sapiens
ggaagttgctgtgcccc

SEQ ID NO: 2175315 - DNA, 12 bp, Homo sapiens
ggaatggggacc

SEQ ID NO: 2175316 - DNA, 14 bp, Homo sapiens
ggaattcagtgcct

SEQ ID NO: 2175317 - DNA, 17 bp, Homo sapiens
ggacagcatggtgcatg

SEQ ID NO: 2175318 - DNA, 18 bp, Homo sapiens
ggacagcggttgtaaata

SEQ ID NO: 2175319 - DNA, 21 bp, Homo sapiens
ggacagcggttgtaaatacaa

SEQ ID NO: 2175320 - DNA, 12 bp, Homo sapiens
ggacaggaagga

SEQ ID NO: 2175321 - DNA, 12 bp, Homo sapiens
ggacaggaccct

SEQ ID NO: 2175322 - DNA, 23 bp, Homo sapiens
ggacctcaaaataagccatgctg

SEQ ID NO: 2175323 - DNA, 19 bp, Homo sapiens
ggacctcagtttctgttgt

SEQ ID NO: 2175324 - DNA, 12 bp, Homo sapiens
ggacctctgggc

SEQ ID NO: 2175325 - DNA, 15 bp, Homo sapiens
ggactaagggaagaa

SEQ ID NO: 2175326 - DNA, 19 bp, Homo sapiens
ggactcaatttctccccag

SEQ ID NO: 2175327 - DNA, 14 bp, Homo sapiens
ggactgacctgccc

SEQ ID NO: 2175328 - DNA, 20 bp, Homo sapiens
ggactgacctgcccctgccg

SEQ ID NO: 2175329 - DNA, 22 bp, Homo sapiens
ggactgacctgcccctgccgcc

SEQ ID NO: 2175330 - DNA, 15 bp, Homo sapiens
ggactgagtgggaag

SEQ ID NO: 2175331 - DNA, 17 bp, Homo sapiens
ggactgagtgggaagcc

SEQ ID NO: 2175332 - DNA, 18 bp, Homo sapiens
ggactgagtgggaagccc

SEQ ID NO: 2175333 - DNA, 14 bp, Homo sapiens
ggactgatgtcatc

SEQ ID NO: 2175334 - DNA, 16 bp, Homo sapiens
ggactgcaccttgtga

SEQ ID NO: 2175335 - DNA, 19 bp, Homo sapiens
ggacttgggagagggagca

SEQ ID NO: 2175336 - DNA, 21 bp, Homo sapiens
ggacttgtgcctcttgggaga

SEQ ID NO: 2175337 - DNA, 12 bp, Homo sapiens
ggagaaagagct

SEQ ID NO: 2175338 - DNA, 16 bp, Homo sapiens
ggagaaagagctgcct

SEQ ID NO: 2175339 - DNA, 15 bp, Homo sapiens
ggagaaggagaggct

SEQ ID NO: 2175340 - DNA, 18 bp, Homo sapiens
ggagaaggagaggctctg

SEQ ID NO: 2175341 - DNA, 14 bp, Homo sapiens
ggagaagggacagc

SEQ ID NO: 2175342 - DNA, 17 bp, Homo sapiens
ggagaagggcttttctt

SEQ ID NO: 2175343 - DNA, 14 bp, Homo sapiens
ggagacacctcaga

SEQ ID NO: 2175344 - DNA, 14 bp, Homo sapiens
gtgactcctgctgg

SEQ ID NO: 2175345 - DNA, 20 bp, Homo sapiens
gtgactcctgctggtacctg

SEQ ID NO: 2175346 - DNA, 15 bp, Homo sapiens
gtgacttttagacag

SEQ ID NO: 2175347 - DNA, 22 bp, Homo sapiens
gtgacttttagacagtggtaaa

SEQ ID NO: 2175348 - DNA, 16 bp, Homo sapiens
gtgagaattaaaataa

SEQ ID NO: 2175349 - DNA, 23 bp, Homo sapiens
gtgagacagccggatcttggaga

SEQ ID NO: 2175350 - DNA, 22 bp, Homo sapiens
gtgagactcctgattgctctgg

SEQ ID NO: 2175351 - DNA, 19 bp, Homo sapiens
gtgagagaaagagagaagc

SEQ ID NO: 2175352 - DNA, 22 bp, Homo sapiens
gtgagagaaagagagaagccag

SEQ ID NO: 2175353 - DNA, 22 bp, Homo sapiens
gtgaggcaagatccccgccacc

SEQ ID NO: 2175354 - DNA, 23 bp, Homo sapiens
gtgagggatgccataccttgaga

SEQ ID NO: 2175355 - DNA, 13 bp, Homo sapiens
gtgagtatgtgtg

SEQ ID NO: 2175356 - DNA, 21 bp, Homo sapiens
gtgagtgtgacgggggttggg

SEQ ID NO: 2175357 - DNA, 16 bp, Homo sapiens
gtgagtgtgtgcacag

SEQ ID NO: 2175358 - DNA, 22 bp, Homo sapiens
gtgatcctcctgtcttggcctc

SEQ ID NO: 2175359 - DNA, 11 bp, Homo sapiens
gtgatgggagt

SEQ ID NO: 2175360 - DNA, 14 bp, Homo sapiens
gtgatgggagtaag

SEQ ID NO: 2175361 - DNA, 21 bp, Homo sapiens
gtgatgtatgttggtttttta

SEQ ID NO: 2175362 - DNA, 14 bp, Homo sapiens
gtgatgtcatctgt

SEQ ID NO: 2175363 - DNA, 13 bp, Homo sapiens
gtgattatcattt

SEQ ID NO: 2175364 - DNA, 22 bp, Homo sapiens
gtgattgccatttcttcccaag

SEQ ID NO: 2175365 - DNA, 17 bp, Homo sapiens
gtgattttcctgtgtcc

SEQ ID NO: 2175366 - DNA, 19 bp, Homo sapiens
gtgcaaaacatgctacctg

SEQ ID NO: 2175367 - DNA, 10 bp, Homo sapiens
gtgcaaagct

SEQ ID NO: 2175368 - DNA, 11 bp, Homo sapiens
gtgcaaagctg

SEQ ID NO: 2175369 - DNA, 16 bp, Homo sapiens
gtgcaaagctgcttga

SEQ ID NO: 2175370 - DNA, 15 bp, Homo sapiens
gtgcaaagtgccctc

SEQ ID NO: 2175371 - DNA, 16 bp, Homo sapiens
gtgcaagcaaagcaga

SEQ ID NO: 2175372 - DNA, 16 bp, Homo sapiens
gtgcaatttcttctgt

SEQ ID NO: 2175373 - DNA, 23 bp, Homo sapiens
gtgcaatttcttctgtagctatt

SEQ ID NO: 2175374 - DNA, 15 bp, Homo sapiens
gtgcagcggtggaag

SEQ ID NO: 2175375 - DNA, 23 bp, Homo sapiens
gtgcagcggtggaaggagcctgc

SEQ ID NO: 2175376 - DNA, 13 bp, Homo sapiens
gtgcagggtcctc

SEQ ID NO: 2175377 - DNA, 21 bp, Homo sapiens
gtgcattgtgtgtcacaaagc

SEQ ID NO: 2175378 - DNA, 22 bp, Homo sapiens
gtgccaaccacctctggccctg

SEQ ID NO: 2175379 - DNA, 22 bp, Homo sapiens
gtgccaatggaacctcctttct

SEQ ID NO: 2175380 - DNA, 21 bp, Homo sapiens
gtgccacagagggctgtgtct

SEQ ID NO: 2175381 - DNA, 16 bp, Homo sapiens
gtgccaccaccctgcc

SEQ ID NO: 2175382 - DNA, 17 bp, Homo sapiens
gtgccaccctctgcagg

SEQ ID NO: 2175383 - DNA, 13 bp, Homo sapiens
gtgccagatcaaa

SEQ ID NO: 2175384 - DNA, 21 bp, Homo sapiens
gtgccatttttttcactcaga

SEQ ID NO: 2175385 - DNA, 19 bp, Homo sapiens
gtgcccacagcccgcatgc

SEQ ID NO: 2175386 - DNA, 21 bp, Homo sapiens
gtgcccagcagtttcccagaa

SEQ ID NO: 2175387 - DNA, 13 bp, Homo sapiens
gtgcccagtgatg

SEQ ID NO: 2175388 - DNA, 13 bp, Homo sapiens
gtgccccacctgc

SEQ ID NO: 2175389 - DNA, 15 bp, Homo sapiens
gtgccccacctgcca

SEQ ID NO: 2175390 - DNA, 17 bp, Homo sapiens
gtgccccatcagcagct

SEQ ID NO: 2175391 - DNA, 20 bp, Homo sapiens
gtgcccttgctgggtccagg

SEQ ID NO: 2175392 - DNA, 15 bp, Homo sapiens
gtgcctcttgggaga

SEQ ID NO: 2175393 - DNA, 21 bp, Homo sapiens
gtgcctcttgggagacgtcca

SEQ ID NO: 2175394 - DNA, 12 bp, Homo sapiens
gtgcctggagct

SEQ ID NO: 2175395 - DNA, 23 bp, Homo sapiens
gtgcctggatgggggtgcaggca

SEQ ID NO: 2175396 - DNA, 23 bp, Homo sapiens
gtgcctgggaaccttcctgtctt

SEQ ID NO: 2175397 - DNA, 17 bp, Homo sapiens
gtgcgaccagaggtggg

SEQ ID NO: 2175398 - DNA, 16 bp, Homo sapiens
gtgctaaccccgtctg

SEQ ID NO: 2175399 - DNA, 20 bp, Homo sapiens
gtgctctgaatgggagccag

SEQ ID NO: 2175400 - DNA, 19 bp, Homo sapiens
gtgctggagccactaacta

SEQ ID NO: 2175401 - DNA, 21 bp, Homo sapiens
gtgctggttgccacatcttag

SEQ ID NO: 2175402 - DNA, 22 bp, Homo sapiens
gtgctgtcttgatgactgctga

SEQ ID NO: 2175403 - DNA, 16 bp, Homo sapiens
gtgcttttgcaaaaga

SEQ ID NO: 2175404 - DNA, 18 bp, Homo sapiens
gtggaaagattgtgtctg

SEQ ID NO: 2175405 - DNA, 16 bp, Homo sapiens
gtggaaggagcctgcg

SEQ ID NO: 2175406 - DNA, 18 bp, Homo sapiens
gtggactgagtgggaagc

SEQ ID NO: 2175407 - DNA, 12 bp, Homo sapiens
gtgtttgtgagt

SEQ ID NO: 2175408 - DNA, 22 bp, Homo sapiens
gtgttttttttccaaaaacaaa

SEQ ID NO: 2175409 - DNA, 20 bp, Homo sapiens
gttaaagtcacacatttcta

SEQ ID NO: 2175410 - DNA, 17 bp, Homo sapiens
gttaaggaaaaaaaacg

SEQ ID NO: 2175411 - DNA, 14 bp, Homo sapiens
gttaataaaggttt

SEQ ID NO: 2175412 - DNA, 21 bp, Homo sapiens
gttaataaaggtttcgttgca

SEQ ID NO: 2175413 - DNA, 17 bp, Homo sapiens
gttaatttaaagctgtt

SEQ ID NO: 2175414 - DNA, 17 bp, Homo sapiens
gttacaatcgttctgtg

SEQ ID NO: 2175415 - DNA, 22 bp, Homo sapiens
gttacagtccagttttgtgtgc

SEQ ID NO: 2175416 - DNA, 16 bp, Homo sapiens
gttactatcctggctt

SEQ ID NO: 2175417 - DNA, 13 bp, Homo sapiens
gttactcatttta

SEQ ID NO: 2175418 - DNA, 18 bp, Homo sapiens
gttactgggtaggttctg

SEQ ID NO: 2175419 - DNA, 14 bp, Homo sapiens
gttactgttcatgg

SEQ ID NO: 2175420 - DNA, 15 bp, Homo sapiens
gttagataaaaataa

SEQ ID NO: 2175421 - DNA, 21 bp, Homo sapiens
gttagattttgtattcagggg

SEQ ID NO: 2175422 - DNA, 21 bp, Homo sapiens
gttagctcagccccagcccag

SEQ ID NO: 2175423 - DNA, 18 bp, Homo sapiens
gttaggctgggcccagag

SEQ ID NO: 2175424 - DNA, 16 bp, Homo sapiens
gttagtgatttgctat

SEQ ID NO: 2175425 - DNA, 21 bp, Homo sapiens
gttagtttgtatatattatta

SEQ ID NO: 2175426 - DNA, 18 bp, Homo sapiens
gttatccctgcacacggc

SEQ ID NO: 2175427 - DNA, 21 bp, Homo sapiens
gttattagaacttagttttgt

SEQ ID NO: 2175428 - DNA, 22 bp, Homo sapiens
gttattcactctcccagaggct

SEQ ID NO: 2175429 - DNA, 15 bp, Homo sapiens
gttcaaaatgttaat

SEQ ID NO: 2175430 - DNA, 18 bp, Homo sapiens
gttcaaaatgttaataaa

SEQ ID NO: 2175431 - DNA, 20 bp, Homo sapiens
gttccaatgtgcccagtcat

SEQ ID NO: 2175432 - DNA, 21 bp, Homo sapiens
gttccctcagtgtgaagcctg

SEQ ID NO: 2175433 - DNA, 17 bp, Homo sapiens
gttccctttgctccacc

SEQ ID NO: 2175434 - DNA, 19 bp, Homo sapiens
gttcgtggagccacaggca

SEQ ID NO: 2175435 - DNA, 21 bp, Homo sapiens
gttcgtggagccacaggcaga

SEQ ID NO: 2175436 - DNA, 22 bp, Homo sapiens
gttcgtggagccacaggcagac

SEQ ID NO: 2175437 - DNA, 15 bp, Homo sapiens
gttctaaaaagatgt

SEQ ID NO: 2175438 - DNA, 21 bp, Homo sapiens
gttctaaaatcaagtgcacct

SEQ ID NO: 2175439 - DNA, 14 bp, Homo sapiens
gttctaatgctgca

SEQ ID NO: 2175440 - DNA, 21 bp, Homo sapiens
gttctatccccaagctggcca

SEQ ID NO: 2175441 - DNA, 19 bp, Homo sapiens
gttctcatgtttgtgcatg

SEQ ID NO: 2175442 - DNA, 20 bp, Homo sapiens
gttctcatgtttgtgcatgt

SEQ ID NO: 2175443 - DNA, 19 bp, Homo sapiens
gttctctccccttgcactg

SEQ ID NO: 2175444 - DNA, 12 bp, Homo sapiens
gttctgaacagc

SEQ ID NO: 2175445 - DNA, 19 bp, Homo sapiens
gttctgcactttgacacaa

SEQ ID NO: 2175446 - DNA, 19 bp, Homo sapiens
gttctggttcctcctggta

SEQ ID NO: 2175447 - DNA, 17 bp, Homo sapiens
gttcttagaagctcacg

SEQ ID NO: 2175448 - DNA, 21 bp, Homo sapiens
gttgaataggaaataaaatta

SEQ ID NO: 2175449 - DNA, 15 bp, Homo sapiens
gttgactttagggac

SEQ ID NO: 2175450 - DNA, 18 bp, Homo sapiens
gttgactttagggactca

SEQ ID NO: 2175451 - DNA, 16 bp, Homo sapiens
gttgagacgctgttgc

SEQ ID NO: 2175452 - DNA, 23 bp, Homo sapiens
gttgagtttcttctaaagaggaa

SEQ ID NO: 2175453 - DNA, 16 bp, Homo sapiens
gttgatatattctttc

SEQ ID NO: 2175454 - DNA, 13 bp, Homo sapiens
gttgcccaggctg

SEQ ID NO: 2175455 - DNA, 18 bp, Homo sapiens
gttggaactgctgccatg

SEQ ID NO: 2175456 - DNA, 22 bp, Homo sapiens
gttggaggcccttttctggctc

SEQ ID NO: 2175457 - DNA, 15 bp, Homo sapiens
gttggaggcctcacc

SEQ ID NO: 2175458 - DNA, 16 bp, Homo sapiens
gttggcatcacctgcg

SEQ ID NO: 2175459 - DNA, 11 bp, Homo sapiens
gttggctgggt

SEQ ID NO: 2175460 - DNA, 12 bp, Homo sapiens
gttggctgggta

SEQ ID NO: 2175461 - DNA, 18 bp, Homo sapiens
gttggtgaccagtttctt

SEQ ID NO: 2175462 - DNA, 15 bp, Homo sapiens
tacagttgactggct

SEQ ID NO: 2175463 - DNA, 21 bp, Homo sapiens
tacataacttcagatacttgt

SEQ ID NO: 2175464 - DNA, 21 bp, Homo sapiens
tacatactatagattctttat

SEQ ID NO: 2175465 - DNA, 18 bp, Homo sapiens
tacatatgatcaaatact

SEQ ID NO: 2175466 - DNA, 19 bp, Homo sapiens
tacatatgatcaaatactc

SEQ ID NO: 2175467 - DNA, 17 bp, Homo sapiens
tacatgaccagaaaaca

SEQ ID NO: 2175468 - DNA, 11 bp, Homo sapiens
tacatttaata

SEQ ID NO: 2175469 - DNA, 19 bp, Homo sapiens
tacatttgggagtttttat

SEQ ID NO: 2175470 - DNA, 12 bp, Homo sapiens
taccaaagctgt

SEQ ID NO: 2175471 - DNA, 14 bp, Homo sapiens
taccacccccacac

SEQ ID NO: 2175472 - DNA, 16 bp, Homo sapiens
taccactggtgtaaaa

SEQ ID NO: 2175473 - DNA, 15 bp, Homo sapiens
taccacttatttcta

SEQ ID NO: 2175474 - DNA, 16 bp, Homo sapiens
taccatacataaactg

SEQ ID NO: 2175475 - DNA, 12 bp, Homo sapiens
taccatagaaca

SEQ ID NO: 2175476 - DNA, 21 bp, Homo sapiens
taccattttgcgatgtgtttt

SEQ ID NO: 2175477 - DNA, 23 bp, Homo sapiens
tacccacagggcctgacttttac

SEQ ID NO: 2175478 - DNA, 14 bp, Homo sapiens
tacccacctgagct

SEQ ID NO: 2175479 - DNA, 18 bp, Homo sapiens
tacccacctgagctttgg

SEQ ID NO: 2175480 - DNA, 17 bp, Homo sapiens
taccccaattccttgta

SEQ ID NO: 2175481 - DNA, 18 bp, Homo sapiens
tacccttctgtgcccagc

SEQ ID NO: 2175482 - DNA, 19 bp, Homo sapiens
tacccttctgtgcccagct

SEQ ID NO: 2175483 - DNA, 14 bp, Homo sapiens
tacctgccctctct

SEQ ID NO: 2175484 - DNA, 18 bp, Homo sapiens
tacctgccctctctcagt

SEQ ID NO: 2175485 - DNA, 16 bp, Homo sapiens
tacgatgttaaaacaa

SEQ ID NO: 2175486 - DNA, 13 bp, Homo sapiens
tacggaacactgt

SEQ ID NO: 2175487 - DNA, 16 bp, Homo sapiens
tacggtgatattgtgc

SEQ ID NO: 2175488 - DNA, 17 bp, Homo sapiens
tactaataaaatacata

SEQ ID NO: 2175489 - DNA, 22 bp, Homo sapiens
tactagaaccttctaatccatg

SEQ ID NO: 2175490 - DNA, 18 bp, Homo sapiens
tactaggcagttagagat

SEQ ID NO: 2175491 - DNA, 19 bp, Homo sapiens
tactatagatataactgta

SEQ ID NO: 2175492 - DNA, 13 bp, Homo sapiens
tactattgcttaa

SEQ ID NO: 2175493 - DNA, 13 bp, Homo sapiens
tactccagcctgg

SEQ ID NO: 2175494 - DNA, 14 bp, Homo sapiens
tactctttgctttg

SEQ ID NO: 2175495 - DNA, 18 bp, Homo sapiens
tactctttgctttgtagt

SEQ ID NO: 2175496 - DNA, 19 bp, Homo sapiens
tactgaatgaccacttgat

SEQ ID NO: 2175497 - DNA, 16 bp, Homo sapiens
tactgaggagcaaagc

SEQ ID NO: 2175498 - DNA, 20 bp, Homo sapiens
tactgataaaaatgatattg

SEQ ID NO: 2175499 - DNA, 22 bp, Homo sapiens
tactgatttggccgttttgtga

SEQ ID NO: 2175500 - DNA, 18 bp, Homo sapiens
tactggaatttattatgt

SEQ ID NO: 2175501 - DNA, 16 bp, Homo sapiens
tactgggtaggttctg

SEQ ID NO: 2175502 - DNA, 12 bp, Homo sapiens
tagtatactttc

SEQ ID NO: 2175503 - DNA, 12 bp, Homo sapiens
tagtcccttcca

SEQ ID NO: 2175504 - DNA, 16 bp, Homo sapiens
tagtcctccctgctca

SEQ ID NO: 2175505 - DNA, 13 bp, Homo sapiens
tagtgcaatttct

SEQ ID NO: 2175506 - DNA, 22 bp, Homo sapiens
tagtgcagtcaccctgtggcaa

SEQ ID NO: 2175507 - DNA, 13 bp, Homo sapiens
tagtggtggctct

SEQ ID NO: 2175508 - DNA, 15 bp, Homo sapiens
tagtgttcaaatact

SEQ ID NO: 2175509 - DNA, 16 bp, Homo sapiens
tagtgttcaaatactt

SEQ ID NO: 2175510 - DNA, 18 bp, Homo sapiens
tagtgttttgtacttgtt

SEQ ID NO: 2175511 - DNA, 21 bp, Homo sapiens
tagttcaggatttggtttttc

SEQ ID NO: 2175512 - DNA, 23 bp, Homo sapiens
tagttcttagaagctcacgcctt

SEQ ID NO: 2175513 - DNA, 19 bp, Homo sapiens
tagttgagacgctgttgca

SEQ ID NO: 2175514 - DNA, 21 bp, Homo sapiens
tagttgtaatgtgtatgtctg

SEQ ID NO: 2175515 - DNA, 21 bp, Homo sapiens
tagttttatgtttcttgggaa

SEQ ID NO: 2175516 - DNA, 14 bp, Homo sapiens
tagttttgctcctt

SEQ ID NO: 2175517 - DNA, 13 bp, Homo sapiens
tataaaaaataaa

SEQ ID NO: 2175518 - DNA, 12 bp, Homo sapiens
tataaagcagta

SEQ ID NO: 2175519 - DNA, 13 bp, Homo sapiens
tataaagttatta

SEQ ID NO: 2175520 - DNA, 21 bp, Homo sapiens
tataaatatgtgattatcatt

SEQ ID NO: 2175521 - DNA, 22 bp, Homo sapiens
tataaatatgtgattatcattt

SEQ ID NO: 2175522 - DNA, 21 bp, Homo sapiens
tataaatggtgagaattaaaa

SEQ ID NO: 2175523 - DNA, 12 bp, Homo sapiens
tataaattactt

SEQ ID NO: 2175524 - DNA, 13 bp, Homo sapiens
tataactttagaa

SEQ ID NO: 2175525 - DNA, 15 bp, Homo sapiens
tataactttagaaat

SEQ ID NO: 2175526 - DNA, 16 bp, Homo sapiens
tataactttagaaata

SEQ ID NO: 2175527 - DNA, 21 bp, Homo sapiens
tataactttagaaataagaag

SEQ ID NO: 2175528 - DNA, 13 bp, Homo sapiens
tataagtttcttt

SEQ ID NO: 2175529 - DNA, 20 bp, Homo sapiens
tataatacttaaaaatatgt

SEQ ID NO: 2175530 - DNA, 19 bp, Homo sapiens
tataatgacttttaaaatt

SEQ ID NO: 2175531 - DNA, 16 bp, Homo sapiens
tataatgggaagtgta

SEQ ID NO: 2175532 - DNA, 21 bp, Homo sapiens
tataattaaagaaaattgcca

SEQ ID NO: 2175533 - DNA, 12 bp, Homo sapiens
tataattgttat

SEQ ID NO: 2175534 - DNA, 20 bp, Homo sapiens
tcaaagcttttgtaaaataa

SEQ ID NO: 2175535 - DNA, 15 bp, Homo sapiens
tcaaaggactgacct

SEQ ID NO: 2175536 - DNA, 22 bp, Homo sapiens
tcaaagtttttacagtgtatct

SEQ ID NO: 2175537 - DNA, 19 bp, Homo sapiens
tcaacaacatcagaaagaa

SEQ ID NO: 2175538 - DNA, 18 bp, Homo sapiens
tcaacataacataagcta

SEQ ID NO: 2175539 - DNA, 16 bp, Homo sapiens
tcaacatggaaaaatc

SEQ ID NO: 2175540 - DNA, 15 bp, Homo sapiens
tcaacccaggagcat

SEQ ID NO: 2175541 - DNA, 23 bp, Homo sapiens
tcaacccaggagcatccacctcc

SEQ ID NO: 2175542 - DNA, 18 bp, Homo sapiens
tcaagatacacttgtaaa

SEQ ID NO: 2175543 - DNA, 21 bp, Homo sapiens
tcaagattcccggctggactt

SEQ ID NO: 2175544 - DNA, 12 bp, Homo sapiens
tcaagcaacaag

SEQ ID NO: 2175545 - DNA, 15 bp, Homo sapiens
tcaaggcctgtccct

SEQ ID NO: 2175546 - DNA, 14 bp, Homo sapiens
tcaagtctgtgaaa

SEQ ID NO: 2175547 - DNA, 17 bp, Homo sapiens
tcaagtctgtgcctgga

SEQ ID NO: 2175548 - DNA, 15 bp, Homo sapiens
tcaagttatgattca

SEQ ID NO: 2175549 - DNA, 17 bp, Homo sapiens
tcaagttatgattcagt

SEQ ID NO: 2175550 - DNA, 14 bp, Homo sapiens
tcaataagccttgt

SEQ ID NO: 2175551 - DNA, 20 bp, Homo sapiens
tcaatatcaagactgactgg

SEQ ID NO: 2175552 - DNA, 20 bp, Homo sapiens
tcaatctctggaaaaataag

SEQ ID NO: 2175553 - DNA, 14 bp, Homo sapiens
tcaatgcattttta

SEQ ID NO: 2175554 - DNA, 13 bp, Homo sapiens
tcaatgtgttctt

SEQ ID NO: 2175555 - DNA, 15 bp, Homo sapiens
tcacaaatgttttaa

SEQ ID NO: 2175556 - DNA, 14 bp, Homo sapiens
tcacaagctgcctc

SEQ ID NO: 2175557 - DNA, 18 bp, Homo sapiens
tcctcaaggggccatcct

SEQ ID NO: 2175558 - DNA, 13 bp, Homo sapiens
tcctcagcttggg

SEQ ID NO: 2175559 - DNA, 22 bp, Homo sapiens
tcctcatttcttgaggcttctg

SEQ ID NO: 2175560 - DNA, 14 bp, Homo sapiens
tcctccacgggctg

SEQ ID NO: 2175561 - DNA, 15 bp, Homo sapiens
tcctcccacccctcc

SEQ ID NO: 2175562 - DNA, 21 bp, Homo sapiens
tcctccctgctcagctggccg

SEQ ID NO: 2175563 - DNA, 19 bp, Homo sapiens
tcctccggggctcagccct

SEQ ID NO: 2175564 - DNA, 22 bp, Homo sapiens
tcctccggggctcagccctgag

SEQ ID NO: 2175565 - DNA, 18 bp, Homo sapiens
tcctcctgtcttggcctc

SEQ ID NO: 2175566 - DNA, 18 bp, Homo sapiens
tcctctcccctaccactg

SEQ ID NO: 2175567 - DNA, 14 bp, Homo sapiens
tcctctctgctggg

SEQ ID NO: 2175568 - DNA, 23 bp, Homo sapiens
tcctcttctgtgagtcagtcagc

SEQ ID NO: 2175569 - DNA, 16 bp, Homo sapiens
tcctgaaacagtgttt

SEQ ID NO: 2175570 - DNA, 17 bp, Homo sapiens
tcctgagggtcctgctg

SEQ ID NO: 2175571 - DNA, 14 bp, Homo sapiens
tcctgattgctctg

SEQ ID NO: 2175572 - DNA, 18 bp, Homo sapiens
tcctgccactgttttgtt

SEQ ID NO: 2175573 - DNA, 23 bp, Homo sapiens
tcctgccctaactctgcccaccc

SEQ ID NO: 2175574 - DNA, 16 bp, Homo sapiens
tcctgcctcagcctcc

SEQ ID NO: 2175575 - DNA, 19 bp, Homo sapiens
tcctgcctcagcctcccga

SEQ ID NO: 2175576 - DNA, 18 bp, Homo sapiens
tcctgcctcagtctgctt

SEQ ID NO: 2175577 - DNA, 20 bp, Homo sapiens
tcctgcctgcgcagctcctt

SEQ ID NO: 2175578 - DNA, 14 bp, Homo sapiens
tcctgctccacagc

SEQ ID NO: 2175579 - DNA, 18 bp, Homo sapiens
tcctgctccacagccatc

SEQ ID NO: 2175580 - DNA, 18 bp, Homo sapiens
tcctgctctctacccagc

SEQ ID NO: 2175581 - DNA, 13 bp, Homo sapiens
tcctgctggggcc

SEQ ID NO: 2175582 - DNA, 13 bp, Homo sapiens
tcctgctggtacc

SEQ ID NO: 2175583 - DNA, 13 bp, Homo sapiens
tcctggagccagc

SEQ ID NO: 2175584 - DNA, 17 bp, Homo sapiens
tcctggggtgccctcca

SEQ ID NO: 2175585 - DNA, 19 bp, Homo sapiens
tcctgggtgagtttttctt

SEQ ID NO: 2175586 - DNA, 22 bp, Homo sapiens
tcctggtatgggtttctcccag

SEQ ID NO: 2175587 - DNA, 17 bp, Homo sapiens
tcctgtacaagtgctca

SEQ ID NO: 2175588 - DNA, 12 bp, Homo sapiens
tcctgtcaatgt

SEQ ID NO: 2175589 - DNA, 19 bp, Homo sapiens
tcctgtcaatgtttgcttt

SEQ ID NO: 2175590 - DNA, 15 bp, Homo sapiens
tcctgtccgccctct

SEQ ID NO: 2175591 - DNA, 16 bp, Homo sapiens
tcctgtcgtcctgcct

SEQ ID NO: 2175592 - DNA, 18 bp, Homo sapiens
tcctgtctcccctctgct

SEQ ID NO: 2175593 - DNA, 12 bp, Homo sapiens
tcctgtctggcc

SEQ ID NO: 2175594 - DNA, 13 bp, Homo sapiens
tcctgtctggccc

SEQ ID NO: 2175595 - DNA, 23 bp, Homo sapiens
tcctgtgtattaaacctttccat

SEQ ID NO: 2175596 - DNA, 13 bp, Homo sapiens
tcctgtttctaag

SEQ ID NO: 2175597 - DNA, 19 bp, Homo sapiens
tccttatttttacttgtat

SEQ ID NO: 2175598 - DNA, 14 bp, Homo sapiens
tccttcccacggcc

SEQ ID NO: 2175599 - DNA, 12 bp, Homo sapiens
tccttccctagg

SEQ ID NO: 2175600 - DNA, 16 bp, Homo sapiens
tccttccctggtccag

SEQ ID NO: 2175601 - DNA, 20 bp, Homo sapiens
tccttccctggtccagattg

SEQ ID NO: 2175602 - DNA, 11 bp, Homo sapiens
tccttcctcat

SEQ ID NO: 2175603 - DNA, 14 bp, Homo sapiens
tccttcgctttcct

SEQ ID NO: 2175604 - DNA, 11 bp, Homo sapiens
tccttctcctc

SEQ ID NO: 2175605 - DNA, 15 bp, Homo sapiens
tccttctctgtctca

SEQ ID NO: 2175606 - DNA, 21 bp, Homo sapiens
tccttggtggccgggggtggg

SEQ ID NO: 2175607 - DNA, 14 bp, Homo sapiens
tccttgtccccaca

SEQ ID NO: 2175608 - DNA, 20 bp, Homo sapiens
tccttgtccccacactccta

SEQ ID NO: 2175609 - DNA, 22 bp, Homo sapiens
tccttgtccccacactcctaca

SEQ ID NO: 2175610 - DNA, 14 bp, Homo sapiens
tccttgtctctcat

SEQ ID NO: 2175611 - DNA, 16 bp, Homo sapiens
tccttgtctctcattc

SEQ ID NO: 2175612 - DNA, 22 bp, Homo sapiens
tcctttccagtggcctggctcc

SEQ ID NO: 2175613 - DNA, 14 bp, Homo sapiens
tccttttccttacc

SEQ ID NO: 2175614 - DNA, 16 bp, Homo sapiens
tcctttttaaatgaga

SEQ ID NO: 2175615 - DNA, 18 bp, Homo sapiens
tcgaagcagtattctagt

SEQ ID NO: 2175616 - DNA, 20 bp, Homo sapiens
tcgagaaagaggcaccagga

SEQ ID NO: 2175617 - DNA, 18 bp, Homo sapiens
tcgaggctgtgtgtccgt

SEQ ID NO: 2175618 - DNA, 23 bp, Homo sapiens
tcgcacaaggacatttgggactg

SEQ ID NO: 2175619 - DNA, 16 bp, Homo sapiens
tcgcagcagctccgcc

SEQ ID NO: 2175620 - DNA, 19 bp, Homo sapiens
tcgcccaggctggagtgca

SEQ ID NO: 2175621 - DNA, 15 bp, Homo sapiens
tcgctgtccaagtgt

SEQ ID NO: 2175622 - DNA, 15 bp, Homo sapiens
tcgctttcctgagcc

SEQ ID NO: 2175623 - DNA, 12 bp, Homo sapiens
tcgggctcagct

SEQ ID NO: 2175624 - DNA, 15 bp, Homo sapiens
tcggggcctgtgccg

SEQ ID NO: 2175625 - DNA, 15 bp, Homo sapiens
tcgtaacttcatatt

SEQ ID NO: 2175626 - DNA, 14 bp, Homo sapiens
tcgtaagaacatgt

SEQ ID NO: 2175627 - DNA, 23 bp, Homo sapiens
tcgtgacccacccgccttggcct

SEQ ID NO: 2175628 - DNA, 13 bp, Homo sapiens
tcgtgttctctcc

SEQ ID NO: 2175629 - DNA, 14 bp, Homo sapiens
tcgttctgtgtttg

SEQ ID NO: 2175630 - DNA, 16 bp, Homo sapiens
tcgttgactttaggga

SEQ ID NO: 2175631 - DNA, 11 bp, Homo sapiens
tcgttgcatgg

SEQ ID NO: 2175632 - DNA, 20 bp, Homo sapiens
tcgttggtgaccagtttctt

SEQ ID NO: 2175633 - DNA, 22 bp, Homo sapiens
tctaaaggtttcactgttcatg

SEQ ID NO: 2175634 - DNA, 20 bp, Homo sapiens
tctaacactagtctgtgtgc

SEQ ID NO: 2175635 - DNA, 23 bp, Homo sapiens
tctaacatttgagtcccttccag

SEQ ID NO: 2175636 - DNA, 16 bp, Homo sapiens
tctaatccatgtgctg

SEQ ID NO: 2175637 - DNA, 18 bp, Homo sapiens
tctaatgtaacttcctct

SEQ ID NO: 2175638 - DNA, 18 bp, Homo sapiens
tctaattcaagattacaa

SEQ ID NO: 2175639 - DNA, 15 bp, Homo sapiens
tctaatttttattaa

SEQ ID NO: 2175640 - DNA, 21 bp, Homo sapiens
tctacacagcgagaaaacttc

SEQ ID NO: 2175641 - DNA, 23 bp, Homo sapiens
tctacagccagtaaggcagctct

SEQ ID NO: 2175642 - DNA, 20 bp, Homo sapiens
tctaccactggtgtaaaaaa

SEQ ID NO: 2175643 - DNA, 15 bp, Homo sapiens
tctacccagcccatc

SEQ ID NO: 2175644 - DNA, 18 bp, Homo sapiens
tctacctgccctctctca

SEQ ID NO: 2175645 - DNA, 19 bp, Homo sapiens
tctacctgccctctctcag

SEQ ID NO: 2175646 - DNA, 18 bp, Homo sapiens
tctactggtaggaagagg

SEQ ID NO: 2175647 - DNA, 22 bp, Homo sapiens
tctagaatactaataaaataca

SEQ ID NO: 2175648 - DNA, 19 bp, Homo sapiens
tctaggcgaggcgaagctg

SEQ ID NO: 2175649 - DNA, 20 bp, Homo sapiens
tctagggaaggccacctgca

SEQ ID NO: 2175650 - DNA, 20 bp, Homo sapiens
tctaggtcagtacccacctg

SEQ ID NO: 2175651 - DNA, 21 bp, Homo sapiens
tctaggtcagtacccacctga

SEQ ID NO: 2175652 - DNA, 22 bp, Homo sapiens
tctagtggaaagattgtgtctg

SEQ ID NO: 2175653 - DNA, 12 bp, Homo sapiens
tctagtttgttt

SEQ ID NO: 2175654 - DNA, 23 bp, Homo sapiens
tctataataaatgggcacagtat

SEQ ID NO: 2175655 - DNA, 15 bp, Homo sapiens
tctatcacctgtcat

SEQ ID NO: 2175656 - DNA, 17 bp, Homo sapiens
tctatcacctgtcatca

SEQ ID NO: 2175657 - DNA, 21 bp, Homo sapiens
tctatgaaagctatgaatgtt

SEQ ID NO: 2175658 - DNA, 21 bp, Homo sapiens
tctatggcatattgataataa

SEQ ID NO: 2175659 - DNA, 21 bp, Homo sapiens
tctcaaaccctgtttacggta

SEQ ID NO: 2175660 - DNA, 22 bp, Homo sapiens
tctcaaagtttttacagtgtat

SEQ ID NO: 2175661 - DNA, 16 bp, Homo sapiens
tctcaagaactgccat

SEQ ID NO: 2175662 - DNA, 15 bp, Homo sapiens
tctcaagcactgaca

SEQ ID NO: 2175663 - DNA, 12 bp, Homo sapiens
tctcactcccct

SEQ ID NO: 2175664 - DNA, 13 bp, Homo sapiens
tctcactcccctc

SEQ ID NO: 2175665 - DNA, 21 bp, Homo sapiens
tctcagaatcccttaacagtt

SEQ ID NO: 2175666 - DNA, 16 bp, Homo sapiens
tctcagttattcagat

SEQ ID NO: 2175667 - DNA, 19 bp, Homo sapiens
tctcagttattcagattga

SEQ ID NO: 2175668 - DNA, 19 bp, Homo sapiens
tctcatagcaggaaatgta

SEQ ID NO: 2175669 - DNA, 21 bp, Homo sapiens
tctcatgtgtgctcttcttct

SEQ ID NO: 2175670 - DNA, 14 bp, Homo sapiens
tctcatgtttgtgc

SEQ ID NO: 2175671 - DNA, 21 bp, Homo sapiens
tctcattctctttctttttct

SEQ ID NO: 2175672 - DNA, 16 bp, Homo sapiens
tctcattttgtatgta

SEQ ID NO: 2175673 - DNA, 11 bp, Homo sapiens
tctccaaagct

SEQ ID NO: 2175674 - DNA, 21 bp, Homo sapiens
tctccaaagctttcctggaga

SEQ ID NO: 2175675 - DNA, 22 bp, Homo sapiens
tctccagctataacagtaggga

SEQ ID NO: 2175676 - DNA, 20 bp, Homo sapiens
tctccaggggcctgcagaag

SEQ ID NO: 2175677 - DNA, 22 bp, Homo sapiens
tctccataaagcacattttaag

SEQ ID NO: 2175678 - DNA, 15 bp, Homo sapiens
tctcccacacaagca

SEQ ID NO: 2175679 - DNA, 17 bp, Homo sapiens
tctcccagaggctcctg

SEQ ID NO: 2175680 - DNA, 18 bp, Homo sapiens
tctcccagaggctcctgg

SEQ ID NO: 2175681 - DNA, 20 bp, Homo sapiens
tcttgcctccatggtgcctc

SEQ ID NO: 2175682 - DNA, 13 bp, Homo sapiens
tcttggcctccca

SEQ ID NO: 2175683 - DNA, 16 bp, Homo sapiens
tcttggtcatttgcca

SEQ ID NO: 2175684 - DNA, 15 bp, Homo sapiens
tcttgtaaacctgga

SEQ ID NO: 2175685 - DNA, 15 bp, Homo sapiens
tttaagtgaaaatgg

SEQ ID NO: 2175686 - DNA, 14 bp, Homo sapiens
tttaatgtagccat

SEQ ID NO: 2175687 - DNA, 21 bp, Homo sapiens
tttaattgtaaagtaaaagct

SEQ ID NO: 2175688 - DNA, 21 bp, Homo sapiens
tttacagtgaataaaaggata

SEQ ID NO: 2175689 - DNA, 16 bp, Homo sapiens
tttacggaattccaat

SEQ ID NO: 2175690 - DNA, 17 bp, Homo sapiens
tttactcaaccctctca

SEQ ID NO: 2175691 - DNA, 19 bp, Homo sapiens
tttactgccttcctcctta

SEQ ID NO: 2175692 - DNA, 15 bp, Homo sapiens
tttactgtactaatt

SEQ ID NO: 2175693 - DNA, 11 bp, Homo sapiens
tttagaaatta

SEQ ID NO: 2175694 - DNA, 19 bp, Homo sapiens
tttagtaaaaataaatcaa

SEQ ID NO: 2175695 - DNA, 21 bp, Homo sapiens
tttagtgcaatttcttctgta

SEQ ID NO: 2175696 - DNA, 13 bp, Homo sapiens
tttatatttaatt

SEQ ID NO: 2175697 - DNA, 13 bp, Homo sapiens
tttatatttgtct

SEQ ID NO: 2175698 - DNA, 20 bp, Homo sapiens
tttatggatcccaattcatt

SEQ ID NO: 2175699 - DNA, 15 bp, Homo sapiens
tttatgtgactgctt

SEQ ID NO: 2175700 - DNA, 18 bp, Homo sapiens
tttattaacatatattgt

SEQ ID NO: 2175701 - DNA, 13 bp, Homo sapiens
tttattcattcag

SEQ ID NO: 2175702 - DNA, 22 bp, Homo sapiens
tttattcattcagtgagacaca

SEQ ID NO: 2175703 - DNA, 13 bp, Homo sapiens
tttatttataaca

SEQ ID NO: 2175704 - DNA, 15 bp, Homo sapiens
tttatttttgtactg

SEQ ID NO: 2175705 - DNA, 17 bp, Homo sapiens
tttatttttttattctt

SEQ ID NO: 2175706 - DNA, 19 bp, Homo sapiens
tttcaacttcaagatgaag

SEQ ID NO: 2175707 - DNA, 13 bp, Homo sapiens
tttcacagaaaac

SEQ ID NO: 2175708 - DNA, 19 bp, Homo sapiens
tttcactgaagtgaataca

SEQ ID NO: 2175709 - DNA, 22 bp, Homo sapiens
tttcactgacactgcgaactct

SEQ ID NO: 2175710 - DNA, 13 bp, Homo sapiens
tttcacttttaaa

SEQ ID NO: 2175711 - DNA, 16 bp, Homo sapiens
tttcagaagttagttt

SEQ ID NO: 2175712 - DNA, 15 bp, Homo sapiens
tttcagtaatagctg

SEQ ID NO: 2175713 - DNA, 17 bp, Homo sapiens
tttcagtaatagctgaa

SEQ ID NO: 2175714 - DNA, 21 bp, Homo sapiens
tttcagtaatagctgaacctg

SEQ ID NO: 2175715 - DNA, 23 bp, Homo sapiens
tttcagtaatagctgaacctgtt

SEQ ID NO: 2175716 - DNA, 21 bp, Homo sapiens
tttccaaaaacaaagtgcaaa

SEQ ID NO: 2175717 - DNA, 21 bp, Homo sapiens
tttccaaattgatgggtgggc

SEQ ID NO: 2175718 - DNA, 17 bp, Homo sapiens
tttccaagcctgggcca

SEQ ID NO: 2175719 - DNA, 22 bp, Homo sapiens
tttccaagcctgggccactggc

SEQ ID NO: 2175720 - DNA, 20 bp, Homo sapiens
tttccaagtcatttttgttt

SEQ ID NO: 2175721 - DNA, 16 bp, Homo sapiens
tttccacacagcctgt

SEQ ID NO: 2175722 - DNA, 22 bp, Homo sapiens
tttccagtggcctggctccgct

SEQ ID NO: 2175723 - DNA, 12 bp, Homo sapiens
tttcccaagctg

SEQ ID NO: 2175724 - DNA, 13 bp, Homo sapiens
tttccctgaacag

SEQ ID NO: 2175725 - DNA, 22 bp, Homo sapiens
tttccttaccataccactttga

SEQ ID NO: 2175726 - DNA, 13 bp, Homo sapiens
tttccttgtctct

SEQ ID NO: 2175727 - DNA, 15 bp, Homo sapiens
tttccttgtctctca

SEQ ID NO: 2175728 - DNA, 19 bp, Homo sapiens
tttccttgtctctcattct

SEQ ID NO: 2175729 - DNA, 13 bp, Homo sapiens
tttcgttgcatgg

SEQ ID NO: 2175730 - DNA, 18 bp, Homo sapiens
tttctacagtattatgta

SEQ ID NO: 2175731 - DNA, 14 bp, Homo sapiens
tttctacctcccag

SEQ ID NO: 2175732 - DNA, 17 bp, Homo sapiens
tttctatggcatattga

SEQ ID NO: 2175733 - DNA, 20 bp, Homo sapiens
tttctatttcttttttaagt

SEQ ID NO: 2175734 - DNA, 13 bp, Homo sapiens
tttctattttgca

SEQ ID NO: 2175735 - DNA, 12 bp, Homo sapiens
tttctccccagg

SEQ ID NO: 2175736 - DNA, 14 bp, Homo sapiens
tttctcctgtgccc

SEQ ID NO: 2175737 - DNA, 18 bp, Homo sapiens
tttctcctttaattgtaa

SEQ ID NO: 2175738 - DNA, 18 bp, Homo sapiens
tttctctgcttcagcttg

SEQ ID NO: 2175739 - DNA, 22 bp, Homo sapiens
tttctctttttttaaaaagttg

SEQ ID NO: 2175740 - DNA, 13 bp, Homo sapiens
tttctgaacaaaa

SEQ ID NO: 2175741 - DNA, 13 bp, Homo sapiens
tttctgccttcct

SEQ ID NO: 2175742 - DNA, 11 bp, Homo sapiens
tttctggctcc

SEQ ID NO: 2175743 - DNA, 13 bp, Homo sapiens
tttctggctcctg

SEQ ID NO: 2175744 - DNA, 14 bp, Homo sapiens
tttctggctcctgt

SEQ ID NO: 2175745 - DNA, 22 bp, Homo sapiens
tttctggtgcctatttattcat

SEQ ID NO: 2175746 - DNA, 23 bp, Homo sapiens
tttctggtgcctatttattcatt

SEQ ID NO: 2175747 - DNA, 17 bp, Homo sapiens
tttctgtctctcttgct

SEQ ID NO: 2175748 - DNA, 18 bp, Homo sapiens
tttctttttctgtctctc

SEQ ID NO: 2175749 - DNA, 20 bp, Homo sapiens
tttgaaactgctaattacac

SEQ ID NO: 2175750 - DNA, 21 bp, Homo sapiens
tttgaacttggtagttcataa

SEQ ID NO: 2175751 - DNA, 22 bp, Homo sapiens
tttgaccccttcctgtctggcc

SEQ ID NO: 2175752 - DNA, 19 bp, Homo sapiens
tttgcagacctgggacttt

SEQ ID NO: 2175753 - DNA, 12 bp, Homo sapiens
tttgcataaagg

SEQ ID NO: 2175754 - DNA, 14 bp, Homo sapiens
tttgccatgctgct

SEQ ID NO: 2175755 - DNA, 16 bp, Homo sapiens
tttgccatgctgctat

SEQ ID NO: 2175756 - DNA, 17 bp, Homo sapiens
tttgcccaacctcagca

SEQ ID NO: 2175757 - DNA, 21 bp, Homo sapiens
tttgcccagggtcctgtgcct

SEQ ID NO: 2175758 - DNA, 22 bp, Homo sapiens
tttgccccaacttaagtttaga

SEQ ID NO: 2175759 - DNA, 23 bp, Homo sapiens
tttgccccaacttaagtttagaa

SEQ ID NO: 2175760 - DNA, 17 bp, Homo sapiens
tttgctcccccatttta

SEQ ID NO: 2175761 - DNA, 19 bp, Homo sapiens
tttgctgattgtctgaaat

SEQ ID NO: 2175762 - DNA, 17 bp, Homo sapiens
tttggacacacacagct

SEQ ID NO: 2175763 - DNA, 16 bp, Homo sapiens
tttggacgcacacagc

SEQ ID NO: 2175764 - DNA, 17 bp, Homo sapiens
tttggacgcacacagct

SEQ ID NO: 2175765 - DNA, 16 bp, Homo sapiens
tttggacgtgtgagga

SEQ ID NO: 2175766 - DNA, 23 bp, Homo sapiens
tttggagaactcatttcaagtta

SEQ ID NO: 2175767 - DNA, 21 bp, Homo sapiens
tttggagtggaggcattgttt

SEQ ID NO: 2175768 - DNA, 18 bp, Homo sapiens
tttggcctcattacttta

SEQ ID NO: 2175769 - DNA, 16 bp, Homo sapiens
tttgggactgtcttga

SEQ ID NO: 2175770 - DNA, 22 bp, Homo sapiens
tttggtcaccttcctctgcctt

SEQ ID NO: 2175771 - DNA, 20 bp, Homo sapiens
tttgtaaggacttgtgcctc

SEQ ID NO: 2175772 - DNA, 21 bp, Homo sapiens
gcacgtatttatttataagtt

SEQ ID NO: 2175773 - DNA, 14 bp, Homo sapiens
gcactaatcaatac

SEQ ID NO: 2175774 - DNA, 15 bp, Homo sapiens
gcactatagccattt

SEQ ID NO: 2175775 - DNA, 16 bp, Homo sapiens
gcactatagccatttg

SEQ ID NO: 2175776 - DNA, 22 bp, Homo sapiens
gcactatagccatttgccccaa

SEQ ID NO: 2175777 - DNA, 16 bp, Homo sapiens
gcactattggactttg

SEQ ID NO: 2175778 - DNA, 14 bp, Homo sapiens
gcactcacatgctg

SEQ ID NO: 2175779 - DNA, 16 bp, Homo sapiens
gcactgcacataattt

SEQ ID NO: 2175780 - DNA, 20 bp, Homo sapiens
gcactgcacataatttgcat

SEQ ID NO: 2175781 - DNA, 20 bp, Homo sapiens
gcactggcaggatcacagct

SEQ ID NO: 2175782 - DNA, 16 bp, Homo sapiens
gcagaaagcagaggct

SEQ ID NO: 2175783 - DNA, 18 bp, Homo sapiens
gcagaaagcagaggctgg

SEQ ID NO: 2175784 - DNA, 18 bp, Homo sapiens
gcagaaatcccagttcat

SEQ ID NO: 2175785 - DNA, 21 bp, Homo sapiens
gcagaacctggtggctggagg

SEQ ID NO: 2175786 - DNA, 16 bp, Homo sapiens
gcagagacagctgttt

SEQ ID NO: 2175787 - DNA, 11 bp, Homo sapiens
gcagagctggg

SEQ ID NO: 2175788 - DNA, 14 bp, Homo sapiens
gcagaggctggcct

SEQ ID NO: 2175789 - DNA, 19 bp, Homo sapiens
gcagaggggagaggaagca

SEQ ID NO: 2175790 - DNA, 17 bp, Homo sapiens
gcagagtgccccacctg

SEQ ID NO: 2175791 - DNA, 16 bp, Homo sapiens
gcagcagcaagtacaa

SEQ ID NO: 2175792 - DNA, 20 bp, Homo sapiens
gcagcagctccgcctggcac

SEQ ID NO: 2175793 - DNA, 13 bp, Homo sapiens
gcagcagcttgct

SEQ ID NO: 2175794 - DNA, 17 bp, Homo sapiens
gcagcattttgctgctt

SEQ ID NO: 2175795 - DNA, 21 bp, Homo sapiens
gcagccattggcctctgtctc

SEQ ID NO: 2175796 - DNA, 21 bp, Homo sapiens
gcagcccttgctttcggagct

SEQ ID NO: 2175797 - DNA, 14 bp, Homo sapiens
gcagcctcaacctc

SEQ ID NO: 2175798 - DNA, 21 bp, Homo sapiens
gcagcctcgaactcctgggct

SEQ ID NO: 2175799 - DNA, 22 bp, Homo sapiens
gcagcctgctataaagttaaag

SEQ ID NO: 2175800 - DNA, 13 bp, Homo sapiens
gcagcgggcggag

SEQ ID NO: 2175801 - DNA, 20 bp, Homo sapiens
gcagcggtggaaggagcctg

SEQ ID NO: 2175802 - DNA, 21 bp, Homo sapiens
gcagcgtctgagcggccgcct

SEQ ID NO: 2175803 - DNA, 13 bp, Homo sapiens
gcagctgctggtt

SEQ ID NO: 2175804 - DNA, 13 bp, Homo sapiens
gcagcttgacgcg

SEQ ID NO: 2175805 - DNA, 16 bp, Homo sapiens
gcaggagaatcagcct

SEQ ID NO: 2175806 - DNA, 14 bp, Homo sapiens
gcaggattgaaaat

SEQ ID NO: 2175807 - DNA, 14 bp, Homo sapiens
gcaggcagccttga

SEQ ID NO: 2175808 - DNA, 22 bp, Homo sapiens
gcaggcccagctggggcccctc

SEQ ID NO: 2175809 - DNA, 13 bp, Homo sapiens
gcaggcctttcct

SEQ ID NO: 2175810 - DNA, 20 bp, Homo sapiens
gcaggctgagtgcactggca

SEQ ID NO: 2175811 - DNA, 19 bp, Homo sapiens
gcagggaaggacaggaccc

SEQ ID NO: 2175812 - DNA, 23 bp, Homo sapiens
gcagggaaggacaggaccctcag

SEQ ID NO: 2175813 - DNA, 19 bp, Homo sapiens
gcagggcagcctgtgggag

SEQ ID NO: 2175814 - DNA, 20 bp, Homo sapiens
gcagggcagcctgtgggaga

SEQ ID NO: 2175815 - DNA, 14 bp, Homo sapiens
gcaggggctgggca

SEQ ID NO: 2175816 - DNA, 17 bp, Homo sapiens
gcaggggctgggcagag

SEQ ID NO: 2175817 - DNA, 24 bp, Homo sapiens
gcagggtcctccggggctcagccc

SEQ ID NO: 2175818 - DNA, 13 bp, Homo sapiens
gcagggtctttgt

SEQ ID NO: 2175819 - DNA, 18 bp, Homo sapiens
gcagtctttttctacagc

SEQ ID NO: 2175820 - DNA, 16 bp, Homo sapiens
gcagtgagcagggttc

SEQ ID NO: 2175821 - DNA, 18 bp, Homo sapiens
gcagtgcccagtgatggc

SEQ ID NO: 2175822 - DNA, 15 bp, Homo sapiens
gcagtgcctttcccc

SEQ ID NO: 2175823 - DNA, 15 bp, Homo sapiens
gcagtggggctgggg

SEQ ID NO: 2175824 - DNA, 16 bp, Homo sapiens
gcagtgtttaaaaaat

SEQ ID NO: 2175825 - DNA, 12 bp, Homo sapiens
gcagtttcccag

SEQ ID NO: 2175826 - DNA, 16 bp, Homo sapiens
gcagtttcccagaata

SEQ ID NO: 2175827 - DNA, 19 bp, Homo sapiens
gcagtttgagcttgctgga

SEQ ID NO: 2175828 - DNA, 14 bp, Homo sapiens
gcatcaaccaggaa

SEQ ID NO: 2175829 - DNA, 18 bp, Homo sapiens
gcatcagcctctggccag

SEQ ID NO: 2175830 - DNA, 12 bp, Homo sapiens
gcatccacctcc

SEQ ID NO: 2175831 - DNA, 14 bp, Homo sapiens
gcatccagccgtgc

SEQ ID NO: 2175832 - DNA, 14 bp, Homo sapiens
gcatgactggacag

SEQ ID NO: 2175833 - DNA, 22 bp, Homo sapiens
gcatgtacaaaagtaccataga

SEQ ID NO: 2175834 - DNA, 13 bp, Homo sapiens
gcatgtgtgtatc

SEQ ID NO: 2175835 - DNA, 15 bp, Homo sapiens
gcattaaatgcaaaa

SEQ ID NO: 2175836 - DNA, 17 bp, Homo sapiens
gcattaaatgctttgat

SEQ ID NO: 2175837 - DNA, 13 bp, Homo sapiens
gcattcccagagg

SEQ ID NO: 2175838 - DNA, 14 bp, Homo sapiens
gcattcgcagcagc

SEQ ID NO: 2175839 - DNA, 16 bp, Homo sapiens
gcatttaatgtagcca

SEQ ID NO: 2175840 - DNA, 13 bp, Homo sapiens
gcattttcaacat

SEQ ID NO: 2175841 - DNA, 18 bp, Homo sapiens
gccaaccacctctggccc

SEQ ID NO: 2175842 - DNA, 23 bp, Homo sapiens
gccaaccacctctggccctgttg

SEQ ID NO: 2175843 - DNA, 17 bp, Homo sapiens
gccaactgtttccctgc

SEQ ID NO: 2175844 - DNA, 18 bp, Homo sapiens
gccaactgtttccctgct

SEQ ID NO: 2175845 - DNA, 11 bp, Homo sapiens
gccaagccaga

SEQ ID NO: 2175846 - DNA, 22 bp, Homo sapiens
gccaagccagattctcttgaat

SEQ ID NO: 2175847 - DNA, 19 bp, Homo sapiens
gccaaggcctatgccacct

SEQ ID NO: 2175848 - DNA, 23 bp, Homo sapiens
gccaatcactgagtttgtggtga

SEQ ID NO: 2175849 - DNA, 18 bp, Homo sapiens
gccaatggaacctccttt

SEQ ID NO: 2175850 - DNA, 19 bp, Homo sapiens
gccaatggaacctcctttc

SEQ ID NO: 2175851 - DNA, 19 bp, Homo sapiens
gccacagacccctgggagc

SEQ ID NO: 2175852 - DNA, 18 bp, Homo sapiens
gccacatccccgctggct

SEQ ID NO: 2175853 - DNA, 15 bp, Homo sapiens
gccaccacacccagc

SEQ ID NO: 2175854 - DNA, 21 bp, Homo sapiens
gccaccctaactgagctgcca

SEQ ID NO: 2175855 - DNA, 16 bp, Homo sapiens
gccaccctctgcaggg

SEQ ID NO: 2175856 - DNA, 18 bp, Homo sapiens
gccacctgtcccacctca

SEQ ID NO: 2175857 - DNA, 13 bp, Homo sapiens
gccacggcctggc

SEQ ID NO: 2175858 - DNA, 14 bp, Homo sapiens
gccacggcctggct

SEQ ID NO: 2175859 - DNA, 15 bp, Homo sapiens
gccacggcctggctg

SEQ ID NO: 2175860 - DNA, 11 bp, Homo sapiens
gccacggggga

SEQ ID NO: 2175861 - DNA, 21 bp, Homo sapiens
gccacgggggaggccgaggca

SEQ ID NO: 2175862 - DNA, 23 bp, Homo sapiens
gccacgggggaggccgaggcagg

SEQ ID NO: 2175863 - DNA, 13 bp, Homo sapiens
gccactaggctgg

SEQ ID NO: 2175864 - DNA, 21 bp, Homo sapiens
gccactaggctgggtgcccac

SEQ ID NO: 2175865 - DNA, 12 bp, Homo sapiens
gccactccttgt

SEQ ID NO: 2175866 - DNA, 15 bp, Homo sapiens
gccactgcagtcacc

SEQ ID NO: 2175867 - DNA, 24 bp, Homo sapiens
gccactgcagtcacccctgtctgc

SEQ ID NO: 2175868 - DNA, 18 bp, Homo sapiens
gccactggaggaagctgt

SEQ ID NO: 2175869 - DNA, 22 bp, Homo sapiens
gccactggaggaagctgttttg

SEQ ID NO: 2175870 - DNA, 21 bp, Homo sapiens
gccactggcatctctggagtg

SEQ ID NO: 2175871 - DNA, 12 bp, Homo sapiens
gccactgttttg

SEQ ID NO: 2175872 - DNA, 21 bp, Homo sapiens
gccacttccccctcttcttct

SEQ ID NO: 2175873 - DNA, 18 bp, Homo sapiens
gccactttgcagacctgg

SEQ ID NO: 2175874 - DNA, 13 bp, Homo sapiens
gccagacctcaac

SEQ ID NO: 2175875 - DNA, 15 bp, Homo sapiens
gccagacggcccgcc

SEQ ID NO: 2175876 - DNA, 14 bp, Homo sapiens
gccagccacagacc

SEQ ID NO: 2175877 - DNA, 16 bp, Homo sapiens
gccagccacagacccc

SEQ ID NO: 2175878 - DNA, 17 bp, Homo sapiens
gccagccaccctaactg

SEQ ID NO: 2175879 - DNA, 22 bp, Homo sapiens
gccagccaccctaactgagctg

SEQ ID NO: 2175880 - DNA, 23 bp, Homo sapiens
gccagccaccctaactgagctgc

SEQ ID NO: 2175881 - DNA, 14 bp, Homo sapiens
gccagccctaggct

SEQ ID NO: 2175882 - DNA, 18 bp, Homo sapiens
gccagccctaggctaccc

SEQ ID NO: 2175883 - DNA, 16 bp, Homo sapiens
gccaggacagctgcag

SEQ ID NO: 2175884 - DNA, 14 bp, Homo sapiens
gccataccttgaga

SEQ ID NO: 2175885 - DNA, 23 bp, Homo sapiens
gccatagctcctgctccacagcc

SEQ ID NO: 2175886 - DNA, 17 bp, Homo sapiens
gccatcggtcctgtctc

SEQ ID NO: 2175887 - DNA, 22 bp, Homo sapiens
gccatctgactgccaagccaga

SEQ ID NO: 2175888 - DNA, 23 bp, Homo sapiens
gccatctgactgccaagccagat

SEQ ID NO: 2175889 - DNA, 22 bp, Homo sapiens
gccatctggaaatccagctggt

SEQ ID NO: 2175890 - DNA, 22 bp, Homo sapiens
gccatgattttggccactttgc

SEQ ID NO: 2175891 - DNA, 12 bp, Homo sapiens
gccatgggacca

SEQ ID NO: 2175892 - DNA, 19 bp, Homo sapiens
aaagtgagcatgctttctg

SEQ ID NO: 2175893 - DNA, 12 bp, Homo sapiens
aaagtgcaaagc

SEQ ID NO: 2175894 - DNA, 13 bp, Homo sapiens
aaagtgcaaagct

SEQ ID NO: 2175895 - DNA, 12 bp, Homo sapiens
aaagtgccctca

SEQ ID NO: 2175896 - DNA, 17 bp, Homo sapiens
gttagtgatttgctatc

SEQ ID NO: 2175897 - DNA, 18 bp, Homo sapiens
gttagtgatttgctatca

SEQ ID NO: 2175898 - DNA, 22 bp, Homo sapiens
gttatactaggttaacatttgt

SEQ ID NO: 2175899 - DNA, 13 bp, Homo sapiens
gttatctttagca

SEQ ID NO: 2175900 - DNA, 20 bp, Homo sapiens
gttattaatagccatttgaa

SEQ ID NO: 2175901 - DNA, 17 bp, Homo sapiens
gttattatctgggctta

SEQ ID NO: 2175902 - DNA, 22 bp, Homo sapiens
gttattatctgggcttatatct

SEQ ID NO: 2175903 - DNA, 19 bp, Homo sapiens
gttattcactctcccagag

SEQ ID NO: 2175904 - DNA, 19 bp, Homo sapiens
gttatttttgtctcgaaat

SEQ ID NO: 2175905 - DNA, 19 bp, Homo sapiens
gttcaagcgactctcctgc

SEQ ID NO: 2175906 - DNA, 21 bp, Homo sapiens
gttcataaaggtttacagtga

SEQ ID NO: 2175907 - DNA, 22 bp, Homo sapiens
gttcataaaggtttacagtgaa

SEQ ID NO: 2175908 - DNA, 19 bp, Homo sapiens
gttccccaagggccctggc

SEQ ID NO: 2175909 - DNA, 20 bp, Homo sapiens
gttccccaagggccctggca

SEQ ID NO: 2175910 - DNA, 13 bp, Homo sapiens
gttccctttgctc

SEQ ID NO: 2175911 - DNA, 18 bp, Homo sapiens
gttccctttgctccaccc

SEQ ID NO: 2175912 - DNA, 20 bp, Homo sapiens
gttccctttgctccacccca

SEQ ID NO: 2175913 - DNA, 19 bp, Homo sapiens
gttcctggggtgccctcca

SEQ ID NO: 2175914 - DNA, 23 bp, Homo sapiens
gttctgaagccatgtagccaccc

SEQ ID NO: 2175915 - DNA, 17 bp, Homo sapiens
gttctgcttttaagttt

SEQ ID NO: 2175916 - DNA, 11 bp, Homo sapiens
gttctgggtgg

SEQ ID NO: 2175917 - DNA, 18 bp, Homo sapiens
gttctgggtggttgccct

SEQ ID NO: 2175918 - DNA, 21 bp, Homo sapiens
gttctggttagctcagcccca

SEQ ID NO: 2175919 - DNA, 12 bp, Homo sapiens
gttgaaggcttt

SEQ ID NO: 2175920 - DNA, 19 bp, Homo sapiens
gttgataggagacttgtac

SEQ ID NO: 2175921 - DNA, 22 bp, Homo sapiens
gttgatatattctttccatgca

SEQ ID NO: 2175922 - DNA, 23 bp, Homo sapiens
gttgatatattctttccatgcag

SEQ ID NO: 2175923 - DNA, 19 bp, Homo sapiens
gttgcatccacaggattcc

SEQ ID NO: 2175924 - DNA, 15 bp, Homo sapiens
gttgctcagaagaga

SEQ ID NO: 2175925 - DNA, 15 bp, Homo sapiens
gttggcatcacctgc

SEQ ID NO: 2175926 - DNA, 14 bp, Homo sapiens
gttggcttttttcc

SEQ ID NO: 2175927 - DNA, 19 bp, Homo sapiens
gttggtgaccagtttctta

SEQ ID NO: 2175928 - DNA, 20 bp, Homo sapiens
gttggtgaccagtttcttaa

SEQ ID NO: 2175929 - DNA, 13 bp, Homo sapiens
gttgtaaatacaa

SEQ ID NO: 2175930 - DNA, 14 bp, Homo sapiens
gttgtaaatacaat

SEQ ID NO: 2175931 - DNA, 23 bp, Homo sapiens
gttgtctaaaaataaaatgcatt

SEQ ID NO: 2175932 - DNA, 16 bp, Homo sapiens
gttgttcagaagttgt

SEQ ID NO: 2175933 - DNA, 20 bp, Homo sapiens
gtttaaaaagaaattgaggt

SEQ ID NO: 2175934 - DNA, 20 bp, Homo sapiens
gtttagaaattacaagtttc

SEQ ID NO: 2175935 - DNA, 18 bp, Homo sapiens
gtttagtaactgtttttt

SEQ ID NO: 2175936 - DNA, 18 bp, Homo sapiens
gtttataatattgcagtt

SEQ ID NO: 2175937 - DNA, 21 bp, Homo sapiens
gtttcactgccaacttttagt

SEQ ID NO: 2175938 - DNA, 17 bp, Homo sapiens
gtttcagtaatagctga

SEQ ID NO: 2175939 - DNA, 17 bp, Homo sapiens
gtttccaagcctgggcc

SEQ ID NO: 2175940 - DNA, 14 bp, Homo sapiens
gtttcgttgcatgg

SEQ ID NO: 2175941 - DNA, 13 bp, Homo sapiens
gtttcttattcaa

SEQ ID NO: 2175942 - DNA, 14 bp, Homo sapiens
gtttgatccttgtt

SEQ ID NO: 2175943 - DNA, 19 bp, Homo sapiens
gtttgatgtgtatgtgttt

SEQ ID NO: 2175944 - DNA, 18 bp, Homo sapiens
gtttgctaagtaaattag

SEQ ID NO: 2175945 - DNA, 14 bp, Homo sapiens
gtttggtataaatt

SEQ ID NO: 2175946 - DNA, 19 bp, Homo sapiens
gtttggtataaattaattt

SEQ ID NO: 2175947 - DNA, 15 bp, Homo sapiens
gtttgtatataaatg

SEQ ID NO: 2175948 - DNA, 16 bp, Homo sapiens
gtttgtcttctcccca

SEQ ID NO: 2175949 - DNA, 17 bp, Homo sapiens
gtttgtcttctccccag

SEQ ID NO: 2175950 - DNA, 16 bp, Homo sapiens
gtttgtgagtatgtgt

SEQ ID NO: 2175951 - DNA, 16 bp, Homo sapiens
gttttagtgccaggct

SEQ ID NO: 2175952 - DNA, 19 bp, Homo sapiens
gttttcccctctctttgag

SEQ ID NO: 2175953 - DNA, 18 bp, Homo sapiens
gttttccctgttctggac

SEQ ID NO: 2175954 - DNA, 21 bp, Homo sapiens
gttttctttttttagggagaa

SEQ ID NO: 2175955 - DNA, 14 bp, Homo sapiens
gttttggcagctga

SEQ ID NO: 2175956 - DNA, 15 bp, Homo sapiens
gttttggcagctgac

SEQ ID NO: 2175957 - DNA, 15 bp, Homo sapiens
gtttttatgagaaac

SEQ ID NO: 2175958 - DNA, 20 bp, Homo sapiens
gttttttttccaaaaacaaa

SEQ ID NO: 2175959 - DNA, 21 bp, Homo sapiens
taaaaacactacctcttttga

SEQ ID NO: 2175960 - DNA, 18 bp, Homo sapiens
taaaaataaaatgcattt

SEQ ID NO: 2175961 - DNA, 16 bp, Homo sapiens
taaaaattaattcttt

SEQ ID NO: 2175962 - DNA, 19 bp, Homo sapiens
taaaaattagaacttgaat

SEQ ID NO: 2175963 - DNA, 12 bp, Homo sapiens
taaaaattcaga

SEQ ID NO: 2175964 - DNA, 19 bp, Homo sapiens
taaaaattgaaaactttgg

SEQ ID NO: 2175965 - DNA, 16 bp, Homo sapiens
taaaacaaaaccaagc

SEQ ID NO: 2175966 - DNA, 21 bp, Homo sapiens
taaaacaaaaccaagccttgg

SEQ ID NO: 2175967 - DNA, 14 bp, Homo sapiens
taaaacaaattaaa

SEQ ID NO: 2175968 - DNA, 17 bp, Homo sapiens
taaaagataagtttgtt

SEQ ID NO: 2175969 - DNA, 22 bp, Homo sapiens
taaaaggcactgcacataattt

SEQ ID NO: 2175970 - DNA, 18 bp, Homo sapiens
taaaataattatataact

SEQ ID NO: 2175971 - DNA, 15 bp, Homo sapiens
taaaataatttatca

SEQ ID NO: 2175972 - DNA, 22 bp, Homo sapiens
taaaataatttatcaaaaaaca

SEQ ID NO: 2175973 - DNA, 23 bp, Homo sapiens
taaaatacatactatagattctt

SEQ ID NO: 2175974 - DNA, 20 bp, Homo sapiens
taaaatatctacctgccctc

SEQ ID NO: 2175975 - DNA, 16 bp, Homo sapiens
taaaatcacaaactca

SEQ ID NO: 2175976 - DNA, 19 bp, Homo sapiens
taaaatctattttgtctga

SEQ ID NO: 2175977 - DNA, 16 bp, Homo sapiens
taaaattcattccatt

SEQ ID NO: 2175978 - DNA, 16 bp, Homo sapiens
taaacagaaatccttt

SEQ ID NO: 2175979 - DNA, 18 bp, Homo sapiens
taaacagttgaataattt

SEQ ID NO: 2175980 - DNA, 19 bp, Homo sapiens
taaaccaaacggaactctt

SEQ ID NO: 2175981 - DNA, 13 bp, Homo sapiens
taaactacaaaaa

SEQ ID NO: 2175982 - DNA, 18 bp, Homo sapiens
taaactactatttttctt

SEQ ID NO: 2175983 - DNA, 22 bp, Homo sapiens
taaactactatttttctttcca

SEQ ID NO: 2175984 - DNA, 16 bp, Homo sapiens
taaactgccctgtcta

SEQ ID NO: 2175985 - DNA, 14 bp, Homo sapiens
taaacttgcaatga

SEQ ID NO: 2175986 - DNA, 22 bp, Homo sapiens
taaagaaaattgccaaaatata

SEQ ID NO: 2175987 - DNA, 23 bp, Homo sapiens
taaagaaaattgccaaaatatat

SEQ ID NO: 2175988 - DNA, 23 bp, Homo sapiens
taaagaggtggggtgaagctggg

SEQ ID NO: 2175989 - DNA, 17 bp, Homo sapiens
taaagcagtatttttct

SEQ ID NO: 2175990 - DNA, 23 bp, Homo sapiens
taaagccagcatttcctcagtct

SEQ ID NO: 2175991 - DNA, 17 bp, Homo sapiens
taaagccttttaaatca

SEQ ID NO: 2175992 - DNA, 15 bp, Homo sapiens
taaagctatatttct

SEQ ID NO: 2175993 - DNA, 14 bp, Homo sapiens
taaagggacactgg

SEQ ID NO: 2175994 - DNA, 21 bp, Homo sapiens
taaaggtttcactgttcatga

SEQ ID NO: 2175995 - DNA, 16 bp, Homo sapiens
taaagtactgcaaaat

SEQ ID NO: 2175996 - DNA, 18 bp, Homo sapiens
taaagtcacacatttcta

SEQ ID NO: 2175997 - DNA, 20 bp, Homo sapiens
taaagtgagctctatgggca

SEQ ID NO: 2175998 - DNA, 15 bp, Homo sapiens
taaagtggctttcaa

SEQ ID NO: 2175999 - DNA, 13 bp, Homo sapiens
taaagttaaagtc

SEQ ID NO: 2176000 - DNA, 17 bp, Homo sapiens
taaatacaattcaaaca

SEQ ID NO: 2176001 - DNA, 16 bp, Homo sapiens
taaatacatggaaatc

SEQ ID NO: 2176002 - DNA, 18 bp, Homo sapiens
taaatatagaaccatgaa

SEQ ID NO: 2176003 - DNA, 16 bp, Homo sapiens
taaatatattttcttt

SEQ ID NO: 2176004 - DNA, 21 bp, Homo sapiens
taaatatgtgattatcattta

SEQ ID NO: 2176005 - DNA, 14 bp, Homo sapiens
taaatatttcttaa

SEQ ID NO: 2176006 - DNA, 22 bp, Homo sapiens
taaatcatgttaatcctagctg

SEQ ID NO: 2176007 - DNA, 15 bp, Homo sapiens
taaatgcaaaaatat

SEQ ID NO: 2176008 - DNA, 15 bp, Homo sapiens
taaatggtgagaatt

SEQ ID NO: 2176009 - DNA, 17 bp, Homo sapiens
taaatggtgagaattaa

SEQ ID NO: 2176010 - DNA, 23 bp, Homo sapiens
taaatggtgagaattaaaataaa

SEQ ID NO: 2176011 - DNA, 17 bp, Homo sapiens
taaatgttaccaaaaat

SEQ ID NO: 2176012 - DNA, 22 bp, Homo sapiens
taaattaatttgttaattaaat

SEQ ID NO: 2176013 - DNA, 20 bp, Homo sapiens
taaattatgaatattaaagg

SEQ ID NO: 2176014 - DNA, 16 bp, Homo sapiens
taaattttttaagcaa

SEQ ID NO: 2176015 - DNA, 20 bp, Homo sapiens
taacaccaagagtagcacct

SEQ ID NO: 2176016 - DNA, 23 bp, Homo sapiens
taacaccaagagtagcaccttca

SEQ ID NO: 2176017 - DNA, 18 bp, Homo sapiens
tagtgtgtcctgtgtaaa

SEQ ID NO: 2176018 - DNA, 17 bp, Homo sapiens
tagtgttttgtacttgt

SEQ ID NO: 2176019 - DNA, 11 bp, Homo sapiens
tagttaaaatc

SEQ ID NO: 2176020 - DNA, 14 bp, Homo sapiens
tagttcaggatttg

SEQ ID NO: 2176021 - DNA, 15 bp, Homo sapiens
tagttccctcagtgt

SEQ ID NO: 2176022 - DNA, 15 bp, Homo sapiens
tagttgtaatgtgta

SEQ ID NO: 2176023 - DNA, 12 bp, Homo sapiens
tagtttgctttg

SEQ ID NO: 2176024 - DNA, 16 bp, Homo sapiens
tagtttgctttgcttt

SEQ ID NO: 2176025 - DNA, 19 bp, Homo sapiens
tagtttgctttgctttgta

SEQ ID NO: 2176026 - DNA, 15 bp, Homo sapiens
tagtttgtttttgtt

SEQ ID NO: 2176027 - DNA, 20 bp, Homo sapiens
tagttttgttccaacagtta

SEQ ID NO: 2176028 - DNA, 22 bp, Homo sapiens
tagttttttggttttgtttctg

SEQ ID NO: 2176029 - DNA, 19 bp, Homo sapiens
tataaaaaataaaggcaaa

SEQ ID NO: 2176030 - DNA, 18 bp, Homo sapiens
tataaaattagattagaa

SEQ ID NO: 2176031 - DNA, 17 bp, Homo sapiens
tataaagttattaatag

SEQ ID NO: 2176032 - DNA, 17 bp, Homo sapiens
tataaatatattttctt

SEQ ID NO: 2176033 - DNA, 17 bp, Homo sapiens
tataaatggaatcacac

SEQ ID NO: 2176034 - DNA, 15 bp, Homo sapiens
tataaattaatttgt

SEQ ID NO: 2176035 - DNA, 17 bp, Homo sapiens
tataaattaatttgtta

SEQ ID NO: 2176036 - DNA, 13 bp, Homo sapiens
tataactgtacaa

SEQ ID NO: 2176037 - DNA, 20 bp, Homo sapiens
tataagaagctttcagtatt

SEQ ID NO: 2176038 - DNA, 22 bp, Homo sapiens
tataatacttaaaaatatgtga

SEQ ID NO: 2176039 - DNA, 15 bp, Homo sapiens
tataatgacttttaa

SEQ ID NO: 2176040 - DNA, 16 bp, Homo sapiens
tataatgacttttaaa

SEQ ID NO: 2176041 - DNA, 22 bp, Homo sapiens
tataattaaagaaaattgccaa

SEQ ID NO: 2176042 - DNA, 23 bp, Homo sapiens
tataattaaagaaaattgccaaa

SEQ ID NO: 2176043 - DNA, 19 bp, Homo sapiens
tataattttattgctggaa

SEQ ID NO: 2176044 - DNA, 18 bp, Homo sapiens
tatacaattcagagaata

SEQ ID NO: 2176045 - DNA, 17 bp, Homo sapiens
tatacatatgatcaaat

SEQ ID NO: 2176046 - DNA, 21 bp, Homo sapiens
tatacatatgatcaaatactc

SEQ ID NO: 2176047 - DNA, 13 bp, Homo sapiens
tatactgcagctt

SEQ ID NO: 2176048 - DNA, 16 bp, Homo sapiens
tatagatataactgta

SEQ ID NO: 2176049 - DNA, 13 bp, Homo sapiens
tatagattcttta

SEQ ID NO: 2176050 - DNA, 18 bp, Homo sapiens
tatataattttattgctg

SEQ ID NO: 2176051 - DNA, 14 bp, Homo sapiens
tatatatgccttat

SEQ ID NO: 2176052 - DNA, 13 bp, Homo sapiens
tatatctggcctc

SEQ ID NO: 2176053 - DNA, 17 bp, Homo sapiens
tatatgccttatgtaat

SEQ ID NO: 2176054 - DNA, 11 bp, Homo sapiens
tatatgtagcc

SEQ ID NO: 2176055 - DNA, 15 bp, Homo sapiens
tatattataagattt

SEQ ID NO: 2176056 - DNA, 18 bp, Homo sapiens
tatattcaaaaattatat

SEQ ID NO: 2176057 - DNA, 12 bp, Homo sapiens
tatattgtaatt

SEQ ID NO: 2176058 - DNA, 20 bp, Homo sapiens
tatatttaatttttacatga

SEQ ID NO: 2176059 - DNA, 16 bp, Homo sapiens
tatatttgaaactgct

SEQ ID NO: 2176060 - DNA, 13 bp, Homo sapiens
tatatttgtctca

SEQ ID NO: 2176061 - DNA, 16 bp, Homo sapiens
tatcaaaaaacaagtc

SEQ ID NO: 2176062 - DNA, 20 bp, Homo sapiens
tatcatcccaacagccaaga

SEQ ID NO: 2176063 - DNA, 16 bp, Homo sapiens
tatcctacagtacaat

SEQ ID NO: 2176064 - DNA, 12 bp, Homo sapiens
tatcctacttct

SEQ ID NO: 2176065 - DNA, 19 bp, Homo sapiens
tatcctggctttgcccaac

SEQ ID NO: 2176066 - DNA, 21 bp, Homo sapiens
tatcctggctttgcccaacct

SEQ ID NO: 2176067 - DNA, 19 bp, Homo sapiens
tatctacctgccctctctc

SEQ ID NO: 2176068 - DNA, 13 bp, Homo sapiens
tatctcattgcaa

SEQ ID NO: 2176069 - DNA, 17 bp, Homo sapiens
tatctcgctagccatat

SEQ ID NO: 2176070 - DNA, 15 bp, Homo sapiens
tatctggcctctgct

SEQ ID NO: 2176071 - DNA, 12 bp, Homo sapiens
tatctgtgttac

SEQ ID NO: 2176072 - DNA, 17 bp, Homo sapiens
tatctgtttgcttctaa

SEQ ID NO: 2176073 - DNA, 17 bp, Homo sapiens
tatcttcttaacagttt

SEQ ID NO: 2176074 - DNA, 19 bp, Homo sapiens
tatgaaagctatgaatgtt

SEQ ID NO: 2176075 - DNA, 19 bp, Homo sapiens
tatgaagactacttttaga

SEQ ID NO: 2176076 - DNA, 20 bp, Homo sapiens
tatgatggcaggagaatcag

SEQ ID NO: 2176077 - DNA, 18 bp, Homo sapiens
tatgcacctataaatact

SEQ ID NO: 2176078 - DNA, 19 bp, Homo sapiens
tatgcagagacagctgttt

SEQ ID NO: 2176079 - DNA, 12 bp, Homo sapiens
tatgcatttttt

SEQ ID NO: 2176080 - DNA, 16 bp, Homo sapiens
tatgccacctgcagcg

SEQ ID NO: 2176081 - DNA, 13 bp, Homo sapiens
tatgcctatattt

SEQ ID NO: 2176082 - DNA, 15 bp, Homo sapiens
tatgcttactcttgc

SEQ ID NO: 2176083 - DNA, 15 bp, Homo sapiens
tatggaattttgcaa

SEQ ID NO: 2176084 - DNA, 19 bp, Homo sapiens
tatggatcccaattcattt

SEQ ID NO: 2176085 - DNA, 13 bp, Homo sapiens
tatggtgccaatg

SEQ ID NO: 2176086 - DNA, 16 bp, Homo sapiens
tatgtaatttaataaa

SEQ ID NO: 2176087 - DNA, 14 bp, Homo sapiens
tatgtagattgcct

SEQ ID NO: 2176088 - DNA, 15 bp, Homo sapiens
tatgtatgataaaca

SEQ ID NO: 2176089 - DNA, 17 bp, Homo sapiens
tatgtatgtgtagtgtg

SEQ ID NO: 2176090 - DNA, 21 bp, Homo sapiens
tatgtattatttacatttaat

SEQ ID NO: 2176091 - DNA, 15 bp, Homo sapiens
tatgtattttaaaat

SEQ ID NO: 2176092 - DNA, 18 bp, Homo sapiens
tatgtgaatatttgtaaa

SEQ ID NO: 2176093 - DNA, 22 bp, Homo sapiens
tatgtgaatatttgtaaaaata

SEQ ID NO: 2176094 - DNA, 17 bp, Homo sapiens
tatgtgagcatgaaact

SEQ ID NO: 2176095 - DNA, 22 bp, Homo sapiens
tatgtgagcatgaaactatgca

SEQ ID NO: 2176096 - DNA, 14 bp, Homo sapiens
tatgttaagggctt

SEQ ID NO: 2176097 - DNA, 18 bp, Homo sapiens
tatgttgacctttgcaaa

SEQ ID NO: 2176098 - DNA, 22 bp, Homo sapiens
tatgtttgcattaaatgctttg

SEQ ID NO: 2176099 - DNA, 19 bp, Homo sapiens
tattaaaaattaattcttt

SEQ ID NO: 2176100 - DNA, 18 bp, Homo sapiens
tattaaaaattgaaaact

SEQ ID NO: 2176101 - DNA, 19 bp, Homo sapiens
tattaatagagaagtaaaa

SEQ ID NO: 2176102 - DNA, 17 bp, Homo sapiens
tattaatagctgcctta

SEQ ID NO: 2176103 - DNA, 15 bp, Homo sapiens
tattaatataagttt

SEQ ID NO: 2176104 - DNA, 21 bp, Homo sapiens
tattactgtttgtcttctccc

SEQ ID NO: 2176105 - DNA, 23 bp, Homo sapiens
tattagccaactgtttccctgct

SEQ ID NO: 2176106 - DNA, 13 bp, Homo sapiens
tattattactgtt

SEQ ID NO: 2176107 - DNA, 15 bp, Homo sapiens
tattcaaaaattata

SEQ ID NO: 2176108 - DNA, 20 bp, Homo sapiens
tattcactctcccagaggct

SEQ ID NO: 2176109 - DNA, 15 bp, Homo sapiens
tattcacttgtgttt

SEQ ID NO: 2176110 - DNA, 14 bp, Homo sapiens
tattcatacctgtt

SEQ ID NO: 2176111 - DNA, 17 bp, Homo sapiens
tattctctgtccagggc

SEQ ID NO: 2176112 - DNA, 22 bp, Homo sapiens
tattctttaattgttgctttta

SEQ ID NO: 2176113 - DNA, 19 bp, Homo sapiens
tattctttccatgcagtta

SEQ ID NO: 2176114 - DNA, 22 bp, Homo sapiens
tattgaataggcattaaatgca

SEQ ID NO: 2176115 - DNA, 20 bp, Homo sapiens
tattgcagttcatactgaat

SEQ ID NO: 2176116 - DNA, 16 bp, Homo sapiens
tattgcttaaacaaaa

SEQ ID NO: 2176117 - DNA, 17 bp, Homo sapiens
tattgtgaaatttgtta

SEQ ID NO: 2176118 - DNA, 19 bp, Homo sapiens
tattgtgaaatttgttaat

SEQ ID NO: 2176119 - DNA, 16 bp, Homo sapiens
tattgttttgtgactt

SEQ ID NO: 2176120 - DNA, 10 bp, Homo sapiens
tatttaacag

SEQ ID NO: 2176121 - DNA, 19 bp, Homo sapiens
tatttaacagaaattgtat

SEQ ID NO: 2176122 - DNA, 22 bp, Homo sapiens
tatttaataccaccaacaaata

SEQ ID NO: 2176123 - DNA, 17 bp, Homo sapiens
tatttaatttttacatg

SEQ ID NO: 2176124 - DNA, 14 bp, Homo sapiens
tatttactgtacta

SEQ ID NO: 2176125 - DNA, 21 bp, Homo sapiens
tatttagtaaaaataaatcaa

SEQ ID NO: 2176126 - DNA, 13 bp, Homo sapiens
tatttataaatat

SEQ ID NO: 2176127 - DNA, 16 bp, Homo sapiens
tatttataattaaaga

SEQ ID NO: 2176128 - DNA, 18 bp, Homo sapiens
tatttccatattaaaatc

SEQ ID NO: 2176129 - DNA, 10 bp, Homo sapiens
tatttcttaa

SEQ ID NO: 2176130 - DNA, 22 bp, Homo sapiens
tatttgaaactgctaattacac

SEQ ID NO: 2176131 - DNA, 17 bp, Homo sapiens
tatttgacttctgagtg

SEQ ID NO: 2176132 - DNA, 23 bp, Homo sapiens
tatttggagtggaggcattgttt

SEQ ID NO: 2176133 - DNA, 16 bp, Homo sapiens
tatttgtgtaaagtat

SEQ ID NO: 2176134 - DNA, 12 bp, Homo sapiens
tattttctttct

SEQ ID NO: 2176135 - DNA, 22 bp, Homo sapiens
tattttctttctagtttgttta

SEQ ID NO: 2176136 - DNA, 18 bp, Homo sapiens
tattttgactgtgattta

SEQ ID NO: 2176137 - DNA, 13 bp, Homo sapiens
tattttgcaaaca

SEQ ID NO: 2176138 - DNA, 21 bp, Homo sapiens
tattttgcacgaattttaaaa

SEQ ID NO: 2176139 - DNA, 19 bp, Homo sapiens
tattttggggaactgttgt

SEQ ID NO: 2176140 - DNA, 15 bp, Homo sapiens
tccctgcagggccat

SEQ ID NO: 2176141 - DNA, 15 bp, Homo sapiens
tccctgcagggtagg

SEQ ID NO: 2176142 - DNA, 13 bp, Homo sapiens
tccctgctcagct

SEQ ID NO: 2176143 - DNA, 19 bp, Homo sapiens
tccctgctttttgtgtttt

SEQ ID NO: 2176144 - DNA, 16 bp, Homo sapiens
tccctggccatctctg

SEQ ID NO: 2176145 - DNA, 24 bp, Homo sapiens
tccctggggtttttttcatccctg

SEQ ID NO: 2176146 - DNA, 14 bp, Homo sapiens
tccctgtccacccc

SEQ ID NO: 2176147 - DNA, 19 bp, Homo sapiens
tcccttatttttatttatt

SEQ ID NO: 2176148 - DNA, 13 bp, Homo sapiens
tcccttctccttc

SEQ ID NO: 2176149 - DNA, 18 bp, Homo sapiens
tccctttcactgaagtga

SEQ ID NO: 2176150 - DNA, 22 bp, Homo sapiens
tccctttgctccaccccactca

SEQ ID NO: 2176151 - DNA, 15 bp, Homo sapiens
tccgcctggcaccca

SEQ ID NO: 2176152 - DNA, 19 bp, Homo sapiens
tccgctttgaaagaagcaa

SEQ ID NO: 2176153 - DNA, 20 bp, Homo sapiens
tccgctttgaaagaagcaag

SEQ ID NO: 2176154 - DNA, 19 bp, Homo sapiens
tccggccaaggtgccacca

SEQ ID NO: 2176155 - DNA, 21 bp, Homo sapiens
tccggccaaggtgccaccacc

SEQ ID NO: 2176156 - DNA, 13 bp, Homo sapiens
tccggccctggct

SEQ ID NO: 2176157 - DNA, 13 bp, Homo sapiens
tccgtctcccctc

SEQ ID NO: 2176158 - DNA, 22 bp, Homo sapiens
tccgttgaatgagtgtgttttg

SEQ ID NO: 2176159 - DNA, 16 bp, Homo sapiens
tcctacacctaactca

SEQ ID NO: 2176160 - DNA, 16 bp, Homo sapiens
tcctaccccaattcct

SEQ ID NO: 2176161 - DNA, 18 bp, Homo sapiens
tcctaccccaattccttg

SEQ ID NO: 2176162 - DNA, 12 bp, Homo sapiens
tcctagctgtgt

SEQ ID NO: 2176163 - DNA, 19 bp, Homo sapiens
tcctagttttatgtttctt

SEQ ID NO: 2176164 - DNA, 21 bp, Homo sapiens
tcctcaaggggccatcctgtc

SEQ ID NO: 2176165 - DNA, 19 bp, Homo sapiens
tcctcactatttttttgtt

SEQ ID NO: 2176166 - DNA, 21 bp, Homo sapiens
tcctcagaatagtgatgtgtt

SEQ ID NO: 2176167 - DNA, 23 bp, Homo sapiens
tcctcagaatagtgatgtgttcg

SEQ ID NO: 2176168 - DNA, 13 bp, Homo sapiens
tcctccctgctca

SEQ ID NO: 2176169 - DNA, 15 bp, Homo sapiens
tcctccctgctcagc

SEQ ID NO: 2176170 - DNA, 16 bp, Homo sapiens
tcctccctgctcagct

SEQ ID NO: 2176171 - DNA, 19 bp, Homo sapiens
tcctccctgctcagctggc

SEQ ID NO: 2176172 - DNA, 17 bp, Homo sapiens
tcctccctttttccttg

SEQ ID NO: 2176173 - DNA, 18 bp, Homo sapiens
tcctccggggctcagccc

SEQ ID NO: 2176174 - DNA, 22 bp, Homo sapiens
tcctcctgagtgatcccatttc

SEQ ID NO: 2176175 - DNA, 14 bp, Homo sapiens
tcctctcgttggta

SEQ ID NO: 2176176 - DNA, 21 bp, Homo sapiens
tcctctcgttggtagttgaga

SEQ ID NO: 2176177 - DNA, 15 bp, Homo sapiens
tcctctctgctgggt

SEQ ID NO: 2176178 - DNA, 24 bp, Homo sapiens
tcctctgcctttgttcactgtgag

SEQ ID NO: 2176179 - DNA, 22 bp, Homo sapiens
tcctctttttgctcccccattt

SEQ ID NO: 2176180 - DNA, 11 bp, Homo sapiens
tcctgaccagc

SEQ ID NO: 2176181 - DNA, 16 bp, Homo sapiens
tcctgaggcagaacct

SEQ ID NO: 2176182 - DNA, 19 bp, Homo sapiens
tcctgaggcagaacctggt

SEQ ID NO: 2176183 - DNA, 21 bp, Homo sapiens
tcctgaggcagaacctggtgg

SEQ ID NO: 2176184 - DNA, 19 bp, Homo sapiens
tcctgattgctctggaagc

SEQ ID NO: 2176185 - DNA, 13 bp, Homo sapiens
tcctgcagagctg

SEQ ID NO: 2176186 - DNA, 14 bp, Homo sapiens
tcctgcagagctgg

SEQ ID NO: 2176187 - DNA, 16 bp, Homo sapiens
tcctgcagagctgggg

SEQ ID NO: 2176188 - DNA, 23 bp, Homo sapiens
tcctgcagagctggggggaaggc

SEQ ID NO: 2176189 - DNA, 11 bp, Homo sapiens
tcctgcatgca

SEQ ID NO: 2176190 - DNA, 18 bp, Homo sapiens
tcctgcccgccctccctc

SEQ ID NO: 2176191 - DNA, 18 bp, Homo sapiens
tcctgccctgccctcctg

SEQ ID NO: 2176192 - DNA, 19 bp, Homo sapiens
tcctgcctcagcctccaga

SEQ ID NO: 2176193 - DNA, 17 bp, Homo sapiens
tcctgcctcagcctccc

SEQ ID NO: 2176194 - DNA, 24 bp, Homo sapiens
tcctgctctctacccagcccatct

SEQ ID NO: 2176195 - DNA, 14 bp, Homo sapiens
tcctgctggtgacc

SEQ ID NO: 2176196 - DNA, 12 bp, Homo sapiens
tcctggcgcctg

SEQ ID NO: 2176197 - DNA, 20 bp, Homo sapiens
tcctggcgcctggcagtccg

SEQ ID NO: 2176198 - DNA, 16 bp, Homo sapiens
tcctggctttgcccaa

SEQ ID NO: 2176199 - DNA, 18 bp, Homo sapiens
tcctgggtgagtttttct

SEQ ID NO: 2176200 - DNA, 12 bp, Homo sapiens
tcctgtacaagt

SEQ ID NO: 2176201 - DNA, 14 bp, Homo sapiens
tcctgtcaatgttt

SEQ ID NO: 2176202 - DNA, 17 bp, Homo sapiens
tcctgtcaatgtttgct

SEQ ID NO: 2176203 - DNA, 18 bp, Homo sapiens
tcctgtcaatgtttgctt

SEQ ID NO: 2176204 - DNA, 13 bp, Homo sapiens
tcctgtccgccct

SEQ ID NO: 2176205 - DNA, 19 bp, Homo sapiens
tcctgtctcccctctgctg

SEQ ID NO: 2176206 - DNA, 14 bp, Homo sapiens
tcctgtcttggcct

SEQ ID NO: 2176207 - DNA, 15 bp, Homo sapiens
tcctgtcttggcctc

SEQ ID NO: 2176208 - DNA, 19 bp, Homo sapiens
tcctgtcttggcctcccaa

SEQ ID NO: 2176209 - DNA, 23 bp, Homo sapiens
tcctgtgcccacccgtcttcaat

SEQ ID NO: 2176210 - DNA, 19 bp, Homo sapiens
tcctgtgtattaaaccttt

SEQ ID NO: 2176211 - DNA, 15 bp, Homo sapiens
tccttagcaacagcc

SEQ ID NO: 2176212 - DNA, 19 bp, Homo sapiens
tccttatcctacagtacaa

SEQ ID NO: 2176213 - DNA, 14 bp, Homo sapiens
tccttccaactgct

SEQ ID NO: 2176214 - DNA, 20 bp, Homo sapiens
tccttccaactgctgcccca

SEQ ID NO: 2176215 - DNA, 19 bp, Homo sapiens
tccttccaagtcttcctga

SEQ ID NO: 2176216 - DNA, 20 bp, Homo sapiens
tccttcccacggccactgca

SEQ ID NO: 2176217 - DNA, 13 bp, Homo sapiens
tccttccctaggc

SEQ ID NO: 2176218 - DNA, 22 bp, Homo sapiens
tccttccctaggcacctctgtg

SEQ ID NO: 2176219 - DNA, 14 bp, Homo sapiens
tccttcctcagaat

SEQ ID NO: 2176220 - DNA, 12 bp, Homo sapiens
tccttctctgtc

SEQ ID NO: 2176221 - DNA, 16 bp, Homo sapiens
tccttgccgctgggag

SEQ ID NO: 2176222 - DNA, 20 bp, Homo sapiens
tccttgccgctgggagagcc

SEQ ID NO: 2176223 - DNA, 13 bp, Homo sapiens
tccttgtccccac

SEQ ID NO: 2176224 - DNA, 16 bp, Homo sapiens
tccttgtccccacact

SEQ ID NO: 2176225 - DNA, 17 bp, Homo sapiens
tccttttatttataaca

SEQ ID NO: 2176226 - DNA, 14 bp, Homo sapiens
tcgaatcactcatt

SEQ ID NO: 2176227 - DNA, 23 bp, Homo sapiens
tcgaatcactcatttatttccat

SEQ ID NO: 2176228 - DNA, 21 bp, Homo sapiens
tcgactctttgcaacagcact

SEQ ID NO: 2176229 - DNA, 21 bp, Homo sapiens
tcgagaaagaggcaccaggaa

SEQ ID NO: 2176230 - DNA, 20 bp, Homo sapiens
tcgaggctgtgtgtccgtca

SEQ ID NO: 2176231 - DNA, 14 bp, Homo sapiens
tcgcacaaggacat

SEQ ID NO: 2176232 - DNA, 21 bp, Homo sapiens
tcgcaggggcgctggctgcac

SEQ ID NO: 2176233 - DNA, 20 bp, Homo sapiens
tcgcagtgcccagtgatggc

SEQ ID NO: 2176234 - DNA, 13 bp, Homo sapiens
tcggagctcctgt

SEQ ID NO: 2176235 - DNA, 12 bp, Homo sapiens
tcggaggtggca

SEQ ID NO: 2176236 - DNA, 14 bp, Homo sapiens
tcggggccagaggc

SEQ ID NO: 2176237 - DNA, 18 bp, Homo sapiens
tcggtcctgtctcccctc

SEQ ID NO: 2176238 - DNA, 15 bp, Homo sapiens
tcggtgcagcggtgg

SEQ ID NO: 2176239 - DNA, 17 bp, Homo sapiens
tcgtggacacacacaga

SEQ ID NO: 2176240 - DNA, 22 bp, Homo sapiens
tcgtggacacacacagactatt

SEQ ID NO: 2176241 - DNA, 15 bp, Homo sapiens
tcgtgggctctggct

SEQ ID NO: 2176242 - DNA, 14 bp, Homo sapiens
tcgtgtatttatta

SEQ ID NO: 2176243 - DNA, 16 bp, Homo sapiens
tcgttctaaaatcaag

SEQ ID NO: 2176244 - DNA, 12 bp, Homo sapiens
tcgttgcatggt

SEQ ID NO: 2176245 - DNA, 15 bp, Homo sapiens
tcgtttgatttcaaa

SEQ ID NO: 2176246 - DNA, 18 bp, Homo sapiens
tctaaaaagatgtaataa

SEQ ID NO: 2176247 - DNA, 23 bp, Homo sapiens
tctaaaaataaaatgcatttaaa

SEQ ID NO: 2176248 - DNA, 19 bp, Homo sapiens
tctaaaatacttgagaaat

SEQ ID NO: 2176249 - DNA, 19 bp, Homo sapiens
tctaaaataggttttccct

SEQ ID NO: 2176250 - DNA, 22 bp, Homo sapiens
tctaaaataggttttccctgtt

SEQ ID NO: 2176251 - DNA, 23 bp, Homo sapiens
tctaaaataggttttccctgttc

SEQ ID NO: 2176252 - DNA, 18 bp, Homo sapiens
tctaacaggggctggtgg

SEQ ID NO: 2176253 - DNA, 15 bp, Homo sapiens
tctaatgctcacgct

SEQ ID NO: 2176254 - DNA, 20 bp, Homo sapiens
tctacatgtgccaccaacat

SEQ ID NO: 2176255 - DNA, 12 bp, Homo sapiens
tctaccatctcc

SEQ ID NO: 2176256 - DNA, 15 bp, Homo sapiens
tctaccatctccctc

SEQ ID NO: 2176257 - DNA, 12 bp, Homo sapiens
tctacccagccc

SEQ ID NO: 2176258 - DNA, 17 bp, Homo sapiens
tctacccagcccatctt

SEQ ID NO: 2176259 - DNA, 21 bp, Homo sapiens
tctacccagcccatcttgcct

SEQ ID NO: 2176260 - DNA, 14 bp, Homo sapiens
tctacttttaaata

SEQ ID NO: 2176261 - DNA, 14 bp, Homo sapiens
tctagaatactaat

SEQ ID NO: 2176262 - DNA, 23 bp, Homo sapiens
aagtgctgtcttgatgactgctg

SEQ ID NO: 2176263 - DNA, 19 bp, Homo sapiens
aagtggccaagaagcagtg

SEQ ID NO: 2176264 - DNA, 18 bp, Homo sapiens
aagtgggagtgggagagg

SEQ ID NO: 2176265 - DNA, 23 bp, Homo sapiens
aagtggtggggactaagggaaga

SEQ ID NO: 2176266 - DNA, 23 bp, Homo sapiens
aagtgtctaaaatacttgagaaa

SEQ ID NO: 2176267 - DNA, 22 bp, Homo sapiens
aagttgataggagacttgtaca

SEQ ID NO: 2176268 - DNA, 18 bp, Homo sapiens
aagtttagaaattacaag

SEQ ID NO: 2176269 - DNA, 20 bp, Homo sapiens
aagtttagaaattacaagtt

SEQ ID NO: 2176270 - DNA, 19 bp, Homo sapiens
aagtttcagtaatagctga

SEQ ID NO: 2176271 - DNA, 20 bp, Homo sapiens
aagtttcagtaatagctgaa

SEQ ID NO: 2176272 - DNA, 13 bp, Homo sapiens
aagtttttctctt

SEQ ID NO: 2176273 - DNA, 14 bp, Homo sapiens
aataaaaaaaaacc

SEQ ID NO: 2176274 - DNA, 23 bp, Homo sapiens
aataaaacgttatctcattgcaa

SEQ ID NO: 2176275 - DNA, 14 bp, Homo sapiens
aataaaacttatct

SEQ ID NO: 2176276 - DNA, 19 bp, Homo sapiens
aataaaatgcactgaccat

SEQ ID NO: 2176277 - DNA, 13 bp, Homo sapiens
aataaaatgcatt

SEQ ID NO: 2176278 - DNA, 15 bp, Homo sapiens
aataaaatgcattta

SEQ ID NO: 2176279 - DNA, 17 bp, Homo sapiens
aataaaatgcatttaaa

SEQ ID NO: 2176280 - DNA, 15 bp, Homo sapiens
aataaaattaatgaa

SEQ ID NO: 2176281 - DNA, 15 bp, Homo sapiens
aataaagtactgcaa

SEQ ID NO: 2176282 - DNA, 16 bp, Homo sapiens
aataaagttaaattgc

SEQ ID NO: 2176283 - DNA, 13 bp, Homo sapiens
aataaataatatt

SEQ ID NO: 2176284 - DNA, 22 bp, Homo sapiens
aataattgtggagaggagagaa

SEQ ID NO: 2176285 - DNA, 20 bp, Homo sapiens
aataattttttagttaaaat

SEQ ID NO: 2176286 - DNA, 14 bp, Homo sapiens
aatacaattcaaac

SEQ ID NO: 2176287 - DNA, 21 bp, Homo sapiens
aatacattattggacttccat

SEQ ID NO: 2176288 - DNA, 22 bp, Homo sapiens
aatacattattggacttccatt

SEQ ID NO: 2176289 - DNA, 17 bp, Homo sapiens
aataccagatcactcaa

SEQ ID NO: 2176290 - DNA, 14 bp, Homo sapiens
aatactaaatatga

SEQ ID NO: 2176291 - DNA, 18 bp, Homo sapiens
aatactaaatatgaaatt

SEQ ID NO: 2176292 - DNA, 14 bp, Homo sapiens
aatactaataaaat

SEQ ID NO: 2176293 - DNA, 13 bp, Homo sapiens
aatactgtacata

SEQ ID NO: 2176294 - DNA, 19 bp, Homo sapiens
aatactgtacatagatgta

SEQ ID NO: 2176295 - DNA, 17 bp, Homo sapiens
aatacttaaaaatatgt

SEQ ID NO: 2176296 - DNA, 18 bp, Homo sapiens
aatacttaaaaatatgtg

SEQ ID NO: 2176297 - DNA, 16 bp, Homo sapiens
aatacttgagaaattt

SEQ ID NO: 2176298 - DNA, 17 bp, Homo sapiens
aatagagaagtaaaaaa

SEQ ID NO: 2176299 - DNA, 14 bp, Homo sapiens
aatagagaagtgtg

SEQ ID NO: 2176300 - DNA, 13 bp, Homo sapiens
aatagctgaacct

SEQ ID NO: 2176301 - DNA, 18 bp, Homo sapiens
aatagttcaggatttggt

SEQ ID NO: 2176302 - DNA, 20 bp, Homo sapiens
aatataggggttaaggaaaa

SEQ ID NO: 2176303 - DNA, 14 bp, Homo sapiens
aatatatataatac

SEQ ID NO: 2176304 - DNA, 20 bp, Homo sapiens
aatatatataatacttaaaa

SEQ ID NO: 2176305 - DNA, 23 bp, Homo sapiens
aatatattttctttctagtttgt

SEQ ID NO: 2176306 - DNA, 14 bp, Homo sapiens
aatatcaatatggt

SEQ ID NO: 2176307 - DNA, 14 bp, Homo sapiens
aatatcactttgta

SEQ ID NO: 2176308 - DNA, 18 bp, Homo sapiens
aatatctacctgccctct

SEQ ID NO: 2176309 - DNA, 22 bp, Homo sapiens
aatatctacctgccctctctca

SEQ ID NO: 2176310 - DNA, 17 bp, Homo sapiens
aatatgtatttgttgaa

SEQ ID NO: 2176311 - DNA, 18 bp, Homo sapiens
aatatgtgattatcattt

SEQ ID NO: 2176312 - DNA, 12 bp, Homo sapiens
aatattgcagtt

SEQ ID NO: 2176313 - DNA, 22 bp, Homo sapiens
aatattgcagttcatactgaat

SEQ ID NO: 2176314 - DNA, 18 bp, Homo sapiens
aatatttataattaaaga

SEQ ID NO: 2176315 - DNA, 22 bp, Homo sapiens
aatatttataattaaagaaaat

SEQ ID NO: 2176316 - DNA, 12 bp, Homo sapiens
aatatttcttaa

SEQ ID NO: 2176317 - DNA, 18 bp, Homo sapiens
aatcaaagctaccttttt

SEQ ID NO: 2176318 - DNA, 12 bp, Homo sapiens
aatcaatacttt

SEQ ID NO: 2176319 - DNA, 15 bp, Homo sapiens
aatcaatactttgaa

SEQ ID NO: 2176320 - DNA, 21 bp, Homo sapiens
aatcacaaaagtatattcaaa

SEQ ID NO: 2176321 - DNA, 15 bp, Homo sapiens
aatcactcatttatt

SEQ ID NO: 2176322 - DNA, 12 bp, Homo sapiens
aatcactgccta

SEQ ID NO: 2176323 - DNA, 14 bp, Homo sapiens
aatcaggcattttt

SEQ ID NO: 2176324 - DNA, 18 bp, Homo sapiens
aatcaggcatttttccaa

SEQ ID NO: 2176325 - DNA, 21 bp, Homo sapiens
aatcagtgtagccccaagaag

SEQ ID NO: 2176326 - DNA, 12 bp, Homo sapiens
aatcagttttgt

SEQ ID NO: 2176327 - DNA, 13 bp, Homo sapiens
aatcattttagaa

SEQ ID NO: 2176328 - DNA, 19 bp, Homo sapiens
aatccatgtgctgctgtgg

SEQ ID NO: 2176329 - DNA, 14 bp, Homo sapiens
aatcccagttcatg

SEQ ID NO: 2176330 - DNA, 22 bp, Homo sapiens
aatcccagttcatgttgctcag

SEQ ID NO: 2176331 - DNA, 16 bp, Homo sapiens
aatcctagctgtgtgc

SEQ ID NO: 2176332 - DNA, 18 bp, Homo sapiens
aatcctccctacttccaa

SEQ ID NO: 2176333 - DNA, 15 bp, Homo sapiens
aatcctcctgagtga

SEQ ID NO: 2176334 - DNA, 12 bp, Homo sapiens
aatcctgtcaat

SEQ ID NO: 2176335 - DNA, 19 bp, Homo sapiens
aatcgtttttgttttaagg

SEQ ID NO: 2176336 - DNA, 18 bp, Homo sapiens
aatctacgatgttaaaac

SEQ ID NO: 2176337 - DNA, 22 bp, Homo sapiens
aatctcatcccaacaaacttta

SEQ ID NO: 2176338 - DNA, 17 bp, Homo sapiens
aatctcctctttgtgaa

SEQ ID NO: 2176339 - DNA, 15 bp, Homo sapiens
aatctctatctcttt

SEQ ID NO: 2176340 - DNA, 21 bp, Homo sapiens
aatctgaaaaactaaactaca

SEQ ID NO: 2176341 - DNA, 21 bp, Homo sapiens
aatctgattttcaaaaatcat

SEQ ID NO: 2176342 - DNA, 13 bp, Homo sapiens
aatgaatattgta

SEQ ID NO: 2176343 - DNA, 16 bp, Homo sapiens
aatgacttttaaaatt

SEQ ID NO: 2176344 - DNA, 18 bp, Homo sapiens
aatgacttttaaaatttg

SEQ ID NO: 2176345 - DNA, 16 bp, Homo sapiens
aatgagagagtgtgga

SEQ ID NO: 2176346 - DNA, 20 bp, Homo sapiens
aatgagtttccagctaagcc

SEQ ID NO: 2176347 - DNA, 15 bp, Homo sapiens
aatgatactgtctaa

SEQ ID NO: 2176348 - DNA, 18 bp, Homo sapiens
aatgatactgtctaagaa

SEQ ID NO: 2176349 - DNA, 21 bp, Homo sapiens
aatgatattgctctatatgta

SEQ ID NO: 2176350 - DNA, 18 bp, Homo sapiens
aatgatgtagacatttta

SEQ ID NO: 2176351 - DNA, 17 bp, Homo sapiens
aatgcaaaaactctttg

SEQ ID NO: 2176352 - DNA, 17 bp, Homo sapiens
aatgcaaagttacatga

SEQ ID NO: 2176353 - DNA, 15 bp, Homo sapiens
aatgcatgctttgga

SEQ ID NO: 2176354 - DNA, 18 bp, Homo sapiens
aatgccaaaaatgtgcct

SEQ ID NO: 2176355 - DNA, 19 bp, Homo sapiens
aatgccaagggtaaacaag

SEQ ID NO: 2176356 - DNA, 20 bp, Homo sapiens
aatgccaagtaacaatgcat

SEQ ID NO: 2176357 - DNA, 16 bp, Homo sapiens
aatgcctcgctccctt

SEQ ID NO: 2176358 - DNA, 19 bp, Homo sapiens
aatgcctcgctcccttcaa

SEQ ID NO: 2176359 - DNA, 15 bp, Homo sapiens
aatgctgaaaacaca

SEQ ID NO: 2176360 - DNA, 22 bp, Homo sapiens
aatgctgcacaccagttactgt

SEQ ID NO: 2176361 - DNA, 12 bp, Homo sapiens
aatgctgtacct

SEQ ID NO: 2176362 - DNA, 19 bp, Homo sapiens
aatgctttgattgttcata

SEQ ID NO: 2176363 - DNA, 14 bp, Homo sapiens
aatggattatacaa

SEQ ID NO: 2176364 - DNA, 17 bp, Homo sapiens
aatggattatacaaaaa

SEQ ID NO: 2176365 - DNA, 21 bp, Homo sapiens
aatggctcactatggtgccaa

SEQ ID NO: 2176366 - DNA, 21 bp, Homo sapiens
aatgggactgatgtcatcttg

SEQ ID NO: 2176367 - DNA, 19 bp, Homo sapiens
aatggtgagaattaaaata

SEQ ID NO: 2176368 - DNA, 13 bp, Homo sapiens
aatgtaatttcag

SEQ ID NO: 2176369 - DNA, 15 bp, Homo sapiens
aatgtaatttcagtt

SEQ ID NO: 2176370 - DNA, 18 bp, Homo sapiens
aatgtaatttcagttcta

SEQ ID NO: 2176371 - DNA, 16 bp, Homo sapiens
aatgtaggtttagata

SEQ ID NO: 2176372 - DNA, 23 bp, Homo sapiens
aatgtaggtttagatatataact

SEQ ID NO: 2176373 - DNA, 15 bp, Homo sapiens
aatgtcccccacctc

SEQ ID NO: 2176374 - DNA, 12 bp, Homo sapiens
aatgttaataaa

SEQ ID NO: 2176375 - DNA, 13 bp, Homo sapiens
aatgtttgtcatt

SEQ ID NO: 2176376 - DNA, 17 bp, Homo sapiens
aattaaagaaaattgcc

SEQ ID NO: 2176377 - DNA, 19 bp, Homo sapiens
aattaaagaaaattgccaa

SEQ ID NO: 2176378 - DNA, 22 bp, Homo sapiens
aattaaagaaaattgccaaaat

SEQ ID NO: 2176379 - DNA, 17 bp, Homo sapiens
aattaaatatttcttaa

SEQ ID NO: 2176380 - DNA, 13 bp, Homo sapiens
aattaattcttta

SEQ ID NO: 2176381 - DNA, 16 bp, Homo sapiens
aattaatttgttaatt

SEQ ID NO: 2176382 - DNA, 23 bp, Homo sapiens
aattacacacgtgtgatgtatgt

SEQ ID NO: 2176383 - DNA, 15 bp, Homo sapiens
aattacacccatgca

SEQ ID NO: 2176384 - DNA, 15 bp, Homo sapiens
aattagtaatgtact

SEQ ID NO: 2176385 - DNA, 19 bp, Homo sapiens
aattatctatccttgatga

SEQ ID NO: 2176386 - DNA, 17 bp, Homo sapiens
aattattcatagctgta

SEQ ID NO: 2176387 - DNA, 21 bp, Homo sapiens
aattcaaacaattcaatcaaa

SEQ ID NO: 2176388 - DNA, 18 bp, Homo sapiens
aattcaaagcatgtcaag

SEQ ID NO: 2176389 - DNA, 17 bp, Homo sapiens
aattcaatcaaagctac

SEQ ID NO: 2176390 - DNA, 21 bp, Homo sapiens
aattcattccatttgctgatt

SEQ ID NO: 2176391 - DNA, 20 bp, Homo sapiens
aattcatttcatctactaca

SEQ ID NO: 2176392 - DNA, 14 bp, Homo sapiens
aattccaatattta

SEQ ID NO: 2176393 - DNA, 16 bp, Homo sapiens
aattccaatatttata

SEQ ID NO: 2176394 - DNA, 21 bp, Homo sapiens
aattccacccctccttccctg

SEQ ID NO: 2176395 - DNA, 17 bp, Homo sapiens
aattctttatcacatgt

SEQ ID NO: 2176396 - DNA, 21 bp, Homo sapiens
aattgatgggtgggctagtaa

SEQ ID NO: 2176397 - DNA, 15 bp, Homo sapiens
aattgccctgttgcc

SEQ ID NO: 2176398 - DNA, 18 bp, Homo sapiens
aattgtaaggtattgcaa

SEQ ID NO: 2176399 - DNA, 16 bp, Homo sapiens
aattgtggagaggaga

SEQ ID NO: 2176400 - DNA, 18 bp, Homo sapiens
aattgtggagaggagaga

SEQ ID NO: 2176401 - DNA, 23 bp, Homo sapiens
aattgttacccatttgaaagaat

SEQ ID NO: 2176402 - DNA, 15 bp, Homo sapiens
aattgttatacattt

SEQ ID NO: 2176403 - DNA, 13 bp, Homo sapiens
aattgttctcaga

SEQ ID NO: 2176404 - DNA, 14 bp, Homo sapiens
aatttaaagctgtt

SEQ ID NO: 2176405 - DNA, 18 bp, Homo sapiens
aatttaaagctgtttcta

SEQ ID NO: 2176406 - DNA, 15 bp, Homo sapiens
aatttagtggattaa

SEQ ID NO: 2176407 - DNA, 23 bp, Homo sapiens
aatttatatttgtctcattttgt

SEQ ID NO: 2176408 - DNA, 22 bp, Homo sapiens
aatttattctacttttaaataa

SEQ ID NO: 2176409 - DNA, 22 bp, Homo sapiens
aatttattgtaccaaagctgtt

SEQ ID NO: 2176410 - DNA, 14 bp, Homo sapiens
aatttcaaatctgt

SEQ ID NO: 2176411 - DNA, 18 bp, Homo sapiens
aatttcatctttccaaat

SEQ ID NO: 2176412 - DNA, 13 bp, Homo sapiens
aatttctccccag

SEQ ID NO: 2176413 - DNA, 20 bp, Homo sapiens
aatttctctcaatttgggtc

SEQ ID NO: 2176414 - DNA, 23 bp, Homo sapiens
aatttcttctgtagctattcttt

SEQ ID NO: 2176415 - DNA, 14 bp, Homo sapiens
aatttgattctatg

SEQ ID NO: 2176416 - DNA, 17 bp, Homo sapiens
aatttgcataaagggcc

SEQ ID NO: 2176417 - DNA, 21 bp, Homo sapiens
aatttgtgttcccattttaaa

SEQ ID NO: 2176418 - DNA, 14 bp, Homo sapiens
aatttgttaatata

SEQ ID NO: 2176419 - DNA, 18 bp, Homo sapiens
aatttgttaattaaatat

SEQ ID NO: 2176420 - DNA, 13 bp, Homo sapiens
aattttattgctg

SEQ ID NO: 2176421 - DNA, 23 bp, Homo sapiens
aattttctaccactggtgtaaaa

SEQ ID NO: 2176422 - DNA, 16 bp, Homo sapiens
aattttctagaatact

SEQ ID NO: 2176423 - DNA, 19 bp, Homo sapiens
aattttctagaatactaat

SEQ ID NO: 2176424 - DNA, 20 bp, Homo sapiens
aattttgttaagaatttcaa

SEQ ID NO: 2176425 - DNA, 16 bp, Homo sapiens
aatttttacatgacca

SEQ ID NO: 2176426 - DNA, 22 bp, Homo sapiens
aattttttaagcaactggaaaa

SEQ ID NO: 2176427 - DNA, 16 bp, Homo sapiens
aattttttacaagagt

SEQ ID NO: 2176428 - DNA, 18 bp, Homo sapiens
aattttttagttaaaatc

SEQ ID NO: 2176429 - DNA, 13 bp, Homo sapiens
acaaaaccaagcc

SEQ ID NO: 2176430 - DNA, 17 bp, Homo sapiens
acaaaactggaactgtt

SEQ ID NO: 2176431 - DNA, 22 bp, Homo sapiens
acaaaactggaactgttgttga

SEQ ID NO: 2176432 - DNA, 15 bp, Homo sapiens
acaaaatacaaaaaa

SEQ ID NO: 2176433 - DNA, 11 bp, Homo sapiens
acaaaatgtta

SEQ ID NO: 2176434 - DNA, 13 bp, Homo sapiens
acaaaccactgta

SEQ ID NO: 2176435 - DNA, 13 bp, Homo sapiens
acaaactcatcca

SEQ ID NO: 2176436 - DNA, 19 bp, Homo sapiens
acaaagaccaatgtgaaga

SEQ ID NO: 2176437 - DNA, 12 bp, Homo sapiens
acaaagtgcaaa

SEQ ID NO: 2176438 - DNA, 14 bp, Homo sapiens
acaaagtgcaaagc

SEQ ID NO: 2176439 - DNA, 15 bp, Homo sapiens
acaaagtgcaaagct

SEQ ID NO: 2176440 - DNA, 21 bp, Homo sapiens
acaaagtgcaaagctgcttga

SEQ ID NO: 2176441 - DNA, 15 bp, Homo sapiens
acaaatcttcaaggt

SEQ ID NO: 2176442 - DNA, 21 bp, Homo sapiens
acaaatcttcaaggtgtaaaa

SEQ ID NO: 2176443 - DNA, 13 bp, Homo sapiens
acaaatgttttaa

SEQ ID NO: 2176444 - DNA, 14 bp, Homo sapiens
acaaattaaaaaca

SEQ ID NO: 2176445 - DNA, 18 bp, Homo sapiens
acaaattaaaaacaccta

SEQ ID NO: 2176446 - DNA, 12 bp, Homo sapiens
acaacatcagaa

SEQ ID NO: 2176447 - DNA, 23 bp, Homo sapiens
acaactgtcagaataaagaacat

SEQ ID NO: 2176448 - DNA, 20 bp, Homo sapiens
acaagactttccccatactc

SEQ ID NO: 2176449 - DNA, 17 bp, Homo sapiens
acaagagggcaaagctg

SEQ ID NO: 2176450 - DNA, 16 bp, Homo sapiens
acaagagtctgtattc

SEQ ID NO: 2176451 - DNA, 20 bp, Homo sapiens
acaagcaaaaccaaagaata

SEQ ID NO: 2176452 - DNA, 17 bp, Homo sapiens
acaagcagcccttgctt

SEQ ID NO: 2176453 - DNA, 14 bp, Homo sapiens
acaagcctcttctg

SEQ ID NO: 2176454 - DNA, 13 bp, Homo sapiens
acaagctgtccct

SEQ ID NO: 2176455 - DNA, 17 bp, Homo sapiens
acaaggcaggcctttcc

SEQ ID NO: 2176456 - DNA, 13 bp, Homo sapiens
acaaggtagacat

SEQ ID NO: 2176457 - DNA, 14 bp, Homo sapiens
acaagtgctcagtt

SEQ ID NO: 2176458 - DNA, 18 bp, Homo sapiens
acaagtgctcagttccaa

SEQ ID NO: 2176459 - DNA, 17 bp, Homo sapiens
acaagtgggcagcataa

SEQ ID NO: 2176460 - DNA, 13 bp, Homo sapiens
acaagtttcagta

SEQ ID NO: 2176461 - DNA, 21 bp, Homo sapiens
acaataccgtaacaatgtttg

SEQ ID NO: 2176462 - DNA, 15 bp, Homo sapiens
acaatatcaatatgg

SEQ ID NO: 2176463 - DNA, 19 bp, Homo sapiens
acaatcgttctgtgtttga

SEQ ID NO: 2176464 - DNA, 23 bp, Homo sapiens
acaatctcatcccaacaaacttt

SEQ ID NO: 2176465 - DNA, 19 bp, Homo sapiens
acaatgcagatgccagagc

SEQ ID NO: 2176466 - DNA, 20 bp, Homo sapiens
acaatgcagatgccagagca

SEQ ID NO: 2176467 - DNA, 16 bp, Homo sapiens
acaatgttaaatgcaa

SEQ ID NO: 2176468 - DNA, 18 bp, Homo sapiens
acacaaaaagaaagctgt

SEQ ID NO: 2176469 - DNA, 20 bp, Homo sapiens
acacaaaaagaaagctgtga

SEQ ID NO: 2176470 - DNA, 21 bp, Homo sapiens
acacaaaaagaaagctgtgaa

SEQ ID NO: 2176471 - DNA, 17 bp, Homo sapiens
acacaaagcctgtgtta

SEQ ID NO: 2176472 - DNA, 14 bp, Homo sapiens
acacaaatgtgtac

SEQ ID NO: 2176473 - DNA, 13 bp, Homo sapiens
acacaaggtgtaa

SEQ ID NO: 2176474 - DNA, 22 bp, Homo sapiens
acacaatctttccttgtctctc

SEQ ID NO: 2176475 - DNA, 11 bp, Homo sapiens
acacacacagc

SEQ ID NO: 2176476 - DNA, 22 bp, Homo sapiens
acacagcacctcctctctgctg

SEQ ID NO: 2176477 - DNA, 13 bp, Homo sapiens
acacattaaagta

SEQ ID NO: 2176478 - DNA, 19 bp, Homo sapiens
acacattaaagtaaagtac

SEQ ID NO: 2176479 - DNA, 19 bp, Homo sapiens
acacatttctattttgcaa

SEQ ID NO: 2176480 - DNA, 15 bp, Homo sapiens
acaccagctgttctg

SEQ ID NO: 2176481 - DNA, 13 bp, Homo sapiens
acaccaggactta

SEQ ID NO: 2176482 - DNA, 19 bp, Homo sapiens
acaccagttactgttcatg

SEQ ID NO: 2176483 - DNA, 16 bp, Homo sapiens
acacctaagtgactac

SEQ ID NO: 2176484 - DNA, 23 bp, Homo sapiens
acacggcacagagcatccgtctc

SEQ ID NO: 2176485 - DNA, 19 bp, Homo sapiens
acacggttttggcagctga

SEQ ID NO: 2176486 - DNA, 21 bp, Homo sapiens
acactacgaagagtatttgga

SEQ ID NO: 2176487 - DNA, 21 bp, Homo sapiens
acactatcaacactgcagcat

SEQ ID NO: 2176488 - DNA, 22 bp, Homo sapiens
acactatcaacactgcagcatt

SEQ ID NO: 2176489 - DNA, 23 bp, Homo sapiens
acactgcagcattttgctgcttt

SEQ ID NO: 2176490 - DNA, 19 bp, Homo sapiens
acactgccagaagtgtgtt

SEQ ID NO: 2176491 - DNA, 19 bp, Homo sapiens
acactttggtattcaattt

SEQ ID NO: 2176492 - DNA, 23 bp, Homo sapiens
acagaaatgccaaaaatgtgcct

SEQ ID NO: 2176493 - DNA, 15 bp, Homo sapiens
acagaaattgtatat

SEQ ID NO: 2176494 - DNA, 13 bp, Homo sapiens
acagaacaagcca

SEQ ID NO: 2176495 - DNA, 20 bp, Homo sapiens
acagaactgctaaatactgt

SEQ ID NO: 2176496 - DNA, 15 bp, Homo sapiens
acagacccctgggag

SEQ ID NO: 2176497 - DNA, 14 bp, Homo sapiens
acagactattttta

SEQ ID NO: 2176498 - DNA, 17 bp, Homo sapiens
acagacttcacacagca

SEQ ID NO: 2176499 - DNA, 23 bp, Homo sapiens
acagagaactagtggtggctctg

SEQ ID NO: 2176500 - DNA, 12 bp, Homo sapiens
acagagcatccg

SEQ ID NO: 2176501 - DNA, 15 bp, Homo sapiens
acagaggcagtggca

SEQ ID NO: 2176502 - DNA, 18 bp, Homo sapiens
acagagtggagccctcag

SEQ ID NO: 2176503 - DNA, 15 bp, Homo sapiens
acagagtgggccccg

SEQ ID NO: 2176504 - DNA, 17 bp, Homo sapiens
acagatctccaaagctt

SEQ ID NO: 2176505 - DNA, 14 bp, Homo sapiens
acagatggctgtga

SEQ ID NO: 2176506 - DNA, 20 bp, Homo sapiens
acccggcccccgccctctgc

SEQ ID NO: 2176507 - DNA, 17 bp, Homo sapiens
acccggctcgtgtattt

SEQ ID NO: 2176508 - DNA, 13 bp, Homo sapiens
acccgttaattta

SEQ ID NO: 2176509 - DNA, 16 bp, Homo sapiens
acccgtttccaagcct

SEQ ID NO: 2176510 - DNA, 14 bp, Homo sapiens
accctactggctgt

SEQ ID NO: 2176511 - DNA, 16 bp, Homo sapiens
accctcagctggcgga

SEQ ID NO: 2176512 - DNA, 19 bp, Homo sapiens
accctctcaggtgaccaaa

SEQ ID NO: 2176513 - DNA, 17 bp, Homo sapiens
accctctgcagggcagc

SEQ ID NO: 2176514 - DNA, 20 bp, Homo sapiens
accctgcttggggcctggcg

SEQ ID NO: 2176515 - DNA, 23 bp, Homo sapiens
accctgcttggggcctggcgtgg

SEQ ID NO: 2176516 - DNA, 18 bp, Homo sapiens
accctgtatggagctaga

SEQ ID NO: 2176517 - DNA, 21 bp, Homo sapiens
accctgtatggagctagagag

SEQ ID NO: 2176518 - DNA, 14 bp, Homo sapiens
accctgtcaagctt

SEQ ID NO: 2176519 - DNA, 16 bp, Homo sapiens
accctgtcctcccacc

SEQ ID NO: 2176520 - DNA, 21 bp, Homo sapiens
accctgtcctcccacccctcc

SEQ ID NO: 2176521 - DNA, 18 bp, Homo sapiens
accctgtggcaaatgcca

SEQ ID NO: 2176522 - DNA, 13 bp, Homo sapiens
acccttctgtgcc

SEQ ID NO: 2176523 - DNA, 18 bp, Homo sapiens
acccttctgtgcccagct

SEQ ID NO: 2176524 - DNA, 21 bp, Homo sapiens
acccttctgtgcccagctcag

SEQ ID NO: 2176525 - DNA, 16 bp, Homo sapiens
accgctacaagagggc

SEQ ID NO: 2176526 - DNA, 16 bp, Homo sapiens
accggaagctcctggt

SEQ ID NO: 2176527 - DNA, 17 bp, Homo sapiens
accgtcgacaagaatgt

SEQ ID NO: 2176528 - DNA, 18 bp, Homo sapiens
accgtcgacaagaatgtc

SEQ ID NO: 2176529 - DNA, 16 bp, Homo sapiens
acctaaaaatcaatca

SEQ ID NO: 2176530 - DNA, 18 bp, Homo sapiens
acctaaaaatcaatcact

SEQ ID NO: 2176531 - DNA, 12 bp, Homo sapiens
acctaagaacaa

SEQ ID NO: 2176532 - DNA, 23 bp, Homo sapiens
acctacaaaaaaacctttattct

SEQ ID NO: 2176533 - DNA, 18 bp, Homo sapiens
acctacctgtaacttttt

SEQ ID NO: 2176534 - DNA, 15 bp, Homo sapiens
acctacctgtgaatc

SEQ ID NO: 2176535 - DNA, 17 bp, Homo sapiens
acctacctgtgaatcat

SEQ ID NO: 2176536 - DNA, 18 bp, Homo sapiens
acctaccttcaaagctga

SEQ ID NO: 2176537 - DNA, 19 bp, Homo sapiens
acctacttgtaaacttgaa

SEQ ID NO: 2176538 - DNA, 16 bp, Homo sapiens
acctagcgtcagtatt

SEQ ID NO: 2176539 - DNA, 17 bp, Homo sapiens
acctaggatatcttctc

SEQ ID NO: 2176540 - DNA, 13 bp, Homo sapiens
acctataaatact

SEQ ID NO: 2176541 - DNA, 15 bp, Homo sapiens
acctcagcaacctgt

SEQ ID NO: 2176542 - DNA, 16 bp, Homo sapiens
acctcaggttccaaat

SEQ ID NO: 2176543 - DNA, 21 bp, Homo sapiens
acctcagtttctgttgtttct

SEQ ID NO: 2176544 - DNA, 17 bp, Homo sapiens
acctccagcttccacaa

SEQ ID NO: 2176545 - DNA, 14 bp, Homo sapiens
acctcccacctttg

SEQ ID NO: 2176546 - DNA, 12 bp, Homo sapiens
acctcctctctg

SEQ ID NO: 2176547 - DNA, 14 bp, Homo sapiens
acctctccttcctc

SEQ ID NO: 2176548 - DNA, 16 bp, Homo sapiens
acctcttttcctagtt

SEQ ID NO: 2176549 - DNA, 19 bp, Homo sapiens
acctgaggcccagcagagc

SEQ ID NO: 2176550 - DNA, 15 bp, Homo sapiens
acctgcacagggccc

SEQ ID NO: 2176551 - DNA, 18 bp, Homo sapiens
acctgccactaggctggg

SEQ ID NO: 2176552 - DNA, 22 bp, Homo sapiens
acctgccactaggctgggtgcc

SEQ ID NO: 2176553 - DNA, 20 bp, Homo sapiens
acctgccccgtagagaatgt

SEQ ID NO: 2176554 - DNA, 21 bp, Homo sapiens
acctgccccgtagagaatgtg

SEQ ID NO: 2176555 - DNA, 22 bp, Homo sapiens
acctgcccctgccgcctgtgcc

SEQ ID NO: 2176556 - DNA, 12 bp, Homo sapiens
acctgccctctc

SEQ ID NO: 2176557 - DNA, 14 bp, Homo sapiens
acctgccctctctc

SEQ ID NO: 2176558 - DNA, 16 bp, Homo sapiens
acctggaccaaagctg

SEQ ID NO: 2176559 - DNA, 15 bp, Homo sapiens
acctggggtggggag

SEQ ID NO: 2176560 - DNA, 13 bp, Homo sapiens
acctggtggctgg

SEQ ID NO: 2176561 - DNA, 15 bp, Homo sapiens
acctggtggctggag

SEQ ID NO: 2176562 - DNA, 23 bp, Homo sapiens
acctgtgcagggccctctggggc

SEQ ID NO: 2176563 - DNA, 16 bp, Homo sapiens
accttaccctactggc

SEQ ID NO: 2176564 - DNA, 19 bp, Homo sapiens
accttaccctactggctgt

SEQ ID NO: 2176565 - DNA, 13 bp, Homo sapiens
accttcaaagctg

SEQ ID NO: 2176566 - DNA, 20 bp, Homo sapiens
accttgagaccaagccggtg

SEQ ID NO: 2176567 - DNA, 23 bp, Homo sapiens
aagaacccatttgccatgctgct

SEQ ID NO: 2176568 - DNA, 14 bp, Homo sapiens
aagaactatattta

SEQ ID NO: 2176569 - DNA, 19 bp, Homo sapiens
aagaagtgggagtgggaga

SEQ ID NO: 2176570 - DNA, 20 bp, Homo sapiens
aagaagtgggagtgggagag

SEQ ID NO: 2176571 - DNA, 16 bp, Homo sapiens
aagaatataatgggaa

SEQ ID NO: 2176572 - DNA, 19 bp, Homo sapiens
aagaccggaagctcctggt

SEQ ID NO: 2176573 - DNA, 13 bp, Homo sapiens
aagacgaggggca

SEQ ID NO: 2176574 - DNA, 23 bp, Homo sapiens
aagactaagggggtgaccatgca

SEQ ID NO: 2176575 - DNA, 21 bp, Homo sapiens
aagactttccccatactctgt

SEQ ID NO: 2176576 - DNA, 21 bp, Homo sapiens
aagagaagttgtaaagtatgt

SEQ ID NO: 2176577 - DNA, 15 bp, Homo sapiens
aagagagaagccagc

SEQ ID NO: 2176578 - DNA, 13 bp, Homo sapiens
aagagcagcctgg

SEQ ID NO: 2176579 - DNA, 15 bp, Homo sapiens
aagagccatgtccaa

SEQ ID NO: 2176580 - DNA, 13 bp, Homo sapiens
aagagctgcctgg

SEQ ID NO: 2176581 - DNA, 15 bp, Homo sapiens
aagagctgcctggat

SEQ ID NO: 2176582 - DNA, 18 bp, Homo sapiens
aagagctgcctggatgag

SEQ ID NO: 2176583 - DNA, 13 bp, Homo sapiens
aagaggaagcctt

SEQ ID NO: 2176584 - DNA, 18 bp, Homo sapiens
aagagggagaaggagagg

SEQ ID NO: 2176585 - DNA, 22 bp, Homo sapiens
aagagtcattttcacttttaaa

SEQ ID NO: 2176586 - DNA, 13 bp, Homo sapiens
aagagtccaggaa

SEQ ID NO: 2176587 - DNA, 23 bp, Homo sapiens
aagagtcctgaggcagaacctgg

SEQ ID NO: 2176588 - DNA, 22 bp, Homo sapiens
aagagtctgtattcctgatatg

SEQ ID NO: 2176589 - DNA, 15 bp, Homo sapiens
aagatcactttgctc

SEQ ID NO: 2176590 - DNA, 23 bp, Homo sapiens
aagatcctaccccaattccttgt

SEQ ID NO: 2176591 - DNA, 21 bp, Homo sapiens
aagatgtattaacctacctgt

SEQ ID NO: 2176592 - DNA, 22 bp, Homo sapiens
aagatgtattaacctacctgtg

SEQ ID NO: 2176593 - DNA, 12 bp, Homo sapiens
aagattctgcat

SEQ ID NO: 2176594 - DNA, 12 bp, Homo sapiens
aagattgtgtct

SEQ ID NO: 2176595 - DNA, 18 bp, Homo sapiens
aagatttttaaaatgaat

SEQ ID NO: 2176596 - DNA, 13 bp, Homo sapiens
aagcaaaaactac

SEQ ID NO: 2176597 - DNA, 15 bp, Homo sapiens
aagcaagacacgtgg

SEQ ID NO: 2176598 - DNA, 18 bp, Homo sapiens
aagcaagctcttctcctc

SEQ ID NO: 2176599 - DNA, 18 bp, Homo sapiens
aagcaatcctcctgagtg

SEQ ID NO: 2176600 - DNA, 14 bp, Homo sapiens
aagcacctttagaa

SEQ ID NO: 2176601 - DNA, 13 bp, Homo sapiens
aagcacgtattta

SEQ ID NO: 2176602 - DNA, 20 bp, Homo sapiens
aagcagaggctggcctcaga

SEQ ID NO: 2176603 - DNA, 22 bp, Homo sapiens
aagcagcccttgctttcggagc

SEQ ID NO: 2176604 - DNA, 17 bp, Homo sapiens
aagcaggctcaacataa

SEQ ID NO: 2176605 - DNA, 19 bp, Homo sapiens
aagcattttctacacagcg

SEQ ID NO: 2176606 - DNA, 21 bp, Homo sapiens
aagccacgtgctggagagtag

SEQ ID NO: 2176607 - DNA, 13 bp, Homo sapiens
aagccagccacag

SEQ ID NO: 2176608 - DNA, 19 bp, Homo sapiens
aagccagccacagacccct

SEQ ID NO: 2176609 - DNA, 20 bp, Homo sapiens
aagccagccacagacccctg

SEQ ID NO: 2176610 - DNA, 21 bp, Homo sapiens
aagccagccacagacccctgg

SEQ ID NO: 2176611 - DNA, 18 bp, Homo sapiens
aagcccatcctgaccagc

SEQ ID NO: 2176612 - DNA, 13 bp, Homo sapiens
aagcctcttctga

SEQ ID NO: 2176613 - DNA, 21 bp, Homo sapiens
aagcctgatttaggcactgct

SEQ ID NO: 2176614 - DNA, 17 bp, Homo sapiens
actatttttttgttgct

SEQ ID NO: 2176615 - DNA, 19 bp, Homo sapiens
actatttttttgttgctgt

SEQ ID NO: 2176616 - DNA, 15 bp, Homo sapiens
actcaaacacagaga

SEQ ID NO: 2176617 - DNA, 17 bp, Homo sapiens
actcaaaggactgacct

SEQ ID NO: 2176618 - DNA, 22 bp, Homo sapiens
actcaagcagtgtgctggacct

SEQ ID NO: 2176619 - DNA, 17 bp, Homo sapiens
actcaatttctccccag

SEQ ID NO: 2176620 - DNA, 16 bp, Homo sapiens
actcacagagacacag

SEQ ID NO: 2176621 - DNA, 22 bp, Homo sapiens
actcacatgctggacaggtctg

SEQ ID NO: 2176622 - DNA, 18 bp, Homo sapiens
actcatccattaatgtag

SEQ ID NO: 2176623 - DNA, 17 bp, Homo sapiens
actcatcgttctaaaat

SEQ ID NO: 2176624 - DNA, 16 bp, Homo sapiens
actcccaaagagctgc

SEQ ID NO: 2176625 - DNA, 13 bp, Homo sapiens
actcccaagaaca

SEQ ID NO: 2176626 - DNA, 21 bp, Homo sapiens
actccggattccggccctggc

SEQ ID NO: 2176627 - DNA, 23 bp, Homo sapiens
actccggattccggccctggctg

SEQ ID NO: 2176628 - DNA, 15 bp, Homo sapiens
actcctgctggtacc

SEQ ID NO: 2176629 - DNA, 21 bp, Homo sapiens
actcctgctggtacctgccct

SEQ ID NO: 2176630 - DNA, 22 bp, Homo sapiens
actccttcctctttgcttgggt

SEQ ID NO: 2176631 - DNA, 23 bp, Homo sapiens
actctcccagaggctcctggagc

SEQ ID NO: 2176632 - DNA, 22 bp, Homo sapiens
actctctactggtaggaagagg

SEQ ID NO: 2176633 - DNA, 21 bp, Homo sapiens
actctgcactatagccatttg

SEQ ID NO: 2176634 - DNA, 15 bp, Homo sapiens
actctgcccaccctc

SEQ ID NO: 2176635 - DNA, 20 bp, Homo sapiens
actctgtgcctgaccttgag

SEQ ID NO: 2176636 - DNA, 21 bp, Homo sapiens
actcttcagtgactcctgctg

SEQ ID NO: 2176637 - DNA, 22 bp, Homo sapiens
actcttcagtgactcctgctgg

SEQ ID NO: 2176638 - DNA, 13 bp, Homo sapiens
actgaaagcttta

SEQ ID NO: 2176639 - DNA, 14 bp, Homo sapiens
actgaagtgaatac

SEQ ID NO: 2176640 - DNA, 12 bp, Homo sapiens
actgaatttcta

SEQ ID NO: 2176641 - DNA, 13 bp, Homo sapiens
actgaatttctat

SEQ ID NO: 2176642 - DNA, 17 bp, Homo sapiens
actgactggcaccaaca

SEQ ID NO: 2176643 - DNA, 13 bp, Homo sapiens
actgactttttaa

SEQ ID NO: 2176644 - DNA, 14 bp, Homo sapiens
actgagctgccagt

SEQ ID NO: 2176645 - DNA, 16 bp, Homo sapiens
actgaggagcaaagca

SEQ ID NO: 2176646 - DNA, 17 bp, Homo sapiens
actgaggagcaaagcag

SEQ ID NO: 2176647 - DNA, 15 bp, Homo sapiens
actgataaaaatgat

SEQ ID NO: 2176648 - DNA, 16 bp, Homo sapiens
actgataaaaatgata

SEQ ID NO: 2176649 - DNA, 18 bp, Homo sapiens
actgatcatttgcagctg

SEQ ID NO: 2176650 - DNA, 12 bp, Homo sapiens
actgatgtcatc

SEQ ID NO: 2176651 - DNA, 14 bp, Homo sapiens
actgatgtcatctt

SEQ ID NO: 2176652 - DNA, 18 bp, Homo sapiens
actgatgttaggctgggc

SEQ ID NO: 2176653 - DNA, 18 bp, Homo sapiens
actgcaaataaagccttt

SEQ ID NO: 2176654 - DNA, 12 bp, Homo sapiens
actgcaacagga

SEQ ID NO: 2176655 - DNA, 14 bp, Homo sapiens
actgcacataattt

SEQ ID NO: 2176656 - DNA, 18 bp, Homo sapiens
actgcacataatttgcat

SEQ ID NO: 2176657 - DNA, 21 bp, Homo sapiens
actgcacataatttgcataaa

SEQ ID NO: 2176658 - DNA, 12 bp, Homo sapiens
actgcaccttgt

SEQ ID NO: 2176659 - DNA, 22 bp, Homo sapiens
actgcagcctcgaactcctggg

SEQ ID NO: 2176660 - DNA, 22 bp, Homo sapiens
actgcattctataataaatggg

SEQ ID NO: 2176661 - DNA, 13 bp, Homo sapiens
actgccaagccag

SEQ ID NO: 2176662 - DNA, 17 bp, Homo sapiens
actgccaagccagattc

SEQ ID NO: 2176663 - DNA, 21 bp, Homo sapiens
actgccaagccagattctctt

SEQ ID NO: 2176664 - DNA, 11 bp, Homo sapiens
actgccctctg

SEQ ID NO: 2176665 - DNA, 22 bp, Homo sapiens
actgccctctgttcagtaacag

SEQ ID NO: 2176666 - DNA, 14 bp, Homo sapiens
actgctaattacac

SEQ ID NO: 2176667 - DNA, 17 bp, Homo sapiens
actgctctaagcacacg

SEQ ID NO: 2176668 - DNA, 19 bp, Homo sapiens
actgctctaagcacacgga

SEQ ID NO: 2176669 - DNA, 21 bp, Homo sapiens
actgctctcaaaatgtgaact

SEQ ID NO: 2176670 - DNA, 16 bp, Homo sapiens
actggaatttattatg

SEQ ID NO: 2176671 - DNA, 20 bp, Homo sapiens
actggacagcggttgtaaat

SEQ ID NO: 2176672 - DNA, 18 bp, Homo sapiens
actggagaggctaacctc

SEQ ID NO: 2176673 - DNA, 13 bp, Homo sapiens
actgggccctgcc

SEQ ID NO: 2176674 - DNA, 16 bp, Homo sapiens
actgggccctgcctct

SEQ ID NO: 2176675 - DNA, 14 bp, Homo sapiens
actggggcctggac

SEQ ID NO: 2176676 - DNA, 15 bp, Homo sapiens
actgggtaggttctg

SEQ ID NO: 2176677 - DNA, 17 bp, Homo sapiens
actggtgtaaaaaacaa

SEQ ID NO: 2176678 - DNA, 18 bp, Homo sapiens
actggtttgtatgatgta

SEQ ID NO: 2176679 - DNA, 18 bp, Homo sapiens
actgtaaggaagagggac

SEQ ID NO: 2176680 - DNA, 21 bp, Homo sapiens
actgtagcctgcgtcatggct

SEQ ID NO: 2176681 - DNA, 18 bp, Homo sapiens
aggctgggcccagaggca

SEQ ID NO: 2176682 - DNA, 20 bp, Homo sapiens
aggctgggcccagaggcaca

SEQ ID NO: 2176683 - DNA, 11 bp, Homo sapiens
aggctgggtgc

SEQ ID NO: 2176684 - DNA, 16 bp, Homo sapiens
aggctgtttttgggtg

SEQ ID NO: 2176685 - DNA, 17 bp, Homo sapiens
agggaaggccacctgca

SEQ ID NO: 2176686 - DNA, 22 bp, Homo sapiens
agggaatatatatttttctatg

SEQ ID NO: 2176687 - DNA, 23 bp, Homo sapiens
agggaatgagacaggacctagga

SEQ ID NO: 2176688 - DNA, 13 bp, Homo sapiens
agggacccctcct

SEQ ID NO: 2176689 - DNA, 20 bp, Homo sapiens
agggactcaatttctcccca

SEQ ID NO: 2176690 - DNA, 14 bp, Homo sapiens
agggactgggggtg

SEQ ID NO: 2176691 - DNA, 16 bp, Homo sapiens
agggagaaggagaggc

SEQ ID NO: 2176692 - DNA, 20 bp, Homo sapiens
agggatgccataccttgaga

SEQ ID NO: 2176693 - DNA, 18 bp, Homo sapiens
agggatgcggatcctgct

SEQ ID NO: 2176694 - DNA, 17 bp, Homo sapiens
agggatggggccacagc

SEQ ID NO: 2176695 - DNA, 16 bp, Homo sapiens
agggcagcctgtggga

SEQ ID NO: 2176696 - DNA, 20 bp, Homo sapiens
agggcagcctgtgggagaag

SEQ ID NO: 2176697 - DNA, 16 bp, Homo sapiens
agggccaagtcccacc

SEQ ID NO: 2176698 - DNA, 22 bp, Homo sapiens
agggccatctgactgccaagcc

SEQ ID NO: 2176699 - DNA, 11 bp, Homo sapiens
agggccctctg

SEQ ID NO: 2176700 - DNA, 14 bp, Homo sapiens
agggccctctgggg

SEQ ID NO: 2176701 - DNA, 17 bp, Homo sapiens
agggccctctggggctc

SEQ ID NO: 2176702 - DNA, 20 bp, Homo sapiens
agggccgactaagagaagtt

SEQ ID NO: 2176703 - DNA, 11 bp, Homo sapiens
agggcctgact

SEQ ID NO: 2176704 - DNA, 12 bp, Homo sapiens
agggccttgcta

SEQ ID NO: 2176705 - DNA, 21 bp, Homo sapiens
agggctaaggcctcttgctgg

SEQ ID NO: 2176706 - DNA, 11 bp, Homo sapiens
agggctgggtg

SEQ ID NO: 2176707 - DNA, 16 bp, Homo sapiens
aggggcaagctaggcc

SEQ ID NO: 2176708 - DNA, 19 bp, Homo sapiens
aggggcaagctaggcccca

SEQ ID NO: 2176709 - DNA, 17 bp, Homo sapiens
aggggcctctggctgcc

SEQ ID NO: 2176710 - DNA, 12 bp, Homo sapiens
aggggcctgcag

SEQ ID NO: 2176711 - DNA, 13 bp, Homo sapiens
aggggcctgcaga

SEQ ID NO: 2176712 - DNA, 14 bp, Homo sapiens
aggggctgggcaga

SEQ ID NO: 2176713 - DNA, 17 bp, Homo sapiens
aggggttccagcttccc

SEQ ID NO: 2176714 - DNA, 20 bp, Homo sapiens
aggggttttaggtctcttcc

SEQ ID NO: 2176715 - DNA, 17 bp, Homo sapiens
agggtaggcaaggctgc

SEQ ID NO: 2176716 - DNA, 15 bp, Homo sapiens
agggtcagtgccaag

SEQ ID NO: 2176717 - DNA, 14 bp, Homo sapiens
agggtcctgtgcct

SEQ ID NO: 2176718 - DNA, 18 bp, Homo sapiens
agggtgccttaaaaataa

SEQ ID NO: 2176719 - DNA, 12 bp, Homo sapiens
agggtgggaagg

SEQ ID NO: 2176720 - DNA, 17 bp, Homo sapiens
agggttttatctctgtc

SEQ ID NO: 2176721 - DNA, 20 bp, Homo sapiens
aggtcaaggcctgtccctgg

SEQ ID NO: 2176722 - DNA, 18 bp, Homo sapiens
aggtcaccaggggaggag

SEQ ID NO: 2176723 - DNA, 19 bp, Homo sapiens
aggtcagtacccacctgag

SEQ ID NO: 2176724 - DNA, 20 bp, Homo sapiens
aggtcatacaatccattctt

SEQ ID NO: 2176725 - DNA, 12 bp, Homo sapiens
aggtcccaaggc

SEQ ID NO: 2176726 - DNA, 22 bp, Homo sapiens
aggtcccgagccccctgtcctt

SEQ ID NO: 2176727 - DNA, 16 bp, Homo sapiens
aggtctcttcccctct

SEQ ID NO: 2176728 - DNA, 16 bp, Homo sapiens
aggtctgggagaggca

SEQ ID NO: 2176729 - DNA, 14 bp, Homo sapiens
aggtgaaggcagaa

SEQ ID NO: 2176730 - DNA, 16 bp, Homo sapiens
aggtgaaggcagaagt

SEQ ID NO: 2176731 - DNA, 22 bp, Homo sapiens
aggtgactgggccctgcctctg

SEQ ID NO: 2176732 - DNA, 22 bp, Homo sapiens
aggtgccaccaccctgcccccc

SEQ ID NO: 2176733 - DNA, 15 bp, Homo sapiens
aggtgcttgccccca

SEQ ID NO: 2176734 - DNA, 17 bp, Homo sapiens
aggtggggaagagagcc

SEQ ID NO: 2176735 - DNA, 22 bp, Homo sapiens
aggtggggaagagagcctgccc

SEQ ID NO: 2176736 - DNA, 14 bp, Homo sapiens
aggtgggggttggc

SEQ ID NO: 2176737 - DNA, 16 bp, Homo sapiens
aggtggggtgaagctg

SEQ ID NO: 2176738 - DNA, 15 bp, Homo sapiens
aggtgtagctctgtt

SEQ ID NO: 2176739 - DNA, 17 bp, Homo sapiens
aggtgtccccagcccac

SEQ ID NO: 2176740 - DNA, 19 bp, Homo sapiens
aggtgtccccagcccactg

SEQ ID NO: 2176741 - DNA, 14 bp, Homo sapiens
aggtgtgagccact

SEQ ID NO: 2176742 - DNA, 18 bp, Homo sapiens
aggttccccaagggccct

SEQ ID NO: 2176743 - DNA, 21 bp, Homo sapiens
aggttctggttagctcagccc

SEQ ID NO: 2176744 - DNA, 22 bp, Homo sapiens
aggttctggttagctcagcccc

SEQ ID NO: 2176745 - DNA, 15 bp, Homo sapiens
aggttggaggcccta

SEQ ID NO: 2176746 - DNA, 22 bp, Homo sapiens
aggttgtgaaaacagcagcaat

SEQ ID NO: 2176747 - DNA, 20 bp, Homo sapiens
aggtttagaatcaagtctgt

SEQ ID NO: 2176748 - DNA, 16 bp, Homo sapiens
aggtttcactgttcat

SEQ ID NO: 2176749 - DNA, 19 bp, Homo sapiens
aggtttcactgttcatgaa

SEQ ID NO: 2176750 - DNA, 22 bp, Homo sapiens
agtaaaaacactacctcttttg

SEQ ID NO: 2176751 - DNA, 17 bp, Homo sapiens
agtaaaaataaatcaag

SEQ ID NO: 2176752 - DNA, 12 bp, Homo sapiens
agtaaaacacaa

SEQ ID NO: 2176753 - DNA, 19 bp, Homo sapiens
agtaagaccggaagctcct

SEQ ID NO: 2176754 - DNA, 21 bp, Homo sapiens
agtaagaccggaagctcctgg

SEQ ID NO: 2176755 - DNA, 18 bp, Homo sapiens
agtaataaaacccagcat

SEQ ID NO: 2176756 - DNA, 13 bp, Homo sapiens
agtaatagctgaa

SEQ ID NO: 2176757 - DNA, 21 bp, Homo sapiens
agtaatagctgaacctgttca

SEQ ID NO: 2176758 - DNA, 17 bp, Homo sapiens
agtaatcccagaacaat

SEQ ID NO: 2176759 - DNA, 19 bp, Homo sapiens
agtacaaaaggagaagagg

SEQ ID NO: 2176760 - DNA, 14 bp, Homo sapiens
agtacatccagaaa

SEQ ID NO: 2176761 - DNA, 15 bp, Homo sapiens
agtacccaaaagctc

SEQ ID NO: 2176762 - DNA, 22 bp, Homo sapiens
agtacccaaaagctcagccagc

SEQ ID NO: 2176763 - DNA, 12 bp, Homo sapiens
agtacccacctg

SEQ ID NO: 2176764 - DNA, 13 bp, Homo sapiens
agtacccacctga

SEQ ID NO: 2176765 - DNA, 15 bp, Homo sapiens
agtacccacctgagc

SEQ ID NO: 2176766 - DNA, 16 bp, Homo sapiens
agtacccacctgagct

SEQ ID NO: 2176767 - DNA, 13 bp, Homo sapiens
agtacctttgctc

SEQ ID NO: 2176768 - DNA, 18 bp, Homo sapiens
agtacctttgctcttgca

SEQ ID NO: 2176769 - DNA, 14 bp, Homo sapiens
agtactggaattta

SEQ ID NO: 2176770 - DNA, 13 bp, Homo sapiens
agtagacccctgg

SEQ ID NO: 2176771 - DNA, 16 bp, Homo sapiens
agtagacccctggctg

SEQ ID NO: 2176772 - DNA, 15 bp, Homo sapiens
agtagatctgtggcg

SEQ ID NO: 2176773 - DNA, 16 bp, Homo sapiens
agtagatctgtggcga

SEQ ID NO: 2176774 - DNA, 17 bp, Homo sapiens
aaatgttaataaaggtt

SEQ ID NO: 2176775 - DNA, 22 bp, Homo sapiens
aaatgttaataaaggtttcgtt

SEQ ID NO: 2176776 - DNA, 16 bp, Homo sapiens
aaatgttattatctgg

SEQ ID NO: 2176777 - DNA, 15 bp, Homo sapiens
aaatgttttaaactc

SEQ ID NO: 2176778 - DNA, 12 bp, Homo sapiens
aaattaaaattg

SEQ ID NO: 2176779 - DNA, 18 bp, Homo sapiens
aaattacaagtttcagta

SEQ ID NO: 2176780 - DNA, 15 bp, Homo sapiens
aaattactgataaaa

SEQ ID NO: 2176781 - DNA, 14 bp, Homo sapiens
aaattagaacttga

SEQ ID NO: 2176782 - DNA, 17 bp, Homo sapiens
aaattagtaatgtacta

SEQ ID NO: 2176783 - DNA, 16 bp, Homo sapiens
aaattcacaagctgcc

SEQ ID NO: 2176784 - DNA, 16 bp, Homo sapiens
aaattcattccatttg

SEQ ID NO: 2176785 - DNA, 12 bp, Homo sapiens
aaattccctgga

SEQ ID NO: 2176786 - DNA, 21 bp, Homo sapiens
aaattgaaatgggaacaatat

SEQ ID NO: 2176787 - DNA, 12 bp, Homo sapiens
aaattgccaaaa

SEQ ID NO: 2176788 - DNA, 23 bp, Homo sapiens
aaattgttacccatttgaaagaa

SEQ ID NO: 2176789 - DNA, 23 bp, Homo sapiens
aaatttacacaaaaagaaagctg

SEQ ID NO: 2176790 - DNA, 13 bp, Homo sapiens
aaatttgggtttt

SEQ ID NO: 2176791 - DNA, 20 bp, Homo sapiens
aaattttactttctctcacc

SEQ ID NO: 2176792 - DNA, 22 bp, Homo sapiens
aaattttatgtattttaaaata

SEQ ID NO: 2176793 - DNA, 15 bp, Homo sapiens
aaattttttaagcaa

SEQ ID NO: 2176794 - DNA, 17 bp, Homo sapiens
aacaaaacctcttctgt

SEQ ID NO: 2176795 - DNA, 14 bp, Homo sapiens
aacaaagtgcaaag

SEQ ID NO: 2176796 - DNA, 15 bp, Homo sapiens
aacaaagtgcaaagc

SEQ ID NO: 2176797 - DNA, 17 bp, Homo sapiens
aacaaagtgcaaagctg

SEQ ID NO: 2176798 - DNA, 17 bp, Homo sapiens
aacaataaaaaaaaacc

SEQ ID NO: 2176799 - DNA, 15 bp, Homo sapiens
aacaatgtttgtcat

SEQ ID NO: 2176800 - DNA, 15 bp, Homo sapiens
aacacaaatgtgtac

SEQ ID NO: 2176801 - DNA, 15 bp, Homo sapiens
aacacaaggtgggca

SEQ ID NO: 2176802 - DNA, 14 bp, Homo sapiens
aacaccaggactta

SEQ ID NO: 2176803 - DNA, 15 bp, Homo sapiens
aacactgcagcattt

SEQ ID NO: 2176804 - DNA, 12 bp, Homo sapiens
aacactgtcaat

SEQ ID NO: 2176805 - DNA, 18 bp, Homo sapiens
aacactgtgattactctt

SEQ ID NO: 2176806 - DNA, 23 bp, Homo sapiens
aacactttggtattcaatttgat

SEQ ID NO: 2176807 - DNA, 15 bp, Homo sapiens
aacagaaattgtata

SEQ ID NO: 2176808 - DNA, 20 bp, Homo sapiens
aacagcaaatgcaaaaactc

SEQ ID NO: 2176809 - DNA, 18 bp, Homo sapiens
aacagcagaaacccatgt

SEQ ID NO: 2176810 - DNA, 14 bp, Homo sapiens
aacaggctgtgtgt

SEQ ID NO: 2176811 - DNA, 15 bp, Homo sapiens
aacagggccttgcta

SEQ ID NO: 2176812 - DNA, 13 bp, Homo sapiens
aacaggggctggt

SEQ ID NO: 2176813 - DNA, 13 bp, Homo sapiens
aacagttgtattt

SEQ ID NO: 2176814 - DNA, 16 bp, Homo sapiens
aacataagctagaaaa

SEQ ID NO: 2176815 - DNA, 17 bp, Homo sapiens
aacataagctagaaaaa

SEQ ID NO: 2176816 - DNA, 22 bp, Homo sapiens
aacataagctagaaaaattaga

SEQ ID NO: 2176817 - DNA, 16 bp, Homo sapiens
aacatctgccttgctg

SEQ ID NO: 2176818 - DNA, 20 bp, Homo sapiens
aacatgaaggatcaaaaaat

SEQ ID NO: 2176819 - DNA, 14 bp, Homo sapiens
aacatgaattaaga

SEQ ID NO: 2176820 - DNA, 23 bp, Homo sapiens
aacatggtgaaaccccatctcta

SEQ ID NO: 2176821 - DNA, 11 bp, Homo sapiens
aacatgtcatg

SEQ ID NO: 2176822 - DNA, 21 bp, Homo sapiens
aacatgttacgtgtgcaacag

SEQ ID NO: 2176823 - DNA, 14 bp, Homo sapiens
aacattcagctctg

SEQ ID NO: 2176824 - DNA, 15 bp, Homo sapiens
aacattcagctctgg

SEQ ID NO: 2176825 - DNA, 12 bp, Homo sapiens
aacattgatttt

SEQ ID NO: 2176826 - DNA, 15 bp, Homo sapiens
aacatttatctttgt

SEQ ID NO: 2176827 - DNA, 12 bp, Homo sapiens
aacatttgtaat

SEQ ID NO: 2176828 - DNA, 15 bp, Homo sapiens
aaccaagccttggct

SEQ ID NO: 2176829 - DNA, 12 bp, Homo sapiens
aaccaaggtgca

SEQ ID NO: 2176830 - DNA, 13 bp, Homo sapiens
aaccaccaaagtc

SEQ ID NO: 2176831 - DNA, 13 bp, Homo sapiens
aaccacctctggc

SEQ ID NO: 2176832 - DNA, 15 bp, Homo sapiens
aaccactgtacatat

SEQ ID NO: 2176833 - DNA, 11 bp, Homo sapiens
aaccaggagca

SEQ ID NO: 2176834 - DNA, 17 bp, Homo sapiens
aaccatgtcatttcaga

SEQ ID NO: 2176835 - DNA, 17 bp, Homo sapiens
aacccaccctaccacag

SEQ ID NO: 2176836 - DNA, 19 bp, Homo sapiens
aacccattaatcttttgta

SEQ ID NO: 2176837 - DNA, 23 bp, Homo sapiens
aacccatttgccatgctgctatg

SEQ ID NO: 2176838 - DNA, 16 bp, Homo sapiens
aaccctacactcggaa

SEQ ID NO: 2176839 - DNA, 23 bp, Homo sapiens
aaccgctacaagagggcaaagct

SEQ ID NO: 2176840 - DNA, 19 bp, Homo sapiens
aaccgtgcaacgtgtaact

SEQ ID NO: 2176841 - DNA, 14 bp, Homo sapiens
aacctacaaaaaaa

SEQ ID NO: 2176842 - DNA, 18 bp, Homo sapiens
aacctacctgtaactttt

SEQ ID NO: 2176843 - DNA, 12 bp, Homo sapiens
aacctacctgtg

SEQ ID NO: 2176844 - DNA, 18 bp, Homo sapiens
aacctagtactttattag

SEQ ID NO: 2176845 - DNA, 14 bp, Homo sapiens
aacctcaggttcca

SEQ ID NO: 2176846 - DNA, 13 bp, Homo sapiens
aacctcctttctc

SEQ ID NO: 2176847 - DNA, 18 bp, Homo sapiens
aacctcctttctcttctc

SEQ ID NO: 2176848 - DNA, 19 bp, Homo sapiens
aacctgatgctaattttca

SEQ ID NO: 2176849 - DNA, 22 bp, Homo sapiens
aacctggctgcgaactgtgcag

SEQ ID NO: 2176850 - DNA, 11 bp, Homo sapiens
aacctggtggc

SEQ ID NO: 2176851 - DNA, 17 bp, Homo sapiens
aacctggtggctggagg

SEQ ID NO: 2176852 - DNA, 16 bp, Homo sapiens
aacctgtgtgcatctg

SEQ ID NO: 2176853 - DNA, 18 bp, Homo sapiens
aacctgttcaaaatgtta

SEQ ID NO: 2176854 - DNA, 18 bp, Homo sapiens
aaccttcaaagcttttgt

SEQ ID NO: 2176855 - DNA, 13 bp, Homo sapiens
aaccttcctgtct

SEQ ID NO: 2176856 - DNA, 15 bp, Homo sapiens
aacgaaactgctcta

SEQ ID NO: 2176857 - DNA, 21 bp, Homo sapiens
aacgcaaacctctccttcctc

SEQ ID NO: 2176858 - DNA, 15 bp, Homo sapiens
aacgcctgccttctg

SEQ ID NO: 2176859 - DNA, 23 bp, Homo sapiens
aacgtgagagaaagagagaagcc

SEQ ID NO: 2176860 - DNA, 19 bp, Homo sapiens
aacgttaaatgaaaaaaga

SEQ ID NO: 2176861 - DNA, 16 bp, Homo sapiens
aactaaactacagaaa

SEQ ID NO: 2176862 - DNA, 20 bp, Homo sapiens
aactaatgtgatatgaaaat

SEQ ID NO: 2176863 - DNA, 16 bp, Homo sapiens
aactagagcagccctg

SEQ ID NO: 2176864 - DNA, 22 bp, Homo sapiens
aactagagcagccctggagtca

SEQ ID NO: 2176865 - DNA, 22 bp, Homo sapiens
aactatatttaataccaccaac

SEQ ID NO: 2176866 - DNA, 23 bp, Homo sapiens
aactatatttaataccaccaaca

SEQ ID NO: 2176867 - DNA, 16 bp, Homo sapiens
aactcaaacacagaga

SEQ ID NO: 2176868 - DNA, 21 bp, Homo sapiens
aactcaaagcaagctcttctc

SEQ ID NO: 2176869 - DNA, 23 bp, Homo sapiens
aactcaaagcaagctcttctcct

SEQ ID NO: 2176870 - DNA, 14 bp, Homo sapiens
aactcaaaggactg

SEQ ID NO: 2176871 - DNA, 20 bp, Homo sapiens
aactcagctattaagaaaat

SEQ ID NO: 2176872 - DNA, 13 bp, Homo sapiens
aactcatttcaag

SEQ ID NO: 2176873 - DNA, 12 bp, Homo sapiens
aactccttcctc

SEQ ID NO: 2176874 - DNA, 18 bp, Homo sapiens
aactcgcttctctgtgac

SEQ ID NO: 2176875 - DNA, 19 bp, Homo sapiens
aactctgggcacttttgaa

SEQ ID NO: 2176876 - DNA, 22 bp, Homo sapiens
aactcttcctggaatgcattca

SEQ ID NO: 2176877 - DNA, 23 bp, Homo sapiens
aactgatatacttgagtgtgcaa

SEQ ID NO: 2176878 - DNA, 19 bp, Homo sapiens
aactgcattagaaaccatg

SEQ ID NO: 2176879 - DNA, 21 bp, Homo sapiens
aactgctaaatactgtacata

SEQ ID NO: 2176880 - DNA, 13 bp, Homo sapiens
aactggagaggct

SEQ ID NO: 2176881 - DNA, 19 bp, Homo sapiens
aactggagaggctaacctc

SEQ ID NO: 2176882 - DNA, 12 bp, Homo sapiens
aactgtaactgc

SEQ ID NO: 2176883 - DNA, 20 bp, Homo sapiens
aactgtatttgaaataagaa

SEQ ID NO: 2176884 - DNA, 21 bp, Homo sapiens
aactgtcagaataaagaacat

SEQ ID NO: 2176885 - DNA, 18 bp, Homo sapiens
aactgttgtttgatgtgt

SEQ ID NO: 2176886 - DNA, 19 bp, Homo sapiens
aactgttgtttgatgtgta

SEQ ID NO: 2176887 - DNA, 16 bp, Homo sapiens
aactgtttccctgctg

SEQ ID NO: 2176888 - DNA, 17 bp, Homo sapiens
aactgtttccctgctga

SEQ ID NO: 2176889 - DNA, 13 bp, Homo sapiens
aacttaagtttag

SEQ ID NO: 2176890 - DNA, 13 bp, Homo sapiens
aacttagttttgt

SEQ ID NO: 2176891 - DNA, 23 bp, Homo sapiens
aacttatattaaataaatgtgca

SEQ ID NO: 2176892 - DNA, 20 bp, Homo sapiens
aacttcagatacttgtgaac

SEQ ID NO: 2176893 - DNA, 10 bp, Homo sapiens
aacttgaaaa

SEQ ID NO: 2176894 - DNA, 18 bp, Homo sapiens
aacttgaaaagattgcaa

SEQ ID NO: 2176895 - DNA, 19 bp, Homo sapiens
aacttgaaaagattgcaaa

SEQ ID NO: 2176896 - DNA, 20 bp, Homo sapiens
aacttgaaaagattgcaaag

SEQ ID NO: 2176897 - DNA, 23 bp, Homo sapiens
acagaactgctaaatactgtaca

SEQ ID NO: 2176898 - DNA, 14 bp, Homo sapiens
acagacaagcagcc

SEQ ID NO: 2176899 - DNA, 15 bp, Homo sapiens
acagacaagcagccc

SEQ ID NO: 2176900 - DNA, 18 bp, Homo sapiens
acagacaagcagcccttg

SEQ ID NO: 2176901 - DNA, 16 bp, Homo sapiens
acagacccctgggagc

SEQ ID NO: 2176902 - DNA, 23 bp, Homo sapiens
acagactatttttagattttctt

SEQ ID NO: 2176903 - DNA, 16 bp, Homo sapiens
acagaggcagtggcag

SEQ ID NO: 2176904 - DNA, 13 bp, Homo sapiens
acagagggattta

SEQ ID NO: 2176905 - DNA, 20 bp, Homo sapiens
acagataatgatagtgtttt

SEQ ID NO: 2176906 - DNA, 13 bp, Homo sapiens
acagatggctgtg

SEQ ID NO: 2176907 - DNA, 21 bp, Homo sapiens
acagcaatctgtgtactgaac

SEQ ID NO: 2176908 - DNA, 20 bp, Homo sapiens
acagcacctcctctctgctg

SEQ ID NO: 2176909 - DNA, 21 bp, Homo sapiens
acagcacctcctctctgctgg

SEQ ID NO: 2176910 - DNA, 22 bp, Homo sapiens
acagcagaaacccatgtgcagg

SEQ ID NO: 2176911 - DNA, 18 bp, Homo sapiens
acagcagcaatgcaatgt

SEQ ID NO: 2176912 - DNA, 20 bp, Homo sapiens
acagcaggcccacctacctt

SEQ ID NO: 2176913 - DNA, 14 bp, Homo sapiens
acagcatggaaaag

SEQ ID NO: 2176914 - DNA, 15 bp, Homo sapiens
acagccatcccagcc

SEQ ID NO: 2176915 - DNA, 16 bp, Homo sapiens
acagccatcccagcct

SEQ ID NO: 2176916 - DNA, 18 bp, Homo sapiens
acagccatcccagccttg

SEQ ID NO: 2176917 - DNA, 19 bp, Homo sapiens
acagccatcccagccttgg

SEQ ID NO: 2176918 - DNA, 23 bp, Homo sapiens
acagccctggaggccgctgctga

SEQ ID NO: 2176919 - DNA, 16 bp, Homo sapiens
acagccggggcctgcc

SEQ ID NO: 2176920 - DNA, 14 bp, Homo sapiens
acagcggttgtaaa

SEQ ID NO: 2176921 - DNA, 18 bp, Homo sapiens
acagcggttgtaaataca

SEQ ID NO: 2176922 - DNA, 20 bp, Homo sapiens
acagcggttgtaaatacaat

SEQ ID NO: 2176923 - DNA, 21 bp, Homo sapiens
acagctaattctactcacagt

SEQ ID NO: 2176924 - DNA, 19 bp, Homo sapiens
acagctcacggcagcctca

SEQ ID NO: 2176925 - DNA, 15 bp, Homo sapiens
acagctccttgtgag

SEQ ID NO: 2176926 - DNA, 14 bp, Homo sapiens
acagctttcctggg

SEQ ID NO: 2176927 - DNA, 18 bp, Homo sapiens
acagctttcctgggtgag

SEQ ID NO: 2176928 - DNA, 22 bp, Homo sapiens
acagcttttagtacccacctga

SEQ ID NO: 2176929 - DNA, 14 bp, Homo sapiens
acagcttttctctt

SEQ ID NO: 2176930 - DNA, 20 bp, Homo sapiens
acaggacagcatggtgcatg

SEQ ID NO: 2176931 - DNA, 15 bp, Homo sapiens
acaggaccctcagga

SEQ ID NO: 2176932 - DNA, 17 bp, Homo sapiens
acaggaccctcaggaat

SEQ ID NO: 2176933 - DNA, 13 bp, Homo sapiens
acaggctgtgtgt

SEQ ID NO: 2176934 - DNA, 18 bp, Homo sapiens
acagggataaggcctgtg

SEQ ID NO: 2176935 - DNA, 12 bp, Homo sapiens
acaggggctggt

SEQ ID NO: 2176936 - DNA, 14 bp, Homo sapiens
acagggtctcccta

SEQ ID NO: 2176937 - DNA, 17 bp, Homo sapiens
acagggtgtctgtcagt

SEQ ID NO: 2176938 - DNA, 16 bp, Homo sapiens
acaggtctgggagagg

SEQ ID NO: 2176939 - DNA, 14 bp, Homo sapiens
acaggtgtgagcca

SEQ ID NO: 2176940 - DNA, 23 bp, Homo sapiens
acagtaaaacaattgtgacagca

SEQ ID NO: 2176941 - DNA, 11 bp, Homo sapiens
acagtatgtgt

SEQ ID NO: 2176942 - DNA, 12 bp, Homo sapiens
acagtatgtgtc

SEQ ID NO: 2176943 - DNA, 17 bp, Homo sapiens
acagtatgtgtctagca

SEQ ID NO: 2176944 - DNA, 16 bp, Homo sapiens
acagtccagttttgtg

SEQ ID NO: 2176945 - DNA, 16 bp, Homo sapiens
acagtctctccctggg

SEQ ID NO: 2176946 - DNA, 18 bp, Homo sapiens
acagtctctccctggggt

SEQ ID NO: 2176947 - DNA, 20 bp, Homo sapiens
acagtctggcagttgctaaa

SEQ ID NO: 2176948 - DNA, 20 bp, Homo sapiens
acagtggggtttttttgtct

SEQ ID NO: 2176949 - DNA, 23 bp, Homo sapiens
acagtggtaaatatagaaccatg

SEQ ID NO: 2176950 - DNA, 16 bp, Homo sapiens
acagtggttgcctggg

SEQ ID NO: 2176951 - DNA, 18 bp, Homo sapiens
acagtgtaaaaattcaga

SEQ ID NO: 2176952 - DNA, 22 bp, Homo sapiens
acagttgagtttcttctaaaga

SEQ ID NO: 2176953 - DNA, 15 bp, Homo sapiens
acataaaacaaaacc

SEQ ID NO: 2176954 - DNA, 23 bp, Homo sapiens
acataaaacaaaaccaagccttg

SEQ ID NO: 2176955 - DNA, 20 bp, Homo sapiens
acataagctagaaaaattag

SEQ ID NO: 2176956 - DNA, 14 bp, Homo sapiens
acataatttgcata

SEQ ID NO: 2176957 - DNA, 15 bp, Homo sapiens
acatacagagtgggc

SEQ ID NO: 2176958 - DNA, 17 bp, Homo sapiens
acatatacatatgatca

SEQ ID NO: 2176959 - DNA, 13 bp, Homo sapiens
acatatggaattt

SEQ ID NO: 2176960 - DNA, 19 bp, Homo sapiens
acatccccgctggctgggg

SEQ ID NO: 2176961 - DNA, 14 bp, Homo sapiens
acatctaacaaagt

SEQ ID NO: 2176962 - DNA, 21 bp, Homo sapiens
acatctaattcaagattacaa

SEQ ID NO: 2176963 - DNA, 21 bp, Homo sapiens
acatctgaggttttatttcat

SEQ ID NO: 2176964 - DNA, 18 bp, Homo sapiens
acatcttcaatctaggcg

SEQ ID NO: 2176965 - DNA, 16 bp, Homo sapiens
acatcttttgggaagc

SEQ ID NO: 2176966 - DNA, 20 bp, Homo sapiens
acatgccttatatttgtcca

SEQ ID NO: 2176967 - DNA, 22 bp, Homo sapiens
acatgctggacaggtctgggag

SEQ ID NO: 2176968 - DNA, 22 bp, Homo sapiens
acatgggaaacttccaagacct

SEQ ID NO: 2176969 - DNA, 16 bp, Homo sapiens
acatgggtagcttctg

SEQ ID NO: 2176970 - DNA, 23 bp, Homo sapiens
acatgtcatgtaggttgtctaaa

SEQ ID NO: 2176971 - DNA, 17 bp, Homo sapiens
acatgtgccaccaacat

SEQ ID NO: 2176972 - DNA, 17 bp, Homo sapiens
acatgttacgtgtgcaa

SEQ ID NO: 2176973 - DNA, 19 bp, Homo sapiens
acattaaagtaaagtacaa

SEQ ID NO: 2176974 - DNA, 19 bp, Homo sapiens
acattattggacttccatt

SEQ ID NO: 2176975 - DNA, 20 bp, Homo sapiens
acattattggacttccattt

SEQ ID NO: 2176976 - DNA, 21 bp, Homo sapiens
acattattggacttccatttg

SEQ ID NO: 2176977 - DNA, 21 bp, Homo sapiens
acattcaaaaacatggccaca

SEQ ID NO: 2176978 - DNA, 22 bp, Homo sapiens
acattcaagattaaactgagtg

SEQ ID NO: 2176979 - DNA, 15 bp, Homo sapiens
acattcagctctgga

SEQ ID NO: 2176980 - DNA, 16 bp, Homo sapiens
acattcagctctggag

SEQ ID NO: 2176981 - DNA, 16 bp, Homo sapiens
acattctaagtgtgtt

SEQ ID NO: 2176982 - DNA, 12 bp, Homo sapiens
acattctgtcat

SEQ ID NO: 2176983 - DNA, 20 bp, Homo sapiens
acattgttctttccggccaa

SEQ ID NO: 2176984 - DNA, 20 bp, Homo sapiens
acatttccagggcagcagcc

SEQ ID NO: 2176985 - DNA, 22 bp, Homo sapiens
acatttgtcctgcagagctggg

SEQ ID NO: 2176986 - DNA, 14 bp, Homo sapiens
accaaaatcccctt

SEQ ID NO: 2176987 - DNA, 21 bp, Homo sapiens
accaaagctgacgaggctggg

SEQ ID NO: 2176988 - DNA, 17 bp, Homo sapiens
accaactgctctcaaaa

SEQ ID NO: 2176989 - DNA, 23 bp, Homo sapiens
accaagagtagcaccttcagaat

SEQ ID NO: 2176990 - DNA, 11 bp, Homo sapiens
accaagccttg

SEQ ID NO: 2176991 - DNA, 13 bp, Homo sapiens
accaagccttggc

SEQ ID NO: 2176992 - DNA, 20 bp, Homo sapiens
accaagctgtacccttgaga

SEQ ID NO: 2176993 - DNA, 12 bp, Homo sapiens
accaccctgagc

SEQ ID NO: 2176994 - DNA, 21 bp, Homo sapiens
accaccctgagccggccccag

SEQ ID NO: 2176995 - DNA, 18 bp, Homo sapiens
accacgcctcttgaccag

SEQ ID NO: 2176996 - DNA, 16 bp, Homo sapiens
accacttatttctaaa

SEQ ID NO: 2176997 - DNA, 14 bp, Homo sapiens
accagagctctgga

SEQ ID NO: 2176998 - DNA, 12 bp, Homo sapiens
accagaggtggg

SEQ ID NO: 2176999 - DNA, 20 bp, Homo sapiens
accagatgctgaaagagaaa

SEQ ID NO: 2177000 - DNA, 21 bp, Homo sapiens
accaggagcattttgtgtctt

SEQ ID NO: 2177001 - DNA, 16 bp, Homo sapiens
accaggggaggagcct

SEQ ID NO: 2177002 - DNA, 19 bp, Homo sapiens
accaggggaggagcctgtg

SEQ ID NO: 2177003 - DNA, 16 bp, Homo sapiens
accagttactgttcat

SEQ ID NO: 2177004 - DNA, 12 bp, Homo sapiens
accagtttctta

SEQ ID NO: 2177005 - DNA, 21 bp, Homo sapiens
accagtttcttttcttttgtt

SEQ ID NO: 2177006 - DNA, 16 bp, Homo sapiens
accatctatgtgaata

SEQ ID NO: 2177007 - DNA, 18 bp, Homo sapiens
accatctatgtgaatatt

SEQ ID NO: 2177008 - DNA, 13 bp, Homo sapiens
accatgaaaaaat

SEQ ID NO: 2177009 - DNA, 23 bp, Homo sapiens
accatgaattctggtcacattcc

SEQ ID NO: 2177010 - DNA, 20 bp, Homo sapiens
accattcaggaacctggacc

SEQ ID NO: 2177011 - DNA, 13 bp, Homo sapiens
accatttcacaga

SEQ ID NO: 2177012 - DNA, 14 bp, Homo sapiens
acccaaatcctctc

SEQ ID NO: 2177013 - DNA, 15 bp, Homo sapiens
acccaaatcctctcc

SEQ ID NO: 2177014 - DNA, 15 bp, Homo sapiens
acccacactgcaaca

SEQ ID NO: 2177015 - DNA, 12 bp, Homo sapiens
acccacagggcc

SEQ ID NO: 2177016 - DNA, 21 bp, Homo sapiens
acccacagggcctgactttta

SEQ ID NO: 2177017 - DNA, 16 bp, Homo sapiens
acccacttccctgggc

SEQ ID NO: 2177018 - DNA, 13 bp, Homo sapiens
acccagcatgtac

SEQ ID NO: 2177019 - DNA, 12 bp, Homo sapiens
agacaattacaa

SEQ ID NO: 2177020 - DNA, 19 bp, Homo sapiens
agacacagagtggagccct

SEQ ID NO: 2177021 - DNA, 15 bp, Homo sapiens
agacacagggcatcc

SEQ ID NO: 2177022 - DNA, 12 bp, Homo sapiens
agacacctcaga

SEQ ID NO: 2177023 - DNA, 16 bp, Homo sapiens
agacacctcagagccc

SEQ ID NO: 2177024 - DNA, 16 bp, Homo sapiens
agacactacagaggat

SEQ ID NO: 2177025 - DNA, 16 bp, Homo sapiens
agacaggacctaggat

SEQ ID NO: 2177026 - DNA, 21 bp, Homo sapiens
agacaggctggtatttaacag

SEQ ID NO: 2177027 - DNA, 17 bp, Homo sapiens
agacagggtcctgctat

SEQ ID NO: 2177028 - DNA, 23 bp, Homo sapiens
agacatccccctccttgccgctg

SEQ ID NO: 2177029 - DNA, 22 bp, Homo sapiens
agacattttaagcattttctac

SEQ ID NO: 2177030 - DNA, 14 bp, Homo sapiens
agaccagagctctg

SEQ ID NO: 2177031 - DNA, 17 bp, Homo sapiens
agaccagagctctggag

SEQ ID NO: 2177032 - DNA, 18 bp, Homo sapiens
agaccagagctctggagc

SEQ ID NO: 2177033 - DNA, 19 bp, Homo sapiens
agaccagagctctggagcc

SEQ ID NO: 2177034 - DNA, 12 bp, Homo sapiens
agaccagcctgg

SEQ ID NO: 2177035 - DNA, 15 bp, Homo sapiens
agaccatttcacaga

SEQ ID NO: 2177036 - DNA, 13 bp, Homo sapiens
agacccctgggag

SEQ ID NO: 2177037 - DNA, 17 bp, Homo sapiens
agaccctcgagattaac

SEQ ID NO: 2177038 - DNA, 18 bp, Homo sapiens
agacctgactcaggcatc

SEQ ID NO: 2177039 - DNA, 15 bp, Homo sapiens
agacctggaaccaga

SEQ ID NO: 2177040 - DNA, 16 bp, Homo sapiens
agacctggaaccagag

SEQ ID NO: 2177041 - DNA, 12 bp, Homo sapiens
agacgaggggca

SEQ ID NO: 2177042 - DNA, 21 bp, Homo sapiens
agacgaggggcagggaaggac

SEQ ID NO: 2177043 - DNA, 14 bp, Homo sapiens
agactatttttaga

SEQ ID NO: 2177044 - DNA, 21 bp, Homo sapiens
agactcaaggcctccagccac

SEQ ID NO: 2177045 - DNA, 20 bp, Homo sapiens
agacttaatttcaaatctgt

SEQ ID NO: 2177046 - DNA, 17 bp, Homo sapiens
agacttgttttcccctc

SEQ ID NO: 2177047 - DNA, 21 bp, Homo sapiens
agagaaactctatgggtatca

SEQ ID NO: 2177048 - DNA, 14 bp, Homo sapiens
agagaaagagagaa

SEQ ID NO: 2177049 - DNA, 19 bp, Homo sapiens
agagaaagtccattgatgt

SEQ ID NO: 2177050 - DNA, 14 bp, Homo sapiens
agagaagccagcca

SEQ ID NO: 2177051 - DNA, 20 bp, Homo sapiens
agagaagtcggccaggtagg

SEQ ID NO: 2177052 - DNA, 23 bp, Homo sapiens
agagaatcaaggccgtgtcccct

SEQ ID NO: 2177053 - DNA, 17 bp, Homo sapiens
agagaatgagagagtgt

SEQ ID NO: 2177054 - DNA, 22 bp, Homo sapiens
agagacacatacagagtgggcc

SEQ ID NO: 2177055 - DNA, 14 bp, Homo sapiens
agagaccagccttt

SEQ ID NO: 2177056 - DNA, 14 bp, Homo sapiens
agagaccattgcat

SEQ ID NO: 2177057 - DNA, 17 bp, Homo sapiens
agagacggggcttcacc

SEQ ID NO: 2177058 - DNA, 19 bp, Homo sapiens
agagactggggcctggact

SEQ ID NO: 2177059 - DNA, 17 bp, Homo sapiens
agagagaagagtccagg

SEQ ID NO: 2177060 - DNA, 18 bp, Homo sapiens
agagagaagagtccagga

SEQ ID NO: 2177061 - DNA, 12 bp, Homo sapiens
agagagaagcca

SEQ ID NO: 2177062 - DNA, 18 bp, Homo sapiens
agagagaagccagccaca

SEQ ID NO: 2177063 - DNA, 24 bp, Homo sapiens
agagaggggcctctggctgcctgg

SEQ ID NO: 2177064 - DNA, 14 bp, Homo sapiens
agagatgcctccct

SEQ ID NO: 2177065 - DNA, 13 bp, Homo sapiens
agagcagggcaag

SEQ ID NO: 2177066 - DNA, 11 bp, Homo sapiens
agagccaaggc

SEQ ID NO: 2177067 - DNA, 19 bp, Homo sapiens
agagccaaggcctatgcca

SEQ ID NO: 2177068 - DNA, 19 bp, Homo sapiens
agagcctgcccggccggag

SEQ ID NO: 2177069 - DNA, 15 bp, Homo sapiens
agagcgctggcctct

SEQ ID NO: 2177070 - DNA, 16 bp, Homo sapiens
agagctacttgggcca

SEQ ID NO: 2177071 - DNA, 20 bp, Homo sapiens
agagctctggagccacctgt

SEQ ID NO: 2177072 - DNA, 12 bp, Homo sapiens
agagctgcctgg

SEQ ID NO: 2177073 - DNA, 11 bp, Homo sapiens
agagctgggtg

SEQ ID NO: 2177074 - DNA, 21 bp, Homo sapiens
agaggaagccttgcccagcaa

SEQ ID NO: 2177075 - DNA, 14 bp, Homo sapiens
agaggcagagtgcc

SEQ ID NO: 2177076 - DNA, 19 bp, Homo sapiens
agaggcagagtgccccacc

SEQ ID NO: 2177077 - DNA, 14 bp, Homo sapiens
agaggcagtggcag

SEQ ID NO: 2177078 - DNA, 13 bp, Homo sapiens
agaggccctggag

SEQ ID NO: 2177079 - DNA, 14 bp, Homo sapiens
agaggctcctggag

SEQ ID NO: 2177080 - DNA, 22 bp, Homo sapiens
agaggctcctggagccagccac

SEQ ID NO: 2177081 - DNA, 23 bp, Homo sapiens
agaggctctgaaagctgcttctg

SEQ ID NO: 2177082 - DNA, 15 bp, Homo sapiens
agagggcaaagctga

SEQ ID NO: 2177083 - DNA, 15 bp, Homo sapiens
agaggggaaggaaat

SEQ ID NO: 2177084 - DNA, 14 bp, Homo sapiens
agaggggagaggaa

SEQ ID NO: 2177085 - DNA, 21 bp, Homo sapiens
agaggtatcctctttttgctc

SEQ ID NO: 2177086 - DNA, 22 bp, Homo sapiens
agaggtatcctctttttgctcc

SEQ ID NO: 2177087 - DNA, 22 bp, Homo sapiens
agaggtggggtgaagctgggga

SEQ ID NO: 2177088 - DNA, 23 bp, Homo sapiens
agaggtggggtgaagctggggac

SEQ ID NO: 2177089 - DNA, 15 bp, Homo sapiens
agagtagacatcccc

SEQ ID NO: 2177090 - DNA, 19 bp, Homo sapiens
agagtcctgaggcagaacc

SEQ ID NO: 2177091 - DNA, 13 bp, Homo sapiens
agagttcagtaag

SEQ ID NO: 2177092 - DNA, 20 bp, Homo sapiens
agagttctatccccaagctg

SEQ ID NO: 2177093 - DNA, 20 bp, Homo sapiens
agatacagtgaaatctttta

SEQ ID NO: 2177094 - DNA, 17 bp, Homo sapiens
agatacttgtgaacatg

SEQ ID NO: 2177095 - DNA, 18 bp, Homo sapiens
agatacttgtgaacatgc

SEQ ID NO: 2177096 - DNA, 20 bp, Homo sapiens
agatacttgtgaacatgcct

SEQ ID NO: 2177097 - DNA, 14 bp, Homo sapiens
agatattttgcacg

SEQ ID NO: 2177098 - DNA, 18 bp, Homo sapiens
agatcacaccactgtact

SEQ ID NO: 2177099 - DNA, 15 bp, Homo sapiens
agatcactttgctct

SEQ ID NO: 2177100 - DNA, 23 bp, Homo sapiens
agatcagaacattcagctctgga

SEQ ID NO: 2177101 - DNA, 13 bp, Homo sapiens
agatcctgctgcc

SEQ ID NO: 2177102 - DNA, 18 bp, Homo sapiens
agatcggggccagaggca

SEQ ID NO: 2177103 - DNA, 16 bp, Homo sapiens
agatcggggtggcaga

SEQ ID NO: 2177104 - DNA, 19 bp, Homo sapiens
agatctagtccggacttgc

SEQ ID NO: 2177105 - DNA, 18 bp, Homo sapiens
agatgactgaatttctat

SEQ ID NO: 2177106 - DNA, 20 bp, Homo sapiens
agatgagaattcagctgccc

SEQ ID NO: 2177107 - DNA, 18 bp, Homo sapiens
agatgataatttagtgga

SEQ ID NO: 2177108 - DNA, 12 bp, Homo sapiens
agatgccagagc

SEQ ID NO: 2177109 - DNA, 21 bp, Homo sapiens
agatgccagagcaaagggcca

SEQ ID NO: 2177110 - DNA, 19 bp, Homo sapiens
agatgcctccctgaccctg

SEQ ID NO: 2177111 - DNA, 21 bp, Homo sapiens
agatggaaggccttttgcccg

SEQ ID NO: 2177112 - DNA, 17 bp, Homo sapiens
agatgtaagaagctaaa

SEQ ID NO: 2177113 - DNA, 14 bp, Homo sapiens
agatgtatcattaa

SEQ ID NO: 2177114 - DNA, 15 bp, Homo sapiens
agatgtatgcccaaa

SEQ ID NO: 2177115 - DNA, 20 bp, Homo sapiens
agatgtattaacctacctgt

SEQ ID NO: 2177116 - DNA, 21 bp, Homo sapiens
agatgtattaacctacctgtg

SEQ ID NO: 2177117 - DNA, 22 bp, Homo sapiens
agatgtattaacctacctgtga

SEQ ID NO: 2177118 - DNA, 18 bp, Homo sapiens
agatgttcagtcattttt

SEQ ID NO: 2177119 - DNA, 21 bp, Homo sapiens
agatgttggtcttggtcattt

SEQ ID NO: 2177120 - DNA, 12 bp, Homo sapiens
agattaacacac

SEQ ID NO: 2177121 - DNA, 16 bp, Homo sapiens
agattaacacactgaa

SEQ ID NO: 2177122 - DNA, 16 bp, Homo sapiens
agattagaaagacttt

SEQ ID NO: 2177123 - DNA, 22 bp, Homo sapiens
agattagaaagactttctaaat

SEQ ID NO: 2177124 - DNA, 13 bp, Homo sapiens
agattctgcattt

SEQ ID NO: 2177125 - DNA, 12 bp, Homo sapiens
agattgcaaagg

SEQ ID NO: 2177126 - DNA, 14 bp, Homo sapiens
agcaaaaccaaaga

SEQ ID NO: 2177127 - DNA, 21 bp, Homo sapiens
agcaaagccaccaagggcctc

SEQ ID NO: 2177128 - DNA, 13 bp, Homo sapiens
agcaaatgcaaaa

SEQ ID NO: 2177129 - DNA, 22 bp, Homo sapiens
agcaaatgcaaaaactctttga

SEQ ID NO: 2177130 - DNA, 19 bp, Homo sapiens
agcaaatttcatctttcca

SEQ ID NO: 2177131 - DNA, 13 bp, Homo sapiens
agcaacatgaatt

SEQ ID NO: 2177132 - DNA, 19 bp, Homo sapiens
agcaacatgaattaagaac

SEQ ID NO: 2177133 - DNA, 19 bp, Homo sapiens
agcaacgcctgccttctgg

SEQ ID NO: 2177134 - DNA, 13 bp, Homo sapiens
agcaacggcacag

SEQ ID NO: 2177135 - DNA, 15 bp, Homo sapiens
agcaagacgccctct

SEQ ID NO: 2177136 - DNA, 17 bp, Homo sapiens
agcaaggaccagtgaga

SEQ ID NO: 2177137 - DNA, 18 bp, Homo sapiens
agcaatcatttcccctcc

SEQ ID NO: 2177138 - DNA, 16 bp, Homo sapiens
agcacaaaagcctctc

SEQ ID NO: 2177139 - DNA, 16 bp, Homo sapiens
agcacaagaagtggga

SEQ ID NO: 2177140 - DNA, 13 bp, Homo sapiens
agcactcacatgc

SEQ ID NO: 2177141 - DNA, 23 bp, Homo sapiens
agtagttgggattacaggtgact

SEQ ID NO: 2177142 - DNA, 14 bp, Homo sapiens
agtatattcaaaaa

SEQ ID NO: 2177143 - DNA, 15 bp, Homo sapiens
agtatattcaaaaat

SEQ ID NO: 2177144 - DNA, 16 bp, Homo sapiens
agtatcctgaaacagt

SEQ ID NO: 2177145 - DNA, 14 bp, Homo sapiens
agtatctgtacctg

SEQ ID NO: 2177146 - DNA, 17 bp, Homo sapiens
agtatgatggcaggaga

SEQ ID NO: 2177147 - DNA, 23 bp, Homo sapiens
agtatgcactaatcaatactttg

SEQ ID NO: 2177148 - DNA, 22 bp, Homo sapiens
agtatggtgagagaagcctgtg

SEQ ID NO: 2177149 - DNA, 12 bp, Homo sapiens
agtatgtgtcta

SEQ ID NO: 2177150 - DNA, 13 bp, Homo sapiens
agtattacacatt

SEQ ID NO: 2177151 - DNA, 17 bp, Homo sapiens
agtattgtgtaaaggaa

SEQ ID NO: 2177152 - DNA, 15 bp, Homo sapiens
agtcaccctgtggca

SEQ ID NO: 2177153 - DNA, 18 bp, Homo sapiens
agtcatgaagctcagttt

SEQ ID NO: 2177154 - DNA, 19 bp, Homo sapiens
agtcatgaagctcagtttg

SEQ ID NO: 2177155 - DNA, 19 bp, Homo sapiens
agtcattttcacttttaaa

SEQ ID NO: 2177156 - DNA, 20 bp, Homo sapiens
agtccactggggagtgctgg

SEQ ID NO: 2177157 - DNA, 23 bp, Homo sapiens
agtccaggtcgggctcagctctg

SEQ ID NO: 2177158 - DNA, 23 bp, Homo sapiens
agtcccaccggttgcttctggga

SEQ ID NO: 2177159 - DNA, 20 bp, Homo sapiens
agtcccatgaatacacaact

SEQ ID NO: 2177160 - DNA, 13 bp, Homo sapiens
agtccgtgggacg

SEQ ID NO: 2177161 - DNA, 23 bp, Homo sapiens
agtccgtgggacgggatggttct

SEQ ID NO: 2177162 - DNA, 13 bp, Homo sapiens
agtcctccctgct

SEQ ID NO: 2177163 - DNA, 14 bp, Homo sapiens
agtcctccctgctc

SEQ ID NO: 2177164 - DNA, 17 bp, Homo sapiens
agtcctccctgctcagc

SEQ ID NO: 2177165 - DNA, 14 bp, Homo sapiens
agtcctgaggcaga

SEQ ID NO: 2177166 - DNA, 19 bp, Homo sapiens
agtctctcttacccttctg

SEQ ID NO: 2177167 - DNA, 21 bp, Homo sapiens
agtctgtcacccaggctggag

SEQ ID NO: 2177168 - DNA, 14 bp, Homo sapiens
agtctgtgcctgga

SEQ ID NO: 2177169 - DNA, 21 bp, Homo sapiens
agtctgtgcctggagctcctg

SEQ ID NO: 2177170 - DNA, 20 bp, Homo sapiens
agtcttcaagggctgcttca

SEQ ID NO: 2177171 - DNA, 14 bp, Homo sapiens
agtcttccatcagc

SEQ ID NO: 2177172 - DNA, 20 bp, Homo sapiens
agtcttccatcagcagtgat

SEQ ID NO: 2177173 - DNA, 22 bp, Homo sapiens
agtcttccctagggctgggtgt

SEQ ID NO: 2177174 - DNA, 23 bp, Homo sapiens
agtctttgtaagtaaactgccct

SEQ ID NO: 2177175 - DNA, 21 bp, Homo sapiens
agtgaaataatattgatttct

SEQ ID NO: 2177176 - DNA, 21 bp, Homo sapiens
agtgaagtatgcactaatcaa

SEQ ID NO: 2177177 - DNA, 20 bp, Homo sapiens
agtgaatgagtttccagcta

SEQ ID NO: 2177178 - DNA, 22 bp, Homo sapiens
agtgactcctgctggtacctgc

SEQ ID NO: 2177179 - DNA, 14 bp, Homo sapiens
agtgagcagggttc

SEQ ID NO: 2177180 - DNA, 20 bp, Homo sapiens
agtgagctcaggagagagct

SEQ ID NO: 2177181 - DNA, 15 bp, Homo sapiens
agtgatcctcctgtc

SEQ ID NO: 2177182 - DNA, 20 bp, Homo sapiens
agtgatggcattactctgca

SEQ ID NO: 2177183 - DNA, 13 bp, Homo sapiens
agtgatttgctat

SEQ ID NO: 2177184 - DNA, 15 bp, Homo sapiens
agtgcaaagctgctt

SEQ ID NO: 2177185 - DNA, 17 bp, Homo sapiens
agtgcaaagctgcttga

SEQ ID NO: 2177186 - DNA, 15 bp, Homo sapiens
agtgcaaagtgccct

SEQ ID NO: 2177187 - DNA, 17 bp, Homo sapiens
agtgcaaagtgccctca

SEQ ID NO: 2177188 - DNA, 15 bp, Homo sapiens
agtgcaatttcttct

SEQ ID NO: 2177189 - DNA, 13 bp, Homo sapiens
agtgcactggcag

SEQ ID NO: 2177190 - DNA, 17 bp, Homo sapiens
agtgcagtcaccctgtg

SEQ ID NO: 2177191 - DNA, 23 bp, Homo sapiens
agtgcccagtgatggcattactc

SEQ ID NO: 2177192 - DNA, 16 bp, Homo sapiens
agtgccccacctgcca

SEQ ID NO: 2177193 - DNA, 20 bp, Homo sapiens
agtgctaagattacaggcgt

SEQ ID NO: 2177194 - DNA, 17 bp, Homo sapiens
agtgctagccactggaa

SEQ ID NO: 2177195 - DNA, 19 bp, Homo sapiens
agtgctgagattacaggtg

SEQ ID NO: 2177196 - DNA, 20 bp, Homo sapiens
agtgctgggattacaggtgt

SEQ ID NO: 2177197 - DNA, 22 bp, Homo sapiens
agtgcttttaaactggagaggc

SEQ ID NO: 2177198 - DNA, 19 bp, Homo sapiens
agtgcttttaagtgaaaat

SEQ ID NO: 2177199 - DNA, 23 bp, Homo sapiens
agtgcttttaagtgaaaatggtc

SEQ ID NO: 2177200 - DNA, 20 bp, Homo sapiens
agtggaaagattgtgtctgg

SEQ ID NO: 2177201 - DNA, 16 bp, Homo sapiens
agtggactgtgtccct

SEQ ID NO: 2177202 - DNA, 13 bp, Homo sapiens
agtggaggcattg

SEQ ID NO: 2177203 - DNA, 19 bp, Homo sapiens
agtggccagaccagagctc

SEQ ID NO: 2177204 - DNA, 13 bp, Homo sapiens
agtggcctggctc

SEQ ID NO: 2177205 - DNA, 15 bp, Homo sapiens
agtgggagaggaagc

SEQ ID NO: 2177206 - DNA, 17 bp, Homo sapiens
agtgggagaggaagcca

SEQ ID NO: 2177207 - DNA, 20 bp, Homo sapiens
agtgggccccgggctggaga

SEQ ID NO: 2177208 - DNA, 21 bp, Homo sapiens
agtgggccccgggctggagaa

SEQ ID NO: 2177209 - DNA, 18 bp, Homo sapiens
agtggggagacacctcag

SEQ ID NO: 2177210 - DNA, 20 bp, Homo sapiens
agtggggagacacctcagag

SEQ ID NO: 2177211 - DNA, 15 bp, Homo sapiens
agtggtacaggaagg

SEQ ID NO: 2177212 - DNA, 15 bp, Homo sapiens
agtggtctatttctc

SEQ ID NO: 2177213 - DNA, 17 bp, Homo sapiens
agtggtgttttttttcc

SEQ ID NO: 2177214 - DNA, 14 bp, Homo sapiens
agtggttgcctggg

SEQ ID NO: 2177215 - DNA, 21 bp, Homo sapiens
agtgtatctcgaagtcttcca

SEQ ID NO: 2177216 - DNA, 13 bp, Homo sapiens
agtgtcacctgca

SEQ ID NO: 2177217 - DNA, 20 bp, Homo sapiens
agtgtcatccaccagtgtgt

SEQ ID NO: 2177218 - DNA, 13 bp, Homo sapiens
agtgtgaagcctg

SEQ ID NO: 2177219 - DNA, 17 bp, Homo sapiens
agtgtgccaccctctgc

SEQ ID NO: 2177220 - DNA, 20 bp, Homo sapiens
agtgtgccaccctctgcagg

SEQ ID NO: 2177221 - DNA, 21 bp, Homo sapiens
agtgtgccaccctctgcaggg

SEQ ID NO: 2177222 - DNA, 19 bp, Homo sapiens
agtgtggaaaaaaaaagaa

SEQ ID NO: 2177223 - DNA, 20 bp, Homo sapiens
agtgtgttttggtatgcact

SEQ ID NO: 2177224 - DNA, 16 bp, Homo sapiens
agtgtttaaaaaatga

SEQ ID NO: 2177225 - DNA, 12 bp, Homo sapiens
agtgtttttcct

SEQ ID NO: 2177226 - DNA, 22 bp, Homo sapiens
agtgtttttcctgtgtattaaa

SEQ ID NO: 2177227 - DNA, 21 bp, Homo sapiens
agttacaccgttgttgtttta

SEQ ID NO: 2177228 - DNA, 17 bp, Homo sapiens
agttacagggcccaggt

SEQ ID NO: 2177229 - DNA, 18 bp, Homo sapiens
agttacgttgcatccaca

SEQ ID NO: 2177230 - DNA, 19 bp, Homo sapiens
agttattagaacttagttt

SEQ ID NO: 2177231 - DNA, 20 bp, Homo sapiens
agttcaggatttggtttttc

SEQ ID NO: 2177232 - DNA, 22 bp, Homo sapiens
agttcatgttgctcagaagaga

SEQ ID NO: 2177233 - DNA, 13 bp, Homo sapiens
agttctaaaaaga

SEQ ID NO: 2177234 - DNA, 12 bp, Homo sapiens
agttctgaaggt

SEQ ID NO: 2177235 - DNA, 21 bp, Homo sapiens
agttgaggggcttccctctgc

SEQ ID NO: 2177236 - DNA, 17 bp, Homo sapiens
agttgataacccctctt

SEQ ID NO: 2177237 - DNA, 20 bp, Homo sapiens
agttggcgttgtgggcaggc

SEQ ID NO: 2177238 - DNA, 17 bp, Homo sapiens
agttgggattacaggtg

SEQ ID NO: 2177239 - DNA, 12 bp, Homo sapiens
agttgtaaagta

SEQ ID NO: 2177240 - DNA, 18 bp, Homo sapiens
agttgtaaagtatgtatt

SEQ ID NO: 2177241 - DNA, 19 bp, Homo sapiens
agttgtatttaacagaaat

SEQ ID NO: 2177242 - DNA, 20 bp, Homo sapiens
agttgtatttaacagaaatt

SEQ ID NO: 2177243 - DNA, 19 bp, Homo sapiens
agttgttagtgatttgcta

SEQ ID NO: 2177244 - DNA, 13 bp, Homo sapiens
agttgttgaaagt

SEQ ID NO: 2177245 - DNA, 14 bp, Homo sapiens
agtttcagtaatag

SEQ ID NO: 2177246 - DNA, 14 bp, Homo sapiens
agtttctttagaaa

SEQ ID NO: 2177247 - DNA, 11 bp, Homo sapiens
agtttgaggcc

SEQ ID NO: 2177248 - DNA, 20 bp, Homo sapiens
agtttgtttcttgtgtgttt

SEQ ID NO: 2177249 - DNA, 18 bp, Homo sapiens
agttttattttaaattat

SEQ ID NO: 2177250 - DNA, 19 bp, Homo sapiens
agttttccaaactgtgtca

SEQ ID NO: 2177251 - DNA, 18 bp, Homo sapiens
agttttgtgtacagtatg

SEQ ID NO: 2177252 - DNA, 20 bp, Homo sapiens
agttttgtgtacagtatgtg

SEQ ID NO: 2177253 - DNA, 15 bp, Homo sapiens
agttttgttccaaca

SEQ ID NO: 2177254 - DNA, 16 bp, Homo sapiens
agtttttatgagaaac

SEQ ID NO: 2177255 - DNA, 14 bp, Homo sapiens
ataaaaaacattca

SEQ ID NO: 2177256 - DNA, 15 bp, Homo sapiens
ataaaaatttattat

SEQ ID NO: 2177257 - DNA, 17 bp, Homo sapiens
ataaaacccagcatgta

SEQ ID NO: 2177258 - DNA, 14 bp, Homo sapiens
ataaaacttatctg

SEQ ID NO: 2177259 - DNA, 12 bp, Homo sapiens
ataaaatacata

SEQ ID NO: 2177260 - DNA, 21 bp, Homo sapiens
ataaaccttatgaactacagt

SEQ ID NO: 2177261 - DNA, 14 bp, Homo sapiens
ataaagcagtattt

SEQ ID NO: 2177262 - DNA, 16 bp, Homo sapiens
ataaagtaaattgaaa

SEQ ID NO: 2177263 - DNA, 21 bp, Homo sapiens
atggtgagagaagcctgtgcc

SEQ ID NO: 2177264 - DNA, 13 bp, Homo sapiens
atggtgcctctgg

SEQ ID NO: 2177265 - DNA, 19 bp, Homo sapiens
atggtgtcttgatatattt

SEQ ID NO: 2177266 - DNA, 13 bp, Homo sapiens
atggttactcatt

SEQ ID NO: 2177267 - DNA, 20 bp, Homo sapiens
atgtaaacagtgagaaaaga

SEQ ID NO: 2177268 - DNA, 15 bp, Homo sapiens
atgtaacttcctctt

SEQ ID NO: 2177269 - DNA, 18 bp, Homo sapiens
atgtaatatatcctgaaa

SEQ ID NO: 2177270 - DNA, 22 bp, Homo sapiens
atgtaatctgattttcaaaaat

SEQ ID NO: 2177271 - DNA, 22 bp, Homo sapiens
atgtactctactgatatctaaa

SEQ ID NO: 2177272 - DNA, 13 bp, Homo sapiens
atgtacttccagt

SEQ ID NO: 2177273 - DNA, 14 bp, Homo sapiens
atgtagaagaggga

SEQ ID NO: 2177274 - DNA, 15 bp, Homo sapiens
atgtagccagacagt

SEQ ID NO: 2177275 - DNA, 14 bp, Homo sapiens
atgtatattactga

SEQ ID NO: 2177276 - DNA, 19 bp, Homo sapiens
atgtattaacctacctgtg

SEQ ID NO: 2177277 - DNA, 23 bp, Homo sapiens
atgtattaacctacctgtgaatc

SEQ ID NO: 2177278 - DNA, 18 bp, Homo sapiens
atgtattagtagagcaac

SEQ ID NO: 2177279 - DNA, 19 bp, Homo sapiens
atgtcaaccttgtgtgagt

SEQ ID NO: 2177280 - DNA, 17 bp, Homo sapiens
atgtcaactgacctaaa

SEQ ID NO: 2177281 - DNA, 15 bp, Homo sapiens
atgtcagttgaaaat

SEQ ID NO: 2177282 - DNA, 12 bp, Homo sapiens
atgtcatcttga

SEQ ID NO: 2177283 - DNA, 21 bp, Homo sapiens
atgtcatgtaggttgtctaaa

SEQ ID NO: 2177284 - DNA, 18 bp, Homo sapiens
atgtccaaacccatcttc

SEQ ID NO: 2177285 - DNA, 12 bp, Homo sapiens
atgtccaggaaa

SEQ ID NO: 2177286 - DNA, 20 bp, Homo sapiens
atgtcgtggacacacacaga

SEQ ID NO: 2177287 - DNA, 15 bp, Homo sapiens
atgtctggtaaatag

SEQ ID NO: 2177288 - DNA, 15 bp, Homo sapiens
atgtgccaccaacat

SEQ ID NO: 2177289 - DNA, 16 bp, Homo sapiens
atgtggtggtttctat

SEQ ID NO: 2177290 - DNA, 17 bp, Homo sapiens
atgtgtactttattgat

SEQ ID NO: 2177291 - DNA, 19 bp, Homo sapiens
atgtgtggtttataatctg

SEQ ID NO: 2177292 - DNA, 20 bp, Homo sapiens
atgtgtttataattgttata

SEQ ID NO: 2177293 - DNA, 13 bp, Homo sapiens
atgttaaatgcaa

SEQ ID NO: 2177294 - DNA, 15 bp, Homo sapiens
atgttaggctgggcc

SEQ ID NO: 2177295 - DNA, 20 bp, Homo sapiens
atgttagttttgctccttct

SEQ ID NO: 2177296 - DNA, 20 bp, Homo sapiens
atgttcaagtattgttaatg

SEQ ID NO: 2177297 - DNA, 14 bp, Homo sapiens
atgttcccttctcc

SEQ ID NO: 2177298 - DNA, 22 bp, Homo sapiens
atgttctatttcagtgccaata

SEQ ID NO: 2177299 - DNA, 14 bp, Homo sapiens
atgttgctgacttt

SEQ ID NO: 2177300 - DNA, 17 bp, Homo sapiens
attaaaaaaaaaacttc

SEQ ID NO: 2177301 - DNA, 14 bp, Homo sapiens
attaaaaaaaaaga

SEQ ID NO: 2177302 - DNA, 12 bp, Homo sapiens
attaaaatcaca

SEQ ID NO: 2177303 - DNA, 16 bp, Homo sapiens
attaaaatcacaaact

SEQ ID NO: 2177304 - DNA, 18 bp, Homo sapiens
attaaaatcacaaactca

SEQ ID NO: 2177305 - DNA, 16 bp, Homo sapiens
attaaagaaaattgcc

SEQ ID NO: 2177306 - DNA, 15 bp, Homo sapiens
attaaaggtgaaaat

SEQ ID NO: 2177307 - DNA, 22 bp, Homo sapiens
attaaatatttcttaagtataa

SEQ ID NO: 2177308 - DNA, 18 bp, Homo sapiens
attaaatcagttttgtgt

SEQ ID NO: 2177309 - DNA, 14 bp, Homo sapiens
attaacacactgaa

SEQ ID NO: 2177310 - DNA, 17 bp, Homo sapiens
attaacacactgaaccg

SEQ ID NO: 2177311 - DNA, 17 bp, Homo sapiens
attaatataagtttctt

SEQ ID NO: 2177312 - DNA, 14 bp, Homo sapiens
attaattattgaaa

SEQ ID NO: 2177313 - DNA, 17 bp, Homo sapiens
attaattctttatcaca

SEQ ID NO: 2177314 - DNA, 22 bp, Homo sapiens
attaattctttatcacatgttg

SEQ ID NO: 2177315 - DNA, 19 bp, Homo sapiens
attaatttatatttgtctc

SEQ ID NO: 2177316 - DNA, 17 bp, Homo sapiens
attaatttatgcagaga

SEQ ID NO: 2177317 - DNA, 13 bp, Homo sapiens
attaatttctctc

SEQ ID NO: 2177318 - DNA, 17 bp, Homo sapiens
attaatttgttaattaa

SEQ ID NO: 2177319 - DNA, 14 bp, Homo sapiens
attacaagtttcag

SEQ ID NO: 2177320 - DNA, 20 bp, Homo sapiens
attactgtttgtcttctccc

SEQ ID NO: 2177321 - DNA, 15 bp, Homo sapiens
attagaacttgaata

SEQ ID NO: 2177322 - DNA, 21 bp, Homo sapiens
attagaagatattagtcttgg

SEQ ID NO: 2177323 - DNA, 12 bp, Homo sapiens
attagagaaagt

SEQ ID NO: 2177324 - DNA, 21 bp, Homo sapiens
attagatgactgaatttctat

SEQ ID NO: 2177325 - DNA, 23 bp, Homo sapiens
attagtaaaacacaagacttcag

SEQ ID NO: 2177326 - DNA, 14 bp, Homo sapiens
attataatcttata

SEQ ID NO: 2177327 - DNA, 16 bp, Homo sapiens
attatacaaaaaaaag

SEQ ID NO: 2177328 - DNA, 19 bp, Homo sapiens
attatataactgtatttga

SEQ ID NO: 2177329 - DNA, 15 bp, Homo sapiens
attatgttcaatgaa

SEQ ID NO: 2177330 - DNA, 22 bp, Homo sapiens
attattaaatcagttttgtgta

SEQ ID NO: 2177331 - DNA, 12 bp, Homo sapiens
attattgagttc

SEQ ID NO: 2177332 - DNA, 17 bp, Homo sapiens
attattgagttctgaag

SEQ ID NO: 2177333 - DNA, 21 bp, Homo sapiens
attcaaacaattcaatcaaag

SEQ ID NO: 2177334 - DNA, 12 bp, Homo sapiens
attcaaagatga

SEQ ID NO: 2177335 - DNA, 14 bp, Homo sapiens
attcaatcaaagct

SEQ ID NO: 2177336 - DNA, 16 bp, Homo sapiens
attcaatcaaagctac

SEQ ID NO: 2177337 - DNA, 21 bp, Homo sapiens
attcactaggctcgtgtttgc

SEQ ID NO: 2177338 - DNA, 20 bp, Homo sapiens
attcacttgtgtttgtatat

SEQ ID NO: 2177339 - DNA, 15 bp, Homo sapiens
attcagctctggaga

SEQ ID NO: 2177340 - DNA, 16 bp, Homo sapiens
attcagctctggagaa

SEQ ID NO: 2177341 - DNA, 17 bp, Homo sapiens
attcagctctggagaac

SEQ ID NO: 2177342 - DNA, 21 bp, Homo sapiens
attcagctctggagaacagtg

SEQ ID NO: 2177343 - DNA, 18 bp, Homo sapiens
attcaggaacctggacca

SEQ ID NO: 2177344 - DNA, 19 bp, Homo sapiens
attcaggaacctggaccaa

SEQ ID NO: 2177345 - DNA, 16 bp, Homo sapiens
attcagtgcattttca

SEQ ID NO: 2177346 - DNA, 14 bp, Homo sapiens
attcatacctgttg

SEQ ID NO: 2177347 - DNA, 22 bp, Homo sapiens
attcattcctgatggaattgtt

SEQ ID NO: 2177348 - DNA, 12 bp, Homo sapiens
attccaatacat

SEQ ID NO: 2177349 - DNA, 14 bp, Homo sapiens
attccaatacatta

SEQ ID NO: 2177350 - DNA, 18 bp, Homo sapiens
attccacccctccttccc

SEQ ID NO: 2177351 - DNA, 21 bp, Homo sapiens
attccacccctccttccctgg

SEQ ID NO: 2177352 - DNA, 20 bp, Homo sapiens
attccagttgcgtgtctgtt

SEQ ID NO: 2177353 - DNA, 18 bp, Homo sapiens
attccattttgtgtctgt

SEQ ID NO: 2177354 - DNA, 17 bp, Homo sapiens
attccctacaattcaca

SEQ ID NO: 2177355 - DNA, 18 bp, Homo sapiens
attcgcagtgcccagtga

SEQ ID NO: 2177356 - DNA, 13 bp, Homo sapiens
attctacttttaa

SEQ ID NO: 2177357 - DNA, 20 bp, Homo sapiens
attctatgactgaagtactg

SEQ ID NO: 2177358 - DNA, 24 bp, Homo sapiens
attctctccagtgtgtgtaacagg

SEQ ID NO: 2177359 - DNA, 14 bp, Homo sapiens
attctctgtccagg

SEQ ID NO: 2177360 - DNA, 17 bp, Homo sapiens
attctctgtccagggct

SEQ ID NO: 2177361 - DNA, 21 bp, Homo sapiens
attctctgtccagggcttcag

SEQ ID NO: 2177362 - DNA, 16 bp, Homo sapiens
attctcttgaataaag

SEQ ID NO: 2177363 - DNA, 22 bp, Homo sapiens
attctctttctttttctgtctc

SEQ ID NO: 2177364 - DNA, 15 bp, Homo sapiens
attcttcggaggagg

SEQ ID NO: 2177365 - DNA, 15 bp, Homo sapiens
attcttcttctcaag

SEQ ID NO: 2177366 - DNA, 21 bp, Homo sapiens
attcttgattttcaagctttc

SEQ ID NO: 2177367 - DNA, 21 bp, Homo sapiens
attcttgtattcctgattaac

SEQ ID NO: 2177368 - DNA, 15 bp, Homo sapiens
attctttccatgcag

SEQ ID NO: 2177369 - DNA, 22 bp, Homo sapiens
attgaaaatgtccaggaaagtg

SEQ ID NO: 2177370 - DNA, 17 bp, Homo sapiens
attgaagtgtttaaaag

SEQ ID NO: 2177371 - DNA, 22 bp, Homo sapiens
attgaagtgtttaaaagagcca

SEQ ID NO: 2177372 - DNA, 19 bp, Homo sapiens
attgacaaggtagacatgg

SEQ ID NO: 2177373 - DNA, 13 bp, Homo sapiens
attgagttctgaa

SEQ ID NO: 2177374 - DNA, 15 bp, Homo sapiens
attgatttctgcctt

SEQ ID NO: 2177375 - DNA, 18 bp, Homo sapiens
attgcaaagggacattga

SEQ ID NO: 2177376 - DNA, 20 bp, Homo sapiens
attgcaaagggacattgaag

SEQ ID NO: 2177377 - DNA, 18 bp, Homo sapiens
attgcaaggtcactttgc

SEQ ID NO: 2177378 - DNA, 15 bp, Homo sapiens
attgcacgtgcaata

SEQ ID NO: 2177379 - DNA, 12 bp, Homo sapiens
attgccaaaata

SEQ ID NO: 2177380 - DNA, 19 bp, Homo sapiens
attgctctggaagcctgct

SEQ ID NO: 2177381 - DNA, 21 bp, Homo sapiens
attgctctggaagcctgctga

SEQ ID NO: 2177382 - DNA, 23 bp, Homo sapiens
attggacttccatttggaatcat

SEQ ID NO: 2177383 - DNA, 15 bp, Homo sapiens
attggagtcctggtt

SEQ ID NO: 2177384 - DNA, 17 bp, Homo sapiens
attggccgatgagctgg

SEQ ID NO: 2177385 - DNA, 20 bp, Homo sapiens
cagcctcaataagccttgtc

SEQ ID NO: 2177386 - DNA, 21 bp, Homo sapiens
cagcctcgaactcctgggctc

SEQ ID NO: 2177387 - DNA, 13 bp, Homo sapiens
cagcctctggcca

SEQ ID NO: 2177388 - DNA, 23 bp, Homo sapiens
cagcctgtcttcagatcctgctg

SEQ ID NO: 2177389 - DNA, 16 bp, Homo sapiens
cagcctgtgggagaag

SEQ ID NO: 2177390 - DNA, 12 bp, Homo sapiens
cagcctttcttc

SEQ ID NO: 2177391 - DNA, 17 bp, Homo sapiens
cagcgggcggaggggat

SEQ ID NO: 2177392 - DNA, 16 bp, Homo sapiens
cagcgggtaaaaagag

SEQ ID NO: 2177393 - DNA, 23 bp, Homo sapiens
cagcggtggaaggagcctgcggc

SEQ ID NO: 2177394 - DNA, 21 bp, Homo sapiens
cagcggttgtaaatacaattc

SEQ ID NO: 2177395 - DNA, 18 bp, Homo sapiens
cagctaagcctgatgatg

SEQ ID NO: 2177396 - DNA, 14 bp, Homo sapiens
cagctatttctcat

SEQ ID NO: 2177397 - DNA, 18 bp, Homo sapiens
cagctcacggcagcctca

SEQ ID NO: 2177398 - DNA, 14 bp, Homo sapiens
cagctcagccagtg

SEQ ID NO: 2177399 - DNA, 15 bp, Homo sapiens
cagctccgcctggca

SEQ ID NO: 2177400 - DNA, 17 bp, Homo sapiens
cagctccgcctggcacc

SEQ ID NO: 2177401 - DNA, 23 bp, Homo sapiens
cagctccgcctggcacccactcc

SEQ ID NO: 2177402 - DNA, 13 bp, Homo sapiens
cagctccttgtga

SEQ ID NO: 2177403 - DNA, 16 bp, Homo sapiens
cagctctggagaacag

SEQ ID NO: 2177404 - DNA, 22 bp, Homo sapiens
cagctgacttggttctgaagcc

SEQ ID NO: 2177405 - DNA, 15 bp, Homo sapiens
cagctgagctggcct

SEQ ID NO: 2177406 - DNA, 14 bp, Homo sapiens
cagctgcaggtgcc

SEQ ID NO: 2177407 - DNA, 16 bp, Homo sapiens
cagctgcaggtgccca

SEQ ID NO: 2177408 - DNA, 23 bp, Homo sapiens
cagctgctccgaggacccaggaa

SEQ ID NO: 2177409 - DNA, 15 bp, Homo sapiens
cagctgctctgccca

SEQ ID NO: 2177410 - DNA, 21 bp, Homo sapiens
cagctggccgggttggaggcc

SEQ ID NO: 2177411 - DNA, 23 bp, Homo sapiens
cagctggggcccctcggctaccc

SEQ ID NO: 2177412 - DNA, 20 bp, Homo sapiens
cagcttcaaataaagtaaat

SEQ ID NO: 2177413 - DNA, 20 bp, Homo sapiens
cagcttctgtcctcttctgt

SEQ ID NO: 2177414 - DNA, 14 bp, Homo sapiens
cagcttgctgcacc

SEQ ID NO: 2177415 - DNA, 14 bp, Homo sapiens
cagctttcctgggt

SEQ ID NO: 2177416 - DNA, 16 bp, Homo sapiens
cagctttcctgggtga

SEQ ID NO: 2177417 - DNA, 18 bp, Homo sapiens
cagcttttagtacccacc

SEQ ID NO: 2177418 - DNA, 19 bp, Homo sapiens
cagcttttagtacccacct

SEQ ID NO: 2177419 - DNA, 21 bp, Homo sapiens
cagcttttagtacccacctga

SEQ ID NO: 2177420 - DNA, 23 bp, Homo sapiens
cagcttttagtacccacctgagc

SEQ ID NO: 2177421 - DNA, 18 bp, Homo sapiens
caggaaagcgtttggaaa

SEQ ID NO: 2177422 - DNA, 15 bp, Homo sapiens
caggaaaggaagatg

SEQ ID NO: 2177423 - DNA, 19 bp, Homo sapiens
caggaacctggaccaaagc

SEQ ID NO: 2177424 - DNA, 19 bp, Homo sapiens
caggaagctttttgtatta

SEQ ID NO: 2177425 - DNA, 17 bp, Homo sapiens
caggaattcagtgcctt

SEQ ID NO: 2177426 - DNA, 15 bp, Homo sapiens
caggacagcatggtg

SEQ ID NO: 2177427 - DNA, 19 bp, Homo sapiens
caggacagcatggtgcatg

SEQ ID NO: 2177428 - DNA, 14 bp, Homo sapiens
caggacagctgcag

SEQ ID NO: 2177429 - DNA, 16 bp, Homo sapiens
caggacagctgcaggt

SEQ ID NO: 2177430 - DNA, 19 bp, Homo sapiens
caggacagctgcaggtgcc

SEQ ID NO: 2177431 - DNA, 13 bp, Homo sapiens
caggaccctcagg

SEQ ID NO: 2177432 - DNA, 19 bp, Homo sapiens
caggagcattttgtgtctt

SEQ ID NO: 2177433 - DNA, 21 bp, Homo sapiens
caggaggagggcgcatgtgtg

SEQ ID NO: 2177434 - DNA, 14 bp, Homo sapiens
caggaggcagggtt

SEQ ID NO: 2177435 - DNA, 17 bp, Homo sapiens
caggaggccgttgcaga

SEQ ID NO: 2177436 - DNA, 12 bp, Homo sapiens
caggatttggtt

SEQ ID NO: 2177437 - DNA, 20 bp, Homo sapiens
caggcaatgactgcgcagag

SEQ ID NO: 2177438 - DNA, 21 bp, Homo sapiens
caggcaatgactgcgcagagt

SEQ ID NO: 2177439 - DNA, 23 bp, Homo sapiens
caggcaatgactgcgcagagtgg

SEQ ID NO: 2177440 - DNA, 18 bp, Homo sapiens
caggcaccccctggcttg

SEQ ID NO: 2177441 - DNA, 20 bp, Homo sapiens
caggcacctctaatcagacc

SEQ ID NO: 2177442 - DNA, 17 bp, Homo sapiens
caggcagccttgaccac

SEQ ID NO: 2177443 - DNA, 18 bp, Homo sapiens
caggccaaagacctccca

SEQ ID NO: 2177444 - DNA, 23 bp, Homo sapiens
caggcccacctaccttcaaagct

SEQ ID NO: 2177445 - DNA, 16 bp, Homo sapiens
caggcccagctggggc

SEQ ID NO: 2177446 - DNA, 17 bp, Homo sapiens
caggcccagctggggcc

SEQ ID NO: 2177447 - DNA, 12 bp, Homo sapiens
caggcctttcct

SEQ ID NO: 2177448 - DNA, 17 bp, Homo sapiens
caggctctgcacagaca

SEQ ID NO: 2177449 - DNA, 13 bp, Homo sapiens
caggctgagtgca

SEQ ID NO: 2177450 - DNA, 20 bp, Homo sapiens
caggctgagtgcactggcag

SEQ ID NO: 2177451 - DNA, 18 bp, Homo sapiens
caggctgcggtgggcagc

SEQ ID NO: 2177452 - DNA, 20 bp, Homo sapiens
caggctgcggtgggcagcca

SEQ ID NO: 2177453 - DNA, 20 bp, Homo sapiens
caggctggagtgatctcagc

SEQ ID NO: 2177454 - DNA, 18 bp, Homo sapiens
caggctggtatttaacag

SEQ ID NO: 2177455 - DNA, 15 bp, Homo sapiens
caggctggtcttgaa

SEQ ID NO: 2177456 - DNA, 17 bp, Homo sapiens
cagggaaggacaggacc

SEQ ID NO: 2177457 - DNA, 18 bp, Homo sapiens
cagggaaggacaggaccc

SEQ ID NO: 2177458 - DNA, 23 bp, Homo sapiens
cagggaggaattggggtttctgg

SEQ ID NO: 2177459 - DNA, 19 bp, Homo sapiens
cagggataaggcctgtggg

SEQ ID NO: 2177460 - DNA, 18 bp, Homo sapiens
cagggcaccaagcccaca

SEQ ID NO: 2177461 - DNA, 21 bp, Homo sapiens
cagggcaccaagcccacaggt

SEQ ID NO: 2177462 - DNA, 11 bp, Homo sapiens
cagggcagcct

SEQ ID NO: 2177463 - DNA, 20 bp, Homo sapiens
cagggcagcctgtgggagaa

SEQ ID NO: 2177464 - DNA, 21 bp, Homo sapiens
cagggccatctgactgccaag

SEQ ID NO: 2177465 - DNA, 16 bp, Homo sapiens
cagggcctgactttta

SEQ ID NO: 2177466 - DNA, 22 bp, Homo sapiens
cagggcttcagatattttgcac

SEQ ID NO: 2177467 - DNA, 14 bp, Homo sapiens
caggggaggagcct

SEQ ID NO: 2177468 - DNA, 22 bp, Homo sapiens
caggggcctgcagaaggaaaga

SEQ ID NO: 2177469 - DNA, 17 bp, Homo sapiens
caggggctgggcagagg

SEQ ID NO: 2177470 - DNA, 20 bp, Homo sapiens
caggggctttggtggcccct

SEQ ID NO: 2177471 - DNA, 19 bp, Homo sapiens
cagggtaggcaaggctgcc

SEQ ID NO: 2177472 - DNA, 17 bp, Homo sapiens
cagggtagggggcctga

SEQ ID NO: 2177473 - DNA, 20 bp, Homo sapiens
cagggtcctccggggctcag

SEQ ID NO: 2177474 - DNA, 20 bp, Homo sapiens
cagggtcctgctatttccca

SEQ ID NO: 2177475 - DNA, 12 bp, Homo sapiens
cagggtcctgtg

SEQ ID NO: 2177476 - DNA, 13 bp, Homo sapiens
cagggtcctgtgc

SEQ ID NO: 2177477 - DNA, 15 bp, Homo sapiens
cagggtcctgtgcct

SEQ ID NO: 2177478 - DNA, 18 bp, Homo sapiens
cagggtctttgtgtgctg

SEQ ID NO: 2177479 - DNA, 14 bp, Homo sapiens
caggtcccaggttg

SEQ ID NO: 2177480 - DNA, 20 bp, Homo sapiens
caggtcccgagccccctgtc

SEQ ID NO: 2177481 - DNA, 23 bp, Homo sapiens
caggtcccgagccccctgtcctt

SEQ ID NO: 2177482 - DNA, 15 bp, Homo sapiens
caggtcgggctcagc

SEQ ID NO: 2177483 - DNA, 20 bp, Homo sapiens
caggtctgggagaggcagag

SEQ ID NO: 2177484 - DNA, 14 bp, Homo sapiens
caggtgtccccagc

SEQ ID NO: 2177485 - DNA, 18 bp, Homo sapiens
caggtgtccccagcccac

SEQ ID NO: 2177486 - DNA, 17 bp, Homo sapiens
caggttccccaagggcc

SEQ ID NO: 2177487 - DNA, 23 bp, Homo sapiens
caggttctggttagctcagcccc

SEQ ID NO: 2177488 - DNA, 22 bp, Homo sapiens
caggttgatcagtgagctcagg

SEQ ID NO: 2177489 - DNA, 21 bp, Homo sapiens
cagtaaaacaattgtgacagc

SEQ ID NO: 2177490 - DNA, 16 bp, Homo sapiens
cagtaaggcagctctg

SEQ ID NO: 2177491 - DNA, 12 bp, Homo sapiens
cagtaatagctg

SEQ ID NO: 2177492 - DNA, 17 bp, Homo sapiens
cagtacccacctgagct

SEQ ID NO: 2177493 - DNA, 13 bp, Homo sapiens
cagtatgtgtcta

SEQ ID NO: 2177494 - DNA, 14 bp, Homo sapiens
cagtattgtgtaaa

SEQ ID NO: 2177495 - DNA, 15 bp, Homo sapiens
cagtattgtgtaaag

SEQ ID NO: 2177496 - DNA, 16 bp, Homo sapiens
cagtcacccctgtctg

SEQ ID NO: 2177497 - DNA, 17 bp, Homo sapiens
cagtcacccctgtctgc

SEQ ID NO: 2177498 - DNA, 18 bp, Homo sapiens
cagtcacccctgtctgcg

SEQ ID NO: 2177499 - DNA, 17 bp, Homo sapiens
cagtcaccctgtggcaa

SEQ ID NO: 2177500 - DNA, 21 bp, Homo sapiens
cagtcatttttgtttctacct

SEQ ID NO: 2177501 - DNA, 21 bp, Homo sapiens
cagtcctggggaggtctgagt

SEQ ID NO: 2177502 - DNA, 20 bp, Homo sapiens
cagtcttccctagggctggg

SEQ ID NO: 2177503 - DNA, 18 bp, Homo sapiens
cagtgatggcattactct

SEQ ID NO: 2177504 - DNA, 21 bp, Homo sapiens
cagtgatggcattactctgca

SEQ ID NO: 2177505 - DNA, 22 bp, Homo sapiens
cagtgatggcattactctgcac

SEQ ID NO: 2177506 - DNA, 23 bp, Homo sapiens
ccatattaaaatcacaaactcat

SEQ ID NO: 2177507 - DNA, 15 bp, Homo sapiens
ccatatttattttgt

SEQ ID NO: 2177508 - DNA, 17 bp, Homo sapiens
ccatcaggactcttgtg

SEQ ID NO: 2177509 - DNA, 23 bp, Homo sapiens
ccatcccagccttggcatctaga

SEQ ID NO: 2177510 - DNA, 22 bp, Homo sapiens
ccatcctgtacaagtgctcagt

SEQ ID NO: 2177511 - DNA, 14 bp, Homo sapiens
ccatcctgtcccac

SEQ ID NO: 2177512 - DNA, 24 bp, Homo sapiens
ccatctccctcgaacccacactgc

SEQ ID NO: 2177513 - DNA, 18 bp, Homo sapiens
ccatctctgaacttcagc

SEQ ID NO: 2177514 - DNA, 19 bp, Homo sapiens
ccatctctgaacttcagct

SEQ ID NO: 2177515 - DNA, 14 bp, Homo sapiens
ccatctgactgcca

SEQ ID NO: 2177516 - DNA, 16 bp, Homo sapiens
ccatgagggtgttttt

SEQ ID NO: 2177517 - DNA, 18 bp, Homo sapiens
ccatgattttggccactt

SEQ ID NO: 2177518 - DNA, 16 bp, Homo sapiens
ccatggattcccctgg

SEQ ID NO: 2177519 - DNA, 15 bp, Homo sapiens
ccatggtagactgtg

SEQ ID NO: 2177520 - DNA, 17 bp, Homo sapiens
ccatggtagactgtgac

SEQ ID NO: 2177521 - DNA, 15 bp, Homo sapiens
ccatggtcacagaga

SEQ ID NO: 2177522 - DNA, 16 bp, Homo sapiens
ccatgtagaagaggga

SEQ ID NO: 2177523 - DNA, 19 bp, Homo sapiens
ccatgtagaagagggagaa

SEQ ID NO: 2177524 - DNA, 21 bp, Homo sapiens
ccatgtagaagagggagaagg

SEQ ID NO: 2177525 - DNA, 11 bp, Homo sapiens
ccatgtagcca

SEQ ID NO: 2177526 - DNA, 12 bp, Homo sapiens
ccatgtgctgct

SEQ ID NO: 2177527 - DNA, 14 bp, Homo sapiens
ccatgttgctgact

SEQ ID NO: 2177528 - DNA, 23 bp, Homo sapiens
ccattaaccagggcaccaagccc

SEQ ID NO: 2177529 - DNA, 22 bp, Homo sapiens
ccattattctagggtcttactc

SEQ ID NO: 2177530 - DNA, 17 bp, Homo sapiens
ccattctctccagtgtg

SEQ ID NO: 2177531 - DNA, 23 bp, Homo sapiens
ccatttaaaaatatctgaatata

SEQ ID NO: 2177532 - DNA, 17 bp, Homo sapiens
ccatttccctgaacaga

SEQ ID NO: 2177533 - DNA, 20 bp, Homo sapiens
ccatttcttctgcacaaaga

SEQ ID NO: 2177534 - DNA, 12 bp, Homo sapiens
ccattttaactt

SEQ ID NO: 2177535 - DNA, 15 bp, Homo sapiens
cccaaaacactgtct

SEQ ID NO: 2177536 - DNA, 12 bp, Homo sapiens
cccaaagagctg

SEQ ID NO: 2177537 - DNA, 16 bp, Homo sapiens
cccaaagagctgccta

SEQ ID NO: 2177538 - DNA, 15 bp, Homo sapiens
cccaacacaatcttt

SEQ ID NO: 2177539 - DNA, 19 bp, Homo sapiens
cccaacgttccacaacagt

SEQ ID NO: 2177540 - DNA, 15 bp, Homo sapiens
cccaactccttcctc

SEQ ID NO: 2177541 - DNA, 20 bp, Homo sapiens
cccaactccttcctctttgc

SEQ ID NO: 2177542 - DNA, 22 bp, Homo sapiens
cccaagaacagcaggcccacct

SEQ ID NO: 2177543 - DNA, 15 bp, Homo sapiens
cccaagaaggctggg

SEQ ID NO: 2177544 - DNA, 21 bp, Homo sapiens
cccaaggcaaggggtgcctgg

SEQ ID NO: 2177545 - DNA, 15 bp, Homo sapiens
cccaaggccagtctg

SEQ ID NO: 2177546 - DNA, 12 bp, Homo sapiens
cccaagggccct

SEQ ID NO: 2177547 - DNA, 14 bp, Homo sapiens
cccacaagctgtcc

SEQ ID NO: 2177548 - DNA, 20 bp, Homo sapiens
cccacaagctgtccctgcag

SEQ ID NO: 2177549 - DNA, 11 bp, Homo sapiens
cccacactcct

SEQ ID NO: 2177550 - DNA, 13 bp, Homo sapiens
cccacagcttggg

SEQ ID NO: 2177551 - DNA, 17 bp, Homo sapiens
cccacagggcctgactt

SEQ ID NO: 2177552 - DNA, 21 bp, Homo sapiens
cccacagtctctccctggggt

SEQ ID NO: 2177553 - DNA, 16 bp, Homo sapiens
cccacccctccccact

SEQ ID NO: 2177554 - DNA, 14 bp, Homo sapiens
cccaccccttgctc

SEQ ID NO: 2177555 - DNA, 20 bp, Homo sapiens
cccaccccttggaggagaga

SEQ ID NO: 2177556 - DNA, 23 bp, Homo sapiens
cccaccccttggaggagagagac

SEQ ID NO: 2177557 - DNA, 22 bp, Homo sapiens
cccacccgtcttcaatctctgt

SEQ ID NO: 2177558 - DNA, 19 bp, Homo sapiens
cccaccggttgcttctggg

SEQ ID NO: 2177559 - DNA, 23 bp, Homo sapiens
cccacctaagggctaaggcctct

SEQ ID NO: 2177560 - DNA, 20 bp, Homo sapiens
cccacctaccttcaaagctg

SEQ ID NO: 2177561 - DNA, 15 bp, Homo sapiens
cccacctgagctttg

SEQ ID NO: 2177562 - DNA, 17 bp, Homo sapiens
cccacctgagctttgga

SEQ ID NO: 2177563 - DNA, 12 bp, Homo sapiens
cccacggccact

SEQ ID NO: 2177564 - DNA, 18 bp, Homo sapiens
cccacggccactgcagtc

SEQ ID NO: 2177565 - DNA, 12 bp, Homo sapiens
cccactcacaga

SEQ ID NO: 2177566 - DNA, 12 bp, Homo sapiens
cccactctgtgc

SEQ ID NO: 2177567 - DNA, 12 bp, Homo sapiens
cccacttccctg

SEQ ID NO: 2177568 - DNA, 23 bp, Homo sapiens
cccagaagatgtattcagagcca

SEQ ID NO: 2177569 - DNA, 16 bp, Homo sapiens
cccagaggctcctgga

SEQ ID NO: 2177570 - DNA, 18 bp, Homo sapiens
cccagaggctcctggagc

SEQ ID NO: 2177571 - DNA, 21 bp, Homo sapiens
cccagaggtggggaagagagc

SEQ ID NO: 2177572 - DNA, 22 bp, Homo sapiens
cccagaggtggggaagagagcc

SEQ ID NO: 2177573 - DNA, 13 bp, Homo sapiens
cccagcagagccg

SEQ ID NO: 2177574 - DNA, 20 bp, Homo sapiens
cccagcagagccgttcctgg

SEQ ID NO: 2177575 - DNA, 22 bp, Homo sapiens
cccagcagagccgttcctggga

SEQ ID NO: 2177576 - DNA, 17 bp, Homo sapiens
cccagcccagcccagct

SEQ ID NO: 2177577 - DNA, 15 bp, Homo sapiens
cccagcccagctgct

SEQ ID NO: 2177578 - DNA, 20 bp, Homo sapiens
cccagcccagctgctctgcc

SEQ ID NO: 2177579 - DNA, 18 bp, Homo sapiens
cccagctgaaggcagtgg

SEQ ID NO: 2177580 - DNA, 13 bp, Homo sapiens
cccagctgctcct

SEQ ID NO: 2177581 - DNA, 15 bp, Homo sapiens
cccagctgctctgcc

SEQ ID NO: 2177582 - DNA, 17 bp, Homo sapiens
cccagctgctctgccca

SEQ ID NO: 2177583 - DNA, 23 bp, Homo sapiens
cccagctgctctgcccagagctg

SEQ ID NO: 2177584 - DNA, 12 bp, Homo sapiens
cccagctggggc

SEQ ID NO: 2177585 - DNA, 20 bp, Homo sapiens
cccaggcaccccctggcttg

SEQ ID NO: 2177586 - DNA, 16 bp, Homo sapiens
cccaggccactgacct

SEQ ID NO: 2177587 - DNA, 17 bp, Homo sapiens
cccaggctcgtggactg

SEQ ID NO: 2177588 - DNA, 22 bp, Homo sapiens
cccaggctcgtggactgagtgg

SEQ ID NO: 2177589 - DNA, 16 bp, Homo sapiens
cccaggggctttggtg

SEQ ID NO: 2177590 - DNA, 19 bp, Homo sapiens
cccaggtgagctgaagaca

SEQ ID NO: 2177591 - DNA, 23 bp, Homo sapiens
cccaggttcaagcgactctcctg

SEQ ID NO: 2177592 - DNA, 21 bp, Homo sapiens
cccagtcatgacatttctcaa

SEQ ID NO: 2177593 - DNA, 12 bp, Homo sapiens
cccagtgatggc

SEQ ID NO: 2177594 - DNA, 23 bp, Homo sapiens
cccagtgatggcattactctgca

SEQ ID NO: 2177595 - DNA, 24 bp, Homo sapiens
cccatcttgcctccatggtgcctc

SEQ ID NO: 2177596 - DNA, 15 bp, Homo sapiens
ccccaactccttcct

SEQ ID NO: 2177597 - DNA, 19 bp, Homo sapiens
ccccaacttaagtttagaa

SEQ ID NO: 2177598 - DNA, 17 bp, Homo sapiens
ccccaagggccctggca

SEQ ID NO: 2177599 - DNA, 23 bp, Homo sapiens
ccccacaagctgtccctgcaggg

SEQ ID NO: 2177600 - DNA, 16 bp, Homo sapiens
ccccaccccgggctct

SEQ ID NO: 2177601 - DNA, 18 bp, Homo sapiens
ccccaccccttgctctca

SEQ ID NO: 2177602 - DNA, 13 bp, Homo sapiens
ccccacctgccac

SEQ ID NO: 2177603 - DNA, 14 bp, Homo sapiens
ccccacctgccact

SEQ ID NO: 2177604 - DNA, 13 bp, Homo sapiens
ccccactcacaga

SEQ ID NO: 2177605 - DNA, 13 bp, Homo sapiens
ccccactctgtgc

SEQ ID NO: 2177606 - DNA, 11 bp, Homo sapiens
ccccagcccag

SEQ ID NO: 2177607 - DNA, 14 bp, Homo sapiens
ccccagctgctcct

SEQ ID NO: 2177608 - DNA, 15 bp, Homo sapiens
ccccaggctcgtgga

SEQ ID NO: 2177609 - DNA, 18 bp, Homo sapiens
ccccatgagggtgttttt

SEQ ID NO: 2177610 - DNA, 20 bp, Homo sapiens
cccccacaagctgtccctgc

SEQ ID NO: 2177611 - DNA, 21 bp, Homo sapiens
cccccacaagctgtccctgca

SEQ ID NO: 2177612 - DNA, 22 bp, Homo sapiens
cccccacaagctgtccctgcag

SEQ ID NO: 2177613 - DNA, 23 bp, Homo sapiens
cccccacaagctgtccctgcagg

SEQ ID NO: 2177614 - DNA, 15 bp, Homo sapiens
cccccgtctcctgcc

SEQ ID NO: 2177615 - DNA, 12 bp, Homo sapiens
ccccctgtcctt

SEQ ID NO: 2177616 - DNA, 18 bp, Homo sapiens
cccccttgtctgctgctc

SEQ ID NO: 2177617 - DNA, 20 bp, Homo sapiens
ccccgggctggagaaagagc

SEQ ID NO: 2177618 - DNA, 21 bp, Homo sapiens
ccccgggctggagaaagagct

SEQ ID NO: 2177619 - DNA, 20 bp, Homo sapiens
cccctacccccttgtctgct

SEQ ID NO: 2177620 - DNA, 14 bp, Homo sapiens
cccctccccaactc

SEQ ID NO: 2177621 - DNA, 12 bp, Homo sapiens
cccctccccact

SEQ ID NO: 2177622 - DNA, 13 bp, Homo sapiens
cccctcctccctt

SEQ ID NO: 2177623 - DNA, 11 bp, Homo sapiens
cccctcctctc

SEQ ID NO: 2177624 - DNA, 23 bp, Homo sapiens
cccctcctctcccctaccactgt

SEQ ID NO: 2177625 - DNA, 14 bp, Homo sapiens
cccctcggctaccc

SEQ ID NO: 2177626 - DNA, 22 bp, Homo sapiens
cccctcggctaccccccgtctc

SEQ ID NO: 2177627 - DNA, 12 bp, Homo sapiens
cccctgtccttc

SEQ ID NO: 2177628 - DNA, 13 bp, Homo sapiens
cctaactcatact

SEQ ID NO: 2177629 - DNA, 19 bp, Homo sapiens
cctaactctgcccaccctc

SEQ ID NO: 2177630 - DNA, 14 bp, Homo sapiens
cctaactgagctgc

SEQ ID NO: 2177631 - DNA, 14 bp, Homo sapiens
cctaagggctaagg

SEQ ID NO: 2177632 - DNA, 18 bp, Homo sapiens
cctaagtccctgccccct

SEQ ID NO: 2177633 - DNA, 22 bp, Homo sapiens
cctacaaaaaaacctttattct

SEQ ID NO: 2177634 - DNA, 13 bp, Homo sapiens
cctaccactgtct

SEQ ID NO: 2177635 - DNA, 16 bp, Homo sapiens
cctacccacagggcct

SEQ ID NO: 2177636 - DNA, 18 bp, Homo sapiens
cctagcactcacatgctg

SEQ ID NO: 2177637 - DNA, 21 bp, Homo sapiens
cctagccccttagcccccacc

SEQ ID NO: 2177638 - DNA, 22 bp, Homo sapiens
cctagctgggcaaacccttctc

SEQ ID NO: 2177639 - DNA, 17 bp, Homo sapiens
cctagctgtgtgcagtc

SEQ ID NO: 2177640 - DNA, 23 bp, Homo sapiens
cctaggacatgttcccttctcct

SEQ ID NO: 2177641 - DNA, 17 bp, Homo sapiens
cctaggctacccttgcc

SEQ ID NO: 2177642 - DNA, 14 bp, Homo sapiens
cctagggctgggtg

SEQ ID NO: 2177643 - DNA, 15 bp, Homo sapiens
cctagggctgggtgt

SEQ ID NO: 2177644 - DNA, 13 bp, Homo sapiens
cctagtcccttcc

SEQ ID NO: 2177645 - DNA, 23 bp, Homo sapiens
cctatcatcagttaggattaggt

SEQ ID NO: 2177646 - DNA, 19 bp, Homo sapiens
cctatgccacctgcagcgt

SEQ ID NO: 2177647 - DNA, 18 bp, Homo sapiens
cctatgggagtcaagtgt

SEQ ID NO: 2177648 - DNA, 15 bp, Homo sapiens
cctatttattcattc

SEQ ID NO: 2177649 - DNA, 16 bp, Homo sapiens
cctcaaagattctgca

SEQ ID NO: 2177650 - DNA, 16 bp, Homo sapiens
cctcaacctccctggc

SEQ ID NO: 2177651 - DNA, 15 bp, Homo sapiens
cctcacactttgcca

SEQ ID NO: 2177652 - DNA, 23 bp, Homo sapiens
cctcactatttttttgttgctgt

SEQ ID NO: 2177653 - DNA, 14 bp, Homo sapiens
cctcagaatagtga

SEQ ID NO: 2177654 - DNA, 22 bp, Homo sapiens
cctcagaatagtgatgtgttcg

SEQ ID NO: 2177655 - DNA, 22 bp, Homo sapiens
cctcagactcatacagaaggtg

SEQ ID NO: 2177656 - DNA, 15 bp, Homo sapiens
cctcagagccccgca

SEQ ID NO: 2177657 - DNA, 22 bp, Homo sapiens
cctcagcaacctgtaagactga

SEQ ID NO: 2177658 - DNA, 13 bp, Homo sapiens
cctcagtgtgaag

SEQ ID NO: 2177659 - DNA, 21 bp, Homo sapiens
cctcatttcttgaggcttctg

SEQ ID NO: 2177660 - DNA, 15 bp, Homo sapiens
cctccactgccctct

SEQ ID NO: 2177661 - DNA, 16 bp, Homo sapiens
cctccactgccctctg

SEQ ID NO: 2177662 - DNA, 12 bp, Homo sapiens
cctccagaggag

SEQ ID NO: 2177663 - DNA, 20 bp, Homo sapiens
cctccagccacttatttcca

SEQ ID NO: 2177664 - DNA, 21 bp, Homo sapiens
cctccatggtgcctctggagg

SEQ ID NO: 2177665 - DNA, 11 bp, Homo sapiens
cctcccacctt

SEQ ID NO: 2177666 - DNA, 12 bp, Homo sapiens
cctcccctggca

SEQ ID NO: 2177667 - DNA, 16 bp, Homo sapiens
cctccctccctgcagg

SEQ ID NO: 2177668 - DNA, 15 bp, Homo sapiens
cctccctgaccctgc

SEQ ID NO: 2177669 - DNA, 13 bp, Homo sapiens
cctccctgctcag

SEQ ID NO: 2177670 - DNA, 17 bp, Homo sapiens
cctccctgctcagctgg

SEQ ID NO: 2177671 - DNA, 15 bp, Homo sapiens
cctccctggctcaag

SEQ ID NO: 2177672 - DNA, 16 bp, Homo sapiens
cctccggggctcagcc

SEQ ID NO: 2177673 - DNA, 21 bp, Homo sapiens
cctcctccagttctgatgagg

SEQ ID NO: 2177674 - DNA, 13 bp, Homo sapiens
cctcctcccctgg

SEQ ID NO: 2177675 - DNA, 21 bp, Homo sapiens
cctcctcccctggcaactgct

SEQ ID NO: 2177676 - DNA, 14 bp, Homo sapiens
cctcctcccttttt

SEQ ID NO: 2177677 - DNA, 20 bp, Homo sapiens
cctcctgagtagctgagact

SEQ ID NO: 2177678 - DNA, 24 bp, Homo sapiens
cctcctgagtagctgagactacag

SEQ ID NO: 2177679 - DNA, 16 bp, Homo sapiens
cctccttagaaaagac

SEQ ID NO: 2177680 - DNA, 23 bp, Homo sapiens
cctccttatcctacagtacaatc

SEQ ID NO: 2177681 - DNA, 15 bp, Homo sapiens
cctccttctctgtct

SEQ ID NO: 2177682 - DNA, 19 bp, Homo sapiens
cctccttgccgctgggaga

SEQ ID NO: 2177683 - DNA, 16 bp, Homo sapiens
cctcctttctcttctc

SEQ ID NO: 2177684 - DNA, 15 bp, Homo sapiens
cctcgtgaggggcaa

SEQ ID NO: 2177685 - DNA, 23 bp, Homo sapiens
cctcgtgaggggcaagctaggcc

SEQ ID NO: 2177686 - DNA, 18 bp, Homo sapiens
cctctaatgctcacgctc

SEQ ID NO: 2177687 - DNA, 19 bp, Homo sapiens
cctctatttattagccaac

SEQ ID NO: 2177688 - DNA, 14 bp, Homo sapiens
cctctccagctata

SEQ ID NO: 2177689 - DNA, 16 bp, Homo sapiens
cctctgagccactgga

SEQ ID NO: 2177690 - DNA, 17 bp, Homo sapiens
cctctgcagggcagcct

SEQ ID NO: 2177691 - DNA, 20 bp, Homo sapiens
cctctgcagggcagcctgtg

SEQ ID NO: 2177692 - DNA, 12 bp, Homo sapiens
cctctgccccca

SEQ ID NO: 2177693 - DNA, 22 bp, Homo sapiens
cctctgctttctcctttaattg

SEQ ID NO: 2177694 - DNA, 16 bp, Homo sapiens
cctctggaggcctctg

SEQ ID NO: 2177695 - DNA, 20 bp, Homo sapiens
cctctggaggcctctgggcc

SEQ ID NO: 2177696 - DNA, 17 bp, Homo sapiens
cctctggccctgttgtg

SEQ ID NO: 2177697 - DNA, 15 bp, Homo sapiens
cctctgggcctcctc

SEQ ID NO: 2177698 - DNA, 10 bp, Homo sapiens
cctctgggct

SEQ ID NO: 2177699 - DNA, 11 bp, Homo sapiens
cctctgggctt

SEQ ID NO: 2177700 - DNA, 23 bp, Homo sapiens
cctctggggctcagccctgagct

SEQ ID NO: 2177701 - DNA, 20 bp, Homo sapiens
cctctgtgctgcatcccacc

SEQ ID NO: 2177702 - DNA, 16 bp, Homo sapiens
cctctgtttgacaaac

SEQ ID NO: 2177703 - DNA, 21 bp, Homo sapiens
cctctgtttgacaaacctcta

SEQ ID NO: 2177704 - DNA, 23 bp, Homo sapiens
cctcttctgtattttttttttcc

SEQ ID NO: 2177705 - DNA, 13 bp, Homo sapiens
cctcttgaccagg

SEQ ID NO: 2177706 - DNA, 12 bp, Homo sapiens
cctcttgctggt

SEQ ID NO: 2177707 - DNA, 14 bp, Homo sapiens
cctcttgctggtgc

SEQ ID NO: 2177708 - DNA, 15 bp, Homo sapiens
cctcttgctggtgca

SEQ ID NO: 2177709 - DNA, 16 bp, Homo sapiens
cctgacacaatcccta

SEQ ID NO: 2177710 - DNA, 15 bp, Homo sapiens
cctgaccagctgctc

SEQ ID NO: 2177711 - DNA, 21 bp, Homo sapiens
cctgaccagctgctccgagga

SEQ ID NO: 2177712 - DNA, 13 bp, Homo sapiens
cctgaccctgcag

SEQ ID NO: 2177713 - DNA, 17 bp, Homo sapiens
cctgacttttacagctt

SEQ ID NO: 2177714 - DNA, 18 bp, Homo sapiens
cctgacttttacagcttt

SEQ ID NO: 2177715 - DNA, 14 bp, Homo sapiens
cctgagatttacac

SEQ ID NO: 2177716 - DNA, 10 bp, Homo sapiens
cctgagccct

SEQ ID NO: 2177717 - DNA, 17 bp, Homo sapiens
cctgagccggccccagg

SEQ ID NO: 2177718 - DNA, 21 bp, Homo sapiens
cctgaggcccagcagagccgt

SEQ ID NO: 2177719 - DNA, 23 bp, Homo sapiens
cctgagttggcgttgtgggcagg

SEQ ID NO: 2177720 - DNA, 12 bp, Homo sapiens
cctgcagagatg

SEQ ID NO: 2177721 - DNA, 19 bp, Homo sapiens
cctgcatcagcctctggcc

SEQ ID NO: 2177722 - DNA, 17 bp, Homo sapiens
cctgccactaggctggg

SEQ ID NO: 2177723 - DNA, 23 bp, Homo sapiens
cctgcccgccctccctcctgcct

SEQ ID NO: 2177724 - DNA, 19 bp, Homo sapiens
cctgccctctatttattag

SEQ ID NO: 2177725 - DNA, 13 bp, Homo sapiens
cctgccctctctc

SEQ ID NO: 2177726 - DNA, 15 bp, Homo sapiens
cctgccgcctgtgcc

SEQ ID NO: 2177727 - DNA, 15 bp, Homo sapiens
cctgcctcagcctcc

SEQ ID NO: 2177728 - DNA, 19 bp, Homo sapiens
cctgcctcagcctcccgag

SEQ ID NO: 2177729 - DNA, 15 bp, Homo sapiens
cctgcctctgtttga

SEQ ID NO: 2177730 - DNA, 15 bp, Homo sapiens
cctgctcagctggcc

SEQ ID NO: 2177731 - DNA, 20 bp, Homo sapiens
cctgctcagctggccgggtt

SEQ ID NO: 2177732 - DNA, 20 bp, Homo sapiens
cctgctccacagccatccca

SEQ ID NO: 2177733 - DNA, 15 bp, Homo sapiens
cctgctctctaccca

SEQ ID NO: 2177734 - DNA, 17 bp, Homo sapiens
cctgctctctacccagc

SEQ ID NO: 2177735 - DNA, 19 bp, Homo sapiens
cctgctctctacccagccc

SEQ ID NO: 2177736 - DNA, 21 bp, Homo sapiens
cctgctgaatgcctcgctccc

SEQ ID NO: 2177737 - DNA, 16 bp, Homo sapiens
cctgctggggccgcca

SEQ ID NO: 2177738 - DNA, 16 bp, Homo sapiens
cctgctggtacctgcc

SEQ ID NO: 2177739 - DNA, 17 bp, Homo sapiens
cctgcttggggcctggc

SEQ ID NO: 2177740 - DNA, 21 bp, Homo sapiens
cctgcttggggcctggcgtgg

SEQ ID NO: 2177741 - DNA, 22 bp, Homo sapiens
cctgctttgtgcagggtcctcc

SEQ ID NO: 2177742 - DNA, 18 bp, Homo sapiens
cctggaaccagagccaca

SEQ ID NO: 2177743 - DNA, 19 bp, Homo sapiens
cctggaatcgaggctgtgt

SEQ ID NO: 2177744 - DNA, 23 bp, Homo sapiens
cctggaccttggccctacagccc

SEQ ID NO: 2177745 - DNA, 13 bp, Homo sapiens
cctggagctcctg

SEQ ID NO: 2177746 - DNA, 14 bp, Homo sapiens
cctggagctcctgg

SEQ ID NO: 2177747 - DNA, 18 bp, Homo sapiens
cctggagctcctgggaag

SEQ ID NO: 2177748 - DNA, 21 bp, Homo sapiens
cctggaggtctccaggggcct

SEQ ID NO: 2177749 - DNA, 18 bp, Homo sapiens
cctggagtcatgccaagc

SEQ ID NO: 2177750 - DNA, 13 bp, Homo sapiens
ctctgcagggcag

SEQ ID NO: 2177751 - DNA, 18 bp, Homo sapiens
ctctgcagggcagcctgt

SEQ ID NO: 2177752 - DNA, 16 bp, Homo sapiens
ctctgcccagagctgg

SEQ ID NO: 2177753 - DNA, 19 bp, Homo sapiens
ctctgcccccagctgctcc

SEQ ID NO: 2177754 - DNA, 12 bp, Homo sapiens
ctctgctctcct

SEQ ID NO: 2177755 - DNA, 20 bp, Homo sapiens
ctctgctggccgggcacagc

SEQ ID NO: 2177756 - DNA, 22 bp, Homo sapiens
ctctgctggccgggcacagctg

SEQ ID NO: 2177757 - DNA, 13 bp, Homo sapiens
ctctgcttcagct

SEQ ID NO: 2177758 - DNA, 14 bp, Homo sapiens
ctctggaagcctgc

SEQ ID NO: 2177759 - DNA, 22 bp, Homo sapiens
ctctggagccacctgtcccacc

SEQ ID NO: 2177760 - DNA, 22 bp, Homo sapiens
ctctggaggcctctgggcctcc

SEQ ID NO: 2177761 - DNA, 18 bp, Homo sapiens
ctctggagtgtgtggggg

SEQ ID NO: 2177762 - DNA, 13 bp, Homo sapiens
ctctggccagacg

SEQ ID NO: 2177763 - DNA, 15 bp, Homo sapiens
ctctggctcacagac

SEQ ID NO: 2177764 - DNA, 11 bp, Homo sapiens
ctctggctgcc

SEQ ID NO: 2177765 - DNA, 13 bp, Homo sapiens
ctctggctgcctg

SEQ ID NO: 2177766 - DNA, 14 bp, Homo sapiens
ctctggctgcctgg

SEQ ID NO: 2177767 - DNA, 19 bp, Homo sapiens
ctctggctgcctggcccag

SEQ ID NO: 2177768 - DNA, 13 bp, Homo sapiens
ctctggggctcag

SEQ ID NO: 2177769 - DNA, 16 bp, Homo sapiens
ctctggggctcagccc

SEQ ID NO: 2177770 - DNA, 18 bp, Homo sapiens
ctctggggctcagccctg

SEQ ID NO: 2177771 - DNA, 23 bp, Homo sapiens
ctctgtccagggcttcagatatt

SEQ ID NO: 2177772 - DNA, 12 bp, Homo sapiens
ctctgtccccat

SEQ ID NO: 2177773 - DNA, 17 bp, Homo sapiens
ctctgtctaccatctcc

SEQ ID NO: 2177774 - DNA, 14 bp, Homo sapiens
ctctgtctcatgtg

SEQ ID NO: 2177775 - DNA, 16 bp, Homo sapiens
ctctgtctcatgtgtg

SEQ ID NO: 2177776 - DNA, 20 bp, Homo sapiens
ctctgtctcatgtgtgctct

SEQ ID NO: 2177777 - DNA, 13 bp, Homo sapiens
ctctgtgctctga

SEQ ID NO: 2177778 - DNA, 15 bp, Homo sapiens
ctctgtgctctgaat

SEQ ID NO: 2177779 - DNA, 17 bp, Homo sapiens
ctcttagcttacaggaa

SEQ ID NO: 2177780 - DNA, 21 bp, Homo sapiens
ctcttagtcctccctgctcag

SEQ ID NO: 2177781 - DNA, 17 bp, Homo sapiens
ctcttcagtgactcctg

SEQ ID NO: 2177782 - DNA, 14 bp, Homo sapiens
ctcttcccctctca

SEQ ID NO: 2177783 - DNA, 16 bp, Homo sapiens
ctcttcttctgaagat

SEQ ID NO: 2177784 - DNA, 14 bp, Homo sapiens
ctcttgcagagaag

SEQ ID NO: 2177785 - DNA, 17 bp, Homo sapiens
ctcttgcagagaagcct

SEQ ID NO: 2177786 - DNA, 17 bp, Homo sapiens
ctctttctttttctgtc

SEQ ID NO: 2177787 - DNA, 22 bp, Homo sapiens
ctctttctttttctgtctctct

SEQ ID NO: 2177788 - DNA, 19 bp, Homo sapiens
ctctttgtaaggacttgtg

SEQ ID NO: 2177789 - DNA, 12 bp, Homo sapiens
ctcttttcctag

SEQ ID NO: 2177790 - DNA, 14 bp, Homo sapiens
ctgaaacagtgttt

SEQ ID NO: 2177791 - DNA, 15 bp, Homo sapiens
ctgaaagctgcttct

SEQ ID NO: 2177792 - DNA, 13 bp, Homo sapiens
ctgaaattttcta

SEQ ID NO: 2177793 - DNA, 23 bp, Homo sapiens
ctgaacctactgaggagcaaagc

SEQ ID NO: 2177794 - DNA, 17 bp, Homo sapiens
ctgaactcgcttctctg

SEQ ID NO: 2177795 - DNA, 13 bp, Homo sapiens
ctgaactgtgcat

SEQ ID NO: 2177796 - DNA, 21 bp, Homo sapiens
ctgaagacaaaccactgtaca

SEQ ID NO: 2177797 - DNA, 23 bp, Homo sapiens
ctgaagacaaaccactgtacata

SEQ ID NO: 2177798 - DNA, 15 bp, Homo sapiens
ctgaagatcagaaca

SEQ ID NO: 2177799 - DNA, 11 bp, Homo sapiens
ctgaaggcagt

SEQ ID NO: 2177800 - DNA, 15 bp, Homo sapiens
ctgaaggcagtggca

SEQ ID NO: 2177801 - DNA, 16 bp, Homo sapiens
ctgaaggcagtggcag

SEQ ID NO: 2177802 - DNA, 20 bp, Homo sapiens
ctgaaggcagtggcagggga

SEQ ID NO: 2177803 - DNA, 20 bp, Homo sapiens
ctgaaggttggaactgctgc

SEQ ID NO: 2177804 - DNA, 17 bp, Homo sapiens
ctgaagtgaatacatgg

SEQ ID NO: 2177805 - DNA, 14 bp, Homo sapiens
ctgaatatatgatt

SEQ ID NO: 2177806 - DNA, 19 bp, Homo sapiens
ctgaatgcctcgctccctt

SEQ ID NO: 2177807 - DNA, 17 bp, Homo sapiens
ctgaccctgcagagatg

SEQ ID NO: 2177808 - DNA, 12 bp, Homo sapiens
ctgacctcagca

SEQ ID NO: 2177809 - DNA, 13 bp, Homo sapiens
ctgacctcccact

SEQ ID NO: 2177810 - DNA, 13 bp, Homo sapiens
ctgacctgcccct

SEQ ID NO: 2177811 - DNA, 13 bp, Homo sapiens
ctgacgaggctgg

SEQ ID NO: 2177812 - DNA, 15 bp, Homo sapiens
ctgacgaggctgggc

SEQ ID NO: 2177813 - DNA, 17 bp, Homo sapiens
ctgactgccaagccaga

SEQ ID NO: 2177814 - DNA, 18 bp, Homo sapiens
ctgactgccaagccagat

SEQ ID NO: 2177815 - DNA, 20 bp, Homo sapiens
ctgacttggttctgaagcca

SEQ ID NO: 2177816 - DNA, 22 bp, Homo sapiens
ctgacttttacagcttttctct

SEQ ID NO: 2177817 - DNA, 23 bp, Homo sapiens
ctgacttttacagcttttctctt

SEQ ID NO: 2177818 - DNA, 21 bp, Homo sapiens
ctgagaaaacgaaactgctct

SEQ ID NO: 2177819 - DNA, 22 bp, Homo sapiens
ctgagaacagatctccaaagct

SEQ ID NO: 2177820 - DNA, 22 bp, Homo sapiens
ctgagaaggggaggacctctgg

SEQ ID NO: 2177821 - DNA, 13 bp, Homo sapiens
ctgagactacagg

SEQ ID NO: 2177822 - DNA, 16 bp, Homo sapiens
ctgagattacaggtgt

SEQ ID NO: 2177823 - DNA, 23 bp, Homo sapiens
ctgagattacaggtgtgagccac

SEQ ID NO: 2177824 - DNA, 21 bp, Homo sapiens
ctgagcaggggaacaaaataa

SEQ ID NO: 2177825 - DNA, 17 bp, Homo sapiens
ctgagccactggaggaa

SEQ ID NO: 2177826 - DNA, 18 bp, Homo sapiens
ctgagccggccccaggct

SEQ ID NO: 2177827 - DNA, 19 bp, Homo sapiens
ctgagccggccccaggctc

SEQ ID NO: 2177828 - DNA, 17 bp, Homo sapiens
ctgagcggccgcctgtc

SEQ ID NO: 2177829 - DNA, 19 bp, Homo sapiens
ctgagcggccgcctgtcct

SEQ ID NO: 2177830 - DNA, 17 bp, Homo sapiens
ctgagcgggtctagtgg

SEQ ID NO: 2177831 - DNA, 22 bp, Homo sapiens
ctgagcgggtctagtggaaaga

SEQ ID NO: 2177832 - DNA, 13 bp, Homo sapiens
ctgagctgccagt

SEQ ID NO: 2177833 - DNA, 23 bp, Homo sapiens
ctgagctttggacacacacagct

SEQ ID NO: 2177834 - DNA, 22 bp, Homo sapiens
ctgagctttggacgcacacagc

SEQ ID NO: 2177835 - DNA, 15 bp, Homo sapiens
ctgaggcagaacctg

SEQ ID NO: 2177836 - DNA, 16 bp, Homo sapiens
ctgaggcagaacctgg

SEQ ID NO: 2177837 - DNA, 12 bp, Homo sapiens
ctgaggcccagc

SEQ ID NO: 2177838 - DNA, 14 bp, Homo sapiens
ctgaggcccagcag

SEQ ID NO: 2177839 - DNA, 18 bp, Homo sapiens
ctgaggcccagcagagcc

SEQ ID NO: 2177840 - DNA, 22 bp, Homo sapiens
ctgaggcccagcagagccgttc

SEQ ID NO: 2177841 - DNA, 20 bp, Homo sapiens
ctgagtagctgagactacag

SEQ ID NO: 2177842 - DNA, 17 bp, Homo sapiens
ctgagtgcactggcagg

SEQ ID NO: 2177843 - DNA, 15 bp, Homo sapiens
ctgagtgggaagccc

SEQ ID NO: 2177844 - DNA, 16 bp, Homo sapiens
ctgagttgaggggctt

SEQ ID NO: 2177845 - DNA, 20 bp, Homo sapiens
ctgagttgaggggcttccct

SEQ ID NO: 2177846 - DNA, 22 bp, Homo sapiens
ctgagttggcatcacctgcgca

SEQ ID NO: 2177847 - DNA, 20 bp, Homo sapiens
ctgatatacttgagtgtgca

SEQ ID NO: 2177848 - DNA, 20 bp, Homo sapiens
ctgatatctgtttgcttcta

SEQ ID NO: 2177849 - DNA, 15 bp, Homo sapiens
ctgatattaagtaat

SEQ ID NO: 2177850 - DNA, 12 bp, Homo sapiens
ctgatcccactc

SEQ ID NO: 2177851 - DNA, 18 bp, Homo sapiens
ctgatcccactcctagga

SEQ ID NO: 2177852 - DNA, 14 bp, Homo sapiens
ctgatgacactgag

SEQ ID NO: 2177853 - DNA, 15 bp, Homo sapiens
ctgatggaattgtta

SEQ ID NO: 2177854 - DNA, 13 bp, Homo sapiens
ctgatgtcatctt

SEQ ID NO: 2177855 - DNA, 18 bp, Homo sapiens
ctgatgtcatcttgagct

SEQ ID NO: 2177856 - DNA, 19 bp, Homo sapiens
ctgatgttaggctgggccc

SEQ ID NO: 2177857 - DNA, 23 bp, Homo sapiens
ctgatgttaggctgggcccagag

SEQ ID NO: 2177858 - DNA, 18 bp, Homo sapiens
ctgattgctctggaagcc

SEQ ID NO: 2177859 - DNA, 17 bp, Homo sapiens
ctgattgtctgaaattt

SEQ ID NO: 2177860 - DNA, 20 bp, Homo sapiens
ctgatttggtcaccttcctc

SEQ ID NO: 2177861 - DNA, 23 bp, Homo sapiens
ctgcaaaatgcttttgtgtctac

SEQ ID NO: 2177862 - DNA, 18 bp, Homo sapiens
ctgcaaataaagcctttt

SEQ ID NO: 2177863 - DNA, 20 bp, Homo sapiens
ctgcaacaggaactgtgaga

SEQ ID NO: 2177864 - DNA, 19 bp, Homo sapiens
ctgcaagtgagcaaacctg

SEQ ID NO: 2177865 - DNA, 15 bp, Homo sapiens
ctgcacaccagttac

SEQ ID NO: 2177866 - DNA, 21 bp, Homo sapiens
ctgcacaccagttactgttca

SEQ ID NO: 2177867 - DNA, 16 bp, Homo sapiens
ctgcacagacaagcag

SEQ ID NO: 2177868 - DNA, 17 bp, Homo sapiens
ctgcacagacaagcagc

SEQ ID NO: 2177869 - DNA, 14 bp, Homo sapiens
ctgcacataatttg

SEQ ID NO: 2177870 - DNA, 23 bp, Homo sapiens
ctgcaccttgtgaaggaaaaaca

SEQ ID NO: 2177871 - DNA, 20 bp, Homo sapiens
ctgcactccagcctgggtga

SEQ ID NO: 2177872 - DNA, 19 bp, Homo sapiens
ctgttctgtcccttggagc

SEQ ID NO: 2177873 - DNA, 18 bp, Homo sapiens
ctgttcttgggcctcagg

SEQ ID NO: 2177874 - DNA, 20 bp, Homo sapiens
ctgttgagaaaaaagaccct

SEQ ID NO: 2177875 - DNA, 18 bp, Homo sapiens
ctgttgcaaattccaccc

SEQ ID NO: 2177876 - DNA, 22 bp, Homo sapiens
ctgttgtctgccgtgagagccc

SEQ ID NO: 2177877 - DNA, 14 bp, Homo sapiens
ctgtttccctgctg

SEQ ID NO: 2177878 - DNA, 20 bp, Homo sapiens
ctgtttccctgctgaatgcc

SEQ ID NO: 2177879 - DNA, 16 bp, Homo sapiens
ctgtttccttctcttt

SEQ ID NO: 2177880 - DNA, 15 bp, Homo sapiens
cttaaacaaaactgg

SEQ ID NO: 2177881 - DNA, 17 bp, Homo sapiens
cttaaagtggctttcaa

SEQ ID NO: 2177882 - DNA, 22 bp, Homo sapiens
cttaagacaaatgggactgatg

SEQ ID NO: 2177883 - DNA, 12 bp, Homo sapiens
cttaagtttaga

SEQ ID NO: 2177884 - DNA, 14 bp, Homo sapiens
cttaagtttagaaa

SEQ ID NO: 2177885 - DNA, 17 bp, Homo sapiens
cttaagtttagaaatta

SEQ ID NO: 2177886 - DNA, 23 bp, Homo sapiens
cttaataatggttactcatttta

SEQ ID NO: 2177887 - DNA, 16 bp, Homo sapiens
cttaatgctgaaaaca

SEQ ID NO: 2177888 - DNA, 19 bp, Homo sapiens
cttacaaggcaggcctttc

SEQ ID NO: 2177889 - DNA, 20 bp, Homo sapiens
cttacacaagactttcccca

SEQ ID NO: 2177890 - DNA, 21 bp, Homo sapiens
cttacccttctgtgcccagct

SEQ ID NO: 2177891 - DNA, 23 bp, Homo sapiens
cttacccttctgtgcccagctca

SEQ ID NO: 2177892 - DNA, 14 bp, Homo sapiens
cttacctcccacct

SEQ ID NO: 2177893 - DNA, 17 bp, Homo sapiens
cttagaacagatggctg

SEQ ID NO: 2177894 - DNA, 19 bp, Homo sapiens
cttagaacagatggctgtg

SEQ ID NO: 2177895 - DNA, 21 bp, Homo sapiens
cttagaacagatggctgtgaa

SEQ ID NO: 2177896 - DNA, 23 bp, Homo sapiens
cttagagcctccctcaattcccc

SEQ ID NO: 2177897 - DNA, 18 bp, Homo sapiens
cttagattatgttcaatg

SEQ ID NO: 2177898 - DNA, 17 bp, Homo sapiens
cttagcccccacccact

SEQ ID NO: 2177899 - DNA, 18 bp, Homo sapiens
cttagcccccacccactt

SEQ ID NO: 2177900 - DNA, 20 bp, Homo sapiens
cttagcccccacccacttcc

SEQ ID NO: 2177901 - DNA, 15 bp, Homo sapiens
cttagcttacaggaa

SEQ ID NO: 2177902 - DNA, 17 bp, Homo sapiens
cttagcttacaggaagc

SEQ ID NO: 2177903 - DNA, 19 bp, Homo sapiens
cttaggtcgcgctcttgca

SEQ ID NO: 2177904 - DNA, 14 bp, Homo sapiens
cttagtcctccctg

SEQ ID NO: 2177905 - DNA, 16 bp, Homo sapiens
cttagttttgttccaa

SEQ ID NO: 2177906 - DNA, 15 bp, Homo sapiens
cttataagcaacatg

SEQ ID NO: 2177907 - DNA, 19 bp, Homo sapiens
cttcaaaatcagtgatggg

SEQ ID NO: 2177908 - DNA, 22 bp, Homo sapiens
cttcaaagcttttgtaaaataa

SEQ ID NO: 2177909 - DNA, 18 bp, Homo sapiens
cttcaagacgaggggcag

SEQ ID NO: 2177910 - DNA, 16 bp, Homo sapiens
cttcaagggctgcttc

SEQ ID NO: 2177911 - DNA, 17 bp, Homo sapiens
cttcaaggtgtaaaata

SEQ ID NO: 2177912 - DNA, 20 bp, Homo sapiens
cttcaaggtgtaaaatatct

SEQ ID NO: 2177913 - DNA, 17 bp, Homo sapiens
cttcaagtctgtgcctg

SEQ ID NO: 2177914 - DNA, 20 bp, Homo sapiens
cttcaatctacgatgttaaa

SEQ ID NO: 2177915 - DNA, 12 bp, Homo sapiens
cttcaatctctg

SEQ ID NO: 2177916 - DNA, 21 bp, Homo sapiens
cttcaatctctggaaaaataa

SEQ ID NO: 2177917 - DNA, 19 bp, Homo sapiens
cttcacactatcaacactg

SEQ ID NO: 2177918 - DNA, 21 bp, Homo sapiens
cttcaccatcttggccaggct

SEQ ID NO: 2177919 - DNA, 19 bp, Homo sapiens
cttcagatacttgtgaaca

SEQ ID NO: 2177920 - DNA, 14 bp, Homo sapiens
cttcagcttgcttc

SEQ ID NO: 2177921 - DNA, 16 bp, Homo sapiens
cttcagctttgtgtat

SEQ ID NO: 2177922 - DNA, 19 bp, Homo sapiens
cttcagtcatggcattcgc

SEQ ID NO: 2177923 - DNA, 15 bp, Homo sapiens
cttcagtgactcctg

SEQ ID NO: 2177924 - DNA, 23 bp, Homo sapiens
cttcagtgactcctgctggtacc

SEQ ID NO: 2177925 - DNA, 16 bp, Homo sapiens
cttcatcgcagtggac

SEQ ID NO: 2177926 - DNA, 17 bp, Homo sapiens
cttcattctaaaccaaa

SEQ ID NO: 2177927 - DNA, 12 bp, Homo sapiens
cttccaagaaaa

SEQ ID NO: 2177928 - DNA, 14 bp, Homo sapiens
cttccaagaaaaat

SEQ ID NO: 2177929 - DNA, 14 bp, Homo sapiens
cttccaagacctga

SEQ ID NO: 2177930 - DNA, 18 bp, Homo sapiens
cttccaagacctgactca

SEQ ID NO: 2177931 - DNA, 16 bp, Homo sapiens
cttccaggccatcaga

SEQ ID NO: 2177932 - DNA, 23 bp, Homo sapiens
cttccaggttctggttagctcag

SEQ ID NO: 2177933 - DNA, 14 bp, Homo sapiens
cttccatttggaat

SEQ ID NO: 2177934 - DNA, 22 bp, Homo sapiens
cttcccaaatacattaacaagc

SEQ ID NO: 2177935 - DNA, 21 bp, Homo sapiens
cttcccagagaacttcacaga

SEQ ID NO: 2177936 - DNA, 19 bp, Homo sapiens
cttcccctctaatgctcac

SEQ ID NO: 2177937 - DNA, 21 bp, Homo sapiens
cttcccctctaatgctcacgc

SEQ ID NO: 2177938 - DNA, 13 bp, Homo sapiens
cttccctacccac

SEQ ID NO: 2177939 - DNA, 19 bp, Homo sapiens
cttccctacccacagggcc

SEQ ID NO: 2177940 - DNA, 20 bp, Homo sapiens
cttccctacccacagggcct

SEQ ID NO: 2177941 - DNA, 21 bp, Homo sapiens
cttccctacccacagggcctg

SEQ ID NO: 2177942 - DNA, 22 bp, Homo sapiens
cttccctaggcacctctgtgct

SEQ ID NO: 2177943 - DNA, 19 bp, Homo sapiens
cttccctagggctgggtgt

SEQ ID NO: 2177944 - DNA, 12 bp, Homo sapiens
cttccctggtcc

SEQ ID NO: 2177945 - DNA, 14 bp, Homo sapiens
cttccctggtccag

SEQ ID NO: 2177946 - DNA, 13 bp, Homo sapiens
cttcccttatttt

SEQ ID NO: 2177947 - DNA, 19 bp, Homo sapiens
cttcccttatttttattta

SEQ ID NO: 2177948 - DNA, 23 bp, Homo sapiens
cttccgctttgaaagaagcaaga

SEQ ID NO: 2177949 - DNA, 16 bp, Homo sapiens
cttcctccatggccca

SEQ ID NO: 2177950 - DNA, 22 bp, Homo sapiens
cttcctccatggcccatcactc

SEQ ID NO: 2177951 - DNA, 16 bp, Homo sapiens
cttcctccctccctgc

SEQ ID NO: 2177952 - DNA, 12 bp, Homo sapiens
cttcctcctccc

SEQ ID NO: 2177953 - DNA, 18 bp, Homo sapiens
cttcctcctcccctggca

SEQ ID NO: 2177954 - DNA, 17 bp, Homo sapiens
cttcctgtccgccctct

SEQ ID NO: 2177955 - DNA, 13 bp, Homo sapiens
cttcctgtttcta

SEQ ID NO: 2177956 - DNA, 22 bp, Homo sapiens
cttccttccaagtcttcctgac

SEQ ID NO: 2177957 - DNA, 19 bp, Homo sapiens
cttccttgctaatgcacca

SEQ ID NO: 2177958 - DNA, 13 bp, Homo sapiens
cttcggaagacct

SEQ ID NO: 2177959 - DNA, 16 bp, Homo sapiens
cttcggaggtggcagc

SEQ ID NO: 2177960 - DNA, 14 bp, Homo sapiens
cttcgtaacttcat

SEQ ID NO: 2177961 - DNA, 23 bp, Homo sapiens
cttcgtgggatctgcccctccct

SEQ ID NO: 2177962 - DNA, 21 bp, Homo sapiens
cttcgttggtgaccagtttct

SEQ ID NO: 2177963 - DNA, 16 bp, Homo sapiens
cttctagattcactgt

SEQ ID NO: 2177964 - DNA, 18 bp, Homo sapiens
cttctcatcactcccctc

SEQ ID NO: 2177965 - DNA, 15 bp, Homo sapiens
cttctccagcctaga

SEQ ID NO: 2177966 - DNA, 11 bp, Homo sapiens
cttctcctctt

SEQ ID NO: 2177967 - DNA, 14 bp, Homo sapiens
cttctgaagatgga

SEQ ID NO: 2177968 - DNA, 15 bp, Homo sapiens
cttctgacctcagca

SEQ ID NO: 2177969 - DNA, 22 bp, Homo sapiens
cttctgtaacgggtcgtgctca

SEQ ID NO: 2177970 - DNA, 17 bp, Homo sapiens
cttctgtgagtcagtca

SEQ ID NO: 2177971 - DNA, 13 bp, Homo sapiens
cttctgtgcccag

SEQ ID NO: 2177972 - DNA, 15 bp, Homo sapiens
cttcttcggaggtgg

SEQ ID NO: 2177973 - DNA, 18 bp, Homo sapiens
cttcttcggaggtggcag

SEQ ID NO: 2177974 - DNA, 15 bp, Homo sapiens
cttcttctttctaca

SEQ ID NO: 2177975 - DNA, 14 bp, Homo sapiens
cttcttttgtactt

SEQ ID NO: 2177976 - DNA, 14 bp, Homo sapiens
cttgaaaagattgc

SEQ ID NO: 2177977 - DNA, 21 bp, Homo sapiens
cttgaaaagattgcaaaggga

SEQ ID NO: 2177978 - DNA, 19 bp, Homo sapiens
cttgaatactttgagtaaa

SEQ ID NO: 2177979 - DNA, 22 bp, Homo sapiens
cttgaatactttgagtaaactt

SEQ ID NO: 2177980 - DNA, 22 bp, Homo sapiens
cttgaatcaggaggagattaac

SEQ ID NO: 2177981 - DNA, 21 bp, Homo sapiens
cttgaccaggctgcctccctt

SEQ ID NO: 2177982 - DNA, 17 bp, Homo sapiens
cttgagaaatttgtggt

SEQ ID NO: 2177983 - DNA, 12 bp, Homo sapiens
cttgagaagaca

SEQ ID NO: 2177984 - DNA, 23 bp, Homo sapiens
cttgagaccaagccggtgcccac

SEQ ID NO: 2177985 - DNA, 23 bp, Homo sapiens
cttgagtatagcaatatcaaaag

SEQ ID NO: 2177986 - DNA, 19 bp, Homo sapiens
cttgatgccagtaggctca

SEQ ID NO: 2177987 - DNA, 14 bp, Homo sapiens
cttgattttcaagc

SEQ ID NO: 2177988 - DNA, 14 bp, Homo sapiens
cttgattttgcaaa

SEQ ID NO: 2177989 - DNA, 18 bp, Homo sapiens
cttgcactattggacttt

SEQ ID NO: 2177990 - DNA, 15 bp, Homo sapiens
cttgcagagaagcct

SEQ ID NO: 2177991 - DNA, 16 bp, Homo sapiens
cttgcccacttctcct

SEQ ID NO: 2177992 - DNA, 18 bp, Homo sapiens
cttgccgctgggagagcc

SEQ ID NO: 2177993 - DNA, 21 bp, Homo sapiens
gagaacagtggttgcctgggg

SEQ ID NO: 2177994 - DNA, 23 bp, Homo sapiens
gagaacagtggttgcctgggggc

SEQ ID NO: 2177995 - DNA, 14 bp, Homo sapiens
gagaagagtccagg

SEQ ID NO: 2177996 - DNA, 16 bp, Homo sapiens
gagaagccagccacag

SEQ ID NO: 2177997 - DNA, 12 bp, Homo sapiens
gagaagctgtgt

SEQ ID NO: 2177998 - DNA, 13 bp, Homo sapiens
gagaagctgtgtc

SEQ ID NO: 2177999 - DNA, 16 bp, Homo sapiens
gagaagttgtaaagta

SEQ ID NO: 2178000 - DNA, 14 bp, Homo sapiens
gagaatagcagttt

SEQ ID NO: 2178001 - DNA, 16 bp, Homo sapiens
gagacaatgcagatgc

SEQ ID NO: 2178002 - DNA, 13 bp, Homo sapiens
gagacaattacaa

SEQ ID NO: 2178003 - DNA, 22 bp, Homo sapiens
gagacacagagtggagccctca

SEQ ID NO: 2178004 - DNA, 17 bp, Homo sapiens
gagacacagggcatcca

SEQ ID NO: 2178005 - DNA, 19 bp, Homo sapiens
gagacacctcagagccccg

SEQ ID NO: 2178006 - DNA, 19 bp, Homo sapiens
gagaccaagccggtgccca

SEQ ID NO: 2178007 - DNA, 13 bp, Homo sapiens
gagaccccgcacc

SEQ ID NO: 2178008 - DNA, 23 bp, Homo sapiens
gagacttgtacagttgactggct

SEQ ID NO: 2178009 - DNA, 15 bp, Homo sapiens
gagagaaagagagaa

SEQ ID NO: 2178010 - DNA, 19 bp, Homo sapiens
gagagaaagagagaagcca

SEQ ID NO: 2178011 - DNA, 21 bp, Homo sapiens
gagagaaagagagaagccagc

SEQ ID NO: 2178012 - DNA, 17 bp, Homo sapiens
gagagaagagtccagga

SEQ ID NO: 2178013 - DNA, 16 bp, Homo sapiens
gagagaagccagccac

SEQ ID NO: 2178014 - DNA, 19 bp, Homo sapiens
gagagaagccagccacaga

SEQ ID NO: 2178015 - DNA, 16 bp, Homo sapiens
gagagaagtcggccag

SEQ ID NO: 2178016 - DNA, 21 bp, Homo sapiens
gagagaatgagagagtgtgga

SEQ ID NO: 2178017 - DNA, 13 bp, Homo sapiens
gagaggaagccac

SEQ ID NO: 2178018 - DNA, 13 bp, Homo sapiens
gagaggcagagtg

SEQ ID NO: 2178019 - DNA, 15 bp, Homo sapiens
gagaggcagagtgcc

SEQ ID NO: 2178020 - DNA, 18 bp, Homo sapiens
gagaggggcctctggctg

SEQ ID NO: 2178021 - DNA, 22 bp, Homo sapiens
gagaggggcctctggctgcctg

SEQ ID NO: 2178022 - DNA, 18 bp, Homo sapiens
gagatcggggccagaggc

SEQ ID NO: 2178023 - DNA, 16 bp, Homo sapiens
gagattaacacactga

SEQ ID NO: 2178024 - DNA, 17 bp, Homo sapiens
gagcaagacgccctctc

SEQ ID NO: 2178025 - DNA, 14 bp, Homo sapiens
gagcaagccttcct

SEQ ID NO: 2178026 - DNA, 22 bp, Homo sapiens
gagcaggttccccaagggccct

SEQ ID NO: 2178027 - DNA, 16 bp, Homo sapiens
gagcagtgtgtctcct

SEQ ID NO: 2178028 - DNA, 18 bp, Homo sapiens
gagcagtgtgtctcctgc

SEQ ID NO: 2178029 - DNA, 16 bp, Homo sapiens
gagcattttgtgtctt

SEQ ID NO: 2178030 - DNA, 13 bp, Homo sapiens
gagccacctgtcc

SEQ ID NO: 2178031 - DNA, 20 bp, Homo sapiens
gagccacctgtcccacctca

SEQ ID NO: 2178032 - DNA, 16 bp, Homo sapiens
gagccactggaggaag

SEQ ID NO: 2178033 - DNA, 18 bp, Homo sapiens
gagcccaatcactgccta

SEQ ID NO: 2178034 - DNA, 17 bp, Homo sapiens
gagcctgcggctgctgg

SEQ ID NO: 2178035 - DNA, 19 bp, Homo sapiens
gagcctgcggctgctggca

SEQ ID NO: 2178036 - DNA, 21 bp, Homo sapiens
gagcctgcggctgctggcaca

SEQ ID NO: 2178037 - DNA, 13 bp, Homo sapiens
gagctctggagcc

SEQ ID NO: 2178038 - DNA, 19 bp, Homo sapiens
gagctctggagccacctgt

SEQ ID NO: 2178039 - DNA, 14 bp, Homo sapiens
gagctggggggaag

SEQ ID NO: 2178040 - DNA, 16 bp, Homo sapiens
gagcttacctcccacc

SEQ ID NO: 2178041 - DNA, 20 bp, Homo sapiens
gagcttcaagtctgtgcctg

SEQ ID NO: 2178042 - DNA, 21 bp, Homo sapiens
gagcttccgctttgaaagaag

SEQ ID NO: 2178043 - DNA, 23 bp, Homo sapiens
gagcttccgctttgaaagaagca

SEQ ID NO: 2178044 - DNA, 15 bp, Homo sapiens
gagcttcctgtttct

SEQ ID NO: 2178045 - DNA, 16 bp, Homo sapiens
gaggaagccacgtgct

SEQ ID NO: 2178046 - DNA, 23 bp, Homo sapiens
gaggaagccacgtgctggagagt

SEQ ID NO: 2178047 - DNA, 13 bp, Homo sapiens
gaggaagccttgc

SEQ ID NO: 2178048 - DNA, 19 bp, Homo sapiens
gaggaagctccagtcctgc

SEQ ID NO: 2178049 - DNA, 21 bp, Homo sapiens
gaggaagctccagtcctgctc

SEQ ID NO: 2178050 - DNA, 15 bp, Homo sapiens
gaggaattttctaaa

SEQ ID NO: 2178051 - DNA, 13 bp, Homo sapiens
gaggagagagacc

SEQ ID NO: 2178052 - DNA, 13 bp, Homo sapiens
gaggagcagggtc

SEQ ID NO: 2178053 - DNA, 23 bp, Homo sapiens
gaggagcctgtgcgtcccagctg

SEQ ID NO: 2178054 - DNA, 19 bp, Homo sapiens
gaggattctgtcttccagg

SEQ ID NO: 2178055 - DNA, 23 bp, Homo sapiens
gaggcaaaaggcagtggggctgg

SEQ ID NO: 2178056 - DNA, 13 bp, Homo sapiens
gaggcaccaggaa

SEQ ID NO: 2178057 - DNA, 23 bp, Homo sapiens
gaggcagaaccctggtgaggaag

SEQ ID NO: 2178058 - DNA, 14 bp, Homo sapiens
gaggcagagtgccc

SEQ ID NO: 2178059 - DNA, 16 bp, Homo sapiens
gaggcagagtgcccca

SEQ ID NO: 2178060 - DNA, 16 bp, Homo sapiens
gaggcaggggctgggc

SEQ ID NO: 2178061 - DNA, 18 bp, Homo sapiens
gaggcaggggctgggcag

SEQ ID NO: 2178062 - DNA, 22 bp, Homo sapiens
gaggcaggtcccgagccccctg

SEQ ID NO: 2178063 - DNA, 20 bp, Homo sapiens
gaggcattcccagaggtggg

SEQ ID NO: 2178064 - DNA, 22 bp, Homo sapiens
gaggcattcccagaggtgggga

SEQ ID NO: 2178065 - DNA, 12 bp, Homo sapiens
gaggcattgttt

SEQ ID NO: 2178066 - DNA, 20 bp, Homo sapiens
gaggccacgggggaggccga

SEQ ID NO: 2178067 - DNA, 11 bp, Homo sapiens
gaggcccagca

SEQ ID NO: 2178068 - DNA, 18 bp, Homo sapiens
gaggcccagcagagccgt

SEQ ID NO: 2178069 - DNA, 19 bp, Homo sapiens
gaggcccttttctggctcc

SEQ ID NO: 2178070 - DNA, 17 bp, Homo sapiens
gaggcctcaccctgctt

SEQ ID NO: 2178071 - DNA, 18 bp, Homo sapiens
gaggctcctggagccagc

SEQ ID NO: 2178072 - DNA, 16 bp, Homo sapiens
gagggagcaagccttc

SEQ ID NO: 2178073 - DNA, 22 bp, Homo sapiens
gagggatgcagtgcctttcccc

SEQ ID NO: 2178074 - DNA, 15 bp, Homo sapiens
gagggatgtggagca

SEQ ID NO: 2178075 - DNA, 16 bp, Homo sapiens
gaggggatccagccac

SEQ ID NO: 2178076 - DNA, 15 bp, Homo sapiens
gaggggcagggaagg

SEQ ID NO: 2178077 - DNA, 17 bp, Homo sapiens
gaggggcttccctctgc

SEQ ID NO: 2178078 - DNA, 21 bp, Homo sapiens
gaggggcttccctctgctcca

SEQ ID NO: 2178079 - DNA, 20 bp, Homo sapiens
gaggggtggtgtccttctcc

SEQ ID NO: 2178080 - DNA, 20 bp, Homo sapiens
gaggtctccaggggcctgca

SEQ ID NO: 2178081 - DNA, 21 bp, Homo sapiens
gaggtctccaggggcctgcag

SEQ ID NO: 2178082 - DNA, 19 bp, Homo sapiens
gaggtggaggttgcagtga

SEQ ID NO: 2178083 - DNA, 11 bp, Homo sapiens
gaggtggctgg

SEQ ID NO: 2178084 - DNA, 23 bp, Homo sapiens
gaggtgggaggcccctggtggca

SEQ ID NO: 2178085 - DNA, 21 bp, Homo sapiens
gaggtggggaagagagcctgc

SEQ ID NO: 2178086 - DNA, 16 bp, Homo sapiens
gaggttttatttcatt

SEQ ID NO: 2178087 - DNA, 21 bp, Homo sapiens
gaggttttatttcatttttca

SEQ ID NO: 2178088 - DNA, 16 bp, Homo sapiens
gagtagctgagactac

SEQ ID NO: 2178089 - DNA, 12 bp, Homo sapiens
gagtcatgccaa

SEQ ID NO: 2178090 - DNA, 14 bp, Homo sapiens
gagtcctgaggcag

SEQ ID NO: 2178091 - DNA, 17 bp, Homo sapiens
gagtgagactcctgatt

SEQ ID NO: 2178092 - DNA, 12 bp, Homo sapiens
gagtgcaggggc

SEQ ID NO: 2178093 - DNA, 14 bp, Homo sapiens
gagtgccccacctg

SEQ ID NO: 2178094 - DNA, 15 bp, Homo sapiens
gagtgccccacctgc

SEQ ID NO: 2178095 - DNA, 16 bp, Homo sapiens
gagtggatagatgccc

SEQ ID NO: 2178096 - DNA, 20 bp, Homo sapiens
gagtggatagatgccctgct

SEQ ID NO: 2178097 - DNA, 11 bp, Homo sapiens
gagtgggaagc

SEQ ID NO: 2178098 - DNA, 14 bp, Homo sapiens
gagtgggagaggaa

SEQ ID NO: 2178099 - DNA, 16 bp, Homo sapiens
gagtgggccccgggct

SEQ ID NO: 2178100 - DNA, 20 bp, Homo sapiens
gagtggggagacacctcaga

SEQ ID NO: 2178101 - DNA, 21 bp, Homo sapiens
gagtgtgtgggggtctgggag

SEQ ID NO: 2178102 - DNA, 22 bp, Homo sapiens
gagttctgatgtcttagtgact

SEQ ID NO: 2178103 - DNA, 20 bp, Homo sapiens
gagttggcgttgtgggcagg

SEQ ID NO: 2178104 - DNA, 14 bp, Homo sapiens
gataataaaattca

SEQ ID NO: 2178105 - DNA, 17 bp, Homo sapiens
gataataaaattcattc

SEQ ID NO: 2178106 - DNA, 16 bp, Homo sapiens
gataccaccgacattt

SEQ ID NO: 2178107 - DNA, 15 bp, Homo sapiens
gatactgacttttta

SEQ ID NO: 2178108 - DNA, 17 bp, Homo sapiens
gatacttcagctttgtg

SEQ ID NO: 2178109 - DNA, 17 bp, Homo sapiens
gataggagacttgtaca

SEQ ID NO: 2178110 - DNA, 14 bp, Homo sapiens
gatagtagatctgt

SEQ ID NO: 2178111 - DNA, 14 bp, Homo sapiens
gatatattctttcc

SEQ ID NO: 2178112 - DNA, 21 bp, Homo sapiens
gatcaaaatctgtagagcagg

SEQ ID NO: 2178113 - DNA, 14 bp, Homo sapiens
gatcacagctcacg

SEQ ID NO: 2178114 - DNA, 15 bp, Homo sapiens
gatcactttgctctg

SEQ ID NO: 2178115 - DNA, 18 bp, Homo sapiens
gcctccatggtgcctctg

SEQ ID NO: 2178116 - DNA, 20 bp, Homo sapiens
gcctccctctcctctgtccc

SEQ ID NO: 2178117 - DNA, 23 bp, Homo sapiens
gcctccctgaccctgcagagatg

SEQ ID NO: 2178118 - DNA, 14 bp, Homo sapiens
gcctccctgtccac

SEQ ID NO: 2178119 - DNA, 14 bp, Homo sapiens
gcctcccttgtggc

SEQ ID NO: 2178120 - DNA, 16 bp, Homo sapiens
gcctcctctaacaggg

SEQ ID NO: 2178121 - DNA, 15 bp, Homo sapiens
gcctcgaactcctgg

SEQ ID NO: 2178122 - DNA, 16 bp, Homo sapiens
gcctcgaactcctggg

SEQ ID NO: 2178123 - DNA, 18 bp, Homo sapiens
gcctcgtgaggggcaagc

SEQ ID NO: 2178124 - DNA, 19 bp, Homo sapiens
gcctctagggacccctcct

SEQ ID NO: 2178125 - DNA, 15 bp, Homo sapiens
gcctctgagccactg

SEQ ID NO: 2178126 - DNA, 18 bp, Homo sapiens
gcctctgagccactggag

SEQ ID NO: 2178127 - DNA, 12 bp, Homo sapiens
gcctctggctgc

SEQ ID NO: 2178128 - DNA, 16 bp, Homo sapiens
gcctctggctgcctgg

SEQ ID NO: 2178129 - DNA, 19 bp, Homo sapiens
gcctctggctgcctggccc

SEQ ID NO: 2178130 - DNA, 15 bp, Homo sapiens
gcctcttgaccaggc

SEQ ID NO: 2178131 - DNA, 22 bp, Homo sapiens
gcctcttgaccaggctgcctcc

SEQ ID NO: 2178132 - DNA, 14 bp, Homo sapiens
gcctgacttttaca

SEQ ID NO: 2178133 - DNA, 20 bp, Homo sapiens
gcctgagcaagacgccctct

SEQ ID NO: 2178134 - DNA, 14 bp, Homo sapiens
gcctgcattcgcag

SEQ ID NO: 2178135 - DNA, 15 bp, Homo sapiens
gcctgcattcgcagc

SEQ ID NO: 2178136 - DNA, 18 bp, Homo sapiens
gcctgcattcgcagcagc

SEQ ID NO: 2178137 - DNA, 21 bp, Homo sapiens
gcctgcctagcactcacatgc

SEQ ID NO: 2178138 - DNA, 22 bp, Homo sapiens
gcctgcctagcactcacatgct

SEQ ID NO: 2178139 - DNA, 16 bp, Homo sapiens
gcctgccttctgggca

SEQ ID NO: 2178140 - DNA, 17 bp, Homo sapiens
gcctgcgcagctccttc

SEQ ID NO: 2178141 - DNA, 14 bp, Homo sapiens
gcctgcggctgctg

SEQ ID NO: 2178142 - DNA, 15 bp, Homo sapiens
gcctgcggctgctgg

SEQ ID NO: 2178143 - DNA, 23 bp, Homo sapiens
gcctgcggctgctggcacagact

SEQ ID NO: 2178144 - DNA, 12 bp, Homo sapiens
gcctggatgaga

SEQ ID NO: 2178145 - DNA, 16 bp, Homo sapiens
gcctggatgagaaaca

SEQ ID NO: 2178146 - DNA, 17 bp, Homo sapiens
gcctggatgagaaacag

SEQ ID NO: 2178147 - DNA, 21 bp, Homo sapiens
gcctggatgggggtgcaggca

SEQ ID NO: 2178148 - DNA, 12 bp, Homo sapiens
gcctggcaccca

SEQ ID NO: 2178149 - DNA, 16 bp, Homo sapiens
gcctggcacccactcc

SEQ ID NO: 2178150 - DNA, 17 bp, Homo sapiens
gcctggcacccactccg

SEQ ID NO: 2178151 - DNA, 18 bp, Homo sapiens
gcctggcccagggaggaa

SEQ ID NO: 2178152 - DNA, 14 bp, Homo sapiens
gcctggctggtggg

SEQ ID NO: 2178153 - DNA, 18 bp, Homo sapiens
gcctgggccactggcatc

SEQ ID NO: 2178154 - DNA, 22 bp, Homo sapiens
gcctggggatgtaaccaagctg

SEQ ID NO: 2178155 - DNA, 23 bp, Homo sapiens
gcctgtactaggattagaaaatt

SEQ ID NO: 2178156 - DNA, 18 bp, Homo sapiens
gcctgtccctggccatct

SEQ ID NO: 2178157 - DNA, 18 bp, Homo sapiens
gcctgtccttggtggccg

SEQ ID NO: 2178158 - DNA, 17 bp, Homo sapiens
gcctgtcttcagatcct

SEQ ID NO: 2178159 - DNA, 18 bp, Homo sapiens
gcctgtgcgtcccagctg

SEQ ID NO: 2178160 - DNA, 15 bp, Homo sapiens
gcctgtgggagaagg

SEQ ID NO: 2178161 - DNA, 20 bp, Homo sapiens
gcctgtgtcacgagcccttt

SEQ ID NO: 2178162 - DNA, 13 bp, Homo sapiens
gccttccttgcta

SEQ ID NO: 2178163 - DNA, 13 bp, Homo sapiens
gccttctcccctc

SEQ ID NO: 2178164 - DNA, 14 bp, Homo sapiens
gccttctcccctcc

SEQ ID NO: 2178165 - DNA, 14 bp, Homo sapiens
gccttgctgcacct

SEQ ID NO: 2178166 - DNA, 12 bp, Homo sapiens
gcctttcttcct

SEQ ID NO: 2178167 - DNA, 14 bp, Homo sapiens
gcctttgttcactg

SEQ ID NO: 2178168 - DNA, 13 bp, Homo sapiens
gcgaagctgagcg

SEQ ID NO: 2178169 - DNA, 23 bp, Homo sapiens
gcgactcggccccgtctcctgag

SEQ ID NO: 2178170 - DNA, 19 bp, Homo sapiens
gcgactctcctgcctcagc

SEQ ID NO: 2178171 - DNA, 16 bp, Homo sapiens
gcgatatgagagggat

SEQ ID NO: 2178172 - DNA, 21 bp, Homo sapiens
gcgatcatggctcactgcagc

SEQ ID NO: 2178173 - DNA, 19 bp, Homo sapiens
gcgatccctcccctcagcc

SEQ ID NO: 2178174 - DNA, 16 bp, Homo sapiens
gcgccagccctaggct

SEQ ID NO: 2178175 - DNA, 21 bp, Homo sapiens
gcgcggttcaggtcagggcta

SEQ ID NO: 2178176 - DNA, 14 bp, Homo sapiens
gcggaacctggctg

SEQ ID NO: 2178177 - DNA, 16 bp, Homo sapiens
gcggaacctggctgcg

SEQ ID NO: 2178178 - DNA, 18 bp, Homo sapiens
gcggaggggatccagcca

SEQ ID NO: 2178179 - DNA, 19 bp, Homo sapiens
gcggaggggatccagccac

SEQ ID NO: 2178180 - DNA, 13 bp, Homo sapiens
gcggatcctgctg

SEQ ID NO: 2178181 - DNA, 15 bp, Homo sapiens
gcggatcctgctggg

SEQ ID NO: 2178182 - DNA, 19 bp, Homo sapiens
gcgggtaaaaagagaaggc

SEQ ID NO: 2178183 - DNA, 23 bp, Homo sapiens
gcgggtaaaaagagaaggcaagc

SEQ ID NO: 2178184 - DNA, 14 bp, Homo sapiens
gcggtgggcagcca

SEQ ID NO: 2178185 - DNA, 19 bp, Homo sapiens
gcggttcaggtcagggcta

SEQ ID NO: 2178186 - DNA, 16 bp, Homo sapiens
gcgtcagtattttccc

SEQ ID NO: 2178187 - DNA, 19 bp, Homo sapiens
gcgtctgagcggccgcctg

SEQ ID NO: 2178188 - DNA, 23 bp, Homo sapiens
gcgtctgagcggccgcctgtcct

SEQ ID NO: 2178189 - DNA, 22 bp, Homo sapiens
gcgtgtctgtttccttctcttt

SEQ ID NO: 2178190 - DNA, 14 bp, Homo sapiens
gcgttgtgggcagg

SEQ ID NO: 2178191 - DNA, 20 bp, Homo sapiens
gctaaagtgctctatttatt

SEQ ID NO: 2178192 - DNA, 15 bp, Homo sapiens
gctaaatactgtaca

SEQ ID NO: 2178193 - DNA, 14 bp, Homo sapiens
gctaaggcaccagc

SEQ ID NO: 2178194 - DNA, 20 bp, Homo sapiens
gctaaggcctcttgctggtg

SEQ ID NO: 2178195 - DNA, 15 bp, Homo sapiens
gctaattacacacgt

SEQ ID NO: 2178196 - DNA, 16 bp, Homo sapiens
gctaattctactcaca

SEQ ID NO: 2178197 - DNA, 21 bp, Homo sapiens
gctacaagagggcaaagctga

SEQ ID NO: 2178198 - DNA, 15 bp, Homo sapiens
gctaccccccgtctc

SEQ ID NO: 2178199 - DNA, 18 bp, Homo sapiens
gctagagaggggcctctg

SEQ ID NO: 2178200 - DNA, 23 bp, Homo sapiens
gctagatgagaattcagctgccc

SEQ ID NO: 2178201 - DNA, 18 bp, Homo sapiens
gctagctcccctcctctc

SEQ ID NO: 2178202 - DNA, 15 bp, Homo sapiens
gctaggccccagagg

SEQ ID NO: 2178203 - DNA, 16 bp, Homo sapiens
gctaggccccagaggc

SEQ ID NO: 2178204 - DNA, 18 bp, Homo sapiens
gctaggccccagaggccc

SEQ ID NO: 2178205 - DNA, 19 bp, Homo sapiens
gctataaagcagtattttt

SEQ ID NO: 2178206 - DNA, 16 bp, Homo sapiens
gctatacctcattcac

SEQ ID NO: 2178207 - DNA, 17 bp, Homo sapiens
gctatacctcattcaca

SEQ ID NO: 2178208 - DNA, 18 bp, Homo sapiens
gctatggatggggcccag

SEQ ID NO: 2178209 - DNA, 23 bp, Homo sapiens
gctatggatggggcccaggggct

SEQ ID NO: 2178210 - DNA, 16 bp, Homo sapiens
gctattctttgaccaa

SEQ ID NO: 2178211 - DNA, 16 bp, Homo sapiens
gctatttcccaagctg

SEQ ID NO: 2178212 - DNA, 15 bp, Homo sapiens
gctcaacataacata

SEQ ID NO: 2178213 - DNA, 20 bp, Homo sapiens
gctcaatccatgttctattt

SEQ ID NO: 2178214 - DNA, 12 bp, Homo sapiens
gctcacagactg

SEQ ID NO: 2178215 - DNA, 16 bp, Homo sapiens
gctcacggcagcctca

SEQ ID NO: 2178216 - DNA, 18 bp, Homo sapiens
gctcagatgaagagaaat

SEQ ID NO: 2178217 - DNA, 17 bp, Homo sapiens
gctcagccagccccatc

SEQ ID NO: 2178218 - DNA, 11 bp, Homo sapiens
gctcagccagt

SEQ ID NO: 2178219 - DNA, 14 bp, Homo sapiens
gctcagccagtggg

SEQ ID NO: 2178220 - DNA, 16 bp, Homo sapiens
gctcagccccagccca

SEQ ID NO: 2178221 - DNA, 14 bp, Homo sapiens
gctcagccctgagc

SEQ ID NO: 2178222 - DNA, 18 bp, Homo sapiens
gctcagctctggctcaca

SEQ ID NO: 2178223 - DNA, 14 bp, Homo sapiens
gctcagctggccgg

SEQ ID NO: 2178224 - DNA, 16 bp, Homo sapiens
gctcatgggcccctct

SEQ ID NO: 2178225 - DNA, 20 bp, Homo sapiens
gctcatgggcccctctgact

SEQ ID NO: 2178226 - DNA, 21 bp, Homo sapiens
gctccacagaaaccctgtttt

SEQ ID NO: 2178227 - DNA, 13 bp, Homo sapiens
gctccaccccact

SEQ ID NO: 2178228 - DNA, 16 bp, Homo sapiens
gctccaccccactcac

SEQ ID NO: 2178229 - DNA, 18 bp, Homo sapiens
gctccagtcctgctctct

SEQ ID NO: 2178230 - DNA, 23 bp, Homo sapiens
gctccagtcctgctctctaccca

SEQ ID NO: 2178231 - DNA, 23 bp, Homo sapiens
gctcccaacacaaggtgggcagg

SEQ ID NO: 2178232 - DNA, 16 bp, Homo sapiens
gctccgaggacccagg

SEQ ID NO: 2178233 - DNA, 15 bp, Homo sapiens
gctccgcctggcacc

SEQ ID NO: 2178234 - DNA, 13 bp, Homo sapiens
gctcctccctccc

SEQ ID NO: 2178235 - DNA, 14 bp, Homo sapiens
gctcctggagccag

SEQ ID NO: 2178236 - DNA, 22 bp, Homo sapiens
gctcgtggactgagtgggaagc

SEQ ID NO: 2178237 - DNA, 23 bp, Homo sapiens
gggagcaggttccccaagggccc

SEQ ID NO: 2178238 - DNA, 21 bp, Homo sapiens
gggagctacagccagcggcat

SEQ ID NO: 2178239 - DNA, 22 bp, Homo sapiens
gggaggagcctgtgcgtcccag

SEQ ID NO: 2178240 - DNA, 15 bp, Homo sapiens
gggagggtcagtgcc

SEQ ID NO: 2178241 - DNA, 13 bp, Homo sapiens
gggagtggccatc

SEQ ID NO: 2178242 - DNA, 22 bp, Homo sapiens
gggatgaggtcaccaggggagg

SEQ ID NO: 2178243 - DNA, 18 bp, Homo sapiens
gggatgcggatcctgctg

SEQ ID NO: 2178244 - DNA, 11 bp, Homo sapiens
gggcaaagctg

SEQ ID NO: 2178245 - DNA, 16 bp, Homo sapiens
gggcaagctaggcccc

SEQ ID NO: 2178246 - DNA, 20 bp, Homo sapiens
gggcaagctaggccccagag

SEQ ID NO: 2178247 - DNA, 22 bp, Homo sapiens
gggcaagctaggccccagaggc

SEQ ID NO: 2178248 - DNA, 17 bp, Homo sapiens
gggcaccaagcccacag

SEQ ID NO: 2178249 - DNA, 22 bp, Homo sapiens
gggcacttttgaactcacgagc

SEQ ID NO: 2178250 - DNA, 24 bp, Homo sapiens
gggcacttttgaactcacgagcct

SEQ ID NO: 2178251 - DNA, 12 bp, Homo sapiens
gggcagagggga

SEQ ID NO: 2178252 - DNA, 19 bp, Homo sapiens
gggcagaggggagaggaag

SEQ ID NO: 2178253 - DNA, 11 bp, Homo sapiens
gggcagcagcc

SEQ ID NO: 2178254 - DNA, 17 bp, Homo sapiens
gggccatcctgtcccac

SEQ ID NO: 2178255 - DNA, 22 bp, Homo sapiens
gggccatctgactgccaagcca

SEQ ID NO: 2178256 - DNA, 23 bp, Homo sapiens
gggccatctgactgccaagccag

SEQ ID NO: 2178257 - DNA, 17 bp, Homo sapiens
gggccccatgagggtgt

SEQ ID NO: 2178258 - DNA, 15 bp, Homo sapiens
gggcccctcggctac

SEQ ID NO: 2178259 - DNA, 9 bp, Homo sapiens
gggccctgc

SEQ ID NO: 2178260 - DNA, 11 bp, Homo sapiens
gggccctggca

SEQ ID NO: 2178261 - DNA, 17 bp, Homo sapiens
gggccgccacggcctgg

SEQ ID NO: 2178262 - DNA, 15 bp, Homo sapiens
gggcctcaggctctg

SEQ ID NO: 2178263 - DNA, 23 bp, Homo sapiens
gggcctcctctaacaggggctgg

SEQ ID NO: 2178264 - DNA, 18 bp, Homo sapiens
gggcctctggctgcctgg

SEQ ID NO: 2178265 - DNA, 21 bp, Homo sapiens
gggcctctggctgcctggccc

SEQ ID NO: 2178266 - DNA, 16 bp, Homo sapiens
gggcctgcagaaggaa

SEQ ID NO: 2178267 - DNA, 22 bp, Homo sapiens
gggctcagctctggctcacaga

SEQ ID NO: 2178268 - DNA, 14 bp, Homo sapiens
gggctggagaaaga

SEQ ID NO: 2178269 - DNA, 20 bp, Homo sapiens
gggctgttttagtgccaggc

SEQ ID NO: 2178270 - DNA, 14 bp, Homo sapiens
gggcttatatctgg

SEQ ID NO: 2178271 - DNA, 21 bp, Homo sapiens
gggcttcaccatcttggccag

SEQ ID NO: 2178272 - DNA, 15 bp, Homo sapiens
gggcttccctctgct

SEQ ID NO: 2178273 - DNA, 18 bp, Homo sapiens
gggcttccctctgctcca

SEQ ID NO: 2178274 - DNA, 19 bp, Homo sapiens
gggcttccctctgctccac

SEQ ID NO: 2178275 - DNA, 21 bp, Homo sapiens
gggcttttctttagtggagaa

SEQ ID NO: 2178276 - DNA, 23 bp, Homo sapiens
ggggaactcaaaggactgacctg

SEQ ID NO: 2178277 - DNA, 21 bp, Homo sapiens
ggggacgcctgtgtcacgagc

SEQ ID NO: 2178278 - DNA, 20 bp, Homo sapiens
ggggagctacagccagcggc

SEQ ID NO: 2178279 - DNA, 16 bp, Homo sapiens
ggggaggacctctggg

SEQ ID NO: 2178280 - DNA, 18 bp, Homo sapiens
ggggaggccgaggcaggg

SEQ ID NO: 2178281 - DNA, 21 bp, Homo sapiens
ggggatccagccacttccccc

SEQ ID NO: 2178282 - DNA, 19 bp, Homo sapiens
ggggatttcaagggactgg

SEQ ID NO: 2178283 - DNA, 16 bp, Homo sapiens
ggggcaggagctcaga

SEQ ID NO: 2178284 - DNA, 19 bp, Homo sapiens
ggggcagggaaggacagga

SEQ ID NO: 2178285 - DNA, 20 bp, Homo sapiens
ggggccacagccagaacccc

SEQ ID NO: 2178286 - DNA, 19 bp, Homo sapiens
ggggccgccacggcctggc

SEQ ID NO: 2178287 - DNA, 20 bp, Homo sapiens
ggggcctctggctgcctggc

SEQ ID NO: 2178288 - DNA, 22 bp, Homo sapiens
ggggcctctggctgcctggccc

SEQ ID NO: 2178289 - DNA, 19 bp, Homo sapiens
ggggctcagccctgagctg

SEQ ID NO: 2178290 - DNA, 14 bp, Homo sapiens
gggggaggccgagg

SEQ ID NO: 2178291 - DNA, 12 bp, Homo sapiens
gggggccctgct

SEQ ID NO: 2178292 - DNA, 17 bp, Homo sapiens
ggggtcgtgaggcaaga

SEQ ID NO: 2178293 - DNA, 17 bp, Homo sapiens
ggggtctgggaggcagg

SEQ ID NO: 2178294 - DNA, 18 bp, Homo sapiens
ggggtctgggaggcaggt

SEQ ID NO: 2178295 - DNA, 14 bp, Homo sapiens
ggggtgaagctggg

SEQ ID NO: 2178296 - DNA, 16 bp, Homo sapiens
ggggtggggaggcaga

SEQ ID NO: 2178297 - DNA, 14 bp, Homo sapiens
ggggtgggggcctg

SEQ ID NO: 2178298 - DNA, 17 bp, Homo sapiens
gggtaatccctgctttt

SEQ ID NO: 2178299 - DNA, 16 bp, Homo sapiens
gggtaggcaaggctgc

SEQ ID NO: 2178300 - DNA, 14 bp, Homo sapiens
gggtagggggcctg

SEQ ID NO: 2178301 - DNA, 23 bp, Homo sapiens
gggtattgttaatattaatttat

SEQ ID NO: 2178302 - DNA, 21 bp, Homo sapiens
gggtgacagagcaagaccctg

SEQ ID NO: 2178303 - DNA, 21 bp, Homo sapiens
gggtgccaaccacctctggcc

SEQ ID NO: 2178304 - DNA, 13 bp, Homo sapiens
gggtggggcggga

SEQ ID NO: 2178305 - DNA, 16 bp, Homo sapiens
gggtggtgtccttctc

SEQ ID NO: 2178306 - DNA, 15 bp, Homo sapiens
gggttggggtggggc

SEQ ID NO: 2178307 - DNA, 22 bp, Homo sapiens
ggtaaacagaaatcctttcata

SEQ ID NO: 2178308 - DNA, 23 bp, Homo sapiens
ggtaagagggagccggtttggga

SEQ ID NO: 2178309 - DNA, 12 bp, Homo sapiens
ggtacctgccct

SEQ ID NO: 2178310 - DNA, 19 bp, Homo sapiens
ggtacttggtaagagggag

SEQ ID NO: 2178311 - DNA, 20 bp, Homo sapiens
ggtagcttctgacctcagca

SEQ ID NO: 2178312 - DNA, 13 bp, Homo sapiens
ggtagggggcctg

SEQ ID NO: 2178313 - DNA, 17 bp, Homo sapiens
ggtaggttctgaacagc

SEQ ID NO: 2178314 - DNA, 16 bp, Homo sapiens
ggtaggttctgtctgt

SEQ ID NO: 2178315 - DNA, 19 bp, Homo sapiens
ggtcaataattgtggagag

SEQ ID NO: 2178316 - DNA, 21 bp, Homo sapiens
ggtcaccaggggaggagcctg

SEQ ID NO: 2178317 - DNA, 15 bp, Homo sapiens
ggtcaggaggcaggg

SEQ ID NO: 2178318 - DNA, 23 bp, Homo sapiens
ggtcagtgtgccaccctctgcag

SEQ ID NO: 2178319 - DNA, 18 bp, Homo sapiens
ggtcatcagtattgtgta

SEQ ID NO: 2178320 - DNA, 21 bp, Homo sapiens
ggtccccaaaacactgtctgc

SEQ ID NO: 2178321 - DNA, 15 bp, Homo sapiens
ggtcctgtgcctgga

SEQ ID NO: 2178322 - DNA, 14 bp, Homo sapiens
ggtcgggctcagct

SEQ ID NO: 2178323 - DNA, 12 bp, Homo sapiens
ggtctatttctc

SEQ ID NO: 2178324 - DNA, 14 bp, Homo sapiens
ggtctgggaggcag

SEQ ID NO: 2178325 - DNA, 22 bp, Homo sapiens
ggtctgggggtcaggaggcagg

SEQ ID NO: 2178326 - DNA, 15 bp, Homo sapiens
ggtctttgtgtgctg

SEQ ID NO: 2178327 - DNA, 17 bp, Homo sapiens
ggtgaaaagtatggcag

SEQ ID NO: 2178328 - DNA, 13 bp, Homo sapiens
ggtgaagtttgtc

SEQ ID NO: 2178329 - DNA, 15 bp, Homo sapiens
ggtgagtttttcttt

SEQ ID NO: 2178330 - DNA, 18 bp, Homo sapiens
ggtgccaaccacctctgg

SEQ ID NO: 2178331 - DNA, 19 bp, Homo sapiens
ggtgccaccaccctgcccc

SEQ ID NO: 2178332 - DNA, 18 bp, Homo sapiens
ggtgccgaagtgtttctg

SEQ ID NO: 2178333 - DNA, 16 bp, Homo sapiens
ggtggaaggagcctgc

SEQ ID NO: 2178334 - DNA, 20 bp, Homo sapiens
ggtggaaggagcctgcggct

SEQ ID NO: 2178335 - DNA, 17 bp, Homo sapiens
ggtggcgctttctcctg

SEQ ID NO: 2178336 - DNA, 14 bp, Homo sapiens
ggtggctaaaggtc

SEQ ID NO: 2178337 - DNA, 20 bp, Homo sapiens
ggtggctggaggcattccca

SEQ ID NO: 2178338 - DNA, 17 bp, Homo sapiens
ggtggggaagagagcct

SEQ ID NO: 2178339 - DNA, 15 bp, Homo sapiens
ggtggggtgaagctg

SEQ ID NO: 2178340 - DNA, 18 bp, Homo sapiens
ggtgtaaaatatctacct

SEQ ID NO: 2178341 - DNA, 17 bp, Homo sapiens
ggtgtaatgaaaatgat

SEQ ID NO: 2178342 - DNA, 18 bp, Homo sapiens
ggtgtcacagaggcagtg

SEQ ID NO: 2178343 - DNA, 17 bp, Homo sapiens
ggtgtccttctcctctt

SEQ ID NO: 2178344 - DNA, 13 bp, Homo sapiens
ggttactcatttt

SEQ ID NO: 2178345 - DNA, 14 bp, Homo sapiens
ggttcccagaaaac

SEQ ID NO: 2178346 - DNA, 19 bp, Homo sapiens
ggttccccaagggccctgg

SEQ ID NO: 2178347 - DNA, 20 bp, Homo sapiens
ggttccccaagggccctggc

SEQ ID NO: 2178348 - DNA, 13 bp, Homo sapiens
ggttctggctgtt

SEQ ID NO: 2178349 - DNA, 20 bp, Homo sapiens
ggttctggttagctcagccc

SEQ ID NO: 2178350 - DNA, 22 bp, Homo sapiens
ggttctgtctgtgccaagggca

SEQ ID NO: 2178351 - DNA, 13 bp, Homo sapiens
ggttgcctggggg

SEQ ID NO: 2178352 - DNA, 17 bp, Homo sapiens
ggttggaactgctgcca

SEQ ID NO: 2178353 - DNA, 21 bp, Homo sapiens
ggttggaggcccttttctggc

SEQ ID NO: 2178354 - DNA, 22 bp, Homo sapiens
ggttggaggcctcaccctgctt

SEQ ID NO: 2178355 - DNA, 13 bp, Homo sapiens
ggttgttcaaagt

SEQ ID NO: 2178356 - DNA, 16 bp, Homo sapiens
gtaaaaataatgaatg

SEQ ID NO: 2178357 - DNA, 20 bp, Homo sapiens
gtaaaatatctacctgccct

SEQ ID NO: 2178358 - DNA, 17 bp, Homo sapiens
gtttctctgtgctctga

SEQ ID NO: 2178359 - DNA, 21 bp, Homo sapiens
gtttcttctaaagaggaagcc

SEQ ID NO: 2178360 - DNA, 14 bp, Homo sapiens
gtttcttgggaaaa

SEQ ID NO: 2178361 - DNA, 13 bp, Homo sapiens
gtttgcttctaaa

SEQ ID NO: 2178362 - DNA, 17 bp, Homo sapiens
gtttgctttgctttgta

SEQ ID NO: 2178363 - DNA, 16 bp, Homo sapiens
gtttggctgtaattta

SEQ ID NO: 2178364 - DNA, 16 bp, Homo sapiens
gtttgtatataaatgg

SEQ ID NO: 2178365 - DNA, 14 bp, Homo sapiens
gtttgtatgatgta

SEQ ID NO: 2178366 - DNA, 20 bp, Homo sapiens
gtttgtatttttagtagaga

SEQ ID NO: 2178367 - DNA, 23 bp, Homo sapiens
gtttgtttttgtttggtataaat

SEQ ID NO: 2178368 - DNA, 18 bp, Homo sapiens
gttttattctttgagaag

SEQ ID NO: 2178369 - DNA, 12 bp, Homo sapiens
gttttatttcat

SEQ ID NO: 2178370 - DNA, 19 bp, Homo sapiens
gttttgctccttctgtgtt

SEQ ID NO: 2178371 - DNA, 16 bp, Homo sapiens
gttttgtacttgttct

SEQ ID NO: 2178372 - DNA, 17 bp, Homo sapiens
gttttgtgaagaaacat

SEQ ID NO: 2178373 - DNA, 20 bp, Homo sapiens
gttttgtgtacagtatgtgt

SEQ ID NO: 2178374 - DNA, 16 bp, Homo sapiens
gtttttagagacaggg

SEQ ID NO: 2178375 - DNA, 23 bp, Homo sapiens
gttttttttttttctttttgtcc

SEQ ID NO: 2178376 - DNA, 18 bp, Homo sapiens
taaaaaaaaacattcaaa

SEQ ID NO: 2178377 - DNA, 14 bp, Homo sapiens
taaaaagagaaggc

SEQ ID NO: 2178378 - DNA, 16 bp, Homo sapiens
taaaaagctaatgaca

SEQ ID NO: 2178379 - DNA, 18 bp, Homo sapiens
taaaaatatctgaatata

SEQ ID NO: 2178380 - DNA, 18 bp, Homo sapiens
taaaaatatgtgagcatg

SEQ ID NO: 2178381 - DNA, 15 bp, Homo sapiens
taaaacaaaaccaag

SEQ ID NO: 2178382 - DNA, 20 bp, Homo sapiens
taaaacaaaaccaagccttg

SEQ ID NO: 2178383 - DNA, 18 bp, Homo sapiens
taaaacaattgtgacagc

SEQ ID NO: 2178384 - DNA, 16 bp, Homo sapiens
taaaagtcattcaaga

SEQ ID NO: 2178385 - DNA, 14 bp, Homo sapiens
taaaagttgcaaag

SEQ ID NO: 2178386 - DNA, 14 bp, Homo sapiens
taaaataatttatc

SEQ ID NO: 2178387 - DNA, 17 bp, Homo sapiens
taaaatacttgagaaat

SEQ ID NO: 2178388 - DNA, 14 bp, Homo sapiens
taaaatcacaaact

SEQ ID NO: 2178389 - DNA, 23 bp, Homo sapiens
taaaatcacaaactcatccatta

SEQ ID NO: 2178390 - DNA, 17 bp, Homo sapiens
taaaatctattttgtct

SEQ ID NO: 2178391 - DNA, 19 bp, Homo sapiens
taaaatctcacgctgccat

SEQ ID NO: 2178392 - DNA, 22 bp, Homo sapiens
taaaatgtatagcttaagatca

SEQ ID NO: 2178393 - DNA, 19 bp, Homo sapiens
taaaattcattccatttgc

SEQ ID NO: 2178394 - DNA, 14 bp, Homo sapiens
taaaatttgtagaa

SEQ ID NO: 2178395 - DNA, 21 bp, Homo sapiens
taaaatttgtagaattgaaaa

SEQ ID NO: 2178396 - DNA, 16 bp, Homo sapiens
taaacaaaactggaac

SEQ ID NO: 2178397 - DNA, 17 bp, Homo sapiens
taaacagtgagaaaaga

SEQ ID NO: 2178398 - DNA, 17 bp, Homo sapiens
taaactactatttttct

SEQ ID NO: 2178399 - DNA, 18 bp, Homo sapiens
taaactgagtagcagaaa

SEQ ID NO: 2178400 - DNA, 13 bp, Homo sapiens
taaactgccctgt

SEQ ID NO: 2178401 - DNA, 21 bp, Homo sapiens
taaactggagaggctaacctc

SEQ ID NO: 2178402 - DNA, 21 bp, Homo sapiens
taaacttgcaatgaaaagaaa

SEQ ID NO: 2178403 - DNA, 14 bp, Homo sapiens
taaagaaaattgcc

SEQ ID NO: 2178404 - DNA, 15 bp, Homo sapiens
taaagaaaattgcca

SEQ ID NO: 2178405 - DNA, 17 bp, Homo sapiens
taaagaaaattgccaaa

SEQ ID NO: 2178406 - DNA, 18 bp, Homo sapiens
taaagaaaattgccaaaa

SEQ ID NO: 2178407 - DNA, 20 bp, Homo sapiens
taaagaggtggggtgaagct

SEQ ID NO: 2178408 - DNA, 15 bp, Homo sapiens
taaagatctcaacat

SEQ ID NO: 2178409 - DNA, 18 bp, Homo sapiens
taaagatctcaacatgga

SEQ ID NO: 2178410 - DNA, 17 bp, Homo sapiens
taaagctgtttctaaac

SEQ ID NO: 2178411 - DNA, 15 bp, Homo sapiens
taaaggaagaaacca

SEQ ID NO: 2178412 - DNA, 20 bp, Homo sapiens
taaaggtttcgttgcatggt

SEQ ID NO: 2178413 - DNA, 16 bp, Homo sapiens
taaagtaaaaggcact

SEQ ID NO: 2178414 - DNA, 15 bp, Homo sapiens
taaagtaaattgaaa

SEQ ID NO: 2178415 - DNA, 14 bp, Homo sapiens
taaagtactgcaaa

SEQ ID NO: 2178416 - DNA, 21 bp, Homo sapiens
taaagtatgtattatttacat

SEQ ID NO: 2178417 - DNA, 13 bp, Homo sapiens
taaagtgctctat

SEQ ID NO: 2178418 - DNA, 20 bp, Homo sapiens
taaagtgctctatttattaa

SEQ ID NO: 2178419 - DNA, 23 bp, Homo sapiens
taaagtgctctatttattaagaa

SEQ ID NO: 2178420 - DNA, 23 bp, Homo sapiens
taaagtgtcatccaccagtgtgt

SEQ ID NO: 2178421 - DNA, 13 bp, Homo sapiens
taaataaattatg

SEQ ID NO: 2178422 - DNA, 15 bp, Homo sapiens
taaatacatggaaat

SEQ ID NO: 2178423 - DNA, 14 bp, Homo sapiens
taaatactgtacat

SEQ ID NO: 2178424 - DNA, 13 bp, Homo sapiens
taaatatagaacc

SEQ ID NO: 2178425 - DNA, 15 bp, Homo sapiens
taaatatattttctt

SEQ ID NO: 2178426 - DNA, 17 bp, Homo sapiens
taaatctctatctcttt

SEQ ID NO: 2178427 - DNA, 22 bp, Homo sapiens
taaatctctatctctttatata

SEQ ID NO: 2178428 - DNA, 16 bp, Homo sapiens
taaatctgccatttca

SEQ ID NO: 2178429 - DNA, 23 bp, Homo sapiens
taaatggctcgtgggctctggct

SEQ ID NO: 2178430 - DNA, 21 bp, Homo sapiens
taaatggtgagaattaaaata

SEQ ID NO: 2178431 - DNA, 17 bp, Homo sapiens
taaattgcacgtgcaat

SEQ ID NO: 2178432 - DNA, 15 bp, Homo sapiens
taacaaagaagtgta

SEQ ID NO: 2178433 - DNA, 17 bp, Homo sapiens
taacaatgcatgctttg

SEQ ID NO: 2178434 - DNA, 15 bp, Homo sapiens
taacaatgttaaatg

SEQ ID NO: 2178435 - DNA, 12 bp, Homo sapiens
taacacactgaa

SEQ ID NO: 2178436 - DNA, 14 bp, Homo sapiens
taacacactgaacc

SEQ ID NO: 2178437 - DNA, 13 bp, Homo sapiens
taacactttttaa

SEQ ID NO: 2178438 - DNA, 14 bp, Homo sapiens
taacagaaattgta

SEQ ID NO: 2178439 - DNA, 17 bp, Homo sapiens
taacagggccttgctaa

SEQ ID NO: 2178440 - DNA, 14 bp, Homo sapiens
taacaggggctggt

SEQ ID NO: 2178441 - DNA, 19 bp, Homo sapiens
taacagttgtatttaacag

SEQ ID NO: 2178442 - DNA, 21 bp, Homo sapiens
taacataagctagaaaaatta

SEQ ID NO: 2178443 - DNA, 17 bp, Homo sapiens
taacatagtaacgtgtt

SEQ ID NO: 2178444 - DNA, 20 bp, Homo sapiens
taaccccgtctgctcctccc

SEQ ID NO: 2178445 - DNA, 21 bp, Homo sapiens
taaccctttcttcaatacaaa

SEQ ID NO: 2178446 - DNA, 15 bp, Homo sapiens
taacctacctgtgaa

SEQ ID NO: 2178447 - DNA, 22 bp, Homo sapiens
taacctacttgtaaacttgaaa

SEQ ID NO: 2178448 - DNA, 18 bp, Homo sapiens
taacctgtttaagatgac

SEQ ID NO: 2178449 - DNA, 16 bp, Homo sapiens
taactcacctaactca

SEQ ID NO: 2178450 - DNA, 23 bp, Homo sapiens
taactcatactgtgctggagcca

SEQ ID NO: 2178451 - DNA, 11 bp, Homo sapiens
taactgagctg

SEQ ID NO: 2178452 - DNA, 11 bp, Homo sapiens
taactgcatta

SEQ ID NO: 2178453 - DNA, 13 bp, Homo sapiens
taactgcattcta

SEQ ID NO: 2178454 - DNA, 17 bp, Homo sapiens
taactgcattctataat

SEQ ID NO: 2178455 - DNA, 18 bp, Homo sapiens
taactgcctggcctggca

SEQ ID NO: 2178456 - DNA, 22 bp, Homo sapiens
taactggcttctgcttgtcatc

SEQ ID NO: 2178457 - DNA, 12 bp, Homo sapiens
taactgtatttg

SEQ ID NO: 2178458 - DNA, 18 bp, Homo sapiens
taacttacccttagggag

SEQ ID NO: 2178459 - DNA, 14 bp, Homo sapiens
taacttcatattaa

SEQ ID NO: 2178460 - DNA, 12 bp, Homo sapiens
taacttcctctt

SEQ ID NO: 2178461 - DNA, 12 bp, Homo sapiens
taacttgaaaag

SEQ ID NO: 2178462 - DNA, 22 bp, Homo sapiens
taacttgaaaagattgcaaagg

SEQ ID NO: 2178463 - DNA, 14 bp, Homo sapiens
taactttagaaata

SEQ ID NO: 2178464 - DNA, 13 bp, Homo sapiens
taagaaaaacatg

SEQ ID NO: 2178465 - DNA, 17 bp, Homo sapiens
taagaaaaacatgtcat

SEQ ID NO: 2178466 - DNA, 22 bp, Homo sapiens
taagaacatgttacgtgtgcaa

SEQ ID NO: 2178467 - DNA, 17 bp, Homo sapiens
taagaatttattattaa

SEQ ID NO: 2178468 - DNA, 17 bp, Homo sapiens
taagaatttcaatatca

SEQ ID NO: 2178469 - DNA, 13 bp, Homo sapiens
taagacaaatggg

SEQ ID NO: 2178470 - DNA, 17 bp, Homo sapiens
taagacaaatgggactg

SEQ ID NO: 2178471 - DNA, 20 bp, Homo sapiens
taagacaaatgggactgatg

SEQ ID NO: 2178472 - DNA, 21 bp, Homo sapiens
taagacaaatgggactgatgt

SEQ ID NO: 2178473 - DNA, 23 bp, Homo sapiens
taagatgtattaacctacctgtg

SEQ ID NO: 2178474 - DNA, 14 bp, Homo sapiens
taagcaactggaaa

SEQ ID NO: 2178475 - DNA, 18 bp, Homo sapiens
taagcacctttagaatat

SEQ ID NO: 2178476 - DNA, 17 bp, Homo sapiens
taagctagaaaaattag

SEQ ID NO: 2178477 - DNA, 17 bp, Homo sapiens
taaggattctgaagttt

SEQ ID NO: 2178478 - DNA, 18 bp, Homo sapiens
taaggcagctctgtcgtg

SEQ ID NO: 2178479 - DNA, 19 bp, Homo sapiens
taaggcctcttgctggtgc

SEQ ID NO: 2178480 - DNA, 13 bp, Homo sapiens
tactatcctggct

SEQ ID NO: 2178481 - DNA, 14 bp, Homo sapiens
tactcaaccctctc

SEQ ID NO: 2178482 - DNA, 23 bp, Homo sapiens
tactcaaccctctcaggtgacca

SEQ ID NO: 2178483 - DNA, 23 bp, Homo sapiens
tactcgcaggggcgctggctgca

SEQ ID NO: 2178484 - DNA, 19 bp, Homo sapiens
tactctttgtctttttaag

SEQ ID NO: 2178485 - DNA, 18 bp, Homo sapiens
tactgatccccaatatgt

SEQ ID NO: 2178486 - DNA, 10 bp, Homo sapiens
tactggctgt

SEQ ID NO: 2178487 - DNA, 13 bp, Homo sapiens
tactggtttgtat

SEQ ID NO: 2178488 - DNA, 18 bp, Homo sapiens
tactgtgctggagccact

SEQ ID NO: 2178489 - DNA, 22 bp, Homo sapiens
tactgttgagaaaaaagaccct

SEQ ID NO: 2178490 - DNA, 19 bp, Homo sapiens
tactgtttgtcttctcccc

SEQ ID NO: 2178491 - DNA, 16 bp, Homo sapiens
tacttaaaaatatgtg

SEQ ID NO: 2178492 - DNA, 17 bp, Homo sapiens
tacttaaaaatatgtga

SEQ ID NO: 2178493 - DNA, 14 bp, Homo sapiens
tacttatctctaaa

SEQ ID NO: 2178494 - DNA, 16 bp, Homo sapiens
tacttcagctttgtgt

SEQ ID NO: 2178495 - DNA, 17 bp, Homo sapiens
tacttggtaagagggag

SEQ ID NO: 2178496 - DNA, 18 bp, Homo sapiens
tacttgtaaacttgaaag

SEQ ID NO: 2178497 - DNA, 18 bp, Homo sapiens
tacttgtgaacatgcctt

SEQ ID NO: 2178498 - DNA, 19 bp, Homo sapiens
tactttaccacccccacac

SEQ ID NO: 2178499 - DNA, 21 bp, Homo sapiens
tactttgattccattttaagt

SEQ ID NO: 2178500 - DNA, 23 bp, Homo sapiens
tagaaaaaggagcttacctccca

SEQ ID NO: 2178501 - DNA, 23 bp, Homo sapiens
tagaaaattttatgtattttaaa

SEQ ID NO: 2178502 - DNA, 19 bp, Homo sapiens
tagaaagcatccattaatt

SEQ ID NO: 2178503 - DNA, 12 bp, Homo sapiens
tagaaattacaa

SEQ ID NO: 2178504 - DNA, 14 bp, Homo sapiens
tagaaattacaagt

SEQ ID NO: 2178505 - DNA, 18 bp, Homo sapiens
tagaaattacaagtttca

SEQ ID NO: 2178506 - DNA, 17 bp, Homo sapiens
tagaacagatggctgtg

SEQ ID NO: 2178507 - DNA, 20 bp, Homo sapiens
tagaacagatggctgtgaaa

SEQ ID NO: 2178508 - DNA, 20 bp, Homo sapiens
tagaagtggcatctgaaaac

SEQ ID NO: 2178509 - DNA, 16 bp, Homo sapiens
tagaagtggtgttttt

SEQ ID NO: 2178510 - DNA, 19 bp, Homo sapiens
tagaataaggattctgaag

SEQ ID NO: 2178511 - DNA, 21 bp, Homo sapiens
tagaatactaataaaatacat

SEQ ID NO: 2178512 - DNA, 20 bp, Homo sapiens
tagaatattaaaaattaatt

SEQ ID NO: 2178513 - DNA, 17 bp, Homo sapiens
tagaatcaagtctgtga

SEQ ID NO: 2178514 - DNA, 14 bp, Homo sapiens
tagaattaaaattt

SEQ ID NO: 2178515 - DNA, 22 bp, Homo sapiens
tagacaaccctgaggtatctgt

SEQ ID NO: 2178516 - DNA, 22 bp, Homo sapiens
tagacagtggtaaatatagaac

SEQ ID NO: 2178517 - DNA, 18 bp, Homo sapiens
tagacatccccctccttg

SEQ ID NO: 2178518 - DNA, 16 bp, Homo sapiens
tagaccaaaagattca

SEQ ID NO: 2178519 - DNA, 15 bp, Homo sapiens
tagacccctggctgg

SEQ ID NO: 2178520 - DNA, 11 bp, Homo sapiens
tagagaatgtg

SEQ ID NO: 2178521 - DNA, 22 bp, Homo sapiens
tagagaattcctatttaaaaaa

SEQ ID NO: 2178522 - DNA, 22 bp, Homo sapiens
tagagaggggcctctggctgcc

SEQ ID NO: 2178523 - DNA, 15 bp, Homo sapiens
tagagatgcctccct

SEQ ID NO: 2178524 - DNA, 14 bp, Homo sapiens
tagagcagccctgg

SEQ ID NO: 2178525 - DNA, 20 bp, Homo sapiens
tagatgactgaatttctatg

SEQ ID NO: 2178526 - DNA, 22 bp, Homo sapiens
tagatgagaattcagctgcccc

SEQ ID NO: 2178527 - DNA, 22 bp, Homo sapiens
tagatgcaaaaaactaatgtga

SEQ ID NO: 2178528 - DNA, 17 bp, Homo sapiens
tagatgtctgtaaccaa

SEQ ID NO: 2178529 - DNA, 14 bp, Homo sapiens
tagattctttatta

SEQ ID NO: 2178530 - DNA, 21 bp, Homo sapiens
tagcaacgcctgccttctggg

SEQ ID NO: 2178531 - DNA, 14 bp, Homo sapiens
tagcactcacatgc

SEQ ID NO: 2178532 - DNA, 18 bp, Homo sapiens
tagcactcacatgctgga

SEQ ID NO: 2178533 - DNA, 22 bp, Homo sapiens
tagcaggaaaaggtccttgact

SEQ ID NO: 2178534 - DNA, 15 bp, Homo sapiens
tagcaggaaatgtag

SEQ ID NO: 2178535 - DNA, 14 bp, Homo sapiens
tagcaggcccagct

SEQ ID NO: 2178536 - DNA, 18 bp, Homo sapiens
tagcatatataattttat

SEQ ID NO: 2178537 - DNA, 22 bp, Homo sapiens
tagccaactgtttccctgctga

SEQ ID NO: 2178538 - DNA, 14 bp, Homo sapiens
tagccatgggacca

SEQ ID NO: 2178539 - DNA, 16 bp, Homo sapiens
tagccatttgaagaag

SEQ ID NO: 2178540 - DNA, 12 bp, Homo sapiens
tagcctccctct

SEQ ID NO: 2178541 - DNA, 17 bp, Homo sapiens
tagcctccctctcctct

SEQ ID NO: 2178542 - DNA, 17 bp, Homo sapiens
tagcctgcgtcatggct

SEQ ID NO: 2178543 - DNA, 21 bp, Homo sapiens
tagcctgcgtcatggctcaag

SEQ ID NO: 2178544 - DNA, 14 bp, Homo sapiens
tagccttttgtaac

SEQ ID NO: 2178545 - DNA, 15 bp, Homo sapiens
tagctattctttgac

SEQ ID NO: 2178546 - DNA, 14 bp, Homo sapiens
tagctcagccccag

SEQ ID NO: 2178547 - DNA, 19 bp, Homo sapiens
tagctcagccccagcccag

SEQ ID NO: 2178548 - DNA, 14 bp, Homo sapiens
tagctcccctcctc

SEQ ID NO: 2178549 - DNA, 21 bp, Homo sapiens
tagctgggcaaacccttctct

SEQ ID NO: 2178550 - DNA, 16 bp, Homo sapiens
tagctgtatatttgaa

SEQ ID NO: 2178551 - DNA, 22 bp, Homo sapiens
tagctgtatatttgaaactgct

SEQ ID NO: 2178552 - DNA, 13 bp, Homo sapiens
tagcttagagcct

SEQ ID NO: 2178553 - DNA, 12 bp, Homo sapiens
taggagacttgt

SEQ ID NO: 2178554 - DNA, 21 bp, Homo sapiens
taggattaagttcgaggtggc

SEQ ID NO: 2178555 - DNA, 18 bp, Homo sapiens
taggcaattagagaaagt

SEQ ID NO: 2178556 - DNA, 13 bp, Homo sapiens
taggccccagagg

SEQ ID NO: 2178557 - DNA, 17 bp, Homo sapiens
taggccccagaggccct

SEQ ID NO: 2178558 - DNA, 18 bp, Homo sapiens
taggctgggcccagaggc

SEQ ID NO: 2178559 - DNA, 12 bp, Homo sapiens
taggctgggtgc

SEQ ID NO: 2178560 - DNA, 17 bp, Homo sapiens
taggctgggtgcccaca

SEQ ID NO: 2178561 - DNA, 18 bp, Homo sapiens
taggctgggtgcccacag

SEQ ID NO: 2178562 - DNA, 17 bp, Homo sapiens
tagggacccctcctccc

SEQ ID NO: 2178563 - DNA, 12 bp, Homo sapiens
tagggctgggtg

SEQ ID NO: 2178564 - DNA, 13 bp, Homo sapiens
tagggttctgctt

SEQ ID NO: 2178565 - DNA, 18 bp, Homo sapiens
tagggttttctatttctt

SEQ ID NO: 2178566 - DNA, 13 bp, Homo sapiens
taggtggagaggt

SEQ ID NO: 2178567 - DNA, 13 bp, Homo sapiens
taggtgtctttta

SEQ ID NO: 2178568 - DNA, 23 bp, Homo sapiens
taggtgtcttttaatgatactgt

SEQ ID NO: 2178569 - DNA, 21 bp, Homo sapiens
taggtttagaatcaagtctgt

SEQ ID NO: 2178570 - DNA, 21 bp, Homo sapiens
tagtaacctttaaaaatgtat

SEQ ID NO: 2178571 - DNA, 16 bp, Homo sapiens
tagtaacgtgttactg

SEQ ID NO: 2178572 - DNA, 14 bp, Homo sapiens
tagtacccacctga

SEQ ID NO: 2178573 - DNA, 16 bp, Homo sapiens
tagtacctttgctctt

SEQ ID NO: 2178574 - DNA, 23 bp, Homo sapiens
tagtagagcaacccattaatctt

SEQ ID NO: 2178575 - DNA, 15 bp, Homo sapiens
tagtcctccctgctc

SEQ ID NO: 2178576 - DNA, 18 bp, Homo sapiens
tagtgcagtcaccctgtg

SEQ ID NO: 2178577 - DNA, 19 bp, Homo sapiens
tagtgcagtcaccctgtgg

SEQ ID NO: 2178578 - DNA, 20 bp, Homo sapiens
tagtggaaagattgtgtctg

SEQ ID NO: 2178579 - DNA, 17 bp, Homo sapiens
tagtggccagaccagag

SEQ ID NO: 2178580 - DNA, 19 bp, Homo sapiens
tagtggccagaccagagct

SEQ ID NO: 2178581 - DNA, 11 bp, Homo sapiens
tagtgggtgag

SEQ ID NO: 2178582 - DNA, 12 bp, Homo sapiens
tagtggtttgct

SEQ ID NO: 2178583 - DNA, 16 bp, Homo sapiens
tagttctgtatataaa

SEQ ID NO: 2178584 - DNA, 18 bp, Homo sapiens
tagtttaggtgtttggga

SEQ ID NO: 2178585 - DNA, 15 bp, Homo sapiens
tagtttgctttgctt

SEQ ID NO: 2178586 - DNA, 13 bp, Homo sapiens
tagttttgttcca

SEQ ID NO: 2178587 - DNA, 16 bp, Homo sapiens
tagttttgttccaaca

SEQ ID NO: 2178588 - DNA, 14 bp, Homo sapiens
tataaaattagatt

SEQ ID NO: 2178589 - DNA, 21 bp, Homo sapiens
tataaatatattttctttcta

SEQ ID NO: 2178590 - DNA, 12 bp, Homo sapiens
tataaatatgtg

SEQ ID NO: 2178591 - DNA, 19 bp, Homo sapiens
tataaatggtgagaattaa

SEQ ID NO: 2178592 - DNA, 20 bp, Homo sapiens
tataaatggtgagaattaaa

SEQ ID NO: 2178593 - DNA, 14 bp, Homo sapiens
tataaatgtcctaa

SEQ ID NO: 2178594 - DNA, 16 bp, Homo sapiens
tataagcaacatgaat

SEQ ID NO: 2178595 - DNA, 23 bp, Homo sapiens
tataagcaacatgaattaagaac

SEQ ID NO: 2178596 - DNA, 18 bp, Homo sapiens
tataagtttctttagaaa

SEQ ID NO: 2178597 - DNA, 15 bp, Homo sapiens
tataatgctggagcg

SEQ ID NO: 2178598 - DNA, 12 bp, Homo sapiens
tataattaaaga

SEQ ID NO: 2178599 - DNA, 13 bp, Homo sapiens
tataattaaagaa

SEQ ID NO: 2178600 - DNA, 21 bp, Homo sapiens
tataattgttctcagaatccc

SEQ ID NO: 2178601 - DNA, 22 bp, Homo sapiens
tatacgtatgcatttttttagt

SEQ ID NO: 2178602 - DNA, 18 bp, Homo sapiens
tcccgtcttcctcctccc

SEQ ID NO: 2178603 - DNA, 14 bp, Homo sapiens
tcccgttgcagagg

SEQ ID NO: 2178604 - DNA, 23 bp, Homo sapiens
tcccgtttagagttatttaggct

SEQ ID NO: 2178605 - DNA, 13 bp, Homo sapiens
tccctacccacag

SEQ ID NO: 2178606 - DNA, 19 bp, Homo sapiens
tccctacccacagggcctg

SEQ ID NO: 2178607 - DNA, 20 bp, Homo sapiens
tccctacccacagggcctga

SEQ ID NO: 2178608 - DNA, 24 bp, Homo sapiens
tccctacccacagggcctgacttt

SEQ ID NO: 2178609 - DNA, 17 bp, Homo sapiens
tccctaggcacctctgt

SEQ ID NO: 2178610 - DNA, 15 bp, Homo sapiens
tccctagggctgggt

SEQ ID NO: 2178611 - DNA, 16 bp, Homo sapiens
tccctataatgctgga

SEQ ID NO: 2178612 - DNA, 14 bp, Homo sapiens
tccctccctgcagg

SEQ ID NO: 2178613 - DNA, 16 bp, Homo sapiens
tccctcctgcctgcgc

SEQ ID NO: 2178614 - DNA, 17 bp, Homo sapiens
tccctcgaacccacact

SEQ ID NO: 2178615 - DNA, 13 bp, Homo sapiens
tccctctcctctg

SEQ ID NO: 2178616 - DNA, 16 bp, Homo sapiens
tccctctcctctgtcc

SEQ ID NO: 2178617 - DNA, 12 bp, Homo sapiens
tccctgaacaga

SEQ ID NO: 2178618 - DNA, 21 bp, Homo sapiens
tccctgcacacggcacagagc

SEQ ID NO: 2178619 - DNA, 10 bp, Homo sapiens
tccctgcagg

SEQ ID NO: 2178620 - DNA, 17 bp, Homo sapiens
tccctgccccctcccct

SEQ ID NO: 2178621 - DNA, 20 bp, Homo sapiens
tccctgctcagctggccggg

SEQ ID NO: 2178622 - DNA, 11 bp, Homo sapiens
tccctgctgaa

SEQ ID NO: 2178623 - DNA, 18 bp, Homo sapiens
tccctggaccagatgctg

SEQ ID NO: 2178624 - DNA, 14 bp, Homo sapiens
tccctggccatctc

SEQ ID NO: 2178625 - DNA, 15 bp, Homo sapiens
tccctgttctggaca

SEQ ID NO: 2178626 - DNA, 17 bp, Homo sapiens
tcccttaacagttgtat

SEQ ID NO: 2178627 - DNA, 15 bp, Homo sapiens
tcccttatttttatt

SEQ ID NO: 2178628 - DNA, 21 bp, Homo sapiens
tcccttcaagacgaggggcag

SEQ ID NO: 2178629 - DNA, 19 bp, Homo sapiens
tcccttcaatcctgtcaat

SEQ ID NO: 2178630 - DNA, 16 bp, Homo sapiens
tcccttccacaccccc

SEQ ID NO: 2178631 - DNA, 13 bp, Homo sapiens
tccctttgctcca

SEQ ID NO: 2178632 - DNA, 20 bp, Homo sapiens
tccctttgctccaccccact

SEQ ID NO: 2178633 - DNA, 17 bp, Homo sapiens
tccctttttccttgtcc

SEQ ID NO: 2178634 - DNA, 21 bp, Homo sapiens
tccctttttccttgtccccac

SEQ ID NO: 2178635 - DNA, 21 bp, Homo sapiens
tccgaggacccaggaaaggca

SEQ ID NO: 2178636 - DNA, 20 bp, Homo sapiens
tccgcctggcacccactccg

SEQ ID NO: 2178637 - DNA, 15 bp, Homo sapiens
tccgtgagcagtgtg

SEQ ID NO: 2178638 - DNA, 17 bp, Homo sapiens
tcctaaatggccctgtt

SEQ ID NO: 2178639 - DNA, 21 bp, Homo sapiens
tcctaccccaattccttgtag

SEQ ID NO: 2178640 - DNA, 14 bp, Homo sapiens
tcctcaaggggcca

SEQ ID NO: 2178641 - DNA, 15 bp, Homo sapiens
tcctcaaggggccat

SEQ ID NO: 2178642 - DNA, 21 bp, Homo sapiens
tcctcattcttctctcccaca

SEQ ID NO: 2178643 - DNA, 16 bp, Homo sapiens
tcctccatggcccatc

SEQ ID NO: 2178644 - DNA, 18 bp, Homo sapiens
tcctcccaaaatactaca

SEQ ID NO: 2178645 - DNA, 19 bp, Homo sapiens
tcctcccacccctccccac

SEQ ID NO: 2178646 - DNA, 11 bp, Homo sapiens
tcctcccataa

SEQ ID NO: 2178647 - DNA, 15 bp, Homo sapiens
tcctccggggctcag

SEQ ID NO: 2178648 - DNA, 15 bp, Homo sapiens
tcctctaaacacact

SEQ ID NO: 2178649 - DNA, 22 bp, Homo sapiens
tcctctaacaggggctggtggg

SEQ ID NO: 2178650 - DNA, 20 bp, Homo sapiens
tcctctcgttggtagttgag

SEQ ID NO: 2178651 - DNA, 13 bp, Homo sapiens
tcctctctgctgg

SEQ ID NO: 2178652 - DNA, 17 bp, Homo sapiens
tcctctgtccccatagc

SEQ ID NO: 2178653 - DNA, 18 bp, Homo sapiens
tcctgaaagcattatttt

SEQ ID NO: 2178654 - DNA, 23 bp, Homo sapiens
tcctgaggcagaacctggtggct

SEQ ID NO: 2178655 - DNA, 12 bp, Homo sapiens
tcctgcagagct

SEQ ID NO: 2178656 - DNA, 15 bp, Homo sapiens
tcctgcagagctggg

SEQ ID NO: 2178657 - DNA, 17 bp, Homo sapiens
tcctgcagagctggggg

SEQ ID NO: 2178658 - DNA, 20 bp, Homo sapiens
tcctgcccgccctccctcct

SEQ ID NO: 2178659 - DNA, 21 bp, Homo sapiens
tcctgccgggcaggtcccagg

SEQ ID NO: 2178660 - DNA, 19 bp, Homo sapiens
tcctgctatttcccaagct

SEQ ID NO: 2178661 - DNA, 15 bp, Homo sapiens
tcctgctctctaccc

SEQ ID NO: 2178662 - DNA, 19 bp, Homo sapiens
tcctgctctctacccagcc

SEQ ID NO: 2178663 - DNA, 21 bp, Homo sapiens
tcctgctctctacccagccca

SEQ ID NO: 2178664 - DNA, 14 bp, Homo sapiens
tcctgctggtacct

SEQ ID NO: 2178665 - DNA, 23 bp, Homo sapiens
tcctgctggtacctgccctctat

SEQ ID NO: 2178666 - DNA, 14 bp, Homo sapiens
tcctggagagtctc

SEQ ID NO: 2178667 - DNA, 18 bp, Homo sapiens
tcctggagagtctcactc

SEQ ID NO: 2178668 - DNA, 15 bp, Homo sapiens
tcctggctttgccca

SEQ ID NO: 2178669 - DNA, 23 bp, Homo sapiens
tcctggctttgcccaacctcagc

SEQ ID NO: 2178670 - DNA, 16 bp, Homo sapiens
tcctgggctcaagcaa

SEQ ID NO: 2178671 - DNA, 12 bp, Homo sapiens
tcctgggtgagt

SEQ ID NO: 2178672 - DNA, 22 bp, Homo sapiens
tcctgtccgccctcttcccctc

SEQ ID NO: 2178673 - DNA, 12 bp, Homo sapiens
tcctgtctcccc

SEQ ID NO: 2178674 - DNA, 13 bp, Homo sapiens
tcctgtctcccct

SEQ ID NO: 2178675 - DNA, 14 bp, Homo sapiens
tcctgtctcccctc

SEQ ID NO: 2178676 - DNA, 16 bp, Homo sapiens
tcctgtctcccctctg

SEQ ID NO: 2178677 - DNA, 14 bp, Homo sapiens
tcctgtgtaaatta

SEQ ID NO: 2178678 - DNA, 14 bp, Homo sapiens
tcctgttgttactg

SEQ ID NO: 2178679 - DNA, 20 bp, Homo sapiens
tccttagaaaagactgacct

SEQ ID NO: 2178680 - DNA, 17 bp, Homo sapiens
tccttagaggaagaata

SEQ ID NO: 2178681 - DNA, 15 bp, Homo sapiens
tccttatttttactt

SEQ ID NO: 2178682 - DNA, 15 bp, Homo sapiens
tccttcaattttctt

SEQ ID NO: 2178683 - DNA, 18 bp, Homo sapiens
tccttccaactgctgccc

SEQ ID NO: 2178684 - DNA, 10 bp, Homo sapiens
tccttctcct

SEQ ID NO: 2178685 - DNA, 13 bp, Homo sapiens
tccttctcctctt

SEQ ID NO: 2178686 - DNA, 11 bp, Homo sapiens
tccttctcttt

SEQ ID NO: 2178687 - DNA, 12 bp, Homo sapiens
tccttctgtgtt

SEQ ID NO: 2178688 - DNA, 16 bp, Homo sapiens
tccttgacttgatgaa

SEQ ID NO: 2178689 - DNA, 17 bp, Homo sapiens
tccttgtccccacactc

SEQ ID NO: 2178690 - DNA, 13 bp, Homo sapiens
tcctttaattgta

SEQ ID NO: 2178691 - DNA, 15 bp, Homo sapiens
tcctttaattgtaaa

SEQ ID NO: 2178692 - DNA, 22 bp, Homo sapiens
tcctttcttccctcatgttctc

SEQ ID NO: 2178693 - DNA, 19 bp, Homo sapiens
tcgaacccacactgcaaca

SEQ ID NO: 2178694 - DNA, 16 bp, Homo sapiens
tcgaagtcttccatca

SEQ ID NO: 2178695 - DNA, 20 bp, Homo sapiens
tcgaagtcttccatcagcag

SEQ ID NO: 2178696 - DNA, 16 bp, Homo sapiens
tcgaatcactcattta

SEQ ID NO: 2178697 - DNA, 10 bp, Homo sapiens
tcgaggtggc

SEQ ID NO: 2178698 - DNA, 18 bp, Homo sapiens
tcgcaggggcgctggctg

SEQ ID NO: 2178699 - DNA, 14 bp, Homo sapiens
tcgcagtgcccagt

SEQ ID NO: 2178700 - DNA, 16 bp, Homo sapiens
tcgctgtccaagtgtt

SEQ ID NO: 2178701 - DNA, 22 bp, Homo sapiens
tcgctgtccaagtgtttcttgt

SEQ ID NO: 2178702 - DNA, 14 bp, Homo sapiens
tcgcttctctgtga

SEQ ID NO: 2178703 - DNA, 19 bp, Homo sapiens
tcggacctcagtttctgtt

SEQ ID NO: 2178704 - DNA, 14 bp, Homo sapiens
tcggaggtggcagc

SEQ ID NO: 2178705 - DNA, 22 bp, Homo sapiens
tcggcattggttccctttgctc

SEQ ID NO: 2178706 - DNA, 13 bp, Homo sapiens
tcggctgtggaga

SEQ ID NO: 2178707 - DNA, 15 bp, Homo sapiens
tcgggctcagctctg

SEQ ID NO: 2178708 - DNA, 19 bp, Homo sapiens
tcgtcttgagcccaggagt

SEQ ID NO: 2178709 - DNA, 22 bp, Homo sapiens
tcgtggactgagtgggaagccc

SEQ ID NO: 2178710 - DNA, 15 bp, Homo sapiens
tcgtgtatttattac

SEQ ID NO: 2178711 - DNA, 14 bp, Homo sapiens
tctaaaatacttga

SEQ ID NO: 2178712 - DNA, 13 bp, Homo sapiens
tctaaaccaaaac

SEQ ID NO: 2178713 - DNA, 15 bp, Homo sapiens
tctaaagaggaagcc

SEQ ID NO: 2178714 - DNA, 17 bp, Homo sapiens
tctaacaggacttgaat

SEQ ID NO: 2178715 - DNA, 16 bp, Homo sapiens
tctaacaggggctggt

SEQ ID NO: 2178716 - DNA, 20 bp, Homo sapiens
tctacagcaccttaaaaatt

SEQ ID NO: 2178717 - DNA, 14 bp, Homo sapiens
tctacccagcccat

SEQ ID NO: 2178718 - DNA, 13 bp, Homo sapiens
tctagaatactaa

SEQ ID NO: 2178719 - DNA, 19 bp, Homo sapiens
tctagggaaggccacctgc

SEQ ID NO: 2178720 - DNA, 18 bp, Homo sapiens
tctagggacccctcctcc

SEQ ID NO: 2178721 - DNA, 16 bp, Homo sapiens
tctaggtcaaggcctg

SEQ ID NO: 2178722 - DNA, 15 bp, Homo sapiens
tctagtttgtttagt

SEQ ID NO: 2178723 - DNA, 20 bp, Homo sapiens
tctataataaatgggcacag

SEQ ID NO: 2178724 - DNA, 21 bp, Homo sapiens
tctatatagtacctttgctct

SEQ ID NO: 2178725 - DNA, 20 bp, Homo sapiens
tgcagcagcttgctgcaccc

SEQ ID NO: 2178726 - DNA, 21 bp, Homo sapiens
tgcagcctcgaactcctgggc

SEQ ID NO: 2178727 - DNA, 21 bp, Homo sapiens
tgcagcggtggaaggagcctg

SEQ ID NO: 2178728 - DNA, 22 bp, Homo sapiens
tgcagcggtggaaggagcctgc

SEQ ID NO: 2178729 - DNA, 13 bp, Homo sapiens
tgcagctgctggt

SEQ ID NO: 2178730 - DNA, 15 bp, Homo sapiens
tgcagggcagcctgt

SEQ ID NO: 2178731 - DNA, 19 bp, Homo sapiens
tgcagggcagcctgtggga

SEQ ID NO: 2178732 - DNA, 20 bp, Homo sapiens
tgcagggtcctccggggctc

SEQ ID NO: 2178733 - DNA, 20 bp, Homo sapiens
tgcagtatgatggcaggaga

SEQ ID NO: 2178734 - DNA, 19 bp, Homo sapiens
tgcagtcacccctgtctgc

SEQ ID NO: 2178735 - DNA, 20 bp, Homo sapiens
tgcagtgcctttccccattc

SEQ ID NO: 2178736 - DNA, 14 bp, Homo sapiens
tgcatcaaccagga

SEQ ID NO: 2178737 - DNA, 18 bp, Homo sapiens
tgcatcagcctctggcca

SEQ ID NO: 2178738 - DNA, 19 bp, Homo sapiens
tgcatcagcctctggccag

SEQ ID NO: 2178739 - DNA, 18 bp, Homo sapiens
tgcatccacaggattcca

SEQ ID NO: 2178740 - DNA, 22 bp, Homo sapiens
tgcatccacaggattccagttg

SEQ ID NO: 2178741 - DNA, 23 bp, Homo sapiens
tgcatcccaaaccacgcctcttg

SEQ ID NO: 2178742 - DNA, 16 bp, Homo sapiens
tgcatccgtgagcagt

SEQ ID NO: 2178743 - DNA, 21 bp, Homo sapiens
tgcatcgctgtccaagtgttt

SEQ ID NO: 2178744 - DNA, 18 bp, Homo sapiens
tgcatgcaaaccaggagc

SEQ ID NO: 2178745 - DNA, 19 bp, Homo sapiens
tgcatgcaaaccaggagca

SEQ ID NO: 2178746 - DNA, 16 bp, Homo sapiens
tgcatgcagtcttgta

SEQ ID NO: 2178747 - DNA, 13 bp, Homo sapiens
tgcatgtctgttt

SEQ ID NO: 2178748 - DNA, 19 bp, Homo sapiens
tgcatgtgtaaatctgaaa

SEQ ID NO: 2178749 - DNA, 23 bp, Homo sapiens
tgcatgtgttgtacaataccaga

SEQ ID NO: 2178750 - DNA, 21 bp, Homo sapiens
tgcattcactcagcatcccca

SEQ ID NO: 2178751 - DNA, 19 bp, Homo sapiens
tgcattgctgtgaattagc

SEQ ID NO: 2178752 - DNA, 23 bp, Homo sapiens
tgcattttctgggttctgggtgg

SEQ ID NO: 2178753 - DNA, 16 bp, Homo sapiens
tgcatttttttagttt

SEQ ID NO: 2178754 - DNA, 13 bp, Homo sapiens
tgccaaaatatat

SEQ ID NO: 2178755 - DNA, 19 bp, Homo sapiens
tgccaaacctttaaatttt

SEQ ID NO: 2178756 - DNA, 17 bp, Homo sapiens
tgccaaccacctctggc

SEQ ID NO: 2178757 - DNA, 20 bp, Homo sapiens
tgccaagaccatttcacaga

SEQ ID NO: 2178758 - DNA, 17 bp, Homo sapiens
tgccaagccagattctc

SEQ ID NO: 2178759 - DNA, 20 bp, Homo sapiens
tgccaagtctcaggaggagg

SEQ ID NO: 2178760 - DNA, 19 bp, Homo sapiens
tgccaatggaacctccttt

SEQ ID NO: 2178761 - DNA, 16 bp, Homo sapiens
tgccaccacactcagc

SEQ ID NO: 2178762 - DNA, 15 bp, Homo sapiens
tgccaccaccctgcc

SEQ ID NO: 2178763 - DNA, 13 bp, Homo sapiens
tgccaccctctgc

SEQ ID NO: 2178764 - DNA, 14 bp, Homo sapiens
tgccacctgcagcg

SEQ ID NO: 2178765 - DNA, 23 bp, Homo sapiens
tgccactaggctgggtgcccaca

SEQ ID NO: 2178766 - DNA, 12 bp, Homo sapiens
tgccagaagtgt

SEQ ID NO: 2178767 - DNA, 23 bp, Homo sapiens
tgccagagcaaagggccaggaag

SEQ ID NO: 2178768 - DNA, 16 bp, Homo sapiens
tgccaggacagctgca

SEQ ID NO: 2178769 - DNA, 22 bp, Homo sapiens
tgccaggacagctgcaggtgcc

SEQ ID NO: 2178770 - DNA, 16 bp, Homo sapiens
tgccatttcttcccaa

SEQ ID NO: 2178771 - DNA, 22 bp, Homo sapiens
tgccatttgcttgtactgggac

SEQ ID NO: 2178772 - DNA, 23 bp, Homo sapiens
tgccatttgcttgtactgggaca

SEQ ID NO: 2178773 - DNA, 19 bp, Homo sapiens
tgccatttttttcactcag

SEQ ID NO: 2178774 - DNA, 14 bp, Homo sapiens
tgcccaacctcagc

SEQ ID NO: 2178775 - DNA, 12 bp, Homo sapiens
tgcccacagccc

SEQ ID NO: 2178776 - DNA, 21 bp, Homo sapiens
tgcccacagcccgcatgcagc

SEQ ID NO: 2178777 - DNA, 18 bp, Homo sapiens
tgcccacccgtcttcaat

SEQ ID NO: 2178778 - DNA, 15 bp, Homo sapiens
tgcccagagctgggt

SEQ ID NO: 2178779 - DNA, 20 bp, Homo sapiens
tgcccaggctggagtgcagt

SEQ ID NO: 2178780 - DNA, 20 bp, Homo sapiens
tgcccaggctggtcttgaac

SEQ ID NO: 2178781 - DNA, 17 bp, Homo sapiens
tgcccagggtcctgtgc

SEQ ID NO: 2178782 - DNA, 19 bp, Homo sapiens
tgcccagggtcctgtgcct

SEQ ID NO: 2178783 - DNA, 22 bp, Homo sapiens
tgcccagtgatggcattactct

SEQ ID NO: 2178784 - DNA, 14 bp, Homo sapiens
tgccccacctgcca

SEQ ID NO: 2178785 - DNA, 17 bp, Homo sapiens
tgccccacctgccacta

SEQ ID NO: 2178786 - DNA, 16 bp, Homo sapiens
tgcccccactcagcat

SEQ ID NO: 2178787 - DNA, 22 bp, Homo sapiens
tgcccccgctcatgggcccctc

SEQ ID NO: 2178788 - DNA, 23 bp, Homo sapiens
tgcccctagcttagagcctccct

SEQ ID NO: 2178789 - DNA, 21 bp, Homo sapiens
tgccctaactctgcccaccct

SEQ ID NO: 2178790 - DNA, 21 bp, Homo sapiens
tgccctccactgccctctgtt

SEQ ID NO: 2178791 - DNA, 12 bp, Homo sapiens
tgccctcccatc

SEQ ID NO: 2178792 - DNA, 18 bp, Homo sapiens
tgccctcctgcccgccct

SEQ ID NO: 2178793 - DNA, 11 bp, Homo sapiens
tgccctctgtt

SEQ ID NO: 2178794 - DNA, 13 bp, Homo sapiens
tgcccttgctggg

SEQ ID NO: 2178795 - DNA, 22 bp, Homo sapiens
tgccgcactagcctccctctcc

SEQ ID NO: 2178796 - DNA, 21 bp, Homo sapiens
tgccgcctgtgcccttgctgg

SEQ ID NO: 2178797 - DNA, 22 bp, Homo sapiens
tgccgcctgtgcccttgctggg

SEQ ID NO: 2178798 - DNA, 23 bp, Homo sapiens
tgccgcgtgcgaccagaggtggg

SEQ ID NO: 2178799 - DNA, 22 bp, Homo sapiens
tgcctagcactcacatgctgga

SEQ ID NO: 2178800 - DNA, 17 bp, Homo sapiens
tgcctcagcctcccgag

SEQ ID NO: 2178801 - DNA, 18 bp, Homo sapiens
tgcctccatggtgcctct

SEQ ID NO: 2178802 - DNA, 22 bp, Homo sapiens
tgcctccatggtgcctctggag

SEQ ID NO: 2178803 - DNA, 14 bp, Homo sapiens
tgcctcctctgtcc

SEQ ID NO: 2178804 - DNA, 14 bp, Homo sapiens
tgcctcgctccctt

SEQ ID NO: 2178805 - DNA, 17 bp, Homo sapiens
tgcctctggaggcctct

SEQ ID NO: 2178806 - DNA, 23 bp, Homo sapiens
tgcctctgtttgacaaacctcta

SEQ ID NO: 2178807 - DNA, 13 bp, Homo sapiens
tgcctcttgggag

SEQ ID NO: 2178808 - DNA, 15 bp, Homo sapiens
tgcctggaaaacagg

SEQ ID NO: 2178809 - DNA, 11 bp, Homo sapiens
tgcctggagct

SEQ ID NO: 2178810 - DNA, 22 bp, Homo sapiens
tgcctggatgagaaacagctca

SEQ ID NO: 2178811 - DNA, 23 bp, Homo sapiens
tgcctggatgagaaacagctcag

SEQ ID NO: 2178812 - DNA, 22 bp, Homo sapiens
tgcctggatgggggtgcaggca

SEQ ID NO: 2178813 - DNA, 16 bp, Homo sapiens
tgcctggcccagggag

SEQ ID NO: 2178814 - DNA, 23 bp, Homo sapiens
tgcctgggggcttttgccactcc

SEQ ID NO: 2178815 - DNA, 23 bp, Homo sapiens
tgccttatatttgtccaacaact

SEQ ID NO: 2178816 - DNA, 17 bp, Homo sapiens
tgccttatctgttcctt

SEQ ID NO: 2178817 - DNA, 21 bp, Homo sapiens
tgccttcaacaacgtgagaga

SEQ ID NO: 2178818 - DNA, 23 bp, Homo sapiens
tgccttcaacaacgtgagagaaa

SEQ ID NO: 2178819 - DNA, 13 bp, Homo sapiens
tgccttcctcctt

SEQ ID NO: 2178820 - DNA, 18 bp, Homo sapiens
tgccttgctgcacctgag

SEQ ID NO: 2178821 - DNA, 22 bp, Homo sapiens
tgcctttccccattcattcctg

SEQ ID NO: 2178822 - DNA, 23 bp, Homo sapiens
tgcctttccccattcattcctga

SEQ ID NO: 2178823 - DNA, 19 bp, Homo sapiens
tgcctttggcaattcttct

SEQ ID NO: 2178824 - DNA, 18 bp, Homo sapiens
tgcgaactctcaggacta

SEQ ID NO: 2178825 - DNA, 18 bp, Homo sapiens
tgcgcagggccctctggg

SEQ ID NO: 2178826 - DNA, 20 bp, Homo sapiens
tgcggttagaatcccatgga

SEQ ID NO: 2178827 - DNA, 13 bp, Homo sapiens
tgcgtcccagctg

SEQ ID NO: 2178828 - DNA, 18 bp, Homo sapiens
tgcgtcccagctgaaggc

SEQ ID NO: 2178829 - DNA, 14 bp, Homo sapiens
tgctaaatttgtgt

SEQ ID NO: 2178830 - DNA, 22 bp, Homo sapiens
tgctcagaagagaatcaaggcc

SEQ ID NO: 2178831 - DNA, 17 bp, Homo sapiens
tgctcctgttgttactg

SEQ ID NO: 2178832 - DNA, 15 bp, Homo sapiens
tgctctaagcacacg

SEQ ID NO: 2178833 - DNA, 15 bp, Homo sapiens
tgctctatatgtaat

SEQ ID NO: 2178834 - DNA, 14 bp, Homo sapiens
tgctctctacccag

SEQ ID NO: 2178835 - DNA, 12 bp, Homo sapiens
tgctctgcccag

SEQ ID NO: 2178836 - DNA, 14 bp, Homo sapiens
tgctctgcccagag

SEQ ID NO: 2178837 - DNA, 18 bp, Homo sapiens
tgctctggaagcctgctg

SEQ ID NO: 2178838 - DNA, 14 bp, Homo sapiens
tgctgaactgtgca

SEQ ID NO: 2178839 - DNA, 17 bp, Homo sapiens
tgctgaactgtgcatca

SEQ ID NO: 2178840 - DNA, 15 bp, Homo sapiens
tgctgcacctgaggc

SEQ ID NO: 2178841 - DNA, 22 bp, Homo sapiens
tgctgcacctgaggcccagcag

SEQ ID NO: 2178842 - DNA, 15 bp, Homo sapiens
tgctgcatcccacca

SEQ ID NO: 2178843 - DNA, 16 bp, Homo sapiens
tgctgcatcccaccag

SEQ ID NO: 2178844 - DNA, 13 bp, Homo sapiens
tgctgctcccagc

SEQ ID NO: 2178845 - DNA, 14 bp, Homo sapiens
tgctgctcccagcc

SEQ ID NO: 2178846 - DNA, 18 bp, Homo sapiens
tgtatcaccctcagctgg

SEQ ID NO: 2178847 - DNA, 14 bp, Homo sapiens
tgtatgcccaaaga

SEQ ID NO: 2178848 - DNA, 17 bp, Homo sapiens
tgtatgtatgtgtagtg

SEQ ID NO: 2178849 - DNA, 15 bp, Homo sapiens
tgtattaaacttgaa

SEQ ID NO: 2178850 - DNA, 21 bp, Homo sapiens
tgtattaacctacctgtgaat

SEQ ID NO: 2178851 - DNA, 19 bp, Homo sapiens
tgtattaggactggctttg

SEQ ID NO: 2178852 - DNA, 15 bp, Homo sapiens
tgtattctctgtcca

SEQ ID NO: 2178853 - DNA, 22 bp, Homo sapiens
tgtatttagtaaaaataaatca

SEQ ID NO: 2178854 - DNA, 14 bp, Homo sapiens
tgtattttaaaata

SEQ ID NO: 2178855 - DNA, 15 bp, Homo sapiens
tgtcaatgtttgctt

SEQ ID NO: 2178856 - DNA, 15 bp, Homo sapiens
tgtcacaaagctaaa

SEQ ID NO: 2178857 - DNA, 17 bp, Homo sapiens
tgtcagaataaagaaca

SEQ ID NO: 2178858 - DNA, 19 bp, Homo sapiens
tgtcagaataaagaacatt

SEQ ID NO: 2178859 - DNA, 20 bp, Homo sapiens
tgtcagaccttcttccacag

SEQ ID NO: 2178860 - DNA, 21 bp, Homo sapiens
tgtcagataatcggtgcagcg

SEQ ID NO: 2178861 - DNA, 14 bp, Homo sapiens
tgtccagggcttca

SEQ ID NO: 2178862 - DNA, 17 bp, Homo sapiens
tgtccagggcttcagat

SEQ ID NO: 2178863 - DNA, 12 bp, Homo sapiens
tgtcccacagct

SEQ ID NO: 2178864 - DNA, 12 bp, Homo sapiens
tgtcccacctca

SEQ ID NO: 2178865 - DNA, 15 bp, Homo sapiens
tgtccccacactcct

SEQ ID NO: 2178866 - DNA, 15 bp, Homo sapiens
tgtccccagcccact

SEQ ID NO: 2178867 - DNA, 13 bp, Homo sapiens
tgtccctgcaggg

SEQ ID NO: 2178868 - DNA, 22 bp, Homo sapiens
tgtccctggccatctctgaact

SEQ ID NO: 2178869 - DNA, 14 bp, Homo sapiens
tgtcccttggagct

SEQ ID NO: 2178870 - DNA, 22 bp, Homo sapiens
tgtcctatgggagtcaagtgtg

SEQ ID NO: 2178871 - DNA, 15 bp, Homo sapiens
tgtcctcattcttct

SEQ ID NO: 2178872 - DNA, 15 bp, Homo sapiens
tgtcctcttctgtga

SEQ ID NO: 2178873 - DNA, 16 bp, Homo sapiens
tgtccttcccacggcc

SEQ ID NO: 2178874 - DNA, 17 bp, Homo sapiens
tgtcgtggtagcagatg

SEQ ID NO: 2178875 - DNA, 22 bp, Homo sapiens
tgtcgttgactttagggactca

SEQ ID NO: 2178876 - DNA, 20 bp, Homo sapiens
tgtctaaaaataaaatgcat

SEQ ID NO: 2178877 - DNA, 23 bp, Homo sapiens
tgtctaaaaataaaatgcattta

SEQ ID NO: 2178878 - DNA, 14 bp, Homo sapiens
tgtctaccatctcc

SEQ ID NO: 2178879 - DNA, 15 bp, Homo sapiens
tgtctagcaaagcca

SEQ ID NO: 2178880 - DNA, 13 bp, Homo sapiens
tgtctcatgtgtg

SEQ ID NO: 2178881 - DNA, 20 bp, Homo sapiens
tgtctcatgtgtgctcttct

SEQ ID NO: 2178882 - DNA, 12 bp, Homo sapiens
tgtctcccctct

SEQ ID NO: 2178883 - DNA, 15 bp, Homo sapiens
tgtctctcttgcttt

SEQ ID NO: 2178884 - DNA, 16 bp, Homo sapiens
tgtctgccgtgagagc

SEQ ID NO: 2178885 - DNA, 15 bp, Homo sapiens
tgtctgcgccgctgt

SEQ ID NO: 2178886 - DNA, 21 bp, Homo sapiens
tgtctgcgccgctgtgctgtt

SEQ ID NO: 2178887 - DNA, 14 bp, Homo sapiens
tgtcttaagaaaaa

SEQ ID NO: 2178888 - DNA, 17 bp, Homo sapiens
tgtcttacaaggcaggc

SEQ ID NO: 2178889 - DNA, 14 bp, Homo sapiens
tgtcttagtgactt

SEQ ID NO: 2178890 - DNA, 13 bp, Homo sapiens
tgtcttcagatcc

SEQ ID NO: 2178891 - DNA, 18 bp, Homo sapiens
tgtcttcagatcctgctg

SEQ ID NO: 2178892 - DNA, 20 bp, Homo sapiens
tgtcttcagatcctgctgcc

SEQ ID NO: 2178893 - DNA, 19 bp, Homo sapiens
tgtcttcatccttagcaac

SEQ ID NO: 2178894 - DNA, 14 bp, Homo sapiens
tgtcttctccccag

SEQ ID NO: 2178895 - DNA, 20 bp, Homo sapiens
tgtcttgagagcgctggcct

SEQ ID NO: 2178896 - DNA, 15 bp, Homo sapiens
tgtcttggcctccca

SEQ ID NO: 2178897 - DNA, 21 bp, Homo sapiens
tgtctttctattcagcaaaag

SEQ ID NO: 2178898 - DNA, 14 bp, Homo sapiens
tgtcttttaatgat

SEQ ID NO: 2178899 - DNA, 13 bp, Homo sapiens
tgtgaaaattaca

SEQ ID NO: 2178900 - DNA, 21 bp, Homo sapiens
tgtgaaatttgttaatatata

SEQ ID NO: 2178901 - DNA, 23 bp, Homo sapiens
tgtgaacataggtgtgcttccca

SEQ ID NO: 2178902 - DNA, 19 bp, Homo sapiens
tgtgaagaaacatttatct

SEQ ID NO: 2178903 - DNA, 21 bp, Homo sapiens
tgtgaagcctgtcgtgttctc

SEQ ID NO: 2178904 - DNA, 17 bp, Homo sapiens
tgtgaatgctgtacctt

SEQ ID NO: 2178905 - DNA, 20 bp, Homo sapiens
tgtgaattagctcacttggt

SEQ ID NO: 2178906 - DNA, 14 bp, Homo sapiens
tgtgacctaagaac

SEQ ID NO: 2178907 - DNA, 22 bp, Homo sapiens
tgtgacgggggttggggtgggg

SEQ ID NO: 2178908 - DNA, 20 bp, Homo sapiens
tgtgacttttagacagtggt

SEQ ID NO: 2178909 - DNA, 19 bp, Homo sapiens
tgtgaggatgtggatggag

SEQ ID NO: 2178910 - DNA, 14 bp, Homo sapiens
tgtgagtatgtgtg

SEQ ID NO: 2178911 - DNA, 17 bp, Homo sapiens
tgtgagtatgtgtggtt

SEQ ID NO: 2178912 - DNA, 15 bp, Homo sapiens
tgtgagtcagtcagc

SEQ ID NO: 2178913 - DNA, 16 bp, Homo sapiens
tgtgagtcagtcagcg

SEQ ID NO: 2178914 - DNA, 15 bp, Homo sapiens
tgtgagtgtgtgcac

SEQ ID NO: 2178915 - DNA, 12 bp, Homo sapiens
tgtgatgtatgt

SEQ ID NO: 2178916 - DNA, 16 bp, Homo sapiens
tgtgatgtatgttggt

SEQ ID NO: 2178917 - DNA, 17 bp, Homo sapiens
tgtgattaattattgaa

SEQ ID NO: 2178918 - DNA, 19 bp, Homo sapiens
tgtgattactctttgcttt

SEQ ID NO: 2178919 - DNA, 18 bp, Homo sapiens
tgtgcagggccctctggg

SEQ ID NO: 2178920 - DNA, 21 bp, Homo sapiens
tgtgcatgcaaaccaggagca

SEQ ID NO: 2178921 - DNA, 23 bp, Homo sapiens
tgtgccaccctctgcagggcagc

SEQ ID NO: 2178922 - DNA, 13 bp, Homo sapiens
tgtgcccagctca

SEQ ID NO: 2178923 - DNA, 18 bp, Homo sapiens
tgtgcccttgctgggtcc

SEQ ID NO: 2178924 - DNA, 21 bp, Homo sapiens
tgtgccgcactagcctccctc

SEQ ID NO: 2178925 - DNA, 16 bp, Homo sapiens
tgtgcgtcccagctga

SEQ ID NO: 2178926 - DNA, 17 bp, Homo sapiens
tgtgcgtcccagctgaa

SEQ ID NO: 2178927 - DNA, 16 bp, Homo sapiens
tgtggagaggagagaa

SEQ ID NO: 2178928 - DNA, 13 bp, Homo sapiens
tgtggaggtggct

SEQ ID NO: 2178929 - DNA, 19 bp, Homo sapiens
tgtggattttgtggcttca

SEQ ID NO: 2178930 - DNA, 22 bp, Homo sapiens
tgtggcaaatgccaggacagct

SEQ ID NO: 2178931 - DNA, 17 bp, Homo sapiens
tgtggcatcaggaaagg

SEQ ID NO: 2178932 - DNA, 21 bp, Homo sapiens
tgtggctctcccgttgcagag

SEQ ID NO: 2178933 - DNA, 14 bp, Homo sapiens
tgtggctcttgcct

SEQ ID NO: 2178934 - DNA, 12 bp, Homo sapiens
tgtgggagaagg

SEQ ID NO: 2178935 - DNA, 19 bp, Homo sapiens
tgtggggggtaatccctgc

SEQ ID NO: 2178936 - DNA, 22 bp, Homo sapiens
tgtggggggtaatccctgcttt

SEQ ID NO: 2178937 - DNA, 20 bp, Homo sapiens
tgtgggggtctgggaggcag

SEQ ID NO: 2178938 - DNA, 16 bp, Homo sapiens
tgtgggtcagtgtgcc

SEQ ID NO: 2178939 - DNA, 21 bp, Homo sapiens
tgtgggtcagtgtgccaccct

SEQ ID NO: 2178940 - DNA, 15 bp, Homo sapiens
tgtggtgaagtttgt

SEQ ID NO: 2178941 - DNA, 20 bp, Homo sapiens
tgtgtaaaggaacaactgat

SEQ ID NO: 2178942 - DNA, 13 bp, Homo sapiens
tgtgtatgtgttt

SEQ ID NO: 2178943 - DNA, 17 bp, Homo sapiens
tgtgtcacaaagctaaa

SEQ ID NO: 2178944 - DNA, 19 bp, Homo sapiens
tgtgtcataaagttgactt

SEQ ID NO: 2178945 - DNA, 16 bp, Homo sapiens
tgtgtctagcaaagcc

SEQ ID NO: 2178946 - DNA, 13 bp, Homo sapiens
tgtgtgagtgtga

SEQ ID NO: 2178947 - DNA, 12 bp, Homo sapiens
tgtgtggaaatg

SEQ ID NO: 2178948 - DNA, 21 bp, Homo sapiens
tgtgttctttgttccactgga

SEQ ID NO: 2178949 - DNA, 16 bp, Homo sapiens
tgtgtttataattgtt

SEQ ID NO: 2178950 - DNA, 14 bp, Homo sapiens
tgtgtttgtatata

SEQ ID NO: 2178951 - DNA, 20 bp, Homo sapiens
tgtgttttattcacttgtgt

SEQ ID NO: 2178952 - DNA, 18 bp, Homo sapiens
tgtgttttggtatgcact

SEQ ID NO: 2178953 - DNA, 16 bp, Homo sapiens
tgtgttttgtacataa

SEQ ID NO: 2178954 - DNA, 13 bp, Homo sapiens
tgttaagtgcttt

SEQ ID NO: 2178955 - DNA, 20 bp, Homo sapiens
tgttaatcctagctgtgtgc

SEQ ID NO: 2178956 - DNA, 14 bp, Homo sapiens
tgttaattaaatat

SEQ ID NO: 2178957 - DNA, 15 bp, Homo sapiens
tgttacgtgtgcaac

SEQ ID NO: 2178958 - DNA, 22 bp, Homo sapiens
tgttactgatttggccgttttg

SEQ ID NO: 2178959 - DNA, 16 bp, Homo sapiens
tgttactggaaaaatt

SEQ ID NO: 2178960 - DNA, 14 bp, Homo sapiens
tgttaggctgggcc

SEQ ID NO: 2178961 - DNA, 18 bp, Homo sapiens
tgttaggctgggcccaga

SEQ ID NO: 2178962 - DNA, 15 bp, Homo sapiens
tgttatacattttta

SEQ ID NO: 2178963 - DNA, 23 bp, Homo sapiens
tgttattatctgggcttatatct

SEQ ID NO: 2178964 - DNA, 18 bp, Homo sapiens
tgttcaaaatgttaataa

SEQ ID NO: 2178965 - DNA, 15 bp, Homo sapiens
tgttcaaagtttaag

SEQ ID NO: 2178966 - DNA, 22 bp, Homo sapiens
tgttcacacctagcgtcagtat

SEQ ID NO: 2178967 - DNA, 15 bp, Homo sapiens
tgttcactgtgagtt

SEQ ID NO: 2178968 - DNA, 14 bp, Homo sapiens
ttagtgttcaaata

SEQ ID NO: 2178969 - DNA, 20 bp, Homo sapiens
ttagtgttcaaatacttcaa

SEQ ID NO: 2178970 - DNA, 20 bp, Homo sapiens
ttagttctgtatataaatat

SEQ ID NO: 2178971 - DNA, 14 bp, Homo sapiens
ttataaactacaaa

SEQ ID NO: 2178972 - DNA, 14 bp, Homo sapiens
ttataaatatgtga

SEQ ID NO: 2178973 - DNA, 22 bp, Homo sapiens
ttataaatatgtgattatcatt

SEQ ID NO: 2178974 - DNA, 15 bp, Homo sapiens
ttataatacaaataa

SEQ ID NO: 2178975 - DNA, 23 bp, Homo sapiens
ttataattaaagaaaattgccaa

SEQ ID NO: 2178976 - DNA, 19 bp, Homo sapiens
ttataattttgaccataaa

SEQ ID NO: 2178977 - DNA, 13 bp, Homo sapiens
ttatatttgtctc

SEQ ID NO: 2178978 - DNA, 10 bp, Homo sapiens
ttatcaaaaa

SEQ ID NO: 2178979 - DNA, 13 bp, Homo sapiens
ttatcaaaaaaca

SEQ ID NO: 2178980 - DNA, 17 bp, Homo sapiens
ttatcaaaaaacaagtc

SEQ ID NO: 2178981 - DNA, 23 bp, Homo sapiens
ttatcccatctcactttaataat

SEQ ID NO: 2178982 - DNA, 13 bp, Homo sapiens
ttatgagaaactt

SEQ ID NO: 2178983 - DNA, 20 bp, Homo sapiens
ttatggatttggactcgaaa

SEQ ID NO: 2178984 - DNA, 21 bp, Homo sapiens
ttattaaatcagttttgtgta

SEQ ID NO: 2178985 - DNA, 18 bp, Homo sapiens
ttattaagaactatattt

SEQ ID NO: 2178986 - DNA, 21 bp, Homo sapiens
ttattcactctcccagaggct

SEQ ID NO: 2178987 - DNA, 21 bp, Homo sapiens
ttattcacttgtgtttgtata

SEQ ID NO: 2178988 - DNA, 21 bp, Homo sapiens
ttattcatagctgtatatttg

SEQ ID NO: 2178989 - DNA, 12 bp, Homo sapiens
ttattcattcag

SEQ ID NO: 2178990 - DNA, 18 bp, Homo sapiens
ttattctacttttaaata

SEQ ID NO: 2178991 - DNA, 14 bp, Homo sapiens
ttattgagttctga

SEQ ID NO: 2178992 - DNA, 18 bp, Homo sapiens
ttattgagttctgaaggt

SEQ ID NO: 2178993 - DNA, 16 bp, Homo sapiens
ttattggacttccatt

SEQ ID NO: 2178994 - DNA, 18 bp, Homo sapiens
ttattgtaccaaagctgt

SEQ ID NO: 2178995 - DNA, 12 bp, Homo sapiens
ttatttccatat

SEQ ID NO: 2178996 - DNA, 22 bp, Homo sapiens
ttatttccatattaaaatcaca

SEQ ID NO: 2178997 - DNA, 23 bp, Homo sapiens
ttatttggagtggaggcattgtt

SEQ ID NO: 2178998 - DNA, 13 bp, Homo sapiens
ttattttaaatta

SEQ ID NO: 2178999 - DNA, 15 bp, Homo sapiens
ttattttctttttgt

SEQ ID NO: 2179000 - DNA, 23 bp, Homo sapiens
ttattttcttttttgataattta

SEQ ID NO: 2179001 - DNA, 20 bp, Homo sapiens
ttattttgactgtgatttat

SEQ ID NO: 2179002 - DNA, 13 bp, Homo sapiens
ttatttttacttg

SEQ ID NO: 2179003 - DNA, 15 bp, Homo sapiens
ttatttttatttatt

SEQ ID NO: 2179004 - DNA, 13 bp, Homo sapiens
ttatttttgtact

SEQ ID NO: 2179005 - DNA, 22 bp, Homo sapiens
ttcaaaaatcattaacactttt

SEQ ID NO: 2179006 - DNA, 19 bp, Homo sapiens
ttcaaaatcagtgatggga

SEQ ID NO: 2179007 - DNA, 15 bp, Homo sapiens
ttcaaacaattcaat

SEQ ID NO: 2179008 - DNA, 13 bp, Homo sapiens
ttcaaataaagta

SEQ ID NO: 2179009 - DNA, 15 bp, Homo sapiens
ttcaacatttcttga

SEQ ID NO: 2179010 - DNA, 16 bp, Homo sapiens
ttcaagacgaggggca

SEQ ID NO: 2179011 - DNA, 18 bp, Homo sapiens
ttcaagcgactctcctgc

SEQ ID NO: 2179012 - DNA, 21 bp, Homo sapiens
ttcaagcgactctcctgcctc

SEQ ID NO: 2179013 - DNA, 22 bp, Homo sapiens
ttcaagcgactctcctgcctca

SEQ ID NO: 2179014 - DNA, 16 bp, Homo sapiens
ttcaagggctgcttca

SEQ ID NO: 2179015 - DNA, 14 bp, Homo sapiens
ttcaaggtgtaaaa

SEQ ID NO: 2179016 - DNA, 14 bp, Homo sapiens
ttcaatcaaagcta

SEQ ID NO: 2179017 - DNA, 15 bp, Homo sapiens
ttcaatcaaagctac

SEQ ID NO: 2179018 - DNA, 16 bp, Homo sapiens
ttcaatcaaagctacc

SEQ ID NO: 2179019 - DNA, 19 bp, Homo sapiens
ttcaatcaaagctaccttt

SEQ ID NO: 2179020 - DNA, 14 bp, Homo sapiens
ttcaatgtgttctt

SEQ ID NO: 2179021 - DNA, 16 bp, Homo sapiens
ttcacaagctgcctcc

SEQ ID NO: 2179022 - DNA, 22 bp, Homo sapiens
ttcacacagcacctcctctctg

SEQ ID NO: 2179023 - DNA, 12 bp, Homo sapiens
ttcacagaaaac

SEQ ID NO: 2179024 - DNA, 14 bp, Homo sapiens
ttcacagctccttg

SEQ ID NO: 2179025 - DNA, 18 bp, Homo sapiens
ttcactctcccagaggct

SEQ ID NO: 2179026 - DNA, 15 bp, Homo sapiens
ttcacttgtgtttgt

SEQ ID NO: 2179027 - DNA, 21 bp, Homo sapiens
ttcagaagttgttagtgattt

SEQ ID NO: 2179028 - DNA, 20 bp, Homo sapiens
ttcagatacttgtgaacatg

SEQ ID NO: 2179029 - DNA, 18 bp, Homo sapiens
ttcagccgaattgtggtg

SEQ ID NO: 2179030 - DNA, 11 bp, Homo sapiens
ttcagctctgg

SEQ ID NO: 2179031 - DNA, 12 bp, Homo sapiens
ttcagctctgga

SEQ ID NO: 2179032 - DNA, 14 bp, Homo sapiens
ttcagctctggaga

SEQ ID NO: 2179033 - DNA, 23 bp, Homo sapiens
ttcaggaacctggaccaaagctg

SEQ ID NO: 2179034 - DNA, 20 bp, Homo sapiens
ttcaggatttggtttttctc

SEQ ID NO: 2179035 - DNA, 16 bp, Homo sapiens
ttcagggtcctgagat

SEQ ID NO: 2179036 - DNA, 14 bp, Homo sapiens
ttcaggtcagggct

SEQ ID NO: 2179037 - DNA, 17 bp, Homo sapiens
ttcagtgactcctgctg

SEQ ID NO: 2179038 - DNA, 18 bp, Homo sapiens
ttcagtgactcctgctgg

SEQ ID NO: 2179039 - DNA, 15 bp, Homo sapiens
ttcagtgcattttca

SEQ ID NO: 2179040 - DNA, 13 bp, Homo sapiens
ttcagtgccaata

SEQ ID NO: 2179041 - DNA, 21 bp, Homo sapiens
ttcataaagcaccagcagtgt

SEQ ID NO: 2179042 - DNA, 23 bp, Homo sapiens
ttcatattaatataagtttcttt

SEQ ID NO: 2179043 - DNA, 14 bp, Homo sapiens
ttcatctttccaaa

SEQ ID NO: 2179044 - DNA, 13 bp, Homo sapiens
ttcattccatttg

SEQ ID NO: 2179045 - DNA, 16 bp, Homo sapiens
ttcattccatttgctg

SEQ ID NO: 2179046 - DNA, 18 bp, Homo sapiens
ttcattccatttgctgat

SEQ ID NO: 2179047 - DNA, 21 bp, Homo sapiens
ttccaaaaacaaagtgcaaag

SEQ ID NO: 2179048 - DNA, 15 bp, Homo sapiens
ttccaactgctgccc

SEQ ID NO: 2179049 - DNA, 22 bp, Homo sapiens
ttccaactgctgccccaaagga

SEQ ID NO: 2179050 - DNA, 19 bp, Homo sapiens
ttccaagcctgggccactg

SEQ ID NO: 2179051 - DNA, 15 bp, Homo sapiens
ttccaagtcttcctg

SEQ ID NO: 2179052 - DNA, 21 bp, Homo sapiens
ttccaatatttataattaaag

SEQ ID NO: 2179053 - DNA, 21 bp, Homo sapiens
ttccaatgtgcccagtcatga

SEQ ID NO: 2179054 - DNA, 13 bp, Homo sapiens
ttccacacagcct

SEQ ID NO: 2179055 - DNA, 16 bp, Homo sapiens
ttccacacagcctgtc

SEQ ID NO: 2179056 - DNA, 15 bp, Homo sapiens
ttccacacccccacc

SEQ ID NO: 2179057 - DNA, 17 bp, Homo sapiens
ttccacacccccacccc

SEQ ID NO: 2179058 - DNA, 18 bp, Homo sapiens
ttccacccctccttccct

SEQ ID NO: 2179059 - DNA, 22 bp, Homo sapiens
ttccactggaaacttagagtca

SEQ ID NO: 2179060 - DNA, 22 bp, Homo sapiens
ttccagtggcctggctccgctg

SEQ ID NO: 2179061 - DNA, 13 bp, Homo sapiens
ttccatattaaaa

SEQ ID NO: 2179062 - DNA, 15 bp, Homo sapiens
ttccatcagcagtga

SEQ ID NO: 2179063 - DNA, 20 bp, Homo sapiens
ttccatcctgtacaagtgct

SEQ ID NO: 2179064 - DNA, 24 bp, Homo sapiens
ttccatcctgtacaagtgctcagt

SEQ ID NO: 2179065 - DNA, 14 bp, Homo sapiens
ttccatgcagttat

SEQ ID NO: 2179066 - DNA, 24 bp, Homo sapiens
ttccatgcagttattagaacttag

SEQ ID NO: 2179067 - DNA, 14 bp, Homo sapiens
ttccattttaagtg

SEQ ID NO: 2179068 - DNA, 16 bp, Homo sapiens
ttcccacggccactgc

SEQ ID NO: 2179069 - DNA, 17 bp, Homo sapiens
ttcccacggccactgca

SEQ ID NO: 2179070 - DNA, 17 bp, Homo sapiens
ttcccatttaaaaatat

SEQ ID NO: 2179071 - DNA, 21 bp, Homo sapiens
ttccccctcttcttctgaaga

SEQ ID NO: 2179072 - DNA, 22 bp, Homo sapiens
ttccccctggccaccacccccc

SEQ ID NO: 2179073 - DNA, 14 bp, Homo sapiens
ttcccggctggact

SEQ ID NO: 2179074 - DNA, 21 bp, Homo sapiens
ttccctacccacagggcctga

SEQ ID NO: 2179075 - DNA, 18 bp, Homo sapiens
ttccctagggctgggtgt

SEQ ID NO: 2179076 - DNA, 11 bp, Homo sapiens
ttccctctgct

SEQ ID NO: 2179077 - DNA, 13 bp, Homo sapiens
ttccctgctgaat

SEQ ID NO: 2179078 - DNA, 16 bp, Homo sapiens
ttccctggtccctctg

SEQ ID NO: 2179079 - DNA, 20 bp, Homo sapiens
ttcccttctccttccaactg

SEQ ID NO: 2179080 - DNA, 23 bp, Homo sapiens
ttccgctttgaaagaagcaagac

SEQ ID NO: 2179081 - DNA, 15 bp, Homo sapiens
ttccggccctggctg

SEQ ID NO: 2179082 - DNA, 22 bp, Homo sapiens
ttcctcagcaggttggcttttt

SEQ ID NO: 2179083 - DNA, 17 bp, Homo sapiens
ttcctccctccctgcag

SEQ ID NO: 2179084 - DNA, 16 bp, Homo sapiens
ttcctctgtagaattt

SEQ ID NO: 2179085 - DNA, 17 bp, Homo sapiens
ttcctgggactgtcaga

SEQ ID NO: 2179086 - DNA, 15 bp, Homo sapiens
ttcctggggtgccct

SEQ ID NO: 2179087 - DNA, 21 bp, Homo sapiens
ttcctggggtgccctccactg

SEQ ID NO: 2179088 - DNA, 13 bp, Homo sapiens
ttcctgtttctaa

SEQ ID NO: 2179089 - DNA, 18 bp, Homo sapiens
ttccttaagtggctgtga

SEQ ID NO: 2179090 - DNA, 20 bp, Homo sapiens
aaatatgtgagcatgaaact

SEQ ID NO: 2179091 - DNA, 21 bp, Homo sapiens
aaatatgtgagcatgaaacta

SEQ ID NO: 2179092 - DNA, 19 bp, Homo sapiens
aaatcaggcatttttccaa

SEQ ID NO: 2179093 - DNA, 20 bp, Homo sapiens
aaatcaggcatttttccaaa

SEQ ID NO: 2179094 - DNA, 19 bp, Homo sapiens
aaatcagttttgtgtacag

SEQ ID NO: 2179095 - DNA, 22 bp, Homo sapiens
aaatcatgcttataagcaacat

SEQ ID NO: 2179096 - DNA, 14 bp, Homo sapiens
aaatcatgttttga

SEQ ID NO: 2179097 - DNA, 13 bp, Homo sapiens
aaatccccttctc

SEQ ID NO: 2179098 - DNA, 17 bp, Homo sapiens
aaatctcctcttttgta

SEQ ID NO: 2179099 - DNA, 20 bp, Homo sapiens
aaatcttcaaggtgtaaaat

SEQ ID NO: 2179100 - DNA, 22 bp, Homo sapiens
aaatcttcaaggtgtaaaatat

SEQ ID NO: 2179101 - DNA, 20 bp, Homo sapiens
aaatgagatgtatgcccaaa

SEQ ID NO: 2179102 - DNA, 14 bp, Homo sapiens
aaatgatgtagaca

SEQ ID NO: 2179103 - DNA, 19 bp, Homo sapiens
aaatgcaaaaactctttga

SEQ ID NO: 2179104 - DNA, 14 bp, Homo sapiens
aaatgcaaaaatat

SEQ ID NO: 2179105 - DNA, 14 bp, Homo sapiens
aaatgcataaaata

SEQ ID NO: 2179106 - DNA, 22 bp, Homo sapiens
aaatgcccttacacttactgtt

SEQ ID NO: 2179107 - DNA, 23 bp, Homo sapiens
aaatgcgcacgacctacattaat

SEQ ID NO: 2179108 - DNA, 18 bp, Homo sapiens
aaatgggactgatgtcat

SEQ ID NO: 2179109 - DNA, 19 bp, Homo sapiens
aaatgggactgatgtcatc

SEQ ID NO: 2179110 - DNA, 19 bp, Homo sapiens
aaatggtgagaattaaaat

SEQ ID NO: 2179111 - DNA, 11 bp, Homo sapiens
aaatggtgcct

SEQ ID NO: 2179112 - DNA, 15 bp, Homo sapiens
aaatgtcagttgaaa

SEQ ID NO: 2179113 - DNA, 16 bp, Homo sapiens
aaatgtgccatttttt

SEQ ID NO: 2179114 - DNA, 14 bp, Homo sapiens
aaatgttaataaag

SEQ ID NO: 2179115 - DNA, 16 bp, Homo sapiens
aaatgttaataaaggt

SEQ ID NO: 2179116 - DNA, 21 bp, Homo sapiens
aaattaattctttatcacatg

SEQ ID NO: 2179117 - DNA, 22 bp, Homo sapiens
aaattaattctttatcacatgt

SEQ ID NO: 2179118 - DNA, 11 bp, Homo sapiens
aaattacaagt

SEQ ID NO: 2179119 - DNA, 23 bp, Homo sapiens
aaattacacccatgcacagaaca

SEQ ID NO: 2179120 - DNA, 20 bp, Homo sapiens
aaattactttgattccattt

SEQ ID NO: 2179121 - DNA, 22 bp, Homo sapiens
aaattactttgattccatttta

SEQ ID NO: 2179122 - DNA, 21 bp, Homo sapiens
aaattagatattgttttgtga

SEQ ID NO: 2179123 - DNA, 23 bp, Homo sapiens
aaattagtgtacctattaaaagt

SEQ ID NO: 2179124 - DNA, 18 bp, Homo sapiens
aaattatgaatattaaag

SEQ ID NO: 2179125 - DNA, 21 bp, Homo sapiens
aaattattatcttcttaacag

SEQ ID NO: 2179126 - DNA, 14 bp, Homo sapiens
aaattcctctgtag

SEQ ID NO: 2179127 - DNA, 14 bp, Homo sapiens
aaattgatgggtgg

SEQ ID NO: 2179128 - DNA, 14 bp, Homo sapiens
aaattgccaaaata

SEQ ID NO: 2179129 - DNA, 12 bp, Homo sapiens
aaattgtataaa

SEQ ID NO: 2179130 - DNA, 12 bp, Homo sapiens
aaatttgtagaa

SEQ ID NO: 2179131 - DNA, 15 bp, Homo sapiens
aaattttctagaata

SEQ ID NO: 2179132 - DNA, 22 bp, Homo sapiens
aaattttctagaatactaataa

SEQ ID NO: 2179133 - DNA, 14 bp, Homo sapiens
aacaaaaccaagcc

SEQ ID NO: 2179134 - DNA, 14 bp, Homo sapiens
aacaaacatttgaa

SEQ ID NO: 2179135 - DNA, 18 bp, Homo sapiens
aacaaagtcaagattccc

SEQ ID NO: 2179136 - DNA, 16 bp, Homo sapiens
aacaaagtgcaaagct

SEQ ID NO: 2179137 - DNA, 18 bp, Homo sapiens
aacaaagtgcaaagctgc

SEQ ID NO: 2179138 - DNA, 20 bp, Homo sapiens
aacaaagtgcaaagctgctt

SEQ ID NO: 2179139 - DNA, 11 bp, Homo sapiens
aacaatgtgtg

SEQ ID NO: 2179140 - DNA, 15 bp, Homo sapiens
aacaattcaatcaaa

SEQ ID NO: 2179141 - DNA, 17 bp, Homo sapiens
aacaattcaatcaaagc

SEQ ID NO: 2179142 - DNA, 16 bp, Homo sapiens
aacaattgtgacagca

SEQ ID NO: 2179143 - DNA, 17 bp, Homo sapiens
aacagaaattgtatatt

SEQ ID NO: 2179144 - DNA, 21 bp, Homo sapiens
aacagaaattgtatattgtaa

SEQ ID NO: 2179145 - DNA, 18 bp, Homo sapiens
aacagccaagacccaaca

SEQ ID NO: 2179146 - DNA, 13 bp, Homo sapiens
aacagccgagtgg

SEQ ID NO: 2179147 - DNA, 22 bp, Homo sapiens
aacagccgagtggatagatgcc

SEQ ID NO: 2179148 - DNA, 15 bp, Homo sapiens
aacagctcagccagt

SEQ ID NO: 2179149 - DNA, 15 bp, Homo sapiens
aacagtgagaaaaga

SEQ ID NO: 2179150 - DNA, 18 bp, Homo sapiens
aacagtggttgcctgggg

SEQ ID NO: 2179151 - DNA, 12 bp, Homo sapiens
aacataaaacaa

SEQ ID NO: 2179152 - DNA, 16 bp, Homo sapiens
aacataaaacaaaacc

SEQ ID NO: 2179153 - DNA, 22 bp, Homo sapiens
aacatgaattaagaactgacac

SEQ ID NO: 2179154 - DNA, 17 bp, Homo sapiens
aacatgctacctgatcc

SEQ ID NO: 2179155 - DNA, 22 bp, Homo sapiens
aacatgtcatgtaggttgtcta

SEQ ID NO: 2179156 - DNA, 22 bp, Homo sapiens
aacattcagctctggagaacag

SEQ ID NO: 2179157 - DNA, 22 bp, Homo sapiens
aacatttgtaatttttttctag

SEQ ID NO: 2179158 - DNA, 20 bp, Homo sapiens
aaccaagtgtctaaaatact

SEQ ID NO: 2179159 - DNA, 20 bp, Homo sapiens
aacccagcatgtacaaaagt

SEQ ID NO: 2179160 - DNA, 23 bp, Homo sapiens
aacccattaatcttttgtagttt

SEQ ID NO: 2179161 - DNA, 20 bp, Homo sapiens
aacccttctcttctcccccc

SEQ ID NO: 2179162 - DNA, 15 bp, Homo sapiens
aacctacctgtgaat

SEQ ID NO: 2179163 - DNA, 21 bp, Homo sapiens
aacctactgaggagcaaagca

SEQ ID NO: 2179164 - DNA, 22 bp, Homo sapiens
aacctacttgtaaacttgaaag

SEQ ID NO: 2179165 - DNA, 12 bp, Homo sapiens
aacctagcccct

SEQ ID NO: 2179166 - DNA, 22 bp, Homo sapiens
aacctcaaaatattttttttaa

SEQ ID NO: 2179167 - DNA, 16 bp, Homo sapiens
aacctccacctcccag

SEQ ID NO: 2179168 - DNA, 13 bp, Homo sapiens
aacctctccttcc

SEQ ID NO: 2179169 - DNA, 10 bp, Homo sapiens
aacctggagg

SEQ ID NO: 2179170 - DNA, 11 bp, Homo sapiens
aacctggctgc

SEQ ID NO: 2179171 - DNA, 21 bp, Homo sapiens
aacctggctgcgaactgtgca

SEQ ID NO: 2179172 - DNA, 19 bp, Homo sapiens
aacctgttcaaaatgttaa

SEQ ID NO: 2179173 - DNA, 17 bp, Homo sapiens
aacctttaaaaatgtat

SEQ ID NO: 2179174 - DNA, 14 bp, Homo sapiens
aacctttattcttt

SEQ ID NO: 2179175 - DNA, 18 bp, Homo sapiens
aacgcaaacctctccttc

SEQ ID NO: 2179176 - DNA, 19 bp, Homo sapiens
aacgcaaacctctccttcc

SEQ ID NO: 2179177 - DNA, 20 bp, Homo sapiens
aacgcctgccttctgggcaa

SEQ ID NO: 2179178 - DNA, 14 bp, Homo sapiens
aacggaactcttca

SEQ ID NO: 2179179 - DNA, 16 bp, Homo sapiens
aacgtgagagaaagag

SEQ ID NO: 2179180 - DNA, 21 bp, Homo sapiens
aactaattttaaagtaaaagg

SEQ ID NO: 2179181 - DNA, 14 bp, Homo sapiens
aactcacctaactc

SEQ ID NO: 2179182 - DNA, 22 bp, Homo sapiens
aactcagcctcaataagccttg

SEQ ID NO: 2179183 - DNA, 21 bp, Homo sapiens
aactcagctattaagaaaatc

SEQ ID NO: 2179184 - DNA, 22 bp, Homo sapiens
aactcatactgtgctggagcca

SEQ ID NO: 2179185 - DNA, 15 bp, Homo sapiens
aactcctgggctcaa

SEQ ID NO: 2179186 - DNA, 13 bp, Homo sapiens
aactccttcctct

SEQ ID NO: 2179187 - DNA, 23 bp, Homo sapiens
aactctctagttccctcagtgtg

SEQ ID NO: 2179188 - DNA, 21 bp, Homo sapiens
aactcttcatcttaaactaca

SEQ ID NO: 2179189 - DNA, 15 bp, Homo sapiens
aactgaccctccctt

SEQ ID NO: 2179190 - DNA, 19 bp, Homo sapiens
aactgatcatttgcagctg

SEQ ID NO: 2179191 - DNA, 15 bp, Homo sapiens
aactgcacaatgcat

SEQ ID NO: 2179192 - DNA, 14 bp, Homo sapiens
aactgcattagaaa

SEQ ID NO: 2179193 - DNA, 14 bp, Homo sapiens
aactgccctgtcta

SEQ ID NO: 2179194 - DNA, 15 bp, Homo sapiens
aactgctaaatactg

SEQ ID NO: 2179195 - DNA, 22 bp, Homo sapiens
aactgctgccccaaaggaagct

SEQ ID NO: 2179196 - DNA, 22 bp, Homo sapiens
aactggcttctgcttgtcatcc

SEQ ID NO: 2179197 - DNA, 22 bp, Homo sapiens
aactgtgtcacgcaggctgagt

SEQ ID NO: 2179198 - DNA, 22 bp, Homo sapiens
aactgttgtttgatgtgtatgt

SEQ ID NO: 2179199 - DNA, 19 bp, Homo sapiens
aactgtttccctgctgaat

SEQ ID NO: 2179200 - DNA, 15 bp, Homo sapiens
aacttaaatgttatt

SEQ ID NO: 2179201 - DNA, 15 bp, Homo sapiens
aacttaagtttagaa

SEQ ID NO: 2179202 - DNA, 16 bp, Homo sapiens
aacttaagtttagaaa

SEQ ID NO: 2179203 - DNA, 18 bp, Homo sapiens
aacttaagtttagaaatt

SEQ ID NO: 2179204 - DNA, 22 bp, Homo sapiens
aacttaagtttagaaattacaa

SEQ ID NO: 2179205 - DNA, 12 bp, Homo sapiens
aacttagttttg

SEQ ID NO: 2179206 - DNA, 18 bp, Homo sapiens
aacttagttttgttccaa

SEQ ID NO: 2179207 - DNA, 20 bp, Homo sapiens
aacttcagctagagcttcaa

SEQ ID NO: 2179208 - DNA, 17 bp, Homo sapiens
aacttcattctaaacca

SEQ ID NO: 2179209 - DNA, 11 bp, Homo sapiens
aacttcctctt

SEQ ID NO: 2179210 - DNA, 16 bp, Homo sapiens
aacttggttcccagaa

SEQ ID NO: 2179211 - DNA, 14 bp, Homo sapiens
acacttactgttgt

SEQ ID NO: 2179212 - DNA, 23 bp, Homo sapiens
acacttactgttgtcctatggga

SEQ ID NO: 2179213 - DNA, 23 bp, Homo sapiens
acagaaatcctttcataaagcac

SEQ ID NO: 2179214 - DNA, 19 bp, Homo sapiens
acagaaatgccaaaaatgt

SEQ ID NO: 2179215 - DNA, 14 bp, Homo sapiens
acagaaattgtata

SEQ ID NO: 2179216 - DNA, 19 bp, Homo sapiens
acagaaattgtatattgta

SEQ ID NO: 2179217 - DNA, 23 bp, Homo sapiens
acagaaattgtatattgtaattt

SEQ ID NO: 2179218 - DNA, 14 bp, Homo sapiens
acagacccctggga

SEQ ID NO: 2179219 - DNA, 18 bp, Homo sapiens
acagaggcagtggcagca

SEQ ID NO: 2179220 - DNA, 17 bp, Homo sapiens
acagagtggagccctca

SEQ ID NO: 2179221 - DNA, 17 bp, Homo sapiens
acagatacatacataga

SEQ ID NO: 2179222 - DNA, 19 bp, Homo sapiens
acagatggctgtgaaaatt

SEQ ID NO: 2179223 - DNA, 15 bp, Homo sapiens
acagcaaatgagatg

SEQ ID NO: 2179224 - DNA, 16 bp, Homo sapiens
acagcaaatgcaaaaa

SEQ ID NO: 2179225 - DNA, 17 bp, Homo sapiens
acagcacctcctctctg

SEQ ID NO: 2179226 - DNA, 18 bp, Homo sapiens
acagcagaaacccatgtg

SEQ ID NO: 2179227 - DNA, 19 bp, Homo sapiens
acagcagaaacccatgtgc

SEQ ID NO: 2179228 - DNA, 17 bp, Homo sapiens
acagcatgactggacag

SEQ ID NO: 2179229 - DNA, 18 bp, Homo sapiens
acagcatgactggacagc

SEQ ID NO: 2179230 - DNA, 16 bp, Homo sapiens
acagcatggaaaaggt

SEQ ID NO: 2179231 - DNA, 17 bp, Homo sapiens
acagcatggtgcatgcc

SEQ ID NO: 2179232 - DNA, 17 bp, Homo sapiens
acagccaagacccaaca

SEQ ID NO: 2179233 - DNA, 17 bp, Homo sapiens
acagccagtaaggcagc

SEQ ID NO: 2179234 - DNA, 17 bp, Homo sapiens
acagcgggtaaaaagag

SEQ ID NO: 2179235 - DNA, 13 bp, Homo sapiens
acagcggttgtaa

SEQ ID NO: 2179236 - DNA, 16 bp, Homo sapiens
acagctcagccagtgg

SEQ ID NO: 2179237 - DNA, 17 bp, Homo sapiens
acagctcagccagtggg

SEQ ID NO: 2179238 - DNA, 14 bp, Homo sapiens
acagctccttgtga

SEQ ID NO: 2179239 - DNA, 17 bp, Homo sapiens
acagctgcaggtgccca

SEQ ID NO: 2179240 - DNA, 15 bp, Homo sapiens
acagctttcctgggt

SEQ ID NO: 2179241 - DNA, 23 bp, Homo sapiens
acagcttttagtacccacctgag

SEQ ID NO: 2179242 - DNA, 13 bp, Homo sapiens
acaggaaggcttg

SEQ ID NO: 2179243 - DNA, 18 bp, Homo sapiens
acaggctggtatttaaca

SEQ ID NO: 2179244 - DNA, 17 bp, Homo sapiens
acagggacacagtctgg

SEQ ID NO: 2179245 - DNA, 22 bp, Homo sapiens
acagggataaggcctgtggggg

SEQ ID NO: 2179246 - DNA, 24 bp, Homo sapiens
acagggccctctgaggctcagccc

SEQ ID NO: 2179247 - DNA, 23 bp, Homo sapiens
acagggcctgacttttacagctt

SEQ ID NO: 2179248 - DNA, 15 bp, Homo sapiens
acagggctgcaacac

SEQ ID NO: 2179249 - DNA, 23 bp, Homo sapiens
acagggggtggagagaccagcct

SEQ ID NO: 2179250 - DNA, 22 bp, Homo sapiens
acaggtgtccccagcccactgg

SEQ ID NO: 2179251 - DNA, 19 bp, Homo sapiens
acaggtgtgagccactgtg

SEQ ID NO: 2179252 - DNA, 10 bp, Homo sapiens
acagtatgtg

SEQ ID NO: 2179253 - DNA, 22 bp, Homo sapiens
acagtatgtgtctagcaaagcc

SEQ ID NO: 2179254 - DNA, 15 bp, Homo sapiens
acagtgagaaaagaa

SEQ ID NO: 2179255 - DNA, 20 bp, Homo sapiens
acagtgtatctcgaagtctt

SEQ ID NO: 2179256 - DNA, 16 bp, Homo sapiens
acagttaaacttgcaa

SEQ ID NO: 2179257 - DNA, 18 bp, Homo sapiens
acagttattaaaatgtta

SEQ ID NO: 2179258 - DNA, 15 bp, Homo sapiens
acagttgactggctt

SEQ ID NO: 2179259 - DNA, 13 bp, Homo sapiens
acagttgtattta

SEQ ID NO: 2179260 - DNA, 14 bp, Homo sapiens
acagtttatgagaa

SEQ ID NO: 2179261 - DNA, 18 bp, Homo sapiens
acataagctagaaaaatt

SEQ ID NO: 2179262 - DNA, 13 bp, Homo sapiens
acatacagagtgg

SEQ ID NO: 2179263 - DNA, 23 bp, Homo sapiens
acatacagagtgggccccgggct

SEQ ID NO: 2179264 - DNA, 17 bp, Homo sapiens
acatactatagattctt

SEQ ID NO: 2179265 - DNA, 22 bp, Homo sapiens
acatacttcatcgcagtggact

SEQ ID NO: 2179266 - DNA, 23 bp, Homo sapiens
acatagatgtatcattaatgtag

SEQ ID NO: 2179267 - DNA, 22 bp, Homo sapiens
acatatatatgccttatgtaat

SEQ ID NO: 2179268 - DNA, 20 bp, Homo sapiens
acatatggaattttgcaaag

SEQ ID NO: 2179269 - DNA, 23 bp, Homo sapiens
acatctgaggttttatttcattt

SEQ ID NO: 2179270 - DNA, 19 bp, Homo sapiens
acatctgccttgctgcacc

SEQ ID NO: 2179271 - DNA, 14 bp, Homo sapiens
acatcttttgggaa

SEQ ID NO: 2179272 - DNA, 18 bp, Homo sapiens
acatcttttgggaagcca

SEQ ID NO: 2179273 - DNA, 15 bp, Homo sapiens
acatgacatttgtcc

SEQ ID NO: 2179274 - DNA, 21 bp, Homo sapiens
acatgacatttgtcctgcaga

SEQ ID NO: 2179275 - DNA, 22 bp, Homo sapiens
acatgacatttgtcctgcagag

SEQ ID NO: 2179276 - DNA, 20 bp, Homo sapiens
acatgaccagaaaacaaatc

SEQ ID NO: 2179277 - DNA, 16 bp, Homo sapiens
acatgcactactgaaa

SEQ ID NO: 2179278 - DNA, 17 bp, Homo sapiens
acatgccttatatttgt

SEQ ID NO: 2179279 - DNA, 11 bp, Homo sapiens
acatggccaca

SEQ ID NO: 2179280 - DNA, 19 bp, Homo sapiens
acatggcttcctaaatggc

SEQ ID NO: 2179281 - DNA, 22 bp, Homo sapiens
acatggcttcctaaatggccct

SEQ ID NO: 2179282 - DNA, 14 bp, Homo sapiens
acatggtagcaggg

SEQ ID NO: 2179283 - DNA, 18 bp, Homo sapiens
acatggtagcagggtctt

SEQ ID NO: 2179284 - DNA, 23 bp, Homo sapiens
acatggtagcagggtctttgtgt

SEQ ID NO: 2179285 - DNA, 12 bp, Homo sapiens
acatgtcatgta

SEQ ID NO: 2179286 - DNA, 15 bp, Homo sapiens
acatgttcccttctc

SEQ ID NO: 2179287 - DNA, 19 bp, Homo sapiens
acattaatttatgcagaga

SEQ ID NO: 2179288 - DNA, 21 bp, Homo sapiens
acattcagctctggagaacag

SEQ ID NO: 2179289 - DNA, 18 bp, Homo sapiens
acatttctattttgcaaa

SEQ ID NO: 2179290 - DNA, 19 bp, Homo sapiens
acatttgagtcccttccag

SEQ ID NO: 2179291 - DNA, 18 bp, Homo sapiens
acatttgggactgtcttg

SEQ ID NO: 2179292 - DNA, 14 bp, Homo sapiens
acatttttaattga

SEQ ID NO: 2179293 - DNA, 16 bp, Homo sapiens
accaaaatccccttct

SEQ ID NO: 2179294 - DNA, 17 bp, Homo sapiens
accaaaatccccttctc

SEQ ID NO: 2179295 - DNA, 10 bp, Homo sapiens
accaaagctg

SEQ ID NO: 2179296 - DNA, 11 bp, Homo sapiens
accaaagctga

SEQ ID NO: 2179297 - DNA, 12 bp, Homo sapiens
accaaagctgtt

SEQ ID NO: 2179298 - DNA, 16 bp, Homo sapiens
accaaagctgttttta

SEQ ID NO: 2179299 - DNA, 16 bp, Homo sapiens
accaacataaaacaaa

SEQ ID NO: 2179300 - DNA, 21 bp, Homo sapiens
accaacataaaacaaaaccaa

SEQ ID NO: 2179301 - DNA, 16 bp, Homo sapiens
accaagccggtgccca

SEQ ID NO: 2179302 - DNA, 18 bp, Homo sapiens
accaatgtgaagacacta

SEQ ID NO: 2179303 - DNA, 20 bp, Homo sapiens
accacaaaaagagaagctgt

SEQ ID NO: 2179304 - DNA, 22 bp, Homo sapiens
accacaaaaagagaagctgtgt

SEQ ID NO: 2179305 - DNA, 21 bp, Homo sapiens
accacacccggctaatttttt

SEQ ID NO: 2179306 - DNA, 14 bp, Homo sapiens
accacaggaagccg

SEQ ID NO: 2179307 - DNA, 14 bp, Homo sapiens
accaccccccactc

SEQ ID NO: 2179308 - DNA, 23 bp, Homo sapiens
accaccctatcatcagttaggat

SEQ ID NO: 2179309 - DNA, 14 bp, Homo sapiens
accaccctgagccg

SEQ ID NO: 2179310 - DNA, 16 bp, Homo sapiens
accacctctggccctg

SEQ ID NO: 2179311 - DNA, 22 bp, Homo sapiens
accacgcctcttgaccaggctg

SEQ ID NO: 2179312 - DNA, 14 bp, Homo sapiens
accactgtacatat

SEQ ID NO: 2179313 - DNA, 13 bp, Homo sapiens
accactgtcttct

SEQ ID NO: 2179314 - DNA, 14 bp, Homo sapiens
accacttatttcta

SEQ ID NO: 2179315 - DNA, 15 bp, Homo sapiens
accacttatttctaa

SEQ ID NO: 2179316 - DNA, 20 bp, Homo sapiens
accagaaaacaaatcttcaa

SEQ ID NO: 2179317 - DNA, 14 bp, Homo sapiens
accagaataaaata

SEQ ID NO: 2179318 - DNA, 23 bp, Homo sapiens
accagagctctggagccacctgt

SEQ ID NO: 2179319 - DNA, 13 bp, Homo sapiens
accagcagtgttt

SEQ ID NO: 2179320 - DNA, 15 bp, Homo sapiens
accagcagtgtttaa

SEQ ID NO: 2179321 - DNA, 22 bp, Homo sapiens
accagctgttctgtcccttgga

SEQ ID NO: 2179322 - DNA, 23 bp, Homo sapiens
accagctgttctgtcccttggag

SEQ ID NO: 2179323 - DNA, 11 bp, Homo sapiens
accaggactta

SEQ ID NO: 2179324 - DNA, 17 bp, Homo sapiens
accaggctgcctccctt

SEQ ID NO: 2179325 - DNA, 17 bp, Homo sapiens
accaggggaggagcctg

SEQ ID NO: 2179326 - DNA, 13 bp, Homo sapiens
accagtttcttaa

SEQ ID NO: 2179327 - DNA, 20 bp, Homo sapiens
accataccactttgacacgc

SEQ ID NO: 2179328 - DNA, 14 bp, Homo sapiens
accatagaacagaa

SEQ ID NO: 2179329 - DNA, 12 bp, Homo sapiens
accatgtcattt

SEQ ID NO: 2179330 - DNA, 15 bp, Homo sapiens
accatgtcatttcag

SEQ ID NO: 2179331 - DNA, 14 bp, Homo sapiens
accattctccttcc

SEQ ID NO: 2179332 - DNA, 17 bp, Homo sapiens
accattctccttcccca

SEQ ID NO: 2179333 - DNA, 22 bp, Homo sapiens
agccacagacccctgggagctt

SEQ ID NO: 2179334 - DNA, 21 bp, Homo sapiens
agccacaggccccttttgtgg

SEQ ID NO: 2179335 - DNA, 20 bp, Homo sapiens
agccaccctaactgagctgc

SEQ ID NO: 2179336 - DNA, 14 bp, Homo sapiens
agccacctgtccca

SEQ ID NO: 2179337 - DNA, 16 bp, Homo sapiens
agccacctgtcccacc

SEQ ID NO: 2179338 - DNA, 16 bp, Homo sapiens
agccacgtgctggaga

SEQ ID NO: 2179339 - DNA, 13 bp, Homo sapiens
agccactaactag

SEQ ID NO: 2179340 - DNA, 16 bp, Homo sapiens
agccactgtgcccagc

SEQ ID NO: 2179341 - DNA, 20 bp, Homo sapiens
agccagaaccccgagcccta

SEQ ID NO: 2179342 - DNA, 14 bp, Homo sapiens
agccagacagttta

SEQ ID NO: 2179343 - DNA, 11 bp, Homo sapiens
agccagccaca

SEQ ID NO: 2179344 - DNA, 12 bp, Homo sapiens
agccagccaccc

SEQ ID NO: 2179345 - DNA, 21 bp, Homo sapiens
agccagcggcatatacttgtt

SEQ ID NO: 2179346 - DNA, 22 bp, Homo sapiens
agccagggatggggccacagcc

SEQ ID NO: 2179347 - DNA, 14 bp, Homo sapiens
agccatcccagcct

SEQ ID NO: 2179348 - DNA, 17 bp, Homo sapiens
agccatcccagccttgg

SEQ ID NO: 2179349 - DNA, 19 bp, Homo sapiens
agccatcccagccttggca

SEQ ID NO: 2179350 - DNA, 22 bp, Homo sapiens
agccatgctgctttgcacacac

SEQ ID NO: 2179351 - DNA, 13 bp, Homo sapiens
agccatgggacca

SEQ ID NO: 2179352 - DNA, 16 bp, Homo sapiens
agccatgtagccaccc

SEQ ID NO: 2179353 - DNA, 23 bp, Homo sapiens
agccatgtccaaacccatcttca

SEQ ID NO: 2179354 - DNA, 16 bp, Homo sapiens
agcccaatcactgcct

SEQ ID NO: 2179355 - DNA, 12 bp, Homo sapiens
agcccactggat

SEQ ID NO: 2179356 - DNA, 20 bp, Homo sapiens
agcccactggatcagaaaga

SEQ ID NO: 2179357 - DNA, 14 bp, Homo sapiens
agcccagctgctct

SEQ ID NO: 2179358 - DNA, 15 bp, Homo sapiens
agcccagctgctctg

SEQ ID NO: 2179359 - DNA, 16 bp, Homo sapiens
agcccagctgctctgc

SEQ ID NO: 2179360 - DNA, 15 bp, Homo sapiens
agccccagcccagcc

SEQ ID NO: 2179361 - DNA, 23 bp, Homo sapiens
agccccagcccagcccagctgct

SEQ ID NO: 2179362 - DNA, 19 bp, Homo sapiens
agcccccacccacttccct

SEQ ID NO: 2179363 - DNA, 13 bp, Homo sapiens
agccccctgtcct

SEQ ID NO: 2179364 - DNA, 22 bp, Homo sapiens
agccccctgtccttcccacggc

SEQ ID NO: 2179365 - DNA, 20 bp, Homo sapiens
agccccgcaaaacccactga

SEQ ID NO: 2179366 - DNA, 16 bp, Homo sapiens
agcccgcatgcagcag

SEQ ID NO: 2179367 - DNA, 17 bp, Homo sapiens
agcccgcatgcagcagc

SEQ ID NO: 2179368 - DNA, 18 bp, Homo sapiens
agcccgcatgcagcagct

SEQ ID NO: 2179369 - DNA, 16 bp, Homo sapiens
agccctgagctggcct

SEQ ID NO: 2179370 - DNA, 22 bp, Homo sapiens
agccctgagctggcgtcacctg

SEQ ID NO: 2179371 - DNA, 20 bp, Homo sapiens
agccctgagttggcatcacc

SEQ ID NO: 2179372 - DNA, 16 bp, Homo sapiens
agccggatcttggaga

SEQ ID NO: 2179373 - DNA, 13 bp, Homo sapiens
agccggtgcccac

SEQ ID NO: 2179374 - DNA, 14 bp, Homo sapiens
agccggtgcccacc

SEQ ID NO: 2179375 - DNA, 16 bp, Homo sapiens
agccggtttgggagag

SEQ ID NO: 2179376 - DNA, 18 bp, Homo sapiens
agccggtttgggagagac

SEQ ID NO: 2179377 - DNA, 23 bp, Homo sapiens
agccgtcctggcgcctggcagtc

SEQ ID NO: 2179378 - DNA, 14 bp, Homo sapiens
agccgttcctggga

SEQ ID NO: 2179379 - DNA, 15 bp, Homo sapiens
agcctcaacctccct

SEQ ID NO: 2179380 - DNA, 19 bp, Homo sapiens
agcctcaataagccttgtc

SEQ ID NO: 2179381 - DNA, 11 bp, Homo sapiens
agcctccctct

SEQ ID NO: 2179382 - DNA, 17 bp, Homo sapiens
agcctccctctcctctg

SEQ ID NO: 2179383 - DNA, 16 bp, Homo sapiens
agcctcgaactcctgg

SEQ ID NO: 2179384 - DNA, 21 bp, Homo sapiens
agcctcgaactcctgggctca

SEQ ID NO: 2179385 - DNA, 15 bp, Homo sapiens
agcctctggccagac

SEQ ID NO: 2179386 - DNA, 15 bp, Homo sapiens
agcctcttctgaaga

SEQ ID NO: 2179387 - DNA, 22 bp, Homo sapiens
agcctgagcaagacgccctctc

SEQ ID NO: 2179388 - DNA, 15 bp, Homo sapiens
agcctgcggctgctg

SEQ ID NO: 2179389 - DNA, 20 bp, Homo sapiens
agcctgcggctgctggcaca

SEQ ID NO: 2179390 - DNA, 17 bp, Homo sapiens
agcctgggccactggca

SEQ ID NO: 2179391 - DNA, 18 bp, Homo sapiens
agcctgggccactggcat

SEQ ID NO: 2179392 - DNA, 19 bp, Homo sapiens
agcctgtgcgtcccagctg

SEQ ID NO: 2179393 - DNA, 12 bp, Homo sapiens
agccttgcccag

SEQ ID NO: 2179394 - DNA, 19 bp, Homo sapiens
agccttgcgcaaaacccag

SEQ ID NO: 2179395 - DNA, 19 bp, Homo sapiens
agccttggctcgttctctt

SEQ ID NO: 2179396 - DNA, 13 bp, Homo sapiens
agccttttaaatc

SEQ ID NO: 2179397 - DNA, 22 bp, Homo sapiens
agcgactctcctgcctcagcct

SEQ ID NO: 2179398 - DNA, 22 bp, Homo sapiens
agcgatccctcccctcagcctc

SEQ ID NO: 2179399 - DNA, 21 bp, Homo sapiens
agcggcatttagtacatccag

SEQ ID NO: 2179400 - DNA, 15 bp, Homo sapiens
agcgggtaaaaagag

SEQ ID NO: 2179401 - DNA, 16 bp, Homo sapiens
agcgggtaaaaagaga

SEQ ID NO: 2179402 - DNA, 17 bp, Homo sapiens
agcggtggaaggagcct

SEQ ID NO: 2179403 - DNA, 22 bp, Homo sapiens
agcggtggaaggagcctgcggc

SEQ ID NO: 2179404 - DNA, 23 bp, Homo sapiens
agcggtggaaggagcctgcggct

SEQ ID NO: 2179405 - DNA, 17 bp, Homo sapiens
agctaagcctgatgatg

SEQ ID NO: 2179406 - DNA, 18 bp, Homo sapiens
agctacagccagcggcat

SEQ ID NO: 2179407 - DNA, 20 bp, Homo sapiens
agctaccttttttttacgga

SEQ ID NO: 2179408 - DNA, 21 bp, Homo sapiens
agctaccttttttttacggaa

SEQ ID NO: 2179409 - DNA, 22 bp, Homo sapiens
agctaccttttttttacggaat

SEQ ID NO: 2179410 - DNA, 19 bp, Homo sapiens
agctacttgggccatagct

SEQ ID NO: 2179411 - DNA, 17 bp, Homo sapiens
agctagagaggggcctc

SEQ ID NO: 2179412 - DNA, 14 bp, Homo sapiens
agctagagcttcaa

SEQ ID NO: 2179413 - DNA, 15 bp, Homo sapiens
agctagctcccctcc

SEQ ID NO: 2179414 - DNA, 16 bp, Homo sapiens
agctagctcccctcct

SEQ ID NO: 2179415 - DNA, 18 bp, Homo sapiens
agctagctcccctcctct

SEQ ID NO: 2179416 - DNA, 20 bp, Homo sapiens
agctagctcccctcctctcc

SEQ ID NO: 2179417 - DNA, 15 bp, Homo sapiens
agctaggccccagag

SEQ ID NO: 2179418 - DNA, 16 bp, Homo sapiens
agctaggccccagagg

SEQ ID NO: 2179419 - DNA, 17 bp, Homo sapiens
agctaggccccagaggc

SEQ ID NO: 2179420 - DNA, 19 bp, Homo sapiens
agctaggccccagaggccc

SEQ ID NO: 2179421 - DNA, 20 bp, Homo sapiens
agctaggccccagaggccct

SEQ ID NO: 2179422 - DNA, 21 bp, Homo sapiens
agctaggccccagaggccctg

SEQ ID NO: 2179423 - DNA, 22 bp, Homo sapiens
agctaggccccagaggccctgg

SEQ ID NO: 2179424 - DNA, 16 bp, Homo sapiens
agctagtgtcacctgc

SEQ ID NO: 2179425 - DNA, 23 bp, Homo sapiens
agctatcctaaatttgaaatagt

SEQ ID NO: 2179426 - DNA, 13 bp, Homo sapiens
agctatgaatgtt

SEQ ID NO: 2179427 - DNA, 17 bp, Homo sapiens
agctatgaatgttacta

SEQ ID NO: 2179428 - DNA, 12 bp, Homo sapiens
agctattctttg

SEQ ID NO: 2179429 - DNA, 22 bp, Homo sapiens
agctatttctcatcaattctct

SEQ ID NO: 2179430 - DNA, 16 bp, Homo sapiens
agctcactgcaacctc

SEQ ID NO: 2179431 - DNA, 18 bp, Homo sapiens
agctcagtcttccctagg

SEQ ID NO: 2179432 - DNA, 23 bp, Homo sapiens
agctcagtcttccctagggctgg

SEQ ID NO: 2179433 - DNA, 17 bp, Homo sapiens
agctcagtttggctgta

SEQ ID NO: 2179434 - DNA, 14 bp, Homo sapiens
agctcccctcctct

SEQ ID NO: 2179435 - DNA, 18 bp, Homo sapiens
agctccgcctggcaccca

SEQ ID NO: 2179436 - DNA, 11 bp, Homo sapiens
agctctggaga

SEQ ID NO: 2179437 - DNA, 13 bp, Homo sapiens
agctctggagaac

SEQ ID NO: 2179438 - DNA, 18 bp, Homo sapiens
agctctggagccacctgt

SEQ ID NO: 2179439 - DNA, 19 bp, Homo sapiens
agctctggagccacctgtc

SEQ ID NO: 2179440 - DNA, 12 bp, Homo sapiens
agctctggctca

SEQ ID NO: 2179441 - DNA, 13 bp, Homo sapiens
agctctggtggga

SEQ ID NO: 2179442 - DNA, 19 bp, Homo sapiens
agctgaagccgccaggacc

SEQ ID NO: 2179443 - DNA, 15 bp, Homo sapiens
agctgacgaggctgg

SEQ ID NO: 2179444 - DNA, 17 bp, Homo sapiens
agctgagactacaggtg

SEQ ID NO: 2179445 - DNA, 13 bp, Homo sapiens
agctgagctggcc

SEQ ID NO: 2179446 - DNA, 16 bp, Homo sapiens
agctgcaggtgcccat

SEQ ID NO: 2179447 - DNA, 17 bp, Homo sapiens
agctgcaggtgcccatt

SEQ ID NO: 2179448 - DNA, 14 bp, Homo sapiens
agctgcctaagagg

SEQ ID NO: 2179449 - DNA, 14 bp, Homo sapiens
agctgcctggatga

SEQ ID NO: 2179450 - DNA, 20 bp, Homo sapiens
agctgcctggatgagaaaca

SEQ ID NO: 2179451 - DNA, 19 bp, Homo sapiens
agctgctccgaggacccag

SEQ ID NO: 2179452 - DNA, 12 bp, Homo sapiens
agctgctctgcc

SEQ ID NO: 2179453 - DNA, 16 bp, Homo sapiens
agctgctctgcccaga

SEQ ID NO: 2179454 - DNA, 20 bp, Homo sapiens
agctgctctgcccagagctg

SEQ ID NO: 2179455 - DNA, 16 bp, Homo sapiens
atgctcacgctcccaa

SEQ ID NO: 2179456 - DNA, 21 bp, Homo sapiens
atgctgcacaccagttactgt

SEQ ID NO: 2179457 - DNA, 17 bp, Homo sapiens
atgctgctatgaagact

SEQ ID NO: 2179458 - DNA, 21 bp, Homo sapiens
atgctggacaggtctgggaga

SEQ ID NO: 2179459 - DNA, 21 bp, Homo sapiens
atgctgtgaattttacaaaaa

SEQ ID NO: 2179460 - DNA, 16 bp, Homo sapiens
atgcttaggtgaaggc

SEQ ID NO: 2179461 - DNA, 17 bp, Homo sapiens
atgctttgattgttcat

SEQ ID NO: 2179462 - DNA, 15 bp, Homo sapiens
atggaaacttggaaa

SEQ ID NO: 2179463 - DNA, 14 bp, Homo sapiens
atggaacctccttt

SEQ ID NO: 2179464 - DNA, 19 bp, Homo sapiens
atggactgcaccttgtgaa

SEQ ID NO: 2179465 - DNA, 21 bp, Homo sapiens
atggatggggcccaggggctt

SEQ ID NO: 2179466 - DNA, 18 bp, Homo sapiens
atggattcccctggacat

SEQ ID NO: 2179467 - DNA, 16 bp, Homo sapiens
atggcaggagaatcag

SEQ ID NO: 2179468 - DNA, 14 bp, Homo sapiens
atggcagtgggaga

SEQ ID NO: 2179469 - DNA, 20 bp, Homo sapiens
atggcatattgataataaaa

SEQ ID NO: 2179470 - DNA, 16 bp, Homo sapiens
atggcattactctgca

SEQ ID NO: 2179471 - DNA, 15 bp, Homo sapiens
atggctaaggcacca

SEQ ID NO: 2179472 - DNA, 22 bp, Homo sapiens
atggctagaatatcctacttct

SEQ ID NO: 2179473 - DNA, 16 bp, Homo sapiens
atggctcaaggattca

SEQ ID NO: 2179474 - DNA, 22 bp, Homo sapiens
atggctcactatggtgccaatg

SEQ ID NO: 2179475 - DNA, 19 bp, Homo sapiens
atggctgtgaaaattacac

SEQ ID NO: 2179476 - DNA, 15 bp, Homo sapiens
atgggactgatgtca

SEQ ID NO: 2179477 - DNA, 17 bp, Homo sapiens
atgggactgatgtcatc

SEQ ID NO: 2179478 - DNA, 21 bp, Homo sapiens
atgggactgatgtcatcttga

SEQ ID NO: 2179479 - DNA, 18 bp, Homo sapiens
atgggagccagaattcac

SEQ ID NO: 2179480 - DNA, 15 bp, Homo sapiens
atgggagtaagagca

SEQ ID NO: 2179481 - DNA, 23 bp, Homo sapiens
atggggagatcggggccagaggc

SEQ ID NO: 2179482 - DNA, 14 bp, Homo sapiens
atgggtagcttctg

SEQ ID NO: 2179483 - DNA, 16 bp, Homo sapiens
atgggtatcaaacagc

SEQ ID NO: 2179484 - DNA, 16 bp, Homo sapiens
atggtagactgtgaca

SEQ ID NO: 2179485 - DNA, 14 bp, Homo sapiens
atggtgcctctgga

SEQ ID NO: 2179486 - DNA, 19 bp, Homo sapiens
atggttctggctgtttgag

SEQ ID NO: 2179487 - DNA, 14 bp, Homo sapiens
atgtaaccaagctg

SEQ ID NO: 2179488 - DNA, 15 bp, Homo sapiens
atgtaaccaagctgt

SEQ ID NO: 2179489 - DNA, 19 bp, Homo sapiens
atgtaataatcattttaga

SEQ ID NO: 2179490 - DNA, 23 bp, Homo sapiens
atgtaataatcattttagaatta

SEQ ID NO: 2179491 - DNA, 19 bp, Homo sapiens
atgtaatttcagttctaaa

SEQ ID NO: 2179492 - DNA, 16 bp, Homo sapiens
atgtactctactgata

SEQ ID NO: 2179493 - DNA, 21 bp, Homo sapiens
atgtacttccagtatcctgaa

SEQ ID NO: 2179494 - DNA, 14 bp, Homo sapiens
atgtagccacccaa

SEQ ID NO: 2179495 - DNA, 18 bp, Homo sapiens
atgtataatgacttttaa

SEQ ID NO: 2179496 - DNA, 19 bp, Homo sapiens
atgtataatgacttttaaa

SEQ ID NO: 2179497 - DNA, 20 bp, Homo sapiens
atgtatgataaacagttgaa

SEQ ID NO: 2179498 - DNA, 15 bp, Homo sapiens
atgtatgtgtagtgt

SEQ ID NO: 2179499 - DNA, 22 bp, Homo sapiens
atgtatgtgtagtgtgtttgtg

SEQ ID NO: 2179500 - DNA, 15 bp, Homo sapiens
atgtattcagagcca

SEQ ID NO: 2179501 - DNA, 23 bp, Homo sapiens
atgtcaaccttgtgtgagtgtga

SEQ ID NO: 2179502 - DNA, 13 bp, Homo sapiens
atgtcatcttgag

SEQ ID NO: 2179503 - DNA, 14 bp, Homo sapiens
atgtcatcttgagc

SEQ ID NO: 2179504 - DNA, 15 bp, Homo sapiens
atgtcatcttgagct

SEQ ID NO: 2179505 - DNA, 19 bp, Homo sapiens
atgtcgtggacacacacag

SEQ ID NO: 2179506 - DNA, 16 bp, Homo sapiens
atgtgaatatttgtaa

SEQ ID NO: 2179507 - DNA, 20 bp, Homo sapiens
atgtgaatatttgtaaaaat

SEQ ID NO: 2179508 - DNA, 22 bp, Homo sapiens
atgtgccaccaacataaaacaa

SEQ ID NO: 2179509 - DNA, 14 bp, Homo sapiens
atgtgcccgcctct

SEQ ID NO: 2179510 - DNA, 18 bp, Homo sapiens
atgtggatggaggtgatg

SEQ ID NO: 2179511 - DNA, 14 bp, Homo sapiens
atgtgtatgtgttt

SEQ ID NO: 2179512 - DNA, 17 bp, Homo sapiens
atgtgtctagcaaagcc

SEQ ID NO: 2179513 - DNA, 19 bp, Homo sapiens
atgtgtctagcaaagccac

SEQ ID NO: 2179514 - DNA, 17 bp, Homo sapiens
atgtgtgctcttcttct

SEQ ID NO: 2179515 - DNA, 21 bp, Homo sapiens
atgttacagtccagttttgtg

SEQ ID NO: 2179516 - DNA, 20 bp, Homo sapiens
atgttaggctgggcccagag

SEQ ID NO: 2179517 - DNA, 18 bp, Homo sapiens
atgttccatcctgtacaa

SEQ ID NO: 2179518 - DNA, 19 bp, Homo sapiens
atgttctcatgtttgtgca

SEQ ID NO: 2179519 - DNA, 16 bp, Homo sapiens
atgttgaagtcaaatt

SEQ ID NO: 2179520 - DNA, 12 bp, Homo sapiens
atgttgcccagg

SEQ ID NO: 2179521 - DNA, 14 bp, Homo sapiens
atgtttgctcctgt

SEQ ID NO: 2179522 - DNA, 17 bp, Homo sapiens
atgtttgtgcatgtata

SEQ ID NO: 2179523 - DNA, 22 bp, Homo sapiens
atgtttttaaatgcataaaata

SEQ ID NO: 2179524 - DNA, 15 bp, Homo sapiens
attaaaaacacctaa

SEQ ID NO: 2179525 - DNA, 13 bp, Homo sapiens
attaaaatcacaa

SEQ ID NO: 2179526 - DNA, 15 bp, Homo sapiens
attaaaatttattct

SEQ ID NO: 2179527 - DNA, 19 bp, Homo sapiens
attaaacctttccatttta

SEQ ID NO: 2179528 - DNA, 13 bp, Homo sapiens
attaaagaaaatt

SEQ ID NO: 2179529 - DNA, 13 bp, Homo sapiens
attaaatatttct

SEQ ID NO: 2179530 - DNA, 16 bp, Homo sapiens
attaaatatttcttaa

SEQ ID NO: 2179531 - DNA, 17 bp, Homo sapiens
attaaatcagttttgtg

SEQ ID NO: 2179532 - DNA, 12 bp, Homo sapiens
attaaatgcaaa

SEQ ID NO: 2179533 - DNA, 13 bp, Homo sapiens
attaacatatatt

SEQ ID NO: 2179534 - DNA, 22 bp, Homo sapiens
attaacggtgctaaccccgtct

SEQ ID NO: 2179535 - DNA, 17 bp, Homo sapiens
attaagttcgaggtggc

SEQ ID NO: 2179536 - DNA, 13 bp, Homo sapiens
attaatgtagata

SEQ ID NO: 2179537 - DNA, 18 bp, Homo sapiens
attaatttctctcaattt

SEQ ID NO: 2179538 - DNA, 20 bp, Homo sapiens
attacaaaggaatctaatta

SEQ ID NO: 2179539 - DNA, 17 bp, Homo sapiens
attacaagtttcagtaa

SEQ ID NO: 2179540 - DNA, 16 bp, Homo sapiens
attacacattaaagta

SEQ ID NO: 2179541 - DNA, 18 bp, Homo sapiens
attacaggggcttgaaca

SEQ ID NO: 2179542 - DNA, 16 bp, Homo sapiens
attaccgtcacactct

SEQ ID NO: 2179543 - DNA, 20 bp, Homo sapiens
attactctgcactatagcca

SEQ ID NO: 2179544 - DNA, 13 bp, Homo sapiens
attactgtttgtc

SEQ ID NO: 2179545 - DNA, 23 bp, Homo sapiens
attactttaccacccccacacct

SEQ ID NO: 2179546 - DNA, 19 bp, Homo sapiens
attactttgattccatttt

SEQ ID NO: 2179547 - DNA, 11 bp, Homo sapiens
attagaacttg

SEQ ID NO: 2179548 - DNA, 18 bp, Homo sapiens
attagatgactgaatttc

SEQ ID NO: 2179549 - DNA, 23 bp, Homo sapiens
attagccaactgtttccctgctg

SEQ ID NO: 2179550 - DNA, 15 bp, Homo sapiens
attagccaggctggt

SEQ ID NO: 2179551 - DNA, 19 bp, Homo sapiens
attagctcacttggtgata

SEQ ID NO: 2179552 - DNA, 16 bp, Homo sapiens
attaggtttagaatca

SEQ ID NO: 2179553 - DNA, 18 bp, Homo sapiens
attagtgaagtatgcact

SEQ ID NO: 2179554 - DNA, 15 bp, Homo sapiens
attatataactgtat

SEQ ID NO: 2179555 - DNA, 13 bp, Homo sapiens
attatattttgaa

SEQ ID NO: 2179556 - DNA, 22 bp, Homo sapiens
attatattttgaacaactcgaa

SEQ ID NO: 2179557 - DNA, 17 bp, Homo sapiens
attatcttcttaacagt

SEQ ID NO: 2179558 - DNA, 18 bp, Homo sapiens
attattaaatcagttttg

SEQ ID NO: 2179559 - DNA, 15 bp, Homo sapiens
attattcatagctgt

SEQ ID NO: 2179560 - DNA, 19 bp, Homo sapiens
attattcatagctgtatat

SEQ ID NO: 2179561 - DNA, 15 bp, Homo sapiens
attattccagatctg

SEQ ID NO: 2179562 - DNA, 16 bp, Homo sapiens
attattttttgttgaa

SEQ ID NO: 2179563 - DNA, 14 bp, Homo sapiens
attcaaaaattata

SEQ ID NO: 2179564 - DNA, 19 bp, Homo sapiens
attcaaaaattatattttg

SEQ ID NO: 2179565 - DNA, 15 bp, Homo sapiens
attcaaagatgataa

SEQ ID NO: 2179566 - DNA, 23 bp, Homo sapiens
attcaagaggcctttcttttaaa

SEQ ID NO: 2179567 - DNA, 19 bp, Homo sapiens
attcaataaaatgcactga

SEQ ID NO: 2179568 - DNA, 15 bp, Homo sapiens
attcaatcaaagcta

SEQ ID NO: 2179569 - DNA, 18 bp, Homo sapiens
attcaatcaaagctacct

SEQ ID NO: 2179570 - DNA, 15 bp, Homo sapiens
attcaatttgattct

SEQ ID NO: 2179571 - DNA, 13 bp, Homo sapiens
attcacaagctgc

SEQ ID NO: 2179572 - DNA, 15 bp, Homo sapiens
attcacaagctgcct

SEQ ID NO: 2179573 - DNA, 17 bp, Homo sapiens
attcacttgtgtttgta

SEQ ID NO: 2179574 - DNA, 14 bp, Homo sapiens
attcagctctggag

SEQ ID NO: 2179575 - DNA, 11 bp, Homo sapiens
attcagctgcc

SEQ ID NO: 2179576 - DNA, 12 bp, Homo sapiens
attcagctgccc

SEQ ID NO: 2179577 - DNA, 21 bp, Homo sapiens
cacctgaggcccagcagagcc

SEQ ID NO: 2179578 - DNA, 17 bp, Homo sapiens
cacctgcacagggccct

SEQ ID NO: 2179579 - DNA, 19 bp, Homo sapiens
cacctgcacagggccctct

SEQ ID NO: 2179580 - DNA, 19 bp, Homo sapiens
cacctgcatcagcctctgg

SEQ ID NO: 2179581 - DNA, 23 bp, Homo sapiens
cacctgcatcagcctctggccag

SEQ ID NO: 2179582 - DNA, 23 bp, Homo sapiens
cacctgccactaggctgggtgcc

SEQ ID NO: 2179583 - DNA, 17 bp, Homo sapiens
cacctgcgcagggccct

SEQ ID NO: 2179584 - DNA, 14 bp, Homo sapiens
cacctgtcccacct

SEQ ID NO: 2179585 - DNA, 17 bp, Homo sapiens
cacctttctgaatggaa

SEQ ID NO: 2179586 - DNA, 22 bp, Homo sapiens
cacgcaggctgagtgcactggc

SEQ ID NO: 2179587 - DNA, 22 bp, Homo sapiens
cacgcttgacaggacagcatgg

SEQ ID NO: 2179588 - DNA, 20 bp, Homo sapiens
cacggcagcctcaacctccc

SEQ ID NO: 2179589 - DNA, 13 bp, Homo sapiens
cacggcctggctg

SEQ ID NO: 2179590 - DNA, 13 bp, Homo sapiens
cacgggaggaatc

SEQ ID NO: 2179591 - DNA, 23 bp, Homo sapiens
cacggtggtccccaaaacactgt

SEQ ID NO: 2179592 - DNA, 18 bp, Homo sapiens
cacgtgctggagagtaga

SEQ ID NO: 2179593 - DNA, 23 bp, Homo sapiens
cactaaacagagaaaagcttgga

SEQ ID NO: 2179594 - DNA, 11 bp, Homo sapiens
cactaactaga

SEQ ID NO: 2179595 - DNA, 18 bp, Homo sapiens
cactagcctccctctcct

SEQ ID NO: 2179596 - DNA, 15 bp, Homo sapiens
cactaggctgggtgc

SEQ ID NO: 2179597 - DNA, 22 bp, Homo sapiens
cactcaaaaaggtgtgtcaaag

SEQ ID NO: 2179598 - DNA, 14 bp, Homo sapiens
cactcacatgctgg

SEQ ID NO: 2179599 - DNA, 23 bp, Homo sapiens
cactcacatgctggacaggtctg

SEQ ID NO: 2179600 - DNA, 22 bp, Homo sapiens
cactccggattccggccctggc

SEQ ID NO: 2179601 - DNA, 18 bp, Homo sapiens
cactcctacacctaactc

SEQ ID NO: 2179602 - DNA, 13 bp, Homo sapiens
cactctcccagag

SEQ ID NO: 2179603 - DNA, 20 bp, Homo sapiens
cactctcccagaggctcctg

SEQ ID NO: 2179604 - DNA, 23 bp, Homo sapiens
cactcttcagtgactcctgctgg

SEQ ID NO: 2179605 - DNA, 21 bp, Homo sapiens
cactgaaacttcaagcaccag

SEQ ID NO: 2179606 - DNA, 19 bp, Homo sapiens
cactgaaccgctacaagag

SEQ ID NO: 2179607 - DNA, 19 bp, Homo sapiens
cactgaagtgaatacatgg

SEQ ID NO: 2179608 - DNA, 21 bp, Homo sapiens
cactgaagtgaatacatggta

SEQ ID NO: 2179609 - DNA, 14 bp, Homo sapiens
cactgcaacctcca

SEQ ID NO: 2179610 - DNA, 20 bp, Homo sapiens
cactgcaacctccacctccc

SEQ ID NO: 2179611 - DNA, 22 bp, Homo sapiens
cactgcaacctccacctcccag

SEQ ID NO: 2179612 - DNA, 23 bp, Homo sapiens
cactgcaacctccacctcccagg

SEQ ID NO: 2179613 - DNA, 17 bp, Homo sapiens
cactgccctctgttcag

SEQ ID NO: 2179614 - DNA, 14 bp, Homo sapiens
cactgcgaactctc

SEQ ID NO: 2179615 - DNA, 16 bp, Homo sapiens
cactgcgaactctcag

SEQ ID NO: 2179616 - DNA, 17 bp, Homo sapiens
cactggatccagaagct

SEQ ID NO: 2179617 - DNA, 13 bp, Homo sapiens
cactggtgtaaaa

SEQ ID NO: 2179618 - DNA, 22 bp, Homo sapiens
cactgtagcctgcgtcatggct

SEQ ID NO: 2179619 - DNA, 23 bp, Homo sapiens
cactgtcaatggactgcaccttg

SEQ ID NO: 2179620 - DNA, 18 bp, Homo sapiens
cacttactgttgtcctat

SEQ ID NO: 2179621 - DNA, 21 bp, Homo sapiens
cacttccccctcttcttctga

SEQ ID NO: 2179622 - DNA, 20 bp, Homo sapiens
cacttgggcacggaaatgca

SEQ ID NO: 2179623 - DNA, 16 bp, Homo sapiens
cactttacataggatt

SEQ ID NO: 2179624 - DNA, 20 bp, Homo sapiens
cactttgcagacctgggact

SEQ ID NO: 2179625 - DNA, 20 bp, Homo sapiens
cactttgccatttgcttgta

SEQ ID NO: 2179626 - DNA, 12 bp, Homo sapiens
cactttggggaa

SEQ ID NO: 2179627 - DNA, 17 bp, Homo sapiens
cactttgtattctctgt

SEQ ID NO: 2179628 - DNA, 20 bp, Homo sapiens
cactttgtattctctgtcca

SEQ ID NO: 2179629 - DNA, 16 bp, Homo sapiens
cacttttgaactcacg

SEQ ID NO: 2179630 - DNA, 21 bp, Homo sapiens
cacttttgaactcacgagcct

SEQ ID NO: 2179631 - DNA, 22 bp, Homo sapiens
cagaaagaattgatcagaatcc

SEQ ID NO: 2179632 - DNA, 16 bp, Homo sapiens
cagaaagcagaggctg

SEQ ID NO: 2179633 - DNA, 21 bp, Homo sapiens
cagaaagttgtgtaggcacca

SEQ ID NO: 2179634 - DNA, 21 bp, Homo sapiens
cagaaatcccagttcatgttg

SEQ ID NO: 2179635 - DNA, 22 bp, Homo sapiens
cagaaatcctttcataaagcac

SEQ ID NO: 2179636 - DNA, 14 bp, Homo sapiens
cagaaatgaaacag

SEQ ID NO: 2179637 - DNA, 15 bp, Homo sapiens
cagaaattgtatatt

SEQ ID NO: 2179638 - DNA, 19 bp, Homo sapiens
cagaacattcagctctgga

SEQ ID NO: 2179639 - DNA, 21 bp, Homo sapiens
cagaacattcagctctggaga

SEQ ID NO: 2179640 - DNA, 23 bp, Homo sapiens
cagaacattcagctctggagaac

SEQ ID NO: 2179641 - DNA, 14 bp, Homo sapiens
cagaacctggtggc

SEQ ID NO: 2179642 - DNA, 21 bp, Homo sapiens
cagaacctggtggctggaggc

SEQ ID NO: 2179643 - DNA, 13 bp, Homo sapiens
cagaagatgtatt

SEQ ID NO: 2179644 - DNA, 21 bp, Homo sapiens
cagaagatgtattcagagcca

SEQ ID NO: 2179645 - DNA, 23 bp, Homo sapiens
cagaagatgtattcagagccacc

SEQ ID NO: 2179646 - DNA, 17 bp, Homo sapiens
cagaaggaaagaagggg

SEQ ID NO: 2179647 - DNA, 23 bp, Homo sapiens
cagaaggtgggggttggctgggt

SEQ ID NO: 2179648 - DNA, 17 bp, Homo sapiens
cagaagttgttagtgat

SEQ ID NO: 2179649 - DNA, 12 bp, Homo sapiens
cagaataaaata

SEQ ID NO: 2179650 - DNA, 13 bp, Homo sapiens
cagaatcccttaa

SEQ ID NO: 2179651 - DNA, 22 bp, Homo sapiens
cagaattattcatagctgtata

SEQ ID NO: 2179652 - DNA, 22 bp, Homo sapiens
cagaattttatgtgactgcttt

SEQ ID NO: 2179653 - DNA, 11 bp, Homo sapiens
cagacaaatta

SEQ ID NO: 2179654 - DNA, 14 bp, Homo sapiens
cagacaagcagccc

SEQ ID NO: 2179655 - DNA, 16 bp, Homo sapiens
cagacaagcagccctt

SEQ ID NO: 2179656 - DNA, 23 bp, Homo sapiens
cagacagcatgactggacagcgg

SEQ ID NO: 2179657 - DNA, 20 bp, Homo sapiens
cagacccctgggagcttccg

SEQ ID NO: 2179658 - DNA, 18 bp, Homo sapiens
cagactcatacagaaggt

SEQ ID NO: 2179659 - DNA, 19 bp, Homo sapiens
cagagactggggcctggac

SEQ ID NO: 2179660 - DNA, 11 bp, Homo sapiens
cagagagaaac

SEQ ID NO: 2179661 - DNA, 17 bp, Homo sapiens
cagagccgttcctggga

SEQ ID NO: 2179662 - DNA, 18 bp, Homo sapiens
cagagccgttcctgggac

SEQ ID NO: 2179663 - DNA, 22 bp, Homo sapiens
cagaggaggggtggtgtccttc

SEQ ID NO: 2179664 - DNA, 21 bp, Homo sapiens
cagaggattctgtcttccagg

SEQ ID NO: 2179665 - DNA, 22 bp, Homo sapiens
cagaggattctgtcttccaggc

SEQ ID NO: 2179666 - DNA, 16 bp, Homo sapiens
cagaggcacagccggg

SEQ ID NO: 2179667 - DNA, 13 bp, Homo sapiens
cagaggcagaacc

SEQ ID NO: 2179668 - DNA, 16 bp, Homo sapiens
cagaggcagtggcagc

SEQ ID NO: 2179669 - DNA, 17 bp, Homo sapiens
cagaggcagtggcagca

SEQ ID NO: 2179670 - DNA, 18 bp, Homo sapiens
cagaggcagtggcagcaa

SEQ ID NO: 2179671 - DNA, 12 bp, Homo sapiens
cagaggccctgg

SEQ ID NO: 2179672 - DNA, 14 bp, Homo sapiens
cagaggccctggag

SEQ ID NO: 2179673 - DNA, 16 bp, Homo sapiens
cagaggctcctggagc

SEQ ID NO: 2179674 - DNA, 18 bp, Homo sapiens
cagaggctcctggagcca

SEQ ID NO: 2179675 - DNA, 19 bp, Homo sapiens
cagaggctcctggagccag

SEQ ID NO: 2179676 - DNA, 16 bp, Homo sapiens
cagagggctgtgtctt

SEQ ID NO: 2179677 - DNA, 14 bp, Homo sapiens
cagaggggagagga

SEQ ID NO: 2179678 - DNA, 18 bp, Homo sapiens
cagaggggagaggaagca

SEQ ID NO: 2179679 - DNA, 23 bp, Homo sapiens
cagaggtgggaggcccctggtgg

SEQ ID NO: 2179680 - DNA, 14 bp, Homo sapiens
cagaggtggggaag

SEQ ID NO: 2179681 - DNA, 23 bp, Homo sapiens
cagaggtggggaagagagcctgc

SEQ ID NO: 2179682 - DNA, 16 bp, Homo sapiens
cagagtagctgggact

SEQ ID NO: 2179683 - DNA, 17 bp, Homo sapiens
cagagtggagccctcag

SEQ ID NO: 2179684 - DNA, 15 bp, Homo sapiens
cagagtgggccccgg

SEQ ID NO: 2179685 - DNA, 16 bp, Homo sapiens
cagatacttgtgaaca

SEQ ID NO: 2179686 - DNA, 17 bp, Homo sapiens
cagatacttgtgaacat

SEQ ID NO: 2179687 - DNA, 15 bp, Homo sapiens
cagatcctgctgccg

SEQ ID NO: 2179688 - DNA, 18 bp, Homo sapiens
cagatgccagagcaaagg

SEQ ID NO: 2179689 - DNA, 21 bp, Homo sapiens
cagatgcctcctctgtcctca

SEQ ID NO: 2179690 - DNA, 13 bp, Homo sapiens
cagatggctgtga

SEQ ID NO: 2179691 - DNA, 14 bp, Homo sapiens
cagatggctgtgaa

SEQ ID NO: 2179692 - DNA, 10 bp, Homo sapiens
cagcaaaagt

SEQ ID NO: 2179693 - DNA, 13 bp, Homo sapiens
cagcaacctgtaa

SEQ ID NO: 2179694 - DNA, 16 bp, Homo sapiens
cagcacatgcactact

SEQ ID NO: 2179695 - DNA, 19 bp, Homo sapiens
cagcacctcctctctgctg

SEQ ID NO: 2179696 - DNA, 18 bp, Homo sapiens
cagcagagccgttcctgg

SEQ ID NO: 2179697 - DNA, 20 bp, Homo sapiens
cagcagagccgttcctggga

SEQ ID NO: 2179698 - DNA, 12 bp, Homo sapiens
ccacaggattcc

SEQ ID NO: 2179699 - DNA, 12 bp, Homo sapiens
ccacagggcctg

SEQ ID NO: 2179700 - DNA, 14 bp, Homo sapiens
ccacagggcctgac

SEQ ID NO: 2179701 - DNA, 16 bp, Homo sapiens
ccacagggcctgactt

SEQ ID NO: 2179702 - DNA, 20 bp, Homo sapiens
ccacagggcctgacttttac

SEQ ID NO: 2179703 - DNA, 19 bp, Homo sapiens
ccacaggtgtccccagccc

SEQ ID NO: 2179704 - DNA, 22 bp, Homo sapiens
ccacaggtgtccccagcccact

SEQ ID NO: 2179705 - DNA, 23 bp, Homo sapiens
ccacatccccgctggctgggggc

SEQ ID NO: 2179706 - DNA, 13 bp, Homo sapiens
ccacatttttcca

SEQ ID NO: 2179707 - DNA, 14 bp, Homo sapiens
ccaccacaaaaaga

SEQ ID NO: 2179708 - DNA, 20 bp, Homo sapiens
ccaccaccccccactctgtg

SEQ ID NO: 2179709 - DNA, 24 bp, Homo sapiens
ccaccaccccccactctgtgcctg

SEQ ID NO: 2179710 - DNA, 21 bp, Homo sapiens
ccaccaccctgccccccctaa

SEQ ID NO: 2179711 - DNA, 12 bp, Homo sapiens
ccacccccacac

SEQ ID NO: 2179712 - DNA, 13 bp, Homo sapiens
ccacccccacacc

SEQ ID NO: 2179713 - DNA, 18 bp, Homo sapiens
ccaccccccactctgtgc

SEQ ID NO: 2179714 - DNA, 13 bp, Homo sapiens
ccaccccttgctc

SEQ ID NO: 2179715 - DNA, 20 bp, Homo sapiens
ccacccgccttggcctccca

SEQ ID NO: 2179716 - DNA, 17 bp, Homo sapiens
ccacccgtttccaagcc

SEQ ID NO: 2179717 - DNA, 18 bp, Homo sapiens
ccacccgtttccaagcct

SEQ ID NO: 2179718 - DNA, 15 bp, Homo sapiens
ccaccctaactgagc

SEQ ID NO: 2179719 - DNA, 16 bp, Homo sapiens
ccaccctaactgagct

SEQ ID NO: 2179720 - DNA, 18 bp, Homo sapiens
ccaccctaactgagctgc

SEQ ID NO: 2179721 - DNA, 14 bp, Homo sapiens
ccaccctctgcagg

SEQ ID NO: 2179722 - DNA, 21 bp, Homo sapiens
ccaccggttgcttctgggaag

SEQ ID NO: 2179723 - DNA, 20 bp, Homo sapiens
ccacctaccttcaaagctga

SEQ ID NO: 2179724 - DNA, 13 bp, Homo sapiens
ccacctccttctc

SEQ ID NO: 2179725 - DNA, 12 bp, Homo sapiens
ccacctgagctt

SEQ ID NO: 2179726 - DNA, 22 bp, Homo sapiens
ccacctgagctttggacgcaca

SEQ ID NO: 2179727 - DNA, 23 bp, Homo sapiens
ccacctgcatcagcctctggcca

SEQ ID NO: 2179728 - DNA, 13 bp, Homo sapiens
ccacctgtcccac

SEQ ID NO: 2179729 - DNA, 15 bp, Homo sapiens
ccacctgtcccacct

SEQ ID NO: 2179730 - DNA, 21 bp, Homo sapiens
ccacgcctcttgaccaggctg

SEQ ID NO: 2179731 - DNA, 14 bp, Homo sapiens
ccacggccactgca

SEQ ID NO: 2179732 - DNA, 22 bp, Homo sapiens
ccacgggggaggccgaggcagg

SEQ ID NO: 2179733 - DNA, 18 bp, Homo sapiens
ccacgtgctggagagtag

SEQ ID NO: 2179734 - DNA, 16 bp, Homo sapiens
ccactaggctgggtgc

SEQ ID NO: 2179735 - DNA, 13 bp, Homo sapiens
ccactatcacata

SEQ ID NO: 2179736 - DNA, 11 bp, Homo sapiens
ccactccttgt

SEQ ID NO: 2179737 - DNA, 11 bp, Homo sapiens
ccactctgtgc

SEQ ID NO: 2179738 - DNA, 17 bp, Homo sapiens
ccactgcagtcacccct

SEQ ID NO: 2179739 - DNA, 22 bp, Homo sapiens
ccactgcagtcacccctgtctg

SEQ ID NO: 2179740 - DNA, 13 bp, Homo sapiens
ccactgccctctg

SEQ ID NO: 2179741 - DNA, 18 bp, Homo sapiens
ccactggggagtgctgga

SEQ ID NO: 2179742 - DNA, 23 bp, Homo sapiens
ccactggtgtaaaaaacaaacat

SEQ ID NO: 2179743 - DNA, 14 bp, Homo sapiens
ccacttatttccat

SEQ ID NO: 2179744 - DNA, 15 bp, Homo sapiens
ccacttatttctaaa

SEQ ID NO: 2179745 - DNA, 15 bp, Homo sapiens
ccactttgcagacct

SEQ ID NO: 2179746 - DNA, 17 bp, Homo sapiens
ccactttgcagacctgg

SEQ ID NO: 2179747 - DNA, 20 bp, Homo sapiens
ccactttgcagacctgggac

SEQ ID NO: 2179748 - DNA, 22 bp, Homo sapiens
ccagaaagttgtgtaggcacca

SEQ ID NO: 2179749 - DNA, 17 bp, Homo sapiens
ccagaccagagctctgg

SEQ ID NO: 2179750 - DNA, 20 bp, Homo sapiens
ccagagctgggtgagtgggg

SEQ ID NO: 2179751 - DNA, 21 bp, Homo sapiens
ccagagctgggtgagtgggga

SEQ ID NO: 2179752 - DNA, 15 bp, Homo sapiens
ccagaggcacagccg

SEQ ID NO: 2179753 - DNA, 14 bp, Homo sapiens
ccagaggccctgga

SEQ ID NO: 2179754 - DNA, 16 bp, Homo sapiens
ccagaggccctggagg

SEQ ID NO: 2179755 - DNA, 18 bp, Homo sapiens
ccagaggtgggaggcccc

SEQ ID NO: 2179756 - DNA, 14 bp, Homo sapiens
ccagaggtggggaa

SEQ ID NO: 2179757 - DNA, 20 bp, Homo sapiens
ccagaggtggggaagagagc

SEQ ID NO: 2179758 - DNA, 21 bp, Homo sapiens
ccagaggtggggaagagagcc

SEQ ID NO: 2179759 - DNA, 19 bp, Homo sapiens
ccagatcggatctgttgca

SEQ ID NO: 2179760 - DNA, 20 bp, Homo sapiens
ccagatgccttctagattca

SEQ ID NO: 2179761 - DNA, 23 bp, Homo sapiens
ccagatgccttctagattcactg

SEQ ID NO: 2179762 - DNA, 19 bp, Homo sapiens
ccagcagagccgttcctgg

SEQ ID NO: 2179763 - DNA, 16 bp, Homo sapiens
ccagcagtttcccaga

SEQ ID NO: 2179764 - DNA, 9 bp, Homo sapiens
ccagccaca

SEQ ID NO: 2179765 - DNA, 16 bp, Homo sapiens
ccagccacagacccct

SEQ ID NO: 2179766 - DNA, 17 bp, Homo sapiens
ccagccacgttggtggt

SEQ ID NO: 2179767 - DNA, 16 bp, Homo sapiens
ccagcccagcccagct

SEQ ID NO: 2179768 - DNA, 19 bp, Homo sapiens
ccagcccatcttgcctcca

SEQ ID NO: 2179769 - DNA, 22 bp, Homo sapiens
ccagcccatcttgcctccatgg

SEQ ID NO: 2179770 - DNA, 10 bp, Homo sapiens
ccagcctttc

SEQ ID NO: 2179771 - DNA, 17 bp, Homo sapiens
ccagctaaagaggtggg

SEQ ID NO: 2179772 - DNA, 13 bp, Homo sapiens
ccagctgaaggca

SEQ ID NO: 2179773 - DNA, 17 bp, Homo sapiens
ccagctgaaggcagtgg

SEQ ID NO: 2179774 - DNA, 18 bp, Homo sapiens
ccagctgaaggcagtggc

SEQ ID NO: 2179775 - DNA, 12 bp, Homo sapiens
ccagctgctctg

SEQ ID NO: 2179776 - DNA, 16 bp, Homo sapiens
ccagctgctctgccca

SEQ ID NO: 2179777 - DNA, 20 bp, Homo sapiens
ccagctggggcccctcggct

SEQ ID NO: 2179778 - DNA, 21 bp, Homo sapiens
ccagctggggcccctcggcta

SEQ ID NO: 2179779 - DNA, 11 bp, Homo sapiens
ccaggaagccg

SEQ ID NO: 2179780 - DNA, 14 bp, Homo sapiens
ccaggaagggtcaa

SEQ ID NO: 2179781 - DNA, 14 bp, Homo sapiens
ccaggacagctgca

SEQ ID NO: 2179782 - DNA, 23 bp, Homo sapiens
ccaggagcatccacctccttctc

SEQ ID NO: 2179783 - DNA, 20 bp, Homo sapiens
ccaggctcgtggactgagtg

SEQ ID NO: 2179784 - DNA, 23 bp, Homo sapiens
ccaggctcgtggactgagtggga

SEQ ID NO: 2179785 - DNA, 22 bp, Homo sapiens
ccagggatggggccacagccag

SEQ ID NO: 2179786 - DNA, 22 bp, Homo sapiens
ccagggcaccaagcccacaggt

SEQ ID NO: 2179787 - DNA, 15 bp, Homo sapiens
ccagggcagcagccg

SEQ ID NO: 2179788 - DNA, 14 bp, Homo sapiens
ccaggggaggagcc

SEQ ID NO: 2179789 - DNA, 16 bp, Homo sapiens
ccaggggaggagcctg

SEQ ID NO: 2179790 - DNA, 12 bp, Homo sapiens
ccaggggcctgc

SEQ ID NO: 2179791 - DNA, 15 bp, Homo sapiens
ccaggggcctgcaga

SEQ ID NO: 2179792 - DNA, 21 bp, Homo sapiens
ccaggggcctgcagaaggaaa

SEQ ID NO: 2179793 - DNA, 19 bp, Homo sapiens
ccagggtcctgtgcctgga

SEQ ID NO: 2179794 - DNA, 21 bp, Homo sapiens
ccaggtcgggctcagctctgg

SEQ ID NO: 2179795 - DNA, 12 bp, Homo sapiens
ccaggtgagctg

SEQ ID NO: 2179796 - DNA, 14 bp, Homo sapiens
ccagtccactgggg

SEQ ID NO: 2179797 - DNA, 12 bp, Homo sapiens
ccagtcctgctc

SEQ ID NO: 2179798 - DNA, 15 bp, Homo sapiens
ccagtggcctggctc

SEQ ID NO: 2179799 - DNA, 12 bp, Homo sapiens
ccagttactgtt

SEQ ID NO: 2179800 - DNA, 13 bp, Homo sapiens
ccagttctctttg

SEQ ID NO: 2179801 - DNA, 13 bp, Homo sapiens
ccagttctgatga

SEQ ID NO: 2179802 - DNA, 18 bp, Homo sapiens
ccagttgcgtgtctgttt

SEQ ID NO: 2179803 - DNA, 18 bp, Homo sapiens
ccataaaatctcacgctg

SEQ ID NO: 2179804 - DNA, 16 bp, Homo sapiens
ccataccttgagacca

SEQ ID NO: 2179805 - DNA, 15 bp, Homo sapiens
ccatagctcctgctc

SEQ ID NO: 2179806 - DNA, 16 bp, Homo sapiens
ccatagtaacaccaag

SEQ ID NO: 2179807 - DNA, 12 bp, Homo sapiens
ccatcagaggcc

SEQ ID NO: 2179808 - DNA, 16 bp, Homo sapiens
ccatcctgtcccacca

SEQ ID NO: 2179809 - DNA, 16 bp, Homo sapiens
ccatcggtcctgtctc

SEQ ID NO: 2179810 - DNA, 18 bp, Homo sapiens
ccatcggtcctgtctccc

SEQ ID NO: 2179811 - DNA, 20 bp, Homo sapiens
ccatcggtcctgtctcccct

SEQ ID NO: 2179812 - DNA, 15 bp, Homo sapiens
ccatctctactaaaa

SEQ ID NO: 2179813 - DNA, 16 bp, Homo sapiens
ccatgcacagaacaag

SEQ ID NO: 2179814 - DNA, 20 bp, Homo sapiens
ccatgctgctttgcacacac

SEQ ID NO: 2179815 - DNA, 21 bp, Homo sapiens
ccatggatgtttcttctttga

SEQ ID NO: 2179816 - DNA, 20 bp, Homo sapiens
ccatggattcccctggacat

SEQ ID NO: 2179817 - DNA, 15 bp, Homo sapiens
ccatgggaccaaacc

SEQ ID NO: 2179818 - DNA, 18 bp, Homo sapiens
ccatggtagactgtgaca

SEQ ID NO: 2179819 - DNA, 14 bp, Homo sapiens
ccatggtcacagag

SEQ ID NO: 2179820 - DNA, 23 bp, Homo sapiens
ccatgttctatttcagtgccaat

SEQ ID NO: 2179821 - DNA, 16 bp, Homo sapiens
cctccctggctcaagc

SEQ ID NO: 2179822 - DNA, 16 bp, Homo sapiens
cctccctttttccttg

SEQ ID NO: 2179823 - DNA, 18 bp, Homo sapiens
cctccctttttccttgtc

SEQ ID NO: 2179824 - DNA, 17 bp, Homo sapiens
cctccggggctcagccc

SEQ ID NO: 2179825 - DNA, 22 bp, Homo sapiens
cctcctccctttttccttgtcc

SEQ ID NO: 2179826 - DNA, 21 bp, Homo sapiens
cctcctctaacaggggctggt

SEQ ID NO: 2179827 - DNA, 15 bp, Homo sapiens
cctcctctgtcctca

SEQ ID NO: 2179828 - DNA, 21 bp, Homo sapiens
cctcctgcccgccctccctcc

SEQ ID NO: 2179829 - DNA, 14 bp, Homo sapiens
cctccttctctgtc

SEQ ID NO: 2179830 - DNA, 21 bp, Homo sapiens
cctccttgccgctgggagagc

SEQ ID NO: 2179831 - DNA, 21 bp, Homo sapiens
cctcctttctcttctctgttc

SEQ ID NO: 2179832 - DNA, 16 bp, Homo sapiens
cctcgaacccacactg

SEQ ID NO: 2179833 - DNA, 14 bp, Homo sapiens
cctcgaactcctgg

SEQ ID NO: 2179834 - DNA, 22 bp, Homo sapiens
cctcgaactcctgggctcaagc

SEQ ID NO: 2179835 - DNA, 13 bp, Homo sapiens
cctcggctacccc

SEQ ID NO: 2179836 - DNA, 17 bp, Homo sapiens
cctctaacaggggctgg

SEQ ID NO: 2179837 - DNA, 21 bp, Homo sapiens
cctctaacaggggctggtggg

SEQ ID NO: 2179838 - DNA, 23 bp, Homo sapiens
cctctaacaggggctggtgggca

SEQ ID NO: 2179839 - DNA, 17 bp, Homo sapiens
cctctatttattagcca

SEQ ID NO: 2179840 - DNA, 18 bp, Homo sapiens
cctctatttattagccaa

SEQ ID NO: 2179841 - DNA, 15 bp, Homo sapiens
cctctcagagctact

SEQ ID NO: 2179842 - DNA, 11 bp, Homo sapiens
cctctcctctg

SEQ ID NO: 2179843 - DNA, 13 bp, Homo sapiens
cctctccttcctc

SEQ ID NO: 2179844 - DNA, 20 bp, Homo sapiens
cctctcgttggtagttgaga

SEQ ID NO: 2179845 - DNA, 13 bp, Homo sapiens
cctctctttgagt

SEQ ID NO: 2179846 - DNA, 21 bp, Homo sapiens
cctctgactcccaaagagctg

SEQ ID NO: 2179847 - DNA, 22 bp, Homo sapiens
cctctgactcccaaagagctgc

SEQ ID NO: 2179848 - DNA, 16 bp, Homo sapiens
cctctgaggctcagcc

SEQ ID NO: 2179849 - DNA, 14 bp, Homo sapiens
cctctgcagggcag

SEQ ID NO: 2179850 - DNA, 19 bp, Homo sapiens
cctctgcagggcagcctgt

SEQ ID NO: 2179851 - DNA, 21 bp, Homo sapiens
cctctgcccccagctgctcct

SEQ ID NO: 2179852 - DNA, 21 bp, Homo sapiens
cctctgctggccgggcacagc

SEQ ID NO: 2179853 - DNA, 22 bp, Homo sapiens
cctctggaggcctctgggcctc

SEQ ID NO: 2179854 - DNA, 17 bp, Homo sapiens
cctctggcccacacaga

SEQ ID NO: 2179855 - DNA, 11 bp, Homo sapiens
cctctggctgc

SEQ ID NO: 2179856 - DNA, 17 bp, Homo sapiens
cctctggctgcctggcc

SEQ ID NO: 2179857 - DNA, 19 bp, Homo sapiens
cctctggctgcctggccca

SEQ ID NO: 2179858 - DNA, 17 bp, Homo sapiens
cctctgggcctcctcta

SEQ ID NO: 2179859 - DNA, 14 bp, Homo sapiens
cctctggggctcag

SEQ ID NO: 2179860 - DNA, 21 bp, Homo sapiens
cctctggggctcagccctgag

SEQ ID NO: 2179861 - DNA, 14 bp, Homo sapiens
cctctgtccccata

SEQ ID NO: 2179862 - DNA, 17 bp, Homo sapiens
cctctgtgctgcatccc

SEQ ID NO: 2179863 - DNA, 13 bp, Homo sapiens
cctcttgggagac

SEQ ID NO: 2179864 - DNA, 14 bp, Homo sapiens
cctcttgggagacg

SEQ ID NO: 2179865 - DNA, 14 bp, Homo sapiens
cctcttttgagact

SEQ ID NO: 2179866 - DNA, 19 bp, Homo sapiens
cctgaaggtgccactccag

SEQ ID NO: 2179867 - DNA, 14 bp, Homo sapiens
cctgaccagctgct

SEQ ID NO: 2179868 - DNA, 21 bp, Homo sapiens
cctgaccttgaggagtcttgt

SEQ ID NO: 2179869 - DNA, 21 bp, Homo sapiens
cctgacttttacagcttttct

SEQ ID NO: 2179870 - DNA, 22 bp, Homo sapiens
cctgacttttacagcttttctc

SEQ ID NO: 2179871 - DNA, 23 bp, Homo sapiens
cctgacttttacagcttttctct

SEQ ID NO: 2179872 - DNA, 20 bp, Homo sapiens
cctgagctggcctcacctgg

SEQ ID NO: 2179873 - DNA, 16 bp, Homo sapiens
cctgagctttggacac

SEQ ID NO: 2179874 - DNA, 18 bp, Homo sapiens
cctgagctttggacacac

SEQ ID NO: 2179875 - DNA, 22 bp, Homo sapiens
cctgagctttggacacacacag

SEQ ID NO: 2179876 - DNA, 23 bp, Homo sapiens
cctgagctttggacgcacacagc

SEQ ID NO: 2179877 - DNA, 14 bp, Homo sapiens
cctgaggcagaacc

SEQ ID NO: 2179878 - DNA, 20 bp, Homo sapiens
cctgaggcagaacctggtgg

SEQ ID NO: 2179879 - DNA, 16 bp, Homo sapiens
cctgaggcccagcaga

SEQ ID NO: 2179880 - DNA, 19 bp, Homo sapiens
cctgatcccactcctagga

SEQ ID NO: 2179881 - DNA, 14 bp, Homo sapiens
cctgattgctctgg

SEQ ID NO: 2179882 - DNA, 16 bp, Homo sapiens
cctgcacacggcacag

SEQ ID NO: 2179883 - DNA, 19 bp, Homo sapiens
cctgcacacggcacagagc

SEQ ID NO: 2179884 - DNA, 16 bp, Homo sapiens
cctgcagggtaggggg

SEQ ID NO: 2179885 - DNA, 21 bp, Homo sapiens
cctgcatcagcctctggccag

SEQ ID NO: 2179886 - DNA, 19 bp, Homo sapiens
cctgcatgtgttgtacaat

SEQ ID NO: 2179887 - DNA, 16 bp, Homo sapiens
cctgcattcgcagcag

SEQ ID NO: 2179888 - DNA, 19 bp, Homo sapiens
cctgccactaggctgggtg

SEQ ID NO: 2179889 - DNA, 13 bp, Homo sapiens
cctgccccatccc

SEQ ID NO: 2179890 - DNA, 19 bp, Homo sapiens
cctgccccccctaagagac

SEQ ID NO: 2179891 - DNA, 13 bp, Homo sapiens
cctgccgcctgtg

SEQ ID NO: 2179892 - DNA, 14 bp, Homo sapiens
cctgccgcctgtgc

SEQ ID NO: 2179893 - DNA, 22 bp, Homo sapiens
cctgccgcctgtgcccttgctg

SEQ ID NO: 2179894 - DNA, 22 bp, Homo sapiens
cctgcctgcgcagctccttccc

SEQ ID NO: 2179895 - DNA, 12 bp, Homo sapiens
cctgccttctgg

SEQ ID NO: 2179896 - DNA, 18 bp, Homo sapiens
cctgcgcagctccttccc

SEQ ID NO: 2179897 - DNA, 13 bp, Homo sapiens
cctgcggctgctg

SEQ ID NO: 2179898 - DNA, 14 bp, Homo sapiens
cctgcggctgctgg

SEQ ID NO: 2179899 - DNA, 15 bp, Homo sapiens
cctgcgtcatggctc

SEQ ID NO: 2179900 - DNA, 16 bp, Homo sapiens
cctgcgtcatggctca

SEQ ID NO: 2179901 - DNA, 19 bp, Homo sapiens
cctgcgtcatggctcaagg

SEQ ID NO: 2179902 - DNA, 23 bp, Homo sapiens
cctgcgtcatggctcaaggattc

SEQ ID NO: 2179903 - DNA, 18 bp, Homo sapiens
cctgctatttcccaagct

SEQ ID NO: 2179904 - DNA, 21 bp, Homo sapiens
cctgctatttcccaagctgga

SEQ ID NO: 2179905 - DNA, 19 bp, Homo sapiens
cctgctccacagccatccc

SEQ ID NO: 2179906 - DNA, 16 bp, Homo sapiens
cctgctctctacccag

SEQ ID NO: 2179907 - DNA, 20 bp, Homo sapiens
cctgctggtacctgccctct

SEQ ID NO: 2179908 - DNA, 22 bp, Homo sapiens
cctgctggtacctgccctctat

SEQ ID NO: 2179909 - DNA, 15 bp, Homo sapiens
cctgctgtgggtcag

SEQ ID NO: 2179910 - DNA, 16 bp, Homo sapiens
cctgctttttgtgttt

SEQ ID NO: 2179911 - DNA, 17 bp, Homo sapiens
cctggaatcgaggctgt

SEQ ID NO: 2179912 - DNA, 15 bp, Homo sapiens
cctggaccaaagctg

SEQ ID NO: 2179913 - DNA, 16 bp, Homo sapiens
cctggagctcctggga

SEQ ID NO: 2179914 - DNA, 14 bp, Homo sapiens
cctggatgggggtg

SEQ ID NO: 2179915 - DNA, 14 bp, Homo sapiens
cctggcacccactc

SEQ ID NO: 2179916 - DNA, 18 bp, Homo sapiens
cctggcacccccacaagc

SEQ ID NO: 2179917 - DNA, 23 bp, Homo sapiens
cctggcacccccacaagctgtcc

SEQ ID NO: 2179918 - DNA, 20 bp, Homo sapiens
cctggcaccgttatccctgc

SEQ ID NO: 2179919 - DNA, 14 bp, Homo sapiens
cctggccatctctg

SEQ ID NO: 2179920 - DNA, 13 bp, Homo sapiens
cctggcgtggggg

SEQ ID NO: 2179921 - DNA, 23 bp, Homo sapiens
cctggcgtggggggagctctggt

SEQ ID NO: 2179922 - DNA, 18 bp, Homo sapiens
cctggctccgctgtgtgg

SEQ ID NO: 2179923 - DNA, 19 bp, Homo sapiens
cctggctccgctgtgtgga

SEQ ID NO: 2179924 - DNA, 21 bp, Homo sapiens
cctggctggggacttggccgc

SEQ ID NO: 2179925 - DNA, 19 bp, Homo sapiens
cctggctggtgggaaggcc

SEQ ID NO: 2179926 - DNA, 20 bp, Homo sapiens
cctgggaaccttcctgtctt

SEQ ID NO: 2179927 - DNA, 21 bp, Homo sapiens
cctgggaaggctactcacctt

SEQ ID NO: 2179928 - DNA, 22 bp, Homo sapiens
cctgggaaggctactcaccttg

SEQ ID NO: 2179929 - DNA, 16 bp, Homo sapiens
cctgggccactggcat

SEQ ID NO: 2179930 - DNA, 22 bp, Homo sapiens
cctgggctcaagcaatcctcct

SEQ ID NO: 2179931 - DNA, 16 bp, Homo sapiens
cctggggtgccctcca

SEQ ID NO: 2179932 - DNA, 22 bp, Homo sapiens
cctggggtgccctccactgccc

SEQ ID NO: 2179933 - DNA, 18 bp, Homo sapiens
cctggggtggggaggcag

SEQ ID NO: 2179934 - DNA, 12 bp, Homo sapiens
cctggtctcctc

SEQ ID NO: 2179935 - DNA, 23 bp, Homo sapiens
cctggtgaggaagctccagtcct

SEQ ID NO: 2179936 - DNA, 17 bp, Homo sapiens
cctggtggcatggaaga

SEQ ID NO: 2179937 - DNA, 16 bp, Homo sapiens
cctggtggctggaggc

SEQ ID NO: 2179938 - DNA, 19 bp, Homo sapiens
cctgtccctggccatctct

SEQ ID NO: 2179939 - DNA, 21 bp, Homo sapiens
cctgtctaggtcagtacccac

SEQ ID NO: 2179940 - DNA, 13 bp, Homo sapiens
cctgtctcccctc

SEQ ID NO: 2179941 - DNA, 18 bp, Homo sapiens
cctgtctcccctctgctg

SEQ ID NO: 2179942 - DNA, 14 bp, Homo sapiens
ctcattctctttct

SEQ ID NO: 2179943 - DNA, 22 bp, Homo sapiens
ctcatttatttccatattaaaa

SEQ ID NO: 2179944 - DNA, 12 bp, Homo sapiens
ctcattttgtat

SEQ ID NO: 2179945 - DNA, 18 bp, Homo sapiens
ctcattttgtatgtatgt

SEQ ID NO: 2179946 - DNA, 20 bp, Homo sapiens
ctcattttgtatgtatgtgt

SEQ ID NO: 2179947 - DNA, 16 bp, Homo sapiens
ctccacagccatccca

SEQ ID NO: 2179948 - DNA, 23 bp, Homo sapiens
ctccacagggacacagtctggtg

SEQ ID NO: 2179949 - DNA, 14 bp, Homo sapiens
ctccactgccctct

SEQ ID NO: 2179950 - DNA, 18 bp, Homo sapiens
ctccagccacttatttcc

SEQ ID NO: 2179951 - DNA, 18 bp, Homo sapiens
ctccaggaaggggctgga

SEQ ID NO: 2179952 - DNA, 14 bp, Homo sapiens
ctccaggggcctgc

SEQ ID NO: 2179953 - DNA, 22 bp, Homo sapiens
ctccaggggcctgcagaaggaa

SEQ ID NO: 2179954 - DNA, 16 bp, Homo sapiens
ctccagtcctgctctc

SEQ ID NO: 2179955 - DNA, 20 bp, Homo sapiens
ctccagtcctgctctctacc

SEQ ID NO: 2179956 - DNA, 23 bp, Homo sapiens
ctccagtcctgctctctacccag

SEQ ID NO: 2179957 - DNA, 12 bp, Homo sapiens
ctccatggtgcc

SEQ ID NO: 2179958 - DNA, 15 bp, Homo sapiens
ctccatggtgcctct

SEQ ID NO: 2179959 - DNA, 14 bp, Homo sapiens
ctcccaaagagctg

SEQ ID NO: 2179960 - DNA, 22 bp, Homo sapiens
ctcccaaagtgctgggattaca

SEQ ID NO: 2179961 - DNA, 19 bp, Homo sapiens
ctcccagaggctcctggag

SEQ ID NO: 2179962 - DNA, 20 bp, Homo sapiens
ctcccagaggctcctggagc

SEQ ID NO: 2179963 - DNA, 23 bp, Homo sapiens
ctccccaactccttcctctttgc

SEQ ID NO: 2179964 - DNA, 21 bp, Homo sapiens
ctccccagggttcagtcctca

SEQ ID NO: 2179965 - DNA, 14 bp, Homo sapiens
ctcccccattttaa

SEQ ID NO: 2179966 - DNA, 16 bp, Homo sapiens
ctcccctcctctcccc

SEQ ID NO: 2179967 - DNA, 16 bp, Homo sapiens
ctcccctcctttccca

SEQ ID NO: 2179968 - DNA, 15 bp, Homo sapiens
ctcccctctgctggc

SEQ ID NO: 2179969 - DNA, 16 bp, Homo sapiens
ctcccctctgctggcc

SEQ ID NO: 2179970 - DNA, 12 bp, Homo sapiens
ctcccctgccct

SEQ ID NO: 2179971 - DNA, 22 bp, Homo sapiens
ctcccgagtagttgggattaca

SEQ ID NO: 2179972 - DNA, 14 bp, Homo sapiens
ctcccgcagagact

SEQ ID NO: 2179973 - DNA, 20 bp, Homo sapiens
ctcccgcagagactggggcc

SEQ ID NO: 2179974 - DNA, 15 bp, Homo sapiens
ctcccgtcttcctcc

SEQ ID NO: 2179975 - DNA, 20 bp, Homo sapiens
ctccctaagtaatcccagaa

SEQ ID NO: 2179976 - DNA, 19 bp, Homo sapiens
ctccctacttccaagaaaa

SEQ ID NO: 2179977 - DNA, 19 bp, Homo sapiens
ctccctatgttgcccaggc

SEQ ID NO: 2179978 - DNA, 13 bp, Homo sapiens
ctccctcccctgc

SEQ ID NO: 2179979 - DNA, 18 bp, Homo sapiens
ctccctcccctgccctcg

SEQ ID NO: 2179980 - DNA, 14 bp, Homo sapiens
ctccctccctgcag

SEQ ID NO: 2179981 - DNA, 13 bp, Homo sapiens
ctccctcctgcct

SEQ ID NO: 2179982 - DNA, 18 bp, Homo sapiens
ctccctcgaacccacact

SEQ ID NO: 2179983 - DNA, 14 bp, Homo sapiens
ctccctctcctctg

SEQ ID NO: 2179984 - DNA, 14 bp, Homo sapiens
ctccctgctcagct

SEQ ID NO: 2179985 - DNA, 23 bp, Homo sapiens
ctccctgctcagctggccgggtt

SEQ ID NO: 2179986 - DNA, 15 bp, Homo sapiens
ctccctggctcaagc

SEQ ID NO: 2179987 - DNA, 12 bp, Homo sapiens
ctccctttgtgg

SEQ ID NO: 2179988 - DNA, 18 bp, Homo sapiens
ctccctttttccttgtcc

SEQ ID NO: 2179989 - DNA, 22 bp, Homo sapiens
ctccctttttccttgtccccac

SEQ ID NO: 2179990 - DNA, 15 bp, Homo sapiens
ctccgaggacccagg

SEQ ID NO: 2179991 - DNA, 15 bp, Homo sapiens
ctccggggctcagcc

SEQ ID NO: 2179992 - DNA, 22 bp, Homo sapiens
ctcctaggacatgttcccttct

SEQ ID NO: 2179993 - DNA, 14 bp, Homo sapiens
ctcctcccctggca

SEQ ID NO: 2179994 - DNA, 17 bp, Homo sapiens
ctcctctcccctaccac

SEQ ID NO: 2179995 - DNA, 18 bp, Homo sapiens
ctcctctcccctaccact

SEQ ID NO: 2179996 - DNA, 14 bp, Homo sapiens
ctcctctctgctgg

SEQ ID NO: 2179997 - DNA, 16 bp, Homo sapiens
ctcctctctgctgggt

SEQ ID NO: 2179998 - DNA, 23 bp, Homo sapiens
ctcctgagggtcctgctggtgac

SEQ ID NO: 2179999 - DNA, 15 bp, Homo sapiens
ctcctgattgctctg

SEQ ID NO: 2180000 - DNA, 23 bp, Homo sapiens
ctcctgattgctctggaagcctg

SEQ ID NO: 2180001 - DNA, 13 bp, Homo sapiens
ctcctgcatgcag

SEQ ID NO: 2180002 - DNA, 21 bp, Homo sapiens
ctcctgcccgccctccctcct

SEQ ID NO: 2180003 - DNA, 13 bp, Homo sapiens
ctcctgcctcagc

SEQ ID NO: 2180004 - DNA, 14 bp, Homo sapiens
ctcctgcctcagcc

SEQ ID NO: 2180005 - DNA, 20 bp, Homo sapiens
ctcctgctggtacctgccct

SEQ ID NO: 2180006 - DNA, 22 bp, Homo sapiens
ctcctgctggtacctgccctct

SEQ ID NO: 2180007 - DNA, 19 bp, Homo sapiens
ctcctggcacccagagaaa

SEQ ID NO: 2180008 - DNA, 19 bp, Homo sapiens
ctcctgtcttggcctccca

SEQ ID NO: 2180009 - DNA, 15 bp, Homo sapiens
ctccttccaactgct

SEQ ID NO: 2180010 - DNA, 19 bp, Homo sapiens
ctccttccaactgctgccc

SEQ ID NO: 2180011 - DNA, 17 bp, Homo sapiens
ctccttccctggtccag

SEQ ID NO: 2180012 - DNA, 20 bp, Homo sapiens
ctccttcctctttgcttggg

SEQ ID NO: 2180013 - DNA, 20 bp, Homo sapiens
ctccttctctgtctcatgtg

SEQ ID NO: 2180014 - DNA, 21 bp, Homo sapiens
ctccttctctgtctcatgtgt

SEQ ID NO: 2180015 - DNA, 16 bp, Homo sapiens
ctccttgccgctggga

SEQ ID NO: 2180016 - DNA, 20 bp, Homo sapiens
ctccttgccgctgggagagc

SEQ ID NO: 2180017 - DNA, 15 bp, Homo sapiens
ctcgaacccacactg

SEQ ID NO: 2180018 - DNA, 18 bp, Homo sapiens
ctcgaacccacactgcaa

SEQ ID NO: 2180019 - DNA, 17 bp, Homo sapiens
ctcgaactcctgggctc

SEQ ID NO: 2180020 - DNA, 15 bp, Homo sapiens
ctcgaagtcttccat

SEQ ID NO: 2180021 - DNA, 13 bp, Homo sapiens
ctcggctgtggag

SEQ ID NO: 2180022 - DNA, 14 bp, Homo sapiens
ctcgtgaggggcaa

SEQ ID NO: 2180023 - DNA, 15 bp, Homo sapiens
ctcgtgaggggcaag

SEQ ID NO: 2180024 - DNA, 13 bp, Homo sapiens
ctcgtgggctctg

SEQ ID NO: 2180025 - DNA, 16 bp, Homo sapiens
ctcgtgggctctggct

SEQ ID NO: 2180026 - DNA, 20 bp, Homo sapiens
ctcgttaacacatggcttcc

SEQ ID NO: 2180027 - DNA, 14 bp, Homo sapiens
ctctaacaggggct

SEQ ID NO: 2180028 - DNA, 18 bp, Homo sapiens
ctctaatgctcacgctcc

SEQ ID NO: 2180029 - DNA, 19 bp, Homo sapiens
ctctacccagcccatcttg

SEQ ID NO: 2180030 - DNA, 20 bp, Homo sapiens
ctctacccagcccatcttgc

SEQ ID NO: 2180031 - DNA, 22 bp, Homo sapiens
ctctactggtaggaagaggtac

SEQ ID NO: 2180032 - DNA, 22 bp, Homo sapiens
ctctagggaaggccacctgcag

SEQ ID NO: 2180033 - DNA, 23 bp, Homo sapiens
ctctagggaaggccacctgcagg

SEQ ID NO: 2180034 - DNA, 14 bp, Homo sapiens
ctctagggacccct

SEQ ID NO: 2180035 - DNA, 19 bp, Homo sapiens
ctctagggacccctcctcc

SEQ ID NO: 2180036 - DNA, 17 bp, Homo sapiens
ctctagttccctcagtg

SEQ ID NO: 2180037 - DNA, 22 bp, Homo sapiens
ctctagttccctcagtgtgaag

SEQ ID NO: 2180038 - DNA, 14 bp, Homo sapiens
ctctatatgtaata

SEQ ID NO: 2180039 - DNA, 22 bp, Homo sapiens
ctctatgggcagatctacccct

SEQ ID NO: 2180040 - DNA, 12 bp, Homo sapiens
ctctattctgta

SEQ ID NO: 2180041 - DNA, 19 bp, Homo sapiens
ctctatttattagccaact

SEQ ID NO: 2180042 - DNA, 17 bp, Homo sapiens
ctctcaacccaggagca

SEQ ID NO: 2180043 - DNA, 20 bp, Homo sapiens
ctctcagagctacttgggcc

SEQ ID NO: 2180044 - DNA, 21 bp, Homo sapiens
ctctcagagctacttgggcca

SEQ ID NO: 2180045 - DNA, 22 bp, Homo sapiens
ctctcagagctacttgggccat

SEQ ID NO: 2180046 - DNA, 15 bp, Homo sapiens
ctctcaggtgaccaa

SEQ ID NO: 2180047 - DNA, 13 bp, Homo sapiens
ctctcagttattc

SEQ ID NO: 2180048 - DNA, 14 bp, Homo sapiens
ctctcagttattca

SEQ ID NO: 2180049 - DNA, 20 bp, Homo sapiens
ctctcagttattcagattga

SEQ ID NO: 2180050 - DNA, 16 bp, Homo sapiens
ctctcattctctttct

SEQ ID NO: 2180051 - DNA, 22 bp, Homo sapiens
ctctcccagaggctcctggagc

SEQ ID NO: 2180052 - DNA, 14 bp, Homo sapiens
ctctcctctgtccc

SEQ ID NO: 2180053 - DNA, 18 bp, Homo sapiens
ctctccttttccttacca

SEQ ID NO: 2180054 - DNA, 13 bp, Homo sapiens
ctctctacccagc

SEQ ID NO: 2180055 - DNA, 22 bp, Homo sapiens
ctctctacccagcccatcttgc

SEQ ID NO: 2180056 - DNA, 11 bp, Homo sapiens
ctctctgctgg

SEQ ID NO: 2180057 - DNA, 9 bp, Homo sapiens
ctctcttca

SEQ ID NO: 2180058 - DNA, 16 bp, Homo sapiens
ctctcttcaatctctg

SEQ ID NO: 2180059 - DNA, 13 bp, Homo sapiens
ctctgaactgcac

SEQ ID NO: 2180060 - DNA, 18 bp, Homo sapiens
ctctgactcccaaagagc

SEQ ID NO: 2180061 - DNA, 22 bp, Homo sapiens
ctctgactcccaaagagctgcc

SEQ ID NO: 2180062 - DNA, 23 bp, Homo sapiens
ctctgagaaggggaggacctctg

SEQ ID NO: 2180063 - DNA, 16 bp, Homo sapiens
ctctgagccactggag

SEQ ID NO: 2180064 - DNA, 23 bp, Homo sapiens
ctgtgcccagcagtttcccagaa

SEQ ID NO: 2180065 - DNA, 15 bp, Homo sapiens
ctgtgcccagctcag

SEQ ID NO: 2180066 - DNA, 18 bp, Homo sapiens
ctgtgccccatcagcagc

SEQ ID NO: 2180067 - DNA, 15 bp, Homo sapiens
ctgtgcccttgctgg

SEQ ID NO: 2180068 - DNA, 20 bp, Homo sapiens
ctgtgcccttgctgggtcca

SEQ ID NO: 2180069 - DNA, 17 bp, Homo sapiens
ctgtgcctgaccttgag

SEQ ID NO: 2180070 - DNA, 13 bp, Homo sapiens
ctgtgctggagcc

SEQ ID NO: 2180071 - DNA, 14 bp, Homo sapiens
ctgtgctggagcca

SEQ ID NO: 2180072 - DNA, 15 bp, Homo sapiens
ctgtgctggagccac

SEQ ID NO: 2180073 - DNA, 19 bp, Homo sapiens
ctgtgctggttgccacatc

SEQ ID NO: 2180074 - DNA, 13 bp, Homo sapiens
ctgtggaggtggc

SEQ ID NO: 2180075 - DNA, 22 bp, Homo sapiens
ctgtggattttgtggcttcaat

SEQ ID NO: 2180076 - DNA, 15 bp, Homo sapiens
ctgtggccagttgac

SEQ ID NO: 2180077 - DNA, 16 bp, Homo sapiens
ctgtgtattaaacctt

SEQ ID NO: 2180078 - DNA, 17 bp, Homo sapiens
ctgtgtattaaaccttt

SEQ ID NO: 2180079 - DNA, 20 bp, Homo sapiens
ctgtgtcacgcaggctgagt

SEQ ID NO: 2180080 - DNA, 13 bp, Homo sapiens
ctgtgtgctgtgg

SEQ ID NO: 2180081 - DNA, 13 bp, Homo sapiens
ctgtgtgtggaaa

SEQ ID NO: 2180082 - DNA, 20 bp, Homo sapiens
ctgttcctttttaggtacag

SEQ ID NO: 2180083 - DNA, 14 bp, Homo sapiens
ctgttctgctccca

SEQ ID NO: 2180084 - DNA, 13 bp, Homo sapiens
ctgttctggacat

SEQ ID NO: 2180085 - DNA, 20 bp, Homo sapiens
ctgttcttgggcctcaggct

SEQ ID NO: 2180086 - DNA, 16 bp, Homo sapiens
ctgttgtacacttggg

SEQ ID NO: 2180087 - DNA, 22 bp, Homo sapiens
ctgttgtctaaaataggttttc

SEQ ID NO: 2180088 - DNA, 23 bp, Homo sapiens
ctgttgtctgccgtgagagccca

SEQ ID NO: 2180089 - DNA, 15 bp, Homo sapiens
ctgtttccctgctga

SEQ ID NO: 2180090 - DNA, 12 bp, Homo sapiens
ctgtttgacaaa

SEQ ID NO: 2180091 - DNA, 15 bp, Homo sapiens
ctgtttgacaaacct

SEQ ID NO: 2180092 - DNA, 17 bp, Homo sapiens
ctgtttgtcttctcccc

SEQ ID NO: 2180093 - DNA, 18 bp, Homo sapiens
ctgtttgtcttctcccca

SEQ ID NO: 2180094 - DNA, 16 bp, Homo sapiens
ctgttttagtgccagg

SEQ ID NO: 2180095 - DNA, 19 bp, Homo sapiens
ctgttttattgagttctga

SEQ ID NO: 2180096 - DNA, 20 bp, Homo sapiens
ctgttttattgagttctgaa

SEQ ID NO: 2180097 - DNA, 15 bp, Homo sapiens
ctgttttgttggccc

SEQ ID NO: 2180098 - DNA, 12 bp, Homo sapiens
cttaaaaatatg

SEQ ID NO: 2180099 - DNA, 13 bp, Homo sapiens
cttaaaaatatgt

SEQ ID NO: 2180100 - DNA, 15 bp, Homo sapiens
cttaaaaatatgtga

SEQ ID NO: 2180101 - DNA, 13 bp, Homo sapiens
cttaaaaattaga

SEQ ID NO: 2180102 - DNA, 18 bp, Homo sapiens
cttaaagatctcaacatg

SEQ ID NO: 2180103 - DNA, 17 bp, Homo sapiens
cttaacagttgtattta

SEQ ID NO: 2180104 - DNA, 15 bp, Homo sapiens
cttaacctgcttttg

SEQ ID NO: 2180105 - DNA, 14 bp, Homo sapiens
cttaagacaaatgg

SEQ ID NO: 2180106 - DNA, 17 bp, Homo sapiens
cttaagacaaatgggac

SEQ ID NO: 2180107 - DNA, 18 bp, Homo sapiens
cttaagacaaatgggact

SEQ ID NO: 2180108 - DNA, 23 bp, Homo sapiens
cttaagacaaatgggactgatgt

SEQ ID NO: 2180109 - DNA, 16 bp, Homo sapiens
cttaagtataaacctt

SEQ ID NO: 2180110 - DNA, 16 bp, Homo sapiens
cttaagtttagaaatt

SEQ ID NO: 2180111 - DNA, 21 bp, Homo sapiens
cttaagtttagaaattacaag

SEQ ID NO: 2180112 - DNA, 23 bp, Homo sapiens
cttacaaggcaggcctttcctac

SEQ ID NO: 2180113 - DNA, 15 bp, Homo sapiens
cttacccttagggag

SEQ ID NO: 2180114 - DNA, 18 bp, Homo sapiens
cttacccttctgtgccca

SEQ ID NO: 2180115 - DNA, 18 bp, Homo sapiens
cttacctcccacctttgg

SEQ ID NO: 2180116 - DNA, 13 bp, Homo sapiens
cttagcccccacc

SEQ ID NO: 2180117 - DNA, 16 bp, Homo sapiens
cttagcttacaggaag

SEQ ID NO: 2180118 - DNA, 23 bp, Homo sapiens
cttaggtgaaggcagaagtgatg

SEQ ID NO: 2180119 - DNA, 16 bp, Homo sapiens
cttagtcctccctgct

SEQ ID NO: 2180120 - DNA, 17 bp, Homo sapiens
cttagtcctccctgctc

SEQ ID NO: 2180121 - DNA, 14 bp, Homo sapiens
cttagttctgtata

SEQ ID NO: 2180122 - DNA, 14 bp, Homo sapiens
cttataattgttct

SEQ ID NO: 2180123 - DNA, 21 bp, Homo sapiens
cttataattgttctcagaatc

SEQ ID NO: 2180124 - DNA, 22 bp, Homo sapiens
cttatatctggcctctgctttc

SEQ ID NO: 2180125 - DNA, 18 bp, Homo sapiens
cttatcctacagtacaat

SEQ ID NO: 2180126 - DNA, 20 bp, Homo sapiens
cttatcctacagtacaatca

SEQ ID NO: 2180127 - DNA, 17 bp, Homo sapiens
cttatctctaaaccatc

SEQ ID NO: 2180128 - DNA, 15 bp, Homo sapiens
cttatgaactacagt

SEQ ID NO: 2180129 - DNA, 15 bp, Homo sapiens
cttatgtaattattt

SEQ ID NO: 2180130 - DNA, 15 bp, Homo sapiens
cttattcaaagatga

SEQ ID NO: 2180131 - DNA, 11 bp, Homo sapiens
cttcaaagctg

SEQ ID NO: 2180132 - DNA, 17 bp, Homo sapiens
cttcaaagcttttgtaa

SEQ ID NO: 2180133 - DNA, 17 bp, Homo sapiens
cttcaagaccttcacca

SEQ ID NO: 2180134 - DNA, 19 bp, Homo sapiens
cttcaagacgaggggcagg

SEQ ID NO: 2180135 - DNA, 18 bp, Homo sapiens
cttcaagcaccagggaag

SEQ ID NO: 2180136 - DNA, 20 bp, Homo sapiens
cttcaaggatatactgcagc

SEQ ID NO: 2180137 - DNA, 14 bp, Homo sapiens
cttcaagtctgtgc

SEQ ID NO: 2180138 - DNA, 22 bp, Homo sapiens
cttcaagtctgtgcctggagct

SEQ ID NO: 2180139 - DNA, 16 bp, Homo sapiens
cttcaatctacgatgt

SEQ ID NO: 2180140 - DNA, 13 bp, Homo sapiens
cttcaatctctgt

SEQ ID NO: 2180141 - DNA, 21 bp, Homo sapiens
cttcacactatcaacactgca

SEQ ID NO: 2180142 - DNA, 17 bp, Homo sapiens
cttcaccatcttggcca

SEQ ID NO: 2180143 - DNA, 14 bp, Homo sapiens
cttcacccatgaaa

SEQ ID NO: 2180144 - DNA, 22 bp, Homo sapiens
cttcagatacttgtgaacatgc

SEQ ID NO: 2180145 - DNA, 17 bp, Homo sapiens
cttcagatattttgcac

SEQ ID NO: 2180146 - DNA, 14 bp, Homo sapiens
cttcagatcctgct

SEQ ID NO: 2180147 - DNA, 15 bp, Homo sapiens
cttcagatcctgctg

SEQ ID NO: 2180148 - DNA, 16 bp, Homo sapiens
cttcagatcctgctgc

SEQ ID NO: 2180149 - DNA, 14 bp, Homo sapiens
cttcagctttgtgt

SEQ ID NO: 2180150 - DNA, 16 bp, Homo sapiens
cttcagtcatggcatt

SEQ ID NO: 2180151 - DNA, 18 bp, Homo sapiens
cttcagtgactcctgctg

SEQ ID NO: 2180152 - DNA, 16 bp, Homo sapiens
cttcatattaatataa

SEQ ID NO: 2180153 - DNA, 22 bp, Homo sapiens
cttcatattaatataagtttct

SEQ ID NO: 2180154 - DNA, 20 bp, Homo sapiens
cttcatccttagcaacagcc

SEQ ID NO: 2180155 - DNA, 17 bp, Homo sapiens
cttccaactgctgcccc

SEQ ID NO: 2180156 - DNA, 14 bp, Homo sapiens
cttccacaccccca

SEQ ID NO: 2180157 - DNA, 20 bp, Homo sapiens
cttccaggccatcagaggcc

SEQ ID NO: 2180158 - DNA, 14 bp, Homo sapiens
cttccatcagcagt

SEQ ID NO: 2180159 - DNA, 17 bp, Homo sapiens
cttccatcagcagtgat

SEQ ID NO: 2180160 - DNA, 20 bp, Homo sapiens
cttccatttggaatcatatg

SEQ ID NO: 2180161 - DNA, 21 bp, Homo sapiens
cttcccacggccactgcagtc

SEQ ID NO: 2180162 - DNA, 13 bp, Homo sapiens
cttccccctccat

SEQ ID NO: 2180163 - DNA, 20 bp, Homo sapiens
cttccccctcttcttctgaa

SEQ ID NO: 2180164 - DNA, 16 bp, Homo sapiens
cttccctagggctggg

SEQ ID NO: 2180165 - DNA, 16 bp, Homo sapiens
cttccctcatgttctc

SEQ ID NO: 2180166 - DNA, 14 bp, Homo sapiens
cttccctctgctcc

SEQ ID NO: 2180167 - DNA, 21 bp, Homo sapiens
cttcccttatttttatttatt

SEQ ID NO: 2180168 - DNA, 22 bp, Homo sapiens
cttccctttgattttttgctgc

SEQ ID NO: 2180169 - DNA, 21 bp, Homo sapiens
cttccgctttgaaagaagcaa

SEQ ID NO: 2180170 - DNA, 18 bp, Homo sapiens
cttcctccatggcccatc

SEQ ID NO: 2180171 - DNA, 20 bp, Homo sapiens
cttcctccctccctgcaggg

SEQ ID NO: 2180172 - DNA, 21 bp, Homo sapiens
cttcctccctccctgcagggt

SEQ ID NO: 2180173 - DNA, 15 bp, Homo sapiens
cttcctcctcccctg

SEQ ID NO: 2180174 - DNA, 14 bp, Homo sapiens
cttcctctttgctt

SEQ ID NO: 2180175 - DNA, 15 bp, Homo sapiens
cttcctgtccgccct

SEQ ID NO: 2180176 - DNA, 16 bp, Homo sapiens
cttcctgtctggccca

SEQ ID NO: 2180177 - DNA, 16 bp, Homo sapiens
cttcctgtttctaagt

SEQ ID NO: 2180178 - DNA, 16 bp, Homo sapiens
cttcggaggaggtgga

SEQ ID NO: 2180179 - DNA, 21 bp, Homo sapiens
cttcggcattggttccctttg

SEQ ID NO: 2180180 - DNA, 16 bp, Homo sapiens
cttcgtggatgacctc

SEQ ID NO: 2180181 - DNA, 22 bp, Homo sapiens
cttcgtgggatctgcccctccc

SEQ ID NO: 2180182 - DNA, 23 bp, Homo sapiens
cttcgttggtgaccagtttctta

SEQ ID NO: 2180183 - DNA, 17 bp, Homo sapiens
cttctaaagaggaagcc

SEQ ID NO: 2180184 - DNA, 20 bp, Homo sapiens
cttctaatccatgtgctgct

SEQ ID NO: 2180185 - DNA, 21 bp, Homo sapiens
cttctagtgatttctggggcc

SEQ ID NO: 2180186 - DNA, 19 bp, Homo sapiens
gaggccgaggcaggggctg

SEQ ID NO: 2180187 - DNA, 11 bp, Homo sapiens
gaggctcctgg

SEQ ID NO: 2180188 - DNA, 15 bp, Homo sapiens
gaggctcctggagcc

SEQ ID NO: 2180189 - DNA, 16 bp, Homo sapiens
gaggctcctggagcca

SEQ ID NO: 2180190 - DNA, 22 bp, Homo sapiens
gaggctcctggagccagccacc

SEQ ID NO: 2180191 - DNA, 15 bp, Homo sapiens
gaggctggcctcaga

SEQ ID NO: 2180192 - DNA, 15 bp, Homo sapiens
gaggctgggccaagc

SEQ ID NO: 2180193 - DNA, 15 bp, Homo sapiens
gagggagaaggagag

SEQ ID NO: 2180194 - DNA, 14 bp, Homo sapiens
gagggatgcagtgc

SEQ ID NO: 2180195 - DNA, 12 bp, Homo sapiens
gagggcaaagct

SEQ ID NO: 2180196 - DNA, 13 bp, Homo sapiens
gagggcaaagctg

SEQ ID NO: 2180197 - DNA, 14 bp, Homo sapiens
gagggcaaagctga

SEQ ID NO: 2180198 - DNA, 13 bp, Homo sapiens
gaggggatccagc

SEQ ID NO: 2180199 - DNA, 15 bp, Homo sapiens
gaggggatccagcca

SEQ ID NO: 2180200 - DNA, 17 bp, Homo sapiens
gaggggcaagctaggcc

SEQ ID NO: 2180201 - DNA, 23 bp, Homo sapiens
gaggggcaagctaggccccagag

SEQ ID NO: 2180202 - DNA, 13 bp, Homo sapiens
gaggtctccaggg

SEQ ID NO: 2180203 - DNA, 23 bp, Homo sapiens
gaggtggggaagagagcctgccc

SEQ ID NO: 2180204 - DNA, 18 bp, Homo sapiens
gaggttattttccgccag

SEQ ID NO: 2180205 - DNA, 21 bp, Homo sapiens
gagtaagcacctttagaatat

SEQ ID NO: 2180206 - DNA, 13 bp, Homo sapiens
gagtagcaccttc

SEQ ID NO: 2180207 - DNA, 22 bp, Homo sapiens
gagtatgagtgcaagcaaagca

SEQ ID NO: 2180208 - DNA, 16 bp, Homo sapiens
gagtcacttgaaactt

SEQ ID NO: 2180209 - DNA, 22 bp, Homo sapiens
gagtcatgagtttatgagctga

SEQ ID NO: 2180210 - DNA, 20 bp, Homo sapiens
gagtcattttcacttttaaa

SEQ ID NO: 2180211 - DNA, 15 bp, Homo sapiens
gagtcctgaggcaga

SEQ ID NO: 2180212 - DNA, 19 bp, Homo sapiens
gagtgccccacctgccact

SEQ ID NO: 2180213 - DNA, 22 bp, Homo sapiens
gagtgctggaatggggacctgg

SEQ ID NO: 2180214 - DNA, 23 bp, Homo sapiens
gagtgctggaatggggacctggg

SEQ ID NO: 2180215 - DNA, 12 bp, Homo sapiens
gagtggaggcat

SEQ ID NO: 2180216 - DNA, 13 bp, Homo sapiens
gagtggaggcatt

SEQ ID NO: 2180217 - DNA, 19 bp, Homo sapiens
gagtggccatctggaaatc

SEQ ID NO: 2180218 - DNA, 15 bp, Homo sapiens
gagtgggagaggaag

SEQ ID NO: 2180219 - DNA, 16 bp, Homo sapiens
gagtgggagaggaagc

SEQ ID NO: 2180220 - DNA, 19 bp, Homo sapiens
gagtgggccccgggctgga

SEQ ID NO: 2180221 - DNA, 20 bp, Homo sapiens
gagtgggccccgggctggag

SEQ ID NO: 2180222 - DNA, 22 bp, Homo sapiens
gagtgtgtgggggtctgggagg

SEQ ID NO: 2180223 - DNA, 20 bp, Homo sapiens
gagttctgatgtcttagtga

SEQ ID NO: 2180224 - DNA, 20 bp, Homo sapiens
gagttgagtattacacatta

SEQ ID NO: 2180225 - DNA, 22 bp, Homo sapiens
gataataaaattcattccattt

SEQ ID NO: 2180226 - DNA, 14 bp, Homo sapiens
gatagatgccctgc

SEQ ID NO: 2180227 - DNA, 23 bp, Homo sapiens
gatagcatatattcatacctgtt

SEQ ID NO: 2180228 - DNA, 16 bp, Homo sapiens
gatagcttgggattta

SEQ ID NO: 2180229 - DNA, 19 bp, Homo sapiens
gatagtagatctgtggcga

SEQ ID NO: 2180230 - DNA, 16 bp, Homo sapiens
gatagttggttctttt

SEQ ID NO: 2180231 - DNA, 16 bp, Homo sapiens
gatatatttataaata

SEQ ID NO: 2180232 - DNA, 20 bp, Homo sapiens
gatatctgtttgcttctaaa

SEQ ID NO: 2180233 - DNA, 14 bp, Homo sapiens
gatatgagagggat

SEQ ID NO: 2180234 - DNA, 21 bp, Homo sapiens
gatatgagagggatgcagtgc

SEQ ID NO: 2180235 - DNA, 16 bp, Homo sapiens
gatattaaaaattgaa

SEQ ID NO: 2180236 - DNA, 20 bp, Homo sapiens
gatatttacgtaaagaaaat

SEQ ID NO: 2180237 - DNA, 14 bp, Homo sapiens
gatattttgcacga

SEQ ID NO: 2180238 - DNA, 15 bp, Homo sapiens
gatcacagctcacgg

SEQ ID NO: 2180239 - DNA, 23 bp, Homo sapiens
gatcagaacattcagctctggag

SEQ ID NO: 2180240 - DNA, 20 bp, Homo sapiens
gatcatggctcactgcagcc

SEQ ID NO: 2180241 - DNA, 21 bp, Homo sapiens
gatcatggctcactgcagcct

SEQ ID NO: 2180242 - DNA, 19 bp, Homo sapiens
gatccaagtttactcaacc

SEQ ID NO: 2180243 - DNA, 11 bp, Homo sapiens
gatccagccac

SEQ ID NO: 2180244 - DNA, 13 bp, Homo sapiens
gatccagccactt

SEQ ID NO: 2180245 - DNA, 14 bp, Homo sapiens
gatccagccacttc

SEQ ID NO: 2180246 - DNA, 13 bp, Homo sapiens
gatccccgccacc

SEQ ID NO: 2180247 - DNA, 17 bp, Homo sapiens
gatccctcccctcagcc

SEQ ID NO: 2180248 - DNA, 22 bp, Homo sapiens
gatccctcccctcagcctcctg

SEQ ID NO: 2180249 - DNA, 20 bp, Homo sapiens
gatcctcctgtcttggcctc

SEQ ID NO: 2180250 - DNA, 19 bp, Homo sapiens
gatcctgctggggccgcca

SEQ ID NO: 2180251 - DNA, 22 bp, Homo sapiens
gatcctgctggggccgccacgg

SEQ ID NO: 2180252 - DNA, 13 bp, Homo sapiens
gatctcagctcac

SEQ ID NO: 2180253 - DNA, 17 bp, Homo sapiens
gatctgggaactcccaa

SEQ ID NO: 2180254 - DNA, 19 bp, Homo sapiens
gatctgggaactcccaaga

SEQ ID NO: 2180255 - DNA, 14 bp, Homo sapiens
gatctgttgcaaac

SEQ ID NO: 2180256 - DNA, 20 bp, Homo sapiens
gatcttggagacaattacaa

SEQ ID NO: 2180257 - DNA, 23 bp, Homo sapiens
gatgaaatatgtgattttctcta

SEQ ID NO: 2180258 - DNA, 20 bp, Homo sapiens
gatgacctccttagaaaaga

SEQ ID NO: 2180259 - DNA, 13 bp, Homo sapiens
gatgactgaattt

SEQ ID NO: 2180260 - DNA, 14 bp, Homo sapiens
gatgactgaatttc

SEQ ID NO: 2180261 - DNA, 12 bp, Homo sapiens
gatgactgctga

SEQ ID NO: 2180262 - DNA, 18 bp, Homo sapiens
gatgagaaacagctcagc

SEQ ID NO: 2180263 - DNA, 20 bp, Homo sapiens
gatgagctggtttgactcat

SEQ ID NO: 2180264 - DNA, 22 bp, Homo sapiens
gatgatactgactttttaaatt

SEQ ID NO: 2180265 - DNA, 18 bp, Homo sapiens
gatgcctccctgaccctg

SEQ ID NO: 2180266 - DNA, 18 bp, Homo sapiens
gatgcggatcctgctggg

SEQ ID NO: 2180267 - DNA, 19 bp, Homo sapiens
gatgctgaaagagaaaaga

SEQ ID NO: 2180268 - DNA, 13 bp, Homo sapiens
gatggcattactc

SEQ ID NO: 2180269 - DNA, 14 bp, Homo sapiens
gatgggagtaagag

SEQ ID NO: 2180270 - DNA, 19 bp, Homo sapiens
gatggggacagactgaaga

SEQ ID NO: 2180271 - DNA, 21 bp, Homo sapiens
gatggggagatcggggccaga

SEQ ID NO: 2180272 - DNA, 13 bp, Homo sapiens
gatggggccacag

SEQ ID NO: 2180273 - DNA, 17 bp, Homo sapiens
gatggtcctcacaagcc

SEQ ID NO: 2180274 - DNA, 16 bp, Homo sapiens
gatgtatgcccaaaga

SEQ ID NO: 2180275 - DNA, 17 bp, Homo sapiens
gatgtatgttggttttt

SEQ ID NO: 2180276 - DNA, 20 bp, Homo sapiens
gatgtattagtagagcaacc

SEQ ID NO: 2180277 - DNA, 15 bp, Homo sapiens
gatgtattcagagcc

SEQ ID NO: 2180278 - DNA, 16 bp, Homo sapiens
gatgtcatcttgagct

SEQ ID NO: 2180279 - DNA, 19 bp, Homo sapiens
gatgtggatggaggtgatg

SEQ ID NO: 2180280 - DNA, 12 bp, Homo sapiens
gatgttaaaaca

SEQ ID NO: 2180281 - DNA, 16 bp, Homo sapiens
gatgttaggctgggcc

SEQ ID NO: 2180282 - DNA, 15 bp, Homo sapiens
gattaaactgagtga

SEQ ID NO: 2180283 - DNA, 14 bp, Homo sapiens
gattaacacactga

SEQ ID NO: 2180284 - DNA, 15 bp, Homo sapiens
gattccatctccttg

SEQ ID NO: 2180285 - DNA, 17 bp, Homo sapiens
gattcccggctggactt

SEQ ID NO: 2180286 - DNA, 15 bp, Homo sapiens
gattctgaagtttta

SEQ ID NO: 2180287 - DNA, 19 bp, Homo sapiens
gattgaaaatgtccaggaa

SEQ ID NO: 2180288 - DNA, 14 bp, Homo sapiens
gattgacatctaat

SEQ ID NO: 2180289 - DNA, 20 bp, Homo sapiens
gattgccatttcttcccaag

SEQ ID NO: 2180290 - DNA, 22 bp, Homo sapiens
gattgccatttcttcccaaggc

SEQ ID NO: 2180291 - DNA, 19 bp, Homo sapiens
gattgctctggaagcctgc

SEQ ID NO: 2180292 - DNA, 22 bp, Homo sapiens
gattgctctggaagcctgctga

SEQ ID NO: 2180293 - DNA, 19 bp, Homo sapiens
gatttaatctgccaagggc

SEQ ID NO: 2180294 - DNA, 15 bp, Homo sapiens
gatttcaagggactg

SEQ ID NO: 2180295 - DNA, 12 bp, Homo sapiens
gatttctacaac

SEQ ID NO: 2180296 - DNA, 16 bp, Homo sapiens
gatttctacaactgat

SEQ ID NO: 2180297 - DNA, 13 bp, Homo sapiens
gatttctgccttc

SEQ ID NO: 2180298 - DNA, 16 bp, Homo sapiens
gatttctgccttcctt

SEQ ID NO: 2180299 - DNA, 15 bp, Homo sapiens
gatttggactcgaaa

SEQ ID NO: 2180300 - DNA, 13 bp, Homo sapiens
gatttggctggtg

SEQ ID NO: 2180301 - DNA, 21 bp, Homo sapiens
gattttacctgggatatgaca

SEQ ID NO: 2180302 - DNA, 15 bp, Homo sapiens
gattttcttttgcct

SEQ ID NO: 2180303 - DNA, 11 bp, Homo sapiens
gcaaaaatata

SEQ ID NO: 2180304 - DNA, 17 bp, Homo sapiens
gcaaaacatgctacctg

SEQ ID NO: 2180305 - DNA, 16 bp, Homo sapiens
gcaaacctctccttcc

SEQ ID NO: 2180306 - DNA, 18 bp, Homo sapiens
gcaaacctgccccatccc

SEQ ID NO: 2180307 - DNA, 14 bp, Homo sapiens
gcaaagctgcttga

SEQ ID NO: 2180308 - DNA, 19 bp, Homo sapiens
gccccatcaggactcttgt

SEQ ID NO: 2180309 - DNA, 20 bp, Homo sapiens
gccccgcaaaacccactgac

SEQ ID NO: 2180310 - DNA, 15 bp, Homo sapiens
gccccgggctggaga

SEQ ID NO: 2180311 - DNA, 17 bp, Homo sapiens
gcccctagaagggaagg

SEQ ID NO: 2180312 - DNA, 22 bp, Homo sapiens
gcccctagcttagagcctccct

SEQ ID NO: 2180313 - DNA, 15 bp, Homo sapiens
gcccctcggctaccc

SEQ ID NO: 2180314 - DNA, 22 bp, Homo sapiens
gccccttagcccccacccactt

SEQ ID NO: 2180315 - DNA, 16 bp, Homo sapiens
gccccttggtgccaca

SEQ ID NO: 2180316 - DNA, 14 bp, Homo sapiens
gcccgcatgcagca

SEQ ID NO: 2180317 - DNA, 22 bp, Homo sapiens
gcccgcatgcagcagcttgctg

SEQ ID NO: 2180318 - DNA, 14 bp, Homo sapiens
gccctacagccctg

SEQ ID NO: 2180319 - DNA, 20 bp, Homo sapiens
gccctaggctacccttgcca

SEQ ID NO: 2180320 - DNA, 13 bp, Homo sapiens
gccctccctcctg

SEQ ID NO: 2180321 - DNA, 16 bp, Homo sapiens
gccctccctcctgcct

SEQ ID NO: 2180322 - DNA, 16 bp, Homo sapiens
gccctctatttattag

SEQ ID NO: 2180323 - DNA, 23 bp, Homo sapiens
gccctctatttattagccaactg

SEQ ID NO: 2180324 - DNA, 11 bp, Homo sapiens
gccctctctca

SEQ ID NO: 2180325 - DNA, 21 bp, Homo sapiens
gccctctgaggctcagccctg

SEQ ID NO: 2180326 - DNA, 10 bp, Homo sapiens
gccctctgcc

SEQ ID NO: 2180327 - DNA, 22 bp, Homo sapiens
gccctctgcccccagctgctcc

SEQ ID NO: 2180328 - DNA, 13 bp, Homo sapiens
gccctctggggct

SEQ ID NO: 2180329 - DNA, 21 bp, Homo sapiens
gccctgagttggcatcacctg

SEQ ID NO: 2180330 - DNA, 13 bp, Homo sapiens
gccctgcctctgt

SEQ ID NO: 2180331 - DNA, 17 bp, Homo sapiens
gccctgctacctgttct

SEQ ID NO: 2180332 - DNA, 19 bp, Homo sapiens
gccctggagtcatgccaag

SEQ ID NO: 2180333 - DNA, 17 bp, Homo sapiens
gccctggcacccccaca

SEQ ID NO: 2180334 - DNA, 15 bp, Homo sapiens
gccctgttgtggggg

SEQ ID NO: 2180335 - DNA, 16 bp, Homo sapiens
gcccttacacttactg

SEQ ID NO: 2180336 - DNA, 23 bp, Homo sapiens
gcccttgctttcggagctcctgt

SEQ ID NO: 2180337 - DNA, 16 bp, Homo sapiens
gcccttttctggctcc

SEQ ID NO: 2180338 - DNA, 19 bp, Homo sapiens
gcccttttctggctcctgt

SEQ ID NO: 2180339 - DNA, 21 bp, Homo sapiens
gcccttttctggctcctgtgt

SEQ ID NO: 2180340 - DNA, 20 bp, Homo sapiens
gccgaggcaggggctgggca

SEQ ID NO: 2180341 - DNA, 18 bp, Homo sapiens
gccgccacggcctggctg

SEQ ID NO: 2180342 - DNA, 13 bp, Homo sapiens
gccgcctgtcctt

SEQ ID NO: 2180343 - DNA, 14 bp, Homo sapiens
gccgcctgtccttg

SEQ ID NO: 2180344 - DNA, 13 bp, Homo sapiens
gccgcctgtgccc

SEQ ID NO: 2180345 - DNA, 14 bp, Homo sapiens
gccgcctgtgccct

SEQ ID NO: 2180346 - DNA, 20 bp, Homo sapiens
gccgcctgtgcccttgctgg

SEQ ID NO: 2180347 - DNA, 21 bp, Homo sapiens
gccgctgggagagccaaggcc

SEQ ID NO: 2180348 - DNA, 18 bp, Homo sapiens
gccgcttccctacccaca

SEQ ID NO: 2180349 - DNA, 15 bp, Homo sapiens
gccggatcttggaga

SEQ ID NO: 2180350 - DNA, 14 bp, Homo sapiens
gccggccccaggct

SEQ ID NO: 2180351 - DNA, 18 bp, Homo sapiens
gccgggaccaccctgagc

SEQ ID NO: 2180352 - DNA, 12 bp, Homo sapiens
gccgggcacagc

SEQ ID NO: 2180353 - DNA, 16 bp, Homo sapiens
gccgggcacagctgtg

SEQ ID NO: 2180354 - DNA, 17 bp, Homo sapiens
gccgggcacagctgtgg

SEQ ID NO: 2180355 - DNA, 14 bp, Homo sapiens
gccgggggtggggg

SEQ ID NO: 2180356 - DNA, 13 bp, Homo sapiens
gccgttcctggga

SEQ ID NO: 2180357 - DNA, 15 bp, Homo sapiens
gcctagtcagccaca

SEQ ID NO: 2180358 - DNA, 18 bp, Homo sapiens
gcctagtcagccacatgg

SEQ ID NO: 2180359 - DNA, 19 bp, Homo sapiens
gcctagtcagccacatggg

SEQ ID NO: 2180360 - DNA, 14 bp, Homo sapiens
gcctagtcccttcc

SEQ ID NO: 2180361 - DNA, 17 bp, Homo sapiens
gcctatgccacctgcag

SEQ ID NO: 2180362 - DNA, 17 bp, Homo sapiens
gcctatttattcattca

SEQ ID NO: 2180363 - DNA, 17 bp, Homo sapiens
gcctcaacctccctggc

SEQ ID NO: 2180364 - DNA, 13 bp, Homo sapiens
gcctcaccctgct

SEQ ID NO: 2180365 - DNA, 15 bp, Homo sapiens
gcctcaccctgcttg

SEQ ID NO: 2180366 - DNA, 16 bp, Homo sapiens
gcctcaggctctgcac

SEQ ID NO: 2180367 - DNA, 19 bp, Homo sapiens
gcctccagaggaggggtgg

SEQ ID NO: 2180368 - DNA, 14 bp, Homo sapiens
gcctccatggtgcc

SEQ ID NO: 2180369 - DNA, 16 bp, Homo sapiens
gcctccatggtgcctc

SEQ ID NO: 2180370 - DNA, 17 bp, Homo sapiens
gcctccatggtgcctct

SEQ ID NO: 2180371 - DNA, 19 bp, Homo sapiens
gcctccctcccctgccctc

SEQ ID NO: 2180372 - DNA, 13 bp, Homo sapiens
gcctctagggacc

SEQ ID NO: 2180373 - DNA, 20 bp, Homo sapiens
gcctctagggacccctcctc

SEQ ID NO: 2180374 - DNA, 23 bp, Homo sapiens
gcctctagggacccctcctccct

SEQ ID NO: 2180375 - DNA, 17 bp, Homo sapiens
gcctctcatcccccatt

SEQ ID NO: 2180376 - DNA, 21 bp, Homo sapiens
gcctctggaggcctctgggcc

SEQ ID NO: 2180377 - DNA, 12 bp, Homo sapiens
gcctctggccag

SEQ ID NO: 2180378 - DNA, 13 bp, Homo sapiens
gcctctggccaga

SEQ ID NO: 2180379 - DNA, 17 bp, Homo sapiens
gcctctggccagacggc

SEQ ID NO: 2180380 - DNA, 13 bp, Homo sapiens
gcctctggctgcc

SEQ ID NO: 2180381 - DNA, 14 bp, Homo sapiens
gcctctggctgcct

SEQ ID NO: 2180382 - DNA, 22 bp, Homo sapiens
gcctctggctgcctggcccagg

SEQ ID NO: 2180383 - DNA, 13 bp, Homo sapiens
gcctctgggcctc

SEQ ID NO: 2180384 - DNA, 21 bp, Homo sapiens
gcctcttcctccctccctgca

SEQ ID NO: 2180385 - DNA, 22 bp, Homo sapiens
gcctcttctgaagatggaaggc

SEQ ID NO: 2180386 - DNA, 20 bp, Homo sapiens
gcctcttgaccaggctgcct

SEQ ID NO: 2180387 - DNA, 14 bp, Homo sapiens
gcctcttgctggtg

SEQ ID NO: 2180388 - DNA, 14 bp, Homo sapiens
gcctcttgggagac

SEQ ID NO: 2180389 - DNA, 19 bp, Homo sapiens
gcctgacctcaagcaacca

SEQ ID NO: 2180390 - DNA, 17 bp, Homo sapiens
gcctgcccggccggaga

SEQ ID NO: 2180391 - DNA, 19 bp, Homo sapiens
gcctgccttctgggcaagg

SEQ ID NO: 2180392 - DNA, 12 bp, Homo sapiens
gcctgcggctgc

SEQ ID NO: 2180393 - DNA, 13 bp, Homo sapiens
gcctgcggctgct

SEQ ID NO: 2180394 - DNA, 16 bp, Homo sapiens
gcctgcggctgctggc

SEQ ID NO: 2180395 - DNA, 17 bp, Homo sapiens
gcctgcggctgctggca

SEQ ID NO: 2180396 - DNA, 17 bp, Homo sapiens
gcctgcgtcatggctca

SEQ ID NO: 2180397 - DNA, 20 bp, Homo sapiens
gcctgcgtcatggctcaagg

SEQ ID NO: 2180398 - DNA, 13 bp, Homo sapiens
gcctgctgtgggt

SEQ ID NO: 2180399 - DNA, 14 bp, Homo sapiens
gcctggagctcctg

SEQ ID NO: 2180400 - DNA, 20 bp, Homo sapiens
gcctggagctcctgggaagg

SEQ ID NO: 2180401 - DNA, 23 bp, Homo sapiens
gcctggatgagaaacagctcagc

SEQ ID NO: 2180402 - DNA, 19 bp, Homo sapiens
gcctggcacccactccgga

SEQ ID NO: 2180403 - DNA, 16 bp, Homo sapiens
gcctggcccagggagg

SEQ ID NO: 2180404 - DNA, 16 bp, Homo sapiens
gcctggcctggcaccg

SEQ ID NO: 2180405 - DNA, 23 bp, Homo sapiens
gcctggcgtggggggagctctgg

SEQ ID NO: 2180406 - DNA, 19 bp, Homo sapiens
gcctggctccgctgtgtgg

SEQ ID NO: 2180407 - DNA, 13 bp, Homo sapiens
gcctgggccactg

SEQ ID NO: 2180408 - DNA, 15 bp, Homo sapiens
gcctgggccactggc

SEQ ID NO: 2180409 - DNA, 22 bp, Homo sapiens
gcctgggggcttttgccactcc

SEQ ID NO: 2180410 - DNA, 20 bp, Homo sapiens
gcctgggtgacagagcaaga

SEQ ID NO: 2180411 - DNA, 14 bp, Homo sapiens
gcctgggtggctca

SEQ ID NO: 2180412 - DNA, 15 bp, Homo sapiens
gcctgggtggctcag

SEQ ID NO: 2180413 - DNA, 16 bp, Homo sapiens
gcctgggtggctcagc

SEQ ID NO: 2180414 - DNA, 16 bp, Homo sapiens
gcctggtctcctccca

SEQ ID NO: 2180415 - DNA, 20 bp, Homo sapiens
gcctgtccctggccatctct

SEQ ID NO: 2180416 - DNA, 22 bp, Homo sapiens
gcctgtcttcagatcctgctgc

SEQ ID NO: 2180417 - DNA, 23 bp, Homo sapiens
gcctgtcttcagatcctgctgcc

SEQ ID NO: 2180418 - DNA, 16 bp, Homo sapiens
gcctgtgcccttgctg

SEQ ID NO: 2180419 - DNA, 23 bp, Homo sapiens
gcctgtgcgtcccagctgaaggc

SEQ ID NO: 2180420 - DNA, 20 bp, Homo sapiens
gccttatctgttccttttta

SEQ ID NO: 2180421 - DNA, 21 bp, Homo sapiens
gccttatgtaattattttctt

SEQ ID NO: 2180422 - DNA, 22 bp, Homo sapiens
gccttatgtaattattttcttt

SEQ ID NO: 2180423 - DNA, 15 bp, Homo sapiens
gcctttcctacaggg

SEQ ID NO: 2180424 - DNA, 12 bp, Homo sapiens
gcctttgaggtt

SEQ ID NO: 2180425 - DNA, 18 bp, Homo sapiens
gcctttggcaattcttct

SEQ ID NO: 2180426 - DNA, 15 bp, Homo sapiens
gcgaactgtgcagtt

SEQ ID NO: 2180427 - DNA, 24 bp, Homo sapiens
gcgagaaaacttcgtaagaacatg

SEQ ID NO: 2180428 - DNA, 18 bp, Homo sapiens
gcgagcatgtcgtggaca

SEQ ID NO: 2180429 - DNA, 17 bp, Homo sapiens
gcgatcatggctcactg

SEQ ID NO: 2180430 - DNA, 20 bp, Homo sapiens
ggcccttttctggctcctgt

SEQ ID NO: 2180431 - DNA, 22 bp, Homo sapiens
ggcccttttctggctcctgtgt

SEQ ID NO: 2180432 - DNA, 23 bp, Homo sapiens
ggccgaggcaggggctgggcaga

SEQ ID NO: 2180433 - DNA, 15 bp, Homo sapiens
ggccgatgagctggt

SEQ ID NO: 2180434 - DNA, 14 bp, Homo sapiens
ggccgcccacctgc

SEQ ID NO: 2180435 - DNA, 14 bp, Homo sapiens
ggccgggcacagct

SEQ ID NO: 2180436 - DNA, 15 bp, Homo sapiens
ggccgggcacagctg

SEQ ID NO: 2180437 - DNA, 18 bp, Homo sapiens
ggccgggttggaggcctc

SEQ ID NO: 2180438 - DNA, 15 bp, Homo sapiens
ggcctagtcccttcc

SEQ ID NO: 2180439 - DNA, 17 bp, Homo sapiens
ggcctatgccacctgca

SEQ ID NO: 2180440 - DNA, 19 bp, Homo sapiens
ggcctatgccacctgcagc

SEQ ID NO: 2180441 - DNA, 15 bp, Homo sapiens
ggcctcaccctgctt

SEQ ID NO: 2180442 - DNA, 22 bp, Homo sapiens
ggcctcacctgggttccccacc

SEQ ID NO: 2180443 - DNA, 13 bp, Homo sapiens
ggcctcaggctct

SEQ ID NO: 2180444 - DNA, 20 bp, Homo sapiens
ggcctcccaaagtgctggga

SEQ ID NO: 2180445 - DNA, 14 bp, Homo sapiens
ggcctctggctgcc

SEQ ID NO: 2180446 - DNA, 21 bp, Homo sapiens
ggcctctggctgcctggccca

SEQ ID NO: 2180447 - DNA, 16 bp, Homo sapiens
ggcctcttgctggtgc

SEQ ID NO: 2180448 - DNA, 19 bp, Homo sapiens
ggcctgagttgaggggctt

SEQ ID NO: 2180449 - DNA, 13 bp, Homo sapiens
ggcctggctccgc

SEQ ID NO: 2180450 - DNA, 14 bp, Homo sapiens
ggcctgtccctggc

SEQ ID NO: 2180451 - DNA, 17 bp, Homo sapiens
ggcgatatgagagggat

SEQ ID NO: 2180452 - DNA, 14 bp, Homo sapiens
ggcgctggctgcac

SEQ ID NO: 2180453 - DNA, 19 bp, Homo sapiens
ggcgctttctcctgtgccc

SEQ ID NO: 2180454 - DNA, 19 bp, Homo sapiens
ggcggaacctggctgcgaa

SEQ ID NO: 2180455 - DNA, 22 bp, Homo sapiens
ggcgtggggggagctctggtgg

SEQ ID NO: 2180456 - DNA, 24 bp, Homo sapiens
ggctaaccagttctctttgtaagg

SEQ ID NO: 2180457 - DNA, 12 bp, Homo sapiens
ggctaaggcctc

SEQ ID NO: 2180458 - DNA, 19 bp, Homo sapiens
ggctaaggcctcttgctgg

SEQ ID NO: 2180459 - DNA, 19 bp, Homo sapiens
ggctcactatggtgccaat

SEQ ID NO: 2180460 - DNA, 18 bp, Homo sapiens
ggctcactgcagcctcga

SEQ ID NO: 2180461 - DNA, 18 bp, Homo sapiens
ggctcagcatcctccacg

SEQ ID NO: 2180462 - DNA, 13 bp, Homo sapiens
ggctcgtggactg

SEQ ID NO: 2180463 - DNA, 14 bp, Homo sapiens
ggctcgtgggctct

SEQ ID NO: 2180464 - DNA, 16 bp, Homo sapiens
ggctcgtgggctctgg

SEQ ID NO: 2180465 - DNA, 18 bp, Homo sapiens
ggctcgtgggctctggct

SEQ ID NO: 2180466 - DNA, 13 bp, Homo sapiens
ggctctcctgccc

SEQ ID NO: 2180467 - DNA, 19 bp, Homo sapiens
ggctctgcacagacaagca

SEQ ID NO: 2180468 - DNA, 13 bp, Homo sapiens
ggctgagtgcact

SEQ ID NO: 2180469 - DNA, 14 bp, Homo sapiens
ggctgcctggccca

SEQ ID NO: 2180470 - DNA, 16 bp, Homo sapiens
ggctgcgaactgtgca

SEQ ID NO: 2180471 - DNA, 19 bp, Homo sapiens
ggctgcgaactgtgcagtt

SEQ ID NO: 2180472 - DNA, 18 bp, Homo sapiens
ggctgcggtgggcagcca

SEQ ID NO: 2180473 - DNA, 16 bp, Homo sapiens
ggctgctggcacagac

SEQ ID NO: 2180474 - DNA, 22 bp, Homo sapiens
ggctggacttttgcagcttcct

SEQ ID NO: 2180475 - DNA, 13 bp, Homo sapiens
ggctggagaaaga

SEQ ID NO: 2180476 - DNA, 14 bp, Homo sapiens
ggctggagaaagag

SEQ ID NO: 2180477 - DNA, 21 bp, Homo sapiens
ggctggagaaagagctgcctg

SEQ ID NO: 2180478 - DNA, 15 bp, Homo sapiens
ggctggcctcagact

SEQ ID NO: 2180479 - DNA, 14 bp, Homo sapiens
ggctgggcccagag

SEQ ID NO: 2180480 - DNA, 19 bp, Homo sapiens
ggctggggacttggccgct

SEQ ID NO: 2180481 - DNA, 15 bp, Homo sapiens
ggctgggggcctcac

SEQ ID NO: 2180482 - DNA, 16 bp, Homo sapiens
ggctgggtgcccacag

SEQ ID NO: 2180483 - DNA, 16 bp, Homo sapiens
ggctggtgggaaggcc

SEQ ID NO: 2180484 - DNA, 13 bp, Homo sapiens
ggctgtaatttaa

SEQ ID NO: 2180485 - DNA, 15 bp, Homo sapiens
ggctgtgtgtggaaa

SEQ ID NO: 2180486 - DNA, 22 bp, Homo sapiens
ggctgtttttgggtgcaagagg

SEQ ID NO: 2180487 - DNA, 21 bp, Homo sapiens
ggcttaaaaatacttaataaa

SEQ ID NO: 2180488 - DNA, 17 bp, Homo sapiens
ggcttcacccatgaaat

SEQ ID NO: 2180489 - DNA, 16 bp, Homo sapiens
ggcttccctctgctcc

SEQ ID NO: 2180490 - DNA, 18 bp, Homo sapiens
ggcttctgcttgtcatcc

SEQ ID NO: 2180491 - DNA, 14 bp, Homo sapiens
ggcttgaacaacac

SEQ ID NO: 2180492 - DNA, 12 bp, Homo sapiens
ggcttgaacctt

SEQ ID NO: 2180493 - DNA, 20 bp, Homo sapiens
ggctttgcccaacctcagca

SEQ ID NO: 2180494 - DNA, 18 bp, Homo sapiens
ggctttggctcgggactt

SEQ ID NO: 2180495 - DNA, 15 bp, Homo sapiens
gggaactcccaagaa

SEQ ID NO: 2180496 - DNA, 13 bp, Homo sapiens
gggaagagagcct

SEQ ID NO: 2180497 - DNA, 23 bp, Homo sapiens
gggaaggacaggaccctcaggaa

SEQ ID NO: 2180498 - DNA, 15 bp, Homo sapiens
gggaaggccacctgc

SEQ ID NO: 2180499 - DNA, 21 bp, Homo sapiens
gggacattgttctttccggcc

SEQ ID NO: 2180500 - DNA, 17 bp, Homo sapiens
gggaccaccctgagccg

SEQ ID NO: 2180501 - DNA, 22 bp, Homo sapiens
gggacctggggtggggaggcag

SEQ ID NO: 2180502 - DNA, 11 bp, Homo sapiens
gggactgatgt

SEQ ID NO: 2180503 - DNA, 15 bp, Homo sapiens
gggacttcaaaatca

SEQ ID NO: 2180504 - DNA, 14 bp, Homo sapiens
gggagaaggagagg

SEQ ID NO: 2180505 - DNA, 15 bp, Homo sapiens
gggagaaggagaggc

SEQ ID NO: 2180506 - DNA, 19 bp, Homo sapiens
gggagatcggggccagagg

SEQ ID NO: 2180507 - DNA, 16 bp, Homo sapiens
gggagcaagccttcct

SEQ ID NO: 2180508 - DNA, 22 bp, Homo sapiens
gggagcttccgctttgaaagaa

SEQ ID NO: 2180509 - DNA, 15 bp, Homo sapiens
gggaggagcctgtgc

SEQ ID NO: 2180510 - DNA, 17 bp, Homo sapiens
gggaggcccctggtggc

SEQ ID NO: 2180511 - DNA, 16 bp, Homo sapiens
gggaggccgaggcagg

SEQ ID NO: 2180512 - DNA, 13 bp, Homo sapiens
gggagggtcagtg

SEQ ID NO: 2180513 - DNA, 12 bp, Homo sapiens
gggagtgggaga

SEQ ID NO: 2180514 - DNA, 15 bp, Homo sapiens
gggagtgggagagga

SEQ ID NO: 2180515 - DNA, 14 bp, Homo sapiens
gggatccagccact

SEQ ID NO: 2180516 - DNA, 19 bp, Homo sapiens
gggatgaattgcctgtcct

SEQ ID NO: 2180517 - DNA, 18 bp, Homo sapiens
gggcaaacccttctcttc

SEQ ID NO: 2180518 - DNA, 21 bp, Homo sapiens
gggcaaacccttctcttctcc

SEQ ID NO: 2180519 - DNA, 12 bp, Homo sapiens
gggcaaagctga

SEQ ID NO: 2180520 - DNA, 23 bp, Homo sapiens
gggcaaagctgatttttttttta

SEQ ID NO: 2180521 - DNA, 23 bp, Homo sapiens
gggcacttttgaactcacgagcc

SEQ ID NO: 2180522 - DNA, 20 bp, Homo sapiens
gggcagcctgtgggagaagg

SEQ ID NO: 2180523 - DNA, 14 bp, Homo sapiens
gggcagggaaggac

SEQ ID NO: 2180524 - DNA, 15 bp, Homo sapiens
gggcagggaaggaca

SEQ ID NO: 2180525 - DNA, 18 bp, Homo sapiens
gggccaagccagggatgg

SEQ ID NO: 2180526 - DNA, 15 bp, Homo sapiens
gggccaagtcccacc

SEQ ID NO: 2180527 - DNA, 13 bp, Homo sapiens
gggccactggcat

SEQ ID NO: 2180528 - DNA, 21 bp, Homo sapiens
gggccactggcatctctggag

SEQ ID NO: 2180529 - DNA, 12 bp, Homo sapiens
gggccagaggca

SEQ ID NO: 2180530 - DNA, 17 bp, Homo sapiens
gggccatctgactgcca

SEQ ID NO: 2180531 - DNA, 19 bp, Homo sapiens
gggccatctgactgccaag

SEQ ID NO: 2180532 - DNA, 21 bp, Homo sapiens
gggccatctgactgccaagcc

SEQ ID NO: 2180533 - DNA, 15 bp, Homo sapiens
gggccccgggctgga

SEQ ID NO: 2180534 - DNA, 18 bp, Homo sapiens
gggccccgggctggagaa

SEQ ID NO: 2180535 - DNA, 13 bp, Homo sapiens
gggcctcactcca

SEQ ID NO: 2180536 - DNA, 14 bp, Homo sapiens
gggcctcactccag

SEQ ID NO: 2180537 - DNA, 12 bp, Homo sapiens
gggcctctggct

SEQ ID NO: 2180538 - DNA, 14 bp, Homo sapiens
gggcctctggctgc

SEQ ID NO: 2180539 - DNA, 17 bp, Homo sapiens
gggcctctggctgcctg

SEQ ID NO: 2180540 - DNA, 11 bp, Homo sapiens
gggcctgactt

SEQ ID NO: 2180541 - DNA, 21 bp, Homo sapiens
gggcctgacttttacagcttt

SEQ ID NO: 2180542 - DNA, 13 bp, Homo sapiens
gggcgggaggcca

SEQ ID NO: 2180543 - DNA, 15 bp, Homo sapiens
gggctaaggcctctt

SEQ ID NO: 2180544 - DNA, 14 bp, Homo sapiens
gggctcagctctgg

SEQ ID NO: 2180545 - DNA, 13 bp, Homo sapiens
gggctctggctcc

SEQ ID NO: 2180546 - DNA, 12 bp, Homo sapiens
gggctgcaggct

SEQ ID NO: 2180547 - DNA, 16 bp, Homo sapiens
gggctggactggctgt

SEQ ID NO: 2180548 - DNA, 22 bp, Homo sapiens
gggctggagaaagagctgcctg

SEQ ID NO: 2180549 - DNA, 24 bp, Homo sapiens
gggctggagaaagagctgcctgga

SEQ ID NO: 2180550 - DNA, 11 bp, Homo sapiens
gggctgggtgt

SEQ ID NO: 2180551 - DNA, 19 bp, Homo sapiens
gggcttatatctggcctct

SEQ ID NO: 2180552 - DNA, 19 bp, Homo sapiens
gggcttggtttcctcacct

SEQ ID NO: 2180553 - DNA, 22 bp, Homo sapiens
tgcaatacatttcttccttcaa

SEQ ID NO: 2180554 - DNA, 21 bp, Homo sapiens
tgcaatgaaaagaaaatgtgc

SEQ ID NO: 2180555 - DNA, 17 bp, Homo sapiens
tgcacacacactagcct

SEQ ID NO: 2180556 - DNA, 19 bp, Homo sapiens
tgcacacacactagccttc

SEQ ID NO: 2180557 - DNA, 16 bp, Homo sapiens
tgcacacggcacagag

SEQ ID NO: 2180558 - DNA, 17 bp, Homo sapiens
tgcacagacaagcagcc

SEQ ID NO: 2180559 - DNA, 13 bp, Homo sapiens
tgcacataatttg

SEQ ID NO: 2180560 - DNA, 23 bp, Homo sapiens
tgcacatgacatttgtcctgcag

SEQ ID NO: 2180561 - DNA, 14 bp, Homo sapiens
tgcaccccaagtcc

SEQ ID NO: 2180562 - DNA, 23 bp, Homo sapiens
tgcacgaattttaaaacatggca

SEQ ID NO: 2180563 - DNA, 20 bp, Homo sapiens
tgcactggcaggatcacagc

SEQ ID NO: 2180564 - DNA, 15 bp, Homo sapiens
tgcagaaggaaagaa

SEQ ID NO: 2180565 - DNA, 15 bp, Homo sapiens
tgcagacctgggact

SEQ ID NO: 2180566 - DNA, 18 bp, Homo sapiens
tgcagagaggttgtgaaa

SEQ ID NO: 2180567 - DNA, 19 bp, Homo sapiens
tgcagagatgcggtggcta

SEQ ID NO: 2180568 - DNA, 19 bp, Homo sapiens
tgcagcagcttgctgcacc

SEQ ID NO: 2180569 - DNA, 20 bp, Homo sapiens
tgcagcggtggaaggagcct

SEQ ID NO: 2180570 - DNA, 14 bp, Homo sapiens
tgcagggcagcctg

SEQ ID NO: 2180571 - DNA, 18 bp, Homo sapiens
tgcagggcagcctgtggg

SEQ ID NO: 2180572 - DNA, 22 bp, Homo sapiens
tgcagggcagcctgtgggagaa

SEQ ID NO: 2180573 - DNA, 16 bp, Homo sapiens
tgcagggccctctggg

SEQ ID NO: 2180574 - DNA, 20 bp, Homo sapiens
tgcagggccctctggggctc

SEQ ID NO: 2180575 - DNA, 19 bp, Homo sapiens
tgcagggtcctccggggct

SEQ ID NO: 2180576 - DNA, 18 bp, Homo sapiens
tgcagtcacccctgtctg

SEQ ID NO: 2180577 - DNA, 18 bp, Homo sapiens
tgcagtcttgtactgtga

SEQ ID NO: 2180578 - DNA, 20 bp, Homo sapiens
tgcagtcttgtactgtgacc

SEQ ID NO: 2180579 - DNA, 16 bp, Homo sapiens
tgcagtgcccctagct

SEQ ID NO: 2180580 - DNA, 17 bp, Homo sapiens
tgcagtgcctttcccca

SEQ ID NO: 2180581 - DNA, 22 bp, Homo sapiens
tgcagttattagaacttagttt

SEQ ID NO: 2180582 - DNA, 19 bp, Homo sapiens
tgcagttcatactgaatga

SEQ ID NO: 2180583 - DNA, 16 bp, Homo sapiens
tgcatcagcctctggc

SEQ ID NO: 2180584 - DNA, 17 bp, Homo sapiens
tgcatccacaggattcc

SEQ ID NO: 2180585 - DNA, 19 bp, Homo sapiens
tgcatcccaccagcctgag

SEQ ID NO: 2180586 - DNA, 14 bp, Homo sapiens
tgcatgccgctgca

SEQ ID NO: 2180587 - DNA, 21 bp, Homo sapiens
tgcatgtgtaaatctgaaaaa

SEQ ID NO: 2180588 - DNA, 17 bp, Homo sapiens
tgcattagaaaccatga

SEQ ID NO: 2180589 - DNA, 21 bp, Homo sapiens
tgccaaagtgtctacatgtgc

SEQ ID NO: 2180590 - DNA, 15 bp, Homo sapiens
tgccaaccacctctg

SEQ ID NO: 2180591 - DNA, 20 bp, Homo sapiens
tgccaacttttagtgggtga

SEQ ID NO: 2180592 - DNA, 22 bp, Homo sapiens
tgccaagccagattctcttgaa

SEQ ID NO: 2180593 - DNA, 15 bp, Homo sapiens
tgccaaggccgccca

SEQ ID NO: 2180594 - DNA, 19 bp, Homo sapiens
tgccaaggccgcccacctg

SEQ ID NO: 2180595 - DNA, 20 bp, Homo sapiens
tgccaaggccgcccacctgc

SEQ ID NO: 2180596 - DNA, 18 bp, Homo sapiens
tgccaagtctcaggagga

SEQ ID NO: 2180597 - DNA, 18 bp, Homo sapiens
tgccaatggaacctcctt

SEQ ID NO: 2180598 - DNA, 14 bp, Homo sapiens
tgccaccctctgca

SEQ ID NO: 2180599 - DNA, 18 bp, Homo sapiens
tgccaccctctgcagggc

SEQ ID NO: 2180600 - DNA, 19 bp, Homo sapiens
tgccaccctctgcagggca

SEQ ID NO: 2180601 - DNA, 18 bp, Homo sapiens
tgccactaggctgggtgc

SEQ ID NO: 2180602 - DNA, 13 bp, Homo sapiens
tgccactccttgt

SEQ ID NO: 2180603 - DNA, 13 bp, Homo sapiens
tgccagaagtgtg

SEQ ID NO: 2180604 - DNA, 20 bp, Homo sapiens
tgccagattaaatgaatata

SEQ ID NO: 2180605 - DNA, 14 bp, Homo sapiens
tgccaggacagctg

SEQ ID NO: 2180606 - DNA, 19 bp, Homo sapiens
tgccaggacagctgcaggt

SEQ ID NO: 2180607 - DNA, 15 bp, Homo sapiens
tgccaggctgcggtg

SEQ ID NO: 2180608 - DNA, 23 bp, Homo sapiens
tgccaggctgcggtgggcagcca

SEQ ID NO: 2180609 - DNA, 22 bp, Homo sapiens
tgccagtaggctcaactaggga

SEQ ID NO: 2180610 - DNA, 17 bp, Homo sapiens
tgccatgctgctatgaa

SEQ ID NO: 2180611 - DNA, 18 bp, Homo sapiens
tgccatgctgctatgaag

SEQ ID NO: 2180612 - DNA, 21 bp, Homo sapiens
tgccatgctgctatgaagact

SEQ ID NO: 2180613 - DNA, 14 bp, Homo sapiens
tgccatttccctga

SEQ ID NO: 2180614 - DNA, 18 bp, Homo sapiens
tgccatttccctgaacag

SEQ ID NO: 2180615 - DNA, 19 bp, Homo sapiens
tgccatttccctgaacaga

SEQ ID NO: 2180616 - DNA, 13 bp, Homo sapiens
tgccatttcttcc

SEQ ID NO: 2180617 - DNA, 14 bp, Homo sapiens
tgccatttcttccc

SEQ ID NO: 2180618 - DNA, 18 bp, Homo sapiens
tgcccaacctcagcaacc

SEQ ID NO: 2180619 - DNA, 11 bp, Homo sapiens
tgcccacagcc

SEQ ID NO: 2180620 - DNA, 14 bp, Homo sapiens
tgcccacttctcct

SEQ ID NO: 2180621 - DNA, 11 bp, Homo sapiens
tgcccagagct

SEQ ID NO: 2180622 - DNA, 12 bp, Homo sapiens
tgcccagagctg

SEQ ID NO: 2180623 - DNA, 14 bp, Homo sapiens
tgcccagagctggg

SEQ ID NO: 2180624 - DNA, 18 bp, Homo sapiens
tgcccagcagtttcccag

SEQ ID NO: 2180625 - DNA, 12 bp, Homo sapiens
tgcccagctcag

SEQ ID NO: 2180626 - DNA, 18 bp, Homo sapiens
tgcccagggtcctgtgcc

SEQ ID NO: 2180627 - DNA, 16 bp, Homo sapiens
tgcccagtgatggcat

SEQ ID NO: 2180628 - DNA, 17 bp, Homo sapiens
tgcccagtgatggcatt

SEQ ID NO: 2180629 - DNA, 22 bp, Homo sapiens
tgccccaaaggaagctttctct

SEQ ID NO: 2180630 - DNA, 12 bp, Homo sapiens
tgccccacctgc

SEQ ID NO: 2180631 - DNA, 15 bp, Homo sapiens
tgccccacctgccac

SEQ ID NO: 2180632 - DNA, 15 bp, Homo sapiens
tgccccatcagcagc

SEQ ID NO: 2180633 - DNA, 16 bp, Homo sapiens
tgcccctagcttagag

SEQ ID NO: 2180634 - DNA, 15 bp, Homo sapiens
tgcccctgccgcctg

SEQ ID NO: 2180635 - DNA, 14 bp, Homo sapiens
tgccctaactctgc

SEQ ID NO: 2180636 - DNA, 22 bp, Homo sapiens
tgccctaactctgcccaccctc

SEQ ID NO: 2180637 - DNA, 18 bp, Homo sapiens
tgccctccactgccctct

SEQ ID NO: 2180638 - DNA, 24 bp, Homo sapiens
tgccctctatttattagccaactg

SEQ ID NO: 2180639 - DNA, 18 bp, Homo sapiens
tgcccttacacttactgt

SEQ ID NO: 2180640 - DNA, 16 bp, Homo sapiens
tgccgaagtgtttctg

SEQ ID NO: 2180641 - DNA, 12 bp, Homo sapiens
tgccgataacct

SEQ ID NO: 2180642 - DNA, 19 bp, Homo sapiens
tgccgcgtgcgaccagagg

SEQ ID NO: 2180643 - DNA, 15 bp, Homo sapiens
tgccgctgggagagc

SEQ ID NO: 2180644 - DNA, 15 bp, Homo sapiens
tgcctatttattcat

SEQ ID NO: 2180645 - DNA, 16 bp, Homo sapiens
tgcctccatggtgcct

SEQ ID NO: 2180646 - DNA, 19 bp, Homo sapiens
tgcctccctgaccctgcag

SEQ ID NO: 2180647 - DNA, 13 bp, Homo sapiens
tgcctccctgtcc

SEQ ID NO: 2180648 - DNA, 17 bp, Homo sapiens
tgcctccctgtccaccc

SEQ ID NO: 2180649 - DNA, 19 bp, Homo sapiens
tgcctcccttgtggcagca

SEQ ID NO: 2180650 - DNA, 16 bp, Homo sapiens
tgcctcctctgtcctc

SEQ ID NO: 2180651 - DNA, 17 bp, Homo sapiens
tgcctcctctgtcctca

SEQ ID NO: 2180652 - DNA, 16 bp, Homo sapiens
tgcctcgctcccttca

SEQ ID NO: 2180653 - DNA, 20 bp, Homo sapiens
tgcctctggaggcctctggg

SEQ ID NO: 2180654 - DNA, 18 bp, Homo sapiens
tgcctggagctcctggga

SEQ ID NO: 2180655 - DNA, 12 bp, Homo sapiens
tgcctggcccag

SEQ ID NO: 2180656 - DNA, 17 bp, Homo sapiens
tgcctggcccagggagg

SEQ ID NO: 2180657 - DNA, 19 bp, Homo sapiens
tgcctggcccagggaggaa

SEQ ID NO: 2180658 - DNA, 21 bp, Homo sapiens
tgcctgggaaccttcctgtct

SEQ ID NO: 2180659 - DNA, 17 bp, Homo sapiens
tgccttatgtaattatt

SEQ ID NO: 2180660 - DNA, 14 bp, Homo sapiens
tgccttcctcctta

SEQ ID NO: 2180661 - DNA, 20 bp, Homo sapiens
tgccttgctgcacctgaggc

SEQ ID NO: 2180662 - DNA, 19 bp, Homo sapiens
tgccttttgcaaccaggaa

SEQ ID NO: 2180663 - DNA, 16 bp, Homo sapiens
tgcgaccagaggtggg

SEQ ID NO: 2180664 - DNA, 15 bp, Homo sapiens
tgcgcagagtggatt

SEQ ID NO: 2180665 - DNA, 16 bp, Homo sapiens
tgcggatcctgctggg

SEQ ID NO: 2180666 - DNA, 16 bp, Homo sapiens
tgcggctgctggcaca

SEQ ID NO: 2180667 - DNA, 16 bp, Homo sapiens
tgcggtgggcagccat

SEQ ID NO: 2180668 - DNA, 15 bp, Homo sapiens
tgcgtcccagctgaa

SEQ ID NO: 2180669 - DNA, 18 bp, Homo sapiens
tgctaaatactgtacata

SEQ ID NO: 2180670 - DNA, 21 bp, Homo sapiens
tgctaaatactgtacatagat

SEQ ID NO: 2180671 - DNA, 20 bp, Homo sapiens
tgctaatcgggttgtcactc

SEQ ID NO: 2180672 - DNA, 23 bp, Homo sapiens
tgctacctgatcccactcctagg

SEQ ID NO: 2180673 - DNA, 23 bp, Homo sapiens
tgctagatgagaattcagctgcc

SEQ ID NO: 2180674 - DNA, 20 bp, Homo sapiens
tgctaggggttttaggtctc

SEQ ID NO: 2180675 - DNA, 16 bp, Homo sapiens
tgttaagaatttcaat

SEQ ID NO: 2180676 - DNA, 20 bp, Homo sapiens
tgttaagtgcttttaaactg

SEQ ID NO: 2180677 - DNA, 12 bp, Homo sapiens
tgttaataaagg

SEQ ID NO: 2180678 - DNA, 15 bp, Homo sapiens
tgttaataaaggttt

SEQ ID NO: 2180679 - DNA, 16 bp, Homo sapiens
tgttaatatatataat

SEQ ID NO: 2180680 - DNA, 21 bp, Homo sapiens
tgttaatatgtatttgttgaa

SEQ ID NO: 2180681 - DNA, 15 bp, Homo sapiens
tgttacccatttgaa

SEQ ID NO: 2180682 - DNA, 16 bp, Homo sapiens
tgttaggctgggccca

SEQ ID NO: 2180683 - DNA, 16 bp, Homo sapiens
tgttattatctgggct

SEQ ID NO: 2180684 - DNA, 16 bp, Homo sapiens
tgttcaaaatgttaat

SEQ ID NO: 2180685 - DNA, 17 bp, Homo sapiens
tgttccatcctgtacaa

SEQ ID NO: 2180686 - DNA, 19 bp, Homo sapiens
tgttccatcctgtacaagt

SEQ ID NO: 2180687 - DNA, 21 bp, Homo sapiens
tgttccatcctgtacaagtgc

SEQ ID NO: 2180688 - DNA, 21 bp, Homo sapiens
tgttctatttcagtgccaata

SEQ ID NO: 2180689 - DNA, 22 bp, Homo sapiens
tgttctcagaatcccttaacag

SEQ ID NO: 2180690 - DNA, 20 bp, Homo sapiens
tgttctcatgtttgtgcatg

SEQ ID NO: 2180691 - DNA, 21 bp, Homo sapiens
tgttctctccccttgcactgg

SEQ ID NO: 2180692 - DNA, 14 bp, Homo sapiens
tgttgaaattaaaa

SEQ ID NO: 2180693 - DNA, 23 bp, Homo sapiens
tgttgtaggaaaagctgttccca

SEQ ID NO: 2180694 - DNA, 24 bp, Homo sapiens
tgttgtgggggtgtcacagaggca

SEQ ID NO: 2180695 - DNA, 13 bp, Homo sapiens
tgttgttaatttt

SEQ ID NO: 2180696 - DNA, 21 bp, Homo sapiens
tgttgttactgggtaggttct

SEQ ID NO: 2180697 - DNA, 15 bp, Homo sapiens
tgttgttcagaagtt

SEQ ID NO: 2180698 - DNA, 18 bp, Homo sapiens
tgtttatatttaattttt

SEQ ID NO: 2180699 - DNA, 23 bp, Homo sapiens
tgtttctaaacagttgagtttct

SEQ ID NO: 2180700 - DNA, 19 bp, Homo sapiens
tgtttgatgtgtatgtgtt

SEQ ID NO: 2180701 - DNA, 17 bp, Homo sapiens
tgtttgctcctgttgtt

SEQ ID NO: 2180702 - DNA, 15 bp, Homo sapiens
tgtttggtataaatt

SEQ ID NO: 2180703 - DNA, 15 bp, Homo sapiens
tgttttaagtgtttg

SEQ ID NO: 2180704 - DNA, 22 bp, Homo sapiens
tgttttattcacttgtgtttgt

SEQ ID NO: 2180705 - DNA, 21 bp, Homo sapiens
tgttttcccatttaaaaatat

SEQ ID NO: 2180706 - DNA, 19 bp, Homo sapiens
tgtttttcaatgtgttctt

SEQ ID NO: 2180707 - DNA, 23 bp, Homo sapiens
tgtttttggtttcttattcaaag

SEQ ID NO: 2180708 - DNA, 22 bp, Homo sapiens
tgttttttttccaaaaacaaag

SEQ ID NO: 2180709 - DNA, 19 bp, Homo sapiens
ttaaaaatatctgaatata

SEQ ID NO: 2180710 - DNA, 13 bp, Homo sapiens
ttaaaaattaatt

SEQ ID NO: 2180711 - DNA, 13 bp, Homo sapiens
ttaaaacatctct

SEQ ID NO: 2180712 - DNA, 19 bp, Homo sapiens
ttaaaatattggctgattt

SEQ ID NO: 2180713 - DNA, 17 bp, Homo sapiens
ttaaaatcacaaactca

SEQ ID NO: 2180714 - DNA, 15 bp, Homo sapiens
ttaaaatgaatctta

SEQ ID NO: 2180715 - DNA, 18 bp, Homo sapiens
ttaaactactatttttct

SEQ ID NO: 2180716 - DNA, 12 bp, Homo sapiens
ttaaacttgcaa

SEQ ID NO: 2180717 - DNA, 15 bp, Homo sapiens
ttaaacttgcaatga

SEQ ID NO: 2180718 - DNA, 14 bp, Homo sapiens
ttaaagctgtttct

SEQ ID NO: 2180719 - DNA, 14 bp, Homo sapiens
ttaaatcagttttg

SEQ ID NO: 2180720 - DNA, 22 bp, Homo sapiens
ttaaatcagttttgtgtacagt

SEQ ID NO: 2180721 - DNA, 12 bp, Homo sapiens
ttaaatgctttg

SEQ ID NO: 2180722 - DNA, 13 bp, Homo sapiens
ttaaatgttatta

SEQ ID NO: 2180723 - DNA, 12 bp, Homo sapiens
ttaaattattat

SEQ ID NO: 2180724 - DNA, 16 bp, Homo sapiens
ttaaattgcacgtgca

SEQ ID NO: 2180725 - DNA, 19 bp, Homo sapiens
ttaaattgcacgtgcaata

SEQ ID NO: 2180726 - DNA, 23 bp, Homo sapiens
ttaacctacttgtaaacttgaaa

SEQ ID NO: 2180727 - DNA, 17 bp, Homo sapiens
ttaacgaatttaaaaag

SEQ ID NO: 2180728 - DNA, 13 bp, Homo sapiens
ttaacttgaaaag

SEQ ID NO: 2180729 - DNA, 19 bp, Homo sapiens
ttaagaaaaacatgtcatg

SEQ ID NO: 2180730 - DNA, 13 bp, Homo sapiens
ttaagaaaaataa

SEQ ID NO: 2180731 - DNA, 18 bp, Homo sapiens
ttaagaactatatttaat

SEQ ID NO: 2180732 - DNA, 15 bp, Homo sapiens
ttaagaactgacaca

SEQ ID NO: 2180733 - DNA, 14 bp, Homo sapiens
ttaagaatttcaat

SEQ ID NO: 2180734 - DNA, 18 bp, Homo sapiens
ttaaggaaaaaagatttt

SEQ ID NO: 2180735 - DNA, 16 bp, Homo sapiens
ttaagggggtgtaatg

SEQ ID NO: 2180736 - DNA, 23 bp, Homo sapiens
ttaagtttagaaattacaagttt

SEQ ID NO: 2180737 - DNA, 17 bp, Homo sapiens
ttaatagagaagtaaaa

SEQ ID NO: 2180738 - DNA, 17 bp, Homo sapiens
ttaatataagtttcttt

SEQ ID NO: 2180739 - DNA, 19 bp, Homo sapiens
ttaatataagtttctttag

SEQ ID NO: 2180740 - DNA, 14 bp, Homo sapiens
ttaatatgtatttg

SEQ ID NO: 2180741 - DNA, 19 bp, Homo sapiens
ttaatatgtatttgttgaa

SEQ ID NO: 2180742 - DNA, 15 bp, Homo sapiens
ttaatattcagatgt

SEQ ID NO: 2180743 - DNA, 14 bp, Homo sapiens
ttaatcgtttttgt

SEQ ID NO: 2180744 - DNA, 19 bp, Homo sapiens
ttaatgaatagaataaata

SEQ ID NO: 2180745 - DNA, 23 bp, Homo sapiens
ttaatgatcaacaatttaatgta

SEQ ID NO: 2180746 - DNA, 15 bp, Homo sapiens
ttaattccccttccc

SEQ ID NO: 2180747 - DNA, 14 bp, Homo sapiens
ttaattgtaaagta

SEQ ID NO: 2180748 - DNA, 21 bp, Homo sapiens
ttaatttcaaatctgtaatta

SEQ ID NO: 2180749 - DNA, 14 bp, Homo sapiens
ttacacttactgtt

SEQ ID NO: 2180750 - DNA, 14 bp, Homo sapiens
ttacagcttttctc

SEQ ID NO: 2180751 - DNA, 15 bp, Homo sapiens
ttacaggaagctttt

SEQ ID NO: 2180752 - DNA, 18 bp, Homo sapiens
ttacagggcccaggtgag

SEQ ID NO: 2180753 - DNA, 19 bp, Homo sapiens
ttacagtccagttttgtgt

SEQ ID NO: 2180754 - DNA, 18 bp, Homo sapiens
ttacatcttttgggaagc

SEQ ID NO: 2180755 - DNA, 10 bp, Homo sapiens
ttacatgacc

SEQ ID NO: 2180756 - DNA, 21 bp, Homo sapiens
ttaccattttgcgatgtgttt

SEQ ID NO: 2180757 - DNA, 16 bp, Homo sapiens
ttacccttctgtgccc

SEQ ID NO: 2180758 - DNA, 19 bp, Homo sapiens
ttacccttctgtgcccagc

SEQ ID NO: 2180759 - DNA, 21 bp, Homo sapiens
ttacccttctgtgcccagctc

SEQ ID NO: 2180760 - DNA, 17 bp, Homo sapiens
ttacggaattccaatat

SEQ ID NO: 2180761 - DNA, 13 bp, Homo sapiens
ttacggtacttgg

SEQ ID NO: 2180762 - DNA, 15 bp, Homo sapiens
ttacggtgatattgt

SEQ ID NO: 2180763 - DNA, 23 bp, Homo sapiens
ttacgttgcatccacaggattcc

SEQ ID NO: 2180764 - DNA, 21 bp, Homo sapiens
ttactcaaagttaacctacct

SEQ ID NO: 2180765 - DNA, 21 bp, Homo sapiens
ttactgataaaaatgatattg

SEQ ID NO: 2180766 - DNA, 23 bp, Homo sapiens
ttactgggtaggttctgaacagc

SEQ ID NO: 2180767 - DNA, 16 bp, Homo sapiens
ttactgtggaggtggc

SEQ ID NO: 2180768 - DNA, 22 bp, Homo sapiens
ttactgtttgtcttctccccag

SEQ ID NO: 2180769 - DNA, 15 bp, Homo sapiens
ttacttacctgcatg

SEQ ID NO: 2180770 - DNA, 15 bp, Homo sapiens
ttactttaccacccc

SEQ ID NO: 2180771 - DNA, 13 bp, Homo sapiens
ttagaaattacaa

SEQ ID NO: 2180772 - DNA, 13 bp, Homo sapiens
ttagaatattaaa

SEQ ID NO: 2180773 - DNA, 14 bp, Homo sapiens
ttagaatattaaaa

SEQ ID NO: 2180774 - DNA, 17 bp, Homo sapiens
ttagaatcccatggatg

SEQ ID NO: 2180775 - DNA, 20 bp, Homo sapiens
ttagagacagggtcctgcta

SEQ ID NO: 2180776 - DNA, 15 bp, Homo sapiens
ttagataaaaataaa

SEQ ID NO: 2180777 - DNA, 21 bp, Homo sapiens
ttagatatataactttagaaa

SEQ ID NO: 2180778 - DNA, 23 bp, Homo sapiens
ttagatatataactttagaaata

SEQ ID NO: 2180779 - DNA, 23 bp, Homo sapiens
ttagccaactgtttccctgctga

SEQ ID NO: 2180780 - DNA, 13 bp, Homo sapiens
ttagcccccaccc

SEQ ID NO: 2180781 - DNA, 19 bp, Homo sapiens
ttagctcagccccagccca

SEQ ID NO: 2180782 - DNA, 16 bp, Homo sapiens
ttagcttacaggaagc

SEQ ID NO: 2180783 - DNA, 14 bp, Homo sapiens
ttaggctgggccca

SEQ ID NO: 2180784 - DNA, 17 bp, Homo sapiens
ttaggctgggcccagag

SEQ ID NO: 2180785 - DNA, 21 bp, Homo sapiens
ttagggagaagggcttttctt

SEQ ID NO: 2180786 - DNA, 14 bp, Homo sapiens
ttaggtctcttccc

SEQ ID NO: 2180787 - DNA, 22 bp, Homo sapiens
ttagtaacctttaaaaatgtat

SEQ ID NO: 2180788 - DNA, 14 bp, Homo sapiens
ttagtgccaggctg

SEQ ID NO: 2180789 - DNA, 13 bp, Homo sapiens
ttagttctgtata

SEQ ID NO: 2180790 - DNA, 15 bp, Homo sapiens
ttagtttgtatatat

SEQ ID NO: 2180791 - DNA, 15 bp, Homo sapiens
ttagttttgttccaa

SEQ ID NO: 2180792 - DNA, 20 bp, Homo sapiens
ttataacaatgttaaatgca

SEQ ID NO: 2180793 - DNA, 23 bp, Homo sapiens
ttataagatttttaggtgtcttt

SEQ ID NO: 2180794 - DNA, 13 bp, Homo sapiens
ttataattaaaga

SEQ ID NO: 2180795 - DNA, 19 bp, Homo sapiens
ttataattaaagaaaattg

SEQ ID NO: 2180796 - DNA, 21 bp, Homo sapiens
ttataattaaagaaaattgcc

SEQ ID NO: 2180797 - DNA, 15 bp, Homo sapiens
tttgcaaccaggaac

SEQ ID NO: 2180798 - DNA, 23 bp, Homo sapiens
tttgcaaccaggaacagcaaatg

SEQ ID NO: 2180799 - DNA, 18 bp, Homo sapiens
tttgcagctgctggtttt

SEQ ID NO: 2180800 - DNA, 15 bp, Homo sapiens
tttgccatgctgcta

SEQ ID NO: 2180801 - DNA, 13 bp, Homo sapiens
tttgccctcccat

SEQ ID NO: 2180802 - DNA, 12 bp, Homo sapiens
tttgctccaccc

SEQ ID NO: 2180803 - DNA, 15 bp, Homo sapiens
tttgctgattgtctg

SEQ ID NO: 2180804 - DNA, 16 bp, Homo sapiens
tttggacacacacagc

SEQ ID NO: 2180805 - DNA, 18 bp, Homo sapiens
tttggagaactcatttca

SEQ ID NO: 2180806 - DNA, 19 bp, Homo sapiens
tttggagaactcatttcaa

SEQ ID NO: 2180807 - DNA, 19 bp, Homo sapiens
tttggatctatcacctgtc

SEQ ID NO: 2180808 - DNA, 15 bp, Homo sapiens
tttggtattcaattt

SEQ ID NO: 2180809 - DNA, 16 bp, Homo sapiens
tttggtattcaatttg

SEQ ID NO: 2180810 - DNA, 22 bp, Homo sapiens
tttggtcctaagtccctgcccc

SEQ ID NO: 2180811 - DNA, 17 bp, Homo sapiens
tttgtaaaataaaacca

SEQ ID NO: 2180812 - DNA, 22 bp, Homo sapiens
tttgtagacagggtctccctat

SEQ ID NO: 2180813 - DNA, 13 bp, Homo sapiens
tttgtatgtatgt

SEQ ID NO: 2180814 - DNA, 22 bp, Homo sapiens
tttgtatgtatgtgtagtgtgt

SEQ ID NO: 2180815 - DNA, 12 bp, Homo sapiens
tttgtattctct

SEQ ID NO: 2180816 - DNA, 20 bp, Homo sapiens
tttgtctgatattggtgtga

SEQ ID NO: 2180817 - DNA, 15 bp, Homo sapiens
tttgtcttctcccca

SEQ ID NO: 2180818 - DNA, 15 bp, Homo sapiens
tttgtgagtatgtgt

SEQ ID NO: 2180819 - DNA, 14 bp, Homo sapiens
tttgtggttgcatg

SEQ ID NO: 2180820 - DNA, 18 bp, Homo sapiens
tttgtgtacagtatgtgt

SEQ ID NO: 2180821 - DNA, 14 bp, Homo sapiens
tttgttaagaattt

SEQ ID NO: 2180822 - DNA, 19 bp, Homo sapiens
tttgttaagaatttcaata

SEQ ID NO: 2180823 - DNA, 20 bp, Homo sapiens
tttgttccaacagttaaact

SEQ ID NO: 2180824 - DNA, 15 bp, Homo sapiens
tttgttgttaatatg

SEQ ID NO: 2180825 - DNA, 16 bp, Homo sapiens
tttgttttttagcata

SEQ ID NO: 2180826 - DNA, 21 bp, Homo sapiens
ttttaacctcaggttccaaat

SEQ ID NO: 2180827 - DNA, 12 bp, Homo sapiens
ttttaacttgaa

SEQ ID NO: 2180828 - DNA, 19 bp, Homo sapiens
ttttaagtcaaatgcattt

SEQ ID NO: 2180829 - DNA, 22 bp, Homo sapiens
ttttaagtcctctaaacacact

SEQ ID NO: 2180830 - DNA, 16 bp, Homo sapiens
ttttacggaattccaa

SEQ ID NO: 2180831 - DNA, 19 bp, Homo sapiens
ttttacggtgatattgtgc

SEQ ID NO: 2180832 - DNA, 14 bp, Homo sapiens
ttttagaattaaaa

SEQ ID NO: 2180833 - DNA, 22 bp, Homo sapiens
ttttagcataagccagaatatt

SEQ ID NO: 2180834 - DNA, 23 bp, Homo sapiens
ttttagggagaagggcttttctt

SEQ ID NO: 2180835 - DNA, 21 bp, Homo sapiens
ttttagtacccacctgagctt

SEQ ID NO: 2180836 - DNA, 16 bp, Homo sapiens
ttttatttttatccca

SEQ ID NO: 2180837 - DNA, 22 bp, Homo sapiens
ttttcatccctgccaagaactc

SEQ ID NO: 2180838 - DNA, 23 bp, Homo sapiens
ttttcatccctgccaagaactct

SEQ ID NO: 2180839 - DNA, 17 bp, Homo sapiens
ttttctagttgtaatgt

SEQ ID NO: 2180840 - DNA, 16 bp, Homo sapiens
ttttctatgaaagcta

SEQ ID NO: 2180841 - DNA, 16 bp, Homo sapiens
ttttctgaacaaaagc

SEQ ID NO: 2180842 - DNA, 22 bp, Homo sapiens
ttttctggtaggttctgtctgt

SEQ ID NO: 2180843 - DNA, 18 bp, Homo sapiens
ttttgaactcacgagcct

SEQ ID NO: 2180844 - DNA, 19 bp, Homo sapiens
ttttgcacgaattttaaaa

SEQ ID NO: 2180845 - DNA, 22 bp, Homo sapiens
ttttggggaactgttgtttgat

SEQ ID NO: 2180846 - DNA, 17 bp, Homo sapiens
ttttggttttgtttctg

SEQ ID NO: 2180847 - DNA, 14 bp, Homo sapiens
ttttgtactgtgct

SEQ ID NO: 2180848 - DNA, 17 bp, Homo sapiens
ttttgtgtacagtatgt

SEQ ID NO: 2180849 - DNA, 18 bp, Homo sapiens
ttttgtgtacagtatgtg

SEQ ID NO: 2180850 - DNA, 19 bp, Homo sapiens
ttttgtgtacagtatgtgt

SEQ ID NO: 2180851 - DNA, 14 bp, Homo sapiens
tttttaacttgaaa

SEQ ID NO: 2180852 - DNA, 22 bp, Homo sapiens
tttttaacttgaaaagattgca

SEQ ID NO: 2180853 - DNA, 12 bp, Homo sapiens
tttttacagtgt

SEQ ID NO: 2180854 - DNA, 14 bp, Homo sapiens
tttttacagtgtat

SEQ ID NO: 2180855 - DNA, 16 bp, Homo sapiens
tttttacggaattcca

SEQ ID NO: 2180856 - DNA, 17 bp, Homo sapiens
tttttacggaattccaa

SEQ ID NO: 2180857 - DNA, 19 bp, Homo sapiens
tttttccaaaaacaaagtg

SEQ ID NO: 2180858 - DNA, 22 bp, Homo sapiens
tttttccttgtccccacactcc

SEQ ID NO: 2180859 - DNA, 21 bp, Homo sapiens
tttttggggggttttcttgcc

SEQ ID NO: 2180860 - DNA, 20 bp, Homo sapiens
tttttggtttcttattcaaa

SEQ ID NO: 2180861 - DNA, 13 bp, Homo sapiens
tttttgtctcgaa

SEQ ID NO: 2180862 - DNA, 13 bp, Homo sapiens
ttttttaacttga

SEQ ID NO: 2180863 - DNA, 14 bp, Homo sapiens
ttttttaacttgaa

SEQ ID NO: 2180864 - DNA, 19 bp, Homo sapiens
ttttttacggaattccaat

SEQ ID NO: 2180865 - DNA, 23 bp, Homo sapiens
ttttttcatccctgccaagaact

SEQ ID NO: 2180866 - DNA, 20 bp, Homo sapiens
ttttttggaaagcacaaact

SEQ ID NO: 2180867 - DNA, 19 bp, Homo sapiens
tttttttacggaattccaa

SEQ ID NO: 2180868 - DNA, 11 bp, Homo sapiens
aaaaaaaagaa

SEQ ID NO: 2180869 - DNA, 18 bp, Homo sapiens
aaaaaagaataatgaccc

SEQ ID NO: 2180870 - DNA, 14 bp, Homo sapiens
aaaaacatgtcatg

SEQ ID NO: 2180871 - DNA, 15 bp, Homo sapiens
aaaaacatgtcatgt

SEQ ID NO: 2180872 - DNA, 12 bp, Homo sapiens
aaaaagattttt

SEQ ID NO: 2180873 - DNA, 22 bp, Homo sapiens
aaaaaggtgtgtcaaagatttt

SEQ ID NO: 2180874 - DNA, 17 bp, Homo sapiens
aaaaataaaatgcattt

SEQ ID NO: 2180875 - DNA, 11 bp, Homo sapiens
aaaaatataaa

SEQ ID NO: 2180876 - DNA, 14 bp, Homo sapiens
aaaaatcctgtcat

SEQ ID NO: 2180877 - DNA, 20 bp, Homo sapiens
aaaaatgtataatgactttt

SEQ ID NO: 2180878 - DNA, 23 bp, Homo sapiens
aaaaattaattctttatcacatg

SEQ ID NO: 2180879 - DNA, 13 bp, Homo sapiens
aaaaatttattat

SEQ ID NO: 2180880 - DNA, 19 bp, Homo sapiens
aaaaatttgcatgcaaaat

SEQ ID NO: 2180881 - DNA, 15 bp, Homo sapiens
aaaacaaagtgcaaa

SEQ ID NO: 2180882 - DNA, 17 bp, Homo sapiens
aaaacaaagtgcaaagc

SEQ ID NO: 2180883 - DNA, 18 bp, Homo sapiens
aaaacaaagtgcaaagct

SEQ ID NO: 2180884 - DNA, 22 bp, Homo sapiens
aaaacaaagtgcaaagctgctt

SEQ ID NO: 2180885 - DNA, 13 bp, Homo sapiens
aaaacaatctgta

SEQ ID NO: 2180886 - DNA, 16 bp, Homo sapiens
aaaacacctaagtgac

SEQ ID NO: 2180887 - DNA, 19 bp, Homo sapiens
aaaacatggcaataaatgg

SEQ ID NO: 2180888 - DNA, 20 bp, Homo sapiens
aaaacatggcaataaatggc

SEQ ID NO: 2180889 - DNA, 14 bp, Homo sapiens
aaaacccagcatgt

SEQ ID NO: 2180890 - DNA, 14 bp, Homo sapiens
aaaacctttattct

SEQ ID NO: 2180891 - DNA, 16 bp, Homo sapiens
aaaacctttattcttt

SEQ ID NO: 2180892 - DNA, 23 bp, Homo sapiens
aaaacgtgagctacatgtgtaag

SEQ ID NO: 2180893 - DNA, 21 bp, Homo sapiens
aaaactaaactacagaaacct

SEQ ID NO: 2180894 - DNA, 19 bp, Homo sapiens
aaaactaaagcagttttta

SEQ ID NO: 2180895 - DNA, 22 bp, Homo sapiens
aaaactctccttttccttacca

SEQ ID NO: 2180896 - DNA, 21 bp, Homo sapiens
aaaacttcgtaagaacatgtt

SEQ ID NO: 2180897 - DNA, 13 bp, Homo sapiens
aaaagacatttaa

SEQ ID NO: 2180898 - DNA, 14 bp, Homo sapiens
aaaagattgcaaag

SEQ ID NO: 2180899 - DNA, 15 bp, Homo sapiens
aaaagcaggttttta

SEQ ID NO: 2180900 - DNA, 15 bp, Homo sapiens
aaaaggcactgcaca

SEQ ID NO: 2180901 - DNA, 14 bp, Homo sapiens
aaaagtcattcaag

SEQ ID NO: 2180902 - DNA, 16 bp, Homo sapiens
aaaagtgtatagaata

SEQ ID NO: 2180903 - DNA, 22 bp, Homo sapiens
aaaagttgataggagacttgta

SEQ ID NO: 2180904 - DNA, 22 bp, Homo sapiens
aaaagttgcaaagtggaattaa

SEQ ID NO: 2180905 - DNA, 22 bp, Homo sapiens
aaaataaaaccaccaaagtcct

SEQ ID NO: 2180906 - DNA, 17 bp, Homo sapiens
aaaataaaatgcattta

SEQ ID NO: 2180907 - DNA, 20 bp, Homo sapiens
aaaataattatataactgta

SEQ ID NO: 2180908 - DNA, 21 bp, Homo sapiens
aaaataatttatcaaaaaaca

SEQ ID NO: 2180909 - DNA, 16 bp, Homo sapiens
aaaatatcactttgta

SEQ ID NO: 2180910 - DNA, 17 bp, Homo sapiens
aaaatatcactttgtat

SEQ ID NO: 2180911 - DNA, 13 bp, Homo sapiens
aaaatatctgaat

SEQ ID NO: 2180912 - DNA, 15 bp, Homo sapiens
aaaatcacaaactca

SEQ ID NO: 2180913 - DNA, 18 bp, Homo sapiens
aaaatcagtgatgggagt

SEQ ID NO: 2180914 - DNA, 17 bp, Homo sapiens
aaaatcatgcttataag

SEQ ID NO: 2180915 - DNA, 23 bp, Homo sapiens
aaaatgcatttaaactcatttga

SEQ ID NO: 2180916 - DNA, 18 bp, Homo sapiens
aaaattagaacttgaata

SEQ ID NO: 2180917 - DNA, 15 bp, Homo sapiens
aaaattcattccatt

SEQ ID NO: 2180918 - DNA, 16 bp, Homo sapiens
aaaattcattccattt

SEQ ID NO: 2180919 - DNA, 21 bp, Homo sapiens
aaaattgtataaattactttg

SEQ ID NO: 2180920 - DNA, 13 bp, Homo sapiens
aaaatttattatt

SEQ ID NO: 2180921 - DNA, 20 bp, Homo sapiens
aaaatttattctacttttaa

SEQ ID NO: 2180922 - DNA, 15 bp, Homo sapiens
aaaatttgtagaatt

SEQ ID NO: 2180923 - DNA, 23 bp, Homo sapiens
aaacaaaaattcacaagctgcct

SEQ ID NO: 2180924 - DNA, 16 bp, Homo sapiens
aaacaaaaccaagcct

SEQ ID NO: 2180925 - DNA, 19 bp, Homo sapiens
aaacaaaaccaagccttgg

SEQ ID NO: 2180926 - DNA, 14 bp, Homo sapiens
aaacaaagtgcaaa

SEQ ID NO: 2180927 - DNA, 17 bp, Homo sapiens
aaacaaccatgtcattt

SEQ ID NO: 2180928 - DNA, 14 bp, Homo sapiens
aaacaatctgtaat

SEQ ID NO: 2180929 - DNA, 20 bp, Homo sapiens
aaacaattcaatcaaagcta

SEQ ID NO: 2180930 - DNA, 15 bp, Homo sapiens
aaacaccatcttcag

SEQ ID NO: 2180931 - DNA, 13 bp, Homo sapiens
aaacactgtctgc

SEQ ID NO: 2180932 - DNA, 19 bp, Homo sapiens
aaacagagaaaagcttgga

SEQ ID NO: 2180933 - DNA, 11 bp, Homo sapiens
aaacagctcag

SEQ ID NO: 2180934 - DNA, 18 bp, Homo sapiens
aaacagttgaataatttg

SEQ ID NO: 2180935 - DNA, 23 bp, Homo sapiens
aaacatggccacatccaacattt

SEQ ID NO: 2180936 - DNA, 16 bp, Homo sapiens
aaaccactgtacatat

SEQ ID NO: 2180937 - DNA, 14 bp, Homo sapiens
aaacccaagttttt

SEQ ID NO: 2180938 - DNA, 13 bp, Homo sapiens
aaacccttctctt

SEQ ID NO: 2180939 - DNA, 18 bp, Homo sapiens
aaaccgtgattcttgaaa

SEQ ID NO: 2180940 - DNA, 19 bp, Homo sapiens
aaacctctaacccaggtct

SEQ ID NO: 2180941 - DNA, 16 bp, Homo sapiens
aaacctctccttcctc

SEQ ID NO: 2180942 - DNA, 12 bp, Homo sapiens
aaacctggaggg

SEQ ID NO: 2180943 - DNA, 13 bp, Homo sapiens
aaacctttccatt

SEQ ID NO: 2180944 - DNA, 21 bp, Homo sapiens
aaactactatttttctttcca

SEQ ID NO: 2180945 - DNA, 22 bp, Homo sapiens
aaactcaaccatgtcatctttt

SEQ ID NO: 2180946 - DNA, 18 bp, Homo sapiens
aaactgcgtaggagagaa

SEQ ID NO: 2180947 - DNA, 21 bp, Homo sapiens
aaacttaaatgttattatctg

SEQ ID NO: 2180948 - DNA, 16 bp, Homo sapiens
aaacttccaagacctg

SEQ ID NO: 2180949 - DNA, 15 bp, Homo sapiens
aaacttggttcccag

SEQ ID NO: 2180950 - DNA, 16 bp, Homo sapiens
aaacttggttcccaga

SEQ ID NO: 2180951 - DNA, 22 bp, Homo sapiens
aaactttggagaactcatttca

SEQ ID NO: 2180952 - DNA, 22 bp, Homo sapiens
aaactttttgaccagtttcttt

SEQ ID NO: 2180953 - DNA, 15 bp, Homo sapiens
aaagaaaattgccaa

SEQ ID NO: 2180954 - DNA, 16 bp, Homo sapiens
aaagaaaattgccaaa

SEQ ID NO: 2180955 - DNA, 19 bp, Homo sapiens
aaagaaattccctggacca

SEQ ID NO: 2180956 - DNA, 14 bp, Homo sapiens
aaagaagcaagaca

SEQ ID NO: 2180957 - DNA, 17 bp, Homo sapiens
aaagaccaatgtgaaga

SEQ ID NO: 2180958 - DNA, 15 bp, Homo sapiens
aaagagctgcctgga

SEQ ID NO: 2180959 - DNA, 19 bp, Homo sapiens
aaagagctgcctggatgag

SEQ ID NO: 2180960 - DNA, 24 bp, Homo sapiens
aaagaggtgactgggccctgcctc

SEQ ID NO: 2180961 - DNA, 14 bp, Homo sapiens
aaagattgtgtctg

SEQ ID NO: 2180962 - DNA, 16 bp, Homo sapiens
aaagatttttaaaatg

SEQ ID NO: 2180963 - DNA, 22 bp, Homo sapiens
aaagcagaacagttaagcagcc

SEQ ID NO: 2180964 - DNA, 23 bp, Homo sapiens
aaagcagaggctggcctcagact

SEQ ID NO: 2180965 - DNA, 13 bp, Homo sapiens
aaagcaggttttt

SEQ ID NO: 2180966 - DNA, 15 bp, Homo sapiens
aaagcaggtttttat

SEQ ID NO: 2180967 - DNA, 13 bp, Homo sapiens
aaagctacctttt

SEQ ID NO: 2180968 - DNA, 15 bp, Homo sapiens
aaagctatgaatgtt

SEQ ID NO: 2180969 - DNA, 19 bp, Homo sapiens
aaagctatgaatgttacta

SEQ ID NO: 2180970 - DNA, 14 bp, Homo sapiens
aaaggaaacctctg

SEQ ID NO: 2180971 - DNA, 22 bp, Homo sapiens
aaaggaagctttctctgcttca

SEQ ID NO: 2180972 - DNA, 21 bp, Homo sapiens
aaaggagcttacctcccacct

SEQ ID NO: 2180973 - DNA, 19 bp, Homo sapiens
aaaggcagtggggctgggg

SEQ ID NO: 2180974 - DNA, 23 bp, Homo sapiens
aaagggccccatgagggtgtttt

SEQ ID NO: 2180975 - DNA, 16 bp, Homo sapiens
aaagtaaaaggcactg

SEQ ID NO: 2180976 - DNA, 14 bp, Homo sapiens
aaagtaaagtacaa

SEQ ID NO: 2180977 - DNA, 17 bp, Homo sapiens
aaagtcacacatttcta

SEQ ID NO: 2180978 - DNA, 15 bp, Homo sapiens
aaagtcatgaagctc

SEQ ID NO: 2180979 - DNA, 23 bp, Homo sapiens
aaagtcatgaagctcagtttggc

SEQ ID NO: 2180980 - DNA, 18 bp, Homo sapiens
aaagtgcaaagtgccctc

SEQ ID NO: 2180981 - DNA, 22 bp, Homo sapiens
aaagtgctctatttattaagaa

SEQ ID NO: 2180982 - DNA, 21 bp, Homo sapiens
aaagttgataggagacttgta

SEQ ID NO: 2180983 - DNA, 17 bp, Homo sapiens
aaagtttaagcaattca

SEQ ID NO: 2180984 - DNA, 11 bp, Homo sapiens
aaataaagcct
